United States Patent 9,932,637 (GENETIC POLYMORPHISMS ASSOCIATED WITH CARDIOVASCULAR DISORDERS AND DRUG RESPONSE, METHODS OF DETECTION AND USES THEREOF) - sequence listing, part 9

SEQ ID NO: 15224 - DNA, 201 bp, Homo sapiens
taaaatgtgaattcactcttttgtgaggtttatctccaaaaaaggcaatattcacatatttgcaaagcatttagtactataacttcttgaatgtctgagcrgtcctgacattagggtgggatccatcagggcccaagatgagtgtttcatctttgttacttgtggcaaagcagcccttacttcttttactttgtagcattg

SEQ ID NO: 15225 - DNA, 201 bp, Homo sapiens
tacttgtttttcatgttctgtatctaaattaagtcagtgtagtggttttgtaccctctttgttcataagaatcacttttcaaactttaaaaaaaatgtagrtaaccaacacccaactctgaaaattctgatttaacaggcctgggttggcacctggcattggtggtttctcacaggtgattctgatatatagcccgggttg

SEQ ID NO: 15226 - DNA, 201 bp, Homo sapiens
atgaaatatatacaggcatactttgttttattgtgcctggctttattgtgacttgcagatattgcatttcttataaattgaaggtttgtggcaaccctgcrtcaaacaggtcatattagccccattttccaatagcatgttctgttgtcatgtctttgtgttatattttggtagttcttgactggccattcaccatttctc

SEQ ID NO: 15227 - DNA, 201 bp, Homo sapiens
atatttaaagttaaacctatggatggacactggatttcacttctgttaaagtttatttcaaacattacttcctccaggaaatctctgactctctaacttgstgtttcacctatcttatcccatgatactctataattccttttgctatagaaattaggctctgttatcataattacctgtttatatatctgttttcttctg

SEQ ID NO: 15228 - DNA, 201 bp, Homo sapiens
cttcctgtttttttttttttcttttttcttttgtttgtttttacagaggtaaataccggattgtatacgtaactccagaatactgttcaggtaacatgggyctgctccagcaacttgaggctgatattggtaagtgataaagaaagatctctgtaaatacttactgagttaatatttaaagttaaacctatggatggacac

SEQ ID NO: 15229 - DNA, 201 bp, Homo sapiens
ccattttggtcaactcaaagcaagtacaccatgggacacagatctgaaataatgtccagatttttacttactgaatgaggtgtgttgagtgtataagactrcatgatgagatggcaagtaattgcctgaagaaatgatgtagtgattttgtgtgtcttatatttatttactttttgatccagaaataaattatatagatac

SEQ ID NO: 15230 - DNA, 201 bp, Homo sapiens
tagtgagtcttcctcatttttctctctgaagagataagcattctctgcatatatatagcattcttttagattttcgtgacataaagtattatttaaacttycataaggtatcttgattttaagttgtaattccttgagatgattgttttctttattgttaatatgtttcccttcctgtttttttttttttcttttttcttt

SEQ ID NO: 15231 - DNA, 201 bp, Homo sapiens
aagaaacttttatttttttcatttatttagcgaatgtttgttaagcgtactatgccttggccactctacagggtgctgattggaccagtctgtctacctaycgttgtagatgttagaagctatattcttttcacatgcctaatataactctttgtgtatgtatacatgcccaggcatgttccttcctcagaacattaaatt

SEQ ID NO: 15232 - DNA, 201 bp, Homo sapiens
gcaagctccgcctcccgggttcacaccattatcctgcctcagcctcccgagtagctgggactaccggcgcccgccaccccacctggctaatttttttttttatttttagtagagacggggtttcaccgtgttagccaggatcgtctcgatctccggacctcgtgatctgcccgcctcagcctcccaaagtgctgggattac

SEQ ID NO: 15233 - DNA, 201 bp, Homo sapiens
tctttggcacgtgagctgctgaaatgtgtgtgaaagtgttgtgcacgtgtatgttcctctttttttctgggaagtggatctgtagtgattcttagatgagkctatgagacaagaaacttttatttttttcatttatttagcgaatgtttgttaagcgtactatgccttggccactctacagggtgctgattggaccagtct

SEQ ID NO: 15234 - DNA, 201 bp, Homo sapiens
agaatttgtgttggtaatttttaatgcaacttggacaatttctgaaagatgtaactttcttttttttgagacgagtctcgctttgttgcccaggctggagkgcagtgacatgatctcaggtcactgcaagctccgcctcccgggttcacaccattatcctgcctcagcctcccgagtagctgggactaccggcgcccgcca

SEQ ID NO: 15235 - DNA, 201 bp, Homo sapiens
gaggctctttggcacgtgagctgctgaaatgtgtgtgaaagtgttgtgcacgtgtatgttcctctttttttctgggaagtggatctgtagtgattcttagrtgagtctatgagacaagaaacttttatttttttcatttatttagcgaatgtttgttaagcgtactatgccttggccactctacagggtgctgattggacc

SEQ ID NO: 15236 - DNA, 201 bp, Homo sapiens
tttcaccatgttagccaggttggtctcgatctcctgacctcgtgatccacccgcctcggcctcccaaagtgctgggattacaggtgtgagccaccgcgccyggcccaagagtaaccttttcaaaagcagctttgctctactgatttgggtaaaagcttagttgcagttggtttgggaggaaatgggagcagaaaatttgag

SEQ ID NO: 15237 - DNA, 201 bp, Homo sapiens
taaattatttttttttcaaggatgtttaacctgagggttagaggctctttggcacgtgagctgctgaaatgtgtgtgaaagtgttgtgcacgtgtatgttyctctttttttctgggaagtggatctgtagtgattcttagatgagtctatgagacaagaaacttttatttttttcatttatttagcgaatgtttgttaagc

SEQ ID NO: 15238 - DNA, 201 bp, Homo sapiens
tttaatctgggaggtggaggttgtagtgagctgagattgcaccattgcactccagcctgcacaagagcgagactctgtctcagaaaaaaaaaaaaaaaaaagttagctagctgaagagtataggaaagaatgggtacaggaaattacaggtgccaagttacagaggtgagagaaattatggtatctataggtaattgaaag

SEQ ID NO: 15239 - DNA, 201 bp, Homo sapiens
acccagccttaaattatttttttttcaaggatgtttaacctgagggttagaggctctttggcacgtgagctgctgaaatgtgtgtgaaagtgttgtgcacrtgtatgttcctctttttttctgggaagtggatctgtagtgattcttagatgagtctatgagacaagaaacttttatttttttcatttatttagcgaatgt

SEQ ID NO: 15240 - DNA, 201 bp, Homo sapiens
ctttaatctgggaggtggaggttgtagtgagctgagattgcaccattgcactccagcctgcacaagagcgagactctgtctcagaaaaaaaaaaaaaaaaaagttagctagctgaagagtataggaaagaatgggtacaggaaattacaggtgccaagttacagaggtgagagaaattatggtatctataggtaattgaaa

SEQ ID NO: 15241 - DNA, 201 bp, Homo sapiens
gtgtgtgtttttgagacagggtcttactctgctcaggctggagtgcagtggcgtgattatagctcactacagccttgacctcctgggctccagtgatcctrccaaagtgttgggattgcaggcgtgagccacctcacccagccttaaattatttttttttcaaggatgtttaacctgagggttagaggctctttggcacgt

SEQ ID NO: 15242 - DNA, 201 bp, Homo sapiens
ctgtgcaaaggtttgctataaataaaggtatgttaagatccataaataaaatgtgaattcactcttttgtgaggtttatctccaaaaaaggcaatattcayatatttgcaaagcatttagtactataacttcttgaatgtctgagcagtcctgacattagggtgggatccatcagggcccaagatgagtgtttcatctttg

SEQ ID NO: 15243 - DNA, 201 bp, Homo sapiens
gcagatggtattgtacccaaacactacctttgtgtgtgtgtgtgtgtgcgcctgtgtgtgtgtttttgagacagggtcttactctgctcaggctggagtgyagtggcgtgattatagctcactacagccttgacctcctgggctccagtgatcctgccaaagtgttgggattgcaggcgtgagccacctcacccagcctta

SEQ ID NO: 15244 - DNA, 201 bp, Homo sapiens
ttctttttttctttttgagacagagtcttgctctgtcgcccaggctggagtgcagtggtgcaatcttggctcactgaaacctctgcctcctgggttcaagygattctcctgcctcagcctcccgagtagctggcactacaggcgtgccaccacacccagctaattttttgtattttttttagtagagacgaggtttcaccg

SEQ ID NO: 15245 - DNA, 201 bp, Homo sapiens
cttaaattatttaattttttttcatgtgcagatggtattgtacccaaacactacctttgtgtgtgtgtgtgtgtgcgcctgtgtgtgtgtttttgagacasggtcttactctgctcaggctggagtgcagtggcgtgattatagctcactacagccttgacctcctgggctccagtgatcctgccaaagtgttgggattgc

SEQ ID NO: 15246 - DNA, 201 bp, Homo sapiens
atagtacttaataattttatgtctgaaaatattatataatgttattttgcccatttaaaaactttaaaaaatgctaacaaactgtgtactctgtaacttgwcttttttactcaacactacgtttttgagaatttttcttgttgatctgtgtagttccattttaactgttatatcttactatgtttcattatgcaacagttg

SEQ ID NO: 15247 - DNA, 201 bp, Homo sapiens
ctttgaggaattgctacacagttttccacaatggaaagcctttagttctaatccatgtcttggcatagagtttcttttctttttttttttttttttgaggkggagtttcgctcttgttgcccaggctggagtggaatggtgtgatctcagctcactgcaacctccacctcctgggtttaagtggttctcctgcctcaggct

SEQ ID NO: 15248 - DNA, 201 bp, Homo sapiens
acagacaccttgtaccttagataaggccaaccttctcataaaatccctcagttacttttattaataataaccaaattaactctggattccagggtgtactyatgatggaatgatttctctgtcatgttatcctgaggatctagtactctgagataacataagtgtatgacactttaggcttatgaaacacttagctactta

SEQ ID NO: 15249 - DNA, 201 bp, Homo sapiens
ataattctcatggttctagtctcgagctgtaggattttgatcactgtttcaaacaataatgtgagtttgctaagaggtctaaataacaaaagctaagtgttccaaacacatatccaaacctatacactgggcaatgcatctgaattatatgtgaaatttcctgccattatttaagacacaaaaggaacattattttgataa

SEQ ID NO: 15250 - DNA, 201 bp, Homo sapiens
ttcattgtcagttgtatgtgctccagataacttgaacagtctgtggttgccttttaatttttgaattatgtctttagttatgcagaagtttaaaattttarcataaattaatttacactatttttctcactttagcatgagtctatcagatggggatgtggtgggatttgacatggagtggccaccattatacaatagagg

SEQ ID NO: 15251 - DNA, 201 bp, Homo sapiens
ggtatgactatggaattgagtggctaaggtctgttgaagaaaagattgtcggaaatgcaggggtcaaggaactggcctgtggatgttgaagtcactggcastgatcaaggaatagtagtggagtgaaagtagttaatgaatcaggcactaagatctccaagggatgaaaggatgcagtttggagatgacaagataactgta

SEQ ID NO: 15252 - DNA, 201 bp, Homo sapiens
tccatgtcaggttggtatctctacatttcatttttatatggctgataattgtaatatgtcaactttatccctataaaattaagttcttttattagctggcygttctctcattatctcaaatttatttaagtatttatgttctacctgattcactcacattccttgttttatttaattttcacaacatacctgtgaggcatt

SEQ ID NO: 15253 - DNA, 201 bp, Homo sapiens
taaacagtattattaagtagcagcatacatggtgttatactgacttctgattttgcaatagtacagacaggttcagattctcatttccaccttctccttcygcctaggtgaataactgctgggttatagtacagatgactgcagatcatttggaatttactttaaatgtaaacagtaaaaatttgaaagagagggaaagtg

SEQ ID NO: 15254 - DNA, 201 bp, Homo sapiens
tagagacggggtttcaccatgttagccatgatggtctcaatctcctgacctcgtgatctgcctgccttggcctcccaaagtgctaggattacaggcatgcygcattgcgttttatataattctcatggttctagtctcgagctgtaggattttgatcactgtttcaaacaataatgtgagtttgctaagaggtctaaataa

SEQ ID NO: 15255 - DNA, 201 bp, Homo sapiens
ctgggattacaggcgttagccaccgcgcccagcctgaaagatgaactttaaaatggggaaggatactagtaaagccatttcttactcatgtatacattttyccctccatgaaattagagcagccaccttttacatgacttttacatgcatttcagatttttgtactagcaattaaaatatctactggatgtaaatcacatg

SEQ ID NO: 15256 - DNA, 201 bp, Homo sapiens
tttttgtatttttagtagagacggggtttcaccatgttagccatgatggtctcaatctcctgacctcgtgatctgcctgccttggcctcccaaagtgctargattacaggcatgccgcattgcgttttatataattctcatggttctagtctcgagctgtaggattttgatcactgtttcaaacaataatgtgagtttgct

SEQ ID NO: 15257 - DNA, 201 bp, Homo sapiens
tacatattttctggctgttcattgtcagttgtatgtgctccagataacttgaacagtctgtggttgccttttaatttttgaattatgtctttagttatgcrgaagtttaaaattttaacataaattaatttacactatttttctcactttagcatgagtctatcagatggggatgtggtgggatttgacatggagtggcca

SEQ ID NO: 15258 - DNA, 201 bp, Homo sapiens
tgtatattgaaatttatattaaggataaaggaatgtctcatagatcccactcaaaagaaattagccagcccttaggaagagactggaattgggtttggaaratacaataggtctttctttttatctgtagtctttagtgagtcttcctcatttttctctctgaagagataagcattctctgcatatatatagcattctttt

SEQ ID NO: 15259 - DNA, 201 bp, Homo sapiens
ttacatattttctggctgttcattgtcagttgtatgtgctccagataacttgaacagtctgtggttgccttttaatttttgaattatgtctttagttatgyagaagtttaaaattttaacataaattaatttacactatttttctcactttagcatgagtctatcagatggggatgtggtgggatttgacatggagtggcc

SEQ ID NO: 15260 - DNA, 201 bp, Homo sapiens
aataatttgtcttttcttacttatttttcaagaaattttacatattttctggctgttcattgtcagttgtatgtgctccagataacttgaacagtctgtgrttgccttttaatttttgaattatgtctttagttatgcagaagtttaaaattttaacataaattaatttacactatttttctcactttagcatgagtctat

SEQ ID NO: 15261 - DNA, 201 bp, Homo sapiens
tttcatttcatagaatggagagcagactctgtaaatattttgccccagacctagccttattacaaacattgtcttaattaggattctgtctacccagaatrgaaattaactcaagctagcatgagtgtatattgaaatttatattaaggataaaggaatgtctcatagatcccactcaaaagaaattagccagcccttagg

SEQ ID NO: 15262 - DNA, 201 bp, Homo sapiens
attatcagcatgctggatctcattgacctttttagaacattctacccaacaacagtagagtacacattcaagtgcagatgcagtattcatgaacatggatyatattcagagtcataaaacaaaccttaacaaatttaagaatcttgtatttgtatattttttgactagaatggaattaaactagaaaacaataacagaaag

SEQ ID NO: 15263 - DNA, 201 bp, Homo sapiens
tgcatattcttaaacatgtctgtacacatctgagggtttcatttatttgtgacaaaacttgccaggtcatagtgtttatgcaccttcaactagatattgtygttgtcaaagtttttttccaaaaggattttaccaatttatacatgaaccaccgatagatatcctcttaacacgtggtattctgaaacttaatttttacca

SEQ ID NO: 15264 - DNA, 201 bp, Homo sapiens
tggtagagacagtctcagtatgttgcccaggctggttttcaaactccttgcctcaatcagtcctcctacttcagcctcctaaagtgctgggattataggcmtgagccatcacgcttgactaatgtttttgtaaataaagttttctcagaacacagccatgccttttgtttatgtgttatgtagggctgcctgagttaagta

SEQ ID NO: 15265 - DNA, 201 bp, Homo sapiens
cccagattcacgccatcctcctgcctcagcctcccgagcagctgggaccacaggtgcccgccacaacacctggctaattttttgtatttttagtagagacrgggtttcaccatgttagccatgatggtctcaatctcctgacctcgtgatctgcctgccttggcctcccaaagtgctaggattacaggcatgccgcattgc

SEQ ID NO: 15266 - DNA, 201 bp, Homo sapiens
gctgtttgacatcagagcttattctttataccatttcctatgttaattagaatacaatattaatttcataaaggtaaaggcatatctgttttgttcctatytgattccttgtgaaagcacaatgcctagcgcacaatagacacttaaacttatctgttgaatggacaggtgaatgcttttaaagtctttccatatagaaaa

SEQ ID NO: 15267 - DNA, 201 bp, Homo sapiens
ttttcttgttgatctgtgtagttccattttaactgttatatcttactatgtttcattatgcaacagttggttcaatccattctcttgttaatggaaatttmgtttgtttctaatttttgccagtaggaacagtgttgcaatgcatattcttaaacatgtctgtacacatctgagggtttcatttatttgtgacaaaacttg

SEQ ID NO: 15268 - DNA, 201 bp, Homo sapiens
accaagggttaagaagttgacaaacttgttcaagagcatacagctaatggccgagctggctttcaagtctatatttgtctacctctagcatcaagacactrtttatttttctttgtatgaaatatatacaggcatactttgttttattgtgcctggctttattgtgacttgcagatattgcatttcttataaattgaaggt

SEQ ID NO: 15269 - DNA, 201 bp, Homo sapiens
accacgtttgagagattcttattcactgtattttctttaattatacttgaattttggtttacattgaggagtgccctcaaagatattaacagatttttaaraaatcctctaaaaaactcattcttagggaaatttgttcacttactaggtgaggagcaaaataaaaatccttaatatagaagagctattatctgtcttcaa

SEQ ID NO: 15270 - DNA, 201 bp, Homo sapiens
caaactgtgtactctgtaacttgtcttttttactcaacactacgtttttgagaatttttcttgttgatctgtgtagttccattttaactgttatatcttaytatgtttcattatgcaacagttggttcaatccattctcttgttaatggaaatttagtttgtttctaatttttgccagtaggaacagtgttgcaatgcata

SEQ ID NO: 15271 - DNA, 201 bp, Homo sapiens
taaacctggaaatcaggtagcgcaaggcctcttgctttgctcttttctttcaaagttgttctggctattctatgtcctttgtatttctgtgagcatgtcascatcaccttttcaacccatatgcctgctgggattttgaatgagtttaccttgaatctagatatcgaaacaattagctgtcttgatagttattgtcaccgt

SEQ ID NO: 15272 - DNA, 201 bp, Homo sapiens
atgaacaatatctagatagtcttcattattgaaatggaataaatggtatttttgtattttaggctaacagacaccttgtaccttagataaggccaaccttstcataaaatccctcagttacttttattaataataaccaaattaactctggattccagggtgtactcatgatggaatgatttctctgtcatgttatcctga

SEQ ID NO: 15273 - DNA, 201 bp, Homo sapiens
ccatctgtatatcttctttgagggagtatctgttcaaatcttttgcctattttttcttagtgagttttgatagtcatttctatattctgaatataaattayttatttgatatatgctttgcaaacattttctcctagtttatggcttttcatactttccacacagttcttttgaagagcagcagtttttcattttgataaa

SEQ ID NO: 15274 - DNA, 201 bp, Homo sapiens
gttagatggtacgttttattaaaatcaaatgcttcaaaaataattgctctgtgtatggcatgagataaatagcaatcagatatattgtttaataatatgaytctattaaatgatggcataaatttgaaaatttgaccttcggtatcttccgggtctaaaattatatgactccattataaatattttggaaatgattaacta

SEQ ID NO: 15275 - DNA, 201 bp, Homo sapiens
catttcgtagtgcttttgcatgatgagagaaagattacaaatttagtattatgttagatggtacgttttattaaaatcaaatgcttcaaaaataattgctytgtgtatggcatgagataaatagcaatcagatatattgtttaataatatgactctattaaatgatggcataaatttgaaaatttgaccttcggtatcttc

SEQ ID NO: 15276 - DNA, 201 bp, Homo sapiens
ctctgttttaattctgtttttttttttttttaatgttacttgttttagtttggattcctagttgaaaagggaatatgattcctttaaaacaaagatactcygctttaaagcaaaggtatatcatcctcttcatggtgattgccatggaaacaagacaatgtaaatttattcaaatagtacacagtttttatagttattgat

SEQ ID NO: 15277 - DNA, 201 bp, Homo sapiens
ttattatgtagaatgtcagcttaaattttacctgtacctcatattgaccgtatagcctggaaaatctttcggaggtatagttaatggatttaagcatatgrcagtttatgtagttaatgaaagtgaaaacaaattgtattataaatacctcccaaactggtttattatcattctatcattcttcatgctctgttagtatga

SEQ ID NO: 15278 - DNA, 201 bp, Homo sapiens
tagctcataggttttctaaaatattctctgtaatttattttgaaatggagtttttttatcgtttacagatatgagtaaaattagcctaatcagaatgttarttcctgaaaacattgacacgtaccttatccacatggcaattgagatccttaaacatggtcctgacagcggacttcaaccttcatgtgatgtcaacaaaag

SEQ ID NO: 15279 - DNA, 201 bp, Homo sapiens
ctcatctagttaatgtgcttttaaaatcattgatgtctcttgttattacaataatagccattgaaagaatcttttttattagaatgttatttacaggtacrattagcttctatttaaataaattatttttatacttgatcttaggcaaaaggccaacaagtgatcagaataaattattttaagagaaaactaattataatt

SEQ ID NO: 15280 - DNA, 201 bp, Homo sapiens
gtaggttctaaactgcttgggtttaccgcactctggagcattgcagaagaatgtgatgttggaaggaagtgctgaaacataattattggcttgcctatagkagggtgctacataattttagaaggtgtcaagaaagtgacacagtctgaattagttctgttgagttgcaaaaaatgtaaagtttcttgattctgaaaataa

SEQ ID NO: 15281 - DNA, 201 bp, Homo sapiens
gatataattttaaattacttttagcatataaaagaagagctacattctgatttgaatccatgcagccagctctcatcaatgagagtgatatttgggggttraaatcagtgttctggctcttaaatatgattagatggacttattgtgtgggaggtgaataaagccaagataaaagacaataatttcattcagaagaaaata

SEQ ID NO: 15282 - DNA, 201 bp, Homo sapiens
tgttgaacaacgtggactaatgtgcctaagtggttccaaacatattttaaaatttgaagacaaataaaagggaactcaaagtaaattgggatacatacatrcaacagaatactgagccattaaaaaatgatgaaatagtaaaattgggggaattttgatgatactaggatgatataatgaccaagagacaaatacaatttt

SEQ ID NO: 15283 - DNA, 201 bp, Homo sapiens
tatttacatgggaagttagagcagagtaagatgcacctgtaaagctaaatgccacttatttgcatatatataaaacgcaggatgaatttaccatagaaatrtaaagggtacttatagaaatgtattagaaaaatatatgaatttttaacttatatctagaagttaactttatacatttaactttaaatcattaatagtggt

SEQ ID NO: 15284 - DNA, 201 bp, Homo sapiens
cggatgtggtggcgagtgcctgtagtcccagctactcgggaggctgaggcaggagaatggtgtgaacccaggaggcggagcttgcagtgagccgagatcgygccactgcactccagcctgggcaacagagcgagactctgtctcaaaaaaaaccaaccaactgaacaaacaaaaaaactaaaaaacaaaaacaaaaaaact

SEQ ID NO: 15285 - DNA, 201 bp, Homo sapiens
tgctggcctagaccatggtgttgccatagtggggtgaccagtctgaatagccaacaatgcttcctcagtaaatacccattttgtcttggtgggatttctayaaattgcaaaatgcagctattatgaagctgtaaaagagaaacagaaacatgtaacacctgggactgttttattaggcccaccgtatgctcagaacatgaa

SEQ ID NO: 15286 - DNA, 201 bp, Homo sapiens
tgtcactgtattctttcaaagaagccaatgaaataaactgttttctccctctatgtggtgtttttctacttgaacataaatgcacattttattttatttcmagactttttgtggccagcacccaatgaagagcaagttacttgcctcaagatgtactttggccattccagttttaaaccgtgagtataatctcatttaatc

SEQ ID NO: 15287 - DNA, 201 bp, Homo sapiens
ttctttttctgttaagcctccctgttaagtaatagcagcaagtttagtttggccatgaatatcttctagagattgtatcggggtactgataaacacatttrtagctcagggatactgcatcagccatattttaaaatgggactaacagtttaaaaactataaatattcacagtgttaagaaacaatctcaagatgcattaa

SEQ ID NO: 15288 - DNA, 201 bp, Homo sapiens
tgggaggcggagacatgggacttgcatgaacccaggaggcagaggttgcagtgagctgagattgcgacactgcattccaacctgggcgaccgagcaagackcggtctccaaaaaaaaaaaaaaaaaagaccatatgtaatgtttcttcattgttctaagataaatctttaaggctgttgaggttttttgtatacaaaatgg

SEQ ID NO: 15289 - DNA, 201 bp, Homo sapiens
agtaaagccatttcttactcatgtatacatttttccctccatgaaattagagcagccaccttttacatgacttttacatgcatttcagatttttgtactarcaattaaaatatctactggatgtaaatcacatgtgcttaatgctttgcttcataatatctgttgaagtcaattaaaatatagagacagatctttaaattg

SEQ ID NO: 15290 - DNA, 201 bp, Homo sapiens
catctctgacattatttttcaattatatagagaatgctttttgtaaaatactgatttatttaaagatattacaatcatagtagttttttgcaatctttttwaaatcagtggatgtcaaggaacaactattgttctttgtacggcatttttcaacattgtgaagagttcttatactcaaaaagtttgggagacacagtgtga

SEQ ID NO: 15291 - DNA, 201 bp, Homo sapiens
ttttgaactcctggcttctagtgatcctcctgccttggtctcttacttaaagcactgggattacaggtgtgagccactggctgctcacatgttttttatartagtacttaataattttatgtctgaaaatattatataatgttattttgcccatttaaaaactttaaaaaatgctaacaaactgtgtactctgtaacttgt

SEQ ID NO: 15292 - DNA, 201 bp, Homo sapiens
tgctgccatgcctggctaattttttatttatagtttttaaagacagggtctcactatgttgcccaggctagttttgaactcctggcttctagtgatcctcytgccttggtctcttacttaaagcactgggattacaggtgtgagccactggctgctcacatgttttttataatagtacttaataattttatgtctgaaaat

SEQ ID NO: 15293 - DNA, 201 bp, Homo sapiens
aaaaacagggtcttgctctgttatccaggctggagtgcggtggcgagatcatactcaatgcagcctcaaccttatgggctcgagtgatcctttcgcctcarcctctcaagtagctacaactactggtgtgtgctgccatgcctggctaattttttatttatagtttttaaagacagggtctcactatgttgcccaggctag

SEQ ID NO: 15294 - DNA, 201 bp, Homo sapiens
gttttgtgcatttttttttctttttaataaaaacagggtcttgctctgttatccaggctggagtgcggtggcgagatcatactcaatgcagcctcaacctyatgggctcgagtgatcctttcgcctcagcctctcaagtagctacaactactggtgtgtgctgccatgcctggctaattttttatttatagtttttaaaga

SEQ ID NO: 15295 - DNA, 201 bp, Homo sapiens
tttttcatacacttattggccatctgtatatcttctttgagggagtatctgttcaaatcttttgcctattttttcttagtgagttttgatagtcatttctrtattctgaatataaattatttatttgatatatgctttgcaaacattttctcctagtttatggcttttcatactttccacacagttcttttgaagagcagc

SEQ ID NO: 15296 - DNA, 201 bp, Homo sapiens
cagctgaagccccgtgtttgttctttctgattctccctctgtgcccctctgagataacttctatgagttttgtgcatttttttttctttttaataaaaacrgggtcttgctctgttatccaggctggagtgcggtggcgagatcatactcaatgcagcctcaaccttatgggctcgagtgatcctttcgcctcagcctctc

SEQ ID NO: 15297 - DNA, 201 bp, Homo sapiens
gaaactatgaagcttttgagagtgattgtatcatgggatattcccaccagcagtgtatgagaggtccagttcctccccatccttgctatcacttagtctgrctgatctttaacttaagccattctaatagtatctcattgtatttttagtttgcttttccctaatgactaattatattgagcatttttcatacacttattg

SEQ ID NO: 15298 - DNA, 201 bp, Homo sapiens
acagctgaagccccgtgtttgttctttctgattctccctctgtgcccctctgagataacttctatgagttttgtgcatttttttttctttttaataaaaayagggtcttgctctgttatccaggctggagtgcggtggcgagatcatactcaatgcagcctcaaccttatgggctcgagtgatcctttcgcctcagcctct

SEQ ID NO: 15299 - DNA, 201 bp, Homo sapiens
catcagtgatggacatttgggttgtttcctttttggctgttatgaataatgatgctgtgaacatttgtgtaccaatttttttatgaacatacattttcaaygcttttgcatatatgcctaagagtggaattgctgggctatatgctaattttttaagaaactatgaagcttttgagagtgattgtatcatgggatattccc

SEQ ID NO: 15300 - DNA, 201 bp, Homo sapiens
aagaaatgaaacagtaaaatacagctgaagccccgtgtttgttctttctgattctccctctgtgcccctctgagataacttctatgagttttgtgcatttytttttctttttaataaaaacagggtcttgctctgttatccaggctggagtgcggtggcgagatcatactcaatgcagcctcaaccttatgggctcgagtg

SEQ ID NO: 15301 - DNA, 201 bp, Homo sapiens
ttgaggctgcagtgagccttgatcacaccattgcactccagcctgggcaacagggcaaaaccctgtctcaaacagacaaacaaacaaacaaaaggcagagrtaggttaagctatttattaatggtcttctactggtatagatataagctagaaataacattcaagtgtttttacttttactacagttatctggccactttg

SEQ ID NO: 15302 - DNA, 201 bp, Homo sapiens
cagacacacgggatggggtgggggaggggtgttgagaacaatcgcagacgcccctcggcctgaccgccccgccgccgcccgcgacccccacgccgggcccrgctcccccggcgccgcagcgcggggctccagccactgccggccggttggcggccgccgctccggctctgcccgcgctccccgcatccctccgccgccccc

SEQ ID NO: 15303 - DNA, 201 bp, Homo sapiens
ggaggctgaagcaggagaatcgcttgaacctgggaggcagaggttgcggtgagccaagattgcatcactgcactccagcctgggcgacagagtgaggctcygtctcaaaaaaaaaaaatccaaaaaaacaaccccacaaacaaacaaaaaacattagaaatgtctgttagtacttttaaaggttgccttgtaaaattagga

SEQ ID NO: 15304 - DNA, 201 bp, Homo sapiens
tagtctcagctactcaggaggctgaagcaggagaatcgcttgaacctgggaggcagaggttgcggtgagccaagattgcatcactgcactccagcctgggygacagagtgaggctccgtctcaaaaaaaaaaaatccaaaaaaacaaccccacaaacaaacaaaaaacattagaaatgtctgttagtacttttaaaggttg

SEQ ID NO: 15305 - DNA, 201 bp, Homo sapiens
tgtaaaatttactgttgaacaacgtggactaatgtgcctaagtggttccaaacatattttaaaatttgaagacaaataaaagggaactcaaagtaaattgkgatacatacatacaacagaatactgagccattaaaaaatgatgaaatagtaaaattgggggaattttgatgatactaggatgatataatgaccaagagac

SEQ ID NO: 15306 - DNA, 201 bp, Homo sapiens
aaattattatatttctttattctttctcacttaagagtgaaattgatatgtgtaatgtgtacatggtgccagaatatttgtttttcttcttatagaatgtscaacatcccagcttgcttccttggatcagcacagtcagaaaatgttctaacagatattaaattgtgagtaatttttttccctcaacttttattttggatt

SEQ ID NO: 15307 - DNA, 201 bp, Homo sapiens
gtgctgggattacaggtgtgagccactgagcccagccctcttttatttcttttgatagtacactcataatcattaaactatcatttctggatgtgagattstgcttttggattcttattttttctttataaaatactttttgttctcttactggagaaaacattgttggattataaatgatataacaaggaatgaggatat

SEQ ID NO: 15308 - DNA, 201 bp, Homo sapiens
catttgttcatcaacttgaacatttatcatttctttgtgctgggaacatttctaatcttttctttgagttattttgaaatacacagtgttgttgttaactrtagttaccctactgttggttaatgagtacaaacatacagttagaaggaataggttctagcaacctattcctttaccccctgtcatcccctgctgccctga

SEQ ID NO: 15309 - DNA, 201 bp, Homo sapiens
aggctggagtgccgtggcacaatcatagcttactgcagccttgaactcttgggctcaagcaagccttccacttcagccttccaagtagctgggaccacacytggctaatttttaagtatttttgtagagatgagttctcactacattgcccaggctagtcttgaacccctagccttaagcgatcctcccacctcagcctgc

SEQ ID NO: 15310 - DNA, 201 bp, Homo sapiens
aaatccagaatagaggaggttaagaaggttgtgataaccatgagctctttttttttttttttgggacaaggtcttactctgtttcccaggctggagtgccrtggcacaatcatagcttactgcagccttgaactcttgggctcaagcaagccttccacttcagccttccaagtagctgggaccacacctggctaattttta

SEQ ID NO: 15311 - DNA, 201 bp, Homo sapiens
atgattatttttatagtctgtccttttgaataggcacttaagaatgtatgaacttaataagtatataagaaagaatgttccccaaaatatatcttacagasgcatacaatttaagaattcaaacaggttgtaatggggtgtgtgtgtgtgtgcacacgcgcacgcatgcgtgctcattcacactaaagaattcttgggcat

SEQ ID NO: 15312 - DNA, 201 bp, Homo sapiens
gttatctctaagcattttaggatttgtcttcttggaaattcatgtaaccaaaccaccatgtgttatttcaagtgtatatagtattgggttacagtttactrtgttttcagaaggttgtgacaactattagacttacagagaatgacttctctgccactaacggctttctaaagtgaatagagaggggcgaggattgaattc

SEQ ID NO: 15313 - DNA, 201 bp, Homo sapiens
agtccatagcttatcttacttactgaataaatgctctaatttgacagtcatgtttcttaaagttccttacaaaggccattgcccaagaaaccaaataattmcattatactatttttgaaatagaacacataataaatgggaattttaagttcagtttcttatgtaaacaataacttctatgtacatgttaaatatgcctgt

SEQ ID NO: 15314 - DNA, 201 bp, Homo sapiens
tatggtccaatgcctgcttttctattgtctgtggttccatccactagtgcctgtgttacacacctcttgttcaggttttatcatttaaaataaataagaayaaacagtccatagcttatcttacttactgaataaatgctctaatttgacagtcatgtttcttaaagttccttacaaaggccattgcccaagaaaccaaat

SEQ ID NO: 15315 - DNA, 201 bp, Homo sapiens
taatcccagatacttgggaggcggagacatgggacttgcatgaacccaggaggcagaggttgcagtgagctgagattgcgacactgcattccaacctgggygaccgagcaagacgcggtctccaaaaaaaaaaaaaaaaaagaccatatgtaatgtttcttcattgttctaagataaatctttaaggctgttgaggttttt

SEQ ID NO: 15316 - DNA, 201 bp, Homo sapiens
aacattggcaatagactgaataaataacatctctgacattatttttcaattatatagagaatgctttttgtaaaatactgatttatttaaagatattacartcatagtagttttttgcaatcttttttaaatcagtggatgtcaaggaacaactattgttctttgtacggcatttttcaacattgtgaagagttcttatac

SEQ ID NO: 15317 - DNA, 201 bp, Homo sapiens
actgttttgatgctctttgaaaacaatctaattgctgtaacaaatgaccatacgtaggccgggtgtggtggctcatgcctgtaatcccagcacttcgggakgctgaggcaggcagatcatttgaggccagggatttgagaccagttggacaacatagggagaccctgtctttactaaaaatacaaaaattagctgggcgta

SEQ ID NO: 15318 - DNA, 201 bp, Homo sapiens
gcctgtagtctcagctactcaggaggctgaagcaggagaatcgcttgaacctgggaggcagaggttgcggtgagccaagattgcatcactgcactccagcstgggcgacagagtgaggctccgtctcaaaaaaaaaaaatccaaaaaaacaaccccacaaacaaacaaaaaacattagaaatgtctgttagtacttttaaa

SEQ ID NO: 15319 - DNA, 201 bp, Homo sapiens
aggtggatcacaaggtcaggagattgagaccatcccggctaacatggtgaaacaccgtctctactaaaaatacaaaaaattagccaggtgtggtggcgtgygcctgtagtctcagctactcaggaggctgaagcaggagaatcgcttgaacctgggaggcagaggttgcggtgagccaagattgcatcactgcactccagc

SEQ ID NO: 15320 - DNA, 201 bp, Homo sapiens
cggtggctcaggcctgtaatcccagcactttgtgaggccgaggcaggtggatcacaaggtcaggagattgagaccatcccggctaacatggtgaaacaccrtctctactaaaaatacaaaaaattagccaggtgtggtggcgtgcgcctgtagtctcagctactcaggaggctgaagcaggagaatcgcttgaacctggga

SEQ ID NO: 15321 - DNA, 201 bp, Homo sapiens
taaacattagaggccaggcgcggtggctcaggcctgtaatcccagcactttgtgaggccgaggcaggtggatcacaaggtcaggagattgagaccatcccrgctaacatggtgaaacaccgtctctactaaaaatacaaaaaattagccaggtgtggtggcgtgcgcctgtagtctcagctactcaggaggctgaagcagg

SEQ ID NO: 15322 - DNA, 201 bp, Homo sapiens
ttcattttatttttatatttttttcatttcaaggatatggaaagagtttgtgcttccagtatccacctgtttatgtaggcaagattggccttgttatctcyccccttatttctctgatggaagaccaagtgctacagcttaagtaagtcatgttatcattgccacaatatcaccctctttttttcttctgtgggtgaaaca

SEQ ID NO: 15323 - DNA, 201 bp, Homo sapiens
ctaaacattagaggccaggcgcggtggctcaggcctgtaatcccagcactttgtgaggccgaggcaggtggatcacaaggtcaggagattgagaccatccyggctaacatggtgaaacaccgtctctactaaaaatacaaaaaattagccaggtgtggtggcgtgcgcctgtagtctcagctactcaggaggctgaagcag

SEQ ID NO: 15324 - DNA, 201 bp, Homo sapiens
tgtataagtacattgtaaaaagaaatgaaagcatcaaaggtttatttttatttctatatttttttcattttatttttatatttttttcatttcaaggatayggaaagagtttgtgcttccagtatccacctgtttatgtaggcaagattggccttgttatctctccccttatttctctgatggaagaccaagtgctacagc

SEQ ID NO: 15325 - DNA, 201 bp, Homo sapiens
gcgagcacgacagttttttaactttcagtacttaagatgttatatatagagctactgaacatactgtgtttattttaccaatttagggaaaaagtgcaaamattatttaacctttaaatgcacctttatatttcattaaaaatatcaacatagtaatattgaataatggctatgatcggctctgttgtgtgtaattagtaa

SEQ ID NO: 15326 - DNA, 201 bp, Homo sapiens
attttaaagtattgattcttttggatatctagtatgaagcttagaatctgttttttactttagatgtatgtagtgaaatttaatatatataccaaatggtrgttgttagttagcttgaatgggacattggtcaaatggcattgtttgttttaaagttccaggtttgtgcatttatgtatgaagtttgaaaataaattctat

SEQ ID NO: 15327 - DNA, 201 bp, Homo sapiens
acccttgatttttgttggggttcgttccaaggagaataatttccatctggatattggattggcacctgtgacctcttctgagctagaccctagtaacagcrtttggatctggggtaggtgtgtggccaactgagctgctggttcatgcctttcctgaaatgagccctacctctgaatatttcagaaacatgggacattaac

SEQ ID NO: 15328 - DNA, 201 bp, Homo sapiens
tgatttgaatttcctgattttatttgaatttggacccttagaaggtactattatggtaatgtttgtgaatatactgagttttacaggtgaggtgtgttcartagataattatttctatgtatacactatcaccaagttttacatttcaaataaaagtcactgaattaatttgtaatctgtcagtttgttcattcataagct

SEQ ID NO: 15329 - DNA, 201 bp, Homo sapiens
ctatcattactatacttgctttatcacatatccatccattcatatgtctctatccatccattcattcattccagttttaaaatgcatctcagggtcaatcraggacaccattacacttccacctaagtatttcagcatgtaaattattaacgagttaaatatttacttaacagttttttctttggtgtaaaatttgcacgt

SEQ ID NO: 15330 - DNA, 201 bp, Homo sapiens
taaattcaccattttggtcaactcaaagcaagtacaccatgggacacagatctgaaataatgtccagatttttacttactgaatgaggtgtgttgagtgtmtaagactacatgatgagatggcaagtaattgcctgaagaaatgatgtagtgattttgtgtgtcttatatttatttactttttgatccagaaataaattat

SEQ ID NO: 15331 - DNA, 201 bp, Homo sapiens
gtagagatcaatgaattgtcataaactgggcaccctgtggccagcacttagttaagaataggtcagtaacagcatgccagaagaccacctctccaattgayttttcccatgatattttattaagaaaattttctaagatgtagtaaagttgaaagaacttttttctgtgcatgtctgtattcccaccacctaaattcaact

SEQ ID NO: 15332 - DNA, 201 bp, Homo sapiens
tttcctgcttgaccgctgagtttgattataaattaaaatacacaatattttatacaaattgttttgtagaagatttatttacagatgctcattcacaggtwaaattgacttatgaaaatagttttcatgacaaatgtatcaggctcggtaactaaatatatggattgatcttgtttataaatgaaattaaatgtgaatgta

SEQ ID NO: 15333 - DNA, 201 bp, Homo sapiens
aggatgaatgaaagaggcagtaagagaacaaagtgaatgaaaaagtatttctatatgaagtgaaagcaggagagtcctctctgttagagaacaacagaatygcatatgacagactagctttcttaatatttctagaacttgatggctgtgaagagcgtcccgtaggaattctcccttcacttaggaaaacatacctcaaaa

SEQ ID NO: 15334 - DNA, 201 bp, Homo sapiens
ttttgtatttacccatgaagacattgttttttggactctgcaaataggacatttcaaagatgagtgaaaaaaaattggaaacaactgcacagcagcggaartgtcctgaatggatgaatgtgcagaataaaagatgtgctgtagaagaaagaaaggtatgttgttcattgactattctttcgggtgagaaatttaatttat

SEQ ID NO: 15335 - DNA, 201 bp, Homo sapiens
cttacatacagaaaagtgcacatgttgtagagatcaatgaattgtcataaactgggcaccctgtggccagcacttagttaagaataggtcagtaacagcaygccagaagaccacctctccaattgatttttcccatgatattttattaagaaaattttctaagatgtagtaaagttgaaagaacttttttctgtgcatgtc

SEQ ID NO: 15336 - DNA, 201 bp, Homo sapiens
aaatctaatagttttgctgaatttacttagatcttaagacagaataatcatgtagaaaatttaaaatgtcaggaattcataatgattcatatacccaaggwttttcattgatagtgaggtaaggttattcttgagaaagactcaaagtcataaaataatagaatttcgaaactaccagaattatacaagtcaattaaaatg

SEQ ID NO: 15337 - DNA, 201 bp, Homo sapiens
ttccttttttcttttgatcttaaacattttttatttatgtcttacatacagaaaagtgcacatgttgtagagatcaatgaattgtcataaactgggcaccytgtggccagcacttagttaagaataggtcagtaacagcatgccagaagaccacctctccaattgatttttcccatgatattttattaagaaaattttcta

SEQ ID NO: 15338 - DNA, 201 bp, Homo sapiens
atagctcagggatactgcatcagccatattttaaaatgggactaacagtttaaaaactataaatattcacagtgttaagaaacaatctcaagatgcattargaaaaaggaaggtgcaaaacagaaaaacaaacgtaaacgtgtgtgcatatgcatgcttatatagtcacatattcttgtatgtgtacaaaaaatacacact

SEQ ID NO: 15339 - DNA, 201 bp, Homo sapiens
acatctaacaggcacatttttgtgaggattaaatgagatgaataagaatgagatgaacaagtaaatgtgaataaaactaataagcctgtgaaaatctagaytggatttttcctattctgagaatttaaaatataatccactgaagtatttctttccttttttcttttgatcttaaacattttttatttatgtcttacatac

SEQ ID NO: 15340 - DNA, 201 bp, Homo sapiens
gtcacatattcttgtatgtgtacaaaaaatacacactggatctctgcaagcatagccaagcaactggaaatatgtttttaaaaacttgcttttcattctakctcttctagtactgttttgatgctctttgaaaacaatctaattgctgtaacaaatgaccatacgtaggccgggtgtggtggctcatgcctgtaatcccag

SEQ ID NO: 15341 - DNA, 201 bp, Homo sapiens
gtaaccatttcaaaagtaccctccagaagcaacatttgctcactttatttgcatttccatactggacacttagaaaatgaattaaaattgtttttacagtyaatctgttgtaaaaacatgtcagttatctacttttaaagatgatactaaaaagtagttgtccaggctgctgatgtctttctatttcattgggaggttttg

SEQ ID NO: 15342 - DNA, 201 bp, Homo sapiens
ttacatctaacaggcacatttttgtgaggattaaatgagatgaataagaatgagatgaacaagtaaatgtgaataaaactaataagcctgtgaaaatctakactggatttttcctattctgagaatttaaaatataatccactgaagtatttctttccttttttcttttgatcttaaacattttttatttatgtcttacat

SEQ ID NO: 15343 - DNA, 201 bp, Homo sapiens
gcttatatagtcacatattcttgtatgtgtacaaaaaatacacactggatctctgcaagcatagccaagcaactggaaatatgtttttaaaaacttgcttytcattctatctcttctagtactgttttgatgctctttgaaaacaatctaattgctgtaacaaatgaccatacgtaggccgggtgtggtggctcatgcctg

SEQ ID NO: 15344 - DNA, 201 bp, Homo sapiens
gctgaatttacttagatcttaagacagaataatcatgtagaaaatttaaaatgtcaggaattcataatgattcatatacccaaggattttcattgatagtraggtaaggttattcttgagaaagactcaaagtcataaaataatagaatttcgaaactaccagaattatacaagtcaattaaaatgactgatttgttttaa

SEQ ID NO: 15345 - DNA, 201 bp, Homo sapiens
gtgagtataatctcatttaatcaaatcacatatttagtattctctttaaaacaagggaaaaggcaaataacctgtctgcttaacagcaacagcacaacttyactatagttatacatgccacactgtattttctgtgtgactacaaaattatttcaaagtgatatttatataaaattcatttctgcaaattgtttttataag

SEQ ID NO: 15346 - DNA, 201 bp, Homo sapiens
acgtgtgtgcatatgcatgcttatatagtcacatattcttgtatgtgtacaaaaaatacacactggatctctgcaagcatagccaagcaactggaaatatrtttttaaaaacttgcttttcattctatctcttctagtactgttttgatgctctttgaaaacaatctaattgctgtaacaaatgaccatacgtaggccggg

SEQ ID NO: 15347 - DNA, 201 bp, Homo sapiens
ttatgatatatttccttacgatatattagtggttatagtacctaaatttgaatagtgattctgttcattcattcattcattcattcaatattcacttccasgagattggggacttatttaaagacagagtagttcacattatagttcctttttttagtccttcttattcgttaaagaaaagactaggaaatgtttgttatt

SEQ ID NO: 15348 - DNA, 201 bp, Homo sapiens
aggaaccatatttaagattttatagaatacttagatttctagttgggatgtatcatttaaaattagatatgtagagagagtgttatgatatatttccttaygatatattagtggttatagtacctaaatttgaatagtgattctgttcattcattcattcattcattcaatattcacttccaggagattggggacttattt

SEQ ID NO: 15349 - DNA, 201 bp, Homo sapiens
tgaacctgcacatgtcctttaatttccttgggtctccatttcctcagctatacaatggaaatgacacttcctcccccacatccaggaaacaacagatgacrttagaaaatagaagacatgggataagtataaaatgttgaaagagttaaacacattcaaggcaatattaagggattattttttacttccaagaagctcctg

SEQ ID NO: 15350 - DNA, 201 bp, Homo sapiens
tgtaaaaacatgtcagttatctacttttaaagatgatactaaaaagtagttgtccaggctgctgatgtctttctatttcattgggaggttttgtttttaarttggaaacattattttaggttgataaattataattttacattcaaatgtggtagttggaatttaaagctggaaagttatccttgctatgagttggtcagg

SEQ ID NO: 15351 - DNA, 201 bp, Homo sapiens
ggctataggcatttgaaagaggaaacttttctttggcaaccttccaccttcctttctacagaatatttcagtatttctagctcataggttttctaaaataktctctgtaatttattttgaaatggagtttttttatcgtttacagatatgagtaaaattagcctaatcagaatgttagttcctgaaaacattgacacgtac

SEQ ID NO: 15352 - DNA, 201 bp, Homo sapiens
ttttttttttttaaatgcacacaccacgtttgagagattcttattcactgtattttctttaattatacttgaattttggtttacattgaggagtgccctcraagatattaacagatttttaaaaaatcctctaaaaaactcattcttagggaaatttgttcacttactaggtgaggagcaaaataaaaatccttaatatag

SEQ ID NO: 15353 - DNA, 201 bp, Homo sapiens
agtcccagctactcaggaggctgaggcaggagaatggcatgaacccaggaggcagatcttgcagagagctgagatcgtgccactgcactccagcctgggcracacagcaagactccgtctcaaaacaaaaaacaaaaaacaaaaaaactgctacctccttattacaaataggaactaaagttgaagtttgaggaatttgct

SEQ ID NO: 15354 - DNA, 201 bp, Homo sapiens
atatctcaaaggttctttatttttttttatttatttttctttttttgagacagtctggttctgtcaccctggctggaatgcagtggcgcgatctcggctcrctgcaagctccgcctcctgggttcacgccattctcctgcctcagcctcccgagtagctgagactacaggcgcccgccactgtgcccggctaattttttgt

SEQ ID NO: 15355 - DNA, 201 bp, Homo sapiens
gaggctgaggtgggcgatcggatcacgaggtcaggagattgagaccatcctggctaacatggtgaaaccccgtcgctactaaaacatgcaaaaaattagcsgggcttggtggcgggcgcctgtagtcccagctactcaggaggctgaggcaggagaatggcatgaacccaggaggcagatcttgcagagagctgagatcgt

SEQ ID NO: 15356 - DNA, 201 bp, Homo sapiens
acgacagactaccctcaaatcataagtagttaatgtaattaacatcctgtttcatcatgagactcttcagtgttacattaaaaactgctacctcctgggcygggcgtggtggctcatgcctgtaatcccagcactttgggaggctgaggtgggcgatcggatcacgaggtcaggagattgagaccatcctggctaacatgg

SEQ ID NO: 15357 - DNA, 201 bp, Homo sapiens
ccaatgaaataaactgttttctccctctatgtggtgtttttctacttgaacataaatgcacattttattttatttccagactttttgtggccagcacccartgaagagcaagttacttgcctcaagatgtactttggccattccagttttaaaccgtgagtataatctcatttaatcaaatcacatatttagtattctctt

SEQ ID NO: 15358 - DNA, 201 bp, Homo sapiens
aaatggtgaacctaactaaatccaagctcctacagtaccttcttttcacctttaggtgaagaaatgcggtgagctattttattactgattatgtggacagwccaaaggaaggttcataagcgaaaaggaaaaatttaaattattccatgtgagcgattcttactttgcagatttgttgaagtgtagttactggcttcaaaa

SEQ ID NO: 15359 - DNA, 201 bp, Homo sapiens
ttatctgtggatttttttagtgcgggactaatgtaatttctgattaccattaattgaaggttggttatattataacatttggattggtatattgcttgccrtggtttgttctaaatgttagcctttagaagtattcctgattctaaaacatcagttttttttaatagtcctggcaaagtgtgaatcacaacaaaattctaa

SEQ ID NO: 15360 - DNA, 201 bp, Homo sapiens
tcaaatggtgaacctaactaaatccaagctcctacagtaccttcttttcacctttaggtgaagaaatgcggtgagctattttattactgattatgtggacmgtccaaaggaaggttcataagcgaaaaggaaaaatttaaattattccatgtgagcgattcttactttgcagatttgttgaagtgtagttactggcttcaa

SEQ ID NO: 15361 - DNA, 201 bp, Homo sapiens
attaaaaaaaaaaaagtagattgtgaattcagatgtaggtttgtatcccagcttttccagttagtatctgtgtgactttggggaagtttcttagcatcttkgatactcggttaacagttgtaattattatttaaggtattgcttgagaagagcttagtatagagcctgacatttagtaagtgtttaatacatattagctaa

SEQ ID NO: 15362 - DNA, 201 bp, Homo sapiens
accatgccactgcactctagcctgggtgacagagtgagaccctgtctcaattaaaaaattaaaaaaaaaaaagtagattgtgaattcagatgtaggtttgwatcccagcttttccagttagtatctgtgtgactttggggaagtttcttagcatctttgatactcggttaacagttgtaattattatttaaggtattgctt

SEQ ID NO: 15363 - DNA, 201 bp, Homo sapiens
aaaacttgcctgtggtttggaatttcacattaaatgattacattaaaaattcaaatggtgaacctaactaaatccaagctcctacagtaccttcttttcasctttaggtgaagaaatgcggtgagctattttattactgattatgtggacagtccaaaggaaggttcataagcgaaaaggaaaaatttaaattattccatg

SEQ ID NO: 15364 - DNA, 201 bp, Homo sapiens
tgctggggattgcaggtgtgagccgccgcatccagccctgtgttccttcttgtgttactttcttgtaattttttcctggaatatgggtagtgatttggctytccagtattgaaattgagtttcctttcttccaattcatgtgtatccatttttatttggaagttttgtttttatacattcaataatcatctttactttctt

SEQ ID NO: 15365 - DNA, 201 bp, Homo sapiens
agtgattctcctgcatgagcctcctgagtagctgggattacaggcgtgtgccaccatacccggcttatttttgtattttttgtagagatggggtttcaccrtgttgcccaggatggtcttaaactcctgggctcaagtgatctactggcctcagcctcccagcgtgctggggattgcaggtgtgagccgccgcatccagcc

SEQ ID NO: 15366 - DNA, 201 bp, Homo sapiens
ccttttttatctatcatataaatatgtaaatatatattatatatccattagggaagaggaagttgtctaaagatatctagtatataggagctttgttctgyagaaaagaggatatgaagtcaattatattggaaattaatgcttaatacttttttttaaagcatttatctcccaatgataatgaaaacgatacgtcctatg

SEQ ID NO: 15367 - DNA, 201 bp, Homo sapiens
tagtagagaaagtgctgggattacaggtgtgagccactgcacctggccttggatttcgtgatttgactgacatcttttacaccaattattgccattttttwattgggtactaattattagtattgctttctttattcgttaaataagaagtaaaagaacttttaaaaaataaaataactttttttcctagtacaaagctta

SEQ ID NO: 15368 - DNA, 201 bp, Homo sapiens
caggatttcatgattttttttttttgagatggaatctatctctgtcgcccaagctggagtgccgtggcgcagtcttggctcactacaacctctgcctcccyggttcaagtgattctcctacctcagcctcccgagtcactgggattacaggtgcccgccaccacacccggctaatttttgtatttttagtagagaaagtgc

SEQ ID NO: 15369 - DNA, 201 bp, Homo sapiens
atttccccatcatttttctaatggcaacaataattttagcatttgagcaattctctgtattttggtaactattagtaatcacttttatcagtataaacatrcatttcattttaaaatggttttcaaaatattctcataccaaccattcataaaagatgttccccttctgggaaatatcagtttttgctaacatctgcattt

SEQ ID NO: 15370 - DNA, 201 bp, Homo sapiens
ggagcttttttcctgtgttttcttcaagtggtttcatggtttggggtcttacatttaagtctttagtccattttgagttgatgctgtatgtggtgagagakaattgactactttcattcttttgcatatggttatcagttttcccaacaccgtttattgaagagcctgacctttccccattgtgggttcttggctcttttg

SEQ ID NO: 15371 - DNA, 201 bp, Homo sapiens
tatatattttaaatgtcataaaataccacatacttataagagaaaaggttctattcattgctgaagtggaagtttatcattaatttttatttatttatttwtttttccagttttggaattcttattactttgaacccaagaaccactgataactagcacaatccagtgaaacagaggaagcagcagcttaatcaaaggaaa

SEQ ID NO: 15372 - DNA, 201 bp, Homo sapiens
tgtgttgtttttaagcttcactctagtttatatattttaaatgtcataaaataccacatacttataagagaaaaggttctattcattgctgaagtggaagyttatcattaatttttatttatttatttttttttccagttttggaattcttattactttgaacccaagaaccactgataactagcacaatccagtgaaaca

SEQ ID NO: 15373 - DNA, 201 bp, Homo sapiens
tagaattttctcccctcagaaaattaagaggaaataaaagtctgtagcaaatcacttggcaaaataatggctccttttgtaataggaatttttactctttygatttatctgttacataagttcaaatttttacatattttccaccttttttaaaaaagagtgatatgtagtcaatatcaatttgagcaacactgttgcata

SEQ ID NO: 15374 - DNA, 201 bp, Homo sapiens
tctttttctttagttcccactgggaatttgaaggtccaacaatcatctactgtccttctagaaaaatgacacaacaagttacaggtgaacttaggaaactkaatctatcctgtggaacataccatgcgggcatgagttttagcacaaggaaagacattcatcataggtttgtaagagatgaaattcaggtatgaggatcaa

SEQ ID NO: 15375 - DNA, 201 bp, Homo sapiens
actcctgggcttaagcgatcctgtcacctcagcctccctagtagctgggaccacaggcctgcaccactacactcagctaatttttgtattttttgtagagrtggggtttcgctctgttgcccagactggtctccaactcctggactcaagtgatccacctgccttggcctcccaaagtgttggaattataggtgtgagtca

SEQ ID NO: 15376 - DNA, 201 bp, Homo sapiens
gtaggagtttgctattttataatttcgtatgcttttttcataatagatgtctctgctttttgtggattctcttcatatctactagtgtttactcttctgastttgatttttgggggtgtattttatttctttatacagaatttttttcttttttctttctttttttgagacaaggttttgctgtgtcaccccagctggagt

SEQ ID NO: 15377 - DNA, 201 bp, Homo sapiens; identical to SEQ ID NO: 1356

SEQ ID NO: 15378 - DNA, 201 bp, Homo sapiens
gcaccatttcaaatgtaatgttaaaaaataataaatggagaagtagatagctaacaagtaggcttaatttaataagacaaagtaaatggcatttggaaacmtcatggatttaatgttttatttaaatgatttctgatttttaaaaagtaaatattgtatccagaaggctgagaaacaagttagtagggagattttttcttt

SEQ ID NO: 15379 - DNA, 201 bp, Homo sapiens; identical to SEQ ID NO: 1359

SEQ ID NO: 15380 - DNA, 201 bp, Homo sapiens
ttttttttaacaaaaaacaaatttacaaaatctttccatgtattcaacttagaatttaatgaaatagggtttttttttttttggtggtcatgtatcatcarctttctttacatttaattaaattaatcaacaaaaaacatatagttgacataaacaaatttgggaccaagcactactgactcttagtaaacatacaagtca

SEQ ID NO: 15381 - DNA, 201 bp, Homo sapiens
ggaaaaatacatttaagattataagtctggttataagcttaaaaagtgacccagaaagggatatcattgctaaaaaaaaaaatccccttgtgacctgggtrcattttgcaaagccacaggtttgcagtgttacacaagggccaaaggaggccatgagttgtctttggttgtggggccggagggtaactgttcatgaaaata

SEQ ID NO: 15382 - DNA, 201 bp, Homo sapiens
tgtttcttgtttaaaccacacctataatgtaccatctacaatttccaattctttaagacagagtgaaaaattaagacacctgaagcaatctgagtgcggartcctaggcattatgattttccttgacacttttagggttcttttatcacagtttatcaaacaccttttttttttttaacaaaaaacaaatttacaaaatct

SEQ ID NO: 15383 - DNA, 201 bp, Homo sapiens
atatcttattcatctttctgagaatggagtatcatgattcatgaattagatacttgcatcttaacatttgaaataatttaattttattattttttagttcraaaactgtatcttcgggcaccaaagagcattgttataatcaagtaccagttgaattaagtacagagaagaaggtttgttttaaagaaattgttctgattt

SEQ ID NO: 15384 - DNA, 201 bp, Homo sapiens
gtgacattgtttttccagaaagttctttggcactagtaaattttggggagttggaagctctgatgggttagtgactgtggtgggtaaaactagtcttagartcacaacaggttgtttcagtatctattagataaaacaggttttaggttacaataggcagtttcagcagctaggcttgcagaaaattacattcttagagta

SEQ ID NO: 15385 - DNA, 201 bp, Homo sapiens
gtataacccagtaataggattgcagtgtcaaatggtatttctggttctaggtctttgaggaatcgccacactgtcttccacaatggttgaactagtttacmttcccaccaacagtgtaaaagcattcctatttctccatagccttgccagcacctgttgtttcttgattttttaataaacgccattctgactggcatgaga

SEQ ID NO: 15386 - DNA, 201 bp, Homo sapiens
ctttgcttcataatatctgttgaagtcaattaaaatatagagacagatctttaaattgaacatgttttatttgggaagcaagaattaaatttgaggcatawacacagactgggtgtccttggtatctctgaagaacaaagagaagtttggaggttatagaaaaaggaaaatgtgacattgtttttccagaaagttctttgg

SEQ ID NO: 15387 - DNA, 201 bp, Homo sapiens
gaagtagctgaccatggtatttagaaaacttctttctcatcgattaaagaagcagtactgaaatcaatgcggaggaatccatatatcatatttacttctgrtgtgtagaagtggaaagggaatacatttgttgcttacttttttgtacctttacatgtgattgatcacttgtgagttttttctttcaaacatcttaaagct

SEQ ID NO: 15388 - DNA, 201 bp, Homo sapiens
ctggttataagcttaaaaagtgacccagaaagggatatcattgctaaaaaaaaaaatccccttgtgacctgggtacattttgcaaagccacaggtttgcartgttacacaagggccaaaggaggccatgagttgtctttggttgtggggccggagggtaactgttcatgaaaatagtgagtgtctgaagattaagaaaatc

SEQ ID NO: 15389 - DNA, 201 bp, Homo sapiens
aagacaataatttcattcagaagaaaatatagctgaatagatgtaatttcagtcaattaatacaggatgggttggtacacatataacactatatccacttrtttaaaaaattgcttaggtgttgaaaaattgctgtggcacttcctggaaagtaatttttaatacaggtaaatgggtgagtcttgtgtaaagtcagaaaga

SEQ ID NO: 15390 - DNA, 201 bp, Homo sapiens
gtgggttttcttcactttttgatattgttctttgattcacttttaaatttttatagagtccagtttatctgttttttcttttattacctatgcttttggcrtcatacctaattcccaaatccaatgccatgaagattttctgttatgttttcttttaatagttttatagttttactttttctattggagttttaagtaaat

SEQ ID NO: 15391 - DNA, 201 bp, Homo sapiens
ttgttctttgattcacttttaaatttttatagagtccagtttatctgttttttcttttattacctatgcttttggcatcatacctaattcccaaatccaakgccatgaagattttctgttatgttttcttttaatagttttatagttttactttttctattggagttttaagtaaattcttgtatattagtgtgatacatt

SEQ ID NO: 15392 - DNA, 201 bp, Homo sapiens
agaaacatgggacattaacttccctttacttacgttaaacccctttgaatgaggagttgtttttcacttccagttgtgttcagttgtcacagaagcacagygatgtgattggtggaaggacccgtcaacagacccagaagatgtaaagtgtttttaatctcaaaggatgtggaatctcagagatagttacaccgagtagag

SEQ ID NO: 15393 - DNA, 201 bp, Homo sapiens
ccttccttccttccttccttcctgcccgtccgaccgccctgccttccttccttccttcctccctccctccctccctccctcctttctttttctttctcttkctttctttctttctctctctctctctctttctttctttttctttctctttttctttctttcaagcagtcctcccgcctcagtcccccaaaatagtgggat

SEQ ID NO: 15394 - DNA, 201 bp, Homo sapiens
ctgagtgggggcatgattttagggattcattcaggaagttgggctccctaaagacagcactgccaatggtaagctttgccaagtctgatgtcccgaaattrcattcttaataaggagagcattcaggattggggagtggtaaagaagctgaagacttcactataaaagagcaaatggataatgtaaaaagagaactatttt

SEQ ID NO: 15395 - DNA, 201 bp, Homo sapiens
cagtctcaaactcctggactcaagcaatcaactagcctcagcctctgagtactgagatgacaggcatgtgccttcatacccagctaatatttttgtagagwtggggtcttcctgtgttgcccggaagagtctcaaactcttggcctcagcctcccaaagcactgggattgcaggcatgagccacaacacatggccctgctt

SEQ ID NO: 15396 - DNA, 201 bp, Homo sapiens
tttaggcttatgaaacacttagctacttaaattatttaattttttttcatgtgcagatggtattgtacccaaacactacctttgtgtgtgtgtgtgtgtgygcctgtgtgtgtgtttttgagacagggtcttactctgctcaggctggagtgcagtggcgtgattatagctcactacagccttgacctcctgggctccagt

SEQ ID NO: 15397 - DNA, 201 bp, Homo sapiens
gattaatacataaatatttccttttaaaattcttaaggcttttattcatatatctcccctctccctatttccaataatgatttttggtgttaatatgatgrtatttatgcttctgtttttataggaaccaaatactttgatttggttatttattctcctttggagatgtagatgagtttattttttcctttcgagctttat

SEQ ID NO: 15398 - DNA, 201 bp, Homo sapiens
gaaatggagatgcttaaggtatgtttacaattataaaaacattacttcaagttctttccaaaggacatttaattaagtaaaatattaactaattctaaacyaggttccaccacaatgaaattgctactaattatgtaacattagatttcacattttccaattcatgtttcttttatgtagtctatgaataatgggttagag

SEQ ID NO: 15399 - DNA, 201 bp, Homo sapiens
aatcacatatttagtattctctttaaaacaagggaaaaggcaaataacctgtctgcttaacagcaacagcacaacttcactatagttatacatgccacackgtattttctgtgtgactacaaaattatttcaaagtgatatttatataaaattcatttctgcaaattgtttttataagtgaggaaaaatggttttccttta

SEQ ID NO: 15400 - DNA, 201 bp, Homo sapiens
acttccttattaaatctctaaaagcaggaatgctctggaacaatgaacaattagaatgtggtaatgtaattttgggccaaaaaatactttgtagaaatgtrattctcttacttggaatagaaagaattctgactcgaaaaagtgcagttaatgtatgcttttctgggtaagatttgtgatagattttgattgagatttaaa

SEQ ID NO: 15401 - DNA, 201 bp, Homo sapiens
gttgcttctccttgtagtttccttgattcctcaaaactccttttaagaattcttgaagatctcgctttattactatttctcgctttattactgtaaagacyatgagaaggtctttcatgatcttatcagcaaagtaattcctctctcttgaattcatagaggactttcagatgaattctaaagatgcttctgtagcactta

SEQ ID NO: 15402 - DNA, 201 bp, Homo sapiens
gagggatgactgttggagaaggctgtgcttactaaacagtattattaagtagcagcatacatggtgttatactgacttctgattttgcaatagtacagacrggttcagattctcatttccaccttctccttctgcctaggtgaataactgctgggttatagtacagatgactgcagatcatttggaatttactttaaatgt

SEQ ID NO: 15403 - DNA, 201 bp, Homo sapiens
tagcttgaagccgggaggtggaggttgcagtgagccgagattgcgccactgcattccagcctgggtgacagagtgagactctgtctcaaaaaaaaaaaaawggaagggcttacattttattttggtgctgactgggaatgaaggcaatgagggatgactgttggagaaggctgtgcttactaaacagtattattaagtagc

SEQ ID NO: 15404 - DNA, 201 bp, Homo sapiens
gagtctctctgtgttgctcaagctggagtgcagtggtgcgatcatagcttactgcagcctcgatctcgtgggcccaagtaatcctcagccacctgagtagrtgggactacagacatgcactactatgcccagctaatatattttaattttttgtatagagacagggtcttctagtgcttcctaggctggtcttgaactcct

SEQ ID NO: 15405 - DNA, 201 bp, Homo sapiens
accgttttatagaataattgtgaagacttaaagggacaaactattcgaagcatctgtattgatataaagttatcactattctcgtagcttccttttggagwttttaaatgattgtgtttgttaagatgttaattaaattaggccattttgctaaatgctcttaaaaatatggcatgactgcctcatataaaatgatatgat

SEQ ID NO: 15406 - DNA, 201 bp, Homo sapiens
tttctagtacggcctttattatggcagaaattgagccactacaggtctgcacagcaaagtcgagggaaataacctgctgtctatgatttagcaagtgatgrtggatatttttgagttcaaatcactcagtctttaatggattttcttttctttttttcctagttgaatctcagttgttctcaggctaggtttgatatgaaa

SEQ ID NO: 15407 - DNA, 201 bp, Homo sapiens
ccttgtcaaaaatcaattggtggtaaatgtatggatttactcctggaatctcaattctattctattgtatttatatttctgtccttatgcctgtaccacamtgttttgattacagtagctttgtagtaagtttagaaattgggaaacatgagtcctccaactttgttcttcttttcaagattattttggctatttggggtc

SEQ ID NO: 15408 - DNA, 201 bp, Homo sapiens
tagcataatgtccgttttaccgttttatagaataattgtgaagacttaaagggacaaactattcgaagcatctgtattgatataaagttatcactattctygtagcttccttttggagattttaaatgattgtgtttgttaagatgttaattaaattaggccattttgctaaatgctcttaaaaatatggcatgactgcct

SEQ ID NO: 15409 - DNA, 201 bp, Homo sapiens
tgcagtgagccgagattgcgccactgcattccagcctgggtgacagagtgagactctgtctcaaaaaaaaaaaaaaggaagggcttacattttattttggwgctgactgggaatgaaggcaatgagggatgactgttggagaaggctgtgcttactaaacagtattattaagtagcagcatacatggtgttatactgactt

SEQ ID NO: 15410 - DNA, 201 bp, Homo sapiens
atggtagctaataaacactaagtgataaagtaggtaaagatctatttattcatttattaaatattgttggtcattttacagtgctttctaacatactgatktacatttctaattttcttctgtcatttttctccaaaaataatggtcatgtcatccaacctcagtgctgtttttagaggtcttgataagccagtgagagca

SEQ ID NO: 15411 - DNA, 201 bp, Homo sapiens
ctatttagaatgagtgcatgaatgaatgaagtatgtgtgatgttatggagtacaaagttagaattagcaacatgacctgaatttagaagcaggtgggatamttatacttttctcagtctgtgggcaccacaccattgaagtatatgtctaagattaatttatatttggttgtttgatttagcaaaacttgctgcctgttaa

SEQ ID NO: 15412 - DNA, 201 bp, Homo sapiens
gatcatcagctaagagtgacgatcggtggaggagatatgaagtttaagtggagaggagaaggtataaaatagtcttaggaggggaggatagtaaatagatkagggaaaagttgtaggattgccaggaagtagtaagggcccacttgaggctggtggtcacaaatttaaggtgagaccagtcaaaatggttgtgcttttcac

SEQ ID NO: 15413 - DNA, 201 bp, Homo sapiens
ccaagatggtagctaataaacactaagtgataaagtaggtaaagatctatttattcatttattaaatattgttggtcattttacagtgctttctaacatamtgatttacatttctaattttcttctgtcatttttctccaaaaataatggtcatgtcatccaacctcagtgctgtttttagaggtcttgataagccagtga

SEQ ID NO: 15414 - DNA, 201 bp, Homo sapiens
ttctatgaaaacaccttcagggtggtttcttgtatgcttgtaagatggctacttgcatcaaccatgaccacatctagcaggagcaaaagcatcctttcccrtaccagaggagagtcccgaaatttgttgcaattggactgccttggaagcaataattatggccaggagatggaggctagagaactgagacctgatcatagc

SEQ ID NO: 15415 - DNA, 201 bp, Homo sapiens
taactcatgctttcatttgtagatgaatattttattgtttctcctttgcatctatcaaaggaatggaaactcctttgaattgtaaccagcaaacaattcayttttgttagggaaattggatgataattttcctttaaaagataccgccaaacttgagactaacattctcagctgatttaagtaggatttctcttactagat

SEQ ID NO: 15416 - DNA, 201 bp, Homo sapiens
gcaattggactgccttggaagcaataattatggccaggagatggaggctagagaactgagacctgatcatagctcctatccttgaatcagttgtatagcarggggaattggattttccttaagacagttggatttcacctgtagtcttggtgatgaggtcagttccatccataaaactttgctgttacacattttgggatg

SEQ ID NO: 15417 - DNA, 201 bp, Homo sapiens
cttcttcttctccttcttccttcttccttccttcctcctcctcctccttcttcttcctcttcctcttcttctttctctctttccttccttcccttcccttycccttccttccttccttccttcctgcccgtccgaccgccctgccttccttccttccttcctccctccctccctccctccctcctttctttttctttctct

SEQ ID NO: 15418 - DNA, 201 bp, Homo sapiens
cagtgagctgtgactgagcaacagagctagactctgtctcaaaaaaaaaaaaaaaagagatgggttttgaaattcagtactttttttgagtgaggtccaatgggtcagaaagaagcattggataaatgaatccattttctcttctctgtttgaatttgtaatttgaaagaatattctacctataaagtacttcagtgctta

SEQ ID NO: 15419 - DNA, 201 bp, Homo sapiens
actactaattcttcttctgattcttcttcttctccttcttccttcttccttccttcctcctcctcctccttcttcttcctcttcctcttcttctttctctstttccttccttcccttccctttcccttccttccttccttccttcctgcccgtccgaccgccctgccttccttccttccttcctccctccctccctccctc

SEQ ID NO: 15420 - DNA, 201 bp, Homo sapiens
aataaagtgacttgtccagggtcacatggatactaagtgaccaagtgtcaaagcagaattttccaaataacttaaagataattcttgtacaaatatagaaygaacacatgtcatatgtgttgtgttaatgagggaaccagaaggatgacaacattggttcagagagatgcaaagataaatatagacattggaggaaaaagt

SEQ ID NO: 15421 - DNA, 201 bp, Homo sapiens; identical to SEQ ID NO: 1335

SEQ ID NO: 15422 - DNA, 201 bp, Homo sapiens
ctttttaaaaagagtgggatactttattcagtttagccctcaagcaattaggcaagtcagttaccatggtaacagtaggtattaatttccttacctagttrgaggttttatgaacaaagaaatctctgagttcatccaccaaaacccaactttctcttgagactggcctcttgagactggtgttaaatttgtctattttct

SEQ ID NO: 15423 - DNA, 201 bp, Homo sapiens; identical to SEQ ID NO: 1336

SEQ ID NO: 15424 - DNA, 201 bp, Homo sapiens
gaacaaagaaatctctgagttcatccaccaaaacccaactttctcttgagactggcctcttgagactggtgttaaatttgtctattttctagaagatgacrctattctaagtggaaaatacggttctcttgaggtgaatttctactctatcaagagtgaagtagagtatggcttaaaagttaagtgattaaaaagctaccc

SEQ ID NO: 15425 - DNA, 201 bp, Homo sapiens
tacatattttttcactacatatgacgcatgtggcaaccccaagagttgagttgtacccatcggcaaactttgatcatgattctgtgaatataggcaagcascaattgcaggtagaacattctttttttgagtcccaaaccgtgagaaacaaattacagaaatgtacctttcttttgcattaggacacgttgtagttttgta

SEQ ID NO: 15426 - DNA, 201 bp, Homo sapiens; identical to SEQ ID NO: 1339

SEQ ID NO: 15427 - DNA, 201 bp, Homo sapiens; identical to SEQ ID NO: 1341

SEQ ID NO: 15428 - DNA, 201 bp, Homo sapiens; identical to SEQ ID NO: 1344

SEQ ID NO: 15429 - DNA, 201 bp, Homo sapiens; identical to SEQ ID NO: 1345

SEQ ID NO: 15430 - DNA, 201 bp, Homo sapiens; identical to SEQ ID NO: 1346

SEQ ID NO: 15431 - DNA, 201 bp, Homo sapiens
atgttacttttttgcaactaataccccttctcagtagtacaaagatttgatttctttttctttctatttcctacagacttcatctgcagagagaaagagaygattacctgtgtggtttgccaaaggaagtgataccagcaagaaattaatggacaaaacgaaaaggggaggtctttttagttaagctggcaattaccagaa

SEQ ID NO: 15432 - DNA, 201 bp, Homo sapiens
cattgtcacggatgattttacaataacatccttttctgacatgcattacaacacactattgattccgtttcaatgtttgtgtctggtatgggggcggagtrgagaggctactacaggaagaaagaacaaataacatttcttcttactactttgtgcatcatgtgatttagctcctcccataccattttacattagaaaatg

SEQ ID NO: 15433 - DNA, 201 bp, Homo sapiens
gacgtcattggatcattttcatttcttgggaggattaataaagcacattccttctgttgggcctccagtgcggggagggtgttggccgagcagtggctgaraaaacgtttttcccctggtgttttcaagaaccctctttattagctaagtggtgagacatgccacctggtggttatagtagtatcatttttctcactgttc

SEQ ID NO: 15434 - DNA, 201 bp, Homo sapiens
gatggctcctccctttcaactgcccctcccccacacctttctgcgtgacacatggaaaattgaaagtatctctggttgcttctgcgtaggaatgtaacttygtaaccaatcagacggatcgcaggccaagtcgcctgcatagaaatgtaactttgtaacttcactttagcctctgattggttgctttccacaaccaatcag

SEQ ID NO: 15435 - DNA, 201 bp, Homo sapiens
ttgcattttcttaaattagagccttaatatataggatattacaatatctaggttttgttgagtagttttttcttctttgaaaacatgtttttaaaataagrtttttttttttttttttttgacatggagtcttgctctgtcgcccaggctgtaatgcagtggcgggatcttggctcgttgcagcctctgcctcctgggttc

SEQ ID NO: 15436 - DNA, 201 bp, Homo sapiens
gaatttgttttctcctaactcatgctttcatttgtagatgaatattttattgtttctcctttgcatctatcaaaggaatggaaactcctttgaattgtaaycagcaaacaattcacttttgttagggaaattggatgataattttcctttaaaagataccgccaaacttgagactaacattctcagctgatttaagtagga

SEQ ID NO: 15437 - DNA, 201 bp, Homo sapiens
attccacagtgaatttgttttctcctaactcatgctttcatttgtagatgaatattttattgtttctcctttgcatctatcaaaggaatggaaactccttkgaattgtaaccagcaaacaattcacttttgttagggaaattggatgataattttcctttaaaagataccgccaaacttgagactaacattctcagctgat

SEQ ID NO: 15438 - DNA, 201 bp, Homo sapiens
agtgttcagaatgagcacgatgggtataacatttttgtaggtttttaaagttgaaatttagtgtaaatccaaagaatcaatagacaagtctgtgttttacytaacctatatgtttaaattagcatttttagatactgattttattcctaatttcagaattctcagcgtcttgccgatcaatatcgcaggcacagtttattt

SEQ ID NO: 15439 - DNA, 201 bp, Homo sapiens
gttttaaaaacattattataaatgactttagaaaaattttattatagtagtggcagaaactctaccaaaatattttatatcaatttggcattgaaaaatgmttaggaagacatttagtgaaactattcattttcgatattaattagcaagtaccaatcaacagattgttcaatgctagtttattttcattgtcatgaagcc

SEQ ID NO: 15440 - DNA, 201 bp, Homo sapiens
aagcctactaaccaactttttttcatgaacaatatttttaaagtccaagatttttaatacctacattagggaaattctagaattaaattcttacaatgtgractgcatatgaggcttttagtgacagggaatttgttgaaggctatctgtgggttgtattttggtataacatttcctaattttatttgtggtatgttcatt

SEQ ID NO: 15441 - DNA, 201 bp, Homo sapiens
gtagaaagcctactaaccaactttttttcatgaacaatatttttaaagtccaagatttttaatacctacattagggaaattctagaattaaattcttacartgtggactgcatatgaggcttttagtgacagggaatttgttgaaggctatctgtgggttgtattttggtataacatttcctaattttatttgtggtatgt

SEQ ID NO: 15442 - DNA, 201 bp, Homo sapiens
tcttggtactctttcactttcatatatttgcaaatgtaaaattgtgttttaggtgtatatttttaatccatgtataccagtaacttaaaaaaaaatttttytttttttaagggagagcataatggagctcttgtgatacggtgctcttagtggaagtttggctatcaattccatcacctgtatttcacatattttattaat

SEQ ID NO: 15443 - DNA, 201 bp, Homo sapiens
ggcccgagaggttgaggctgcagtgagccttgatcacaccattgcactccagcctgggcaacagggcaaaaccctgtctcaaacagacaaacaaacaaacraaaggcagaggtaggttaagctatttattaatggtcttctactggtatagatataagctagaaataacattcaagtgtttttacttttactacagttatc

SEQ ID NO: 15444 - DNA, 201 bp, Homo sapiens
ttgcaggcgtgagccaccgcacctggccggcagacagtttctttttttctttttgagacagagtcttgctctgtcgcccaggctggagtgcagtggtgcartcttggctcactgaaacctctgcctcctgggttcaagcgattctcctgcctcagcctcccgagtagctggcactacaggcgtgccaccacacccagctaa

SEQ ID NO: 15445 - DNA, 201 bp, Homo sapiens
tgtctgaaaatattatataatgttattttgcccatttaaaaactttaaaaaatgctaacaaactgtgtactctgtaacttgtcttttttactcaacactaygtttttgagaatttttcttgttgatctgtgtagttccattttaactgttatatcttactatgtttcattatgcaacagttggttcaatccattctcttgt

SEQ ID NO: 15446 - DNA, 201 bp, Homo sapiens
catggttctagtctcgagctgtaggattttgatcactgtttcaaacaataatgtgagtttgctaagaggtctaaataacaaaagctaagtgttccaaacayatatccaaacctatacactgggcaatgcatctgaattatatgtgaaatttcctgccattatttaagacacaaaaggaacattattttgataatgtattta

SEQ ID NO: 15447 - DNA, 201 bp, Homo sapiens
ctttatttatttatttatttttaacttttgtttcaagatcggggtacatgtgcatgtttgttacacaggtaaacttgtgtcatgggggtttatcatacagmttattttatcacccgggtattaagcctggtacccattagttatttttcctgattttcttcctccctcctcccaccctccacctcccacagtgtgtgttgt

SEQ ID NO: 15448 - DNA, 201 bp, Homo sapiens
ctttattgaagtatgcagaatgtaaatgaattgtttttataactttggcacttgctgtatcttagaacattcttttgatgatttattttctgtagttttgrgagagataagacattggaatgcgtttctaactacctttagaactttagaaactgataatttaggaggttattttcaggtgattaatttgacagcttgatt

SEQ ID NO: 15449 - DNA, 201 bp, Homo sapiens
gtagctggcactacaggcgtgccaccacacccagctaattttttgtattttttttagtagagacgaggtttcaccgtgttagccaggatggtcttgatctyctgacctcatgatccacctgcctcggtctcccaaagtgctgggattacatacagtttctttaagcaagccttctcttttccttcctcccagttcttggta

SEQ ID NO: 15450 - DNA, 201 bp, Homo sapiens
taattttatttgtggtatgttcatttgatatcatttggtaatacctgaaaacaggaactgattttactgtgttgctttttcatcatttctagctgaaatgyacagagacctggagccttaacagtctggttaaacacctcttaggtaaacagctcctgaaagacaagtctatccgctgtagcaattggagtaaatttcctc

SEQ ID NO: 15451 - DNA, 201 bp, Homo sapiens
ttcttttactttgtagcattgctatgtatttggcttctagagttggggctttgtggctttcttattgcagtgacacaaccagctttctcctagtctggagrttatacatccttgctataagtatttaaaatgctttctatataatgctttaaaacatgtaagatggcttatccccaagatggtagctaataaacactaagt

SEQ ID NO: 15452 - DNA, 201 bp, Homo sapiens
ttgagaccagcctggccaaaatggtgaaacaccatctctactaaaaatacaaaaaattagctgagtgtggtgacgggcacctgtaatcccagcttcttggraggctgaggcaggagaatcgctttaatctgggaggtggaggttgtagtgagctgagattgcaccattgcactccagcctgcacaagagcgagactctgtc

SEQ ID NO: 15453 - DNA, 201 bp, Homo sapiens
agagaaattatggtatctataggtaattgaaagtaattcagtatagtgaacattgaatagggctgggcggatgaaggcaaagcagaaaaaggaaagcagawgggccatggtaaggagtttatatctcctcccaagagcaatcgaagtgactgagagttttaaacacagcagtgaagtgaattacattaaaaaaataagaac

SEQ ID NO: 15454 - DNA, 201 bp, Homo sapiens
catcgaagtcaatctaaacatattattggccatttagttaaaaaaagaaagaaaagaaaagcaatatgcttgtggacatacaccagttactttatgtgcartaaaagagtaggaaggggaaggtgaaagaatagagaaaactatgtagtcaggatgtggtggaaccaaattgcaactttcttttttttttttttttttttg

SEQ ID NO: 15455 - DNA, 201 bp, Homo sapiens
attaaagagtttaaggatatccaaaatacttggcaaagtaatctgaaataatactcttaggaaggtagggcaagaatgtgattctagtaagcaaaaatgtratcaaatcgtattctagtcccagctactcgggaggctgaggcaggagaatggcgtgaacctgggaggcggagcttggagtaagccgagatcgtgccactg

SEQ ID NO: 15456 - DNA, 201 bp, Homo sapiens
gggaggcggagcttggagtaagccgagatcgtgccactgcactccagcctgggcgacagagcgagactccatctcaaaaaaaaaaaaagactatatgaacwtgtatggcataaatatgtacaaatattatttattttaaaaaaattcaggggtagggacagggtagttagaaaatatctaaggatgttcatgaaataatac

SEQ ID NO: 15457 - DNA, 201 bp, Homo sapiens
ccacgcccagctaatttttgtgtgtttagtggagatgtggtttcgccatgttggccaggctggtctcgaactcctggtctcaagtcttccgcccacctcakcctcccaaagtgctagaattataggcatgagctaccacacctgacctcaaaatacatttaatagagcaagcatgagccactatgcccagcctcaaaatac

SEQ ID NO: 15458 - DNA, 201 bp, Homo sapiens
actttgcaaatatgcatatttattaaaaatgtactttaaaatagagattaaaattctcgtattgaatgtagaataggtaagcatttatttgtgaaatactygaatgcttcatgtaaatactttctgagtttgtatttttagaaaggaacattttggaggctgaggcaggagaatggcgtgaacgtgggaggcggagcttgc

SEQ ID NO: 15459 - DNA, 201 bp, Homo sapiens
caattcacagtaggttttgcgctgctatgagaatctaatgccaccgttgatgtgtcaggaggtggagctcaggtggtaacgtgaggaatggggagcagctrtaaagaaaaatgaagcttcgcttgcttgcctgctgctcacctactgctttgtggcctggttcctaacaggccatggactggtactaatctgtggccctgg

SEQ ID NO: 15460 - DNA, 201 bp, Homo sapiens
ttatctgaacaggctattaaaatactcttctcttttccaactacgtgcctgtgcaaagtcagatttttttcatatacttcagccaaaacagcatatcaaartggattgaatgcagaagtagatctgagaatacagccacttttgttaagccagacaatgagatttgcaaaatgtaaacaatgctgctgttctcagttttta

SEQ ID NO: 15461 - DNA, 201 bp, Homo sapiens
atgaattgttagtacacagtgtttctcagtaaagtattattaagcaacagttatctagttttcaaatgtacatcttaagaagcttttaagatggaaggatvcactaaatcccccaataccctttttagttggggaaggttagtacttctgtgaattctgagatatcatatttgtgttagtgactgttcataggttccttgc

SEQ ID NO: 15462 - DNA, 201 bp, Homo sapiens
ttgatgtcattgaatagtggtgtctacctaaaaggaagaggctggggcacaaaattataatttaaagtgtttacttcagccaaaatgaggacagctgcccrggactcatttcccagttgccttggggagtgctccttcagccttggttacaagcaggtttttaaaggcgaaggggaagagtgggctgagacaaagttggtc

SEQ ID NO: 15463 - DNA, 201 bp, Homo sapiens
gttcagatcttgatgtcattgaatagtggtgtctacctaaaaggaagaggctggggcacaaaattataatttaaagtgtttacttcagccaaaatgaggamagctgcccaggactcatttcccagttgccttggggagtgctccttcagccttggttacaagcaggtttttaaaggcgaaggggaagagtgggctgagaca

SEQ ID NO: 15464 - DNA, 201 bp, Homo sapiens
ctattgaagagggtaatataattcttaggatgctaatacaggagtctgtaagtcggagtacttcaggctttttatggttcggtacatttctttttaggggwgggatattgggataagtaggacagttcagatcttgatgtcattgaatagtggtgtctacctaaaaggaagaggctggggcacaaaattataatttaaagt

SEQ ID NO: 15465 - DNA, 201 bp, Homo sapiens
tgtttaccttgcgcgcttagttaggattgctctttctagtacggcctttattatggcagaaattgagccactacaggtctgcacagcaaagtcgagggaartaacctgctgtctatgatttagcaagtgatgatggatatttttgagttcaaatcactcagtctttaatggattttcttttctttttttcctagttgaatc

SEQ ID NO: 15466 - DNA, 201 bp, Homo sapiens
ctgggctgtgtttgggagattctggaaaaacagactttctcccttttcctttcccctctggagcagctgggaaaggcgtctctcggagcttccgccattcmgaaagtgtttccccgcccctgacggccccagcttgatgtttaccttgcgcgcttagttaggattgctctttctagtacggcctttattatggcagaaatt

SEQ ID NO: 15467 - DNA, 201 bp, Homo sapiens
aggagttcaagaccagcctggccaacatgatgaaactccgtttctactaaaagtacaaaaattagctgggcgtggtgttgggtgcctgtaatcccagctaytcaggaggctgaggcaggagaattgcttgaacccaggaggtggaggttgcagtgagtcaagattgtgccactgcacttcagcctgggagacagagcgaga

SEQ ID NO: 15468 - DNA, 201 bp, Homo sapiens
agttttaaagaacaagtttgattgaaatctaaactttgtacaatcctgaattgagaagtttcctgtattttattatgacacaatatttacctaaaaatagrgtaattatgaattgagaaaacatagctattaatttcatactcttatttgttaagtagattttgtctggaaaactgttcatatttaaaggagctttgtacc

SEQ ID NO: 15469 - DNA, 201 bp, Homo sapiens
cgggtaggtctcccggagctgatgtgtactgtgtgcgccggggaggcgccggcttgtactcggcagcgcgggaataaagtttgctgatttggtgtctagcstggatgcctgggttgcaggccctgcttgtggtggcgctccacagtcatccggctgaagaagacctgttggactggatcttctcggggtaaagtgtcttcc

SEQ ID NO: 15470 - DNA, 201 bp, Homo sapiens
tgaattgagtgtcaaatatttgatatgttttgtaaattaggtgaagatgagtgagtaggttctaaactgcttgggtttaccgcactctggagcattgcagragaatgtgatgttggaaggaagtgctgaaacataattattggcttgcctataggagggtgctacataattttagaaggtgtcaagaaagtgacacagtct

SEQ ID NO: 15471 - DNA, 201 bp, Homo sapiens; identical to SEQ ID NO: 1378

SEQ ID NO: 15472 - DNA, 201 bp, Homo sapiens
gagcattgcagaagaatgtgatgttggaaggaagtgctgaaacataattattggcttgcctataggagggtgctacataattttagaaggtgtcaagaaaktgacacagtctgaattagttctgttgagttgcaaaaaatgtaaagtttcttgattctgaaaataagaaatatgttcccagaaatctcatctagttaatgt

SEQ ID NO: 15473 - DNA, 201 bp, Homo sapiens; identical to SEQ ID NO: 1379

SEQ ID NO: 15474 - DNA, 201 bp, Homo sapiens; identical to SEQ ID NO: 1381

SEQ ID NO: 15475 - DNA, 201 bp, Homo sapiens; identical to SEQ ID NO: 1380

SEQ ID NO: 15476 - DNA, 201 bp, Homo sapiens; identical to SEQ ID NO: 1382

SEQ ID NO: 15477 - DNA, 201 bp, Homo sapiens
aaatttagtattatgttagatggtacgttttattaaaatcaaatgcttcaaaaataattgctctgtgtatggcatgagataaatagcaatcagatatattrtttaataatatgactctattaaatgatggcataaatttgaaaatttgaccttcggtatcttccgggtctaaaattatatgactccattataaatattttg

SEQ ID NO: 15478 - DNA, 201 bp, Homo sapiens
tttactaagcttgctagattctaaaaggtataccttatttggccccttttccccatttaggggaacaagggtgttggggctgggaagtagataagaggtgagtaagtcatccaaagcatatgtcttcattagcctccctgtatgaaaagctgatttctgtagagtgttggaggcctactttcagaatctgtcatatgttaa

SEQ ID NO: 15479 - DNA, 201 bp, Homo sapiens
aatgtctaaaatatggaaacttggtttatgagatctactctgccatttttatctgggctttctcttccttttgtctctgttgtacctgtcctgcttggttytgatttaaccccagtggtttctcctgaatgtggagccttctcctagaaggcagcctcggctagtcccagggttcagagtagccagctgctctcttcacct

SEQ ID NO: 15480 - DNA, 201 bp, Homo sapiens; identical to SEQ ID NO: 1357

SEQ ID NO: 15481 - DNA, 201 bp, Homo sapiens; identical to SEQ ID NO: 1358

SEQ ID NO: 15482 - DNA, 201 bp, Homo sapiens
catcaccgccgccgccgatgcccttcacgaccaccgccgccgccaccgccagctctcggcccctctgctgcagccgccgcagccgccgccccccgcctccycccccgccgccgccgctcgcactgccccccgccggagcagccgggcaggggcatcgcccgcggcgcccaccgcagccgcccctcctgcggccgctgcggg

SEQ ID NO: 15483 - DNA, 201 bp, Homo sapiens
tcctggatttcggctgcgcccccggcctgattaggggtggctgaggccgcgtagtgggggtagtgggagtgctgggcctggggatagagtctactcttgcytaggccagagccccctacattcttgcctccgcggccgcggccgccgccgcctccccttcgcctggctctttccatcttcagctgcaagtaacaaacagac

SEQ ID NO: 15484 - DNA, 201 bp, Homo sapiens
ccccaaaatagtgggattataggtgtgagccaccatgcacagccttacataaagccttttctaatgagatggatagtaattaacaaatgtgagtttttgawattatataaagattttttctgtgtttcgaagatccgtataactcagtgaatcagtatgttctggatgactaatatgtgatgttaagaaatcatgactgag

SEQ ID NO: 15485 - DNA, 201 bp, Homo sapiens
tgctatagccttgaattcctgggctcatgtgatacttctgcttcagcctcctgagtagctgggactataggcgtgcaccactatgcccagctgctttgaayattcttgaaatgaaatatggtatagtctcataccatatcatagccagagggggagagagagaattttgttgttgttgttatgttatctgtagtggacttt

SEQ ID NO: 15486 - DNA, 201 bp, Homo sapiens
ctatcatgccagtcccccgcatcatggtttgtctaatccgtaggaagcgaccccgctgattttcctttaggtctaggtaatatttcctattgtccctctckatatagtctgttttcaggacactgtgaggatgctcttcggaccccaccgagactggtggggagggtgccgagtgcttctgcctccttctggagccttgct

SEQ ID NO: 15487 - DNA, 201 bp, Homo sapiens
cagagggggagagagagaattttgttgttgttgttatgttatctgtagtggactttatgccttcccagcataaattctctctttccccatttttcgtgacycttgatttttgttggggttcgttccaaggagaataatttccatctggatattggattggcacctgtgacctcttctgagctagaccctagtaacagcgtt

SEQ ID NO: 15488 - DNA, 201 bp, Homo sapiens
gaaccttttattgtccactctgaaagaagtcccctctgggagttcaagcgggtcatcgtctccacctcttcgttcttctatgtctccttcgccatagtctkcaatcagctgaaccaaggcatcacgaaactcaatcattccttgtgctgggaggacaatagtctgttcttggcccaaactgtggccaaaataacctatcat

SEQ ID NO: 15489 - DNA, 201 bp, Homo sapiens
atccaaacctggtcatgcttcccatgctcagaggcaaatctccctccccttggggggcggagtcagacgagaccccctctccatccttttccaggtccggygggggcgggactttaaaggtaaaaacagcaattacttttgcaccaacttatcttctaagtttcgctccctaccacctgagtgtgtttggaggctctggct

SEQ ID NO: 15490 - DNA, 201 bp, Homo sapiens
cacttaccttcaggaaaattccatatttattagagcccacatcaaagtagaaccttttattgtccactctgaaagaagtcccctctgggagttcaagcggrtcatcgtctccacctcttcgttcttctatgtctccttcgccatagtcttcaatcagctgaaccaaggcatcacgaaactcaatcattccttgtgctggga

SEQ ID NO: 15491 - DNA, 201 bp, Homo sapiens
ttaagagggacagatttactctgaagattcaatgaaaaaacatccacaaacaacttttctacaagaaacaaaacattttaaagaaaacatttacttcagcygggcgcggtggcttacgcctgtaatcccagcactttgggagggcgaggtgggtgcatcacgaggtcagaagttcgaaaccagactggccagtatggtgaa

SEQ ID NO: 15492 - DNA, 201 bp, Homo sapiens
tggcagaaggcttaataattttagagtatactcaattgccagtatatatgcatctatttaatctgcagctttgagatggtaaaaactttgaagtatacatmcaaagtagaaaatctggctgcttaactaattctttacttaaataattaatggaaaactaaatttaataatgtttatatacaatgagttaaagatatttat

SEQ ID NO: 15493 - DNA, 201 bp, Homo sapiens
taagcatcttcctcatgctttcagtaaattggaaaacccacggaggttaaatattaccttttttttttttaacttaaatcaattctgtttatttttttatyacattttcctatatgtgaagaatactattcattaaggctgactcatagaaatttgcttgaatacacacacacagactgatgcataaatttgagaaatatc

SEQ ID NO: 15494 - DNA, 201 bp, Homo sapiens
catattgcctaggctggtcttgaactcctaagctcaagcaatcttcccgcctcagtctccaaagttctggcactacaggtgtgagccactgtgcctggccyctttttctcatttaaatacttttcataccttttgtaaaacgggttccttgttgcctgtctatgccttcctcctccttcttaatgacaccacgttaattct

SEQ ID NO: 15495 - DNA, 201 bp, Homo sapiens
ctgggtgctaaggctgtctgcaggctactaatatgcataataacaatcctgaaaaagaaggaaaagtatactgtgccttactgaagaaggcaggacagcckttggtatttgttagagtaaatattagttatcttacataaagcatgttatattccctgatgtcagggcctgataaatgagcccttacactcttgatagtca

SEQ ID NO: 15496 - DNA, 201 bp, Homo sapiens
cctactaaactatttgcatataattttaacatttgagtggctgtatataaagctaaaagttctttataagatttatagcatcttagaatgtttaaattagrtaacattagtgtgcttttagtttttgaatttaattttgctcttgattttgtttgtgttaatgtagactttgtctacgtaagcttgagcccaactttggag

SEQ ID NO: 15497 - DNA, 201 bp, Homo sapiens
cccgccccaaattttcttttaacttaaagtgttaatgtttgtttgttcccaatatttttatatatgtcaaggctttttcattatatacaggccagctcttkggagttctgcatagtgtttcttgtttaaaccacacctataatgtaccatctacaatttccaattctttaagacagagtgaaaaattaagacacctgaagc

SEQ ID NO: 15498 - DNA, 201 bp, Homo sapiens
gtgccttgatgctagagagtagcctgcaagctgtaattatatatgggcattagggaatgaagaacagccttaatactattgatcttttaagtgaaggtcascttagaaagcttttacttgttaaaaagcttcacagtttgtccttgtagttaatgcaattgaagttgaattaatctttcttaattttttttttagggtttc

SEQ ID NO: 15499 - DNA, 201 bp, Homo sapiens
ctgcacctggccttggatttcgtgatttgactgacatcttttacaccaattattgccatttttttattgggtactaattattagtattgctttctttattygttaaataagaagtaaaagaacttttaaaaaataaaataactttttttcctagtacaaagcttattttcaattttttttattgcttaaattttgcaggtt

SEQ ID NO: 15500 - DNA, 201 bp, Homo sapiens
tcgaaaactgtatcttcgggcaccaaagagcattgttataatcaagtaccagttgaattaagtacagagaagaaggtttgttttaaagaaattgttctgayttatttcattctttattgattcaaattctgtttaaaattttatattttaattcctttccaattaaagagaaaatggcatatataacaaagcataaaattc

SEQ ID NO: 15501 - DNA, 201 bp, Homo sapiens
aatgagattccttcacgctactagaggaaatgtgaaatacaatctgcaaaccaacactagtatatatgtcggggttactgattgcttgttcttaagtaacmtaaaccaatgaaattaatttttttaattcataccatcaagttttcttagtgacctcacgtaaaggtattgggggacaaaactctggaagaaaaaaatcgc

SEQ ID NO: 15502 - DNA, 201 bp, Homo sapiens
ttcacccaacatacagttttatgttattttatttttttatttttgagatggagtttcactcttgttgcccaggctggagtgcaatggcgtgaactcacctyactgcaacctctgcctcccgggttcaagcgattcttctgctcagcctccccagtagttaggattataggtacgtgccaccatgcctagctaattttgtat

SEQ ID NO: 15503 - DNA, 201 bp, Homo sapiens
tctctagaagagcatagctgagagcaggattctgcctctcatgacaattggcatgcacttatcccaagcggtgaaagctggctgcccccttgatttggagygagcaggcctgactccagaggttcagaagattattgctgatgttatccgaaaccctcccgtcaactcaggtgagaggcatggcctagctctgcaccctta

SEQ ID NO: 15504 - DNA, 201 bp, Homo sapiens
tttgtctgaagacttgtctcactgtgttgcccaggctggagtgtagtggtgcgatcactgctcactgcagccttgaccccctggactcaagctatcctcgyacctcagcctcccgagtagctgggactacagaacatgccaccatgctcagctaatttttgtattttttgtagagacagggttttgccatattgcctaggc

SEQ ID NO: 15505 - DNA, 201 bp, Homo sapiens
tcatattcaatatttataaaatctaactcattatttacccaccctgcattttatccaaatgccgaaactcctctttttggattctttatttttgattatcwtaccatcacatttgtagtcagaggttcctaatgcttaaaacctctgatctgaattttctctcctccaatataaaaccccttcgtcttcctcttcttcttc

SEQ ID NO: 15506 - DNA, 201 bp, Homo sapiens
aaggcgatcctcctgccttggctttccaaagtgccgggattacaggcgtgaaccaccgcacctgatgcagttgttgttgttgttgttgttttaatatctgrttattattttattgtatttcattgaatatagcacagtttgtttttacattttcttattgatagacacctaggctatttttctggttttggactgttacta

SEQ ID NO: 15507 - DNA, 201 bp, Homo sapiens
ttcccaccagcagtgtatgagaggtccagttcctccccatccttgctatcacttagtctggctgatctttaacttaagccattctaatagtatctcattgkatttttagtttgcttttccctaatgactaattatattgagcatttttcatacacttattggccatctgtatatcttctttgagggagtatctgttcaaat

SEQ ID NO: 15508 - DNA, 201 bp, Homo sapiens
atggtacctgttacagtgctagttatgaaagaaagaaagagagagagagagaaggaaggaagggagaaaggaaggaaggggctgggagtggtggctcacasctgtaatcccagcactttgggaggccgaggcgggtggatcatgaggtcaggagatcgagaccatcctggcgaacatggtgaaaccctgtctctactaaaa

SEQ ID NO: 15509 - DNA, 201 bp, Homo sapiens
gcatgaacccgggaggcagagcttgcagtgagccgagattgcgccactgcactttagcctaagaaaaggaaggaaggaaggaaggaaggaaggaaggaaawatcagtcactcactcaggtttagtttcaaaagccaaaacagtgataatattgaattttttccagccactcagtagtacccagagaattttgatacaaata

SEQ ID NO: 15510 - DNA, 201 bp, Homo sapiens
cctttaaaaatataaagagttacatttttcactggtgggccataacaaaacaggctgtgggccatatttgtccgaatgtcttctcagtgatctttcatccrtatgtccttttactctaggatgctgtgaaatcctggttaccccttcttgtatcacattgaaaacctaaagtttgaactattctatagaaattttattaaa

SEQ ID NO: 15511 - DNA, 201 bp, Homo sapiens
gttttgttttgttttttgctttttaactgcagtattttgaggagtcttggagtagcaagctaatctttggaagaaaggaaaatataaacctgaaaactaayaatttaaagaacgtcttttcaggttgtcatttgaaaaatacttgatttctgatcactgatttgaattgagtgtcaaatatttgatatgttttgtaaatta

SEQ ID NO: 15512 - DNA, 201 bp, Homo sapiens
taggaatttttcagctccattataatcttatgggaccactgttccacatgtgctctgtcattgacagaaatgccgttaagtaccacatgactatttttttyggtggtctgttcctttttattattacagagtattccacagtatggttgtaccacagtttaactgatcacctgttgaagaacttttgggttgttttccagt

SEQ ID NO: 15513 - DNA, 201 bp, Homo sapiens
aggaatttttcagctccattataatcttatgggaccactgttccacatgtgctctgtcattgacagaaatgccgttaagtaccacatgactattttttttrgtggtctgttcctttttattattacagagtattccacagtatggttgtaccacagtttaactgatcacctgttgaagaacttttgggttgttttccagtt

SEQ ID NO: 15514 - DNA, 201 bp, Homo sapiens
ctgcagtattttgaggagtcttggagtagcaagctaatctttggaagaaaggaaaatataaacctgaaaactaacaatttaaagaacgtcttttcaggttdtcatttgaaaaatacttgatttctgatcactgatttgaattgagtgtcaaatatttgatatgttttgtaaattaggtgaagatgagtgagtaggttctaa

SEQ ID NO: 15515 - DNA, 201 bp, Homo sapiens
ttgtctataggatgttctcccatacttctctcagatctcttggatttaggcctcctgggccaccatatttgaaatatcagattagttccccctcccccatyattcagcattcctcgtaaatctttgctgttttaaaaatagcactatcactgtctaacttactgtgttatattttgttaattttctgtgagttcttcttca

SEQ ID NO: 15516 - DNA, 201 bp, Homo sapiens
tctcctcctatgtcatttttttcttcttatttttcttgactgtataagagagaatgtatgacatttcctgcttgaccgctgagtttgattataaattaaawtacacaatattttatacaaattgttttgtagaagatttatttacagatgctcattcacaggtaaaattgacttatgaaaatagttttcatgacaaatgta

SEQ ID NO: 15517 - DNA, 201 bp, Homo sapiens
aatggattgaatgcagaagtagatctgagaatacagccacttttgttaagccagacaatgagatttgcaaaatgtaaacaatgctgctgttctcagttttwaaaaatatgttttttaaaagtatttatgttaatgtgtacttggtttactactgctatttttaaataaaacaagaaacatttttaaatgtctgttttaatt

SEQ ID NO: 15518 - DNA, 201 bp, Homo sapiens
tgaattcactcttttgtgaggtttatctccaaaaaaggcaatattcacatatttgcaaagcatttagtactataacttcttgaatgtctgagcagtcctgrcattagggtgggatccatcagggcccaagatgagtgtttcatctttgttacttgtggcaaagcagcccttacttcttttactttgtagcattgctatgta

SEQ ID NO: 15519 - DNA, 201 bp, Homo sapiens
taagagttgtagttttgttttctcaaatttgtcctgacactgacgagattagttaaatgtaggtcatctgaaccaaatacaaggaaggaaggacccagttytgaagagtgtgggcatttcttttcttgtttttttttttttttttttttttttctataggaggggaacgaggtgaactaaacaaacaaaataaagcaaaaa

SEQ ID NO: 15520 - DNA, 201 bp, Homo sapiens
gtttgtactgatttggaaagacattctcatttaggggatgaaatagaaagtcaatgaggagaaagaaaagcttttattatttattttcttttaaatatttyagtatcatggtacagtcaccagaaaaagcttacagttcctcacagcctgttatttcggcacaagagcaggagactcaggtaaggcttttgtaaaaaggta

SEQ ID NO: 15521 - DNA, 201 bp, Homo sapiens
aacactacattcattactttggataaaacccgtgtgtatggcatcttctgctgttttcatgttcaagccgatgttcagctctgcagctcagtctggaagcrttgtgttaatttatcacattgcatttgggtgaatccctagactagtcttgcttaggataattaggaaaagttaactttcattgtatcaagggacaggtag

SEQ ID NO: 15522 - DNA, 201 bp, Homo sapiens
aatgaacaggttcttttcctctcctcagatcctgtcaagttgcgatgtcttcagccatagttacttcaactaccactgattttgttactgattctttcttmccatgctacagtggtgattattccagaggatttctctcagtccctatttgactcttgttactatttgttttcttggttagttccatgagaccatgccagt

SEQ ID NO: 15523 - DNA, 201 bp, Homo sapiens
tggtaagttgtacttaagcaaaacctaatcctttaaaaaaataaaacataaagagtttgaaatgcttaatctttcattaaactctcaaaatacaaatgcarctacaaatgatgtaaactatagaagagagtgaacaaagaacagatgctcagatttatgtatcaattagcttttaggaagatagcatactagtattgacca

SEQ ID NO: 15524 - DNA, 201 bp, Homo sapiens
gacaatacttgggcctgtcacagagatcctatggaatactttcctaccattgtgcattaatgaacaggttcttttcctctcctcagatcctgtcaagttgygatgtcttcagccatagttacttcaactaccactgattttgttactgattctttcttcccatgctacagtggtgattattccagaggatttctctcagtc

SEQ ID NO: 15525 - DNA, 201 bp, Homo sapiens
ttagcacaaggaaagacattcatcataggtttgtaagagatgaaattcaggtatgaggatcaatcatcattgctctccgttgctcatagtggaagtggatrtttctcaaatgtttatttaccagatctttattgaatactttctttgtgttgaacataaagcagtccctctgataaatgtgggagaacaaacttgcagatt

SEQ ID NO: 15526 - DNA, 201 bp, Homo sapiens
ttctttctttccatataaacctcaaaagtgtttgaggctatttccagtatcccaagtaatttgtgagtgcatttaaagtaaaaaaaaaaaaaaagaaaaakaaaacctccccaaatccagaggacatgtaagaagaacatttgtggtaagagttgccacttggagatgagctaatttcagcatgccttagttagtgtgagg

SEQ ID NO: 15527 - DNA, 201 bp, Homo sapiens
aaactgaagcttagagagttaaataaagagctcaaaatctcacatctagtaagtggcaaaaacaggatttcagctcaagcaatctgattccaaaacagacytttttcactgtgctgccattcttttgcctggtttttctgttaacttcttaaatatatgtcatgtttcatgcttacttcctcattttcataaatatattac

SEQ ID NO: 15528 - DNA, 201 bp, Homo sapiens
acagctgataatttagaaacaactgtaagacagtccactttttctgattatgaaataataccatagttaagtgtaatttcctataatagaataaaaacacsagttctagttttaggggaggcatgttgttactgtaccttagaatttctggaagatgacatattcatgcttttcctgataactgctgagtctcctgctctg

SEQ ID NO: 15529 - DNA, 201 bp, Homo sapiens
actctgcttgctcgtcctattattgacattattcctttctgtggtctgaggtgcctcccatgaaacttgcttctaggacactaggattgagaaccatcagygtaacatatctgttacgctacaatagtttattttcatattttagctactttacatactcgggtataatgaactttattcatagcttctgaagcagttggc

SEQ ID NO: 15530 - DNA, 201 bp, Homo sapiens
gctgataatttagaaacaactgtaagacagtccactttttctgattatgaaataataccatagttaagtgtaatttcctataatagaataaaaacacgagwtctagttttaggggaggcatgttgttactgtaccttagaatttctggaagatgacatattcatgcttttcctgataactgctgagtctcctgctctgtct

SEQ ID NO: 15531 - DNA, 201 bp, Homo sapiens
ggagctgttctagctataaatatggcaactctgcttgctcgtcctattattgacattattcctttctgtggtctgaggtgcctcccatgaaacttgcttcyaggacactaggattgagaaccatcagcgtaacatatctgttacgctacaatagtttattttcatattttagctactttacatactcgggtataatgaact

SEQ ID NO: 15532 - DNA, 201 bp, Homo sapiens
gtccactttttctgattatgaaataataccatagttaagtgtaatttcctataatagaataaaaacacgagttctagttttaggggaggcatgttgttacygtaccttagaatttctggaagatgacatattcatgcttttcctgataactgctgagtctcctgctctgtctgccaatccagtcaagaagcctttgctagc

SEQ ID NO: 15533 - DNA, 201 bp, Homo sapiens
atatagtatgttattgattatctcagtaccactgaagagaggttatctgggtcattggagctttgcttctagatttgtgaagccataaacctatatatttmaaataggaggccaaaaaaaaacgaccattgctttatatagttagattttcagtgaattgagagtttatcatttgtaattatacattaatcaaatataagg

SEQ ID NO: 15534 - DNA, 201 bp, Homo sapiens
ttttcatgcacttaaatatatcattatttttgataggctttcttcctttagtcttttctttagaaggtagaaaggaagaattaaataagataaaaccaaaygggtctgaagcatgtataaagtatatatgtttgctcttttgttcttctttttctttagttcccactgggaatttgaaggtccaacaatcatctactgtcc

SEQ ID NO: 15535 - DNA, 201 bp, Homo sapiens
atatgagacattctatcaattttaccctcttaaagatgcagagataatgcattatgtttcatcccaccatctttaatgagaagcttccatcttagattaayattagagaatgttaaaatactctgcaatcaggtaaggacgcttgaaacttcattataatgcaaaagttttctttaacacaataaatattttgaacccttt

SEQ ID NO: 15536 - DNA, 201 bp, Homo sapiens
tgtttcatcccaccatctttaatgagaagcttccatcttagattaatattagagaatgttaaaatactctgcaatcaggtaaggacgcttgaaacttcatyataatgcaaaagttttctttaacacaataaatattttgaaccctttttgtgtcttgtattcataggagttcagatagaccactttatttactatttttta

SEQ ID NO: 15537 - DNA, 201 bp, Homo sapiens
aatattagagaatgttaaaatactctgcaatcaggtaaggacgcttgaaacttcattataatgcaaaagttttctttaacacaataaatattttgaacccyttttgtgtcttgtattcataggagttcagatagaccactttatttactattttttatagagagtgaacagaaatcccatttctagtcaccagtccttaat

SEQ ID NO: 15538 - DNA, 201 bp, Homo sapiens
atgatgaataaattctaagcaggggaagtgtttgggaaagcagggcaggctttgtgctgttgatggcaaatgatgtaccagacaggatgaagttgagaatytggaagttgatcactgattagaaaggcttacattttattttggccgggggtggcagctcatgcctgtaatcccagcactttgggaggccaaggtgggcgg

SEQ ID NO: 15539 - DNA, 201 bp, Homo sapiens
tttttcttgtcatttatcaatcaggactgtttgctttagttaagaaatactcaaggtcaatgtgtttctgaatttaaaattactgttaaatacaaatttayacataaacatggtatgtataagaagtaggacataaatccatcatacttgacagaacttatggaaataacaagaaaatgttacagtttttccccagggatt

SEQ ID NO: 15540 - DNA, 201 bp, Homo sapiens
ttggaatgggcattaataaagctgacattcgccaagtcattcattacggtgctcctaaggacatggaatcatattatcaggagattggtagagctggtcgygatggacttcaaagttcttgtcacgtcctctgggctcctgcagacattaacttaaataggtaaaaaaaatttattgtttttactcttgcagatttctttc

SEQ ID NO: 15541 - DNA, 201 bp, Homo sapiens
cgaacaaattattcttacaaaaaggtataaatgtaaggttttcattctgctaaatatgtttgtcaaactgtgttgtgatttgttctcagtgtgtcatagckaccatagcttttggaatgggcattaataaagctgacattcgccaagtcattcattacggtgctcctaaggacatggaatcatattatcaggagattggta

SEQ ID NO: 15542 - DNA, 201 bp, Homo sapiens
aaaggctttttttttttttttttgcaacacacctttaacactaaagtccaatatttatataattggtcaagtaagtggagctgttctagctataaatatgrcaactctgcttgctcgtcctattattgacattattcctttctgtggtctgaggtgcctcccatgaaacttgcttctaggacactaggattgagaaccatc

SEQ ID NO: 15543 - DNA, 201 bp, Homo sapiens
tgaacagaaatcccatttctagtcaccagtccttaatctgtaaatcaggcagataatctgtaaatgattggttgaaatcacattgaattccactttgtgcyagggacttaagttaacgaacaaattattcttacaaaaaggtataaatgtaaggttttcattctgctaaatatgtttgtcaaactgtgttgtgatttgttc

SEQ ID NO: 15544 - DNA, 201 bp, Homo sapiens
aatatcttattcatctttctgagaatggagtatcatgattcatgaattagatacttgcatcttaacatttgaaataatttaattttattattttttagttygaaaactgtatcttcgggcaccaaagagcattgttataatcaagtaccagttgaattaagtacagagaagaaggtttgttttaaagaaattgttctgatt

SEQ ID NO: 15545 - DNA, 201 bp, Homo sapiens
cttgtgacctgggtacattttgcaaagccacaggtttgcagtgttacacaagggccaaaggaggccatgagttgtctttggttgtggggccggagggtaaytgttcatgaaaatagtgagtgtctgaagattaagaaaatcatgctgcagcagaggagaagggagaggaaggcaggaagggaaaggagatgcctgagggtc

SEQ ID NO: 15546 - DNA, 201 bp, Homo sapiens
atttggaaaatatatctaagttgataatatgaccatagcttccactgtcacatctgggaggtgactcagattccccctgctgcgatgcttatctctttgcyaagctttagtaccgtgtttctgtatgaataaaaaccagttacgttttcagcaatcatattcaatatttataaaatctaactcattatttacccaccctgc

SEQ ID NO: 15547 - DNA, 201 bp, Homo sapiens
acaacctttttagctgattcttttggtactttaccactatatcttgccatagtttatgtacctggctcctacttaattttttgtttatttgtgtattagtygtaggcattatttatcgactcttctctctgaaagatgaaaggttagctctctttcacattcttaactgcccttttttcttaccttgtccatgtatttcta

SEQ ID NO: 15548 - DNA, 201 bp, Homo sapiens
gttttcaccatgttggccaggctggtcttgaatgcctgacttcaagtgatccacccgcctcagcctcccaaagtgctgggattacaggcgtgagccactgygcctggccaaattgtagctttctaattgagactgtcttcttggtctggaagagcagagttctgcagtaaaataacaggtcccccttttagtagacatctc

SEQ ID NO: 15549 - DNA, 201 bp, Homo sapiens
tcaaaaaattgctgagtcttattcagccagagcttttacttagtatgatattcattcctatatttacttttttctcacctttctcatactttcttttactyactcagcattttcctcctttcctccctcctttcttttcttctttccttcttttctcttcctttcgtattcctggtccatcttagcatgtaatctttcttt

SEQ ID NO: 15550 - DNA, 201 bp, Homo sapiens
aattatatttcgtcatattaataatttgtttatatatatttttaatataatatgataatattgtatttatattattaaaactacacaaatattatatacayactactaacccaaccgtgttattatggccaccactacctttatttttttccttgtgttagtgattgtctttgttttattttcttggttttgagtattcct

SEQ ID NO: 15551 - DNA, 201 bp, Homo sapiens
cttcttggttccagtctagagcccatatagcaggtgggctttaagagataattatccagctcagaccgggagtgagacgggactgttttttcattctaatrcctctctgggcctgataatttaaaggggcttgcattcttcagctaaaattttattttcttttattttttttcccccacagtggtctccctttattaatcc

SEQ ID NO: 15552 - DNA, 201 bp, Homo sapiens
gaaaggaatacaacagaactttctgagatgctagaaatgtttttttatcttgatggggtgtgggttttgtagataatgaaaaataaacagtaaaaaataaktaaaaaaaaaagtaagaaagttgccaatacagttttacatattcctgtgatgtttttaatcgacaggcaccttcttactgagatacgtaatgagaagttt

SEQ ID NO: 15553 - DNA, 201 bp, Homo sapiens
ggtgcgttggctcacgcctgtaatcccagcactttgggaggccgaggctgggggatcacgaggtcaagagattgaaaccatcctggccaacatggtgaaaycccgtctctactaaaaatacaaaaatcagctgggcgtggtggcacgcgcctgtagtcccagctacttgggaggctgaggcaggagaatcgcttgaacctg

SEQ ID NO: 15554 - DNA, 201 bp, Homo sapiens
agccgagattgggccactgcactccagcctggcgacagagcgacactcttgtctcaaaaaaaaaacaaaaaaaaaaacaaaaaaaaaaactagtaagaggkcccagtggctcacacctgtcattctagctctttgggagactgaggagagaggatcagttgaggccaggattcaagaccagtctgggcaacataacgagac

SEQ ID NO: 15555 - DNA, 201 bp, Homo sapiens
tctccgaggatctgtaagtatatatctgtgaattcccttcatagatcttcttttacttctattacacttttcttcagaggtttgcagtattatgattgtarctttgacttcagatgggtgactaggaactcatagagtcttactaagttccagttaaacactacattcattactttggataaaacccgtgtgtatggcatc

SEQ ID NO: 15556 - DNA, 201 bp, Homo sapiens
ttaatttttttgtaggtatggggtctccccatgttgccctgcctgtctcaaactccagggctctcaggtgatacccaccacccttggcctcccaaagcacygagagtcactgtgccaggctgagtttaaaatttcttgagttggagtttatggctattttttccactagttattaaacatgtatttttgtataaggcactg

SEQ ID NO: 15557 - DNA, 201 bp, Homo sapiens
gtagcagagaattagataagggacgtatgaatacatataaatgctgttgaagttctgaagagagagagtgtttagagaaattagaggagtctttgtgaagktatcactagaacttcctatttttgtggaatatatagtagattttggtgtgatactgtggatttggacattcactcagagaaggaatgagggaagaatggt

SEQ ID NO: 15558 - DNA, 201 bp, Homo sapiens
gatacaaataactgactttgaccccatgtttagtaggttttttttttgtttgtttgtttgttttttttttttgtctttcttctccacactctcttaggackgttgtagcttgtaatgttagtgaattgtaattgtttatttgcatgtctgtctcctcttttagaattgtgaactcctcaggtcatggattgtattttatta

SEQ ID NO: 15559 - DNA, 201 bp, Homo sapiens
atttgacatggagtggccaccattatacaatagagggaaacttggcaaagttgcactaattcagttgtgtgtttctgagagcaaatgttacttgttccacrtttcttccatgtcaggttggtatctctacatttcatttttatatggctgataattgtaatatgtcaactttatccctataaaattaagttcttttattag

SEQ ID NO: 15560 - DNA, 201 bp, Homo sapiens
acataccatgcgggcatgagttttagcacaaggaaagacattcatcataggtttgtaagagatgaaattcaggtatgaggatcaatcatcattgctctccvttgctcatagtggaagtggatatttctcaaatgtttatttaccagatctttattgaatactttctttgtgttgaacataaagcagtccctctgataaatg

SEQ ID NO: 15561 - DNA, 201 bp, Homo sapiens
agaactttctgagatgctagaaatgtttttttatcttgatggggtgtgggttttgtagataatgaaaaataaacagtaaaaaataagtaaaaaaaaaagtragaaagttgccaatacagttttacatattcctgtgatgtttttaatcgacaggcaccttcttactgagatacgtaatgagaagtttcgattatacaaatt

SEQ ID NO: 15562 - DNA, 201 bp, Homo sapiens
agtactatttttttgacttagcaattttagaaattttctactcatctcctattatggtagatttcccctccttcattcctcctccaatataattatatttygtcatattaataatttgtttatatatatttttaatataatatgataatattgtatttatattattaaaactacacaaatattatatacacactactaacc

SEQ ID NO: 15563 - DNA, 201 bp, Homo sapiens
ctgaagaagggaaagggtatcgatgcagctattgtgaaattctacagttgagattcctgacctgattggactggctcagtgggtgtcatagaggatttatwtgggaggatttaagttcaaggcacatgagtaggtttaagtcaacaacttgacactgtcaacatgaaatccacactgtaactataagtccgaggaagagcc

SEQ ID NO: 15564 - DNA, 201 bp, Homo sapiens
cttttattagctggccgttctctcattatctcaaatttatttaagtatttatgttctacctgattcactcacattccttgttttatttaattttcacaacrtacctgtgaggcattgacattttttctgttttagagaagagaaaactgaaattttaagaggctaaatgaccaggatatgtactgctattgctagcaggag

SEQ ID NO: 15565 - DNA, 201 bp, Homo sapiens
ctacataaaaacagttgtaaaattgtccttggttttacaatgataaatgaaaaacattaaaattctctaattgaacaaggtatgcaaggatttttatattsttttttgctaaaactatgacagcaaaataacatcctggagtataaagataagagctgaatgagcaggccactaggggacaaagggagtcttttcacagaa

SEQ ID NO: 15566 - DNA, 201 bp, Homo sapiens
agcaataagttggattgatttgaagaagagaaactgaagaagggaaagggtatcgatgcagctattgtgaaattctacagttgagattcctgacctgattrgactggctcagtgggtgtcatagaggatttatttgggaggatttaagttcaaggcacatgagtaggtttaagtcaacaacttgacactgtcaacatgaaa

SEQ ID NO: 15567 - DNA, 201 bp, Homo sapiens
tggatgaatgtgcagaataaaagatgtgctgtagaagaaagaaaggtatgttgttcattgactattctttcgggtgagaaatttaatttatatttgactgygcaaagagtcagttgttacttgtaaacttcaagtcattgtttaggtcagagttgctgttgtctaaatgcaccaggacctagttgttgaaagggtaaactg

SEQ ID NO: 15568 - DNA, 201 bp, Homo sapiens
taggttgaattccatgtttgggtgctttgtgaatcattctcttcgatttttctgaagatgggacttactgttttatttcggtgatctttagcatacttttwaaatttttctgtttttttataggctggttttattatttaccgaaatttagagattttggatgatactgtgcaaaggtttgctataaataaaggtatgtta

SEQ ID NO: 15569 - DNA, 201 bp, Homo sapiens
taggtaaaacggattaaagtagaataactctggctgaagttaatgtgagggaaaaggaggtacaagagtctcgtctctagaccttgaagacactccctgtyggggtcttataatccttggagtgccgcagaatcatttgaaaaccatcttgatgtactactctgtgtttttaaataagataataggattatagaaacatta

SEQ ID NO: 15570 - DNA, 201 bp, Homo sapiens
caatgtggggtaggaatggcacaaagtatggacaaagaggcagggtggaaccgttagagacttgagagaacagttgaatgggtcggttggccaggttatakatggctttaaaacttgcaaagaagcagtctgggcttggtatcatatacctgttagttttcactgactactttagccttagaatttttagtttagatacaa

SEQ ID NO: 15571 - DNA, 201 bp, Homo sapiens
gggaaaggaattggttatagaattccaggaagaaggactagcaggtgcaaagacactttgatatgagaacacatactgggttcaggaaatgtgactggtayggaatggttggagggaaagacaatgtggggtaggaatggcacaaagtatggacaaagaggcagggtggaaccgttagagacttgagagaacagttgaatg

SEQ ID NO: 15572 - DNA, 201 bp, Homo sapiens
tagctctgtcaaggtagttgtgtaatgggggtggtccatccaggaaaattcaattagagtccaaacatgtaagtagaagtttttcaagtatgccaggccartaggtgatgaggggaaaggaattggttatagaattccaggaagaaggactagcaggtgcaaagacactttgatatgagaacacatactgggttcaggaaa

SEQ ID NO: 15573 - DNA, 201 bp, Homo sapiens
atacttacgaagctcatcattgtatgctgggttctttgctaatactttcttataaaaattaaatacctccacaatcatgcatgctagcagaaacagcagasgagtagccttagcctcacttcctgcttatacctgtcatgcaaatatacagaacccagaaccctagctgaaagggagtttgagaactagtatttgtattgt

SEQ ID NO: 15574 - DNA, 201 bp, Homo sapiens
tactttcttataaaaattaaatacctccacaatcatgcatgctagcagaaacagcagacgagtagccttagcctcacttcctgcttatacctgtcatgcaratatacagaacccagaaccctagctgaaagggagtttgagaactagtatttgtattgtcccagattctgcagtggaagaattcatagtggatggaagtta

SEQ ID NO: 15575 - DNA, 201 bp, Homo sapiens
tgggaggcggaggttgccgtgagccgagattgggccactgcactccagcctggcgacagagcgacactcttgtctcaaaaaaaaaacaaaaaaaaaaacamaaaaaaaaactagtaagagggcccagtggctcacacctgtcattctagctctttgggagactgaggagagaggatcagttgaggccaggattcaagacca

SEQ ID NO: 15576 - DNA, 201 bp, Homo sapiens
aatcgcttgaacctgggaggcggaggttgccgtgagccgagattgggccactgcactccagcctggcgacagagcgacactcttgtctcaaaaaaaaaacmaaaaaaaaaacaaaaaaaaaaactagtaagagggcccagtggctcacacctgtcattctagctctttgggagactgaggagagaggatcagttgaggcca

SEQ ID NO: 15577 - DNA, 201 bp, Homo sapiens
ggaaggctttttcccgtcagctgatcactgagggattcttggtagaagtttctcggtataacaaatttatgaagatttgcgcccttacgaaaaaggtaaayggtgtaggagtctgcctgtttgacttaattttgtttcccactccacattaaaagatcctttttgcttttaatagggtagaaattggcttcataaagctaa

SEQ ID NO: 15578 - DNA, 201 bp, Homo sapiens
aactatttagaatgagtgcatgaatgaatgaagtatgtgtgatgttatggagtacaaagttagaattagcaacatgacctgaatttagaagcaggtgggawacttatacttttctcagtctgtgggcaccacaccattgaagtatatgtctaagattaatttatatttggttgtttgatttagcaaaacttgctgcctgtt

SEQ ID NO: 15579 - DNA, 201 bp, Homo sapiens
gaaggctttttcccgtcagctgatcactgagggattcttggtagaagtttctcggtataacaaatttatgaagatttgcgcccttacgaaaaaggtaaacrgtgtaggagtctgcctgtttgacttaattttgtttcccactccacattaaaagatcctttttgcttttaatagggtagaaattggcttcataaagctaat

SEQ ID NO: 15580 - DNA, 201 bp, Homo sapiens
agaatataggattcttcctattcaaataggttgcatataattaagagcatgaacgatccaatggaatgaactcaaagtagtttttgagtgtaatagacttraagtgtcttatggaaaagaattgcaaaaccacagaaacagtgaagaaggttagttatagccttgatggggtagctgacttcagcagtctcagctatctga

SEQ ID NO: 15581 - DNA, 201 bp, Homo sapiens
ctttttgcttttaatagggtagaaattggcttcataaagctaatacagaatctcagagcctcatccttcaagctaatgaagaattgtgtccaaagaagttkcttctgcctaggttcatttttcagtttttttcttgtaacttctgcattttttgttgctatttatgtgattcaaattataccagtttataggcctctcaca

SEQ ID NO: 15582 - DNA, 201 bp, Homo sapiens
tcatttttcagtttttttcttgtaacttctgcattttttgttgctatttatgtgattcaaattataccagtttataggcctctcacaagtaaaatgaattrcctgtttgtttttgtatgcctattttagtcagtttgggggaagggatctgtgaggaaaggataagtcatagagcacttttcttttttaagagacagagtc

SEQ ID NO: 15583 - DNA, 201 bp, Homo sapiens
atatagtctgttttcaggacactgtgaggatgctcttcggaccccaccgagactggtggggagggtgccgagtgcttctgcctccttctggagccttgctytttgctgtggccatgctcttgccggtggcctttcaggcccaggtgggcatagtgctcgatgaagtcccctagacagtccttcagctccgctgccacagac

SEQ ID NO: 15584 - DNA, 201 bp, Homo sapiens
tacagaacatgccaccatgctcagctaatttttgtattttttgtagagacagggttttgccatattgcctaggctggtcttgaactcctaagctcaagcartcttcccgcctcagtctccaaagttctggcactacaggtgtgagccactgtgcctggcctctttttctcatttaaatacttttcataccttttgtaaaac

SEQ ID NO: 15585 - DNA, 201 bp, Homo sapiens
ggaaaaattaatatctttgtacatgattttgagctgtaaaataaacattttaaactgggaataattggagtttagttaaagagataatgtatataaatatrtaacatagtagcagcatataattctgtcttacacaagatttttctgaatagtataaacagttatgtagcctatctaggagtttgtgaatagagtttaaaa

SEQ ID NO: 15586 - DNA, 201 bp, Homo sapiens
cctaatcagaatgttagttcctgaaaacattgacacgtaccttatccacatggcaattgagatccttaaacatggtcctgacagcggacttcaaccttcaygtgatgtcaacaaaaggagatgttttcccggttctgaagagatctgttcaagttctaagagaagcaaggaagaagtaggcatcaatactgaggtattaat

SEQ ID NO: 15587 - DNA, 201 bp, Homo sapiens
tttttatcaaggtttcagctaaaacaaataaatttgtttctggttttagctttaatttgaactgaaacagtcaaaactgagttttggggacttcacacaaytcatttggatatttgattctccataatgttttaaattttcatgcacttaaatatatcattatttttgataggctttcttcctttagtcttttctttagaa

SEQ ID NO: 15588 - DNA, 201 bp, Homo sapiens
ttccccaaagtatttgtatctgtcgtttataagtttttatcaaggtttcagctaaaacaaataaatttgtttctggttttagctttaatttgaactgaaayagtcaaaactgagttttggggacttcacacaattcatttggatatttgattctccataatgttttaaattttcatgcacttaaatatatcattatttttg

SEQ ID NO: 15589 - DNA, 201 bp, Homo sapiens
accttcaagagttcagtggaaagtgattcattcagtattagaagaaagaagagataatgttgctgtcatggcaactggtaagttgtacttaagcaaaaccwaatcctttaaaaaaataaaacataaagagtttgaaatgcttaatctttcattaaactctcaaaatacaaatgcaactacaaatgatgtaaactatagaag

SEQ ID NO: 15590 - DNA, 201 bp, Homo sapiens
cgaatgagtgagcccctaaacaggaccaggagtggcagaagaaagaggcagcaactgagatgtgttttttctaagctgaaaggctttttttttttttttttgcaacacacctttaacactaaagtccaatatttatataattggtcaagtaagtggagctgttctagctataaatatggcaactctgcttgctcgtcctat

SEQ ID NO: 15591 - DNA, 201 bp, Homo sapiens
ggaaacttggcaaagttgcactaattcagttgtgtgtttctgagagcaaatgttacttgttccacgtttcttccatgtcaggttggtatctctacatttcwtttttatatggctgataattgtaatatgtcaactttatccctataaaattaagttcttttattagctggccgttctctcattatctcaaatttatttaag

SEQ ID NO: 15592 - DNA, 201 bp, Homo sapiens
gcaaaacctaatcctttaaaaaaataaaacataaagagtttgaaatgcttaatctttcattaaactctcaaaatacaaatgcaactacaaatgatgtaaamtatagaagagagtgaacaaagaacagatgctcagatttatgtatcaattagcttttaggaagatagcatactagtattgaccattcatctgtataagtac

SEQ ID NO: 15593 - DNA, 201 bp, Homo sapiens
ccgaatgagtgagcccctaaacaggaccaggagtggcagaagaaagaggcagcaactgagatgtgttttttctaagctgaaaggctttttttttttttttttgcaacacacctttaacactaaagtccaatatttatataattggtcaagtaagtggagctgttctagctataaatatggcaactctgcttgctcgtccta

SEQ ID NO: 15594 - DNA, 201 bp, Homo sapiens
ctgtttatgtaggcaagattggccttgttatctctccccttatttctctgatggaagaccaagtgctacagcttaagtaagtcatgttatcattgccacamtatcaccctctttttttcttctgtgggtgaaacatctgatccatcatgcatgttaaaatctagttcacaataacacatttctgcaggtattgctttatct

SEQ ID NO: 15595 - DNA, 201 bp, Homo sapiens
cccgaatgagtgagcccctaaacaggaccaggagtggcagaagaaagaggcagcaactgagatgtgttttttctaagctgaaaggctttttttttttttttttgcaacacacctttaacactaaagtccaatatttatataattggtcaagtaagtggagctgttctagctataaatatggcaactctgcttgctcgtcct

SEQ ID NO: 15596 - DNA, 201 bp, Homo sapiens
agggatatgttctgagaaatgtgttcttaggacattttgtggttgtctgaacatggacttacacaaacctacatgataaagcttactgcacacctaggctrtatgatagagcctattgctcctaggctgtaaacctgtacagatgttactgtaatgaatattgcaggcaattgtaatacaatggtaagtatttgtgtatct

SEQ ID NO: 15597 - DNA, 201 bp, Homo sapiens
ccccgaatgagtgagcccctaaacaggaccaggagtggcagaagaaagaggcagcaactgagatgtgttttttctaagctgaaaggctttttttttttttttttgcaacacacctttaacactaaagtccaatatttatataattggtcaagtaagtggagctgttctagctataaatatggcaactctgcttgctcgtcc

SEQ ID NO: 15598 - DNA, 201 bp, Homo sapiens
gtaggcttaatttaataagacaaagtaaatggcatttggaaacctcatggatttaatgttttatttaaatgatttctgatttttaaaaagtaaatattgtwtccagaaggctgagaaacaagttagtagggagattttttctttgcaaaaaaattttacagttgtgtctttaacattgtaccacaaactgttgtcctacca

SEQ ID NO: 15599 - DNA, 201 bp, Homo sapiens
gtattttttgtagagatagtattcgccatgttgcctaggctggactcaagccagcctcctgccttagcctcccaaagtgctgggattgctggcacgtaccrctacgtccagccagggctgagtttctgaatcatcattgcagcaagagaaattggattacctttagaccactggctctactgtgggctgggagtgggacac

SEQ ID NO: 15600 - DNA, 201 bp, Homo sapiens
tgaaagacttcactcctcaaacatacatggaatatttctaaaaactatgtattgggccgggtgcagtggctcatgcctgtaatcccagcactttgggaggmcgaggcgggtggatcccgaggtcaggagatcgagaccatcctggctaacatgatgaaacgccgtctctactaaaaatacaaaaaattagccggatgtggt

SEQ ID NO: 15601 - DNA, 201 bp, Homo sapiens
aatttcattttctattttgaaatttaaactaccactgacacttcgttttccctctgttttacttagcatttatcttagagaataatcttaatatgtatagktctattttattcttttactggcagcttagtatgccatattttggatgtgtcattgtttatttacctattaatttaccctataactgcttcccatattttt

SEQ ID NO: 15602 - DNA, 201 bp, Homo sapiens
agaagcacaagtttctacaaaatacattctaacagatgttttctataacattcagtctcaagattactagtaaatacttctttgaactgtaaaagcaatcyttcaatattataagaaagctcttgctttagtaaacatttagaaactcagctttattatcataagcaagaataagaacagtgtaacaagttttatgcacac

SEQ ID NO: 15603 - DNA, 201 bp, Homo sapiens
cggccaatttcattttctattttgaaatttaaactaccactgacacttcgttttccctctgttttacttagcatttatcttagagaataatcttaatatgkatagttctattttattcttttactggcagcttagtatgccatattttggatgtgtcattgtttatttacctattaatttaccctataactgcttcccata

SEQ ID NO: 15604 - DNA, 201 bp, Homo sapiens
tctaaaatagtatagtcttttttatattgtcagcataaatgaatgcacttatgtaaatgaatatttttaggcgttaagtaaaatattctgtggaaattgawcatttaagttgtttatacttctatggaaatcgtttacgcttttaataaagaagcacaagtttctacaaaatacattctaacagatgttttctataacatt

SEQ ID NO: 15605 - DNA, 201 bp, Homo sapiens
ggcgtgagccactgtgcccggccaatttcattttctattttgaaatttaaactaccactgacacttcgttttccctctgttttacttagcatttatcttaragaataatcttaatatgtatagttctattttattcttttactggcagcttagtatgccatattttggatgtgtcattgtttatttacctattaatttacc

SEQ ID NO: 15606 - DNA, 201 bp, Homo sapiens
tttggccgggggtggcagctcatgcctgtaatcccagcactttgggaggccaaggtgggcggatcccttaggccagaagttggagaccagcctggccaccrttgcgaaacactgtctctactagaaatacaaaaaaaaaaaaaattagctggtcgtggtggcacatgcctgtagtcccagctactccgggggctagggaat

SEQ ID NO: 15607 - DNA, 201 bp, Homo sapiens
caatgggagatctttatatctctgtgtccatctctatctgtatttctgtctctgtatctatgaagagattataaaagttttaagatctgccaggagacatwcccacgggagctaatggtatagttccaggccagttgtgaaggcctgagaaccaggagagcctatggtgtaagttccagtctgagtccaagtctgaaggca

SEQ ID NO: 15608 - DNA, 201 bp, Homo sapiens
gaaaataaggcattgtttttttttctccccatttcagtgatcttggtatcctgggatattgtttttaaaattatcgttataattcctttgagaatttagtraaatgttccctttaaccaacttaggaaaaattaatatctttgtacatgattttgagctgtaaaataaacattttaaactgggaataattggagtttagtt

SEQ ID NO: 15609 - DNA, 201 bp, Homo sapiens
caacataaaagtcattggaaaccttgacatgagcccttttcgtggagtggagtggttacagtgggtttaagagaggattaaaggagtggaaacagagatgytattatagatgactcgtttgagtagttttcctacaaaggggagaataataatggagcagttagccaaaagttgagtttttttttcttcttctttttttta

SEQ ID NO: 15610 - DNA, 201 bp, Homo sapiens
cccgacctctacaaaaacaatttcttaaaattagccaggcatggtggtgctagcctgtaatcccagctatttaggatgcttaggcaggaggattgcttgarcccggggatttgaggctgcagtgagccatcattgtgccacaatactccagcctgagtgatagaaaaaaaaaaaaaaagtgtctttgttatattccaaact

SEQ ID NO: 15611 - DNA, 201 bp, Homo sapiens
aacagacaaacatctctctccttttggagcttacattttagtggaaagagacaggcaaaaagtaaaattataggatgacagaaggtgaaaatagagattaraaaggaaagggggatgaagagtgtgtgtgtgtgttgtgggtggggggctgtagggagctgcagttttacaataagtggtcagggacgtcctcgctgagaa

SEQ ID NO: 15612 - DNA, 201 bp, Homo sapiens
aggagaatggcgtgaacgtgggaggcggagcttgcagtgagctgagattgtgccactgcactccagcctgcgcgacagagcaagattctgtctcaataaaraaaaaaaaagaaacatatttattaaattagttgtgaaatatttttaatgaaatatattgaaaacttctgttgatttttcatgtactgatgtttttagatt

SEQ ID NO: 15613 - DNA, 201 bp, Homo sapiens
aattatcttttgtgttgatgtgagagtttagctctgagattcttccacatgtaaaatgtaatcccccaaagtatttggcaagcacattttattgccttggstcagataattgaaacattaggcatcatatatatagcatgtaaaaagtaaaacagaaacatttatgtttctcaccaagcagtaaattagtactcaactaat

SEQ ID NO: 15614 - DNA, 201 bp, Homo sapiens
tgctccttcagccttggttacaagcaggtttttaaaggcgaaggggaagagtgggctgagacaaagttggtcaggaattgttattggtttacagagatacsattgcttagtgattggctgtacactgtaactcatagggtatgagttatcgtgtccagcatatggcattttatggcttcttggttccagtctagagcccat

SEQ ID NO: 15615 - DNA, 201 bp, Homo sapiens
actagtgcctgtgttacacacctcttgttcaggttttatcatttaaaataaataagaataaacagtccatagcttatcttacttactgaataaatgctctratttgacagtcatgtttcttaaagttccttacaaaggccattgcccaagaaaccaaataattccattatactatttttgaaatagaacacataataaatg

SEQ ID NO: 15616 - DNA, 201 bp, Homo sapiens
ttcagccaaaatgaggacagctgcccaggactcatttcccagttgccttggggagtgctccttcagccttggttacaagcaggtttttaaaggcgaagggraagagtgggctgagacaaagttggtcaggaattgttattggtttacagagataccattgcttagtgattggctgtacactgtaactcatagggtatgagt

SEQ ID NO: 15617 - DNA, 201 bp, Homo sapiens
ttatttggttgtattttattgtgtgatatggtggtataattatccttacctcccaggagtttgagagggtcttgccagttaaccgcagaattaaacatgcytaggactaattaatcaggagcaatactacaattaattggaggtaatttgaaacctggtttcaaataaccctgatattatgcacacatggtgcacactttt

SEQ ID NO: 15618 - DNA, 201 bp, Homo sapiens
aaagttataatttaaaaaaattataataaaatcagaaaataaaggtctgagatggaaaattaaaagaccaaagccacccataagcacaataaatccctccycccaaaaaattatatctattaaaaaaaggtgttgcgccaggcactgtggctcatgcctataatcctagcactttgggaggccaagacgggcagatgactt

SEQ ID NO: 15619 - DNA, 201 bp, Homo sapiens
ctctactaaaaataccaaaattagctgggcttggtggcacacacctgtaatcccagctacttgggaggctgaggcaggagaattgcttgaacccccatggraggtggaggttgtggtgagccaagattgtgtcattgtactacagtctggacaacagagtgagactctgtctcaaaaaaaaaaaaatagaatttgtgcagt

SEQ ID NO: 15620 - DNA, 201 bp, Homo sapiens
acagtctctgttgcagtaactcagttctgttattgtagtgtgaaagcagccacagacaaatgtaaacaaatgtgcctgtctttcaataaaactttatctasaaatacagatagtgggccacatttggcttgcgagctgtagtttgctgttcctgacttagtatgatatgcagcattgtgtagtggaaagattttatagtat

SEQ ID NO: 15621 - DNA, 201 bp, Homo sapiens
cttttcctaaatctaaaatagtatagtcttttttatattgtcagcataaatgaatgcacttatgtaaatgaatatttttaggcgttaagtaaaatattctrtggaaattgaacatttaagttgtttatacttctatggaaatcgtttacgcttttaataaagaagcacaagtttctacaaaatacattctaacagatgttt

SEQ ID NO: 15622 - DNA, 201 bp, Homo sapiens
aaaatgtcaggaattcataatgattcatatacccaaggattttcattgatagtgaggtaaggttattcttgagaaagactcaaagtcataaaataatagamtttcgaaactaccagaattatacaagtcaattaaaatgactgatttgttttaagaggaagaaatactaaatgtataattattagatgcagcatattgtat

SEQ ID NO: 15623 - DNA, 201 bp, Homo sapiens
gccccgaatgagtgagcccctaaacaggaccaggagtggcagaagaaagaggcagcaactgagatgtgttttttctaagctgaaaggctttttttttttttttttgcaacacacctttaacactaaagtccaatatttatataattggtcaagtaagtggagctgttctagctataaatatggcaactctgcttgctcgtc

SEQ ID NO: 15624 - DNA, 201 bp, Homo sapiens
agcccatttggttgctgtcaaaaatagatttgaacagattattcagtatgactcttgtagtgaaattattgccttgtttcctctgcttaagttttcagtgrcttttgccacagtccttaaaggttttataatttttttaatgtttaatttttaaatgtttgcttaatatttcttagtatgagtgtagataatgatgaacat

SEQ ID NO: 15625 - DNA, 201 bp, Homo sapiens
ttgataggctttcttcctttagtcttttctttagaaggtagaaaggaagaattaaataagataaaaccaaacgggtctgaagcatgtataaagtatatatrtttgctcttttgttcttctttttctttagttcccactgggaatttgaaggtccaacaatcatctactgtccttctagaaaaatgacacaacaagttacag

SEQ ID NO: 15626 - DNA, 201 bp, Homo sapiens
aagtgctggaattacaggtgttggccactgcgcctggccagtttataattttaaacattaaaataaatgcttcttgtccaatcatggtgtctcacacccakaatcccagcactttgggaggcagacgttggagaatcacttgaggccaggagttcgagaccagcctgggcaacatggtgaatccctgtctctacaaaaaat

SEQ ID NO: 15627 - DNA, 201 bp, Homo sapiens
accttctggaaaatattcactattctagaagtcatgaagaatatttgtgattcaggagagtaggtcagaatatcaatattaataggaatttggaagaagtygattcttattaaaatcaagagtttagtgatagacatactgagtttgggatacctgtggagtagtccagaagttaatttaaatatatgggcttagtgtaca

SEQ ID NO: 15628 - DNA, 201 bp, Homo sapiens
tgacggaaagagaaaagacacagaagaccaataccaggaatgaaagagggaatttcactacagacctcccaggtattactagggatgataagggaacactrtgaacaactcagaacataactttaataatttagatgaaatggatcaatttcttgataatctcaagctaattaaacttacagtgaattagataacctgcat

SEQ ID NO: 15629 - DNA, 201 bp, Homo sapiens
aactgaatgaaatgaaaatacaaaatgtgtgagatgcagctaatgcaatactgagaaggaaatttatagcattaaatacctatgtaataaaagaagaaagktctcaaatcagtacctaagcttacatcttaagcaacaagcaaataagagcaaaataaatcaaaatgaagtaaacataaggaaataacaaagaacataagt

SEQ ID NO: 15630 - DNA, 201 bp, Homo sapiens
attttggtttacattgaggagtgccctcaaagatattaacagatttttaaaaaatcctctaaaaaactcattcttagggaaatttgttcacttactaggtraggagcaaaataaaaatccttaatatagaagagctattatctgtcttcaaaattaagtctttgagtagatttgtgaataaatctaatagttttgctgaat

SEQ ID NO: 15631 - DNA, 201 bp, Homo sapiens
aaatgaaaggtttataatctttttgtcatattttacagtcgttagcgtttaacaatttatagcataggatttgggtttttttttttttcattttaaagaaraagtttatttaagcaagacacttgactaagggaagactatcttggagttattattactagagtaatttatttctacttaaagacagattgccccacaagt

SEQ ID NO: 15632 - DNA, 201 bp, Homo sapiens
aataattctcatttgaatttatgatagtttcagatctacccaaagggtgacttaggaatttaacttctaaatctatttaaatgaaaggtttataatctttktgtcatattttacagtcgttagcgtttaacaatttatagcataggatttgggtttttttttttttcattttaaagaagaagtttatttaagcaagacact

SEQ ID NO: 15633 - DNA, 201 bp, Homo sapiens
acctgggaggcggaggttgccgtgagccgagattgggccactgcactccagcctggcgacagagcgacactcttgtctcaaaaaaaaaacaaaaaaaaaaacaaaaaaaaaaactagtaagagggcccagtggctcacacctgtcattctagctctttgggagactgaggagagaggatcagttgaggccaggattcaaga

SEQ ID NO: 15634 - DNA, 201 bp, Homo sapiens
ttaagaaatacagtttgtaatgctttagcttctgtagatagtgattatcagagatgggtttttaagaggttttccagaaaaccttctggaaaatattcacyattctagaagtcatgaagaatatttgtgattcaggagagtaggtcagaatatcaatattaataggaatttggaagaagtcgattcttattaaaatcaaga

SEQ ID NO: 15635 - DNA, 201 bp, Homo sapiens
tcgcttgaacctgggaggcggaggttgccgtgagccgagattgggccactgcactccagcctggcgacagagcgacactcttgtctcaaaaaaaaaacaamaaaaaaaacaaaaaaaaaaactagtaagagggcccagtggctcacacctgtcattctagctctttgggagactgaggagagaggatcagttgaggccagg

SEQ ID NO: 15636 - DNA, 201 bp, Homo sapiens
gaatcgcttgaacctgggaggcggaggttgccgtgagccgagattgggccactgcactccagcctggcgacagagcgacactcttgtctcaaaaaaaaaamaaaaaaaaaaacaaaaaaaaaaactagtaagagggcccagtggctcacacctgtcattctagctctttgggagactgaggagagaggatcagttgaggcc

SEQ ID NO: 15637 - DNA, 201 bp, Homo sapiens
ccatgccaggctaatttttgtattttttagtggagacggggtttcaccatggtggccaggctgatctcgaactcctgacctcaagtgatccacctgtgttrgccttccaaagtgctggaattacaggtgttggccactgcgcctggccagtttataattttaaacattaaaataaatgcttcttgtccaatcatggtgtct

SEQ ID NO: 15638 - DNA, 201 bp, Homo sapiens
aaagacattctcatttaggggatgaaatagaaagtcaatgaggagaaagaaaagcttttattatttattttcttttaaatattttagtatcatggtacagkcaccagaaaaagcttacagttcctcacagcctgttatttcggcacaagagcaggagactcaggtaaggcttttgtaaaaaggtaattagtttatgatagg

SEQ ID NO: 15639 - DNA, 201 bp, Homo sapiens
tgatggggtgtgggttttgtagataatgaaaaataaacagtaaaaaataagtaaaaaaaaaagtaagaaagttgccaatacagttttacatattcctgtgmtgtttttaatcgacaggcaccttcttactgagatacgtaatgagaagtttcgattatacaaattaaagatgatggcaaagatggaaaaatatcttcattc

SEQ ID NO: 15640 - DNA, 201 bp, Homo sapiens
tttcaccaatgtatcagtcagggttcaccagagaaataggacgattgatattatggagatatatatatatatatatatatatatatatatatatatatatwtatatatatatatggggagggaaaggaagaacaaatatggggagagagggatgaggcgactgattttgaagaattagctcacgaaattgtgggggttggc

SEQ ID NO: 15641 - DNA, 201 bp, Homo sapiens
ctggagtgcagtggcgcaatcccggctcactacaacttccacctcctgggttcaagctattctcctgcctcagtctcccaagtagctgaaattacaggtgygcgccaccatgccaggctaatttttgtattttttagtggagacggggtttcaccatggtggccaggctgatctcgaactcctgacctcaagtgatccacc

SEQ ID NO: 15642 - DNA, 201 bp, Homo sapiens
cattaatcaaaaggaagttggagttactttaatatcagacaatggacactttggagcaaagaatattatcaggataaagaaggatattatatgatgtaaargaatcatttcaccaatgtatcagtcagggttcaccagagaaataggacgattgatattatggagatatatatatatatatatatatatatatatatatat

SEQ ID NO: 15643 - DNA, 201 bp, Homo sapiens
tgagaaagcaaacaatattaaagtattttgcttaaaaaatagataaagcaataaaatggtagccctaaatctaaacatatcaatagttatgttaaatgtaratgatctaaaatattatttaaaggcgtaaattgtaagaattggtttaaaaacatgaccctgttctgtacgttgtccacaagaaatccactgtaattatat

SEQ ID NO: 15644 - DNA, 201 bp, Homo sapiens
gaatcaattaatggtgattttacctcattattttcaggaatgaacttaacatatacgtttctgttcttttatttaatttaaaattttgtcttgggtagaakcatcttgtctcattttgaggacaaacaagtacaaaaagcctccttgggaattatgggaactgaaaaatgctgtgataattgcaggtccaggtaaagattt

SEQ ID NO: 15645 - DNA, 201 bp, Homo sapiens
tggaaaaatatcttcattctagcagatgtaggagacagtatgtattatttattttatgccaatagtatggatttatggatgatgctcttttaagacaacartttggctaaataattatcagtattttgaaaaaatattttgttgctgttacatgtgtgctgaatttttaaggctaacttctttgtgtctgagtaaactgaa

SEQ ID NO: 15646 - DNA, 201 bp, Homo sapiens
tattttcttcatgtacatatggatgatattttcgaatgaccacttttctcttttgctttttattattagactgtttttttcttcttgttaaaggataaaargattagaacataaaaggatatttacacattgtttccccattgacttattcccaagatggtagctaataaacaccaaatgatatagtagttaaagatacat

SEQ ID NO: 15647 - DNA, 201 bp, Homo sapiens
ttttgtagagatagtattcgccatgttgcctaggctggactcaagccagcctcctgccttagcctcccaaagtgctgggattgctggcacgtaccgctacrtccagccagggctgagtttctgaatcatcattgcagcaagagaaattggattacctttagaccactggctctactgtgggctgggagtgggacaccttcc

SEQ ID NO: 15648 - DNA, 201 bp, Homo sapiens
agctcatggatcaagaagtaaattaaccttttaagtattattatttaagaaatacagtttgtaatgctttagcttctgtagatagtgattatcagagatgrgtttttaagaggttttccagaaaaccttctggaaaatattcactattctagaagtcatgaagaatatttgtgattcaggagagtaggtcagaatatcaat

SEQ ID NO: 15649 - DNA, 201 bp, Homo sapiens
tccaggaattacacaatcacaaaattgctgatttttcttcttattcatgttacataaacttatcctgtccgaaaagactgtatttgaacttactatgtaaratttgctttaggtaaatttatggctgcttccagaattgtgtattaattttccagtttcttttttaccagtctccacttttacctttccctcttcccccta

SEQ ID NO: 15650 - DNA, 201 bp, Homo sapiens
aataacccataatactaagagacagttttggagggcgagaagtcctgaagagctgatagagataaaggttcaaatttgagcttctttcagtgttccttacrtcaatgcttttagtttctcatacaaaataaaataaagaataacctttttactgggaaaaggtaaaaattaataaattgtagaagcattgtttgaagccaa

SEQ ID NO: 15651 - DNA, 201 bp, Homo sapiens
taactatacctatcagaagcctatgttttaagtccaatgtataggcactgctctgtttgtctctggtgggaacttaccctgctttacctaatttcatcctrgcttcctttttgtgaaagatcacccttgcttagcctattttttggcaaatctacaccttggaaatagtagtaaatgacataagcatattaatatttatga

SEQ ID NO: 15652 - DNA, 201 bp, Homo sapiens
tagttaacatggactttcatttgttcttgtaaagatatgcaaagctatttgggagattgtcatcatctgatatttgatattcatgggctttcttcacagargactagaaattaacagagtcatgatgaattatggctgcattgactttaaaaaacaaacacctccttaatgttatttaacaattttgaataaatttgatat

SEQ ID NO: 15653 - DNA, 201 bp, Homo sapiens
gtccattaacactcaactcaaataccatcaatttgatttatatctaacaccacaaagttaggtgttgagttacatgtggttatattgtaactaatagtcarcccttcatggacttctattctttgatgagactcttcttgtaggagtagtaggtgccttaaagcaccttttcatagttgtcagattgaaatccttcaccag

SEQ ID NO: 15654 - DNA, 201 bp, Homo sapiens
aagtaaatcgttgttttcttttgaaatatctgaaacctagttaacatggactttcatttgttcttgtaaagatatgcaaagctatttgggagattgtcatsatctgatatttgatattcatgggctttcttcacagaagactagaaattaacagagtcatgatgaattatggctgcattgactttaaaaaacaaacacctc

SEQ ID NO: 15655 - DNA, 201 bp, Homo sapiens
ttacaaacacagtggagcctgtattgtgttccaaggactattgtaggcgctttctatataaaatgatctaatttaatccctataactgctcagtaagttaygtattattttcattttattgttgaggaaactggcattagtacttttttctgtttattttgtttaaaggcattttaaatatatatgttaagaagttttcaa

SEQ ID NO: 15656 - DNA, 201 bp, Homo sapiens
attatgcagaggtatttaatcagtcagaaggttgaatagtcaaattattagtgagtgaagtctattttgatgaggattttactaatgctgtcccttagatrttataagtaaatcgttgttttcttttgaaatatctgaaacctagttaacatggactttcatttgttcttgtaaagatatgcaaagctatttgggagattg

SEQ ID NO: 15657 - DNA, 201 bp, Homo sapiens
aaaaattgcgtatatgttgatgggtcttttctggcagaccagtagagaggaaaaagttgatgatgtaggagatgggaaaatgtctttgagtagatgtcttygagaaaatgtctttgagtagatgagaggtttgcacacatggagaggttggatgtaggagtactgatagttcatccatagttacataagaaaaggtagatg

SEQ ID NO: 15658 - DNA, 201 bp, Homo sapiens
caagtacaaaaagcctccttgggaattatgggaactgaaaaatgctgtgataattgcaggtccaggtaaagatttcttattatagatggacattctaaaastctttctttctcttccttttcatgtttaactgaatttttgttgaatgataagtatttcagttttttaaacaaaacaatgaatgtgtttagatatgagaaa

SEQ ID NO: 15659 - DNA, 201 bp, Homo sapiens
ttactttttctattggagttttaagtaaattcttgtatattagtgtgatacattttaagttatttttgtatatggtgtgaggtaggggtccaacttcactsttttccatatggagatccagttgtcccagcaccacatgtttaagagtctattctttccccactgaatggacttggcacccttgtcaaaaatcaattggtg

SEQ ID NO: 15660 - DNA, 201 bp, Homo sapiens
atttaatcagtcagaaggttgaatagtcaaattattagtgagtgaagtctattttgatgaggattttactaatgctgtcccttagatattataagtaaatygttgttttcttttgaaatatctgaaacctagttaacatggactttcatttgttcttgtaaagatatgcaaagctatttgggagattgtcatcatctgata

SEQ ID NO: 15661 - DNA, 201 bp, Homo sapiens
accatgcctggctaggacatatacttttaatgattgataagtaaacaagcaaacataaaatgactctttcatctgaattctgtctagtttactaattacaygacttcagtcttaaggagcttagaaaaggtcaccttacaaacacagtggagcctgtattgtgttccaaggactattgtaggcgctttctatataaaatga

SEQ ID NO: 15662 - DNA, 201 bp, Homo sapiens
atgatgttgagcatcttttaatgtgcttattggccattatatgtcttctttgggaactgtctattaagtcctttgcccattttttaattgagtttttttttctgttgaattgtgggagatctttatatattctgaatattaaacccttattgggtgtatgatttgcaaataatttctcccattttgtgggttttcttcact

SEQ ID NO: 15663 - DNA, 201 bp, Homo sapiens
agaatgagcacgatgggtataacatttttgtaggtttttaaagttgaaatttagtgtaaatccaaagaatcaatagacaagtctgtgttttacttaacctrtatgtttaaattagcatttttagatactgattttattcctaatttcagaattctcagcgtcttgccgatcaatatcgcaggcacagtttatttggcactg

SEQ ID NO: 15664 - DNA, 201 bp, Homo sapiens
taactgatctttacctgaatgaaatttatcagtactgtattaagggtctagggtggaacggatgctagcaaggcaaccgttaacatccacttactgatgartcctataaaattttatttcaggccatacgaagtaacagtaataaatataaaaggaaaaatagacaacctaagcaactttttaaattgacttacttgaaaa

SEQ ID NO: 15665 - DNA, 201 bp, Homo sapiens
acagtgcttgtgttcaagtaacgcttattttacttaagaatgaccccaaagcacaagagtactgtgcctaatttataaattaaactttttcataggtatayacatataggaaaaaacataatacatacaggatttggttggtactattctgcggcttcaggcatccactggacgtcttggaatgtatcccttgtggataag

SEQ ID NO: 15666 - DNA, 201 bp, Homo sapiens
ttgtcctgacactgacgagattagttaaatgtaggtcatctgaaccaaatacaaggaaggaaggacccagttctgaagagtgtgggcatttcttttcttgkttttttttttttttttttttttttctataggaggggaacgaggtgaactaaacaaacaaaataaagcaaaaaagaactgatttttatcccttgaggtaga

SEQ ID NO: 15667 - DNA, 201 bp, Homo sapiens
agtttggttggagcagatattaaaacagaacaaaccaaaaataaattaaatatactagttagcaagtttatattgagggaaaatcaaaccatgtgaattgmgctccaatgatgtggctggccttgggtcagattttagtatcatggttcaacaaggtagctattaaaatcttcatactttttcttgaaataattctttagt

SEQ ID NO: 15668 - DNA, 201 bp, Homo sapiens
aatttgtcctgacactgacgagattagttaaatgtaggtcatctgaaccaaatacaaggaaggaaggacccagttctgaagagtgtgggcatttcttttcytgtttttttttttttttttttttttttctataggaggggaacgaggtgaactaaacaaacaaaataaagcaaaaaagaactgatttttatcccttgaggt

SEQ ID NO: 15669 - DNA, 201 bp, Homo sapiens
tgaacaagccaggcatactctgtttcctgaggggcctacagttttattggggatatagatgagtgaagaaagcaattgcagtgtagggagatgagtcttaygtcatgggaaaacaaggtgctgtagttgacacaccgagaggcatctgacacattgggggaaatattctagaatatttcctggagaaagtgcaggtaaaag

SEQ ID NO: 15670 - DNA, 201 bp, Homo sapiens
tttacaatacactcagcccttgtggcttaagatcaggggctcagaggctgtgacaactcatgatgctgaaaatgtatccaatgaaaacgaagtactagctygtttagtagtaacgaagtactattaatttttaatatagtctgatactttattttctaattgtagaagcaacattcttagctatatctttctagaatgttg

SEQ ID NO: 15671 - DNA, 201 bp, Homo sapiens
taaggtcaacggtatgactatggaattgagtggctaaggtctgttgaagaaaagattgtcggaaatgcaggggtcaaggaactggcctgtggatgttgaastcactggcagtgatcaaggaatagtagtggagtgaaagtagttaatgaatcaggcactaagatctccaagggatgaaaggatgcagtttggagatgacaa

SEQ ID NO: 15672 - DNA, 201 bp, Homo sapiens
tgcactgagtagtaagaatatataatggtgtgtggtatttcccaagttaaaaaggtcagataaggcttccttgtggaagtgatagttcaaatctgaaagartaggaattaattaggtaaaaatgtttgatgcaaattttaagattttccttctgagtagtcagtagcttttccttcttaacatagaagatgacaaaaccat

SEQ ID NO: 15673 - DNA, 201 bp, Homo sapiens
caattaacagaggaggccttgttcagagtgagaaatcattaagcatttgttgttgaaatttcttactgtactctgttttaattctgtttttttttttttttaatgttacttgttttagtttggattcctagttgaaaagggaatatgattcctttaaaacaaagatactctgctttaaagcaaaggtatatcatcctcttc

SEQ ID NO: 15674 - DNA, 201 bp, Homo sapiens
attttaataccccattctgttgcttaaacagggcatatactatttatttttattttttaaaattttacttatttatttatagagacagggtctctctgtcrtccaggctggagtgcagtggtgtgatcacaactcactgcagcctcaaactcctgggttcaagcagtcctcctgcctcagtctcccaagtagctggaacta

SEQ ID NO: 15675 - DNA, 201 bp, Homo sapiens
tgcccaaatccgtaagctatgttctgtatagcagctttttcatcataggcagtttttactcttatcagtggacaacctacaaaattaactaaacacttaarcaattaacagaggaggccttgttcagagtgagaaatcattaagcatttgttgttgaaatttcttactgtactctgttttaattctgtttttttttttttt

SEQ ID NO: 15676 - DNA, 201 bp, Homo sapiens
tttacgatttccttctaatgcatatttaacatatttcaaattccacctagttttggttcaagtcaagcatgatgttatataatcaattcagtgattgagamtagtgtatttttaaaagcagaaaccaattctcctaatattttaataccccattctgttgcttaaacagggcatatactatttatttttattttttaaaat

SEQ ID NO: 15677 - DNA, 201 bp, Homo sapiens; identical to SEQ ID NO: 1343

SEQ ID NO: 15678 - DNA, 201 bp, Homo sapiens
agctatagacatgttgggaatgaatgagctctttcctttttaaaatatcagttttacatcattcaggttccaatcgttgcacttactgctactgcaagttyttcaatccgggaagacattgtacgttgcttaaatctgagaaatcctcagatcacctgtactggttttgatcgaccaaacctgtatttagaagttaggcga

SEQ ID NO: 15679 - DNA, 201 bp, Homo sapiens
tcagataccgttgtaaagactttgcttttaccggaaactgatacgttgggtcatgtaccctggccagtcagttctctttattctaacacttagccgatcarttagatttccacattccatgatatgtcagttttggtgacccttatttttccacctggtttataaagggaaagaatgtgatatgtcacccaggctctggag

SEQ ID NO: 15680 - DNA, 201 bp, Homo sapiens
tacaatatgaaaaagtatatttttgtagcctacttttaaatccagaatagaggaggttaagaaggttgtgataaccatgagctctttttttttttttttgrgacaaggtcttactctgtttcccaggctggagtgccgtggcacaatcatagcttactgcagccttgaactcttgggctcaagcaagccttccacttcagc

SEQ ID NO: 15681 - DNA, 201 bp, Homo sapiens
acataaacatagtaacatagtcatttattatcattttcaagtattatatactgtacataattgtacatgctagacttttacacagctggcagcaaggtgartttgtttacaccattaccaccacaaacacatgggtgatgctttgcattgtgatgttacgatggcatgatgtcactaggtggtaggaacttttcagctcca

SEQ ID NO: 15682 - DNA, 201 bp, Homo sapiens
tataacgtacctgcatatgtacccttgaaactaaaataaaagttaaaaaatttatcttcttttgccaataataaattaaccttagcttactgtaatgattyttctttatgaattaaaatctttttactcttttgtaataacacttggcttaaaacacaaacatattgtacagctatacaaatatattttctttatatcctt

SEQ ID NO: 15683 - DNA, 201 bp, Homo sapiens
cttgaacccccatgggaggtggaggttgtggtgagccaagattgtgtcattgtactacagtctggacaacagagtgagactctgtctcaaaaaaaaaaaaatagaatttgtgcagttccccccacccccttttttttttctgttggcatttttgctatcatttagctgccttctttatatcctgaaacttacaggtggtgt

SEQ ID NO: 15684 - DNA, 201 bp, Homo sapiens
caaagtaaatggcatttggaaacctcatggatttaatgttttatttaaatgatttctgatttttaaaaagtaaatattgtatccagaaggctgagaaacargttagtagggagattttttctttgcaaaaaaattttacagttgtgtctttaacattgtaccacaaactgttgtcctaccagtctctttgtaagaaagcta

SEQ ID NO: 15685 - DNA, 201 bp, Homo sapiens
ataagctgtgatcatgccactgtgctccagcctgagtgacacccagagtgagaacctgtctcaaaaggagaaaaaaaaaaaagtaacagtagacgctgggractactgaggggagggaaggaacaatggttgaaaaggtgggaagggacagtggttgaaaaactacgtgttgggtactatgctcactatctgggtgatggg

SEQ ID NO: 15686 - DNA, 201 bp, Homo sapiens
aaggatttcctgtcactttgctgcagaacctcagctcgcggagagcaagcccctttgcttgccctgtagaaatattttaaattattatcctttttttttttaacagaagtaaataggagatacgttagaggattttctctcctagatgtgtaaatacaaacttggggtcttataactcaataaatctgataaatttctttt

SEQ ID NO: 15687 - DNA, 201 bp, Homo sapiens
cttggctcgctgcaacctctatctcccaggttcaagtgattctcttgcctcagcttcctgagtagctgggactacaggcgtgtgccaccatgcccagctaytttttgtattttttgatagagacagggttttccatgttggctaggcaggtctcgaactcctgacctctgatgatccgcccacctcagcctcccaaagtgc

SEQ ID NO: 15688 - DNA, 201 bp, Homo sapiens
tatttcctatatatagtatgttattgattatctcagtaccactgaagagaggttatctgggtcattggagctttgcttctagatttgtgaagccataaacstatatatttaaaataggaggccaaaaaaaaacgaccattgctttatatagttagattttcagtgaattgagagtttatcatttgtaattatacattaatc

SEQ ID NO: 15689 - DNA, 201 bp, Homo sapiens
ataattatccttacctcccaggagtttgagagggtcttgccagttaaccgcagaattaaacatgcttaggactaattaatcaggagcaatactacaattarttggaggtaatttgaaacctggtttcaaataaccctgatattatgcacacatggtgcacacttttctagtagacatttaatgaaagtaatttaaaaccta

SEQ ID NO: 15690 - DNA, 201 bp, Homo sapiens
ctgcatagtattccattttatatgtaccacattttctttatctagtctatcattgatgggcatttggtttttttccatgtctttgctattgtgaatagtgstgcagtgaacatgaacatgtgtgtgcttgtatctttataataaaatgatttatattcctttgggtatatacccagtaatataattgtataacccagtaat

SEQ ID NO: 15691 - DNA, 201 bp, Homo sapiens
aggtgaagaaatgcggtgagctattttattactgattatgtggacagtccaaaggaaggttcataagcgaaaaggaaaaatttaaattattccatgtgagygattcttactttgcagatttgttgaagtgtagttactggcttcaaaaagtggtatccttaactgacattttgaacacttgaattcactcaataaaaaaat

SEQ ID NO: 15692 - DNA, 201 bp, Homo sapiens
aatgattacattaaaaattcaaatggtgaacctaactaaatccaagctcctacagtaccttcttttcacctttaggtgaagaaatgcggtgagctattttrttactgattatgtggacagtccaaaggaaggttcataagcgaaaaggaaaaatttaaattattccatgtgagcgattcttactttgcagatttgttgaag

SEQ ID NO: 15693 - DNA, 201 bp, Homo sapiens
tatgaattcataaacatttgtaacgatcctcagtttgaagaccatatagaatccctgaagaactggaagacactatttgcttggcaaagagaagtccccaraccaactggggatgaaatattcaaagagataaatgaatactttgaaacatacaaggtactatggaaaaagagtggaagtttgggacaggtaatgacagga

SEQ ID NO: 15694 - DNA, 201 bp, Homo sapiens
tcttcaaataatatttttctcagactggaaatttgtattctaaattatttttagaaaaaaaaaatccccaccccctccagaattaaaacacctgtaaaatwcaggattatattggaagtgttgacatggttttaagggtagcaattgcaaaagtgctactaaaatatattattacaggtatatttttatatcagttaattg

SEQ ID NO: 15695 - DNA, 201 bp, Homo sapiens
ggaatggggagcagctgtaaagaaaaatgaagcttcgcttgcttgcctgctgctcacctactgctttgtggcctggttcctaacaggccatggactggtamtaatctgtggccctggggttgggaacctctagccctgaccaatgttagggagcttttttcctgtgttttcttcaagtggtttcatggtttggggtcttac

SEQ ID NO: 15696 - DNA, 201 bp, Homo sapiens
actaattcttccctaaaatttcccacaattgtgtaaacttacctcagtatattcatagatatgagacattctatcaattttaccctcttaaagatgcagarataatgcattatgtttcatcccaccatctttaatgagaagcttccatcttagattaatattagagaatgttaaaatactctgcaatcaggtaaggacgct

SEQ ID NO: 15697 - DNA, 201 bp, Homo sapiens
catttatacatatttcctatatatagtatgttattgattatctcagtaccactgaagagaggttatctgggtcattggagctttgcttctagatttgtgawgccataaacctatatatttaaaataggaggccaaaaaaaaacgaccattgctttatatagttagattttcagtgaattgagagtttatcatttgtaatta

SEQ ID NO: 15698 - DNA, 201 bp, Homo sapiens
ataaggcattgtttttttttctccccatttcagtgatcttggtatcctgggatattgtttttaaaattatcgttataattcctttgagaatttagtgaaaygttccctttaaccaacttaggaaaaattaatatctttgtacatgattttgagctgtaaaataaacattttaaactgggaataattggagtttagttaaag

SEQ ID NO: 15699 - DNA, 201 bp, Homo sapiens
attctgcaaattgaaatgaattatttaaaaaaaaacaactttaatgtttattaagcaagttttgttattcatgagtttcattagccttttattttttttttaaattttgaagtaaaatttcttgctgtcacaatacacattaaaaattacaaatatgacacatattaaacacattaagatggccgaataggaaaaatatgc

SEQ ID NO: 15700 - DNA, 201 bp, Homo sapiens
atacttgggttattctgcaaattgaaatgaattatttaaaaaaaaacaactttaatgtttattaagcaagttttgttattcatgagtttcattagcctttwattttttttttaaattttgaagtaaaatttcttgctgtcacaatacacattaaaaattacaaatatgacacatattaaacacattaagatggccgaatag

SEQ ID NO: 15701 - DNA, 201 bp, Homo sapiens
acgagttctagttttaggggaggcatgttgttactgtaccttagaatttctggaagatgacatattcatgcttttcctgataactgctgagtctcctgctstgtctgccaatccagtcaagaagcctttgctagcaatcaattaataatacgtttcatttatacatatttcctatatatagtatgttattgattatctcag

SEQ ID NO: 15702 - DNA, 201 bp, Homo sapiens
tatgaaacctttatgaaccttctggatagagaagatgactgctgatttctgtgattagaaattatacttgggttattctgcaaattgaaatgaattatttwaaaaaaaacaactttaatgtttattaagcaagttttgttattcatgagtttcattagccttttattttttttttaaattttgaagtaaaatttcttgctg

SEQ ID NO: 15703 - DNA, 201 bp, Homo sapiens
ctttttctgattatgaaataataccatagttaagtgtaatttcctataatagaataaaaacacgagttctagttttaggggaggcatgttgttactgtacyttagaatttctggaagatgacatattcatgcttttcctgataactgctgagtctcctgctctgtctgccaatccagtcaagaagcctttgctagcaatca

SEQ ID NO: 15704 - DNA, 201 bp, Homo sapiens
gtaaaacatctcccagaacatgaaagaatacaaactttattcatgttacgttgtgacaggagactttgttggatgcgcctgattttcctgccaattcacarcttcattaaaacagtaatgctttgaaatatggcttaggaaacttcacaatgatcattaattacacctaatttctggaagagtatatgcatgtatgtgttg

SEQ ID NO: 15705 - DNA, 201 bp, Homo sapiens
ttagagtaaaacatctcccagaacatgaaagaatacaaactttattcatgttacgttgtgacaggagactttgttggatgcgcctgattttcctgccaatwcacagcttcattaaaacagtaatgctttgaaatatggcttaggaaacttcacaatgatcattaattacacctaatttctggaagagtatatgcatgtatg

SEQ ID NO: 15706 - DNA, 201 bp, Homo sapiens
tatttttttatttttgagatggagtttcactcttgttgcccaggctggagtgcaatggcgtgaactcacctcactgcaacctctgcctcccgggttcaagygattcttctgctcagcctccccagtagttaggattataggtacgtgccaccatgcctagctaattttgtatttttagtagagatggggtttcaccatatt

SEQ ID NO: 15707 - DNA, 201 bp, Homo sapiens
caactctgcttgctcgtcctattattgacattattcctttctgtggtctgaggtgcctcccatgaaacttgcttctaggacactaggattgagaaccatcrgcgtaacatatctgttacgctacaatagtttattttcatattttagctactttacatactcgggtataatgaactttattcatagcttctgaagcagttg

SEQ ID NO: 15708 - DNA, 201 bp, Homo sapiens
acctgggaggcagaggttgcagtgagctgagatcaggccattgtgctccagcctgggcaacagagcgagactccgactcaaaaaaaaaaaaaagaaaaaaraaaagaaaacatttacttcacataataagatatgagaaaaaatggactctctgaatgaaaaaaagaggagatcatgtgaaagatttgcgctttttttttt

SEQ ID NO: 15709 - DNA, 201 bp, Homo sapiens
tgtattagtaattattcatttagagtaaaacatctcccagaacatgaaagaatacaaactttattcatgttacgttgtgacaggagactttgttggatgcrcctgattttcctgccaattcacagcttcattaaaacagtaatgctttgaaatatggcttaggaaacttcacaatgatcattaattacacctaatttctgg

SEQ ID NO: 15710 - DNA, 201 bp, Homo sapiens
tttcttctatcttaatgtattagtaattattcatttagagtaaaacatctcccagaacatgaaagaatacaaactttattcatgttacgttgtgacaggaractttgttggatgcgcctgattttcctgccaattcacagcttcattaaaacagtaatgctttgaaatatggcttaggaaacttcacaatgatcattaatt

SEQ ID NO: 15711 - DNA, 201 bp, Homo sapiens
tttttaattcagtaaagttatagtgattgaaaaagtagtttataatttttaataaattgatcttgttttaattttgagtcatattctagaagtgcttcttygcaaattggtaaattgcacatacatttccacttatatacaagataattgctatggttggtttgtataatagatgcagtgcatctgaagagctattttatg

SEQ ID NO: 15712 - DNA, 201 bp, Homo sapiens
tttttaaatataagtttggagataatttttaattcagtaaagttatagtgattgaaaaagtagtttataatttttaataaattgatcttgttttaattttsagtcatattctagaagtgcttctttgcaaattggtaaattgcacatacatttccacttatatacaagataattgctatggttggtttgtataatagatgc

SEQ ID NO: 15713 - DNA, 201 bp, Homo sapiens
ttttttaatttgaaaaaacctactcttaaacttaattgatttttttaaatataagtttggagataatttttaattcagtaaagttatagtgattgaaaaartagtttataatttttaataaattgatcttgttttaattttgagtcatattctagaagtgcttctttgcaaattggtaaattgcacatacatttccactta

SEQ ID NO: 15714 - DNA, 201 bp, Homo sapiens
gtgaatccctagactagtcttgcttaggataattaggaaaagttaactttcattgtatcaagggacaggtagaacaaaattgtccttttgtccaggaaacyattaaattcttcaaggaaaactttagttatagggattattttttaaatgtctaatttcagtaacaatatttgggacatatttatttttccttctgtttcc

SEQ ID NO: 15715 - DNA, 201 bp, Homo sapiens
tcatggcttctattgcaaatgcccctatttcccaccttcagttggcctaaccaaatttaatttttcaatatcatatgatctttttgtataattatgtattmaaataattccagataggttaggttttcgaattgcaacgtctcatttaatggttactttcatataactgtaggaaagcatttgataatttttccaacaatg

SEQ ID NO: 15716 - DNA, 201 bp, Homo sapiens
gctgaggcaggggaattgcttgaactcgggaggtggaggttgcagtgagccgagattgtgccattccactccagcctgggcaacaagagcgaaactctgtytcaaaaaaaaaaaaaaaaaaaaaaaaagtgaatttttacatgaatattctacatgattggcatatttacatgaatggtttaaaaacccacaataatagca

SEQ ID NO: 15717 - DNA, 201 bp, Homo sapiens
ggaggctgaggcaggggaattgcttgaactcgggaggtggaggttgcagtgagccgagattgtgccattccactccagcctgggcaacaagagcgaaactytgtctcaaaaaaaaaaaaaaaaaaaaaaaaagtgaatttttacatgaatattctacatgattggcatatttacatgaatggtttaaaaacccacaataat

SEQ ID NO: 15718 - DNA, 201 bp, Homo sapiens
ctcacgcctgtagtcccagcactttgggaggccgaggtgggtggatcacctgaggtcaggagttcgagaccagcctggtcaacatggtgaaaccctgtctytactaaaaatacaacaattagctgggcgtggtggcaggtgcctgtaatcccagctacttgggaggctgaggcaggggaattgcttgaactcgggaggtgg

SEQ ID NO: 15719 - DNA, 201 bp, Homo sapiens
ggctcacgcctgtagtcccagcactttgggaggccgaggtgggtggatcacctgaggtcaggagttcgagaccagcctggtcaacatggtgaaaccctgtytctactaaaaatacaacaattagctgggcgtggtggcaggtgcctgtaatcccagctacttgggaggctgaggcaggggaattgcttgaactcgggaggt

SEQ ID NO: 15720 - DNA, 201 bp, Homo sapiens
aaagaagcacaagtttctacaaaatacattctaacagatgttttctataacattcagtctcaagattactagtaaatacttctttgaactgtaaaagcaatctttcaatattataagaaagctcttgctttagtaaacatttagaaactcagctttattatcataagcaagaataagaacagtgtaacaagttttatgcac

SEQ ID NO: 15721 - DNA, 201 bp, Homo sapiens
tactggtactgctgaggcagagggcagtaattggttctttgggataggagaaggggcagttgctgaaatacaaaattaatagtcagcatcccaagttcctyaattgcagccaaaatacatgtgttcaggcctttcggcagtaccgcccccagaactaccagctgtagtgtggtctattcccagacagcaacatgcaagaat

SEQ ID NO: 15722 - DNA, 201 bp, Homo sapiens
ggggaaggatactagtaaagccatttcttactcatgtatacatttttccctccatgaaattagagcagccaccttttacatgacttttacatgcatttcaratttttgtactagcaattaaaatatctactggatgtaaatcacatgtgcttaatgctttgcttcataatatctgttgaagtcaattaaaatatagagaca

SEQ ID NO: 15723 - DNA, 201 bp, Homo sapiens
gttgtctagtatctgaaacagttgttttatatgttttgtccaagtttagatttgtttgtggtgggagggtgagtctggcctcccttgttatatcatgttgkcctgaagcagaagctgagtttcttttattttttaaatatagtttcaatttttaacaactattaaataggcaagtatcaacaacaatagataacaatataa

SEQ ID NO: 15724 - DNA, 201 bp, Homo sapiens
catgaacccgggaggcagagcttgcagtgagccgagattgcgccactgcactttagcctaagaaaaggaaggaaggaaggaaggaaggaaggaaggaaaaatcagtcactcactcaggtttagtttcaaaagccaaaacagtgataatattgaattttttccagccactcagtagtacccagagaattttgatacaaataa

SEQ ID NO: 15725 - DNA, 201 bp, Homo sapiens
gctagttatgaaagaaagaaagagagagagagagaaggaaggaagggagaaaggaaggaaggggctgggagtggtggctcacacctgtaatcccagcactytgggaggccgaggcgggtggatcatgaggtcaggagatcgagaccatcctggcgaacatggtgaaaccctgtctctactaaaaatacaaaaagaaaaaat

SEQ ID NO: 15726 - DNA, 201 bp, Homo sapiens
tgtaaaatactgatttatttaaagatattacaatcatagtagttttttgcaatcttttttaaatcagtggatgtcaaggaacaactattgttctttgtacrgcatttttcaacattgtgaagagttcttatactcaaaaagtttgggagacacagtgtgacattgtttaacctgagttgaacttgtcattttgtattcttg

SEQ ID NO: 15727 - DNA, 201 bp, Homo sapiens
aaagcttctaccaatacaaacacaaaacaagcatagacaaatagagtttaaagaacatcattggtgttttcctctaaagggaatattgatgctaggccaaraaaatcctggagttattcttgaggaccttaaggaataattgaaatgtaggatttgctcctggctttcttgtcctatattcagaataaaacaagaatggat

SEQ ID NO: 15728 - DNA, 201 bp, Homo sapiens
aatcctatgcaaatgtttctttctgtttttcatgttgactctgctaattgaggtctttgttactttttagccgagactattataatttccccaacagatayccctctccccagtgccccttgttgctttctatgcagtttacaaattattgtctgcaaacacatccttaagtctggaatacctttctggaactccttacta

SEQ ID NO: 15729 - DNA, 201 bp, Homo sapiens
tctttgtacggcatttttcaacattgtgaagagttcttatactcaaaaagtttgggagacacagtgtgacattgtttaacctgagttgaacttgtcatttygtattcttgtttagagcagggattttattttgtctctttatctaactttgtattcctaactatttctttctttctctttggttctttgtttctttgttca

SEQ ID NO: 15730 - DNA, 201 bp, Homo sapiens
caattatatagagaatgctttttgtaaaatactgatttatttaaagatattacaatcatagtagttttttgcaatcttttttaaatcagtggatgtcaagraacaactattgttctttgtacggcatttttcaacattgtgaagagttcttatactcaaaaagtttgggagacacagtgtgacattgtttaacctgagttg

SEQ ID NO: 15731 - DNA, 201 bp, Homo sapiens
gattgccaaattattgaaaagtttcctcatacccaaacattggcaatagactgaataaataacatctctgacattatttttcaattatatagagaatgctwtttgtaaaatactgatttatttaaagatattacaatcatagtagttttttgcaatcttttttaaatcagtggatgtcaaggaacaactattgttctttgt

SEQ ID NO: 15732 - DNA, 201 bp, Homo sapiens
catctcgttggacacttggttcctggagattgccaaattattgaaaagtttcctcatacccaaacattggcaatagactgaataaataacatctctgacaytatttttcaattatatagagaatgctttttgtaaaatactgatttatttaaagatattacaatcatagtagttttttgcaatcttttttaaatcagtgga

SEQ ID NO: 15733 - DNA, 201 bp, Homo sapiens
tctttctatggatttttgtgggggatcccatctcgttggacacttggttcctggagattgccaaattattgaaaagtttcctcatacccaaacattggcartagactgaataaataacatctctgacattatttttcaattatatagagaatgctttttgtaaaatactgatttatttaaagatattacaatcatagtagt

SEQ ID NO: 15734 - DNA, 201 bp, Homo sapiens; identical to SEQ ID NO: 1361

SEQ ID NO: 15735 - DNA, 201 bp, Homo sapiens
agacatctaagttacctgaagatcaactttatgttttgaagcttgttttcaagcttgatcagggaaagtctacgtttgcctttagtctaaaggtaatttasccctataataagatgtgacccttctggagtctttgtagactgcctctggtgatcaacgatctcttctctgacttttcagaacgttaatgcctcttacctt

SEQ ID NO: 15736 - DNA, 201 bp, Homo sapiens
tttcctttcagattgttcatttctggtgtataacaacagctgatatttcaacgttgatgttgtactctgaaactttgttgaatttacttattagatctagwagctttctttgagatttttatatgggattatgtcatctgtatatagagatagttttacttcttcctttccattatggatgccttttatttcttttccatg

SEQ ID NO: 15737 - DNA, 201 bp, Homo sapiens
aataggcaagtatcaacaacaatagataacaatataatagatatgcatattcctcccactttatcaaatcttaattttcttcaatttttttttttttttttaatagggtctcactctgttgctcgtgctggagtgacagtggtgtgatcttggttcgctgcaacctccgcctcttgggctcaagtgatcctcctgcctcag

SEQ ID NO: 15738 - DNA, 201 bp, Homo sapiens
aaataggcaagtatcaacaacaatagataacaatataatagatatgcatattcctcccactttatcaaatcttaattttcttcaatttttttttttttttttaatagggtctcactctgttgctcgtgctggagtgacagtggtgtgatcttggttcgctgcaacctccgcctcttgggctcaagtgatcctcctgcctca

SEQ ID NO: 15739 - DNA, 201 bp, Homo sapiens
tgtatcatgtgcaaaagcacagtaaaaacaaaaatgcattggaagctgtgagttgttgcactgcactcatggatgaatagctgttggttcgcattgcgttkttttgttttgttttgttttgtttttttgagatggagtcttgctctgttgcccaggctggagtgcagtggcgtgatctcggctcactgcaagctctgcctc

SEQ ID NO: 15740 - DNA, 201 bp, Homo sapiens
tgagccttgatcacaccattgcactccagcctgggcaacagggcaaaaccctgtctcaaacagacaaacaaacaaacaaaaggcagaggtaggttaagctrtttattaatggtcttctactggtatagatataagctagaaataacattcaagtgtttttacttttactacagttatctggccactttgggactcattata

SEQ ID NO: 15741 - DNA, 201 bp, Homo sapiens
atttgctaagaactaagccttgaactaaggctattttatttgagtatgagtcatatcagggtacggatccattttactattaacaaaacaaatatgttctkttttttttttttaaatgcacacaccacgtttgagagattcttattcactgtattttctttaattatacttgaattttggtttacattgaggagtgccctc

SEQ ID NO: 15742 - DNA, 201 bp, Homo sapiens
caggatacatgtgcaggacgtgcaggtttgctacataggtaaatgtgtgccatggtggtttgctgcacctatcaatctgtcacctacatattaagccccgyatacattagctgtttttcctgatgctgtccctcctccaggacccagtgtgtgttgttccccatgtattctcatcgttcggctcccacttataagtgagaa

SEQ ID NO: 15743 - DNA, 201 bp, Homo sapiens
atgtatatgtatctagatacacaatctgtgtgtgtgtatatatatgcatgtgtgtgtataaatgtataaattagttactagtatatacgtaagtataaaamctcaatgtgcaaggttacattttcagaaaatatgtaatataataaaagaaatcaagcccagaatttttaaaaagtttattgcgctttctgttaaaaatga

SEQ ID NO: 15744 - DNA, 201 bp, Homo sapiens
agtagctgggattacaggcgcccgccaccatgctctgctaatttttgtatttttattagagatggggttttaccatggtggtcaggctggtctcgaactcytgactacgtgatccgcctgcctcggcctcccaaagttctgggattataggcgtgagccactgtgcccggccaatttcattttctattttgaaatttaaac

SEQ ID NO: 15745 - DNA, 201 bp, Homo sapiens
caggagaataccttataaatgatatcttctgcaataaactatagattgtatatatgtatatgtatctagatacacaatctgtgtgtgtgtatatatatgcwtgtgtgtgtataaatgtataaattagttactagtatatacgtaagtataaaaactcaatgtgcaaggttacattttcagaaaatatgtaatataataaaa

SEQ ID NO: 15746 - DNA, 201 bp, Homo sapiens
catttgagcccaggatgttggggctgcagtgagctgagatcacaccactgtactccaggctggatgacagagcaaggccccgtttcaaaaaaaaaaaaaaagcttctaccaatacaaacacaaaacaagcatagacaaatagagtttaaagaacatcattggtgttttcctctaaagggaatattgatgctaggccaagaa

SEQ ID NO: 15747 - DNA, 201 bp, Homo sapiens; identical to SEQ ID NO: 1369

SEQ ID NO: 15748 - DNA, 201 bp, Homo sapiens
aaatgttaaatagaaaattccagaaataaacaatttataaattttaaatcagtggtggctttgagtactgtaatgaaattttgtgccatcccactcagtckgcctcgacttcccttagaatcatccctttgtccggtgcattcacgttgtatttactccctgtctgttagtcacttgttgcagtatcacagtgcttgtgtt

SEQ ID NO: 15749 - DNA, 201 bp, Homo sapiens
tcacgcttgactaatgtttttgtaaataaagttttctcagaacacagccatgccttttgtttatgtgttatgtagggctgcctgagttaagtagttggctrcaaagcctatcatggcctataaagcctgaaatacttactatctggtcctttatagaaagtgttttctgaccctgtactagactagcttgtctcaaaattc

SEQ ID NO: 15750 - DNA, 201 bp, Homo sapiens
ttctgaatagtataaacagttatgtagcctatctaggagtttgtgaatagagtttaaaattttgttttgaagctgcaaatttgattagaaattaaacagtraagttattacttaaggaacttcgttttagctgtctgaacaacttactgtataaaaatctttaaacattctgtataaatatgtgataagatatgcaatgac

SEQ ID NO: 15751 - DNA, 201 bp, Homo sapiens
aatgtttctgagattctttcatgctgttgcatgtatcagtagttttttgttttgttttgttttgtttttgttttttcagagtcagggtctccttctgtcayccaggctagagtacagtggcgcaatcatagcttactgcagcctctaactactgggctcaagctatcctcctgcctctcaagtaggctaggctgcaggtat

SEQ ID NO: 15752 - DNA, 201 bp, Homo sapiens
tggagatgagattttgctatgttgcccaggttgctctcaaactcctgggctcaagtaattgtcccacctcagccttccaaaatgctgggattacaggcgtsagccactctgcccggcctattatctctgttctgcccacttccaaccactaatctactttctgtctctatgatttgcctattctggatgtttctataaatt

SEQ ID NO: 15753 - DNA, 201 bp, Homo sapiens
tccatatagaaaattaagtttcattacatttgacttgatctaggttttcatttcatagaatggagagcagactctgtaaatattttgccccagacctagcyttattacaaacattgtcttaattaggattctgtctacccagaatagaaattaactcaagctagcatgagtgtatattgaaatttatattaaggataaagg

SEQ ID NO: 15754 - DNA, 201 bp, Homo sapiens
ttcctgctcagtcattgacacccgcaggacatcccatccccataatgccaggccacaggcgagacccacggagcatctgaccactcccaaccctccacccrctccccactcatgcaaatgcaggcaaaggcgtcctgcctgggtttctttcaaaccgtgtgggttttctcctcatgacaggatcttctggggagcaaggag

SEQ ID NO: 15755 - DNA, 201 bp, Homo sapiens
aggtttccaaactgatgtatttcccattttgtaaataaaatcgttaatctctcaagagaatatctagccactttagatgaaaacagaaaaattacagtgcrttggcttgacctaggtgacagctaggtttcattactgtgcattaattattttaaaaacatgagcggtctgttcattattatcagtgcctctgggccaggc

SEQ ID NO: 15756 - DNA, 201 bp, Homo sapiens
atacaagggatataccttaatgtaataaaggccatctatgacaaacccacagacaacataatactgaatggggaaaaattgaaagcattccctctgagaaygggaacaagataaggatgctcactctcaccactcctcttcaacatagtgctgaaagtcctagccagagcaatcagacaagattaaaaaaaaagggcatcc

SEQ ID NO: 15757 - DNA, 201 bp, Homo sapiens
acatagagaaaaactccaactatctctctccatgtctccctctctctctctctgaatatagatgtatgtacatagagaaaatctccaactctcactctccrtgtctttctcagtctctctctgtctctgacttctgtctctctctctctctctctgtctcttcccactctttctttttgtgcccagaaaccagagacagga

SEQ ID NO: 15758 - DNA, 201 bp, Homo sapiens
ttttgcttgttctagaagcctgtataaatgggatcataccgtatgtcctgtctgaagtctagcttcttttgctcagcataatgggttctgagattcattcrtgtggcatatttcattttactgcagactagtattccattgcatagataggacacaattcattcgcctgttcacggtcatttgtgttgttaattttctcta

SEQ ID NO: 15759 - DNA, 201 bp, Homo sapiens
caattatatgcatgctgctagacaaataaagccagaccctgcatttcttggacaacttgtctccaaatgcaacttcacctgggaagaaactgctggatctktgttcctggagataaaagtgtctgagtaagacttcagaagagactgtaccatatttcctaaattgtgtgttttgtatttatagaagatttaaaggatttt

SEQ ID NO: 15760 - DNA, 201 bp, Homo sapiens
cagggcaggcaaacgcagatgttcactccagctgtctgtgaaccagcagcctggattgaccagcaagcagtcttggctgtgatcatctttaaagagaagaygggaagggaagagaaagcaaatcagagcagggacttactaaaatgtgtggaaaatgtcttcggatgctggagactcagcctatatctttcagccaaaagt

SEQ ID NO: 15761 - DNA, 201 bp, Homo sapiens
atgcatgctgctagacaaataaagccagaccctgcatttcttggacaacttgtctccaaatgcaacttcacctgggaagaaactgctggatctgtgttcckggagataaaagtgtctgagtaagacttcagaagagactgtaccatatttcctaaattgtgtgttttgtatttatagaagatttaaaggatttttaaggga

SEQ ID NO: 15762 - DNA, 201 bp, Homo sapiens
agccactctctcccttccttccttctctcccttccttccccctttctccttcttcctttccttttctctctccctccctcccttcctcccctttcccttcwttctttcctctccatccctccttcctttccctctctctctccattctttccttccttccttctcttttctcagctttcctttttttctctccacaacaca

SEQ ID NO: 15763 - DNA, 201 bp, Homo sapiens
atattttgttcatcgcagaatttttgcattaactttgattttttaaatatattgcactaaaatattatttatcttgattattgaatcttttgtactcaagkctagtgaattatttgcttcatcctaatccctgagtctcaggccctgcaaggtgaatggattagcttgagtcatataaagtatccatttattgcatatgaa

SEQ ID NO: 15764 - DNA, 201 bp, Homo sapiens
catagcaagagcaaacactgcctggaactgccagggactctgctggttgtgtttgtgcaatcatatgtgtgtgattgtgtgtgtgcatgtgtgtgaaaaagagagagagagagagagtgagagtgagagagagagaaagatctccttctgggaaccttgctcaactaagggaatctagaatgtcagctgattaaagacatt

SEQ ID NO: 15765 - DNA, 201 bp, Homo sapiens
gcttcatcctaatccctgagtctcaggccctgcaaggtgaatggattagcttgagtcatataaagtatccatttattgcatatgaaaaacagataaatatytgtcattccatatgattcaacctaatggatcctcctaggatggagtcaggaggccacactgcacatgagtgcttcaattataccactcggtggtcctaag

SEQ ID NO: 15766 - DNA, 201 bp, Homo sapiens
atagcaagagcaaacactgcctggaactgccagggactctgctggttgtgtttgtgcaatcatatgtgtgtgattgtgtgtgtgcatgtgtgtgaaaaagagagagagagagagagtgagagtgagagagagagaaagatctccttctgggaaccttgctcaactaagggaatctagaatgtcagctgattaaagacattt

SEQ ID NO: 15767 - DNA, 201 bp, Homo sapiens
gccacactgcacatgagtgcttcaattataccactcggtggtcctaagcctggtgcacattagagctctttctgaaatttttattaaaaccagagcctcargtttgggatgggaaactggcattcctctactgcaaacctctggattggaacccctggattaaaccagaattaaatcagtctatagattgaggcagagagt

SEQ ID NO: 15768 - DNA, 201 bp, Homo sapiens
tagcaagagcaaacactgcctggaactgccagggactctgctggttgtgtttgtgcaatcatatgtgtgtgattgtgtgtgtgcatgtgtgtgaaaaagagagagagagagagagtgagagtgagagagagagaaagatctccttctgggaaccttgctcaactaagggaatctagaatgtcagctgattaaagacatttt

SEQ ID NO: 15769 - DNA, 201 bp, Homo sapiens
tgcctcctcatgaaagaggactagagatgcccccggaggagaatgtatccccatacgattgccaccaaaattgttagaaatatcaaaattgttagaaatasatcattggtgccacaaaggaaagtcagcacagagacaaaagatctctcagcaaggccatctttactttctgcagaaagggtgctcaattgcagatggaac

SEQ ID NO: 15770 - DNA, 201 bp, Homo sapiens
agcaagagcaaacactgcctggaactgccagggactctgctggttgtgtttgtgcaatcatatgtgtgtgattgtgtgtgtgcatgtgtgtgaaaaagagagagagagagagagtgagagtgagagagagagaaagatctccttctgggaaccttgctcaactaagggaatctagaatgtcagctgattaaagacatttta

SEQ ID NO: 15771 - DNA, 201 bp, Homo sapiens
gtggcttctttgctttgactctaatcctacccttcttcctctgtctcttgctttctctctatcaaggcactgggcagatctggctggataatgttcagtgycggggcacggagagtaccctgtggagctgcaccaagaatagctggggccatcatgactgcagccacgaggaggacgcaggcgtggagtgcagcgtctgac

SEQ ID NO: 15772 - DNA, 201 bp, Homo sapiens
cctcctaggatggagtcaggaggccacactgcacatgagtgcttcaattataccactcggtggtcctaagcctggtgcacattagagctctttctgaaatktttattaaaaccagagcctcaggtttgggatgggaaactggcattcctctactgcaaacctctggattggaacccctggattaaaccagaattaaatcag

SEQ ID NO: 15773 - DNA, 201 bp, Homo sapiens
aacatttccaaataaggaaggagcatagggtgtgagctggaacgtgcctgtgagcatgttcagcagttacataggctagggcttaacaaagagttattaaygcaaagcaagaggcttgaagaaagttattcctcaaaagaaaccatcatttccaacactcacaatttattcttcaacaagaaggaaaactttgaagaggaa

SEQ ID NO: 15774 - DNA, 201 bp, Homo sapiens
atttttatagactgtttttaaccttttataattttttgttaaagagcaggttagtgttttaagaaaaacctgttgttcttttattttaatatccagttcayagaaaaactggatgacacccctttaactttagccaatatgtttacacacagaatttcctttacaattaaagtttcaaaacttgcttaaaccttcaaaaca

SEQ ID NO: 15775 - DNA, 201 bp, Homo sapiens
gctttccttacataccttgcatataaactgtttcttcaatagttttacattcaggaggcctaattacttttaagttatacaacatttcttgcataaattcycttttataattttgtttttcacaacttttacagacaattcttcgacatgcctcaactttctgagttgttgctaacatcgctttctttaaacaaccagtta

SEQ ID NO: 15776 - DNA, 201 bp, Homo sapiens
cactgttaatatttagcaaattttacttttgttgaaaaccttgtaagtttgggatttcaattatcctttgctattaataagacctaatttagtccaaattyaacttagaattgctatagatgactccttcctgaatctgtaagtattttaaggcttggctgagtgcaaacagctcccacctttgagcagaccaattattag

SEQ ID NO: 15777 - DNA, 201 bp, Homo sapiens
agctggaacgggcctgtgagcacattcaacagttacataggctagggcttaacaaagagttattaacacaaagcaaggaggcttgaagaaagttagtcctyaaaagaaaccatcatttccaacacacaatttattcttcaacaagaaggaaaactttgaagaggaaactttttactttctacatttggtgtgattgtcagt

SEQ ID NO: 15778 - DNA, 201 bp, Homo sapiens
aaaactggatgacacccctttaactttagccaatatgtttacacacagaatttcctttacaattaaagtttcaaaacttgcttaaaccttcaaaacaaaatttttttaaccttttaatgtaggtagaaatccacattcttatgcctccttataatccttttaccaaaagtttattttgctttccttacataccttgcatat

SEQ ID NO: 15779 - DNA, 201 bp, Homo sapiens
atacttaagaagaaggagtatacttattatagttgttgaagaggtaagaattgaagctatgtttgtttgtttgtttgtttgtttcttgttgatgaaatacyagagtaaaagggataggcaattgaactagagcaaaagtattgctccaattatttggcagagtgtccagtaatggtcctccataataccaccatacatccg

SEQ ID NO: 15780 - DNA, 201 bp, Homo sapiens
ggaaggaaggaaagaaagaaagaaagaaagaaagaaagaaagaaaagaaagaaagaaagagaaagaaagagaaagaaagaagaaagaaagaaaagaaagartgtgagagaaaagaaaagaaagggaaagaaagaaagttttcttaatgtattggagatttctccatttcactcagaatcaggagatctgagcctcagcttg

SEQ ID NO: 15781 - DNA, 201 bp, Homo sapiens
gaaggaaggaaagaaagaaagaaagaaagaaagaaagaaagaaaagaaagaaagaaagagaaagaaagagaaagaaagaagaaagaaagaaaagaaagagygtgagagaaaagaaaagaaagggaaagaaagaaagttttcttaatgtattggagatttctccatttcactcagaatcaggagatctgagcctcagcttga

SEQ ID NO: 15782 - DNA, 201 bp, Homo sapiens
gagaggctgcacctgccctccttcctccctggagggcctttgcctcatcttgatctggatcaatcccccattatccttttaagcccagctctggtatctgrtatctcttgattcagatgataaagctatttgtcatatttctgccctgtctcccctgcctcccggcacttctgtcttttcagggacatcaacctttgccgc

SEQ ID NO: 15783 - DNA, 201 bp, Homo sapiens
gaaaaatatttctaatgtcattttcctcatttatttttctctattgttggtattgaaatataaaatgctgtttttccctgattataaagtattaaactagttttttttttattattattacccaaggatactggactaggaaagttttcaacacatgctgaagaaaattttagaagtgagtttgggaaacttttggaatat

SEQ ID NO: 15784 - DNA, 201 bp, Homo sapiens
atagagcattaaaccaccaaagctaaggaccctcacagagtccactgcaccctctgctgcgtccgctggaacaggtgctggtatccacagctaagaggccsttagttggttcacatcagaggactttgtgcagacaacccccagtaccagcctggagctgggtaaagttgctgggtgactagacccagaagagagacaaaa

SEQ ID NO: 15785 - DNA, 201 bp, Homo sapiens
cactgcctggaactgccagggactctgctggttgtgtttgtgcaatcatatgtgtgtgattgtgtgtgtgcatgtgtgtgaaaaagagagagagagagagagtgagagtgagagagagagaaagatctccttctgggaaccttgctcaactaagggaatctagaatgtcagctgattaaagacattttagacattctcagg

SEQ ID NO: 15786 - DNA, 201 bp, Homo sapiens
actgcctggaactgccagggactctgctggttgtgtttgtgcaatcatatgtgtgtgattgtgtgtgtgcatgtgtgtgaaaaagagagagagagagagagtgagagtgagagagagagaaagatctccttctgggaaccttgctcaactaagggaatctagaatgtcagctgattaaagacattttagacattctcaggc

SEQ ID NO: 15787 - DNA, 201 bp, Homo sapiens
aaatatattgcttgatattatttactaacttttttatgcaagttttttttgaaatttttatttctattttaagttccagagtacatgtgcagaatgtgcasgtttgttacacaggtaaatgtatgccatggtggtttgctgcacccgtcaacccatcacctagatattaagctcagaatgcatgagctattattcctaatg

SEQ ID NO: 15788 - DNA, 201 bp, Homo sapiens
aaaggtgccttcagggaacattgggaggctgggcctgggtgacagccccaacttcccccattcactcttatgtgaccttgaattactcacctagcatctcygagtgtgtactttctcctctgtaaaggagggaaatcacactgccttggagggtggctgaaagatcaaacaaggtcatggatgtaaagcccctggcacagt

SEQ ID NO: 15789 - DNA, 201 bp, Homo sapiens
tggctagccagttttcccagcaaaatttattaatagagaatcctttccccattgcttgtttttctcaggtttgtcaaagatcagatagttgtagatacgcrgcattatttctgagggctctgttctgttccattggtctatatctctgttttggtaccagtaccatgctgttttggttactgtagccttgcagtatagttt

SEQ ID NO: 15790 - DNA, 201 bp, Homo sapiens
tggggctatggacctggtgaacaggggcttccctatgattcctgtctttagagggtgtttgctgctcggtgctttaggggacagttggaggggtgcatctytttaggtggtcacaataaagggtggtcacagtgttttgaggccccttctacttacctgcatgtgaacagcgtatgtcaagactggtggggagaaagacca

SEQ ID NO: 15791 - DNA, 201 bp, Homo sapiens
gaaaaaaaggctttctcagactatatgggtttgtaggatttctggacaggagggatgggaggaagaccacaccccagagtgctaatagagattatctcatygggttaggaccttagggggttgagggatgattattaacccttgtcatgccctgtacattatttgataaaatatatcaagcatgttttacttttataattt

SEQ ID NO: 15792 - DNA, 201 bp, Homo sapiens
tagtttctgatgagaaactttctgtcattcaaattggtattcctggccaggcacagtggctcatgcctgtaatcccagcattttgggaggctgaggtgggyggatctcttgaggtcaggaattcaagaccagcctggacatcatagtgaaaccctgtctctactaaaaatataaaaattagccgggcatggtggcgtgcac

SEQ ID NO: 15793 - DNA, 201 bp, Homo sapiens
ttgaagaggtccttcacgtcctctattaactgtattcctaggtattttattctctgtagcaattgtgaatggaagttcattcacaattttgttctctgctygccttttactgaagatttttgtgtcaaagttcatgaaatagttttgtttgtttctttctttctttttactggactatctttgattttcatattaggatca

SEQ ID NO: 15794 - DNA, 201 bp, Homo sapiens
aagtgtcctgtctttcaccattaagtatgatgttagctttagatagtttgtagatgcagttttttaagttgaggaagttctcctctatttctagtttgctragaatttttattgtgagtttattatttgttatgagtcatagttttgaattataatgatgagagttttactatgaattggattttggcaagtgctttttct

SEQ ID NO: 15795 - DNA, 201 bp, Homo sapiens
ccaaagctaaggaccctcacagagtccactgcaccctctgctgcgtccgctggaacaggtgctggtatccacagctaagaggcccttagttggttcacatsagaggactttgtgcagacaacccccagtaccagcctggagctgggtaaagttgctgggtgactagacccagaagagagacaaaaatcactgcagtttgac

SEQ ID NO: 15796 - DNA, 201 bp, Homo sapiens
caaggaaaactttcctggccttcccagagacttagacatggaaacacaagaagcacaaagaagacctgggaaattcgttgcaaaaagatcttcccctagayacattgtcatcaggttatctaaagttaagatgaaggaaagagtcttaagagctgtgagacagaagcacaaggtaacctataaaggaaaacctatcagatt

SEQ ID NO: 15797 - DNA, 201 bp, Homo sapiens
tctctgaccagaccaagcatccctcaccaatctaacttcaacccctcttgctgtagctcaggcccgtttcttcctgctcagtcattgacacccgcaggacrtcccatccccataatgccaggccacaggcgagacccacggagcatctgaccactcccaaccctccacccgctccccactcatgcaaatgcaggcaaaggc

SEQ ID NO: 15798 - DNA, 201 bp, Homo sapiens
cccacagcaaaaaaggcaccaacagattcctccagggaaacagttctcagtgccttctaacaggtgccgttggccccttctccagggtggacactctgaayggccaagaacagcctcctctgctttttgcatctccagctgttataggacgcctcagccataaccaagttccttaggattgctttgtcttcctcaaggagc

SEQ ID NO: 15799 - DNA, 201 bp, Homo sapiens
tctttgaagcaattctgaatgggagttcactcatgatttggctctctgtttgtttgttattggtgtataagaatgcttgtgatttttgtacattgattttktatcctgagactttgctgaagttgcttatcagcttaaggagattttgggctgagacaatggggttttctagatatacaatcatgtcgtctgcaaacaggg

SEQ ID NO: 15800 - DNA, 201 bp, Homo sapiens
ctactactgggtatctacccagaggaaaagaagtcactgtttgaaaaagatacttgcacatgcatgtttatagcagcacaattcacaattgcaaaatcatrgaaccccaacaagtggataaagaaactgtggtgtatatatgatggaatactactcagccataaaaaggaatgaattaacagcattttcagtgacctggat

SEQ ID NO: 15801 - DNA, 201 bp, Homo sapiens
tttggctctctgtttgtttgttattggtgtataagaatgcttgtgatttttgtacattgattttttatcctgagactttgctgaagttgcttatcagcttraggagattttgggctgagacaatggggttttctagatatacaatcatgtcgtctgcaaacagggacaatttgacttcctcttttcctatttgaataccct

SEQ ID NO: 15802 - DNA, 201 bp, Homo sapiens
ggctgagacaatggggttttctagatatacaatcatgtcgtctgcaaacagggacaatttgacttcctcttttcctatttgaataccctttatttccttcwcctgcctgattgacctggccagaatttccaacactatgttgaataggagtggtgagagagggcaaccctgtcttgtgccagttttcaaagggaatgcttc

SEQ ID NO: 15803 - DNA, 201 bp, Homo sapiens
taggaggcatggccagaaagaggaatgaataaacaattaggaaggagttacagctactaaaaatgacaagatagggcacaacccgtgagtacatgactaarggagggtgaattgcaagctcattggtaagggcaaggttctgttttcttttcttactagcacagagcttggaacatagtaggcactcattatatatccgtt

SEQ ID NO: 15804 - DNA, 201 bp, Homo sapiens
acatcatatgttatcactgatatgagggagctaagccatgaaggcataagaatgatatagtggactttggggacttggagggaagagtgggagggtggtgwcggataaaagactacaaatacagggcaatgtatactgcttgggtgatgggtgcaccaaaatctcacatatcaccactaaacaacttcctcatgtaaccaa

SEQ ID NO: 15805 - DNA, 201 bp, Homo sapiens
tgtggtaccggagtgattatttctatgttatctcctttacagcttggtccagagagctaccttaggctctccaatgaatctattcaaacactgcctctgtyacctttactcatctaaaattttgtcaacctgagacgaagtgctggcactaggaatgtaagactgtctctattattttgtttgctctaggttagggagaag

SEQ ID NO: 15806 - DNA, 201 bp, Homo sapiens
ctgagatagtccaataatttattaaattctactaagtcaaatcactaaattgtcatttataaaactcttcctcattttcctctaagtttctgagagagctytgcagaagtctacacataccccaattttgagtcccttatccttcatctcacttcttaccacaaggtcgatttgtcagttattagctcaatcctaaatttg

SEQ ID NO: 15807 - DNA, 201 bp, Homo sapiens
ctaggcttaactatttgctcaatgttaaggcagctctgtggaaatttgtctgtgtaactagggtgctatgcaggcctgtctgtgtgacggtcatgcctgcytgtctgtgtggttgtcagggagaattgacctgccacactagcatgtgtaaggatcctcatcaggcaagaaaaagtgtgggtggccagtccacacctgtta

SEQ ID NO: 15808 - DNA, 201 bp, Homo sapiens
ctgtgtgacggtcatgcctgcttgtctgtgtggttgtcagggagaattgacctgccacactagcatgtgtaaggatcctcatcaggcaagaaaaagtgtgrgtggccagtccacacctgttactgggaggctggcactgtcacctcattccaatagctctcaaaagacaaacctctgtgagttgggccaaggttcaacaac

SEQ ID NO: 15809 - DNA, 201 bp, Homo sapiens
gtccagtctctccatcccttccgctggtgggcataggcagatgactgagcagatgtgtggaagggactccagagaggtccccaaggctcggttcacctgtstgctgtggattggttggttggtttcggacacatgggtttgtgccggtaatttttatatcatgcgttaacttggttgccccagttttaagctggaattggg

SEQ ID NO: 15810 - DNA, 201 bp, Homo sapiens
gatctgccaggcagcccactgactgaactaatttggaacccaccagctgataggaaatcaagctccatggagaccatcaagagtggtcacacttgcctggractccagccccaccactcctgtgtgataaagcactgggagccacttgaccatcacttcagagaatatcagaacttgatgtaactacattgggcattgagc

SEQ ID NO: 15811 - DNA, 201 bp, Homo sapiens
cacctcttcagagctctctctccccttttctaattcactggagagaaggctggtgtcatgcctgagtcctccccagcttcagaattatcaaaatcatagawtggagcaataaatgccttttagcaaaattgcatcccaataagcctttttgaaagcctaaaatgttgtgttgaggtgagatattcctctttagacctttgc

SEQ ID NO: 15812 - DNA, 201 bp, Homo sapiens
aagggaggaagaatgattcagaacctggggctgacccatgatgaagtgcgtgggcatgggttttagcgggaagctgactgctgggaggggaggaggggctrcagaattctcctaggctggtctgatgagggatactggcaccaggaacatggttgggtggttgacctctgaggatccttccaaagctggaacaacacagtt

SEQ ID NO: 15813 - DNA, 201 bp, Homo sapiens
cctcgtgaattcacagcactcaatgctaagacccagggctctcccttcttcctcacctcttcagagctctctctccccttttctaattcactggagagaargctggtgtcatgcctgagtcctccccagcttcagaattatcaaaatcatagattggagcaataaatgccttttagcaaaattgcatcccaataagccttt

SEQ ID NO: 15814 - DNA, 201 bp, Homo sapiens
aattcctaaaagttctttttcatcttaggtttggctggttttcctggagctaaaggagatcaaggtaagaactacaggaatctgggcatcatcccagctaygactgtccctggcagagtgaagctggggaccagacaccaccatcttttgcttcattgtagtattcacccagaacacctggggttttttagacatctggcc

SEQ ID NO: 15815 - DNA, 201 bp, Homo sapiens
atggtcatgtactctacaaataagaacattttaatttctttctttccaaactgtatgccttttatttctttttcttgccttactgctctggctagaacttyccagtgctatgttgaataagaaggcaagaacatatatccttgccttgtttcgaatcttaagggaaaagtgtcctgtctttcaccattaagtatgatgtta

SEQ ID NO: 15816 - DNA, 201 bp, Homo sapiens
attattcctaatgctctccctatacccccaccccctgactggccccagtgtgtgttgttcccctccttgtgtccacgtgttctcattgttcagctcccacwtataagtgagaacatgcagtgtttggttttctgttcctacattagttttctgaggataatggcttccagctccatccatgtcactgcaaaggacacgatc

SEQ ID NO: 15817 - DNA, 201 bp, Homo sapiens
tcattcaaattggtattcctggccaggcacagtggctcatgcctgtaatcccagcattttgggaggctgaggtgggcggatctcttgaggtcaggaattcragaccagcctggacatcatagtgaaaccctgtctctactaaaaatataaaaattagccgggcatggtggcgtgcacctgtaatcacaactacttgggagg

SEQ ID NO: 15818 - DNA, 201 bp, Homo sapiens
atctcaatgctggtatctcttgattgtctcctctcatctgagttgtgattttctctattctttgtatgatgggtgattttccattatataatggatgtttygtatagtatgttaggagattctgagtcctatttaaaacttctattttagtagacagtcacagagtcacacagtttaggtttattatgtaggttctggcct

SEQ ID NO: 15819 - DNA, 201 bp, Homo sapiens
gtgttaaatgtgaggctcccctcgtgtgttatttgtcttcatcatgacggttgcatgaatacctgaggccctgagttgcattcctgatgttctttcaacamttctaactctgcacatgttcagcacccaaacctctgtagccactcattcattcatctattcagtcatcatcttcccagcatgttgtgtgccagataccac

SEQ ID NO: 15820 - DNA, 201 bp, Homo sapiens
ggaatgacttgggcaggttatgtgttgtggggctcactcaggctgctgtgtgagcctggattctggggggtagggtgcagaggagacggggcactccatgytaaactgagtataatcgagtaccactagctaaacaaccaacccaccaacaaaaccactcctctctgtgctgccagagctacccctagaccattgttcatc

SEQ ID NO: 15821 - DNA, 201 bp, Homo sapiens
ggaatataaggtttggtcccccgtgaaaacattgcaggtgtcaggaaggcagggcatggtgtctggggtcaggagaacttgtgttcctgaaatcagaccargaaagctgctgcttttccagcctctgccctttatggttcctgaattgggagtgctgagtcagtggaagagtctcataggagaccagtttgcttctctttt

SEQ ID NO: 15822 - DNA, 201 bp, Homo sapiens
tgtgcgggggttggaaggaatatcagcagggtaaacacaggagctgcaggtgataggaaaagatctgaggtttaagtgcatctgtcacaatagttaaaacycacctgcccctatcacaaaagcaaacatggttgggcacacattcccttgggctccttcattattgtctgtttccctttcagatgtgcccttggggcccat

SEQ ID NO: 15823 - DNA, 201 bp, Homo sapiens
ctagaccaacctggggtcatatgcctgctgtgtcacctgccaccttaactttttaaccccagctctctcctctgtaaaggagtgtaaccatgcctaccttkcagggttgctgcaatggttagagatgatgttggtaaatgcctggtgtggaataggtgctcatttaatgtgagcagtaggaactgcagggccttctgcagt

SEQ ID NO: 15824 - DNA, 201 bp, Homo sapiens
cctgttttctcttgtgggcatttagtgctacaaatttccctctacacactgctttgaatgtgtcccagagattctggtatgttgtgtctttgttcttattsgtttcaaagaacatctttatttctgccttcattttgttatgtacccagtagtcattcaggagcaggttgttcagtttccatgtagttgagggtttttttt

SEQ ID NO: 15825 - DNA, 201 bp, Homo sapiens
gtaggcacagctttaggccacgcagaaatgttttgtggacgtgcaatatcatgcctgagtgtggagcgcacatggtcaagatgtagaaaaggccgtgtgcycacgctaggtcctgacagcacatggaatttgtgtttacaaattcagggcctgtagaagttatgcacacatgacacaagaatgtcagggatatgctcaaat

SEQ ID NO: 15826 - DNA, 201 bp, Homo sapiens
tcaggccctgcaaggtgaatggattagcttgagtcatataaagtatccatttattgcatatgaaaaacagataaatatctgtcattccatatgattcaacytaatggatcctcctaggatggagtcaggaggccacactgcacatgagtgcttcaattataccactcggtggtcctaagcctggtgcacattagagctctt

SEQ ID NO: 15827 - DNA, 201 bp, Homo sapiens
ctcctctctcagcctgccccaaaatgggaagagcctcgccctcagacagtttcagcaaaaccagctgctaggtgtggctcaactgttgtagggtttacccygtgacacagagctccagccccagcagggttccttgctctgggccctgtgtgagctgaggcttaggagggtgatcccatggctaggtcctgtgaccaaggg

SEQ ID NO: 15828 - DNA, 201 bp, Homo sapiens
cctaatggatcctcctaggatggagtcaggaggccacactgcacatgagtgcttcaattataccactcggtggtcctaagcctggtgcacattagagctcyttctgaaatttttattaaaaccagagcctcaggtttgggatgggaaactggcattcctctactgcaaacctctggattggaacccctggattaaaccaga

SEQ ID NO: 15829 - DNA, 201 bp, Homo sapiens
ttgctattgtgaataatgccgcactaaacatacgtgtgcatgtgtctttatagcagcatgatttataatcctttgggtatatacccagtaatgggatggckgggtcaaatggtatttccagttctagatccctgaggaattgccacactgacttccacaatggttgaactagtttacagtcccatcaacagtgtaaaagtg

SEQ ID NO: 15830 - DNA, 201 bp, Homo sapiens
aacctgctctggaaaagaataatattgctcatttacacttcagtgtatgtctctgtttcctctcctagaggggatgtatgtttacatctcatttctgattragggaatataaggtttggtcccccgtgaaaacattgcaggtgtcaggaaggcagggcatggtgtctggggtcaggagaacttgtgttcctgaaatcagac

SEQ ID NO: 15831 - DNA, 201 bp, Homo sapiens
caggcaagaaatattacagcctcttttgtaatgtcgcaaactggaaacagctcattaaaagggaaatgttagcatgaactgtggcttttgtctctaaggartattaggcagctaatctctctctacaaagaaaactaggaaaatgtccacgaaaatctttcactgtgaaaagcaatgtgtggtattttatgtactatgata

SEQ ID NO: 15832 - DNA, 201 bp, Homo sapiens
ttagcccatgacattttctaataagtcccctccccacacccatgagaatcaaagatgagctgaccaggcagaggcagagggagagcagggagctctgccargctaagtgagcgggttcctttgcctaggggactgccctccagtgggcaaatcccctgtgtcctcaattatctggtcctgtctaccccccagactctagct

SEQ ID NO: 15833 - DNA, 201 bp, Homo sapiens
accttaaaataggaaaggcgctgttttaagagttctggggattttcagaacccaggagggtagaggtttatttccttgattgacaagtcttgtgctggggyttgccctaggcatggagcacacagcagcgggttaggcgcagctctagcatccaaggcaggggcgtgaacatgcacttgagccatgccccacgacccaaca

SEQ ID NO: 15834 - DNA, 201 bp, Homo sapiens
tggcaggtcccaagggagcccctggacaagctggccagaagggagaccagggagtgaaaggtaaggcctctgcatctgattcctttgttcttaggactgtrctttacagccagttctgtaccttaaaataggaaaggcgctgttttaagagttctggggattttcagaacccaggagggtagaggtttatttccttgattg

SEQ ID NO: 15835 - DNA, 201 bp, Homo sapiens
agtccaacgaaaagggccccagtaccttcaaggcctgtctactgtggtaccggagtgattatttctatgttatctcctttacagcttggtccagagagctrccttaggctctccaatgaatctattcaaacactgcctctgttacctttactcatctaaaattttgtcaacctgagacgaagtgctggcactaggaatgta

SEQ ID NO: 15836 - DNA, 201 bp, Homo sapiens
ggtttggttttaagagttctttatatattctatatataagtcctttgctagatatgtggtttgcacatattttctccgagtctgtaacttgcattgttatsttcatatcagcatcttttacaatgcaaaagtttttaattctgacaaggtccaacctaacaatttttccatgtatgtattatgctttcggtgtcaagtcta

SEQ ID NO: 15837 - DNA, 201 bp, Homo sapiens
tcacatcccttgtaagttggattcctaggtattttattctctttgaagcaattctgaatgggagttcactcatgatttggctctctgtttgtttgttattkgtgtataagaatgcttgtgatttttgtacattgattttttatcctgagactttgctgaagttgcttatcagcttaaggagattttgggctgagacaatgg

SEQ ID NO: 15838 - DNA, 201 bp, Homo sapiens
tatattctatatataagtcctttgctagatatgtggtttgcacatattttctccgagtctgtaacttgcattgttatgttcatatcagcatcttttacaaygcaaaagtttttaattctgacaaggtccaacctaacaatttttccatgtatgtattatgctttcggtgtcaagtctaagagttctttagcccttgttggt

SEQ ID NO: 15839 - DNA, 201 bp, Homo sapiens
tttttatatgttagagacaagatctcactatgttgcccaagttggagtgtgcagtggctattcacaggtgtgatcatagtgcattgcagcctcaaactcaygggctcatgtgatcttcccacttcagcctcccaagtagctgggactagaggctcataccaccatgcctgcccgtgatccattttgaattgattctcgtat

SEQ ID NO: 15840 - DNA, 201 bp, Homo sapiens
aggggagcccagggctggcaggtcccaagggagcccctggacaagctggccagaagggagaccagggagtgaaaggtaaggcctctgcatctgattccttkgttcttaggactgtgctttacagccagttctgtaccttaaaataggaaaggcgctgttttaagagttctggggattttcagaacccaggagggtagaggt

SEQ ID NO: 15841 - DNA, 201 bp, Homo sapiens
gaggagtcctatttctctgaaataaaataaatattggcacttaaaatcaagaggacatgatcttgctaaatgaacaaattattatctcagtgacccagcargatgctggggacagtgggccttccatgaaagtttactgaaaaaaaaggatgaatggatggaaagaaggaagaaagggggacctttaacattaactacaat

SEQ ID NO: 15842 - DNA, 201 bp, Homo sapiens
tcagagtgactgctgtgggctgcagacgcagcctccctccagagtctggacctctgaggggtctgtaggtgaacggaggcctggtgggagaccccagaggkgatgagaggctgggaagcaccctttctggtggccagagtagggctgggcagccgccctcaggggcaggtatggctagatggccttcatcctagatggggc

SEQ ID NO: 15843 - DNA, 201 bp, Homo sapiens
actactcagccataaaaaggaatgaattaacagcattttcagtgacctggatgagattggagactattattctaagtgaagtaactcaggaatggaaaacsaaacatcatatgttatcactgatatgagggagctaagccatgaaggcataagaatgatatagtggactttggggacttggagggaagagtgggagggtgg

SEQ ID NO: 15844 - DNA, 201 bp, Homo sapiens
agaaggaccaagaatctgtggaataccaccagctattttagcctgcctgttctcgacagcatttacctaagagttgagagatcagtgcagcccccagatgraccaaagacaggctgaacattcagatagcccagccatgggggaggtctggcagttaaggataactcatttattaaacagtaatgcccttgggtctctctt

SEQ ID NO: 15845 - DNA, 201 bp, Homo sapiens
agaggcttcctctctccactcccccatccaaatctagctaccttcccaggccagaccaggcatcatctggctgccagggcagcctctctcctggtttcctrtaagcattccttccaggtgactcttacctaccacatacatagcacttcccaccagaggtgctgtgctcatttccatggtgtctcactcctctctcctaca

SEQ ID NO: 15846 - DNA, 201 bp, Homo sapiens
caataatggaaatgaccagaaatgtagtctttctgctagcgagatacgaaaatagacaagtcaatagaaagtctaggtttggcttattgctgcattttgcrcgtaatcatcactaatactgtctggagtgcttcaatttggaatttctggaatgctaataatagatgctgtatttttagcatatagtcaggtttttcttag

SEQ ID NO: 15847 - DNA, 201 bp, Homo sapiens
ctgcattttgcacgtaatcatcactaatactgtctggagtgcttcaatttggaatttctggaatgctaataatagatgctgtatttttagcatatagtcargtttttcttagcttcactattgttttaatcatatttaaatattttcccttgaaaaaatgccaatgcttattaaatgtcccctttttttaatgaatgtctt

SEQ ID NO: 15848 - DNA, 201 bp, Homo sapiens; identical to SEQ ID NO: 1490

SEQ ID NO: 15849 - DNA, 201 bp, Homo sapiens
agccactttagatgaaaacagaaaaattacagtgcgttggcttgacctaggtgacagctaggtttcattactgtgcattaattattttaaaaacatgagckgtctgttcattattatcagtgcctctgggccaggcactgtgcctgggtcttgactcccatgatcacactgaacttatcattcctactttacaaacaagga

SEQ ID NO: 15850 - DNA, 201 bp, Homo sapiens
ggattgggggatgatttgggagtcatgagcttttggtgtctttcccagctgacctcacagggtgccccctgctcacatggagtagggcctggagcaggcarggacttcctgtgctgtgttctctgcagcagcctccttcctcctggcttgtgtttcagttccaaagcccaagaggagaaatggggtgaacttctccctagc

SEQ ID NO: 15851 - DNA, 201 bp, Homo sapiens
ttgctttgactctaatcctacccttcttcctctgtctcttgctttctctctatcaaggcactgggcagatctggctggataatgttcagtgtcggggcacrgagagtaccctgtggagctgcaccaagaatagctggggccatcatgactgcagccacgaggaggacgcaggcgtggagtgcagcgtctgacccggaaacc

SEQ ID NO: 15852 - DNA, 201 bp, Homo sapiens
aactgaattcagaagtgaatcccaaagtctgattccagagttgtgcttttccagaatcggttttatggaagaacgtagagtgtatgatttgagagaaatcrgttaccttcaccctgtccccaccccagccacacctcccactcctccataaatgggtaaatcctggcttggtcaccaagcctttctacctcctccacagcc

SEQ ID NO: 15853 - DNA, 201 bp, Homo sapiens
cctgagggagggagagagagagacattgagaatgctcttgtgagcctatgtgtctaagcagtgaaagacatcataatttcacacgggggatgacacacacwtctgacatctaagactcccagcctctgagtgggaagggctttgctgatccaagtgtccatttgaacatgattttacttttgaagtattcccaatctaaag

SEQ ID NO: 15854 - DNA, 201 bp, Homo sapiens
ccaggctctggtgacagtcaagcaggggcatttcttttccttaactgtagaactccaaaatgaaaagaaagagcccgcacttacccaaagccccaaggggycttccttgcctctcccatgtgtgtttcttcacccaggtgaaaactcagtgtccgtcaggattgtcggcagtagtaaccgaggccgggctgaagtttacta

SEQ ID NO: 15855 - DNA, 201 bp, Homo sapiens
gtccccacgtggtaatctcaggacatccctgtgtaattagtacactaattccatcttactgatgagggagctgaggctcaaaatgatgatgtaacttgcayaaggtcacccagctaaaggggcagtgctaacacctgctcctaggactgtgactcagtgtctctcttttgctttctaggccatgggtttcttgcaggagga

SEQ ID NO: 15856 - DNA, 201 bp, Homo sapiens
tggagcaggacctcacaatcttaaactgatacccgatttgctaatagcctacaactttcctaatagttaagtacagggaagaacaaagaaattgcttacaraaggtttaaggaagcaataacatttccaaataaggaaggagcatagggtgtgagctggaacgtgcctgtgagcatgttcagcagttacataggctagggc

SEQ ID NO: 15857 - DNA, 201 bp, Homo sapiens
aactgttgtagggtttaccccgtgacacagagctccagccccagcagggttccttgctctgggccctgtgtgagctgaggcttaggagggtgatcccatgrctaggtcctgtgaccaaggggtacgcccagcacgggacccaggaggccaatccctccagaggctgtggcctccccagggagaaaagacgaaggctgagtg

SEQ ID NO: 15858 - DNA, 201 bp, Homo sapiens
gcctccttataatccttttaccaaaagtttattttgctttccttacataccttgcatataaactgtttcttcaatagttttacattcaggaggcctaattwcttttaagttatacaacatttcttgcataaattcccttttataattttgtttttcacaacttttacagacaattcttcgacatgcctcaactttctgagt

SEQ ID NO: 15859 - DNA, 201 bp, Homo sapiens
tctgaggacaaggctatggttgtttgccttttcttcctgcctcaacccacatgtgttgtgttacacacacgcttcactcacagccctgttccatttcatcwgctgagtggttgaaatttccccctgaggataaatatacatgccatttttgggacagaatcctttggtcccataatatttcaaggatggcccagatcacac

SEQ ID NO: 15860 - DNA, 201 bp, Homo sapiens
taccctggcttttaaatgactagggtacagttttctctttactacttccatctctctctttctctctcttccttgactctgtctctctctctcttttactmcctctttatctctctgtctctttctctcactctctgattctccatctctctctctctctttcttcctctttctctttgactccctctttgtctctccgcc

SEQ ID NO: 15861 - DNA, 201 bp, Homo sapiens
tctctcccctatccatcctggacttctttccttcctcccaacaaatacctattgaaagttccatgaggatgagaagtcgcataggcactggggatccagayatgaagaagacagacaaggccctgcccttgtgagccttcctgtgagcttgccttgtgtgttttccatgatggtccccacgtggtaatctcaggacatccc

SEQ ID NO: 15862 - DNA, 201 bp, Homo sapiens
tggattaaggacttaaaccaaagacctgaaactgtaaacattatagaagataacattgggaaaacccttctagacattggcttaagcaaagatttcatgamcaagaacccaaaagtaaatgcaataaaaacaaagataaatagctgggacctaattaaactaaagagcttttgcacggcaaaaggaacagtcagcagagta

SEQ ID NO: 15863 - DNA, 201 bp, Homo sapiens
cattcacgcacatgtacatttagccctccagaatttcatgaccaaggaagtactttaccggctcctgtggctttgccttccttggtctgtgcacaaagtcrtcgctgcagtatgtgaggatcctttaagctaggttgctggccagtttctttctgcattgctgagagctcgggttattcctcgcaccaggtgggtcttggt

SEQ ID NO: 15864 - DNA, 201 bp, Homo sapiens
ctggtgcccctggcccgccgggaccacctgctgagaagggagccaagggggctatgggacgagatggagcaacaggtacgggtctttttcttctgaccctyaatcattttcctcctccttctctggcttcactctgaattccctttcccttccaggcccctcgggaccccaaggcccaccgggagtcaagggagaggcggg

SEQ ID NO: 15865 - DNA, 201 bp, Homo sapiens
ggtcttggtcccttacccctgaggccaccgcaagaggtggtgtggtgcctcctcatgaaagaggactagagatgcccccggaggagaatgtatccccataygattgccaccaaaattgttagaaatatcaaaattgttagaaatacatcattggtgccacaaaggaaagtcagcacagagacaaaagatctctcagcaagg

SEQ ID NO: 15866 - DNA, 201 bp, Homo sapiens
gcaaattccgcaaggggttgaggctgctgggatgtgaagatgcgaagacattaagacctttactagacaaagggcagatgagaggatttacaagggagtgkggagtaaacaaagcaggtctctaagccgccaggctgctgaggcagaaagaaaacaccaccagttacaagaaaggaaacttgttaggaggtagaatcctcc

SEQ ID NO: 15867 - DNA, 201 bp, Homo sapiens
tgctctcagtccaggattggagaggcaaaatggtttcaggtcaatgcaaattaccacgggtgatccttggtacaactgtgaaacctgtaaagttttattastggctcttgcttttctttccatgcatttatagcactctcctgtgcagagcttctagggcctgggtgctcccactctctcctgtgcccctatttcctccaa

SEQ ID NO: 15868 - DNA, 201 bp, Homo sapiens
gtgggttttgtcaaatgaggacaatgaagcaaaaaagggataagggagttaaggatgtgtgcaagggggtgagtaaccataaatttaagctggttaagtarggaagagaggacatgaagtagatgatgggcagtggcagagtagcagaataatagataagaggtcctagagtcaaaagattgttggagttagtgctaaaga

SEQ ID NO: 15869 - DNA, 201 bp, Homo sapiens
caagggagtggggagtaaacaaagcaggtctctaagccgccaggctgctgaggcagaaagaaaacaccaccagttacaagaaaggaaacttgttaggaggkagaatcctccagaaattgattttgggaaggaatttaatagaagggaccccaaagagcctattgatctgtgtccagcagggggttttctgaggagggttta

SEQ ID NO: 15870 - DNA, 201 bp, Homo sapiens
ggtgaatggattagcttgagtcatataaagtatccatttattgcatatgaaaaacagataaatatctgtcattccatatgattcaacctaatggatcctcytaggatggagtcaggaggccacactgcacatgagtgcttcaattataccactcggtggtcctaagcctggtgcacattagagctctttctgaaattttta

SEQ ID NO: 15871 - DNA, 201 bp, Homo sapiens
tcacactcagcctgtgggggcttgagcagagcaggctcactcagaggggagtgggtctccctccatcctctttcctccgagagagagggactcaggctagktgactgaaactcaccagagtggagccactgaggctggcttgaagggaaaagccagaagcctgaggagcacagtcatttccttcaagaaggaatagagctg

SEQ ID NO: 15872 - DNA, 201 bp, Homo sapiens
tcccccccaccccccatcctctttccacagccccaccccagcccctgacagttactgcccaccctacagtcctcttctcttgagtcctgtcacatttcttyaagaccacccaagaaatgagctagcacatcccccagaggaaatctggggatcccattcccttctctcccaaatgcttcctgcccctttgcctctggtagc

SEQ ID NO: 15873 - DNA, 201 bp, Homo sapiens
tgagtcctccccagcttcagaattatcaaaatcatagattggagcaataaatgccttttagcaaaattgcatcccaataagcctttttgaaagcctaaaabgttgtgttgaggtgagatattcctctttagacctttgccccactctacccacccccaggggagtggagttgagcacggacacccagctgatggtgggacc

SEQ ID NO: 15874 - DNA, 201 bp, Homo sapiens
ccaagactttttggtttttcaggaagcaaaggggacaggggcatgaaaggagatgcaggggtcatggggcctcctggagcccaggggagtaaaggtgactycgggaggccaggcccaccaggtaagagggcacgtggtcacatccactgacctctaggtatttccttttttttttttttctggctggctgagccaaaggaa

SEQ ID NO: 15875 - DNA, 201 bp, Homo sapiens
tgcagggtattgcagtgaacagagactgttgccagatgatgtgggcacactctgattgggcatttctgtggagaactgttgcacattggaaagccaagagygggcaggaggggcaatggggaaggcagggttgtgatgtaaagctgcatgtctgccaaggacatctgtagacagtctgcctccacccctgtcctctgcctg

SEQ ID NO: 15876 - DNA, 201 bp, Homo sapiens
ctatggtttgccataggtctcctatttctactactgagaccttgcttttgtcatttggcatgaggcgagtcatagtttgattttgtaggtttgggaaaggkgcagttgtaggaggtagaggagggagaacaaagtgcaccttaaagaagcctataggatcctttccagtgacttctgctcctaaaccacagaagtgcccta

SEQ ID NO: 15877 - DNA, 201 bp, Homo sapiens
ggataagctttttgatgtgctgctggattcggtttgccagtattttactgaggatttttgcatcaatgttcatcagggatattggtctaaaattctctttktttgttgtgtctctgccaggctttgttatcaggatgacgatggcctcataaaatgagttagggaggattccctctttttctattgattggaatagtttca

SEQ ID NO: 15878 - DNA, 201 bp, Homo sapiens
cccccatgcacacacactcacactcagcctgtgggggcttgagcagagcaggctcactcagaggggagtgggtctccctccatcctctttcctccgagagrgagggactcaggctaggtgactgaaactcaccagagtggagccactgaggctggcttgaagggaaaagccagaagcctgaggagcacagtcatttccttc

SEQ ID NO: 15879 - DNA, 201 bp, Homo sapiens
tctgagttgttgctaacatcgctttctttaaacaaccagttaatttattttaggacaagaatttaccatataacattcctttttacataaattctcccctcccccctttttttttcctcaaagatgatagccattcttttccaaagtgaacttccttcatgtctgtggactggactgttaaaggccacaagattagaagtt

SEQ ID NO: 15880 - DNA, 201 bp, Homo sapiens
cccccacttccctgacaacctgcatgactcagcagaggcagccataatccttctaggtacacaactccagtgacctgggaatctcacccctatcccccacrgcagctgcagcaagacctgccgaaggagactctgagatcatacatgcctagtcccacccctggacctgatggtccttccctacctgccctggtggcagaa

SEQ ID NO: 15881 - DNA, 201 bp, Homo sapiens
gcagcaagacctgccgaaggagactctgagatcatacatgcctagtcccacccctggacctgatggtccttccctacctgccctggtggcagaagacaaargacatgtgatattgggagttctagggccacacccactgccagtccccctccacactactacagctgatgctttctggaaattgctacctcctggcaggcc

SEQ ID NO: 15882 - DNA, 201 bp, Homo sapiens
gtgagctatgattgcaccactgcactccagcctgagcaacagagtgagaccctgtcaaaaagaagaaagaaagaaagagagagagaggaaggaaggaaggragggagggagggagggaaggaaagaagaaagaaagaaagaaagaaagaaagaaagaaagaaagaaagaaagaaagaaagaaagaaagaaagaaagaaaga

SEQ ID NO: 15883 - DNA, 201 bp, Homo sapiens
agcctggagctgggtaaagttgctgggtgactagacccagaagagagacaaaaatcactgcagtttgactcacaggaagccacatccacaggaaaacaggragaatactacatcaagggaacaccccgtgggacaaaaaaatctgaacagcaatcttcagccctagacttccctctaacagaacctacccaaatgagaagg

SEQ ID NO: 15884 - DNA, 201 bp, Homo sapiens
actagctctcttggtaactaatctagtctcacaagagcaggaactcactccatcttgccagatgggattaatctcttcataagagatctgtctttgtgacycaaacacctccccactaggacctgctgcattaaggaccaggcttccaatgcatgaacttttgagggacactttcatgccatagcaagagcaaacactgcc

SEQ ID NO: 15885 - DNA, 201 bp, Homo sapiens
gttggcactgtaaagtgggatcttccaggctctggtgacagtcaagcaggggcatttcttttccttaactgtagaactccaaaatgaaaagaaagagcccrcacttacccaaagccccaaggggccttccttgcctctcccatgtgtgtttcttcacccaggtgaaaactcagtgtccgtcaggattgtcggcagtagtaa

SEQ ID NO: 15886 - DNA, 201 bp, Homo sapiens
gcctggacatcatagtgaaaccctgtctctactaaaaatataaaaattagccgggcatggtggcgtgcacctgtaatcacaactacttgggaggctgaggsacaagaatcacctgaacccaggagatggaggttgaagcgagcagagatcatgccagtacactccagcctgggcgacagagtgagataccatctcaaaaaa

SEQ ID NO: 15887 - DNA, 201 bp, Homo sapiens
actgtgctttacagccagttctgtaccttaaaataggaaaggcgctgttttaagagttctggggattttcagaacccaggagggtagaggtttatttcctygattgacaagtcttgtgctggggcttgccctaggcatggagcacacagcagcgggttaggcgcagctctagcatccaaggcaggggcgtgaacatgcact

SEQ ID NO: 15888 - DNA, 201 bp, Homo sapiens
ggaagcaaaggggacacaggtaacagagggtgcagtgggtgagtaggtgggcttgctgggtggcaggatggatggagagaaaaactgcttcttcttaggcycacggaggaggcagagggtcttctgtgccttggcctctgaggttcctggttatgggggcagttgcccctgccaggaccccttaagcccaagggcctaggg

SEQ ID NO: 15889 - DNA, 201 bp, Homo sapiens
ctactttcctttcaggacaacctggactgcagggtgttccgggccctcctggtgcagtgggacacccaggtgccaagggtgagcctggcagtgctggctcycctgggcgagcaggtgaggtcctgggtcctatggtgggcacagggagtgatgtgtgaaaacctgcctagtccagcccttatgctctctgtggtgtctgtt

SEQ ID NO: 15890 - DNA, 201 bp, Homo sapiens
caatatgagagggagaacaatgtcattccaggcatgactatggcaagctggggcacaggcagtgctaggagctcagagaggaagccaaggggatgaggagrgtgggcctgcactgggccttgggaagcagggcagactgactggtggcaagggcaaggggattgattcaaggagggagaccccaggcagccagaatccccc

SEQ ID NO: 15891 - DNA, 201 bp, Homo sapiens
atacttcacccttctgagctttaatgttctcattttagaaaagaatggtaattaagttaaaaaataattaaattagatatattttacaagacagtaataakggttagagaccatgttttcaagctgtctgcaacatgataggcattaaatacatgacaactagtaataggcattaaatatgtgatagctagtaatagtaat

SEQ ID NO: 15892 - DNA, 201 bp, Homo sapiens
caaatttcctctcccaagatcatgaggtctctcttacccatggcttgctcaatccactgctggtggctgggctgtgcaaaccaagagagacctgaccccartagtgctgagattttacctattctcttcctgctagtagacagataagccaccaacttaaagtcccaggggataagcctattttcctcactctactactta

SEQ ID NO: 15893 - DNA, 201 bp, Homo sapiens
cttctgaaactattccaatcaatagaaaaagagggaatcctccctaactcattttatgaggccagcatcattctgataccaaagccaggcagagacacaayaaaaaaagagaattttagaccaatatccttgatgaacattgatgcaaaaatcctcagtaaaatactggcaaaacaaatccagcagcacatcaaaaagctt

SEQ ID NO: 15894 - DNA, 201 bp, Homo sapiens
aatcgttaatctctcaagagaatatctagccactttagatgaaaacagaaaaattacagtgcgttggcttgacctaggtgacagctaggtttcattactgygcattaattattttaaaaacatgagcggtctgttcattattatcagtgcctctgggccaggcactgtgcctgggtcttgactcccatgatcacactgaac

SEQ ID NO: 15895 - DNA, 201 bp, Homo sapiens
aagttgatcagtcatttccactcccaggctttgctggaagttgtctatgcaggaaaattggtggctttatctcctggccagagtgtccttctcatcccacrcctgtctgcccaggtccctgcctggaattttcagcgcacaaagatgaagcgtctggggctctgcctctaggaatttacagtgtaataacagagaaaggtg

SEQ ID NO: 15896 - DNA, 201 bp, Homo sapiens
aggccctatcatggttcttagttatttaaccaggaccccacacccattttagcaaaagacttttggcccatagcttggggatcattttaatttcatcctcrtcgagaccttttatatctgctgaatacccttatggagttctccaataattaggcctagtggtgagtaccagccagcaaattctaggggttacccttaatt

SEQ ID NO: 15897 - DNA, 201 bp, Homo sapiens
tcttaatgacccatgcattatatagaagtccttttttaaatgttccaaatgtttggagattttcctgttgcctatccattgttgatttttatttttattgyattattggcaaataaggtattctgtatgaccttggttttttttcatttggttgaaatttgttttatgacctaggatatcatctattttggtgtatgttcc

SEQ ID NO: 15898 - DNA, 201 bp, Homo sapiens
catgagcggtctgttcattattatcagtgcctctgggccaggcactgtgcctgggtcttgactcccatgatcacactgaacttatcattcctactttacaracaaggaagcaaaggctcagagagagtaaaccctttgctcacagtgtcacagggagcatgaactgaattcagaagtgaatcccaaagtctgattccagag

SEQ ID NO: 15899 - DNA, 201 bp, Homo sapiens
aagggcagatgagaggatttacaagggagtggggagtaaacaaagcaggtctctaagccgccaggctgctgaggcagaaagaaaacaccaccagttacaakaaaggaaacttgttaggaggtagaatcctccagaaattgattttgggaaggaatttaatagaagggaccccaaagagcctattgatctgtgtccagcagg

SEQ ID NO: 15900 - DNA, 201 bp, Homo sapiens
cgggtgatccttggtacaactgtgaaacctgtaaagttttattagtggctcttgcttttctttccatgcatttatagcactctcctgtgcagagcttctarggcctgggtgctcccactctctcctgtgcccctatttcctccaatcccccaaacctgctctggaaaagaataatattgctcatttacacttcagtgtatg

SEQ ID NO: 15901 - DNA, 201 bp, Homo sapiens
aggtaagagggcacgtggtcacatccactgacctctaggtatttccttttttttttttttctggctggctgagccaaaggaaaaaaaaattcctaaaagtyctttttcatcttaggtttggctggttttcctggagctaaaggagatcaaggtaagaactacaggaatctgggcatcatcccagctacgactgtccctggc

SEQ ID NO: 15902 - DNA, 201 bp, Homo sapiens
ttgcattaactttgattttttaaatatattgcactaaaatattatttatcttgattattgaatcttttgtactcaaggctagtgaattatttgcttcatcytaatccctgagtctcaggccctgcaaggtgaatggattagcttgagtcatataaagtatccatttattgcatatgaaaaacagataaatatctgtcattc

SEQ ID NO: 15903 - DNA, 201 bp, Homo sapiens
caaaccttgggctctgggcttgagcttttgtgtttctttgaaagctgtcgggagccatggcaagcgcagttttacaccctctctgtccttgtaatctgtcsagccccagagcaattgtgttttttatggacagtgtgtttgggaggatccctgctacctgatcccatgtggatgccacctgaaggccactagctgggtctc

SEQ ID NO: 15904 - DNA, 201 bp, Homo sapiens
ttctgagttgttgctaacatcgctttctttaaacaaccagttaatttattttaggacaagaatttaccatataacattcctttttacataaattctccccycccccctttttttttcctcaaagatgatagccattcttttccaaagtgaacttccttcatgtctgtggactggactgttaaaggccacaagattagaagt

SEQ ID NO: 15905 - DNA, 201 bp, Homo sapiens
gcccctgagccttctgtgtgatttcatggagatgattgctttcatctctcggttgtaaatagtagtcaccctctgcccccacccccactgccagactaacrgttctcaactaaccaagagtattggaggtaaaacatgattttacccacaggagcattgtgcttactccccaagccccaagcttgtgtcttccacagtctg

SEQ ID NO: 15906 - DNA, 201 bp, Homo sapiens
tggtgcagtcagaggtgtgcacatgcattcacaccacacacactcacactcatgtctgagggcacatctgtgcacatacttgcattctcacactcactcaygcaccaatgtaatcacactcatgcacacacatgcactcacatacacacatatactcatgcacatatatgcactcacatacacgcatatactcatgcacac

SEQ ID NO: 15907 - DNA, 201 bp, Homo sapiens
atacaaacctcaattctaatttccaatacccattaaatacatatcagaaggcatttcatcaaggtccaacctctgctataggaactgtgggtctgggaggrttcagatgcgagaggggctgtgagctcctaaagagacaaggaaggctgctcgtaggaggtgggctgtaagctggtcgctcaagaatgagtgagagttgtt

SEQ ID NO: 15908 - DNA, 201 bp, Homo sapiens
atgtaaagcccctggcacagtgcctggcgtgatgcaggcagcagaaaatgctgagtcccctggaggtgaggagctaggaagggagagtgtgggaaatgaaragggagagtcaggcttggggctatggacctggtgaacaggggcttccctatgattcctgtctttagagggtgtttgctgctcggtgctttaggggacagt

SEQ ID NO: 15909 - DNA, 201 bp, Homo sapiens
ctggcaccagctggacggtgtttctaggcctctcaagagccctgcccctgtgagtgcaaaagtgagatttttcagacacatttcttgagcaagttttcttyctcataagctagatattctattatgttttatggttttttttttttttcaatttttttagagacaaattctctgtgtcacccaggcccgaatgcagtggtg

SEQ ID NO: 15910 - DNA, 201 bp, Homo sapiens
tataaaaacaacaacaacaacaacaacaacaaaaacaggctaagccagccatcagcacattgggccggaatgggccagaatgagtgagaagtcggcagtcyacctcagatggaagctcccaggcgcacacgtggcttctttgctttgactctaatcctacccttcttcctctgtctcttgctttctctctatcaaggcact

SEQ ID NO: 15911 - DNA, 201 bp, Homo sapiens
tccagattccccgcccatcaccctttcccacccagggaggctgtgttctctccccttccccatggcttgccttgcctggtcaagacttcccagaggttccyttgttgaaaaggctccagagacaaataggtgggtgggggaggagggctgggtgtggaacccagaagtcatggtctcactggaggcagcctgccggtggaa

SEQ ID NO: 15912 - DNA, 201 bp, Homo sapiens
ggaacctcttgtttcttttttttttttttttttcttttttgagatggagtctcgctctgtcacccatgctggagtgcaggggagcgatctcggctcagtgyaacctccatctcccgggttcaagtgattctcctgactcagtctccctagtagctgggattacaggtgcccaccaccatgcccggctaacttttatatttt

SEQ ID NO: 15913 - DNA, 201 bp, Homo sapiens
tatggtacaacataatacttaagaagaaggagtatacttattatagttgttgaagaggtaagaattgaagctatgtttgtttgtttgtttgtttgtttctkgttgatgaaatactagagtaaaagggataggcaattgaactagagcaaaagtattgctccaattatttggcagagtgtccagtaatggtcctccataata

SEQ ID NO: 15914 - DNA, 201 bp, Homo sapiens
tggaaatgaccagaaatgtagtctttctgctagcgagatacgaaaatagacaagtcaatagaaagtctaggtttggcttattgctgcattttgcacgtaaycatcactaatactgtctggagtgcttcaatttggaatttctggaatgctaataatagatgctgtatttttagcatatagtcaggtttttcttagcttcac

SEQ ID NO: 15915 - DNA, 201 bp, Homo sapiens
actccagcctgagcaacagagtgagaccctgtcaaaaagaagaaagaaagaaagagagagagaggaaggaaggaagggagggagggagggagggaaggaargaagaaagaaagaaagaaagaaagaaagaaagaaagaaagaaagaaagaaagaaagaaagaaagaaagaaagaaagaaagaaagaaggaaggaaggaagg

SEQ ID NO: 15916 - DNA, 201 bp, Homo sapiens
ggaaggaagggagggagggagggagggaaggaaagaagaaagaaagaaagaaagaaagaaagaaagaaagaaagaaagaaagaaagaaagaaagaaagaargaaagaaagaaagaaagaaggaaggaaggaaggaaagaaagaaagaaagaaagaaagaaagaaagaaaagaaagaaagaaagagaaagaaagagaaagaa

SEQ ID NO: 15917 - DNA, 201 bp, Homo sapiens
ttccagcacacacatgaactctcttcatgccctatgctgtgtgctccaccctgactccacctgcccaaccggtccttgctctctctcagcgccctgcctgmtgggctaagcccactctccatgttgcaaaccacatagtaagcctgaaatcagtcttagagtctcattgatctttccttccatacatgggtgggatttaca

SEQ ID NO: 15918 - DNA, 201 bp, Homo sapiens
gggagggagggaaggaaagaagaaagaaagaaagaaagaaagaaagaaagaaagaaagaaagaaagaaagaaagaaagaaagaaagaaagaaagaaagaargaaggaaggaaggaaggaaagaaagaaagaaagaaagaaagaaagaaagaaaagaaagaaagaaagagaaagaaagagaaagaaagaagaaagaaagaaa

SEQ ID NO: 15919 - DNA, 201 bp, Homo sapiens
ggagtcctatttctctgaaataaaataaatattggcacttaaaatcaagaggacatgatcttgctaaatgaacaaattattatctcagtgacccagcaggwtgctggggacagtgggccttccatgaaagtttactgaaaaaaaaggatgaatggatggaaagaaggaagaaagggggacctttaacattaactacaatag

SEQ ID NO: 15920 - DNA, 201 bp, Homo sapiens
ttctgtagcttgccagttcactatgatggtagtttcttttgctgtgcagaagctctttagtttaattagatgccatttgtcaattttggcttttgttgccrttgcttttggtgttttagacatgaagtccttgcccatgcctatgtcctgaatggtattgcctaggttttcttctagggtttttatggttttaggtctaac

SEQ ID NO: 15921 - DNA, 201 bp, Homo sapiens
ccaggactagggtaagcaaatgaggagggtcattgtacgtgcaaagtgggattctgtcttcctttaaaatgatgatattttgttcatcgcagaatttttgmattaactttgattttttaaatatattgcactaaaatattatttatcttgattattgaatcttttgtactcaaggctagtgaattatttgcttcatcctaa

SEQ ID NO: 15922 - DNA, 201 bp, Homo sapiens
gtagcttgccagttcactatgatggtagtttcttttgctgtgcagaagctctttagtttaattagatgccatttgtcaattttggcttttgttgccattgyttttggtgttttagacatgaagtccttgcccatgcctatgtcctgaatggtattgcctaggttttcttctagggtttttatggttttaggtctaacgttt

SEQ ID NO: 15923 - DNA, 201 bp, Homo sapiens
ctgtgggtttgtcatagatagctcttattattttgagatacatcccattgatacctaatttatcgagagtttttaccatgaggggttcttgaattttgtcraaggccttttctgcatctattgagatattgagataatcgtgtggtttttgtcattggttctgtttatatgctggattacgttaattgatttgcatatgtt

SEQ ID NO: 15924 - DNA, 201 bp, Homo sapiens
agaggtcctgggacagagagctgagtctgggcccatggcagggcttggttggccctctctggagccatccagcttttgggtctcagggacctgggagtgasgggtgcattcagaggcccgtaacttgtgtcccaaagcctcctcgatcccccttaacaagcagcagcactgtgtgggagatccacatgtgaatagcccgtg

SEQ ID NO: 15925 - DNA, 201 bp, Homo sapiens
gggccctccctttaatacccctaaacaagacagagtaacagctgacgaaagactagagtcaggacttccaggcaagaaatattacagcctcttttgtaatstcgcaaactggaaacagctcattaaaagggaaatgttagcatgaactgtggcttttgtctctaaggagtattaggcagctaatctctctctacaaagaaa

SEQ ID NO: 15926 - DNA, 201 bp, Homo sapiens
ccttttctctcaatcacctgggaggaaccatctatcatcctgtcaccaaggaggaaccgtcaatcatcctgtcctgaagggagttcctcctaggtctggtrggacctttctatggtaactaagatttagatccccgttaggaaacctactgagttaagggaattttcagtggctaacgttaaatcactttttctaacagaa

SEQ ID NO: 15927 - DNA, 201 bp, Homo sapiens
gcatcccaataagcctttttgaaagcctaaaatgttgtgttgaggtgagatattcctctttagacctttgccccactctacccacccccaggggagtggarttgagcacggacacccagctgatggtgggaccttggcagcctaccagtagtaccctgcattgcatggctggcaaggtccaggcagtccacccctaaacca

SEQ ID NO: 15928 - DNA, 201 bp, Homo sapiens
ccttgcccatgcctatgtcctgaatggtattgcctaggttttcttctagggtttttatggttttaggtctaacgtttaagtctttaatccatcttgaattratttttgtataaggtataaagaagggatccagtttcagctttctacatatggctagccagttttcccagcaaaatttattaatagagaatcctttcccca

SEQ ID NO: 15929 - DNA, 201 bp, Homo sapiens
atttgagcctgcagtgagctatgattgcaccactgcactccagcctgagcaacagagtgagaccctgtcaaaaagaagaaagaaagaaagagagagagagraaggaaggaagggagggagggagggagggaaggaaagaagaaagaaagaaagaaagaaagaaagaaagaaagaaagaaagaaagaaagaaagaaagaaag

SEQ ID NO: 15930 - DNA, 201 bp, Homo sapiens
gtcctgaatggtattgcctaggttttcttctagggtttttatggttttaggtctaacgtttaagtctttaatccatcttgaattgatttttgtataaggtrtaaagaagggatccagtttcagctttctacatatggctagccagttttcccagcaaaatttattaatagagaatcctttccccattgcttgtttttctca

SEQ ID NO: 15931 - DNA, 201 bp, Homo sapiens
gggatgtcttgccttgcctgtcctggaaggctcaacccctcaaaccagtgggtgtcttgccttgcctgccctgggaggttgacctggtttctcccttcccytctctgaaggtcccttgcacacttcccacttgtgttgtcctctctggccgctcccccaagggagaattaggccccttttagtgttggcgtgcaggtataa

SEQ ID NO: 15932 - DNA, 201 bp, Homo sapiens
tgaatggtattgcctaggttttcttctagggtttttatggttttaggtctaacgtttaagtctttaatccatcttgaattgatttttgtataaggtataargaagggatccagtttcagctttctacatatggctagccagttttcccagcaaaatttattaatagagaatcctttccccattgcttgtttttctcaggtt

SEQ ID NO: 15933 - DNA, 201 bp, Homo sapiens
ctctggccgctcccccaagggagaattaggccccttttagtgttggcgtgcaggtataaatcccatggcaggatccgccctaagccatatgaggtagctayggaaccgcagagaggacccactcactccatccagcagtaggacttgtcaccatccacacaaacaacaccgcaagcagggttatctgtgatcattcacgca

SEQ ID NO: 15934 - DNA, 201 bp, Homo sapiens
aaccgcagagaggacccactcactccatccagcagtaggacttgtcaccatccacacaaacaacaccgcaagcagggttatctgtgatcattcacgcacaygtacatttagccctccagaatttcatgaccaaggaagtactttaccggctcctgtggctttgccttccttggtctgtgcacaaagtcgtcgctgcagtat

SEQ ID NO: 15935 - DNA, 201 bp, Homo sapiens
tttgagcctgcagtgagctatgattgcaccactgcactccagcctgagcaacagagtgagaccctgtcaaaaagaagaaagaaagaaagagagagagaggraggaaggaagggagggagggagggagggaaggaaagaagaaagaaagaaagaaagaaagaaagaaagaaagaaagaaagaaagaaagaaagaaagaaaga

SEQ ID NO: 15936 - DNA, 201 bp, Homo sapiens
tggtctgtgcacaaagtcgtcgctgcagtatgtgaggatcctttaagctaggttgctggccagtttctttctgcattgctgagagctcgggttattcctcrcaccaggtgggtcttggtcccttacccctgaggccaccgcaagaggtggtgtggtgcctcctcatgaaagaggactagagatgcccccggaggagaatgt

SEQ ID NO: 15937 - DNA, 201 bp, Homo sapiens
aatataaaaattagccgggcatggtggcgtgcacctgtaatcacaactacttgggaggctgaggcacaagaatcacctgaacccaggagatggaggttgargcgagcagagatcatgccagtacactccagcctgggcgacagagtgagataccatctcaaaaaaaaaaaaaaaagtattcctttataagtaatgtgccat

SEQ ID NO: 15938 - DNA, 201 bp, Homo sapiens
caccacacatagtctcttctttccgggtgagcaaagagatgcaatatgagagggagaacaatgtcattccaggcatgactatggcaagctggggcacaggyagtgctaggagctcagagaggaagccaaggggatgaggagagtgggcctgcactgggccttgggaagcagggcagactgactggtggcaagggcaagggg

SEQ ID NO: 15939 - DNA, 201 bp, Homo sapiens
tcagtacaaccttcaaaatctgcctgtcacccgccctaggcacagtgctgcccacctcaccccagagcacagaacatggcttctatggctctctctctctstgtatgaatatagatgtgcgtacatagaggaaaactccaactctctctctccatgtctctctctctgtctctctgaatatagatgtatgtacatagagaa

SEQ ID NO: 15940 - DNA, 201 bp, Homo sapiens
agtattcaggggacacacattgccccaagtcagaagaatgccaccagttgtcatctggcctggccattggtcaggatccatgtggaggtgtgacatggaaytgcagccataggagagctggccagacgggcttcaggtgccaggttgggagcagtgagcccccactgaagggctgagagcagggaatgacttgggcaggtt

SEQ ID NO: 15941 - DNA, 201 bp, Homo sapiens
ggttctacctcctcaggctggtttgaagcaacctcctttccccacctccaagactcccagggatctacaggtctcggggtgcagtccgctagttgcagctragcatctggctctttccaaggactctttcccaaaaaacagccaggtgcttggctcctgttgtccaaacccccacagtctgatgggagccccacacaggag

SEQ ID NO: 15942 - DNA, 201 bp, Homo sapiens
aagtgtccatttgaacatgattttacttttgaagtattcccaatctaaaggttaaagtcatgaagtcgttccatgagcagacactgaagtcactcaagaaygctgaatgagcagttgtcataaacacgtcttgtgtgtattaagatcacacacgaatgctgcttgcacatatttaggtcagaccagcatgttagctgtcat

SEQ ID NO: 15943 - DNA, 201 bp, Homo sapiens
cagggatgttcagaatcaaaggtgaacaaggcgccccaggtaggttcatttccactcacacccaccctgctctttccccaaaacctccccaaaagggcccyttggcctgtgccattctgggtctggacagctgaccctagcttaccttcccctgtctccacagcctcctttgtcttcagttgggtctcctctctgttccca

SEQ ID NO: 15944 - DNA, 201 bp, Homo sapiens
acgtcctctctgatttccttgagcagcagtttgtagttctccttgaagaggtccttcacgtcctctattaactgtattcctaggtattttattctctgtascaattgtgaatggaagttcattcacaattttgttctctgcttgccttttactgaagatttttgtgtcaaagttcatgaaatagttttgtttgtttctttc

SEQ ID NO: 15945 - DNA, 201 bp, Homo sapiens
gggaaggaaagaagaaagaaagaaagaaagaaagaaagaaagaaagaaagaaagaaagaaagaaagaaagaaagaaagaaagaaagaaagaaagaaggaargaaggaaggaaagaaagaaagaaagaaagaaagaaagaaagaaaagaaagaaagaaagagaaagaaagagaaagaaagaagaaagaaagaaaagaaagag

SEQ ID NO: 15946 - DNA, 201 bp, Homo sapiens
caggttgggtgatacaatgaaaacgcaaaacaggggcactgaaaggggaccacaaaactgaagccaagcatgacagttttcaaaacacagcttctttaaarttctttaaggggatttctgttataactgatgtgctggtcaggaaacatattctgtatttcatgttgactgaaatatgttcatagcttcataattagtttg

SEQ ID NO: 15947 - DNA, 201 bp, Homo sapiens
aagaaagaaagaaagaaagaaagaaagaaagaaagaaggaaggaaggaaggaaagaaagaaagaaagaaagaaagaaagaaagaaaagaaagaaagaaagrgaaagaaagagaaagaaagaagaaagaaagaaaagaaagagtgtgagagaaaagaaaagaaagggaaagaaagaaagttttcttaatgtattggagattt

SEQ ID NO: 15948 - DNA, 201 bp, Homo sapiens
cagtttcacagcactctgggtttgaaataggcagcttccctgggagcaggaacaattgaagactttagtcagaacaccagctcaacactaaacaactggamggcatatgttttctaacttaacacacatttcttgggagaatattatttctgtaaaaacactttgcaagtaaatatttggaaccctttcagcttgataagc

SEQ ID NO: 15949 - DNA, 201 bp, Homo sapiens
aatttttgaagtgaattcaaataattgccaaaatgcagacactaaaacaagccagacagtgctggctgagccttggctattgtccctcccaaggggaccarggctttctgttgactgtcagccataccagatcacctcaccaaattttcatgagtttctttcttgtctctggggcaaagcggtgcactccttgagggcagc

SEQ ID NO: 15950 - DNA, 201 bp, Homo sapiens
agaccaatatccttgatgaacattgatgcaaaaatcctcagtaaaatactggcaaaacaaatccagcagcacatcaaaaagcttatccaccatgatcaagkgggcttcatccctgggatgcaaggctggttcaatatacacaaatcaataaatgtaatccagcacataaacagagccaaagacaaaaaccacaggattgtc

SEQ ID NO: 15951 - DNA, 201 bp, Homo sapiens
ctcatgaaagtccttgaatgccatgaccaaacctccagcatcacggaggagagcaaagcaccttgcccataccatctccctggtctgcctcccagctgtaygtttctgctgtctcctgctaacccttcattggggcccctaagagggggtccaagagtctagattcaggctggagggtccagaaaactcttcttccacatt

SEQ ID NO: 15952 - DNA, 201 bp, Homo sapiens
ccactaaacaacttcctcatgtaaccaaatacaacctataccccaataacttatggaaaaataaaataaaataataataataataataaataaaaataaarctttttttgtagattttgtggaatggtttatgtagatggtcatgtactctacaaataagaacattttaatttctttctttccaaactgtatgccttttat

SEQ ID NO: 15953 - DNA, 201 bp, Homo sapiens
tacactgggacctggccctccacagctctaatcaattgattgattcattcatcaccacctcctggcaaaccttgggctctgggcttgagcttttgtgtttytttgaaagctgtcgggagccatggcaagcgcagttttacaccctctctgtccttgtaatctgtcgagccccagagcaattgtgttttttatggacagtgt

SEQ ID NO: 15954 - DNA, 201 bp, Homo sapiens
agtgttttttattgaatagttttcttaatggtttctctacttattgcaatatacatatggaacttatcgcagcctggctattgcaatatacatacagaacrtatcaacattttaccattttgagtcaagtgtagaaatcttactttcatttatgttctttagccttctccactttttaaatataattgtcattttctatta

SEQ ID NO: 15955 - DNA, 201 bp, Homo sapiens
cacactgctttgaatgtgtcccagagattctggtatgttgtgtctttgttcttattcgtttcaaagaacatctttatttctgccttcattttgttatgtayccagtagtcattcaggagcaggttgttcagtttccatgtagttgagggttttttttttttgttaattatactttaagttttagggtacatgtgcacattg

SEQ ID NO: 15956 - DNA, 201 bp, Homo sapiens
ctcaccaactcactctccactcctatacccctcactccttccccctcctctctctgagctccagactcccaattacctacttccaccctttttgacccccrgggacttatctcagcctggaattttccctctttgctctccactgaactgtccactcccagtctaagacatgtgcttatgtcacacgcccttaccgtgctt

SEQ ID NO: 15957 - DNA, 201 bp, Homo sapiens
catatcacagaataaaatcagatttcatcagaggaggtgaagacagggagaggagatatttcaatcccttctccgcaacccccgtttttttttttttttttaacaaggatcctagagttactgaatgatagcacgtttgagggggaaagaccctaaggatgatctttataagccatcacttggtgttggtggtgataagag

SEQ ID NO: 15958 - DNA, 201 bp, Homo sapiens
ctagggtttccttagcccaagtctggctagagcaagactaagtaagacttgattccttaatgtccttttgttttaagaaatattaaagaattatttttatrttaatatattttaagaaataaggaaatacaaaacactgagcaagcaacacaaattcaagaaatcttaaaaagtataatagctgctcagtctctgattaac

SEQ ID NO: 15959 - DNA, 201 bp, Homo sapiens
gtggatacattgtttgcatttccctgtcattggctctcactggccaagaacacctttgctccttcttctctaaaacttattcctcaccaatttttcttttyatcagagtggctgacaaagggtgttatgcaaccttatgagctctgcagggtaaactgaggtctggctcaaaagtatacatccctgggcctcacctctgga

SEQ ID NO: 15960 - DNA, 201 bp, Homo sapiens
gtcaccacgcccagctaattttttgtattttttgtaaagacggggtttcatcatgttggccaggctggtctcgatctcctgacctcaggcgatccacccayctcagcctcccaaagtgctgtgattacaggcatgagccacggcacccagccactccttttttacttatgggtgagaagccattagagattatttcttctt

SEQ ID NO: 15961 - DNA, 201 bp, Homo sapiens
aatgtttcttctaggttctaaaaattgtgatcagaccataatgttacattattatcaacaatagtgattgatagagtgttatcagtcataactaaataaarcttgcaacaaaattctctgacacatagttattcattgccttaatcattattttactgcatggtaattagggacaaatggtaaatgtttacataaataatt

SEQ ID NO: 15962 - DNA, 201 bp, Homo sapiens; identical to SEQ ID NO: 1503

SEQ ID NO: 15963 - DNA, 201 bp, Homo sapiens; identical to SEQ ID NO: 1506

SEQ ID NO: 15964 - DNA, 201 bp, Homo sapiens
cattcatttgctaagagtctggtgttctaccacctgaactaggctggccacaggaattataaaagctgagaaattctttaataatagtaaccaggcaacaycattgaaggctcatatgtaaaaatccatgccttcctttctcccaatctccattcccaaacttagccactggcttctggctgaggccttacgcatacctcc

SEQ ID NO: 15965 - DNA, 201 bp, Homo sapiens
agattttgcacctgcaatagaccttatgacacctaaccaaccccattatttacaattaaacaggaacagagggaatactttatccaactcacacaagctgytttcctcccagatccatgcttttttgcgtttattattttttagagatgggggcttcactatgttgcccacactggactaaaactctgggcctcaagtgat

SEQ ID NO: 15966 - DNA, 201 bp, Homo sapiens
accttcatttacatctcatatgtttgtaaataagcccaataggcagacacctctaacaaggtgacactgtcctctttccttcctaccacagcccccacctrcccaccccactcccattgattccagaggcgtgcctaggcaggatctatgagaaaatataacagagagtaagaggaaaattaccttctttctttttccttt

SEQ ID NO: 15967 - DNA, 201 bp, Homo sapiens
cagacacctctaacaaggtgacactgtcctctttccttcctaccacagcccccacctgcccaccccactcccattgattccagaggcgtgcctaggcaggmtctatgagaaaatataacagagagtaagaggaaaattaccttctttctttttcctttccctgcctgaccttattcacctcccatcccagagcatccattt

SEQ ID NO: 15968 - DNA, 201 bp, Homo sapiens
tgaatgaagagcctatagcatcatgttacagccatagtcctaaagtgctgtttctcatgaaggccaaatgctaagggattgagcttcagtcctttttctamcatcttgttctctaacagaattctcttcttttcttcataggagatgcctgagatacccaaaaccatcacaggtagtgagaccaacctcctcttcttctgg

SEQ ID NO: 15969 - DNA, 201 bp, Homo sapiens; identical to SEQ ID NO: 1498

SEQ ID NO: 15970 - DNA, 201 bp, Homo sapiens; identical to SEQ ID NO: 1500

SEQ ID NO: 15971 - DNA, 201 bp, Homo sapiens
agggtgctaagatagagaaaagtgggagagtgctatttagacaaagtggtaaaaacaaagccccttgtgagatgagagctgccgacagagggggcgggtcrtggttgtgggtttttgggtaggacattcagaggagggggcgggtcgtggttgtgggtttttgggtaggacattcagaggagggggcgggtcgtggttgtg

SEQ ID NO: 15972 - DNA, 201 bp, Homo sapiens
gagatatgttctatgaggaagtgaagcttagaactgtggtcagcaacttgcaacgactgggaagtcagagccacacaatgaagaatgcagagtggaaggaraaaaagagccagcatctctgacaacattgttacaccgagaacctacctccagattttaagaaaacaagaaatgctactgttattaagccatttcactggg

SEQ ID NO: 15973 - DNA, 201 bp, Homo sapiens
cacataagcaacaacaaggataatcctagaaaaccagttctgctgactgggtgatttcacttctctttgcttcctcatctggattggaatattcctaataycccctccagaactattttccctgtttgtactagactgtgtatatcatctgtgtttgtacatagacattaatctgcacttgtgatcatggttttagaaatc

SEQ ID NO: 15974 - DNA, 201 bp, Homo sapiens
aaagatgtatagaattccattcctgacttccaggtatttacaccataggtggggacctaactacacacacacacacacacacacacacacacacacacacmccatgcacacacaatctacatcaacacttgattttatacaaatacaatgaatttactttctttttggttcttctcttcaccagtgaaatttgacatgggt

SEQ ID NO: 15975 - DNA, 201 bp, Homo sapiens
gtctcctaacgtgatgtgttgtggttgtcttctctgacaccagcatcagaggttagagaaagtctccaaacatgaagctgagagagaggaagcaagccagytgaaagtgagaagtctacagccactcatcaatctgtgttattgtgtttggagaccacaaatagacactataagtactgcctagtatgtcttcagtactgg

SEQ ID NO: 15976 - DNA, 201 bp, Homo sapiens
ctccaaaagtaactctcatgtttatcactggttaagaaccactgcatgaagagagtcccagattaaggatggttttattatagtgttaataatggcttccytttgggcaagtcaatccagggttagaaaagatgagaacacacaacttccacctatccagtagaggccttctcacagccacagggacaccggcaggcctca

SEQ ID NO: 15977 - DNA, 201 bp, Homo sapiens
gcaaaggtattgtcctcacatctctggctattaaagtattttctgttgttgtttttctctttggctgttttctctcacattgccttctctaaagctacagyctctcctttcttttcttgtccctccctggtttggtatgtgacctagaattacagtcagatttcagaaaatgattctctcattttgctgataaggactgat

SEQ ID NO: 15978 - DNA, 201 bp, Homo sapiens
taatggcttccttttgggcaagtcaatccagggttagaaaagatgagaacacacaacttccacctatccagtagaggccttctcacagccacagggacacyggcaggcctcatttggaaataaggtactcaacagcacaagtacccccattttatatactcacttatacttgcgtagaagctgaggggcctgccaagcagg

SEQ ID NO: 15979 - DNA, 201 bp, Homo sapiens
tagagacggagtttcaccgtggtctccatctcctcgtgatccacccaccttggcctcccaaagtgccgggattacaggcgtgagccaccgcgcccggcctdttattattattattactactactactacctatatgaatactaccagcaatactaatttattaatgactggattatgtctaaacctcacaagaatcctacc

SEQ ID NO: 15980 - DNA, 201 bp, Homo sapiens
gtaaataagcccaataggcagacacctctaacaaggtgacactgtcctctttccttcctaccacagcccccacctgcccaccccactcccattgattccasaggcgtgcctaggcaggatctatgagaaaatataacagagagtaagaggaaaattaccttctttctttttcctttccctgcctgaccttattcacctccc

SEQ ID NO: 15981 - DNA, 201 bp, Homo sapiens
tgaactacttttcagtatcactagcaacatatgagtgtatcagcttcctaaacccctccatgttaggtcattatgaacttatgatctaacaaattacaggrtcttatcccactaatgaaattataagagattcaacacttattcagccccgaaggattcattcaacgtagaaaattctaagaacattaaccaagtatttac

SEQ ID NO: 15982 - DNA, 201 bp, Homo sapiens
gttccacaagagagaagtttcctatctttgagagtaaagggttgtgcacaaagctagctgatgtactacctctttggttctttcagacattcttaccctcrattttaaaactgaggaaactgtcagacatattaaatgatttactcagatttacccagaagccaatgaagaacaatcactctcctttaaaaagtctgttga

SEQ ID NO: 15983 - DNA, 201 bp, Homo sapiens
tattttccctgtttgtactagactgtgtatatcatctgtgtttgtacatagacattaatctgcacttgtgatcatggttttagaaatcatcaagcctaggkcagcaccttttagcttcctgagcaatgtgaaatacaactttatgaggatcatcaaatacgaattcatcctgaatgacgccctcaatcaaagtataattcg

SEQ ID NO: 15984 - DNA, 201 bp, Homo sapiens
gagccatgaggatttgtgacgctattgatatgtgccactttgcactctctgtgacatatataattatttttaatgcattctttttttctcagagtgcattyatttgaaaacatagacgggaaatactggtagtcttccttgtcagttagaaacacccaaacaatgaaaaatgaaaaagttgcacaaatagtctctaaaaac

SEQ ID NO: 15985 - DNA, 201 bp, Homo sapiens
gagtctcaggctttacagactgagctagctgggccctcctgactgttataaagattaaatgagtcaacatcccctaacttctggactagaataatgtctgrtacaaagtaagcacccaataaatgttagctattactatcattattattattattttattttatttttttgagatggagtctggctctgtcacccaggctg

SEQ ID NO: 15986 - DNA, 201 bp, Homo sapiens
taagaccacttacgagctatgttcctctcatactaactatgcctccttggtcatgttacataatcttttcgtgattcagtttcctctactgtaaaatggarataatcagaatcccccactcattggactgctgtaaagattaagagtctcaggctttacagactgagctagctgggccctcctgactgttataaagattaa

SEQ ID NO: 15987 - DNA, 201 bp, Homo sapiens
gtgtctctgagtatctctgaaacctctaaaacatccaagcttaccttcaaggagagcatggtggtagtagcaaccaacgggaaggttctgaagaagagacrgttgagtttaagccaatccatcactgatgatgacctggaggccatcgccaatgactcagaggaaggtaaggggtcaagcacaataatatctttcttttac

SEQ ID NO: 15988 - DNA, 201 bp, Homo sapiens
agtactgcctagtatgtcttcagtactggctttaaaagctgtccccaaaggagtatttctaaaatattttgagcattgttaagcagatttttaacctcctragagggaactaattggaaagctaccactcactacaatcattgttaacctatttagttacaacatctcatttttgagcatgcaaataaatgaaaaagtctt

SEQ ID NO: 15989 - DNA, 201 bp, Homo sapiens
acgtgatgtgttgtggttgtcttctctgacaccagcatcagaggttagagaaagtctccaaacatgaagctgagagagaggaagcaagccagttgaaagtragaagtctacagccactcatcaatctgtgttattgtgtttggagaccacaaatagacactataagtactgcctagtatgtcttcagtactggctttaaaa

SEQ ID NO: 15990 - DNA, 201 bp, Homo sapiens
ctaggcaacatagtgagatctcatctctacaaaaaaaaatgaaaaattaaaaaatgagctggacatggtagtacacacctgtagtcccagctactcgggargcttgaggtgggaggatcacttgagcctgggagatggaggctgcagtgagccataatcacaccattgcaccccaacctgggcaacagagtgagacccagt

SEQ ID NO: 15991 - DNA, 201 bp, Homo sapiens
atcaaaccaagattttatatttttttctcctctttgttagctgccagtatgcataaatggcattaagaatgataatatttccgggttcacttaaagctcayattacacatacacaaaacatgtgttcccatctttatacaaactcacacatacagagctacattaaaaacaactaataggccaggcacggtggctcagacc

SEQ ID NO: 15992 - DNA, 201 bp, Homo sapiens; identical to SEQ ID NO: 1495

SEQ ID NO: 15993 - DNA, 201 bp, Homo sapiens
ggttttagaaatcatcaagcctaggtcagcaccttttagcttcctgagcaatgtgaaatacaactttatgaggatcatcaaatacgaattcatcctgaatracgccctcaatcaaagtataattcgagccaatgatcagtacctcacggctgctgcattacataatctggatgaagcaggtacattaaaatggcaccagac

SEQ ID NO: 15994 - DNA, 201 bp, Homo sapiens
actagaggtccagagacctgtctttcattataagtgagaccagctgcctctctaaactaatagttgatgtgcattggcttctcccagaacagagcagaacyatcccaaatccctgagaactggagtctcctggggcaggcttcatcaggatgttagttatgccatcctgagaaaggccccgcaggccgcttcaccaggtgt

SEQ ID NO: 15995 - DNA, 201 bp, Homo sapiens
tcccatagactgttctttcggataaacatagaaattgacgcttctggtcttaaagctggaagcttgtatttgttttgtttgagttccttcctggggaaaakacttcaggcctctcaaaaaaagtatcaaagaactgaaactcgccagatcaccacatccaggcaatgagactttggaccactcattcatcaggattgcttc

SEQ ID NO: 15996 - DNA, 201 bp, Homo sapiens
gtttcttcatccaaagagaacagcaatgacttgaatcttaaatacttttgttttaccctcactagaggtccagagacctgtctttcattataagtgagacyagctgcctctctaaactaatagttgatgtgcattggcttctcccagaacagagcagaaccatcccaaatccctgagaactggagtctcctggggcaggct

SEQ ID NO: 15997 - DNA, 201 bp, Homo sapiens
ccagagacctgtctttcattataagtgagaccagctgcctctctaaactaatagttgatgtgcattggcttctcccagaacagagcagaaccatcccaaayccctgagaactggagtctcctggggcaggcttcatcaggatgttagttatgccatcctgagaaaggccccgcaggccgcttcaccaggtgtctgtctcct

SEQ ID NO: 15998 - DNA, 201 bp, Homo sapiens
tcataacagcattattcataatagccaaaaagtggaaagaacctagatgtccatcaactgatgaatggcaaataaaatattgtatatccgcacaatagaawacccagtcataaaagaatgaagtactgacacatgctatgtggataaaccttgaaaacagcatactaagtgaaagtgaaacttaaccaatagtcccataga

SEQ ID NO: 15999 - DNA, 201 bp, Homo sapiens
tctcatttgtctcatcctgttctttctagcagccacgactttcctagggtttccttagcccaagtctggctagagcaagactaagtaagacttgattcctyaatgtccttttgttttaagaaatattaaagaattatttttatattaatatattttaagaaataaggaaatacaaaacactgagcaagcaacacaaattca

SEQ ID NO: 16000 - DNA, 201 bp, Homo sapiens
tgagtgttgaaaacatatgtctacacaaaaacttatacatgaaagttcataacagcattattcataatagccaaaaagtggaaagaacctagatgtccatyaactgatgaatggcaaataaaatattgtatatccgcacaatagaatacccagtcataaaagaatgaagtactgacacatgctatgtggataaaccttgaa

SEQ ID NO: 16001 - DNA, 201 bp, Homo sapiens
gtctctgaatcaggtaagcaaatgactgtaattctcatgggactgctattcttacacagtggtttcttcatccaaagagaacagcaatgacttgaatcttmaatacttttgttttaccctcactagaggtccagagacctgtctttcattataagtgagaccagctgcctctctaaactaatagttgatgtgcattggctt

SEQ ID NO: 16002 - DNA, 201 bp, Homo sapiens
tgtatatattattgttttttctcctatcttgtaatttctttgagcacatcccaaagaggaatgcctagatcaatgggcacaaataatttgacagctcttaytaaacattattctgtaagtaaaaactgaactacttttcagtatcactagcaacatatgagtgtatcagcttcctaaacccctccatgttaggtcattatg

SEQ ID NO: 16003 - DNA, 201 bp, Homo sapiens
ccgcaacccccgtttttttttttttttttaacaaggatcctagagttactgaatgatagcacgtttgagggggaaagaccctaaggatgatctttataagycatcacttggtgttggtggtgataagagactcgagtatctttatgcagtggaaagagaagattggactcggaatcagaagcttgagttcaagcactggtt

SEQ ID NO: 16004 - DNA, 201 bp, Homo sapiens
gtccctccctggtttggtatgtgacctagaattacagtcagatttcagaaaatgattctctcattttgctgataaggactgattcgttatactgagggacrgcagaactagtttcctatgagggcatgggtgaatacaactgaggcttctcatgggagggaatctctactatccaaaattattaggagaaaattgaaaatt

SEQ ID NO: 16005 - DNA, 201 bp, Homo sapiens
ctttcttttcttgtccctccctggtttggtatgtgacctagaattacagtcagatttcagaaaatgattctctcattttgctgataaggactgattcgttwtactgagggacagcagaactagtttcctatgagggcatgggtgaatacaactgaggcttctcatgggagggaatctctactatccaaaattattaggaga

SEQ ID NO: 16006 - DNA, 201 bp, Homo sapiens
aattctactcatactcacaagaaaagtacattctaaagagtatattgaaagagtttactgatatacttaggaattttgtgtgtatgtgtgtgtgtgtatgygtgtgtgtgtgtttaaccttcaattgttgacttaaatactgagataaatgtcatctaaatgctaaattgatttcccaaaggtatgatttgttcacttgga

SEQ ID NO: 16007 - DNA, 201 bp, Homo sapiens
gcatttagcaaagtctctactgatattgtggtagacaaggcagagacatatgggctataagagctagtagtattattgaatgggcttgtggctacttatayatagtgtggttactgtattgaagggatctttaaaaggagaaagccctattcattcaaaagacattaatttagtttctatttggtgccaagaacaatgaat

SEQ ID NO: 16008 - DNA, 201 bp, Homo sapiens
tgtcactcttccaaaaggtctggagtgctttgcccaattgagagaggcctatggaataagaaaaacatgagtggatggtccctgtcttatcttctcaactstccacactctaaaaaacgactttggctcctagcatgacaagagccttgattttcagaggaacactcccttctcatctccaccaagaagtagagctaattt

SEQ ID NO: 16009 - DNA, 201 bp, Homo sapiens
caaagcctctagtctcatagaacttagtcttctggaggatatggaaaacagacaacccaaacaaccaacaaaagagcaagatgctgcaaaaaaaaaaaaaatgaatagggtgctaagatagagaaaagtgggagagtgctatttagacaaagtggtaaaaacaaagccccttgtgagatgagagctgccgacagagggggc

SEQ ID NO: 16010 - DNA, 201 bp, Homo sapiens
cctgcctgtgcttttctacctggatcaagtgatgtctacagagtagggcagtagcttcattcatgaactcattcaacaagcattattcactgagagccttstatttttcaggcatagtgccaacagcagtgtggacagtggtgcatcaaagcctctagtctcatagaacttagtcttctggaggatatggaaaacagacaa

SEQ ID NO: 16011 - DNA, 201 bp, Homo sapiens
tgttgtttttctctttggctgttttctctcacattgccttctctaaagctacagcctctcctttcttttcttgtccctccctggtttggtatgtgacctaraattacagtcagatttcagaaaatgattctctcattttgctgataaggactgattcgttatactgagggacagcagaactagtttcctatgagggcatgg

SEQ ID NO: 16012 - DNA, 201 bp, Homo sapiens
ttaaaatcaagggatcttggaattaggtgtggtagatttgggtaaggagtagtctaagatgaccctgtttcttggtactggagactggatgagtggcagcrtcttaaccatatttttggtagaaatatggaggtcttctccattccaggatgaatgatgagtaaaattttaggcatgtaatttgagctactagaaggacac

SEQ ID NO: 16013 - DNA, 201 bp, Homo sapiens
catcaacacttgattttatacaaatacaatgaatttactttctttttggttcttctcttcaccagtgaaatttgacatgggtgcttataagtcatcaaagsatgatgctaaaattaccgtgattctaagaatctcaaaaactcaattgtatgtgactgcccaagatgaagaccaaccagtgctgctgaaggtcagttgtcc

SEQ ID NO: 16014 - DNA, 201 bp, Homo sapiens
aaaatgctgaatgtggactaagtcattcaacaaagttttcaggaagcacaaagaggaggggctcccctcacagatatctggattagaggctggctgagctratggtggctggtgttctctgttgcagaagtcaagatggccaaagttccagacatgtttgaagacctgaagaactgttacaggtaaggaataagatttatc

SEQ ID NO: 16015 - DNA, 201 bp, Homo sapiens
acaattaaacaggaacagagggaatactttatccaactcacacaagctgctttcctcccagatccatgcttttttgcgtttattattttttagagatgggrgcttcactatgttgcccacactggactaaaactctgggcctcaagtgattgtcctgcctcagcctcctgaatagctgggactacaggggcatgccatcac

SEQ ID NO: 16016 - DNA, 201 bp, Homo sapiens
caatttacaagaagatcatgtgaaggaaaaggttgggtgatattctaacccaagttagctgtttctcaaccaagttctctttgaaaaattcaacaaccacytttggggaattatttacaacagaggagtgaggatgggaccaggataggtattgcctatgttggtggaaccagggtttttttcctggattaccaaagagat

SEQ ID NO: 16017 - DNA, 201 bp, Homo sapiens
atcagctaattcttgtaggtgcagtgaggaggcagtgagatagtgcaggtaaactataaaacaattgtcacatgaaacgcatcacagtgattctttggacmcacaagctccaatcttataaaacatatccagtcacccaccaacatagatcatctcaccttgcatatctgattttgtggatcatggggaaaaactgctgat

SEQ ID NO: 16018 - DNA, 201 bp, Homo sapiens
ctcaggctgggatcactaagaacaagtcatgctgcagacctcattaccacttttgatgggattacctgagtggcattggcaggtatatctctattgtggcrgtgagtggactgtggcttaatgtcattaagcatttggatcagatagataattcatcttgttctgatccataccaaaggagttttcttgaagttgttttgt

SEQ ID NO: 16019 - DNA, 201 bp, Homo sapiens
gacatattaaatgatttactcagatttacccagaagccaatgaagaacaatcactctcctttaaaaagtctgttgatcaaactcacaagtaacaccaaacyaggaagatctttattatctctgataacatatttgtgaggcaaaacctccaataagctacaaatatggcttaaaggatgaagtttagtgtccaaaaacttt

SEQ ID NO: 16020 - DNA, 201 bp, Homo sapiens
atgagtgttgaaaacatatgtctacacaaaaacttatacatgaaagttcataacagcattattcataatagccaaaaagtggaaagaacctagatgtccawcaactgatgaatggcaaataaaatattgtatatccgcacaatagaatacccagtcataaaagaatgaagtactgacacatgctatgtggataaaccttga

SEQ ID NO: 16021 - DNA, 201 bp, Homo sapiens
tgtgcttatgtcacacgcccttaccgtgcttatctcagtttgtaattatctactcatttagaaaagtgttgatgaaggtcttcactgtcagctttcaggayagcaggaatcatagctgattttacttacttaacggggtttcattctttgtaactttttttttttttgagatggagactcactcttgcccaggctggagtg

SEQ ID NO: 16022 - DNA, 201 bp, Homo sapiens
tcctctcattaggtatatacccatgagtgttgaaaacatatgtctacacaaaaacttatacatgaaagttcataacagcattattcataatagccaaaaartggaaagaacctagatgtccatcaactgatgaatggcaaataaaatattgtatatccgcacaatagaatacccagtcataaaagaatgaagtactgacac

SEQ ID NO: 16023 - DNA, 201 bp, Homo sapiens
gtccgtatcactatcagcattttggtcacaaccatttagccagtctctaagaagttccaaactttccctcatcttcttgttttcttctgagccctttaaaytcttccaatctttgcccattacccagttccaaagttgactccacatttttagatatctttatagctatatgccccattcttcagtaccagttttctgtat

SEQ ID NO: 16024 - DNA, 201 bp, Homo sapiens
aattattgtggtggatataaaatatgctcgtgtatctatatctctgaatgactgaatgatttataagtttaatggttatatacatttctgacttttaaaartgaatgtatgagtatatgacaatataataatttacaaaaaaaatttattatctatagcacctcattgaactatacataaaatagattaaattatacctca

SEQ ID NO: 16025 - DNA, 201 bp, Homo sapiens
catgtgttggctcatgcatgctttattcctctgaagagcttttataccaagtgaaaggaaataattgcatttccctgaaaattcacaggaaaaagttatgyttttctcttcattcaagtgattctgttagacccaaccacatgcaacaattttaaagttgcttccaaatatatttacaaatatttcctgtcttcaaggaac

SEQ ID NO: 16026 - DNA, 201 bp, Homo sapiens
gcatgtaataaatgcttgctgaatgaacaaatgaatgaagagcctatagcatcatgttacagccatagtcctaaagtgctgtttctcatgaaggccaaatkctaagggattgagcttcagtcctttttctaccatcttgttctctaacagaattctcttcttttcttcataggagatgcctgagatacccaaaaccatcac

SEQ ID NO: 16027 - DNA, 201 bp, Homo sapiens
cctcgggccatacttcccctgtaccctgtttcctcttttataaaagtaagagtttaaactagatggtctccgacatgcatccttctctaacatattctggraccttcaataaactaagataaagcagaataattaaaacttaatttaaaagaacacaggaaaggaagcagctacattaagcaaaagagacatcctcatggt

SEQ ID NO: 16028 - DNA, 201 bp, Homo sapiens
ttcctaaaatagaaaacagatcagaaggaaggcaatagagaagcagaaagtccaatgaggaggtttcacagcagtcatgggggtggggtaaggaaaagaartggaaagaaacagacagaattgggttatattttggagatagaaccaacagaaggaagaggagaaacaacatttactgagaagggaaaaagtaggagagga

SEQ ID NO: 16029 - DNA, 201 bp, Homo sapiens
ttacttatgggtgagaagccattagagattatttcttcttttctttctctcttcactaaggcaccagggtcactaagtagtaggatactttgaactagaaytcaagaaattgagttttaattttacctcacactctcatatgaattctccatgtgacctcgggccatacttcccctgtaccctgtttcctcttttataaaa

SEQ ID NO: 16030 - DNA, 201 bp, Homo sapiens
ggcgggtcgtggttgtgggtttttgggtaggacattcagaggagggggcgggtcgtggttgtgggtttttgggtaggacattcagaggagggggcgggtcrtggttgtgggtttttgggacattcagaggagtctgaatgcacccaggcctacaacttcaagatggtaaaggacagctccaaggatcagaagaagcattct

SEQ ID NO: 16031 - DNA, 201 bp, Homo sapiens
cggggtttcatcatgttggccaggctggtctcgatctcctgacctcaggcgatccacccacctcagcctcccaaagtgctgtgattacaggcatgagccayggcacccagccactccttttttacttatgggtgagaagccattagagattatttcttcttttctttctctcttcactaaggcaccagggtcactaagtag

SEQ ID NO: 16032 - DNA, 201 bp, Homo sapiens
atgaatactaccagcaatactaatttattaatgactggattatgtctaaacctcacaagaatcctaccttctcattttacataaaaggaaactaagctcaytgagataggtaaactgcccaatggcatacatctgtaagtgggagagcctcaaatctaattcagttctacctgagtaaaaaaatcatggtttctcctccat

SEQ ID NO: 16033 - DNA, 201 bp, Homo sapiens
cggtggtctcaatctcctgacctcatgttccacccccctcagcctcccacagtgctgggattacaggcgtgagccaccatgcccagcctgtattaagccaytcttatgttgctataaagaaatatctgaggctgggtaatttatatggaaatgaagtttattttggctcacagttctgcaggctgtacaagcatggcaccc

SEQ ID NO: 16034 - DNA, 201 bp, Homo sapiens
gtcaacatcccctaacttctggactagaataatgtctggtacaaagtaagcacccaataaatgttagctattactatcattattattattattttattttwtttttttgagatggagtctggctctgtcacccaggctggagtgcagtggcgcaatctcggctcactgcaagctctgcctcctgggttcatgccattctcc

SEQ ID NO: 16035 - DNA, 201 bp, Homo sapiens
acctgtaatcccagcactttgggaggccaaggtgggaagatcacttgaggtcaggagttcaagaccagcctaggcaacatagtgagatctcatctctacaraaaaaaatgaaaaattaaaaaatgagctggacatggtagtacacacctgtagtcccagctactcgggaggcttgaggtgggaggatcacttgagcctggg

SEQ ID NO: 16036 - DNA, 201 bp, Homo sapiens
tggcataggataagtgcacaataatttttttttcctaaatgatttagatgacagtgactcattaagggtttcctgaggcctcctcagagtcgagaggtggrtgcctgaagccacccaaagtccctgtcacaggatggctcccaacgcacacaccacaggcctgcccagtatgttccactatctacccagtagagccctgcc

SEQ ID NO: 16037 - DNA, 201 bp, Homo sapiens
atcccactaatgaaattataagagattcaacacttattcagccccgaaggattcattcaacgtagaaaattctaagaacattaaccaagtatttacctgcytagtgagtgtggaagacattgtgaaggacacaaagatgtatagaattccattcctgacttccaggtatttacaccataggtggggacctaactacacaca

SEQ ID NO: 16038 - DNA, 201 bp, Homo sapiens
gagtctggctctgtcacccaggctggagtgcagtggcgcaatctcggctcactgcaagctctgcctcctgggttcatgccattctcctgcctcagcctccygagtagctgggaatacaggcacccgccactgttcccggctaattttttgtatttttagtagagacggagtttcaccgtggtctccatctcctcgtgatcc

SEQ ID NO: 16039 - DNA, 201 bp, Homo sapiens
acccaataaatgttagctattactatcattattattattattttattttatttttttgagatggagtctggctctgtcacccaggctggagtgcagtggcrcaatctcggctcactgcaagctctgcctcctgggttcatgccattctcctgcctcagcctcctgagtagctgggaatacaggcacccgccactgttcccg

SEQ ID NO: 16040 - DNA, 201 bp, Homo sapiens
agatatgaattactctacctatgtgtatgtgtagaagtccttaaatttcaaagatgacagtaatggccatgtgtatgtgtgtgacccacaactatcatggycattaaagtacattggccagagaccacactgaaataacaacaattacattctcatcatcttattttgacagtgaaaatgaagaagacagttcctccattg

SEQ ID NO: 16041 - DNA, 201 bp, Homo sapiens
tgtgtttgtacatagacattaatctgcacttgtgatcatggttttagaaatcatcaagcctaggtcagcaccttttagcttcctgagcaatgtgaaatacractttatgaggatcatcaaatacgaattcatcctgaatgacgccctcaatcaaagtataattcgagccaatgatcagtacctcacggctgctgcattaca

SEQ ID NO: 16042 - DNA, 201 bp, Homo sapiens
actcatactcacaagaaaagtacattctaaagagtatattgaaagagtttactgatatacttaggaattttgtgtgtatgtgtgtgtgtgtatgtgtgtgygtgtgtttaaccttcaattgttgacttaaatactgagataaatgtcatctaaatgctaaattgatttcccaaaggtatgatttgttcacttggagatcaa

SEQ ID NO: 16043 - DNA, 201 bp, Homo sapiens
agacaggccatatcctggcttagaaatttctaagcaggccaggcggggtggctcatgcttgtaaccccagcattttgggaggccaaggcgggtggatcacsaggtcagaagattgagaccatcttggctaacatggtgaaacctcgtctctactaaaatactaaaaaattagccaggtatggtggcaggcgcctgtagtcc

SEQ ID NO: 16044 - DNA, 201 bp, Homo sapiens
acttatgatctaacaaattacagggtcttatcccactaatgaaattataagagattcaacacttattcagccccgaaggattcattcaacgtagaaaattytaagaacattaaccaagtatttacctgcctagtgagtgtggaagacattgtgaaggacacaaagatgtatagaattccattcctgacttccaggtattta

SEQ ID NO: 16045 - DNA, 201 bp, Homo sapiens
tttccctgtttgtactagactgtgtatatcatctgtgtttgtacatagacattaatctgcacttgtgatcatggttttagaaatcatcaagcctaggtcakcaccttttagcttcctgagcaatgtgaaatacaactttatgaggatcatcaaatacgaattcatcctgaatgacgccctcaatcaaagtataattcgagc

SEQ ID NO: 16046 - DNA, 201 bp, Homo sapiens
cctctaaaacatccaagcttaccttcaaggagagcatggtggtagtagcaaccaacgggaaggttctgaagaagagacggttgagtttaagccaatccatyactgatgatgacctggaggccatcgccaatgactcagaggaaggtaaggggtcaagcacaataatatctttcttttacagttttaagcaagtagggacag

SEQ ID NO: 16047 - DNA, 201 bp, Homo sapiens
acaatgtgctttgcaattgttccttagcaatagccctcacaagattctcaggaggagagggttaatcaggattaacatttctgtgttgcctaaagaggaaycaaggtaagcagaaatgtagccagttggctggcatcactgttgcttcaggattcatccttagacacccaagcttctaccctagtctggtgctacacttac

SEQ ID NO: 16048 - DNA, 201 bp, Homo sapiens
taattctcatgggactgctattcttacacagtggtttcttcatccaaagagaacagcaatgacttgaatcttaaatacttttgttttaccctcactagagrtccagagacctgtctttcattataagtgagaccagctgcctctctaaactaatagttgatgtgcattggcttctcccagaacagagcagaaccatcccaa

SEQ ID NO: 16049 - DNA, 201 bp, Homo sapiens
aacatatccagtcacccaccaacatagatcatctcaccttgcatatctgattttgtggatcatggggaaaaactgctgattcctagcaaaacccatggcayaggataagtgcacaataatttttttttcctaaatgatttagatgacagtgactcattaagggtttcctgaggcctcctcagagtcgagaggtgggtgcct

SEQ ID NO: 16050 - DNA, 201 bp, Homo sapiens
gattctttggacccacaagctccaatcttataaaacatatccagtcacccaccaacatagatcatctcaccttgcatatctgattttgtggatcatggggraaaactgctgattcctagcaaaacccatggcataggataagtgcacaataatttttttttcctaaatgatttagatgacagtgactcattaagggtttcc

SEQ ID NO: 16051 - DNA, 201 bp, Homo sapiens
ctgagaactggagtctcctggggcaggcttcatcaggatgttagttatgccatcctgagaaaggccccgcaggccgcttcaccaggtgtctgtctcctaaygtgatgtgttgtggttgtcttctctgacaccagcatcagaggttagagaaagtctccaaacatgaagctgagagagaggaagcaagccagttgaaagtga

SEQ ID NO: 16052 - DNA, 201 bp, Homo sapiens
tcatactaactatgcctccttggtcatgttacataatcttttcgtgattcagtttcctctactgtaaaatggagataatcagaatcccccactcattggaytgctgtaaagattaagagtctcaggctttacagactgagctagctgggccctcctgactgttataaagattaaatgagtcaacatcccctaacttctgga

SEQ ID NO: 16053 - DNA, 201 bp, Homo sapiens
tactaactatgcctccttggtcatgttacataatcttttcgtgattcagtttcctctactgtaaaatggagataatcagaatcccccactcattggactgytgtaaagattaagagtctcaggctttacagactgagctagctgggccctcctgactgttataaagattaaatgagtcaacatcccctaacttctggacta

SEQ ID NO: 16054 - DNA, 201 bp, Homo sapiens
catgggggtggggtaaggaaaagaagtggaaagaaacagacagaattgggttatattttggagatagaaccaacagaaggaagaggagaaacaacatttastgagaagggaaaaagtaggagaggaataggtttgggaaataaatcctgctgacattggaaaccccaaggaagcctcaaaagtatatttacttgctttaga

SEQ ID NO: 16055 - DNA, 201 bp, Homo sapiens
agccatgaggatttgtgacgctattgatatgtgccactttgcactctctgtgacatatataattatttttaatgcattctttttttctcagagtgcattcrtttgaaaacatagacgggaaatactggtagtcttccttgtcagttagaaacacccaaacaatgaaaaatgaaaaagttgcacaaatagtctctaaaaaca

SEQ ID NO: 16056 - DNA, 201 bp, Homo sapiens
gatttataagtttaatggttatatacatttctgacttttaaaaatgaatgtatgagtatatgacaatataataatttacaaaaaaaatttattatctatarcacctcattgaactatacataaaatagattaaattatacctcagtaacaaaggattttttttaatttacaaggaaaaaactctttattccatttatcgcg

SEQ ID NO: 16057 - DNA, 201 bp, Homo sapiens
gtttaaaaagaagcacataagcaacaacaaggataatcctagaaaaccagttctgctgactgggtgatttcacttctctttgcttcctcatctggattggmatattcctaatatcccctccagaactattttccctgtttgtactagactgtgtatatcatctgtgtttgtacatagacattaatctgcacttgtgatcat

SEQ ID NO: 16058 - DNA, 201 bp, Homo sapiens
cctttttgacccccagggacttatctcagcctggaattttccctctttgctctccactgaactgtccactcccagtctaagacatgtgcttatgtcacacrcccttaccgtgcttatctcagtttgtaattatctactcatttagaaaagtgttgatgaaggtcttcactgtcagctttcaggatagcaggaatcatagct

SEQ ID NO: 16059 - DNA, 201 bp, Homo sapiens
gccctttaaattcttccaatctttgcccattacccagttccaaagttgactccacatttttagatatctttatagctatatgccccattcttcagtaccarttttctgtattaagccattcttttttttttctttttttcttttttttgagacggagtctcactctgtcgcccaggctggagtgcagtggtgcaatctcgg

SEQ ID NO: 16060 - DNA, 201 bp, Homo sapiens; identical to SEQ ID NO: 1501

SEQ ID NO: 16061 - DNA, 201 bp, Homo sapiens
catatctgattttgtggatcatggggaaaaactgctgattcctagcaaaacccatggcataggataagtgcacaataatttttttttcctaaatgatttakatgacagtgactcattaagggtttcctgaggcctcctcagagtcgagaggtgggtgcctgaagccacccaaagtccctgtcacaggatggctcccaacgc

SEQ ID NO: 16062 - DNA, 201 bp, Homo sapiens
aggcatgagccacggcacccagccactccttttttacttatgggtgagaagccattagagattatttcttcttttctttctctcttcactaaggcaccagrgtcactaagtagtaggatactttgaactagaattcaagaaattgagttttaattttacctcacactctcatatgaattctccatgtgacctcgggccata

SEQ ID NO: 16063 - DNA, 201 bp, Homo sapiens
taaataaataaaacaatcagccaggcatgctggcatgcacctgtagtcctagctacttgggaagctgacactggaggattgcttgagcccagaagttcaasactgcagtgagctgtgatcgcaccattgcactccagcctgggtgacagagtgagaccctgtctctaaaaaatgttcccagatagaaaagaaaagaaaaag

SEQ ID NO: 16064 - DNA, 201 bp, Homo sapiens
gactactttcccattacaagtccctccagccttgggacctggaggctatccagatgtgttgttgcaagggcttcctgcagaggcaaatggggagaaaagaytccaagcccacaatacaaggaatccctttgcaaagtgtggcttggagggagagggagagctcagattttagctgactctgctgggctagaggttaggcct

SEQ ID NO: 16065 - DNA, 201 bp, Homo sapiens
ttccaagttgatgtcattctaggaccataaggaaaaatacaataaaaagcccctggaaactaggtacttcaagaagctctagcttaattttcacccccccmaaaaaaaaaaattctcacctacattatgctcctcagcatttggcactaagttttagaaaagaagaagggctcttttaataatcacacggaaagttggggg

SEQ ID NO: 16066 - DNA, 201 bp, Homo sapiens
atttccaagttgatgtcattctaggaccataaggaaaaatacaataaaaagcccctggaaactaggtacttcaagaagctctagcttaattttcacccccscaaaaaaaaaaaattctcacctacattatgctcctcagcatttggcactaagttttagaaaagaagaagggctcttttaataatcacacggaaagttggg

SEQ ID NO: 16067 - DNA, 201 bp, Homo sapiens
ccatgttatattcctgctgtcccttctgttttatatgatgctcagtagccttcctaggtggcccagccatcagcctagctaggtcagttgtgcaggttggraggcagccacttttctctggctttattttattccagtttgtgatagcctcccctagcctcataatccagtcctcaatcttgttaaaaacatatttcttta

SEQ ID NO: 16068 - DNA, 201 bp, Homo sapiens
gggctgctctcatttgatagacaccttgggaaatagatgacttaaagggtcccattatcacgtccactccactcccaaaatcaccaccactatcacctccrgctttctcagcaaaagcttcatttccaagttgatgtcattctaggaccataaggaaaaatacaataaaaagcccctggaaactaggtacttcaagaagct

SEQ ID NO: 16069 - DNA, 201 bp, Homo sapiens
gtgttcttagccaccccactcccagcttcatccctactggtgttgtcatcagactttgaccgtatatgctcaggtgtcctccaagaaatcaaattttgccrcctcgcctcacgaggcctgcccttctgattttatacctaaacaacatgtgctccacatttcagaacctatcttcttcgacacatgggataacgaggctta

SEQ ID NO: 16070 - DNA, 201 bp, Homo sapiens
cctccccagtcttccccccttgccccaacatccgtcccacccaatgccaggtggttccttgtagggaaattttaccgcccagcaggaacttatatctctcygctgtaacgggcaaaagtttcaagtgcggtgaacccatcattagctgtggtgatctgcctggcatcgtgccacagtagccaaagcctctgcacaggagtg

SEQ ID NO: 16071 - DNA, 201 bp, Homo sapiens
tttcacccccccaaaaaaaaaaaattctcacctacattatgctcctcagcatttggcactaagttttagaaaagaagaagggctcttttaataatcacacrgaaagttgggggcccagttacaactcaggagtctggctcctgatcatgtgacctgctcgtcagtttcctttctggccaacccaaagaacatctttcccat

SEQ ID NO: 16072 - DNA, 201 bp, Homo sapiens
gggattctttcaagccctttcctcctctctgagctttctactctctgatgtcaaagcatggttcctggcaggaccacctcaccaggctccctccctcgctytctccgcagtgctccttccaggacctggacctctgccctctggatggcggcatccagctacgaatctccgaccaccactacagcaagggcttcaggcagg

SEQ ID NO: 16073 - DNA, 201 bp, Homo sapiens
gggcagcaaatggtcatttttcagactcatccttacaaagagccatgttatattcctgctgtcccttctgttttatatgatgctcagtagccttcctaggkggcccagccatcagcctagctaggtcagttgtgcaggttgggaggcagccacttttctctggctttattttattccagtttgtgatagcctcccctagcc

SEQ ID NO: 16074 - DNA, 201 bp, Homo sapiens
aatcatagtgtgacagcattagggatacaaaaagatatagagaaggtatacatgtatggtgtaggtggggcatgtacaaaaaagatgaacaaagtagaaaygggatttattctaaaagaatagcctgtaaggtgtcagaaagcccacattctagtcttgagtctgcctctaacctgctgtgtgcccttgagtacaccctta

SEQ ID NO: 16075 - DNA, 201 bp, Homo sapiens
tgggcagcaaatggtcatttttcagactcatccttacaaagagccatgttatattcctgctgtcccttctgttttatatgatgctcagtagccttcctagktggcccagccatcagcctagctaggtcagttgtgcaggttgggaggcagccacttttctctggctttattttattccagtttgtgatagcctcccctagc

SEQ ID NO: 16076 - DNA, 201 bp, Homo sapiens
atccctttgcaaagtgtggcttggagggagagggagagctcagattttagctgactctgctgggctagaggttaggcctcaagatccaacagggagcaccmagggtgcccacctgccaggcctagaatctgccttctggactgttctgcgcatatcactgtgaaacttgccaggtgtttcaggcagctttgagaggcaggc

SEQ ID NO: 16077 - DNA, 201 bp, Homo sapiens
gaggacttggactaccatgcagcagcagaaatggagagaaataacagatcccaggcactcaggaagcgctcagaatgagcccttcaaagaacttatggtasgtgatggatggatggagtgtgagtcctgggatagcattgcctgggaaaatactttctagttgagacagggaagtgggccagcagaaatggagggcttctt

SEQ ID NO: 16078 - DNA, 201 bp, Homo sapiens; identical to SEQ ID NO: 1512

SEQ ID NO: 16079 - DNA, 201 bp, Homo sapiens; identical to SEQ ID NO: 1513

SEQ ID NO: 16080 - DNA, 201 bp, Homo sapiens
cctccaagaaatcaaattttgccgcctcgcctcacgaggcctgcccttctgattttatacctaaacaacatgtgctccacatttcagaacctatcttcttygacacatgggataacgaggcttatgtgcacgatgcacctgtacgatcactgaactgcacgctccgggactcacagcaaaaaagcttggtgatgtctggtc

SEQ ID NO: 16081 - DNA, 201 bp, Homo sapiens
agctctctcagatacaaaagggaagacatgccaggaagaatgaaactgtgaaggcatctcaccttgtgaggaagccagattccaaatcatctctgtatggktaagtgggtatggccattttggagagaaaattggtagcgtctagtttttttgggttttttaaacatgttctttggctcagcaattccactacttgccatc

SEQ ID NO: 16082 - DNA, 201 bp, Homo sapiens
ggatatggagcaacaaggtaaatggaaacatcctggtttccctgcctggcctcctggcagcttgctaattctccatgttttaaacaaagtagaaagttaayttaaggcaaatgatcaacacaagtgaaaaaaaatattaaaaaggaatatacaaactttggtcctagaaatggcacatttgattgcactggccagtgcatt

SEQ ID NO: 16083 - DNA, 201 bp, Homo sapiens
ccactttcccagctcagcctctcctctcccagtttcttcccatgggctactctctgttcctgaaacagttctggtgcctgatttctggcagaagtacagcytcacctctttcctttccttccacattgatcaagttgttccgctcctgtggatgggcacattgccagccagtgacacaatggcttccttccttccttcctt

SEQ ID NO: 16084 - DNA, 201 bp, Homo sapiens
tgcagagcgagcacgatacctggcacatactaatttgaataaaaatgctgtcaaattcccattcacccattcaagcagcaaactctaccacctgaatgtayatgccaggcactgtgctagacttggctcaaaaagatttcagtttcctggaggaaccaggaggagcaaggtttcaactcagtgctataagaagtgttacag

SEQ ID NO: 16085 - DNA, 201 bp, Homo sapiens
gtcggaggctgaggaataagatatatagggacaggtgtgggagcaagacacttttatgaacacattttacacagtttgggttttttttttttggagacaargtctcgctgtcacccaggctggagagcagtggtacagtcatggctcactgcagccttaaactcccaggctcaagcaatcctcttacctcagcctcctggg

SEQ ID NO: 16086 - DNA, 201 bp, Homo sapiens
tgtgggaggagcccattggcttgtctgcctggcctttgcccccattgcctcttccagcagcttggctctgctccaggcaggaaattctctcctgctcaacwttcttttgtgcacttacaggtctctttaactgtctttcaagcctttgaaccattatcatgccttaaggcaacctcagtgaagccttaatacggagcttct

SEQ ID NO: 16087 - DNA, 201 bp, Homo sapiens
aaatcatagtgtgacagcattagggatacaaaaagatatagagaaggtatacatgtatggtgtaggtggggcatgtacaaaaaagatgaacaaagtagaawtgggatttattctaaaagaatagcctgtaaggtgtcagaaagcccacattctagtcttgagtctgcctctaacctgctgtgtgcccttgagtacaccctt

SEQ ID NO: 16088 - DNA, 201 bp, Homo sapiens
agacaggaaaggttgatgcgtgggataggagaggagggcaggggattccaggtgggccctgcttgccacactcaggagcttgaacttatccacaaaggagrtgtggaaccagtaatgaatgggttttgtgcaagggcttcatgtcaccagatttgctttttggagatacttctgtggctgatatgtgaggaagggatggag

SEQ ID NO: 16089 - DNA, 201 bp, Homo sapiens
aagaagtagcagtgtctgtaaaagagcctagtttttaatagctatggaatcaattcaatttggactggtgtgctctctttaaatcaagtcctttaattaasactgaaaatatataagctcagattatttaaatgggaatatttataaatgagcaaatatcatactgttcaatggttctgaaataaacttcactgaagaaaa

SEQ ID NO: 16090 - DNA, 201 bp, Homo sapiens
ggcagcaaatggtcatttttcagactcatccttacaaagagccatgttatattcctgctgtcccttctgttttatatgatgctcagtagccttcctaggtkgcccagccatcagcctagctaggtcagttgtgcaggttgggaggcagccacttttctctggctttattttattccagtttgtgatagcctcccctagcct

SEQ ID NO: 16091 - DNA, 201 bp, Homo sapiens
caccattgcactccagcctgggtgacagagtgagaccctgtctctaaaaaatgttcccagatagaaaagaaaagaaaaagccctcaggtagaggaaccagygtgaacaagagcatgggtgtataagaatgaatgatgcaaaaagtacactttcagaattgcgggaatcaccagaagcaaagtcaaagcgcaaaacaagcca

SEQ ID NO: 16092 - DNA, 201 bp, Homo sapiens
ctgagattccagcatcctgcaacctccagttctgaaatattttcagttgtagctaagggcatttgggcagcaaatggtcatttttcagactcatccttacmaagagccatgttatattcctgctgtcccttctgttttatatgatgctcagtagccttcctaggtggcccagccatcagcctagctaggtcagttgtgcag

SEQ ID NO: 16093 - DNA, 201 bp, Homo sapiens
gtggccacacttggtggtgacaggggaggagtagtgataatgtttcccatttcatagtaggaagacaaccaagtcttcaacataaatttgattatcctttyaagagatggattcagcctatgccaatcacttgagttaaactctgaaaccaagagatgatcttgagaactaacatatgtctaccccttttgagtagaatag

SEQ ID NO: 16094 - DNA, 201 bp, Homo sapiens
tttgttttagaaagactttaacctcttccagtgagacacaggctgcaccacttgctgacctggccacttggtcatcatatcaccacagtcactcactaacrttggtggtggtggccacacttggtggtgacaggggaggagtagtgataatgtttcccatttcatagtaggaagacaaccaagtcttcaacataaatttga

SEQ ID NO: 16095 - DNA, 201 bp, Homo sapiens
attttgttttagaaagactttaacctcttccagtgagacacaggctgcaccacttgctgacctggccacttggtcatcatatcaccacagtcactcactawcgttggtggtggtggccacacttggtggtgacaggggaggagtagtgataatgtttcccatttcatagtaggaagacaaccaagtcttcaacataaattt

SEQ ID NO: 16096 - DNA, 201 bp, Homo sapiens
gatgccatggtattttgttttagaaagactttaacctcttccagtgagacacaggctgcaccacttgctgacctggccacttggtcatcatatcaccacaktcactcactaacgttggtggtggtggccacacttggtggtgacaggggaggagtagtgataatgtttcccatttcatagtaggaagacaaccaagtcttc

SEQ ID NO: 16097 - DNA, 201 bp, Homo sapiens
ccctttgcaaagtgtggcttggagggagagggagagctcagattttagctgactctgctgggctagaggttaggcctcaagatccaacagggagcacccarggtgcccacctgccaggcctagaatctgccttctggactgttctgcgcatatcactgtgaaacttgccaggtgtttcaggcagctttgagaggcaggctg

SEQ ID NO: 16098 - DNA, 201 bp, Homo sapiens
ggggcatgtacaaaaaagatgaacaaagtagaaatgggatttattctaaaagaatagcctgtaaggtgtcagaaagcccacattctagtcttgagtctgcytctaacctgctgtgtgcccttgagtacacccttaacctccttgagcttcagagagggataatctttttattttattttattttattttgttttgttttgt

SEQ ID NO: 16099 - DNA, 201 bp, Homo sapiens
cttggagaccagatttttcccctaaattgcctctttcagtggcaaacagggtgccaagtaaatctgatttaaagactactttcccattacaagtccctccrgccttgggacctggaggctatccagatgtgttgttgcaagggcttcctgcagaggcaaatggggagaaaagactccaagcccacaatacaaggaatccct

SEQ ID NO: 16100 - DNA, 201 bp, Homo sapiens
gtcactcattttctcctttttacacaggtgtctgaagcagccatggcagaagtacctgagctcgccagtgaaatgatggcttattacaggtcagtggagaygctgagaccagtaacatgagcaggtctcctctttcaagagtagagtgttatctgtgcttggagaccagatttttcccctaaattgcctctttcagtggca

SEQ ID NO: 16101 - DNA, 201 bp, Homo sapiens
tggggcatgtacaaaaaagatgaacaaagtagaaatgggatttattctaaaagaatagcctgtaaggtgtcagaaagcccacattctagtcttgagtctgyctctaacctgctgtgtgcccttgagtacacccttaacctccttgagcttcagagagggataatctttttattttattttattttattttgttttgttttg

SEQ ID NO: 16102 - DNA, 201 bp, Homo sapiens
gtctgaagcagccatggcagaagtacctgagctcgccagtgaaatgatggcttattacaggtcagtggagacgctgagaccagtaacatgagcaggtctcstctttcaagagtagagtgttatctgtgcttggagaccagatttttcccctaaattgcctctttcagtggcaaacagggtgccaagtaaatctgatttaaa

SEQ ID NO: 16103 - DNA, 201 bp, Homo sapiens
gtacctgagctcgccagtgaaatgatggcttattacaggtcagtggagacgctgagaccagtaacatgagcaggtctcctctttcaagagtagagtgttayctgtgcttggagaccagatttttcccctaaattgcctctttcagtggcaaacagggtgccaagtaaatctgatttaaagactactttcccattacaagtc

SEQ ID NO: 16104 - DNA, 201 bp, Homo sapiens
gtgctgcaaagtacctagaaatatccttggccaccgaagactatcctcctcacccatcccctttatttctgttgttcaacagaaggatattcagtgcacayctggaacaggatcagctgaagcactgcagggagtcaggactggtagtaacagctaccagtgatttatctatcaatgcaccaaacatctgttgagcaagcg

SEQ ID NO: 16105 - DNA, 201 bp, Homo sapiens
cctgctattgtctgtgagaagtcaagttatcctgtgtcttaggccaaggaacctcactgtgggttcccacagaggctaccaaattacatgtatcctactcwtggggcctaggggttggggtgaccctgcactgctgtgtccctaaccacaagacccccttctttcttcagtggtgttctccatgtcctttgtacaaggaga

SEQ ID NO: 16106 - DNA, 201 bp, Homo sapiens
attttattccagtttgtgatagcctcccctagcctcataatccagtcctcaatcttgttaaaaacatatttctttagaagttttaagactggcataacttsttggctgcagctgtgggaggagcccattggcttgtctgcctggcctttgcccccattgcctcttccagcagcttggctctgctccaggcaggaaattctc

SEQ ID NO: 16107 - DNA, 201 bp, Homo sapiens
atgttatattcctgctgtcccttctgttttatatgatgctcagtagccttcctaggtggcccagccatcagcctagctaggtcagttgtgcaggttgggargcagccacttttctctggctttattttattccagtttgtgatagcctcccctagcctcataatccagtcctcaatcttgttaaaaacatatttctttaga

SEQ ID NO: 16108 - DNA, 201 bp, Homo sapiens
agacctgtcaaagaggcaaaggagggtgttcctacactccaggcactgttcataacctggactctcattcattctacaaatggagggctcccctgggcagwaccctggagcaggcactttgctggtgtctcggttaaagagaaactgataactcttggtattaccaagagatagagtctcagatggatattcttacagaaa

SEQ ID NO: 16109 - DNA, 201 bp, Homo sapiens
cagggtgccaagtaaatctgatttaaagactactttcccattacaagtccctccagccttgggacctggaggctatccagatgtgttgttgcaagggcttyctgcagaggcaaatggggagaaaagactccaagcccacaatacaaggaatccctttgcaaagtgtggcttggagggagagggagagctcagattttagct

SEQ ID NO: 16110 - DNA, 201 bp, Homo sapiens
actggccagtgcatttgttaacaggagtgtgaccctgagaaattagacggctcaagcactcccaggaccatgtccacccaagtctcttgggcatagtgcartgtcaattcttccacaatatggggtcatttgatggacatggcctaactgcctgtgggttctctcttcctgttgttgaggctgaaacaagagtgctggagc

SEQ ID NO: 16111 - DNA, 201 bp, Homo sapiens
tgagaactaacatatgtctaccccttttgagtagaatagttttttgctacctggggtgaagcttataacaacaagacatagatgatataaacaaaaagatsaattgagacttgaaagaaaaccattcacttgctgtttgaccttgacaagtcattttacccgctttggacctcatctgaaaaataaagggctgagctggat

SEQ ID NO: 16112 - DNA, 201 bp, Homo sapiens
aggtattcaacagagaaatttctcagcctcctacttctgcttttgaaagccataaaaacagcgagggagaaactggcagataccaaacctcttcgaggcamaaggcacaacaggctgctctgggattctcttcagccaatcttcattgctcaagtatgactttaatcttccttacaactaggtgctaagggagtctctctg

SEQ ID NO: 16113 - DNA, 201 bp, Homo sapiens
atgggctactctctgttcctgaaacagttctggtgcctgatttctggcagaagtacagcttcacctctttcctttccttccacattgatcaagttgttccrctcctgtggatgggcacattgccagccagtgacacaatggcttccttccttccttccttcagcatttaaaatgtagaccctctttcattctccgttccta

SEQ ID NO: 16114 - DNA, 201 bp, Homo sapiens
tccctttgcaaagtgtggcttggagggagagggagagctcagattttagctgactctgctgggctagaggttaggcctcaagatccaacagggagcacccvgggtgcccacctgccaggcctagaatctgccttctggactgttctgcgcatatcactgtgaaacttgccaggtgtttcaggcagctttgagaggcaggct

SEQ ID NO: 16115 - DNA, 201 bp, Homo sapiens
ctgataactcttggtattaccaagagatagagtctcagatggatattcttacagaaacaatattccacttttcagagttcaccaaaaaatcattttaggcmgagctcatctggcattgatctggttcatccatgagattggctagggtaacagcacctggtcttgcagggttgtgtgagcttatctccagggttgccccaa

SEQ ID NO: 16116 - DNA, 201 bp, Homo sapiens
tctcagcctcctacttctgcttttgaaagccataaaaacagcgagggagaaactggcagataccaaacctcttcgaggcacaaggcacaacaggctgctckgggattctcttcagccaatcttcattgctcaagtatgactttaatcttccttacaactaggtgctaagggagtctctctgtctctctgcctctttgtgtg

SEQ ID NO: 16117 - DNA, 201 bp, Homo sapiens
gacctgtcaaagaggcaaaggagggtgttcctacactccaggcactgttcataacctggactctcattcattctacaaatggagggctcccctgggcagtwccctggagcaggcactttgctggtgtctcggttaaagagaaactgataactcttggtattaccaagagatagagtctcagatggatattcttacagaaac

SEQ ID NO: 16118 - DNA, 201 bp, Homo sapiens
cctacttctgcttttgaaagccataaaaacagcgagggagaaactggcagataccaaacctcttcgaggcacaaggcacaacaggctgctctgggattctyttcagccaatcttcattgctcaagtatgactttaatcttccttacaactaggtgctaagggagtctctctgtctctctgcctctttgtgtgtatgcatat

SEQ ID NO: 16119 - DNA, 201 bp, Homo sapiens
ctggttttgaagtcctgacctaaatgattcatccacctcggcttcccaaagtgctgggattacaggcatgagccaccacgcctggcccagagagggatgayctttagaagctcgggattctttcaagccctttcctcctctctgagctttctactctctgatgtcaaagcatggttcctggcaggaccacctcaccaggct

SEQ ID NO: 16120 - DNA, 201 bp, Homo sapiens
ttttctcctcagaggctcctgcaattgacagagagctcccgaggcagagaacagcacccaaggtagagacccacaccctcaatacagacagggagggctaktggcccttcattgtacccatttatccatctgtaagtgggaagattcctaaacttaagtacaaagaagtgaatgaagaaaagtatgtgcatgtataaatct

SEQ ID NO: 16121 - DNA, 201 bp, Homo sapiens
ccaactccgtcaggagcctgaaccctgcataccgtatgttctctgccccagccaagaaaggtcaattttctcctcagaggctcctgcaattgacagagagytcccgaggcagagaacagcacccaaggtagagacccacaccctcaatacagacagggagggctattggcccttcattgtacccatttatccatctgtaag

SEQ ID NO: 16122 - DNA, 201 bp, Homo sapiens
cagggaaaagccattggagactacatagctcgccagccccagccacctgctcatatatctaagccctccttgttctagaccagggaggagaatggaatgtyccttggactctgcatgtccccaatctgagaacctggatccaagagggagaagaagcccattggagatgatgccataaaggaagtggaagcgatatgataa

SEQ ID NO: 16123 - DNA, 201 bp, Homo sapiens
cctctcttatacccactaggtgtgagaaaagacatagagtaggagagccctgccatccatcttacccacccaggggctttttctgatggatccaaaggaargacaaggtcttattggtctcccagaactgacataacaactccgacatcagggaaaagccattggagactacatagctcgccagccccagccacctgctca

SEQ ID NO: 16124 - DNA, 201 bp, Homo sapiens
gaaaagccattggagactacatagctcgccagccccagccacctgctcatatatctaagccctccttgttctagaccagggaggagaatggaatgtccctyggactctgcatgtccccaatctgagaacctggatccaagagggagaagaagcccattggagatgatgccataaaggaagtggaagcgatatgataaaaat

SEQ ID NO: 16125 - DNA, 201 bp, Homo sapiens
agttaataagataatgagggaaaaaaaggtacctggcacttagtaggtgctcaataaaggacggctttttttttttaagtattgcttctaaatttgtatgyaagaaaaaatgatataatacaatgatataagacaggggaccgcaggacaagtccagccacacccattcatttatgtattatctgactgcttttctgaaat

SEQ ID NO: 16126 - DNA, 201 bp, Homo sapiens
atgataagcccactctacagctggaggtaagtgaatgctatggaatgaagcccttctcagcctcctgctaccacttattcccagacaaccaccttctcccygcccccatccctaggaaaagctgggaacaggtctatttgacaattttgcattaatgtaaataaatttaacataatttttaactgcgtgcaaccttcaatc

SEQ ID NO: 16127 - DNA, 201 bp, Homo sapiens
tgataagcccactctacagctggaggtaagtgaatgctatggaatgaagcccttctcagcctcctgctaccacttattcccagacaaccaccttctccccrcccccatccctaggaaaagctgggaacaggtctatttgacaattttgcattaatgtaaataaatttaacataatttttaactgcgtgcaaccttcaatcc

SEQ ID NO: 16128 - DNA, 201 bp, Homo sapiens
agaattatctcagtttattagtcccctcccctaagaagcttccaccaatactcttttcccctttcctttaacttgattgtgaaatcaggtattcaacagakaaatttctcagcctcctacttctgcttttgaaagccataaaaacagcgagggagaaactggcagataccaaacctcttcgaggcacaaggcacaacaggc

SEQ ID NO: 16129 - DNA, 201 bp, Homo sapiens
ataagctcagattatttaaatgggaatatttataaatgagcaaatatcatactgttcaatggttctgaaataaacttcactgaagaaaaaaaaagggtctytcctgatcattgacttgtcttggatttgacactgaacagtaaagacaaacagggctgtgagagttcttgggggactaaagcccactcctcattgctgagt

SEQ ID NO: 16130 - DNA, 201 bp, Homo sapiens
aaaagggaggggaagaagggcaatacattccactgtgcttgtatttgattttttttttttgattctggaagatacataagaaatgaataaagtagttgtcrgaggctgaggaataagatatatagggacaggtgtgggagcaagacacttttatgaacacattttacacagtttgggttttttttttttggagacaaggtc

SEQ ID NO: 16131 - DNA, 201 bp, Homo sapiens
ggatcagctgaagcactgcagggagtcaggactggtagtaacagctaccagtgatttatctatcaatgcaccaaacatctgttgagcaagcgctatgtackaggagctgggagtacagagatgagaacagtcacaagtccctcctcagataggagaggcagctagttataagcagaaacaaggtaacatgacaagtagagt

SEQ ID NO: 16132 - DNA, 201 bp, Homo sapiens
ggcatttccagctccccatctctgcttgttccacttccttggggctacatcaccatctacatcatcatcactcttccactccctcccttagtgccaactaygtttatagcgagatattttctgctcattggggatcggaaggaagtgctgtggcctgagcggtctccttgggaagacaggatctgatacatacgttgcaca

SEQ ID NO: 16133 - DNA, 201 bp, Homo sapiens
tgctgcaaagtacctagaaatatccttggccaccgaagactatcctcctcacccatcccctttatttctgttgttcaacagaaggatattcagtgcacatytggaacaggatcagctgaagcactgcagggagtcaggactggtagtaacagctaccagtgatttatctatcaatgcaccaaacatctgttgagcaagcgc

SEQ ID NO: 16134 - DNA, 201 bp, Homo sapiens
ttatggcttatcaaattcacaggaaactaacatgttgaacagcttttagatttcctgtggaaaatataacttactaaagatggagttcttgtgactgactsctgatatcaagatactgggagccaaattaaaaatcagaaggctgcttggagagcaagtccatgaaatgctctttttcccacagtagaacctatttccctc

SEQ ID NO: 16135 - DNA, 201 bp, Homo sapiens
agttttaagactggcataacttgttggctgcagctgtgggaggagcccattggcttgtctgcctggcctttgcccccattgcctcttccagcagcttggckctgctccaggcaggaaattctctcctgctcaactttcttttgtgcacttacaggtctctttaactgtctttcaagcctttgaaccattatcatgccttaa

SEQ ID NO: 16136 - DNA, 201 bp, Homo sapiens
tattttctgctcattggggatcggaaggaagtgctgtggcctgagcggtctccttgggaagacaggatctgatacatacgttgcacaacctatttgacatragaggtttcacttcctgagatggatgggatggtagcagatttgggtccaggttacagggccaggatgagacatggcagaactgtggagactgttacgtca

SEQ ID NO: 16137 - DNA, 201 bp, Homo sapiens
atcagggaaaagccattggagactacatagctcgccagccccagccacctgctcatatatctaagccctccttgttctagaccagggaggagaatggaatrtcccttggactctgcatgtccccaatctgagaacctggatccaagagggagaagaagcccattggagatgatgccataaaggaagtggaagcgatatgat

SEQ ID NO: 16138 - DNA, 201 bp, Homo sapiens
atgtttccagaccctggataagtggtaccagagccccctctgtttgtggtcccctctcttatacccactaggtgtgagaaaagacatagagtaggagagcsctgccatccatcttacccacccaggggctttttctgatggatccaaaggaaagacaaggtcttattggtctcccagaactgacataacaactccgacatc

SEQ ID NO: 16139 - DNA, 201 bp, Homo sapiens
cttgagtctgcctctaacctgctgtgtgcccttgagtacacccttaacctccttgagcttcagagagggataatctttttattttattttattttattttrttttgttttgttttgttttgttttatgagacagagtctcactctgttgcccaggctggagtgcagtggtacaatcttggcttactgcatcctccacctcc

SEQ ID NO: 16140 - DNA, 201 bp, Homo sapiens
agcgagggagaaactggcagataccaaacctcttcgaggcacaaggcacaacaggctgctctgggattctcttcagccaatcttcattgctcaagtatgaytttaatcttccttacaactaggtgctaagggagtctctctgtctctctgcctctttgtgtgtatgcatattctctctctctctctctttctttctctgtc

SEQ ID NO: 16141 - DNA, 201 bp, Homo sapiens
cttacaggtctctttaactgtctttcaagcctttgaaccattatcatgccttaaggcaacctcagtgaagccttaatacggagcttctctgaataagaggwaagtggtaacatttcacaaaaagtactctcacaggatttgcagaatgcctatgagacagtgttatgaaaaaggaaaaaaaagaacagtgtagaaaaattg

SEQ ID NO: 16142 - DNA, 201 bp, Homo sapiens
gaaatgggatttattctaaaagaatagcctgtaaggtgtcagaaagcccacattctagtcttgagtctgcctctaacctgctgtgtgcccttgagtacacmcttaacctccttgagcttcagagagggataatctttttattttattttattttattttgttttgttttgttttgttttgttttatgagacagagtctcac

SEQ ID NO: 16143 - DNA, 201 bp, Homo sapiens
agatctggttttggttcagttaacccatatttgagtcgtagttccagcatttactgtttgtgcggtcttaaataatttattgtctcaacctcagtttctgrataggtcaaatggttcaatattatctactttaaaggttattatgaagagttaataagataatgagggaaaaaaaggtacctggcacttagtaggtgctca

SEQ ID NO: 16144 - DNA, 201 bp, Homo sapiens
ccaggctccctccctcgctctctccgcagtgctccttccaggacctggacctctgccctctggatggcggcatccagctacgaatctccgaccaccactayagcaagggcttcaggcaggccgcgtcagttgttgtggccatggacaagctgaggaagatgctggttccctgcccacagaccttccaggagaatgacctga

SEQ ID NO: 16145 - DNA, 201 bp, Homo sapiens
caggtctatttgacaattttgcattaatgtaaataaatttaacataatttttaactgcgtgcaaccttcaatcctgctgcagaaaattaaatcattttgcygatgttattatgtcctaccatagttacaaccccaacagattatatattgttagggctgctctcatttgatagacaccttgggaaatagatgacttaaagg

SEQ ID NO: 16146 - DNA, 201 bp, Homo sapiens
tcctaccatagttacaaccccaacagattatatattgttagggctgctctcatttgatagacaccttgggaaatagatgacttaaagggtcccattatcaygtccactccactcccaaaatcaccaccactatcacctccagctttctcagcaaaagcttcatttccaagttgatgtcattctaggaccataaggaaaaat

SEQ ID NO: 16147 - DNA, 201 bp, Homo sapiens
gaaagttgggggcccagttacaactcaggagtctggctcctgatcatgtgacctgctcgtcagtttcctttctggccaacccaaagaacatctttcccatrgcatctttgtcccttgccccacaaaaattcttctttctctttcgctgcagagtgtagatcccaaaaattacccaaagaagaagatggaaaagcgatttgt

SEQ ID NO: 16148 - DNA, 201 bp, Homo sapiens
aacagattatatattgttagggctgctctcatttgatagacaccttgggaaatagatgacttaaagggtcccattatcacgtccactccactcccaaaatyaccaccactatcacctccagctttctcagcaaaagcttcatttccaagttgatgtcattctaggaccataaggaaaaatacaataaaaagcccctggaaa

SEQ ID NO: 16149 - DNA, 201 bp, Homo sapiens
gcaccccaccacacccagctaatttttgtatttttagtagagaaggggtttcgccatgttggccaggctggttttgaagtcctgacctaaatgattcatcmacctcggcttcccaaagtgctgggattacaggcatgagccaccacgcctggcccagagagggatgatctttagaagctcgggattctttcaagccctttc

SEQ ID NO: 16150 - DNA, 201 bp, Homo sapiens
caaagcctctgcacaggagtgtgggcaactaaggctgctgactttgaaggacagcctcactcagggggaagctatttgctctcagccaggccaagaaaatyctgtttctttggaatcgggtagtaagagtgatcccagggcctccaattgacactgctgtgactgaggaagatcaaaatgagtgtctctctttggagccac

SEQ ID NO: 16151 - DNA, 201 bp, Homo sapiens
tttccaagttgatgtcattctaggaccataaggaaaaatacaataaaaagcccctggaaactaggtacttcaagaagctctagcttaattttcaccccccmaaaaaaaaaaaattctcacctacattatgctcctcagcatttggcactaagttttagaaaagaagaagggctcttttaataatcacacggaaagttgggg

SEQ ID NO: 16152 - DNA, 201 bp, Homo sapiens
gaaggctgcttggagagcaagtccatgaaatgctctttttcccacagtagaacctatttccctcgtgtctcaaatacttgcacagaggctcactcccttgsataatgcagagcgagcacgatacctggcacatactaatttgaataaaaatgctgtcaaattcccattcacccattcaagcagcaaactctaccacctgaa

SEQ ID NO: 16153 - DNA, 201 bp, Homo sapiens
tccaggagagcctgtgtacctggagaggagaaggcaagtgcttccgaacttgacttgatgtcttagattctgcaatgcgtagtctgtagggacaggctgtrgcttatcctataggcttgggctggagtcagcaagcatctgggctggcagaagataaaagatgcaaaggtggaggaaagcatacgtggtctggaagacaga

SEQ ID NO: 16154 - DNA, 201 bp, Homo sapiens
cagctgctggggaggctgaggcaggagaatggtgtgaacccgggaggcggaacttgcagggggccgagatcgtgccactgcactccagcctgggcgacagrgtgagactctgtctcaaaaaaaaaaaaaaagtgttatgatgcagacctgtcaaagaggcaaaggagggtgttcctacactccaggcactgttcataacct

SEQ ID NO: 16155 - DNA, 201 bp, Homo sapiens
taggagaggtgtcaacttgatatatgatgcaaagcccttggaggttcccaaacacaaaagcgatgatctaatatatggttttaaaaatgccactcttggcygggcgcggtggctcacgcctgtaatcccagcactttgggaggccgaggcgggtggatcatgaggtcaggagatcgagaccatcctggctaacaaggtgaa

SEQ ID NO: 16156 - DNA, 201 bp, Homo sapiens
cacacccaagcaagtacacaaatacaactggaagaaggcagtctttctgaagggctgtgaagtcaacttctctgcacctgcagcaggtaacacaccacacytccacagctgctaccagctttccaggagagcctgtgtacctggagaggagaaggcaagtgcttccgaacttgacttgatgtcttagattctgcaatgcgt

SEQ ID NO: 16157 - DNA, 201 bp, Homo sapiens
ctccgtcaggagcctgaaccctgcataccgtatgttctctgccccagccaagaaaggtcaattttctcctcagaggctcctgcaattgacagagagctccygaggcagagaacagcacccaaggtagagacccacaccctcaatacagacagggagggctattggcccttcattgtacccatttatccatctgtaagtggg

SEQ ID NO: 16158 - DNA, 201 bp, Homo sapiens
gctgagaggacagaggagcaggaaagagccaggcttgggtaggagaggtgtcaacttgatatatgatgcaaagcccttggaggttcccaaacacaaaagcratgatctaatatatggttttaaaaatgccactcttggccgggcgcggtggctcacgcctgtaatcccagcactttgggaggccgaggcgggtggatcatg

SEQ ID NO: 16159 - DNA, 201 bp, Homo sapiens
ggtctaactgattcacagttctacaggctgtacaggaagcatagctgggaggcttcaggaaacttacaatcatggcggaaggcaaaggggaaacacacacrtcttactatggcggagcaggagagtgagagagtgaagggggaggtgctacacactttcaaataaccaggtcttgtgagaactcactcactatcatgagaa

SEQ ID NO: 16160 - DNA, 201 bp, Homo sapiens
agcttccaccaatactcttttcccctttcctttaacttgattgtgaaatcaggtattcaacagagaaatttctcagcctcctacttctgcttttgaaagcyataaaaacagcgagggagaaactggcagataccaaacctcttcgaggcacaaggcacaacaggctgctctgggattctcttcagccaatcttcattgctc

SEQ ID NO: 16161 - DNA, 201 bp, Homo sapiens
ctgatcattgacttgtcttggatttgacactgaacagtaaagacaaacagggctgtgagagttcttgggggactaaagcccactcctcattgctgagtgcygcaaagtacctagaaatatccttggccaccgaagactatcctcctcacccatcccctttatttctgttgttcaacagaaggatattcagtgcacatctgg

SEQ ID NO: 16162 - DNA, 201 bp, Homo sapiens
catgaaatgcagcatgtgggcaagaatcacagggaaaggtaggtcttggagaggaaaggatggcagggaggaagaaagcagggtgccaggggccctgggckgctgtccaagtcaggtggctcaccgtctctgagaacatttcactttctggtaaatggggcagttggagatagaagggttgggtgaatgccaagagtgagc

SEQ ID NO: 16163 - DNA, 201 bp, Homo sapiens
gaaggttctagaattcttataaataatgaaattaacatgaaggtggacatctaagacagagggaagtcttccattaagtgcagactacaaggagttaatamgcaagatgaacacgatatacaaatccagctcttatcactaagttaactttttaagtaaatgaaagtatttgcaaaaataattaccaattgagaacatagt

SEQ ID NO: 16164 - DNA, 201 bp, Homo sapiens
actcagattgtatgtgaggatcatcatattaaaagtggaggaaggttctagaattcttataaataatgaaattaacatgaaggtggacatctaagacagarggaagtcttccattaagtgcagactacaaggagttaataagcaagatgaacacgatatacaaatccagctcttatcactaagttaactttttaagtaaat

SEQ ID NO: 16165 - DNA, 201 bp, Homo sapiens
ccggcccatgaaggcagccgtaggggctgtaccctgcaaagccacagggacagagctgcccaaggccttaacagcccacaccttgcatcagcatgccctgkgtgtgagacaggggctccaaggagattattttggagctttaaaatttaatgacttccctgctaggttttgcatatgcttgggacctgtggcccctttatt

SEQ ID NO: 16166 - DNA, 201 bp, Homo sapiens
ccaactaggattgcgtatgggacacaagggagctctggttactctttgagattgtgtaacactggggacaactctggtgagtaacctcactttttcgtggwcctgtcagggatgtctgtcatgttgatagtttgcttagtcttaaggaattatgtgtcttgttctccttggttagaagggactttgattcacttctaattc

SEQ ID NO: 16167 - DNA, 201 bp, Homo sapiens
atagagaagctctttcattcaatgcgaaaggtcaaaggcacatcagtttctttaataatgcaaacctcagcacacattatcagtgtcctcattattattgscttgtttatttcccactgctcattgataatttcaacgtgaaatttacctgtattgctgcatgcatcttgcagtttaagaagtgaagtaacccaatttcaa

SEQ ID NO: 16168 - DNA, 201 bp, Homo sapiens
ggcacatcagtttctttaataatgcaaacctcagcacacattatcagtgtcctcattattattgccttgtttatttcccactgctcattgataatttcaaygtgaaatttacctgtattgctgcatgcatcttgcagtttaagaagtgaagtaacccaatttcaaagctagtgctttagggaaaatattggattgtattta

SEQ ID NO: 16169 - DNA, 201 bp, Homo sapiens
cccaatttcaaagctagtgctttagggaaaatattggattgtatttacttcaagcagagttcgataatttatgtacataataaaaattttaaatcccttasttaatatagcagttgccaaaactgggctattatcattctaaactaccaacccaaatggtagtgggtatctaatctacctctagaaagaaaatggactgta

SEQ ID NO: 16170 - DNA, 201 bp, Homo sapiens
tgctaacaggccatggaccaggtactgttctgggccccgggggttgggaacccctgctcagagacacaccgggtggtaggaggagctaaaggtggagaggstgaaggaaaatatgaggtctgggctatccacaaaccagatagcaggaaactgaagagttaaacatttacttcagaattgaatggcttttgtaaaatctgg

SEQ ID NO: 16171 - DNA, 201 bp, Homo sapiens
tggagtggatgtcaggtggatcagagagatacagtcatgggggtgggggccagcctaaaacagtaaggtcaagttgtttgaacagaaaggctacagggcgyggtcctggctcttgtgtaagaattttgactgcgcagccctgcacttcggctgtgtgtaatgaaaagggttgggatgagttagggagagctagtgtgggag

SEQ ID NO: 16172 - DNA, 201 bp, Homo sapiens
attatttatgatatatgtcacaatctatgcatgtgctatttaagaggggcaaatatacatgcaataattgtgctagaatataaaaacattagacttctttrtcattgggatgatgatatcaagatttctttgttagatttatttcagatagaaaaggggatacgaaaaatgcaggcacatgagatacttggagaactttaa

SEQ ID NO: 16173 - DNA, 201 bp, Homo sapiens
tctagaacttgtgattttgggacagggcagttctaaatggggcctatagtgagccagtttgggcacctgtggcatgatgctatgtatggtgtgtgtgtgtrtgtgtgcttgtgcttgtgtgaatatgtattattaactggaaatttgtaaaagtattggaaaaatagtacttacgattttgtgtgtgtgtgtgatggagtc

SEQ ID NO: 16174 - DNA, 201 bp, Homo sapiens
ttggccagatttctggcacttgaaacaagatcctgatggaggaggtcctgtaggaatgcttgaccactgcagtttaggcattttgaagtttttgtgtgtgstggagatgtggctgggttttgtctcacagcagaggcaaggaatcgcaactcagaaatacattgctacttggctgcctctattattgtacaccttgaaggc

SEQ ID NO: 16175 - DNA, 201 bp, Homo sapiens
agagtctaacaggtgaacatttcatccgaataaagaaacagatttaactgtgtgacccatgatcacattagcggatagcacagtccaaagaaaataacatragacaagcattttgctgagaatgtaattgagaaagatctagaacttgtgattttgggacagggcagttctaaatggggcctatagtgagccagtttgggc

SEQ ID NO: 16176 - DNA, 201 bp, Homo sapiens
tccagcaagttcaatcaatgacatggagaaaaggtaaaagttggtatttcattattggagaagctgtttttcaaaactgaatcagttttgtgcagaaaggygtagtataactgagagttcttcctcacacggggttcaaggaccagcttcagcaaaatcccgtcaagtggttcttacaaatgcagattcctaggccacaac

SEQ ID NO: 16177 - DNA, 201 bp, Homo sapiens
gtgacaaaatacaagcaaatttagcctcgtgtcatttcctaaggaacatcttctctctgtgagttcacaggttgccacatgaacatcttccagcatcttgmgttctcagatgtggatgttgccagggttctcactccagatgcttttgtgtgtcggaccatctgcacctatcaccccaactgcctcttctttacattctat

SEQ ID NO: 16178 - DNA, 201 bp, Homo sapiens
ccagtgcttaataaaatgcacgtggtctaagctgcccactccctcaaaggcaataaaaattaggtactatttaaattgaagagtaactactgccccagggwatggacaggttgtcattggaatagccatggttaatggtcccagttgacaactgaaatgaatgtgctacctgaacaggaaagcttattaaccagatttcaa

SEQ ID NO: 16179 - DNA, 201 bp, Homo sapiens
ctgtccaggcagaagcctgctgcagggacccagccctcatggagaacctctattagggcagtgcagaggtgaactgtggggttggagcccacacacagagwccccactggagcactgcccagtggagctgtgaaaagagttcccccatcttccagatgccagaatggtagatccactgactggaaagttgcaggcactcag

SEQ ID NO: 16180 - DNA, 201 bp, Homo sapiens
gagatactttaaaggacattttttcacttaggatgtttagtactatgaataataaatagtcacaatttccttaactatggtgacaaaatacaagcaaattyagcctcgtgtcatttcctaaggaacatcttctctctgtgagttcacaggttgccacatgaacatcttccagcatcttgcgttctcagatgtggatgttgc

SEQ ID NO: 16181 - DNA, 201 bp, Homo sapiens
attctttgggaaaatctctgtttaaatcttttggccattaaaaataattgggttattttcattgttgagttgtatgaactctttatatactctggatactrcactcttatgacatatattattttcaaaaattttctgtgcatctgcaggtcatcttttcactttactgatggtgttctttgaagcaccaaagtttttaaa

SEQ ID NO: 16182 - DNA, 201 bp, Homo sapiens
gtagaagctagtcattttctattcaaagcctcaaaatgcttgaatatcattgggctaagggattgtctcaagaaagagtctaacaggtgaacatttcatcygaataaagaaacagatttaactgtgtgacccatgatcacattagcggatagcacagtccaaagaaaataacataagacaagcattttgctgagaatgtaa

SEQ ID NO: 16183 - DNA, 201 bp, Homo sapiens
tttaaaggacattttttcacttaggatgtttagtactatgaataataaatagtcacaatttccttaactatggtgacaaaatacaagcaaatttagcctcrtgtcatttcctaaggaacatcttctctctgtgagttcacaggttgccacatgaacatcttccagcatcttgcgttctcagatgtggatgttgccagggtt

SEQ ID NO: 16184 - DNA, 201 bp, Homo sapiens
tagagctgggaataattccaaacagcaaatagttcaaaatttattttcaatttagcatatgcatgcatttgcttaaactgtcttaaaaatgagtaaaaaayactgtcagtttgtttcaatcatactgagatgaggaacaatgtttagcattgcatgctagaaaaggacacaggattgggagtcagggctgggtgaccgtca

SEQ ID NO: 16185 - DNA, 201 bp, Homo sapiens
tagtcacaatttccttaactatggtgacaaaatacaagcaaatttagcctcgtgtcatttcctaaggaacatcttctctctgtgagttcacaggttgccamatgaacatcttccagcatcttgcgttctcagatgtggatgttgccagggttctcactccagatgcttttgtgtgtcggaccatctgcacctatcacccca

SEQ ID NO: 16186 - DNA, 201 bp, Homo sapiens
atgggtgccaacttggagcctggggttgctggggctaacgtggaggctagatagagtcttgggggccaggctagagctggagcaggcctgaagtctaggtyttgtgtggccatcttggagcctgaagccccaggggctgacctggtctggggtgagcatggggctgaggccacagaggctggtctggcctgtggcaggcct

SEQ ID NO: 16187 - DNA, 201 bp, Homo sapiens
gttgaggggatggcagaaaacatggaagcaaggtctctggtcagcccagggtgctgggcttgtcccaacaccacgtaggcaataagaggacagtacagggkgccgtctctctccctcttcctctctctgtctctctctctgtgtgtgtgtgtgtgtgtgtgtgtaacactatcttcccaatttttactgtctatttgtatt

SEQ ID NO: 16188 - DNA, 201 bp, Homo sapiens
tcccatctgatatctttttgtgtttataattgacacagaaccctgccattctaaaatttacccgggagttgactttggaggagaagaattgaatgtgactkttgttaaaggagtgaatgtttgccaagagacttgcacaaagatgattcgctgtcagtttttcacttattctttactcccagaagactgtaaggaagagaa

SEQ ID NO: 16189 - DNA, 201 bp, Homo sapiens
cttctaattccaaccattagcgtcaacgctctcttttcagtctgcacaacaaaaacaagcacacgcattgttggaggaacaaactcttcttggggagagtrgccctggcaggtgagcctgcaggtgaagctgacagctcagaggcacctgtgtggagggtcactcataggacaccagtgggtcctcactgctgcccactgc

SEQ ID NO: 16190 - DNA, 201 bp, Homo sapiens
atgcctggctaatttttgtatttttagtagagtcggggttttactatgttggtcaggctggtctcgaactcctgatcttgtgatccacccacctcagcctyccaaagcgctgggattacaggcatgagccactgcggcctcgcccttcattttttaattaaaataattcatttaatttcatttgtttctctactcttttcc

SEQ ID NO: 16191 - DNA, 201 bp, Homo sapiens
tttcatagcatgtcaggcaacaggaaaaaactaagttaggattttattttattgtggggaatttatgtgcaaattattgtgcaatttaatgaaaataagccaatgttttatacagaagtacccagaaaattaaataacactatacattgttcaaatagttgccttaatatattttattttctcagcataattagagttgta

SEQ ID NO: 16192 - DNA, 201 bp, Homo sapiens
tcctgtaggaatgcttgaccactgcagtttaggcattttgaagtttttgtgtgtgctggagatgtggctgggttttgtctcacagcagaggcaaggaatcrcaactcagaaatacattgctacttggctgcctctattattgtacaccttgaaggcgaggttaattaagtcctcttgtggggtttgagggctggaatctaa

SEQ ID NO: 16193 - DNA, 201 bp, Homo sapiens
ggctaagggagaagaaggaggaatggagggtggaaagttgcctatagtgaaggaggcaagcccagagaaaagagagggtagagacatggagagaaggggtsggggggtgcttgcccccaggaaagtggttcttgccactaagggtgaaggatcaaggcaggcattcgcgcggtgatcagatacctctgaaacgtgggtgaa

SEQ ID NO: 16194 - DNA, 201 bp, Homo sapiens
ccatgtggttctggtgaccctgattcttctgctgaaccagaaagtgcacacatcctcctggctgtggtgacccaatcagagccaacgtcttgcaatgaagyttttctttagacatctagaaataagactcttatgttttttttttccaatttgacttgaaacttaagacaatacacaggcctgagttgttggtactatttt

SEQ ID NO: 16195 - DNA, 201 bp, Homo sapiens
tggagtagctgagactacaggtgcccaccaccacgcctggctaaattttttttgtatttttagtagagatggggtttcactgtgttagccaggatggtctygatctcctgacctcatgatccacccatcttggcctcccaaagtgctgggattacaggcatgagccactgcacctggccgaggatctctttatatttaatc

SEQ ID NO: 16196 - DNA, 201 bp, Homo sapiens
gggaggtcccctgatctgagtcacagcaccaaatatcacgtgtgtccatgcgaagagaccaccaaacaggctttgtgtgagcaagaaagctttttaatcayctgggtgcaggcgggctgagtccaaaaagagagtcagtgaagggagataggggtggggacgttttataggatttgggtaggtagtggaaaattacagtca

SEQ ID NO: 16197 - DNA, 201 bp, Homo sapiens
ggtgcaaataagtaatatattttggagcttgctattcttctctttttatggtatttttgtgtgcacattcttatgctcttattcagttatttctgtagaayacattttttgaaataaaaatactagattcaaaggtgtgaatatttttgaaggttttgtggtgtggtatcatgaaattaggtttcagaaagtttactccat

SEQ ID NO: 16198 - DNA, 201 bp, Homo sapiens
gggctccaaggagattattttggagctttaaaatttaatgacttccctgctaggttttgcatatgcttgggacctgtggcccctttattttggccaatttytcccatttggaatgggaacatttacccaattcctgtacccacattgtgttttggaagtaactaacttgttttttattttaaaggctcattgagggaaggg

SEQ ID NO: 16199 - DNA, 201 bp, Homo sapiens
cacaactcccctgtgtctgtccctcaaccctgatttctcttctaaaccgtaatttacaaacccatgtgcaaacccactgaaaggtgagaaggagcataagmcagagacactgggaaccacagccaactacagggggtttttcatttttttgttttgttttgttttttggcaaaataaatcatgattatggctaggaaaatc

SEQ ID NO: 16200 - DNA, 201 bp, Homo sapiens
atttgctttggttcctttctctttatgttttgtatatctactacagactttttctttgtggttatcatgaggtttacataaaatatttcatagttataacyatccattttaatctggtaacaactttgactgcatttaaaaatactgtattttaacttctcctcctcccacattttattattcatgccatagtttatatct

SEQ ID NO: 16201 - DNA, 201 bp, Homo sapiens
atggtgtgtgtgtgtatgtgtgcttgtgcttgtgtgaatatgtattattaactggaaatttgtaaaagtattggaaaaatagtacttacgattttgtgtgygtgtgtgatggagtctcgctttgtagcccaggctggagtgcagtggcgtgatctcggctcactgcaacttccacctcccaggttcaagcgattctcctgc

SEQ ID NO: 16202 - DNA, 201 bp, Homo sapiens; identical to SEQ ID NO: 1526

SEQ ID NO: 16203 - DNA, 201 bp, Homo sapiens
caagtaattcacatttttagattttttattggtaatctgagacaagaagaaatttaaagtaatcttcactaagccatgaaagctcccaacattgttctccrtgagagatgctggcctgcatttattcaaaaacaaaagacccctctgttgccaaagctcggagggcttttcagaaacgatatagttgtaaattataatttt

SEQ ID NO: 16204 - DNA, 201 bp, Homo sapiens
ctttgagcctgctgtttgcattttaaccagttatcaaaggatggcaatgccttcattataaatgtgggcctgacttagccagtataataggtgtagtctaygtgaggtggagtacatttcctattttaaaagatcaatttttatgttaatccaatttggtataaattattcgagtaagtgctatttctgattgttgtatct

SEQ ID NO: 16205 - DNA, 201 bp, Homo sapiens
ttatttttatttgcatagatgtatggggtacaagtgtaattttgttactttgatgtattttacagtggtaaagtctgggcttttggtatatccatcactgsagtcatgtacattgtacccactaagctatttttcaacgcccgcccccttcccacctctctgtcaccttcccagtctctactgtctatcgctccatgctct

SEQ ID NO: 16206 - DNA, 201 bp, Homo sapiens
ctcccgagtagctgggattacaggcgtccgccaccatgcctggctaatttttgtatttttagtagagtcggggttttactatgttggtcaggctggtctcraactcctgatcttgtgatccacccacctcagcctcccaaagcgctgggattacaggcatgagccactgcggcctcgcccttcattttttaattaaaataa

SEQ ID NO: 16207 - DNA, 201 bp, Homo sapiens
gaaaagggtgcttaaatagaagttaacactattttaaagcaagaatggaagtggtttcatcatgcgtaaacaacaactctccacattttgtaatgattgakctggatgcaatttgtcatcagacaggagaagtcgaaagcaaagaaataacactgggagatagagaagctctttcattcaatgcgaaaggtcaaaggcaca

SEQ ID NO: 16208 - DNA, 201 bp, Homo sapiens
ctgagccctgggacctgtgcgtgtgttcccatagctggcaaaagcgtttctgtcaatggcatgcagttacgggcttcgagatggggagtttactctggatkttctgaatgggcccaatgtactcacagggttgagtgctcacaaggctcataagaaaaagagagaggcggaaggctcagagccagagagagaggtttgaag

SEQ ID NO: 16209 - DNA, 201 bp, Homo sapiens
cgtccctgtgctgagccctgggacctgtgcgtgtgttcccatagctggcaaaagcgtttctgtcaatggcatgcagttacgggcttcgagatggggagttkactctggattttctgaatgggcccaatgtactcacagggttgagtgctcacaaggctcataagaaaaagagagaggcggaaggctcagagccagagagag

SEQ ID NO: 16210 - DNA, 201 bp, Homo sapiens
cagttacttcaggccatctggatgtatgcatgtaggcttgggcccagaggcctgacatttaacatggataaatgtaaagttcttagaatcatacatacacwttggaaaagatggggcttaatcgcactttataagacttgaaggatgtttgagaatcactatgaaactgctgaaaataccaagaaaatttaattcttatgt

SEQ ID NO: 16211 - DNA, 201 bp, Homo sapiens
ttaattaaaataattcatttaatttcatttgtttctctactcttttcccctggcatgtaattgtaccgcatcttcaaagcctgacatcctcttcccctacktctccaaagctgattcttgcaggtctttcctcaaataccgtcccctccaaaagcccatttctgagcattctcttttaagtcacactcagctctgtttatt

SEQ ID NO: 16212 - DNA, 201 bp, Homo sapiens
gggccaggctagagctggagcaggcctgaagtctaggtcttgtgtggccatcttggagcctgaagccccaggggctgacctggtctggggtgagcatgggkctgaggccacagaggctggtctggcctgtggcaggcctgaatcctggtgctggggtttactggagtgggcttggtgcttgggatctgtggtgaagttagg

SEQ ID NO: 16213 - DNA, 201 bp, Homo sapiens
ggctaagacaggagtagccaagcaagtggcaccacccctggagaaagctattgaacatacagcttcgggggtggagattgtccctgatgattcaggacacrtgtctatttaatgttccacaacaaggaccacttgtcaggtatattgctgtagacatatgttgcagaccagaggaaggagctcagaagtaggaatgtcttg

SEQ ID NO: 16214 - DNA, 201 bp, Homo sapiens
cccccagagacgtccctgtgctgagccctgggacctgtgcgtgtgttcccatagctggcaaaagcgtttctgtcaatggcatgcagttacgggcttcgagrtggggagtttactctggattttctgaatgggcccaatgtactcacagggttgagtgctcacaaggctcataagaaaaagagagaggcggaaggctcagag

SEQ ID NO: 16215 - DNA, 201 bp, Homo sapiens
ctgtgccctttcagaaattggtaattgtaggactacttcactttgtgattgtggtaggtggaataggagcccccagagacgtccctgtgctgagccctggracctgtgcgtgtgttcccatagctggcaaaagcgtttctgtcaatggcatgcagttacgggcttcgagatggggagtttactctggattttctgaatggg

SEQ ID NO: 16216 - DNA, 201 bp, Homo sapiens; identical to SEQ ID NO: 1531

SEQ ID NO: 16217 - DNA, 201 bp, Homo sapiens
ctgctccctgcccctcaaagtgcagaaagcaaagtaacctcttttcttcccattcaggaacaattgcctattaaagtacagtcccggaggaacacctaccrctataaaggtgctgagtaacgtggaatctggattctcactgaagccctgtgccctttcagaaattggtaattgtaggactacttcactttgtgattgtgg

SEQ ID NO: 16218 - DNA, 201 bp, Homo sapiens
actgttacctgcactgctccctgcccctcaaagtgcagaaagcaaagtaacctcttttcttcccattcaggaacaattgcctattaaagtacagtcccggrggaacacctaccgctataaaggtgctgagtaacgtggaatctggattctcactgaagccctgtgccctttcagaaattggtaattgtaggactacttcac

SEQ ID NO: 16219 - DNA, 201 bp, Homo sapiens
aatgagggtttagtgtcacggagtctcctgcctcattctcaccctaacttttcctttacccctttgcgaggggaaggatgtccattaggttaataatgcasacccctaacccactcattatcagggtcattgtttttccactgtgcattttaatactaactgttacctgcactgctccctgcccctcaaagtgcagaaagc

SEQ ID NO: 16220 - DNA, 201 bp, Homo sapiens
catttttcgctttcctgaagcgaattttggtgtcatttttcctgaagttccgtttgccccacacataggccttgcttatagaatgagggtttagtgtcacsgagtctcctgcctcattctcaccctaacttttcctttacccctttgcgaggggaaggatgtccattaggttaataatgcagacccctaacccactcatta

SEQ ID NO: 16221 - DNA, 201 bp, Homo sapiens
agcaaaattttggtgtcattttttctgaagtcattttctgaagtctgtgtcatttttcgctttcctgaagcgaattttggtgtcatttttcctgaagttcygtttgccccacacataggccttgcttatagaatgagggtttagtgtcacggagtctcctgcctcattctcaccctaacttttcctttacccctttgcgag

SEQ ID NO: 16222 - DNA, 201 bp, Homo sapiens
cctaatgtgctgggattacaggcatgagccaccgcacccagcggtaattacaatttttattaggtcagagagatgcttattaatcacgagccacagtttcwtcttaatgatttttccttttgattaatatccagagtaagcttttctttgttgttcccatttccatgttcataactctttactcatcttcactctatgtga

SEQ ID NO: 16223 - DNA, 201 bp, Homo sapiens
ctgagatctccatgactgtgtgttgtgaaataaaatggtgaaagatcacgattagcaagtgttttcttctggttgtgaaacagaactgaaagtaagtggtygaggttccagcacagttcctgggatccctctaattgcactgcttcctctggaactcagtatatctcaaagatgtaatttcctctccgtgctgcacctggt

SEQ ID NO: 16224 - DNA, 201 bp, Homo sapiens
acattttacataaatggaatcatgcaatgcagcacattttgcatctggcttttttcacctggcgtgttttcaaggctcattcgtattctagcatatatcartactttgttcctatttaggactaaataagattctattgtatgaataaaacatattttgtttatatacttagtttgatgaacatttgagttgtttctggat

SEQ ID NO: 16225 - DNA, 201 bp, Homo sapiens
tgcctcagcctccggagtagctgggactacaggcacccgccactgtgcttggctaattttttgtatttttagtagagacgggtttcaccatgttagccagratggtctcgatctgctgaccttgtgatccacccgcctcggcctcccaaagtgctgggattacaggcttgagccaccacaccgagccctgttaggtataaa

SEQ ID NO: 16226 - DNA, 201 bp, Homo sapiens
tacatttaggcatttgatgcattttaaattaaattttgtatatggtgtaaagtagcaatccaacttaattcttgcatgtgggtattcagttattccattgycttgaaacccttttcaaaatcaattgtctataaatgtaagagtttatttttggaccatcagttctatcctgttgacctatatatgcctatcctaatgcca

SEQ ID NO: 16227 - DNA, 201 bp, Homo sapiens
ttacacacagtcttgattaccataactttgcagtaagttttgaactcagacagtctgagtgcttttattttgtcctttttcaagattaatttggttattcyggatcttttgcatttccatatgaattttaggatggttgtcaatttctgcaatagaaaagcagcaggattttgatagagagtgcattgaatctgtagacca

SEQ ID NO: 16228 - DNA, 201 bp, Homo sapiens
tttcaccatgttagccagaatggtctcgatctgctgaccttgtgatccacccgcctcggcctcccaaagtgctgggattacaggcttgagccaccacaccsagccctgttaggtataaattatttcataaaattcagacttgtaaatttatggtagcctttggaatgggtgatagatgtcctatgccacacaaattcctca

SEQ ID NO: 16229 - DNA, 201 bp, Homo sapiens
tttcccagaagaataaaatttgctgcgttgctttttgggtgtgagctgcttttgtatttgcctaatgcctttaatgcaaatttctttctttctctcttgcttttttttaaaaaaaatagaaatgtttgtcttcttaaaacatctgaaagtggcacaccaagttcctctactcctcaagaaaacaccatatctggatatagc

SEQ ID NO: 16230 - DNA, 201 bp, Homo sapiens
ggagaggtggcttgatttacatttaatctctgcaatttattagagtcctgtagttggatttactttgaagagagtttcccagaagaataaaatttgctgcrttgctttttgggtgtgagctgcttttgtatttgcctaatgcctttaatgcaaatttctttctttctctcttgcttttttttaaaaaaaatagaaatgttt

SEQ ID NO: 16231 - DNA, 201 bp, Homo sapiens
agtcaggatgttggcatacccatcacccaaccatttctatgtgttgagtacatttcaagtccttttctagctatttagaaaactataataccttgttgttsactgcagtcaccctactcttctgtcaaacattagaaagcattccttctatctaactctgtggttgtaccccttcaccaacctctcttcgtcctcaccacc

SEQ ID NO: 16232 - DNA, 201 bp, Homo sapiens
gctttgctgcttattagaggtgtggccctagaagatttgtaaatccctctgagctttatttgatctaaaatatgaatagtaatagtcccgaatttgtaacrttgttgggaagattaagtgacacatttaaaatgcttagtactgtgtgtagaacataaacacttcaaaaaatgtaaactgtgatttctatattcaataaga

SEQ ID NO: 16233 - DNA, 201 bp, Homo sapiens
tttcttaagattatctatggatggttctccaactaggattgcgtatgggacacaagggagctctggttactctttgagattgtgtaacactggggacaackctggtgagtaacctcactttttcgtggacctgtcagggatgtctgtcatgttgatagtttgcttagtcttaaggaattatgtgtcttgttctccttggtt

SEQ ID NO: 16234 - DNA, 201 bp, Homo sapiens
aggatgttggcatacccatcacccaaccatttctatgtgttgagtacatttcaagtccttttctagctatttagaaaactataataccttgttgttcactrcagtcaccctactcttctgtcaaacattagaaagcattccttctatctaactctgtggttgtaccccttcaccaacctctcttcgtcctcaccacccccc

SEQ ID NO: 16235 - DNA, 201 bp, Homo sapiens
taaatccctctgagctttatttgatctaaaatatgaatagtaatagtcccgaatttgtaacgttgttgggaagattaagtgacacatttaaaatgcttagkactgtgtgtagaacataaacacttcaaaaaatgtaaactgtgatttctatattcaataagaaatgtagcaatggacaaagcatataaaaagcaaaagaaa

SEQ ID NO: 16236 - DNA, 201 bp, Homo sapiens
taaagcggggatggtattcacaacatttaacttatagggtccaagcactgaccaacctgaccattagaacagagtgtggtctctgtacagggcagatggcrctgagtgggtattctccacagaaagagaaacgaagacagtaccccactcctccaacccaccacccaccaccaatcccaccaccaattccaccaccaatcc

SEQ ID NO: 16237 - DNA, 201 bp, Homo sapiens
actgcagtcaccctactcttctgtcaaacattagaaagcattccttctatctaactctgtggttgtaccccttcaccaacctctcttcgtcctcaccaccmcccccacacacacacacccttcccagcctctcgtaaccaccatatactctctacggccatgaaatcatctttcgtgggatcacgcaatgtttgtctttct

SEQ ID NO: 16238 - DNA, 201 bp, Homo sapiens
gacaaagcatataaaaagcaaaagaaatactagaagacacttgatttttctcaaaaataaacacaccaagtatttttgttttagtgaaattcatgcttacwtgctgtatactaggattgaacatactgccaccaaaatatagcagtcggtggtacatgtgggtggagcaagacccctccaccttgtcatcgtgtgaagggg

SEQ ID NO: 16239 - DNA, 201 bp, Homo sapiens
tacattttttgaaataaaaatactagattcaaaggtgtgaatatttttgaaggttttgtggtgtggtatcatgaaattaggtttcagaaagtttactccayagttgactttttctaccagctaataagagtgctcatttaccccacttaggccaactctaacaggcttctgttgctttgcatcctgacatatttatctttc

SEQ ID NO: 16240 - DNA, 201 bp, Homo sapiens
gaagattaagtgacacatttaaaatgcttagtactgtgtgtagaacataaacacttcaaaaaatgtaaactgtgatttctatattcaataagaaatgtagmaatggacaaagcatataaaaagcaaaagaaatactagaagacacttgatttttctcaaaaataaacacaccaagtatttttgttttagtgaaattcatgc

SEQ ID NO: 16241 - DNA, 201 bp, Homo sapiens
tttaacttatagggtccaagcactgaccaacctgaccattagaacagagtgtggtctctgtacagggcagatggcgctgagtgggtattctccacagaaasagaaacgaagacagtaccccactcctccaacccaccacccaccaccaatcccaccaccaattccaccaccaatcctgccacccaccaccaatctcaccac

SEQ ID NO: 16242 - DNA, 201 bp, Homo sapiens
caccctactcttctgtcaaacattagaaagcattccttctatctaactctgtggttgtaccccttcaccaacctctcttcgtcctcaccaccccccccacmcacacacacccttcccagcctctcgtaaccaccatatactctctacggccatgaaatcatctttcgtgggatcacgcaatgtttgtctttctgtgcttgg

SEQ ID NO: 16243 - DNA, 201 bp, Homo sapiens
caaataagtaatatattttggagcttgctattcttctctttttatggtatttttgtgtgcacattcttatgctcttattcagttatttctgtagaatacawtttttgaaataaaaatactagattcaaaggtgtgaatatttttgaaggttttgtggtgtggtatcatgaaattaggtttcagaaagtttactccatagtt

SEQ ID NO: 16244 - DNA, 201 bp, Homo sapiens
cactaagccacatggaaaagtaaagctgggaactgcattgggcaaaccttcctcccattctattcctaaataaaatagctttcttaagctataaaaaaccytttttaagctttaaaaaggttttaaaaagctacattcctcacaatttgcccatgaggaaattccttgtggaaaaaggacaggcagaagtcagagtcaccc

SEQ ID NO: 16245 - DNA, 201 bp, Homo sapiens
accttgcatgtgactttaaggtggttggcctggaagaaaagtcccaagatgggaaatagtaggtgtcttttttactaaatgcactccaatttgggaccaaraattttcattcttgaaggctcagtattgtgagtttataagagataatagacataaaagtgtaatgatttcattgcaaataaaaaaaggcccctttgcacc

SEQ ID NO: 16246 - DNA, 201 bp, Homo sapiens
cctcccgggttcaagcgattctcctgcctcagcctcctgagtagctgggattacaggcgcgcgccacacctggctaatttttgtatttttagtagagacgrggtttcatcatgttggtcaggctggtctcgaactcctggcctcaagggatccacccacctcggcctcccgaagtgctgggattacaggtgtgggccactg

SEQ ID NO: 16247 - DNA, 201 bp, Homo sapiens
taaaatacaaaaaaaaaaaattagccgggcgtggtggcaggcacctgcagtcccagctactcgggaggttgaggcaggagaatggcgtgaacccgggaggyggagcttgcagtgagccgagatcacaccactgcactccagcctgggcgacagagcgagactccgtctcaaaaaaaaaaaaaaaaaaaaagaaaaagaaaa

SEQ ID NO: 16248 - DNA, 201 bp, Homo sapiens
gcgcgccacacctggctaatttttgtatttttagtagagacgaggtttcatcatgttggtcaggctggtctcgaactcctggcctcaagggatccacccayctcggcctcccgaagtgctgggattacaggtgtgggccactgtgcccagctgtatagagatattttaaacaacactaaagtcctcctactttgactaatt

SEQ ID NO: 16249 - DNA, 201 bp, Homo sapiens
ttgtgtgtgctggagatgtggctgggttttgtctcacagcagaggcaaggaatcgcaactcagaaatacattgctacttggctgcctctattattgtacaycttgaaggcgaggttaattaagtcctcttgtggggtttgagggctggaatctaatttttggagttttttgttttttgttttttgtttttttttttttaat

SEQ ID NO: 16250 - DNA, 201 bp, Homo sapiens
ttctcaaaaataaacacaccaagtatttttgttttagtgaaattcatgcttacatgctgtatactaggattgaacatactgccaccaaaatatagcagtcrgtggtacatgtgggtggagcaagacccctccaccttgtcatcgtgtgaaggggctctgccatacatgaccttgcatgtgactttaaggtggttggcctgg

SEQ ID NO: 16251 - DNA, 201 bp, Homo sapiens
ttcaaaatcaattgtctataaatgtaagagtttatttttggaccatcagttctatcctgttgacctatatatgcctatcctaatgccagttacacacagtyttgattaccataactttgcagtaagttttgaactcagacagtctgagtgcttttattttgtcctttttcaagattaatttggttattccggatcttttgc

SEQ ID NO: 16252 - DNA, 201 bp, Homo sapiens
agttctttgaaagagagtgataggaaaaaggaacactattgaaggaaggactgcccagtttcaaacaggtatttatttttctctcctaggcttcccctgcmggatgtttggcgcatctatagtggcattttaaatctgtcagacattacaaaagatacacctttctcacaaataaaagagattattattcaccaaaactat

SEQ ID NO: 16253 - DNA, 201 bp, Homo sapiens
agtagcagaactgtcattgctttgggcttagggatattcgaatgtgtgagggcaagtgggatcagatatctacttccaggtataatttgggtaggaaagaractcatgcagaaagaagccctggaaggccagagcatcgtggtcagaggtgttgcctttggagggtcattgctgccaggagccgaatacccactgtatcca

SEQ ID NO: 16254 - DNA, 201 bp, Homo sapiens
gtttgagaccagcctgggcaacacagtgagaccccgtctctacataaaattagaaaaaaacaattaactgggtgtggtggtgtgcacctgtagtcccagcyagtcaagaggctgagacaagaggatctcttgagcccaggagctcaaggctgtagtgagccaagatcgtgccactgcacacaaacaattatgtgacctcgg

SEQ ID NO: 16255 - DNA, 201 bp, Homo sapiens
cctgacttcttgacagttctgaatttagtggagcaatgaggttcagctttggtgaatgagcttaatttttccatgataaactgctagtttcttcccactayagtgtctctcaaaaatgggacagcaacattctttttgttttcacttgcagtaagcatgatgcaattacataaatgtacacttttcaatttgttaaataga

SEQ ID NO: 16256 - DNA, 201 bp, Homo sapiens
atcgtgccactgcacacaaacaattatgtgacctcgggcaagttgctttacctctttacacctcttaatttccttatctgtaaaatgaggatgataatttmttcctgggtctgttgtaataattaatacatcaaagcacttcatgtctggaacagtgaagacaccctgctatgactattaaggatagtatacatggaataa

SEQ ID NO: 16257 - DNA, 201 bp, Homo sapiens
gcaacacagtgagaccccgtctctacataaaattagaaaaaaacaattaactgggtgtggtggtgtgcacctgtagtcccagctagtcaagaggctgagayaagaggatctcttgagcccaggagctcaaggctgtagtgagccaagatcgtgccactgcacacaaacaattatgtgacctcgggcaagttgctttacctc

SEQ ID NO: 16258 - DNA, 201 bp, Homo sapiens
ctctattattgtacaccttgaaggcgaggttaattaagtcctcttgtggggtttgagggctggaatctaatttttggagttttttgttttttgttttttgkttttttttttttaatgtcaggagctgactgggtgataaaatgcatattgagaataagaggccttctgacccttctgggtctagggctgtaaagcgtctca

SEQ ID NO: 16259 - DNA, 201 bp, Homo sapiens
ttgctttacctctttacacctcttaatttccttatctgtaaaatgaggatgataatttcttcctgggtctgttgtaataattaatacatcaaagcacttcmtgtctggaacagtgaagacaccctgctatgactattaaggatagtatacatggaataagacacaggaacttctaaatgcttttgaccatagatttaggtt

SEQ ID NO: 16260 - DNA, 201 bp, Homo sapiens
ctcttaatttccttatctgtaaaatgaggatgataatttcttcctgggtctgttgtaataattaatacatcaaagcacttcatgtctggaacagtgaagayaccctgctatgactattaaggatagtatacatggaataagacacaggaacttctaaatgcttttgaccatagatttaggttctgagttttaagaatttaa

SEQ ID NO: 16261 - DNA, 201 bp, Homo sapiens
ttagagcctttctgtttctctcaatagggttggagagttatccttatcttctttttattggggcttaagaagagagatgaggttccatggagtaaacaatwcaaggatataaggacctcatataatctcacgtatccattttccatgaaagccattcttggcacgaatttgccattctatgtttgagcctcataaaaggca

SEQ ID NO: 16262 - DNA, 201 bp, Homo sapiens
taatttccttatctgtaaaatgaggatgataatttcttcctgggtctgttgtaataattaatacatcaaagcacttcatgtctggaacagtgaagacaccytgctatgactattaaggatagtatacatggaataagacacaggaacttctaaatgcttttgaccatagatttaggttctgagttttaagaatttaactca

SEQ ID NO: 16263 - DNA, 201 bp, Homo sapiens
tgaatatataaagcaaaaaaatgaaaagtgagaacttccaggctttggattgttgtaggtgataaatataaaatgggatttctggggggctgctactgagwtgaggggatggcagaaaacatggaagcaaggtctctggtcagcccagggtgctgggcttgtcccaacaccacgtaggcaataagaggacagtacagggtg

SEQ ID NO: 16264 - DNA, 201 bp, Homo sapiens
aaggctcagtattgtgagtttataagagataatagacataaaagtgtaatgatttcattgcaaataaaaaaaggcccctttgcacctgatatctccatcatttttctagaattttgtgcacacatgccttgcactacttggtgatgataaagatttccagatctttgcacagaataaggctttgctttagatcagaatttt

SEQ ID NO: 16265 - DNA, 201 bp, Homo sapiens
gaggatgataatttcttcctgggtctgttgtaataattaatacatcaaagcacttcatgtctggaacagtgaagacaccctgctatgactattaaggatartatacatggaataagacacaggaacttctaaatgcttttgaccatagatttaggttctgagttttaagaatttaactcaggaaattgtaacaccaaaaat

SEQ ID NO: 16266 - DNA, 201 bp, Homo sapiens
cacgtaggcaataagaggacagtacagggtgccgtctctctccctcttcctctctctgtctctctctctgtgtgtgtgtgtgtgtgtgtgtgtaacactaycttcccaatttttactgtctatttgtattcaaagataaggtccttatgaaaaatacactgctctgattcactttaaaacttatttccatatttattattt

SEQ ID NO: 16267 - DNA, 201 bp, Homo sapiens
tcactatggagaataatatttgtgtcattctttacagaagaaggtagcttgccaaactgtctccatctttcccgattcagtcttttgttcaagtaattcayatttttagattttttattggtaatctgagacaagaagaaatttaaagtaatcttcactaagccatgaaagctcccaacattgttctccatgagagatgct

SEQ ID NO: 16268 - DNA, 201 bp, Homo sapiens
actgtctatttgtattcaaagataaggtccttatgaaaaatacactgctctgattcactttaaaacttatttccatatttattatttattgtgggaataayaatattcccaatattattatttattatttaagttattattattaacttccctctgaggttatatattggttactcacaggtgaaatccaaaatattctac

SEQ ID NO: 16269 - DNA, 201 bp, Homo sapiens
tccagcctgggcgacagagcaagactccatctcacaaaaaaataataaaaataaaataaaaaaaaaaaagaaaggctgtctttctcctttcccattggccrtctttctccattccctactcctccaatcccctggcaaccactaaatctactttccatgtctgtggacttgactcttcgggacattttacataaatggaat

SEQ ID NO: 16270 - DNA, 201 bp, Homo sapiens
ttgccaaactgtttttgagagcagctacacaatgttacattcttaccagcaacaattgagggcttcagtctctctacaaccttaacaacacttgttattgkctttgtaattattgcctttctaggcagtgtgaagtggtgtctcactgtggttttgatatgcatttccctaatgactaacaatgttgtgtatcttttcgtg

SEQ ID NO: 16271 - DNA, 201 bp, Homo sapiens
tctttcccgattcagtcttttgttcaagtaattcacatttttagattttttattggtaatctgagacaagaagaaatttaaagtaatcttcactaagccaygaaagctcccaacattgttctccatgagagatgctggcctgcatttattcaaaaacaaaagacccctctgttgccaaagctcggagggcttttcagaaac

SEQ ID NO: 16272 - DNA, 201 bp, Homo sapiens
gtgagtcagttaaacctcttttgtttataaattacccagtctcaggtagtatctttacagcagtgtgaaactggactaatacatctgggaaattctttttstctccttcctttctgaaggacagctttgcctgatattatattcttggttgccaggttttgtactttcaatactttgaatatatcatcccactctctcttg

SEQ ID NO: 16273 - DNA, 201 bp, Homo sapiens
ctcacaggtgaaatccaaaatattctacaaaaggtaaatattcctttggtaacaaatgaagaatgccagaaaagatatcaagattataaaataacccaacrgatggtctgtgctggctataaagaagggggaaaagatgcttgtaaggtaactcatgagattatgaaaaacacaataggctgcttgagaaaattcatttca

SEQ ID NO: 16274 - DNA, 201 bp, Homo sapiens
agtcaagtcatatgcgttcacaaagagatggtatgaaattggaacttatgtttaaaagggaagcaaagcataaaagtttggaaattttgcagcctgaccawgtggtagaaaagaaaaaccaattttctgaggaggaattcaagccggctgcagaaatttacataagtaatcaggagctgaatgttaattgccaaacaatgg

SEQ ID NO: 16275 - DNA, 201 bp, Homo sapiens
ttgtaaggtaactcatgagattatgaaaaacacaataggctgcttgagaaaattcatttcaaaatatattttccaatagcataatttaatcatagtttttwaaaaaattcagagacaaatgatctgataaattgataagcaacttttaacaaattgaatatacataatatatatttatattatttatgatatatgtcacaa

SEQ ID NO: 16276 - DNA, 201 bp, Homo sapiens
ttgggagatgattggatcacgaggtgttttcccccattatgttctcatgatagtgagggtgttctcatgagatctgatggtttaaaagtggtggttacccstgcgcacatgctctctctctctcctgctgccttgtgaagaaggtacctgcttccccttcaccttccaccataattgtaagtttcctgaggcctccccagc

SEQ ID NO: 16277 - DNA, 201 bp, Homo sapiens
gcagtcacttatttgaatcccattgtcgtaactttctactattttatttttccactgtgactcagggagattcaggtggtcccttagtttgcaaacacaayggaatgtggcgtttggtgggcatcaccagctggggtgaaggctgtgcccgcagggagcaacctggtgtctacaccaaagtcgctgagtacatggactgga

SEQ ID NO: 16278 - DNA, 201 bp, Homo sapiens
tattgtacaccttgaaggcgaggttaattaagtcctcttgtggggtttgagggctggaatctaatttttggagttttttgttttttgttttttgttttttkttttttaatgtcaggagctgactgggtgataaaatgcatattgagaataagaggccttctgacccttctgggtctagggctgtaaagcgtctcagggttg

SEQ ID NO: 16279 - DNA, 201 bp, Homo sapiens
tccctctaattgcactgcttcctctggaactcagtatatctcaaagatgtaatttcctctccgtgctgcacctggtcggccactgaaacccactattgccygcttcacgtgtggcaaagagctagcgggcttgggttttgttctgccgagaggaagggagaacacccacttttataagaaagagatgggttacctgaaccc

SEQ ID NO: 16280 - DNA, 201 bp, Homo sapiens
ggcacctcagaccgtttgcccattttatgacaagaattatctagatcttgtaggatggaaaaatcgaaagtgccgttttctggctatttggaaccattgtygagtttgtattggggttaagcagcattgcagaagaaaataaggcatttaggttttaggtcaggtgtgagttgaagaggttttaagttcttgagaacatag

SEQ ID NO: 16281 - DNA, 201 bp, Homo sapiens
cactcctccaacccaccacccaccaccaatcccaccaccaattccaccaccaatcctgccacccaccaccaatctcaccaccaatcccaccaccaatcctrccacccaccatcaatctcagcaccaatcccaccaccaatcccaccaccaatcccaccacctaccccaccaccaatcccgccacccacgaccaatcccacc

SEQ ID NO: 16282 - DNA, 201 bp, Homo sapiens
cagttaaggcaggaaccggccattttcacttcttttgtcattcttcagttacttcaggccatctggatgtatgcatgtaggcttgggcccagaggcctgayatttaacatggataaatgtaaagttcttagaatcatacatacacattggaaaagatggggcttaatcgcactttataagacttgaaggatgtttgagaat

SEQ ID NO: 16283 - DNA, 201 bp, Homo sapiens
agaatcatacatacacattggaaaagatggggcttaatcgcactttataagacttgaaggatgtttgagaatcactatgaaactgctgaaaataccaagaraatttaattcttatgtatataaataatgtgtctgttttacatgaatcccttctacaagcttggtatttaatatggcatatattgttttttcatagtagat

SEQ ID NO: 16284 - DNA, 201 bp, Homo sapiens
taaacgatatgtacacaactaaaacaaaactaagatataagatcatattaatgtaatgataataaaagtggattgtctcctgttctaattttaataggcayaaggcatttttgttaatcacttcttattaaagaattttttataatattcaggaaaatacaacaaaaaaacccttacattcctaaggcctcagagtcagag

SEQ ID NO: 16285 - DNA, 201 bp, Homo sapiens
aaacgatatgtacacaactaaaacaaaactaagatataagatcatattaatgtaatgataataaaagtggattgtctcctgttctaattttaataggcacwaggcatttttgttaatcacttcttattaaagaattttttataatattcaggaaaatacaacaaaaaaacccttacattcctaaggcctcagagtcagagt

SEQ ID NO: 16286 - DNA, 201 bp, Homo sapiens
gcctcttctctttgtttcagaaactagagccctgtttattctgatcaaggctctggcccactgtctttatctcagataacccaccctcttctgcacacagyatggagctaagagaagggtgtctagttatgtaatatcatcggcagcataaattcccagaatttgttctttgatttttttgtttgtttttccagttagaag

SEQ ID NO: 16287 - DNA, 201 bp, Homo sapiens
gcctttaatgcaaatttctttctttctctcttgcttttttttaaaaaaaatagaaatgtttgtcttcttaaaacatctgaaagtggcacaccaagttcctstactcctcaagaaaacaccatatctggatatagccttttaacctgcaaaagaactttacctggtaatgtgatttgataataatattacataaaatgtaac

SEQ ID NO: 16288 - DNA, 201 bp, Homo sapiens
ttcatatcagtttgaacaagagggcagacctagagagactgtcgtcgttttctgactggtggagttgagggaaacgtgagggttgctgggaagtgaagacyccgcgacttgccgtgaaatctcttctacttaaagagcaagacatgtgaattaattctttcagggagggatacaactgcatgcaggtgatggaaataatgg

SEQ ID NO: 16289 - DNA, 201 bp, Homo sapiens
taaaacttagtatccaaaggcggaagtacttaaccatacctaggaagaaaaggagttgttttgtagaaggggttggggtttgggagatgagccagacacartcagcagggagagcacatgtgttttcatgaagaattatgccgagataggtaatggatgaggaagaaatttgggcttgactgaagtaatgggggctgtcct

SEQ ID NO: 16290 - DNA, 201 bp, Homo sapiens
aggaatggcaagaggagtggctaaaggatttaggatctttggggtcagctagctttgcttttgtgagtttatataatggtttagtcaggatggtaaaactwagtatccaaaggcggaagtacttaaccatacctaggaagaaaaggagttgttttgtagaaggggttggggtttgggagatgagccagacacaatcagcag

SEQ ID NO: 16291 - DNA, 201 bp, Homo sapiens
gcagaaaacatggaagcaaggtctctggtcagcccagggtgctgggcttgtcccaacaccacgtaggcaataagaggacagtacagggtgccgtctctctmcctcttcctctctctgtctctctctctgtgtgtgtgtgtgtgtgtgtgtgtaacactatcttcccaatttttactgtctatttgtattcaaagataaggt

SEQ ID NO: 16292 - DNA, 201 bp, Homo sapiens
aggtaagcatgacgctttaaatattgcttctagagtaagtctcacatgttgaaatacatggagtgggtcgttttaatcggtttctgtctgaaattatatckaaactctttatctttcctatctatttattcccaaatatttattcagttattcttaaaaaatgtatttttgctttggcttgaaaaaaaattttagggagac

SEQ ID NO: 16293 - DNA, 201 bp, Homo sapiens
tgtgtgtgtgtgtgtgtgtgtgtgtgtctggcaagcaaggtcttgcacacacacagcactttgggaggccaatgcaggtggatcacttgagcctaggaatytgagaccagtctgggcaatgtgatgaaacccatctctacaaaaaaatatgaaagtatctgtgtgtgtgtgttgctgtgtagtggactacagaactttaga

SEQ ID NO: 16294 - DNA, 201 bp, Homo sapiens
tgaaagtaagtggtcgaggttccagcacagttcctgggatccctctaattgcactgcttcctctggaactcagtatatctcaaagatgtaatttcctctcygtgctgcacctggtcggccactgaaacccactattgcccgcttcacgtgtggcaaagagctagcgggcttgggttttgttctgccgagaggaagggagaa

SEQ ID NO: 16295 - DNA, 201 bp, Homo sapiens
gatgggttacctgaacccatgggcacctttgcctcttggcctcctaactttgctaccagggcatggctaggagggtccaggctgcgcgtgctgaggagctygaggggctgcagcattgcacagccttcatggcaggcaaggaatctgctttgcaaggggcattagccctggaggctcagtggatatgggctattgcaatag

SEQ ID NO: 16296 - DNA, 201 bp, Homo sapiens
tggcaggcaaggaatctgctttgcaaggggcattagccctggaggctcagtggatatgggctattgcaatagtaattcaaggagcatttttaggcctggcrtggtggctcacgcctgtaattccaacagtttaggagatcaaggcaggtggatcacttgagcataggagttcgagactagcctggccaatgtgacgaaacc

SEQ ID NO: 16297 - DNA, 201 bp, Homo sapiens
gggctattgcaatagtaattcaaggagcatttttaggcctggcatggtggctcacgcctgtaattccaacagtttaggagatcaaggcaggtggatcactkgagcataggagttcgagactagcctggccaatgtgacgaaaccccatctccacaaaaattagctgggcatggtggtgcgcacctgtaatcccagctcccc

SEQ ID NO: 16298 - DNA, 201 bp, Homo sapiens
cttttatctcagtctttgagtattgatcatggggtgttggaacaggactttggaatgcttgcagggtaaacctttggcctctgttagtcagggaatgaccyagtttggcaaaacagaggagagttttgaaatatggaactttcccgaggcatacattgtcattttaaagtggtcaatcaaagcccagtaggactgggctgg

SEQ ID NO: 16299 - DNA, 201 bp, Homo sapiens
cattgaaaaaaaattgaaaaaagtagttgatatcagaattttaaactgcaatgcattagttgaaaataattttttaaggatatctatggtcagtttaaaasaaaggtctatttaatctcaaagagtttctatgtagtcaagacttttattctaggctgggcacggtggctcatgcctgtaattccagcacttgggaggcca

SEQ ID NO: 16300 - DNA, 201 bp, Homo sapiens
tgatatccggttgcttctcactaggagaaggatgaaagatgacagagcatttataaccaccatttgttattttcattatcaactgacactggtgtttctcygcccggagcgattttgtcctcccttcacctcaggaaacattcggcaacgtctagagacacttttggttgtcctaatgggagagggtatgcaactggctgt

SEQ ID NO: 16301 - DNA, 201 bp, Homo sapiens
acttgggaggccaaggcaggtggatcgcttgtgcccaggcattccagaccagcttggggaacacagcaaaaccctgtctctacaaaaaatacaacaattasccatgcggagtgacatgcggctgtattcctagctattcaggaggctgaggtgggaggatcacctggtggctgcgttgagtggagatcacaccactgtact

SEQ ID NO: 16302 - DNA, 201 bp, Homo sapiens
aatcccagcactttgggaggctgaggtgggcggatcgcgagatcaggagatcgagactatcctggctaacacggtgaaaccccgtctctacttaaaatacaaaaaaaaaaaattagccgggcgtggtggcaggcacctgcagtcccagctactcgggaggttgaggcaggagaatggcgtgaacccgggaggtggagcttg

SEQ ID NO: 16303 - DNA, 201 bp, Homo sapiens
gtctctacaaaaaatacaacaattagccatgcggagtgacatgcggctgtattcctagctattcaggaggctgaggtgggaggatcacctggtggctgcgytgagtggagatcacaccactgtactctcgtctgggcgacaggagtgagaccttgtctgaaaaaaaattattctacttttatttgaatagacaaaattttt

SEQ ID NO: 16304 - DNA, 201 bp, Homo sapiens
tcttcgtcctcaccaccccccccacacacacacacccttcccagcctctcgtaaccaccatatactctctacggccatgaaatcatctttcgtgggatcaygcaatgtttgtctttctgtgcttggcttactttacttaacataatgacctccagttccatccacattgctgcaaatggaatgatttccttcttttttatt

SEQ ID NO: 16305 - DNA, 201 bp, Homo sapiens
tgacatgcggctgtattcctagctattcaggaggctgaggtgggaggatcacctggtggctgcgttgagtggagatcacaccactgtactctcgtctgggygacaggagtgagaccttgtctgaaaaaaaattattctacttttatttgaatagacaaaatttttttgaatcctgatactatttcaaagaccttaaagatt

SEQ ID NO: 16306 - DNA, 201 bp, Homo sapiens
cttaaagatttcactaactagctaaatcaaacttaggaaaatattatttggttttccagtgaagcatttctcttatttagagcctttctgtttctctcaayagggttggagagttatccttatcttctttttattggggcttaagaagagagatgaggttccatggagtaaacaatacaaggatataaggacctcatataa

SEQ ID NO: 16307 - DNA, 201 bp, Homo sapiens
tccaaccattagcgtcaacgctctcttttcagtctgcacaacaaaaacaagcacacgcattgttggaggaacaaactcttcttggggagagtggccctggyaggtgagcctgcaggtgaagctgacagctcagaggcacctgtgtggagggtcactcataggacaccagtgggtcctcactgctgcccactgctttgatgg

SEQ ID NO: 16308 - DNA, 201 bp, Homo sapiens
ctatgtatttccttcccagttctttgaaagagagtgataggaaaaaggaacactattgaaggaaggactgcccagtttcaaacaggtatttatttttctcycctaggcttcccctgcaggatgtttggcgcatctatagtggcattttaaatctgtcagacattacaaaagatacacctttctcacaaataaaagagatta

SEQ ID NO: 16309 - DNA, 201 bp, Homo sapiens
aacccatctctacaaaaaaatatgaaagtatctgtgtgtgtgtgttgctgtgtagtggactacagaactttagaggcagtcacttatttgaatcccattgycgtaactttctactattttatttttccactgtgactcagggagattcaggtggtcccttagtttgcaaacacaacggaatgtggcgtttggtgggcatca

SEQ ID NO: 16310 - DNA, 201 bp, Homo sapiens
aatccccagggggtaggatagtgcagagaagatggcactctccagtgcttaataaaatgcacgtggtctaagctgcccactccctcaaaggcaataaaaawtaggtactatttaaattgaagagtaactactgccccagggaatggacaggttgtcattggaatagccatggttaatggtcccagttgacaactgaaatga

SEQ ID NO: 16311 - DNA, 201 bp, Homo sapiens
actttatgagaaaattaatcatttatattctaatttcctgagtatgtagagagtatagataatgttcctttatgtagaaatatttaaatgtaagatgattytaaatcagaaagaatatttgattgatttaaaatttttaaatgggctttaatattttcagaggttttctttacttagggatttttggactgacattattgc

SEQ ID NO: 16312 - DNA, 201 bp, Homo sapiens
ctccatgttttgtgcatacatgaaatctaggcaatacacttgtattcccaaaagcttccacttgaagagatctgtgctctttccaaatataaaccttaccygagaggtggtcatcttggccacacctcagagagggagagaggcagtcttgttgggttgggtggtcataatggggctcagggccaaatccccagggggtag

SEQ ID NO: 16313 - DNA, 201 bp, Homo sapiens
gcaaaataaatcatgattatggctaggaaaatcagggatgtaagtaagcaaaaatttagaaactacatattgcatgtagtccccaaattcagaaacagtcrtcgttaaacatcttttatttagtctttcagatatttttctacatatacctatttgcacatttcacaaaaaagagttattaactgtggacactctttgact

SEQ ID NO: 16314 - DNA, 201 bp, Homo sapiens
ttttttttttttttttttagatggagtctagctctgttgtccaggctggagtgcagtggcgcaatctcggctcactgcaagctccgtctcctgggttcacrccattttcctgtctcagcctctggagtagctgagactacaggtgcccaccaccacgcctggctaaattttttttgtatttttagtagagatggggtttca

SEQ ID NO: 16315 - DNA, 201 bp, Homo sapiens
tgggacttggtgccctgtgccccagccactccagctccagctgtgactaaaagggtccatagctcaggctgtcgcttcaagggtgcaagccccaagccttsgtggcttccacgtgctcttgggtctgcgagttcacagaaaacaagagctgagctttgagagcctctgcctagatttcacaggatgtgtggaaacacctgg

SEQ ID NO: 16316 - DNA, 201 bp, Homo sapiens
cctcctcccacattttattattcatgccatagtttatatcttttgtatgttgtgtattcattagcaaattgttgtagttatagttatttgttaatactttkgttttttaacttttatactagagttaaaagtgactgttgcacaataacagtattggagtattctgtatttgactgtataagaatacctttaatagagttt

SEQ ID NO: 16317 - DNA, 201 bp, Homo sapiens
aactccgtggtttttagtatatccacctgattgcacaacgatcaccactgtctagttccagaacatttttatcaccacaaaagaaaggctgtatccaggcygggcacggtggctcacgcctgtaatcccagcactttgggaggctgaggcgggcggatcacggggtcaggagattgaaaccatcctgggtaacacggtgaa

SEQ ID NO: 16318 - DNA, 201 bp, Homo sapiens
ccactgtctagttccagaacatttttatcaccacaaaagaaaggctgtatccaggctgggcacggtggctcacgcctgtaatcccagcactttgggaggcygaggcgggcggatcacggggtcaggagattgaaaccatcctgggtaacacggtgaagccctatctgtactaaagatacaaaaaaattagctgggcatggt

SEQ ID NO: 16319 - DNA, 201 bp, Homo sapiens
gtgctatttctgattgttgtatcttgtagcaaaatttaaagaaaaagtaatttgtgcctttctcaatattcctgttattgttcatgtattctaaaactcastgttactcacttagcttgcttttaatgttttttaaagtgaaaaattgttcccaagtacataaaatctctacactcaagaacaattctagtcaaaagcatt

SEQ ID NO: 16320 - DNA, 201 bp, Homo sapiens
ctgaggcgggcggatcacggggtcaggagattgaaaccatcctgggtaacacggtgaagccctatctgtactaaagatacaaaaaaattagctgggcatgrtggcagatgcctgtagtcccagctactcaggaggctgaggcaggagaatggcctgaacccaggaagcggagcttgcagtgagccaagattgcgccactgc

SEQ ID NO: 16321 - DNA, 201 bp, Homo sapiens
ctttttaagtaaatgaaagtatttgcaaaaataattaccaattgagaacatagttgcctgaaagtttaagaacacaggaaaaatcattaactctttaatayggttgatttcctgtacttaaaaaatgtgagtgtaaagaaaacgcagtgatggagttagatattatggggtgttataaaattagctctaagagtgttcttt

SEQ ID NO: 16322 - DNA, 201 bp, Homo sapiens
tattattaacttccctctgaggttatatattggttactcacaggtgaaatccaaaatattctacaaaaggtaaatattcctttggtaacaaatgaagaatrccagaaaagatatcaagattataaaataacccaacggatggtctgtgctggctataaagaagggggaaaagatgcttgtaaggtaactcatgagattatg

SEQ ID NO: 16323 - DNA, 201 bp, Homo sapiens
catttcatattctctttccccctgtgaaggcttactctttctactgttcatttcatctaggtgtaagtgtttcttaagattatctatggatggttctccarctaggattgcgtatgggacacaagggagctctggttactctttgagattgtgtaacactggggacaactctggtgagtaacctcactttttcgtggacct

SEQ ID NO: 16324 - DNA, 201 bp, Homo sapiens; identical to SEQ ID NO: 1543

SEQ ID NO: 16325 - DNA, 201 bp, Homo sapiens
ttgaaggatctatgatcagctgcttcaccgccatgtgactttatgaatagagacgtgttaaagcggggatggtattcacaacatttaacttatagggtccragcactgaccaacctgaccattagaacagagtgtggtctctgtacagggcagatggcgctgagtgggtattctccacagaaagagaaacgaagacagtac

SEQ ID NO: 16326 - DNA, 201 bp, Homo sapiens
ttcttcaaagacttatttgtcaggcccatagaaatgttacttcttgctctttgattcataaatatactaagtcataataatttttaaaagtgagagtttcktactctgtatatttcaatgtatataatttgatctatttcaatttattggtcaaatagtagacatgttaggtaagtcttaaaatactgaggctttggagtt

SEQ ID NO: 16327 - DNA, 201 bp, Homo sapiens
tttcactaactagctaaatcaaacttaggaaaatattatttggttttccagtgaagcatttctcttatttagagcctttctgtttctctcaatagggttgragagttatccttatcttctttttattggggcttaagaagagagatgaggttccatggagtaaacaatacaaggatataaggacctcatataatctcacgt

SEQ ID NO: 16328 - DNA, 201 bp, Homo sapiens
taggaaaatattatttggttttccagtgaagcatttctcttatttagagcctttctgtttctctcaatagggttggagagttatccttatcttctttttaytggggcttaagaagagagatgaggttccatggagtaaacaatacaaggatataaggacctcatataatctcacgtatccattttccatgaaagccattct

SEQ ID NO: 16329 - DNA, 201 bp, Homo sapiens
tgaggcaggagaatggcgtgaacccgggaggtggagcttgcagtgagccgagatcacaccactgcactccagcctgggcgacagagcgagactccgtctcaaaaaaaaaaaaaaaaaaaaagaaaaagaaaaacaaaagaggacatttcaggaacagcaagaaaggggttgtaggacatggcgggctgtgccctttctctt

SEQ ID NO: 16330 - DNA, 201 bp, Homo sapiens
cactctctctctcgtatcaccttgtgaagaaggtgtctgcttcccctctgccttccatcgtgattataagtttcctgaggcctccccagccatgggtaacygtgagtcagttaaacctcttttgtttataaattacccagtctcaggtagtatctttacagcagtgtgaaactggactaatacatctgggaaattcttttt

SEQ ID NO: 16331 - DNA, 201 bp, Homo sapiens
tgtgatgaaacccatctctacaaaaaaatatgaaagtatctgtgtgtgtgtgttgctgtgtagtggactacagaactttagaggcagtcacttatttgaaycccattgtcgtaactttctactattttatttttccactgtgactcagggagattcaggtggtcccttagtttgcaaacacaacggaatgtggcgtttggt

SEQ ID NO: 16332 - DNA, 201 bp, Homo sapiens
gcaggcacatgagatacttggagaactttaagaaagagtgagtgtgtgtgtgtgtgtgtgtgtgtgtgtgtgtgtctggcaagcaaggtcttgcacacacrcagcactttgggaggccaatgcaggtggatcacttgagcctaggaatttgagaccagtctgggcaatgtgatgaaacccatctctacaaaaaaatatgaa

SEQ ID NO: 16333 - DNA, 201 bp, Homo sapiens
tctggaggtctcaatttgtatcttgggaagcattataaattttccaactccctagacacaaatgtaccaaaaaaaaacccttgttttctataccagtaatygtgtgctttgtcttgcaattcagacatttacaagaaaatctaaatcaccttaaattaagatttatgttaaatgtggtctaaaaccagcagagttatgtat

SEQ ID NO: 16334 - DNA, 201 bp, Homo sapiens
aatgaacaataaacacaacagtagtctggaggtctcaatttgtatcttgggaagcattataaattttccaactccctagacacaaatgtaccaaaaaaaamcccttgttttctataccagtaattgtgtgctttgtcttgcaattcagacatttacaagaaaatctaaatcaccttaaattaagatttatgttaaatgtgg

SEQ ID NO: 16335 - DNA, 201 bp, Homo sapiens
aatttttattaggtcagagagatgcttattaatcacgagccacagtttcttcttaatgatttttccttttgattaatatccagagtaagcttttctttgttgttcccatttccatgttcataactctttactcatcttcactctatgtgagtttaccaactagaaattggatagtcattctctgatcccacatgttaaact

SEQ ID NO: 16336 - DNA, 201 bp, Homo sapiens; identical to SEQ ID NO: 1534

SEQ ID NO: 16337 - DNA, 201 bp, Homo sapiens; identical to SEQ ID NO: 1536

SEQ ID NO: 16338 - DNA, 201 bp, Homo sapiens
atcctaataaatttaagacaaatgaactatttctcaaacatgactgggactgataagaaagtgaaaagtgctgaaaagattcaactgatgggttgtcagartcttaaaataactgctgttattctatgtatgactatatatcattactattttattttcattatgcacaattaattttgtaggttcaaatttcagatgttt

SEQ ID NO: 16339 - DNA, 201 bp, Homo sapiens
ggagaaaatgtgtcctatgtatttccttcccagttctttgaaagagagtgataggaaaaaggaacactattgaaggaaggactgcccagtttcaaacaggwatttatttttctctcctaggcttcccctgcaggatgtttggcgcatctatagtggcattttaaatctgtcagacattacaaaagatacacctttctcaca

SEQ ID NO: 16340 - DNA, 201 bp, Homo sapiens
tgggaaacagtttccaatgctatcctaataaatttaagacaaatgaactatttctcaaacatgactgggactgataagaaagtgaaaagtgctgaaaagaktcaactgatgggttgtcagaatcttaaaataactgctgttattctatgtatgactatatatcattactattttattttcattatgcacaattaattttgt

SEQ ID NO: 16341 - DNA, 201 bp, Homo sapiens
gggggaaaagatgcttgtaaggtaactcatgagattatgaaaaacacaataggctgcttgagaaaattcatttcaaaatatattttccaatagcataattyaatcatagttttttaaaaaattcagagacaaatgatctgataaattgataagcaacttttaacaaattgaatatacataatatatatttatattatttat

SEQ ID NO: 16342 - DNA, 201 bp, Homo sapiens
tctttaaagtagtagaagctagtcattttctattcaaagcctcaaaatgcttgaatatcattgggctaagggattgtctcaagaaagagtctaacaggtgmacatttcatccgaataaagaaacagatttaactgtgtgacccatgatcacattagcggatagcacagtccaaagaaaataacataagacaagcattttgc

SEQ ID NO: 16343 - DNA, 201 bp, Homo sapiens
cctgctgtttgcattttaaccagttatcaaaggatggcaatgccttcattataaatgtgggcctgacttagccagtataataggtgtagtctacgtgaggwggagtacatttcctattttaaaagatcaatttttatgttaatccaatttggtataaattattcgagtaagtgctatttctgattgttgtatcttgtagca

SEQ ID NO: 16344 - DNA, 201 bp, Homo sapiens
tacaaggcacagggcagtcgtccacagcaaataattttctggcccaaaacgtcaacagtgctgacatcaagaaactctgtgatataccactaggcccaaaytgaagaactgagttctgcaaatcttgctaagaataatacttcctaaaggaaacttgaggactaggatgctagagaactttgattctgacatctgaagcta

SEQ ID NO: 16345 - DNA, 201 bp, Homo sapiens
tttgaatgctgaccaacattctacaaggcacagggcagtcgtccacagcaaataattttctggcccaaaacgtcaacagtgctgacatcaagaaactctgygatataccactaggcccaaattgaagaactgagttctgcaaatcttgctaagaataatacttcctaaaggaaacttgaggactaggatgctagagaactt

SEQ ID NO: 16346 - DNA, 201 bp, Homo sapiens
gcttgccatcgagacatttataaaggagttgatatgagaggagtcaattttaatgtgtctaaggttagcagtgttgaagaatgccaaaaaaggtgcaccavtaacattcgctgccagtttttttcatatgccacgcaaacatttcacaaggcagagtaccggtgagtacaattcaaggtgtgtgttctttgtattggtgcc

SEQ ID NO: 16347 - DNA, 201 bp, Homo sapiens
gtctttataaatcaacacatacttaatgagcctctattatttatgaggttagcgctcaagtgtaagatttgcagaaaatgaatccaaataattgtgtctcrtttccagataagaatttttaagaaaacacaagggaacatctctctcaagttcacttgagggtaatttttacatcagtgattctcaaccagcagtgatttt

SEQ ID NO: 16348 - DNA, 201 bp, Homo sapiens
ctatacttaaattgtggtgaaatacgtatgacataaaacttaccatcttaacttttttttattgagacaggatctcattctgtcacccaggctggagtgcrgtggcgcgatctctgctcactgcaacctctgcctcctgggttcaggcgattctcatgcctcagccacccgagtagctggaattacacgcgcccgccacca

SEQ ID NO: 16349 - DNA, 201 bp, Homo sapiens
aaatgcatacttttttggtgtgatcagagatgggtaactccttattacttgtgggttagattagtttttggaaatagcctggagtcattgagagccaatcyttatcaacaaaatggcataaatggacaggaatgggtttcttcttcactttagagatagctctgaagacatgtctcagttgggattagttcagttgcatat

SEQ ID NO: 16350 - DNA, 201 bp, Homo sapiens
ggttgtatggccccatcaccggggcaattcagaaaggctgtttctataaacaaatccttaaacgtctggtaagaaatgagtccgcgacggaacgagagcakatcgtggttcgcgtgtttactgccgagtgggacgcggactggggccggaccttccacagatctgggctctcctgctctttgttttctaaactttcagcgg

SEQ ID NO: 16351 - DNA, 201 bp, Homo sapiens
gtagtcctagctactccgaggcaggagaattgcttgaacctgggaggcagaggttgcagtgagccaagatcacactacttcattccatcctgggagacagmgtctcactctgtctccaaaaaaaaaaaaaaaaaagagaagttcgttataacaaatgccatatgcccttttgtacatgtcaactggacttctataaatttg

SEQ ID NO: 16352 - DNA, 201 bp, Homo sapiens
ttagaagacacgggagaaataatccattttgttatgttatgcagttgaactgtatagcttctctagttttgtgtttttaatgttctgaaattcaaaacagyagggatggccttcgccgacgcaggagtcgggcattttaaaataggctgtttttcttttggagcgttcttcttgaaggatattctttgtgcaagacggcga

SEQ ID NO: 16353 - DNA, 201 bp, Homo sapiens
ccgcctccgggttcacaccattcccctgcctcagcctcccgagtagccgggactacaggcgctcaccaccacgcccgactaatttttttgtatttttagtrgagacggggtttcaccatgttagccagtatggtctcgatcatctgacctcgtgatctgcctgcctcggcctctgaaagtgctgggattacaggtgtgagc

SEQ ID NO: 16354 - DNA, 201 bp, Homo sapiens
gttcagtttttagccgggaaggtgctagaccacttaactctgatagaaataagctgctgagccctatcagggagggcgttctttcagctgttgtctggtgragaaataaagacagggtgttggttcagttgcaggtattttgctggcgtattgagagattagagtttcctctttgagtgtgatggcagtagaaagagtgtt

SEQ ID NO: 16355 - DNA, 201 bp, Homo sapiens
cctcagcctcccgagtagccgggactacaggcgctcaccaccacgcccgactaatttttttgtatttttagtagagacggggtttcaccatgttagccagkatggtctcgatcatctgacctcgtgatctgcctgcctcggcctctgaaagtgctgggattacaggtgtgagccaccgtgcctggcctgatgggtgaatat

SEQ ID NO: 16356 - DNA, 201 bp, Homo sapiens
tttttagccgggaaggtgctagaccacttaactctgatagaaataagctgctgagccctatcagggagggcgttctttcagctgttgtctggtggagaaawaaagacagggtgttggttcagttgcaggtattttgctggcgtattgagagattagagtttcctctttgagtgtgatggcagtagaaagagtgttgtttat

SEQ ID NO: 16357 - DNA, 201 bp, Homo sapiens
ctaaggttgaatagatgaagcttaaaaatatcacaaaaagtgaaagaagtcagtcacaaaagaccacatatcgtatgatccggtttatgtgaaatgtctaraataaacaaatccatagaggcagaaggtagatgagtggttgccaggggctgggggcggatggaatggggagtgactgctggtgggcacagggtttctttt

SEQ ID NO: 16358 - DNA, 201 bp, Homo sapiens
ttttagtacagacgaggttttgctatgttgctcaggttggactcaagcgatccactcacctcggcctcccggagggctgggatcacaggtgcgagccaccrcccccagcctacaagaatttgtaaactcatagattgctcttctgttttcactggaccacaacagaaagtagtttcttttatggtgagggatgaacaccta

SEQ ID NO: 16359 - DNA, 201 bp, Homo sapiens
tgattaggctttttgcacattgaggtgaataaaaaaaattagaactcctggaagggtaatttgtgagtctggccttgtgtcaagatcacctcatccctgtrgatggagactttgttccataagttccctatagataagatgtaatgaataattcattggcaccgatttatgtctgtagtgtgcttttaaaccctcctggag

SEQ ID NO: 16360 - DNA, 201 bp, Homo sapiens
ttgccagaatctcagaaagaatctctggactctggctcaggacctctgaggtgattatgcatctagaggcatccccaggtgctgcccaatttggggaagcrgcacttcccgctggaagctgggaagtttcccctggctgggggtcctgtgaggatggagaggccagaatgaggaatgggttgtgagtcaagaccaaccaga

SEQ ID NO: 16361 - DNA, 201 bp, Homo sapiens
attttcccatcaaatgttcttccaggaaaagagaaccttttctaatgattttaacaacagccaaaataatttttcgatggtacagaccttcccctggctgkcttttctggtatacagatactgctgctggtgcatacttttccaaacgcgatgcgctagccttcccaatcaaataagcctttttatttccaatgaagtaaa

SEQ ID NO: 16362 - DNA, 201 bp, Homo sapiens
ttggccttggatctgtcttcattaatatttctttctttctttttttttttaatcaaagtttttagcagttcagtgaatatgtcaaaacttgtgggactgtrtggggtgccccaaggaaacacaggctttagagatgaatgtggccagcgcagtaatcaatttatttaattgcttgagatgttatgctagaatgaaaacagc

SEQ ID NO: 16363 - DNA, 201 bp, Homo sapiens
gcaaacaaagttgaatcatgaagtgatgtcactctgaaccaattggagcagtggtgtcatgtgcctggcagctacttcaaatgcccacaaaacaggagtamtggtttaagctgtttccctcttcccctcccaccaccaatcagcagcagactgctagaggacagatgcaaaacagttattagaccaggcttagttagacat

SEQ ID NO: 16364 - DNA, 201 bp, Homo sapiens
gtgggcacagggtttctttttggggtgatgaaaattgttctaaaattagtttgtggcgatggctgcatagctctaaatatacttaaaaccattggattatrtactttaaatcggggactttaatggtatgtgaattatatctcaataaaccctttttttttttttttaaagaaatgtgatcaggttgaaaataacttgtta

SEQ ID NO: 16365 - DNA, 201 bp, Homo sapiens
gaatccgcaggatttctccttttgtgactgccttatttcacttagcataatgtcctcaagctccatccaggttgttgcatgtgagaggatttccttcctgkgcatgaactagagtgatgcagggactgacctctggccatgtgatgggtggttggtgatggatccaagaggtagctggtctctgaatactagcccagtcct

SEQ ID NO: 16366 - DNA, 201 bp, Homo sapiens
cctaggacctcaaggttgtgtctaagacataatttacagttctcgtgtaggtcttccaaatacttagctacacagctttggggcgttttctcagccaaatrcttttctttagcccttctcatattaacatttagttcttagggatttattttcaaaatatatatagcttgtatatgccattcacctaagttgttagagcag

SEQ ID NO: 16367 - DNA, 201 bp, Homo sapiens
caagtgattcttgggcctcagccacccaagtagctgggattacaggcgtgcaccaccacgcctggctaatttttgtatttttagtagagatggggtttcaractcttggcctcaagcgatctacctgccttgggctaccagagtgctgggactgcaggcatgaaccactgtgcctgacttttaaggctttctttaaaatgg

SEQ ID NO: 16368 - DNA, 201 bp, Homo sapiens
ccagatggcaaagtgaagcagattctttcctcctgtctgcattttgattgcagtatgaagttcaacttgcttcagtctttgtcttcatgttgtttcactargtactgaattttgtgatctgttggaaataacaagtaaatagatgcctaacgctttatacaggttgagcctgtctaatccaaaaatccaaaatccagaatg

SEQ ID NO: 16369 - DNA, 201 bp, Homo sapiens
gggggagggagaaggcccagggttgaccccccacaagcttgtctccctgtctcatgctgtctcctatcccatcatgctgctgattgggcaggatttacttscatggataatgggagactttagagcaaagtgtacgctgttccgattgggtagcagagcatgtctgttctctcatggactgctttcaagcacgttgtacat

SEQ ID NO: 16370 - DNA, 201 bp, Homo sapiens
cccttaaaatggtgatgtagaaggacatgtattgacctagtaaaatattaagtgaaggaagtgtgtttacaaatgtcatttttgtctgatttcacttaccktcatttatagagagtggataattggcatagatagtgttaacattgtttatcgtggaatgttgagatcgttgatgatttttactggtttttttttttttgg

SEQ ID NO: 16371 - DNA, 201 bp, Homo sapiens
aaaaagatggagtgagcctgcagccctgagttgatattgctttttaaattgagaacaatataattacagccttgtactggttataaaactttaaggtctcrtatcagagatacagcagtgcctttctcatctaaccctgtgtagaatacggctgttgagaatggcgtggctctctggctggatagggttataaaagtaaat

SEQ ID NO: 16372 - DNA, 201 bp, Homo sapiens
tgtcttggggtgctgagcctgttcccccctcatttgggggtgtggtgctatgctggcgtttgggtccatgccccgcatttctgatggctgccccatctgcyctgtgtggggtggcagagttctgtgtacacagagttacatttcgttgttcctggcttctctatggatgacagcagcactgataaatgccacacctgcttt

SEQ ID NO: 16373 - DNA, 201 bp, Homo sapiens
gtcttggtacattttctaggctggtctggaagtcctggcctcaagcagttcttccacctgaacctcccaaagtgctgggattataggcgtgagccactgcrcctggcttatttaaatttttatgggtatgaattcacttaaaagctgaaggttttgagaggagagggagcatatgaaaaaacctaaaggttttgggaggag

SEQ ID NO: 16374 - DNA, 201 bp, Homo sapiens
gctgttcctctctctttctgtttgaaagtgacttggcagggtgaagttgagaaccccttggaaaggaggaagccgaaatgcaaacaaagttgaatcatgargtgatgtcactctgaaccaattggagcagtggtgtcatgtgcctggcagctacttcaaatgcccacaaaacaggagtaatggtttaagctgtttccctct

SEQ ID NO: 16375 - DNA, 201 bp, Homo sapiens
ataacattttggatatattagattaagtaaaatgtgttcttaaatttcacctgcctgtttcctttttattcttttttttttttttttgaggcggagtttckctctcatcacccaggctggagtgcagcggcgcgatctcagctcactgcaacctccgtctcctgggttcaagcgattctcttgcctcagcctcccaagtag

SEQ ID NO: 16376 - DNA, 201 bp, Homo sapiens
gaggaagcatctgcaggctggactcggctgcctggtggtctccggagtggcctggtgcagagggccagggtggcatctcagaaagttgggtgggtagggtrcttgcacacctgctgaccttgagttacagggtggacctaggtcatttcacaggcccttccagccttcagatctcaagatactaggcagagagagagatgg

SEQ ID NO: 16377 - DNA, 201 bp, Homo sapiens
accaccatgttggccaggctggtctcaaactcctgacctcagatgatccgcccgcctcagcctcccaaagtgttaggattacaggtgtgagccaccatgcycgactctttttaattcttaatgtggctacttgaaaatttaaaattacagatgtggcttgcattctgtgttggtaagctgctttagagcatttcttttaac

SEQ ID NO: 16378 - DNA, 201 bp, Homo sapiens
ctgaaggttttgagaggagagggagcatatgaaaaaacctaaaggttttgggaggaggaggagaaggaagagagggagcatgtgaacaagagcaactgatkacttccttgtcattcatttgcccagtgtttactaagcacctgctgtgtctcagacctgtgctggtttggcccttgtgaaggacagtaaatacagtgcagt

SEQ ID NO: 16379 - DNA, 201 bp, Homo sapiens
aagagtcttactctgtcacccaggctggagtgcagtggtgcgatcttggctcattgcaacctccgggctcccaggttcaagtgattctactgcctcagcckcctgagtagctgggattacaggcccgcaccaccacacccagctaatttttgtatttttagtagagacggggtttcaccatgttaaccaggctggtctcga

SEQ ID NO: 16380 - DNA, 201 bp, Homo sapiens
ttgttggttcctgtaaacattagaattctgttttaaggtttctagggggagccacaaagcccatttcttcatatttgaccaaagcagcaattagagggtcrcaccctcatgcctcatctgccctttttggtgagaatgtcctttttgtgatgactttatgcactcccttttgcttttcggttgttccaagccccattcaaa

SEQ ID NO: 16381 - DNA, 201 bp, Homo sapiens
tagaaacacgcctcctttgggcatatggtgtgaatcagggactctggctataaaaggtggggtctctgagcaccatcctggttggaatgttcccctgactyggaggtagcgagagacagccaaggtgtttgttccagggaggctggtgggtgggagatgggatttttctgtctgtggcacaggcagtattaagtagagcag

SEQ ID NO: 16382 - DNA, 201 bp, Homo sapiens
gagatttgtttagatgtttgattccctcactgattatgattatactggaagtttttcatttgttttgacagctcaattttttttttattgtaaatggactscctcattacagaggggggagcccttgaaagaaagggattgacctctgcaggcaagaatctgagcatcctaaaagtagaaaagggctagaggcttcgcctt

SEQ ID NO: 16383 - DNA, 201 bp, Homo sapiens
gcgaatctgatcagttcactgctgggcctgaaagctttcgctgactccttttaatctgcagaatgagggtgaaactgcttagcttgggctgggtcccttgkgagctggccctgacttctctccagtatcatcattttctaggaaagccatttccccacaacccccaaggaaagcatatcataaacaagttttcccttgggg

SEQ ID NO: 16384 - DNA, 201 bp, Homo sapiens
agcagtcgaactttttaggatgggccctacccttagggactgcctacgaaactagatctagaagaggaggctgtggacattaggaggtggctgcaattggraagttccagagagcttactgagggataacggatgtaggacaggaggctggcaaagcacctcagtgatagggcagaaggaaataaagtggttagggaagga

SEQ ID NO: 16385 - DNA, 201 bp, Homo sapiens
aggctgggtaccggggacatggaccaaaccctggaacattctgtggaatgtgggaaattagtgtcaaatgtatgcattttcactaacagtcattaaactgygtacaaagattatttttcttcagtctatcattgaaactattgcaccagaatatactgtactttaaaaaatgagtatatgcctcagtctgcacatatttac

SEQ ID NO: 16386 - DNA, 201 bp, Homo sapiens
caaactcctgggctcaagtgatcgcctgcctcagacttcattttgatttgtgaacctcgtgattctattacttgttccacaaaaaattttaaatgaaaaartatttcaaaaatacatatattccggccaggcatagtagctcatgcctctaatcccatcactttgggaggccaaggcagacagatcacctgaggtcaggag

SEQ ID NO: 16387 - DNA, 201 bp, Homo sapiens
aatcttgattagacctgccagagctgtgcttattttgtgtccccatccaaatccagaattaattgccgtgctccacatgttttggtcaatggtggacctcrtctgtaacagtagtcccatgagattataatggggctgaaaacagtgctgtcccctagggatatcgtgtctgttgtagtgcaaggcactgctcacgtgttt

SEQ ID NO: 16388 - DNA, 201 bp, Homo sapiens
aacttctttttcccaaagctataatctgcatgtcaccattctccagagtacattgaaaatcccctacaggaaagtgctgataacattgtgcacagaaaccrctcctggctggtggcactggggacgcctgcttaaagtcggagccgttgggttgaatcgagagaaaaggattgagcgtattgacttcagggacctcccagg

SEQ ID NO: 16389 - DNA, 201 bp, Homo sapiens
gacagatcacctgaggtcaggagtttcagaccagcctggccaacatggtgaaaccccgtctctactgaaaatacaaaagttagctgggcgtggtggcacgwgcctgtaatcccagttactcgggagactgaggcaggagaattgcttgaacccgggaggtggaggttgcagtgaaccgagattgcatcattatgctccagc

SEQ ID NO: 16390 - DNA, 201 bp, Homo sapiens
actgacatttcatatggatcttatggaacaggttgattttattttcgtttttaccctacccatttggaggtgtagaattgagcctgtgtttggttttgttwtctttctttccaacctttttcctttctttctctttgttttgccttccttcctgcatagaaatatttatttattcattcattcatttttttgagacaggtt

SEQ ID NO: 16391 - DNA, 201 bp, Homo sapiens
ccaatttaaacaatttgtagtttttttctaataaccagtaagttcttcgtcttcgaataattcttttatactgttctatttccagctccactgagtgcccmtgtgttttcagagaaaacaggagtctgttttggacttcctctttggtatatatggtgggagatttgtttaaaaaatttttttatagaggtaaaattcata

SEQ ID NO: 16392 - DNA, 201 bp, Homo sapiens
caggcttggtatctactgtgcattcctcccaaatctctacccattggtcaaggtccctgagttcacagagcccaggccagagccctggaaacgcctctgcycgtccgctgcctaattgcctgtccacgctgggcaccaccgggtctctccctcagtctcagagctcagttgcttctgcacctcatcagggatccagccatc

SEQ ID NO: 16393 - DNA, 201 bp, Homo sapiens
tagatttaccttgagttttttgaaacggtagaattaatatattaaaacatatggtttttagttaaaataggatgttaaaggaatagagcgcacgaacaaaraactttccacttgaacccatgttgtttcatctgacagtgggtatggtgtccctggcaggatagggcttccacctcctgctggtgccggtaggacagggaa

SEQ ID NO: 16394 - DNA, 201 bp, Homo sapiens
acctcctgctggtgccggtaggacagggaagaggtggggaacactgtgtctccatctcccaagcatcttacctcccaagtcagatccctggcattgtttgmatacttgcgtgtttgtgtgtggggtgatgttttcctgagaatgtggcaaaataatagaaggtcccagggttcctcagtctgcagaccatagctgagtggt

SEQ ID NO: 16395 - DNA, 201 bp, Homo sapiens
ccccatctttactaaaaatacaaaaactagctgggcgtggtggtgcgtgcctataatttcagctacttgggaggctgaggcaggagaatcactttaaccaragagttggaggttgcagggagccgagatcgcaccactgcactccagcctgggtgacaaagcgagactccatctcaaaaaaaaaaaaaaatgcccacaact

SEQ ID NO: 16396 - DNA, 201 bp, Homo sapiens
ccatctttactaaaaatacaaaaactagctgggcgtggtggtgcgtgcctataatttcagctacttgggaggctgaggcaggagaatcactttaaccagaragttggaggttgcagggagccgagatcgcaccactgcactccagcctgggtgacaaagcgagactccatctcaaaaaaaaaaaaaaatgcccacaactgg

SEQ ID NO: 16397 - DNA, 201 bp, Homo sapiens
gacgcccgctccgccggctgtggtgtgcgcccttcctgctctcccctccgaggggctgaggctccttttgtctggcgcgcgcgccccaccccgccccgggygagggaagagggagcgggcaccccgcgcccgcgccgccgccgtggaccaaggttgtttactactttccactccgaataacacgccaatcaccagggccca

SEQ ID NO: 16398 - DNA, 201 bp, Homo sapiens
ctcaaatgatccacgtgcctcagcctcccaaagtgctgggattacaggcttgagccaccatgccctgtccgattatttttcagggaagagccagtgtgctycagccctatgagctctacccttctgctcccacagaagggaagcacaggcctgtggggtggagggggctctgccctaagcgcagcccctgtgggccacggg

SEQ ID NO: 16399 - DNA, 201 bp, Homo sapiens
ttggatcccctctgctaagcccctctgtgcctttgttcctgcattccctccacccccagtcccctccccacatcagtgtccacctgccaagccaggccagygccactccctccccgaagctttcctgccccactccagtagctatctcctctgctaacttctcgatgcgcttgactcacatcctcgtatgtgttctctctc

SEQ ID NO: 16400 - DNA, 201 bp, Homo sapiens
agcaggccgagaaggaggaggctgaataccgcaaagtctttgagaatttcctgcacaactccatcttcgtgcccaggtacccagctcatgtgaaatttcakttggcaaaacccactgctcaggccggttctgttgcctttctccccaccaggtagtgtgtaagtcagcagctggggggtacaatacagtagccactgagac

SEQ ID NO: 16401 - DNA, 201 bp, Homo sapiens
tctttgtctttactgacactcaggatcattgttaggtgggaggtcagatcaggcagctggagtccccagtgtggtgagtttagttggcaggccccagattyctcctgcattcatgggaaattgacatgtatgttttatttccccaggatcagcgagaatgtgtgtccagacaggaatacaggaagtatggaggggccaagc

SEQ ID NO: 16402 - DNA, 201 bp, Homo sapiens
atccatctgatcatcgctctgcccgtcgctgtcctgttgatcgtgggagggttggtgattatgctgtacgtcttccatagaaagaggtcagtgatgtgcaragttatgacactttctgtggctgagtggtttgatgatttgaatgtgagtgaaggtgatatttttgaagatttcaaggaaatattttatggactggaaaac

SEQ ID NO: 16403 - DNA, 201 bp, Homo sapiens
ttcccaaactgaaactccatgtccatcaaacaactccccattgcctttttccccaagtctttggcaaccgccattccactttctgtctgtaaatttgactrtctggatacctcatgtaagtggactcgtacactatttgtccttttgtgactggcccattttatgagcataatgtcctcaaggttcattcaggctgtagca

SEQ ID NO: 16404 - DNA, 201 bp, Homo sapiens
taatatatgtatgtgtgataacacatttatataatgtccattaccatgtggtatatatgcttatccatttgtctgtcgatggacacttgagttgctccccygctttggctactgtgaataatatgactgtgatcatggatatgcaaatatttccttaagtctttcagttcttttgggtatatacccagaagtggaattgct

SEQ ID NO: 16405 - DNA, 201 bp, Homo sapiens
ttgtccttttctcattgtccaaaagagtcttaagcgatctccaggaaatcccctgctcctgccaggaatctgcctgtgagtatttgagtgagttgctgctytttaagtaccagttgagaagctgaaggttggtgttgtggttgtgataaactcccaacatgaaaactgaggaccaccagcgttttcagctcacctttgact

SEQ ID NO: 16406 - DNA, 201 bp, Homo sapiens
tgcttatttagtctttggctttcccttgttgttagacactgcctgtcactcgggcattcatccatctttgaaggtgggtgccttcaaagacagaacaagarctgccctgtcctttagtaggcctcaggtggtagaaagagcacggaggtgaccagagtctggggtgtggggtcctcctgggtgcagttctggcactgaagt

SEQ ID NO: 16407 - DNA, 201 bp, Homo sapiens
ccagagtaaacattgcccctcaagatcaactcctggagtagcctctggtcttgcttatttagtctttggctttcccttgttgttagacactgcctgtcacycgggcattcatccatctttgaaggtgggtgccttcaaagacagaacaagagctgccctgtcctttagtaggcctcaggtggtagaaagagcacggaggtg

SEQ ID NO: 16408 - DNA, 201 bp, Homo sapiens
aaaagaagggccagagcggtgtcctgcagagggtggtgtaccttgggagggaagtgtgtagggttgttgaggaacagtgtgctgcacagggaggaaagacrtggggcagcattgtgggaagagcaaccaagattctcataggcttgggagcggaagccctgaggtctgttgctggactagatatgtgaggtgtgagaggag

SEQ ID NO: 16409 - DNA, 201 bp, Homo sapiens
tttgcaggtttccttgctagttccttggccagagtttccatcgtgtccctcagctgcacaattaaggtgcccccgttttgtgcaagtctcatgctaggcastatgagatgacacaaactaggattctgttgtgagataagataaaaacacttgacatttaaaagagagagacaacttatgcggtgtgacgagacactctac

SEQ ID NO: 16410 - DNA, 201 bp, Homo sapiens
atcgggttgccccctcctgagctctcacatgtccagagatgtctccagttagttgccttgatccagagtaaacattgcccctcaagatcaactcctggagyagcctctggtcttgcttatttagtctttggctttcccttgttgttagacactgcctgtcactcgggcattcatccatctttgaaggtgggtgccttcaaa

SEQ ID NO: 16411 - DNA, 201 bp, Homo sapiens
gaaaaactctgcatatgatctttggcctggagaaatattaaatctatgttaagtatgcagacatgaatgggcaaatgaaggatttgtggcaaagaagatcygccgaaacaaataagtcatgtaaatgggcagagggaaatattaaattgattgcatctttcagctcctggtacttaatgcaaagataaagtagtgggaaaa

SEQ ID NO: 16412 - DNA, 201 bp, Homo sapiens
aacgtgcagtcattggcaggtggcgtgtagaccagctgcccagggaacagagcccacgctctcctagtgacaccactcccagcttggtctctccatagaaygtgctgggagcagggagctgtctgcagggtccaccctccacctgctacttggtgcacatcgtgcattcctgctgtcctttgccccctcttgcgcacaaat

SEQ ID NO: 16413 - DNA, 201 bp, Homo sapiens
tggtatagatgagggaggcagtgaggacaggctcagggagggaagtcttgtctctagacctgagaccaggaagcaggaatggactggacaggttggcccasctgagggaggtgactggtgagatgggtcctcggtgtgaggggctgggttgccagaggagctgtgggctggggtggtttgtcgagagagcagtcccagttg

SEQ ID NO: 16414 - DNA, 201 bp, Homo sapiens
actggggaaaccgccggccggccctggtgcgctgtcaccccgaaggaatgcgggccaggccggggctgctgggcctggaaagttctccagtccctgttgcrgatctggcctgccgactcaaagtaaatctctcttcccctttatttcccatcaaataaaaaaggaacacgaggtagccactgtactcactgaagatgcatt

SEQ ID NO: 16415 - DNA, 201 bp, Homo sapiens
ttgtaaaataatttcaagtcagttattaaagtaacaaaaataatggcaaacttgataccttcccgtatttttttttcatatttttccttgaatgcttacaraaatattaaagaatattatcacatcattgtagtcaccgatgaattattttctggtggcttatgattagaagagcttgactcggagtggaaacagataaca

SEQ ID NO: 16416 - DNA, 201 bp, Homo sapiens
ctccacccccagtcccctccccacatcagtgtccacctgccaagccaggccagcgccactccctccccgaagctttcctgccccactccagtagctatctyctctgctaacttctcgatgcgcttgactcacatcctcgtatgtgttctctctcgttatgttgtgttgtgctgttgttggagtgtgtcccccctccacccc

SEQ ID NO: 16417 - DNA, 201 bp, Homo sapiens
gcacatggcattctaccgtggggtagacttttaaaattctggctacagagatacttttccataaaagtggccacatggaactctccaaatctaagaagcayactgtgggggccttcatattttgtctaattcttttctccccagaacaggaacctgcacccttccttcttttaaagggcgacgtggtaaataaacattttt

SEQ ID NO: 16418 - DNA, 201 bp, Homo sapiens
gttctttcagcatcgaactcctcttctcagttaatcgtgaagtggaaccctccctctctgcccaacggcaacctgagttactacattgtgcgctggcagcrgcagcctcaggacggctacctttaccggcacaattactgctccaaaggtaagggtgcagcagcggcctggacggagggtgtgaccgttcattcctgtggt

SEQ ID NO: 16419 - DNA, 201 bp, Homo sapiens
aaaaattcagaacacatggccttggtcctggctctgtggctggctgcctgtggtcctcagacagctgctgcaggttcctgggcctcagtgtcctcaatatraaataagagggtgggacaagattactgaagtccctttcagaactaaaattcacctttagattggtcagatttaaactttttctttctagctcatgtcagg

SEQ ID NO: 16420 - DNA, 201 bp, Homo sapiens
ggtgctgcccccttcacgctactgaaccccagggtcataattaaaagctgtgttagctcttctctggttagaggcatacaggttggaggcttgtacatagmcgtgagccggttggtctaggccaggaagcaaaccattggaaaatgtggttagcagtgacagttgacagcatgtttgcctgcagtagtggtggttggtgct

SEQ ID NO: 16421 - DNA, 201 bp, Homo sapiens
ggaggccacatttaaaaaggcactccttccttttaaaagctttgcaagggggctgcatatattttcctaattagtgggaatattttcttttttcttttttyttttttttttttgagacagagtttcactttattgtccaggctggagtggagtggcatgatctcggcttactgcaacctctgcctcccgggttcaagcaat

SEQ ID NO: 16422 - DNA, 201 bp, Homo sapiens
cgtgatctcagctcactgcaacctctgcctcccaggttcaagcagttctcctgcctcagcctcccaagtagctgggattacaggtgtctgccaccacactyggctaatttttatatttttagtagggacaaagtttcatcatgttattcaaattcctgacctcaagccatctgcctgccttggcctcccaaagtgctggga

SEQ ID NO: 16423 - DNA, 201 bp, Homo sapiens
tattagcagacactctcgtgttgacatgtccattttcctttccattaagctgtctccattgcagttctgttgatatggctttatatagttttcctgagctkttttttttttttttttttttttttggtaacaagatacctatgcaagctgaaaaactcttggctttttagtttgtatcacttccagaaacttttagatgct

SEQ ID NO: 16424 - DNA, 201 bp, Homo sapiens
tggaaatctcctgccccaggtttttccatgtggcttgaccagcacctgcagcccaggacaggtccagctagaatccctgctccccaccctgctcccgcccytacttggtgatgagtagcctattttactccaccaaagtgaaccacatggaaaggcacacaggtcagggagaatttgtgaattacggaatttgccctggga

SEQ ID NO: 16425 - DNA, 201 bp, Homo sapiens
ctcaaaaaaaaaaaaaaatgcccacaactgggcatggtggctcatgcctgtaatcccagcactttgggaggctgaggcgggcagatcacgaggtcaggagwtcgagaccatcctggctaacacggtgaaaccccgtctctactaaaaatacaaaaaaaaaaaaaaaaaaaaagccgggcgcggtgccgggcgcctgtagtc

SEQ ID NO: 16426 - DNA, 201 bp, Homo sapiens
gctttcttttagggttaggtaagatacttccttttttggaaatagttttgccatttggtctcgctgcctgatttgtgctttttcttcttcagcaggtagtrggaggctgtgtattgtattgccttttaccagacacccagaggggtcatgttggaaaatagcatcctcttagcaaaaacacaatcccttctctgagaataa

SEQ ID NO: 16427 - DNA, 201 bp, Homo sapiens
aggctgcagtgagccatgtctgtgccactgtactccaacttgggtgacagagcaagactatcccaaaacaaaaacaaaaacacatgcttatggtaggcaaktaaaacaggaggtaaggagtaaacatgccaggcccctcctcctctcctctgactcttccttcttcccccctgcttcccaagggtaagctttgcagatact

SEQ ID NO: 16428 - DNA, 201 bp, Homo sapiens
gcggaggttgcagtgagcggagatcacaccactgcactccaacctgggtgacagagtgagattccgtctcaaaaaacaacaacaacaacaacaacaacaamacctcacaaccctggtctcccagagcttccatattaataaatctagacaatgtgaaatgcaaatccacttaatatttgatgcaaaaaaaatttatttgac

SEQ ID NO: 16429 - DNA, 201 bp, Homo sapiens
aaatgatgaatttaataaaatttgaaaataaaccccacataactagtgctgctattgatcattcatatagccagcaggagtggtgagaggcttggtctgcytgaggtgtggagatgcttgtggcggggggcaaggtggacgagggctggggctgctcctggagcatctttacgcgggtggaggagctctgacacagtggca

SEQ ID NO: 16430 - DNA, 201 bp, Homo sapiens
catttggtctcctacagtgtctgtgggccaggaatccagatgcaggtgttcttgctctcagctcagagtcacaggaggcagaaatcaagatgtcagtgggrctgcagtctcacctgaggctcagggacatcttcaggctccttcagggttctgcacttgcaggactgaggtccccatattcttggcacctgtcagctgggg

SEQ ID NO: 16431 - DNA, 201 bp, Homo sapiens
acaacaacaaaacctcacaaccctggtctcccagagcttccatattaataaatctagacaatgtgaaatgcaaatccacttaatatttgatgcaaaaaaawtttatttgacctgttattttaactctttgacataaaatctctaaatcaaaataatcagcaacagttttaagtgtataaatatgtatttctttcagtgctt

SEQ ID NO: 16432 - DNA, 201 bp, Homo sapiens
acttctgagtcaagcaggcatttggaaatgtggactggtgccgagaaggaattcccagcagtgacttggtttaggtggtcctggaaagtagaaacacacaygagataattctggggatggagcttaaagggacgtcagcgttcaagggccaggtagaggatcatgagctgtaaagggacccaggtggttccagcacagcga

SEQ ID NO: 16433 - DNA, 201 bp, Homo sapiens
ctccaacttgggtgacagagcaagactatcccaaaacaaaaacaaaaacacatgcttatggtaggcaattaaaacaggaggtaaggagtaaacatgccagkcccctcctcctctcctctgactcttccttcttcccccctgcttcccaagggtaagctttgcagatacttgctatgcaagcaaaaatgctattcttagcca

SEQ ID NO: 16434 - DNA, 201 bp, Homo sapiens
tgggtgccatggctcacgcctgtaatcccagcactttgggaggccgaggcgggcggatcacctgtggtcgggagtttgagaccagcctggcgagcacggcraaaccccgtctctacgaaaaatacaatacaaaaattagccgcgtgtggtggtgtgcgcctgtagtcccagctactcgggaggctgaggtgggagaatcac

SEQ ID NO: 16435 - DNA, 201 bp, Homo sapiens
caaacacagctgtgggcgtcacataagctagcgtggctgtgttccaatacagctttatttttaatactggaatttgaattccacatcatccctgtgttgtyacaaaatattcttattttgaatttcttttagccatttacatgaaaaccattcttagctcatagaccttggaaaactaggcagcaggccagattttaccca

SEQ ID NO: 16436 - DNA, 201 bp, Homo sapiens
agacataggtgtaggcatagatttttaagctgagaaccttttgacagggaagaccagggatggttttagggtgtggggaatctgtgtaagttggccgttasctgtcaacaggcaacaatcactgtctctcaggtccctcccgctcccggccgtgtcctggttctacttgccggcagggatctaagttggaattcctttcca

SEQ ID NO: 16437 - DNA, 201 bp, Homo sapiens
ttctgttgctacaagacatgaaagaatggcctccgtttatcccggagaggagagtccctgagcccttgggagttgccttgaaacctctgccgggtcccagktgagaaagtgtgtgagttgtgtggttctgagatctgaacaggcaccatctggtgacactaggggctgaaggagctcggtggctgcaggtggactggagct

SEQ ID NO: 16438 - DNA, 201 bp, Homo sapiens
tttaagctgagaaccttttgacagggaagaccagggatggttttagggtgtggggaatctgtgtaagttggccgttagctgtcaacaggcaacaatcactstctctcaggtccctcccgctcccggccgtgtcctggttctacttgccggcagggatctaagttggaattcctttccaacatggaatcctgagtgtccacc

SEQ ID NO: 16439 - DNA, 201 bp, Homo sapiens
gaatcctggtttggttctgcgggaatcgagtgcttgagtgggacccagacagacaggaagggcgctcctgctcagttagccccagtaagctcactgaggcrcacaggccccatgtccacagccgctcctggctgaggcgtggttcctaagacgacccttactgttgagggctgccaggagggagagacacattcagccccg

SEQ ID NO: 16440 - DNA, 201 bp, Homo sapiens
taagctgagaaccttttgacagggaagaccagggatggttttagggtgtggggaatctgtgtaagttggccgttagctgtcaacaggcaacaatcactgtstctcaggtccctcccgctcccggccgtgtcctggttctacttgccggcagggatctaagttggaattcctttccaacatggaatcctgagtgtccaccat

SEQ ID NO: 16441 - DNA, 201 bp, Homo sapiens
ggaagaccagggatggttttagggtgtggggaatctgtgtaagttggccgttagctgtcaacaggcaacaatcactgtctctcaggtccctcccgctccckgccgtgtcctggttctacttgccggcagggatctaagttggaattcctttccaacatggaatcctgagtgtccaccatgtcaaaattgtgtcaaaattcg

SEQ ID NO: 16442 - DNA, 201 bp, Homo sapiens
caagtgagatcttcttgtcagtgcttaatccagcctcccgttgtttgtcagccctagctggaggcctcacaggagttcctgtgtccttccagtttgatacsaagtttagaccaagaaaagttcctttctgtggcacacctgtagtctcttacctgtctttggtggttgtacacgaacaggcagatatccacaactgcagaa

SEQ ID NO: 16443 - DNA, 201 bp, Homo sapiens
ggccgtgtcctggttctacttgccggcagggatctaagttggaattcctttccaacatggaatcctgagtgtccaccatgtcaaaattgtgtcaaaattcrtctgtatgcatttttcttggtagaagggtccccaaaagtcaccacattctcagagacttctgatccctaaaactttagatcaacagtcaataaaaaggtc

SEQ ID NO: 16444 - DNA, 201 bp, Homo sapiens
gactttgtttgaagagtcacccaggtttttgtaaagaagtgtttcagatcagtatgcaatggatgactgtaaatttctcttcagatctaagaatctgtgaytggatgaaagggagaaaggactgcataagtgcttgttgcttgtaaactgggccaggtggatgtcatggccctaggagcttcttgcctgcctttgcatgcc

SEQ ID NO: 16445 - DNA, 201 bp, Homo sapiens
tttctaaggtgtgctgggaccatttacatttagttctttggagaacacaactacttaggatttttgttgttgttgttgttttcctgtacattgtcttcctmtctcccttctggtacccattccaccctctctccccttcctcactgccgtttcataggggttctcagattcctgtgaataaagcaaaccgatgtgcagata

SEQ ID NO: 16446 - DNA, 201 bp, Homo sapiens
gcctggcacagggcagggcctctccagatggcagttcctgtctgtgtcttattcccaccctccgggcacatggggggaactcagtttctccccactgcgcrtcaccctgggagaggtgttttttgtgccaattgccattttaaatccaaatcagcagggatcatgtttgctgttcaaccatgtggcatatttatagtgatt

SEQ ID NO: 16447 - DNA, 201 bp, Homo sapiens; identical to SEQ ID NO: 1561

SEQ ID NO: 16448 - DNA, 201 bp, Homo sapiens
gacacagatgggaaggggtttccagggactcagccccactgttgatgcaggtttgcaaggaaagaaattcaaacaccacaacagcagtaagaagaaaagcrgtcaatggattcaagcattctaagctttgttgacattttctctgttcctaggacttcttcatgggtcttacagttctatgttagaccatgaaacatttgc

SEQ ID NO: 16449 - DNA, 201 bp, Homo sapiens
gtgtagacaagagctgctgtagacagtaagctctccccattctgttctgataccgtgtgagagaggataaatgaaactgttgtagcgaagatgaaagtatwtacaggaatgtatggaggtggggttttgttaacgtgaatttaatctttttgacagaaataacagcaggctggggaatggagtgctgtatgcctctgtgaa

SEQ ID NO: 16450 - DNA, 201 bp, Homo sapiens
gaggccgcaagcatgcgtgagaggattgagtttctcaacgaagcttctgtgatgaaggagttcaattgtcaccatgtggtaagagaaagttcctgaaaagycaaaatgcagcacagggagagggtatcacacaagcctcccagtatgttcttggctgcatgtacccgtgggtttggtgtcttgcctttgccttctggatag

SEQ ID NO: 16451 - DNA, 201 bp, Homo sapiens
cactttccaccagctcagtctctagggctttatctttctctgttcattgttacccgttgccagctttagctcagtgttgtgtgagccacacttcttcatcrttgaggtgttcctgttgtcagtgggctagctaagggcagaagggcattcgtgggattttaaagaatttatgggaccaacattctttccgccttcagcaga

SEQ ID NO: 16452 - DNA, 201 bp, Homo sapiens
atcaatttgtacaaaaatctttgattcaccgaaagtagctgaagcagcgaataaaacgttctcatacagtcaggagcactgtgggcttgggcacaaggtcwaggtcccaagagctcttggttggaaatctcctgccccaggtttttccatgtggcttgaccagcacctgcagcccaggacaggtccagctagaatccctgc

SEQ ID NO: 16453 - DNA, 201 bp, Homo sapiens
ggtctgtcctctgattgctaagattctatttctgtctaacatctacttttagtatcaatttgtacaaaaatctttgattcaccgaaagtagctgaagcagygaataaaacgttctcatacagtcaggagcactgtgggcttgggcacaaggtcaaggtcccaagagctcttggttggaaatctcctgccccaggtttttcc

SEQ ID NO: 16454 - DNA, 201 bp, Homo sapiens
agtttgtgggtagcccagtaactgggaacttggaatggagcagttgggccgggagggccagggtgggagccgtgccgtgagaactggctgcctgcaagccrctgacacagccaggaagggcacgtggggcaagaggagaagtgggtctgggagggagccacatcctcaggccatttcccagaccagcctgcagtcagcaaa

SEQ ID NO: 16455 - DNA, 201 bp, Homo sapiens
gcatgggtgacagcaggcagactgctcgggtggaatgggcatcagctgcagggaagccgggggaagaacagggcacaaatcagagttcagtgtgagacgcrgtgagtttgtgggtagcccagtaactgggaacttggaatggagcagttgggccgggagggccagggtgggagccgtgccgtgagaactggctgcctgcaa

SEQ ID NO: 16456 - DNA, 201 bp, Homo sapiens
ctgctacctcctgtatcgttgcctgtgggtgatggtaaggctcttgggggtgtggaagatgcggggatgatgatgatgacgatgatgacgatgacgacgaygacagcgtcgtcgtcgtcctggtcctggaaggataaagtcttgtggagaagaggaggcaattctgacagtttggggttgcatcatcttcttcacagaaga

SEQ ID NO: 16457 - DNA, 201 bp, Homo sapiens
gcttctgctaagaggtttccttccagggactccatgttcactgcctcacaaaggcaggccagcctcatgctttagacatccttgctcttaacaaatctttygtgttctgctacgtcagcctctgtgtgacacccattggaccttctctctgtagcacaattgcataccttgctctgttcttgataagataggtctaggagt

SEQ ID NO: 16458 - DNA, 201 bp, Homo sapiens
ctctcaaaagaatggaaatgatttcagattgtattcagcagcacgaagcaatgattcctaaatagttaaaaatctagaaagaaacactaagaattgtattkggctttgtagaagagaccccagaattttaggatttgggatgtatccctgcagtcaggcccagtccccagtgcacctgcagatctttgacagctgctggtt

SEQ ID NO: 16459 - DNA, 201 bp, Homo sapiens
gaagaaactaccattctcctcatttgatggatgaggaccctaagccctggagaggccaggaaacattcccagagtccctcaggaggaggactagtgctggkctcctttcctcctgttctgctgcctctgagaggagccaggattgaatcgtagccttgtcctctgacctggaggtctgggagtaactctcttatgactttt

SEQ ID NO: 16460 - DNA, 201 bp, Homo sapiens
gtcttggctttcctctggggggatcccgttgctgttgtgttacagaaatggtagttgtttactccaacagtctggatgaccgcatagaggaactatttcartagtgactgacatcattttttttttaacctcgtaaacctttcacagttcaggggccttggatcttattttgaagacaggtgcaaattggaaatagcattt

SEQ ID NO: 16461 - DNA, 201 bp, Homo sapiens
atgtaagtgcagtgtaatgtaaaatcaagccggcaactccagcaatttgctcttcaaactatagctctatcagttcccattcatttatacacttacactaytcaatttgtcgttgttgttgttgttgttgttgtttttgagacagagtttcactcttgtcacccaggctggagtgcaatggcatggtctcggctcactgca

SEQ ID NO: 16462 - DNA, 201 bp, Homo sapiens
gcaactccagcaatttgctcttcaaactatagctctatcagttcccattcatttatacacttacactactcaatttgtcgttgttgttgttgttgttgttktttttgagacagagtttcactcttgtcacccaggctggagtgcaatggcatggtctcggctcactgcaacctccacctcccgggttcaagtgattctcct

SEQ ID NO: 16463 - DNA, 201 bp, Homo sapiens
cagggccaagagtgaagtgagaatacggaggcacctctgtgtgctcaccctgctgaccgtcacccagcctccggggggggtcacagctggcccccaggaarctgcttcccagcagggcaggaattccatttgagtcttgtccctgttccaggagaagggctgggtatgtgtcccccaaaggggagagcattcgagaaggat

SEQ ID NO: 16464 - DNA, 201 bp, Homo sapiens
actgttggggaagctgcggtcactcatcagccttcctggtgagaaaccaggggtttcctgctaattctggaaaggatgtttcagcagtgcctgcatgagaygcctcagatagaaaactggttatttttgtttcttagcactgccaccatagataacagctgtcacgatggacagtgtggacctggattagtccttcttggg

SEQ ID NO: 16465 - DNA, 201 bp, Homo sapiens
acataatacagactcttcactgtttgtattatacatgtattttgtgagtctgtgtcagtatttgtttacacgggaattagggcatcaggctgtcttcctakggttcctctgtgcagacttgtagacagtatgggttctttgcgtgctgagttgaggtggccccaaacctttcagacagttgctcagatacctggcagttgc

SEQ ID NO: 16466 - DNA, 201 bp, Homo sapiens; identical to SEQ ID NO: 1546

SEQ ID NO: 16467 - DNA, 201 bp, Homo sapiens
ttgtattatacatgtattttgtgagtctgtgtcagtatttgtttacacgggaattagggcatcaggctgtcttcctagggttcctctgtgcagacttgtaracagtatgggttctttgcgtgctgagttgaggtggccccaaacctttcagacagttgctcagatacctggcagttgctcatttacccttccagaccttcc

SEQ ID NO: 16468 - DNA, 201 bp, Homo sapiens
tagtgcttctgttccctcatctgtaacatgggggtatattatagtcagtagcacctgcttcacaaactcgtgaggacttcagcagttcacacacataactscctcgctgcctggcacctagcgtgcacatggcattctaccgtggggtagacttttaaaattctggctacagagatacttttccataaaagtggccacatg

SEQ ID NO: 16469 - DNA, 201 bp, Homo sapiens
gcttttatttggtggtgtaataaattacgttgattagatttcccaatattgaatcatctttgcattcctggaataagccctaatttgttatggtgtgatawtctttggatatgttgctatttgatttgctaatatttttttaaaaattgtgactgtagcctacaaagccctacagataggggtctttagtttttttccttg

SEQ ID NO: 16470 - DNA, 201 bp, Homo sapiens; identical to SEQ ID NO: 1552

SEQ ID NO: 16471 - DNA, 201 bp, Homo sapiens
cccacggttttgctggttgacagtgatttgtcttgttccttgcttgtaattttattaggaccatggagccaaagtggctggtttgaatctcagctcttcastagctaagctctcaggcaaataatttaatcttcttgtgcctcagtttcctcatctgtgaaattataattttaatagaatctactttaaacattcatagaa

SEQ ID NO: 16472 - DNA, 201 bp, Homo sapiens
ctgtccttgaatttttcttttgcttaccttttgatattgtttatatgatttatgaatgcagctctgaggtatctgagaggatttattaacgtttacttgcrtccaagtacatgattaagttttaattgctttgtggacattaaaaaattatgcccttggtaaaatgcaaaggttttattttctgtatttagtaaatcaaac

SEQ ID NO: 16473 - DNA, 201 bp, Homo sapiens
agggtctcagactttccttgtccttggtgactttgacagtttcgagggacactggccaggttttgtgcacactgccccttaatttggagttgtctcatggktttttttgtttttttttttttttgagacagagtctcactcgtctcccaagctggagtgcaatggtgcaacctcgactcactgcaacttctgcctcccagg

SEQ ID NO: 16474 - DNA, 201 bp, Homo sapiens
tgagaccagcctggcgagcacggcaaaaccccgtctctacgaaaaatacaatacaaaaattagccgcgtgtggtggtgtgcgcctgtagtcccagctactygggaggctgaggtgggagaatcacttgaacctgggaggcagaggttgcagcgagacaagatggcgccattgcactccagcctgagtgacagagcaagact

SEQ ID NO: 16475 - DNA, 201 bp, Homo sapiens
accccattagctaacttccagcaaggctgtgttaggaatgtggaatcaattagatgaattttgaaaataacttggtctgttctaaaaggccctatgagatycaaactgttgtggcctggtgcctggtaactttgatggccattttgaaatgttaccgtagtgataattcttctggaatctcaagtcattaaaagtgatatg

SEQ ID NO: 16476 - DNA, 201 bp, Homo sapiens
tgtttttttttttttaattcctgaaagtttttatactccaattgtgtctccacatatgctcttagactcctcttcccgtctagttctcctttcttggttcrattagttctgtttcagctggtgccacctgttgcagctgagcttggtcaccctccctcaggctcctgcgtcgtcctcagtgggtcatggtttttctttgct

SEQ ID NO: 16477 - DNA, 201 bp, Homo sapiens
gaaatgccctcccttcagtgatttgtcagcatgacctatcaccattgttgttaaccttcaccacctggatgaggcagtgtatgcgtggggacatacatctrtttgccccactgacatgagggttggatctctagaagaggagtcactgttcagaggttataggcatttgtattttttggcagatgttgtccttcaaaatgg

SEQ ID NO: 16478 - DNA, 201 bp, Homo sapiens
ttacacatgtggacgtatttgaggaggtaagagggacctgcacaaggctttagtgagtaagcagagaagttatttatatatagtgagacccagtaaacggygatgtcgcaggtgaggcagttgatctggtcagaatatgcctccagagacatcactggtgaggcctgcatgcatgttgaaaagagtgtatcttacatctag

SEQ ID NO: 16479 - DNA, 201 bp, Homo sapiens
tgatattacgatgtttgttatcacagaatatgtttgcttttgataggggttgggtgctgaagggtaagtggttagaatcattctttttctaagggtacagycattaatactccttgattcaaatcactatttaagttataaatacatggatttattttctaacctcaaaattatagcatcttaccacatatttgcatgcct

SEQ ID NO: 16480 - DNA, 201 bp, Homo sapiens
ggtaatttttttgtgtgtgaatctgttaagttaaaaatatttctttctttggccgggcacagagtggctcatgcctgtaatcccagcactttgggagtccsaggcgggcagatcacttgagctcaggagttcaagatcagcctgggcaacatggtgaaaccccatctctaccaaaaatacaaaaaaattagctgggcatgg

SEQ ID NO: 16481 - DNA, 201 bp, Homo sapiens
tgctgtgggtttagacatcatgccgtgacaaaaagaagaggatcttagaagcgggggacattcactgaagctttatgagcctttcctgaatcccttcaaaycagatcaagttctctctctcctgtgcttagaaatgctgcctgttaagtcacgttggctacagcacccatctcagatcccttgtgattcagttgtaaagta

SEQ ID NO: 16482 - DNA, 201 bp, Homo sapiens
aatttttttgtgtgtgaatctgttaagttaaaaatatttctttctttggccgggcacagagtggctcatgcctgtaatcccagcactttgggagtccgagscgggcagatcacttgagctcaggagttcaagatcagcctgggcaacatggtgaaaccccatctctaccaaaaatacaaaaaaattagctgggcatggtgg

SEQ ID NO: 16483 - DNA, 201 bp, Homo sapiens
tctctctctcctgtgcttagaaatgctgcctgttaagtcacgttggctacagcacccatctcagatcccttgtgattcagttgtaaagtagattcttctgstctgaattagaggccaaaacacaagacagatcaaaaatggggaacatattgcaaatttccccacaaaagactgaaggatgtgtttaccattgattgcaca

SEQ ID NO: 16484 - DNA, 201 bp, Homo sapiens
taataccataggtctctacttcagtaagagttacataatacgaatgccgtttgttcagaattgtgtatctccatccatccgtccatcgtccaaattctgcragtttgaaatacattgttgttgctgttttgtatacttttgttcaaccattttctttttaacatggcactagctttctcaaactggctttggaattatttg

SEQ ID NO: 16485 - DNA, 201 bp, Homo sapiens
cacaaaaggacaaatactctatgtgatttcatttagatgaggttccctggagtagtcgcattcagagacagaaaacagaatgatggctgcggtggtggggkggtggggggtggtttggggaagggagtggagtgatggtttcacttttgcaagatggaaaaagttctggaggtggctggcggtgatgttgtacaacagtgt

SEQ ID NO: 16486 - DNA, 201 bp, Homo sapiens
tccttatagttcaaaggtctttttctcaacttagttgatgatcatgctgtaagttgttttcttttgctttatcaacttttaaaaacgtttattaacttttwaatttgaaataatttcagacttgcataaaggttacaaagagtaccaggagttctggaacaccctccacccagcttccacagatgttaacatcttacataa

SEQ ID NO: 16487 - DNA, 201 bp, Homo sapiens
tgtgtggtttctggtttcacagaaggctttgtttcttggttcttgttgctgctttcagccttggcctgtaatcactgggcgccagggagggctgcggtctktttcccggggtgtgctcagataccgtgtcagttcacatgtgttgctgcagcggcagggggccaggcaggaggggcgggtgtcctgaagcacgctcaattt

SEQ ID NO: 16488 - DNA, 201 bp, Homo sapiens
ccaaatcagcagggatcatgtttgctgttcaaccatgtggcatatttatagtgattttttttgtaatcatggtttttctttctggaatttcaagtttttcrtttgtgctgaggaaggtcgtttgtgttttttaataggattccttcttttccaccttgtgcaagtaaaggcaaatcccctatttgcatgtcactgtattaa

SEQ ID NO: 16489 - DNA, 201 bp, Homo sapiens
acgtaaatgagacatcaccaatttaagtcagccaaagtttagtcaatagaactttaaagaacagaagtctaatggtaattagggagagatgaatttatttrtaggagttttccccaaattcaaagcgtcttagtgacctttgataacttcctggaaaaagtaggaagcatggagagaaattccaggtaggagcccatgatc

SEQ ID NO: 16490 - DNA, 201 bp, Homo sapiens
ataacaaacattcgcatttattgaaaacttaaagtataataaaaaaataaataaaataaaaaaagaaaaaagaaaacttattcctgtgtcaggcacttttytaagtgctttgcagtgtattgtctcatttaatagttgtttaaattaacagagtaggccgggtgtggtggctcacatctgtaatcccagtactttgggagg

SEQ ID NO: 16491 - DNA, 201 bp, Homo sapiens
tttttaattcggaaatctttgtttggctgtctgagagagaacttcagcctcccttcctcccagacattttgaacagttcaggctgtactcattcgtgtctytttgtcttggcaggtggaagcccctctgcttggaatagcaaacaatactaccagcttgccctctggcaagctcctttaagagttagctgtaatttcaccc

SEQ ID NO: 16492 - DNA, 201 bp, Homo sapiens
cccaccctcaggtcggggacaggctcgtgacgatgctcagggtagtggtggagccccagaagcctccagtttccattttggacccacggagatctccaggktgcctatcactcttggcccaggcctgggctttccaggaacttccccgattgatgttttactgaacgtggtgccgaaagttagtcacaggaagacattatc

SEQ ID NO: 16493 - DNA, 201 bp, Homo sapiens
gctatatgcacatagagtttttgattggtctattgcaaatactatggcatctgaaattttttttttttttttttttttttttttgagatggagtctccctytgttgcccaggctagagtgcaatggcgcagtctcagctcactgcagcctctgcctcccgggttcaagcgattctcctgcctcagcctcccaagtagctgg

SEQ ID NO: 16494 - DNA, 201 bp, Homo sapiens
atgtatctagacattgacagatgttaacctgggattagggggtggggagaccaaaattgtaccctgttgagaaccactggaccagagtcatagcaatttgyagtggatagatttaggaatatttgaagacttgtaaaatatagcctgaagggaatggagactgggagagtgaaagatacctctgagacattttggcttgga

SEQ ID NO: 16495 - DNA, 201 bp, Homo sapiens
aatcattttgactttcacagagtgatagtgtctagagagggtttttgttgtactaagttattggttccaaagaattcattttaagaggagtaaagaactaytatagtatgccgcttactgagacaaaaccgacttctcacataagcccaaaggttttgttatgttggattttaccattagagttaaagatgatgattggtt

SEQ ID NO: 16496 - DNA, 201 bp, Homo sapiens
ccttcctcccagacattttgaacagttcaggctgtactcattcgtgtctctttgtcttggcaggtggaagcccctctgcttggaatagcaaacaatactaycagcttgccctctggcaagctcctttaagagttagctgtaatttcaccctctctctggccttgattctgcatgcagaatgattgcactgacttgagctcc

SEQ ID NO: 16497 - DNA, 201 bp, Homo sapiens
aaattttttttttttttttttttttttttttgagatggagtctccctctgttgcccaggctagagtgcaatggcgcagtctcagctcactgcagcctctgsctcccgggttcaagcgattctcctgcctcagcctcccaagtagctgggattgcaggcacccgcaaccacacccgggtaatttttgtatttgtagtggaga

SEQ ID NO: 16498 - DNA, 201 bp, Homo sapiens
gccttctggatagttaccccattacctcactgctaccttcagacccctgtgctcagaccaggccgcagcaccacagagacagttccagacaacacaggcaycagcaagggccaccctgaccctctgagtctttctctttttgattcctcccaggtgcgattgctgggtgtggtgtcccaaggccagccaacactggtcatc

SEQ ID NO: 16499 - DNA, 201 bp, Homo sapiens
ctgtgctgtggctgggagacctgtttggtcttggaagctgggtcctggatgagcagaatgaggcaggcatagaggtgatgttggctacgggcaggggagcrtttgctttgccttggagtagtgccatttccatgtagaggggcaagatttaccaccctgttgtggggatttgagactttgggttttgttttcctttacacc

SEQ ID NO: 16500 - DNA, 201 bp, Homo sapiens
cgctggatgtctcctgagtccctcaaggatggagtcttcaccacttactcggacgtctggtatgagaacctttactgcattgccagcctggagcccccagyctctgcactttccaccagctcagtctctagggctttatctttctctgttcattgttacccgttgccagctttagctcagtgttgtgtgagccacacttct

SEQ ID NO: 16501 - DNA, 201 bp, Homo sapiens
cgggaaaccactgcaggcggcccatgaagcctcctggccatgtgcgccctcccggtttggaccccctcccgtgtgtcttggctgcaggtttgaactgatgygcatgtgctggcagtataaccccaagatgaggccttccttcctggagatcatcagcagcatcaaagaggagatggagcctggcttccgggaggtctcctt

SEQ ID NO: 16502 - DNA, 201 bp, Homo sapiens; identical to SEQ ID NO: 1564

SEQ ID NO: 16503 - DNA, 201 bp, Homo sapiens; identical to SEQ ID NO: 1566

SEQ ID NO: 16504 - DNA, 201 bp, Homo sapiens
atttagagtgtcccaaagcaggctgggcgggaagtttgtttttctctatcatgggcccttggttacgttgctgtcttgttccaccaaccagcaggaggttygggttgtgagtcaaggttttggaaagattttgctgaaaggccccttgctttcagttgtagttacgaggcaagacctgtttttttctcatcagatgtggag

SEQ ID NO: 16505 - DNA, 201 bp, Homo sapiens
tgttcccctctccagttccttccattcccttggacgttctttcagcatcgaactcctcttctcagttaatcgtgaagtggaaccctccctctctgcccaayggcaacctgagttactacattgtgcgctggcagcggcagcctcaggacggctacctttaccggcacaattactgctccaaaggtaagggtgcagcagcgg

SEQ ID NO: 16506 - DNA, 201 bp, Homo sapiens
ttatatctcaataaaccctttttttttttttttaaagaaatgtgatcaggttgaaaataacttgttatgctaccttaaattacgttaaaattattacatayatttgacaggctgatgtctctctctcttttcatttatgagtttttcagatccgtgagttgcagcaatacaacaaactgataattgaagcttagcaacagg

SEQ ID NO: 16507 - DNA, 201 bp, Homo sapiens
ggttttgtaggatttggagacagagacaaatttggagtgtttggatgttcggggacctgcaggaggtatgtgaggtgtgtaaaatgcagcccctgttttawaaagagcttacattgtctcttgagaagataaggtgtgcccagctgtggaatggaaccagatgcttttatgagtgaggatggagtgagcacactgggaaag

SEQ ID NO: 16508 - DNA, 201 bp, Homo sapiens
gccaggcgcagtggctcgtgtctccaatgtcagcactttgggaggccagggcgggcagatcgcttgaggtcgggagttcgagactagcctggccaacgtgrcgaaaccccgtctctgctaaaaatacaaaaattagatggttgtggtggtgcatgcctgtaatcccagctactcagagaagtgtttgaacccgggagttgg

SEQ ID NO: 16509 - DNA, 201 bp, Homo sapiens
cttatggtttccactggctcggctccgtgcgtgtgcggattgggcttcctgagagcctggttagccccttttatctgctctctgaaacctgcgcaagggtktttagcatgcaccttgaaacctctgctgcctgaagacagtgtgcttaaatgaagggtatacaaacccatgtgaggttttctcttcccttttccatgaact

SEQ ID NO: 16510 - DNA, 201 bp, Homo sapiens
cacacctgtagtcccagatacttgggaggctgagatggaggtcaaggcttcagtgagccatgatggcaccactgcactccagcctggacaacagagtaagmccttgtctccaaaaaaaaaaaaaaaaaaaaaaaagccaaatctgttgggtttttttttttgggggggggggtcctttagaatggccctgacagatcttta

SEQ ID NO: 16511 - DNA, 201 bp, Homo sapiens
aaagaaaagaaaattggagaatttataacgtctgatgtgacctgttctttaggtgttgaaattagaacggcctcactcacctgggacattcttcagctcaygccctgtacctggcttacagttgctcagtgaaatgctttcttgattgtagcatggtgggatttttataaatccaaatgacttagaggtaggtgtcacatt

SEQ ID NO: 16512 - DNA, 201 bp, Homo sapiens
ttggacttacttgctttccatttatatgttgtctaattccaaagagatttcgagacagctttcaattaaaaaaaacaaacaacaacaacaacaaaaaaaamcaccacataccgcatgggtattacacaggacctgtatggtcaaattggcaacgaccacaccacatgagaaggaagattattcttcctggaacctggctcc

SEQ ID NO: 16513 - DNA, 201 bp, Homo sapiens
ctgtgcacagggagcaaaccccaagccgactgcttgtctgtgccaccctcaaacaatgatttccccaaattggacagcctgggtttgtatccttgagcacrgttttgggaagagcattctgcatgaggcattgtagctatgtatatggagtataattctgttttcaggttgctctgccacagaggttaagaactccctctt

SEQ ID NO: 16514 - DNA, 201 bp, Homo sapiens
gccaaaaggctgggcccttgtctcccaccccactgctgttactcatgtgttctcccacttgctcggcattctttcccatgctttttccttgatcatcactyactagctaacatctattttttcctaaacactctgttgcagttgtagtctgcagtcactctcctaagacttgatcatctattacgctgtttcgttctttat

SEQ ID NO: 16515 - DNA, 201 bp, Homo sapiens
tggtttggtccagccttagagcgggtttgcaggtagacaccttcctaatgtttgttccacgtaagcccccggagcacagtatttccatcagctattttgtrgaagtgagcgattctcttttggttgtaaaccttcactatttcatgtgggtgacttgacaatggctccatttttgaatggcccattgatagttgtagtcta

SEQ ID NO: 16516 - DNA, 201 bp, Homo sapiens
cacatgggagcatctttttattttattttacttttttttaaaaaaatgaggtctttattatcctggctggagtgcagtggtgtgatcatggctcactgtarccttgaactcctgggctcaagtgatcctcttgcctcaacctcccaagtagttgggctgatagacatgagctactgtgccacgtagcattcttggggatta

SEQ ID NO: 16517 - DNA, 201 bp, Homo sapiens
ttgaacacttgattgaggtggtgcctgccaggtttctccagtgtaaattttctgcttttcgcattgttactgatatcttagggctgatactcacagtatgyagatgtctcgtttctcttttttcatatttcttttcttttttctttttttgagacagtcttgctctgttgcccaggcaggggagtgcagcctcagacttct

SEQ ID NO: 16518 - DNA, 201 bp, Homo sapiens; identical to SEQ ID NO: 1565

SEQ ID NO: 16519 - DNA, 201 bp, Homo sapiens
gctctgcagtgaacaattgaacctcatttctttaataataatacaggattcctgaaaaccaactgtattattgtttggaaaatagtttaaaaattatttcyttctaactgagacgtttaccctcttgtctcccttcagtctgcgggccaggcatcgacatccgcaacgactatcagcagctgaagcgcctggagaactgca

SEQ ID NO: 16520 - DNA, 201 bp, Homo sapiens; identical to SEQ ID NO: 1568

SEQ ID NO: 16521 - DNA, 201 bp, Homo sapiens
tggccattgaaagaaaaaataaatagcaaaatccccatcccagaagttctacttcctgttgttgtactattgagctctgaaaaacagctttgtaagtttargctcttgtttggactatttcagtggaattcttgagatctttttgtttggacaggcaagtatgaaggcgataagtcgaaagaactacagcttactcagcac

SEQ ID NO: 16522 - DNA, 201 bp, Homo sapiens
aattctaaagcttaagtaaattcagtaataataaactgtcaattatccaagcgatgaatataaatccataaggtttttcaaatccccagaaatccctttcrtctcccacctggttttgctgagcgcctgtctcttctgtctcttttctgattcccacctttcacttttcctccatttttcgcttaatggatttatacttta

SEQ ID NO: 16523 - DNA, 201 bp, Homo sapiens
ataagaagctgctcaagacatttacctatcctgaatgtttcaggccctcaaggtgccaggtagctgcaatatagttctagtgtagaaaagaaaaccctgaygaggtctatatattccaggactctgtctgaggccctttgacactccgggggcaccctgccgtgaccctgactctttcctgcatgtactgaggatggaggt

SEQ ID NO: 16524 - DNA, 201 bp, Homo sapiens
atcaggcctttctctgaaattcccatcaataactacaagatctgcccagtaccttgtgcatatcaggtctcaggaaattgtgagtttcttgtttcattaarcatttttctttccaggaatcatcattcatcgcattgccatatgtgtccagatcccccttttcagggagccagtaattcgaaagcacttgcctgtgttgaa

SEQ ID NO: 16525 - DNA, 201 bp, Homo sapiens
ggtgtggctttcatagctttggttctctggtcttcactttatctgccaagtgaagacatttgactggatgtcgtgatcttgagttgctttcagctccagawttcgaagaccccttccattgggcattcatctaatttcaaagatgctccctggctccagctctgcagtgaagcagaacaaactgatacagcctagcttggg

SEQ ID NO: 16526 - DNA, 201 bp, Homo sapiens
ttgaattgcactgaaaacgaaatttcataggtacacgatacagtagttagttttaaaagtttttaaaatattaaaaaattgaaagtatttaaaatattttwaaaatattttaaaatctgctgtgtgagatagataggagacctagcttttcttccttcttaccttgatccatagagaaagcaaccctgaaagaagaaaaac

SEQ ID NO: 16527 - DNA, 201 bp, Homo sapiens
gcagacctgaaaggaagcggagagatgtcatgcaagtggccaacaccaccatgtccagccgaagcaggaacaccacggccgcagacacctacaacatcacygacccggaagagctggagacagagtaccctttctttgagagcagagtggataacaaggagagaactgtcatttctaaccttcggcctttcacattgtacc

SEQ ID NO: 16528 - DNA, 201 bp, Homo sapiens
tacgtggtgccaggcaggtatccgggtacctttttacgtagggtattcagagaaggtctctagagaggtgacatttggacgaagacctaaaggaaagggargggaaaggcgaggagcttggagagcttggtgcatcttggtgggggatggggtaaactgagtcagttatgtagggccctggaggccacggtgaggacttcg

SEQ ID NO: 16529 - DNA, 201 bp, Homo sapiens
agaccccatagtcctgtggtttaccttctaatgagcatacttttgtcgatcaaacagggtgacctctctggtgtctctgcacactacctgtatggtctttscgtagctgatggggtctcctgactagtgattggtgattttaatctggattttgccacagcacttattttctaacatatgacttaatttacttaataattg

SEQ ID NO: 16530 - DNA, 201 bp, Homo sapiens
gcaagaactcagtgggtgagcacttccatttcttcaacaaatgcttctgagtccctgacctgtgccaggtgctcttcttgagctgagaatcctgcagggaraaaagagataaagaccccatagtcctgtggtttaccttctaatgagcatacttttgtcgatcaaacagggtgacctctctggtgtctctgcacactacct

SEQ ID NO: 16531 - DNA, 201 bp, Homo sapiens
cttgctttccatttatatgttgtctaattccaaagagatttcgagacagctttcaattaaaaaaaacaaacaacaacaacaacaaaaaaaaacaccacatrccgcatgggtattacacaggacctgtatggtcaaattggcaacgaccacaccacatgagaaggaagattattcttcctggaacctggctcccttgagatt

SEQ ID NO: 16532 - DNA, 201 bp, Homo sapiens
gtgccttttgatttgatacctatttatttgtttggaaagaagcttttaaaatcaaaaccatgaatctgtggttatcttcaaaggataaattatgataggtrgttgttacccaggttaccattttaagatgattatggctggcccaaattaggggatcttttcatatatgtattatatattttaacttcagtcttttaaaaa

SEQ ID NO: 16533 - DNA, 201 bp, Homo sapiens
taaagtgtgccttttgatttgatacctatttatttgtttggaaagaagcttttaaaatcaaaaccatgaatctgtggttatcttcaaaggataaattatgrtaggtagttgttacccaggttaccattttaagatgattatggctggcccaaattaggggatcttttcatatatgtattatatattttaacttcagtcttt

SEQ ID NO: 16534 - DNA, 201 bp, Homo sapiens
gggattacaggcatgagccaccatgctggccttctggttctttttaaatcaattttagtaatttagtaatttccagcaagtcaattaaaaattatagctcrgttgtatgtagtattttctgtgtggtgttatgccctctgtatctgttttctcagatgttttagttgcttttctctcttaatcttgattagacctgccaga

SEQ ID NO: 16535 - DNA, 201 bp, Homo sapiens
ttcaagatttctctttaggtaaatagatttgtatttttgatggccatcctagtccagtgtaaagatatggacaagaaaccccacataaaggaagcaagatygctggctgctttctctaggtagcttgagttgtatactaatttgtagattatttctcttcatcgaaaaaacaaaacattctgcagagggcagtcatgtgtc

SEQ ID NO: 16536 - DNA, 201 bp, Homo sapiens
ccaaatacataaccattattatatgacttagcatttataaggcatttctatgcatcctgagagactagagcactctcaaatgaggtttcagagtaagattmatctttgcaaatgaagacaaattagcaaaatcttcctatttttaaagtgtgccttttgatttgatacctatttatttgtttggaaagaagcttttaaaat

SEQ ID NO: 16537 - DNA, 201 bp, Homo sapiens
tttatggaaaagcatctctttagccagaattttaaaataaagaggataacttcctggtgagaacagacgtggaaaggaaggcactttggtttcacgctcaygtaagagagggctgttggcggtcactcctcagaactatggccagccctggatggtagccagctgctttttgccccaaaagtctgtttagctgggtctctg

SEQ ID NO: 16538 - DNA, 201 bp, Homo sapiens
agctcctaggctcaagtaatcctccacctcagcctcctgagtagctgggactactggtatgcgccaccatgcctggctaagttttttctttttcttttagrggcaggatcttgctgtgttgcccaggctggtctcaaactcatgacctcaagtgatcctcccaccttcacctcccaaagtgctggcattgcaggcgtgagc

SEQ ID NO: 16539 - DNA, 201 bp, Homo sapiens
gcagtactgccagactcagggacccagttcatcgagaggggcagtgtttctcttatgctgccttaaaggcattggatgccttttggaaagccagtggacarctcctgcatccacccaagattaatgttaacagcttaaagaatcattgcaatcaagggaaattttgcaacactttgttgggatatttttaaataaatgtgt

SEQ ID NO: 16540 - DNA, 201 bp, Homo sapiens
aagtgtgtagggttgttgaggaacagtgtgctgcacagggaggaaagacgtggggcagcattgtgggaagagcaaccaagattctcataggcttgggagcrgaagccctgaggtctgttgctggactagatatgtgaggtgtgagaggagagaagaatcaggaatgactctttgattcttaacgtgagcaactcagagaat

SEQ ID NO: 16541 - DNA, 201 bp, Homo sapiens
agacgtacccaagactgtgaagaaaaagaggttttaattggacttacaattccacatggctggggaggcctcagaatcatggcaggaggcaaaaggtactkcttacatggtggcagcaagagaaaatgtggaagaagcaaaagtggaaaccctgataaacccatcagatctcgtcagacttattcactatcatgagaatag

SEQ ID NO: 16542 - DNA, 201 bp, Homo sapiens
ttcttaccttgatccatagagaaagcaaccctgaaagaagaaaaactcacccatttgagctttcttttgtttccactgagcaatacggaagaaattcaccrctggttataggtcttcagtgctttcttcagagtgggattgttttttgtttcaccataagtagtagtctattaaattaacagttgctagagaagaagctgc

SEQ ID NO: 16543 - DNA, 201 bp, Homo sapiens
ttctggcattgggaaagaaagaaaaatggcactagcagccttttttttttttttttttttttttccccaaaaaatttgctactcttgaggttctgtcaaaraatgtgctgtggcctctagaagcatttttaaaaagagactttcacaagtgattgtgcaaaattgtgaggtcactgaataggtgtgtatcctcctaaggag

SEQ ID NO: 16544 - DNA, 201 bp, Homo sapiens; identical to SEQ ID NO: 1567

SEQ ID NO: 16545 - DNA, 201 bp, Homo sapiens
ctgcctgcccgcccaacacctacaggtttgagggctggcgctgtgtggaccgtgacttctgcgccaacatcctcagcgccgagagcagcgactccgagggrtttgtgatccacgacggcgagtgcatgcaggagtgcccctcgggcttcatccgcaacggcagccagaggtcagtcgcggccacacgtgtggtcactaccc

SEQ ID NO: 16546 - DNA, 201 bp, Homo sapiens
ctgggacagatctgcttcttgatactgcagggctccagccttccttccagccagctcatttctcagggaagccttgttttcctttttcagaaaatttaaaygtatatttaacgcacaatttaactccctttcctgttgataatttttttcttcttcatattttgttattaataatagcttacagaatgggatcagtatcag

SEQ ID NO: 16547 - DNA, 201 bp, Homo sapiens
ctgggggtgtgtgggggtggttggttggggtttgcttgttagtttgttgtaaaagcccagcttttcattcttggaaagatttcagccaactcgagagggtkacctgccaggaatgctgcagaagcaagaactcagtgggtgagcacttccatttcttcaacaaatgcttctgagtccctgacctgtgccaggtgctcttct

SEQ ID NO: 16548 - DNA, 201 bp, Homo sapiens
tagtaatctttgcgagaacattccaaagatgatagttttacatttgtatgtttttttccgaggcacttttgaatcatcagatagattaaatataagttccrtgtatttttgaaggtgggagtgttctttggtacagttcccccaaaaaactggttctcatgaggcttatgtggtaattctgttaacgagaatgtatgatta

SEQ ID NO: 16549 - DNA, 201 bp, Homo sapiens
tacaggcatgagccaccacacctggcctgggttgctttttaaattcatacctactgtcttatttgggtctcaaatgtgatcagtggttatacttttcttgstatgcatttaagttggagcaggctccggggcaccacttccctccctagagttgatgaacccctcatatcagtgacctccccatgtcacagtgtatctcgt

SEQ ID NO: 16550 - DNA, 201 bp, Homo sapiens
atgcattgtttgtatgaataatagcttctaaaaagaaaatcagtaaggaagggagtcatcccagatgatggaattgatagaacaaggcaagaccactttcyccctctgtgagggtggactgtgactctacgagagaagctattctgctttgaaatgcggcactagaggttggtgtgtgtagcttttgactgtgaagtgtcc

SEQ ID NO: 16551 - DNA, 201 bp, Homo sapiens
aggcagcctgttgacccaacccatgcatgccggtctttgggactcctagatgtggaccctggagtgaatagggatcaggtgggaaatgagttcctttgatsaagatccttgtaccagtgaactgaccccactccccgtctggattcctgtggtgattaccctctgtattagtctgttttcatgctgctgataaagacgtac

SEQ ID NO: 16552 - DNA, 201 bp, Homo sapiens
gagatactgtatgcaaagaattgtcatgaagacataaaatcaagtcttggtgtaaaacttttaataaatttaaaggcatgtctctgtttttctcctcctcyatggggattttcatgtggttagtaataaaactgtaggcagttgtatgtctagatttctatgtaatttgtttgtgttcgtatatgcacacctgtatacatg

SEQ ID NO: 16553 - DNA, 201 bp, Homo sapiens
acagcaactgtctgttctcctatagtgttaataactaaatctcttattggcaaaggaaatgtattgtggagcaggtggcaaagaggacctgtgttacgtgrccagcaggctagaggggactgtggccaagggcaggtgcgctaacatcgatttctgtgcttctaggaattactccttctacgtcctcgacaaccagaactt

SEQ ID NO: 16554 - DNA, 201 bp, Homo sapiens
gccccttgttttcaggttaggaaacccaggttcatgtccaagtccctgggcaagtagccagcgtaactgattgacctaaaacaaaggatggagcccttggrgctctgcatagtgaaatgtatgatttcttagtggaaaacgagaaagccactgaggaagcccagaagggaacttagcatatacagccagctttggggaagg

SEQ ID NO: 16555 - DNA, 201 bp, Homo sapiens
tgctcttctgagttctcttctcaaatacctgttttcttgggtcacaggagattaggagattaaagccattctctctggtcctgcacctcccttgccaggcrtggctaagaggtttgtccttgtggaaggagctgagtgggttggtcgacctgtgcttttccgtgggtaccttaattctaccccatattccgtaatgctttc

SEQ ID NO: 16556 - DNA, 201 bp, Homo sapiens
acaaagagttttcttggtgtgtgtctgtgcttagaatttagaaaataagtcatccagtattgaggccattttatgaaaagcctttaaaatctgcaaatgcrttggcccagcacttccacttctagggatttatcctaagaaaatagtcttgggtatctgccaataatgttcactggagtgttgtttataatgtgcaaaaca

SEQ ID NO: 16557 - DNA, 201 bp, Homo sapiens
tgccgtctctgcctgctccatctggctgatcccaggcaggcagctcagctctcagcagacacagatccccagcacatatgaacgtgaaagaggcttctccrtgggagcgaagtggccagcaggtgtcacaggctgtgtgggcccagcatcgtgtgggcactgctgggggaatcccatcacagcatgtgctggcgttagtag

SEQ ID NO: 16558 - DNA, 201 bp, Homo sapiens
ttttagtttgttcaccacgcttgatggcagatttgcctctggatcctcaggccacgttcctatggtgggtagggatctctctctctctctctctctctgtstgtgtgtgtgtgtgtgtgtgtgtgtgtgtgtaaatagtgatttctctaagttaataaagaatgtggggtgacctcctacacatgcccgtatgctattgtg

SEQ ID NO: 16559 - DNA, 201 bp, Homo sapiens
tttttgagggggaaaaatacagcaaggggaaatgttttattaacaataaatatgcggcttaccatatctgtagggcacagatttggttagtagtattttgraggcaggataaaggaagatcctaaaatctctgtgctgtgtagcttccattcgagctgcacatgttaaaaacattctaggatccacacagtttaaacaagg

SEQ ID NO: 16560 - DNA, 201 bp, Homo sapiens
ttgggcttagtagtaaaaagggggaacaaaataaaagaagatcaggagacaaagagcctacagtacaaaaaaggaaagacgaaggttgatattattagaartacttcctgggcagccttactgtttgaattaggatcacccccacccccacctcccagaggtattagttgtaatgcagagacaaatggaaactagtcagat

SEQ ID NO: 16561 - DNA, 201 bp, Homo sapiens
tcaaagagaacaacaattcaccacaccccaacatggtaacagtctttttgttttagaagcatctgtgaattgccaagactcgtagaactaagatgtattcraagtcagtcgattttctggaaacgacccagtccctgaagatagtcttttggggagttgagtgttttgagagggacaccccctctacagggacttaaaatg

SEQ ID NO: 16562 - DNA, 201 bp, Homo sapiens
tcctgcatagaaatatttatttattcattcattcatttttttgagacaggttctcactctgttgcccaggctggagtgcagtggtgcagtctcagctcccwgtagcctcaacctcctgggctcaggcgattctcctgcctcagccccctgagtagctgggattccaggtgtgtgccatcacacctggctaattttttaata

SEQ ID NO: 16563 - DNA, 201 bp, Homo sapiens
tgtgtgatcgcattggagctacttcaaagagcaaacacaccactttgatttatttctcttagtgatacagtatttagagagggagatactttttatcttcrtgggatacttacagtggtgctctagaagccatgtactgcttctggcttctccttcctttcctccaaggctcctcctgcctcctcccaaagctctgtgccc

SEQ ID NO: 16564 - DNA, 201 bp, Homo sapiens
ttagtatcctcaaattatcttgaaatcctcagagatctgaaatactagtactgactgtacagttttcttactcaaatctatagcatgtggaaagttgacakcaagccatgccatcgcctcctggtattctctgtgggtttaaggaagcagcatcttatattctttggcttagagttcccccaaagcacgttctgtctaagg

SEQ ID NO: 16565 - DNA, 201 bp, Homo sapiens
aatgtttggccagagtaatccatccttactcatcctctccatgtgaggtttttgtttctttttaaagaaggctacaacacaacacatactactctgaagtygaattcaagagccccgcgccccacctgtggcaggcctgagggagccgccgcagtgagtgtgcacacagctgcatggccaggactccggcatgcaccacgt

SEQ ID NO: 16566 - DNA, 201 bp, Homo sapiens
gcgaagaaaagtggagagagaacaaccttcatgtcttgagccttttgtgacttctcctagactctgttgggagcttttcctgtgtgatcacatgacattcmcccatctaagcagccgaggcttattcctcccgactgcagccctctttgatctccctcttccttcctttgccttctatatccaggtggctaccccggtcta

SEQ ID NO: 16567 - DNA, 201 bp, Homo sapiens
tgcctcatctgccctttttggtgagaatgtcctttttgtgatgactttatgcactcccttttgcttttcggttgttccaagccccattcaaatccatgacraggactctgctctctgatgggcaggaccttgatgaggccacaggtgctcactgctgagtgggaggaagcctgggtgggctccagggacctgcagagtgta

SEQ ID NO: 16568 - DNA, 201 bp, Homo sapiens
gaggaagtgacggggactaaagggcgccaaagcaaaggggacataaacaccaggaacaacggggagagagcctcctgtgagtgacagcatccaaaacaccrtgggcccaaccatcatgataacagcagaccctcctcccatgtgtgatggcagctttcctctgcggcccctcctggtttcacatgggggaccactagacca

SEQ ID NO: 16569 - DNA, 201 bp, Homo sapiens
ttttgtggttggtgtattctgaaccctccgctgtgtgagcagcccgctcaggggcagtgtacgtggctgatctccactgtcctgcccgcgtggatgggggsgttattctcagtgtacgtggctgatctccactgtcctgcccgtgtggatgggggggttattctcaggtcagcccagtgttggcctccctccctgggaacc

SEQ ID NO: 16570 - DNA, 201 bp, Homo sapiens
agtccctgggcaagtagccagcgtaactgattgacctaaaacaaaggatggagcccttggggctctgcatagtgaaatgtatgatttcttagtggaaaacragaaagccactgaggaagcccagaagggaacttagcatatacagccagctttggggaagggggaagcagtgccaagcaagacaggtgcttttcagagaca

SEQ ID NO: 16571 - DNA, 201 bp, Homo sapiens
catatacagccagctttggggaagggggaagcagtgccaagcaagacaggtgcttttcagagacacatgaatctctgtcactcacggatgtactctttgcmccaggtgaaagtgacgtcctgcatttcacctccaccaccacgtcgaagaatcgcatcatcataacctggcaccggtaccggccccctgactacagggatc

SEQ ID NO: 16572 - DNA, 201 bp, Homo sapiens
gagcagatttggggagatgttagtcaaaggatacaaaatttcagttagataggaggaataagttcaatagatatattgtacatgatgacagtaataatgakgtattcttaaaaattgctgagacaatagattttaagtgttctcaccacacacaaaaaaatgtgatgtaatacatatgttaattaggctcattcagctgtt

SEQ ID NO: 16573 - DNA, 201 bp, Homo sapiens
gaaggaggccagttactagagcagagtggccgtagaggctgcaacacggtggccaaagcatgaagctgctgtatagtggcaaggtcacagtgatttccccrcagcctcggtttagagggagacggggtgtgctgagctgtgcctgcttctgtagaaggggccttctccaagtctgagtagccttaagccattaggactgct

SEQ ID NO: 16574 - DNA, 201 bp, Homo sapiens
atgcatccttttttacttcagagtaagtcggccttggttaagtcttaatatttctcatgcctatttttttttcttcaaatgaaaacatacggagagaaaayagcatgtttatgccttttggttgtacccagcactgcccagaatggcttacagagtttatacccatggaggtttcgtaaaggtgacattaacttcgcagta

SEQ ID NO: 16575 - DNA, 201 bp, Homo sapiens
cttcagtgcagtggcataatcttggcccacttcagccttgacctcccaggctcaagcagtcctcccacctcagcctccctggtagccgggaccacaggtgytttgccgccacacccggctaattttttattttttttgtagtttttgtagagatggggttttgccacgttgcgcaggctggtctagcattactgggctcaa

SEQ ID NO: 16576 - DNA, 201 bp, Homo sapiens
tgaaaggttagatctttgttctgagataaattaagtggaaaaaggtgtagagcattatatgtactctgattcttcagggcttaatttaaaaagagcatgtwtgctggtgaatgctggttcaatcattaagaagtttttgagaaggaatcccagaaagtaataagcacttatttttcatggaaaggaaccggaagtgcttgg

SEQ ID NO: 16577 - DNA, 201 bp, Homo sapiens
gggtttttagtttgttcaccacgcttgatggcagatttgcctctggatcctcaggccacgttcctatggtgggtagggatctctctctctctctctctctstgtgtgtgtgtgtgtgtgtgtgtgtgtgtgtgtgtaaatagtgatttctctaagttaataaagaatgtggggtgacctcctacacatgcccgtatgctat

SEQ ID NO: 16578 - DNA, 201 bp, Homo sapiens
cagtaactgttgaagtggctcttcctgaggcagaccattcaattctgtaatgcccgactggggaagcccagagtccagtcacttcatttcttcttctataraagtctaattgattatttgtttatttagacctcccattatagaaagtgtgacatgctgggcctctggggaagatttttgagggttttgatgtcagagccc

SEQ ID NO: 16579 - DNA, 201 bp, Homo sapiens
gtagaaagcaagaggattttccttgcagtcactgaaggtaccttgtgtacacagaaagaagacagagggagccccggatgcctcggtatccctcagagccrgatccttcagacctgtgcagtacctgtggatttggttagtcgatgatgcgctgccattaaaacaaaggcatcggccctggaatagagaagttcagtgaga

SEQ ID NO: 16580 - DNA, 201 bp, Homo sapiens
gaaccgtaagaaaagggggctcccacctcccgctctggggtcgccacttgcctcgcaggcaggaggaggctcccagagtagatacaacttgcccgtcaccyggatgggttggtagtgcacatatgcacggggcgcagtttaaaatgaaagtaaaagatgcaaatgtgtttgcaaaagaaaaattaacataggatacgtgcg

SEQ ID NO: 16581 - DNA, 201 bp, Homo sapiens
gaaaagcatctaacatgtttccaagcacataggtttttggtaaatggtggcagctgctgctattttttttttaaattaaactatctaagagttgcattctragaccatctaaaattctgagtcttaagctgtgttgactatatatgttcactaccataactaaatggtccttctgtattgcttttctaaattgtagaattt

SEQ ID NO: 16582 - DNA, 201 bp, Homo sapiens
gcagaagaacagaacagtccttggagcttggtaggaggtgtgagggcttatgggggacagttgtcttttcaagtcaaggaggaataagggcttctggggcsggtggaaagggtgagtcttaggcagggaagggtgaccatccaggttagatcacttcttctgcggggtcagcttggccgctgttaggttttcaggatgtca

SEQ ID NO: 16583 - DNA, 201 bp, Homo sapiens
tggggaagggggaagcagtgccaagcaagacaggtgcttttcagagacacatgaatctctgtcactcacggatgtactctttgccccaggtgaaagtgacrtcctgcatttcacctccaccaccacgtcgaagaatcgcatcatcataacctggcaccggtaccggccccctgactacagggatctcatcagcttcaccgt

SEQ ID NO: 16584 - DNA, 201 bp, Homo sapiens
cctaaggggtgtaaggaactccagaggtcatctggttcagcctgctacagggcaggaatctccacggtagcatcgcagaccctccactgtccttttaaagyccccacatgcattggaaatgtacggtgctcaccctttggtacagagactgaggaatgtgagtttatgctcaagtcattaacaagacagaattcttaggct

SEQ ID NO: 16585 - DNA, 201 bp, Homo sapiens
attgattatttgtttatttagacctcccattatagaaagtgtgacatgctgggcctctggggaagatttttgagggttttgatgtcagagccccgaacttyctctgaacttaattgtctttcagaccctttaagaatgtcacagagtatgatgggcaggatgcctgcggctccaacagctggaacatggtggacgtggacc

SEQ ID NO: 16586 - DNA, 201 bp, Homo sapiens
ttttaagtgttctcaccacacacaaaaaaatgtgatgtaatacatatgttaattaggctcattcagctgttctacaatgtatgcatatttcaaaacaataygttgtacatgataaatatacaatttttatttgtatattaaaattaattaattttaaaaaagatctccagtagtcacctggtcagcaccagatattctaat

SEQ ID NO: 16587 - DNA, 201 bp, Homo sapiens
tggtcttagacttgtagcaggactcaaatgtctgcagcggcattggaaaggggtgccgtccagtgtgtgcatgtgtgtgtgtgtttattttaaattgtctrtggaactatctcaaagattgaggccagcaggacttgacctatacatagatgtagactgtacatagatgtaagaatttctattcattttatgaaaatgaat

SEQ ID NO: 16588 - DNA, 201 bp, Homo sapiens
ggatctgggagcacggtgctaggactctctaagcgtgacctccttcagtttggcccagagtggtcagatagtttgccggggcataggatggatgacaggcytcatacgcatcacgtctgaagggaaagcccttgaattttccacgctactttttagtaacagtaggctttgtcataattggcttcatgttccagctttcct

SEQ ID NO: 16589 - DNA, 201 bp, Homo sapiens
ttaagtgttctcaccacacacaaaaaaatgtgatgtaatacatatgttaattaggctcattcagctgttctacaatgtatgcatatttcaaaacaatatgytgtacatgataaatatacaatttttatttgtatattaaaattaattaattttaaaaaagatctccagtagtcacctggtcagcaccagatattctaatct

SEQ ID NO: 16590 - DNA, 201 bp, Homo sapiens
agaaagaattcggggatgatttcagagtacactagaatattttttaaaagaatattttataaaaatacagtgatagtaaaagaagtagaaggccaaattcygcccccagccccttcttaatattggactttattcctttgcttttttcccttgctgccatctaaggaggctttctgtgctatagcatccagttcctctgcc

SEQ ID NO: 16591 - DNA, 201 bp, Homo sapiens
atataaccatatgtaagtgactgtgctatcaggagacagaacaacaagacccagaaagactcagtgacccacagagccagttccacccaaacaagtcttastaatgagattagataatgagagtgtattttcttcatcaattcatgtagctcagcaaggctggaaactgcttgcacacttctgcagagaaaaaaaaaagtt

SEQ ID NO: 16592 - DNA, 201 bp, Homo sapiens
gtagccactgtactcactgaagatgcattgttttttttttttttttttttttaagcgagcagcagcaagatttattgtgaagagtgaaagaacaaagcttycacagcatggaaagggacccaagcgggttgccctgaagatgcattttttaacttgctttttaactaagtatttttgctctgagctttcctggatctgtaa

SEQ ID NO: 16593 - DNA, 201 bp, Homo sapiens
ttttacagatgggaagagagaggatcaagatcacagaagctaatggtttgtcccagaccaaacaaggagttcctaggagagactgaactttaaagatatcractctctgcaggtctaagtggatgaaaggacagtggtgggggtgaggatttcgtagtgtgtttttgcattgtctcctcaatgagtgatctggtgctggtg

SEQ ID NO: 16594 - DNA, 201 bp, Homo sapiens
agctttgtgcacactgaacttggagaaccactgtgttggactccgagtcctcttgcctggatgagaggcccaagagcactgcatgttagtggctcttcctyctcccccacacctccagggactggagctggggctgctcagaatgaaagatgaatgggggagggagaaggcccagggttgaccccccacaagcttgtctcc

SEQ ID NO: 16595 - DNA, 201 bp, Homo sapiens
gagcactgcatgttagtggctcttcctcctcccccacacctccagggactggagctggggctgctcagaatgaaagatgaatgggggagggagaaggcccrgggttgaccccccacaagcttgtctccctgtctcatgctgtctcctatcccatcatgctgctgattgggcaggatttacttccatggataatgggagact

SEQ ID NO: 16596 - DNA, 201 bp, Homo sapiens
ggctaacatatggctttaagctggatgttacaatgagagctggagtttcgtctgattgcacatagccttgcttttctgtctttggaaaagtagctcactgyagagccctggtaaacgtttgaactgcattgcgggagtaggcagaagaacagaacagtccttggagcttggtaggaggtgtgagggcttatgggggacagt

SEQ ID NO: 16597 - DNA, 201 bp, Homo sapiens
gagcaggctgtttaaatcacattttaagtaaaaaccaaagtgcacagatgatctgcagaacttctgggggataagaagctgctttcctcgaagaagttcayctccaaaccagcgcccatggctcagcagccagcatggcagccccaggggtacatgggacttgggcatgtgaggctggtgagggacagggacagctgggtc

SEQ ID NO: 16598 - DNA, 201 bp, Homo sapiens
tggaggtaggaaagttccttgaactctttcttgtgcccttccagctgtgagctgtgtcaccattgtattatttttacattgttgttgttcttgaaaaagcttttttttttttttcaaggcagagtcttactctgtcgcccaggctagagtacaatggtgcgatctcagttcactgcaatctccgcctcctggtttcaagca

SEQ ID NO: 16599 - DNA, 201 bp, Homo sapiens
aagtgcagtggcgcaatctcagctcactgcaacctctgccttccgggttcaagcgattctcctgcctcagcctcctgagtagctgggattacatgcgcacrccaccacacccggctaatttttgtatttttagtagagatggggtttcaccatgttggttaggctggtctcaaactcctgacgtcatgatccacctgcctc

SEQ ID NO: 16600 - DNA, 201 bp, Homo sapiens
aagctttcagaaccactgacttgtggtgatttttgcatgccaagtatttggaaaatatctggagccccttcagctctcaccagttaaacctatttgtacawttgttctggtttcttcctgtgcttgaaaagcctctttctttgttgcgttaatacctctgtcttgctttcctcatgtgtatgccagtgtgacattctcggc

SEQ ID NO: 16601 - DNA, 201 bp, Homo sapiens
ttgctgtggaggctttctggtatttcatttcaggtgcagatgccttcactttcccacaaaaaaaaccccaacaaaacctaagaccttactgcaactaagtytccaagtactttttaacccaatgggatgaacagcctgtggtctgctcagatcaccctgagtgcgtgtgagaaggcctgggctttgccaggaaatccagga

SEQ ID NO: 16602 - DNA, 201 bp, Homo sapiens
tctgggggataagaagctgctttcctcgaagaagttcacctccaaaccagcgcccatggctcagcagccagcatggcagccccaggggtacatgggacttsggcatgtgaggctggtgagggacagggacagctgggtccagcagtgcctttcctagggacggttgccacgtcacctgtctgccctgtacttccatttcct

SEQ ID NO: 16603 - DNA, 201 bp, Homo sapiens
tgaacctgggaggaggaggttgcagtgagccaagattgtgtcattgcactccagcgagtgcagtgtaaatcccttaaggaaacagtgtgttgtggtaatcrtgatatcatagtaaataggttttgttcgttatttttttcttttacttccttttctaccagtgactagtcctaatgtgttctaacttttgaaaataaagta

SEQ ID NO: 16604 - DNA, 201 bp, Homo sapiens
cttacagtggtgctctagaagccatgtactgcttctggcttctccttcctttcctccaaggctcctcctgcctcctcccaaagctctgtgccctgaaagakccttgagccattgctcagatgtcaaaattgtattaagcagacacatcaaattaaaacttttgggatcactcaccaatatggtttcctgtacagtactgcc

SEQ ID NO: 16605 - DNA, 201 bp, Homo sapiens
gtgagctggccctgacttctctccagtatcatcattttctaggaaagccatttccccacaacccccaaggaaagcatatcataaacaagttttcccttggrgaggttccctcgactcccttctctcctctcccttcctctctgaattgttgccatatgtgaagtccacttttctagttgtcatgctacctgttgacactaa

SEQ ID NO: 16606 - DNA, 201 bp, Homo sapiens
ccggcattgttggcggtccttgtctttgccactgggaatctggtttcctcagactctacgtccacgtttcaggattgatccagagtcagtgtcctgcttaygcttttgaatgaatgatcccacctcagctgcaggatttctgcttagtttcctaaaaatttcactttgggttatgagcttccaattctaaacctgctaaag

SEQ ID NO: 16607 - DNA, 201 bp, Homo sapiens
tgggagataaatgctgagacataaagccagcaagaactgagttttcatttggttgcctccgtgggtctgaagtctttgacccttactttgctgcttactgrgtaagcagtgtgtctgcttttattccttagaagcagtgacttccccttctcggcccctttggaaattcttttgctgttcttcatttgggcttaatttttt

SEQ ID NO: 16608 - DNA, 201 bp, Homo sapiens
gcctgagtcatgaaaccggaccacattaagggcgacacatggtccaatcactgtttgtaaaagtccacgtatttcaaactcctctctcctgccactgctgrgctgtttccctctttgaggacctggtctccgcagcatttattcattagatggcagtcctaggggagtctcgctttggggaaacctctcctcctgcacatt

SEQ ID NO: 16609 - DNA, 201 bp, Homo sapiens
ctgccactgctgggctgtttccctctttgaggacctggtctccgcagcatttattcattagatggcagtcctaggggagtctcgctttggggaaacctctsctcctgcacattcaagaaaacaaccgcggagacttagggtcggtactggtttccagtcacttacgtagcaaacgaagcaagaggaacgtgcctgggagga

SEQ ID NO: 16610 - DNA, 201 bp, Homo sapiens
tatttgtctagcatcattgaaagagttttttgcttgagttgatttcccaggtaattgaagcttacttctcaaagcacaagatattttttctcatatattarcggtcttaagtgagtgagacccctaagaattcttaattcctttatcttacttttcctacaggaaacttattatgttttcctagataggaattgtgctacc

SEQ ID NO: 16611 - DNA, 201 bp, Homo sapiens
acatgccgtttgaatgtataccatgaagaccccttagctcagggagctttgctctatttaagtaatgtttatattcttaatgaaccaaagaggaagtggtyatgggaaaagagccaggactagatttcattctaatgcttataaggagagttctaggaaaccctcagacttggtaaaccaaggcatttggagatactatga

SEQ ID NO: 16612 - DNA, 201 bp, Homo sapiens
gaaaagcttgatgaaataggtgactggagatctggcagagtatttcttgccagcatcgattgaggcacctctgaaaagtccaaaactcactcccttcctcyccagtttcaggcacagaataaaaattcagaacacatggccttggtcctggctctgtggctggctgcctgtggtcctcagacagctgctgcaggttcctgg

SEQ ID NO: 16613 - DNA, 201 bp, Homo sapiens
ggcgccacacccaggtgatgcagggggaagccaggctgtattccggggtcaaagcaacactaactcacctctctgctcatttcagacagcttgcctttttytgagatgtcctgttttgtgttgctttttttgttttgttttctatcttggtttccaccaaggtgttagatttctcctcctcctagccaggtggccctgtga

SEQ ID NO: 16614 - DNA, 201 bp, Homo sapiens
gccctctcaacttctccctcacctccttccctaggggtagacagagatgtaccaaaccttccggctggaaagcccagtggccggcgccgaggctcgtggcrtcacgccccccccgccagggctgtacctccgtctccctggtcctgctgctcacaggacagacggctcgctcccctcttccagcagctgctcttacaggca

SEQ ID NO: 16615 - DNA, 201 bp, Homo sapiens
agtctcgctctgtcgcccaggctggagtgcagtggtgcagtctcggctcactgcaacctccacctcccaagttcacgccattctcctgcctcagcctcccragtagctgggactacaggcgcctgccaccacgcctggctaattttttgtatttttagtggagacagcgttgcaccgtgttagccaggatggtctcaatct

SEQ ID NO: 16616 - DNA, 201 bp, Homo sapiens
ctgggtttgtgcccttcgtgctgcactgacaggtcaaagccgactcaggcctttgatgtctgctctaggagcaaaagtgattcctggtcccgcagccgttyccactgccttgtgtatgaaggtctgctgctctgaggtggatggtggctctaggcaggctgtttccgctgggtgcggttgttgctgcaggtttttctatat

SEQ ID NO: 16617 - DNA, 201 bp, Homo sapiens
gtatcctccactgtatgctgtcaccccaagggcaagcactgcatctgcttagtgaaggatttattgttcggaagatacattttccccttgagcagagagtrgcgtatcctggcagtcttcggtgagccagttgtaccaggattatgaaatgcagatgtttactgtgtcattgttgctgtcattgctactgaggagtactga

SEQ ID NO: 16618 - DNA, 201 bp, Homo sapiens
ccaccatgttggccaggctggtctcaaactcctgacctcagatgatccgcccgcctcagcctcccaaagtgttaggattacaggtgtgagccaccatgccygactctttttaattcttaatgtggctacttgaaaatttaaaattacagatgtggcttgcattctgtgttggtaagctgctttagagcatttcttttaaca

SEQ ID NO: 16619 - DNA, 201 bp, Homo sapiens
gcgaaggtgagtctgggagagacgccatggagtcagtgtgagttctgcagcctcccaagttccgctggcgtgagaggcttgcctggtgccagggctctggrcattgggaacattgcctggtctaccgggcaagaaacgtgaaccaccgcagtgaactggcagcgcgttggcatttttccctccatgtttttataaaaccgc

SEQ ID NO: 16620 - DNA, 201 bp, Homo sapiens
gtcttgtccctgttccaggagaagggctgggtatgtgtcccccaaaggggagagcattcgagaaggatggcgccagcctccccagaactgacctgtggttwaaaaaaaaaaaaaaaattgtgctttttaaaagatgagttttatcagctcacacatccttctagagtctaatggagattttttgtgtgtgtggaaatagta

SEQ ID NO: 16621 - DNA, 201 bp, Homo sapiens
aggcgtcacatggcttgtttgtgctgatgtcactgcctcgctgctctcctgtggcacctcctcggtccctggccacagggcacagagccaagcacatctcrtgctcttggcccagttacgcttctgcccaggggtaagtcagctggagaggaattcacagcccaggcatttcatgtcgttatggcctattttaattttttt

SEQ ID NO: 16622 - DNA, 201 bp, Homo sapiens
ctcgacaattcacaactcttttattagctatcttaaaaaaatttattactggcatcaattagcctgagtcatgaaaccggaccacattaagggcgacacayggtccaatcactgtttgtaaaagtccacgtatttcaaactcctctctcctgccactgctgggctgtttccctctttgaggacctggtctccgcagcattt

SEQ ID NO: 16623 - DNA, 201 bp, Homo sapiens
cctgtctttggaaccagaacatcccaagggaactccttcgcactggcgttgagtgggaccccgggatccaggctggcccagggcggcaccctcagggctgkgcccgctggagtgctaggtggaggcagcacagacgccacggtggcccaagagcccctttgcttcttgctgggggaccagggctgtggtgctggcccactt

SEQ ID NO: 16624 - DNA, 201 bp, Homo sapiens
ccctggctggttgtctttggaacaaactgcttctgtgcagatggaatgaccaacacatttcgtccttaagagagcagtggttcctcaggttctgaggagargaaggtgtccaggcagcaccatctctgtgcgaatccccagggtaaaggcgtgggtcattgggtttgctccccttgctgctgctccatccctgcaggaggc

SEQ ID NO: 16625 - DNA, 201 bp, Homo sapiens
ttaaatttcacctgcctgtttcctttttattcttttttttttttttttgaggcggagtttcgctctcatcacccaggctggagtgcagcggcgcgatctcrgctcactgcaacctccgtctcctgggttcaagcgattctcttgcctcagcctcccaagtagctggaattacaagcatgtgccaccatgcccgtctaattt

SEQ ID NO: 16626 - DNA, 201 bp, Homo sapiens
tttccgggaaattgacttcccttccccttgtcctgaaaactcaggcatgggcatatttcttggagattttctagttgaatcagaacttcctcttggtttgygtagattccatttagacctgcattgtccagtgtggtagccgcttattgagtaagccacgtggcttattgagtacttgaactgtggcttgtccgaattggg

SEQ ID NO: 16627 - DNA, 201 bp, Homo sapiens
atagagcagtcccttgattctgctttgtccccattaatgacagatctgagggcatccagaaggaatctccacaagcccagcctccacagtggctgcttccyctacatggtagagtggtgctcacctccactcctccatagatgccaagtcatctgtggtatagatgtggatgtctttgttcaaatggtccttgagtctttg

SEQ ID NO: 16628 - DNA, 201 bp, Homo sapiens
tttggccagtcacagtggctcatacctatctcagcaccttgggaggctgaggcaggcagattgcttgaggtcaggaggccaacatggtgaaaccccatctytactaaaaatacaaaaattagccgggcctggtgatgggtgcctgtatttccagctactcaggaggctgaggcaggagaatcacttgaacccaggaggtgg

SEQ ID NO: 16629 - DNA, 201 bp, Homo sapiens
ctccttgtaaatggccggccagcggagggcatggggtggggaagactggatacacacccctgtgctctgggagtacgttggctgggcggcatgctcattarctgctgcttccgaacataggttcagctgaagtgtatcccaggcagtggacacttcgtgtggaattcagaaaggtggcgcaggaaggataccagggaaagc

SEQ ID NO: 16630 - DNA, 201 bp, Homo sapiens
cgtcctcagttttgtgaagcaacagcctctgtgcctctttctctgcatgctctgttgacggtctagtcttgagagagaacctgctgctgtcccgtctgtcrtagccttcctagcaactcttaggcctgcatgctgtgttttcatgatctcccccaaagcggcactttgatgttttttcagagtcaaagtatcactgtggat

SEQ ID NO: 16631 - DNA, 201 bp, Homo sapiens
ctgctgcgggataagggccagggcagaggtgtgaacgcagccgtggaagacttgggccaggaagccatttgttctgctgctaacacttccacagctccacrtgtccagactgttgccagagacgtctttggtctacaggattcaggagggaatctgaactttagcctggagcattatcaactcatagatgagtctgaaaca

SEQ ID NO: 16632 - DNA, 201 bp, Homo sapiens
cgctgggcaccaccgggtctctccctcagtctcagagctcagttgcttctgcacctcatcagggatccagccatcaaagccaaggctgggggacacttggrctagagtaatcctaccaataatgcagttcagctttgtaaccgcaaattttctagtagccgtattttttaaaagtaaaaagaaacagatcaaatgcatttt

SEQ ID NO: 16633 - DNA, 201 bp, Homo sapiens
ttttaagtagaaaacactaacagtgtagtgcccatcatagcaaatgcttcagaaacacctcaataaaagagaaaacttggcttgtgtgatggtgcagtcaytttactggaccaacccacccaccttgactataccaaggcatcatctatccacagttctagcctaacttcatgctgatttctctgcctcttgatttttctc

SEQ ID NO: 16634 - DNA, 201 bp, Homo sapiens
catgcctgcacccccatccccgagggtctggaaaagaattgatttgttctgaggaaggaacatatatttggaatataaaatggttagtaaacaaaggatctttaaaacaagttagattgttatctcaagagaagcatacttcctcggcatgatgttttcttttgttaaattgctttggttttatttgactcaaagtattaa

SEQ ID NO: 16635 - DNA, 201 bp, Homo sapiens
gcctgcacccccatccccgagggtctggaaaagaattgatttgttctgaggaaggaacatatatttggaatataaaatggttagtaaacaaaggatctttwaaacaagttagattgttatctcaagagaagcatacttcctcggcatgatgttttcttttgttaaattgctttggttttatttgactcaaagtattaacaa

SEQ ID NO: 16636 - DNA, 201 bp, Homo sapiens
ttgcttttgggcgtacgatttggaaatgtagttgtttaccaaaaaaaatgatgtatgggccattgtgcttcccctgttcctgccttccagataatgttctstgtcacctccctccccttgtcactgccttgatgtcatcagcattgagagctgtgcagtccctaaaagtgtgatgttgataaacaagtaaactactgagta

SEQ ID NO: 16637 - DNA, 201 bp, Homo sapiens
cgtacgatttggaaatgtagttgtttaccaaaaaaaatgatgtatgggccattgtgcttcccctgttcctgccttccagataatgttctgtgtcacctccstccccttgtcactgccttgatgtcatcagcattgagagctgtgcagtccctaaaagtgtgatgttgataaacaagtaaactactgagtatacttcatgaa

SEQ ID NO: 16638 - DNA, 201 bp, Homo sapiens
tgatccattttttttttttttttttaggacacctgtttactagctagctttacaatatgccaaaaaaggatttctccctgaccccatccgtggttcaccckcttttccccccatgctttttgccctagtttataacaaaggaatgatgatgatttaaaaagtagttctgtatcttcagtatcttggtcttccagaaccctc

SEQ ID NO: 16639 - DNA, 201 bp, Homo sapiens
tgttggctttgaagaagaatgatgctgtgcttgcctttgcagtcctgtcaccatacttcctggaaagtgggtggacacgctggatggtagatgttgagttstttagatgcctggatgcttacatgctttgtgtgggttcttactggggctgtaacttactagaggacagactccaacttctgcttacttagtctggggagg

SEQ ID NO: 16640 - DNA, 201 bp, Homo sapiens
aactcctggactcaagcagtcctctccctccagcctcccaaagttctgggattacaggcatgagccaccatgcccggctggaactgttggctttgaagaaraatgatgctgtgcttgcctttgcagtcctgtcaccatacttcctggaaagtgggtggacacgctggatggtagatgttgagttctttagatgcctggatg

SEQ ID NO: 16641 - DNA, 201 bp, Homo sapiens
ccagggtaaaggcgtgggtcattgggtttgctccccttgctgctgctccatccctgcaggaggctcgcgctgaggcaggaccgtgcggccatggctgctgyattcattgagcacaaaggtgcagctgcagcagcagctggagagcaagagtcacccagcctgtgcgccagaatgcagaggctcctgacctcacagccagtc

SEQ ID NO: 16642 - DNA, 201 bp, Homo sapiens
cccaaatctctacccattggtcaaggtccctgagttcacagagcccaggccagagccctggaaacgcctctgcccgtccgctgcctaattgcctgtccacrctgggcaccaccgggtctctccctcagtctcagagctcagttgcttctgcacctcatcagggatccagccatcaaagccaaggctgggggacacttggac

SEQ ID NO: 16643 - DNA, 201 bp, Homo sapiens
tcaaactcctggactcaagcagtcctctccctccagcctcccaaagttctgggattacaggcatgagccaccatgcccggctggaactgttggctttgaaraagaatgatgctgtgcttgcctttgcagtcctgtcaccatacttcctggaaagtgggtggacacgctggatggtagatgttgagttctttagatgcctgg

SEQ ID NO: 16644 - DNA, 201 bp, Homo sapiens
ggtggtggacgggctgtgtggtctcccctcagctgtccacttgcacttgtgttaaaatgcggcagaactttccctctatacttaaattgtggtgaaatacrtatgacataaaacttaccatcttaacttttttttattgagacaggatctcattctgtcacccaggctggagtgcggtggcgcgatctctgctcactgcaa

SEQ ID NO: 16645 - DNA, 201 bp, Homo sapiens
ctacaggttttcaagtcatctcgtgtggtgcacagtcctcgccctacctcgaaggcccgggcgaagttttcctgagtgtgtatactcatctctttgtgttrtctctggcagggagcaagtgagtacaggattggagtaataggcatttttaggcttgagatggctttgtgtgtttggttaatgtcactacatttcctaggg

SEQ ID NO: 16646 - DNA, 201 bp, Homo sapiens
gcttgcctgccttttgggtcgtctccacctcccagggatgtttttgttccctgatcgaatgacctcctgttttgtttgttttttgagacggagttttgctytgtcacccaggctggagtgcaatggcatgatctcggctaactgcaacctctgcctcccgggttcaagtgattcttgtgcttcagccttctgagtagctgg

SEQ ID NO: 16647 - DNA, 201 bp, Homo sapiens
tgtcgttatggcctattttaatttttttaaccccaatcatttttcttaggaagtgatggggagtttggaaaggcaggcttatttgtcatcaagctgccagyttttatcaatgcaaaccacatccctgtgacatctgtgactgttccttggacagttaggtgagggagggtctcctggtggccccagggttactcttattta

SEQ ID NO: 16648 - DNA, 201 bp, Homo sapiens
tcagaccctttaagaatgtcacagagtatgatgggcaggatgcctgcggctccaacagctggaacatggtggacgtggacctcccgcccaacaaggacgtrgagcccggcatcttactacatgggctgaagccctggactcagtacgccgtttacgtcaaggctgtgaccctcaccatggtggagaacgaccatatccgtg

SEQ ID NO: 16649 - DNA, 201 bp, Homo sapiens
gcaagtccctataggataggcatgtggtacagtgtgaagctcctgagtggtcaacagctaccccgtgacaacatgccacactccatgtgccactccctccygcctgcctgctgtgtccttggccccagtggtgctctcccgtgctgaccagccggcacggctcacctggccgaactctagccttgccttttcctctcaagg

SEQ ID NO: 16650 - DNA, 201 bp, Homo sapiens
ccattggtcaaggtccctgagttcacagagcccaggccagagccctggaaacgcctctgcccgtccgctgcctaattgcctgtccacgctgggcaccaccrggtctctccctcagtctcagagctcagttgcttctgcacctcatcagggatccagccatcaaagccaaggctgggggacacttggactagagtaatccta

SEQ ID NO: 16651 - DNA, 201 bp, Homo sapiens
tactgggtaagcagtgtgtctgcttttattccttagaagcagtgacttccccttctcggcccctttggaaattcttttgctgttcttcatttgggcttaatttttttttttttttaatgttctttgaatcggcaacttaatcatctcccaagtgacagtttcttaattttagttccaaacacctgttcacatatgacttca

SEQ ID NO: 16652 - DNA, 201 bp, Homo sapiens
agttggaatgcagtggcatggtcatggcttactgcagcctcaacgtcccaggctcaagggatcctcctgcctcagcctcctgagtagctggggtcacagakgtgtgccatcacgcctggctaatttttaacattttttgtagagatgggagtctcactatgttgcccaggctgcactcaaactcctggactcaagcagtcc

SEQ ID NO: 16653 - DNA, 201 bp, Homo sapiens
cttagcattggttacagaaataattaagacaatgtcttcaggagattttgacttgggaataaaactcactgtccaaccttgcattcatccctccaattttyctagcttttaaggagcattgctccccttccagggacccacattggtttctaagaggcaagctgccctaatgacgaagcctctgcacggagcaggagcagt

SEQ ID NO: 16654 - DNA, 201 bp, Homo sapiens
gtgttgtcaataaacaagtccattttaaaagcatctttgaaggtgtgtaatgaaaatggaggccttaggttgtatcagggtttatgaggagccagcttatmtgtaatcagatgttcctgttactgttatcactgtagtatagggcttagttctgccctttaagtcacagactcaagttactcctgattttaccagcagtca

SEQ ID NO: 16655 - DNA, 201 bp, Homo sapiens
gacttgggaataaaactcactgtccaaccttgcattcatccctccaattttcctagcttttaaggagcattgctccccttccagggacccacattggtttmtaagaggcaagctgccctaatgacgaagcctctgcacggagcaggagcagtggcaggagctggcatggcagtcccttaggtgagggacgatcactgctca

SEQ ID NO: 16656 - DNA, 201 bp, Homo sapiens
ggaaaaaaaaatgtattcagccagtactctttccaggttatagctaaacgtcagttggcaacctctatgctgtggtttattgagtaacacttaatacttarcacagccctcagtgaagatcttttatggccttttctgaatgttatacaaacataactaaagcttatccagatgaggacagggacctttctttccttcctt

SEQ ID NO: 16657 - DNA, 201 bp, Homo sapiens
ggccagttctgccgctaatgggtgagagacttgggccaggtgccttacatccgggagcctcagtttcctcacctcggaaatagggtgataatgtaacagaccccatggggttatgagaaggacttggtgcaggaaagcagcagcacgtgcctggcacagggcagggcctctccagatggcagttcctgtctgtgtcttatt

SEQ ID NO: 16658 - DNA, 201 bp, Homo sapiens
agtgagagtctgttgtttaccacctgatacattggtaagagctgcttgatggtatggggacatcagtagggaggatatagacgtagccacccccgccctasatagtaggggcctcagggtggggtaagcctgggtgggggaggtatgagtggtggaacagtgggagaccctggatccttagtctccagcgtgattgcattt

SEQ ID NO: 16659 - DNA, 201 bp, Homo sapiens
gcgtaaaaggtttttcatttgtccttgaccacgtggtccaaacctcaatttccctagcagaacgcggtttcgatcactggtggatccgtctcacagcaccrgtcatgctgcctcgctgggaagtggagggctcaggattcccgtggttcacgatccattttatgttggaaggaaatcattttgaactatctcagtacacac

SEQ ID NO: 16660 - DNA, 201 bp, Homo sapiens
tccagaagcagtgtctgtcatccatactccaccagaattgaacactaaattgagctttgcaattttagcatttaaaaagttgtatcatttaatatagaatrgcagtctcttcattatgatcttcccttgcctagtaagtttatactcaagtcaaaatcggttaatcatgcatattgattccttgtttatctttttctttta

SEQ ID NO: 16661 - DNA, 201 bp, Homo sapiens
agtcagatggaatgggtctgttttctatatcaagagacagtattgcagataatttttttctttcaaggaaagcaagtcaggagtcaaactctcatgccacygtagtcacaaatgaaatttattgctaatcagccatgtgacgtgtaattgctttttcattttcttatttttccagaagagagatttgtttagatgtttgat

SEQ ID NO: 16662 - DNA, 201 bp, Homo sapiens
ctgcaagagacttcctgggagggtggtatcatttggcctgtgggcttttgtaacactttcctgctattaggagagtgaattctgaattttcaatcacgttsacctgttggagcaagtagagtttcagacggtctccgcttttctcgactagaaagcaggccttctcccttttccccccagtcttgtttcatgacaccattc

SEQ ID NO: 16663 - DNA, 201 bp, Homo sapiens
ccactgtaactgttttcacttgacaaataacattaaaaaacacagttctgcaagagacttcctgggagggtggtatcatttggcctgtgggcttttgtaayactttcctgctattaggagagtgaattctgaattttcaatcacgttcacctgttggagcaagtagagtttcagacggtctccgcttttctcgactagaaa

SEQ ID NO: 16664 - DNA, 201 bp, Homo sapiens
ggggtgcagtggcatgatctcagctcactgcaacctccaccacctgggttcaagcgattctcctgcctcagtctcccaagtagctgggattacaggtgtgyaccaccatgcccacctaatttttgtatttttagtagagacggggtttcaccatgttggccaggctggtcttgaactcctgacctcaggtgatccacccac

SEQ ID NO: 16665 - DNA, 201 bp, Homo sapiens
gtggcatgatctcagctcactgcaacctccaccacctgggttcaagcgattctcctgcctcagtctcccaagtagctgggattacaggtgtgcaccaccaygcccacctaatttttgtatttttagtagagacggggtttcaccatgttggccaggctggtcttgaactcctgacctcaggtgatccacccacctcagcct

SEQ ID NO: 16666 - DNA, 201 bp, Homo sapiens; identical to SEQ ID NO: 1558

SEQ ID NO: 16667 - DNA, 201 bp, Homo sapiens
ctgaacctaagaaaggtttgtaaaaaataaacatgaaggaagacttcattcaagaggtcacttaaaaattattattattattattattattattattattrttattattattattgttattttaagaattaggtctctgttggccaggctggagcacagtggcacaatcatagctcactgaagcctcgaactcctgggctc

SEQ ID NO: 16668 - DNA, 201 bp, Homo sapiens
ttttcacctttggcttttaataagggaagggtattagaaaaaaagtaatttgtatgatgaagggtgatttgtgcgtgtgtgcagacagacacacatgcagrgaggcaaatcagaaccgatgcgtgtttggctttggcttgtttcgctggtgtctggatttacctggcgacacttgttgctctgggggatcttagagggaag

SEQ ID NO: 16669 - DNA, 201 bp, Homo sapiens
accataattctgtgctaagtcagaattaatgttattttgttaattcaggttattgtgaaaatctccacaggaggttatttaagcaagtcacaaattgatgwttctgtttgtagaaaaactccagctcatccagccagccacattattccagggctgcatggtgtcagcgtagggaccaggctcggtgtagagaccaagggt

SEQ ID NO: 16670 - DNA, 201 bp, Homo sapiens
ctgtggaatcatttgaaaatttctgaaaacatgaaacaggtgtttataaggagttttctgacttaacaaaattggtgaaataccaactttactaaaaactrctaattcataattttttgattaataatttctagtctggaaaagaggaattttttgaaaatcactgatatttttgatatactgttgttttcaaattgagtt

SEQ ID NO: 16671 - DNA, 201 bp, Homo sapiens
gaggggcagcagggctgtgttcagtgctcccgccgtacgcttgtatgcgggaaaccactgcaggcggcccatgaagcctcctggccatgtgcgccctcccrgtttggaccccctcccgtgtgtcttggctgcaggtttgaactgatgcgcatgtgctggcagtataaccccaagatgaggccttccttcctggagatcatc

SEQ ID NO: 16672 - DNA, 201 bp, Homo sapiens
ctaagaaggtgggactccagcggcaatgccttgtccatgtgctaagccagccgagggcgcacgaagtgctgtgtggtgtccaagctgacttgggagggacmagtttggggccagccccccagcctcacttgtcatgtcccacctctgctggcatctgtgggcttaaagtgccttcactcccatccttttcaactatttctt

SEQ ID NO: 16673 - DNA, 201 bp, Homo sapiens
accatagataacagctgtcacgatggacagtgtggacctggattagtccttcttgggaaaggagagtttgggttttgtaccgtggtggttctgggttctgrgggaagagaatggaaccgtacgaggtaaaacaggagactctgaaggccacttggccatccaggcagaaagccagggatggagaggggcagcagggctgtg

SEQ ID NO: 16674 - DNA, 201 bp, Homo sapiens
tgccttgtccatgtgctaagccagccgagggcgcacgaagtgctgtgtggtgtccaagctgacttgggagggaccagtttggggccagccccccagcctcmcttgtcatgtcccacctctgctggcatctgtgggcttaaagtgccttcactcccatccttttcaactatttcttgattaaaaaaaaaaaacaaaaaactg

SEQ ID NO: 16675 - DNA, 201 bp, Homo sapiens
tagcactgccaccatagataacagctgtcacgatggacagtgtggacctggattagtccttcttgggaaaggagagtttgggttttgtaccgtggtggttytgggttctgggggaagagaatggaaccgtacgaggtaaaacaggagactctgaaggccacttggccatccaggcagaaagccagggatggagaggggcag

SEQ ID NO: 16676 - DNA, 201 bp, Homo sapiens
tttgtttcttagcactgccaccatagataacagctgtcacgatggacagtgtggacctggattagtccttcttgggaaaggagagtttgggttttgtaccrtggtggttctgggttctgggggaagagaatggaaccgtacgaggtaaaacaggagactctgaaggccacttggccatccaggcagaaagccagggatgga

SEQ ID NO: 16677 - DNA, 201 bp, Homo sapiens
aaggaggcaacttggtttcatagggagtgtcatgttgtccttctgagtttactgatgagcttacctgagaaaggagggttctagcatgggagttctgttgytacaagacatgaaagaatggcctccgtttatcccggagaggagagtccctgagcccttgggagttgccttgaaacctctgccgggtcccaggtgagaaag

SEQ ID NO: 16678 - DNA, 201 bp, Homo sapiens
ggagccccggccacagccggcaggactccctttgctccatgtgactctgagggcctcacaggtatttgcagcccaggtgctgtcggagcccagccgatgckaccgacacacagcacaagcgtcatcctgttctgcctgtcccttgcgtgtggaggggactcgtgcccagggctctccttgctggcttgttggaatctggct

SEQ ID NO: 16679 - DNA, 201 bp, Homo sapiens
gcccactgatccaggaagagattcctttgacctgggaagtcataatggcagatatttagacccagctctcaagcaagcctccaagttgttccggtgaaccygtaactttgagtaacctctgattgaaccagagagtaggaactaggtgcagaaccttgttgaatagaattgtttagcatcgtccatttgttagagcatttc

SEQ ID NO: 16680 - DNA, 201 bp, Homo sapiens
aggagagtccctgagcccttgggagttgccttgaaacctctgccgggtcccaggtgagaaagtgtgtgagttgtgtggttctgagatctgaacaggcaccrtctggtgacactaggggctgaaggagctcggtggctgcaggtggactggagctcaccatcaggaagtagccagattctcacccctcagtgtcaccgagtg

SEQ ID NO: 16681 - DNA, 201 bp, Homo sapiens
gttagggtattctccttgaggagctcagaataaccaaaggtaaagcatttggtggtataagatatattcatcttaaaaataagttgaaaataataagataytgggagatgttagccaccgaagtaaataactacagtgaaatagctctttattaattttgaaacctaaagttgaaagagttccgtattatttgtcagtatc

SEQ ID NO: 16682 - DNA, 201 bp, Homo sapiens
cctggctttcaggaaacgtagtgacgtaaaaggtcccggctgctgcgggataagggccagggcagaggtgtgaacgcagccgtggaagacttgggccaggragccatttgttctgctgctaacacttccacagctccacgtgtccagactgttgccagagacgtctttggtctacaggattcaggagggaatctgaacttt

SEQ ID NO: 16683 - DNA, 201 bp, Homo sapiens
gaaaaagataatccagcctcaccaacagccacagaattgaaatgagatacctgtttctgcttctggcattgggaaagaaagaaaaatggcactagcagccttttttttttttttttttttttttccccaaaaaatttgctactcttgaggttctgtcaaagaatgtgctgtggcctctagaagcatttttaaaaagagact

SEQ ID NO: 16684 - DNA, 201 bp, Homo sapiens
tatcataatatgccacctactctggttgtgtcttacaactgtagctctgtggggttttttttgtttgttttatgcttgctaatgggggaggtggggggtgkgggcggatgaatataaatgatacctagaaattgaaattggaaaaaaaaatgtattcagccagtactctttccaggttatagctaaacgtcagttggcaac

SEQ ID NO: 16685 - DNA, 201 bp, Homo sapiens
agaaatgattggggataaaattgtttgcattatgaaatattgtatggccaggtggcccctctttcatgttttgttccttgtgaagaggttgagtctcctattttttttttttttttggagatagagttttgttcttgtccctcaggctggagtaaaatggtgcaatcttggctcactgcaacctccgcctcctgggttcaa

SEQ ID NO: 16686 - DNA, 201 bp, Homo sapiens
tgggatcctcctggaggcttagtagggctgccctgagcagtattgtcttctccagctgggcctctgagctgtaccatgtgcccgtgctcagcctcagtccmtccctcagccagttgttaaatcactttggacgtgtgacagcctcaacatgtcacagctttaaaagttcagattttaaaaaggtaaggaaatgatctccta

SEQ ID NO: 16687 - DNA, 201 bp, Homo sapiens
tggtcctgaacactaataatatttatatacattgagatgagacaaaatttacagcgggctctggggctggctccaggactctctaatcccacacttgctcrcgttctcttgcttgcctcctagaatcctttcaggttgtgcttcagtgaggggagcatggtgtccgtctctgcagcaatgcttatttatgcagttcgtcct

SEQ ID NO: 16688 - DNA, 201 bp, Homo sapiens
tctgaagagcagcctcggtgctccaagatgggtgtatgcttaatactgctggcacacgcctgacgagcgggaatgtgagcgttgtttctgtaaccagtttyactgaacctcacagatccattatacgacgtgaattttgtgggaataacataggctgggagtctgctctcttccagcctggtccctctcttctttcagccc

SEQ ID NO: 16689 - DNA, 201 bp, Homo sapiens
aataatccaccccttgtttagcgtgtcataaaaatgggcaaccagcagccttccaggctgctctgtgtatggagtagccattcttctgttcctttactttyctaatcagcttgctttcagtttacagactcaccctgaattattcttgcgtaagatctaagaaccctctcttggggtctggatcaggactcctttcctgta

SEQ ID NO: 16690 - DNA, 201 bp, Homo sapiens; identical to SEQ ID NO: 1551

SEQ ID NO: 16691 - DNA, 201 bp, Homo sapiens
tatatatatttttttaattcttgggtacaacagcagtgttaaccgcagacactaggcatttggattactatttttcttaatggctatttaatccttccatyccacgaaaaacagctgctgagtccaagggagcagcagagcgtggtccggcagggcctgttgtggccctcgccacccccctcaccggaccgactgacctgt

SEQ ID NO: 16692 - DNA, 201 bp, Homo sapiens
catttcgtccttaagagagcagtggttcctcaggttctgaggagaggaaggtgtccaggcagcaccatctctgtgcgaatccccagggtaaaggcgtgggkcattgggtttgctccccttgctgctgctccatccctgcaggaggctcgcgctgaggcaggaccgtgcggccatggctgctgcattcattgagcacaaagg

SEQ ID NO: 16693 - DNA, 201 bp, Homo sapiens
ggtttgactatcgagtttagattttaaagttgaggattgtttctttaagaagaaatatagaatattattcagtcctaaaaaggaaggacattctgacacawgcaacagcgtgaatgaaccttgaggacattatgccaggtgaaatcagccagtcacaaaaggacaaatactctatgtgatttcatttagatgaggttccct

SEQ ID NO: 16694 - DNA, 201 bp, Homo sapiens
acattttaggaactcataaaatgcatacttttttggtgtgatcagagatgggtaactccttattacttgtgggttagattagtttttggaaatagcctggwgtcattgagagccaatccttatcaacaaaatggcataaatggacaggaatgggtttcttcttcactttagagatagctctgaagacatgtctcagttggg

SEQ ID NO: 16695 - DNA, 201 bp, Homo sapiens
gcccagccagattttatttctttaaaaaagaaacttactagttatcaggacacttgtgttcttggtacttgattttgtcagcattatttttaagagcctcktccctccttccccctacctccctgttgagcccaggctctgaaataacataggtgcatgtgaagttcccctacctgccattaccagacattggtgctgggc

SEQ ID NO: 16696 - DNA, 201 bp, Homo sapiens
tgcctggtcatgcagagacggagctgggagcagctgcatgacttttcagagaagtggcacacgtttactgtaagggtcccaaatgtagaccactgcagatsgtaaggtctagatggagggaccaatagtagggaagtaggggagaagaaagtaaaaccttacagtataaagacccatagatgctcttttgtttttgatgtg

SEQ ID NO: 16697 - DNA, 201 bp, Homo sapiens
tgtaacatgggggtatattatagtcagtagcacctgcttcacaaactcgtgaggacttcagcagttcacacacataactgcctcgctgcctggcacctagygtgcacatggcattctaccgtggggtagacttttaaaattctggctacagagatacttttccataaaagtggccacatggaactctccaaatctaagaag

SEQ ID NO: 16698 - DNA, 201 bp, Homo sapiens
gagggaccaatagtagggaagtaggggagaagaaagtaaaaccttacagtataaagacccatagatgctcttttgtttttgatgtgtgtacgggggttagrtatttattgagcacctactgcatgacagagtgttcagcaatgacaatgcagagcttaataagaacaggttctagactaatcttttagggggtgaggatag

SEQ ID NO: 16699 - DNA, 201 bp, Homo sapiens
ccctgtgaggccaacgagggcaccagagcacacctgggggagccaccaggctgtccctggctggttgtctttggaacaaactgcttctgtgcagatggaatgaccaacacatttcgtccttaagagagcagtggttcctcaggttctgaggagaggaaggtgtccaggcagcaccatctctgtgcgaatccccagggtaaa

SEQ ID NO: 16700 - DNA, 201 bp, Homo sapiens
aaggatacaagtgtgtgtcattgtgtacataaagtttcggtctcacccctgtacaatgacctttatttgcaatagatggcattcctggtaagttgcttctragttggatttgtgcaaaggatttcccactgacttagcctatgatctcttcacttctttggttttttgtgtgtttgttttttggttttgttttgagacagg

SEQ ID NO: 16701 - DNA, 201 bp, Homo sapiens
cagcaagggcataggtacctgccattgtgcaccaaagtccctttcctcatggccctggctgttctcctgcatggggtcatgtgtgtcccgttaccaagttrtggccccttttcaaccttgagtgccacatctgggctgttgtaggcatgggtagtacaagctgggtttgttactctaaaaatgaaagggaggatcagttgt

SEQ ID NO: 16702 - DNA, 201 bp, Homo sapiens
gctgatttctctgcctcttgatttttctctgtgtgttccaaataatcttaagctgagttgtggcattttccatgcaacctccttctgccagcagctcacaytgcttgaagtcatatgaaccactgaggcacatcatggaattgatgtgagcattaagacgttctcccacacagcccttccctgaggcagcaggagctggtg

SEQ ID NO: 16703 - DNA, 201 bp, Homo sapiens; identical to SEQ ID NO: 1548

SEQ ID NO: 16704 - DNA, 201 bp, Homo sapiens
tagattttaagtgttctcaccacacacaaaaaaatgtgatgtaatacatatgttaattaggctcattcagctgttctacaatgtatgcatatttcaaaacaatatgttgtacatgataaatatacaatttttatttgtatattaaaattaattaattttaaaaaagatctccagtagtcacctggtcagcaccagatattc

SEQ ID NO: 16705 - DNA, 201 bp, Homo sapiens
gtctagtgttcttagctgtcacgttggctccttccagggtggccagacggtgttggccactcccttctaaaacacaggcgccctcctggtgacagtgaccygccgtggtatgccttggcccattccagcagtcccagttatgcatttcaagtttggggtttgttcttttcgttaatgttcctctgtgttgtcagctgtctt

SEQ ID NO: 16706 - DNA, 201 bp, Homo sapiens; identical to SEQ ID NO: 1550

SEQ ID NO: 16707 - DNA, 201 bp, Homo sapiens
taacctagtctcaccagttagtctatgccacctttgcagcacccagaagcttcataatattcctgcagccttgtccagggtagtggcttgcttgctttctrtctttccccagcctccttccctcctctttttcctcccctccatctcctagaaacagatcctagtttgggggtctgtgatctgtgaaacagcaaccttggc

SEQ ID NO: 16708 - DNA, 201 bp, Homo sapiens
tttctagactaagcaaatgatagacatagaggtgaatgctgagaggagagtttaattaatttccattaggaattattatgtggttaccttttcatggagtsttaactaagtattgtgcacttaaatgtagttagaaattaaagcctgatttttatttgcaagaatatttatgatgtctttctcattatctgaaacttgcat

SEQ ID NO: 16709 - DNA, 201 bp, Homo sapiens
agatcctagtttgggggtctgtgatctgtgaaacagcaaccttggcttctggggttgagtgaactcagcttgttttggtgacatgacatgttcctgtctgsctttgctgctccatttttaaccttgtaagtgccaggatgccagtgggaaatcgggagtccttctgatagaatttttccagcagatgttatcacgtactgc

SEQ ID NO: 16710 - DNA, 201 bp, Homo sapiens
ttaaagcctgatttttatttgcaagaatatttatgatgtctttctcattatctgaaacttgcataaaacctgaagcatcagcaaaatctttttaaggttgygtgctcaggtgtttgggaggctttccaggtaagcccgggcccctggcctgctcttaccattttagatgcaggggagggcaagtgggccttgggttttccc

SEQ ID NO: 16711 - DNA, 201 bp, Homo sapiens
gtcacagggatcctggcacagagaagagttacgagcagcagggtgcagggcttggaaggaatgtgggcaaggttttgaacttgattgttcttgaagctatyagaccacatcgaggctcagcagtcatccgtgggcatttggtttcaacaaagaaacctaacatcctactctggaaactgatctcggagttaaggcgaattg

SEQ ID NO: 16712 - DNA, 201 bp, Homo sapiens
agtggccacagtcatgtcactgggtaaagtgcttattgaaacaaaattggcacaggcttctgatcctgcgtgtgggttggtgtagcagaggttcagtgcarcagaagaagtttttcatcttaaaatttggaagtaacccctggccagcaattcactgtagtgtttgggaaacataggaatatctgcttattgtgacagatt

SEQ ID NO: 16713 - DNA, 201 bp, Homo sapiens
catgatacaaactcaggtcagaaaaacaaaggttaaatatttcacacgtctttgttcagtgtttccactcaccgtggttgagaagcctcaccctctctttyccttgcctttgcttaggttgtgacacacatatatatatatttttttaattcttgggtacaacagcagtgttaaccgcagacactaggcatttggattact

SEQ ID NO: 16714 - DNA, 201 bp, Homo sapiens; identical to SEQ ID NO: 1560

SEQ ID NO: 16715 - DNA, 201 bp, Homo sapiens
aggagaagccgatgtgtgagaagaccaccatcaacaatgagtacaactaccgctgctggaccacaaaccgctgccagaaaagtaagaatgatgctgactgytgctttctctctgcctctctctctcctctcctcctccttgacctcccttctcttctgagtgcacgagttccgctgggcagggtgcagtcgtgttgcattt

SEQ ID NO: 16716 - DNA, 201 bp, Homo sapiens
tttgcctatccttccacttcacagatgagaagactgagacccagagagggtcatggttttcattagccaaatggtgcagaaacccagtggtcacagtggcyctctagctctttgtcacccacagggcccttgataagagtacggtctttctccaggggagcagggttgaggagtgggggcagccctggcctgggtggccat

SEQ ID NO: 16717 - DNA, 201 bp, Homo sapiens
ggacattccgtctgcggggagccgagtccgaggctggagcaactctggaaccacagccctccagtagagggcacacgagagcaggctatctgtggagatakcctgttggcacaggggtgaagatgacagaggcgaacccaagcaaagagagttaattagcagagtttgccctccaggctcggagggcaagtcagcctgggg

SEQ ID NO: 16718 - DNA, 201 bp, Homo sapiens
tccatcagcataattccttatagattcattcaggttgctgtgtttatcaatagtttgtttctttttattgctgaatggtattctgtggtgtaaatgtactrcattccatgagcatggcatgtccctccatttatttagtttttctttgatttacttcattagcattttgtagtttttgtagtcctgtgtatgttttggtag

SEQ ID NO: 16719 - DNA, 201 bp, Homo sapiens
atccttagtctccagcgtgattgcattttgccaaggctttgtcccatgtccctttgtcccgtgttccatttgcccgtggtgttgcctagagagcatggagrggctggtggagcatgctctgtggttccctaacccagggctgtgtggggagagcttgcagcacccccctgaccccatatgaacgtccttgctatttcctgc

SEQ ID NO: 16720 - DNA, 201 bp, Homo sapiens
taaacagcagaatattccaggaaaccttaagtgataactgagttgaaagagtcatattttttaagcaatacaatttaaataatttttaaaggaaacatttmtaaaggacgttttacattgcttgcattaaaaagaatataatgaacataatccaactttttctcaatactcagggtcatcactgtgaaagtaacttcattc

SEQ ID NO: 16721 - DNA, 201 bp, Homo sapiens
tgagactttgggttttgttttcctttacaccttgagctttgttctacagcaggtccctgggaagactggtccacaaagctgctgaatggggctgctgtccwtcagccctgcctcctgctgcagaatgcagaggacgctgtagacttgcttggtgggtgcctggggttttctgcctccctggtgcactgggcacagcggctt

SEQ ID NO: 16722 - DNA, 201 bp, Homo sapiens
gagactttgggttttgttttcctttacaccttgagctttgttctacagcaggtccctgggaagactggtccacaaagctgctgaatggggctgctgtcctkcagccctgcctcctgctgcagaatgcagaggacgctgtagacttgcttggtgggtgcctggggttttctgcctccctggtgcactgggcacagcggcttg

SEQ ID NO: 16723 - DNA, 201 bp, Homo sapiens
ggctgatgatgggattggccttcatggggctgctgtctggctgggctggtgggcagaggttcctgtgggtgtggatggagaaatcctaaatgccgagggtrcctggtcttagtagaaatcgtaggatgcctcagtgaagaagtcagggatgcggattgtcctccggatgcttggatgagcgtgcagtggaaaaagtactcc

SEQ ID NO: 16724 - DNA, 201 bp, Homo sapiens
aagtctgtgcttgcattatgtatcaaaacttagtgctatctcctcaggtgcagggttctctggaactctgtctaggttggtctcttggatggcattcttgsagacttgccggaaaaccaaacaaaaggtgtgagtgcatgcctcctggatagatgtctttttagtgtaacttagcacaccttgtacactgtcagggcgcct

SEQ ID NO: 16725 - DNA, 201 bp, Homo sapiens
gcttctatgacttataatattcacttgtagaactcactggcctttgtcagctttcagagtatgtgaacactttttgccatgtaagtagttagtccattggyaatggatatatgtaagttggtatcttcactgcaaacatttagttaattgcgtttattcttgagccattcttgctctacccttaggacttgattttcagta

SEQ ID NO: 16726 - DNA, 201 bp, Homo sapiens
tatcgtataacctggagcaccctcaagctgtccgcccttttcaagttttaaaaatggcttaggcaaacatattgcttaagtgatatccagtgaaggtgtcycctgtgctttgaaaaaccatcaacattgatgcttttttgtgacccaataaggacaagatttcagtggttctgggatgcatttgatctttatgcacacttc

SEQ ID NO: 16727 - DNA, 201 bp, Homo sapiens
gttttaccagttgtcgaaattgccggagtgcagcactgtggagaatggcagttgtaataaatgagaaataccaggtgtttgaattagctgtagattttcayattgtctcttctaaccctgcttgtgcccccgcagcctttttccatttacaactcagtaatgtttgttttcacagagattaccggaggaaatagattataa

SEQ ID NO: 16728 - DNA, 201 bp, Homo sapiens
gtgtgaccgttcattcctgtggttgtaatgtgcctgagccctaatattacacgtatcagacaacagtgtagttctccattggaaaccagctatcttctggttttttttttttttttttgagacagagtctcactctgttgcccaggctggagtgcagtggcacgatcatggctcactgcaatttctgcctcccaggttcaa

SEQ ID NO: 16729 - DNA, 201 bp, Homo sapiens
attattacaatttgatttgaaatgtctagagaaagtgagagattatggaaattaccataaatgctccctttttcatagatttagatctgttaattgcaagmaatctttttttaagtgaatcaatgggaactttttatttcttccctaagattcatttagccttgaaaaggccaaaagttgaatgaagcttctaaatgccaa

SEQ ID NO: 16730 - DNA, 201 bp, Homo sapiens
taatgtgttctacaaaatgaagccagtgagaggacaggggacacagggccgacttttatttaggacatttgcctggttctgagaagaaagttgaaagtcaygagagagagggaaaggaaggcagaaggaacttggtttttgcaggtgcctgctcagcatgggccttgccccagcttggctgtacctcacagcaccatccac

SEQ ID NO: 16731 - DNA, 201 bp, Homo sapiens
cggtttatgtgaaatgtctagaataaacaaatccatagaggcagaaggtagatgagtggttgccaggggctgggggcggatggaatggggagtgactgctrgtgggcacagggtttctttttggggtgatgaaaattgttctaaaattagtttgtggcgatggctgcatagctctaaatatacttaaaaccattggattat

SEQ ID NO: 16732 - DNA, 201 bp, Homo sapiens
tttgctgaagtcttgactgactcagtacctgcccctccctccatctctgaaatgtggagaattaaaagctatgcctgtgaacgggcgttcagtttttagcsgggaaggtgctagaccacttaactctgatagaaataagctgctgagccctatcagggagggcgttctttcagctgttgtctggtggagaaataaagacag

SEQ ID NO: 16733 - DNA, 201 bp, Homo sapiens
tcagaaacgtgagggtgctgattgaagctttttataacttttcttattgagaattgttctctggagttgtctccaagaacaaaggaattccagacgttctycttctctccttgtctcttctgtcctccagtcaaagaaaaactctgcatatgatctttggcctggagaaatattaaatctatgttaagtatgcagacatga

SEQ ID NO: 16734 - DNA, 201 bp, Homo sapiens
tctgaaattcaaaacagcagggatggccttcgccgacgcaggagtcgggcattttaaaataggctgtttttcttttggagcgttcttcttgaaggatattstttgtgcaagacggcgatttttgagaacacaggcaggagggagggggtgttttaatgtatgtttttactccatgataccaaagcttccccccaggatccc

SEQ ID NO: 16735 - DNA, 201 bp, Homo sapiens
gggctagggttaaaacccgtggagtaatacgccctcctattgtgttcctctcctctaaaaatgaaggtgaaactgtttcaggtgagcgctgttgttgttcrtttgctggggcactgctttctgatttttagaggagtccaggctggagactgacccctgcctttttctgagttgggccggctgggcccgaggctggttctg

SEQ ID NO: 16736 - DNA, 201 bp, Homo sapiens
caaattttgtgagttccctggtaactgactgtatggaagacagaaataaaaatcagaataaacttttattttctgaatcagaaagcagttgctccagcttytggtggtcacattgctaagatgtaaaaaacagaagttaggtgaaataaattaagaataattattttggagaaagagagggtagtgtttgactaaattaga

SEQ ID NO: 16737 - DNA, 201 bp, Homo sapiens
tcacaggtgtgagccaccacgcccaccggcctcccatcttaacattttaaagtgttcagtttaagtacctttacactgctgtccaatcaatctctagaacrcttttcatcttgaaaaacggaaactctgtacccattaataactcccattctctcctaccacagccacgggcagccactttctgctgtctccgtgagtctg

SEQ ID NO: 16738 - DNA, 201 bp, Homo sapiens
tctttgtttacagggaaaatgctcttgagaaaatggaggtcattaaacactccagcttcagcaatatcatcagagctttccgtcacgtgagttatctcacmaaagggtcagattctggtaaaaactcttgccttcacacttacttctgttttattttgccttatttgacatttcaccagaattgatccataggttcaataa

SEQ ID NO: 16739 - DNA, 201 bp, Homo sapiens
tcaatctctagaacacttttcatcttgaaaaacggaaactctgtacccattaataactcccattctctcctaccacagccacgggcagccactttctgctktctccgtgagtctgactactttgagtacctatgagcagaatccgcaggatttctccttttgtgactgccttatttcacttagcataatgtcctcaagctc

SEQ ID NO: 16740 - DNA, 201 bp, Homo sapiens
gcttaaggaacatcatcctctgttgggcagaattcttccatggccaccccagcattatgccccacaccatttgacttactcatttgtgaatgccaactcaraatgtattgctttgattcttgattaggatctcaacctctatttattgttaagactatcaccctttgattcccccccatcccattgtgtccttctaaaggc

SEQ ID NO: 16741 - DNA, 201 bp, Homo sapiens
gtgttgggacagggacggaccgtgaggaggctggatcatggggaatgtgttgctttaggccaagctggagttgatagtggctcagatcagagctaaagtartggagacacacagacattgaaagaatgatgaaattcactcattctgcgtgtgtcccatgtcatgtgtccgctgcacaccaagtactgttttaggcactgg

SEQ ID NO: 16742 - DNA, 201 bp, Homo sapiens
aggaaagacgtggggcagcattgtgggaagagcaaccaagattctcataggcttgggagcggaagccctgaggtctgttgctggactagatatgtgaggtktgagaggagagaagaatcaggaatgactctttgattcttaacgtgagcaactcagagaatgagagtgctgcagtttacaagcttggaaggtggattatgt

SEQ ID NO: 16743 - DNA, 201 bp, Homo sapiens
ccagtgggacttttcttctctccctcgtctgttcacttattccgtcctgcactgggccaccagattaatcctgcaaaaggcctcacatgggcttctctccygctcaggagccttgtgggggctttattcctctgagatgaaagttcttatccccacatgtgatcctttatgacttgggtgctatcaaattcatttcctcaa

SEQ ID NO: 16744 - DNA, 201 bp, Homo sapiens
atttcatttcaggtgcagatgccttcactttcccacaaaaaaaaccccaacaaaacctaagaccttactgcaactaagtctccaagtactttttaacccawtgggatgaacagcctgtggtctgctcagatcaccctgagtgcgtgtgagaaggcctgggctttgccaggaaatccaggaaggcagggccgggctgtgttg

SEQ ID NO: 16745 - DNA, 201 bp, Homo sapiens
tctcaccgtggccattacgggctgctgtttacaaaaatcctgcaggcctttgacaccccgtcctcccttcccccggcatccctgcccttattctggctttyttctcttccatctcctggtgagcacagcatactgttctcaggcttgttttccttttattgctctccatgtgggacaggtcatgctttatcaacatgtacc

SEQ ID NO: 16746 - DNA, 201 bp, Homo sapiens
ggtgaagttggaagcatcacttagaaacacgcctcctttgggcatatggtgtgaatcagggactctggctataaaaggtggggtctctgagcaccatcctrgttggaatgttcccctgacttggaggtagcgagagacagccaaggtgtttgttccagggaggctggtgggtgggagatgggatttttctgtctgtggcac

SEQ ID NO: 16747 - DNA, 201 bp, Homo sapiens
cttcctgggccctccgtgctcttctgagttctcttctcaaatacctgttttcttgggtcacaggagattaggagattaaagccattctctctggtcctgcrcctcccttgccaggcgtggctaagaggtttgtccttgtggaaggagctgagtgggttggtcgacctgtgcttttccgtgggtaccttaattctaccccat

SEQ ID NO: 16748 - DNA, 201 bp, Homo sapiens
tgctgtcctctgcaaagaggaatgcttatccctgttacttattcctggtttcctccaagactagtttcagctggacttcagttgccaaggacttgtcttcygtaatgcccacagaaaataataatgccacattgtaaggtgaaaacagtaatcctggtatttttgtattttagaagaaggttgaagggaaagaaaaggatt

SEQ ID NO: 16749 - DNA, 201 bp, Homo sapiens
attatttgtttatttagacctcccattatagaaagtgtgacatgctgggcctctggggaagatttttgagggttttgatgtcagagccccgaactttctcygaacttaattgtctttcagaccctttaagaatgtcacagagtatgatgggcaggatgcctgcggctccaacagctggaacatggtggacgtggacctccc

SEQ ID NO: 16750 - DNA, 201 bp, Homo sapiens
aggggagagcacacctgcagtgaggcaattcacatagcaaagttctccggaaactgcagtgttcaacttttttaaagaatagctggatgttagaaaagtgraggaactgtcacctttattaggggcatcatggatacctggtagcatcaagggctagggttaaaacccgtggagtaatacgccctcctattgtgttcctct

SEQ ID NO: 16751 - DNA, 201 bp, Homo sapiens
tgcacatgttaaaaacattctaggatccacacagtttaaacaaggtggctggcttaggaaatgcttctccccattccttggcatccccacaaccctattcycctactttctcttatgtatctggactggcttttaaaagatatttagtgaaatttaattttctagggaaactccactttgtcaaaagtgtagtattcctca

SEQ ID NO: 16752 - DNA, 201 bp, Homo sapiens
ctgatgccgaatccacttggcagcactgagttacaagaaggttaagtagatgaactagaagatggataaacgaagatagataaaatgaagaaaaacaaaartcaaggagaactcaggcgtccaagagtgtgtaaacaacttctggtgtgagacgcgctacattgcgctaaatggcctgtgcgcttctggtttttcccttcc

SEQ ID NO: 16753 - DNA, 201 bp, Homo sapiens
atccagtatgactgctcttccatagatgatgaaaccaaggcagagaaataagatgtaactctcttaccttgattagtgatgagaatgggacagctttattyatgaaacccggaaaccactagcccattcttgggatgattgatatctgcaaggatcttcaggaatagagtacctggggctcaggagccaagactagaagtg

SEQ ID NO: 16754 - DNA, 201 bp, Homo sapiens
aaaacagcctgcgtatgttcttgcttgcaactcagatatccagcccactgatccaggaagagattcctttgacctgggaagtcataatggcagatatttaracccagctctcaagcaagcctccaagttgttccggtgaacccgtaactttgagtaacctctgattgaaccagagagtaggaactaggtgcagaaccttgt

SEQ ID NO: 16755 - DNA, 201 bp, Homo sapiens
ccatggatctgtggttattagatactgatttcactttagcacacgaagaggcttagcggaggtggcttctaatatcctatggttctgtgggctcggagatrctactcacccacttgtcagaggcattgaaaccagagcaactgcatcttgaataggagctaggtaaaatgaggccgaattcccagacagttaagacattct

SEQ ID NO: 16756 - DNA, 201 bp, Homo sapiens
ctgtgagcttgcaaaacgcatttttaaggagtctcaacttttctgatttgtgttaaagtttaggtgtgggtcccagaaatgagtttcatggaggggagagsttgtctctctgggtgggtaatacaggggccactgggggctcactgtggctttctggcacagacagttatgaagcaggggttactaaagtgggagagagca

SEQ ID NO: 16757 - DNA, 201 bp, Homo sapiens
gtgggtcccagaaatgagtttcatggaggggagagcttgtctctctgggtgggtaatacaggggccactgggggctcactgtggctttctggcacagacakttatgaagcaggggttactaaagtgggagagagcagccagttctccagcagccccagtgagagctctcatggatctgcctattgcactggggtaggagcc

SEQ ID NO: 16758 - DNA, 201 bp, Homo sapiens
agtttcatggaggggagagcttgtctctctgggtgggtaatacaggggccactgggggctcactgtggctttctggcacagacagttatgaagcaggggtkactaaagtgggagagagcagccagttctccagcagccccagtgagagctctcatggatctgcctattgcactggggtaggagccatcaccgtcagctttt

SEQ ID NO: 16759 - DNA, 201 bp, Homo sapiens
gaaataatttcacctgccctgtgtaattctctggaagaatcacagtgagttggaaggaaacttaagacttggaaaaggattgagaggttagcccagaccayaccagggctctgaaggcccagctggggttagaacctgggacaccctccagcccactgtctcctgttccctggccatttactgccccactcccctttctac

SEQ ID NO: 16760 - DNA, 201 bp, Homo sapiens
tgtgcgtttttgatatttgtatatttttactcagtgtgtttcaaagatctgcccatgttgtgtggggctgtagtttattcacttttgctgctaacattccyttctgcgaatacatcacaatatactgtattacttgatacttgtcaattgttgtgctgtttctcacgtttgcacttgatgtatatgatatacattacattt

SEQ ID NO: 16761 - DNA, 201 bp, Homo sapiens
acatggtggcagcaagagaaaatgtggaagaagcaaaagtggaaaccctgataaacccatcagatctcgtcagacttattcactatcatgagaatagcacrggaaagaccagccctcatgattcaattacctcacctgggtccttcccataacacatgaaaattctgggagacacaattcaagttgagatttgggcgggga

SEQ ID NO: 16762 - DNA, 201 bp, Homo sapiens
atcagtgacatatgtaaatgttttagggagctgtttactgtaacattacctactttagctctgtgcagttgtctggcaaccaatgtgataaagacagaggraagtgctgtattttgttgctgacaagtatatcttaaaagtgcaggtgcacctgaataggcaataaagtattaagagctgctcctggagcagtttgctctc

SEQ ID NO: 16763 - DNA, 201 bp, Homo sapiens
aaaccctgataaacccatcagatctcgtcagacttattcactatcatgagaatagcacaggaaagaccagccctcatgattcaattacctcacctgggtcyttcccataacacatgaaaattctgggagacacaattcaagttgagatttgggcggggacacagccaaatcatatcaccctcttagcaaggactgtgttcg

SEQ ID NO: 16764 - DNA, 201 bp, Homo sapiens
gctcctggagcagtttgctctctgtgacgtgtgaaaagtctacggggtttataattggtctggccatacggctgcctaggattagactcttttcatatccyactaaacactctccttagaagcaagcacaaggagatagtttattttaaaatgtaattgctatgttactaagatttgaatttgagtaccgagaataaacca

SEQ ID NO: 16765 - DNA, 201 bp, Homo sapiens
tacttcattccatcctgggagacagagtctcactctgtctccaaaaaaaaaaaaaaaaaagagaagttcgttataacaaatgccatatgcccttttgtacrtgtcaactggacttctataaatttgtcattggtttatgcttttgaaaataagatgttagcattgtttaaaaatgtgataactataactttgaaagcaaaa

SEQ ID NO: 16766 - DNA, 201 bp, Homo sapiens
ctcagcttccttctaaggtcgttgtgagaggtaaagaaaaggggttagtccagggccagacatggcacaatgcctcaatgaaatattagctgatactatcrtaatttttaaattcccataggactcactgttaaaggattacaaggctgacacaaaaaatactgcattttgaatttgtgtctgatttatacatttccaaag

SEQ ID NO: 16767 - DNA, 201 bp, Homo sapiens
gaatcccagaaagtaataagcacttatttttcatggaaaggaaccggaagtgcttggtgacctccacaggtaatcttgtattatttttgcactgtttggarttttttaaccatgtgcttttatttcttctattcttttcaaaggtcagtaggtgttatctggacaatagggttctggtctgttttctgttttcttcattgt

SEQ ID NO: 16768 - DNA, 201 bp, Homo sapiens
gtgcagttgtctggcaaccaatgtgataaagacagagggaagtgctgtattttgttgctgacaagtatatcttaaaagtgcaggtgcacctgaataggcartaaagtattaagagctgctcctggagcagtttgctctctgtgacgtgtgaaaagtctacggggtttataattggtctggccatacggctgcctaggatta

SEQ ID NO: 16769 - DNA, 201 bp, Homo sapiens
acagttcttgattttttgggttttttttcccccaaacatttatctacctcactcttattttttatatgtgtatatagacaaaagaatacatctcacctttytcagcacctgacaataggccgttgatactggtaacctcatccacgccacaggcgccacacccaggtgatgcagggggaagccaggctgtattccggggtc

SEQ ID NO: 16770 - DNA, 201 bp, Homo sapiens
tcttctgaattcgttgatatcccttgttgctgttcacaatacacccactcccagccctccgtgatggagataactctgttccccacaactagggcttgccsactctcatggtacttctgatgtttaattcttttggctgtgtctgcatttcctcatttacttttaatttgcttatccctagaacataccttttgagtgcct

SEQ ID NO: 16771 - DNA, 201 bp, Homo sapiens
tcaatcacgttcacctgttggagcaagtagagtttcagacggtctccgcttttctcgactagaaagcaggccttctcccttttccccccagtcttgtttcmtgacaccattcccctctgagatgagggttggagaattagaagtctactgatgcattgtaccggggcacgttattgaccctctctgctctcctttcctcat

SEQ ID NO: 16772 - DNA, 201 bp, Homo sapiens
ctgttcacaatacacccactcccagccctccgtgatggagataactctgttccccacaactagggcttgcccactctcatggtacttctgatgtttaattmttttggctgtgtctgcatttcctcatttacttttaatttgcttatccctagaacataccttttgagtgcctaaacttttttatcttcctgtcctgaagac

SEQ ID NO: 16773 - DNA, 201 bp, Homo sapiens
ccctccgtgatggagataactctgttccccacaactagggcttgcccactctcatggtacttctgatgtttaattcttttggctgtgtctgcatttcctcrtttacttttaatttgcttatccctagaacataccttttgagtgcctaaacttttttatcttcctgtcctgaagacaaaaatttaatctgtgaattaaacc

SEQ ID NO: 16774 - DNA, 201 bp, Homo sapiens
ggtggggctgagggcagccagtgtgactgaggctcgctggcccaccctgagctgcttgtgcccatggggcccctggggaggagggcccagctgcagtgcgsatacatctgcccttggcagcagatctgtgaacccaggctgccattctggatttccggatagatgcaaagtgcttggacgtgttttagcagctgctgagac

SEQ ID NO: 16775 - DNA, 201 bp, Homo sapiens
aacttaaaaaagcaacaactaacttatttgtatcttttcctctaatatttagtttttacttcacttgtaacttattacatgtattaaggagtttatttttwtatgacattttactcataaaaggatgaaaccaagattggtgatctgttcacatagattaaaatcctgtttgtgaccacttaggtgtgtaatgtgtgactt

SEQ ID NO: 16776 - DNA, 201 bp, Homo sapiens
caccctcaaacagttacccagtgagtctcctcaaagcaagtggcactgagatacaaccttcctacaggttttcaagtcatctcgtgtggtgcacagtcctsgccctacctcgaaggcccgggcgaagttttcctgagtgtgtatactcatctctttgtgttgtctctggcagggagcaagtgagtacaggattggagtaat

SEQ ID NO: 16777 - DNA, 201 bp, Homo sapiens
ttttgagaatgtgttttccttaatatttgttaaatgagtagactgtattcttaaggtttagaaaggacagaaacaagtttgtgcttagttcttctgaattmgttgatatcccttgttgctgttcacaatacacccactcccagccctccgtgatggagataactctgttccccacaactagggcttgcccactctcatggt

SEQ ID NO: 16778 - DNA, 201 bp, Homo sapiens
agaatttaaaataaaatacattttgacccattgtattgagagctggtataatttaatatagtgagcccctcggcttctggttggttgggttataaagcttsttattcattcgctcatccattaatgcatttctcctatgaggaagctttttcctttgagctgaacacacaaaattaatcgtgctcgaactctccaaatttt

SEQ ID NO: 16779 - DNA, 201 bp, Homo sapiens
gccttcacaggaatagaggcctaggattcgccttcatcctcttgaagagccctaacagtaggtcctggctggggtctggcatagaatgcccttggcacgaygtgtgtgagtgtgtctttccttagtaaatggccttgaaaatgccatgtgcttctggcaggcctggataaggtttgccctgcataacccttggaaagcaca

SEQ ID NO: 16780 - DNA, 201 bp, Homo sapiens
gaagagccctaacagtaggtcctggctggggtctggcatagaatgcccttggcacgatgtgtgtgagtgtgtctttccttagtaaatggccttgaaaatgycatgtgcttctggcaggcctggataaggtttgccctgcataacccttggaaagcacagttctcacttgtaacaccctgtctgcaggtccatgatattgta

SEQ ID NO: 16781 - DNA, 201 bp, Homo sapiens
caagatttcagtggttctgggatgcatttgatctttatgcacacttcagctctgggtttcagttcaggggtcagcataagtaaagcttgatcagataactrtgctttgcctataatcggcattcattctgctggtgacagagtcctttgctcaaaatgaggcttccatgcgtttgcagttctaaactgcttttcagagtca

SEQ ID NO: 16782 - DNA, 201 bp, Homo sapiens
gcttagttagacatggaggatgcatcttaacaagttagtacctttttgcaaagcatgaagactaattcaaagtctattttctggttttgctctaccagtayggccaaaaccatttctttttaagtgagaagtggggatatggtcaggtttgattccagttgaagttgtgagctgcacagggctggtctgagcccagtggca

SEQ ID NO: 16783 - DNA, 201 bp, Homo sapiens
ccagcctgggcaacagagtgagactctgccccaaagcaagataaaattatcccacaggattttagtcctgacttgtgtattactatgcagttgtgtctgtstgaggctcagattcccccccatttaggatttgtgtggctaaatctcagatctcattttcaggtgaatttctctattaaggttataaaagaccaaaataac

SEQ ID NO: 16784 - DNA, 201 bp, Homo sapiens
gaaaataaaccccacataactagtgctgctattgatcattcatatagccagcaggagtggtgagaggcttggtctgcctgaggtgtggagatgcttgtggyggggggcaaggtggacgagggctggggctgctcctggagcatctttacgcgggtggaggagctctgacacagtggcagtgtttgtaacactttccaaagg

SEQ ID NO: 16785 - DNA, 201 bp, Homo sapiens
gaacgaccatatccgtggggccaagagtgagatcttgtacattcgcaccaatgcttcaggtatccatgcctagacaagcccccagcatccacacttcttcrcaagctcactggccttgcttgtaccaggtgtcattgtagggttagcagtgagctatgcctgttgtctttcttgtcaataggtaatactgtgtcatattca

SEQ ID NO: 16786 - DNA, 201 bp, Homo sapiens
cacagcccggattcaggccacatctctctctgggaatgggtcgtggacagatcctgtgttcttctatgtccaggccaaaagtaaggcttgtggagggagamgaaacgtggtaaaactgaaagcagggtggtccaggatcaggacagcccgagtgttcatggctgtcttattttctgttaaaatggagttggccagcttcca

SEQ ID NO: 16787 - DNA, 201 bp, Homo sapiens
gtagaaacacacacgagataattctggggatggagcttaaagggacgtcagcgttcaagggccaggtagaggatcatgagctgtaaagggacccaggtggytccagcacagcgaggaaagcatgcgagtgtgatggccaggcttccagggagagaggagggttttaaggagaacaacgtgctaaaagccactaagaagcca

SEQ ID NO: 16788 - DNA, 201 bp, Homo sapiens
tcagggctctcaggaaagagccgcccgcgtccctggctgggcttccttggtgcacccagctcatttctccttccctctctgtagaactcacattgtccccrtggaaatgccagccagctcccctttcccagtgcaggggggagccaggtgggcctgaggtgggccagttctgccgctaatgggtgagagacttgggccagg

SEQ ID NO: 16789 - DNA, 201 bp, Homo sapiens
tagtggattagaaggagatttggagatttttaaaaaagcctctggacagtgagttaaatggtgggttgacactctgtggtcgggactttttggagagtctrtaaagttctgctgtatttctcaagagctagagagagatgatactatgaccaaatttggtttgaatgtattataatgtactgagtatcactaatttgttgg

SEQ ID NO: 16790 - DNA, 201 bp, Homo sapiens
aaatttctctttgtccctgcagggactgttgcagagcattagagccaccctcaaacagttacccagtgagtctcctcaaagcaagtggcactgagatacarccttcctacaggttttcaagtcatctcgtgtggtgcacagtcctcgccctacctcgaaggcccgggcgaagttttcctgagtgtgtatactcatctcttt

SEQ ID NO: 16791 - DNA, 201 bp, Homo sapiens
ttgcctaagagattcgatttggctgctgctaggctgcttaggcaggtgacagcatggtgggacacttctcatttttctggttagactacttaaccataacrttcatggtgccacctgaaaaaataattttatcgttttagacttttaaaatatttttaggctttttttttttttggcttaaaaaaagaatctgttctactt

SEQ ID NO: 16792 - DNA, 201 bp, Homo sapiens
tttttttttttttaatgttctttgaatcggcaacttaatcatctcccaagtgacagtttcttaattttagttccaaacacctgttcacatatgacttcatktatttgcagcacatggtgtttggggccaagtgtggactggggcttcaagcaggatggtttacaaaactcccaccctctgttctgccaagcattggtcccc

SEQ ID NO: 16793 - DNA, 201 bp, Homo sapiens
cgatctcaaaagttatctccggtctctgaggccagaaatggaggtcagttttcatttccaccggtattgcatgttgcctggcctgctctcttttcctttayaatctccctgcaaggaaatgctgtgtctttaaatcagtttactttccagcatccagtgtttcttactgcatgctcagttgtaggtcatttatgcaaagga

SEQ ID NO: 16794 - DNA, 201 bp, Homo sapiens; identical to SEQ ID NO: 1549

SEQ ID NO: 16795 - DNA, 201 bp, Homo sapiens
ttcttctcaagggctcaagatgttttcccaatgcccagcgtctcatggatgacaaatatgacaagtaattttaccagaggcagtttgagggctcttagcayagcacaagtaaattatgttggttcaagtccaaggaactttgttctctttgtgtttgcttttgtagccttacctctttggggcatgagttagagacataca

SEQ ID NO: 16796 - DNA, 201 bp, Homo sapiens
agtgatccacccacctcggcctcccaaagtcctgggattacaggcgtgagccatcatgcccggccttcttctagatgtttaaaacaaacacattttagtgyagttgagcctctgatcgttacatgtttatttcctagcatttaaaagcctttcagcgacatacactccttattagcttaattttttcttttaagagccgtg

SEQ ID NO: 16797 - DNA, 201 bp, Homo sapiens
tgctggttgagcttctgctaagaggtttccttccagggactccatgttcactgcctcacaaaggcaggccagcctcatgctttagacatccttgctcttarcaaatctttcgtgttctgctacgtcagcctctgtgtgacacccattggaccttctctctgtagcacaattgcataccttgctctgttcttgataagatag

SEQ ID NO: 16798 - DNA, 201 bp, Homo sapiens
gtgtagttgagcctctgatcgttacatgtttatttcctagcatttaaaagcctttcagcgacatacactccttattagcttaattttttcttttaagagcygtgttcttgctctgtcacccaggctggggtgcagtggtaccatcgtaactcactgaagccttgagctcctggcttaagtgctcttcccaccttaaccttc

SEQ ID NO: 16799 - DNA, 201 bp, Homo sapiens
caaactaacggtaggactttcctcagggatttaacgtttgctgtagaagactgaatgatagaatatataagctgtatttttcttgtgattctacacattgyccatgttgcaacttaaatatttttggaatgcaatgtaaaagtgatttactgtcctataattgttttcctgaaagcaaaatgatatttaagtgaactgcaa

SEQ ID NO: 16800 - DNA, 201 bp, Homo sapiens
ggttaggtgataccgccttgccagataaatggccgggactaggtagatgctgaacccagtatgctctgcgttcaaagcacagatcaggggcttcctgaccrtgcaagggatgccggaagcgccctcaccaccttccttagctccaccaccggggctgaatttagtttacggggaacattagcagcaacagagggaggatga

SEQ ID NO: 16801 - DNA, 201 bp, Homo sapiens
tttctgagcccacaccaggtcatttttctataaaatcagaactgtgagagctcagggcatgtggccatcctggataatgggtcctgctgtctggggagtcrttttcatcaaaattcacttttaaagaatagagtgtttattaacgaaaatatgtgagccttggctgggcactgtggctcctgcctgtaatcccagcacttt

SEQ ID NO: 16802 - DNA, 201 bp, Homo sapiens
tataaatctagacttcctttggaatttgtttcctttttctcagccaggtgtatgaagattttaagttcttaggcctcagtgggaagaagatttaaggttcyaagagtacatttgtatctcttttaaattttctattgtttatcagtgacatatgtaaatgttttagggagctgtttactgtaacattacctactttagctc

SEQ ID NO: 16803 - DNA, 201 bp, Homo sapiens
gtcctgctgtctggggagtcgttttcatcaaaattcacttttaaagaatagagtgtttattaacgaaaatatgtgagccttggctgggcactgtggctccygcctgtaatcccagcactttgggaggccgaggcgggtggatcacaaggccaggagatcgagaccatcctaacgcggtgaaaccccgtctctactaaaaat

SEQ ID NO: 16804 - DNA, 201 bp, Homo sapiens
aggagcttggaggtcagcttgtagtataataaaatagaaaactatacagccggggagaacagaagcagaatagaaggataaagtgttgttcatatctctcrggcaaattttacccaaattctgacgagcagttactgcacaagcaacaacaaagggacctagagtgtgttcattgccaattctgtccatttggctacataa

SEQ ID NO: 16805 - DNA, 201 bp, Homo sapiens
caccctctggtccagcgtgcctgttacagtgatcactccatagtggttttgcatgaacaagactgcccagtttgcttaggaagaaaacaaaggacataagktagttctcatgtcttcccagcaccctaaatactcgggctaaacttccacagtcagaccgtcagcttcaggaagggctgctgttgggaactttttttttag

SEQ ID NO: 16806 - DNA, 201 bp, Homo sapiens
tctgacattacttagaagtatgtctgtccttgaatttttcttttgcttaccttttgatattgtttatatgatttatgaatgcagctctgaggtatctgagrggatttattaacgtttacttgcgtccaagtacatgattaagttttaattgctttgtggacattaaaaaattatgcccttggtaaaatgcaaaggttttat

SEQ ID NO: 16807 - DNA, 201 bp, Homo sapiens
ggctcagtggaggtcagagctgctggagcagggaggccttgttgtccttcctggaatgagtttgaggagggggtgaaggtgttccagttcagtcatcaggygcacaacaggtacaggttgggagcagtggccttgcttttgacatgcactttaaggcaggcttcagagattgatctggatctccatagctgaacaggaagg

SEQ ID NO: 16808 - DNA, 201 bp, Homo sapiens
gagacagtctcgctgtgttgcccaggctggggtgcagtcttggttcactgcaacctctgcctcccaggttcaagtgattcttgtgcctcagcctcccaagyagctggggccacaggtgtgagccaccacacctggctaatttttttttcttttctcttttttgtttttgtagagatggagtgttgccatgttggccaggct

SEQ ID NO: 16809 - DNA, 201 bp, Homo sapiens; identical to SEQ ID NO: 1573

SEQ ID NO: 16810 - DNA, 201 bp, Homo sapiens
ggtcagtgttgtcctgctagtgatgagtatcccatggtgggcatgctgatgccacgcaagggagagggtgtctggttctgtgcagtggcagtggtgcaacyccttaccaaggtaccgtggggacctgggttagggcaggaggaggaaggtgttctctacagactgcagggcttggaggcagcctgtcatggggaagggtgt

SEQ ID NO: 16811 - DNA, 201 bp, Homo sapiens
gaacttaaatattaacgtgtatataagttaatagtaagtagaccgtgaatttagaagagtaaaacagaatcatgagtacgtagtcactgtggccccttttytgctggatttcaagttcgtaagcatttttggaagagagtcgaaggggaaggggtggcttgccagtcagttgagtgatgcgtgagggaggcgttaaatgtg

SEQ ID NO: 16812 - DNA, 201 bp, Homo sapiens
accccttaccaaggtaccgtggggacctgggttagggcaggaggaggaaggtgttctctacagactgcagggcttggaggcagcctgtcatggggaagggygtggatgaagggtgagccgggaccccaggcaggtacggagcagttcaaggccgtcaagtgtgcttcattcttcagtcattagggtgtctctgaaaggttt

SEQ ID NO: 16813 - DNA, 201 bp, Homo sapiens
ttagaatttaaaataaaatacattttgacccattgtattgagagctggtataatttaatatagtgagcccctcggcttctggttggttgggttataaagcytcttattcattcgctcatccattaatgcatttctcctatgaggaagctttttcctttgagctgaacacacaaaattaatcgtgctcgaactctccaaatt

SEQ ID NO: 16814 - DNA, 201 bp, Homo sapiens
tttctgtaagaactcataaagctgtatgcatcagctgctcccaggggccttctaaggcctcagtccaacaacagtgctacaggtgaggaaaggaaagaagrcactatgtcatcatgtcattcttttagacttggtaagaagtatattcaagcagatcagatgctctcagaatcacagcgtgttgtactgctagtaattaaa

SEQ ID NO: 16815 - DNA, 201 bp, Homo sapiens
ttgacccattgtattgagagctggtataatttaatatagtgagcccctcggcttctggttggttgggttataaagcttcttattcattcgctcatccattmatgcatttctcctatgaggaagctttttcctttgagctgaacacacaaaattaatcgtgctcgaactctccaaattttgtgagttccctggtaactgact

SEQ ID NO: 16816 - DNA, 201 bp, Homo sapiens
ctgctcccacagaagggaagcacaggcctgtggggtggagggggctctgccctaagcgcagcccctgtgggccacgggtttcctgtcccttacactcggcygccttgtttctcccaccccaacatgaaaaagatggagtgagcctgcagccctgagttgatattgctttttaaattgagaacaatataattacagccttgt

SEQ ID NO: 16817 - DNA, 201 bp, Homo sapiens
acctggcaagctgaggccctaccagtttaaggtgatgattattgtttcttgtattaaattttaaaatgaatttttctccgctttttttttttctaagtagrtttgtgtttctggaatctcgggtgtctgtgagcatttcttcttcagcagagcagtagctgtcaaattttcttgttgcttaatgatatacttttttgtttc

SEQ ID NO: 16818 - DNA, 201 bp, Homo sapiens
gcataaagctggaatgatggacatgatttctttaatcactccaaattagtcatttagttgtttccagttttttagtattacaaataactctgcaataaacrtgtcttgggtatgcattcttttagtttaaaatagtcttgttccttcagaaagttgctcaataatagacttagaaattcttttgtgctaattactgtaatt

SEQ ID NO: 16819 - DNA, 201 bp, Homo sapiens
tgtttctcccaccccaacatgaaaaagatggagtgagcctgcagccctgagttgatattgctttttaaattgagaacaatataattacagccttgtactgkttataaaactttaaggtctcatatcagagatacagcagtgcctttctcatctaaccctgtgtagaatacggctgttgagaatggcgtggctctctggctg

SEQ ID NO: 16820 - DNA, 201 bp, Homo sapiens
taaatgtagggaaggtgaagtgttcaccttcagatggtagctatttatctcagcaagaagagcagatgactaacacccaaatacataaccattattatatracttagcatttataaggcatttctatgcatcctgagagactagagcactctcaaatgaggtttcagagtaagattcatctttgcaaatgaagacaaatta

SEQ ID NO: 16821 - DNA, 201 bp, Homo sapiens
tcttttcacctttggcttttaataagggaagggtattagaaaaaaagtaatttgtatgatgaagggtgatttgtgcgtgtgtgcagacagacacacatgcrgggaggcaaatcagaaccgatgcgtgtttggctttggcttgtttcgctggtgtctggatttacctggcgacacttgttgctctgggggatcttagaggga

SEQ ID NO: 16822 - DNA, 201 bp, Homo sapiens
caactggataaagttactgcataagggtttctttacagcctccctgtttttctcagactaactcttggtcagtcttaaattcttaaaattccatcatctgwtagagctaacgagagcgggcagctcttcattccatccttgaaaagcacagtgtcctccccactggggaacaccaatccttaaaaaacttctttctcattg

SEQ ID NO: 16823 - DNA, 201 bp, Homo sapiens
ggtccacttaatggaagagtctaagagtggcttcaggaagtccactgggggctccccgtgactctgcccacctgcatattgtcttcattctaaggatccakgtggtagcaaaagggttgttacaactttaaccctgcatccccaccttcaggttcagtacccaagggtgagcaatctgttccagtggcacagacctgtttc

SEQ ID NO: 16824 - DNA, 201 bp, Homo sapiens
ccctctcgggctgtccctgtgatgtcagtcacagccagtgacagccatgattgggaaagtgttagctcgaggcctgtcattctttagtgagtgattagagrtgtttgaataaaataaacccaaaatggggaaagcttgctttttccagaattaggtcagtccagactcatgaacgatgatgggggacttcactgaaatatc

SEQ ID NO: 16825 - DNA, 201 bp, Homo sapiens
agtaatttgaaacacccgtgtaaactacctttggcaaataggatagctaaatcaccgctaagatttataatttactttttggatatctgaaacatcaacartatagccatccatggcgtgttcctctggagtgtggtccgtgccgtctctgcctgctccatctggctgatcccaggcaggcagctcagctctcagcagaca

SEQ ID NO: 16826 - DNA, 201 bp, Homo sapiens
tgacagccatgattgggaaagtgttagctcgaggcctgtcattctttagtgagtgattagagatgtttgaataaaataaacccaaaatggggaaagcttgytttttccagaattaggtcagtccagactcatgaacgatgatgggggacttcactgaaatatcgtttcagcctccttacctactaggcctactccaggaac

SEQ ID NO: 16827 - DNA, 201 bp, Homo sapiens
atgtcattcttttagacttggtaagaagtatattcaagcagatcagatgctctcagaatcacagcgtgttgtactgctagtaattaaaactgaagtccacrttgaataagaaataattttttattgattgctggcatttgtgagaaagggtttaattagaccaggatatggaggggacttatcgacagttccgttgtacat

SEQ ID NO: 16828 - DNA, 201 bp, Homo sapiens
ttctgtggatgaaacttcgaatgaggattgttggtgagagttggattgttgttgtatgaggaagtgcaccttggaatctaatggggtcttcacggaggggragtcagttgtggcactgtttgtgtattccattcatcattcatccctccatccaagcacccacgtggagctcagaaagatgactaacacataccccctgct

SEQ ID NO: 16829 - DNA, 201 bp, Homo sapiens
gaacttgatcaagacccagaccaccccaggtctccttcgtgggatgtcatgacgtttgacatacctttggaacgagcctcctccttggaagatggaagacygtgttcgtggccgacctggcctctcctggcctgtttcttaagatgcggagtcacatttcaatggtacgaaaagtggcttcgtaaaatagaagagcagtca

SEQ ID NO: 16830 - DNA, 201 bp, Homo sapiens
caactacttaggatttttgttgttgttgttgttttcctgtacattgtcttcctatctcccttctggtacccattccaccctctctccccttcctcactgcygtttcataggggttctcagattcctgtgaataaagcaaaccgatgtgcagatatgtgtgcttacacatgtggacgtatttgaggaggtaagagggacctg

SEQ ID NO: 16831 - DNA, 201 bp, Homo sapiens
accatctctgtgcgaatccccagggtaaaggcgtgggtcattgggtttgctccccttgctgctgctccatccctgcaggaggctcgcgctgaggcaggacygtgcggccatggctgctgcattcattgagcacaaaggtgcagctgcagcagcagctggagagcaagagtcacccagcctgtgcgccagaatgcagaggct

SEQ ID NO: 16832 - DNA, 201 bp, Homo sapiens
ttgctccctgttcagatcatagtaaaatcggatgtatccgagtatttcagagtgcttgtctccttagagtcagccagtctgacctgtcagatcataatacrtagtagccgtttattttcttttgaaagcaaaatcatggtttcctctctaaataacacttcagcaggaactgtgacatttcccaatctcagttgcgcacat

SEQ ID NO: 16833 - DNA, 201 bp, Homo sapiens
acaaggcattttaccaagtccggctgaaagagcttcttaccacatctggcatgtagaatggcagaagactatttttgctagattccttgttgctgcagccrtttctgatgtccttttccccttcacacctttcgtgttacacatgtctgagatgacatgatgctaagtaaccaaagtactgctgcgatggaattgctctga

SEQ ID NO: 16834 - DNA, 201 bp, Homo sapiens
agtgttgggggctgtgtaaacctcgaggctcagagtggctgccattttcctaaaagagaagtatggctgctgttggcctcaatgttcagctttacaaaaaytcccgtaattaatgaaggtcaaggcatctgcaaacattaatggggtcacaagggacaaatcagttccttgaggggaagttaaaatgctagattgcttacc

SEQ ID NO: 16835 - DNA, 201 bp, Homo sapiens
tgttttggtgaaacctgataaccttgcttttctccgtgtaccttgtttttcattgtaaaactatttaattatgaaaatgagagtgtgaaaggcaaagtatrattgaatttagggggcagttccatatagttgtaacaaactgattatcaaatgtccaccattagtatgttaaaatacggttttctaatactgagacaacag

SEQ ID NO: 16836 - DNA, 201 bp, Homo sapiens
aaggtcaaggcatctgcaaacattaatggggtcacaagggacaaatcagttccttgaggggaagttaaaatgctagattgcttaccgctccagacaaggcrttctcaagaagtatgtgcagtttcagcacaaggattaacacggagcattacttgagccatggggtgccttgggggacatggatcagcaaccatttccttt

SEQ ID NO: 16837 - DNA, 201 bp, Homo sapiens
tcattttgggttgaggtatcccctggtaccctctcctgaacttcaatagaataacatgatgtggtgaatgaaccatattagaaaaaccagccaatcagccragattcttgtattgactcttctgatctccctctacctctcctttccccatctgccaaacaaagggtttggaacagttaaattctaaagtggtgtcattga

SEQ ID NO: 16838 - DNA, 201 bp, Homo sapiens
gtttgaatcaattatttttatctctttgggattggtttttggttaatctcagcaattcagaaatagctgaagaactatgctgtgggtttagacatcatgcygtgacaaaaagaagaggatcttagaagcgggggacattcactgaagctttatgagcctttcctgaatcccttcaaatcagatcaagttctctctctcctg

SEQ ID NO: 16839 - DNA, 201 bp, Homo sapiens
tggcacagagatttgctgtctggctagcagtacttcagggtactgggtggcttgaggacctcctgttagaagcttggattcacttttcccaaggcaaccasgattggattctattagttctgggtcttgagagcctgcaagggcttccttctgcgaaggtgagtctgggagagacgccatggagtcagtgtgagttctgca

SEQ ID NO: 16840 - DNA, 201 bp, Homo sapiens
gtcaagccactgttgtttcagagctggacacaggtgcttaggaaaattcctcactgaagggttttcaggatttacaagttcttgctgtttttgtgaccttstgtggtttctggtttcacagaaggctttgtttcttggttcttgttgctgctttcagccttggcctgtaatcactgggcgccagggagggctgcggtctgt

SEQ ID NO: 16841 - DNA, 201 bp, Homo sapiens
tttcttatactcagtcatttgtgaatgatgtggttcaaacaaaactgaaacaaaaatagtttttctcattaaaaatatgtttgtcgcatagccagcactcrgaactagggagggtaacatggaagtattgtcattctcggggctgactggttgacagcagcctatacaggagtggagaatattgacagggctgcccgttct

SEQ ID NO: 16842 - DNA, 201 bp, Homo sapiens
aggaatgatgaccgaagaggaacctcaagggtgcaggcggctctgggatctcagcacatctcagtgatggaatgagctgccggggaatgacccctgtgggkgctgtccaaagtcagagcagacacaaacgtagctctccaggccccataccttggtgggcaagagggcagcaagtgcatcctcacagttgatggggagagc

SEQ ID NO: 16843 - DNA, 201 bp, Homo sapiens
agaatgggagttggaaagaaatgttttctcccacacctgtcccgctcctgtctactgaaagctgattaatcagtcagatagtgagttcctattggtagtamgcctccaaaatttggaagaggggaggtggcgtgatgtgaaaaagcaaggctttagggagagattcccgctgggggcattcaccctctggtccagcgtgcc

SEQ ID NO: 16844 - DNA, 201 bp, Homo sapiens
ttactagttacgtagctcaggaacctggaaccagactccttctccagctgggcagtcccaggtttgagtcctggctccactggaggttgtctgacttggakgttaataataacctgccttagtcccagagtccttagagggaaaataggttataatacctgagtccatgtgtatcaagccattgctggttccaggcccctg

SEQ ID NO: 16845 - DNA, 201 bp, Homo sapiens
gatgttcagaaccttgtgtgtatcgtataacctggagcaccctcaagctgtccgcccttttcaagttttaaaaatggcttaggcaaacatattgcttaagygatatccagtgaaggtgtctcctgtgctttgaaaaaccatcaacattgatgcttttttgtgacccaataaggacaagatttcagtggttctgggatgcat

SEQ ID NO: 16846 - DNA, 201 bp, Homo sapiens
ctgaggagaggaaggtgtccaggcagcaccatctctgtgcgaatccccagggtaaaggcgtgggtcattgggtttgctccccttgctgctgctccatcccygcaggaggctcgcgctgaggcaggaccgtgcggccatggctgctgcattcattgagcacaaaggtgcagctgcagcagcagctggagagcaagagtcacc

SEQ ID NO: 16847 - DNA, 201 bp, Homo sapiens
gcaggagtcgggcattttaaaataggctgtttttcttttggagcgttcttcttgaaggatattctttgtgcaagacggcgatttttgagaacacaggcagragggagggggtgttttaatgtatgtttttactccatgataccaaagcttccccccaggatccctttacagtggttagttcctggaaacctgatgggtggt

SEQ ID NO: 16848 - DNA, 201 bp, Homo sapiens
ctctcttaagaagtttcagggcagcctaaaggctcaccttcaccctaccaggccccctttcatagccaggatcttagggatggagaagaaagataagttcrcctcgttcactgaagtcgccccttgttttcaggttaggaaacccaggttcatgtccaagtccctgggcaagtagccagcgtaactgattgacctaaaaca

SEQ ID NO: 16849 - DNA, 201 bp, Homo sapiens
agaaatcactgggctacagttttggattaaggttactctactgtgtcagtgcgagctgtcctgagagaattagggtcttcctaagtgatgcagacaggcgyactgcaactccatggcagagctgttaacacctagtgtgtcttttacagttagagttttaagataattttacaggactttaataaatttaaagctccaaaa

SEQ ID NO: 16850 - DNA, 201 bp, Homo sapiens
cctgtggatggagactttgttccataagttccctatagataagatgtaatgaataattcattggcaccgatttatgtctgtagtgtgcttttaaaccctcytggagctgggttcctgaggaggaagcatctgcaggctggactcggctgcctggtggtctccggagtggcctggtgcagagggccagggtggcatctcaga

SEQ ID NO: 16851 - DNA, 201 bp, Homo sapiens
ttttgcattgttttcttggtgaggccagtaagcttttgcctcactcctgggagggacagtagcaaggtcttacaggtctctctatcattgaagcaccctcyccaaccctgccggttttggttgctggtgaaggcctttgacagtgtcctggtagggcgacggtgaggccagctcccgacctctggacagaagaaagcttac

SEQ ID NO: 16852 - DNA, 201 bp, Homo sapiens
atgcatctttgcaggaacttgcccctttccactgaggtttgaggcagactccaaccacatttccatccagtggcttagtggtcttacccgtgagcttgaastgttgtccctgccaggacagtctttgcctctgtaagtatctccatattcctccatcctttcaggtcccattcagtccctaggtcctccatgatggaatat

SEQ ID NO: 16853 - DNA, 201 bp, Homo sapiens
caagaccagcctgacaaacatggagaaacctcatctctactaaaaatacaaaattagccacagtggtggcgcatgcctgtaatcccagctactcaggaggmtgaggcaggagaatcgcttgaacccgggaggtggaggttgtggagagccaagattgcatcattgcactccagcttgggcaaaaagaatgaaactctgtct

SEQ ID NO: 16854 - DNA, 201 bp, Homo sapiens
cctacttccaaatgagtgggttgtccaggtgtgcttgtagatgtcacatacttctaacaaggctctgcagctgcgatgtcaccttgcccagcgtgacctcmttagcatgtatgtggctttcagtggccatgtactttgcttctagagctttctttcccattctgggttcttaggagggggctgtgctttgtgtgtggccag

SEQ ID NO: 16855 - DNA, 201 bp, Homo sapiens
gagatttaaatgaagcgaaatgccattttctctaggtgagaaactggaatattatcaatgtcacttcttcccaaattgatttataatttaaaaacaatttyagtacttctgcagcttgtttggagcttgataaaatgattgtagagtttgtcttgaagctttaatagtgaggcaggtttaaaattgggggcaaaaaagaaa

SEQ ID NO: 16856 - DNA, 201 bp, Homo sapiens
acccagaaaatatttcttattgttgataatctgcagtttgcaagtgcagcgaatcttgtaggtagatttaccttgagttttttgaaacggtagaattaatrtattaaaacatatggtttttagttaaaataggatgttaaaggaatagagcgcacgaacaaagaactttccacttgaacccatgttgtttcatctgacagt

SEQ ID NO: 16857 - DNA, 201 bp, Homo sapiens
ttagccctagctgtttgtcttgcttatttaaacttgtacatggcacatgctcaaagatttttccaggcaaaatttctttaaagcaggatttgagattttcyatccccttccgtctgctggattattccggtgagtgttaatctcccgcctttgtcttagcctctctgtggtcttcggttgcttccttgttctctgtagatc

SEQ ID NO: 16858 - DNA, 201 bp, Homo sapiens
gtaaaatgaagcctctgcatccttcagtaacttacttaaaattttgttagggctgcattttcttcaaagccaagttctgaataagaagtatttgttttggrctctagccagattactgaagtattgttgagggagatttgctgtggaaggtgttgggggtacagggattgtgaagataatgtaaaatatttaacattttaa

SEQ ID NO: 16859 - DNA, 201 bp, Homo sapiens
ttttcagcaaaactgtgtacattacatttttttctttaccatttctccgtagttatttctagcatttttttttcagctgatgaaagcaaatgaagaatttktatgctccatagtcagtcaaacattgatttctctgacttttaacttagaaagtcattttgcagtggcttgcgtgtgtgtatttagactgtgcttctacaa

SEQ ID NO: 16860 - DNA, 201 bp, Homo sapiens
tagggcttagttctgccctttaagtcacagactcaagttactcctgattttaccagcagtcagaatacatttttctttaaaaggaaaagagacgatatccyagtgcttctctatactaaaacaggaagagaagcttccttgttgaagtgacagtttagatgttgttattttgacagaaatattagtaaatatgtcacatta

SEQ ID NO: 16861 - DNA, 201 bp, Homo sapiens
caaatacttttctttagcccttctcatattaacatttagttcttagggatttattttcaaaatatatatagcttgtatatgccattcacctaagttgttaragcagacattctgcctcttgatctttagaaaatacctaagagtattttgttaacagtactcatttcagctgaaagactttattttaaaatttaatttaat

SEQ ID NO: 16862 - DNA, 201 bp, Homo sapiens
ctaatacagtcagcccagccaagatagtgccatcctccgcaagcatccactaaggcatggagtcagcttccgtcattgttagatcagtacttgtttctttsccttgcttatttttcctaacctctctgaacctgctgtgttggaagcttaaggaacatcatcctctgttgggcagaattcttccatggccaccccagcatt

SEQ ID NO: 16863 - DNA, 201 bp, Homo sapiens
tgctgggattataggcgtgagccactgcacctggcttatttaaatttttatgggtatgaattcacttaaaagctgaaggttttgagaggagagggagcatrtgaaaaaacctaaaggttttgggaggaggaggagaaggaagagagggagcatgtgaacaagagcaactgattacttccttgtcattcatttgcccagtgt

SEQ ID NO: 16864 - DNA, 201 bp, Homo sapiens
tttgtttatttagacctcccattatagaaagtgtgacatgctgggcctctggggaagatttttgagggttttgatgtcagagccccgaactttctctgaayttaattgtctttcagaccctttaagaatgtcacagagtatgatgggcaggatgcctgcggctccaacagctggaacatggtggacgtggacctcccgccc

SEQ ID NO: 16865 - DNA, 201 bp, Homo sapiens
cccaaagtgctgggattataggcgtgagccactgcacctggcttatttaaatttttatgggtatgaattcacttaaaagctgaaggttttgagaggagagrgagcatatgaaaaaacctaaaggttttgggaggaggaggagaaggaagagagggagcatgtgaacaagagcaactgattacttccttgtcattcatttgc

SEQ ID NO: 16866 - DNA, 201 bp, Homo sapiens
ccaccatgtcactctgacttccagatgataatgagtgtgaccatgggctgaatgaatgtctctctgctgggattaaaagttagaggaaggcaaaaacagayattgcgtgttctcacgtatacgtgggagcaaaaaaagttgatctcttggaggtagagagtagagtgatggttaccagagactgggaaagggggcgatgaa

SEQ ID NO: 16867 - DNA, 201 bp, Homo sapiens
ttcactcccatgacccaatcacctcccaaaggccatgcctcctaattccatccccttaggggttaggattttgacatgtgagttttggtaggggacacagrcattcactctatagcactgataaacattctttgataatagccattattttagtgggtaaggtgtttttaaatacccataagcgagcacaaaatcagttta

SEQ ID NO: 16868 - DNA, 201 bp, Homo sapiens
acggttaagtttggattgtttgcttattggtttggttattggcaattgctacaaagtccagggtgttctttatcagcagcatgcttatcaagttactgacrttcaagctgagtttccttccctccctccttccttcttctccactgacattttttttttttaaataggtagggaggcatttaatcttgtagcagcatgaga

SEQ ID NO: 16869 - DNA, 201 bp, Homo sapiens
tggtggacttccgtgttctttgcattgcctctcccccatccctcttacacacagctgtgacatgggcatgcacactccttcacacacacagactctccagscccctttccacttcctctttccatttggcttcatgacatttttatcagagattcaaaatctcagatgaaatccaagtcagcctgttttaccagttgtcga

SEQ ID NO: 16870 - DNA, 201 bp, Homo sapiens
ccattagagctacccatagctggtgaagactctgcttatagtggaacctagtttctcagttttccatttatatttatttacctgagctttttgtaaagtartaagtacttgactgaatttctgctatttatcaaatgctttttgaatagaaataatgagttaataacatttagccttttttggtaaatagtataaacaaga

SEQ ID NO: 16871 - DNA, 201 bp, Homo sapiens
gaccccagccgaaggcctcagccctgttttctcaccattcgtccatggctgacctgagggttgccctttctccatctgggtgctcctctcgtattctgttygtttttgttggttcctgtaaacattagaattctgttttaaggtttctagggggagccacaaagcccatttcttcatatttgaccaaagcagcaattagag

SEQ ID NO: 16872 - DNA, 201 bp, Homo sapiens
cctgagctttttgtaaagtagtaagtacttgactgaatttctgctatttatcaaatgctttttgaatagaaataatgagttaataacatttagcctttttyggtaaatagtataaacaagatagggcaaatatgtaaactacttagaactttatctaccttgcatattttgtacctcttatttgcatatgcatgtcacatg

SEQ ID NO: 16873 - DNA, 201 bp, Homo sapiens
ggctgcattttcttcaaagccaagttctgaataagaagtatttgttttgggctctagccagattactgaagtattgttgagggagatttgctgtggaaggkgttgggggtacagggattgtgaagataatgtaaaatatttaacattttaaaaattttcagtaagttctctttccccaatgtcagcatgacttcttcattc

SEQ ID NO: 16874 - DNA, 201 bp, Homo sapiens
attccttacctctctcacccacttgaggattgctcagagcctgggtttcggattgaaatagcactatttctggttgatgacgacattctgtgagccagcartgtagtttaaatatccacaagagcgccctggttccatcagcgccccttcgtaattggtcatgagacttggacctccttcggggctgggactcgggcaagg

SEQ ID NO: 16875 - DNA, 201 bp, Homo sapiens
tgtatgcatcttctgcaattaggaatctgctcaccagcacgagtgctgtggtttctgtagttctgggattcagaggagcattttaaagatgtaggatgttrgaggaggaggtgcagggatctccccttgggtaaagagtgggagacagtctctgagtcataatctgggaccagtggaaggtcaaagggaagaactgtcctg

SEQ ID NO: 16876 - DNA, 201 bp, Homo sapiens
aaattacttaacctctctatgcctcaatgttctcatctctaaagtatggaaaataattgcatctgtgtgaaaactgagttactatacgtaaagtttttagratagtacctgacatacagtaagtgctgaataagtatcagctagagagagagagagttagtttccagcagcctgtttctgtttggggtcacatgtggtctc

SEQ ID NO: 16877 - DNA, 201 bp, Homo sapiens
gttctctgtgtgtaagtagttatattattcctaggttatggcatcttgatttatctttgaaagaagaaaaccctcactgagttgacagggacacattgttytaggcttctacaattgtgctgatgacgctttttcccattggaatgacagggatgataaggtcggctggctagcctttttttaaaatgtagaaaaccacaa

SEQ ID NO: 16878 - DNA, 201 bp, Homo sapiens
ccaccctcaaacaatgatttccccaaattggacagcctgggtttgtatccttgagcacagttttgggaagagcattctgcatgaggcattgtagctatgtrtatggagtataattctgttttcaggttgctctgccacagaggttaagaactccctcttccaaggtagacattgagaacagagacgaccacactgggtttt

SEQ ID NO: 16879 - DNA, 201 bp, Homo sapiens
tcttcagcagctgtgagtttacaagatgtcgcacattgagtatttttctctagcttatttagaaacgccagtctagacttccgcagttttggattcgtggscatagttttggcctttattagatggccctcaaaggtacttttcaggtggacattgatttcatgccagctgtcagagatgattttccctagaaatggctgg

SEQ ID NO: 16880 - DNA, 201 bp, Homo sapiens
aactatctcaaggtaattacccttttgaatacttgaggacatcttttctgtgccctctgaatatttccttccccagataaaatatttctagttcttttacytgttctttgtttcagagttttaagtctccatttgataaagtatagtttaatagccttcgaaaccacatcgttgagatttaaaaagccctccttgagagac

SEQ ID NO: 16881 - DNA, 201 bp, Homo sapiens
tggctgggtatatggagacattctgtattagaatggaggtatacacccatctcttctgtattagagagcaggtgttgccccccgtggtgctcagattgctkagtgtgagaaggaaaagaccagtgataagaggaggaaaactgcgccttccatgtagctcagttaacagcatcatgattctccaggatggccccatttctg

SEQ ID NO: 16882 - DNA, 201 bp, Homo sapiens
ttacccttttgaatacttgaggacatcttttctgtgccctctgaatatttccttccccagataaaatatttctagttcttttacttgttctttgtttcagrgttttaagtctccatttgataaagtatagtttaatagccttcgaaaccacatcgttgagatttaaaaagccctccttgagagacatgaccagtagaaatc

SEQ ID NO: 16883 - DNA, 201 bp, Homo sapiens
gcacacaggatgcacgtgggatgtccagtgaggaggatgagatgaggttgggtggctggagcctggtgagtgacaggcagagagggctattagatcacatkggccctggagccatggtgaagaatttggattttgttctctgtgttggaaagttagcagagagcttatatggggggtgagatggcatagggacaatgttaa

SEQ ID NO: 16884 - DNA, 201 bp, Homo sapiens
ggttttgccatattggccaggctggtctcaaactgctgacctcaggtgatcctcccacctcagcctcccaaagtgctgggattacaggcgtgaaccaccgkgcccggccaaaaaagcttttgaaaacttcgtcgtataatattatggccatccttccaaacgtgacctttttatgttgtattttatctaactaatttgccc

SEQ ID NO: 16885 - DNA, 201 bp, Homo sapiens
tcctaggtagtgaatgagtacaatgctcatatgcaaaataaccaatccaaaggccacgcccctcactcatatgcaaaataaccaatccaaaggccaggccycttaccacctttattgggatttcatactccaggccaatattgccctaccttaatcaccctagggccagataccaggcaagagacagcccctacaccccag

SEQ ID NO: 16886 - DNA, 201 bp, Homo sapiens
cagagagcttattagtgtcttggccatttggaattccatttcacttaaattagaagagtgaaagagaaatgaatggaagaccaaaaatggggagaagaaaytgtatctgatataagcgtggctctacctgggagaatggccattccgaattactggaaacaggaagaagacttgctatgatgcttccttatatctgtgggg

SEQ ID NO: 16887 - DNA, 201 bp, Homo sapiens
acaatggctgtctttttaatgggagttgctcctattcctggtggtaacaacctcttcctgttgctcctttccgaatggaattgcctcagtgaagttgttgaagaagtgaggagggcgaaatatgcccatccttctacagtggggagaggcctggcgcatgaaagcaggcctttgtgtatgccgggctgggcccatgcaaac

SEQ ID NO: 16888 - DNA, 201 bp, Homo sapiens
cttaattgtctccttaacagccctaccttcaacagagtcacatgaggggttagggttcctacatatgaattggcagggtggaggtgggaggtggccggggrtgagacacaattgatttcatagcgtcgagttataagatgggtcacagtattagatgggaccagagcagagagggtctgtaggccatggcaagagtgagaa

SEQ ID NO: 16889 - DNA, 201 bp, Homo sapiens
ggtttacaaaactcccaccctctgttctgccaagcattggtccccagcacccctgggtgttagtgcctcttcctggttcactcactcactttctctggccstctctgtgtctctctcactctctttctttcgagatggagttttgctctgttgcccaggctggggtgcagtggcatgatctcagctcactgcaacctccac

SEQ ID NO: 16890 - DNA, 201 bp, Homo sapiens
gaccgcttaggaagctgctgggaccgtgcatatgagagatgttggtggcttgaaccagtgctgggtttctcagcattggcagtattgacgttttgggtgarataattagttggggagtggcagggcggggggtaggggtgcagtcctgaaccagtgccaggtttctcagcattggcactgttggcattttgggtgagataa

SEQ ID NO: 16891 - DNA, 201 bp, Homo sapiens
gaaataattagttggggagtggcagggcggggggtaggggtgcagtcctgaaccagtgccaggtttctcagcattggcactgttggcattttgggtgagawaattagttgtggggggctgtcctgtgtattgcaaaatgttcagcagcttcactagtctctacctgctagatgccagaagcccacccaccccgccccctag

SEQ ID NO: 16892 - DNA, 201 bp, Homo sapiens
aggctgatctaatcagggtattaaccttgccccactcatcttgatttattcctagatcccagttcccagagcatccctttagagcctcagaaatggaacamaagacagctgaaataagcccgtggccaaaaggcactctgagcatgagggaagtaagcaggcttccctgtcactgctgaggctctgtcatccagccccagc

SEQ ID NO: 16893 - DNA, 201 bp, Homo sapiens
atgtgttagttattaagcatacttataaaatggaaatttgtaaatccgtcactcaatccaagagtgaactcatttccaaattacaatggaaacccatgtgsctatgggcttctcatcctctccaaaggaattcacatccttcattaattcttttgctaaaacaaaagcaaaacaaaggaaaaatattattttattatttaa

SEQ ID NO: 16894 - DNA, 201 bp, Homo sapiens
ccctgcctttttctgagttgggccggctgggcccgaggctggttctgggctgggccaggctgatgcagtggccttgggcttcccgaggctgggagagggcrgtggcccccgctaccctgaagagctggccaacgcggcagggctctttccagtccttaccatgcaagtgaagaggaacagtttgtttaaagaggggtgcca

SEQ ID NO: 16895 - DNA, 201 bp, Homo sapiens
tgtgactcagcagatgggaattcctttaataacacgctgggtgttagcgttagaaccgccactgaacagctctgcaggatgccctcccagccctccctccrcctatttggattagaccaggagactgcagcaaacttctcaaggggaggcgaacttggtgttggtatctgagcgattgtctgtttcaattgtttccctctg

SEQ ID NO: 16896 - DNA, 201 bp, Homo sapiens
ccttggcctcccaaagtgctgggattacaggcatgagccgccactcccggccgctgcagagaatttttaaaataaatgatagattctcacagataagaagwacaggataattatttgccaaagtttgaaactgccattatattcaaaggcattctcttttgggagtggttttatatttaaggtttgaatttagatgacctc

SEQ ID NO: 16897 - DNA, 201 bp, Homo sapiens
tgacacttgcagagtagagaaagcaagataatgaggaaggacatccctgtgttattcatgagttcttacctaagggggctcaatagctccttctattccayggttaagattcttctgttactcttactcaagtcatagaaaagacaaaagaggtaaaagtacttaaaagccacatttctctcctccttgcagacctgaaag

SEQ ID NO: 16898 - DNA, 201 bp, Homo sapiens
gggaggtggggcccagggtgtccagctttgtagaaaggcatggtgtgggggtggctggcggagggggtggtgggtggttttcctcttgaatctctgagaamcttgactggtgtactgctctctgctttcctaaggggtccgtagctgtgctggtggtttgcttggtatctgtattacatccactctgtgcttcagcctgtt

SEQ ID NO: 16899 - DNA, 201 bp, Homo sapiens
aagtggcttctccgatagtgctggtgaattggaagcttctcgtcatcccccttggctggggcgaggcttacttcctggggccttggcagttttgatctaaytgacttatgttacctttctgtattaatcaagcctttttattttccatacttctgatgctttgacatcttggggccttgctgaccctgaagagaccagccc

SEQ ID NO: 16900 - DNA, 201 bp, Homo sapiens
ggaggttaccaggggctgagggtgagggagcagatttggggagatgttagtcaaaggatacaaaatttcagttagataggaggaataagttcaatagatayattgtacatgatgacagtaataatgatgtattcttaaaaattgctgagacaatagattttaagtgttctcaccacacacaaaaaaatgtgatgtaataca

SEQ ID NO: 16901 - DNA, 201 bp, Homo sapiens
aaaagcagggagaccgcttaggaagctgctgggaccgtgcatatgagagatgttggtggcttgaaccagtgctgggtttctcagcattggcagtattgacrttttgggtgaaataattagttggggagtggcagggcggggggtaggggtgcagtcctgaaccagtgccaggtttctcagcattggcactgttggcatttt

SEQ ID NO: 16902 - DNA, 201 bp, Homo sapiens
gccagctttccgttggtaatgatcacctctgagtgtttttaggaattgcaaaatgctggagcctgcatccattttgagagctacaatatcaataaaaatayttctttcttcgattaaaatacttctaattttaaaaattaaaatagctgtagtagtctttaaagagtaaccatgatcacagttttccatggcaaaataatc

SEQ ID NO: 16903 - DNA, 201 bp, Homo sapiens
cagaccagcctggccaacatggtgaaaccccgtctctactgaaaatacaaaagttagctgggcgtggtggcacgtgcctgtaatcccagttactcgggagrctgaggcaggagaattgcttgaacccgggaggtggaggttgcagtgaaccgagattgcatcattatgctccagcctgggcagtgagtgaaactctgtctc

SEQ ID NO: 16904 - DNA, 201 bp, Homo sapiens
tgccagaaataacatacaaatttatcatcatacaactgtacaatatgcaaataacttgctagatgatattactgaagattctacatccaattaaaataaaragagaaaacaccttaagataaccatactattaaaagatacagaagacaactggaataaatggaaagacataccacatttattagacaggaataatcatca

SEQ ID NO: 16905 - DNA, 201 bp, Homo sapiens
aagtccacgttgaataagaaataattttttattgattgctggcatttgtgagaaagggtttaattagaccaggatatggaggggacttatcgacagttccrttgtacattgttgacatggttattttctgtatctcattttgcctgggaatttgtcattctcttctattttcttatcagtagcactgcttttacacttatt

SEQ ID NO: 16906 - DNA, 201 bp, Homo sapiens
ctgcagcatgctgctttcttcccattgcatgtgggaagcttcaggttctcttcggtttattttctcatcacctttattaaaatgcagtaaagcaaggagtrtattaatgcgggcctctgcaaatagagggaatttattgaaaagcagaatggcttgaaagattgaacttcatcttaaaaatcagaaacagactcttgttat

SEQ ID NO: 16907 - DNA, 201 bp, Homo sapiens
tgggagagtgaaagatacctctgagacattttggcttggacagaacagggggtggaggcttccattcctgagctgcaaaggagtggggagggaggagcagygtagtttgggaagtgtgtggtggagaaggcagatggggcaggagctctgtcttgcatctctcaggtcagaaatgcctcagacatccagggggggcaagct

SEQ ID NO: 16908 - DNA, 201 bp, Homo sapiens
aagatgcggagcggagtttgcgtggcccggagcagctccagtgtctgaggcttctctgtgtcacaggctccaagcaggaagcgcaggcaaaatggcaaaayacagcatgtggcattcagttcaaaaatgcccttttttagaagtcggtattctaaatgacatccagtcttgcttagttttttaagagaaaggaaaaataat

SEQ ID NO: 16909 - DNA, 201 bp, Homo sapiens
caaagggagctttgaggcccggaagaggcctttccttgatgatcgagctgtgcacagggagcaaaccccaagccgactgcttgtctgtgccaccctcaaamaatgatttccccaaattggacagcctgggtttgtatccttgagcacagttttgggaagagcattctgcatgaggcattgtagctatgtatatggagtata

SEQ ID NO: 16910 - DNA, 201 bp, Homo sapiens
gacagaacagggggtggaggcttccattcctgagctgcaaaggagtggggagggaggagcagtgtagtttgggaagtgtgtggtggagaaggcagatgggrcaggagctctgtcttgcatctctcaggtcagaaatgcctcagacatccagggggggcaagctaagatggagttgaacacagcagtgtagggctcagggga

SEQ ID NO: 16911 - DNA, 201 bp, Homo sapiens
tacttaaatacctacagccttataaggcctaggtgtcaattttttacgcttgcagatcttttacaactgtaagttaaatgattttacacattaagtgcatmtaaaacaaaaagattcaaacccaaatattaatttaatgacatgggtaatattttgctaaaagtaaaccactgctcagaatgtgaataaactgacctcgaa

SEQ ID NO: 16912 - DNA, 201 bp, Homo sapiens
cagttacccagtgagtctcctcaaagcaagtggcactgagatacaaccttcctacaggttttcaagtcatctcgtgtggtgcacagtcctcgccctacctsgaaggcccgggcgaagttttcctgagtgtgtatactcatctctttgtgttgtctctggcagggagcaagtgagtacaggattggagtaataggcattttt

SEQ ID NO: 16913 - DNA, 201 bp, Homo sapiens
caaggagtctacttctaagaatgcatttgcaagccaaaagagtggtgaaccacttcagagtgcgggtctgtgggggatgatgtctgctttgcttcgttttktggaataatttttaacatttctatttagcattcatgatactctaaatagaagcaggagaacactgtggctctcggatccaggagaggcaggccacgaggg

SEQ ID NO: 16914 - DNA, 201 bp, Homo sapiens
ccttcctacaggttttcaagtcatctcgtgtggtgcacagtcctcgccctacctcgaaggcccgggcgaagttttcctgagtgtgtatactcatctctttrtgttgtctctggcagggagcaagtgagtacaggattggagtaataggcatttttaggcttgagatggctttgtgtgtttggttaatgtcactacatttcc

SEQ ID NO: 16915 - DNA, 201 bp, Homo sapiens
gaaaagagggttagcttttttttttccggctcatggttcttcaggctgttcaagcatggttccaacatctgatcatcatctttttttttttttttttagayggagtctcattctgtcacccaggctggagtacagtggcgccatcttggctcactgcaacctcccacttctgggttcaagcaattctcctgcgtcagcctc

SEQ ID NO: 16916 - DNA, 201 bp, Homo sapiens
ccaacatccttcattgtgtttacttactatatctagtcttctccagtctgtaaaaatgtgtctatctttgcttgtttttcatgaccttgatatttttgaakagtatggacaggttgttgcatagaatgctccaaattggttctaatgtttctcatcattaaactcatttttatacattttggggaagactactacaagatt

SEQ ID NO: 16917 - DNA, 201 bp, Homo sapiens
gaggtggccgagcttgtctggcttccagaggagctttctctgtcccgcccgggggagtggctcaccttggtctgagaccaatgggaggaagcctgctgcgrgcaactggtctgtgcctggaagttggacttgcattttctctggacctccaaagcaaacccgaatgaccactctcatcctccccttttgcttgtttgtgta

SEQ ID NO: 16918 - DNA, 201 bp, Homo sapiens
gcacgggcaggaggagctgtgggttgcttttcttccttggaacatggagcaccactctcccctgtgctgatacacttacaaagaagttcacctactccttggaaagttctggaaaaggggcttctacactgttggcctctcgaggagaacggtttttgtttctgtcttcctggaaaagaggtgactgctggcatcatcttt

SEQ ID NO: 16919 - DNA, 201 bp, Homo sapiens
aaagtgccagtctctctatgggttttagagctgatttagatacatgcattgctaatacagtcagcccagccaagatagtgccatcctccgcaagcatccahtaaggcatggagtcagcttccgtcattgttagatcagtacttgtttctttcccttgcttatttttcctaacctctctgaacctgctgtgttggaagctta

SEQ ID NO: 16920 - DNA, 201 bp, Homo sapiens
tttatcaacatgtaccattttctacaaatgccgcccttcctctttaaattgcttggatgggcagatcgattttgattagcaacactgcagcagaaacaagktgcatctctggaaggactgggtggttttctcgttattgttgctggtttgggtcacatcggatgctattttaaattctgtgttttattccacgatgggtct

SEQ ID NO: 16921 - DNA, 201 bp, Homo sapiens
ttttattttcaagacaggttctcactctgtcacccaagctggagtgcagtgttgtgatcatggctcactgcagcctcaacctccagggctcaagtgattcytccaccttagcctcccaagtacctaggaacacaggcgcacaccaccactcacaactgactaatttttaaaattttttatacagacagggtcttgctgtgt

SEQ ID NO: 16922 - DNA, 201 bp, Homo sapiens
ccactgtactatttccttgtttgtttttcctgtcaatcttgccttccgcgctaatgggacactgatgctgtatggtgatgtgttctcccacagtcatcttytcctcctgtggttggggtggggagctttctctgtgtccccccatgagagtgaggacagtctcatttaatggcaccatggtctgtggagccaggcaggcct

SEQ ID NO: 16923 - DNA, 201 bp, Homo sapiens
acccaagctggagtgcagtgttgtgatcatggctcactgcagcctcaacctccagggctcaagtgattcttccaccttagcctcccaagtacctaggaacrcaggcgcacaccaccactcacaactgactaatttttaaaattttttatacagacagggtcttgctgtgttgcccaggctgatcttgaattcctgggcaca

SEQ ID NO: 16924 - DNA, 201 bp, Homo sapiens
attaactgtgcctggccctgaattcgtgccttgcaggtacttaggaagtgagttattacaagcagtgctttttatcatccatagatggagatgttatctaygctataggactgcagaaagaattacagagaattatgtagaatcactagggacttgattaatatttgtttacctttcccccacatggattgatgtccttta

SEQ ID NO: 16925 - DNA, 201 bp, Homo sapiens
aggttaaatatttcacacgtctttgttcagtgtttccactcaccgtggttgagaagcctcaccctctctttcccttgcctttgcttaggttgtgacacacwtatatatatatttttttaattcttgggtacaacagcagtgttaaccgcagacactaggcatttggattactatttttcttaatggctatttaatccttcc

SEQ ID NO: 16926 - DNA, 201 bp, Homo sapiens
gtaaacgttcatagcaggactgttcatagtagccaaatctggaaacccagtgtacatcaacaggtgagtggctcaataaaatgggctcgaaccttacagtrgaatattattcagccataaaaagggaggaaattttgatccatgtcacaacacagatgaaccttgaagacaccatgccaagtgaaacaaggccagacacaa

SEQ ID NO: 16927 - DNA, 201 bp, Homo sapiens
acacttctcatttttctggttagactacttaaccataacattcatggtgccacctgaaaaaataattttatcgttttagacttttaaaatatttttaggctttttttttttttggcttaaaaaaagaatctgttctacttgggtattttgttctccttatttcttagtgaacaaagatatttgctcgacttctatcccaga

SEQ ID NO: 16928 - DNA, 201 bp, Homo sapiens
taaaagatttatgagccaactattctctggcaccagattctaggccagtttgttccactgaagcttttcccacagcagtccacctctgcaggctggcagcygaatggcttgccagtggctctgtggcaagatcacactgagatcgatgggtgagaaggctaggatgcttgtctagtgttcttagctgtcacgttggctcct

SEQ ID NO: 16929 - DNA, 201 bp, Homo sapiens
accaccataaacacggtgggggaagaggctgcaatcaacagtcaggaggatctgggttccaagcccaggtttgcagtgtaacagctgtgtgctcttggtgygaacatttggtcatgtacaaatgaggataatgatactgcccccttgtgatcattagggggattaaattaaatgcagaaatatatgtgagatgcttaatgt

SEQ ID NO: 16930 - DNA, 201 bp, Homo sapiens
aatgttctcatctctaaagtatggaaaataattgcatctgtgtgaaaactgagttactatacgtaaagtttttagaatagtacctgacatacagtaagtgytgaataagtatcagctagagagagagagagttagtttccagcagcctgtttctgtttggggtcacatgtggtctctgtccacctggctttttaggcctct

SEQ ID NO: 16931 - DNA, 201 bp, Homo sapiens
agcaaatactctgcatgttgagtgctttcaaaatacagaaacaaacaacttgtggaggcattggaaaagtgtgtttgagaaacaagcagcctcaccatgartgggagtttgtttccctttctcgtctttctggtcatctgctgcacgggcaggaggagctgtgggttgcttttcttccttggaacatggagcaccactctc

SEQ ID NO: 16932 - DNA, 201 bp, Homo sapiens
tgccccagggaggagtttgagttggtacatcctgactgggtactctgcctgtggttagcaaatactctgcatgttgagtgctttcaaaatacagaaacaarcaacttgtggaggcattggaaaagtgtgtttgagaaacaagcagcctcaccatgaatgggagtttgtttccctttctcgtctttctggtcatctgctgca

SEQ ID NO: 16933 - DNA, 201 bp, Homo sapiens
gtgctgggattaaggtatgagccaccttgcccggctaccggacagtccactctttacaggggggcgtcttggtataagtatggaaagctccgtagatgccrtgtcagtccataccctcaccaccttcttgaccctgtgccgataaactaagagatgtgggcagtgtaccatctggaaaggaaaaggctttggagccaggta

SEQ ID NO: 16934 - DNA, 201 bp, Homo sapiens
ccaggttcaagtgattcttgtgcctcagcctcccaagcagctggggccacaggtgtgagccaccacacctggctaatttttttttcttttctcttttttgkttttgtagagatggagtgttgccatgttggccaggctcgtctcgaactcctggcatcaagtgatctgcccgcttcagcctcccaaagtgctgggattaca

SEQ ID NO: 16935 - DNA, 201 bp, Homo sapiens
tcatggggaagggtgtggatgaagggtgagccgggaccccaggcaggtacggagcagttcaaggccgtcaagtgtgcttcattcttcagtcattagggtgtctctgaaaggtttttcattgaatcagaattcccctaattcacgaattctaaagcttaagtaaattcagtaataataaactgtcaattatccaagcgatga

SEQ ID NO: 16936 - DNA, 201 bp, Homo sapiens
catggggaagggtgtggatgaagggtgagccgggaccccaggcaggtacggagcagttcaaggccgtcaagtgtgcttcattcttcagtcattagggtgtctctgaaaggtttttcattgaatcagaattcccctaattcacgaattctaaagcttaagtaaattcagtaataataaactgtcaattatccaagcgatgaa

SEQ ID NO: 16937 - DNA, 201 bp, Homo sapiens
ctttaaccagagagttggaggttgcagggagccgagatcgcaccactgcactccagcctgggtgacaaagcgagactccatctcaaaaaaaaaaaaaaatrcccacaactgggcatggtggctcatgcctgtaatcccagcactttgggaggctgaggcgggcagatcacgaggtcaggagatcgagaccatcctggctaa

SEQ ID NO: 16938 - DNA, 201 bp, Homo sapiens
tctccagtgtacatttatggaggggcaagatttcaccattctgtgaagaactctgcgtgttgacgactgctcacgcctagggaataaatttcagagcatgygtagatagtgccattttctacttaaaatactataatccattatttacttcggaaaataaaagcattaaggctgaaagttttgggttagtaatcttgatgt

SEQ ID NO: 16939 - DNA, 201 bp, Homo sapiens
acaactgttcgactaactgtcggagacaccctaatcaccccagccacaaacaaatagaacattgtatgtgtgctgaatcccacaaaggccagacatgatgscatgagaccaagaaggaaaagaaataatgtggaaagggtttggggtggaaaggtggggaacctggaggcgggccacatggggccccagaagccatgttga

SEQ ID NO: 16940 - DNA, 201 bp, Homo sapiens
tcatgcttctcaagtaaagcaacagtatctgtgtatccatttacttgattgagctttctactgaattacaggagttaaattatactttgttacactcttgrtattacaaaatgatggccatgcctttattataaaatgacaccagttattctttcctggaggatgtgccttgtgtcactagccgcactaagcacttcccca

SEQ ID NO: 16941 - DNA, 201 bp, Homo sapiens
ggcacctggctgtgctcccttgttggggggtcccttggcctgggcagttttgcgcttctccctgtttccctgtgccctgagactttgtgggtcacaggcargggggctggcctccctgatcaagggcccttggcctaggagggcccctggatttatctagtccagcttctcgtcgtccaggtgcaaaactgatgctctgag

SEQ ID NO: 16942 - DNA, 201 bp, Homo sapiens
tggcagggagcaagtgagtacaggattggagtaataggcatttttaggcttgagatggctttgtgtgtttggttaatgtcactacatttcctaggggatartaaaagtctagcatgataaaagatctcgtcttacaaggtcccgatgtaaagtttggagcctaacttagaatttaaaataaaatacattttgacccattgt

SEQ ID NO: 16943 - DNA, 201 bp, Homo sapiens
gagggtaacatggaagtattgtcattctcggggctgactggttgacagcagcctatacaggagtggagaatattgacagggctgcccgttctccccaggtygaagagagcaaatgcacatccctgtgtgcacggccacctggttcctctcctcacttgctggtgagtattgaacggctcacataattaggcagaactcagg

SEQ ID NO: 16944 - DNA, 201 bp, Homo sapiens
agctaaatcaccgctaagatttataatttactttttggatatctgaaacatcaacaatatagccatccatggcgtgttcctctggagtgtggtccgtgccrtctctgcctgctccatctggctgatcccaggcaggcagctcagctctcagcagacacagatccccagcacatatgaacgtgaaagaggcttctccgtggg

SEQ ID NO: 16945 - DNA, 201 bp, Homo sapiens
cagtcccagtgccttttctctggtgcagcctcatggttcggtctcaccttcagcttttccttccctccaatacatcctgtaaattattgtcagacttcttyttatctaaataactcgtttaggtaaggtactcatatgttcaaaataccatggtggctccctgttctctgtgatgtgaagtcctaaccattagactcagct

SEQ ID NO: 16946 - DNA, 201 bp, Homo sapiens
ctcggcattctttcccatgctttttccttgatcatcacttactagctaacatctattttttcctaaacactctgttgcagttgtagtctgcagtcactctyctaagacttgatcatctattacgctgtttcgttctttattttttaacttttcttcttcttttttttttttgaaacggattctcgctctgtcacccatgct

SEQ ID NO: 16947 - DNA, 201 bp, Homo sapiens
cactcgccttggggggatggtatgagctgtcatactgtatgagcctcatcctggggccatgacttaccaagccagatcatctctgtgagtctgcctggtgkaaagacaaggatcagtgacttctttgtaggtctgaactgggtaatgcagagcatgccctggagacatggcatgtccccccaattctccaagacatgacag

SEQ ID NO: 16948 - DNA, 201 bp, Homo sapiens
tggtgacagcaggttaaggagagtgtcagagctggtgcagagttttgccccggggccatgaggttctgggcatcatgactctcttatgaagttacaaaackgggcaagtgattgaaggcagaaagacactgtaataaagtgtgctccagtgatgtgtgctccggcttctctcccttactcatctgggccaggtgctttcgc

SEQ ID NO: 16949 - DNA, 201 bp, Homo sapiens
catgctttttccttgatcatcacttactagctaacatctattttttcctaaacactctgttgcagttgtagtctgcagtcactctcctaagacttgatcayctattacgctgtttcgttctttattttttaacttttcttcttcttttttttttttgaaacggattctcgctctgtcacccatgctggagtgtactggcac

SEQ ID NO: 16950 - DNA, 201 bp, Homo sapiens
cgattgaggcacctctgaaaagtccaaaactcactcccttcctctccagtttcaggcacagaataaaaattcagaacacatggccttggtcctggctctgyggctggctgcctgtggtcctcagacagctgctgcaggttcctgggcctcagtgtcctcaatataaaataagagggtgggacaagattactgaagtccctt

SEQ ID NO: 16951 - DNA, 201 bp, Homo sapiens
tgaaatcagggggattcccaaatttctaccccaaatctggatgactgcatattgcgggagttcagtaaatatttgttgcactaatacttatgtgcatacgytgaaataatctaaatatttaaaaaccaaactaacggtaggactttcctcagggatttaacgtttgctgtagaagactgaatgatagaatatataagctgt

SEQ ID NO: 16952 - DNA, 201 bp, Homo sapiens
ctcactcccttcctctccagtttcaggcacagaataaaaattcagaacacatggccttggtcctggctctgtggctggctgcctgtggtcctcagacagcygctgcaggttcctgggcctcagtgtcctcaatataaaataagagggtgggacaagattactgaagtccctttcagaactaaaattcacctttagattggt

SEQ ID NO: 16953 - DNA, 201 bp, Homo sapiens
agagcaaatgacttggaaaacaggcaaatccactgacataggcatttttagccaccttggaatccgaggagggattctgcactatgccctgtaacctcgtycacatgccgtttgaatgtataccatgaagaccccttagctcagggagctttgctctatttaagtaatgtttatattcttaatgaaccaaagaggaagtgg

SEQ ID NO: 16954 - DNA, 201 bp, Homo sapiens
ctccacaaaaatatgtgggaggcctgcagggcaggtgctcaactaagctctggggctgcaaagatccagagccatgcccctccttggaggcaggtccttgyagacgaggacaatcgtagccttcctgattaaagcaggaattgtccaatcaggctatatgacgggcatcgtccatagtcttcaccaggggagcttttctga

SEQ ID NO: 16955 - DNA, 201 bp, Homo sapiens
ttctctaggaatcatctgtaaaaagtagaggtttgtcatatctctaaactagggattcaccttatttattaagctatcagtgactttatcttgaggtgcayggcttttagtaactctggttcaagtgcaaggaatgcaaagttaagtgtatcattggaggtgggatttttgagtttgtcagtcatttattgatttgcatgt

SEQ ID NO: 16956 - DNA, 201 bp, Homo sapiens
tccaaactcacctatttttgctctaaggggtataaggtgttaaaaaatgaatggaagttaactcattctcaccttgtctgctaacttccttttgttctttktctgtaagaactcataaagctgtatgcatcagctgctcccaggggccttctaaggcctcagtccaacaacagtgctacaggtgaggaaaggaaagaaggc

SEQ ID NO: 16957 - DNA, 201 bp, Homo sapiens
attatgtgtaggggactagatggaaagagtgcagataggactacctaccattcacccctaccagcgaagtggaagcactcatcttctttcccttcttaccytttcaaagcaagttgttgagggatgaagaggagagtgactttaatcgtggctttaagtagagattttctttaggagtaattgtttctctcgacagagtgg

SEQ ID NO: 16958 - DNA, 201 bp, Homo sapiens
caaacccttgtacagaccatcctagtagaaatgtggatcttgagtatctcagcttcttagtagattttgaactccgtgaaagcaggagccaggcctctcamagcaagtctctccaatatgctcagtaaatatttgtcagatcgagcaatgaccagatgatgaaatacattaaagccttagggagaactgagactactgcac

SEQ ID NO: 16959 - DNA, 201 bp, Homo sapiens
taatacggttatcaaaacagtgttcactccatactccagtgctgttaatctccagactgaattcggatttcactattttcccactgatgtccctttttttkgttccagatccaagagacgatcctacctggcatttattgtgttcagtttttctaattctgggacgttttcctgggttttctttagtcattcacgaagttc

SEQ ID NO: 16960 - DNA, 201 bp, Homo sapiens; identical to SEQ ID NO: 1556

SEQ ID NO: 16961 - DNA, 201 bp, Homo sapiens
cccccaaattccatcactgagggaataagtaagttagggtgatagctcccaagcttattttctcttcagaatcacctcatgaagaaaatgaaggtctgtgkgatagtagctggcaggtgggcatggtggtgagggtggtgtttgagcggagacctgaatgaaggttgagaaggagccagccactcacagacacagaggagg

SEQ ID NO: 16962 - DNA, 201 bp, Homo sapiens
ttgttattccccaatgaggatcatttcatttggggctggtctccggaaaaaagtagatcaagcttttcagatgagatttgggtgaaaccctgacaaactcttttttattgccttccctaccacatagtggtggatcaggaaactgtagggcttatgatgctgggaaatttctgctaatgcaataaagatttttgctgttga

SEQ ID NO: 16963 - DNA, 201 bp, Homo sapiens
caggaacacagcggctgaggaacggatgcttggagaggagggggtgctttacatgccaggcgggcagggccggggtggggccagatgctggaggagagggytggccaaggggtggcagagaggccccccaggtggcaagtttgcaccctgttgcttcctgcaaggagcttttgtttacgttttcagcttggacagtctggc

SEQ ID NO: 16964 - DNA, 201 bp, Homo sapiens
ggttttctttagtcattcacgaagttcgcacttttggagaacatggggccagttattttgtagaatatctttctgttagagtttgtggatgtttcctcctkattaaatttggggggtacatttttaacttggagatcacagaggtgctgctgtttgtgtctttgcgcatcctgtcaggagatgcgtgatgtttcctttcct

SEQ ID NO: 16965 - DNA, 201 bp, Homo sapiens
ttaacagtgagggacataaactttttaactagcagtggcaagtccacttttatttgggaggacaattactagtcacatgaagaagaaaaaatatgcagaascttaagaaatcccacatatgaatgttatttgaaatgttcttgccctttctccctacaaaggaggtgaagaagatgacaggagatgttaattgccaaaata

SEQ ID NO: 16966 - DNA, 201 bp, Homo sapiens
aagaggaacgtgcctgggaggacccgagacaggtgcgggtgggtttccgcagtagccgctgatcccgagtgcatgcggcgtgttcccgggtcgggaccgcrgccaagggaggcttcccggccccagcctccaccccctcctcggcgccccgggacccggacacgccccccgagcttcggagacccgcagcgtgcacgcgcc

SEQ ID NO: 16967 - DNA, 201 bp, Homo sapiens
actacataagatgtgctgttcctctctctttctgtttgaaagtgacttggcagggtgaagttgagaaccccttggaaaggaggaagccgaaatgcaaacamagttgaatcatgaagtgatgtcactctgaaccaattggagcagtggtgtcatgtgcctggcagctacttcaaatgcccacaaaacaggagtaatggttta

SEQ ID NO: 16968 - DNA, 201 bp, Homo sapiens
ttttagaggcaggatcttgctgtgttgcccaggctggtctcaaactcatgacctcaagtgatcctcccaccttcacctcccaaagtgctggcattgcaggygtgagccaccatgcctgaccttccttgtttcttttaggtgattattggttgtgtgtgaggaaagctctggtattttctgtacttatcttgtacctaccca

SEQ ID NO: 16969 - DNA, 201 bp, Homo sapiens
aagtaatcctccacctcagcctcctgagtagctgggactactggtatgcgccaccatgcctggctaagttttttctttttcttttagaggcaggatcttgytgtgttgcccaggctggtctcaaactcatgacctcaagtgatcctcccaccttcacctcccaaagtgctggcattgcaggcgtgagccaccatgcctgac

SEQ ID NO: 16970 - DNA, 201 bp, Homo sapiens
tgttctatggaattaatattgaacaagctgttctgaacctaagaaaggtttgtaaaaaataaacatgaaggaagacttcattcaagaggtcacttaaaaattattattattattattattattattattattattattattattattgttattttaagaattaggtctctgttggccaggctggagcacagtggcacaatc

SEQ ID NO: 16971 - DNA, 201 bp, Homo sapiens
gttctatggaattaatattgaacaagctgttctgaacctaagaaaggtttgtaaaaaataaacatgaaggaagacttcattcaagaggtcacttaaaaattattattattattattattattattattattattattattattattgttattttaagaattaggtctctgttggccaggctggagcacagtggcacaatca

SEQ ID NO: 16972 - DNA, 201 bp, Homo sapiens
tcacagctccaggaacttgcaaggaaagggactaacggggcatctgattcacccgtgtgcccttaatggcgtattgtgtgaataaagcaacaatttttagyacagggatttaaaacaacttctgcaaagacagaactaaaaattaatcttaaaaggtggagggttggggtggagggcaggaaagaggaggaactaaattgc

SEQ ID NO: 16973 - DNA, 201 bp, Homo sapiens
tctatggaattaatattgaacaagctgttctgaacctaagaaaggtttgtaaaaaataaacatgaaggaagacttcattcaagaggtcacttaaaaattattattattattattattattattattattattattattattattgttattttaagaattaggtctctgttggccaggctggagcacagtggcacaatcata

SEQ ID NO: 16974 - DNA, 201 bp, Homo sapiens
tgttttggttcatttgtagtttccccccgcttcgttgtttcctcagatatggagaataaagcctggctggtcagtttcagtttttatttaaattcattttrtcttcattccttttaatctagcacagtcctgtgatgtattgggatcacagtgctctggggaaacattgaaatataaaaacattttcctgaaaacatttcc

SEQ ID NO: 16975 - DNA, 201 bp, Homo sapiens
ctatggaattaatattgaacaagctgttctgaacctaagaaaggtttgtaaaaaataaacatgaaggaagacttcattcaagaggtcacttaaaaattattattattattattattattattattattattattattattattgttattttaagaattaggtctctgttggccaggctggagcacagtggcacaatcatag

SEQ ID NO: 16976 - DNA, 201 bp, Homo sapiens
atggaattaatattgaacaagctgttctgaacctaagaaaggtttgtaaaaaataaacatgaaggaagacttcattcaagaggtcacttaaaaattattattattattattattattattattattattattattattattgttattttaagaattaggtctctgttggccaggctggagcacagtggcacaatcatagct

SEQ ID NO: 16977 - DNA, 201 bp, Homo sapiens
tggaattaatattgaacaagctgttctgaacctaagaaaggtttgtaaaaaataaacatgaaggaagacttcattcaagaggtcacttaaaaattattattattattattattattattattattattattattattattgttattttaagaattaggtctctgttggccaggctggagcacagtggcacaatcatagctc

SEQ ID NO: 16978 - DNA, 201 bp, Homo sapiens
gaattaatattgaacaagctgttctgaacctaagaaaggtttgtaaaaaataaacatgaaggaagacttcattcaagaggtcacttaaaaattattattattattattattattattattattattattattattattgttattttaagaattaggtctctgttggccaggctggagcacagtggcacaatcatagctcac

SEQ ID NO: 16979 - DNA, 201 bp, Homo sapiens
aattaatattgaacaagctgttctgaacctaagaaaggtttgtaaaaaataaacatgaaggaagacttcattcaagaggtcacttaaaaattattattattattattattattattattattattattattattattgttattttaagaattaggtctctgttggccaggctggagcacagtggcacaatcatagctcact

SEQ ID NO: 16980 - DNA, 201 bp, Homo sapiens
ttgcatacttctcttagtggcggactagcggttgtacagtaaatagatgatcattctcgctctgttttacctttcctcagctgctcttctagtaggaaaataacagccctcttagctgtagtcttctggaggctctctcaataatagaagtggaaagaaaagactcaaatccctgggcagtgactttttagttgtttcatt

SEQ ID NO: 16981 - DNA, 201 bp, Homo sapiens
tgcatacttctcttagtggcggactagcggttgtacagtaaatagatgatcattctcgctctgttttacctttcctcagctgctcttctagtaggaaaataacagccctcttagctgtagtcttctggaggctctctcaataatagaagtggaaagaaaagactcaaatccctgggcagtgactttttagttgtttcattt

SEQ ID NO: 16982 - DNA, 201 bp, Homo sapiens
gtcaagtgggcatcccgcaaggatgcagcaggagtattagggaggcgatcaccagagcagaggaggagtaaccttccccataaacaagatgtgttcccccsactaagaaagcgggtggagggtggaggagccaaaacacatcccagccccggggccccaccggagcgaagcgggccgagcgcagagtgcagagtcggggaa

SEQ ID NO: 16983 - DNA, 201 bp, Homo sapiens
ctgggtgtcccctgcctgagatgagcacagtgatgtctatgcgaggttgtaggactcagtgaagtgccttagggattttgcctggcactctcctgggctcmtgaggtgcctagggctgagacttccccttctctgtctggtaaatcatctctcccattctttcttctgcggcccttcatatgagctttgtaatttactcag

SEQ ID NO: 16984 - DNA, 201 bp, Homo sapiens
gtgatttccccgcagcctcggtttagagggagacggggtgtgctgagctgtgcctgcttctgtagaaggggccttctccaagtctgagtagccttaagccwttaggactgctgagtctttctccacaaaaatatgtgggaggcctgcagggcaggtgctcaactaagctctggggctgcaaagatccagagccatgcccct

SEQ ID NO: 16985 - DNA, 201 bp, Homo sapiens
attatgcataatacagtgataccctcaaggctgagtgggaggcagtttgccctctgctgaaggtttcttgtgcttattgtgttcttatggtttggttttaycatttttatgtctccatttctgtttaatagacttatttcagtaagaagagaaagccgtctccatcagcccctctgtaggtgattatttgccacttccttt

SEQ ID NO: 16986 - DNA, 201 bp, Homo sapiens
gtgcttattgtgttcttatggtttggttttaccatttttatgtctccatttctgtttaatagacttatttcagtaagaagagaaagccgtctccatcagcmcctctgtaggtgattatttgccacttcctttttgctgtgagtgctttgaaaacagatttctaagcttgttagagttatgtgttaagagtaaataggcagt

SEQ ID NO: 16987 - DNA, 201 bp, Homo sapiens
taaaataagagggtgggacaagattactgaagtccctttcagaactaaaattcacctttagattggtcagatttaaactttttctttctagctcatgtcargtattaaaatgtgtgcacttaccctgcagtttcattatattcaacctgctcccccgaccaagtttcacttacgtatctcactacgagtaggtgtatatgt

SEQ ID NO: 16988 - DNA, 201 bp, Homo sapiens
ctgggaaatttctgctaatgcaataaagatttttgctgttgaaagaatttgatctgttttatgtataacatgcagagagcagaagcatatattatctgtarcagatgatagagcagggtatatgggcaagttagaaaaacacagttctcactacatttgaagaaaaaggacaaggagttgtcacaaggatccaggagagtc

SEQ ID NO: 16989 - DNA, 201 bp, Homo sapiens
ctgcaaagaggaatgcttatccctgttacttattcctggtttcctccaagactagtttcagctggacttcagttgccaaggacttgtcttctgtaatgccsacagaaaataataatgccacattgtaaggtgaaaacagtaatcctggtatttttgtattttagaagaaggttgaagggaaagaaaaggattaaataattt

SEQ ID NO: 16990 - DNA, 201 bp, Homo sapiens
aattaacacctgtctctatctgtgtgtaaggctctctgggaggagctgtgaggcaaataaaaataaggaatggtgtcccgcaaggagcttacaatgtgtgyattacaagtatatactgagcatggccctgggaacacagtgaaaaaacaggattcctgccctagtacagtgtacactagtggaagagagagaggcagtaaa

SEQ ID NO: 16991 - DNA, 201 bp, Homo sapiens
taatgccacattgtaaggtgaaaacagtaatcctggtatttttgtattttagaagaaggttgaagggaaagaaaaggattaaataatttataacgatgctyttatgggaaataaaatataccatgtccatttggaaacacatttgcttacttccacacagcctttgtaacgtgctctccttcctcttacctgtacttcggt

SEQ ID NO: 16992 - DNA, 201 bp, Homo sapiens
tgagaaaagcaggtgggcaatgtactcctgacatactcccttccgttgcaatggccttgagtgatggagcaagagtgaaggaatgttcccatggcactggyaccaggatgactttttgtgaagcagagcagttggtcttagatagtggaggtgcgggaggcatgagaactgggcagtctgacggctgcaccagccagttgg

SEQ ID NO: 16993 - DNA, 201 bp, Homo sapiens
acgcctctgtctctgtcccccgccgccaccacacagatgcacgtactctcttcacttccgtgtacccagtaaatgcagatcctgatttaaatctgcagcaygctgctttcttcccattgcatgtgggaagcttcaggttctcttcggtttattttctcatcacctttattaaaatgcagtaaagcaaggagtatattaatg

SEQ ID NO: 16994 - DNA, 201 bp, Homo sapiens
gtttttacattttccttaggcacagagaaactagtatctttctctgggttgcctttttttttggagacagaatcttactctgtcatccaggctggagtgcrgtggcctgatctcggctcactgcagcctctgccttccgagttccagcaattctcctgcctcagccttccaggtagctgggattacaggcacgtgccacca

SEQ ID NO: 16995 - DNA, 201 bp, Homo sapiens
tctgtgttctgaacctggagtacaggcagacacagccgcatcccagaagctcaagagtgcccataccaggaaattacagaaatctttgccaaatggatgartgaatgcaacttccttgatacagggtcagagaggggaaatctgagaaaagcaggtgggcaatgtactcctgacatactcccttccgttgcaatggccttg

SEQ ID NO: 16996 - DNA, 201 bp, Homo sapiens
catcgaaaaaacaaaacattctgcagagggcagtcatgtgtccgctgtgcctctgctcctgtgtgcaccataaaacttgaaagtgagccagaatttgaaartatcggattgggatgtgatttctttaagcctctggctaatttaatataaagtgtttacacttcatttttctggcagtggattttctatgtaggtggtgga

SEQ ID NO: 16997 - DNA, 201 bp, Homo sapiens
ctgccatccccatgctctgcctcctaagcagaggatgaacttaagcatcttaaaattttaaacattgactttccctaaaaccaattaaaaaaaaaaacaaracagacagacagacatgacttgtgcccttaaaaatgcagccaggctggcatataaatgggcgtaggctgtttctaaattttttgctttaaattttgccag

SEQ ID NO: 16998 - DNA, 201 bp, Homo sapiens
tatagtggtggcattctgcctaagtcatcttgaaaactgaatgcaaaatctttttaatagctccataatggtctcttgaagtgttacagatttttataacratagctgtaatacaagtgcctttatttactgtgagacttgaacattttgaccatttacatgggtacttgtgtgtctccagctgagctgagtgcatgtcgc

SEQ ID NO: 16999 - DNA, 201 bp, Homo sapiens
catggattctgcctcttaaatgtctctggaatccagccctctgtcaccaccagcaccgccacagctcagactccaggtcactcgccttggggggatggtakgagctgtcatactgtatgagcctcatcctggggccatgacttaccaagccagatcatctctgtgagtctgcctggtgtaaagacaaggatcagtgacttc

SEQ ID NO: 17000 - DNA, 201 bp, Homo sapiens
cccgtccccacaatatcttagggcgaagaaaagcaggtttgagaaaagctttttttcatcatgtatttgtaatagctggagcctgctgagatgatgaggtrgagtggagggagaaagagaccttgaggaggtgtggagggggaaggggtggaaagttctgtcgtcttctgtgcctctctctctctcttgctcagggtctcc

SEQ ID NO: 17001 - DNA, 201 bp, Homo sapiens
ctctgagtgtttttaggaattgcaaaatgctggagcctgcatccattttgagagctacaatatcaataaaaatacttctttcttcgattaaaatacttctmattttaaaaattaaaatagctgtagtagtctttaaagagtaaccatgatcacagttttccatggcaaaataatcattgataggggacttacgattaatgt

SEQ ID NO: 17002 - DNA, 201 bp, Homo sapiens
gcatacttctcttagtggcggactagcggttgtacagtaaatagatgatcattctcgctctgttttacctttcctcagctgctcttctagtaggaaaataacagccctcttagctgtagtcttctggaggctctctcaataatagaagtggaaagaaaagactcaaatccctgggcagtgactttttagttgtttcatttg

SEQ ID NO: 17003 - DNA, 201 bp, Homo sapiens
agtctcctcaaagcaagtggcactgagatacaaccttcctacaggttttcaagtcatctcgtgtggtgcacagtcctcgccctacctcgaaggcccgggcraagttttcctgagtgtgtatactcatctctttgtgttgtctctggcagggagcaagtgagtacaggattggagtaataggcatttttaggcttgagatgg

SEQ ID NO: 17004 - DNA, 201 bp, Homo sapiens
catacttctcttagtggcggactagcggttgtacagtaaatagatgatcattctcgctctgttttacctttcctcagctgctcttctagtaggaaaataacagccctcttagctgtagtcttctggaggctctctcaataatagaagtggaaagaaaagactcaaatccctgggcagtgactttttagttgtttcatttgc

SEQ ID NO: 17005 - DNA, 201 bp, Homo sapiens
ctttcctgggtcagggcagccggctttccttgtccacgtgtggccggctgttttcttggggagccccggccacagccggcaggactccctttgctccatgygactctgagggcctcacaggtatttgcagcccaggtgctgtcggagcccagccgatgcgaccgacacacagcacaagcgtcatcctgttctgcctgtccc

SEQ ID NO: 17006 - DNA, 201 bp, Homo sapiens
aaatagagttatagtgctacaatgagataaatttcacaggtaaatgtgacgtagctaatgcataatcattctttgtgttgcatggcaattctgtacaaatrgaaggtagcatgtttaacgttcctgttatttcacataaatacagactgagagtttcagtggtctggtttgaaagggaagaaatagaagaaggaaggagag

SEQ ID NO: 17007 - DNA, 201 bp, Homo sapiens
cctgggggtgtgtgggggtggttggttggggtttgcttgttagtttgttgtaaaagcccagcttttcattcttggaaagatttcagccaactcgagagggttacctgccaggaatgctgcagaagcaagaactcagtgggtgagcacttccatttcttcaacaaatgcttctgagtccctgacctgtgccaggtgctcttc

SEQ ID NO: 17008 - DNA, 201 bp, Homo sapiens
aatttgaaacacccgtgtaaactacctttggcaaataggatagctaaatcaccgctaagatttataatttactttttggatatctgaaacatcaacaatayagccatccatggcgtgttcctctggagtgtggtccgtgccgtctctgcctgctccatctggctgatcccaggcaggcagctcagctctcagcagacacag

SEQ ID NO: 17009 - DNA, 201 bp, Homo sapiens
atttacttaataattgtgtctattgaatgtattcttatacatacacacaggcatgcacacacggacacgaatataagctttacaaggacagaaaccttatyttttatttatttcttccttgtgtatcctgagcactgagaacagcctggcacaaagcagggctcaggaaatgtttgctgaatgcatgttcacactggatgt

SEQ ID NO: 17010 - DNA, 201 bp, Homo sapiens
gcttgttgagttgcacaaaccagcctccttggcccttctaggtgataaaagatgctgggctgggagggcagctgtggaaaagggtgtgggcgagggagacagtgcttcatcctgcctggatgaagcatgttggttgttggtttattcataaattagaaaaatatattaagaattgaagttgttccttatctcataagattt

SEQ ID NO: 17011 - DNA, 201 bp, Homo sapiens
cttgttgagttgcacaaaccagcctccttggcccttctaggtgataaaagatgctgggctgggagggcagctgtggaaaagggtgtgggcgagggagacagtgcttcatcctgcctggatgaagcatgttggttgttggtttattcataaattagaaaaatatattaagaattgaagttgttccttatctcataagatttc

SEQ ID NO: 17012 - DNA, 201 bp, Homo sapiens
agaagttgctctgggtgagtcagtgagtcagtggtgagtaattgtgaaggcctggataaatactgtacacttaggctacacttagtgaatattacattttatttatttatttatttatttatttatttatttatttatttatgagatagggtcttgctctgtcccccaggctggagtgcagtggtgcaatcacagctcact

SEQ ID NO: 17013 - DNA, 201 bp, Homo sapiens
tgcactgcttcctgctgggggcagaacaaagagagcgggcattgtctctggcataaatgaacctctatcaaaacaaacacccagagagaggggcagcctgrttacagctgcctgtgtgagcctcgacagtgggcctcattcctcacaaagggagctttgaggcccggaagaggcctttccttgatgatcgagctgtgcaca

SEQ ID NO: 17014 - DNA, 201 bp, Homo sapiens
gaagttgctctgggtgagtcagtgagtcagtggtgagtaattgtgaaggcctggataaatactgtacacttaggctacacttagtgaatattacattttatttatttatttatttatttatttatttatttatttatttatgagatagggtcttgctctgtcccccaggctggagtgcagtggtgcaatcacagctcactg

SEQ ID NO: 17015 - DNA, 201 bp, Homo sapiens
aagttgctctgggtgagtcagtgagtcagtggtgagtaattgtgaaggcctggataaatactgtacacttaggctacacttagtgaatattacattttatttatttatttatttatttatttatttatttatttatttatgagatagggtcttgctctgtcccccaggctggagtgcagtggtgcaatcacagctcactgc

SEQ ID NO: 17016 - DNA, 201 bp, Homo sapiens
ggtttagaaatttcaaaggatgggggttgagggagggaggagttatgggcatgtgatgtggacagggcgggcaggaggatggaagtaacaggtccaaaatrtatctttggtggcccggcagagctcttgcatggggtgagaatggtaatttaggaagagcaagtcttcccatctgtgaagcagaagaaaaaagtggactta

SEQ ID NO: 17017 - DNA, 201 bp, Homo sapiens
gtgtacctgtgattttatcactgcacattcatagaaaggttacagggctaatcttcccgtgatatgaatcatgaaagtcaaaatttatgaatgaaaataaraaggaatgaagtactgatatatgccacaccagagataaatattgaaaacattacctatgctaagtaaaagaagccagtcacaaaagacactacctattgt

SEQ ID NO: 17018 - DNA, 201 bp, Homo sapiens
acacgcctgacgagcgggaatgtgagcgttgtttctgtaaccagttttactgaacctcacagatccattatacgacgtgaattttgtgggaataacatagrctgggagtctgctctcttccagcctggtccctctcttctttcagccctaccctctctgatcatcatgtcccttgcactgcggccaggtaacctttctgat

SEQ ID NO: 17019 - DNA, 201 bp, Homo sapiens
gtcacagctttaaaagttcagattttaaaaaggtaaggaaatgatctcctagtgagacaacttctgcctaaaaaataaaagcttctaagacataaattctrtgttatgaacaacttgcaattttcatagttttcagttttagctctggcagcctctgatagatcttaaatatgtttatcacagctggaaaaatgttttatt

SEQ ID NO: 17020 - DNA, 201 bp, Homo sapiens
aattcacaatcttttatgccaaaagaaagctttcagaatggcttgtcttttttgtagatacttgtatttatatgtccatgcacatacataagaaaggaccrgggaaggtctgcttgaagatattaataaaggggtcacttgtgggtaggtggacttacttgttctctatattctctttacttgtttgtgatctctggtttt

SEQ ID NO: 17021 - DNA, 201 bp, Homo sapiens
tattctacaaatataaaaatatcgttagaaaagtaggtgttaattttaaatataatttttgctgcagcttatgaagtacattgaggaagtgtttataaagrggattctttttctagtgtattatttggagacgcagcttctactgtaggcttaccttcaaatcaaagataatacattcttttatagtattagatgtagagc

SEQ ID NO: 17022 - DNA, 201 bp, Homo sapiens
cagcttaccatcctattacacacacatcgcataagttcgtattatttgtcttgtttggaaatcagtccaactttctgacccttgttctatatataactatrgatcccaaaggttcagctgctgggctagcattttgtctgctatttcctaaataatggtaggtaagcaggaaaagtgccagtcttacttgtccctgactct

SEQ ID NO: 17023 - DNA, 201 bp, Homo sapiens
cagcctttaggtttgtgtttttacttcggtcttttaatctgcctaataaaaacacacataacatcagggctgctcaggaaaccacctgcttttaccaggaytctcatcttcccactatgatacaatgatagtttagaaaaataccaaatatttatcctgagaaactgcaggggagatttaacacccaaaagaagctatttc

SEQ ID NO: 17024 - DNA, 201 bp, Homo sapiens
gatccttcaactctgacaaccttggctttccaaaatgtcactgagatccccctcaaaaagtctcctgagccatccagaacagaaaattcaagcattttacmtagagtagagctcttattcctcactcagagcctgttgacttttatatcgcactcggcgtgagctgattttgtaacccagttacaaaagccatagccatgg

SEQ ID NO: 17025 - DNA, 201 bp, Homo sapiens
atgagaaggacttggtgcaggaaagcagcagcacgtgcctggcacagggcagggcctctccagatggcagttcctgtctgtgtcttattcccaccctccgrgcacatggggggaactcagtttctccccactgcgcgtcaccctgggagaggtgttttttgtgccaattgccattttaaatccaaatcagcagggatcatg

SEQ ID NO: 17026 - DNA, 201 bp, Homo sapiens
agcccttactgaaaggaaagaactgttgacttacaagtttttgctaccggtttggtggtcactaatgtgtccagaggcctgaagatgggcgtgtgaggagsctgacttagcttcagaggctctgtctttcgactcacttgtgtgctcactgcacccctgtgctggcaggactccaacctccacccccagcacttgtgtgga

SEQ ID NO: 17027 - DNA, 201 bp, Homo sapiens
ttgcttgcaactcagatatccagcccactgatccaggaagagattcctttgacctgggaagtcataatggcagatatttagacccagctctcaagcaagcmtccaagttgttccggtgaacccgtaactttgagtaacctctgattgaaccagagagtaggaactaggtgcagaaccttgttgaatagaattgtttagcat

SEQ ID NO: 17028 - DNA, 201 bp, Homo sapiens
agtcctcttgcctggatgagaggcccaagagcactgcatgttagtggctcttcctcctcccccacacctccagggactggagctggggctgctcagaatgmaagatgaatgggggagggagaaggcccagggttgaccccccacaagcttgtctccctgtctcatgctgtctcctatcccatcatgctgctgattgggcag

SEQ ID NO: 17029 - DNA, 201 bp, Homo sapiens
agctgcagcagcagctggagagcaagagtcacccagcctgtgcgccagaatgcagaggctcctgacctcacagccagtccctgatagaacacacgcaggarcagagtcccctccccctccaggctgccctctcaacttctccctcacctccttccctaggggtagacagagatgtaccaaaccttccggctggaaagccca

SEQ ID NO: 17030 - DNA, 201 bp, Homo sapiens
agttgctctgggtgagtcagtgagtcagtggtgagtaattgtgaaggcctggataaatactgtacacttaggctacacttagtgaatattacattttatttatttatttatttatttatttatttatttatttatttatgagatagggtcttgctctgtcccccaggctggagtgcagtggtgcaatcacagctcactgca

SEQ ID NO: 17031 - DNA, 201 bp, Homo sapiens
gagaccatggcacgcatgctgtgtgtcgaaggccaggtccgcctgtctgcctctccagcagatactctctggggctatttttttctgcttggttgtcatcytttggtttaaccaggcgccagggctcaggcctggacctgctggattccaaagaagacttcgaggtggccgagcttgtctggcttccagaggagctttctc

SEQ ID NO: 17032 - DNA, 201 bp, Homo sapiens
agctgctcgggaggctgaggcaggagaatggcttgaacccaggaggcagagcttgcagtgagccgagatcacgccactgcactccagcctgggtgacagascgaaactccatctcaaaaaaaaaaaaaaagttatttctctatgtaaacaaagaaaactctccttccttataacttgtatgtgttgggtctatttgtattc

SEQ ID NO: 17033 - DNA, 201 bp, Homo sapiens
tgaggcaggagaatggcttgaacccaggaggcagagcttgcagtgagccgagatcacgccactgcactccagcctgggtgacagagcgaaactccatctcaaaaaaaaaaaaaaagttatttctctatgtaaacaaagaaaactctccttccttataacttgtatgtgttgggtctatttgtattctgtgaaccataagaa

SEQ ID NO: 17034 - DNA, 201 bp, Homo sapiens
gttacacatgtctgagatgacatgatgctaagtaaccaaagtactgctgcgatggaattgctctgatgtttttttccagagtgaaagctgctattactttaaaaaaaaaaaaacttgaggtttggtttctttccccctctatccgggtgttatacaaatatgtaattaagatgtttgggggttcagatgacaaacaaggag

SEQ ID NO: 17035 - DNA, 201 bp, Homo sapiens
ccttcaccaatttttaaattttttgtagaaactcactatgttgcccagtctggtctcgaactcctggcctcccacctcagcctcccaaccacaactggccraggtcctgtttctcatcacattgtcactcactgatcttgtcatgctttggtggagcttatctacaataattattactgccatgctttaatggcaattttc

SEQ ID NO: 17036 - DNA, 201 bp, Homo sapiens
gacccatctctcccaggaccccggggatcttaaggtcattgagaaatactgttggatcagggttttgttcttccacactgtaggtgaccccttggaataayggcctctcctctcgtgcacatacctaccggtttccacaactggatttctacagatcattcagctggttataagggttttgtttaaactgtccgagttact

SEQ ID NO: 17037 - DNA, 201 bp, Homo sapiens
gtcagagtgcagtagcatgatctcggctcactgcaacctctacctcctgggttcaagtgattctcatccctcagtttcccaagtagctgggatttcaggcrcgtaccaccatgcctggctattatttgcatttttagtaaagacagggttttaccatgttggctaggctggtctcgaactcctgacctcaagtgatccttc

SEQ ID NO: 17038 - DNA, 201 bp, Homo sapiens
taaaaaaaaaaataccctttgggtgtgtattgattctgatgttttgctcctagctacatttgccgtttttttttgactgcagaattaggaaccagcttcatttttttttttttttttggatggaatctcgctctgtcgtccaggctggagtgtggtggcgcaatcttggctcactgcaagctccacctcccgggttcacgc

SEQ ID NO: 17039 - DNA, 201 bp, Homo sapiens
aaaaaaagttgtgcttaagctaagtttaatttattattgaagaaagaaatttttaaataaatttagtgaggcctaggtatacagtatttataaagtctacrgtagtgtacagtaatgtcctcagccttcacattcactcaccactcactgactcacccgagggagcaacttccagtcctgcaagctttattcgtggtggta

SEQ ID NO: 17040 - DNA, 201 bp, Homo sapiens
aaaaaaaaaaataccctttgggtgtgtattgattctgatgttttgctcctagctacatttgccgtttttttttgactgcagaattaggaaccagcttcatttttttttttttttttggatggaatctcgctctgtcgtccaggctggagtgtggtggcgcaatcttggctcactgcaagctccacctcccgggttcacgcc

SEQ ID NO: 17041 - DNA, 201 bp, Homo sapiens
agccttcacattcactcaccactcactgactcacccgagggagcaacttccagtcctgcaagctttattcgtggtggtactcccatatacgtatgtatacttttttttttttttgagacagagtctcgctctgtcgcccaggctggagtgcagtggtgcagtctcggctcactgcaacctccacctcccaagttcacgcca

SEQ ID NO: 17042 - DNA, 201 bp, Homo sapiens
ctattttcccactgatgtccctttttttggttccagatccaagagacgatcctacctggcatttattgtgttcagtttttctaattctgggacgttttcckgggttttctttagtcattcacgaagttcgcacttttggagaacatggggccagttattttgtagaatatctttctgttagagtttgtggatgtttcctcc

SEQ ID NO: 17043 - DNA, 201 bp, Homo sapiens
tatggtcaaattggcaacgaccacaccacatgagaaggaagattattcttcctggaacctggctcccttgagattcttttttttttttttttttagacggmgtttcgcccttgttgcccaggctggagtgcaatggcacgatctccggctcaccgcaacctccacctctcgggttcaagcgattctcctgcctcagcctcc

SEQ ID NO: 17044 - DNA, 201 bp, Homo sapiens
aaaaccttttgctgtgcacgcctgctccttcctccactcctaccccatctccatgaccctgtaagtggccacagtcatgtcactgggtaaagtgcttattraaacaaaattggcacaggcttctgatcctgcgtgtgggttggtgtagcagaggttcagtgcaacagaagaagtttttcatcttaaaatttggaagtaacc

SEQ ID NO: 17045 - DNA, 201 bp, Homo sapiens
tggggtcctgtggcggtgaaggggcgagtctgcacccaggcgagtgttaaaggcctggcctagagaagatgggtgttttgatggaaggagctgctgggaascatgtgtactcggtgtcttggagtttagaaacctcagttggctccatgtctcgtccttagtaaaggaatatcgggagctgagactggatgtattgacaca

SEQ ID NO: 17046 - DNA, 201 bp, Homo sapiens
cttggcagcaggctttttttgttgagggactggggagaaaggaggatcttgtggcatcttgagacgtgcaagttttgtggttggtgtattctgaaccctcygctgtgtgagcagcccgctcaggggcagtgtacgtggctgatctccactgtcctgcccgcgtggatgggggggttattctcagtgtacgtggctgatctc

SEQ ID NO: 17047 - DNA, 201 bp, Homo sapiens
cattcccttccgactagggtcatacgctcgtggctcattcacattccccttggtaataactaatgagggccattcagttaagtggctgggaaggtctgacrtggaagttgggtgatcctcaatggttatttccttttttgctctttctagcatttttatatccagaccttttgagtgagtcggattagggtgaggggttgg

SEQ ID NO: 17048 - DNA, 201 bp, Homo sapiens
agtggctcttcctgaggcagaccattcaattctgtaatgcccgactggggaagcccagagtccagtcacttcatttcttcttctataaaagtctaattgaktatttgtttatttagacctcccattatagaaagtgtgacatgctgggcctctggggaagatttttgagggttttgatgtcagagccccgaactttctctg

SEQ ID NO: 17049 - DNA, 201 bp, Homo sapiens
tatcttctccagtcggcctcccaaagggctgtgattacaggcgggagccacagcgctcagcctaaaaataactctttagccaaaagaaagttttaaaaaaytgtctgttgtattctttgattttactctatgtggtcttttctattatttttaaaataaaaaagatttatactcctcaagtgtaacattttatcaaatctc

SEQ ID NO: 17050 - DNA, 201 bp, Homo sapiens
aacaaacttattgccacccaggtcgacaggtgggaacagtgtcaccttatttgaacttaatttattcggcctttgagaagcacttatagccagtttcctcraggggcaacaaaatgacattgcagttcaaaagtgctttaaaaacttctttttcccaaagctataatctgcatgtcaccattctccagagtacattgaaaa

SEQ ID NO: 17051 - DNA, 201 bp, Homo sapiens
acttactctcctctgacaagcacccgcctcttcttcaggggtgcaagccacctatgccagctggagggcagagttccattcgtgaaacccttgaaacataygtactatgaaatacaaaaatgtgtaggaaagaaaacaagattattaatgaagttcatattggacacccctcagaggtctaaaatgatggtgcccctcctg

SEQ ID NO: 17052 - DNA, 201 bp, Homo sapiens
ctgtggagacgcaggcccccgggctctagaacgctgaattctagtgaattctggatggctctccctcacacccaggcccaccctccctcaaggttgcaccwtctccacctgaaggaagctgccaggtggccataggagcccttctcttggcaggccagcttccaggcccagtggcttctcttacatcaggggcctcccctt

SEQ ID NO: 17053 - DNA, 201 bp, Homo sapiens
ccttgaaaagaagaaggaaaaagtagatggagggtggtgagttaaaagaattgaaattcgcggataggcatttctatgcttttgttcctaccactcgactstgcaacacgcagtgctttgtaataccttcttggagctcaaaggtcaggctgaaacatggccgctttttcacatttccctgggacttttggaaaatataca

SEQ ID NO: 17054 - DNA, 201 bp, Homo sapiens
aacccacggtgcccagattgaacaaagatgatatgcaaacctcgaaagaaattggcatggaaaaaaaaaatccaaaattctcatgtgaatttttttaaatstccaacagaataatccagtcctagcacctccaagcctgagcaagatgattcagatggccggagagattgcagacggcatggcatacctcaacgccaataa

SEQ ID NO: 17055 - DNA, 201 bp, Homo sapiens
gtgacctagcaattccgggatccacccaagagaaatgaaaacatgcccacacaagacttgtgtatgaatgctggtagcagtattactcataatagcctccygggattcccccgacccccagcccaaaagaaagacccactggaaaccattcagatgttcatcagcagatgagtggatagaaagataaatggataaatgaaa

SEQ ID NO: 17056 - DNA, 201 bp, Homo sapiens
actgggcacggtccctgaggctggctctccagacgtttgaggcatttcttggtagaacacctcttagcattggttacagaaataattaagacaatgtcttyaggagattttgacttgggaataaaactcactgtccaaccttgcattcatccctccaattttcctagcttttaaggagcattgctccccttccagggaccc

SEQ ID NO: 17057 - DNA, 201 bp, Homo sapiens
tctccagacgtttgaggcatttcttggtagaacacctcttagcattggttacagaaataattaagacaatgtcttcaggagattttgacttgggaataaarctcactgtccaaccttgcattcatccctccaattttcctagcttttaaggagcattgctccccttccagggacccacattggtttctaagaggcaagctg

SEQ ID NO: 17058 - DNA, 201 bp, Homo sapiens
atcaacaaggagattttgtcctgtaactaactcaggtacctggaagcagcccgacatttgggggtgcatcgctgcagtctcctttggagctggagaaaccyatgagcaagaatgggcttatgacacatccatttccactccatccctccttccgttgtatgactgcatggagcccctctgacctccagcagtgtcacctgc

SEQ ID NO: 17059 - DNA, 201 bp, Homo sapiens
acgggcattgcagggggactcacagccgccggtcttccccctggggaaacaacgtcaaggttcctaattagaaagggctttacacagagacatgtatctamtgtttgaagattaaatctgtccatgaaatggaagacttgattttatatgaagtcatgaagagccaacaccacatagtaaaataccggctttgaaaaacac

SEQ ID NO: 17060 - DNA, 201 bp, Homo sapiens
tcctgtaactaactcaggtacctggaagcagcccgacatttgggggtgcatcgctgcagtctcctttggagctggagaaacctatgagcaagaatgggctwatgacacatccatttccactccatccctccttccgttgtatgactgcatggagcccctctgacctccagcagtgtcacctgcagcctggtagtgagaaac

SEQ ID NO: 17061 - DNA, 201 bp, Homo sapiens
cttttaaaaatcagctctaaatttttgtcttacaagtatgtattaaaaattctgaaatcaagtataatgaaattatatatcaatattcctttgcatttaaytccagagtggatctgcaggaatcaagaccaacctcatgcagagaacttaagaaatatttaaaaattagtagactggactttaattcttcatgtgtagtgc

SEQ ID NO: 17062 - DNA, 201 bp, Homo sapiens
agccgtgtttcccggctaggcgcgaggactcggtagggaagttggtgccggggcgggctccgcggttcccgggccccgcgacccgcacctcgccccttccrtgcgcacgagcctctccgcacacagcgctgatccccctgcggcgcgcaggcagcagcgacagcaccctgggccgcaccgcgtctccgctgctggggctga

SEQ ID NO: 17063 - DNA, 201 bp, Homo sapiens
tttcccggctaggcgcgaggactcggtagggaagttggtgccggggcgggctccgcggttcccgggccccgcgacccgcacctcgccccttccgtgcgcamgagcctctccgcacacagcgctgatccccctgcggcgcgcaggcagcagcgacagcaccctgggccgcaccgcgtctccgctgctggggctgaccgggca

SEQ ID NO: 17064 - DNA, 201 bp, Homo sapiens
cttgccagtggctctgtggcaagatcacactgagatcgatgggtgagaaggctaggatgcttgtctagtgttcttagctgtcacgttggctccttccaggktggccagacggtgttggccactcccttctaaaacacaggcgccctcctggtgacagtgacccgccgtggtatgccttggcccattccagcagtcccagtt

SEQ ID NO: 17065 - DNA, 201 bp, Homo sapiens; identical to SEQ ID NO: 1545

SEQ ID NO: 17066 - DNA, 201 bp, Homo sapiens
gtttgtaaaaaataaacatgaaggaagacttcattcaagaggtcacttaaaaattattattattattattattattattattattattattattattattrttattttaagaattaggtctctgttggccaggctggagcacagtggcacaatcatagctcactgaagcctcgaactcctgggctcaaacagtcctcctcc

SEQ ID NO: 17067 - DNA, 201 bp, Homo sapiens; identical to SEQ ID NO: 1547

SEQ ID NO: 17068 - DNA, 201 bp, Homo sapiens
aagaatggagccaggtggctattttttttttttaaatttatgtaataacaaacattcgcatttattgaaaacttaaagtataataaaaaaataaataaaakaaaaaaagaaaaaagaaaacttattcctgtgtcaggcacttttctaagtgctttgcagtgtattgtctcatttaatagttgtttaaattaacagagtagg

SEQ ID NO: 17069 - DNA, 201 bp, Homo sapiens
tccacttgcacttgtgttaaaatgcggcagaactttccctctatacttaaattgtggtgaaatacgtatgacataaaacttaccatcttaacttttttttmttgagacaggatctcattctgtcacccaggctggagtgcggtggcgcgatctctgctcactgcaacctctgcctcctgggttcaggcgattctcatgcct

SEQ ID NO: 17070 - DNA, 201 bp, Homo sapiens
ttttttttttttttttttttttttttttgagatggagtctccctctgttgcccaggctagagtgcaatggcgcagtctcagctcactgcagcctctgcctyccgggttcaagcgattctcctgcctcagcctcccaagtagctgggattgcaggcacccgcaaccacacccgggtaatttttgtatttgtagtggagacag

SEQ ID NO: 17071 - DNA, 201 bp, Homo sapiens
tctatacttaaattgtggtgaaatacgtatgacataaaacttaccatcttaacttttttttattgagacaggatctcattctgtcacccaggctggagtgyggtggcgcgatctctgctcactgcaacctctgcctcctgggttcaggcgattctcatgcctcagccacccgagtagctggaattacacgcgcccgccacc

SEQ ID NO: 17072 - DNA, 201 bp, Homo sapiens
tgtgcctctttctctgcatgctctgttgacggtctagtcttgagagagaacctgctgctgtcccgtctgtcgtagccttcctagcaactcttaggcctgcrtgctgtgttttcatgatctcccccaaagcggcactttgatgttttttcagagtcaaagtatcactgtggatatttatcccaaacaaaattgcaaactgat

SEQ ID NO: 17073 - DNA, 201 bp, Homo sapiens
cagcctctgcctcccgggttcaagcgattctcctgcctcagcctcccaagtagctgggattgcaggcacccgcaaccacacccgggtaatttttgtatttktagtggagacagagtttcaccgtgttgaccaggctggtttcaaagtgctgggattacaggcgtgagccaccgtgcccggcccctgaatcctatttttaag

SEQ ID NO: 17074 - DNA, 201 bp, Homo sapiens
tgccatatgaaacgtcattaagtggagagttgttcacgaactaggtaggtagttactttggtcttgccataggtttttggctgtttctgatgagctactgwttgaagacccctggggtaggggtgaggcctgcattctgggtccaagtctaagagtggcgactagaaatgagcaagttatttaaattgcctgggccttggt

SEQ ID NO: 17075 - DNA, 201 bp, Homo sapiens
cctttggtggtgaaggaatgtttccaatttctgctgatggtgtagtgctcttgggagctgggtgctctgaatgagcagatgggcatctgcttttttaagcstgctgttcattctgcaaaatagttattgtgcaaatacctgataagcaccaggtctgtgccaggcgctgtattttgtattttgcatgtctgaggccagcat

SEQ ID NO: 17076 - DNA, 201 bp, Homo sapiens
ggctggagtgcggtggcgcgatctctgctcactgcaacctctgcctcctgggttcaggcgattctcatgcctcagccacccgagtagctggaattacacgygcccgccaccatgcctggctaacttttgtattgttagagatggggtttcgccatgttggccaggccggtcttgaattcctggcctcaagtgatccccctg

SEQ ID NO: 17077 - DNA, 201 bp, Homo sapiens
gtcatggagaattgatccttagacattccttacctctctcacccacttgaggattgctcagagcctgggtttcggattgaaatagcactatttctggttgrtgacgacattctgtgagccagcaatgtagtttaaatatccacaagagcgccctggttccatcagcgccccttcgtaattggtcatgagacttggacctcc

SEQ ID NO: 17078 - DNA, 201 bp, Homo sapiens
ttggtcagggtggtctcgaactcccatcctcaggtgatccacgcgcctcaccctcccaaagtgctgggattacaggcatgaaccaccgcactcccttgagrttcttgtaagccaaggcagaagaagagacatcttaaagtctgtatgtgcacacctgcctccccccattttatatacaattcaagggctttgcttttggaa

SEQ ID NO: 17079 - DNA, 201 bp, Homo sapiens
tggccaggccggtcttgaattcctggcctcaagtgatccccctgcttcggcctcccgaagtgctgagattacaggcgtgagccgccgcgcctggccttccttttttttttttttttaagagatggagtcttgctctgtcgcccaggctggagtgccgtggtgcgatcttggctcactgcaacctctgcctcccaggttgaa

SEQ ID NO: 17080 - DNA, 201 bp, Homo sapiens
cttctactgtaggcttaccttcaaatcaaagataatacattcttttatagtattagatgtagagcaactttctccctcttataatctgtataaccattagsatactaacaacaagaagaaaattactctgaatactttaaaatgataaataggccaaggacttcaatgagctgtagaggatacatattacatccaaaatca

SEQ ID NO: 17081 - DNA, 201 bp, Homo sapiens
atactactatacaggaaatctgattgttgcattgaaacaggatttgttatcacatcacggttagacatacccaaaaggcaaaaactacagtggtcatgatkgctttacataagattttggaggagaaactgttagctccatgaaagcaggaactgtgttcactcttgaatgcctgctacctgcacatggtgaatgttctat

SEQ ID NO: 17082 - DNA, 201 bp, Homo sapiens
ctttttagtaacagtaggctttgtcataattggcttcatgttccagctttcctaaaactgtaagtgatgttgggtgggccagcagcaaaataattcacttwacaatttgcatgatagtctggaatgaaccgaatacctaaaaccaggaaataatagtagatatttaatggtttggggatcaaataagaatttactcccaga

SEQ ID NO: 17083 - DNA, 201 bp, Homo sapiens
gaaaatagtcttgggtatctgccaataatgttcactggagtgttgtttataatgtgcaaaacaggagctaacctaaatgtccaacaataagggattggttaaaaaaaaaaaacaaccctcatggtgtgtattaatactctggaactactgtccccttaaaatggtgatgtagaaggacatgtattgacctagtaaaatatt

SEQ ID NO: 17084 - DNA, 201 bp, Homo sapiens
tcattttccttatgtatgtagtatgtttcaaaaataatccaatgtcagattcttgcttctgtgatcaaggtcttgtttttgccctttctttgctcaccacytccctgcccctgacgccgagtcctcgccttagaggaggtggtcagcttatattgcaacattgaaaatgttataccttacaaagaaggtgatatgccattt

SEQ ID NO: 17085 - DNA, 201 bp, Homo sapiens
attcactcttcaactaggattttactcatgggatgcctgtgttcttcatttgaacccaattttacctatcatctacaaaaaaagaaaactattaagagttaaaaaaaaaaaaagagagagagagtcttgaactttgaaatccttcatccacgttttataaagtgtggggtcagattttttccctagttgaaattgaggaaa

SEQ ID NO: 17086 - DNA, 201 bp, Homo sapiens
tgatttcacttaccttcatttatagagagtggataattggcatagatagtgttaacattgtttatcgtggaatgttgagatcgttgatgatttttactggtttttttttttttggttattacctctaaactctgtaggaagcatgctttcttgatcaataaaacttaaagttggagtttatgctgcttttattcataaaaa

SEQ ID NO: 17087 - DNA, 201 bp, Homo sapiens
ttggatgatgctcttatagtttaataaagaaacaagcaaacaaaataggctatacagggcatgtgttcttaaactctgtgacagtggaggtgaacccaggsccctttcatggccttgggagggtcctcagctttgggggcgagttatctgggtggaaaagcaccatgggaggaagaagtcagagaggcgggttgctggagc

SEQ ID NO: 17088 - DNA, 201 bp, Homo sapiens
aaaaagataatccagcctcaccaacagccacagaattgaaatgagatacctgtttctgcttctggcattgggaaagaaagaaaaatggcactagcagccttttttttttttttttttttttttccccaaaaaatttgctactcttgaggttctgtcaaagaatgtgctgtggcctctagaagcatttttaaaaagagactt

SEQ ID NO: 17089 - DNA, 201 bp, Homo sapiens
ctttttttctcctcctcatggtgggtggccctggtgggctctctctggggcctccagtcctccttccccacaacactggggaattgctgccagttgaatarggccctttttttttttttttttttttgagacagtcttgctctgttgcccaggctggagtgcagtggtgcaatctccgctcactgcaacctctgccttact

SEQ ID NO: 17090 - DNA, 201 bp, Homo sapiens
acagccacagaattgaaatgagatacctgtttctgcttctggcattgggaaagaaagaaaaatggcactagcagccttttttttttttttttttttttttycccaaaaaatttgctactcttgaggttctgtcaaagaatgtgctgtggcctctagaagcatttttaaaaagagactttcacaagtgattgtgcaaaattg

SEQ ID NO: 17091 - DNA, 201 bp, Homo sapiens
agagatcatttatatggaagaaggaaccccaagtagaaacccaaaatctagaccattctgggttctaatctgtacctgccactggctaacatatggctttaagctggatgttacaatgagagctggagtttcgtctgattgcacatagccttgcttttctgtctttggaaaagtagctcactgcagagccctggtaaacgt

SEQ ID NO: 17092 - DNA, 201 bp, Homo sapiens
gatctcggctcactgcaagctccgcctcctgggttcatgccattctcctgcctcagcctcccgagcagctgggactgcaggcacccgcaaccacccctggytaattttttttgtatttttagtagagacagggtttcactgtgttagccaggatggtcttgatctcctgacctcgtgatccacctgtctcggcctcccaac

SEQ ID NO: 17093 - DNA, 201 bp, Homo sapiens
gtttctttagatcttggaccttgaggtgacctctgtaatggatatatttgaaattattaactgtcttcaagtgggggtttgatgagagagagagagagagwgtgtgtgtgtgtgtgtgtgtgtgtgtgtgtgtgtttacagaaaatatgctaggtttgtacattcaaatttgtgttatcctcttcaagaaagtcaccttgg

SEQ ID NO: 17094 - DNA, 201 bp, Homo sapiens
tcaccttccttcagtgagacaggaataggacagtatttgaaaagcatctaacatgtttccaagcacataggtttttggtaaatggtggcagctgctgctattttttttttaaattaaactatctaagagttgcattctgagaccatctaaaattctgagtcttaagctgtgttgactatatatgttcactaccataactaa

SEQ ID NO: 17095 - DNA, 201 bp, Homo sapiens
cgagagggaatgagttgaggattcgatcactgtttatagccagtctcggatcctgattgtgaagtcattctttctggataataactactatatccagcatmttgagagtataaaataaaggcacatgttgtacgtcatctctgagatgtagcgatggcttggactttggaggctgatgagagaaaactcatggtggtgagc

SEQ ID NO: 17096 - DNA, 201 bp, Homo sapiens
tttctttagatcttggaccttgaggtgacctctgtaatggatatatttgaaattattaactgtcttcaagtgggggtttgatgagagagagagagagagaktgtgtgtgtgtgtgtgtgtgtgtgtgtgtgtgtttacagaaaatatgctaggtttgtacattcaaatttgtgttatcctcttcaagaaagtcaccttggt

SEQ ID NO: 17097 - DNA, 201 bp, Homo sapiens
ggtaatcttgtattatttttgcactgtttggaattttttaaccatgtgcttttatttcttctattcttttcaaaggtcagtaggtgttatctggacaatagggttctggtctgttttctgttttcttcattgtactgtgcattaagaaaaaccctaatgtgcttttttttttttttaagtgaacctttccacatctcattg

SEQ ID NO: 17098 - DNA, 201 bp, Homo sapiens
ggtgcaatcacagctcactgcagcctcgaccgccaaggctcaagcgatcctcttacctcagcctcctgagtagccgggactagacgcacacaccaccatgsctgactaatttttgtgtttgtagtagggatgaggtttcaccatgttgcccaggctgatctcaaactcctgaccttaagtgatccacccgcctcggcctcc

SEQ ID NO: 17099 - DNA, 201 bp, Homo sapiens
gacaacttctgcctaaaaaataaaagcttctaagacataaattctgtgttatgaacaacttgcaattttcatagttttcagttttagctctggcagcctcwgatagatcttaaatatgtttatcacagctggaaaaatgttttattgtcatctttgtttatcataatatgccacctactctggttgtgtcttacaactgta

SEQ ID NO: 17100 - DNA, 201 bp, Homo sapiens
ggccaaggtgggcagatcccttgaggccatgggttcaagaccagcctgggcaacatgcaaaccccatctgtacaaaagattaaaaaaaaattagtttggcktggtggcacacacctgtagtctcagctccttgggagttgcaagtgggaggatcacctgagcccttgaggtcaaggccgaaataagccaaaatcgcctcac

SEQ ID NO: 17101 - DNA, 201 bp, Homo sapiens
acattggaggaagttggatgaaggctatgtgggatctctctgtaactttctcgtaaatctttgcagctttttgtgactctataattattttaaaataaaatttttttttttaaatggaaagtttatagggtatgtagataaattagaaacaacagaaggccaagtaaaaaagtgctgaaggaagcctctacccaggctgga

SEQ ID NO: 17102 - DNA, 201 bp, Homo sapiens
gactccgaggaggccaagggcatgggtgacagcaggcagactgctcgggtggaatgggcatcagctgcagggaagccgggggaagaacagggcacaaatcrgagttcagtgtgagacgcagtgagtttgtgggtagcccagtaactgggaacttggaatggagcagttgggccgggagggccagggtgggagccgtgccgt

SEQ ID NO: 17103 - DNA, 201 bp, Homo sapiens
caccaccggggctgaatttagtttacggggaacattagcagcaacagagggaggatgatatcccgcacttagcccagggcctggctcgctgtctgacaagyactgtcaccatagtaaggacagtttatctgctcgggatgtaagaagtgctggaaaggagggggcagcattgttcagtccatccctttccaagctcctcac

SEQ ID NO: 17104 - DNA, 201 bp, Homo sapiens
tccaagaaaagagtagaatgaaaggaggcaacttggtttcatagggagtgtcatgttgtccttctgagtttactgatgagcttacctgagaaaggagggtyctagcatgggagttctgttgctacaagacatgaaagaatggcctccgtttatcccggagaggagagtccctgagcccttgggagttgccttgaaacctct

SEQ ID NO: 17105 - DNA, 201 bp, Homo sapiens
ttaatatgtgaatgtatgtttcttatggaaattagaacaatacacagttacagagtagaaggtgataggtgatatagctcaccctctcctcttcctgctaytctccccagtctgcttcactccccggaaggaactactggcccatcagcatgtctccttccaggcattttttccatgtggttatgtccacctgcataagaa

SEQ ID NO: 17106 - DNA, 201 bp, Homo sapiens
acacggggcctctcgtttggtccagaacagcctggctcatcggctggggcttgcttgtgcagggctggagcgagcacgtgctagatggagacagcagactyggagtgtgcatttcttcgtgttgcaagcctggcctcacagtgccttcttcctttggttgtctgccaggggtagccctgcaccaggaggaagcttagaaat

SEQ ID NO: 17107 - DNA, 201 bp, Homo sapiens
tggggttttctgcctccctggtgcactgggcacagcggcttgcctgccttttgggtcgtctccacctcccagggatgtttttgttccctgatcgaatgacytcctgttttgtttgttttttgagacggagttttgctttgtcacccaggctggagtgcaatggcatgatctcggctaactgcaacctctgcctcccgggtt

SEQ ID NO: 17108 - DNA, 201 bp, Homo sapiens
aatccagagttaaaaataatgttcataaggaagggtagcaaaatttagattttaatacttataggaggtgtgttaattggccccagggccgcaggctttakcgttcagaggactttagccccaaaggttttgtggaacttttccagagtcctcaccagtacattgggaataaatggaatgcctttggaagtactttgaaga

SEQ ID NO: 17109 - DNA, 201 bp, Homo sapiens
atgagataaatttcacaggtaaatgtgacgtagctaatgcataatcattctttgtgttgcatggcaattctgtacaaatagaaggtagcatgtttaacgtycctgttatttcacataaatacagactgagagtttcagtggtctggtttgaaagggaagaaatagaagaaggaaggagagaagttggcagaggagcaatct

SEQ ID NO: 17110 - DNA, 201 bp, Homo sapiens
tgtacaacaaatttattttcatctgatcattgcacctctgctagccaaaacattttatcacaccagttactgctgcatggaacttgaaagcaataaaattwtctttaaaatcattgtttgattaggctttttgcacattgaggtgaataaaaaaaattagaactcctggaagggtaatttgtgagtctggccttgtgtcaa

SEQ ID NO: 17111 - DNA, 201 bp, Homo sapiens
tgttggcatttctcgtggtatcatacatgttgggtgcttcccaaattaattacatcagtcagaaaacttcactctatctgagaagctttaatagtgtactkgggattattaaatcctaaaaaaggttatcacaaagagttttcttggtgtgtgtctgtgcttagaatttagaaaataagtcatccagtattgaggccattt

SEQ ID NO: 17112 - DNA, 201 bp, Homo sapiens
ttttttttgagatggagtcttactctgtcgcccaggctggagtgcagtggtgtgatctcaggtcactgcaacctccgcctcccgggttccagcaattctcytgcctcggccttctgagtaacagggtctatgggcatgtgccaccatgccgggctaattttttgtattggtagtggagatggggttttgccatgttggcca

SEQ ID NO: 17113 - DNA, 201 bp, Homo sapiens
cattaagatggccattcgaaaacattaagcacagaagaatcccattcaggtaatcttctgttggctggctgtagaactacggagaacatctggagaaacaygtcaagggtgtgtgtgaaatcgttgagcctactcgattttgtcgtgctgttgcgcggttttcacttggcactgtcctttaaactccttctgtgccgtgac

SEQ ID NO: 17114 - DNA, 201 bp, Homo sapiens
agtaatttagcttactgacaaaaagaaaagcaaaggaaattccagagaaagaacaggataccaagtctaaataaatttggaagacaaagagaatatcatartttagttcaatcttttaaacaaattgtcacaatttatacgttgggataagagaaccatgagaaaaggtatattctaagtcctgaacatctttctataccc

SEQ ID NO: 17115 - DNA, 201 bp, Homo sapiens
ttctgttggctggctgtagaactacggagaacatctggagaaacacgtcaagggtgtgtgtgaaatcgttgagcctactcgattttgtcgtgctgttgcgyggttttcacttggcactgtcctttaaactccttctgtgccgtgactctgcagtgtctggcagcgtagtagactctactccctctatggacgtgatccctc

SEQ ID NO: 17116 - DNA, 201 bp, Homo sapiens
agaaaaatggcactagcagccttttttttttttttttttttttttccccaaaaaatttgctactcttgaggttctgtcaaagaatgtgctgtggcctctaraagcatttttaaaaagagactttcacaagtgattgtgcaaaattgtgaggtcactgaataggtgtgtatcctcctaaggaggtagcgttggaggagctgt

SEQ ID NO: 17117 - DNA, 201 bp, Homo sapiens
aaaatggtttctctgcactaatgattatttaaaaaaaaaactctggcaagaacaaaaacaaatggttttttaaaaactctagaaataatttgatacattcraggactctggagagggagagagttaaaggctgatgtgtgtgactctttttcctctccccccaaggaaaaaaaatgaagagaaggagcttttaagtgcagt

SEQ ID NO: 17118 - DNA, 201 bp, Homo sapiens
tggaattcacaatcttttatgccaaaagaaagctttcagaatggcttgtcttttttgtagatacttgtatttatatgtccatgcacatacataagaaaggmccagggaaggtctgcttgaagatattaataaaggggtcacttgtgggtaggtggacttacttgttctctatattctctttacttgtttgtgatctctggt

SEQ ID NO: 17119 - DNA, 201 bp, Homo sapiens
gagcatagttcactgcagcctcaacctcctaggctcatgtgatgctcccacctacgcttcctcaatagatgggactatgttcctgcgccatcactcctggkgaatttttaaatttttgtagagatgcggtcttggtacattttctaggctggtctggaagtcctggcctcaagcagttcttccacctgaacctcccaaagt

SEQ ID NO: 17120 - DNA, 201 bp, Homo sapiens
gccaatggttttcatgatgattacagcatacacagtgatcacataaacgatgacagctatggggcacacaggccatttgcttacatgcctcgtatcatgaytgattactgctttgttagaacacagaagagaccctattttatttaaggcagaaccccgaagatacgtatttccaatacagaaaagaatttttaataaaaa

SEQ ID NO: 17121 - DNA, 201 bp, Homo sapiens; identical to SEQ ID NO: 1563

SEQ ID NO: 17122 - DNA, 201 bp, Homo sapiens
attcttttcaaaggtcagtaggtgttatctggacaatagggttctggtctgttttctgttttcttcattgtactgtgcattaagaaaaaccctaatgtgcttttttttttttttaagtgaacctttccacatctcattgtccttcagtgagagcaggctgtgtgtgtggtcttggtgaactgtcccgttccctggagacag

SEQ ID NO: 17123 - DNA, 201 bp, Homo sapiens
ttattgcttttgtaaacgcacataaaggactctgaactgttgctactcataacatttctgacgccaaatgtgtggggttttgccataccaacaaccagttstctaactctccagacaccaactgggggccttacaattcagtgcagttctgacactcaccacctggagttagcacagactccacagggatgagggttcagt

SEQ ID NO: 17124 - DNA, 201 bp, Homo sapiens
gtggtgtgggtggcagtgtgcactgatggagtggagagggtgtcagaatccggtgtttgtgtggtgggaaggaattgactgctggctagagaatgaggagygctgaaacctttgcaccattgcagtggacccgctgagaagggtgttctggggaggctgctctggtctctcgatggagtcaggattgggggacagatagac

SEQ ID NO: 17125 - DNA, 201 bp, Homo sapiens
tatttttaattttttgaggaaccactgtactgttttccatgtagactgcataagaattccaatttttccacatcttgccaacgtttatttttatttatttytttaaattttttatagtagctatccattctaatggatgtgaggtggtatctcattatggttttgatgggacttttgagttttagcaaatatcaatgaagt

SEQ ID NO: 17126 - DNA, 201 bp, Homo sapiens
gcacatgttttctcaccctgagtggctacacttgtacagtcataccctccaaactctaagatgtatactcttacataccaaaacacaaagaaacaacaggaagtaagaacaaaactcaagaggtctgagtgacatcttgccttgcttcacaacttcagagtttgcattgctttaaaaacattggttataagtgagtgtgga

SEQ ID NO: 17127 - DNA, 201 bp, Homo sapiens
gtgattttgcattgaactgtgatataagaatgatcatcagccccttgagattactgtgtgtacctgtgtcaccagtggcatataggggcttaaaagcaagyaagtttaatatatacattcattgagaacacactgtagactgttaggattttcggtgctggagccatagtgatgaatatgacaaggccctcacccttgagg

SEQ ID NO: 17128 - DNA, 201 bp, Homo sapiens
cttactatatttttattgtaccttttctatgtttaggtatgtttaaatacacacatacttaccatggtgttacaactgcctgcagtattcagtgcagtaaygcactacaggtttgcaggttggtagcctaggagtaataggctatactgtatagcctaggtgtgtagtaggctataccattgaggtgtaagtatactctga

SEQ ID NO: 17129 - DNA, 201 bp, Homo sapiens
cacatgttttctcaccctgagtggctacacttgtacagtcataccctccaaactctaagatgtatactcttacataccaaaacacaaagaaacaacaggaagtaagaacaaaactcaagaggtctgagtgacatcttgccttgcttcacaacttcagagtttgcattgctttaaaaacattggttataagtgagtgtggaa

SEQ ID NO: 17130 - DNA, 201 bp, Homo sapiens
ctcctgctctttgttttctaaactttcagcggactcgattgggcgaaagccttccggctccctttactaagtcgtttaggtggtggctggggggacaaagragggtttttatctttaaaagataagtacggtttagaagacacgggagaaataatccattttgttatgttatgcagttgaactgtatagcttctctagttt

SEQ ID NO: 17131 - DNA, 201 bp, Homo sapiens
gctcaagaaatcgtcctgtctcagcctcccgagtagctaggactacaggtgtgcaccaccatgtctggctaatttttatttgtattttatttttatagagwcagagtcttactctattgcccaggctgatcttgaactcctatctcaagtgatcctcctgcctcagcctcccaaagtgctgggattacaggcatgagccac

SEQ ID NO: 17132 - DNA, 201 bp, Homo sapiens
aagagccaggattttcaggctggccatttcaggatcagccatttcccacttcctgattcatagcttccaggatttgtaatgcctgtagacttttttctctyttgcttaaaagtggccattgaaagaaaaaataaatagcaaaatccccatcccagaagttctacttcctgttgttgtactattgagctctgaaaaacagct

SEQ ID NO: 17133 - DNA, 201 bp, Homo sapiens
cagaatgtttgaaactttgtgaggagtctgaccccacactgtaggctccctccatgtatatatttcttcttccttttcctttttttttttttttttttttwaatttttgagatagtgtctcgctctgtaaccccagttggaatgcagtggcatggtcatggcttactgcagcctcaacgtcccaggctcaagggatcctcc

SEQ ID NO: 17134 - DNA, 201 bp, Homo sapiens
acatgttttctcaccctgagtggctacacttgtacagtcataccctccaaactctaagatgtatactcttacataccaaaacacaaagaaacaacaggaagtaagaacaaaactcaagaggtctgagtgacatcttgccttgcttcacaacttcagagtttgcattgctttaaaaacattggttataagtgagtgtggaaa

SEQ ID NO: 17135 - DNA, 201 bp, Homo sapiens
tactctattgcccaggctgatcttgaactcctatctcaagtgatcctcctgcctcagcctcccaaagtgctgggattacaggcatgagccactgtgccctmtgtaaaagattcttatcaacagttaaaataagaagctgctcaagacatttacctatcctgaatgtttcaggccctcaaggtgccaggtagctgcaatata

SEQ ID NO: 17136 - DNA, 201 bp, Homo sapiens
acttggtcaaggtactgatagttttataagctagaataaatatcgtaaaatggctttgaagttgaaaggaattttggggggggaatccttttatgaagaatttttttttttttttacagtttgagaggaaaaataatgtattttgagaatgtgttttccttaatatttgttaaatgagtagactgtattcttaaggtttag

SEQ ID NO: 17137 - DNA, 201 bp, Homo sapiens
catgttttctcaccctgagtggctacacttgtacagtcataccctccaaactctaagatgtatactcttacataccaaaacacaaagaaacaacaggaagtaagaacaaaactcaagaggtctgagtgacatcttgccttgcttcacaacttcagagtttgcattgctttaaaaacattggttataagtgagtgtggaaac

SEQ ID NO: 17138 - DNA, 201 bp, Homo sapiens
cctagggttgtagaaattctcccccatgattgcacaacccactccttctcagccagtgtgcacctggagtcagctgtgtttggccttaaggtgtccatggkccagcagggagagggcagatgggtcagtgttgtcctgctagtgatgagtatcccatggtgggcatgctgatgccacgcaagggagagggtgtctggttct

SEQ ID NO: 17139 - DNA, 201 bp, Homo sapiens
tccaacgtaaagtgctgcacaaggactgtgctgtgagatccaggagtgtcttttcagccctcagtgagtgcctgcaggggacacagctgctttggaggaaygtggttccggagggtttcccactctccatcctagttgctaaagtcacgttccacgtattgtgttctgatgatagaatgaaagcccactccccgcaccctg

SEQ ID NO: 17140 - DNA, 201 bp, Homo sapiens
ttgagaaatcctgatgtccaagttgcacccccaccccaattcaataggagcgtttggggttaggatccaggaatcagtgcttgtctaaagatccctaggcwcttcagcaggcagcaaagattggaaaccactgctttatcccttcatttcttcccatgtgcatatcacaaagcactttgacggttttttttcctaaatatt

SEQ ID NO: 17141 - DNA, 201 bp, Homo sapiens
aagactaattgattaatttattaagcacttattgtccagtttgcctttaattttcatttttctaagtttccattagctatcatggcctcacttgttatttmataatgaatggttacaaattgtttgtgtgtttttgtaattagaatgtaatagcaatcgtctaccagatgagctgacattgtaatgacatgaagtcagtaa

SEQ ID NO: 17142 - DNA, 201 bp, Homo sapiens
tggaacgagcctcctccttggaagatggaagaccgtgttcgtggccgacctggcctctcctggcctgtttcttaagatgcggagtcacatttcaatggtasgaaaagtggcttcgtaaaatagaagagcagtcactgtggaactaccaaatggcgagatgctcggtgcacattggggtgctttgggataaaagatttatga

SEQ ID NO: 17143 - DNA, 201 bp, Homo sapiens
ctgtcactcacggatgtactctttgccccaggtgaaagtgacgtcctgcatttcacctccaccaccacgtcgaagaatcgcatcatcataacctggcaccrgtaccggccccctgactacagggatctcatcagcttcaccgtttactacaaggaagcgtgagtttctgctttgggtgatgccattctgttgacagggcta

SEQ ID NO: 17144 - DNA, 201 bp, Homo sapiens
ccgcctgagccccccaaatagctgggaccacaagtatgcaccaccatacctggcttttttttttttttttttttttttgtattttttgtagagacggggtmattctatgttgcccaggcttgtctcgaactcctggcctcaagcgatccacctgccttggcttctcaaagtgctaggattacagatgtgagccactatgcc

SEQ ID NO: 17145 - DNA, 201 bp, Homo sapiens
ctgggactacaggcatgtgccaccatgcccggctaatttttgtatttttagtagaaatggggtttcactatgttggccaggctggtcttgaaatcctgacyttgcgatccgcctgcctcgacctcccaaagtgctaggattacaggcgtgagccaccgctcctggccgagactctattttaaagctgtcttctcccactga

SEQ ID NO: 17146 - DNA, 201 bp, Homo sapiens
gtgcagtggcacgatcatggctcactgcaatttctgcctcccaggttcaagcatttctcattccccagcattccgagtagctgggattacaggcatgcacyaccatgcccagctaatttttgtatttttagtagagacggggtttcaccatgttgcccaggctggtctgaaactcctaacctcaggtgatttgcccgcctc

SEQ ID NO: 17147 - DNA, 201 bp, Homo sapiens
gcctgagccccccaaatagctgggaccacaagtatgcaccaccatacctggcttttttttttttttttttttttttgtattttttgtagagacggggtaaytctatgttgcccaggcttgtctcgaactcctggcctcaagcgatccacctgccttggcttctcaaagtgctaggattacagatgtgagccactatgcctg

SEQ ID NO: 17148 - DNA, 201 bp, Homo sapiens
gaggctgaggcaggagaatcacttgaacccaggagttggaggttgcggtgagccatggctcatgcatgtaatccttgcactttgggaggctgagacgggcrgatcacaaggtcaggagatcgagaccatcctggctaacacggtgaaaccccgtctccactaaaaatacaaaaaaaaaaaaaaaattagccaggcgtggtt

SEQ ID NO: 17149 - DNA, 201 bp, Homo sapiens
tggcaggaagggagaggatccgagcctctcctttgaggttgtgtaaccactggagagccagaggagacagttgctttcaacctggcttacattcaaagacttttttttttttttaaacaaaagacattttataaagcattgaattgaccattccacctcctacttggtcagtaaagctagatagggctcggattcagggct

SEQ ID NO: 17150 - DNA, 201 bp, Homo sapiens
gttttccctttcgtttttcttttctgcttttaatgagccttaattaatccagggagctaggctgcagtatctgtggctctccctgatgttttctttctgcmtttctgtcttggaggggaacctgaggatttggaagtagagggctctactagtgcttcctttttgtccttttctcattgtccaaaagagtcttaagcgatc

SEQ ID NO: 17151 - DNA, 201 bp, Homo sapiens
atttgaagcaccattatttcaggtgaactttgtgtgtgtgtatgttgttttgtttttgcaattcttctccgctactcttccaaaaaagaaaacacaaattyattaggttttgattgttaataaatcagtttgggagaaaacatttccagatatttgaattactcattcaaggacatttcgtgtttctccatttactcaact

SEQ ID NO: 17152 - DNA, 201 bp, Homo sapiens
ggcaggaagggagaggatccgagcctctcctttgaggttgtgtaaccactggagagccagaggagacagttgctttcaacctggcttacattcaaagacttttttttttttttaaacaaaagacattttataaagcattgaattgaccattccacctcctacttggtcagtaaagctagatagggctcggattcagggctt

SEQ ID NO: 17153 - DNA, 201 bp, Homo sapiens
gagccactgcctttgctgccacattttgcttggttattgtgtgagaacaccatttttctctttttaaatgaattgtgtttctctttttaaattgagcatcygactgggcgcggtggctcacgcctgtaatcccagcactttgggaggccacggtgagtggatcacctgaggtcaggaatttgagaccatcctggccaacat

SEQ ID NO: 17154 - DNA, 201 bp, Homo sapiens
aggaaagagactgggcttacctcttgtcccattcactccaaatctctcagtgcgtaggatagggtccatctggtccaaaggagagttttgtgtgactctgygtgttggagtgttttcgaaatgcagagaaattcagagcttctctagctttggctagagaaggaacaatggaagtgagtcttattctacctaagtttgatg

SEQ ID NO: 17155 - DNA, 201 bp, Homo sapiens
tcccaacactttgggaggccaaggtgggtggatctcttgaggtcaggagtttgagactagcctggccaacatgggtgaaaccccgtctctactaaaaatamaaaaattagttgggggtggtggtacacgcctgtaatcccagctacttgggaggttgaggcaagagaatctcttgaacctgggaggcagaggttgcagtga

SEQ ID NO: 17156 - DNA, 201 bp, Homo sapiens
aatagttttttagttccaataatacgtttcgtgtaacccagtatatccaaaatatccattttaacatggagtcagtattaaagttacctaaatatttcactttttttttttttttgtctaatctttgaaatcccatgtgcatgtctcaaattggactggccacatggaatgctcaggagtcccatgtagggaccagctgcc

SEQ ID NO: 17157 - DNA, 201 bp, Homo sapiens
ccaccctctgttctgccaagcattggtccccagcacccctgggtgttagtgcctcttcctggttcactcactcactttctctggccctctctgtgtctctstcactctctttctttcgagatggagttttgctctgttgcccaggctggggtgcagtggcatgatctcagctcactgcaacctccaccacctgggttcaag

SEQ ID NO: 17158 - DNA, 201 bp, Homo sapiens
aaatatatggaatgggcaaatgtatggtgacagaaagtagatttgaatttaccaggggatggggatagagtgtggaggggaatgggaattattccataatygataggttttctatttggagtgatgaaaatttttggaaatagataatgatgatagctgtaccattctgtgaatgcaattaatgccactgaattgtaccct

SEQ ID NO: 17159 - DNA, 201 bp, Homo sapiens
gtatttcatttcaggtgcagatgccttcactttcccacaaaaaaaaccccaacaaaacctaagaccttactgcaactaagtctccaagtactttttaaccyaatgggatgaacagcctgtggtctgctcagatcaccctgagtgcgtgtgagaaggcctgggctttgccaggaaatccaggaaggcagggccgggctgtgt

SEQ ID NO: 17160 - DNA, 201 bp, Homo sapiens
agaatgctttcatgatacgtcttggtacttcattacaacaaaaacaaacttattgccacccaggtcgacaggtgggaacagtgtcaccttatttgaacttratttattcggcctttgagaagcacttatagccagtttcctcgaggggcaacaaaatgacattgcagttcaaaagtgctttaaaaacttctttttcccaaa

SEQ ID NO: 17161 - DNA, 201 bp, Homo sapiens
acatatgtctatatcggggtgccagtggagtcaccctagtcatatgtaaactctatttatttggttccgaaactgaatttattttgtttgcaagtttggtrtttgggagcatttaagaaatatccatagattcttgtatgatactgacattaaatcattaaataccatattttttaaatgcctctgtctgtttgcatggat

SEQ ID NO: 17162 - DNA, 201 bp, Homo sapiens
attgatagaacaaggcaagaccactttccccctctgtgagggtggactgtgactctacgagagaagctattctgctttgaaatgcggcactagaggttggygtgtgtagcttttgactgtgaagtgtccaggaagagaaagcatcaatacaacaaattcagattctcagggctctcatggtgacttgaattcacattttgt

SEQ ID NO: 17163 - DNA, 201 bp, Homo sapiens
taagcaatacaatttaaataatttttaaaggaaacatttctaaaggacgttttacattgcttgcattaaaaagaatataatgaacataatccaactttttstcaatactcagggtcatcactgtgaaagtaacttcattctatgataagataatgatgctcccaggtgggcaaggcagtttttcatctaaggtaattgaga

SEQ ID NO: 17164 - DNA, 201 bp, Homo sapiens
gaacttgaaatgattggattattttgtaatacgtcgatactacttttagaagcttttgaataactgtgtcaaagaagctttagaagaggttttaagcaggrttgcagagaatgtactgagtgtgtttttccactcacaaggaaagacagcagctgaatgcagaagtgtgtgtctggttctaactctttatcacttcaggga

SEQ ID NO: 17165 - DNA, 201 bp, Homo sapiens
gaacccggagtacttcagcgctgctgatggtaagagtccgggccaccagcactgccagcgtgcagggcaggtagatcgggagctttcaggagggttgctartttgggaaaggaaggaggtttgcattattttgagctacctttggccttggatctgtcttcattaatatttctttctttctttttttttttaatcaaagtt

SEQ ID NO: 17166 - DNA, 201 bp, Homo sapiens
aaagaagctttagaagaggttttaagcaggattgcagagaatgtactgagtgtgtttttccactcacaaggaaagacagcagctgaatgcagaagtgtgtrtctggttctaactctttatcacttcagggactgtccaggcagcaccatccgttgggtctcctgcccttcctcctcccacccctgccttacccctggccat

SEQ ID NO: 17167 - DNA, 201 bp, Homo sapiens
ctgacaccatttaccttcaggaattcttactgtatgatggggagtaaacgaatatacaggtatttttttcatacttccaactgaatgtgaagaaatgaaaygagcaaattgttcacctggtgatattttatcatttcctcctctttgctgcagcaggatatgaaaacttcatccatctgatcatcgctctgcccgtcgctg

SEQ ID NO: 17168 - DNA, 201 bp, Homo sapiens
atgcaatgtaaaagtgatttactgtcctataattgttttcctgaaagcaaaatgatatttaagtgaactgcaatgaaaaatgcaacgactgtaatttatcrttgaagggcattttcaaagtgtatagaatgactaaagcttaagtgtattaaatattctagaggaagacatatttaggctataaatctagacttcctttgg

SEQ ID NO: 17169 - DNA, 201 bp, Homo sapiens
tttccactcacaaggaaagacagcagctgaatgcagaagtgtgtgtctggttctaactctttatcacttcagggactgtccaggcagcaccatccgttggrtctcctgcccttcctcctcccacccctgccttacccctggccattcttttgtgaccagtagtcctttatgaatggaattctgagaatgtataattttctc

SEQ ID NO: 17170 - DNA, 201 bp, Homo sapiens
tttgcgttttaatctgttggtgaagatgggtaaaatcctgcttgaccatttcattcagtttctcaatcccctgtggttaatttgtttttttcaaaaatgtrtttttatgtgatgaaaagaaatttttaaaaaccaactgctttctttcctatactagacttccttgctttgttctggtccttctatctgttagtatcctca

SEQ ID NO: 17171 - DNA, 201 bp, Homo sapiens; identical to SEQ ID NO: 1557

SEQ ID NO: 17172 - DNA, 201 bp, Homo sapiens
agacagcagctgaatgcagaagtgtgtgtctggttctaactctttatcacttcagggactgtccaggcagcaccatccgttgggtctcctgcccttcctcytcccacccctgccttacccctggccattcttttgtgaccagtagtcctttatgaatggaattctgagaatgtataattttctcagaagaatgcttcttta

SEQ ID NO: 17173 - DNA, 201 bp, Homo sapiens
ggtatccctttgtctgggataaaaaaaatcaaaccagaaggcgggatggaatggatgcaccgcaaataatgcattttctgagttttcttgttaaaaaaaawtttttttaagtaagaaaaaaaaaggtaataacatggccaatttgttacataaaatgactttctgtgtataaattattcctaaaaaatcctgtttatataa

SEQ ID NO: 17174 - DNA, 201 bp, Homo sapiens
agaagtgtgtgtctggttctaactctttatcacttcagggactgtccaggcagcaccatccgttgggtctcctgcccttcctcctcccacccctgccttayccctggccattcttttgtgaccagtagtcctttatgaatggaattctgagaatgtataattttctcagaagaatgcttctttagctcaccaaatatttct

SEQ ID NO: 17175 - DNA, 201 bp, Homo sapiens
cacttcagggactgtccaggcagcaccatccgttgggtctcctgcccttcctcctcccacccctgccttacccctggccattcttttgtgaccagtagtcstttatgaatggaattctgagaatgtataattttctcagaagaatgcttctttagctcaccaaatatttcttgtttgctgaggggggaaaaagatcctcct

SEQ ID NO: 17176 - DNA, 201 bp, Homo sapiens
cacctgtctgccctgtacttccatttcctttctttgaactcggggggcttgcatcggactacctgtgccgtttcctcaaactctaaaattgagtaagttaytgagggtttccgtggtctgctctgagaagatttcttgcttcctgatctgcctgtgtgttcgtgttgcttggtctctctctctgtctctctctctctcctc

SEQ ID NO: 17177 - DNA, 201 bp, Homo sapiens
ctcagaagaatgcttctttagctcaccaaatatttcttgtttgctgaggggggaaaaagatcctccttggaaaagtcactgggtgccaaaggtgggtgatkaggagagatgaacttctgggtgtgcctagcaaagctgtttctgttgataggcgattaacaaaacagccaaacttgacctaacagactgccattttgagag

SEQ ID NO: 17178 - DNA, 201 bp, Homo sapiens
aaaaagatcctccttggaaaagtcactgggtgccaaaggtgggtgatgaggagagatgaacttctgggtgtgcctagcaaagctgtttctgttgataggcrattaacaaaacagccaaacttgacctaacagactgccattttgagaggaatttgttttgcaggattaattggcttcgaggtgtactggtggctgtgcagt

SEQ ID NO: 17179 - DNA, 201 bp, Homo sapiens
gtttgaggcagactccaaccacatttccatccagtggcttagtggtcttacccgtgagcttgaactgttgtccctgccaggacagtctttgcctctgtaartatctccatattcctccatcctttcaggtcccattcagtccctaggtcctccatgatggaatattggttgatgcacttattccacaaacatttgttggcc

SEQ ID NO: 17180 - DNA, 201 bp, Homo sapiens
tatagctcagttgtatgtagtattttctgtgtggtgttatgccctctgtatctgttttctcagatgttttagttgcttttctctcttaatcttgattagayctgccagagctgtgcttattttgtgtccccatccaaatccagaattaattgccgtgctccacatgttttggtcaatggtggacctcatctgtaacagtag

SEQ ID NO: 17181 - DNA, 201 bp, Homo sapiens
catcctttcaggtcccattcagtccctaggtcctccatgatggaatattggttgatgcacttattccacaaacatttgttggccacctttcaagtgccagwcaacccttctaggtatggaggggtacagtgatgagcaagccactgtttctggctgcagagggctcactgtttagtgggagaaacagacaaatcatacatc

SEQ ID NO: 17182 - DNA, 201 bp, Homo sapiens
aaaaggggcttctacactgttggcctctcgaggagaacggtttttgtttctgtcttcctggaaaagaggtgactgctggcatcatctttctagataaactscttgctatgatgccattagaagcagtgttcttttgtgttttgcttttgtttttccctgtagacaggaataacattttgactagaaacttccctgatgtaa

SEQ ID NO: 17183 - DNA, 201 bp, Homo sapiens
gcctttgtttttattgttggtcactgtaagaattccaaggaatagaaggatctcatgggcaaaatcagtttgcttttttctctgtatatttgttagtttayagcagcttctattttcctcctatttttaaaagctgaaatgcctttaatcgcactcagtgtgtttattcatggaagccagagaagagggtcccttcctttc

SEQ ID NO: 17184 - DNA, 201 bp, Homo sapiens
atttggaagtaacccctggccagcaattcactgtagtgtttgggaaacataggaatatctgcttattgtgacagattctcaagaaacctgtttcctttccrcaaagatggaaaccaggcactgtaccaatgagtcagttcactacgttttgtcctctgtccttacacgcagcggagacagacgagaacttggtcctctgcc

SEQ ID NO: 17185 - DNA, 201 bp, Homo sapiens
aaggaccgtgttttcctcaggggaatccatgggctgagaagactggggagcctcagaggccctttcccaaagccctctgctctccccttccaggttctgasctaaggaccagccagaagcctgccgagcgtcagccgaacctgcaagtggcttctgggctgttccgttccctgcgtgagctttccctctctgctgctgctg

SEQ ID NO: 17186 - DNA, 201 bp, Homo sapiens
tcggtaggacccccgtgtgccactacacaaagaaggaccgtgttttcctcaggggaatccatgggctgagaagactggggagcctcagaggccctttcccraagccctctgctctccccttccaggttctgacctaaggaccagccagaagcctgccgagcgtcagccgaacctgcaagtggcttctgggctgttccgttc

SEQ ID NO: 17187 - DNA, 201 bp, Homo sapiens
gagaaccacctgggtagaggtttccaaaattgtctgattgtaaaaatcacctgaggagcttggtaaagcttgactgtcccaggcctcatttgaggctactragtcaatgtccaggctggggcttggacaagaatgtcattctttttgggtcaaagccaggttaggtgataccgccttgccagataaatggccgggactagg

SEQ ID NO: 17188 - DNA, 201 bp, Homo sapiens
gagctgcggtgagagagaccatgaaaagaagggccagagcggtgtcctgcagagggtggtgtaccttgggagggaagtgtgtagggttgttgaggaacagygtgctgcacagggaggaaagacgtggggcagcattgtgggaagagcaaccaagattctcataggcttgggagcggaagccctgaggtctgttgctggact

SEQ ID NO: 17189 - DNA, 201 bp, Homo sapiens
gtgctttagggtggggggacttgagacccttgacttgactcggtcccactggaaagcttctgttgcttatttgggtaaccccaactctatcttattgggcrgtagtgttatcctaattcttggaaatactcagtgtagaataaagagctgatgaaaatgtgtaagaagggagtaagtggtcattagagagaaatggtaatt

SEQ ID NO: 17190 - DNA, 201 bp, Homo sapiens
tgtgtgttggagtgttttcgaaatgcagagaaattcagagcttctctagctttggctagagaaggaacaatggaagtgagtcttattctacctaagtttgrtgtggggcagcctgttctgtagttgccttccaagcccttcttctttctgatgctttcttggtaccattgcccacatgctgcctccaccctggatgaggtc

SEQ ID NO: 17191 - DNA, 201 bp, Homo sapiens
ctgtaatcccagcactttgggaggccacggtgagtggatcacctgaggtcaggaatttgagaccatcctggccaacatggtgaaactcctgtctctacttaaaaaaaaaaaaaatgcaaaaactagctgggcatggtggtgcacatctgtaatcccagccacttgggaggctgagggcaggagaatggcttgaacctggga

SEQ ID NO: 17192 - DNA, 201 bp, Homo sapiens
ttttaaaagggttccattttcccctcatatgactttggttcattctcctccttgtttctgtctctcagtgaactttccaaaagatgggttatgatgaaagrtgaatcgtcgttgataactgctcttacttatctgtgtatcgaaactgcaggtagtgctcttcagctctgtggctggatttagtgcctcttctagggaggg

SEQ ID NO: 17193 - DNA, 201 bp, Homo sapiens
tcttggtaccattgcccacatgctgcctccaccctggatgaggtctagacctgttacattgattctcaactaattaaaagtcaatatggtaaaatatttgyagcattccttctccttccctgtgttcatttctgaagctcaacagtcttccatactcaagctgtggggaggtccctttctcctttgacaccagccattttg

SEQ ID NO: 17194 - DNA, 201 bp, Homo sapiens
ttgggaggccacggtgagtggatcacctgaggtcaggaatttgagaccatcctggccaacatggtgaaactcctgtctctacttaaaaaaaaaaaaaatgsaaaaactagctgggcatggtggtgcacatctgtaatcccagccacttgggaggctgagggcaggagaatggcttgaacctgggatgcggaggtcatagtg

SEQ ID NO: 17195 - DNA, 201 bp, Homo sapiens
tctggatgctgaaagtccaaggtcaggtgtcaacaaggtctggttctagtgagggctctcttcctggtttgcaaacagctaccttctcactgtatcctcayatagtggtgggagagagcaagctgtggtgtctcttcactgattaaggacattaatccaattgtatcagggtctcacccttatgacctcatttgatcttaa

SEQ ID NO: 17196 - DNA, 201 bp, Homo sapiens
tctcatttttatgctgttcagagtgtggttgaagttcagccatcactagtccttcacggatagttcataccccaagttgatggccttgtggaattgctgaygctattttcatatatatatatatataattctagcctttttctctggtcttataagagtcacatacgtaggtaatttcatatcctacaaatatgttctaaa

SEQ ID NO: 17197 - DNA, 201 bp, Homo sapiens
taaaaaaaaaaaaaatgcaaaaactagctgggcatggtggtgcacatctgtaatcccagccacttgggaggctgagggcaggagaatggcttgaacctggsatgcggaggtcatagtgagccaagactgtgtcattgcactccagcctgagcaacagagagagactgcctcaaaaaaaaaaaaatccgtttacatagtgat

SEQ ID NO: 17198 - DNA, 201 bp, Homo sapiens
tccccccaccctggcttcccaaagtgctgggattacaggtgtgaaccaccacgcccggccaggatctgatcattttctaggaggcctcagggagcttttaytcatggcagaaggtgaagggggagcagttgtatcatggcaagaagagaaagagagacgccagatctcctggtagataactaacagagtgagaactcactc

SEQ ID NO: 17199 - DNA, 201 bp, Homo sapiens
gtttcaccatgttggccaggctggtcttgaactcctgacctcaggtgatccacccacctcagcctcccaaagtgctgggattacaggtgtgagccgctgcrcctggcccttggttcactttaatacacaaaacagcatgaaggagaaaagcttgatgaaataggtgactggagatctggcagagtatttcttgccagcatc

SEQ ID NO: 17200 - DNA, 201 bp, Homo sapiens
gagtctcgctctgtcgcccaggctggagtgcagtggtgcagtctcggctcactgcaacctccacctcccaagttcacgccattctcctgcctcagcctccygagtagctgggactacaggcgcctgccaccacgcctggctaattttttgtatttttagtggagacagcgttgcaccgtgttagccaggatggtctcaatc

SEQ ID NO: 17201 - DNA, 201 bp, Homo sapiens
tgttattcaaattcctgacctcaagccatctgcctgccttggcctcccaaagtgctgggattacaggcgtgagtcactgtgctcagccagttgcactacattttttttttagatgccattgttgaggatccaggggtttgtcatagattgattaatcagaaagtattaatctaaagtattagaatatattgattgcaggca

SEQ ID NO: 17202 - DNA, 201 bp, Homo sapiens
agcttcatccgctgaccaatgtggacctggagcgtgtgtgagctgacatccctgcggacagaaggatgccagtgctggtgaatttgtcttctcactgcacttttttttttttttttttgagatggagtctcgctctgtcgcccaggctggagtgcattggcgtgatcttggctcactgcaacctctgcctcccgggttcaa

SEQ ID NO: 17203 - DNA, 201 bp, Homo sapiens
ttcgtttttaagagacagggtctagctctgtcacccaagctggagtgcagtggcgtgattatagctcattgcagccttgaactcctgggctcaactgattstgttgtgtcaccctccccaagtagctagaactacaggctcatgccaccacacttggctaatttttgttttttaattttttgtagaaatggaatctcacta

SEQ ID NO: 17204 - DNA, 201 bp, Homo sapiens
aggttacaccatgtgagagtcaatcacgtggggatgtgagctccaggacacaggggagaggaccactggggatccgggagcctggctaccccccagtaccccaccaacacacacacacacacacacacacacacacacacacactgcccctcacaggtgaccatctgctccacactttgagcagcgcagccactgttttct

SEQ ID NO: 17205 - DNA, 201 bp, Homo sapiens
cagtacgagtaccctggcctggctttgggttctacacggtctgactttagcctgccttggtctttgttcccctctcactccctccacccctgccccccccmacacatgtggagtaccttaccctgccttcctagttctggaatggctgcccctgtgccaggccaccccattttctagaaccaccttcatacagcccctgcg

SEQ ID NO: 17206 - DNA, 201 bp, Homo sapiens
ggttacaccatgtgagagtcaatcacgtggggatgtgagctccaggacacaggggagaggaccactggggatccgggagcctggctaccccccagtaccccaccaacacacacacacacacacacacacacacacacacacactgcccctcacaggtgaccatctgctccacactttgagcagcgcagccactgttttctt

SEQ ID NO: 17207 - DNA, 201 bp, Homo sapiens
agtacttgtaatgacctaagaactataagacaagcaagtcgtcttctgtaactgagtatcagcggattcaagcgttaaggaaaatgattaagagaaaacamccaaaaaagtcttaatggttctgtcaatcaagtggctatcaattcatggctattcaaaagcttttgtggctatgaaaataaactagattgaaaaaattct

SEQ ID NO: 17208 - DNA, 201 bp, Homo sapiens
gttacaccatgtgagagtcaatcacgtggggatgtgagctccaggacacaggggagaggaccactggggatccgggagcctggctaccccccagtaccccaccaacacacacacacacacacacacacacacacacacacactgcccctcacaggtgaccatctgctccacactttgagcagcgcagccactgttttcttg

SEQ ID NO: 17209 - DNA, 201 bp, Homo sapiens
acatttcatttagttttgcaacagccgatgaggtagattctaccaacattgttttacggaagaacaaatggaagcctggaaaaataaattgtctacctcayacacttcgcaggtggtaaacacaggatttgaactaagacatacttgattttaaagtgtttgcttttcctttgcactactgcatctgcgatgtttgcactc

SEQ ID NO: 17210 - DNA, 201 bp, Homo sapiens
caccatgtgagagtcaatcacgtggggatgtgagctccaggacacaggggagaggaccactggggatccgggagcctggctaccccccagtaccccaccaacacacacacacacacacacacacacacacacacacactgcccctcacaggtgaccatctgctccacactttgagcagcgcagccactgttttcttgccag

SEQ ID NO: 17211 - DNA, 201 bp, Homo sapiens
agtaactctggttcaagtgcaaggaatgcaaagttaagtgtatcattggaggtgggatttttgagtttgtcagtcatttattgatttgcatgtatccttayagttcaaaggtctttttctcaacttagttgatgatcatgctgtaagttgttttcttttgctttatcaacttttaaaaacgtttattaacttttaaatttg

SEQ ID NO: 17212 - DNA, 201 bp, Homo sapiens
ccatgtgagagtcaatcacgtggggatgtgagctccaggacacaggggagaggaccactggggatccgggagcctggctaccccccagtaccccaccaacacacacacacacacacacacacacacacacacacactgcccctcacaggtgaccatctgctccacactttgagcagcgcagccactgttttcttgccagcc

SEQ ID NO: 17213 - DNA, 201 bp, Homo sapiens
tgtgagagtcaatcacgtggggatgtgagctccaggacacaggggagaggaccactggggatccgggagcctggctaccccccagtaccccaccaacacacacacacacacacacacacacacacacacacactgcccctcacaggtgaccatctgctccacactttgagcagcgcagccactgttttcttgccagccatt

SEQ ID NO: 17214 - DNA, 201 bp, Homo sapiens
ttgggatggtctatgaaggagttgccaagggtgtggtgaaagatgaacctgaaaccagagtggccattaaaacagtgaacgaggccgcaagcatgcgtgaraggattgagtttctcaacgaagcttctgtgatgaaggagttcaattgtcaccatgtggtaagagaaagttcctgaaaagccaaaatgcagcacagggaga

SEQ ID NO: 17215 - DNA, 201 bp, Homo sapiens
tcttgtccctgttccaggagaagggctgggtatgtgtcccccaaaggggagagcattcgagaaggatggcgccagcctccccagaactgacctgtggttaaaaaaaaaaaaaaaaattgtgctttttaaaagatgagttttatcagctcacacatccttctagagtctaatggagattttttgtgtgtgtggaaatagtaa

SEQ ID NO: 17216 - DNA, 201 bp, Homo sapiens
acacgtctttgttcagtgtttccactcaccgtggttgagaagcctcaccctctctttcccttgcctttgcttaggttgtgacacacatatatatatatttktttaattcttgggtacaacagcagtgttaaccgcagacactaggcatttggattactatttttcttaatggctatttaatccttccatcccacgaaaaac

SEQ ID NO: 17217 - DNA, 201 bp, Homo sapiens
ctttctcccaggtgcgccccttccgccacgttcgggctttccagtacgcagcgaaaaaaatgccgcatgcacgcatttatttattttgcaacagctgcaakaaacaatgaagcttttcaagaaccggggaaacgcgctttccagccgcgctgttgttgttttcaatgaacctctcccagccccgcactccccgcccacccc

SEQ ID NO: 17218 - DNA, 201 bp, Homo sapiens
aggcactctgtcaataaatgtatgttacagttcaaggttaagctgcctggattcttgcccttgcatctgggaagttgctgggtgatttcccacccagctcygtgcgcaagatgtgcactcattcataaaccccctccccacacacagtccccttccccggcattgttggcggtccttgtctttgccactgggaatctggtt

SEQ ID NO: 17219 - DNA, 201 bp, Homo sapiens
atcctccttggaaaagtcactgggtgccaaaggtgggtgatgaggagagatgaacttctgggtgtgcctagcaaagctgtttctgttgataggcgattaayaaaacagccaaacttgacctaacagactgccattttgagaggaatttgttttgcaggattaattggcttcgaggtgtactggtggctgtgcagtgatgac

SEQ ID NO: 17220 - DNA, 201 bp, Homo sapiens
aagtccctgggcaagtagccagcgtaactgattgacctaaaacaaaggatggagcccttggggctctgcatagtgaaatgtatgatttcttagtggaaaaygagaaagccactgaggaagcccagaagggaacttagcatatacagccagctttggggaagggggaagcagtgccaagcaagacaggtgcttttcagagac

SEQ ID NO: 17221 - DNA, 201 bp, Homo sapiens
ttagagagaaatggtaattgggatgatgctctgaccccttcagcaaaaaataaaaggtgaatggtttattatgagctagttcagattctgtttttggaaaygagcttggttatacatagtgcatttgaaaagcgtgaagcatggactttcagatgccagctcctcagcctcctgtaactccagtcgcaaaatccctccagt

SEQ ID NO: 17222 - DNA, 201 bp, Homo sapiens
tgtgaagcgaggacttggggtcccaagtctaggttttaggttccctgctgtaacccgtggccaccgagagagagttttatgataaaatgtcagcaaagtayctgacaacgtctcacgctagaatgagtttcgtacatgtttagttccctctctttttattccacgctcccccaccccaactttaaatcagaaacgtgaggg

SEQ ID NO: 17223 - DNA, 201 bp, Homo sapiens
gtgtgcttggtacgaagtagtaacatcaattcagtgttcagtacatccactttgttccagaacaatgtattcaaggtcggtgtattttggctgtgccacakagttctggaaattcccaagagaataagttttcacctgttatataatccagcacaagtgactgtgtagcagcaacctcatgtttcatgatgactttaaaat

SEQ ID NO: 17224 - DNA, 201 bp, Homo sapiens
cccgtggccaccgagagagagttttatgataaaatgtcagcaaagtacctgacaacgtctcacgctagaatgagtttcgtacatgtttagttccctctctytttattccacgctcccccaccccaactttaaatcagaaacgtgagggtgctgattgaagctttttataacttttcttattgagaattgttctctggagtt

SEQ ID NO: 17225 - DNA, 201 bp, Homo sapiens
agagagagttttatgataaaatgtcagcaaagtacctgacaacgtctcacgctagaatgagtttcgtacatgtttagttccctctctttttattccacgcycccccaccccaactttaaatcagaaacgtgagggtgctgattgaagctttttataacttttcttattgagaattgttctctggagttgtctccaagaaca

SEQ ID NO: 17226 - DNA, 201 bp, Homo sapiens
ctccttctctccttgtctcttctgtcctccagtcaaagaaaaactctgcatatgatctttggcctggagaaatattaaatctatgttaagtatgcagacaygaatgggcaaatgaaggatttgtggcaaagaagatctgccgaaacaaataagtcatgtaaatgggcagagggaaatattaaattgattgcatctttcagc

SEQ ID NO: 17227 - DNA, 201 bp, Homo sapiens
ccttgtctcttctgtcctccagtcaaagaaaaactctgcatatgatctttggcctggagaaatattaaatctatgttaagtatgcagacatgaatgggcaratgaaggatttgtggcaaagaagatctgccgaaacaaataagtcatgtaaatgggcagagggaaatattaaattgattgcatctttcagctcctggtact

SEQ ID NO: 17228 - DNA, 201 bp, Homo sapiens
tgcctggaagatgcggagcggagtttgcgtggcccggagcagctccagtgtctgaggcttctctgtgtcacaggctccaagcaggaagcgcaggcaaaatrgcaaaatacagcatgtggcattcagttcaaaaatgcccttttttagaagtcggtattctaaatgacatccagtcttgcttagttttttaagagaaaggaa

SEQ ID NO: 17229 - DNA, 201 bp, Homo sapiens
attaaatctatgttaagtatgcagacatgaatgggcaaatgaaggatttgtggcaaagaagatctgccgaaacaaataagtcatgtaaatgggcagagggmaatattaaattgattgcatctttcagctcctggtacttaatgcaaagataaagtagtgggaaaaggttgtcatttgaaataatggaaagatgagggagtt

SEQ ID NO: 17230 - DNA, 201 bp, Homo sapiens
gatactggatactagctcattaaactcttgtgagaagccttcattagcattatgggaagacttgctgtatctatattatgaaggcatttagattttttttwaaatgcatgttcttaacattttttgtttattaagtggggcagtagattaggactgaatggatttgattctctcatcctacatagtgtgcccagaagccag

SEQ ID NO: 17231 - DNA, 201 bp, Homo sapiens
atggagtataattctgttttcaggttgctctgccacagaggttaagaactccctcttccaaggtagacattgagaacagagacgaccacactgggttttcmctgcagcttttaaacaggatgactcccagcccccatccccgtggctagcagcaagcagggactctgaaacactgcaagccaatggactgagcatcttact

SEQ ID NO: 17232 - DNA, 201 bp, Homo sapiens
cagtagtggtggttggtgctgcgtgttgactggagttgcttgcattgggagagcctgacttggccaagtgtgtagcttgagaccagttggattcctctcasagagacagtcttcacccccaagctctgggtgttgggcgtgcagcattcgtattcagcaaacatttgctgatttccgcctctgcaactactgagctcagct

SEQ ID NO: 17233 - DNA, 201 bp, Homo sapiens
aaggcaaaactatagagacagaaagcagaccagggatggctgcaaggaagaggtggagattgaccaccaatgggaatgagggaactcttggatgatggaartgttctggaactgagtagtggtgatggttggacagttgtgtaaatttacggaagctcatggaatgatgggtgaattttttttttttttttttttgagatg

SEQ ID NO: 17234 - DNA, 201 bp, Homo sapiens
tggaggttgcagtgagccaagatcgcgccactgcactccagcctgggcgagagtgagactccatgtcaaaaaaaaaaaaaaaaagtgtcacccatcttggrggatcgttaccaatacttcatgagtgaatacatacacatttcttagaacctagggtttataaacactaggagttagctgatactattgttgctaaggata

SEQ ID NO: 17235 - DNA, 201 bp, Homo sapiens
gtttttagtttgttcaccacgcttgatggcagatttgcctctggatcctcaggccacgttcctatggtgggtagggatctctctctctctctctctctctstgtgtgtgtgtgtgtgtgtgtgtgtgtgtgtgtaaatagtgatttctctaagttaataaagaatgtggggtgacctcctacacatgcccgtatgctattg

SEQ ID NO: 17236 - DNA, 201 bp, Homo sapiens
tatgattggatttgtactgccaagatggggttttagcacttctaatgcattctggcaaggctggtatacttgtatcaagtgcacagccccactaccaccasctctaccacccacaaaaataaaaactagcaaaataaaatatgagccaacagaattctgtgggaatggcaagtgttttgtttttgtttttagtagtaatct

SEQ ID NO: 17237 - DNA, 201 bp, Homo sapiens
gaaaagggtgctgtatttcttcctgatggatacatgcttaaatggaaaagtagcatgagatgaactcccatagccccttccttttattatttttaaaatawtcattcatttatttatttatttttgagatggagtctcactctgtcacccaggctggagcgcagtggcgcgatctcagctcactgcaacctccgcctcccg

SEQ ID NO: 17238 - DNA, 201 bp, Homo sapiens
ggacttctgttcggcctggggcaggacgctgcatgtcagttcacctagagcccctcgcttgccctcacccctctccctttccttctcctccccgtgttgtstcatggtcagttcctctcctggcaaggcaagagaatcataaaatctctttggaccatgtgtctctctgatgcactttggaggttgaagctcactttcgtg

SEQ ID NO: 17239 - DNA, 201 bp, Homo sapiens
cagtgtttctttagatcttggaccttgaggtgacctctgtaatggatatatttgaaattattaactgtcttcaagtgggggtttgatgagagagagagagwgagagtgtgtgtgtgtgtgtgtgtgtgtgtgtgtgtgtttacagaaaatatgctaggtttgtacattcaaatttgtgttatcctcttcaagaaagtcacc

SEQ ID NO: 17240 - DNA, 201 bp, Homo sapiens
cggaagctcgggcgtccggccgcctcccgcgcggccagggccgggcttgtttttcctcgcctaggcagatttgggctttgccccctttctttgcagttttycccccttcctgcctctccgggtttgaaaatggaggccgacgacgccgacagtccgccccggcgcgcctcgggttcccgactccgccgagccctgggccgc

SEQ ID NO: 17241 - DNA, 201 bp, Homo sapiens
agcaccctgggccgcaccgcgtctccgctgctggggctgaccgggcagtggggagcgggcagccgcccggcccgcggggtgcgagttgccctcgagggggsaggtgccctgcggagaggccccgaagccccaggacacgtctccaagcgcccgtcgctgcctcccgtcgcccaacgtgcttttgcccctcgggctcctcgg

SEQ ID NO: 17242 - DNA, 201 bp, Homo sapiens
gaccctcatagtaaccctgctgcattttacaaaggaagaactgtgttggggtacagatgtgccaaacactcaaagttagaaaatcaacgcagtcggttgtrgcttctgcccttgaaacatcagatagtgagaacctgccactgttcagtttgcagagtggttggttgcatacagtgttttagctcttgcccactcaataca

SEQ ID NO: 17243 - DNA, 201 bp, Homo sapiens
gtgtttctttagatcttggaccttgaggtgacctctgtaatggatatatttgaaattattaactgtcttcaagtgggggtttgatgagagagagagagagwgagtgtgtgtgtgtgtgtgtgtgtgtgtgtgtgtgtttacagaaaatatgctaggtttgtacattcaaatttgtgttatcctcttcaagaaagtcacctt

SEQ ID NO: 17244 - DNA, 201 bp, Homo sapiens
ttgtgttaaaatgcggcagaactttccctctatacttaaattgtggtgaaatacgtatgacataaaacttaccatcttaacttttttttattgagacaggwtctcattctgtcacccaggctggagtgcggtggcgcgatctctgctcactgcaacctctgcctcctgggttcaggcgattctcatgcctcagccacccga

SEQ ID NO: 17245 - DNA, 201 bp, Homo sapiens
atcttggaccttgaggtgacctctgtaatggatatatttgaaattattaactgtcttcaagtgggggtttgatgagagagagagagagagagtgtgtgtgwgtgtgtgtgtgtgtgtgtgtgtgtttacagaaaatatgctaggtttgtacattcaaatttgtgttatcctcttcaagaaagtcaccttggtagacagcat

SEQ ID NO: 17246 - DNA, 201 bp, Homo sapiens
ccgtcgcccaacgtgcttttgcccctcgggctcctcgggttcctggccttgcccgtcactttggcccgctcctcgttgggttacctgcccccggcgtcccrgggctgggcggtggggtgaggggaagcgctctctgggcagccccccgggaagtgcgaggccgggagtcttcctcagcttgtctcttccggggagcgccac

SEQ ID NO: 17247 - DNA, 201 bp, Homo sapiens
aaatttgtattatttaatacatttaatgcattattttttattatatttaaatattgatttatttgtactttttgccttattgctatattgtttcaaaaaawttaacattatttgagttacatgatttcaaatacatactgattaacattttaattagaaactttatgtctgatatgaattgccaaaatgtgtagttggtac

SEQ ID NO: 17248 - DNA, 201 bp, Homo sapiens
gcagttttattttcctacccttgtctttctattttctctttcatctgctttagacttaaactgtgttttatgtattgctgtaagcctctttaaaccctttmtaaaacaaagcagggaatacataaacaaatagttttttgttttttgtttttttttctttgtaacagaaatcgacttaaagcctccagagaagtagaatct

SEQ ID NO: 17249 - DNA, 201 bp, Homo sapiens
cctctttaaaccctttctaaaacaaagcagggaatacataaacaaatagttttttgttttttgtttttttttctttgtaacagaaatcgacttaaagcctycagagaagtagaatctgtagaccttccacactgccacctgattaaaggaattggtatgtatatgaaaatgcttgttgggcacattgcattttttggccat

SEQ ID NO: 17250 - DNA, 201 bp, Homo sapiens
gttttggggacattcataaagaatagggattaactgaagtggcactgccatgtaacaatagcataattccagtttgttctacttaccaggcttgccctccrtgaaaatatacaattgtagataatcttttttaattggagagatttcctcttatgtccaattttatacataaagtaagacttttttattgtgtgcctaaat

SEQ ID NO: 17251 - DNA, 201 bp, Homo sapiens
ttttatctctgtttatgaatttgacctctacaaacaagttaatatcattcaacctattatttgaagatgttaatttgttgaacataaatattaaaaaaaamctttatgtttctgttatgccatttcttcactttttaatatgttggaattctcagaaaacggcctggctgtggggaggtttcctttactctttgagaagcc

SEQ ID NO: 17252 - DNA, 201 bp, Homo sapiens
ggtcattggtgctgtttctccttgttgcccaaaccagacccgtctttaataaagttgttctccacccatttctgcatagtttgagaaactcttcagctgtmgatcaaagacacttgaaatattcagctactgttcttacttcctatttattcaccagggaagcctgaagccagaatgccagacagcgcagacactattcca

SEQ ID NO: 17253 - DNA, 201 bp, Homo sapiens
gattaagaaaacgtggcacatatacaccatggaatactatgcagccataaaaaaggatgagttcatgtcctttgtagggacatggatgaagctggaaaccrtcattcttagcaaactattggaaggacagaaaaccaaacaccacatgttctcacttataggtgggaattgaacaatgagaacacttggatacaggaaggg

SEQ ID NO: 17254 - DNA, 201 bp, Homo sapiens
tattatttatttcctttgaccacccacaattatcatcagtgtcatcctcatcatcacaattaagattactaccacattaggctacataaactttttttttctctctctctttgttttataatttcaattttattttagattcaaggggtacatgtgcaggttttacatgggtatattgtctgatgctgaggtttggggaac

SEQ ID NO: 17255 - DNA, 201 bp, Homo sapiens
tttcctttgaccacccacaattatcatcagtgtcatcctcatcatcacaattaagattactaccacattaggctacataaactttttttttctctctctctttgttttataatttcaattttattttagattcaaggggtacatgtgcaggttttacatgggtatattgtctgatgctgaggtttggggaacaactgatgc

SEQ ID NO: 17256 - DNA, 201 bp, Homo sapiens
ttcctttgaccacccacaattatcatcagtgtcatcctcatcatcacaattaagattactaccacattaggctacataaactttttttttctctctctctttgttttataatttcaattttattttagattcaaggggtacatgtgcaggttttacatgggtatattgtctgatgctgaggtttggggaacaactgatgcc

SEQ ID NO: 17257 - DNA, 201 bp, Homo sapiens
agaactttgcaataggcatttttgttttaacttcatttctggtgcagttttattttcctacccttgtctttctattttctctttcatctgctttagacttmaactgtgttttatgtattgctgtaagcctctttaaaccctttctaaaacaaagcagggaatacataaacaaatagttttttgttttttgtttttttttct

SEQ ID NO: 17258 - DNA, 201 bp, Homo sapiens
ctttatcatctactaagtacatgtccctagtacataatagactagtagttagattatcaatgaacaataaatattggctttccttttttttaaattttaattttttttttttttttttttgagaggtggcctcactttgtcacccaggccagaatgcagtagcgcaatcttggctcactgcagccctgatatcctgggctc

SEQ ID NO: 17259 - DNA, 201 bp, Homo sapiens
attgaggggaaaaaagcattaaagtttgtggcccttataatcaagtactttacagtctactgatgggagaaaaggaaaacaaaacaaaacaaaaaaccactgtgagatatagatatgtcttttctttctctagcagataagtacctgaggctcaaggaggttaagcaacttttgcaaattcactttccaatatagtgtctt

SEQ ID NO: 17260 - DNA, 201 bp, Homo sapiens
ttgaggggaaaaaagcattaaagtttgtggcccttataatcaagtactttacagtctactgatgggagaaaaggaaaacaaaacaaaacaaaaaaccactgtgagatatagatatgtcttttctttctctagcagataagtacctgaggctcaaggaggttaagcaacttttgcaaattcactttccaatatagtgtcttt

SEQ ID NO: 17261 - DNA, 201 bp, Homo sapiens
atacttttttattatttatttcctttgaccacccacaattatcatcagtgtcatcctcatcatcacaattaagattactaccacattaggctacataaactttttttttctctctctctttgttttataatttcaattttattttagattcaaggggtacatgtgcaggttttacatgggtatattgtctgatgctgaggt

SEQ ID NO: 17262 - DNA, 201 bp, Homo sapiens
tggataggcaagcatggccatattaatttctcttgtggaaagctgaaagtgaatggactcttaatttgaaacaacaacaacaaaaatcaatgaaatattgmaactcaaattcccagttcctaaggaggtttccatcagctctcttccttaatgggagtccactttagagacaaagaggaaataagggttgggacaggaagg

SEQ ID NO: 17263 - DNA, 201 bp, Homo sapiens
tatttaacatttttcaccgttttggaaagggtctaaaattcccaggactccacagctttgcaccagataagcctggaggaatactaatgatggatctaaargaagaaaaaccaagggcacgggaattaagaatcagtcgtgggtttgatttggcctcattcaatccacatggcatcagcactttcatagacaacggtaaga

SEQ ID NO: 17264 - DNA, 201 bp, Homo sapiens
ttctgcctgggaagtgcctcctccgtcctcatctcaaatctcatctctctttacacagccactgcagatgccccttccttggtgagcctttctgtgtcctyggaagttagctatttctagacctgaactatttctcatgcttattaggtgtttaatgtgtacaaaccagtgagatttgttccaacacactataaactttca

SEQ ID NO: 17265 - DNA, 201 bp, Homo sapiens
atatggctaggagaaatgggaaagcagctgcttccttatggagtttggataggcaagcatggccatattaatttctcttgtggaaagctgaaagtgaatgsactcttaatttgaaacaacaacaacaaaaatcaatgaaatattgcaactcaaattcccagttcctaaggaggtttccatcagctctcttccttaatggga

SEQ ID NO: 17266 - DNA, 201 bp, Homo sapiens
taaattatacttttttattatttatttcctttgaccacccacaattatcatcagtgtcatcctcatcatcacaattaagattactaccacattaggctacrtaaactttttttttctctctctctttgttttataatttcaattttattttagattcaaggggtacatgtgcaggttttacatgggtatattgtctgatgc

SEQ ID NO: 17267 - DNA, 201 bp, Homo sapiens
ttgatgcaccttttctttacgtgactgtgatgcactttaatgggcagtgactttataaaatggtaactttattggatatgtggagccccaaatgggctgaygtgagaatgttggggtaggtggtgggtggctggatttagcaaagaaaaatgtaggctacccagttaactttgaatttcacatggattttttttttttttt

SEQ ID NO: 17268 - DNA, 201 bp, Homo sapiens
tgtttttaaatgagtaaaataaaatatataggattacacaggaaaccaattaaatactgctaccaagctatttaaaaatctatgatataatatgctttttwaattaaacccttaaatggatctagaggtaggtaaatgtctaacagcagatattttgaagttgcaatgaatgtaaatggcactttgagctatctacaactg

SEQ ID NO: 17269 - DNA, 201 bp, Homo sapiens
tttggttttgacaacctagaaataaccttgaagaaatcctatggagaagtcttaaagaggaagattggattttgtagactcaaagaatgtgtcatggtttggcttaatctaagccatttttattcttcttttcttgtgtttgggtctattatctgtctgtagaatttatacagtgagactgctggggaaagtcttatgtct

SEQ ID NO: 17270 - DNA, 201 bp, Homo sapiens
actgcagcctgaactcctaaactcctgcgctcaagaggtccttccacctcagccttccgagcagctaggactacaagtgctcaccataacactcagctaattttttttttttttttttttttttttgtagagacagagtcttgctatgttgcccaggctggtctcaaactgctggcctcaagcagtcctcccacgtcagcc

SEQ ID NO: 17271 - DNA, 201 bp, Homo sapiens
ctgcagcctgaactcctaaactcctgcgctcaagaggtccttccacctcagccttccgagcagctaggactacaagtgctcaccataacactcagctaattttttttttttttttttttttttttgtagagacagagtcttgctatgttgcccaggctggtctcaaactgctggcctcaagcagtcctcccacgtcagcct

SEQ ID NO: 17272 - DNA, 201 bp, Homo sapiens
tgcagcctgaactcctaaactcctgcgctcaagaggtccttccacctcagccttccgagcagctaggactacaagtgctcaccataacactcagctaattttttttttttttttttttttttttgtagagacagagtcttgctatgttgcccaggctggtctcaaactgctggcctcaagcagtcctcccacgtcagcctc

SEQ ID NO: 17273 - DNA, 201 bp, Homo sapiens
tcatacaggcctgggttcaaatcccacccagggcactggctaaatggttctatgagctacttttctgtagaacagacccctagaaatagaactatttgctcaaacagtgtgattcttttaaatgttaactttaatagatattgccaaattgtcctccagaattatctcattatttttatatgcacaaccacaacctataag

SEQ ID NO: 17274 - DNA, 201 bp, Homo sapiens
catacaggcctgggttcaaatcccacccagggcactggctaaatggttctatgagctacttttctgtagaacagacccctagaaatagaactatttgctcaaacagtgtgattcttttaaatgttaactttaatagatattgccaaattgtcctccagaattatctcattatttttatatgcacaaccacaacctataaga

SEQ ID NO: 17275 - DNA, 201 bp, Homo sapiens
gtgaatggcctagggtagttaggtgactgtgttccatatggtcattcaggggcaaatgctgatgaagcaacacagctgtcttcatctaagactagaactcygcttgttgccatttcccagcaggaaggggttgaaagaaaatttatgtagatttttttttctacccagtagttgcatatatattgtattctcacatcctat

SEQ ID NO: 17276 - DNA, 201 bp, Homo sapiens
tacaggcctgggttcaaatcccacccagggcactggctaaatggttctatgagctacttttctgtagaacagacccctagaaatagaactatttgctcaaacagtgtgattcttttaaatgttaactttaatagatattgccaaattgtcctccagaattatctcattatttttatatgcacaaccacaacctataagaga

SEQ ID NO: 17277 - DNA, 201 bp, Homo sapiens
aaagcaaagtctccttccatactcactgacctccccactctccacgaccccaatcttctgctctcaaagtaactactcttcagtttatgtctagattgtttatatatatacacacacacacacacacacacacacacatatgtggataatatgtaattcccctaattttataccttagaattataccacatgtatattctg

SEQ ID NO: 17278 - DNA, 201 bp, Homo sapiens
aagcaaagtctccttccatactcactgacctccccactctccacgaccccaatcttctgctctcaaagtaactactcttcagtttatgtctagattgtttatatatatacacacacacacacacacacacacacacatatgtggataatatgtaattcccctaattttataccttagaattataccacatgtatattctgc

SEQ ID NO: 17279 - DNA, 201 bp, Homo sapiens
aggttcctgatggtttttatgtgaaagacagtgagcagctggttattaccactgaggcaataaagagatactgtgggctttagcagaaacaccagtatatrtatttagtttttaaaataaggttttaaaaggaatgttttatttaattgcctacacagaatgaataaagtgatatttatagtaggactctgggtttgttta

SEQ ID NO: 17280 - DNA, 201 bp, Homo sapiens
cttttaaaatggaacctggttgtcccatcataggcagtattgagtgcagaagacattactcagacctttcttaagaaagggctaatataaaaaatacattkattacatgaattgattcaaggcctgaaaatgatgattaggataaacatgacttttgtcactccactttgaagaaaactctccagatttctcctacaatat

SEQ ID NO: 17281 - DNA, 201 bp, Homo sapiens
agcactttcatagacaacggtaagagccaatgggctaccaacatttagtaacgtgtgatggttcacaaatgactgtgaaaaatagatttggatcatatttmtaggaagagaagaacaattaactcatgagtgatttctgtattcttcattacaaagaacttgttcatttgcctcttcagctggcagtaagttatgctacat

SEQ ID NO: 17282 - DNA, 201 bp, Homo sapiens
agggatttattttcctcacatgaaaaacagctctgtgggtgacccaatatagagcttgttcattgagccagtgattatatcaaggaactgggttcttcatrtattttcattctttgatctccccctattgactttatagctgtatctttctcaaggatgcagaatggctgccgcagtctcaaacactgcgtgtgtgttcaa

SEQ ID NO: 17283 - DNA, 201 bp, Homo sapiens
gtctccttccatactcactgacctccccactctccacgaccccaatcttctgctctcaaagtaactactcttcagtttatgtctagattgtttatatatayacacacacacacacacacacacacacacatatgtggataatatgtaattcccctaattttataccttagaattataccacatgtatattctgcatccccc

SEQ ID NO: 17284 - DNA, 201 bp, Homo sapiens
ctccttccatactcactgacctccccactctccacgaccccaatcttctgctctcaaagtaactactcttcagtttatgtctagattgtttatatatatayacacacacacacacacacacacacacatatgtggataatatgtaattcccctaattttataccttagaattataccacatgtatattctgcatccccctt

SEQ ID NO: 17285 - DNA, 201 bp, Homo sapiens
ccttccatactcactgacctccccactctccacgaccccaatcttctgctctcaaagtaactactcttcagtttatgtctagattgtttatatatatacayacacacacacacacacacacacacatatgtggataatatgtaattcccctaattttataccttagaattataccacatgtatattctgcatcccccttaa

SEQ ID NO: 17286 - DNA, 201 bp, Homo sapiens
ttccatactcactgacctccccactctccacgaccccaatcttctgctctcaaagtaactactcttcagtttatgtctagattgtttatatatatacacayacacacacacacacacacacacatatgtggataatatgtaattcccctaattttataccttagaattataccacatgtatattctgcatcccccttaatg

SEQ ID NO: 17287 - DNA, 201 bp, Homo sapiens
acccaaacttagacatatggccacatctgtcagccagaaagggtgggcaatgttatctatagctgtgttgctacgtgcctattgctaaaaaggctaaaaasgaagaaggggaacatggatgctggtgaacacttggccacctctgacacagataattgctaaagtaataagaagagatggaaattaaatgtgctaagctag

SEQ ID NO: 17288 - DNA, 201 bp, Homo sapiens
aaggaattggtatgtatatgaaaatgcttgttgggcacattgcattttttggccattaacattaaaacactcattaatggcattttagcatgaaattactscttttcagtggataaatcacattagatcaacaaaaacctctttggtcaacctcttgatctgatgaaccctgtatttattcttctttcctaccctcactgt

SEQ ID NO: 17289 - DNA, 201 bp, Homo sapiens
tgatggttgcatgctagtaatcccacagaattagagccactcaagttgagagtgagtcattacacttcaagaacataaagctggttgaaaatgtggctaaragagaatcatgtgtacccccacccccagttcagtgtgtattagcctactgcttcttttagtttaaacttgatgaatatttttaatttctaatgaaatttc

SEQ ID NO: 17290 - DNA, 201 bp, Homo sapiens
acattatactattttaaatacagcatctactcatctttctattactattcaacttgaagcaaatattcttgccattattatttattttcaaatattatacyaaccttgcccttttgctttctttcttttttcccctgaatagccaatcataagtggaaagtcattgagtttatttacacccttcattttgccttgattctt

SEQ ID NO: 17291 - DNA, 201 bp, Homo sapiens
cagatattttcaaacttttaaaatggaacctggttgtcccatcataggcagtattgagtgcagaagacattactcagacctttcttaagaaagggctaatrtaaaaaatacatttattacatgaattgattcaaggcctgaaaatgatgattaggataaacatgacttttgtcactccactttgaagaaaactctccagat

SEQ ID NO: 17292 - DNA, 201 bp, Homo sapiens
aggctctgagcaatgccattttctcttggcttctttgcagtctctgtgtgaggcttacagtcatttttcacgtttgactcttcagaaggaagacagggctwctggttctacatctggaactcttttcccacaacaccaacactgagaaatgtgacatggtgctgtgtttacatttgcataggaacttgcattataagtttt

SEQ ID NO: 17293 - DNA, 201 bp, Homo sapiens
cttattaggtgtttaatgtgtacaaaccagtgagatttgttccaacacactataaactttcaaggagagaggctgtgtcttcttcatgtttatatctgctrcaacactgagttcatggcttttcacacataattgctcaacagagcaggtgccatggaaagtcaattcaatgagtaaaattacctcaaaatagtctgttaa

SEQ ID NO: 17294 - DNA, 201 bp, Homo sapiens
tttatcttagaaataaaaaaaatgaataatctctgatttttggcttctctggaccatgaggaattctatcaaactcagtatattgtgcacttatttatggkgtcttctctctgatcttatactgagctgaacaattgaaaacaactgaaactgtaattgggatatgacaccatgaggtgaatataggtcttacaggtgtgt

SEQ ID NO: 17295 - DNA, 201 bp, Homo sapiens
aggtcttgccacctcctcattgaacagaactgtgaactaaagccaggagaatgaagtcagtcgtccgtgaccacatggttaagcagcagcaatgctaggawcagggccgcgtgcccagctcacagagggagagtttttctgctcactgtacctcctataaaatcatcataagccctagagagagactttcatgtgtttctt

SEQ ID NO: 17296 - DNA, 201 bp, Homo sapiens
actttagagacaaagaggaaataagggttgggacaggaaggtcttgccacctcctcattgaacagaactgtgaactaaagccaggagaatgaagtcagtcrtccgtgaccacatggttaagcagcagcaatgctaggatcagggccgcgtgcccagctcacagagggagagtttttctgctcactgtacctcctataaaat

SEQ ID NO: 17297 - DNA, 201 bp, Homo sapiens
aaacagggcttattgatgattgagtgacatgcatgtacggtggtcttatattcatactttgtatcccctgaataggttctccgcatccagaacattctatstgagaagcctacagtgactacagtttatgccaacaatgggtctgttctccaaggaagttctgtagcctcagtgtatgatgggaagctgctcataggcact

SEQ ID NO: 17298 - DNA, 201 bp, Homo sapiens
ttagaaggtggaagcagggcgatgtgtaatttcctcacatgcatagaggcaggaaggttacctctaaattatttaatcaagtttctcatgtcatttagatwttgacaatttctcatttggaaggtacttgagctggatacactggtggataatttatctattgatccttcctcgggggacatctgggtaggctgtcatcct

SEQ ID NO: 17299 - DNA, 201 bp, Homo sapiens
taagagtaccacacgtagaacaaaatatggatgccagtgtagctattctgggtttttaaatactccctacaactagagaaagctcctgtttccagcgatcwcaagaactgaccatgattacatgcagcagcaggttgagagtgatattcatcagatttagggcccattccatgaagtattgatggcagtggaagaattcca

SEQ ID NO: 17300 - DNA, 201 bp, Homo sapiens
ggcttttcacacataattgctcaacagagcaggtgccatggaaagtcaattcaatgagtaaaattacctcaaaatagtctgttaattcactcacctttgawgtagacagattattctgcattgatacttatctcttactcttaaaattcgctatgtattaataaatattttattgaatattaaggaatgatcactatttta

SEQ ID NO: 17301 - DNA, 201 bp, Homo sapiens
ctgctgcaacactgagttcatggcttttcacacataattgctcaacagagcaggtgccatggaaagtcaattcaatgagtaaaattacctcaaaatagtcygttaattcactcacctttgaagtagacagattattctgcattgatacttatctcttactcttaaaattcgctatgtattaataaatattttattgaatat

SEQ ID NO: 17302 - DNA, 201 bp, Homo sapiens
tttctttttaaaaaattgggaatagcaaaagggaaatagacagagaatagcatatacttggatattcttatttgccatctatgtggtttcctcattttgcrgaacttgtggaaagacacggtagcctggctcctgacccagaatccatgaggcatagttgtatgtacttcccttggggcctaagagattaagagagaagcc

SEQ ID NO: 17303 - DNA, 201 bp, Homo sapiens
tgaagaacatgactattaagaacatgacttttttctttttaaaaaattgggaatagcaaaagggaaatagacagagaatagcatatacttggatattcttrtttgccatctatgtggtttcctcattttgcagaacttgtggaaagacacggtagcctggctcctgacccagaatccatgaggcatagttgtatgtacttc

SEQ ID NO: 17304 - DNA, 201 bp, Homo sapiens
agcttcttccaaggtacttcctcattttgttccttctctaatttatccccagcatttgcaaacaatccctatggtgggttgtcctgtcatcttttataagygctaatgtatatattagctaatatgtaagagctaaagagcttatatttccttatttataaatgtgtgtgtatagtttccttataaaccagggcaagcatg

SEQ ID NO: 17305 - DNA, 201 bp, Homo sapiens
aggaaagacagagaatgatctgttaggtcgtctaacagcttatacattcaacctttccttgcctgtggtatttaaatgtcagtgcctgcccagaggtcccrtagttatgtcttgtaaattaactctgttctttcaattctttagatgacacagtttatctctttgttgtaaaccacccagaattcaagaatacagtggaaa

SEQ ID NO: 17306 - DNA, 201 bp, Homo sapiens
taaatcttatgagtacttaatatttaatatggagaccaacaggccttttgtttcctctcacatgctatttttctttttcagtgtgaatgacatcacagctsttggaccggcacatttctatgccacaaatgaccactacttctctgatcctttcttaaagtatttagaaacatacttgaacttacactgggcaaatgttgt

SEQ ID NO: 17307 - DNA, 201 bp, Homo sapiens
ggcaacaatattatagtatattgtatatgactatagtcgtgatttttagctcgtcttttcctcttaccaaaaatttaaagcacatgttgcataaatcttaygagtacttaatatttaatatggagaccaacaggccttttgtttcctctcacatgctatttttctttttcagtgtgaatgacatcacagctgttggaccgg

SEQ ID NO: 17308 - DNA, 201 bp, Homo sapiens
tgctattttcaacagcatgtccccttaatcagtgtgtcattgtggaaaacagggcttattgatgattgagtgacatgcatgtacggtggtcttatattcawactttgtatcccctgaataggttctccgcatccagaacattctatctgagaagcctacagtgactacagtttatgccaacaatgggtctgttctccaagg

SEQ ID NO: 17309 - DNA, 201 bp, Homo sapiens
caggaacccccagagtacccatgtgaatgttctgcttgctgcctcgcaccttttatgacaattcccacaagaagctatgtggtctgtttctacttctgaargagcagcctttttccctttttttttttttttaaaccaccatcctttaaatcatttattatgtaactcttgtgtgctggtcagtcagtgtgtcaaaagtgt

SEQ ID NO: 17310 - DNA, 201 bp, Homo sapiens
gatttttagctcgtcttttcctcttaccaaaaatttaaagcacatgttgcataaatcttatgagtacttaatatttaatatggagaccaacaggccttttrtttcctctcacatgctatttttctttttcagtgtgaatgacatcacagctgttggaccggcacatttctatgccacaaatgaccactacttctctgatcc

SEQ ID NO: 17311 - DNA, 201 bp, Homo sapiens
ttcaccattcctatccagcctgtaggcaggtcctgttggttctacctgtgcctccttcctctacccccaaactcctttccctttgagtgagacctgcctartttaggttgtcatcctctctgactagcatatgagactttcttccaatttgttttctgtctacttggatttttttcactcttgccaattttgtctgtctat

SEQ ID NO: 17312 - DNA, 201 bp, Homo sapiens
cccaagctaacaaaaaaataacaataatgaaaagggagaatcagcttttactcctctttcaccattcctatccagcctgtaggcaggtcctgttggttctmcctgtgcctccttcctctacccccaaactcctttccctttgagtgagacctgcctaatttaggttgtcatcctctctgactagcatatgagactttcttc

SEQ ID NO: 17313 - DNA, 201 bp, Homo sapiens
ttttataaatataaattttaaagtgtgatcatactgatgcatacatattgaagtatcaggtatttccttttaaataaatgtattatttttattggctatayattattccattataaggatgatcttaaactaatttaaccaattctctattgatggatatgtgtataggggtggggagttctacataaaaaatattttata

SEQ ID NO: 17314 - DNA, 201 bp, Homo sapiens
taactctgttctttcaattctttagatgacacagtttatctctttgttgtaaaccacccagaattcaagaatacagtggaaatttttaaatttgaagaagsagaaaattctctgttgcatctgaaaacagtcaaacatgagcttcttccaaggtacttcctcattttgttccttctctaatttatccccagcatttgcaaa

SEQ ID NO: 17315 - DNA, 201 bp, Homo sapiens
acaaaactgtcattagagaagcagggactggctcaattgcccaggctgatgtgcagtagtgcaatcatagctcactgcagcctgaactcctaaactcctgygctcaagaggtccttccacctcagccttccgagcagctaggactacaagtgctcaccataacactcagctaattttttttttttttttttttttttttgt

SEQ ID NO: 17316 - DNA, 201 bp, Homo sapiens
agtgttctttatttccccattgcattgcactaaaatattccaatgcaatctgtgttttgttttgttttttcttttttaattttttttattttttgagacgsagtcttgttctggttgccccggctggagtgcagtggcatgatctcagcttactgcaacctccgcctcccgggttcaagcaattcttttgcctcagcctcc

SEQ ID NO: 17317 - DNA, 201 bp, Homo sapiens
attcattttaaacttgagttccatgactggaccactcttcctatagcaaaccaggaataaatattttttatgaattgcataattattttgtaactagcacrttacattgtattttatctctgtttatgaatttgacctctacaaacaagttaatatcattcaacctattatttgaagatgttaatttgttgaacataaata

SEQ ID NO: 17318 - DNA, 201 bp, Homo sapiens
cccatgtgaatgttctgcttgctgcctcgcaccttttatgacaattcccacaagaagctatgtggtctgtttctacttctgaaggagcagcctttttcccyttttttttttttttaaaccaccatcctttaaatcatttattatgtaactcttgtgtgctggtcagtcagtgtgtcaaaagtgtaaaaacttctttattta

SEQ ID NO: 17319 - DNA, 201 bp, Homo sapiens
tgcatacatgagacattttgcattgcatagaatttccgagggttcacagatactttgaagcccaaaagtgatccacagaccccagattgagaactcctccrctatgccatgcttaagcttatttctgtgtatcttctttctgaggagcaggcagatgggtcatctttacaatgtgaagttcttggcatttttattttgttt

SEQ ID NO: 17320 - DNA, 201 bp, Homo sapiens
gtgaattactgaaagcaggcagaggaaaagtataaaaagcaacctagttttaaactctccctcatgcaagtttatatgatgcaattttctacaactctcaytaccagctcattcatctctgctctgaccatgaatagcaaagaaatagaaatcatattttatttgacaattaacaaaagacatatcaaggtgggtatgtgg

SEQ ID NO: 17321 - DNA, 201 bp, Homo sapiens
gcttttactcctctttcaccattcctatccagcctgtaggcaggtcctgttggttctacctgtgcctccttcctctacccccaaactcctttccctttgaktgagacctgcctaatttaggttgtcatcctctctgactagcatatgagactttcttccaatttgttttctgtctacttggatttttttcactcttgccaa

SEQ ID NO: 17322 - DNA, 201 bp, Homo sapiens
tttcattgatacttttgtatttccccagttctacctcccctcccctagactggttggctgtcctggaatttcccttccttctttcaattgcccaaacactwagtgggaggaggcaaactcatatcaaatagcagattgactacatctgtgctggatcatgcagacagttcaagagtcccaagtaacttagcagcttcatct

SEQ ID NO: 17323 - DNA, 201 bp, Homo sapiens
aaacaatatagaaagatataaaatggaaagtaaataaaaataaaaatctctcatcaaactcttcatcacccccaacagaaataaccccaaagataaagctyccttttttatctttcctgatagtttcagtgcatttgcaaacaaatatattgactctttttttcacaaatagaattttagtgtaaatatttcacaaccttc

SEQ ID NO: 17324 - DNA, 201 bp, Homo sapiens
tctagtcctttacaacaacatccttctctagaggtaggagagacaatttaatattttgttttactctttagaaattaaaactcgggttacatggaaatgtkctcttctctgaataggtaacattgttaaacaagttttgagtgtccttccatctttttctttttatgaatactcctgtacataatttttaaaaacataagt

SEQ ID NO: 17325 - DNA, 201 bp, Homo sapiens; identical to SEQ ID NO: 1598

SEQ ID NO: 17326 - DNA, 201 bp, Homo sapiens
ggcttggaagcaaaacttcaggggaaaaagacaacatatggaattgaccacaattgaatttacaagtgaagtggctttacagaggaatcaggggatgtttytgagagaggaaattcattaaattctaacttgaatattttctgtttgcctttaagtcagagcaaaggctttgagtcccagcttcccagtttgtgaccttga

SEQ ID NO: 17327 - DNA, 201 bp, Homo sapiens
tattccaaagaaggctacagatagatacattttttccattggaattaggcaatggagttaaacagaagttacaatatggttgaaataaatgtatttttttwaaaaaagatttctctttccttaattattaaaaaatatacaattttgtagaaaattttaaacaaagtataaagaaaaaaataaaaatcattcataatccta

SEQ ID NO: 17328 - DNA, 201 bp, Homo sapiens
agtgctgggattgcaggcatgaggcactgagcccagccaatattggctttccttagatatggttcatggtatgattagaaacaaaaagaattagcagtcamaacacctagtttctagttctattctgccacaatgtaaccttaggcaaagttggtttttgtatttgtcacctataatgatgagtttgtgattagactaatg

SEQ ID NO: 17329 - DNA, 201 bp, Homo sapiens
tgagaggtggcctcactttgtcacccaggccagaatgcagtagcgcaatcttggctcactgcagccctgatatcctgggctcaagcgatcctcccgcctcrtcctcccaggtagctgagactacaggcacatgcccccactcatggctagttttttatttttgtagagacagggtcttgttatgttgtccaggctggtctt

SEQ ID NO: 17330 - DNA, 201 bp, Homo sapiens
ttcatgaccagtccgggctacatagcaagacccccatctctatgttaaaaaaaaaaaaactttaaaaaaaattactacagctttatatataagatatatgktggcacctgctgtagtcccaggtacatgagaggctgaggtgggaggatcacatgagcctgggaagtagaggctgcagtgagccatgatcacaccactgca

SEQ ID NO: 17331 - DNA, 201 bp, Homo sapiens
tagtagttagattatcaatgaacaataaatattggctttccttttttttaaattttaattttttttttttttttttttgagaggtggcctcactttgtcayccaggccagaatgcagtagcgcaatcttggctcactgcagccctgatatcctgggctcaagcgatcctcccgcctcgtcctcccaggtagctgagactac

SEQ ID NO: 17332 - DNA, 201 bp, Homo sapiens
ccttgcttgcctccctttctttttttcttcttttaaatcagcttcctcaggttgatctgcctctcattccttaggcatctgtttcctatgtgttctttctmctttttttcattgatacttttgtatttccccagttctacctcccctcccctagactggttggctgtcctggaatttcccttccttctttcaattgcccaa

SEQ ID NO: 17333 - DNA, 201 bp, Homo sapiens
tccataatccactctcatcattgtgtagcaatgtttctaaaacacctgccaaaacatgttacttccagtggcttcccaatgccccttagaatataattcargtttcttaacttggcctacaatctgccttcctctccagattcaattctcaccatcttcttcccaaatctttaagctcagtgattctcaaagcatggtccc

SEQ ID NO: 17334 - DNA, 201 bp, Homo sapiens
atcctgagactagcctaaaagatgtagacctccaaccctttaatgtcacctggaaccaggttgaagaacatgactattaagaacatgacttttttcttttwaaaaaattgggaatagcaaaagggaaatagacagagaatagcatatacttggatattcttatttgccatctatgtggtttcctcattttgcagaacttgt

SEQ ID NO: 17335 - DNA, 201 bp, Homo sapiens
agtggcttcccaatgccccttagaatataattcaggtttcttaacttggcctacaatctgccttcctctccagattcaattctcaccatcttcttcccaawtctttaagctcagtgattctcaaagcatggtccctgggccagcagcatcagcatcacctgcaaacttgttagagatgcaaattctcaagccccaccccaa

SEQ ID NO: 17336 - DNA, 201 bp, Homo sapiens
gcttctactaaataggactgaaaagcaaaacctggactagaattctctctcggtgtgtgtgtgtgtgtgtgtgtgtgtgtgtgtgtgtctgtgtgtacatrtgtatgtgctgtgtatacatgtgtatgtggtgtagcgttcccctgattcttaacttattaccagtggacaaccaccgtggaactagagtctagtcattct

SEQ ID NO: 17337 - DNA, 201 bp, Homo sapiens
gctaacacgtaactgaccaatatggtttggttgtgtccccacccgaatctcatcttgaattgtagttcccataatccccacgtgttgtgggagggacccaktgagaggtcattgaatcatgaggtggttaccctgtgctgctgttctcgtgatagtgagtgagttctcatgagatctgatggttttataagggcttttccc

SEQ ID NO: 17338 - DNA, 201 bp, Homo sapiens
tttatgtaggcagtgacagcatttaccctgctcactactctataactaggatctgatcttatggctaacacgtaactgaccaatatggtttggttgtgtcmccacccgaatctcatcttgaattgtagttcccataatccccacgtgttgtgggagggacccagtgagaggtcattgaatcatgaggtggttaccctgtgc

SEQ ID NO: 17339 - DNA, 201 bp, Homo sapiens
agccttgtggtcagctagtgaaggaagctttatgtaggcagtgacagcatttaccctgctcactactctataactaggatctgatcttatggctaacacgwaactgaccaatatggtttggttgtgtccccacccgaatctcatcttgaattgtagttcccataatccccacgtgttgtgggagggacccagtgagaggtc

SEQ ID NO: 17340 - DNA, 201 bp, Homo sapiens
tgtgttctgtgagccttgtggtcagctagtgaaggaagctttatgtaggcagtgacagcatttaccctgctcactactctataactaggatctgatcttayggctaacacgtaactgaccaatatggtttggttgtgtccccacccgaatctcatcttgaattgtagttcccataatccccacgtgttgtgggagggaccc

SEQ ID NO: 17341 - DNA, 201 bp, Homo sapiens
ttatttaaaaaaatactgtcatagggatgctaccttcttttcttttttgttagtaactatttgtgggatgtctttggtgtgtcaggctctgagcaatgccrttttctcttggcttctttgcagtctctgtgtgaggcttacagtcatttttcacgtttgactcttcagaaggaagacagggcttctggttctacatctgga

SEQ ID NO: 17342 - DNA, 201 bp, Homo sapiens
taaatgacctgtgttcagattacctggtaccatacaaaattgttctctggcaacaatattatagtatattgtatatgactatagtcgtgatttttagctcrtcttttcctcttaccaaaaatttaaagcacatgttgcataaatcttatgagtacttaatatttaatatggagaccaacaggccttttgtttcctctcaca

SEQ ID NO: 17343 - DNA, 201 bp, Homo sapiens
caaggtgttgttcctcctgaccacccagcaccaagatggcaaacaggtttcatcctgaactgaaatctgttccctagctcagggattcttatttccctttygttgttgttttaaaaaattgtgaggacaagtctgggtgtgatgagacactttgccaaaatcaattagtgacgcctaccatgggccagggaagaaaggaaa

SEQ ID NO: 17344 - DNA, 201 bp, Homo sapiens
tgtgttttttgttgttgttttgcaaggatgtgttcttggagatttttataatctagaattcacctatttcaagatttctctccagcccccatagtaataamtctgaagtaggagggatgaggtctccaaacacataaatctacagccattttagcttgggggcatgttatagttacaaagatcttatagccatatcaatag

SEQ ID NO: 17345 - DNA, 201 bp, Homo sapiens
ggcagtggaagaattccaataagaattttcacaattgaaaatactaatagatgaattctcaaatgaaggtttatgcacagtgtcagttctttcaataatamatgaaggtagaaattgggttccacaccattattattttcttcctactcaacaacacatattttaggttgattaagaatttcctatcttgctttgattgag

SEQ ID NO: 17346 - DNA, 201 bp, Homo sapiens
atacaggcctgggttcaaatcccacccagggcactggctaaatggttctatgagctacttttctgtagaacagacccctagaaatagaactatttgctcaracagtgtgattcttttaaatgttaactttaatagatattgccaaattgtcctccagaattatctcattatttttatatgcacaaccacaacctataagag

SEQ ID NO: 17347 - DNA, 201 bp, Homo sapiens
tcctgccataattgctaaatgacctgtgttcagattacctggtaccatacaaaattgttctctggcaacaatattatagtatattgtatatgactatagtygtgatttttagctcgtcttttcctcttaccaaaaatttaaagcacatgttgcataaatcttatgagtacttaatatttaatatggagaccaacaggcctt

SEQ ID NO: 17348 - DNA, 201 bp, Homo sapiens
ggaaaaacacactaatatgaatttaactcagttgaaggtaaaatatttatttttacatatagacagtaatctattatgctttgcaatgacatagtttttcyataagagtaccacacgtagaacaaaatatggatgccagtgtagctattctgggtttttaaatactccctacaactagagaaagctcctgtttccagcgat

SEQ ID NO: 17349 - DNA, 201 bp, Homo sapiens
gttctccaaccttcctattccaatacatactgtcatggatgggtacactaaaatctcagaattcactgctatatcactcatccatgtaaccaaaaaccacrtgtacccccaaaagctattgaaataagataaatacattcttatttaaaaaaatactgtcatagggatgctaccttcttttcttttttgttagtaactatt

SEQ ID NO: 17350 - DNA, 201 bp, Homo sapiens
gttcctggtgtcaaggtacacagccatggatgaatcatgaggcttgagtgcatcagagacctaagcgtgggcaggaacccccagagtacccatgtgaatgytctgcttgctgcctcgcaccttttatgacaattcccacaagaagctatgtggtctgtttctacttctgaaggagcagcctttttcccttttttttttttt

SEQ ID NO: 17351 - DNA, 201 bp, Homo sapiens
cattcatgagttggatgactttgtatatgatctgtcctgctctccatttcaaaggcaagaccaccaaaattcacaagcttattatgttgtcactaatgtgyaagccaccagtttttctgcaagttggaagttttctcaacagtcaaatattcccccttctcactaatcttaaggttttaaagttatagctgcaaatctaaa

SEQ ID NO: 17352 - DNA, 201 bp, Homo sapiens
tgggtgctttatatatatcatatcatattgtgtctgctttaataaatcatagttattgactacatatcatacaggatgtgtgccttctgtgggtcagaaartaagttcactatttagtccttttcaaaaattccttcccgatctatcttatagacagaaactaagcttttatacacccaagatttggcagattaacatctg

SEQ ID NO: 17353 - DNA, 201 bp, Homo sapiens
tcctggccagcatttggtggtgtcagtattttggattatactattatgaagtggtatctcattttgatttccaattacctgatgacataaaatgttgaacwttatgcttgtttgctatctgtatgtcttctctgataaggtgcctgtttataccattggcccattttaaaaatcttccttttgttgttgttttgttttctt

SEQ ID NO: 17354 - DNA, 201 bp, Homo sapiens
ttcaaaagggaaatattggtgggttttgcttttcaacaagaacttaatataactagttgtgttttatagagataagcctggaaggggggattggaggagarcaatggttctctgtacattagaatctcctggagggctggtgtctgagtggcaccaccaaagattctgattcagctgttctggatcagaatctacagctca

SEQ ID NO: 17355 - DNA, 201 bp, Homo sapiens
gtgatttctgtattcttcattacaaagaacttgttcatttgcctcttcagctggcagtaagttatgctacattttgaaattcctaacaggtaacacctgamagaatgtttagatttcataatcttttcatatacctacgatcatcacatttaaaaaagaactgtatttttgaattaaagtagaaacagattatgcatgaat

SEQ ID NO: 17356 - DNA, 201 bp, Homo sapiens
tatgagcatgaaggggcccatgccaaatgtatagtgcagcaggagcaaaggggctaaggtgggaagttggaagactagcaaatgggccaatttgaagggarcataaagtcaggagatgagaatagtagggtggtgggaaggataggttttgaggccattaaatataagttgaaaaatggggccccactttcataggcccaa

SEQ ID NO: 17357 - DNA, 201 bp, Homo sapiens
accgacccccatccccaaaagctgctttctatgtaagtttctcactggaatagcgagtgagaaatgtgtttgaagactagggaaacgagaaaggtatgcgrgctgctagagggtttcgggtgggttgtttgaaaaaggaagtgaaggaattcaaagtttcacatcatgagcctaatgtaaggcgtgtccgggccgtcccga

SEQ ID NO: 17358 - DNA, 201 bp, Homo sapiens
taggcctcatgcaaaagagttccagaaagactgagcacctgctatgtgtaatgttctctcttaggcttctatagtagagtacgacccttatggagtttgayacaggggaagagagaattaaaatacagtaaatgtataaattaggatgttctaaggacagacacaaatgaaccgcataggcttaaagaggaaagattccat

SEQ ID NO: 17359 - DNA, 201 bp, Homo sapiens
gaccttggataagaaaaaaaaaatcttgatttcaaatggaatttagcattttcttcaattacaaaactagcagacaaacctcagaagcatttgcagtactygtgactgttactaatggaaataacagttattttcattatttcattatagttgttttcagtatcatgaaagaacatttgcactcctctttatttaaaagaa

SEQ ID NO: 17360 - DNA, 201 bp, Homo sapiens
atttcattatagttgttttcagtatcatgaaagaacatttgcactcctctttatttaaaagaatgttgctagatcttgttatttaatatgttaaataatgwtgcacacattacattaccacattactatagcaaaaaattatgttttagatattttaacaattacatttcaattgttgacctttaattttaaagctaaggc

SEQ ID NO: 17361 - DNA, 201 bp, Homo sapiens
tgacctttaattttaaagctaaggcaaaattaatgtaagtagagagtttatttgggccaagtttgagtactgcaacccaggagtatagattcaagtttccytaaatatacactctgattagcagcagttacacatagatttttaaggggaaggaagaggcagttcctaaattccttgcgttaaaataacataagctgtgga

SEQ ID NO: 17362 - DNA, 201 bp, Homo sapiens
tgaagataatgggtgggacagctactcgggaacaaaatgtctttaaacaactgtccccaggcatgggtattggggcgtgactgaagtcccatactcatgtygctctgggcctgataaattttgcatacctcacaaagctcagactgctctcagctattttttttccttacaatgtaattgattttctttgcaatctataca

SEQ ID NO: 17363 - DNA, 201 bp, Homo sapiens
ccatccagtataatccaatatccttaggactgaagcagagatacacacacacacagggagagaggtgtttgtgcttttttttttttttttttttttttggkgagaggcaggtgggaaattggcatccacttttatttactggttctttataaaactgatatttgttgaaaattgtcaagtgtgaccatttctgcctacata

SEQ ID NO: 17364 - DNA, 201 bp, Homo sapiens
cagcaagactcggtctccacacacacacacacagacacacacacaacttacacacacttagctaggtgtaacggtacgtgcctgcggtcccagctactcargaggctgaggctggagggtcccttgagtccgggaggtccagactgcagtgagctatgattgtgccaatgtactccagcctaggcaacacagcgagaccct

SEQ ID NO: 17365 - DNA, 201 bp, Homo sapiens
gggtgacccaatatagagcttgttcattgagccagtgattatatcaaggaactgggttcttcatatattttcattctttgatctccccctattgactttayagctgtatctttctcaaggatgcagaatggctgccgcagtctcaaacactgcgtgtgtgttcaaatcatgaagaaaggagattgagtgatgccagctagc

SEQ ID NO: 17366 - DNA, 201 bp, Homo sapiens
gtgcctgcggtcccagctactcaggaggctgaggctggagggtcccttgagtccgggaggtccagactgcagtgagctatgattgtgccaatgtactccascctaggcaacacagcgagaccctgttaaaaaaaaaaaaaaaaagtattacgaggcacaggatgtttatttattcgcaactacgtcctgttataaaaagta

SEQ ID NO: 17367 - DNA, 201 bp, Homo sapiens
tgcggtcccagctactcaggaggctgaggctggagggtcccttgagtccgggaggtccagactgcagtgagctatgattgtgccaatgtactccagcctargcaacacagcgagaccctgttaaaaaaaaaaaaaaaaagtattacgaggcacaggatgtttatttattcgcaactacgtcctgttataaaaagtagtgat

SEQ ID NO: 17368 - DNA, 201 bp, Homo sapiens
atcccccatcccagttaatatgctcccattcactcatttccttccatgttttttctctttttaaaaaaactctaatcccataacagattacacccgcattaaaaaaaaaaaaaaaaaagagtctcattatgttgctgaaactggactggaactcctgggctcaagtgatcctcccacctcagcctgcagaagagtctctgc

SEQ ID NO: 17369 - DNA, 201 bp, Homo sapiens
ctcttttcccacaacaccaacactgagaaatgtgacatggtgctgtgtttacatttgcataggaacttgcattataagttttatttgttgagttattggctttttttttttaataacccacatcagtatatagaactttgcaataggcatttttgttttaacttcatttctggtgcagttttattttcctacccttgtctt

SEQ ID NO: 17370 - DNA, 201 bp, Homo sapiens
gtatgtacttcccttggggcctaagagattaagagagaagcccagacaatagtccaaggccctctgctttaggtctttcttctaaattctgattctttaatttttttttttttgttaattttaattttttttttgtagagatgggttctccctatgttgcccacaatggtcttgaactccccgcttcaagtgatcctccca

SEQ ID NO: 17371 - DNA, 201 bp, Homo sapiens
gattcctgcgggacctggccctgcggccgggggtggagaatttttgaatgctgtccctcccccagctagttgaacccccatcaccccgactctccgcttcyagtgaaaaaactagcaaagtttggagtgaatcgcgacactttcttgaaagtttataagcccttgctgctaacaaagttctcttctgcttaggctgacaag

SEQ ID NO: 17372 - DNA, 201 bp, Homo sapiens
ggcttctatagtagagtacgacccttatggagtttgatacaggggaagagagaattaaaatacagtaaatgtataaattaggatgttctaaggacagacamaaatgaaccgcataggcttaaagaggaaagattccatcccctgagggtggagttctagagggaggaagagacattcgacctgaccttgaagggtgggtgc

SEQ ID NO: 17373 - DNA, 201 bp, Homo sapiens
taaggcgtgtccgggccgtcccgaaggtatctggggaaataggtttgtgaggacaaagaccagggccaggcccagggcggagcctccgcggccccgacgcrgggactcggcctaggcggaggacggggcggagcgcggccggcaccatcgagccgggaagatggcaccgcccacggagctgctggccaggccggagcgagg

SEQ ID NO: 17374 - DNA, 201 bp, Homo sapiens
ctgggctcaagcaatcctcccacctcagcctcctaagcagtgaggactataggcatgcaccactacacctggctaattaaaaaaacatggccgggcacggkggctcattactataatcccagcactttgggaggctgaggcgggtggatacctgaggtcgggagttcaagaccagcctgaccaacatggtgaaaccccatc

SEQ ID NO: 17375 - DNA, 201 bp, Homo sapiens
ttctcagcatcatgtttttaaatgagtaaaataaaatatataggattacacaggaaaccaattaaatactgctaccaagctatttaaaaatctatgatatratatgcttttttaattaaacccttaaatggatctagaggtaggtaaatgtctaacagcagatattttgaagttgcaatgaatgtaaatggcactttgagc

SEQ ID NO: 17376 - DNA, 201 bp, Homo sapiens
acttttgctgctgagttaataattgtcacattattaaacagcccttggccctgggaagcccaccttctgtgaatacaagtctcagagtagacaatagggcmcaaccagccatgttacatgacagactgccaagtgcattcctcttacaactcactgggatggagcgctcctcagagaaaaacaagcccagcaacatttgta

SEQ ID NO: 17377 - DNA, 201 bp, Homo sapiens
ccccaacttccctgagtgttggctaccaaaagctctgagtgcacccagggagctaagtcctcctgcccacaggcaataatggactgacacggggtagactwaaagaaataagaggcacatcaatcaattgaaatgtgtgggaccttacctggactctgaattaaacaaactgtaattttttaaagctacaccttttaaaca

SEQ ID NO: 17378 - DNA, 201 bp, Homo sapiens
ggatactgtttgctgtattatacctaccataggctcgtgatgaggaaataataaaataaataactgtaatgaaaaagaaaagaaaggaaaacaaaaggaayctaaaacagagaaggcaaatagctttccttttgagtgtcaattttaacagactccctgtggttgcgaaacaatgtgtctgaggctggctctgggttagag

SEQ ID NO: 17379 - DNA, 201 bp, Homo sapiens
ggttttgaaagaggttttaaagaaaagtgcaggatattcattggtaaagatgttggtgagaggcttggaagcaaaacttcaggggaaaaagacaacatatrgaattgaccacaattgaatttacaagtgaagtggctttacagaggaatcaggggatgtttctgagagaggaaattcattaaattctaacttgaatatttt

SEQ ID NO: 17380 - DNA, 201 bp, Homo sapiens
ctcctgacctcaggtgatccgcctgccccggcctcccaaagtgcagggattacaggcgtgagccaccgtgcccagcctatatttgttacaattgatgaacytacactgacacatcataatcacccaaagtccattgcatttgtgttcactcttgatgttgtacattctatgtgtttggacaaatgcaaaatgacatgaatc

SEQ ID NO: 17381 - DNA, 201 bp, Homo sapiens
tatgttttcatcaagtagccattaaaagcaggtttcagaatctgctcaaatcgggcttgagttccaaccctccactcactatgtagatagactcaggaagktcatcaaacttctctaagcttcaggtttccaatttggaagttggagataagaatggtatcaaccaaatgagggtgttgtgaagcattcaacacaatacct

SEQ ID NO: 17382 - DNA, 201 bp, Homo sapiens
gctccagctcccacattatctcttccttcaacttctccaactcctgagttaggcctgagtgtggatccacacaataatactagtatcttctatggggcacmcacagaagcaaggttagagacctagcaacagggagaagccatcacaagcacctgtgatagaaggagaaaagttccagcttgttactcatttcacaggtcc

SEQ ID NO: 17383 - DNA, 201 bp, Homo sapiens
ttgaaaattgaatttatgattgtcaagagagaagtataatgtaaaagagttggaagataaagaaagccactcagaatgaagagctgaaagacaaaaaaatrgaaaataggacagaaaaaggaagaagaaaagatcaattcaggaggtccaatacccaactctgtcagctttgaaatatgtcaacttaactaagctaaactt

SEQ ID NO: 17384 - DNA, 201 bp, Homo sapiens
gaggccaaggtgggcagatcgcttgaggtcaggagttcgagaccagcatggccaacatgatgaaacccgtctctcctaaaaatataaaagttagccaggcrtggtggcaggtgcctgtaatcccagctacttgggaaactgagggaggagaatcgcttggacccaggaggaagaggttgcagtgagccgagatcgtgtcac

SEQ ID NO: 17385 - DNA, 201 bp, Homo sapiens
gacaaccatagcacagtaacgtcaaggttgttttgaccagaaatttatggtaagtaccttctcttacacaaggaacaataaataagccggaaatcttggargccttcacagaactggggttaatgacaagataacatggtggattaacatccaagatggaattgctttagtctccacaccccttatttaaatgagattggg

SEQ ID NO: 17386 - DNA, 201 bp, Homo sapiens
ggatttcaattaatttctgtaagatctaatacagctaatagacaaaacataccagcctcagcctaggatgtacaaagaggcctacagtgaaaatgggagtyaaaattgtccaactcctcagaggctttgaaatctcagttagaaggtttaatgaaggcagggtgaaaaatggtattaggcgattaactgtgtatgagtaca

SEQ ID NO: 17387 - DNA, 201 bp, Homo sapiens
acattttacagatttgtaatctgatgctaagagaggttaagtagtaaactacctaaggtcacacatctagtaaactggtagaaacaagatgcaaaggtacmtgagccctgggcccacactccagtcaatcctgccttcttagcctctggaggttgttcttcagaatctttgtcccagggacaagaaatggtctgagtgaat

SEQ ID NO: 17388 - DNA, 201 bp, Homo sapiens
ttacaatgaactgagatcacgccactgcactccagcctaggtgatagagcgacaccctgtcttaaaagaaaaaaatctgtattccaaagccagggtactawgtatttatagaagtccataagacttgggtgtattttgtaaattacttgttatttttctggttttaaagtcaataaactccagtttaagaaagaggtctta

SEQ ID NO: 17389 - DNA, 201 bp, Homo sapiens
ctaaggcatgaggatcacttgagcccaggaggcagaggttacaatgaactgagatcacgccactgcactccagcctaggtgatagagcgacaccctgtctyaaaagaaaaaaatctgtattccaaagccagggtactatgtatttatagaagtccataagacttgggtgtattttgtaaattacttgttatttttctggtt

SEQ ID NO: 17390 - DNA, 201 bp, Homo sapiens
gctacttgggagactaaggcatgaggatcacttgagcccaggaggcagaggttacaatgaactgagatcacgccactgcactccagcctaggtgatagagygacaccctgtcttaaaagaaaaaaatctgtattccaaagccagggtactatgtatttatagaagtccataagacttgggtgtattttgtaaattacttgt

SEQ ID NO: 17391 - DNA, 201 bp, Homo sapiens
caggtgtgatggcaggcacctgtaatctcagctacttgggagactaaggcatgaggatcacttgagcccaggaggcagaggttacaatgaactgagatcaygccactgcactccagcctaggtgatagagcgacaccctgtcttaaaagaaaaaaatctgtattccaaagccagggtactatgtatttatagaagtccata

SEQ ID NO: 17392 - DNA, 201 bp, Homo sapiens
gagaaactttagagaaattcccaggaatccaaccttgcatggaataaacctgggagtcctactgtatactgcaatctcccaaagtgggtttgactagagawttaacagcagaaagaagggctgggaatggaatgagcagaaagagggaaaagaggacctaggagtcaggaaagtcaagtccagttctgctactaatttaag

SEQ ID NO: 17393 - DNA, 201 bp, Homo sapiens
tctaacccctctccacttttgaaagcctagaaacaaataagtaagctaccgtgggctaaaacttgggtatttttctttagtttttttaaattatgatatcwtatatataatattacataatgtatgtagctatttttatcattactgtttgtcacttcttcggttgtagggattaacttcctgtatgctgcaactcatgaa

SEQ ID NO: 17394 - DNA, 201 bp, Homo sapiens
ttcctgtatgctgcaactcatgaacttggccattctttgggtatgggacattcctctgatcctaatgcagtgatgtatccaacctatggaaatggagatcyccaaaattttaaactttcccaggatgatattaaaggcattcagaaactatatggtaatatttattatttcaaataagaggatttcccattttctttttag

SEQ ID NO: 17395 - DNA, 201 bp, Homo sapiens
atgatacctatgagagcagtcatttgactttggcaaaaaaatgaggtttctcatggagtcaatttatgcagcagacagaaaaaaaaatcctttgaaagacraatacattgtgtgcttcctgccaataacgatgtaatacttcctcgttttagttaatgaaaaataacacatactttcaaagttctgtagactctaaaaaga

SEQ ID NO: 17396 - DNA, 201 bp, Homo sapiens
aatttgacaattagccaggcgtggttgtacgtacctgggctcccagctacttggaaggctgaggtgggagggttgcttgagcccaggaggtcagggctgcmgtgaggcatgactgtaccactgcactccagcctgggcaacagagcacgaccctgtctcaaaagaaaaaaaaagaatgcttacagttaaccctggcctcta

SEQ ID NO: 17397 - DNA, 201 bp, Homo sapiens
attttgttgtttgtttagctctttgtattttgattttagacagcaggaggcagtatctaccttgcagctaaagtggatatctattgttcttacctgcccarcatcccatcaccctacttctggggacaagaaactgcctcttccctttgtgtacaatcttcatgagatgtcacataggttgcctcaagctgcctgggctga

SEQ ID NO: 17398 - DNA, 201 bp, Homo sapiens
ccttctctttcttcctccttctccacactcccaacacccatgaatggctttctctatagggagatgaacaattgaaatttactttcttactgataaaaatyatccttcccacacataccctaaaagcagatcaatatcccgaaattcggaactatcctgcagccttaggaagccattccaagaatagatcaaatgagagga

SEQ ID NO: 17399 - DNA, 201 bp, Homo sapiens
ggggtggactgaagggacaaaacacctttcttcatagctgcccactcctaaggattcaatcctagataattataagtgaccctgctcttcctgtttgcacrtacatgtagagaaagcggttaaccacggacagaaactgcttatcattcctggtcttgatacttatgtatatcccttgccccagtctatgcttttttggtt

SEQ ID NO: 17400 - DNA, 201 bp, Homo sapiens
tcctttttatgggtctcaatgagtcccataaactagcacttcagagaacacactttggaaaatgctgtgtaactattcccaaaagttacgacgtaaagaamcactgctgtccaaaagattcacaaaatgctgactattgttcgtaaagttatcatgaacaaaactgaaaatactatcctccccttacataaaactgtggaa

SEQ ID NO: 17401 - DNA, 201 bp, Homo sapiens
catgtggtaaaattatgcaaatgatattgtccagattttcttcaagctgccacccactgctcttcctctctcagtttaaatagtttaggagagtgtccccygtaggggtggactgaagggacaaaacacctttcttcatagctgcccactcctaaggattcaatcctagataattataagtgaccctgctcttcctgtttg

SEQ ID NO: 17402 - DNA, 201 bp, Homo sapiens
ggcctcatatcacctcgaagataaccagctctgcatcacacattaaaggactataaaaagccattttaagagatcttgagcatggctctctaagagactayttactatgcccacgaagaataagctaggtttttaagaaaaaaaaaaaaaaaaacctatgaaatggtgcacaaattacttgccaaatgtggtattcatatt

SEQ ID NO: 17403 - DNA, 201 bp, Homo sapiens
ttatgggaaagcactaatcatggcactacaagttttttaagagctagataaactggactggcctcatatcacctcgaagataaccagctctgcatcacacrttaaaggactataaaaagccattttaagagatcttgagcatggctctctaagagactatttactatgcccacgaagaataagctaggtttttaagaaaaa

SEQ ID NO: 17404 - DNA, 201 bp, Homo sapiens
cgaagaaaatgttatgggaaagcactaatcatggcactacaagttttttaagagctagataaactggactggcctcatatcacctcgaagataaccagctytgcatcacacattaaaggactataaaaagccattttaagagatcttgagcatggctctctaagagactatttactatgcccacgaagaataagctaggtt

SEQ ID NO: 17405 - DNA, 201 bp, Homo sapiens
gcttgaacctgggaggcagaggttgcaatgagccaaggtcacaccactgtattccagcctgggcaacagagcaagactatgtctcaaaagaaaaaaaaaawatatatatatatatattttttttttttacgtgggtttttctatatgtaaaacccatttttttagtatatgtgttatatatgtgtgtgtgtgtatatatgt

SEQ ID NO: 17406 - DNA, 201 bp, Homo sapiens
gaatttttcagctccattataatcttataggaccattgtatatgtgatctgtttactgaaagatcattatgtagcacatgactatatgtttacaatatatmtacctaacatcgatattaaatcaacagaaagagtcgcagcttccaaaggcctcaagagtcccctgagaagtggtatatgacctgttgctaatgcctttca

SEQ ID NO: 17407 - DNA, 201 bp, Homo sapiens
tccatttttcggataaggaagttgaatttcataaaggttaaatattcagtcactgtaacacagaaggaatctaaccggggctgaataactctcctttaacrtaattacaagttaagtcagtctgctcagatcaccaaagcagaaaatcacactacagcaagaagaaatcaaaggtatgaaaaggaaagctatcagaatcaa

SEQ ID NO: 17408 - DNA, 201 bp, Homo sapiens
gtatgtttcattttgaaagaaaccatcaaactgtcttccaaggtggctgtaccatttttcatttccactaaaacatcctgcaattgccactgtcagcgttytggattttggcctttctaattggtaagtagtggtatctcattactgttttgatttgcatttccccaatgacatatgatgtgaagaatattttcatatgct

SEQ ID NO: 17409 - DNA, 201 bp, Homo sapiens
ctatataaatttctgcagtcactagcagaaaacaccaaatcaaccataggtccaagaacaattgtctctggacggcagctatgcgactcaccgtgctgtgkgctgtgtgcctgctgcctggcagcctggccctgccgctgcctcaggaggcgggaggcatgagtgagctacagtgggaacaggctcaggtatgtcacagcc

SEQ ID NO: 17410 - DNA, 201 bp, Homo sapiens
tgtgtattttttttgttttgttttgtttttttgagacagagtctcactgtattgcccaggctagagtgcagtggcgtgatctcggctcactccaatctccrcctcctgggttcaggtgattctcctgcctcagcctcctgagcagctgggattacacgcacctgccacaacacctggatgatttttgtacttttagtagag

SEQ ID NO: 17411 - DNA, 201 bp, Homo sapiens
agcctattgctcctaggctgtaaatctatacagcatgttactatactgaatacggtaggcaactgtaacacagtggcaagtatttgtgtgtctaaacgtayttaaacattgaaaaggtaatgtattgagctatgacattatcacaactactatatcactaggctataggaatttttcagctccattataatcttataggac

SEQ ID NO: 17412 - DNA, 201 bp, Homo sapiens
aattactctcttttcaataggactatctcaagagattttatctctatgactcagaaacaaaaaatgccaacagtttagaagccaaactcaaggagatgcaraaattctttggcctacctataactggaatgttaaactcccgcgtcatagaaataatgcagaagcccagatgtggagtgccagatgttgcagaatactcac

SEQ ID NO: 17413 - DNA, 201 bp, Homo sapiens
aaatgttcctgtgaggttgctattgttgttagttcattcacttttgttgttgttgtatttgtgctgctggattcctatcctcatattcagatactgagaamctttagagaaattcccaggaatccaaccttgcatggaataaacctgggagtcctactgtatactgcaatctcccaaagtgggtttgactagagatttaac

SEQ ID NO: 17414 - DNA, 201 bp, Homo sapiens
tgtgtttcttcatgtataaaatagggataacaatgccatacttgtttcatagagtggttatgaggtttacataaaataaatatgtaagtgcctggctctartaagtgcttaaaaatgttcctgtgaggttgctattgttgttagttcattcacttttgttgttgttgtatttgtgctgctggattcctatcctcatattca

SEQ ID NO: 17415 - DNA, 201 bp, Homo sapiens
taactaatgggatgattacttataactattatttgtaaatttaggccttaagcataagaaaagtcaatttttaattcacattaacttagacttttaaaaakttccagttataataagttagattgaaccacataaagttactagtatttaacttttaaaatctccaaaacagtagttttatatggttccacctaatgaatt

SEQ ID NO: 17416 - DNA, 201 bp, Homo sapiens
tgtgttttatacctcatggggtattctagtaagtaaatgaggtgataacaaaaccaactagcatgtatgtaacaattgtagattataaagtacttatataracattgtgtcatttaatccttagttctataaaaagaggaaaccaaagttaaactgattagtgtacttattagtggtagagatagaaatcaaggacaagtg

SEQ ID NO: 17417 - DNA, 201 bp, Homo sapiens
atttacaatactgtttgtaatggagatatctgaagtcagaaaacatgggtagaaattacaactctccaacaagtcaatgacaatagacaaggcattaacawctgactttgttttctcatgtgtccagtagaaaaaataatattatgtgttttatacctcatggggtattctagtaagtaaatgaggtgataacaaaaccaa

SEQ ID NO: 17418 - DNA, 201 bp, Homo sapiens
tttggcaaaaaaatgaggtttctcatggagtcaatttatgcagcagacagaaaaaaaaatcctttgaaagacaaatacattgtgtgcttcctgccaataaygatgtaatacttcctcgttttagttaatgaaaaataacacatactttcaaagttctgtagactctaaaaagaaagaaaacactcaaatgagtcacctatt

SEQ ID NO: 17419 - DNA, 201 bp, Homo sapiens
ctgcctctgaggttcaagcagttctcgtgcctcagcctcctgagtagctaggactacaggcacgcatcaccatgtttggctaattgttgtatttttattaraaacagggttttgccatgtttcccaggcttgtctcaaactcctgacctcaggcaatccactggcctcagctttccaaagtcctaggattacaggcgtgag

SEQ ID NO: 17420 - DNA, 201 bp, Homo sapiens
aggtttttggcccatctttaaaatcagattgtttgtgtttttattgttgagttttaaaagatacttgtatattttggataacagtcctttattggatatgkctttttttttttttttttttttttgagagagagagagagtctccctctgtcacccaggctggagtgcagtggagtgatctcagctcactgcaacctctgc

SEQ ID NO: 17421 - DNA, 201 bp, Homo sapiens
gagaggggagaagagagctattcgttaatggatacagagtttctctttgggatggcaaaatagctctcgaaatggatattggtgataattatataacgttrtaaatgtacttaatgaaactcaattgtacacttaaaatggttaaagtggtaaattttatatgatgtatattttaccagttaagaaaacatagtttccttc

SEQ ID NO: 17422 - DNA, 201 bp, Homo sapiens
atccagtaagctttcaatatatggtgattatcagtgatgagcaatggttctgtgaaaggaaaagtgtctgggccaagaaagcacccaaactaccctgtgartgcaaccgacagcacataacaatgtcagctacttgcactgggctgccttttttttttttttaatttattttttgagatggagtttcactgttgtcaccca

SEQ ID NO: 17423 - DNA, 201 bp, Homo sapiens
agtggaattttctactgtgcaagggtcatgaaattgaacaaaactaaaattggatattatggatattatccccatccttcaaatccttttttttttttttkggaggcagtgtcattgttacccaggctggtgtacagtggcacgcgatctcggctcactgcaaccaccgcctcgtgggttcaagcgattctcctgcctcag

SEQ ID NO: 17424 - DNA, 201 bp, Homo sapiens
aggctaagacaggtggatcatttgaggtcaggagttcaagaccagcctggccaacatggcaaaaccccctttctactaaagatacaaaaattagccaggtrtgatggcaggcacctgtaatctcagctacttgggagactaaggcatgaggatcacttgagcccaggaggcagaggttacaatgaactgagatcacgccac

SEQ ID NO: 17425 - DNA, 201 bp, Homo sapiens
aaaaaacctatgaaatggtgcacaaattacttgccaaatgtggtattcatattcattctccctcccaccaccctttggccgagcaaagtggtcaaatttamcaaaagcttaaatgcaaccttaagttagatataactgcattttaagtcctgtatccagtaagctttcaatatatggtgattatcagtgatgagcaatggt

SEQ ID NO: 17426 - DNA, 201 bp, Homo sapiens
tttgaggaaaagattgtcatattttaagaaataaaaaacacctgaattccagctgggcacgtggctaacgcctgtaatcacaacactttgggaggctaagrcaggtggatcatttgaggtcaggagttcaagaccagcctggccaacatggcaaaaccccctttctactaaagatacaaaaattagccaggtgtgatggca

SEQ ID NO: 17427 - DNA, 201 bp, Homo sapiens
aggtggtgataccaaaaaaattcaccccagaaaaaacagaaataatttacagaatagaagaggtatgagaaaaaaaaaataggacattctcacagaaattkgggacgacattacacacataaaaaacagtaaccagccaggggcggtggctcacgtctgcaatctcagctctttgggaggccaaggtgggcagatcgcttg

SEQ ID NO: 17428 - DNA, 201 bp, Homo sapiens
tggaaatggagatccccaaaattttaaactttcccaggatgatattaaaggcattcagaaactatatggtaatatttattatttcaaataagaggatttcycattttctttttagagtggggtaggaaaagaaaggctgggaaatgggtatttacctggaaaaccacactggaactcatatcaaaaagcctattgagggga

SEQ ID NO: 17429 - DNA, 201 bp, Homo sapiens
agtaccttctcttacacaaggaacaataaataagccggaaatcttggaagccttcacagaactggggttaatgacaagataacatggtggattaacatccmagatggaattgctttagtctccacaccccttatttaaatgagattgggaacaaaataacaactcattgaaaaaggtggtgataccaaaaaaattcacccc

SEQ ID NO: 17430 - DNA, 201 bp, Homo sapiens
catcccatcaccctacttctggggacaagaaactgcctcttccctttgtgtacaatcttcatgagatgtcacataggttgcctcaagctgcctgggctgakagaagagtacaggacccaagcttggcctatcagacactctcccaaaaacactggaggggttataggtggattcatcctggccatggggctctggagacac

SEQ ID NO: 17431 - DNA, 201 bp, Homo sapiens
ttgttttgaccagaaatttatggtaagtaccttctcttacacaaggaacaataaataagccggaaatcttggaagccttcacagaactggggttaatgacmagataacatggtggattaacatccaagatggaattgctttagtctccacaccccttatttaaatgagattgggaacaaaataacaactcattgaaaaagg

SEQ ID NO: 17432 - DNA, 201 bp, Homo sapiens
gccattccaagaatagatcaaatgagaggagaatccacaatccaggcaaaaaattaagtatatgtgaacaagcgttcaaagacccttttaaaacataaggraatatataaatatgatgctagaatgaaaaggaagttatgtcattaaattcaagttcttcattttgtagaagacaaaacagagattaaatgatttccctaa

SEQ ID NO: 17433 - DNA, 201 bp, Homo sapiens
tagtgaatcctgcacccagacagattccctgaagctgccctgggccctgtccttctcatagcttaggtgtagggcttctcttccagatttacaactgacckcactgccttccagtacattttgtctattgcttaagttatccatagttagttcatttctgtggtttgcaaattctggcacagtagcttagttggctttcct

SEQ ID NO: 17434 - DNA, 201 bp, Homo sapiens
ggggatcgcttgaggccaggagctcgagacctggacaacatggtaaaaccccatgtctactaaaaatacaaaaattagccgggcgtgaaggtgcatgtctktagtcccagcaactcaggaggctgaagcatgagaattgccggaacccaggaggcagaggttgcagtgagtcaagatcacaccgctgcaatccagcctggg

SEQ ID NO: 17435 - DNA, 201 bp, Homo sapiens
ctgtctcccaactcctcttgtctttaaaccccactccttctcacttccccagaaactcattttcctgatgtccttcagctcaggtcctccctttccacacrtagaaacccactgtgtttctctgggtgaagcactctctatgcaaggtttaaccttttagcagaacacggagctggcaagggctttgctgtttcagccttc

SEQ ID NO: 17436 - DNA, 201 bp, Homo sapiens
  misc_feature (1)...(201): n = A,T,C or G, or insertion/deletion polymorphism (see Tables 1-2)
gcactgagctactatctgtgtgagctgggagaagtataataagttaaattatcatcttggcctcactttcatttttggtaagaatggagtcattgggctanaatctgtaggtaatggattcttactgctatacgtagaataaccattttgtgtactaaggaccaatgcagccctacctgtagctgggcagcagccagagtc

SEQ ID NO: 17437 - DNA, 201 bp, Homo sapiens; identical to SEQ ID NO: 1614

SEQ ID NO: 17438 - DNA, 201 bp, Homo sapiens
caaatgttattttgaatacagaggatacagagaaattgaaatcctagtacattgctggtgggaatgcaaaagggtatagccactatagaaaccagtttagyggctcctcaaaaagttaaacctagaattaccatatgacccagcaattctactcccaggtgtatacgcaaagtaactgaaaacaaaaattcaaacaggtat

SEQ ID NO: 17439 - DNA, 201 bp, Homo sapiens
gtgtcattttgttttaaaagtatttacctcccgatattgccaccctagagcacgagcttctaaaggctggaactgggacttgattccactgggtctttttkcctaattacaatttagatgaacaagagatttctttctccttattcaagagtgaatattgaaggaagtcactaaaattaatttaaagtgtttgtaatttct

SEQ ID NO: 17440 - DNA, 201 bp, Homo sapiens
cttctccaactcctgagttaggcctgagtgtggatccacacaataatactagtatcttctatggggcacacacagaagcaaggttagagacctagcaacarggagaagccatcacaagcacctgtgatagaaggagaaaagttccagcttgttactcatttcacaggtcccaggtgtcctgctctccccactttacttcta

SEQ ID NO: 17441 - DNA, 201 bp, Homo sapiens
aaagaaagccactcagaatgaagagctgaaagacaaaaaaatggaaaataggacagaaaaaggaagaagaaaagatcaattcaggaggtccaatacccaaytctgtcagctttgaaatatgtcaacttaactaagctaaactttatttcccagaattcctttctctatgtttcttgttagggctggccacaagaaaaatct

SEQ ID NO: 17442 - DNA, 201 bp, Homo sapiens
caaactgtcttccaaggtggctgtaccatttttcatttccactaaaacatcctgcaattgccactgtcagcgttctggattttggcctttctaattggtawgtagtggtatctcattactgttttgatttgcatttccccaatgacatatgatgtgaagaatattttcatatgcttattcactatctgtatatcttttttg

SEQ ID NO: 17443 - DNA, 201 bp, Homo sapiens
gaggcatgctgattaaatttaacaggaagaaaagagactagtgcattaaaaccttaagtattagacaaaagggcatctctggtcagagttggaaacaagtmacttctggacaaatggaaatagaatttaattatgtgggctgtatatgtagggagttaatctaaaaagtaatatgagcagaaaacatagattccaaagaaa

SEQ ID NO: 17444 - DNA, 201 bp, Homo sapiens
cctgaatgaaagaagcaaataaaaaaaattacacatttttaataagcagaagtagtgatgagattaaagcactcctattctgattaaccttctaacccctytccacttttgaaagcctagaaacaaataagtaagctaccgtgggctaaaacttgggtatttttctttagtttttttaaattatgatatcatatatataat

SEQ ID NO: 17445 - DNA, 201 bp, Homo sapiens
atgtccatgatgtctttactttcccacgaccacatctgtttccctcacaaaatcaactcctagtttcttttcctataagccatgtttccatattaacagcwtgaccacccaccaagtctattaggctcagatcatccttgattttcttctcattcctgcagccaatcatctccccagttttggttttgttttgttttgttt

SEQ ID NO: 17446 - DNA, 201 bp, Homo sapiens
agtggtcaaatttaacaaaagcttaaatgcaaccttaagttagatataactgcattttaagtcctgtatccagtaagctttcaatatatggtgattatcaktgatgagcaatggttctgtgaaaggaaaagtgtctgggccaagaaagcacccaaactaccctgtgagtgcaaccgacagcacataacaatgtcagctact

SEQ ID NO: 17447 - DNA, 201 bp, Homo sapiens
caaaggcctcaagagtcccctgagaagtggtatatgacctgttgctaatgcctttcatgtggcaaggaagtaggaaatggaaactttcatattaaagaacwtaaaaatatataacacagcagggtgtggtggctcacgcctgtaatcccagcacttcgggaggccaaggcaggtggatcatctgcggtcaggagttcaaga

SEQ ID NO: 17448 - DNA, 201 bp, Homo sapiens; identical to SEQ ID NO: 1615

SEQ ID NO: 17449 - DNA, 201 bp, Homo sapiens
gtctatgataacacagagaatgtcccagtcgtacccctgaggacagactggtacatgcttcctgattgctcttacacacttctaggctttataaagtgtayagtgtaattctccccaaaacatttaaatggattttttaaaaattgagggattcttttcttttgctcacgaaatggcacgccagtgcttcattagcaatat

SEQ ID NO: 17450 - DNA, 201 bp, Homo sapiens
aaaatacaaaattagccgggcatggtggcgcttgcctgtaatcccagctactcgggagactgaggcaggagaattgcttgaacctgggaggtggaggttgyggtgagccaagatcacaccactgcactccagcctgggcaacaagagtgaaactctgtctcaaaaaaaaaaaaaaaaaaaaaaaaaattgagatctgaagc

SEQ ID NO: 17451 - DNA, 201 bp, Homo sapiens
gagtcacgtgatctgatttagctttatgtaaacatctgacagtgttcagtttaatagagtctgtagagaaaatgcttctagatagtatttctttttttttycccccaagtagctgggactccaggcacacaccaccatgccaagtgacttgtttttatttatttttatagagacagggtctcagtatgttgcccaggctgg

SEQ ID NO: 17452 - DNA, 201 bp, Homo sapiens
caggaggatcacctgaggttgggatttcgagaccagcctgaccaacatggagaaaccctgtttctactaaaaatacaaaattagccgggcatggtggcgcwtgcctgtaatcccagctactcgggagactgaggcaggagaattgcttgaacctgggaggtggaggttgcggtgagccaagatcacaccactgcactccag

SEQ ID NO: 17453 - DNA, 201 bp, Homo sapiens
ctgggggtgggaggacaggaaacatctgccagagggaaggcctgagctggtcccatccaatcctggccctggtccttggtcctgaggactcaggccccacygcctaatcctgctaacctcctgtgtgtccctcccagctctcccaggagaccctgagtgcagggaaatgggagagaccctccctgagaaaccaggtgaata

SEQ ID NO: 17454 - DNA, 201 bp, Homo sapiens
acaagcaaaccacagtcacagtggtgattaccactgcacaggaaacataggctacacgctgttctcatccaagcctgtgaccatcactgtccaaggtatgsggagtctgccaagatgtagggaggggagaagaggggatggacaagggctgaggtcacatgggcctacatggaggtctgagaaagcccatagcagcaaaat

SEQ ID NO: 17455 - DNA, 201 bp, Homo sapiens
catggggatgaaagaggctgatgctcttacaccagtgcctggtaggcagtaacagcacacaaacagggctgttgccattctggaggaggtggtatgtgagrgcagcgcttagctagggaaggaggactctccaggcactgggccaaggcagggactgaggctgggtggggcttatatgaggggggagtagatagggtactg

SEQ ID NO: 17456 - DNA, 201 bp, Homo sapiens
tgagctggtcccatccaatcctggccctggtccttggtcctgaggactcaggccccaccgcctaatcctgctaacctcctgtgtgtccctcccagctctcycaggagaccctgagtgcagggaaatgggagagaccctccctgagaaaccaggtgaatacagagttgtctcagggattcagtgatggctcaccagggctgc

SEQ ID NO: 17457 - DNA, 201 bp, Homo sapiens
ttagtagagacggggtttcaccgtgttagccaggatggtctcgatctcctgacctcgtgatccacccgccttggcctcccaaagtgctgagattacaggcktgagccaccgcgcccggccgaccaggaattatcttaaacagaaaaagaatactctaaggaggggtataccggccagcagaacagtaacccctccccgggg

SEQ ID NO: 17458 - DNA, 201 bp, Homo sapiens
ggtcccatccaatcctggccctggtccttggtcctgaggactcaggccccaccgcctaatcctgctaacctcctgtgtgtccctcccagctctcccaggakaccctgagtgcagggaaatgggagagaccctccctgagaaaccaggtgaatacagagttgtctcagggattcagtgatggctcaccagggctgccggctg

SEQ ID NO: 17459 - DNA, 201 bp, Homo sapiens
gatggctcaccagggctgccggctggacctgagccagcgagaaggggcttgtgcgagttcagctgggagccagggagggagcagcgatggggggatggccrgggctcaaatcgcttggtcaactctgagtctaatttctgggcctaaagaggacctcgctggagatgagaagagaaacaccagtcccagatacagaggaga

SEQ ID NO: 17460 - DNA, 201 bp, Homo sapiens
tttctgtctgccagacatcatgtcaagttctgtgagtaacgtacctctgagactgaaaaacccttggaatctatccttacaactttttcttatcatatttrtgtctttcagaatggctggtgctccagacccctcacctggagttccaggagggagaaaccatcatgctgaggtgccacagctggaaggacaagcctctgg

SEQ ID NO: 17461 - DNA, 201 bp, Homo sapiens
ccagggctgccggctggacctgagccagcgagaaggggcttgtgcgagttcagctgggagccagggagggagcagcgatggggggatggccagggctcaamtcgcttggtcaactctgagtctaatttctgggcctaaagaggacctcgctggagatgagaagagaaacaccagtcccagatacagaggagagggcggtgt

SEQ ID NO: 17462 - DNA, 201 bp, Homo sapiens; identical to SEQ ID NO: 1617

SEQ ID NO: 17463 - DNA, 201 bp, Homo sapiens
ctttttatttcttatgtggatggaagattttatgcagggtatagtatggtctgaatgtttctgtgcccccaaaattcatatgatatgaattaatcaaatarcaacccccagggtgatggtattaggaggtgaggtctttgggtaggtgattaggtcatgagggcagagcccttataaaagagggccgagggagctcaaagg

SEQ ID NO: 17464 - DNA, 201 bp, Homo sapiens
agcttctgcagacagtcaagctggtgagtatgccctttgcttccttgtattgacagtgttgtatcctcataatatgatgctgtgtttgctggggcggcggrggggtatgtctattccactgaaaatcaagcttgggttcagcatgggcagttcccccattttagtggggtctgggatttgcttcttagatccactgaagac

SEQ ID NO: 17465 - DNA, 201 bp, Homo sapiens
gtgggacagggagaatacaaacgttgtcattaaaatagtaaccccccatcctgccctaatgtctgtcttccctagtgcccagcatgggcagctcttcaccratggggatcattgtggctgtggtcattgcgactgctgtagcagccattgttgctgctgtagtggccttgatctactgcaggaaaaagcggatttcaggtt

SEQ ID NO: 17466 - DNA, 201 bp, Homo sapiens
caatagaatggaagctctctgaatgcagggatttttgtctgttttatttacaaatgtatctgaggcatctagaacagtctagtacctggtaagcacccaayagatacttgctgaatgaatgaaaatctgttgtctgggtgctctgaggctgtttcccaggcaattctcacaattatacctgaggacacccctctgaggctc

SEQ ID NO: 17467 - DNA, 201 bp, Homo sapiens
caggatcttgagatgggtcctggagaaggaagagcccaagctcacctccccagcatttcacatacgcagctaaatttgaagccgtgttctcctgctcgacrttgatccactctcttctcttttacagcttctgcagacagtcaagctggtgagtatgccctttgcttccttgtattgacagtgttgtatcctcataatatg

SEQ ID NO: 17468 - DNA, 201 bp, Homo sapiens
tatcacatttccacagtttgccatttatttccacttaagctgattacaggttgtgtttacttttcgttattccacagcatctctttagctctgtttcaatrgtaaatccctccaacgtgccagtctttctccctcaactggattcgatctgaaaagtaacttaataaaatcctaactgtagactccctctcccttggggtc

SEQ ID NO: 17469 - DNA, 201 bp, Homo sapiens
ttaggtcttttgcactaagtttgaaatcctcttcaacaccacaggaatgctgctcctgagatctggatgctgaatagaatttctataagttctggaaaacstgttggggtaggtggttaggaaatcttacagcaggattgttaaaaatccaagcctcgtaggatttcctcctacaaaggaactgctacagttctgaccact

SEQ ID NO: 17470 - DNA, 201 bp, Homo sapiens
cccaagctggagtacagtggcgctatctgggctcactgcaagctctgcctcccgggttcacgccattctcctgcctcagcctcccgagtagctgggactayctgccaccgcgcccggctaaattttttttgtattattagtagagacggggtttcaccgtgttagccaggatggtctcgatctcctgacctcgtgatccac

SEQ ID NO: 17471 - DNA, 201 bp, Homo sapiens
attatttctaattttagatttcccctcacttctcaaggcctcaaacacaatatcctctaatgacattgtctttggggtgacccaaaattatcatttatttyttacttatgagcagagagtttgcagcttttacttgccttgtctcttttaatacctacagccaccccctgggagcagaggagggagtgtgtataaagtatc

SEQ ID NO: 17472 - DNA, 201 bp, Homo sapiens
tggacaaaaatcccttcccttgatttcccaagacttgggactctcaagatattttactaaatgacaatgaaaaacaaataaatttaaaaaattataaaaamaataatatccattgcagagggtacaacagttacttaggaatgaggaatacaaagtattgtgaaaagtctgaagaattgacaaatatttgtggctggtttc

SEQ ID NO: 17473 - DNA, 201 bp, Homo sapiens
agacagatgccatggcgtggcctttctgacactcctgggcgtccccatgggtgagctgaattctgcctctggactagcccttttccaggtgggagcagccyctgagcaggggaactgggggtgggaggacaggaaacatctgccagagggaaggcctgagctggtcccatccaatcctggccctggtccttggtcctgagg

SEQ ID NO: 17474 - DNA, 201 bp, Homo sapiens
gagaaaagttttaggaaaagtgctgggctcagtgactcatgcctgtaatcccagctcttaaggaggcagaggtgagaggatagcttgagtccaggagttcsagacctgcctgggcaatatagtgagcactcattctcaaagaaaaaaaaacattttaagaaaagtttaaacatatttgtgttttttaaaggctaccttaga

SEQ ID NO: 17475 - DNA, 201 bp, Homo sapiens
tcactctgttgcccaggatggtcttgaactgtctctattatcttctaatcttgacttttttccttatacgctacaatactccaatgaatattcttgttgattttttttttcacacctaagtgtttctattggatgtattttttgaaatggaatttttaggtgataaggcttacaaatttcaaatgtttaatagatagtgcc

SEQ ID NO: 17476 - DNA, 201 bp, Homo sapiens
tggaatctatccttacaactttttcttatcatatttgtgtctttcagaatggctggtgctccagacccctcacctggagttccaggagggagaaaccatcrtgctgaggtgccacagctggaaggacaagcctctggtcaaggtcacattcttccagaatggaaaatcccagaaattctcccatttggatcccaccttctc

SEQ ID NO: 17477 - DNA, 201 bp, Homo sapiens
tcccctcttctccgtcaggctgcattgctggtcatttttggctcctgttggaagcaaactgctctaatgcctttggataagattttaaccaggaattatctttttttttttttttttttttttttttttgagacggagtctcgctctttcgcccaagctggagtacagtggcgctatctgggctcactgcaagctctgcct

SEQ ID NO: 17478 - DNA, 201 bp, Homo sapiens
taattaaaggagtcacgtgatctgatttagctttatgtaaacatctgacagtgttcagtttaatagagtctgtagagaaaatgcttctagatagtatttcttttttttttcccccaagtagctgggactccaggcacacaccaccatgccaagtgacttgtttttatttatttttatagagacagggtctcagtatgttgc

SEQ ID NO: 17479 - DNA, 201 bp, Homo sapiens
agctcagcagttaatggcacagccaaaatcgcaatcctgactttagtttctgttttatgccatctcagtaatggtacctggcctttcatatacagaatactttttttttttggccaggcacagtggctcatgcctgtaatcccagcactttgggaggacgaggtggatggatcacttgaggtcgggagttcgagaccagcc

SEQ ID NO: 17480 - DNA, 201 bp, Homo sapiens
ctctgagtctaatttctgggcctaaagaggacctcgctggagatgagaagagaaacaccagtcccagatacagaggagagggcggtgttcaaatttctagkaccaggaatctggtgatatttccagagcaagaaatcagagatactttggtctttctgtggagctttggcagagctggcagaggatggggttaggggctgt

SEQ ID NO: 17481 - DNA, 201 bp, Homo sapiens
tgagcacccttttcaggtaaaataccacccactaaatacaggggtgtcactatcttctcacaggcccatccataaaagagtagcataaagatagtaattamattatttaacattttctgatatttttgttattattctaagtactttatacaattaatttatctgacattatttaaccttcaaaacaactctataaggcag

SEQ ID NO: 17482 - DNA, 201 bp, Homo sapiens
aactctgagtctaatttctgggcctaaagaggacctcgctggagatgagaagagaaacaccagtcccagatacagaggagagggcggtgttcaaatttctrggaccaggaatctggtgatatttccagagcaagaaatcagagatactttggtctttctgtggagctttggcagagctggcagaggatggggttaggggct

SEQ ID NO: 17483 - DNA, 201 bp, Homo sapiens
tcaaatcgcttggtcaactctgagtctaatttctgggcctaaagaggacctcgctggagatgagaagagaaacaccagtcccagatacagaggagagggckgtgttcaaatttctaggaccaggaatctggtgatatttccagagcaagaaatcagagatactttggtctttctgtggagctttggcagagctggcagagg

SEQ ID NO: 17484 - DNA, 201 bp, Homo sapiens
atctgtttacagacagaggtttgcaggaaagagtgggcgtggactgcttactgggaagcactgttgtgagttgctcattcattccccatttcacccacccyctttgcttagcatgcgtggtgggggaagggggaatttctaataattttctcagcatgtgttaggttgtttttgcctcagtcttgattgagcaagggggtt

SEQ ID NO: 17485 - DNA, 201 bp, Homo sapiens
tttccactctgcccctcagcagctcccccaaaggctgtgctgaaacttgagcccccgtggatcaacgtgctccaggaggactctgtgactctgacatgccrgggggctcgcagccctgagagcgactccattcagtggttccacaatgggaatctcattcccacccacacgcagcccagctacaggttcaaggccaacaac

SEQ ID NO: 17486 - DNA, 201 bp, Homo sapiens
tttttttttttttttttttttttttttttgagacggagtctcgctctttcgcccaagctggagtacagtggcgctatctgggctcactgcaagctctgccwcccgggttcacgccattctcctgcctcagcctcccgagtagctgggactacctgccaccgcgcccggctaaattttttttgtattattagtagagacggg

SEQ ID NO: 17487 - DNA, 201 bp, Homo sapiens
ctttccactctgcccctcagcagctcccccaaaggctgtgctgaaacttgagcccccgtggatcaacgtgctccaggaggactctgtgactctgacatgcyagggggctcgcagccctgagagcgactccattcagtggttccacaatgggaatctcattcccacccacacgcagcccagctacaggttcaaggccaacaa

SEQ ID NO: 17488 - DNA, 201 bp, Homo sapiens
tctgtttacagacagaggtttgcaggaaagagtgggcgtggactgcttactgggaagcactgttgtgagttgctcattcattccccatttcacccaccctytttgcttagcatgcgtggtgggggaagggggaatttctaataattttctcagcatgtgttaggttgtttttgcctcagtcttgattgagcaagggggtta

SEQ ID NO: 17489 - DNA, 201 bp, Homo sapiens
agatcaggcagaggctgataggctgttgcaactattttgacttttattcctgagtgagttgagatggctttaattaaaggagtcacgtgatctgatttagstttatgtaaacatctgacagtgttcagtttaatagagtctgtagagaaaatgcttctagatagtatttcttttttttttcccccaagtagctgggactcc

SEQ ID NO: 17490 - DNA, 201 bp, Homo sapiens
aggtggatggatcacttgaggtcgggagttcgagaccagcctggccaacatggaaaaaccccatctctactaaaaatacaaaattagccgggcgtgatggygcatgcctgtaatccagctactcaggaggctgagggaggaggattgcttgaacttgggaggtggagtttgcagtgagccgagatcgcgccattccactcc

SEQ ID NO: 17491 - DNA, 201 bp, Homo sapiens
aatttttcttgaatgccccttttattcagagtcacaaatgaatactgaattcacctgtgtgaattcaagtcatgcctttttatttcttatgtggatggaakattttatgcagggtatagtatggtctgaatgtttctgtgcccccaaaattcatatgatatgaattaatcaaatagcaacccccagggtgatggtattagg

SEQ ID NO: 17492 - DNA, 201 bp, Homo sapiens
acagtgttcagtttaatagagtctgtagagaaaatgcttctagatagtatttcttttttttttcccccaagtagctgggactccaggcacacaccaccatrccaagtgacttgtttttatttatttttatagagacagggtctcagtatgttgcccaggctggtcttcagctcctggcctcaagtgatcttccctcctcag

SEQ ID NO: 17493 - DNA, 201 bp, Homo sapiens
gaaaccaggtgaatacagagttgtctcagggattcagtgatggctcaccagggctgccggctggacctgagccagcgagaaggggcttgtgcgagttcagytgggagccagggagggagcagcgatggggggatggccagggctcaaatcgcttggtcaactctgagtctaatttctgggcctaaagaggacctcgctgga

SEQ ID NO: 17494 - DNA, 201 bp, Homo sapiens
ggtctcagtatgttgcccaggctggtcttcagctcctggcctcaagtgatcttccctcctcaggctctcaaagtattgggattataggcgtgagccaccaygcctggcttagatactgtttctacctgcttccaatgtctgaaaatataagcacatttctattgttgtttacttgagctgcactcttggtgcataaaccct

SEQ ID NO: 17495 - DNA, 201 bp, Homo sapiens
gcttggtcaactctgagtctaatttctgggcctaaagaggacctcgctggagatgagaagagaaacaccagtcccagatacagaggagagggcggtgttcraatttctaggaccaggaatctggtgatatttccagagcaagaaatcagagatactttggtctttctgtggagctttggcagagctggcagaggatggggt

SEQ ID NO: 17496 - DNA, 201 bp, Homo sapiens
ccattaaattagtaatccccagaccacaaaaactgacggcttcaggccctgtcgagtagcctctacagttactgaaatgcgctcatttctctactcaaacrtagtattttaaattcctcagaattgttttaaatatctgctctgcatctttgaaacctctgaaaacttctgcttttagaagtcccacagatataataccat

SEQ ID NO: 17497 - DNA, 201 bp, Homo sapiens
ttctgggcctaaagaggacctcgctggagatgagaagagaaacaccagtcccagatacagaggagagggcggtgttcaaatttctaggaccaggaatctgrtgatatttccagagcaagaaatcagagatactttggtctttctgtggagctttggcagagctggcagaggatggggttaggggctgtaagactgaggcca

SEQ ID NO: 17498 - DNA, 201 bp, Homo sapiens
ttctctactcaaacgtagtattttaaattcctcagaattgttttaaatatctgctctgcatctttgaaacctctgaaaacttctgcttttagaagtcccayagatataataccatatattgcctataagagaatgctcacatctgtcatgaagcatcttcatttctgtctgccagacatcatgtcaagttctgtgagtaac

SEQ ID NO: 17499 - DNA, 201 bp, Homo sapiens
ttgggaggacgaggtggatggatcacttgaggtcgggagttcgagaccagcctggccaacatggaaaaaccccatctctactaaaaatacaaaattagccrggcgtgatggcgcatgcctgtaatccagctactcaggaggctgagggaggaggattgcttgaacttgggaggtggagtttgcagtgagccgagatcgcgc

SEQ ID NO: 17500 - DNA, 201 bp, Homo sapiens
aaaaggaaaaagtgattttaaatttaaaatttttcttgaatgccccttttattcagagtcacaaatgaatactgaattcacctgtgtgaattcaagtcatrcctttttatttcttatgtggatggaagattttatgcagggtatagtatggtctgaatgtttctgtgcccccaaaattcatatgatatgaattaatcaaat

SEQ ID NO: 17501 - DNA, 201 bp, Homo sapiens
cccttttattcagagtcacaaatgaatactgaattcacctgtgtgaattcaagtcatgcctttttatttcttatgtggatggaagattttatgcagggtayagtatggtctgaatgtttctgtgcccccaaaattcatatgatatgaattaatcaaatagcaacccccagggtgatggtattaggaggtgaggtctttggg

SEQ ID NO: 17502 - DNA, 201 bp, Homo sapiens
tgtgtgaattcaagtcatgcctttttatttcttatgtggatggaagattttatgcagggtatagtatggtctgaatgtttctgtgcccccaaaattcataygatatgaattaatcaaatagcaacccccagggtgatggtattaggaggtgaggtctttgggtaggtgattaggtcatgagggcagagcccttataaaaga

SEQ ID NO: 17503 - DNA, 201 bp, Homo sapiens
ctggaggaggtggtatgtgagggcagcgcttagctagggaaggaggactctccaggcactgggccaaggcagggactgaggctgggtggggcttatatgakgggggagtagatagggtactgcaagcctctgagaaagagaaataatcccactaacacctcacaaagcactttgcaattggttcatagccaacacctcagt

SEQ ID NO: 17504 - DNA, 201 bp, Homo sapiens
ggctgtgctccatagagtaatgatgcctccagctatgcgaggctttgggcccaccctccgtactgtccccaggggctaaggggaatccttccctctgctcstgcatgctcaccagtgtgctttcattcatttggtggagaaacctgggtagggaggaggcacaagtccagccacagaaaccctgtgccagtgaggctgggg

SEQ ID NO: 17505 - DNA, 201 bp, Homo sapiens
tctgaatgtttctgtgcccccaaaattcatatgatatgaattaatcaaatagcaacccccagggtgatggtattaggaggtgaggtctttgggtaggtgaytaggtcatgagggcagagcccttataaaagagggccgagggagctcaaaggcctcttccgccatgtgaggacacagtaagaagcctcagttctgtgaacc

SEQ ID NO: 17506 - DNA, 201 bp, Homo sapiens
gcctggcacgtcatggactgttcaaggctgtgctccatagagtaatgatgcctccagctatgcgaggctttgggcccaccctccgtactgtccccaggggmtaaggggaatccttccctctgctcctgcatgctcaccagtgtgctttcattcatttggtggagaaacctgggtagggaggaggcacaagtccagccacag

SEQ ID NO: 17507 - DNA, 201 bp, Homo sapiens
ctatctccagggacctggctcttcatcagtaaacttggatgtttcctcgtgttctccctcctgcagtcatttcaaagctgttaaatagtaatctcgctggrccccagtttcccaatctgtacaatgagtgggttggactaggtcatcgtaaagggcctttctaactcttttaatctcccaggtgggaggagggacaggccc

SEQ ID NO: 17508 - DNA, 201 bp, Homo sapiens; identical to SEQ ID NO: 1631

SEQ ID NO: 17509 - DNA, 201 bp, Homo sapiens
cggatgatatccccaaccagaccttccagttagaaaatgaggatcagatgtctgcatgaggaaggagtgggttattcagtaaaaggttgtagcagacagamttgcttaccaactcaatagtcatctccctcttcctccttgtggaaagaatccccatttttaaggtaattcatcctcctccgcatgagtctgtgctcctct

SEQ ID NO: 17510 - DNA, 201 bp, Homo sapiens; identical to SEQ ID NO: 1632

SEQ ID NO: 17511 - DNA, 201 bp, Homo sapiens
cttctcacaacacctggcctttattcaaaagtcacccttaatatttatttatttacttatagacagggtcttgctttgtcattcaggctggagtgcagagktctgaccatagttcactgcaacctcaaactgctgggctcaagtgatcctcctatctccgactcccaaagcactgggattacaggtgtgagccactgtgcc

SEQ ID NO: 17512 - DNA, 201 bp, Homo sapiens; identical to SEQ ID NO: 1633

SEQ ID NO: 17513 - DNA, 201 bp, Homo sapiens; identical to SEQ ID NO: 1634

SEQ ID NO: 17514 - DNA, 201 bp, Homo sapiens
tatggctgtaagttctagcattgaggagtagagcagatttgtgcagaggaaggtggtgacaagaattgacgcccagagctagtgtttcactgatctctccmctttctctaggtcctgccccaaataaatgataaatctgtcaccagctctttcagatcaggcttcaggactttgaggccagggtggagcactaggactggg

SEQ ID NO: 17515 - DNA, 201 bp, Homo sapiens
aaactgctgggctcaagtgatcctcctatctccgactcccaaagcactgggattacaggtgtgagccactgtgcctggtttcattcctaatatttaaaacracaaccctctctattacccttttccttccctctttattacccttttccttccctctttaatttttctccataatgatgatcacaatctacatattttact

SEQ ID NO: 17516 - DNA, 201 bp, Homo sapiens
ctataatacatgggtggaagaaatatttttaggtccttacccaccctcattctgtacacccggatgatatccccaaccagaccttccagttagaaaatgakgatcagatgtctgcatgaggaaggagtgggttattcagtaaaaggttgtagcagacagaattgcttaccaactcaatagtcatctccctcttcctccttg

SEQ ID NO: 17517 - DNA, 201 bp, Homo sapiens; identical to SEQ ID NO: 1635

SEQ ID NO: 17518 - DNA, 201 bp, Homo sapiens; identical to SEQ ID NO: 1636

SEQ ID NO: 17519 - DNA, 201 bp, Homo sapiens
ctcccaggtgggaggagggacaggccccacctccaactccacctccttggatatgccctctggctgccaaggggaagggtgacagagtcagctgagctcarcttcaaggggaccaggtaggagatgtgccaacgttcttgggcaagggtggcaatggggctcctgggctgtaggcaggcagtggggaaggtgtcataggta

SEQ ID NO: 17520 - DNA, 201 bp, Homo sapiens; identical to SEQ ID NO: 1638

SEQ ID NO: 17521 - DNA, 201 bp, Homo sapiens; identical to SEQ ID NO: 1637

SEQ ID NO: 17522 - DNA, 201 bp, Homo sapiens
ggaaggtgtcataggtaaatgtcatctggagacactgtgaccagggcactaggagaggcgaaggcactgtggggagagacactcctcttccagggatatakctgtgatgacgagtcagaagacactttgggtctgggtatcttcccactttggatagtgctgggaggcctccaccctcttcagccagccaggctcttaggg

SEQ ID NO: 17523 - DNA, 201 bp, Homo sapiens; identical to SEQ ID NO: 1639

SEQ ID NO: 17524 - DNA, 201 bp, Homo sapiens
agaacatgtatatgacagctctcctgtacttaacaaaaggacaagtggatggctcagactgagggggtggagctctcacgtctatggctgtaagttctagyattgaggagtagagcagatttgtgcagaggaaggtggtgacaagaattgacgcccagagctagtgtttcactgatctctccactttctctaggtcctgcc

SEQ ID NO: 17525 - DNA, 201 bp, Homo sapiens; identical to SEQ ID NO: 1640

SEQ ID NO: 17526 - DNA, 201 bp, Homo sapiens
caagacaagtcaaaatccttttgtcagaagttcaagagggtctttgaatcttactttccattattccccagtaaaagtctctcttctctagctaaattggkcttttcattctctttccaaacaagacttggattttctcacctccgtctttattcttcctgtcccccacactggaatgccctccctttcttcttgggctgc

SEQ ID NO: 17527 - DNA, 201 bp, Homo sapiens; identical to SEQ ID NO: 1641

SEQ ID NO: 17528 - DNA, 201 bp, Homo sapiens
ttatacgttagtaattcagttttttgtttcttcttctgggtatatttccactttgagaggccacaggaaccccaaggaattaaaggccaaggggactttakgaacaatggtggtgggagggcattggaaagatgttttgaggggaagtagacataaccagcatctttcacattccactctgtgggctactcactacttggc

SEQ ID NO: 17529 - DNA, 201 bp, Homo sapiens
tctagtgtagtgcttctccttgggtgtacaccaaacttcaaaacacgcttgtccacctctgcagaggccaggttcattcctgggagcaaagcagtaacaaraaacaccttctaaacttgcagcattttatggttcacaaagtgctccacacctgttaaccaattcaatattcaggaaaccctaaaagattggtattattat

SEQ ID NO: 17530 - DNA, 201 bp, Homo sapiens
aaaatacttgattctctgccaaactgggtttatgcatacaatagataatagccagtggcattgactaaagaggccaattttaaatagcttttgtaatcaakaactttttacatgcattagttggtgaccacacctctttccaaagtttcctgttgaccacacctctttccaaagttttcagaataacccatttaatgggtt

SEQ ID NO: 17531 - DNA, 201 bp, Homo sapiens
gaacattccacagcagctgtttcctgtctttttcacctccacaagtccccaaattcatctccttcttgtgatctcttaagagagttaccttgcctcctgcraaactgagaagctctaacgcttcaacttccagttatcattcacgataactactctatatttgccctgtctttctccctttcttccctgaagttccagaat

SEQ ID NO: 17532 - DNA, 201 bp, Homo sapiens
agaaaattcagccaattggagtggacctcacaccttccaaatacacgtatactttaattctcaataacgacaatgagggcactctgctgggttccttacakgcattgcttcattgtcttctcacaacaagctaggtgctagcatcctcattctacatatgaggaaatggaggttcagaaagacttatccatagtcatagcc

SEQ ID NO: 17533 - DNA, 201 bp, Homo sapiens
gttgcatcatgttggccaggctggtctcgaacttctgacctcaagtgatccgcccacctcagcctcccaaagtgctgggattacaggcatgagctaccacrcctggcctagaaaccttttattgtaaatattctccctggttgctatagtctttcatatctattatttcagttgcctcataaaattacacctgtcagtaga

SEQ ID NO: 17534 - DNA, 201 bp, Homo sapiens
catctcaaaatttacaggctgaaaagtgaactcccaatctttcccctaaacccactcctgtctctgtcaacagtaactctattcttccagttgctcaggcyggacattttggagtaatttttgactcttctttctcttataccccacatcagtaaatcttgctgtccctacttaaaaaagtctatccagaatttgaccact

SEQ ID NO: 17535 - DNA, 201 bp, Homo sapiens
cacttacacaggcttgtatgatccccctgtaatctatctccagggacctggctcttcatcagtaaacttggatgtttcctcgtgttctccctcctgcagtsatttcaaagctgttaaatagtaatctcgctgggccccagtttcccaatctgtacaatgagtgggttggactaggtcatcgtaaagggcctttctaactct

SEQ ID NO: 17536 - DNA, 201 bp, Homo sapiens
ctcttcatcagtaaacttggatgtttcctcgtgttctccctcctgcagtcatttcaaagctgttaaatagtaatctcgctgggccccagtttcccaatctrtacaatgagtgggttggactaggtcatcgtaaagggcctttctaactcttttaatctcccaggtgggaggagggacaggccccacctccaactccacctc

SEQ ID NO: 17537 - DNA, 201 bp, Homo sapiens
acccagtaaagctgctctttccatcccaactgactcagcctcctccatttcctcagtctatttaactcccatatgcttaatcgagatgaactttctggtcygttactttagggctgtcttcccttgcactttagctttaaacaccttgactttcaccttaggccaatctcctttcttctaggactggaggaaattgcagat

SEQ ID NO: 17538 - DNA, 201 bp, Homo sapiens
tccctttgtcattatttgatgtaaatatttatcttatttattgtgatacttttaattttagttccttattttatcctcttgctttagaatttctctcctcwtgcttttatctctctgattactttctatctcctttgctgacttctcttttgctccttaagtaaacagcattcctgagatcggtcacagagtcatagcatt

SEQ ID NO: 17539 - DNA, 201 bp, Homo sapiens; identical to SEQ ID NO: 1643

SEQ ID NO: 17540 - DNA, 201 bp, Homo sapiens
ttgtagggcctcattgcgttaggatttcttcttattccagaagaggggcattttcttaaggaacactggaagaccaaaacacactttcaaaacctagaggsaaaaacccttcatgcagcacttgggccccaggacattagttgtgcggggccctgagcttccctgtcctcctcacttcctgctgcctgggggatcagcagt

SEQ ID NO: 17541 - DNA, 201 bp, Homo sapiens
ccctcttgggcaggaacctgcacaatttccgctgtaagcaccccgcagggctgatatgtggtgtgaacagcatacacacctgggtgtgaccccagcctgamacctgctggtcacatggccacgggcaccacatgacccttcaaaggctgtaagacgggttcaagcagtgccgcctcacaaggtttccaggaagattagata

SEQ ID NO: 17542 - DNA, 201 bp, Homo sapiens
ttgcacaaagtggatactgttccatcaagggaagatgcagttgcttggagcaatgttgtcaatgctagaggaactgtaatgttggatttgcaggcatctayatcatagcttaaacaggaagatttttgtgccaggtgagaagtgagctccaacactcggtcactctaaaatccagcttcgaaggcttcagcttattttccc

SEQ ID NO: 17543 - DNA, 201 bp, Homo sapiens; identical to SEQ ID NO: 1645

SEQ ID NO: 17544 - DNA, 201 bp, Homo sapiens; identical to SEQ ID NO: 1647

SEQ ID NO: 17545 - DNA, 201 bp, Homo sapiens; identical to SEQ ID NO: 1649

SEQ ID NO: 17546 - DNA, 201 bp, Homo sapiens
gggacagtcgtgcttgcctttttcactttcagagtgtccacgccccacccgtttggtcactgcaggtcagtccagtccagcccggcccaccccaccggtgygtgtctgtcgcacgtggcagacgccatactctctgttcttgtttaaagcccaggatctactgggccctggaggcaagaggtgaacgcagcggaatccacg

SEQ ID NO: 17547 - DNA, 201 bp, Homo sapiens
cacgaccccctgattcagcctaggcagccacagcttgactgctcccgccggacaagccctactgtgctatctgccgctcttcccttcctcttcccaggggstccgcgtcaggggaggcgcagctgtgtgcattccgggagcttcagacccccgtgtccagcagctccttcgtttcctgggtgctggggcggccttcccagc

SEQ ID NO: 17548 - DNA, 201 bp, Homo sapiens; identical to SEQ ID NO: 1653

SEQ ID NO: 17549 - DNA, 201 bp, Homo sapiens
aacttgagattctcaaaacgctaaatagccatagtgcctctcagggaaagataccaggaccacataaacaaatcagttagctttaaaaactatccctgagmatttaaaatcaggatagaccttgtgaaaccagagccatgggtcaacctgtgtgatctctgctttctgttcacatcattggacatccaggtctgagggaga

SEQ ID NO: 17550 - DNA, 201 bp, Homo sapiens
tcattccttgtttaacactttgctatcacagtcttgaatccttgtaattgaacaatggaccccacattttcactttgcactggtttctgattctgtaaccratcctgtccccctctcttgtctcattcactctgggaattgtccccacattctgagacctttcagcagtgccccaacgaggttcctgcccttatctgaagc

SEQ ID NO: 17551 - DNA, 201 bp, Homo sapiens; identical to SEQ ID NO: 1656

SEQ ID NO: 17552 - DNA, 201 bp, Homo sapiens
gtccacgccccacccgtttggtcactgcaggtcagtccagtccagcccggcccaccccaccggtgcgtgtctgtcgcacgtggcagacgccatactctctrttcttgtttaaagcccaggatctactgggccctggaggcaagaggtgaacgcagcggaatccacgctgagctgcccgggaacggagcttccaaccccaga

SEQ ID NO: 17553 - DNA, 201 bp, Homo sapiens; identical to SEQ ID NO: 1657

SEQ ID NO: 17554 - DNA, 201 bp, Homo sapiens
caggggaccttcagtcaccagaaggtagtctaaaatatgcaaagcctccaaggtattggctggagaggaaaaacaaagcggctgagggcaggccccacaargcaaaggtatcctgagggtcaggggtaaagcccttacaggtgggaaagccaagtgggtcatgtccacccatccttgtgtagggcaacccagacactgtgg

SEQ ID NO: 17555 - DNA, 201 bp, Homo sapiens
aatgaaagcctgattaaaaaaaaaaatggaaaaaaaagacacccaactgtgtaccaactccctcttcctccttctatatcatgaagtagtcaccatttgartggtaaaccttcctcccctgggccaggaacatggcctttgtgtgtcactgtgcacctgcaggtggatactgttgctctgccctctccacacagtcatgca

SEQ ID NO: 17556 - DNA, 201 bp, Homo sapiens
tatcactgccaggggaatgggtaagttcaccaaaaggtgggttgtaaagagatgatgaagaccaccagcaaaaccttgagaatggccactctagtgggtgstacaagaggatcccaggggcctccccaaggctcacaggagaggaagggaggaaaacatgtgtctcaaaagtaattggaggaggagccttgagaatggtga

SEQ ID NO: 17557 - DNA, 201 bp, Homo sapiens
gggacttgaaagaatggaaagatttcagtgggtgaagagcctggcagacgagaatgttgctagcagagggagagacatgaactacagggtggagatgagcrgacaaggtgcttctctgacagtgagcaggagcctcccttgccaggatgtttcctcattcatggagaccagcagaacactggtccttgaagccttgtgagg

SEQ ID NO: 17558 - DNA, 201 bp, Homo sapiens
gcttctcttactaggcagacccaagcccctcattagagcctgccaccactgacccctggctcttaggacacagccctcatccttgaggtggcatagaaggsattaggctcctgctcatgtgcctgccagtgcctcacacgcccctgtggtctgtgttttggtcacattgagcccttcagtgcctcccactgcaagctcttt

SEQ ID NO: 17559 - DNA, 201 bp, Homo sapiens
aggagaatggaaagtctgaaaagggcatggggcaagtcccagtttcactgtttaatttgtctatgactctccacagcacaggatacggccatgataaacaygagcaaactcaacagcaagctgcctggaggcccgtgacaaacggaaatggtgcttttgggatgcggctggatcttgaggagcactctgctctgtttggcg

SEQ ID NO: 17560 - DNA, 201 bp, Homo sapiens
aagttaccccgctgttgtccagcaaagctttgttctacttggcaaagaggagaggggcttttccacattctccctaattcctccccttttcccactgcctmctgccttgtttcgatttaaatcctttgggaacatggatcccaccttccacagactctttggagatcctacgccttgttcattgtccccctcttttaataa

SEQ ID NO: 17561 - DNA, 201 bp, Homo sapiens
aacatctaccacaggtgctccaataagctctgggcactgtctagttacaaagcgtgctgttaggtgtaaggggatacaaaaatgtgtgggaatctggagtmtaagtgcagcaaaaagtgtggtatatgcatgattaggtacagggcagggagggagtggtgagtactaaagagctgagagaacgacctgtctatgggaatc

SEQ ID NO: 17562 - DNA, 201 bp, Homo sapiens
ggaggactagagggagcttcctggacaagctgacacttaacaccagacctgaaggggaaggaggggtttgtcaaatgcaaactggaggggaagcagtccakgtgggaaggatcacacctgcaaaggccctgtactgggaagagccctggtggagcggactgggcatagtgaacaaggtgaggtgggctgcaaggcagctga

SEQ ID NO: 17563 - DNA, 201 bp, Homo sapiens
tctgttctaaatgctttacatgtataacccatttaatcttcatcctaacactttgaaggagggactattcccattacacagtcaaggaaactgagctacayggggaggggttattagtcaaatcttaacaataaacaaaaacttgtgaatgccggagctgggtctccagtgcagccaagtcggctccaaagtccacactct

SEQ ID NO: 17564 - DNA, 201 bp, Homo sapiens
ttcttttttgctaaaatttattgagagctgactacggctcctctgttctaaatgctttacatgtataacccatttaatcttcatcctaacactttgaaggwgggactattcccattacacagtcaaggaaactgagctacacggggaggggttattagtcaaatcttaacaataaacaaaaacttgtgaatgccggagctg

SEQ ID NO: 17565 - DNA, 201 bp, Homo sapiens; identical to SEQ ID NO: 1648

SEQ ID NO: 17566 - DNA, 201 bp, Homo sapiens; identical to SEQ ID NO: 1650

SEQ ID NO: 17567 - DNA, 201 bp, Homo sapiens
gcaagaagcaccatccttcggaagctgggccgaaactggccaggctgactcgctcccacgcgcccgcccctacccggcgccgcagcaattcacctgccacsgcctctgagccgggtccggacttcggcgccctgacagtgtccccgcgacttccccacccgatgagatggggtctggcgttggccagtgcgtgtccaggga

SEQ ID NO: 17568 - DNA, 201 bp, Homo sapiens
gcaccatccttcggaagctgggccgaaactggccaggctgactcgctcccacgcgcccgcccctacccggcgccgcagcaattcacctgccaccgcctctkagccgggtccggacttcggcgccctgacagtgtccccgcgacttccccacccgatgagatggggtctggcgttggccagtgcgtgtccagggactcgcgg

SEQ ID NO: 17569 - DNA, 201 bp, Homo sapiens; identical to SEQ ID NO: 1652

SEQ ID NO: 17570 - DNA, 201 bp, Homo sapiens; identical to SEQ ID NO: 1654

SEQ ID NO: 17571 - DNA, 201 bp, Homo sapiens
tgaggacttgtgtctctgtgcttttaaatgcataaatgcattataggatcatttgttggaatgaattaaataaacccttcctggggcatctggcgaatccyagctgtgtgtccggtgtatggtttggcattatctcctctgcgagatatccaaattcactgtagtcatgaagggtctcagtttgtggctctcattcaaata

SEQ ID NO: 17572 - DNA, 201 bp, Homo sapiens
cccctgggccaggaacatggcctttgtgtgtcactgtgcacctgcaggtggatactgttgctctgccctctccacacagtcatgcagccttccctgggccrctgtgggctggaagtgggagagccggaactcagtcctggtttgtgtgcctctcaatttgttctttctccccatctacgacacgttcacactgggtgagtg

SEQ ID NO: 17573 - DNA, 201 bp, Homo sapiens
ttcaatgcacacgtttcttgggctcacttttctaaggtggtagggctggctgaatgcaatatgcagggctcggaaagattttttaaagaagaaattaaaarcaagtagagtccaggcaaatattcagatgctttatatgtctggataatgctgaactcatgagttttagtttgactgattattgtgaagaccgggttggag

SEQ ID NO: 17574 - DNA, 201 bp, Homo sapiens; identical to SEQ ID NO: 1655

SEQ ID NO: 17575 - DNA, 201 bp, Homo sapiens
agtttgactgattattgtgaagaccgggttggagattttgacatccatcgcagaagaagtaatggctttagtgtgtgtgtgtgtgtgctggggaagctccrtgcacagtgccctatggagataacaagctgagccatgctccccctaagtagcagactaagtctttgtgaaggaagagctacacaaatgggggcaggacag

SEQ ID NO: 17576 - DNA, 201 bp, Homo sapiens
gtgccctatggagataacaagctgagccatgctccccctaagtagcagactaagtctttgtgaaggaagagctacacaaatgggggcaggacaggtgcagmtaaatggggctgggagaccagaggagacagtgacaccttatagttcgccccctgttacccagccttctgtttgtcaaaagagtctgctcccagtcactgt

SEQ ID NO: 17577 - DNA, 201 bp, Homo sapiens
tgaaggaagagctacacaaatgggggcaggacaggtgcagataaatggggctgggagaccagaggagacagtgacaccttatagttcgccccctgttaccyagccttctgtttgtcaaaagagtctgctcccagtcactgtcaaactgacttgtagggcctcattgcgttaggatttcttcttattccagaagaggggcat

SEQ ID NO: 17578 - DNA, 201 bp, Homo sapiens
gcagtccaggtgggaaggatcacacctgcaaaggccctgtactgggaagagccctggtggagcggactgggcatagtgaacaaggtgaggtgggctgcaasgcagctgaagaggtggaaagagagatacaagcagtgggagatgactgtaggggctgtaggtcaaagacactgaaaaaaagactgaaagagtgacattgaa

SEQ ID NO: 17579 - DNA, 201 bp, Homo sapiens; identical to SEQ ID NO: 1660

SEQ ID NO: 17580 - DNA, 201 bp, Homo sapiens
tgtttaaagcccaggatctactgggccctggaggcaagaggtgaacgcagcggaatccacgctgagctgcccgggaacggagcttccaaccccagaaggargactctgtgctcctacaccttaaccctttttagcccgaaacttctccaacttccttggctttgtttagagctcgacagcgccgccccctggcgctcgttg

SEQ ID NO: 17581 - DNA, 201 bp, Homo sapiens; identical to SEQ ID NO: 1666

SEQ ID NO: 17582 - DNA, 201 bp, Homo sapiens
tcatgaagggtctcagtttgtggctctcattcaaatattcatttctaaacgtctcatccagtatgaaatcattctcatctcttttggagattaacaacatsatcttttcaatgcacacgtttcttgggctcacttttctaaggtggtagggctggctgaatgcaatatgcagggctcggaaagattttttaaagaagaaat

SEQ ID NO: 17583 - DNA, 201 bp, Homo sapiens; identical to SEQ ID NO: 1669

SEQ ID NO: 17584 - DNA, 201 bp, Homo sapiens; identical to SEQ ID NO: 1642

SEQ ID NO: 17585 - DNA, 201 bp, Homo sapiens
tgtgtgtgtgtgtgtgctggggaagctccatgcacagtgccctatggagataacaagctgagccatgctccccctaagtagcagactaagtctttgtgaargaagagctacacaaatgggggcaggacaggtgcagataaatggggctgggagaccagaggagacagtgacaccttatagttcgccccctgttacccagcc

SEQ ID NO: 17586 - DNA, 201 bp, Homo sapiens
ttttgggaaagagttttattttacactaatcctacatattagatattatatctccagtttttgggaaagaacaccagagattgaaataacttagccaagtmggccagtatgtggcaaaatgggggctcagacatactccacattgtaattctttcatccttaccacaggccggtgaatctttgtttcaccacttactagct

SEQ ID NO: 17587 - DNA, 201 bp, Homo sapiens
aggtagttggtccagcctcctccacagacatcaagcagaaactcccatctaaaaagctgggcttggctgggcatagtggctcatgcatgtgatctcagcasttttggaggctgaggtggaggattgtctgagcccaggagttccagactagcctggacaacatagtgagaccccatttctgcacacacacacaaaagaaaa

SEQ ID NO: 17588 - DNA, 201 bp, Homo sapiens; identical to SEQ ID NO: 1646

SEQ ID NO: 17589 - DNA, 201 bp, Homo sapiens
agataggaagatagggatggggcaagaacacagacaggggaccttcagtcaccagaaggtagtctaaaatatgcaaagcctccaaggtattggctggagargaaaaacaaagcggctgagggcaggccccacaaggcaaaggtatcctgagggtcaggggtaaagcccttacaggtgggaaagccaagtgggtcatgtcca

SEQ ID NO: 17590 - DNA, 201 bp, Homo sapiens
ctaaagaatagaccaacaaacaattgtccacttttaccctgtttctttaagaaagcctgagtaagaggcaaaattttggaaaatacttgttttgctctaaygtgctgcagttattagataacatttgcttaacagacagttatttttccatccttgaatttatatattgctcatagccatagagacttaatttttatgtgt

SEQ ID NO: 17591 - DNA, 201 bp, Homo sapiens
tttccagaggctattattttcactgtagaatgatttcatgctatctctgtgtgcacaaatatttattttctttctgtaaccataacaacttcatatatgargacttgtgtctctgtgcttttaaatgcataaatgcattataggatcatttgttggaatgaattaaataaacccttcctggggcatctggcgaatcccagc

SEQ ID NO: 17592 - DNA, 201 bp, Homo sapiens
tcctttgggaacatggatcccaccttccacagactctttggagatcctacgccttgttcattgtccccctcttttaataaatctgttctgaaatgctcatrtaatcccaaatccccattttcagcgagcctttgccagggtttgactccagtctttcttcatgtattttccccctcctccaaaaaggtagcatgcagaaac

SEQ ID NO: 17593 - DNA, 201 bp, Homo sapiens
aaatgttctgggtgcaagtgggggcactcaaggagttttgatgagagtgcactgggattcaatttatgtactgcattgtttgggaagataacaactacttytagatgtatttacatgtccctcttgggcaggaacctgcacaatttccgctgtaagcaccccgcagggctgatatgtggtgtgaacagcatacacacctgg

SEQ ID NO: 17594 - DNA, 201 bp, Homo sapiens
tgcattgtttgggaagataacaactacttctagatgtatttacatgtccctcttgggcaggaacctgcacaatttccgctgtaagcaccccgcagggctgrtatgtggtgtgaacagcatacacacctgggtgtgaccccagcctgacacctgctggtcacatggccacgggcaccacatgacccttcaaaggctgtaaga

SEQ ID NO: 17595 - DNA, 201 bp, Homo sapiens
gaaaagcacagcacactctgaaaaggcgcacgaggaaggcaggatttagagtggaggactagagggagcttcctggacaagctgacacttaacaccagacytgaaggggaaggaggggtttgtcaaatgcaaactggaggggaagcagtccaggtgggaaggatcacacctgcaaaggccctgtactgggaagagccctgg

SEQ ID NO: 17596 - DNA, 201 bp, Homo sapiens; identical to SEQ ID NO: 1658

SEQ ID NO: 17597 - DNA, 201 bp, Homo sapiens
ttcctggacaagctgacacttaacaccagacctgaaggggaaggaggggtttgtcaaatgcaaactggaggggaagcagtccaggtgggaaggatcacacytgcaaaggccctgtactgggaagagccctggtggagcggactgggcatagtgaacaaggtgaggtgggctgcaaggcagctgaagaggtggaaagagaga

SEQ ID NO: 17598 - DNA, 201 bp, Homo sapiens; identical to SEQ ID NO: 1662

SEQ ID NO: 17599 - DNA, 201 bp, Homo sapiens; identical to SEQ ID NO: 1661

SEQ ID NO: 17600 - DNA, 201 bp, Homo sapiens; identical to SEQ ID NO: 1663

SEQ ID NO: 17601 - DNA, 201 bp, Homo sapiens
ttgattggggcaacagttagttgccccaatgtaaaatgtaaaattgtaaaatgtaaaatgtaaaaatttgcatgtcaaaattcatagaactgtacaactaraaagagaacactctaccatatgtaaattatactccaattaaaaatagattaaaaagaaattacagcctcttcagaacactaatgaaagcctgattaaaaa

SEQ ID NO: 17602 - DNA, 201 bp, Homo sapiens
gccatgataacactgctgcactctagtctgggctaccgattttgagactctgtctcaaaagtcaatcaatcagtcaataaataaataaaaagcaagacttsctggatggctaccagtgaccacaggggtctttgataaagcttttttttttatatatagcagtaataacaaccatatttgttaaacagctgctgtcttcca

SEQ ID NO: 17603 - DNA, 201 bp, Homo sapiens
caatcaatcagtcaataaataaataaaaagcaagacttcctggatggctaccagtgaccacaggggtctttgataaagcttttttttttatatatagcagyaataacaaccatatttgttaaacagctgctgtcttccaagaaaagtaatagtcactgtatgtacattttctgttttattttacactaatcctacatatta

SEQ ID NO: 17604 - DNA, 201 bp, Homo sapiens; identical to SEQ ID NO: 1644

SEQ ID NO: 17605 - DNA, 201 bp, Homo sapiens
cagagggcgctggtgttaggccagtcttccccaccctgccccgtcaccccagccacacccactgtcctgtgaggccaagcgcgctccgctggtttcctgarccaggcaccttggccgcggacaggatccagctgtctctccttgcgatcctgtcttcggggaagtccacgtcctaggcaggtcctcccaaagtgcccttgg

SEQ ID NO: 17606 - DNA, 201 bp, Homo sapiens
agagggagcttcctggacaagctgacacttaacaccagacctgaaggggaaggaggggtttgtcaaatgcaaactggaggggaagcagtccaggtgggaargatcacacctgcaaaggccctgtactgggaagagccctggtggagcggactgggcatagtgaacaaggtgaggtgggctgcaaggcagctgaagaggtgg

SEQ ID NO: 17607 - DNA, 201 bp, Homo sapiens
ggaggctgaggtggaggattgtctgagcccaggagttccagactagcctggacaacatagtgagaccccatttctgcacacacacacaaaagaaaaaaatsagctgggtgtgatggcacatacctgtagtcccagctactctggaggctgagataggcggatcacttgatctgggaggtcaaggctgcagtgagccatgat

SEQ ID NO: 17608 - DNA, 201 bp, Homo sapiens
gtcaaggctgcagtgagccatgataacactgctgcactctagtctgggctaccgattttgagactctgtctcaaaagtcaatcaatcagtcaataaataartaaaaagcaagacttcctggatggctaccagtgaccacaggggtctttgataaagcttttttttttatatatagcagtaataacaaccatatttgttaaa

SEQ ID NO: 17609 - DNA, 201 bp, Homo sapiens
gaaaacaagattttggcaacagtatttaggaccagatgggtgttcttcaagggagctgtttcaggagtaaagcaagtctgctggtgggccagagtgagggygctgggccaggaactgggccaagcattgggaagtggatgtgttatctgcaaagggataggaaggagtggcccaccctggtgtgcagggggcacagatagg

SEQ ID NO: 17610 - DNA, 201 bp, Homo sapiens
agaaggtagtctaaaatatgcaaagcctccaaggtattggctggagaggaaaaacaaagcggctgagggcaggccccacaaggcaaaggtatcctgagggycaggggtaaagcccttacaggtgggaaagccaagtgggtcatgtccacccatccttgtgtagggcaacccagacactgtggtaccccccatgggacaatg

SEQ ID NO: 17611 - DNA, 201 bp, Homo sapiens
aggtagtctaaaatatgcaaagcctccaaggtattggctggagaggaaaaacaaagcggctgagggcaggccccacaaggcaaaggtatcctgagggtcakgggtaaagcccttacaggtgggaaagccaagtgggtcatgtccacccatccttgtgtagggcaacccagacactgtggtaccccccatgggacaatgctc

SEQ ID NO: 17612 - DNA, 201 bp, Homo sapiens; identical to SEQ ID NO: 1659

SEQ ID NO: 17613 - DNA, 201 bp, Homo sapiens; identical to SEQ ID NO: 1664

SEQ ID NO: 17614 - DNA, 201 bp, Homo sapiens; identical to SEQ ID NO: 1665

SEQ ID NO: 17615 - DNA, 201 bp, Homo sapiens; identical to SEQ ID NO: 1667

SEQ ID NO: 17616 - DNA, 201 bp, Homo sapiens; identical to SEQ ID NO: 1668

SEQ ID NO: 17617 - DNA, 201 bp, Homo sapiens
gtctctccttgcgatcctgtcttcggggaagtccacgtcctaggcaggtcctcccaaagtgcccttggtgccgatcacccctcccagcgtcttgcaggtcytgtgcaccacctcccccactccccattcaaagccctcttctctgaagtctccggttcccagagctcttgcaatccaggctttccttggaagtggctgtaa

SEQ ID NO: 17618 - DNA, 201 bp, Homo sapiens
caaatgggggcaggacaggtgcagataaatggggctgggagaccagaggagacagtgacaccttatagttcgccccctgttacccagccttctgtttgtcmaaagagtctgctcccagtcactgtcaaactgacttgtagggcctcattgcgttaggatttcttcttattccagaagaggggcattttcttaaggaacact

SEQ ID NO: 17619 - DNA, 201 bp, Homo sapiens
gagcagaagagtttgtgcctgttgaagtttgctggctgggttacttgaattgcctccctggaacttccatagaagacttcccttacatcactgtcaagtaktggatcatgtagctacctggtcttcaagggaggctggcacattagtattgcagctggacatgctcttgccccagtaaagcaggagtccattggtgaggaa

SEQ ID NO: 17620 - DNA, 201 bp, Homo sapiens
tgaatagctatagggattatgtcttttttctatgtaaacaagataaaaataacttacttttcactcttatatcagttttcacactatttcattttatcccrttagcaaacctctaaaataggtgagtcattttacaaatgaagaaatttagccttggaggggtgatatggttgtccaggagcacccacctagttagggtca

SEQ ID NO: 17621 - DNA, 201 bp, Homo sapiens
aaaaaaagcaaataaacaaaagtatttctcatgcccctcagttcatagacagaaactcataccaacaggctttttttttattttagtaagaactgccaaawggtgaaactattcacaaacactagaaatgcatgagagtgtcctcccgatattcttacctgaattttgcatctttttatctcttgtcaatctagctgggaa

SEQ ID NO: 17622 - DNA, 201 bp, Homo sapiens
ggactgtgctaagcacttcacaggcatttgctccttgtgataaccctaccaggtagataccatggttatcctgattttgcagatgagctatgtgaaactcrgagaggttaaggagcttgtctataggaactcggccagcaagtagagatagggagattcaggctggccagcccccacccccaaatccaaccagtgtcctag

SEQ ID NO: 17623 - DNA, 201 bp, Homo sapiens
ttttttctatcatttacttttagcctttaaaacaagaaaggaaatcatgggttggggtacatgtatatacgtgtgtgtgtgtgtgtgtgtgtgtgtgtgtgtatcacaagaaattgctttactgtagcttaagatagtttgagaaaccgtagaaccactgtgtgactttcttgggagcccttgtttttgcttatagtaatt

SEQ ID NO: 17624 - DNA, 201 bp, Homo sapiens
tttttttctatcatttacttttagcctttaaaacaagaaaggaaatcatgggttggggtacatgtatatacgtgtgtgtgtgtgtgtgtgtgtgtgtgtgtgtatcacaagaaattgctttactgtagcttaagatagtttgagaaaccgtagaaccactgtgtgactttcttgggagcccttgtttttgcttatagtaat

SEQ ID NO: 17625 - DNA, 201 bp, Homo sapiens
tgataaccctaccaggtagataccatggttatcctgattttgcagatgagctatgtgaaactcggagaggttaaggagcttgtctataggaactcggccakcaagtagagatagggagattcaggctggccagcccccacccccaaatccaaccagtgtcctagcccctctcatgatgacacaggaacctttgaactggga

SEQ ID NO: 17626 - DNA, 201 bp, Homo sapiens
ccagcctccccttacaccatgcctctgccccgccccaaaccagactcgcatttgccatatgctcctctctgccccagggcctttgcaaccactgttccccytgcctcgggtctctacctcagatcttcctggcacatgctccttcttatcagcctccagcccaaatcctcagagatgccttccctgactgcgctctctaaa

SEQ ID NO: 17627 - DNA, 201 bp, Homo sapiens
aacttacttttcactcttatatcagttttcacactatttcattttatcccattagcaaacctctaaaataggtgagtcattttacaaatgaagaaatttakccttggaggggtgatatggttgtccaggagcacccacctagttagggtcatggtatattctgcatcctggggctgatgtccttttgcaccaatatgctgc

SEQ ID NO: 17628 - DNA, 201 bp, Homo sapiens
ttcctccaccctctctcactatctgtctctctaccctccccatccttttattctagaggagaataaactctaaggccagattgaatgagcatccaaaagamgtatctggagggagattttgtctttcctgtgagcagcagcagcttcctacggaccctgctggagccccagctcggatcagcccttctgacagcaatgaat

SEQ ID NO: 17629 - DNA, 201 bp, Homo sapiens
tgtatgtctctctctctctctgtctcttcctccaccctctctcactatctgtctctctaccctccccatccttttattctagaggagaataaactctaagkccagattgaatgagcatccaaaagacgtatctggagggagattttgtctttcctgtgagcagcagcagcttcctacggaccctgctggagccccagctcg

SEQ ID NO: 17630 - DNA, 201 bp, Homo sapiens
ggattttcaaatgagtattatgcgaagtaaaagtactcttctgcctagaatgctgaccccacgccagggactgtgctaagcacttcacaggcatttgctcyttgtgataaccctaccaggtagataccatggttatcctgattttgcagatgagctatgtgaaactcggagaggttaaggagcttgtctataggaactcgg

SEQ ID NO: 17631 - DNA, 201 bp, Homo sapiens
gtcattctgctgcgctgaagattaagtaggagttgtttgcccttggccaatatgaaaaacctgagtgttctcccttcacttctagcgacaagtaacacatyccctgtcttgccatgaaaagagctgtaactgtagcagccggtggcaggttttctgttcccaggtggggaagtgaggagagacaaacagaggggtgagagg

SEQ ID NO: 17632 - DNA, 201 bp, Homo sapiens
ttttatcccattagcaaacctctaaaataggtgagtcattttacaaatgaagaaatttagccttggaggggtgatatggttgtccaggagcacccacctarttagggtcatggtatattctgcatcctggggctgatgtccttttgcaccaatatgctgctgccagcaggttttcatcatcaaaactagtccccctctcct

SEQ ID NO: 17633 - DNA, 201 bp, Homo sapiens
acatttaagctggatcttgaagaataaggagggtataccagtcacaaaattgaggaagagcttttcaggcaaagagaccacctgggttcattatctcctaraataagaatctccttgttacatttattataactgattcaaaacagacacccccacatatgccaacaacatacggtaaacactgacagagactgtcatgtc

SEQ ID NO: 17634 - DNA, 201 bp, Homo sapiens; identical to SEQ ID NO: 1672

SEQ ID NO: 17635 - DNA, 201 bp, Homo sapiens
cccttgaaaccacagactggatgtgaccctgagggtaagagaagttcccaaaaggattaagaatgtgtttttttccaacctagaagaatggtggcttggcmtcagaaattaagtcgttctgttgaaaataaacagaagtggaaatgtatattcagggcaacttaaactcatgctcttgacaaaatatttttttaaaaaaag

SEQ ID NO: 17636 - DNA, 201 bp, Homo sapiens
ctttttttttattttagtaagaactgccaaatggtgaaactattcacaaacactagaaatgcatgagagtgtcctcccgatattcttacctgaattttgcrtctttttatctcttgtcaatctagctgggaaaacgatattaaaatctcattttgactggcatttccccaacttcctagatggcttcacatcttttcatgt

SEQ ID NO: 17637 - DNA, 201 bp, Homo sapiens
gtaaaagcacaccatgattttagctcatctgttaattcatttatcgattttcacccccatccccaaggcagaatccctgcagtacttgattctctgagtcytgagaagttgttgcctgttgtccttatttaagatgaacttttgaatttaattttgaaatctttctatagaggctgggtgctaaaacatacgctagcctct

SEQ ID NO: 17638 - DNA, 201 bp, Homo sapiens
ccaacaacatacggtaaacactgacagagactgtcatgtcctacaattgttattaataaagccaattcattcatgcaagattcagttaaaacgtaatgctrcatctgtgcaactcccccaggaaagtgggaagtagtgtttggagaagaccaaataaacactcatgagtgatgatgatacctctgaggacacagattttaa

SEQ ID NO: 17639 - DNA, 201 bp, Homo sapiens
ctgttccccctgcctcgggtctctacctcagatcttcctggcacatgctccttcttatcagcctccagcccaaatcctcagagatgccttccctgactgckctctctaaaggaggacctcagtcactcacaccatcactgttttatcacagctcttattactattttatattttcttgttaatttatttgattaattctca

SEQ ID NO: 17640 - DNA, 201 bp, Homo sapiens
aaaccagactcgcatttgccatatgctcctctctgccccagggcctttgcaaccactgttccccctgcctcgggtctctacctcagatcttcctggcacakgctccttcttatcagcctccagcccaaatcctcagagatgccttccctgactgcgctctctaaaggaggacctcagtcactcacaccatcactgttttat

SEQ ID NO: 17641 - DNA, 201 bp, Homo sapiens
acctctaattatgcaatattctgcatgtcatttttaaaacagctttgttgagatagcgtcaatataccatacaattcacctaaagtggacaattcaatggwtttttagtgtattttagtattttcactaatgactaatcatattgagtcttttttcatgtgcttgttggacatgtgatatcttcctcggtgaaatgtctat

SEQ ID NO: 17642 - DNA, 201 bp, Homo sapiens
ctttggttatgatgtttggaaataataaaaagcttttatggctgctaaacgtgtgttacattgaaatacaccctggaatcattctggtgactcctgcacasggccatggtatgtttcactgcaattcagtgatgactttgtaagtggcataaacagctccattgatcacagtgctagtcttttctagggcaatgcctttta

SEQ ID NO: 17643 - DNA, 201 bp, Homo sapiens; identical to SEQ ID NO: 1671

SEQ ID NO: 17644 - DNA, 201 bp, Homo sapiens
gtaggagttgtttgcccttggccaatatgaaaaacctgagtgttctcccttcacttctagcgacaagtaacacatcccctgtcttgccatgaaaagagctktaactgtagcagccggtggcaggttttctgttcccaggtggggaagtgaggagagacaaacagaggggtgagagggagacagaaggaagacagctggtaa

SEQ ID NO: 17645 - DNA, 201 bp, Homo sapiens
ctgtcgttctccattattttaatcaagacactaaattacaggactttccatggccgctcagtgggtaaatgtagagaatggggaatctaattacttgaaastgatatgaatagctatagggattatgtcttttttctatgtaaacaagataaaaataacttacttttcactcttatatcagttttcacactatttcatttt

SEQ ID NO: 17646 - DNA, 201 bp, Homo sapiens
ttttcttctatttccatatgcatatttttaatatttctcacacctacacacacatacatagttacatggagagatggatcattaattcacctagaatgtgytgtgtgtgtgtgtgtgtgtgtgtgtgtgtgtgtgtagggatgagaagactcagtgttttctgagttcatatgatctacatggggaatcagatctaacatg

SEQ ID NO: 17647 - DNA, 201 bp, Homo sapiens
gcgcaacacctttagggagattctctgtggctgcaacggcatgaacttgggataggatgcagggccatggaaatgatcatcagtcgggtcacttttgactytccatccacgtgaggtgtttagaaagaaaaatatatatacttagaaaatataaaaatgtgttaacagccatgattgtacttgtcgtttgtttttaagttt

SEQ ID NO: 17648 - DNA, 201 bp, Homo sapiens; identical to SEQ ID NO: 1675

SEQ ID NO: 17649 - DNA, 201 bp, Homo sapiens
tacttttcactcttatatcagttttcacactatttcattttatcccattagcaaacctctaaaataggtgagtcattttacaaatgaagaaatttagcctyggaggggtgatatggttgtccaggagcacccacctagttagggtcatggtatattctgcatcctggggctgatgtccttttgcaccaatatgctgctgcc

SEQ ID NO: 17650 - DNA, 201 bp, Homo sapiens
tcttctcatttttgtggcatcttttaaaacacaaaagttgttaattttgaggaagtccaatttacttttttttttttttttttgagacagtgtctcgttcrctctgttgcccaggctggagtgcagtggtgcaatctcagctcactacaacctctgatacctgggttcaagcaattctcttgtctcagccactcgagtagc

SEQ ID NO: 17651 - DNA, 201 bp, Homo sapiens
ttgtcttcacacttataaaatgagggatagagctccagcctttacatcatcattccaggcagtaaaaaggagaaacagtcaagagcagaagagtttgtgcmtgttgaagtttgctggctgggttacttgaattgcctccctggaacttccatagaagacttcccttacatcactgtcaagtattggatcatgtagctacct

SEQ ID NO: 17652 - DNA, 201 bp, Homo sapiens
ggatgtaacccacttctatttttctgttgttgtgttggtgtgtgttgttgttttgtttttatggattaaatctaagacaaccttcaaaactctaacgaaasagagaaagtgctttggacaatcagaatatacttgtgtacgtgtattttgataccttgctattttaaggtatagattaatctttttaaaataacttctttt

SEQ ID NO: 17653 - DNA, 201 bp, Homo sapiens
atctcattcctgccctacctatgtttcttccacagtccccattgctgtcaaggtactgtccaaattctcacatctggctgaggctgtccttcaggattcargcacctctcaactttttaagaaactgtgcagcctcatttctcagattgtgtctcctatttccatgctctgaccagagcagactactttcagcactttcaa

SEQ ID NO: 17654 - DNA, 201 bp, Homo sapiens
aagcatacacagcatctgccattgtccacctgcaggatgggggagctgaagaatgtatctattgcctctggccctcattagttgagcgttgcccctggggkcatttactcccccctcatttccaggttgaactttgtcagatgaggaatgccacacacacacacaccagggaagactctggggcagaatgtgttcgtcacc

SEQ ID NO: 17655 - DNA, 201 bp, Homo sapiens
taaaggattatttttctgtgatacaacttgaaacctaaaggtaagcaattcagggctgggactacctctctctaaagtcatctgagattcagaagtctttyaggtttgggctccacattcacaggatcaggcccttgtcttcacacttataaaatgagggatagagctccagcctttacatcatcattccaggcagtaaaa

SEQ ID NO: 17656 - DNA, 201 bp, Homo sapiens
agatataattacaaagttgaggaaatgaagtcgcttccttttctgtctaactagtagagtctactggggttttacataattaagattgtctgaaaccaaawcagagaaagctaaaggcttcttcctttcagacacgtattaagtacttgatatatttctgacagaaatcagagctaaagatggccttctgccagaagttga

SEQ ID NO: 17657 - DNA, 201 bp, Homo sapiens
gagggagacagaaggaagacagctggtaagagaccctatggtgtattttttctatgtaaacaagataaaaactgctcctcctggaacagcaaagttctccstatgtctccaagctacaaacttgcatgctagctactaactagctactctccctctctctctctcttcccccttcgctctttctctctgtgtgtatgtctc

SEQ ID NO: 17658 - DNA, 201 bp, Homo sapiens
gttgcctgttgtccttatttaagatgaacttttgaatttaattttgaaatctttctatagaggctgggtgctaaaacatacgctagcctctctggctgaawacattttttaattcacgctcacctccactaaaatccattctccacatagcagctagtgcaattatttaaaaatataaatcagattatattacacttctgc

SEQ ID NO: 17659 - DNA, 201 bp, Homo sapiens
ttaaagttgagtgaccctgttatcaatgtctatatcctatcaagtacaggaattcattcctgggagcaaagggtgagactggctgactagtgctcgcattstcagatccttttctgcccaagataacttcaatttgtgctttctggctgtccccatatctccccctgtcacaaattcttatattaagctgtgtcttggggt

SEQ ID NO: 17660 - DNA, 201 bp, Homo sapiens
cacatcttttcatgtttattaaccatttgcatcttctcttcagtaaattattatttatatcctttgcccaattttcttaggggtaatttatctttttctarttaatgtgaaagtagtctttgtatgtaagagatagtaactttacctatagcaaatattttcattctgtttttcttttaacttagttcagggtgtttttcc

SEQ ID NO: 17661 - DNA, 201 bp, Homo sapiens
ctttttttctatcatttacttttagcctttaaaacaagaaaggaaatcatgggttggggtacatgtatatacgtgtgtgtgtgtgtgtgtgtgtgtgtgtktgtatcacaagaaattgctttactgtagcttaagatagtttgagaaaccgtagaaccactgtgtgactttcttgggagcccttgtttttgcttatagtaa

SEQ ID NO: 17662 - DNA, 201 bp, Homo sapiens
cctcggggacgtggctgctggttgggggtccccatcttaaagagcaagggcatagaggattttcaaatgagtattatgcgaagtaaaagtactcttctgcytagaatgctgaccccacgccagggactgtgctaagcacttcacaggcatttgctccttgtgataaccctaccaggtagataccatggttatcctgatttt

SEQ ID NO: 17663 - DNA, 201 bp, Homo sapiens
aactctccagcctccccttacaccatgcctctgccccgccccaaaccagactcgcatttgccatatgctcctctctgccccagggcctttgcaaccactgytccccctgcctcgggtctctacctcagatcttcctggcacatgctccttcttatcagcctccagcccaaatcctcagagatgccttccctgactgcgctc

SEQ ID NO: 17664 - DNA, 201 bp, Homo sapiens
tcttcctctttgcatccctggtttcctggactttcctgattcaagcatttattgattcctcttcttccaccccagactctgagttcggggaagcctgagayagtggctgttgtcttgctcaccactgtatttcctgcactcagcagagacctgacacatagtaggcgctcaataaatgtttgctaaacaacaacaacaaat

SEQ ID NO: 17665 - DNA, 201 bp, Homo sapiens
ctggagtcctcttctacctcctccagctccagcccccaccccaccacccaccccaaactggatatgacctcttcctccttgaagtcaaagcataggtgctscttcctccaggaactttgacagtccgggttagggctcttcctctttgcatccctggtttcctggactttcctgattcaagcatttattgattcctcttct

SEQ ID NO: 17666 - DNA, 201 bp, Homo sapiens
agaacaacactacattagtaggccacctgctaacttctgcctttcacattttccagcttaaaacatctccatcctccccattatgtaagaaagaagtacargtgtttctgactgctccctctcccatgatcccataacccatcagttctgaagctgcattatccaaccttctgaatctctctgaccaccctccaagtcttc

SEQ ID NO: 17667 - DNA, 201 bp, Homo sapiens; identical to SEQ ID NO: 1674

SEQ ID NO: 17668 - DNA, 201 bp, Homo sapiens
ccacagagaaggatagatcgagtcaggattctcaagcagtttggctgtgcaattggcatgtattctctgaccccttggcattctctggagagaatgcactraatattttcactgcatttcacctgagtttctcagcctcaacatcactgacatttggaagcagctcattctctgttgtaggaggctgtcctgtgctgttag

SEQ ID NO: 17669 - DNA, 201 bp, Homo sapiens
acatgagacttgagtggtacctgcaaagaaagaagtgagttgactaggataaaattaaataaagccggcgatgtggctcacacctgtaatcccagcacctyggaaggctgaggtgggtggattacctgaggccaggagttcgagaccagcctagccaacatggtgaaaccccgtctctactaaaaaacacaaaaacttgct

SEQ ID NO: 17670 - DNA, 201 bp, Homo sapiens; identical to SEQ ID NO: 1670

SEQ ID NO: 17671 - DNA, 201 bp, Homo sapiens
aacatgagacttgagtggtacctgcaaagaaagaagtgagttgactaggataaaattaaataaagccggcgatgtggctcacacctgtaatcccagcaccytggaaggctgaggtgggtggattacctgaggccaggagttcgagaccagcctagccaacatggtgaaaccccgtctctactaaaaaacacaaaaacttgc

SEQ ID NO: 17672 - DNA, 201 bp, Homo sapiens
tgtggataaaaaccaacacacaaggacacccaaggcggtagtgccagcaagggaaaaaaaggctttggaggaggagccaggcagcgctgggtgtgcatccytaggcaagtctcttgacctctgggcacctcattggcttatctgcaaggtgggagctccacctacttacatggcagcaagcagctgtgatgattcagtgaa

SEQ ID NO: 17673 - DNA, 201 bp, Homo sapiens
gaaaatgaccactaacgctacaggcttaaagaagcacttacacattgaatccacttttctttaatcatcagagatgtggataaaaaccaacacacaaggayacccaaggcggtagtgccagcaagggaaaaaaaggctttggaggaggagccaggcagcgctgggtgtgcatccttaggcaagtctcttgacctctgggca

SEQ ID NO: 17674 - DNA, 201 bp, Homo sapiens
gctggggtgccactgtctcctccgcgaccactttctcagattctcaagtgggaactcaccagatgttttaagcggcaggacagtcatgtttgaaaatgctwaattgttggaagtaaaagcacaccatgattttagctcatctgttaattcatttatcgattttcacccccatccccaaggcagaatccctgcagtacttga

SEQ ID NO: 17675 - DNA, 201 bp, Homo sapiens
tgagactgggccaagaaagaagctgccatccatgtgatgggtccacagagaaggatagatcgagtcaggattctcaagcagtttggctgtgcaattggcaygtattctctgaccccttggcattctctggagagaatgcactaaatattttcactgcatttcacctgagtttctcagcctcaacatcactgacatttggaa

SEQ ID NO: 17676 - DNA, 201 bp, Homo sapiens
gattccaagatgggtaagtcacaaactctgatttcccaaatagtcactgggagaaatcagcgaaggcttctctgcatgctctctgcactcatttccaaacrcccagggtgtgcgacgcctgtctgctcatctgctccacacccacgtcttcatgctccaggccagaccagactgaaggattctcatgaacaataagggtgg

SEQ ID NO: 17677 - DNA, 201 bp, Homo sapiens
tgcgcaacacctttagggagattctctgtggctgcaacggcatgaacttgggataggatgcagggccatggaaatgatcatcagtcgggtcacttttgacyttccatccacgtgaggtgtttagaaagaaaaatatatatacttagaaaatataaaaatgtgttaacagccatgattgtacttgtcgtttgtttttaagtt

SEQ ID NO: 17678 - DNA, 201 bp, Homo sapiens
atgctcttgccccagtaaagcaggagtccattggtgaggaagaagagaataggtattgtgtggacaacccacagccctgacttctaggagtaagtaatcamgcaagggaaagagtatgccaaagaagcctggtgcacaggaggtcttctgtagtccttaatttggaccctattcccctaaagctgaacttgtgacagagac

SEQ ID NO: 17679 - DNA, 201 bp, Homo sapiens
ccaggtggggaagtgaggagagacaaacagaggggtgagagggagacagaaggaagacagctggtaagagaccctatggtgtattttttctatgtaaacargataaaaactgctcctcctggaacagcaaagttctccctatgtctccaagctacaaacttgcatgctagctactaactagctactctccctctctctctc

SEQ ID NO: 17680 - DNA, 201 bp, Homo sapiens
aaaacctatgctcaaaataaaaccattagaggagagggggagtaaggcccagaaataaggcaggagaggagaggaagtcaagaataccactgagactgggscaagaaagaagctgccatccatgtgatgggtccacagagaaggatagatcgagtcaggattctcaagcagtttggctgtgcaattggcatgtattctctg

SEQ ID NO: 17681 - DNA, 201 bp, Homo sapiens
gattacttgaggccaggagttcgagaccagcctagccaacatggtgaaaccctgtctctactaaaaaatacaaaaattagctgggcacggtggagcatgcytgtaatctcagctactcaggagactgaggcacaagaatcacttgaacccaggaggcagaggttgcagtgagtcaagatcgcaccactgcactccagcctg

SEQ ID NO: 17682 - DNA, 201 bp, Homo sapiens
ccacctacttacatggcagcaagcagctgtgatgattcagtgaagtataacaatgtccaaaaataattagcacgtgaacttcacgtcccctttccccttcrcttgctggactctagacatttctgaagttgcctgcagttttcctgcccctcgtctctgaggttcctgaaaacagcagttattaatgaggggaaggagagg

SEQ ID NO: 17683 - DNA, 201 bp, Homo sapiens
tcacagacgtgaatcatcttgactgtcttgaccgatactactcagcagggatgaggcagagctgagatgattggaaaatgaccactaacgctacaggcttmaagaagcacttacacattgaatccacttttctttaatcatcagagatgtggataaaaaccaacacacaaggacacccaaggcggtagtgccagcaaggga

SEQ ID NO: 17684 - DNA, 201 bp, Homo sapiens
gacagctggtaagagaccctatggtgtattttttctatgtaaacaagataaaaactgctcctcctggaacagcaaagttctccctatgtctccaagctacraacttgcatgctagctactaactagctactctccctctctctctctcttcccccttcgctctttctctctgtgtgtatgtctctctctctctctgtctct

SEQ ID NO: 17685 - DNA, 201 bp, Homo sapiens
acctatagcaaatattttcattctgtttttcttttaacttagttcagggtgtttttccatactaaattttggattgctcatcttgcttaagatctttccaycccaaggatcctaagttttcttctatttccatatgcatatttttaatatttctcacacctacacacacatacatagttacatggagagatggatcattaa

SEQ ID NO: 17686 - DNA, 201 bp, Homo sapiens
gaggagagacaaacagaggggtgagagggagacagaaggaagacagctggtaagagaccctatggtgtattttttctatgtaaacaagataaaaactgctyctcctggaacagcaaagttctccctatgtctccaagctacaaacttgcatgctagctactaactagctactctccctctctctctctcttcccccttcgc

SEQ ID NO: 17687 - DNA, 201 bp, Homo sapiens
agtgattctcctgcctcagcctcccgagtagctgggactacaggcgcacaccaccatccccggctattttttgtatttttagtagagatgggattttgccrtgttggccaggctggtcccaaactcctgacctcaggtctcgatctcttgaccttgtgatctgcccaccttggcctcctaaagtgctggaattacaggcat

SEQ ID NO: 17688 - DNA, 201 bp, Homo sapiens; identical to SEQ ID NO: 1676

SEQ ID NO: 17689 - DNA, 201 bp, Homo sapiens
tatttctatggaagaactgtccatgttatccaaagaccaatgcctccaccatcccctcacctattccaaaatctcttcgacagcaccaatttcctcctttytatgagattatccccattagtagagaaatatgttgatattttgtccatcttctaaaaaataccttggcctaatgtctccctgtagctaccatcccactta

SEQ ID NO: 17690 - DNA, 201 bp, Homo sapiens
ttacaccataactaggctatttaaaggcttgatttaaaatggtcttcagagtgtacatattaatgtatcttgtttataattcttattccaacatgtttgttaaattaaaacaactttcttccaacgaacatatagtttttcatgagtatctttttttttttttttttttttttttgagacaaggtcttactctgttgccag

SEQ ID NO: 17691 - DNA, 201 bp, Homo sapiens
cttacaccataactaggctatttaaaggcttgatttaaaatggtcttcagagtgtacatattaatgtatcttgtttataattcttattccaacatgtttgttaaattaaaacaactttcttccaacgaacatatagtttttcatgagtatctttttttttttttttttttttttttgagacaaggtcttactctgttgcca

SEQ ID NO: 17692 - DNA, 201 bp, Homo sapiens
acttacaccataactaggctatttaaaggcttgatttaaaatggtcttcagagtgtacatattaatgtatcttgtttataattcttattccaacatgtttgttaaattaaaacaactttcttccaacgaacatatagtttttcatgagtatctttttttttttttttttttttttttgagacaaggtcttactctgttgcc

SEQ ID NO: 17693 - DNA, 201 bp, Homo sapiens
aacttacaccataactaggctatttaaaggcttgatttaaaatggtcttcagagtgtacatattaatgtatcttgtttataattcttattccaacatgtttgttaaattaaaacaactttcttccaacgaacatatagtttttcatgagtatctttttttttttttttttttttttttgagacaaggtcttactctgttgc

SEQ ID NO: 17694 - DNA, 201 bp, Homo sapiens
agtctttgacattcccaatatctgaaaacctttcatgatccaagtttgagcttcccattctttaactaacttcttctaccttcctgctcactcaatctagwactctaataactgttggaacttaccaggatctgtaattcactgaccccacaccttcatagggtcagtcttcctcctcaagttcttagttcctaattatat

SEQ ID NO: 17695 - DNA, 201 bp, Homo sapiens
accttcctgctcactcaatctagtactctaataactgttggaacttaccaggatctgtaattcactgaccccacaccttcatagggtcagtcttcctcctcaagttcttagttcctaattatatcactaatttcattgtgatcactccctggggtgttgtataacaatgctcctttgtcctttcactatactaatgtgaca

SEQ ID NO: 17696 - DNA, 201 bp, Homo sapiens
gggctacaggcgcccgccaccatgcccagctaattttttgtatttttagtagagacagggtttcaccgtgttatccaggatggtctcgatctcctgacctygtgatccacccacctcggcctcccaaagtgctgggattacaggcgtgagccactgcacccggcctatagaactgttttttaagtcacgggacaaatcttc

SEQ ID NO: 17697 - DNA, 201 bp, Homo sapiens
taccttcctgctcactcaatctagtactctaataactgttggaacttaccaggatctgtaattcactgaccccacaccttcatagggtcagtcttcctcctcaagttcttagttcctaattatatcactaatttcattgtgatcactccctggggtgttgtataacaatgctcctttgtcctttcactatactaatgtgac

SEQ ID NO: 17698 - DNA, 201 bp, Homo sapiens
ctaccttcctgctcactcaatctagtactctaataactgttggaacttaccaggatctgtaattcactgaccccacaccttcatagggtcagtcttcctcctcaagttcttagttcctaattatatcactaatttcattgtgatcactccctggggtgttgtataacaatgctcctttgtcctttcactatactaatgtga

SEQ ID NO: 17699 - DNA, 201 bp, Homo sapiens
aaagagcggtaacaagaaagaaccccagaaaaaaagagaagcaatgcagggaacaaaaatctactttataaaagagctaaaaaaaaaaaaaaaaaaaaaaagcctttactattctcagggagtcagcagaagaaacaacattcataataccagggctagatgctgtaaagacagtaacaacaaacagatgaaaatgatcaa

SEQ ID NO: 17700 - DNA, 201 bp, Homo sapiens
tggatcttggacttcccagcctccacaattgtaagaaataaatttcttatctttataaattacctagtccctggtattgtgttacagcagcaaaaacagaytgagaccttcagatagacaaaaattatctacagtgtagaagcatgtacgaaaatgaacactctattccattttggtagaataataaagtaggtacatcac

SEQ ID NO: 17701 - DNA, 201 bp, Homo sapiens
tctgcctcccgggttcaagagattttcctgcctcagcctcctgagtagctgggattacaggtgcgcgccaccacgcccagctaatttttttggatttttartagaggcagggtttcaccatgttgaccaggctggtctcaaactcctgacctcaagtgacacttctgccttagcctccccaagtgctgagattacaggcat

SEQ ID NO: 17702 - DNA, 201 bp, Homo sapiens
tggtggctcacacctgtaatcccagcactttaggaggctgaggtgggcagttcatgggttcaagagatcgagaccatcctggccaacatgatgaaatcccmtctctactaaaaatacaaaaattagctgggcgtggtggcacacacctgtaatcccacttactcaggaggctgaggcaggcgaattgcttaaacccgggag

SEQ ID NO: 17703 - DNA, 201 bp, Homo sapiens
atgagcttgtgcataacattcacctggctgttaacttcttggtgtcactgctcgagaaaaaactggcagaatgtccgggccttatatatcaagagcaccaygggcaagccccagcgcctatattaaggcatatttgaaaagattctactgctactagtaaaaaaaacaaaaaacaaaaaaccaactaatcccatgaaaact

SEQ ID NO: 17704 - DNA, 201 bp, Homo sapiens
acaggtgcgcgccaccacgcccagctaatttttttggatttttagtagaggcagggtttcaccatgttgaccaggctggtctcaaactcctgacctcaagkgacacttctgccttagcctccccaagtgctgagattacaggcatgagtcaccgtgcccggcccacacacacatttttaacagaaagaatggaagatgaag

SEQ ID NO: 17705 - DNA, 201 bp, Homo sapiens
tcccattctttaactaacttcttctaccttcctgctcactcaatctagtactctaataactgttggaacttaccaggatctgtaattcactgaccccacamcttcatagggtcagtcttcctcctcaagttcttagttcctaattatatcactaatttcattgtgatcactccctggggtgttgtataacaatgctccttt

SEQ ID NO: 17706 - DNA, 201 bp, Homo sapiens
ggaggcggaggttgcagagagccgagaccatgccacttcactccaggcctgggctacagggcaagactccgtcccaacccccgacacccccctaacccccmaaaaaagaaaaagcttaattagtgaggcatggtggctcatgcctgtaatcccaacactctgggaggttgaggcaggaggactgcttgaacacaggagttc

SEQ ID NO: 17707 - DNA, 201 bp, Homo sapiens
aaaaaacaatataaacttaattttcgacattccaaatgagagatcaaaagtttcccaaatgcaagaagttatatgattattgccttcttgaggaaaaaaawgttccatttacattagcaacaaaaattataaaatagcttgaaatgaatttaacaagcattatataaaacatagatgaaaaaagttacaaaacctgaaaac

SEQ ID NO: 17708 - DNA, 201 bp, Homo sapiens
cctctgttgccccggctggagtacagcggtacaatcatagcacaatgcagtcttgtactcctgggctcaagtgatcctccttgccttggcctcccaaagcrctatgaatacaggcatgagctactgcgggtggccagggaacttgcctcaaaaagaaattatgaatgacaaaaatatataaaaagatcataaatctaagta

SEQ ID NO: 17709 - DNA, 201 bp, Homo sapiens
ggaggctgaggcaggcggatcacgagatgagatcgagaccatcctggctaacacagtgaaaccccgtctctactaaaaatacaaaaaattagccgggtgtrgtggtggatgcctgtagtcccagctactcgggaggctgaggcaggagaatggcgtgaacccagaaggcggagcttgcagtgagccgagattgcaccactg

SEQ ID NO: 17710 - DNA, 201 bp, Homo sapiens
atgtttggctgtggctgttggccacgtgaagatgacagacgatgagcttgtgcataacattcacctggctgttaacttcttggtgtcactgctcgagaaamaactggcagaatgtccgggccttatatatcaagagcaccacgggcaagccccagcgcctatattaaggcatatttgaaaagattctactgctactagtaa

SEQ ID NO: 17711 - DNA, 201 bp, Homo sapiens
ggccagggaacttgcctcaaaaagaaattatgaatgacaaaaatatataaaaagatcataaatctaagtagtgaaaagggaaaaagcaacttctggttttytctacaccctttttttgtccatacgtgctatggtttgaatgaatgtcccctcccaaactcatggtgaaacgtaattgctgttgcagcagtactaaggcat

SEQ ID NO: 17712 - DNA, 201 bp, Homo sapiens
gggaggctgaggcaggcggatcacgagatgagatcgagaccatcctggctaacacagtgaaaccccgtctctactaaaaatacaaaaaattagccgggtgyggtggtggatgcctgtagtcccagctactcgggaggctgaggcaggagaatggcgtgaacccagaaggcggagcttgcagtgagccgagattgcaccact

SEQ ID NO: 17713 - DNA, 201 bp, Homo sapiens
tattgccttcttgaggaaaaaaaagttccatttacattagcaacaaaaattataaaatagcttgaaatgaatttaacaagcattatataaaacatagatgraaaaagttacaaaacctgaaaacaaatttgagacacatgcacattcctgaatagaaacatttggcattagccggatgtggtggcttacactggtaatccc

SEQ ID NO: 17714 - DNA, 201 bp, Homo sapiens
agggtcagtcttcctcctcaagttcttagttcctaattatatcactaatttcattgtgatcactccctggggtgttgtataacaatgctcctttgtccttycactatactaatgtgacaaaaccccaatctctgcaaatgccatgcctgcagctgggcaactgaatgtggctggagagtagcacaacgccatgctgactct

SEQ ID NO: 17715 - DNA, 201 bp, Homo sapiens
agtaatgggaaagcaaaagaactcccagatgggccaggcgtggtggctcacgcctgtaatcccagcactgtgggaggctgaggcaggcggatcacgagatragatcgagaccatcctggctaacacagtgaaaccccgtctctactaaaaatacaaaaaattagccgggtgtggtggtggatgcctgtagtcccagctact

SEQ ID NO: 17716 - DNA, 201 bp, Homo sapiens
aaaacagtattattgcattcatttagcaaatatttattaagtacctaacaggttccaagcactgtgttaagttctgtcatcttcccctacagactggagayagcctacaaactagagaaggagacagacaaacgagcaattccaatacaatgtaaattgtgccatataaggggagtatcgggatttttatggaatcccatg

SEQ ID NO: 17717 - DNA, 201 bp, Homo sapiens
gggaaaggggatttgtcaatgattacttctcagaaatgttccctaaacagaagagtaaagagtatttcaggtacagggaaaagcaggcgcaaagacctaartgcaagaaactacatcaaaggttgggcacgctggcttacacctgcaatcccagcattttgggaggttgaggcgggcagatcaccaggtcaagagattgag

SEQ ID NO: 17718 - DNA, 201 bp, Homo sapiens
ttctggttagcgtggcatgagaacccataagcagcaaagtctctcacgacaccctggatgaggcggtgcaggaagtcctgcacgggaaccagtgaaagtgycccaagttcctgaagatggtggagttgcagatcagcttgaagaactatgacccccagaaggacaagcgcttctcgggcaccgtcaggcttaagtccactc

SEQ ID NO: 17719 - DNA, 201 bp, Homo sapiens
aggagaatggcttgaacccagaaggcggagcttgcagtgagccgagattgcaccactgcactccagcctgggtgacagagtgagactctgcctcagaaaawaaacaaaaacaaaaacaaaacaaaaaactcccagacacctaatatatgtttcatgttcttttgagaaagcttaattaggctgggcgtggtggctcatgcc

SEQ ID NO: 17720 - DNA, 201 bp, Homo sapiens; identical to SEQ ID NO: 1677

SEQ ID NO: 17721 - DNA, 201 bp, Homo sapiens
tataatgtttacattttatatgtcatatctacaataggcaaaaaaaaccccacaagagtaaaatgattttgttcaaagtttttccttttttttttttttttttttttttactttaagttctgggatacatgtgcagaacgtgcaggttaaacaggtatacatgtgccatggtggtttgctgcgcccatcgacccatcagct

SEQ ID NO: 17722 - DNA, 201 bp, Homo sapiens
acataatgaatttctatatttctataatgtttacattttatatgtcatatctacaataggcaaaaaaaaccccacaagagtaaaatgattttgttcaaagwttttccttttttttttttttttttttttttactttaagttctgggatacatgtgcagaacgtgcaggttaaacaggtatacatgtgccatggtggtttgc

SEQ ID NO: 17723 - DNA, 201 bp, Homo sapiens; identical to SEQ ID NO: 1680

SEQ ID NO: 17724 - DNA, 201 bp, Homo sapiens
ttttttgtttgtttgtttgttttttcgagacggagtctcactctgtcacccaggctgcagtgcagtgatgcagtctcagctcactgcaagctccgtctccygggttcatgccattctcccgccttagcctcctgaacagctggggctacaggcgcccgccaccatgcccagctaattttttgtatttttagtagagacagg

SEQ ID NO: 17725 - DNA, 201 bp, Homo sapiens
tgtagatatggaagtgggaagtggaagtcaatgatgtttaaaatgataaatttggagaaagctattggagtaacagaagaaagagcttaaaaaagttgggkcctttgagtaataatgctgaggaaaaagagggataagaaaagaaacttctgattgtcattagaactttttagtatatttgacttgttaagctatgtgcat

SEQ ID NO: 17726 - DNA, 201 bp, Homo sapiens
atgaaaactaatctaatcaaaatttcatgctctgtttttagaaaatggcaacttaattctaaaattcatgtggaagagtaaatgaccaaaaaaaaaaaaaagctatgaaaattttgaaaaataagagtcattggccgggcgtggtggctcacacctgtaatcccagcactttaggaggctgaggtgggcagttcatgggtt

SEQ ID NO: 17727 - DNA, 201 bp, Homo sapiens
catgaaaactaatctaatcaaaatttcatgctctgtttttagaaaatggcaacttaattctaaaattcatgtggaagagtaaatgaccaaaaaaaaaaaaaagctatgaaaattttgaaaaataagagtcattggccgggcgtggtggctcacacctgtaatcccagcactttaggaggctgaggtgggcagttcatgggt

SEQ ID NO: 17728 - DNA, 201 bp, Homo sapiens
gtgagctgagatcacgccactgcactctagcctgggcaacaagagcgaaattccgtctcaaaaaaaaaaaagaaagaaaaaaaagaaagaaagacttggcrtcattaaaatatcaatttcctcccaaactattaataatttataaaaccaactaaaccctcttttctggttagcgtggcatgagaacccataagcagcaaa

SEQ ID NO: 17729 - DNA, 201 bp, Homo sapiens
aggccgaggcaggcggactgcttaagctcaggagttcaagaccagcctgggcaatatggtgaaactccatctctaccaaaaataaaataaaataaaataawtaaataaaataaaataaaataaaataagccaggtgcggtactgtgtgcttgtggtcccagctactggggaggctgaagtgggaggttgcttgagtccaaa

SEQ ID NO: 17730 - DNA, 201 bp, Homo sapiens
aatgtggctggagagtagcacaacgccatgctgactcttcccactttaaatccttggtcaccaacctcagggaagccttaaggctgcctggcaattctatwacatttctctagtccattcactctcctgcttatctggcaattattttaacctcctcacatctctaatacatctcctcatcgtagcagatcagtttgcttt

SEQ ID NO: 17731 - DNA, 201 bp, Homo sapiens
ttttgggaggttgaggcgggcagatcaccaggtcaagagattgagaccatcctggccaacatggtgaaaccccatctctactaaaaatacaaaaattagcygggcatggtggcgcacgcctatagtcccagctactcaggaggctgaggcaggagaattgcttgaacccaggaggcggaggttacagggagctgagatcac

SEQ ID NO: 17732 - DNA, 201 bp, Homo sapiens
ggcaccctctgctttcctcctatttctttactttattttctttctttattttttgagacagagttttgctcttgttgcccaggctggactgcagtggtgcratctcggctcaccacaacctctgcctcctgggttcaagcaattcgcctgcctcagcttcctgagtagctgggattacaggggcacgccaccatgcccaga

SEQ ID NO: 17733 - DNA, 201 bp, Homo sapiens
ttttttaaaagttaatgtctatataaaaaactctgggaatatacaccaaactgctgaaagtgattgtctttgaagagacaaatttcaaggaacttactttytacataatgaatttctatatttctataatgtttacattttatatgtcatatctacaataggcaaaaaaaaccccacaagagtaaaatgattttgttcaaa

SEQ ID NO: 17734 - DNA, 201 bp, Homo sapiens
atcccagcattttgggaggttgaggcgggcagatcaccaggtcaagagattgagaccatcctggccaacatggtgaaaccccatctctactaaaaatacaraaattagccgggcatggtggcgcacgcctatagtcccagctactcaggaggctgaggcaggagaattgcttgaacccaggaggcggaggttacagggagc

SEQ ID NO: 17735 - DNA, 201 bp, Homo sapiens
tatatcactgcaatagaaaagctagggaaagaaatgtagatatggaagtgggaagtggaagtcaatgatgtttaaaatgataaatttggagaaagctattrgagtaacagaagaaagagcttaaaaaagttggggcctttgagtaataatgctgaggaaaaagagggataagaaaagaaacttctgattgtcattagaact

SEQ ID NO: 17736 - DNA, 201 bp, Homo sapiens
tggcaacagtcttttaaaattccagttagcacagtccagtgcttcccaaccttttccaagtctccgcacacacaggaaatgaaaatatttacagggcacaytgctgcaaacagaggatgcatgctgacagatgacagacccagggctcatgctcttgcagccccaggcctggtgggctgcaggcatgaatgctacgccata

SEQ ID NO: 17737 - DNA, 201 bp, Homo sapiens
gagagagagaaaaaaaaaagaatcatcaggaggggaacttgacctaaaacatacaatccacagctgcagtaataaaaacaccacggtatgggtataggacyaaataaacagactggagaaataacaggacacatatgagaatttattatgtgttaacgcaggtatcttcaattgttgggagagaactgatggttctgggac

SEQ ID NO: 17738 - DNA, 201 bp, Homo sapiens
catctcaccaaaaaaagagagagagaaaaaaaaaagaatcatcaggaggggaacttgacctaaaacatacaatccacagctgcagtaataaaaacaccacrgtatgggtataggaccaaataaacagactggagaaataacaggacacatatgagaatttattatgtgttaacgcaggtatcttcaattgttgggagagaa

SEQ ID NO: 17739 - DNA, 201 bp, Homo sapiens
accctcttttctggttagcgtggcatgagaacccataagcagcaaagtctctcacgacaccctggatgaggcggtgcaggaagtcctgcacgggaaccagygaaagtgccccaagttcctgaagatggtggagttgcagatcagcttgaagaactatgacccccagaaggacaagcgcttctcgggcaccgtcaggcttaa

SEQ ID NO: 17740 - DNA, 201 bp, Homo sapiens
aaataagccaggtgcggtactgtgtgcttgtggtcccagctactggggaggctgaagtgggaggttgcttgagtccaaaaggtggagcttgcagtgagccragatcgcgctgcactccagcctgggcgacagagccagactctgtctcaaaaaaaaaaaaaaagcatgctattaaaaaacaatataaacttaattttcgac

SEQ ID NO: 17741 - DNA, 201 bp, Homo sapiens
ttcttaaaactttcttcaactttggtataagaaagactctgtagcctgaaagttaattttcaaacatggctgcagaaagacttggtgtcaaaagatgtggraagtattttacacaatgaaaatcaccacaacaaccagggacctgtgggggtagagtcctttgggtttagaggcattgatgtaattttttttggcagtttt

SEQ ID NO: 17742 - DNA, 201 bp, Homo sapiens
ccaagccttttcctttgaggctcagggcgggctggctaacattgctatattgaacaacaacttgaataccttgatccagcgttccaaccacactcaggccrccaacggtacgccctatctttgcctcttcctctgtagcccaactggaagggatgagagggcctctctgccaccctcagactaggaagcctaagtgccccc

SEQ ID NO: 17743 - DNA, 201 bp, Homo sapiens; identical to SEQ ID NO: 1685

SEQ ID NO: 17744 - DNA, 201 bp, Homo sapiens
aaaataggaataatgtgattaggctagtgggtaagggtagcattgaaaagatagaaatagaccttcaagtagagcatgcatgatcttgaataaaataatarttagtaagtatatagcggaatggcagggagacagagtttgcactctgtagcacatttaggagaaattttaaccaaaagtaatttgggcaaagaatatttg

SEQ ID NO: 17745 - DNA, 201 bp, Homo sapiens; identical to SEQ ID NO: 1686

SEQ ID NO: 17746 - DNA, 201 bp, Homo sapiens; identical to SEQ ID NO: 1687

SEQ ID NO: 17747 - DNA, 201 bp, Homo sapiens
tctgcccagattattatttcttaggcatgttcactatgtaattgattcctagatgttgaaaataggaataatgtgattaggctagtgggtaagggtagcaytgaaaagatagaaatagaccttcaagtagagcatgcatgatcttgaataaaataatagttagtaagtatatagcggaatggcagggagacagagtttgca

SEQ ID NO: 17748 - DNA, 201 bp, Homo sapiens
aacctccacctccgggcttcaaccaattctccttcctcagcctcccgaatagctgggattataggtgcctgccacttcacctggctaatttttgtattatyagtagagacaaggtttctccatgttggtcagcctggttctctaggagcacttgaccaacgcctgacctcaagtgatccacccgctcggcctctcaaaggg

SEQ ID NO: 17749 - DNA, 201 bp, Homo sapiens
catccgggagggaggtgggggggtcagccccccgcccggccagccaccccatccgggaagtgaggggcgcctctgcccggccgcccctactgggaagtgargagcccctctgcccagccagccgccccgtccgggagggaggtggggggtcagccccctgccccgccagccgccccgtccgggagggaggtgggggggtca

SEQ ID NO: 17750 - DNA, 201 bp, Homo sapiens
tatctgttttaaggtcccagaacattccacgagaggcatcttgctcaatattctttgacaggagcaggtcagcctggagccacatcagtgacctccagggkgcgctggagttaaggcctgatacccaatggcctcatttctgacccagttcaaatacatttcaccaaggcaaggattcctgtttgttctagttgccttctc

SEQ ID NO: 17751 - DNA, 201 bp, Homo sapiens
tctgcccggccagccgccccatccgggagggaggtgggggagtcagtcccccgcccggccagccgccccatccgggagggaggtgggggggtcagcccccygcccggccagccaccccatccgggaagtgaggggcgcctctgcccggccgcccctactgggaagtgaagagcccctctgcccagccagccgccccgtccg

SEQ ID NO: 17752 - DNA, 201 bp, Homo sapiens
tccgaggagctggggccatcaagggtgagtgctcaggaggacgcaggagcgtcggggtgagtgatggggtggttcacatcaattgctgcttcagggatcasagattttaggggctcattgatctatctggtcctcatagtctatgttccctctggccctcataataataacagcaataacagccagaatttatgagactcc

SEQ ID NO: 17753 - DNA, 201 bp, Homo sapiens
gtcagtcccccgcccggccagccgccccatccgggagggaggtgggggggtcagccccccgcccggccagccaccccatccgggaagtgaggggcgcctcygcccggccgcccctactgggaagtgaagagcccctctgcccagccagccgccccgtccgggagggaggtggggggtcagccccctgccccgccagccgcc

SEQ ID NO: 17754 - DNA, 201 bp, Homo sapiens; identical to SEQ ID NO: 1688

SEQ ID NO: 17755 - DNA, 201 bp, Homo sapiens
ggcccacagtttcagtctcatctgcctccactcggcctcagttcctcatcactgttcctgtgctcacagtcatcaattatagaccccacaacatgcgcccwgaagacagaatgttccatatcagagctgtgatcttgagagccctctccttggctttcctgctgagtctccgaggagctggggccatcaagggtgagtgct

SEQ ID NO: 17756 - DNA, 201 bp, Homo sapiens
attccacatcttaacagaatacaaaagaaaaattatgtaattatgtaaatggatgcagaaaaaggcatttgctcattcatgataaaaagtcctagaaaackaggaataaaaaggaattacctgataaggtgtgtccatgaaaaccaacaactgaaattttcaattttgggtgggggaggggggcgggcattttactttctc

SEQ ID NO: 17757 - DNA, 201 bp, Homo sapiens; identical to SEQ ID NO: 1690

SEQ ID NO: 17758 - DNA, 201 bp, Homo sapiens
gttagtaagtatatagcggaatggcagggagacagagtttgcactctgtagcacatttaggagaaattttaaccaaaagtaatttgggcaaagaatatttratcaactgtgaaattacctaccttttcaaagttctatcttgatacaaaggaagcaaaatttactcaaataatatcttgaaattaagatatacagacaatg

SEQ ID NO: 17759 - DNA, 201 bp, Homo sapiens
atgctgcctgggtagaaatccgtcacgtggcagacaagcaggttgtggtgctgcaagggccccttcttggagggggaaacattcaccctaggctggactasgagcgtggaagaaaaataatgaaatagaatttgagattgtccttctttccttccttccttccttccttccttccttccttccttccttccttcctttttt

SEQ ID NO: 17760 - DNA, 201 bp, Homo sapiens; identical to SEQ ID NO: 1691

SEQ ID NO: 17761 - DNA, 201 bp, Homo sapiens
atcagggccctcctatctctctgggatccccagcctctatcttttgtggctgctttacaggaactccgagctatggactctgcattaggagacgaagtgcraagagtgtttctgtatcctccctctcttctaggaccctagggctcttcctgggtctttgtgggtggtcacaagctttcctctctcaagacagcagggttg

SEQ ID NO: 17762 - DNA, 201 bp, Homo sapiens; identical to SEQ ID NO: 1692

SEQ ID NO: 17763 - DNA, 201 bp, Homo sapiens
ggctgtgcaacggggagctggtcactgagggtgtcgctgagagcctcttcctgcccagaacagattacagcttccacaagttccattacctgacctttgtrccctcagcagaggacttctatgactgcagggtggagcactggggcttggaccagccgctcctcaagcactggggtatgcaactgcttttctctccataat

SEQ ID NO: 17764 - DNA, 201 bp, Homo sapiens
tatgaggtttaaatgaggtaatgcatgcaaagcactaataacagaatctctcatgtcctaatctgttagtaattattatttatgcaaggtaaggctaccayaaataagataaaatattaacgtaatatatgtacttcatcattacattaaatagtaaatgttttgtgaccttctctatgagtatcaaataaatagctcaaa

SEQ ID NO: 17765 - DNA, 201 bp, Homo sapiens
cacttgcatattcaaactgacattttgtcgtgtttttctctactgtctttatgcagcggaccatgtgtcaacttatgccgcgtttgtacagacgcatagamcaacaggggagtttatgtttgaatttgatgaagatgagatgttctatgtggatctggacaagaaggagaccgtctggcatctggaggagtttggccaagc

SEQ ID NO: 17766 - DNA, 201 bp, Homo sapiens
cccatccgggaagtgaggggcgcctctgcccggccgcccctactgggaagtgaagagcccctctgcccagccagccgccccgtccgggagggaggtggggrgtcagccccctgccccgccagccgccccgtccgggagggaggtgggggggtcagccccccgcccggccagccaccccatccgggaagtgaggggcgcctc

SEQ ID NO: 17767 - DNA, 201 bp, Homo sapiens
gcaggtgaggggcgcctctgcccggcccgcccctactgggaagtgaggagcccctctgcccggccagccgccccatccgggagggaggtgggggagtcagycccccgcccggccagccgccccatccgggagggaggtgggggggtcagccccccgcccggccagccaccccatccgggaagtgaggggcgcctctgcccg

SEQ ID NO: 17768 - DNA, 201 bp, Homo sapiens
cctttgaggctcagggcgggctggctaacattgctatattgaacaacaacttgaataccttgatccagcgttccaaccacactcaggccaccaacggtackccctatctttgcctcttcctctgtagcccaactggaagggatgagagggcctctctgccaccctcagactaggaagcctaagtgccccctgctgtgtgat

SEQ ID NO: 17769 - DNA, 201 bp, Homo sapiens
gctgcgtcttcaggtcccatgaaggtctcacagatgaccaggtgttgcctccctctgcatctttgcatttgtgccccagcttgtcctgttgttctcaggtsaatttccacactgccactggcaacttttcttttggatctctgccaccagtacctttttcctcctcagaaagcagaaaaggccaggcatggtggtcatgcc

SEQ ID NO: 17770 - DNA, 201 bp, Homo sapiens
tttgctcctttctttttataactgctcatctgctctgtattatttcctttatggtgttgctccttcttcttccccatatgtccttcctttgacctcttacyttcttcctttttatattcataagtctttattcattctctagctttgaccacttgcatattcaaactgacattttgtcgtgtttttctctactgtctttat

SEQ ID NO: 17771 - DNA, 201 bp, Homo sapiens
agggggcggacatgagcggaggcgccactctcatctaatcctctttctccctctctctctcaatattaacgattcttcccaaatcttcccacccagggctrgattttaaaataggagttttcctagtaccgagttctgtggtcctaagcgggtcgcagagcctctccaggcctgttttctcaccacgcagagagagaattt

SEQ ID NO: 17772 - DNA, 201 bp, Homo sapiens
aagtgaggagcccctctgcccggccagccgccccatccgggagggaggtgggggagtcagtcccccgcccggccagccgccccatccgggagggaggtggrggggtcagccccccgcccggccagccaccccatccgggaagtgaggggcgcctctgcccggccgcccctactgggaagtgaagagcccctctgcccagcc

SEQ ID NO: 17773 - DNA, 201 bp, Homo sapiens
ctttgaggctcagggcgggctggctaacattgctatattgaacaacaacttgaataccttgatccagcgttccaaccacactcaggccaccaacggtacgscctatctttgcctcttcctctgtagcccaactggaagggatgagagggcctctctgccaccctcagactaggaagcctaagtgccccctgctgtgtgatc

SEQ ID NO: 17774 - DNA, 201 bp, Homo sapiens
ctgcggggagggggcggacatgagcggaggcgccactctcatctaatcctctttctccctctctctctcaatattaacgattcttcccaaatcttcccacycagggctggattttaaaataggagttttcctagtaccgagttctgtggtcctaagcgggtcgcagagcctctccaggcctgttttctcaccacgcagaga

SEQ ID NO: 17775 - DNA, 201 bp, Homo sapiens; identical to SEQ ID NO: 1703

SEQ ID NO: 17776 - DNA, 201 bp, Homo sapiens
aattctctgcggggagggggcggacatgagcggaggcgccactctcatctaatcctctttctccctctctctctcaatattaacgattcttcccaaatctwcccacccagggctggattttaaaataggagttttcctagtaccgagttctgtggtcctaagcgggtcgcagagcctctccaggcctgttttctcaccacg

SEQ ID NO: 17777 - DNA, 201 bp, Homo sapiens
ctgacattttgtcgtgtttttctctactgtctttatgcagcggaccatgtgtcaacttatgccgcgtttgtacagacgcatagaccaacaggggagtttakgtttgaatttgatgaagatgagatgttctatgtggatctggacaagaaggagaccgtctggcatctggaggagtttggccaagccttttcctttgaggct

SEQ ID NO: 17778 - DNA, 201 bp, Homo sapiens
ggagctgattacaagcagagatccccagacctccccacccagggaatctgagtctgggggcactgagtctggagatctgtgcatcacagaggatctccagragagtcttcagaggagtgaggttggggacctgcgggcctggaggagaaacccacactccttaggctggcatcagggctgtctgcaatctggcagttgatt

SEQ ID NO: 17779 - DNA, 201 bp, Homo sapiens
tattcaaactgacattttgtcgtgtttttctctactgtctttatgcagcggaccatgtgtcaacttatgccgcgtttgtacagacgcatagaccaacaggrgagtttatgtttgaatttgatgaagatgagatgttctatgtggatctggacaagaaggagaccgtctggcatctggaggagtttggccaagccttttcct

SEQ ID NO: 17780 - DNA, 201 bp, Homo sapiens
tcaaagggctgggattacgggcctgagccactgcatctgcccagattattatttcttaggcatgttcactatgtaattgattcctagatgttgaaaatagraataatgtgattaggctagtgggtaagggtagcattgaaaagatagaaatagaccttcaagtagagcatgcatgatcttgaataaaataatagttagtaa

SEQ ID NO: 17781 - DNA, 201 bp, Homo sapiens
actgcatatacatgtgggcctgacctgcatccctggaatgtatgtatcctagaaaggggttgcagggttgctggagatgcagctccttaatttgactaaayactgctcatcttctcatcagaatggctgtactcatctgaacttcctttgtcagtactctaattgtcctgcaactcctaaatggacttcaacactggacat

SEQ ID NO: 17782 - DNA, 201 bp, Homo sapiens
ggaattctcttagcattagacagtgaacttccatgcagatgaccacatctaattcattattattattgttattcatgctggacctcaggtacaaaaggttragaacttctcagttcattatatgatcatcattggtgcctccgagctctctctctctcccttgatttatttggtcccttttatctccagtccttactccca

SEQ ID NO: 17783 - DNA, 201 bp, Homo sapiens
tagatagcacattcattcttaattatcagcagaatatttttgtaaaatattgacaacataacataaaacatgatttaaaatatagtgaccaaaaaacatcraagatcatctgactgtctgggatgggggtggggctcgggagaaggaacataatggaaaacatttgccgtcagaagaaggtgtaacttatctttttacatc

SEQ ID NO: 17784 - DNA, 201 bp, Homo sapiens
atctgtgcatcacagaggatctccagaagagtcttcagaggagtgaggttggggacctgcgggcctggaggagaaacccacactccttaggctggcatcarggctgtctgcaatctggcagttgattactgtgaaagaaaatgctgccatgtcactgattggtgcctctacaaagtcttagtaacagtttttgccaattgc

SEQ ID NO: 17785 - DNA, 201 bp, Homo sapiens
cctaaattcctctcctgagaccacccataatccacaaatatctatgtattatttctccttagatgactttcaggtcttctaagtgcaatagccccacagtraactcagtatcttctcccggtcaggctgtcttccctgagagaagtggcttttgccctgttttctgaatgcctacattgaagccatctgttccccaggaag

SEQ ID NO: 17786 - DNA, 201 bp, Homo sapiens
agtctatgttccctctggccctcataataataacagcaataacagccagaatttatgagactcctgcatagtttctttccccatttacatctcacaggaaycttcaatgaagataatattccattcatttagaaattattccttttatttagaaattattttgaaaaaactgaagctcaaaaagatgaataagttttccaa

SEQ ID NO: 17787 - DNA, 201 bp, Homo sapiens
gagtctccgaggagctggggccatcaagggtgagtgctcaggaggacgcaggagcgtcggggtgagtgatggggtggttcacatcaattgctgcttcaggratcacagattttaggggctcattgatctatctggtcctcatagtctatgttccctctggccctcataataataacagcaataacagccagaatttatgag

SEQ ID NO: 17788 - DNA, 201 bp, Homo sapiens
cctagagaacagctcatcaagaggaatgtctcaaattagtcttctaggtccctaatcactcagttctttcctttctacttcctggagaacacaaatacccyaacatggcgctgggccaggtaaaagtacagtcttgaactgacacacaacccttactccctattgtatttttgccttgttttcagactgatccacattgtc

SEQ ID NO: 17789 - DNA, 201 bp, Homo sapiens
ctttcctgctgagtctccgaggagctggggccatcaagggtgagtgctcaggaggacgcaggagcgtcggggtgagtgatggggtggttcacatcaattgytgcttcagggatcacagattttaggggctcattgatctatctggtcctcatagtctatgttccctctggccctcataataataacagcaataacagccag

SEQ ID NO: 17790 - DNA, 201 bp, Homo sapiens
aaatatgaaggcaaagacaggtaaaaagtaaaagaatgggaaaatacatgtataccgtggaatgctatgcagccataaaaaaatgagttcatgttgtttgyggggacatggatgaagctggaagccatccttcacagcaaactaacacaggaacagaaaaccaaacaccacacgttctcactcgtaagtgggagttcaaca

SEQ ID NO: 17791 - DNA, 201 bp, Homo sapiens
ccttccttccttccttccttccttccttccttccttttttttgagacataatctcgctctttctttctttcattctttctttttgttgagatggagtgtcrctctgttgccaagtctggaatgcagtggcgcaatattggctcactgcaacctccacctccgggcttcaaccaattctccttcctcagcctcccgaatagc

SEQ ID NO: 17792 - DNA, 201 bp, Homo sapiens
ggccagccgccccatccgggagggaggtgggggggtcagccccccgcccggccagccaccccatccgggaagtgaggggcgcctctgcccggccgcccctwctgggaagtgaagagcccctctgcccagccagccgccccgtccgggagggaggtggggggtcagccccctgccccgccagccgccccgtccgggagggag

SEQ ID NO: 17793 - DNA, 201 bp, Homo sapiens
ggcccgcccctactgggaagtgaggagcccctctgcccggccagccgccccatccgggagggaggtgggggagtcagtcccccgcccggccagccgccccrtccgggagggaggtgggggggtcagccccccgcccggccagccaccccatccgggaagtgaggggcgcctctgcccggccgcccctactgggaagtgaag

SEQ ID NO: 17794 - DNA, 201 bp, Homo sapiens
cttcgatatttccagcagctacaaggtgaatgtactgagaccgacaggacagcaagaaggcatttgcacatttatatctgacaccagaccacactttcagycaccagaatatcttctctccatattttaaaaaatagtgtctctccctctccctctccccacggtctccctctccctctccctctccctctccccacggtc

SEQ ID NO: 17795 - DNA, 201 bp, Homo sapiens
aagttcacaggaggaagccaaagctccaaggccttcctgtcccatccttgagaaatcctcttactgcacacacctcacctctctccatccctttacacccmgacttcctgaaggaaaaagacgaatgaactgagacactgccctgtgacagccgtggggaacccaagacaagtaaaatccatctcagccccgaggaggatg

SEQ ID NO: 17796 - DNA, 201 bp, Homo sapiens
acttatctggctacatgggaacctctagggagctgattacaagcagagatccccagacctccccacccagggaatctgagtctgggggcactgagtctggrgatctgtgcatcacagaggatctccagaagagtcttcagaggagtgaggttggggacctgcgggcctggaggagaaacccacactccttaggctggcatc

SEQ ID NO: 17797 - DNA, 201 bp, Homo sapiens
cacaaccatcccaggccatcaccaccctcactgcacctcctgaccctatctcttcattcttcccccagaggcccaagagccaatccagatgcctgagacarcggagactgtgctctgtgccctgggcctggtgctgggcctagtcggcatcatcgtgggcaccgtcctcatcataaagtctctgcgttctggccatgaccc

SEQ ID NO: 17798 - DNA, 201 bp, Homo sapiens
tttgtcgtgtttttctctactgtctttatgcagcggaccatgtgtcaacttatgccgcgtttgtacagacgcatagaccaacaggggagtttatgtttgartttgatgaagatgagatgttctatgtggatctggacaagaaggagaccgtctggcatctggaggagtttggccaagccttttcctttgaggctcagggcg

SEQ ID NO: 17799 - DNA, 201 bp, Homo sapiens
tttttctctactgtctttatgcagcggaccatgtgtcaacttatgccgcgtttgtacagacgcatagaccaacaggggagtttatgtttgaatttgatgahgatgagatgttctatgtggatctggacaagaaggagaccgtctggcatctggaggagtttggccaagccttttcctttgaggctcagggcgggctggcta

SEQ ID NO: 17800 - DNA, 201 bp, Homo sapiens
cataaaaaaatgagttcatgttgtttgtggggacatggatgaagctggaagccatccttcacagcaaactaacacaggaacagaaaaccaaacaccacacrttctcactcgtaagtgggagttcaacaattagaacacatggacacagggaggggaacacctcacaccagggtctgtcagggcatggggagcaaggggagg

SEQ ID NO: 17801 - DNA, 201 bp, Homo sapiens
tgaagagagctttacatgtcttattctgtaaaaaacctatgtatttttttacctcacctacaaaaactcaaaatcttcatatttacagaatatcctgagcycctacatgcttgagtagtagaaatcccgtcctttttcaagttcctcctctgtgctgcgtcttcaggtcccatgaaggtctcacagatgaccaggtgttgc

SEQ ID NO: 17802 - DNA, 201 bp, Homo sapiens
ctaccttttcaaagttctatcttgatacaaaggaagcaaaatttactcaaataatatcttgaaattaagatatacagacaatggcattatggtggcctgtkaatctaataacttcatgaaaatacaaagaaaatgaagagagctttacatgtcttattctgtaaaaaacctatgtatttttttacctcacctacaaaaact

SEQ ID NO: 17803 - DNA, 201 bp, Homo sapiens
ttctttctttcattctttctttttgttgagatggagtgtcactctgttgccaagtctggaatgcagtggcgcaatattggctcactgcaacctccacctchgggcttcaaccaattctccttcctcagcctcccgaatagctgggattataggtgcctgccacttcacctggctaatttttgtattattagtagagacaag

SEQ ID NO: 17804 - DNA, 201 bp, Homo sapiens
acatttgtaatgaaatactaattttaaaagtccatgacaccttgatagaaattagagtttacacaaacaaaaaaggaaccttcgatatttccagcagctayaaggtgaatgtactgagaccgacaggacagcaagaaggcatttgcacatttatatctgacaccagaccacactttcagccaccagaatatcttctctcca

SEQ ID NO: 17805 - DNA, 201 bp, Homo sapiens
tgttcttgggcacactggggaaattaaggtgctgtgattgttctgctcatctgtttcatgctccacaaattaacttctccagtttattaacctcacccctwgcagaagttgcacagctggtggcagaggatagtggagatggggtagggctgggctcaagggcaccatggagtccacctttagtctccagtgtcattgcta

SEQ ID NO: 17806 - DNA, 201 bp, Homo sapiens
ccacatcttaacagaatacaaaagaaaaattatgtaattatgtaaatggatgcagaaaaaggcatttgctcattcatgataaaaagtcctagaaaactaggaataaaaaggaattacctgataaggtgtgtccatgaaaaccaacaactgaaattttcaattttgggtgggggaggggggcgggcattttactttctccat

SEQ ID NO: 17807 - DNA, 201 bp, Homo sapiens
caattgctgcttcagggatcacagattttaggggctcattgatctatctggtcctcatagtctatgttccctctggccctcataataataacagcaataayagccagaatttatgagactcctgcatagtttctttccccatttacatctcacaggaatcttcaatgaagataatattccattcatttagaaattattcct

SEQ ID NO: 17808 - DNA, 201 bp, Homo sapiens
aaggatgatataacatgatcataaaagtttatgccaggaatggaaggcatgtttaacatgcaaaaaatcaatgtgattccacatcttaacagaatacaaaagaaaaattatgtaattatgtaaatggatgcagaaaaaggcatttgctcattcatgataaaaagtcctagaaaactaggaataaaaaggaattacctgata

SEQ ID NO: 17809 - DNA, 201 bp, Homo sapiens
ccgtccctggaaaaggtaattctctgcggggagggggcggacatgagcggaggcgccactctcatctaatcctctttctccctctctctctcaatattaasgattcttcccaaatcttcccacccagggctggattttaaaataggagttttcctagtaccgagttctgtggtcctaagcgggtcgcagagcctctccagg

SEQ ID NO: 17810 - DNA, 201 bp, Homo sapiens
cactaaggtcccttaggccaacccggctgctcctgcgccctgggcacgggcccgcggggctgccctgggaccgccggcccaaagccctcactcacctcggygctgcagggtcatgggcccgcccagctcgtagttgtgtctgcacatcctgtccggcactgcccgcttctcctccaggatgtccttctggctgttccagta

SEQ ID NO: 17811 - DNA, 201 bp, Homo sapiens
agatgtgagcagcaccatcagtaacgccgtcagagccactgtccggggggccgcagaaacctgcagaaccatcatggagctggaaaaggatggcaaaatgraaagagctgcagtcaggaaaagaaggactcgctaaagggagctcctgtttgaaatattagagaccatgaacccaagtagtcttctgtgaccctgggattg

SEQ ID NO: 17812 - DNA, 201 bp, Homo sapiens
acatgctgttcttcctagggagtgccatgagcagtgtctggcaggtgtgtgtctacacagaattatcagtgacacggcacatgtttgtttctgtttgagtrtcttcaggcctgctctgttcttgggcacactggggaaattaaggtgctgtgattgttctgctcatctgtttcatgctccacaaattaacttctccagttt

SEQ ID NO: 17813 - DNA, 201 bp, Homo sapiens
gcactaaggtcccttaggccaacccggctgctcctgcgccctgggcacgggcccgcggggctgccctgggaccgccggcccaaagccctcactcacctcgrcgctgcagggtcatgggcccgcccagctcgtagttgtgtctgcacatcctgtccggcactgcccgcttctcctccaggatgtccttctggctgttccagt

SEQ ID NO: 17814 - DNA, 201 bp, Homo sapiens
tcgctgtcgaagcgcgcgaactcctcccggttgtagatgtatctctccaggaagcgctgtgtcccattaaacgcgtagcattcctgccgtccctggaaaasgtaattctctgcggggagggggcggacatgagcggaggcgccactctcatctaatcctctttctccctctctctctcaatattaacgattcttcccaaat

SEQ ID NO: 17815 - DNA, 201 bp, Homo sapiens
ttattagtagagacaaggtttctccatgttggtcagcctggttctctaggagcacttgaccaacgcctgacctcaagtgatccacccgctcggcctctcawagggctgggattacgggcctgagccactgcatctgcccagattattatttcttaggcatgttcactatgtaattgattcctagatgttgaaaataggaat

SEQ ID NO: 17816 - DNA, 201 bp, Homo sapiens
cgtcgctgtcgaagcgcgcgaactcctcccggttgtagatgtatctctccaggaagcgctgtgtcccattaaacgcgtagcattcctgccgtccctggaamaggtaattctctgcggggagggggcggacatgagcggaggcgccactctcatctaatcctctttctccctctctctctcaatattaacgattcttcccaa

SEQ ID NO: 17817 - DNA, 201 bp, Homo sapiens
cacgtcgctgtcgaagcgcgcgaactcctcccggttgtagatgtatctctccaggaagcgctgtgtcccattaaacgcgtagcattcctgccgtccctggwaaaggtaattctctgcggggagggggcggacatgagcggaggcgccactctcatctaatcctctttctccctctctctctcaatattaacgattcttccc

SEQ ID NO: 17818 - DNA, 201 bp, Homo sapiens
tcccccacgtcgctgtcgaagcgcgcgaactcctcccggttgtagatgtatctctccaggaagcgctgtgtcccattaaacgcgtagcattcctgccgtcmctggaaaaggtaattctctgcggggagggggcggacatgagcggaggcgccactctcatctaatcctctttctccctctctctctcaatattaacgattc

SEQ ID NO: 17819 - DNA, 201 bp, Homo sapiens
ttcagtgttctgacaatacttatctggctacatgggaacctctagggagctgattacaagcagagatccccagacctccccacccagggaatctgagtctsggggcactgagtctggagatctgtgcatcacagaggatctccagaagagtcttcagaggagtgaggttggggacctgcgggcctggaggagaaacccaca

SEQ ID NO: 17820 - DNA, 201 bp, Homo sapiens
atggcagggagacagagtttgcactctgtagcacatttaggagaaattttaaccaaaagtaatttgggcaaagaatatttgatcaactgtgaaattacctrccttttcaaagttctatcttgatacaaaggaagcaaaatttactcaaataatatcttgaaattaagatatacagacaatggcattatggtggcctgtgaa

SEQ ID NO: 17821 - DNA, 201 bp, Homo sapiens
cctcccccttccacctctcccttgcctctgtgttttccctgttctaactcatgccttgattgcaatttccctgacaaataatagcagtttcctacctcatytccctgcctctggtccctcctctagccagcacccttagtagtcttctgaagacacatctccaaccttctctttttcatttttcaaaaatcttcagtgttc

SEQ ID NO: 17822 - DNA, 201 bp, Homo sapiens
cttgttttcagactgatccacattgtcagcctcttccctcaatgtgagtttatttcaggggcacctgtgtctcactacttcattacctcggttaactcaaygtccattacactattcaacttatgtctaaatctcagttgtgaattacctacaatttcttccccatagagcttctgggaaccatgaaatcagggggaatac

SEQ ID NO: 17823 - DNA, 201 bp, Homo sapiens
cttttcttttggatctctgccaccagtacctttttcctcctcagaaagcagaaaaggccaggcatggtggtcatgcctataatcttagcactttgggaggytgaggcatgaggatcacttgagcccagggttttgagaccggcctgggcaacatagtgagaacccatctctaaaaagaaaaataaattagccagacatggt

SEQ ID NO: 17824 - DNA, 201 bp, Homo sapiens
accatggagtccacctttagtctccagtgtcattgctaaggcaagatcccaggtcttgactcagatatcctgacctgcctcttctcctggtgccttgggcsccagaccctaaaattccaggcccagagccccccagctccttgagtccagattcctcctcctctgccatccatccgcccctgcctgttcaattgccccact

SEQ ID NO: 17825 - DNA, 201 bp, Homo sapiens
atagaccttcaagtagagcatgcatgatcttgaataaaataatagttagtaagtatatagcggaatggcagggagacagagtttgcactctgtagcacatwtaggagaaattttaaccaaaagtaatttgggcaaagaatatttgatcaactgtgaaattacctaccttttcaaagttctatcttgatacaaaggaagcaa

SEQ ID NO: 17826 - DNA, 201 bp, Homo sapiens
ctactgtctttatgcagcggaccatgtgtcaacttatgccgcgtttgtacagacgcatagaccaacaggggagtttatgtttgaatttgatgaagatgagmtgttctatgtggatctggacaagaaggagaccgtctggcatctggaggagtttggccaagccttttcctttgaggctcagggcgggctggctaacattgc

SEQ ID NO: 17827 - DNA, 201 bp, Homo sapiens
gggacatggatgaagctggaagccatccttcacagcaaactaacacaggaacagaaaaccaaacaccacacgttctcactcgtaagtgggagttcaacaaytagaacacatggacacagggaggggaacacctcacaccagggtctgtcagggcatggggagcaaggggagggagagcattaggacacataccgaatgtat

SEQ ID NO: 17828 - DNA, 201 bp, Homo sapiens
cacctggatttaaaaagagtcagaaggaaaattagaaaatattttgaactgagtgaatatgaaagcacactatcaaaattagtatgatacactaattagasaataatttataactttacataattggaaaggagggaaactctaaaatcaaccatctatgttcccatcttaagaagctagaaaaaaaaagtcaaatgaatc

SEQ ID NO: 17829 - DNA, 201 bp, Homo sapiens
ttccatatcagagctgtgatcttgagagccctctccttggctttcctgctgagtctccgaggagctggggccatcaagggtgagtgctcaggaggacgcargagcgtcggggtgagtgatggggtggttcacatcaattgctgcttcagggatcacagattttaggggctcattgatctatctggtcctcatagtctatgt

SEQ ID NO: 17830 - DNA, 201 bp, Homo sapiens
ccctcctctagccagcacccttagtagtcttctgaagacacatctccaaccttctctttttcatttttcaaaaatcttcagtgttctgacaatacttatcyggctacatgggaacctctagggagctgattacaagcagagatccccagacctccccacccagggaatctgagtctgggggcactgagtctggagatctgt

SEQ ID NO: 17831 - DNA, 201 bp, Homo sapiens
aaaaataaagtccatagagaatataaattgactggtaaataaggaagaaagtgaaaaaaaatcatcaaagaccccacctccttcaaagcatctgattctaytttgtttagagtgaatatttttacaaactttcaaagaacattacttcttactttagacacttataaatgtgatcctgttggaccaccaattctaatttca

SEQ ID NO: 17832 - DNA, 201 bp, Homo sapiens
ctccacatcctctccagcacctgttgtttcctgactttttaatgatcgccattttaactggtgtgagatggtatctcaagacagtgtggcaattcctcaargatctagaactagaaataccatttgacccagccatcccattactggatatatacccaaaggattataaatcatgctgctataaagacacatgcacacata

SEQ ID NO: 17833 - DNA, 201 bp, Homo sapiens
gacctcaagtgatccacccgctcggcctctcaaagggctgggattacgggcctgagccactgcatctgcccagattattatttcttaggcatgttcactaygtaattgattcctagatgttgaaaataggaataatgtgattaggctagtgggtaagggtagcattgaaaagatagaaatagaccttcaagtagagcatgc

SEQ ID NO: 17834 - DNA, 201 bp, Homo sapiens
agttagtatgaaaggtctgaaaatataaagcctgtgatgcacttaagatgacggaggaaagacagtgatactcattttaaccagtcagataagtcatgatrtttggggagattatgcgttttctttgctctgaaggtgatctcaaatattctgctggcccatctacagggattatcatttccccaattctgccacacctca

SEQ ID NO: 17835 - DNA, 201 bp, Homo sapiens
tgcctgagtcccctccaggctggatgcagacatgaacacgcccaggagcctgcacttgccaacttctctctctgcaaaccttgtctgtccaaggttatccwggacctcttggtcccattttccccaaagacaagcactgaccactgggcacctctctctgtttactgtacccatgtccttggagagagaataggccagtag

SEQ ID NO: 17836 - DNA, 201 bp, Homo sapiens
ctggattaagaaaatgcacacatatacaccatggaatactgtgcagccataaaaaaggatgagttcatgtcctttgtagggacatggaggaagctggaaaycatcattcacagcaaactattgcaaggacaaaaaaccaaagaccacatgttctcactcataggtgggaactgaacaatgagaacacatggacacaggaag

SEQ ID NO: 17837 - DNA, 201 bp, Homo sapiens
ctcccccacgtcgctgtcgaagcgcgcgaactcctcccggttgtagatgtatctctccaggaagcgctgtgtcccattaaacgcgtagcattcctgccgtmcctggaaaaggtaattctctgcggggagggggcggacatgagcggaggcgccactctcatctaatcctctttctccctctctctctcaatattaacgatt

SEQ ID NO: 17838 - DNA, 201 bp, Homo sapiens
cagccaccccatccgggaagtgaggggcgcctctgcccggccgcccctactgggaagtgaagagcccctctgcccagccagccgccccgtccgggagggargtggggggtcagccccctgccccgccagccgccccgtccgggagggaggtgggggggtcagccccccgcccggccagccaccccatccgggaagtgaggg

SEQ ID NO: 17839 - DNA, 201 bp, Homo sapiens
ttttttaagtacatttaacttttgaaatggaattttacctgccaagtagacataagcaatgaggggttttatggtgtaatttgaaaccttcatttttttttgtatataagaaactttatcctgtttgtggaacccttagcaattgagttgcccagagcacggtttgaaaccactgatctgaatgaattcgtctcttattca

SEQ ID NO: 17840 - DNA, 201 bp, Homo sapiens
atcacatggtcatagagggagaaagagacatagaaagaggtgccagcctctttttaacaaccaggtttcatgtgcactaatagagtgagaactcactcatyacccggagaggggacaaagccattcatgagggtctcctccatgattcaaatacctcccaccaggccccacctgcaacactggggatcaattttcaacatg

SEQ ID NO: 17841 - DNA, 201 bp, Homo sapiens; identical to SEQ ID NO: 1839

SEQ ID NO: 17842 - DNA, 201 bp, Homo sapiens
ctcctccaggatgtccttctggctgttccagtactccgcagcaggccgccccagctccgtcaccgcccggaactcccccacgtcgctgtcgaagcgcgcgwactcctcccggttgtagatgtatctctccaggaagcgctgtgtcccattaaacgcgtagcattcctgccgtccctggaaaaggtaattctctgcggggag

SEQ ID NO: 17843 - DNA, 201 bp, Homo sapiens
agatctagaactagaaataccatttgacccagccatcccattactggatatatacccaaaggattataaatcatgctgctataaagacacatgcacacatrtgtttattgcggcactattcacaatagcaaagacttggaaccaacccaactgtccatcagtgatagactggattaagaaaatgcacacatatacaccatg

SEQ ID NO: 17844 - DNA, 201 bp, Homo sapiens
agtgaccaaaaaacatcaaagatcatctgactgtctgggatgggggtggggctcgggagaaggaacataatggaaaacatttgccgtcagaagaaggtgtracttatctttttacatctctttctctaactctgaaaatgaactgtgaactggagctctcttgaccacgctggtacctaaaattctcccatctcttcccca

SEQ ID NO: 17845 - DNA, 201 bp, Homo sapiens
cttctcctccaggatgtccttctggctgttccagtactccgcagcaggccgccccagctccgtcaccgcccggaactcccccacgtcgctgtcgaagcgcrcgaactcctcccggttgtagatgtatctctccaggaagcgctgtgtcccattaaacgcgtagcattcctgccgtccctggaaaaggtaattctctgcggg

SEQ ID NO: 17846 - DNA, 201 bp, Homo sapiens
tttggatctctgccaccagtacctttttcctcctcagaaagcagaaaaggccaggcatggtggtcatgcctataatcttagcactttgggaggttgaggcrtgaggatcacttgagcccagggttttgagaccggcctgggcaacatagtgagaacccatctctaaaaagaaaaataaattagccagacatggtggtacgt

SEQ ID NO: 17847 - DNA, 201 bp, Homo sapiens
cagggtcatgggcccgcccagctcgtagttgtgtctgcacatcctgtccggcactgcccgcttctcctccaggatgtccttctggctgttccagtactcckcagcaggccgccccagctccgtcaccgcccggaactcccccacgtcgctgtcgaagcgcgcgaactcctcccggttgtagatgtatctctccaggaagcg

SEQ ID NO: 17848 - DNA, 201 bp, Homo sapiens
gctgcagggtcatgggcccgcccagctcgtagttgtgtctgcacatcctgtccggcactgcccgcttctcctccaggatgtccttctggctgttccagtastccgcagcaggccgccccagctccgtcaccgcccggaactcccccacgtcgctgtcgaagcgcgcgaactcctcccggttgtagatgtatctctccagga

SEQ ID NO: 17849 - DNA, 201 bp, Homo sapiens
caaagccctcactcacctcggcgctgcagggtcatgggcccgcccagctcgtagttgtgtctgcacatcctgtccggcactgcccgcttctcctccaggadgtccttctggctgttccagtactccgcagcaggccgccccagctccgtcaccgcccggaactcccccacgtcgctgtcgaagcgcgcgaactcctcccgg

SEQ ID NO: 17850 - DNA, 201 bp, Homo sapiens
tcagagctgtgatcttgagagccctctccttggctttcctgctgagtctccgaggagctggggccatcaagggtgagtgctcaggaggacgcaggagcgtyggggtgagtgatggggtggttcacatcaattgctgcttcagggatcacagattttaggggctcattgatctatctggtcctcatagtctatgttccctct

SEQ ID NO: 17851 - DNA, 201 bp, Homo sapiens
ccatcggacttgaatgctgcctgggtagaaatccgtcacgtggcagacaagcaggttgtggtgctgcaagggccccttcttggagggggaaacattcaccytaggctggactaggagcgtggaagaaaaataatgaaatagaatttgagattgtccttctttccttccttccttccttccttccttccttccttccttcct

SEQ ID NO: 17852 - DNA, 201 bp, Homo sapiens
aggccaacccggctgctcctgcgccctgggcacgggcccgcggggctgccctgggaccgccggcccaaagccctcactcacctcggcgctgcagggtcatsggcccgcccagctcgtagttgtgtctgcacatcctgtccggcactgcccgcttctcctccaggatgtccttctggctgttccagtactccgcagcaggcc

SEQ ID NO: 17853 - DNA, 201 bp, Homo sapiens
ataatgccaaccatggaagtattggtggctgtgttaatatcagaaatataagactcagaaatattaccaaggagaaagaaggatagttcataatgataaarggatcattttattatcaacatataacaatcctaaatgtgtttgttcttagaaaatatgtcttaaatcacattataccaaaaatgataaaaataaatcaga

SEQ ID NO: 17854 - DNA, 201 bp, Homo sapiens
tactgtctttatgcagcggaccatgtgtcaacttatgccgcgtttgtacagacgcatagaccaacaggggagtttatgtttgaatttgatgaagatgagawgttctatgtggatctggacaagaaggagaccgtctggcatctggaggagtttggccaagccttttcctttgaggctcagggcgggctggctaacattgct

SEQ ID NO: 17855 - DNA, 201 bp, Homo sapiens
tgagttcatgttgtttgtggggacatggatgaagctggaagccatccttcacagcaaactaacacaggaacagaaaaccaaacaccacacgttctcactcrtaagtgggagttcaacaattagaacacatggacacagggaggggaacacctcacaccagggtctgtcagggcatggggagcaaggggagggagagcatta

SEQ ID NO: 17856 - DNA, 201 bp, Homo sapiens
ctaccctgtccttatttttctcctgtttacctggatcctccttatcatcttttaaaccacctcttaactatcatgttctctcattataccctgagatctcrgcaattctgatttttggcactcttcctggaaaatcttatttaacctgcacctgccactaatgactctcagttctatggcctaaattcctctcctgagacc

SEQ ID NO: 17857 - DNA, 201 bp, Homo sapiens; identical to SEQ ID NO: 1762

SEQ ID NO: 17858 - DNA, 201 bp, Homo sapiens
tggcagggagacagagtttgcactctgtagcacatttaggagaaattttaaccaaaagtaatttgggcaaagaatatttgatcaactgtgaaattacctaycttttcaaagttctatcttgatacaaaggaagcaaaatttactcaaataatatcttgaaattaagatatacagacaatggcattatggtggcctgtgaat

SEQ ID NO: 17859 - DNA, 201 bp, Homo sapiens
tcaatcccacatcctgatactactccctcaagtccctcaggttggtgcaccaggctccccaccccacaagttcacaggaggaagccaaagctccaaggccytcctgtcccatccttgagaaatcctcttactgcacacacctcacctctctccatccctttacacccagacttcctgaaggaaaaagacgaatgaactgag

SEQ ID NO: 17860 - DNA, 201 bp, Homo sapiens
gaacctctagggagctgattacaagcagagatccccagacctccccacccagggaatctgagtctgggggcactgagtctggagatctgtgcatcacagakgatctccagaagagtcttcagaggagtgaggttggggacctgcgggcctggaggagaaacccacactccttaggctggcatcagggctgtctgcaatctg

SEQ ID NO: 17861 - DNA, 201 bp, Homo sapiens
cctatgtgtgaggtcagttcctaagtgtgagggtttcgagaccagtcagtgtccctagattctctgacaagggggagaactatgaatcttcaggaaccccyaagccaaggtcaggaagtctccatttccctggcttcaaactatgctcaggagctggtatagaagaaagatggggtttggacatggccccagggtatagat

SEQ ID NO: 17862 - DNA, 201 bp, Homo sapiens
atttgtgccccagcttgtcctgttgttctcaggtgaatttccacactgccactggcaacttttcttttggatctctgccaccagtacctttttcctcctcrgaaagcagaaaaggccaggcatggtggtcatgcctataatcttagcactttgggaggttgaggcatgaggatcacttgagcccagggttttgagaccggc

SEQ ID NO: 17863 - DNA, 201 bp, Homo sapiens
aatctgataagtgttcattgatcttctaatgggttaaaagcattcagccacataacaacaacaacaccgataactaactgagtagttaatatggtcaggcrctattctgaggatttacatttattaactcactttattctcacacatagtctttgaggtaggtactattattttcactatttcacatgagagatacttaca

SEQ ID NO: 17864 - DNA, 201 bp, Homo sapiens
gccattttaactggtgtgagatggtatctcaagacagtgtggcaattcctcaaagatctagaactagaaataccatttgacccagccatcccattactggrtatatacccaaaggattataaatcatgctgctataaagacacatgcacacatatgtttattgcggcactattcacaatagcaaagacttggaaccaaccc

SEQ ID NO: 17865 - DNA, 201 bp, Homo sapiens
ctcacacatagtctttgaggtaggtactattattttcactatttcacatgagagatacttacatctttttacatacacagagactttaagcactttgatcmagttcccacagctatgaagtagtagggctagcttccaatccagaaagtctggatccaagactgtttatccactgtcctattcaccctattttgtgaagga

SEQ ID NO: 17866 - DNA, 201 bp, Homo sapiens
aactagaaataccatttgacccagccatcccattactggatatatacccaaaggattataaatcatgctgctataaagacacatgcacacatatgtttatwgcggcactattcacaatagcaaagacttggaaccaacccaactgtccatcagtgatagactggattaagaaaatgcacacatatacaccatggaatactg

SEQ ID NO: 17867 - DNA, 201 bp, Homo sapiens
caatccagaaagtctggatccaagactgtttatccactgtcctattcaccctattttgtgaaggaaaagaccaagttcaaattctccagagtccattgccwaataatggagtcagatctatatttctatacataattacaacacagtgtggtgggtgcctgtaactacttactgtctctacttggactcattccatggcaa

SEQ ID NO: 17868 - DNA, 201 bp, Homo sapiens
tctccctctccctctccctctccccacggtctccctctccctctctttccacagtctccctctgatgccgagccgaagctggacgatactgctgccatcasggctcactgcaacctccctgcctgattctcctgcctcagcttgccgagtgcctgcgattgcaggcgcgcgccgccacacctgactggttttcgtattttt

SEQ ID NO: 17869 - DNA, 201 bp, Homo sapiens
ggaccgccggcccaaagccctcactcacctcggcgctgcagggtcatgggcccgcccagctcgtagttgtgtctgcacatcctgtccggcactgcccgctyctcctccaggatgtccttctggctgttccagtactccgcagcaggccgccccagctccgtcaccgcccggaactcccccacgtcgctgtcgaagcgcgcg

SEQ ID NO: 17870 - DNA, 201 bp, Homo sapiens
gaggattgtggagaaaaactcagtttttttagtaactgcctgggtgggacttttctccttgtcatttacctgccatagataattagacaaatacttcctcratgtctcaggtaatttatttttacagtagacattaataatacctccctcaggtttaatatgaggtttaaatgaggtaatgcatgcaaagcactaataaca

SEQ ID NO: 17871 - DNA, 201 bp, Homo sapiens
acctcacctacaaaaactcaaaatcttcatatttacagaatatcctgagctcctacatgcttgagtagtagaaatcccgtcctttttcaagttcctcctcwgtgctgcgtcttcaggtcccatgaaggtctcacagatgaccaggtgttgcctccctctgcatctttgcatttgtgccccagcttgtcctgttgttctcag

SEQ ID NO: 17872 - DNA, 201 bp, Homo sapiens
ccaagttctggggaggctgggagaagtacctttaatgagaatgccttcaggggctaaaacctatccccctccctcccttctctccttaattgtccaagggrtgtgggctcctgctccaccctggggaataagaggcattcttcgtgagcactgaatcctcagtgatcctcagagcctggacactccagcttagggctctct

SEQ ID NO: 17873 - DNA, 201 bp, Homo sapiens
cgggcccgcggggctgccctgggaccgccggcccaaagccctcactcacctcggcgctgcagggtcatgggcccgcccagctcgtagttgtgtctgcacaycctgtccggcactgcccgcttctcctccaggatgtccttctggctgttccagtactccgcagcaggccgccccagctccgtcaccgcccggaactccccc

SEQ ID NO: 17874 - DNA, 201 bp, Homo sapiens
cacgggcccgcggggctgccctgggaccgccggcccaaagccctcactcacctcggcgctgcagggtcatgggcccgcccagctcgtagttgtgtctgcayatcctgtccggcactgcccgcttctcctccaggatgtccttctggctgttccagtactccgcagcaggccgccccagctccgtcaccgcccggaactccc

SEQ ID NO: 17875 - DNA, 201 bp, Homo sapiens
ctgcccggccagccgccccatccgggagggaggtgggggagtcagtcccccgcccggccagccgccccatccgggagggaggtgggggggtcagccccccrcccggccagccaccccatccgggaagtgaggggcgcctctgcccggccgcccctactgggaagtgaagagcccctctgcccagccagccgccccgtccgg

SEQ ID NO: 17876 - DNA, 201 bp, Homo sapiens
atgtatgcatggcttaaaacctagatgatgggttgatagatgcagcaaaccacatggcacatgtataactatgtaacaaacctgcacattctgcacatgtrtcccagaacttaaagtaaaaaaaaaaaaaacgaaaataatgccaaccatggaagtattggtggctgtgttaatatcagaaatataagactcagaaatatt

SEQ ID NO: 17877 - DNA, 201 bp, Homo sapiens
tttactttctcccagaggtctgtgagtcctgcgatgtgcaggagttaccaggttcttccacaggactgtcatcagggtcaggagggctcagtctagggacsttacactgggagcgtggacacaccacctaccctaccatgtaaatatgcagctttaacgacactgcctctcttggacttcgattccttgtcttcaatatgg

SEQ ID NO: 17878 - DNA, 201 bp, Homo sapiens
tcccaccaggccccacctgcaacactggggatcaattttcaacatgagacttggaagtgacaaatatccaaatcatattaatccacatatctacattgctsctgggatacctggatcattcctggttctctactattgcaagcaatgcttgtatctcacatggaactgcatatacatgtgggcctgacctgcatccctgga

SEQ ID NO: 17879 - DNA, 201 bp, Homo sapiens
gctacatgggaggctgaggcaggaggatcacttgagcccaggaggttgaggctgcagtgagccatgatggtgccacagcactccagcctgggagacaaagygagaacctgtctcaaaaacaaacacaaacacaaaacaaaaaacaaacacagaaaagggtcaagtgctcctagagaacagttcattcagggagatccacta

SEQ ID NO: 17880 - DNA, 201 bp, Homo sapiens
tctctgcgggcctctcctcacactgcacttgggtttttttggtctctttcacaggcttttctgtcttggccaaatcacaactgtccagttcccaggatccrgtcctttgctcttccccctgggtcccctctccctggatggtctcatgtatctcagtctcctccccggctgcagacccttctgtctacctgcccatcagac

SEQ ID NO: 17881 - DNA, 201 bp, Homo sapiens
ttggggacctgcgggcctggaggagaaacccacactccttaggctggcatcagggctgtctgcaatctggcagttgattactgtgaaagaaaatgctgccrtgtcactgattggtgcctctacaaagtcttagtaacagtttttgccaattgcgttatttttatttgaacacctctctcaaccaattacctcagcaacttt

SEQ ID NO: 17882 - DNA, 201 bp, Homo sapiens
ttccctgcccagtctcttaacatttaaacatgtcatttaccttaaaaacataagtgcaaaccaactgataaaaaacaaccttgccttcagtctgcatcctrtcccagagacactttctttgtgtcctcacacgtggagctaagcttctgacttgtctctggtacatccctgaggatcctctcatcttggccatcaggaacc

SEQ ID NO: 17883 - DNA, 201 bp, Homo sapiens
taggggctcattgatctatctggtcctcatagtctatgttccctctggccctcataataataacagcaataacagccagaatttatgagactcctgcataktttctttccccatttacatctcacaggaatcttcaatgaagataatattccattcatttagaaattattccttttatttagaaattattttgaaaaaact

SEQ ID NO: 17884 - DNA, 201 bp, Homo sapiens
cctgacaaataatagcagtttcctacctcatctccctgcctctggtccctcctctagccagcacccttagtagtcttctgaagacacatctccaaccttckctttttcatttttcaaaaatcttcagtgttctgacaatacttatctggctacatgggaacctctagggagctgattacaagcagagatccccagacctcc

SEQ ID NO: 17885 - DNA, 201 bp, Homo sapiens
ctccccaattcatgaattgttctttgctaaataaactctgttaaattcaacttctctaaaatttttattttaacaacatgaaatagaaacatttcttgaaygattcaaattaccaaaactaaatcaagaagaaatctctgtcaatggaagaaattaagtttgtaattttaaaaatccttctcacagagaaggccaaatggt

SEQ ID NO: 17886 - DNA, 201 bp, Homo sapiens
ttccttccttccttccttccttccttccttccttccttccttccttttttttgagacataatctcgctctttctttctttcattctttctttttgttgagrtggagtgtcactctgttgccaagtctggaatgcagtggcgcaatattggctcactgcaacctccacctccgggcttcaaccaattctccttcctcagcct

SEQ ID NO: 17887 - DNA, 201 bp, Homo sapiens
aggatttgtagaatgtaaggaagggaggaaaaattcaatctgataagtgttcattgatcttctaatgggttaaaagcattcagccacataacaacaacaayaccgataactaactgagtagttaatatggtcaggcgctattctgaggatttacatttattaactcactttattctcacacatagtctttgaggtaggtac

SEQ ID NO: 17888 - DNA, 201 bp, Homo sapiens
gggttctgagggctccccaattcatgaattgttctttgctaaataaactctgttaaattcaacttctctaaaatttttattttaacaacatgaaatagaarcatttcttgaacgattcaaattaccaaaactaaatcaagaagaaatctctgtcaatggaagaaattaagtttgtaattttaaaaatccttctcacagaga

SEQ ID NO: 17889 - DNA, 201 bp, Homo sapiens
ggtggcaaatgctgattctggaagttgcctctcaaaatgcctgagaagaggctaaaatgctgaaggaagagaactgttcctatgtgtgaggtcagttcctragtgtgagggtttcgagaccagtcagtgtccctagattctctgacaagggggagaactatgaatcttcaggaacccctaagccaaggtcaggaagtctcc

SEQ ID NO: 17890 - DNA, 201 bp, Homo sapiens
ctgaatctttctgggttctgagggctccccaattcatgaattgttctttgctaaataaactctgttaaattcaacttctctaaaatttttattttaacaayatgaaatagaaacatttcttgaacgattcaaattaccaaaactaaatcaagaagaaatctctgtcaatggaagaaattaagtttgtaattttaaaaatcc

SEQ ID NO: 17891 - DNA, 201 bp, Homo sapiens
tatctataaacactgccttcacatgttgctggacagagctttctgaatctttctgggttctgagggctccccaattcatgaattgttctttgctaaataarctctgttaaattcaacttctctaaaatttttattttaacaacatgaaatagaaacatttcttgaacgattcaaattaccaaaactaaatcaagaagaaat

SEQ ID NO: 17892 - DNA, 201 bp, Homo sapiens
agcctaacttaagagtgttgtaataaatagctgagtctcagccaatcacaggctgccaagtgatcatattatgtcccccataaggcaaatgcctcatcacrccatgcccatataaggcaaacactgagctgtaataaattggctggttttgagtatcacttcctgtttttatctataaacactgccttcacatgttgctgg

SEQ ID NO: 17893 - DNA, 201 bp, Homo sapiens
tatgtggatctggacaagaaggagaccgtctggcatctggaggagtttggccaagccttttcctttgaggctcagggcgggctggctaacattgctatatygaacaacaacttgaataccttgatccagcgttccaaccacactcaggccaccaacggtacgccctatctttgcctcttcctctgtagcccaactggaagg

SEQ ID NO: 17894 - DNA, 201 bp, Homo sapiens
gtgtcattgctaaggcaagatcccaggtcttgactcagatatcctgacctgcctcttctcctggtgccttgggccccagaccctaaaattccaggcccagrgccccccagctccttgagtccagattcctcctcctctgccatccatccgcccctgcctgttcaattgccccactctgagtgtggattctcccattttcat

SEQ ID NO: 17895 - DNA, 201 bp, Homo sapiens
tccagtctccattacggatcaggttggtggacacgaccccagctgtttcctcctgtccattcaggaaccatcggacttgaatgctgcctgggtagaaatcygtcacgtggcagacaagcaggttgtggtgctgcaagggccccttcttggagggggaaacattcaccctaggctggactaggagcgtggaagaaaaataat

SEQ ID NO: 17896 - DNA, 201 bp, Homo sapiens
tgctcttcagaggtggggtctagagggtcatcagagactcactccactccacggtgacaggactatccaggctggtgtgctccacttggcaggtgtagacrtctccctgctggggggtcatttccagcatcaccaggatctggaaggtccagtctccattacggatcaggttggtggacacgaccccagctgtttcctcct

SEQ ID NO: 17897 - DNA, 201 bp, Homo sapiens
atgaagcatgtgggatggcctcacagtcagctggggtttgagggtgaaattcaatgactttcgtgaactccttggctcctatgtgctcttcacctggaggrccagggcatgtgcagggatgaccaccttctccctgggacctgaacagggcagagaaatgggaagctcgggtgcaaagggagtggggaagatgggtccggg

SEQ ID NO: 17898 - DNA, 201 bp, Homo sapiens
gagtcccctgctcttcagaggtggggtctagagggtcatcagagactcactccactccacggtgacaggactatccaggctggtgtgctccacttggcagrtgtagacatctccctgctggggggtcatttccagcatcaccaggatctggaaggtccagtctccattacggatcaggttggtggacacgaccccagctgt

SEQ ID NO: 17899 - DNA, 201 bp, Homo sapiens
gataagatgagtggaccccagagccagagagtcccctgctcttcagaggtggggtctagagggtcatcagagactcactccactccacggtgacaggactrtccaggctggtgtgctccacttggcaggtgtagacatctccctgctggggggtcatttccagcatcaccaggatctggaaggtccagtctccattacgga

SEQ ID NO: 17900 - DNA, 201 bp, Homo sapiens
ccagccgccccatccgggagggaggtgggggggtcagccccccgcccggccagccaccccatccgggaagtgaggggcgcctctgcccggccgcccctacygggaagtgaagagcccctctgcccagccagccgccccgtccgggagggaggtggggggtcagccccctgccccgccagccgccccgtccgggagggaggt

SEQ ID NO: 17901 - DNA, 201 bp, Homo sapiens
cctgaacagggcagagaaatgggaagctcgggtgcaaagggagtggggaagatgggtccgggcttacagtactgaacccaggaatgacaataactgtgtgygttgctgcaggtgacaaaatatctgaacagaagaggacttaggagagatctgaactccagctgccctacaaactccatctcagcttttcttctcacttca

SEQ ID NO: 17902 - DNA, 201 bp, Homo sapiens
atgatgggttgatagatgcagcaaaccacatggcacatgtataactatgtaacaaacctgcacattctgcacatgtatcccagaacttaaagtaaaaaaamaaaaaacgaaaataatgccaaccatggaagtattggtggctgtgttaatatcagaaatataagactcagaaatattaccaaggagaaagaaggatagttc

SEQ ID NO: 17903 - DNA, 201 bp, Homo sapiens
tttccaacaaatagaaattaatgacactttggtagcactaatatggagattatcctttcattgagccttttatcctctgttctcctttgaagaacccctcwctgtcaccttcccgagaataccctaagaccaataaatacttcagtatttcagagcggggagactctgagtcattcttactggaagtctaggaccaggtca

SEQ ID NO: 17904 - DNA, 201 bp, Homo sapiens
attcacagcccctgagcttccttcccaaggctgtattgtaattatagcaatatttcatggaggatttttctacatgataaactaagagccaagaaataaawtttttaaaatgccctaattcattgcaatttttaccagccatagtcactccatgtgggagaacttaaatcatgattaccagagctttcaaaggtttgagaa

SEQ ID NO: 17905 - DNA, 201 bp, Homo sapiens
actagggtgatgtaggggatgcacctggcttaggtgcaaaatttgggggataccaaaagaactcagtaataaatcatattttaatgaaatatcttgaaaargcaaaattaatgcaaagatacatgattaacaaaacatccaaagaggagtatttaacaaaaatggagaagcagagaagcagaagaattaggagaatatgct

SEQ ID NO: 17906 - DNA, 201 bp, Homo sapiens
ctgtgccctgggcctggtgctgggcctagtcggcatcatcgtgggcaccgtcctcatcataaagtctctgcgttctggccatgacccccgggcccaggggmccctgtgaaatactgtaaaggtgggaatgtaaagaggaggccctaggatttgtagaatgtaaggaagggaggaaaaattcaatctgataagtgttcattg

SEQ ID NO: 17907 - DNA, 201 bp, Homo sapiens
tgcatcacagaggatctccagaagagtcttcagaggagtgaggttggggacctgcgggcctggaggagaaacccacactccttaggctggcatcagggctstctgcaatctggcagttgattactgtgaaagaaaatgctgccatgtcactgattggtgcctctacaaagtcttagtaacagtttttgccaattgcgttat

SEQ ID NO: 17908 - DNA, 201 bp, Homo sapiens
ccaattaactggtccataaccttcaattcccacaaccatcccaggccatcaccaccctcactgcacctcctgaccctatctcttcattcttcccccagagscccaagagccaatccagatgcctgagacaacggagactgtgctctgtgccctgggcctggtgctgggcctagtcggcatcatcgtgggcaccgtcctcat

SEQ ID NO: 17909 - DNA, 201 bp, Homo sapiens
tccaattaactggtccataaccttcaattcccacaaccatcccaggccatcaccaccctcactgcacctcctgaccctatctcttcattcttcccccagakgcccaagagccaatccagatgcctgagacaacggagactgtgctctgtgccctgggcctggtgctgggcctagtcggcatcatcgtgggcaccgtcctca

SEQ ID NO: 17910 - DNA, 201 bp, Homo sapiens
gaacataatggaaaacatttgccgtcagaagaaggtgtaacttatctttttacatctctttctctaactctgaaaatgaactgtgaactggagctctcttraccacgctggtacctaaaattctcccatctcttccccagcaccttccagcgtcctctttacccagcaacagagaatgtcagctctatgatttctctgata

SEQ ID NO: 17911 - DNA, 201 bp, Homo sapiens
gtagaggaccaccctcccctaagaggtggagcctttgtgattcatcccagaagaggggcctaacctggtgctgtctccttccagatccccctgaggtgacsgtgtttcccaaggagcctgtggagctgggccagcccaacaccctcatctgccacattgacaagttcttcccaccagtgctcaacgtcacgtggctgtgca

SEQ ID NO: 17912 - DNA, 201 bp, Homo sapiens
gaatgagctcaggggcactgagtgatcactagggaggggcgagcactgaggggaaggcagtcccttctgctggtggctggaggaggcggagacgtttcacktggggtcactgggagaaaaaacaggggcgggaggagctggggacgtggagggcggagctgctccccctacttaactccctgactgacatttccatcctga

SEQ ID NO: 17913 - DNA, 201 bp, Homo sapiens
agaccgtctggcatctggaggagtttggccaagccttttcctttgaggctcagggcgggctggctaacattgctatattgaacaacaacttgaataccttkatccagcgttccaaccacactcaggccaccaacggtacgccctatctttgcctcttcctctgtagcccaactggaagggatgagagggcctctctgccac

SEQ ID NO: 17914 - DNA, 201 bp, Homo sapiens
ggaagccctcccttccttctttctcttttccatagctaagcgctctctcttctcgaccagtttcttgagaattcctcaacttgctcctgttgttttgcatktaggagatgtagaaatatatttcttaaaactttcttcaactttggtataagaaagactctgtagcctgaaagttaattttcaaacatggctgcagaaaga

SEQ ID NO: 17915 - DNA, 201 bp, Homo sapiens
gagaccgtctggcatctggaggagtttggccaagccttttcctttgaggctcagggcgggctggctaacattgctatattgaacaacaacttgaatacctygatccagcgttccaaccacactcaggccaccaacggtacgccctatctttgcctcttcctctgtagcccaactggaagggatgagagggcctctctgcca

SEQ ID NO: 17916 - DNA, 201 bp, Homo sapiens
cctcccttccttctttctcttttccatagctaagcgctctctcttctcgaccagtttcttgagaattcctcaacttgctcctgttgttttgcatgtaggaratgtagaaatatatttcttaaaactttcttcaactttggtataagaaagactctgtagcctgaaagttaattttcaaacatggctgcagaaagacttggt

SEQ ID NO: 17917 - DNA, 201 bp, Homo sapiens
ggagaccgtctggcatctggaggagtttggccaagccttttcctttgaggctcagggcgggctggctaacattgctatattgaacaacaacttgaataccktgatccagcgttccaaccacactcaggccaccaacggtacgccctatctttgcctcttcctctgtagcccaactggaagggatgagagggcctctctgcc

SEQ ID NO: 17918 - DNA, 201 bp, Homo sapiens
ctttgaccacttgcatattcaaactgacattttgtcgtgtttttctctactgtctttatgcagcggaccatgtgtcaacttatgccgcgtttgtacagacscatagaccaacaggggagtttatgtttgaatttgatgaagatgagatgttctatgtggatctggacaagaaggagaccgtctggcatctggaggagtttg

SEQ ID NO: 17919 - DNA, 201 bp, Homo sapiens
ccctaagaggtggagcctttgtgattcatcccagaagaggggcctaacctggtgctgtctccttccagatccccctgaggtgaccgtgtttcccaaggagsctgtggagctgggccagcccaacaccctcatctgccacattgacaagttcttcccaccagtgctcaacgtcacgtggctgtgcaacggggagctggtcac

SEQ ID NO: 17920 - DNA, 201 bp, Homo sapiens
tcaggaaccatcggacttgaatgctgcctgggtagaaatccgtcacgtggcagacaagcaggttgtggtgctgcaagggccccttcttggagggggaaacrttcaccctaggctggactaggagcgtggaagaaaaataatgaaatagaatttgagattgtccttctttccttccttccttccttccttccttccttcctt

SEQ ID NO: 17921 - DNA, 201 bp, Homo sapiens
ctatgtaacaaacctgcacattctgcacatgtatcccagaacttaaagtaaaaaaaaaaaaaacgaaaataatgccaaccatggaagtattggtggctgtrttaatatcagaaatataagactcagaaatattaccaaggagaaagaaggatagttcataatgataaaaggatcattttattatcaacatataacaatcct

SEQ ID NO: 17922 - DNA, 201 bp, Homo sapiens
gggtcatgggcccgcccagctcgtagttgtgtctgcacatcctgtccggcactgcccgcttctcctccaggatgtccttctggctgttccagtactccgcvgcaggccgccccagctccgtcaccgcccggaactcccccacgtcgctgtcgaagcgcgcgaactcctcccggttgtagatgtatctctccaggaagcgct

SEQ ID NO: 17923 - DNA, 201 bp, Homo sapiens; identical to SEQ ID NO: 1729

SEQ ID NO: 17924 - DNA, 201 bp, Homo sapiens
ccatccgggagggaggtgggggagtcagtcccccgcccggccagccgccccatccgggagggaggtgggggggtcagccccccgcccggccagccaccccrtccgggaagtgaggggcgcctctgcccggccgcccctactgggaagtgaagagcccctctgcccagccagccgccccgtccgggagggaggtggggggtc

SEQ ID NO: 17925 - DNA, 201 bp, Homo sapiens
tagagaataatttataactttacataattggaaaggagggaaactctaaaatcaaccatctatgttcccatcttaagaagctagaaaaaaaaagtcaaatkaatcccaagattaataagatcagaaataaatgcaataaaatggacaaacaataaagaaaataaacaaagtcaattgctggttttcaataaggctcaatac

SEQ ID NO: 17926 - DNA, 201 bp, Homo sapiens
gggcctggaggagaaacccacactccttaggctggcatcagggctgtctgcaatctggcagttgattactgtgaaagaaaatgctgccatgtcactgattkgtgcctctacaaagtcttagtaacagtttttgccaattgcgttatttttatttgaacacctctctcaaccaattacctcagcaactttcctaagctcatg

SEQ ID NO: 17927 - DNA, 201 bp, Homo sapiens
aaggagaccgtctggcatctggaggagtttggccaagccttttcctttgaggctcagggcgggctggctaacattgctatattgaacaacaacttgaataycttgatccagcgttccaaccacactcaggccaccaacggtacgccctatctttgcctcttcctctgtagcccaactggaagggatgagagggcctctctg

SEQ ID NO: 17928 - DNA, 201 bp, Homo sapiens
cttatctggctacatgggaacctctagggagctgattacaagcagagatccccagacctccccacccagggaatctgagtctgggggcactgagtctggakatctgtgcatcacagaggatctccagaagagtcttcagaggagtgaggttggggacctgcgggcctggaggagaaacccacactccttaggctggcatca

SEQ ID NO: 17929 - DNA, 201 bp, Homo sapiens
tagctttgaccacttgcatattcaaactgacattttgtcgtgtttttctctactgtctttatgcagcggaccatgtgtcaacttatgccgcgtttgtacaracgcatagaccaacaggggagtttatgtttgaatttgatgaagatgagatgttctatgtggatctggacaagaaggagaccgtctggcatctggaggagt

SEQ ID NO: 17930 - DNA, 201 bp, Homo sapiens
ttgttctttgctcctttctttttataactgctcatctgctctgtattatttcctttatggtgttgctccttcttcttccccatatgtccttcctttgaccycttaccttcttcctttttatattcataagtctttattcattctctagctttgaccacttgcatattcaaactgacattttgtcgtgtttttctctactgt

SEQ ID NO: 17931 - DNA, 201 bp, Homo sapiens
gaagtggcttttgccctgttttctgaatgcctacattgaagccatctgttccccaggaagccttccctgatgtgctgtttggtcgcatcttgtgtataccyacgtatctgcacttatccttctgaacctgctgttgtcctgtcacttgtgtttccttctgtgacttatacgcgtctgcagaacaggacgtatgtattattt

SEQ ID NO: 17932 - DNA, 201 bp, Homo sapiens
cggtcaggctgtcttccctgagagaagtggcttttgccctgttttctgaatgcctacattgaagccatctgttccccaggaagccttccctgatgtgctgyttggtcgcatcttgtgtatacctacgtatctgcacttatccttctgaacctgctgttgtcctgtcacttgtgtttccttctgtgacttatacgcgtctgc

SEQ ID NO: 17933 - DNA, 201 bp, Homo sapiens
cactcttcctggaaaatcttatttaacctgcacctgccactaatgactctcagttctatggcctaaattcctctcctgagaccacccataatccacaaatrtctatgtattatttctccttagatgactttcaggtcttctaagtgcaatagccccacagtaaactcagtatcttctcccggtcaggctgtcttccctgag

SEQ ID NO: 17934 - DNA, 201 bp, Homo sapiens
ttctctcattataccctgagatctcggcaattctgatttttggcactcttcctggaaaatcttatttaacctgcacctgccactaatgactctcagttctmtggcctaaattcctctcctgagaccacccataatccacaaatatctatgtattatttctccttagatgactttcaggtcttctaagtgcaatagccccac

SEQ ID NO: 17935 - DNA, 201 bp, Homo sapiens
ttttaaaccacctcttaactatcatgttctctcattataccctgagatctcggcaattctgatttttggcactcttcctggaaaatcttatttaacctgcrcctgccactaatgactctcagttctatggcctaaattcctctcctgagaccacccataatccacaaatatctatgtattatttctccttagatgactttc

SEQ ID NO: 17936 - DNA, 201 bp, Homo sapiens
cctaccatgtaaatatgcagctttaacgacactgcctctcttggacttcgattccttgtcttcaatatggggatgatataacctgccttatagcaaagctsttaagatcaaatgagatcaataggtctgaaattgctttggaaaaataaagtccatagagaatataaattgactggtaaataaggaagaaagtgaaaaaaa

SEQ ID NO: 17937 - DNA, 201 bp, Homo sapiens
tggaatactgtgcagccataaaaaaggatgagttcatgtcctttgtagggacatggaggaagctggaaatcatcattcacagcaaactattgcaaggacaraaaaccaaagaccacatgttctcactcataggtgggaactgaacaatgagaacacatggacacaggaaggggaacatcatacaccggggcctgttgtggg

SEQ ID NO: 17938 - DNA, 201 bp, Homo sapiens
tgccttgggccccagaccctaaaattccaggcccagagccccccagctccttgagtccagattcctcctcctctgccatccatccgcccctgcctgttcarttgccccactctgagtgtggattctcccattttcatttgttagtctttgtttctcctcctcaatcaccagtaagagaacgtttttcattcaagaataaga

SEQ ID NO: 17939 - DNA, 201 bp, Homo sapiens
tcccttctgctggtggctggaggaggcggagacgtttcacgtggggtcactgggagaaaaaacaggggcgggaggagctggggacgtggagggcggagctsctccccctacttaactccctgactgacatttccatcctgatgtcagtcctggttcaaatgccacctcctccaggaagccctcccttccttctttctcttt

SEQ ID NO: 17940 - DNA, 201 bp, Homo sapiens
tatgaaaggtctgaaaatataaagcctgtgatgcacttaagatgacggaggaaagacagtgatactcattttaaccagtcagataagtcatgatgtttggsgagattatgcgttttctttgctctgaaggtgatctcaaatattctgctggcccatctacagggattatcatttccccaattctgccacacctcacacacc

SEQ ID NO: 17941 - DNA, 201 bp, Homo sapiens
atagatgcaaatactttttagtattcttggtagaaattcctaatgagctcagctgtctcttcagggcttccctgcccagtctcttaacatttaaacatgtmatttaccttaaaaacataagtgcaaaccaactgataaaaaacaaccttgccttcagtctgcatcctgtcccagagacactttctttgtgtcctcacacgt

SEQ ID NO: 17942 - DNA, 201 bp, Homo sapiens
agcacctggatttaaaaagagtcagaaggaaaattagaaaatattttgaactgagtgaatatgaaagcacactatcaaaattagtatgatacactaattasagaataatttataactttacataattggaaaggagggaaactctaaaatcaaccatctatgttcccatcttaagaagctagaaaaaaaaagtcaaatgaa

SEQ ID NO: 17943 - DNA, 201 bp, Homo sapiens
ccaggaatgacaataactgtgtgtgttgctgcaggtgacaaaatatctgaacagaagaggacttaggagagatctgaactccagctgccctacaaactccrtctcagcttttcttctcacttcatgtgaaaactactccagtggctgactgaattgctgacccttcaagctctgtccttatccattacctcaaagcagtca

SEQ ID NO: 17944 - DNA, 201 bp, Homo sapiens
agttgtgaattacctacaatttcttccccatagagcttctgggaaccatgaaatcagggggaatacttgggtatctgttttaaggtcccagaacattccaygagaggcatcttgctcaatattctttgacaggagcaggtcagcctggagccacatcagtgacctccagggtgcgctggagttaaggcctgatacccaatg

SEQ ID NO: 17945 - DNA, 201 bp, Homo sapiens
agatcagaaataaatgcaataaaatggacaaacaataaagaaaataaacaaagtcaattgctggttttcaataaggctcaatacattcatgaatctctagstagatggatcaagaaaaagagataagactcaaatccccaatatcagaaatggaagtgggtacgtcacaacaaatcatacagacattaaaagtattatgac

SEQ ID NO: 17946 - DNA, 201 bp, Homo sapiens
ttgatagatgcagcaaaccacatggcacatgtataactatgtaacaaacctgcacattctgcacatgtatcccagaacttaaagtaaaaaaaaaaaaaacraaaataatgccaaccatggaagtattggtggctgtgttaatatcagaaatataagactcagaaatattaccaaggagaaagaaggatagttcataatgat

SEQ ID NO: 17947 - DNA, 201 bp, Homo sapiens
tttagaggcattgatgtaattttttttggcagtttttatggttttatttacacacaaaacgtggacatgaactttctactcattttcttagctgtgcaccstggtactggggttggtgactctgatggccggctgggtgactctttccatgatgactttgcagttctggaggaaattttgtgagcgatctcagcacagtaa

SEQ ID NO: 17948 - DNA, 201 bp, Homo sapiens
caaggggagggagagcattaggacacataccgaatgtatgcatggcttaaaacctagatgatgggttgatagatgcagcaaaccacatggcacatgtatamctatgtaacaaacctgcacattctgcacatgtatcccagaacttaaagtaaaaaaaaaaaaaacgaaaataatgccaaccatggaagtattggtggctgt

SEQ ID NO: 17949 - DNA, 201 bp, Homo sapiens
ttcattgagccttttatcctctgttctcctttgaagaacccctcactgtcaccttcccgagaataccctaagaccaataaatacttcagtatttcagagcrgggagactctgagtcattcttactggaagtctaggaccaggtcacatgtgaatactatttcttgaaggtgtggtttcaacctctgttgccgatgtggtta

SEQ ID NO: 17950 - DNA, 201 bp, Homo sapiens
cttgaaggtgtggtttcaacctctgttgccgatgtggttactaaaggttctgatcccacttgaacggaaaggtctgaggatattgattcagtcctgggttyttccctaactacaggatagggtggggtagagaaaggatatttgggggaaattttacttggatgaagattttcttggatgtagtttgaagactgcagtgtt

SEQ ID NO: 17951 - DNA, 201 bp, Homo sapiens
cgctgtcgaagcgcgcgaactcctcccggttgtagatgtatctctccaggaagcgctgtgtcccattaaacgcgtagcattcctgccgtccctggaaaagktaattctctgcggggagggggcggacatgagcggaggcgccactctcatctaatcctctttctccctctctctctcaatattaacgattcttcccaaatc

SEQ ID NO: 17952 - DNA, 201 bp, Homo sapiens
ctcaaataatatcttgaaattaagatatacagacaatggcattatggtggcctgtgaatctaataacttcatgaaaatacaaagaaaatgaagagagcttkacatgtcttattctgtaaaaaacctatgtatttttttacctcacctacaaaaactcaaaatcttcatatttacagaatatcctgagctcctacatgcttg

SEQ ID NO: 17953 - DNA, 201 bp, Homo sapiens
acgtcgctgtcgaagcgcgcgaactcctcccggttgtagatgtatctctccaggaagcgctgtgtcccattaaacgcgtagcattcctgccgtccctggavaaggtaattctctgcggggagggggcggacatgagcggaggcgccactctcatctaatcctctttctccctctctctctcaatattaacgattcttccca

SEQ ID NO: 17954 - DNA, 201 bp, Homo sapiens
gtggcaaatgctgattctggaagttgcctctcaaaatgcctgagaagaggctaaaatgctgaaggaagagaactgttcctatgtgtgaggtcagttcctawgtgtgagggtttcgagaccagtcagtgtccctagattctctgacaagggggagaactatgaatcttcaggaacccctaagccaaggtcaggaagtctcca

SEQ ID NO: 17955 - DNA, 201 bp, Homo sapiens
gaactcccccacgtcgctgtcgaagcgcgcgaactcctcccggttgtagatgtatctctccaggaagcgctgtgtcccattaaacgcgtagcattcctgcmgtccctggaaaaggtaattctctgcggggagggggcggacatgagcggaggcgccactctcatctaatcctctttctccctctctctctcaatattaacg

SEQ ID NO: 17956 - DNA, 201 bp, Homo sapiens
tccgtcaccgcccggaactcccccacgtcgctgtcgaagcgcgcgaactcctcccggttgtagatgtatctctccaggaagcgctgtgtcccattaaacgsgtagcattcctgccgtccctggaaaaggtaattctctgcggggagggggcggacatgagcggaggcgccactctcatctaatcctctttctccctctctc

SEQ ID NO: 17957 - DNA, 201 bp, Homo sapiens
ctgttccagtactccgcagcaggccgccccagctccgtcaccgcccggaactcccccacgtcgctgtcgaagcgcgcgaactcctcccggttgtagatgtmtctctccaggaagcgctgtgtcccattaaacgcgtagcattcctgccgtccctggaaaaggtaattctctgcggggagggggcggacatgagcggaggcg

SEQ ID NO: 17958 - DNA, 201 bp, Homo sapiens
atgtccttctggctgttccagtactccgcagcaggccgccccagctccgtcaccgcccggaactcccccacgtcgctgtcgaagcgcgcgaactcctccckgttgtagatgtatctctccaggaagcgctgtgtcccattaaacgcgtagcattcctgccgtccctggaaaaggtaattctctgcggggagggggcggaca

SEQ ID NO: 17959 - DNA, 201 bp, Homo sapiens
ccaggatgtccttctggctgttccagtactccgcagcaggccgccccagctccgtcaccgcccggaactcccccacgtcgctgtcgaagcgcgcgaactcytcccggttgtagatgtatctctccaggaagcgctgtgtcccattaaacgcgtagcattcctgccgtccctggaaaaggtaattctctgcggggagggggc

SEQ ID NO: 17960 - DNA, 201 bp, Homo sapiens
ggctgtctgcaatctggcagttgattactgtgaaagaaaatgctgccatgtcactgattggtgcctctacaaagtcttagtaacagtttttgccaattgcrttatttttatttgaacacctctctcaaccaattacctcagcaactttcctaagctcatgtcactcacctcatccccacccagtgtgtccaccttctcact

SEQ ID NO: 17961 - DNA, 201 bp, Homo sapiens
tctcctccaggatgtccttctggctgttccagtactccgcagcaggccgccccagctccgtcaccgcccggaactcccccacgtcgctgtcgaagcgcgcraactcctcccggttgtagatgtatctctccaggaagcgctgtgtcccattaaacgcgtagcattcctgccgtccctggaaaaggtaattctctgcgggga

SEQ ID NO: 17962 - DNA, 201 bp, Homo sapiens
atcctgtccggcactgcccgcttctcctccaggatgtccttctggctgttccagtactccgcagcaggccgccccagctccgtcaccgcccggaactcccmcacgtcgctgtcgaagcgcgcgaactcctcccggttgtagatgtatctctccaggaagcgctgtgtcccattaaacgcgtagcattcctgccgtccctgg

SEQ ID NO: 17963 - DNA, 201 bp, Homo sapiens
ctgcagggtcatgggcccgcccagctcgtagttgtgtctgcacatcctgtccggcactgcccgcttctcctccaggatgtccttctggctgttccagtacwccgcagcaggccgccccagctccgtcaccgcccggaactcccccacgtcgctgtcgaagcgcgcgaactcctcccggttgtagatgtatctctccaggaa

SEQ ID NO: 17964 - DNA, 201 bp, Homo sapiens
cccttttatctccagtccttactcccatatctaacctcttacccctacctcataggtaaacattttaatgaatttgatgtttccttttatttgcatagatsctctgtaatatgtagtagtgtccagtgtacatgtatttttaattaaccaaaatggcattaaattatagatctaattttgtacatccagtttgtttcttcc

SEQ ID NO: 17965 - DNA, 201 bp, Homo sapiens
tttatctccagtccttactcccatatctaacctcttacccctacctcataggtaaacattttaatgaatttgatgtttccttttatttgcatagatcctcygtaatatgtagtagtgtccagtgtacatgtatttttaattaaccaaaatggcattaaattatagatctaattttgtacatccagtttgtttcttccaaat

SEQ ID NO: 17966 - DNA, 201 bp, Homo sapiens
ttatctccagtccttactcccatatctaacctcttacccctacctcataggtaaacattttaatgaatttgatgtttccttttatttgcatagatcctctstaatatgtagtagtgtccagtgtacatgtatttttaattaaccaaaatggcattaaattatagatctaattttgtacatccagtttgtttcttccaaatc

SEQ ID NO: 17967 - DNA, 201 bp, Homo sapiens
gatgggtccgggcttacagtactgaacccaggaatgacaataactgtgtgtgttgctgcaggtgacaaaatatctgaacagaagaggacttaggagagatytgaactccagctgccctacaaactccatctcagcttttcttctcacttcatgtgaaaactactccagtggctgactgaattgctgacccttcaagctctg

SEQ ID NO: 17968 - DNA, 201 bp, Homo sapiens
ggaatgacaataactgtgtgtgttgctgcaggtgacaaaatatctgaacagaagaggacttaggagagatctgaactccagctgccctacaaactccatcwcagcttttcttctcacttcatgtgaaaactactccagtggctgactgaattgctgacccttcaagctctgtccttatccattacctcaaagcagtcattc

SEQ ID NO: 17969 - DNA, 201 bp, Homo sapiens
catattaatccacatatctacattgctcctgggatacctggatcattcctggttctctactattgcaagcaatgcttgtatctcacatggaactgcatatrcatgtgggcctgacctgcatccctggaatgtatgtatcctagaaaggggttgcagggttgctggagatgcagctccttaatttgactaaacactgctcat

SEQ ID NO: 17970 - DNA, 201 bp, Homo sapiens
catgaggatcacttgagcccagggttttgagaccggcctgggcaacatagtgagaacccatctctaaaaagaaaaataaattagccagacatggtggtacrtgtatctgtagttctagctacatgggaggctgaggcaggaggatcacttgagcccaggaggttgaggctgcagtgagccatgatggtgccacagcactcc

SEQ ID NO: 17971 - DNA, 201 bp, Homo sapiens
ttcctcctcagaaagcagaaaaggccaggcatggtggtcatgcctataatcttagcactttgggaggttgaggcatgaggatcacttgagcccagggtttygagaccggcctgggcaacatagtgagaacccatctctaaaaagaaaaataaattagccagacatggtggtacgtgtatctgtagttctagctacatggga

SEQ ID NO: 17972 - DNA, 201 bp, Homo sapiens
tggccatgggctgatcccactacagcaagggcttgcatcctctcttctcaggagagagaaaggtgagcagagtgaggctggtcagtggtgtgatacccctstctgtgattcagagctgccataaaatctaaggctgaggtagaggaccaccctcccctaagaggtggagcctttgtgattcatcccagaagaggggcctaa

SEQ ID NO: 17973 - DNA, 201 bp, Homo sapiens
gatcccactacagcaagggcttgcatcctctcttctcaggagagagaaaggtgagcagagtgaggctggtcagtggtgtgatacccctctctgtgattcasagctgccataaaatctaaggctgaggtagaggaccaccctcccctaagaggtggagcctttgtgattcatcccagaagaggggcctaacctggtgctgtc

SEQ ID NO: 17974 - DNA, 201 bp, Homo sapiens
ttttcctctttctagaaaaaaggtccagggctcaatcccacatcctgatactactccctcaagtccctcaggttggtgcaccaggctccccaccccacaarttcacaggaggaagccaaagctccaaggccttcctgtcccatccttgagaaatcctcttactgcacacacctcacctctctccatccctttacacccaga

SEQ ID NO: 17975 - DNA, 201 bp, Homo sapiens
agttcaaatacatttcaccaaggcaaggattcctgtttgttctagttgccttctctaatgcccagaaaacatttgctcaattacttctagatttgggtggrcatccaccctggaattgtcactacttctttcctcccccttccacctctcccttgcctctgtgttttccctgttctaactcatgccttgattgcaatttcc

SEQ ID NO: 17976 - DNA, 201 bp, Homo sapiens
ctctaatgcccagaaaacatttgctcaattacttctagatttgggtggacatccaccctggaattgtcactacttctttcctcccccttccacctctcccytgcctctgtgttttccctgttctaactcatgccttgattgcaatttccctgacaaataatagcagtttcctacctcatctccctgcctctggtccctcct

SEQ ID NO: 17977 - DNA, 201 bp, Homo sapiens
ggcagacaagcaggttgtggtgctgcaagggccccttcttggagggggaaacattcaccctaggctggactaggagcgtggaagaaaaataatgaaatagmatttgagattgtccttctttccttccttccttccttccttccttccttccttccttccttccttccttttttttgagacataatctcgctctttctttct

SEQ ID NO: 17978 - DNA, 201 bp, Homo sapiens
ctttatggtgttgctccttcttcttccccatatgtccttcctttgacctcttaccttcttcctttttatattcataagtctttattcattctctagctttsaccacttgcatattcaaactgacattttgtcgtgtttttctctactgtctttatgcagcggaccatgtgtcaacttatgccgcgtttgtacagacgcata

SEQ ID NO: 17979 - DNA, 201 bp, Homo sapiens
tgtccttcctttgacctcttaccttcttcctttttatattcataagtctttattcattctctagctttgaccacttgcatattcaaactgacattttgtcrtgtttttctctactgtctttatgcagcggaccatgtgtcaacttatgccgcgtttgtacagacgcatagaccaacaggggagtttatgtttgaatttgat

SEQ ID NO: 17980 - DNA, 201 bp, Homo sapiens
agccctcactcacctcggcgctgcagggtcatgggcccgcccagctcgtagttgtgtctgcacatcctgtccggcactgcccgcttctcctccaggatgtscttctggctgttccagtactccgcagcaggccgccccagctccgtcaccgcccggaactcccccacgtcgctgtcgaagcgcgcgaactcctcccggttg

SEQ ID NO: 17981 - DNA, 201 bp, Homo sapiens
ccaaagccctcactcacctcggcgctgcagggtcatgggcccgcccagctcgtagttgtgtctgcacatcctgtccggcactgcccgcttctcctccaggwtgtccttctggctgttccagtactccgcagcaggccgccccagctccgtcaccgcccggaactcccccacgtcgctgtcgaagcgcgcgaactcctcccg

SEQ ID NO: 17982 - DNA, 201 bp, Homo sapiens
ccggcccaaagccctcactcacctcggcgctgcagggtcatgggcccgcccagctcgtagttgtgtctgcacatcctgtccggcactgcccgcttctcctmcaggatgtccttctggctgttccagtactccgcagcaggccgccccagctccgtcaccgcccggaactcccccacgtcgctgtcgaagcgcgcgaactcc

SEQ ID NO: 17983 - DNA, 201 bp, Homo sapiens
ctgggaccgccggcccaaagccctcactcacctcggcgctgcagggtcatgggcccgcccagctcgtagttgtgtctgcacatcctgtccggcactgcccrcttctcctccaggatgtccttctggctgttccagtactccgcagcaggccgccccagctccgtcaccgcccggaactcccccacgtcgctgtcgaagcgc

SEQ ID NO: 17984 - DNA, 201 bp, Homo sapiens
ccctgggaccgccggcccaaagccctcactcacctcggcgctgcagggtcatgggcccgcccagctcgtagttgtgtctgcacatcctgtccggcactgcmcgcttctcctccaggatgtccttctggctgttccagtactccgcagcaggccgccccagctccgtcaccgcccggaactcccccacgtcgctgtcgaagc

SEQ ID NO: 17985 - DNA, 201 bp, Homo sapiens
ccatgatgactttgcagttctggaggaaattttgtgagcgatctcagcacagtaagatttgttgcacatcagcagcactttcagctccttgaggctgtggrccagaaacttctggaagccactgggcagcatgttttttttgttgttgttgttgctcccataagcaatgttgggcatcaagatctggcccttggaccttct

SEQ ID NO: 17986 - DNA, 201 bp, Homo sapiens
gctgccctgggaccgccggcccaaagccctcactcacctcggcgctgcagggtcatgggcccgcccagctcgtagttgtgtctgcacatcctgtccggcamtgcccgcttctcctccaggatgtccttctggctgttccagtactccgcagcaggccgccccagctccgtcaccgcccggaactcccccacgtcgctgtcg

SEQ ID NO: 17987 - DNA, 201 bp, Homo sapiens
agacttggtgtcaaaagatgtggaaagtattttacacaatgaaaatcaccacaacaaccagggacctgtgggggtagagtcctttgggtttagaggcattsatgtaattttttttggcagtttttatggttttatttacacacaaaacgtggacatgaactttctactcattttcttagctgtgcaccctggtactggggt

SEQ ID NO: 17988 - DNA, 201 bp, Homo sapiens
gggctgccctgggaccgccggcccaaagccctcactcacctcggcgctgcagggtcatgggcccgcccagctcgtagttgtgtctgcacatcctgtccggmactgcccgcttctcctccaggatgtccttctggctgttccagtactccgcagcaggccgccccagctccgtcaccgcccggaactcccccacgtcgctgt

SEQ ID NO: 17989 - DNA, 201 bp, Homo sapiens
ctccacaccatacccttgtgcgctgtcctgtggcttccttttttcaccccacatgcagtcagctgccaggcctgatgaagtcccgggggtctctctgctcycgtcctcctcactccatgctcagcccagtccaggtccccgcgctcgctcccctgacaagctccagatgggctccccccatgaatccccaacccaaagtcc

SEQ ID NO: 17990 - DNA, 201 bp, Homo sapiens
cggggctgccctgggaccgccggcccaaagccctcactcacctcggcgctgcagggtcatgggcccgcccagctcgtagttgtgtctgcacatcctgtccrgcactgcccgcttctcctccaggatgtccttctggctgttccagtactccgcagcaggccgccccagctccgtcaccgcccggaactcccccacgtcgct

SEQ ID NO: 17991 - DNA, 201 bp, Homo sapiens; identical to SEQ ID NO: 1701

SEQ ID NO: 17992 - DNA, 201 bp, Homo sapiens
ccatctccacctccatctccacaccatacccttgtgcgctgtcctgtggcttccttttttcaccccacatgcagtcagctgccaggcctgatgaagtcccsggggtctctctgctctcgtcctcctcactccatgctcagcccagtccaggtccccgcgctcgctcccctgacaagctccagatgggctccccccatgaat

SEQ ID NO: 17993 - DNA, 201 bp, Homo sapiens
gggcccgcggggctgccctgggaccgccggcccaaagccctcactcacctcggcgctgcagggtcatgggcccgcccagctcgtagttgtgtctgcacatyctgtccggcactgcccgcttctcctccaggatgtccttctggctgttccagtactccgcagcaggccgccccagctccgtcaccgcccggaactccccca

SEQ ID NO: 17994 - DNA, 201 bp, Homo sapiens; identical to SEQ ID NO: 1702

SEQ ID NO: 17995 - DNA, 201 bp, Homo sapiens
ccacctttagtctccagtgtcattgctaaggcaagatcccaggtcttgactcagatatcctgacctgcctcttctcctggtgccttgggccccagaccctraaattccaggcccagagccccccagctccttgagtccagattcctcctcctctgccatccatccgcccctgcctgttcaattgccccactctgagtgtgg

SEQ ID NO: 17996 - DNA, 201 bp, Homo sapiens
tccccagcttcctcctcctcctcccttcatttttttcctctttctagaaaaaaggtccagggctcaatcccacatcctgatactactccctcaagtccctmaggttggtgcaccaggctccccaccccacaagttcacaggaggaagccaaagctccaaggccttcctgtcccatccttgagaaatcctcttactgcacac

SEQ ID NO: 17997 - DNA, 201 bp, Homo sapiens
aggtcccttaggccaacccggctgctcctgcgccctgggcacgggcccgcggggctgccctgggaccgccggcccaaagccctcactcacctcggcgctgyagggtcatgggcccgcccagctcgtagttgtgtctgcacatcctgtccggcactgcccgcttctcctccaggatgtccttctggctgttccagtactccg

SEQ ID NO: 17998 - DNA, 201 bp, Homo sapiens
atgataaactaagagccaagaaataaaatttttaaaatgccctaattcattgcaatttttaccagccatagtcactccatgtgggagaacttaaatcatgmttaccagagctttcaaaggtttgagaatagtgatgattatgaagaaaaatatcttatttgagcaaggattttgtttctttatgagtgttcattagatatt

SEQ ID NO: 17999 - DNA, 201 bp, Homo sapiens
gttggggatgtgtgtggagttgggggagcatgcagggaattgtggaatcagccctgcccactttacccactcccctatggctccagctctccctccagcargttttgattgaacattcattctacgcagggagctccagtaatctaccctcagtccctgtcacatggctccactgcctcatctcattccccctacaaacct

SEQ ID NO: 18000 - DNA, 201 bp, Homo sapiens
ctccccagcttcctcctcctcctcccttcatttttttcctctttctagaaaaaaggtccagggctcaatcccacatcctgatactactccctcaagtcccwcaggttggtgcaccaggctccccaccccacaagttcacaggaggaagccaaagctccaaggccttcctgtcccatccttgagaaatcctcttactgcaca

SEQ ID NO: 18001 - DNA, 201 bp, Homo sapiens
ggtcatacactgccttccccagattcctgcacacagtgacctactatcagggccctcctatctctctgggatccccagcctctatcttttgtggctgcttyacaggaactccgagctatggactctgcattaggagacgaagtgcaaagagtgtttctgtatcctccctctcttctaggaccctagggctcttcctgggtc

SEQ ID NO: 18002 - DNA, 201 bp, Homo sapiens
tttttcatttttcaaaaatcttcagtgttctgacaatacttatctggctacatgggaacctctagggagctgattacaagcagagatccccagacctcccyacccagggaatctgagtctgggggcactgagtctggagatctgtgcatcacagaggatctccagaagagtcttcagaggagtgaggttggggacctgcgg

SEQ ID NO: 18003 - DNA, 201 bp, Homo sapiens
ccagacccagctctgagggtcatacactgccttccccagattcctgcacacagtgacctactatcagggccctcctatctctctgggatccccagcctctrtcttttgtggctgctttacaggaactccgagctatggactctgcattaggagacgaagtgcaaagagtgtttctgtatcctccctctcttctaggaccct

SEQ ID NO: 18004 - DNA, 201 bp, Homo sapiens
agctccaaggccttcctgtcccatccttgagaaatcctcttactgcacacacctcacctctctccatccctttacacccagacttcctgaaggaaaaagaygaatgaactgagacactgccctgtgacagccgtggggaacccaagacaagtaaaatccatctcagccccgaggaggatgcgccacactcagcctcatgca

SEQ ID NO: 18005 - DNA, 201 bp, Homo sapiens
aaccttctctttttcatttttcaaaaatcttcagtgttctgacaatacttatctggctacatgggaacctctagggagctgattacaagcagagatccccmgacctccccacccagggaatctgagtctgggggcactgagtctggagatctgtgcatcacagaggatctccagaagagtcttcagaggagtgaggttggg

SEQ ID NO: 18006 - DNA, 201 bp, Homo sapiens
aatacaaagaaaatgaagagagctttacatgtcttattctgtaaaaaacctatgtatttttttacctcacctacaaaaactcaaaatcttcatatttacakaatatcctgagctcctacatgcttgagtagtagaaatcccgtcctttttcaagttcctcctctgtgctgcgtcttcaggtcccatgaaggtctcacagat

SEQ ID NO: 18007 - DNA, 201 bp, Homo sapiens; identical to SEQ ID NO: 1704

SEQ ID NO: 18008 - DNA, 201 bp, Homo sapiens
taaagaggaggccctaggatttgtagaatgtaaggaagggaggaaaaattcaatctgataagtgttcattgatcttctaatgggttaaaagcattcagccrcataacaacaacaacaccgataactaactgagtagttaatatggtcaggcgctattctgaggatttacatttattaactcactttattctcacacatagt

SEQ ID NO: 18009 - DNA, 201 bp, Homo sapiens; identical to SEQ ID NO: 1706

SEQ ID NO: 18010 - DNA, 201 bp, Homo sapiens
tccaatccagaaagtctggatccaagactgtttatccactgtcctattcaccctattttgtgaaggaaaagaccaagttcaaattctccagagtccattgycaaataatggagtcagatctatatttctatacataattacaacacagtgtggtgggtgcctgtaactacttactgtctctacttggactcattccatggc

SEQ ID NO: 18011 - DNA, 201 bp, Homo sapiens
taacagaatacaaaagaaaaattatgtaattatgtaaatggatgcagaaaaaggcatttgctcattcatgataaaaagtcctagaaaactaggaataaaarggaattacctgataaggtgtgtccatgaaaaccaacaactgaaattttcaattttgggtgggggaggggggcgggcattttactttctccataaaactat

SEQ ID NO: 18012 - DNA, 201 bp, Homo sapiens
aaataattatgtagtagaaggtgtctagtaggattaaggggccaggagaggattgtggagaaaaactcagtttttttagtaactgcctgggtgggactttyctccttgtcatttacctgccatagataattagacaaatacttcctcgatgtctcaggtaatttatttttacagtagacattaataatacctccctcaggt

SEQ ID NO: 18013 - DNA, 201 bp, Homo sapiens
cagaaaacatttgctcaattacttctagatttgggtggacatccaccctggaattgtcactacttctttcctcccccttccacctctcccttgcctctgtsttttccctgttctaactcatgccttgattgcaatttccctgacaaataatagcagtttcctacctcatctccctgcctctggtccctcctctagccagca

SEQ ID NO: 18014 - DNA, 201 bp, Homo sapiens
tcagaaagcagaaaaggccaggcatggtggtcatgcctataatcttagcactttgggaggttgaggcatgaggatcacttgagcccagggttttgagaccrgcctgggcaacatagtgagaacccatctctaaaaagaaaaataaattagccagacatggtggtacgtgtatctgtagttctagctacatgggaggctgag

SEQ ID NO: 18015 - DNA, 201 bp, Homo sapiens
gagtcagtcccccgcccggccagccgccccatccgggagggaggtgggggggtcagccccccgcccggccagccaccccatccgggaagtgaggggcgccyctgcccggccgcccctactgggaagtgaagagcccctctgcccagccagccgccccgtccgggagggaggtggggggtcagccccctgccccgccagccg

SEQ ID NO: 18016 - DNA, 201 bp, Homo sapiens
cttcagacagttttatttaagatgtgtagaataaagaggaggtcaggctgggtagaaccagaagtatctattgccctgttcgcggtcacctgagttatttytaatgttatgttataataaacaccacaataggcttctcttcatagatgcaaatactttttagtattcttggtagaaattcctaatgagctcagctgtctc

SEQ ID NO: 18017 - DNA, 201 bp, Homo sapiens
aacccactttccatcttctgttttctgaccttcccaagtcactggcaccgctgtccactgtgctgctgaggtcacctcccctcagcttccaagactcttcyctgcgggcctctcctcacactgcacttgggtttttttggtctctttcacaggcttttctgtcttggccaaatcacaactgtccagttcccaggatccggt

SEQ ID NO: 18018 - DNA, 201 bp, Homo sapiens
caagggcaccatggagtccacctttagtctccagtgtcattgctaaggcaagatcccaggtcttgactcagatatcctgacctgcctcttctcctggtgcsttgggccccagaccctaaaattccaggcccagagccccccagctccttgagtccagattcctcctcctctgccatccatccgcccctgcctgttcaattg

SEQ ID NO: 18019 - DNA, 201 bp, Homo sapiens
ggattcctgtttgttctagttgccttctctaatgcccagaaaacatttgctcaattacttctagatttgggtggacatccaccctggaattgtcactactyctttcctcccccttccacctctcccttgcctctgtgttttccctgttctaactcatgccttgattgcaatttccctgacaaataatagcagtttcctacc

SEQ ID NO: 18020 - DNA, 201 bp, Homo sapiens
tccccacggtctccctctccctctccctctccctctccccacggtctccctctccctctctttccacagtctccctctgatgccgagccgaagctggacgrtactgctgccatcacggctcactgcaacctccctgcctgattctcctgcctcagcttgccgagtgcctgcgattgcaggcgcgcgccgccacacctgact

SEQ ID NO: 18021 - DNA, 201 bp, Homo sapiens
ctggagaacacaaataccctaacatggcgctgggccaggtaaaagtacagtcttgaactgacacacaacccttactccctattgtatttttgccttgtttwcagactgatccacattgtcagcctcttccctcaatgtgagtttatttcaggggcacctgtgtctcactacttcattacctcggttaactcaatgtccatt

SEQ ID NO: 18022 - DNA, 201 bp, Homo sapiens
ttggggatgtgtgtggagttgggggagcatgcagggaattgtggaatcagccctgcccactttacccactcccctatggctccagctctccctccagcagrttttgattgaacattcattctacgcagggagctccagtaatctaccctcagtccctgtcacatggctccactgcctcatctcattccccctacaaacctc

SEQ ID NO: 18023 - DNA, 201 bp, Homo sapiens
caagttcctcctctgtgctgcgtcttcaggtcccatgaaggtctcacagatgaccaggtgttgcctccctctgcatctttgcatttgtgccccagcttgtyctgttgttctcaggtgaatttccacactgccactggcaacttttcttttggatctctgccaccagtacctttttcctcctcagaaagcagaaaaggccag

SEQ ID NO: 18024 - DNA, 201 bp, Homo sapiens
taaaaaacctatgtatttttttacctcacctacaaaaactcaaaatcttcatatttacagaatatcctgagctcctacatgcttgagtagtagaaatcccrtcctttttcaagttcctcctctgtgctgcgtcttcaggtcccatgaaggtctcacagatgaccaggtgttgcctccctctgcatctttgcatttgtgccc

SEQ ID NO: 18025 - DNA, 201 bp, Homo sapiens
cattctacgcagggagctccagtaatctaccctcagtccctgtcacatggctccactgcctcatctcattccccctacaaacctcaacccagcctttgccygtcctccctttcactgcccagcatcacatgcccccttctgctctctgctcccccacctctgggtttccttggtggctcccaacactgtccctcatcccac

SEQ ID NO: 18026 - DNA, 201 bp, Homo sapiens
cattctttctttttgttgagatggagtgtcactctgttgccaagtctggaatgcagtggcgcaatattggctcactgcaacctccacctccgggcttcaascaattctccttcctcagcctcccgaatagctgggattataggtgcctgccacttcacctggctaatttttgtattattagtagagacaaggtttctccat

SEQ ID NO: 18027 - DNA, 201 bp, Homo sapiens
catgcccccttctgctctctgctcccccacctctgggtttccttggtggctcccaacactgtccctcatcccacatgacagctctgcctatgggatggggrcgctgcatccgtcacttcctcctgacactgttcagtgtcaccagtgctgctccagcctcctctctccccagcctcacccctctgcagttcccagggctga

SEQ ID NO: 18028 - DNA, 201 bp, Homo sapiens
agcagtcattccttagtaaagtttccaacaaatagaaattaatgacactttggtagcactaatatggagattatcctttcattgagccttttatcctctgktctcctttgaagaacccctcactgtcaccttcccgagaataccctaagaccaataaatacttcagtatttcagagcggggagactctgagtcattcttac

SEQ ID NO: 18029 - DNA, 201 bp, Homo sapiens
atgcccccttctgctctctgctcccccacctctgggtttccttggtggctcccaacactgtccctcatcccacatgacagctctgcctatgggatgggggygctgcatccgtcacttcctcctgacactgttcagtgtcaccagtgctgctccagcctcctctctccccagcctcacccctctgcagttcccagggctgag

SEQ ID NO: 18030 - DNA, 201 bp, Homo sapiens
cagtcattccttagtaaagtttccaacaaatagaaattaatgacactttggtagcactaatatggagattatcctttcattgagccttttatcctctgttytcctttgaagaacccctcactgtcaccttcccgagaataccctaagaccaataaatacttcagtatttcagagcggggagactctgagtcattcttactg

SEQ ID NO: 18031 - DNA, 201 bp, Homo sapiens
gtcattccttagtaaagtttccaacaaatagaaattaatgacactttggtagcactaatatggagattatcctttcattgagccttttatcctctgttctyctttgaagaacccctcactgtcaccttcccgagaataccctaagaccaataaatacttcagtatttcagagcggggagactctgagtcattcttactgga

SEQ ID NO: 18032 - DNA, 201 bp, Homo sapiens
cccccttctgctctctgctcccccacctctgggtttccttggtggctcccaacactgtccctcatcccacatgacagctctgcctatgggatgggggcgcygcatccgtcacttcctcctgacactgttcagtgtcaccagtgctgctccagcctcctctctccccagcctcacccctctgcagttcccagggctgagccg

SEQ ID NO: 18033 - DNA, 201 bp, Homo sapiens
ttagtaaagtttccaacaaatagaaattaatgacactttggtagcactaatatggagattatcctttcattgagccttttatcctctgttctcctttgaaraacccctcactgtcaccttcccgagaataccctaagaccaataaatacttcagtatttcagagcggggagactctgagtcattcttactggaagtctagg

SEQ ID NO: 18034 - DNA, 201 bp, Homo sapiens
ctctgctcccccacctctgggtttccttggtggctcccaacactgtccctcatcccacatgacagctctgcctatgggatgggggcgctgcatccgtcacytcctcctgacactgttcagtgtcaccagtgctgctccagcctcctctctccccagcctcacccctctgcagttcccagggctgagccgtcctgctggtta

SEQ ID NO: 18035 - DNA, 201 bp, Homo sapiens
ccttcctgtcccatccttgagaaatcctcttactgcacacacctcacctctctccatccctttacacccagacttcctgaaggaaaaagacgaatgaactsagacactgccctgtgacagccgtggggaacccaagacaagtaaaatccatctcagccccgaggaggatgcgccacactcagcctcatgcaccccctccca

SEQ ID NO: 18036 - DNA, 201 bp, Homo sapiens
agaggcattcttcgtgagcactgaatcctcagtgatcctcagagcctggacactccagcttagggctctctgcctgagtcccctccaggctggatgcagayatgaacacgcccaggagcctgcacttgccaacttctctctctgcaaaccttgtctgtccaaggttatccaggacctcttggtcccattttccccaaagac

SEQ ID NO: 18037 - DNA, 201 bp, Homo sapiens
gatgagtggaccccagagccagagagtcccctgctcttcagaggtggggtctagagggtcatcagagactcactccactccacggtgacaggactatccakgctggtgtgctccacttggcaggtgtagacatctccctgctggggggtcatttccagcatcaccaggatctggaaggtccagtctccattacggatcagg

SEQ ID NO: 18038 - DNA, 201 bp, Homo sapiens
gaggcattcttcgtgagcactgaatcctcagtgatcctcagagcctggacactccagcttagggctctctgcctgagtcccctccaggctggatgcagacrtgaacacgcccaggagcctgcacttgccaacttctctctctgcaaaccttgtctgtccaaggttatccaggacctcttggtcccattttccccaaagaca

SEQ ID NO: 18039 - DNA, 201 bp, Homo sapiens
tcataatactgtcataatacttttaatgtctgtatgattaattctattatacatttaaggaagaaacaatacaaactcaatacaaactctttcaacaaaasagcagaagaaaacacatcccaataatttacaagtccaatatactaacatcaaacaatgacattaaaagaaaaggaaactaaagacacacaaacatagcca

SEQ ID NO: 18040 - DNA, 201 bp, Homo sapiens
gagcctggacactccagcttagggctctctgcctgagtcccctccaggctggatgcagacatgaacacgcccaggagcctgcacttgccaacttctctctstgcaaaccttgtctgtccaaggttatccaggacctcttggtcccattttccccaaagacaagcactgaccactgggcacctctctctgtttactgtaccc

SEQ ID NO: 18041 - DNA, 201 bp, Homo sapiens
aaaagaatgggaaaatacatgtataccgtggaatgctatgcagccataaaaaaatgagttcatgttgtttgtggggacatggatgaagctggaagccatcmttcacagcaaactaacacaggaacagaaaaccaaacaccacacgttctcactcgtaagtgggagttcaacaattagaacacatggacacagggaggggaa

SEQ ID NO: 18042 - DNA, 201 bp, Homo sapiens
tacatttaaggaagaaacaatacaaactcaatacaaactctttcaacaaaagagcagaagaaaacacatcccaataatttacaagtccaatatactaacaycaaacaatgacattaaaagaaaaggaaactaaagacacacaaacatagccatgaaaatgtttaacaaaatattttttaaaattgaattcaataatatatt

SEQ ID NO: 18043 - DNA, 201 bp, Homo sapiens
cacagattttaggggctcattgatctatctggtcctcatagtctatgttccctctggccctcataataataacagcaataacagccagaatttatgagackcctgcatagtttctttccccatttacatctcacaggaatcttcaatgaagataatattccattcatttagaaattattccttttatttagaaattatttt

SEQ ID NO: 18044 - DNA, 201 bp, Homo sapiens
aattagccagacatggtggtacgtgtatctgtagttctagctacatgggaggctgaggcaggaggatcacttgagcccaggaggttgaggctgcagtgagycatgatggtgccacagcactccagcctgggagacaaagtgagaacctgtctcaaaaacaaacacaaacacaaaacaaaaaacaaacacagaaaagggtca

SEQ ID NO: 18045 - DNA, 201 bp, Homo sapiens
accccagctgtttcctcctgtccattcaggaaccatcggacttgaatgctgcctgggtagaaatccgtcacgtggcagacaagcaggttgtggtgctgcargggccccttcttggagggggaaacattcaccctaggctggactaggagcgtggaagaaaaataatgaaatagaatttgagattgtccttctttccttcct

SEQ ID NO: 18046 - DNA, 201 bp, Homo sapiens
ttagtagagacaaggtttctccatgttggtcagcctggttctctaggagcacttgaccaacgcctgacctcaagtgatccacccgctcggcctctcaaagkgctgggattacgggcctgagccactgcatctgcccagattattatttcttaggcatgttcactatgtaattgattcctagatgttgaaaataggaataat

SEQ ID NO: 18047 - DNA, 201 bp, Homo sapiens
cagtggcgcaatattggctcactgcaacctccacctccgggcttcaaccaattctccttcctcagcctcccgaatagctgggattataggtgcctgccacytcacctggctaatttttgtattattagtagagacaaggtttctccatgttggtcagcctggttctctaggagcacttgaccaacgcctgacctcaagtga

SEQ ID NO: 18048 - DNA, 201 bp, Homo sapiens
gacatggtggtacgtgtatctgtagttctagctacatgggaggctgaggcaggaggatcacttgagcccaggaggttgaggctgcagtgagccatgatggygccacagcactccagcctgggagacaaagtgagaacctgtctcaaaaacaaacacaaacacaaaacaaaaaacaaacacagaaaagggtcaagtgctcct

SEQ ID NO: 18049 - DNA, 201 bp, Homo sapiens
taagatatacagacaatggcattatggtggcctgtgaatctaataacttcatgaaaatacaaagaaaatgaagagagctttacatgtcttattctgtaaawaacctatgtatttttttacctcacctacaaaaactcaaaatcttcatatttacagaatatcctgagctcctacatgcttgagtagtagaaatcccgtcct

SEQ ID NO: 18050 - DNA, 201 bp, Homo sapiens
aggtttctccatgttggtcagcctggttctctaggagcacttgaccaacgcctgacctcaagtgatccacccgctcggcctctcaaagggctgggattacrggcctgagccactgcatctgcccagattattatttcttaggcatgttcactatgtaattgattcctagatgttgaaaataggaataatgtgattaggcta

SEQ ID NO: 18051 - DNA, 201 bp, Homo sapiens
gggtcatttccagcatcaccaggatctggaaggtccagtctccattacggatcaggttggtggacacgaccccagctgtttcctcctgtccattcaggaascatcggacttgaatgctgcctgggtagaaatccgtcacgtggcagacaagcaggttgtggtgctgcaagggccccttcttggagggggaaacattcaccc

SEQ ID NO: 18052 - DNA, 201 bp, Homo sapiens
caccccatccgggaagtgaggggcgcctctgcccggccgcccctactgggaagtgaagagcccctctgcccagccagccgccccgtccgggagggaggtgrggggtcagccccctgccccgccagccgccccgtccgggagggaggtgggggggtcagccccccgcccggccagccaccccatccgggaagtgaggggcgc

SEQ ID NO: 18053 - DNA, 201 bp, Homo sapiens
cggccagccgccccatccgggagggaggtgggggggtcagccccccgcccggccagccaccccatccgggaagtgaggggcgcctctgcccggccgcccckactgggaagtgaagagcccctctgcccagccagccgccccgtccgggagggaggtggggggtcagccccctgccccgccagccgccccgtccgggaggga

SEQ ID NO: 18054 - DNA, 201 bp, Homo sapiens
cttagggcaggagcccccgcagcctgtctcagaatttgatcccttaaagataacgtcccctaggaattgttccctgagccagaccctccaagaatggcagytcggctcttacctggagtggccctgccctggaccacagatgtgagcagcaccatcagtaacgccgtcagagccactgtccggggggccgcagaaacctgc

SEQ ID NO: 18055 - DNA, 201 bp, Homo sapiens
gtctgggggcactgagtctggagatctgtgcatcacagaggatctccagaagagtcttcagaggagtgaggttggggacctgcgggcctggaggagaaacycacactccttaggctggcatcagggctgtctgcaatctggcagttgattactgtgaaagaaaatgctgccatgtcactgattggtgcctctacaaagtct

SEQ ID NO: 18056 - DNA, 201 bp, Homo sapiens
agatggggtttggacatggccccagggtatagatgcagaagataagatgagtggaccccagagccagagagtcccctgctcttcagaggtggggtctagabggtcatcagagactcactccactccacggtgacaggactatccaggctggtgtgctccacttggcaggtgtagacatctccctgctggggggtcatttcc

SEQ ID NO: 18057 - DNA, 201 bp, Homo sapiens
tccagtaatctaccctcagtccctgtcacatggctccactgcctcatctcattccccctacaaacctcaacccagcctttgcctgtcctccctttcactgyccagcatcacatgcccccttctgctctctgctcccccacctctgggtttccttggtggctcccaacactgtccctcatcccacatgacagctctgcctat

SEQ ID NO: 18058 - DNA, 201 bp, Homo sapiens
tcagtccctgtcacatggctccactgcctcatctcattccccctacaaacctcaacccagcctttgcctgtcctccctttcactgcccagcatcacatgcycccttctgctctctgctcccccacctctgggtttccttggtggctcccaacactgtccctcatcccacatgacagctctgcctatgggatgggggcgctg

SEQ ID NO: 18059 - DNA, 201 bp, Homo sapiens
acttgggtttttttggtctctttcacaggcttttctgtcttggccaaatcacaactgtccagttcccaggatccggtcctttgctcttccccctgggtccyctctccctggatggtctcatgtatctcagtctcctccccggctgcagacccttctgtctacctgcccatcagaccacccatctgcccctcaagcacctca

SEQ ID NO: 18060 - DNA, 201 bp, Homo sapiens
gctaccctgaaagatgaggaggtgacatgatgtcagtaccttctaggtgtgtcctaggaggggtgtggagaggtctaggaggaagggtgtaagcaggaaargtggaagtcagtggaaaactaaggtacctactttgcagtccttcctctcagagtgttggtgtaaatttggactagaaatgtcctgagagtacaatggttg

SEQ ID NO: 18061 - DNA, 201 bp, Homo sapiens
ggtcatgggcccgcccagctcgtagttgtgtctgcacatcctgtccggcactgcccgcttctcctccaggatgtccttctggctgttccagtactccgcakcaggccgccccagctccgtcaccgcccggaactcccccacgtcgctgtcgaagcgcgcgaactcctcccggttgtagatgtatctctccaggaagcgctg

SEQ ID NO: 18062 - DNA, 201 bp, Homo sapiens
ttcctcagcctcccgaatagctgggattataggtgcctgccacttcacctggctaatttttgtattattagtagagacaaggtttctccatgttggtcagsctggttctctaggagcacttgaccaacgcctgacctcaagtgatccacccgctcggcctctcaaagggctgggattacgggcctgagccactgcatctgc

SEQ ID NO: 18063 - DNA, 201 bp, Homo sapiens
agtaaagtttccaacaaatagaaattaatgacactttggtagcactaatatggagattatcctttcattgagccttttatcctctgttctcctttgaagarcccctcactgtcaccttcccgagaataccctaagaccaataaatacttcagtatttcagagcggggagactctgagtcattcttactggaagtctaggac

SEQ ID NO: 18064 - DNA, 201 bp, Homo sapiens
gaaattaatgacactttggtagcactaatatggagattatcctttcattgagccttttatcctctgttctcctttgaagaacccctcactgtcaccttccygagaataccctaagaccaataaatacttcagtatttcagagcggggagactctgagtcattcttactggaagtctaggaccaggtcacatgtgaatacta

SEQ ID NO: 18065 - DNA, 201 bp, Homo sapiens
gacactttggtagcactaatatggagattatcctttcattgagccttttatcctctgttctcctttgaagaacccctcactgtcaccttcccgagaatacyctaagaccaataaatacttcagtatttcagagcggggagactctgagtcattcttactggaagtctaggaccaggtcacatgtgaatactatttcttgaa

SEQ ID NO: 18066 - DNA, 201 bp, Homo sapiens
tggtagaaattcctaatgagctcagctgtctcttcagggcttccctgcccagtctcttaacatttaaacatgtcatttaccttaaaaacataagtgcaaaycaactgataaaaaacaaccttgccttcagtctgcatcctgtcccagagacactttctttgtgtcctcacacgtggagctaagcttctgacttgtctctgg

SEQ ID NO: 18067 - DNA, 201 bp, Homo sapiens
tgcaaagcactaataacagaatctctcatgtcctaatctgttagtaattattatttatgcaaggtaaggctaccacaaataagataaaatattaacgtaayatatgtacttcatcattacattaaatagtaaatgttttgtgaccttctctatgagtatcaaataaatagctcaaaattgaaatatttaaaatgagactag

SEQ ID NO: 18068 - DNA, 201 bp, Homo sapiens
gggctcttcctgggtctttgtgggtggtcacaagctttcctctctcaagacagcagggttgcatggtcttgatagccttgtgattcgggttctgagagatycaggactgcaagggaggcctagacttttgatagctgcaaggactcagccagagatggaccgtagtgaatgctcctttttcctgtagctgaaatcagggag

SEQ ID NO: 18069 - DNA, 201 bp, Homo sapiens
taaaagtgttcctatttctccacatcctctccagcacctgttgtttcctgactttttaatgatcgccattttaactggtgtgagatggtatctcaagacaktgtggcaattcctcaaagatctagaactagaaataccatttgacccagccatcccattactggatatatacccaaaggattataaatcatgctgctataa

SEQ ID NO: 18070 - DNA, 201 bp, Homo sapiens
gctgggaagagaggacactgccttagggcaggagcccccgcagcctgtctcagaatttgatcccttaaagataacgtcccctaggaattgttccctgagcyagaccctccaagaatggcagttcggctcttacctggagtggccctgccctggaccacagatgtgagcagcaccatcagtaacgccgtcagagccactgtc

SEQ ID NO: 18071 - DNA, 201 bp, Homo sapiens
ttctgacaatacttatctggctacatgggaacctctagggagctgattacaagcagagatccccagacctccccacccagggaatctgagtctgggggcastgagtctggagatctgtgcatcacagaggatctccagaagagtcttcagaggagtgaggttggggacctgcgggcctggaggagaaacccacactcctta

SEQ ID NO: 18072 - DNA, 201 bp, Homo sapiens
caggatctggaaggtccagtctccattacggatcaggttggtggacacgaccccagctgtttcctcctgtccattcaggaaccatcggacttgaatgctgyctgggtagaaatccgtcacgtggcagacaagcaggttgtggtgctgcaagggccccttcttggagggggaaacattcaccctaggctggactaggagcgt

SEQ ID NO: 18073 - DNA, 201 bp, Homo sapiens
attacggatcaggttggtggacacgaccccagctgtttcctcctgtccattcaggaaccatcggacttgaatgctgcctgggtagaaatccgtcacgtggyagacaagcaggttgtggtgctgcaagggccccttcttggagggggaaacattcaccctaggctggactaggagcgtggaagaaaaataatgaaatagaat

SEQ ID NO: 18074 - DNA, 201 bp, Homo sapiens
agctgtttcctcctgtccattcaggaaccatcggacttgaatgctgcctgggtagaaatccgtcacgtggcagacaagcaggttgtggtgctgcaagggcyccttcttggagggggaaacattcaccctaggctggactaggagcgtggaagaaaaataatgaaatagaatttgagattgtccttctttccttccttcctt

SEQ ID NO: 18075 - DNA, 201 bp, Homo sapiens
tattcattctctagctttgaccacttgcatattcaaactgacattttgtcgtgtttttctctactgtctttatgcagcggaccatgtgtcaacttatgccrcgtttgtacagacgcatagaccaacaggggagtttatgtttgaatttgatgaagatgagatgttctatgtggatctggacaagaaggagaccgtctggca

SEQ ID NO: 18076 - DNA, 201 bp, Homo sapiens
tctcatctaatcctctttctccctctctctctcaatattaacgattcttcccaaatcttcccacccagggctggattttaaaataggagttttcctagtaycgagttctgtggtcctaagcgggtcgcagagcctctccaggcctgttttctcaccacgcagagagagaatttactgaaaagaatgagctcaggggcactg

SEQ ID NO: 18077 - DNA, 201 bp, Homo sapiens
tccgggagggaggtgggggggtcagccccccgcccggccagccaccccatccgggaagtgaggggcgcctctgcccggccgcccctactgggaagtgaagrgcccctctgcccagccagccgccccgtccgggagggaggtggggggtcagccccctgccccgccagccgccccgtccgggagggaggtgggggggtcagc

SEQ ID NO: 18078 - DNA, 201 bp, Homo sapiens; identical to SEQ ID NO: 1864

SEQ ID NO: 18079 - DNA, 201 bp, Homo sapiens
ctagcactcagtaaacaataaaatatttaggaaaaaacttcatgaggacatgatagatttaaataacattatcaatgaaccaacgtgatctaatcaagatytgtagaatattccacccaatagtggcagaatacacattattttcaaatgctcaagaatattccacaggacagactatacactgggtcataaacacatata

SEQ ID NO: 18080 - DNA, 201 bp, Homo sapiens
ttcccacccagggctggattttaaaataggagttttcctagtaccgagttctgtggtcctaagcgggtcgcagagcctctccaggcctgttttctcaccaygcagagagagaatttactgaaaagaatgagctcaggggcactgagtgatcactagggaggggcgagcactgaggggaaggcagtcccttctgctggtggc

SEQ ID NO: 18081 - DNA, 201 bp, Homo sapiens
tggagatctgtgcatcacagaggatctccagaagagtcttcagaggagtgaggttggggacctgcgggcctggaggagaaacccacactccttaggctggyatcagggctgtctgcaatctggcagttgattactgtgaaagaaaatgctgccatgtcactgattggtgcctctacaaagtcttagtaacagtttttgcca

SEQ ID NO: 18082 - DNA, 201 bp, Homo sapiens; identical to SEQ ID NO: 1683

SEQ ID NO: 18083 - DNA, 201 bp, Homo sapiens
ttctagatttgggtggacatccaccctggaattgtcactacttctttcctcccccttccacctctcccttgcctctgtgttttccctgttctaactcatgycttgattgcaatttccctgacaaataatagcagtttcctacctcatctccctgcctctggtccctcctctagccagcacccttagtagtcttctgaagac

SEQ ID NO: 18084 - DNA, 201 bp, Homo sapiens
aaaaacaaacacagaaaagggtcaagtgctcctagagaacagttcattcagggagatccactagagaacagctctttcagaggactaccctagagaacagytcatcaagaggaatgtctcaaattagtcttctaggtccctaatcactcagttctttcctttctacttcctggagaacacaaataccctaacatggcgctg

SEQ ID NO: 18085 - DNA, 201 bp, Homo sapiens
atttttgtattattagtagagacaaggtttctccatgttggtcagcctggttctctaggagcacttgaccaacgcctgacctcaagtgatccacccgctcrgcctctcaaagggctgggattacgggcctgagccactgcatctgcccagattattatttcttaggcatgttcactatgtaattgattcctagatgttgaa

SEQ ID NO: 18086 - DNA, 201 bp, Homo sapiens
aatctgtgagttgggaggtgagagcagaagagtcccgtagttccttctcactctgatgcatttatcattctaaacccagactttcacatacacattcatcrttttctttcatgataatagttgcttttatcctcttatctttgctaattcttacaaactaataaagactaagaaacaaaataaattaaatcctacaggtgt

SEQ ID NO: 18087 - DNA, 201 bp, Homo sapiens
cagttcaaatacatttcaccaaggcaaggattcctgtttgttctagttgccttctctaatgcccagaaaacatttgctcaattacttctagatttgggtgracatccaccctggaattgtcactacttctttcctcccccttccacctctcccttgcctctgtgttttccctgttctaactcatgccttgattgcaatttc

SEQ ID NO: 18088 - DNA, 201 bp, Homo sapiens
aagaaacaaaataaattaaatcctacaggtgttccaaactcagcaataatttctagttggcctctaaaacaaaaatcaaaatataaatgtaagaaaagttyagaatgcttagtacctgtgtgatgaaataatctgtacactaaacccccaagtcatgagtttacctatacaacaaacctgcacatgtactcctgaacataa

SEQ ID NO: 18089 - DNA, 201 bp, Homo sapiens
gaaacaaaagtttggaacaaatgccaaaataactgtactgtacttttgaatttatatgccccaaatgaaaaatattatcaacaaagctatacattctacaktttcatgttcataaactaagacagaaactttaaaactgtcaagagccctaaaatttgaaggatattttcttcttcctctcaattttgtatttttttctac

SEQ ID NO: 18090 - DNA, 201 bp, Homo sapiens
tatttctatacataattacaacacagtgtggtgggtgcctgtaactacttactgtctctacttggactcattccatggcaatgttcacacaaaaaatgccyctccagagatcttacaggtttctatttatcataacactcaccatgctttatatttttatatgttttgggaattctcttagcattagacagtgaacttcca

SEQ ID NO: 18091 - DNA, 201 bp, Homo sapiens
tggctacatgggaacctctagggagctgattacaagcagagatccccagacctccccacccagggaatctgagtctgggggcactgagtctggagatctgygcatcacagaggatctccagaagagtcttcagaggagtgaggttggggacctgcgggcctggaggagaaacccacactccttaggctggcatcagggctg

SEQ ID NO: 18092 - DNA, 201 bp, Homo sapiens
aacactggacattatccagttttctaacttttgccaatttcatgtgcataaagaaatatgctgttttattttgcatttctttaattactaataattggggytataattaggactgattagccacttgggggttccttttctataaattgcctgttcacattcattgtccatttttgtactatgtgcttccatcattttctt

SEQ ID NO: 18093 - DNA, 201 bp, Homo sapiens
actattcacaatagcaaagacttggaaccaacccaactgtccatcagtgatagactggattaagaaaatgcacacatatacaccatggaatactgtgcagycataaaaaaggatgagttcatgtcctttgtagggacatggaggaagctggaaatcatcattcacagcaaactattgcaaggacaaaaaaccaaagaccac

SEQ ID NO: 18094 - DNA, 201 bp, Homo sapiens
cagaacattccacgagaggcatcttgctcaatattctttgacaggagcaggtcagcctggagccacatcagtgacctccagggtgcgctggagttaaggcytgatacccaatggcctcatttctgacccagttcaaatacatttcaccaaggcaaggattcctgtttgttctagttgccttctctaatgcccagaaaacat

SEQ ID NO: 18095 - DNA, 201 bp, Homo sapiens
gcctcatgcaccccctcccattccagctcctgccgctgcggccaacctgctctccccaggtctccctggtttccaaacccactttccatcttctgttttcygaccttcccaagtcactggcaccgctgtccactgtgctgctgaggtcacctcccctcagcttccaagactcttctctgcgggcctctcctcacactgcac

SEQ ID NO: 18096 - DNA, 201 bp, Homo sapiens
agggaatctgagtctgggggcactgagtctggagatctgtgcatcacagaggatctccagaagagtcttcagaggagtgaggttggggacctgcgggcctrgaggagaaacccacactccttaggctggcatcagggctgtctgcaatctggcagttgattactgtgaaagaaaatgctgccatgtcactgattggtgcct

SEQ ID NO: 18097 - DNA, 201 bp, Homo sapiens
ggaagttgcctctcaaaatgcctgagaagaggctaaaatgctgaaggaagagaactgttcctatgtgtgaggtcagttcctaagtgtgagggtttcgagaycagtcagtgtccctagattctctgacaagggggagaactatgaatcttcaggaacccctaagccaaggtcaggaagtctccatttccctggcttcaaact

SEQ ID NO: 18098 - DNA, 201 bp, Homo sapiens
cagagactcactccactccacggtgacaggactatccaggctggtgtgctccacttggcaggtgtagacatctccctgctggggggtcatttccagcatcwccaggatctggaaggtccagtctccattacggatcaggttggtggacacgaccccagctgtttcctcctgtccattcaggaaccatcggacttgaatgct

SEQ ID NO: 18099 - DNA, 201 bp, Homo sapiens
gcattcctgccgtccctggaaaaggtaattctctgcggggagggggcggacatgagcggaggcgccactctcatctaatcctctttctccctctctctctyaatattaacgattcttcccaaatcttcccacccagggctggattttaaaataggagttttcctagtaccgagttctgtggtcctaagcgggtcgcagagc

SEQ ID NO: 18100 - DNA, 201 bp, Homo sapiens
agaaagtctggatccaagactgtttatccactgtcctattcaccctattttgtgaaggaaaagaccaagttcaaattctccagagtccattgccaaataayggagtcagatctatatttctatacataattacaacacagtgtggtgggtgcctgtaactacttactgtctctacttggactcattccatggcaatgttca

SEQ ID NO: 18101 - DNA, 201 bp, Homo sapiens
attcattctctagctttgaccacttgcatattcaaactgacattttgtcgtgtttttctctactgtctttatgcagcggaccatgtgtcaacttatgccgygtttgtacagacgcatagaccaacaggggagtttatgtttgaatttgatgaagatgagatgttctatgtggatctggacaagaaggagaccgtctggcat

SEQ ID NO: 18102 - DNA, 201 bp, Homo sapiens
aggatgtccttctggctgttccagtactccgcagcaggccgccccagctccgtcaccgcccggaactcccccacgtcgctgtcgaagcgcgcgaactcctsccggttgtagatgtatctctccaggaagcgctgtgtcccattaaacgcgtagcattcctgccgtccctggaaaaggtaattctctgcggggagggggcgg

SEQ ID NO: 18103 - DNA, 201 bp, Homo sapiens
attgcaagcaatgcttgtatctcacatggaactgcatatacatgtgggcctgacctgcatccctggaatgtatgtatcctagaaaggggttgcagggttgytggagatgcagctccttaatttgactaaacactgctcatcttctcatcagaatggctgtactcatctgaacttcctttgtcagtactctaattgtcctgc

SEQ ID NO: 18104 - DNA, 201 bp, Homo sapiens
gtgctgtttggtcgcatcttgtgtatacctacgtatctgcacttatccttctgaacctgctgttgtcctgtcacttgtgtttccttctgtgacttatacgygtctgcagaacaggacgtatgtattatttttatttgggtatttagcatctaacagtgtttgacatatagtagtcttttaatacatatttttgtctgaatg

SEQ ID NO: 18105 - DNA, 201 bp, Homo sapiens
ctcttaccttcttcctttttatattcataagtctttattcattctctagctttgaccacttgcatattcaaactgacattttgtcgtgtttttctctactktctttatgcagcggaccatgtgtcaacttatgccgcgtttgtacagacgcatagaccaacaggggagtttatgtttgaatttgatgaagatgagatgttc

SEQ ID NO: 18106 - DNA, 201 bp, Homo sapiens
ggaatacttgggtatctgttttaaggtcccagaacattccacgagaggcatcttgctcaatattctttgacaggagcaggtcagcctggagccacatcagygacctccagggtgcgctggagttaaggcctgatacccaatggcctcatttctgacccagttcaaatacatttcaccaaggcaaggattcctgtttgttct

SEQ ID NO: 18107 - DNA, 201 bp, Homo sapiens
tgtgatctccccagcttcctcctcctcctcccttcatttttttcctctttctagaaaaaaggtccagggctcaatcccacatcctgatactactccctcargtccctcaggttggtgcaccaggctccccaccccacaagttcacaggaggaagccaaagctccaaggccttcctgtcccatccttgagaaatcctcttac

SEQ ID NO: 18108 - DNA, 201 bp, Homo sapiens
cacaaaaaaatctacaggccaacttcatgctctctacataatgccctctttaaatatgaaggcaaagacaggtaaaaagtaaaagaatgggaaaatacatrtataccgtggaatgctatgcagccataaaaaaatgagttcatgttgtttgtggggacatggatgaagctggaagccatccttcacagcaaactaacacag

SEQ ID NO: 18109 - DNA, 201 bp, Homo sapiens
ctataatgatttgtaacagagtgaagtgaatgtagaatgtcagatgttaagaggaagaatggaaaagagggctgggactagggtgatgtaggggatgcacytggcttaggtgcaaaatttgggggataccaaaagaactcagtaataaatcatattttaatgaaatatcttgaaaaggcaaaattaatgcaaagatacatg

SEQ ID NO: 18110 - DNA, 201 bp, Homo sapiens
ataggtgcctgccacttcacctggctaatttttgtattattagtagagacaaggtttctccatgttggtcagcctggttctctaggagcacttgaccaackcctgacctcaagtgatccacccgctcggcctctcaaagggctgggattacgggcctgagccactgcatctgcccagattattatttcttaggcatgttca

SEQ ID NO: 18111 - DNA, 201 bp, Homo sapiens
ttatttctaatgttatgttataataaacaccacaataggcttctcttcatagatgcaaatactttttagtattcttggtagaaattcctaatgagctcagytgtctcttcagggcttccctgcccagtctcttaacatttaaacatgtcatttaccttaaaaacataagtgcaaaccaactgataaaaaacaaccttgcct

SEQ ID NO: 18112 - DNA, 201 bp, Homo sapiens
ctgaagacagaatgttccatatcagagctgtgatcttgagagccctctccttggctttcctgctgagtctccgaggagctggggccatcaagggtgagtgstcaggaggacgcaggagcgtcggggtgagtgatggggtggttcacatcaattgctgcttcagggatcacagattttaggggctcattgatctatctggtc

SEQ ID NO: 18113 - DNA, 201 bp, Homo sapiens
cttcttcttccccatatgtccttcctttgacctcttaccttcttcctttttatattcataagtctttattcattctctagctttgaccacttgcatattcraactgacattttgtcgtgtttttctctactgtctttatgcagcggaccatgtgtcaacttatgccgcgtttgtacagacgcatagaccaacaggggagtt

SEQ ID NO: 18114 - DNA, 201 bp, Homo sapiens
gggagggaggtgggggggtcagccccccgcccggccagccaccccatccgggaagtgaggggcgcctctgcccggccgcccctactgggaagtgaagagcscctctgcccagccagccgccccgtccgggagggaggtggggggtcagccccctgccccgccagccgccccgtccgggagggaggtgggggggtcagcccc

SEQ ID NO: 18115 - DNA, 201 bp, Homo sapiens
cttctagatttgggtggacatccaccctggaattgtcactacttctttcctcccccttccacctctcccttgcctctgtgttttccctgttctaactcatkccttgattgcaatttccctgacaaataatagcagtttcctacctcatctccctgcctctggtccctcctctagccagcacccttagtagtcttctgaaga

SEQ ID NO: 18116 - DNA, 201 bp, Homo sapiens
gaccttagcaagttattaatatgtaacttccctgcatttccttacctgtaaaatgtatgatatgtatttgcttcatagggttattgtgacaattcagcgastgaaatatgtaaagtatttagaaggatgcctggcacaagtaagtgctcaacaaatgttagctgtcattgttactattactattgtgtagggtcaggatgc

SEQ ID NO: 18117 - DNA, 201 bp, Homo sapiens
tgggggagtcagtcccccgcccggccagccgccccatccgggagggaggtgggggggtcagccccccgcccggccagccaccccatccgggaagtgagggkcgcctctgcccggccgcccctactgggaagtgaagagcccctctgcccagccagccgccccgtccgggagggaggtggggggtcagccccctgccccgcc

SEQ ID NO: 18118 - DNA, 201 bp, Homo sapiens
cgtccggcaggtgaggggcgcctctgcccggcccgcccctactgggaagtgaggagcccctctgcccggccagccgccccatccgggagggaggtgggggrgtcagtcccccgcccggccagccgccccatccgggagggaggtgggggggtcagccccccgcccggccagccaccccatccgggaagtgaggggcgcctc

SEQ ID NO: 18119 - DNA, 201 bp, Homo sapiens
ccatgcagatgaccacatctaattcattattattattgttattcatgctggacctcaggtacaaaaggttaagaacttctcagttcattatatgatcatcrttggtgcctccgagctctctctctctcccttgatttatttggtcccttttatctccagtccttactcccatatctaacctcttacccctacctcataggt

SEQ ID NO: 18120 - DNA, 201 bp, Homo sapiens
cgccccatccgggagggaggtgggggggtcagccccccgcccggccagccaccccatccgggaagtgaggggcgcctctgcccggccgcccctactgggargtgaagagcccctctgcccagccagccgccccgtccgggagggaggtggggggtcagccccctgccccgccagccgccccgtccgggagggaggtggggg

SEQ ID NO: 18121 - DNA, 201 bp, Homo sapiens
gctccccaccccacaagttcacaggaggaagccaaagctccaaggccttcctgtcccatccttgagaaatcctcttactgcacacacctcacctctctccrtccctttacacccagacttcctgaaggaaaaagacgaatgaactgagacactgccctgtgacagccgtggggaacccaagacaagtaaaatccatctcag

SEQ ID NO: 18122 - DNA, 201 bp, Homo sapiens
cgaagaaaagagctttaaatggctcacagatctgcaggctgtacgcgaaacatggcactagcatctgcttctgttgggggattctggaagcttttactcayggtggaaggcaagtggagccagtgcatcacatggtcatagagggagaaagagacatagaaagaggtgccagcctctttttaacaaccaggtttcatgtgc

SEQ ID NO: 18123 - DNA, 201 bp, Homo sapiens
gcagagatccccagacctccccacccagggaatctgagtctgggggcactgagtctggagatctgtgcatcacagaggatctccagaagagtcttcagagragtgaggttggggacctgcgggcctggaggagaaacccacactccttaggctggcatcagggctgtctgcaatctggcagttgattactgtgaaagaaaa

SEQ ID NO: 18124 - DNA, 201 bp, Homo sapiens
gtgccccagcttgtcctgttgttctcaggtgaatttccacactgccactggcaacttttcttttggatctctgccaccagtacctttttcctcctcagaargcagaaaaggccaggcatggtggtcatgcctataatcttagcactttgggaggttgaggcatgaggatcacttgagcccagggttttgagaccggcctgg

SEQ ID NO: 18125 - DNA, 201 bp, Homo sapiens
tgctaaggcaagatcccaggtcttgactcagatatcctgacctgcctcttctcctggtgccttgggccccagaccctaaaattccaggcccagagcccccyagctccttgagtccagattcctcctcctctgccatccatccgcccctgcctgttcaattgccccactctgagtgtggattctcccattttcatttgttag

SEQ ID NO: 18126 - DNA, 201 bp, Homo sapiens
cctgggtagaaatccgtcacgtggcagacaagcaggttgtggtgctgcaagggccccttcttggagggggaaacattcaccctaggctggactaggagcgkggaagaaaaataatgaaatagaatttgagattgtccttctttccttccttccttccttccttccttccttccttccttccttccttccttttttttgaga

SEQ ID NO: 18127 - DNA, 201 bp, Homo sapiens
ctatgtatttttttacctcacctacaaaaactcaaaatcttcatatttacagaatatcctgagctcctacatgcttgagtagtagaaatcccgtccttttycaagttcctcctctgtgctgcgtcttcaggtcccatgaaggtctcacagatgaccaggtgttgcctccctctgcatctttgcatttgtgccccagcttgt

SEQ ID NO: 18128 - DNA, 201 bp, Homo sapiens
tcctccaggatgtccttctggctgttccagtactccgcagcaggccgccccagctccgtcaccgcccggaactcccccacgtcgctgtcgaagcgcgcgarctcctcccggttgtagatgtatctctccaggaagcgctgtgtcccattaaacgcgtagcattcctgccgtccctggaaaaggtaattctctgcggggagg

SEQ ID NO: 18129 - DNA, 201 bp, Homo sapiens
ggagtgaggttggggacctgcgggcctggaggagaaacccacactccttaggctggcatcagggctgtctgcaatctggcagttgattactgtgaaagaaratgctgccatgtcactgattggtgcctctacaaagtcttagtaacagtttttgccaattgcgttatttttatttgaacacctctctcaaccaattacctc

SEQ ID NO: 18130 - DNA, 201 bp, Homo sapiens
ctagctacatgggaggctgaggcaggaggatcacttgagcccaggaggttgaggctgcagtgagccatgatggtgccacagcactccagcctgggagacaragtgagaacctgtctcaaaaacaaacacaaacacaaaacaaaaaacaaacacagaaaagggtcaagtgctcctagagaacagttcattcagggagatcca

SEQ ID NO: 18131 - DNA, 201 bp, Homo sapiens
acatttaggagaaattttaaccaaaagtaatttgggcaaagaatatttgatcaactgtgaaattacctaccttttcaaagttctatcttgatacaaaggawgcaaaatttactcaaataatatcttgaaattaagatatacagacaatggcattatggtggcctgtgaatctaataacttcatgaaaatacaaagaaaatg

SEQ ID NO: 18132 - DNA, 201 bp, Homo sapiens
gaagaaaaataatgaaatagaatttgagattgtccttctttccttccttccttccttccttccttccttccttccttccttccttccttttttttgagacrtaatctcgctctttctttctttcattctttctttttgttgagatggagtgtcactctgttgccaagtctggaatgcagtggcgcaatattggctcactgc

SEQ ID NO: 18133 - DNA, 201 bp, Homo sapiens
tagaaatccgtcacgtggcagacaagcaggttgtggtgctgcaagggccccttcttggagggggaaacattcaccctaggctggactaggagcgtggaagraaaataatgaaatagaatttgagattgtccttctttccttccttccttccttccttccttccttccttccttccttccttccttttttttgagacataat

SEQ ID NO: 18134 - DNA, 201 bp, Homo sapiens
ggcgcctctgcccggcccgcccctactgggaagtgaggagcccctctgcccggccagccgccccatccgggagggaggtgggggagtcagtcccccgcccrgccagccgccccatccgggagggaggtgggggggtcagccccccgcccggccagccaccccatccgggaagtgaggggcgcctctgcccggccgccccta

SEQ ID NO: 18135 - DNA, 201 bp, Homo sapiens
caaatacatttcaccaaggcaaggattcctgtttgttctagttgccttctctaatgcccagaaaacatttgctcaattacttctagatttgggtggacatmcaccctggaattgtcactacttctttcctcccccttccacctctcccttgcctctgtgttttccctgttctaactcatgccttgattgcaatttccctga

SEQ ID NO: 18136 - DNA, 201 bp, Homo sapiens
cacctacaaaaactcaaaatcttcatatttacagaatatcctgagctcctacatgcttgagtagtagaaatcccgtcctttttcaagttcctcctctgtgmtgcgtcttcaggtcccatgaaggtctcacagatgaccaggtgttgcctccctctgcatctttgcatttgtgccccagcttgtcctgttgttctcaggtga

SEQ ID NO: 18137 - DNA, 201 bp, Homo sapiens
caaaaaatgcccctccagagatcttacaggtttctatttatcataacactcaccatgctttatatttttatatgttttgggaattctcttagcattagacrgtgaacttccatgcagatgaccacatctaattcattattattattgttattcatgctggacctcaggtacaaaaggttaagaacttctcagttcattata

SEQ ID NO: 18138 - DNA, 201 bp, Homo sapiens
ttgtgaaggaaaagaccaagttcaaattctccagagtccattgccaaataatggagtcagatctatatttctatacataattacaacacagtgtggtgggwgcctgtaactacttactgtctctacttggactcattccatggcaatgttcacacaaaaaatgcccctccagagatcttacaggtttctatttatcataac

SEQ ID NO: 18139 - DNA, 201 bp, Homo sapiens
ccggccagccaccccatccgggaagtgaggggcgcctctgcccggccgcccctactgggaagtgaagagcccctctgcccagccagccgccccgtccgggwgggaggtggggggtcagccccctgccccgccagccgccccgtccgggagggaggtgggggggtcagccccccgcccggccagccaccccatccgggaagt

SEQ ID NO: 18140 - DNA, 201 bp, Homo sapiens
cctatctcttcattcttcccccagaggcccaagagccaatccagatgcctgagacaacggagactgtgctctgtgccctgggcctggtgctgggcctagtsggcatcatcgtgggcaccgtcctcatcataaagtctctgcgttctggccatgacccccgggcccaggggaccctgtgaaatactgtaaaggtgggaatgt

SEQ ID NO: 18141 - DNA, 201 bp, Homo sapiens
aaaatgccaataaacaaaaatgacaataaatttgacaatttacattgttaaattaaattaaatttggtgtaaagctttctccatatcttaaattcctacakagcaaactaacccaacttaacataactgcgttatgcaaacaaactacagcctaacttaagagtgttgtaataaatagctgagtctcagccaatcacaggc

SEQ ID NO: 18142 - DNA, 201 bp, Homo sapiens
ccctcaggtttaatatgaggtttaaatgaggtaatgcatgcaaagcactaataacagaatctctcatgtcctaatctgttagtaattattatttatgcaasgtaaggctaccacaaataagataaaatattaacgtaatatatgtacttcatcattacattaaatagtaaatgttttgtgaccttctctatgagtatcaaa

SEQ ID NO: 18143 - DNA, 201 bp, Homo sapiens
cccgcccggccagccaccccatccgggaagtgaggggcgcctctgcccggccgcccctactgggaagtgaagagcccctctgcccagccagccgccccgtmcgggagggaggtggggggtcagccccctgccccgccagccgccccgtccgggagggaggtgggggggtcagccccccgcccggccagccaccccatccgg

SEQ ID NO: 18144 - DNA, 201 bp, Homo sapiens
aaggttacacagcagatcaacgagccaagtttgaagtccagacccagctctgagggtcatacactgccttccccagattcctgcacacagtgacctactaycagggccctcctatctctctgggatccccagcctctatcttttgtggctgctttacaggaactccgagctatggactctgcattaggagacgaagtgcaa

SEQ ID NO: 18145 - DNA, 201 bp, Homo sapiens
acaagcagagatccccagacctccccacccagggaatctgagtctgggggcactgagtctggagatctgtgcatcacagaggatctccagaagagtcttcrgaggagtgaggttggggacctgcgggcctggaggagaaacccacactccttaggctggcatcagggctgtctgcaatctggcagttgattactgtgaaag

SEQ ID NO: 18146 - DNA, 201 bp, Homo sapiens
gtctgcaatctggcagttgattactgtgaaagaaaatgctgccatgtcactgattggtgcctctacaaagtcttagtaacagtttttgccaattgcgttayttttatttgaacacctctctcaaccaattacctcagcaactttcctaagctcatgtcactcacctcatccccacccagtgtgtccaccttctcactcata

SEQ ID NO: 18147 - DNA, 201 bp, Homo sapiens
cccacccagggaatctgagtctgggggcactgagtctggagatctgtgcatcacagaggatctccagaagagtcttcagaggagtgaggttggggacctgygggcctggaggagaaacccacactccttaggctggcatcagggctgtctgcaatctggcagttgattactgtgaaagaaaatgctgccatgtcactgatt

SEQ ID NO: 18148 - DNA, 201 bp, Homo sapiens
aatcctcttactgcacacacctcacctctctccatccctttacacccagacttcctgaaggaaaaagacgaatgaactgagacactgccctgtgacagccrtggggaacccaagacaagtaaaatccatctcagccccgaggaggatgcgccacactcagcctcatgcaccccctcccattccagctcctgccgctgcggc

SEQ ID NO: 18149 - DNA, 201 bp, Homo sapiens
tacagacaatggcattatggtggcctgtgaatctaataacttcatgaaaatacaaagaaaatgaagagagctttacatgtcttattctgtaaaaaacctakgtatttttttacctcacctacaaaaactcaaaatcttcatatttacagaatatcctgagctcctacatgcttgagtagtagaaatcccgtcctttttcaa

SEQ ID NO: 18150 - DNA, 201 bp, Homo sapiens
aatatcctgagctcctacatgcttgagtagtagaaatcccgtcctttttcaagttcctcctctgtgctgcgtcttcaggtcccatgaaggtctcacagatraccaggtgttgcctccctctgcatctttgcatttgtgccccagcttgtcctgttgttctcaggtgaatttccacactgccactggcaacttttcttttgg

SEQ ID NO: 18151 - DNA, 201 bp, Homo sapiens
cttcttccccatatgtccttcctttgacctcttaccttcttcctttttatattcataagtctttattcattctctagctttgaccacttgcatattcaaaytgacattttgtcgtgtttttctctactgtctttatgcagcggaccatgtgtcaacttatgccgcgtttgtacagacgcatagaccaacaggggagtttat

SEQ ID NO: 18152 - DNA, 201 bp, Homo sapiens
gctggtcactgagggtgtcgctgagagcctcttcctgcccagaacagattacagcttccacaagttccattacctgacctttgtgccctcagcagaggacktctatgactgcagggtggagcactggggcttggaccagccgctcctcaagcactggggtatgcaactgcttttctctccataatctcctggcatcctcta

SEQ ID NO: 18153 - DNA, 201 bp, Homo sapiens
ttgcctcttcctctgtagcccaactggaagggatgagagggcctctctgccaccctcagactaggaagcctaagtgccccctgctgtgtgatcctcttccmctagtggccatgggctgatcccactacagcaagggcttgcatcctctcttctcaggagagagaaaggtgagcagagtgaggctggtcagtggtgtgatac

SEQ ID NO: 18154 - DNA, 201 bp, Homo sapiens
ttgagaaatcctcttactgcacacacctcacctctctccatccctttacacccagacttcctgaaggaaaaagacgaatgaactgagacactgccctgtgmcagccgtggggaacccaagacaagtaaaatccatctcagccccgaggaggatgcgccacactcagcctcatgcaccccctcccattccagctcctgccgc

SEQ ID NO: 18155 - DNA, 201 bp, Homo sapiens
aagtcactggcaccgctgtccactgtgctgctgaggtcacctcccctcagcttccaagactcttctctgcgggcctctcctcacactgcacttgggttttwttggtctctttcacaggcttttctgtcttggccaaatcacaactgtccagttcccaggatccggtcctttgctcttccccctgggtcccctctccctgga

SEQ ID NO: 18156 - DNA, 201 bp, Homo sapiens
aggcttttctgtcttggccaaatcacaactgtccagttcccaggatccggtcctttgctcttccccctgggtcccctctccctggatggtctcatgtatcycagtctcctccccggctgcagacccttctgtctacctgcccatcagaccacccatctgcccctcaagcacctcaaacccagctacctccctgtaggtttc

SEQ ID NO: 18157 - DNA, 201 bp, Homo sapiens
gtgagggtttcgagaccagtcagtgtccctagattctctgacaagggggagaactatgaatcttcaggaacccctaagccaaggtcaggaagtctccattkccctggcttcaaactatgctcaggagctggtatagaagaaagatggggtttggacatggccccagggtatagatgcagaagataagatgagtggacccca

SEQ ID NO: 18158 - DNA, 201 bp, Homo sapiens
tcaagatttcaggcagattaggattccattcacagcccctgagcttccttcccaaggctgtattgtaattatagcaatatttcatggaggatttttctacrtgataaactaagagccaagaaataaaatttttaaaatgccctaattcattgcaatttttaccagccatagtcactccatgtgggagaacttaaatcatga

SEQ ID NO: 18159 - DNA, 201 bp, Homo sapiens
aattctcattccagggttaagcttcttctctgccctcagtaatgtggcccttccccttgtctgtatattttggagacatgaagcatgtgggatggcctcamagtcagctggggtttgagggtgaaattcaatgactttcgtgaactccttggctcctatgtgctcttcacctggaggaccagggcatgtgcagggatgacc

SEQ ID NO: 18160 - DNA, 201 bp, Homo sapiens
tttcaaagagcagtatacacaatgtgagcaagtatccttcgttcattgccgtcattgatatggtttggatatttgtcccttccaattctcattccagggtyaagcttcttctctgccctcagtaatgtggcccttccccttgtctgtatattttggagacatgaagcatgtgggatggcctcacagtcagctggggtttga

SEQ ID NO: 18161 - DNA, 201 bp, Homo sapiens
aataaatcagaaatagacaaattcacaattatattttagtattctagcactcagtaaacaataaaatatttaggaaaaaacttcatgaggacatgatagayttaaataacattatcaatgaaccaacgtgatctaatcaagatctgtagaatattccacccaatagtggcagaatacacattattttcaaatgctcaagaa

SEQ ID NO: 18162 - DNA, 201 bp, Homo sapiens
tcctttcaaagagcagtatacacaatgtgagcaagtatccttcgttcattgccgtcattgatatggtttggatatttgtcccttccaattctcattccagsgttaagcttcttctctgccctcagtaatgtggcccttccccttgtctgtatattttggagacatgaagcatgtgggatggcctcacagtcagctggggtt

SEQ ID NO: 18163 - DNA, 201 bp, Homo sapiens
gcatcacagaggatctccagaagagtcttcagaggagtgaggttggggacctgcgggcctggaggagaaacccacactccttaggctggcatcagggctgyctgcaatctggcagttgattactgtgaaagaaaatgctgccatgtcactgattggtgcctctacaaagtcttagtaacagtttttgccaattgcgttatt

SEQ ID NO: 18164 - DNA, 201 bp, Homo sapiens
tctttgtgtttgatggggatcatgttttatttttctttatataatgggccagtgtgttcccacaactactaaatagttcaccttttccccataggttagtrgtgtctcctttgctatactgaaagctcccattataggtgggcctgtgtctgagttccatcttgttccactgttctgtttgtctcttcttgtgccagtgtc

SEQ ID NO: 18165 - DNA, 201 bp, Homo sapiens
ggacaaagccattcatgagggtctcctccatgattcaaatacctcccaccaggccccacctgcaacactggggatcaattttcaacatgagacttggaagygacaaatatccaaatcatattaatccacatatctacattgctcctgggatacctggatcattcctggttctctactattgcaagcaatgcttgtatctca

SEQ ID NO: 18166 - DNA, 201 bp, Homo sapiens
ttgcatttgtgccccagcttgtcctgttgttctcaggtgaatttccacactgccactggcaacttttcttttggatctctgccaccagtacctttttcctyctcagaaagcagaaaaggccaggcatggtggtcatgcctataatcttagcactttgggaggttgaggcatgaggatcacttgagcccagggttttgagac

SEQ ID NO: 18167 - DNA, 201 bp, Homo sapiens
tagggaggggcgagcactgaggggaaggcagtcccttctgctggtggctggaggaggcggagacgtttcacgtggggtcactgggagaaaaaacaggggcrggaggagctggggacgtggagggcggagctgctccccctacttaactccctgactgacatttccatcctgatgtcagtcctggttcaaatgccacctcct

SEQ ID NO: 18168 - DNA, 201 bp, Homo sapiens
aagttctatcttgatacaaaggaagcaaaatttactcaaataatatcttgaaattaagatatacagacaatggcattatggtggcctgtgaatctaataayttcatgaaaatacaaagaaaatgaagagagctttacatgtcttattctgtaaaaaacctatgtatttttttacctcacctacaaaaactcaaaatcttca

SEQ ID NO: 18169 - DNA, 201 bp, Homo sapiens
cccggctgctcctgcgccctgggcacgggcccgcggggctgccctgggaccgccggcccaaagccctcactcacctcggcgctgcagggtcatgggcccghccagctcgtagttgtgtctgcacatcctgtccggcactgcccgcttctcctccaggatgtccttctggctgttccagtactccgcagcaggccgccccag

SEQ ID NO: 18170 - DNA, 201 bp, Homo sapiens
caaagggctgggattacgggcctgagccactgcatctgcccagattattatttcttaggcatgttcactatgtaattgattcctagatgttgaaaataggwataatgtgattaggctagtgggtaagggtagcattgaaaagatagaaatagaccttcaagtagagcatgcatgatcttgaataaaataatagttagtaag

SEQ ID NO: 18171 - DNA, 201 bp, Homo sapiens
acatcctgtccggcactgcccgcttctcctccaggatgtccttctggctgttccagtactccgcagcaggccgccccagctccgtcaccgcccggaactcycccacgtcgctgtcgaagcgcgcgaactcctcccggttgtagatgtatctctccaggaagcgctgtgtcccattaaacgcgtagcattcctgccgtccct

SEQ ID NO: 18172 - DNA, 201 bp, Homo sapiens
gggaccgccggcccaaagccctcactcacctcggcgctgcagggtcatgggcccgcccagctcgtagttgtgtctgcacatcctgtccggcactgcccgcytctcctccaggatgtccttctggctgttccagtactccgcagcaggccgccccagctccgtcaccgcccggaactcccccacgtcgctgtcgaagcgcgc

SEQ ID NO: 18173 - DNA, 201 bp, Homo sapiens
caacccggctgctcctgcgccctgggcacgggcccgcggggctgccctgggaccgccggcccaaagccctcactcacctcggcgctgcagggtcatgggcycgcccagctcgtagttgtgtctgcacatcctgtccggcactgcccgcttctcctccaggatgtccttctggctgttccagtactccgcagcaggccgccc

SEQ ID NO: 18174 - DNA, 201 bp, Homo sapiens
ctgagctcctacatgcttgagtagtagaaatcccgtcctttttcaagttcctcctctgtgctgcgtcttcaggtcccatgaaggtctcacagatgaccagrtgttgcctccctctgcatctttgcatttgtgccccagcttgtcctgttgttctcaggtgaatttccacactgccactggcaacttttcttttggatctct

SEQ ID NO: 18175 - DNA, 201 bp, Homo sapiens; identical to SEQ ID NO: 1738

SEQ ID NO: 18176 - DNA, 201 bp, Homo sapiens; identical to SEQ ID NO: 1740

SEQ ID NO: 18177 - DNA, 201 bp, Homo sapiens
ccagtgctgctccagcctcctctctccccagcctcacccctctgcagttcccagggctgagccgtcctgctggttagttctcagcacccttctgtgactayaagttcaagttctcctccccttcctggacaatgaacccaaggtaatagataagaggttttagggcttgaggggctgtattcaggagattccaaccttgct

SEQ ID NO: 18178 - DNA, 201 bp, Homo sapiens
aggtaatagataagaggttttagggcttgaggggctgtattcaggagattccaaccttgctaccctgaaagatgaggaggtgacatgatgtcagtaccttytaggtgtgtcctaggaggggtgtggagaggtctaggaggaagggtgtaagcaggaaaagtggaagtcagtggaaaactaaggtacctactttgcagtcct

SEQ ID NO: 18179 - DNA, 201 bp, Homo sapiens
aataagataaaatattaacgtaatatatgtacttcatcattacattaaatagtaaatgttttgtgaccttctctatgagtatcaaataaatagctcaaaaytgaaatatttaaaatgagactagaaaagtatttcttaaatatggtaaagagaatataaaataaaaaattaacattacctgtaacagaaaaacattagaga

SEQ ID NO: 18180 - DNA, 201 bp, Homo sapiens
tatgaagtagtagggctagcttccaatccagaaagtctggatccaagactgtttatccactgtcctattcaccctattttgtgaaggaaaagaccaagttsaaattctccagagtccattgccaaataatggagtcagatctatatttctatacataattacaacacagtgtggtgggtgcctgtaactacttactgtctc

SEQ ID NO: 18181 - DNA, 201 bp, Homo sapiens
cagccacataacaacaacaacaccgataactaactgagtagttaatatggtcaggcgctattctgaggatttacatttattaactcactttattctcacamatagtctttgaggtaggtactattattttcactatttcacatgagagatacttacatctttttacatacacagagactttaagcactttgatcaagttcc

SEQ ID NO: 18182 - DNA, 201 bp, Homo sapiens
acctggtgctgtctccttccagatccccctgaggtgaccgtgtttcccaaggagcctgtggagctgggccagcccaacaccctcatctgccacattgacargttcttcccaccagtgctcaacgtcacgtggctgtgcaacggggagctggtcactgagggtgtcgctgagagcctcttcctgcccagaacagattacagc

SEQ ID NO: 18183 - DNA, 201 bp, Homo sapiens
ctgagtagttaatatggtcaggcgctattctgaggatttacatttattaactcactttattctcacacatagtctttgaggtaggtactattattttcacyatttcacatgagagatacttacatctttttacatacacagagactttaagcactttgatcaagttcccacagctatgaagtagtagggctagcttccaat

SEQ ID NO: 18184 - DNA, 201 bp, Homo sapiens
gtctggatccaagactgtttatccactgtcctattcaccctattttgtgaaggaaaagaccaagttcaaattctccagagtccattgccaaataatggagycagatctatatttctatacataattacaacacagtgtggtgggtgcctgtaactacttactgtctctacttggactcattccatggcaatgttcacacaa

SEQ ID NO: 18185 - DNA, 201 bp, Homo sapiens
tttatttcaggggcacctgtgtctcactacttcattacctcggttaactcaatgtccattacactattcaacttatgtctaaatctcagttgtgaattacstacaatttcttccccatagagcttctgggaaccatgaaatcagggggaatacttgggtatctgttttaaggtcccagaacattccacgagaggcatcttg

SEQ ID NO: 18186 - DNA, 201 bp, Homo sapiens
ccgccccatccgggagggaggtgggggagtcagtcccccgcccggccagccgccccatccgggagggaggtgggggggtcagccccccgcccggccagccrccccatccgggaagtgaggggcgcctctgcccggccgcccctactgggaagtgaagagcccctctgcccagccagccgccccgtccgggagggaggtggg

SEQ ID NO: 18187 - DNA, 201 bp, Homo sapiens
cgcccctactgggaagtgaggagcccctctgcccggccagccgccccatccgggagggaggtgggggagtcagtcccccgcccggccagccgccccatccrggagggaggtgggggggtcagccccccgcccggccagccaccccatccgggaagtgaggggcgcctctgcccggccgcccctactgggaagtgaagagcc

SEQ ID NO: 18188 - DNA, 201 bp, Homo sapiens
ctctgtgttttccctgttctaactcatgccttgattgcaatttccctgacaaataatagcagtttcctacctcatctccctgcctctggtccctcctctasccagcacccttagtagtcttctgaagacacatctccaaccttctctttttcatttttcaaaaatcttcagtgttctgacaatacttatctggctacatgg

SEQ ID NO: 18189 - DNA, 201 bp, Homo sapiens
tgggctccccccatgaatccccaacccaaagtcccctttccgcccggcactaaggtcccttaggccaacccggctgctcctgcgccctgggcacgggcccrcggggctgccctgggaccgccggcccaaagccctcactcacctcggcgctgcagggtcatgggcccgcccagctcgtagttgtgtctgcacatcctgtcc

SEQ ID NO: 18190 - DNA, 201 bp, Homo sapiens
actcttaaaacatctcctacagttttaaatttcacatttactactttaattcatctgggattcatctttgtgtttgatggggatcatgttttatttttctytatataatgggccagtgtgttcccacaactactaaatagttcaccttttccccataggttagtagtgtctcctttgctatactgaaagctcccattatag

SEQ ID NO: 18191 - DNA, 201 bp, Homo sapiens
ggtggcctgtgaatctaataacttcatgaaaatacaaagaaaatgaagagagctttacatgtcttattctgtaaaaaacctatgtatttttttacctcacytacaaaaactcaaaatcttcatatttacagaatatcctgagctcctacatgcttgagtagtagaaatcccgtcctttttcaagttcctcctctgtgctgc

SEQ ID NO: 18192 - DNA, 201 bp, Homo sapiens
cggagctgctccccctacttaactccctgactgacatttccatcctgatgtcagtcctggttcaaatgccacctcctccaggaagccctcccttccttctytctcttttccatagctaagcgctctctcttctcgaccagtttcttgagaattcctcaacttgctcctgttgttttgcatgtaggagatgtagaaatatat

SEQ ID NO: 18193 - DNA, 201 bp, Homo sapiens
aactgtatttttgtttgtgtgtcttttttaaaagaagtcttccctatactgagatatcaaagatactcttaaaacatctcctacagttttaaatttcacayttactactttaattcatctgggattcatctttgtgtttgatggggatcatgttttatttttctttatataatgggccagtgtgttcccacaactactaaa

SEQ ID NO: 18194 - DNA, 201 bp, Homo sapiens
ggagaaattttaaccaaaagtaatttgggcaaagaatatttgatcaactgtgaaattacctaccttttcaaagttctatcttgatacaaaggaagcaaaawttactcaaataatatcttgaaattaagatatacagacaatggcattatggtggcctgtgaatctaataacttcatgaaaatacaaagaaaatgaagagag

SEQ ID NO: 18195 - DNA, 201 bp, Homo sapiens
attttgaaaaaactgaagctcaaaaagatgaataagttttccaaggttacacagcagatcaacgagccaagtttgaagtccagacccagctctgagggtcrtacactgccttccccagattcctgcacacagtgacctactatcagggccctcctatctctctgggatccccagcctctatcttttgtggctgctttacag

SEQ ID NO: 18196 - DNA, 201 bp, Homo sapiens
tcttattgatttgcaggtgatccttatatagtcctgctagtagtcccttgtcagttttaggcattgcaaatgttttcctctaatctgacttctggcaactktctccttggtttcctttattgaagagaaatccttaatattttgtaatgaagtccatcaactgtatttttgtttgtgtgtcttttttaaaagaagtcttcc

SEQ ID NO: 18197 - DNA, 201 bp, Homo sapiens
attctcctgcctcagcttgccgagtgcctgcgattgcaggcgcgcgccgccacacctgactggttttcgtatttttttggtggagatggggattcgctgtrttggctgggctggtctccagctcctaaccgagagtgatccgccagcctcggcctcccgaggtgccgggattgcagacagagtctcgttcactcagtgctc

SEQ ID NO: 18198 - DNA, 201 bp, Homo sapiens
tgcctgggtagaaatccgtcacgtggcagacaagcaggttgtggtgctgcaagggccccttcttggagggggaaacattcaccctaggctggactaggagygtggaagaaaaataatgaaatagaatttgagattgtccttctttccttccttccttccttccttccttccttccttccttccttccttccttttttttga

SEQ ID NO: 18199 - DNA, 201 bp, Homo sapiens
gttgcctctcaaaatgcctgagaagaggctaaaatgctgaaggaagagaactgttcctatgtgtgaggtcagttcctaagtgtgagggtttcgagaccagycagtgtccctagattctctgacaagggggagaactatgaatcttcaggaacccctaagccaaggtcaggaagtctccatttccctggcttcaaactatgc

SEQ ID NO: 18200 - DNA, 201 bp, Homo sapiens; identical to SEQ ID NO: 1751

SEQ ID NO: 18201 - DNA, 201 bp, Homo sapiens
aactgcttttctctccataatctcctggcatcctctattccaaagacctggtgtcctctgcaccagctttccgcactggctgggtctcagtcctctcctcrtcctaacatccaattaactggtccataaccttcaattcccacaaccatcccaggccatcaccaccctcactgcacctcctgaccctatctcttcattctt

SEQ ID NO: 18202 - DNA, 201 bp, Homo sapiens
ctacaaaaactcaaaatcttcatatttacagaatatcctgagctcctacatgcttgagtagtagaaatcccgtcctttttcaagttcctcctctgtgctgygtcttcaggtcccatgaaggtctcacagatgaccaggtgttgcctccctctgcatctttgcatttgtgccccagcttgtcctgttgttctcaggtgaatt

SEQ ID NO: 18203 - DNA, 201 bp, Homo sapiens
accctcatatctggaacaggggtgtgacctcaacaaggtggcaaatgctgattctggaagttgcctctcaaaatgcctgagaagaggctaaaatgctgaargaagagaactgttcctatgtgtgaggtcagttcctaagtgtgagggtttcgagaccagtcagtgtccctagattctctgacaagggggagaactatgaat

SEQ ID NO: 18204 - DNA, 201 bp, Homo sapiens
tgagcgatctcagcacagtaagatttgttgcacatcagcagcactttcagctccttgaggctgtggaccagaaacttctggaagccactgggcagcatgtkttttttgttgttgttgttgctcccataagcaatgttgggcatcaagatctggcccttggaccttctacgaaccctactgttaagacctctgggtttccgc

SEQ ID NO: 18205 - DNA, 201 bp, Homo sapiens
cattaggagacgaagtgcaaagagtgtttctgtatcctccctctcttctaggaccctagggctcttcctgggtctttgtgggtggtcacaagctttcctcyctcaagacagcagggttgcatggtcttgatagccttgtgattcgggttctgagagattcaggactgcaagggaggcctagacttttgatagctgcaagga

SEQ ID NO: 18206 - DNA, 201 bp, Homo sapiens
tacctcacctacaaaaactcaaaatcttcatatttacagaatatcctgagctcctacatgcttgagtagtagaaatcccgtcctttttcaagttcctcctmtgtgctgcgtcttcaggtcccatgaaggtctcacagatgaccaggtgttgcctccctctgcatctttgcatttgtgccccagcttgtcctgttgttctca

SEQ ID NO: 18207 - DNA, 201 bp, Homo sapiens; identical to SEQ ID NO: 1754

SEQ ID NO: 18208 - DNA, 201 bp, Homo sapiens
tgggatccccagcctctatcttttgtggctgctttacaggaactccgagctatggactctgcattaggagacgaagtgcaaagagtgtttctgtatcctcyctctcttctaggaccctagggctcttcctgggtctttgtgggtggtcacaagctttcctctctcaagacagcagggttgcatggtcttgatagccttgtg

SEQ ID NO: 18209 - DNA, 201 bp, Homo sapiens
ttctttcattctttctttttgttgagatggagtgtcactctgttgccaagtctggaatgcagtggcgcaatattggctcactgcaacctccacctccgggsttcaaccaattctccttcctcagcctcccgaatagctgggattataggtgcctgccacttcacctggctaatttttgtattattagtagagacaaggttt

SEQ ID NO: 18210 - DNA, 201 bp, Homo sapiens; identical to SEQ ID NO: 1755

SEQ ID NO: 18211 - DNA, 201 bp, Homo sapiens
gacctactatcagggccctcctatctctctgggatccccagcctctatcttttgtggctgctttacaggaactccgagctatggactctgcattaggagasgaagtgcaaagagtgtttctgtatcctccctctcttctaggaccctagggctcttcctgggtctttgtgggtggtcacaagctttcctctctcaagacag

SEQ ID NO: 18212 - DNA, 201 bp, Homo sapiens; identical to SEQ ID NO: 1756

SEQ ID NO: 18213 - DNA, 201 bp, Homo sapiens
ctctgcagttcccagggctgagccgtcctgctggttagttctcagcacccttctgtgactacaagttcaagttctcctccccttcctggacaatgaacccraggtaatagataagaggttttagggcttgaggggctgtattcaggagattccaaccttgctaccctgaaagatgaggaggtgacatgatgtcagtacctt

SEQ ID NO: 18214 - DNA, 201 bp, Homo sapiens
tacaaacctcaacccagcctttgcctgtcctccctttcactgcccagcatcacatgcccccttctgctctctgctcccccacctctgggtttccttggtgrctcccaacactgtccctcatcccacatgacagctctgcctatgggatgggggcgctgcatccgtcacttcctcctgacactgttcagtgtcaccagtgct

SEQ ID NO: 18215 - DNA, 201 bp, Homo sapiens
cctcatgaacttgttggtcctctttttgaggatcttatccttcatgaggagtctgagggaggccatgatgtggaggaagagatggctgccagctgcatagrcagcaccgaggaagacagcattgatgtaatttttacatgaacaattttggcagcctttcccacatgctgttcttcctagggagtgccatgagcagtgtct

SEQ ID NO: 18216 - DNA, 201 bp, Homo sapiens
gccaacccggctgctcctgcgccctgggcacgggcccgcggggctgccctgggaccgccggcccaaagccctcactcacctcggcgctgcagggtcatggscccgcccagctcgtagttgtgtctgcacatcctgtccggcactgcccgcttctcctccaggatgtccttctggctgttccagtactccgcagcaggccgc

SEQ ID NO: 18217 - DNA, 201 bp, Homo sapiens
agcttccaatccagaaagtctggatccaagactgtttatccactgtcctattcaccctattttgtgaaggaaaagaccaagttcaaattctccagagtccrttgccaaataatggagtcagatctatatttctatacataattacaacacagtgtggtgggtgcctgtaactacttactgtctctacttggactcattcca

SEQ ID NO: 18218 - DNA, 201 bp, Homo sapiens
taggccaacccggctgctcctgcgccctgggcacgggcccgcggggctgccctgggaccgccggcccaaagccctcactcacctcggcgctgcagggtcaygggcccgcccagctcgtagttgtgtctgcacatcctgtccggcactgcccgcttctcctccaggatgtccttctggctgttccagtactccgcagcaggc

SEQ ID NO: 18219 - DNA, 201 bp, Homo sapiens
ccttttcctttgaggctcagggcgggctggctaacattgctatattgaacaacaacttgaataccttgatccagcgttccaaccacactcaggccaccaayggtacgccctatctttgcctcttcctctgtagcccaactggaagggatgagagggcctctctgccaccctcagactaggaagcctaagtgccccctgctg

SEQ ID NO: 18220 - DNA, 201 bp, Homo sapiens
taatggagtcagatctatatttctatacataattacaacacagtgtggtgggtgcctgtaactacttactgtctctacttggactcattccatggcaatgytcacacaaaaaatgcccctccagagatcttacaggtttctatttatcataacactcaccatgctttatatttttatatgttttgggaattctcttagcat

SEQ ID NO: 18221 - DNA, 201 bp, Homo sapiens
cccaacccaaagtcccctttccgcccggcactaaggtcccttaggccaacccggctgctcctgcgccctgggcacgggcccgcggggctgccctgggaccsccggcccaaagccctcactcacctcggcgctgcagggtcatgggcccgcccagctcgtagttgtgtctgcacatcctgtccggcactgcccgcttctcct

SEQ ID NO: 18222 - DNA, 201 bp, Homo sapiens
tgtggtgggtgcctgtaactacttactgtctctacttggactcattccatggcaatgttcacacaaaaaatgcccctccagagatcttacaggtttctatytatcataacactcaccatgctttatatttttatatgttttgggaattctcttagcattagacagtgaacttccatgcagatgaccacatctaattcatta

SEQ ID NO: 18223 - DNA, 201 bp, Homo sapiens; identical to SEQ ID NO: 1964

SEQ ID NO: 18224 - DNA, 201 bp, Homo sapiens
ataaaaatggaatcatcctaaattgtattcattcatccatgtgtttactttttattttttgagacaaggtcttgctcagtctcctggtgaaatgctgtaaygcaatcatagctcactgcaaccgtgacctcctgggctccagtgatcctcttacctcagcctcccgagtagctgggaccacaggtgcccgtcaccatgccc

SEQ ID NO: 18225 - DNA, 201 bp, Homo sapiens
atgcctataagccatatctatgccataaacaggtcagtctagaacctagagatcaaagctcaggccagagtctagaatataaaggccagaatgcaaaccasactctagaatcttggatccgggccataacctagagctccaactagaacccagagcccaacctgaggtcaagggctagggccagagtccagaaccaagagc

SEQ ID NO: 18226 - DNA, 201 bp, Homo sapiens
gcatgttaggatttgagaagcgccgctgcatagtacacatccaccatgtttagtaacccagtccttcagtgatggacacctaggttcccttcactttgagygtgccacttatgtatctatacaagactcctcttgaccattcacacaggagtgggaccaaggggcctaaaggcctattcttaatcaatttcaccgaatact

SEQ ID NO: 18227 - DNA, 201 bp, Homo sapiens
gagttcgagaccagcctgagcaacatagagaaaccctgtctctactaaaaatgcaaaattagccaggcatggtggcacatgcctgtaatcccagccactcrggaggctgaggcaggagaatcacttgaacctgggaggcggaggttgcagtgagtcaagatcgcaccattgcactccaggctaggcaacaagagcgaaact

SEQ ID NO: 18228 - DNA, 201 bp, Homo sapiens
cagaatgtggcgggtgcggtggctcatgcctataatcctagcactttgggatgctgaggcaggcagatcacctgaggtcaggagttcgagaccagcctgascaacatagagaaaccctgtctctactaaaaatgcaaaattagccaggcatggtggcacatgcctgtaatcccagccactcgggaggctgaggcaggagaa

SEQ ID NO: 18229 - DNA, 201 bp, Homo sapiens
tttcacacccaaggtttagttcagagtctagtctatagctccgctatgagcagacttcaacccagtgtttgaatcccagaatgtggcgggtgcggtggctyatgcctataatcctagcactttgggatgctgaggcaggcagatcacctgaggtcaggagttcgagaccagcctgagcaacatagagaaaccctgtctcta

SEQ ID NO: 18230 - DNA, 201 bp, Homo sapiens
ataaggtggccacggcacaaaataagagatgctacggaggtgacttgggaggtgagtcagaaagctctccgtgctggggcaataacggggtcaatattggrcatgtctcaccctgggtgggacagatagaggcgggcagtttaggggttagaccaaaaggaaggggatttgtcagttttggaatcctacaaacttgtggag

SEQ ID NO: 18231 - DNA, 201 bp, Homo sapiens
atagtttaaagactactttaattttatttgcaactcaaagttccagctatggtggttgaacattatattttattgatttaaagacacattcttttcatatktttcacatctctgaaattaggaagcatcttacatcttaattcagcatgatgtcttacacctcataatttaattggcaacttctttttctttctgagtggt

SEQ ID NO: 18232 - DNA, 201 bp, Homo sapiens
tacctattaagatgatcatataatttttatccttcattctgttgaggtatatcatgcttagtgatttgtgcatgttgaaccgtccttatatcccagggatraatcccacttgatcatggtgtatgatgtttttaatatgctactgaatttagtttgctagtgttttgttgaggatttttgcatctatatgcatcagagata

SEQ ID NO: 18233 - DNA, 201 bp, Homo sapiens
agatagaggcgggcagtttaggggttagaccaaaaggaaggggatttgtcagttttggaatcctacaaacttgtggagtggagagtgtttgctcatctackttccccacccaatcctgtccactcctagccatgacacagagccaagaggatgagaacaagataattggtggccatacgtgcacccggagctcccagccgt

SEQ ID NO: 18234 - DNA, 201 bp, Homo sapiens
tccttctctctcactttttctctgcatttgacaggacctggccctcagcccctaaaatgttcctcctgctgacagcacttcaagtcctggctataggtaaragaacggttgggtatgacacaagggggtcccctggagactctgagaagagatggggatgggtccttggggcccctggatgctcatggtgacctcataaga

SEQ ID NO: 18235 - DNA, 201 bp, Homo sapiens
cagataaagaacttggctggttaaacagaatgtggtctatatacacagtggaatagcaatcagccttaaaaaaggaaagaaatcctggcacatgctgcaaygtggatgagtgttgagaacattaggttgagtgaaataagccagtcacaagaggacaaatatcatatgattccttttggccaggtgcagtggctcacgcct

SEQ ID NO: 18236 - DNA, 201 bp, Homo sapiens
ataagagatgctacggaggtgacttgggaggtgagtcagaaagctctccgtgctggggcaataacggggtcaatattgggcatgtctcaccctgggtgggmcagatagaggcgggcagtttaggggttagaccaaaaggaaggggatttgtcagttttggaatcctacaaacttgtggagtggagagtgtttgctcatcta

SEQ ID NO: 18237 - DNA, 201 bp, Homo sapiens
aggggatttgtcagttttggaatcctacaaacttgtggagtggagagtgtttgctcatctactttccccacccaatcctgtccactcctagccatgacacrgagccaagaggatgagaacaagataattggtggccatacgtgcacccggagctcccagccgtggcaggcggccctgctggcgggtcccaggcgccgcttc

SEQ ID NO: 18238 - DNA, 201 bp, Homo sapiens
cagttcccaaacctacagaccccttccactgcagggaagcccttgctgccaccttttcatagaccctcataacttgtaatgtcgtatatcgtatttatttmctttctttttcttccagaatatacagatcagtagggcaaagatttttttggaaggggtatctattgtgttcattgctgtatcccctagaactatgagggt

SEQ ID NO: 18239 - DNA, 201 bp, Homo sapiens
ccagaactagaacgctgctcacagctggaacatacaactctaagaatagaggcaaaacctggaggctgtttcacacccaaggtttagttcagagtctagtytatagctccgctatgagcagacttcaacccagtgtttgaatcccagaatgtggcgggtgcggtggctcatgcctataatcctagcactttgggatgctga

SEQ ID NO: 18240 - DNA, 201 bp, Homo sapiens
ttcctcctgctgacagcacttcaagtcctggctataggtaagagaacggttgggtatgacacaagggggtcccctggagactctgagaagagatggggatkggtccttggggcccctggatgctcatggtgacctcataagaaagagcagggagtggtttgggggtcatggtgggggaacgtgctggaggcctaaattcct

SEQ ID NO: 18241 - DNA, 201 bp, Homo sapiens
ccgaaacaatgtaagaggagtctttccccatgtctggggctaatcccaccacatcgctggttgcaccatccactcctttgttcttgaacatttcgtgaggyggttgagagctctccacctgcgttcaaatcacggcgcccccgttcagcgttgtgtaaccttggcacgtggccgagcatctccatcttggcttcctccatc

SEQ ID NO: 18242 - DNA, 201 bp, Homo sapiens
cctggtgtccctcttagctcttcaatcactcctacccctggcataactgtttcttaccccctgagctgtgagtcttcagtggggtcctctcactgtatacyctctccctaggtgggctccacaccgctggtatccagcaccatccgtgccgtgatgccccatcactctcctgagctccagacctgagtatcccgaaggatt

SEQ ID NO: 18243 - DNA, 201 bp, Homo sapiens
gggtgacagagagagactccatctcaaaaaaaaaaaaaattaggtttcttccctctccacaccttcaacaatatccatatttgtcactgacggttcctacrgaagtgaatgaagggggacgaatgcagaaataaagacaagagatctgttttgaaagaatgtgtcagggagctccttgcttctggtgagcaaaggcagcct

SEQ ID NO: 18244 - DNA, 201 bp, Homo sapiens
aactccagaacccccctgcaggctggccagaatccttccccatctcattcactctgtctctcctgctctctgccgtctcctattttgaatttccaaccccrtctgttaagactgtccttctgtctctgaatctctgtccccttctctttctgggtctctctccctctccctctgggtctctgtccccctctctgggtctct

SEQ ID NO: 18245 - DNA, 201 bp, Homo sapiens
acccaatgtagtggctggctcctggtttgaggtctagagaagagcctggaacaaaaacacagctcgggatgtgggctcctccataaatctcgaactcagcmtaggttctgaaagcagatgggcagcttggaacccatggacctgctgagaaccgaacatctgatccagtgattcttccagaggccacacattacatcgaga

SEQ ID NO: 18246 - DNA, 201 bp, Homo sapiens
cagacccaggccaagctccagctcaaagagccagcctaggggggtgccgaggtggagggaggctgagtcaggctgaggccggggaacagttggggtagccragggaggcaagcagcctcctgagtcaccacgtggtccaggtacggggctgcccaggcccagagacggacacaagcactggggaatttaaggggctagggg

SEQ ID NO: 18247 - DNA, 201 bp, Homo sapiens
ctcctagccatgacacagagccaagaggatgagaacaagataattggtggccatacgtgcacccggagctcccagccgtggcaggcggccctgctggcggrtcccaggcgccgcttcctctgcggaggcgccctgctttcaggccagtgggtcatcactgctgctcactgcggccgcccgtaagtgaccccctcccctgtc

SEQ ID NO: 18248 - DNA, 201 bp, Homo sapiens
agtgagctgagatcgtgccactgcactccagcctaggtgacagagcgagactccatcacaaaaaaaaaataaataaataaatcaagtcataatccaggttygatctagaatcctgatcttagcatagagtcaaaagtttaagatgtctagaactcagaacccaggctagaaacagaatggtgcctactccggaatatcagt

SEQ ID NO: 18249 - DNA, 201 bp, Homo sapiens
aaggcacctggggagagatgggtgtgtggctccagatgcaggtgcccagacagtgcgtccccaggtgtacagacagacccaggccaagctccagctcaaaragccagcctaggggggtgccgaggtggagggaggctgagtcaggctgaggccggggaacagttggggtagccaagggaggcaagcagcctcctgagtcac

SEQ ID NO: 18250 - DNA, 201 bp, Homo sapiens
gcagctctgctccaggtccaggtatctcccgcccacctcctgcccgtcctctatcccacccctcctctccatctctccctggcgctgccatctctcatctmggcctccgtctcctctgtcattgtccccatcccctgtaggtgcccatccttcccgtctcccctctgccatcggcctgcctgtcccatcctctttctccca

SEQ ID NO: 18251 - DNA, 201 bp, Homo sapiens
agtccagaaccaagagccctataatccaatatgaaacagacctgtagaggctgggtgcggtggctcacgcctgtaatcccagcactttgggaggctgaggygggagaatcacttgaactgggagttggaggtcgagagtgagctgagatcgtgccactgcactccagcctaggtgacagagcgagactccatcacaaaaaa

SEQ ID NO: 18252 - DNA, 201 bp, Homo sapiens
tagggccagagtccagaaccaagagccctataatccaatatgaaacagacctgtagaggctgggtgcggtggctcacgcctgtaatcccagcactttgggrggctgaggcgggagaatcacttgaactgggagttggaggtcgagagtgagctgagatcgtgccactgcactccagcctaggtgacagagcgagactccat

SEQ ID NO: 18253 - DNA, 201 bp, Homo sapiens
ggaggtgagtcagaaagctctccgtgctggggcaataacggggtcaatattgggcatgtctcaccctgggtgggacagatagaggcgggcagtttaggggytagaccaaaaggaaggggatttgtcagttttggaatcctacaaacttgtggagtggagagtgtttgctcatctactttccccacccaatcctgtccactc

SEQ ID NO: 18254 - DNA, 201 bp, Homo sapiens
gaccgtgccaagcaggtggtggagtggtgagcgagataccctgggaacctagcatgtggtgggaagagggcccagcaacctggccacggcacggcaggtgstgaggtccgggctggggacggcaagtccttgggagccaccggcggtgaactgggcctcatcagctgcatctccagctgtctccctacctttgagctgaag

SEQ ID NO: 18255 - DNA, 201 bp, Homo sapiens
agaccgtgccaagcaggtggtggagtggtgagcgagataccctgggaacctagcatgtggtgggaagagggcccagcaacctggccacggcacggcaggtsctgaggtccgggctggggacggcaagtccttgggagccaccggcggtgaactgggcctcatcagctgcatctccagctgtctccctacctttgagctgaa

SEQ ID NO: 18256 - DNA, 201 bp, Homo sapiens
ctggtttttgcccttgcttcacatagcgtggtgcagaaaatagcaattctgaatcacttattagaactggagtcttagatctcacccagaccaactgaatyggaatctgcgttatatataacaagattgccagggcactcagtgcatgttaggatttgagaagcgccgctgcatagtacacatccaccatgtttagtaacc

SEQ ID NO: 18257 - DNA, 201 bp, Homo sapiens
taaaattagatgcaccttaaaattccattccttagtcatactcacaacatttcaataaccgtacgtggctagcggctgccatattgacagcacggatataytatagatagaattatttgcatctcatcactggaagtcccattgaacagcactactctggtttttgcccttgcttcacatagcgtggtgcagaaaatagca

SEQ ID NO: 18258 - DNA, 201 bp, Homo sapiens
gtggatcacctgaggtcaggagtttgagagcagcctggccaacatggcgaaaccccgtctctgctaaaaatgcaaaaattagccaggcatggtggtgggcrcccatagtcccagctactcaaaaggctgaggcaacagaattgctttaacctgggaggcggaagttgcagtgagccgagatcctgccactgcactccagcc

SEQ ID NO: 18259 - DNA, 201 bp, Homo sapiens
agatagctttggttagcattgacattttagaaatattaattcttccaattcacaaatatgggatatctttcaatttctttatgttgtcttcaattttttttatcagcattttatagttttcagtgtacagattatttacttccttgcttaagtttatttttaagcattttattgtttctgatgccattgtaaattgagttg

SEQ ID NO: 18260 - DNA, 201 bp, Homo sapiens
ttctttcttttataaggcagaataatattaaattatactgatactaatatattacatttcctttatccattcatccatcaacagacacataggttgttttyatatcctggtcatcatgaatgatgccgccatgaacatgggtgtgcagatatcactttgagatgccaatttcatttccttgcaccaacttacactccaacc

SEQ ID NO: 18261 - DNA, 201 bp, Homo sapiens
aatcccagcactttgagaggctgaggtgggaggagaatcacttgggcccaggagttcaagacaagcctgggcagcacagtgagaccccatctctacaaaawatttttttaattatctgggtgtagtggtgtgcatctgtagtcccagctactcaggaggctgaggtgggaggatcgcttgagcccaggaggttgtggctgc

SEQ ID NO: 18262 - DNA, 201 bp, Homo sapiens
acctttgagctgaaggccttggggagccttccagtcattctgtgccctggctcaggctctgcataaacacaagaaccccctctttatttatttgtttgttkatttatttattttgcaacagagtctcgctctgtcacccaggctggagtgcagtggcacaatctcagctcactgcaacctctgcctcccgggttcaagcga

SEQ ID NO: 18263 - DNA, 201 bp, Homo sapiens
agggtcgtagatgtagcaaggccctggataaggtggccacggcacaaaataagagatgctacggaggtgacttgggaggtgagtcagaaagctctccgtgytggggcaataacggggtcaatattgggcatgtctcaccctgggtgggacagatagaggcgggcagtttaggggttagaccaaaaggaaggggatttgtca

SEQ ID NO: 18264 - DNA, 201 bp, Homo sapiens
ctcggcctgcagttagtgagaagcaggctagacctcggggaagactcgtcacccggccagggaaccgggctggagggtggggaggagtctctggctcagamcctgagcagcgcttctcttgggggtcgtggccaggatccttcaggttgccctgggcaagcacaacctgaggaggtgggaggccacccagcaggtgctgcg

SEQ ID NO: 18265 - DNA, 201 bp, Homo sapiens
gtttgctcatctactttccccacccaatcctgtccactcctagccatgacacagagccaagaggatgagaacaagataattggtggccatacgtgcacccrgagctcccagccgtggcaggcggccctgctggcgggtcccaggcgccgcttcctctgcggaggcgccctgctttcaggccagtgggtcatcactgctgct

SEQ ID NO: 18266 - DNA, 201 bp, Homo sapiens
gtggtttgggggtcatggtgggggaacgtgctggaggcctaaattcctagttgtggaggtgctagggaattgtggggccggggagagaggtgtttataagrtctggtgcaaaatacataaggaatcttagggaactattaggtcctgagtgggtcatagcagaaagatcacggggctctacctgactgtgttaggaaagaa

SEQ ID NO: 18267 - DNA, 201 bp, Homo sapiens
agatatcactttgagatgccaatttcatttccttgcaccaacttacactccaaccaacagggtacaaggattcactttttttccccacatccttgccagcrtttgttattgtttgccttttctatactagtcattccaaaatgtgtgaggtgatgtcttactgtgattttaatttgtgtctccctgatgattagtgatagt

SEQ ID NO: 18268 - DNA, 201 bp, Homo sapiens
tttcatatttttcacatctctgaaattaggaagcatcttacatcttaattcagcatgatgtcttacacctcataatttaattggcaacttctttttctttmtgagtggtctacaaaataaagtgcaatataatcaacagtattttacattcaattaaatagtgtgtgaaggaaggtaggtgtaggtgaggggtcaggttgt

SEQ ID NO: 18269 - DNA, 201 bp, Homo sapiens
atagcagaaagatcacggggctctacctgactgtgttaggaaagaaacaatgtcagaaagatgttttgttgtcagagggaaggtggagaaggatgatgggrtggcgggatcgtggcatggggtggcgggatcgtggcatgggtgtgtgaggtggatgggggcaagtgtggggcaagagatggcggatccttggggtcccac

SEQ ID NO: 18270 - DNA, 201 bp, Homo sapiens
agtgtcctcccggtccatccatgttgtcacaaatgacaggatttctttcttttataaggcagaataatattaaattatactgatactaatatattacatttcctttatccattcatccatcaacagacacataggttgttttcatatcctggtcatcatgaatgatgccgccatgaacatgggtgtgcagatatcactttg

SEQ ID NO: 18271 - DNA, 201 bp, Homo sapiens
ttttcttttcttatagtgtccttgtctcagtttgtggaggttgcaccttctgtgtcaaggtgataaacacacactgtggatttaatacttagcagccatamaagccctataggaaaaaggagagaaaagaagttgtgtacttgggtagatttgggcacccagtgacatgatataactcatgctataattctcaacctgcat

SEQ ID NO: 18272 - DNA, 201 bp, Homo sapiens
tgagtgggaacgttggggaggagacagggaggtccttgaatgtgttggggaaggactcattggggggaaatgtggcatatttcgagaagtgatcacagaarttatgggagcatagagctaagggtcgtagatgtagcaaggccctggataaggtggccacggcacaaaataagagatgctacggaggtgacttgggaggtg

SEQ ID NO: 18273 - DNA, 201 bp, Homo sapiens
attaaattatactgatactaatatattacatttcctttatccattcatccatcaacagacacataggttgttttcatatcctggtcatcatgaatgatgcygccatgaacatgggtgtgcagatatcactttgagatgccaatttcatttccttgcaccaacttacactccaaccaacagggtacaaggattcactttttt

SEQ ID NO: 18274 - DNA, 201 bp, Homo sapiens
ttggatccgggccataacctagagctccaactagaacccagagcccaacctgaggtcaagggctagggccagagtccagaaccaagagccctataatccartatgaaacagacctgtagaggctgggtgcggtggctcacgcctgtaatcccagcactttgggaggctgaggcgggagaatcacttgaactgggagttgga

SEQ ID NO: 18275 - DNA, 201 bp, Homo sapiens
tgtgttaggaatctcattctctttcttactttcactcatcaacagctattgagcacctactacgggccaggcattggtctatttattaggcacctgctatrcaccaggcattgttctgggtgctggaggaagaactgtgagcaagccagtcagaatccctgccctcacagaacttatattctagcaggagatgacagacaa

SEQ ID NO: 18276 - DNA, 201 bp, Homo sapiens
atcacttgaacctgggaggcggaggttgcagtgagtcaagatcgcaccattgcactccaggctaggcaacaagagcgaaactccatatcaatcaatcaatmaataaatcccagaatgcagatcctaatcagaagccccatataaaacctagacccctcctaaattctagatctgaacttacaacccagaccccagccaaga

SEQ ID NO: 18277 - DNA, 201 bp, Homo sapiens
ggggacagcacagtattggggaaccctaaggtggcaggtctgggacatgcacgaaagattgctgggaagtagaggctccctccttttcctcatcctcccaycccatcctccagtgtctggtaaccaccattctactctctgcttctaagagtctgagttttttagatttcacatgtaagtgagatcatgcagtaattgtca

SEQ ID NO: 18278 - DNA, 201 bp, Homo sapiens
ccaagaatgctcggcctgcagttagtgagaagcaggctagacctcggggaagactcgtcacccggccagggaaccgggctggagggtggggaggagtctcyggctcagaccctgagcagcgcttctcttgggggtcgtggccaggatccttcaggttgccctgggcaagcacaacctgaggaggtgggaggccacccagca

SEQ ID NO: 18279 - DNA, 201 bp, Homo sapiens
gctaagggtcgtagatgtagcaaggccctggataaggtggccacggcacaaaataagagatgctacggaggtgacttgggaggtgagtcagaaagctctcygtgctggggcaataacggggtcaatattgggcatgtctcaccctgggtgggacagatagaggcgggcagtttaggggttagaccaaaaggaaggggattt

SEQ ID NO: 18280 - DNA, 201 bp, Homo sapiens
aagacttatctcttaaaaaaaaaaaaaaaaaatccaattcctattatgtcaggtacctggacctagagtagtcaaattcatagagacagaaagtcgaatgrttgttgctaggggctggggaagggagaagcagggagttatcatttagtgggtgcagaatttgaggacaatgaaaacatctgggggagttagagagtagtg

SEQ ID NO: 18281 - DNA, 201 bp, Homo sapiens
acaactctaagaatagaggcaaaacctggaggctgtttcacacccaaggtttagttcagagtctagtctatagctccgctatgagcagacttcaacccagygtttgaatcccagaatgtggcgggtgcggtggctcatgcctataatcctagcactttgggatgctgaggcaggcagatcacctgaggtcaggagttcgag

SEQ ID NO: 18282 - DNA, 201 bp, Homo sapiens
cacgtggtccaggtacggggctgcccaggcccagagacggacacaagcactggggaatttaaggggctaggggaggggctgaggagggtaggccctccccsaaatgaggatggaacccccccaactccagaacccccctgcaggctggccagaatccttccccatctcattcactctgtctctcctgctctctgccgtctc

SEQ ID NO: 18283 - DNA, 201 bp, Homo sapiens
gctgaggtccgggctggggacggcaagtccttgggagccaccggcggtgaactgggcctcatcagctgcatctccagctgtctccctacctttgagctgarggccttggggagccttccagtcattctgtgccctggctcaggctctgcataaacacaagaaccccctctttatttatttgtttgtttatttatttatttt

SEQ ID NO: 18284 - DNA, 201 bp, Homo sapiens
gtgccgcatggtgggggcgtctcggcctctctcctctctctccactgttttctctttctgtgtgtctgtttccattctatctccaccttcttccctccgtyttttgcttttctatctccacttctccacacccctctctccctgcgtctctgtgtctccctcttcctctgtcttgtttttttcccaccgtctgcctcttct

SEQ ID NO: 18285 - DNA, 201 bp, Homo sapiens
gaggcgccctgctttcaggccagtgggtcatcactgctgctcactgcggccgcccgtaagtgaccccctcccctgtccctgtacctagtgaattccagagyctaaagccctagagctgagctgagaacctggatctctgtatagaacccaatgtagtggctggctcctggtttgaggtctagagaagagcctggaacaaaa

SEQ ID NO: 18286 - DNA, 201 bp, Homo sapiens
atgacacagagccaagaggatgagaacaagataattggtggccatacgtgcacccggagctcccagccgtggcaggcggccctgctggcgggtcccaggcrccgcttcctctgcggaggcgccctgctttcaggccagtgggtcatcactgctgctcactgcggccgcccgtaagtgaccccctcccctgtccctgtacct

SEQ ID NO: 18287 - DNA, 201 bp, Homo sapiens
tggagtggagagtgtttgctcatctactttccccacccaatcctgtccactcctagccatgacacagagccaagaggatgagaacaagataattggtggcyatacgtgcacccggagctcccagccgtggcaggcggccctgctggcgggtcccaggcgccgcttcctctgcggaggcgccctgctttcaggccagtgggt

SEQ ID NO: 18288 - DNA, 201 bp, Homo sapiens
tgggagttggaggtcgagagtgagctgagatcgtgccactgcactccagcctaggtgacagagcgagactccatcacaaaaaaaaaataaataaataaatmaagtcataatccaggttcgatctagaatcctgatcttagcatagagtcaaaagtttaagatgtctagaactcagaacccaggctagaaacagaatggtgc

SEQ ID NO: 18289 - DNA, 201 bp, Homo sapiens; identical to SEQ ID NO: 1970

SEQ ID NO: 18290 - DNA, 201 bp, Homo sapiens
gcgcttctcttgggggtcgtggccaggatccttcaggttgccctgggcaagcacaacctgaggaggtgggaggccacccagcaggtgctgcgcgtggttcrtcaggtgacgcaccccaactacaactcccggacccacgacaacgacctcatgctgctgcagctacagcagcccgcacggatcgggagggcagtcaggccc

SEQ ID NO: 18291 - DNA, 201 bp, Homo sapiens; identical to SEQ ID NO: 1971

SEQ ID NO: 18292 - DNA, 201 bp, Homo sapiens
tgccttactttggcttaagagatgtgctcttaatgagctaaatgttaaattccatctttttaattctctaaaccaggagtccccgatccccaggccatggwgtggtactggtctgtggcctgttgggcagtgggccccacagcagtaggtgagtggcaggtgagcaagtattaccacctgagctccgcctcctgtcagatc

SEQ ID NO: 18293 - DNA, 201 bp, Homo sapiens
ttttaattctctaaaccaggagtccccgatccccaggccatggagtggtactggtctgtggcctgttgggcagtgggccccacagcagtaggtgagtggcmggtgagcaagtattaccacctgagctccgcctcctgtcagatcagtggcagcattagattctcataggagtgtgaaccctattgtgaactacacatgcaa

SEQ ID NO: 18294 - DNA, 201 bp, Homo sapiens
gatcagtggcagcattagattctcataggagtgtgaaccctattgtgaactacacatgcaagggatctaggctgcatgctccttataagaatctaagtaaygcctgataatacgaggtggaacagtttcatcccgaaactatctttgccccctgccccccgggtctgtggaaaaattgtcttccacaaaaccagcccctgc

SEQ ID NO: 18295 - DNA, 201 bp, Homo sapiens
agcagatcacattatgaaaagcagactccaaagtattcactctgtggtatcccccacactcggcaaatgtttttgtgcattttcttatgtcagcctcaaarcaaccatatgggatctgcacaaaggagggaaccaaaccttaggagagttaaaccacttgtctgaggctctgcctcttaaaatccttcaagaggatttcac

SEQ ID NO: 18296 - DNA, 201 bp, Homo sapiens
atggccccatccagccctccagcctcacaccctgcaaggacacctagacccccacctccctcaacccttcatgactgcgcttctgatccctgtttcccctkgctagaccctgcgtgccctcccgctggaagcggtctaatgcctgcttgtttttaacactcaggttggggcccctgcctgctcccgggagcctttgctgac

SEQ ID NO: 18297 - DNA, 201 bp, Homo sapiens; identical to SEQ ID NO: 1979

SEQ ID NO: 18298 - DNA, 201 bp, Homo sapiens
atgggatatgcttcaaaaacatgactggccacagaaacagcttcatggttcattccattctttattgcatggttagtttttcactttttttaagcctgtgyctgcagtttacaagtagtgtagtatgcttgcaaccaaatcattccaatgctccccattggtctcctcttctgaaaaaggaaggtaatactagaatctacc

SEQ ID NO: 18299 - DNA, 201 bp, Homo sapiens
aacatgaaaaatatttagttgtcagctgccccattaaaggtccaggactttgggaagacagaacagttctaggacatggtctggccagacatccaaaggtragtattgaaaaactcaagagatgtaaaagacccttagacacccaaaggaggataagaaactacagacaaaaagaaaagaacaccagctttgttgggggcc

SEQ ID NO: 18300 - DNA, 201 bp, Homo sapiens
tcagctgccccattaaaggtccaggactttgggaagacagaacagttctaggacatggtctggccagacatccaaaggtaagtattgaaaaactcaagagrtgtaaaagacccttagacacccaaaggaggataagaaactacagacaaaaagaaaagaacaccagctttgttgggggccagcacccacagccatcataag

SEQ ID NO: 18301 - DNA, 201 bp, Homo sapiens
tcaactgatcacaagcctctttgggatctcacttcatctgaggatgagctgccaccctaaattatggcaccaaagatatagttccaaatcttctgttcagktcctatgactctgaccttgtctacttgtcagggagaataacaatgaagacaggcatatcgagctatctactcaaatcagccagggtttctcttccagcac

SEQ ID NO: 18302 - DNA, 201 bp, Homo sapiens; identical to SEQ ID NO: 1976

SEQ ID NO: 18303 - DNA, 201 bp, Homo sapiens; identical to SEQ ID NO: 1977

SEQ ID NO: 18304 - DNA, 201 bp, Homo sapiens
tacttcccattaggttgcagatgtcttagaaacacattcctgcaccacagcttcaagaaatccaaataatgacctgatctgctggtttccaagctaccctrccaggagcaagtcagaggccctgcagggctcctcggtaagccctcgaaatccctctcccctcaatgaccccaccacagcagctccacttttgaatatttt

SEQ ID NO: 18305 - DNA, 201 bp, Homo sapiens
gctgcccacattccttgacttgtggccccttccattgtccataccagcaatgtctggttgagtctttctcatgctgctccctctggactgaccttctaccygcttctacttttgaggacactgcttacactggattcacccagataatccaggatcatctctctactcttagatcagctgattagcaaattgaatgtcatc

SEQ ID NO: 18306 - DNA, 201 bp, Homo sapiens
acttgtggccccttccattgtccataccagcaatgtctggttgagtctttctcatgctgctccctctggactgaccttctacccgcttctacttttgaggwcactgcttacactggattcacccagataatccaggatcatctctctactcttagatcagctgattagcaaattgaatgtcatctgcaccttcattcctct

SEQ ID NO: 18307 - DNA, 201 bp, Homo sapiens
tcttcaatcatacagtcctttacttcctaagatacatttcataattttacccaacggtgctttccaacacactaagatgacatctctgtgtatgtgtgtgygtgtgtgcactgcaaattaaatctcagcttgtcttaagggtttgcatgtttgttatatccatcaaactgtgaccttaacagttccccctttagaagttat

SEQ ID NO: 18308 - DNA, 201 bp, Homo sapiens
tacattaaaaatatgagtatgaattagatctatgtaatatcaaaaacagtatattaatggaatctgttttagacaaaaaaaaagtagtagcaactgctcarttgtgcttcctaaatgccaggcatgttcctaagagtttaccacaaataaacataaccatcctaataaccctttttatggatgtggaaagtgaagaaaatt

SEQ ID NO: 18309 - DNA, 201 bp, Homo sapiens
tgggggccagcacccacagccatcataagtcctcttctctgtgtcacactgggccattcagttattatccttatttgaggactaaacattttgggccgggygcggtggctcacacctgtaatcctagcactttgggaggccaaagcgggcggatcacaaggtcaagagatcaagactatcctggccaacatagtgaaaccc

SEQ ID NO: 18310 - DNA, 201 bp, Homo sapiens
cattagattctcataggagtgtgaaccctattgtgaactacacatgcaagggatctaggctgcatgctccttataagaatctaagtaatgcctgataataygaggtggaacagtttcatcccgaaactatctttgccccctgccccccgggtctgtggaaaaattgtcttccacaaaaccagcccctgctgcccaaaaggt

SEQ ID NO: 18311 - DNA, 201 bp, Homo sapiens
agaagctagatcccatcacctatctccttctcttgagtgattcttccacaatcttgaatggtccacaagtgcttcacagacatgggtttctttcaagtgtygagtctggggtctcagcagctttgacagtgaggagagacgaacggggctgtagagttgcagccacccctcacttggaatggtgactactggttgtctggg

SEQ ID NO: 18312 - DNA, 201 bp, Homo sapiens
cacatgcaagggatctaggctgcatgctccttataagaatctaagtaatgcctgataatacgaggtggaacagtttcatcccgaaactatctttgcccccygccccccgggtctgtggaaaaattgtcttccacaaaaccagcccctgctgcccaaaaggttgcggaccactgctgtaaatcatgtaaatcttaggtttca

SEQ ID NO: 18313 - DNA, 201 bp, Homo sapiens
aaatattttgagtgacccctttcctcagttactcctcccaactgaatcccaatctttctccctgtaaatgtgttatctccttcccaggtcctcctgcatgrcaaacattctcgtttttcaaattcttgccctattagacattcaataaaatagaaaccatcagaagctagatcccatcacctatctccttctcttgagtga

SEQ ID NO: 18314 - DNA, 201 bp, Homo sapiens
agggctagcgttgcacctggcacatagtaagtgcacaataaatgtaagcacattttgaaatgtattattagtctttgggctaagcacctgcaccgaatttkttacctcctctttgctgctatttcctcattgatgaaattcagaaaacggtgggacctaattaactgtgttattgtgaagattaaatgacacaatacagtg

SEQ ID NO: 18315 - DNA, 201 bp, Homo sapiens
aaaaaaaaaaaaaattcaatgtgagtttgggagggggacacaccacattcaaaccatagcaattcacctgacacaatacaatttaatgttaaggctttgayaatccattcctccttaatagaaaaaggacctaaaatacaaaatattttgagtgacccctttcctcagttactcctcccaactgaatcccaatctttctcc

SEQ ID NO: 18316 - DNA, 201 bp, Homo sapiens
cctcctctttgctgctatttcctcattgatgaaattcagaaaacggtgggacctaattaactgtgttattgtgaagattaaatgacacaatacagtgccarcacctagttattactcaacataaatttgtcacagttctcacaagacatcagaacacccgctgatgtgctgtcccccatggcactcagcatattaagtgtg

SEQ ID NO: 18317 - DNA, 201 bp, Homo sapiens; identical to SEQ ID NO: 1974

SEQ ID NO: 18318 - DNA, 201 bp, Homo sapiens
acctaattaactgtgttattgtgaagattaaatgacacaatacagtgccagcacctagttattactcaacataaatttgtcacagttctcacaagacatcmgaacacccgctgatgtgctgtcccccatggcactcagcatattaagtgtggtcggcacaagcggctgcctggtgtgaagtatgagggcaaaaggcagggt

SEQ ID NO: 18319 - DNA, 201 bp, Homo sapiens
gcagttattgatgagctgatgcaggtaagacttcattctatcagtgagagcacctttttcatgctaaagataaccagccagggtctttgataaagagatayaaaaagaggtctggaggccttttaaaggcctgacagacctacattttcaagaagacagccttgagggtgccgtctatagggagcacaaatgtgagcagat

SEQ ID NO: 18320 - DNA, 201 bp, Homo sapiens
acttagttcattttgtactgctgtaacagaatatctgagactgggccatttgtaaagaacagtgatttatttttttactgctctggaggttgggaagttcragaacaaggggccaacatctgatgatggcctttgtgccccatcatcatatggcggaaggtgagagagagagcaagggggtgctgaacgtgtccctttata

SEQ ID NO: 18321 - DNA, 201 bp, Homo sapiens
cctatcgttaaactggattctctacaagagtaataattgcagagtcagccagctctcatcccttttcaggtttcagaaaagacctgtgaacaaaacgcctkgagtctgatttagtgtggcaatgccccaagggtcctgttctccctgggtgtcctgcacctggtgcaacgtcggcctggcatctagtgagccatctaaagg

SEQ ID NO: 18322 - DNA, 201 bp, Homo sapiens
aaacatgactggccacagaaacagcttcatggttcattccattctttattgcatggttagtttttcactttttttaagcctgtgtctgcagtttacaagtwgtgtagtatgcttgcaaccaaatcattccaatgctccccattggtctcctcttctgaaaaaggaaggtaatactagaatctacctaaaaggatcagagaa

SEQ ID NO: 18323 - DNA, 201 bp, Homo sapiens
taacaaactactttattcaaaagaaactaaaccttgaaagtgtatctcacacctaagaatgactaaatcagagaattaacatgaaaaatatttagttgtcmgctgccccattaaaggtccaggactttgggaagacagaacagttctaggacatggtctggccagacatccaaaggtaagtattgaaaaactcaagagatg

SEQ ID NO: 18324 - DNA, 201 bp, Homo sapiens
tgcagtttacaagtagtgtagtatgcttgcaaccaaatcattccaatgctccccattggtctcctcttctgaaaaaggaaggtaatactagaatctacctmaaaggatcagagaaagggtaaaatggaacaactcgtgcaaagggctagcgttgcacctggcacatagtaagtgcacaataaatgtaagcacattttgaaa

SEQ ID NO: 18325 - DNA, 201 bp, Homo sapiens
gtgcaaagggctagcgttgcacctggcacatagtaagtgcacaataaatgtaagcacattttgaaatgtattattagtctttgggctaagcacctgcaccraatttgttacctcctctttgctgctatttcctcattgatgaaattcagaaaacggtgggacctaattaactgtgttattgtgaagattaaatgacacaat

SEQ ID NO: 18326 - DNA, 201 bp, Homo sapiens
tgtgccttagtagtatttatgaagacttgaagatgtaccaggtggagttcaagaccatgaatgcaaagcttctgatggatcctaagaggcagatctttctrgatcaaaacatgctggcagttattgatgagctgatgcaggtaagacttcattctatcagtgagagcacctttttcatgctaaagataaccagccagggtc

SEQ ID NO: 18327 - DNA, 201 bp, Homo sapiens
tcaagtgtatttgaaaaatatttttaagtgttctaaaaataaaagtattgaattaaagtgattctgcaatttttctaatgtacttttaagtgttaaaatayacattgtgggaaaattgaaaactctgatgagacttcaacaaaattactctggaaagaatgccacaatattcttattcctttcctagtccctttcatctca

SEQ ID NO: 18328 - DNA, 201 bp, Homo sapiens; identical to SEQ ID NO: 1975

SEQ ID NO: 18329 - DNA, 201 bp, Homo sapiens
gagaaccacagaaatagatctttaatatattctgtcaaatttttgaaaagacccttgtctctcagtgatgaaaatgcctgattgactcatagctcaaaccraatgggaaaggaataactaacaataaaagctacctgaattcccagcactttgggaggccaaggcaggcagatcacgaggtcaggagataaagaccaacct

SEQ ID NO: 18330 - DNA, 201 bp, Homo sapiens
tcaaatacaaatatctaaatgtatttatatattttcattatcactagtcctcattctcattcccctcactccccagtgggatctatcctactaatatatayccttttgtctgtgtctttgtataatgtgtactattttgaatatatcattctcatttaagtcaatagagttccgcaatcacttactcacaattcttaaact

SEQ ID NO: 18331 - DNA, 201 bp, Homo sapiens
caacagagcgagactccgtctcaaaaaaaaaaaaaaaaattcaatgtgagtttgggagggggacacaccacattcaaaccatagcaattcacctgacacartacaatttaatgttaaggctttgataatccattcctccttaatagaaaaaggacctaaaatacaaaatattttgagtgacccctttcctcagttactcct

SEQ ID NO: 18332 - DNA, 201 bp, Homo sapiens; identical to SEQ ID NO: 1980

SEQ ID NO: 18333 - DNA, 201 bp, Homo sapiens
ccctttagaagttatacttgaaataggtattcatagaatacagtcactttagcaaaagaagaaacaattttcaccagaagcaagtgtcacagtgaggtgtrgaggctggttagcacaggctgttgacatgatttattgtgtttacataatgaaaaaatatgtaatccagagaaacatgccccaagcttagggagaggaggg

SEQ ID NO: 18334 - DNA, 201 bp, Homo sapiens
ttaccattggaattaaccaaggtataaaggattttcctcccagagcatgcagtgtggttaaaaactgtgcatcaaatctcacctgcttctaaaaattcacrtttctggtatccatcattatgggattttaactggtcctacttcagaagttagatttgggagaaaaattatttttaaaaaatggttttttttgcaacaatg

SEQ ID NO: 18335 - DNA, 201 bp, Homo sapiens
gcttcactcatttttatgaatgaatatttgaattttggaataccatgtaagtcatgcttactgttcattctcctaggccctgaatttcaacagtgagactrtgccacaaaaatcctcccttgaagaaccggatttttataaaactaaaatcaagctctgcatacttcttcatgctttcagaattcgggcagtgactattga

SEQ ID NO: 18336 - DNA, 201 bp, Homo sapiens
gaggcctgtttaccattggaattaaccaaggtataaaggattttcctcccagagcatgcagtgtggttaaaaactgtgcatcaaatctcacctgcttctaraaattcacgtttctggtatccatcattatgggattttaactggtcctacttcagaagttagatttgggagaaaaattatttttaaaaaatggtttttttt

SEQ ID NO: 18337 - DNA, 201 bp, Homo sapiens
attgtgaaccaaaatgtgaaccaaataaaagaatgacctatcatctggggcatctataatgttattcataggcaagaacttgctttgttatgttctgaatyaccataacacagatgctaatataaaacaaatatttatataagcgagggtgactgctttggtgacgaggacatgggataaaaatatggtggcagaaatcat

SEQ ID NO: 18338 - DNA, 201 bp, Homo sapiens
aacacactaagatgacatctctgtgtatgtgtgtgcgtgtgtgcactgcaaattaaatctcagcttgtcttaagggtttgcatgtttgttatatccatcaractgtgaccttaacagttccccctttagaagttatacttgaaataggtattcatagaatacagtcactttagcaaaagaagaaacaattttcaccagaag

SEQ ID NO: 18339 - DNA, 201 bp, Homo sapiens
tcaatcatacagtcctttacttcctaagatacatttcataattttacccaacggtgctttccaacacactaagatgacatctctgtgtatgtgtgtgcgtstgtgcactgcaaattaaatctcagcttgtcttaagggtttgcatgtttgttatatccatcaaactgtgaccttaacagttccccctttagaagttatact

SEQ ID NO: 18340 - DNA, 201 bp, Homo sapiens
ccaactctaggaagctttgcttcccttcctgcccctcctcagaagcttcatgcccttctcaccatgtctcacctactgatgcctcctggtcatttgggcamttgtctgtctcagcagctaaacttgcaatccaggagggtatacatggtcctcttctctgtcatgttcttagtacctaatggagtgcctgccacccattag

SEQ ID NO: 18341 - DNA, 201 bp, Homo sapiens
tgaattttcaggccttgcttcttggctcatgctgttacctctgtctgaaatttccctcctccattgtcgacactttactcctcttaatgtgggtgtcccawctctaggaagctttgcttcccttcctgcccctcctcagaagcttcatgcccttctcaccatgtctcacctactgatgcctcctggtcatttgggcaattg

SEQ ID NO: 18342 - DNA, 201 bp, Homo sapiens
ctactcttagatcagctgattagcaaattgaatgtcatctgcaccttcattcctctttggcaggtcacatagctcattaccgggttccagggattgggagrtggatgtctttggaggtggagaattggtctagctaccacagaaagggattttactacttgtgcccaaacgtattctgaattttcaggccttgcttcttgg

SEQ ID NO: 18343 - DNA, 201 bp, Homo sapiens
aagaaaatcggctgattttttttaagttgatatgtgtattgcatgatgttgttaaattctcttcttagttctaatagtctattaattttttttctttttgyatatcaactgtaaaaagtgacagttttaccttttcttttccaatgtttaaagctctcatttctttttctttccttatagcattggccgagacctccacga

SEQ ID NO: 18344 - DNA, 201 bp, Homo sapiens
ctactaatatatatccttttgtctgtgtctttgtataatgtgtactattttgaatatatcattctcatttaagtcaatagagttccgcaatcacttactcrcaattcttaaacttacacagctctggacaccagaagttttctcttaaattcttaacagcgaaatctgactgaagcgacaaggggttacttggggttcttt

SEQ ID NO: 18345 - DNA, 201 bp, Homo sapiens
aagatggatgtgcttggaaaatgagtatttcttttctcattctgcctggtgatctggctgagagtagatttggattgggtttaggagtggcataagggacygagttgcaggctctgagacatgtactggcttcactcatttttatgaatgaatatttgaattttggaataccatgtaagtcatgcttactgttcattctcc

SEQ ID NO: 18346 - DNA, 201 bp, Homo sapiens
atgtaggctttctctgggtgagtgttgggttcaacacccttgtccaagctcatctctagaccctcacagggagctggcttctagccctagaatagagtggygctttgtaataactcgagtcatctctcaggtgttgaaggaaaagtgttggaaatgggttgagggaggtgggtgccaagcatgaatggatgggtgaaggtg

SEQ ID NO: 18347 - DNA, 201 bp, Homo sapiens
cttacatcaggaccagaacaaattaggtctaaatctacagtgggctccagggtggaaatggaggtctcacttaagaagcaggagaaatctcaaaactcagmgcctagaatttaaccccagggcctccgtgttagcatcagcggctgcagagccaggatcaggacttctcaaatcctgacatatagacagggaggctgagaa

SEQ ID NO: 18348 - DNA, 201 bp, Homo sapiens
gtggccactccagacccaggaatgttcccatgccttcaccactcccaaaacctgctgagggccgtcagcaacatgctccagaaggtgagcctttcctgtcstctccactgtggacctgcaccctccctgaggaaggggcctctgatcctcccctctggtacctgatggaactgcagagaaattgtggaagttcattagcag

SEQ ID NO: 18349 - DNA, 201 bp, Homo sapiens
aaatcacgtttacagtgctgacctacacatgcaaatttacggtctcaactgatcacaagcctctttgggatctcacttcatctgaggatgagctgccaccytaaattatggcaccaaagatatagttccaaatcttctgttcaggtcctatgactctgaccttgtctacttgtcagggagaataacaatgaagacaggcat

SEQ ID NO: 18350 - DNA, 201 bp, Homo sapiens
cttgtctgaggctctgcctcttaaaatccttcaagaggatttcactacacttaccttctcactcacctctaaaggctccaggacgtgctccaggatttgcmtgcaaggggccagtttgcatatctgcaaatattgctgggaaacaagcaagattggtgcctgattatgacccattgtgaaccaaaatgtgaaccaaataaa

SEQ ID NO: 18351 - DNA, 201 bp, Homo sapiens; identical to SEQ ID NO: 1978

SEQ ID NO: 18352 - DNA, 201 bp, Homo sapiens
gactatcctggccaacatagtgaaaccctgtctctactaaaaatacaaaaattagttgggcatggtggtgtgtgcctgtagtcccagctactcaggaggcygaggcaggagaattgcttgaacccaggaggcggaggttgcagtgagccgatatcgcaccactgcactccagcctggcaacagagcgagattccatctaaa

SEQ ID NO: 18353 - DNA, 201 bp, Homo sapiens
tctggggcatctataatgttattcataggcaagaacttgctttgttatgttctgaatcaccataacacagatgctaatataaaacaaatatttatataagygagggtgactgctttggtgacgaggacatgggataaaaatatggtggcagaaatcattgtctgaaaagtaattgttttacttttattcttttcgtgtgtg

SEQ ID NO: 18354 - DNA, 201 bp, Homo sapiens
agctgtagttgctatttcatttttaggaccaagagttgggtgatttgggtgctagaatcaattctaccagtaaccagacaactattcccaagtcacttaamccctctgtgcctcagtttcctccagtataaaatggggtgactttattctagctttcttttagactttttgtgaggaagatatgaaagtatttattcatca

SEQ ID NO: 18355 - DNA, 201 bp, Homo sapiens
agatgtcattttaaaggaactgtttctttctaagacacaactcccactgatgattttttctaaatagttttaagggtcttttcagagctcattgaagatgsatgtgcttggaaaatgagtatttcttttctcattctgcctggtgatctggctgagagtagatttggattgggtttaggagtggcataagggactgagttg

SEQ ID NO: 18356 - DNA, 201 bp, Homo sapiens
aattagccaggtgtggtgacgaacatctgtaatcccagctactcgggaggctgaggcaggagaatctcttgaacccgggaggcagagcttgtagtgagccragatcgcaccactgcactccagcctgggcaacagagcgagactccgtctcaaaaaaaaaaaaaaaaattcaatgtgagtttgggagggggacacaccaca

SEQ ID NO: 18357 - DNA, 201 bp, Homo sapiens
ttaatccattcatgagggcagagtcctcattgcctaatcacctcgtaaaggtcccacatctttatactgttacaatggcaattaaacctcaacgtgaggckgggtgcagtggctcactcctctaatcccagcactttgggaggccgaggtgggtggatcacctgatgtcgggagtttgagaccagcctagccaacatagtg

SEQ ID NO: 18358 - DNA, 201 bp, Homo sapiens
accacttgtctgaggctctgcctcttaaaatccttcaagaggatttcactacacttaccttctcactcacctctaaaggctccaggacgtgctccaggatktgcatgcaaggggccagtttgcatatctgcaaatattgctgggaaacaagcaagattggtgcctgattatgacccattgtgaaccaaaatgtgaaccaaa

SEQ ID NO: 18359 - DNA, 201 bp, Homo sapiens
gtcatggtttttgagggtttattatttttgttcaacataagactaaaagtatgctgtgcattagaaaaatacttcatagtattcttcaaccagaaaaaaaatgtcactaagaggccttctagcctaattattctaatttttgtgaccctttgggctctgagagaaaagttgtctctaatttgcaaccagaaaatctctcca

SEQ ID NO: 18360 - DNA, 201 bp, Homo sapiens
agattggtgcctgattatgacccattgtgaaccaaaatgtgaaccaaataaaagaatgacctatcatctggggcatctataatgttattcataggcaagarcttgctttgttatgttctgaatcaccataacacagatgctaatataaaacaaatatttatataagcgagggtgactgctttggtgacgaggacatgggat

SEQ ID NO: 18361 - DNA, 201 bp, Homo sapiens
cgagggtgactgctttggtgacgaggacatgggataaaaatatggtggcagaaatcattgtctgaaaagtaattgttttacttttattcttttcgtgtgtktgtgtgtgtgtgtgtgtgtgtgtgtgtgtgtgtgtgcatgtgccagatttcttgtttgaaaggcaatgagcttcatccaagtatcaaagaatgttagcat

SEQ ID NO: 18362 - DNA, 201 bp, Homo sapiens
aattagccgagtgtggtggtgggtgcctgtaatcccatctactcgggagtctaaggcagggaaaattgcttgaactcggaggtggaggttgcagtgagccraaatcgtgccactgcactccagtctgggccacagagtgagactccgtcttaaaaaaacaaaaaaagtcaggctttctcactccactgtttttaaaacact

SEQ ID NO: 18363 - DNA, 201 bp, Homo sapiens
gttcaagaccagcctgaccaacatggtgaaaccccgtctctactaacaaatacacaaattagccgagtgtggtggtgggtgcctgtaatcccatctactcsggagtctaaggcagggaaaattgcttgaactcggaggtggaggttgcagtgagccgaaatcgtgccactgcactccagtctgggccacagagtgagactc

SEQ ID NO: 18364 - DNA, 201 bp, Homo sapiens
acgcctgtaatcccagcactttgggaggccaaggcggacagatctcctgaggtcaggagttcaagaccagcctgaccaacatggtgaaaccccgtctctastaacaaatacacaaattagccgagtgtggtggtgggtgcctgtaatcccatctactcgggagtctaaggcagggaaaattgcttgaactcggaggtggag

SEQ ID NO: 18365 - DNA, 201 bp, Homo sapiens
ggaggcaaagcttgcagtgagccaagattgagccactgcactccagcctgggcgacagagtgagactccgtctcgaaaacaaaacaaaacaaaacaaaaaactacctgaatgtaccaaatagcaattgaagtttgcaaacaatgaccttgagtcatctgcttacagaaggtgtctatctgtcttttggacaaaggacttct

SEQ ID NO: 18366 - DNA, 201 bp, Homo sapiens
ttagagtacagtgacacaatcatggctcactatagccttgaccttccgggctcaggtgatcctcccacctcagcctacttggtaggtgggagtacaggcaygtgccaccatgcctgactaatttttgtattttttgtggagatggggaatccctatgttgcccaggctggtctcaaactcctgggttcaagcaatccactt

SEQ ID NO: 18367 - DNA, 201 bp, Homo sapiens
ccctctgtgcctcagtttcctccagtataaaatggggtgactttattctagctttcttttagactttttgtgaggaagatatgaaagtatttattcatcargggtgcaaatgtaaggttttatattctgttatcaaatcaaagtgctaaacttgggaaattcattgccaggtttatctgacacaaatggcatgtcttcagt

SEQ ID NO: 18368 - DNA, 201 bp, Homo sapiens
ttgttacctcctctttgctgctatttcctcattgatgaaattcagaaaacggtgggacctaattaactgtgttattgtgaagattaaatgacacaatacastgccagcacctagttattactcaacataaatttgtcacagttctcacaagacatcagaacacccgctgatgtgctgtcccccatggcactcagcatatta

SEQ ID NO: 18369 - DNA, 201 bp, Homo sapiens
ggtgactgctttggtgacgaggacatgggataaaaatatggtggcagaaatcattgtctgaaaagtaattgttttacttttattcttttcgtgtgtgtgtktgtgtgtgtgtgtgtgtgtgtgtgtgtgtgtgcatgtgccagatttcttgtttgaaaggcaatgagcttcatccaagtatcaaagaatgttagcatctag

SEQ ID NO: 18370 - DNA, 201 bp, Homo sapiens
ccttgaccttccgggctcaggtgatcctcccacctcagcctacttggtaggtgggagtacaggcatgtgccaccatgcctgactaatttttgtattttttrtggagatggggaatccctatgttgcccaggctggtctcaaactcctgggttcaagcaatccactttccttggcttcccaaagtgcttggattacaggcat

SEQ ID NO: 18371 - DNA, 201 bp, Homo sapiens
ctaaaaattcacgtttctggtatccatcattatgggattttaactggtcctacttcagaagttagatttgggagaaaaattatttttaaaaaatggttttwtttgcaacaatgtgaatacacttaacacttaaaaatagttcagatgctaaatattatgatatgtgtttttaccataataaaaaaaatttgagacctgaag

SEQ ID NO: 18372 - DNA, 201 bp, Homo sapiens
aaaggctaatgttttaaaagatgtcctctgcctttctgctctctaggaattttttcttgagtattttctagcttgttgccttaggaatatcttaaaataarctcaatgccaccaagccttcttaaagggctcctttcccctttcaatctttcataatgtgctgtgcattgctcctcacaattcaattaatcttaattggac

SEQ ID NO: 18373 - DNA, 201 bp, Homo sapiens
ttgctcctcacaattcaattaatcttaattggacagggggctcaagtgaaaactgctttgtttcccgaagaaaggttcaaaatgggtaacttttaggtgcyccaattcatatagatttttttgtgcaaaagctgacacccctactcccagatatagtcctaagggtcaaaagattatagaaatcaatttaatgttttgtac

SEQ ID NO: 18374 - DNA, 201 bp, Homo sapiens
gtaatccctgtaaagctagaacaatctccattccccattctcagggccttcctctcccgctcacctgaggagctaccaagccttggcccacaagccctctsagagtccctcctgcccaccctgtgttctccatactgaataaggacttggccacaccttgtcaactcttccctctgctctactcctgacccctggatccat

SEQ ID NO: 18375 - DNA, 201 bp, Homo sapiens
tcaggtctagaggctgcccacattccttgacttgtggccccttccattgtccataccagcaatgtctggttgagtctttctcatgctgctccctctggacygaccttctacccgcttctacttttgaggacactgcttacactggattcacccagataatccaggatcatctctctactcttagatcagctgattagcaaa

SEQ ID NO: 18376 - DNA, 201 bp, Homo sapiens
ttccctctagaatgagagttgcctaaattccagagagacctctttcataactgtaagtcaaaaaatgaaaagtttcagcctgtatgatgaattcatatcastgatgtctgattattttttcctctagaatgggagttgcctggcctccagaaagacctcttttatgatggtaagacacacagctctttcctcaaatgcaat

SEQ ID NO: 18377 - DNA, 201 bp, Homo sapiens
atccatccttcatgctgtggctgaagggatccccccatcatgcaaattctgccacatctcccgcctaaaacccaggaagactccccactactctcagcacrgaaagtacactccttagtatggcatcccctgccctcatggcatggccccatccagccctccagcctcacaccctgcaaggacacctagacccccacctcc

SEQ ID NO: 18378 - DNA, 201 bp, Homo sapiens
attagcacttatcccagtttgtaatttaccatttgtgtcttatttgattaatgtctgtctcccatgtccagccttactctccatgaagccagggagcatayttcttttgtgtatcaatatatgcatttagtgacttgcatatagtaatcactcaataaatgtttgctgaaggaaatttaaggtttgtttactgtttccttt

SEQ ID NO: 18379 - DNA, 201 bp, Homo sapiens
  misc_feature (1)...(201): n = A,T,C or G, or insertion/deletion polymorphism (see Tables 1-2)
tatggatccatgttctgcatattagctcactcatactcatccaagactgtaactataggtacccaacacccagaattgagatggccactgaaaactctatncttgaccaacactctaatatcattttattttctttaattgcctttgtaagaagtataatacaaacaaaactccagtaagcaaatggctttaattatttgt

SEQ ID NO: 18380 - DNA, 201 bp, Homo sapiens
gatccacccaccttggcctcccaaagtgctgggattacgggagtaatccaccacacctggcctttcatgcttttaggaaaaatttgaaattcttttaaacrtgggtcctggagaatcgctgaacttcctttttttttcttctattgagacagaatttctctctgctgtctatgctgattacagactcctgagcttaagaga

SEQ ID NO: 18381 - DNA, 201 bp, Homo sapiens
actttagtttcctgggatgttatctgtatcatgtaaaagaatgtttgattttgaactaaagttaaattctttctcattcttcatcttttggctcaaaagtyacttcttcaggggatacttttctgggcccccaaatctctctgctatgcagtctcacagtcctctgtactttccacattagcacttatcccagtttgtaat

SEQ ID NO: 18382 - DNA, 201 bp, Homo sapiens
tcatgaagaagatggtcagaccaaggaagatatcacatttgtgaaaaggagggtattcaaaggccataaaaggcagaacttcaaaatattttaaaaagccraatgaactaaaatgttcacctgtgataaataatagcaacattgaacatttctcaagcacagagagtaatgtcccacccctgtactaagtgtgcacagtga

SEQ ID NO: 18383 - DNA, 201 bp, Homo sapiens
cattcagaaacagattttcaggtattttcagtatttggtggagttagggagctctgtgcaatctttcctatgagtatacatcccaggttaactatgcaccraagagatcaaggtgtgcaggggttgagaggggtcctctgctgattgagagtgattctttatcagtgtggatggagacaagaaagctgtgtgttcctcatt

SEQ ID NO: 18384 - DNA, 201 bp, Homo sapiens
gctttcataatgcattttaaagggtctgaatatccatccttcggccaatttctattaaggaggtgcagttttcaagaaggataaatcatatgtgctcttgygcccctatttttgctccccatcttctgtaaaatataaaactggtgtcactgagcacccaggtccctgagataaacagttggtttccctgtaggtaatgcc

SEQ ID NO: 18385 - DNA, 201 bp, Homo sapiens
ctctctctctctgagtttagttgtttctttttgctcgaatatatactccacttttatagcgtccccagtgcttagaatggtgtttggtttacagtgaatacctaccatttttctggtgaatgaatggattaataatctattaataacatggtatgtgtaataaaaatgtataggatctaggaaacatcctgtgtgtgggga

SEQ ID NO: 18386 - DNA, 201 bp, Homo sapiens
ctcatctgtagaataggaacgatactaatgcctacttgattgagtggctgtgaggatggatgaatccatgtagaatacttggtccagtttctgccacctastaagtgctcatttaatctaagctgtgattattaacactattaacaatattgtgttttctaaatatatagttggctttctatcacatagagaactttcttt

SEQ ID NO: 18387 - DNA, 201 bp, Homo sapiens
gacgaacatgcttgcagtacggtgatttctttatgctgggtcatgttgttgggagtgttttgttttgtttcggttttgttttgttttatccccccgctccsccaccaatgtacctcttttttcaaggagaagagtcactacgtttgatggcagatggaatcagacggtcactagggggtcttggcacaagcctttgtggtg

SEQ ID NO: 18388 - DNA, 201 bp, Homo sapiens
cttttgtttaaaatgatatgaagtagttacatttcagaaagttacattttggaaaagaataattttgattcctctggatcccataaaagagaaaaagttgtttttttattttcttttgttttttttgtgttttttttttttgtttttgtttttttttgcctctagacttatctttttcccactctttagaatattaaaaaa

SEQ ID NO: 18389 - DNA, 201 bp, Homo sapiens
ttactttcagtctatatgtgtctttactggtacagtgagtttcttataagcaacatatagttggatcatgtttttaaatccattcagccattatattttcrgaatttaatttttttatgttcaaaattattattgatatgtgaagctccattcgttcctgtcatattgttagttgttttctggttgttgtaaatattcttt

SEQ ID NO: 18390 - DNA, 201 bp, Homo sapiens
atacattgcaagttacaatagtaaactcatcctcatgtggcattttcacaatcccagaaaagctggccactttaaaatgaaaaaatttaaaatggtgctatatatttagacaaaacatttggtttgttgatggtgtatttcatttttagagtgtgatttttgttttgtatatattcgtataatgttgacagtgtatatggg

SEQ ID NO: 18391 - DNA, 201 bp, Homo sapiens
aatctctcccactctttcccacaacgctgcccgctccacctttttttctttaagcctaagttttctctttttgtgtctatttatctctttttgtctttccraagtaacacctatcctttccctcccctagcccccacacctaaagctgcgcctaccactgcagcccacggaagctacgcgatccggactgttggggtcagc

SEQ ID NO: 18392 - DNA, 201 bp, Homo sapiens
taaatctcttgctagacttgggaagttttcatctactcattaaataggttttctaatcctttgtctctttgcccttgaggataccaataatgcaaatattmaattgctttatgttgccccaaatattacaaagattttgtttattcttttaaaattcttttttctttatttttgcataactggattatttcaaaagggatt

SEQ ID NO: 18393 - DNA, 201 bp, Homo sapiens
atgttttggaatataatccaattctacataaaatcagtatcattgaatcaagcttggtgagtaggcatcacttagaaatattagcatgtaggcagggcgcrgtggctcatgcctgtaatcccagcactttaggaggctgaggcaggcggatcacctgaggtcaagagttcgagaccagcctgaccaacatggtgaaacccc

SEQ ID NO: 18394 - DNA, 201 bp, Homo sapiens
aggtgggaggattgcctgaacccagggaggtcaaggctgtagtgagctgtgattgtgccactgcactccagcctgggtgacaaagtgagaccctgttttcaaaaaaaaaaaaaacaaaaattaactagatttatatttctcagtcttgttcttcacataacattttttattctataaattctgttgaatttattttcacaa

SEQ ID NO: 18395 - DNA, 201 bp, Homo sapiens
ttctttatctggaatttcaaaaatttctttttgattaaaatctattgctagagaattattgtgttcctctggaggtgtcatattttcttgctttttcatgyttcctgggtccttatgttgctatctgatgtgatggttggtgtaacagttgtttcttctcatttttgaatttacttttgcaggggaggactttttctgaag

SEQ ID NO: 18396 - DNA, 201 bp, Homo sapiens
ggtgggaggattgcctgaacccagggaggtcaaggctgtagtgagctgtgattgtgccactgcactccagcctgggtgacaaagtgagaccctgttttcaaaaaaaaaaaaaacaaaaattaactagatttatatttctcagtcttgttcttcacataacattttttattctataaattctgttgaatttattttcacaag

SEQ ID NO: 18397 - DNA, 201 bp, Homo sapiens
ttctcatagtatttttggtaaacttcaagttcgtatgctgagcaacctacctttttttaatttttttatttttatttatttatttattattatactttaarttttagggtacatgtgtacaatgtgcaggttagttacatatgtatacatgtgccatgctggtgcgctgcacccactaactcgtcatctagcattagttat

SEQ ID NO: 18398 - DNA, 201 bp, Homo sapiens
gacgttcgctctttttcaattttgcttcaaaatgagcagacttgtaagaagcacgatctggccatgacacctgtagatgtggtgctgaataattgctaaayaaggatccaacctccccaacaaagatccacctccctctctaatttgtaaaaacacaaagcaccccatctcagcagcctgtatcctatcaggggaaaccaa

SEQ ID NO: 18399 - DNA, 201 bp, Homo sapiens
cagtcccaccaacagtgtaaaagtgttcctatttctccacatcctctccagcacctgttgtttcctgactttttaatgattgccattctaactggtgtgaratggtatctcattgtggttttgatttgcatttctctgatggccagtgatggtgagcattttttcgtgtgttttttggctgcataaatgtcttcttttgag

SEQ ID NO: 18400 - DNA, 201 bp, Homo sapiens
agcggcagcaaacttgagaaagcagccccgccagtttcggtgacagcgcaccccacggagaccctgtctttgttcccacgggcgttggtccgatgctcctrgaaagcactttgcgggagaacgaggttctccgccgtttgcagcctgccctccctagcggagttctctgctgggcggcgcggtcccgggctctgctcagag

SEQ ID NO: 18401 - DNA, 201 bp, Homo sapiens
tgactttttaatgattgccattctaactggtgtgaaatggtatctcattgtggttttgatttgcatttctctgatggccagtgatggtgagcattttttcrtgtgttttttggctgcataaatgtcttcttttgagaagtgtctgttcatatcctttgcccactttttgatggggttgtttgtttttttcttgtaaatttg

SEQ ID NO: 18402 - DNA, 201 bp, Homo sapiens
tttgcccactttttgatggggttgtttgtttttttcttgtaaatttgtttgagttcattgtagattctggatattagccctttgtcagatgagtaggttgygaatattttctcccattttgtgggttgcctgttcactgtgatggtagtttcttttgctgtgcagaagctctttagtttaattagatcccatttgtcaatt

SEQ ID NO: 18403 - DNA, 201 bp, Homo sapiens
ttagacatgaagtctttgcccatgcctatgtcctgaatggtaatgcctaggttttcttctagggtttttatggttttaggtctaatatttaagtctttaarccatcttgaattgatatttgtataaggtgtaaggaagggatccagtttcagctttctacatatggctagccagttttcccagcaccatttattaaatagg

SEQ ID NO: 18404 - DNA, 201 bp, Homo sapiens
tatggacttctttcataaatggtagaacacgtatccatcacaccttattggattaattcagaaatgccagatatatgtactctttgctgatggttactttkttggtctctaatttaagtcttatctctaatcacattagctgagaaaatggagacattatcattctaaaaataagatggttaacttttatattaggacact

SEQ ID NO: 18405 - DNA, 201 bp, Homo sapiens
atatggctagccagttttcccagcaccatttattaaatagggaatcctttccccattgctttttttctcaggtttgtcaaagatcagatagttgtagatayacggcgttatttctgagggctctgttctgttccattggtctatatctgtgttttggtaccagtaccatgctgttttgcttactatagccttgtaggatag

SEQ ID NO: 18406 - DNA, 201 bp, Homo sapiens
tttggatcctaaagttttcttatttggagcagagctttgtgatagacaggaaagttctggaaaatgagctgagcgatcagactacaggatcccttaagtcyggtgcagtatttcatttttctgtgaatcttaggctcctactccttttccaatttacttcactccaatgtttatgttcctaagagtttgtctgttttccaa

SEQ ID NO: 18407 - DNA, 201 bp, Homo sapiens
agtaccatgctgttttgcttactatagccttgtaggatagtttgaagtcaggtagtgtgatgcctccagctttgttcttttggcttaggattgacttggcratgcgggctcttttttggttccatatgagctttaaagtagttttttccaattctgtgaagaaagtcattggtagcttgatggggatggcattgaatctat

SEQ ID NO: 18408 - DNA, 201 bp, Homo sapiens
ggctgggtgtggtggctcatgcctataaatctcagcactttgggagtctgaggtgagcggattgcttgagcctaggagtttgagaccagcctgggcaacayagtgagactccatctctacaaaaaatacaaaaaattagccaggaatggtggtgtgcccttgtggtcccagctacttgggaggctgaggtgagatgatcgc

SEQ ID NO: 18409 - DNA, 201 bp, Homo sapiens
actgcccttttaatggtttaactggtgtttccccttaggtcatttaaattgtaagtaagtcttccaggtgattgttggattaattaagaaaataggaatcrtattcactttctgtttacctgtataatattccttcctgcctaagagtagttcgtgtttaactccaacttgaaaataagagaaacattgaagaaactatta

SEQ ID NO: 18410 - DNA, 201 bp, Homo sapiens
ttgtaggatagtttgaagtcaggtagtgtgatgcctccagctttgttcttttggcttaggattgacttggcaatgcgggctcttttttggttccatatgarctttaaagtagttttttccaattctgtgaagaaagtcattggtagcttgatggggatggcattgaatctataaattaccttgggcagtatggccattttc

SEQ ID NO: 18411 - DNA, 201 bp, Homo sapiens
atacctagtttattgagagtttttagcatgaagggttgttgacttttgtcaaaggccttttctgcatctattgagataatcatgtggtttttgtctttggytctgtttatatgctggattacatttattgatttgcgtatattgaaccagccttgcatcccagggatgaagcccacttgatcatggtggataagctttttg

SEQ ID NO: 18412 - DNA, 201 bp, Homo sapiens
gaaagaggtatggctgtttattctgattcagattttctttagtgaaaaaaagaaaaaagagggtaaaagaaagcataataactccataaagaggaaagcgtttttttttttgttgttgttttttttaatcagttctgatttcctttctggtatctctgctggtgttttcaaaacttggcaactttgtggctgtggaagact

SEQ ID NO: 18413 - DNA, 201 bp, Homo sapiens
tagcaaagatggccttatacatggtaccacaacctatgtggtacgatgttaggagccctgataagatactctgttcccctacaatctgctccatcaagccrgtgaggaaggtatgtaggcattaggaatgcctaaaatgccacaattagaaaattcattccttggagggcttctgttttctgctgaaagtgcaaacacccg

SEQ ID NO: 18414 - DNA, 201 bp, Homo sapiens
gctgaggtaggaggatcccttaagcccaggagatgcaggttgcagggactgagaacatgcatggcactccagcctgagtaacagagtgagaccctttctcaaaaaaaacaaaacaaacaaaacaaaaaaaacaaccaatactagtcattcccagcatgggctgggcgtgaaaactggagaatggctaacatgagactcttg

SEQ ID NO: 18415 - DNA, 201 bp, Homo sapiens
caggacctctgggtaatgggcagtagccactcaatcagttccagatgtggttcctcttggttgggagacccataaactaataaacaatcagtgccttctgygcctgataggtattggcggaacaggggcaacacaatagaaataaacactcccattggaaagaaagaattggagactcatggccatcaccaatgtatagca

SEQ ID NO: 18416 - DNA, 201 bp, Homo sapiens
gctattcgaccttggacaaattacttaacttctctgagcctgttttctcatctgtacagtggagtttatggctgaggaagtaaaagtacttcataacactraggtatcctgtaaatacagagcgctgtttccctcaaatgatcaatatttttagaaaatccatgaaagacctgtgagaataatgatccaagggcaaactgc

SEQ ID NO: 18417 - DNA, 201 bp, Homo sapiens
acttaacttctctgagcctgttttctcatctgtacagtggagtttatggctgaggaagtaaaagtacttcataacactgaggtatcctgtaaatacagagygctgtttccctcaaatgatcaatatttttagaaaatccatgaaagacctgtgagaataatgatccaagggcaaactgcccttttaatggtttaactggtg

SEQ ID NO: 18418 - DNA, 201 bp, Homo sapiens
ggtcaagagatcgagaccatcctggccaacatggtgaaacctgtctctactaaaaacacaagaattagccgggcgcggtggcacacgcctgtaatcccagytactcaggcaggagaatcacttgaacctgggaggcggaggttgcagtgagccgagatcgcaccactgcactccagcctggccacagagtgagactctgtc

SEQ ID NO: 18419 - DNA, 201 bp, Homo sapiens
ctgttgccaattactctgctcccttttacaacagagtttcctagcattaacgttaatggctgtttccgtttaccctcgtcctgtttctttctttaaaaaawttttttttacatatgtgatatatccaactgattgtcctttttttagaacccactgaaaatagtccttcatcttcaccaatctcctgaaaatattctttca

SEQ ID NO: 18420 - DNA, 201 bp, Homo sapiens
gaatatgaacttttagactgccatattagtgcatcataatagttgctatttggaactgttgatgctcctgactgacccccacagtctctttaaaaaaaaamaacaacttaatttccctgttgttttatactgtggttctctaatcagctggataaaatttccattgatccaaacacactgttaaaaaaaattcccaggtta

SEQ ID NO: 18421 - DNA, 201 bp, Homo sapiens
gtgagcggattgcttgagcctaggagtttgagaccagcctgggcaacatagtgagactccatctctacaaaaaatacaaaaaattagccaggaatggtggwgtgcccttgtggtcccagctacttgggaggctgaggtgagatgatcgcttgagcccaggaggtcgaggctacagtgagctgtgatcatgccactgcactc

SEQ ID NO: 18422 - DNA, 201 bp, Homo sapiens
gagccaggtgttacttattataatggatttagcctcttgtctaccttgataaaaacttcaaaaagtggacaagatgtcatctttcttaaggctcaaacaayaacaaaagcttgcctatgggatggtcatcaataaaaggaaggtaacaaggccctctagctcccactccactgagaataagatttgaggcccagtagtcca

SEQ ID NO: 18423 - DNA, 201 bp, Homo sapiens
caggaatggtggtgtgcccttgtggtcccagctacttgggaggctgaggtgagatgatcgcttgagcccaggaggtcgaggctacagtgagctgtgatcaygccactgcactccagcctcagcgacagagtgagaccctgtctcaaagaaaataaatacatagttgaaaagatacagataattaggttgatccatttgaga

SEQ ID NO: 18424 - DNA, 201 bp, Homo sapiens
atcatttgtttgaacaatggtgttttagaccaaaaaagtaagttttcatgaattctcctcctgcgtcagaaaggtagtgtgtaaagccatggattaaaaakaaaagttaaataaaatgcttatatactttatagtttgcacaacatctagaaattactaatcactaattttcctgtttcacattaaaaacataaaattctg

SEQ ID NO: 18425 - DNA, 201 bp, Homo sapiens
agaaagttacattttggaaaagaataattttgattcctctggatcccataaaagagaaaaagttgtttttttattttcttttgttttttttgtgttttttktttttgtttttgtttttttttgcctctagacttatctttttcccactctttagaatattaaaaaaatgcttgggtcagatactgtttgcattgcattgat

SEQ ID NO: 18426 - DNA, 201 bp, Homo sapiens
gcagccctgcgcaaaggggcagcctcacttctgctcagagtggggctcgtctgtgggtgtgaggccactcctgtgtctttagcaaatgtcaggctcctttkcccccctcactgctacccagctgccaatcccattcccagccttttagttctttaggcattttccttttctcttagtagaaaagaagttccaatagaaata

SEQ ID NO: 18427 - DNA, 201 bp, Homo sapiens
gagtccagaaaggcgcttgctcaaggtggaaggtgagtttgacatagtaggacttcctgaggtgaaagtatgtcttaggtatttgggcacaactggagccrtgaagagatattgcttgtgccaaggactgttaagggacacacacaggcacattgagagcatcaggaatggccaccttacagcatgcgaaggaagacagtg

SEQ ID NO: 18428 - DNA, 201 bp, Homo sapiens
gtgggaaagatatactaagtaggcacaagatcagagaagcagagtcacaggggccattgactggaggggcaggcagctcatcaacaggcgctaatgtaccrttggagtccagtgtggtgtacgattgtgtgtttattgtggtggtcctgaggaagaaggaggaggtgaaggagcagggactcagcagtaatttaaaaagta

SEQ ID NO: 18429 - DNA, 201 bp, Homo sapiens
attgcagaaggagaaaggaggacatgccttctctgtttaaaggagactttccagaagtcccacacaacactactgcttgcatttgatctcatcgattaagrcttagtcctatgatcacatttggctgaagtttggaaaatgtagctttttagctcagcacatagttcacctgagtaacactgggttctattactgaggaga

SEQ ID NO: 18430 - DNA, 201 bp, Homo sapiens
gcagggactcagcagtaatttaaaaagtagataaatgctatcaggaaaatacactctgtgggtgattcatcctctgatgagtggacattgctgagaggtgrtagtttgtgaactgacaatgcaaagacattcaagaggtggagctgtcttcttttgtagtgaagctgcagtagaatatgctttgtttgtatttaagtaata

SEQ ID NO: 18431 - DNA, 201 bp, Homo sapiens
cccctcccccgaccccaccacagtccccagagtgtgatattccccttcctgtgtccatgtgatctcattgttcaattcccacctatgagtgagaatatgcrgtgtttggttttttgttcttgcgatagtttactgagaatgatggtttccaatttcatccatgtctctacaaaggatatgaactcatcattttttatggct

SEQ ID NO: 18432 - DNA, 201 bp, Homo sapiens
actgagaatgatggtttccaatttcatccatgtctctacaaaggatatgaactcatcattttttatggctgcatagtattccatggtgtatatgtgccacrttttcttaatccagtctatcattgttggacatttgggttggttccaagtctttgctattgtgaatagtgccacaataaacatacgtgtgcatgtgtcttt

SEQ ID NO: 18433 - DNA, 201 bp, Homo sapiens
atttctgtggttcttcacatgttcctaatgcaaatgtttccgaagtaatttcttgacagttacagtgttttgagatgaagtgggaagggcttgtgattttraagttggaggatcttggtttgattcctacctctgccatttattatctgggaaatccagtaccacacatgctgggtgctctggggcagttttcttatctgt

SEQ ID NO: 18434 - DNA, 201 bp, Homo sapiens
ctcctccttcatcttcttcttctccaaaagcatcactgaagtgtttaagacacattgttcgattttttaaaattgaaggtatacaacatgacattttgatrtacttatatatagtgatgtgttataatcaagcaaattaacatatccgttatctcacatagttatctttaaaaaaattatttttgtggtaagagcacctaa

SEQ ID NO: 18435 - DNA, 201 bp, Homo sapiens
tcgcaattaaaatggactgcagttttgcatttaagattctgaaatagtcattgactcattcctaataaccctgcccaggatctcaccagcattagaaagaytggagatgtttcagcatccgagttctgggatgcttcttgataatgatcagctagtagttgttttgaaatgtcaagagcatttctgtggttcttcacatgt

SEQ ID NO: 18436 - DNA, 201 bp, Homo sapiens
taatcaagcaaattaacatatccgttatctcacatagttatctttaaaaaaattatttttgtggtaagagcacctaaagtctactgtcttggcaaattttygggaatgaaaatacattagcattttttctagcaccattcaggtataaaggaaagaaattaacctcaggttgcaaatattatttatgtgatcataaagata

SEQ ID NO: 18437 - DNA, 201 bp, Homo sapiens
atgcgctttcagcttggtccagaactgatgccatgtcagtgcccctactcccaaagaccatacctccagatccatttttcaaattcttgagccatcaaagygcattcctgaagatctttgggttttgtagtgcaggctgctgtaagactaggttttcagtcttactaaaggtaattattaggtcataatcattgttcatgt

SEQ ID NO: 18438 - DNA, 201 bp, Homo sapiens
tagtagaataagggctttcagtttaaacagaacccacatgagtgtttcattaatcatgttcacgtgttaatggattctcttgaggcctttggagtcattgyttttgcaatatttccttagggcctttttcttcagtccagattaatctaaaatacattgcactgatccagagatgtcaccaaattctcctgaaaagccctt

SEQ ID NO: 18439 - DNA, 201 bp, Homo sapiens
ttctttttctctttcttttgctctgggtttgctctgtcagtcaggctggagtgcagtgcagtggcatgatcatagctcactgtagcttcaaactcccgggygcaagcgatcctcccacctcagcctcctgaatagctaggactacaggtgtgcaccatcacacctggttaatttgttttgtttttgtagatactggctctc

SEQ ID NO: 18440 - DNA, 201 bp, Homo sapiens
ataattgttgaaaatgtcttaaaaacacagctagtatcaaccagagaaataatttagcaaagagttaatttatttcactaagtagtgatatatttttgaaygcatgtggaatagatgtgtgcctataaacttgactttgtgaattaagttttatttttctagttcagttttactttgaatatggatatgttgttgttttgt

SEQ ID NO: 18441 - DNA, 201 bp, Homo sapiens
aactctgagaaggtttggtgtggtgtacaaggcaaaagaatggttctgtcatgagcgagttgactagctacctggaacctatccattacttgatgagggcrgtagtccttttctgttttcttttcaagtatttggcatcaggattggtgcagccatactggttattgaatactgaactacttccatgaggttggtagatag

SEQ ID NO: 18442 - DNA, 201 bp, Homo sapiens
gactttatagaattttaaggtgttgacttttaaggaatttattgtttaatgagtgaattttgttgcattagtggaggaggaaactcttccaatccagcatrctcctgatgccttagcgtggccttgaatcccagccaagctttcctgatttctttctaaaactcctccgatcactggggtttatcctttctggaccatctc

SEQ ID NO: 18443 - DNA, 201 bp, Homo sapiens
ccagcttctgacttccctccccccattctccttaaaaagctagattataatttttggttaaattaatcatatgtgtttatattattaacataatataaatrtaaatattgttcactgctcagccaattagtattctaggatgacatttcttgacaatttttgacaattgccccattttcatttgcttagtttttaaatata

SEQ ID NO: 18444 - DNA, 201 bp, Homo sapiens
atatgcctgtgctcttaaaagattttgctttaggaatagaaacgtataacttatttttgtttaaaggttacttagctattttattatttttacatattatygtctaaaccttttttagtatggaaggttttttttaacatatacaaaagaagcatgaagtgtatagtgaacccctttgtatgcatcactcaattacatcaa

SEQ ID NO: 18445 - DNA, 201 bp, Homo sapiens
acaacagataaggtcatttggggacaaatcaaggagggcctttaatatcatgctaagaagttgaactttattcttttgagtgataaggagcaagtagggattttttttaaaaaatttcaacttttattttagttatagggggcacatgtgcaggtttgttacatgggtatattgtacccagatagtgagcatagtacccaa

SEQ ID NO: 18446 - DNA, 201 bp, Homo sapiens
tcacagccctcctgcatcttgcagctgtgctgcctggaacacatggcttccaaggttgctgcagcagcacaggagacacggaggaggcacgtgtgcttttcattgcttcagcccagtagtgacacatggcacctccaactgacagtacgttggctagaactggtcacatggtcctaacccagctgcaagggagactgggaa

SEQ ID NO: 18447 - DNA, 201 bp, Homo sapiens
tggcctggtgcacagacttctctttgccactcccctgtgctggaacttctgtttgtggcaggccatttatttctttttctagatttatttcctcattttgmtgaaacacgttacatgatagcttcctgagaaacataagtaggtggcatatattttgagtctttgaatgtctgtgagtgttttattttgctctccatcttg

SEQ ID NO: 18448 - DNA, 201 bp, Homo sapiens
cattgtaaaaagatgatacacattattaatcaaaaattaaacaacaatacccatattgaattttgctagttatggcctagttggaccatagtattgtcttytgcataagcatttatggataacgatccaggaacagcctgttgcactcagaagcatggaaatgccattcattcagtagaactatttcaaatttttttattt

SEQ ID NO: 18449 - DNA, 201 bp, Homo sapiens
ttttggtatatgcagagttgtgtatccatcatcataatcggttttaaagcattttttcatcaccctacaaagaaaccctgttcctctgagccaccattttyctgccctcagtacctgctaatctgctctctgtctctatagatttgcctattctggacatttcctacaaatggaatcctacagtatgtggttctttgtgac

SEQ ID NO: 18450 - DNA, 201 bp, Homo sapiens
aaaatccacacattcgtcagtagaatttaaaacttggcctatgcctgatgactggtttagactacaggctgcaaagcagcggctggtgggccaaatatggyccataggacatatttggctgggacaacacagagctttaagatttttttttttttaacatagtgctgacatttaaaatttaagaaaagaaagaaaacctgt

SEQ ID NO: 18451 - DNA, 201 bp, Homo sapiens
gcttgcatctgatggcaccctcctgtgttgtgactttggtggtgggtcacaactccacatttaccctatccaccctatccactgacatgggtggttttcarctacacatacatggattgtggtgtatgcatttctctcacctgtctttaccaacatcatcttctttcttttgtttcctattcacctgcaatgagtctggat

SEQ ID NO: 18452 - DNA, 201 bp, Homo sapiens
gtctgttgttcccatgtgtatgtccatgtgtgctcaatgtttagctcccacttataagtcagaacatgtggtatttggttttctcttcctagcaaggaatyctgaggaagggagtgaaagaaccaaatttgtgttttagaaaaattggtcaggattgatgtggagagaggccagggccagggagaccagttaggagaaaat

SEQ ID NO: 18453 - DNA, 201 bp, Homo sapiens
gcctgatgactggtttagactacaggctgcaaagcagcggctggtgggccaaatatggcccataggacatatttggctgggacaacacagagctttaagatttttttttttttaacatagtgctgacatttaaaatttaagaaaagaaagaaaacctgtatttcttgctttggaaatcagaggagcggattacactgggta

SEQ ID NO: 18454 - DNA, 201 bp, Homo sapiens
gtgctcaatgtttagctcccacttataagtcagaacatgtggtatttggttttctcttcctagcaaggaatcctgaggaagggagtgaaagaaccaaattygtgttttagaaaaattggtcaggattgatgtggagagaggccagggccagggagaccagttaggagaaaatggtcttaatggatgtaggctggagtcctc

SEQ ID NO: 18455 - DNA, 201 bp, Homo sapiens
cacttctgatataagaatttacttcttccctaatatttggttcagtgaagtgttgaaagaatttgctaagtaatcattgaaagctaagattctagtgaaamacaaaatgcatggtttaaaaattgaacgtactaactgaaagacagtggaagttagatgcttcttgctgtaaataattaaacccaacagtgcagacgagag

SEQ ID NO: 18456 - DNA, 201 bp, Homo sapiens
attttcccagttcttaagtccaaccatttcattcatgttctagatctcattccctctcacctctctgcaattgtcccctctttcttttatgaaatcctctrttccacattaccttctaactatcactctattttttcggttccactttacagtaaaattcttgtacagatgtgcctatatccactgtaattacctttcaat

SEQ ID NO: 18457 - DNA, 201 bp, Homo sapiens
ttttaatgcaaaaagatctcttttaggtcaggtaaggagacagattatttggcatcatatttctattacaagttccagattactcagtggctgtttgttcrtaatccagttatagactggattgatctgtaaccttgagtcattctcctctctcgtgtctcttatgaattctaagttgaaagcctgatgctagggaagttg

SEQ ID NO: 18458 - DNA, 201 bp, Homo sapiens
atatagaattccttagaaaatcccattgttttgatcttcaaaatacatctagaatccaactacttttcaccatcttcacttctgccaccctgattcaaccractgccctctcttgcctcgacgattgcaatggcttccatactgatttccttgctgtagcaacttttttagaacatcagtcagatcacagcacccctctgc

SEQ ID NO: 18459 - DNA, 201 bp, Homo sapiens
tgagattgcccaatcctaggtgctcttattgatgggtgggaaggagtgggattgctgtttaagaaattttattatctttagaagggaagaatgtattatgttttttttttttagatgatctctttcatgtgggctaagataattttgagctctgactgtccaagctgcttagaggttctgagttgttctccactgggggtg

SEQ ID NO: 18460 - DNA, 201 bp, Homo sapiens
atctgctcaggttttctgtttcttcctgatacaatcttggtaggtagtgtgtttccaggaatttatctatttcctagattttccagtttgtcagcatatakttgttcataatagtttctgatgatcttttgtatttctatggtatcagttgtaatgtcttctttttcatttctgattttgtgtatttgggtcttttcttgg

SEQ ID NO: 18461 - DNA, 201 bp, Homo sapiens
cgagagagggcatccctgccttgtgccagttttcaaagggaatgcttccagtttttgtccattcagtatgatattggctgtgggtttgtcataaatagctsttattattttgagatacatcccatcaatacctagtttattgatttagcatgaagtgctgttgaattttgtcaaaggccttttctgcatctattgagataa

SEQ ID NO: 18462 - DNA, 201 bp, Homo sapiens
ttgtccaggacaagatcttctggccctgcggcttaactattgactaccccaacagactgctctacttcatggactcctatcttgattacatggacttttgygattataatggacaccatcggagacaggtgatagccagtgatttggtaagttggtggtgaggaaaaccaaattaaaactacagtcgtggataggtagaaa

SEQ ID NO: 18463 - DNA, 201 bp, Homo sapiens
tacagataagcaattagcccaggagggagaagaaaggggctgagaggatgaaagggaaggcggttaataggtttcttgcctaaggacatctagcctgtgayagagctaagatataaatttgcagtggaccattttttagattcatgccttctgaatgtccccagcctgtttggttggttgagatttctagattccttttgg

SEQ ID NO: 18464 - DNA, 201 bp, Homo sapiens
tcaaaaatagaaatggggtctcactgtgttgcccaggctggtcttgaactcttggcctcaaatgatcctcctacctctgcttcccaaagtgctgacattayaggcaggagccaccttacctggtccaacattatattctttaatccaataaaaatgtggtaatgtttttaagagttagtatcagcttttatgacaattaca

SEQ ID NO: 18465 - DNA, 201 bp, Homo sapiens
atgacatcttgtaagcataaagagataaaatatgccaagtgcttagcatggtgtaaagcatatagacagtgaaaataaactagaaaataatctaaaaatayaatatttttattatatttatcaacccttaaagtaacatattgttttgcttcctattcctatttccatttccaattttcaaatatacaaaggaaagtcttc

SEQ ID NO: 18466 - DNA, 201 bp, Homo sapiens
aatttgactttagggtcacttttaacctttgaccttatatagtacagatgcataccatatagatgtatccataagtttgtgcttttgaggttaaaatattrcttattctctggttacttcatattggaattctctttactgagggttgctatggtgataacacccttagcagtctgcattttgaaaagctttggacttttc

SEQ ID NO: 18467 - DNA, 201 bp, Homo sapiens
taaactctggcaagtttagagatggtagcgtgtgtctggatgccacagaatagcaagtttaggggtcaaagattctcctttcagtgctttgtaaagcacayagtaggttcttcatttaggcaaatgaagaagatatttttgattaataataatgataaaccatatgttatattttgtagcattttataaatttcagagcat

SEQ ID NO: 18468 - DNA, 201 bp, Homo sapiens
ctacagaaaggtcagtgagatgttcaataggtgagaaagctgtcaagctagacttggttaataattacagttaaaataatcactgatgtatttctttcacrcacgtttattgcaagctttttttttatcaggaactgacatgcatagatgaataagacatgcaaataaacaattgtgctacagggtgagaggtctataata

SEQ ID NO: 18469 - DNA, 201 bp, Homo sapiens
atttgtgtgacggagacaatgactgtggagataacagtgatgaaaaccctacttattgcagtgagtaagataaaactgctttctttctatcgttccagagrtgcatgttgtgagctaatacaaagatatgaagcgtgggtattcgggctgatttcaattgtcatttcacattgaccttctaagtagaggtggtaggcagtt

SEQ ID NO: 18470 - DNA, 201 bp, Homo sapiens
cttttatttgttcatttttatttacgcagtgttccttgctcatttttgaagtaattcaaaatgacactcacggtaagcttgcaaggctgcctttcctttaytataacggagaaaaaattctggaaagaaggcagctctttcagtatagtcatataagaacaaaatttccccaaacttggcttgtggctagattggaatccg

SEQ ID NO: 18471 - DNA, 201 bp, Homo sapiens
tgtactgacggctacgatgagaatcagaattgcaccaggagaacttgctctgaaaatgaattcacctgtggttacggactgtgtatcccaaagatattcakgtgaattgaggattcagaagttacccagcatgcctcaaatgtccatgggggctgggctcacttacctatcaggcaccccgtggccacagtgcccagggcc

SEQ ID NO: 18472 - DNA, 201 bp, Homo sapiens
gcctagggcctgtgaaagacagaatctggccttgcacagagggccagggagatgaatggatagggcttgagataagaattctttcttgaagctggtgaccygcttagttttccacttggagtagaggcattggtattacaagaactgtttcactctcttctctctactacaagaaaaataacagcacaagcatgatgataa

SEQ ID NO: 18473 - DNA, 201 bp, Homo sapiens
ggatagggcttgagataagaattctttcttgaagctggtgacccgcttagttttccacttggagtagaggcattggtattacaagaactgtttcactctcytctctctactacaagaaaaataacagcacaagcatgatgataaatagagcttggctcttaggctcagagtcaagtagaggcaggtggagtgaactgagac

SEQ ID NO: 18474 - DNA, 201 bp, Homo sapiens
ggtgatcgcatttgtaatctgtatagacctgggaaagttacttaatatctcaagcctcagacatctcatctgtaaaatggagctactactagggttcttgygaggagtaagagaaacaatatgtaaaaatcccttagcatgaggcatggtgcaagctaagtctagcttagcttgggactaaggaaacgtatcattttacca

SEQ ID NO: 18475 - DNA, 201 bp, Homo sapiens
ataatattgctatcttctgatttcttccaatggtgttggaagaaacaagaatggtgttcaccccaggatatcaaaagggtgcttaatgaggaacatcactrtaagaggccataaacctacaacagctataacagcttcatccgcaggaaagcagctgtggttaggaattagtgattatttaaactcctgacactattccta

SEQ ID NO: 18476 - DNA, 201 bp, Homo sapiens
ctccaggctcatgtttcttatattctaaattctagaactttgatcagtttcatcagcataaccactcttgtaactgctgggctcccttttcagccatggcwgtaaagccacactgtgtctctcgccaatacccagcccagatcctggcacagagcaggcacttgaggcaggtttttggagtgaaattaaaccagctacatc

SEQ ID NO: 18477 - DNA, 201 bp, Homo sapiens
taaagtatgtgacatgtgaggtcaatgtgggtgagagtgagaagggccacttcccagagaaagtgggactgacatagaacctagatggatgtcttgggtaytgataggcaaaggagccaggccggctgttcagaagctcaggcaatagcataaacgaagtcatggaggaaacaaaaatcattctgtgtaccttttgtgtgt

SEQ ID NO: 18478 - DNA, 201 bp, Homo sapiens
taactatattcaacaaggtactttaagatcaagtgacttaagtgaactctggaataatttaagaaggcccccaaatttctaatcattttaaaacattttayaaataaaagttatgatctgcaactggacttaaataagattgcaggacacattttgtgttttattgttatcattaccattatattgggaatgcattcaagt

SEQ ID NO: 18479 - DNA, 201 bp, Homo sapiens
acacttggccaaacccagagtggatggaagaaatagactccatctattgatgggaagagcctaacaattttttagcaactccccgttcctaatccctaacrcacacacagggaggattgtttcaatggcaattttgatgaccttaaagatgttctggagattttattacctggcttatacttatggaaaaaggccttgtct

SEQ ID NO: 18480 - DNA, 201 bp, Homo sapiens
ggttttataattattatatcttatcacatgataatttctatatgtttgaattttcaagtaccaccttgaaaactgtcactgtctacttatcttttacatatttttttttttttagagacaggggtcttgctttgctgcccaggctggagtgcagtggcatgattatagctcactctaactacataaaaagagaagtttttt

SEQ ID NO: 18481 - DNA, 201 bp, Homo sapiens
ctcctgagtagctgggactataggtgtgcaccaccatgcccagctaatttttaaattttttgtagagacacgatcttgttacgtttcccaggctggtctgraatcctgggctaaagtgatcctcctgccttggcctcccaaaatgttgggattataggcatgacccccccatgactggcctgaaaataattttagatgaga

SEQ ID NO: 18482 - DNA, 201 bp, Homo sapiens
ctgctgagtttgaggccttaggacattggattggagctgttcagggggcagttggctctcaggaggaaactcaggaggcactcaggaggacacacacacaycacacacacacacacacacacacaagaaacagtagtgttataaagttatacatatcttttccacatgaaagttattttggtttctatgttgttatatttc

SEQ ID NO: 18483 - DNA, 201 bp, Homo sapiens
tgggtgactgggactggaaatgtgctctgaaatgggaatgatttgtagtttttgcacagggtgtgtcaaatcatgaggtgctgaagggcatgttattcttstaagtagtttgattcattgggtccttatttacctgggcaggcaggccatcttaaattttcttctgtttggatagtgttcttttcaacatcctgtaagtgt

SEQ ID NO: 18484 - DNA, 201 bp, Homo sapiens
catataagtaaaagaagctctgtaggctgggagcctcggatccctgacagttttgcagaacgctgatatctatggactctaaaatagacttcatttatagwtacccacggaccactaatggacaaaaacatgaatcaatatgtattgtggcattcaaatcctagcgctttgggagaggagggaggttccaagatggccgaa

SEQ ID NO: 18485 - DNA, 201 bp, Homo sapiens
catcttccattctatgataataatatataataataatgtgtatagtaatagtaacctagcatacacatatatgtggcaggctttgttctaagcactttatrcttattgactcaattaatcttcataatatcccttggaagtaagtactcttattatcactgttttacagatgagaaagtggaggcacagaacaattcagta

SEQ ID NO: 18486 - DNA, 201 bp, Homo sapiens
cgcggagatggatcgcgggccggcagcagtggcgtgcacgctgctcctggctctcgtcgcctgcctagccccggccagtggccaaggtaagagcccagccrgagcctctcgtggagcccccacttccccggctgtggcagggtcgggtccgcgggaggccggaggggagagcgtccgggcaggggctagggccgggcggcg

SEQ ID NO: 18487 - DNA, 201 bp, Homo sapiens
gcaggtttgggttctgactcccagagactgataggtggcttaaaatagactacagtactttcttttcaaatggcatttaattagtagcaggtttttgtttktttttttaaggaaataagtagcacaaacaattcgggtatggaagcagcttctcttttcagatattaagtgaatatgtgatatggaattcagtcttatttc

SEQ ID NO: 18488 - DNA, 201 bp, Homo sapiens
ccggggaaggaacggcgaggccggggaccgtcgcggagatggatcgcgggccggcagcagtggcgtgcacgctgctcctggctctcgtcgcctgcctagcsccggccagtggccaaggtaagagcccagccggagcctctcgtggagcccccacttccccggctgtggcagggtcgggtccgcgggaggccggaggggaga

SEQ ID NO: 18489 - DNA, 201 bp, Homo sapiens
ttagtagcaggtttttgtttttttttttaaggaaataagtagcacaaacaattcgggtatggaagcagcttctcttttcagatattaagtgaatatgtgayatggaattcagtcttatttctctgggctaataatttgaggcatagaattcttttttaatatactagttcttgggtgctgttaatttatttgcctttgtct

SEQ ID NO: 18490 - DNA, 201 bp, Homo sapiens
ttaaggaaataagtagcacaaacaattcgggtatggaagcagcttctcttttcagatattaagtgaatatgtgatatggaattcagtcttatttctctggrctaataatttgaggcatagaattcttttttaatatactagttcttgggtgctgttaatttatttgcctttgtcttttttctccttcctcctcttctcctt

SEQ ID NO: 18491 - DNA, 201 bp, Homo sapiens
ttgtttttcctcctgcattggatctaaattagacaaaggaaaacattggtgttttcaaaccatttggaaatgagttaaatagctcccgggagaccaaatgragctgagccagtctgccttgaccacagctttcttcacaattacatgcacacattttgctgtaaatcatgttgacaaggccctgggtttatggatggcagt

SEQ ID NO: 18492 - DNA, 201 bp, Homo sapiens
aagatcctaaaatgggtggggacagttggcttcccagttctccctgaccagtagctggcctgacataggtgctgagtgcttgctggataataaatgaaacrttgactaagcattcctattgtatgtatcaattcctgttttacgtatcctacatgtcaaaaagtatagtgattaatgatttccaggaacagaactgagcat

SEQ ID NO: 18493 - DNA, 201 bp, Homo sapiens
atatatagcactcaccctatgagtttccatttgggtatgggcacttttatcatgtgattacccagtacattgccagtgcctactggctatctcattatctrttgaacatagatagtgccactgttcataagctgtctcatagatctgatgtataccaaaattacaaaagttgtatttaattagtttatcaactaaggaaaa

SEQ ID NO: 18494 - DNA, 201 bp, Homo sapiens
tttaaatcaaaataaaatttgacctaaattgatgctgagaagagtctatatcaaggcttctgtacaccttctcaaattcccttatttcttcttctcatgtcacacacacacacacacacacacacacacacactcatacactcacagacatacataaatattgtctagaaaggaattttcagtttcagatttttcaaggga

SEQ ID NO: 18495 - DNA, 201 bp, Homo sapiens
ctgcctgctttcccaggacttggagaaacacatcttttctagtcagaaacaccagtgggtatagctcacttctggtagcatataaatgagctttcttaaarcacagggttgttgcttgtataactctatcatctgttttatttaggaacttttgggaaaatcataaatctaggatagttttttttttactaagaggtgatg

SEQ ID NO: 18496 - DNA, 201 bp, Homo sapiens
ttggagaaacacatcttttctagtcagaaacaccagtgggtatagctcacttctggtagcatataaatgagctttcttaaagcacagggttgttgcttgtwtaactctatcatctgttttatttaggaacttttgggaaaatcataaatctaggatagttttttttttactaagaggtgatgagtttaaagtcaagatgtg

SEQ ID NO: 18497 - DNA, 201 bp, Homo sapiens
tatatatatggagagaatatatatataaaaaatatagagtatgtatctatactatatggtatatagaatctatatagattctatatatgatctatatagawtctatatatgatctatatagatatagaatatatattatagaatatagaatatatatttatagaatacagaatatatatctattatatatagaatatagaa

SEQ ID NO: 18498 - DNA, 201 bp, Homo sapiens
tatagaatatagaatatatatttatagaatacagaatatatatctattatatatagaatatagaatttatatatctgtataggatataggtatattctatrtatctacctatgtgtgtgtgtatgtatgtatgtatctatttatttacgtagcaaggttctgaactcagcatcccctcgtagctacacattcttctctaat

SEQ ID NO: 18499 - DNA, 201 bp, Homo sapiens
tggtaagctttggagattaaaaagaagtgatgatgtgtgtgaaaacactttgcagagttgggtgcatgtgtgcaatgacgaggaagctcttgttacatggtatggtttctgtacacacatctgacagggcacagcttctaaatctacgtgcttgttagtggtgtgactctccaacctttctcctagtgtagttcccttatt

SEQ ID NO: 18500 - DNA, 201 bp, Homo sapiens
ttaagctctttccccaaaatggccttcataggagaggagagagaacttgtgtttgcattattacccttcctagaatagttgactattttaggagggctaayagttaattaacaggacaggttttagtttctctctcccagtcgaaggtattgactacaaggcattggatagggaggttgaggaaaggaagccaagaggctg

SEQ ID NO: 18501 - DNA, 201 bp, Homo sapiens
aggctgtagtgagctgtgattgtgccactgcactccagcctgggtgacaaagtgagaccctgttttcaaaaaaaaaaaaaacaaaaattaactagatttayatttctcagtcttgttcttcacataacattttttattctataaattctgttgaatttattttcacaagttaaatgggaaaataaagaaaatagatatttt

SEQ ID NO: 18502 - DNA, 201 bp, Homo sapiens
ggatagttattttcagtgtaaattctttttcaccttttaaaaaatgtggctggtgttcctggaagagcatctttgaagaagctaattgggtcccgctgtgyctgcaggctaacaggagactcattttagcattttcagtcaagaaacagggccttagagtactgttgctagagtcaggaactcaaaactccagacattaac

SEQ ID NO: 18503 - DNA, 201 bp, Homo sapiens
cttcacctaagaagtaaacattctcaacgtttgtgtacagcttcattttttatgtccattgtctctttctccctcttttttttttcttttttctttctttyttttttttttctttctgagacagggtcttgctctgatgcccagactgtagtgcaatggcgtaatcatagctcactgtagcctccactttccgggcccctg

SEQ ID NO: 18504 - DNA, 201 bp, Homo sapiens
cataattcttttgctctttaccctcatgttctgaaacctctctctctctctctgagtttagttgtttctttttgctcgaatatatactccacttttatagygtccccagtgcttagaatggtgtttggtttacagtgaatacctaccatttttctggtgaatgaatggattaataatctattaataacatggtatgtgtaa

SEQ ID NO: 18505 - DNA, 201 bp, Homo sapiens
tcagctcacaagatgtctcctgtatgtgattcctggtgcacactcatggccaggtgcctttcctttccagctccccgggagtgcacagagagcgagtttcratgtgtcaatcagcagtgcattccctcgcgatggatctgtgaccattacaacgactgtggggacaactcagatgaacgggactgtggtaactgtcatttg

SEQ ID NO: 18506 - DNA, 201 bp, Homo sapiens
ccagtttttgcccattcagtatgatattggctgtgggtttgtcataaatagctcttattattttgagatacatcccatcaatacctaatttattgagattrtttagcatgaagggctgttgaattttgtcgaaggccttttctgcatctattgagataatcatgtagtttttgtctttggttctgtttatatgctggatta

SEQ ID NO: 18507 - DNA, 201 bp, Homo sapiens
tgttaagttttgggggtacattccttaacagatctaattttatcagaaaaccaagttttgctgaacctaaatatctatactacatataagtaaaagaagckctgtaggctgggagcctcggatccctgacagttttgcagaacgctgatatctatggactctaaaatagacttcatttatagatacccacggaccactaat

SEQ ID NO: 18508 - DNA, 201 bp, Homo sapiens
aactttaaagtagttttttccaattctgtgaagaaagtcattggtagcttgatggggatggcattgaatctataaatcaccttgggcagtatggccatttycacaatattgattcttcctatccatgagcatggattgttcttccatttgtttgtgtcctcttttattttgctgagcagtggtttgtagttctccttgaag

SEQ ID NO: 18509 - DNA, 201 bp, Homo sapiens
gggcagttggctctcaggaggaaactcaggaggcactcaggaggacacacacacatcacacacacacacacacacacacaagaaacagtagtgttataaakttatacatatcttttccacatgaaagttattttggtttctatgttgttatatttcatttgaatataattcttgccttgacctgctaaattgatttcatta

SEQ ID NO: 18510 - DNA, 201 bp, Homo sapiens
agaagctaaaaatcttgaaaaaagattagatgaatggctaactagaataaccagcatagagaagaccttaaatgacctgatggagctgaaaaccatggcaygagaactacgtgatgcatgcacaagcgtcaatagccgtttcgatcaactggaataaagggtatcagtgattgaagatcaaatgaatgaaatgaagtgaga

SEQ ID NO: 18511 - DNA, 201 bp, Homo sapiens
aaacagatattctttttcctgggttgatgatttagtcactaaataaccaatacctactcttcttgatagttttttgcacccatccatcttccattctatgataataatatataataataatgtgtatagtaatagtaacctagcatacacatatatgtggcaggctttgttctaagcactttatgcttattgactcaatta

SEQ ID NO: 18512 - DNA, 201 bp, Homo sapiens
attttgtcaccaccaggcctaccttacaagaaatcctgaaggaagcactaaacatggaaaggaacaactggtaccagccactgcaaaaacatgccaaattstaaagaccatcaaggctaggaagaaactgcatcaactaacgagcaaaataaccagctaacatcataatgacaggatcaaattcacacataacaatattaa

SEQ ID NO: 18513 - DNA, 201 bp, Homo sapiens
aaatataaaactggtgtcactgagcacccaggtccctgagataaacagttggtttccctgtaggtaatgccctgtgctctgctgtagtggagaagtcttaycaggtgagatgctacagtgaagaaatcttctgttataggcttatgttctggactgactggggaaaggaacctaaactcgagtctgcctggatgaatggag

SEQ ID NO: 18514 - DNA, 201 bp, Homo sapiens; identical to SEQ ID NO: 2033

SEQ ID NO: 18515 - DNA, 201 bp, Homo sapiens
aacagatattctttttcctgggttgatgatttagtcactaaataaccaatacctactcttcttgatagttttttgcacccatccatcttccattctatgataataatatataataataatgtgtatagtaatagtaacctagcatacacatatatgtggcaggctttgttctaagcactttatgcttattgactcaattaa

SEQ ID NO: 18516 - DNA, 201 bp, Homo sapiens
gactcccacacaataataatgggagactttaacaccccactgtcaacattagacagatccacgagacagaaagttaacaaagatttccaggaattgaactsagctctgcaccaagcagacctaatagacatctacagaactctccaccccaaatcaacagaatatacattcctctcagcaccacattgcacttatttcaat

SEQ ID NO: 18517 - DNA, 201 bp, Homo sapiens
ctctgctgtagtggagaagtcttaccaggtgagatgctacagtgaagaaatcttctgttataggcttatgttctggactgactggggaaaggaacctaaamtcgagtctgcctggatgaatggagaggaccgcaacatcctggttttcgaggaccttggttggccaactggcctttctatcgattatttgaacaatgaccg

SEQ ID NO: 18518 - DNA, 201 bp, Homo sapiens
gttcaagtgcccattctcacgcacagagattctgcatttctaacaagctctaggtaggccacagggtcttggaccacactttggggagcaaggagttagaraattggcagcagcattttcctactcacctggtattgttgattacaacagggctgtgggagaagagctgtctgcagggctgctttagtacaaggcactcgt

SEQ ID NO: 18519 - DNA, 201 bp, Homo sapiens
ggacctgagactgctattgacaggtcaatggcaatggtgagtatggtttcaaaatgattatttgaaggttgtcatttatagaataaatactttttataaaraacaaaattcacctagagaagactgaaatacagtattaggcctctcagaataaggtctgcactacacaagttaggaaacattaggtttgttgctgaaagg

SEQ ID NO: 18520 - DNA, 201 bp, Homo sapiens
acagatattctttttcctgggttgatgatttagtcactaaataaccaatacctactcttcttgatagttttttgcacccatccatcttccattctatgataataatatataataataatgtgtatagtaatagtaacctagcatacacatatatgtggcaggctttgttctaagcactttatgcttattgactcaattaat

SEQ ID NO: 18521 - DNA, 201 bp, Homo sapiens
caatattgaccacatagttggaagtaaagcactccccatcaaatgtaaaaggacagaaattataacaaactgtctctcagaccacagtgcaatcaaactaraactcaggattaagaaactcactcaaaaccgctcaactacatggaaactgaacaacctgctcctgaatgactactgggtacataaagaaatgaaggcaga

SEQ ID NO: 18522 - DNA, 201 bp, Homo sapiens
gaacacaggaggcagggattgcagtgagctgagattgtgccactgcactccagcctgggtgacagagcaagaatctgtctcaaaaataaaataaaataaaataaaataaaataaaataaaataaaataaaataaaataaaaataaataaaaaagaaaaaaaaaagaaaagaaagtagaaggtgcttatgaaagagtgttga

SEQ ID NO: 18523 - DNA, 201 bp, Homo sapiens
agccaaatcatgagtgaattcccattcacaattgcttcaaagagaataaaatacctaggaatccaacttacaagggatgtgaaggacctcttcaaggagarctacaaaccattctcagtgaaataaaagaggacacaaacaaatgaaggaacattctatgcttatggataggaagaatcaatatcatggaaatggccatac

SEQ ID NO: 18524 - DNA, 201 bp, Homo sapiens
aacacaggaggcagggattgcagtgagctgagattgtgccactgcactccagcctgggtgacagagcaagaatctgtctcaaaaataaaataaaataaaataaaataaaataaaataaaataaaataaaataaaataaaaataaataaaaaagaaaaaaaaaagaaaagaaagtagaaggtgcttatgaaagagtgttgaa

SEQ ID NO: 18525 - DNA, 201 bp, Homo sapiens
catgagccactgtgtctggcccctagtttctctgaaaagttcttacaagtctagcgtttatgaatttttccagaagttccttgagtttttaatatatatayattttaatatatacatataacatatatttctgacaggccttttcgtgcagtcctgcatttcataaatttactatgtgctgtataaagatatagtcatgtg

SEQ ID NO: 18526 - DNA, 201 bp, Homo sapiens
agataaacacgtgcatggtgcaggctgttttcaaacgtcacgaattggggattgcattgagaaaatgggttattctagtggaaaagtgtgtgggtccacayacagagtgctgcgaatgatgggctgtgctccgctaggtggtcccccatccctaccccttttctgctctcctacctcccgttctccctccctcctttcccc

SEQ ID NO: 18527 - DNA, 201 bp, Homo sapiens
tggagaaacacatcttttctagtcagaaacaccagtgggtatagctcacttctggtagcatataaatgagctttcttaaagcacagggttgttgcttgtakaactctatcatctgttttatttaggaacttttgggaaaatcataaatctaggatagttttttttttactaagaggtgatgagtttaaagtcaagatgtgt

SEQ ID NO: 18528 - DNA, 201 bp, Homo sapiens
atctatttatttttaattttactttaagttctgggatacatgtgtgacgttcccctctctgtatccatgtgttctcatcgttcaactcccacttatgagtragaacatgtggcgtttggttttctattcctgtgttagtttgctgagaatgatggcttccagcttcatccatgtccttgtaaaagacatgaacttgttcct

SEQ ID NO: 18529 - DNA, 201 bp, Homo sapiens
caaatggaaagtagatgggagggggcaaaactgatagcaaggagctcattctaaggctctccctataatttagattgatgagtggattgataaatttgagktaacagaatttcatgattgattggcaatgggggtggaaaaaagaaggagtcaagaatgatgtaaatttcagcttggcttctggggcaatggtggtgctga

SEQ ID NO: 18530 - DNA, 201 bp, Homo sapiens
aacacatcttttctagtcagaaacaccagtgggtatagctcacttctggtagcatataaatgagctttcttaaagcacagggttgttgcttgtataactcyatcatctgttttatttaggaacttttgggaaaatcataaatctaggatagttttttttttactaagaggtgatgagtttaaagtcaagatgtgtaatcag

SEQ ID NO: 18531 - DNA, 201 bp, Homo sapiens
tgtgaaacaggtaaaagctcattttcccccttagttcttttattattcaatctggtcatctgtaaaatggcatctcatattaaacagcttgtcaattaacttttttttttttttaaggaacagagagattcaaaactgcggtccattttacttctaatgggattagcatcaaggaaaaaccactcatgcagggtctaagat

SEQ ID NO: 18532 - DNA, 201 bp, Homo sapiens
acttttttggctgagatgcatatgagaaatatattttacatggcgacacagtgtgtgtgtgtgtgtgtgtgtgtgtgtgtgtgtgtattggtttgggctcyatcctgctgagtttgaggccttaggacattggattggagctgttcagggggcagttggctctcaggaggaaactcaggaggcactcaggaggacacacac

SEQ ID NO: 18533 - DNA, 201 bp, Homo sapiens
attagattttgtcttttgttctgcccaggtgggtccctgggaataactactaaagtatgaaaccatggtgttgtctggctttcaatgaaaacatgtagccycgtgccactaaacatgatgtacattataaacatttgtttaccccttagaaggcatcttacttctttgtactattccttggagcatttgatgcacattttt

SEQ ID NO: 18534 - DNA, 201 bp, Homo sapiens
gtcatttgagaagcttaccatagaattttgtactgtgacagtgtaggggcttcaaattagtgtttataaggcttttagaggaaaattatttttgtatatgkgtaatatgtaaaccttagcataacacagtatcttctgctctgtattttctatgcattattcttaactcatagcagtctagattagtcataattgaggaaa

SEQ ID NO: 18535 - DNA, 201 bp, Homo sapiens
catttgagaagcttaccatagaattttgtactgtgacagtgtaggggcttcaaattagtgtttataaggcttttagaggaaaattatttttgtatatgtgkaatatgtaaaccttagcataacacagtatcttctgctctgtattttctatgcattattcttaactcatagcagtctagattagtcataattgaggaaaat

SEQ ID NO: 18536 - DNA, 201 bp, Homo sapiens
tcaggcaggagaatcacttgaacctgggaggcggaggttgcagtgagccgagatcgcaccactgcactccagcctggccacagagtgagactctgtctccaaaaaaaaaaaaaaaaaaaaaagtctggatcaatgtacacacttttcatagcagcttctgaaagagcctgtttcttgttactgttatgatataggctgtgt

SEQ ID NO: 18537 - DNA, 201 bp, Homo sapiens
acttttaaatccagttttgggggtctgtctacacactgttgctactaggcatgtgggtcatgctggttttgttgcctgattgggctccattgcttggctttggtctagagtcatggacttcatagtattcatgaaatgtagtccaagtccaagcacatgatgctcactttctgaatgtggtctattttccaaggtgtaatc

SEQ ID NO: 18538 - DNA, 201 bp, Homo sapiens
cttttaaatccagttttgggggtctgtctacacactgttgctactaggcatgtgggtcatgctggttttgttgcctgattgggctccattgcttggctttggtctagagtcatggacttcatagtattcatgaaatgtagtccaagtccaagcacatgatgctcactttctgaatgtggtctattttccaaggtgtaatca

SEQ ID NO: 18539 - DNA, 201 bp, Homo sapiens
ttttaaatccagttttgggggtctgtctacacactgttgctactaggcatgtgggtcatgctggttttgttgcctgattgggctccattgcttggctttggtctagagtcatggacttcatagtattcatgaaatgtagtccaagtccaagcacatgatgctcactttctgaatgtggtctattttccaaggtgtaatcac

SEQ ID NO: 18540 - DNA, 201 bp, Homo sapiens
ttggcctcccaaagtgctgggattacaagcatgagccactgcacccagtggttggccactcttaatagcaaccttcacagtataacaatgaactgtctctrgtttcctttgtcaccttaaagcggcatggagggaggggtgttatgcctcttgagtagataatggaacatcattttcattaccaacagggtatggaaatct

SEQ ID NO: 18541 - DNA, 201 bp, Homo sapiens
tgcaatagaaattaattttttattactataaagaatattcttttttttttatttttccataggtttttggggtacaggtggtgtttggttacatgagtaarttctttagtggtgatttgtgagattttggtgcacccatcacctgagcaatatacactgcaccctatttgtagtcttttatccctcgcccccctcccaccc

SEQ ID NO: 18542 - DNA, 201 bp, Homo sapiens
ttcatcaggatttactcatttacccaagtgaattaactggcaagacttgtacatatatggatactcattctttcttgctgaagcctgaagcgatgctactrtcctaactattcagatatccagcatgaatggttaagcgcgtacttgttgcaaagaggcattcaggtcttttggaagggaaatcattctccttcattctcc

SEQ ID NO: 18543 - DNA, 201 bp, Homo sapiens
aacctcatattttctctcacctgggtacagttagacttctctgacaagccatgataatgggaagttccaaattcttcacctaagaagtaaacattctcaaygtttgtgtacagcttcattttttatgtccattgtctctttctccctcttttttttttcttttttctttctttcttttttttttctttctgagacagggtc

SEQ ID NO: 18544 - DNA, 201 bp, Homo sapiens
cctcctgaggagctggtattacaggcgtgcaccaccacacctggctaattttgtatttttagtagagacagggtttctccatgttggtcaggctggtctcraactcccgacctcaggtgatctgcctgcctctgcctccctaagtgttgggattacaggcgtgagccactgcacccagctgtgtagttctactcttgacaa

SEQ ID NO: 18545 - DNA, 201 bp, Homo sapiens
atatttattaaatatcaacagtgtgctgatgagtcaatagtatcaatactacagaaacattaaggaagatgagaactgaaaagaggtgtctacatatctcrcaattaaaatggactgcagttttgcatttaagattctgaaatagtcattgactcattcctaataaccctgcccaggatctcaccagcattagaaagattg

SEQ ID NO: 18546 - DNA, 201 bp, Homo sapiens
ataaaaataaataaaaaagaaaaaaaaaagaaaagaaagtagaaggtgcttatgaaagagtgttgaatggataggaaaggggttctcaaggttgactgcasgaatctagagcaactaaaaaaatactaattgtgaagccctattctagcatggaaaaaataagcttgatggaacctttggtataaatcaaatggttctatc

SEQ ID NO: 18547 - DNA, 201 bp, Homo sapiens
gggaatgccattaattccaggactattctttaaatcttatttcatatatttaaaaaaaatcacattattgatcatgtaactgaacatattattttaagtgycagttcataggcaaattatgagcagatttatatactgacctccctaatcctcgcatgatttgtagaagaaaacaagtgaagccccattctctaactatta

SEQ ID NO: 18548 - DNA, 201 bp, Homo sapiens
tagtaagactataaaagtatttcttctgtgagatagaatgtctgcagtcttgtctgttttgatgtcagtaaataaaaacaattcagtgaaaatgaggactstacgtagggttctcagtctagctttgttccatactaccactgagtacaaagaataaagaactgataatgtccctaagagacatattagctttccacttga

SEQ ID NO: 18549 - DNA, 201 bp, Homo sapiens
acacaggaggcagggattgcagtgagctgagattgtgccactgcactccagcctgggtgacagagcaagaatctgtctcaaaaataaaataaaataaaataaaataaaataaaataaaataaaataaaataaaataaaaataaataaaaaagaaaaaaaaaagaaaagaaagtagaaggtgcttatgaaagagtgttgaat

SEQ ID NO: 18550 - DNA, 201 bp, Homo sapiens
atttgcctgcctgtaccaggaggattgttttcctgcgcctgtgccactggatttaaactcaatcctgataatcggtcctgctctccatataactctttcaytgttgtttcaatgctgtctgcaatcagaggctttagcttggaattgtcagatcattcagaaaccatggtgccggtggcaggccaaggtatgccaactcca

SEQ ID NO: 18551 - DNA, 201 bp, Homo sapiens
cacaggaggcagggattgcagtgagctgagattgtgccactgcactccagcctgggtgacagagcaagaatctgtctcaaaaataaaataaaataaaataaaataaaataaaataaaataaaataaaataaaataaaaataaataaaaaagaaaaaaaaaagaaaagaaagtagaaggtgcttatgaaagagtgttgaatg

SEQ ID NO: 18552 - DNA, 201 bp, Homo sapiens
ggtcctgctctccatataactctttcattgttgtttcaatgctgtctgcaatcagaggctttagcttggaattgtcagatcattcagaaaccatggtgccrgtggcaggccaaggtatgccaactccaatataagtaagatttgacttcatctggcaccaggttgaaatccctggtgccatgaaaacatttcttcatgtgt

SEQ ID NO: 18553 - DNA, 201 bp, Homo sapiens
acaggaggcagggattgcagtgagctgagattgtgccactgcactccagcctgggtgacagagcaagaatctgtctcaaaaataaaataaaataaaataaaataaaataaaataaaataaaataaaataaaataaaaataaataaaaaagaaaaaaaaaagaaaagaaagtagaaggtgcttatgaaagagtgttgaatgg

SEQ ID NO: 18554 - DNA, 201 bp, Homo sapiens
aggaggcagggattgcagtgagctgagattgtgccactgcactccagcctgggtgacagagcaagaatctgtctcaaaaataaaataaaataaaataaaataaaataaaataaaataaaataaaataaaataaaaataaataaaaaagaaaaaaaaaagaaaagaaagtagaaggtgcttatgaaagagtgttgaatggat

SEQ ID NO: 18555 - DNA, 201 bp, Homo sapiens
cttagaaggcatcttacttctttgtactattccttggagcatttgatgcacatttttccatcttgttgctcggtcacttttgtaatagagcttgtgtgagttttttttttttttaaggaatttagaactatgtcagtttttatctcctttgcagtttttggtgatagctctgttatgggaagaaggcagtgctgtggatct

SEQ ID NO: 18556 - DNA, 201 bp, Homo sapiens
tcatctctagctacactgcctccttggtggcctcatcctgtctcatggccctctttgaagcagggagtggtttcccaattcagggaggcggcatggactckggtggaaagaacatcacatgtcaagtcaggacattcatggatcttgttcctgaagaaagaaggaaaaataggcacaaccaaagagggccccaggctgctg

SEQ ID NO: 18557 - DNA, 201 bp, Homo sapiens
ccttggagcatttgatgcacatttttccatcttgttgctcggtcacttttgtaatagagcttgtgtgagttttttttttttttaaggaatttagaactatrtcagtttttatctcctttgcagtttttggtgatagctctgttatgggaagaaggcagtgctgtggatctggactccttggagcaaccctctcaggcacat

SEQ ID NO: 18558 - DNA, 201 bp, Homo sapiens
gtgtgtgtgtgtgtgtgtgtgtgtgtgtgtgatggagtcttgctctgtcacccaggctggggtgtagtagtccaatctcagctcactgcagcctctgcctsctggtttcaagtgattctcctgcctcagcctcctgagtagctgggattacaggtgcatgccaccgcgcctggctaatttttttgtattttcagtacagat

SEQ ID NO: 18559 - DNA, 201 bp, Homo sapiens
aactttatggcctgttttttggtattgactctcctgtttgtcctggtactccttctggaaagttatttttcctgtgtaggtttcctagaattcctagaatwtatcatattgaagtactttgttaactatgccataagttgtgggaaactagagttggcctcacttttcccttcttcctaatgtggatgggaaactgactgg

SEQ ID NO: 18560 - DNA, 201 bp, Homo sapiens
gagttcggcttgctgagaggtagtggagcggggcagagcggtagcctcaatgatagatgtggaagatactatagcatagcctgcctttgctggtgagtggygattaggcctggtggaactgctatcagtaaaccaagtgtgttcagggtgaggaacaggaaaaaaggaaatatggggaaatggggtgaatgtcaggtggat

SEQ ID NO: 18561 - DNA, 201 bp, Homo sapiens
gaagtctcacttagtcacccaggctggagtgcaatggcactatcttggctcactgcaacttctgcctcctgggttcaggagattctcccagctcagcctcycaagtagctgggactacaggtgcatgccaccatgcctggctaattttttgtatttttagtagggatggggttttgccatgctggccaggctggtcttgaa

SEQ ID NO: 18562 - DNA, 201 bp, Homo sapiens
gacataccttttccttggttaaaaagaaatcagaagatgacctgataatcactacaaaaataatctttcatgaagaagatggtcagaccaaggaagatatcacatttgtgaaaaggagggtattcaaaggccataaaaggcagaacttcaaaatattttaaaaagccaaatgaactaaaatgttcacctgtgataaataat

SEQ ID NO: 18563 - DNA, 201 bp, Homo sapiens
agagttgcttattgatgttgaagcattggtttcgttagagtaaattatgtatatatatgtgtatgtgcatgtacgtatgtgtgtgtatatatatatgtatmtacctgatctctactttctgaaaatttacacatttagaatgggaggttatttagttcctagcatgtaacttgtgacttataaacccacttagcaattaca

SEQ ID NO: 18564 - DNA, 201 bp, Homo sapiens
tggggaaatgccgtctctactaaaaatacaaaaatattagccaggtgtggtggcgcacacctgtagttccagctactcggtaggctgaggtggaaggatcrcttgaacccgggaggcggaggttgcagtgagccgagactgtgccactgcactccagcctgggcaacagactgtgactccatctcaaaaaaaaaaaaaaaa

SEQ ID NO: 18565 - DNA, 201 bp, Homo sapiens
tagggtaaagtgtgagctgttaaaagtctgtcttggaacatctggatcagaataacagggatcatttatatgggctctacaaaaataaactgtgttttttkttttttttttactgtgaaagttcaataaaaatcaaaagtaaaaatcatttgaatcccatcactaaaagagaactaacctttaaagtttggtgtacttttg

SEQ ID NO: 18566 - DNA, 201 bp, Homo sapiens
agcggggaaataggatttgccacagaaattaccttactctgttaactttggacaatgttccattgactaccacttgtctttgtcttataagaatagaattkatggaaggagaaagaaacttacaaggaacgggtaaaagaatgaaactgctattaatatgactcaatgtttttttctttctttttttttttttttgaaaaa

SEQ ID NO: 18567 - DNA, 201 bp, Homo sapiens
cgggaggcggaggttgcagtgagccgagactgtgccactgcactccagcctgggcaacagactgtgactccatctcaaaaaaaaaaaaaaaaaaaaaaaaragaaaaaaaagaaaaagaaaagaaaagagaagaaacttggccttttggtgggttatggaatggtgggccacccagcaggaatggttgaacccaattcaca

SEQ ID NO: 18568 - DNA, 201 bp, Homo sapiens
ttagtttggacattctaaaaaatgagaaaacattggtttgactgatgttttctcatgcttagatttggggcatgcacagtaataccacagaagtgctgctstgtccttcagagtgtgtcacaccaggaggaacatgatgtcagtttgcctcatattagttttgattgttgtgttgactttgattccttggttcaatgtaga

SEQ ID NO: 18569 - DNA, 201 bp, Homo sapiens
gtcttggaacatctggatcagaataacagggatcatttatatgggctctacaaaaataaactgtgtttttttttttttttttactgtgaaagttcaataamaatcaaaagtaaaaatcatttgaatcccatcactaaaagagaactaacctttaaagtttggtgtacttttgctatcttttttttgcatatgtatatgtaa

SEQ ID NO: 18570 - DNA, 201 bp, Homo sapiens
tgtcttataagaatagaatttatggaaggagaaagaaacttacaaggaacgggtaaaagaatgaaactgctattaatatgactcaatgtttttttctttctttttttttttttttgaaaaaaacttctagatattccccttttttcagattattccagattccatttttctttctatggatttaagatggtaaatttctat

SEQ ID NO: 18571 - DNA, 201 bp, Homo sapiens
aggctgcgaaagcacgtagtacatgttcgaagaaccaagtggaggccagggtggctgaactgtcaagtaaagtttgagatattgtcaaaggcccaatcatrcaagggtttgtaggctatgctaaaaatttttcattttattgtggaaaaatggaaaagtgattgaaaggttgtaatcaggcaagtgtatggttggcataat

SEQ ID NO: 18572 - DNA, 201 bp, Homo sapiens
cgtatcttaatctcaccttcaaggctgcgaaagcacgtagtacatgttcgaagaaccaagtggaggccagggtggctgaactgtcaagtaaagtttgagakattgtcaaaggcccaatcatgcaagggtttgtaggctatgctaaaaatttttcattttattgtggaaaaatggaaaagtgattgaaaggttgtaatcagg

SEQ ID NO: 18573 - DNA, 201 bp, Homo sapiens
tctatcattctcatcttttcaaaaattcaacctctttttagtagtactatgaaatcttaatttccgaagataggatttattaatattcaaagaaattattragatccaaagataggattctcagttcatcagtgaggttggggaattattcttgctgttcttctaggatttggcttccagtatataactagagtatgatta

SEQ ID NO: 18574 - DNA, 201 bp, Homo sapiens
tatatatttcaaatttcaaggagaaattctttgtattgtatttttacctggtatacaaagatacttaaacggcaatatttgaatgtagaatatggctttcttttttttttttttttttgagatggagtctcactctgtcacccaggctgaagtgcagtgatgcgatctcggttcactgcaaactccacctcccaagttcaa

SEQ ID NO: 18575 - DNA, 201 bp, Homo sapiens
tgtacttggttatgtgtttttacttctttttatgtctttgtttcaaaaaatgagactaaattgaggccattagattgtcaaattaaatttggttctgttgktaatgtgctcattaatttttctaactttaatattttctaatttcaatcagaacttatcacaaaaaaatgaagtccagggatttgtgttgctgtgattaaa

SEQ ID NO: 18576 - DNA, 201 bp, Homo sapiens
cttaaacggcaatatttgaatgtagaatatggctttcttttttttttttttttttgagatggagtctcactctgtcacccaggctgaagtgcagtgatgcratctcggttcactgcaaactccacctcccaagttcaagtgattctcctgcttcaacctccccagtagctaggattacaagcatacaccaccatgcctggc

SEQ ID NO: 18577 - DNA, 201 bp, Homo sapiens
aaaagcactctctgtagactaagaacacagcctatgtagagttcggtactatctgaggtttcatgcatcccttggtgatcttggaatgtatcccccatggwtgagtgcagatgactgtttttatttctgccaaatgaagaaatagggaaaaggtgtcccaggcagagaaaagagctctcactggaacagcgcttgagttta

SEQ ID NO: 18578 - DNA, 201 bp, Homo sapiens
atggtttcaaaatgattatttgaaggttgtcatttatagaataaatactttttataaagaacaaaattcacctagagaagactgaaatacagtattaggcytctcagaataaggtctgcactacacaagttaggaaacattaggtttgttgctgaaaggtgtctaaaaacattggtaataacattggaatttacccctgct

SEQ ID NO: 18579 - DNA, 201 bp, Homo sapiens
caggcagagaaaagagctctcactggaacagcgcttgagtttacaaagatctttcactagcatctaatttaatcctcacaacattcctgagggcaggcagktctggtagccatttgtgatgagagggaaatttgcagtgtgcacaagtatctcaagccaggtagaattatcaggtgttaacatgaagggccccttggaggc

SEQ ID NO: 18580 - DNA, 201 bp, Homo sapiens
tggtttcaaaatgattatttgaaggttgtcatttatagaataaatactttttataaagaacaaaattcacctagagaagactgaaatacagtattaggccwctcagaataaggtctgcactacacaagttaggaaacattaggtttgttgctgaaaggtgtctaaaaacattggtaataacattggaatttacccctgctc

SEQ ID NO: 18581 - DNA, 201 bp, Homo sapiens
ctacactgaaattagaaacaacttttttctccaatattaataaatatttctgctgtcagcactagggtgtttggtttccaaagcccttgcatttgatatarctttttaaaccaccattacgcacattggaagatactgttggctctcagttatcttaatttttccagtagtggagacggaatatcttctccatgttttctt

SEQ ID NO: 18582 - DNA, 201 bp, Homo sapiens
agaattatcaggtgttaacatgaagggccccttggaggctcctctggttcaaactcttttttttatttttatttttttacatcagaaaccaaggcccacaraagctaagaagatgtcttaaatggtcagcttcactgctctaattcctgagcagtattctctctttgcacttttataaactacaactccggcaatccagac

SEQ ID NO: 18583 - DNA, 201 bp, Homo sapiens
tatttgactgataaagttcaaagaggtgaatttatttgcctcagattgtacagtcaggacctggcagggcagagatttcagctcatgtgtttcagtttagkttgttgacttggaacagaattcactgtacctctgagtaaatttggactattttgatcaactgtgttggcagtaactggccaccgagtgccttggtggggt

SEQ ID NO: 18584 - DNA, 201 bp, Homo sapiens
gtcagaacatgtggtatttggttttctcttcctagcaaggaatcctgaggaagggagtgaaagaaccaaatttgtgttttagaaaaattggtcaggattgrtgtggagagaggccagggccagggagaccagttaggagaaaatggtcttaatggatgtaggctggagtcctccggtctgtttgattggctatttcattct

SEQ ID NO: 18585 - DNA, 201 bp, Homo sapiens
atgggttgcaggagtgatcccattttgttttccttctttgtttaaagctcttgtggaaagtgggaaagggaactgccagtcaccgagcaccagccaccacyttacccacttttcacgtcaatgctgcaaggtgggtatgaggaccagctctgttttacagagattgtaaagattatcaagatgtaagagtaggggagccag

SEQ ID NO: 18586 - DNA, 201 bp, Homo sapiens
agggaaaagatattagtgttaactatcaaagtctctgaagtgaaagaggaaaaccaccttaaaattttttttaaatttatttttatttatttatttatttwttttttagacaaagtctcactctgtcgcccaggctggagtgcagtggcaagaccttggctcactgcaacctctggctcctgggttcaagcaattctcctg

SEQ ID NO: 18587 - DNA, 201 bp, Homo sapiens
tgatcttgagtatgctttcaaattctcaacagcctgccctggtttatctctatacattctgttttggaaactagaacttgatcctaataagagtaaataarcactttgttgaaatacgtttaaatgaatcacttttaaatagagatgactaaatctcactaagttctcagttgaagcatttgtagctcatagctcaagttt

SEQ ID NO: 18588 - DNA, 201 bp, Homo sapiens
cttaaagtataataataataaataaataaaaaagaaatagatgagctcagaaaaaaatatgtatataaaattacaaatagctgggactattacaaaatacmaaattacaaaatacaaaaaaaacaaaattacaagtagctaggactacaggcacatgccaccacacccagctaatttgtattttgtattttcacaaaattt

SEQ ID NO: 18589 - DNA, 201 bp, Homo sapiens
cacgctttcctgatggtgcatactgccaggctactatgttcgaatgcaaaaaccatgtttgtatcccgccatattggaaatgtgatggcgatgatgactgyggcgatggttcagatgaagaacttcacctgtgctgtaagagggagagaaacggagtgaatgggagtggtgttgtctgtcaaatctcattgtttcttacgt

SEQ ID NO: 18590 - DNA, 201 bp, Homo sapiens
cctggagagggtgccttatgctgcatgaggaaagtaaaaccagacccgtcgaatgaagtgtgtcccccgtattttctacatgacaccaccttaaagtgggmattattgcacacagtcttgcaccctctgttgcctcactgcaggaagacaaacttcctgttttcccctgccctcatttgcctgaagaaaggtgacttctaa

SEQ ID NO: 18591 - DNA, 201 bp, Homo sapiens; identical to SEQ ID NO: 2029

SEQ ID NO: 18592 - DNA, 201 bp, Homo sapiens
tgtcctgcaagtagacacaatggggtcaacacacatggatgactgagtgtttctaatgcatatgagactctaatgtctttgtgtgtgcttgtgtgtgtgtytgcctgtatgtgtccaggtatagggactgctgatggcattgcctttgactggattactagaagaatttattacagtgactacctcaaccagatgattaat

SEQ ID NO: 18593 - DNA, 201 bp, Homo sapiens
ttgtatgatttagaactctatgtattttactgcaccctggtcaacacttgatatacatgtatatatttgtgtgtgtgtgtgtgtgtgtgtgtgtgtgtgtrtgtgtatataatcaattggtcaatgttagggaaattatagtcttcttaaaattttataatttcctcctatttgtaactttgttctaacctatctgtatcc

SEQ ID NO: 18594 - DNA, 201 bp, Homo sapiens
gtatgatttagaactctatgtattttactgcaccctggtcaacacttgatatacatgtatatatttgtgtgtgtgtgtgtgtgtgtgtgtgtgtgtgtgtrtgtatataatcaattggtcaatgttagggaaattatagtcttcttaaaattttataatttcctcctatttgtaactttgttctaacctatctgtatccat

SEQ ID NO: 18595 - DNA, 201 bp, Homo sapiens
cttgtcctgcaagtagacacaatggggtcaacacacatggatgactgagtgtttctaatgcatatgagactctaatgtctttgtgtgtgcttgtgtgtgtktctgcctgtatgtgtccaggtatagggactgctgatggcattgcctttgactggattactagaagaatttattacagtgactacctcaaccagatgatta

SEQ ID NO: 18596 - DNA, 201 bp, Homo sapiens
gctttgataatcccagaggacttgcccttcaccctcaatatgggtattgtctccctgcaatcctgggcttttctttcacctccttcttctgcctctgttamcgagaaggctgttcatgtaactatctcaaggccaatgtcttgctggggtttgtcttctgcttttcctacttggtaaattgtttagtgtaatgagtagaag

SEQ ID NO: 18597 - DNA, 201 bp, Homo sapiens
ccaaggcggaaggaaaatcagacagcccaaatcctccatgtgaaagacagaccacatgtgaagaccacatgtatgttgagttcactgcatttgtggtacaygcatagtgaaccatgttccctgtaccaaacaagtaggggacctggggactacccttgagttcctcacatctgtacaggcagcagctagaggtctcactct

SEQ ID NO: 18598 - DNA, 201 bp, Homo sapiens
atttctttactggactctcgaagtcaaagccactgaaatccagttaactatgtttatttgtgagcattttctgtacattgtccccttcctttttctttttwagattatttgctgttagctctctttcttttctgaatgcagaaaagaattcagaatgcagtctgctctacagaatgcagactccatttctctaaatggaga

SEQ ID NO: 18599 - DNA, 201 bp, Homo sapiens
aaatactcattgtaaaaagatgatacacattattaatcaaaaattaaacaacaatacccatattgaattttgctagttatggcctagttggaccatagtawtgtcttctgcataagcatttatggataacgatccaggaacagcctgttgcactcagaagcatggaaatgccattcattcagtagaactatttcaaatttt

SEQ ID NO: 18600 - DNA, 201 bp, Homo sapiens
gtatttaatactttttaatttaaattaaattgaattaattaatttacttatatagacagggtcttgctctgtcacccagactggagtgcagtggcatgatyatagctcactgcagccttgaactcctgggctcaagcagtcccctgcctcagccttctacttgcacaccaccatgcctggcttattatctttaagaaaaca

SEQ ID NO: 18601 - DNA, 201 bp, Homo sapiens
acaatttacccttgtgtcactaaatactcctttatgattttcttctcacacacagaacacccttaaccccttcccaagggacatagctcatagtccattcmgaaactgaaatccaggacctctgggtaatgggcagtagccactcaatcagttccagatgtggttcctcttggttgggagacccataaactaataaacaat

SEQ ID NO: 18602 - DNA, 201 bp, Homo sapiens
agagattaagctgaaggaagattttgtggtaaggggtgatattgtggggttgttagaagaaacatttgtcgtgtagaattattggtgatggcctggatacrgttttgtatgaattgaaaaagtaaatggaataagagaaggagaaaaacaggtattaaaggactaagaattgggaggacccaggacatctaattagagagt

SEQ ID NO: 18603 - DNA, 201 bp, Homo sapiens
tgttaaaatgacatgttactaagttacacctttgtagtccatttatgactcataaagtgctttcacatacattatttaatgtgttactcaagttagccccrttgagttgcttttattgtctatgtaataaagctcagagagcttaagtaacttccttgtggtcacacagaatgtcagaggcagaattggagcagtcatgta

SEQ ID NO: 18604 - DNA, 201 bp, Homo sapiens
agcattttttcatcaccctacaaagaaaccctgttcctctgagccaccattttcctgccctcagtacctgctaatctgctctctgtctctatagatttgcytattctggacatttcctacaaatggaatcctacagtatgtggttctttgtgactagcttctttcacatgtgtgtcctttttaatgaaaaccaaacaaggt

SEQ ID NO: 18605 - DNA, 201 bp, Homo sapiens
catgttactaagttacacctttgtagtccatttatgactcataaagtgctttcacatacattatttaatgtgttactcaagttagccccgttgagttgctkttattgtctatgtaataaagctcagagagcttaagtaacttccttgtggtcacacagaatgtcagaggcagaattggagcagtcatgtaagtccaggtta

SEQ ID NO: 18606 - DNA, 201 bp, Homo sapiens
gaggtgggaggatcacttgaacccaggaggaggaggttgcagtgagccaacattgtgcaactgtactccagcttgggcaacagagtcagactatctctagwtaaataaataaataaataaataaataaataaataaataaatcagatggtgactaatttctggtcatttacctgcatccttatcaacaaaggccaagcaca

SEQ ID NO: 18607 - DNA, 201 bp, Homo sapiens
atctatatagattctatatatgatctatatagattctatatatgatctatatagatatagaatatatattatagaatatagaatatatatttatagaatayagaatatatatctattatatatagaatatagaatttatatatctgtataggatataggtatattctatgtatctacctatgtgtgtgtgtatgtatgtat

SEQ ID NO: 18608 - DNA, 201 bp, Homo sapiens
atggtcagtgtatcccaagtgaatacaggtgcgaccacgtcagagactgccccgatggagctgatgagaatgactgccgtgagtctgttttagtccttgcrctgtatttggtttcacccttgtccctttggcattttaatcaatttgttagatttgttgatggacataaatgcctacaatatgcctcttgttattgcaatc

SEQ ID NO: 18609 - DNA, 201 bp, Homo sapiens
aatgagcaacgaacttagaggttaaacgaattggccaggtcttactgtcattaagaggttgactcaggatttgaactctggtctgtttcactgcagagcamgtcctcttcccagtccactgggtgcctcttagcactttaaggctacatattttgtttattagtctgcacattatggtgggaggatgggggagggatagca

SEQ ID NO: 18610 - DNA, 201 bp, Homo sapiens
aagcacagcaggcgactcctgcctctcagcttctgcgctagctcttccctctacctggaacatctctcttccagatctctgcatgagttgcttcgcgtgcyatttaggattctacccaaatgtcactttctcagagaggccctcattgaccgctctacctaaaatagccaccccctcataattcttttgctctttaccctc

SEQ ID NO: 18611 - DNA, 201 bp, Homo sapiens
gttgcggttcatccttcgaaacaaccaaattgtgagtgatacagagaaacatcctgcctgggagtagcttgaaaaacactgaccctgggaatgctaaatgyacactgttacagacccatttgtttggacaatacattttccttttctctttacaaaccaccccactatatactttccctagtcctgacattgccattactt

SEQ ID NO: 18612 - DNA, 201 bp, Homo sapiens
tgtctgaatatttagtctgtctttcattttttaccctgcagttctcatgaaatggaagttaggtctaattgcttgattagatcaaggttaaatacatttakcaataatactttataggttatgctgtgttagttgatacagaatcttattaggaagaacataatgtcagcttgccctgctcttagtggcatttgagtttga

SEQ ID NO: 18613 - DNA, 201 bp, Homo sapiens
cttcgcgtgctatttaggattctacccaaatgtcactttctcagagaggccctcattgaccgctctacctaaaatagccaccccctcataattcttttgcyctttaccctcatgttctgaaacctctctctctctctctgagtttagttgtttctttttgctcgaatatatactccacttttatagcgtccccagtgctta

SEQ ID NO: 18614 - DNA, 201 bp, Homo sapiens
tcagcaggtgagtgctttagcgggtgcagacctatgaggcctcatttaatgctctgtagaagaattccccaattcttattttcactattacctatgcagawctaaatccaattgctactaaatgccatcataaaactccatatgtgcttgcctgaacctgaaccctgatattattaacatacagacttccacagagcatta

SEQ ID NO: 18615 - DNA, 201 bp, Homo sapiens
gaccaaatctacgtctgattgttgtacctgaaagtgacggggagaatggaaccaagttggaaaacactctgcaggatattatccgggagaacttccccaayctagcaaggcaggccaacactcaaattcaggaaatacagagaatgccacaaagacatacctcgagaagagcaactccaagacacgtaattgtcagattca

SEQ ID NO: 18616 - DNA, 201 bp, Homo sapiens
gttaagggcagccagagagaaaggtcgggttacccacaaagggaagcccatcagactaacagctgatctctcggcagaaactccacaagccagaagagagkgggggccaatattcaacattcttaaagaaaagaattttcaacccagaatttcatatccagccaaactaagcttcataagtgaaggacaaataaaatcctt

SEQ ID NO: 18617 - DNA, 201 bp, Homo sapiens
aaggcaggggttgcaatcctagtctctgataaaacagactttaaaccaacaaagatcagaagagacaaagaaggccattacgtaatggtaaagggatccaktcaacaagaagagctaactatcctaaatatatatgcacccaatacaggagcacccagattcataaagcaagtccttagagacctacaaagacacttagac

SEQ ID NO: 18618 - DNA, 201 bp, Homo sapiens
agctttgcagcagtacagcccaggtaatttgctgagcctgatgggtgtcaggttcagtctaagtgaaagtgaagagaggctgggatgacgggtgcaaaggratagtaaagaaagcatgtttgagattcagtccgtcatctttaagaagagctgggagatgaaataggaatataggtgaagggaataactttacataaggtc

SEQ ID NO: 18619 - DNA, 201 bp, Homo sapiens
cctaatgctccttttgaactcgagatatggcacattttaatacagaaactagaaatgtttattttacaaatattttgtgattttaagatcggaaatgtttmaatcttgaaagcattttccctgatcctctgataaacagatatgaaaactttaatcacatgataaaagagatacgacatttcatttgacatcttcacttaa

SEQ ID NO: 18620 - DNA, 201 bp, Homo sapiens
gagaaatgtctgtgctatttgccattgtctctccatttcctagcagagttcctagtacagttctgttctaattttcatctgaaatattcttatttatctayttatttttaattttactttaagttctgggatacatgtgtgacgttcccctctctgtatccatgtgttctcatcgttcaactcccacttatgagtgagaac

SEQ ID NO: 18621 - DNA, 201 bp, Homo sapiens
acatttgagaagtgttataggagacttagctttctcctagaatttcacaattgggtcttaggacccttggataagctttaggctattttagtctttgtgartgatgattattcagttctacttcattatatcagctatccttccttgaaaatgacggaaatgttctctgtgcctcagaatggaaaactgaggagcaaaatg

SEQ ID NO: 18622 - DNA, 201 bp, Homo sapiens
cattttcatttgcttagtttttaaatataacaatcatgtattttccccaaatgctctaatagctctatcaaatgcctgtacaaagacagaaaacaatctayaattttttttttctttctggagacccctatcctgtgttccaattgggacttgtttttctctggcctggtgcacagacttctctttgccactcccctgtgc

SEQ ID NO: 18623 - DNA, 201 bp, Homo sapiens
tgactataatattccattgagtggttatagtatcatcaaattaactgcctctattattaagcattaggttgcttttattttattcctctatagtatatatcattgcagtaaatattaacatcgtatttaaaacattttattttcaggatattttcttaggatcattagtatagttttatagctgaagtcaaactattttca

SEQ ID NO: 18624 - DNA, 201 bp, Homo sapiens
acttcccaaacaatacttttatatcaccctggcagacaatctcaaccaatcactgctcctagaacacagctcaaaacacccactctttatttgtttattgttttttttttgtggaggaaatttattcatcatattaagagcacattttcagtttgtatttggatcttaagaaacctgttctatcttgccaagttatgtttt

SEQ ID NO: 18625 - DNA, 201 bp, Homo sapiens
tagaagagtgacttattttaattcagtatttattgaacagtggtgttctaggaacttttgggctgtgtcagtgaataagacaacaatccctacccacatgragctaatattctaaagaggggagacaggcaaccaatcagtaaattgtctagtatgttgaaaggtggtgctaagtgttatggaaagaaggaaagggagcaa

SEQ ID NO: 18626 - DNA, 201 bp, Homo sapiens
aattgtgagtgatacagagaaacatcctgcctgggagtagcttgaaaaacactgaccctgggaatgctaaatgcacactgttacagacccatttgtttggrcaatacattttccttttctctttacaaaccaccccactatatactttccctagtcctgacattgccattacttttatttaccatggaaatttcaaaccta

SEQ ID NO: 18627 - DNA, 201 bp, Homo sapiens
cagtgattgaagatcaaatgaatgaaatgaagtgagaagagcagtttagagaaaaaagagtaaaaagaaatgaacaaagcctccaagaaatatgggactaygtgaaacgaccaaatctacgtctgattgttgtacctgaaagtgacggggagaatggaaccaagttggaaaacactctgcaggatattatccgggagaact

SEQ ID NO: 18628 - DNA, 201 bp, Homo sapiens
ttctgttcttctagaccttctagtggcccagggaccagagccacacattttggatggtttttaagtagaacttaagtagggttatcatcaggtaggtgtgygaggtacaaatggatgtggagaagttagtaagctcattcttcaaggaagaggtttgcactgacttacattggtgggaaaatgattccttgaaaatgaacc

SEQ ID NO: 18629 - DNA, 201 bp, Homo sapiens
aggccacttgtgcttttggcttccgggccccttgccagcctgtccaaagcggccccaaagaagggaggctaggggttccctgaacctctcgtgtttctccytcttataaaagggtaccggaaccatggagaagacgttcgctctttttcaattttgcttcaaaatgagcagacttgtaagaagcacgatctggccatgaca

SEQ ID NO: 18630 - DNA, 201 bp, Homo sapiens
agacacataccaccactcacagttaatttttatattttttgtagagatgaggtttctccatgttgttcaggctggcctcaaacccctgagctcaagtgatsctcccgcctcagcttcccaaagtgctgggattataggcgctagccaccatgcccggctgaaatcatttattttgtcaggaaattcttaaagttgaattta

SEQ ID NO: 18631 - DNA, 201 bp, Homo sapiens
atgtagttggaaaagcactaaatttggaggagaaagacctaggtttgaagccccagctcttcacctagttctatgactttgagacatccagttaaccatctttgagcttcagttttctcatctatacaaatggtgtaaaaatacctatttcacattgtgcttgtgtgattatactttgtaaactaaaaaaagttaccaaaa

SEQ ID NO: 18632 - DNA, 201 bp, Homo sapiens
ctcgaggcccctggaggcccagtcaaggtcctgatggagaaaaaggaaaattgctgtctctatcaaagcaagtggcttagcaacgctgtttctctcgatcygactccccccttttctccaccccagtgcctcccactcccgccctgctggtgattcccaatgcatttgagtagttgaatctgcatccttctttttaacttc

SEQ ID NO: 18633 - DNA, 201 bp, Homo sapiens
taaccatctttgagcttcagttttctcatctatacaaatggtgtaaaaatacctatttcacattgtgcttgtgtgattatactttgtaaactaaaaaaagktaccaaaatataaggcattcggtatccagttaacaaaatggtagtggttttctgaagccctaagggaaaaagtatgaccattctaatgtattttatggaa

SEQ ID NO: 18634 - DNA, 201 bp, Homo sapiens
tcttactgaatttaatttaaattttacttaattattataatgcctatggatccatgttctgcatattagctcactcatactcatccaagactgtaactatrggtacccaacacccagaattgagatggccactgaaaactctattcttgaccaacactctaatatcattttattttctttaattgcctttgtaagaagtat

SEQ ID NO: 18635 - DNA, 201 bp, Homo sapiens
ctttcttcacaattacatgcacacattttgctgtaaatcatgttgacaaggccctgggtttatggatggcagtgctggttagcaggcctggttataggtcrgttgtaaaactgaccacattcaccgttgttgccttcacattttgtaatgctctatgtgccgctcctatgctttctatgataaattgttcaaaaccattag

SEQ ID NO: 18636 - DNA, 201 bp, Homo sapiens
atatagtcttgaaaataagccaacttccttttctggggaataaagggttattatgcttgtgctttttcttagaatggctttatggggaatttcagctgtgrtctattaggaaggcctcaaagatagaacttaaaagcttctagtatggctgtccttcctctagttagcaattgaaactgagttgttacaacaaaaggaaaa

SEQ ID NO: 18637 - DNA, 201 bp, Homo sapiens
aacaggtcagggtgttcagttcttatctcttaagtctgtatgcaataaagagatatttaagaatttgggagacagtaatagtcaaaagaagaagtgctccrtgtagtagtactgactgataagtacattaggaaataagtcctctaaaaagaaatcatgatcctgctatccaggattcactgatgtcaattaggagctttc

SEQ ID NO: 18638 - DNA, 201 bp, Homo sapiens
ataaaatctgtcaggaaacagtaaggaatgagacttttctggtaaacttttagtaagactataaaagtatttcttctgtgagatagaatgtctgcagtctwgtctgttttgatgtcagtaaataaaaacaattcagtgaaaatgaggactgtacgtagggttctcagtctagctttgttccatactaccactgagtacaaa

SEQ ID NO: 18639 - DNA, 201 bp, Homo sapiens
caatgtccgaattcgaaaatataatctctcatctgagaggttctcagagtatcttcaagatgaggaatatatccaagctgttgattatgattgggatcccraggacataggcctcagtgagtataaactttggcatctttcattgatattaagtgactttatagaattttaaggtgttgacttttaaggaatttattgttt

SEQ ID NO: 18640 - DNA, 201 bp, Homo sapiens
aagtcttttgagatctgtgtggttgaatagagaactgatggcattaacaataatttcactcccttctgaggtaggggttcaattcacattgatgatagagyatcagtttctatctcacccttatcccttgaccacaactttgatatggaaacatatttgggtgcagttttctggagtctgtaggtgattatttctaatatt

SEQ ID NO: 18641 - DNA, 201 bp, Homo sapiens
tggagctggagatgatgggatggcctcaggcccgcaaacagccccttctcacacagggttcccaccaccgggaaataacttgcatcaaccctccttttttwcccctccctgtgggctctgatgtcacgtacaggctgaggacgtgcgctgagggcgggtgtaaggccacttgtgcttttggcttccgggccccttgccagc

SEQ ID NO: 18642 - DNA, 201 bp, Homo sapiens
tacgtatttttaaaaggcttcttagccttttagtttagtcccctggttgagaactactgattttaatgaagtgaacgtaaatagagtttgttgcagtcatwttgctacatgctttgagtcattggaggaactctagggtaatagttctcaaaagtgtcttacctggactaggaatgtcagtgccacttgggaatatgttag

SEQ ID NO: 18643 - DNA, 201 bp, Homo sapiens
agggggagcaggcagttagaccaggaaccaccctttgactcattccaaacaggctgaggagttggcaggtttagggaatgaatccagggagaaaaaactgyttcttgtcacccctcttcccctactcttgcactcatcccaacgctactggggaaatattggtaggaatccaatatttcgagccatatttggaacaaaatg

SEQ ID NO: 18644 - DNA, 201 bp, Homo sapiens
tcttcaaggaagaggtttgcactgacttacattggtgggaaaatgattccttgaaaatgaaccaataatgcaaacatgtttgagggggaaggttcaggagwcactactctcctggagaatggatagttattttcagtgtaaattctttttcaccttttaaaaaatgtggctggtgttcctggaagagcatctttgaagaag

SEQ ID NO: 18645 - DNA, 201 bp, Homo sapiens
ggtcaaagtcactcatgagttccatgttgttaaatccaatgatctattttcagctctggtccttatttaactggttagcagcatcacacacagtgtatccwgacttcctccttgaaacacttagttagattttcaagaaactgccttctcctggtttcttttcttccttgctggcctacccttggtatctcatgcttgttc

SEQ ID NO: 18646 - DNA, 201 bp, Homo sapiens
atatccactgtaattacctttcaattttttctcaaatccatgccattttgctttagccctcatccttgatagatatttttttggtcaaagtcactcatgasttccatgttgttaaatccaatgatctattttcagctctggtccttatttaactggttagcagcatcacacacagtgtatcctgacttcctccttgaaaca

SEQ ID NO: 18647 - DNA, 201 bp, Homo sapiens
tctcacatgtagagtgagctttttaaaactgtgaaaatggaagcaaccagaagagaattccataaacttctataactcaaccatcatcatttgaacttcgkcttatatcttctgtctttcctcctattactctggaagaattttcccagttcttaagtccaaccatttcattcatgttctagatctcattccctctcacct

SEQ ID NO: 18648 - DNA, 201 bp, Homo sapiens
attcccttttcttgcaattaaggtaactgaaacccagaagaaatgtctccttggagggttggggtggaaatcacatccagtatactttggatagaccataygttatgatctgtccagttttgggtagtgacaaatcttggtataatatgtggatctcactggtcttttgaaccatctcaagttgtttagcactgagtagat

SEQ ID NO: 18649 - DNA, 201 bp, Homo sapiens
tttccttgtgtactaatttatggctctaagagcagttgtatgatttagaactctatgtattttactgcaccctggtcaacacttgatatacatgtatatatttgtgtgtgtgtgtgtgtgtgtgtgtgtgtgtgtgtgtgtatataatcaattggtcaatgttagggaaattatagtcttcttaaaattttataatttcct

SEQ ID NO: 18650 - DNA, 201 bp, Homo sapiens
ccttgtgtactaatttatggctctaagagcagttgtatgatttagaactctatgtattttactgcaccctggtcaacacttgatatacatgtatatatttgtgtgtgtgtgtgtgtgtgtgtgtgtgtgtgtgtgtgtatataatcaattggtcaatgttagggaaattatagtcttcttaaaattttataatttcctcct

SEQ ID NO: 18651 - DNA, 201 bp, Homo sapiens
taggcacccaccaccacactgggctaatttttgtattttcagtagagacagggtttcaccatgttgggcagcctggtcttgaactcctgacctcaggtgawccatctgcctcgccctcccagtgtgccgggattacaggtgtgagccaccacacctggccagaaattcttattttagtctttgtaattcctttctctctgg

SEQ ID NO: 18652 - DNA, 201 bp, Homo sapiens
aaatgggaaaaggttgagaagacggaagtgcatattcacatcacagcacagggaactgaggcaccgctgaaataaatatacctttcccagattcctccaargatcccgaggagttgtttgagtttgttgtatatattctggatatgagtcccctgtcaagtgaatagtttgcaaaaattttcttccatttaacaggtggtc

SEQ ID NO: 18653 - DNA, 201 bp, Homo sapiens
tttttgtattttcagtagagacagggtttcaccatgttgggcagcctggtcttgaactcctgacctcaggtgatccatctgcctcgccctcccagtgtgcygggattacaggtgtgagccaccacacctggccagaaattcttattttagtctttgtaattcctttctctctggaatggctcagtgtagtcctgtgaggga

SEQ ID NO: 18654 - DNA, 201 bp, Homo sapiens
caattggtcaatgttagggaaattatagtcttcttaaaattttataatttcctcctatttgtaactttgttctaacctatctgtatccatgtcttttattwatttatttatttatttatttatttatttatttatttatttctatctgttatctatctatcgatctatcatctatctctctatctatctattgatctatct

SEQ ID NO: 18655 - DNA, 201 bp, Homo sapiens
caatatcatgccattttgattactatagccttgtagtcaggtagcgtaatgcctccaactttgttctttttgctcaggattgtcttggctattcgagctcytttttttggttccatttttaaattttttttctaactgtgaagaatggtattggtattttgatggggattgtgttgattctgtatattgctttggacaata

SEQ ID NO: 18656 - DNA, 201 bp, Homo sapiens
tttgaggtattcctagtttgttgagagttttcattctgaagggatgttgaattttatccaacgttcttttctgcatctattgagatgatcatatggttttsttattcattctgttaatgtgatgtatcatgtttattgatttgcatgtgttgaaccatctttgcatccctggtgtaaatcccactggatcttggtgtatta

SEQ ID NO: 18657 - DNA, 201 bp, Homo sapiens
gaggtattcctagtttgttgagagttttcattctgaagggatgttgaattttatccaacgttcttttctgcatctattgagatgatcatatggttttgttmttcattctgttaatgtgatgtatcatgtttattgatttgcatgtgttgaaccatctttgcatccctggtgtaaatcccactggatcttggtgtattatct

SEQ ID NO: 18658 - DNA, 201 bp, Homo sapiens
caactttgtggctgtggaagactgttgatgagagggttgggcgatgatacctcagggttaccctcaggtcgtacctggtggtgtcagcttatcagagccgwctccgggtggtagtaggtgaactcaggtatctcttcttcagatattctacagtgagaaatttttttctggaaggttggacatgggagtaaatccaggcca

SEQ ID NO: 18659 - DNA, 201 bp, Homo sapiens
tttaagaatgaaagtattttatcagaaatatggcaatcctacccacattttaatctcactagaaggggggtgatacatgctagcaagtactcccacactgrtttaattttgatgtgaggaagggtgtggagaatactttttgttgcaagaaacagaaaacccaactcaaaatggcctacacaataaagggtatttcttggc

SEQ ID NO: 18660 - DNA, 201 bp, Homo sapiens
ttgcttccttatatcttctcctctttcctcaaacctctgacatcaccttctcacatgtagagtgagctttttaaaactgtgaaaatggaagcaaccagaaragaattccataaacttctataactcaaccatcatcatttgaacttcggcttatatcttctgtctttcctcctattactctggaagaattttcccagttct

SEQ ID NO: 18661 - DNA, 201 bp, Homo sapiens
ggtgcagtcagggctccagttctctttctttgtgttttccttgaccctactcccccctaagtttcacctttgtgtgcggtctggcttcccatatgattctratatggctgccagggcaaatggggctacgtgtttccttgatcctatccagggggaatccaactttgagaaggttttagttatgttctcaaaagtattatt

SEQ ID NO: 18662 - DNA, 201 bp, Homo sapiens
ttttagttatgttctcaaaagtattatttcatcacaataacttacagattgttagaatttctaaggaccctagacaaagtcagctagctccccaaacttgrcatatcatcaaaatcacctgaggaacttaaaaaagtatagagattcttaaatcaaaactcacccttactaaagcaggggtatgaaaatctgtgtttttta

SEQ ID NO: 18663 - DNA, 201 bp, Homo sapiens
gtgattggaggcagaggtataagtgaggggagagagcatgcagatttcccattcatggttacttgtgagctgagtcttgaaagatgactaatacatccttscttatcggagggtttcactttccgaggtttcagttacctgcagtggcctgagaatatgtgagtacagcacaataagatatttaaaagggaggagagagag

SEQ ID NO: 18664 - DNA, 201 bp, Homo sapiens
agataagaattctttcttgaagctggtgacccgcttagttttccacttggagtagaggcattggtattacaagaactgtttcactctcttctctctactayaagaaaaataacagcacaagcatgatgataaatagagcttggctcttaggctcagagtcaagtagaggcaggtggagtgaactgagacaatgtctccaac

SEQ ID NO: 18665 - DNA, 201 bp, Homo sapiens
agtgttcagtatgccaaagtcccaggttgaatgctatggatatgtggcctttgacaagttactcccttcctgtccccatatgtgagtcatgggtggagtcyggggttgtcttgagtctgctgatattttgagaccttgatcagccttgaaaaattgcaactcaaagctgagactcccatgagatgacaggggtggcaaatg

SEQ ID NO: 18666 - DNA, 201 bp, Homo sapiens
tccaaaagtcaaactgctgacctctggccatcacaataccctccctgatgatatcaagctgggcttcttgtttgttgggtggggaatgggccttgtcagtwaacttgtagtcatgtcagtggttacagttttaatctttcccctttcaattttctggcactggctctcaaaaagcaggatgaagaaaacgagagatccatc

SEQ ID NO: 18667 - DNA, 201 bp, Homo sapiens
accagacatggtcttttcaggccgctctaccctgtgcagtaggttatccaaatgtgcagatagggaagtagcaacatggagaggacatgaagcttgagtcmcagtaaatagctgcttagtggtacctctgggccgccagggctcctgaactctaggcctgctttctttctgcaacccgccagtggaagaaatggcctttct

SEQ ID NO: 18668 - DNA, 201 bp, Homo sapiens
ttatatttctcagtcttgttcttcacataacattttttattctataaattctgttgaatttattttcacaagttaaatgggaaaataaagaaaatagataytttatcaaagagctgttattgacccccattaaaaataggaatgcttttacactgttggtgggagtgtaaattagttcaaccattgtggaagatagtgtgg

SEQ ID NO: 18669 - DNA, 201 bp, Homo sapiens
tagcaacatggagaggacatgaagcttgagtcacagtaaatagctgcttagtggtacctctgggccgccagggctcctgaactctaggcctgctttctttytgcaacccgccagtggaagaaatggcctttcttttttccaagcttgtgcagtggtactttagtttcctgggatgttatctgtatcatgtaaaagaatgtt

SEQ ID NO: 18670 - DNA, 201 bp, Homo sapiens
tctgtatcatgtaaaagaatgtttgattttgaactaaagttaaattctttctcattcttcatcttttggctcaaaagtcacttcttcaggggatacttttytgggcccccaaatctctctgctatgcagtctcacagtcctctgtactttccacattagcacttatcccagtttgtaatttaccatttgtgtcttatttga

SEQ ID NO: 18671 - DNA, 201 bp, Homo sapiens
tttcttttgtgtatcaatatatgcatttagtgacttgcatatagtaatcactcaataaatgtttgctgaaggaaatttaaggtttgtttactgtttccttytcctttttttttttttttttttttacaatagagtacccaacatgtgagcagcttacttgtgacaatggggcctgctataacaccagtcagaagtgtgatt

SEQ ID NO: 18672 - DNA, 201 bp, Homo sapiens
ccccatcctgtgtccatgtgtgctcattgttcaattcccacctgtgagtgagaacatgtggtgtttggttttctgtccttgcaatagtttgctgagaatgwtggtttccagcttcatccatgtccctgtaaagaacatgaactcatccttttttatggctgcatagtattccatggtgcatatgtaacacattttcttaat

SEQ ID NO: 18673 - DNA, 201 bp, Homo sapiens
catcctgtgtccatgtgtgctcattgttcaattcccacctgtgagtgagaacatgtggtgtttggttttctgtccttgcaatagtttgctgagaatgttgrtttccagcttcatccatgtccctgtaaagaacatgaactcatccttttttatggctgcatagtattccatggtgcatatgtaacacattttcttaatcca

SEQ ID NO: 18674 - DNA, 201 bp, Homo sapiens
tgtccatgtgtgctcattgttcaattcccacctgtgagtgagaacatgtggtgtttggttttctgtccttgcaatagtttgctgagaatgttggtttccarcttcatccatgtccctgtaaagaacatgaactcatccttttttatggctgcatagtattccatggtgcatatgtaacacattttcttaatccagtctatc

SEQ ID NO: 18675 - DNA, 201 bp, Homo sapiens
catgtctgtttagaattgttatgccctcttgctggattgatccctttatcaacatataatgacctcctttgttttttatttttgtttctgttttttactgktcttgccttaaggtctattttatctgatataagcataatactcctgcttgcttttggtttccgtttgcatggaatatgtctttccatccctttactttca

SEQ ID NO: 18676 - DNA, 201 bp, Homo sapiens
gtccatgtgtgctcattgttcaattcccacctgtgagtgagaacatgtggtgtttggttttctgtccttgcaatagtttgctgagaatgttggtttccagyttcatccatgtccctgtaaagaacatgaactcatccttttttatggctgcatagtattccatggtgcatatgtaacacattttcttaatccagtctatca

SEQ ID NO: 18677 - DNA, 201 bp, Homo sapiens
ttgttgtaaatattctttgttctttactttttctcatattgattgtcattgtagtttggtgaatttctgtagtggtaccattgagtcctttttcttccttytttatgtgattactttaccagtgaattttatatgtttgtgtgttttcatgatggtaaatattgtcttttcacctccaggtttagaactcccttgagtatt

SEQ ID NO: 18678 - DNA, 201 bp, Homo sapiens
tccatgttcaaattttgtcacttatccccaaaatgtatttttactgttctctgttcaagttagggttcagatgagatctacaactgattttgattgttatmattcttcaatctcttttatgccacaacacttcccactttttaatgtcattgattcattagaaagattaggtgatttgtcctgtagaatatctcacattct

SEQ ID NO: 18679 - DNA, 201 bp, Homo sapiens
tacttcctgagtccctcctacatgcccagcgtgatgacaagcagcaggggttttgaggggaacaaggcagacatggcccttgctctcctgaagtacatagscttgcttacaatacttgtcattggccgggggcagtggctcacgcctgtaatctcagaactttgggaggctgaggtgagaggatcgcttgagcccagaagt

SEQ ID NO: 18680 - DNA, 201 bp, Homo sapiens
tgttcagaaatatatttcatagatgcataaagcaatagatttttatagagcatgcaattgattccttgtacatcttgggatgcaccaacacatcactggarctgtgcctgtagttctactcttacttttttttttgagatggaaattcgctcttgttgcccaggctgaagtgcgatggcgtgatctcggctcaccacaacc

SEQ ID NO: 18681 - DNA, 201 bp, Homo sapiens
tctggcacatagtttttaatacatgttattgatgatgatgatgatgatgatgatgatgattgcttgtttaactttgtgggtagcgcttgaagtaagtgctkttggccaaactggtagattctttctggcaaatcattacattgactggattaatctgtcttggagccagaggaaataacataaagtaacttataaaggatg

SEQ ID NO: 18682 - DNA, 201 bp, Homo sapiens
ctggcacatagtttttaatacatgttattgatgatgatgatgatgatgatgatgatgattgcttgtttaactttgtgggtagcgcttgaagtaagtgcttktggccaaactggtagattctttctggcaaatcattacattgactggattaatctgtcttggagccagaggaaataacataaagtaacttataaaggatga

SEQ ID NO: 18683 - DNA, 201 bp, Homo sapiens
cttttttatggctgcatagtattccatggtgcatatgtaacacattttcttaatccagtctatcattgatgaacatttgggttggttccaagtttttgctrttgtgaatagtgccgcaataaacatacgtgagcatgtgtctttatagcagcatgatttataatcctttgggtatatgcccagtaatgggatggctgggtc

SEQ ID NO: 18684 - DNA, 201 bp, Homo sapiens
gatatacggcgttatttctgagggctctgttctgttccattggtctatatctgtgttttggtaccagtaccatgctgttttgcttactatagccttgtagkatagtttgaagtcaggtagtgtgatgcctccagctttgttcttttggcttaggattgacttggcaatgcgggctcttttttggttccatatgagctttaa

SEQ ID NO: 18685 - DNA, 201 bp, Homo sapiens
taccattgtacaccttgaaaatttctactcagacctcaaagacccagtttaatgtcaccacctctgtgacaacttctatcactccttctggcagagttctwtgattgctcaccatgaatctatgtcattttatggcacatgttactctaagttatatagctagttgaccacataatatctttctatcctctagacatctgc

SEQ ID NO: 18686 - DNA, 201 bp, Homo sapiens
taatatattttaatacattttcatatatcatggatttggcaatgctgtgtggtaattatggttcatgtgtacctgatcgctgtgaaatagaaagaaaaaakaagtcttccttaccccataacagcatgataatgagattccactctcacagaaaagtgttactcattatttctcctattttctgtgtcagttttcaaaatt

SEQ ID NO: 18687 - DNA, 201 bp, Homo sapiens
agttcaggaacagcctgggcagcatggcgaaactccgtcttaacaaaatacacaaaaatttgctgggtgtagtggtgtgcacctctagtcccagatactcragaggatgaggtggaaggatggcttgagtgcaggtaggggctgcagtgagctgtgattgtgccactgtactccagcctgggcaataaagcaagaccttgt

SEQ ID NO: 18688 - DNA, 201 bp, Homo sapiens
tccgggcaggggctagggccgggcggcggcgcgggagctgctcccggtggggcgctcaggttgcttcgcgaagccggagggggagcgcccctcttcgctcrccaggaactgagcggcagcaaacttgagaaagcagccccgccagtttcggtgacagcgcaccccacggagaccctgtctttgttcccacgggcgttggtc

SEQ ID NO: 18689 - DNA, 201 bp, Homo sapiens
agttgggaaataagccacaataaaagtgactaaattatttgagtgctttctataccaggcattggcctaagtgttttgtaggtattagtttacctacttaygtagtaacagtaaaaattttatggataaaggaccaagacaatgacaggtgaggtaatttgcccaaagcaattcagttactaagtggcagagccaacattt

SEQ ID NO: 18690 - DNA, 201 bp, Homo sapiens
gtagagatggggttttcccatgttgcccaggctggtctccaactcctggcctgaagtgatccacccaccttggccccccaagtgctgggatgataggtgtsagccaccatgtctgacccatctctttatttctgctcccactgccaacatctctcatttgggtgtcagcagtagtctctgggttggcctccctgcctccag

SEQ ID NO: 18691 - DNA, 201 bp, Homo sapiens
caattttcaaatatacaaaggaaagtcttctttaagcatttttcactaacagttctctgaagacttctcagaccctagcatgtgattggaagattttttcytttttttttttttttttgagaaaatcgtattggccttaaacaaagttgtattctgtttactaattaaaaaaacttatttttcaaaaatagaaatggggtc

SEQ ID NO: 18692 - DNA, 201 bp, Homo sapiens
gaagggaaatcattctccttcattctccttccggttggaattgattatcaaatcctaaatgaccttctcactataggtgcatttaaccctttggaaggttrtggatgctataagactctggtgaaagccctgggcccctttagaaagtacacagatcaccaaagctggcttccctgattctgggtaaagaccttgggttaa

SEQ ID NO: 18693 - DNA, 201 bp, Homo sapiens
agaattctacacttcctgacgaacatgcattagctattccataagcacccggtgctgtgccagaggctgtaaatgacacagaggaatgctctcaatccagygttgttccttgctgtggaaaacaaacaggcaaatgactcctcttctctgggcgctatctgttactctaatatcttatcttaacacattcttagtccaaca

SEQ ID NO: 18694 - DNA, 201 bp, Homo sapiens
tttaccatggaaatttcaaacctaggatataataacagcacatctgaattatatcatttcagcatttggctgctacctctttgaccctcacatgagtctcygtttcctcagctgacaaatggagtacagaccagatagtgccttcgatcctcttaccgctaccactctgattgaaagcagcttacttttaggactagttta

SEQ ID NO: 18695 - DNA, 201 bp, Homo sapiens
agtgccaagggctaatttggcatctgaaaggccagattgacttcagagtaagtttattccctttctcttcccattactttcaattccttactttgcttttrcttcatagaactccctgttttctattgtttgtgttacttattagaatataacctctgtacgggcaggcattttgtctgtcttgtttgctgctcaatactc

SEQ ID NO: 18696 - DNA, 201 bp, Homo sapiens
gggtgcagcaaaccaccatggcacatgtatacctatgtaacaaacctgcacgttctgcacatgtatcccagaacttaaagtaaaataaaaaataaaaaatwaaaaacaatttaaaaaagagaaaaaattgctattgtatagttgctgtgacttgaaggaaagatgcatctaaactataacagattgatgtgaatcagtgag

SEQ ID NO: 18697 - DNA, 201 bp, Homo sapiens
cataagcacccggtgctgtgccagaggctgtaaatgacacagaggaatgctctcaatccagtgttgttccttgctgtggaaaacaaacaggcaaatgactyctcttctctgggcgctatctgttactctaatatcttatcttaacacattcttagtccaacacttacccaggaagcttgggatatggctacttatgaagaa

SEQ ID NO: 18698 - DNA, 201 bp, Homo sapiens
gaaaaaaattagccagatgtggtggcatgtacctgtagtccccactacttgggaggctgcaatggaaggattgtttgagcccaggagatccaggttgcagygagctatgaccataccactgcactccagcttgggcaacagagtgcaaccctatctcggaaaaaaaaaaaaaaaaaaggttacaaacgtgtgtgtatttta

SEQ ID NO: 18699 - DNA, 201 bp, Homo sapiens
tgcacagacttctctttgccactcccctgtgctggaacttctgtttgtggcaggccatttatttctttttctagatttatttcctcattttgctgaaacamgttacatgatagcttcctgagaaacataagtaggtggcatatattttgagtctttgaatgtctgtgagtgttttattttgctctccatcttgactgtttg

SEQ ID NO: 18700 - DNA, 201 bp, Homo sapiens
ttgctagagtcaggaactcaaaactccagacattaacactctcttctgaaaaccaaccagggaatggcagatctgtcttcttgtttgaagttttacctctktctcagccttaatgaataagagaattaagaaagtggtggaactttttctgcttgtaagagactgagacctgcagcctcagaagtggaaataaggcaggac

SEQ ID NO: 18701 - DNA, 201 bp, Homo sapiens
agaattcccctgtacatacagaatgggtcattctgctatttttaggacagatttgatacagtagcttttacaaaaagataagccaaagtttttagacttcrtgttagtggactgtcattctgtatttaaacagaacacaaaagaaagctgtctgagaccatgacacagtgaaaacagccttgatcaaacaaaaggccctct

SEQ ID NO: 18702 - DNA, 201 bp, Homo sapiens
atgttcttccatttgtttgtatcctcttttatttcattgagcagtggtttgtagttctccttgaagaggtccttcacatcccttgtaagttgcattcctasgtattttattctctttgaagcaattgtgaatgggagttcactcatgatttggctctctgtttgtctgttattgatgtataggaatgcttgtgatttttgc

SEQ ID NO: 18703 - DNA, 201 bp, Homo sapiens
aggagtcccctcaattccttactcttccaagtgtaacctgccaaacatgtccccttggctgtagttcccccaagagagggggactatggtctgatgatagktatctgagcagctgtctcaccagccaaacgaaatgctctcatcttcaaacctcttacccagtaatgattactctaggctttgcagttgtttaactttgtc

SEQ ID NO: 18704 - DNA, 201 bp, Homo sapiens
atagttaaaaggttaatgggcagaacttccatggcgcttcttagggagcatttaatgtagaagctgttgcaagtgctattgtggaggggtcaatgtgaacsgtggctgcatccatcttttacttcttctgggattatctttcttcaggtccaaatggtgccgagtgccagtgtccacatgagggcaactggtatttggcca

SEQ ID NO: 18705 - DNA, 201 bp, Homo sapiens
attgagcagtggtttgtagttctccttgaagaggtccttcacatcccttgtaagttgcattcctaggtattttattctctttgaagcaattgtgaatgggmgttcactcatgatttggctctctgtttgtctgttattgatgtataggaatgcttgtgatttttgcacattgattttgtatcctgagactttgctgacgtt

SEQ ID NO: 18706 - DNA, 201 bp, Homo sapiens
aatctaactaattaaaagtgttatctcactttgcatgcagtccattttgcagcgttttttgccttggaaggtaaattcaaagtgtctcttttatttaattrtatctttttaaaaattaggataatgttttaatcaagagggtttgttctcatgtttttcctgttcttagcacttcacacctgctcaccgacagccttcacc

SEQ ID NO: 18707 - DNA, 201 bp, Homo sapiens
gatggaaaagtgactcagaatatagttaaaaggttaatgggcagaacttccatggcgcttcttagggagcatttaatgtagaagctgttgcaagtgctatygtggaggggtcaatgtgaacggtggctgcatccatcttttacttcttctgggattatctttcttcaggtccaaatggtgccgagtgccagtgtccacatg

SEQ ID NO: 18708 - DNA, 201 bp, Homo sapiens
ccacaggtataaggtacttagagaaaatatgaaattatttagtgttagaagtaggctgacttgaaaaattttgtttgctgttccagaattataagacaccrttttgctaattaaacagaaagaaggaacaaaatgacaaggaagatataatcaattaagcatggagaagggtgttaattatggttttataattattatatc

SEQ ID NO: 18709 - DNA, 201 bp, Homo sapiens
gtaaaaacaaatgtcttcatgaccagtttgttactattgtagataatacctgttcatcttcggcgttcacctgtggccatggggagtgcattcctgcacamtggcgctgtgacaaacgcaacgactgtgtggatggcagtgatgagcacaactgccccacccacgcacctgcttcctgccttgacacccaatacacctgtg

SEQ ID NO: 18710 - DNA, 201 bp, Homo sapiens
cggcataaatcacccgcgaagactggagtgcagcatcaagccccctcgccgcctccctcctcccgctccggtccggtcgccccctccctccccagaccccrgctctcctgtccccagtcctgtctcctccgcgccgcacagcgcccaacactatgcagggaggcaaatagagaaccagtgactttggccagagcacagacc

SEQ ID NO: 18711 - DNA, 201 bp, Homo sapiens
agtaagaagggaagaggagagagcgtaagagaagcaaataggaataaggaaagaaggagggaagagaacgactggggcgggagaagagagagagagaggasagagaggagagagacagagagagagagagagagagagagagagagagagagagagagacagagagagacagagagagacagagagagacagagagacaga

SEQ ID NO: 18712 - DNA, 201 bp, Homo sapiens
agagcgtaagagaagcaaataggaataaggaaagaaggagggaagagaacgactggggcgggagaagagagagagagaggacagagaggagagagacagasagagagagagagagagagagagagagagagagagagagacagagagagacagagagagacagagagagacagagagacagagacccggccgaggatgaat

SEQ ID NO: 18713 - DNA, 201 bp, Homo sapiens
ggaagagaacgactggggcgggagaagagagagagagaggacagagaggagagagacagagagagagagagagagagagagagagagagagagagagagasagagagagacagagagagacagagagagacagagagacagagacccggccgaggatgaatgggaagggcgaggaggaggctggaaccggcgagctctccc

SEQ ID NO: 18714 - DNA, 201 bp, Homo sapiens
attcttaaagttgaatttaagaatgaaagtattttatcagaaatatggcaatcctacccacattttaatctcactagaaggggggtgatacatgctagcawgtactcccacactggtttaattttgatgtgaggaagggtgtggagaatactttttgttgcaagaaacagaaaacccaactcaaaatggcctacacaataa

SEQ ID NO: 18715 - DNA, 201 bp, Homo sapiens
tcgctcaattcttcaagatcatctttttttttttcctttgtttttgataagatttaacagttatcatgttgccatatttacttcatctatttctatgggargactgaagtattttaaaggaattaaaaatatggcatttcagccctaaatactaaatactaaataaatgcatatgatattgtattgtgtataaattagata

SEQ ID NO: 18716 - DNA, 201 bp, Homo sapiens
aaagttgaatttaagaatgaaagtattttatcagaaatatggcaatcctacccacattttaatctcactagaaggggggtgatacatgctagcaagtactyccacactggtttaattttgatgtgaggaagggtgtggagaatactttttgttgcaagaaacagaaaacccaactcaaaatggcctacacaataaagggta

SEQ ID NO: 18717 - DNA, 201 bp, Homo sapiens
ttttatcagaaatatggcaatcctacccacattttaatctcactagaaggggggtgatacatgctagcaagtactcccacactggtttaattttgatgtgrggaagggtgtggagaatactttttgttgcaagaaacagaaaacccaactcaaaatggcctacacaataaagggtatttcttggcttatgtgagtaaaaaa

SEQ ID NO: 18718 - DNA, 201 bp, Homo sapiens
ttgccgtaagtttatcttaagtgcttattgtgattttgggtctgaagtcttggatcacaggagatgaaattattatataaaaaaaaggctttccaaaaatraaaaccctaagtatttatctaaaacgtaaatttttggctaggcgcggtagcaagtatcaacaaataccaatcttgtttcatttttctctccttttttcta

SEQ ID NO: 18719 - DNA, 201 bp, Homo sapiens
gtcttaattgtatgttttgttcttaccttggtcacctttgaagttccccccagaccctcctaagaacgttggattcattgaggtaaataactgttgcaggycttctaatcttttctcacctgaatctgaattcatctcagaacacccctgacacagcccactggcttctagagaagctgtctgttccatgcttggaatgga

SEQ ID NO: 18720 - DNA, 201 bp, Homo sapiens
tctcctgcctcagcctcccaagtaaactgggattacaggtgcacaccaccatgcctggctaatttttgtatttttgtagagatggggttttgccatgctgktcaggctggtctcaaactcctgacctcaagtcatcctcctccctcggcctctcaaattacaggcatgaaccactgtgcctggcctcagtccccatacttt

SEQ ID NO: 18721 - DNA, 201 bp, Homo sapiens
actaccctatagtctagacccacatatccaactgctcatttgacatgtccacctggctggccaatagtcatctcagacttcacatgtctgaaattgaactyctgatctccactaatgtccaaacttgctttccatgtggaatttctcatctcagcaaatggcttcctcatccttgctcaagcctcaaactgtatcctactt

SEQ ID NO: 18722 - DNA, 201 bp, Homo sapiens
cctccactgtttttttcatagaaattcttttttttttttaatttttttggagatggagtgttgctctgtttcccaggctggagtgcagtggcatgatctcrgctcactgcaacctctgtctccaagattcaagtgattctcctgcctcagcctcctggcagctgggattataggcacccaccaccacactgggctaatttt

SEQ ID NO: 18723 - DNA, 201 bp, Homo sapiens
acgtaaatttttggctaggcgcggtagcaagtatcaacaaataccaatcttgtttcatttttctctccttttttctagtattttaaagtgactcctagtcmtgcacttcactgataacattttggaaaataactaccatgccattataatgcctggcaaaatcaaaagtgcttactaaatatccctgagtacctagtccat

SEQ ID NO: 18724 - DNA, 201 bp, Homo sapiens
cccagaccaagaggtattttagtttcctgacttggggcatgtgagtaaagtcaatttgccagtcctgggcgggggaaaaaccccgagcttgaggtgtaggkaagggagggggcctgagaaattcctgaggagtagtagaatagcagatggaacactgagaagtgatttccttgaggatagatttccacaatggaaaggaaa

SEQ ID NO: 18725 - DNA, 201 bp, Homo sapiens
ttgtttcatttttctctccttttttctagtattttaaagtgactcctagtcatgcacttcactgataacattttggaaaataactaccatgccattataaygcctggcaaaatcaaaagtgcttactaaatatccctgagtacctagtccatgttcaaattttgtcacttatccccaaaatgtatttttactgttctctgt

SEQ ID NO: 18726 - DNA, 201 bp, Homo sapiens
tgcaaagagttttttggacagacaccgtgcaaaataaggtaaatagaaatttcagtagctgaatggaaccctgagcacaaagtgttgatagcttttcactyttagagggagtagaggggaaagttcctttgttttctaacaaaaaaggcccttgagatattttatgttaatcagcaccttttccatgctatactattacat

SEQ ID NO: 18727 - DNA, 201 bp, Homo sapiens
ctcgcgtttatttgtgtgacggagacaatgactgtggagataacagtgatgaaaaccctacttattgcagtgagtaagataaaactgctttctttctatcrttccagagatgcatgttgtgagctaatacaaagatatgaagcgtgggtattcgggctgatttcaattgtcatttcacattgaccttctaagtagaggtgg

SEQ ID NO: 18728 - DNA, 201 bp, Homo sapiens
ttagagggagtagaggggaaagttcctttgttttctaacaaaaaaggcccttgagatattttatgttaatcagcaccttttccatgctatactattacatstgacctattaaacaaagcagtctattatatggattagccttgagcaacttttaattttattcgaagtggagtccaggagcctaattaaaagaaatagtag

SEQ ID NO: 18729 - DNA, 201 bp, Homo sapiens
ctataatataagatacaaagggagaattgtcatgaggacactgctgaaaaacactgtgatagttctcctaccttacaagggttcagggaagctctatggaraaagtatcactgaactgaatgttgaaggttgggatccactggtagtataaccagtgataaagtatgtgacatgtgaggtcaatgtgggtgagagtgagaa

SEQ ID NO: 18730 - DNA, 201 bp, Homo sapiens
acaaacctgcacgctgtgcacatgtaccccagaacttaaagtaaaataataataataaaaaaggaattataaaaaaaagaagttttgtaaaaattgagagsaaatcttttttcttccattaggggattatattatattttttagatgatcacgttttcccccaaagctctttgtatgtagacaatttaaaatcccaggata

SEQ ID NO: 18731 - DNA, 201 bp, Homo sapiens
taatacgattctcatttatttaaatgataacttgcatgaaatttctgaaaattgagaatttagatttttagcacttctgatttgattatagctaaaaaaawtcaaaacaaaccacgtagttagtgatgctgaagaaatataataattttggtttttctttcaggttttttcagttgacattaatggtttaaatatccaaga

SEQ ID NO: 18732 - DNA, 201 bp, Homo sapiens
atcagttcactggattttatctgttttatccggaggcaaatttcatgaactgctgatgccctgctttcacctatactaatcaacatgggatgaaatcaagstagcttaaatttttttctctttataaaattgatacatggtcaatgtaggcagtttatagaatagaggaaactatatagaaaaaaataaaatcactcatat

SEQ ID NO: 18733 - DNA, 201 bp, Homo sapiens
ctcatttatttaaatgataacttgcatgaaatttctgaaaattgagaatttagatttttagcacttctgatttgattatagctaaaaaaaatcaaaacaamccacgtagttagtgatgctgaagaaatataataattttggtttttctttcaggttttttcagttgacattaatggtttaaatatccaagaggttctcaat

SEQ ID NO: 18734 - DNA, 201 bp, Homo sapiens
atttaatgagggggacacattctgagaaatgtattattaggcaattttgttgttgtgtgaacgtgatagagtgttgttaaacaaacctggatggtatagcytactgcacacctagggtaaacagtatataccctaggcatatactgttgctcctaggctacaaacctgaacaccatgtttccgtgctaaatactacaggca

SEQ ID NO: 18735 - DNA, 201 bp, Homo sapiens
aatttctgaaaattgagaatttagatttttagcacttctgatttgattatagctaaaaaaaatcaaaacaaaccacgtagttagtgatgctgaagaaatayaataattttggtttttctttcaggttttttcagttgacattaatggtttaaatatccaagaggttctcaatgtttctgttgaaaccccagagaacctggc

SEQ ID NO: 18736 - DNA, 201 bp, Homo sapiens
agcaaaaatatggtattataatcttaggggaccactgtagtacatgtagtccatgcggtctgtcgttgaccgaaagagccatatgcggttcctgactgtasttccttttgtttgctcttaaatttatatttcaaacttcaagaaattatcccagtattccattaattggtgagcagatttttgtgtaccttagaaatcttg

SEQ ID NO: 18737 - DNA, 201 bp, Homo sapiens
ggcatcctagaggaattgccgtggacccaactgttgggtaagtgatgtgaaaacatattgattcctgtatttttagaattttctctctccctctatacackgaacatctactggattaatcaaaggctcattctgatttcttttaggctgtatactctagaagccatgtctattttatgcccttatttatagaagctttaa

SEQ ID NO: 18738 - DNA, 201 bp, Homo sapiens
tcaccgtgccacctgaaaaggttgactgactcatgtgagctccgtcttcattatcaatgaaaggggcacagtgacattttcctgacctgctgcttggtgtsgttgtgatgatcaaatcagaaaatagaagtgaaaaatctctgtaagggatagagggctgtataaatgtgagacattataattaggagaatattagtgttt

SEQ ID NO: 18739 - DNA, 201 bp, Homo sapiens
ggatgattgccataatgagtcctcttttggtttgttttagctgttgtgacctgccagcagggctatttcaagtgccagagtgagggacaatgcatccccarctcctgggtgtgtgaccaagatcaagactgtgatgatggctcagatgaacgtcaagattgctgtaagtgtttggagaggaatcttgctttggctttgtgg

SEQ ID NO: 18740 - DNA, 201 bp, Homo sapiens
ttctcatctcagcaaatggcttcctcatccttgctcaagcctcaaactgtatcctactttgacttttcttttgctcctctaccccatatagaattccttaraaaatcccattgttttgatcttcaaaatacatctagaatccaactacttttcaccatcttcacttctgccaccctgattcaaccaactgccctctcttgc

SEQ ID NO: 18741 - DNA, 201 bp, Homo sapiens
aaaaggaaaattgctgtctctatcaaagcaagtggcttagcaacgctgtttctctcgatctgactccccccttttctccaccccagtgcctcccactcccrccctgctggtgattcccaatgcatttgagtagttgaatctgcatccttctttttaacttccatcccagatacttggttaccctgtgagaattcccctgta

SEQ ID NO: 18742 - DNA, 201 bp, Homo sapiens
acaagaggcccaagaagttgcaggagcctttggttgtattcctggggacagttatgccctgtttacatttggaggctgctatttgccttcacaaattctartctatatccatgcacattttttacataattgtaaaaatataaaaatacaatcttctacattgctttaaaaaacctgtcaataaatcatattgctatatag

SEQ ID NO: 18743 - DNA, 201 bp, Homo sapiens
cctctggtctcttgtgtctggcacagtgtcaggcataagcatgcactcaagaaatttttgtttaatagaaagtcaaaagaacagcatgtgttatagtaaascaactccatcatggtggggaggtaataggcatgctctactctgggctcctgtcgcagagaggattttgtttggcttgaacaagacaaacatttaattctc

SEQ ID NO: 18744 - DNA, 201 bp, Homo sapiens
tacccaaatgtcactttctcagagaggccctcattgaccgctctacctaaaatagccaccccctcataattcttttgctctttaccctcatgttctgaaayctctctctctctctctgagtttagttgtttctttttgctcgaatatatactccacttttatagcgtccccagtgcttagaatggtgtttggtttacagtg

SEQ ID NO: 18745 - DNA, 201 bp, Homo sapiens
tagccccctccctccctccctccctcccttccttccttccttcgttccttccttccttccttttcttccttccctccttccttccttgtagatctctttgwcatcttttggacatcatcttagtttcacacatatattctaacacatcatatatagttcgtttattgagggtaggctgggtactaggaggtcctgtaacag

SEQ ID NO: 18746 - DNA, 201 bp, Homo sapiens
ttccttttcttccttccctccttccttccttgtagatctctttgtcatcttttggacatcatcttagtttcacacatatattctaacacatcatatatagytcgtttattgagggtaggctgggtactaggaggtcctgtaacaggccctgggaatacagaggtcgcttagtctcatctgttctgttccttatatttcaca

SEQ ID NO: 18747 - DNA, 201 bp, Homo sapiens
ataagatacaaagggagaattgtcatgaggacactgctgaaaaacactgtgatagttctcctaccttacaagggttcagggaagctctatggaaaaagtakcactgaactgaatgttgaaggttgggatccactggtagtataaccagtgataaagtatgtgacatgtgaggtcaatgtgggtgagagtgagaagggccac

SEQ ID NO: 18748 - DNA, 201 bp, Homo sapiens
tagtctctagtggggattggggccagaggagaagaaagtcttgagcttagtttccttccacgtgtagggaaggttcctctccaggaacctcagtgacttarctgatagaggaggcactgcatgagctattcagggggagcacagaaaagactggtacaaatacactttcagtgctttgatgctggctaacaggaagttttc

SEQ ID NO: 18749 - DNA, 201 bp, Homo sapiens
actgtagccttgacctcctgggctcaaatggtcctcccacttctcagcctccagagtagctgggactacgggcgcatggcaccatacctggctaattttgkattttttttttttttttttttttttgtagagatggggttttcccatgttgcccaggctggtctccaactcctggcctgaagtgatccacccaccttggcc

SEQ ID NO: 18750 - DNA, 201 bp, Homo sapiens
ctgatgagctgatgcacctgtgccacaccccagaacccacgtgtccacctcacgagttcaagtgtgacaatgggcgctgcatcgagatgatgaaactctgyaaccacctagatgactgtttggacaacagcgatgagaaaggctgtggtgagtacaacagaggatttgggaaaaggaaacaggggagactgaatatggatt

SEQ ID NO: 18751 - DNA, 201 bp, Homo sapiens
agcaaggagtggtatgaggaaggatattctcacctttttgtgttagaaaaaaccttaaaggtctgaggcttaatttatagctacttgttgatctttccatyaaaaccaaattcagaaggaagagtttccttggtgttcttatatatggtctcctctcatattgcactttaccctatacttaaattcttgcaggacattata

SEQ ID NO: 18752 - DNA, 201 bp, Homo sapiens
aatcacttttgcccccaataaacttataggctctgtcaaaaaaggaccatatctttttatttatttatttatttatttctttttttttctttttttttttytttttttttttatcccggcccgttctcaatgagctgttgggtacacctcccagacgaggtggtggctgggcagaggggctcctcacttcctagtaggggt

SEQ ID NO: 18753 - DNA, 201 bp, Homo sapiens
cccatctctttatttctgctcccactgccaacatctctcatttgggtgtcagcagtagtctctgggttggcctccctgcctccagttctgtggatccttarattctctctgacactgatgctgatctaactaagattctttggtagctctccattaattccaggagaaagttccaattccctaacacggtttacagtggct

SEQ ID NO: 18754 - DNA, 201 bp, Homo sapiens
gagaatgactgccgtgagtctgttttagtccttgcactgtatttggtttcacccttgtccctttggcattttaatcaatttgttagatttgttgatggacrtaaatgcctacaatatgcctcttgttattgcaatctcttggcagattcttttgtggattaggggtgatgttctgataagagtctatttttaacaagacat

SEQ ID NO: 18755 - DNA, 201 bp, Homo sapiens
aattcagacacttaagtgccttctggaaaaatctatctattctgcctttattaatagaagtaaaattggacccacaggtataaggtacttagagaaaataygaaattatttagtgttagaagtaggctgacttgaaaaattttgtttgctgttccagaattataagacaccattttgctaattaaacagaaagaaggaaca

SEQ ID NO: 18756 - DNA, 201 bp, Homo sapiens
tatttctttttttttctttttttttttttttttttttttatcccggcccgttctcaatgagctgttgggtacacctcccagacgaggtggtggctgggcaraggggctcctcacttcctagtaggggtggccgggcagaggcgcccctcacctcccggacggggcgtctggccgggcggggggctgacccccccacctccc

SEQ ID NO: 18757 - DNA, 201 bp, Homo sapiens
tctctcatttgggtgtcagcagtagtctctgggttggcctccctgcctccagttctgtggatccttagattctctctgacactgatgctgatctaactaarattctttggtagctctccattaattccaggagaaagttccaattccctaacacggtttacagtggcttccaagatgtgactagtgcttattttcctatgt

SEQ ID NO: 18758 - DNA, 201 bp, Homo sapiens
aagtggcttcacgtcttggataattacacatttctaattgcaatttaaccctgtgcatttttccttccagctaccaatccgtgtaaagataacaatggggrctgtgagcaggtctgtgttctcagccacagaacagataatgatggtttgggtttccgttgcaagtgcacattcggcttccaactggatacagatgagcgc

SEQ ID NO: 18759 - DNA, 201 bp, Homo sapiens
tcttcgcagcacaaagtacatgctcaagtcatcagataacatgctccaatggtcagtgtatcccaagtgaatacaggtgcgaccacgtcagagactgcccmgatggagctgatgagaatgactgccgtgagtctgttttagtccttgcactgtatttggtttcacccttgtccctttggcattttaatcaatttgttagat

SEQ ID NO: 18760 - DNA, 201 bp, Homo sapiens
tcctcctgcttaagcctcctgagtagctgggactataggtgtgcaccaccatgcccagctaatttttaaattttttgtagagacacgatcttgttacgttkcccaggctggtctggaatcctgggctaaagtgatcctcctgccttggcctcccaaaatgttgggattataggcatgacccccccatgactggcctgaaaa

SEQ ID NO: 18761 - DNA, 201 bp, Homo sapiens
tttgtttgctctctacatttgaatgagcttttaattgcttcttcgtaagccctttgaaaacctaagcacaacatttagaattatttgggcttgacgtaaasaagaaagccaaggtaattgaacgagcactgatacctgacccaggttcttttcatattttgtttgagacaacccatgacttgccttctcgggaataaaaga

SEQ ID NO: 18762 - DNA, 201 bp, Homo sapiens
aacagataatgatggtttgggtttccgttgcaagtgcacattcggcttccaactggatacagatgagcgccactgcattggtaagaagtctgttttggacrttgttggcaggtgacacaggtgtatgtgtgtccaaacctctaactagactaactgctactcttgaactggaccagctccctgtctaacttcttgactgca

SEQ ID NO: 18763 - DNA, 201 bp, Homo sapiens
ctgcaattgttattagacctaatctagaccttttcactagtggtttatttttggtttatttttaaacaacacatattccctttatgagagaatgagcttcygaggccagtgaagcattttggctgatggctgagaggtcacccagcaatgataaagtatcagtttgttttttctggagagatatttccaaacaatagtcgt

SEQ ID NO: 18764 - DNA, 201 bp, Homo sapiens
ctgggcaggaatttttaatcaagtttttttttatttaaaaaaatttaagtacaaatagttggtgaaataatgattcactaaggaaagaaaaccaaatttgkcttactgtttctggaatcatacaagtcatgaacccttcagggcacactgtgacctaaaatgaatcacatgcatgtaagggattttgcagtgaggcattct

SEQ ID NO: 18765 - DNA, 201 bp, Homo sapiens
tttttggctcaagtgatcctcctacctcagccttccaaatagctacgactacagctacttggaagtgagccactgtgcccagctaaatttatttttttttycttttaagatataaggatctcactatgttgcccaggctagtcttgaattcttggcctcaagtgatcttcttgcctcaatctcccatagctgggattaaag

SEQ ID NO: 18766 - DNA, 201 bp, Homo sapiens
tctatttctcagaaatagaatggcctataggaatgaatatattaggtacctggaaaccacctaaaaatagtaatggatgttggaaaagctccaaagaaggrctcaattcttccctctaatattcaaaaggattagggagcttgatgttgtagtttgtagccctgcctgtcattccagacccctaggttgtagttcataccc

SEQ ID NO: 18767 - DNA, 201 bp, Homo sapiens
tgttttcctaagagcttgaaactgtatgtcttttacagtcattgaaaagtgatgccctagggatttaggtaagttcagcaaatataagattgaactgtatwagttgaaatcaccttaaattttatttcttttttcctccaaaaaactttattctgggggagtaaaaaaaattgtttttaaacccaaaacatttcttctaac

SEQ ID NO: 18768 - DNA, 201 bp, Homo sapiens
caagagttctgaaagttgagcatgcctcagaattatctggagagcttgttaaatatagattcgtgggccccatctgttgcacttctgatgcaatatgcctkaggtggcctaagaatttgcatttctagttctcctgtgacgttgatgctgctggttcagtgaccacattttgagaaccgctgctccagtcccttgctactc

SEQ ID NO: 18769 - DNA, 201 bp, Homo sapiens
gtgtgtagagggaaatttatagcactaaatgcccacaagagaaagcaggaaagatctaaaattgacaccctaacatcacaattaaaagaactagagaagcmagagcaaacacattcaaaagctagcagaaggcaagaaataactaagatcagagcagaactgaaggagatggagacacaaaaaacccttcaaaaaatcaat

SEQ ID NO: 18770 - DNA, 201 bp, Homo sapiens
aaaatttttgaatatatatatattaaaacctgtgaaacaggtaaaagctcattttcccccttagttcttttattattcaatctggtcatctgtaaaatggmatctcatattaaacagcttgtcaattaacttttttttttttttaaggaacagagagattcaaaactgcggtccattttacttctaatgggattagcatca

SEQ ID NO: 18771 - DNA, 201 bp, Homo sapiens
cattgaaaagtgatgccctagggatttaggtaagttcagcaaatataagattgaactgtataagttgaaatcaccttaaattttatttcttttttcctccraaaaactttattctgggggagtaaaaaaaattgtttttaaacccaaaacatttcttctaacttttggctttctcagtcttcactgaagagtagttttttt

SEQ ID NO: 18772 - DNA, 201 bp, Homo sapiens
caatatctggatatagatattatatctaggatataatagtgaatattatatttactataagtgaatagcattcttgccaacagagttctggattccaaaaktaactttcagtatggcagcactgctcattttgtgaagaaatgggacagcctcacaattctcccagcaaagcagttgagatgaaactttttttctatggta

SEQ ID NO: 18773 - DNA, 201 bp, Homo sapiens
taacatcacaattaaaagaactagagaagccagagcaaacacattcaaaagctagcagaaggcaagaaataactaagatcagagcagaactgaaggagatrgagacacaaaaaacccttcaaaaaatcaatgaatccaggagctggttttttgaaaagatcaacaaaattgatagaccactaggaagactaataacgaaaa

SEQ ID NO: 18774 - DNA, 201 bp, Homo sapiens
tgctctttagaatttaaacatttttctttatatctttaactgctgaaactccagctgagggaacagtgggaggggaataaaaagatggttaaagtcatttygtggactgtgagggtgcatgaagaacatgttcttcaaactcagttccacatttaagctgcccagcgagccttgcccttgctattctctctctccctgaag

SEQ ID NO: 18775 - DNA, 201 bp, Homo sapiens
ttttattattttagtgcttcacgattgtactgggtagatgcctattttgataaaattgagcacagcacctttgatggtttagacagaagaagactgggccrtatagagcagatgacacatccgtttggacttgccatctttggaggtatgttttaaagcaataaaagtatgtattgtttttatacattgcaagttacaata

SEQ ID NO: 18776 - DNA, 201 bp, Homo sapiens
ataattttttctcttcgcagcacaaagtacatgctcaagtcatcagataacatgctccaatggtcagtgtatcccaagtgaatacaggtgcgaccacgtcrgagactgccccgatggagctgatgagaatgactgccgtgagtctgttttagtccttgcactgtatttggtttcacccttgtccctttggcattttaatca

SEQ ID NO: 18777 - DNA, 201 bp, Homo sapiens
gggaccgtcgcggagatggatcgcgggccggcagcagtggcgtgcacgctgctcctggctctcgtcgcctgcctagccccggccagtggccaaggtaagarcccagccggagcctctcgtggagcccccacttccccggctgtggcagggtcgggtccgcgggaggccggaggggagagcgtccgggcaggggctagggcc

SEQ ID NO: 18778 - DNA, 201 bp, Homo sapiens
ttatacttctgtttttgctttgtaagctcagcttggtggtagccaggtactttaccttgtgtccctatgaactttatgctttccaatatccttgttaatgmcaatagattagtctgtgtctagcaataattataaattaagtaataattttttctcttcgcagcacaaagtacatgctcaagtcatcagataacatgctcc

SEQ ID NO: 18779 - DNA, 201 bp, Homo sapiens
ggccggaggggagagcgtccgggcaggggctagggccgggcggcggcgcgggagctgctcccggtggggcgctcaggttgcttcgcgaagccggagggggmgcgcccctcttcgctcgccaggaactgagcggcagcaaacttgagaaagcagccccgccagtttcggtgacagcgcaccccacggagaccctgtctttgt

SEQ ID NO: 18780 - DNA, 201 bp, Homo sapiens
ctattctctgggcattttgataacattatacttctgtttttgctttgtaagctcagcttggtggtagccaggtactttaccttgtgtccctatgaactttwtgctttccaatatccttgttaatgacaatagattagtctgtgtctagcaataattataaattaagtaataattttttctcttcgcagcacaaagtacatg

SEQ ID NO: 18781 - DNA, 201 bp, Homo sapiens
aaacatgtctgcagtcttcctgtcaagataataatgaacagtgccttatatttgtatcttactctgcttaaaatgatttccattctaagaggtctacaagrtcttcaaactacatttctacaccctcctccctgattatgtaaacagaactatagcatagaaatttcttgcttcaaaccaaatcattaacagtgaaaaaat

SEQ ID NO: 18782 - DNA, 201 bp, Homo sapiens
ttggcgggttgatttccaagaggaagctactttttagtattgggtctgaaaaatgttttgtcctgtttgttttccttcacaaatcaaacccgtgacctacytagtgaaaatgtacatgactgactccctcggggctttgcttttgcaggttctaacgcctgtaatcaacccacgcatcctaacggtgactgcagccacttc

SEQ ID NO: 18783 - DNA, 201 bp, Homo sapiens
tagagatgaggtctcaccatgttgcccaggctgatctaatttttaatcttgaaaaacagaaaccggcacctgagttcatttcctggacccaaagctgctgktatcttcttctttctctctcttttttttcctcctttttaaaaatttttgtcaagatgtctaagggattaaattgatatagaaatttcaatttctaggagt

SEQ ID NO: 18784 - DNA, 201 bp, Homo sapiens
cttaacatgcactttgaaggcttttaggaagctaagcaagaaatttcattcataatgttatggatggtttctggccttgatttagactatcttcaacaatwtttttccttgacattggctgtttggaccaatgcagtcattatgtcttggcaaactcctcaaaaagtcaaatcgaaataaactagatctgaccaggcaagg

SEQ ID NO: 18785 - DNA, 201 bp, Homo sapiens
aaagaactgggtctgtgacacagacaatgattgtggggatggatctgatgaaaagaactgcagtaagttttgagctggtttcccttggttggtcagcctcstaaatagacttcaacaaccaaatggccttgcattctttcctctaaggctcatgcaattttcattgtctctttagtacttctattccacttgtcaatctct

SEQ ID NO: 18786 - DNA, 201 bp, Homo sapiens
gcaggcttctagttaaaacagattggaaatttgactaaagaagtctttggaattgagttaatagaggtgtcagtctcttctgttcttctagaccttctagwggcccagggaccagagccacacattttggatggtttttaagtagaacttaagtagggttatcatcaggtaggtgtgcgaggtacaaatggatgtggagaa

SEQ ID NO: 18787 - DNA, 201 bp, Homo sapiens
agagtgagactctgtctccaaaaaaaaaaaaaaaaaaaaaagtctggatcaatgtacacacttttcatagcagcttctgaaagagcctgtttcttgttacygttatgatataggctgtgtctttatcagttgcaactatactttctcttgccttaggctaattccagggtcccctgggtttgggagcctatgacaccttca

SEQ ID NO: 18788 - DNA, 201 bp, Homo sapiens
gggcattgcatccctgcagactggaggtgtgatgggaccaaagactgttcagatgacgcggatgaaattggctgcggtaagtgaggaggggccaggctaarttctattttgagtaacctaagtgcttcctggtgatttcagctgtaacaaagagaagagctatgccttttagtgacagagccaggtctgggcccaagtctt

SEQ ID NO: 18789 - DNA, 201 bp, Homo sapiens
acccaacttcaccagctgctgatggaactcaggtaacagttgccgactcctgaaataatgtgggatttggaaaaactttgggatgactgggtttttattamccttaagcaaacaagggagattctggaaggctcaaagatctcaagatgtgttgacagttaataaatataattttttaaaaagtcatagattgaaaaactt

SEQ ID NO: 18790 - DNA, 201 bp, Homo sapiens
ggtgcctttcctttccagctccccgggagtgcacagagagcgagtttcgatgtgtcaatcagcagtgcattccctcgcgatggatctgtgaccattacaaygactgtggggacaactcagatgaacgggactgtggtaactgtcatttgagaagcttaccatagaattttgtactgtgacagtgtaggggcttcaaattag

SEQ ID NO: 18791 - DNA, 201 bp, Homo sapiens
atcagagcagaactgaaggagatggagacacaaaaaacccttcaaaaaatcaatgaatccaggagctggttttttgaaaagatcaacaaaattgatagacyactaggaagactaataacgaaaaaagagagaagaatcaaatagacacaataaaaaatgataaaggggatatcaccaccaatccctcagaaatacaaacta

SEQ ID NO: 18792 - DNA, 201 bp, Homo sapiens
gcagaactgaaggagatggagacacaaaaaacccttcaaaaaatcaatgaatccaggagctggttttttgaaaagatcaacaaaattgatagaccactagsaagactaataacgaaaaaagagagaagaatcaaatagacacaataaaaaatgataaaggggatatcaccaccaatccctcagaaatacaaactaccatca

SEQ ID NO: 18793 - DNA, 201 bp, Homo sapiens
tctgagcagagtggccacaaatagtcttctttatgaaaaaccgtgtatggtgaccttgggggaataaatggctgattcctgttacattgtattcttagatrgagaacgagcaaaaggaaagtgttgctgcgacaccacctccatcaccttcgctccctgctaagcctaagcctccttcgagaagagacccaactccaacct

SEQ ID NO: 18794 - DNA, 201 bp, Homo sapiens
cttcaaaaaatcaatgaatccaggagctggttttttgaaaagatcaacaaaattgatagaccactaggaagactaataacgaaaaaagagagaagaatcawatagacacaataaaaaatgataaaggggatatcaccaccaatccctcagaaatacaaactaccatcagagaatactataaaaacctctatgcaaatcaac

SEQ ID NO: 18795 - DNA, 201 bp, Homo sapiens
aaaatcaatgaatccaggagctggttttttgaaaagatcaacaaaattgatagaccactaggaagactaataacgaaaaaagagagaagaatcaaatagayacaataaaaaatgataaaggggatatcaccaccaatccctcagaaatacaaactaccatcagagaatactataaaaacctctatgcaaatcaactagaaa

SEQ ID NO: 18796 - DNA, 201 bp, Homo sapiens
agacgtgccagtgacattgatgaagaatgtgactttttcttggacatgccttgcacttccctgtttctgtgccagttctagtttgtttcctctgtgaggcrtcccctcccctcagatccatctatctgtagcttaaatgcacctttctctacaggacctttcttgatatccactgaatgttatctgaacctctcttacagc

SEQ ID NO: 18797 - DNA, 201 bp, Homo sapiens
cataattgaggaaaatagcaaggaattttaaacatttaattttaatatcaacacttcttaggagcagattttaatctgcgttagccttgtaaacaaagacwttgatcttgctactattccacggaaagtcaccctaaggaatatgcatgtgctcctatgactctcttgtgtagagatcagatcattgacagagtaatccta

SEQ ID NO: 18798 - DNA, 201 bp, Homo sapiens
aaatcaatgaatccaggagctggttttttgaaaagatcaacaaaattgatagaccactaggaagactaataacgaaaaaagagagaagaatcaaatagacrcaataaaaaatgataaaggggatatcaccaccaatccctcagaaatacaaactaccatcagagaatactataaaaacctctatgcaaatcaactagaaaa

SEQ ID NO: 18799 - DNA, 201 bp, Homo sapiens
caacttcagcaaagtctcaggatacaaaatcaatgtgcaaaaatcacaagcattcctatataccaataacagacaaacagagagccaaatcatgagtgaaytcccattcacaattgcttcaaagagaataaaatacctaggaatccaacttacaagggatgtgaaggacctcttcaaggagaactacaaaccattctcagt

SEQ ID NO: 18800 - DNA, 201 bp, Homo sapiens
gggtctgtgacacagacaatgattgtggggatggatctgatgaaaagaactgcagtaagttttgagctggtttcccttggttggtcagcctcgtaaatagwcttcaacaaccaaatggccttgcattctttcctctaaggctcatgcaattttcattgtctctttagtacttctattccacttgtcaatctctgtgtcaat

SEQ ID NO: 18801 - DNA, 201 bp, Homo sapiens
tagttttaaaatctatattgtattctttacacatgttgataacgtaattgtgtacatagcatgcttgagtgtggacactattctctgggcattttgataayattatacttctgtttttgctttgtaagctcagcttggtggtagccaggtactttaccttgtgtccctatgaactttatgctttccaatatccttgttaat

SEQ ID NO: 18802 - DNA, 201 bp, Homo sapiens
aaagaagacatttatgcagccaacagacacatgaaaaaatgctgatcatcactgagcatcagagaaatgcaaatcaaaaccacaatgagatatcatctcayaccagttagaatggtgatcattaaaaagtcaagaaacaacaggtgctggagaggatgtggagaaataggaacacttttacactgttggtgggactgtaaa

SEQ ID NO: 18803 - DNA, 201 bp, Homo sapiens
ggggggcggcggctacttgtctttcattacagtacactgatgggtgccctgatctctgacatctaggaggttgcacttgtggagagtcgtcatggtctgtyataacaaagagcaacccagacctcacagaaaacctggcaaatagggaattttaactctgagaaggtttggtgtggtgtacaaggcaaaagaatggttctg

SEQ ID NO: 18804 - DNA, 201 bp, Homo sapiens
ttgatgggtgcagcaaaccaccatggcacgtgtatacctatgtaacaaacctgcatgttctgcatatgtactccagaacttaaagtataacaacaaaaaakaaaaatctcagtgtttagtcattttagccctgagctaatttctaatgcttttctctttcattcttagtattaaactgtactgcttctcaattcaagtgtg

SEQ ID NO: 18805 - DNA, 201 bp, Homo sapiens; identical to SEQ ID NO: 2031

SEQ ID NO: 18806 - DNA, 201 bp, Homo sapiens
tttttaacaatttttcttagcacagacattttttcttagaaattatttgcttggttaaattggacacacacttagattattctgagcagagtggccacaartagtcttctttatgaaaaaccgtgtatggtgaccttgggggaataaatggctgattcctgttacattgtattcttagatggagaacgagcaaaaggaaag

SEQ ID NO: 18807 - DNA, 201 bp, Homo sapiens
agaaacaacaggtgctggagaggatgtggagaaataggaacacttttacactgttggtgggactgtaaactagttcaaccattgtggaagacagtgtggcrattcctcaaggatctagaactagaaataccatttgacccagccatcccattactgagtatatacccaaaggattataaatcatgctgctataaagacaca

SEQ ID NO: 18808 - DNA, 201 bp, Homo sapiens
gaagactctatatcatttagccttaaatattaatttggtcatagttgttactataaacctactattggatccaaaatcatttcctctgagtctagactatraaagggatcacaaattacattcacaagccgatttaccccatgttttccttctagcaaccaggcctcctggtatgtgccactcagatgaatttcagtgcca

SEQ ID NO: 18809 - DNA, 201 bp, Homo sapiens
gttgaaaccactgatgaaggagtaagttggtgaggaagttgaaaaatagtgacttttcaataatccacagtctttggaagtctttgttgtctgtcttagcmtgattcattaagaattggcactgtttagtagaaatgttgactttgaaccattatagtgagttggtcgttgatattttaggatctctaagaactgcttttt

SEQ ID NO: 18810 - DNA, 201 bp, Homo sapiens
aatcactcatattcatattcacaccactctggaataactgctattaaagctttggtatatttccttcttgtttatacaaggatttcaatgggtgggttggkggtccttggttaatacctatacttgcaaaatttttatttcattaaactttttaccatatagttttaaaatctatattgtattctttacacatgttgataa

SEQ ID NO: 18811 - DNA, 201 bp, Homo sapiens
caactatttcctcatatctctcctctctgacttcagaaatgatttctcccaatgagatttttgattttgatgccagctttatatctcactgtgattaggayggggccttatgatgggagaattagacttgaccaactatcatcagtttttgttttctcagtgagtttttggtgctctgatcttttttccttctatctgatt

SEQ ID NO: 18812 - DNA, 201 bp, Homo sapiens; identical to SEQ ID NO: 2036

SEQ ID NO: 18813 - DNA, 201 bp, Homo sapiens
tgctttttacctacaggcattaatgaatgccatgacccttcaatcagtggctgcgatcacaactgcacagacaccttaaccagtttctattgttcctgtcrtcctggttacaagctcatgtctgacaagcggacttgtgttgatattgatgaatgcacagagatgccttttgtctgtagccagaagtgtgagaatgtaata

SEQ ID NO: 18814 - DNA, 201 bp, Homo sapiens
ccccagtggccgatgcatttatcaaaactgggtttgtgatggagaagatgactgtaaagataatggagatgaagatggatgtggtaaggaggggaagagaytcctactgaaaagcattttcttcaagtgttttccagcgcttgttttttctcctttcctttttagaaattttgtgtgacaagcaagcctcaggattggctg

SEQ ID NO: 18815 - DNA, 201 bp, Homo sapiens
gaactcaacatttttcagattacctttggaaaagtgttacattttgaaaatgtcttttcctataacagcagcatactatatctctttgtaactgatcaccmcaaaataagacatataaatcatagtattctatgtataatgtataaatattaccacaccaaaataagaaagtgcaatcatggttcattatctagtaacagg

SEQ ID NO: 18816 - DNA, 201 bp, Homo sapiens
ataggccatgaagtcctttcaggaaaagtgatttgttctttcagaatcgctaattcagtcttgtgatgccccacaagctgttctcagttttttgttccacsctagagcccagataacacattttccatattttccaacatataagtctgtggtgagccttgggttgtatttccaaatgtctagggttttctaaatgtcaga

SEQ ID NO: 18817 - DNA, 201 bp, Homo sapiens
attttttttttttttttttttttttgtagagatggggttttcccatgttgcccaggctggtctccaactcctggcctgaagtgatccacccaccttggccycccaagtgctgggatgataggtgtgagccaccatgtctgacccatctctttatttctgctcccactgccaacatctctcatttgggtgtcagcagtagtc

SEQ ID NO: 18818 - DNA, 201 bp, Homo sapiens
atattgaaggtggcatgagactgcataataaatattgcataagagtgaatcaaagaagcaaagattcttgattttcttttttcattattctctttcttttytctagatgggaacagctgctcagatttcaatggtggttgtactcacgagtgtgttcaagagccctttggggctaaatgcctatgtccattgggattctta

SEQ ID NO: 18819 - DNA, 201 bp, Homo sapiens
gacatgctgtttgttgacagaatgacatcgtggtgcagagtgagggcagggaggtcattcagcatggtggggtttcacacagccagatggatcagagggtrgccaaggggggctcagttaaaaaggggtttttgagtcattttcacagcagtatttgttggtgggaggagacaaagaataaaaaggaaagaaaaatagata

SEQ ID NO: 18820 - DNA, 201 bp, Homo sapiens
ttttttttttttgtagagatggggttttcccatgttgcccaggctggtctccaactcctggcctgaagtgatccacccaccttggccccccaagtgctggratgataggtgtgagccaccatgtctgacccatctctttatttctgctcccactgccaacatctctcatttgggtgtcagcagtagtctctgggttggcct

SEQ ID NO: 18821 - DNA, 201 bp, Homo sapiens
tcttacttgccaatgattctaagacctgtgaagacatagatgaatgtgatattctaggctcttgtagccagcactgttacaatatgagaggttctttccgstgctcgtgtgatacaggctacatgttagaaagtgatgggaggacttgcaaagttacaggtaattgctgaactaacccgagccagtttatcagcacatccc

SEQ ID NO: 18822 - DNA, 201 bp, Homo sapiens
tgttgacagaatgacatcgtggtgcagagtgagggcagggaggtcattcagcatggtggggtttcacacagccagatggatcagagggtggccaagggggkctcagttaaaaaggggtttttgagtcattttcacagcagtatttgttggtgggaggagacaaagaataaaaaggaaagaaaaatagataaaggtattgga

SEQ ID NO: 18823 - DNA, 201 bp, Homo sapiens
gttttatataactttttattgaaagcttcttcaaattacttttggactggggaaggatatgcttctctgtttttttccttgtatattactgcattccctargagctagtccatgatggcagtcactttagggacttgaaattcaccaggaatgggggtttggggagtcgtggtggtaccttcatgagactaactttatggc

SEQ ID NO: 18824 - DNA, 201 bp, Homo sapiens
ttgtgttttctcccagtatcattgacatttttgcatttttttcttgaacagcatctgagagtctgctgttacttgtggcaagtcagaacaaaattattgcsgacagtgtcacctcccaggtccacaatatctattcattggtcgagaatggttcttacattgtagctgttgattttgattcaattagtggtcgtatctttt

SEQ ID NO: 18825 - DNA, 201 bp, Homo sapiens
ggttgcagtgagccgagactgtgccactgcactccagcctgggcaacagactgtgactccatctcaaaaaaaaaaaaaaaaaaaaaaaaaagaaaaaaaaraaaaagaaaagaaaagagaagaaacttggccttttggtgggttatggaatggtgggccacccagcaggaatggttgaacccaattcacaactctgacagt

SEQ ID NO: 18826 - DNA, 201 bp, Homo sapiens
ctagtcctctactgatcaatttttatatcattccttatcttttgctattgccaataagactgcaattaataccttgttcatatatcattttgcatacctgsgagtaaacagacagaacagatttggaaccaccattaccatctttttcagagtgatttcctggtaatctttaaaatgtcttctgtgtttaacaaaatctaa

SEQ ID NO: 18827 - DNA, 201 bp, Homo sapiens
taaccacaaacaaaatatgccacctctgtattcactaaagttaccagataactcctgattgccaatgggcacttttccttccttctcacactggatgggcrtttagattgcacttgactctggagaccattcctccttcttgacaccactcccttggctgccatgactcccagcagtcctggctctcttttgagctgcttt

SEQ ID NO: 18828 - DNA, 201 bp, Homo sapiens
atgaagtaagacttttttttaaaattatgttgccttgacatggttatgatgagggaaaaacaacagtaacatgatgtagctgatatgcatgttgctgataygcaaaatttaaaatgatcccttgtttaaacatggtaggtgtccaactgggtgttgctatctctccttcatctgaatcatcctcttcataaagtacataag

SEQ ID NO: 18829 - DNA, 201 bp, Homo sapiens
cagaatgcttgaattcttaccaaattcttcctaacttactgagattttggacgcttcattaagcctttttgtgcctcaatttgcccttctgtaaaatggayagaatgctagctatctgtctgcctcagaggtttatgttaaaatcaggtaagacaacctagaagatagcatttgaaaaagcagaaagcatatcatttgtaa

SEQ ID NO: 18830 - DNA, 201 bp, Homo sapiens
tatgacagttttactttgtgacacttagaggaaacaataaactctgtgaatatattctgaaccagagatgatttattttaagcagggcataaacaggatgwtgtattatttaaaatgacagttatttttaatatttaaatacgtcccctccaattggtaactcatttcctttcccagtgagcatctactgttctggtctga

SEQ ID NO: 18831 - DNA, 201 bp, Homo sapiens
ttattataccattaatacgattctcatttatttaaatgataacttgcatgaaatttctgaaaattgagaatttagatttttagcacttctgatttgattakagctaaaaaaaatcaaaacaaaccacgtagttagtgatgctgaagaaatataataattttggtttttctttcaggttttttcagttgacattaatggttt

SEQ ID NO: 18832 - DNA, 201 bp, Homo sapiens
attctgaaccagagatgatttattttaagcagggcataaacaggatgttgtattatttaaaatgacagttatttttaatatttaaatacgtcccctccaaytggtaactcatttcctttcccagtgagcatctactgttctggtctgactggggccaccaccctcgcatcgagcgagccagcatggacggcagcatgcgca

SEQ ID NO: 18833 - DNA, 201 bp, Homo sapiens
aattttctctctccctctatacactgaacatctactggattaatcaaaggctcattctgatttcttttaggctgtatactctagaagccatgtctattttrtgcccttatttatagaagctttaagagagtttattaaatataatcctatttgaggacatgttacccaaacacacctagtggtgtactaaaaatacttgtt

SEQ ID NO: 18834 - DNA, 201 bp, Homo sapiens
ttgctcataaggttgttgagagaatttttggctaatgcatgtaaacacctagagtaatggctagaaaatagtaaatattcagtaaatgttggatatcattwtatctgttatcaatataaaaccatattgcccaccctcccctgcccctaatccagacctgctctggggagggaacagctcttttgactatttcttcttttg

SEQ ID NO: 18835 - DNA, 201 bp, Homo sapiens
agggtatctagactctttaaataatatacacatgtaacctatacttattaagcatcttcaatataaaagacactgaagcactaattccccatcaggcacaycctgggagtatgtacaggcctagctgggagcagggacttggagtaagggcagtttgggaggacttgaaaactcaggagctctctagctaactgcctatca

SEQ ID NO: 18836 - DNA, 201 bp, Homo sapiens
taagtgctggaggtaacagaggtgaacaaaacagacaaaaccccctgtgtgtattgagtttacattctaagaggacaataaatagagaagtcaataaatayatggtagttcaggtggtactatggagaaaatgaaggcagaggaagagggatgaggatggggtgagtggggattgtcctttagatagtgttcagggaagac

SEQ ID NO: 18837 - DNA, 201 bp, Homo sapiens
gaagagtgagtttttataagacctctacctcaagctggattcccattgccccagaatccactcaaccttaattgtagctcctcagggtagagaaccatgtycagttttgacaactgaaaaagggctaccttttgaaaagtgctttatattatcaggagacgaagaccagcatgaggaagctgtggtttaattctagtccca

SEQ ID NO: 18838 - DNA, 201 bp, Homo sapiens
ccagtatactttggatagaccatatgttatgatctgtccagttttgggtagtgacaaatcttggtataatatgtggatctcactggtcttttgaaccatckcaagttgtttagcactgagtagattttgaggttaggcagtgaaccagatacccaccttccaaacctctcagggcagcagagaagataagtgatgccaata

SEQ ID NO: 18839 - DNA, 201 bp, Homo sapiens
atgtctccttggagggttggggtggaaatcacatccagtatactttggatagaccatatgttatgatctgtccagttttgggtagtgacaaatcttggtayaatatgtggatctcactggtcttttgaaccatctcaagttgtttagcactgagtagattttgaggttaggcagtgaaccagatacccaccttccaaacct

SEQ ID NO: 18840 - DNA, 201 bp, Homo sapiens
cttgggatccttatgggagctggctagaaatgcagtctctcaggcccaccccagaccttctgaatcagaatctgcattttagcaagattccccaggtgatkgatagcacattcaagtttgaaaatctccactctggagggccgacgaaatggtaatgagacagatattgatggaggcttttggaagatgtgttactaattt

SEQ ID NO: 18841 - DNA, 201 bp, Homo sapiens
ctcaggttacctgtgcgctaatttatccttcagcagtgtgtggagcaagatgaaaggcaaagggaagtgaggaaaggaaatagccttttactaagttcttrtgtcaaattctctcttcagtgttaattcagccatctattacttcaattaccttataaagacctcccaaaccttataaagacattttattctcatctcaaa

SEQ ID NO: 18842 - DNA, 201 bp, Homo sapiens
catcagcaggtaagtaaaaatattagccctcatcattgtttggagtgatggatatgtacttctaggccacagaatccagcagacatcagtcccctgctaartgtgagttgggttaacaagtcacaaaatgggtttcataggcatcagaaatcttatccttcccattgcaaggctaggctagtcaggtcaacctgagatatg

SEQ ID NO: 18843 - DNA, 201 bp, Homo sapiens
caaagctgctgttatcttcttctttctctctcttttttttcctcctttttaaaaatttttgtcaagatgtctaagggattaaattgatatagaaatttcawtttctaggagtactgcttaggcagtgaggtgagagcactttcagtttttcccggtgatttgtgtctttggagtgcagctgttgctttattccagactatc

SEQ ID NO: 18844 - DNA, 201 bp, Homo sapiens
ttgaagaggaggacagaggtttattttttatttaacgatttaccccttgacacctgggaaatgattagttgatgttttcaaagaagattaagtcagtgtgrttaattaactgtggtaatcaggtgacttaaatcaattaactccttgttaacaatttccatcaattttgtaaataaatgactaaatcagtaaattgtactc

SEQ ID NO: 18845 - DNA, 201 bp, Homo sapiens
ttggtttacttacaaagtaagcatccagtgagtaatatttattatatcctacaaatggcaaaaaagcagtgaagtgtgggttttcttttgacaattatttstaatcatggaggatagcagacatactctgacataattattggggagaaagttgtaggagtcctttctttttttttgccaccgtctgttggagagtggatg

SEQ ID NO: 18846 - DNA, 201 bp, Homo sapiens
gcctttgcactgcctggagagggtgccttatgctgcatgaggaaagtaaaaccagacccgtcgaatgaagtgtgtcccccgtattttctacatgacaccaycttaaagtgggcattattgcacacagtcttgcaccctctgttgcctcactgcaggaagacaaacttcctgttttcccctgccctcatttgcctgaagaaa

SEQ ID NO: 18847 - DNA, 201 bp, Homo sapiens
cccagacgaggtggtggctgggcagaggggctcctcacttcctagtaggggtggccgggcagaggcgcccctcacctcccggacggggcgtctggccgggyggggggctgacccccccacctccctcccggacggggcggctggccgggcggggcgctgacccccccacctccctcccggacggggcggctggccgggcgg

SEQ ID NO: 18848 - DNA, 201 bp, Homo sapiens
aggctgatctaatttttaatcttgaaaaacagaaaccggcacctgagttcatttcctggacccaaagctgctgttatcttcttctttctctctcttttttwtcctcctttttaaaaatttttgtcaagatgtctaagggattaaattgatatagaaatttcaatttctaggagtactgcttaggcagtgaggtgagagcac

SEQ ID NO: 18849 - DNA, 201 bp, Homo sapiens
attggtgagtaggtgattgaggggtttggcaaggttgccttgggttatgtgcatgtcatgattgtctttaagcatgaacttcgtgatttacaaaaagtttrttgcacttgttagtgttttcttcaaagcatatgctgaaagttgacagtaggcaaatatctttagagtttatcccccttcccctgggaaagactacctaga

SEQ ID NO: 18850 - DNA, 201 bp, Homo sapiens
ctccttagaatctcagtaaaagactagtggtagagttagaaatcactaacttattgtaaaatgtagatcatttatagatttctcttgttcaacttgctctrcatcctctgtaaaccactgattaacaaagagctggctgtacctcccctatggcctgtaactctctctttttccccccacagaaagcggtcctcatgatgt

SEQ ID NO: 18851 - DNA, 201 bp, Homo sapiens
ttgcacaatgacttccttgtgtttttattaaataatgacatgttaaaggaaaccgtcttcttgagcagatatcctctttgactcagtgcaccttggctttsatttttggatgaggtctcactgttctcttctgcctcacagattatacggcacccctatgccctaactctctttgaagactctgtgtactggactgaccgt

SEQ ID NO: 18852 - DNA, 201 bp, Homo sapiens
ttcaacttgctctacatcctctgtaaaccactgattaacaaagagctggctgtacctcccctatggcctgtaactctctctttttccccccacagaaagcsgtcctcatgatgttcataaatgttccccaagagaatggtcttgcccagagtcgggacgatgcatctccatttataaagtttgtgatgggattttagattg

SEQ ID NO: 18853 - DNA, 201 bp, Homo sapiens
tccattacaagtatgatcagttgatagttccatcaagcagatgcataagagtggtagtggcattgcttcttgctttccttacagtgacatcaggaacagaygtgggcgtttgctggggcttgaaccctaccactcactgtcctgctccctaattgctaggaaatgctcaatggtgcagtgggaaatagttggcaaaggcat

SEQ ID NO: 18854 - DNA, 201 bp, Homo sapiens
aattctaagttgaaagcctgatgctagggaagttgaaagtgtgagtagttcagtgaaaacaaaacaaaagaaaacaacagaggtaacaacgtacttaagcmcccctgtactggggcctctggaaggacactaagagcatgactctgttttgattttaatgtggaggttttccacttactggtgctttcttctctttctcat

SEQ ID NO: 18855 - DNA, 201 bp, Homo sapiens
tatgatcagttgatagttccatcaagcagatgcataagagtggtagtggcattgcttcttgctttccttacagtgacatcaggaacagacgtgggcgtttkctggggcttgaaccctaccactcactgtcctgctccctaattgctaggaaatgctcaatggtgcagtgggaaatagttggcaaaggcatcttttcccaga

SEQ ID NO: 18856 - DNA, 201 bp, Homo sapiens
aagtacattatatttattgctgcaatgctgcaatgtcattttagcccatatgatggtaacaggctattgccttccattactctaaatgtctgggaatagtrggatatgattttgactgatattcttctattttcacagatgatcaacctttcttaataactgtaaggcaacatataatttttggaatctcccttaatcctg

SEQ ID NO: 18857 - DNA, 201 bp, Homo sapiens
aaggcaacattagtgagtcttttctggagatggtcaatttctccttcatagatgcctccattttccttcatgaggtaaggggaagatgtggggagatggtkgtctgttctgggggtgattaatttctcctccatagatgccttcattctccttcttggagtaaggggaagatgtgggaagatggtggtctgttctgggggt

SEQ ID NO: 18858 - DNA, 201 bp, Homo sapiens
tccttacagtgacatcaggaacagacgtgggcgtttgctggggcttgaaccctaccactcactgtcctgctccctaattgctaggaaatgctcaatggtgmagtgggaaatagttggcaaaggcatcttttcccagacttccaaagtcttggtatactctttcacttatggtattcaaaatgctatttcacatcttagcct

SEQ ID NO: 18859 - DNA, 201 bp, Homo sapiens
ttagatgttgaatttgatgatgctgagcaatacatctattgggttgaaaatccagtaagttttgaataacattcaaagtatataatttattcttgaagagmctgcctgcactgatgttttcttataagcaaacttttgtcatgtgagtaaaagggaaacaatgtggaaataaatttatccctaagttttttgattcaatga

SEQ ID NO: 18860 - DNA, 201 bp, Homo sapiens
aatccaccttctgttttgttacatgctggtgtttttcatggttgtaggaagctgtactggtcagaccaaggaactgacagtggggttcctgccaagatcgscagtgctaacatggatggcacatctgtgaaaactctctttactgggaacctcgaacacctggagtgtgtcactcttgacatcgaagagcagaaactctac

SEQ ID NO: 18861 - DNA, 201 bp, Homo sapiens
cagacacatatcgccagaggcggtttgcttggtaacatggtcattgttattcctcagtaccacaacctcaatgtgacaatggaaaggtgctttcttgtacyttcagttctgactttgatgcctcctcccttttcagtgagctctgcccatctctgtgacaacttcacagaattcagctgcaaaacaaattaccgctgcatc

SEQ ID NO: 18862 - DNA, 201 bp, Homo sapiens
agttgataaggccactggggccaacaaaatagtcttgagagataatgttccaaatctgaggggtcttcaagtttatcacagacgcagtaagtatttgtcaytgaaatacattcatgggtgtataatgcatattcacacataactcacatttgtaagcacacacccacacacagtttcacgtacatacacgtgcatacaaat

SEQ ID NO: 18863 - DNA, 201 bp, Homo sapiens
tttgatgcctcctcccttttcagtgagctctgcccatctctgtgacaacttcacagaattcagctgcaaaacaaattaccgctgcatcccaaagtgggccrtgtgcaatggtgtagatgactgcagggacaacagtgatgagcaaggctgtggtaggaggggccacaggggagtggagggagggacaagaaagtgcacatg

SEQ ID NO: 18864 - DNA, 201 bp, Homo sapiens
tgttgtttttagattgctaactcagctactatatgttggttattaatttttagaataaattatttggtgacccaattaaagaaatttgagatggggtggcragtagctaggatcaaaagttacaaatggattttgttttcatttagatgccgccgaatcctcaaatggctgtagcaacaacatgaatgcctgtcagcagat

SEQ ID NO: 18865 - DNA, 201 bp, Homo sapiens
aaaagagggaatgttgaccatgaatgttgctggcattcctctctttgggagcttcaagagtgagctaatacaattctcagactgtctcacaaggaagccartactactttgtgcatttctctgccaatggtttatgaagtctttgcaatgactgctttgcagaggagaggacatgccatcctgtgggggatttccgctgta

SEQ ID NO: 18866 - DNA, 201 bp, Homo sapiens
acttggcatatcatcaaaatcacctgaggaacttaaaaaagtatagagattcttaaatcaaaactcacccttactaaagcaggggtatgaaaatctgtgtkttttaaaaattttattttattttactttcagttctgggatacatatgcagaatgtgcaggtttgttacataggtatacatgtgccatggtggtttgctgt

SEQ ID NO: 18867 - DNA, 201 bp, Homo sapiens
gaggagaagaaagtcttgagcttagtttccttccacgtgtagggaaggttcctctccaggaacctcagtgacttagctgatagaggaggcactgcatgagstattcagggggagcacagaaaagactggtacaaatacactttcagtgctttgatgctggctaacaggaagttttcattgctcagcgttcttggtaaaaac

SEQ ID NO: 18868 - DNA, 201 bp, Homo sapiens
tagaataaattatttggtgacccaattaaagaaatttgagatggggtggcgagtagctaggatcaaaagttacaaatggattttgttttcatttagatgcygccgaatcctcaaatggctgtagcaacaacatgaatgcctgtcagcagatttgcctgcctgtaccaggaggattgttttcctgcgcctgtgccactggat

SEQ ID NO: 18869 - DNA, 201 bp, Homo sapiens
tgttacaagctagctacaacaagaaggacaggactcttttaagtctgagggtgacatgaagtactaccctcattcctggccacctccttttttggccagcrtggcaggtcctgaacctctccctaaatatgccactgtttgtgtcttaattgtatgttttgttcttaccttggtcacctttgaagttccccccagaccctc

SEQ ID NO: 18870 - DNA, 201 bp, Homo sapiens
gaagaaagtcttgagcttagtttccttccacgtgtagggaaggttcctctccaggaacctcagtgacttagctgatagaggaggcactgcatgagctattyagggggagcacagaaaagactggtacaaatacactttcagtgctttgatgctggctaacaggaagttttcattgctcagcgttcttggtaaaaacttgga

SEQ ID NO: 18871 - DNA, 201 bp, Homo sapiens
atcaaaagttacaaatggattttgttttcatttagatgccgccgaatcctcaaatggctgtagcaacaacatgaatgcctgtcagcagatttgcctgcctrtaccaggaggattgttttcctgcgcctgtgccactggatttaaactcaatcctgataatcggtcctgctctccatataactctttcattgttgtttcaat

SEQ ID NO: 18872 - DNA, 201 bp, Homo sapiens
cagatgtcaccatgggtgctaagaaggggcatcctcagctcatcaccattccctggtactaccagcccttaattcctcgaggcccctggaggcccagtcarggtcctgatggagaaaaaggaaaattgctgtctctatcaaagcaagtggcttagcaacgctgtttctctcgatctgactccccccttttctccaccccag

SEQ ID NO: 18873 - DNA, 201 bp, Homo sapiens
cttcaaccttatatattttgttctgaatttgtaaagttctccctttttttcttcttggttctccattgatcagcatgcactttcatttttcccataggaamtctttatttcaccaatgcctttgtttctgaaacactgatagaagttctgcggatcaatactacttaccgccgtgttcttcttaaagtcacagtggacatg

SEQ ID NO: 18874 - DNA, 201 bp, Homo sapiens
ggaaggtggcttggttgccagattgctccccaaggcaacattagtgagtcttttctggagatggtcaatttctccttcatagatgcctccattttccttcrtgaggtaaggggaagatgtggggagatggtggtctgttctgggggtgattaatttctcctccatagatgccttcattctccttcttggagtaaggggaag

SEQ ID NO: 18875 - DNA, 201 bp, Homo sapiens
ctgagatatgcttgcacaatgagttttcatgtggcaatggagagtgtatccctcgtgcttatgtctgtgaccatgacaatgattgccaagacggcagtgaygaacatgcttgcagtacggtgatttctttatgctgggtcatgttgttgggagtgttttgttttgtttcggttttgttttgttttatccccccgctccccc

SEQ ID NO: 18876 - DNA, 201 bp, Homo sapiens
caagctaatctcttggtgcatgaaaggggtatatgtgtatgtacgtttgctgggggagaggaacgttttaaccattttcaccaaagaaagataaaattggwggtcaaatgaaattatgcaaaccatcagcaggtaagtaaaaatattagccctcatcattgtttggagtgatggatatgtacttctaggccacagaatcca

SEQ ID NO: 18877 - DNA, 201 bp, Homo sapiens
ggaagatggcagtagataacaacaagctaatctcttggtgcatgaaaggggtatatgtgtatgtacgtttgctgggggagaggaacgttttaaccattttmaccaaagaaagataaaattggtggtcaaatgaaattatgcaaaccatcagcaggtaagtaaaaatattagccctcatcattgtttggagtgatggatatg

SEQ ID NO: 18878 - DNA, 201 bp, Homo sapiens
tgagaagggccacttcccagagaaagtgggactgacatagaacctagatggatgtcttgggtactgataggcaaaggagccaggccggctgttcagaagcycaggcaatagcataaacgaagtcatggaggaaacaaaaatcattctgtgtaccttttgtgtgttttttccattccattccctacgttttgttttttttag

SEQ ID NO: 18879 - DNA, 201 bp, Homo sapiens
cttggtgcatacatacatagtacaaaatttctttccttgtgtactaatttatggctctaagagcagttgtatgatttagaactctatgtattttactgcamcctggtcaacacttgatatacatgtatatatttgtgtgtgtgtgtgtgtgtgtgtgtgtgtgtgtgtgtgtatataatcaattggtcaatgttagggaaa

SEQ ID NO: 18880 - DNA, 201 bp, Homo sapiens
agggacatagctcatagtccattcagaaactgaaatccaggacctctgggtaatgggcagtagccactcaatcagttccagatgtggttcctcttggttgrgagacccataaactaataaacaatcagtgccttctgtgcctgataggtattggcggaacaggggcaacacaatagaaataaacactcccattggaaagaa

SEQ ID NO: 18881 - DNA, 201 bp, Homo sapiens
aagtggtctgcagtttggaaaatgtgcctctgggatttcagtttgttctatagagttgtgcccatgactgcagatctctgctgacataattgtttacaagrccatgcaaacacatgcattgcttacatgtaaccctgcctgtttcttcctgtctcatttgagcatgatgctggcaaatccattaatttttcagtctttgtt

SEQ ID NO: 18882 - DNA, 201 bp, Homo sapiens
agagatcagatcattgacagagtaatcctaaacccaaagtaatttttatagctctttactgatttggtgttgggtcttaggaaaattagaaaacattgaarattggggaattccgatttctgaggaaaagcttaagagctggagattatttaatattagggagctaggtacttccatctctgtatgttgagtggggaaagt

SEQ ID NO: 18883 - DNA, 201 bp, Homo sapiens
cctgtggtaccaacaatggtggctgttctcatctctgcctcatcaagccaggaggaaaagggttcacttgcgagtgtccagatgacttccgcacccttcarctgagtggcagcacctactgcatgcccatgtgctccagcacccagttcctgtgcgctaacaatgaaaagtaaggctctctttcccctctcctcagtgcct

SEQ ID NO: 18884 - DNA, 201 bp, Homo sapiens
gaaaatactgtagtgagtatagacatttacctgggtagctttcagataaagatatttctgttttctagaacagacgttcaaatacagtgtatctgttggcrtttgcataacaaagcaccccaagacttagtggcataaactgagaaacgtgtcttatttctcacagttctgtgggttggctaggtagttcctctggcctgt

SEQ ID NO: 18885 - DNA, 201 bp, Homo sapiens
tcacagaaaacctggcaaatagggaattttaactctgagaaggtttggtgtggtgtacaaggcaaaagaatggttctgtcatgagcgagttgactagctayctggaacctatccattacttgatgagggcggtagtccttttctgttttcttttcaagtatttggcatcaggattggtgcagccatactggttattgaata

SEQ ID NO: 18886 - DNA, 201 bp, Homo sapiens
ctctctggccttgactaggcatggccttcagtggtgaagcctgctttcatgttggagacatgttttcttcataaagccacagtcagcaagttggatcacgrctcagcttggagccttgccctgaggagtagctcccaacacttctgtgaggttgctcagctaatctggtcctggcctccactctctccactctctcctcca

SEQ ID NO: 18887 - DNA, 201 bp, Homo sapiens
acttagaaatattagcatgtaggcagggcgcagtggctcatgcctgtaatcccagcactttaggaggctgaggcaggcggatcacctgaggtcaagagttygagaccagcctgaccaacatggtgaaaccccatctctactaaaaacacaaaaattaaccaggcatggtggcgtacgcctgtaatcccagctactcaggag

SEQ ID NO: 18888 - DNA, 201 bp, Homo sapiens
ataaacttataggctctgtcaaaaaaggaccatatctttttatttatttatttatttatttctttttttttctttttttttttttttttttttttatccckgcccgttctcaatgagctgttgggtacacctcccagacgaggtggtggctgggcagaggggctcctcacttcctagtaggggtggccgggcagaggcgcc

SEQ ID NO: 18889 - DNA, 201 bp, Homo sapiens
tgacagtgtaggggcttcaaattagtgtttataaggcttttagaggaaaattatttttgtatatgtgtaatatgtaaaccttagcataacacagtatcttytgctctgtattttctatgcattattcttaactcatagcagtctagattagtcataattgaggaaaatagcaaggaattttaaacatttaattttaatatc

SEQ ID NO: 18890 - DNA, 201 bp, Homo sapiens
agctttttccaagtgtctgagttgctagtttggtattaagggtgaggttataaaacctgacccaaaagtctgtacatgtggataggccttgtcagctggtragcttcaggcaggaaggtggcttggttgccagattgctccccaaggcaacattagtgagtcttttctggagatggtcaatttctccttcatagatgcctc

SEQ ID NO: 18891 - DNA, 201 bp, Homo sapiens
aatcagcagtgcattccctcgcgatggatctgtgaccattacaacgactgtggggacaactcagatgaacgggactgtggtaactgtcatttgagaagctyaccatagaattttgtactgtgacagtgtaggggcttcaaattagtgtttataaggcttttagaggaaaattatttttgtatatgtgtaatatgtaaacct

SEQ ID NO: 18892 - DNA, 201 bp, Homo sapiens
ttacatgatagcttcctgagaaacataagtaggtggcatatattttgagtctttgaatgtctgtgagtgttttattttgctctccatcttgactgtttggstgggtacaggttgcaagttaatttaaacctggaatttgaagacattgctctagtgacgtctaatatctagtgttgagtccagtgccattctgagtaccat

SEQ ID NO: 18893 - DNA, 201 bp, Homo sapiens
ggtttgctgtgagccagtcacagggtgtagataggaatgtgatggagtaaccactatactccaggtacctaatatctgtctgaaaatgacaaggccttctyggaatgacaatcttttctcttcagagatgaggacctgccatcctgaatattttcagtgtacaagtggacattgtgtacacagtgaactgaaatgcgatgg

SEQ ID NO: 18894 - DNA, 201 bp, Homo sapiens; identical to SEQ ID NO: 2042

SEQ ID NO: 18895 - DNA, 201 bp, Homo sapiens
tagggatttggtcatatttcatttaaaaattaaacatttatatccaaaatatataaatatttaaaatgacacatgtataaatatatattatccatttgtakaaatattccaatttgcaatttatctataaatcatctcagtgtaaatgagaacaagttttgttatttttctctacatttcaagacatttatttgaataatc

SEQ ID NO: 18896 - DNA, 201 bp, Homo sapiens; identical to SEQ ID NO: 2043

SEQ ID NO: 18897 - DNA, 201 bp, Homo sapiens; identical to SEQ ID NO: 2045

SEQ ID NO: 18898 - DNA, 201 bp, Homo sapiens
gtcctgctggtgtttgcaaagttaaccctgcaggcctgtaagttgtgttcccctcaggttatactgagaatgcaactatctcctagaataacgtcccctcyggaatgttaatgagaaggtagaattccagtataatattgctatcttctgatttcttccaatggtgttggaagaaacaagaatggtgttcaccccaggata

SEQ ID NO: 18899 - DNA, 201 bp, Homo sapiens
tgatgactgtggcgatggttcagatgaagaacttcacctgtgctgtaagagggagagaaacggagtgaatgggagtggtgttgtctgtcaaatctcattgkttcttacgtgtagcatgtgagcctggagagcagttgtacaattgtttaggaatggacacaggatcagcgttggtgttatttcactgggtcttccagcttc

SEQ ID NO: 18900 - DNA, 201 bp, Homo sapiens; identical to SEQ ID NO: 2047

SEQ ID NO: 18901 - DNA, 201 bp, Homo sapiens
ctcctctctcgtgtctcttatgaattctaagttgaaagcctgatgctagggaagttgaaagtgtgagtagttcagtgaaaacaaaacaaaagaaaacaacrgaggtaacaacgtacttaagcccccctgtactggggcctctggaaggacactaagagcatgactctgttttgattttaatgtggaggttttccacttact

SEQ ID NO: 18902 - DNA, 201 bp, Homo sapiens
ttgacagtaggcaaatatctttagagtttatcccccttcccctgggaaagactacctagaactcttcatcttcttaaaactcgctcaattcttcaagatcrtctttttttttttcctttgtttttgataagatttaacagttatcatgttgccatatttacttcatctatttctatgggaagactgaagtattttaaagga

SEQ ID NO: 18903 - DNA, 201 bp, Homo sapiens
ctggaactgtgcctgtagttctactcttacttttttttttgagatggaaattcgctcttgttgcccaggctgaagtgcgatggcgtgatctcggctcaccrcaacctctgcctcctgggttcaagcaattcccctgtctcagcctcctgaggagctggtattacaggcgtgcaccaccacacctggctaattttgtatttt

SEQ ID NO: 18904 - DNA, 201 bp, Homo sapiens
actcatgaggctgaggtaggaggatcccttaagcccaggagatgcaggttgcagggactgagaacatgcatggcactccagcctgagtaacagagtgagaycctttctcaaaaaaaacaaaacaaacaaaacaaaaaaaacaaccaatactagtcattcccagcatgggctgggcgtgaaaactggagaatggctaacatg

SEQ ID NO: 18905 - DNA, 201 bp, Homo sapiens
aattgcgactgaacatgtgctgtgtcctttgattcctcaggtgtctgcagaatgatgtgtgttgtatggggtgatgtcactgtgtgccttggttgtaatayagtttctgtatatggaactaatgttatctgtgcatgtaattgaacaatctgtaacctcatattttctctcacctgggtacagttagacttctctgacaag

SEQ ID NO: 18906 - DNA, 201 bp, Homo sapiens
aaaattagccaggaaaggtggtgttcgtctgtagtcccagctactcatgaggctgaggtaggaggatcccttaagcccaggagatgcaggttgcagggacygagaacatgcatggcactccagcctgagtaacagagtgagaccctttctcaaaaaaaacaaaacaaacaaaacaaaaaaaacaaccaatactagtcattc

SEQ ID NO: 18907 - DNA, 201 bp, Homo sapiens
agaccagcctgggcaacatggcgaaatctgtctctaaggaaaatgaaaaaaattagccaggaaaggtggtgttcgtctgtagtcccagctactcatgaggytgaggtaggaggatcccttaagcccaggagatgcaggttgcagggactgagaacatgcatggcactccagcctgagtaacagagtgagaccctttctcaa

SEQ ID NO: 18908 - DNA, 201 bp, Homo sapiens
gttcaagaccagcctgggcaacatggcgaaatctgtctctaaggaaaatgaaaaaaattagccaggaaaggtggtgttcgtctgtagtcccagctactcaygaggctgaggtaggaggatcccttaagcccaggagatgcaggttgcagggactgagaacatgcatggcactccagcctgagtaacagagtgagacccttt

SEQ ID NO: 18909 - DNA, 201 bp, Homo sapiens
aagaggaattgcaagggaagagagttcactgttgctggccattcacttaactggagatgatatgaagggacgattcatgcattcattggtgcattcagtcrttacttcctgagtccctcctacatgcccagcgtgatgacaagcagcaggggttttgaggggaacaaggcagacatggcccttgctctcctgaagtacata

SEQ ID NO: 18910 - DNA, 201 bp, Homo sapiens
ttacaggaccagccagagggacatgtagtgttgtgttgcacctagtgttgagctcatgccatctcgtgagaggcaaatgtgtgtatctctttgtggttccrtgttcagtgatgtcacactggaagcctgagcttgaccatggtgtgaacagtcacactggaacatgctacaaatcagagcatttagaaaatttttcctgag

SEQ ID NO: 18911 - DNA, 201 bp, Homo sapiens
aaactgttggtcgctggtactagtcttattggaggactaccctagatgtatataattaaataatgctctgtttcaggttttctagacaacccatgctacarccagcttgtctccagattcctggactgtaaaccactttttttcactgagaatgctattgatcttttcaggtcactctgagcgaacatgcctagctgatga

SEQ ID NO: 18912 - DNA, 201 bp, Homo sapiens
tgtgctgcctggaacacatggcttccaaggttgctgcagcagcacaggagacacggaggaggcacgtgtgcttttcattgcttcagcccagtagtgacacrtggcacctccaactgacagtacgttggctagaactggtcacatggtcctaacccagctgcaagggagactgggaaatgtagggaagcacttgtttatttg

SEQ ID NO: 18913 - DNA, 201 bp, Homo sapiens
taatagctgtagagtgtcaggcttcatagttgtgcagtccagaattggatgctctgaggataagcctaggagtgctgcatataatgtgaaaattgcctcamagttttagcattatatgcatttatctaaatggtattcagatcacgatcagaaataggaatcctgactcccccagtgccctctgtcctctccaaggcttat

SEQ ID NO: 18914 - DNA, 201 bp, Homo sapiens
tagtgacacatggcacctccaactgacagtacgttggctagaactggtcacatggtcctaacccagctgcaagggagactgggaaatgtagggaagcactygtttatttggtaagcacaaactgtctctgtcaaagaaggaagtatcttgcttcataaaagaaaaagttttgattttaacttgtttttacattgcaggtag

SEQ ID NO: 18915 - DNA, 201 bp, Homo sapiens
ttctctgtgtttttaagttgctttggttcatgagtttgttgtgatgctgttgctgagcttatttgacagtgaactctgactggcgtccacagactctagtrtaagggttgtttactatttgccttcaaataaattgagcaggagtttacatgatacactcttctggaacaagcattgcttgctagtataatggggaggatg

SEQ ID NO: 18916 - DNA, 201 bp, Homo sapiens
tgccagcagggctatttcaagtgccagagtgagggacaatgcatccccaactcctgggtgtgtgaccaagatcaagactgtgatgatggctcagatgaacrtcaagattgctgtaagtgtttggagaggaatcttgctttggctttgtggacacctaaaacccaacctgtcgcaaagaagttacacacaatgggatgattc

SEQ ID NO: 18917 - DNA, 201 bp, Homo sapiens
tgtccattcagtatgatattggctgtgggtttgtcataaatagctgttattattttgagatacatcccatcaatacctagtttattgatttagcatgaagkgctgttgaattttgtcaaaggccttttctgcatctattgagataatcatgtggtttttgtctttggttctgtttatatgctggattacgtttattgattt

SEQ ID NO: 18918 - DNA, 201 bp, Homo sapiens
ctccaggtgctgcttgtcctgcaagtagacacaatggggtcaacacacatggatgactgagtgtttctaatgcatatgagactctaatgtctttgtgtgtrcttgtgtgtgtgtctgcctgtatgtgtccaggtatagggactgctgatggcattgcctttgactggattactagaagaatttattacagtgactacctca

SEQ ID NO: 18919 - DNA, 201 bp, Homo sapiens
atatgtatatacctgatctctactttctgaaaatttacacatttagaatgggaggttatttagttcctagcatgtaacttgtgacttataaacccacttarcaattacatactgcttcaatctgaatttgggccatagctaaataagggtgagttgccattttgtaccaaattgaggttaaggtgcaagatgccaggtgtc

SEQ ID NO: 18920 - DNA, 201 bp, Homo sapiens; identical to SEQ ID NO: 2016

SEQ ID NO: 18921 - DNA, 201 bp, Homo sapiens
gaagcacttgtttatttggtaagcacaaactgtctctgtcaaagaaggaagtatcttgcttcataaaagaaaaagttttgattttaacttgtttttacatkgcaggtagaaaaccgacccctaaaccttgtacagaatatgaatataagtgtggcaatgggcattgcattccacatgacaatgtgtgtgatgatgccgatg

SEQ ID NO: 18922 - DNA, 201 bp, Homo sapiens
ctggactgacttgtacacacaaagaatttaccgagctaacaaatatgacgggtcaggtcagattgcaatgaccacaaatttgctctcccagcccaggggartcaacactgttgtgaagaaccagaaacaacagtgtaacaatccttgtgaacagtttaatgggggctgcagccatatctgtgcaccaggtaaggcactgac

SEQ ID NO: 18923 - DNA, 201 bp, Homo sapiens
ttcaaatttttttattttatttttagaaattcctttcttctgttatatttattttgctgccaaagtcagtgtagtaaagtttgaagttctctaacaccatrctccctggggacatgccactgaaaaagaaggaatacctggcacacacgccagtgctctttcttcctgtgctcatggcaggcataattaatcaatccaagt

SEQ ID NO: 18924 - DNA, 201 bp, Homo sapiens
gccactgcacctggcccgatttctcttttttcttttgtacaaaaaatgtcatgctccctaacttactgtccatgtttgaggttcccaaagaagctgagggrcaatatgcaactcgtaccacctgctgcttcataactgtggatctttttccagaatctctcctcaggtttctaagaccagaacccaagtctccccattccc

SEQ ID NO: 18925 - DNA, 201 bp, Homo sapiens
gcattacatttgtttctctatagggaaattaaaatcatgattatgctatattagcaaattgcttataaaacaaattacaatttttgattgtaggataagawgtactcttgtagccccctccctccctccctccctcccttccttccttccttcgttccttccttccttccttttcttccttccctccttccttccttgtag

SEQ ID NO: 18926 - DNA, 201 bp, Homo sapiens
gggaagttccaaattcttcacctaagaagtaaacattctcaacgtttgtgtacagcttcattttttatgtccattgtctctttctccctcttttttttttyttttttctttctttcttttttttttctttctgagacagggtcttgctctgatgcccagactgtagtgcaatggcgtaatcatagctcactgtagcctcca

SEQ ID NO: 18927 - DNA, 201 bp, Homo sapiens
ggaagttccaaattcttcacctaagaagtaaacattctcaacgtttgtgtacagcttcattttttatgtccattgtctctttctccctcttttttttttcytttttctttctttcttttttttttctttctgagacagggtcttgctctgatgcccagactgtagtgcaatggcgtaatcatagctcactgtagcctccac

SEQ ID NO: 18928 - DNA, 201 bp, Homo sapiens
aagggctcatatacttggtcttgccctctagatgctgcgttccttgaggataaagcctctacctggtctgtagatgtatgcttattgcctgtggcacttcrtggtacatggtggcactcagtaaatgttgagtgaatgacaagctctccaatatccatttttgttacttccccagtcctctgatttttacccgtttgctcc

SEQ ID NO: 18929 - DNA, 201 bp, Homo sapiens
ggcaaccaatcagtaaattgtctagtatgttgaaaggtggtgctaagtgttatggaaagaaggaaagggagcaaggaagcgggcatggggagtgcaggcgrggggagactttgcacaaaacaaaatggttttggatgaaaagtagattttaaaatagaaacatgtgaaatagtaggtaattcatatctttcctgggaaaag

SEQ ID NO: 18930 - DNA, 201 bp, Homo sapiens
  misc_feature (1)...(201): n = A,T,C or G, or insertion/deletion polymorphism (see Tables 1-2)
tgttaagactgatgggaacatgcttgtgttttgctcatgggttttatcttctttccctcctgcagccactcacacgtgcagcagcagtgagttccaatgcncatctgggcgctgtattcctcaacattggtattgtgatcaagaaacagattgttttgatgcctctgatgaacctgcctcttgtggtaagagagtaagcaa

SEQ ID NO: 18931 - DNA, 201 bp, Homo sapiens
tacacaagcatccattttccaggctcagtcttccttttttggtaactattatctagctcagagatagaggcagattgttaagactgatgggaacatgcttrtgttttgctcatgggttttatcttctttccctcctgcagccactcacacgtgcagcagcagtgagttccaatgcgcatctgggcgctgtattcctcaaca

SEQ ID NO: 18932 - DNA, 201 bp, Homo sapiens
aaacggccttatagaccagaagaattacaagactttaattagatgtgcacccacataacaatttggaaaatgcatataaccagagctacctaaaattactsgagaaaagagtcaatgttcaaacataggcagagtttcccacttactcaactaaaagtctggtattccaaggatgaatacgaagataactttgccaacttt

SEQ ID NO: 18933 - DNA, 201 bp, Homo sapiens
agagtgggggtcacaaggtgctcagtgggggggagtttttgagccagatgagccaggaaaaggaatttcacaaggtaatgtcatcagttaaggcaaggacmggccattttcacttcttttgtggtggaatgtcatcagttaaggcaggaacaggccattttcacttcttttgtgattcttcagttacttcaggccatctgg

SEQ ID NO: 18934 - DNA, 201 bp, Homo sapiens
gccgcccttccagtggtttgagttccacaatagatgtgttagcacggatactgttcataatacatatttggtggatatattcctaatatttatctggttgyctttttcaagctgatcgcacttgccagtctggatacacaaaatgtcataattcaaatatttgtattcctcgcgtttatttgtgtgacggagacaatgact

SEQ ID NO: 18935 - DNA, 201 bp, Homo sapiens
aaaaaatttttgggggggtggcatggagagataatgcgcagtgtttctcagggctgctcaagtgggattaggggcggtgtgggaacctagagtgggagagmttaagctgaaggaagattttgtggtaaggggtgatattgtggggttgttagaagaaacatttgtcgtgtagaattattggtgatggcctggatacggttt

SEQ ID NO: 18936 - DNA, 201 bp, Homo sapiens
gaaaagacaacatatagtgacccagacttcaaccttatatattttgttctgaatttgtaaagttctccctttttttcttcttggttctccattgatcagcrtgcactttcatttttcccataggaaatctttatttcaccaatgcctttgtttctgaaacactgatagaagttctgcggatcaatactacttaccgccgtg

SEQ ID NO: 18937 - DNA, 201 bp, Homo sapiens
gccaaccctggattaaaggattggaaatgagcaaatgcatacatagcaagtagagttaggtaatgaaaaaatgtatcagtaacatatttcacattggcctsatttctctagaggtggtttgaatcagatataggaacaaaatatgtgtgtcttggtagtagcattgatagttcaacaacagactttcaactacatgaaatc

SEQ ID NO: 18938 - DNA, 201 bp, Homo sapiens
agcactttaggaggctgaggcaggcggatcacctgaggtcaagagttcgagaccagcctgaccaacatggtgaaaccccatctctactaaaaacacaaaarttaaccaggcatggtggcgtacgcctgtaatcccagctactcaggagcctgaggcaggagaatctcttgaagccgggaggtggaggttgcagtgggccga

SEQ ID NO: 18939 - DNA, 201 bp, Homo sapiens
tggtctaagaaccatttgccttgtgtgggaagagattgataggtggaagtttcagcgggggactaggtgggagtgactaatgtgaaggagaaaaactgacygtgagggacagaagttggaacgctagctgcttttttagctaatttatcagcataagcattgtcctgagcgatgggatctgatgcctttttgatggccctt

SEQ ID NO: 18940 - DNA, 201 bp, Homo sapiens
ccagctacttgggaggctgaggtgagatgatcgcttgagcccaggaggtcgaggctacagtgagctgtgatcatgccactgcactccagcctcagcgacakagtgagaccctgtctcaaagaaaataaatacatagttgaaaagatacagataattaggttgatccatttgagattgattttttttcctatgcagaaatag

SEQ ID NO: 18941 - DNA, 201 bp, Homo sapiens
tagaaggtatactactatttaatatggtaatgaaatagtccacaaatatgatttattaatatatatttggtgaattgaagcaaaagagttcacagtgtcastccctctttagtaatcatatttttgcagcactttgtgcttacatactgtgaatgtatgaaacgatcacttgcttcctagatgagccaaggtttttaggta

SEQ ID NO: 18942 - DNA, 201 bp, Homo sapiens
tagtccctttgcaagagtgagggtttgacttaaggcaatgagttcggcttgctgagaggtagtggagcggggcagagcggtagcctcaatgatagatgtgsaagatactatagcatagcctgcctttgctggtgagtggcgattaggcctggtggaactgctatcagtaaaccaagtgtgttcagggtgaggaacaggaaa

SEQ ID NO: 18943 - DNA, 201 bp, Homo sapiens
attagtgtttaaatgttcaaaattttcactatgaatccatgaaactaatgaaaattccaatcctttagattgaaagaggaaacgtggatggaacagatcgratgatcctggtacaccagctttcccacccctggggaattgcagtccatgattctttcctttattatactgatgaacagtatgaggtcattgaaagagttg

SEQ ID NO: 18944 - DNA, 201 bp, Homo sapiens
gaatctatgcaatcacacttaggccctgtgaatgtcttggctcccaagcaccttttacccattggttttggcagccatggatgatccttgtttgaaatgaytatttaatcgaggattgcaaaatggtgattttcttattttagcattccctttacatttgttagataatattcttctataaaggaaagctcttcgtgtctc

SEQ ID NO: 18945 - DNA, 201 bp, Homo sapiens
tttgtaatgctgggattttgtttttcagataaaggaaaagaaagaacatgtgctgaaaatatatgcgagcaaaattgtacccaattaaatgaaggaggatytatctgctcctgtacagctgggttcgaaaccaatgtttttgacagaacctcctgtctaggtagagtatattttttccaattcctgtttaggtgaacttta

SEQ ID NO: 18946 - DNA, 201 bp, Homo sapiens
gggagggctctaggtttggtgctatcaaacgtgcctacatccccaactttgaatccggccgcaataatcttgtgcaggaagttgacctgaaactgaaataygtaatgcagccagatggaatagcagtggactgggttggaaggtaaatttgccatacattccccccttacctgttctgttttcctggttagagttctctac

SEQ ID NO: 18947 - DNA, 201 bp, Homo sapiens
tcctgcgtgattcaggtgctttggctgttgggcaggagtcccctcaattccttactcttccaagtgtaacctgccaaacatgtccccttggctgtagttcycccaagagagggggactatggtctgatgataggtatctgagcagctgtctcaccagccaaacgaaatgctctcatcttcaaacctcttacccagtaatga

SEQ ID NO: 18948 - DNA, 201 bp, Homo sapiens
ttggatcctaaagttttcttatttggagcagagctttgtgatagacaggaaagttctggaaaatgagctgagcgatcagactacaggatcccttaagtcckgtgcagtatttcatttttctgtgaatcttaggctcctactccttttccaatttacttcactccaatgtttatgttcctaagagtttgtctgttttccaag

SEQ ID NO: 18949 - DNA, 201 bp, Homo sapiens
tgaccgaatctactggagtgacttcaaggaggacgttattgaaaccataaaatatgatgggactgataggagagtcattgcaaaggaaggttagaaattarttagaaagtaatatattaaattaataattaacatatttctaatgtctttgcctgttttctcaagaaggagccctgctcttaggaaatggcttatatagtt

SEQ ID NO: 18950 - DNA, 201 bp, Homo sapiens
ttcctaagagtttgtctgttttccaagcactagtcctttgctataaggatggggtagagagaaagaagcttaaagagtttgcagacaggttaagatgcttytgtggagacagaacacatcttggtgcacatctgagtgtccttagcacttcatctatggacttctttcataaatggtagaacacgtatccatcacacctta

SEQ ID NO: 18951 - DNA, 201 bp, Homo sapiens
aaactcgagtctgcctggatgaatggagaggaccgcaacatcctggttttcgaggaccttggttggccaactggcctttctatcgattatttgaacaatgrccgaatctactggagtgacttcaaggaggacgttattgaaaccataaaatatgatgggactgataggagagtcattgcaaaggaaggttagaaattagtt

SEQ ID NO: 18952 - DNA, 201 bp, Homo sapiens
caaggtgattctgagggctggaccaatttttgggaacgtgtgatctaggtaccctctcatttttcagttttgtaaacagacttagaggtgaactgacttamcactgcaaatttcttcagtggcagttaaatatactctgttaaatctctttcttttggatgggaatgttacaagctagctacaacaagaaggacaggactc

SEQ ID NO: 18953 - DNA, 201 bp, Homo sapiens
aatgctcaataataattattgatgaagcattgctttgggtgctgaactgaatatatgctagtcccttccttgctatttaacagtagttacttcagatcctkgacattgatgcttttcataatattgtgcagtaggtttggctttcagttcattgtttgttcaacaagtactaacttcactccgaatatggacctataatgg

SEQ ID NO: 18954 - DNA, 201 bp, Homo sapiens
taagttctcttatttaaagtcactgaagaaaaaaatgaacaaccaagtgagagctgagtttctttacttcccggagaacactgctgttgtagagatggagragacatttcctatgtgctggatgtgcttaaaggtctcttggtcccaaagtatctctcactacggccaaagatctctgctctgtcattactaaagtcagtt

SEQ ID NO: 18955 - DNA, 201 bp, Homo sapiens
ctcagcttggagccttgccctgaggagtagctcccaacacttctgtgaggttgctcagctaatctggtcctggcctccactctctccactctctcctccargctcatgtttcttatattctaaattctagaactttgatcagtttcatcagcataaccactcttgtaactgctgggctcccttttcagccatggcagtaaa

SEQ ID NO: 18956 - DNA, 201 bp, Homo sapiens
aatgactaaatcagtaaattgtactcttaagattaaaggctattttctgatttatttttttgatgacaaattagagtgtttccttctcatctcagtcactscctgccactcttgctcttaatcataagccagttttagtttgagaggagcacaccagggaaacttttaatatatggttttaaggaaaagtcaggcttaagg

SEQ ID NO: 18957 - DNA, 201 bp, Homo sapiens
tttgtgtgtcagttagtagagattttattgtatatattttctggtatagtttattactgaagccgtacttctttttagcattaaaattctaaaattttatrtttataatagtgacaaaggtttttactgtaattactaatgatatttaaaacacagattaggcaaaatcttaggaaatataccctgctttttttccttcca

SEQ ID NO: 18958 - DNA, 201 bp, Homo sapiens
attaatatgagtttttaaacttctctatggtaacaaaagccatagtaatagcagtgagtaccaatgacctgatatatttaaataaaaataagcacataatmtatatatgaatatatcctcattgtagtaaagtaataatattcagaaatatattttaaagaaataatacgatgtacaaaaaagtaaaatttacattttttc

SEQ ID NO: 18959 - DNA, 201 bp, Homo sapiens
tctcataaggaatgcacaacctagatccctctcatgtgcagtttacaacagggtttgtgctcctatgggaatctaatgcagccactcatctgacaggaggyggagctcaggcactaatgctcactcacccgcctctcacctgctgctgtgtagcctggttcctagcaggccacggaccagtaccagtttgtagcccaggga

SEQ ID NO: 18960 - DNA, 201 bp, Homo sapiens
tttcttctgttatatttattttgctgccaaagtcagtgtagtaaagtttgaagttctctaacaccatgctccctggggacatgccactgaaaaagaaggartacctggcacacacgccagtgctctttcttcctgtgctcatggcaggcataattaatcaatccaagtactttctcttgttgaactggttcatttgctaca

SEQ ID NO: 18961 - DNA, 201 bp, Homo sapiens
ttctatttttaaaaaaatttagagatgggggtctcactatgttgcccaggctggattcaaactcctaggctcaagtaaccctcctgcctcagcctcctgartagctgggactaaggtgtgtgccactgtgcctagctctgtttttctttaaagttactgtgtaataaaaaaagaatttgcaaatgcataaaattgaatata

SEQ ID NO: 18962 - DNA, 201 bp, Homo sapiens
gagaagttttttttggctcaagtgatcctcctacctcagccttccaaatagctacgactacagctacttggaagtgagccactgtgcccagctaaatttawtttttttttcttttaagatataaggatctcactatgttgcccaggctagtcttgaattcttggcctcaagtgatcttcttgcctcaatctcccatagctg

SEQ ID NO: 18963 - DNA, 201 bp, Homo sapiens
tcctattttctgtgtcagttttcaaaattctttgcatttttcatcacagaaatcaggttaggtaattaagtagccggtcttgtggtagatggtgatttggrgaataattaaatgaggcctggtaagtgatcagggagtgtacttggcagctttttatattagctttggccttcactatgtactgaagatggagggattatt

SEQ ID NO: 18964 - DNA, 201 bp, Homo sapiens
tgtccaggtgtagaagaactggagggttgggagctcaggcagggcttaagggcaaagaacaagtttaataggaaaagttaaagcaaggaagaaatgagagkttttggtcgaagcagagcatttcagagtttgagaacttagaggcggagaagtttagagttgaagatgaaattcaaaggacgggtatattgatttggtggt

SEQ ID NO: 18965 - DNA, 201 bp, Homo sapiens
agaaacccagggttggagattagcttagacacaatgggaacccaaaagaataaataagaatattgttgaaatggttacatatgatgtccaggtgtagaagractggagggttgggagctcaggcagggcttaagggcaaagaacaagtttaataggaaaagttaaagcaaggaagaaatgagaggttttggtcgaagcaga

SEQ ID NO: 18966 - DNA, 201 bp, Homo sapiens
catctgatattattatcatactctgatatccctccactgtttttttcatagaaattcttttttttttttaatttttttggagatggagtgttgctctgttkcccaggctggagtgcagtggcatgatctcagctcactgcaacctctgtctccaagattcaagtgattctcctgcctcagcctcctggcagctgggattat

SEQ ID NO: 18967 - DNA, 201 bp, Homo sapiens
attttttttaaaaaatttcaacttttattttagttatagggggcacatgtgcaggtttgttacatgggtatattgtacccagatagtgagcatagtacccratagttagtttttcaacccatgccctcctcccttcctcccctctctagtagtccacagtgtctgttgttcccatgtgtatgtccatgtgtgctcaatgtt

SEQ ID NO: 18968 - DNA, 201 bp, Homo sapiens
ctcattttctattgagctaatttcctcatttccctgaagtgcaatatagattatctgaatctcatgcaaatcctctctcatccatccctaatcgtgctttrgaatttgttttgtacataagttctccttcatctcagtttcctttggttccccttatgaaagtcagttctaataagtgattttatgctataggttttgaca

SEQ ID NO: 18969 - DNA, 201 bp, Homo sapiens
tttctctttccaaggtgctgaatttctttctttctttctttctctttctttctttctttctttctttctttctttctttctttctttctttctttctttcyttctttctttctttccttctttctttcttctttctgaatttcttttttaataaatctggttttatataactttttattgaaagcttcttcaaattacttt

SEQ ID NO: 18970 - DNA, 201 bp, Homo sapiens
ttaaatcaaaataaaatttgacctaaattgatgctgagaagagtctatatcaaggcttctgtacaccttctcaaattcccttatttcttcttctcatgtcacacacacacacacacacacacacacacacactcatacactcacagacatacataaatattgtctagaaaggaattttcagtttcagatttttcaagggac

SEQ ID NO: 18971 - DNA, 201 bp, Homo sapiens
gtggtacagaaattggctggagggcccagagagggactatcccactgcagtgtggtggcagagatgatagtgtaaatgagggtgagtggccagctgacacrtggacgagaggtattgagaggatgcctaggctctgctgtcacctggcagagccacttccagttgctgggtattcaggttattcattctgtcaggacctaa

SEQ ID NO: 18972 - DNA, 201 bp, Homo sapiens
ttacatttacattggtagggggcagttctaagatactagctacactgaaattagaaacaacttttttctccaatattaataaatatttctgctgtcagcaytagggtgtttggtttccaaagcccttgcatttgatatagctttttaaaccaccattacgcacattggaagatactgttggctctcagttatcttaatttt

SEQ ID NO: 18973 - DNA, 201 bp, Homo sapiens
acagaaattggctggagggcccagagagggactatcccactgcagtgtggtggcagagatgatagtgtaaatgagggtgagtggccagctgacacgtggaygagaggtattgagaggatgcctaggctctgctgtcacctggcagagccacttccagttgctgggtattcaggttattcattctgtcaggacctaactgct

SEQ ID NO: 18974 - DNA, 201 bp, Homo sapiens
ggcactctgctgagtacagctgactaacacctgcatggctttcccttcctgcagccatcgaactgcctatcaacctgccccccccatgcaggtgcatgcayggaggaaattgctattttgatgagactgacctccccaaatgcaagtaagtctgaatgttgaggtcccagctataggccttgcctcttctggggaaatttg

SEQ ID NO: 18975 - DNA, 201 bp, Homo sapiens
aacttatattccttttatgcaattaaagcaactttatgatttagagtctgaaataaagataaaggtctgaaatatattttggggatagactggtttttgtrggtctgctttgttgtgatgtcttgctaaaacatatgataaacttggaattaaggaaaaatgagaattagcaaaataaagaaatttagtatttctttctgg

SEQ ID NO: 18976 - DNA, 201 bp, Homo sapiens
cccccaaactaaaaacaacacatcaataacagtaacaaacacaaagtttgaagactattttccagtaggagaatagggacagaggaaggtatgcttaacakgtcagggtgttcagttcttatctcttaagtctgtatgcaataaagagatatttaagaatttgggagacagtaatagtcaaaagaagaagtgctccatgta

SEQ ID NO: 18977 - DNA, 201 bp, Homo sapiens
atcaacctgccccccccatgcaggtgcatgcacggaggaaattgctattttgatgagactgacctccccaaatgcaagtaagtctgaatgttgaggtcccrgctataggccttgcctcttctggggaaatttgagaccttaaagtagccaggaaaacaaatacaggaacctcaccagttcactaattcttacattttaacc

SEQ ID NO: 18978 - DNA, 201 bp, Homo sapiens
caaaaggcatctctccaggaacaagtaagttttaagaatgtgagcaacttggaaattactcatggcccctacattgaatgctgtcacagcttttctacttmacccagtctttgaaggagtggttctagcccccagtttctgccaggattgcgggctcccatgtgttgatgtgctctctgctatcttcttctatagccgcag

SEQ ID NO: 18979 - DNA, 201 bp, Homo sapiens
atacactttcccatagcaaatagcatacctgactctctgtgctaatattgcacatttgttaaacaatgaatgaatggatggatggatggatggatgaatgratgaaacatatactactgattattttattccagagttctcaaaatatttgttgctgatattttgagtgctgactgtaattactttgattagataaacaac

SEQ ID NO: 18980 - DNA, 201 bp, Homo sapiens
agaaatccttgtggaaaaaacgattacacatattcatcaactatatgctgactgaatgactttgaaacttttttattcaaaatgttggagaactgacatcrtctttgttttatggaagtgttaggttatgctttatgaagaacagcaagacataattttttttcgtcaacctttccaaataatttcatgctactagtgaag

SEQ ID NO: 18981 - DNA, 201 bp, Homo sapiens
tggctttctatagctgaggcagaccccaaaggagctgattgcaggaagaaagtccttcctcatagctggtccttcctataaggggaagctgcatggcacawctctgggtgtaccactgcttcccatctcatgaagagtcaaagtccaagtccttactatgatctacaagaccctaaccatttggccttcacatcacctccc

SEQ ID NO: 18982 - DNA, 201 bp, Homo sapiens
attttattcattcatttaatgagcactaggaaatgctttctatggatcagttgatcctggatatcctaagatgaataaacattttttttctgtctttaagwagctcacatatctgtgagatggatacataaacaaatacctgtgctccagtgtcataagtgtgataaggccggtgaatataaagtgctagtgattggaggc

SEQ ID NO: 18983 - DNA, 201 bp, Homo sapiens
tgaataaacattttttttctgtctttaagtagctcacatatctgtgagatggatacataaacaaatacctgtgctccagtgtcataagtgtgataaggccrgtgaatataaagtgctagtgattggaggcagaggtataagtgaggggagagagcatgcagatttcccattcatggttacttgtgagctgagtcttgaaag

SEQ ID NO: 18984 - DNA, 201 bp, Homo sapiens
ctaagacccttactaccaaactcacatctctctaaagtccacccagtgcaaagctgtcttaattccaaatggcaattaatatgctcttattttatctcttkgtctcttgattagtaaatggggttctcttcttttaaactgatagttttccaaaagcagggaacgtgtctttcccattagtgttaggtacaatgcagtagt

SEQ ID NO: 18985 - DNA, 201 bp, Homo sapiens
taaatcaaaataaaatttgacctaaattgatgctgagaagagtctatatcaaggcttctgtacaccttctcaaattcccttatttcttcttctcatgtcacacacacacacacacacacacacacacacactcatacactcacagacatacataaatattgtctagaaaggaattttcagtttcagatttttcaagggact

SEQ ID NO: 18986 - DNA, 201 bp, Homo sapiens
gagccaccacgcctggctggcaaaaataaattatttgagctttctattgctctattttgtttcctcctaattatcaatactaccttgttgctataaaagtrttttaggtaatttacaaaataatatataagaagataaataaaagttgcataaggaattcaacataaagggaagattatggtaagcagagaattttactat

SEQ ID NO: 18987 - DNA, 201 bp, Homo sapiens
aaatcaaaataaaatttgacctaaattgatgctgagaagagtctatatcaaggcttctgtacaccttctcaaattcccttatttcttcttctcatgtcacacacacacacacacacacacacacacacactcatacactcacagacatacataaatattgtctagaaaggaattttcagtttcagatttttcaagggacta

SEQ ID NO: 18988 - DNA, 201 bp, Homo sapiens
aatcaaaataaaatttgacctaaattgatgctgagaagagtctatatcaaggcttctgtacaccttctcaaattcccttatttcttcttctcatgtcacamacacacacacacacacacacacacacactcatacactcacagacatacataaatattgtctagaaaggaattttcagtttcagatttttcaagggactaa

SEQ ID NO: 18989 - DNA, 201 bp, Homo sapiens
ccagtggtgctgaacctttgtttgcctttcctctgagtgtaaggactgttcaagaaatacagcagctggcagtagccacagtgaagaaagggttcttttgyaggagccatggccttggaactgctcacctccccttgtctttctttccagggtgaaattcacagagtgaagacagatggcaccaacaggacagtatttgct

SEQ ID NO: 18990 - DNA, 201 bp, Homo sapiens
gaatacatgccaagaagcagcagtcacaatgcttgcccctagaggagtcttaagctagtagaaaatattcgacgaatataaaaatgatcaaaactcaagayaaaagtagtagctccctaagggaatttagtgaaagcatttgatgtggtgctggggccttcctttagaatcctttagaatatttgcctctagggtaagaat

SEQ ID NO: 18991 - DNA, 201 bp, Homo sapiens
taatcaattaagcatggagaagggtgttaattatggttttataattattatatcttatcacatgataatttctatatgtttgaattttcaagtaccacctygaaaactgtcactgtctacttatcttttacatatttttttttttttagagacaggggtcttgctttgctgcccaggctggagtgcagtggcatgattata

SEQ ID NO: 18992 - DNA, 201 bp, Homo sapiens
gatgttttcttataagcaaacttttgtcatgtgagtaaaagggaaacaatgtggaaataaatttatccctaagttttttgattcaatgaggggtatatatktgagcttggcctggagcaaaaatcataacactctttagcttcagaataagaaacaaatttaagctattgtgtattatttactcattcagcaagtattttc

SEQ ID NO: 18993 - DNA, 201 bp, Homo sapiens
aggcggaggttgcagtgagccgagactgtgccactgcactccagcctgggcaacagactgtgactccatctcaaaaaaaaaaaaaaaaaaaaaaaaaagaraaaaaagaaaaagaaaagaaaagagaagaaacttggccttttggtgggttatggaatggtgggccacccagcaggaatggttgaacccaattcacaactc

SEQ ID NO: 18994 - DNA, 201 bp, Homo sapiens
actgatgttttcttataagcaaacttttgtcatgtgagtaaaagggaaacaatgtggaaataaatttatccctaagttttttgattcaatgaggggtatawatgtgagcttggcctggagcaaaaatcataacactctttagcttcagaataagaaacaaatttaagctattgtgtattatttactcattcagcaagtatt

SEQ ID NO: 18995 - DNA, 201 bp, Homo sapiens
tacaatgtgtagacagttttgagaactttggaagatactgtttacttattcacttatacattcatccattaatgcagtcatatggtcatccatttagttakcaaacatttattgggcaactattttatgccaggctctgagtaccaggccctgggacacaataatgagcaaatcagacacagtcattgacctttgggagtt

SEQ ID NO: 18996 - DNA, 201 bp, Homo sapiens
cctatctaacaaacaagattaggaaacttgagggagataaattaagggaaatacttacctgatgcatgcagtatggcgcatattctcaatcaatgagaagygatttttattgcaattgcagttgttcagaagagaggcaatgtggagcagctgagagaagaagggcctggaagtgaatgagccagggtccatctcctatta

SEQ ID NO: 18997 - DNA, 201 bp, Homo sapiens
aacaatgctttggttgagaattattccaattaagcaaagggagatgacccattcaaaagggcaggatcagatcttacgtaagtgagtaaaaatttaaagtyccccataaaactgggacagagatagtttctactgagccagtgaacattaataacagataatcaataaataattaaatatcatctcaatataatttcttgg

SEQ ID NO: 18998 - DNA, 201 bp, Homo sapiens
acagtggcagtgttgagtacttgtgaaaccatatgctctgcaaagcctaaaatatttattatgtggccctttacagaaaaagtttgccaaccctggattawaggattggaaatgagcaaatgcatacatagcaagtagagttaggtaatgaaaaaatgtatcagtaacatatttcacattggcctgatttctctagaggtg

SEQ ID NO: 18999 - DNA, 201 bp, Homo sapiens
caaaggattgtgaattattgttttctggagtagattgaaactcattaacatctttagcaatggtagtagaatccattcatttctttctttgctcagtgttracagtttggacctgttgtctctgtgtgggtctccaaagagggaaaaccattcagaaacagattttcaggtattttcagtatttggtggagttagggagct

SEQ ID NO: 19000 - DNA, 201 bp, Homo sapiens
ctaactttatggcctgttttttggtattgactctcctgtttgtcctggtactccttctggaaagttatttttcctgtgtaggtttcctagaattcctagawtatatcatattgaagtactttgttaactatgccataagttgtgggaaactagagttggcctcacttttcccttcttcctaatgtggatgggaaactgact

SEQ ID NO: 19001 - DNA, 201 bp, Homo sapiens
tggcagtcactttagggacttgaaattcaccaggaatgggggtttggggagtcgtggtggtaccttcatgagactaactttatggcctgttttttggtatygactctcctgtttgtcctggtactccttctggaaagttatttttcctgtgtaggtttcctagaattcctagaatatatcatattgaagtactttgttaac

SEQ ID NO: 19002 - DNA, 201 bp, Homo sapiens
aatagagtaaataagcttataaagatgaaatgccaaggtaacttatgggagaaaaaaagggaagaaatatatttcaccttttaaacatagattactaccamtgtttttcttaacttgttgatttcacaaggagaaaataaaatttctggctcaaagatagcaacattttaagttttctaagacaattgattgaaagccact

SEQ ID NO: 19003 - DNA, 201 bp, Homo sapiens
ccagattagtatggtgtaatctctctctctgtttctctctctctctctctctctctttctgtctctgccatcagagtgaagactttgtcatggaaatgggraagcagcccataatatttgaaaacccaatgtactcagccagagacagtgctgtcaaagtggttcagccaatccaggtgagaaaccatacagtcttttctt

SEQ ID NO: 19004 - DNA, 201 bp, Homo sapiens
catatgtgatatatccaactgattgtcctttttttagaacccactgaaaatagtccttcatcttcaccaatctcctgaaaatattctttcaatgctaccartgactgccattatgctaagcctaatggttcttgttcaaatatcacttctcagagagctactccccacagttactctttaccttttacccagctctatttt

SEQ ID NO: 19005 - DNA, 201 bp, Homo sapiens
acttgtgaaagggcccgcagctattaggcaacagtcagtattcaaattccagacctgtctgactggaatgcctgtgtgcctaaaaaagtctgtttgctgcrtctagagtatctgctttaatttcctctctgtaagataataaaagaaacacattttaaaactgatgttattattgataagaaatttcattgccctatagag

SEQ ID NO: 19006 - DNA, 201 bp, Homo sapiens
ttttgggtaacttatgacgtagcacctagcgtacctccaggtgtgaggaaggcacctttctttgtgtgtgaaccagattagtatggtgtaatctctctctstgtttctctctctctctctctctctctttctgtctctgccatcagagtgaagactttgtcatggaaatggggaagcagcccataatatttgaaaacccaa

SEQ ID NO: 19007 - DNA, 201 bp, Homo sapiens
aaggacccatggccacttgtctcctgggcatagtctccctcatctcagtccccattcttttgaggactccatacgtaacaaataggttggaggcaggagartgatggaattccacacatagatgagtagagaagttgggaaataagccacaataaaagtgactaaattatttgagtgctttctataccaggcattggccta

SEQ ID NO: 19008 - DNA, 201 bp, Homo sapiens
atcgttggtttgcagcacttctcttttgttacttaggaatgccaaagaaagggtaaaatccctgttacaatgaaggctttcttgctggtaatcagcagtayttggtctgcctgcaactggggctgctttgtcccagaagttttatttctattgactttctgctctttagaatttaaacatttttctttatatctttaactg

SEQ ID NO: 19009 - DNA, 201 bp, Homo sapiens
ttctgattcagattttctttagtgaaaaaaagaaaaaagagggtaaaagaaagcataataactccataaagaggaaagcgtttttttttttgttgttgttktttttaatcagttctgatttcctttctggtatctctgctggtgttttcaaaacttggcaactttgtggctgtggaagactgttgatgagagggttgggcg

SEQ ID NO: 19010 - DNA, 201 bp, Homo sapiens
tgagtggctgtgaggatggatgaatccatgtagaatacttggtccagtttctgccacctagtaagtgctcatttaatctaagctgtgattattaacactaytaacaatattgtgttttctaaatatatagttggctttctatcacatagagaactttcttttcacaatttgctgaataaatgaagagaaaaagtagtagga

SEQ ID NO: 19011 - DNA, 201 bp, Homo sapiens
cttctaatgggattagcatcaaggaaaaaccactcatgcagggtctaagataaacatcagaacaatgcagcaattataggtcattcaattaatatattgaygtgactttcagttgctcaaaaatagtacagtttttttctgttaagtgaaaagattattttgctttttcaagcaccatattagaatgattttggtgtgaat

SEQ ID NO: 19012 - DNA, 201 bp, Homo sapiens
gcctagttgcctcctcctctttcaccacctcactatgaattaccttgagggtggtgtccacacttctttccagatgcttaacttctctttgacttggttcyctcatctgtagaataggaacgatactaatgcctacttgattgagtggctgtgaggatggatgaatccatgtagaatacttggtccagtttctgccaccta

SEQ ID NO: 19013 - DNA, 201 bp, Homo sapiens
tctttcttgtgcattgtagaatgtctaacagtatccctggcctctatccactagatgtctgtagcattgcccagtcgtgacaatccaaaatgtctctggasgttgtcaaatgtcctccaggagccaaatcatccagttgagaaccactgatttaggggactgaacaggtgcaaggattttcttggtggggaaacaagggaa

SEQ ID NO: 19014 - DNA, 201 bp, Homo sapiens
aaatcaaagtccaaataaaatctttatgttcaagttagttgatatgtctcataagcctttcaatttgtggggtttccttctatttctgttctttacccctwgcaatttacttgttaaaaaaaaaaaacccaggtcacttgtcctggagtttcccacagtctggcttgtgttcattgtgtcccctgatgtcctttaacacat

SEQ ID NO: 19015 - DNA, 201 bp, Homo sapiens
tggattgatctgtaaccttgagtcattctcctctctcgtgtctcttatgaattctaagttgaaagcctgatgctagggaagttgaaagtgtgagtagttcrgtgaaaacaaaacaaaagaaaacaacagaggtaacaacgtacttaagcccccctgtactggggcctctggaaggacactaagagcatgactctgttttga

SEQ ID NO: 19016 - DNA, 201 bp, Homo sapiens
agagagagctctatatattccagaaagcaagaaaaggaactgtgaaccaaagagatccttagtcttaggaaaaggagagagattgtagcagaaagaggcawaccgagaaaagaaaagctaccttagtccaagcaagagtgaaagataccagacaataggcagagaaaaaaatttagagaaaagaatgagggaaagaaggat

SEQ ID NO: 19017 - DNA, 201 bp, Homo sapiens
cagtatgaggtcattgaaagagttgataaggccactggggccaacaaaatagtcttgagagataatgttccaaatctgaggggtcttcaagtttatcacaracgcagtaagtatttgtcactgaaatacattcatgggtgtataatgcatattcacacataactcacatttgtaagcacacacccacacacagtttcacgt

SEQ ID NO: 19018 - DNA, 201 bp, Homo sapiens
gggctccatcctgctgagtttgaggccttaggacattggattggagctgttcagggggcagttggctctcaggaggaaactcaggaggcactcaggaggamacacacacatcacacacacacacacacacacacaagaaacagtagtgttataaagttatacatatcttttccacatgaaagttattttggtttctatgtt

SEQ ID NO: 19019 - DNA, 201 bp, Homo sapiens
cctctctcgtgtctcttatgaattctaagttgaaagcctgatgctagggaagttgaaagtgtgagtagttcagtgaaaacaaaacaaaagaaaacaacagrggtaacaacgtacttaagcccccctgtactggggcctctggaaggacactaagagcatgactctgttttgattttaatgtggaggttttccacttactgg

SEQ ID NO: 19020 - DNA, 201 bp, Homo sapiens
tgcacaacaggaaccatggcaggaatatacactttcccatagcaaatagcatacctgactctctgtgctaatattgcacatttgttaaacaatgaatgaadggatggatggatggatggatgaatgaatgaaacatatactactgattattttattccagagttctcaaaatatttgttgctgatattttgagtgctgact

SEQ ID NO: 19021 - DNA, 201 bp, Homo sapiens
ttttgctctttaccctcatgttctgaaacctctctctctctctctgagtttagttgtttctttttgctcgaatatatactccacttttatagcgtccccartgcttagaatggtgtttggtttacagtgaatacctaccatttttctggtgaatgaatggattaataatctattaataacatggtatgtgtaataaaaatg

SEQ ID NO: 19022 - DNA, 201 bp, Homo sapiens
aattttttttcgtcaacctttccaaataatttcatgctactagtgaagattgctgagaagcatgaattctggggaactacagtcacaatgagcacagccartgcttgcctgtcttctcagctccccatttgagtgcaggcatgctgctgtgagttgagtttctgggaataagaatgtagcctggtaccatgaaacaggtgg

SEQ ID NO: 19023 - DNA, 201 bp, Homo sapiens
tctcttctcccactcgctgttgccacattggatttcattatggtccaaaagcacagcaggcgactcctgcctctcagcttctgcgctagctcttccctctrcctggaacatctctcttccagatctctgcatgagttgcttcgcgtgctatttaggattctacccaaatgtcactttctcagagaggccctcattgaccgc

SEQ ID NO: 19024 - DNA, 201 bp, Homo sapiens
actttaaaagtataagctatggttctcaagaaattgatgatctatctaggaatataggaaaaggaatagagtaaataagcttataaagatgaaatgccaargtaacttatgggagaaaaaaagggaagaaatatatttcaccttttaaacatagattactaccactgtttttcttaacttgttgatttcacaaggagaaaa

SEQ ID NO: 19025 - DNA, 201 bp, Homo sapiens
gccagcacgagttgtcctaaagtgcatggtatgggtgtctaggtgaaagacttggcatccgtactgttctttctggtgggagagggagataagtcacttartcttcacttaatcctctctcctcaaaactctccaattgtttctcacacccttcagcatgtggctgctgctatttccctgctctcttctcccactcgctgt

SEQ ID NO: 19026 - DNA, 201 bp, Homo sapiens
gggagaaggatattgaacaagaacacaaaggacataaacatagttggccagctactgctggggtgaaaactaataaattcatgagtattctgagaaaattrctagagaaagctgaatgacaagatttagtggaaactcaagatgggggaggtgggtcccaagcagcatttaaagtagggtacagatttgttgaactgtagg

SEQ ID NO: 19027 - DNA, 201 bp, Homo sapiens
gccataaaaaagaatgagttcatgtcctttgcagggatatggatgaagctggaaaccatcattttcagcaaactaacacaagaacagaaaaccaaacactkcatgttgtcactcataagtgagagttgaacaatgagaacacatggacacagggaggggaacatcacacaccggggcctgtcagtgggtgggggcaagggg

SEQ ID NO: 19028 - DNA, 201 bp, Homo sapiens
aaagtttggcttttgattggatttcaaagaatctctattggacagactctcattacaagagtatcagtgtcatgaggctagctgataaaacgagacgcacrgtagttcagtatttaaataacccacggtcggtggtagttcatccttttgccgggtaagtgtgttcatgttttcctaagagcttgaaactgtatgtctttt

SEQ ID NO: 19029 - DNA, 201 bp, Homo sapiens
acaaaatatacttagcttaaaatatgtccatattttaacttataggaagagaaattctcgcagctaacagggtggaaaatgttgaaagtttggcttttgaytggatttcaaagaatctctattggacagactctcattacaagagtatcagtgtcatgaggctagctgataaaacgagacgcacagtagttcagtatttaa

SEQ ID NO: 19030 - DNA, 201 bp, Homo sapiens
attttaagagcacattgatttattagcttggcaatacaatttttgaaatgtcatataattaaaaattaagtttctaattactgcatgcagtaatagtccayagaggggccagtttgatgtaactttgataactcatgattatacaacaaaaaagctggatttttctgcttcagttttatgttgtttattagagctcccttt

SEQ ID NO: 19031 - DNA, 201 bp, Homo sapiens
tctaagttaaaaaagcacaatacgcagttcaccgattccacagaaacaaaaagtagtgaggatgtaaagcagtcacttcaaatcccaacttcttagtcaartgcttctctaaagcctgagtgacaagctgtgttttgtagtccaaatggttgtgcctactggtaggtgttcaggtcagagaggagtgaaaaggcagctgtg

SEQ ID NO: 19032 - DNA, 201 bp, Homo sapiens
agctttaatttagtgatatttctcaatccatctcccagaatttcagtttcttggctcctgatagttacatttcctctgcctcttacaactttattttgtarttcttggtccttaattaatagagatattattcgttgcatgcaaacactataacattttgtaatgttgccaactaagcaaatggatagagctttttcttaa

SEQ ID NO: 19033 - DNA, 201 bp, Homo sapiens
agatacatcccatcaatacctaatttattgagattgtttagcatgaagggctgttgaattttgtcgaaggccttttctgcatctattgagataatcatgtrgtttttgtctttggttctgtttatatgctggattacatttattgatttgtgtatgttgaaccagtcttgcatcccagggatgaagtccacttgatcatgg

SEQ ID NO: 19034 - DNA, 201 bp, Homo sapiens
gagaattggcagcagcattttcctactcacctggtattgttgattacaacagggctgtgggagaagagctgtctgcagggctgctttagtacaaggcactsgtgatgagcagaaagactgggatggattcggaaagaagatgactgtgttgcgaaaactctaacatggagcaagataaatggatgtctttaaaaagcattt

SEQ ID NO: 19035 - DNA, 201 bp, Homo sapiens
cccctcctcccacccctaacctgggccggtttgcatggtgtgggcactctgctgagtacagctgactaacacctgcatggctttcccttcctgcagccatygaactgcctatcaacctgccccccccatgcaggtgcatgcacggaggaaattgctattttgatgagactgacctccccaaatgcaagtaagtctgaatgt

SEQ ID NO: 19036 - DNA, 201 bp, Homo sapiens
atgtgactgcctgtggactgatcaattactgatgctttggtgtctttagttgaagtttcaaggtgggcctacattaaactcttgattttaactgggttcayggaggagaattctgaaaacttcaaatgagaatgtgaatattttaagagattattttaccactaggttcttgtaactattaatatatgtgctccagagtct

SEQ ID NO: 19037 - DNA, 201 bp, Homo sapiens
aatcatcttgttattttttatagtttgattatttaaatcaaagtccaaataaaatctttatgttcaagttagttgatatgtctcataagcctttcaatttrtggggtttccttctatttctgttctttacccctagcaatttacttgttaaaaaaaaaaaacccaggtcacttgtcctggagtttcccacagtctggcttg

SEQ ID NO: 19038 - DNA, 201 bp, Homo sapiens
aacaaacctggatggtatagcctactgcacacctagggtaaacagtatataccctaggcatatactgttgctcctaggctacaaacctgaacaccatgttyccgtgctaaatactacaggcaattggaacacaatgttaagtatttatgtagctaaacatatgtaaacatagaaaaggtacagcaaaaatatggtattata

SEQ ID NO: 19039 - DNA, 201 bp, Homo sapiens
gggaggccggaggggagagcgtccgggcaggggctagggccgggcggcggcgcgggagctgctcccggtggggcgctcaggttgcttcgcgaagccggagsgggagcgcccctcttcgctcgccaggaactgagcggcagcaaacttgagaaagcagccccgccagtttcggtgacagcgcaccccacggagaccctgtct

SEQ ID NO: 19040 - DNA, 201 bp, Homo sapiens
ttttggctcaagtgatcctcctacctcagccttccaaatagctacgactacagctacttggaagtgagccactgtgcccagctaaatttattttttttttyttttaagatataaggatctcactatgttgcccaggctagtcttgaattcttggcctcaagtgatcttcttgcctcaatctcccatagctgggattaaagg

SEQ ID NO: 19041 - DNA, 201 bp, Homo sapiens
ccctggcatcctgtcacagtctcctctttgctgttaaacatcacttcttcttacctatttcctttatccctccccttccttccctgctttcactcctttayatctttatatttctgattgctgttaattatcttggtatctactgtaaggttcttggtgtagatctctatgcagaagttaaaccaacttgaggattgttac

SEQ ID NO: 19042 - DNA, 201 bp, Homo sapiens
gtttcctacacatctattcacacttaagccatcgcctgggccccagctaatgatgaaatgcactcctacaatatttgtttttcttattttcacttctacawttctcctttctgtgcctgtgacaaattcttgctctccagatgttgcggtttctagcgtcgtatataaattatcttattctaacccagacacatttgttaa

SEQ ID NO: 19043 - DNA, 201 bp, Homo sapiens
ataattacacatttctaattgcaatttaaccctgtgcatttttccttccagctaccaatccgtgtaaagataacaatgggggctgtgagcaggtctgtgtyctcagccacagaacagataatgatggtttgggtttccgttgcaagtgcacattcggcttccaactggatacagatgagcgccactgcattggtaagaagt

SEQ ID NO: 19044 - DNA, 201 bp, Homo sapiens
gtactggggcctctggaaggacactaagagcatgactctgttttgattttaatgtggaggttttccacttactggtgctttcttctctttctcatgcagcygtgaatccatgtgccttttcccgctgcagccatctctgcctgctttcctcacaggggcctcatttttactcctgtgtttgtccttcaggatggagtctgt

SEQ ID NO: 19045 - DNA, 201 bp, Homo sapiens
tgtggatgtatccagtagtaaccagtagtaatgttttcaacacgttgctaatccattactctatttcacctataggtgaaaagggctagaagtggcttcaygtcttggataattacacatttctaattgcaatttaaccctgtgcatttttccttccagctaccaatccgtgtaaagataacaatgggggctgtgagcagg

SEQ ID NO: 19046 - DNA, 201 bp, Homo sapiens
cagatttgctctaaaactcatgttaagtgatggatctatttaggatgaagaaagactgcaaagtaatgaggttaacttaacaaaagcccaaccactagaamtgacacattcagatgaatctccttcaatgtcatcatcctgggaaagtataaacttgtctaaaaatagatattttatctgaaaacatttttggaaatatct

SEQ ID NO: 19047 - DNA, 201 bp, Homo sapiens
ttgtttcctcttgtatttccattttgtaaggataatatcacagtttgccattggattatatatccttgggacaatctctgcttggttaaatgaagtattgkgtattaatatggtgacttcctatcactgaaactggcttccataaggagaatatgaataaattttatgaaaaaattagctaacccaataagtcacataaaa

SEQ ID NO: 19048 - DNA, 201 bp, Homo sapiens
aattaattattgactccttttgtatgactaggtacctgtactgggctgactgggatacacatgccaaaatcgagagagccacattgggaggaaacttccgsgtacccattgtgaacagcagtctggtcatgcccagtgggctgactctggactatgaagaggaccttctctactgggtggatgctagtctgtaggtgtctc

SEQ ID NO: 19049 - DNA, 201 bp, Homo sapiens
agggatttgcatcatgtgatgaaaatatagcatgccagatagacattgccagaatatagaatcacagttttaggaactatgtttatattggaacttggtgwacatactgtgaaaatttatctatatcatgcattgaataattatgaactaaaagacatctaaagatgcattgctaaatatatctataatttcagctataat

SEQ ID NO: 19050 - DNA, 201 bp, Homo sapiens
ctgagggcctcagaaaacagaaatatttaagacatgattcctgctgtccagaagcctacaacctattaaatagtaaggaagataaccaaagtacaaaaatraatacagtaaaaggaagaatgtaagcatagtttactctagactagtatttagaaacacagttaaatataacccaagaaagagtctattttaagtactcat

SEQ ID NO: 19051 - DNA, 201 bp, Homo sapiens
aattgtgaatgggagttcactcatgatttggctctctgtttgtctgttattggtgtataggaatgcttgtgatttttgcacattgattttgtatcctgagmctttgctgaagttgcttatcagcttaaggagatattgggctgagatgatggggttttctaaatatacagtcatatcatctgcaaacagggacaatttgac

SEQ ID NO: 19052 - DNA, 201 bp, Homo sapiens
tacaatatgagaggttctttccggtgctcgtgtgatacaggctacatgttagaaagtgatgggaggacttgcaaagttacaggtaattgctgaactaaccygagccagtttatcagcacatcccagagcttaaaatcaaatggcacatgtaggtatttgacaatgttgattaggagttagatcgacttgaatcctggaaag

SEQ ID NO: 19053 - DNA, 201 bp, Homo sapiens
ggtatatacccaaaggaatataaatcattctactataaagacacatgcactcatatgttattgcagcactatttacaatagcaaagacttggaactaacamaaatgcccattaatgatagacatatacatcatggactactatgcagccataaaaaagaatgagttcatgtcctttgcagggatatggatgaagctggaaa

SEQ ID NO: 19054 - DNA, 201 bp, Homo sapiens
tgttttcacttttagtttttcttaggacttcccactttagtaggtttaaacttttgaggctctactccatataaagatattttactggtttcttttaagtktcagtagagaagtcatatcatggtgtagaaatggtatggagctgtgtttagtattgactctgatgaattcattctttgtgctattatgtgttgaatatct

SEQ ID NO: 19055 - DNA, 201 bp, Homo sapiens
cacacattttccctaactcagacaaactgggggaaagtatcctcaaaggaatgtggtattgaacatacagtaaaattgagtagacattgccatataatgtrtaattaacaaatcaagtggttgtataaatggacacttcaaatagtctcttagatgggctaaatatttcttagatatttttgttttcacttttagtttttc

SEQ ID NO: 19056 - DNA, 201 bp, Homo sapiens
gtggggataaatgtattggcgtcacaaatcgttgtgatggtgtttttgattgcagtgacaactcggatgaagcaggctgtcgtaagtaacacatacccagmatgtttcagacaaaggggtcatttcatttttgccagtattgatattgatattgccacacattttccctaactcagacaaactgggggaaagtatcctcaa

SEQ ID NO: 19057 - DNA, 201 bp, Homo sapiens
gtactgcttctcaattcaagtgtgccagtggggataaatgtattggcgtcacaaatcgttgtgatggtgtttttgattgcagtgacaactcggatgaagcrggctgtcgtaagtaacacatacccagaatgtttcagacaaaggggtcatttcatttttgccagtattgatattgatattgccacacattttccctaactc

SEQ ID NO: 19058 - DNA, 201 bp, Homo sapiens
ccccaatcatcgatgtattgacctatcgtttgtctgtgatggtgacaaggattgtgttgatggatctgatgaggttggttgtggtaagtgcattgccttcktttttattcacaatgtttatttagaaaaatctcagtgttaacacatggacacagggaggggaacatcacacaccggggcctgttggggggtggggagcta

SEQ ID NO: 19059 - DNA, 201 bp, Homo sapiens
attgccccaatcatcgatgtattgacctatcgtttgtctgtgatggtgacaaggattgtgttgatggatctgatgaggttggttgtggtaagtgcattgcyttcttttttattcacaatgtttatttagaaaaatctcagtgttaacacatggacacagggaggggaacatcacacaccggggcctgttggggggtgggga

SEQ ID NO: 19060 - DNA, 201 bp, Homo sapiens
agacttttaaatccagttttgggggtctgtctacacactgttgctactaggcatgtgggtcatgctggttttgttgcctgattgggctccattgcttggckttggtctagagtcatggacttcatagtattcatgaaatgtagtccaagtccaagcacatgatgctcactttctgaatgtggtctattttccaaggtgtaa

SEQ ID NO: 19061 - DNA, 201 bp, Homo sapiens
gagtagaggtgggctttaaagaaaataaataaaagcttgggctatttatatgggaaaaatatcttttagaatttcagattcttaacatgcactttgaaggyttttaggaagctaagcaagaaatttcattcataatgttatggatggtttctggccttgatttagactatcttcaacaatttttttccttgacattggctg

SEQ ID NO: 19062 - DNA, 201 bp, Homo sapiens
tgtattggttaactcctggctctccattttagaaagctctactggttggatgcccgcctggatggcctctttgtctctgacctcaatggtggacaccgccrcatgctggcccagcactgtgtggatgccaacaacaccttctgctttgataatcccagaggacttgcccttcaccctcaatatgggtattgtctccctgca

SEQ ID NO: 19063 - DNA, 201 bp, Homo sapiens
ctcccttgcacgtacctcgcccctagctgaagtccagttctttatagtatgtgcatagttccctatagggtaatgtttattaatttccccaccaacgtttktttttcttcaagataaattaattccatttgtcatttcttacttgtcatttcagagccatttctttcatggtttagtgatttcagtgtttttctttgaaag

SEQ ID NO: 19064 - DNA, 201 bp, Homo sapiens
taagcatccagtgagtaatatttattatatcctacaaatggcaaaaaagcagtgaagtgtgggttttcttttgacaattatttgtaatcatggaggatagsagacatactctgacataattattggggagaaagttgtaggagtcctttctttttttttgccaccgtctgttggagagtggatgggagagcagcagtgaaa

SEQ ID NO: 19065 - DNA, 201 bp, Homo sapiens
ctcggcctcccaaagtattgggattacagatgtgagccactacacctggctgaatatggcatattttttttcatctttttactctgattagagctaactayaacttaatgtaaaaaaaattattttagatcctctccttttggtattttcaaaaattgggtaaaacatgttcttcaaattttgacccaaaatattattctt

SEQ ID NO: 19066 - DNA, 201 bp, Homo sapiens
ctcggcctcccaaagtgctggtattatgggtatgagccaccacgcccagcctgaaagtttcagtgtggtataggtggctttcttgcctccacttcttcackctgaccttgcttttatgtccatgctgttgcctgcaatgcaaatgacctctcttattgttgccacctctccacttatgttttttggaaagagtaaagttag

SEQ ID NO: 19067 - DNA, 201 bp, Homo sapiens
agagaagttttttttggctcaagtgatcctcctacctcagccttccaaatagctacgactacagctacttggaagtgagccactgtgcccagctaaatttwttttttttttcttttaagatataaggatctcactatgttgcccaggctagtcttgaattcttggcctcaagtgatcttcttgcctcaatctcccatagct

SEQ ID NO: 19068 - DNA, 201 bp, Homo sapiens
tcctgattatattaacttacttccctttctaacgcatgttctgtgttatgactcttacaaatatgttagagtacacatggaaatagaaggcatttgcatcyccaggcatgtgaactgtcttagggtggctttaggcattttcattttggccctgaaagtaaggcatgacgatatgttaccggatctgtgtactctaatatt

SEQ ID NO: 19069 - DNA, 201 bp, Homo sapiens
atgagcttttaattgcttcttcgtaagccctttgaaaacctaagcacaacatttagaattatttgggcttgacgtaaagaagaaagccaaggtaattgaaygagcactgatacctgacccaggttcttttcatattttgtttgagacaacccatgacttgccttctcgggaataaaagaaagttctttaattttatgtgaa

SEQ ID NO: 19070 - DNA, 201 bp, Homo sapiens
tctaacttttaactagtaggtgatccggatacatcaccttgctttttgtgcttcagttttgttttcatttgtaaaatagatgcccagtgtaattaccaagrcaaacataaagagtaaatggcacgtgtatgtgaaaggctcttgaatggtttagtgggatataggacgaattgtgtattttttgccgctcttttgcacaat

SEQ ID NO: 19071 - DNA, 201 bp, Homo sapiens
tcagtaacctggaaaaaacctttaaattctaatttctttggaatcagactggaaaagactgttttaataggtctaacaataattttattttatttattttwattttattattatttttagagtcagggtctcactctctcacccaggctggagtgcagtggtgcgatcacagctcactgcagcctcaaacaccggggctca

SEQ ID NO: 19072 - DNA, 201 bp, Homo sapiens
ctgggaattaattggattttactctgctcttatatatttcaaatttcaaggagaaattctttgtattgtatttttacctggtatacaaagatacttaaacrgcaatatttgaatgtagaatatggctttcttttttttttttttttttgagatggagtctcactctgtcacccaggctgaagtgcagtgatgcgatctcgg

SEQ ID NO: 19073 - DNA, 201 bp, Homo sapiens
attacattgaaactgtaacttatgatggaattcaaaggtaagaagtattttttatggcttatggctttataagttgcagggaaagtgcataaaatggctgsagagaaatatcaaaggaccagaattaaaatattgctttgttggtggacatgatagctttaatgacctttgtactgacatttgcatgaagtgacctgctct

SEQ ID NO: 19074 - DNA, 201 bp, Homo sapiens
atcccttagcatgaggcatggtgcaagctaagtctagcttagcttgggactaaggaaacgtatcattttaccaattttcgtagcacaaaggtcattatttmaaaaattttatgaaaataacttccaatcctcagcttccatctgaatagagtgaataaaacacagtggactttctcagggagttctgaggttggttacctt

SEQ ID NO: 19075 - DNA, 201 bp, Homo sapiens
ggtgtgagatggtatctcattgtgattttgatttgcatttctctgatggctagtgatgatgagcattttttcttgtgtctgttgcctccataaatgtcttyttttgagaagtgtctgttcatatccttcacccactttttgatggggttgtttgattttttcttgtaaatttgtttaagttctttgtagattctggatatt

SEQ ID NO: 19076 - DNA, 201 bp, Homo sapiens
agaggagaaagttcagaaggtgaatatgaattttttttttttgagacaggttcttgctctgttgcccaggctggagtgcagcagcacaatcacagcatgcygcagacttgaacttctgggctcaagcaatcctcccacctcagcttcctgagtagctgagactatgggcaagtgccatcatgcccagctaatcttttaatt

SEQ ID NO: 19077 - DNA, 201 bp, Homo sapiens
taggggctaggagtttttattttcctgaaataaactataattgcatgctttttgtgattgagataaattgagattatagagaaacagaatgactttgattkgtgcttaaattacttgatttgtgcctaaaacaattttaaaaatgtatacaacatattttgcttaatctaactaattaaaagtgttatctcactttgcatg

SEQ ID NO: 19078 - DNA, 201 bp, Homo sapiens
ggggctaggagtttttattttcctgaaataaactataattgcatgctttttgtgattgagataaattgagattatagagaaacagaatgactttgatttgkgcttaaattacttgatttgtgcctaaaacaattttaaaaatgtatacaacatattttgcttaatctaactaattaaaagtgttatctcactttgcatgca

SEQ ID NO: 19079 - DNA, 201 bp, Homo sapiens; identical to SEQ ID NO: 1997

SEQ ID NO: 19080 - DNA, 201 bp, Homo sapiens; identical to SEQ ID NO: 1998

SEQ ID NO: 19081 - DNA, 201 bp, Homo sapiens
cagagcattactagggagtaacaagtcgtggaaaatggttagagaaacatattacagatatttatgggggagatgatcgtacttgcaagaagcatttcaarcctattgcattttctcaagtgatttatttataagttagctgtgactgaaaatactaatctacccatgtttcttttcagagcatttattttttactgactg

SEQ ID NO: 19082 - DNA, 201 bp, Homo sapiens
cctgcactgatgttttcttataagcaaacttttgtcatgtgagtaaaagggaaacaatgtggaaataaatttatccctaagttttttgattcaatgagggktatatatgtgagcttggcctggagcaaaaatcataacactctttagcttcagaataagaaacaaatttaagctattgtgtattatttactcattcagcaa

SEQ ID NO: 19083 - DNA, 201 bp, Homo sapiens
tgaggataccaataatgcaaatattcaattgctttatgttgccccaaatattacaaagattttgtttattcttttaaaattcttttttctttatttttgcrtaactggattatttcaaaagggattctgagataatgagattctttcttctgcctgatctagtatactgttgaagctttcaaatgtattgcgagcttttgt

SEQ ID NO: 19084 - DNA, 201 bp, Homo sapiens
atatgttttggaatataatccaattctacataaaatcagtatcattgaatcaagcttggtgagtaggcatcacttagaaatattagcatgtaggcagggcrcagtggctcatgcctgtaatcccagcactttaggaggctgaggcaggcggatcacctgaggtcaagagttcgagaccagcctgaccaacatggtgaaacc

SEQ ID NO: 19085 - DNA, 201 bp, Homo sapiens
ttgttattacagtatatttttataattgttctattttcagattatggttaatctcttaccatgtctaatttataaattaaactttgtcataggtgtgtatrtgtaggaaaaaatatagtatatatagcattcagtactatctgaggtttcaggcatccattggtgatcttggaatttgtcccccatggatgagggggatga

SEQ ID NO: 19086 - DNA, 201 bp, Homo sapiens
tacttcagtgactgctgccacagccaccatagggagagcttgaacaagaaagaaaatagtagcgatgaagcggatcttggcaactgcggcatccctggacrttgagggggtttggttcagtaacctggaaaaaacctttaaattctaatttctttggaatcagactggaaaagactgttttaataggtctaacaataattt

SEQ ID NO: 19087 - DNA, 201 bp, Homo sapiens
ccagagtgaatttgtacattccttaggggcatttttgcaagggaggttgttgtgttttaaaggtagttgataagagacctgcaccaccaaccccagacctrcaccaccaaccaccatcatgcattagtctatagaaggtatttgggtgtacgtactcctgtaccactcggtaccaccatttagccaagcgaagtttctgac

SEQ ID NO: 19088 - DNA, 201 bp, Homo sapiens
gaatgtctctgttgccttttatttgttcatttttatttacgcagtgttccttgctcatttttgaagtaattcaaaatgacactcacggtaagcttgcaagrctgcctttcctttactataacggagaaaaaattctggaaagaaggcagctctttcagtatagtcatataagaacaaaatttccccaaacttggcttgtgg

SEQ ID NO: 19089 - DNA, 201 bp, Homo sapiens
aagaagttacacacaatgggatgattctttataaatgtggagcagggccttaaatcataagggaacctatgccagcaatctcattcaggggttggatgatrttgaaagtacggatgtactgaagaattatgaatataccccagcaatttggaagtgagataggttcccaatctttaattttgattatgttatgctcaagaa

SEQ ID NO: 19090 - DNA, 201 bp, Homo sapiens
aaacagaggagaaagttcagaaggtgaatatgaattttttttttttgagacaggttcttgctctgttgcccaggctggagtgcagcagcacaatcacagcrtgctgcagacttgaacttctgggctcaagcaatcctcccacctcagcttcctgagtagctgagactatgggcaagtgccatcatgcccagctaatctttt

SEQ ID NO: 19091 - DNA, 201 bp, Homo sapiens
cctaatatttggttcagtgaagtgttgaaagaatttgctaagtaatcattgaaagctaagattctagtgaaaaacaaaatgcatggtttaaaaattgaacrtactaactgaaagacagtggaagttagatgcttcttgctgtaaataattaaacccaacagtgcagacgagagaacatggcaccaagagggacttgggcta

SEQ ID NO: 19092 - DNA, 201 bp, Homo sapiens
tcctctgggcttactgagttcattttgattaaacaataaaagcaaaaaggcaagggcagtgtatctggggtaaaggaataagtgaacagctatgccaacarctcttcagagattgttacctgtattatattttattgacctgtaaaaataataacaataacaacaatatcaatgacgatagtgatagcaagtaacattaca

SEQ ID NO: 19093 - DNA, 201 bp, Homo sapiens
atttttaacaattcaatgtgtttatttttgcataggtaacatatttatatgttcacaaattttaaattataagaagatatgtagtgaaatgccttcctccrtaactattcccctctgcatggttttcaccttctctttcctatgagtaattgccgtttctttattttagttctagagattttttaatgaataaacaagaac

SEQ ID NO: 19094 - DNA, 201 bp, Homo sapiens
tgattgaaagcagcttacttttaggactagtttattatggcaccactgccttctaggtgctctgctgtagccagcacgagttgtcctaaagtgcatggtaygggtgtctaggtgaaagacttggcatccgtactgttctttctggtgggagagggagataagtcacttaatcttcacttaatcctctctcctcaaaactct

SEQ ID NO: 19095 - DNA, 201 bp, Homo sapiens
agacgaagagggcccctgactgctgaaaaggacccatggccacttgtctcctgggcatagtctccctcatctcagtccccattcttttgaggactccatamgtaacaaataggttggaggcaggagaatgatggaattccacacatagatgagtagagaagttgggaaataagccacaataaaagtgactaaattatttga

SEQ ID NO: 19096 - DNA, 201 bp, Homo sapiens
cagtgttcttgcaaaatttagggatatttccaaatggacatgctaaatttggattaacaattttttgaatgcactaactctgggtaatttgttggaatcartgtaagagtatgaaaagtagagagtagtacagagtagtagagaaaagtcatggagaaaatctgcaaaaaatagatgagggctccaaagcattttgtcgct

SEQ ID NO: 19097 - DNA, 201 bp, Homo sapiens
ggcagggctttatcattacaaatcagggatggctcctactgcctagaaaaattggtcaacattaatttcatactttgattattaaggaccaatttgtcgaytaatggtgaccattattaatattttttaattgattgattgtttactttgcctaggctatcatgtcacccacctttaattgtggaataaatgctatgccta

SEQ ID NO: 19098 - DNA, 201 bp, Homo sapiens
ctgtgccactgtgaagaagggtatatcttggagcgtggacagtattgcaaagctaatgattcctgtgagtaaattatggacacctgtgtctctgaacagtraacagattctaatagcttctttccttccttctgatgacaacagaattatcagcatttttgttgttggcagggctttatcattacaaatcagggatggctc

SEQ ID NO: 19099 - DNA, 201 bp, Homo sapiens
taaagtgactcctagtcatgcacttcactgataacattttggaaaataactaccatgccattataatgcctggcaaaatcaaaagtgcttactaaatatcyctgagtacctagtccatgttcaaattttgtcacttatccccaaaatgtatttttactgttctctgttcaagttagggttcagatgagatctacaactgat

SEQ ID NO: 19100 - DNA, 201 bp, Homo sapiens
ttctgtaaagttatccttcatgtaggtttaaaaaatgatgtaaatgttctttttccttacatgaagatggttgttataaattctcagaacctgtgcctaaytccagagggtgtttatttagacatgggcaacaccacattcttggccatcttatctaggatttttgtcagagagtgcttaataaatgctgataaccttgac

SEQ ID NO: 19101 - DNA, 201 bp, Homo sapiens
tatgttttttaaaaattctagttttaaaaaatttgaaaaatacgataatgtagtaaacttcaaatctaattaattataaaatgactttcacattcattttktcatttagttttctcactaatcttctgaggtcggtttcagattagtaaattgagactcggagaagttaagtcatttattaaagttcttacagttggtaag

SEQ ID NO: 19102 - DNA, 201 bp, Homo sapiens
acttgaaatgtggcaagtgactaggaaagcaaattattacttttattttattttaattaatctaaagatacatttagatagccacagggggttagtggctrccatgttggaaagcatagtattgaagggaaacatttacaccaaaatttatatatttgtagactaacattaataaatgaaatgcagtaccatagggctatg

SEQ ID NO: 19103 - DNA, 201 bp, Homo sapiens
ccctagcttcttattccagacaccattttaagtggcctctactccagttatagctaggaaatataccgacattggtagaacactggtgaagtacccctccrcgttgtatgcaacgagatattgattttcagcctttgcccattgtattgtgagcatcttgaggacaagtaatacacattgtcatttatgtcactgactcaa

SEQ ID NO: 19104 - DNA, 201 bp, Homo sapiens
tccagacaccattttaagtggcctctactccagttatagctaggaaatataccgacattggtagaacactggtgaagtacccctccacgttgtatgcaacragatattgattttcagcctttgcccattgtattgtgagcatcttgaggacaagtaatacacattgtcatttatgtcactgactcaaatccaccttctgtt

SEQ ID NO: 19105 - DNA, 201 bp, Homo sapiens
tctgtgaaaactctctttactgggaacctcgaacacctggagtgtgtcactcttgacatcgaagagcagaaactctactgggcagtcactggaagaggagkggtatgagcaccctttcagtcttttggtctttatgctgagctggtgtagctgatgctgagtgttctgagctgtcaggcagtggttcttgaacaatcttac

SEQ ID NO: 19106 - DNA, 201 bp, Homo sapiens
tagaatcctttagaatatttgcctctagggtaagaatgaacacttctccagttctcttcctcagaggtcattttcttcagccttcagggaaaaaacctgtmagaatagggaaagagcaagaagactataaaggaggaagagaagaaaaatctttgtgtttcatgtttgtcacctatatacaaaatatactcctggtcttct

SEQ ID NO: 19107 - DNA, 201 bp, Homo sapiens
cccaccgtgccttatgacttctacctagaagcccatgtctcataataatgccagtcagaggccagtctgactgctgtgtctatggtagttatcttggggaygagcaatccacatcttgtgtatttagcaggcttgtagttaaaacagattggaaatttgactttcctgtttagtctttggaattgagttaattccattgtg

SEQ ID NO: 19108 - DNA, 201 bp, Homo sapiens
tccaaattcttcacctaagaagtaaacattctcaacgtttgtgtacagcttcattttttatgtccattgtctctttctccctcttttttttttcttttttytttctttcttttttttttctttctgagacagggtcttgctctgatgcccagactgtagtgcaatggcgtaatcatagctcactgtagcctccactttccg

SEQ ID NO: 19109 - DNA, 201 bp, Homo sapiens
agtgatgagatggaaagtgtctgtggtgagttggactcttggcgcttttggtaggagctaatggcatcttgatgtcaagtgtttggtatggaatcctgctrtgtgtgaatgtgtttgaaatgtgtgcctaggcatcctggtagagctgaaaaatgtttcctctgataatccagactgtttctgttaaatcacctctgtagt

SEQ ID NO: 19110 - DNA, 201 bp, Homo sapiens
tataaaaattagttaattgcaacatttccccatcagtttcatttttcatatgtgtgattttaaataattgactttgaagtgttttataaaatgacttttgrgtctctattttgtgttcttttcatgatgtgtttaacttggtattttagtttggcaaaaacaaacaaatccccccaccccactcctcaaaaatgggacttg

SEQ ID NO: 19111 - DNA, 201 bp, Homo sapiens
atgaattatagatctgttgataaattgagtaaattggatttgatatattagataatggagtgaggagatcaagtgtgaaaatcactacctataaaaattasttaattgcaacatttccccatcagtttcatttttcatatgtgtgattttaaataattgactttgaagtgttttataaaatgacttttgagtctctatttt

SEQ ID NO: 19112 - DNA, 201 bp, Homo sapiens
taagagaaacaatatgtaaaaatcccttagcatgaggcatggtgcaagctaagtctagcttagcttgggactaaggaaacgtatcattttaccaattttcrtagcacaaaggtcattatttcaaaaattttatgaaaataacttccaatcctcagcttccatctgaatagagtgaataaaacacagtggactttctcaggg

SEQ ID NO: 19113 - DNA, 201 bp, Homo sapiens
gattactcagatttgagtctttatggatcacttgaatcaatgcaaactgtttatacatcattattgctgatccatcaacaataaccatcatccatgataaycatccatgatggttatcgttgatgatgtggttgccaaagagactttataaatgtatgtgggtaaaaccagtcttgacatttgcctgtagagattaagtcc

SEQ ID NO: 19114 - DNA, 201 bp, Homo sapiens
gacattcatgggtcttgttcctgatgaatgaaggaaaaatgggcacagacgaagagggcccctgactgctgaaaaggacccatggccacttgtctcctggrcatagtctccctcatctcagtccccattcttttgaggactccatacgtaacaaataggttggaggcaggagaatgatggaattccacacatagatgagta

SEQ ID NO: 19115 - DNA, 201 bp, Homo sapiens
aacagccttgatcaaacaaaaggccctctttgaagaggggagtggtttctccactcagggaggcagcatggattgtggtggaaagaacatcacatgtcaaktcaggacattcatgggtcttgttcctgatgaatgaaggaaaaatgggcacagacgaagagggcccctgactgctgaaaaggacccatggccacttgtctc

SEQ ID NO: 19116 - DNA, 201 bp, Homo sapiens
tgagaggtcacccagcaatgataaagtatcagtttgttttttctggagagatatttccaaacaatagtcgtttgggagttataaacaggcatcgaagttamtactgaaaaggtgaatttgacaaatgaattatagatctgttgataaattgagtaaattggatttgatatattagataatggagtgaggagatcaagtgtg

SEQ ID NO: 19117 - DNA, 201 bp, Homo sapiens
ttacataaatgattatttgcaagattacttcttggctaaaactggattggttgaatgtggcagttttgagactattttctgaacaaagttttaaagctggytctatgtagattttttttttctccctgtgggtggctccaatgtatgaaatcatccccttagctttttttttttttaaatcttcaaataaataacaaaatg

SEQ ID NO: 19118 - DNA, 201 bp, Homo sapiens
atttgcctgtagagattaagtccagtgctgtccatgccatggatgattcatgccattggaaactgactgggctctgacaactgcccttaagacatagtccrttcaactttcagacaggtcaaggccactatacatcttgatgaataaagaagagcaggctataatggcaagagccaaaggagaaatagcaggaagcttccc

SEQ ID NO: 19119 - DNA, 201 bp, Homo sapiens
atgtaaatgtgtatcttcactctgtcatattgtaaccactagtcatatgtggctattgagcacttgaaatgtggcaagtgactaggaaagcaaattattamttttattttattttaattaatctaaagatacatttagatagccacagggggttagtggctaccatgttggaaagcatagtattgaagggaaacatttaca

SEQ ID NO: 19120 - DNA, 201 bp, Homo sapiens
ataaaaattctccattagatatcttttaaccacaaacaaaatatgccacctctgtattcactaaagttaccagataactcctgattgccaatgggcacttytccttccttctcacactggatgggcgtttagattgcacttgactctggagaccattcctccttcttgacaccactcccttggctgccatgactcccagca

SEQ ID NO: 19121 - DNA, 201 bp, Homo sapiens
ctgaagccttatagtctttaagaaagactcttctaatattttgttgtgttctcccctccatattctattgtttatgtcaattatattggaactatttttamacagtagaactgggacttctctggtaatgaacagagctctgtcatgtaagggacttcaatgaacacttactaaatgagtgaataataagttaaccaataa

SEQ ID NO: 19122 - DNA, 201 bp, Homo sapiens
aggaattgaaaaagtgaaaatccctcagctatctatttatatatttaaaacaatactaaaagtcatatagatatatccagacctttggctattgatgtttmtttttcatttggtacaagcaaaaagacatcaaaataaagaggcacagaaaatttaaatttcctttgatcttatccacctgttttccatcttgccagttct

SEQ ID NO: 19123 - DNA, 201 bp, Homo sapiens
tgagacaggaaaattgcttgaacccgggaagcagaggttgcagtgagctgagattgcctcactgcactccagcctaggtgacagagtgagactccatctcaaaaaaaaaaaaaatttttttcaagcaaaaatttataacttaacttggccaggcacattgtctcacatctgtaatcctagcactttgggaggctgaggttg

SEQ ID NO: 19124 - DNA, 201 bp, Homo sapiens
ttcagaaagatactgaagatgagcaaggcgcacagcagcctgctggctaatttagagcacctatctatactaaaaagcactctctgtagactaagaacacrgcctatgtagagttcggtactatctgaggtttcatgcatcccttggtgatcttggaatgtatcccccatggatgagtgcagatgactgtttttatttctg

SEQ ID NO: 19125 - DNA, 201 bp, Homo sapiens
ttgcttgaacccgggaagcagaggttgcagtgagctgagattgcctcactgcactccagcctaggtgacagagtgagactccatctcaaaaaaaaaaaaawtttttttcaagcaaaaatttataacttaacttggccaggcacattgtctcacatctgtaatcctagcactttgggaggctgaggttggtggatcgcttga

SEQ ID NO: 19126 - DNA, 201 bp, Homo sapiens
taatttttaaattttttgtagagacacgatcttgttacgtttcccaggctggtctggaatcctgggctaaagtgatcctcctgccttggcctcccaaaatkttgggattataggcatgacccccccatgactggcctgaaaataattttagatgagaagtaatgttgggtaaatataagatggcgacctatgagcaatttg

SEQ ID NO: 19127 - DNA, 201 bp, Homo sapiens
agtctcaccattctcatgactttagtgaccctctgtggcctgatgagacttaaatctgtgtttacaacccagatttttgcccacacttgagtcttgtatastcaactacctttggacctctgcaagttgccttgaactcaaggtgtcccaactgaaaataatcatcttccctcctgaactggattttccttctatatttgc

SEQ ID NO: 19128 - DNA, 201 bp, Homo sapiens
ccaggctggagtgcagtggcattatcacgctcactgcagcctcccacttcagcctcccgaatagctgggactacaggcacgtgcctccatgcctggctaatttttttttttttttttttaattcttagtacacataaacccttgccatattgcccaggctagtctcaaacccttggactcaagcaatcctcccaccttacc

SEQ ID NO: 19129 - DNA, 201 bp, Homo sapiens
acttaaatctgtgtttacaacccagatttttgcccacacttgagtcttgtatactcaactacctttggacctctgcaagttgccttgaactcaaggtgtcmcaactgaaaataatcatcttccctcctgaactggattttccttctatatttgctagtctacatattttatctttattaatagaaatagcatttaacccac

SEQ ID NO: 19130 - DNA, 201 bp, Homo sapiens
gtgagaattcccctgtacatacagaatgggtcattctgctatttttaggacagatttgatacagtagcttttacaaaaagataagccaaagtttttagacwtcgtgttagtggactgtcattctgtatttaaacagaacacaaaagaaagctgtctgagaccatgacacagtgaaaacagccttgatcaaacaaaaggccc

SEQ ID NO: 19131 - DNA, 201 bp, Homo sapiens
catttaccctatccaccctatccactgacatgggtggttttcagctacacatacatggattgtggtgtatgcatttctctcacctgtctttaccaacatcwtcttctttcttttgtttcctattcacctgcaatgagtctggataaaacccctgttcttttattttgtggacactaatgatttgatgtcagcatctcacct

SEQ ID NO: 19132 - DNA, 201 bp, Homo sapiens
atggctccccagtgaatacctcggtggtaatcaagaataacattgaataatcctgacacgaaatcttgtgtctttctaccattcatctgcctctggtagtsttgacctggcagtggaagctctgaggcatgctgaagcagtttactgggctcattgtttctgattgacaggacatgctgtttgttgacagaatgacatcgt

SEQ ID NO: 19133 - DNA, 201 bp, Homo sapiens
agccccagctcttcacctagttctatgactttgagacatccagttaaccatctttgagcttcagttttctcatctatacaaatggtgtaaaaatacctatytcacattgtgcttgtgtgattatactttgtaaactaaaaaaagttaccaaaatataaggcattcggtatccagttaacaaaatggtagtggttttctgaa

SEQ ID NO: 19134 - DNA, 201 bp, Homo sapiens
gaatcagactgcctcagtgtaaatctgtgctccactacctactagctgtgagatttgttcaagccttgtcgtcctcatctatgaaatggggccattgatamcatctcacaaagctgttgtgaggatatgtaaggtaatgcatgggaagcacttaaaatattgctggcaagttctgggtgaacaaatgctgtcatttgcttt

SEQ ID NO: 19135 - DNA, 201 bp, Homo sapiens
ctcagtattacatcagcttttctctctttttcctttatcaactcccaaagaggagttggggctgagctgtcttacagttgaaacttgataggccatgaagkcctttcaggaaaagtgatttgttctttcagaatcgctaattcagtcttgtgatgccccacaagctgttctcagttttttgttccacgctagagcccagat

SEQ ID NO: 19136 - DNA, 201 bp, Homo sapiens
ctgctttgaccaggacagttctgcaagatgagtaattgtcccaccccaaatggcgatagcgtcctctgaagaacctctgagaagtgtggctttgcttatamtgttctgtagtgctgatggactgcctgattgtagaggtgagaggtgcataatgaaaaaacaagtgggatgtaagagccttgggggagaaagacaggtgac

SEQ ID NO: 19137 - DNA, 201 bp, Homo sapiens
tctcttagtagaaaagaagttccaatagaaataccagaagccacattctcagtattacatcagcttttctctctttttcctttatcaactcccaaagaggmgttggggctgagctgtcttacagttgaaacttgataggccatgaagtcctttcaggaaaagtgatttgttctttcagaatcgctaattcagtcttgtgat

SEQ ID NO: 19138 - DNA, 201 bp, Homo sapiens
tgacattgccattacttttatttaccatggaaatttcaaacctaggatataataacagcacatctgaattatatcatttcagcatttggctgctacctctktgaccctcacatgagtctccgtttcctcagctgacaaatggagtacagaccagatagtgccttcgatcctcttaccgctaccactctgattgaaagcagc

SEQ ID NO: 19139 - DNA, 201 bp, Homo sapiens
tactggtgttccacaggtgggggtcagggatgatgtacatactgctttgaccaggacagttctgcaagatgagtaattgtcccaccccaaatggcgatagygtcctctgaagaacctctgagaagtgtggctttgcttataatgttctgtagtgctgatggactgcctgattgtagaggtgagaggtgcataatgaaaaaa

SEQ ID NO: 19140 - DNA, 201 bp, Homo sapiens
cacaaagatagacccatgcatgacctgatttttttttcataaataagacttttaatgacttatacttgcacatagttataactttaaaaaggagctttttyttttcttttgtttccactcaaggcagcctcttgttctgtcacccaggctagagtgcagtggtgcagtcatagctcactgcagcctccatcttttgggctc

SEQ ID NO: 19141 - DNA, 201 bp, Homo sapiens
ttagcacaagaggaactaagagttttctaacatcgctaggagaatgtcacaggctaaagagagaaatagagggtagaaaggaaggaaaaaaggatgaagtsaatgaaggggttgtagagatggtcagaaaatacagaaatgcacctggagaagggaatcagagagcttccagtcccacacgtcctcctgcctgatggtcat

SEQ ID NO: 19142 - DNA, 201 bp, Homo sapiens
gtcttgtgtgaccacattcatttatgaggaaactgactggaactagggattttttttctccttttttggggctgtagaatattcaccccaccaacaacccmtcaactctgtggacagctgatggtcctgtaaggaaatgccatttaaaaccttgatttcatcaataatatactctaactaaatttgtgattgcctagaagt

SEQ ID NO: 19143 - DNA, 201 bp, Homo sapiens
taaataactacatcttttcttaggggatcatgaatttagtttgtcgataattgaggcccatatctgcttcttcctcttataaccctactgggggctgccthttccaggaaaagtggagtaattccattatgcctctccttagaatctcagtaaaagactagtggtagagttagaaatcactaacttattgtaaaatgtaga

SEQ ID NO: 19144 - DNA, 201 bp, Homo sapiens
agagggagcactttgtgtaggaaaaggatgatgaacataaccaaggaacaattctagctcaatattttgatggaaatgttaaaatgacatgttactaagtyacacctttgtagtccatttatgactcataaagtgctttcacatacattatttaatgtgttactcaagttagccccgttgagttgcttttattgtctatgt

SEQ ID NO: 19145 - DNA, 201 bp, Homo sapiens
gtcttttatccctcgcccccctcccacccttcccccaagtccccaaagtccattgtatcattcttaggcctttgtgtcctcatagcttagctcccacatamcagtgagaacatgcgatgtttggttttccattcctgagttacttcactttgaataatagtctccagtttcttccaagtcactgggaatgccattaattcc

SEQ ID NO: 19146 - DNA, 201 bp, Homo sapiens
tctggtcctggactctttttggcaacctaccttttaaaatattcctcatagtcagtggttaaactctgtatgctttgttgagggaggcattacattgttcttttttttttttttgaatgagtacacagtatatgcaggaaatgagttgtcagaaatcaaattagctaatgtggtggtgtggtgtagtgccagatacttggg

SEQ ID NO: 19147 - DNA, 201 bp, Homo sapiens
gtgggctatgactgtgccactgcactccagcctaggtaagacctgtctctaaagaaaaagaaaaagaaatcatattaaaagtcaggattagctgaatgaarccctcaggagaactccctccttcaatgataccttcttttttccaaattctctttttctactgacttttccctatcatcagatatgctcaagtttctccca

SEQ ID NO: 19148 - DNA, 201 bp, Homo sapiens
cctgaacctctccctaaatatgccactgtttgtgtcttaattgtatgttttgttcttaccttggtcacctttgaagttccccccagaccctcctaagaacrttggattcattgaggtaaataactgttgcaggccttctaatcttttctcacctgaatctgaattcatctcagaacacccctgacacagcccactggcttc

SEQ ID NO: 19149 - DNA, 201 bp, Homo sapiens
caccatgcctggcaatttttgtatttttagtagagataaaatttcaccgtgtttcccaggctggtcccaaactcctaacctcaagttattcgcctgcctcrgcctcccaaagtattgggattacagatgtgagccactacacctggctgaatatggcatattttttttcatctttttactctgattagagctaactataac

SEQ ID NO: 19150 - DNA, 201 bp, Homo sapiens
tttgtgtgtgtgtgtgtgtgtgtatgcgtgttttgcctgtttattgtaatgatacttacaacttgataattaaaactcagtatctaatttttaagcagtcwtatttatttatttatttatttatttatttatttatttatttatactattttactttaagttctagggtacatgtgcacaacgtgcaggtttgttacatat

SEQ ID NO: 19151 - DNA, 201 bp, Homo sapiens
ttatttatttatactattttactttaagttctagggtacatgtgcacaacgtgcaggtttgttacatatgtatacatgtgccatgttggtgtgctgcaccygttaactcgtcatttatgttaggtatatctcctaatgctatccctccccctccccccaccccacgacaggccctggcgtgtgatgttccccatcctgtgt

SEQ ID NO: 19152 - DNA, 201 bp, Homo sapiens
gttctccacatctgcaactctgtagctaaacatggcaggagaaaaacacaactatactgactagcctcgcttgacattcatgaagccaatctcaagcttargacttgcttcctagtctgtctattgcctctcttgcttccttatatcttctcctctttcctcaaacctctgacatcaccttctcacatgtagagtgagctt

SEQ ID NO: 19153 - DNA, 201 bp, Homo sapiens
ttgcaattggtacactatttggtctgcaggaagaaattcaataaatatatttgatattaaactctgtattaatgtatatcattagttttaatgaatgcatwtgcagctataccagatatagctgtttgaatctggacaaactgttttacttctggggctagagtcctcaataatatttctcactgggggcgctattggcat

SEQ ID NO: 19154 - DNA, 201 bp, Homo sapiens
aagggttcttatggctttaggtctaacatttaaatctttaatccatcttgaattgatttttgtataaggtgtaaggaagggatccagtttcagctttctamatatggctagccagttttcccagtaccatttattaaatagggaatcctttccccatttcttgtttttgtcaggtttgtcaaagatcagatggttgtagat

SEQ ID NO: 19155 - DNA, 201 bp, Homo sapiens
gatcctaccgcctcttcaccatccctcaaatccctcacctatttacttcctcagcttatattttatggccatcattaatttcacttccctgcatacatacrcgctcagcagcttggcccctttatctggctctgttgtgcttggcaaggccctgatcctggttaaatccagttctccacatctgcaactctgtagctaaac

SEQ ID NO: 19156 - DNA, 201 bp, Homo sapiens
acacacacactcatacactcacagacatacataaatattgtctagaaaggaattttcagtttcagatttttcaagggactaaacattttttctttaagctrtattaaaaatggattttgaagattaattttccacagacacacggatgcttgaatgtcatatatttggtcctccaagcctgagtcaaccccaagctagtgc

SEQ ID NO: 19157 - DNA, 201 bp, Homo sapiens
gttttcccagtaccatttattaaatagggaatcctttccccatttcttgtttttgtcaggtttgtcaaagatcagatggttgtagatgtgtgatatcattwctgaggactctattctgttccattggtctatatctctgttttggtaccagtaccatgctgttttggttactgtagccttgtagtatagcttgaagtcagg

SEQ ID NO: 19158 - DNA, 201 bp, Homo sapiens
tcaggctggagtgcatggctccctgcagcctcaacttcccaggctgaagagatcctctccgcttaaccccacaagaagctgggactacagacacataccascactcacagttaatttttatattttttgtagagatgaggtttctccatgttgttcaggctggcctcaaacccctgagctcaagtgatcctcccgcctcag

SEQ ID NO: 19159 - DNA, 201 bp, Homo sapiens
gatttttcaagggactaaacattttttctttaagctgtattaaaaatggattttgaagattaattttccacagacacacggatgcttgaatgtcatatatytggtcctccaagcctgagtcaaccccaagctagtgccagatttattttatattttcaacattttttctcagtccatctctagtctagtgatcttcttcac

SEQ ID NO: 19160 - DNA, 201 bp, Homo sapiens
aagtcatgcaggatacattgtctgttcaacatgtaatttatgcagtcaaagctctctctacttcaggatgtgctcagaaaaatgcagtagaagcctaagawcataacagctagtgaatgatttgctttttcctttcaggtgtcctagcggctacaccggaaaatattgtgaaatggcgttttcaaaaggcatctctccagg

SEQ ID NO: 19161 - DNA, 201 bp, Homo sapiens
agatctctactgctttctcctgtgggcatttagtgctataaatttccttctacaccctacttcaaatgtgtcccagagattctggtgtgttgtgtctttgstctcattggtttcacagaacgtctttatttctgccttcatttcgttgcttacccagtagtcattcaggagcacgttgttcagtttccgtgtagttgagtg

SEQ ID NO: 19162 - DNA, 201 bp, Homo sapiens
tctacaccctacttcaaatgtgtcccagagattctggtgtgttgtgtctttgctctcattggtttcacagaacgtctttatttctgccttcatttcgttgyttacccagtagtcattcaggagcacgttgttcagtttccgtgtagttgagtggttttgagtgagtttctggatcctgagttctaatttgattgccttgtg

SEQ ID NO: 19163 - DNA, 201 bp, Homo sapiens
gccttgtggtctgagagacagtttgttataatttctgttcttttacatttgctgaggagtgctttacttccaactatgtggtcaattttggaataagtgcratgtggtgctgagaggaatgtatattctgttgatttggggtggatagttatgtaagcagagattttactaagcttcctaaatagttttagattgagaaaa

SEQ ID NO: 19164 - DNA, 201 bp, Homo sapiens
ttataatttctgttcttttacatttgctgaggagtgctttacttccaactatgtggtcaattttggaataagtgcgatgtggtgctgagaggaatgtataytctgttgatttggggtggatagttatgtaagcagagattttactaagcttcctaaatagttttagattgagaaaataaatttattgcttttttatggatt

SEQ ID NO: 19165 - DNA, 201 bp, Homo sapiens
gcacctccacaggtcagcttccttctgttttgttgatctggaattctcatagtatttttggtaaacttcaagttcgtatgctgagcaacctaccttttttwaatttttttatttttatttatttatttattattatactttaaattttagggtacatgtgtacaatgtgcaggttagttacatatgtatacatgtgccatg

SEQ ID NO: 19166 - DNA, 201 bp, Homo sapiens
gatgttgtcatgtctgcagcatctttgtctgcattttctgttctgtgccaacgcattgcaaaccatcttgtttttaatttttttttttttttttttttgaracagggtctcactctgtcacccaggctggagtgcagtggtgcgatcttggctcactgcaactccacacacccccaccaggctcatgccatcctcccacct

SEQ ID NO: 19167 - DNA, 201 bp, Homo sapiens
cagctttgcgtggtgatttatttactagaatgtatgatttccctccacacctcttttgattggttggtacccatgccttagggtgttgttaaatattttcratatcaccctaattttcaatgagccatgcctgacttcctttctggaacctgggcttatttcagtgacagagaattaaagagaatgtgacatcatggaatg

SEQ ID NO: 19168 - DNA, 201 bp, Homo sapiens
acaacagggtttgtgctcctatgggaatctaatgcagccactcatctgacaggaggcggagctcaggcactaatgctcactcacccgcctctcacctgctsctgtgtagcctggttcctagcaggccacggaccagtaccagtttgtagcccagggactggggacccctccctcatggaacctgttcgtagtttgccatgc

SEQ ID NO: 19169 - DNA, 201 bp, Homo sapiens
tagtcccagctactcgggaggctgaggtgggaggatcacttgagcctgggaagcagaggttgcaatgagctgagatggcaccactgcactccagcctgggbgaccgggggcaaaaaaataataataataatgcagctgggcacactccaggagccagggtggggaagggagaggagaacattgagatggtataggtcattt

SEQ ID NO: 19170 - DNA, 201 bp, Homo sapiens
gaccttagggccatagaccccgaaacatgcattctccagaactgagtatgcaactgtttgctttcgaccttacagcacaggctttgggagaaaacagttamgttcaggtcctaactccagtaatgaatttcaagcttcttgttattgtttttcttcctgaaagacaaagggagttttatgccatggtattttgaggacaat

SEQ ID NO: 19171 - DNA, 201 bp, Homo sapiens
gtgtagaaatcacgtgcttagtcttgaattatgattcacctttactgaatgtcccttctcttttctttactcactgtcgaacaggaacccaaaggatgtartttttggcagatgtcctttgtagggttcagtatttctcactcacccctttaagaccctaaagggagagttattaatagtttcagaaagttgagggaaatc

SEQ ID NO: 19172 - DNA, 201 bp, Homo sapiens
aaaccaagagggtttttttatccttccatggtttcaaaatctggaaggacaatttgtacagaccctgagatagaaggattcctcagctttaatttcatgawcgatttgcctttcattgattcttgaggatatgaatgttttagaaagcaacagtgtatgccttgattttaagaggcaatgagccttttccttccttcgttt

SEQ ID NO: 19173 - DNA, 201 bp, Homo sapiens
ccgaactggacatggctcgaggtgggtgaccattactgctgtggtggaaatgggttctgtacccttataccttgctcttcttcttcccaggatggcctgaycattcactcacccatccatccttccctccttccctccctccttctctccaacaagcatgtattgagtacgtaatagttattaagcactgggatacaccag

SEQ ID NO: 19174 - DNA, 201 bp, Homo sapiens
taatgtacaacatgcagcaagaacaagtgtggtgggaatagcctggcaccagagattaagggagtcctagattcagctgtttgatgggtggccctctggcytggagcaagtcttgttcccttttggggcctcagttccctcatcttaaaaaatgaaggtttttgagcttagtggtctccaggattgcctcaaagctttgcc

SEQ ID NO: 19175 - DNA, 201 bp, Homo sapiens
gttcacaccaaccctgaccggagatgcaccgaactggacatggctcgaggtgggtgaccattactgctgtggtggaaatgggttctgtacccttatacctwgctcttcttcttcccaggatggcctgatcattcactcacccatccatccttccctccttccctccctccttctctccaacaagcatgtattgagtacgta

SEQ ID NO: 19176 - DNA, 201 bp, Homo sapiens
cctcggcctcccaaagtgctgggattacaggcatgagccaccacactccacctccaaccacaattcttgttttaaaaaatgaaaatagagtgaaacagaartggtagaatcaagtcaccttgctcattcacagtcatgtgtggctaggacaccatgtggtccagtctgacacaggctgatcctttcccctcaggacccatc

SEQ ID NO: 19177 - DNA, 201 bp, Homo sapiens
agggttggatgcagagaaatagtaagaaaggatggaggatggaggggataaaaagatcacatgtttggtgaatcctcttttaaaaacacttagaagatttyccctaaactaattatctggcttaatgctaactgcttatttgctgaccttctgctttatttacaaatttaaagtggggccaacccttcctgttttccttta

SEQ ID NO: 19178 - DNA, 201 bp, Homo sapiens
atgtgttcagaacacttacattagcctacagttgggcaaaagtcatctaacacaaagcttattttacaataaagtgttgaatatctcatgtaatgtattgracactatactgaaaatgaaaaacaaaatggttgtatgggtactcaccattaacacacacagctgaaagcacactggacctaaagaatatttgaactaaaa

SEQ ID NO: 19179 - DNA, 201 bp, Homo sapiens
aggacacacataaaatgaaagcaaagggatgaaaaaaattctatgcaaatggaaaccaacacagagcaggagtagactttaagtcaaaaatagactttaartcaaaaactgtaaaaacagacgaagatcattatacaatgataaagggatcagttcagcaagaggacataacaattgtaaatatatatgcacccaacacca

SEQ ID NO: 19180 - DNA, 201 bp, Homo sapiens
aagcagccaagcttgtgtttgccagaggacttaggaggatgtggataaaatcaggctgaggcctttttttaaaggcccaagctggagctattgggattgtyccctcagaggaaaatcaggagtttgggccattggcttcatggagaacctgtactttgtaccaaggagaagtcatttctacttggtttttgaaactgcatt

SEQ ID NO: 19181 - DNA, 201 bp, Homo sapiens
tacataatataaatagatataaactgaggcatcaatagcatgtaacttggggggagcagagggaaaatcagagtttttatgcaagtaaagttacattgtgracttataacagactgttacaaattatttcgtgtaagctcctggtaaccaccaagaaaatacctatggaagttatatatataaaaaaagaaaggaatcaaa

SEQ ID NO: 19182 - DNA, 201 bp, Homo sapiens
tcataaagtcaaaaaactgttaagtcgaggtatggtaacttggggattatttgtacttgttagatcatcaaattcagagtcactatctttagtttagtgtwtatctttagtctttagtttttatattttatctttagccattatctttagttgaagtcattatctttacttaaggggatgacaaaaaccttgctaaattta

SEQ ID NO: 19183 - DNA, 201 bp, Homo sapiens
gcagagggaaaatcagagtttttatgcaagtaaagttacattgtgaacttataacagactgttacaaattatttcgtgtaagctcctggtaaccaccaagraaatacctatggaagttatatatataaaaaaagaaaggaatcaaaacctatcgatacaaaaaaaaaaaagaaacaaaacaaaagaaaaccgcaagggaga

SEQ ID NO: 19184 - DNA, 201 bp, Homo sapiens
atcataaagtcaaaaaactgttaagtcgaggtatggtaacttggggattatttgtacttgttagatcatcaaattcagagtcactatctttagtttagtgwttatctttagtctttagtttttatattttatctttagccattatctttagttgaagtcattatctttacttaaggggatgacaaaaaccttgctaaattt

SEQ ID NO: 19185 - DNA, 201 bp, Homo sapiens
acggtgcagtaacccaaagacctgttaattgatggtctaaactccagcctcatatttgacttatacgggaggtcttaatgtttccggcttattgccatatyccatatgtaatttcctccattcctttcaaggggaaagccactgagtgttacccagctgccactgctgaccggttgcccacttcactgagggcctttgaag

SEQ ID NO: 19186 - DNA, 201 bp, Homo sapiens
caagtaaagttacattgtgaacttataacagactgttacaaattatttcgtgtaagctcctggtaaccaccaagaaaatacctatggaagttatatatatwaaaaaagaaaggaatcaaaacctatcgatacaaaaaaaaaaaagaaacaaaacaaaagaaaaccgcaagggagaaaaagagggacaaaagaacaagacac

SEQ ID NO: 19187 - DNA, 201 bp, Homo sapiens
tggtttccttgctaagatttttgcagtttattctgtgtggctgtgtgtgttggtcccttgccaataatcctagactcacccatcccggcacaggcttgttwctgtgggccaagccaaattctgaagcagcgcagttgtttgttgtctgaactcagtcttccccaacacatacttttcttgttgtcctgcacacaccctctc

SEQ ID NO: 19188 - DNA, 201 bp, Homo sapiens
ttatgctcacagaagtcagaggcctggtttgtgtcatattcatgtagaaccatctaccacctgcatgatttttacatttttttggtcttaaactcatactkcctgtgatattttctttcatatttttctctttaaatcagccaacttttggtctcaaataaaataatttaaaacagaaactttgtacctttctataagcag

SEQ ID NO: 19189 - DNA, 201 bp, Homo sapiens
tgtacaggacagtcatgacctacacctggctaaatccagtagtcatttttcagtcttctttctggacccgtcagcatctattagtacaaataacgactacktctgttattattattattattattattattattattattattattatactttaagttctagggtacatgtgcacaacgtgcaggtttgttacataggtat

SEQ ID NO: 19190 - DNA, 201 bp, Homo sapiens
atggggtcagcgtcacacagcaccattgtttcagaacaataggagggagaaggagaggggatgtgagagctatttaagtgctgttgccattcagcacttgytggttgagagaggaaggcagtggggcagggcttggagggggcagagagagggcacagagcagacagggactcagcagatgttcagggaacggcgtggtgg

SEQ ID NO: 19191 - DNA, 201 bp, Homo sapiens
aaggctttcactagatgctagttatacccccagtaactatgaacaagatgaaatttttaccctcaagacttccacagccccaaacaggtcaacacacacayacacacacacacacacacacacacacacacacacacacgtgcacacacatcacacccctgcagcactgtatgcatacgtgcccagagtatctgtgctgaa

SEQ ID NO: 19192 - DNA, 201 bp, Homo sapiens
tcaagatgaagtcagatggtgtcttgggctggattctcaagaagcagaccctgagatgagggcatcatgtaagcagtttatttagggagatgctcctaatragacccagaaataaatgggacaggataggaaagaggagaagggaagcaagggtgagatttcagggaccatcttagctccaccctgatcttgacctcggag

SEQ ID NO: 19193 - DNA, 201 bp, Homo sapiens
actgcctgttttattcatcaatgaatttccacaatgtctagcacataggagatactgcagacacatttgttggttggttggatggatggatggatggatgratggatggatgaatggatggatggaacgacggacagacggatggacagagcagatggacaggttgattgacagatggataggtggtggatgggcggatgg

SEQ ID NO: 19194 - DNA, 201 bp, Homo sapiens
gagtgtggtggcatgcgcctgtaatcccagcttcttgggaggctcagacaggagaattgcttgaacccaggaggcagaggttgcagtgagttgagattgcsccaccgcactgcagcctgagcaacggagcaagactccgtctcaaaaaaagaaagaaaagaaaagagaaaagaaatgaaaccaggtactgtagttcataca

SEQ ID NO: 19195 - DNA, 201 bp, Homo sapiens
cagacaggagaattgcttgaacccaggaggcagaggttgcagtgagttgagattgccccaccgcactgcagcctgagcaacggagcaagactccgtctcawaaaaagaaagaaaagaaaagagaaaagaaatgaaaccaggtactgtagttcatacatcatcattccattcatagcaaggacccaaagaagcaggtgatgc

SEQ ID NO: 19196 - DNA, 201 bp, Homo sapiens
ctggtgattgcaggtccccctggggtccccactcatagatgcccagctctcctgcctttccagggaagaaggagtatcctgttagagcttccttcatggcmccggtacagtgaaggacagtgacccttcaggcagggagtggaatcttggctccccttgaggccattcacaactgaggatttggaccacttcagagtgaag

SEQ ID NO: 19197 - DNA, 201 bp, Homo sapiens
aaggagtgtatattttaagctttttaaaaattatatttatttttttattttgagatggagttttgctcttgtctcccaggctggagtacagtggagtgatytcagctcactgcaacctccccctcccgggttcaagcaagtctcctgcctcagcctcctgaatagttgggattacaggcgtctgtcaccacaaccagctat

SEQ ID NO: 19198 - DNA, 201 bp, Homo sapiens
cctcatgcctcacgcagcacccatctaagtaaggctgtttggggcaatctgttgtttccctaggagttttctggttgcttttggatacatggttatatgaraaaattgtgtatgtctgttacgagggttcagggagctgctctttggagctgcaggaccagcagacacaaaaaccagaaagcacactgttccttcggcttc

SEQ ID NO: 19199 - DNA, 201 bp, Homo sapiens
cacagtctagagccttgaattcactttggggaaaacagaaaaagctgtcatgatgtttcagggctggaagaggtctgagaatcccattgatctcttaggcrgagacgaagacactatggctcgaagccagaaaataaccttcccaggctgggcgcggtggctcacacctgtaatcccagcactttgggaggccaaggcagg

SEQ ID NO: 19200 - DNA, 201 bp, Homo sapiens
ctgtcttaggacattggacctccgagcagcctgcagatcttgggaattcctctgccccctaaagtattctttgtctttaatccagttgttacagtgagtgwacctgatttgttccagatgtcctaagatttagtgattccggaaactactcctaaagtcaaggctgatgaggatttgaattcctctgttagctgggaacca

SEQ ID NO: 19201 - DNA, 201 bp, Homo sapiens
tcttgtaatagtgaataagtctcacgagatctgatggttttataaaggggagttcccctgcacacactctcttgcctgccaccatgtaagacgtgactttscttctcattcaccttccgccatggttgtgaggcctccccagccatgtggaactgtgagtcaattaaacctctttcctttataaattacccagtctcaagt

SEQ ID NO: 19202 - DNA, 201 bp, Homo sapiens
caaacaaatgcataaccacaacttcgataagtgccatgaagggttgatggggcacatggggggtggggggctcataatgggaggatttatttcacctaggsagggagatcaggaaggatcccctggggacatgatagtcagggggctggagaatgtgggttatgttggagaggaatgagttttgaagggataggagttgct

SEQ ID NO: 19203 - DNA, 201 bp, Homo sapiens
tttcatgtgagcctctaaacagtctagtgagttaggcaaggtagaaccctgtgctttacatgaggaagctgaggccctagagctaactgattgcccaaggrcacatggctagttaatggggctcctggaacttgtagttctgatctcggtttctgccccccaccttcaactaccccctgtgcctcatgttatattagtgta

SEQ ID NO: 19204 - DNA, 201 bp, Homo sapiens
tctcaaaaggctaactatgacttttgagacttataaagtctcaaaagactttataagaggttaaaagggcaattgaaatgtaggattattttaaagacctmcgtatttctagaacttcaactacagacctcttgttaactctgattcccatgtctacaacctaagaatgatacattatgtttagtgaatagtgattcggta

SEQ ID NO: 19205 - DNA, 201 bp, Homo sapiens
tgttgctctaactgctgatagctgttcagctgggactgcttgcagctttttaatatttacagcattgaacggggttgccttgttctttatgttaaaatggraccaaaatcactttctgtggaaaaccttcactctgcccaccgatgagcactgggcatacattgagcaggtcaacggcgtttgttcaggcacatattctgt

SEQ ID NO: 19206 - DNA, 201 bp, Homo sapiens
atgttatggatgggataaagaaatgttacaatgaaaccaggaaatcagtggcagaattaaaatatgttatagtcaggaaagagcagaatcagcagaacagraaattgatttaatgatgcggaggtgtttttgagaggctctgagaattcagagaaaaagaacaaagcaataaaaaaggatgacatgaggactatattgtgg

SEQ ID NO: 19207 - DNA, 201 bp, Homo sapiens
agctacaatgaagttctacaatctgttgttctcaattttcctggcaggaaaaaaaaaatcttttctgagtaggaaggtttgcctttttagaacaaacacgwtcttccctgcgtgattcttctgaatgcctggccttctgtcaactatcagtctgaaggggaatttccatagagcctcgccaccaaatttaaattaggcaaa

SEQ ID NO: 19208 - DNA, 201 bp, Homo sapiens
caggagttgggtgaggcaggtgtggtatgtgggtgaagaggaccagggtggggcaggaggaagcagtgaagacagtgggaagatggagggttccagcttcmcccacagggcagcaggctcacagcagcattcagtggttgccaggtgggagtgaggcccagcacactctattttctaataaaaccgagagatcttatgact

SEQ ID NO: 19209 - DNA, 201 bp, Homo sapiens
ggcatctggcccaaagggctggaggagtgcggtatgggattcagactttttatcaggtaggcagtaagtgaggtcttgactgagagaacagagaacgaagracagaggctagagacatcttagaggaagaacaaagaaacagtgctgacaggccaggaaggtcagagactcagtgttgggactgctggaagaaagacaagt

SEQ ID NO: 19210 - DNA, 201 bp, Homo sapiens
tcctctactcctgatcatgctctagcgcacagagcactgtaagctcgtgaggaatgtgcttcgtacctggcatcggttggccataagtcactgaatttggstaataagatgttgcattgtctctgatctccttgagagactgagatagatggataggccctaggtccttatttcctccatgggagggtattgtgggagggg

SEQ ID NO: 19211 - DNA, 201 bp, Homo sapiens
tgtttgaatgacttaaagagattacatccaaattgccaagacctagtaactgctctttaactatttaccacccccttctcctccataaagtgcagttggcrccaaggcctcagagacacgggagggtgtggcaaaccacgaggctgagagtggaggtgtgggagaggctggagggaagctatggccttggaattttattgc

SEQ ID NO: 19212 - DNA, 201 bp, Homo sapiens
agtcttttccgcccccttcctgtctttaatccagtgccccaagccccctggtgactttaccttgaacttcctgtataacgccaggtagaaaagcctcaccyggctggaagcccactcgaggctctaacacaacagcaagctctttatcttgctttgttggtcttccccatccgcttatcagatggaaactcggcattcctc

SEQ ID NO: 19213 - DNA, 201 bp, Homo sapiens
aaacactgggtgttttaaaaacaagttgtttgaatgacttaaagagattacatccaaattgccaagacctagtaactgctctttaactatttaccaccccmttctcctccataaagtgcagttggcaccaaggcctcagagacacgggagggtgtggcaaaccacgaggctgagagtggaggtgtgggagaggctggaggg

SEQ ID NO: 19214 - DNA, 201 bp, Homo sapiens
gacttggagacctggagctggaatttgagggtcaagacagtctctgagccaagatgttgggtttgtggcagacccaagactatgcctgccttggcttccargccccccctggagaacttctgtggttcgttcttgtgatagcattgtcctttaggatgccatcattatgtgaatgtttcctgctatgattgtccaaaggga

SEQ ID NO: 19215 - DNA, 201 bp, Homo sapiens
aatggccttctttgtctcttctgatctttgttggtttaaagtctgttttatcagagactaggattgcaacccctgccattttttgttttccgtttgcttgrtagatcttcctccatccctttattttgagcctatgtgtgtctctgcacgtgagatgggtctgctgaatacagcacactgatgggtcttgactctttatcc

SEQ ID NO: 19216 - DNA, 201 bp, Homo sapiens
ttaagtttggatgaaatgacatgaatatactattatgaaccagtgcctacactaggacattttttttattgttatactttaagttccaggatacatgtgcygaacgtgcaggtttgttacataggtatacacatgccatggtggtttgctgcacccatcaacctgtcatctacattaggtatttctcctaatgctatccct

SEQ ID NO: 19217 - DNA, 201 bp, Homo sapiens
ctcttcttcatcaacatgtggcagaaggtaaggagggcatccctgtaaaaagagcagttgttccatctggtgcgcttgctgactttcattattgcctggamtaggcaatgattctacaagcactaatcctttctgtggactatcatttagaatgattagaacttttttcttcctgggcttagaaaacatgttggtatagcc

SEQ ID NO: 19218 - DNA, 201 bp, Homo sapiens
cacctcagcctagatttcgttgtccctattattatcagcattttggtcaaagccattcaacaagtctctaggaagttccaaactttctcacatttcctgtyttcttctgaaccctccaaactgttccaacctctgcctgttacccaatttcaaagtcgcttccacattttcagatatcttcacagcaatagccccctcctg

SEQ ID NO: 19219 - DNA, 201 bp, Homo sapiens
tcacgtggttcccattgtgctgaattgcacactgctcctgaaagtgctgcccactccctaatcaccagaggcaggctcagtcaataggacagacagatgakgagtagacccccaagaatcacccaccagaggaggagcatcaacaccagggcagagaggcagcaaccgcaatcaaaagaactaataccagagggtgcagta

SEQ ID NO: 19220 - DNA, 201 bp, Homo sapiens
agaaatgttacaatgaaaccaggaaatcagtggcagaattaaaatatgttatagtcaggaaagagcagaatcagcagaacagaaaattgatttaatgatgyggaggtgtttttgagaggctctgagaattcagagaaaaagaacaaagcaataaaaaaggatgacatgaggactatattgtggaaggtagaaactggaaaa

SEQ ID NO: 19221 - DNA, 201 bp, Homo sapiens
tgcaatggatttttctgtcttctaatgcaaaactactttcatagatttattctggattattttttcctttgagggaaggctgcttataaaaacatggggtrcacatggatgaccatctgctggcttttttctctcctaaataaagctaacttgaaaacacattataaaagagggcttaatttgttggtggctactctgctg

SEQ ID NO: 19222 - DNA, 201 bp, Homo sapiens
tccccaccggaattaatggtaatggatcctttactttccactgtacattaagactctctaaaaaaaaaaaaaaaaaaaaaaaaaagccacacttcccaaasttatttgaccatgaaaccttttttttttttttttttttttttttgagatggagtctcactctgtcgcccaggctggagtgcagtggtggcacgatctcgg

SEQ ID NO: 19223 - DNA, 201 bp, Homo sapiens
ttatttgaccatgaaaccttttttttttttttttttttttttttgagatggagtctcactctgtcgcccaggctggagtgcagtggtggcacgatctcggytcactgcaacctccgcctcccaggttcaagcgattctcgtgccccagcctcccaagtagctgggattacaggcacacaccaccatgcccagctaattttt

SEQ ID NO: 19224 - DNA, 201 bp, Homo sapiens
ccgcctcccaggttcaagcgattctcgtgccccagcctcccaagtagctgggattacaggcacacaccaccatgcccagctaatttttgtatttttagtaragacagggtttcaccatgttggccaggctgctctcaaactcctgacctcaagtgatctgcctgtctcagcctcccaaagtgctgggattacaggcgtgag

SEQ ID NO: 19225 - DNA, 201 bp, Homo sapiens
agggagaaattagcatttcccatcggagaccatgggaagggcactctagaaaaaagagcacaggaaaaagtatggctcaatacagggtccagaaatactcwcctggaggaactatgtgtatttcctgctatagtaatatagcatagtatttgtaatgaaaaattgtattctaaacctaaagattactaagccaattggctt

SEQ ID NO: 19226 - DNA, 201 bp, Homo sapiens
tggggatgggcggcccggctgcgccgaggggcgccgggaggctccgcgcgctgctgctggcgctggtggtcgcggggatccccgcgggcgcctacaacctygacccgcagcgccccgtgcacttccagggccccgctgactcgttcttcggctacgcagttctggagcatttccacgacaacacgcgctggtgagtgcccg

SEQ ID NO: 19227 - DNA, 201 bp, Homo sapiens
atgaggtggaggtgaaaggtcaggtaactgtgggggcccagctctgggtgaggtgtcctagaattcagcaaggaaggcagcctcttggctctgcacagttkggaaggtcagtcttcagatggaggaaagatgggcacttccaggacacagataccctccactcccatccaagctcagcagagggtgctggccaactctgtc

SEQ ID NO: 19228 - DNA, 201 bp, Homo sapiens
attaaaggcatgagccaccgtgcccagctattctttttctttcttttcttttttttttttttttcagatggagtcttgctcagtcacccaggttggaatgyagtggcgcactgtcggctcactgcaagctcgacccctcagcttcaagcgattctcctgcctcagcctcccaagtagctggaattacaggcatgtgccacc

SEQ ID NO: 19229 - DNA, 201 bp, Homo sapiens
ggttcatagataaagtcaaacatccctttatactctaagggtgtgtttccccgataatcaggcttaaaggggatggtaactggagaattttgatatctcartataataaggcaatgcagaaaattattcatccccagcatgtttctgtcactttctctggcattcatatctcaatctttgcagtagaaagagaaatgtaga

SEQ ID NO: 19230 - DNA, 201 bp, Homo sapiens
atcacttgtaacataaaggataaacgcttcaggtgatggataccccatttaccctgctgtggttattacatattacatgcctgtaacaaaatatctcatgyacctcataaatatgtacctactgtgtgcccaaatcttttttttttttttttttttgagatggagtcttgctctgtcacccaggctggagtgcagtggtgc

SEQ ID NO: 19231 - DNA, 201 bp, Homo sapiens
ctgagcgcagaggagatgtgggtgcctcctcatgctgttcccgaccagtggctctttctggggccccatctagcatgagcctttcacagactgctaagcayaattagaatgaaggtctaggcttagccatagccccagaagtgttggggtaaagtggaagaggccggcagttggatggcatcttgtactgtaccttgtggg

SEQ ID NO: 19232 - DNA, 201 bp, Homo sapiens
ttacaggcgtgagccaccgcacccggactatgtgcccaaatttttaagaaaaataaaaaatcacggaacaaatttcctccatcttagctgatctgttggtrtgttaaggccacctgggagatggcctttcctaccccttcctatctagtgtccaagtgctgtgatgtatgtggatcccagagtaaacttggtgttgtgcag

SEQ ID NO: 19233 - DNA, 201 bp, Homo sapiens
actctgttaaaaaacatttttaaagaatgaagattaattttgatacacataagaatgagaactattctagaactctcaaaaagggcaaacgagtaatagtktctgtgtatgttcatttgacacatgcttattatgtatccacatgtgccaggcactggagatatagtcctgccctcatggagcttctaaagggagttacaa

SEQ ID NO: 19234 - DNA, 201 bp, Homo sapiens
ctttgggaggctgaggcaggtggatcacctgaggtcagaagttcaagaccggccttaccaatatggtgaaaccccatctctactaaaaatataaaaattascggggcgtggtggcgtgtgcctgtggtacccagctactagggaggctgagacaagagaattgcttgaacccgggaggtggaggttgcagtgagcggagat

SEQ ID NO: 19235 - DNA, 201 bp, Homo sapiens
gtcttttccgcccccttcctgtctttaatccagtgccccaagccccctggtgactttaccttgaacttcctgtataacgccaggtagaaaagcctcacctkgctggaagcccactcgaggctctaacacaacagcaagctctttatcttgctttgttggtcttccccatccgcttatcagatggaaactcggcattcctca

SEQ ID NO: 19236 - DNA, 201 bp, Homo sapiens
gccacacctcaaatgttctaccttatttaatatgttcatccttcttggctgtctcattggcaatttctcttgatcttcaggtatattgaataagctcaackattaaacatatttattttatcattttttaaaaagagcttagaaatttcaacattgaatgaaaccataccataaaacttgggaactggttagtgagggagg

SEQ ID NO: 19237 - DNA, 201 bp, Homo sapiens
tagcttttcaaagtggttctgccttttacaccctcaccagcaatgtataagagtttgagttggtccccatccttgtatattcagtattgtcagtcattttwattttagccattctggtgtgtaattgtgtttctttgtgatttagagctgcatctcccatatgactaataaacacgttttcacgtgcccctcagccattgg

SEQ ID NO: 19238 - DNA, 201 bp, Homo sapiens
caggactttgggctccgctttggacttctgaatcagaatctgcattttcacaagagccccacaagattcctgtgcacatttaagtttgagaagcactgctstggagcacacatgtgtgcacacacgcccactcatgcagaaatatttacgtgagctagttcattcctcagccacacctcaaatgttctaccttatttaata

SEQ ID NO: 19239 - DNA, 201 bp, Homo sapiens
tcagaagttcaagaccggccttaccaatatggtgaaaccccatctctactaaaaatataaaaattagcggggcgtggtggcgtgtgcctgtggtacccagytactagggaggctgagacaagagaattgcttgaacccgggaggtggaggttgcagtgagcggagatcgccgcactgcactccagcctgggtaacagagca

SEQ ID NO: 19240 - DNA, 201 bp, Homo sapiens
aagctggctgggaggaaagagatttttctctcccagcaaagtagtaaacaggctctctcaagcattcatccatctggggagcttggcacacaggacagatmctttctcttaagtgtcccaaggccaaccctgaaccatggaagccttcatttaccatcagtttttctttcaaaacttctgcaagggcataaaaatggggga

SEQ ID NO: 19241 - DNA, 201 bp, Homo sapiens
actcacagtgtagcccctggcctagcattgtcagcatcactgggaacttgttagaaatgcaggactttgggctccgctttggacttctgaatcagaatctkcattttcacaagagccccacaagattcctgtgcacatttaagtttgagaagcactgctctggagcacacatgtgtgcacacacgcccactcatgcagaaa

SEQ ID NO: 19242 - DNA, 201 bp, Homo sapiens
aaatataaaaattagcggggcgtggtggcgtgtgcctgtggtacccagctactagggaggctgagacaagagaattgcttgaacccgggaggtggaggttscagtgagcggagatcgccgcactgcactccagcctgggtaacagagcaagacaccatctcaaaaaaaaaaaaaaaaaaaaaaaaaaaaaaagggcctttg

SEQ ID NO: 19243 - DNA, 201 bp, Homo sapiens
taaagaataaagtaggggattcgaaacttggattttctgagaatgtattgcagaagaacaaaaaagccagttaaacttattcctttttttaaatagcaatstggaatgaaaatatcagatgatcataatataagagttagaagtcaagagagatggaaatgaaagcaagtcaagattcttgtcttggggggacaagtttat

SEQ ID NO: 19244 - DNA, 201 bp, Homo sapiens
acagaggcttaggtttctaaaagaggggtgctgctttggcagctcagaattgaaaagaggcaggcattgtcctgacagctggtaactgtccctgccatttktctggctggggaaaatcaacttgctagcccagctctagagactggattaaaccccagaacaagatagaaccagtgttgattggaattcagagcacgtgat

SEQ ID NO: 19245 - DNA, 201 bp, Homo sapiens
tacaaaggaggtattttgttataatcatgactgcaagcatttctttctccaaagtctttttgcataaagattttctaatttttttgttgttttttgtttgyttgtttgtttttgagacagagtcttgctgtgtcacccaggctagagtgcaatggtacaatctctgctcactgcaacctctgcctcccaggttcaagcgat

SEQ ID NO: 19246 - DNA, 201 bp, Homo sapiens
ttgagtttttatttttagagaactgatattttttctgttcttgatgaggtaatcaggcagtctctatgttacatgagttaagagtcctagacttacttagyaagtcctcaattctgacacttattataagacatctgatccagagctgcatgttcaactccatcaagccttgcctactttcctcatcggtaaaattgacct

SEQ ID NO: 19247 - DNA, 201 bp, Homo sapiens
aacacgttccaggagagattggtaatgagccaccaagtcagggctcaggatacccgtttagctggagtgggctagtgggatatttccgatgttccctgtcrctgttcctcccagctggttttgcaggcagcaggcacacaggctggacatcctttccctctgaggttcctccccttctatttcctgcttatcaacatgttt

SEQ ID NO: 19248 - DNA, 201 bp, Homo sapiens
acaaaggaggtattttgttataatcatgactgcaagcatttctttctccaaagtctttttgcataaagattttctaatttttttgttgttttttgtttgtytgtttgtttttgagacagagtcttgctgtgtcacccaggctagagtgcaatggtacaatctctgctcactgcaacctctgcctcccaggttcaagcgatt

SEQ ID NO: 19249 - DNA, 201 bp, Homo sapiens
tccatcaacatcacagcgcctcagtgtcacgacggacagcagcctgtgaactgcctgaacgtcaccacctgcttcagcttccatggcaaacacgttccagragagattggtaatgagccaccaagtcagggctcaggatacccgtttagctggagtgggctagtgggatatttccgatgttccctgtcgctgttcctccca

SEQ ID NO: 19250 - DNA, 201 bp, Homo sapiens
gtggtgtctggtgctgatagaaaacctaagaacaaatggagaatttgaaagctgcaatggggcgtgaaatgtctcagtgaccaaaggcattatgtggaccmtggacccagcaaccagctctggcaaggaccagattgtcaggctggtctggcaggttgaccttggcttagtgcctgcccatctcagctccatggacactgt

SEQ ID NO: 19251 - DNA, 201 bp, Homo sapiens
ggagtgattatttacttagtgatatattttttatagttctctgcctcatatcatttcagtctatttagaaacctgctattttagcacaaaacaatatcaargagaggagtgaatgtggtttgcagcagaaaaaataacaatagattgttttctgtagtttaatgtcatacgacaagaggcagaatgtgggcaagctcaggt

SEQ ID NO: 19252 - DNA, 201 bp, Homo sapiens
tgagggaatccctgagtatgcatctatttcttgaatcatggcatctgctataggaaatcctcttaaatgtattcttatctccctaataaaatggaaattgrtacttaattggtaaaattttaaataattacccagcatctggtggttcatttatggcttcaaccagatgcgttttattaacaacaaacttgcttttattat

SEQ ID NO: 19253 - DNA, 201 bp, Homo sapiens
ttcatgagtctttttatttttattttttggttatatagatcagaggtttccgtgttgcccaggctggcctcgaacgtctagcctcgccttcttatgcgccwggacaacaggcctgagccactgcagctccctatttcatgagtcttttagctttggtcccaaaattgaattctgctcagttctgagctggggttctcactg

SEQ ID NO: 19254 - DNA, 201 bp, Homo sapiens
cagcaaatgcttgagggaatccctgagtatgcatctatttcttgaatcatggcatctgctataggaaatcctcttaaatgtattcttatctccctaataawatggaaattggtacttaattggtaaaattttaaataattacccagcatctggtggttcatttatggcttcaaccagatgcgttttattaacaacaaactt

SEQ ID NO: 19255 - DNA, 201 bp, Homo sapiens
ctgaagtagggagttggcaaaatgggttgctaagttctaggtaaagggaacgctttaaagattacaaaactccttttttggtaatattaaaaaattattgsccaggcgtggtggctcatacctgtaatcccagcactttgggaggctgagactggcagatcacctgaagtcaggagttcgagaccagcctgaccaacatgg

SEQ ID NO: 19256 - DNA, 201 bp, Homo sapiens
cactttgctattaccagctgggactccacttatcaagttcttttaggaaattacccaatgaattggtggaggtaaatgatgcaggaggtttgaccaactgsatggggctacaacattgcagttcatgctcataatggcagcaaatgcttgagggaatccctgagtatgcatctatttcttgaatcatggcatctgctatag

SEQ ID NO: 19257 - DNA, 201 bp, Homo sapiens
acccatgaaatgatttccaacatccagtcactttcctgggtatttttagtcactcactttgcagaacctttgatggtctacagaagtgaaggaatgggttkctaagtccaagctgaggtagaatcctggcattgccatttactagagctgtgtgaccttagacaattcacttaacctctctgagcctcaatattcttacct

SEQ ID NO: 19258 - DNA, 201 bp, Homo sapiens
gatttactctttgtttttgtgggatgtccttggggagcccaaggactgtccattcatcaagcactgggagatggtccatggcagggaggagagtatggctwtttattgagtttcatttggtcataagactgggcaggttgatttcttctgccctgaagcactttgctattaccagctgggactccacttatcaagttcttt

SEQ ID NO: 19259 - DNA, 201 bp, Homo sapiens
tcaccccagatagtttccttgtgcctctgtctggtcatacccctctcctgatagacaaccactgttctgacttctatcaccatagatccatcttgcccatkctagaatttcacattggtgggaatatacagtatggactcttgtttctggcctcttttaatcagtgtgatgcatttgagattcgttcatgttggtgtgttg

SEQ ID NO: 19260 - DNA, 201 bp, Homo sapiens
ctgttggttttaaaggtttttgaagacaggaattactttatcttaccctgtttataatgtttgagaggggatgcagtggtatggtaggcatacatttttcmacttttatcctgggttagtctaaatcatcagaaagcaacatatcccatccctgcccccaatgttccgaagagcctttgcaggcctgtgctgatgctcaaa

SEQ ID NO: 19261 - DNA, 201 bp, Homo sapiens
atgactccatgagttttgaccactgcatacgctgtgtgactaccaccccaccacaataaagaatacttctgtcaccccagatagtttccttgtgcctctgkctggtcatacccctctcctgatagacaaccactgttctgacttctatcaccatagatccatcttgcccattctagaatttcacattggtgggaatataca

SEQ ID NO: 19262 - DNA, 201 bp, Homo sapiens
cagggagctgacgaactttccagttgactaggcttgactaaggataatttctgtggatcctcctgggcagaggttaggagctgctgctcacgtttctggascatgtgcctccctcctccctaacactgatgctgtggaaagaggttcttcaaaactgaaaccagataaaccagggccctgagctggcagggaggagggatc

SEQ ID NO: 19263 - DNA, 201 bp, Homo sapiens
aagtttagagtcctgcattgatgagaggacctaaaaggcttatgaggccaggcatagtggctcaggcttgtaatcccaacactttgggaggctgaggcagktggatcacctgaggtcagaagttcaagaccggccttaccaatatggtgaaaccccatctctactaaaaatataaaaattagcggggcgtggtggcgtgtg

SEQ ID NO: 19264 - DNA, 201 bp, Homo sapiens
caggcgtgagccattgcgcctgacccaacaggccctcttaaaaccggggccatctggctgaaggtccatcatatagactctgctttctcatcattcttgtrttttttaatcttcctgctgtgagcttaatccaaagggtattttctttttctcttcttcatggtgagggacagccttctccaggagtttgctcacatatgg

SEQ ID NO: 19265 - DNA, 201 bp, Homo sapiens
aacccaggggccttttattagaaaacatttattttaaaagaataatgctttttctctttcttttcttttcttttcttttcttttcttttcttttcttttcytttcttttcttttcttttctttctttctttctttctttctttctttctttctttctttctttctttccttccttccttccttccttccttccttccttcc

SEQ ID NO: 19266 - DNA, 201 bp, Homo sapiens
ggcatggtggctcatgactgtaatcccatcactttgggaggctgaggtgggcacattgcttgagcccagaagttcaagaccagcctgtgcaacatggtgaragcctatctctactaaaaatacaaatattagctgaacgtggtgatgcatgcctgtagtcccagctactcaggaggccgaggcaggaggatcacttgaacc

SEQ ID NO: 19267 - DNA, 201 bp, Homo sapiens
tctgtagctaatggagggtgggtgagtgggggctgggttgggggacagcagtgcatcgtggaagcaggagaccagtgagaaagcagtcttttcaggatctkgaagtacaagtgttcaagtacaagtattcagcaagaacaacatggttcaatgaaaacattctggtgccgcctaccttttctctaacatgagaaaacgctt

SEQ ID NO: 19268 - DNA, 201 bp, Homo sapiens
cagagtggcccttgcagcaggcgctggcagggtggaagacctggcagtgcctgatgctgcaggaatggccagacactgacccatgggcagggtcagagagyggaggaggtggaagaatgcacttaatccaggccacatggtgggtggaatgagcatgggttttggagacacatagatccagtgtgtatccagctggacaca

SEQ ID NO: 19269 - DNA, 201 bp, Homo sapiens
tgactaataaatattttctgatttaaatgtaatgaaatattatcagcttttgaagaaggccctggggataattatcttcattttacagacagggataccaygagatactcaggtcacatagagtgaggggtggagggtgacaattccatgttcttcagaacctagagcattttccaagagtcactgaattctaggtatgtc

SEQ ID NO: 19270 - DNA, 201 bp, Homo sapiens
ttaaataaatgagtgctgtgggcattcagtggtgcctgccattgtatttgcaggagactgagacatttgtgtaggagtcaggtccaacagccagactgtgwgtctaaatcagaaggtggactcttgaagcacaagaactcccccaggcctccactgggcatgatgcacccacaccctcccctgccaaccagtgtttcttga

SEQ ID NO: 19271 - DNA, 201 bp, Homo sapiens
tgggagtgcaggcatggggttatgggggtcagggtgacctcactgacgaggtgtgatttgagcaaagcatggaaggaggctggggagttagcacagcgggytcctggaggagggctcagaccagtgtctgagtgtctggtgtgtctgaggaggagcagggagaccagtgtgggcaaagaggtcagagtggcagtgatggtt

SEQ ID NO: 19272 - DNA, 201 bp, Homo sapiens
agaacagacataggctgtctttgcttgtgtagatgacaattacaagactcttttctttaatttatgccctaaatgctataattctggattgaaagcgaagytaaatttaggaaggcctaatgatgacacacaatgctctttcgcactcatgatacataacttacagggaaaggccctgactccctttttgcatagcgtcac

SEQ ID NO: 19273 - DNA, 201 bp, Homo sapiens
actcagtaggaaaacttacgaatatggaaactattttgccatgaggcatacatagtctgaggggcatttatctatccagaccatcctcttttcattagaartacataacaggagattaataaacttcggtgattcagcccacaaggcaggaggaagagagctttgggcacagtttgggggccacatctgagtcacaagagc

SEQ ID NO: 19274 - DNA, 201 bp, Homo sapiens
tcgggggagttgaatggtgagcctggagtccaggcagggtgcggtattgcttactgcttttcatgagtggtgttccccagaatctgtggttgaggtcaatktcagctgtttgtcatttccttgttagagcctgatgtaaagttgaggaaacgtgtgtggtctcatcgtggatagaataggggcctggcctgtcgtgaattc

SEQ ID NO: 19275 - DNA, 201 bp, Homo sapiens
acagtcatttcttgtctacaccctcctgaattatcaaaaagcaagcctttccggcgagaatctagtggcttttcttccatctgtgttcctgccctatcctytgttaaggctcttccccaaattaaccataacacgtattgtttaaggcattgccctcttgcctgcaggctctatcctcctctctctattttttttctttag

SEQ ID NO: 19276 - DNA, 201 bp, Homo sapiens
aacagtcatttcttgtctacaccctcctgaattatcaaaaagcaagcctttccggcgagaatctagtggcttttcttccatctgtgttcctgccctatccyttgttaaggctcttccccaaattaaccataacacgtattgtttaaggcattgccctcttgcctgcaggctctatcctcctctctctattttttttcttta

SEQ ID NO: 19277 - DNA, 201 bp, Homo sapiens
gcactgtccctcccttcagcctcagccctgagggtcgcaggcttggccctgttttatgtagtatgggctgaagggagaggggtgtgagcactgggggcggrgtggcgtggtgcggtaaaaacaagagctgttggttttaaaggtttttgaagacaggaattactttatcttaccctgtttataatgtttgagaggggatgc

SEQ ID NO: 19278 - DNA, 201 bp, Homo sapiens
ttaaaaaagatttcgatctttaatctttctggaatttgtgttgtatacattgtgtgatagaaactaactacattatttttctaaatatatagttggttgtyctgatactggtttgttaaacaacttttcctctccccattgaaatgccatcctgccgtgtggcgacttcactctcttcttccatctcagcaaacatttaga

SEQ ID NO: 19279 - DNA, 201 bp, Homo sapiens
tagcactttcataggttgtttttaaaaaagatttcgatctttaatctttctggaatttgtgttgtatacattgtgtgatagaaactaactacattattttyctaaatatatagttggttgttctgatactggtttgttaaacaacttttcctctccccattgaaatgccatcctgccgtgtggcgacttcactctcttctt

SEQ ID NO: 19280 - DNA, 201 bp, Homo sapiens
atttttaatagcactttcataggttgtttttaaaaaagatttcgatctttaatctttctggaatttgtgttgtatacattgtgtgatagaaactaactacrttatttttctaaatatatagttggttgttctgatactggtttgttaaacaacttttcctctccccattgaaatgccatcctgccgtgtggcgacttcact

SEQ ID NO: 19281 - DNA, 201 bp, Homo sapiens
cattgaggccgaatttaaagattgttctctcacctcactctcctacttctaagccaccttgcaagtcccaccacctcctatgccctcaaaacctctaacawtgacatccattgccctccacatcctctgccaccctacaaatctaagccatagttgtcttgcttccaacccactgcggaatccttctgccgtcttgcttcc

SEQ ID NO: 19282 - DNA, 201 bp, Homo sapiens
gaaactgctgtttaaatccaaagagaacatagacagttggcaatatagtgtctgatccagaaagcaagaaagaaaaggcagaaagtctgaagttttatttycactctcaaaccaataaataggagatgctaccctccaacccccattccgcaccctcagtgattcttacctcgctggagaatcatttttatgacagtcgac

SEQ ID NO: 19283 - DNA, 201 bp, Homo sapiens
tgagcttccagcccactggagttttgcctctgcataatcccttctcaccagctcagtgttctttgttgtttgcagtggaagcaaaccttggggctggtccrtttgggacttcttatggcaagaagtttgaatagcttcatcctgccatcaactctccttgtttctgagcctttgatgctccatcatgctctaccatgttga

SEQ ID NO: 19284 - DNA, 201 bp, Homo sapiens
ccttggggctggtccatttgggacttcttatggcaagaagtttgaatagcttcatcctgccatcaactctccttgtttctgagcctttgatgctccatcaygctctaccatgttgatggggaaatgagtgaggagagaattagaaacccagacatcttctgcctgattatagcagcagctagattgacttttgagagtgta

SEQ ID NO: 19285 - DNA, 201 bp, Homo sapiens
gaagtttgaatagcttcatcctgccatcaactctccttgtttctgagcctttgatgctccatcatgctctaccatgttgatggggaaatgagtgaggagaraattagaaacccagacatcttctgcctgattatagcagcagctagattgacttttgagagtgtacgcgtgtgtgtgtgtgtgtgtgtgtgtgtgtgtgtg

SEQ ID NO: 19286 - DNA, 201 bp, Homo sapiens
ccgcttcccgggttcaagtgattctcttgcctcagcctccagagtagctgggacaacaggtgcgtgccaccacacccagctaatttttgtatttttagtaragctggggtttcactatgttggccaggctggtcttaaactcttgacctcaggcgacctgcccgccttggcctgccaaagtgctgggattacaggcgtgag

SEQ ID NO: 19287 - DNA, 201 bp, Homo sapiens
aaggcagagagtgtagtcattggctaccatgacattctccttccctcaaaaatgcatctcaggctatgggagaccatcctgctaagcaggtaaaagggackcattttgccagcaggagagagaagtttgggttcctgtaattctgcccaggtgtttcctgtcaatgagtgtgctctagcagggcagcattcaaactctggt

SEQ ID NO: 19288 - DNA, 201 bp, Homo sapiens
gacctgcccgccttggcctgccaaagtgctgggattacaggcgtgagccaccacactggcctacttttttttttttttttttcctgctgagggatcttgtscccaaattaatgcttgaacaatcaacaaccaataatttctggtatccagggactcagacatgacaaccagaattagggaagctgcacttgtattattaat

SEQ ID NO: 19289 - DNA, 201 bp, Homo sapiens
cataggagcaatcagttgctggtgttcctctcctcttccccactacactgaaagaaagaaattaatgcatatttgtgttttggggtggaggtttcattcayccaagaaatcatctcaccttgactgttttcaaggtgtaaattgtgtttatagtgaaaaagaagacttggtcatgataaaagccagacactcgtgggatgg

SEQ ID NO: 19290 - DNA, 201 bp, Homo sapiens
gtagaaatggtaaaaatgcctacgtctagttcacagtgatgcgggtgcctctatgctaatgatagcagctttcttttctccctaattgcagaaaacacgayccagttttatagtttttccttcagatgattgtgatgaacttcatagtccctgtcaagtcttaagatgacccctccgcaaacccctctcactggctatctg

SEQ ID NO: 19291 - DNA, 201 bp, Homo sapiens
tgcctgtgtggatatgtgatgaacttaatgatgaataagaagtgagcacagccaggagtggtggctgtaatcccagttccttgggaggctgaggcaggaayatcgtttgaggcttggagtttgaaaccaccttgggcaacatggcgagaccccgtctgacaaaaaaagtaaaacagctgggtatattggagcatgcctata

SEQ ID NO: 19292 - DNA, 201 bp, Homo sapiens
tctgtagaaatggtaaaaatgcctacgtctagttcacagtgatgcgggtgcctctatgctaatgatagcagctttcttttctccctaattgcagaaaacaygacccagttttatagtttttccttcagatgattgtgatgaacttcatagtccctgtcaagtcttaagatgacccctccgcaaacccctctcactggctat

SEQ ID NO: 19293 - DNA, 201 bp, Homo sapiens
tttttgtttttaaaaaacatataaagtaagcatagatgctagtgtgtcccatggtgaagttgtgaactctggttggttgagggggctgttttctagagggsagggcagggcatcttcttcagctgagtgcttttgatttcctacagtttaagaagtgttcaggaccatggagttctagatttactgggtaaaactgttcac

SEQ ID NO: 19294 - DNA, 201 bp, Homo sapiens
tcagtctcttcacatctttagtcctgataatcccgtctgtataatagattccataatgctgatgaatctggtgaaatctgtttttgttgcttagctggggmaaaaaaagttcttggtgtgaggaatttctcctttgttgtgactgtggttctcattgcattcccctcctcccctcctcacttccttctctgcttaccgttg

SEQ ID NO: 19295 - DNA, 201 bp, Homo sapiens
gtaggtggccccagggctggcttagtaacctaacaatggcaccagtggcaccaggggtgaaggctctttatctgtccttgccttgcagaaggccaaggcamcttgagcaacatgtcaaagggcatcccaactggttgtattatttaccttgaagtgaagtgtcaggatttgaactgtcagccctcagggagaagtgttcca

SEQ ID NO: 19296 - DNA, 201 bp, Homo sapiens
gacaccagttctccgctggaaaaagggacaaaagattgcccaaaagaatcaggtcagaaccttaaagctcatactcagcacccaaggtggcagctgcacasagcagaaataatggcccaaaagttgagagagccgtgggcctggctgctcaggagaccgcagccaggacacacctcctctctgggtctcccttttctgatc

SEQ ID NO: 19297 - DNA, 201 bp, Homo sapiens
atcccgggcactcctgcccagctgctcatgccaacttgcagtacacagaggaaatatatggcttctcccaggcccacctacataccccggttcctctaggkgttctgctaataaatgcatcttgggaaaaagctgcattgcttattgatgggattccacaaatgtgatttaggtagtggtggcctttgcttagagaagctt

SEQ ID NO: 19298 - DNA, 201 bp, Homo sapiens
gaccagtggctctttctggggccccatctagcatgagcctttcacagactgctaagcacaattagaatgaaggtctaggcttagccatagccccagaagtrttggggtaaagtggaagaggccggcagttggatggcatcttgtactgtaccttgtgggcaatgcgaagcaacctggcttatatctgacattaggtggggc

SEQ ID NO: 19299 - DNA, 201 bp, Homo sapiens
atggggtgtcagcatgtgctggctgtgctcatggtacagcaaagtggggacatggtgggtgtacagagtgtccggggagggtgggcagtggtgagtgggawggcagcccctctgggcgccactctgtcctctgaccccggcctgctgtctcctggctactttggactttggcctccgcttcagttcccaggcttttggcct

SEQ ID NO: 19300 - DNA, 201 bp, Homo sapiens
gtgtaccctcccattaatttctcttccctatcctccatctgccacatgggttcatagataaagtcaaacatccctttatactctaagggtgtgtttccccrataatcaggcttaaaggggatggtaactggagaattttgatatctcagtataataaggcaatgcagaaaattattcatccccagcatgtttctgtcactt

SEQ ID NO: 19301 - DNA, 201 bp, Homo sapiens
catttagattgtgtgacaactatggctgttgttcctccaacaggcctgtctagtattgtatgacttgagtcaataggcagtgggaaccactgtaagttcayaagcaggtgacacactggcagatggcagtgttgaaagaaaggctatttgagctgggtttgcccagaactttgggagtggaagggcctgaagggaggcctg

SEQ ID NO: 19302 - DNA, 201 bp, Homo sapiens
cagttccgctcagggctttggaatgagtggtcagcatttcttcttgcctcctcaggcagggtctctcgttgtgactcttgctttcttctagaggagacagkctgatgtagaagtaatttcctttggggtaatttaaaatgtcaaaatttaaatcaaggaaaagtactaattaggcagttctagagatgaaatgcttccaga

SEQ ID NO: 19303 - DNA, 201 bp, Homo sapiens
gatgaagggtgctctctggcttccaaagtgagggcccctcctgagtcaggagcaagactgcctaccttcctttcagaaactgctgtttaaatccaaagagracatagacagttggcaatatagtgtctgatccagaaagcaagaaagaaaaggcagaaagtctgaagttttattttcactctcaaaccaataaataggaga

SEQ ID NO: 19304 - DNA, 201 bp, Homo sapiens
caaaaaaagagtactttttacttctaattcatctgcagtcctgttgttttagcctccaaaacacatcccaaatatgacagcttttattactattacaatcrcctccattatcaccatcatgcttctagaaaggccaccaccatcacctggaggtacactggccctgattggtcttcttatgtctattatgcttttttaaaa

SEQ ID NO: 19305 - DNA, 201 bp, Homo sapiens
acctgtatttttagtagagacggggtttcgccatgttggccaggctggtcttgaacacctgacctcaggtgatctgccagtctcggcttcccaaagtgctrggattacaggctgagccaccacacccggcctgagagacttggttttacacacaactctaaccattccttttcccagattcagaaggacaggacacctgca

SEQ ID NO: 19306 - DNA, 201 bp, Homo sapiens
gtgagcatcccctcctagcagccttctctccttagtggagagacttgtttgtttttcgagacagagtcttgctatgtcactcaagctggagtgcagtggcrtgatctcggctcactgcaatctccgcctcctgggttcaagcaattctcttgccttagcctcccggttataggcgcccaccgccacacctgtatttttagt

SEQ ID NO: 19307 - DNA, 201 bp, Homo sapiens
gtctggtggattcctgagactttccttcctcaccccagtctggacagcatccctgggcccagcctgccgcggcactcgtgggaagtggctggctggctctsctggctccacgcacagctggcatacactgacatggctgtggtttgcttctctctccttccttgcccctagagtataagaagaagtacggagaggaacacg

SEQ ID NO: 19308 - DNA, 201 bp, Homo sapiens
gctggggcactgggcagcctcccttcccgatggcaccagagcctggatttttgaggtctggtggattcctgagactttccttcctcaccccagtctggacrgcatccctgggcccagcctgccgcggcactcgtgggaagtggctggctggctctgctggctccacgcacagctggcatacactgacatggctgtggtttg

SEQ ID NO: 19309 - DNA, 201 bp, Homo sapiens
tgctggggcactgggcagcctcccttcccgatggcaccagagcctggatttttgaggtctggtggattcctgagactttccttcctcaccccagtctggayagcatccctgggcccagcctgccgcggcactcgtgggaagtggctggctggctctgctggctccacgcacagctggcatacactgacatggctgtggttt

SEQ ID NO: 19310 - DNA, 201 bp, Homo sapiens
tggtcaacccttgaagccaagggctttgctaagtccaaaaacttagcaaaaccaaaacataactgatttacccacaaattagataacaataagtgattcargtttgcgagccataagaattgagtcagaactttaaaaatcaattatttagcagtatggagtgattatttacttagtgatatattttttatagttctctgc

SEQ ID NO: 19311 - DNA, 201 bp, Homo sapiens
ggagtaaatgaaataattgtcactagcctcccacttaatgactgtggctattgctcctctttctcgcacacgaggggaggaagtctgctggggcactgggyagcctcccttcccgatggcaccagagcctggatttttgaggtctggtggattcctgagactttccttcctcaccccagtctggacagcatccctgggccc

SEQ ID NO: 19312 - DNA, 201 bp, Homo sapiens
cacactgggatggccacatcattccatttctgggtcacgttttcagctccttgggcctgcaagggatctctgtcccttctggagtaaatgaaataattgtmactagcctcccacttaatgactgtggctattgctcctctttctcgcacacgaggggaggaagtctgctggggcactgggcagcctcccttcccgatggca

SEQ ID NO: 19313 - DNA, 201 bp, Homo sapiens
ccaggagactccacactgggatggccacatcattccatttctgggtcacgttttcagctccttgggcctgcaagggatctctgtcccttctggagtaaatraaataattgtcactagcctcccacttaatgactgtggctattgctcctctttctcgcacacgaggggaggaagtctgctggggcactgggcagcctccct

SEQ ID NO: 19314 - DNA, 201 bp, Homo sapiens
gttgtgagctgagggggtggaggagaaaagcttatctgttagttttctttccacctggagagatcttccccctttccttccacacagcaatagtgtaaccraatgccagagcagtcccttcttcttgcggtcctctgtggacggcttgtttctttttggatggtaggaggcatccaaagcctcttttagggaaggttggtc

SEQ ID NO: 19315 - DNA, 201 bp, Homo sapiens
atccccaaaacagttaaaaaataaaaagggttacggaggggatgacctctggcacagaaaagcagtaaaataggtgtattgacactgaagtcatatttctrtaatgaaatacatacctatctatttacttattgactctgaaataacagaggtagatccttccaggtttatctagcctgcatttgatactgtgatcatctt

SEQ ID NO: 19316 - DNA, 201 bp, Homo sapiens
ttttgtaggagtctgcttgactctgagacctggggaaggagtcgatttggggatgtgtgagtgagatgacattcagtcaggttgtgccccatcattggcgrctgtgcagatacatgaagcgtgtgagcatcccctcctagcagccttctctccttagtggagagacttgtttgtttttcgagacagagtcttgctatgtca

SEQ ID NO: 19317 - DNA, 201 bp, Homo sapiens
gaggctatttctacctgccaggagggcaccagctggccagagaccactgggcagaggaggtggggtggctcatctcgaggctacccctatttgatgatttytgtaggagtctgcttgactctgagacctggggaaggagtcgatttggggatgtgtgagtgagatgacattcagtcaggttgtgccccatcattggcgact

SEQ ID NO: 19318 - DNA, 201 bp, Homo sapiens
ttggcaacccttagaggtgggacttctggagtcccagatacttgagcctcgagggagcagattctggtcctcacaccagaggaggctatttctacctgccmggagggcaccagctggccagagaccactgggcagaggaggtggggtggctcatctcgaggctacccctatttgatgatttttgtaggagtctgcttgact

SEQ ID NO: 19319 - DNA, 201 bp, Homo sapiens
ctgccgcggcactcgtgggaagtggctggctggctctgctggctccacgcacagctggcatacactgacatggctgtggtttgcttctctctccttccttscccctagagtataagaagaagtacggagaggaacacggctcctgccaggctgggatagcgggcttcttcaccgaggtgggtgtctgctgtctgggcattt

SEQ ID NO: 19320 - DNA, 201 bp, Homo sapiens
gtaaccgaatgccagagcagtcccttcttcttgcggtcctctgtggacggcttgtttctttttggatggtaggaggcatccaaagcctcttttagggaagrttggtcttcttccaggagactccacactgggatggccacatcattccatttctgggtcacgttttcagctccttgggcctgcaagggatctctgtccctt

SEQ ID NO: 19321 - DNA, 201 bp, Homo sapiens
tctgcctcccagactcaagccatcctcccacctcagcctcctgagtagctgggactacaggtgtgcaccaccgcatccagctaatttttgtatttttgtasagatgggggtctcactttgttccccaggctgattttcaactcctggactcaagtgatctgcctgcctcggcctcccaaagtgctgggattacaggtgtca

SEQ ID NO: 19322 - DNA, 201 bp, Homo sapiens
tgccactctgttagaaacaaaatgcttgttcctcagtgccacaatgaaatagcacttgaacataaatttaattttctcagcaaggcaatttttacttctaytgaagcgtgcgacttgtggatggagtaatggtgagagcacacctggacaggggaggggcaggggttcttattcctgttgcaggtagcccctactgctgtg

SEQ ID NO: 19323 - DNA, 201 bp, Homo sapiens
gctgattttcaactcctggactcaagtgatctgcctgcctcggcctcccaaagtgctgggattacaggtgtcagccaccgtgctggccagcttccccaaakgtaagggttaggtttgttacagtgcctgtgagctgctgtcaggcaaagcctgcttttcccctgcttctttgaggtggataaatgttttgttcagtagtgg

SEQ ID NO: 19324 - DNA, 201 bp, Homo sapiens
tgtataattgcccttttttttttttttttttactagagctgtgtctgcccaaatgcattgtttcctgtattgtacaattatcagttatttagatttgccastctgttagaaacaaaatgcttgttcctcagtgccacaatgaaatagcacttgaacataaatttaattttctcagcaaggcaatttttacttctactgaag

SEQ ID NO: 19325 - DNA, 201 bp, Homo sapiens
ggcaggaagagttccacaacctggttccagctcctctaagtgacttctaagtccccttgttcaaccctatcttttgggtctcagatttggcttcccccccsctttttttttttttttttttgagaccgaatctggctctgttgcccaggctggagtgcagcggcatgatcgtggctcactgcaacctctgcctcccagact

SEQ ID NO: 19326 - DNA, 201 bp, Homo sapiens
tgactggcttgtttcacttagcataatgtcctcaaggtgtatccatattgtagcatctgtcagaattttcttcctttttaaaggaaggaatatttaataakattccattgtatgtgtgtgccccacatttatctattcatctgtttataaaacattttctttggatgataagaatgttttcactggaaatgtgctttgtga

SEQ ID NO: 19327 - DNA, 201 bp, Homo sapiens
tgtgataaaatcaagtacagagatttctttcatcctttgcccttgagaccactgaggcaagaagccggaacttagcaggagtgagactgcaaacaagttgyctttttattgtgaccgaaaaacctgatgagtgtggaatagtttgggagcagcatggcaaattaacaaagcctgttcaagattaaactctgagaaagaaat

SEQ ID NO: 19328 - DNA, 201 bp, Homo sapiens
gcatatccttcagtcagtttagtttgtgtttgtctgatgtgagaacatcattacctaccatatgttctttggttttatcagaatgtgtgagaaaacgagakctttggtgggacgatgtatagggaaaactacttgtaaattaaagggcaagcactataaaacattaattactattaaccaagctatgatattttaggactc

SEQ ID NO: 19329 - DNA, 201 bp, Homo sapiens
agctcccgagaaaactcaggtgaaagtgctcagcaaggccacccattgttctataactgtggcctcatggtaagtctccatatgggccagctgtgctcctwtacaacattggaaggtcggtttggttgcagagactctaaatatgtggggatctctccaaaatgtctcaagcttttgaattcttaaaaaattggtctctgg

SEQ ID NO: 19330 - DNA, 201 bp, Homo sapiens
tttagagtttgacaggacctttcagataccacctagaacagcctcctgtctttcatgaggtccagagaggtgatggcctgagtttttctttctaatctgtwattcacatgccacacaatggagaggcagagtagcttggtggccaatgcacagattctggacacagactgccggagttcaagtcccggctctgctacttcc

SEQ ID NO: 19331 - DNA, 201 bp, Homo sapiens
gggctcttgtctgtgctctgttggctttaggcatctccacctccctgttttgtggtttaaactagacctactatggcttttaaggccaccattatttcctyaatgtggagaaactcagtaatgcaagttctctgttccacgttaggggtcacattatggttaaagacaatgggaagattttagagtttgacaggacctttc

SEQ ID NO: 19332 - DNA, 201 bp, Homo sapiens
attttcttcctttttaaaggaaggaatatttaataatattccattgtatgtgtgtgccccacatttatctattcatctgtttataaaacattttctttggrtgataagaatgttttcactggaaatgtgctttgtgaagcataagggagtggcagaagcagatcagaagttgggagccttgctcttgggtcctgatgctga

SEQ ID NO: 19333 - DNA, 201 bp, Homo sapiens
gtcagaattttcttcctttttaaaggaaggaatatttaataatattccattgtatgtgtgtgccccacatttatctattcatctgtttataaaacattttstttggatgataagaatgttttcactggaaatgtgctttgtgaagcataagggagtggcagaagcagatcagaagttgggagccttgctcttgggtcctga

SEQ ID NO: 19334 - DNA, 201 bp, Homo sapiens
gcttgtttcacttagcataatgtcctcaaggtgtatccatattgtagcatctgtcagaattttcttcctttttaaaggaaggaatatttaataatattccrttgtatgtgtgtgccccacatttatctattcatctgtttataaaacattttctttggatgataagaatgttttcactggaaatgtgctttgtgaagcata

SEQ ID NO: 19335 - DNA, 201 bp, Homo sapiens
attgaattctgctcagttctgagctggggttctcactgaaatgtgactgtcccatgttcagggtcacttttttttttctgagagtagagcatgacataatrcatagtaagttgcatgtctatatatacattattatgtgcctgtattattacttgctgctgaagtagggagttggcaaaatgggttgctaagttctaggta

SEQ ID NO: 19336 - DNA, 201 bp, Homo sapiens
caaaattgaattctgctcagttctgagctggggttctcactgaaatgtgactgtcccatgttcagggtcacttttttttttctgagagtagagcatgacayaatgcatagtaagttgcatgtctatatatacattattatgtgcctgtattattacttgctgctgaagtagggagttggcaaaatgggttgctaagttcta

SEQ ID NO: 19337 - DNA, 201 bp, Homo sapiens
tttcagtatctgcacagcagtttgtctgtccatgctttggtgccagttatttcatgagtctttttatttttattttttggttatatagatcagaggtttcygtgttgcccaggctggcctcgaacgtctagcctcgccttcttatgcgccaggacaacaggcctgagccactgcagctccctatttcatgagtcttttagc

SEQ ID NO: 19338 - DNA, 201 bp, Homo sapiens
ggtttccttggagccaagaattttaatcttgggcaaacctgtctcctatacttcaaacgtgtttccatgtattacgtggaattatagactacctaaactgmatcttttgtttctctcagaaaaattcacagattcagattcacctaatatttattgagcacctacctggtgccaggggttgtgctaggtacttaacatttt

SEQ ID NO: 19339 - DNA, 201 bp, Homo sapiens
atcttatttaaataaatagagcaaattaaagagaagaggatgcagttgtacattatggccagttaaacagagagggattctgagggggaggaagggagggwggccccagaggacagccatggctgtaaggaggaggccagaggtctccagcagggcctctctggggctttccaggtttccttggagccaagaattttaatc

SEQ ID NO: 19340 - DNA, 201 bp, Homo sapiens
ctccctgttttgtggtttaaactagacctactatggcttttaaggccaccattatttcctcaatgtggagaaactcagtaatgcaagttctctgttccacrttaggggtcacattatggttaaagacaatgggaagattttagagtttgacaggacctttcagataccacctagaacagcctcctgtctttcatgaggtcc

SEQ ID NO: 19341 - DNA, 201 bp, Homo sapiens
gtgttgatctgaggtctttacacattctctcatctaatcttcccagaagctgtgaaaaatgtttgtttcttttttttcttgggtctgattacaggtatttwattttggaaattgttctagaagacaccagtgaggcagggggaagtaagaatgggaagggaaggcagcccatggaagatgtactcctcagcacgttacctg

SEQ ID NO: 19342 - DNA, 201 bp, Homo sapiens
agccacacagccaaatggaaatacaaataatagattgaggtcacattgactgtttcacgttgtacttagacatgctgattaaaacctgagttgcaagtgtrccatggaacataatctctccctctagtgttttggaacaatcacacacaaatgtttatatccacatacaggccccatatacaatgggggaaacagaacaga

SEQ ID NO: 19343 - DNA, 201 bp, Homo sapiens
ttatttggacagaagtctcactggcttatgtccacattgcctttgggcctccctgggttttcctaggtttcaaattttgtggacactaaaaaggattcatkagaaacactatatggacactgggacccttctgggtactgaggtgacacaggtagggtgctctgggaaacgtcccccacagaagagccagcaagatctctg

SEQ ID NO: 19344 - DNA, 201 bp, Homo sapiens
tcaggactagctacaattctcatttgttgatatatttatttcctgtctcctagtaggctcccagtggcttgttcctgttcatgcagttttctgatgcccaraaaagtgcctgttatgaaggtgtggctttctggtccctctgctcctctcttctcccacagaaagaaacatctggcactgacaggagtctgctttgtgatc

SEQ ID NO: 19345 - DNA, 201 bp, Homo sapiens
ccacttcccattgcagatctgctgaagtcacagccattcctacgtccccctgtggtccaaccttggccgcctctttgatcttatctccttcccaccatggkcactccagaccggcctttctttctcttgagcctctgagcctttctcacgatgtatcctttacattctgctatcctttgaatcctcccagaaccctcttcc

SEQ ID NO: 19346 - DNA, 201 bp, Homo sapiens
aaccagccactccctggcatgagggaactttctggtgagatggagatgttctgtgtcttgctagggccttggtgacatgagtgtgtacatttgtcaaagcycatttgtgcattttgctgtatgtaagtttccataaaaaaacaactctccacacacatttacttctagttaatgagatgcatgctgaagtgtttctgtggg

SEQ ID NO: 19347 - DNA, 201 bp, Homo sapiens
cctgcctcatggtgtcttgcgtggcttcgaccctagtgctgagaggctcctctggagagctggccaatgcatctgtccatcttcttcgccagtatgcggasctctcatgcaccccaagacccttggccatgaaccttccttcagctttctcctcagagaggccttccttgacctgcctggcaaaaccagccactccctggc

SEQ ID NO: 19348 - DNA, 201 bp, Homo sapiens
tcagtgtgcagctggctatcagacagcaccatgataaacatccgcctcttttcacagcccctccaactcagaaatacaataaaacatggtcaacccttgargccaagggctttgctaagtccaaaaacttagcaaaaccaaaacataactgatttacccacaaattagataacaataagtgattcaagtttgcgagccata

SEQ ID NO: 19349 - DNA, 201 bp, Homo sapiens
ttcctgttttgaggaaagattcggagccagctaaggttttctgagggcccgtcatgtctcagactgtcacacttattcctctgtcatgtatgcttaagtcygttttagatgaccccttgtaaagaaaggaagcctggcccctgaagcctcattgcgtgggataaggggactaacatattctgtggttgtaccagcaaatta

SEQ ID NO: 19350 - DNA, 201 bp, Homo sapiens
aataatttaagcttctagattatttttgtgcagaagcagtattctctggttctctttgtcatttcctttctaattatcagggctgtccttatctgttcagkgcttcccatctgtccatttttttttttcaaagccacagggtacatttttgcatttacttctgttgctctgtttcctgattttttttaaagtgaacttttt

SEQ ID NO: 19351 - DNA, 201 bp, Homo sapiens
tgtgttgttcaggtgcattttgagaacttgagaagtgcctgggggtgtaggcaagagaccagtatccccaaggagcacaatattggattccaaggttgggkttgaagagggagaggtgggctagctcttttgaaagtggtgtctggtgctgatagaaaacctaagaacaaatggagaatttgaaagctgcaatggggcgtg

SEQ ID NO: 19352 - DNA, 201 bp, Homo sapiens
tgttaagggttttctggaacaagctgagcatcttttgtgtcattaggaactcaacatcatcttattacttatattgtgtgtataatttattttgtggccayatgtccccttttatggaagccacttggggatagagaccaaatctacccactttcattctcagcatctggaggacatctctctaaggaatggcatctgaaa

SEQ ID NO: 19353 - DNA, 201 bp, Homo sapiens
tctcattttgcattacaatagcatctagtaacattcaagcctcaattaattgaaccaataattattatattaaaaatggtatgtatgccccagggcagagrttaggctatggtgggcatttgagaccttagggccatagaccccgaaacatgcattctccagaactgagtatgcaactgtttgctttcgaccttacagcac

SEQ ID NO: 19354 - DNA, 201 bp, Homo sapiens
tcacagactcccctaacgtccatgaagatcatcaccaggatttgagggaatgctgtggtgcatactttgtgttggacagttatgggggattgcttttgccrtctcagcatttcaccgctgtcctcggtatgagattatggtgatgttgaatgggggtcattagaaggctgtccacagaggggatcagcccccctcaatgac

SEQ ID NO: 19355 - DNA, 201 bp, Homo sapiens
ctacagacattttgagtactgttaagcataaacaatatttcaaggtgtctacaactataatatagtgtgtaatatctcagatttctatcgacggtagagtyacaggtctttctaatacttttgtggtttgatgcctacattttataatggaaggaaatgctaaatttcagttagaggttaataaaaataaagaaggaaaat

SEQ ID NO: 19356 - DNA, 201 bp, Homo sapiens
ggagtgctagggtgaccctagcactgtatccagctcttctcacctctttaggaattttaagcccacaaattaagtatggaatttattacatggtatcttgsatttcagaagcagaatctgagatggggatttttgccagagatttattgggggagtgctctcagaagtgaggaaaacagaaagggacagagaaaaaaatgt

SEQ ID NO: 19357 - DNA, 201 bp, Homo sapiens
gttccggcagccattgccaggaagcagcattcgcacccctacatgtccaaatgcattactcatccaaaataagatatgccacgactcaggtttccctcctyagccaccatggcttgaatggctgcatttagaaacagcccttacttcaagcccctatttcttaattatttgtcacttattcgcattcatccttgtgtgtga

SEQ ID NO: 19358 - DNA, 201 bp, Homo sapiens
cgactcaggtttccctccttagccaccatggcttgaatggctgcatttagaaacagcccttacttcaagcccctatttcttaattatttgtcacttattcscattcatccttgtgtgtgaaacatttttcccctcaccctatatgctgttatgtaaacaagtaattttttaggatgatgtcagaacctgatgtagttgggg

SEQ ID NO: 19359 - DNA, 201 bp, Homo sapiens
gggactctggaacaaaaattacaccaaagagttgtcctcaccttgaggcaagaggggcttcccttttgtgccccatatcattcagccattgactggctgtkggggggaagggaagtgtaaccctccttgaaaggagatcccctcagctgaggatggttctctagagaagaatgcagatgtgagccataagcagcctacaca

SEQ ID NO: 19360 - DNA, 201 bp, Homo sapiens
ggctgggaggatgccggccgtagtgagagggctcttgtctgtgctctgttggctttaggcatctccacctccctgttttgtggtttaaactagacctactwtggcttttaaggccaccattatttcctcaatgtggagaaactcagtaatgcaagttctctgttccacgttaggggtcacattatggttaaagacaatggg

SEQ ID NO: 19361 - DNA, 201 bp, Homo sapiens
acagtccaggaataatttacaaagtgagatttagattagtgtgtaagaatttcactgcagaggccacttctggctgaggagaagatgttctatggagaaarggagaattggccagagccttaaaggtggagtaggatttgggtcctcagggaatggaggggctgatggatgctaaaggtctctcacgtggctgaatatcta

SEQ ID NO: 19362 - DNA, 201 bp, Homo sapiens
gaaagtttctgtagttcttggccctgtaagaggagaggggtagaagatgctgagtatttttctagaagactggactggacgggtggggctgggaggatgcyggccgtagtgagagggctcttgtctgtgctctgttggctttaggcatctccacctccctgttttgtggtttaaactagacctactatggcttttaaggcc

SEQ ID NO: 19363 - DNA, 201 bp, Homo sapiens
tatccctcctcctcagctgagcataccaatggtgatgacagaggccctgtcttcaatccctgtacacagaatagcgctctgaaaattataactcttctcasgcttcatcagcaggcccccaaagagacctggctacagcagggcttccaggtctttcactgcggtaggcagaatggccccccaaagatgtccatgccctaa

SEQ ID NO: 19364 - DNA, 201 bp, Homo sapiens
caatcttccttcccatgggcgcacacacacttttatatgctaacccattcattggcccagggtgggaaataagggatggatggggctggcatgtggagtaytggggtgtaagagcagccccttagaaaaatgggggactaaattgaaagtttctgtagttcttggccctgtaagaggagaggggtagaagatgctgagtat

SEQ ID NO: 19365 - DNA, 201 bp, Homo sapiens
ttgcccaagacttccatgatattttccctgataatcaaggaagggagtgttggctgggacacttttttcttttggaaatgtggcaggggaatatgaatttycataggcgaaattactctgtctggtcgagtctagactgttcgttggccagcacgtttgctggcgcccacactgacactctgaggtgctgcctggacttat

SEQ ID NO: 19366 - DNA, 201 bp, Homo sapiens
tgattatgcccctgcccaatcttccttcccatgggcgcacacacacttttatatgctaacccattcattggcccagggtgggaaataagggatggatgggkctggcatgtggagtattggggtgtaagagcagccccttagaaaaatgggggactaaattgaaagtttctgtagttcttggccctgtaagaggagaggggt

SEQ ID NO: 19367 - DNA, 201 bp, Homo sapiens
cagctccaagtcagtcattaggctcccacacagcttctggctgcactgtggacagatgtcctgaggctggggggagaggagacccaggattcataaagcarcagctggacagaaacctgacactctgaactttcagcatttcatgacatttgaggtctgactttccttcccatgtggtcctgcagcccaggcagatgctgg

SEQ ID NO: 19368 - DNA, 201 bp, Homo sapiens
tcatggtgtcttgcgtggcttcgaccctagtgctgagaggctcctctggagagctggccaatgcatctgtccatcttcttcgccagtatgcggagctctcrtgcaccccaagacccttggccatgaaccttccttcagctttctcctcagagaggccttccttgacctgcctggcaaaaccagccactccctggcatgagg

SEQ ID NO: 19369 - DNA, 201 bp, Homo sapiens
tagttgccatcttttcttggtggctgattctaagtggctgaaggaaacaccaggaaacattctgtaaaatgttccttggaaatggcaggcaaaaacaagawacagtgagtgtccctatttacatttggaggtctcatagccatttgcttttttctttaatgtttcaaccctacctgtcagagctttctgggaggcaagtat

SEQ ID NO: 19370 - DNA, 201 bp, Homo sapiens
agttcctctgcccttggtgagtgaacaactattctgacataggctttctcttgcccttgacttttatcagaagctgtacgaagatttttgttataaaagcrtaagctcaagaggggaaagtaatactagctgccgcttatggagggcttcatttgggtcacatgctgcaaagctgagggtttcgtgtgtattttatcccag

SEQ ID NO: 19371 - DNA, 201 bp, Homo sapiens
tttcacgcatgtacacttatgcatccccattgccagtactccggaaggacccctgcaccctttcccagtcagttcctctgcccttggtgagtgaacaactrttctgacataggctttctcttgcccttgacttttatcagaagctgtacgaagatttttgttataaaagcgtaagctcaagaggggaaagtaatactagct

SEQ ID NO: 19372 - DNA, 201 bp, Homo sapiens
tgcagaggttttgtttttgtcaatttttcctttaagcttttctatgaggtataatactaaagcacttaacacacccagctgtgagtgcacagcccgatggkttttcacgcatgtacacttatgcatccccattgccagtactccggaaggacccctgcaccctttcccagtcagttcctctgcccttggtgagtgaacaac

SEQ ID NO: 19373 - DNA, 201 bp, Homo sapiens
tgtttaggtcctttgcccaattttaaattggattgtttggtttttattgttgttgagttatcctcatggcattttgcacatgggcagtcttgctaggaaakgcttgtcctaagtcccctctgcccctgccccactctgtcctcggcacttctctttcttcccctgtatgggctctgcctccttcgtgaagcctgttaaggg

SEQ ID NO: 19374 - DNA, 201 bp, Homo sapiens
atctgcttgttggtcattttatatcttttttggagaaatgtttaggtcctttgcccaattttaaattggattgtttggtttttattgttgttgagttatcstcatggcattttgcacatgggcagtcttgctaggaaaggcttgtcctaagtcccctctgcccctgccccactctgtcctcggcacttctctttcttcccc

SEQ ID NO: 19375 - DNA, 201 bp, Homo sapiens
catcatctgcttgttggtcattttatatcttttttggagaaatgtttaggtcctttgcccaattttaaattggattgtttggtttttattgttgttgagtyatcctcatggcattttgcacatgggcagtcttgctaggaaaggcttgtcctaagtcccctctgcccctgccccactctgtcctcggcacttctctttctt

SEQ ID NO: 19376 - DNA, 201 bp, Homo sapiens
aatattttattgtgattttggtttgcatctccctgatgattagtaacattgagcattgtttcatcatctgcttgttggtcattttatatcttttttggagraatgtttaggtcctttgcccaattttaaattggattgtttggtttttattgttgttgagttatcctcatggcattttgcacatgggcagtcttgctagga

SEQ ID NO: 19377 - DNA, 201 bp, Homo sapiens
taccaccttaaccattttgagtgtacagtagtggtaaatgtatggcacattgttgtacaacaaacctttaaactttatcttgcaaaacttacatccattgracaacactctcctttttctccttcccgtggttcctggcaacattgtatttctattaagagtttgactactttagatcttatgtgagtggagtgtggtgtt

SEQ ID NO: 19378 - DNA, 201 bp, Homo sapiens
tatgaagttattgcatcatccactcagtaagccactgtatatgggtgctgggcaaagaggagcatctgacaccatctgctttccttgtgccttttgtttgkttttctaattgtggccaaacacatgacataaaacttaccaccttaaccattttgagtgtacagtagtggtaaatgtatggcacattgttgtacaacaaac

SEQ ID NO: 19379 - DNA, 201 bp, Homo sapiens
taccacagatcagtatcacaaaggagtcatttctggggacagtgaacagcaatgaggaccacagggaagatttagcaaagggagccaagaaggcagcactrgagcatttgtggataatggtgccatggatagtcctgtctaattaattgcatgcaggactatttttttaatgttttatgaagttattgcatcatccactca

SEQ ID NO: 19380 - DNA, 201 bp, Homo sapiens
tggtggcctgaccctgactggacaaatgggccccagaggggctgaacccttgtctgccattctggggaaagaaagggaagaagctgactcatctgtaaatyaaagggtagcccaaggtcctgattcagaacaaaaaggaggtggtggccccgtggcagcataacacaagatgctcttaagggcatcgagcctagagtcaga

SEQ ID NO: 19381 - DNA, 201 bp, Homo sapiens
ggtcctgcacaggctccctgagcccgctgtttgccttggtttccagtcctttcatcactgtcatggctggccctggaccctctccaaacttccacattccyccaggcatggtggcctgaccctgactggacaaatgggccccagaggggctgaacccttgtctgccattctggggaaagaaagggaagaagctgactcatc

SEQ ID NO: 19382 - DNA, 201 bp, Homo sapiens
tataatactaaagcacttaacacacccagctgtgagtgcacagcccgatgggttttcacgcatgtacacttatgcatccccattgccagtactccggaagracccctgcaccctttcccagtcagttcctctgcccttggtgagtgaacaactattctgacataggctttctcttgcccttgacttttatcagaagctgta

SEQ ID NO: 19383 - DNA, 201 bp, Homo sapiens
atgcctacattttataatggaaggaaatgctaaatttcagttagaggttaataaaaataaagaaggaaaattcttttcctctatctaaatccacagatgcyctgaattctcttcgaggttaagaacttctggtttaagatatgcttttggttgacagtagtaaaacaagccaaaagaagttgaccatttatgtgatgtgca

SEQ ID NO: 19384 - DNA, 201 bp, Homo sapiens
ctgacaattcaatacagtcccattgctcaggcagaacctatttcatatataaatttcctgcatccccaaggcagagcaaatagggggaaatgaccaaactrtaatctgagagttctttactcaactggattatcattcatctaagagcatctgaaagacagtctcacacaagcaaagactgaaaggacatccaccaccacg

SEQ ID NO: 19385 - DNA, 201 bp, Homo sapiens
aattcaatacagtcccattgctcaggcagaacctatttcatatataaatttcctgcatccccaaggcagagcaaatagggggaaatgaccaaactataatytgagagttctttactcaactggattatcattcatctaagagcatctgaaagacagtctcacacaagcaaagactgaaaggacatccaccaccacgtacct

SEQ ID NO: 19386 - DNA, 201 bp, Homo sapiens
ggccttccacaaagtgttttagggaaaaaataacaagaaacaaaaatatatggatttgttttgtcttgaggcagactggaaatgctggaaatttattttgsatcgtagaaaaacttcatgtggtgggaaaatgttcacttgctccaaggtcaggtattaagttagcaaagtcctaatgcttttgctacccattagtggatg

SEQ ID NO: 19387 - DNA, 201 bp, Homo sapiens
cagcaggatatctgtaaagccagaatcatctggtggcaacatataattgtcctatggttgtaaccttgatagtgctgttaccatgggggttgggtggtggrgcgaagtgcatttcccaaaactgttggctagctgagggatgagagctccatccatgaaaaccagtcttccagaggaggatccccaaacccagagagctat

SEQ ID NO: 19388 - DNA, 201 bp, Homo sapiens
taatactgtttgtttacagatttcatgaaggcatttaccctggcattgtaccactaaaggctgatgttggcggcattattcttaggagacatagaaatgtkgtggttttgagaatgggcttttatattatttggcgtagattattaaagaacagttacctgtgtcatgaaggagaggcccccagactggcactttgaatgc

SEQ ID NO: 19389 - DNA, 201 bp, Homo sapiens
aagaacagttacctgtgtcatgaaggagaggcccccagactggcactttgaatgcaaattcttctgtgacaaatccaggggactttggaataactctcagrtatggcagtagacttaactgtaaaagctcccagcccacagaggtgagcagaggctgaggagtaaacaccataccaacattctgggacaaaatagcctgaa

SEQ ID NO: 19390 - DNA, 201 bp, Homo sapiens
tctgtacattcatgggattcatactcgctttaggagacattctgtagcaagatgagttatatggggccaagttacagcacagagttttaagagattgtccrtagttcagactgtcatcaaagtgactgcatgccctgtctctctgcctccatcctttctcaacgaatctccacctccagagagagcagatctttctgagta

SEQ ID NO: 19391 - DNA, 201 bp, Homo sapiens
ctgtgtctcactctaccccttccctactggtgttttatggaaccacctctggaataaacaacttgctttcaaacctgtctccagctctgcatctgggggcrcctgcactgacattctttattccctagatctgtgtggcttgctacttttttctcccaccacatcacaggtaatgaatgaggctcatttgcacaacataca

SEQ ID NO: 19392 - DNA, 201 bp, Homo sapiens
taagtggctcaataatcacaaatggttactggctactctattggaaagcagagagagagaatattttcatcatcacagaaagttttattagactcaacacraaaggaatttctaacactgcagaggttttgtttttgtcaatttttcctttaagcttttctatgaggtataatactaaagcacttaacacacccagctgtg

SEQ ID NO: 19393 - DNA, 201 bp, Homo sapiens
agcctgcccagcttaggggacagctgaaatgctcagagccaccaacagtagaggcactccaaaactttccaagaagtcatctcagattccctgctgcttcrtagcttttaggagctccagggttgagggaggccacaaaagcaatcaaggactgcaggaggggtgtgctttccatccactttctatattctaaaaattacc

SEQ ID NO: 19394 - DNA, 201 bp, Homo sapiens
cagtctcagctcattgcagcctcaacctcctgggctcaagcaatcctcccacctcagcctcctgagtagctgggactagagttacacaccaccacgcctasctaattttttttgtggagagggggtcgggttttagatacggggtttcaccacgttgcccagctggtctcaaacatgcctgcctcccaaggcttattttac

SEQ ID NO: 19395 - DNA, 201 bp, Homo sapiens
aggtggccaccagccctgtgtccttatttaaacttaaatttatccaaattaaactagaaattcaggtttttagtcatattagccacatttaagtggctcartaatcacaaatggttactggctactctattggaaagcagagagagagaatattttcatcatcacagaaagttttattagactcaacacgaaaggaatttc

SEQ ID NO: 19396 - DNA, 201 bp, Homo sapiens
agcataccctgatacaatgatacaggtacaggtagtttatttgggggtgggcgatctcagtgttgagtttagacaggaaagagaggaaagacaggaaggcrtgcatttataagcaggttactgccgtaggcaccttgggcttgtcttcctcagaccctccaagagactgtgtgtaacaaacctcacatccacttcactcca

SEQ ID NO: 19397 - DNA, 201 bp, Homo sapiens
tataatttacagtacacaaatcttaagattacagtcttgattttcacaattgtacacacctgtgtaaccatatgcccactgagatatagaatatttccatygtcccaaaagtctccgatgtccctttccagccaactcctctcacctgagacaaaccacagctgtgatttgtataatacattacttttgctttttctagaa

SEQ ID NO: 19398 - DNA, 201 bp, Homo sapiens
cccatggcaggaagagttccacaacctggttccagctcctctaagtgacttctaagtccccttgttcaaccctatcttttgggtctcagatttggcttccyccccgctttttttttttttttttttgagaccgaatctggctctgttgcccaggctggagtgcagcggcatgatcgtggctcactgcaacctctgcctccc

SEQ ID NO: 19399 - DNA, 201 bp, Homo sapiens
tatttttctttggtaataataaaataagaaatgggcatttcagggctagtatgcacctgtgtggtacccacaggaaccccattccttctgtctttcctctmagcctgtcttcataggggttttcatctccatactccaaggctgggctttccctgatggtgctttttggtttccgcttccaacactacagctgcattccaa

SEQ ID NO: 19400 - DNA, 201 bp, Homo sapiens
cagcccctctcctgtaaaactcatgaataatccactccttttttagcatttaatcaagaaataaccattaaaataggcaagcagcagcccttggggctgtkttacctatggggtaaccaccttttatttctttactttcttaataaacttgctttcactttactctctgggcttcctcttgaattctttcctttaggaagc

SEQ ID NO: 19401 - DNA, 201 bp, Homo sapiens
aagtctcctggggctgtgtttaagtgccgtgttcacaccaaccctgaccggagatgcaccgaactggacatggctcgaggtgggtgaccattactgctgtsgtggaaatgggttctgtacccttataccttgctcttcttcttcccaggatggcctgatcattcactcacccatccatccttccctccttccctccctcct

SEQ ID NO: 19402 - DNA, 201 bp, Homo sapiens
aaatgcttccagaatgattgcacttggtgaattggataatgcggtatgtctgtgattgtatgttttaacattttagagaaatctgaaagtttaatgtgctrgcatgcacacaccccgctggagaggagcagcagttgccttgtcctcagctcagtttctgtgaactgtgggttgtttctctcttccttgagttgcaagaga

SEQ ID NO: 19403 - DNA, 201 bp, Homo sapiens
aacacatttcatctcttgacaagagaagctgcaaagtcacactgaaaagagcagggatacaggaaggatggggaattgtggccactttgtaatatattacyggtggtgaaagcatcctggctgtccctgaattactgtgacagtctgaataaattcctgcccagcgcaccagaaaagggaacaaggttctattaacctaaa

SEQ ID NO: 19404 - DNA, 201 bp, Homo sapiens
tcctgtcagatgagcagaggcattagattctcacaggaacatgaaccctacacatgtgagggatctagattgtgccgaaaccatcccgccccctccaccgyccgttcatggaaaaattatctttcacaaaactggtccctggtgccataaaggttggagaacactggtctaagggttctggcaggctctcagatgaacctc

SEQ ID NO: 19405 - DNA, 201 bp, Homo sapiens
accaccccaaaacttagtggcttaaatcaaccaccacctgtagcttattctctggttggcagcttaggttgggttcagctgggtggttcttctgttctctscaggactcactcatgcatctgtggtcaacttctgggttagctggttggctggctggcaaaggatggcttcagctgggagggcttatttttgctccatatg

SEQ ID NO: 19406 - DNA, 201 bp, Homo sapiens
gtttggacttagcgggaattagtgggcgatggaattaccacggtccagattccgtcagaagtggcatgccttagcttgatgacgtatctgttttctatcascacaatattgctgcatccctaacaaaccaccccaaaacttagtggcttaaatcaaccaccacctgtagcttattctctggttggcagcttaggttgggtt

SEQ ID NO: 19407 - DNA, 201 bp, Homo sapiens
agagaatattttcatcatcacagaaagttttattagactcaacacgaaaggaatttctaacactgcagaggttttgtttttgtcaatttttcctttaagcktttctatgaggtataatactaaagcacttaacacacccagctgtgagtgcacagcccgatgggttttcacgcatgtacacttatgcatccccattgccag

SEQ ID NO: 19408 - DNA, 201 bp, Homo sapiens
caataatcacaaatggttactggctactctattggaaagcagagagagagaatattttcatcatcacagaaagttttattagactcaacacgaaaggaatktctaacactgcagaggttttgtttttgtcaatttttcctttaagcttttctatgaggtataatactaaagcacttaacacacccagctgtgagtgcacag

SEQ ID NO: 19409 - DNA, 201 bp, Homo sapiens
tttctagaatttcatataaatggaatcctacagtatgtgctcttttatataagacttctttcactcaaaataatattttctgaaattaatccccattgtaygtatcagtagttcattcctgtttatctctacataatattacattttatgaaataaatgttatttttaactagttatttatcggacctccaaagcacctat

SEQ ID NO: 19410 - DNA, 201 bp, Homo sapiens
tcccaaaagtctccgatgtccctttccagccaactcctctcacctgagacaaaccacagctgtgatttgtataatacattacttttgctttttctagaatktcatataaatggaatcctacagtatgtgctcttttatataagacttctttcactcaaaataatattttctgaaattaatccccattgtacgtatcagtag

SEQ ID NO: 19411 - DNA, 201 bp, Homo sapiens
atatttccatcgtcccaaaagtctccgatgtccctttccagccaactcctctcacctgagacaaaccacagctgtgatttgtataatacattacttttgckttttctagaatttcatataaatggaatcctacagtatgtgctcttttatataagacttctttcactcaaaataatattttctgaaattaatccccattgt

SEQ ID NO: 19412 - DNA, 201 bp, Homo sapiens
ccatatgcccactgagatatagaatatttccatcgtcccaaaagtctccgatgtccctttccagccaactcctctcacctgagacaaaccacagctgtgakttgtataatacattacttttgctttttctagaatttcatataaatggaatcctacagtatgtgctcttttatataagacttctttcactcaaaataatat

SEQ ID NO: 19413 - DNA, 201 bp, Homo sapiens
tggagaaatgcttcccccacctggtgattgcatcttgctgtatgggatcaggcctgaaaagtgagttaagtctgttggtgctggaactcatcactgaggarcagcctatgtctgtgccttcaggggtgacagacagtggaccaaggccatgcctgcatattcctccctggacccctcattcaaagccagaatctctttcct

SEQ ID NO: 19414 - DNA, 201 bp, Homo sapiens
cagctatggtcagatattccttccttttctatgtcttcaggttgtttggtgaatattgttcttttttgaatcaggagttggcaacccactcatctgctctrtcagtttttatctatttattctttgaagtggaaccaactattgcagaaaaccaaagacacagttttctagggaagagctagctggagctagatcttcata

SEQ ID NO: 19415 - DNA, 201 bp, Homo sapiens
gggtgacagacagtggaccaaggccatgcctgcatattcctccctggacccctcattcaaagccagaatctctttcctgccagagcagtcctttgtccacrtgggtttctgcagtagcccaagtttgcaggcccttgatagggctggagtgtgagctgtaatcctatgggcttgaaataatctctgctatgggctctttaa

SEQ ID NO: 19416 - DNA, 201 bp, Homo sapiens
gctctttcgcactcatgatacataacttacagggaaaggccctgactccctttttgcatagcgtcactgggaacttcttgttaaatggggttagggagtcrttgacttgccttttcccttctaactacaagttttttgcctggtagcatagacccaacaatccttctactctggggtgtttgctcctgtaggcacccagct

SEQ ID NO: 19417 - DNA, 201 bp, Homo sapiens
agtatacagcaaccattttatttttcttgtgcctcatgaattaatagggcagtgagaggaaagagcatgcatactgagcatctgagcttttttaaagcaaygattcacccagctttctagtataaaaaacttcctctggcccaccccgagcaaaccctcattcactgctcagtcctcccatttgttcatctggaaagaagg

SEQ ID NO: 19418 - DNA, 201 bp, Homo sapiens
cctggcttctcttctttccggtagatgaacttgagcacatgatctcaccacttggagcctagtaaaatccatgctactgttctgcaattgttcttttattytttctctctactaatgttttcacctatggatgtcagttctacttctccttggggctttaactaaaaaggaagaattgtctgtggcttcttagaaagtggt

SEQ ID NO: 19419 - DNA, 201 bp, Homo sapiens
ggagcctagtaaaatccatgctactgttctgcaattgttcttttattctttctctctactaatgttttcacctatggatgtcagttctacttctccttggrgctttaactaaaaaggaagaattgtctgtggcttcttagaaagtggtgtgtggacaggcaagggctgccctgcccttggctggcagcacaggctctgcaa

SEQ ID NO: 19420 - DNA, 201 bp, Homo sapiens
gccttagttttcttcttcttttttttaatgctgcctcaattacagaacagatgcctaagttttcttatctgtgagactgagctaagaataatgttgacctyataaatttgttgcaaagattaaattagacattcatgtaaagcacttaggaccatacctgagacatagtagcctttagttatttttgtctaattcttcttt

SEQ ID NO: 19421 - DNA, 201 bp, Homo sapiens
gccaagacctgagccccaggccagggcagcagcctctgacctttcactccctaacacacaagctggggaccaatgtcactccaaggttggaccctgccccygtgcctctgcttttcccagttgggcatggactccaccaatttcattctctgacttagcgttatgtggtgtggattgtactgctctccctccatttactgt

SEQ ID NO: 19422 - DNA, 201 bp, Homo sapiens
ttgttattcccatcttacaggggtgacagcttagctcagaaagcttgcagtttgctccacgttacaaagctagtaagtagcagagctgagattggaacccycgtccgtctaatggcaatgcttcctcttttgctattctgcctcacaattaaatggagtaggacctgatccccgacatcgagaaactgacggtgttgtcaa

SEQ ID NO: 19423 - DNA, 201 bp, Homo sapiens
agtaggacctgatccccgacatcgagaaactgacggtgttgtcaagaaataaatatcccccccccacacacataaatagagaacaataaaagataacgtcrgaggatgaacccacgagcgtggtttgtgtgggaggatgtcttgatcctgggctcgcagggctgtccgctgaacatgacagttatcctggcttcacagtaa

SEQ ID NO: 19424 - DNA, 201 bp, Homo sapiens
cctggaagaccacttgctcagagtctgaaatgtttacactgcctctgactggcatctctataccagaaaggagaagagggggactagatgtttttgtgtgrtagtctctttcctgctatcttaggctgagttccctaaaacaaaatcctgagatgagacatcatgtaaaaataatttgttaggaagtgttctcaggggaat

SEQ ID NO: 19425 - DNA, 201 bp, Homo sapiens
gcccctctcctgtaaaactcatgaataatccactccttttttagcatttaatcaagaaataaccattaaaataggcaagcagcagcccttggggctgtgtwacctatggggtaaccaccttttatttctttactttcttaataaacttgctttcactttactctctgggcttcctcttgaattctttcctttaggaagcca

SEQ ID NO: 19426 - DNA, 201 bp, Homo sapiens
gggctcacttggtccaccaatgtctgttctgaccaaaaaggacttctgtgttgagtttaaattagcaacagtagcaacaataacaccaaaagcagcaacartgtatctgaatattcagtagatgtcaagtgctatctacattggtactcataccagctcatttaatgttcccaacagtcctttcagctggtagccatttgg

SEQ ID NO: 19427 - DNA, 201 bp, Homo sapiens
cctctcctgggacacatcaagacggctgtgcttaggcacagagcgagtgctcggaaatggaagatgtgctgggctttttgctttgttaaagttgtcagagygttgttcagtgaggaataggaggcaattccaagccaaggagaacatatccttgatttgcatgaaggttgagaattaaaagaacaagctagatagttctgg

SEQ ID NO: 19428 - DNA, 201 bp, Homo sapiens
gtgaaaagatgtgttgtctctagggaaagggagggagaagaatgtgctggaagtggtagggggagagcacagaccccaaagtcagcacggactctgcaggyggcagagtagagcgttcccatgttgagggacctgcgggtgtacatctcaaagcatgtgaatgtgctctgttggtggaactagcacttctctaatcccata

SEQ ID NO: 19429 - DNA, 201 bp, Homo sapiens
ttcaactgtggggttggttgattgacttggtaactgattgttggtcgcttactcctaagcagtacctgagccctggatcttctagtcctgcttgagggacrtgtcagtcattttcaattattcgtgattgcaaacagcagcaggggtaaacaacctttaacgaaacccttgaggacaatcttaattatttcctttgaataa

SEQ ID NO: 19430 - DNA, 201 bp, Homo sapiens
tgttttccaagatgaagagttgtggagatggatggtggtgaaggttgcataacatgcatatacttaatcccccgaactgcacagttacaaatggttaagayggtaaactttctgttatgcatatttacaattacacacacacacacacacacacccttcagtgcacgcaaaccctgctggactccaaccttcagagcttcc

SEQ ID NO: 19431 - DNA, 201 bp, Homo sapiens
ttgttttattgatttactaaaattacacagttgttcgggcctgggagttaaattctcttcaccagatgccaaatcctacgtttttcttaccacatcatggygccacaggttaaggaatacagtgcagggttctgaatctctctcctgtaggacagtgcttcccaagcctggctacttgacaaatctcccaagaggtgttgg

SEQ ID NO: 19432 - DNA, 201 bp, Homo sapiens
tagctgggactacaggcatgcacaatgcctggctcatttttttatttttttgtaaacatagggtctcactatgtttctcatactggtcctgaactcctggsctccagctatcctcccacctcagcctcccaaagtgctgggattataggtgtgaaccaacgcacctggcctggatttgatttattaatctgggaaaaacgt

SEQ ID NO: 19433 - DNA, 201 bp, Homo sapiens
ggctgagacaagagaattgcttgaacccgggaggtggaggttgcagtgagcggagatcgccgcactgcactccagcctgggtaacagagcaagacaccatytcaaaaaaaaaaaaaaaaaaaaaaaaaaaaaaagggcctttgagtttgtggcatctttaactggggatgggataggaggagagagccttgcttctcaagg

SEQ ID NO: 19434 - DNA, 201 bp, Homo sapiens
gtagagtgtctgcagtctactcatccagtcccctgatactggaatttaggttgcttctgtttcacacttcttttaacagtgccacattaaatatccctggrgccaaatatttgcacaaatctttcattatgtcgttaggttgaaagcctagaaatagaattgccatcaaaaggagtgtatattttaagctttttaaaaatt

SEQ ID NO: 19435 - DNA, 201 bp, Homo sapiens
ttcggcggaagccatatgacccacctctgtcattttagggagactgagcatggctggtaaatctcagtgatggctggagccctgggggtccttagtttccyagcaagtgccctgtcctgctcttgcctttctgagcatcatcctcgtggcattctggagcatgaggacccaaggctgggtctgagtggatgactgtagtta

SEQ ID NO: 19436 - DNA, 201 bp, Homo sapiens
ggtgaagtgtagacagtggggcttcaatagcttaagggcagaagaagacccacggttctggctcttggagccaaacgaagactgaagccacagtgtgcatrtaaagggagtccaaggagcattgggtggggcattgaaattgtttgctacagtcggtttaccttcaactggtttccttcttgttctgaaggatatattaca

SEQ ID NO: 19437 - DNA, 201 bp, Homo sapiens
gcccctttcctgtagccgggggatgctcctgctggggatggcccaccctaggcagcttttcagttcaagatggaggatacagaggttcattcttgctcctstttgcatgcaaactgttctatttctgttttgcagtgggagagaggatacggtttataattccgcactgctgctattttttttcctatttgcccctaaatg

SEQ ID NO: 19438 - DNA, 201 bp, Homo sapiens
gtctctgagccaggttagtgacgatgtcctttgtgatatctgccagcctttgctggagtcccctttgagggcctcagacttctgttgtatgatgtagaggmcttgtttgtctgcccctttgcctagctggagtgttgcaggaggagcagcagcattccaagaccagggtgcagtgaatgactgagatcccaagatgaaggt

SEQ ID NO: 19439 - DNA, 201 bp, Homo sapiens
atcttttcagtggcttgttctgaactctgggccatggtaatctctgtatcccttgggatcagcctggtaaacagccagctgaattaacttcagaaaagacycactcatgggctggcctgcggtagtcttgctggatggtggcctaggtacagagcagtgctgggctgcggaggaagccacgatgttctgtaaacacataga

SEQ ID NO: 19440 - DNA, 201 bp, Homo sapiens
ctgtaaaatggggataatattagtacctcccgtagggttgctgtgaagagtaaatttgatcctgcccgcaatgagcctaacccagcacctgcacactctaygtgcctgctacatgctggttgccctaattagaagtttagagtcctgcattgatgagaggacctaaaaggcttatgaggccaggcatagtggctcaggctt

SEQ ID NO: 19441 - DNA, 201 bp, Homo sapiens
gagggggcactgggtacctgttggttcccttttcctcctttcaggctgatgtggggtgggtagaatagggcacgggtgatgtatttgactactggggtgcrtgctacagcttggcatcttaacatgaataaccatcttaacctcctctggccacctgcttccctatctgtaaaatggggataatattagtacctcccgtag

SEQ ID NO: 19442 - DNA, 201 bp, Homo sapiens
aagaagagcttatgaggcctttcaggtcccatggctccattgggcaagcattggtccctagtgagtcccctccctctggaaatgaagggtttggtgtggtyagaggtggctatcctggcaccagctcttcctttactcaagcctgggctgctttctgcccagtaagggatgcggacaattcctggggtttccccgtggtgg

SEQ ID NO: 19443 - DNA, 201 bp, Homo sapiens
agcagaacgaaaaaatggtatggaaagcaaggcacctgaaaaaattttcaaagggagaaaaagaatgagcaaaactatcctgtagaggagagagacattgmaaatgacatatacagacacagaaaaggttgctcagtcaacaacttctgcaggctcaaagcatgggaagtaatcagtaaatggccaatttatctctccctc

SEQ ID NO: 19444 - DNA, 201 bp, Homo sapiens
ttctctatcaccagcaaatctcccttttcaacaaagatggagtagaccttaggctcagaggcttccaaaggcaacagagttcagcattgctctgttttcaktgtgttcatttttacaactaccttctctttttggcaagtgatcctggattcccatctatgacagtgatataaattgttcttttaaaacaatctttaaact

SEQ ID NO: 19445 - DNA, 201 bp, Homo sapiens
ttgtaaaactgtcttgcccttgttctaattgcgtattgatcaccgaggttcttggcatcgggcttttctttgatgtgtgcatgatcagaacacactaagakacagcctgtgtgctccttcctgtcctcgtgggcatttcctaaagcttcagccctaagctggtatatgtttctctgttacatcaactgccaaggcaattac

SEQ ID NO: 19446 - DNA, 201 bp, Homo sapiens
ttccagcactgttatgcaaattggagagactcatgccaaggtgaagggcttggtgagagcagccaggtcttctatgcagtgatcagcctgcacagctgggygtggcatctctggctcccaggtggttccagtgcacacccccagttaagaaccaatgaagaatgttgcttgttaacaacctttgaaggctttttagcaaaa

SEQ ID NO: 19447 - DNA, 201 bp, Homo sapiens
tgcagatgctccttgaactatgttggggttatgtcctgataaacccatagttagttgaaaatatcataagttgaaaatgcatttaatacactcagcctacsaaacatcatagcttagcctagcctacttaaacatgcttagaacagttccattaacctacagttgggcagaatcatctggcaacacagccctccatagagt

SEQ ID NO: 19448 - DNA, 201 bp, Homo sapiens
gtgagtcctggaaattggaggacctctgtaccttctcttccaaaatctgtaaacatactgtttccgcttggcagtcttgatttgctttcagtgactctgaraagccctgtggtttgtgaagagcctcttggctttcctttgaccttggttggaagccatgtgcccaggtggaaagacagcagttccctacagcctttctct

SEQ ID NO: 19449 - DNA, 201 bp, Homo sapiens
tttagccgcttctttttactggtccacaagacttggttattttctattgacactattttcaagatcacataatttacatcacataaaacatgactgtgatytaatagaagcctatgcaaagcatagatagggtagacttcattcccattgcacaaaatccagaagggcttcagtggggaggtagcatttaaacagaggagt

SEQ ID NO: 19450 - DNA, 201 bp, Homo sapiens
cagatttttctatgcttttaaaaatcggttattcaacaagctacataattgtttaaaggctccactgccattgtacacaggagaaaggcagaaatactagycttgggcctgctttttacatttcatcatagtttttaaacagacacattaatttctcgacaataagaggcttttttggcatcaaaatttaaagcatttccc

SEQ ID NO: 19451 - DNA, 201 bp, Homo sapiens
ggcctaagccggccaaacaaacggcagggcaagacctggcaggatgctggggtgggggcgggagtgggccaggatggtgttaacccatccacaggggagtygcctttggcctgcccacagcagtgatcccaaggcttttgtcaccccttgggaaaggaaggacaaggaagtcaggctgtgtgggcacctgatcctgctgct

SEQ ID NO: 19452 - DNA, 201 bp, Homo sapiens
aaaaacaatggccaaaaataatgcagatattacacatgaacatttgcagagaatccagtataaagacatttgttaaaaataaagatggtaatacaagctcwcctgtcctcctggctctgatgagtgaaatagtgcaaatcagcatccttttcttcattgcttaccccattcatgcttgaaatgggatttcccagacatgcc

SEQ ID NO: 19453 - DNA, 201 bp, Homo sapiens
tggctaccctcttaaatattattaaccatgctgaccatgccacatttccccagcatctaggagtgttctcttcctagagcatgctttctgagttgttcacrtgaacatctacagtgttgcaggagcctttttttttcctatgggcaaaatcatctattgaccaaaacaagacatttaagtcactcagattctgaaggtacc

SEQ ID NO: 19454 - DNA, 201 bp, Homo sapiens
gtgaagaagagaacattccagatagaggaacagtcaccacttgtgagtgtatgatgagtatctgctgtgctgggagctacacccggttctccattctgttwgcctagctcttatacaaataggcaagagtaagtgttccgtatgccttctgcagatgtacagcagatagatattttggcagaatgacagagagtactgaac

SEQ ID NO: 19455 - DNA, 201 bp, Homo sapiens
ttcatttttatttaaaaggctgatttaataatagaaagaaaaactccaggcaaacaaaaacactaacggacctgaacctactgacgttcttagatattttkaatgtcatgagtgactccttttgctactcacagtgtagcccctggcctagcattgtcagcatcactgggaacttgttagaaatgcaggactttgggctcc

SEQ ID NO: 19456 - DNA, 201 bp, Homo sapiens
aggatctatgagctcttgggtgctgccaggagttagaactgggatgagttgagtgtcaaggtgtttgacctactactgcccagcagtctaacatttctttraacacctactttgtagcaggcactatgatgggtgttttataaacattcttttgcttaaaccttacaagaaaccttcttaggtacacttttattcctcctg

SEQ ID NO: 19457 - DNA, 201 bp, Homo sapiens
gtgggagccctgccttctcataacctcagtggtgagcatctttgcagagttcctctgtcctgtgccagactctaggggaaggtgtaggtccgcttcctcakttgaatttttctagggaaatggcattttcagacattgttcctggtcctcactcaccctacagagcctgctttctcaagctctcaagaaggaacaacacat

SEQ ID NO: 19458 - DNA, 201 bp, Homo sapiens
gctaaagacttgctgatcacattaggattactttttttttttctttcaacaactttaagaccaagtgtcctagggaagctggaataaagcagtcacagttsttatttgtgactgtggtcttttcctgtgactccatttccctattatctgtttcagaaactgtctgggcagaagataaatccagtgctccggatgtttggt

SEQ ID NO: 19459 - DNA, 201 bp, Homo sapiens
tgtggatttgcatgggccacaggtcaaagccacactgcctgggaaaggaatgggtagagacgagagcagatctgacagagaaaaggtgttcagcctacttkgatttaaaacggggatgaagaaaagctgtgtgacatgagcagatttggccagtgtgggaaaagacagtctggccttcagcttggtacccagggtaaatgg

SEQ ID NO: 19460 - DNA, 201 bp, Homo sapiens
cactccgagattctcagtaaaaaaaaaaaaaaaaaaaaaaaaaaatcaaggaaatcttaatggccaaagccataggtccaaaacccggcgttccctcccamccaactttccaggccattttctccaatagcccctcatccctgaccttgtcttccagcctccctggaccatgaatgctgctgaaggctctcactttgtact

SEQ ID NO: 19461 - DNA, 201 bp, Homo sapiens
gcgcctggaggcgggcgggggcgtccgggtgcctccctggggtcccagcccagagcgtggggggagagccgctagagttgtctcctccgccgcccagctaractcggcttcactctctgaatcgaaaagtaacttggctcctctgcctccgggcggccgccgctggcccagcgagcctcctgaacctcgcagggcctggag

SEQ ID NO: 19462 - DNA, 201 bp, Homo sapiens
tccggggcccgctaaggtcggggtcggcgcctggaggcgggcgggggcgtccgggtgcctccctggggtcccagcccagagcgtggggggagagccgctaragttgtctcctccgccgcccagctagactcggcttcactctctgaatcgaaaagtaacttggctcctctgcctccgggcggccgccgctggcccagcgag

SEQ ID NO: 19463 - DNA, 201 bp, Homo sapiens
aagaggggcaagggcacaggacaaaagccataagtcagctgagttgcctctcctttaagaaacctcctgagaagcctaccacccaaataacatgctcatayctcattggccagacactgcacatggccactctgtctgcaaaagagactgggaaacatagttttatttatttttaaagctaggcatattaacactccacta

SEQ ID NO: 19464 - DNA, 201 bp, Homo sapiens
tgaagcaacatggaaaatgagtgaactctaggttaggagcatctgttctagattccattcattctagatgttaaatcaacaagaaattctgcttgcctacraataacagaatccctaaaagcagtggctcttataaattaggtgtttactttttttcaggtagtaagaagtccccaggaaggcatcccatgtcaggtgcag

SEQ ID NO: 19465 - DNA, 201 bp, Homo sapiens
aagacaagtaataataaaggagtgtgtggccttcaactgcctgctaaagacttgctgatcacattaggattactttttttttttctttcaacaactttaasaccaagtgtcctagggaagctggaataaagcagtcacagttcttatttgtgactgtggtcttttcctgtgactccatttccctattatctgtttcagaaa

SEQ ID NO: 19466 - DNA, 201 bp, Homo sapiens
aaggttctctgcttttaaggattcacataattagactgtgcccagccagataatcctggaaaatctttccatctcaagacccttaaccttaatcacatttkcagtccttttttgccatataaggtgacatattcacaggttccagggattaggagggggactattagtctaccaaccacaggggatcttaggacctctgaa

SEQ ID NO: 19467 - DNA, 201 bp, Homo sapiens
catggtagtctaggtggatttttttcattaacacagaacttagaaaaaattttaaatgatgacgtttggccaagacaagtaataataaaggagtgtgtggycttcaactgcctgctaaagacttgctgatcacattaggattactttttttttttctttcaacaactttaagaccaagtgtcctagggaagctggaataaa

SEQ ID NO: 19468 - DNA, 201 bp, Homo sapiens
gtggatcacctgaggtcagaagttcaagaccggccttaccaatatggtgaaaccccatctctactaaaaatataaaaattagcggggcgtggtggcgtgtscctgtggtacccagctactagggaggctgagacaagagaattgcttgaacccgggaggtggaggttgcagtgagcggagatcgccgcactgcactccagc

SEQ ID NO: 19469 - DNA, 201 bp, Homo sapiens
gtaaccaccatcctcaactccacattgcaaaaaggaacgctcggaaactcagtaggaaaacttacgaatatggaaactattttgccatgaggcatacatastctgaggggcatttatctatccagaccatcctcttttcattagaagtacataacaggagattaataaacttcggtgattcagcccacaaggcaggaggaa

SEQ ID NO: 19470 - DNA, 201 bp, Homo sapiens
gtctctgccaggctttggtatcaggatgatgctggcctcataaaatgaattggggaggattccctctttttctgttgattggaatagtttcagaaggaatrgtcccagctcctccttgtacctctggtagaattcggctgtgaatccatctggtcctggatgttgtttggttggtaagctattaattgttgcctcaatttc

SEQ ID NO: 19471 - DNA, 201 bp, Homo sapiens
acatagccctggtacagaaaccagaaatggagagcgggcacactcacgcaaaaataggaagcagtgagccaaactcactttgaaaacagatacaaaagttytaaataaattgcaaattgagggccgggcgcggtggctcacgcctgtaatcccagcactttgggaggccgaggcgggtggatcatgaggtcaggagatcga

SEQ ID NO: 19472 - DNA, 201 bp, Homo sapiens
gcacaagggtttcaatttctccacattcttgacaattcttgtcttctgtttttttgatagttgccatcctaatagtcatgaagtgggaaaaaatagttttwaaaaagtaacagatggataaacaactaagagaaagaaggaaggagtgaaggatggacggatggacagacttggctgccctatactattatcctagtcatc

SEQ ID NO: 19473 - DNA, 201 bp, Homo sapiens
tagaagactgttgtagtcagctgtgcttgtcataaagttttgtttaaaattattttagaattttcttctttggctttaatttaaatttttgtttgtttacttttttttttttttttccccggctcactgcaagctccacctcccaggttcacaccattctcctgcctcagcctcccaagcagctgggactacaggcgcccg

SEQ ID NO: 19474 - DNA, 201 bp, Homo sapiens
tggaatgagtcagtttatttggctggtgaaggaggaacctaggttggagcagggatgagagggtagaagagagcaaaggaggaggggcaggagagaacccrgtaggatggaaagaggctgcccatgttgaacaaagggccagtaacatttctggtggcagggagatgtcaggacattttagaaatctgatgcctgctgtta

SEQ ID NO: 19475 - DNA, 201 bp, Homo sapiens
ttcccagatgccttcacagatggccctgcctcagggcctttgcacctgcctttgctgagaacactgttccctccaatctttgcatagctggctccttcttmttatgcagatctgagcccagagttcactttctcaataagtcttccctgaacactttacctaaagttgcaaacccccattactctctatctcatttgtatg

SEQ ID NO: 19476 - DNA, 201 bp, Homo sapiens
tttgagatatccatccaggtgttcacgtaagtgctgagatttttaccaaggcatcgcattatctcccaaagcctctttcccatcatcctaagtggggttcyctagaagcagagcctgagaaagggaattgggaacacatggtctaatgatgctgtgctcttagggaaaacctgtaaaggaaaggcatgggggctcaaaatg

SEQ ID NO: 19477 - DNA, 201 bp, Homo sapiens
tgtccatggatgatgggtggtcctttcaggtgagacatagctgctgaagtctagcaactccttcctggctgcaataccctaacttcattggtccattgttygtggaacaggcacttacacaagtagcacacacagtaggtgccctgcccataacccctcagccctcacccttcccaatctatccgcaaactgggcagattc

SEQ ID NO: 19478 - DNA, 201 bp, Homo sapiens
aaagaccatcattcttcagaaggatctcccaaagaatgccattgaaaactcctcattaccttcaaatggggtgatgcacacacgagtagcatgaaattagscatgttcatattaaggagcaatctaagatcattattgctgtttctctggccttatattaaatagtgtcattgcaattgaaaaattagagtaaatgaacag

SEQ ID NO: 19479 - DNA, 201 bp, Homo sapiens
agtaaatgaacagagcctgtgagcatccaccctttgtaggttatcctgagtctgcattattacagggtcttgaaatgaatggtgatacgtgaaagtatttktcctaggattcattaatattattatattttagtctttggtcaatatgaagaaatactcaatagtaaatcatagcaacatgatttaacatgagatataatt

SEQ ID NO: 19480 - DNA, 201 bp, Homo sapiens
cactcccgtgttctttgtttcaaagctgaaacaaaaggtacattgtcgttatctgttctgaatcaagaacatagtgtgtcctctaagtttttcagtacacktttgttcacttcatgatatttaaatcagggttgttgtcattacaaccctttcaagacctagggcttggatttcaagtgccttttcaggtgccagtgaaaa

SEQ ID NO: 19481 - DNA, 201 bp, Homo sapiens
gagagcagctttcaggctgacagctgtgggcagcaatcctgactctcacacttgcctgacatgaggccttaagggggctgcttaccttctgtgaccctcastttcttcctctgtaaaaaggagaccatcacctccagtttggtatgtagaggttatgcaaggaaaatgtttagcactgcgcttagcacacagaagccaggg

SEQ ID NO: 19482 - DNA, 201 bp, Homo sapiens
tagtgggggagaaagatgcaggatggtggtttaggggatactggggaggagactctcagaaaagaaaacaattaggcaggcaccccaaaggagttcgctcytgcaggatttcatcgttgttagtgctgctgctgcctgaattgcaggctgttgtatcataccagctagctatgctgcatacaaactgcccccaaattgaat

SEQ ID NO: 19483 - DNA, 201 bp, Homo sapiens
ggtcttaatgtttccggcttattgccatattccatatgtaatttcctccattcctttcaaggggaaagccactgagtgttacccagctgccactgctgacyggttgcccacttcactgagggcctttgaagacagcggttggcggggacagtgttgaagtcctcttccctttacagaaccgtggctcttgaatgtccttct

SEQ ID NO: 19484 - DNA, 201 bp, Homo sapiens
tcctccattcctttcaaggggaaagccactgagtgttacccagctgccactgctgaccggttgcccacttcactgagggcctttgaagacagcggttggcrgggacagtgttgaagtcctcttccctttacagaaccgtggctcttgaatgtccttctagagtagctcttggcattgctacctatggtcatttgctgctgc

SEQ ID NO: 19485 - DNA, 201 bp, Homo sapiens
agtagctcttggcattgctacctatggtcatttgctgctgccttgaggtccggagccaaaagtggttgttcccaaaagtgttgcataaacgtgaatcgtgwcatggtactgaaagctgagcagagcagctggccatgccgccgcattcacagcaccacacaagcctgaaggtctgcatgctttatgcttgcaagatggcca

SEQ ID NO: 19486 - DNA, 201 bp, Homo sapiens
ggagtgcagtggtgcagtcttggctcactgcaacctccgcctcccgggttcaagcaattctcctgcctcagcctcctgtgtagctaggattataggtgtgygccaccatgcctggctaatttttgtatttttagtagagacagggtttcaccatattggccaggctagtcttgagctcctggcctcaagtgatccacccac

SEQ ID NO: 19487 - DNA, 201 bp, Homo sapiens
gagcaacatgtcaaagggcatcccaactggttgtattatttaccttgaagtgaagtgtcaggatttgaactgtcagccctcagggagaagtgttccagctmccaggttttttttttttttttttttttttttttttttttttttttttttttttttttgagacggagtctcccgctgtcaccaaggctggagtgcagtggc

SEQ ID NO: 19488 - DNA, 201 bp, Homo sapiens
gccaaagagaaccaggaagttaaactttaaaatggaaaatcaaagaataagagagctgaacatattgacatactgattctttgaagagaaacttggaattygctataacaactccttggtgaaattcagaataaagactggcaagctatttttcccccagtattttatttcagagctaagctaaggaactacagaaaaata

SEQ ID NO: 19489 - DNA, 201 bp, Homo sapiens
tgtccttgggtgctcctttgcttttatctcagaggctggcacatttgtaggcaggactgtgagacacagtctcccctgcccccaggagtgtggctggcccrctctgccctcaggaagtttgcttccctcagattagctccggggcaggtcctgtgtcagggtgataggcacacggtgctctcccattgaaggtcacaggaa

SEQ ID NO: 19490 - DNA, 201 bp, Homo sapiens
atgaataccaacatctgttagaatattccaagttggtgccaggactcatattttagtaaactgtaaaatcttccctccccatgcttgtacagtagacaggsctacccatgatgtacgatgggtatcccacaatgagtcagttgatgtgggaacttcaattaatttatagtgggactgctcacatccctatgaagaaaatat

SEQ ID NO: 19491 - DNA, 201 bp, Homo sapiens
taagaaaaaaaaagcactgaaagcgcttgtggtgctgtccttgggtgctcctttgcttttatctcagaggctggcacatttgtaggcaggactgtgagacrcagtctcccctgcccccaggagtgtggctggcccactctgccctcaggaagtttgcttccctcagattagctccggggcaggtcctgtgtcagggtgata

SEQ ID NO: 19492 - DNA, 201 bp, Homo sapiens
gttgcaaacccccattactctctatctcatttgtatgttgttttcttcatagcacttgtcactatgtgaaattactctcttatcatcagtcttcttccacsagattaaaaacaccatgagagtaaagggcaaggtccttattttctgtgtatttgcagcatttggtgccgagaccatagtgagtggtcagacaaatgaaag

SEQ ID NO: 19493 - DNA, 201 bp, Homo sapiens
agtcttcttccacgagattaaaaacaccatgagagtaaagggcaaggtccttattttctgtgtatttgcagcatttggtgccgagaccatagtgagtggtsagacaaatgaaagaaatggctgcttccactctgttagtggcatcctcagacacacagtcaccccttgtatctcctggggattggctccaggacatccccc

SEQ ID NO: 19494 - DNA, 201 bp, Homo sapiens
aaagttacgatcttttcctttctgtgcttaagtgatactaggtcattctttaacttcttgctccacctgctctatccccagctctgcaggtttggagtggsctgtcatgtgattttgtttacccgtttcggttcaaagacagaactctttatttgaacactgaagctagcagggactgtccaaagccagagcccctcatat

SEQ ID NO: 19495 - DNA, 201 bp, Homo sapiens
cagagaatttacctgcagattaccctcaaaacatgagacaggttcagagcgaggtgggcggctggaatggagccttcacagacagcttgaccacacacagrgagctcaggaagcagctttgttggaaaaatgcagggcacttaaactgccacaccaggagggggtttggagaggctggaaagagcatgccattggacacag

SEQ ID NO: 19496 - DNA, 201 bp, Homo sapiens
atgatgacacacaatgctctttcgcactcatgatacataacttacagggaaaggccctgactccctttttgcatagcgtcactgggaacttcttgttaaayggggttagggagtcgttgacttgccttttcccttctaactacaagttttttgcctggtagcatagacccaacaatccttctactctggggtgtttgctcc

SEQ ID NO: 19497 - DNA, 201 bp, Homo sapiens
tggccagccctaaaggcccgggctgctctgcttacagccacacggctgtttctgagctgaggatgaccctccaggtggctgagattccctccaatcttttwatttctggttgggaaaccctacacagaccagtgtctgtctcacggtttaaaaggctgcatgcaaaacatttcctcccctggtagaaatgctgcattgagc

SEQ ID NO: 19498 - DNA, 201 bp, Homo sapiens
tatttaatggaaaagcttctgaggacagggctatactcacatacctccacacctggcacagtagatgagctcactatctgttgaataagttcgtgacagarcagaagttctactgcagccacaaaggcctattcacagtctttaagcctgatgaagttctgaataagtaaacccttagctacatcaggcagtttatgaatg

SEQ ID NO: 19499 - DNA, 201 bp, Homo sapiens
gcccatgacagctgggtttgcttcacgatttgtgtaggacacgtcttatatgtgcatgcactgttggcagcagactgcagagagtcttaagggttttccartatgacttgggaattgcaagctgatgataccatggtaccacaacctgcagtgtggcaagcctaccagcaccaggtcaagtgtgtgtctctgtttgatttc

SEQ ID NO: 19500 - DNA, 201 bp, Homo sapiens
cttcactgtttggtggtgatgactatgtgagaaaaactagacacttgtcttaccatatgtgaaaagttgtaagaccaaatgtaacatcaaagggcagggtyttttcagaactaagctagaggaaattgccatcctgggtcaggatgaaacgcccgttctaagtgagaatgtgctgctgactgtggtgcacagacagcacaa

SEQ ID NO: 19501 - DNA, 201 bp, Homo sapiens
tggtggtgatgactatgtgagaaaaactagacacttgtcttaccatatgtgaaaagttgtaagaccaaatgtaacatcaaagggcagggtcttttcagaaytaagctagaggaaattgccatcctgggtcaggatgaaacgcccgttctaagtgagaatgtgctgctgactgtggtgcacagacagcacaaattccatggg

SEQ ID NO: 19502 - DNA, 201 bp, Homo sapiens
tgtgaaaagttgtaagaccaaatgtaacatcaaagggcagggtcttttcagaactaagctagaggaaattgccatcctgggtcaggatgaaacgcccgttytaagtgagaatgtgctgctgactgtggtgcacagacagcacaaattccatgggtttgagagaaagatgtaaatgacagcaaggtagaatgcagacctgca

SEQ ID NO: 19503 - DNA, 201 bp, Homo sapiens
ttgacagtagatatattgtcagatgcactgtgctgcttagttttgagtgcagtgtgattttctgaaagggcaatgagatgatggatgtagcatgctcagcrctgacctggcccatagtgatcactcaataactgttaacagctatggctgctattcctactgatggataaccatctaataagacagaaaacatggggctaa

SEQ ID NO: 19504 - DNA, 201 bp, Homo sapiens
cgttggtgacagtgtagaagggtgattcgcaggcccatgttctgcccaccagcaaagccccactggagaagggtagactcctgtgggcagtctcagagctsggacctatttgcttctgcttgattctgcgtgggtggacccacatgagcagctgtatacccaggaggtcactaagactttataaaggcaggttttaagaaa

SEQ ID NO: 19505 - DNA, 201 bp, Homo sapiens
tcctgacgttgccatggcatctgcaaactgtcaagacaccggtgggagtgtcttttaacatgataatgcattataattagcacataatgagcagtgagggraaccagaagttactcttgtagccatgttggttttggtgggttttggctggcttctttataacagcctgttttaacaaggtttttatgacctgtatcttgt

SEQ ID NO: 19506 - DNA, 201 bp, Homo sapiens
actataaatctagtgggtacttaatgaatattatataatgactaataaatattttctgatttaaatgtaatgaaatattatcagcttttgaagaaggcccyggggataattatcttcattttacagacagggataccatgagatactcaggtcacatagagtgaggggtggagggtgacaattccatgttcttcagaacct

SEQ ID NO: 19507 - DNA, 201 bp, Homo sapiens
agtgagtaatttcaagcattttaattccagtgcttcctggcttaacaaacctgccaccattactaatgctaattaaataggtttctctgaggttgcccaamctgttttcctaagccaggaaatggactcgacaaactcaaaagaatcaaaagatacaaatttaagaggaagaaaaatcactaattagtgaagtctgcttcc

SEQ ID NO: 19508 - DNA, 201 bp, Homo sapiens
aaatagaagaggacaaaatgacatatgccccctcccttttaactattcttcctagaagttccatataacgctggccagaaattaattatgtatgtagatayacccacccactaaggaggctggggaatgcattattaaggaataagaggagggtaagtgttaagagacaactaccagttgccacaccctccactgagaaaa

SEQ ID NO: 19509 - DNA, 201 bp, Homo sapiens
agccaccgtgcccggccagcaatccgtgttttaacaagatggctgggtgattctcatgcagctaaagtatgagaactgatacagtagaggagttaaactartaatttgcccatcaaaattatggaggtgaaggagtggggatcgttatgtgagataaattcctgtctatcatggaaggaatttagtaaaataatgtctaga

SEQ ID NO: 19510 - DNA, 201 bp, Homo sapiens
taagacacagttcacaacttttggagaaatttttggtttccacaactagttcagcgctattagcatctagtgggtatgccagggatgctgctaaatacccmacaatgcacaggacagctccccacacaacaaggaattatccaacaatgcacaggacagctccccacacaacaaggaattatccaacaatgcacaggacag

SEQ ID NO: 19511 - DNA, 201 bp, Homo sapiens
tccctggaggctggtttggacagtgtgagaggcatccttcccaaagcagacaaagagaaaacacatgggaatggtaattaaatgagtccatgtttaagggrcacttaagtggattaaaatcaatatgtagtcacataagtctgctaagccatccttaatgtttggcgggtggatttctttgtttaaaaaatcctggtttgc

SEQ ID NO: 19512 - DNA, 201 bp, Homo sapiens
cttccaaaggcaacagagttcagcattgctctgttttcattgtgttcatttttacaactaccttctctttttggcaagtgatcctggattcccatctatgwcagtgatataaattgttcttttaaaacaatctttaaactaaaagagtaaggcaacaaaaatatgaacaaatatcccaggtgatgtaatttgcagatgtgg

SEQ ID NO: 19513 - DNA, 201 bp, Homo sapiens
aatgacgggaagccttttgatgtttgacgtctttatctcaactcttcaacttagctcattctggagcagtcacacgatgacagatgagacggttgggcctragccggccaaacaaacggcagggcaagacctggcaggatgctggggtgggggcgggagtgggccaggatggtgttaacccatccacaggggagtcgcctt

SEQ ID NO: 19514 - DNA, 201 bp, Homo sapiens
gccatctgcccttggagaatgtagagattcaactctaaagtggaacagagaaagcccactgctggacagctagtgttggccagcgttcattcattctcctytctctgcacagtggcaacacggagcgctctgaatccctgcatgacaacaccctcgtgctgatggtgccactgatgcacgaggtggacacgtccatcaccg

SEQ ID NO: 19515 - DNA, 201 bp, Homo sapiens
taggccaggcacggtggctcacgcgtgtaatcccagcagtttgggaggctgagacgggcagatcacttgagatcaggaattagagaccagcctggcaacayggggaaaccccatctctactaaaaacacaaaaattagcggggcatggtggtacgtgcctgtaatcctagctactcaggaggctgaggcacgagacttgaa

SEQ ID NO: 19516 - DNA, 201 bp, Homo sapiens
ctcactttaaataaccattgcagcttggggaacctggcctgtctttaggtggaaacaagttttggaaattcctcctattgcagaaagcatttgatttgcaktttcctgaatgcgaggctccaagtgtagggaccgccacccaaggacgtttttctctgttgggcagactcaaagcactgaggggagcttttcagggcccac

SEQ ID NO: 19517 - DNA, 201 bp, Homo sapiens
ggcagaaagatgtgggaagcctttgacctggaggggcatggcttcaggtgaccagaactgtggctggttctggggaatgtgagcgaggtgctggccacatstgctatagtaaccatgagagcttcctgaaaagtagttatttactgataaactactcaagaatacaaaagtagttgaataaaaagtgtgccacagccaaat

SEQ ID NO: 19518 - DNA, 201 bp, Homo sapiens
acagggactgtgtttggctgctctgtttggggccctgtgggaggaaacctgtgtcctctctcttgctctgagtcaacagacaactcttagaagtgcctgaytgagcctacaacatggaaatgccatttcctccaagccgtttatctgaccacctcagcctggaaagtaacagctcttgacttcccttctccacctgggatc

SEQ ID NO: 19519 - DNA, 201 bp, Homo sapiens
ggggcgatggccacagagtccttagccagccaaggaaatgacattgttggtcattggccggggatgcttgggttgtctgcaacacatgaaaaaagcatcaygtccccttgactttgagcaaagagtgcggttaaaaccaagttgtgggaggatggatagtcagtaattgtttatctgtgtgatgagataaggtagtcccct

SEQ ID NO: 19520 - DNA, 201 bp, Homo sapiens
ctttggctgttttgttgagtgcccaggtcatcctggtagaagggagacagtgacccacgtgaaaaaggatggctacagatgcatggctgcatggctgtgcrtcatccaccctggagtatctgcttgccaaaaatagggctacctgcaaaatgctttgagcactgtggaaaccagccgttacaactccaaacgtttattttt

SEQ ID NO: 19521 - DNA, 201 bp, Homo sapiens
tattgaaatgatgttcttggtcacttctggttccagatggccaaccaagcacaaatgttgatgtctgtgccttggtaccccattgcaatgattataaatgagtagatcggaacagggaggacaacactgtgaaagaaagggcatcagctaataataagagtccagtaattttctggtatgagtgaagtaaatggaagagtg

SEQ ID NO: 19522 - DNA, 201 bp, Homo sapiens
tgaaatgatgttcttggtcacttctggttccagatggccaaccaagcacaaatgttgatgtctgtgccttggtaccccattgcaatgattataaatgagtagatcggaacagggaggacaacactgtgaaagaaagggcatcagctaataataagagtccagtaattttctggtatgagtgaagtaaatggaagagtgtta

SEQ ID NO: 19523 - DNA, 201 bp, Homo sapiens
gaaatgatgttcttggtcacttctggttccagatggccaaccaagcacaaatgttgatgtctgtgccttggtaccccattgcaatgattataaatgagtagatcggaacagggaggacaacactgtgaaagaaagggcatcagctaataataagagtccagtaattttctggtatgagtgaagtaaatggaagagtgttag

SEQ ID NO: 19524 - DNA, 201 bp, Homo sapiens
cctacagttgggcagaatcatctggcaacacagccctccatagagtatcgattgtttaccctggtgatgatgtggctgacgaggtgctacagctcgctgcrctggccagcatcttgagagtattgtacagctttctaccactttccactgaatacctattgtttttacaccatcagaaagttgaaaaatcttaagtagaac

SEQ ID NO: 19525 - DNA, 201 bp, Homo sapiens
aatgatgttcttggtcacttctggttccagatggccaaccaagcacaaatgttgatgtctgtgccttggtaccccattgcaatgattataaatgagtagatcggaacagggaggacaacactgtgaaagaaagggcatcagctaataataagagtccagtaattttctggtatgagtgaagtaaatggaagagtgttagtg

SEQ ID NO: 19526 - DNA, 201 bp, Homo sapiens
tgatgttcttggtcacttctggttccagatggccaaccaagcacaaatgttgatgtctgtgccttggtaccccattgcaatgattataaatgagtagatcggaacagggaggacaacactgtgaaagaaagggcatcagctaataataagagtccagtaattttctggtatgagtgaagtaaatggaagagtgttagtggg

SEQ ID NO: 19527 - DNA, 201 bp, Homo sapiens
gatgttcttggtcacttctggttccagatggccaaccaagcacaaatgttgatgtctgtgccttggtaccccattgcaatgattataaatgagtagatcggaacagggaggacaacactgtgaaagaaagggcatcagctaataataagagtccagtaattttctggtatgagtgaagtaaatggaagagtgttagtgggt

SEQ ID NO: 19528 - DNA, 201 bp, Homo sapiens
atgttcttggtcacttctggttccagatggccaaccaagcacaaatgttgatgtctgtgccttggtaccccattgcaatgattataaatgagtagatcggaacagggaggacaacactgtgaaagaaagggcatcagctaataataagagtccagtaattttctggtatgagtgaagtaaatggaagagtgttagtgggtg

SEQ ID NO: 19529 - DNA, 201 bp, Homo sapiens
tgttcttggtcacttctggttccagatggccaaccaagcacaaatgttgatgtctgtgccttggtaccccattgcaatgattataaatgagtagatcggaacagggaggacaacactgtgaaagaaagggcatcagctaataataagagtccagtaattttctggtatgagtgaagtaaatggaagagtgttagtgggtga

SEQ ID NO: 19530 - DNA, 201 bp, Homo sapiens
attgtccccacccctacaggcttcaggcatgcagaatagcaagcagccaggcatcgccttctctaaagtgttaagtaaactgtttaagatagtgtgggcgrcctcgttctcagagaaaagaaagccttacttctggcatttgaagtcaccaacgtaagagctagctttctctcccacaatccacccaaacactttcacaga

SEQ ID NO: 19531 - DNA, 201 bp, Homo sapiens
gggcaaaagtcatctaacacaaagcttattttacaataaagtgttgaatatctcatgtaatgtattgaacactatactgaaaatgaaaaacaaaatggttktatgggtactcaccattaacacacacagctgaaagcacactggacctaaagaatatttgaactaaaattaactgctggattatggggctactagtgtaac

SEQ ID NO: 19532 - DNA, 201 bp, Homo sapiens
cagcagtgtagctttaaacaaaccacttgctctttctgagcaaaaatattccatttgtaaataaatggacagagttagagttattaggcattccctaaagrtcttttccccttttaaaatctttctttcatttaattctaagtttctggctttatgcactttgtgtttcatgcacaccatagcttagtcatcagttatttt

SEQ ID NO: 19533 - DNA, 201 bp, Homo sapiens
atcttgatccaaaaatgacgaggctgggtggttgccattggtgtcacacccacatcccttgctgtgcaggtgcactgctcccagctgctgtgctggctgcwagctgctcacagtggcccgtcctttggtctggaaagtcacccttgccctgcctgggagggtgacttgttagccaatggctggctgatttggggtgtggat

SEQ ID NO: 19534 - DNA, 201 bp, Homo sapiens
cttttcttttcttttctttctttctttctttctttctttctttctttctttctttctttctttccttccttccttccttccttccttccttccttccttcyttccttctttcttttcttttcttttcttttcttttcttttcttttcttttcttttcttttcttttcttttcttttcttttctttctttctttcttctttc

SEQ ID NO: 19535 - DNA, 201 bp, Homo sapiens
gaggtagtgcaggaaagtggtgataagcagatgtctgcagctgtgtgacgtgtgtcccagcccagttctgtggcctgctacctggggagcctctggttgtmattgggcctcctgttgcctctcagcttgcctccctctgtaaaatggggacagtaggccaggggctgtggctcacacctgtaatctcaacactttgggagg

SEQ ID NO: 19536 - DNA, 201 bp, Homo sapiens
gaatctttgccagtctgctgcctgaaacttgttatcgtaaccaccatcctcaactccacattgcaaaaaggaacgctcggaaactcagtaggaaaacttasgaatatggaaactattttgccatgaggcatacatagtctgaggggcatttatctatccagaccatcctcttttcattagaagtacataacaggagattaa

SEQ ID NO: 19537 - DNA, 201 bp, Homo sapiens
ctgcagctgtgtgacgtgtgtcccagcccagttctgtggcctgctacctggggagcctctggttgtcattgggcctcctgttgcctctcagcttgcctccmtctgtaaaatggggacagtaggccaggggctgtggctcacacctgtaatctcaacactttgggaggccaaggcaggtggatctcctgaggtcaggagttc

SEQ ID NO: 19538 - DNA, 201 bp, Homo sapiens
gctcataatggcagcaaatgcttgagggaatccctgagtatgcatctatttcttgaatcatggcatctgctataggaaatcctcttaaatgtattcttatytccctaataaaatggaaattggtacttaattggtaaaattttaaataattacccagcatctggtggttcatttatggcttcaaccagatgcgttttatta

SEQ ID NO: 19539 - DNA, 201 bp, Homo sapiens
cgtatagatgaaacatcatcaaggtatgtatacgcattttggaacctatcatataaaaaagaaaacttttgtaacttaaatttgggatttatgtttttggytttttgtttgtttgtttgttttgagatggagtcttgctctgtcgcccagggtggagtgcagtggcatgatctcggctcactgcagcttctgcctctcggg

SEQ ID NO: 19540 - DNA, 201 bp, Homo sapiens
cccctcccccaaccccacaaccgtccccggtgtgtgatgttccccttcctgtgtccatgtgttctcattgttcaattcccacctatgagtgagaacatgcrgtgtttggtttttttgtccttgcgatagtttgctgagaatgatggtttccagtttcatccatgtccctacaaaggacacgaagtcatcattttttatggc

SEQ ID NO: 19541 - DNA, 201 bp, Homo sapiens
aaaagaaaaaattgttcttagattgggaagattgtccaggagcctgagagaagttctgggagagcagttctttcttattgtccttttcctgattatggggaaaaaaaaaaaaaaaaaaaagataatcttccagatgttggctcagtttgaggaggaggaaagattctgagagtgaggcccactgcaggaagcagagctgat

SEQ ID NO: 19542 - DNA, 201 bp, Homo sapiens
ggggtgccatcggctgctctgcctgcctctgggtggtggtgggattacatgagggaaatgtgagaagcccggaaatgatgaggcagcactggatcctgctgttcccttcctgggaagccggcttcctggtgttgtgaggagaggatgaggccgtcatgggagcaggtctgacctgggctctgaggaagcaggtgctctgct

SEQ ID NO: 19543 - DNA, 201 bp, Homo sapiens
ggacacagggtttccccatgttgcccaggctggtcttgaactcctaggctcaaggaatcctcctgcctcagcctccctaagtgctgggattacaggcatgrgccaccgtgcatggccttagctgcctatttgattccttcgtgacatctaacagaacgtgttatttcgtctacttgttattgtatttacctctctagaatg

SEQ ID NO: 19544 - DNA, 201 bp, Homo sapiens
gacacagggtttccccatgttgcccaggctggtcttgaactcctaggctcaaggaatcctcctgcctcagcctccctaagtgctgggattacaggcatgarccaccgtgcatggccttagctgcctatttgattccttcgtgacatctaacagaacgtgttatttcgtctacttgttattgtatttacctctctagaatgg

SEQ ID NO: 19545 - DNA, 201 bp, Homo sapiens
cgggaaaggagaggggactcatcaaaggttagaccatgtcctgaagtgacctgttgaatttgcaaaacttctttttcagtgttatgttttatttttgcaatttttgtggggggaaaatgcattctaggcttctgaaaccctttttagaagaaaatcatggtttcctcaaactcttcaagcttattgagttttcttctgtat

SEQ ID NO: 19546 - DNA, 201 bp, Homo sapiens
gggaaaggagaggggactcatcaaaggttagaccatgtcctgaagtgacctgttgaatttgcaaaacttctttttcagtgttatgttttatttttgcaatttttgtggggggaaaatgcattctaggcttctgaaaccctttttagaagaaaatcatggtttcctcaaactcttcaagcttattgagttttcttctgtatt

SEQ ID NO: 19547 - DNA, 201 bp, Homo sapiens
cacttagcataatgtcctccagtttcatccatgttatcaaaaatggcaggatctcctttttaaaggctgaataatattccattgtatgtttatatatgtgtatatatatatatgtgtgtgtgtgtagtatatatacatatatacacaccacaatttctttatccattcacctgttgacaaacacttaggttgattccatgt

SEQ ID NO: 19548 - DNA, 201 bp, Homo sapiens
acttagcataatgtcctccagtttcatccatgttatcaaaaatggcaggatctcctttttaaaggctgaataatattccattgtatgtttatatatgtgtatatatatatatgtgtgtgtgtgtagtatatatacatatatacacaccacaatttctttatccattcacctgttgacaaacacttaggttgattccatgtc

SEQ ID NO: 19549 - DNA, 201 bp, Homo sapiens
taatgaatttcaagcttcttgttattgtttttcttcctgaaagacaaagggagttttatgccatggtattttgaggacaatgttgaatcaattgttatcaratgggaagatttctgaatgctgaatagtttgtaatatccttcaaaaaaccaaaccaagaacccacccacccattcaccatttatctctccatttgtccac

SEQ ID NO: 19550 - DNA, 201 bp, Homo sapiens
tctagttcaatgataaaatttttgtctgggctacatggaatcatggaatttcagttctgcccagtccctctcaaggcccagccattatcatagaaaaatcytcaagtaagttgtgttgtttcttccacaggacagttcgtctgtcatccagttcatgtcccgcgccaaggtgaaggtggatcctgccctaagggtggtgga

SEQ ID NO: 19551 - DNA, 201 bp, Homo sapiens
ccctctctctcctgggttcaagcaattctcctgcctcagcctcccaagtagctgggattacaggcacccaccaccacacccggctaatttttgcatttttagtagagacagggtttcaccaagttggccaggctggtctcaaactcctgacttcaggtgatcacccgcctcagcctcccaaagtgctgggattacaggtgt

SEQ ID NO: 19552 - DNA, 201 bp, Homo sapiens
accatgcctggccccaccatccacacccagccccaccatccattaattaagcttcatggtgttcactcagtcacactgttgtcgctctcatttgccaatgttaaatagtgatgcacagtgcctaagacaaaatcgctatcactgcaagctcctacccctggctaaatgctaatctggatttatgggacagtgacgagtgct

SEQ ID NO: 19553 - DNA, 201 bp, Homo sapiens
gttttctgcatatggctaaccagttttcccaacaccatttattaagtagggaatcctttccccattgcttgtttttgtcaggtttgtcaaagatcagatgrttgtagatgtgtggtgttatttctaggcctctgttctgttccattggtctatatctctgttttggtaccagtaccatgctgttttggttactgtggcctt

SEQ ID NO: 19554 - DNA, 201 bp, Homo sapiens
gcgagggcatccttgtcttgtgccagttttcagagggaatgcttccagcttttgcccattcagtatgatattggctgtgggtttgtcataaacagctcttatttttttgagatatgttccatcaatacctggtttattgagagtttttagcatgaaggggtgttgaattttgttgaagcccttttctgcatctattgagat

SEQ ID NO: 19555 - DNA, 201 bp, Homo sapiens
ttggtggtaatatcccctttatcattttttgttgtttctgtttgattctctgttttcttctttattagtgtggctagtggtctcttttgttgatcttttcaaaaaaaaaaaaaccagctcctggatttgtttattttttttttgaagggtttttcatgtctctatctccttcagttctgttctgatcttaattatctcttg

SEQ ID NO: 19556 - DNA, 201 bp, Homo sapiens
tggtggtaatatcccctttatcattttttgttgtttctgtttgattctctgttttcttctttattagtgtggctagtggtctcttttgttgatcttttcaaaaaaaaaaaaaccagctcctggatttgtttattttttttttgaagggtttttcatgtctctatctccttcagttctgttctgatcttaattatctcttgt

SEQ ID NO: 19557 - DNA, 201 bp, Homo sapiens
ttttcaaaaaaaaaaaaaccagctcctggatttgtttattttttttttgaagggtttttcatgtctctatctccttcagttctgttctgatcttaattatytcttgtcttctgctagcttttgaatttgtttgctcttacttctctagttcttttaattatgaagttagggtgtcaattttagatctttcctgctttctcc

SEQ ID NO: 19558 - DNA, 201 bp, Homo sapiens
ttggagtgggacaaggccctccttcccctttcttatgattagttgaaatctgagtttgagcaagtcttgctgttttcagagaatgctctccttctcctgtycttccctcacagccgaactcatttggagagattgatggagttactaatgctttggagacagtccctaggaatttttttaaaatgtagtggtcagattgac

SEQ ID NO: 19559 - DNA, 201 bp, Homo sapiens
gtctgacctggaggccttgttcaatagcttttcctcctggagacacaagcaatctgtcctgctgggtcagtggcagtccttgcattgagtcagcacattcttttttttttttttttttttttagacggagtttcgctcttgttgcccaggctggcaatggcacaatctcagctcaccataacctccacctcccgggctcaa

SEQ ID NO: 19560 - DNA, 201 bp, Homo sapiens
gggagaggctggagggaagctatggccttggaattttattgccttttattgttgttcttgcaggagcaggggggttgaggggggttcatcctgtatttgaygcccacactcagatcccaggggagtagaggaggagacagcagccgatgcacttcttttgccagtgagctgtgcaatgatgctacctgtctgcttcccttc

SEQ ID NO: 19561 - DNA, 201 bp, Homo sapiens
taatatttggagtgggacaaggccctccttcccctttcttatgattagttgaaatctgagtttgagcaagtcttgctgttttcagagaatgctctccttcycctgttcttccctcacagccgaactcatttggagagattgatggagttactaatgctttggagacagtccctaggaatttttttaaaatgtagtggtcag

SEQ ID NO: 19562 - DNA, 201 bp, Homo sapiens
tctgacctggaggccttgttcaatagcttttcctcctggagacacaagcaatctgtcctgctgggtcagtggcagtccttgcattgagtcagcacattcttttttttttttttttttttttagacggagtttcgctcttgttgcccaggctggcaatggcacaatctcagctcaccataacctccacctcccgggctcaag

SEQ ID NO: 19563 - DNA, 201 bp, Homo sapiens
ttctaatatttggagtgggacaaggccctccttcccctttcttatgattagttgaaatctgagtttgagcaagtcttgctgttttcagagaatgctctccytctcctgttcttccctcacagccgaactcatttggagagattgatggagttactaatgctttggagacagtccctaggaatttttttaaaatgtagtggt

SEQ ID NO: 19564 - DNA, 201 bp, Homo sapiens
ggtttatgtttaatgaatgaaatgatgattaagataggacaattggacaaaaaggctgggccttcttaggtgggtattgagtgggaagtgattcaagaggscagacattctgtctggacattagctggaagtggggctggacaagatgaactagagccctcttgtggtcccatcattcaggcctgtagctttcatttgaga

SEQ ID NO: 19565 - DNA, 201 bp, Homo sapiens
agttttctgtgataatgagatttgaactggaagaaatgctgttctttcagttaacagttgtgttttttccaagaaaaaaaagaaatacaaatgttaaaacttttttttttttttctggtgctaaagaacaatttcacctcctaagccaagaaggaaaaaattctcatctaaaccgccaggcttaaaggtggctccttgtca

SEQ ID NO: 19566 - DNA, 201 bp, Homo sapiens
gataagtgctggggctcctatggtgggtgtgctgcagtcttcagcagagcttggctacagaggagaaagatctaaactggaccaatttcatatggtcattkcctctggcttgtggctgatcatcttgttctttggaattgactgtctcatgaaatagtgagtttcttgtcaccagagagatttaagcaagagccatggaat

SEQ ID NO: 19567 - DNA, 201 bp, Homo sapiens
cccgtgtgatgatggctaagtgcgcagaacatgtgaaatttaagtagatttgtggaaacagaaacacatttttatttagtcgtgagcgtcacttggagtakaaatagagccctttatgattcgtgtgctggtctttcttcctggagggcttcagtattatctcatgctgtcatctttatgttgtattggaaaaatctggga

SEQ ID NO: 19568 - DNA, 201 bp, Homo sapiens
atgtgccagtcacctagggctgagaaaggggagcaagcagagagggagaagaggaagaagccaaatgagatggttcgtaattgattagtggaagttaaatmatgttaaggataggaggcttgtcccctccatcatgatttagtatatcatccttcccaagagaagttttgagaacttgtcctctggtatccaggaaatggc

SEQ ID NO: 19569 - DNA, 201 bp, Homo sapiens
gtgatgtaaccagggactgcaacttctagggaaaggggaaaaatcactgttggccccaccctctagcattggaagcttaacagggctttggcccacagcasatggaagtttgagctgtgttttgtaattcttttttaaatgttcgccagagcatccattattcttcctcattttctcttctcctcttccctccttttcttc

SEQ ID NO: 19570 - DNA, 201 bp, Homo sapiens
aggtctgcacgttggctggggaagctgttctccatgtctcttatctttctagaaccagttggctactggggcaggttcttctcatggtgatggcaaaaatkcaagaggggcatgcagaaacatgtgagacctcttaaggggtaggctcagaactggcactatcacttctgccctcattccattggccagagcaagtcatga

SEQ ID NO: 19571 - DNA, 201 bp, Homo sapiens
ggcagctgataagtaatgcagtctagcctgtaatcccagcactttgggaggccaaggcaggtggatcatgaggtcaagagattgagaccatcctggccaaygcgatgaaaccccatctctactaaaaatacaaaatttatctgggcatggtggcatgtatctgtagtcccagctactcgggaggctgagtcaggagaattg

SEQ ID NO: 19572 - DNA, 201 bp, Homo sapiens
cttttagttgggttcagtcagaggggagcactggaaaaagagggtggaagagtggccagccatagtgaccatggctctctacggaaggccatagcttctgycaggtggttagttctaataacttaggggttccagtgaccactccccaccttgctccttccgacctagggcattaatggctccctgctttgccacaggggt

SEQ ID NO: 19573 - DNA, 201 bp, Homo sapiens
tgcccgttgggacaattagggagggattctttcaagtacaacattttctctagcaattatgggggttttatctcccagatgtgatttatgccatattacaytccaagaagggaacatgaagaatgtttgtggctaaaaaagtctcaacacaaggaaactacaggtgaaacgtaacaatagtaattgccttactttatttgc

SEQ ID NO: 19574 - DNA, 201 bp, Homo sapiens
ttgggcctgggaatctgttttcaacgtgtatcctgagtcatatttgggaagcactgggctctgcttatgattctcacgttctggtctgtgactgaggagaygtgccatgatgagagtgatgatggtgatggtggcagacaagagcatgtcacatttagaaatactgtaactggttgctgaggttttacatatattccttct

SEQ ID NO: 19575 - DNA, 201 bp, Homo sapiens
tatgttacgctttttttttcagcatttcacaatattcactaaagcattttataagcaagtgagttgtaggagctaaatatgatcaatttttaaaaactactttttttttttttttttttgagatggaatcttgctcttttgccagactggagtgcagtggtgtgatctcggctcactgcaatttctgcctcccgggttcca

SEQ ID NO: 19576 - DNA, 201 bp, Homo sapiens
ggagtgcagtggtgtgatctcggctcactgcaatttctgcctcccgggttccagccattctcctgcctcagcctcctaagtagctgggactacaggtgtgyaccaccacacccagctgatttttgtatttttagtagagacagggtttcaccatgttggccaggatggtctcaatctcttgatctcatgatccacccgcct

SEQ ID NO: 19577 - DNA, 201 bp, Homo sapiens
caaggactgcaggaggggtgtgctttccatccactttctatattctaaaaattaccgctggattaagcccagtcaagagagaaccaagtatctgtatggtycaagtatcgctggccacacacacagtatcttttacagaatcgcatgtgctgtgatgccatctccctgtgcagggtgggttggtaggtgggggaaaggggc

SEQ ID NO: 19578 - DNA, 201 bp, Homo sapiens
cacacacagtatcttttacagaatcgcatgtgctgtgatgccatctccctgtgcagggtgggttggtaggtgggggaaaggggcttccttggggatttgayctgtggaactcatctctgtggtaactgaaaagatgtaattggcaactggctcattacattacacagatttctctcactcaggacccatgcgagaaatttc

SEQ ID NO: 19579 - DNA, 201 bp, Homo sapiens
tgccatctccctgtgcagggtgggttggtaggtgggggaaaggggcttccttggggatttgatctgtggaactcatctctgtggtaactgaaaagatgtarttggcaactggctcattacattacacagatttctctcactcaggacccatgcgagaaatttccttccagcctcatttaagctatttccagacttagaaat

SEQ ID NO: 19580 - DNA, 201 bp, Homo sapiens
atttgttggtggctactctgctggctggcgtgtgctgtccagccagagcacagggtattatggccagcaactgggtttcctcaggggcaggcccagtgcaycgtgttgcctgccgggcaaggaaccagcaaagcctcactacagagtgacaattcctggggtgccctgtgggagcagtgagagggagctcctggggccggg

SEQ ID NO: 19581 - DNA, 201 bp, Homo sapiens
  misc_feature (1)...(201): n = A,T,C or G, or insertion/deletion polymorphism (see Tables 1-2)
caggcccagtgcaccgtgttgcctgccgggcaaggaaccagcaaagcctcactacagagtgacaattcctggggtgccctgtgggagcagtgagagggagntcctggggccggggggtgctgcatggttaaaaaggagcataaggaagaatagataaccactgcatcacaccagggtcaccattcacactgggttccatgt

SEQ ID NO: 19582 - DNA, 201 bp, Homo sapiens
gggataagtgctggggctcctatggtgggtgtgctgcagtcttcagcagagcttggctacagaggagaaagatctaaactggaccaatttcatatggtcawtgcctctggcttgtggctgatcatcttgttctttggaattgactgtctcatgaaatagtgagtttcttgtcaccagagagatttaagcaagagccatgga

SEQ ID NO: 19583 - DNA, 201 bp, Homo sapiens
aggacagtcatgacctacacctggctaaatccagtagtcatttttcagtcttctttctggacccgtcagcatctattagtacaaataacgactacttctgttattattattattattattattattattattattattattatactttaagttctagggtacatgtgcacaacgtgcaggtttgttacataggtatacatg

SEQ ID NO: 19584 - DNA, 201 bp, Homo sapiens
tgaagcacatttcttatgtcaggttcccagtttcctcttctgtaaaatggaggcagcatgggattgtaatgaggattaatggagctcatttacctgaacgscccagagggtgcttagcaaatactttatgcttcttgtgggtccattactttcccttgcctgtttttttagggaccctggagtgttaccttggcttctgat

SEQ ID NO: 19585 - DNA, 201 bp, Homo sapiens
ggacagtcatgacctacacctggctaaatccagtagtcatttttcagtcttctttctggacccgtcagcatctattagtacaaataacgactacttctgttattattattattattattattattattattattattattatactttaagttctagggtacatgtgcacaacgtgcaggtttgttacataggtatacatgt

SEQ ID NO: 19586 - DNA, 201 bp, Homo sapiens
gtgaagcacatttcttatgtcaggttcccagtttcctcttctgtaaaatggaggcagcatgggattgtaatgaggattaatggagctcatttacctgaacsccccagagggtgcttagcaaatactttatgcttcttgtgggtccattactttcccttgcctgtttttttagggaccctggagtgttaccttggcttctga

SEQ ID NO: 19587 - DNA, 201 bp, Homo sapiens
gacagtcatgacctacacctggctaaatccagtagtcatttttcagtcttctttctggacccgtcagcatctattagtacaaataacgactacttctgttattattattattattattattattattattattattattatactttaagttctagggtacatgtgcacaacgtgcaggtttgttacataggtatacatgtg

SEQ ID NO: 19588 - DNA, 201 bp, Homo sapiens
atcttcctgctatcagtgaaaaagggagagggatcagctcttgtttcttggctttgctctttacagcctcttagaaacttgagttctatctggattcatcstgtcatttgatggtacaggagtacaaatggaggtccacttagcgaatatctaaatatttaaagattacaaatcaaggtaactgttcagtaaactgtgttc

SEQ ID NO: 19589 - DNA, 201 bp, Homo sapiens
agcctcatgctgtcctcaggccaccctagccccctgttctcctggctggctttatcccgctgagcagtgggacagaggacaggaagatgagaggaagataktccagagctgggtggagagtcagggtggagtagagctgtgtgagggtgtgcatgagggagccaacaggaaggagggctgggttcttgttctctgaccaat

SEQ ID NO: 19590 - DNA, 201 bp, Homo sapiens
aatgtccctggaatttatttgctggagcattttccattttcatattcagtttagaccttggctgaagtagggaggttatgtaactgggatggaacaaatcycattggcatctggggaccctagtgtaccccacccttagccattcctgcagtggactgagtgcccccctggctgtatattcaagtcgcctctgtggctgcc

SEQ ID NO: 19591 - DNA, 201 bp, Homo sapiens
aaattcatagatgctcaagtccctgatataaggtggcatcgtatttgtatataacctacatatatcctcctgtatactttaaattatctctagattacttrtaatacctacaacaatgtcaatgctatgtaaatagttgttatactgtattttgggttttttgttgtattgttatttttattgtttttttcctgaatattt

SEQ ID NO: 19592 - DNA, 201 bp, Homo sapiens
gctcaagtccctgatataaggtggcatcgtatttgtatataacctacatatatcctcctgtatactttaaattatctctagattacttataatacctacarcaatgtcaatgctatgtaaatagttgttatactgtattttgggttttttgttgtattgttatttttattgtttttttcctgaatatttttgatctgtggt

SEQ ID NO: 19593 - DNA, 201 bp, Homo sapiens
agccagctgagggtgacaccttgggctgcagccacaggccactttgccactgggctcacccacgctgctgctgccacacgtggggccaagggtgacaaggytgccagggagcctgggatcggagttccagggccatctgagctctgggtcagcagcagtcattggagcagggatctggggaggcttttcacgtgggggttg

SEQ ID NO: 19594 - DNA, 201 bp, Homo sapiens
gcataacagaggtgaagggcacagacttgggagccccatggccaggatttgaatctgaactcttaggcaggtccctgaactgctcagccctcagtttcccrtctgtaaatggtgataacagtaccttcctaaggtcattatgaggactaaatgagtaaacattgatacagtgctaacaacgcttaatagagtacttacaac

SEQ ID NO: 19595 - DNA, 201 bp, Homo sapiens
ttttgtttttgtttttgtttttttttgactttgagacaggatctcactctgacacccaggcgggagtgcagtggtacagtctccgctcactgcagcctcarcagcccaggcccaagtgatcctcccacctcagctttccaggtagctgggcagtgtcagcagctctcctatggccagctccaccaccaggtcagacagtac

SEQ ID NO: 19596 - DNA, 201 bp, Homo sapiens
cagctagctgttggttatctagactggcattggctggggtgactggggcaactcagcaccgctccatgcatatctcactgtccaacaggccagcctgggcrtattcacgtggagactgagaagcacgagaaggcagaattgggcccttgataagatcatcctaacacagaggcagatgtagatttgaaccctatttgcaac

SEQ ID NO: 19597 - DNA, 201 bp, Homo sapiens
atgggaggagctactgtatcatcttttcatgacacatatgtagggacaggtagaacattgtggtcatatgcagtggactgagcccatgggctttggagtcmcatggggctctcaagccatgattctttacttaaccttcatctataaaatgaaaacactgatagaatctatctcacaagatcattttgaggtaaatgcaca

SEQ ID NO: 19598 - DNA, 201 bp, Homo sapiens
cctttttatggctacatagtattccatggtgtatatgtgccacattttcttaatctagtctattattgatggacatttgggttggttccaagtttttgctrttggaaatagtgctgcaataaacatacgtgtgcatgttctttatagcagcatgatttataatcctttgggtatacacccaataatgggatggctgggtca

SEQ ID NO: 19599 - DNA, 201 bp, Homo sapiens
acaatggttgaactagttgacagtcccaccaacagtgtaaaagcattcctatttctccacatcctctccagcatctgtggtttcctgactttttaatgatygccattctaactggtgtgagatgatatcttattgtggttttgatttgcatttctctgatggccagtgatgatgagcattttttcatgtgtcttttggctg

SEQ ID NO: 19600 - DNA, 201 bp, Homo sapiens
atgtcctgaatgatattgcctaggttttcttctagggtttttatggttttaggtctaacatctaagtttttaatctatcttgaattaatttttgtataagrtgtaaggaagagatcccgttttccatcatatgaatatgccacaatatgttttctccattatcctgatgatggacattgaagttgtttctggttttatctt

SEQ ID NO: 19601 - DNA, 201 bp, Homo sapiens
acaggacagctccccacacaacaaggaattatccaacaatgcacaggacagctctccacacaacaaagaattatccaacaatgcacaggacagctccccayacaacaaagaattatccagccccaatgccaacagcattgaggctgagaaaccctggattatccctttttacacatgagatgagggtcttacaggtcttct

SEQ ID NO: 19602 - DNA, 201 bp, Homo sapiens
gctccccacacaacaaggaattatccaacaatgcacaggacagctctccacacaacaaagaattatccaacaatgcacaggacagctccccatacaacaargaattatccagccccaatgccaacagcattgaggctgagaaaccctggattatccctttttacacatgagatgagggtcttacaggtcttctaagtggtg

SEQ ID NO: 19603 - DNA, 201 bp, Homo sapiens
aagcatgggaagtaatcagtaaatggccaatttatctctccctcacagccaagccaactcctaacataattggaagtttaatatattccaacaagttcagracaagcatactagatcttaaggcaatctcatggccctgcagctcatcctttttttcaaagaaattaattttcaaaaaatgactctattgagattgaattt

SEQ ID NO: 19604 - DNA, 201 bp, Homo sapiens
ggtaggcacccatgttggagccagccatggtctgcagagttcatttctctgagtccctgccccagaggcacatgacataggaggctccagacaactgactyaaagacagagaggaccataataccagggttcctcagtcctcaccagcataagaatcccagagaaggcattttttttctcacatactctaggtctcaatct

SEQ ID NO: 19605 - DNA, 201 bp, Homo sapiens
ggaggctccagacaactgactcaaagacagagaggaccataataccagggttcctcagtcctcaccagcataagaatcccagagaaggcattttttttctyacatactctaggtctcaatctcttaacttcaaaaatggcagtggctacattagctcttgggaccagtgtttcaaaggctagtgtagaacacttgcctcag

SEQ ID NO: 19606 - DNA, 201 bp, Homo sapiens
agaggaccataataccagggttcctcagtcctcaccagcataagaatcccagagaaggcattttttttctcacatactctaggtctcaatctcttaacttyaaaaatggcagtggctacattagctcttgggaccagtgtttcaaaggctagtgtagaacacttgcctcagatgattcaagatccaggtttcctgactctg

SEQ ID NO: 19607 - DNA, 201 bp, Homo sapiens
gaatttcaatgcagtttcacttttgagggtttttaacttgattgtccatcagaaccacctggggagctttcagcaaatgcatgccgacgccacatgcattrattctgcggccacacagaggggcctgcatctgggtcttttttacaaagcttttcataggattgtcatcgtcacctttccagcactgttatgcaaattgga

SEQ ID NO: 19608 - DNA, 201 bp, Homo sapiens
gtagggacaggtagaacattgtggtcatatgcagtggactgagcccatgggctttggagtcacatggggctctcaagccatgattctttacttaaccttcrtctataaaatgaaaacactgatagaatctatctcacaagatcattttgaggtaaatgcacatgtacctaatgcatagtaaattctcagtagaaaataaca

SEQ ID NO: 19609 - DNA, 201 bp, Homo sapiens
atggggctctcaagccatgattctttacttaaccttcatctataaaatgaaaacactgatagaatctatctcacaagatcattttgaggtaaatgcacatrtacctaatgcatagtaaattctcagtagaaaataacattttatgtattttgcatgtttctcataaactgattgtgcattctaattatttagtttggaaaa

SEQ ID NO: 19610 - DNA, 201 bp, Homo sapiens
cactgatagaatctatctcacaagatcattttgaggtaaatgcacatgtacctaatgcatagtaaattctcagtagaaaataacattttatgtattttgcrtgtttctcataaactgattgtgcattctaattatttagtttggaaaatgtagtctctgtaggtttacccttccctgaggcagtaggggagatcatcacct

SEQ ID NO: 19611 - DNA, 201 bp, Homo sapiens
gatcattttgaggtaaatgcacatgtacctaatgcatagtaaattctcagtagaaaataacattttatgtattttgcatgtttctcataaactgattgtgyattctaattatttagtttggaaaatgtagtctctgtaggtttacccttccctgaggcagtaggggagatcatcacctctgtaatggtataatatgaactc

SEQ ID NO: 19612 - DNA, 201 bp, Homo sapiens
gtaaagcagtaaggaatgcatagtcagctatactggaaatttgggaaagggaaatggactatgtgggaaagcgggactcttatccttgcagaagtcactaygaaatgaggctttcagtaaacagaagatgggcatttcatcctttctcattactgagccttcctcaagacctccttaacatcctaacattataaatacaat

SEQ ID NO: 19613 - DNA, 201 bp, Homo sapiens
cattcttccaagcaggcccggagaaggaatgggctccacgatgcagggcccgcggtagagaacagccaggcagagcagggggcctggctggatgtggccascatctgcaggggttcagcattgagatatgacactgtcacctccatctcaagaagcccttacggatgcctcccttcccttcatgactcactgtgatctaca

SEQ ID NO: 19614 - DNA, 201 bp, Homo sapiens
atgatctccagaagcaacttacatgtagacatttttctgagaattccagaaagaatattgataattttcagacaccatggcttccacgcctcatcaacatragcagtattaggctttatctctgacatcaatcaaacttgaacaccatcagcatgggctttaatgaaattctcacatatgtatcagaacttgtattttttc

SEQ ID NO: 19615 - DNA, 201 bp, Homo sapiens
agcaacttacatgtagacatttttctgagaattccagaaagaatattgataattttcagacaccatggcttccacgcctcatcaacataagcagtattagkctttatctctgacatcaatcaaacttgaacaccatcagcatgggctttaatgaaattctcacatatgtatcagaacttgtattttttcctttagtcagtg

SEQ ID NO: 19616 - DNA, 201 bp, Homo sapiens
agtttttttaatttttattttttgcatttcttgatcatttcaaagtgaggtcagttacagagtgaatgggttcatcctgtcattgtaaataacagtttttygtttaataatggcattttgtattaccaagaccttgcttcacattaggtgttttgtatacattatctcatttaatcaaaaccagcactctatatcatgggt

SEQ ID NO: 19617 - DNA, 201 bp, Homo sapiens
ccccaccccaggccccgtctgatctattcttacatcacaactaaaaatattcttaaaaatgtgaatcagatggtatgactcccctgctcagaaccctccaktgccttccctctgtacttggaaccaagtccaaactcctgatgagcagcagggctccgcatggcctggcctttcatctgttgcttcccaaacgtgtggcct

SEQ ID NO: 19618 - DNA, 201 bp, Homo sapiens
agctcttcagtgagttagtaaacaaagtggttctcaaaatgtaaaattcttccttgactcactaagcaaccttctgattgcaactgctttccctttttggsctccaagacaggaattctctggccctgctgacaggagccccatgttgcacagggcaactatgtcactcattggaaattaacatgtctgccctctgacttc

SEQ ID NO: 19619 - DNA, 201 bp, Homo sapiens
tgggcaagtgatataacttcacattccagtttcctcctcataaaaatggaaataaagagaaggtgtacatagagtttttagataatggatttaaaacactrcctggcacacagtaaaccattactaagtagaggctatgtactccatcctacacgcatcagcagtggcagtccagcaatactcctataaggcacatgttat

SEQ ID NO: 19620 - DNA, 201 bp, Homo sapiens
attcttccaaccactgcacgttacaaacagggctgtagcctgggtctactggccaagcttccggggctgggacaggcaaggtatgtctggatgagagaagktctttgccaagacaagcatctcttgtgccaggcagaccagcaaatgagctgcttcttgcagccccttctttggcatctcccataagccaaggcctattca

SEQ ID NO: 19621 - DNA, 201 bp, Homo sapiens
ccaaccactgcacgttacaaacagggctgtagcctgggtctactggccaagcttccggggctgggacaggcaaggtatgtctggatgagagaaggtctttsccaagacaagcatctcttgtgccaggcagaccagcaaatgagctgcttcttgcagccccttctttggcatctcccataagccaaggcctattcatttaat

SEQ ID NO: 19622 - DNA, 201 bp, Homo sapiens
tagatgagctccgggccccttgtgtggcatgcactgtgcttagcactgggacacagacagacacagacttctcactccgactgtgggctcctccaggagcrggtttacaacgtatttcataaagcactttaaaataggagttcttcctgtccctaatagtattattcatcacttcattcttggcctgggaacagcctgtgg

SEQ ID NO: 19623 - DNA, 201 bp, Homo sapiens
attgtttaccctggtgatgatgtggctgacgaggtgctacagctcgctgcgctggccagcatcttgagagtattgtacagctttctaccactttccactgratacctattgtttttacaccatcagaaagttgaaaaatcttaagtagaaccatcataagtcagggactatctgtatggtagtagaaatttttaattgaat

SEQ ID NO: 19624 - DNA, 201 bp, Homo sapiens
ctagatgagctccgggccccttgtgtggcatgcactgtgcttagcactgggacacagacagacacagacttctcactccgactgtgggctcctccaggagmaggtttacaacgtatttcataaagcactttaaaataggagttcttcctgtccctaatagtattattcatcacttcattcttggcctgggaacagcctgtg

SEQ ID NO: 19625 - DNA, 201 bp, Homo sapiens
atctttacttcaagaacagacctttgacttaaaattaaagcttctctcctggtttgaaaggaattcccagtgaggtattgggcattacaagagaaactggraacagagttaggtaagcatgtaatatatgtatatgtgtatgtgtgagatacacacacacacatacacttatatatatttgcttatcctgggacactcttg

SEQ ID NO: 19626 - DNA, 201 bp, Homo sapiens
cctaccgtctgagcactgctctgaaggactcgattgccccgtggagcctgctcccacacacctgccttttgtgcagccggcccatctgttggtgctttttytttcaggaggagatgggcatctcctgtgagctgctggaatcggacttcctcaaatgcagcgtgggatttcctttcatgaggtcaaagtcaaaggtaaggg

SEQ ID NO: 19627 - DNA, 201 bp, Homo sapiens
ccttgggtgctcacagttttctgaagagaactctcaaaattctcaaaacataaatacctgtatcccacttcatttttaagaagagtaaagaaattaagtcmctttggtattggtatggagacagattttctaagttcaaatagtatactacagcatcttcagacattcatggaacattgtagtatgtgccatcattataag

SEQ ID NO: 19628 - DNA, 201 bp, Homo sapiens
caagagatagtgggacctgctcaaggtttcatccaggaggccagggagaaagggccaacctcagtatctaagggttaagggtgtgcaagagagtgcaatcwgtattgcatttcagcagatcagccaagctgcaggataggtgacagatatgaaacgataaatgtggaggcagggagaccaggtaagaagtctgcggtggtc

SEQ ID NO: 19629 - DNA, 201 bp, Homo sapiens
gctccccacacaacaaggaattatccaacaatgcacaggacagctccccacacaacaaggaattatccaacaatgcacaggacagctctccacacaacaargaattatccaacaatgcacaggacagctccccatacaacaaagaattatccagccccaatgccaacagcattgaggctgagaaaccctggattatccctt

SEQ ID NO: 19630 - DNA, 201 bp, Homo sapiens
gttacagagtgaatgggttcatcctgtcattgtaaataacagtttttcgtttaataatggcattttgtattaccaagaccttgcttcacattaggtgtttygtatacattatctcatttaatcaaaaccagcactctatatcatgggtgccaccattcctctgatttttgctaaggaggaaactgaggttcaaaaagggta

SEQ ID NO: 19631 - DNA, 201 bp, Homo sapiens
gaactgtggggtgaaaatattccaaaaaaatggatggttgcatctgtactgaacatatacagacttttttcaatatttcctaaacaataaagtatagcaaygatttacatattatttacattgtattgggtattataagtaatctagagattaaagtatataggaggatgtgtgtatgttatatgcaaattctacaccatt

SEQ ID NO: 19632 - DNA, 201 bp, Homo sapiens
ggaggatgtgtgtatgttatatgcaaattctacaccattttacatcaaggacttgtgtgttcttggggtttggtgtcagggtggtcctggaaccagttccycatggacattgaggaatgactgtgcttcccctacccaacagaagtggttctcccgtcaggttataatagggaagggatgtgtgatctttcctgagaactg

SEQ ID NO: 19633 - DNA, 201 bp, Homo sapiens
ttacatcaaggacttgtgtgttcttggggtttggtgtcagggtggtcctggaaccagttccccatggacattgaggaatgactgtgcttcccctacccaayagaagtggttctcccgtcaggttataatagggaagggatgtgtgatctttcctgagaactgaggcatgctattaagctttaaatggagcatctctaagtt

SEQ ID NO: 19634 - DNA, 201 bp, Homo sapiens
taatcagacaaagggccatgtggcaagagctcttgcttcaccaaacacgtagtgatggacccccctatacccagtgtgccagacatcatcatgagatgtamctcctttcacatatctcttcccttgccagaggaaggaactgaggctcagaaaggttcaattcctcacccaaaggtttccaacccaaggtttctgacctgg

SEQ ID NO: 19635 - DNA, 201 bp, Homo sapiens
ttgaattatgattcacctttactgaatgtcccttctcttttctttactcactgtcgaacaggaacccaaaggatgtagtttttggcagatgtcctttgtarggttcagtatttctcactcacccctttaagaccctaaagggagagttattaatagtttcagaaagttgagggaaatcatgcagaggttctcagatgttca

SEQ ID NO: 19636 - DNA, 201 bp, Homo sapiens
caaatgcccatggtttggaggcaggaatggtgttccaagagtagtagggagcctcgggactagagtttggaggatgagcggggagagtgggaggagatagygggaaagtctgtggagccagttccctgaggggcctggtgggccatgctcagtgggggtttcatttgacgagccatgggaaggcttccagcaatgggggat

SEQ ID NO: 19637 - DNA, 201 bp, Homo sapiens
atgggggatgtggttttacttgtaccttaagaagatcacactgggtcttgtttggagaatggacaggaaaggagcaggagagcaagcagagagtctgaggkgcaagaaatgccctgtcctcccagcagactggagcgaattctaattctgcctctgctacttcattcctatgcaactttgggcaggtttcctaatctctct

SEQ ID NO: 19638 - DNA, 201 bp, Homo sapiens
aactgaaaaatgttcactggaacggagctgcaatggtggaaacgttctgtgtgtgccctgttcagtacagcagccactgcgcggctgctgagcccttgaawtgtggctatcagggtagaagaactgatttttaatatattgaattatgagtcatttaaatttaaagagcacagctgtattggacagcacagctgtagaagg

SEQ ID NO: 19639 - DNA, 201 bp, Homo sapiens
ggtgcaatagagtgatcatagttcactgtaacctcgaactccaggtctcaagggatcctcctgcctcagtctcctgagtaactggatctatacacatgtgyccccgtacctggctaatgtggcttcctttatgttcagcaaggaactctcagtgtttgtccatttccttaggaacatgagtgtttttggaaggcctttgat

SEQ ID NO: 19640 - DNA, 201 bp, Homo sapiens
actctcaaaattctcaaaacataaatacctgtatcccacttcatttttaagaagagtaaagaaattaagtcactttggtattggtatggagacagattttytaagttcaaatagtatactacagcatcttcagacattcatggaacattgtagtatgtgccatcattataaggagatacaaacataggtaaaaagatgtgg

SEQ ID NO: 19641 - DNA, 201 bp, Homo sapiens
tgcagtgctaaatgctgggcacatgagaaaatgacagtaacctactaaattcaagaacaccccctatgtacattaacagtgctgcatagcttcaggaagcmctaggatctgtagcttcaataatataaaaatttctagtttcttaaatcacaaatgttaagatgaccatattatcttctaagcacacaccagaatatttca

SEQ ID NO: 19642 - DNA, 201 bp, Homo sapiens
cattaacagtgctgcatagcttcaggaagccctaggatctgtagcttcaataatataaaaatttctagtttcttaaatcacaaatgttaagatgaccatawtatcttctaagcacacaccagaatatttcagatgctcatttcttttcaggcattggtgaagatatggtctgactgccccggagggcacccacacacagcg

SEQ ID NO: 19643 - DNA, 201 bp, Homo sapiens
tgctgcatagcttcaggaagccctaggatctgtagcttcaataatataaaaatttctagtttcttaaatcacaaatgttaagatgaccatattatcttctragcacacaccagaatatttcagatgctcatttcttttcaggcattggtgaagatatggtctgactgccccggagggcacccacacacagcgcttgactcc

SEQ ID NO: 19644 - DNA, 201 bp, Homo sapiens
tcagctaggaagactgactctgcctcacagagtccccgcgagactgggccctggctgccgacagcacgaccctcctgtatggcatgcctttattgtctccyttcctttgctctctcccttctccactctccagtcctactggcatttcctggggccacctctcgaataaactacttacactcaaatctttgtgtggaacac

SEQ ID NO: 19645 - DNA, 201 bp, Homo sapiens
gagaaagggaaggatggggttagagcttgtttttgagacagtagagtgattgctgtgaacagcacctctgcatttctgaattgcttctcagagttattttmtttttctcctttgcttttcgtaattgggtaggaaatagataaagacctgatgggtttatttcatcttagttgtttctactctttcctactcttatagttt

SEQ ID NO: 19646 - DNA, 201 bp, Homo sapiens
attgaatttaacgcaggctttttattgcaggacttcatggagctttagaagcccaggcacgcaaggaggatgcactgtttggcatttcctaaatgtacttraccacggaacaccatttttctcctgaggtttaggaaatggtgctatgatatagattagttttctatgaataacttggctttatgccttcatatacctttt

SEQ ID NO: 19647 - DNA, 201 bp, Homo sapiens
gagacagtagagtgattgctgtgaacagcacctctgcatttctgaattgcttctcagagttattttatttttctcctttgcttttcgtaattgggtaggamatagataaagacctgatgggtttatttcatcttagttgtttctactctttcctactcttatagttttgggggtgtcttgcaattaaagatgtagttcaga

SEQ ID NO: 19648 - DNA, 201 bp, Homo sapiens
tcaaaatttaaagcatttccccacctgaaaaacaatggccaaaaataatgcagatattacacatgaacatttgcagagaatccagtataaagacatttgtkaaaaataaagatggtaatacaagctctcctgtcctcctggctctgatgagtgaaatagtgcaaatcagcatccttttcttcattgcttaccccattcatg

SEQ ID NO: 19649 - DNA, 201 bp, Homo sapiens
agcatccttttcttcattgcttaccccattcatgcttgaaatgggatttcccagacatgccaggatgtttctttttaattctgtgcactcatgtttcactkcaaattagttatttcagctatggtcagatattccttccttttctatgtcttcaggttgtttggtgaatattgttcttttttgaatcaggagttggcaacc

SEQ ID NO: 19650 - DNA, 201 bp, Homo sapiens
ggtcagatattccttccttttctatgtcttcaggttgtttggtgaatattgttcttttttgaatcaggagttggcaacccactcatctgctctatcagttkttatctatttattctttgaagtggaaccaactattgcagaaaaccaaagacacagttttctagggaagagctagctggagctagatcttcatacatcctg

SEQ ID NO: 19651 - DNA, 201 bp, Homo sapiens
cacttctctatcaccagcaaatctcccttttcaacaaagatggagtagaccttaggctcagaggcttccaaaggcaacagagttcagcattgctctgtttwcattgtgttcatttttacaactaccttctctttttggcaagtgatcctggattcccatctatgacagtgatataaattgttcttttaaaacaatctttaa

SEQ ID NO: 19652 - DNA, 201 bp, Homo sapiens
gccatctgtcacagtaatgagttgtgcaaagcccaatgaaccttgtagaaacaacatcgtgcccagaaatagcctagacctcagagtgacatcagggggcrgggacctgatagatgtggtcctgcaaaaggaccgaaggttcttctttaacaattcaaattgaataggaaccatttttaatttgggggtaactccgtcttc

SEQ ID NO: 19653 - DNA, 201 bp, Homo sapiens
tagaggatttttgttgttgttgtttctttgaggttttctctgaaacttcagattaaggtagtccttgaagtggaggctattaagacctagtgttatctgtytcagggaggtgggggactaggtggactgatggaccccagaactccagattccttgcactggaagctggtgttttgtgtttggaagagcctctgccctctg

SEQ ID NO: 19654 - DNA, 201 bp, Homo sapiens
ttaagtggtgtcatactctgatccttcttccactgaacatcacattcttcatgagaatcacaccattgtcctctgtctgccctgcctgtgagacgggccaygctctatgcttgcccgcctcttccatcaggaacactcacacagtcattctcctcacataccccactctcatctgctgcccctcacacctgcccttctata

SEQ ID NO: 19655 - DNA, 201 bp, Homo sapiens
tgagaatcacaccattgtcctctgtctgccctgcctgtgagacgggccatgctctatgcttgcccgcctcttccatcaggaacactcacacagtcattctyctcacataccccactctcatctgctgcccctcacacctgcccttctatagaatgttctaccctttaatagggaagggtttcttcttcctatgaattttta

SEQ ID NO: 19656 - DNA, 201 bp, Homo sapiens
gaggacagagagagaatgtcccttggatccaatatggtggccattagtgaccttgttaaaaccagtaggaatggggtggcaagaaggagagtagaacagaytataagaaagaatgagttttgatgaaagtattggaattttgatgaccttttttattacaggtttgggagcaactactttcttcactctctaaactgcaaa

SEQ ID NO: 19657 - DNA, 201 bp, Homo sapiens
tctcttcctcagatgtctagtgtttattagacctccatagtatcttcaccaactgagaaggtgccccatcagcctgaggaactcccagggtcacccctctmcaaggattcttgacacttgcacttctacccactctgggtcagaagctattcttccctcattggattgccaccattcttgtaagggcaccttctctgcacc

SEQ ID NO: 19658 - DNA, 201 bp, Homo sapiens
actttataaattacccagttttgggtatgtctttatcagcagcatgagaacagactaatacaccaattgaggttcctccagagaattaacaaaatgtccakgcactctttcgttgttcccccatacccacagacctgccatccctggccctgcctggatgccggtacctggccactgctgctatattccatgcttttggac

SEQ ID NO: 19659 - DNA, 201 bp, Homo sapiens
tgttttacctttgaagagaaaaaagcatcagtggggttatgtgattttcatagatgaacaatttttgcaaatatgttaattgaagagtaattggtgctttyttgaccctcctgagcactgatgcttgccaaagggttatacatttcagactaatgatgatatccattactatatgtgcaattgcttataaactaatatata

SEQ ID NO: 19660 - DNA, 201 bp, Homo sapiens
ccattactatatgtgcaattgcttataaactaatatatagtcatattaaaatctctaatctgattgagaaattttcagaaacaaggtacactgattttctyaccacttatttcctgctctcatgacagaatttctggagttctttgaattcacctggtttttggagctctgtcaagtcaatatttataactgaactagttc

SEQ ID NO: 19661 - DNA, 201 bp, Homo sapiens
gaggcagggagaattgttcgaatccaggaggtggaagttgcagtgagccgaggttggcccactgcactccagcctgggcgacagagcaagactctgtcttaaaaaaaaaaaaaaaaaaaagaaggaagccaaacagaaagatacctgggtccaactgaagcaccagcctgcaccacccagagaagcacactttgtgagaac

SEQ ID NO: 19662 - DNA, 201 bp, Homo sapiens
aggcagggagaattgttcgaatccaggaggtggaagttgcagtgagccgaggttggcccactgcactccagcctgggcgacagagcaagactctgtcttaaaaaaaaaaaaaaaaaaaagaaggaagccaaacagaaagatacctgggtccaactgaagcaccagcctgcaccacccagagaagcacactttgtgagaacc

SEQ ID NO: 19663 - DNA, 201 bp, Homo sapiens
agagatctactcactttttttattcctctgcatattctgtttcttcctcgagtttcatgttcagctttttcctctccctccttgctcttactggtctctgygacctccatctttttcctcatttctcaggaaatgattgacttctgaagacagaaaatggagaaatgctagggaaaacaagagaggcaaagttttatagaa

SEQ ID NO: 19664 - DNA, 201 bp, Homo sapiens
aggattgtgaaagcattgctctctataggggcacgtgaaggacattcagccaaagggacagtttttccatagatagcttgaaaatcagggcagcaaggccmatatggagcaggtgaatatctgagccgagagttgaagaggacacagcccacagggtggaggttcagaaaacattgtgtgatggtgacagtaatttctggc

SEQ ID NO: 19665 - DNA, 201 bp, Homo sapiens
ggattgtgaaagcattgctctctataggggcacgtgaaggacattcagccaaagggacagtttttccatagatagcttgaaaatcagggcagcaaggccchtatggagcaggtgaatatctgagccgagagttgaagaggacacagcccacagggtggaggttcagaaaacattgtgtgatggtgacagtaatttctggca

SEQ ID NO: 19666 - DNA, 201 bp, Homo sapiens
aaatcaagggtcaatggcatgaactaagctgatcctggaaatcagggatgttgcatctaactgtgggatggaggcacagaggtagctacagggagcaggaygaggcaaagaaagcagctgtcactcagagttcgcttatgagttttatcaaaagcagcaagaaaagcagtcttgggtgggttttatcacttattaacagcc

SEQ ID NO: 19667 - DNA, 201 bp, Homo sapiens
aaatattattaaccatgctgaccatgccacatttccccagcatctaggagtgttctcttcctagagcatgctttctgagttgttcacgtgaacatctacartgttgcaggagcctttttttttcctatgggcaaaatcatctattgaccaaaacaagacatttaagtcactcagattctgaaggtaccccaaaaccaggga

SEQ ID NO: 19668 - DNA, 201 bp, Homo sapiens
gagtccccagatacttgtttcagaggcccacagctggcacaccctctgccttaaagccctcggcaagggcctcctgtggctccgcccctcccttgctcagyagggcctgagaatgctcactgggtcaggtgtgattcagagctcatgacggtttccactttggccttatgggactttgaatggagcagggctttcattctg

SEQ ID NO: 19669 - DNA, 201 bp, Homo sapiens
aaactcccagccttggctcgtgatcttctttccttgtagctaatgtctctgagcccctctgctgtgcttgtatttaccttaaaaacagagccacggtggtsgcctgaggaaagactatcaattttcactgcttcccacccacgggggttgtgtggaccctactctgacttcccacagcacagaaaaaaaaggaaacaggtc

SEQ ID NO: 19670 - DNA, 201 bp, Homo sapiens
ctcccagccttggctcgtgatcttctttccttgtagctaatgtctctgagcccctctgctgtgcttgtatttaccttaaaaacagagccacggtggtggcytgaggaaagactatcaattttcactgcttcccacccacgggggttgtgtggaccctactctgacttcccacagcacagaaaaaaaaggaaacaggtcact

SEQ ID NO: 19671 - DNA, 201 bp, Homo sapiens
gaaacttggattttctgagaatgtattgcagaagaacaaaaaagccagttaaacttattcctttttttaaatagcaatctggaatgaaaatatcagatgakcataatataagagttagaagtcaagagagatggaaatgaaagcaagtcaagattcttgtcttggggggacaagtttatgtaccaattagctcaaggcttt

SEQ ID NO: 19672 - DNA, 201 bp, Homo sapiens
ctctccacacccttgggaccctcaaattgtttctccctctctaacagtgcccttggtgtctgtattgcctgtgatcatcatccatagagcataatgaggawgggcttactcgccctatgggccctgggctgtcaccctacctacggacccacgtgtggcacagttttctgacttggttcagaattcatttagaagtctctg

SEQ ID NO: 19673 - DNA, 201 bp, Homo sapiens
tctccacacccttgggaccctcaaattgtttctccctctctaacagtgcccttggtgtctgtattgcctgtgatcatcatccatagagcataatgaggatkggcttactcgccctatgggccctgggctgtcaccctacctacggacccacgtgtggcacagttttctgacttggttcagaattcatttagaagtctctgg

SEQ ID NO: 19674 - DNA, 201 bp, Homo sapiens
agccaagagctccagggctgaacagatgtgactgaaaatctttaccagccatgtgccctggggaactgagcctttcatttcccctttccttttctgtatawtggaggataacaagccttcactcacagggcgtgggtgtgtttctcatctccttgcagcacctagcacagtacctggcatctcatatgttcagggcatgtt

SEQ ID NO: 19675 - DNA, 201 bp, Homo sapiens
agaagggttagagttgacttttcaccattgtccccacccctacaggcttcaggcatgcagaatagcaagcagccaggcatcgccttctctaaagtgttaartaaactgtttaagatagtgtgggcgacctcgttctcagagaaaagaaagccttacttctggcatttgaagtcaccaacgtaagagctagctttctctccc

SEQ ID NO: 19676 - DNA, 201 bp, Homo sapiens
aaagaagggggagaaaattatgtaataatagaatagcatgtttcagagttaaagagggagactattttttaaaattggtgtaaacaacaatttacaatcamaataaaccaaaattatcatagacacatcattttgaaatgtcagtgcttcaaagacaaagggaaaattctaaatgtttcgagggcaaagaatgcaggaatg

SEQ ID NO: 19677 - DNA, 201 bp, Homo sapiens
ttccccatgttgcccaggctggtcttgaactcctaggctcaaggaatcctcctgcctcagcctccctaagtgctgggattacaggcatgagccaccgtgcrtggccttagctgcctatttgattccttcgtgacatctaacagaacgtgttatttcgtctacttgttattgtatttacctctctagaatggaagcccagtg

SEQ ID NO: 19678 - DNA, 201 bp, Homo sapiens
atcaatgtggcaaaactgcacttgtatcccatgaatatataccatgtttttaaaaatgttgcctttgggcagaggggataattctgcaaactgcagagccrtggagtaaaaaaaacacccaagatagcagaacttgtcatttctagtttttccacaggaccataaagcaaaattggtgccgggtttgtatttaaagggaaa

SEQ ID NO: 19679 - DNA, 201 bp, Homo sapiens
cctggccttggtgaccatggcactgtaagagaagcacagccagccccagcgtccttactctgactcagaggaaaatgcaacttgagctggattcattgaawtcttttttttcctggcctgaaggaaatgaagaaacatagccaaatattctaaaacaggattcaacaaacagcccataggccaaatccaccactgcctgtt

SEQ ID NO: 19680 - DNA, 201 bp, Homo sapiens
tcaaggctgcagtgagccatgttcacaccactgtactcaagccaggatgacagatcctgtctcaaaaaaacaaaaacaaaacaaaaaaatcttttcaattktattcacacaaagataaaatctgaataaaatatgcatgaggttaaaaaaaaagtccaactagactatcttagaaaaaaatgtaaaagtagacaaagacct

SEQ ID NO: 19681 - DNA, 201 bp, Homo sapiens
ttcacaccactgtactcaagccaggatgacagatcctgtctcaaaaaaacaaaaacaaaacaaaaaaatcttttcaattgtattcacacaaagataaaatytgaataaaatatgcatgaggttaaaaaaaaagtccaactagactatcttagaaaaaaatgtaaaagtagacaaagacctatatcttaaaaaaaatcaccg

SEQ ID NO: 19682 - DNA, 201 bp, Homo sapiens
aacatgtttctaatgtcacacaacctccagctctaggacaaataatgttggaccccaagcattctttttgcaaatatgagggctagactgaagcctcattkgaccacaggtcctatgggactggtggagatatagtgcccggagcctggcccttagggaacattcgagcagttagaaagcagaagtgacaggactttggag

SEQ ID NO: 19683 - DNA, 201 bp, Homo sapiens
aacaaaaacaaaacaaaaaaatcttttcaattgtattcacacaaagataaaatctgaataaaatatgcatgaggttaaaaaaaaagtccaactagactatyttagaaaaaaatgtaaaagtagacaaagacctatatcttaaaaaaaatcaccgacccagatagctatataggcagattctagtaggctttcaaggaatgg

SEQ ID NO: 19684 - DNA, 201 bp, Homo sapiens
ctcttctcctctttctccagggaagaatcggggcacgtcctgcggaaagacctgccgggaagaccgcgatgatgagtggatgggggtgagcctggcccgamagcccaaggctgatggccgtgtgttggtaagtccctcctgggggtgctgtgggaagggggtggcactctgagaatgaatgatctgttaggaaggctggat

SEQ ID NO: 19685 - DNA, 201 bp, Homo sapiens
acaattctatgtttaattattttgagaaatgttcatattgttttccaagcagccactcgattttacgttcctaccaacagtgcacaagggtttcaatttcyccacattcttgacaattcttgtcttctgtttttttgatagttgccatcctaatagtcatgaagtgggaaaaaatagtttttaaaaagtaacagatggata

SEQ ID NO: 19686 - DNA, 201 bp, Homo sapiens
taactttctgtctcgttgatctgtctaatgttgacagtggggtgttaaagtctcccattatattgtgtgggagtctgagtctctttgtaggtcactaaggrcttgctttatgaatctgggtgctcctgtattgggtgcatatatatttaggatagttagctcttcttgttgaattgatccctttaccattatgtaatggcc

SEQ ID NO: 19687 - DNA, 201 bp, Homo sapiens
aaaaaagtccaactagactatcttagaaaaaaatgtaaaagtagacaaagacctatatcttaaaaaaaatcaccgacccagatagctatataggcagattytagtaggctttcaaggaatggataattcttatgttaatataagctgttccagagagtagaaaaagataaagcaactcattccagaaaactaacatagccc

SEQ ID NO: 19688 - DNA, 201 bp, Homo sapiens
tgacaattctatgtttaattattttgagaaatgttcatattgttttccaagcagccactcgattttacgttcctaccaacagtgcacaagggtttcaattyctccacattcttgacaattcttgtcttctgtttttttgatagttgccatcctaatagtcatgaagtgggaaaaaatagtttttaaaaagtaacagatgga

SEQ ID NO: 19689 - DNA, 201 bp, Homo sapiens
atatatatacccacacacacacacacacacacacatatacccacatacatatatatgcatacatgcaatatatattttgccagcagaaacatcagaggctrcacactccaggaaaaacagactccagagactatgtctaggcaagtcactaaacaaacaaaacaaaaaaaaagtaacaactacccctcaatgggaggggta

SEQ ID NO: 19690 - DNA, 201 bp, Homo sapiens
cccaggaggcggaggttgcggtgagccgagatcacaccactgcacttcagcctgggcaaaagagtgagactctgtctcaatttaattaaaaaaaaaaaaaagcaaaacacctgaaatgaacaattcattagaggggctcaatagcatatttgagctgacacagaatcagtgaacttgaagctggattacagtacagatttt

SEQ ID NO: 19691 - DNA, 201 bp, Homo sapiens
attcgcagcccctctcctgtaaaactcatgaataatccactccttttttagcatttaatcaagaaataaccattaaaataggcaagcagcagcccttgggyctgtgttacctatggggtaaccaccttttatttctttactttcttaataaacttgctttcactttactctctgggcttcctcttgaattctttcctttag

SEQ ID NO: 19692 - DNA, 201 bp, Homo sapiens
ttcgcagcccctctcctgtaaaactcatgaataatccactccttttttagcatttaatcaagaaataaccattaaaataggcaagcagcagcccttggggktgtgttacctatggggtaaccaccttttatttctttactttcttaataaacttgctttcactttactctctgggcttcctcttgaattctttcctttagg

SEQ ID NO: 19693 - DNA, 201 bp, Homo sapiens
ttactatctgagaactttagtcctaataatttctctacaccaacttctagtcctaataatttatccgtataatgctcagaaacactccgagattctcagtaaaaaaaaaaaaaaaaaaaaaaaaaaatcaaggaaatcttaatggccaaagccataggtccaaaacccggcgttccctcccacccaactttccaggccatt

SEQ ID NO: 19694 - DNA, 201 bp, Homo sapiens
ctgaagctagcagggactgtccaaagccagagcccctcatattagcctagcttatgttgttgtgatcatcagactgtttctgttttttggatttttgtccwtaaataaacaccttggaaccactagctacacagaggggtaaatatcagaaaatccaaatttggtgcactaatgaacacggggtctcttttcacaaagcaa

SEQ ID NO: 19695 - DNA, 201 bp, Homo sapiens
atggtattgactgttatggcatgcatggaaacagacctggacatgaaaggataagcttcaagccaggtgcatgagggctcccagctgacttttgggtgcamacaggatgcaacagcttgccacagagtgatagaggaggccatgctaggagagaagggagaacaagcagggcaggcaccctggcccgactcttacacacag

SEQ ID NO: 19696 - DNA, 201 bp, Homo sapiens
ctttggcctgtgctttggattatttatttatttattttttgagacaagtctcgctctgtcacccaggctggagtgcagtgccacaatctcggctcactgcracctccacctcctgagttcaagtgatcctcccacctcatcctcccgagtagctgggactacaggtgtgcacctggctaatttttgtattttttggtagag

SEQ ID NO: 19697 - DNA, 201 bp, Homo sapiens
aaagaagtagagtaaggatttagtgagaagctggagaaaatattttcaaagacaactgtattctccagggaaacctgagatgaagaccaaggtgaggaagragccagcagagaaatcgagtccatgaggctgaggaggccactggatgtccagtcttcagctctctgaagcctgagacaggaaacagttgtctcccgagag

SEQ ID NO: 19698 - DNA, 201 bp, Homo sapiens
gatttagtgagaagctggagaaaatattttcaaagacaactgtattctccagggaaacctgagatgaagaccaaggtgaggaaggagccagcagagaaatygagtccatgaggctgaggaggccactggatgtccagtcttcagctctctgaagcctgagacaggaaacagttgtctcccgagagaaaggtttgaacctcc

SEQ ID NO: 19699 - DNA, 201 bp, Homo sapiens
aagcactggccacatctaaaatggttgaatagtgaaacctcatgttttcctttgtatttaaccacattcaaaggcttcttactcttgagagggaaaaagakcagcacccccaccgccccctgcccctactcttgaaataaaatgatggagaaagatttggagttaaaagaaaaccaagtcctcttgcgtgtggacaaagca

SEQ ID NO: 19700 - DNA, 201 bp, Homo sapiens
acctcctttaactagggaggaataagagatgatggcttcttagatctgtttacatttgctggaaaaacttcttccagggaaataactagacagggctttgrccaactagcaggtgaagtctggagggaggtggaagagactgcttccaagctgggttccgatttgtctgattgaagcagccaagcttgtgtttgccagagg

SEQ ID NO: 19701 - DNA, 201 bp, Homo sapiens
aaattcaacacacagccaacttgccctccattgtgacgtcaaaataaagatatactcagatatatgagaattcataggctattacctcttccagtttggayttccccaaaagcataccctgatacaatgatacaggtacaggtagtttatttgggggtgggcgatctcagtgttgagtttagacaggaaagagaggaaaga

SEQ ID NO: 19702 - DNA, 201 bp, Homo sapiens
actgtgccgcagacctgcagcttcagggtaaactgctgctctccaggtatgtcggtgtttccttcagagcattgttctcaggctcctttttcttgaccccrggtcccaaacctgaatgtgcagatttccccactgaagaggataaacagagttgatgggttacagtaatattctgtggttttaaaaaaatgtatgttacaa

SEQ ID NO: 19703 - DNA, 201 bp, Homo sapiens
ttatatgacaattctatgtttaattattttgagaaatgttcatattgttttccaagcagccactcgattttacgttcctaccaacagtgcacaagggtttwaatttctccacattcttgacaattcttgtcttctgtttttttgatagttgccatcctaatagtcatgaagtgggaaaaaatagtttttaaaaagtaacag

SEQ ID NO: 19704 - DNA, 201 bp, Homo sapiens
gagaaaaagagggacaaaagaacaagacacatagaaaatagtcaccaaaatggcaatagtaaatctgtctctatatttactttaaatgtaaaaagactaamcttcccaataaaaagatacagcatgactgaatagattattaaaaaaaacaacaacaaccaggatcaaactgtatgctgtctacaagaagctcacttttag

SEQ ID NO: 19705 - DNA, 201 bp, Homo sapiens
actgacatcaaatgcttgtatgattgggaggaaggagcccgaaggccaaagaggctcactaatttcattattcgattcttccaaccactgcacgttacaawcagggctgtagcctgggtctactggccaagcttccggggctgggacaggcaaggtatgtctggatgagagaaggtctttgccaagacaagcatctcttgt

SEQ ID NO: 19706 - DNA, 201 bp, Homo sapiens
agccaggcactgtgctaggcactggggactcgatggggaacaaaagagacatgatccgtgccctcccagagctggccgagggggcagcagtcagcaaggasgcaaacaagaattctatttccagttgaggttagtccccagggagtagcctgctttagattgggggtcgaggaatgtttctacaaggaagctgagactggc

SEQ ID NO: 19707 - DNA, 201 bp, Homo sapiens
agtgatagctggcatgagaaagccagggtgacagaggtgaggagggcacatgccagatctggcagcctgcatgtcaccagatggatttaggtcacatcctkttcttccgttctcacctctttcacctccatctccacctccacctctaccccttcacctctccatgcctcacaaagttggactgtcttgcctgtgagacag

SEQ ID NO: 19708 - DNA, 201 bp, Homo sapiens
agatggcaaagaaagagcaaatatattgaaatctcctggaaatttggctctctccttgaccccagtagtgtccaaaagaacacaggaatttcctctttttkcccaagacttccatgatattttccctgataatcaaggaagggagtgttggctgggacacttttttcttttggaaatgtggcaggggaatatgaattttca

SEQ ID NO: 19709 - DNA, 201 bp, Homo sapiens
gctcttctcctctttctccagggaagaatcggggcacgtcctgcggaaagacctgccgggaagaccgcgatgatgagtggatgggggtgagcctggcccgrcagcccaaggctgatggccgtgtgttggtaagtccctcctgggggtgctgtgggaagggggtggcactctgagaatgaatgatctgttaggaaggctgga

SEQ ID NO: 19710 - DNA, 201 bp, Homo sapiens
gattgaggggaagactaacaagccctccatggaccgtagaagaaagccctaacccctctccaaatgctgctgctgatctcctggcaagcctccacagatargcccaggcccaggcacagccagcaagctctctggaaatatttgggttttgacatgccaagacttggccccagtaagggctgggtggggctttggctgttg

SEQ ID NO: 19711 - DNA, 201 bp, Homo sapiens
cctttgtaggttatcctgagtctgcattattacagggtcttgaaatgaatggtgatacgtgaaagtatttgtcctaggattcattaatattattatatttwagtctttggtcaatatgaagaaatactcaatagtaaatcatagcaacatgatttaacatgagatataatttgaagggctctttaaggctgctaagcaacc

SEQ ID NO: 19712 - DNA, 201 bp, Homo sapiens
catcatcccagctactcgggaggctgaggcaggagaatcgcttgaacccggaaggcagaggttgtggtgagctgagattgcaccattgcactccagcctgrgcaataagagcaaaactctgtctcaaaaaaaaaaaaaaaaagctaaaaatatcacataccaaagctgcaaattatttctttaattttgagcgacgttaat

SEQ ID NO: 19713 - DNA, 201 bp, Homo sapiens
ctgtccccttcctttagacatggaccggttactcagctgcagggctgacaactgtaacaccctgtgatataaataaatgctgcctggctggcgtgcagccyccagagcggacgtctttcacaccccaccccgtcccctcctccttctctgccccagacgccctggagtccaaagtggttgggtgcactggcttcctttctg

SEQ ID NO: 19714 - DNA, 201 bp, Homo sapiens
atgtcctctttggggtaaaggggaggacagatgccaacagaaaaccctcagtacctgccttggtagaatacagccttgtcactgtgtcctgcatcctcctktccttgtttgggtgcctggtgaagtccttttgttcaaattctaatagccatggacctctgccagctcccagaggccctgagagataagcagccatgtcat

SEQ ID NO: 19715 - DNA, 201 bp, Homo sapiens
accagcctgaccaatatggtgaaaccccatctctactaaaaatccaaaaagcttagccaggcatggtggcgtgtgcctgtaattccagctactggggaggstgaggcaggagaattacttgaacccaggaggcagaggtttcagtgagccaagatcgcaccactgcactacagcctgggtaacagagcaagactccatctc

SEQ ID NO: 19716 - DNA, 201 bp, Homo sapiens
aataaagttttattggaacacatctatgcccattcccttatgtattatctatggctgcttttgctctacaacagcagagttgagtagtgtgactgagaccrtatagcctacaagcccaaaacatatactgtctcacccttttcagaaaaagttgccagccttgttctaaaagaagtagagtaaggatttagtgagaagctg

SEQ ID NO: 19717 - DNA, 201 bp, Homo sapiens
atccaagtgtgcatcttctgagattgatgggtttcatttctaagccacatttttagtcagcagtttaccagaatatatcatctacaatttgcctaatttakttgaaatgcagaacttcttgaatccatgttggtgctgaaatttgattggcacacaccaacgcccacttgcgtagcactgcagcagttgttttcctcattt

SEQ ID NO: 19718 - DNA, 201 bp, Homo sapiens
aactttcaacaattgaacccaaggaataattaccaaatcttcattaaagctcattgcctccttcccattgtttccctctcgtgacctctaaaatcgtccaracctgatgttgattgagatcatttcaggctagtgtgttttccccaaatgttgtcgttcaaataaagtaattgaggctgggtgcagtggctcatgcctata

SEQ ID NO: 19719 - DNA, 201 bp, Homo sapiens
gcctataatcccagtgctttggaaggccaagacaggcagattgcttgagctaaggagttcgagaccagcctgggtaatgtggcaaaactctatctctaccaaaaaaaaaaaaaagaaaccagcaaaaaacaaaacaaaacaaaaactagccatgtgtggtggcatgtgcctatagtcccagctactcaggaggctgaggaa

SEQ ID NO: 19720 - DNA, 201 bp, Homo sapiens
cctggtgcggtggctcatgcctgtaatcccagcactttgggaggccgaggcgggcggatcatgaggtcaggagatggagaccatcctggctaacacggtgaaccccatatctactaaaaatacaaaaaaaaattagccgggcatggtggcaggtgcctgttgtcccagctactcgggaggctgaggcaggagaatggcttg

SEQ ID NO: 19721 - DNA, 201 bp, Homo sapiens
ggaacagaaaaccaaatatcacatgatctcaatgataagtgggagctaaattatgagaactcatgaacacaaagaagggaacaacagacactggagtctayttgagaatggaggttggaaggagggagaggagtagaaaaaataactattgggtactaggcttagtacctgggtgatgaaataatctgtaccaaaaacctc

SEQ ID NO: 19722 - DNA, 201 bp, Homo sapiens
ctgtccagccttcagctacaaccagtgtgatatggtgatatataaagaagacttcatttttctaacagttcctcaatttaaacatcagaaagagtgctgtycttaaggaaatcatcaagaaagactaagcaccattgttttgtttctgatgttgctgtcactcagcaccgttgccattgctgtcagaagcaaaatcaaatc

SEQ ID NO: 19723 - DNA, 201 bp, Homo sapiens
ttcttattgctgctgtaacaaattactacaacatttgtggcttaaaacaacacaaatttgttatcttacagttctgaagaacagaagtccaaaatgggccycgctgggctaaaaccaaagtatcagggcctgtgttcttgccagaggcaccaggggaaaatccacttcttgcctttgccagcctctaagggctgcctgcat

SEQ ID NO: 19724 - DNA, 201 bp, Homo sapiens
ttcttctgcagaggcgagccgtgtagcatagcccctgagcacaggtctaagattgcaccaagataacacatctgtcacaagcttcatggcttatgaagggragagggtagtggtctttccaaagttaagttttactcacaatttctgaaggttcaatggaagagatgggagctttatctcagactgcaagcttcacttgat

SEQ ID NO: 19725 - DNA, 201 bp, Homo sapiens
ctaacagggagtgaagggctagaacttttattccaggtgaaagtactggatttttgaaagaactctagtgttagtccagaagagatataaaataaatatcrtaccattcattcctcctcctgcaaaaccaattgaaaatattggcctctctggcttgttgttttcttgctatggggcagtgattctaaagaactgacctga

SEQ ID NO: 19726 - DNA, 201 bp, Homo sapiens
ggcttgttgttttcttgctatggggcagtgattctaaagaactgacctgatttccaggaggtaaaattgtagggatgaatgataattttctaaggagatayatcaatgtctttgccatagggtaccattaggacattgacttcaatatggcatgaataccaacatctgttagaatattccaagttggtgccaggactcata

SEQ ID NO: 19727 - DNA, 201 bp, Homo sapiens
gccacagtctctgaccacaatgcaataaacttggaagctaaaaacaaaaggttaggcaaacaaccaaccaaaaacaaatccacttgggaaattttaaacamcattcaaattaactttttagaaaaaaaagaaatcaaagttgaagggatgaacaaattagaagtgaaagacagtgagcggttgttcatatcaaaaccaatg

SEQ ID NO: 19728 - DNA, 201 bp, Homo sapiens
attaactttttagaaaaaaaagaaatcaaagttgaagggatgaacaaattagaagtgaaagacagtgagcggttgttcatatcaaaaccaatgggatttaracaaaaccaacacagaggaaaatgccactacttacatgtggaaaatagggaagactgaaaataagtgaactaaattgacaacataaaaactagacaaggg

SEQ ID NO: 19729 - DNA, 201 bp, Homo sapiens
cacacacacacacacacacacacacacacacacacacactagtgtatgttttaacaagtaacatttctgtggcaggagagggctgaaggagaggggcaggytgccctgatccaagtgagcagatagtctccttattgtttcagggtttcctcccgcactacatgaatcccccaaggctaaaggtgaaccgtacagcggcct

SEQ ID NO: 19730 - DNA, 201 bp, Homo sapiens
ccgacccagatagctatataggcagattctagtaggctttcaaggaatggataattcttatgttaatataagctgttccagagagtagaaaaagataaagmaactcattccagaaaactaacatagccctggtacagaaaccagaaatggagagcgggcacactcacgcaaaaataggaagcagtgagccaaactcacttt

SEQ ID NO: 19731 - DNA, 201 bp, Homo sapiens
acaggcatgaaccaccgcgcctggccgagtcagcacattctttatctatgtaggttgcattttctctccttggagagcctcagattcaatggtgagcttayggctggcatgccagcagtttcctaaaatgtaatatcatcactattattgttattatatgagggaaggtgaataggaactcatcagaaacctggaaaatgt

SEQ ID NO: 19732 - DNA, 201 bp, Homo sapiens
aataaattaaaataagtggaaattaaataaatgaataataaaatagatggaaattataagaaccaaggggaaattctggaattgaaagtaaaacatgggcygagcatggtggctcatgcctgtaatcccagcactttgggaggctgagttgggcatatcacctgaggtcaggagttggagaccagccaggccaacatggtg

SEQ ID NO: 19733 - DNA, 201 bp, Homo sapiens
aaagcatttgatttgcagtttcctgaatgcgaggctccaagtgtagggaccgccacccaaggacgtttttctctgttgggcagactcaaagcactgagggragcttttcagggcccaccatacatgagcaacagatagctctccctacagataccatatttcagggacagccccttccctcctgagcagacactggctgag

SEQ ID NO: 19734 - DNA, 201 bp, Homo sapiens
cagcttcgactttctagatggtgagaggatggggatgctcagagggacagtgaaggcactgaggcagtaactgtggcaaccatagaagaggctggccacgwgctcatagcggccttcctcctgagacacccgggaaggctgagtctacctcacaggtgtgcctgataaaatttttttgggcagtgttttccttggcttcca

SEQ ID NO: 19735 - DNA, 201 bp, Homo sapiens
tctggttgaggctagattccccctgtgcccacagccttggtccactcctgccctgtccctgccccagcctggttccctggctcgccaacagatccctggawctctgccacaagctctggcttccagggaagggagcctatcctgagatgcggtagaacctcatgttttatttatctgctcttagatctcctgtccgggcag

SEQ ID NO: 19736 - DNA, 201 bp, Homo sapiens
gccactcaatcctgccctaaccttcctctcctgtctttctcacagactgtttttgaaaggaattgccgttcagaggactgtgccgcagacctgcagcttcrgggtaaactgctgctctccaggtatgtcggtgtttccttcagagcattgttctcaggctcctttttcttgaccccaggtcccaaacctgaatgtgcagat

SEQ ID NO: 19737 - DNA, 201 bp, Homo sapiens
tctgtccccttcctttagacatggaccggttactcagctgcagggctgacaactgtaacaccctgtgatataaataaatgctgcctggctggcgtgcagcytccagagcggacgtctttcacaccccaccccgtcccctcctccttctctgccccagacgccctggagtccaaagtggttgggtgcactggcttcctttct

SEQ ID NO: 19738 - DNA, 201 bp, Homo sapiens
tccagggctcctggttttcatttagggttattagcactgggcagacttatcttcttggcttttagcataatggcctgcagatgtctgtgggataacttaascctgcatcaccaccccagatggaccaccccttcgctctgcccctcgtcccagccacagcataccttagaaatgtagatccaggggcaggctgctgctaga

SEQ ID NO: 19739 - DNA, 201 bp, Homo sapiens
atgaggcaattcatgtagaaggtctttgtaaactgtgaaatgctctacgactgtcagccaggattagtagttaatgcacgtatttgtttattgtttcagcrgagggtgcaggacgtcatcagcccgatcgtgtttgaagcagcctacagcctcagtgagcatgtgactggagaggaggagagggaactgccgcctctgaca

SEQ ID NO: 19740 - DNA, 201 bp, Homo sapiens
acattcatccctccttcagagttatagcattagatttacctccagatctttttatttaatatgttttttttaaagcatattgctaaactacacatttgtgytctcccctttcccatagggctacctcacctcccaggagaaaagattcaaaatctaggagattcataatttcaatatattccattgcttgtgactatttat

SEQ ID NO: 19741 - DNA, 201 bp, Homo sapiens
cattagaaggcgatgaggctatggaaaaaaagaaagaaaatagagcccagtgaagcgggtttgggagtgcaggcatggggttatgggggtcagggtgaccycactgacgaggtgtgatttgagcaaagcatggaaggaggctggggagttagcacagcgggttcctggaggagggctcagaccagtgtctgagtgtctggt

SEQ ID NO: 19742 - DNA, 201 bp, Homo sapiens
aaaaggagaagggccagatgcccagggtctactttgtgctgctgggagagaccatgggtcaggtcacagagaagctgcagctgacttacatggaggagacrtgtcgtcactatgtggcccatgtgaaggtcagtcctctcctcctttttatcctcaaactttgatctctgcagatgttcacttggagctggtggaaactat

SEQ ID NO: 19743 - DNA, 201 bp, Homo sapiens
agccttcatgtccgacagcgtggttcttctcaggtgagaggccccactcttgctccttgaattgtgctgttcagggtgagggatggagccattcaccattyatgggctctttcctctgtcctgttccttgtaggctggaggtgcttagtaagtggaaatgctaccttattttctcattctaattattctctatcccagagt

SEQ ID NO: 19744 - DNA, 201 bp, Homo sapiens; identical to SEQ ID NO: 2065

SEQ ID NO: 19745 - DNA, 201 bp, Homo sapiens
tccttcccgtggttcctggcaacattgtatttctattaagagtttgactactttagatcttatgtgagtggagtgtggtgttcgtccttttgtgacgaacktacttcatttagcataatgtcctcaaggttcatcatgttgtagcatgtgaccggatctccttcctttttaaaggcagaataatatttcattgtatgaatt

SEQ ID NO: 19746 - DNA, 201 bp, Homo sapiens
aaacagtatagtacatagtgatggagttgatttacattttgtggaaagttccttatttcctcatagggctgtggaccaccctttgaaagcagccagcagamcatcactcctcaacccaagtctggctcttctcctctttctccagggaagaatcggggcacgtcctgcggaaagacctgccgggaagaccgcgatgatgag

SEQ ID NO: 19747 - DNA, 201 bp, Homo sapiens
tcttgccttgtcattccagggacagagattcctgttctctcactttaaaaataacatatttccttgaatccccaaaacagttaaaaaataaaaagggttayggaggggatgacctctggcacagaaaagcagtaaaataggtgtattgacactgaagtcatatttctataatgaaatacatacctatctatttacttattg

SEQ ID NO: 19748 - DNA, 201 bp, Homo sapiens
atctctgcacttgtttggacctgctatccatgcattcaaaaaaatgggaggttttggtcaagtaatgtacaacatgcagcaagaacaagtgtggtgggaakagcctggcaccagagattaagggagtcctagattcagctgtttgatgggtggccctctggcctggagcaagtcttgttcccttttggggcctcagttccc

SEQ ID NO: 19749 - DNA, 201 bp, Homo sapiens
cactttgggaggctgagttgggcatatcacctgaggtcaggagttggagaccagccaggccaacatggtgaaaccctgtctgtactaaaaatacacaaaamttagccaggtgtcgtgggcaggtgcctgtaatcccagctactcgggaggctgaggcaggagaatcgcttgaacccgggaagcagagattgcagtaagccg

SEQ ID NO: 19750 - DNA, 201 bp, Homo sapiens
cctatggggtaaccaccttttatttctttactttcttaataaacttgctttcactttactctctgggcttcctcttgaattctttcctttaggaagccaamacccaccggccctcccaggccaaaccccaatttgggggttcatcctgccacaactgtacagtgtggggtcaaggggaacccttggtctttttcactgaaa

SEQ ID NO: 19751 - DNA, 201 bp, Homo sapiens
acggagtggtcagggacagtttcacggagacctttattcagaagttgcagggaccaaagctatcttacgggagtttgcaatgagaatttctttgcccatgragtccttgccaagtctatgtcttttctgagaattctctcccccttgatttcagccctgtttgatttctgacctttgaaatgccagcccccatgctgccgt

SEQ ID NO: 19752 - DNA, 201 bp, Homo sapiens
tcattttcctcattcagacaagaattgcttgtaaggatgttcttaagtgtgctttcaaaaccatggagtataaggcttattttactccttaagtcttcctrtttcctagtcacatctcatttgcatgttatatgccatctcatcaattattgggggacctaagatccacattttctattatttggccctgttgatgctaca

SEQ ID NO: 19753 - DNA, 201 bp, Homo sapiens
caaataaaaattcaaaactgagcagcaaatcctgtgcctcttcatccaacccctcctcatcatgaatcattatcactcaggaagtaaggacctggtttacyatctgagaactttagtcctaataatttctctacaccaacttctagtcctaataatttatccgtataatgctcagaaacactccgagattctcagtaaaaa

SEQ ID NO: 19754 - DNA, 201 bp, Homo sapiens
ccctgttgatgctacaacttctgcctttcagcttttcagccattgttctccacttcaaaatggacaaggaggaaaggtgaattggggttctaccactcctscctctacaataagaggctccagcatcatgattcattcttgagaatgactcctctgacaggcctcttttcatttgcaggtgggccaagagaagggaaactg

SEQ ID NO: 19755 - DNA, 201 bp, Homo sapiens
ttctctacaccaacttctagtcctaataatttatccgtataatgctcagaaacactccgagattctcagtaaaaaaaaaaaaaaaaaaaaaaaaaaatcarggaaatcttaatggccaaagccataggtccaaaacccggcgttccctcccacccaactttccaggccattttctccaatagcccctcatccctgaccttg

SEQ ID NO: 19756 - DNA, 201 bp, Homo sapiens
gttacagtgagtgaacctgatttgttccagatgtcctaagatttagtgattccggaaactactcctaaagtcaaggctgatgaggatttgaattcctctgytagctgggaaccagcagttcttttcacagttaaacagatgaggcaggaggagggagactgagctgccttgagggacagggaggggcccactgactggctt

SEQ ID NO: 19757 - DNA, 201 bp, Homo sapiens
gcacacacgagtagcatgaaattagccatgttcatattaaggagcaatctaagatcattattgctgtttctctggccttatattaaatagtgtcattgcarttgaaaaattagagtaaatgaacagagcctgtgagcatccaccctttgtaggttatcctgagtctgcattattacagggtcttgaaatgaatggtgatac

SEQ ID NO: 19758 - DNA, 201 bp, Homo sapiens
atttggcgtagattattaaagaacagttacctgtgtcatgaaggagaggcccccagactggcactttgaatgcaaattcttctgtgacaaatccaggggaytttggaataactctcagatatggcagtagacttaactgtaaaagctcccagcccacagaggtgagcagaggctgaggagtaaacaccataccaacattct

SEQ ID NO: 19759 - DNA, 201 bp, Homo sapiens
ggtcaatatgaagaaatactcaatagtaaatcatagcaacatgatttaacatgagatataatttgaagggctctttaaggctgctaagcaaccatgaatcrtggtttgcatttttctagatggataatatgaagctatcttatttatctttctagaactagacaccttaggtcaggctaatcaaccagctggtatcatttc

SEQ ID NO: 19760 - DNA, 201 bp, Homo sapiens
gagtaaacaccataccaacattctgggacaaaatagcctgaatgctgttgtaccttggaaatgcaatagcagctgccttcctaggtggggaagctgagagyagcctcttacaggagtgcatgccctatagacagaggctcatgaacttgtgcttgctgacatgtatatcttcttcagttggtccctagtgagtctacccaa

SEQ ID NO: 19761 - DNA, 201 bp, Homo sapiens
attcacacttcaaacccactacttcatgaagcaaggtcttgccagatcccctagagtgaacaggggattctttatcctctcacaggcctggcaccgtggtrgcttctgaccatgacagctcctttcactgaggctgacccagactctgccaccaagtgatggccactccttgggctcccacagccagggttcctgacagct

SEQ ID NO: 19762 - DNA, 201 bp, Homo sapiens
cacagtttcccagagctccccagcaagattaagttccaggtgctcagggagctgactggcttgatgttgctgcctttgctggttgcctgtccttctgtgtytcactctaccccttccctactggtgttttatggaaccacctctggaataaacaacttgctttcaaacctgtctccagctctgcatctgggggcgcctgca

SEQ ID NO: 19763 - DNA, 201 bp, Homo sapiens
ccatggacactttgggttgtgtctacccttggctactgtgaatagtgctgctatgaacatgggggaacaaatgtctctttgagttcctgctttcagttcaytgggtaataaacccaaaagtataatttttgggttatatgacaattctatgtttaattattttgagaaatgttcatattgttttccaagcagccactcgat

SEQ ID NO: 19764 - DNA, 201 bp, Homo sapiens
gagcaatatattttcagcaggctatatatatgctgtaagataagctttatagaagcagtacactttgtatcttatgttgactactaataatgattttcatwtaaaagcacagcaaagagatccatgtacaaagtaatataacccacttaaaagactgcacaagcaaattaaaataaatggggaaatttctcagggaataaa

SEQ ID NO: 19765 - DNA, 201 bp, Homo sapiens
attctagtaggggatagacagtcctcaaccaaaaagccccacaaacaaatgcataaccacaacttcgataagtgccatgaagggttgatggggcacatggkgggtggggggctcataatgggaggatttatttcacctaggcagggagatcaggaaggatcccctggggacatgatagtcagggggctggagaatgtgggt

SEQ ID NO: 19766 - DNA, 201 bp, Homo sapiens
aagaatgcagatgtgagccataagcagcctacacacacatcagccaggagatgggccacagttcacagtgcccactacacatcaaaacacaccctctgggraatgctgccaagaggttttgatttaaaacacgaaccttctttcacaacacaagtgccccaggagagtggcctgtaagtcccactggccattgatacttgg

SEQ ID NO: 19767 - DNA, 201 bp, Homo sapiens
tgtgaggtttcagaaggatgacatatttgacaacacccaatatcatgctggcacatcacattttcatttcatttctaaaaataactttggaagcagagatrtgctgttttagtcaaagacttttttagctttggagaaagaatgaaaccccagctttgagactcctctaaaaaaaatctgagttcacattctgccctggaa

SEQ ID NO: 19768 - DNA, 201 bp, Homo sapiens
gggcccccatgttttctgagatcagggatgagggacaggtcactgtctacatcaacagaggaaatgtgagtacaatactgggcaatgtgcggatgggtgtsggggagggacatttgtccagccagcagtggccgagcacccctctgggccggcactgggggcaatgttacccagaggagatgaaaatatgtgatatctgtc

SEQ ID NO: 19769 - DNA, 201 bp, Homo sapiens
tactctgaggtgtggagaaggctagagaagagtagaagataaggtgaagaggcagggcaggaagctgatggcttctgccttgactgggaagtacagacctrggtcccctcctgacagggaagtggggagaagaggttggcctggggacacagtaaagcatggtattatggtaacttctacataattggtctctagttctag

SEQ ID NO: 19770 - DNA, 201 bp, Homo sapiens
agagggtctgccccctttctgctgatgtgccgccccacctatcttgagattcccccaaaacacgaggatgtcaggatgctgagtggccaaaaataacaacygttcattatacaaacccttatatccttaattacgtcttccattaactggttatccgattaaaactggccactcacatggatttattttgttcaaaggtcg

SEQ ID NO: 19771 - DNA, 201 bp, Homo sapiens
cccaaaagtataatttttgggttatatgacaattctatgtttaattattttgagaaatgttcatattgttttccaagcagccactcgattttacgttcctmccaacagtgcacaagggtttcaatttctccacattcttgacaattcttgtcttctgtttttttgatagttgccatcctaatagtcatgaagtgggaaaaa

SEQ ID NO: 19772 - DNA, 201 bp, Homo sapiens
tgctggctccacgcacagctggcatacactgacatggctgtggtttgcttctctctccttccttgcccctagagtataagaagaagtacggagaggaacayggctcctgccaggctgggatagcgggcttcttcaccgaggtgggtgtctgctgtctgggcatttctgttctcttgtgggtgttcatttccttgcttatat

SEQ ID NO: 19773 - DNA, 201 bp, Homo sapiens
taaacccaaaagtataatttttgggttatatgacaattctatgtttaattattttgagaaatgttcatattgttttccaagcagccactcgattttacgtycctaccaacagtgcacaagggtttcaatttctccacattcttgacaattcttgtcttctgtttttttgatagttgccatcctaatagtcatgaagtggga

SEQ ID NO: 19774 - DNA, 201 bp, Homo sapiens
cagtctcccctgcccccaggagtgtggctggcccactctgccctcaggaagtttgcttccctcagattagctccggggcaggtcctgtgtcagggtgatargcacacggtgctctcccattgaaggtcacaggaagcgatcagagaggcctctgaaagatttctgggcttttcttcatccaaaaacaatacttggagttga

SEQ ID NO: 19775 - DNA, 201 bp, Homo sapiens
actttgtctctgaatttggatactctagacacctcatgtaagttgaatcatacagtatgtgcccttttgtgactggcttgtttcacttagcataatgtccdcaaggtgtatccatattgtagcatctgtcagaattttcttcctttttaaaggaaggaatatttaataatattccattgtatgtgtgtgccccacatttat

SEQ ID NO: 19776 - DNA, 201 bp, Homo sapiens
gctgtggtttgcttctctctccttccttgcccctagagtataagaagaagtacggagaggaacacggctcctgccaggctgggatagcgggcttcttcacygaggtgggtgtctgctgtctgggcatttctgttctcttgtgggtgttcatttccttgcttatatgattttggcaacccttagaggtgggacttctggagt

SEQ ID NO: 19777 - DNA, 201 bp, Homo sapiens
gggaacaaatgtctctttgagttcctgctttcagttcactgggtaataaacccaaaagtataatttttgggttatatgacaattctatgtttaattatttkgagaaatgttcatattgttttccaagcagccactcgattttacgttcctaccaacagtgcacaagggtttcaatttctccacattcttgacaattcttgt

SEQ ID NO: 19778 - DNA, 201 bp, Homo sapiens
ttcccgtggttcctggcaacattgtatttctattaagagtttgactactttagatcttatgtgagtggagtgtggtgttcgtccttttgtgacgaacttayttcatttagcataatgtcctcaaggttcatcatgttgtagcatgtgaccggatctccttcctttttaaaggcagaataatatttcattgtatgaattcac

SEQ ID NO: 19779 - DNA, 201 bp, Homo sapiens
atccgttctgaataccatgacttggcaagtgaagcattcccatgccttccagactcctggctctgcctgtgtgaaacgtactccatttccagagccagctrccgagctttttcccctgggctgactttccaccaccctgacctgcgattcctctctgctaaccctcctctcaccgttctccccagggtgggctgtgggcct

SEQ ID NO: 19780 - DNA, 201 bp, Homo sapiens
aaaagagctccttcagctgcaaagaacacagaggtcaggaggaataaagctaatgagagagcagagagtcctttgtctccccaggtgttattcccagaggscaactagggaaaatggagatggggtataaacatctgaattcactgttaaacactccatgaactgttgataattccctagaagcagcatattcctgaggta

SEQ ID NO: 19781 - DNA, 201 bp, Homo sapiens
atttcagggtcctctgtgcttatttgtttctgaattgacccagtgaggtagtcatctaccctgtccagcatcttgctagcctggacatactttccacagtkaacctatctctcattcctgcaagtctgtcagtggcacagatgtggactttctttagtgaaaagcatcttggaacctttactgacatttttagatttaagc

SEQ ID NO: 19782 - DNA, 201 bp, Homo sapiens
gccaggctgggatagcgggcttcttcaccgaggtgggtgtctgctgtctgggcatttctgttctcttgtgggtgttcatttccttgcttatatgattttgrcaacccttagaggtgggacttctggagtcccagatacttgagcctcgagggagcagattctggtcctcacaccagaggaggctatttctacctgccagga

SEQ ID NO: 19783 - DNA, 201 bp, Homo sapiens
cctgaggggctcaggggaggaattcccactgatttgcaagaaaggaattggccactgtgtactcgtttgccactcaatcctgccctaaccttcctctcctrtctttctcacagactgtttttgaaaggaattgccgttcagaggactgtgccgcagacctgcagcttcagggtaaactgctgctctccaggtatgtcggtg

SEQ ID NO: 19784 - DNA, 201 bp, Homo sapiens
cctgttactgctttcatcatcacctctcactctcattttctaataagcctgaaaagcatgatggagtcataaatcatgtctgtaaaatgaagatgtgtagrctttggtaagatctcacatgtgatgttaataacaataccttacatatctggcctcacacttcacttaaactgtcccatttaatccctgaagtggtctcat

SEQ ID NO: 19785 - DNA, 201 bp, Homo sapiens
taaggactacaatccttagtttcctacctactcaaggttatgttttgtagatgctaacagtgtacattctagagaaaatcagctggagggaggaaaatggyacagttctaaaattctttaagcctcgtttaattttttacctgttactgctttcatcatcacctctcactctcattttctaataagcctgaaaagcatgat

SEQ ID NO: 19786 - DNA, 201 bp, Homo sapiens
gtctttccctttgtttcttcgagggagcttgagtggcaggattattattaagagtactttttaagttcccaacaattagataggaaatgaactgaatgggrgttcacattttatcttcaggaaaatgaccgcaagaaggccttactgtggggtggttaagagcatggcctggctttggaatgcctggattgggaatccttg

SEQ ID NO: 19787 - DNA, 201 bp, Homo sapiens
tttcagcggaatccaaaccatgtgacatggaccattatcattcagctgccacctcctggatcctgccctgtaaacatgcccaggggtctctgaggatggaygcgtgtcattcacacaccaagtgtgttagagacaacagaaaaccttgtttttttcctgtgttctggtgaaagtcttttctgtctttccctttgtttcttc

SEQ ID NO: 19788 - DNA, 201 bp, Homo sapiens
atgtatttagggggtacaagtgcagacttcttatatgaatatattgtatcgtgatgaaatctgggcttttagtgtacccaatagtgaacatggtacccaayaggtaacttttcaaccctcacccccctcccacattttggagtctccaatgtctgttaattccactctttatgcctatgggtacccattacttagctccca

SEQ ID NO: 19789 - DNA, 201 bp, Homo sapiens
tggtgtgtcttgcactatagtttcattcagctcatggggtctgaatttcctttttatgtttcattttttcaagagttacaattgggtgtttagtctctagrgtcagtgggatggatatgctttttgccagacttttcacatttaatatgtaactgtttgtttaggttgagacattttgatcctttttgccgttgtgctatt

SEQ ID NO: 19790 - DNA, 201 bp, Homo sapiens
ctaccttcctgtttctttgagggtttaaccaaaggtggcatttaagtgtaagctccttgcatgacaggcaagctgggtagatgtaggtggggacaccacargacaccttgcctgtggagcccctcctgccccacaggtagaatgttgaatgcactagttctctgctatctgtttccacgacagaagccaggctgcccttct

SEQ ID NO: 19791 - DNA, 201 bp, Homo sapiens
tgtagatcagatgccttctgtggaatgccaggcctagatttgctctacacaattaaacagctttatttatcctcaactctttgtgaacatgtcaatatcartatccaaatatctggctctaactgcttggaaaccacagcacacatcttgcgtgtgttgattactggcaaactccatcatttcccaccatccaccatgatc

SEQ ID NO: 19792 - DNA, 201 bp, Homo sapiens
agaccccagcaattgttgcctgtcgtgttttcattaattgttgcctctctaatggatcattcccattagcttgcaaatatgctatgataattcccatcttrataaaaaagagcaaaaaaactccctggagcccacttcccccaccagctaccatccaatttctctgttctcctttagagaaaaactcctccaaatagttgt

SEQ ID NO: 19793 - DNA, 201 bp, Homo sapiens
gggttggggtagcctaactcttaagcctaaggtaggggttggggtagcctaactcttaagcctaactcttaagctatttgcttttggccaagaaccttccrtaatgtgccataaaaatattttataatttcctgcgggtgctgggaagcactgttcattctgtctcttcatctgtacaccctgcatttgtacctccagtca

SEQ ID NO: 19794 - DNA, 201 bp, Homo sapiens
taattattcccattgttctggcctgtctgccatattggacaaaattgatccttcctttcttgagactgtcctctgtgaccatgtggatgactcctctctcrattttcctcttccttctctagccatgcttttccagtcttgttggctgacacctcctcatcttcaactcctaaatgtgagtcctcatttctatctatactc

SEQ ID NO: 19795 - DNA, 201 bp, Homo sapiens
aattcctcttattctgtatttaggttattcccagtttctatattaagtaaaattgtgagaaatgtcttttatggagattagtaccagtaaatgatcatatycttagctctataacttttcagagggtgtgaagtcacatttttgaccacctactatacaccagggactttttgcatctcgtccgcatcccctcttcactgc

SEQ ID NO: 19796 - DNA, 201 bp, Homo sapiens
cataggctattacctcttccagtttggatttccccaaaagcataccctgatacaatgatacaggtacaggtagtttatttgggggtgggcgatctcagtgktgagtttagacaggaaagagaggaaagacaggaaggcgtgcatttataagcaggttactgccgtaggcaccttgggcttgtcttcctcagaccctccaag

SEQ ID NO: 19797 - DNA, 201 bp, Homo sapiens
gcaactcaggcagaaagatgtgggaagcctttgacctggaggggcatggcttcaggtgaccagaactgtggctggttctggggaatgtgagcgaggtgctrgccacatctgctatagtaaccatgagagcttcctgaaaagtagttatttactgataaactactcaagaatacaaaagtagttgaataaaaagtgtgccac

SEQ ID NO: 19798 - DNA, 201 bp, Homo sapiens
taatgtatgtaaggtatataaaatgatgttttgatgtacatttacatagtgaaatggctactatggtcaagcaaatgaacatatccattgcctaacatagkttttttttttttttgatagtaagagcacttggaatctactttattgtcaaatttccagtatataatacaatattgtcaacatagtcatcacgctatacat

SEQ ID NO: 19799 - DNA, 201 bp, Homo sapiens
catttttgtttaatgaactactatgtccttaaatctcagcttagggagcccgtgtgcaggctcctcacctggctgcacaggatctgtccacagaatagatrgatggatggatggatgggtgggtgggtggctgaatggttagataggtaggtaggtagatgactggctgggtgactgggtggatgagtgggtggatagtta

SEQ ID NO: 19800 - DNA, 201 bp, Homo sapiens
gggtgtttctcctcaactccactcactttaagcagcatctctggcagtagctacttctcctccaccgtcttagctccctcttggcagtcccagtcccagtyacaatcacaacacctcctccctcagtccctccaactctaagggtgtcagcagttgcttctgatctcagcttttccttatcttaccttgtttgctcttctg

SEQ ID NO: 19801 - DNA, 201 bp, Homo sapiens
tgggcgcaccaaaggcagattccaaatacagcccttcagtgaagtctcctggggctgtgtttaagtgccgtgttcacaccaaccctgaccggagatgcacmgaactggacatggctcgaggtgggtgaccattactgctgtggtggaaatgggttctgtacccttataccttgctcttcttcttcccaggatggcctgatc

SEQ ID NO: 19802 - DNA, 201 bp, Homo sapiens
tggctgaatggttagataggtaggtaggtagatgactggctgggtgactgggtggatgagtgggtggatagttatgtggataggtgagtggggatggctgrctgggtggatgagtgggtatgtgggtggatgggcaggtgagtggatgactggctgggtggatgggtgtgtgagtggatggctggctgggtggatgagtgg

SEQ ID NO: 19803 - DNA, 201 bp, Homo sapiens
atgactaataaacacgttttcacgtgcccctcagccattgggacacttattttagcctgttcaagtcttctgcactcccttcttctggggatacttttctyctcctgtgctgtggtacactcctcaccccaattcttctcactcgccactccttttctgcttcctttgttggggtctccttatcttgccaacctttcaaca

SEQ ID NO: 19804 - DNA, 201 bp, Homo sapiens
aagatgagaagacactactattcatgcctggtcagaaagcacagactggctatgtaacagccccagcagggaagcactgggtgcaagacactggattaaaytgagacaaatgtttgcttctcagaatggcagtgaccatgggtgcttgactgtgggtggggatgacagatttcatgctttcctctttcagaatcatgtctc

SEQ ID NO: 19805 - DNA, 201 bp, Homo sapiens
ggacgcaggcgtggtgagtagcctcccaagcatgctggacaaggaggctctaggaagtcaaagacaatgtgcctgggaaggccacaggtacaagccattgrccactgtagctggccatgggaaaaatgggagcacatcattttgatctctttgccattgaattccagcaacctttgaaacctttgtcacaaggaaccctag

SEQ ID NO: 19806 - DNA, 201 bp, Homo sapiens
gtggaatgagtcagtttatttggctggtgaaggaggaacctaggttggagcagggatgagagggtagaagagagcaaaggaggaggggcaggagagaaccyggtaggatggaaagaggctgcccatgttgaacaaagggccagtaacatttctggtggcagggagatgtcaggacattttagaaatctgatgcctgctgtt

SEQ ID NO: 19807 - DNA, 201 bp, Homo sapiens
ctatttggctattgtgtatcattctttaaatatctggctgggttcaacttgctaagattttatttagtatatttgtatctatagtcataaacaagatttcyctgtaattttctttcttgtcaggttttggtgtcagatttctgctagtgtttgcaaaaataagcagaaagcttgcacttttctctgttctctgaagacata

SEQ ID NO: 19808 - DNA, 201 bp, Homo sapiens
ctgggagacaggctgggcgcttcctgcggcagtcggcagtgaggaagtggtggagaaacgcagatgtccatttcaaatcacaaggcggcttcagtattccrccgcggggctcagctttcacgtatatgaaaagcttcatttgtgtattcactgcgtttggaaggaaggctatgttttgctttagaaatgtcaacagagctg

SEQ ID NO: 19809 - DNA, 201 bp, Homo sapiens
  misc_feature (1)...(201): n = A,T,C or G, or insertion/deletion polymorphism (see Tables 1-2)
ttcctgaaatgtgtccgcaggccaggctggaggactatgcctctgcatatgtacctgtcctgtttgtattcttcaaaaatggtgctgcagacagttttatngcctgtgccatacttgccactgtccatagagccctggtgacagcactggtggctgtaagccactctgatgtttcctttatcctcaacccagatggctgct

SEQ ID NO: 19810 - DNA, 201 bp, Homo sapiens
tttctctgtaattttctttcttgtcaggttttggtgtcagatttctgctagtgtttgcaaaaataagcagaaagcttgcacttttctctgttctctgaagrcatacaaccaacatagttgcaacagcaggcagtgagagctgacccttactgagagcttgtttatgtgccagaggctgctcaacactttttattaacgtgt

SEQ ID NO: 19811 - DNA, 201 bp, Homo sapiens
aaatatttcattatctgtggaaggaaaacatttttggtatgcatgtcaagtgctcagataacatatttatgtatcgctttttcactaaagagaatctgacsgcatctggaaattcttttgtgtcactgcctctctcagactacttcccatctgtatcgctttaactccaataaaaggccatccccatgcctgggaaatggg

SEQ ID NO: 19812 - DNA, 201 bp, Homo sapiens
tgcaaaaataagcagaaagcttgcacttttctctgttctctgaagacatacaaccaacatagttgcaacagcaggcagtgagagctgacccttactgagascttgtttatgtgccagaggctgctcaacactttttattaacgtgtttaaccctcacagcaacccagtgaggtatgtgcagttaccatctcagttttcctg

SEQ ID NO: 19813 - DNA, 201 bp, Homo sapiens
tggccctaaactttcttttctttttcttttgcattttcttctttctgcacatgtatgaatgcaagctgaatagtcaagttcctgaaatgggtcaggattakgtttgccttaaatctttttctcaacagaagccaaacacttaaaagaagggagatggctgattgaattctggaacaaaagttacattcctaggctcttggt

SEQ ID NO: 19814 - DNA, 201 bp, Homo sapiens
ggggaacaaatgtctctttgagttcctgctttcagttcactgggtaataaacccaaaagtataatttttgggttatatgacaattctatgtttaattattktgagaaatgttcatattgttttccaagcagccactcgattttacgttcctaccaacagtgcacaagggtttcaatttctccacattcttgacaattcttg

SEQ ID NO: 19815 - DNA, 201 bp, Homo sapiens
tggctactgtgaatagtgctgctatgaacatgggggaacaaatgtctctttgagttcctgctttcagttcactgggtaataaacccaaaagtataattttygggttatatgacaattctatgtttaattattttgagaaatgttcatattgttttccaagcagccactcgattttacgttcctaccaacagtgcacaaggg

SEQ ID NO: 19816 - DNA, 201 bp, Homo sapiens
gttgccttgtcctcagctcagtttctgtgaactgtgggttgtttctctcttccttgagttgcaagagatcagtacttccggatcagtacttctgcagtgasatgaaactttggaggagtaaagttggtgtttgtaaattatctagcacagtgcttggcacacgttgcaggttgaatttatttgcttttccttacttaccct

SEQ ID NO: 19817 - DNA, 201 bp, Homo sapiens
agaatgaagattaattttgatacacataagaatgagaactattctagaactctcaaaaagggcaaacgagtaatagtgtctgtgtatgttcatttgacacrtgcttattatgtatccacatgtgccaggcactggagatatagtcctgccctcatggagcttctaaagggagttacaaagagtttctactattttggcctt

SEQ ID NO: 19818 - DNA, 201 bp, Homo sapiens
ggcagtaggggagatcatcacctctgtaatggtataatatgaactcaggagttgagattcgtaaagcagtaaggaatgcatagtcagctatactggaaatwtgggaaagggaaatggactatgtgggaaagcgggactcttatccttgcagaagtcactatgaaatgaggctttcagtaaacagaagatgggcatttcatc

SEQ ID NO: 19819 - DNA, 201 bp, Homo sapiens
agtaggggagatcatcacctctgtaatggtataatatgaactcaggagttgagattcgtaaagcagtaaggaatgcatagtcagctatactggaaatttgrgaaagggaaatggactatgtgggaaagcgggactcttatccttgcagaagtcactatgaaatgaggctttcagtaaacagaagatgggcatttcatcctt

SEQ ID NO: 19820 - DNA, 201 bp, Homo sapiens
attgtgtatcattctttaaatatctggctgggttcaacttgctaagattttatttagtatatttgtatctatagtcataaacaagatttctctgtaatttyctttcttgtcaggttttggtgtcagatttctgctagtgtttgcaaaaataagcagaaagcttgcacttttctctgttctctgaagacatacaaccaacat

SEQ ID NO: 19821 - DNA, 201 bp, Homo sapiens
gtgagtggtggggctgggattcaggcacaggcaggctggtacttaatctctctcctacaaataccagcttccttggtgagtattggggctggggttcaggsacaggcaggctgactccagtgtgctctaatgcatcttctttgcataaagaggcttatttacatgtcttttggggtatgctggctgctcacgtggctttgt

SEQ ID NO: 19822 - DNA, 201 bp, Homo sapiens
gttccatgtaaacgacacctccacagaatataatgtgagtggtgtccctggagatgtacagctctatggccctggagtcaaggtaaagcctcattttaatwttttgccctggagccgtttggcacaaaggactttggctcttcttgcctttgtcaaacagccatgaatttgtttggacagcagttgttgaatgcctgctaa

SEQ ID NO: 19823 - DNA, 201 bp, Homo sapiens
gcccaacctgttttcctaagccaggaaatggactcgacaaactcaaaagaatcaaaagatacaaatttaagaggaagaaaaatcactaattagtgaagtcygcttcctattcaatcaggagttttacagctcaccagattacctctcatccttaaagtctgtctggtcctcaggttactgtttagtaacagaattgatgta

SEQ ID NO: 19824 - DNA, 201 bp, Homo sapiens
gcaggcggatcatctgagatcaggagttcaagaccaacatggcgaaacgctgtctctactaaaaaatataaaaattagccagtcgtggtggtaggctcttrtaatcccagctacttgggaactgaggcaggagaatcacttgaaacccggaggcggaggttgcagtgagccaagatcatgccactctgctccagcctgggc

SEQ ID NO: 19825 - DNA, 201 bp, Homo sapiens
tgggaagtagtgatgcctgtcttccctcagaagcacactgataaccccaatatacccacaattcacacttttttccttctctgaggtatgctgttttttgkcaaaacagaaaaaacacactactaggatatgaaaaacttcattctgggcctggttaggtcataaactacagaaccttaggtcatatattctcaccgggcg

SEQ ID NO: 19826 - DNA, 201 bp, Homo sapiens
acagaaccttaggtcatatattctcaccgggcgcttgtttctccactgcaaaaaataattcgtatttgcttggtcctttgtagtactttactgtttataartgtagtacatttatcttcatgatgacccttaaatttaagtaaggtagtattatgctcattttatagaagaaattcaatctcaaagaggatacagtctccc

SEQ ID NO: 19827 - DNA, 201 bp, Homo sapiens
tttatagaagaaattcaatctcaaagaggatacagtctcccaaagatcccacaagcagtaatatattaggcagagctaaactcacacactgtcactcaatwtcctaatattggtacatgccatgctaataagtgtgctaaaatggatgaagcggcaatttctcaggtcccttccaatgatcctgtcctctgcttctacttg

SEQ ID NO: 19828 - DNA, 201 bp, Homo sapiens
cagggagctcaatatatattaagagtatgcgctcagccaggcgcggtggctcacacctgtaatcctagcactttgggaggccaaggcgggtggaccacaargtcaggagatcgagaccatcctggctaacgtggtgtaaccctgtctctactaaaaaatacaaaaaaaaaaaaaaaatgagctgggtgtggtggcgggcgc

SEQ ID NO: 19829 - DNA, 201 bp, Homo sapiens
aactgtatgctttaattaaaaagctgacagttgaacctccagggaaataaacattttattttctcattttatcaattgttgaagttcagatggtcaggtaraaatgagtgtgatggagtcttgattttccacgggcgtccctttggatggagtccttgctttctgatcacaaaactggtagcaaatagaaagataagaact

SEQ ID NO: 19830 - DNA, 201 bp, Homo sapiens
tgatttgcatttctgtaatgaccaatgatgatgagcattttttcttatatttgttggccgcataaatgtcttcttttgagaagtgtctgttcatatctttygcctactttttgatggggttgttttttttcttgtaaatttgttttagttctttgtagattctggatattagccctttgtcagatggatagattgcaaaaa

SEQ ID NO: 19831 - DNA, 201 bp, Homo sapiens
tctcttttcacaaagcaaaagaccatcattcttcagaaggatctcccaaagaatgccattgaaaactcctcattaccttcaaatggggtgatgcacacacragtagcatgaaattagccatgttcatattaaggagcaatctaagatcattattgctgtttctctggccttatattaaatagtgtcattgcaattgaaaaa

SEQ ID NO: 19832 - DNA, 201 bp, Homo sapiens
acaccagggcagagaggcagcaaccgcaatcaaaagaactaataccagagggtgcagtaacaaggccaacagaaggcttctgaataagcaagactgatgtyttcagagcaatgcaaaaagacagtgtttccatgaaacagaataaactagagatttgtaaattcaagatattgatcattcaaatgaaacttcaatataagc

SEQ ID NO: 19833 - DNA, 201 bp, Homo sapiens
taaagtttttagactgaaagagatacctaaagacatgcataaaaatgttggtagcaaccttgttcatattaaccccagcctggaaacaacctaaatgcccrgcaacagaataaacatatgacatatttatataacggatattactcaataataaaaagaaactactactgtactcaacgatgtggatgaatgtcacagatg

SEQ ID NO: 19834 - DNA, 201 bp, Homo sapiens
aagtagagctgggtttgtaaccaggtctgactccaaagttcacgtggttcccattgtgctgaattgcacactgctcctgaaagtgctgcccactccctaawcaccagaggcaggctcagtcaataggacagacagatgatgagtagacccccaagaatcacccaccagaggaggagcatcaacaccagggcagagaggcag

SEQ ID NO: 19835 - DNA, 201 bp, Homo sapiens
atgaggcacaatgtgtgtgaattattggaggagcactctcaggagaagaggggcgagggagcagggaggggcaggggatgggctgggagggatgtgctgtygggtcaaagctagccttggtctgatttatgggctgggaagaggtggggaagccctggagcataaatcactctgcagaattgtccccccttgaagctgctg

SEQ ID NO: 19836 - DNA, 201 bp, Homo sapiens
gagttctcaccaagtgtaatagtctatgagtaaattcctatgcatgtaaaaagaaaagttttagcaggaagaagacaaaatgctgaaagagaatatggtartttcaaagtttgagatttttagatgcatgttagaagtgtttctattttgttgaaatttcccgtcattcagtagttcactttacttcaagttgtgaccttc

SEQ ID NO: 19837 - DNA, 201 bp, Homo sapiens
cctgggaagtgaaaaagaaaagtggttccctgctcattgtcatagttctggtttaaaagttttatagaatgaaatacttgcccaacatgagaggtttagartgttctggtaaaccacagtgttaataagtggaagctaatggaaatagctaacaggttttctacacgtagaatcccttgtgtagatgaaaaaaaaaaatca

SEQ ID NO: 19838 - DNA, 201 bp, Homo sapiens
tatctggtcttagtgggttctgtacaatcccattaagttgaaggaataaacctgtagttggagaaataacagtgtgacttctccaagactgattggctgayttttggaccctctttgtcccatttctagtcaggaattatgtcttctactgttccacaacccacaaaagaagatgtctgttccacttctggcctaagcaat

SEQ ID NO: 19839 - DNA, 201 bp, Homo sapiens
gttcagaaaattatttagaagggttcaagtaacacagaccatgtaatgaagagggtatgagtgttgaaagaaggaaaagaagaacaggggttgcacagaakataccaaatgttcttatcaccctctggggaacaaaagaaagaaatctgagggtatgcagcttatccttccagttgtttctctgaaggtaatttttacagt

SEQ ID NO: 19840 - DNA, 201 bp, Homo sapiens
tgtccatggacactttgggttgtgtctacccttggctactgtgaatagtgctgctatgaacatgggggaacaaatgtctctttgagttcctgctttcagtwcactgggtaataaacccaaaagtataatttttgggttatatgacaattctatgtttaattattttgagaaatgttcatattgttttccaagcagccactc

SEQ ID NO: 19841 - DNA, 201 bp, Homo sapiens
cagggcatctcgtcccactggtgcctaccgtctgagcactgctctgaaggactcgattgccccgtggagcctgctcccacacacctgccttttgtgcagcyggcccatctgttggtgctttttctttcaggaggagatgggcatctcctgtgagctgctggaatcggacttcctcaaatgcagcgtgggatttcctttcat

SEQ ID NO: 19842 - DNA, 201 bp, Homo sapiens
gaggttagcttctaactcatcaggtctagggtggggcctgagaatctgcatttctaacagtgagcatgtccagggaccacactttgagtagcaagaccttsacagcttcaagttgcaaaccagttttgaatgagcagagtagaagggggtttgcaggtgagaaggaactcttcaccatgagtacatttctatgaagatttc

SEQ ID NO: 19843 - DNA, 201 bp, Homo sapiens
tcaaggactgcaggaggggtgtgctttccatccactttctatattctaaaaattaccgctggattaagcccagtcaagagagaaccaagtatctgtatggwtcaagtatcgctggccacacacacagtatcttttacagaatcgcatgtgctgtgatgccatctccctgtgcagggtgggttggtaggtgggggaaagggg

SEQ ID NO: 19844 - DNA, 201 bp, Homo sapiens
agagccaccaacagtagaggcactccaaaactttccaagaagtcatctcagattccctgctgcttcatagcttttaggagctccagggttgagggaggccmcaaaagcaatcaaggactgcaggaggggtgtgctttccatccactttctatattctaaaaattaccgctggattaagcccagtcaagagagaaccaagta

SEQ ID NO: 19845 - DNA, 201 bp, Homo sapiens
gcacatattctgtggcctcaatagtgttgacaggtttgtgccaagcctgcccagcttaggggacagctgaaatgctcagagccaccaacagtagaggcacyccaaaactttccaagaagtcatctcagattccctgctgcttcatagcttttaggagctccagggttgagggaggccacaaaagcaatcaaggactgcagg

SEQ ID NO: 19846 - DNA, 201 bp, Homo sapiens
catccaaatgggttttcccagccatcttctggtgcatttctaacatacccttaaaaggcataaaaaagtggcatagatgatggctggaaagattaagttcyttctggtggcttctttaattttggaataaccagccttccttcaacccccttacatgcattagaaacttctgaactgtttttgttctgtttttaattaggt

SEQ ID NO: 19847 - DNA, 201 bp, Homo sapiens
cattttgctgaaattgcagtgagagggaaggtaccaggtagagaacctctagattttatgagcttgcttccctgactccattccaggtgatcttgatccamaaatgacgaggctgggtggttgccattggtgtcacacccacatcccttgctgtgcaggtgcactgctcccagctgctgtgctggctgctagctgctcaca

SEQ ID NO: 19848 - DNA, 201 bp, Homo sapiens
cctcaggtgaacaagaaggctgccctgtggctcttcacggatgaaaagccaaaggcagctgtggcttcgctttgtccccagtagtcactggccacggtgakacctgggtttaacatgacctgcccataaatcagtttgctgcaattgcagtgagagggaaggtaccttgtagaaaacctctagattttatgagcttgtttc

SEQ ID NO: 19849 - DNA, 201 bp, Homo sapiens
tcccaagtttgttctgagccacctgatataacctcaggtgaacaagaaggctgccctgtggctcttcacggatgaaaagccaaaggcagctgtggcttcgstttgtccccagtagtcactggccacggtgagacctgggtttaacatgacctgcccataaatcagtttgctgcaattgcagtgagagggaaggtaccttgt

SEQ ID NO: 19850 - DNA, 201 bp, Homo sapiens
ggagcatgcacacatgtcctgtgattctttatatcttttatttttatgccatggtacaagttgtgctttacagagcatttgggtgaataactagaaatatrccatagattcttgaggctttgcctggttcactaatgacaggctccagggcgtttctcagggagcgtgttagcatgtttctaggaccagccacatcagcca

SEQ ID NO: 19851 - DNA, 201 bp, Homo sapiens
ctttacagagcatttgggtgaataactagaaatatgccatagattcttgaggctttgcctggttcactaatgacaggctccagggcgtttctcagggagcrtgttagcatgtttctaggaccagccacatcagccagacctggctctgtacagacccaaacctgagaatgccatgtgagacctgtgtgactgcagaatcaa

SEQ ID NO: 19852 - DNA, 201 bp, Homo sapiens
aggtgccaattacatgttgaatttcatcttcaacccaactctacttacctttcagggagtgatgagtagggggcgagaggggaaaatgcagaaagtgttgyttgaggcccacagaaactataaagatgaagaacaggagaaacgtagttaatcatgccctggaaagctggcctgcagaaagaaaaggaatttatctctgag

SEQ ID NO: 19853 - DNA, 201 bp, Homo sapiens
cttacctttcagggagtgatgagtagggggcgagaggggaaaatgcagaaagtgttgtttgaggcccacagaaactataaagatgaagaacaggagaaacstagttaatcatgccctggaaagctggcctgcagaaagaaaaggaatttatctctgagaaggccttcagaaagaaaatgagtaggctccggagacgttcat

SEQ ID NO: 19854 - DNA, 201 bp, Homo sapiens
ctcaaccagagaggcatctttcaacatggcaagcaagattactccaaaaaaatgccacttaccattcctttggtgtactgcttctagaggcaaagtttacygcttttactgtcatgaaatagactgtgacttgttatttatcatttatgtgaccaattatagttacaatcatgttccatgtgacaatagaatctttccccc

SEQ ID NO: 19855 - DNA, 201 bp, Homo sapiens
tactgccattgtgatcatattctcaggccttgtggagacatgggcattgccagctgttacagtaggcatatttgcattgatcagaacataaaagtttccakaaacacagaagtgaatcaaatagtgtggtttaggttcacccactgcctcagactggaagctggcttctggccactccatgacaccagcttggcaacctca

SEQ ID NO: 19856 - DNA, 201 bp, Homo sapiens
gtgtgtgagccctccagccagggtccgcaccaggccatcagccatcccttcactggccagagctcctgccttccccagctcagcctgctacgaccctcacrgccactcccccaaaaccagcagacttctcctcctcctcagtcaatcttctcctttcacaccacctcctttcttactgaaagcgtggatctaacctgggga

SEQ ID NO: 19857 - DNA, 201 bp, Homo sapiens
tctcaggccccattctagactctaattcagaatctgcattttaatagagttcctcatgtgattcttatacacagtaaaatttgagaagcactggtggaggkcccaaattctgtaaagttacctattaacttacggaaggctgataagttataaatgactcttgccagtaaagataaaaatgatttctgtttgactgaaaat

SEQ ID NO: 19858 - DNA, 201 bp, Homo sapiens
tcctcaataataaattaaataaatctttgccacgtattcactatatatttgtatgagaatcatgtttttaactttttgaaaattatgctttgacaaccagstttctgtcatcatttttaatagttctgtggtattctattttgtgattgaccatagtttacttatctattgccctaatgttagacacttaggatattgcta

SEQ ID NO: 19859 - DNA, 201 bp, Homo sapiens
aaaaaagcataaactgacacagacaatattcaataagtgttagagagggatggaagccaggccctaaaaaggttaaataagcagtgctaggcattataacrtcagtattgtgcccagtcactgcttgggcttgagcaaggggctggaccagtgggcttcagcgatcagtgaggcttcttgacagaggattgaactaggttt

SEQ ID NO: 19860 - DNA, 201 bp, Homo sapiens
ccaaaagaatcaggtcagaaccttaaagctcatactcagcacccaaggtggcagctgcacagagcagaaataatggcccaaaagttgagagagccgtgggyctggctgctcaggagaccgcagccaggacacacctcctctctgggtctcccttttctgatctgcaaaatgataaaataaacagtcttaggggttacttgt

SEQ ID NO: 19861 - DNA, 201 bp, Homo sapiens
tctggtttatccacttgtctgtccatggacactttgggttgtgtctacccttggctactgtgaatagtgctgctatgaacatgggggaacaaatgtctctktgagttcctgctttcagttcactgggtaataaacccaaaagtataatttttgggttatatgacaattctatgtttaattattttgagaaatgttcatatt

SEQ ID NO: 19862 - DNA, 201 bp, Homo sapiens
cagagcactggggcaagtacaggtggtccacactcatcagattctgggatgtgcggctgtgtagagaagctttagtgcgatgggtgtatcactcgtatgargtaggagtgagcctgtgcctgattttgtgcagcagcgctggccagctctgaggcgtgcagcactgagtgcggtgcaggaatatgcaaggaatctgcaatc

SEQ ID NO: 19863 - DNA, 201 bp, Homo sapiens
gcttcacaatgtcctttttggtatgatttccatgattgagaaaactggggattgtatgtgtagtacatctggtttatccacttgtctgtccatggacactktgggttgtgtctacccttggctactgtgaatagtgctgctatgaacatgggggaacaaatgtctctttgagttcctgctttcagttcactgggtaataaa

SEQ ID NO: 19864 - DNA, 201 bp, Homo sapiens
ggcttgagctcctggcctcaagttgatccacccgccttggtctcccaaagtgctggaattacaggtgtgatccaccatacccaacctatttattttatttwattttattttggacggggtcttgctctgtcacccaggctggagcgcagtggcacagttacagctcacttcagcctcgatatcccatgctcaaatgatcct

SEQ ID NO: 19865 - DNA, 201 bp, Homo sapiens
aggtttaatggactcacagttccatgtggctggggaggcctcacaatcatggtagaaagcaaagacatgtcttacatgggtggcagcaggcaagagagagracttgtgctggggaactcctcattataaaaccattagatcacatgagacttattcactttcatgaagacagcacaggaaatacctgtccccatgattcag

SEQ ID NO: 19866 - DNA, 201 bp, Homo sapiens
ggagggaggagggtctcaaattaaaaagacaagaaacaaacaatctccccaaataagcagaaagtctgagcgtggaactgagctggttggagctggggagsgggtgcgggaggtactttcagcactccctcgtgagatcatggaacagggcaggaaatctgaacctgctgccaaagaaaactcgctttgccttttgtaaaa

SEQ ID NO: 19867 - DNA, 201 bp, Homo sapiens
tgctgatagacactgagactgggtaaattacacagaaaaagaggtttaatggactcacagttccatgtggctggggaggcctcacaatcatggtagaaagsaaagacatgtcttacatgggtggcagcaggcaagagagagaacttgtgctggggaactcctcattataaaaccattagatcacatgagacttattcactt

SEQ ID NO: 19868 - DNA, 201 bp, Homo sapiens
ttaggtcagttctgaggctcccccagatgtgggacactcctcacggacaagttcagtgttgtatttacttttctggatttattttcacaaatattcagctyagaatgtgccagggaggggaggaacatacctcctatgcggcaggagctgtattgggcacagccacgagtgtcatcccagggaactcatgtgagccctgtg

SEQ ID NO: 19869 - DNA, 201 bp, Homo sapiens
attagtccatttttacactgctgatagacactgagactgggtaaattacacagaaaaagaggtttaatggactcacagttccatgtggctggggaggcctyacaatcatggtagaaagcaaagacatgtcttacatgggtggcagcaggcaagagagagaacttgtgctggggaactcctcattataaaaccattagatca

SEQ ID NO: 19870 - DNA, 201 bp, Homo sapiens
gggtcaccaggcagtcaaggcggagcaggcctgaggcatccttgcaacattagaaccagaacaacatttcattcttttatgttaaacggactctcctgccyggacccaggcccacgttagcatccagagtggcatgcagtggcagaattggagctggaacagccctcatttgttgtcttctctccttgggaaatcttcctg

SEQ ID NO: 19871 - DNA, 201 bp, Homo sapiens
gagaggctgtcaatcagtgcatcatcccctgctcccacagtggatgattggcactttgtcctgcagggaaacgtacctcttggaatgactatatctgagargtgaaggagctggagtgtttgtaccccaattcctgagattcactggttgagggctactctgggttaggtgggtggggacagttagctccctggcacttgc

SEQ ID NO: 19872 - DNA, 201 bp, Homo sapiens
ggcattataacatcagtattgtgcccagtcactgcttgggcttgagcaaggggctggaccagtgggcttcagcgatcagtgaggcttcttgacagaggatygaactaggtttagaaaagactttcccaaaggggaatggacattccaaagagatggcaaagcttggagaaagacctgtggttggccagcctgtctggagcc

SEQ ID NO: 19873 - DNA, 201 bp, Homo sapiens
acctgcaggcataatggagggtggtgagtgctgcgcagtaactgctctggaaactgagaagaaggtgccatgagtccccctcccttgcccccaaggaggasggaggattaaaaggtcacagagaacagtgtggtagatgagagcagctttcaggctgacagctgtgggcagcaatcctgactctcacacttgcctgacatg

SEQ ID NO: 19874 - DNA, 201 bp, Homo sapiens
tgctgcgcagtaactgctctggaaactgagaagaaggtgccatgagtccccctcccttgcccccaaggaggagggaggattaaaaggtcacagagaacagygtggtagatgagagcagctttcaggctgacagctgtgggcagcaatcctgactctcacacttgcctgacatgaggccttaagggggctgcttaccttctg

SEQ ID NO: 19875 - DNA, 201 bp, Homo sapiens
tgttaatgggcatattgctggctcagttgatacctcatgatggcatgaggtttaaatcagggagagccgtgaagtatgacacaaggagagtcattagaaargcagaggacatcatgcttctctctcgattctttgagcaccctggctgtgtgctgctttctgagcaagtctctgcttggggctgcagtctcctgccatgga

SEQ ID NO: 19876 - DNA, 201 bp, Homo sapiens
agatagtggtaccacacagtgagtgctaggtgggttactccagggctctggagcagcttccaagaggtggtgttgagaggaatgaggactcacgcattccdagcagagggaaaatgtgagcagaagtatggagaacaggactcccatgaagatctgcaggtgtctggaatgaaggaggcagtcaggagaacacagtgagag

SEQ ID NO: 19877 - DNA, 201 bp, Homo sapiens
aaattatggaagtattggacttgagcaaacttttgacaaatagcgctctctttctctcttgggcgtatgcgtgtgtgcatgcatgtactccagctctctgkgtatgttacacacacacacgtttttcgcataaaacatttttattttgggccaggtgtggtggctcacgcctgtaatcccagcactttgggatgctgaggc

SEQ ID NO: 19878 - DNA, 201 bp, Homo sapiens
gctaggaagacctgttctttatttattgacttgcatttattgagaactgttgggaataatattgtgcctctagggcatttagaagataacatgcttttttytggttcttgcaaattactttcggtgacttgttctcatgggttgcttattttgagtttttatttttagagaactgatattttttctgttcttgatgaggta

SEQ ID NO: 19879 - DNA, 201 bp, Homo sapiens
aatcccagctactctggaggctgagacaggagaattgtttgaatctggtaggcggaggttgcagtgagccaagattgtgccactgcactccagcctaggasaccgagcaagactccatctaaaaaaaaaaaaaaaaaatctttattttgaaataatagcagtcttacaaaaaagtcattaggatagcacaaagaaataccg

SEQ ID NO: 19880 - DNA, 201 bp, Homo sapiens
aacaagacactctactgccatctgttggaaaacagttataataaacttatacacatacatgatatctgtgatgtgagtggtatcccccagccccttaaatrcagtgtagcacctgcactactgtacctacaactccctagccatgagagtgcattatgttttaagaaatggtcttcagactctaaaaaaaggaagacatac

SEQ ID NO: 19881 - DNA, 201 bp, Homo sapiens
aaataccgtaaattcttcacccagattccctaaatgtcatttgctttgtaattttctatctattcgtacttcttacctgtttgagagtaagtcggagacgygatgcccccttatccctaacatcagggatatttcctgagaacaaggacattcttttacgtaaccatagcacaattattgaaataaggaaattaagtgata

SEQ ID NO: 19882 - DNA, 201 bp, Homo sapiens
aacaggtgcgtgccaccacacccagctaatttttgtatttttagtagagctggggtttcactatgttggccaggctggtcttaaactcttgacctcaggcracctgcccgccttggcctgccaaagtgctgggattacaggcgtgagccaccacactggcctacttttttttttttttttttcctgctgagggatcttgtc

SEQ ID NO: 19883 - DNA, 201 bp, Homo sapiens
gattgaagctcagaacacaagactcttgccagttgttctaagaaagcttctgctctttcccagtcattcaaactgcaccaccttatcgacttcccctcacrgtgaatgctcaggatctccttggcaacgtgggtgaagatacctgctggctctcttgacagttctcgtctttggcttggccaataaaccccctttagggaa

SEQ ID NO: 19884 - DNA, 201 bp, Homo sapiens
tcagagcagagagccacgaatggggcactcggggccgtgacaggcatcccttagctctggccttctggttgtgggcagactctgctgtgtccggcagcccmtccagcgttggatggcatcagcaacctgaaagccctttcttaggctgaaccagagtctacctccatgtaatcacacactcccctcctatttctgccccgg

SEQ ID NO: 19885 - DNA, 201 bp, Homo sapiens
cgacttcccctcacggtgaatgctcaggatctccttggcaacgtgggtgaagatacctgctggctctcttgacagttctcgtctttggcttggccaataawccccctttagggaagtagaaagatggtggcaacagacagctcctcagctccacctgccttcccttcttcaggggagcttatgaccatcagggtggctgtg

SEQ ID NO: 19886 - DNA, 201 bp, Homo sapiens
ggataagtgctggggctcctatggtgggtgtgctgcagtcttcagcagagcttggctacagaggagaaagatctaaactggaccaatttcatatggtcatkgcctctggcttgtggctgatcatcttgttctttggaattgactgtctcatgaaatagtgagtttcttgtcaccagagagatttaagcaagagccatggaa

SEQ ID NO: 19887 - DNA, 201 bp, Homo sapiens; identical to SEQ ID NO: 2062

SEQ ID NO: 19888 - DNA, 201 bp, Homo sapiens
ttcattttgttatgagagatttcagttacaacagtgtgaggtgggtggtcaggaaacattccccctgggctcactttttgcttagaaaagtcctgatggaraggttgaggtgggaagagagtgagggggaagactccatggagcatgacaggcatgctgtgcctgccacagccaagcatggaggtcccaaccataatgtgt

SEQ ID NO: 19889 - DNA, 201 bp, Homo sapiens
ccccctcccttgcccccaaggaggagggaggattaaaaggtcacagagaacagtgtggtagatgagagcagctttcaggctgacagctgtgggcagcaatsctgactctcacacttgcctgacatgaggccttaagggggctgcttaccttctgtgaccctcagtttcttcctctgtaaaaaggagaccatcacctccagt

SEQ ID NO: 19890 - DNA, 201 bp, Homo sapiens
tgagggcatgctgcccctagttatgatattgctcctaggaagaataaaatctgcttcacaatgtcctttttggtatgatttccatgattgagaaaactggsgattgtatgtgtagtacatctggtttatccacttgtctgtccatggacactttgggttgtgtctacccttggctactgtgaatagtgctgctatgaacat

SEQ ID NO: 19891 - DNA, 201 bp, Homo sapiens
aaagtcctgatggagaggttgaggtgggaagagagtgagggggaagactccatggagcatgacaggcatgctgtgcctgccacagccaagcatggaggtcycaaccataatgtgtttttgagacaggatctggctctatcgcccaggctggaatgcagtggtgcaatcttggctcactgcaacctccgcctcccaggctca

SEQ ID NO: 19892 - DNA, 201 bp, Homo sapiens
gggaagcattgtttgtgatttcacattgcaggggctatttacatgtatgatttgcatcattgattttatgatacattgttgagagtatctgtgattttttkggaagctgaatccttactgagggcatgctgcccctagttatgatattgctcctaggaagaataaaatctgcttcacaatgtcctttttggtatgatttcc

SEQ ID NO: 19893 - DNA, 201 bp, Homo sapiens
ctccctaaacatctctatctccaacctcggagatgatgcctatgatgccaacgtgtccttcaatgtttcccgggagctcttcttcatcaacatgtggcagmaggtaaggagggcatccctgtaaaaagagcagttgttccatctggtgcgcttgctgactttcattattgcctggaataggcaatgattctacaagcacta

SEQ ID NO: 19894 - DNA, 201 bp, Homo sapiens
tattttgagaaatgttcatattgttttccaagcagccactcgattttacgttcctaccaacagtgcacaagggtttcaatttctccacattcttgacaatycttgtcttctgtttttttgatagttgccatcctaatagtcatgaagtgggaaaaaatagtttttaaaaagtaacagatggataaacaactaagagaaaga

SEQ ID NO: 19895 - DNA, 201 bp, Homo sapiens
catgtcaaaacctagtagcttaaaacaacattgattagccctcatagtgggttggggattccagagtggttctggctcgaggtctcttatgagactgcagycaggatgttggctggggatgcagttgtctgaaggctccactggaggatctgcttcccttgtggcccctcgcttggctggctgttggccacaggccacaga

SEQ ID NO: 19896 - DNA, 201 bp, Homo sapiens
tattagttatctgttgctgtgtcacaaatcacatgtcaaaacctagtagcttaaaacaacattgattagccctcatagtgggttggggattccagagtggytctggctcgaggtctcttatgagactgcagtcaggatgttggctggggatgcagttgtctgaaggctccactggaggatctgcttcccttgtggcccctc

SEQ ID NO: 19897 - DNA, 201 bp, Homo sapiens
agtagggaggtgaaacaatggtagggaggtgaagttatataggcaggaggcagtgaatgaaaagtgagctgttaaaccaactactacagtgggcaatgggscttattcctgcagggcaacactaggaagagtaagggagctgggggttttatactcctttccccaagtgtcaagaattgaggtctcctggggctatttata

SEQ ID NO: 19898 - DNA, 201 bp, Homo sapiens
atagcagccctaacacccactgtattagttatctgttgctgtgtcacaaatcacatgtcaaaacctagtagcttaaaacaacattgattagccctcatagygggttggggattccagagtggttctggctcgaggtctcttatgagactgcagtcaggatgttggctggggatgcagttgtctgaaggctccactggagga

SEQ ID NO: 19899 - DNA, 201 bp, Homo sapiens
gtgatgggagtagctgcgaagtcaaaactgcaagggatgtagttaaagggagggttggagagtgggcgtttttgcaaactatctaccccaacctctgagcrgtaggtataattatcccagtggttctcaaccaagggtaattttgtctcctaagacacagttcacaacttttggagaaatttttggtttccacaactagtt

SEQ ID NO: 19900 - DNA, 201 bp, Homo sapiens
taacactgccctcaccaaagatgcaagcctggtatctcaaccagagaggcatctttcaacatggcaagcaagattactccaaaaaaatgccacttaccatwcctttggtgtactgcttctagaggcaaagtttactgcttttactgtcatgaaatagactgtgacttgttatttatcatttatgtgaccaattatagttac

SEQ ID NO: 19901 - DNA, 201 bp, Homo sapiens
caatcagttctctggcaggagggtaggggtgccctgatttgtttgccaaatactcccaccatagcccatttcaaactgccattgcaatgtcactaggtacrgagttaggaagagatgcacagttgcctctcatgagctgatatgagccagttccacataccactgggtttcaggaaaagttgggaaaacttgcctcattgg

SEQ ID NO: 19902 - DNA, 201 bp, Homo sapiens
aaagatgcaagcctggtatctcaaccagagaggcatctttcaacatggcaagcaagattactccaaaaaaatgccacttaccattcctttggtgtactgcytctagaggcaaagtttactgcttttactgtcatgaaatagactgtgacttgttatttatcatttatgtgaccaattatagttacaatcatgttccatgtg

SEQ ID NO: 19903 - DNA, 201 bp, Homo sapiens
agaggtgtcccaacctgaatcaaggggctggctgcacccagaggagatgtaaacgttttattctcaattcctgctggcgtaatggctccagtagctcaggrcagtcctctaaaggacaaccacagatgcatcctcagccaggggagacacagggaaatgatgcaaaagaaatgatgcaaaggatctgagcagaacactgcc

SEQ ID NO: 19904 - DNA, 201 bp, Homo sapiens
gccaggggagacacagggaaatgatgcaaaagaaatgatgcaaaggatctgagcagaacactgcccctccccaccccctgaatgtgtgagtgctgagttayggccttcagtatccaagctctctgtttgacagtagatatattgtcagatgcactgtgctgcttagttttgagtgcagtgtgattttctgaaagggcaatg

SEQ ID NO: 19905 - DNA, 201 bp, Homo sapiens
attgtcacttggagcctttagtagacaaaaggcagaaagtgagcatcatttcagaaatgctttagtatgcacacttttagctgatattttgatatatagartaataatatacacagtggagaatattcaaagagtggctgaagggagaatacagagccagtagggccaaaatgaaacttctaggatgtcttctgaattttc

SEQ ID NO: 19906 - DNA, 201 bp, Homo sapiens
gcaatcttggctcactgcaacctccgcctcccaggctcaagccatcctccctcagcctcccgagtacctgggactacaggcgcaccaccaccatgcctgcmtaattttttgcattttttgcagaggcaggggtttcgccatgttgctcaggctggtgtcgaactcaagtgatccacctacctcggcctcccaaagtgctgg

SEQ ID NO: 19907 - DNA, 201 bp, Homo sapiens
gaaggaaactctgacagccagacttctcagtcggaaagtgtctttggtgagccttactatgtgactggctgattcactttgtccgctaagtcttgggagargtgatgtaaccagggactgcaacttctagggaaaggggaaaaatcactgttggccccaccctctagcattggaagcttaacagggctttggcccacagca

SEQ ID NO: 19908 - DNA, 201 bp, Homo sapiens
attgaacaaaataatgtgtgaaggaaaacccagcgagagggatgaagagcagagtgtgctgggctacataggctaaactaagaagtttggattttatttayagtgctctgggaagcagggaagtgacctgatattgtagatattttcaaaaaatcactctgggcctgtggagtgaatggaggacaggagctggagtggaag

SEQ ID NO: 19909 - DNA, 201 bp, Homo sapiens
gggctgccttttaacttacgggtcacctggttattgcctgtgaggctcactgaggaaatgtcttgctggcaaagctgagttcgctcagaatgtggactgtkccatttttctgttgtccaacacttgctttgtttgtgacatttagctccttttcttcctttccatcccaaatccacaccctttcttctgtcttttgcaaaa

SEQ ID NO: 19910 - DNA, 201 bp, Homo sapiens
tcagggtggctcagatgcaggaagtcctcgcctctgctgtcctgctctgccccaccctgtcctgcagaggggaggccctgcccatgggagagtctgcctcyactgggcagtgctggcctggaggaaacttccatgccacccctcctgcccctgggctccagggctctcgatttttggggtaaacagaggtgctgggctctg

SEQ ID NO: 19911 - DNA, 201 bp, Homo sapiens
ctcttctgtgttgggtattgtctctctaagctgcggggaaagggaaggcagcagattggtgtcctggcccatccacttcaggtgagaaggatgcctgctgwcctcgtgtggacacaacttcctctgctctccttggccttgccttggcctctttgctttaggatatgatgcccagaagggctcgaaactggagtctgacca

SEQ ID NO: 19912 - DNA, 201 bp, Homo sapiens
ccactacagcctccaactcctgggctcaagcagtcctccttcctcagcttcccaagtagctgggactacaggcatgtaccattgcacccagctaaattttwaaaaattaagtcttgttgaagagtgagtagaaaccagagtggtgataatttctggttctccctagtcatctccctcaagaatttcccagttacttctcct

SEQ ID NO: 19913 - DNA, 201 bp, Homo sapiens
gattaaaaagagctcaaatgaagggaagataattctaggcagaagaaagagcatgttcaaaggctgtgtgagtgaagaggtgggagagtgtgctgaaaggkgggcagaagcctctctgccctgggggaggggatggtgccagggagctctaattgtattttgctggcactggggagccatggaaatttctgtaggaaggga

SEQ ID NO: 19914 - DNA, 201 bp, Homo sapiens
acatggagaaaatgtcatgagggaggaaatgctgggatttgccttgacctctggctgggggacggggagggatgagaggtccaaggcaagatggataagtrggaataagcagccttgttttggggaaaaagagggacagacctagaatggctggctgggtgaaatggcttgttgtgtctcctaaattagattttacatttt

SEQ ID NO: 19915 - DNA, 201 bp, Homo sapiens
agattctggatattagccctttgtcagatgagtagattgcaaaaattttctcccattctgtaggttgcctgttcactctgatggtagtttcttttgctgtkcagaagctctttagttcaattagatcccatttgtcaattttggctgttgttgccattgcttttggtgttttagacatgaagtccttgcccatgcctatgt

SEQ ID NO: 19916 - DNA, 201 bp, Homo sapiens
agaggggtgattgtgaactcagcagggagaacccagatcctctactcctgatcatgctctagcgcacagagcactgtaagctcgtgaggaatgtgcttcgyacctggcatcggttggccataagtcactgaatttggctaataagatgttgcattgtctctgatctccttgagagactgagatagatggataggccctagg

SEQ ID NO: 19917 - DNA, 201 bp, Homo sapiens
catgtcaccagggcatgtggtggtggaggtggggcaacccttgcccaggccagccatccagacgtctttgatacctcctaccactggctacagtgggcttyattttcctcccccttggcctcacttctgcagacacatgactttgttagaagcaagggaaaaaagttaggaagatctaggttttgttctaggagttgccag

SEQ ID NO: 19918 - DNA, 201 bp, Homo sapiens
aggctggtctcaaactcctgatttcaagtgatctgccctacttggcctccctaggattacagacgtgagccaccacgcctggccaataatcttggtgtccyctattctgcagaaccatgaaagggacgtgacatggacagaaagatgcctctggccctctgtagctaatggagggtgggtgagtgggggctgggttggggg

SEQ ID NO: 19919 - DNA, 201 bp, Homo sapiens
gatttaatgatgcggaggtgtttttgagaggctctgagaattcagagaaaaagaacaaagcaataaaaaaggatgacatgaggactatattgtggaaggtrgaaactggaaaacagcaaagagaaaatggttccagaataattggaacagaagccattccttagacagcaaaggaggatctccatttcctgaaatgggtgc

SEQ ID NO: 19920 - DNA, 201 bp, Homo sapiens
gcaggtggagacacagggcaggggatctggaggaacatcagtggggtctgcgacaacctgtgaccacctcacagacaaggtgacttctggcttctcagtgmctcagccacacttctctttttcactcactcttctttctggtcctcactaagacaaaatacagaatacagagcagcagttcacgggctatagcatttgagg

SEQ ID NO: 19921 - DNA, 201 bp, Homo sapiens
ttggtttccacaactagttcagcgctattagcatctagtgggtatgccagggatgctgctaaataccccacaatgcacaggacagctccccacacaacaargaattatccaacaatgcacaggacagctccccacacaacaaggaattatccaacaatgcacaggacagctccccacacaacaaggaattatccaacaatg

SEQ ID NO: 19922 - DNA, 201 bp, Homo sapiens
aattttttgtatttttattagagacggagtttcaccatgttggccaggctggtctcaaacgcctgacctcaggtgatccacccacctcagcctcccaaatkgctgggattacagtcgtgagccactgagcccggtcaaaatcccttcttacctgtcatttgtattctccccattctgtgtctgacatcttgtaggtgtttg

SEQ ID NO: 19923 - DNA, 201 bp, Homo sapiens
tagccagttttcccagcaccatttattaaatagggaatcctttccccattgcttgttttcgtcaggtttgtcaaagatcagatagttgtagatatgcggcrttatttctgagggctctgttctgttccattgatctatatctctgttttggtaccagtaccatgctgttttggttactgtagccttgtagtatagtttgaa

SEQ ID NO: 19924 - DNA, 201 bp, Homo sapiens
tttccttctaacagtcaggaccctcagctgcaggtctgttggagtttgccagaggtccactccagaccctgtttgcctgggtatcagcagcggaggctgcmgaacagtggatattggtgaacagcaaatgtagctgcctgatcattcctctggaagttttgtctcagaggagtacctggccgtgtgaggtgtcagtctgcc

SEQ ID NO: 19925 - DNA, 201 bp, Homo sapiens
gtgaacagcaaatgtagctgcctgatcattcctctggaagttttgtctcagaggagtacctggccgtgtgaggtgtcagtctgcccctactcggggatgcytcccagttaggctactcgggggccagggacccacttgaggaggcagtctgtccattctcagatctcaagctgcctgctgggagaaccactactctcttca

SEQ ID NO: 19926 - DNA, 201 bp, Homo sapiens
cgatggtgggcgcccctcccccagccttgctgctgccttgcagtttgatctcagactgctgtgctagcaatgagcaaggctccgtgggcgtaggactctcygagctaggcacgggatataatctcctcgtgtgctgtttgctaagactgttggaaaagcgcagtattagggtaggagtgacccgattttccaggtgccatc

SEQ ID NO: 19927 - DNA, 201 bp, Homo sapiens
ggtgatgcctcgccctgcttcggctcacgcttggtgtgctgcacccactgtcctgcacccactgtctgacactccccagtgaggtgaacccagtacctcarttggaaatgcagaaatcgcccgtcttctgtgtcactcatgctgggagcagtagactggagctgttcctatttggccgtcttcgctgttatttttaagaat

SEQ ID NO: 19928 - DNA, 201 bp, Homo sapiens
ggctcacgcttggtgtgctgcacccactgtcctgcacccactgtctgacactccccagtgaggtgaacccagtacctcagttggaaatgcagaaatcgccygtcttctgtgtcactcatgctgggagcagtagactggagctgttcctatttggccgtcttcgctgttatttttaagaataaattttaaaaggacaaagta

SEQ ID NO: 19929 - DNA, 201 bp, Homo sapiens
ccatacccacagacctgccatccctggccctgcctggatgccggtacctggccactgctgctatattccatgcttttggacaagagcatgttcagtattgyccaggagacccagggagctcaagacagagctgagatccagttcctacagccacagttaacaccccagcccccgacacacacacagacttttcaatgcaaa

SEQ ID NO: 19930 - DNA, 201 bp, Homo sapiens
ttagttccctgataactttatatatttttaatttttttaaatgaacctggcatttcaaacataagttccatgataattttaaacaggggtgtgtgtgtgtrtgtgtgtgtgtgtgtgtctgtgtgtgtgtgtgtgtgtgtgtccagcttttcgagttgtccgtgggaggacggtttcagtaagttactctatcattactgg

SEQ ID NO: 19931 - DNA, 201 bp, Homo sapiens
agttccctgataactttatatatttttaatttttttaaatgaacctggcatttcaaacataagttccatgataattttaaacaggggtgtgtgtgtgtatrtgtgtgtgtgtgtgtctgtgtgtgtgtgtgtgtgtgtgtccagcttttcgagttgtccgtgggaggacggtttcagtaagttactctatcattactggaa

SEQ ID NO: 19932 - DNA, 201 bp, Homo sapiens
tcttttaaaagagtcttcaagctgatgaaaattttaaagtagcttataacattttaactgtgatcttatttattatgagtatagagataaaggaaaaggcmtcccacttctgaagatttctcgtttctaggagtgtctacaagattatcataggtgaaagtagggttggatgcagagaaatagtaagaaaggatggaggat

SEQ ID NO: 19933 - DNA, 201 bp, Homo sapiens
ggatgagagggtagaagagagcaaaggaggaggggcaggagagaacccggtaggatggaaagaggctgcccatgttgaacaaagggccagtaacatttctkgtggcagggagatgtcaggacattttagaaatctgatgcctgctgttacaggcctgtcaggactttaccactcataggttctaagaaatctcccctcccc

SEQ ID NO: 19934 - DNA, 201 bp, Homo sapiens
ctttggctcttcttgcctttgtcaaacagccatgaatttgtttggacagcagttgttgaatgcctgctaaatgctagggactgttccagccacaaggagamacaaagatctagtccctgctcccagggagctcatggcctattggggccaaaggcatgtcagtaagcaattaaagcacaaggtgccagctgctctacagag

SEQ ID NO: 19935 - DNA, 201 bp, Homo sapiens
gggtcgtggtggtctaggagaccagtgatggtccctggctttgacttgttcttttgagaggtttctcatcctctcccctctatgaggcttggtagcctttycagaggagagccttggaagcatgtgcctctgggtctgcagtgatgctggatcacactgcacctgatgcctttctcagtggtctactacaaattagctcat

SEQ ID NO: 19936 - DNA, 201 bp, Homo sapiens
atgtggaaaaagcccttgccatctctatcctccaacacagagctttggtgtccgagacacatccaagtgacaggcccaagagggcctctgaatgaagacgkatgagccgtgtggacacagccacactatgttttcgtgaaggcataagaccatgggccaactttctgggcatccagggctggctgcagaggctggagtgag

SEQ ID NO: 19937 - DNA, 201 bp, Homo sapiens
actggaaatttgggaaagggaaatggactatgtgggaaagcgggactcttatccttgcagaagtcactatgaaatgaggctttcagtaaacagaagatggrcatttcatcctttctcattactgagccttcctcaagacctccttaacatcctaacattataaatacaataattttagaaattacttagtcaataaaaaat

SEQ ID NO: 19938 - DNA, 201 bp, Homo sapiens
tgttccccttcctgtgtccatgtgttctcattgttcaattcccacctatgagtgagaacatgcagtgtttggtttttttgtccttgcgatagtttgctgaraatgatggtttccagtttcatccatgtccctacaaaggacacgaagtcatcattttttatggctgcatagtattccatggtgtatatgtgccacattttc

SEQ ID NO: 19939 - DNA, 201 bp, Homo sapiens
atgtgccacattttcttaatccagtctatcgttgttggacatttaggttggttccaagtctttgctattgtgaatagtgctgctataaacatacatgtgcrtgtgtctttatagcagcatgatttataatcctttgggtatatacccagtaatgggatggctgggtcaaatggcatttctggttctagatccctgaggaat

SEQ ID NO: 19940 - DNA, 201 bp, Homo sapiens
tgggtcaaatggcatttctggttctagatccctgaggaatcgccatattgacttccacaatggttgaactagttgacagtcccaccaacagtgtaaaagtsttcctatttctccacatcctctccagcacctgttgtttcctgactttttaatgatcaccattctaactggtgtgagatggtatctcattgtggttttgat

SEQ ID NO: 19941 - DNA, 201 bp, Homo sapiens
ttctggatattagccctttgtcagatgagtaggttgcagaaattttctcccattctgtaggttgcctgttcactctgatggtagtttcttttgctgtgcakaagctctttagtttaattagatcccatttatcaattttggcttatgttgccattgcttttggtgatttagacatgaagtccttgcccatgcctatgtcct

SEQ ID NO: 19942 - DNA, 201 bp, Homo sapiens
ccccagagagttgactcctaattaattgctagttggtctcagctgctgaaacagagggtatggaactaaatgaaacaatcatgggaagtcctggctggtcygtgtgctgggaagggagcaatgctgtccttggactggtcacctgaaggtcctttatccctcctcctcagctgagcataccaatggtgatgacagaggccc

SEQ ID NO: 19943 - DNA, 201 bp, Homo sapiens
tagaacctggagcagacccagacaacccaccgacctctgacttacagaactgtgagataatagatttgtgttattttgagcagctgaactccggtaacttrttactgcagcaatagaaaataatagacacacaatacagcccacacctccagaaccccggggcttctttcctccctgggctctctggggaaggagcacagg

SEQ ID NO: 19944 - DNA, 201 bp, Homo sapiens
cttgtccccaaattaatgcttgaacaatcaacaaccaataatttctggtatccagggactcagacatgacaaccagaattagggaagctgcacttgtattrttaatgtggctttttaacccatagctgtttttttaccctcagatgtggccattggtgcacccaaggaggatgacttcgcaggggcggtctatatctatca

SEQ ID NO: 19945 - DNA, 201 bp, Homo sapiens
acttttttttttttttttttcctgctgagggatcttgtccccaaattaatgcttgaacaatcaacaaccaataatttctggtatccagggactcagacatracaaccagaattagggaagctgcacttgtattattaatgtggctttttaacccatagctgtttttttaccctcagatgtggccattggtgcacccaagga

SEQ ID NO: 19946 - DNA, 201 bp, Homo sapiens
ggagatcccctcagctgaggatggttctctagagaagaatgcagatgtgagccataagcagcctacacacacatcagccaggagatgggccacagttcacwgtgcccactacacatcaaaacacaccctctggggaatgctgccaagaggttttgatttaaaacacgaaccttctttcacaacacaagtgccccaggagag

SEQ ID NO: 19947 - DNA, 201 bp, Homo sapiens
agtgttagagtggggcatagagcttgcaaggctgtttcagccaggggtgggtgggggtgattttcaggcctaatgctgacaccactccactgagagaaagragcttgcttccgggtgcctgcaagagatgacagtgccttcaccttgttgttagcaagaattgcatacataaaaacttgagcacatgaaagccacatgtaa

SEQ ID NO: 19948 - DNA, 201 bp, Homo sapiens
cctccatccagcagaagcctgggtgagatgtactgccattgtgatcatattctcaggccttgtggagacatgggcattgccagctgttacagtaggcatayttgcattgatcagaacataaaagtttccagaaacacagaagtgaatcaaatagtgtggtttaggttcacccactgcctcagactggaagctggcttctgg

SEQ ID NO: 19949 - DNA, 201 bp, Homo sapiens
ccagctgttacagtaggcatatttgcattgatcagaacataaaagtttccagaaacacagaagtgaatcaaatagtgtggtttaggttcacccactgcctyagactggaagctggcttctggccactccatgacaccagcttggcaacctcaggtacgttaaattctacagaagcaggcagggtgccagtgtctggacctg

SEQ ID NO: 19950 - DNA, 201 bp, Homo sapiens
aagataggacacagatgcaaaagcagatcgctacagctggatctgggtaaaggtggcagtgacgcgtcggtgcagagaattcctgttttgaggaaagattmggagccagctaaggttttctgagggcccgtcatgtctcagactgtcacacttattcctctgtcatgtatgcttaagtctgttttagatgaccccttgtaa

SEQ ID NO: 19951 - DNA, 201 bp, Homo sapiens
aggcagctgcggctcagtccttctctgtcacccgctctccagagaatttacctgcagattaccctcaaaacatgagacaggttcagagcgaggtgggcggytggaatggagccttcacagacagcttgaccacacacagggagctcaggaagcagctttgttggaaaaatgcagggcacttaaactgccacaccaggaggg

SEQ ID NO: 19952 - DNA, 201 bp, Homo sapiens
ttacagtaggcatatttgcattgatcagaacataaaagtttccagaaacacagaagtgaatcaaatagtgtggtttaggttcacccactgcctcagactgsaagctggcttctggccactccatgacaccagcttggcaacctcaggtacgttaaattctacagaagcaggcagggtgccagtgtctggacctgtctcaaa

SEQ ID NO: 19953 - DNA, 201 bp, Homo sapiens
ggggctctcaagccatgattctttacttaaccttcatctataaaatgaaaacactgatagaatctatctcacaagatcattttgaggtaaatgcacatgtrcctaatgcatagtaaattctcagtagaaaataacattttatgtattttgcatgtttctcataaactgattgtgcattctaattatttagtttggaaaatg

SEQ ID NO: 19954 - DNA, 201 bp, Homo sapiens
gtgctcatcgctggaagaacatctactatgaagccgaccacatcctaccccatggcttctgctacatcatcccctccaacctccaggccaaaggcaggacrctgatcccttgctatgaaggtgagcatggattgatttttcctcatccccctacccacctcatgccctaagcccgccttcccacctctatgcaccaccagc

SEQ ID NO: 19955 - DNA, 201 bp, Homo sapiens
tcctgcctgctgaaggcttgctgttgttcaaggctcagtccacaggttttggacatcctcagtggcagctactgtcctaggccctggggatgccactgtcrtcttcctgacttcttggagcttgttccatgctgcctgactcctgctttggggatacttgtcaggcagaaccttgttggagtgactaattgggttagctgg

SEQ ID NO: 19956 - DNA, 201 bp, Homo sapiens
tgcctttcagttccttaggaaacaaattggccatttgcccaaagagactaatccaggactagaacacaggcactgagtttcaacctcaggctccccagtgygtgactcaggtctcttgattccatggtgtattgtttttttacctattaaacaattgcattcctagcctatggaaggtcttacctaagccaagactttggc

SEQ ID NO: 19957 - DNA, 201 bp, Homo sapiens
gtttttttacctattaaacaattgcattcctagcctatggaaggtcttacctaagccaagactttggcagggattggattgtgcagcccatttttgttaayagcattgcccaagttagggaaggccattaggttggctgagtattctggtattctattgctgcataacaaactctgaaatttagtagcttaaaataacatt

SEQ ID NO: 19958 - DNA, 201 bp, Homo sapiens
ttacatagtgaaatggctactatggtcaagcaaatgaacatatccattgcctaacatagtttttttttttttttgatagtaagagcacttggaatctactytattgtcaaatttccagtatataatacaatattgtcaacatagtcatcacgctatacattcaatctctaaattttttcatgctacctaaccaaaactttg

SEQ ID NO: 19959 - DNA, 201 bp, Homo sapiens
caccatccattaattaagcttcatggtgttcactcagtcacactgttgtcgctctcatttgccaatgttaaatagtgatgcacagtgcctaagacaaaatygctatcactgcaagctcctacccctggctaaatgctaatctggatttatgggacagtgacgagtgctattattttcattttataaatgaggaaactgagt

SEQ ID NO: 19960 - DNA, 201 bp, Homo sapiens
accaggaaatcagtggcagaattaaaatatgttatagtcaggaaagagcagaatcagcagaacagaaaattgatttaatgatgcggaggtgtttttgagargctctgagaattcagagaaaaagaacaaagcaataaaaaaggatgacatgaggactatattgtggaaggtagaaactggaaaacagcaaagagaaaatgg

SEQ ID NO: 19961 - DNA, 201 bp, Homo sapiens
acccctgcaccctttcccagtcagttcctctgcccttggtgagtgaacaactattctgacataggctttctcttgcccttgacttttatcagaagctgtaygaagatttttgttataaaagcgtaagctcaagaggggaaagtaatactagctgccgcttatggagggcttcatttgggtcacatgctgcaaagctgaggg

SEQ ID NO: 19962 - DNA, 201 bp, Homo sapiens
gagctcctggcctcaagttgatccacccgccttggtctcccaaagtgctggaattacaggtgtgatccaccatacccaacctatttattttattttatttwattttggacggggtcttgctctgtcacccaggctggagcgcagtggcacagttacagctcacttcagcctcgatatcccatgctcaaatgatcctcctgc

SEQ ID NO: 19963 - DNA, 201 bp, Homo sapiens
cccgccttggtctcccaaagtgctggaattacaggtgtgatccaccatacccaacctatttattttattttattttattttggacggggtcttgctctgtmacccaggctggagcgcagtggcacagttacagctcacttcagcctcgatatcccatgctcaaatgatcctcctgcctcagctccccaaatagctgggacg

SEQ ID NO: 19964 - DNA, 201 bp, Homo sapiens
tcccatttgtcaattttggcttttgttgccattgcttttggtgttttagacatgaagtccttgcctatgcctatgtcctgaatgatattgcctaggttttmttctagggtttttatggttttaggtctaacatctaagtttttaatctatcttgaattaatttttgtataaggtgtaaggaagagatcccgttttccatca

SEQ ID NO: 19965 - DNA, 201 bp, Homo sapiens
tttaattagatcccatttgtcaattttggcttttgttgccattgcttttggtgttttagacatgaagtccttgcctatgcctatgtcctgaatgatattgyctaggttttcttctagggtttttatggttttaggtctaacatctaagtttttaatctatcttgaattaatttttgtataaggtgtaaggaagagatcccg

SEQ ID NO: 19966 - DNA, 201 bp, Homo sapiens
gagtgctgcaataaacatatgtgtgcatgtgtctttatagtagaatgattcataatcctttgggtatgtatacccagtaatgggatggctgggtcaaatgrtatttctggttctaaatccttgaggaattgccacactgttttccacaatagttgaactaatttacactcccaccaacagtgtaaaagcattcctatttct

SEQ ID NO: 19967 - DNA, 201 bp, Homo sapiens
tcaaatggtatttctggttctaaatccttgaggaattgccacactgttttccacaatagttgaactaatttacactcccaccaacagtgtaaaagcattcytatttctccacatcctctccagcacctgttgttttcttgactttttaatgattgccattctaactggcgtgacatggtatctcattgtggttttgatttg

SEQ ID NO: 19968 - DNA, 201 bp, Homo sapiens
tgcagaagctctttagtttagttagatcccatttatcaattctggcttttgttgccattgcttttggtgttttagtcatgaagtctttgcccatgcctatrtcctgaatggtattgcctaggttttcttctagagtttttatggttttaggtcttacgtttaactctttaatccatcttgagttaatttttgtataaagtg

SEQ ID NO: 19969 - DNA, 201 bp, Homo sapiens
ggtccttcacatctcttgtaagttggattcctaggtattttattctgtttgtagcaattgtgaatgggagttcactcatgatttggctctctgtttgtctrttattggtgtacaggaatgcttgtgatttttgcacattgattttgtatcctgagactgctgaagttgcttatcagcttaaggagattttgggctgagact

SEQ ID NO: 19970 - DNA, 201 bp, Homo sapiens
ccttcacatctcttgtaagttggattcctaggtattttattctgtttgtagcaattgtgaatgggagttcactcatgatttggctctctgtttgtctattwttggtgtacaggaatgcttgtgatttttgcacattgattttgtatcctgagactgctgaagttgcttatcagcttaaggagattttgggctgagactatg

SEQ ID NO: 19971 - DNA, 201 bp, Homo sapiens
tttacttccaattacatggtcaattttagaataagtgtgatgaggtactgagaagaatgtatattctgctgatttggggtggaaagttctgtagatgtctrttaggtctgcttggtccagaactgagttcaagttctgaatatccttgttaattttctgtctcatgatctaatatttgacagtggagtgttaaagtctccc

SEQ ID NO: 19972 - DNA, 201 bp, Homo sapiens
aggagatgggcatctcctgtgagctgctggaatcggacttcctcaaatgcagcgtgggatttcctttcatgaggtcaaagtcaaaggtaagggacacagaygggacccttcctcagcagcaggcccccagcccttccaccagccactgattccgccgcctccctgaggtgaggagtcctcccaccccctgcctcccatagc

SEQ ID NO: 19973 - DNA, 201 bp, Homo sapiens
gaagaatgtatattctgctgatttggggtggaaagttctgtagatgtctgttaggtctgcttggtccagaactgagttcaagttctgaatatccttgttarttttctgtctcatgatctaatatttgacagtggagtgttaaagtctcccactattattgtgtgggagtctaagtctctttgtaggtctctaagaacttgc

SEQ ID NO: 19974 - DNA, 201 bp, Homo sapiens
taaagtctgttttatcagagactaggattgcaacccctactctcttttgctttccatttgcttggtaaatattctaccatccctttattttgagcctataygtgtctttgcacatgaaatgggtctcctgaatacagcacactgatgggtcttgactcttcatccaatttgccagtctgtgtcttttaattgggtcattta

SEQ ID NO: 19975 - DNA, 201 bp, Homo sapiens
gatggccagacacgagaaagccaagcagggattttcagttacaggtgagcatccgatctgcagccagggctttttctaccgggcacatctttgtgcgcagsctggtttgagctgatctgcacataaacaggcactctgggtgtggatgggggcatctgtgtactctttatggctatatttccagaatatgcttttaaagac

SEQ ID NO: 19976 - DNA, 201 bp, Homo sapiens
ggatggccagacacgagaaagccaagcagggattttcagttacaggtgagcatccgatctgcagccagggctttttctaccgggcacatctttgtgcgcascctggtttgagctgatctgcacataaacaggcactctgggtgtggatgggggcatctgtgtactctttatggctatatttccagaatatgcttttaaaga

SEQ ID NO: 19977 - DNA, 201 bp, Homo sapiens
cacactgggtcttgtttggagaatggacaggaaaggagcaggagagcaagcagagagtctgaggtgcaagaaatgccctgtcctcccagcagactggagcraattctaattctgcctctgctacttcattcctatgcaactttgggcaggtttcctaatctctctgcctctcaactgttcacccctcataaaatgaggaca

SEQ ID NO: 19978 - DNA, 201 bp, Homo sapiens
cccttttttttttttttttttttttaatggagacaagcagcaattaggtaggcttctaggtcaggtggccagttaggggtgccagggttcccaggtccagytttcttcgggtcatagagtgagggtgggaatcaagtcactcagatatttctcccgaattgaaatgcgtgtcttcctttggctgggcagatgaggtcccct

SEQ ID NO: 19979 - DNA, 201 bp, Homo sapiens
ggtaggcttctaggtcaggtggccagttaggggtgccagggttcccaggtccagctttcttcgggtcatagagtgagggtgggaatcaagtcactcagatwtttctcccgaattgaaatgcgtgtcttcctttggctgggcagatgaggtcccctcttctccatctctgctgctgggtcctggtgcaagcccttactctct

SEQ ID NO: 19980 - DNA, 201 bp, Homo sapiens
tttagtttgcaatttctgtagcctgttttcaaggttcttagcatccttgaattgggttagaacatgctcctttagctcagaggagtttgttattacccacyttctgaagcttacttctgtcaattcatcagactcattctccatccagttttgttcccttgctggtgaggagttgtgatcctttggaggagaagaggcatt

SEQ ID NO: 19981 - DNA, 201 bp, Homo sapiens
tcacggtgaatgctcaggatctccttggcaacgtgggtgaagatacctgctggctctcttgacagttctcgtctttggcttggccaataaaccccctttakggaagtagaaagatggtggcaacagacagctcctcagctccacctgccttcccttcttcaggggagcttatgaccatcagggtggctgtgatgcttccct

SEQ ID NO: 19982 - DNA, 201 bp, Homo sapiens
ctagtggaaaccagggtctgaatttggttggcaaaggcatagtggctccaagcagaggtaaactgctttggttatcattgagctctcttgattcattcttstctgggatggaatgtgccctcctttcttgttcaagccaggcaagtgctaggcactgggctgcagaagtgagcagtatgtgagccctgctctcctgctgtg

SEQ ID NO: 19983 - DNA, 201 bp, Homo sapiens
accactcaccttcccataggacaggtgttcttaacctggagtctatgtcctcttgctgatctgtgaacccggataaggaaatgattgcattttgttttcastaacttcacactgaaatttaacatcatattcaattatgaatgtaggaaacagactacagtaatattaccaggacctgtgactctgtcccaaatagaaatc

SEQ ID NO: 19984 - DNA, 201 bp, Homo sapiens
tattccattgcttgtgactatttatggccgtatttggttcctgagctagaaacagaaaagttatggccatgacagaattacttgtcaagggactatgatgrccctgctaacctgggctttcttgagctgtctgccccgctagctttgatgaaatgcacatacactgcttgcattttctgtgcaatggccaagtgtaacagg

SEQ ID NO: 19985 - DNA, 201 bp, Homo sapiens
gtaactcactcccagaggaagttaaaacatgtatacatacatatagaatgttctgtttaatattattggtttatgcagtatttgaatatataaatatgaayataaagccacgtacagttatggatttaaaacaaaagcagaacttaattaatgttgctgtttggatttttttcaagtgtatttgaatgcagacaagtatcc

SEQ ID NO: 19986 - DNA, 201 bp, Homo sapiens
aggctcccttgcagataagcttcttgggaagttcagccagtggcatcactggtgtgagattggagaaagggaggaggagaaaagtcagggtgtttctcctyaactccactcactttaagcagcatctctggcagtagctacttctcctccaccgtcttagctccctcttggcagtcccagtcccagtcacaatcacaacac

SEQ ID NO: 19987 - DNA, 201 bp, Homo sapiens
atttgagagtatgactccatgagttttgaccactgcatacgctgtgtgactaccaccccaccacaataaagaatacttctgtcaccccagatagtttcctygtgcctctgtctggtcatacccctctcctgatagacaaccactgttctgacttctatcaccatagatccatcttgcccattctagaatttcacattggtg

SEQ ID NO: 19988 - DNA, 201 bp, Homo sapiens
ctaatacatagtgggtttgaatcctggtactgccactagttactaaataagttattaagttgtctaccttatttagtcctcaatgtctttgcaaaatgggraggaggttggtctgtaatgaattctgagatcccttgaagctttgaaaatccgtgagtctctaaattttgatctcataatacatattcatgaaatgagtgt

SEQ ID NO: 19989 - DNA, 201 bp, Homo sapiens
tgcaaatatgctatgataattcccatcttaataaaaaagagcaaaaaaactccctggagcccacttcccccaccagctaccatccaatttctctgttctcytttagagaaaaactcctccaaatagttgtctgtcctcattgcttccatttgttctcctcctacatctctgaaactctctccagttaggctttcctcccat

SEQ ID NO: 19990 - DNA, 201 bp, Homo sapiens
gagggtcactgctttggcctgtgctttggattatttatttatttattttttgagacaagtctcgctctgtcacccaggctggagtgcagtgccacaatctyggctcactgcaacctccacctcctgagttcaagtgatcctcccacctcatcctcccgagtagctgggactacaggtgtgcacctggctaatttttgtatt

SEQ ID NO: 19991 - DNA, 201 bp, Homo sapiens
cctcagggtggcaggaaaaggaagggaaaagaaacagaaactacccttccaggactccagccacgctgcaaggttgataaacagcggatgtaaatggcatyacccagcaccgggtaggattctgacaggacccagtggctagtgaggggcaccaggagagcccccccaacctgcttaacaacccacaggcctaacaggacc

SEQ ID NO: 19992 - DNA, 201 bp, Homo sapiens
aatcttaaaatcaaaattgatggctttatttttctaaaaatgggaaaatatctccaaaacattgttcaaaaacaaaacaaaacaaaaaaaaaatgtttgtycttatatcccatcagtttattcaactaacattcactgtggactttttataaggcagtaactgttttatgaataggagatataaaactgggtgaaacagtg

SEQ ID NO: 19993 - DNA, 201 bp, Homo sapiens
ttttatagttctctgcctcatatcatttcagtctatttagaaacctgctattttagcacaaaacaatatcaaggagaggagtgaatgtggtttgcagcagraaaaataacaatagattgttttctgtagtttaatgtcatacgacaagaggcagaatgtgggcaagctcaggttttgagagtcattctgagtgtgtcctct

SEQ ID NO: 19994 - DNA, 201 bp, Homo sapiens
gagatgtgccatgatgagagtgatgatggtgatggtggcagacaagagcatgtcacatttagaaatactgtaactggttgctgaggttttacatatattcyttctgagcttgttttgtctaatattgcctgtgccaacagtattttaccagaattgaatgaaaagaaaggtaccagcagatttttttagatgttctaattg

SEQ ID NO: 19995 - DNA, 201 bp, Homo sapiens
gcagtatggagtgattatttacttagtgatatattttttatagttctctgcctcatatcatttcagtctatttagaaacctgctattttagcacaaaacartatcaaggagaggagtgaatgtggtttgcagcagaaaaaataacaatagattgttttctgtagtttaatgtcatacgacaagaggcagaatgtgggcaag

SEQ ID NO: 19996 - DNA, 201 bp, Homo sapiens
ccttgtaaggtttagccatgtatagtcatgtgccagtcacctagggctgagaaaggggagcaagcagagagggagaagaggaagaagccaaatgagatggktcgtaattgattagtggaagttaaatcatgttaaggataggaggcttgtcccctccatcatgatttagtatatcatccttcccaagagaagttttgagaa

SEQ ID NO: 19997 - DNA, 201 bp, Homo sapiens
tgatttacccacaaattagataacaataagtgattcaagtttgcgagccataagaattgagtcagaactttaaaaatcaattatttagcagtatggagtgrttatttacttagtgatatattttttatagttctctgcctcatatcatttcagtctatttagaaacctgctattttagcacaaaacaatatcaaggagagg

SEQ ID NO: 19998 - DNA, 201 bp, Homo sapiens
gatgactttgtccatggaatgcctggtgaatgagtgccagccctgggcaggccttccaggcacctctcaatgtctgcatatcttgggctgagtttgttatyaagacggctgcatttgggcagagcaatacacagatacctgtggtgggctaggtactgctgtcagaagtggtatcttctgtggtatttatctgctgctgtc

SEQ ID NO: 19999 - DNA, 201 bp, Homo sapiens
gaagtctcctggggctgtgtttaagtgccgtgttcacaccaaccctgaccggagatgcaccgaactggacatggctcgaggtgggtgaccattactgctgyggtggaaatgggttctgtacccttataccttgctcttcttcttcccaggatggcctgatcattcactcacccatccatccttccctccttccctccctcc

SEQ ID NO: 20000 - DNA, 201 bp, Homo sapiens
tggcaggaaaaggaagggaaaagaaacagaaactacccttccaggactccagccacgctgcaaggttgataaacagcggatgtaaatggcatcacccagcmccgggtaggattctgacaggacccagtggctagtgaggggcaccaggagagcccccccaacctgcttaacaacccacaggcctaacaggaccaacatggg

SEQ ID NO: 20001 - DNA, 201 bp, Homo sapiens
aacctgctagacaaattctaaaagagccataacactcagagcggggattttaacttcatcttctgcttcagggaccacattgttcccagtgtgtttaaacmcctggctggtttttcacttggggttctcattcagattcgtgattctgtttactgagagatgatgtcccagttactctagctctgtaacaaatgactccaa

SEQ ID NO: 20002 - DNA, 201 bp, Homo sapiens
caagaatataaaacatagaatgtatgtcagggggtgataactcttccttttaagccaaaaattatcagtcattgtcttaatgaaggattgagagagagagwgagtgtgtgtgtgtgtgtgtgtgtgtgtgtgtgtctacatactgtaaaaaaaaatagagacagtgttaaactgacatctcttaatttaatgagttgcttg

SEQ ID NO: 20003 - DNA, 201 bp, Homo sapiens
agaatataaaacatagaatgtatgtcagggggtgataactcttccttttaagccaaaaattatcagtcattgtcttaatgaaggattgagagagagagagwgtgtgtgtgtgtgtgtgtgtgtgtgtgtgtgtctacatactgtaaaaaaaaatagagacagtgttaaactgacatctcttaatttaatgagttgcttgta

SEQ ID NO: 20004 - DNA, 201 bp, Homo sapiens
ctgctcctgtgcctgttaagccatacagccccgccccgtcagtcttagattacattggcttgttggtgcctttggtggggtgtgaggctgcgcagtacagrctcgtatgcaaacactgtcaggcctttgaatgcctgtgattggtgtttttatacctgctggggacagggcatcttctctcgggcctcttcttgctaggtc

SEQ ID NO: 20005 - DNA, 201 bp, Homo sapiens
gtagttgggaatacaggcatgcaccaccacacctgggtaatttttgtattttctgtagagatgggggttttgccatgttgcccaggctggtcttgaactcytgagctcaagtgatccacccacctcagcctcccaaagtgctggagattacagagtgagccaccacacccggcctggaatgactttttattcattgattca

SEQ ID NO: 20006 - DNA, 201 bp, Homo sapiens
tgtattttctgtagagatgggggttttgccatgttgcccaggctggtcttgaactcctgagctcaagtgatccacccacctcagcctcccaaagtgctggrgattacagagtgagccaccacacccggcctggaatgactttttattcattgattcatacctagtaactgcagcagtgcctggatgtgtggtaggatctca

SEQ ID NO: 20007 - DNA, 201 bp, Homo sapiens
aaacgacacctccacagaatataatgtgagtggtgtccctggagatgtacagctctatggccctggagtcaaggtaaagcctcattttaattttttgcccyggagccgtttggcacaaaggactttggctcttcttgcctttgtcaaacagccatgaatttgtttggacagcagttgttgaatgcctgctaaatgctaggg

SEQ ID NO: 20008 - DNA, 201 bp, Homo sapiens
tgccatgttgcccaggctggtcttgaactcctgagctcaagtgatccacccacctcagcctcccaaagtgctggagattacagagtgagccaccacacccrgcctggaatgactttttattcattgattcatacctagtaactgcagcagtgcctggatgtgtggtaggatctcaatctttgttgaataaactaatggatg

SEQ ID NO: 20009 - DNA, 201 bp, Homo sapiens
ggcttattttactccttaagtcttcctatttcctagtcacatctcatttgcatgttatatgccatctcatcaattattgggggacctaagatccacatttyctattatttggccctgttgatgctacaacttctgcctttcagcttttcagccattgttctccacttcaaaatggacaaggaggaaaggtgaattggggtt

SEQ ID NO: 20010 - DNA, 201 bp, Homo sapiens
ttcaattattgttttatattacaccagtaatttttaagtagtgttaaaaactagtaaacaatgtaggggtttggagaaaaatgctaattccttatctcccrgaaaagggaaaccatcaggaatcagaaatggagaaatgcttcccccacctggtgattgcatcttgctgtatgggatcaggcctgaaaagtgagttaagtc

SEQ ID NO: 20011 - DNA, 201 bp, Homo sapiens
acacacttcagatttgttctatttactatatttgttacacctccatttttaaaaagtgcaggtattgaagatggaatgacaatgcttttccaaagcctccttttttttatctttggttacatttctctaagctccttatttcagccctggcacatctcacctttatcatttcctttctcattcttttctcctgttggagaa

SEQ ID NO: 20012 - DNA, 201 bp, Homo sapiens
gagcctgtttgtagccatggctgccaacatgcatgagccacttagaagggcttagggtggtgagggtacaggtctacctgtgaagctgagtgatagtcacrgtaattacagtcacctactatagcctcacaatgagccattataaaaatgaggaaactggggctccagaaagatttctcagccccaggacggtgcagccag

SEQ ID NO: 20013 - DNA, 201 bp, Homo sapiens
gtgattttatagttacgactctgtctggctgaaaattttgccgtatagatgaaacatcatcaaggtatgtatacgcattttggaacctatcatataaaaamgaaaacttttgtaacttaaatttgggatttatgtttttggttttttgtttgtttgtttgttttgagatggagtcttgctctgtcgcccagggtggagtgc

SEQ ID NO: 20014 - DNA, 201 bp, Homo sapiens
ggcccaacaaaggacactgaggctactcagtaattattaaatgagagcatgaacaaaggaatgtaagatgtaacagaaaacatacgtgtctcacacatgakaattattgtgtagaagctgtttcccatttgagacaaaataagaaacacttgttgaacgagtagatgggcttcctctgggagcacagcaggtaggcaccca

SEQ ID NO: 20015 - DNA, 201 bp, Homo sapiens
tgccgtatagatgaaacatcatcaaggtatgtatacgcattttggaacctatcatataaaaaagaaaacttttgtaacttaaatttgggatttatgttttyggttttttgtttgtttgtttgttttgagatggagtcttgctctgtcgcccagggtggagtgcagtggcatgatctcggctcactgcagcttctgcctctc

SEQ ID NO: 20016 - DNA, 201 bp, Homo sapiens
ccgcctatgacagttcgccataggcgaactgtttctctggttaggaactttctctggctacaggagtgtgctgcacccgagtcaggagggctggaagtgcrggatagttaacgtccccagtacagttttctaccaaggagagaccggtgagatggatagatgccccagctttctcacccgttgatgacacacttcactacc

SEQ ID NO: 20017 - DNA, 201 bp, Homo sapiens
agatggagtcttgctctgtcgcccagggtggagtgcagtggcatgatctcggctcactgcagcttctgcctctcgggttcatgcagttctcccgcctcagmctccccagcagctgggactacaggcggccaccactatgcctggctaacttctgtattttttgtagagacagggtttcaccatgttggccaaactggtctt

SEQ ID NO: 20018 - DNA, 201 bp, Homo sapiens
ttacaggcgtgagccactgcgcccagccgagatttacgtctctattgtaacttttgtgttttcttgaggaagtgtcacatgacttcttagccctcttattyacctacctaataaataggcatgaaagtatatttgccactacacaggtggaagtcacataatgtaggaaacgtgtctgtgttcaaaactcataagaatgct

SEQ ID NO: 20019 - DNA, 201 bp, Homo sapiens
atgaatgtgttttaaataaggtatatagtgagaaaagtgagcattggagtctatttcagttatgtgttacaataataatgctgcagaacaaactcaaaacytcagtggcatataatacaaagcatatagtttgtgcagctgggattagcagtggcttggctagctggctctgctgatttgggcagggcttgttcatatagc

SEQ ID NO: 20020 - DNA, 201 bp, Homo sapiens
aaaaaggtaagccctaatgaaccgcacttgtggatgcatttagaagcatttgaattgttgacatctgattttgggtaaaaaaaaggaaaaaggaaagcatytgaattggtgtcctcatgacaatctggctgcccccccttttggctgtctacaagagactgtttttatttttatgtatttagggggtacaagtgcagactt

SEQ ID NO: 20021 - DNA, 201 bp, Homo sapiens
taaataaggtatatagtgagaaaagtgagcattggagtctatttcagttatgtgttacaataataatgctgcagaacaaactcaaaacctcagtggcatayaatacaaagcatatagtttgtgcagctgggattagcagtggcttggctagctggctctgctgatttgggcagggcttgttcatatagctaggggtcagct

SEQ ID NO: 20022 - DNA, 201 bp, Homo sapiens
gtgggggcccatcctgtgccagactcctcgtctgcttggcctgtaacgttggcaattatcatcatcattatcgttattaatatccaagtttatttttattyattttaatgtttttatttaaaaaaatatttttagagacaggatcttgctctgtcacccagatgggagtacagtggctcaatcatagctcactgcagcctc

SEQ ID NO: 20023 - DNA, 201 bp, Homo sapiens
gaaacccggaggcggaggttgcagtgagccaagatcatgccactctgctccagcctgggcaacggagtaagactccgtctcaaaaaaacaaaaaacaaacaaacaaaaaaaaaaaaaccaatagtaataatgcttaggacctcaataaaacttcagtcctgtccgtttttggtgagcaagagatgagaacatcagggagtc

SEQ ID NO: 20024 - DNA, 201 bp, Homo sapiens
cggaggcggaggttgcagtgagccaagatcatgccactctgctccagcctgggcaacggagtaagactccgtctcaaaaaaacaaaaaacaaacaaacaamaaaaaaaaaaccaatagtaataatgcttaggacctcaataaaacttcagtcctgtccgtttttggtgagcaagagatgagaacatcagggagtctgggat

SEQ ID NO: 20025 - DNA, 201 bp, Homo sapiens
gggtacagcatttcaggtgcggaagatgaaaggttctggaggtggatggtggtgatggttgcagaataatgaaaatgtacttaatgccatagaactggacrcttgaaaatggtgaaagtgatacatcttatattgctctccctgccccatcacaaatagattgctaggctcactccttatagattctgattctgtacctct

SEQ ID NO: 20026 - DNA, 201 bp, Homo sapiens
ctgactgtattagtcagctattgccacataacaaactgccccacaactccatggcacacatcaagaagcatttatgttctcatggatctgtgggatggttrgacagttctgctgcaggtctgcacgttggctggggaagctgttctccatgtctcttatctttctagaaccagttggctactggggcaggttcttctcatg

SEQ ID NO: 20027 - DNA, 201 bp, Homo sapiens
tcagtcgatataatccaaagctaaagagtaaagaaattactcctgaataactgacccccccaaaaaaatgaataccatttattgctgtcccaaggctttartagcctttttcatgtgctgtcaaatttaatccttatggcaccttcataaggtaagatcagcatcccaagttgaggaaccaagcttcaaggatttgcccaa

SEQ ID NO: 20028 - DNA, 201 bp, Homo sapiens
tgttgcctgccgggcaaggaaccagcaaagcctcactacagagtgacaattcctggggtgccctgtgggagcagtgagagggagctcctggggccgggggrtgctgcatggttaaaaaggagcataaggaagaatagataaccactgcatcacaccagggtcaccattcacactgggttccatgtaaacgacacctccaca

SEQ ID NO: 20029 - DNA, 201 bp, Homo sapiens
agaaaaagaacaaagcaataaaaaaggatgacatgaggactatattgtggaaggtagaaactggaaaacagcaaagagaaaatggttccagaataattggracagaagccattccttagacagcaaaggaggatctccatttcctgaaatgggtgcagcagacaccaggcaaaaatatttaaaacattttaatgtctacaa

SEQ ID NO: 20030 - DNA, 201 bp, Homo sapiens
taaggcaaaggaaaagagtgatagaaaataaaaataacttgattcattagatggaattcaacttgaattcttagtttgttgactaagaatttgcagcctcygaggaaattttttttaattgaagaaaaactaatttttaaaaatctgaaaataattcgtttgtgactatttaacagaaggaaaaacttcctgagtgagcat

SEQ ID NO: 20031 - DNA, 201 bp, Homo sapiens
atcttcagcaagaaaccctgagaatattgaacgtctttgccagacaaggaaaagtgggactggggaaaaggccagttatgtgaatcctcttaaaatagggwctaaaattttataataaaaatgtattttaaaagttttgattgagactttgcctgaaatgtgaaactgaaaattacgaaattaggtttattttatcctgca

SEQ ID NO: 20032 - DNA, 201 bp, Homo sapiens
tcaccggatcccagcccttgcagggtgctgcaggatggtggggcaggtttggaaatagacaatgactgttcaccttagtaagtgggggccagaggtgtgtktacagagctggaagcacagagagggaggatgcctgtcaggggtactagagaaggcttcctcagggtgggaacatttgagctggctgttgaaaggtcgacg

SEQ ID NO: 20033 - DNA, 201 bp, Homo sapiens
gtcaaagctaattaaactgaggtttcctcgagttccagagtacatttttgaagacatttatttcacacatgcaaaaactgaagaagtctttggggcaatamatctttttgatttcttttttttttttttttttttttgagacagagtcttgctctgtcaccaggctggagtgcagtggtgcgatctcggctcactgcaacc

SEQ ID NO: 20034 - DNA, 201 bp, Homo sapiens
ggtcactaagggcttgctttatgaatctgggtgctcctgtattgggtgcatatatatttaggatagttagctcttcttgttgaattgatccctttaccatkatgtaatggccttctttgtctcttctgatctttgttggtttaaagtctgttttatcagagactaggattgcaacccctgccattttttgttttccgtttg

SEQ ID NO: 20035 - DNA, 201 bp, Homo sapiens
tccggcagaatcactaattttatcactcaataattttatgtattaaaaatgctcatcccagaccctgcagtctctgtgtctactcagaaaagactcatgcwgtgcaattagagtgtggcccaggaatctgcattttatttatttatttattttttagacggagtctcgcactctcgcccaggctggagtgcagtggcacca

SEQ ID NO: 20036 - DNA, 201 bp, Homo sapiens
tataattttttttgttaaccatgtgaaagttgcagaaatcatgcctcttgattcataaatacttcagtgtgcattcccaagaatgaggctgttctcttaakaaactgtagtatagttatcacattcaggaaattgaacattgacactatgctattagctaatccgcagtttatgttctgattatgccagttatcccaataa

SEQ ID NO: 20037 - DNA, 201 bp, Homo sapiens
cgccattgttgggcagacccatcaatgtgctctcttggtccttccacacctgaggcagcctgtatgcctgggaaggaatgtgacatggaagagatttcccwtgtcaaaatagaagacacttcctgcctccacctaattcagggctaatcataacagtcagagagggcagggaaccagtattgcaattgtgaaaggttcatt

SEQ ID NO: 20038 - DNA, 201 bp, Homo sapiens
cttccattataggactagactgtgggatccaggaaaatgttgcttaacatctcgttgttggattccaagtcatctgtactcccccaaaataccacttccawtaattactgttccattttgagcactatggtgatattttcattatcaagagttcttgggaagaggccgagaggttttttttagcactcctaagaaaaaatt

SEQ ID NO: 20039 - DNA, 201 bp, Homo sapiens
aagaacaccccctatgtacattaacagtgctgcatagcttcaggaagccctaggatctgtagcttcaataatataaaaatttctagtttcttaaatcacaratgttaagatgaccatattatcttctaagcacacaccagaatatttcagatgctcatttcttttcaggcattggtgaagatatggtctgactgccccgga

SEQ ID NO: 20040 - DNA, 201 bp, Homo sapiens
tattttttctctctttcaactagcattaacatccgaaactgtatatcatcaccacatttcatttaccatggttttttaatttaattattctttaaattttyctatttccatgttaaatccagagaaattgttactttttggaaagtttctactgctgcctgcctctgaaggccacgggacttacctgtttgtttgtcaaag

SEQ ID NO: 20041 - DNA, 201 bp, Homo sapiens
tctattcgtacttcttacctgtttgagagtaagtcggagacgcgatgcccccttatccctaacatcagggatatttcctgagaacaaggacattcttttaygtaaccatagcacaattattgaaataaggaaattaagtgatacattactgttagcttatctgcagaactcactcaaatatcaccagttatcttcatgtcc

SEQ ID NO: 20042 - DNA, 201 bp, Homo sapiens
ggctggcttgcccaggcacacaggcatcatttccagcaagtccacttggtgtagactgtggacctcatgaaggacactgtttcttctcttagttgggggtsagcaaactttttctgaaaagagccatggggtaatttaggctttgtgggccatttggcctctgcagcatctattcaaccatacttctgtagttcaaaggca

SEQ ID NO: 20043 - DNA, 201 bp, Homo sapiens
agaaatgcccaacattttgtaaacactaatttttttataactgtaaagatgattattccatacttaaaaccaattcaaaataaaataaatcctcaatactycttattccctggggtagtaattttaattagattctattgattcattattttctcctgtgtgcctttatttgggaaatactgttagtttaccttgctatcg

SEQ ID NO: 20044 - DNA, 201 bp, Homo sapiens
ggtggctcacgcctgtaatcccagcactttgggatgctgaggcaggcagaccatctgaggtcgggagttcaagaccagcctggccaacatggtgaaacccygtttctactaaaattacaaaaattagctgggcatggtggtgggtgcctgtaatcccagctactctggaggctgagacaggagaattgtttgaatctggta

SEQ ID NO: 20045 - DNA, 201 bp, Homo sapiens
tttagatacggggtttcaccacgttgcccagctggtctcaaacatgcctgcctcccaaggcttattttacttagcataatgacctccagttccgtccttgytgttgcaaaattttggaacatttcaatcacccccaaaagaaatttcggccttttggccagaaccaccatcttccagtaattcgccaaaatgtcgaacaca

SEQ ID NO: 20046 - DNA, 201 bp, Homo sapiens
gaaaagtcagggagctcaatatatattaagagtatgcgctcagccaggcgcggtggctcacacctgtaatcctagcactttgggaggccaaggcgggtggrccacaaggtcaggagatcgagaccatcctggctaacgtggtgtaaccctgtctctactaaaaaatacaaaaaaaaaaaaaaaatgagctgggtgtggtgg

SEQ ID NO: 20047 - DNA, 201 bp, Homo sapiens
tctaagtccccttgttcaaccctatcttttgggtctcagatttggcttcccccccgctttttttttttttttttttgagaccgaatctggctctgttgccyaggctggagtgcagcggcatgatcgtggctcactgcaacctctgcctcccagactcaagccatcctcccacctcagcctcctgagtagctgggactacag

SEQ ID NO: 20048 - DNA, 201 bp, Homo sapiens
attttgactggatttattggatagtgtaattgtttccatttaaaacaatggaaaagatttcatttaaatttattgagatcttatttttcaccctcattccrtgcacatttgggattctgttcgccagcccctctgcactctgaagatgcacagcagcctctctgtactctgaagacgcatgaattgctgactgttgggctt

SEQ ID NO: 20049 - DNA, 201 bp, Homo sapiens
atgggaaggagcctgagctgctggaacctgttccctatgaattcatggcataataggtgtctaaaaaatgaaagacctctggactgtttaaaaaaaaaaaraaaaaagaaaaatccttaacccattgacatagcttcttgtattaatttcttattgctgctgtaacaaattactacaacatttgtggcttaaaacaacaca

SEQ ID NO: 20050 - DNA, 201 bp, Homo sapiens
atcctagcactttgggaggccaaggcgggtggaccacaaggtcaggagatcgagaccatcctggctaacgtggtgtaaccctgtctctactaaaaaatacmaaaaaaaaaaaaaaatgagctgggtgtggtggcgggcgcctgtagtcccagctactcgggaggctgagacaggagaatggcgtgaacccagaaggcggag

SEQ ID NO: 20051 - DNA, 201 bp, Homo sapiens
tcgcatactggtgagtattgggcttctagcatgtttgttaataagttggtcatatcactcaagtcatgcctgatacacagatgtttgattatcagagtctkttttctttcttgtttcctgtggctttttaagttgatgaataataggaaagtaaatttgtggggtcagttaaaccaccagacgacagcttttatgtttgta

SEQ ID NO: 20052 - DNA, 201 bp, Homo sapiens
tcctagcactttgggaggccaaggcgggtggaccacaaggtcaggagatcgagaccatcctggctaacgtggtgtaaccctgtctctactaaaaaatacamaaaaaaaaaaaaaatgagctgggtgtggtggcgggcgcctgtagtcccagctactcgggaggctgagacaggagaatggcgtgaacccagaaggcggagc

SEQ ID NO: 20053 - DNA, 201 bp, Homo sapiens
aggctttgcccgccttaagtccttttttgaaatggagctgatttaaatatgtaagtatggtcacagcattgacacttcagtggttatcgtaagcttatttstacagtatgtgagatgcagtttgtagcaattgctatgggtaaaatttttattttaagaggtgactttctatttacagttattcatttacactgggttcat

SEQ ID NO: 20054 - DNA, 201 bp, Homo sapiens
caaggtcaggagatcgagaccatcctggctaacgtggtgtaaccctgtctctactaaaaaatacaaaaaaaaaaaaaaaatgagctgggtgtggtggcggscgcctgtagtcccagctactcgggaggctgagacaggagaatggcgtgaacccagaaggcggagcttgcagtgagctgagatcacgccactgcactccag

SEQ ID NO: 20055 - DNA, 201 bp, Homo sapiens
ctttgtgcccttggcaggctctcctggtctgtaggtagcatagatggcctgaatgtttggtaaggggtgctggaaactagggcaagaaaagaggggaaggytgggatgcatagaactgatgtgtgggaaactaccttcatcatccagctcaggtgtgaagccgctgctcatgcgatatgctctgctcacacagatggcact

SEQ ID NO: 20056 - DNA, 201 bp, Homo sapiens
tgtctctactaaaaaatacaaaaaaaaaaaaaaaatgagctgggtgtggtggcgggcgcctgtagtcccagctactcgggaggctgagacaggagaatggygtgaacccagaaggcggagcttgcagtgagctgagatcacgccactgcactccagcctgggtgacagagtgagactccgtctcaaaaaaaaaaaaaaaaa

SEQ ID NO: 20057 - DNA, 201 bp, Homo sapiens
ttaaaacttaacagagtgcacacctaaaattagtgaatgttatgtatgtaaattatatctcaatcaaacttattttgttaaaaaaagtttcgtggagattrttccatattggtgcatatagagctttcctgttctttttcagtagttctttttcactattccttgatttatttaacctgtccaggtggtcttctatatgtc

SEQ ID NO: 20058 - DNA, 201 bp, Homo sapiens
tctcacaatgagagcattaaacatttggtaattaacataatttaatatgccaaaaatgagaaaatagtcaggatgagggatgaggagtacacataggaaakttttgtgattttcttcattttgattgtattgctttcttgtcttcaggagggaagattttgacttcaaaagtaacaaaatatttaagaagggaattcacat

SEQ ID NO: 20059 - DNA, 201 bp, Homo sapiens
ctaagatcgtggttgtagcggttgtatggttgcatttattaaaacttaacagagtgcacacctaaaattagtgaatgttatgtatgtaaattatatctcartcaaacttattttgttaaaaaaagtttcgtggagattgttccatattggtgcatatagagctttcctgttctttttcagtagttctttttcactattcct

SEQ ID NO: 20060 - DNA, 201 bp, Homo sapiens
aatcaacatacacatcttttagaaatggcagcagcttgtcatctttatgagcaatctctcccttaatttctggatagagactaatctgctctcacaggagkctgttggtagaggggtgcctgggagcaggagagggcttcatcttgctgatttcccattctgctcggttctctcggttggaatgcctgatcctgcgagtca

SEQ ID NO: 20061 - DNA, 201 bp, Homo sapiens
agcggccagggtttgggggaagggctgatgatgattgacttcaaagagggatgagacaactttctggggcgatgaacatattctaagatcgtggttgtagyggttgtatggttgcatttattaaaacttaacagagtgcacacctaaaattagtgaatgttatgtatgtaaattatatctcaatcaaacttattttgttaa

SEQ ID NO: 20062 - DNA, 201 bp, Homo sapiens
ttctttatctggaaaataacatgctaaatctccgggtcatcttgagaaatcaaagaaatagctaagaaaaaaacagttgcagggtttggcaaaaggggacrccaaccttagatatgaggtcttctgaaaacttttaaaatttgtttattttttgaatcagtagtgtgtatagttaaaatttttaaatggttataaaagttg

SEQ ID NO: 20063 - DNA, 201 bp, Homo sapiens
aggggccagatgcctctctcctcacactgaccgtgagagcgagtgctcctcatcaacaacgtggggccaggcttgagtcagcagcactgactttatgtgayctagtgcagctcgccagcccacgctgatgtgtgttaatggagggggtgccccttataggagggtggtgtgggctataatttcttctgcattctctgccta

SEQ ID NO: 20064 - DNA, 201 bp, Homo sapiens
agtgtgtttggggaaaagtgaggtataataatacaggaattagtattaaggaatgtagtaattaaactccttttgaaaatgattttaaaagaattcccatratattcaggtaatagcgataaaagcagctaacactaatcgagcatttagtatgtgctggttactgtgagtcactacatgtgagatagttactgtttttat

SEQ ID NO: 20065 - DNA, 201 bp, Homo sapiens
tcaaattttggaagcagcaagatttctctgcaatcctctctagtagataatagtgtgtttggggaaaagtgaggtataataatacaggaattagtattaargaatgtagtaattaaactccttttgaaaatgattttaaaagaattcccatgatattcaggtaatagcgataaaagcagctaacactaatcgagcatttag

SEQ ID NO: 20066 - DNA, 201 bp, Homo sapiens
atctgtttctggtttatgtgttcttacctggatgacagctgtgctcatcctctaatcctgtacaataccttgagagcacaggccttttgtgagatcaaatrcctatgcatgacaggcaaataagcaggctcttcaggaccagggaaacgatggcaacagttctgagtctgatgcagggatggcagagaagcccaggcagag

SEQ ID NO: 20067 - DNA, 201 bp, Homo sapiens
gaattggtgtgtgacacttgcacaggtgccagtgttttctgtgtgggagcactttcctgtatgcattattttcttcttaataatggcacctcctgagagtwtccaggtctcagatcccttctggtgacacagccttgccttgtaagtcaactgtttgctggcgttaaacaagttggggcagatggctctgctgactaggaa

SEQ ID NO: 20068 - DNA, 201 bp, Homo sapiens
atcttaaaaaatgaaggtttttgagcttagtggtctccaggattgcctcaaagctttgccagtctgaatctacccttttcttgctattgtccccattggarttggtgtgtgacacttgcacaggtgccagtgttttctgtgtgggagcactttcctgtatgcattattttcttcttaataatggcacctcctgagagtatc

SEQ ID NO: 20069 - DNA, 201 bp, Homo sapiens
gcaggctcagtcaataggacagacagatgatgagtagacccccaagaatcacccaccagaggaggagcatcaacaccagggcagagaggcagcaaccgcartcaaaagaactaataccagagggtgcagtaacaaggccaacagaaggcttctgaataagcaagactgatgtcttcagagcaatgcaaaaagacagtgttt

SEQ ID NO: 20070 - DNA, 201 bp, Homo sapiens
tcagatggttctgatgttttgctgaaatttgagaaccactggactagattatgatgtctgagttctcaccaagtgtaatagtctatgagtaaattcctatrcatgtaaaaagaaaagttttagcaggaagaagacaaaatgctgaaagagaatatggtaatttcaaagtttgagatttttagatgcatgttagaagtgttt

SEQ ID NO: 20071 - DNA, 201 bp, Homo sapiens
gcagaaaaaaaaatttgatgaaatatcgttccaaaacagtggcagtgtataaactcttcaataaatgatatgaagacaattggctatccatttgggaagamattagagaaagcctgtacctcacagaaaaaaacaaacaaacaaaaaacaggtgaattaaagttagatgttaaaaaaaatatttgcagaactgaatatttt

SEQ ID NO: 20072 - DNA, 201 bp, Homo sapiens
tttagacattgagagaggtgattatgaaagtacgatagcttgctcaccacctctctcctctgctcctgggagcacaggggagtttcaactctggggaaggygatcatttgggtcattagtagcgctttgagtaccatggtgtctgcagggagttcccagttcttactgctgtctgagaataaaacataatatctttggtct

SEQ ID NO: 20073 - DNA, 201 bp, Homo sapiens
aaaaatgagtacttgtgcttcccagaaaagacatgaaaaaggatgctcacagaaatgttaaaatagctgaaagctgagaacaatgcagatatccatcaatwggagaataagtaagcaattgtggtatatccatacactggaatattacacagtaatgaaaaataacaaactactgctaatgaatgaatctcacagacagaa

SEQ ID NO: 20074 - DNA, 201 bp, Homo sapiens
gcatgagggagcctgcttagatgctggaaatgtcctacatcctaatcagggtggtagtcctccaggtataaacacatgtaaaaatttttaaagacaggccrggcacggtggctcatgcctgtaataccagcacttagggaggctgagggggtggatcacctgaggtcaggagtttgagaccagcctggccaacatggtgaa

SEQ ID NO: 20075 - DNA, 201 bp, Homo sapiens
gctcatgcctgtaataccagcacttagggaggctgagggggtggatcacctgaggtcaggagtttgagaccagcctggccaacatggtgaaaccctgtatytactaaaaatacaaaaattagctggatgtggtagtgggcgcctgtaatcccagctactagggaggctgaggcaggagaatcggttgaatcagggaggcag

SEQ ID NO: 20076 - DNA, 201 bp, Homo sapiens
cctgtatctagctttgggggctgtgaagaacatctccctaaacatctctatctccaacctcggagatgatgcctatgatgccaacgtgtccttcaatgttycccgggagctcttcttcatcaacatgtggcagaaggtaaggagggcatccctgtaaaaagagcagttgttccatctggtgcgcttgctgactttcattat

SEQ ID NO: 20077 - DNA, 201 bp, Homo sapiens
ttgtagttgttgttgttgaactgtttagtaatagtctggctgccccttttgaaacttttccagcaagtgccattggtaattttgctggtagataatgccarggtaaaataccagacccttgctactcaaagtgtggtccgaggaccagcagcatcagcatcacctgagagtttcttagaaatgcagaatcctgggctccac

SEQ ID NO: 20078 - DNA, 201 bp, Homo sapiens
ctgaagccagaaactcccccaaggcaaatcaagactttatggaatcagctctgttactgcaagacatcccctcaaactcccgtctcagtctgtgtgagaascgtgcatgaattcttgctattttcttgatattttcaaatagcagaatacatgataaacttgtaagtccacagatgagtcggtaagctgctgccatatgga

SEQ ID NO: 20079 - DNA, 201 bp, Homo sapiens
gatattttcaaatagcagaatacatgataaacttgtaagtccacagatgagtcggtaagctgctgccatatggagcatgcaccagactgaggtctttggtracagctggaaagactggctctgtctcatttcagcagaatcagaatggattcgaaggctatccagtggaagtgctcagaattgcgctggaaggctggagaa

SEQ ID NO: 20080 - DNA, 201 bp, Homo sapiens
ccattttcatatccaacaaaatgcgttgggaccatggcttcaatcacattacatgctgtgagtttagagtgttggatgctggttttcagaggtgatcaaamctttttttttttcttgtttaagaaacagatagttaagaaagggagattaagttggagttaataagaactctgagaaagaggagaaagaaaaacagcaaaa

SEQ ID NO: 20081 - DNA, 201 bp, Homo sapiens
attccctactcagtgaggagaatgagtgttccatgcagacttttatgctctacccacaagataagttgtccaagcactatttttgtttgtttgtttgtttstttgtttgtttgagacagggtcttgctttgtcacccaggctggagtgcactggtgcaatcatggctcactgcagcctccacctgttggctcaggccaggc

SEQ ID NO: 20082 - DNA, 201 bp, Homo sapiens
aagattactccaaaaaaatgccacttaccattcctttggtgtactgcttctagaggcaaagtttactgcttttactgtcatgaaatagactgtgacttgtkatttatcatttatgtgaccaattatagttacaatcatgttccatgtgacaatagaatctttccccccttgaacctcacattatgctgagatgtaggatga

SEQ ID NO: 20083 - DNA, 201 bp, Homo sapiens
gatcataccctgggatctgcccaggtgttttggcctgtttccattttcatatccaacaaaatgcgttgggaccatggcttcaatcacattacatgctgtgrgtttagagtgttggatgctggttttcagaggtgatcaaacctttttttttttcttgtttaagaaacagatagttaagaaagggagattaagttggagtta

SEQ ID NO: 20084 - DNA, 201 bp, Homo sapiens
tccctcagaagcacactgataaccccaatatacccacaattcacacttttttccttctctgaggtatgctgttttttgtcaaaacagaaaaaacacactamtaggatatgaaaaacttcattctgggcctggttaggtcataaactacagaaccttaggtcatatattctcaccgggcgcttgtttctccactgcaaaaaa

SEQ ID NO: 20085 - DNA, 201 bp, Homo sapiens
tctacaaggaagctgagactggcagatgagaaggaattcgcttgccaagcatgaggaagagtgtctcagttggggaggagagctgtatggagccccaaaargcttggcctcttcaaggcactgaaagaccaggtagcaggaagctggttagcagtgaagagaaccatggtagacctaggcagggtccatgccaggtaacac

SEQ ID NO: 20086 - DNA, 201 bp, Homo sapiens
ggtgggacatcaccctggccaccaggtctcctgagagatcataccctgggatctgcccaggtgttttggcctgtttccattttcatatccaacaaaatgcsttgggaccatggcttcaatcacattacatgctgtgagtttagagtgttggatgctggttttcagaggtgatcaaacctttttttttttcttgtttaagaa

SEQ ID NO: 20087 - DNA, 201 bp, Homo sapiens
caaaggctttcactagatgctagttatacccccagtaactatgaacaagatgaaatttttaccctcaagacttccacagccccaaacaggtcaacacacayacacacacacacacacacacacacacacacacacacacacgtgcacacacatcacacccctgcagcactgtatgcatacgtgcccagagtatctgtgctg

SEQ ID NO: 20088 - DNA, 201 bp, Homo sapiens
aggctggcttgagctcctggcctcaagttgatccacccgccttggtctcccaaagtgctggaattacaggtgtgatccaccatacccaacctatttatttwattttattttattttggacggggtcttgctctgtcacccaggctggagcgcagtggcacagttacagctcacttcagcctcgatatcccatgctcaaatg

SEQ ID NO: 20089 - DNA, 201 bp, Homo sapiens
aagtggctgcagctccttccttgcttttgtgggcagatgctcatcctggcctggcgaagggtgggacatcaccctggccaccaggtctcctgagagatcayaccctgggatctgcccaggtgttttggcctgtttccattttcatatccaacaaaatgcgttgggaccatggcttcaatcacattacatgctgtgagttta

SEQ ID NO: 20090 - DNA, 201 bp, Homo sapiens
ttgggaaaacttgcctcattggaacatgggctccaattgctgtggctcccatgggaaactacagtacagcctctcgaacgagtttctccaatgtgctaggscctaccatgagacccaagacagactgtgtcctaactctagtggggtccacagtctactggggaaactggcattaatcaaataattcctctaagtgacaca

SEQ ID NO: 20091 - DNA, 201 bp, Homo sapiens
gctcttcaggaccagggaaacgatggcaacagttctgagtctgatgcagggatggcagagaagcccaggcagagtgcaggggcagtgatgtcattccctaytgtgaggatcagtgacaccctctagaggcatttagggaactttttttgaacagaaccatgtgtcagacactgtcaagaaggccaataacggtattattgt

SEQ ID NO: 20092 - DNA, 201 bp, Homo sapiens
caaaaaaagttgtaaaacaccaggagttcacatcccagaaataaccatgatgagcatagtattgcctcattttgacctttttctctgcatatatagatatmgaccaggcattctcataacatcaacttatttttgaatagtgtattagttaaattttacagtaatatactcagcatattttcaggtgaagtacctctaaat

SEQ ID NO: 20093 - DNA, 201 bp, Homo sapiens
ccctgggccccagctcttgtcatgacctgcccctttcctcctggaacctgctccttacacttctttgccttggttcttatgctcacagaagtcagaggccyggtttgtgtcatattcatgtagaaccatctaccacctgcatgatttttacatttttttggtcttaaactcatactgcctgtgatattttctttcatattt

SEQ ID NO: 20094 - DNA, 201 bp, Homo sapiens
ttgcacaaatctttcattatgtcgttaggttgaaagcctagaaatagaattgccatcaaaaggagtgtatattttaagctttttaaaaattatatttattwttttattttgagatggagttttgctcttgtctcccaggctggagtacagtggagtgatctcagctcactgcaacctccccctcccgggttcaagcaagtc

SEQ ID NO: 20095 - DNA, 201 bp, Homo sapiens
ttcttgctttggctgagaagttatcctttgttcctagttaccaagggtactggctatgagatgccacgtagagtggcaatagtgaagtgcaggccagaggmagggctgtttctatggtggccctgagggttactgggaaggatcagggttgcgcaaggggttggtcctgctactttctgatatctagggttgccagactta

SEQ ID NO: 20096 - DNA, 201 bp, Homo sapiens
aaaggagtgtatattttaagctttttaaaaattatatttatttttttattttgagatggagttttgctcttgtctcccaggctggagtacagtggagtgayctcagctcactgcaacctccccctcccgggttcaagcaagtctcctgcctcagcctcctgaatagttgggattacaggcgtctgtcaccacaaccagcta

SEQ ID NO: 20097 - DNA, 201 bp, Homo sapiens
agtctgctcagcagctgcctccaccacattggttcacccaactgtggcctctggcttgtcttccagcaatgtgtatctgtagccatgactttgcttaagcraacttggaaattcacttcatttaaatgtaatctttcttacttcagggcagttgttcagggaagttgtgatcagtagaaagtaaattggctagagttcagt

SEQ ID NO: 20098 - DNA, 201 bp, Homo sapiens
gctcacatttctcgaacgcttactttgccccagtccttgctttgcctggactaggcactgggatgcagcaataactgtgcccttccctgcacttgaccgcstcaccacctagcaatagacctgcaggcataatggagggtggtgagtgctgcgcagtaactgctctggaaactgagaagaaggtgccatgagtccccctcc

SEQ ID NO: 20099 - DNA, 201 bp, Homo sapiens
cctcaggagaagagatgcaggtactggcagttgcaatttgggccggacagcagagaaatggtaaaagccaagaggatatgggtgggggagcaataccatcmgttccatcttcctgtgttcctttccacccaggttttctctgagctcagctagttcatctctggtaagatagtccagtctcgctgttctctccattgtctc

SEQ ID NO: 20100 - DNA, 201 bp, Homo sapiens
cactgtgggcagctggagctcagtcctgctggggaaccctggcagtcagtgtagaccgtgccccagaattaccccacatcaaggggcaagggagctggggmcctgcattatggagggctgctctggggacttgagttccctggcactcctggcttgccaggcacatggacagagccactagagaaagccctcaggagaaga

SEQ ID NO: 20101 - DNA, 201 bp, Homo sapiens
cattttgcactcagacccagtgctcctgtgtttccatggttagcctgaaactcgggaaggagaatttgttagaatttcacagctgaaatcttgttctgacrgagagcaggaattaatcaaaacttgctgggagagaccagagctagagttgatgagagacagctggctccctcctggcccaggcccgtgcaggggggctcc

SEQ ID NO: 20102 - DNA, 201 bp, Homo sapiens
tcaaggttatacttcgggttaaccacttccttggggttatcagaacctatgagcttggagaaggggccctgcggagctaggacctgaacctctgaggaggrggctggtgctgctgatctctctgagggagtgcaatgaggctggctctgggagaatggggggaaaattgaaaactacaattaactgctgttggggccagct

SEQ ID NO: 20103 - DNA, 201 bp, Homo sapiens
aggtggggcccattcagcaccagtgtaccctcccattaatttctcttccctatcctccatctgccacatgggttcatagataaagtcaaacatccctttayactctaagggtgtgtttccccgataatcaggcttaaaggggatggtaactggagaattttgatatctcagtataataaggcaatgcagaaaattattcat

SEQ ID NO: 20104 - DNA, 201 bp, Homo sapiens
cccatctagcatgagcctttcacagactgctaagcacaattagaatgaaggtctaggcttagccatagccccagaagtgttggggtaaagtggaagaggcyggcagttggatggcatcttgtactgtaccttgtgggcaatgcgaagcaacctggcttatatctgacattaggtggggcccattcagcaccagtgtaccct

SEQ ID NO: 20105 - DNA, 201 bp, Homo sapiens
ggttcgttcttgtgatagcattgtcctttaggatgccatcattatgtgaatgtttcctgctatgattgtccaaagggaaaatggtctggaagtacacccaygtcaacagagttggatttccactgtggagccaggactatttatatctttcttagacctttcctaagacagaccacatctgccttacccgtcacattactc

SEQ ID NO: 20106 - DNA, 201 bp, Homo sapiens
aaataatgttggaccccaagcattctttttgcaaatatgagggctagactgaagcctcattggaccacaggtcctatgggactggtggagatatagtgccyggagcctggcccttagggaacattcgagcagttagaaagcagaagtgacaggactttggaggctccttattgagcttgtagcatcagccagatgtcaggg

SEQ ID NO: 20107 - DNA, 201 bp, Homo sapiens
acaacattttctctagcaattatgggggttttatctcccagatgtgatttatgccatattacactccaagaagggaacatgaagaatgtttgtggctaaaraagtctcaacacaaggaaactacaggtgaaacgtaacaatagtaattgccttactttatttgcgaaggggtggtgaacactaatatgcctgactccatag

SEQ ID NO: 20108 - DNA, 201 bp, Homo sapiens
ctggatggggctacaacattgcagttcatgctcataatggcagcaaatgcttgagggaatccctgagtatgcatctatttcttgaatcatggcatctgctmtaggaaatcctcttaaatgtattcttatctccctaataaaatggaaattggtacttaattggtaaaattttaaataattacccagcatctggtggttcat

SEQ ID NO: 20109 - DNA, 201 bp, Homo sapiens
tgccccttaatcttgttatgtcaccccagtggtgtgaaggccagggctccttagaggtaaaagggtctctttgtgaggcctggaggggagaaggttgagcrgtagcttaggtgaatgctgcctgagcagatgtctgcagtgggagcagaatggtgtgatttactctttgtttttgtgggatgtccttggggagcccaagga

SEQ ID NO: 20110 - DNA, 201 bp, Homo sapiens
tcctcccttgtcattaaattattactaatctatgaccagaggaagcagccactgcatacgtgggtgtatttttaaaaattgtgacacatcatcaagatggrtatacttgcccctttaattcaacaggcacctgttgaatgcctgtgcatgcaaacatgatgctgggctgagccctggggcttaccctgaagagctttggag

SEQ ID NO: 20111 - DNA, 201 bp, Homo sapiens
ggaaagactaaggtgttggccttctttcaggcactgctattgtctgacttccgtttgtcctgtggccagatttgctctggaagtcccgcagttccactgcmtctgttatcactactctctgttgaccccatctcccagcatggtggcagcagtggagtcccctcaccctatctgtgcctcgtgtctcttcacttcctttgt

SEQ ID NO: 20112 - DNA, 201 bp, Homo sapiens
ggctaagtgcgcagaacatgtgaaatttaagtagatttgtggaaacagaaacacatttttatttagtcgtgagcgtcacttggagtataaatagagccctytatgattcgtgtgctggtctttcttcctggagggcttcagtattatctcatgctgtcatctttatgttgtattggaaaaatctgggattctttttccctt

SEQ ID NO: 20113 - DNA, 201 bp, Homo sapiens
aggaccaggcctgacttagagcaccactggccatcctctgattccataagggaggctggaaaaccccacgtctggagaagtaccttcctgaaatgtgtccrcaggccaggctggaggactatgcctctgcatatgtacctgtcctgtttgtattcttcaaaaatggtgctgcagacagttttattgcctgtgccatacttg

SEQ ID NO: 20114 - DNA, 201 bp, Homo sapiens
gtatatttgtatctatagtcataaacaagatttctctgtaattttctttcttgtcaggttttggtgtcagatttctgctagtgtttgcaaaaataagcagraagcttgcacttttctctgttctctgaagacatacaaccaacatagttgcaacagcaggcagtgagagctgacccttactgagagcttgtttatgtgcca

SEQ ID NO: 20115 - DNA, 201 bp, Homo sapiens
tcagctggctatgttaagtaggggcttggctcagcctggcctaactgatgttagattttgagttactttaggttttgggtgggactagaaaagcagggagrgctaggagaccacgcatgtgcaagcacacatagatatatattgcccatcgttcctaaccctcctaagggcaggaggccagaggtatgtgggttaggaatg

SEQ ID NO: 20116 - DNA, 201 bp, Homo sapiens
cagttacgttcaggtcctaactccagtaatgaatttcaagcttcttgttattgtttttcttcctgaaagacaaagggagttttatgccatggtattttgasgacaatgttgaatcaattgttatcaaatgggaagatttctgaatgctgaatagtttgtaatatccttcaaaaaaccaaaccaagaacccacccacccatt

SEQ ID NO: 20117 - DNA, 201 bp, Homo sapiens
cctgcaggatttcatcgttgttagtgctgctgctgcctgaattgcaggctgttgtatcataccagctagctatgctgcatacaaactgcccccaaattgartggcttttcacaaccattacatctgacaaatttctgggtcagggatccaggaagggtttggcggggtgattcttccgtcccacatgacattgagtgaggt

SEQ ID NO: 20118 - DNA, 201 bp, Homo sapiens
ggctgttgtatcataccagctagctatgctgcatacaaactgcccccaaattgaatggcttttcacaaccattacatctgacaaatttctgggtcagggayccaggaagggtttggcggggtgattcttccgtcccacatgacattgagtgaggtcacttagtggcatttacctggtggctaagctggtcttcagagttca

SEQ ID NO: 20119 - DNA, 201 bp, Homo sapiens
ctctggaggctgggaatcaagctggcagttctgggctttcaccagagtgtgaaacgaaaaccaggaaggggcgctctctgagtgattgcattttgcactcwgacccagtgctcctgtgtttccatggttagcctgaaactcgggaaggagaatttgttagaatttcacagctgaaatcttgttctgacagagagcaggaat

SEQ ID NO: 20120 - DNA, 201 bp, Homo sapiens
tgagtttttatttttagagaactgatattttttctgttcttgatgaggtaatcaggcagtctctatgttacatgagttaagagtcctagacttacttagcyagtcctcaattctgacacttattataagacatctgatccagagctgcatgttcaactccatcaagccttgcctactttcctcatcggtaaaattgacctt

SEQ ID NO: 20121 - DNA, 201 bp, Homo sapiens
cattcttggcctgggaacagcctgtggccccttggagcctcctggctagcataggtgaaggtggtgaatgctttgcccaaggggaccctgcccctcacccrtggacggtgcttgtacctactcactggccaggctgaagcctaaacttgcttgtcaatctctggaggctgggaatcaagctggcagttctgggctttcacc

SEQ ID NO: 20122 - DNA, 201 bp, Homo sapiens
cagggatgttgcatctaactgtgggatggaggcacagaggtagctacagggagcaggatgaggcaaagaaagcagctgtcactcagagttcgcttatgagytttatcaaaagcagcaagaaaagcagtcttgggtgggttttatcacttattaacagccatttatgaggcccctgctgtgtgtcaggcactgtgcaaggtg

SEQ ID NO: 20123 - DNA, 201 bp, Homo sapiens
gctgctaggaataggaagcagggaggaaggagcgagttcctttgccctctccagccttgcaggctccctccgatgctccatattagcagagcctcacagcragcctctggcaaaacaagtgaggtttgcagggtcccagctccagtgtcacagtgcagggtagagaagggtgggttggagctgaggacaacagcttcataa

SEQ ID NO: 20124 - DNA, 201 bp, Homo sapiens
cttgttcataatgccatgttttctttaatgaatcatttaggattcttaggtgatatttctggaacagcaccatcaacagctttggccacatgcacttagarcaactaacttgcctcctgccggggtgtaggtgcgttggtgacagtgtagaagggtgattcgcaggcccatgttctgcccaccagcaaagccccactggag

SEQ ID NO: 20125 - DNA, 201 bp, Homo sapiens
gggataagctgctaggaataggaagcagggaggaaggagcgagttcctttgccctctccagccttgcaggctccctccgatgctccatattagcagagcckcacagcaagcctctggcaaaacaagtgaggtttgcagggtcccagctccagtgtcacagtgcagggtagagaagggtgggttggagctgaggacaacagc

SEQ ID NO: 20126 - DNA, 201 bp, Homo sapiens
gaacagcaccatcaacagctttggccacatgcacttagagcaactaacttgcctcctgccggggtgtaggtgcgttggtgacagtgtagaagggtgattcrcaggcccatgttctgcccaccagcaaagccccactggagaagggtagactcctgtgggcagtctcagagctgggacctatttgcttctgcttgattctgc

SEQ ID NO: 20127 - DNA, 201 bp, Homo sapiens
agctgccgtgagaaactgttgctgggataagctgctaggaataggaagcagggaggaaggagcgagttcctttgccctctccagccttgcaggctccctcygatgctccatattagcagagcctcacagcaagcctctggcaaaacaagtgaggtttgcagggtcccagctccagtgtcacagtgcagggtagagaagggt

SEQ ID NO: 20128 - DNA, 201 bp, Homo sapiens
taaatggtatggattccttattatcagtagacttctttcacatgtgcctgccagttactaagcatttttccagaagcattttgataacattcttacacatwtacaaatattgtattctcttaggttttcactctccttcatctgtctattaatagttatgttcttgttcatattccacatgctgttcatttatgtgttttt

SEQ ID NO: 20129 - DNA, 201 bp, Homo sapiens
tgactttgtccatggaatgcctggtgaatgagtgccagccctgggcaggccttccaggcacctctcaatgtctgcatatcttgggctgagtttgttattargacggctgcatttgggcagagcaatacacagatacctgtggtgggctaggtactgctgtcagaagtggtatcttctgtggtatttatctgctgctgtctt

SEQ ID NO: 20130 - DNA, 201 bp, Homo sapiens
agaagttactcttgtagccatgttggttttggtgggttttggctggcttctttataacagcctgttttaacaaggtttttatgacctgtatcttgtgccamccccctgtctcatcctgtgacaggatgcctaacctcctgggaatgcagcgcagtagctctcagccttattttacccagcccctattcaagatggagttgc

SEQ ID NO: 20131 - DNA, 201 bp, Homo sapiens
tgatgactttgtccatggaatgcctggtgaatgagtgccagccctgggcaggccttccaggcacctctcaatgtctgcatatcttgggctgagtttgttaktaagacggctgcatttgggcagagcaatacacagatacctgtggtgggctaggtactgctgtcagaagtggtatcttctgtggtatttatctgctgctgt

SEQ ID NO: 20132 - DNA, 201 bp, Homo sapiens
gttactcttgtagccatgttggttttggtgggttttggctggcttctttataacagcctgttttaacaaggtttttatgacctgtatcttgtgccaacccsctgtctcatcctgtgacaggatgcctaacctcctgggaatgcagcgcagtagctctcagccttattttacccagcccctattcaagatggagttgctctg

SEQ ID NO: 20133 - DNA, 201 bp, Homo sapiens
tcagatggaggaaagatgggcacttccaggacacagataccctccactcccatccaagctcagcagagggtgctggccaactctgtcatttccaggcctcygcctcaggaacccacagctgagacactgggttaccagccttcctactctttgtgctggcagctgcagaggaaccatgtggatgatgactttgtccatgga

SEQ ID NO: 20134 - DNA, 201 bp, Homo sapiens
aaggtcagtcttcagatggaggaaagatgggcacttccaggacacagataccctccactcccatccaagctcagcagagggtgctggccaactctgtcatytccaggcctccgcctcaggaacccacagctgagacactgggttaccagccttcctactctttgtgctggcagctgcagaggaaccatgtggatgatgact

SEQ ID NO: 20135 - DNA, 201 bp, Homo sapiens
attcagcaaggaaggcagcctcttggctctgcacagttgggaaggtcagtcttcagatggaggaaagatgggcacttccaggacacagataccctccactyccatccaagctcagcagagggtgctggccaactctgtcatttccaggcctccgcctcaggaacccacagctgagacactgggttaccagccttcctactc

SEQ ID NO: 20136 - DNA, 201 bp, Homo sapiens
aatgcaccaatttgagagtatgactccatgagttttgaccactgcatacgctgtgtgactaccaccccaccacaataaagaatacttctgtcaccccagakagtttccttgtgcctctgtctggtcatacccctctcctgatagacaaccactgttctgacttctatcaccatagatccatcttgcccattctagaatttc

SEQ ID NO: 20137 - DNA, 201 bp, Homo sapiens
cttctaagggaaccagcttgccccgggtaacattaaatcttgaattattaaagaggcagaagagccttgaggttgaatgtgaactcaggggccaggtggcygggttccagccctgactctgcccttactaggtgagtttcctgggcaagtcccctgacctttctgtttcaggattctcctctgttggccaggacagcaata

SEQ ID NO: 20138 - DNA, 201 bp, Homo sapiens
ttctctaaattttatagtcatcttgcttttgagaaatatttctttccactaaaatttaagaaaactaacgcagtcttgtatgaggacaccacattgtgtawttttgtacagataggagttttggaaattcctcaagacaacagagccaggaggaagtaagggaatagaaagaagtcagtgttgaagcttttgtcccaagaa

SEQ ID NO: 20139 - DNA, 201 bp, Homo sapiens
gaaagtcaaagtgagcccctagatagctgtaaacctggttctattgtactttgaaaacaaagcatttctcttgtcctccacagtgaggacatcaggaagtragcctcccctgggggaccatgcagataaaggcagaaggagtaggtcagaccccagaagatgggacttttctgattcaagaagttcagtatctttgtgagg

SEQ ID NO: 20140 - DNA, 201 bp, Homo sapiens
gcaggtaaatgcaagtacaacttctacatgaataattgtccttggcagatagagataaactagttaagggtggagggttggttggttgtcattcgtgcctyagatcccctctctactggcctcctgctgagctcagtgcctcacctgcaggagacagggctttgggaggcgctgcgaagaggagggactgttttttgggtg

SEQ ID NO: 20141 - DNA, 201 bp, Homo sapiens
agattgacttttgagagtgtacgcgtgtgtgtgtgtgtgtgtgtgtgtgtgtgtgtgtgtgtgtgtgtcttgggaggcatggaggcatatgtacctaatgyctaggtctgtttggacagcagtgttcctcacagcctcttggcctctctctctggcttgtttgagcctcttcacctcgctgcatacacagcatacagacgt

SEQ ID NO: 20142 - DNA, 201 bp, Homo sapiens
ctgcactccagcctgggctacacaatgagactctgtctctaaaaaaaataaaatatctgggagggaaggtgcttattggtacctgttgcaggaactcttgkcacctgcatacccactgacattccaggaagtcagggcagggtgcagggagaaatgaaggggacattaaataaatgagtgctgtgggcattcagtggtgcc

SEQ ID NO: 20143 - DNA, 201 bp, Homo sapiens
gagccgtgatcatgccactgtactccagcctgggtgacagagtgagaccttgtcaatcagttagtcaacaagccaacaagcaaggtgcagtggtggttgcytaggaggctgaggcgagaggatcccttgagcaccggagtttgaggtggtagtgagctatgattgcaccactgcactccagcctgggctacacaatgagac

SEQ ID NO: 20144 - DNA, 201 bp, Homo sapiens
tcagaaatatgccaaatacatagaaaatgtgaataacagctctctggatagatgtttagttttatctttatccaaatagtgagaatataatttcatatttwaaaaaatcgaagtgtactgttaagcagtggctgagatgctaggtatcccagttgggagagggcagaggtttagctataactaagtgggcagatgccagaa

SEQ ID NO: 20145 - DNA, 201 bp, Homo sapiens
ctaatttaaatgagaagtaaaagccagtcaacaaccctcacaaagcaagaaagggtgactgaactatcccaaaaatacaatggacttaatgatggttaaawggaactggtgaagaaattagcaaaatgattatgcccctgcccaatcttccttcccatgggcgcacacacacttttatatgctaacccattcattggccca

SEQ ID NO: 20146 - DNA, 201 bp, Homo sapiens
atttatttcacacatgcaaaaactgaagaagtctttggggcaataaatctttttgatttcttttttttttttttttttttttgagacagagtcttgctctrtcaccaggctggagtgcagtggtgcgatctcggctcactgcaacctccacctcccaggttcaagtgattctcctgccgcagccttctgagtagctgggac

SEQ ID NO: 20147 - DNA, 201 bp, Homo sapiens
ttcatatcaaaaccaatgggatttagacaaaaccaacacagaggaaaatgccactacttacatgtggaaaatagggaagactgaaaataagtgaactaaaytgacaacataaaaactagacaagggacaatgaaataaacccaactcaaagaaagtaaaatgaaggtattattaaagacaaagcatatcctgaaatagaaa

SEQ ID NO: 20148 - DNA, 201 bp, Homo sapiens
tttgaaataaagtgtttattttctttctctttttcctcttttgggaggaagagcaatccttataccttgaaatgtgtcagattctaatatttggagtgggmcaaggccctccttcccctttcttatgattagttgaaatctgagtttgagcaagtcttgctgttttcagagaatgctctccttctcctgttcttccctcac

SEQ ID NO: 20149 - DNA, 201 bp, Homo sapiens
tgttggccaggctggtctcgaactcctggccttgtgatccacccgcctcccaaagtgctgggagtacaggcgtgagtcaccatgcccggccttcttctttwatttttttttaaagtagaggttgcaaactgacagcctttggaaagaatacagcctacaaatacttttgtttggcttgcacagtatttgtttattgttttt

SEQ ID NO: 20150 - DNA, 201 bp, Homo sapiens
gagacattcatgtctttctgacttctccattacctcctacaaaaggacatgaccccaggctttcaaaggatgcctttagatttatccctatgtccagagtyacatagacaggagggttctaactcagcaaaccaccggttcacttctgcttccgtttggctagaatttggtcagatagttctgtatcctggcttcctataa

SEQ ID NO: 20151 - DNA, 201 bp, Homo sapiens
gggagctgtgggggtaatttggaggtcttggtggaggccttagtgggatctgggaagaagcataggatgtctgggacatgggaggaggccatgtgcctccycaattctgttcctgccgagttagaactgctgtacgccagcctaggatccttccatgttgttctcccattcaagtagacctttttgcaattttaacaatcc

SEQ ID NO: 20152 - DNA, 201 bp, Homo sapiens
tgatcgtctttgcagtggcgatgcatagttcacatgaacatgctaaaggctctaaaaagttccacagtcaaagaatttacttaatgtttaactccacattycccaaatgaaactcatttttacccaggcagatcacatgactctaatattacgtgaaatcactttgggaaactgctttgtctacagtactcatctccacct

SEQ ID NO: 20153 - DNA, 201 bp, Homo sapiens
agacctcataatcttttaaaatattattaaattctgttttatttgtttctttcaaaaattaacagatttttaaaaattgaaaattgaattttcaaaaaatytctcaaaaatctttgagaaaaattgagatgggacaaagactctgtgccttgttcccccttagtgtgagtcctgagtacccagctgtgtggcccacagtct

SEQ ID NO: 20154 - DNA, 201 bp, Homo sapiens
agttaaatgtcagtgatcgtctttgcagtggcgatgcatagttcacatgaacatgctaaaggctctaaaaagttccacagtcaaagaatttacttaatgtytaactccacatttcccaaatgaaactcatttttacccaggcagatcacatgactctaatattacgtgaaatcactttgggaaactgctttgtctacagta

SEQ ID NO: 20155 - DNA, 201 bp, Homo sapiens
tttaattccagtgcttcctggcttaacaaacctgccaccattactaatgctaattaaataggtttctctgaggttgcccaacctgttttcctaagccaggraatggactcgacaaactcaaaagaatcaaaagatacaaatttaagaggaagaaaaatcactaattagtgaagtctgcttcctattcaatcaggagtttta

SEQ ID NO: 20156 - DNA, 201 bp, Homo sapiens
ttgatttaatggagctaggtccagtctcagatatctttgaggctttattcatgccccaaattattctcgtatttatttccccagtgtttgagaaggaacaytgggttcccaagactggttcagcccaaaggctggactggaaatatgtgggtctggctttccctaaactatagtatctgccaaaaaacccaccccctggat

SEQ ID NO: 20157 - DNA, 201 bp, Homo sapiens
ttaaataggtttctctgaggttgcccaacctgttttcctaagccaggaaatggactcgacaaactcaaaagaatcaaaagatacaaatttaagaggaagaraaatcactaattagtgaagtctgcttcctattcaatcaggagttttacagctcaccagattacctctcatccttaaagtctgtctggtcctcaggttact

SEQ ID NO: 20158 - DNA, 201 bp, Homo sapiens
gaacagacataggctgtctttgcttgtgtagatgacaattacaagactcttttctttaatttatgccctaaatgctataattctggattgaaagcgaagcwaaatttaggaaggcctaatgatgacacacaatgctctttcgcactcatgatacataacttacagggaaaggccctgactccctttttgcatagcgtcact

SEQ ID NO: 20159 - DNA, 201 bp, Homo sapiens
ttgcccaacctgttttcctaagccaggaaatggactcgacaaactcaaaagaatcaaaagatacaaatttaagaggaagaaaaatcactaattagtgaagkctgcttcctattcaatcaggagttttacagctcaccagattacctctcatccttaaagtctgtctggtcctcaggttactgtttagtaacagaattgatg

SEQ ID NO: 20160 - DNA, 201 bp, Homo sapiens
ctgttttcctaagccaggaaatggactcgacaaactcaaaagaatcaaaagatacaaatttaagaggaagaaaaatcactaattagtgaagtctgcttccyattcaatcaggagttttacagctcaccagattacctctcatccttaaagtctgtctggtcctcaggttactgtttagtaacagaattgatgtaagaatta

SEQ ID NO: 20161 - DNA, 201 bp, Homo sapiens
ctgtttagtaacagaattgatgtaagaattacttagagctcaggctgcactatcagaccgactggcagctatccatcagcaaagccacctgtccctaagakcatgtccgttcactctatgtatacatgcaactaaagtgtgtataatgagatattgccatccctgagctgaaatctaaggctgcctgctgccaaatctctg

SEQ ID NO: 20162 - DNA, 201 bp, Homo sapiens
ggcccagggtgggaaataagggatggatggggctggcatgtggagtattggggtgtaagagcagccccttagaaaaatgggggactaaattgaaagtttcygtagttcttggccctgtaagaggagaggggtagaagatgctgagtatttttctagaagactggactggacgggtggggctgggaggatgccggccgtagt

SEQ ID NO: 20163 - DNA, 201 bp, Homo sapiens
agatcttcctccatccctttattttgagcctatgtgtgtctctgcacgtgagatgggtctgctgaatacagcacactgatgggtcttgactctttatccartttgccagtctgtcttttaattggagcatttagcccatttacatttaaggttaatattgttatgtgtgaatttgatcctgtcattatgatgttagctggt

SEQ ID NO: 20164 - DNA, 201 bp, Homo sapiens
gccatagggtaccattaggacattgacttcaatatggcatgaataccaacatctgttagaatattccaagttggtgccaggactcatattttagtaaactrtaaaatcttccctccccatgcttgtacagtagacagggctacccatgatgtacgatgggtatcccacaatgagtcagttgatgtgggaacttcaattaat

SEQ ID NO: 20165 - DNA, 201 bp, Homo sapiens
agatcgagaccatcctggctaacaaggtgaaaccccgtctctactaaaaatacaaaaaattagccgggcgcggtggcgggcgcctgtagtcccagatactsgggaggctgaggcaggagaatggcgtgaacccgggaagcggagcttgcagtgagccgagattgcgccactgcagtccgcagtccggcctgggcgacagag

SEQ ID NO: 20166 - DNA, 201 bp, Homo sapiens
tctcccctacccataatcatcccgagtgtaccacctctcagaggaagtgaacaggcttccctgcagacaacaagggggaacaagtggacaaaagtcgactstgctctacccagtgttgctctaactgctgatagctgttcagctgggactgcttgcagctttttaatatttacagcattgaacggggttgccttgttcttt

SEQ ID NO: 20167 - DNA, 201 bp, Homo sapiens
atagctggtagaagccactgcggtattaacactcgttgatggcttagcaggcatggtgttctgtagaaagctatcagttgtttaccctcctaatcctatarctgactgggacctgcagctcactcccactgcccagcatcacaggaagtattgtaccacatattgctaccctgggaaaagcttttgaaataaaaaatttga

SEQ ID NO: 20168 - DNA, 201 bp, Homo sapiens
tagtaacagaattgatgtaagaattacttagagctcaggctgcactatcagaccgactggcagctatccatcagcaaagccacctgtccctaagatcatgkccgttcactctatgtatacatgcaactaaagtgtgtataatgagatattgccatccctgagctgaaatctaaggctgcctgctgccaaatctctgctttg

SEQ ID NO: 20169 - DNA, 201 bp, Homo sapiens
tggtggtgaaggttgcataacatgcatatacttaatcccccgaactgcacagttacaaatggttaagatggtaaactttctgttatgcatatttacaattmcacacacacacacacacacacccttcagtgcacgcaaaccctgctggactccaaccttcagagcttccgatttagcagggctgagtgggacctgaggatt

SEQ ID NO: 20170 - DNA, 201 bp, Homo sapiens
gaggatgaattcaccggatcccagcccttgcagggtgctgcaggatggtggggcaggtttggaaatagacaatgactgttcaccttagtaagtgggggccrgaggtgtgtgtacagagctggaagcacagagagggaggatgcctgtcaggggtactagagaaggcttcctcagggtgggaacatttgagctggctgttga

SEQ ID NO: 20171 - DNA, 201 bp, Homo sapiens
cagctgtcttgcccagtggagaaccttccagggcaagaagacagtcttgtctcaaccagtcattaacggccctgagtgtgagagtgtgaagggccgggccmcagccagctctgattccctggtgacatgctgctgttcaggaaatggtctcctgataacttctattgtgatttgttcagggaaaatgttgtttttacattt

SEQ ID NO: 20172 - DNA, 201 bp, Homo sapiens
tctgtttcttcctcgagtttcatgttcagctttttcctctccctccttgctcttactggtctctgtgacctccatctttttcctcatttctcaggaaatgrttgacttctgaagacagaaaatggagaaatgctagggaaaacaagagaggcaaagttttatagaaccaaatgctgagacagaagaggggtacagttgtgc

SEQ ID NO: 20173 - DNA, 201 bp, Homo sapiens
ccaccccaggctccagataagtctgggaggtagatctacagttccaggatgggatacttttttaaaaagtaaatgtaaatgtattgccatatttctcttgaaaaaaaattatcacaagaaaccaacaagaagatatcaaggctttttcttagatctgccagaagtctgtaatttgctctatcccttggattttagtgttca

SEQ ID NO: 20174 - DNA, 201 bp, Homo sapiens
ttttagtgttcacttgctgctttcagatgtggaaggaaaacctcagtccttttgccttgcctccttctccagttgcctcccctcagtgtgtctgccaagacctgagccccaggccagggcagcagcctctgacctttcactccctaacacacaagctggggaccaatgtcactccaaggttggaccctgcccccgtgcctc

SEQ ID NO: 20175 - DNA, 201 bp, Homo sapiens
aaaggagaagggccctgaaaggaaaagggcttcttcggagggcatttgtgtctgctcttggccttgcagataaaataccataatctactcttgcaaatcargccatcctggggtgcatggtcccccaaacactttcatctgccttttccttttgtgcctcatcactgccttgggagggggatcatgcatttgttattatcc

SEQ ID NO: 20176 - DNA, 201 bp, Homo sapiens
ataattatctttggatacaaggatcagtgacaagggtggcaccagtttgaggttggatagagagttgctaggtagatttcctcacagaaggtgtgagtgtgtgtgtgtgtgtgtgtgtgtgtgtgtgtgtgtaaggttgtgatggcctttgtgcaagattgtgtttttgcagatttttttgtgctagttcttgttatcagt

SEQ ID NO: 20177 - DNA, 201 bp, Homo sapiens
agctggtgaccctggagacacgcccttcaggtcaagtctctgtaaaacagcttattctggcaactaggaaattgagctcactcttgagctcagattatacraataactaatacatgtttagcgttttatggttaggaaatgctgtcctgagaagctcatcaataggtttattagttattggtatccttgttttattgattt

SEQ ID NO: 20178 - DNA, 201 bp, Homo sapiens
tttagcgttttatggttaggaaatgctgtcctgagaagctcatcaataggtttattagttattggtatccttgttttattgatttactaaaattacacagytgttcgggcctgggagttaaattctcttcaccagatgccaaatcctacgtttttcttaccacatcatggtgccacaggttaaggaatacagtgcagggtt

SEQ ID NO: 20179 - DNA, 201 bp, Homo sapiens
tgatccacccgcctcagcctcccaaagtgctgggattacaggcgtgagccaccgcgcccggccgctaccagcttcttaagaaaaaaaaagcactgaaagcrcttgtggtgctgtccttgggtgctcctttgcttttatctcagaggctggcacatttgtaggcaggactgtgagacacagtctcccctgcccccaggagtg

SEQ ID NO: 20180 - DNA, 201 bp, Homo sapiens
ggaggccagaggtatgtgggttaggaatgctatgggctgcagctaagagaaaacctggctgaggctttcaactatatgacctcaaattagctccctggagrtaggtggccccagggctggcttagtaacctaacaatggcaccagtggcaccaggggtgaaggctctttatctgtccttgccttgcagaaggccaaggcac

SEQ ID NO: 20181 - DNA, 201 bp, Homo sapiens
ttagatcttatgtgagtggagtgtggtgttcgtccttttgtgacgaacttacttcatttagcataatgtcctcaaggttcatcatgttgtagcatgtgacyggatctccttcctttttaaaggcagaataatatttcattgtatgaattcaccatgttttctttattcatctattgacggacatttaggttggttctatct

SEQ ID NO: 20182 - DNA, 201 bp, Homo sapiens
gcctaactgatgttagattttgagttactttaggttttgggtgggactagaaaagcagggagagctaggagaccacgcatgtgcaagcacacatagatatrtattgcccatcgttcctaaccctcctaagggcaggaggccagaggtatgtgggttaggaatgctatgggctgcagctaagagaaaacctggctgaggctt

SEQ ID NO: 20183 - DNA, 201 bp, Homo sapiens
ttttgtggtttaaactagacctactatggcttttaaggccaccattatttcctcaatgtggagaaactcagtaatgcaagttctctgttccacgttagggrtcacattatggttaaagacaatgggaagattttagagtttgacaggacctttcagataccacctagaacagcctcctgtctttcatgaggtccagagagg

SEQ ID NO: 20184 - DNA, 201 bp, Homo sapiens
taattatctttggatacaaggatcagtgacaagggtggcaccagtttgaggttggatagagagttgctaggtagatttcctcacagaaggtgtgagtgtgtgtgtgtgtgtgtgtgtgtgtgtgtgtgtgtaaggttgtgatggcctttgtgcaagattgtgtttttgcagatttttttgtgctagttcttgttatcagtt

SEQ ID NO: 20185 - DNA, 201 bp, Homo sapiens
aattatctttggatacaaggatcagtgacaagggtggcaccagtttgaggttggatagagagttgctaggtagatttcctcacagaaggtgtgagtgtgtgtgtgtgtgtgtgtgtgtgtgtgtgtgtgtaaggttgtgatggcctttgtgcaagattgtgtttttgcagatttttttgtgctagttcttgttatcagttg

SEQ ID NO: 20186 - DNA, 201 bp, Homo sapiens
attatctttggatacaaggatcagtgacaagggtggcaccagtttgaggttggatagagagttgctaggtagatttcctcacagaaggtgtgagtgtgtgtgtgtgtgtgtgtgtgtgtgtgtgtgtgtaaggttgtgatggcctttgtgcaagattgtgtttttgcagatttttttgtgctagttcttgttatcagttgt

SEQ ID NO: 20187 - DNA, 201 bp, Homo sapiens
ttatctttggatacaaggatcagtgacaagggtggcaccagtttgaggttggatagagagttgctaggtagatttcctcacagaaggtgtgagtgtgtgtktgtgtgtgtgtgtgtgtgtgtgtgtgtaaggttgtgatggcctttgtgcaagattgtgtttttgcagatttttttgtgctagttcttgttatcagttgtt

SEQ ID NO: 20188 - DNA, 201 bp, Homo sapiens
gattgtgtttttgcagatttttttgtgctagttcttgttatcagttgtttatgcatgaaaacctttccttcatggcgtcccacagctctatttgtcagggttttttttttttttttaaacataagtgactccattttgattctgacaacttttgcaattctaaggatctatgagctcttgggtgctgccaggagttagaac

SEQ ID NO: 20189 - DNA, 201 bp, Homo sapiens
cacctgaggtcagaagttcaagaccggccttaccaatatggtgaaaccccatctctactaaaaatataaaaattagcggggcgtggtggcgtgtgcctgtrgtacccagctactagggaggctgagacaagagaattgcttgaacccgggaggtggaggttgcagtgagcggagatcgccgcactgcactccagcctgggt

SEQ ID NO: 20190 - DNA, 201 bp, Homo sapiens
gtggtaggaggaggagagggagacagaagagaaatagcgtttctaaattttctatttgttactgaaatgtaacacatccaggaaagtgtccatatcatatrcagttatcacaaatttgtataatgtcactgaggttgaatgacaacattatccgcacccccagcaattcccctccctaattgcaaccctgctttctcctct

SEQ ID NO: 20191 - DNA, 201 bp, Homo sapiens
cccacctcggcctcccagtgctgcatagaattctgttgtattgctgtaccatgatttacctgtccactctagcactgatgggcctttaggtttcttcttgtttttttttttttttttttgatattacatatgcagctttgaacattttgcatgtctcctggtagaaatgtatgcatctctattaggtatagtcctagaaat

SEQ ID NO: 20192 - DNA, 201 bp, Homo sapiens
aaatgcccatggtttggaggcaggaatggtgttccaagagtagtagggagcctcgggactagagtttggaggatgagcggggagagtgggaggagatagtrggaaagtctgtggagccagttccctgaggggcctggtgggccatgctcagtgggggtttcatttgacgagccatgggaaggcttccagcaatgggggatg

SEQ ID NO: 20193 - DNA, 201 bp, Homo sapiens
ggaactagctatcatgtccacattccaagccaaaaatagaagaggacaaaatgacatatgccccctcccttttaactattcttcctagaagttccatatamcgctggccagaaattaattatgtatgtagatatacccacccactaaggaggctggggaatgcattattaaggaataagaggagggtaagtgttaagagac

SEQ ID NO: 20194 - DNA, 201 bp, Homo sapiens
ccacctcggcctcccagtgctgcatagaattctgttgtattgctgtaccatgatttacctgtccactctagcactgatgggcctttaggtttcttcttgtttttttttttttttttttgatattacatatgcagctttgaacattttgcatgtctcctggtagaaatgtatgcatctctattaggtatagtcctagaaatg

SEQ ID NO: 20195 - DNA, 201 bp, Homo sapiens
ttttgggtattacattttaactagggaaagatatgatcagatggatgtttttaaaagctcactttgcgctgggcatggtggctcatgactgtaatcccatyactttgggaggctgaggtgggcacattgcttgagcccagaagttcaagaccagcctgtgcaacatggtgaaagcctatctctactaaaaatacaaatatt

SEQ ID NO: 20196 - DNA, 201 bp, Homo sapiens
gtgtggtagtagcatgacttttggctggtagtacatttttagggactgttttcttgtgtcattcttacttactgtaagtttgcccttcgtatcagttcctyctctctcaaacactttcatgactgcctgctggcactgtctatccatgtggttgctcaggccaaaaaaagagtactttttacttctaattcatctgcagtc

SEQ ID NO: 20197 - DNA, 201 bp, Homo sapiens
gcttttattactattacaatcacctccattatcaccatcatgcttctagaaaggccaccaccatcacctggaggtacactggccctgattggtcttcttaygtctattatgcttttttaaaaattgtggtaaaagatgcataatataaaagtcaccactttaaagtgtgattcagtggcattagtgcattcacagtgttgt

SEQ ID NO: 20198 - DNA, 201 bp, Homo sapiens
gccttttacaccctcaccagcaatgtataagagtttgagttggtccccatccttgtatattcagtattgtcagtcatttttattttagccattctggtgtrtaattgtgtttctttgtgatttagagctgcatctcccatatgactaataaacacgttttcacgtgcccctcagccattgggacacttattttagcctgtt

SEQ ID NO: 20199 - DNA, 201 bp, Homo sapiens
tttgccgcagcagctggcaagtcaggcattgggctgagtggaggcagggagtggtaggaggaaccggcggggcaggagtgtggaggggaagtccaggtagytgtgcaagctcagggtgaccagaagaacagaagacctgctgaaatccaggctttgggatttagaacctgagggaaacatggggtgtcagcatgtgctggc

SEQ ID NO: 20200 - DNA, 201 bp, Homo sapiens
cgtgggctcgtctctgcagagggagatcaacctgaaaagatctgtttctgaaatatatgtgggtgaccaagggacggggtgcaggggaattctgaaggctyaggggaaggtcaggtgggtttcagcagtgagagacttgacctgcacagcatctgttatccccatgagccttcatgaccagtatctttggagttttgtcta

SEQ ID NO: 20201 - DNA, 201 bp, Homo sapiens
agtcagatctaaaaccagggaggtttgggaggcccaggtgggaggatcacttgaagccaggagttcaagaccagcctggccaacatggtgaaaccctgtcyctactaaaaacacacaaaaaaattagcctggtgtggtggtgcttgcctgtggtcccagctgaggctgaggtgggaggattgtttgagcccaggaggtgga

SEQ ID NO: 20202 - DNA, 201 bp, Homo sapiens
caggggcaggctgctgctagagttcttggacttcagagccaagagggtctgcttcaaaacgtggcttttaagaaatgtgcagacacacgtacatgtttgtktagacagagccatgtgggatgtagggctttgcctgttagtgtgaaacatttcttcagtgtttcctacagtgttctgatttgtactttggtgcttggacat

SEQ ID NO: 20203 - DNA, 201 bp, Homo sapiens
tgtagggctttgcctgttagtgtgaaacatttcttcagtgtttcctacagtgttctgatttgtactttggtgcttggacatttcctgttggatggcttaayggaggatggcaagcagccttctctgatcacttctaggagggttatttgcagttatcagctgctgggggtcagggggcatctctcgtgcctccatctgtag

SEQ ID NO: 20204 - DNA, 201 bp, Homo sapiens
aggataaggaaagaaagtcaaagtgagcccctagatagctgtaaacctggttctattgtactttgaaaacaaagcatttctcttgtcctccacagtgaggrcatcaggaagtaagcctcccctgggggaccatgcagataaaggcagaaggagtaggtcagaccccagaagatgggacttttctgattcaagaagttcagt

SEQ ID NO: 20205 - DNA, 201 bp, Homo sapiens
tcaatctttgcagtagaaagagaaatgtagaaatctgccagaaaatgtgctggcagtgaaatggagagtttggggagggaaaaatgggcaggccttatggwaatgtgataggaaatgaggtggaggtgaaaggtcaggtaactgtgggggcccagctctgggtgaggtgtcctagaattcagcaaggaaggcagcctcttg

SEQ ID NO: 20206 - DNA, 201 bp, Homo sapiens
ataacattcacaggttccacagatgaggacatggacatctttggggggcctgtcatgctgcctgtcctactccctattcttcctgctccccagccctaggsaaccgctaatctactttctgtctctagagatctactcactttttttattcctctgcatattctgtttcttcctcgagtttcatgttcagctttttcctct

SEQ ID NO: 20207 - DNA, 201 bp, Homo sapiens
ggcctagtagaccattgaaaggacttggcttttactcattgcaaagtacggaggggacaaatgacatgaccttctgcatctcctcccacgccttgggcccrcaggctgcctctgcactgttagtcctccctgacttcctgccccaggctcactgcccccatccatgttgcacacccctctctacctgcagccgccatcccc

SEQ ID NO: 20208 - DNA, 201 bp, Homo sapiens
gtggcttatgcctataaccccagcacttcgggaggttggggtgggcggatcacttgaggttaggagtttgagaccagcctggacaacatggtgaaaacccrtctctgctaaaaatatgaacattagtgggatgtggtggcgcacacctgtaatcccagctacttgggaggctgaggcagggcaatcgcttgaacctgggag

SEQ ID NO: 20209 - DNA, 201 bp, Homo sapiens
tcttttcacatagtcccatatttcttggaggctttgttcgtttctttttattcttttttctctaaacttctcttcttgcttcatttcattcatttgatctkccttcactgatatcctttcttctagttgatcgaattggctactgaggcttgggcattcgtcacgtagttctcgtgccatggttttcagctccatcaggtc

SEQ ID NO: 20210 - DNA, 201 bp, Homo sapiens
tgaaggaggtaaggggagagaaccatgtggagggatctgggagaagagcattccaggcagcggaaacagccggtgcaaaggccctgaggcaggagtgcctrttgttccagggacagtcaggaggccagtgtgtctagagcagaatgagggtgtaggtattaagagacgaggtcagagacatgacagaggcctgaccgtgta

SEQ ID NO: 20211 - DNA, 201 bp, Homo sapiens
gcagaggttttgtttttgtcaatttttcctttaagcttttctatgaggtataatactaaagcacttaacacacccagctgtgagtgcacagcccgatgggttttcacgcatgtacacttatgcatccccattgccagtactccggaaggacccctgcaccctttcccagtcagttcctctgcccttggtgagtgaacaact

SEQ ID NO: 20212 - DNA, 201 bp, Homo sapiens
gggaggctgaggtgggcatatcacaaggtcaggaattcaagaccagcctggccaacatggtgaaaccccatctctactaaaaaatacaaaaattagcctgrcatggtggtgggcacctgtagtctcagctactcgggaggctgaggcagaagaatcgcttgaacctgggaggtggaggttgcagtgagccaagatcgtgcc

SEQ ID NO: 20213 - DNA, 201 bp, Homo sapiens
tagggagttggcaaaatgggttgctaagttctaggtaaagggaacgctttaaagattacaaaactccttttttggtaatattaaaaaattattggccaggygtggtggctcatacctgtaatcccagcactttgggaggctgagactggcagatcacctgaagtcaggagttcgagaccagcctgaccaacatggtgaaac

SEQ ID NO: 20214 - DNA, 201 bp, Homo sapiens
gggaggggcaggggttcttattcctgttgcaggtagcccctactgctgtgtcgttcccctatttcctggggttcaactgcatagtctgagctaattccaaytggctgttttaaagagagcagactacgatcctgagtggcggggtgagtagtttggtgggaagggtggttacagaacaggtgactcaggatgatttgggtc

SEQ ID NO: 20215 - DNA, 201 bp, Homo sapiens
tcctgttgcaggtagcccctactgctgtgtcgttcccctatttcctggggttcaactgcatagtctgagctaattccaactggctgttttaaagagagcagactacgatcctgagtggcggggtgagtagtttggtgggaagggtggttacagaacaggtgactcaggatgatttgggtcagagcaagtgaccaggggtga

SEQ ID NO: 20216 - DNA, 201 bp, Homo sapiens
ctgttgcaggtagcccctactgctgtgtcgttcccctatttcctggggttcaactgcatagtctgagctaattccaactggctgttttaaagagagcagastacgatcctgagtggcggggtgagtagtttggtgggaagggtggttacagaacaggtgactcaggatgatttgggtcagagcaagtgaccaggggtgact

SEQ ID NO: 20217 - DNA, 201 bp, Homo sapiens
gatggagcaggtaaccagggtgacttaggttaaagcaggtgaccaggggaacagatctgaactactgattagaactggcgggaaagttgtttactgaaackagaggcaagggggccaaagagaaccaggaagttaaactttaaaatggaaaatcaaagaataagagagctgaacatattgacatactgattctttgaagag

SEQ ID NO: 20218 - DNA, 201 bp, Homo sapiens
cccagactcaagccatcctcccacctcagcctcctgagtagctgggactacaggtgtgcaccaccgcatccagctaatttttgtatttttgtagagatggsggtctcactttgttccccaggctgattttcaactcctggactcaagtgatctgcctgcctcggcctcccaaagtgctgggattacaggtgtcagccaccg

SEQ ID NO: 20219 - DNA, 201 bp, Homo sapiens
atgttttctgttttcagtggcatagaactagataaaaggtggcagtgcagaggatggaagtggtattgctcagtgggaaagggaaggcattttaggtttgrgacatattacaatattgccttttagcgtagaaaagccctccttcctgatgctcttgctagtgctgggtggaaagattccctttcaactcaacatgtgtga

SEQ ID NO: 20220 - DNA, 201 bp, Homo sapiens
aggaatgggtttctaagtccaagctgaggtagaatcctggcattgccatttactagagctgtgtgaccttagacaattcacttaacctctctgagcctcartattcttacctgttaacaagtggggatatgggttcccagggatgagggaccggtgaaatgatatgcctggagacagctaacacaatgcctggaaaatgct

SEQ ID NO: 20221 - DNA, 201 bp, Homo sapiens
cagtacttctgcagtgagatgaaactttggaggagtaaagttggtgtttgtaaattatctagcacagtgcttggcacacgttgcaggttgaatttatttgyttttccttacttaccctgtgttaatatgggttctccccaaaacagagcctgggtcaaggatctgagtgcatgtggttgatacacaaatgatcccaagagg

SEQ ID NO: 20222 - DNA, 201 bp, Homo sapiens
tgacatctagattggtgcttgaccagattctgggtactgtggcccagccaagttgacacataaaattagccatcagagcagccaaatagagggtgtcttaytgagcaggttaccactgtgggcagctggagctcagtcctgctggggaaccctggcagtcagtgtagaccgtgccccagaattaccccacatcaaggggca

SEQ ID NO: 20223 - DNA, 201 bp, Homo sapiens
cagcaggcgctggcagggtggaagacctggcagtgcctgatgctgcaggaatggccagacactgacccatgggcagggtcagagagcggaggaggtggaakaatgcacttaatccaggccacatggtgggtggaatgagcatgggttttggagacacatagatccagtgtgtatccagctggacacataattgtgacctct

SEQ ID NO: 20224 - DNA, 201 bp, Homo sapiens
cagactttgttccattcaccgtattggagggcacctccggagggtataggattttgtgataaggcacatcctcctgaggggagggcaggtactttctcacrgcctcactgtggtcagcagagctgaggcagctccagccacttccttggcttctctgcctcagagttcacacaccccggcttatcttccctcttccccgag

SEQ ID NO: 20225 - DNA, 201 bp, Homo sapiens
agttctttttcactattccttgatttatttaacctgtccaggtggtcttctatatgtcagttccagactaacctgatctgatgcttgtagactagttatcytagtttgcttctccagaagaggctcctcttctctcccctagatccatagtatcctggctgaggacccctgagagggcagcatggaggggccctggtgctc

SEQ ID NO: 20226 - DNA, 201 bp, Homo sapiens
cttggctttatgccttcatataccttttctctctactcatgtagaaactcttcttcagcttcatgttttaataatggaagaacttagtgatgtttcatatstagagatttttctctaggtccttctcatcgataagacctgtttcaagatatggcaagccctagttctgatctctggggtcctcaccatttatagacttcc

SEQ ID NO: 20227 - DNA, 201 bp, Homo sapiens
agagctgggatttttttttgtggaggaataggggagacttttctggtaaagaccagaaaacctgctagacaaattctaaaagagccataacactcagagckgggattttaacttcatcttctgcttcagggaccacattgttcccagtgtgtttaaacacctggctggtttttcacttggggttctcattcagattcgtga

SEQ ID NO: 20228 - DNA, 201 bp, Homo sapiens
atttcttttattggatgggtcagtggtttttcttacgagcataaggtagaaacttttttggaactaaattcttctcagtcagcttctatagttttcactgkacttttttttttttttttttttttttttgagatggagtctcactctgtttcccaggctggagtccagtggcacaatctcagctcactgcaacctccgctt

SEQ ID NO: 20229 - DNA, 201 bp, Homo sapiens
atcacttcacatgggaatcctaggactccatattatattcttatcctgttgaaaatttgaccttttaaagatttatttatatttagctcaggccttaaaarttccatgtactatctaaaaagggaaaagttcatcccagtcaatgtcctgtcttgcttatgtttaagttggataggaagaaaaaaatccacaccaggagaa

SEQ ID NO: 20230 - DNA, 201 bp, Homo sapiens
ctgggctacataggctaaactaagaagtttggattttatttacagtgctctgggaagcagggaagtgacctgatattgtagatattttcaaaaaatcactstgggcctgtggagtgaatggaggacaggagctggagtggaagcagatagcccagctaggaggcaagaacagtggacaagacggctggactagtgtggtca

SEQ ID NO: 20231 - DNA, 201 bp, Homo sapiens
ggggaggaagatggctaaatgtatatggtatttcttgttttctgctcttactcttcctacctccaaccccattccaaatttcctcttaagaaaaggaaggrgagtttgtttttctcagtagagtaagtagtgactgcctaggtggcaggattttggatggtagtggtgatgttacttattgatggcacatttgatgactgt

SEQ ID NO: 20232 - DNA, 201 bp, Homo sapiens
cttttttttttttttttttcctgctgagggatcttgtccccaaattaatgcttgaacaatcaacaaccaataatttctggtatccagggactcagacatgrcaaccagaattagggaagctgcacttgtattattaatgtggctttttaacccatagctgtttttttaccctcagatgtggccattggtgcacccaaggag

SEQ ID NO: 20233 - DNA, 201 bp, Homo sapiens
attttatccccattcatggaggggaagctgaggtacagaggcattattgcccaagttacatggctaatgagttgtcgagcacaggcctgtgcctttgcccmcccaggctgactgcctgtcaggaagtcaagaatccgagtttgggggcttcagggcgctcaaacatctgtcttgtgaagttctgttctgcctgctttcctg

SEQ ID NO: 20234 - DNA, 201 bp, Homo sapiens
tgcagaagataacaaatgggtgaatgtatctagcatggaaacaatctccctcttcccttcaaatgtacctgggtttgaaagcctaaaggtaaaggattcctttttttttttttttttgagacagagtctcactatggcatgatcttggttcactgtaacatctgcctcctggactcaagccatcctcctacctcagcctcc

SEQ ID NO: 20235 - DNA, 201 bp, Homo sapiens
gtatagcctctccagcgccgctgcgcggggtggggctccccaggggcagggtgtctgggatccactggggcgcactggagcccagagccccggcgcccccsccccccccagctcctacaagaccctgggtggaagtggagcggagaagctcctaggatatagggaagaggaaggtgagggagcacttcccagtgacaccgc

SEQ ID NO: 20236 - DNA, 201 bp, Homo sapiens
ttttttttttttttgagacagagtctcactatggcatgatcttggttcactgtaacatctgcctcctggactcaagccatcctcctacctcagcctcccargtagctcggaccacagacatgtgccaccatgcccagcaaatttttgtatttttttttgtagagatggggtttcaccatgttgcccaggctggtctcagac

SEQ ID NO: 20237 - DNA, 201 bp, Homo sapiens
ctgtaacatctgcctcctggactcaagccatcctcctacctcagcctcccaagtagctcggaccacagacatgtgccaccatgcccagcaaatttttgtatttttttttgtagagatggggtttcaccatgttgcccaggctggtctcagactcctgggctcaagggatccacccaccttggcctcccagagtgcgggatg

SEQ ID NO: 20238 - DNA, 201 bp, Homo sapiens
ctaccatgttgatggggaaatgagtgaggagagaattagaaacccagacatcttctgcctgattatagcagcagctagattgacttttgagagtgtacgcktgtgtgtgtgtgtgtgtgtgtgtgtgtgtgtgtgtgtgtgtgtcttgggaggcatggaggcatatgtacctaatgtctaggtctgtttggacagcagtgt

SEQ ID NO: 20239 - DNA, 201 bp, Homo sapiens
gttggccaggctggtcttaaactcttgacctcaggcgacctgcccgccttggcctgccaaagtgctgggattacaggcgtgagccaccacactggcctacttttttttttttttttttcctgctgagggatcttgtccccaaattaatgcttgaacaatcaacaaccaataatttctggtatccagggactcagacatgac

SEQ ID NO: 20240 - DNA, 201 bp, Homo sapiens
actcttgacctcaggcgacctgcccgccttggcctgccaaagtgctgggattacaggcgtgagccaccacactggcctacttttttttttttttttttccygctgagggatcttgtccccaaattaatgcttgaacaatcaacaaccaataatttctggtatccagggactcagacatgacaaccagaattagggaagctg

SEQ ID NO: 20241 - DNA, 201 bp, Homo sapiens
aaaaattttaaatgatgacgtttggccaagacaagtaataataaaggagtgtgtggccttcaactgcctgctaaagacttgctgatcacattaggattactttttttttttctttcaacaactttaagaccaagtgtcctagggaagctggaataaagcagtcacagttcttatttgtgactgtggtcttttcctgtgact

SEQ ID NO: 20242 - DNA, 201 bp, Homo sapiens
tcatctttgctctcttcattatcctgagcatcttactttggtttgtcaggattcttctcaaataaaacacactcctcaacttttacagttgaaaacaggctttttttttttcttcttttctttttttgagatggagtcttgctctgtcacccgggctggagtgcaatggtgtgatctcagctcaccacaacctccgcctcc

SEQ ID NO: 20243 - DNA, 201 bp, Homo sapiens
tcctcaacttttacagttgaaaacaggctttttttttttcttcttttctttttttgagatggagtcttgctctgtcacccgggctggagtgcaatggtgtratctcagctcaccacaacctccgcctcctgggttcaagtgattctcctgcctcagcctcctgagcagctgggatcacaggtgcacaccaccacacctggc

SEQ ID NO: 20244 - DNA, 201 bp, Homo sapiens
agtagtatgtaatggttccagtttgtccacatctagtccagcatttgttattgtttgtctttttgattgtagccattctaatgagtaggaagtagcatctytttgtggttttgatttagatttccctgaaggttaatgatgttgagcatcttttcatgtgattattggccatctgtatgtattttttggaaaaactattca

SEQ ID NO: 20245 - DNA, 201 bp, Homo sapiens
ggggccaggccacgtggggcctagcaggccagggcaatgtgctggaattttattctgtgtgtgagtggggaggccactgaaatcaattttgggtattacaktttaactagggaaagatatgatcagatggatgtttttaaaagctcactttgcgctgggcatggtggctcatgactgtaatcccatcactttgggaggctg

SEQ ID NO: 20246 - DNA, 201 bp, Homo sapiens
caggctggggccaggccacgtggggcctagcaggccagggcaatgtgctggaattttattctgtgtgtgagtggggaggccactgaaatcaattttgggtrttacattttaactagggaaagatatgatcagatggatgtttttaaaagctcactttgcgctgggcatggtggctcatgactgtaatcccatcactttggg

SEQ ID NO: 20247 - DNA, 201 bp, Homo sapiens
ccaatggccagttctaattattcccattgttctggcctgtctgccatattggacaaaattgatccttcctttcttgagactgtcctctgtgaccatgtggrtgactcctctctcgattttcctcttccttctctagccatgcttttccagtcttgttggctgacacctcctcatcttcaactcctaaatgtgagtcctcat

SEQ ID NO: 20248 - DNA, 201 bp, Homo sapiens
gcctgtgtcttactgatttcttttaccaaagctcagatggggagattggcaaggccactgaaatagtgactggcaactcggtttctttcctcctcaccctytgtgatttcaaccctttcctgctccgttctcctttgagaatgggtaatcagaggggaggaagatggccttggcatatcactggggaaggatttctgagcg

SEQ ID NO: 20249 - DNA, 201 bp, Homo sapiens
ttccagggacagagattcctgttctctcactttaaaaataacatatttccttgaatccccaaaacagttaaaaaataaaaagggttacggaggggatgacytctggcacagaaaagcagtaaaataggtgtattgacactgaagtcatatttctataatgaaatacatacctatctatttacttattgactctgaaataac

SEQ ID NO: 20250 - DNA, 201 bp, Homo sapiens
tgccatgtttaaatgttcttaaatttgggattgttgaagtctgaattttactgtgctttaaaattgtgatggaaaaacttcctatggattccaaagatttstgtaccactctattatcagggaatgactggcttttatttctagtgtgtgtttgcatttcctaggacagtgatcatttccagggaaggaaatagattaccc

SEQ ID NO: 20251 - DNA, 201 bp, Homo sapiens
ctgagacatagtagcctttagttatttttgtctaattcttctttccctgatacagtgcccaccataaatccccagtcatggtgctgacctggcatgtgaarctggctgggaggaaagagatttttctctcccagcaaagtagtaaacaggctctctcaagcattcatccatctggggagcttggcacacaggacagatcct

SEQ ID NO: 20252 - DNA, 201 bp, Homo sapiens
acaaaggcagggagacaggcccagcagggccggcagagcctgtagtgacggaggggagcagccttatctccgggaacccgagcgccccgtgcgcggcgggragggggcagttcggggcgccccggcgggtcccaggggctgactcccgcccgggaagtgcgcgcagggctcacggcccgcagggggcgctgccgcgccgtc

SEQ ID NO: 20253 - DNA, 201 bp, Homo sapiens
ggaaagagagacaaaggcagggagacaggcccagcagggccggcagagcctgtagtgacggaggggagcagccttatctccgggaacccgagcgccccgtscgcggcggggagggggcagttcggggcgccccggcgggtcccaggggctgactcccgcccgggaagtgcgcgcagggctcacggcccgcagggggcgctg

SEQ ID NO: 20254 - DNA, 201 bp, Homo sapiens
aggtgcacaccaccacacctggctaattttttaatatttttagtagagacaggtttcaccatgttgatcaggctggtctcgaactcctgacctcgtgatcygcccacctcagcctcccaaagtgctgggattacaggcgtgagccattgcgcctgacccaacaggccctcttaaaaccggggccatctggctgaaggtcca

SEQ ID NO: 20255 - DNA, 201 bp, Homo sapiens
ccctctcctgatagacaaccactgttctgacttctatcaccatagatccatcttgcccattctagaatttcacattggtgggaatatacagtatggactcttgtttctggcctcttttaatcagtgtgatgcatttgagattcgttcatgttggtgtgttgcttgtttttccccttactgagtagcactccattgactgaa

SEQ ID NO: 20256 - DNA, 201 bp, Homo sapiens
taattcccacatgctgtgggagggacctggtgggagataattgaatcatgggggtgattttccccatactgttcttatggtagtgaataagtctcatgagktctgatgcttttataaggggaaactcctttcacttggctctcattctctcttgtctgctgccatgtaagatgtgccttttgccttccaccatggttgtga

SEQ ID NO: 20257 - DNA, 201 bp, Homo sapiens
ctagatcagtgattaggccaagaacgtctttgagccattttctggtctcccaagtcccttaccctcttggaagagatcagaggtggtcaccctcagcttcrccctcatctatgtgaaccctgatgccctaaccctgtgcctacacccaagggtcctggagaggttgaagagacaagagggaggatgggaggctgctccagg

SEQ ID NO: 20258 - DNA, 201 bp, Homo sapiens
gccctcatctatgtgaaccctgatgccctaaccctgtgcctacacccaagggtcctggagaggttgaagagacaagagggaggatgggaggctgctccagrgatgagggatggggggatgaggttggtgagagtgatggaatctggtacatgggctgggggcgaggggccctcatcttctgagccaggccccaagatagga

SEQ ID NO: 20259 - DNA, 201 bp, Homo sapiens
ggctctttatctgtccttgccttgcagaaggccaaggcaccttgagcaacatgtcaaagggcatcccaactggttgtattatttaccttgaagtgaagtgwcaggatttgaactgtcagccctcagggagaagtgttccagctaccaggtttttttttttttttttttttttttttttttttttttttttttttttttttt

SEQ ID NO: 20260 - DNA, 201 bp, Homo sapiens
ctctttatctgtccttgccttgcagaaggccaaggcaccttgagcaacatgtcaaagggcatcccaactggttgtattatttaccttgaagtgaagtgtcrggatttgaactgtcagccctcagggagaagtgttccagctaccaggttttttttttttttttttttttttttttttttttttttttttttttttttttga

SEQ ID NO: 20261 - DNA, 201 bp, Homo sapiens
cccgcctcagcctcccaaagtgctgggattacaggcgtgagccaccgcgcccggccgctaccagcttcttaagaaaaaaaaagcactgaaagcgcttgtgrtgctgtccttgggtgctcctttgcttttatctcagaggctggcacatttgtaggcaggactgtgagacacagtctcccctgcccccaggagtgtggctgg

SEQ ID NO: 20262 - DNA, 201 bp, Homo sapiens
agtgttcaggaccagctcattagcgggacacaagctgctgtagcctctgtaaatactgtaggaaatacagactttctctgtaggaggtgaatctgccttgscctctgaaacaggcagagtccagtcaggaaaacaaaaaccataccagttattttaacagaggaaatttagcactgggaatgggttaaacaggtcatggac

SEQ ID NO: 20263 - DNA, 201 bp, Homo sapiens
acaattaactgctgttggggccagctgccgtgagaaactgttgctgggataagctgctaggaataggaagcagggaggaaggagcgagttcctttgccctytccagccttgcaggctccctccgatgctccatattagcagagcctcacagcaagcctctggcaaaacaagtgaggtttgcagggtcccagctccagtgtc

SEQ ID NO: 20264 - DNA, 201 bp, Homo sapiens
gttctagagatgaaatgcttccagaatgattgcacttggtgaattggataatgcggtatgtctgtgattgtatgttttaacattttagagaaatctgaaagtttaatgtgctggcatgcacacaccccgctggagaggagcagcagttgccttgtcctcagctcagtttctgtgaactgtgggttgtttctctcttccttg

SEQ ID NO: 20265 - DNA, 201 bp, Homo sapiens
gagagggagccaggagagtggagcacaggagggcagcaaggcaggctggggccaggccacgtggggcctagcaggccagggcaatgtgctggaattttatyctgtgtgtgagtggggaggccactgaaatcaattttgggtattacattttaactagggaaagatatgatcagatggatgtttttaaaagctcactttgcg

SEQ ID NO: 20266 - DNA, 201 bp, Homo sapiens
gttattaagcactgggatacaccagtgaacaaaaaaaacaaggatgctgccatccctagtcccataaattagtgggcaaaagagatattaagacaagtaaytgagagagaaaagaccagagggaaggtgagtatttgatttaatctagataggagggtcaagaaaggtctgggacctttcgacatgattagaaggatgcgt

SEQ ID NO: 20267 - DNA, 201 bp, Homo sapiens
ggaagaggaagttctcagcttcattgttactgctcagaggtaaggggggggtttaaacacttttttcaaagatgagagatttatgggaccaggaaaggatrtgtcctggttaagctttgatgaatcccaggatgctgaggaggaagaaatggttactcagtgataaagccttgagccgcaaagtggaattggatttcttgg

SEQ ID NO: 20268 - DNA, 201 bp, Homo sapiens
tatatttcttccctgacaggttactgtgggccaccagcctccttggtgacttctgttttgcagatggggaatttgttgattgtagtgagtacgctgtgtgyggcagaaaggattctgtcacctacagagagctagggaagcgcccaggctgaggaaacccaccccttcgaagcagccatccataggtagcctgggggtctt

SEQ ID NO: 20269 - DNA, 201 bp, Homo sapiens
acccatctactaatgcatcttcagctcacctccagccaggcgagaacagtcattcatcagaccccagcaattgttgcctgtcgtgttttcattaattgttrcctctctaatggatcattcccattagcttgcaaatatgctatgataattcccatcttaataaaaaagagcaaaaaaactccctggagcccacttccccca

SEQ ID NO: 20270 - DNA, 201 bp, Homo sapiens
tctgactcagcaaaccattttgtgtcctggtaattaatggtaatttctgttagtttgttttttagggtttctaatttaaatgagaagtaaaagccagtcarcaaccctcacaaagcaagaaagggtgactgaactatcccaaaaatacaatggacttaatgatggttaaatggaactggtgaagaaattagcaaaatgatt

SEQ ID NO: 20271 - DNA, 201 bp, Homo sapiens
gtgtttgacctactactgcccagcagtctaacatttctttgaacacctactttgtagcaggcactatgatgggtgttttataaacattcttttgcttaaaycttacaagaaaccttcttaggtacacttttattcctcctgttttacagaagaggaaaactgaggcttggagtgtttaagacacttgtctaagagacacag

SEQ ID NO: 20272 - DNA, 201 bp, Homo sapiens
atttctccatgcagcttattgacgtaacctaagatgagaagacactactattcatgcctggtcagaaagcacagactggctatgtaacagccccagcaggraagcactgggtgcaagacactggattaaattgagacaaatgtttgcttctcagaatggcagtgaccatgggtgcttgactgtgggtggggatgacagatt

SEQ ID NO: 20273 - DNA, 201 bp, Homo sapiens
gctgctggccgtgctgctctggaaggtgagtctggtgattgcaggtccccctggggtccccactcatagatgcccagctctcctgcctttccagggaagamggagtatcctgttagagcttccttcatggcaccggtacagtgaaggacagtgacccttcaggcagggagtggaatcttggctccccttgaggccattcac

SEQ ID NO: 20274 - DNA, 201 bp, Homo sapiens
catagtattgcctcattttgacctttttctctgcatatatagatatagaccaggcattctcataacatcaacttatttttgaatagtgtattagttaaatyttacagtaatatactcagcatattttcaggtgaagtacctctaaatttaaaagcagtgggttcctttttttttttaagtatggggtcttgttctgtcacc

SEQ ID NO: 20275 - DNA, 201 bp, Homo sapiens
cagtctcgctgttctctccattgtctcccttcctgagggaaggcagccattcacctgggaaggaggctggtcaggggaccccgaggagagtctgctcagcrgctgcctccaccacattggttcacccaactgtggcctctggcttgtcttccagcaatgtgtatctgtagccatgactttgcttaagcaaacttggaaatt

SEQ ID NO: 20276 - DNA, 201 bp, Homo sapiens
tcttaatcttctgcatttggacacttgccacagaggacattgtgattagcaaaggaaggcacaaaaattctaatccaaaggctttgcccgccttaagtccktttttgaaatggagctgatttaaatatgtaagtatggtcacagcattgacacttcagtggttatcgtaagcttatttgtacagtatgtgagatgcagttt

SEQ ID NO: 20277 - DNA, 201 bp, Homo sapiens
ctaatcgagcatttagtatgtgctggttactgtgagtcactacatgtgagatagttactgtttttatcctcatcttactgtttcaaagacaaggcatagargagtgaagggacttgctcacaaccttacagttgacaagtagcagaggtaggatttaaacccgcaagtctggctcctaagacttgggtttaaaccactaca

SEQ ID NO: 20278 - DNA, 201 bp, Homo sapiens
ctgagacaggagaattgtttgaatctggtaggcggaggttgcagtgagccaagattgtgccactgcactccagcctaggagaccgagcaagactccatctaaaaaaaaaaaaaaaaaatctttattttgaaataatagcagtcttacaaaaaagtcattaggatagcacaaagaaataccgtaaattcttcacccagattc

SEQ ID NO: 20279 - DNA, 201 bp, Homo sapiens
tagagaagagagggggaccaagggctgagctgtggacactccaacactaagagcatcttttcctcctacccctaaaatggctctggggctccagccattgtatgtgtttttcatgcaggaagaagtgggacatgcaaaggggctctttataatctggtctgaggcccctgtaaagagcctccagtgacttctgcttataac

SEQ ID NO: 20280 - DNA, 201 bp, Homo sapiens
agagaagagagggggaccaagggctgagctgtggacactccaacactaagagcatcttttcctcctacccctaaaatggctctggggctccagccattgtatgtgtttttcatgcaggaagaagtgggacatgcaaaggggctctttataatctggtctgaggcccctgtaaagagcctccagtgacttctgcttataacg

SEQ ID NO: 20281 - DNA, 201 bp, Homo sapiens
acatggtctcaggcaagttgcttcacctttactgctgagcttcagtgtcctcagctgaaatggggagcagaatactgacttcttagtaggggtctggtaamcactgggccccttttcccttctgctctaccctgcaaatcttttcctctttctaactgcctctgcatttggaaggggtcaagactcgtttcatagtttttt

SEQ ID NO: 20282 - DNA, 201 bp, Homo sapiens
gttgcttcacctttactgctgagcttcagtgtcctcagctgaaatggggagcagaatactgacttcttagtaggggtctggtaaacactgggccccttttyccttctgctctaccctgcaaatcttttcctctttctaactgcctctgcatttggaaggggtcaagactcgtttcatagttttttgggggattaaaaaatg

SEQ ID NO: 20283 - DNA, 201 bp, Homo sapiens
ggttcaaaaagggtaaataagttgtccaagaccacacagccattgtttggcagagctggggcaaaggtctatactgctgcaaagcttgtgatttttggctrctaccctctaatgttctgtgagggtggaacacctaacctagaatttccctgtggatcactcacccccaatgatggcatgtcttgctctggacccatgata

SEQ ID NO: 20284 - DNA, 201 bp, Homo sapiens
catcaacaacgtggggccaggcttgagtcagcagcactgactttatgtgacctagtgcagctcgccagcccacgctgatgtgtgttaatggagggggtgcmccttataggagggtggtgtgggctataatttcttctgcattctctgcctattgcttgaaggacagtgttgtcagcagtcaactgactgagcttgactttt

SEQ ID NO: 20285 - DNA, 201 bp, Homo sapiens
tgtgctgatgtaaatttggagttggtgggaatttttggactctgctgtgtggccctggggtttttgagtggaagaggtattttatgctccccaggtcttaraacctgacctgtggaaaggctgaggatgtttcagcagtttagacagggcaaactgctaattcttctcacctgtgaaaacagctggtcttatgaagcgcaa

SEQ ID NO: 20286 - DNA, 201 bp, Homo sapiens
ttgctggatggtggcctaggtacagagcagtgctgggctgcggaggaagccacgatgttctgtaaacacatagatacaagcacattcccgcgtgccacctygtgagtgtcatgcatgtgtgtgcatgcccccttatctctagcctgattttccattgcacaggatttgggaaaaacctttcatctgaccagctgatcagaa

SEQ ID NO: 20287 - DNA, 201 bp, Homo sapiens
cccctgcaatcctcttgggacatcattttagcaggggagactaccattgaacatgtaatgataaaattgattagttatgattgagatgagcagtaggaggraaaagtgtgtggaactgtgagagctcacgatgggcctgaacttgcccagggactcagagaagtggtctggatttgcttgttgaagggtgagaggacatgt

SEQ ID NO: 20288 - DNA, 201 bp, Homo sapiens
caacacagagctttggtgtccgagacacatccaagtgacaggcccaagagggcctctgaatgaagacggatgagccgtgtggacacagccacactatgttytcgtgaaggcataagaccatgggccaactttctgggcatccagggctggctgcagaggctggagtgagtggctttcaaggcaagactgataatgaaagtc

SEQ ID NO: 20289 - DNA, 201 bp, Homo sapiens
aagagttaacgtattgaacttgaaaggagagatttttttccctcttgtaataaatcaaacttttctgaatctggaaaagtgatggatgaaactatgtgagmacacacacacacacacatatacaccccataaccattttgaggtcatttaataagggattgctttctggataatctcgctccttgggtataaatctaatgt

SEQ ID NO: 20290 - DNA, 201 bp, Homo sapiens
aagcattcatccatctggggagcttggcacacaggacagatcctttctcttaagtgtcccaaggccaaccctgaaccatggaagccttcatttaccatcastttttctttcaaaacttctgcaagggcataaaaatgggggactaaatagggaccaaataagtgagtccatgctttggaaatgatgacctgagagtgtgag

SEQ ID NO: 20291 - DNA, 201 bp, Homo sapiens
gccatctctatcctccaacacagagctttggtgtccgagacacatccaagtgacaggcccaagagggcctctgaatgaagacggatgagccgtgtggacasagccacactatgttttcgtgaaggcataagaccatgggccaactttctgggcatccagggctggctgcagaggctggagtgagtggctttcaaggcaaga

SEQ ID NO: 20292 - DNA, 201 bp, Homo sapiens
ctgtgtccaagtgatgtcattgttcaagtcccacctatgagtgagaacatgtagtgtttggttttctgtccttctgatggtttgctgagaatgatggtttycagcttcatccgtgtccctgcaaaggacatgaactcatccttttttatggctgcatagtattccatggtgtatatgtcccgcattttcttaatccagtct

SEQ ID NO: 20293 - DNA, 201 bp, Homo sapiens
cctgggcccagcctgccgcggcactcgtgggaagtggctggctggctctgctggctccacgcacagctggcatacactgacatggctgtggtttgcttctmtctccttccttgcccctagagtataagaagaagtacggagaggaacacggctcctgccaggctgggatagcgggcttcttcaccgaggtgggtgtctgct

SEQ ID NO: 20294 - DNA, 201 bp, Homo sapiens
aagtctttgctattgtgaagagtgctccaataaacatatgtgtgcatgtgtctttatagtagcatgatttataatcctttgggtatatacccagtaatggrattgctggatcaaatggtgattctagttctaggtccttgaggaattgccacactgtcttccacaatggttgaacgaatttacactcccgccaacagtgta

SEQ ID NO: 20295 - DNA, 201 bp, Homo sapiens
ctagtgtctgtccatcaggaagccaggttgtaatgatcatgaaaataatagaggggaagaatgacagacctttctagtctatctgaaatagcaaaattacyagtaacaaatcattcttgatttgttcacaaacactggctcagcaagtacctattacgtgccaggctccaaggagaggaataagtcccacatctgccccag

SEQ ID NO: 20296 - DNA, 201 bp, Homo sapiens
tgtatagtgtaagtgctgacctgagggcctgtggctctcctgtagtgagggaggatccaactggagtatgacttccacctctgcatggccagcctggtgaygtgaagcacatttcttatgtcaggttcccagtttcctcttctgtaaaatggaggcagcatgggattgtaatgaggattaatggagctcatttacctgaac

SEQ ID NO: 20297 - DNA, 201 bp, Homo sapiens
gcatgcagttatgtctgggttacgtgtgaaacgtacatctggtgaactgtatacttggctcaaacttctcaaaatttagaggtgctggaaaggattgtcasttggagcctttagtagacaaaaggcagaaagtgagcatcatttcagaaatgctttagtatgcacacttttagctgatattttgatatatagaataataat

SEQ ID NO: 20298 - DNA, 201 bp, Homo sapiens
  misc_feature (1)...(201): n = A,T,C or G, or insertion/deletion polymorphism (see Tables 1-2)
aggcaccattctaacctctttacccaagttgtctctgctagtcctcaccacagccctgggaagtgtgtgctgtcatatacccatgaagaaactgaggccangaaaggaaagcagctctgcccaaggtgttataagcagagagcaccgagacaggacccaagcccaatttgtgttgactggggaatcagtactcagttctct

SEQ ID NO: 20299 - DNA, 201 bp, Homo sapiens
gaaaccttggtggaaatgaattctgtttttggtggagtgcgtgaagttatttccctccattagtttgtaggccagaggttgaaaactagtggcccgcaggmtgagtcttcctcaccgtcccactttgcttgcctggcaaagtgttaacctatacaattgccaatattggaaaactgggatactttgtttacaaatctttat

SEQ ID NO: 20300 - DNA, 201 bp, Homo sapiens
ataaagaagagcgatgatgccaaaaaacaacactagaaatactttttaaagaagtaccatacttatatgaagatttaaaatttataacatcttttgagctgggcatggttggctcatgcctgtaatcccaggactttaggaggctaaggcaagaagatccttgagcctaggagttcaagaccagcccagacaaggaagtaa

SEQ ID NO: 20301 - DNA, 201 bp, Homo sapiens
aatagtaattgccttactttatttgcgaaggggtggtgaacactaatatgcctgactccatagagcagtgtatttggttttcttaagcaggaagaaggggsccccccccaattttaatttactgaatgagtttaagaaccatggtgtatttcccaagcttcgctagtgaagatggtattttgttaaaaattgagattccca

SEQ ID NO: 20302 - DNA, 201 bp, Homo sapiens
atagtaattgccttactttatttgcgaaggggtggtgaacactaatatgcctgactccatagagcagtgtatttggttttcttaagcaggaagaagggggccccccccaattttaatttactgaatgagtttaagaaccatggtgtatttcccaagcttcgctagtgaagatggtattttgttaaaaattgagattcccat

SEQ ID NO: 20303 - DNA, 201 bp, Homo sapiens
gggaaagggaaggcagcagattggtgtcctggcccatccacttcaggtgagaaggatgcctgctgtcctcgtgtggacacaacttcctctgctctccttggccttgccttggcctctttgctttaggatatgatgcccagaagggctcgaaactggagtctgaccaggggcaagcaggctgcctcttgctcctccccagaa

SEQ ID NO: 20304 - DNA, 201 bp, Homo sapiens
ttcacagacagcttgaccacacacagggagctcaggaagcagctttgttggaaaaatgcagggcacttaaactgccacaccaggagggggtttggagaggytggaaagagcatgccattggacacagacactctgggttcaaatcccagctctgccacttactggtggtgtgacccaacatctctgaatggaaaacacatg

SEQ ID NO: 20305 - DNA, 201 bp, Homo sapiens
caagcctgggctgctttctgcccagtaagggatgcggacaattcctggggtttccccgtggtggacacacagtgaagaatttgactcatgtaaccaaaacrtgggtccctggggaagctttggctttgggatcaaatgctgaaagcaaacctaatgggtttaaagtttttaatccccagttgctgtccttgatctggctat

SEQ ID NO: 20306 - DNA, 201 bp, Homo sapiens
atttctgttctttttacttcctacttgcaaagactctggaaatgtaatgatggttcagagtgttctgctataaatcctaacagcttaaacaatctcctggratcatattggcaaactctaagatgatacaagtatagacttagtttgtctgagcccgaggttcagtgtttggagaaaaataatacctatgtcgagataata

SEQ ID NO: 20307 - DNA, 201 bp, Homo sapiens
aagtggccaaggttgcagtttgcaagaaatggagcttggaccccctctgaccttgaactggctgacatcaaagttgtcgctttgcctggtcctgtcacctstcttcctcagatgtctagtgtttattagacctccatagtatcttcaccaactgagaaggtgccccatcagcctgaggaactcccagggtcacccctctac

SEQ ID NO: 20308 - DNA, 201 bp, Homo sapiens
gtagaattggcagatgccttgaggacaattgtggcgtacagtaaacatacctcaatatacttatttctgtttgggattttcgcccctcaagtcctcattgygttattagccctgagctcttaagttttgtcttcacagagtcataagacttccagaaattcagcttagaaactcaagaacttagctttttagccactgctt

SEQ ID NO: 20309 - DNA, 201 bp, Homo sapiens
agaaatttttggtttccacaactagttcagcgctattagcatctagtgggtatgccagggatgctgctaaataccccacaatgcacaggacagctccccayacaacaaggaattatccaacaatgcacaggacagctccccacacaacaaggaattatccaacaatgcacaggacagctccccacacaacaaggaattatc

SEQ ID NO: 20310 - DNA, 201 bp, Homo sapiens
caggcctaatgctgacaccactccactgagagaaagaagcttgcttccgggtgcctgcaagagatgacagtgccttcaccttgttgttagcaagaattgcrtacataaaaacttgagcacatgaaagccacatgtaagagtgagttcaggtgctctaaatcctttccagattgttaacacactgtctatgtcaaatcctta

SEQ ID NO: 20311 - DNA, 201 bp, Homo sapiens
agagaacagaagctaatttacttgcctgggtcaccaggcagtcaaggcggagcaggcctgaggcatccttgcaacattagaaccagaacaacatttcattmttttatgttaaacggactctcctgcctggacccaggcccacgttagcatccagagtggcatgcagtggcagaattggagctggaacagccctcatttgtt

SEQ ID NO: 20312 - DNA, 201 bp, Homo sapiens
aaataacagtttttcgtttaataatggcattttgtattaccaagaccttgcttcacattaggtgttttgtatacattatctcatttaatcaaaaccagcastctatatcatgggtgccaccattcctctgatttttgctaaggaggaaactgaggttcaaaaagggtaaataagttgtccaagaccacacagccattgttt

SEQ ID NO: 20313 - DNA, 201 bp, Homo sapiens
ggaaagggaaggcagcagattggtgtcctggcccatccacttcaggtgagaaggatgcctgctgtcctcgtgtggacacaacttcctctgctctccttggccttgccttggcctctttgctttaggatatgatgcccagaagggctcgaaactggagtctgaccaggggcaagcaggctgcctcttgctcctccccagaaa

SEQ ID NO: 20314 - DNA, 201 bp, Homo sapiens
gaaagggaaggcagcagattggtgtcctggcccatccacttcaggtgagaaggatgcctgctgtcctcgtgtggacacaacttcctctgctctccttggccttgccttggcctctttgctttaggatatgatgcccagaagggctcgaaactggagtctgaccaggggcaagcaggctgcctcttgctcctccccagaaag

SEQ ID NO: 20315 - DNA, 201 bp, Homo sapiens
aaagggaaggcagcagattggtgtcctggcccatccacttcaggtgagaaggatgcctgctgtcctcgtgtggacacaacttcctctgctctccttggccttgccttggcctctttgctttaggatatgatgcccagaagggctcgaaactggagtctgaccaggggcaagcaggctgcctcttgctcctccccagaaagg

SEQ ID NO: 20316 - DNA, 201 bp, Homo sapiens
gaaagcttcttagagcaaatttaaactctacaaactttggtcagggatttgaacacatatttccttccccctcagtttctctcacacagacactgctgatytcagtaatggccctaaactttcttttctttttcttttgcattttcttctttctgcacatgtatgaatgcaagctgaatagtcaagttcctgaaatgggtc

SEQ ID NO: 20317 - DNA, 201 bp, Homo sapiens
aagggaaggcagcagattggtgtcctggcccatccacttcaggtgagaaggatgcctgctgtcctcgtgtggacacaacttcctctgctctccttggccttgccttggcctctttgctttaggatatgatgcccagaagggctcgaaactggagtctgaccaggggcaagcaggctgcctcttgctcctccccagaaaggg

SEQ ID NO: 20318 - DNA, 201 bp, Homo sapiens
agggaaggcagcagattggtgtcctggcccatccacttcaggtgagaaggatgcctgctgtcctcgtgtggacacaacttcctctgctctccttggccttgccttggcctctttgctttaggatatgatgcccagaagggctcgaaactggagtctgaccaggggcaagcaggctgcctcttgctcctccccagaaaggga

SEQ ID NO: 20319 - DNA, 201 bp, Homo sapiens
ccatagcaattagaatcttaaaatcaaaattgatggctttatttttctaaaaatgggaaaatatctccaaaacattgttcaaaaacaaaacaaaacaaaamaaaaatgtttgttcttatatcccatcagtttattcaactaacattcactgtggactttttataaggcagtaactgttttatgaataggagatataaaact

SEQ ID NO: 20320 - DNA, 201 bp, Homo sapiens
gtcttatggttgttttaagaaaagaatgataattggtgcataactcccaagtcacatatacagaccagggtccctgtgtgccccaggaaggtctttgtggkttctttggcagagatgagcaaagggtacccttggaactgttttctgtggagtcctctaccttcctgtttctttgagggtttaaccaaaggtggcatttaa

SEQ ID NO: 20321 - DNA, 201 bp, Homo sapiens
attcagctatttctactaacagaaagtgagtttatgggataccaatgcaaacaaacatagatttagtggaaaatgactcaaccaagtaagatttacaaaamaaacaaaactgttttcatcatctttggttgtagttttataaagaatgctggttcatggactccagacacttcattgaaactgtgtgaatcattttaaaca

SEQ ID NO: 20322 - DNA, 201 bp, Homo sapiens
ttaatttgagcttggctagagggagaaagcgtgtgtgtttctgtgcacaagttacactcaacacacaccctctggaaggtgggggtaagcttcagtcccgrctgtccgtacagagtgtggttcagaggctgccctttaacctgtgtggccagagagaataaatcaagccagcagtgctgtctccctgctgactgaaggcgc

SEQ ID NO: 20323 - DNA, 201 bp, Homo sapiens
cagagctacttaatattgtatttaccccagaggaagattatttttttcattctctaaattgtttaattaaaactcatagttcatgttaaatttgttcaaastttccatctaatggtgaggtggtaaaggaaataaaacttaccaaaatagaagagggagaaatgaaaaggaaatatgatcaatgatttctgttctttttac

SEQ ID NO: 20324 - DNA, 201 bp, Homo sapiens
cggctgtccgtacagagtgtggttcagaggctgccctttaacctgtgtggccagagagaataaatcaagccagcagtgctgtctccctgctgactgaaggygcccggccttatcaaggagcccaaatgtcttgtgctcacagctgctgtgacatctggaagcattaacactttgttgccagcatgtaggctagttgaatgc

SEQ ID NO: 20325 - DNA, 201 bp, Homo sapiens
tttgatgaaagtattggaattttgatgaccttttttattacaggtttgggagcaactactttcttcactctctaaactgcaaatcattcagggtaattgtsctggttcagttagcccccaagctgagaagacaggcccactgtggtttgagtaacttggaaatcttgtggggtcagtgttttgactctcttcattttggtc

SEQ ID NO: 20326 - DNA, 201 bp, Homo sapiens
ttttgtgagtggctctaaaaatgggggcaaaacatgaccctgaggaggcctggggctgatctgagccttaagacttatttgtggagaccttgtgctgttctttttttttttttttaattatactttaagttttagggtacatgtgcacaacgtgcaggtttgttacatatgtattcatgtgccatgttggtgtgctgcacc

SEQ ID NO: 20327 - DNA, 201 bp, Homo sapiens
tggtacagagcttgtgcccaaccccagcagagaagcactaagggggggttggtgccctccttggccacatcctctggaccagagggtataaacagccacayagtggtcacttcttgataggagagagagttaggctgcgggaagttcccccgttcaaggtcgtgcctcatgggggcccaggtgacagccaggccggggttg

SEQ ID NO: 20328 - DNA, 201 bp, Homo sapiens
gccagatgcccagggtctactttgtgctgctgggagagaccatgggtcaggtcacagagaagctgcagctgacttacatggaggagacgtgtcgtcactaygtggcccatgtgaaggtcagtcctctcctcctttttatcctcaaactttgatctctgcagatgttcacttggagctggtggaaactatttttattatgta

SEQ ID NO: 20329 - DNA, 201 bp, Homo sapiens
ctcttgcctgcaggctctatcctcctctctctattttttttctttaggtacttctggcttttgcagacacttgctccctgagaattcagtggtgactttakgaattgtcctcagaaattctaaatctctgcggcaggatctagcctccagggacttgtcagagccagcagcttctgccagtgcgtgggctcgtctctgcag

SEQ ID NO: 20330 - DNA, 201 bp, Homo sapiens
tttagaaatctgatgcctgctgttacaggcctgtcaggactttaccactcataggttctaagaaatctcccctccccacctcattctgttttgtttttagyccattctggatttctgcactcatgcatgcctcatgtgaccagggataggcagggagaaaaactcaaggggctggggttatgtgtacatcttcatggtatt

SEQ ID NO: 20331 - DNA, 201 bp, Homo sapiens
ttgcttgttttcgtcaggtttgtcaaagatcagatagttgtagatatgcggcattatttctgagggctctgttctgttccattgatctatatctctgtttyggtaccagtaccatgctgttttggttactgtagccttgtagtatagtttgaagtcaggtagcgtgatgcctccggttttgttcttttggcttaggattga

SEQ ID NO: 20332 - DNA, 201 bp, Homo sapiens
tgtggtttttgtcgctggttctgtttatatgctggattatgtttattgatttgcgtatgttgaaccagccttgcatcccagggatgaagcccacttgatcrtggtggataaggcttttgatgtgctgctggattcggtttgccagtattttattgaggatttttacatcgatgttcatcagggatactggtctaaaattct

SEQ ID NO: 20333 - DNA, 201 bp, Homo sapiens
tcttttcttcattagtcttgctagcggtctatcaattttgttgatcttttcaaaaaaacagctcctggattcattgatttttttgaagggttttttgtgtytctgtttccttcagttctgctctgatcttggttatttcttgccttctgctagcttttgaatgtgtttgctcttgcttctctagttcttttaattgtgatg

SEQ ID NO: 20334 - DNA, 201 bp, Homo sapiens
ataaatattttccatccacaatgtactatatatgcctaaatatagggcaagccccaaatagcacatcctccatttccctaattagataaatttaactctcttttttttttttgccaacttaataggaatcagaactatgattgcctttgaggtggggggagtgggcagtgggaattgactggcaagggactggtgggaact

SEQ ID NO: 20335 - DNA, 201 bp, Homo sapiens
gactctttatccaatttgccagtctgtcttttaattggagcatttagcccatttacatttaaggttaatattgttatgtgtgaatttgatcctgtcattakgatgttagctggttattttgctcattagttgatgcagtttcttcctagccttgatggtctttacaatttggcatgtttttgcagtggctggtaatggttg

SEQ ID NO: 20336 - DNA, 201 bp, Homo sapiens
tatttcctgaatttgaatgttggcctgccttgctagactggggaagttctcctggataatatcctgcagagtgttttccaacttggttccattttccccgycactttcaggtacaccaatcagacgtagatttggtcttttcacatagtcccatatttcttggaggctttgttcgtttctttttattcttttttctctaaa

SEQ ID NO: 20337 - DNA, 201 bp, Homo sapiens
gaaatgatgattaagataggacaattggacaaaaaggctgggccttcttaggtgggtattgagtgggaagtgattcaagaggccagacattctgtctggayattagctggaagtggggctggacaagatgaactagagccctcttgtggtcccatcattcaggcctgtagctttcatttgagaccagtggttcttaaactt

SEQ ID NO: 20338 - DNA, 201 bp, Homo sapiens
gggacatttaagtctgcagaggtttctgctgccttttgtttggctatcccctacccccagaggtggagtctacagaggcaggcagacctccttgagctccrgtaggctccactcagttcgagcttctcagccactttgttaacctactcaagccttggcgatggtgggcgcccctcccccagccttgctgctgccttgcag

SEQ ID NO: 20339 - DNA, 201 bp, Homo sapiens
ccttatgggaggcatctcagcagaggccctttttgggggcaggagggattgcatagcaatactgcctacccagagttgttgttcccaggctagggtccaamtcagggcagggagatctactggaggcagcgtatcacacactagttgtccaagagatggagagagagtgcaaaatctgagctgtgcttatgggaagctcgg

SEQ ID NO: 20340 - DNA, 201 bp, Homo sapiens
tccaggtgccatctgtcacccctttctttgactaggaaagggaatgccctgaccccttgtgcttcccaggtgaggtgatgcctcgccctgcttcggctcaygcttggtgtgctgcacccactgtcctgcacccactgtctgacactccccagtgaggtgaacccagtacctcagttggaaatgcagaaatcgcccgtcttc

SEQ ID NO: 20341 - DNA, 201 bp, Homo sapiens
cgacgcccgcattccgcccgtgtccaggcgcagagctcccgccccggggagcttcctggccgtcggcgggccccgcggcccgcgcgctcggcgccctgctygccgggcagaggggaaggcggcggccggctggggatgggcggcccggctgcgccgaggggcgccgggaggctccgcgcgctgctgctggcgctggtggtc

SEQ ID NO: 20342 - DNA, 201 bp, Homo sapiens
ttgctattcttaaatattgagtgtccaaaagattcgtgaactgcatctcagctgggtgggaccctttgggacaggagtaggggaataatgccgtcgttaaytgcaaagaggagttttgggaccaggttgtcttataggtttattttgaacaactgataggcttggtattgctggaagtggatagatttgggttgcctgtgt

SEQ ID NO: 20343 - DNA, 201 bp, Homo sapiens
gcccaatcaaagccagagatggagggacagattagtattgaaatgatgttcttggtcacttctggttccagatggccaaccaagcacaaatgttgatgtctgtgccttggtaccccattgcaatgattataaatgagtagatcggaacagggaggacaacactgtgaaagaaagggcatcagctaataataagagtccagt

SEQ ID NO: 20344 - DNA, 201 bp, Homo sapiens
tgcagctgccttgagaatgcatatcattgaataatgttagtgggaggttttaaactatctgaagatcacacaactgtgagagcccagctcccctgaaatgygtagggttggtcagtgattttgctatgcgccaaagcagctgccttgatccctcagagccccggcatttctgcccggggtttggccacccctggccttggc

SEQ ID NO: 20345 - DNA, 201 bp, Homo sapiens
cccaatcaaagccagagatggagggacagattagtattgaaatgatgttcttggtcacttctggttccagatggccaaccaagcacaaatgttgatgtctgtgccttggtaccccattgcaatgattataaatgagtagatcggaacagggaggacaacactgtgaaagaaagggcatcagctaataataagagtccagta

SEQ ID NO: 20346 - DNA, 201 bp, Homo sapiens
ttatttcatgccccaaattatttcaaatattgtataaagttacctttataggtcatgtgtagaaggtgtatataaacataaatgaatatgaagtttagccyttagtcccatcctcaaagtatctctttattatatggagatatttcaaaatctgaaaaaatccaaaatctgaaagacttctggtcccttatatttcaatta

SEQ ID NO: 20347 - DNA, 201 bp, Homo sapiens
aatcaaagccagagatggagggacagattagtattgaaatgatgttcttggtcacttctggttccagatggccaaccaagcacaaatgttgatgtctgtgccttggtaccccattgcaatgattataaatgagtagatcggaacagggaggacaacactgtgaaagaaagggcatcagctaataataagagtccagtaatt

SEQ ID NO: 20348 - DNA, 201 bp, Homo sapiens
aagtcaaaatagtacaatagtccccccttatccattgggaatacattctaagacccctagtagatgcctgaaactgtgggtagtcctgaaccctttatctrctgttttttcaatctgataactgagacagctagtaagggattaatgggtagtagtgtaatagcatggatgtgccggacaaaggtgtgattcccatcctgg

SEQ ID NO: 20349 - DNA, 201 bp, Homo sapiens
cggtggcgggcccgacgcccgcattccgcccgtgtccaggcgcagagctcccgccccggggagcttcctggccgtcggcgggccccgcggcccgcgcgctsggcgccctgctcgccgggcagaggggaaggcggcggccggctggggatgggcggcccggctgcgccgaggggcgccgggaggctccgcgcgctgctgctg

SEQ ID NO: 20350 - DNA, 201 bp, Homo sapiens
tgatcactctgtgttctcaagacaagcaatgggtaagaagacaaggccacggaggtcaaagatacagaaagataattgccatatatgctatgcagccagtkcccctacctcatgtgattgtagagtggttcttacactagggtggcatagaatcacctgaagggcttgtttaaacagatcatgggtggtgggtacagcatt

SEQ ID NO: 20351 - DNA, 201 bp, Homo sapiens
ttgaagctgcagtgagctggactactgtacttcagcctgggagacagagaccctgtctccaaaaaaaaaacaaaaaacaaaaaacaaaatttccaaattaytagacacttaaattttaaaggacagtaagtcccaaactgtgagaaacttttataggcaacatcctcttttctaatagtttaacttgaggatataaacctt

SEQ ID NO: 20352 - DNA, 201 bp, Homo sapiens
gacacatcatcaagatggatatacttgcccctttaattcaacaggcacctgttgaatgcctgtgcatgcaaacatgatgctgggctgagccctggggcttmccctgaagagctttggagcccacagcagaactcccagccaggctcatccaccactacagccacaaccatccctacctggagaaaggggctaaaagaagcc

SEQ ID NO: 20353 - DNA, 201 bp, Homo sapiens
tcttcataccagcatttcccaaagcattttttcaaaggatagtaacgacttttatgtcaaaaaacaaaacaaaattttgaattcaaattaattttggaacrtaattgaatttaacgcaggctttttattgcaggacttcatggagctttagaagcccaggcacgcaaggaggatgcactgtttggcatttcctaaatgtac

SEQ ID NO: 20354 - DNA, 201 bp, Homo sapiens
atgttatcttttacatttagattagtgatccattttgagttaatttttgtgtgttgtccaggatagtttcaaacagttgtgcaaaacaattctgtttgttkgttatcatgggtagactaatacctgtcagatcatataacccgacagtcagctggaaacacttggtcacatgagattgcctatctacattttaaatttggc

SEQ ID NO: 20355 - DNA, 201 bp, Homo sapiens
gagcgtggcctcagcctgatgctgcaagggggatcagaggtgtgagttacgccaaggtactgttccatctccagcttaggaagctgagttttgttctcccrtaaacaccagtcattggttaagggccacttagggaggaataagtggtagaaagtggtcctaggcactttccacccaggggtgaagtgtagacagtggggc

SEQ ID NO: 20356 - DNA, 201 bp, Homo sapiens
ttggagccaaacgaagactgaagccacagtgtgcatgtaaagggagtccaaggagcattgggtggggcattgaaattgtttgctacagtcggtttaccttyaactggtttccttcttgttctgaaggatatattacaagcatattgacaaaagtctttgaactcttgaggtgtttgtatgatattctgtgtcagttgcaca

SEQ ID NO: 20357 - DNA, 201 bp, Homo sapiens
acctgagagaggtagtttgtgagtgtgtatccctgagatacgtagcagaactggggaaggactgcccagtgagtctactcccttcagtatttgtcagatcytgctcaattataagatgatctttatctgtccgccttatctatcttcactgacgtgtatttcttattttcacaaaatgaagccatttcaacgatgttgtca

SEQ ID NO: 20358 - DNA, 201 bp, Homo sapiens
gaaggcaaatatatagagtgggttttggagccctgaacttagtcatgggtggataggggtgggctgaggagggggtgcaacctctgccttccctccccacrcccccatattctgagatggtagagaaccctttcattcctccagcctgtctctttcatccctctatggactgagacatctccctttacaccagttttttac

SEQ ID NO: 20359 - DNA, 201 bp, Homo sapiens
attttagccattctggtgtgtaattgtgtttctttgtgatttagagctgcatctcccatatgactaataaacacgttttcacgtgcccctcagccattggracacttattttagcctgttcaagtcttctgcactcccttcttctggggatacttttcttctcctgtgctgtggtacactcctcaccccaattcttctcac

SEQ ID NO: 20360 - DNA, 201 bp, Homo sapiens
agaccaaggacatgcagatcttattaatataaaagggaaggtgattccagatggtggtaggtgctgtgaggattctaaggcagggttacttggtcaggcartggtgtcaaagtcagcaggaagggccaagcagagtgaggcctgagacttgttggaggtggcagggggaggtcaggggtgcccttggctgtggtggctcta

SEQ ID NO: 20361 - DNA, 201 bp, Homo sapiens
agtgcctggtttaactgcttaataaatcttagcaagtttgatgtaaattgggttaaatttgcctccctaaaattctgcttctcagtcttgtgtcttttatrtagcaaccctttagtatctgaagggggcaattgtgtcccccaagtggtgacttcactaagataaggcctccctggttcctgtaattatttcccatgtgac

SEQ ID NO: 20362 - DNA, 201 bp, Homo sapiens
ctcctcaattctgttcctgccgagttagaactgctgtacgccagcctaggatccttccatgttgttctcccattcaagtagacctttttgcaattttaacwatccgaataggtacacttagtgtataattgtcattatcttttgaataaaaaatgcatcaccaaacttggttttgcatttttcctcagaatggctctgcct

SEQ ID NO: 20363 - DNA, 201 bp, Homo sapiens
atcaaagccagagatggagggacagattagtattgaaatgatgttcttggtcacttctggttccagatggccaaccaagcacaaatgttgatgtctgtgccttggtaccccattgcaatgattataaatgagtagatcggaacagggaggacaacactgtgaaagaaagggcatcagctaataataagagtccagtaattt

SEQ ID NO: 20364 - DNA, 201 bp, Homo sapiens
tcaaagccagagatggagggacagattagtattgaaatgatgttcttggtcacttctggttccagatggccaaccaagcacaaatgttgatgtctgtgccttggtaccccattgcaatgattataaatgagtagatcggaacagggaggacaacactgtgaaagaaagggcatcagctaataataagagtccagtaatttt

SEQ ID NO: 20365 - DNA, 201 bp, Homo sapiens
gactggtcagttatttttttggtagcaaaactctggctttagagttggaccatgagcagtcctgcttgctgctcattccctttctctagaaggacccctawggagttttacagcaccgtgggggctttctagaatggttgaaaacctctggcagcagatcatccatcaggcttggtcccaagttccagacctgggttcttg

SEQ ID NO: 20366 - DNA, 201 bp, Homo sapiens
caaagccagagatggagggacagattagtattgaaatgatgttcttggtcacttctggttccagatggccaaccaagcacaaatgttgatgtctgtgcctyggtaccccattgcaatgattataaatgagtagatcggaacagggaggacaacactgtgaaagaaagggcatcagctaataataagagtccagtaattttc

SEQ ID NO: 20367 - DNA, 201 bp, Homo sapiens
aaaaattataaagacacacacttcagatttgttctatttactatatttgttacacctccatttttaaaaagtgcaggtattgaagatggaatgacaatgcttttccaaagcctccttttttttatctttggttacatttctctaagctccttatttcagccctggcacatctcacctttatcatttcctttctcattcttt

SEQ ID NO: 20368 - DNA, 201 bp, Homo sapiens
aaagccagagatggagggacagattagtattgaaatgatgttcttggtcacttctggttccagatggccaaccaagcacaaatgttgatgtctgtgccttggtaccccattgcaatgattataaatgagtagatcggaacagggaggacaacactgtgaaagaaagggcatcagctaataataagagtccagtaattttct

SEQ ID NO: 20369 - DNA, 201 bp, Homo sapiens
agccagagatggagggacagattagtattgaaatgatgttcttggtcacttctggttccagatggccaaccaagcacaaatgttgatgtctgtgccttggtaccccattgcaatgattataaatgagtagatcggaacagggaggacaacactgtgaaagaaagggcatcagctaataataagagtccagtaattttctgg

SEQ ID NO: 20370 - DNA, 201 bp, Homo sapiens
aaattcaaacccttgttttgctcctcatcagcgacagtggtagggaagatgcccacggcacggaggttcagtggttgttttcattctttcctgttagccaktttcctcaaattggtcagtataatcctacctcttggagcgatagctggctggattcttctgccattttggcagttatatattggtctggatttaaaagtg

SEQ ID NO: 20371 - DNA, 201 bp, Homo sapiens
gccagagatggagggacagattagtattgaaatgatgttcttggtcacttctggttccagatggccaaccaagcacaaatgttgatgtctgtgccttggtaccccattgcaatgattataaatgagtagatcggaacagggaggacaacactgtgaaagaaagggcatcagctaataataagagtccagtaattttctggt

SEQ ID NO: 20372 - DNA, 201 bp, Homo sapiens
tattcctctttagttgaccttttagatacttttctaaccatgccccctccccgctgccccgaaagatcagggaaaataagaagaaattcaaacccttgttktgctcctcatcagcgacagtggtagggaagatgcccacggcacggaggttcagtggttgttttcattctttcctgttagccagtttcctcaaattggtca

SEQ ID NO: 20373 - DNA, 201 bp, Homo sapiens
ccagagatggagggacagattagtattgaaatgatgttcttggtcacttctggttccagatggccaaccaagcacaaatgttgatgtctgtgccttggtaccccattgcaatgattataaatgagtagatcggaacagggaggacaacactgtgaaagaaagggcatcagctaataataagagtccagtaattttctggta

SEQ ID NO: 20374 - DNA, 201 bp, Homo sapiens
tagttcattttggaacttattccactattgaattatccgtattctttggttttatacctttattcctctttagttgaccttttagatacttttctaaccawgccccctccccgctgccccgaaagatcagggaaaataagaagaaattcaaacccttgttttgctcctcatcagcgacagtggtagggaagatgcccacgg

SEQ ID NO: 20375 - DNA, 201 bp, Homo sapiens
aatcttttgtagagataggatgtttccccaggctggacttgacctcctagcctcaagtgatcctcccacttcagtctctcaaagtgctgggattacaggcyttaaccatcgtgcctggcccaagattattgttattattcaagattgaaaatacagcatatcctgatacataaaaccccaactttataaaactgttaaatt

SEQ ID NO: 20376 - DNA, 201 bp, Homo sapiens
cagagatggagggacagattagtattgaaatgatgttcttggtcacttctggttccagatggccaaccaagcacaaatgttgatgtctgtgccttggtaccccattgcaatgattataaatgagtagatcggaacagggaggacaacactgtgaaagaaagggcatcagctaataataagagtccagtaattttctggtat

SEQ ID NO: 20377 - DNA, 201 bp, Homo sapiens
gtgttgaagtcagggaataagaatttcctctgtgccacaaataatgctccccacctgtatagaatgcctgggaaatgcaacactggccatccttcagctcytctgcttacagctgttgtgctggtgggtctcctcctattctcagagcagagagccacgaatggggcactcggggccgtgacaggcatcccttagctctgg

SEQ ID NO: 20378 - DNA, 201 bp, Homo sapiens
ggctggacttgacctcctagcctcaagtgatcctcccacttcagtctctcaaagtgctgggattacaggccttaaccatcgtgcctggcccaagattattrttattattcaagattgaaaatacagcatatcctgatacataaaaccccaactttataaaactgttaaattggtaaaagattatttgttgcttaaaattat

SEQ ID NO: 20379 - DNA, 201 bp, Homo sapiens
agatggagggacagattagtattgaaatgatgttcttggtcacttctggttccagatggccaaccaagcacaaatgttgatgtctgtgccttggtaccccattgcaatgattataaatgagtagatcggaacagggaggacaacactgtgaaagaaagggcatcagctaataataagagtccagtaattttctggtatgag

SEQ ID NO: 20380 - DNA, 201 bp, Homo sapiens
gttctggaggttggaagtccaggatcaggtgtccacaggtttggtttctcctgaggcctctcttcttggcttgtagatgactgccttttccctgtgtcccygcatggtctttcctctgtactcatatctctggggtttctgtgtgtccacatttcctcctattctaaggactccggtcagattggattagggcacaccctg

SEQ ID NO: 20381 - DNA, 201 bp, Homo sapiens
tggagggacagattagtattgaaatgatgttcttggtcacttctggttccagatggccaaccaagcacaaatgttgatgtctgtgccttggtaccccattgcaatgattataaatgagtagatcggaacagggaggacaacactgtgaaagaaagggcatcagctaataataagagtccagtaattttctggtatgagtga

SEQ ID NO: 20382 - DNA, 201 bp, Homo sapiens
ggtttgttacataggtatacatgtgccatgttggtttgctgcacccattaactcatcatttacattagatatttctcctaatgctgtccctccccttgccyccaaccccacgacaggcccccatgtgtgatgttccccttcttgtgtccaagtgttctcattgttcaattcccacctatgagtgagaacatggggtgtttg

SEQ ID NO: 20383 - DNA, 201 bp, Homo sapiens
ctctctgctaaccctcctctcaccgttctccccagggtgggctgtgggccttctggtgctgagctccctcacatctgagctgtcttagcaccttctttccrcctgtatttgtgttacttggatatttgtgttttatcttctgtaccagagcataggttattttaaagcagggagcttatggcattcaacactgtcaccctg

SEQ ID NO: 20384 - DNA, 201 bp, Homo sapiens
cagtactttggttttcccagaagatgacatgttgtgacagggacacatgatggtccctgatgattcctctatatataccacaagcacaaggacagccctcygaagagggaggtggagttcaatgtccatgtgtacgcaggtccacgaggctcataattctgcattactttctattaagtagctgtggatcatcagtaggcc

SEQ ID NO: 20385 - DNA, 201 bp, Homo sapiens
ctctatttcactctcaagtgttccgatttggatggcaccctatttattgagtgctcattgtgtgccagacactgtgctgggcccggggcagatggagactygtaagccataaccgctgcctcccaggagctagtctgctggggcatccgttctgaataccatgacttggcaagtgaagcattcccatgccttccagactcc

SEQ ID NO: 20386 - DNA, 201 bp, Homo sapiens
ttatatctgtattgtcccaaacagaagaagaacaaacttcatcttaaaaatagaggatgatataatcaatcaagagtggagggatcgttggtttcagaaaygcaaagcatgtgtcaagcctgggtttccactgccccagtttactcctcctttttcctaaggaagaaaaaggaaaagcctctggaacaaccggtggggcag

SEQ ID NO: 20387 - DNA, 201 bp, Homo sapiens
tgcagtgtcctatgtacaggtgtgcctgggacagtcctggtttatgcctgttgtcccagcataatcattaatagttctctatttcactctcaagtgttccratttggatggcaccctatttattgagtgctcattgtgtgccagacactgtgctgggcccggggcagatggagactcgtaagccataaccgctgcctccca

SEQ ID NO: 20388 - DNA, 201 bp, Homo sapiens
ttcggggcactgtcttacttggcctagtcccacacttgtccctcccaccccttgcttctctattttcaattcacttctgtttctacacacatcagtgatgyagtgtcctatgtacaggtgtgcctgggacagtcctggtttatgcctgttgtcccagcataatcattaatagttctctatttcactctcaagtgttccgat

SEQ ID NO: 20389 - DNA, 201 bp, Homo sapiens
cactctcacacaaccaaaacatgaagaaagttaaaagtctccttcaaaatctcccccatagtgcctcatcctcttactaagcttgcttttctttaagcagktcattctttttttttttcatttttcttgagatggattcttactctgtcacccaggctggagtgcagtggcacgatctcggctcactgtaacctccgcctc

SEQ ID NO: 20390 - DNA, 201 bp, Homo sapiens
tccctccttggcctcccaaagtgctgggatgacaggtgtgagccactgcacctagccggacatactatttgtttgttgctggttgtcttagtcctcctacyggaattaggttaggtttctacatataatatgcaatgacttttttgagacaaggtctcactctgttgcccaggatagagtgcagtgacatgatcttggctc

SEQ ID NO: 20391 - DNA, 201 bp, Homo sapiens
gacatgatcttggctcactgcaacctccacctcccaggctcaagcgatcctcccagcctccggagtagttgggaatacaggcatgcaccaccacacctggstaatttttgtattttctgtagagatgggggttttgccatgttgcccaggctggtcttgaactcctgagctcaagtgatccacccacctcagcctcccaaa

SEQ ID NO: 20392 - DNA, 201 bp, Homo sapiens
atgcacaggaaaagagctctgcctcccggaaggttccaggtgttggggtaaatagagatcctgctgctgcctctactcccttactggtctccctggggacrtatttgaacatattttactcataaattctcatctcagggtctgtttctaaccagacctaaaacagacaggtcccccccttttttaatcagtaactttggt

SEQ ID NO: 20393 - DNA, 201 bp, Homo sapiens
atcagaattttcacttataaaagtaccatttacacatttcgtcactgctgacagtcattagctagtggatagatccaagctttaaatctgaatcttgtcayaggaggatggaagctcaagttgttaaaggcctaaaaggttgcatgttacatatagaacaaggccctgggaaaggaaatggtctgttgaaagtcacaaggc

SEQ ID NO: 20394 - DNA, 201 bp, Homo sapiens
caaagtagtaaacaggctctctcaagcattcatccatctggggagcttggcacacaggacagatcctttctcttaagtgtcccaaggccaaccctgaaccwtggaagccttcatttaccatcagtttttctttcaaaacttctgcaagggcataaaaatgggggactaaatagggaccaaataagtgagtccatgctttgg

SEQ ID NO: 20395 - DNA, 201 bp, Homo sapiens
tgggtgcttggattttctgaaccatgactccctctatcaagataactcatatatgcactttgcaaaacagttttataaacttgtaccaaaaggcacaggaragaaaaaatagaaaaatgtatacccttttaaaacaacattggggaaaaagtgctatgccttaaggacgtggagagcacatgggggaaaggtgggtaggga

SEQ ID NO: 20396 - DNA, 201 bp, Homo sapiens
accagcagctctggaagtgactggattaaaaccccaccaactgaagacagtggcgtgggatgatggctcgctgatgggagacagaatttctgtctctcctstcagaagccctttgaagaactcagctgtctggacaacaaaagtgggagcttttgttgtctagaagttcatgtgacctttcctttcaccttttagtgctgc

SEQ ID NO: 20397 - DNA, 201 bp, Homo sapiens
ggttgaggacggctctgctgcacttctgcccctttagcctcaggcctgtcacttggcctctcagtgggagtcgatgctgtgatgcctccactgcatttacygctttgggttatggtgaggagctcccgagaaaactcaggtgaaagtgctcagcaaggccacccattgttctataactgtggcctcatggtaagtctccat

SEQ ID NO: 20398 - DNA, 201 bp, Homo sapiens
caggacagtcacaggggtggaacaaatgcaggagccatggagccaaactgaactgggttggaatcccagtttcagccacttaatagttacatggatattgscaagtagcctgagttctcagaggcttgatatcctcatctgtaaggtgggaagtataagacctacctcacggtgtcagtgttaaataagacagggcaaaat

SEQ ID NO: 20399 - DNA, 201 bp, Homo sapiens
ggtcgtgcctcatgggggcccaggtgacagccaggccggggttgattttattgtgtattcaccagcctgagcgtccttaggggtggcaggcagggaggtcraggtcactgatgctggtgctctcagcatgtagttatgcaggagagtcactgctctgtattggacagaggctgatggaaaagggtggtttgtggatcgcag

SEQ ID NO: 20400 - DNA, 201 bp, Homo sapiens
tgatgaaggtactctgtaaatgtatgtccattccttcctcctcctctgggttccttttcagcacttcctcaccacagcaccattcttaagttttctagccycatttattttagaaggggaactggaggcagcttggagggaggtaacatctggatgtcgcagtgacagctggtggctggtgaggagtccacaggtcagggg

SEQ ID NO: 20401 - DNA, 201 bp, Homo sapiens
gagatgagacatcatgtaaaaataatttgttaggaagtgttctcaggggaatgggaagtagagcttcaaagggaaggaggccaaacaaggatgtgatatcmagcaaagtccccaggagacagaaagaaggtgggtgactttggcaccgtctaaagtataggtcacatctcactgtcccaatcagggacaaaagagcatggc

SEQ ID NO: 20402 - DNA, 201 bp, Homo sapiens
gtggtttccttgctaagatttttgcagtttattctgtgtggctgtgtgtgttggtcccttgccaataatcctagactcacccatcccggcacaggcttgtwactgtgggccaagccaaattctgaagcagcgcagttgtttgttgtctgaactcagtcttccccaacacatacttttcttgttgtcctgcacacaccctct

SEQ ID NO: 20403 - DNA, 201 bp, Homo sapiens
gtgtggtttccttgctaagatttttgcagtttattctgtgtggctgtgtgtgttggtcccttgccaataatcctagactcacccatcccggcacaggcttkttactgtgggccaagccaaattctgaagcagcgcagttgtttgttgtctgaactcagtcttccccaacacatacttttcttgttgtcctgcacacaccct

SEQ ID NO: 20404 - DNA, 201 bp, Homo sapiens
tgagagctccatccatgaaaaccagtcttccagaggaggatccccaaacccagagagctatttagagtttgaaacaaattgttctccttctcaaaagtggbagaatggttagaatcatcaactgcacagcctaggtcagaagtgaagtttgtcctgttttatgaagggaaagacacccttgtttagtgagcactgaccaag

SEQ ID NO: 20405 - DNA, 201 bp, Homo sapiens
ttgaagtctggtccatgccttcagcccaccagcatgtgttgagtacctgttgggtacacagctctgtgtctggtggaggggaaacaaagattaaaaagacygggccctgtcctccaacagctcaggttatttcatgcctgcattcggggcactgtcttacttggcctagtcccacacttgtccctcccaccccttgcttct

SEQ ID NO: 20406 - DNA, 201 bp, Homo sapiens
cttccctgcctgtctgtggcctctgcagtttaaacaatgactgtcacttaaacctcttctgaagagcttgaagtctggtccatgccttcagcccaccagcrtgtgttgagtacctgttgggtacacagctctgtgtctggtggaggggaaacaaagattaaaaagactgggccctgtcctccaacagctcaggttatttca

SEQ ID NO: 20407 - DNA, 201 bp, Homo sapiens
gcaggtggatctcctgaggtcaggagttcaagaccagcctgaccaatatggtgaaaccccatctctactaaaaatccaaaaagcttagccaggcatggtgrcgtgtgcctgtaattccagctactggggaggctgaggcaggagaattacttgaacccaggaggcagaggtttcagtgagccaagatcgcaccactgcact

SEQ ID NO: 20408 - DNA, 201 bp, Homo sapiens
ggacagacactggacagacaactcacagctcctgccacagtacagcatggagcctcccaaggcactagtcacacagatcaagccacacagccaaatggaawtacaaataatagattgaggtcacattgactgtttcacgttgtacttagacatgctgattaaaacctgagttgcaagtgtgccatggaacataatctctcc

SEQ ID NO: 20409 - DNA, 201 bp, Homo sapiens
taccagctagacatcttataaatcctatcactatagagttttgctctccagcagaactttctgtgatgaaggaaatgttccgtatcagcactgtccaatattggtggccagtgaccacatatgactgtgagcacttaaaatgtggctagtgccaataaggcattgactttttacttttctatacttttaattaatataaat

SEQ ID NO: 20410 - DNA, 201 bp, Homo sapiens
gcttataacgcattgaccatccatattttaaaagaggttggaagatgtctaagtaccagctagacatcttataaatcctatcactatagagttttgctctscagcagaactttctgtgatgaaggaaatgttccgtatcagcactgtccaatattggtggccagtgaccacatatgactgtgagcacttaaaatgtggcta

SEQ ID NO: 20411 - DNA, 201 bp, Homo sapiens
agtggtcaaattctgcgtgcattttgaagggggatcctacagcatttcctgagggtttgattgtcagttgtgagggaataagatatcaagggtcactccargcttttcagcctgagtacctaaaaggatggagttgtcactggtggtgttttcaacggaaggtgcaggtgagcaggttgaaagggggaagatctggagttt

SEQ ID NO: 20412 - DNA, 201 bp, Homo sapiens
ccaggcaaggtggagaccagctcttcatggtacttctgtccatctgtgaggctttggacactcgtggttttcagtctcctaggctggagtaaaatttgtayttatttaacaagggtgtttgcacatttattatgggaacgagaggatgaattcaccggatcccagcccttgcagggtgctgcaggatggtggggcaggttt

SEQ ID NO: 20413 - DNA, 201 bp, Homo sapiens
gggctgtagcagaggactgggcaaatggcagagtgcacccgtaggatgagtgctaatggcctagctagctgtccacagaggaggcagcaggcaccgccccrgcttactggctgtgggaacacagctatggaagctgaggcaggaagcaaggatgaggggaaggggagtggcagccgggccacctcctggagcaggaactgg

SEQ ID NO: 20414 - DNA, 201 bp, Homo sapiens
gcatgaataccaacatctgttagaatattccaagttggtgccaggactcatattttagtaaactgtaaaatcttccctccccatgcttgtacagtagacarggctacccatgatgtacgatgggtatcccacaatgagtcagttgatgtgggaacttcaattaatttatagtgggactgctcacatccctatgaagaaaat

SEQ ID NO: 20415 - DNA, 201 bp, Homo sapiens
ccgcaaggaggaggagtcccagatcactggttgaccttcagcgggcatttaacagcatattccatcaggcctcacctactagtgttttgttgaggctgctrtgtaactttgactttctctgctgtctcctatttaagagtaaataaaggtagtgacagtcacaaaaatagcatcaatgatgacaactagcgtttactgagt

SEQ ID NO: 20416 - DNA, 201 bp, Homo sapiens
aatgttgcttgttaacaacctttgaaggctttttagcaaaaacaaagtgtcatattgggattcatctgtggcagtttgcagaacatatcaggggagagagstgtgtgcaaggcatccaccaggaggccgttttgtgctggtctaggtaagaggagattggagctgacctgttgaagcaacaaagagaaagggaggaaggat

SEQ ID NO: 20417 - DNA, 201 bp, Homo sapiens
ctgcacccgagtcaggagggctggaagtgcaggatagttaacgtccccagtacagttttctaccaaggagagaccggtgagatggatagatgccccagctktctcacccgttgatgacacacttcactaccctctcctggagctccctgagatcactgcccatacaaactaattgcaccccaatgcttgtcccaaagtctg

SEQ ID NO: 20418 - DNA, 201 bp, Homo sapiens
aacgtgcaggtttgttacatatgtattcatgtgccatgttggtgtgctgcacccattaactcgtcatttatcattaagtatatctcctaatgctatccctsccccagccccccaccccacaacagtccccagtatgtgatgttccccttcctgtgtccatgtgttctcattgttcaattcccacatatgagtgagaacatg

SEQ ID NO: 20419 - DNA, 201 bp, Homo sapiens
gagggcatcatgaggaaggtggtcttcgtggggtgaatatcatgtttcctccagggagggctcagtgacatggagcagtgcttctcaaatgtccatgttcrcagaggttagcttctaactcatcaggtctagggtggggcctgagaatctgcatttctaacagtgagcatgtccagggaccacactttgagtagcaagacc

SEQ ID NO: 20420 - DNA, 201 bp, Homo sapiens
tcctgaaatgggtgcagcagacaccaggcaaaaatatttaaaacattttaatgtctacaaatagcttcatgaaatttttaattttaaggatatgaaaatgwtactattaacacttagcagaaaacaaagaaaccagtttctacagacttttctgtaacattaatgtccaaaattagaacagtatattccattgtgaatttt

SEQ ID NO: 20421 - DNA, 201 bp, Homo sapiens
ctaacagtgagcatgtccagggaccacactttgagtagcaagaccttcacagcttcaagttgcaaaccagttttgaatgagcagagtagaagggggtttgyaggtgagaaggaactcttcaccatgagtacatttctatgaagatttctggccaggattttagtaagtacctgagccccttcaaacatttgactcccgcat

SEQ ID NO: 20422 - DNA, 201 bp, Homo sapiens
atcagagcacagaagaagcctggtccctggaatctctcccatatgcatcctggtggataccaagtgcctggcagaagtcataggcaactcccaaccagagygctctccactgacatgttgcttagagctggggacagcttagattagccatatctccccaaaatttgtatttttaattgaattgattttttaaattgaatc

SEQ ID NO: 20423 - DNA, 201 bp, Homo sapiens
tttgcaggtgagaaggaactcttcaccatgagtacatttctatgaagatttctggccaggattttagtaagtacctgagccccttcaaacatttgactccygcataaccttttcatccaaacaccattcatgagttgtttttatgccatgaggttaaattctttcctatcatttcaggggaggtccccacttgttgagttt

SEQ ID NO: 20424 - DNA, 201 bp, Homo sapiens
tgtgtgctgctttctgagcaagtctctgcttggggctgcagtctcctgccatggaagggtaggtatcatatgagatgtgcatgtgatcctgtgacaaggamaagaggtggcctcatcacagtgtgtcggtcctttctgacattttgacctctcatttattggcaggcctgaattatgttctgatggctgacgtggccaaaa

SEQ ID NO: 20425 - DNA, 201 bp, Homo sapiens
gctcacatcaaggaagggaatgccactcagcctctgggcacacagctgcaacttcccctggtgctgtctctcttggtgctaccctatactagccttgtccygaaacatctaccccattcatttcaccctctctgctactatgtcactgcctctcccatcacagtattccacccaaatgaggcaaattcttatcctttcaag

SEQ ID NO: 20426 - DNA, 201 bp, Homo sapiens
gggtggcaccctgctatgagctcttggaacaatttatttataagttccttatagcctggatcgtattcaaccaatagtttttccccctctattaaaatgcrttaatttggagtctttgcttactaaatgctgtctcctttttttttgagacagagtttcgctcttgttgcccagcctagagtgcaatggtgcaaactcggc

SEQ ID NO: 20427 - DNA, 201 bp, Homo sapiens
tgatttcttattgagcctttggaaagttccttgccgtttcacagccatttcccgtcagagtggggaatattgactgtgcaaaccacttaaggtcacaggcrccacagctgtgtttcttctttgcagaaggggggtttctttgggtggggctgtgctcagcccttccgggtggtgaaggtctgaggtcacactgggagagca

SEQ ID NO: 20428 - DNA, 201 bp, Homo sapiens
accacagccctgggaagtgtgtgctgtcatatacccatgaagaaactgaggccaagaaaggaaagcagctctgcccaaggtgttataagcagagagcaccragacaggacccaagcccaatttgtgttgactggggaatcagtactcagttctcttagtctttggctgttttgttgagtgcccaggtcatcctggtagaag

SEQ ID NO: 20429 - DNA, 201 bp, Homo sapiens
tgaaactctgtgacttcttcccgtgtgatgatggctaagtgcgcagaacatgtgaaatttaagtagatttgtggaaacagaaacacatttttatttagtcrtgagcgtcacttggagtataaatagagccctttatgattcgtgtgctggtctttcttcctggagggcttcagtattatctcatgctgtcatctttatgtt

SEQ ID NO: 20430 - DNA, 201 bp, Homo sapiens
ctattttctcattttgcattacaatagcatctagtaacattcaagcctcaattaattgaaccaataattattatattaaaaatggtatgtatgccccaggrcagaggttaggctatggtgggcatttgagaccttagggccatagaccccgaaacatgcattctccagaactgagtatgcaactgtttgctttcgacctta

SEQ ID NO: 20431 - DNA, 201 bp, Homo sapiens
agtagctgggattacaggcatctgcccaccacgcccagctaattttttgtatttttattagagacggagtttcaccatgttggccaggctggtctcaaacrcctgacctcaggtgatccacccacctcagcctcccaaattgctgggattacagtcgtgagccactgagcccggtcaaaatcccttcttacctgtcatttg

SEQ ID NO: 20432 - DNA, 201 bp, Homo sapiens
actcatgtagaaactcttcttcagcttcatgttttaataatggaagaacttagtgatgtttcatatgtagagatttttctctaggtccttctcatcgatargacctgtttcaagatatggcaagccctagttctgatctctggggtcctcaccatttatagacttccattagtcctgttgtgacttaattgttttgttata

SEQ ID NO: 20433 - DNA, 201 bp, Homo sapiens
tgagaatgaatgatctgttaggaaggctggatggcatggtgacaagtgcatggctttgaggttgcttattctggactactgcttagacaaatgacttatcktcttattttctttatctgtcaaatgtgaataatgtctgtcccaaggtgctgagatgtgactattgaaaaataaaacatatgtgaaaagtgctttgtacat

SEQ ID NO: 20434 - DNA, 201 bp, Homo sapiens
tcccctacccccagaggtggagtctacagaggcaggcagacctccttgagctccggtaggctccactcagttcgagcttctcagccactttgttaacctastcaagccttggcgatggtgggcgcccctcccccagccttgctgctgccttgcagtttgatctcagactgctgtgctagcaatgagcaaggctccgtgggc

SEQ ID NO: 20435 - DNA, 201 bp, Homo sapiens
ccattagaagcatcaaaaatacgccctgtggcaggtgcagaatgcccattcaggtcaccttcctctctgcctgttcatacctcccctggtggctgatcccwttgatgtcattaaaagccggagccttccctaatgcctgacttcacttacttaaatgccagtgggctcggggctacttgttactgatgcaaagcccccaga

SEQ ID NO: 20436 - DNA, 201 bp, Homo sapiens
tgggaaaaaatagtttttaaaaagtaacagatggataaacaactaagagaaagaaggaaggagtgaaggatggacggatggacagacttggctgccctatrctattatcctagtcatcattgttaaatatagttgtggttggtagatacaataccgataataataatgatggtgtaatgagaatttttttaatgcaaatat

SEQ ID NO: 20437 - DNA, 201 bp, Homo sapiens
gtgactcagccacacttctctttttcactcactcttctttctggtcctcactaagacaaaatacagaatacagagcagcagttcacgggctatagcatttraggagattaaatacaggcctccaaccacacaggccatctggaagctttggcctccagatgaggacataacgaggtcatctctgctttcagggagctctca

SEQ ID NO: 20438 - DNA, 201 bp, Homo sapiens
aatgtctgtgtgagacagtggcagcctctgatgggttcctgccgattggcaaggtggttagagctgtgtattgagaggtcttctccaaggtatcagttttyctctgggagggttaaagaaggaccttgcaaagcccatggcctttgaatagagagctctgttctgtttgcagtgactcccctcaaaaggcagaatgcaatt

SEQ ID NO: 20439 - DNA, 201 bp, Homo sapiens
tggtggggactcacaaatgggcatgctgcctgccagcaagggtctcctggccagccctaaaggcccgggctgctctgcttacagccacacggctgtttctragctgaggatgaccctccaggtggctgagattccctccaatctttttatttctggttgggaaaccctacacagaccagtgtctgtctcacggtttaaaag

SEQ ID NO: 20440 - DNA, 201 bp, Homo sapiens
ttcctttttcctctccatgctttgatctggatatttcctattgagagaatacactgaggcccagtgtgatttcattcacaatcctataaattaaaaagcaracaacttctgggtcactggtcgtcttttctgctgtgttcaatctccagtaaaatatgtcagcaccttaaccactgtcctctgcctggtttcttagtctca

SEQ ID NO: 20441 - DNA, 201 bp, Homo sapiens
ctcaataaatgacaacttttctcttctagttattgaatccaaaatccttgaagcagtccttgactcctcttttcctaacacccttcatccagtccatgagraaaatctgttggcatgacctttgaaatgtgtccagaatatgaccccttctcaccccctcagctgccatcaccctggccttcacgttcatcttctcacacc

SEQ ID NO: 20442 - DNA, 201 bp, Homo sapiens
gtctttcccatctcaataaatgacaacttttctcttctagttattgaatccaaaatccttgaagcagtccttgactcctcttttcctaacacccttcatcmagtccatgagaaaaatctgttggcatgacctttgaaatgtgtccagaatatgaccccttctcaccccctcagctgccatcaccctggccttcacgttcat

SEQ ID NO: 20443 - DNA, 201 bp, Homo sapiens
caatagtaattgccttactttatttgcgaaggggtggtgaacactaatatgcctgactccatagagcagtgtatttggttttcttaagcaggaagaagggsgccccccccaattttaatttactgaatgagtttaagaaccatggtgtatttcccaagcttcgctagtgaagatggtattttgttaaaaattgagattccc

SEQ ID NO: 20444 - DNA, 201 bp, Homo sapiens
atcagttcagcaagaggacataacaattgtaaatatatatgcacccaacaccagagaaactaaatatataaagcaaatattaatagatcttatgagagagwtagattgcagtacattaatattagggaatttcagtaccccactttctgcaatggacagatcatccagacagaaaatcaataaggaaacatcagacttaaa

SEQ ID NO: 20445 - DNA, 201 bp, Homo sapiens
gaaatgggttctgtacccttataccttgctcttcttcttcccaggatggcctgatcattcactcacccatccatccttccctccttccctccctccttctstccaacaagcatgtattgagtacgtaatagttattaagcactgggatacaccagtgaacaaaaaaaacaaggatgctgccatccctagtcccataaatta

SEQ ID NO: 20446 - DNA, 201 bp, Homo sapiens
cgctaagtcttgggagaggtgatgtaaccagggactgcaacttctagggaaaggggaaaaatcactgttggccccaccctctagcattggaagcttaacarggctttggcccacagcacatggaagtttgagctgtgttttgtaattcttttttaaatgttcgccagagcatccattattcttcctcattttctcttctcc

SEQ ID NO: 20447 - DNA, 201 bp, Homo sapiens
gctatgttggctattctctacttcccctctccagatccattctccaccattatccctcctgctttgtgcccttgggaggctgaccttcccctctgcctttwagttgggttcagtcagaggggagcactggaaaaagagggtggaagagtggccagccatagtgaccatggctctctacggaaggccatagcttctgtcagg

SEQ ID NO: 20448 - DNA, 201 bp, Homo sapiens
ccgctaagtcttgggagaggtgatgtaaccagggactgcaacttctagggaaaggggaaaaatcactgttggccccaccctctagcattggaagcttaacsgggctttggcccacagcacatggaagtttgagctgtgttttgtaattcttttttaaatgttcgccagagcatccattattcttcctcattttctcttctc

SEQ ID NO: 20449 - DNA, 201 bp, Homo sapiens
gtttgcttcctattccttgtaaggtttagccatgtatagtcatgtgccagtcacctagggctgagaaaggggagcaagcagagagggagaagaggaagaasccaaatgagatggttcgtaattgattagtggaagttaaatcatgttaaggataggaggcttgtcccctccatcatgatttagtatatcatccttcccaag

SEQ ID NO: 20450 - DNA, 201 bp, Homo sapiens
aggaaacattccccctgggctcactttttgcttagaaaagtcctgatggagaggttgaggtgggaagagagtgagggggaagactccatggagcatgacargcatgctgtgcctgccacagccaagcatggaggtcccaaccataatgtgtttttgagacaggatctggctctatcgcccaggctggaatgcagtggtgca

SEQ ID NO: 20451 - DNA, 201 bp, Homo sapiens
cgttcactctatgtatacatgcaactaaagtgtgtataatgagatattgccatccctgagctgaaatctaaggctgcctgctgccaaatctctgctttgcytcaaagtccaaattattttatattttattttaaatcagttttttaatcctaaaaattaaacctcaataaagggataactactatcctttgaagacaacca

SEQ ID NO: 20452 - DNA, 201 bp, Homo sapiens
gtctttctcagcaccctcaaggttgcctcatggtctgagatgactaccagggaactagctatcatgtccacattccaagccaaaaatagaagaggacaaartgacatatgccccctcccttttaactattcttcctagaagttccatataacgctggccagaaattaattatgtatgtagatatacccacccactaaggag

SEQ ID NO: 20453 - DNA, 201 bp, Homo sapiens
actaccagggaactagctatcatgtccacattccaagccaaaaatagaagaggacaaaatgacatatgccccctcccttttaactattcttcctagaagtkccatataacgctggccagaaattaattatgtatgtagatatacccacccactaaggaggctggggaatgcattattaaggaataagaggagggtaagtgt

SEQ ID NO: 20454 - DNA, 201 bp, Homo sapiens
ctgacctcaggtgatccacccacctcagcctcccaaattgctgggattacagtcgtgagccactgagcccggtcaaaatcccttcttacctgtcatttgtrttctccccattctgtgtctgacatcttgtaggtgtttgttagatgattggtgagtgaattaatgaatgtacagatggatgatgtataagtcctttcagag

SEQ ID NO: 20455 - DNA, 201 bp, Homo sapiens
ctctacctagcattgagcataagcaggtcactgaccacaaagatattctgttcccaaagagcaccatattcgtggtcaagtaaggccagagtctagactgrcatcaaatgcttgtatgattgggaggaaggagcccgaaggccaaagaggctcactaatttcattattcgattcttccaaccactgcacgttacaaacagg

SEQ ID NO: 20456 - DNA, 201 bp, Homo sapiens
cactgaatacctattgtttttacaccatcagaaagttgaaaaatcttaagtagaaccatcataagtcagggactatctgtatggtagtagaaatttttaaytgaatcttctgtaatcttcagcaagaaaccctgagaatattgaacgtctttgccagacaaggaaaagtgggactggggaaaaggccagttatgtgaatcc

SEQ ID NO: 20457 - DNA, 201 bp, Homo sapiens
aatatattagaataataagatatgtataattggataatttaagtagatatattatggtaaatgctcacatgtttttaccagttggacacaaaataaaaatrtttttcatccacctgtctagatgccttgaaatgttagtctgagctgagatgtgagtcctggaaattggaggacctctgtaccttctcttccaaaatctgt

SEQ ID NO: 20458 - DNA, 201 bp, Homo sapiens
aaatgctcacatgtttttaccagttggacacaaaataaaaatgtttttcatccacctgtctagatgccttgaaatgttagtctgagctgagatgtgagtcytggaaattggaggacctctgtaccttctcttccaaaatctgtaaacatactgtttccgcttggcagtcttgatttgctttcagtgactctgagaagccct

SEQ ID NO: 20459 - DNA, 201 bp, Homo sapiens
tcacataacctgcaaagtgccctgagatctggttctgcatgaatcttctctaccctattgctgcctatcaacttgacttcccacctttgggagtcagatgmagtccgctggacagcccatgccctctccatgtggctataccacccctgccttgcccctgctctctgcctgatgtcctactgtcttttgactgtgcccagg

SEQ ID NO: 20460 - DNA, 201 bp, Homo sapiens
ttcatccacctgtctagatgccttgaaatgttagtctgagctgagatgtgagtcctggaaattggaggacctctgtaccttctcttccaaaatctgtaaayatactgtttccgcttggcagtcttgatttgctttcagtgactctgagaagccctgtggtttgtgaagagcctcttggctttcctttgaccttggttggaa

SEQ ID NO: 20461 - DNA, 201 bp, Homo sapiens
ctgagatctggttctgcatgaatcttctctaccctattgctgcctatcaacttgacttcccacctttgggagtcagatgcagtccgctggacagcccatgscctctccatgtggctataccacccctgccttgcccctgctctctgcctgatgtcctactgtcttttgactgtgcccaggggcatttcctctgggaagcct

SEQ ID NO: 20462 - DNA, 201 bp, Homo sapiens
ttgagaggctctgagaattcagagaaaaagaacaaagcaataaaaaaggatgacatgaggactatattgtggaaggtagaaactggaaaacagcaaagagraaatggttccagaataattggaacagaagccattccttagacagcaaaggaggatctccatttcctgaaatgggtgcagcagacaccaggcaaaaatatt

SEQ ID NO: 20463 - DNA, 201 bp, Homo sapiens
tttgggggctgtgaagaacatctccctaaacatctctatctccaacctcggagatgatgcctatgatgccaacgtgtccttcaatgtttcccgggagctcytcttcatcaacatgtggcagaaggtaaggagggcatccctgtaaaaagagcagttgttccatctggtgcgcttgctgactttcattattgcctggaatag

SEQ ID NO: 20464 - DNA, 201 bp, Homo sapiens
agagcaggtggtttagggctgaggctgtaaaccacaggggattacctatgtttatctggggcaagttgcaggataaccacaggacaagactagtagttggmcagaaataccaatttttattattctagaatagattaaaatataaaataaaattagattttctctaatatatttagaattgaacctttttgggtacaatat

SEQ ID NO: 20465 - DNA, 201 bp, Homo sapiens
caggaaacattccccctgggctcactttttgcttagaaaagtcctgatggagaggttgaggtgggaagagagtgagggggaagactccatggagcatgacvggcatgctgtgcctgccacagccaagcatggaggtcccaaccataatgtgtttttgagacaggatctggctctatcgcccaggctggaatgcagtggtgc

SEQ ID NO: 20466 - DNA, 201 bp, Homo sapiens
tcaggaaacattccccctgggctcactttttgcttagaaaagtcctgatggagaggttgaggtgggaagagagtgagggggaagactccatggagcatgamaggcatgctgtgcctgccacagccaagcatggaggtcccaaccataatgtgtttttgagacaggatctggctctatcgcccaggctggaatgcagtggtg

SEQ ID NO: 20467 - DNA, 201 bp, Homo sapiens
caggcaccattctaacctctttacccaagttgtctctgctagtcctcaccacagccctgggaagtgtgtgctgtcatatacccatgaagaaactgaggccwagaaaggaaagcagctctgcccaaggtgttataagcagagagcaccgagacaggacccaagcccaatttgtgttgactggggaatcagtactcagttctc

SEQ ID NO: 20468 - DNA, 201 bp, Homo sapiens
gtggacaaaagtcgactctgctctacccagtgttgctctaactgctgatagctgttcagctgggactgcttgcagctttttaatatttacagcattgaacrgggttgccttgttctttatgttaaaatggaaccaaaatcactttctgtggaaaaccttcactctgcccaccgatgagcactgggcatacattgagcaggt

SEQ ID NO: 20469 - DNA, 201 bp, Homo sapiens
ggacacagacgggacccttcctcagcagcaggcccccagcccttccaccagccactgattccgccgcctccctgaggtgaggagtcctcccaccccctgcytcccatagcagctggggcggccactgaagccctgacatgctcctgtccctggctgtgtacaccggggtatactccggaggggctgcatcatatggtcttt

SEQ ID NO: 20470 - DNA, 201 bp, Homo sapiens
gttagggtcaatgttgttcagtgctgtgttcacatatcacccaagataatctcatgaaccacctaaaataatcttagtgtaccactcccagtgtgaacatmctgtgatttgggtaacactgccccaaacaaatggtgttcaccatatacatatcaggcacgtgtgggaatgtgggaggaacccctgggtaggggttatagg

SEQ ID NO: 20471 - DNA, 201 bp, Homo sapiens
ttaactggaaaacttgcaacagtttccatttcattttaaactccagcctatatcacatatcagacctaagatgtgtctttctctctctagtggagtgttamattttgtcaaatttttgtttgtttgagagggagtctctctctgtcgcccaggctggagtgcagtggcgcaatcttggctcactgcaacctccgcctccca

SEQ ID NO: 20472 - DNA, 201 bp, Homo sapiens
gggttatacatttcagactaatgatgatatccattactatatgtgcaattgcttataaactaatatatagtcatattaaaatctctaatctgattgagaarttttcagaaacaaggtacactgattttctcaccacttatttcctgctctcatgacagaatttctggagttctttgaattcacctggtttttggagctctg

SEQ ID NO: 20473 - DNA, 201 bp, Homo sapiens
ccctctgaggttcctccccttctatttcctgcttatcaacatgtttctaatgtcacacaacctccagctctaggacaaataatgttggaccccaagcattstttttgcaaatatgagggctagactgaagcctcattggaccacaggtcctatgggactggtggagatatagtgcccggagcctggcccttagggaacatt

SEQ ID NO: 20474 - DNA, 201 bp, Homo sapiens
tttttaacccatagctgtttttttaccctcagatgtggccattggtgcacccaaggaggatgacttcgcaggggcggtctatatctatcatggtgatgccrgtgggatagtccctcagtactcaatggtaattagtgtgagagtgatatggcaactgttcatacattcattcagcaaacatgtatggaaccttcattatgc

SEQ ID NO: 20475 - DNA, 201 bp, Homo sapiens
gatctcctcccagtgctgactctacaccagtcaagaccctgcctctctcttccttcttgtcctcttcccgccctgtctccatgcctgccccccaccccacwgtaagctgaccagtcccacagcaacagaaatttctgtctagaaagagatgtccatgttcactgtagatgatggtccattgtaatggaccaatgtccgttg

SEQ ID NO: 20476 - DNA, 201 bp, Homo sapiens
tctaatctgattgagaaattttcagaaacaaggtacactgattttctcaccacttatttcctgctctcatgacagaatttctggagttctttgaattcacmtggtttttggagctctgtcaagtcaatatttataactgaactagttcaaacagttcaagcattgtctcttcctttctggttgaagttctgtcttagaaga

SEQ ID NO: 20477 - DNA, 201 bp, Homo sapiens
tacactagataattttagatggttcatgaaattatcgtgggtgatacgtggacgcagcactgaacaacattgaccctaacagtgacccttttcaccttagycagttcagtcatctataacaaattaccctgggctgggtggtttaaacaacagacatgtatttctcacagttcttaaggctgagaagttcaaggtcatggt

SEQ ID NO: 20478 - DNA, 201 bp, Homo sapiens
gacccctggatggagctccatgatgtgggatttacatcccgcccatactctgctgtgagagagatggtatgcagccagtccagccatctgaagcagaacgraaaaatggtatggaaagcaaggcacctgaaaaaattttcaaagggagaaaaagaatgagcaaaactatcctgtagaggagagagacattgaaaatgacat

SEQ ID NO: 20479 - DNA, 201 bp, Homo sapiens
tagtcagttcagtcatctataacaaattaccctgggctgggtggtttaaacaacagacatgtatttctcacagttcttaaggctgagaagttcaaggtcawggtcccggcagattcagttcctggcgagagttctcttcctggttcataaacagaaccttctctatgtgtgcccatctggctttcccttggtgtgtgtgca

SEQ ID NO: 20480 - DNA, 201 bp, Homo sapiens
aacacttctctatcaccagcaaatctcccttttcaacaaagatggagtagaccttaggctcagaggcttccaaaggcaacagagttcagcattgctctgtkttcattgtgttcatttttacaactaccttctctttttggcaagtgatcctggattcccatctatgacagtgatataaattgttcttttaaaacaatcttt

SEQ ID NO: 20481 - DNA, 201 bp, Homo sapiens
tcctttttcactagtatgaattcagcgtgatctttgatacaagccacctgtctggggaagaggaagttctcagcttcattgttactgctcagaggtaaggsgggggtttaaacacttttttcaaagatgagagatttatgggaccaggaaaggatgtgtcctggttaagctttgatgaatcccaggatgctgaggaggaag

SEQ ID NO: 20482 - DNA, 201 bp, Homo sapiens
tttatgggaccaggaaaggatgtgtcctggttaagctttgatgaatcccaggatgctgaggaggaagaaatggttactcagtgataaagccttgagccgcwaagtggaattggatttcttggggatggtggttgcctagtgctgcttgcatagccgccactgcagattgaactgagaggaactgggcatcagccactcaga

SEQ ID NO: 20483 - DNA, 201 bp, Homo sapiens
gtttatgttctgattatgccagttatcccaataatgtctttttagccgcttctttttactggtccacaagacttggttattttctattgacactattttcragatcacataatttacatcacataaaacatgactgtgatctaatagaagcctatgcaaagcatagatagggtagacttcattcccattgcacaaaatcca

SEQ ID NO: 20484 - DNA, 201 bp, Homo sapiens
ccatattgacttaattttttcttagattgtgttctccccttgatttctgttctcatgctgttgttttcaagtattttcctccccatccttttttctctttscctttttcccagtattctttgtcttagaccttgaatgtattttttgctgtatgtatgcttgaatgtgttttttacccaggcttggtaaactatggccttt

SEQ ID NO: 20485 - DNA, 201 bp, Homo sapiens
tgaagaggttgaattgtctttctactcataaaacaccgcagggcctgatctatatttagggctgggggttcaacaatgaaaactttttgctcacaatctgkcaggtgagaaaattgtggggttctagttgtgtgtctcaaatgaaatttaagatctaggctctgatgggggagaggcttgtcctcaggcaggcatgagttg

SEQ ID NO: 20486 - DNA, 201 bp, Homo sapiens
aacatttctgtggcaggagagggctgaaggagaggggcaggctgccctgatccaagtgagcagatagtctccttattgtttcagggtttcctcccgcactrcatgaatcccccaaggctaaaggtgaaccgtacagcggccttctgtttcctctttgccaaccttttattttagacttcatttaggatgaaggtgctggtc

SEQ ID NO: 20487 - DNA, 201 bp, Homo sapiens
tcctattattaaataaaggtttatgccctcctgcctccacacacacacacacacacacacacacacacacacacacacactagtgtatgttttaacaagtwacatttctgtggcaggagagggctgaaggagaggggcaggctgccctgatccaagtgagcagatagtctccttattgtttcagggtttcctcccgcacta

SEQ ID NO: 20488 - DNA, 201 bp, Homo sapiens
tgattcatcctattattaaataaaggtttatgccctcctgcctccacacacacacacacacacacacacacacacacacacacacactagtgtatgttttwacaagtaacatttctgtggcaggagagggctgaaggagaggggcaggctgccctgatccaagtgagcagatagtctccttattgtttcagggtttcctcc

SEQ ID NO: 20489 - DNA, 201 bp, Homo sapiens
atgaaaaagtgggcagctggaagggggctggagacggcctggtcagggcatctcgtcccactggtgcctaccgtctgagcactgctctgaaggactcgatygccccgtggagcctgctcccacacacctgccttttgtgcagccggcccatctgttggtgctttttctttcaggaggagatgggcatctcctgtgagctgc

SEQ ID NO: 20490 - DNA, 201 bp, Homo sapiens
gtgggcagctggaagggggctggagacggcctggtcagggcatctcgtcccactggtgcctaccgtctgagcactgctctgaaggactcgattgccccgtrgagcctgctcccacacacctgccttttgtgcagccggcccatctgttggtgctttttctttcaggaggagatgggcatctcctgtgagctgctggaatcg

SEQ ID NO: 20491 - DNA, 201 bp, Homo sapiens
ttgatgtttgacgtctttatctcaactcttcaacttagctcattctggagcagtcacacgatgacagatgagacggttgggcctaagccggccaaacaaayggcagggcaagacctggcaggatgctggggtgggggcgggagtgggccaggatggtgttaacccatccacaggggagtcgcctttggcctgcccacagca

SEQ ID NO: 20492 - DNA, 201 bp, Homo sapiens
gaatccccgttctgtgctttctcacccggaggccttatgtggatgtattttagaatcacctggggagctttcaaaaatatcgatgcctgatctacccccakagacttgctatagccagggtctatagcgagagcttccatgatgtttatagtggtaggtttggtcagggcctctttcctgggcttggctgtccatggatga

SEQ ID NO: 20493 - DNA, 201 bp, Homo sapiens
acaggaggaccactttctgattagctccacaggcagtgctggctttgcttgtttctgttaactccctctgcagagccagaggtggcttttcctgatgtctrtaatggtctggaatgggcagggaaccatcccatcggccacactgtctgtctgggtcaagtccacggtcattcagtgccgctggcattgttggaaagcagg

SEQ ID NO: 20494 - DNA, 201 bp, Homo sapiens
ggcacctgatcctgctgcttttgcaaactgtggatgcccctgagggactgatgtcaccccatgtaggaagacagatgaggagccagggcagagactgtggscctatggggtcagcgtcacacagcaccattgtttcagaacaataggagggagaaggagaggggatgtgagagctatttaagtgctgttgccattcagcac

SEQ ID NO: 20495 - DNA, 201 bp, Homo sapiens
tcaaaggcacagcaagaatatacccagaaccaagccctatccttggggacaaagagaaaacattctccccaccacccccagacacttgatcatgtaatcaktccttagaggaccttgttgggaggtgttaacagcccctgatgaagccatcagttaaacaaatgagtcaacctctgatctctccaggaacctaaaacagct

SEQ ID NO: 20496 - DNA, 201 bp, Homo sapiens
taaaataaaattagattttctctaatatatttagaattgaacctttttgggtacaatattcttttttagtatttcttggtgatttttttttttacaacaamaaatagagcaatacctttcttggttagtaaaataaatccctaaatatttgccacaatctctagaatcttctaaatcaggaaattttaatgattttcacag

SEQ ID NO: 20497 - DNA, 201 bp, Homo sapiens
ccatttggtaatgctgggaactcactaccttactaaaataatgcactaaacattgaaaatggatgagttgttgtctattcggacttagtctcaaaaatctkccattgttgtgtttaggtgagtgagtggcctccagcatctagaagtcgatatttgtctgggagtgtcagtcagagctttgtttcttctcaggaatgtgtt

SEQ ID NO: 20498 - DNA, 201 bp, Homo sapiens
ttctcacctcttatgtagcctccgaaatccaagggaaaatgctatcaatgaacggattcagctttcaaatgcctaacttctagtcatcttggcagtctgayaaatttaagttttttaagtgaatttgtcatagagtggggtttaggatgccaaatacataactcatttatatttattttttaaaagcttatgatcatcttc

SEQ ID NO: 20499 - DNA, 201 bp, Homo sapiens
tcgatgcctggtactctgctgtgcaggcccctctgctttttcaggatttggaaggacaggtccacgtcatgaatgccagttttccccaagaagccctctgygtggtggaggcctcagccaatgtcccagcccagatgaccccatgaggacccctttctgttctccatcattccccaccttctgggcagggctgcctcagag

SEQ ID NO: 20500 - DNA, 201 bp, Homo sapiens
tcctcctgagattttcttgccagctcatccaggagcccactcctcctgcaggggaacagcctttcggaagggcagttttataagaacagaggagtgtgagyccctgtgagcccccacgggaggcacgctgctccctcactgagccatggctggcttgcccaggcacacaggcatcatttccagcaagtccacttggtgtag

SEQ ID NO: 20501 - DNA, 201 bp, Homo sapiens
gcggatcacctgaggtcaggagtttgagaccaacctggccaacatggtgaaatcccgtctctactaaaatacaaaaattagccggggatggtggcagccayctgtaatcccagctactcaggaggctgaggcagggagaattgttcgaatccaggaggtggaagttgcagtgagccgaggttggcccactgcactccagcc

SEQ ID NO: 20502 - DNA, 201 bp, Homo sapiens
gactgtaatcccatcactttgggaggctgaggtgggcacattgcttgagcccagaagttcaagaccagcctgtgcaacatggtgaaagcctatctctactwaaaatacaaatattagctgaacgtggtgatgcatgcctgtagtcccagctactcaggaggccgaggcaggaggatcacttgaacccaggaggtcaagggt

SEQ ID NO: 20503 - DNA, 201 bp, Homo sapiens
gtggagacggggtttcgccatgttggccaggctggtctcgaacttctggcctcaagtgaaccgcccacctcagcctcccaaagtgctgggattacaggtgygagccaccatgcctggccaagatcttctaattattttttaaataaagagttattgtgattttctttagcagaaaaagaggtttgtgaactgtttgttact

SEQ ID NO: 20504 - DNA, 201 bp, Homo sapiens
tggaggaccgatcccccagctcctgtcattcatcatggagaaccattccctgggcatgaactctctggcacttccagccttctctaagtaggtccacactscctggggccaggaagcaactcaggcagaaagatgtgggaagcctttgacctggaggggcatggcttcaggtgaccagaactgtggctggttctggggaat

SEQ ID NO: 20505 - DNA, 201 bp, Homo sapiens
cactggggaaggatttctgagcggccactacaaagccctcctgtgaccctgttagctgcaggaaatagattggagtgtcctctacctctctccctcaaackccctgggtcagctgccaacaaactccaacagtaaaagaaaaggcttgttcatgtccatcaacccaggggccttttattagaaaacatttattttaaaaga

SEQ ID NO: 20506 - DNA, 201 bp, Homo sapiens
ctgttagctgcaggaaatagattggagtgtcctctacctctctccctcaaactccctgggtcagctgccaacaaactccaacagtaaaagaaaaggcttgktcatgtccatcaacccaggggccttttattagaaaacatttattttaaaagaataatgctttttctctttcttttcttttcttttcttttcttttctttt

SEQ ID NO: 20507 - DNA, 201 bp, Homo sapiens
tggaaagagatttgttgcagcaaagagcattgatgagcctgacacttatgacaatggtccagtgagtaatttcaagcattttaattccagtgcttcctggsttaacaaacctgccaccattactaatgctaattaaataggtttctctgaggttgcccaacctgttttcctaagccaggaaatggactcgacaaactcaaa

SEQ ID NO: 20508 - DNA, 201 bp, Homo sapiens
gactcaaccaagtaagatttacaaaacaaacaaaactgttttcatcatctttggttgtagttttataaagaatgctggttcatggactccagacacttcaytgaaactgtgtgaatcattttaaacaggtttgtccttgggccccagatagtacattggcatttgtgaatcattttagatgagtttgtcctcagtacaaat

SEQ ID NO: 20509 - DNA, 201 bp, Homo sapiens
gtacatttccactgaggaattttggtgggtggggggaggttgtgctgcctcacaatgtcacgtgtattaaagtctaagcagtcacttctgattcacttgcmctgtttgggaaatgtcaggtttacaaaaacatacatgtttggaataaaaaatggctgcaaacaattcagaagttcaatctgtaatttacttgctaataag

SEQ ID NO: 20510 - DNA, 201 bp, Homo sapiens
tatggcaactgttcatacattcattcagcaaacatgtatggaaccttcattatgcaccatgccctggaggtacaaagaaaaacatttttcttgccttggcmttcctacccttttgtgaaagatacaattaatattgcttattaaatactaaaaaaagcattcttagaatcccaagttcgctaacactcagggatgcatttt

SEQ ID NO: 20511 - DNA, 201 bp, Homo sapiens
ctgatgcatccatgtacatttccactgaggaattttggtgggtggggggaggttgtgctgcctcacaatgtcacgtgtattaaagtctaagcagtcacttytgattcacttgcactgtttgggaaatgtcaggtttacaaaaacatacatgtttggaataaaaaatggctgcaaacaattcagaagttcaatctgtaattt

SEQ ID NO: 20512 - DNA, 201 bp, Homo sapiens
aaatgaatctggagctttatgcatattactaggtgcttcatttttatttaaaaggctgatttaataatagaaagaaaaactccaggcaaacaaaaacactmacggacctgaacctactgacgttcttagatatttttaatgtcatgagtgactccttttgctactcacagtgtagcccctggcctagcattgtcagcatca

SEQ ID NO: 20513 - DNA, 201 bp, Homo sapiens
ttccagaatattatttgaaaattctacagtatgttctactttctccccttcctgcttccatggtttcactgtggaatcctataagatattctcctgagcaktattatttcagtttccttcagcttttagttgaatcttcaatgtggttttaaccaactgttcagagaactgaaatggtttttaaatatgaaaaaggacctt

SEQ ID NO: 20514 - DNA, 201 bp, Homo sapiens
atgaatctggagctttatgcatattactaggtgcttcatttttatttaaaaggctgatttaataatagaaagaaaaactccaggcaaacaaaaacactaasggacctgaacctactgacgttcttagatatttttaatgtcatgagtgactccttttgctactcacagtgtagcccctggcctagcattgtcagcatcact

SEQ ID NO: 20515 - DNA, 201 bp, Homo sapiens
ttgcaagagatcagtacttccggatcagtacttctgcagtgagatgaaactttggaggagtaaagttggtgtttgtaaattatctagcacagtgcttggcmcacgttgcaggttgaatttatttgcttttccttacttaccctgtgttaatatgggttctccccaaaacagagcctgggtcaaggatctgagtgcatgtgg

SEQ ID NO: 20516 - DNA, 201 bp, Homo sapiens
ctgctggaatcggacttcctcaaatgcagcgtgggatttcctttcatgaggtcaaagtcaaaggtaagggacacagacgggacccttcctcagcagcaggyccccagcccttccaccagccactgattccgccgcctccctgaggtgaggagtcctcccaccccctgcctcccatagcagctggggcggccactgaagccc

SEQ ID NO: 20517 - DNA, 201 bp, Homo sapiens
ttcccttcttcaggggagcttatgaccatcagggtggctgtgatgcttccctggatgtttggctcacagtgaagaagcatgaggacaaatacacagacaayaaaaacatttgatgtgcccatgacagctgggtttgcttcacgatttgtgtaggacacgtcttatatgtgcatgcactgttggcagcagactgcagagagt

SEQ ID NO: 20518 - DNA, 201 bp, Homo sapiens
ggatttcctttcatgaggtcaaagtcaaaggtaagggacacagacgggacccttcctcagcagcaggcccccagcccttccaccagccactgattccgccrcctccctgaggtgaggagtcctcccaccccctgcctcccatagcagctggggcggccactgaagccctgacatgctcctgtccctggctgtgtacaccgg

SEQ ID NO: 20519 - DNA, 201 bp, Homo sapiens
tgaattcaaagacctcataatcttttaaaatattattaaattctgttttatttgtttctttcaaaaattaacagatttttaaaaattgaaaattgaatttycaaaaaatttctcaaaaatctttgagaaaaattgagatgggacaaagactctgtgccttgttcccccttagtgtgagtcctgagtacccagctgtgtggc

SEQ ID NO: 20520 - DNA, 201 bp, Homo sapiens
gcaagagatcagtacttccggatcagtacttctgcagtgagatgaaactttggaggagtaaagttggtgtttgtaaattatctagcacagtgcttggcacmcgttgcaggttgaatttatttgcttttccttacttaccctgtgttaatatgggttctccccaaaacagagcctgggtcaaggatctgagtgcatgtggtt

SEQ ID NO: 20521 - DNA, 201 bp, Homo sapiens
aaaagaaagaagaaagaagaaaggaaaaagaaaaaaaggcagcggggcgcggtggctcacgcctgtaatcccaccactttgggaggccaaggcgagcggaycacgaggtcaggagatcgagaccatcctggctaacacggtgaaaccccgtctctactaaaaatacaaaaattagccgggcgtggtggcaggcgcctgtag

SEQ ID NO: 20522 - DNA, 201 bp, Homo sapiens
tcctcgccactttctaggccttcatggctgtctggtgcagactgtgtgcctaccagacttccaggctgggtggggagggggcttccatgactgaagccacrgtgggtgggcgggtgtccatgacccatgcatgggggtggtggggaggggcaagaagaaagaaaagaacacagcaacctctctgagaagtcagtaggctct

SEQ ID NO: 20523 - DNA, 201 bp, Homo sapiens
agggtctccctatgttgccgagggtgatcttgaactcctgggctcaaatgatccaccctcctcagcctcccaaagtgttgggattacagacgtgagccacygctctcagccccttacacttttttgaagttcagttctcccatctgtaaaaacgaggtaataatattgcctcaaatgacttaatggatgtgaaagggttta

SEQ ID NO: 20524 - DNA, 201 bp, Homo sapiens
aagtagcagcgtggctgctggggaaaaggggaatggggagttattctttaatggctacagagtttcagttaggggtgatggagaagttctggagatgggcrgtggtgacggccggccgcacagcaatatgacgtgcttaatgccactgaactgtgcactgaacatcgttaaggtggtaaattttgtgttatatatattttg

SEQ ID NO: 20525 - DNA, 201 bp, Homo sapiens
catgattctacagagatgcctgtgtcggcaccattctcccatcagctgcggccactgggcgggttctgattctgaggggagcagaaacaggtgttcccccvcaaggagccaggctgtcagggatcacaacctagcgggggctggggggggcggccactggcccaaggtcctggttatacagatcaaaaggcagagcccagg

SEQ ID NO: 20526 - DNA, 201 bp, Homo sapiens
gtggggagctcagagctgagatcctacaggagtccagggctggagagaaaacctctgcgaggaaagggaaggagcaagccgtggtaggtcgggtttctgtrccttggggtctgtctcctcttctttctcttaaaagtctttccagcaagctgagccagtgaaggaatgctttaaccaagggaccaactttgtaattcaggc

SEQ ID NO: 20527 - DNA, 201 bp, Homo sapiens
gctcatgcctgtaaccccagcactttgggagaccgaggtgggtggatcacttgagatcaggagttcgagaccagcctgtccaatatggtgaaaccccgtcyctaccaaaaatacaaaaattagccgggcatggtatcgggcacctgtaatcccagctactcgggaggctgaggcaggagaatcacttgaacccaggaggtg

SEQ ID NO: 20528 - DNA, 201 bp, Homo sapiens
cctggttaatttttgtatttttagtagagacagggtttcaccatgttggccagactggtcttgaactcgtgacctcaggtgatccacccacctcggccccycgaagtgctgggattacaggcatgagccaacatgcctggcctgaatcttcatttttacaaaaacaatagggcagaggaagcaatcagatatgcgtttgtc

SEQ ID NO: 20529 - DNA, 201 bp, Homo sapiens
aatgacatcacggctgtgaataatcagcctggcccgaagccaggatgggctgtgctgcttccaccgtgaacttcctccccctgctttataaaaacaggccygcctcagctccctcatggccctgtccactgagcatcctcccgccacacagaaacccgcccagccggggccaccgaccccaccccctgcctggaaacttaa

SEQ ID NO: 20530 - DNA, 201 bp, Homo sapiens
gctgggattaccagcatcagtcaccgtgtttggccagtattcattatcttgttgtcttccagttgtgtctcttcaataagggagtatgcaatggagtctayagaaagcaagtgagggagttttctcagtaggtgcaagggtagtgaggcatttcattttgagtcatactctgatgaggctggcctgtcttttctcatagtg

SEQ ID NO: 20531 - DNA, 201 bp, Homo sapiens
ggctgaggcgggcggctcacctgaggtcaggagtttgagaccagcctggccaacatggtgaaaccctgtctctactaaaaatacaaaaattagccggatayggtggcaggcacctgtaatcccagctactcaggaggctgaggcaggagaattgcttgaacctgggagatggaggttgcagtgagccgagatcatgccact

SEQ ID NO: 20532 - DNA, 201 bp, Homo sapiens
gttttccaacctaaatcccaagttaagggtcctggcctgtaaccatttagtcctcagctgttctcctgacatctttattgcaatgatttgtaagagttccrtaacaggacagctcacagttctgtctgacaaccctatgagattagaacactacattactgactgggtaacaaagttaaagagaagttctcctagggtggg

SEQ ID NO: 20533 - DNA, 201 bp, Homo sapiens
ctgcatttcaacctcagtgacagggcaagccctcacctctaaaacaaaacaaaacaacacaaacaaaaacaaaaacacagaaaagcccagtacaaatcgayttcaaactgagacttcgagttcaggggtccagtcatgaaccctgtctttcatggtccccggaaagttcaaatcttcaaaaggagcctccaggcctgttcg

SEQ ID NO: 20534 - DNA, 201 bp, Homo sapiens
gaataaatgtttgcaaagcaaaaatggtaaggaacacctcttactaccatgaagttcaaaaacaatcacaaatagggcaggctccctgactgcctccacasctcacagtttatcatgcattcgtgtatttagcacagactagacagatttttactttataacactttgtattcattcattttccaacgtgcttattccggt

SEQ ID NO: 20535 - DNA, 201 bp, Homo sapiens
cctgggggaggaaagtccaggaggacaggccgatagccctcctgcacctgaggggagaaagggggaggccaggagtgagtcattttggttgcagagggaaraaagacaggacttaggtctgtgcctgggcttggcctctgactggctatttgtctgacctggagctgatctcctcacactctgaccctcaatttcctcctc

SEQ ID NO: 20536 - DNA, 201 bp, Homo sapiens
tgcttcagaatttgtttttgtttcagtttgagaattcttttcttctaggaaacagtgactgctactttgggaatgggtcagcctaccgtggcacgcacagyctcaccgagtcgggtgcctcctgcctcccgtggaattccatgatcctgataggcaaggtttacacagcacagaaccccagtgcccaggcactgggcctgg

SEQ ID NO: 20537 - DNA, 201 bp, Homo sapiens
ttctaggccttcatggctgtctggtgcagactgtgtgcctaccagacttccaggctgggtggggagggggcttccatgactgaagccacggtgggtgggcrggtgtccatgacccatgcatgggggtggtggggaggggcaagaagaaagaaaagaacacagcaacctctctgagaagtcagtaggctctacccggctctc

SEQ ID NO: 20538 - DNA, 201 bp, Homo sapiens
tgatagatgctcctgctgagccctgtgatgtgccagggccctgacatgcgtggcttctctctgatcctcacgtgacctgcagatgcaaaagccagagctcrgcatagttgaaaatcttgattgaggtcatatcccagttactggcacagccggatttaaacctaagactttcccctacacgacagggcttttatttctcag

SEQ ID NO: 20539 - DNA, 201 bp, Homo sapiens
ataagaagataaaaaggaaaccttaaactctcttatcatttaggaatcctgatggggatgccaagccctggtgccacgtgctgaagaaccgcaggctgacrtgggagtactgtgatgtgccctcctgctgtaagggctgggccccggctgcctccctgcacctggtctcccttcttcaccatctcctcgccactttctagg

SEQ ID NO: 20540 - DNA, 201 bp, Homo sapiens
gtgttttggaggggagaggcagtcggggaaagggagactagggaggttgcattcattggagaagcctctgctgacagagtaaaggggaaagtgaaaagaaygatacagaaaagccccaaatagcctatgggagtacctcaagacgagcaagcaataaaagcaaaatcggctgccttgggacacgtgcctgtgacagctggg

SEQ ID NO: 20541 - DNA, 201 bp, Homo sapiens
gggaggacggggcagagaggggagcctcctgagggctgaatgaaaggggactcccatgtgaggcatccatgccctgctctctgtcagataccagggccacrtgctacgaggaccagggcatcagctacaggggcacgtggagcacagcggagagtggcgccgagtgcaccaactggaacagcagcgcgttggcccagaagc

SEQ ID NO: 20542 - DNA, 201 bp, Homo sapiens
ccactgggcgggttctgattctgaggggagcagaaacaggtgttcccccccaaggagccaggctgtcagggatcacaacctagcgggggctggggggggcrgccactggcccaaggtcctggttatacagatcaaaaggcagagcccaggagagagcaagtggcttgcccagggtcacacagccgccagcagcacggccag

SEQ ID NO: 20543 - DNA, 201 bp, Homo sapiens
cttgggccagttacccgagggggtctctgagcagaggtatctggccggcaggttcacatgggcttctgggttggccgcctttactcttagtacacctggcwtgtgctgatccttcctccacctctggtttcttcgcaggaaatccatgcccgattcagaagaggagccagatcttaccaaggtcgggtgaagctgaggggt

SEQ ID NO: 20544 - DNA, 201 bp, Homo sapiens
atgcttaacagagaagcagctcatgtgggtgcttgagggctgggggggcagggtgggggtctggtaggcgctgggaggaggacatccctgcagcttctccrgccccatagatgggactcttgatgtgggcagtttttatttcagctgagtctccagaaggcaggggacagggactgggaggggatgctaaacccgataacc

SEQ ID NO: 20545 - DNA, 201 bp, Homo sapiens
cttaagggctgatggctttgatcgaatttcaggcatgttggccccaaggccctgtgtatattccctgggcccactcaaggggatgctggagccggaaagtycccggaggccacctactgcagccctgcactttacaaagaagagaaagattctccctaaaattacagaacagggccaaagatgcctaccggagcaaacccc

SEQ ID NO: 20546 - DNA, 201 bp, Homo sapiens
tcctagttccaagaataaatcggatgctgcaatgctgctgttggggatatgctgacacagctcctcagagaggagaaaggtggtcgtctctctggtggagytgtcagaactgctcagtttagaggttcttggaacaaaagtcgtttaaactcacaaaagaaagagattctttaactcccaagagcttgactggggtgaggg

SEQ ID NO: 20547 - DNA, 201 bp, Homo sapiens
agcgggtggtatgtgtggaccagccctaggtcgtgcttctcctccatctggtccccccacccctagttatccagaaagggggatgttcccaggcaatgccracatgtccatactgcactcttcacattgcagtttcccggcatctgggattgcattccttttggaaggactttgagttcttgaaataaagaagtaacttgg

SEQ ID NO: 20548 - DNA, 201 bp, Homo sapiens
catcagctgcggccactgggcgggttctgattctgaggggagcagaaacaggtgttcccccccaaggagccaggctgtcagggatcacaacctagcggggrctggggggggcggccactggcccaaggtcctggttatacagatcaaaaggcagagcccaggagagagcaagtggcttgcccagggtcacacagccgccag

SEQ ID NO: 20549 - DNA, 201 bp, Homo sapiens
gtgggatagagaaatgcctctgatctccctaggtgccacccctacaagtctccacaggtcagtttggccctctggctttttgcccagggtgcatcagtcawgtgtgcagtcctccttaaaggacattttaattacaggggaaaaaactgacattaatgtcttttattcctaaagcactctgcaggaagcatgtggggttct

SEQ ID NO: 20550 - DNA, 201 bp, Homo sapiens
gactttcatagtgtggcttggtcagatgggccttatcaatagagatggcctgatgtctcagctgtgtcatctcagctgctagttctggcttctgctgggartccacagtggcctctgcatgcatggtgtgggaaaggcaaataaaaaagcagattaaaaaccagattaaagacatcaccctgtattcaggaaataatggct

SEQ ID NO: 20551 - DNA, 201 bp, Homo sapiens
ctaaaaaatgaaactttagtttggaaatggccagagagtaggttattaatcacctcctgtgaacacagatcagccagaatgttccccaaggaacacaagtycaactgggacgatgagacacagaccaccagctaactcacacccaagggcattagtgtgagtcctcagtggtccgtgtccctaagctcctcagagctgagc

SEQ ID NO: 20552 - DNA, 201 bp, Homo sapiens
tgaagtacctaggccagtaaataaatgcaggtcacagagacttaagtcacagatttcttgacttcagactgctcacttgcatgttctacagtttttagacrgatgtgtgtctcagccatttaagaaaaacattgtttgaggccaggaacggtggctcatgcctataatcccagcactttaggaggctgacgtgggtggatc

SEQ ID NO: 20553 - DNA, 201 bp, Homo sapiens
ctttaggggctgggggtagaagagatacaaagagaagtgaggccaggctctggtgctgaaggatgtgtgggctttgttttcgcaaggcagtcatatcggcrgtttcccctctgattccctgacaggatttagtttctttttgaatggtttcttcagcaacctcagctgtaccagcttacagtccagaaacaaaaaggttgt

SEQ ID NO: 20554 - DNA, 201 bp, Homo sapiens
gggagggaggcagggcggggtgcagggtgcatcacccacccaccacctgccttcttccacccaccacctgcctacggtgtgacagtgccattgcagcatgrttctacagagatgcctgtgtcggcaccattctcccatcagctgcggccactgggcgggttctgattctgaggggagcagaaacaggtgttcccccccaag

SEQ ID NO: 20555 - DNA, 201 bp, Homo sapiens
caaactaaccacacctctcccacaggaccctacagcggggagagccaggtgactgcgtggagtagacagccagctgcaactccattgcccaatatggtggycacttaccttgtgcaactgtttaaatttaaaataattaaagttaaaaattgtttctcagtcccactggccacattcaaagcactcggtggccctgtgtgg

SEQ ID NO: 20556 - DNA, 201 bp, Homo sapiens
gggcagtttttatttcagctgagtctccagaaggcaggggacagggactgggaggggatgctaaacccgataacccagtatggatgagctaacagaggccrggcacacagctcctgcctgtaatcccagcactttgggagcccgaggtgggcgggttgcttgagccaaggagtttgaaaccagcccgggtcttgaacatag

SEQ ID NO: 20557 - DNA, 201 bp, Homo sapiens
gcccaaatccaggaaacggaggttgcagtgagaggagatgcgccgctgcactccagcctgggataaacagcgagactctgtcaaaaaaaaaagcacccccyattcctccagaaaaggataccaaagtccttgggtcctaaaggagaggcttcacctttgacctaccctggcccttcccttggctgatttttcagaaaccca

SEQ ID NO: 20558 - DNA, 201 bp, Homo sapiens
cgtgggggcccgtctctgctgtctctgcctcacagggacactgcaggccaggaaaggacacaacagtatgagggcctcgaagtgctgcaggtgttgggaakgttctgagtaggaagtggagtacagtcgctaagcgtgtgggttctgggaagctggagttacaaagacccgatttcaaatcccacttgctgagctgtgtga

SEQ ID NO: 20559 - DNA, 201 bp, Homo sapiens
ctcttcagtaagtctccacttaacagcatgcctggaaaaaataggttcttagaaactgcaactgtaagtgaaatgacgtataacaaaaccaattttaccaycagctaattgatataaacaagagttggtcaggtgcggggctcatgcctgtaatcccagcactttgagaggctgaggaaggcagatcacctgaggtcagga

SEQ ID NO: 20560 - DNA, 201 bp, Homo sapiens
atagacattccttagagcagtttcaggtttacagaaaaattgagcaggaagcacagagttcccatattattatcccttctcttccctccgcagtttcccckgttattatcttgtacttagtccagtgatattgttttttttttaaactactattgtttttcagtttttagatagtcaaaacaaagttgtagacctatcatt

SEQ ID NO: 20561 - DNA, 201 bp, Homo sapiens
ggtttacagaaaaattgagcaggaagcacagagttcccatattattatcccttctcttccctccgcagtttcccctgttattatcttgtacttagtccagwgatattgttttttttttaaactactattgtttttcagtttttagatagtcaaaacaaagttgtagacctatcattatcttgtatgggaatttaaaaaatg

SEQ ID NO: 20562 - DNA, 201 bp, Homo sapiens
tatgtagtgtttatattattattattttttgagatggagtctcactcttgttgcacgatcttggctcactgcaacctccacctcccaggttcaagtgattytcttgcctcagcttcccgagtagcggggattacaggtgcccgccaccatgcctgactaatttttgtgtttttagtagagatggggtttcaccatgttggc

SEQ ID NO: 20563 - DNA, 201 bp, Homo sapiens
ttattttggtatgtcggtataattatgttatcagtcatctcaatggctacacaatattgcagtattctaacatgtcctagtctactaggcccctatgtttygacatctaagttattttcagtatttagacagtcaaaacaatgttgaatacttatcattatcttgtatggggatttaaaaaatgcatgtcagcaggctaaa

SEQ ID NO: 20564 - DNA, 201 bp, Homo sapiens
actctgcaggaagcatgtggggttctccagattttcactgttattatctttattttcttaacctcacagggagggagagaggaagggagggagggaagacsaaaacacgccgaggtcccaggtaactaatgacaactcaagctcaaagaagtgtggtaacaaggatgtgtttggtggccaattgggaataatatggtggtc

SEQ ID NO: 20565 - DNA, 201 bp, Homo sapiens
tcctttctccctcccagcgctgctgcagctgaaatcggattcgtcccgctgtgcccaggagagcagcgtggtccgcactgtgtgccttcccccggcggacytgcagctgccggactggacggagtgtgagctctccggctacggcaagcatgaggcctgtaagtggaaggaagtctcggccccatcctgtctgcgggacag

SEQ ID NO: 20566 - DNA, 201 bp, Homo sapiens
tttgaagattacgatgttcatgctacacatactgactttctccagatagtctgctttttttgcaaacgccaaacctgctatctcctttgcagggcgattcrggaggccccctggtgtgtctgaacgatggccgcatgactttggtgggcatcatcagctggggcctgggctgtggacagaaggatgtcccgggtgtgtaca

SEQ ID NO: 20567 - DNA, 201 bp, Homo sapiens
cagagaagctacttctgcacatgttaaacacacatggaaccaaacagctcgatggagacaccctgcactgcttatggtgatgctgcaggaatggcggcagygatgcccgctacactccatggcctgctgcacgtgtgacaggacagttatttcatctatgcttacacctgcaggtcccttaccctagaaacactctatatc

SEQ ID NO: 20568 - DNA, 201 bp, Homo sapiens
ttgacatttcccttggctcatgacgttggggtcctgagatttattttcctttcacactagatagatagacatttatgttaaggaactggctgacaggatcrtgggggctggcaagtccgaaacatcttggtaagccaggctggaagtgcaggcagaagctgaggctgctctcttaaggcagaatttcttattcaggaaacc

SEQ ID NO: 20569 - DNA, 201 bp, Homo sapiens
tattttttggtgaattacaatgagaaaaagtccaggtgcaatggctcacatctgtaactccagcactttaggaggcggatccaggaggatggctttagccyaggagttcaagaccagcatgggcaacatagtgagacacctctgcctcccccaccccaccccgcctctacaaaaaaatttaaaaattagctgggtgtggtg

SEQ ID NO: 20570 - DNA, 201 bp, Homo sapiens
tctacagagatgcctgtgtcggcaccattctcccatcagctgcggccactgggcgggttctgattctgaggggagcagaaacaggtgttcccccccaaggrgccaggctgtcagggatcacaacctagcgggggctggggggggcggccactggcccaaggtcctggttatacagatcaaaaggcagagcccaggagagag

SEQ ID NO: 20571 - DNA, 201 bp, Homo sapiens
aatcagctcaaggcgcaggaaggtccagggaagccaaggaagagaagagacaagtctccaactctctcaggagcaaagacaaaaatatgctcctgctctcytatctcttattcagaccgttcagttgcaaaagggttgaacatgatgcagcgggtggtatgtgtggaccagccctaggtcgtgcttctcctccatctggtc

SEQ ID NO: 20572 - DNA, 201 bp, Homo sapiens
acacaatattgcagtattctaacatgtcctagtctactaggcccctatgttttgacatctaagttattttcagtatttagacagtcaaaacaatgttgaawacttatcattatcttgtatggggatttaaaaaatgcatgtcagcaggctaaatattcaaaaaattactgctccaagaaaataatccaatttttaacttaa

SEQ ID NO: 20573 - DNA, 201 bp, Homo sapiens
cttaccaaagagttgcaagaataaagacctcctcctacagtttggtgaacagctcttaacaagaataagatttgtaagagtccttcccatgccttcagctkgtcctgttttgatgtttctcattgtttgtgtggaattcacacaactggtgctgttaccaccatgggcgtctagtctggatcagtggtcctcagtcttttt

SEQ ID NO: 20574 - DNA, 201 bp, Homo sapiens
atgtagcgaggcaaggagggtgatcagcacctcccacgggggagttcgtttcgaagtaacaatcaaagatccagagccggacccaggcagggaggcaaggyctggaagcccctgtgcctccaggcccctaggacgctcgggggagggggagggggagggtgggacctgaagttgttgtgaccgaagggaaatgagtcaggg

SEQ ID NO: 20575 - DNA, 201 bp, Homo sapiens
agttgcaagaataaagacctcctcctacagtttggtgaacagctcttaacaagaataagatttgtaagagtccttcccatgccttcagcttgtcctgtttkgatgtttctcattgtttgtgtggaattcacacaactggtgctgttaccaccatgggcgtctagtctggatcagtggtcctcagtcttttttgcaccaggg

SEQ ID NO: 20576 - DNA, 201 bp, Homo sapiens
aggaaatttgaggaaagctgagaaagagaagatctggagtaagtctctgtgatgagaagattccaccccgcactcctgttctgggtggccttggctcctgrctccctttcttctgaaactgcctggagccagggagtagcacagctgcttcctcccggggagaaagggacacccaaagagcgcactccagggagaccttgg

SEQ ID NO: 20577 - DNA, 201 bp, Homo sapiens
gaataaagacctcctcctacagtttggtgaacagctcttaacaagaataagatttgtaagagtccttcccatgccttcagcttgtcctgttttgatgtttytcattgtttgtgtggaattcacacaactggtgctgttaccaccatgggcgtctagtctggatcagtggtcctcagtcttttttgcaccagggaccagttt

SEQ ID NO: 20578 - DNA, 201 bp, Homo sapiens
tttctcattgtttgtgtggaattcacacaactggtgctgttaccaccatgggcgtctagtctggatcagtggtcctcagtcttttttgcaccagggaccarttttgtaaagatagcttttccacggacagagggaggggagatagtttcgggatgattcaagaggattacatttattgtgcactttatttatattactatt

SEQ ID NO: 20579 - DNA, 201 bp, Homo sapiens
cttaaaagaaaaaaaaaaaaaggacatgctacagcatggatgcaccttgaagacatttgcaaagtgaaacaaaccagtcgcaaaagaagaaacactgtctsattccacttctaggatgtatgtagagcagtcaggttcatacagacagaaagtagcagcgtggctgctggggaaaaggggaatggggagttattctttaat

SEQ ID NO: 20580 - DNA, 201 bp, Homo sapiens
accttgctaacacagcaacatcccaaccgttggttcggcctagaagctggtatttgggccatctgtctcccattgtcttaattttctgctcattagaaatygaacccctaaaccagtccacacaagtacgttatctaagtaatgttgcattctgcttctcttagactactttttttttttttttttgagacagagtctcgc

SEQ ID NO: 20581 - DNA, 201 bp, Homo sapiens
tggtgctgttaccaccatgggcgtctagtctggatcagtggtcctcagtcttttttgcaccagggaccagttttgtaaagatagcttttccacggacagarggaggggagatagtttcgggatgattcaagaggattacatttattgtgcactttatttatattactattacattgtattatataatgaaataatggtatg

SEQ ID NO: 20582 - DNA, 201 bp, Homo sapiens
ttacaggggaaaaaactgacattaatgtcttttattcctaaagcactctgcaggaagcatgtggggttctccagattttcactgttattatctttattttyttaacctcacagggagggagagaggaagggagggagggaagacgaaaacacgccgaggtcccaggtaactaatgacaactcaagctcaaagaagtgtggt

SEQ ID NO: 20583 - DNA, 201 bp, Homo sapiens
caggaagcatgtggggttctccagattttcactgttattatctttattttcttaacctcacagggagggagagaggaagggagggagggaagacgaaaacmcgccgaggtcccaggtaactaatgacaactcaagctcaaagaagtgtggtaacaaggatgtgtttggtggccaattgggaataatatggtggtctcctgt

SEQ ID NO: 20584 - DNA, 201 bp, Homo sapiens
ccgggaaggggtcttgcaaataccattgtcaggtggagtcccctcaaaggtgacttcctagcagtacttgctgtggcaagaacgctcattctgggatctaractcaatccatgacggtcagcatgagctgctgggtgcgtgcttcctgtgcaggcagagtcggactccagcactggcagggacactgtgagtattgagata

SEQ ID NO: 20585 - DNA, 201 bp, Homo sapiens
ctttgagttcttgaaataaagaagtaacttggtgggcatctggaaaaaacacccaaactgtatcccaggctggggtgcaggagcctatcgagagggctggktggtgtggacagcgtgatgaagaaggtcaagttccttgtactcactcgtttgctgtttcattcacaattcctgtgaggtgggagctctcaccatccttgg

SEQ ID NO: 20586 - DNA, 201 bp, Homo sapiens
gcttgtttagatgcagactttgcagttaacattttattgcactgactgatttagttttcaccaggtggtccttgtgtttgcttcagaaggatctaagtgtrttaggacagggtttcttctgttttgattgtgggaggaggcgggatagacttctgttttcctagacccacaaccaaaattccccactcctccaaataaccg

SEQ ID NO: 20587 - DNA, 201 bp, Homo sapiens
tagcagtacttgctgtggcaagaacgctcattctgggatctagactcaatccatgacggtcagcatgagctgctgggtgcgtgcttcctgtgcaggcagartcggactccagcactggcagggacactgtgagtattgagatatgaatagctccatcctgcccacccatttattccacctaaaatgttctcaaagatgcaa

SEQ ID NO: 20588 - DNA, 201 bp, Homo sapiens
agacagggctggccgagcacagatatgctggctgtgtcctacacacaggtgcctacacacacatccttcagatccgggctgcactctatcagccaacccayggactctgttttttctaatttgcacagattctttgtcaacctgccatgccctgagactgctgaacttcatccaacagagagggtaccttttgcaaatctg

SEQ ID NO: 20589 - DNA, 201 bp, Homo sapiens
accaaacatcatttgcctcccctccttcctgcaaatatgcacattgccggatctgctgcagtctatgaaaaaggagacagatgttctggcagagcggtggsgggggtgggcgtggaggttgggttggggggcctctgctttgtggggagaacctcaggcaggggagtaggctccatcctgcgtggaggaacctgagcagtc

SEQ ID NO: 20590 - DNA, 201 bp, Homo sapiens
ttgtttgtgtggaattcacacaactggtgctgttaccaccatgggcgtctagtctggatcagtggtcctcagtcttttttgcaccagggaccagttttgtwaagatagcttttccacggacagagggaggggagatagtttcgggatgattcaagaggattacatttattgtgcactttatttatattactattacattgt

SEQ ID NO: 20591 - DNA, 201 bp, Homo sapiens
ctggccaagttgacatataagactattccagtccacaccttgtcaatttggcacccatgtgcatctccttaaaccatccttcacctccaagtaaacacagkaacaaaatcatactcctgcctaacatgatagaactaccagtgtacaaccaaaaacgcactcccggctgggcgtggtggctcacgcctgtaatcccagcac

SEQ ID NO: 20592 - DNA, 201 bp, Homo sapiens
caaatcttcaaaaggagcctccaggcctgttcggccttaggcggaggtgaaggtacaagcagaaaagggagcaagaccaagtgaccttgggcaaatgcccrcttgcctcagtttcctcatctgtaaagaggtgggaataacagtacacacttcatggtttgctgtgaggattaaattagctaatttttgtagactgtacaa

SEQ ID NO: 20593 - DNA, 201 bp, Homo sapiens
tgagaccagcctgggcaacaaagtgagactccatctctacaaaaaatacaaaaattagtcaggtgtggtggcttgtgcctatggtcccagctgcttgggasgctcaggtgggaggatcgcttgagcccaggaggttgaggccacagtgagcaatgattgtgccactgcactccagcctgggtgacagtgagatcctgcctc

SEQ ID NO: 20594 - DNA, 201 bp, Homo sapiens
aaaaattagccaggtgtggtggtgcgtgcccataagcacgagaattgcttgaaccccggaggtggagggtgcagtgagctgagattgcgccactgcactcyagcctgggtgggtgacagagtgagactctgtctcaaaacaaaaaaacaaaaaaaaacaaaaaaagaagagtgaagttcttgtggcaatatttctagtcat

SEQ ID NO: 20595 - DNA, 201 bp, Homo sapiens
aatggctcatgcctgtaatcccagcactttgggaggccgaggcaggcagatctcaagacgagcctggccaacatagtgaaaccctgtctccactaaaaatmcaaaaaaaaaaaaaaaaaaaattagctgggcatggtggtgggcgccctgtaatcctagttactcgggagtctgaggcaggagaatcgcttgaatccagga

SEQ ID NO: 20596 - DNA, 201 bp, Homo sapiens
aaaaaaaaaaaaacttccaagattgaaaaaatatatattaagttacaagaccaggcacagtggcttatgcctataaacccagcactctgggaggctgaggygggcggctcacctgaggtcaggagtttgagaccagcctggccaacatggtgaaaccctgtctctactaaaaatacaaaaattagccggatacggtggcag

SEQ ID NO: 20597 - DNA, 201 bp, Homo sapiens
gcgggaccagccctggacagacgccaccatcctattgcagagccactaacacccacactcactcagactgggcccacgtagatacatcctcagttggcttratgtgcaagctttgggatgtggaaggaaaccggggtacctggacaaaacccaggcagacagtgtccccagacaggaattgatttttgttttcctcatcaa

SEQ ID NO: 20598 - DNA, 201 bp, Homo sapiens
gtggttgttcactttctgtttctgagttatttcagttaggataatggtctccagtttcatccatgttgctccaaaagacagacttcattgttttttacggytttgtcgtattcctcggtgtatatgtgcattttctttatccagtcctccattgatggacacttaggttaattctgtgcctttgctattgtgaattgtgct

SEQ ID NO: 20599 - DNA, 201 bp, Homo sapiens
ctgtgcgggggcatactcatcagctcctgctggattctctctgccgcccactgcttccaggagaggtaggggctcggaaacccagttggtttttccaccckctaacgcctagaaaccaagccctttaggggaaatcccacagcaaaaaaagcattctaaggctgtttctccaccaggtttccgccccaccacctgacggtg

SEQ ID NO: 20600 - DNA, 201 bp, Homo sapiens
ggaagaaggcgggtcaccttctcactgaagataagagaccaagtgctgatggacagcaacaggcagtgtctgaaaactagtccgataccatcatggtcttygagggaaaatctgattccactggggtttccatgtcaatagtggactcaaatttaaaaagtctccagtccatttccagaagtacaagtgttttctacatga

SEQ ID NO: 20601 - DNA, 201 bp, Homo sapiens
tgtgatgcggacagagctatcgccctgctggggtgagattcacttgcattgaatcagctcaaggcgcaggaaggtccagggaagccaaggaagagaagagmcaagtctccaactctctcaggagcaaagacaaaaatatgctcctgctctcttatctcttattcagaccgttcagttgcaaaagggttgaacatgatgcag

SEQ ID NO: 20602 - DNA, 201 bp, Homo sapiens
atgaaagctgcccttgtctccaaaatgctccttctctgcccgactccccaagaccagcttggtttatttcacaatgactcgcgtcggattctcccagtgtytgcggctccccctgcttcatcacaggcctgggacagtccaggcagccagggaatagctgggaatagcagttcccctttgttggtttttgagttcactgag

SEQ ID NO: 20603 - DNA, 201 bp, Homo sapiens
tgcattgaatcagctcaaggcgcaggaaggtccagggaagccaaggaagagaagagacaagtctccaactctctcaggagcaaagacaaaaatatgctccygctctcttatctcttattcagaccgttcagttgcaaaagggttgaacatgatgcagcgggtggtatgtgtggaccagccctaggtcgtgcttctcctcca

SEQ ID NO: 20604 - DNA, 201 bp, Homo sapiens
ttggtttttgagttcactgaggctttgatttcccccagggcctgacgttgctgagcagagccagcggccagtagatttcaaaggattccaaaaaacagtcwggcactcctttgtgaacccaaaagtatctgagacaggtctgtcaatttagaaagtttattttgccaatgttaagaacacacatgtgacacggcctctgga

SEQ ID NO: 20605 - DNA, 201 bp, Homo sapiens
ttcacttgcattgaatcagctcaaggcgcaggaaggtccagggaagccaaggaagagaagagacaagtctccaactctctcaggagcaaagacaaaaataygctcctgctctcttatctcttattcagaccgttcagttgcaaaagggttgaacatgatgcagcgggtggtatgtgtggaccagccctaggtcgtgcttct

SEQ ID NO: 20606 - DNA, 201 bp, Homo sapiens
ccaaggtatggcttggtttcatacatttcagggagacatgagacattaatcaatgtatgtaagatgtgcaccggttcggtctggaaaggcaggacaactcsaagtaggggcttccaggtcataggtagataagagaaggcttcattcttctgagtctttgtcagcctttcactgaatacacaatttacatatgagaggggg

SEQ ID NO: 20607 - DNA, 201 bp, Homo sapiens
gccatttgtaagagtttcccagtttatactgcatgtgacactccccatgtcgtatgttctcacaacagaacagaaaccgcaggatgtcagcaccggaggcraccttggagcatccagcccacttggttttgcattgctggcaggagattttatgcctcaaaatatagatgctttttggaaggacagcacattaattatttt

SEQ ID NO: 20608 - DNA, 201 bp, Homo sapiens
catttcagggagacatgagacattaatcaatgtatgtaagatgtgcaccggttcggtctggaaaggcaggacaactcgaagtaggggcttccaggtcatargtagataagagaaggcttcattcttctgagtctttgtcagcctttcactgaatacacaatttacatatgagaggggggcagaggaagagtcacttatgcc

SEQ ID NO: 20609 - DNA, 201 bp, Homo sapiens
atgagaggggggcagaggaagagtcacttatgccttagttggctcagtgaatctacttttttttttgagacggagtttcactctttttgcccaggctagartgcaatggcatgatcccggctactgcaacctccacctcccaggttcaagtgattctcctgcctcagccttctgagtaactgggattacaggcgcctgcca

SEQ ID NO: 20610 - DNA, 201 bp, Homo sapiens
tggtatgtcggtataattatgttatcagtcatctcaatggctacacaatattgcagtattctaacatgtcctagtctactaggcccctatgttttgacatytaagttattttcagtatttagacagtcaaaacaatgttgaatacttatcattatcttgtatggggatttaaaaaatgcatgtcagcaggctaaatattca

SEQ ID NO: 20611 - DNA, 201 bp, Homo sapiens
ctgctccaaccctaagtcaagccacatggtcttccgatagtggctcagttttctacttacataaaaagacagcacattctcttagcaatatgtgtttgtatgtgtgtgtgtgtgtgtgtgtgtgtgtgtgtgtgtgtatatatatatatatatatatataatttagagacaaggtctgactccatcacccaggctggagtg

SEQ ID NO: 20612 - DNA, 201 bp, Homo sapiens
tgtcaatattttttaaattaatagacattccttagagcagtttcaggtttacagaaaaattgagcaggaagcacagagttcccatattattatcccttctyttccctccgcagtttcccctgttattatcttgtacttagtccagtgatattgttttttttttaaactactattgtttttcagtttttagatagtcaaaac

SEQ ID NO: 20613 - DNA, 201 bp, Homo sapiens
aaagagtgttagatttggggtaagagaactgtgtctcctgggcttgagtcctgatgccaactctcacaagatgtgtcaccgtacagcacgacgcttatactttttttttttttttttttgagacaggatcttgctctgtctcaagctggagtgcagtggtatgatcacagctcactgcagcctcaaactcccaggctcagg

SEQ ID NO: 20614 - DNA, 201 bp, Homo sapiens
cttgagtcctgatgccaactctcacaagatgtgtcaccgtacagcacgacgcttatactttttttttttttttttttgagacaggatcttgctctgtctcragctggagtgcagtggtatgatcacagctcactgcagcctcaaactcccaggctcaggccatcctcccacctcagcctcccaagtagctgggactacagg

SEQ ID NO: 20615 - DNA, 201 bp, Homo sapiens
gatgtgagccaccacaccttgcaaatttttgtattttttgtacagccgagggtctccctatgttgccgagggtgatcttgaactcctgggctcaaatgatycaccctcctcagcctcccaaagtgttgggattacagacgtgagccactgctctcagccccttacacttttttgaagttcagttctcccatctgtaaaaac

SEQ ID NO: 20616 - DNA, 201 bp, Homo sapiens
gggacacccaaagagcgcactccagggagaccttgggcactgcgggctcaaaggctggagatggcacttctgttccctcctgatgggacaggtgcagggargctgagaggatgccacgctggcgagcctccctctgagctgtgttttctcattggaattgctgtacccggagcctcctgcaggtttccctcgccctctccc

SEQ ID NO: 20617 - DNA, 201 bp, Homo sapiens
ttaggttaattctgtgcctttgctattgtgaattgtgctgttgtgaattgtgtgtgataaacgtgtgagtgcaggtgtctttttgatgtaatgatttcttyttctttgaatagatactcagtagtgggattgccgggtcaaatggatgttctatttttagtttgggaaatctccatattgttttccatagaggttcaggat

SEQ ID NO: 20618 - DNA, 201 bp, Homo sapiens
cacactctctgaaaatgcctagcaataaagggcctcacggaagtccaaactaaccacacctctcccacaggaccctacagcggggagagccaggtgactgygtggagtagacagccagctgcaactccattgcccaatatggtggccacttaccttgtgcaactgtttaaatttaaaataattaaagttaaaaattgtttc

SEQ ID NO: 20619 - DNA, 201 bp, Homo sapiens
aaatgggggaaataaatgaaaacaggcagcactccacggctcataccctcctccttcccaagcccatcatcagatcctcaggacactggcagacacagtcygagaaataacccccaccccagccccactgaagcacgttggttcactgcagcctgttaagtaacacaaggaaacccctactggctttcaaagcagcttcag

SEQ ID NO: 20620 - DNA, 201 bp, Homo sapiens; identical to SEQ ID NO: 2080

SEQ ID NO: 20621 - DNA, 201 bp, Homo sapiens
aggccccagtttctagggctgcaggatattgctgggtcttaatcattcgggtatatttcagcaaagctcagggcccctgctaatgatctgcaaaccctctyctctcagtctcccgttgtttagcccctatttataagtgagtgcatgtggttgttcactttctgtttctgagttatttcagttaggataatggtctccagt

SEQ ID NO: 20622 - DNA, 201 bp, Homo sapiens
gccacagtgagcaatgattgtgccactgcactccagcctgggtgacagtgagatcctgcctcaaaataaatacataaatatgtgtgtgggtgtgtgtatayatatatgtaatacacatatattaaatttatatatgatatatataaacacgcaccagctatatgcattcagcacccaggtccacgggtgatgcctgtgact

SEQ ID NO: 20623 - DNA, 201 bp, Homo sapiens
tgggcacaacccaggggagaatgcccctgggacaacaggttcttcaccaaagaaaaaagttatcaccagagtggagtgatttcctcttagtgatacccctrgggattctagatgagggcctcacagaataaagcaactggaggaagatcaaagtcacctaaacctaagaattctaaactgcaggaaatttccccaggatct

SEQ ID NO: 20624 - DNA, 201 bp, Homo sapiens
gcacatagagcacattcttaatattttaactcacatcatccttggagctgctttgaaaatacaggggacccttgaacaacacttgtctgacctgcagggtycacttatgtatggatttttttcaaccaaaggcaggatgaaaacagtatttgtaggatgcagaactggtatacgcgtgttccacgctgcaggacttgagtg

SEQ ID NO: 20625 - DNA, 201 bp, Homo sapiens
ctgaggggagcagaaacaggtgttcccccccaaggagccaggctgtcagggatcacaacctagcgggggctggggggggcggccactggcccaaggtcctrgttatacagatcaaaaggcagagcccaggagagagcaagtggcttgcccagggtcacacagccgccagcagcacggccagggcagtcacagccgaggcca

SEQ ID NO: 20626 - DNA, 201 bp, Homo sapiens
atcatggcctctgtactatgcagggcctggagaagtgggatgagagctaccaggctcaaagctcctgtcccgaacaaagggttgctttcgtgggagcacgycaccctttccaaggctagttcctctcccagcatctcacttcagctctcgtcctgctctagaaacgtgcctttgctggtccaaggaatcctggccgtttct

SEQ ID NO: 20627 - DNA, 201 bp, Homo sapiens
tggtagtttttgaaagtggtttttattctgagatcatggcctctgtactatgcagggcctggagaagtgggatgagagctaccaggctcaaagctcctgtyccgaacaaagggttgctttcgtgggagcacgccaccctttccaaggctagttcctctcccagcatctcacttcagctctcgtcctgctctagaaacgtgc

SEQ ID NO: 20628 - DNA, 201 bp, Homo sapiens
gaaaatcaccttttcgaaaagttaagaattacttatgtgatggtagtttttgaaagtggtttttattctgagatcatggcctctgtactatgcagggcctrgagaagtgggatgagagctaccaggctcaaagctcctgtcccgaacaaagggttgctttcgtgggagcacgccaccctttccaaggctagttcctctccc

SEQ ID NO: 20629 - DNA, 201 bp, Homo sapiens
gcagcgcgttggcccagaagccctacagcgggcggaggccagatgccatcaggctgggcctggggaaccacaactactgcaggtgagggcacatccccaargagggattccccctgtgagaagctgctacagctggggaaagattctgtcagatccgtcagggttctcccaagaaacataaccaatacaggatggatagat

SEQ ID NO: 20630 - DNA, 201 bp, Homo sapiens
ccaccaggtttccgccccaccacctgacggtgatcttgggcagaacataccgggtggtccctggcgaggaggagcagaaatttgaagtcgaaaaatacatygtccataaggaattcgatgatgacacttacgacaatgacattggtaagagctcgtcattcccggctccagttcatacagatcacacaacacacccacatg

SEQ ID NO: 20631 - DNA, 201 bp, Homo sapiens
gccacacaattaagaaacgtttgcctcagcctggtgtggtggttcacgcctgtaatcccagcactttgggaggctgaggtgggaggctcacctgaggtcargagttcgagaccagcctgaccaacatggagaaaccccatctctactaaaaatacaaaattagcctggcatggtggcacatgcctgtaatcccagctactc

SEQ ID NO: 20632 - DNA, 201 bp, Homo sapiens
agtcccagctacttgggaggttgacgcaggaggactgcttgagcctgggaggcagaggttgcagtgagccaagacagcaccattggactccagcctgggtracagagaccctcgaaaaaaaaaaagaaaaagaaaagaaaagaaaaaattaggctgggcacggtggctcatgcctgtaaccccagcactttgggagaccga

SEQ ID NO: 20633 - DNA, 201 bp, Homo sapiens
ccaggcctgttcggccttaggcggaggtgaaggtacaagcagaaaagggagcaagaccaagtgaccttgggcaaatgcccgcttgcctcagtttcctcatstgtaaagaggtgggaataacagtacacacttcatggtttgctgtgaggattaaattagctaatttttgtagactgtacaacagcgcctggcacatagagc

SEQ ID NO: 20634 - DNA, 201 bp, Homo sapiens
gataggtgatagatagatgatagattgatagatgattgatagataaatagatgatagatacatagatgatagatggtagatagatgatagatggatagatdatagatgataggtggtagatgatagacagatgattagaaagatagatgatagatacatagatgatagacacatagatgatagacagattgacagatgata

SEQ ID NO: 20635 - DNA, 201 bp, Homo sapiens
aaagatagatgatagatacatagatgatagacacatagatgatagacagattgacagatgatagatgattgatagatgattaaatagatgatacatagatdataatgataaatagatgatagatgatagatgataggtgatagatagattgatagatgatagaagattgatagatgatagatacataggtgatagtagatg

SEQ ID NO: 20636 - DNA, 201 bp, Homo sapiens
catggaaccaaacagctcgatggagacaccctgcactgcttatggtgatgctgcaggaatggcggcagcgatgcccgctacactccatggcctgctgcacrtgtgacaggacagttatttcatctatgcttacacctgcaggtcccttaccctagaaacactctatatcttcttaggtacttcccttgaaacaggatgagt

SEQ ID NO: 20637 - DNA, 201 bp, Homo sapiens
atagatgattgatagatgattaaatagatgatacatagatgataatgataaatagatgatagatgatagatgataggtgatagatagattgatagatgatagaagattgatagatgatagatacataggtgatagtagatgtaagatgatagatgatagatagatagatgatagacagattgatagatgatagagagatag

SEQ ID NO: 20638 - DNA, 201 bp, Homo sapiens
caacacaactctgcagcaaaaactagtcccaaagtcagaagataaaactagcaaaaactttgcacaatatttagagaaaagctctagggtgtggagagtaygggtcttcctttttctccatgcaccaagcagagcacagtatcattccttaagctataaacaaaaacccttttgtataaatatttaaatagtaacagacac

SEQ ID NO: 20639 - DNA, 201 bp, Homo sapiens
tagatgattgatagatgattaaatagatgatacatagatgataatgataaatagatgatagatgatagatgataggtgatagatagattgatagatgatagaagattgatagatgatagatacataggtgatagtagatgtaagatgatagatgatagatagatagatgatagacagattgatagatgatagagagataga

SEQ ID NO: 20640 - DNA, 201 bp, Homo sapiens
gctacaggggcacgtggagcacagcggagagtggcgccgagtgcaccaactggaacagcagcgcgttggcccagaagccctacagcgggcggaggccagaygccatcaggctgggcctggggaaccacaactactgcaggtgagggcacatccccaaggagggattccccctgtgagaagctgctacagctggggaaagat

SEQ ID NO: 20641 - DNA, 201 bp, Homo sapiens
atcgttaaggtggtaaattttgtgttatatatattttgcaacaataaaaaatatgtagtttctagaatcctcttctagatgcatgtctggcgtttctgccrcggggctggcactggaggaagccagacaggacaacattgcggcttatcctcctctgttgccatcatggacctctcgcaccccgtgatcaagctgtttttt

SEQ ID NO: 20642 - DNA, 201 bp, Homo sapiens
agatgattgatagatgattaaatagatgatacatagatgataatgataaatagatgatagatgatagatgataggtgatagatagattgatagatgatagaagattgatagatgatagatacataggtgatagtagatgtaagatgatagatgatagatagatagatgatagacagattgatagatgatagagagatagag

SEQ ID NO: 20643 - DNA, 201 bp, Homo sapiens
agcgggcggaggccagatgccatcaggctgggcctggggaaccacaactactgcaggtgagggcacatccccaaggagggattccccctgtgagaagctgytacagctggggaaagattctgtcagatccgtcagggttctcccaagaaacataaccaatacaggatggatagatggatagatgatagacagataatagat

SEQ ID NO: 20644 - DNA, 201 bp, Homo sapiens
aaggatgtgtttggtggccaattgggaataatatggtggtctcctgtagctgcttgatgacagaaaaaatgtcgtgtgtgtgtgtatgcgtgtgcattgcrgtcccgggaaggggtcttgcaaataccattgtcaggtggagtcccctcaaaggtgacttcctagcagtacttgctgtggcaagaacgctcattctgggat

SEQ ID NO: 20645 - DNA, 201 bp, Homo sapiens
ggaagataagctatccatttacaatgccaaggtgaaagtcaacagaactgttttagggtaaagatctttaggcctgcaaggaatgtccttgtagagaattaaaaaaaaaaaaaaaaaactttgcagctatcttattgaggaataaatgagaggcaggtttgcctgacgtagttcccggcttgacatttcccttggctcatg

SEQ ID NO: 20646 - DNA, 201 bp, Homo sapiens
caacgaggagccatggagattctgctcagggaagtgaggaactgggcatgccttaggaaaattaaccagggggtggctggcaagcaagcagacagcaggaraggaacgctgtggggatagggaggaagaacctcgcatgaccttgctaacacagcaacatcccaaccgttggttcggcctagaagctggtatttgggccat

SEQ ID NO: 20647 - DNA, 201 bp, Homo sapiens
tatcttgtaagaagcctctcctggaataaagacgccagagtactgcgacaccgtttcatgcctaaattaacaagacaagagaagcaggtcaagagaatgcrgaaagccctagactaaatgccggcagcttcaacgatttcgtcttttaaaactctggtgaaaaataactaggtggatctggaccttatgctcacaacccta

SEQ ID NO: 20648 - DNA, 201 bp, Homo sapiens
gtaccctgagtgtctagttattcatcaggccccttcctaactatgagctctttcaggataagagctgtgtctttgcatcaccagagcctgtgccagggcayggctggtgctccatacacgttgatggtgaatatatagcatgggtagatcattgtctgtgaatgcttaacagagaagcagctcatgtgggtgcttgagggc

SEQ ID NO: 20649 - DNA, 201 bp, Homo sapiens
gaagataagctatccatttacaatgccaaggtgaaagtcaacagaactgttttagggtaaagatctttaggcctgcaaggaatgtccttgtagagaattaaaaaaaaaaaaaaaaaactttgcagctatcttattgaggaataaatgagaggcaggtttgcctgacgtagttcccggcttgacatttcccttggctcatga

SEQ ID NO: 20650 - DNA, 201 bp, Homo sapiens
acgctgtggggatagggaggaagaacctcgcatgaccttgctaacacagcaacatcccaaccgttggttcggcctagaagctggtatttgggccatctgtytcccattgtcttaattttctgctcattagaaattgaacccctaaaccagtccacacaagtacgttatctaagtaatgttgcattctgcttctcttagact

SEQ ID NO: 20651 - DNA, 201 bp, Homo sapiens
ctttgggaagccaaggcaggtggatcacctgaggtcaggagttcaagaccagcctggccaacatggtgaaaccctgtctctactaaaaatacaaaaattakccaggcatggtggcaggcacctgtaatcccagctactcgggaagctgaggctgaagaattgcccaaatccaggaaacggaggttgcagtgagaggagatg

SEQ ID NO: 20652 - DNA, 201 bp, Homo sapiens
caattaagaaacgtttgcctcagcctggtgtggtggttcacgcctgtaatcccagcactttgggaggctgaggtgggaggctcacctgaggtcaggagttsgagaccagcctgaccaacatggagaaaccccatctctactaaaaatacaaaattagcctggcatggtggcacatgcctgtaatcccagctactcaggagg

SEQ ID NO: 20653 - DNA, 201 bp, Homo sapiens
tcatgacgttggggtcctgagatttattttcctttcacactagatagatagacatttatgttaaggaactggctgacaggatcgtgggggctggcaagtcygaaacatcttggtaagccaggctggaagtgcaggcagaagctgaggctgctctcttaaggcagaatttcttattcaggaaacctcatatttgctcttaag

SEQ ID NO: 20654 - DNA, 201 bp, Homo sapiens
catttagtcctcagctgttctcctgacatctttattgcaatgatttgtaagagttccgtaacaggacagctcacagttctgtctgacaaccctatgagatyagaacactacattactgactgggtaacaaagttaaagagaagttctcctagggtgggggtgtgctgcaaggtcaagatgaactcggtgtcctccctccca

SEQ ID NO: 20655 - DNA, 201 bp, Homo sapiens
cactgcttccaggagaggtaggggctcggaaacccagttggtttttccaccctctaacgcctagaaaccaagccctttaggggaaatcccacagcaaaaawagcattctaaggctgtttctccaccaggtttccgccccaccacctgacggtgatcttgggcagaacataccgggtggtccctggcgaggaggagcagaaa

SEQ ID NO: 20656 - DNA, 201 bp, Homo sapiens
atcaatgttagctattattggaaaatttggctttctctttcaaaaacgtttataaataactttccctaaaaccatatgatggttctcccctttcagtgtcycctttctattcggagcggctgaaggaggctcatgtcagactgtacccatccagccgctgcacatcacaacatttacttaacagaacagtcaccgacaaca

SEQ ID NO: 20657 - DNA, 201 bp, Homo sapiens
attctgaggggagcagaaacaggtgttcccccccaaggagccaggctgtcagggatcacaacctagcgggggctggggggggcggccactggcccaaggtyctggttatacagatcaaaaggcagagcccaggagagagcaagtggcttgcccagggtcacacagccgccagcagcacggccagggcagtcacagccgagg

SEQ ID NO: 20658 - DNA, 201 bp, Homo sapiens
aactggtgttgctgtgtttcagttctgtccagttctccctggtgaccttttcctcccttgattagttccatggcactgaaggctaaggaaaaaagggagcrggtgggtccaggaggggactgacctaggagacaggctgatatttttttttacttttagacaagtaagaaatgaaaaaatgtgcaagactattccctcagc

SEQ ID NO: 20659 - DNA, 201 bp, Homo sapiens
gggttctgattctgaggggagcagaaacaggtgttcccccccaaggagccaggctgtcagggatcacaacctagcgggggctggggggggcggccactggyccaaggtcctggttatacagatcaaaaggcagagcccaggagagagcaagtggcttgcccagggtcacacagccgccagcagcacggccagggcagtcac

SEQ ID NO: 20660 - DNA, 201 bp, Homo sapiens
ctcctgccgtgcacccaggtgtgggggaaggactttcctgcttcttttccagttaccttacaattcagcaagacggaaatgattagcccatgacaaaaacyaggaaacaggctcagagagagtgagttgcccacacagaatgtgtgctgtaaatgcagttagatttccaggttgagaatccagtgaccacgccccttcttt

SEQ ID NO: 20661 - DNA, 201 bp, Homo sapiens
ttccagggagaagcgggaagcctcagtgcttttgttgaggaaggatgttcatgacagtaggtgcaggtcgctcctgccgtgcacccaggtgtgggggaagractttcctgcttcttttccagttaccttacaattcagcaagacggaaatgattagcccatgacaaaaaccaggaaacaggctcagagagagtgagttgcc

SEQ ID NO: 20662 - DNA, 201 bp, Homo sapiens
cagtacttgctgtggcaagaacgctcattctgggatctagactcaatccatgacggtcagcatgagctgctgggtgcgtgcttcctgtgcaggcagagtcrgactccagcactggcagggacactgtgagtattgagatatgaatagctccatcctgcccacccatttattccacctaaaatgttctcaaagatgcaagcc

SEQ ID NO: 20663 - DNA, 201 bp, Homo sapiens
cctcatggccctgtccactgagcatcctcccgccacacagaaacccgcccagccggggccaccgaccccaccccctgcctggaaacttaaaggaggccggmgctgtggggagctcagagctgagatcctacaggagtccagggctggagagaaaacctctgcgaggaaagggaaggagcaagccgtggtaggtcgggtttc

SEQ ID NO: 20664 - DNA, 201 bp, Homo sapiens
ctcctctagcttgctcacgtttctgccttcttcttgctggcaagagtacagactataattctccagttcactaacatctggagcgactgcactgtttgcartttcattgattgactacatgtgtacagttcctttattgcaagtcacttttctgtataatcttttttgagacgaagtcctgctctgtcgcccaggctgcag

SEQ ID NO: 20665 - DNA, 201 bp, Homo sapiens
tgaacccgggaggcagaggttgcagtgagccgagatcgcgccattgcgcttcagcctgggcaacaagagcgaaactcgatctcaaaaaaaaaaaaaaaaaraaaagaaagaaatgtttgcctctgttggcactagagaattggagtctgctttgtagaaggagaaggaagaaaggcaacttactgggaagcaggatctaga

SEQ ID NO: 20666 - DNA, 201 bp, Homo sapiens
cctaaaccagtccacacaagtacgttatctaagtaatgttgcattctgcttctcttagactactttttttttttttttttgagacagagtctcgctctttygcccaggctgaagtgcagtggcgctatctgcaagctctgcctcctgggttcacgccattctcctgcctcagtctcccgagtagctgggactataggtgcc

SEQ ID NO: 20667 - DNA, 201 bp, Homo sapiens
gaggtggagggtgcagtgagctgagattgcgccactgcactccagcctgggtgggtgacagagtgagactctgtctcaaaacaaaaaaacaaaaaaaaacmaaaaaagaagagtgaagttcttgtggcaatatttctagtcataaaaacatcagcaaacttctaaataaagacccaaaacacttctaacattcaatattga

SEQ ID NO: 20668 - DNA, 201 bp, Homo sapiens
gagttgtcagaactgctcagtttagaggttcttggaacaaaagtcgtttaaactcacaaaagaaagagattctttaactcccaagagcttgactggggtgrgggaggcagcgggggacatccctgaagtgttgaagtacctaggccagtaaataaatgcaggtcacagagacttaagtcacagatttcttgacttcagact

SEQ ID NO: 20669 - DNA, 201 bp, Homo sapiens
taacattcaatattgaaataaatgtgagctatacaacatttaagaaaggttaataaaaacaaacatggtatttatttacccaatttttggagaataagtgratgatggcggccataatagtggtgggttaattcagggaataaatgtttgcaaagcaaaaatggtaaggaacacctcttactaccatgaagttcaaaaaca

SEQ ID NO: 20670 - DNA, 201 bp, Homo sapiens
cttggttttgcattgctggcaggagattttatgcctcaaaatatagatgctttttggaaggacagcacattaattatttttcagtcatttttaccttatgygaacaagctgattagttcctttcctaggagctggtttttatggagggaagatggggccggtagaggcagatagagggggatgtaatacacaggcactgag

SEQ ID NO: 20671 - DNA, 201 bp, Homo sapiens
taaaaacaaacatggtatttatttacccaatttttggagaataagtgaatgatggcggccataatagtggtgggttaattcagggaataaatgtttgcaargcaaaaatggtaaggaacacctcttactaccatgaagttcaaaaacaatcacaaatagggcaggctccctgactgcctccacacctcacagtttatcatg

SEQ ID NO: 20672 - DNA, 201 bp, Homo sapiens
actgcactgtttgcaatttcattgattgactacatgtgtacagttcctttattgcaagtcacttttctgtataatcttttttgagacgaagtcctgctctrtcgcccaggctgcagtagcgcaatcttggctcactgcaacttccgcctcccgggttcaagcgattctcctgcctcagcctcctgagtagctgggattata

SEQ ID NO: 20673 - DNA, 201 bp, Homo sapiens
aacaaacatggtatttatttacccaatttttggagaataagtgaatgatggcggccataatagtggtgggttaattcagggaataaatgtttgcaaagcaraaatggtaaggaacacctcttactaccatgaagttcaaaaacaatcacaaatagggcaggctccctgactgcctccacacctcacagtttatcatgcatt

SEQ ID NO: 20674 - DNA, 201 bp, Homo sapiens
ctgccttcttcttgctggcaagagtacagactataattctccagttcactaacatctggagcgactgcactgtttgcaatttcattgattgactacatgtstacagttcctttattgcaagtcacttttctgtataatcttttttgagacgaagtcctgctctgtcgcccaggctgcagtagcgcaatcttggctcactgc

SEQ ID NO: 20675 - DNA, 201 bp, Homo sapiens
acaaacatggtatttatttacccaatttttggagaataagtgaatgatggcggccataatagtggtgggttaattcagggaataaatgtttgcaaagcaaraatggtaaggaacacctcttactaccatgaagttcaaaaacaatcacaaatagggcaggctccctgactgcctccacacctcacagtttatcatgcattc

SEQ ID NO: 20676 - DNA, 201 bp, Homo sapiens
agatcatggcctctgtactatgcagggcctggagaagtgggatgagagctaccaggctcaaagctcctgtcccgaacaaagggttgctttcgtgggagcasgccaccctttccaaggctagttcctctcccagcatctcacttcagctctcgtcctgctctagaaacgtgcctttgctggtccaaggaatcctggccgttt

SEQ ID NO: 20677 - DNA, 201 bp, Homo sapiens
acagctcactgcagcctcaaactcccaggctcaggccatcctcccacctcagcctcccaagtagctgggactacaggcatgtaccaccatgcccaaataawtttttgtatttttttgttgagatggggttttgccatgttacccagggaggtctcaaactccaaggatcaagccacccaccctccttggcctcccaaagtg

SEQ ID NO: 20678 - DNA, 201 bp, Homo sapiens
caaaacggcatgcatccttggctctgggaaacagtacatctcccaggaaagtgagcttacagcacggtaccccacttcctggttaccagactattgttccygttttccccaagaacagtcatcattcacaggttgtttggcagggcccaggaacagagtcactctggttgctacagccaacagaccaaacacggcttccag

SEQ ID NO: 20679 - DNA, 201 bp, Homo sapiens
ggatcatttgtgcccaggagttcgagactagcctggacaacatagagaaaccttgtctctacacacacacacacacacacacacacacacacacacacacwctctctctctctctctctctctctcagccaggcacagtggcacatgcctgaagtcccagctctgggaagctgaggcaggaggatctcttgagcctggtgg

SEQ ID NO: 20680 - DNA, 201 bp, Homo sapiens
aagagaaacccgttgtattttatcttgttgtagcaagagccggtgtctaacacctgggctactgagagaaagcgaagggtttttttctgggaagctccaayttccttatttctctcacatgatgcctctgactttcatagtgtggcttggtcagatgggccttatcaatagagatggcctgatgtctcagctgtgtcatct

SEQ ID NO: 20681 - DNA, 201 bp, Homo sapiens
atgcctgtaatcccagcactttgagaggctgaggaaggcagatcacctgaggtcaggagttcgagaccagcctggccaccatggtgaaaccctgcctctaytaaaaacacaaaaattagccaggtgtggtggtgcgtgcccataagcacgagaattgcttgaaccccggaggtggagggtgcagtgagctgagattgcgcc

SEQ ID NO: 20682 - DNA, 201 bp, Homo sapiens
gctctcgttcgaatacccatcctgccacctgccccagtgagaagggttggagcagcccctgttctctgcccccgccacctccatgactcatgcattctgtrggggaggcgcccactgcagaaacagccaggctggctgggaaaagccctgcagcaattccccgtccagtttctctgtgcccactttgtctccgtgttatct

SEQ ID NO: 20683 - DNA, 201 bp, Homo sapiens
aaaaaaaaaaaaacaagtttcttgcccactcttcctttctctgagtttccagagacatcacatcatttcttacccagctgagcagagtcccagcatggctytcgttcgaatacccatcctgccacctgccccagtgagaagggttggagcagcccctgttctctgcccccgccacctccatgactcatgcattctgtgggg

SEQ ID NO: 20684 - DNA, 201 bp, Homo sapiens
agagagagagtgttgggctgggcacacccagtgtggagccagtacatctacttttatgaaagtcatttagaagcatcactaaaggaactgaaaaacaattsaccaataatgacagtactccaacacctagttttatcttctaatctctatccatacatctatgtagtgtttatattattattattttttgagatggagtct

SEQ ID NO: 20685 - DNA, 201 bp, Homo sapiens
tgccaatctttcatttaagtgtctcctcctaactcctttacttctttttcctctttcttctccttcatagagcagatccttaagtggcctttccttgactracattcattttcttcccatctttctttctttttaatctttctatcttaaaaaatcaacaaagaagtctttcattggctttagataattaaagccaagcaa

SEQ ID NO: 20686 - DNA, 201 bp, Homo sapiens
tttccatgtcaatagtggactcaaatttaaaaagtctccagtccatttccagaagtacaagtgttttctacatgagtagaggaatcagaaagaaaccaacwcaactctttccttcccatccctccttaaggtagagtccgactgcttttcttgccaatctttcatttaagtgtctcctcctaactcctttacttctttttc

SEQ ID NO: 20687 - DNA, 201 bp, Homo sapiens
cagtccagcactgacaaatggagatatgagctcactcactcacagctgtgctcaccttcatgggaagagtcggccctctactccagtacgatgacacacaraccctggctgcactggggattatgggatcggcttctctgaaactctcttactttttaaaaatcctgtagaaggatcaggtaacaggaaaatggccggtga

SEQ ID NO: 20688 - DNA, 201 bp, Homo sapiens
gataggagtacaaaagaaaagactgaggaaatgataactttaccaagcagcttcaaggatcaaccacaccctcgatggtaagctttctctttttctagggygacagatggaaaagtttccgaccaacgggaaggttacgatctggtaccagtccagcactgacaaatggagatatgagctcactcactcacagctgtgctc

SEQ ID NO: 20689 - DNA, 201 bp, Homo sapiens
ccgcaggtgagcccaaggctggtcctgccttctcagtggctacccccctgagctcccgccaccacacaaagtgttccaatccttgtgcatcctccagtccytttaacctctcatgtcctgagaggccagagctacagccacagattccagaagacaccccactcccagccccaacctgctgcctttagaattataaacact

SEQ ID NO: 20690 - DNA, 201 bp, Homo sapiens
ggttgcttacacccatgatcaacacagtccatcttcctacagcactgattttattcagagatttaggagaaatgttttgtcttagaatgaaaagggactgrtagatattaatgaatacatgataggagtacaaaagaaaagactgaggaaatgataactttaccaagcagcttcaaggatcaaccacaccctcgatggtaa

SEQ ID NO: 20691 - DNA, 201 bp, Homo sapiens
tccttcgtgtgttcccggaacagcttctgtgttatgcattccagaaagcctgcctgaccaccccaacctcaacaagcctgggatggacaacctcctccacrttccactccaagcccacccccgtccccaccctgctgcgtggtatggcgctgctctgctgtaccctgagtgtctagttattcatcaggccccttcctaact

SEQ ID NO: 20692 - DNA, 201 bp, Homo sapiens
gagggctgaatgaaaggggactcccatgtgaggcatccatgccctgctctctgtcagataccagggccacgtgctacgaggaccagggcatcagctacagsggcacgtggagcacagcggagagtggcgccgagtgcaccaactggaacagcagcgcgttggcccagaagccctacagcgggcggaggccagatgccatca

SEQ ID NO: 20693 - DNA, 201 bp, Homo sapiens
ctcagtgcttttgttgaggaaggatgttcatgacagtaggtgcaggtcgctcctgccgtgcacccaggtgtgggggaaggactttcctgcttcttttccarttaccttacaattcagcaagacggaaatgattagcccatgacaaaaaccaggaaacaggctcagagagagtgagttgcccacacagaatgtgtgctgtaa

SEQ ID NO: 20694 - DNA, 201 bp, Homo sapiens
cagagagaccttttgctaagcaacaataacctaagaatctccttgaccaaagataaatgtagcaaactttgcacatggtgcaacatttgataatagtatcmatttacgtttgtctttcccttgcaatttccctcctcctctagcttgctcacgtttctgccttcttcttgctggcaagagtacagactataattctccagt

SEQ ID NO: 20695 - DNA, 201 bp, Homo sapiens
gacagttatttcatctatgcttacacctgcaggtcccttaccctagaaacactctatatcttcttaggtacttcccttgaaacaggatgagttctagaggmaataaaactgctgcacttacaaacctagaaatattcagggaccaagattagttgttcagtgacctaggaaaccttagaatcctgtaggttcctcaggaga

SEQ ID NO: 20696 - DNA, 201 bp, Homo sapiens
agttacccgagggggtctctgagcagaggtatctggccggcaggttcacatgggcttctgggttggccgcctttactcttagtacacctggcatgtgctgwtccttcctccacctctggtttcttcgcaggaaatccatgcccgattcagaagaggagccagatcttaccaaggtcgggtgaagctgaggggtgcatgggg

SEQ ID NO: 20697 - DNA, 201 bp, Homo sapiens; identical to SEQ ID NO: 2084

SEQ ID NO: 20698 - DNA, 201 bp, Homo sapiens
ggggccaaaaatgcatcatttctgtgtggtaatacttatgtggataaaaaactctggtagacagttatgcatatatatattttttggtgaattacaatgaraaaaagtccaggtgcaatggctcacatctgtaactccagcactttaggaggcggatccaggaggatggctttagcccaggagttcaagaccagcatgggc

SEQ ID NO: 20699 - DNA, 201 bp, Homo sapiens; identical to SEQ ID NO: 2086

SEQ ID NO: 20700 - DNA, 201 bp, Homo sapiens; identical to SEQ ID NO: 2087

SEQ ID NO: 20701 - DNA, 201 bp, Homo sapiens
cagcactcatggtttgacaaatatgagtatatttaggatcagaatgtatgaaatctggcctctcctgaatagtcggtcatcccacaatttcctctgccaarcttctcttccctccctgcgttctttctttcacctctctctcatttttacaaggtctggtctcagccagacatgaaccaatgatgatagatgctcctgctg

SEQ ID NO: 20702 - DNA, 201 bp, Homo sapiens
ttcctttttttctgttcttttcttttcctcgaagtgatcccttgactaaaatcaaggctcccattgtcaccttatcagcctgcccatgcctaattctgcaytctcaggcttccccagaatctgtccgagggaaaccaatctcaattcagaaggaacacagaggccccagtttctagggctgcaggatattgctgggtctta

SEQ ID NO: 20703 - DNA, 201 bp, Homo sapiens
gtctgtgaatgcttaacagagaagcagctcatgtgggtgcttgagggctgggggggcagggtgggggtctggtaggcgctgggaggaggacatccctgcarcttctccagccccatagatgggactcttgatgtgggcagtttttatttcagctgagtctccagaaggcaggggacagggactgggaggggatgctaaacc

SEQ ID NO: 20704 - DNA, 201 bp, Homo sapiens
gaaacccagatcgagactcaaagccctggtgctacgtctttaaggcggggaagtacagctcagagttctgcagcacccctgcctgctctgagggtaagtgrcagccaccccgcctttccctgaatgtccctgggggaggaaagtccaggaggacaggccgatagccctcctgcacctgaggggagaaagggggaggccagg

SEQ ID NO: 20705 - DNA, 201 bp, Homo sapiens
ccaccatgcccggctaatttttcatatttgtagtagagacggggtttcaccgtgttagccaggatggtctcgatctcctgacctcgtgatccgcctgcctyggcctcccaaggtgctgggattacaggcgtgagccactgcacccagccctcttagactactttctactcgcgagatgcaacccctattcctggctgctgt

SEQ ID NO: 20706 - DNA, 201 bp, Homo sapiens
aaaggggaatggggagttattctttaatggctacagagtttcagttaggggtgatggagaagttctggagatgggcggtggtgacggccggccgcacagcratatgacgtgcttaatgccactgaactgtgcactgaacatcgttaaggtggtaaattttgtgttatatatattttgcaacaataaaaaatatgtagtttc

SEQ ID NO: 20707 - DNA, 201 bp, Homo sapiens
atcagcacctcccacgggggagttcgtttcgaagtaacaatcaaagatccagagccggacccaggcagggaggcaaggtctggaagcccctgtgcctccargcccctaggacgctcgggggagggggagggggagggtgggacctgaagttgttgtgaccgaagggaaatgagtcagggaaagaaatgccatgctttaatt

SEQ ID NO: 20708 - DNA, 201 bp, Homo sapiens
cttcaaaaggagcctccaggcctgttcggccttaggcggaggtgaaggtacaagcagaaaagggagcaagaccaagtgaccttgggcaaatgcccgcttgyctcagtttcctcatctgtaaagaggtgggaataacagtacacacttcatggtttgctgtgaggattaaattagctaatttttgtagactgtacaacagcg

SEQ ID NO: 20709 - DNA, 201 bp, Homo sapiens
ggagaaagggggaggccaggagtgagtcattttggttgcagagggaagaaagacaggacttaggtctgtgcctgggcttggcctctgactggctatttgtytgacctggagctgatctcctcacactctgaccctcaatttcctcctctatggaggagaggatggggctgaatcagtggttttcagtccttttgagaatga

SEQ ID NO: 20710 - DNA, 201 bp, Homo sapiens; identical to SEQ ID NO: 2088

SEQ ID NO: 20711 - DNA, 201 bp, Homo sapiens
ttcggtgggcttaagggctgatggctttgatcgaatttcaggcatgttggccccaaggccctgtgtatattccctgggcccactcaaggggatgctggagycggaaagtccccggaggccacctactgcagccctgcactttacaaagaagagaaagattctccctaaaattacagaacagggccaaagatgcctaccgga

SEQ ID NO: 20712 - DNA, 201 bp, Homo sapiens
tgacagggcaagccctcacctctaaaacaaaacaaaacaacacaaacaaaaacaaaaacacagaaaagcccagtacaaatcgacttcaaactgagacttcragttcaggggtccagtcatgaaccctgtctttcatggtccccggaaagttcaaatcttcaaaaggagcctccaggcctgttcggccttaggcggaggtga

SEQ ID NO: 20713 - DNA, 201 bp, Homo sapiens
cctgctccaaccctaagtcaagccacatggtcttccgatagtggctcagttttctacttacataaaaagacagcacattctcttagcaatatgtgtttgtrtgtgtgtgtgtgtgtgtgtgtgtgtgtgtgtgtgtgtatatatatatatatatatatataatttagagacaaggtctgactccatcacccaggctggagt

SEQ ID NO: 20714 - DNA, 201 bp, Homo sapiens
tgggggcacctcctaccgcaggtgagcccaaggctggtcctgccttctcagtggctacccccctgagctcccgccaccacacaaagtgttccaatccttgkgcatcctccagtccttttaacctctcatgtcctgagaggccagagctacagccacagattccagaagacaccccactcccagccccaacctgctgccttt

SEQ ID NO: 20715 - DNA, 201 bp, Homo sapiens
gccaggatggtctcgatctcctgacctcgtgatccgcctgcctcggcctcccaaggtgctgggattacaggcgtgagccactgcacccagccctcttagaytactttctactcgcgagatgcaacccctattcctggctgctgtctggcagcttttgttctcactgacatcctagttccaagaataaatcggatgctgcaa

SEQ ID NO: 20716 - DNA, 201 bp, Homo sapiens
gtgtgggaaaggcaaataaaaaagcagattaaaaaccagattaaagacatcaccctgtattcaggaaataatggctcctgttgatactgttctacgaacayagatgaaggcacaaaattctacatcaattgcagagaattggttataggctaacacaggtggtcggatgatctaggaagcaggattcagtattaacgggga

SEQ ID NO: 20717 - DNA, 201 bp, Homo sapiens
tggcctcgctttcctatataatttaaacaatagaactatagtgccatttgtaagagtttcccagtttatactgcatgtgacactccccatgtcgtatgttstcacaacagaacagaaaccgcaggatgtcagcaccggaggcaaccttggagcatccagcccacttggttttgcattgctggcaggagattttatgcctca

SEQ ID NO: 20718 - DNA, 201 bp, Homo sapiens
agactgcactgtttttctgctggccggatgactcatttctttgtcatctcttaccccacttggccttttcagctgctcgaatcgcctctgtgtgatgcggwcagagctatcgccctgctggggtgagattcacttgcattgaatcagctcaaggcgcaggaaggtccagggaagccaaggaagagaagagacaagtctcca

SEQ ID NO: 20719 - DNA, 201 bp, Homo sapiens
agctgtgtctttgcatcaccagagcctgtgccagggcacggctggtgctccatacacgttgatggtgaatatatagcatgggtagatcattgtctgtgaaygcttaacagagaagcagctcatgtgggtgcttgagggctgggggggcagggtgggggtctggtaggcgctgggaggaggacatccctgcagcttctccag

SEQ ID NO: 20720 - DNA, 201 bp, Homo sapiens
attttcctttcacactagatagatagacatttatgttaaggaactggctgacaggatcgtgggggctggcaagtccgaaacatcttggtaagccaggctgsaagtgcaggcagaagctgaggctgctctcttaaggcagaatttcttattcaggaaacctcatatttgctcttaaggcctttaagtgattggacgaggccc

SEQ ID NO: 20721 - DNA, 201 bp, Homo sapiens
ccaggcgtgttggctcacgcctgtaatcctagcactttgggaggccaaggtggacagatcacctgaggttgggagttcgagaccagcctggccagcatgcygaaaccctgtctctactaaaaatacaaaaattagccaggcatggtggcacacacttgtaatccgagctactcgggaggctgaagaaggagaatcgcttaa

SEQ ID NO: 20722 - DNA, 201 bp, Homo sapiens
gaacacctcttactaccatgaagttcaaaaacaatcacaaatagggcaggctccctgactgcctccacacctcacagtttatcatgcattcgtgtatttakcacagactagacagatttttactttataacactttgtattcattcattttccaacgtgcttattccggttcagggtcttgggtgggggtggccagagcca

SEQ ID NO: 20723 - DNA, 201 bp, Homo sapiens
ttaccaccagctaattgatataaacaagagttggtcaggtgcggggctcatgcctgtaatcccagcactttgagaggctgaggaaggcagatcacctgagrtcaggagttcgagaccagcctggccaccatggtgaaaccctgcctctactaaaaacacaaaaattagccaggtgtggtggtgcgtgcccataagcacgag

SEQ ID NO: 20724 - DNA, 201 bp, Homo sapiens
ggggaatcttaaggaaaaaatagaatcttaaggaaaaaataactgggtgagacgtggactgtggacaggtgtggaaaaggcactctccatggaggtatgartatgtagagggccaagagaggggagtacagggagaaatgagttgagcttgtctgaagtgaacttcaggaagaggaacataggctggaatttagattatgg

SEQ ID NO: 20725 - DNA, 201 bp, Homo sapiens
aggcagatagagggggatgtaatacacaggcactgagacagcaccccactgactttcccctgtccctcctccagctggcctcctcctttccaggggctgtrcccaatccagaatcagttactcactggtgcccatcgaccatcatttccccatgtggccaccaaagaaatgaacaccacctttctggttggcatgatcatc

SEQ ID NO: 20726 - DNA, 201 bp, Homo sapiens
tgttcatgccactgcactccagtctggatgacagagcgagacctagtctcaaaaaaaaaaaaaaaaaaaaaaagaaagaagaaagaagaaaggaaaaagaraaaaaggcagcggggcgcggtggctcacgcctgtaatcccaccactttgggaggccaaggcgagcggatcacgaggtcaggagatcgagaccatcctggc

SEQ ID NO: 20727 - DNA, 201 bp, Homo sapiens
ggaacactgaggcaggagaatcgcttgagcctgggaggcagaggttgcagtgagctgaaattgtgtcactgtactccaccctgggcaacagagcaagactytgtcaagaaaaaaaaagaaagaaagaaagaaaaaaaaaaaaacactgaggaccagtgcgaaggaacccccagccactgaatctccggcagaaattcagct

SEQ ID NO: 20728 - DNA, 201 bp, Homo sapiens
ggtgcacgcctgtggctccagctacttggaacactgaggcaggagaatcgcttgagcctgggaggcagaggttgcagtgagctgaaattgtgtcactgtaytccaccctgggcaacagagcaagactctgtcaagaaaaaaaaagaaagaaagaaagaaaaaaaaaaaaacactgaggaccagtgcgaaggaacccccagc

SEQ ID NO: 20729 - DNA, 201 bp, Homo sapiens
gccagggagtagcacagctgcttcctcccggggagaaagggacacccaaagagcgcactccagggagaccttgggcactgcgggctcaaaggctggagatkgcacttctgttccctcctgatgggacaggtgcagggaggctgagaggatgccacgctggcgagcctccctctgagctgtgttttctcattggaattgctg

SEQ ID NO: 20730 - DNA, 201 bp, Homo sapiens
aaaagggagataacacagaacaaaattagaagtctatttataaaaatgagcctcttccatcccttccgccaatgtcatctctcacccgggtctcgccagarcactcatggacctccctttggtgaggcccaaagtccatcccagccacgccctgcggtcccgagtctgagtccattgttctggctttcactctgctctgca

SEQ ID NO: 20731 - DNA, 201 bp, Homo sapiens
ttttcgaaaagttaagaattacttatgtgatggtagtttttgaaagtggtttttattctgagatcatggcctctgtactatgcagggcctggagaagtggratgagagctaccaggctcaaagctcctgtcccgaacaaagggttgctttcgtgggagcacgccaccctttccaaggctagttcctctcccagcatctcac

SEQ ID NO: 20732 - DNA, 201 bp, Homo sapiens
ttggaacactgaggcaggagaatcgcttgagcctgggaggcagaggttgcagtgagctgaaattgtgtcactgtactccaccctgggcaacagagcaagaytctgtcaagaaaaaaaaagaaagaaagaaagaaaaaaaaaaaaacactgaggaccagtgcgaaggaacccccagccactgaatctccggcagaaattcag

SEQ ID NO: 20733 - DNA, 201 bp, Homo sapiens
gagaccagcctggccaacgtggcaaaaccccatctctactaaaatacaaaagttagctgggtgtggtggtgcacgcctgtggctccagctacttggaacamtgaggcaggagaatcgcttgagcctgggaggcagaggttgcagtgagctgaaattgtgtcactgtactccaccctgggcaacagagcaagactctgtcaa

SEQ ID NO: 20734 - DNA, 201 bp, Homo sapiens
ggaaagagtgttagatttggggtaagagaactgtgtctcctgggcttgagtcctgatgccaactctcacaagatgtgtcaccgtacagcacgacgcttatrctttttttttttttttttttgagacaggatcttgctctgtctcaagctggagtgcagtggtatgatcacagctcactgcagcctcaaactcccaggctca

SEQ ID NO: 20735 - DNA, 201 bp, Homo sapiens
agcattgacagacgaatggataaacaaaatgtgttctatcccacagtggagtattattcagctttaaaaaggaaggaaaaatgctgggcgcggtggctcaygcctgatcccagcactttgggaggctgaggaaggaggatcatttgtgcccaggagttcgagactagcctggacaacatagagaaaccttgtctctacaca

SEQ ID NO: 20736 - DNA, 201 bp, Homo sapiens
agaaaaccaaagcatggttagtctaaggccatcagctagtaagtgatggagccaagccagggtttttgaggcctgaaacgtttgagtaattaactctactktaccagaatagatacagcctaatcctccatgggaccaagataactgagatacaatctacccactcttcagtaagtctccacttaacagcatgcctggaaa

SEQ ID NO: 20737 - DNA, 201 bp, Homo sapiens
ctcctcttctttctcttaaaagtctttccagcaagctgagccagtgaaggaatgctttaaccaagggaccaactttgtaattcaggcaactagaggatccrctagaatccactccagaggggagatgtctgtttgcatttgcatgtgattgggataggctggagtgttttggaggggagaggcagtcggggaaagggagac

SEQ ID NO: 20738 - DNA, 201 bp, Homo sapiens
taattacaggggaaaaaactgacattaatgtcttttattcctaaagcactctgcaggaagcatgtggggttctccagattttcactgttattatctttatyttcttaacctcacagggagggagagaggaagggagggagggaagacgaaaacacgccgaggtcccaggtaactaatgacaactcaagctcaaagaagtgt

SEQ ID NO: 20739 - DNA, 201 bp, Homo sapiens
catcgttaaggtggtaaattttgtgttatatatattttgcaacaataaaaaatatgtagtttctagaatcctcttctagatgcatgtctggcgtttctgcygcggggctggcactggaggaagccagacaggacaacattgcggcttatcctcctctgttgccatcatggacctctcgcaccccgtgatcaagctgttttt

SEQ ID NO: 20740 - DNA, 201 bp, Homo sapiens
agtctccttctactcttacatggcctgtgatgtggctgaaaatgggattgaaaatcttaaactcctggcctggtgtggtggtgcatgcctgtaatcccagmactttgggaggctgaggcaggaggattgcttgagcccaggagttcaagaccagcctgggcaacatggcaagaccccatctctacaaaaattaaaaaataa

SEQ ID NO: 20741 - DNA, 201 bp, Homo sapiens
ccggctgtgaattgcacacaccaatggccaagacccagcagcgacttggctaacaggcccagccgatgtgcatgggtgaccacgcgatgctcctgacacaygcactggtggcttagggaagtttttttgaggattgatcagaagatctgattccacctggagcctctgaagtgatcacttccaggttaggctgaacccaga

SEQ ID NO: 20742 - DNA, 201 bp, Homo sapiens
tgagctatacaacatttaagaaaggttaataaaaacaaacatggtatttatttacccaatttttggagaataagtgaatgatggcggccataatagtggtrggttaattcagggaataaatgtttgcaaagcaaaaatggtaaggaacacctcttactaccatgaagttcaaaaacaatcacaaatagggcaggctccctg

SEQ ID NO: 20743 - DNA, 201 bp, Homo sapiens
atgtagtgtttatattattattattttttgagatggagtctcactcttgttgcacgatcttggctcactgcaacctccacctcccaggttcaagtgattcycttgcctcagcttcccgagtagcggggattacaggtgcccgccaccatgcctgactaatttttgtgtttttagtagagatggggtttcaccatgttggcc

SEQ ID NO: 20744 - DNA, 201 bp, Homo sapiens
ggcctcccaaggtgctgggattacaggcgtgagccactgcacccagccctcttagactactttctactcgcgagatgcaacccctattcctggctgctgtytggcagcttttgttctcactgacatcctagttccaagaataaatcggatgctgcaatgctgctgttggggatatgctgacacagctcctcagagaggaga

SEQ ID NO: 20745 - DNA, 201 bp, Homo sapiens
caaactcctaggcttaagccttggcctcccaaaactctggggttacaggtgtgagccacaagcccagcttatattattattttttatttttctgttttggwtgaatccacagatatggaacctgcagatatacaaagtggactgtatttataaaagacaatgcaggacagggcacagtgactcacacctgtaatctcagca

SEQ ID NO: 20746 - DNA, 201 bp, Homo sapiens
gaggccacagtgagcaatgattgtgccactgcactccagcctgggtgacagtgagatcctgcctcaaaataaatacataaatatgtgtgtgggtgtgtgtrtatatatatgtaatacacatatattaaatttatatatgatatatataaacacgcaccagctatatgcattcagcacccaggtccacgggtgatgcctgtg

SEQ ID NO: 20747 - DNA, 201 bp, Homo sapiens
actccttcgtgtgttcccggaacagcttctgtgttatgcattccagaaagcctgcctgaccaccccaacctcaacaagcctgggatggacaacctcctccrcattccactccaagcccacccccgtccccaccctgctgcgtggtatggcgctgctctgctgtaccctgagtgtctagttattcatcaggccccttcctaa

SEQ ID NO: 20748 - DNA, 201 bp, Homo sapiens
ctctcgtcctgctctagaaacgtgcctttgctggtccaaggaatcctggccgtttcttttcttaattgttggcattcatctgggctatggtggttgtggcrggggtggcagtggagagtgtgttgttttaaatccatgagtcattttagggtattggtactcttgaagactgactttctcttgctcaggttttcagagaga

SEQ ID NO: 20749 - DNA, 201 bp, Homo sapiens
ccatgtggccaccaaagaaatgaacaccacctttctggttggcatgatcatcaatttctcagccaaaacggcatgcatccttggctctgggaaacagtacmtctcccaggaaagtgagcttacagcacggtaccccacttcctggttaccagactattgttcccgttttccccaagaacagtcatcattcacaggttgttt

SEQ ID NO: 20750 - DNA, 201 bp, Homo sapiens
tgatagatgatagattgatagatgatagatgataggtgatagattagataaatagatgatacatacatgatagatagatgataaatagacggtagatggaygacagatagacagatgataggtgatagatagatgatagattgatagatgattgatagataaatagatgatagatacatagatgatagatggtagatagat

SEQ ID NO: 20751 - DNA, 201 bp, Homo sapiens; identical to SEQ ID NO: 2072

SEQ ID NO: 20752 - DNA, 201 bp, Homo sapiens
ctggtgggtcaaggctgcagtgaaccatgttcatgccactgcactccagtctggatgacagagcgagacctagtctcaaaaaaaaaaaaaaaaaaaaaaaraaagaagaaagaagaaaggaaaaagaaaaaaaggcagcggggcgcggtggctcacgcctgtaatcccaccactttgggaggccaaggcgagcggatcacg

SEQ ID NO: 20753 - DNA, 201 bp, Homo sapiens
tcacagggagggagagaggaagggagggagggaagacgaaaacacgccgaggtcccaggtaactaatgacaactcaagctcaaagaagtgtggtaacaagratgtgtttggtggccaattgggaataatatggtggtctcctgtagctgcttgatgacagaaaaaatgtcgtgtgtgtgtgtatgcgtgtgcattgcagtc

SEQ ID NO: 20754 - DNA, 201 bp, Homo sapiens
ctttttttttttttttaagatggagtctcgctttttcaccaggctggggtgcagtggcacaatcttggctcactgcaacctccacctcccaggttcaagcrattttcctgcctcagcctcccaaatagcttggattacaggcgcccgccaccacacccagctaagttttcaccatgttggccaggctggtcttgaacacct

SEQ ID NO: 20755 - DNA, 201 bp, Homo sapiens
atgggccttatcaatagagatggcctgatgtctcagctgtgtcatctcagctgctagttctggcttctgctgggagtccacagtggcctctgcatgcatgktgtgggaaaggcaaataaaaaagcagattaaaaaccagattaaagacatcaccctgtattcaggaaataatggctcctgttgatactgttctacgaacac

SEQ ID NO: 20756 - DNA, 201 bp, Homo sapiens
cgaccttcatcacggaagatgacattcatttcgattcactttagatttcagggcttgtttagatgcagactttgcagttaacattttattgcactgactgrtttagttttcaccaggtggtccttgtgtttgcttcagaaggatctaagtgtattaggacagggtttcttctgttttgattgtgggaggaggcgggataga

SEQ ID NO: 20757 - DNA, 201 bp, Homo sapiens
tgcaccggcagctttggtaacaacatccctgtgtatccatttccctctgttgatccaaccgggatgtcccaactgggatgtcccacccaggcaacccctcsacatggtggggtctctaagtccacatctagagttgactctagaaggctgaggaatgcgaggcccagcttcaggtccaaaactaccaacttaggccctcga

SEQ ID NO: 20758 - DNA, 201 bp, Homo sapiens
gaaaacattagaaggaatgaaggatggcagatccccagttttggagtcaaacatacttgggaactaatccaggtgccattgcaaccttgggcaaaaacgtytccgcctcctgaaacttatcgctgtgggaactaaagagaatgtatggacaacattcggcatgctgatcccaccaagtgaaagttgtggttttacagccat

SEQ ID NO: 20759 - DNA, 201 bp, Homo sapiens
tgcctgtaatcccagcactttgggaggctgaggcaggaggattgcttgagcccaggagttcaagaccagcctgggcaacatggcaagaccccatctctacwaaaattaaaaaataagaagataaaaaggaaaccttaaactctcttatcatttaggaatcctgatggggatgccaagccctggtgccacgtgctgaagaac

SEQ ID NO: 20760 - DNA, 201 bp, Homo sapiens
gccgactaacctacttttagctgccgagggcaggatcacagaggagaggcagatggaaactggggctctggggtccaggaagatctgagtcttccgaccaracatcatttgcctcccctccttcctgcaaatatgcacattgccggatctgctgcagtctatgaaaaaggagacagatgttctggcagagcggtggggggg

SEQ ID NO: 20761 - DNA, 201 bp, Homo sapiens
aagatggagtctcgctttttcaccaggctggggtgcagtggcacaatcttggctcactgcaacctccacctcccaggttcaagcgattttcctgcctcagsctcccaaatagcttggattacaggcgcccgccaccacacccagctaagttttcaccatgttggccaggctggtcttgaacacctgacctcaagtgatctg

SEQ ID NO: 20762 - DNA, 201 bp, Homo sapiens
ctaaaaatacaaaattagcgtagcatggtggcgcatgcctgtaaccccacctactcgggaggctgaggtagaagaatcgcttgaacccaggaggtggagaytgcagtgagccaagatcgcgcattgcactccagcctgggcaacaaaaggggaagtgtgaggtgttacactcttctcagtgccgggctagcggcctccagc

SEQ ID NO: 20763 - DNA, 201 bp, Homo sapiens
ggcattctgctgtcgtataccatgtggaacacattaagaacgttatggccaggcgtgttggctcacgcctgtaatcctagcactttgggaggccaaggtgkacagatcacctgaggttgggagttcgagaccagcctggccagcatgccgaaaccctgtctctactaaaaatacaaaaattagccaggcatggtggcacac

SEQ ID NO: 20764 - DNA, 201 bp, Homo sapiens
caagcatgaggcctgtaagtggaaggaagtctcggccccatcctgtctgcgggacagcaggggaggctgcggtccaccagaggaaaatggggtcaggagascgaagttccagccccgggtcaggcactgacgccagtcccgtctccctgtgtcgtgggggcccgtctctgctgtctctgcctcacagggacactgcaggcc

SEQ ID NO: 20765 - DNA, 201 bp, Homo sapiens
tgggttggccgcctttactcttagtacacctggcatgtgctgatccttcctccacctctggtttcttcgcaggaaatccatgcccgattcagaagaggagmcagatcttaccaaggtcgggtgaagctgaggggtgcatggggtcatcagggagggaggcagggcggggtgcagggtgcatcacccacccaccacctgcct

SEQ ID NO: 20766 - DNA, 201 bp, Homo sapiens
ctttgtcatctcttaccccacttggccttttcagctgctcgaatcgcctctgtgtgatgcggacagagctatcgccctgctggggtgagattcacttgcaytgaatcagctcaaggcgcaggaaggtccagggaagccaaggaagagaagagacaagtctccaactctctcaggagcaaagacaaaaatatgctcctgctc

SEQ ID NO: 20767 - DNA, 201 bp, Homo sapiens
aggggcatgctgccatatccagctaattataaaatttttttgtagaagcagagttttgctttgttgcccaggctagtctcaaactcctggcctcaagcaaycctcttgccatggcctcacaaaatgctgggattacaggcaagagccactgtgcccagtccctcttagtgatattttgcatattatatattcaaaaaatat

SEQ ID NO: 20768 - DNA, 201 bp, Homo sapiens
ttagggtaaagatctttaggcctgcaaggaatgtccttgtagagaattaaaaaaaaaaaaaaaaaactttgcagctatcttattgaggaataaatgagagkcaggtttgcctgacgtagttcccggcttgacatttcccttggctcatgacgttggggtcctgagatttattttcctttcacactagatagatagacattt

SEQ ID NO: 20769 - DNA, 201 bp, Homo sapiens
gtagatcattgtctgtgaatgcttaacagagaagcagctcatgtgggtgcttgagggctgggggggcagggtgggggtctggtaggcgctgggaggaggayatccctgcagcttctccagccccatagatgggactcttgatgtgggcagtttttatttcagctgagtctccagaaggcaggggacagggactgggagggg

SEQ ID NO: 20770 - DNA, 201 bp, Homo sapiens
ggcctcgaagtgctgcaggtgttgggaaggttctgagtaggaagtggagtacagtcgctaagcgtgtgggttctgggaagctggagttacaaagacccgakttcaaatcccacttgctgagctgtgtgaccgtggacatggatttttattttgaactgctcccagcctcagtttcctcgttggtaaagtggagatagaact

SEQ ID NO: 20771 - DNA, 201 bp, Homo sapiens
tgggtcaaggctgcagtgaaccatgttcatgccactgcactccagtctggatgacagagcgagacctagtctcaaaaaaaaaaaaaaaaaaaaaaagaaaraagaaagaagaaaggaaaaagaaaaaaaggcagcggggcgcggtggctcacgcctgtaatcccaccactttgggaggccaaggcgagcggatcacgaggt

SEQ ID NO: 20772 - DNA, 201 bp, Homo sapiens
gctgcacactgcagggctcgggactgtccccatcccccacaacagggacctccctggtccgaagcatcagcagtgccactacggagaggctgtgggttcartcccggaatcctgctgtttttgtgggtcaaaacgataaaataccagcagtgtcataggattcgacctaatacatgttgaatcttgatcaatgttagctat

SEQ ID NO: 20773 - DNA, 201 bp, Homo sapiens
ccagtctggatgacagagcgagacctagtctcaaaaaaaaaaaaaaaaaaaaaaagaaagaagaaagaagaaaggaaaaagaaaaaaaggcagcggggcgyggtggctcacgcctgtaatcccaccactttgggaggccaaggcgagcggatcacgaggtcaggagatcgagaccatcctggctaacacggtgaaaccccg

SEQ ID NO: 20774 - DNA, 201 bp, Homo sapiens
ccatcccccatggtctggtctaaatgaggactcgcagatctagataatcttgaaaatcccttccatttatggtatttatgtatagaggtatgctttgtcartttcaggtcgggagaaaaaaatggaaaaatgggggaaataaatgaaaacaggcagcactccacggctcataccctcctccttcccaagcccatcatcaga

SEQ ID NO: 20775 - DNA, 201 bp, Homo sapiens
gggccccggctgcctccctgcacctggtctcccttcttcaccatctcctcgccactttctaggccttcatggctgtctggtgcagactgtgtgcctaccaracttccaggctgggtggggagggggcttccatgactgaagccacggtgggtgggcgggtgtccatgacccatgcatgggggtggtggggaggggcaagaa

SEQ ID NO: 20776 - DNA, 201 bp, Homo sapiens
cctgggcaacaagagcgaaactcgatctcaaaaaaaaaaaaaaaaaaaaaagaaagaaatgtttgcctctgttggcactagagaattggagtctgctttgyagaaggagaaggaagaaaggcaacttactgggaagcaggatctagatgatgtgagaaagaagttttcaaaactcacattcagccctaataccctgggaaa

SEQ ID NO: 20777 - DNA, 201 bp, Homo sapiens
gatactggggtatgggaggacaggccagcctgctggtattaagacctgcacagagccaaggaattgatcttcctcagacatttcagtgcctgcagcgtgcsaagctctcctttaggggctgggggtagaagagatacaaagagaagtgaggccaggctctggtgctgaaggatgtgtgggctttgttttcgcaaggcagtc

SEQ ID NO: 20778 - DNA, 201 bp, Homo sapiens
gctggaagtgcaggcagaagctgaggctgctctcttaaggcagaatttcttattcaggaaacctcatatttgctcttaaggcctttaagtgattggacgargcccaactacattatctaggacaatttccttttctaaagtcaactggctgtagatattaaccacatctataaaacactttcacaactcctagatgaatgt

SEQ ID NO: 20779 - DNA, 201 bp, Homo sapiens
aactgggtgagacgtggactgtggacaggtgtggaaaaggcactctccatggaggtatgaatatgtagagggccaagagaggggagtacagggagaaatgmgttgagcttgtctgaagtgaacttcaggaagaggaacataggctggaatttagattatgggggctctgaacaccaaactgagtttggacttaattgactt

SEQ ID NO: 20780 - DNA, 201 bp, Homo sapiens
ggtgcttgagggctgggggggcagggtgggggtctggtaggcgctgggaggaggacatccctgcagcttctccagccccatagatgggactcttgatgtgkgcagtttttatttcagctgagtctccagaaggcaggggacagggactgggaggggatgctaaacccgataacccagtatggatgagctaacagaggccgg

SEQ ID NO: 20781 - DNA, 201 bp, Homo sapiens
agtgttgggattacagacgtgagccactgctctcagccccttacacttttttgaagttcagttctcccatctgtaaaaacgaggtaataatattgcctcaratgacttaatggatgtgaaagggtttagtaaactctgtgcctggaaaggtagaagctactcaaatatctgttgagtgagtggcattcatccatgtgtaca

SEQ ID NO: 20782 - DNA, 201 bp, Homo sapiens
agcccacagaaatctctgggcaaaattatctcccagcattgacagacgaatggataaacaaaatgtgttctatcccacagtggagtattattcagctttamaaaggaaggaaaaatgctgggcgcggtggctcacgcctgatcccagcactttgggaggctgaggaaggaggatcatttgtgcccaggagttcgagactag

SEQ ID NO: 20783 - DNA, 201 bp, Homo sapiens
agagggaagaaagacaggacttaggtctgtgcctgggcttggcctctgactggctatttgtctgacctggagctgatctcctcacactctgaccctcaatktcctcctctatggaggagaggatggggctgaatcagtggttttcagtccttttgagaatgaatggagattctcccttttttgattaatgggtgaatgggg

SEQ ID NO: 20784 - DNA, 201 bp, Homo sapiens
gtacctcaagacgagcaagcaataaaagcaaaatcggctgccttgggacacgtgcctgtgacagctgggagggcccgctgggtcccctagtttcctccctyccccgatgaacccccagaaaggaactgaggctgtggatggggcagagggggacttacttccagagcactatttgctaggtgctgggagagagaagcaggt

SEQ ID NO: 20785 - DNA, 201 bp, Homo sapiens
gggaaaaaactgacattaatgtcttttattcctaaagcactctgcaggaagcatgtggggttctccagattttcactgttattatctttattttcttaacytcacagggagggagagaggaagggagggagggaagacgaaaacacgccgaggtcccaggtaactaatgacaactcaagctcaaagaagtgtggtaacaag

SEQ ID NO: 20786 - DNA, 201 bp, Homo sapiens
ggccaccaaagaaatgaacaccacctttctggttggcatgatcatcaatttctcagccaaaacggcatgcatccttggctctgggaaacagtacatctccyaggaaagtgagcttacagcacggtaccccacttcctggttaccagactattgttcccgttttccccaagaacagtcatcattcacaggttgtttggcagg

SEQ ID NO: 20787 - DNA, 201 bp, Homo sapiens
atgggataaaatttaaaaggggaatttaagaggaattttgggcagttttgagaaacaggaaatttgaggaaagctgagaaagagaagatctggagtaagtytctgtgatgagaagattccaccccgcactcctgttctgggtggccttggctcctgactccctttcttctgaaactgcctggagccagggagtagcacagc

SEQ ID NO: 20788 - DNA, 201 bp, Homo sapiens
aaatctgcaaaaatcaactttgtgtgctagggtggcctgacagggctaggccttggggtcttggggaccagcattccacctctcctctcatacagtgattytggattccagcccagcaaaagtcagccaaccttggggccttcctttctttcatcctttcttttttttccttttctatccttctgtgcctcccttcctacc

SEQ ID NO: 20789 - DNA, 201 bp, Homo sapiens
agcacagatatgctggctgtgtcctacacacaggtgcctacacacacatccttcagatccgggctgcactctatcagccaacccacggactctgttttttytaatttgcacagattctttgtcaacctgccatgccctgagactgctgaacttcatccaacagagagggtaccttttgcaaatctgcaaaaatcaactttg

SEQ ID NO: 20790 - DNA, 201 bp, Homo sapiens
accctttgtgaaggtgttaaaaagggtgactcactccccagagcgagtcacacctggactcttaatgccttcgttgttggatggcatcctgcttcctaccrggttatcctggcctcagtgacctcagaagcagcaagggtctgacttacagtgggcacgtgctacttctttaattaattgaaagtaaagttgttgtttttt

SEQ ID NO: 20791 - DNA, 201 bp, Homo sapiens
gaaagattctgtcagatccgtcagggttctcccaagaaacataaccaatacaggatggatagatggatagatgatagacagataatagatgataggtgatrgatgatagattgatagatgatagatgataggtgatagattagataaatagatgatacatacatgatagatagatgataaatagacggtagatggatgaca

SEQ ID NO: 20792 - DNA, 201 bp, Homo sapiens; identical to SEQ ID NO: 2073

SEQ ID NO: 20793 - DNA, 201 bp, Homo sapiens
ggctcatgacgttggggtcctgagatttattttcctttcacactagatagatagacatttatgttaaggaactggctgacaggatcgtgggggctggcaadtccgaaacatcttggtaagccaggctggaagtgcaggcagaagctgaggctgctctcttaaggcagaatttcttattcaggaaacctcatatttgctctt

SEQ ID NO: 20794 - DNA, 201 bp, Homo sapiens
tgaaaacagtatttgtaggatgcagaactggtatacgcgtgttccacgctgcaggacttgagtgtgtgtggattgtggtagacagggctcctggaaccatrgcctgagcacacagaaggaggctgtcattaggggcttccttttttatacttgacaggttgcagcgagccaaggtgtttcaacgggggcacctgccagcag

SEQ ID NO: 20795 - DNA, 201 bp, Homo sapiens
aactttgcagctatcttattgaggaataaatgagaggcaggtttgcctgacgtagttcccggcttgacatttcccttggctcatgacgttggggtcctgaratttattttcctttcacactagatagatagacatttatgttaaggaactggctgacaggatcgtgggggctggcaagtccgaaacatcttggtaagccag

SEQ ID NO: 20796 - DNA, 201 bp, Homo sapiens
ctgtgtccatctgggccacggaggttggaatgctgtcagggagcagagaggcacagggacgaggggctggcattgctgtggagcacacagcacacactccyttctgtacagcaaactctgtatttgggggcccagtgtgtagctgggccctaggcacttattttgacctgagtaagcggaattaacatgccactccctgcc

SEQ ID NO: 20797 - DNA, 201 bp, Homo sapiens
ggtgagagcacgtgaaacgagctgaaatcccacctctccagtctcccccgcccccggaaggaaaggcagggtgcgatggcagggccaggggtgggggccarggacagggaaggcgcttctgccatgggtcaggaagcacagtgccacacagcaagcagagcctaggtgtgaccctgaatccaggctggcacccttgccacc

SEQ ID NO: 20798 - DNA, 201 bp, Homo sapiens
tgtccatctgggccacggaggttggaatgctgtcagggagcagagaggcacagggacgaggggctggcattgctgtggagcacacagcacacactcccttytgtacagcaaactctgtatttgggggcccagtgtgtagctgggccctaggcacttattttgacctgagtaagcggaattaacatgccactccctgcctgt

SEQ ID NO: 20799 - DNA, 201 bp, Homo sapiens
acagagccaaaccatatcaactaaatattcaaaaaaagtactgctctaagagagtacttcaatttttaacttggtagccttggttcttgttcatgtgtgtracactaacatagcttaggaggcagttggaaaaaatttgagtcaggggctctttaaagttcctttcttcatctttgagaaaacagtacgaggctttccctt

SEQ ID NO: 20800 - DNA, 201 bp, Homo sapiens
aaccatatcaactaaatattcaaaaaaagtactgctctaagagagtacttcaatttttaacttggtagccttggttcttgttcatgtgtgtaacactaacrtagcttaggaggcagttggaaaaaatttgagtcaggggctctttaaagttcctttcttcatctttgagaaaacagtacgaggctttcccttgcaaagttc

SEQ ID NO: 20801 - DNA, 201 bp, Homo sapiens
aaagtactgctctaagagagtacttcaatttttaacttggtagccttggttcttgttcatgtgtgtaacactaacatagcttaggaggcagttggaaaaamtttgagtcaggggctctttaaagttcctttcttcatctttgagaaaacagtacgaggctttcccttgcaaagttctttccatctttacttctcttatctg

SEQ ID NO: 20802 - DNA, 201 bp, Homo sapiens
tttgaagattgatagctggcgatgtgttaggaggctcaaaagaggtagatttaggagcagagaaagaaagttctgtgtcggagaatcagcaaaccaacctragaaactcaactcactccacaaaggaattgattgaaaattagatgtgttcaaaaataacttgaataaactcatggatactccatcataagttattaagga

SEQ ID NO: 20803 - DNA, 201 bp, Homo sapiens
aaaagccccaaatagcctatgggagtacctcaagacgagcaagcaataaaagcaaaatcggctgccttgggacacgtgcctgtgacagctgggagggccckctgggtcccctagtttcctccctcccccgatgaacccccagaaaggaactgaggctgtggatggggcagagggggacttacttccagagcactatttgct

SEQ ID NO: 20804 - DNA, 201 bp, Homo sapiens
cgtgcctgtgacagctgggagggcccgctgggtcccctagtttcctccctcccccgatgaacccccagaaaggaactgaggctgtggatggggcagagggrgacttacttccagagcactatttgctaggtgctgggagagagaagcaggtggctttcacaccccacattaccccgtgggatagagaaatgcctctgatct

SEQ ID NO: 20805 - DNA, 201 bp, Homo sapiens
actcatggaagtggttcttcctgctgaacctgaagatgtccccagactctctctcaacatagcaatctagggagccacttccggtggagatgaaacccccytgccatctctaagtaaaaggactcaaagagggggaaaaaggctcaggccgggcgtgttggctcacacctgtactcccagcactttgggaggctgaggcgg

SEQ ID NO: 20806 - DNA, 201 bp, Homo sapiens
aatcattgcgtatttaattaccttgtggtgatgtttgctttagggagtggaaggaacatgaggaacgaacgaccttcatcacggaagatgacattcatttmgattcactttagatttcagggcttgtttagatgcagactttgcagttaacattttattgcactgactgatttagttttcaccaggtggtccttgtgtttg

SEQ ID NO: 20807 - DNA, 201 bp, Homo sapiens
ccccattcctccagaaaaggataccaaagtccttgggtcctaaaggagaggcttcacctttgacctaccctggcccttcccttggctgatttttcagaaayccagatcgagactcaaagccctggtgctacgtctttaaggcggggaagtacagctcagagttctgcagcacccctgcctgctctgagggtaagtggcagc

SEQ ID NO: 20808 - DNA, 201 bp, Homo sapiens
cacagtgccacacagcaagcagagcctaggtgtgaccctgaatccaggctggcacccttgccacccagcctgtggcttccgagccagcctgcatcaggccygggggaggacggggcagagaggggagcctcctgagggctgaatgaaaggggactcccatgtgaggcatccatgccctgctctctgtcagataccagggcc

SEQ ID NO: 20809 - DNA, 201 bp, Homo sapiens
aagtccatcccagccacgccctgcggtcccgagtctgagtccattgttctggctttcactctgctctgcatcccgtcactggccccagacctcgacgcccwcctcttcagcgaaggcgaaacaaggactcatttttcctccctctcttcgctctttcttgttttcagactgcactgtttttctgctggccggatgactcat

SEQ ID NO: 20810 - DNA, 201 bp, Homo sapiens
atctctatggtacagataagaaaaccaaagcatggttagtctaaggccatcagctagtaagtgatggagccaagccagggtttttgaggcctgaaacgttkgagtaattaactctactttaccagaatagatacagcctaatcctccatgggaccaagataactgagatacaatctacccactcttcagtaagtctccact

SEQ ID NO: 20811 - DNA, 201 bp, Homo sapiens
aaggcagggtgcgatggcagggccaggggtgggggccagggacagggaaggcgcttctgccatgggtcaggaagcacagtgccacacagcaagcagagccyaggtgtgaccctgaatccaggctggcacccttgccacccagcctgtggcttccgagccagcctgcatcaggcctgggggaggacggggcagagaggggag

SEQ ID NO: 20812 - DNA, 201 bp, Homo sapiens
tttgtagccgtcttatgtaggaataaaatgggaggcaggtttgcctcatgcagttcccagcttggcttttccctttggcttagtgatttgggggtcttgaratttattttcctttcataccttggtagtgtcacttgaagccaccacgcccggctaatttttatatttttagtagagacagggtttcaccatgttgatcag

SEQ ID NO: 20813 - DNA, 201 bp, Homo sapiens
gggggctggggggggcggccactggcccaaggtcctggttatacagatcaaaaggcagagcccaggagagagcaagtggcttgcccagggtcacacagccrccagcagcacggccagggcagtcacagccgaggccaggcccatgctctgggtctcatcctaggctgtgatcccaccacagtgcaccggcagctttggtaa

SEQ ID NO: 20814 - DNA, 201 bp, Homo sapiens
gatggggtttcactatgttggccaggcttgttttgaactcctgacctcaagagatctgccagccttggcctcccaaagtgctgggattacaggtgtgagcyactgtgcctggccatataatctatttttaaaatgtttttatatgaaaataaacagagacagagtctcactgtgttgcccaggctgatctcgaactcctgg

SEQ ID NO: 20815 - DNA, 201 bp, Homo sapiens
caagttgcatgacagacccagtgcgtgggaagcacccatggatattatctaatccaacctcttcacttgctagaataacacatattgtgaaaagcaaggtytaccagttttccaacctaaatcccaagttaagggtcctggcctgtaaccatttagtcctcagctgttctcctgacatctttattgcaatgatttgtaaga

SEQ ID NO: 20816 - DNA, 201 bp, Homo sapiens
ccaaggctggtcctgccttctcagtggctacccccctgagctcccgccaccacacaaagtgttccaatccttgtgcatcctccagtccttttaacctctcrtgtcctgagaggccagagctacagccacagattccagaagacaccccactcccagccccaacctgctgcctttagaattataaacacttcttgtcatcac

SEQ ID NO: 20817 - DNA, 201 bp, Homo sapiens
aattatctcccagcattgacagacgaatggataaacaaaatgtgttctatcccacagtggagtattattcagctttaaaaaggaaggaaaaatgctgggcrcggtggctcacgcctgatcccagcactttgggaggctgaggaaggaggatcatttgtgcccaggagttcgagactagcctggacaacatagagaaacctt

SEQ ID NO: 20818 - DNA, 201 bp, Homo sapiens
gctgctggggaaaaggggaatggggagttattctttaatggctacagagtttcagttaggggtgatggagaagttctggagatgggcggtggtgacggccrgccgcacagcaatatgacgtgcttaatgccactgaactgtgcactgaacatcgttaaggtggtaaattttgtgttatatatattttgcaacaataaaaaa

SEQ ID NO: 20819 - DNA, 201 bp, Homo sapiens
tgaatgaaaggggactcccatgtgaggcatccatgccctgctctctgtcagataccagggccacgtgctacgaggaccagggcatcagctacaggggcacrtggagcacagcggagagtggcgccgagtgcaccaactggaacagcagcgcgttggcccagaagccctacagcgggcggaggccagatgccatcaggctgg

SEQ ID NO: 20820 - DNA, 201 bp, Homo sapiens
ccctgctgcgtggtatggcgctgctctgctgtaccctgagtgtctagttattcatcaggccccttcctaactatgagctctttcaggataagagctgtgtytttgcatcaccagagcctgtgccagggcacggctggtgctccatacacgttgatggtgaatatatagcatgggtagatcattgtctgtgaatgcttaaca

SEQ ID NO: 20821 - DNA, 201 bp, Homo sapiens
gggcgactgtcacctttgcctgctgtcgggagctgtgctgatgggtagggggctctgtgcttgctgtggcccagagccaagccgtggggatgtgctctgtytggagcagaccccttcactgtctgcctaactccttcgtgtgttcccggaacagcttctgtgttatgcattccagaaagcctgcctgaccaccccaacctc

SEQ ID NO: 20822 - DNA, 201 bp, Homo sapiens
tttagatgcagactttgcagttaacattttattgcactgactgatttagttttcaccaggtggtccttgtgtttgcttcagaaggatctaagtgtattagsacagggtttcttctgttttgattgtgggaggaggcgggatagacttctgttttcctagacccacaaccaaaattccccactcctccaaataaccgggatt

SEQ ID NO: 20823 - DNA, 201 bp, Homo sapiens
tccctcatatctatggggtatttgttccaggacccccaaggataccaaaatccagggatactcaagttcctcatatagaatggtgtagagtttgcatatcytatgcacaccctcctgtatactttaaatcatctctaaattacttataatacctagtacaatgttaatgctatgtaaatggttgttataaggtatttttta

SEQ ID NO: 20824 - DNA, 201 bp, Homo sapiens
atgacccatgcatgggggtggtggggaggggcaagaagaaagaaaagaacacagcaacctctctgagaagtcagtaggctctacccggctctctctagacrcctctattggtgttgctgagagtaatggggaatgaggaggaggcctcgcatgcatggctccttagataataaagtgccttcaccacatttgtccaacagc

SEQ ID NO: 20825 - DNA, 201 bp, Homo sapiens
gactgcctccacacctcacagtttatcatgcattcgtgtatttagcacagactagacagatttttactttataacactttgtattcattcattttccaacstgcttattccggttcagggtcttgggtgggggtggccagagccacctggcagctcagggcgccaggcgggaccagccctggacagacgccaccatcctat

SEQ ID NO: 20826 - DNA, 201 bp, Homo sapiens; identical to SEQ ID NO: 2079

SEQ ID NO: 20827 - DNA, 201 bp, Homo sapiens
ttagctattattggaaaatttggctttctctttcaaaaacgtttataaataactttccctaaaaccatatgatggttctcccctttcagtgtctcctttcyattcggagcggctgaaggaggctcatgtcagactgtacccatccagccgctgcacatcacaacatttacttaacagaacagtcaccgacaacatgctgtg

SEQ ID NO: 20828 - DNA, 201 bp, Homo sapiens
gggaagtgctgtgaaataggtgagtaggtgagagcacgtgaaacgagctgaaatcccacctctccagtctcccccgcccccggaaggaaaggcagggtgcsatggcagggccaggggtgggggccagggacagggaaggcgcttctgccatgggtcaggaagcacagtgccacacagcaagcagagcctaggtgtgaccct

SEQ ID NO: 20829 - DNA, 201 bp, Homo sapiens
aggaggctgtcattaggggcttccttttttatacttgacaggttgcagcgagccaaggtgtttcaacgggggcacctgccagcaggccctgtacttctcaratttcgtgtgccagtgccccgaaggatttgctgggaagtgctgtgaaataggtgagtaggtgagagcacgtgaaacgagctgaaatcccacctctccagt

SEQ ID NO: 20830 - DNA, 201 bp, Homo sapiens
aaactccatctcagaaaaaaaaaaaaagttacaattgggtgtcacatagacagtgaggagtagtggaaagagtgttagatttggggtaagagaactgtgtytcctgggcttgagtcctgatgccaactctcacaagatgtgtcaccgtacagcacgacgcttatactttttttttttttttttttgagacaggatcttgct

SEQ ID NO: 20831 - DNA, 201 bp, Homo sapiens
gtgggagggtcgctggagcccgggagttcaagaccaatctgggcaaacatagcaagtcccctgtctctacaaaaaataaaaaaattagccagacctggtakgtagtcccaactacttgggaggttgaggcagaaggatcacttgagcccaggagttggaggctgcagtaatctacgattatgccactgcatttcaacctca

SEQ ID NO: 20832 - DNA, 201 bp, Homo sapiens
gagatgggcggtggtgacggccggccgcacagcaatatgacgtgcttaatgccactgaactgtgcactgaacatcgttaaggtggtaaattttgtgttatrtatattttgcaacaataaaaaatatgtagtttctagaatcctcttctagatgcatgtctggcgtttctgccgcggggctggcactggaggaagccagaca

SEQ ID NO: 20833 - DNA, 201 bp, Homo sapiens
gcgccctgtgctcagaagcaaccgggtggaatattgctggtgcaacagtggcagggcacagtgccactcagtgcctgtcaaaagtatgtactgaggctggraggtggtgcatgcctgtgatcccagcactttaggaggccaaggtgggagggtcgctggagcccgggagttcaagaccaatctgggcaaacatagcaagtc

SEQ ID NO: 20834 - DNA, 201 bp, Homo sapiens
ggtgcctactctctagctgagatggaagcgctacacacactctctgaaaatgcctagcaataaagggcctcacggaagtccaaactaaccacacctctccmacaggaccctacagcggggagagccaggtgactgcgtggagtagacagccagctgcaactccattgcccaatatggtggccacttaccttgtgcaactgt

SEQ ID NO: 20835 - DNA, 201 bp, Homo sapiens
cagtcatggctgcgccctgtgctcagaagcaaccgggtggaatattgctggtgcaacagtggcagggcacagtgccactcagtgcctgtcaaaagtatgtrctgaggctgggaggtggtgcatgcctgtgatcccagcactttaggaggccaaggtgggagggtcgctggagcccgggagttcaagaccaatctgggcaaa

SEQ ID NO: 20836 - DNA, 201 bp, Homo sapiens
atgcctagcaataaagggcctcacggaagtccaaactaaccacacctctcccacaggaccctacagcggggagagccaggtgactgcgtggagtagacagycagctgcaactccattgcccaatatggtggccacttaccttgtgcaactgtttaaatttaaaataattaaagttaaaaattgtttctcagtcccactggc

SEQ ID NO: 20837 - DNA, 201 bp, Homo sapiens
gagtgatggggagcggctgtaaacacagatgaagcttcactggctctccagccactcacctcctgctgcgcagcctggttcctaacaggccacggacagayaccagcccatggccccagggccggggattcccagtctagatggagacctagacaaggcgtgcgacaataacaccgattttagatccatcatgacatttac

SEQ ID NO: 20838 - DNA, 201 bp, Homo sapiens
cagggtgcatcacccacccaccacctgccttcttccacccaccacctgcctacggtgtgacagtgccattgcagcatgattctacagagatgcctgtgtcrgcaccattctcccatcagctgcggccactgggcgggttctgattctgaggggagcagaaacaggtgttcccccccaaggagccaggctgtcagggatcac

SEQ ID NO: 20839 - DNA, 201 bp, Homo sapiens
aaaaattagccagacctggtatgtagtcccaactacttgggaggttgaggcagaaggatcacttgagcccaggagttggaggctgcagtaatctacgattrtgccactgcatttcaacctcagtgacagggcaagccctcacctctaaaacaaaacaaaacaacacaaacaaaaacaaaaacacagaaaagcccagtacaa

SEQ ID NO: 20840 - DNA, 201 bp, Homo sapiens
tgaggcatccatgccctgctctctgtcagataccagggccacgtgctacgaggaccagggcatcagctacaggggcacgtggagcacagcggagagtggcrccgagtgcaccaactggaacagcagcgcgttggcccagaagccctacagcgggcggaggccagatgccatcaggctgggcctggggaaccacaactactg

SEQ ID NO: 20841 - DNA, 201 bp, Homo sapiens
aggcctgttcggccttaggcggaggtgaaggtacaagcagaaaagggagcaagaccaagtgaccttgggcaaatgcccgcttgcctcagtttcctcatctrtaaagaggtgggaataacagtacacacttcatggtttgctgtgaggattaaattagctaatttttgtagactgtacaacagcgcctggcacatagagcac

SEQ ID NO: 20842 - DNA, 201 bp, Homo sapiens
gaacaacacttgtctgacctgcagggtccacttatgtatggatttttttcaaccaaaggcaggatgaaaacagtatttgtaggatgcagaactggtatacrcgtgttccacgctgcaggacttgagtgtgtgtggattgtggtagacagggctcctggaaccatggcctgagcacacagaaggaggctgtcattaggggct

SEQ ID NO: 20843 - DNA, 201 bp, Homo sapiens
gggcaacagagcaagactctgtcaagaaaaaaaaagaaagaaagaaagaaaaaaaaaaaaacactgaggaccagtgcgaaggaacccccagccactgaatytccggcagaaattcagctggtttcatcccctccccctttgcaggacaagctcttcttcaggattaatgaaatgaactgaggcagtgaggcccctggggat

SEQ ID NO: 20844 - DNA, 201 bp, Homo sapiens
aaaactctggggttacaggtgtgagccacaagcccagcttatattattattttttatttttctgttttggttgaatccacagatatggaacctgcagatayacaaagtggactgtatttataaaagacaatgcaggacagggcacagtgactcacacctgtaatctcagcactttgggaggccgaggtgggaggatcgctt

SEQ ID NO: 20845 - DNA, 201 bp, Homo sapiens
gcacccctgcctgctctgagggtaagtggcagccaccccgcctttccctgaatgtccctgggggaggaaagtccaggaggacaggccgatagccctcctgyacctgaggggagaaagggggaggccaggagtgagtcattttggttgcagagggaagaaagacaggacttaggtctgtgcctgggcttggcctctgactgg

SEQ ID NO: 20846 - DNA, 201 bp, Homo sapiens
cggcatgcatccttggctctgggaaacagtacatctcccaggaaagtgagcttacagcacggtaccccacttcctggttaccagactattgttcccgtttyccccaagaacagtcatcattcacaggttgtttggcagggcccaggaacagagtcactctggttgctacagccaacagaccaaacacggcttccaggcagg

SEQ ID NO: 20847 - DNA, 201 bp, Homo sapiens
ttgcctgcctcggtctcccaaagggctgggattatgggtgtgagacaccatgcctgatctacattatttatatcacagctcatgtacaaatttattttctycttcttttgggcaaggcaattttatgatttattttggtatgtcggtataattatgttatcagtcatctcaatggctacacaatattgcagtattctaaca

SEQ ID NO: 20848 - DNA, 201 bp, Homo sapiens
aggtcccatcccacttccaaattcctgcgattcaatgacatcacggctgtgaataatcagcctggcccgaagccaggatgggctgtgctgcttccaccgtraacttcctccccctgctttataaaaacaggcctgcctcagctccctcatggccctgtccactgagcatcctcccgccacacagaaacccgcccagccggg

SEQ ID NO: 20849 - DNA, 201 bp, Homo sapiens
tcaaggctgcagtgaaccatgttcatgccactgcactccagtctggatgacagagcgagacctagtctcaaaaaaaaaaaaaaaaaaaaaaagaaagaagwaagaagaaaggaaaaagaaaaaaaggcagcggggcgcggtggctcacgcctgtaatcccaccactttgggaggccaaggcgagcggatcacgaggtcagg

SEQ ID NO: 20850 - DNA, 201 bp, Homo sapiens
tgtagtcccaactacttgggaggttgaggcagaaggatcacttgagcccaggagttggaggctgcagtaatctacgattatgccactgcatttcaacctcrgtgacagggcaagccctcacctctaaaacaaaacaaaacaacacaaacaaaaacaaaaacacagaaaagcccagtacaaatcgacttcaaactgagactt

SEQ ID NO: 20851 - DNA, 201 bp, Homo sapiens
cgaccccaccccctgcctggaaacttaaaggaggccggagctgtggggagctcagagctgagatcctacaggagtccagggctggagagaaaacctctgcraggaaagggaaggagcaagccgtggtaggtcgggtttctgtaccttggggtctgtctcctcttctttctcttaaaagtctttccagcaagctgagccagt

SEQ ID NO: 20852 - DNA, 201 bp, Homo sapiens
ttataacactttgtattcattcattttccaacgtgcttattccggttcagggtcttgggtgggggtggccagagccacctggcagctcagggcgccaggcrggaccagccctggacagacgccaccatcctattgcagagccactaacacccacactcactcagactgggcccacgtagatacatcctcagttggcttaat

SEQ ID NO: 20853 - DNA, 201 bp, Homo sapiens
cggagcggctgaaggaggctcatgtcagactgtacccatccagccgctgcacatcacaacatttacttaacagaacagtcaccgacaacatgctgtgtgcwggagacactcggagcggcgggccccaggcaaacttgcacgacgcctgccaggtaaccaggagtggcgcgcccatgctgggcacaacccaggggagaatgc

SEQ ID NO: 20854 - DNA, 201 bp, Homo sapiens
aaagattttttttaagttctaaatatatatagggccaggtgcagtggctcgtgtctataatcccagcactttgggaggctgaggcgggagaactgcttgascccaggagtttgagaccagcctgggcaacaaagtgagactccatctctacaaaaaatacaaaaattagtcaggtgtggtggcttgtgcctatggtcccag

SEQ ID NO: 20855 - DNA, 201 bp, Homo sapiens
tggaaaggtagaagctactcaaatatctgttgagtgagtggcattcatccatgtgtacatttctcaggcaacaataatgtcactttcacctaaggccagtmaaatgtgggtaaagtcatataatgatacaatgaaagtttctgatcagtatttcctaattcaagtgtgttgaaatgtggagttgggctggagaattgtcaa

SEQ ID NO: 20856 - DNA, 201 bp, Homo sapiens
tacagatcacacaacacacccacatgcactcacctatgtttacacacacgggcctcctcctccagcccctgcccctcctgcgtgttcctcccctcccgggracgcggccctcacgccagctcactcctcctttctccctcccagcgctgctgcagctgaaatcggattcgtcccgctgtgcccaggagagcagcgtggtcc

SEQ ID NO: 20857 - DNA, 201 bp, Homo sapiens
gtcccctcaaaggtgacttcctagcagtacttgctgtggcaagaacgctcattctgggatctagactcaatccatgacggtcagcatgagctgctgggtgygtgcttcctgtgcaggcagagtcggactccagcactggcagggacactgtgagtattgagatatgaatagctccatcctgcccacccatttattccacct

SEQ ID NO: 20858 - DNA, 201 bp, Homo sapiens
aaggctgtttctccaccaggtttccgccccaccacctgacggtgatcttgggcagaacataccgggtggtccctggcgaggaggagcagaaatttgaagtvgaaaaatacattgtccataaggaattcgatgatgacacttacgacaatgacattggtaagagctcgtcattcccggctccagttcatacagatcacacaa

SEQ ID NO: 20859 - DNA, 201 bp, Homo sapiens
ctgctgacagagtaaaggggaaagtgaaaagaacgatacagaaaagccccaaatagcctatgggagtacctcaagacgagcaagcaataaaagcaaaatcrgctgccttgggacacgtgcctgtgacagctgggagggcccgctgggtcccctagtttcctccctcccccgatgaacccccagaaaggaactgaggctgtg

SEQ ID NO: 20860 - DNA, 201 bp, Homo sapiens
agcagcttcaagttgttccagggagaagcgggaagcctcagtgcttttgttgaggaaggatgttcatgacagtaggtgcaggtcgctcctgccgtgcaccyaggtgtgggggaaggactttcctgcttcttttccagttaccttacaattcagcaagacggaaatgattagcccatgacaaaaaccaggaaacaggctcag

SEQ ID NO: 20861 - DNA, 201 bp, Homo sapiens
atgttgcattctgcttctcttagactactttttttttttttttttgagacagagtctcgctcttttgcccaggctgaagtgcagtggcgctatctgcaagstctgcctcctgggttcacgccattctcctgcctcagtctcccgagtagctgggactataggtgcccgccaccatgcccggctaatttttcatatttgtag

SEQ ID NO: 20862 - DNA, 201 bp, Homo sapiens
tagtggctcagttttctacttacataaaaagacagcacattctcttagcaatatgtgtttgtatgtgtgtgtgtgtgtgtgtgtgtgtgtgtgtgtgtgtrtatatatatatatatatatataatttagagacaaggtctgactccatcacccaggctggagtgcagcagtgtgatcgtaggtcactgaaccttcaaactc

SEQ ID NO: 20863 - DNA, 201 bp, Homo sapiens
gctaatttttttgtatttttagtagagatggggtttcactatgttggccaggcttgttttgaactcctgacctcaagagatctgccagccttggcctcccraagtgctgggattacaggtgtgagccactgtgcctggccatataatctatttttaaaatgtttttatatgaaaataaacagagacagagtctcactgtgt

SEQ ID NO: 20864 - DNA, 201 bp, Homo sapiens
caacaagcctgggatggacaacctcctccacattccactccaagcccacccccgtccccaccctgctgcgtggtatggcgctgctctgctgtaccctgagygtctagttattcatcaggccccttcctaactatgagctctttcaggataagagctgtgtctttgcatcaccagagcctgtgccagggcacggctggtgct

SEQ ID NO: 20865 - DNA, 201 bp, Homo sapiens
agaggtgggaataacagtacacacttcatggtttgctgtgaggattaaattagctaatttttgtagactgtacaacagcgcctggcacatagagcacattyttaatattttaactcacatcatccttggagctgctttgaaaatacaggggacccttgaacaacacttgtctgacctgcagggtccacttatgtatggatt

SEQ ID NO: 20866 - DNA, 201 bp, Homo sapiens
caaaaaaagcattctaaggctgtttctccaccaggtttccgccccaccacctgacggtgatcttgggcagaacataccgggtggtccctggcgaggaggarcagaaatttgaagtcgaaaaatacattgtccataaggaattcgatgatgacacttacgacaatgacattggtaagagctcgtcattcccggctccagttc

SEQ ID NO: 20867 - DNA, 201 bp, Homo sapiens
tagatacatcctcagttggcttaatgtgcaagctttgggatgtggaaggaaaccggggtacctggacaaaacccaggcagacagtgtccccagacaggaaytgatttttgttttcctcatcaaagttataatgaaatgacactgaatggaatattattgaagggcctgctgtattttgaagattacgatgttcatgctaca

SEQ ID NO: 20868 - DNA, 201 bp, Homo sapiens
gatagccctcctgcacctgaggggagaaagggggaggccaggagtgagtcattttggttgcagagggaagaaagacaggacttaggtctgtgcctgggctyggcctctgactggctatttgtctgacctggagctgatctcctcacactctgaccctcaatttcctcctctatggaggagaggatggggctgaatcagtgg

SEQ ID NO: 20869 - DNA, 201 bp, Homo sapiens
aggacaggccgatagccctcctgcacctgaggggagaaagggggaggccaggagtgagtcattttggttgcagagggaagaaagacaggacttaggtctgygcctgggcttggcctctgactggctatttgtctgacctggagctgatctcctcacactctgaccctcaatttcctcctctatggaggagaggatggggct

SEQ ID NO: 20870 - DNA, 201 bp, Homo sapiens
ccaaacagctcgatggagacaccctgcactgcttatggtgatgctgcaggaatggcggcagcgatgcccgctacactccatggcctgctgcacgtgtgacwggacagttatttcatctatgcttacacctgcaggtcccttaccctagaaacactctatatcttcttaggtacttcccttgaaacaggatgagttctagag

SEQ ID NO: 20871 - DNA, 201 bp, Homo sapiens
cgcactgtgtgccttcccccggcggacctgcagctgccggactggacggagtgtgagctctccggctacggcaagcatgaggcctgtaagtggaaggaagyctcggccccatcctgtctgcgggacagcaggggaggctgcggtccaccagaggaaaatggggtcaggagaccgaagttccagccccgggtcaggcactga

SEQ ID NO: 20872 - DNA, 201 bp, Homo sapiens
catacagatcacacaacacacccacatgcactcacctatgtttacacacacgggcctcctcctccagcccctgcccctcctgcgtgttcctcccctcccgrggacgcggccctcacgccagctcactcctcctttctccctcccagcgctgctgcagctgaaatcggattcgtcccgctgtgcccaggagagcagcgtggt

SEQ ID NO: 20873 - DNA, 201 bp, Homo sapiens
gcccagcaaaagtcagccaaccttggggccttcctttctttcatcctttcttttttttccttttctatccttctgtgcctcccttcctacccccttccttycttcttctcatttgcctttttttttttcagttctttgatgatcctgagaagctactaaatatagcaaaagggagataacacagaacaaaattagaagtct

SEQ ID NO: 20874 - DNA, 201 bp, Homo sapiens
gcattgacagacgaatggataaacaaaatgtgttctatcccacagtggagtattattcagctttaaaaaggaaggaaaaatgctgggcgcggtggctcacrcctgatcccagcactttgggaggctgaggaaggaggatcatttgtgcccaggagttcgagactagcctggacaacatagagaaaccttgtctctacacac

SEQ ID NO: 20875 - DNA, 201 bp, Homo sapiens
ccagggcatcagctacaggggcacgtggagcacagcggagagtggcgccgagtgcaccaactggaacagcagcgcgttggcccagaagccctacagcgggyggaggccagatgccatcaggctgggcctggggaaccacaactactgcaggtgagggcacatccccaaggagggattccccctgtgagaagctgctacagc

SEQ ID NO: 20876 - DNA, 201 bp, Homo sapiens
gaggccaaggcgggcggatcacgaggtcaggagatcgagaccatcctggctaacacagtgaaaccccgtctctactaaaaatacaaaaaattagccgggtrtggtggcaggcgcgcatagtcccagctactcgggaggctgaggcaggagaatcgcttcaacctgggaggtggaggttgtagtgagctgagatcacgccac

SEQ ID NO: 20877 - DNA, 201 bp, Homo sapiens
cacttggcacctcgagccagcaggtgtgggggggcctggccgaggggcagttcctcagccgagtagcagtgtggggtaccgtgactgtgggggtgcccccygagggaggggtcatggtgggccaggcatgtgtgcagccaggtcagaaacaggaggccggggaggagctggtgaaacaggcaggtgggtggttaggaggtg

SEQ ID NO: 20878 - DNA, 201 bp, Homo sapiens; identical to SEQ ID NO: 2247

SEQ ID NO: 20879 - DNA, 201 bp, Homo sapiens
ggccagggcctcaaatcctggatgacccctgcgcccacctcctgggtcctgacggcctgccgaagccagctgcctgactgcctcagcagggaccgcatgcygcttggagaaggggtggcctcgccggagctagggagcggatgtggtgggctggccggactcctgggacatgtgggtggtggcttgaccccgggcccatgg

SEQ ID NO: 20880 - DNA, 201 bp, Homo sapiens; identical to SEQ ID NO: 2248

SEQ ID NO: 20881 - DNA, 201 bp, Homo sapiens
ccatggggaataaaccagcattgctgcctccggcctccgccgtttttctgtttcgtaaaccagcatcccggggttcctgctctgagtgaccctggcacctstcagggagtccaggtgtgccccatgagggcctgggggaggggcaggctgggcagagccacagaggggctcccctcaaaccccacattggctcaggtggga

SEQ ID NO: 20882 - DNA, 201 bp, Homo sapiens
ccctccagcggaccagggaaggggtcaccgtgctgggagcagcctccttgggcctcaggaaaccaccaagtgcctcggatggtggctgcccacggcgcttytgctgagaccctgcccccggcccaggtgtctcggagggtggctgcccacggcctgggtgtggctggaatggtggcaggagtgggcaccagtgcggccccg

SEQ ID NO: 20883 - DNA, 201 bp, Homo sapiens
ggtcctgacggcctgccgaagccagctgcctgactgcctcagcagggaccgcatgccgcttggagaaggggtggcctcgccggagctagggagcggatgtrgtgggctggccggactcctgggacatgtgggtggtggcttgaccccgggcccatgggcagcttgctgtggggcagtgcagggagtcctgcggccgcccag

SEQ ID NO: 20884 - DNA, 201 bp, Homo sapiens
gctggaggacggggccctgcagcctgtcctgtgcccaggaaagtgaccgcctgcttcgagtcagcggccaagaagtcggtgggtcagttcagacagctctycccagagctgccccgtgagactcaccctgcctgccccgcactccctacaggaagtagacggactgagggcacccagctgggagccaggagacctgggctc

SEQ ID NO: 20885 - DNA, 201 bp, Homo sapiens
cctggctaatttttgtatttttagtacagacagggttttgccatatcggccaggctggtctgaggctcctgacctcaagtgatctgctcgccttggcctcmcaaagtgctgggattacaggagtgagccactgcgcccagccttgaacctcctataagagggtttctgcttgcgtatccgtcagcaccttgctgattcaac

SEQ ID NO: 20886 - DNA, 201 bp, Homo sapiens
ccaggtggggccagggcctcaaatcctggatgacccctgcgcccacctcctgggtcctgacggcctgccgaagccagctgcctgactgcctcagcagggascgcatgccgcttggagaaggggtggcctcgccggagctagggagcggatgtggtgggctggccggactcctgggacatgtgggtggtggcttgaccccgg

SEQ ID NO: 20887 - DNA, 201 bp, Homo sapiens
ggctgggggcggggcctgggcggggcggggttcggccgggagcgcaggggcggcagtgcgcgcctagcagtgtcccagccgggttcgtgtcgccatggggyagatcgagtgggccatgtgggccaacgaacaggcgctggcgtccggcctgagtgagtgcacgtcagggacggtggaggctgcagcctggaggggtgtccc

SEQ ID NO: 20888 - DNA, 201 bp, Homo sapiens
cggtgaaaccccgtctctactaaaaatacaaaaaattagccgggcgtggtggcgggcgcctgtagtcccagctactcaggaggctgaggcaggagaatggygtgaacccgggaggcggagcttgcagtgagccgagatcgcaccattgcactccagcctgggccagagcgagactcctcaaaaaaaaaaaaaagaactgca

SEQ ID NO: 20889 - DNA, 201 bp, Homo sapiens
gactgctgtgggttccaggtggcgtacacctttgacgcgggccccaatgccgtgatcttcaccctggacgacactgtggctgagtttgtggctgctgtgtkgcacggctttcccccaggctcgaatggagacacgtgagtgtggaccccgcccctcctcctttttgggagatggtgccaggaactctggtcggaagagacg

SEQ ID NO: 20890 - DNA, 201 bp, Homo sapiens
acagctcctgcaggccctgcaggccctccacacctaacgcctccctaaggggcttggattccagaggaggccgctggcgttaagtgaaaagggaacagggycggagccacgtggtgagcctctaccctgcgcctcttttccgtagaagctggggtgaagctggtggcggatgtggccttgtttgcccccacactgatgctg

SEQ ID NO: 20891 - DNA, 201 bp, Homo sapiens
accgctaccctcctgtgtccggccctacagatgctgggcacaggatgaggcgctgccattcctggtgacctgacatggatttctatccccaggtggggccrgggcctcaaatcctggatgacccctgcgcccacctcctgggtcctgacggcctgccgaagccagctgcctgactgcctcagcagggaccgcatgccgctt

SEQ ID NO: 20892 - DNA, 201 bp, Homo sapiens
tctggagggtgcgtggcagctggagtgggagcagagacctcagggtgggagggctggaggacggggccctgcagcctgtcctgtgcccaggaaagtgacckcctgcttcgagtcagcggccaagaagtcggtgggtcagttcagacagctctccccagagctgccccgtgagactcaccctgcctgccccgcactccctac

SEQ ID NO: 20893 - DNA, 201 bp, Homo sapiens
gaggatcacttgagctcaggagttcgagaccaacctggccaacatggcgaaaccccgcctccactaaaaatacaaatatgagttgggtgtggtggtgcacrcctgtactgggaagctgagctgggaggatcgcttgaactcagaaggtgggggtggcagtgagctgaagtcataccacactgcactccagcctgggcaaca

SEQ ID NO: 20894 - DNA, 201 bp, Homo sapiens
cccgcctccactaaaaatacaaatatgagttgggtgtggtggtgcacgcctgtactgggaagctgagctgggaggatcgcttgaactcagaaggtgggggwggcagtgagctgaagtcataccacactgcactccagcctgggcaacagagcgagaccctttttcaagaaagaaaagaaactcaataaatgtgttgaatga

SEQ ID NO: 20895 - DNA, 201 bp, Homo sapiens
gtggagcagcagcccggtggcctctgtccctagtcagggctgctgccgggagcaggagcgaaggcgtccatccaggctttgcttggctcctggggtcagcrggggctgaaggaacagaagcgtggttgagtgctcaggaaccgctcccatgcggcgggcgccaccacccgctgggatctggaagttgcccctgcgtcaccc

SEQ ID NO: 20896 - DNA, 201 bp, Homo sapiens; identical to SEQ ID NO: 2238

SEQ ID NO: 20897 - DNA, 201 bp, Homo sapiens
ggttcctgttcccaggggtgtcctcaggggagacactgtgtgggcagagcagggacacctgtgacccccccgtgctacagctcagtcccacctgcatgcaytgctcgcggctgcgtagacctttctggaaggacaccccagaattgggtccatggctggcctggaccagggctgaacgggagaatgtcgcattgaatgttg

SEQ ID NO: 20898 - DNA, 201 bp, Homo sapiens; identical to SEQ ID NO: 2263

SEQ ID NO: 20899 - DNA, 201 bp, Homo sapiens
accttttctgcagctttaagggctggaagaggtgctgagctccttctacccccaactactgaggctggagatgaggagaacagtggggggctgtcctccaracacggggaatgcccagaccccaagggtagtgttgggggaggcatataaataacaataaatacacataaatagggggtgccctctggggagcacacgtgt

SEQ ID NO: 20900 - DNA, 201 bp, Homo sapiens; identical to SEQ ID NO: 2243

SEQ ID NO: 20901 - DNA, 201 bp, Homo sapiens
cacacgggcttggggtgcagtcgggctcacatgtggtggtaatccacgtctccccagggccctccaagagcacagagcagggtccggaggcctctaggagmctcccttccacttcatcacccagccccacttctgcaggagctcaggtgacgggcccagaatttccccaggggaccctggccacctaggacagtgggaggc

SEQ ID NO: 20902 - DNA, 201 bp, Homo sapiens; identical to SEQ ID NO: 2245

SEQ ID NO: 20903 - DNA, 201 bp, Homo sapiens
ttaaccacatggcttcagtgtggcgggcgtgtttgtgtgcctgctggagtacccccgggggaagaggaagaagggctccaccatggagcgctggtgagtcycctcctgctctggggtctctccgggggttgcggggcccaggcagggctcacagggttgggtggagcttggtttctcacttggaggctccggaaccaaccc

SEQ ID NO: 20904 - DNA, 201 bp, Homo sapiens
tgcaggagctcaggtgacgggcccagaatttccccaggggaccctggccacctaggacagtgggaggcagggcacggccagccgcaagcagcagctcagcmgtccaggtcaggagggccggagggagggagctcaggtggccacgcccacttgacaggtgagaaccgccaaggcccagagagctctccgggcagtcagggc

SEQ ID NO: 20905 - DNA, 201 bp, Homo sapiens
cctgctctgccgcaggtaccttttgttgcccttgtcgcaggccgcaagctctgcaggccgtgaacagagagtgtccgagagtggaactagcggaggtgggrgacagacggctgggccggtgaatgctggcctcaaaggctgatggcccagaagccctgtcatctggaaatccccatttgccgtggggtgtgggacgttcct

SEQ ID NO: 20906 - DNA, 201 bp, Homo sapiens
ccgggagcgagacttccccagcttcgcccagctgaccatgaaggacagcaaccagttccacgccacctgcctcgacaccttcccgcccatctcttacctcmatgccatctcctggcgcatcatccacctggtgcaccgcttcaacgcccaccacggggacaccaaggtgacgcgggccgggagggcagaggctgcgctcgc

SEQ ID NO: 20907 - DNA, 201 bp, Homo sapiens
cgtacacctttgacgcgggccccaatgccgtgatcttcaccctggacgacactgtggctgagtttgtggctgctgtgtggcacggctttcccccaggctcraatggagacacgtgagtgtggaccccgcccctcctcctttttgggagatggtgccaggaactctggtcggaagagacggaggcacctgaaggctgtggcg

SEQ ID NO: 20908 - DNA, 201 bp, Homo sapiens; identical to SEQ ID NO: 2249

SEQ ID NO: 20909 - DNA, 201 bp, Homo sapiens
accgcttcaacgcccaccacggggacaccaaggtgacgcgggccgggagggcagaggctgcgctcgcgctgtagcgcgtgtctaggcttgtgctgccgtgragacggccccggggctcgcgtgcagggcaatctgtgtctgaaagctccaccctgctgtgtgcgaagctcactgaccatctgggttcttctgtttcatttt

SEQ ID NO: 20910 - DNA, 201 bp, Homo sapiens; identical to SEQ ID NO: 2225

SEQ ID NO: 20911 - DNA, 201 bp, Homo sapiens; identical to SEQ ID NO: 2227

SEQ ID NO: 20912 - DNA, 201 bp, Homo sapiens; identical to SEQ ID NO: 2228

SEQ ID NO: 20913 - DNA, 201 bp, Homo sapiens
caggcctgggccccctttccacgactggggctgctccccccggggccccttaactaaaatctccaacagagcctgggtcccgaagcgtggctagttcaccwtcagggagggcgcttggccttggatgttgatccgaaccacgaaggctgggggccctgccttgagccgacagccctgcagttcatcctcagagacttgcct

SEQ ID NO: 20914 - DNA, 201 bp, Homo sapiens; identical to SEQ ID NO: 2229

SEQ ID NO: 20915 - DNA, 201 bp, Homo sapiens
gtggtggcgggcgcctgtagtcccagctactcaggaggctgaggcaggagaatggcgtgaacccgggaggcggagcttgcagtgagccgagatcgcaccaytgcactccagcctgggccagagcgagactcctcaaaaaaaaaaaaaagaactgcagcccctcccccagagcctctgtcctggactcactcacagactaca

SEQ ID NO: 20916 - DNA, 201 bp, Homo sapiens
ggtcaagatcaggtgaggctcacgtgcccccttcacccaggtgggagaggtcccggagatgggggaggcaggcacgtcttcaggtctctgttgggtttctgtgttgtttttttttttgttgtttttttgaggcggagtctgactctgtcgcccaggcggggagtacagtggtgcgatctcggctcactacaagctcagctt

SEQ ID NO: 20917 - DNA, 201 bp, Homo sapiens
gtcaagatcaggtgaggctcacgtgcccccttcacccaggtgggagaggtcccggagatgggggaggcaggcacgtcttcaggtctctgttgggtttctgkgttgtttttttttttgttgtttttttgaggcggagtctgactctgtcgcccaggcggggagtacagtggtgcgatctcggctcactacaagctcagcttc

SEQ ID NO: 20918 - DNA, 201 bp, Homo sapiens
gaggcaggagaatcgcttcaacctgggaggtggaggttgtagtgagctgagatcacgccacggaactccagcctgggtgacagggcaagactctgtctccaaaaaaaaaaaaaaaaagaaataaaatagtaggaaggaccaggcgccgtggctcatgcctgtaatcccaacactctgggaggccaaggcgggcggattccc

SEQ ID NO: 20919 - DNA, 201 bp, Homo sapiens
agatgcagaaaccacactcggcctgttagctttcagtgcatcaaacaaagactcatggtgacaagggggtccatttgggggtcccagagcccactggggcytgcaggtcgggctgtccttggccactcctgggacccagagcccgggcatgtccagcaccccctccgccagcccgtgcgccacaggctctgctcttcacca

SEQ ID NO: 20920 - DNA, 201 bp, Homo sapiens; identical to SEQ ID NO: 2232

SEQ ID NO: 20921 - DNA, 201 bp, Homo sapiens
catggtgggccaggcatgtgtgcagccaggtcagaaacaggaggccggggaggagctggtgaaacaggcaggtgggtggttaggaggtgcccagggcaggrggcacctcacttccacctcagctttccttgttcccagcggaaagatggagtacagccctccctctatagatggggaaactgaagcccagagaggctagcc

SEQ ID NO: 20922 - DNA, 201 bp, Homo sapiens; identical to SEQ ID NO: 2233

SEQ ID NO: 20923 - DNA, 201 bp, Homo sapiens
gagtagctgggattacaggcaccccccaccatgcctggctaatttttgtatttttagtacagacagggttttgccatatcggccaggctggtctgaggctsctgacctcaagtgatctgctcgccttggcctcccaaagtgctgggattacaggagtgagccactgcgcccagccttgaacctcctataagagggtttctg

SEQ ID NO: 20924 - DNA, 201 bp, Homo sapiens
gtgcacctggccatgcacctggcagcagccgctcttatacctgaggccacacctgggggaaattccggcaccacttcctcctcgggaagtgcccagctggkgcgcttcttccttctctggtccccgcagcccccgcctgctgtgcatcaggacacagacatgcaaggaggccccgggaggcgctgtcctgttacccccctc

SEQ ID NO: 20925 - DNA, 201 bp, Homo sapiens; identical to SEQ ID NO: 2234

SEQ ID NO: 20926 - DNA, 201 bp, Homo sapiens; identical to SEQ ID NO: 2235

SEQ ID NO: 20927 - DNA, 201 bp, Homo sapiens
tacaggcaccccccaccatgcctggctaatttttgtatttttagtacagacagggttttgccatatcggccaggctggtctgaggctcctgacctcaagtsatctgctcgccttggcctcccaaagtgctgggattacaggagtgagccactgcgcccagccttgaacctcctataagagggtttctgcttgcgtatccgt

SEQ ID NO: 20928 - DNA, 201 bp, Homo sapiens
gttgaggacattcacagggtcatgtgagcaccacctcaagccacctccttaactttttcatcacccctaaaagaaacctgtccccacagcagccacctgcygtctccccctccctgagccctgacggccaggaatgcacttcccatctctggacttgcctgttgtagactgttgtagacgcttagagaaacggatgcattc

SEQ ID NO: 20929 - DNA, 201 bp, Homo sapiens
cctcaagtgatctgctcgccttggcctcccaaagtgctgggattacaggagtgagccactgcgcccagccttgaacctcctataagagggtttctgcttgygtatccgtcagcaccttgctgattcaacttgtaggttttcatctggacctgatggtggcggggcgcttttgcaccctatacagttcttctccgtctgctg

SEQ ID NO: 20930 - DNA, 201 bp, Homo sapiens
cctgacggccaggaatgcacttcccatctctggacttgcctgttgtagactgttgtagacgcttagagaaacggatgcattcaccgtgcccctgccctgcktttccaggtttctgaaggggctgcaggtgaggccggcccctctctcagctgagcttcaggctgcgctggccatggagccgacccccggtggggtcaaata

SEQ ID NO: 20931 - DNA, 201 bp, Homo sapiens
tgagacccccagtaattcccttgcagaccctgcggagcgcggcgcccctcccccattcccttctctcggtcccccgactccgcgaaggaggaagttgcagygcaggggaagaggcggttcagccccggtggtttccggggtcaccgccccgaagcccccgagtgggggctccggcctgggcatcgggagaagctcccctgc

SEQ ID NO: 20932 - DNA, 201 bp, Homo sapiens
tgatctgctcgccttggcctcccaaagtgctgggattacaggagtgagccactgcgcccagccttgaacctcctataagagggtttctgcttgcgtatccstcagcaccttgctgattcaacttgtaggttttcatctggacctgatggtggcggggcgcttttgcaccctatacagttcttctccgtctgctgctggtgg

SEQ ID NO: 20933 - DNA, 201 bp, Homo sapiens
cagccttgaacctcctataagagggtttctgcttgcgtatccgtcagcaccttgctgattcaacttgtaggttttcatctggacctgatggtggcggggcrcttttgcaccctatacagttcttctccgtctgctgctggtgggtgccaagggtggttcagtgttttagctgagatggtcaagatcaggtgaggctcacgt

SEQ ID NO: 20934 - DNA, 201 bp, Homo sapiens
cctgtctcagccattcgagagcatataatcctgcggtgttgaggacattcacagggtcatgtgagcaccacctcaagccacctccttaactttttcatcamccctaaaagaaacctgtccccacagcagccacctgccgtctccccctccctgagccctgacggccaggaatgcacttcccatctctggacttgcctgttg

SEQ ID NO: 20935 - DNA, 201 bp, Homo sapiens
ggggaggcaggcacgtcttcaggtctctgttgggtttctgtgttgtttttttttttgttgtttttttgaggcggagtctgactctgtcgcccaggcggggrgtacagtggtgcgatctcggctcactacaagctcagcttcctgggttcacgccattctcctgcctcagcctgccgggtagctgggactacaggcgcccgc

SEQ ID NO: 20936 - DNA, 201 bp, Homo sapiens
tgctttcccagttgtacacatcctgtcccctccctcgagtctcagtcacagttcagtgacctggtgacgggaggccccctgcagtgtctgacccaggccaygcctgtgccagcccagagccagggggaggaaatgggggctgggcctctggtccccatggggaggccacccttgtccttggtagcatcagggtgcagaggt

SEQ ID NO: 20937 - DNA, 201 bp, Homo sapiens
tgtctcggagggtggctgcccacggcctgggtgtggctggaatggtggcaggagtgggcaccagtgcggccccggtggccatggggaataaaccagcattrctgcctccggcctccgccgtttttctgtttcgtaaaccagcatcccggggttcctgctctgagtgaccctggcacctgtcagggagtccaggtgtgcccc

SEQ ID NO: 20938 - DNA, 201 bp, Homo sapiens; identical to SEQ ID NO: 2222

SEQ ID NO: 20939 - DNA, 201 bp, Homo sapiens; identical to SEQ ID NO: 2223

SEQ ID NO: 20940 - DNA, 201 bp, Homo sapiens; identical to SEQ ID NO: 2224

SEQ ID NO: 20941 - DNA, 201 bp, Homo sapiens
tacatcattgtcactcaggtgaggcctggggctcacccagtaccccggggtttcctttcctgccaggggggcccgcccagcccccagggcccttaaaggcwaagcgcggctccctgtccctaccgtgtctcaggcaggaagccagaacgcctttgtccattcatttgctctcaaagtggacattacaggccactggtgatg

SEQ ID NO: 20942 - DNA, 201 bp, Homo sapiens
ctggtccccgcagcccccgcctgctgtgcatcaggacacagacatgcaaggaggccccgggaggcgctgtcctgttacccccctcccccgagagagactcygcccaacctgagcacctacacagggtgctgccttgtctgacattctcaaactttttttttttttttgagacagggtcttgctgtcacccgagctggaggg

SEQ ID NO: 20943 - DNA, 201 bp, Homo sapiens; identical to SEQ ID NO: 2205

SEQ ID NO: 20944 - DNA, 201 bp, Homo sapiens
ctaaaagaaacctgtccccacagcagccacctgccgtctccccctccctgagccctgacggccaggaatgcacttcccatctctggacttgcctgttgtasactgttgtagacgcttagagaaacggatgcattcaccgtgcccctgccctgcttttccaggtttctgaaggggctgcaggtgaggccggcccctctctca

SEQ ID NO: 20945 - DNA, 201 bp, Homo sapiens
ttccctgagctgttaccccatggggcttggcagcacccttggccagatgtgggtccagcctgggcatagctgtttaccacataacctaaaatttcctgtcycagccattcgagagcatataatcctgcggtgttgaggacattcacagggtcatgtgagcaccacctcaagccacctccttaactttttcatcacccctaa

SEQ ID NO: 20946 - DNA, 201 bp, Homo sapiens
caggcggctgtgcgtggcgagcagtggacgcccatcgagcccaagccccgggagcggccgcagatcggaggcaccatcaagcagccgcccagcaacccccmgccgcggcccccggccgaggcccgcaagaagcccagcgaggaggaggctgcggcggcggcggggggacccccgggaggtccccaggtcaaccccatcccg

SEQ ID NO: 20947 - DNA, 201 bp, Homo sapiens; identical to SEQ ID NO: 2226

SEQ ID NO: 20948 - DNA, 201 bp, Homo sapiens; identical to SEQ ID NO: 2254

SEQ ID NO: 20949 - DNA, 201 bp, Homo sapiens
cgaccctgtcactgtgctgtggggatgggtagggggcagctctgggtggcctggtggcccacagtaggtagagaaggggggtggcccaggcccccgggacrggagccccacagtgcctgacccacttctccccgcagtcctcatcaccgggggcatcgtggccacagctgggcgcttcacccagtggtactttggtgccta

SEQ ID NO: 20950 - DNA, 201 bp, Homo sapiens
tccccagggccctccaagagcacagagcagggtccggaggcctctaggagcctcccttccacttcatcacccagccccacttctgcaggagctcaggtgamgggcccagaatttccccaggggaccctggccacctaggacagtgggaggcagggcacggccagccgcaagcagcagctcagccgtccaggtcaggagggc

SEQ ID NO: 20951 - DNA, 201 bp, Homo sapiens
gccatccccacccaggccacctgccgcctcccgctctgccctcatcccctgaaaccatcctgatgctgccattgaaacccaaagcctcaccccagtgcctscggctcagaatccgcaggctcagaacccacaggctcagctacctccagtgacagccacaagcttctgatggccccagggcagacatgatctgcaccccca

SEQ ID NO: 20952 - DNA, 201 bp, Homo sapiens
actcccagatgtgtgcgtaagtgtccgacattttgaaggaaaggagtcaaagcccctgatttccttcttactgaagcgagttagagccagtcaaggcggcygggtgttgaccccgccccggcagttgggtgtcttttcttgggtggggtccggcagctgcatcttggcgccacagagcccccatgtacgccctcctcggtg

SEQ ID NO: 20953 - DNA, 201 bp, Homo sapiens
ttcccacccactgtcagagcctgtccccccggtggtggtctcacaccatcttcacccctcaactccaggggtgacgcttcctggcccacctgggctcctgygccttccctgaaccaccctcggtgaccagggtgggtgaccagacctggaggtggggttgccctgctggagccctgtgggaggaggggagaaggtggctcc

SEQ ID NO: 20954 - DNA, 201 bp, Homo sapiens
agcctgtcccagggcccctagcggggtgggcctccggggagggagggagggagggagggcgggcgctggggcgcggctcaacccttcagtgccccgcaggyggctgtgcgtggcgagcagtggacgcccatcgagcccaagccccgggagcggccgcagatcggaggcaccatcaagcagccgcccagcaaccccccgccg

SEQ ID NO: 20955 - DNA, 201 bp, Homo sapiens
accccaagggtagtgttgggggaggcatataaataacaataaatacacataaatagggggtgccctctggggagcacacgtgtccagtctaggggccccayggcctcggcggtcacactgaacggggcagcacgcaggtgcagccgacggggacgtggatgaactcggtgtggaaggcaaaggccccaggtgtggggagcc

SEQ ID NO: 20956 - DNA, 201 bp, Homo sapiens
ttactgaagcgagttagagccagtcaaggcggccgggtgttgaccccgccccggcagttgggtgtcttttcttgggtggggtccggcagctgcatcttggygccacagagcccccatgtacgccctcctcggtgcacagcttggccctgaaccgcctcttcccctgcgctgctctgtgggggtgccacagagcccccatgt

SEQ ID NO: 20957 - DNA, 201 bp, Homo sapiens
cttccatggggcttcctgctctgccgcaggtaccttttgttgcccttgtcgcaggccgcaagctctgcaggccgtgaacagagagtgtccgagagtggaastagcggaggtgggggacagacggctgggccggtgaatgctggcctcaaaggctgatggcccagaagccctgtcatctggaaatccccatttgccgtgggg

SEQ ID NO: 20958 - DNA, 201 bp, Homo sapiens
ggggaggcatataaataacaataaatacacataaatagggggtgccctctggggagcacacgtgtccagtctaggggccccacggcctcggcggtcacacygaacggggcagcacgcaggtgcagccgacggggacgtggatgaactcggtgtggaaggcaaaggccccaggtgtggggagccccgagccgtcgcgggagc

SEQ ID NO: 20959 - DNA, 201 bp, Homo sapiens
cgaaggcgtccatccaggctttgcttggctcctggggtcagcgggggctgaaggaacagaagcgtggttgagtgctcaggaaccgctcccatgcggcgggygccaccacccgctgggatctggaagttgcccctgcgtcacccctgctgtggccgggaggcctctgtggtcaggcaggtggcactgactcccacccccgct

SEQ ID NO: 20960 - DNA, 201 bp, Homo sapiens
aggtggctcccgtgctgggtgggcagggggcgcgtcttgtggagtccagctctgtcctggcatcggtccctgccccacacagccttaaaattccttcccaycctcaaagcccagcttgggtgtcctcgggggcctttctcccgccttccatggggcttcctgctctgccgcaggtaccttttgttgcccttgtcgcaggcc

SEQ ID NO: 20961 - DNA, 201 bp, Homo sapiens
aaagctccaccctgctgtgtgcgaagctcactgaccatctgggttcttctgtttcattttgtttcttgacttgcccgggtcacggccccaccaccttcttyctgggttcacaggcagacgtgtcaagtaccaggcacttggggtcacagctccactccagtgtggccctgagggcctagactgagctcttggagagcccaa

SEQ ID NO: 20962 - DNA, 201 bp, Homo sapiens
gcggtggctcacgcctgtaatcccagcactttgggaggccgaggcgggcagatcatgaggtcaggagatcgagaccatcctggctaacacggtgaaacccmgtctctactaaaaatacaaaaaattagccgggcgtggtggcgggcgcctgtagtcccagctactcaggaggctgaggcaggagaatggcgtgaacccggg

SEQ ID NO: 20963 - DNA, 201 bp, Homo sapiens
gtgggagccacgggcagggtgtccccatagagccatcccacagcccacgtccacagggaagaaagagaggccgctcacgcgtgtgtgagcaacgcccaggrtctcccacctcctgagtgacagcgtcccctgcagctcgggaccccgcaggctcttattctatagaacagtggcttaggaaacacgcctgcactcccagat

SEQ ID NO: 20964 - DNA, 201 bp, Homo sapiens
cccagcgccctgccctgcccctgcggtccccctctcacctggcatcagccacgcaggccactctctgacccttggacacacgcagcatgtgtcttctcagrgcctttgcatgggctcttcctgctgcctggagctgttccctgcatggctgcctggctccttcctcctccccttcaggtcttcgaggcctccctgaccctc

SEQ ID NO: 20965 - DNA, 201 bp, Homo sapiens
gttagagccagtcaaggcggccgggtgttgaccccgccccggcagttgggtgtcttttcttgggtggggtccggcagctgcatcttggcgccacagagccsccatgtacgccctcctcggtgcacagcttggccctgaaccgcctcttcccctgcgctgctctgtgggggtgccacagagcccccatgtacgccctcctcg

SEQ ID NO: 20966 - DNA, 201 bp, Homo sapiens; identical to SEQ ID NO: 2237

SEQ ID NO: 20967 - DNA, 201 bp, Homo sapiens
gttcggccgggagcgcaggggcggcagtgcgcgcctagcagtgtcccagccgggttcgtgtcgccatggggcagatcgagtgggccatgtgggccaacgarcaggcgctggcgtccggcctgagtgagtgcacgtcagggacggtggaggctgcagcctggaggggtgtcccaagaccccagccgggacctcgggctactt

SEQ ID NO: 20968 - DNA, 201 bp, Homo sapiens
cgaatggagacacgtgagtgtggaccccgcccctcctcctttttgggagatggtgccaggaactctggtcggaagagacggaggcacctgaaggctgtggygctgagacagggagtcccagggcaggcagcagtcccccgagtgtgggagccacgggcagggtgtccccatagagccatcccacagcccacgtccacaggg

SEQ ID NO: 20969 - DNA, 201 bp, Homo sapiens
cctgtggggtggactcagacccacaccccaggactgcccgcctgggaagcaccaggctcgtggctgctgctccgggtggggcttgcaggcttccgctgttytgcagaacacggtgacgaacgcaccagcttgaattgggcgcttccctgagctgttaccccatggggcttggcagcacccttggccagatgtgggtccagc

SEQ ID NO: 20970 - DNA, 201 bp, Homo sapiens; identical to SEQ ID NO: 2240

SEQ ID NO: 20971 - DNA, 201 bp, Homo sapiens
gctgaagggctttctcaccccagctctggctatgcccagttctctgagaaaggagctcagtggggaggtggtccctccagcggaccagggaaggggtcacygtgctgggagcagcctccttgggcctcaggaaaccaccaagtgcctcggatggtggctgcccacggcgcttctgctgagaccctgcccccggcccaggtg

SEQ ID NO: 20972 - DNA, 201 bp, Homo sapiens
tgtagctgggctcaaaccaaggataggaaatcttccaacaagaccatgtggagacaaaaacagaatggctggcagggcaaggtggctacacctgtaatccyagcactttgggaggccaaggcgggcggatcacgaggtcaggagatcgagaccatcctggctaacacagtgaaaccccgtctctactaaaaatacaaaaaa

SEQ ID NO: 20973 - DNA, 201 bp, Homo sapiens
gtagctgggctcaaaccaaggataggaaatcttccaacaagaccatgtggagacaaaaacagaatggctggcagggcaaggtggctacacctgtaatcctrgcactttgggaggccaaggcgggcggatcacgaggtcaggagatcgagaccatcctggctaacacagtgaaaccccgtctctactaaaaatacaaaaaat

SEQ ID NO: 20974 - DNA, 201 bp, Homo sapiens
actcggtgtggaaggcaaaggccccaggtgtggggagccccgagccgtcgcgggagcagggccggcggcgcagcaccagcaggctctggagcagccgcacrgagttgagcgcagctgtctcgcggcccgtccgtgcatcgatacagcctctgcacaggcactcggcgaaggccagcttctgtggatagcggtcctcatccg

SEQ ID NO: 20975 - DNA, 201 bp, Homo sapiens
gcagggcacggccagccgcaagcagcagctcagccgtccaggtcaggagggccggagggagggagctcaggtggccacgcccacttgacaggtgagaaccrccaaggcccagagagctctccgggcagtcagggccccgccaggggaggggcagccccacgccacagcggaatccccaggtcctcaccggtatctccaggg

SEQ ID NO: 20976 - DNA, 201 bp, Homo sapiens
ggagcctcccttccacttcatcacccagccccacttctgcaggagctcaggtgacgggcccagaatttccccaggggaccctggccacctaggacagtggsaggcagggcacggccagccgcaagcagcagctcagccgtccaggtcaggagggccggagggagggagctcaggtggccacgcccacttgacaggtgagaa

SEQ ID NO: 20977 - DNA, 201 bp, Homo sapiens
cagtaccgtgggcatgcgggccagtgtggagaccagccccctgcttcgggtaaggccaggagcgggtggtcccggggccctgggagtcacgcttgtgcccrgctctgccctcagcctctgtctgggcccgagtgttctcacacctgcggcagccccgccaagaccacgtgcaggagccaaatgcagagatggggctcgagc

SEQ ID NO: 20978 - DNA, 201 bp, Homo sapiens
cttcccctcacttgtgcggaggctgtggctggctgcacacacacctgcccacaggtcctcaccaccaccccagcccggtgcccccaaagctttgcccggcrtcagccacgtcccccacctttgggctctcgccaaggcacccactcccctgaggccggagaagcccttgcctgctgcttgtccacctgctctcccagcaac

SEQ ID NO: 20979 - DNA, 201 bp, Homo sapiens
aggctgcggcggcggcggggggacccccgggaggtccccaggtcaaccccatcccggtgaccgacgaggtcgtgtgacctcgccccggacctgccctcccrccaggtgcacccacctgcaataaatgcagcgaagccgggagcgcgtgagcctctgcctggggccggtgggcggggctggggtagcgatggttcccgaggc

SEQ ID NO: 20980 - DNA, 201 bp, Homo sapiens
agggcagaggcaccactgcagcagctccaggaaggacctgcaccgggggaggagtgcctgggaagggcctgggggctgagggtgaggaggaggggcccgcygccaccactcccctggggctctgagcgccctccctgttgtctggagggtgcgtggcagctggagtgggagcagagacctcagggtgggagggctggagga

SEQ ID NO: 20981 - DNA, 201 bp, Homo sapiens; identical to SEQ ID NO: 2236

SEQ ID NO: 20982 - DNA, 201 bp, Homo sapiens
cagtgtggcgggcgtgtttgtgtgcctgctggagtacccccgggggaagaggaagaagggctccaccatggagcgctggtgagtctcctcctgctctgggktctctccgggggttgcggggcccaggcagggctcacagggttgggtggagcttggtttctcacttggaggctccggaaccaaccctttggtgcttgtggg

SEQ ID NO: 20983 - DNA, 201 bp, Homo sapiens
ctgtggcccctcaggctgagctgggctgttccttaaccacatggcttcagtgtggcgggcgtgtttgtgtgcctgctggagtacccccgggggaagaggamgaagggctccaccatggagcgctggtgagtctcctcctgctctggggtctctccgggggttgcggggcccaggcagggctcacagggttgggtggagctt

SEQ ID NO: 20984 - DNA, 201 bp, Homo sapiens; identical to SEQ ID NO: 2219

SEQ ID NO: 20985 - DNA, 201 bp, Homo sapiens
cccgggaggtccccaggtcaaccccatcccggtgaccgacgaggtcgtgtgacctcgccccggacctgccctcccgccaggtgcacccacctgcaataaaygcagcgaagccgggagcgcgtgagcctctgcctggggccggtgggcggggctggggtagcgatggttcccgaggcctgggcaggcaccccgtttcctgcc

SEQ ID NO: 20986 - DNA, 201 bp, Homo sapiens
gtaggtagagaaggggggtggcccaggcccccgggacaggagccccacagtgcctgacccacttctccccgcagtcctcatcaccgggggcatcgtggccrcagctgggcgcttcacccagtggtactttggtgcctactccatgtatccttccacctgaggctggggtgggcggggaacgcccagggcagagctggggag

SEQ ID NO: 20987 - DNA, 201 bp, Homo sapiens
acaaaaacagaatggctggcagggcaaggtggctacacctgtaatcctagcactttgggaggccaaggcgggcggatcacgaggtcaggagatcgagaccrtcctggctaacacagtgaaaccccgtctctactaaaaatacaaaaaattagccgggtatggtggcaggcgcgcatagtcccagctactcgggaggctgag

SEQ ID NO: 20988 - DNA, 201 bp, Homo sapiens
acaaaggtaagcatggatgtctcacttattgggatacttgagagactgtgttgactgtgaaaaaagacagcacaaaaacttaaatgcttttattttaatgyaattttgctactcttaagtatatacaataataaacattaaccccacaaacattatcacaaactgaatccataaatcctgaattatactctctgttatact

SEQ ID NO: 20989 - DNA, 201 bp, Homo sapiens
cttcctccttagggaaataaaaataataggatttcccacatgacagtagaaaactaaaatgtatgtatgtgattccacaaatttcttcgttctccataatrttatttttttccatgtttataaaatttaaaagtatggaagtattatatagttatgaaagataactaatcctgattccctgtctctaggattcttcttttt

SEQ ID NO: 20990 - DNA, 201 bp, Homo sapiens; identical to SEQ ID NO: 2268

SEQ ID NO: 20991 - DNA, 201 bp, Homo sapiens; identical to SEQ ID NO: 2269

SEQ ID NO: 20992 - DNA, 201 bp, Homo sapiens
tgctaacagaaccggcttcagctgaagaaagagaggaatgaagcgccttctgcttctgtttttgttctttataacattttcttctgcatttcccttagtcyggatgatggaaaatgaagaaaatgtgcaactggctcaggtactgtcttaataaatgatatcgatgactattgataaaaagcttattttattgattctctt

SEQ ID NO: 20993 - DNA, 201 bp, Homo sapiens
ttatggcaagtgtccctttctgttattaattaaatgatgatacaagccaattcatgccacgtctcactattattttctaaattctgtgctaacagaaccgkcttcagctgaagaaagagaggaatgaagcgccttctgcttctgtttttgttctttataacattttcttctgcatttcccttagtccggatgatggaaaat

SEQ ID NO: 20994 - DNA, 201 bp, Homo sapiens
gcctgaacaattggcaactggtcacatgcgtcacttacaataagtacttgatgtagttaatgcgcagtaaatgtgagccatcattattataattagatatrctaagcaatttattctaaagtaaaaacaattgggaaaactaaaaattaagctcagagtttctcaaaattggaaaaaaatatgggccaattctttctgtcc

SEQ ID NO: 20995 - DNA, 201 bp, Homo sapiens; identical to SEQ ID NO: 2274

SEQ ID NO: 20996 - DNA, 201 bp, Homo sapiens
caggtgtggggtgcctgatgtgggccagtatggctacaccctccctgggtggagaaaatacaacctcacctacaggtaatgcttctgccagcttatttccrcctaatccaaaggaacataaagataatttccaaggaacagaataatattcattcaattgactgagcacttcctgtgtgcacagcacatcttaggctccat

SEQ ID NO: 20997 - DNA, 201 bp, Homo sapiens
cacttcctgtgtgcacagcacatcttaggctccatttacggtatcttcccaacaaacctgtgctgtaggctctgctgctaccaccatcttaaatacagagraactgaaacaaaagtttatttaccgtggctgaggttacacagctcttactggctccagcagacatgctctcatctctagcctctgccaccatcatataag

SEQ ID NO: 20998 - DNA, 201 bp, Homo sapiens
aattgcactcatttttgcttatgggcagttactttttcctggatatatattcttaaaaattgacctgtaggagaggacaagattcaactataaaaataatyctatttcaaattcagtggaaaatctaaaaacacagttttcaaagcatatatgttgaatattagaattatattaaagatttataactcaaaaagtaggtga

SEQ ID NO: 20999 - DNA, 201 bp, Homo sapiens
ttatctcaggagatttgaggaagctgatcttttttcctcgcataaattgtatctcagtccatggtcggtgtcctcgctattttgatggtcccttgggagtkcttggccatgcctttcctcctggtccgggtctgggtggtgacactcattttgatgaggatgaaaactggaccaaggatggagcaggtgagtctaattttc

SEQ ID NO: 21000 - DNA, 201 bp, Homo sapiens
ttttgttaatttttaagaataataaactatactccggatatggcacgagctgctgtggatgaggctatccaagaaggtttagaagtgtggagcaaagtcaytccactaaaattcaccaagatttcaaaggggattgcagacatcatgattgcctttaggactcgaggtaaggttttcaacagagagcaaagctatttttat

SEQ ID NO: 21001 - DNA, 201 bp, Homo sapiens
tttctgagacaccggtttcaagccattttcttaccctaggctatatttttccatgatgtgactagtaccaattaaagttatgtgccatttaatcatatttkggtcaactatggactatggatatgacagtggtcccattcgattatgatggagctgaaaatttcctatcacctagtgatgtcacagcacaacacattactc

SEQ ID NO: 21002 - DNA, 201 bp, Homo sapiens
tgtgccctttttccctgatcatttcttgtttggaagattctataaatgattcaaccaaacataatctttactgtatttttattattgatccaattagttttcctctactatgcctatgtattccccacatccctgcttgactctaagttgtgcggtagacaaattaagctccccaaaccaaagatccgctggtatcctttc

SEQ ID NO: 21003 - DNA, 201 bp, Homo sapiens
gtagaccatgaccatatttttatagcaaaataccaagacatacaccattgacaaagatataggggcaaaaggaaagaatatttgaaattggactcctttcwcccatgaatatatcgcgttacaatcacatgttatcaccaccattctctgaccagcagaggccaagagctacccaccatgaatgtcacagaggagtggcct

SEQ ID NO: 21004 - DNA, 201 bp, Homo sapiens
tgtatataggacacagaagctgccctccagggcttcacagtctaagggacacatagacaattaaatggcaactaaaatcagtaggatcagtactgagatamaggaaactatggcaatgtaataggtcctcacagaagaaagtccaacccagacccacaggtcagcagaggaagctatgtcaagcctgagaactggaggctc

SEQ ID NO: 21005 - DNA, 201 bp, Homo sapiens
gaagattgcgtgaggccagaagttcaagactagcccagccaacatagcaagaccctatttctatataaaacatataattaaataaaattttttttccaggygtggtggctcacacctgtaatcccagcactttgggaagctgaggtgggcggatcatgaggtcaggagattgcgaccatcctggctaacatggtgaaaccc

SEQ ID NO: 21006 - DNA, 201 bp, Homo sapiens
agtatttcatttaaataaagtgctaatgcaactgtaagataattgcaccacaccaaagttactgcagcacattattgataagctagaaatgttttttgtarttatgtgtgtatattcatgcatgaataagccagaaattgacatatttttgttaatttttaagaataataaactatactccggatatggcacgagctgctg

SEQ ID NO: 21007 - DNA, 201 bp, Homo sapiens
ttaacatttaaaacctttgctttcaaaaaacaatattgaaagaataaaaagttggctgggcacagtggctcctgcctgtaatcccagcactttgggaggcyaagacaggaagattgcgtgaggccagaagttcaagactagcccagccaacatagcaagaccctatttctatataaaacatataattaaataaaatttttt

SEQ ID NO: 21008 - DNA, 201 bp, Homo sapiens
ttcctccttagggaaataaaaataataggatttcccacatgacagtagaaaactaaaatgtatgtatgtgattccacaaatttcttcgttctccataatgytatttttttccatgtttataaaatttaaaagtatggaagtattatatagttatgaaagataactaatcctgattccctgtctctaggattcttctttttc

SEQ ID NO: 21009 - DNA, 201 bp, Homo sapiens
tcctggtccgggtctgggtggtgacactcattttgatgaggatgaaaactggaccaaggatggagcaggtgagtctaattttctttatgaacaaaatcttrttattctaaagaatccctgaaaagaatagctttgtaactagctgctttttaactgtaaagttcccaatgtccccacaattttccatattccaagatgacc

SEQ ID NO: 21010 - DNA, 201 bp, Homo sapiens
ttatgctaattatctcaattatttgaggaagataccaaccaattagctaaaaggcaagcctaagattacaaaattctcattgacatggaaataggctgcawgtgtaaagtgttttttgtttaacacaggcacctatggaggatctattatgatatcacggatgttgagtttgaattaattgcttcattctggccatctctg

SEQ ID NO: 21011 - DNA, 201 bp, Homo sapiens
catggatgtctcacttattgggatacttgagagactgtgttgactgtgaaaaaagacagcacaaaaacttaaatgcttttattttaatgcaattttgctaytcttaagtatatacaataataaacattaaccccacaaacattatcacaaactgaatccataaatcctgaattatactctctgttatactatctcaaatct

SEQ ID NO: 21012 - DNA, 201 bp, Homo sapiens
aaccaattagctaaaaggcaagcctaagattacaaaattctcattgacatggaaataggctgcatgtgtaaagtgttttttgtttaacacaggcacctatkgaggatctattatgatatcacggatgttgagtttgaattaattgcttcattctggccatctctgccagctgatctgcaagctgcatacgagaaccccaga

SEQ ID NO: 21013 - DNA, 201 bp, Homo sapiens
acaggcacctatggaggatctattatgatatcacggatgttgagtttgaattaattgcttcattctggccatctctgccagctgatctgcaagctgcataygagaaccccagagataagattctggtttttaaaggtaacctggcccatcccgattcctcttctccctctggctgcctgaactaaccagtggatattttgg

SEQ ID NO: 21014 - DNA, 201 bp, Homo sapiens
taaagaaagtggtaggaatgaatgtggacataagattattaaatctctaagcactgaagctaaaaggaactaggtatctaatgatttttaaatttcttgasatacctatttctccctctagaaaataaataatcactcctctcttcctagatgaaaacttctggatgatcagaggatatgctgtcttgccagattatccca

SEQ ID NO: 21015 - DNA, 201 bp, Homo sapiens
tagcattgcaatacctcccagataaatggtggtacatatgagaattatctgctgtatagcaagcctttatttcattccccttagttactttctaatctcasatgcagccattctctttttgattaagtcatgtgctcgtgttttccctgttattatcaaggattcaacttgtttcttgtggctgctcatgaatttggtcat

SEQ ID NO: 21016 - DNA, 201 bp, Homo sapiens
ggaatgaatgtggacataagattattaaatctctaagcactgaagctaaaaggaactaggtatctaatgatttttaaatttcttgagatacctatttctcyctctagaaaataaataatcactcctctcttcctagatgaaaacttctggatgatcagaggatatgctgtcttgccagattatcccaaatccatccataca

SEQ ID NO: 21017 - DNA, 201 bp, Homo sapiens
ggacttgaaggagcgaaaggttagggcagagagatgctttttcgttacaacaagatagcaccatttgacttccctttttctggtaactctatttttttttwaattttgttctgaaatattttagagtttaaaaaacacaaaagaacaatacaatgagcatacttgtacttagcatacttgtacttaataccattataacac

SEQ ID NO: 21018 - DNA, 201 bp, Homo sapiens
atctctaagcactgaagctaaaaggaactaggtatctaatgatttttaaatttcttgagatacctatttctccctctagaaaataaataatcactcctctyttcctagatgaaaacttctggatgatcagaggatatgctgtcttgccagattatcccaaatccatccatacattaggttttccaggacgtgtgaagaaaa

SEQ ID NO: 21019 - DNA, 201 bp, Homo sapiens
ttggggagcaggacttgaaggagcgaaaggttagggcagagagatgctttttcgttacaacaagatagcaccatttgacttccctttttctggtaactctrtttttttttaaattttgttctgaaatattttagagtttaaaaaacacaaaagaacaatacaatgagcatacttgtacttagcatacttgtacttaatacc

SEQ ID NO: 21020 - DNA, 201 bp, Homo sapiens
tgttgcccaggctgggaactcctgggctcaagtgatccgcccacctcagcctccaaagtgctggggttacaagcatgagccaccgcccctgccatcccctyatttttttaaaaaaattaatgaatgtttatattttaaattatttatttatttatttttagaaagagtcttattctgttacccaggctggaatgcagtggt

SEQ ID NO: 21021 - DNA, 201 bp, Homo sapiens
ggcatgaaaatgagtgtcttatcttctcagaacacctgctagttgtgctggctatgatagactcttggctcaaacctcatctatacatctttgagatgagractgatctcatactattttttaaccacatttgacagagtcatagacagtgaactgtaatatgaagtgtaataaagaattcagagttattccttttaaaaa

SEQ ID NO: 21022 - DNA, 201 bp, Homo sapiens
gctatgatagactcttggctcaaacctcatctatacatctttgagatgagaactgatctcatactattttttaaccacatttgacagagtcatagacagtraactgtaatatgaagtgtaataaagaattcagagttattccttttaaaaaaattatcttgttgacaacatgtagtattttccagctattacattgatatt

SEQ ID NO: 21023 - DNA, 201 bp, Homo sapiens
ccaccgcccctgccatcccctcatttttttaaaaaaattaatgaatgtttatattttaaattatttatttatttatttttagaaagagtcttattctgttrcccaggctggaatgcagtggtgcgatcttggctcactgcaaccttcgcctcccaggttcaagagattctgccatctcagcctccccagtagctgggatta

SEQ ID NO: 21024 - DNA, 201 bp, Homo sapiens
acttgtacttagcatacttgtacttaataccattataacacaaatcctgatcatgtctgccttctccccttcatcccattgctccagaggccaattaaacwatttaaactatatacatatattaaaacagtaaataataatatttctgaaacaagatttataactgggatgagctttaaatgcaaaggaagtatgtatcta

SEQ ID NO: 21025 - DNA, 201 bp, Homo sapiens
aagaaagagaggaatgaagcgccttctgcttctgtttttgttctttataacattttcttctgcatttcccttagtccggatgatggaaaatgaagaaaatrtgcaactggctcaggtactgtcttaataaatgatatcgatgactattgataaaaagcttattttattgattctcttgggacctaaaaagaaaacacattc

SEQ ID NO: 21026 - DNA, 201 bp, Homo sapiens
tttgtcatcttttacctacagcgtcatatggccaataacagtgttgtcacatgagaaatactctacaaatcattggtaaataaagtcactcaatggtcatktattgaacatccactatgactaaggctctgtcataaaaatgaaatatacccttgtatataggacacagaagctgccctccagggcttcacagtctaaggg

SEQ ID NO: 21027 - DNA, 201 bp, Homo sapiens
tgaaaaatgccagcgatttaacatagttagcttgcagaatatgaaaataaaatataaggctgaaaataggcagggactagaccatggaaggtcatgtgaakgtgtttggactttatcctatagcaatacagaacctctgaagaatagaagtaggagcaacatgatcacatatactgtagtctagcaacaaccccaaactgg

SEQ ID NO: 21028 - DNA, 201 bp, Homo sapiens
agaagacaaagtagggtgaagagggtgaataggagtgttctgaacagaatagctcaatccaacataaggaatagaattgtagaagacaaggctaaaatggygaataggattcagattacagagggtcttgaaagccagaataaagatctggacttcatttagaaaatctgagcttgaattatttttcccaacagtcatttt

SEQ ID NO: 21029 - DNA, 201 bp, Homo sapiens
gttacgttagaggttattctctgacaagtaaggaactagcagaagtaggagagaagtgttcccccagcctcacaaacattgaccaacgccgttaaacattycttagggaatataaaattaagttttctgcacactgatttcagacacaagaaatgtgaggattttcatcctgtgtttgtggtatatgtgcatcatctgagc

SEQ ID NO: 21030 - DNA, 201 bp, Homo sapiens
ctcccgagtagctgagactacaggtgcacgccaccacacccagctaatttttgtatttttagtagagacggggtttcaccatgttggtcaagatggtctcratctcttgacctcgtgatctgcccacctcggcctcccaaagtgcttggattacaggtgtgagccaccacacccagcaagatttttcaatatcattagtca

SEQ ID NO: 21031 - DNA, 201 bp, Homo sapiens
aaaattactttttctctgccttcctccttctttctgcctgtaatgcagatgtaatggctagaggttgagaaggcagctgactcatgaggcattgtactgasagagtggtgtagcaaggtagatgttgcctacccttgatgatatggagctgtcaaacaaaccctaggcttccaaatctgggcacttttttttaatgtgagg

SEQ ID NO: 21032 - DNA, 201 bp, Homo sapiens
ccttgtccctacaaaaaaataaaaataaaaatattagctgggcatggtggcatgcaactatagtcccagctactcgggaggctgtggcaggaggatcactmgaacccaggagtttgaggctgcagtgagtcatgactgtgtcaccgcattcgagcttgggtgacagagtatgccttcttttgtttatttaaacaaacaaat

SEQ ID NO: 21033 - DNA, 201 bp, Homo sapiens
  misc_feature (1)...(201): n = A,T,C or G, or insertion/deletion polymorphism (see Tables 1-2)
atgcaactatagtcccagctactcgggaggctgtggcaggaggatcactcgaacccaggagtttgaggctgcagtgagtcatgactgtgtcaccgcattcnagcttgggtgacagagtatgccttcttttgtttatttaaacaaacaaataaataaatataagaattaaatataagaatataattttggatgtaaaatatg

SEQ ID NO: 21034 - DNA, 201 bp, Homo sapiens
aaatatccacttaggtaagacccttgtgtaggcatatttcttcatgccctcttaattcattgtggtattttttttctcatcaaaggaggtctgcctaaggwacctgctaagccaaaggaacccactataccccatgcctgtgaccctgacttgacttttgacgctatcacaactttccgcagagaagtaatgttctttaaa

SEQ ID NO: 21035 - DNA, 201 bp, Homo sapiens
tcttctgaccactttatttcagtccctcagagtagaaattgtgggccctctgtgatccaattgtataactcttagttcactgacattaaaggggaaaataycttcctcttctccaatggaaacataaaatatcaagcaaacgtaatctccaacaaaattgcaatttttaaaaaataggcaattcagcaataacctatatga

SEQ ID NO: 21036 - DNA, 201 bp, Homo sapiens
taggacactataaatttcagataaacaacaaataattttttggtatatatatatatcccttaaaatattttgtatttatttataccaaaagttagtcattstttacttgaaatcaaatttaactgacattttctgtttaatgatcatgatcttatcagattactagcctttgagagcacttgggggctgaaacttaggaga

SEQ ID NO: 21037 - DNA, 201 bp, Homo sapiens
cactctacagcctttctgatagttcttctttcatcttactgagtgctaggacttgagataaaaatgaatttagcaagataggcaacataaacgagaaaaawcttttcctgagcaattcttgtggttctcatgtaagattcttaatatatggactgggtgtggtggctcatgcctgtaatcccagcactttgggaggctgag

SEQ ID NO: 21038 - DNA, 201 bp, Homo sapiens
cccagtatattcaattcagtaataagcactaactgtgtttactaaacaattgcaggccaagattacaaaatcagctcagtcaaaaaaaaaaaaaaaaaaaagcaaatcatgacacactttatggcaagtgtccctttctgttattaattaaatgatgatacaagccaattcatgccacgtctcactattattttctaaatt

SEQ ID NO: 21039 - DNA, 201 bp, Homo sapiens
gcaatagttaccttgggtctggtgtctagcttccagagtcacaggaaagcacaggttgtagtggtcctgatggatagtatacaaggacacagatcattccygaccatgtatctccagataatcggtctagatcagctttgcactttctgtgaaactaaaagtctgtcacacaaaatggtccatggccactcactgctcagt

SEQ ID NO: 21040 - DNA, 201 bp, Homo sapiens
tggtgccatctctgctcaccgcaacctccacctcccaggttcaagtgattcttgtgcctcagcctcttgagtagctggaattacaggtgtacaccaccacrcctaatttttgtattttcagtggagacgaggttttgccatgttggccaggctggtctcgaattcctgacctcaagtgatccactcatctaggcctcccaa

SEQ ID NO: 21041 - DNA, 201 bp, Homo sapiens
aaggatggagcaggtgagtctaattttctttatgaacaaaatcttattattctaaagaatccctgaaaagaatagctttgtaactagctgctttttaactvtaaagttcccaatgtccccacaattttccatattccaagatgaccttgatggaagtgttcaatacaccctcataaagtggctacttctactatgatcaga

SEQ ID NO: 21042 - DNA, 201 bp, Homo sapiens
aaattagctgggcctggtggcacgcgcctgtagtcccagctactcaggaggctgaggcatgagaatcacttgaacctgggaggcagaggttgcagtgagcygaggtcgcgccactgcactccagcctgggggacagagcgagactctgtctcaaaaaaaaaaaagttcttaatatatggtacatgcacaagactgatttct

SEQ ID NO: 21043 - DNA, 201 bp, Homo sapiens
gtaactagctgctttttaactgtaaagttcccaatgtccccacaattttccatattccaagatgaccttgatggaagtgttcaatacaccctcataaagtkgctacttctactatgatcagagcagtcttcattatttatacattcattcatacacccataatgtctgaggggccactgtgtgcccggaactatacaaggt

SEQ ID NO: 21044 - DNA, 201 bp, Homo sapiens
taaacataaagataaaaagctataaaaataatttaaagaagttacctttggggagcaggacttgaaggagcgaaaggttagggcagagagatgctttttcrttacaacaagatagcaccatttgacttccctttttctggtaactctatttttttttaaattttgttctgaaatattttagagtttaaaaaacacaaaaga

SEQ ID NO: 21045 - DNA, 201 bp, Homo sapiens
ctcactgcaacctctgcctcctgggttcaagcaattctcctgtctcagcctcccgagtagctgagactacaggtgcacgccaccacacccagctaattttkgtatttttagtagagacggggtttcaccatgttggtcaagatggtctcgatctcttgacctcgtgatctgcccacctcggcctcccaaagtgcttggatt

SEQ ID NO: 21046 - DNA, 201 bp, Homo sapiens
cataaagataaaaagctataaaaataatttaaagaagttacctttggggagcaggacttgaaggagcgaaaggttagggcagagagatgctttttcgttayaacaagatagcaccatttgacttccctttttctggtaactctatttttttttaaattttgttctgaaatattttagagtttaaaaaacacaaaagaacaa

SEQ ID NO: 21047 - DNA, 201 bp, Homo sapiens
agtacatgaaaagatttttcttttttttttttggagatggagtctctctccgttgcccaggctggaatgcagtggcgcgatctcagctcactgcaacctckgcctcctgggttcaagcaattctcctgtctcagcctcccgagtagctgagactacaggtgcacgccaccacacccagctaatttttgtatttttagtaga

SEQ ID NO: 21048 - DNA, 201 bp, Homo sapiens
aaaaaaaagcaaatcatgacacactttatggcaagtgtccctttctgttattaattaaatgatgatacaagccaattcatgccacgtctcactattatttkctaaattctgtgctaacagaaccggcttcagctgaagaaagagaggaatgaagcgccttctgcttctgtttttgttctttataacattttcttctgcatt

SEQ ID NO: 21049 - DNA, 201 bp, Homo sapiens
agaaccggcttcagctgaagaaagagaggaatgaagcgccttctgcttctgtttttgttctttataacattttcttctgcatttcccttagtccggatgayggaaaatgaagaaaatgtgcaactggctcaggtactgtcttaataaatgatatcgatgactattgataaaaagcttattttattgattctcttgggacct

SEQ ID NO: 21050 - DNA, 201 bp, Homo sapiens
gcttatttccgcctaatccaaaggaacataaagataatttccaaggaacagaataatattcattcaattgactgagcacttcctgtgtgcacagcacatcwtaggctccatttacggtatcttcccaacaaacctgtgctgtaggctctgctgctaccaccatcttaaatacagagaaactgaaacaaaagtttatttacc

SEQ ID NO: 21051 - DNA, 201 bp, Homo sapiens
ttcaattgactgagcacttcctgtgtgcacagcacatcttaggctccatttacggtatcttcccaacaaacctgtgctgtaggctctgctgctaccaccaycttaaatacagagaaactgaaacaaaagtttatttaccgtggctgaggttacacagctcttactggctccagcagacatgctctcatctctagcctctgc

SEQ ID NO: 21052 - DNA, 201 bp, Homo sapiens
aaagacctacatcaagagcataactataaaatttataaatatctaggtaaagagaagatttccaaaacctttcaaaagaaaaacatcaagaatcagagtawaaaacttttcaacagcagcactagagtctggaaaataatggaatcttcattatccttcaaagttctcaggcaaatttattttagactgaaattctgtatc

SEQ ID NO: 21053 - DNA, 201 bp, Homo sapiens
ttagttatgaattatgtattattaattatttagtaatttatttaaataaataaataagacatattttatgtccaaaaacactaatgaaatgcaaaaaaaaagcttaaaaatgtaaaagaatactcagaactggaaagagttcttggaaattaaatgtcttagctgaaattaacaatcggtgggctggaaagttaagttggt

SEQ ID NO: 21054 - DNA, 201 bp, Homo sapiens
ctttctgtcctatatcatacacttacagaaacagactagctggaacaacaaacataattgacacttggcttgtcccttctggttttcttaagggcctgcgrttacgtctcaaaagaaagaaacagctttaaaaacaagcatgaacaagacagtgctggcaatagttattcattttggagatttgaacagctgaggtggaaa

SEQ ID NO: 21055 - DNA, 201 bp, Homo sapiens
agtgctcatccctatgcatgttctgaacccatcaatcaagtaagttactccacctcccaaagagaagggtgacagcctggatagatgcagggtgagttacrttagaggttattctctgacaagtaaggaactagcagaagtaggagagaagtgttcccccagcctcacaaacattgaccaacgccgttaaacattccttag

SEQ ID NO: 21056 - DNA, 201 bp, Homo sapiens
tactcgggaggctgtggcaggaggatcactcgaacccaggagtttgaggctgcagtgagtcatgactgtgtcaccgcattcgagcttgggtgacagagtaygccttcttttgtttatttaaacaaacaaataaataaatataagaattaaatataagaatataattttggatgtaaaatatgtcttatttatttaataatt

SEQ ID NO: 21057 - DNA, 201 bp, Homo sapiens
gcatgagccactgcacacaacctcagttttttttaatgcccaaaatattcaccatatgagtagtaaattagtacatgaaaagatttttctttttttttttkggagatggagtctctctccgttgcccaggctggaatgcagtggcgcgatctcagctcactgcaacctctgcctcctgggttcaagcaattctcctgtctc

SEQ ID NO: 21058 - DNA, 201 bp, Homo sapiens
ggaactcctgggctcaagtgatccgcccacctcagcctccaaagtgctggggttacaagcatgagccaccgcccctgccatcccctcatttttttaaaaamattaatgaatgtttatattttaaattatttatttatttatttttagaaagagtcttattctgttacccaggctggaatgcagtggtgcgatcttggctca

SEQ ID NO: 21059 - DNA, 201 bp, Homo sapiens
ggggggctgaggcaggagaatcgcttgaaccagggaggtggaggttgcagtgagccaagatcgcgtaactgcattccagcctcatgacagagtgagactccatctcaaaaacaaaacaaaacaaaacaaaacaaaacaaaacaaaaaactgctgggctgggcgcagtggctcatgcctgtaatcctagcactttgggaagc

SEQ ID NO: 21060 - DNA, 201 bp, Homo sapiens
tagatgcagggtgagttacgttagaggttattctctgacaagtaaggaactagcagaagtaggagagaagtgttcccccagcctcacaaacattgaccaamgccgttaaacattccttagggaatataaaattaagttttctgcacactgatttcagacacaagaaatgtgaggattttcatcctgtgtttgtggtatatg

SEQ ID NO: 21061 - DNA, 201 bp, Homo sapiens
aatttttgtactttttgtagagatggagtttcaccatgattctcagtctggtctcgaactcctgggctcaagcgatccacccacctcggcctctcaaagtrctgggattacaggcatgagtcgccacgcccagcccatagtcttcttaaagtgaataatgaaggcagtggatgacatttatcaagccgaaagagatctcaa

SEQ ID NO: 21062 - DNA, 201 bp, Homo sapiens
gattgctttagcccggagttcaagatcagcctgggcaacatagtgagacccccatctctacaaaaataaataagaaaattagctggacatggtggcatgcwcctgtagtcccagctgcacaggaggctgagggaggaggattgtccaagcctaggagtttgaagctgcagtgagctgtaatcacaccactccagcctgggc

SEQ ID NO: 21063 - DNA, 201 bp, Homo sapiens
actgaactgaactcacaatcacctaaatttactggggaaaattatgctaattatctcaattatttgaggaagataccaaccaattagctaaaaggcaagcytaagattacaaaattctcattgacatggaaataggctgcatgtgtaaagtgttttttgtttaacacaggcacctatggaggatctattatgatatcacgg

SEQ ID NO: 21064 - DNA, 201 bp, Homo sapiens
gtagcttaagtgtctagtgtttatatagtctacataatgtactgtaagtcctaggccttcacattcactcaccactcactcactgactcacccagagcaayttccagtcctgcaagctccattcatggtaagtgtcctacatagctgtactattttttatcttttataccatatttttactgtaccttctccatgttcaga

SEQ ID NO: 21065 - DNA, 201 bp, Homo sapiens
gtaatcacaccactccagcctgggcaacagagcaagaccctgcctcaaaaaaaaaatttataaagtaaaaaagttactgtaagcaaaagttaatttattaytgaagaaaaatatttttaatttggtgtagcttaagtgtctagtgtttatatagtctacataatgtactgtaagtcctaggccttcacattcactcaccac

SEQ ID NO: 21066 - DNA, 201 bp, Homo sapiens
ggagtttgaagctgcagtgagctgtaatcacaccactccagcctgggcaacagagcaagaccctgcctcaaaaaaaaaatttataaagtaaaaaagttacwgtaagcaaaagttaatttattattgaagaaaaatatttttaatttggtgtagcttaagtgtctagtgtttatatagtctacataatgtactgtaagtcct

SEQ ID NO: 21067 - DNA, 201 bp, Homo sapiens
ttgcccctgaagactttccagtgggacaagatgtggaggtggaagacagtaatacggatgaccctgatcaaaggaaggaaatatttttgtacagctgtacracaagtttgtgttttaagctaagtcacaataaagtccaaaattttaaaaatttaaaagtttaggccaggtatggtggctcacacctgtaatcccagcact

SEQ ID NO: 21068 - DNA, 201 bp, Homo sapiens
caagtcaagtaattttcttactctctatttctttgcctgtaaaagagtaatgatgctcttcttttaggagggtgaaataaattacccttaccctaactagrttaataaaggtgaaaacccctttcagagcagttgtccatagtgaacactcagaaagtgcttgacatcaaagattctgttgacaattgttagtattgatga

SEQ ID NO: 21069 - DNA, 201 bp, Homo sapiens
tattccaagatgaccttgatggaagtgttcaatacaccctcataaagtggctacttctactatgatcagagcagtcttcattatttatacattcattcatrcacccataatgtctgaggggccactgtgtgcccggaactatacaaggtgtcctatggaccccaaagttgtactagaaaagtgtaagccttcagaggttca

SEQ ID NO: 21070 - DNA, 201 bp, Homo sapiens
agacttttgtcatcttttacctacagcgtcatatggccaataacagtgttgtcacatgagaaatactctacaaatcattggtaaataaagtcactcaatgrtcatttattgaacatccactatgactaaggctctgtcataaaaatgaaatatacccttgtatataggacacagaagctgccctccagggcttcacagtct

SEQ ID NO: 21071 - DNA, 201 bp, Homo sapiens
tataaaacttgcaaaaaatattttttaaaaaaattttgggactttggactaagcaaagatttcttaggtagaacataaaaactattaaccattaaaaaatsaatgaattaaactttaacatttaaaacctttgctttcaaaaaacaatattgaaagaataaaaagttggctgggcacagtggctcctgcctgtaatcccag

SEQ ID NO: 21072 - DNA, 201 bp, Homo sapiens
aagttaagtgcttagcaaagctcttaacaaaatttttgacccagaaaatgggagattatcagtggaacttgcttctgatgaggtgatatattgggcattaygtcaactgatagaaaataggcatagaaaatcacacaaattcctacagttggtccccacccccacttccctggagttcagtgttcccagttgcctaaaaga

SEQ ID NO: 21073 - DNA, 201 bp, Homo sapiens
gtcatatggccaataacagtgttgtcacatgagaaatactctacaaatcattggtaaataaagtcactcaatggtcatttattgaacatccactatgactmaggctctgtcataaaaatgaaatatacccttgtatataggacacagaagctgccctccagggcttcacagtctaagggacacatagacaattaaatggca

SEQ ID NO: 21074 - DNA, 201 bp, Homo sapiens
gttagaggttattctctgacaagtaaggaactagcagaagtaggagagaagtgttcccccagcctcacaaacattgaccaacgccgttaaacattccttarggaatataaaattaagttttctgcacactgatttcagacacaagaaatgtgaggattttcatcctgtgtttgtggtatatgtgcatcatctgagcctatg

SEQ ID NO: 21075 - DNA, 201 bp, Homo sapiens
aatggtcatttattgaacatccactatgactaaggctctgtcataaaaatgaaatatacccttgtatataggacacagaagctgccctccagggcttcacwgtctaagggacacatagacaattaaatggcaactaaaatcagtaggatcagtactgagataaaggaaactatggcaatgtaataggtcctcacagaagaa

SEQ ID NO: 21076 - DNA, 201 bp, Homo sapiens
aagataaaataaaaagttggtgatcccaaccaaattgccaatgacacaaacatatctagtgaaaaattttgaaagctccaagctcagccttcaatctgatrtaacgatttctctgaatagcatcaatctaacatatgttgtgccctttttccctgatcatttcttgtttggaagattctataaatgattcaaccaaacata

SEQ ID NO: 21077 - DNA, 201 bp, Homo sapiens
ttgaggattgaaagaagactctagggaggtggtaattttgagttagcaattaaaggacagtatatggattcatagcccatagaggctctaattcaaagcaygaacttcctcttctaactcttgcccagctgcaaaggaatcagaccttaatccttatatttgacttatttcttcaaaccaagtaagtttattttatttttc

SEQ ID NO: 21078 - DNA, 201 bp, Homo sapiens
cttaattcattgtggtattttttttctcatcaaaggaggtctgcctaaggaacctgctaagccaaaggaacccactataccccatgcctgtgaccctgacytgacttttgacgctatcacaactttccgcagagaagtaatgttctttaaaggcaggtaaactcatttctctaaacacctcaacttcctatgaagattttt

SEQ ID NO: 21079 - DNA, 201 bp, Homo sapiens
tagtctttacaatctgcactgtgtatttgcccacttgcctcctttttgtcctacattaatttctgtatgtgtctgaattctccaacaagattgcattcacwggggcaggcaaacagtaggaattcaataaacatttgaagtttatcttagttaataagggtaatctgactcctgattcatttgtctttttatgataacatc

SEQ ID NO: 21080 - DNA, 201 bp, Homo sapiens
aattaggaaagcagaaggagtgttaagtccttcttttccataggaagatgttaataataacatttaactttgaaaactcgagaaatagtagcataagcacrttatttacaaatgtggagttaaacataaagataaaaagctataaaaataatttaaagaagttacctttggggagcaggacttgaaggagcgaaaggttag

SEQ ID NO: 21081 - DNA, 201 bp, Homo sapiens
taagtcctaggccttcacattcactcaccactcactcactgactcacccagagcaacttccagtcctgcaagctccattcatggtaagtgtcctacatagmtgtactattttttatcttttataccatatttttactgtaccttctccatgttcagatatgtttagatagacaaatgcttaccattgcgctaaataattgc

SEQ ID NO: 21082 - DNA, 201 bp, Homo sapiens
gataataagcaaccatgttactggtttatgtatttaatgtactatacctcttatggttattttagaatgtactcctacttgtacaaaaaaaaagaaagaargaaagaataggtaactgtaaaacagcctcaggcaggcccttcaggagggattccagaagaaggcatcgttatcctaggagatgacagctccatgcctgtt

SEQ ID NO: 21083 - DNA, 201 bp, Homo sapiens
ttccatcagggaagctgaggttttccttaggctccatgcacttagttgcaaagccagggatggactttatgtatgtatgtatgtatttatttatttatttwttgagaccgggtctcactctgtcacccaggctggagtgcagtggtgcgatctcggctcactacaacctatgcctattggactcaagcaattctcctacct

SEQ ID NO: 21084 - DNA, 201 bp, Homo sapiens
ttgtccatagtgaacactcagaaagtgcttgacatcaaagattctgttgacaattgttagtattgatgatgataatgataactagggtggaattacattcyaggcataaggaaaaatatttgaaaagctatgaatgtataatgcacaaatttgtctatttagtcacatctccatgagacagagacttttgtcatcttttac

SEQ ID NO: 21085 - DNA, 201 bp, Homo sapiens
tgtactcctacttgtacaaaaaaaaagaaagaaagaaagaataggtaactgtaaaacagcctcaggcaggcccttcaggagggattccagaagaaggcatygttatcctaggagatgacagctccatgcctgttattgcccctgaagactttccagtgggacaagatgtggaggtggaagacagtaatacggatgaccctg

SEQ ID NO: 21086 - DNA, 201 bp, Homo sapiens
tatagcaatacagaacctctgaagaatagaagtaggagcaacatgatcacatatactgtagtctagcaacaaccccaaactggtggcttctttttttttttaatattatccatttctgagacaccggtttcaagccattttcttaccctaggctatatttttccatgatgtgactagtaccaattaaagttatgtgccatt

SEQ ID NO: 21087 - DNA, 201 bp, Homo sapiens
tctcactctgtcacccaggctggagtgcagtggtgcgatctcggctcactacaacctatgcctattggactcaagcaattctcctacctcagcctcccaartagcttggactacaggcacaggtcaccttgcctggctaattttttttttctttagtagagacagggtttctccatgttacccaggctgctcttgaactcc

SEQ ID NO: 21088 - DNA, 201 bp, Homo sapiens
ggtctcactctgtcacccaggctggagtgcagtggtgcgatctcggctcactacaacctatgcctattggactcaagcaattctcctacctcagcctcccraatagcttggactacaggcacaggtcaccttgcctggctaattttttttttctttagtagagacagggtttctccatgttacccaggctgctcttgaact

SEQ ID NO: 21089 - DNA, 201 bp, Homo sapiens
atcactaggcaaatttccatcagggaagctgaggttttccttaggctccatgcacttagttgcaaagccagggatggactttatgtatgtatgtatgtatktatttatttattttttgagaccgggtctcactctgtcacccaggctggagtgcagtggtgcgatctcggctcactacaacctatgcctattggactcaag

SEQ ID NO: 21090 - DNA, 201 bp, Homo sapiens
ccttttgtctcttaaatccaatgctaagtagcagttactcttacccatactgctttaagccctctgccaagggggacatgtggggtaagttatttttttttaagtccgatgtatctgggttccacatcggtaaggctcgcttgagcaaggcaagagataaatacagtcctcaaccaagttctgggtgggcaaccaggcagc

SEQ ID NO: 21091 - DNA, 201 bp, Homo sapiens
aaaaatttataaagtaaaaaagttactgtaagcaaaagttaatttattattgaagaaaaatatttttaatttggtgtagcttaagtgtctagtgtttatayagtctacataatgtactgtaagtcctaggccttcacattcactcaccactcactcactgactcacccagagcaacttccagtcctgcaagctccattcat

SEQ ID NO: 21092 - DNA, 201 bp, Homo sapiens
gactccccttgctcagccaggctttactttcatagctagaggcagagatcaaagatttcactatccttttgtctcttaaatccaatgctaagtagcagttmctcttacccatactgctttaagccctctgccaagggggacatgtggggtaagttatttttttttaagtccgatgtatctgggttccacatcggtaaggct

SEQ ID NO: 21093 - DNA, 201 bp, Homo sapiens
agagaggaaaggaatgaaccatgcctgttgtgtatcttctgctgagacatgtttcaatatttctttggtattagtctgaagacactgcgggtgtgtttcaycaaacagttacaggaaatatcctagcacttgccaaaatcagaatgactccccttgctcagccaggctttactttcatagctagaggcagagatcaaagat

SEQ ID NO: 21094 - DNA, 201 bp, Homo sapiens
tttaactcaacctggataagacctggagggataagggaagttacatgaaggaaataactttagaggggagtcctggggaataaataggatagttaagccargagaaagtggaagagatatgttattagcaaagagacaaaggtatgaagacatagagattagaaagaacctgacacagatgaaaaatgccagcgatttaac

SEQ ID NO: 21095 - DNA, 201 bp, Homo sapiens
gctgccattgccacatgacttagcatcacaagcagacaagaaattgaaggaggtaagataacattgtcacccaagcaagagaggaaaggaatgaaccatgyctgttgtgtatcttctgctgagacatgtttcaatatttctttggtattagtctgaagacactgcgggtgtgtttcatcaaacagttacaggaaatatcct

SEQ ID NO: 21096 - DNA, 201 bp, Homo sapiens
aggaaggaaatatttttgtacagctgtacaacaagtttgtgttttaagctaagtcacaataaagtccaaaattttaaaaatttaaaagtttaggccaggtrtggtggctcacacctgtaatcccagcacttcgaaagaccaagccggaggattgctttagcccggagttcaagatcagcctgggcaacatagtgagacccc

SEQ ID NO: 21097 - DNA, 201 bp, Homo sapiens
atgtttcaatatttctttggtattagtctgaagacactgcgggtgtgtttcatcaaacagttacaggaaatatcctagcacttgccaaaatcagaatgackccccttgctcagccaggctttactttcatagctagaggcagagatcaaagatttcactatccttttgtctcttaaatccaatgctaagtagcagttactc

SEQ ID NO: 21098 - DNA, 201 bp, Homo sapiens
agtccaaaattttaaaaatttaaaagtttaggccaggtatggtggctcacacctgtaatcccagcacttcgaaagaccaagccggaggattgctttagccyggagttcaagatcagcctgggcaacatagtgagacccccatctctacaaaaataaataagaaaattagctggacatggtggcatgcacctgtagtcccag

SEQ ID NO: 21099 - DNA, 201 bp, Homo sapiens
tatcaaactgtactatattaacaggtagcaatgtaggcctcaaagaaaagagcaagctcaatagatttttgggtcccccattcttttgttctgtcattggmaatagttaccttgggtctggtgtctagcttccagagtcacaggaaagcacaggttgtagtggtcctgatggatagtatacaaggacacagatcattcctg

SEQ ID NO: 21100 - DNA, 201 bp, Homo sapiens
tataccatatttttactgtaccttctccatgttcagatatgtttagatagacaaatgcttaccattgcgctaaataattgcttaccattgtgctacaattrcctataatattcagtacagtaacgtgcaatacaggtttgtagcctgggagcaagaggctataccatgtaaccttggtgtgtagtgggctgtgccatctag

SEQ ID NO: 21101 - DNA, 201 bp, Homo sapiens
atatcaaactgtactatattaacaggtagcaatgtaggcctcaaagaaaagagcaagctcaatagatttttgggtcccccattcttttgttctgtcattgscaatagttaccttgggtctggtgtctagcttccagagtcacaggaaagcacaggttgtagtggtcctgatggatagtatacaaggacacagatcattcct

SEQ ID NO: 21102 - DNA, 201 bp, Homo sapiens
aacccactataccccatgcctgtgaccctgacttgacttttgacgctatcacaactttccgcagagaagtaatgttctttaaaggcaggtaaactcatttmtctaaacacctcaacttcctatgaagatttttcttttcaagagatttgaggataaagaggtagtcatggggctagtgaaaatgtgtgccttttatcttca

SEQ ID NO: 21103 - DNA, 201 bp, Homo sapiens
ccaagtaagtttattttatttttctcaatgggtctgcctggcattcaaggtgttttactactgttccgacaaaaatatcaaactgtactatattaacaggyagcaatgtaggcctcaaagaaaagagcaagctcaatagatttttgggtcccccattcttttgttctgtcattggcaatagttaccttgggtctggtgtct

SEQ ID NO: 21104 - DNA, 201 bp, Homo sapiens
ttgaggataaagaggtagtcatggggctagtgaaaatgtgtgccttttatcttcattttataactgcctatactgtttgaatgctttaccatatgtgtgtmtcttgtagttgtttgataaatttttaaatgtctttaaggaattttaaaaattgccattgcataagaaagggaaatagagtccactttcagtgactttttg

SEQ ID NO: 21105 - DNA, 201 bp, Homo sapiens
tggtacatgcacaagactgatttctacaagccattcaaaaaaatgattctcagttctttttaagaatgtctttataatactttcatatacaagccaacacrtacatgagataaatgctgtcttgggatgtgatcttagtgaagtcatttaacctctttcagcctcctttgttgaagtgttaatactactgattcataggga

SEQ ID NO: 21106 - DNA, 201 bp, Homo sapiens
gcaaaaatatgtaagataggtcatcattcaacagacagacgaagcttcattctcttctgtggaggtttaagagctgcgtgctttggctaattctggtcacycataagtcaaccaagtcttggaaattgaaagagcagggtgactcgttattttcctctttgtgtccttcctttcttctttcctccttcactcctcactttc

SEQ ID NO: 21107 - DNA, 201 bp, Homo sapiens
aaaatgaaagtaacagcaaaaatatgtaagataggtcatcattcaacagacagacgaagcttcattctcttctgtggaggtttaagagctgcgtgctttgsctaattctggtcactcataagtcaaccaagtcttggaaattgaaagagcagggtgactcgttattttcctctttgtgtccttcctttcttctttcctcct

SEQ ID NO: 21108 - DNA, 201 bp, Homo sapiens
ccagtgcaggctgtatttaacttgcataaaacctcaaggccacactcataagcaatgatctgcctttggcccttcttagtctttacaatctgcactgtgtwtttgcccacttgcctcctttttgtcctacattaatttctgtatgtgtctgaattctccaacaagattgcattcacaggggcaggcaaacagtaggaattc

SEQ ID NO: 21109 - DNA, 201 bp, Homo sapiens
tgaggagttaacatttgggaagaaagggaagaaaattttaataattggtagaagaaaaggggaggacaagtgagggaggacattgctgtaactaagactgktccttcatctaaaagtagcccaagtaaagaagaatatattgaaattaatccaaaaggctctcactaactatattctcacttctgatgttaattttggcct

SEQ ID NO: 21110 - DNA, 201 bp, Homo sapiens
tatttcctgtcatgtttggttattctgagagagtttaagagttctatggaagaatttggtaaagaattagcatataaaaatcaattcaactatcaactgcrgagaaaaaaggctatacaagaaaggagatgtaaggccaggcatggtggctcacacctgtaatcccagcactttgggaggctgaggggggtggatcacctg

SEQ ID NO: 21111 - DNA, 201 bp, Homo sapiens
tttttatagcaaaataccaagacatacaccattgacaaagatataggggcaaaaggaaagaatatttgaaattggactcctttcacccatgaatatatcgygttacaatcacatgttatcaccaccattctctgaccagcagaggccaagagctacccaccatgaatgtcacagaggagtggcctgtatgtggagggaaat

SEQ ID NO: 21112 - DNA, 201 bp, Homo sapiens
ttgagcaaggcaagagataaatacagtcctcaaccaagttctgggtgggcaaccaggcagcagttccaaaaaggattgtcttctgaccactttatttcagyccctcagagtagaaattgtgggccctctgtgatccaattgtataactcttagttcactgacattaaaggggaaaataccttcctcttctccaatggaaac

SEQ ID NO: 21113 - DNA, 201 bp, Homo sapiens
accttaatccttatatttgacttatttcttcaaaccaagtaagtttattttatttttctcaatgggtctgcctggcattcaaggtgttttactactgttcygacaaaaatatcaaactgtactatattaacaggtagcaatgtaggcctcaaagaaaagagcaagctcaatagatttttgggtcccccattcttttgttct

SEQ ID NO: 21114 - DNA, 201 bp, Homo sapiens
aaaatgattctcagttctttttaagaatgtctttataatactttcatatacaagccaacacgtacatgagataaatgctgtcttgggatgtgatcttagtraagtcatttaacctctttcagcctcctttgttgaagtgttaatactactgattcatagggaagataaaggaatttaattctatagtatatgtaagagtat

SEQ ID NO: 21115 - DNA, 201 bp, Homo sapiens
gaggcagaggttgcagtgagccgaggtcgcgccactgcactccagcctgggggacagagcgagactctgtctcaaaaaaaaaaaagttcttaatatatggyacatgcacaagactgatttctacaagccattcaaaaaaatgattctcagttctttttaagaatgtctttataatactttcatatacaagccaacacgtac

SEQ ID NO: 21116 - DNA, 201 bp, Homo sapiens
gaacccgggaggcaaatgtcgcagtgagccgagattgtgccaatgcactccagcctgggtgacagagcgagagtccgtctcaaaaaaaaagggaaaaaaargaaaaggatatgtaatcatagtatactacgtgattctcttgtgaataatattttcatggtcataattgtatgaacgctgattacgggcttaaacattcct

SEQ ID NO: 21117 - DNA, 201 bp, Homo sapiens
caagaaaaacctacttctttgtgggcatttggtgctggaggtaagtttacagacaattgacactttgttttattatggagaaaaatattcacaatagcatmactttgacacagacaaaattaaaatgaatccataatattttttatttttttattttttttgagatggagtcttgctctgtctcccaggctagagtgtagt

SEQ ID NO: 21118 - DNA, 201 bp, Homo sapiens
aaatataagaattaaatataagaatataattttggatgtaaaatatgtcttatttatttaataatttcttatttatttagttatgaattatgtattattawttatttagtaatttatttaaataaataaataagacatattttatgtccaaaaacactaatgaaatgcaaaaaaaaagcttaaaaatgtaaaagaatactc

SEQ ID NO: 21119 - DNA, 201 bp, Homo sapiens
gctagagtgtagtgctgcaatctctgctcactgcagcctcgacctcctgctttcaagagatcctcctgtctcagcaacccccaagtaactgatactacagkcatgtgccaccacgcctggctaatttttgtactttttgtagagatggagtttcaccatgattctcagtctggtctcgaactcctgggctcaagcgatcca

SEQ ID NO: 21120 - DNA, 201 bp, Homo sapiens
ataaatataagaattaaatataagaatataattttggatgtaaaatatgtcttatttatttaataatttcttatttatttagttatgaattatgtattattaattatttagtaatttatttaaataaataaataagacatattttatgtccaaaaacactaatgaaatgcaaaaaaaaagcttaaaaatgtaaaagaatac

SEQ ID NO: 21121 - DNA, 201 bp, Homo sapiens
aaagtgaataatgaaggcagtggatgacatttatcaagccgaaagagatctcaatgagtctaatgactttccttcaatttaaaaaaaaagataagataaartaaaaagttggtgatcccaaccaaattgccaatgacacaaacatatctagtgaaaaattttgaaagctccaagctcagccttcaatctgatgtaacgatt

SEQ ID NO: 21122 - DNA, 201 bp, Homo sapiens
agacagtgaactgtaatatgaagtgtaataaagaattcagagttattccttttaaaaaaattatcttgttgacaacatgtagtattttccagctattacaytgatattttgaatgggcacaagagatataaagacctaagcttagaatgcatttatttattttttgtttatttatttatttttgagacagggtcttgctct

SEQ ID NO: 21123 - DNA, 201 bp, Homo sapiens
tgcggtagacaaattaagctccccaaaccaaagatccgctggtatcctttcatattcttgtatgcaggtttgatgaaatgacccaaaccatggacaaaggrttcccgcagagagtggtaaaacactttcctggaatcagtatccgtgttgatgctgctttccagtacaaaggtaagcatggatgtctcacttattgggata

SEQ ID NO: 21124 - DNA, 201 bp, Homo sapiens
atggaatcttcattatccttcaaagttctcaggcaaatttattttagactgaaattctgtatccagtcatacaccaatcaagtgtgaggatgaaataaagrgcattcttaggtatgaaaaaaatcagaatatttattttccttatattctttcttagaaaactcctgagagacatgttgcatcaaaacaagggagtaaatc

SEQ ID NO: 21125 - DNA, 201 bp, Homo sapiens
gcgaagtgactaagcacatgaacaaaacaatgattctcaaactttaatgtatgtaccttaatgtacatagcttggggtttgtgtgtgaaacaaagtatttkaggcagaattgtgagtgatacctaagaatctgcagttttaaaagaacctcaggcaatgtaatgaatacaatccagcaactatatcatccaagacaatgac

SEQ ID NO: 21126 - DNA, 201 bp, Homo sapiens
attcaagaccagcctgggcaacatagtgagaccttgtccctacaaaaaaataaaaataaaaatattagctgggcatggtggcatgcaactatagtcccagstactcgggaggctgtggcaggaggatcactcgaacccaggagtttgaggctgcagtgagtcatgactgtgtcaccgcattcgagcttgggtgacagagta

SEQ ID NO: 21127 - DNA, 201 bp, Homo sapiens
tctactaaaaccacaaaaaattagccaggcgtggtggcatgcacctgtaatcccagctacttggaaggctggggcagaagaatctcttgaacccgggaggyggatgttgcagtgagccgagatcatgccactggaatgttaacaagggaaagagagaaagaaagctctctgccacagaaagggttcccaaaaaagggtttc

SEQ ID NO: 21128 - DNA, 201 bp, Homo sapiens
tgtgcttaaagttgtattaggttggtgcaaaagtaaccacaattacttttgcactttgtcagagcaaagtgagttacacaaaccagtccaccccttgtgcwactaaattaatgctgtgggtatgtggcagaggacatcagaagaatctcctacagctttgttccttggagatttaaatgatgggaaattggatgagctttc

SEQ ID NO: 21129 - DNA, 201 bp, Homo sapiens
ccgagatcatgccactggaatgttaacaagggaaagagagaaagaaagctctctgccacagaaagggttcccaaaaaagggtttccatttcacagttgaayacagagacttttataaggaaccactgagtgttgggtgtctcatttgcataaggagcaaatttctggtcgctccacccagtcctcctagtgtgcatgcagg

SEQ ID NO: 21130 - DNA, 201 bp, Homo sapiens
gagattcttcaaaagcaaagcctaagtcaagacattggtgcaattatattttcaggacacagtcccaggaagcaagagtgaggtagcaagaagagtgagtmaaagaatgaggaaaagccaatacaattatgtgttatcaaggtttctgctatgggcaattgaagctcaattccaccaggggcctctgagaagcctgcagac

SEQ ID NO: 21131 - DNA, 201 bp, Homo sapiens
gcacaaatacgtgtgatattacagttaggagagcaccagaaattgcactcatttttgcttatgggcagttactttttcctggatatatattcttaaaaatygacctgtaggagaggacaagattcaactataaaaataatcctatttcaaattcagtggaaaatctaaaaacacagttttcaaagcatatatgttgaatat

SEQ ID NO: 21132 - DNA, 201 bp, Homo sapiens
gaaattgaaagagcagggtgactcgttattttcctctttgtgtccttcctttcttctttcctccttcactcctcactttctctcattacttcttttttttyccctttcctattgccagaaggaattttaggcaattttgctttatcctgagatggagatttgctctcctgtagtctgtgcctcttttttttttttcttatc

SEQ ID NO: 21133 - DNA, 201 bp, Homo sapiens
acactttcctggaatcagtatccgtgttgatgctgctttccagtacaaaggtaagcatggatgtctcacttattgggatacttgagagactgtgttgactrtgaaaaaagacagcacaaaaacttaaatgcttttattttaatgcaattttgctactcttaagtatatacaataataaacattaaccccacaaacattatc

SEQ ID NO: 21134 - DNA, 201 bp, Homo sapiens
aaagtatggaagtattatatagttatgaaagataactaatcctgattccctgtctctaggattcttctttttcagccgtggatcaaagcaatttgaatacracattaagacaaagaatattacccgaatcatgagaactaatacttggtttcaatgcaaagaaccaaagaactcctcatttggttttgatatcaacaagga

SEQ ID NO: 21135 - DNA, 201 bp, Homo sapiens
gttttcaaagcatatatgttgaatattagaattatattaaagatttataactcaaaaagtaggtgatatcactcatcctttaagatttaaataaacttgayttccaaaatccaaaatcttatggagtttctaatgctccccatcaaacaattagagggaaaaatcttattaatatcctttggcaaacccacctccaaaatc

SEQ ID NO: 21136 - DNA, 201 bp, Homo sapiens
cagttgatgaatagacaaactggaatgtccatactcaacaacaaaaaggaagaaatgactgacacatgaaacaatatggatgaatcccaaaagcaatatgkaaagtgaatgaaaccagatacaaaagacttcatgatatatgattccatttatatgaaaaattagaggagacaaaactatagtaacagaaagcaggtcact

SEQ ID NO: 21137 - DNA, 201 bp, Homo sapiens
tcctgtgtcaagtctggtgatgagaccagactccagctggaggtaaaaacatgctttggatctcaaatcaccccaaaacccagtggcttgaaacaaccaawattttttcttatgattctgtgggttgaccaggattagctgggtagttctgttccatgtggtggaacatgctggggtcactttggaagctgcattcagcag

SEQ ID NO: 21138 - DNA, 201 bp, Homo sapiens
gggaaagtgagggaaatatggacatcacatggaacaacatccaggagactcaggcctctaggagtaactgggtagtgtgcttggtttaatcttctatttasctgcagaccaggaagatgagacctctctgcccttctgacctcgggattttagttttgtggggaccaggggagatagaaaaatacccggggtctcttcatt

SEQ ID NO: 21139 - DNA, 201 bp, Homo sapiens; identical to SEQ ID NO: 2283

SEQ ID NO: 21140 - DNA, 201 bp, Homo sapiens
atgccaaaaaattagccaggcatggtggtacatgtctgtaatcccagctacttgggaggctgaggcatgagaatcactcaaacctggaaggtgacggttgyggtgagctgagatcatgccactgcatcccagcctgggtgatagtgagaccctgtctcaaacaaacaaaaaaacaaaacacttccttactttggtttaaag

SEQ ID NO: 21141 - DNA, 201 bp, Homo sapiens
cttcacccactctgttcctcagctttcccttcagtgggatgatatcaactggacaacaggatgtgcgattcttttagttccagccttccaggatgttttcrctcccctgtttgttgttgtaggatggtattacctccaccttcccaccttccctatgccctggttctgtctcctgtgcctcgctctgaaagtggatgagac

SEQ ID NO: 21142 - DNA, 201 bp, Homo sapiens
gatttacagtcatcagaattgtaaaactgatcccatgtattttcaaacctcaaatcccttgctctgaccttgtgtgtctaagctagaaggaagcaggatgsacctctcccctggctggaatgaagggattcacccaagctctcagtcttctcacggcatccagggcccccctgcttgtgtgtggtctagatttccattccc

SEQ ID NO: 21143 - DNA, 201 bp, Homo sapiens
ttgttcaaaccctaactcaatcccaaattaatccaccatgtataaggttgagctatgtctcttattcctggacaccatactcagccatattctggtccacrcattaaacaagctggatgaccttgaagaagcttcacccactctgttcctcagctttcccttcagtgggatgatatcaactggacaacaggatgtgcgatt

SEQ ID NO: 21144 - DNA, 201 bp, Homo sapiens
ctttgggagccttggggtctctcctgctagagggcttcacctgtgactgtctcaattcaagggaggggttctaataacattaaacctcaatatcttgctcytccattcctgatgcctccctttccttctacccttcccctacctccttctttcctatgccacaggctggcaggttagtgccagagcaagtggccagtcacc

SEQ ID NO: 21145 - DNA, 201 bp, Homo sapiens
cctacctccttctttcctatgccacaggctggcaggttagtgccagagcaagtggccagtcaccatcattggggttgtggatcctcagggttcttcagaasccccttcaccatgatcaagagtctccagtcactcagaattccacggttcccaaatgccagctctcccactactcccagcgttctccatctctgggatgtt

SEQ ID NO: 21146 - DNA, 201 bp, Homo sapiens
ctacctccttctttcctatgccacaggctggcaggttagtgccagagcaagtggccagtcaccatcattggggttgtggatcctcagggttcttcagaagscccttcaccatgatcaagagtctccagtcactcagaattccacggttcccaaatgccagctctcccactactcccagcgttctccatctctgggatgttg

SEQ ID NO: 21147 - DNA, 201 bp, Homo sapiens
ccttggtttccccgtctgtgacatctgtgacatgagagtcacgataactccttgtgtgccttacagggttgttgtgaaaattaaatgcacagataatagcrtaacagtattccgtgcattgtaaagagcctgaaaaccattatgatttgaaaatggaatcggctttgtgagaccatcactattgtaaagatgtgatgctga

SEQ ID NO: 21148 - DNA, 201 bp, Homo sapiens
taaacttttaccagcacaacactgccctgccttcagagtcaatgaccctatccaagtttaatccatctgtccactgtctccaacacgatctttataaaacwcacctgacaacattacccttttattcagttttttaaaagataagtttccagctcatcggggtggctttaaaggccatttctcctctggacctcacccaac

SEQ ID NO: 21149 - DNA, 201 bp, Homo sapiens
aacttttaccagcacaacactgccctgccttcagagtcaatgaccctatccaagtttaatccatctgtccactgtctccaacacgatctttataaaacacwcctgacaacattacccttttattcagttttttaaaagataagtttccagctcatcggggtggctttaaaggccatttctcctctggacctcacccaactt

SEQ ID NO: 21150 - DNA, 201 bp, Homo sapiens
gtctttgtattcaagtttgaagctgggagggcctggctactgaagggcacatatgagggcagcctgaagagggtgtggagaggtagagtctaggtcagagktcagtgcctataggcacagtggtcccagggccacagctgggaagggcaaataccagaaggcaaggttgaccattcccttcctcaagtgcctattaaggct

SEQ ID NO: 21151 - DNA, 201 bp, Homo sapiens
gcatgccctctgcagtgtgacattccagcagtgaaatcatgttggggtgacttctcccccactctgacctttatgtttgtctgggccgaggctgcaagtcrggctctgtgggtgtatgagtgacaagtctctcccttccagatatggggactgtctgcttccctaggttgcctctccctgctctgatcagctagaagctcc

SEQ ID NO: 21152 - DNA, 201 bp, Homo sapiens
ccaaggctgtaaggaactgcctgagcccagagaggtggagcccagcactggtgccctttactcctggggacatgtgctggtttcaaaaacttcagctgagyttttgagcattcatggaacttggtgggggagatgaaatttgtaccttaaatcctgcctacagggagggtccctgataatccccacccaatttggaaatct

SEQ ID NO: 21153 - DNA, 201 bp, Homo sapiens
tctgcagcagcatggcctgcctgcacaaaccctaggtgcaatgtcctaatccttgttgggtctttgtattcaagtttgaagctgggagggcctggctactraagggcacatatgagggcagcctgaagagggtgtggagaggtagagtctaggtcagaggtcagtgcctataggcacagtggtcccagggccacagctggg

SEQ ID NO: 21154 - DNA, 201 bp, Homo sapiens
tcgagcatgtgggctcttcagagccacctgatgaggtgggtacagttagccacacttcacaggtgaggaggtgaggcacaggtcccaggtcaggctggccrgagctctgtttattacgtctcacagctttgagtcctgctctcaaccagagaggccctttaccaagaagaaaggattgggacccagaatcaggtcactggc

SEQ ID NO: 21155 - DNA, 201 bp, Homo sapiens
tgtcaactggtggatgaatggataaagaaattgtggtatatacatacactggaatattattcaaccttaaaaagaaggaaatcctaacatttgtgacaacrtggatggacctggagggaattatgctgagtgaaataagacagacacaaaaagacatttcttgcaggagctcacttatatgtggaatctaaaatagtcaag

SEQ ID NO: 21156 - DNA, 201 bp, Homo sapiens
atgtgagtggccatactgtggcactgtcccatccctcaccagggacactgttctggagggtgactgcctgttctgtgaggagtggggatggctaggacatkgcatggaacacaccaccaccccatcttctcagagctcaaaccctgacagaacaccagctccacaggccttggcttctgctgatggtgccgtgtatttacc

SEQ ID NO: 21157 - DNA, 201 bp, Homo sapiens
tgcaagatgacctgtgtatcagggagaaataggcaataaattgagatccagcagggatttgaatcatggatttgaatcaggggcagccttcgaaagaactrtggagaatatactcagatttaaaacataagattggaatttttggcagagaactaacaactgtacaaaaaaggaaccaaatggaaatcctagaactgaaag

SEQ ID NO: 21158 - DNA, 201 bp, Homo sapiens
ctcacagctttgagtcctgctctcaaccagagaggccctttaccaagaagaaaggattgggacccagaatcaggtcactggctgaggtagagaggaagccrggttgttcccaagggtagctgctcctgcaggactctgagcaggtcaccagctaatggaggaaaggctctagggaaagacccttctggtctcagactcaga

SEQ ID NO: 21159 - DNA, 201 bp, Homo sapiens
tgagttttctctttcttgtatataaaatggaagtagctggcagggcagggcatgtgtcgttgatatatttttaatcctggtaaaaggaggaggttcaaggmagaaaactcatcaaagcttaatgacaacaatagcagctaacatttgtgaggctctaaggtaaaacccaaggctaagactcttcatgcaaactaggtcaag

SEQ ID NO: 21160 - DNA, 201 bp, Homo sapiens
agggaggttccaggagccccgagcgtcttttctccaggagaatactctctgaattcagactggggtcagagaaacatttacccaggagccgcagtgtgggyggggctttttacttgaaacgctgtctgaaggcagtggccaggatggaactctccaccctaccttggcaagccacttctcttctgcaatctgtaaggacat

SEQ ID NO: 21161 - DNA, 201 bp, Homo sapiens
agagactcaggaacccagtgagtaatagatgcatgccaaggagtgggactgcgattcaggcctagttgaatgtgctgacagagaagcagagaggggcaccrggggcacagcccgaaggcccagactgatatgggcaaggcctgtctgtgctgacatgtcggagggtcccactctccagggaccttggtttccccgtctgtg

SEQ ID NO: 21162 - DNA, 201 bp, Homo sapiens
tgacgcactgcaaaatcccatggtctgaatgcttctaccttccctgtgaaagcccctggcctcagaaaaggaagctggtttaagtgaccaacatttggggyggagcttccgagggcccagccaccgtgttacatgcaacaatcaacagagatattctttggctagagttgtttttctgggtataggaccctataattaaaa

SEQ ID NO: 21163 - DNA, 201 bp, Homo sapiens
taataagacttttgaaaagtagattatgggctgggcacagtggctcacacctgtaatcccagcactttgggaggccaagatgggtggatcacctgaggtcrggagttcgagaccagcctgactaacatagtgaaaccctgtctctactaaaaatacaaaattagttgggggtggtggcacaagcctgtaatcccagctact

SEQ ID NO: 21164 - DNA, 201 bp, Homo sapiens
tttacgaagtttccaggtttacaaatctagtttctgattctttagtcagcaggaatttctctacaaaagctgcttcgaaaatttccagccaaaccttacayaccttggcattacatcttggtgagccaaggcggaagagaacaggaagtgaaggccccatgggaagtccctgcggtcgggagcacccaggcggggcggggg

SEQ ID NO: 21165 - DNA, 201 bp, Homo sapiens
caggttggtcttgaactcctgacctcaggtgatccgcccacctcagcctccccaagtgctgggattacaggtgtgagccaccgtgcccagcccagccatcrtttttgaaacacgtttgagaaatagtgtcttcctttgagggccaaggagacattttttttgtttatttgtttgtttttgtgaggactagctgaagggggt

SEQ ID NO: 21166 - DNA, 201 bp, Homo sapiens
ctcaggtgatccgcccacctcagcctccccaagtgctgggattacaggtgtgagccaccgtgcccagcccagccatcatttttgaaacacgtttgagaaayagtgtcttcctttgagggccaaggagacattttttttgtttatttgtttgtttttgtgaggactagctgaagggggtgatgtatattaacctgcctactt

SEQ ID NO: 21167 - DNA, 201 bp, Homo sapiens
tctcttcaactttttcctacccataaaataggagcatgcttacctttttcctaatgttccaggccccgggtctagaatattgtaagtaaggaagttaatgygtatcagagcccattatgggccagaagttctcctcttccttcctacacctgcttcctccctccctccctccctctttcccttccttccttccatccattt

SEQ ID NO: 21168 - DNA, 201 bp, Homo sapiens
aactttttcctacccataaaataggagcatgcttacctttttcctaatgttccaggccccgggtctagaatattgtaagtaaggaagttaatgtgtatcasagcccattatgggccagaagttctcctcttccttcctacacctgcttcctccctccctccctccctctttcccttccttccttccatccatttgtgaaga

SEQ ID NO: 21169 - DNA, 201 bp, Homo sapiens; identical to SEQ ID NO: 2294

SEQ ID NO: 21170 - DNA, 201 bp, Homo sapiens
ataacatgagagcaaatctctctgcaaaaaagatatggggcagcactgtccacaacagcctctactggaaacaacccaagcacccatcacagaatgaattmgtacatcatgtatctgcacacaacacagtgctccttggcaaagaaaatgaatgaattacagccagctgcacctcacaagacagataatcttacaaacatc

SEQ ID NO: 21171 - DNA, 201 bp, Homo sapiens; identical to SEQ ID NO: 2295

SEQ ID NO: 21172 - DNA, 201 bp, Homo sapiens
ccccagaggctggcgcctggcctcttctctgagagttcttttcttccttcagcctcactctccctggataacatgagagcaaatctctctgcaaaaaagayatggggcagcactgtccacaacagcctctactggaaacaacccaagcacccatcacagaatgaattagtacatcatgtatctgcacacaacacagtgctc

SEQ ID NO: 21173 - DNA, 201 bp, Homo sapiens
gaaggtgagtggttgccaggaaagccaatgtatgtgggcatcacgtcactttgcccgtctgtctgcagcagcatggcctgcctgcacaaaccctaggtgcmatgtcctaatccttgttgggtctttgtattcaagtttgaagctgggagggcctggctactgaagggcacatatgagggcagcctgaagagggtgtggaga

SEQ ID NO: 21174 - DNA, 201 bp, Homo sapiens
accaactagttgctggatacttgcaaggaccaaatgtcaatttagaaggtgagtggttgccaggaaagccaatgtatgtgggcatcacgtcactttgcccstctgtctgcagcagcatggcctgcctgcacaaaccctaggtgcaatgtcctaatccttgttgggtctttgtattcaagtttgaagctgggagggcctggc

SEQ ID NO: 21175 - DNA, 201 bp, Homo sapiens; identical to SEQ ID NO: 2288

SEQ ID NO: 21176 - DNA, 201 bp, Homo sapiens
gagagttcttttcttccttcagcctcactctccctggataacatgagagcaaatctctctgcaaaaaagatatggggcagcactgtccacaacagcctctrctggaaacaacccaagcacccatcacagaatgaattagtacatcatgtatctgcacacaacacagtgctccttggcaaagaaaatgaatgaattacagcc

SEQ ID NO: 21177 - DNA, 201 bp, Homo sapiens
agaccttctatctgaggaacaaccaactagttgctggatacttgcaaggaccaaatgtcaatttagaaggtgagtggttgccaggaaagccaatgtatgtrggcatcacgtcactttgcccgtctgtctgcagcagcatggcctgcctgcacaaaccctaggtgcaatgtcctaatccttgttgggtctttgtattcaagt

SEQ ID NO: 21178 - DNA, 201 bp, Homo sapiens
aaacaggtggtgcagagagaagcaaggccatgctctgtctgaaggcccagtgacacttggcccctgcgagagagagtggcaggcaggagcacctgggggaytttagggtccagacaacattctatttcttggcatggatgcagttaggcggttttctgtatgtatattttatttcacaatacctagaaaataaaaagactt

SEQ ID NO: 21179 - DNA, 201 bp, Homo sapiens
tgttaaccagaagaccttctatctgaggaacaaccaactagttgctggatacttgcaaggaccaaatgtcaatttagaaggtgagtggttgccaggaaagycaatgtatgtgggcatcacgtcactttgcccgtctgtctgcagcagcatggcctgcctgcacaaaccctaggtgcaatgtcctaatccttgttgggtctt

SEQ ID NO: 21180 - DNA, 201 bp, Homo sapiens
gaatcagttacaacactccattgcgacacttagtggggttgaaagtgacaacagcaagggtttctctttttggaaatgcgaggagggtatttccgcttctygcagtggggcagggtggcagacgcctagcttgggtgagtgactatttctttataaaccacaactctgggcccgcaatggcagtccactgccttgctgcag

SEQ ID NO: 21181 - DNA, 201 bp, Homo sapiens
tttagggtccagacaacattctatttcttggcatggatgcagttaggcggttttctgtatgtatattttatttcacaatacctagaaaataaaaagacttsccccccaacaaccagggtgtaaagaaaggagcatctgggaaattatgagattagtgaatggagtattgaatttgtccccataggtgggagtgcaagacca

SEQ ID NO: 21182 - DNA, 201 bp, Homo sapiens
atggcagtccactgccttgctgcagtcacagaatggaaatctgcagaggcctccgcagtcacctaatcactctcctcctcttcctgttccattcagagacratctgccgaccctctgggagaaaatccagcaagatgcaagccttcaggtaaggctaccccaaggaggagaaggtgagggtggatcagctggagactggaa

SEQ ID NO: 21183 - DNA, 201 bp, Homo sapiens
gtgagccgagatcacaccattgcactccaacctgggcaacaagagcaaaactctgtctcaaaataaagaaagaaataagataaaataaaaagcataaatcrcacaatgcataagttttggcatacacactagcataaagggattctcctacttataaacctagcccatctccttactctctatcacactagcccattgatg

SEQ ID NO: 21184 - DNA, 201 bp, Homo sapiens
gcaagatgcaagccttcaggtaaggctaccccaaggaggagaaggtgagggtggatcagctggagactggaaacatatcacagctgccaggggctgccagsccccagagggcctgagaactgggtttgggctggagaggatgtccattattcaagaaagaggctgttacatgcatgggcttcaggacttgtgtttcaaaat

SEQ ID NO: 21185 - DNA, 201 bp, Homo sapiens
agaccctgtctcaaacaaacaaaaaaacaaaacacttccttactttggtttaaagtgttccataaaatattcctaagaggaaaaactttaaatcatcatcrtgctgctagaatgtcagctcaacccatgcagatatttttgtctgttttgttctacagtgtatctcaagtgccaaggccattgcttgcgatatactgggtg

SEQ ID NO: 21186 - DNA, 201 bp, Homo sapiens
gtggggtattccaggtctggtctcagcctgcggtgaggaaattaataatcaaggggccagcactttatatagcacaaggcaggggccatggattaggaaakccaggcctggggttcatgcttaagtgaggcttttgttcaactgggaggcggtgcacaggtgactgggaggtggaggggctgagatgggaaagaaaagcac

SEQ ID NO: 21187 - DNA, 201 bp, Homo sapiens
tcccaacagagccctctgtttttctcttctttacaacttggacctcccatgggactttgtttgaaagggagacttcattgctaaaagcaaactaaactaartaggctaaaaggcaacaaactggagaaaatgtttaaggtcttctctagatctaagatcctatgacgttgaggaggtcatccaacatctctgagttttctc

SEQ ID NO: 21188 - DNA, 201 bp, Homo sapiens
agcagctcagttgagttagagtctggaagacctcagaagacctcctgtcctatgaggccctccccatggctttaggtaagctccttccactctcatttttycacctgagaaatgagagaggaaaatgtctacaattggtgtttatcaaatgctttcaggctctggtgagcaagcgtccaggaaaatgtcaagcgcatggag

SEQ ID NO: 21189 - DNA, 201 bp, Homo sapiens
tattgtatacttaaaattgctaagagggtatatcttatatgttcttaccaataataataataatggtaataattaaggggcaggaggacacttcaaaaggtgatggatatgtttatggccttgatggtggtgatggtttcatgagagtatacttatccccaaactaattgagatgtaaatattaaatatgtacagcttttt

SEQ ID NO: 21190 - DNA, 201 bp, Homo sapiens
tcctggggaaagtgagggaaatatggacatcacatggaacaacatccaggagactcaggcctctaggagtaactgggtagtgtgcttggtttaatcttctrtttacctgcagaccaggaagatgagacctctctgcccttctgacctcgggattttagttttgtggggaccaggggagatagaaaaatacccggggtctct

SEQ ID NO: 21191 - DNA, 201 bp, Homo sapiens
ggcacatggtggctgtgcactacagctgagtccttttccttttcagaatctgggatgttaaccagaagaccttctatctgaggaacaaccaactagttgcyggatacttgcaaggaccaaatgtcaatttagaaggtgagtggttgccaggaaagccaatgtatgtgggcatcacgtcactttgcccgtctgtctgcagca

SEQ ID NO: 21192 - DNA, 201 bp, Homo sapiens
tggctatttaaatttatacttaaatgaatgaaaatagaagaaaatttaaaatccagacccttggtcacactatccacatttaaagaggtcaatagccacaygtggttagtggccaccctattgggcagtgcagctacagaacatttttgcatcccagaaagttcttttggatgttgctgctctacagcatgctttgctgaa

SEQ ID NO: 21193 - DNA, 201 bp, Homo sapiens
tgcaaagcactttggtttgcctggccacccctcgtcgagcatgtgggctcttcagagccacctgatgaggtgggtacagttagccacacttcacaggtgargaggtgaggcacaggtcccaggtcaggctggccggagctctgtttattacgtctcacagctttgagtcctgctctcaaccagagaggccctttaccaaga

SEQ ID NO: 21194 - DNA, 201 bp, Homo sapiens
ttcttcttcctcccccttctcctcttcttcttcctcctccttctcctcttcttcttcttcttcttcttcttcctcttcttcttcttcctcctcctcctcctcctcttcttcttcctcttcctcttcctcttcctcttcttcctcttcctcttattcttcttcgtcgtcttcgtcttctttttattttcaaagtgaaagcaa

SEQ ID NO: 21195 - DNA, 201 bp, Homo sapiens
tcttcttcctcccccttctcctcttcttcttcctcctccttctcctcttcttcttcttcttcttcttcttcctcttcttcttcttcctcctcctcctcctcctcttcttcttcctcttcctcttcctcttcctcttcttcctcttcctcttattcttcttcgtcgtcttcgtcttctttttattttcaaagtgaaagcaag

SEQ ID NO: 21196 - DNA, 201 bp, Homo sapiens
ttcttcttcttcctcttcttcttcttcctcctcctcctcctcctcttcttcttcctcttcctcttcctcttcctcttcttcctcttcctcttattcttctrcgtcgtcttcgtcttctttttattttcaaagtgaaagcaagtttattaagaaagtaaaggaataaaagaatggccactccatagacagagtagcctgaac

SEQ ID NO: 21197 - DNA, 201 bp, Homo sapiens
ttagaaggtgagtggttgccaggaaagccaatgtatgtgggcatcacgtcactttgcccgtctgtctgcagcagcatggcctgcctgcacaaaccctaggkgcaatgtcctaatccttgttgggtctttgtattcaagtttgaagctgggagggcctggctactgaagggcacatatgagggcagcctgaagagggtgtgg

SEQ ID NO: 21198 - DNA, 201 bp, Homo sapiens
cttttgcaaagaaagttgtagtggaacacagctaggcttattgatttatggattgccaacgtccttttgtgaaacagacagctgagctgagtaatcgtggygcacaaaacctaaaatatttactatctcgtcctttacagaatgtttgccaatctatggtccggagtccaaggctgtccatttttcaaagaacacaaagtg

SEQ ID NO: 21199 - DNA, 201 bp, Homo sapiens
gacgaaaccaagagtggacttgtggccagaagcgtgaggaagagggagagagcttcccttgtcccctttcttcctctccctaagccacagtgattgacagccccccccctttggagtcagagcaggcttgagactggactgggaaaggagggtgggtcaggatacagagcaggaaggctgggagtgcagggcaggagcaag

SEQ ID NO: 21200 - DNA, 201 bp, Homo sapiens
ccaagagtggacttgtggccagaagcgtgaggaagagggagagagcttcccttgtcccctttcttcctctccctaagccacagtgattgacagcccccccsctttggagtcagagcaggcttgagactggactgggaaaggagggtgggtcaggatacagagcaggaaggctgggagtgcagggcaggagcaaggggctgg

SEQ ID NO: 21201 - DNA, 201 bp, Homo sapiens
tggagccccactcatggccttgttcattttccctgcccctcagcaacactcctattgacctggagcacaggtatcctggggaaagtgagggaaatatggamatcacatggaacaacatccaggagactcaggcctctaggagtaactgggtagtgtgcatcctggggaaagtgagggaaatatggacatcacatggaacaa

SEQ ID NO: 21202 - DNA, 201 bp, Homo sapiens
ggagccccactcatggccttgttcattttccctgcccctcagcaacactcctattgacctggagcacaggtatcctggggaaagtgagggaaatatggacmtcacatggaacaacatccaggagactcaggcctctaggagtaactgggtagtgtgcatcctggggaaagtgagggaaatatggacatcacatggaacaac

SEQ ID NO: 21203 - DNA, 201 bp, Homo sapiens
gattaggaaatccaggcctggggttcatgcttaagtgaggcttttgttcaactgggaggcggtgcacaggtgactgggaggtggaggggctgagatgggaragaaaagcacagagagggaagacaagcaagcctcaagaggattgtggcttcttccgtcacttctgggcccgatctactacaacactacagaatcaaggac

SEQ ID NO: 21204 - DNA, 201 bp, Homo sapiens
aatcttctatttacctgcagaccaggaagatgagacctctctgcccttctgacctcgggattttagttttgtggggaccaggggagatagaaaaatacccrgggtctcttcattattgctgcttcctcttctattaacctgaccctcccctctgttcttccccagaaaagatagatgtggtacccattgagcctcatgctc

SEQ ID NO: 21205 - DNA, 201 bp, Homo sapiens
tgactgggaggtggaggggctgagatgggaaagaaaagcacagagagggaagacaagcaagcctcaagaggattgtggcttcttccgtcacttctgggccygatctactacaacactacagaatcaaggacaactgtttgaaaattcaaggctgaattcaggtctttcattggtgagtcagagttttcctacagactcact

SEQ ID NO: 21206 - DNA, 201 bp, Homo sapiens
caggaagatgagacctctctgcccttctgacctcgggattttagttttgtggggaccaggggagatagaaaaatacccggggtctcttcattattgctgcytcctcttctattaacctgaccctcccctctgttcttccccagaaaagatagatgtggtacccattgagcctcatgctctgttcttgggaatccatggagg

SEQ ID NO: 21207 - DNA, 201 bp, Homo sapiens
cccgatctactacaacactacagaatcaaggacaactgtttgaaaattcaaggctgaattcaggtctttcattggtgagtcagagttttcctacagactcmctggggggcccttggccaagcaacctctcctccctaggcctcagttttcataaaaggagggaattgaactagatatgtgtcttcatcaggctgacctgca

SEQ ID NO: 21208 - DNA, 201 bp, Homo sapiens
ctctgaggcaggggctgcaagcctagtgcctgctggggcagcaggtgaacagagaggtgtaactgctgtgacagaagtcatggagtccttggagtgtgagrgtcattttccactgttgatagaatagggaaattggtgaaatagccctgttaaatgagagaaagaacagtgtgagctcaatgagaaatactaatagaatgt

SEQ ID NO: 21209 - DNA, 201 bp, Homo sapiens
gaaatccctagccacaacagcaaatctcaacatgcttgatattcagcccagttctctccataaaagtttctggagacaatgaaactcatctattgggttcwtagctttaaacctgagaaagcttaaaaacagggaagattagctttgacgtcttgcctctgggtctccttcatgtggagctaaaagagtagttcaggaaat

SEQ ID NO: 21210 - DNA, 201 bp, Homo sapiens
cactctccctggataacatgagagcaaatctctctgcaaaaaagatatggggcagcactgtccacaacagcctctactggaaacaacccaagcacccatcrcagaatgaattagtacatcatgtatctgcacacaacacagtgctccttggcaaagaaaatgaatgaattacagccagctgcacctcacaagacagataat

SEQ ID NO: 21211 - DNA, 201 bp, Homo sapiens
gacatcttcgccttccctccttggcagtatttattataagtcacaggagtttagttttctttcaactcaggcctgtggttggagcacagggagctaggctsgggctagatcttgctaacctagtaggcaatggtaaggattctagtctgtcctaaagcataaataggccttggacactctgaaatttgtcctttcaccacc

SEQ ID NO: 21212 - DNA, 201 bp, Homo sapiens
aaagatatggggcagcactgtccacaacagcctctactggaaacaacccaagcacccatcacagaatgaattagtacatcatgtatctgcacacaacacartgctccttggcaaagaaaatgaatgaattacagccagctgcacctcacaagacagataatcttacaaacatcatgtgggtacaagaatcacaaaagcatg

SEQ ID NO: 21213 - DNA, 201 bp, Homo sapiens
aaacacaagataactgcataagtaatgactttcagtgcagattcatagctaacccataaactgctggggcaaaaatcatcttggaaggctctgaacctcaraaaggattcacagtaagttaaccatgtagatctgagaggagagtagcttcttgtagataacagttggattatataccatgtcctgatccccttcatcatc

SEQ ID NO: 21214 - DNA, 201 bp, Homo sapiens
gttttctctctcatgaccagctaggcccctagctccccagggaagaaatccaatctatttcctctgatagtaatggctaatacttaaataatgccaaccayatgccaagcactttacagttgttagcccagtcttcacaagcaccttgtgaggtgggcaagagtcttatcttactctcattttatagatgtggcccaggat

SEQ ID NO: 21215 - DNA, 201 bp, Homo sapiens
cagagatttcctgtgggcagaaatcataaggacgccaactgtttgggtgagataagacgaaaccaagagtggacttgtggccagaagcgtgaggaagaggragagagcttcccttgtcccctttcttcctctccctaagccacagtgattgacagccccccccctttggagtcagagcaggcttgagactggactgggaaa

SEQ ID NO: 21216 - DNA, 201 bp, Homo sapiens
aaaatttccagccaaaccttacacaccttggcattacatcttggtgagccaaggcggaagagaacaggaagtgaaggccccatgggaagtccctgcggtcsggagcacccaggcggggcggggggtggggggctttcctgtggccggctccctgcccctcccacccccattcaggccctgtgagttgaatgaagagaccct

SEQ ID NO: 21217 - DNA, 201 bp, Homo sapiens
acaaagtgacatgagactgtcccatgtgcagggagccctatcattttattatgaaaaaacggcctttctgctcaaatctgttttttaaaaagtcaacaaasagactctgggtacctgtcaggaacagtagggagtttggtttccattgtgctcttcttcccaggaactcaatgaaggggaaatagaaatcttaattttggg

SEQ ID NO: 21218 - DNA, 201 bp, Homo sapiens
cacaccttggcattacatcttggtgagccaaggcggaagagaacaggaagtgaaggccccatgggaagtccctgcggtcgggagcacccaggcggggcggsgggtggggggctttcctgtggccggctccctgcccctcccacccccattcaggccctgtgagttgaatgaagagaccctgggaatgagtccaggtctgca

SEQ ID NO: 21219 - DNA, 201 bp, Homo sapiens
gaagtgaaggccccatgggaagtccctgcggtcgggagcacccaggcggggcggggggtggggggctttcctgtggccggctccctgcccctcccaccccmattcaggccctgtgagttgaatgaagagaccctgggaatgagtccaggtctgcagggttagaggaaattgaaggcccttaccagatccctgttgagaagt

SEQ ID NO: 21220 - DNA, 201 bp, Homo sapiens
ggattattccaaaaagagcctcaacatgcaggcgcttattatgacttctgcttgcatcatcctattggccaaagccagtcacgtggctaagtctagccccytgtgagaggagactgcataagagtgtgaacaccaggagacacggtcactgggggccaccactgtaaccatctaccacaggacctgaatctctgtgtgcta

SEQ ID NO: 21221 - DNA, 201 bp, Homo sapiens
gggtggggggctttcctgtggccggctccctgcccctcccacccccattcaggccctgtgagttgaatgaagagaccctgggaatgagtccaggtctgcarggttagaggaaattgaaggcccttaccagatccctgttgagaagtttatgaattatgagcccttctgcaaatgagagggttcttccctgtcaggagggac

SEQ ID NO: 21222 - DNA, 201 bp, Homo sapiens
ctgcgtgtcattcatgcttccggtgagccctaagtctaagatagggcagatagcatcaggtccattttgcagctgtcaaaatgaggtctgaagggcagaartggtgtgcccacacacacacaactggttggctgcagacctggggactagacccgggacttcgtcctgcccaggggtctcttgccactgctccccatcaac

SEQ ID NO: 21223 - DNA, 201 bp, Homo sapiens
gctgcagacctggggactagacccgggacttcgtcctgcccaggggtctcttgccactgctccccatcaacttggatggctttaagcatttgtgagttgtytgctccctgatggcagaatgcagagacatgaagctacaagcaggttcgctcccaacggcaaaaaggaggaggggtgttcagaacatcaggtgcttctaga

SEQ ID NO: 21224 - DNA, 201 bp, Homo sapiens
tgccactgctccccatcaacttggatggctttaagcatttgtgagttgtctgctccctgatggcagaatgcagagacatgaagctacaagcaggttcgctmccaacggcaaaaaggaggaggggtgttcagaacatcaggtgcttctagagaaagcagggagagagtatctggccttgtggacaatgtcacggcagaggcc

SEQ ID NO: 21225 - DNA, 201 bp, Homo sapiens
gcaagtcgggctctgtgggtgtatgagtgacaagtctctcccttccagatatggggactgtctgcttccctaggttgcctctccctgctctgatcagctakaagctccaggagatcctcctggaggccccagcaggtgatgtttatccctccagactgaggctaaatctagaaactaggataatcacaaacaggccaatgc

SEQ ID NO: 21226 - DNA, 201 bp, Homo sapiens
gccactgctccccatcaacttggatggctttaagcatttgtgagttgtctgctccctgatggcagaatgcagagacatgaagctacaagcaggttcgctcycaacggcaaaaaggaggaggggtgttcagaacatcaggtgcttctagagaaagcagggagagagtatctggccttgtggacaatgtcacggcagaggcca

SEQ ID NO: 21227 - DNA, 201 bp, Homo sapiens
actgatatgggcaaggcctgtctgtgctgacatgtcggagggtcccactctccagggaccttggtttccccgtctgtgacatctgtgacatgagagtcacrataactccttgtgtgccttacagggttgttgtgaaaattaaatgcacagataatagcgtaacagtattccgtgcattgtaaagagcctgaaaaccattat

SEQ ID NO: 21228 - DNA, 201 bp, Homo sapiens
ggtgtgacagtgggacagcctctttgtgtctttgctgtcctaagaaacctgggccaggccaggcgcagtggctcacgcctgtaatcccagcactttgagargccaaggtgggcagatcacgaggtcaggagtttgagaccagcctggccaacatggtgaaaccctgtctctattaaaaatagaaaacattagacaggtgtg

SEQ ID NO: 21229 - DNA, 201 bp, Homo sapiens
ggagggcctggctactgaagggcacatatgagggcagcctgaagagggtgtggagaggtagagtctaggtcagaggtcagtgcctataggcacagtggtcycagggccacagctgggaagggcaaataccagaaggcaaggttgaccattcccttcctcaagtgcctattaaggctccatgttcctatgttgttcaaaccc

SEQ ID NO: 21230 - DNA, 201 bp, Homo sapiens
taatcccagctactcaggaggctgaggcaggagaatcgcttgaacccaggaggtggaggttgcagtgagccgagattgtgccactgcactccagcctaggygacagagcaagactccgtctcgggaaaattaattaataaataaataaacctaggtcccagagtcccacagaatggcagacaggagcacctgggggctttt

SEQ ID NO: 21231 - DNA, 201 bp, Homo sapiens
gagcacttgaggccaggagttcaagaccagcctgaccaacatggcaaaaccctgtctctactgaaaatgccaaaaaattagccaggcatggtggtacatgyctgtaatcccagctacttgggaggctgaggcatgagaatcactcaaacctggaaggtgacggttgcggtgagctgagatcatgccactgcatcccagcct

SEQ ID NO: 21232 - DNA, 201 bp, Homo sapiens
tgaaaatgccaaaaaattagccaggcatggtggtacatgtctgtaatcccagctacttgggaggctgaggcatgagaatcactcaaacctggaaggtgacrgttgcggtgagctgagatcatgccactgcatcccagcctgggtgatagtgagaccctgtctcaaacaaacaaaaaaacaaaacacttccttactttggtt

SEQ ID NO: 21233 - DNA, 201 bp, Homo sapiens
gaagaccttctatctgaggaacaaccaactagttgctggatacttgcaaggaccaaatgtcaatttagaaggtgagtggttgccaggaaagccaatgtatstgggcatcacgtcactttgcccgtctgtctgcagcagcatggcctgcctgcacaaaccctaggtgcaatgtcctaatccttgttgggtctttgtattcaa

SEQ ID NO: 21234 - DNA, 201 bp, Homo sapiens
cttcttcctcccccttctcctcttcttcttcctcctccttctcctcttcttcttcttcttcttcttcttcctcttcttcttcttcctcctcctcctcctcytcttcttcttcctcttcctcttcctcttcctcttcttcctcttcctcttattcttcttcgtcgtcttcgtcttctttttattttcaaagtgaaagcaagt

SEQ ID NO: 21235 - DNA, 201 bp, Homo sapiens
gtcaccctcctggaaactgggcctgcttggcatcaagtcagccatcagccggcccatctcctcatgctggccaaccctctgtgagtgtgtgggaggggagrctgggctcctccttgtactctctgaggtgctctggaaggaggggcagctccaccctgggagggactgtggcccaggtactgcccgggtgctactttatgg

SEQ ID NO: 21236 - DNA, 201 bp, Homo sapiens
tgagtgtgtgggaggggaggctgggctcctccttgtactctctgaggtgctctggaaggaggggcagctccaccctgggagggactgtggcccaggtactrcccgggtgctactttatgggcagcagctcagttgagttagagtctggaagacctcagaagacctcctgtcctatgaggccctccccatggctttaggtaa

SEQ ID NO: 21237 - DNA, 201 bp, Homo sapiens
tcccaacggcaaaaaggaggaggggtgttcagaacatcaggtgcttctagagaaagcagggagagagtatctggccttgtggacaatgtcacggcagaggycaggtatagggcatgggggtaactggaagcgggatggaccctgttattccctaagacatggcttccacgtagtgctcaaacaaggcctttgcccttgctg

SEQ ID NO: 21238 - DNA, 201 bp, Homo sapiens
aggaggggcagctccaccctgggagggactgtggcccaggtactgcccgggtgctactttatgggcagcagctcagttgagttagagtctggaagacctcrgaagacctcctgtcctatgaggccctccccatggctttaggtaagctccttccactctcattttttcacctgagaaatgagagaggaaaatgtctacaat

SEQ ID NO: 21239 - DNA, 201 bp, Homo sapiens
aaatgtctacaattggtgtttatcaaatgctttcaggctctggtgagcaagcgtccaggaaaatgtcaagcgcatggagctccaggcctgtctgggggatstgggcacggggaggcatccatgggagaccatgcaggcactctgaggcaggggctgcaagcctagtgcctgctggggcagcaggtgaacagagaggtgtaa

SEQ ID NO: 21240 - DNA, 201 bp, Homo sapiens
tgggagggactgtggcccaggtactgcccgggtgctactttatgggcagcagctcagttgagttagagtctggaagacctcagaagacctcctgtcctatsaggccctccccatggctttaggtaagctccttccactctcattttttcacctgagaaatgagagaggaaaatgtctacaattggtgtttatcaaatgctt

SEQ ID NO: 21241 - DNA, 201 bp, Homo sapiens
tatcaaatgctttcaggctctggtgagcaagcgtccaggaaaatgtcaagcgcatggagctccaggcctgtctgggggatctgggcacggggaggcatccrtgggagaccatgcaggcactctgaggcaggggctgcaagcctagtgcctgctggggcagcaggtgaacagagaggtgtaactgctgtgacagaagtcatg

SEQ ID NO: 21242 - DNA, 201 bp, Homo sapiens
tggccaagcaacctctcctccctaggcctcagttttcataaaaggagggaattgaactagatatgtgtcttcatcaggctgacctgcaggagctttttacmaaaagtggcctacctcctccatccagaggttctgattcacttgatctgggtgtgggacaaggacatcatgatgccagggctgaggccctgtggaccacat

SEQ ID NO: 21243 - DNA, 201 bp, Homo sapiens
acagagaggtgtaactgctgtgacagaagtcatggagtccttggagtgtgagggtcattttccactgttgatagaatagggaaattggtgaaatagccctsttaaatgagagaaagaacagtgtgagctcaatgagaaatactaatagaatgtggcactgagccacaaggtctgagggttgattgataaggaagggtgggg

SEQ ID NO: 21244 - DNA, 201 bp, Homo sapiens
ccctgttaaatgagagaaagaacagtgtgagctcaatgagaaatactaatagaatgtggcactgagccacaaggtctgagggttgattgataaggaagggwggggactgtggagaattaagggcttggcacaggtcagttccaccagttgtcacaagagaatgcaggctcaggtggccagaacttctcgcttttccagaag

SEQ ID NO: 21245 - DNA, 201 bp, Homo sapiens
atgtaaagataaataaaatgaaataaaataggcctctaatgagcaggccattctcctttctgggtcttactttccttgcactcctttctgggtgttaagargaggtctagaggaagctggacaactcttagcttgtagtaagcacagtggaagtgtcagctcttaatgggtcatggacacgttacaagctaggcgccgtgc

SEQ ID NO: 21246 - DNA, 201 bp, Homo sapiens
cagcacagaacagggtgccaagaagagaaaagttgacggggtgcatactctgactggaaactggaagggtgagaacagagggtaaaggatagagatggaamcatgtgcatacactttgtgttaccttggacaagtcattcatttctctggacctctgctttctctctacacaatggggtcccaccacttcccttacagctg

SEQ ID NO: 21247 - DNA, 201 bp, Homo sapiens
agtgagttaatctttctaagccttgagtagtttcttcttcttcttcttcttcttcctcccccttctcctcttcttcttcctcctccttctcctcttcttcytcttcttcttcttcttcctcttcttcttcttcctcctcctcctcctcctcttcttcttcctcttcctcttcctcttcctcttcttcctcttcctcttatt

SEQ ID NO: 21248 - DNA, 201 bp, Homo sapiens
tgcactgggtgctcataagcaagctagttaacacctcagagccttggttttcccaccactaaatgcaaataataggcaatgctgagttattgcaaagttayttaatctttgcaatagccttctgtggtgagtggcatattcttattattattattagtcctagaagagtcagtgctcaaaggaatctgctttagagcctta

SEQ ID NO: 21249 - DNA, 201 bp, Homo sapiens
aggttggagctgagaaatgtggagacaatttccctttagaaggactgaatctccctgcctctctggggtgcggcagccagcaggatccaatggtgtatatrtctccccagctccccattcagtgatatcatgtcagtagcttgaaattatccgtggtgggagtattatgtcatggaaattggcaaatggaaacttttattg

SEQ ID NO: 21250 - DNA, 201 bp, Homo sapiens
ccaccactaaatgcaaataataggcaatgctgagttattgcaaagttacttaatctttgcaatagccttctgtggtgagtggcatattcttattattattrttagtcctagaagagtcagtgctcaaaggaatctgctttagagccttattgctccaagtgtggttcatgcatcagcaacatcagcatacttctggagtta

SEQ ID NO: 21251 - DNA, 201 bp, Homo sapiens
cctttagaaggactgaatctccctgcctctctggggtgcggcagccagcaggatccaatggtgtatatgtctccccagctccccattcagtgatatcatgkcagtagcttgaaattatccgtggtgggagtattatgtcatggaaattggcaaatggaaacttttattggagattcaattgttaaacttttaccagcacaa

SEQ ID NO: 21252 - DNA, 201 bp, Homo sapiens
tccaacctgggcaacaagagcaaaactctgtctcaaaataaagaaagaaataagataaaataaaaagcataaatcacacaatgcataagttttggcatacrcactagcataaagggattctcctacttataaacctagcccatctccttactctctatcacactagcccattgatgacaccaaaaactcccctcttaacac

SEQ ID NO: 21253 - DNA, 201 bp, Homo sapiens
cctgttgtcataacagaaaagtacaacaccatgatgacacatcaggctatcctggcaggttcccaggctgccccaatgcccaactttctaggtttacaaarttgacatttacgaagtttccaggtttacaaatctagtttctgattctttagtcagcaggaatttctctacaaaagctgcttcgaaaatttccagccaaac

SEQ ID NO: 21254 - DNA, 201 bp, Homo sapiens
ttcacccactctgttcctcagctttcccttcagtgggatgatatcaactggacaacaggatgtgcgattcttttagttccagccttccaggatgttttcartcccctgtttgttgttgtaggatggtattacctccaccttcccaccttccctatgccctggttctgtctcctgtgcctcgctctgaaagtggatgagacc

SEQ ID NO: 21255 - DNA, 201 bp, Homo sapiens
ggcggctgacttccaaaagggattattccaaaaagagcctcaacatgcaggcgcttattatgacttctgcttgcatcatcctattggccaaagccagtcaygtggctaagtctagccccctgtgagaggagactgcataagagtgtgaacaccaggagacacggtcactgggggccaccactgtaaccatctaccacagga

SEQ ID NO: 21256 - DNA, 201 bp, Homo sapiens
gaggaggtctagaggaagctggacaactcttagcttgtagtaagcacagtggaagtgtcagctcttaatgggtcatggacacgttacaagctaggcgccgygctgagcactttacatggtttatcccactgaaccctctcaataaccctatgaggaagggctattattgctcacattttcagaagaggaaatggatataga

SEQ ID NO: 21257 - DNA, 201 bp, Homo sapiens
acaataaaatcttgaaaatgcctatattgttgactatgtccttggccttgacaggctttgggtatagagtgctgaggaaactgaaagaccaatgtgtcttycttaccccagaggctggcgcctggcctcttctctgagagttcttttcttccttcagcctcactctccctggataacatgagagcaaatctctctgcaaaa

SEQ ID NO: 21258 - DNA, 201 bp, Homo sapiens
ccctgcctctctggggtgcggcagccagcaggatccaatggtgtatatgtctccccagctccccattcagtgatatcatgtcagtagcttgaaattatccrtggtgggagtattatgtcatggaaattggcaaatggaaacttttattggagattcaattgttaaacttttaccagcacaacactgccctgccttcagagt

SEQ ID NO: 21259 - DNA, 201 bp, Homo sapiens
cctgcctacagggagggtccctgataatccccacccaatttggaaatctgggtcagccttcacaggtactgaagccctcctctgaatgatctcaagtcctrctagggtagaggttacctgcttttgaaaggctcctggcctacctgtgcagcaggagcaaaagtgaaccatctcagggtacagataacaatcatccagagc

SEQ ID NO: 21260 - DNA, 201 bp, Homo sapiens
gaagacatgatcaccctcattctgagagtgaagagacagaggctcaactaatgaaatgatttgttcaaggtcacacgggtggcacaaggcaagtggcagargttgaatttagacccattcctgtccaaatgctgagtttatgtcatcgtcccgagaccataactttaaagatgtaagatagtgggaaaagagttgatttca

SEQ ID NO: 21261 - DNA, 201 bp, Homo sapiens
tttaggcacatgcaagatgacctgtgtatcagggagaaataggcaataaattgagatccagcagggatttgaatcatggatttgaatcaggggcagccttygaaagaactatggagaatatactcagatttaaaacataagattggaatttttggcagagaactaacaactgtacaaaaaaggaaccaaatggaaatccta

SEQ ID NO: 21262 - DNA, 201 bp, Homo sapiens
ttacagggttgttgtgaaaattaaatgcacagataatagcgtaacagtattccgtgcattgtaaagagcctgaaaaccattatgatttgaaaatggaatcrgctttgtgagaccatcactattgtaaagatgtgatgctgatagaaatgacaggactgcttgtgcatgccctctgcagtgtgacattccagcagtgaaatc

SEQ ID NO: 21263 - DNA, 201 bp, Homo sapiens
tgaaactgagaccaagacaggctctgcacattgtgtggggtaatgacacagggggattcagacctagactccataactcctgccccagggaccacccccaycctcaccctgtgcatgtcgacaaaggacagactgggccacttctcaggacacagcggggaaatgacacagagcagggaggttccaggagccccgagcgtc

SEQ ID NO: 21264 - DNA, 201 bp, Homo sapiens
atttactatctcgtcctttacagaatgtttgccaatctatggtccggagtccaaggctgtccatttttcaaagaacacaaagtgacatgagactgtcccakgtgcagggagccctatcattttattatgaaaaaacggcctttctgctcaaatctgttttttaaaaagtcaacaaacagactctgggtacctgtcaggaac

SEQ ID NO: 21265 - DNA, 201 bp, Homo sapiens
tattcctggtactggcttagtttgaggcagctgcccaccgtaagtccagtgagccatggcctggggacaaggtcaggtacatgtgtaatcagctgggtctrtgagttgtggtggtggcgatggaggtagctcccagaaaaatggattacaggttaagaagagtctatatatcttgaccacatttgatgtgacttggaagtt

SEQ ID NO: 21266 - DNA, 201 bp, Homo sapiens
ggttgaaagtgacaacagcaagggtttctctttttggaaatgcgaggagggtatttccgcttctcgcagtggggcagggtggcagacgcctagcttgggtragtgactatttctttataaaccacaactctgggcccgcaatggcagtccactgccttgctgcagtcacagaatggaaatctgcagaggcctccgcagtca

SEQ ID NO: 21267 - DNA, 201 bp, Homo sapiens
ctcaatgagaaatactaatagaatgtggcactgagccacaaggtctgagggttgattgataaggaagggtggggactgtggagaattaagggcttggcacwggtcagttccaccagttgtcacaagagaatgcaggctcaggtggccagaacttctcgcttttccagaagagtccgatattctgatttcattatatatagt

SEQ ID NO: 21268 - DNA, 201 bp, Homo sapiens
cttgtgtttcaaaatatcccagatgtggatagtgcgaccggagggctgtcttactttcccagagactcaggaacccagtgagtaatagatgcatgccaagkagtgggactgcgattcaggcctagttgaatgtgctgacagagaagcagagaggggcaccaggggcacagcccgaaggcccagactgatatgggcaaggcc

SEQ ID NO: 21269 - DNA, 201 bp, Homo sapiens
tactaatagaatgtggcactgagccacaaggtctgagggttgattgataaggaagggtggggactgtggagaattaagggcttggcacaggtcagttccascagttgtcacaagagaatgcaggctcaggtggccagaacttctcgcttttccagaagagtccgatattctgatttcattatatatagtattctgattaaa

SEQ ID NO: 21270 - DNA, 201 bp, Homo sapiens
tttcaaaatatcccagatgtggatagtgcgaccggagggctgtcttactttcccagagactcaggaacccagtgagtaatagatgcatgccaaggagtggractgcgattcaggcctagttgaatgtgctgacagagaagcagagaggggcaccaggggcacagcccgaaggcccagactgatatgggcaaggcctgtctg

SEQ ID NO: 21271 - DNA, 201 bp, Homo sapiens
gagactcaggaacccagtgagtaatagatgcatgccaaggagtgggactgcgattcaggcctagttgaatgtgctgacagagaagcagagaggggcaccargggcacagcccgaaggcccagactgatatgggcaaggcctgtctgtgctgacatgtcggagggtcccactctccagggaccttggtttccccgtctgtga

SEQ ID NO: 21272 - DNA, 201 bp, Homo sapiens
aaggagtgggactgcgattcaggcctagttgaatgtgctgacagagaagcagagaggggcaccaggggcacagcccgaaggcccagactgatatgggcaargcctgtctgtgctgacatgtcggagggtcccactctccagggaccttggtttccccgtctgtgacatctgtgacatgagagtcacgataactccttgtgt

SEQ ID NO: 21273 - DNA, 201 bp, Homo sapiens
ctgttagattctgggcttggtctctggagtccaagaggcaggccccagtgaggtcatgcacttgctgtctgattttggccaagtcacctccctttgtgggractgttcctcatttgtttgaggggaatgttgatttggatggggattttccaaacagagctccttggacccttccctctaaggtctctggaaatgggaaac

SEQ ID NO: 21274 - DNA, 201 bp, Homo sapiens
ctgcctgttctgtgaggagtggggatggctaggacattgcatggaacacaccaccaccccatcttctcagagctcaaaccctgacagaacaccagctccaraggccttggcttctgctgatggtgccgtgtatttaccagacttagtggtccaaggccagagtggccagatttcccaaagtcaaggtgtgacagtgggaca

SEQ ID NO: 21275 - DNA, 201 bp, Homo sapiens
accccagaggctggcgcctggcctcttctctgagagttcttttcttccttcagcctcactctccctggataacatgagagcaaatctctctgcaaaaaagytatggggcagcactgtccacaacagcctctactggaaacaacccaagcacccatcacagaatgaattagtacatcatgtatctgcacacaacacagtgct

SEQ ID NO: 21276 - DNA, 201 bp, Homo sapiens
tgctctgttcttgggaatccatggagggaagatgtgcctgtcctgtgtcaagtctggtgatgagaccagactccagctggaggtaaaaacatgctttggakctcaaatcaccccaaaacccagtggcttgaaacaaccaaaattttttcttatgattctgtgggttgaccaggattagctgggtagttctgttccatgtgg

SEQ ID NO: 21277 - DNA, 201 bp, Homo sapiens
ctctcacctgcccatcttttgatttccaggcagttaacatcactgacctgagcgagaacagaaagcaggacaagcgcttcgccttcatccgctcagacagyggccccaccaccagttttgagtctgccgcctgccccggttggttcctctgcacagcgatggaagctgaccagcccgtcagcctcaccaatatgcctgacg

SEQ ID NO: 21278 - DNA, 201 bp, Homo sapiens
caagggcctgtgtaaatgcatgtgatttacagagcattttatgtactgcgtgtcattcatgcttccggtgagccctaagtctaagatagggcagatagcaycaggtccattttgcagctgtcaaaatgaggtctgaagggcagaagtggtgtgcccacacacacacaactggttggctgcagacctggggactagacccgg

SEQ ID NO: 21279 - DNA, 201 bp, Homo sapiens
ttggttttcccaccactaaatgcaaataataggcaatgctgagttattgcaaagttacttaatctttgcaatagccttctgtggtgagtggcatattcttmttattattattagtcctagaagagtcagtgctcaaaggaatctgctttagagccttattgctccaagtgtggttcatgcatcagcaacatcagcatactt

SEQ ID NO: 21280 - DNA, 201 bp, Homo sapiens
tcaaacaaggcctttgcccttgctgttccctccacctggaatattcttccccttccttgacattgctcaggtctccactcttatgtcaccctctcagagasggcttccctggccactttccctaaaatagccacccactcctaggtccctcaaaagcatatcctgctttggattttccctatagcaatatgccctatgaag

SEQ ID NO: 21281 - DNA, 201 bp, Homo sapiens
tgaggaggtcatccaacatctctgagttttctctttcttgtatataaaatggaagtagctggcagggcagggcatgtgtcgttgatatatttttaatcctrgtaaaaggaggaggttcaaggcagaaaactcatcaaagcttaatgacaacaatagcagctaacatttgtgaggctctaaggtaaaacccaaggctaagac

SEQ ID NO: 21282 - DNA, 201 bp, Homo sapiens
cactttccctaaaatagccacccactcctaggtccctcaaaagcatatcctgctttggattttccctatagcaatatgccctatgaagttattttatttgytaacttgtttcttgtctgttttcctttgttagagcgttggggaccttgtctggcttgttcccaatgcctggaagagtgcctggcacacaggattaagcca

SEQ ID NO: 21283 - DNA, 201 bp, Homo sapiens
ctgaaaaccattatgatttgaaaatggaatcggctttgtgagaccatcactattgtaaagatgtgatgctgatagaaatgacaggactgcttgtgcatgcyctctgcagtgtgacattccagcagtgaaatcatgttggggtgacttctcccccactctgacctttatgtttgtctgggccgaggctgcaagtcgggctct

SEQ ID NO: 21284 - DNA, 201 bp, Homo sapiens
gttggggaccttgtctggcttgttcccaatgcctggaagagtgcctggcacacaggattaagccaacacatatgttttgaatgaatgtgtgcacacatgcmtgagctggcggcagtcggggttggggtaagcacgaaggcccagctcagttctctgcatgtgacctcccatcttacgcagataagaaccagtttggtttct

SEQ ID NO: 21285 - DNA, 201 bp, Homo sapiens
caggctggccggagctctgtttattacgtctcacagctttgagtcctgctctcaaccagagaggccctttaccaagaagaaaggattgggacccagaatcwggtcactggctgaggtagagaggaagccgggttgttcccaagggtagctgctcctgcaggactctgagcaggtcaccagctaatggaggaaaggctctag

SEQ ID NO: 21286 - DNA, 201 bp, Homo sapiens
ctaagccttgagtagtttcttcttcttcttcttcttcttcctcccccttctcctcttcttcttcctcctccttctcctcttcttcttcttcttcttcttcytcctcttcttcttcttcctcctcctcctcctcctcttcttcttcctcttcctcttcctcttcctcttcttcctcttcctcttattcttcttcgtcgtctt

SEQ ID NO: 21287 - DNA, 201 bp, Homo sapiens
aaccagaagaccttctatctgaggaacaaccaactagttgctggatacttgcaaggaccaaatgtcaatttagaaggtgagtggttgccaggaaagccaaygtatgtgggcatcacgtcactttgcccgtctgtctgcagcagcatggcctgcctgcacaaaccctaggtgcaatgtcctaatccttgttgggtctttgta

SEQ ID NO: 21288 - DNA, 201 bp, Homo sapiens
agccttgagtagtttcttcttcttcttcttcttcttcctcccccttctcctcttcttcttcctcctccttctcctcttcttcttcttcttcttcttcttcytcttcttcttcttcctcctcctcctcctcctcttcttcttcctcttcctcttcctcttcctcttcttcctcttcctcttattcttcttcgtcgtcttcgt

SEQ ID NO: 21289 - DNA, 201 bp, Homo sapiens
gctaggacattgcatggaacacaccaccaccccatcttctcagagctcaaaccctgacagaacaccagctccacaggccttggcttctgctgatggtgccrtgtatttaccagacttagtggtccaaggccagagtggccagatttcccaaagtcaaggtgtgacagtgggacagcctctttgtgtctttgctgtcctaag

SEQ ID NO: 21290 - DNA, 201 bp, Homo sapiens
gttgccaggaaagccaatgtatgtgggcatcacgtcactttgcccgtctgtctgcagcagcatggcctgcctgcacaaaccctaggtgcaatgtcctaatmcttgttgggtctttgtattcaagtttgaagctgggagggcctggctactgaagggcacatatgagggcagcctgaagagggtgtggagaggtagagtcta

SEQ ID NO: 21291 - DNA, 201 bp, Homo sapiens
tttcttcttcttcttcttcttcttcctcccccttctcctcttcttcttcctcctccttctcctcttcttcttcttcttcttcttcttcctcttcttcttcytcctcctcctcctcctcctcttcttcttcctcttcctcttcctcttcctcttcttcctcttcctcttattcttcttcgtcgtcttcgtcttctttttatt

SEQ ID NO: 21292 - DNA, 201 bp, Homo sapiens
gggcatcacgtcactttgcccgtctgtctgcagcagcatggcctgcctgcacaaaccctaggtgcaatgtcctaatccttgttgggtctttgtattcaagyttgaagctgggagggcctggctactgaagggcacatatgagggcagcctgaagagggtgtggagaggtagagtctaggtcagaggtcagtgcctataggc

SEQ ID NO: 21293 - DNA, 201 bp, Homo sapiens
gttaagaggaggtctagaggaagctggacaactcttagcttgtagtaagcacagtggaagtgtcagctcttaatgggtcatggacacgttacaagctaggmgccgtgctgagcactttacatggtttatcccactgaaccctctcaataaccctatgaggaagggctattattgctcacattttcagaagaggaaatggat

SEQ ID NO: 21294 - DNA, 201 bp, Homo sapiens
catcacgtcactttgcccgtctgtctgcagcagcatggcctgcctgcacaaaccctaggtgcaatgtcctaatccttgttgggtctttgtattcaagtttraagctgggagggcctggctactgaagggcacatatgagggcagcctgaagagggtgtggagaggtagagtctaggtcagaggtcagtgcctataggcaca

SEQ ID NO: 21295 - DNA, 201 bp, Homo sapiens
agaggaggtctagaggaagctggacaactcttagcttgtagtaagcacagtggaagtgtcagctcttaatgggtcatggacacgttacaagctaggcgccktgctgagcactttacatggtttatcccactgaaccctctcaataaccctatgaggaagggctattattgctcacattttcagaagaggaaatggatatag

SEQ ID NO: 21296 - DNA, 201 bp, Homo sapiens
atgagggcagcctgaagagggtgtggagaggtagagtctaggtcagaggtcagtgcctataggcacagtggtcccagggccacagctgggaagggcaaatmccagaaggcaaggttgaccattcccttcctcaagtgcctattaaggctccatgttcctatgttgttcaaaccctaactcaatcccaaattaatccaccat

SEQ ID NO: 21297 - DNA, 201 bp, Homo sapiens
tcccaaattaatccaccatgtataaggttgagctatgtctcttattcctggacaccatactcagccatattctggtccacacattaaacaagctggatgaycttgaagaagcttcacccactctgttcctcagctttcccttcagtgggatgatatcaactggacaacaggatgtgcgattcttttagttccagccttcca

SEQ ID NO: 21298 - DNA, 201 bp, Homo sapiens
ttctgattctttagtcagcaggaatttctctacaaaagctgcttcgaaaatttccagccaaaccttacacaccttggcattacatcttggtgagccaaggyggaagagaacaggaagtgaaggccccatgggaagtccctgcggtcgggagcacccaggcggggcggggggtggggggctttcctgtggccggctccctgc

SEQ ID NO: 21299 - DNA, 201 bp, Homo sapiens
gaaacaggtggtgcagagagaagcaaggccatgctctgtctgaaggcccagtgacacttggcccctgcgagagagagtggcaggcaggagcacctgggggyttttagggtccagacaacattctatttcttggcatggatgcagttaggcggttttctgtatgtatattttatttcacaatacctagaaaataaaaagact

SEQ ID NO: 21300 - DNA, 201 bp, Homo sapiens
gcttgcgctgggcatccaaggtggtccctcatcctccaggctctctttccatgtgatctctcagtgtttaagagttagttggagcttccttacagcatggyggctgacttccaaaagggattattccaaaaagagcctcaacatgcaggcgcttattatgacttctgcttgcatcatcctattggccaaagccagtcacgt

SEQ ID NO: 21301 - DNA, 201 bp, Homo sapiens
gtggaggttgcagtgagccgagattgtgccactgcactccagcctaggcgacagagcaagactccgtctcgggaaaattaattaataaataaataaacctrggtcccagagtcccacagaatggcagacaggagcacctgggggcttttagggtatggcatttcccctgtactaactctgggctgtccagagggccatttc

SEQ ID NO: 21302 - DNA, 201 bp, Homo sapiens
tggcacaggtcagttccaccagttgtcacaagagaatgcaggctcaggtggccagaacttctcgcttttccagaagagtccgatattctgatttcattatrtatagtattctgattaaaccagacaataaagcaagcagataaaatatttaaattataagctgccagtttgcaacctccggttaggatttgtgtggggcaa

SEQ ID NO: 21303 - DNA, 201 bp, Homo sapiens
agttgtcacaagagaatgcaggctcaggtggccagaacttctcgcttttccagaagagtccgatattctgatttcattatatatagtattctgattaaacmagacaataaagcaagcagataaaatatttaaattataagctgccagtttgcaacctccggttaggatttgtgtggggcaaagaaaaaaactctcaggatc

SEQ ID NO: 21304 - DNA, 201 bp, Homo sapiens
agaacttctcgcttttccagaagagtccgatattctgatttcattatatatagtattctgattaaaccagacaataaagcaagcagataaaatatttaaaktataagctgccagtttgcaacctccggttaggatttgtgtggggcaaagaaaaaaactctcaggatcattggtatgtagactctaattttaagtttctaa

SEQ ID NO: 21305 - DNA, 201 bp, Homo sapiens
taagttaaccatgtagatctgagaggagagtagcttcttgtagataacagttggattatataccatgtcctgatccccttcatcatccaggagagcagagrtggtcaccctgatagcagcaagcctgggggctgcagcttggtgggtagaggtactcaggggtacagatgtctccaaacctgtcctgctgccttagggagc

SEQ ID NO: 21306 - DNA, 201 bp, Homo sapiens
cccctgaggctgggcgtggtggctcacacctgtaatcccagcattttgggaggccaaggtgggtggatctcttgaggtcaagagttcaaggcctgcctggycaacatggtgaaaccctgtctctattaaaaatacaaaaattagctgggcatggtggtgcatgtctgcaatcttagctacttgggtagctaaggcaggaga

SEQ ID NO: 21307 - DNA, 201 bp, Homo sapiens
tggatctcttgaggtcaagagttcaaggcctgcctggccaacatggtgaaaccctgtctctattaaaaatacaaaaattagctgggcatggtggtgcatgyctgcaatcttagctacttgggtagctaaggcaggagaattgctggaacccgggaggtagaggttgcagtgaatggagatcacaccactgcactccagtct

SEQ ID NO: 21308 - DNA, 201 bp, Homo sapiens
gaggtcaagagttcaaggcctgcctggccaacatggtgaaaccctgtctctattaaaaatacaaaaattagctgggcatggtggtgcatgtctgcaatctyagctacttgggtagctaaggcaggagaattgctggaacccgggaggtagaggttgcagtgaatggagatcacaccactgcactccagtctgggcaataga

SEQ ID NO: 21309 - DNA, 201 bp, Homo sapiens
ccctgtctctattaaaaatacaaaaattagctgggcatggtggtgcatgtctgcaatcttagctacttgggtagctaaggcaggagaattgctggaacccrggaggtagaggttgcagtgaatggagatcacaccactgcactccagtctgggcaatagagagagacgctctctctaaaaaaaaatatgtaaagataaata

SEQ ID NO: 21310 - DNA, 201 bp, Homo sapiens
agacgctctctctaaaaaaaaatatgtaaagataaataaaatgaaataaaataggcctctaatgagcaggccattctcctttctgggtcttactttccttrcactcctttctgggtgttaagaggaggtctagaggaagctggacaactcttagcttgtagtaagcacagtggaagtgtcagctcttaatgggtcatggac

SEQ ID NO: 21311 - DNA, 201 bp, Homo sapiens
cctttctgggtcttactttccttgcactcctttctgggtgttaagaggaggtctagaggaagctggacaactcttagcttgtagtaagcacagtggaagtrtcagctcttaatgggtcatggacacgttacaagctaggcgccgtgctgagcactttacatggtttatcccactgaaccctctcaataaccctatgaggaa

SEQ ID NO: 21312 - DNA, 201 bp, Homo sapiens
atagagagattagataatttgcccatggccagacagctagtataagaggaggaggtggattgactgcagacattctgtcttcaaaccactacactatgctrtgggggcacagagacttaatgaaatcatggagaggggaattgctttgtcaaccacaagcagttattccgggggcagcagatcctcccctgtcccccagtg

SEQ ID NO: 21313 - DNA, 201 bp, Homo sapiens
gttaatgggtttcccagccctgggaaaacatggctttgtctcaggggcttgctggatgcaaccttaacctcaatgtgagtggccatactgtggcactgtcmcatccctcaccagggacactgttctggagggtgactgcctgttctgtgaggagtggggatggctaggacattgcatggaacacaccaccaccccatcttc

SEQ ID NO: 21314 - DNA, 201 bp, Homo sapiens
gctccacccagagccctgtgctcctttatctcatgtaatgttaatgggtttcccagccctgggaaaacatggctttgtctcaggggcttgctggatgcaascttaacctcaatgtgagtggccatactgtggcactgtcccatccctcaccagggacactgttctggagggtgactgcctgttctgtgaggagtggggatg

SEQ ID NO: 21315 - DNA, 201 bp, Homo sapiens
gagtcaatgaccctatccaagtttaatccatctgtccactgtctccaacacgatctttataaaacacacctgacaacattacccttttattcagttttttwaaagataagtttccagctcatcggggtggctttaaaggccatttctcctctggacctcacccaacttttcaaatcacttttcctacccctacctctaaat

SEQ ID NO: 21316 - DNA, 201 bp, Homo sapiens
ttgagcattcatggaacttggtgggggagatgaaatttgtaccttaaatcctgcctacagggagggtccctgataatccccacccaatttggaaatctggktcagccttcacaggtactgaagccctcctctgaatgatctcaagtcctgctagggtagaggttacctgcttttgaaaggctcctggcctacctgtgcagc

SEQ ID NO: 21317 - DNA, 201 bp, Homo sapiens
gagcctcaacatgcaggcgcttattatgacttctgcttgcatcatcctattggccaaagccagtcacgtggctaagtctagccccctgtgagaggagactrcataagagtgtgaacaccaggagacacggtcactgggggccaccactgtaaccatctaccacaggacctgaatctctgtgtgctactcccttgctcaagg

SEQ ID NO: 21318 - DNA, 201 bp, Homo sapiens
ccgcagtcacctaatcactctcctcctcttcctgttccattcagagacgatctgccgaccctctgggagaaaatccagcaagatgcaagccttcaggtaargctaccccaaggaggagaaggtgagggtggatcagctggagactggaaacatatcacagctgccaggggctgccaggccccagagggcctgagaactggg

SEQ ID NO: 21319 - DNA, 201 bp, Homo sapiens
attgaacacttcccatgtggacagctgtgctaaacactttacaggcatcaacataagatgtgtccccttacagcagtgcagtgtccctcctaagacatggwcagcctggtttccctatctctctgcttcatcaaaacccctttacgtggggcttagacactcctgttgtctctagtgtctagtagcacagggctcagcaca

SEQ ID NO: 21320 - DNA, 201 bp, Homo sapiens
ctcagtgtttaagagttagttggagcttccttacagcatggcggctgacttccaaaagggattattccaaaaagagcctcaacatgcaggcgcttattatracttctgcttgcatcatcctattggccaaagccagtcacgtggctaagtctagccccctgtgagaggagactgcataagagtgtgaacaccaggagacac

SEQ ID NO: 21321 - DNA, 201 bp, Homo sapiens
caacactccattgcgacacttagtggggttgaaagtgacaacagcaagggtttctctttttggaaatgcgaggagggtatttccgcttctcgcagtggggyagggtggcagacgcctagcttgggtgagtgactatttctttataaaccacaactctgggcccgcaatggcagtccactgccttgctgcagtcacagaatg

SEQ ID NO: 21322 - DNA, 201 bp, Homo sapiens
ttcagacctagactccataactcctgccccagggaccacccccaccctcaccctgtgcatgtcgacaaaggacagactgggccacttctcaggacacagcrgggaaatgacacagagcagggaggttccaggagccccgagcgtcttttctccaggagaatactctctgaattcagactggggtcagagaaacatttaccc

SEQ ID NO: 21323 - DNA, 201 bp, Homo sapiens
gcgctgggcatccaaggtggtccctcatcctccaggctctctttccatgtgatctctcagtgtttaagagttagttggagcttccttacagcatggcggckgacttccaaaagggattattccaaaaagagcctcaacatgcaggcgcttattatgacttctgcttgcatcatcctattggccaaagccagtcacgtggct

SEQ ID NO: 21324 - DNA, 201 bp, Homo sapiens
gcacaaggcaagtggcagaggttgaatttagacccattcctgtccaaatgctgagtttatgtcatcgtcccgagaccataactttaaagatgtaagatagkgggaaaagagttgatttcaaagcacctctcagaaggactcactttacatcaggggtcagcagactcaggccaaatccggtccattccccgcttttgcaaa

SEQ ID NO: 21325 - DNA, 201 bp, Homo sapiens
ctgtgggttgaccaggattagctgggtagttctgttccatgtggtggaacatgctggggtcactttggaagctgcattcagcagagtgcctggcttgcgcygggcatccaaggtggtccctcatcctccaggctctctttccatgtgatctctcagtgtttaagagttagttggagcttccttacagcatggcggctgact

SEQ ID NO: 21326 - DNA, 201 bp, Homo sapiens
tccctgtgaaagcccctggcctcagaaaaggaagctggtttaagtgaccaacatttggggtggagcttccgagggcccagccaccgtgttacatgcaacamtcaacagagatattctttggctagagttgtttttctgggtataggaccctataattaaaatcagctctccaacttcccttcctccaaaaagtatacaatg

SEQ ID NO: 21327 - DNA, 201 bp, Homo sapiens
cagagtcccacagaatggcagacaggagcacctgggggcttttagggtatggcatttcccctgtactaactctgggctgtccagagggccatttcatggcrtggagtggagagggaggcagcacaggacttcctaggcctcagctctcacctgcccatcttttgatttccaggcagttaacatcactgacctgagcgagaa

SEQ ID NO: 21328 - DNA, 201 bp, Homo sapiens; identical to SEQ ID NO: 2286

SEQ ID NO: 21329 - DNA, 201 bp, Homo sapiens
tctgggtataggaccctataattaaaatcagctctccaacttcccttcctccaaaaagtatacaatgtaaggaggaaaatgcaaattgaaaagttgctagyccttcccgccagaatgccaccccaagcctcccctgcaggaagttctggagtccccaactctgccccaagcctgaggcccttgataaggtaaagggatgtg

SEQ ID NO: 21330 - DNA, 201 bp, Homo sapiens; identical to SEQ ID NO: 2287

SEQ ID NO: 21331 - DNA, 201 bp, Homo sapiens
taaaatcagctctccaacttcccttcctccaaaaagtatacaatgtaaggaggaaaatgcaaattgaaaagttgctagcccttcccgccagaatgccaccycaagcctcccctgcaggaagttctggagtccccaactctgccccaagcctgaggcccttgataaggtaaagggatgtgagtgtggaggccggagcccccc

SEQ ID NO: 21332 - DNA, 201 bp, Homo sapiens; identical to SEQ ID NO: 2289

SEQ ID NO: 21333 - DNA, 201 bp, Homo sapiens
gcctgcacaaaccctaggtgcaatgtcctaatccttgttgggtctttgtattcaagtttgaagctgggagggcctggctactgaagggcacatatgagggyagcctgaagagggtgtggagaggtagagtctaggtcagaggtcagtgcctataggcacagtggtcccagggccacagctgggaagggcaaataccagaag

SEQ ID NO: 21334 - DNA, 201 bp, Homo sapiens
aaattgctaagagggtatatcttatatgttcttaccaataataataataatggtaataattaaggggcaggaggacacttcaaaaggtgatggatatgttwatggccttgatggtggtgatggtttcatgagagtatacttatccccaaactaattgagatgtaaatattaaatatgtacagctttttgtatgtcaatcgt

SEQ ID NO: 21335 - DNA, 201 bp, Homo sapiens
tcttatgattctgtgggttgaccaggattagctgggtagttctgttccatgtggtggaacatgctggggtcactttggaagctgcattcagcagagtgccwggcttgcgctgggcatccaaggtggtccctcatcctccaggctctctttccatgtgatctctcagtgtttaagagttagttggagcttccttacagcatg

SEQ ID NO: 21336 - DNA, 201 bp, Homo sapiens; identical to SEQ ID NO: 2290

SEQ ID NO: 21337 - DNA, 201 bp, Homo sapiens
aattgctaagagggtatatcttatatgttcttaccaataataataataatggtaataattaaggggcaggaggacacttcaaaaggtgatggatatgtttwtggccttgatggtggtgatggtttcatgagagtatacttatccccaaactaattgagatgtaaatattaaatatgtacagctttttgtatgtcaatcgta

SEQ ID NO: 21338 - DNA, 201 bp, Homo sapiens; identical to SEQ ID NO: 2291

SEQ ID NO: 21339 - DNA, 201 bp, Homo sapiens
agctcccagaaaaatggattacaggttaagaagagtctatatatcttgaccacatttgatgtgacttggaagtttcaatgtgtgaccacttacaaagttakgatcaggtgtctcatttatttatggtgatgtatgagtccgtgtgtgagtgtgtgtgtgtctgtgtttgtgtgtgtgtgtgagagagagagagagaatgag

SEQ ID NO: 21340 - DNA, 201 bp, Homo sapiens; identical to SEQ ID NO: 2293

SEQ ID NO: 21341 - DNA, 201 bp, Homo sapiens
ggatttacagtcatcagaattgtaaaactgatcccatgtattttcaaacctcaaatcccttgctctgaccttgtgtgtctaagctagaaggaagcaggatscacctctcccctggctggaatgaagggattcacccaagctctcagtcttctcacggcatccagggcccccctgcttgtgtgtggtctagatttccattcc

SEQ ID NO: 21342 - DNA, 201 bp, Homo sapiens
tgcaaagttccctacttcctgtgacttcagctctgttttacaataaaatcttgaaaatgcctatattgttgactatgtccttggccttgacaggctttggrtatagagtgctgaggaaactgaaagaccaatgtgtctttcttaccccagaggctggcgcctggcctcttctctgagagttcttttcttccttcagcctca

SEQ ID NO: 21343 - DNA, 201 bp, Homo sapiens
gccagcactttatatagcacaaggcaggggccatggattaggaaatccaggcctggggttcatgcttaagtgaggcttttgttcaactgggaggcggtgcmcaggtgactgggaggtggaggggctgagatgggaaagaaaagcacagagagggaagacaagcaagcctcaagaggattgtggcttcttccgtcacttctg

SEQ ID NO: 21344 - DNA, 201 bp, Homo sapiens
agagattagataatttgcccatggccagacagctagtataagaggaggaggtggattgactgcagacattctgtcttcaaaccactacactatgctatggrggcacagagacttaatgaaatcatggagaggggaattgctttgtcaaccacaagcagttattccgggggcagcagatcctcccctgtcccccagtgggta

SEQ ID NO: 21345 - DNA, 201 bp, Homo sapiens
atggtccctggtgggttgtgctacaatgttagcccatggtcttatgtgtttttcaaatgtgtaaagtaggatgctggaaccactcttagaaccagataccratacattgtgaagaaataaatctctgtgcttaaaactggttcatcccaaaatattttgaactgacacacaataggtgctaaataaatgtgtgttaacttg

SEQ ID NO: 21346 - DNA, 201 bp, Homo sapiens
tgtgtgttaacttgaattggattgaattcgggaaaaaagtgcaataagcttagtgaagacaccatgttccctgggtagaggaaccacattctccatctaakgccaggagtatgggaggtatcaatgtttgcccagcacagaacagggtgccaagaagagaaaagttgacggggtgcatactctgactggaaactggaaggg

SEQ ID NO: 21347 - DNA, 201 bp, Homo sapiens
accacattctccatctaaggccaggagtatgggaggtatcaatgtttgcccagcacagaacagggtgccaagaagagaaaagttgacggggtgcatactckgactggaaactggaagggtgagaacagagggtaaaggatagagatggaaccatgtgcatacactttgtgttaccttggacaagtcattcatttctctgga

SEQ ID NO: 21348 - DNA, 201 bp, Homo sapiens
gtttgcccagcacagaacagggtgccaagaagagaaaagttgacggggtgcatactctgactggaaactggaagggtgagaacagagggtaaaggatagasatggaaccatgtgcatacactttgtgttaccttggacaagtcattcatttctctggacctctgctttctctctacacaatggggtcccaccacttccctt

SEQ ID NO: 21349 - DNA, 201 bp, Homo sapiens
cacaatggggtcccaccacttcccttacagctgacttgtatgaagaaggaggtggaggaggaggagaaggtgaagacaatgctgactcaaagggtaaattmtttttaggatccaagtttgaaaacaattttaggctactagatatgaacaacatcttgattatgtagttgaaggaaattaaagatgaatggtttaattaaa

SEQ ID NO: 21350 - DNA, 201 bp, Homo sapiens
aggccccagtgaggtcatgcacttgctgtctgattttggccaagtcacctccctttgtggggactgttcctcatttgtttgaggggaatgttgatttggayggggattttccaaacagagctccttggacccttccctctaaggtctctggaaatgggaaaccctgcagaggggaggataaatgggccaggattcatccct

SEQ ID NO: 21351 - DNA, 201 bp, Homo sapiens
ccttctcctcttcttcttcctcctccttctcctcttcttcttcttcttcttcttcttcctcttcttcttcttcctcctcctcctcctcctcttcttcttcytcttcctcttcctcttcctcttcttcctcttcctcttattcttcttcgtcgtcttcgtcttctttttattttcaaagtgaaagcaagtttattaagaaag

SEQ ID NO: 21352 - DNA, 201 bp, Homo sapiens
gtgtggtgtgtcctgtgacactcaggattcaagtgttggccgaagccactaaatgtgagatgaagccattacaaggcagtgtgcacatctgtccacccaarctggatgccaacatttcacaaatagtgcttgcgtgacacaaatgcagttccaggaggcccaaatgaaaatgtttgtactgaaatttgttaaagcttcccg

SEQ ID NO: 21353 - DNA, 201 bp, Homo sapiens
tccatctgtccactgtctccaacacgatctttataaaacacacctgacaacattacccttttattcagttttttaaaagataagtttccagctcatcgggstggctttaaaggccatttctcctctggacctcacccaacttttcaaatcacttttcctacccctacctctaaatgctactcaaactccagccatcctgaa

SEQ ID NO: 21354 - DNA, 201 bp, Homo sapiens
tatttcttaccgttctggggactgggaagtgacccggcatctggggacggcagagggtatcacacggcgagagggcaagagcgtgtatgtcgtttcaggcytctcttcctattcttataaagccaccagtcgcatcctgggggtctcaccccgatgaccttatctaatcctaattaccgtctcagaggctgcgcctccaat

SEQ ID NO: 21355 - DNA, 201 bp, Homo sapiens
gtggagcgcagtctacgggagggccactacgctcagcgcctgagtcgcacggcgccggtctacctcgctgcggttattgagtacctgacggccaaggtccyggagctggcgggcaacgaggcccagaacagcggagagcggaacatcactcccctgctgctggacatggtggttcacaacgacaggctactgagcaccctt

SEQ ID NO: 21356 - DNA, 201 bp, Homo sapiens
ataagttttagaagcccacagccaaaatacaatcaaccgaattaaaaaatgggcaaagggcttgaatagacattcctccaaagcagaggtacagagggccragaagcacatgaaaagatgtcttagtctgttttctgttgccataattgaatacccgacactgaacaatttataaagaaaagaaatttatttcttaccgtt

SEQ ID NO: 21357 - DNA, 201 bp, Homo sapiens
gtgagatgggttggggggttgtgagacctccacagctggagggatggagaggtggtgggggtctggggttgggtgggagccagggatggcacagaggagcmgtctctccgggtgacagtgcaggggagtggccctgggtgggaaggggacacccccgctggttctgagcaagtcagggcctgcccgggaaagtcctcagca

SEQ ID NO: 21358 - DNA, 201 bp, Homo sapiens
acgcggtaactgtcctcttgagagccatcttgcctagctgggccaagccgagatagcacactcaacgcccagcatgccgaggaggaggagacgccgagggycctccggtgctggcggccgggggcggacctgctctcgcaccgtccgagcggagctttcgttttcagtgagccaggtggagcgcagtctacgggagggcca

SEQ ID NO: 21359 - DNA, 201 bp, Homo sapiens
cgcggtaactgtcctcttgagagccatcttgcctagctgggccaagccgagatagcacactcaacgcccagcatgccgaggaggaggagacgccgagggtyctccggtgctggcggccgggggcggacctgctctcgcaccgtccgagcggagctttcgttttcagtgagccaggtggagcgcagtctacgggagggccac

SEQ ID NO: 21360 - DNA, 201 bp, Homo sapiens
gatgtatactctgaaaatttcaagacgttgctaaaataaattaaagaagacctaaataaatcgaaaggcattttgtgttaacggattgggacacttaataytgttaagatgcccataatctccaaggcaatatacagattcatcgtgatgcctgtcagaatccaacctgccttctttgtaaaaactgacaagctgatccta

SEQ ID NO: 21361 - DNA, 201 bp, Homo sapiens; identical to SEQ ID NO: 2364

SEQ ID NO: 21362 - DNA, 201 bp, Homo sapiens; identical to SEQ ID NO: 2366

SEQ ID NO: 21363 - DNA, 201 bp, Homo sapiens
gggtggggacggagaggtggacccggtgcttggcaaggggccctggaccggaagacggaggactgagtagtcggggcggggggggggggggacaacagtcyagaaatgcgcagacatggaattagggtcacgagtttcctttgggtcatgttcagatggagaggctgtgggatgcctttagcaacctagaccacttgcatt

SEQ ID NO: 21364 - DNA, 201 bp, Homo sapiens
gagctggcgggcaacgaggcccagaacagcggagagcggaacatcactcccctgctgctggacatggtggttcacaacgacaggctactgagcaccctttkcaacacgaccaccatctctcaagtggcccctggcgaggactagcttctgacacccggcccctgggacctgacaggtccactcgtccacccacccggcccc

SEQ ID NO: 21365 - DNA, 201 bp, Homo sapiens
ccccgctggttctgagcaagtcagggcctgcccgggaaagtcctcagcatgatggtgttcgttggggcgggtgggcctcaagaccatgactgcagtgttgsgacaggacggacttctaaggcaaccggggtggggacggagaggtggacccggtgcttggcaaggggccctggaccggaagacggaggactgagtagtcgg

SEQ ID NO: 21366 - DNA, 201 bp, Homo sapiens
ggggtggggacggagaggtggacccggtgcttggcaaggggccctggaccggaagacggaggactgagtagtcggggcggggggggggggggacaacagtscagaaatgcgcagacatggaattagggtcacgagtttcctttgggtcatgttcagatggagaggctgtgggatgcctttagcaacctagaccacttgcat

SEQ ID NO: 21367 - DNA, 201 bp, Homo sapiens
agacacacacggcctcacatttggtcgtataattccatctataggaaatctccagaacaggctaacctctatggacagaaagcagatggactaggggttgycagggactatcgggaacgtgtgtatgggcgggggcagggggtgtgtgtgggagggtgtgggggctggtagtggtggtgtggaaggaggcgtgcggcaagt

SEQ ID NO: 21368 - DNA, 201 bp, Homo sapiens
ccaagaagcacatgaaaagatgtcttagtctgttttctgttgccataattgaatacccgacactgaacaatttataaagaaaagaaatttatttcttaccrttctggggactgggaagtgacccggcatctggggacggcagagggtatcacacggcgagagggcaagagcgtgtatgtcgtttcaggcctctcttcctat

SEQ ID NO: 21369 - DNA, 201 bp, Homo sapiens; identical to SEQ ID NO: 2359

SEQ ID NO: 21370 - DNA, 201 bp, Homo sapiens
aggcagttctttatagcagtgtaggaacggactaatatgccaaccctgtctgagtatgctcagcaaagcatattcggctcagcaaagttgcagtatccaaratcaatctgcaacagtcggttgtatttctacaccctagcaatgaataacatgaaaataagattaaggaaatgattcattttacagtagcatcgaaacaat

SEQ ID NO: 21371 - DNA, 201 bp, Homo sapiens
ggactaatatgccaaccctgtctgagtatgctcagcaaagcatattcggctcagcaaagttgcagtatccaagatcaatctgcaacagtcggttgtatttstacaccctagcaatgaataacatgaaaataagattaaggaaatgattcattttacagtagcatcgaaacaataaaatgtcgaggaataaatttaactaaa

SEQ ID NO: 21372 - DNA, 201 bp, Homo sapiens; identical to SEQ ID NO: 2360

SEQ ID NO: 21373 - DNA, 201 bp, Homo sapiens
agagggcatccatgaaaaacccagagataatatcatacttaatggtgaaagactggttgatttccccctaagatcaggaatgccacttgtaactcaacatygtactcaaagttctagtcagggcaattagtcaagaaaaagaaataaaaggcatccagattggaagggaacaagtaaaaccatctctattcatagatgcat

SEQ ID NO: 21374 - DNA, 201 bp, Homo sapiens
ccctaagatcaggaatgccacttgtaactcaacatcgtactcaaagttctagtcagggcaattagtcaagaaaaagaaataaaaggcatccagattggaarggaacaagtaaaaccatctctattcatagatgcatagatggcatgttcttatatagaggacactaaagagtccaacaaaagaaaaaaaaaaaaactgaga

SEQ ID NO: 21375 - DNA, 201 bp, Homo sapiens; identical to SEQ ID NO: 2361

SEQ ID NO: 21376 - DNA, 201 bp, Homo sapiens; identical to SEQ ID NO: 2362

SEQ ID NO: 21377 - DNA, 201 bp, Homo sapiens
tgattgaatcatgggggcggacttcccccttgctattcttctgatagagcgctcacaagatctgatgattgtttgaaaatgtgcagcgcttccccctttgygtgcgttctctctctcttcctcctgctccaacatgtgaagaaggtgcttgcttccccttcgccttccgccatgattgcacgtttcctgaggcctgcccag

SEQ ID NO: 21378 - DNA, 201 bp, Homo sapiens; identical to SEQ ID NO: 2363

SEQ ID NO: 21379 - DNA, 201 bp, Homo sapiens; identical to SEQ ID NO: 2365

SEQ ID NO: 21380 - DNA, 201 bp, Homo sapiens
gctctgtgtccccacccaaatctcatgtcgaattgtaatccccacctgttgaaggaagggcctagtgggaggtgattgaatcatgggggcggacttccccyttgctattcttctgatagagcgctcacaagatctgatgattgtttgaaaatgtgcagcgcttccccctttgcgtgcgttctctctctcttcctcctgctc

SEQ ID NO: 21381 - DNA, 201 bp, Homo sapiens
agagttttcatctagcattttcttataaatctattcctatgtatccttagatagaaaccatagaatttcaaacctggaaattttgagctcatagagaccarctgcctcatctgacagagaaggaaactgaggccaagaccctaaatgctgaaactgcacagttacatatggctagagacacacttggggttagaaccctgg

SEQ ID NO: 21382 - DNA, 201 bp, Homo sapiens
gggaacagagggactgggcgcgcctcacaactcaccacctcgcccgctggtccttcctggctcgcctggctctgaagctgcacctggaggggaaacctcaraacagtaggcgggattgcctagtaaatatctcccattcagggaggcccaggtcgtgtgacgtcgacagttgctgggtagatgaggccaacacaggttgca

SEQ ID NO: 21383 - DNA, 201 bp, Homo sapiens
tctctctctcacacacacatacacacattgttccttctcattcttgatataccctctccctgtctctctctctctgtctctgtctctctctctctctctcwcacacacacacacacacaattgtttttctcattcttgatatacctcaggagcaaaatattgtcctccttaccttaagaaaaacctagagttttcatctag

SEQ ID NO: 21384 - DNA, 201 bp, Homo sapiens
ctctctctcacacacacatacacacattgttccttctcattcttgatataccctctccctgtctctctctctctgtctctgtctctctctctctctctctyacacacacacacacacaattgtttttctcattcttgatatacctcaggagcaaaatattgtcctccttaccttaagaaaaacctagagttttcatctagc

SEQ ID NO: 21385 - DNA, 201 bp, Homo sapiens
tctctatgggcagtatgatctgtggctgggataagaaggtgggtgctctccattcttcatgttcccccaccatgttccctatggatgacagatctgtttcycatcatatactcctactccctccctgacaagatgcatggcatatagagtgcttggttatagaactgtttcagtatatccatggactatttattggcccag

SEQ ID NO: 21386 - DNA, 201 bp, Homo sapiens
ttttgagtggcgcagccttgacccaaattcaggtctgcctgacttgaatgctcatctctttactactaagttatatttccttaaaatcgaatataaaaatkccaagtccatgggtagagaagaggactattcaatagtctttattcttctgtcacgtgtttcaccctagggttctcatttttatcctacttttgcaccctt

SEQ ID NO: 21387 - DNA, 201 bp, Homo sapiens
cgtgcacagccacttgcagggagaggtgtttggggctgtcctgcgccaggagacggagtttttccaacagaaccagacaggtttctcctgaaactctttcrttatacgccatgtactgttcatatcctcatacatctgctttgatctcccccctccccgctctctctctctcacacacacatacacacattgttccttctc

SEQ ID NO: 21388 - DNA, 201 bp, Homo sapiens
aggtcatatagcttttgagtggcgcagccttgacccaaattcaggtctgcctgacttgaatgctcatctctttactactaagttatatttccttaaaatckaatataaaaatgccaagtccatgggtagagaagaggactattcaatagtctttattcttctgtcacgtgtttcaccctagggttctcatttttatcctac

SEQ ID NO: 21389 - DNA, 201 bp, Homo sapiens
gagtgagaatctgagcttatttctgtggtacctggtgcgaggcctatgtctcttggggatcatgctctggggatcagtgtccctcaccatggtcaccctgrtcaccctgcctctgcttttccttctgcccaagaaggtgggaaaatggtaccaggtatgttcatggagttggcccgctctacacagaccctcatctcccag

SEQ ID NO: 21390 - DNA, 201 bp, Homo sapiens; identical to SEQ ID NO: 2380

SEQ ID NO: 21391 - DNA, 201 bp, Homo sapiens
tttttgtggagacagggtttcaccatcttgcctaggctggcctcaaactcctgggctcaagtaatcctcctgcctcagcctcccaaattgttggcattacmggtgtgagccactgtgcttagcacaccactggttctcacagtgactgtgtatcctcatttgatttactcagaacagccctggtttatccgtattgcccaa

SEQ ID NO: 21392 - DNA, 201 bp, Homo sapiens
cctgggacagcgcacaacgcgcagccgacagccccgccccttcgcggcgccgccaggaggcgcctgggtgctgcggggctgctttgcgcgcggcgctaacktgtgtagggcagatctgccccgagacaagtgacgaggcagccccgccctgaggctggggtgggaaaactggtgcaagtggaaaggcaggaggcagggaga

SEQ ID NO: 21393 - DNA, 201 bp, Homo sapiens
tgtgagccactgtgcttagcacaccactggttctcacagtgactgtgtatcctcatttgatttactcagaacagccctggtttatccgtattgcccaagarccccattgagctttgcatttgtcctgccccttttcactcttaaaagtgtaccaggcccggcattaacttaaatggccacccctgtatttctcttcctgtt

SEQ ID NO: 21394 - DNA, 201 bp, Homo sapiens
gtttgccaacccgtgtgacatctcttgtccatgtatccacagttgctggaagtgcaggtgcgggaatctctggcaaagtccagccaggtggccattgaggytctgtcggccatgcctacagttcgaagctttgccaacgaggagggcgaagcccagaagtttagggaaaagctgcaagaaataaagacactcaaccagaag

SEQ ID NO: 21395 - DNA, 201 bp, Homo sapiens
cttcccatgtttcaaagccctccccaggtacccttccacttggctggttaccgtctgtggtgaagcgcctgcactcctcgggagacatgcctggcttataygctgcatccacataaccatagataaaggtgctgccggagccaccaatggcaaaaggctgtcgagtcagcattcctcccagggttccatatacctgggaaa

SEQ ID NO: 21396 - DNA, 201 bp, Homo sapiens
ttccaacttgcctagtggaatcctctccactgtagagaggtggagatgaggctcctacaggtagaagtgaagcagctccgcaagtgaaaattatctccaayggaagggctcatagtatgtgcagatgtggtgtagacccaacacagagtaattgactatgatcttgggaaacaaggtcagtctatttttttttttttggtc

SEQ ID NO: 21397 - DNA, 201 bp, Homo sapiens
aggagagaagcagcaaggaacacatacagatggttgaaaataaaagtttcagttatggaatttccgatcaagaggtaaatacatatctcagcagccagggrggtaaatttgtaccaagagataatttgactgagaagtttaagctgacttttccaggtcaagaaaagaatcaagaagaagtgagggaagataaagctacat

SEQ ID NO: 21398 - DNA, 201 bp, Homo sapiens
acagccttgatctccccggctcagatgatctttccacctcagcctcctgagtagctgggactacaggtgtgcaccactatgcccagttcatttttttttttacttttttttattgttttttgtggagacagggtttcaccatcttgcctaggctggcctcaaactcctgggctcaagtaatcctcctgcctcagcctccca

SEQ ID NO: 21399 - DNA, 201 bp, Homo sapiens
cttagccttaaaggaaagagtcccatcacctcacttgcggcctcatcatcatggaccgcatgatgatgcggaatgagaatttttattgtttgtactacttcaaaatcattcagtacgtgatcacctgtcatgtatagggctctttatatttctagtttagtcccttttgttttctctaggaaagatgttttagacctggga

SEQ ID NO: 21400 - DNA, 201 bp, Homo sapiens
ggaggcgttgtcaatagtaagagaccaatgctcccaccaccatgcctgggaggagtcggcgggtggtggggggggtgatttaagattgagaaaccagcctkgccaacatggcgaaaccccgtctctactaaaactacaaaaattagccggacgtggtgacgggtgcctgtagtcccagctacttgggaggctgaggcagga

SEQ ID NO: 21401 - DNA, 201 bp, Homo sapiens
ttcttttctagcttctccccacaatctgtctttaagaatttgatccccaacccgttctgagtcattttcctcttcctcgtatttctttagcatccaagggscatagctgtgtctctttctcttttctccttttcctctgtctcttctcacctttaatttccaaataggtaactcaggtattagtgtccctgatggtttgcc

SEQ ID NO: 21402 - DNA, 201 bp, Homo sapiens
caaacggcccactgccttttgcagcgcacttttcagctgcggatgtctcctcttttatcatcctcaatgttttaccccctaactgcatcaccttttccctyaagctttttaattcctatgaggccccttccacttcccctatccccttaggcccacccccaagaatgtgcaagaccccagccacagggcccatcagggcac

SEQ ID NO: 21403 - DNA, 201 bp, Homo sapiens
cccgagggcagcggccggaatcggctctcccggttgcgggaagcgggcgtcgctcggacccaggacactacagtttctctatgcgatctccagagctcgcyttaccccggggaatgcaggtcggggcagtagggaagcccctagggatgcagggaggcgggcgctgaggagtggagggtcgcctgagaggaggaggcgaga

SEQ ID NO: 21404 - DNA, 201 bp, Homo sapiens
gaagaaagagtgtatgctgacatctaggagggaagcacccacctcccctaagctccatctccctgagcactcatttcccaatgaccataccaggttttggycctagagagtttattacaaaataagaaagagaagtctggggaaggttcactcatcatagaattttggcagttcattgcccaagatgactcgatggtccac

SEQ ID NO: 21405 - DNA, 201 bp, Homo sapiens
taaggaaagtgtgtatttgaggccattagcttctttccaaatgcatacatcttcacttttactcaccctgcagacactcgggaatcagaacccatcacaaygcccccgtcaaactccactgccatgatggtggtctgcagagacacagaatatggaatgtcagggcaagaacagccttgatgccctcatgttagagaagaa

SEQ ID NO: 21406 - DNA, 201 bp, Homo sapiens
ggtcagtctatttttttttttttggtccacaatcctccactctcaccccccatttcatcagaagtgagctcttccaatttactgaacattggaaaaaatcraggagggcagtggttagcatggccaggggcaaggcaggagagaagcagcaaggaacacatacagatggttgaaaataaaagtttcagttatggaatttcc

SEQ ID NO: 21407 - DNA, 201 bp, Homo sapiens
gctttcaattgctcactcttttgctcagccccacccacataactttcttttggctgcaaggaccctgctcttatggggaaaagcagataaggttacttccrtcccaacgaccttgatttctcgtatggtaactgcctgatattatggtgggtcacaatatcaccttcttcctgattatttatatcaggatagtgatttaca

SEQ ID NO: 21408 - DNA, 201 bp, Homo sapiens
ggaacgcagggcaagaggggaggacacaaggggactgggacaggaatcaaaggtaattgtcagtaaggtagagtagcgtgggttctgggaaatgtggagcrggagaaggactcctagcgtgggtcttggaacaccacttcggtgtagaagaaacggcactggactggcgggggccagaggttctgggctccattgctgacc

SEQ ID NO: 21409 - DNA, 201 bp, Homo sapiens
taactgcctgatattatggtgggtcacaatatcaccttcttcctgattatttatatcaggatagtgatttacagcttttaaactgtgttcacatatagaaygtggttctcaaaataaccgtctcatgaggtactatattatctccactttacagatgcagaaactgacagattcaagtgccagcaagagccgaaacaagac

SEQ ID NO: 21410 - DNA, 201 bp, Homo sapiens
tcaccttcttcctgattatttatatcaggatagtgatttacagcttttaaactgtgttcacatatagaatgtggttctcaaaataaccgtctcatgaggtrctatattatctccactttacagatgcagaaactgacagattcaagtgccagcaagagccgaaacaagacttttccatttcccagtgtccagctcctggaa

SEQ ID NO: 21411 - DNA, 201 bp, Homo sapiens
agcactgacacatccaccctggcgggacagtatcatttactaggctgcctttgtatgtttcagatactttaaattccaaatctttctctgatctttagatmctacaaaataattcctttccaatgcttatctctttaatcatttcctgccccatcaagttggaaagagctaacctctctttcctcactccaccttgtcctc

SEQ ID NO: 21412 - DNA, 201 bp, Homo sapiens
gggacagtatcatttactaggctgcctttgtatgtttcagatactttaaattccaaatctttctctgatctttagatcctacaaaataattcctttccaaygcttatctctttaatcatttcctgccccatcaagttggaaagagctaacctctctttcctcactccaccttgtcctcacccaggctgtactatctgcgaa

SEQ ID NO: 21413 - DNA, 201 bp, Homo sapiens
tgctgtccaacatgatgtgccagtaccggggcatgggcctctctatgggcagtatgatctgtggctgggataagaaggtgggtgctctccattcttcatgytcccccaccatgttccctatggatgacagatctgtttcccatcatatactcctactccctccctgacaagatgcatggcatatagagtgcttggttatag

SEQ ID NO: 21414 - DNA, 201 bp, Homo sapiens
ctgtggcctatgcagtcaactcctggaccactagtgtgagcacctgaagatgaatacccattcccttgtccttaagatgccgtgactccattcccattccyatgaccctgctcccactcctcctttactgggaaatggttggttcagtattttcgtcctagcaacctgaggctcaatgactctactcagtgtccctagccc

SEQ ID NO: 21415 - DNA, 201 bp, Homo sapiens
agataaaggtgctgccggagccaccaatggcaaaaggctgtcgagtcagcattcctcccagggttccatatacctgggaaagggatcctcaggttaaagawtcatcaagcccttccttcccactgagacattaagtggtctctgcaccctgcaatgaagccctggtatctcatatccccaaagtactatgctttcagaggt

SEQ ID NO: 21416 - DNA, 201 bp, Homo sapiens
gcactgagatttgcagacctctggagaaccctaaccttgtttcctgcagcctccttagaaccccatgttgacacccctgaccctggcatcctggctcattkttagttcgtctcatcacttggaacctgtctgattcacctcactctcttctccccaaccctgcaggtaacatcatgtctcgggtaacagaggacacgtcca

SEQ ID NO: 21417 - DNA, 201 bp, Homo sapiens
cctgatcaccctgcctctgcttttccttctgcccaagaaggtgggaaaatggtaccaggtatgttcatggagttggcccgctctacacagaccctcatctyccagacttggcagactcagttcctctcacattgctttcagtccagctttcctggcacccttactgattctccatcttcatggaacaccctgtccctgtgg

SEQ ID NO: 21418 - DNA, 201 bp, Homo sapiens
gaagaggccacatggggatggggcctgagaggaggaagtgcaagttaggacaaagagttacaggtgaggtgggggctcccaaaggaagacaagagaacttycctgcccttgtccacacacaaatggtggagcctttttcatggggttatcacatgatataggaggtgtgtggtgtcttgggaaacctatgaaatttgcctg

SEQ ID NO: 21419 - DNA, 201 bp, Homo sapiens
tcttagccttaaaggaaagagtcccatcacctcacttgcggcctcatcatcatggaccgcatgatgatgcggaatgagaatttttattgtttgtactacttcaaaatcattcagtacgtgatcacctgtcatgtatagggctctttatatttctagtttagtcccttttgttttctctaggaaagatgttttagacctggg

SEQ ID NO: 21420 - DNA, 201 bp, Homo sapiens
ttcctcatttttcaaaaatggagtgatataaccttctttataaggctcttcatgtattagctgacatcacatgaatgaaagccttttgtgaagagtaaaaygctccccagacaaggtgatagtggtgatggtggtgaagataactgtgacttgcatgatgtgcattgagtcagactccatggggtctctggttcattctcc

SEQ ID NO: 21421 - DNA, 201 bp, Homo sapiens
ttatacaaaccagtccttgcagttctcagttcccaaatccagttccattggatgcctccccaaggagtagagatagaagacgaggcaaagacacctagaaycagttaaaagagactatctacaaactacagactgaatttctttctttctttccttttttttttttaagacagtgtctcactcagttgcccaggctggagc

SEQ ID NO: 21422 - DNA, 201 bp, Homo sapiens
gtcttagccttaaaggaaagagtcccatcacctcacttgcggcctcatcatcatggaccgcatgatgatgcggaatgagaatttttattgtttgtactacttcaaaatcattcagtacgtgatcacctgtcatgtatagggctctttatatttctagtttagtcccttttgttttctctaggaaagatgttttagacctgg

SEQ ID NO: 21423 - DNA, 201 bp, Homo sapiens; identical to SEQ ID NO: 2415

SEQ ID NO: 21424 - DNA, 201 bp, Homo sapiens
atcttggctcactgcagcttcaacctgctgggctcaagcgattctcccctcagcctcccgagtagctgggactacaggtgtacaccactatgcctggttgrcttttatatttttagtagagatgggtttcaccatgttgcccaggctggccttgaattcctgagctcaggtaatctgcccccctcagcctcccaaagggct

SEQ ID NO: 21425 - DNA, 201 bp, Homo sapiens
ttgatatttataataaaattggtgttttgtactgtggtttcttatgtttccggcacaccaaacggcccactgccttttgcagcgcacttttcagctgcggrtgtctcctcttttatcatcctcaatgttttaccccctaactgcatcaccttttcccttaagctttttaattcctatgaggccccttccacttcccctatc

SEQ ID NO: 21426 - DNA, 201 bp, Homo sapiens
gaacagagggactgggcgcgcctcacaactcaccacctcgcccgctggtccttcctggctcgcctggctctgaagctgcacctggaggggaaacctcagarcagtaggcgggattgcctagtaaatatctcccattcagggaggcccaggtcgtgtgacgtcgacagttgctgggtagatgaggccaacacaggttgcaag

SEQ ID NO: 21427 - DNA, 201 bp, Homo sapiens
tcctggctcgcctggctctgaagctgcacctggaggggaaacctcagaacagtaggcgggattgcctagtaaatatctcccattcagggaggcccaggtcrtgtgacgtcgacagttgctgggtagatgaggccaacacaggttgcaagaagaggcggggtttagaggcgtgaaactccgcagtgctcagccaagcaggga

SEQ ID NO: 21428 - DNA, 201 bp, Homo sapiens
cggacgtggtgacgggtgcctgtagtcccagctacttgggaggctgaggcaggagaatcacttgaacctgggaggtggagcttgcagtgagccaagatggygccactgcattccagtctgggccacagagtgagactccttctcaaaagaaaaaaaagaaaatgattgagagactcaaaggagggagagtagtagggagga

SEQ ID NO: 21429 - DNA, 201 bp, Homo sapiens; identical to SEQ ID NO: 2372

SEQ ID NO: 21430 - DNA, 201 bp, Homo sapiens
atattgacctaaccccatatactcattttgcatgtgaggaaattggttaggagtgggagaagagacaaaatagttcaatatatggtaaatgagaaaccagrtatctgcttgacagaatcatctttttgatccctaagcacagatggaaagaagaccctcaaaaatctatctcctgtccccctctcagaccctattccttta

SEQ ID NO: 21431 - DNA, 201 bp, Homo sapiens
gggaccagagtgaaagcgaaagcgctttagagtagcttcccgttgacgcttccagctaagagtcaaagcacccgctttttccaccagcctcgcgtgcctgktcccttcacggacactctagacgacccccctcagaaaagaaatactctatgctcattgcgggttgcaagcgctggctgctacaggcgacctccctgcgct

SEQ ID NO: 21432 - DNA, 201 bp, Homo sapiens
ggttataggtgtgagccactgcgcccagtcctatagactgaatttctaaagcgaaacataaggaaaagaccatcctcataatatcgtttatttaaaaaaawtattttttgtacagacagcgtcccgctatgttgcccaggctggccttgaactcctgggcccaagtgatcctccctccttgacctcccaaagtgctaggat

SEQ ID NO: 21433 - DNA, 201 bp, Homo sapiens
acctcaggaaggctgctcattgctgtccatggacacttgtttgcaatttcacataggttagggtcctttccatagagaggcacctggggactcctgtgtgytccattgttaatggtttgaggaacagggagtagggcacctaggataactgtttttgactttatagagtaggatgaaaaagcttccacttcactttaatat

SEQ ID NO: 21434 - DNA, 201 bp, Homo sapiens
tcttgatttaaccagcccccactgtccgggaccagagtgaaagcgaaagcgctttagagtagcttcccgttgacgcttccagctaagagtcaaagcacccsctttttccaccagcctcgcgtgcctgttcccttcacggacactctagacgacccccctcagaaaagaaatactctatgctcattgcgggttgcaagcgct

SEQ ID NO: 21435 - DNA, 201 bp, Homo sapiens
tcttcttttctagcttctccccacaatctgtctttaagaatttgatccccaacccgttctgagtcattttcctcttcctcgtatttctttagcatccaagkggcatagctgtgtctctttctcttttctccttttcctctgtctcttctcacctttaatttccaaataggtaactcaggtattagtgtccctgatggtttg

SEQ ID NO: 21436 - DNA, 201 bp, Homo sapiens; identical to SEQ ID NO: 2376

SEQ ID NO: 21437 - DNA, 201 bp, Homo sapiens
gaaagtagaaagtacagatgtcagtgacctgctgcaccagtaccgggaagccaatcaataatggtggtggtggcagctgggcaggtctcctctgggaggtyttggccgactcagggacctaagccacgttaagtccaaggagaagaagaggcctagcctgagccaaagagagagtacgggctcagcagccagaggaggccg

SEQ ID NO: 21438 - DNA, 201 bp, Homo sapiens
cacccctcgctgcccacccagtggtctgttgactcccttacacttggagggccttgtccagttccaagatgtctcctttgcctacccaaaccgcccagatrtcttagtgctacaggtacaacctaccactccctgtattccactggccccaactgcaattctgccatcctaaattttcttcctgccttcagcctgcttact

SEQ ID NO: 21439 - DNA, 201 bp, Homo sapiens
gggaatcctctacattggtgggcagctggtgaccagtggggctgtaagcagtgggaaccttgtcacatttgttctctaccagatgcagttcacccaggctktggaggtgaggtccctccaccttcactccccagtgtgattccttcctctggcccagcaccatctgtgtgatgtccttccattctttacccttcttgcttc

SEQ ID NO: 21440 - DNA, 201 bp, Homo sapiens; identical to SEQ ID NO: 2368

SEQ ID NO: 21441 - DNA, 201 bp, Homo sapiens
tgtatccttagatagaaaccatagaatttcaaacctggaaattttgagctcatagagaccaactgcctcatctgacagagaaggaaactgaggccaagacyctaaatgctgaaactgcacagttacatatggctagagacacacttggggttagaaccctggtctcttgagtgctccacagacttcggcatgctttctagc

SEQ ID NO: 21442 - DNA, 201 bp, Homo sapiens
ggaatcggctctcccggttgcgggaagcgggcgtcgctcggacccaggacactacagtttctctatgcgatctccagagctcgctttaccccggggaatgmaggtcggggcagtagggaagcccctagggatgcagggaggcgggcgctgaggagtggagggtcgcctgagaggaggaggcgagagcgggagcgcggggta

SEQ ID NO: 21443 - DNA, 201 bp, Homo sapiens
aggtccctccaccttcactccccagtgtgattccttcctctggcccagcaccatctgtgtgatgtccttccattctttacccttcttgcttcacataatgmtggcaagcagactacctcactttcactattcttacctccctctaggtactgctctccatctaccccagagtacagaaggctgtgggctcctcagagaaaa

SEQ ID NO: 21444 - DNA, 201 bp, Homo sapiens
ggtgctgggtctctgcccttgtctttgccgcttcttctatctctactccttggggaggcatcacccagaaatctgtgcatgtgggagggtaggagtttctrtatttccctgtttttcttctggggtaagacatcatgctatgtaacaaggcaatgacactctcaaggttagaggccttggtagcctcttatcgtgtgcttc

SEQ ID NO: 21445 - DNA, 201 bp, Homo sapiens
tttttccctttcctggtggtatctgacatcaagtgtgtggcatagtggtgctgggtctctgcccttgtctttgccgcttcttctatctctactccttgggraggcatcacccagaaatctgtgcatgtgggagggtaggagtttctatatttccctgtttttcttctggggtaagacatcatgctatgtaacaaggcaatg

SEQ ID NO: 21446 - DNA, 201 bp, Homo sapiens
ttaacctccatactctctgggtcttcttttctagcttctccccacaatctgtctttaagaatttgatccccaacccgttctgagtcattttcctcttcctygtatttctttagcatccaaggggcatagctgtgtctctttctcttttctccttttcctctgtctcttctcacctttaatttccaaataggtaactcaggt

SEQ ID NO: 21447 - DNA, 201 bp, Homo sapiens
ttatgcaaagtcacacagagttaatagtagacctgggactaaaattcaggtctaactcttatcccttgtttccacttctacttcctacttgccactgctcwtttggcagtgaggggagatttcccaaattataagtggtttcactgtgtctttcttaccaggccgtaagttactctggccccaaaggacgctcctctgagt

SEQ ID NO: 21448 - DNA, 201 bp, Homo sapiens
tttccacttctacttcctacttgccactgctcatttggcagtgaggggagatttcccaaattataagtggtttcactgtgtctttcttaccaggccgtaarttactctggccccaaaggacgctcctctgagtatgctttccgacggaccgacttatcatgaatagagggtcaaagaacagggttaacttcaagttagagg

SEQ ID NO: 21449 - DNA, 201 bp, Homo sapiens
ttctaaagttcgatgactttaccaaagtggtttcctaattccaatgttcttgtggtaatattaattcttttgttcactttttatgtctcatatttgaaccyccatgttaccaacatcttcctctccaatttcagcctgaaatctttcatcttatagggtcctggactctactacgtggatgaacatgggactcggctctca

SEQ ID NO: 21450 - DNA, 201 bp, Homo sapiens
ttttcctttttcatttctaaagttcgatgactttaccaaagtggtttcctaattccaatgttcttgtggtaatattaattcttttgttcactttttatgtmtcatatttgaacccccatgttaccaacatcttcctctccaatttcagcctgaaatctttcatcttatagggtcctggactctactacgtggatgaacatg

SEQ ID NO: 21451 - DNA, 201 bp, Homo sapiens
cctggaccactagtgtgagcacctgaagatgaatacccattcccttgtccttaagatgccgtgactccattcccattcctatgaccctgctcccactcctyctttactgggaaatggttggttcagtattttcgtcctagcaacctgaggctcaatgactctactcagtgtccctagccccctccctctctttaaagatgc

SEQ ID NO: 21452 - DNA, 201 bp, Homo sapiens
cttttcctttgtaatttggaatgtgatttttccctttcctggtggtatctgacatcaagtgtgtggcatagtggtgctgggtctctgcccttgtctttgcygcttcttctatctctactccttggggaggcatcacccagaaatctgtgcatgtgggagggtaggagtttctatatttccctgtttttcttctggggtaag

SEQ ID NO: 21453 - DNA, 201 bp, Homo sapiens; identical to SEQ ID NO: 2417

SEQ ID NO: 21454 - DNA, 201 bp, Homo sapiens
gaactccagagcttcatacccatggagctccagctggtaggcggccatgtcggccacggcttgggcatcagcagctgaaccagagagtgcacagtagatgygctcgtgcagcggggacagcttgtcaaacactcggttcaccaccgcctcgctgtcaggagggagtcaacagtcaccaagttaaaactcaggttttttttt

SEQ ID NO: 21455 - DNA, 201 bp, Homo sapiens
agcctagtggttaatccctggatctctcagatcattgctccttactcttgtcctatgtggtccatcttagtgctaatagtatatttcacaaaacagctttytggtgataagacccttctcccaaatctcagcctgtgctccactcataagccagatagtacgtcaggtatttagcactgacacatccaccctggcgggaca

SEQ ID NO: 21456 - DNA, 201 bp, Homo sapiens
aaggtgattgagattaacccttacctgcttggcaccatgtctggctgtgcagcagactgtcagtactgggagcgcctgctggccaaggaatgcaggtaagygaggcctctcatcttcctttcttagcctagtggttaatccctggatctctcagatcattgctccttactcttgtcctatgtggtccatcttagtgctaat

SEQ ID NO: 21457 - DNA, 201 bp, Homo sapiens
tccagggtcccctggccgctgcatctcctccacccctctgccaaccctcaagcccagacccattaccccggtgtggacttctcccgcccggggtaagtccycggttggtgctcccgcccgcagcatccctgcaaggcaccgctctcctcgccgcctggggcactggtttccaacctgggacagcgcacaacgcgcagccga

SEQ ID NO: 21458 - DNA, 201 bp, Homo sapiens
aatttgtttgtttgtttgtttttagtttgggaggtggtttcaatctgaagagtcctttctggaataaacgaatctttctgttgcataggaaggctctgggwcaggaaggatatttaaaaacctaattactgttctaaacagtgttaaaatagaacaagaaccaaagctcagtacggggcatttccctcataggctgaaggt

SEQ ID NO: 21459 - DNA, 201 bp, Homo sapiens
ccagcctcgcgtgcctgttcccttcacggacactctagacgacccccctcagaaaagaaatactctatgctcattgcgggttgcaagcgctggctgctacmggcgacctccctgcgctcccgttggtctctgcattcacttctccgcgcgcgcttccagggtcccctggccgctgcatctcctccacccctctgccaaccc

SEQ ID NO: 21460 - DNA, 201 bp, Homo sapiens
acgaatctttctgttgcataggaaggctctgggtcaggaaggatatttaaaaacctaattactgttctaaacagtgttaaaatagaacaagaaccaaagcycagtacggggcatttccctcataggctgaaggtgcgcccaacataatttggagtacagactcagaggcacctgaacacgcgccagctcaaggtgctccgg

SEQ ID NO: 21461 - DNA, 201 bp, Homo sapiens
tcacctcaaaactcatcttccaggaaggcatatttagtggtgtgctggtaaatcagtttttttacaaaaaggcttccatatgtggcatctgctgatgtccrtggtgtaaatgctcccgctatgatgaattgcaagttacaaatagctaagcagttcacaaatccttgactatttaacagtccgctctcatgagtggtccca

SEQ ID NO: 21462 - DNA, 201 bp, Homo sapiens
tttagagtagcttcccgttgacgcttccagctaagagtcaaagcacccgctttttccaccagcctcgcgtgcctgttcccttcacggacactctagacgamccccctcagaaaagaaatactctatgctcattgcgggttgcaagcgctggctgctacaggcgacctccctgcgctcccgttggtctctgcattcacttct

SEQ ID NO: 21463 - DNA, 201 bp, Homo sapiens
tttctgttgcataggaaggctctgggtcaggaaggatatttaaaaacctaattactgttctaaacagtgttaaaatagaacaagaaccaaagctcagtacsgggcatttccctcataggctgaaggtgcgcccaacataatttggagtacagactcagaggcacctgaacacgcgccagctcaaggtgctccggctgagaa

SEQ ID NO: 21464 - DNA, 201 bp, Homo sapiens
ccttgtctttgccgcttcttctatctctactccttggggaggcatcacccagaaatctgtgcatgtgggagggtaggagtttctatatttccctgtttttsttctggggtaagacatcatgctatgtaacaaggcaatgacactctcaaggttagaggccttggtagcctcttatcgtgtgcttctctggcctctaggggc

SEQ ID NO: 21465 - DNA, 201 bp, Homo sapiens
gcaggtcggggcagtagggaagcccctagggatgcagggaggcgggcgctgaggagtggagggtcgcctgagaggaggaggcgagagcgggagcgcggggkacagggtcgggggtagccttcagtcccggagagcgccagacccaaagaagaggccacatggggatggggcctgagaggaggaagtgcaagttaggacaaa

SEQ ID NO: 21466 - DNA, 201 bp, Homo sapiens
tctctactccttggggaggcatcacccagaaatctgtgcatgtgggagggtaggagtttctatatttccctgtttttcttctggggtaagacatcatgctrtgtaacaaggcaatgacactctcaaggttagaggccttggtagcctcttatcgtgtgcttctctggcctctaggggctgacattcaccctacgccctggc

SEQ ID NO: 21467 - DNA, 201 bp, Homo sapiens
gggaggcatcacccagaaatctgtgcatgtgggagggtaggagtttctatatttccctgtttttcttctggggtaagacatcatgctatgtaacaaggcartgacactctcaaggttagaggccttggtagcctcttatcgtgtgcttctctggcctctaggggctgacattcaccctacgccctggcgaggtgacggcgc

SEQ ID NO: 21468 - DNA, 201 bp, Homo sapiens
ttcctttcagtatggtacataaaatccacccaaccatgtggattggagagatgcgtgtcttccagtcctagggccttcctttgcctctcaggggaagtgcmgggcgccataaattcttgcacctgggactgcttcatgctggtaccttgtagatttgttagtgagagtgatgggaatagtggaagccagggatgagggaca

SEQ ID NO: 21469 - DNA, 201 bp, Homo sapiens; identical to SEQ ID NO: 2377

SEQ ID NO: 21470 - DNA, 201 bp, Homo sapiens
tttcagtatggtacataaaatccacccaaccatgtggattggagagatgcgtgtcttccagtcctagggccttcctttgcctctcaggggaagtgcagggmgccataaattcttgcacctgggactgcttcatgctggtaccttgtagatttgttagtgagagtgatgggaatagtggaagccagggatgagggacatctg

SEQ ID NO: 21471 - DNA, 201 bp, Homo sapiens
acccaaccatgtggattggagagatgcgtgtcttccagtcctagggccttcctttgcctctcaggggaagtgcagggcgccataaattcttgcacctgggmctgcttcatgctggtaccttgtagatttgttagtgagagtgatgggaatagtggaagccagggatgagggacatctgtgatgcactggaaagagagctac

SEQ ID NO: 21472 - DNA, 201 bp, Homo sapiens
tctctaacaaagccgcccccaagccacgagtggtggcagtagtccagagcagaagccagccagccagtcttggggctgccatctgccccaggcgcccatcytaagcaaagtccccccagtgggcacatgggagtgggcagggaagacacagggaagggagtaaggcagcatctgggccaaggagaggccttcctgggtcaa

SEQ ID NO: 21473 - DNA, 201 bp, Homo sapiens
cctatttaggttcgggattgagacgtcagtgtttcctttctgctgatgccctccaggataatggtgagggggaggaggcgtggtggggccagtctgactgraactgacctacttagacttaatatttgtgcgtgacctctcttctctttctccaggggagatggccattccattctttacgggccgcctcactgactggat

SEQ ID NO: 21474 - DNA, 201 bp, Homo sapiens
agatgcgctcgtgcagcggggacagcttgtcaaacactcggttcaccaccgcctcgctgtcaggagggagtcaacagtcaccaagttaaaactcaggtttktttttttttttttttttttgagacagtctcactctgtcacccaggctggagtgcagtggatcaatcttgggctcactgcaaacttcgcctccctggttca

SEQ ID NO: 21475 - DNA, 201 bp, Homo sapiens; identical to SEQ ID NO: 2423

SEQ ID NO: 21476 - DNA, 201 bp, Homo sapiens
caatatgagcaccgctacctgcacaggcaggtatggaagcaggtggcttgaaggagggcagggagcatcaaatacgaagagcattcttactgagcactctraaagaggggttagggaatgataagagaccttgggtggagatggtggtgtagtcaggagggaggtagtatgattttgtgacatgttctcaataaagatttt

SEQ ID NO: 21477 - DNA, 201 bp, Homo sapiens
tttttttttttttttctccagacagggtctctctctgtcacctaggctgcagcgcagtggtgcaatcaccgctcactacagccttgatctccccggctcaratgatctttccacctcagcctcctgagtagctgggactacaggtgtgcaccactatgcccagttcatttttttttttacttttttttattgttttttgtg

SEQ ID NO: 21478 - DNA, 201 bp, Homo sapiens
ttattattattatttttgagctggagtctcgctttgtcgcccaggctggagtgcagtggcgcgatctgggctcactgcaagctccgcctcccgggttcacrccgttctcccgcctcagcctcctgagtagctgggactacaggcacccgccaccacgcccggctaattttttttttttttttgtatttttagtagagacga

SEQ ID NO: 21479 - DNA, 201 bp, Homo sapiens
aactcctgacctcaaatatctgcccacctcggcatcccaaagtgctgagattatagatgtgagccactgcacccaaccagaactcaggaatttttgagggkgatcattcaatgtctctcaaatttctttgacaagagaatagcatgaagtttaatgcttggattaaagcaggaggcaaataatcatctcagatattattaa

SEQ ID NO: 21480 - DNA, 201 bp, Homo sapiens
tgtggcctatgcagtcaactcctggaccactagtgtgagcacctgaagatgaatacccattcccttgtccttaagatgccgtgactccattcccattcctrtgaccctgctcccactcctcctttactgggaaatggttggttcagtattttcgtcctagcaacctgaggctcaatgactctactcagtgtccctagcccc

SEQ ID NO: 21481 - DNA, 201 bp, Homo sapiens; identical to SEQ ID NO: 2371

SEQ ID NO: 21482 - DNA, 201 bp, Homo sapiens
gatgcgctcgtgcagcggggacagcttgtcaaacactcggttcaccaccgcctcgctgtcaggagggagtcaacagtcaccaagttaaaactcaggttttyttttttttttttttttttgagacagtctcactctgtcacccaggctggagtgcagtggatcaatcttgggctcactgcaaacttcgcctccctggttcaa

SEQ ID NO: 21483 - DNA, 201 bp, Homo sapiens; identical to SEQ ID NO: 2375

SEQ ID NO: 21484 - DNA, 201 bp, Homo sapiens
tgtgagtgcgtgaatgcatgagtgtgtctgtgtgcatgtacatgcgtgcacacatgtggctataccgttctcatcttggccctttgctctgcagaggtagrcgaggctgggagccagctgtcagggggtcagcgacaggcagtggcgttggcccgagcattgatccggaaaccgtgtgtacttatcctggatgatgccacc

SEQ ID NO: 21485 - DNA, 201 bp, Homo sapiens
gcatgtacatgcgtgcacacatgtggctataccgttctcatcttggccctttgctctgcagaggtagacgaggctgggagccagctgtcagggggtcagcracaggcagtggcgttggcccgagcattgatccggaaaccgtgtgtacttatcctggatgatgccaccagtgccctggatgcaaacagccagttacaggtg

SEQ ID NO: 21486 - DNA, 201 bp, Homo sapiens
cattgatccggaaaccgtgtgtacttatcctggatgatgccaccagtgccctggatgcaaacagccagttacaggtgaggcagtcatcttcttaatggctrtatcccacccaatcttgcttcttttatacatcttctgttagttttactaacatcataattatacaaaccagtccttgcagttctcagttcccaaatccag

SEQ ID NO: 21487 - DNA, 201 bp, Homo sapiens; identical to SEQ ID NO: 2419

SEQ ID NO: 21488 - DNA, 201 bp, Homo sapiens
ggtttccaacctgggacagcgcacaacgcgcagccgacagccccgccccttcgcggcgccgccaggaggcgcctgggtgctgcggggctgctttgcgcgckgcgctaacgtgtgtagggcagatctgccccgagacaagtgacgaggcagccccgccctgaggctggggtgggaaaactggtgcaagtggaaaggcaggag

SEQ ID NO: 21489 - DNA, 201 bp, Homo sapiens; identical to SEQ ID NO: 2374

SEQ ID NO: 21490 - DNA, 201 bp, Homo sapiens
agcgtcccgctatgttgcccaggctggccttgaactcctgggcccaagtgatcctccctccttgacctcccaaagtgctaggattataggcatgagccacygggcccagcccatcctaatcatattaatattaattaagctagtctgtttacatgcactgtcactcatttattcattaggaatccttctgagctaggcatt

SEQ ID NO: 21491 - DNA, 201 bp, Homo sapiens
aaacacaggtgtctccctgggctgagggtagtccccggctctgacggtccgatgtctttcctcaggtggagcagctcctgtacgaaagccctgagcggtaytcccgctcagtgcttctcatcacccagcacctcagcctggtggagcaggctgaccacatcctctttctggaaggaggcgctatccgggaggggggaaccc

SEQ ID NO: 21492 - DNA, 201 bp, Homo sapiens
tctctaccagatgcagttcacccaggctgtggaggtgaggtccctccaccttcactccccagtgtgattccttcctctggcccagcaccatctgtgtgatktccttccattctttacccttcttgcttcacataatgctggcaagcagactacctcactttcactattcttacctccctctaggtactgctctccatctac

SEQ ID NO: 21493 - DNA, 201 bp, Homo sapiens
ctccgcctcccgggttcacgccgttctcccgcctcagcctcctgagtagctgggactacaggcacccgccaccacgcccggctaattttttttttttttttgtatttttagtagagacgaggtttctccgtgttagccaggatggtctcaatctcctgaccttgtgatccgcccacttcggcctcccaaagtgctggaatt

SEQ ID NO: 21494 - DNA, 201 bp, Homo sapiens
gctccgcctcccgggttcacgccgttctcccgcctcagcctcctgagtagctgggactacaggcacccgccaccacgcccggctaattttttttttttttttgtatttttagtagagacgaggtttctccgtgttagccaggatggtctcaatctcctgaccttgtgatccgcccacttcggcctcccaaagtgctggaat

SEQ ID NO: 21495 - DNA, 201 bp, Homo sapiens
aaatgccaagtccatgggtagagaagaggactattcaatagtctttattcttctgtcacgtgtttcaccctagggttctcatttttatcctacttttgcayccttcatgtaaaacagtccttaatgaaacaaagggtttgcggagaagtactcagaatgggaaacgttggtgtccttggggttgttagcagagccagcagt

SEQ ID NO: 21496 - DNA, 201 bp, Homo sapiens
cctaagcacagatggaaagaagaccctcaaaaatctatctcctgtccccctctcagaccctattcctttactcatccctgtacactactgggacaggtcayatacacattcagaccccagatcctcctccacaaattcagagacccaagcacccaccaaatagcttatcatagtggcttttggggaaggtcaactccattc

SEQ ID NO: 21497 - DNA, 201 bp, Homo sapiens
actccattcccattcctatgaccctgctcccactcctcctttactgggaaatggttggttcagtattttcgtcctagcaacctgaggctcaatgactctactcagtgtccctagccccctccctctctttaaagatgctaggtggcttcctttcagtatggtacataaaatccacccaaccatgtggattggagagatgcg

SEQ ID NO: 21498 - DNA, 201 bp, Homo sapiens; identical to SEQ ID NO: 2373

SEQ ID NO: 21499 - DNA, 201 bp, Homo sapiens
gatttcccaaattataagtggtttcactgtgtctttcttaccaggccgtaagttactctggccccaaaggacgctcctctgagtatgctttccgacggacmgacttatcatgaatagagggtcaaagaacagggttaacttcaagttagaggctattcctctctaacaaagccgcccccaagccacgagtggtggcagtag

SEQ ID NO: 21500 - DNA, 201 bp, Homo sapiens
ctaataatgatacatcaagatcaaatagggaatccttggaatactagggtggttcaatataataaaacatattgttgctataatttaccatattcatagaraagtcatttcctttgctcagtctattaataaaagacatttggtaaagtatatccatttgtgatttttgaaaaacagttaaggaagcaggaatcaaaactt

SEQ ID NO: 21501 - DNA, 201 bp, Homo sapiens
ccagggttctaaccccaagtgtgtctctagccatatgtaactgtgcagtttcagcatttagggtcttggcctcagtttccttctctgtcagatgaggcagytggtctctatgagctcaaaatttccaggtttgaaattctatggtttctatctaaggatacataggaatagatttataagaaaatgctagatgaaaactct

SEQ ID NO: 21502 - DNA, 201 bp, Homo sapiens
ctagatgaaaactctaggtttttcttaaggtaaggaggacaatattttgctcctgaggtatatcaagaatgagaaaaacaattgtgtgtgtgtgtgtgtgwgagagagagagagagagacagagacagagagagagagacagggagagggtatatcaagaatgagaaggaacaatgtgtgtatgtgtgtgtgagagagaga

SEQ ID NO: 21503 - DNA, 201 bp, Homo sapiens
agaaaggaaggcaggaattaagaataatccttagttctcttcctaatttgcacctctctcactgatacatatgtattattttctttttatgtcttttagartctaataaacatgttttatattatataacaaactagaatatatggattatctttggtcttccttaccaagttcttaactctgctggctctggggcactgg

SEQ ID NO: 21504 - DNA, 201 bp, Homo sapiens; identical to SEQ ID NO: 2460

SEQ ID NO: 21505 - DNA, 201 bp, Homo sapiens
gctagatgaaaactctaggtttttcttaaggtaaggaggacaatattttgctcctgaggtatatcaagaatgagaaaaacaattgtgtgtgtgtgtgtgtragagagagagagagagagacagagacagagagagagagacagggagagggtatatcaagaatgagaaggaacaatgtgtgtatgtgtgtgtgagagagag

SEQ ID NO: 21506 - DNA, 201 bp, Homo sapiens
gagaaggaacaatgtgtgtatgtgtgtgtgagagagagagagcggggaggggggagatcaaagcagatgtatgaggatatgaacagtacatggcgtataaygaaagagtttcaggagaaacctgtctggttctgttggaaaaactccgtctcctggcgcaggacagccccaaacacctctccctgcaagtggctgtgcacg

SEQ ID NO: 21507 - DNA, 201 bp, Homo sapiens; identical to SEQ ID NO: 2461

SEQ ID NO: 21508 - DNA, 201 bp, Homo sapiens; identical to SEQ ID NO: 2463

SEQ ID NO: 21509 - DNA, 201 bp, Homo sapiens
ctgggagatgagggtctgtgtagagcgggccaactccatgaacatacctggtaccattttcccaccttcttgggcagaaggaaaagcagaggcagggtgaycagggtgaccatggtgagggacactgatccccagagcatgatccccaagagacataggcctcgcaccaggtaccacagaaataagctcagattctcactc

SEQ ID NO: 21510 - DNA, 201 bp, Homo sapiens
gtaatcccagctactcgggaggctgaggcagggagaatcgcttgaacccgggaggcaaaggtggcagtgagccaagattgcgccattgcactccacctggrcgacaagagagaaattccatctcaaaaaaaaaaaaaaaaaaaaaattagaagacttcatttttctgtattggccaaataactgttctaatgcccttcatt

SEQ ID NO: 21511 - DNA, 201 bp, Homo sapiens
ctgacaacgaaggcggtagggtgacttccccagtgcagtagcctggtgctatccgcggacccgggggctccccatgagatcagctctcggaacaaggcaastcccggcagggccaagcccagtgccgcagctaatggcttcaaagcagccagccagccctgggcacctgcgttttcgctcttggagccaaccgttgccctg

SEQ ID NO: 21512 - DNA, 201 bp, Homo sapiens
tctccctgcctcctgcctttccacttgcaccagttttcccaccccagcctcagggcggggctgcctcgtcacttgtctcggggcagatctgccctacacamgttagcgccgcgcgcaaagcagccccgcagcacccaggcgcctcctggcggcgccgcgaaggggcggggctgtcggctgcgcgttgtgcgctgtcccagg

SEQ ID NO: 21513 - DNA, 201 bp, Homo sapiens
ttgggcaatacggataaaccagggctgttctgagtaaatcaaatgaggatacacagtcactgtgagaaccagtggtgtgctaagcacagtggctcacacckgtaatgccaacaatttgggaggctgaggcaggaggattacttgagcccaggagtttgaggccagcctaggcaagatggtgaaaccctgtctccacaaaaa

SEQ ID NO: 21514 - DNA, 201 bp, Homo sapiens
cttctggttgagtgtctttatttcttgcagcttttccctaaacttctgggcttcgccctcctcgttggcaaagcttcgaactgtaggcatggccgacagarcctcaatggccacctggctggactttgccagagattcccgcacctgcacttccagcaactgtggatacatggacaagagatgtcacacgggttggcaaac

SEQ ID NO: 21515 - DNA, 201 bp, Homo sapiens
aacaggaagagaaatacaggggtggccatttaagttaatgccgggcctggtacacttttaagagtgaaaaggggcaggacaaatgcaaagctcaatggggytcttgggcaatacggataaaccagggctgttctgagtaaatcaaatgaggatacacagtcactgtgagaaccagtggtgtgctaagcacagtggctcaca

SEQ ID NO: 21516 - DNA, 201 bp, Homo sapiens
tttcccaggtatatggaaccctgggaggaatgctgactcgacagccttttgccattggtggctccggcagcacctttatctatggttatgtggatgcagcrtataagccaggcatgtctcccgaggagtgcaggcgcttcaccacagacggtaaccagccaagtggaagggtacctggggagggctttgaaacatgggaag

SEQ ID NO: 21517 - DNA, 201 bp, Homo sapiens
gaccaaaaaaaaaaaaatagactgaccttgtttcccaagatcatagtcaattactctgtgttgggtctacaccacatctgcacatactatgagcccttccrttggagataattttcacttgcggagctgcttcacttctacctgtaggagcctcatctccacctctctacagtggagaggattccactaggcaagttggaa

SEQ ID NO: 21518 - DNA, 201 bp, Homo sapiens
tgggaggctgaggcaggaggattacttgagcccaggagtttgaggccagcctaggcaagatggtgaaaccctgtctccacaaaaaacaataaaaaaaagtaaaaaaaaaaatgaactgggcatagtggtgcacacctgtagtcccagctactcaggaggctgaggtggaaagatcatctgagccggggagatcaaggctgt

SEQ ID NO: 21519 - DNA, 201 bp, Homo sapiens
atgtagctttatcttccctcacttcttcttgattcttttcttgacctggaaaagtcagcttaaacttctcagtcaaattatctcttggtacaaatttaccyccctggctgctgagatatgtatttacctcttgatcggaaattccataactgaaacttttattttcaaccatctgtatgtgttccttgctgcttctctcct

SEQ ID NO: 21520 - DNA, 201 bp, Homo sapiens
ggcaaaccatcagggacactaatacctgagttacctatttggaaattaaaggtgagaagagacagaggaaaaggagaaaagagaaagagacacagctatgscccttggatgctaaagaaatacgaggaagaggaaaatgactcagaacgggttggggatcaaattcttaaagacagattgtggggagaagctagaaaagaa

SEQ ID NO: 21521 - DNA, 201 bp, Homo sapiens; identical to SEQ ID NO: 2467

SEQ ID NO: 21522 - DNA, 201 bp, Homo sapiens
gaagccaaggagtgaaactaatggaaactaatggacaacgtgaatatcttaaaaaaaaaaaaaagtggtgcgctgtcttatactggctagcaagagcagaytgcaaagtattcaggatttttgaagacagttgttaactattggtaacttgatattgaccactatggaagtatttatactatagaaatcagcaatgctaca

SEQ ID NO: 21523 - DNA, 201 bp, Homo sapiens; identical to SEQ ID NO: 2457

SEQ ID NO: 21524 - DNA, 201 bp, Homo sapiens
aaataactgttctaatgcccttcattccaataaaaggtttgtagcagcttacagagataatttaaaacaatttttaaaagaagaaaacaacactgggtcaragagaaaatatggttaagaaaagtaagtgaagccaaggagtgaaactaatggaaactaatggacaacgtgaatatcttaaaaaaaaaaaaaagtggtgcg

SEQ ID NO: 21525 - DNA, 201 bp, Homo sapiens
ttcttctctaacatgagggcatcaaggctgttcttgccctgacattccatattctgtgtctctgcagaccaccatcatggcagtggagtttgacgggggcrttgtgatgggttctgattcccgagtgtctgcagggtgagtaaaagtgaagatgtatgcatttggaaagaagctaatggcctcaaatacacactttcctta

SEQ ID NO: 21526 - DNA, 201 bp, Homo sapiens
tgtaaatcactatcctgatataaataatcaggaagaaggtgatattgtgacccaccataatatcaggcagttaccatacgagaaatcaaggtcgttgggayggaagtaaccttatctgcttttccccataagagcagggtccttgcagccaaaagaaagttatgtgggtggggctgagcaaaagagtgagcaattgaaagc

SEQ ID NO: 21527 - DNA, 201 bp, Homo sapiens
ggaaattccataactgaaacttttattttcaaccatctgtatgtgttccttgctgcttctctcctgccttgcccctggccatgctaaccactgccctcctygattttttccaatgttcagtaaattggaagagctcacttctgatgaaatggggggtgagagtggaggattgtggaccaaaaaaaaaaaaatagactgacc

SEQ ID NO: 21528 - DNA, 201 bp, Homo sapiens
tatttatactatagaaatcagcaatgctacaagtcagaagcattgtttttcttcagagagccggtttaacaggacacatatttatcagccaactataaatrgataaaaaataattggctccaggccataggatagtgaaagcaaagaaggaaataaaatgaggtacaagattcataaaattcattttttaaaagttgccag

SEQ ID NO: 21529 - DNA, 201 bp, Homo sapiens
ggtcagcaatggagcccagaacctctggcccccgccagtccagtgccgtttcttctacaccgaagtggtgttccaagacccacgctaggagtccttctccygctccacatttcccagaacccacgctactctaccttactgacaattacctttgattcctgtcccagtccccttgtgtcctcccctcttgccctgcgttcc

SEQ ID NO: 21530 - DNA, 201 bp, Homo sapiens
gtcttgtttcggctcttgctggcacttgaatctgtcagtttctgcatctgtaaagtggagataatatagtacctcatgagacggttattttgagaaccacrttctatatgtgaacacagtttaaaagctgtaaatcactatcctgatataaataatcaggaagaaggtgatattgtgacccaccataatatcaggcagtta

SEQ ID NO: 21531 - DNA, 201 bp, Homo sapiens
ttccaggagctggacactgggaaatggaaaagtcttgtttcggctcttgctggcacttgaatctgtcagtttctgcatctgtaaagtggagataatatagyacctcatgagacggttattttgagaaccacattctatatgtgaacacagtttaaaagctgtaaatcactatcctgatataaataatcaggaagaaggtga

SEQ ID NO: 21532 - DNA, 201 bp, Homo sapiens
ggtcgaaatctgcaggtaggctggagacccaggaagagctgatgttgcggcttgagtctgaaggtggtccagaggcagaattccctcttccttggaggacmtcagtctttgcccctaagaccttcaactgattggaagggccacttacattatggagggtaatctgctttacccaaaatctattgatttaaatgtaaatct

SEQ ID NO: 21533 - DNA, 201 bp, Homo sapiens
gggctagggacactgagtagagtcattgagcctcaggttgctaggacgaaaatactgaaccaaccatttcccagtaaaggaggagtgggagcagggtcatrggaatgggaatggagtcacggcatcttaaggacaagggaatgggtattcatcttcaggtgctcacactagtggtccaggagttgactgcataggccacag

SEQ ID NO: 21534 - DNA, 201 bp, Homo sapiens
acctctgaaagcatagtactttggggatatgagataccagggcttcattgcagggtgcagagaccacttaatgtctcagtgggaaggaagggcttgatgawtctttaacctgaggatccctttcccaggtatatggaaccctgggaggaatgctgactcgacagccttttgccattggtggctccggcagcacctttatct

SEQ ID NO: 21535 - DNA, 201 bp, Homo sapiens
tggacgtgtcctctgttacccgagacatgatgttacctgcagggttggggagaagagagtgaggtgaatcagacaggttccaagtgatgagacgaactaamaatgagccaggatgccagggtcaggggtgtcaacatggggttctaaggaggctgcaggaaacaaggttagggttctccagaggtctgcaaatctcagtgc

SEQ ID NO: 21536 - DNA, 201 bp, Homo sapiens; identical to SEQ ID NO: 2462

SEQ ID NO: 21537 - DNA, 201 bp, Homo sapiens
ccacagggacagggtgttccatgaagatggagaatcagtaagggtgccaggaaagctggactgaaagcaatgtgagaggaactgagtctgccaagtctggragatgagggtctgtgtagagcgggccaactccatgaacatacctggtaccattttcccaccttcttgggcagaaggaaaagcagaggcagggtgatcagg

SEQ ID NO: 21538 - DNA, 201 bp, Homo sapiens; identical to SEQ ID NO: 2464

SEQ ID NO: 21539 - DNA, 201 bp, Homo sapiens
ggagaatgaaccagagaccccatggagtctgactcaatgcacatcatgcaagtcacagttatcttcaccaccatcaccactatcaccttgtctggggagcrttttactcttcacaaaaggctttcattcatgtgatgtcagctaatacatgaagagccttataaagaaggttatatcactccatttttgaaaaatgaggaa

SEQ ID NO: 21540 - DNA, 201 bp, Homo sapiens; identical to SEQ ID NO: 2465

SEQ ID NO: 21541 - DNA, 201 bp, Homo sapiens
ataaagagaccacaaaaaaagggactgaggtagagaaatctggaggggacacaaagaaccacagtcattaacctgaaggaaatatcaagtccctgtctccyaagtgacatcggcaggctcaataggcagacaggagaatgaaccagagaccccatggagtctgactcaatgcacatcatgcaagtcacagttatcttcacc

SEQ ID NO: 21542 - DNA, 201 bp, Homo sapiens
cttaagggcacagcaaagactttgagaactgaatgaagattagatcttttaaaattggaagacttcggccaggcgcggtggctcgtgcctgtaattccagmactttgggaggccaaggcgggtggttcacctgaggtcaggagttcgtgaccagtctggccaacatggtgaaacctcatctctacttaaaatacaaaaatt

SEQ ID NO: 21543 - DNA, 201 bp, Homo sapiens
gagtttgagaccagcctgggcaacatggcaaaaccccgtctctacaaaaaatttagctggatggggtgcacctgtaatcccaactagtcagaaggctagaygggaggatcgcttgaacccaggaggcagaggttgcagtgagctgagattgtgccactgccctccagcctgggcaacagagtaagacactgtcttaaaaaa

SEQ ID NO: 21544 - DNA, 201 bp, Homo sapiens
gaagaaaacaacactgggtcagagagaaaatatggttaagaaaagtaagtgaagccaaggagtgaaactaatggaaactaatggacaacgtgaatatcttaaaaaaaaaaaaaagtggtgcgctgtcttatactggctagcaagagcagattgcaaagtattcaggatttttgaagacagttgttaactattggtaacttg

SEQ ID NO: 21545 - DNA, 201 bp, Homo sapiens
gtgggcaccagcagggagaatatgcggggcagcgcggtccggagcagcacccagtcggcgagaagtagcagtactgtccccagccatgcgagagaagctcsggggaggcagcggcacccgcggggagcgggacacctagagctagccattggcactcggacgccgtcccggtcccggccgggcctgggactctccgcgccc

SEQ ID NO: 21546 - DNA, 201 bp, Homo sapiens
taggataggtaccaggcaaaagctgggtgactcgatggaggcttttgtgccaaccttcagagactggctgcgtcagactgccctcaagagcatacaaaggaaaaaaagacaaattaaaagcctttaatccaaactcaagacatgaatgaaaaactgtaaatgcctctatagcagttttaaaggctatcttttctcctgcaa

SEQ ID NO: 21547 - DNA, 201 bp, Homo sapiens
taaaggaatagggtctgagagggggacaggagatagatttttgagggtcttctttccatctgtgcttagggatcaaaaagatgattctgtcaagcagatayctggtttctcatttaccatatattgaactattttgtctcttctcccactcctaaccaatttcctcacatgcaaaatgagtatatggggttaggtcaatat

SEQ ID NO: 21548 - DNA, 201 bp, Homo sapiens
agcgcagggaggtcgcctgtagcagccagcgcttgcaacccgcaatgagcatagagtatttcttttctgaggggggtcgtctagagtgtccgtgaagggamcaggcacgcgaggctggtggaaaaagcgggtgctttgactcttagctggaagcgtcaacgggaagctactctaaagcgctttcgctttcactctggtccc

SEQ ID NO: 21549 - DNA, 201 bp, Homo sapiens
agtaagcaggctgaaggcaggaagaaaatttaggatggcagaattgcagttggggccagtggaatacagggagtggtaggttgtacctgtagcactaagayatctgggcggtttgggtaggcaaaggagacatcttggaactggacaaggccctccaagtgtaagggagtcaacagaccactgggtgggcagcgaggggtg

SEQ ID NO: 21550 - DNA, 201 bp, Homo sapiens
gaagcaagaagggtaaagaatggaaggacatcacacagatggtgctgggccagaggaaggaatcacactggggagtgaaggtggagggacctcacctccamagcctgggtgaactgcatctggtagagaacaaatgtgacaaggttcccactgcttacagccccactggtcaccagctgcccaccaatgtagaggattccc

SEQ ID NO: 21551 - DNA, 201 bp, Homo sapiens
ggtagtttacagttccaacattcaatgccattttgctaacaagtgggcagtcaacaggcatattcaacagaaatactagtaggatctcaggctaaacataygaattcaaaactctaaaacaatcacatccccctggagtgtaaagaaaaaaatctaaaattacaaatgcctggagttgtttctagccatgatatttaactt

SEQ ID NO: 21552 - DNA, 201 bp, Homo sapiens
cagtactgtccccagccatgcgagagaagctccggggaggcagcggcacccgcggggagcgggacacctagagctagccattggcactcggacgccgtccyggtcccggccgggcctgggactctccgcgccccggtggggcctgaagctccgggtaccgccgagtcctcccctactggcggctgggggagggaacgaggg

SEQ ID NO: 21553 - DNA, 201 bp, Homo sapiens
caaaccatcagggacactaatacctgagttacctatttggaaattaaaggtgagaagagacagaggaaaaggagaaaagagaaagagacacagctatgccmcttggatgctaaagaaatacgaggaagaggaaaatgactcagaacgggttggggatcaaattcttaaagacagattgtggggagaagctagaaaagaaga

SEQ ID NO: 21554 - DNA, 201 bp, Homo sapiens
agcgcttgcaacccgcaatgagcatagagtatttcttttctgaggggggtcgtctagagtgtccgtgaagggaacaggcacgcgaggctggtggaaaaagsgggtgctttgactcttagctggaagcgtcaacgggaagctactctaaagcgctttcgctttcactctggtcccggacagtgggggctggttaaatcaaga

SEQ ID NO: 21555 - DNA, 201 bp, Homo sapiens
gctagaaagcatgccgaagtctgtggagcactcaagagaccagggttctaaccccaagtgtgtctctagccatatgtaactgtgcagtttcagcatttagrgtcttggcctcagtttccttctctgtcagatgaggcagttggtctctatgagctcaaaatttccaggtttgaaattctatggtttctatctaaggataca

SEQ ID NO: 21556 - DNA, 201 bp, Homo sapiens
tccgggtaccgccgagtcctcccctactggcggctgggggagggaacgagggcggggctctcggaaagtcccaggaacaggctgatcctgcgctggcgagmagctcagccatttaggggaaagcgaaatcgaaagcggccgcctgctcactagataacgcctacttccaaaagtggcctgcccagactattttggtagcaa

SEQ ID NO: 21557 - DNA, 201 bp, Homo sapiens
ttttctctgaggagcccacagccttctgtactctggggtagatggagagcagtacctagagggaggtaagaatagtgaaagtgaggtagtctgcttgccakcattatgtgaagcaagaagggtaaagaatggaaggacatcacacagatggtgctgggccagaggaaggaatcacactggggagtgaaggtggagggacct

SEQ ID NO: 21558 - DNA, 201 bp, Homo sapiens
actggcctttcgccaaggtaacatgtggcaaggttttaggttaggataggtaccaggcaaaagctgggtgactcgatggaggcttttgtgccaaccttcaragactggctgcgtcagactgccctcaagagcatacaaaggaaaaaaagacaaattaaaagcctttaatccaaactcaagacatgaatgaaaaactgtaaa

SEQ ID NO: 21559 - DNA, 201 bp, Homo sapiens
aacaatatgtcaatgacttaaataacatcatatctctgagagtaatttctcctatatttccatgacaaatgttagataattttccattttttccattcaayaaaataaacaggaaatataattaaagagttcaattgaggattgggatttagaaaggaaggcaggaattaagaataatccttagttctcttcctaatttgc

SEQ ID NO: 21560 - DNA, 201 bp, Homo sapiens
cattgccttgttacatagcatgatgtcttaccccagaagaaaaacagggaaatatagaaactcctaccctcccacatgcacagatttctgggtgatgcctycccaaggagtagagatagaagaagcggcaaagacaagggcagagacccagcaccactatgccacacacttgatgtcagataccaccaggaaagggaaaaa

SEQ ID NO: 21561 - DNA, 201 bp, Homo sapiens
caaataggacatgcatcattccataaaggtaacgccaataaattccagagtatcggtatcttagaaactatctatattctaggccaggagcagtggctcaygcctgtaatcccaacattttgggaggtcaaggtgggcagatccctagagcccaggagtttgagaccagcctgggcaacatggcaaaaccccgtctctaca

SEQ ID NO: 21562 - DNA, 201 bp, Homo sapiens
acctgagttacctatttggaaattaaaggtgagaagagacagaggaaaaggagaaaagagaaagagacacagctatgccccttggatgctaaagaaatacraggaagaggaaaatgactcagaacgggttggggatcaaattcttaaagacagattgtggggagaagctagaaaagaagacccagagagtatggaggttaa

SEQ ID NO: 21563 - DNA, 201 bp, Homo sapiens
actcagaggagcgtcctttggggccagagtaacttacggcctggtaagaaagacacagtgaaaccacttataatttgggaaatctcccctcactgccaaawgagcagtggcaagtaggaagtagaagtggaaacaagggataagagttagacctgaattttagtcccaggtctactattaactctgtgtgactttgcataa

SEQ ID NO: 21564 - DNA, 201 bp, Homo sapiens
cctctaacttgaagttaaccctgttctttgaccctctattcatgataagtcggtccgtcggaaagcatactcagaggagcgtcctttggggccagagtaayttacggcctggtaagaaagacacagtgaaaccacttataatttgggaaatctcccctcactgccaaatgagcagtggcaagtaggaagtagaagtggaaa

SEQ ID NO: 21565 - DNA, 201 bp, Homo sapiens
acccaggaggcagaggttgcagtgagctgagattgtgccactgccctccagcctgggcaacagagtaagacactgtcttaaaaaaaaaaaaaaaaaaagaraaagaaagaaagaaactatattctgcaaccatactgtaataaaattagaacttgataactaaaatatacttaaaattgtaagtgaacaaatatatttatc

SEQ ID NO: 21566 - DNA, 201 bp, Homo sapiens
gcatctttaaagagagggagggggctagggacactgagtagagtcattgagcctcaggttgctaggacgaaaatactgaaccaaccatttcccagtaaagraggagtgggagcagggtcataggaatgggaatggagtcacggcatcttaaggacaagggaatgggtattcatcttcaggtgctcacactagtggtccagg

SEQ ID NO: 21567 - DNA, 201 bp, Homo sapiens
cttaccccagaagaaaaacagggaaatatagaaactcctaccctcccacatgcacagatttctgggtgatgcctccccaaggagtagagatagaagaagcrgcaaagacaagggcagagacccagcaccactatgccacacacttgatgtcagataccaccaggaaagggaaaaatcacattccaaattacaaaggaaaag

SEQ ID NO: 21568 - DNA, 201 bp, Homo sapiens
cactttcagcagcatacctgaaatctataaagagaccacaaaaaaagggactgaggtagagaaatctggaggggacacaaagaaccacagtcattaacctraaggaaatatcaagtccctgtctcctaagtgacatcggcaggctcaataggcagacaggagaatgaaccagagaccccatggagtctgactcaatgcaca

SEQ ID NO: 21569 - DNA, 201 bp, Homo sapiens
aaaaaaaaacctgagttttaacttggtgactgttgactccctcctgacagcgaggcggtggtgaaccgagtgtttgacaagctgtccccgctgcacgagcrcatctactgtgcactctctggttcagctgctgatgcccaagccgtggccgacatggccgcctaccagctggagctccatgggtatgaagctctggagttc

SEQ ID NO: 21570 - DNA, 201 bp, Homo sapiens
tcggctgcgcgttgtgcgctgtcccaggttggaaaccagtgccccaggcggcgaggagagcggtgccttgcagggatgctgcgggcgggagcaccaaccgrggacttaccccgggcgggagaagtccacaccggggtaatgggtctgggcttgagggttggcagaggggtggaggagatgcagcggccaggggaccctgga

SEQ ID NO: 21571 - DNA, 201 bp, Homo sapiens
gggttggcagaggggtggaggagatgcagcggccaggggaccctggaagcgcgcgcggagaagtgaatgcagagaccaacgggagcgcagggaggtcgcckgtagcagccagcgcttgcaacccgcaatgagcatagagtatttcttttctgaggggggtcgtctagagtgtccgtgaagggaacaggcacgcgaggctgg

SEQ ID NO: 21572 - DNA, 201 bp, Homo sapiens
tgggaccactcatgagagcggactgttaaatagtcaaggatttgtgaactgcttagctatttgtaacttgcaattcatcatagcgggagcatttacaccayggacatcagcagatgccacatatggaagcctttttgtaaaaaaactgatttaccagcacaccactaaatatgccttcctggaagatgagttttgaggtga

SEQ ID NO: 21573 - DNA, 201 bp, Homo sapiens
agaagtgaatgcagagaccaacgggagcgcagggaggtcgcctgtagcagccagcgcttgcaacccgcaatgagcatagagtatttcttttctgagggggktcgtctagagtgtccgtgaagggaacaggcacgcgaggctggtggaaaaagcgggtgctttgactcttagctggaagcgtcaacgggaagctactctaaa

SEQ ID NO: 21574 - DNA, 201 bp, Homo sapiens
tgtccctcatccctggcttccactattcccatcactctcactaacaaatctacaaggtaccagcatgaagcagtcccaggtgcaagaatttatggcgccckgcacttcccctgagaggcaaaggaaggccctaggactggaagacacgcatctctccaatccacatggttgggtggattttatgtaccatactgaaaggaa

SEQ ID NO: 21575 - DNA, 201 bp, Homo sapiens
cagatgtccctcatccctggcttccactattcccatcactctcactaacaaatctacaaggtaccagcatgaagcagtcccaggtgcaagaatttatggckccctgcacttcccctgagaggcaaaggaaggccctaggactggaagacacgcatctctccaatccacatggttgggtggattttatgtaccatactgaaa

SEQ ID NO: 21576 - DNA, 201 bp, Homo sapiens
gccatgcgagagaagctccggggaggcagcggcacccgcggggagcgggacacctagagctagccattggcactcggacgccgtcccggtcccggccgggyctgggactctccgcgccccggtggggcctgaagctccgggtaccgccgagtcctcccctactggcggctgggggagggaacgagggcggggctctcggaa

SEQ ID NO: 21577 - DNA, 201 bp, Homo sapiens
gtagctctctttccagtgcatcacagatgtccctcatccctggcttccactattcccatcactctcactaacaaatctacaaggtaccagcatgaagcagkcccaggtgcaagaatttatggcgccctgcacttcccctgagaggcaaaggaaggccctaggactggaagacacgcatctctccaatccacatggttgggt

SEQ ID NO: 21578 - DNA, 201 bp, Homo sapiens
ttgacccaggaaggcctctccttggcccagatgctgccttactcccttccctgtgtcttccctgcccactcccatgtgcccactggggggactttgcttargatgggcgcctggggcagatggcagccccaagactggctggctggcttctgctctggactactgccaccactcgtggcttgggggcggctttgttagaga

SEQ ID NO: 21579 - DNA, 201 bp, Homo sapiens
atccagtcagtgaggcggcccgtaaagaatggaatggccatctcccctggagaaagagaagagaggtcacgcacaaatattaagtctaagtaggtcagttycagtcagactggccccaccacgcctcctccccctcaccattatcctggagggcatcagcagaaaggaaacactgacgtctcaatcccgaacctaaatagg

SEQ ID NO: 21580 - DNA, 201 bp, Homo sapiens
tgaaccagggaggcgaagtttgcagtgagcccaagattgatccactgcactccagcctgggtgacagagtgagactgtctcaaaaaaaaaaaaaaaaaaamaaacctgagttttaacttggtgactgttgactccctcctgacagcgaggcggtggtgaaccgagtgtttgacaagctgtccccgctgcacgagcgcatct

SEQ ID NO: 21581 - DNA, 201 bp, Homo sapiens
aggatcgcctgaggccaggagttcaagaccagcattgtcaacatactgagatcctgtgagatcctgtctctacaaaaaattaaaaaattagccaggtgtgrtggtgagcacctgtagtctcagctactagggaggctgaggcaggaagatcatttgagcccaggagtttgaggctgcagtaagctatgattgcaccactgc

SEQ ID NO: 21582 - DNA, 201 bp, Homo sapiens
aaaaatatatttttgaaaatgcccagatggtttcacagatgagttctatcaaacattcaaggaacatgaaacttctatattatatactttttccagaaaayagaaaaaaactaaacctgattagctaattttatcagccgagtgtaatcttgactccaaattgagttgtggaaaactcaaggaaaaaaaaataatagaccc

SEQ ID NO: 21583 - DNA, 201 bp, Homo sapiens
tgtagaggattcccactttcagcagcatacctgaaatctataaagagaccacaaaaaaagggactgaggtagagaaatctggaggggacacaaagaaccayagtcattaacctgaaggaaatatcaagtccctgtctcctaagtgacatcggcaggctcaataggcagacaggagaatgaaccagagaccccatggagtct

SEQ ID NO: 21584 - DNA, 201 bp, Homo sapiens
accaggtgttaaaaatgttacacataaaatatacatataaaataatattataatttcaaatacatttattagaacaagaaaagttaaaataaaggacctaraaattctactcaaaaatttggaaaaagagaagttgagcaaacctaaagaaatacgaagaaaaggagttataaagataagaatagaaagcaatgaaacaga

SEQ ID NO: 21585 - DNA, 201 bp, Homo sapiens
cacaaaaaacaataaaaaaaagtaaaaaaaaaaatgaactgggcatagtggtgcacacctgtagtcccagctactcaggaggctgaggtggaaagatcatytgagccggggagatcaaggctgtagtgagcggtgattgcaccactgcgctgcagcctaggtgacagagagagaccctgtctggagaaaaaaaaaaaaaaa

SEQ ID NO: 21586 - DNA, 201 bp, Homo sapiens
aaaacattttaattagctggcatggtggcatgcacctgtagtcctacctacttgggaggccaaggcaggaagattgcttgagcccaggagtttgagcttaytgtgagctgtgatcacaccactgcactccagcctgggtgacaaaggaagaccgtatttctaaaaaataaaaaatacaaatacaactacaaactagcacta

SEQ ID NO: 21587 - DNA, 201 bp, Homo sapiens
tcgtctctactaaaaatacaaaaaaaaaaaaaaaattagccgggcgtggtggcgggtgcctgtagtcccagctactcaggaggctgaggcgggagaacggygtgaacccgggaggcggagcttgcagtgagcccagatcgcgccactgcactccagcctgggcgacaaagcgagactccagctcaaaaataataataataa

SEQ ID NO: 21588 - DNA, 201 bp, Homo sapiens
ttaataatatctgagatgattatttgcctcctgctttaatccaagcattaaacttcatgctattctcttgtcaaagaaatttgagagacattgaatgatcmccctcaaaaattcctgagttctggttgggtgcagtggctcacatctataatctcagcactttgggatgccgaggtgggcagatatttgaggtcaggagtt

SEQ ID NO: 21589 - DNA, 201 bp, Homo sapiens
ggggctagggacactgagtagagtcattgagcctcaggttgctaggacgaaaatactgaaccaaccatttcccagtaaaggaggagtgggagcagggtcayaggaatgggaatggagtcacggcatcttaaggacaagggaatgggtattcatcttcaggtgctcacactagtggtccaggagttgactgcataggccaca

SEQ ID NO: 21590 - DNA, 201 bp, Homo sapiens
caatgctacaagtcagaagcattgtttttcttcagagagccggtttaacaggacacatatttatcagccaactataaatggataaaaaataattggctccrggccataggatagtgaaagcaaagaaggaaataaaatgaggtacaagattcataaaattcattttttaaaagttgccagaaaaccaaaaattatatataa

SEQ ID NO: 21591 - DNA, 201 bp, Homo sapiens
gaacaaggcaagtcccggcagggccaagcccagtgccgcagctaatggcttcaaagcagccagccagccctgggcacctgcgttttcgctcttggagccamccgttgccctgaggaccccgcaggcccccagccagagcacggcccagcggctcaggcccaccgcccagacccggagcagtggcagcgcggtgggcaccag

SEQ ID NO: 21592 - DNA, 201 bp, Homo sapiens
tcaaggactccaaaaagtaaacaaaagcaggtggattgtgaagagggtcaaaactgggagaggggcccctcctggggagtgggttttcaatgttttccccytttttcctcccagctctgccctgacgtcaggcctcaggtgcagagctgcactgcgtggtagcacaagccctgagttaacaagagaaataccggctttctg

SEQ ID NO: 21593 - DNA, 201 bp, Homo sapiens
taatgaaaaagggggaacagctacagatatgacacagatataaagcatagagtgttatgaacaagtatatgctaataaatttgaaaacctaggtgagatawgcaaattcctagaaacatttaatctatcaaaattagcacaaaaagaaatacaaaacttgactataccaatgagtattaaagcaatttttaaagttatcaa

SEQ ID NO: 21594 - DNA, 201 bp, Homo sapiens
atccaaaaaatctgtaaccactagtatacataacggaaaaaccttgggtatccaagacaagaatgttcactataattactagcttatcatagcactaaagmctatgggcaacataacaagaccccatttaccaaaaataaatttaaaacattttaattagctggcatggtggcatgcacctgtagtcctacctacttggga

SEQ ID NO: 21595 - DNA, 201 bp, Homo sapiens
ttgaaccagggaggcgaagtttgcagtgagcccaagattgatccactgcactccagcctgggtgacagagtgagactgtctcaaaaaaaaaaaaaaaaaaraaaacctgagttttaacttggtgactgttgactccctcctgacagcgaggcggtggtgaaccgagtgtttgacaagctgtccccgctgcacgagcgcatc

SEQ ID NO: 21596 - DNA, 201 bp, Homo sapiens
tcgcttgaacccaggaggcagaggttgcagtgagctgagattgtgccactgccctccagcctgggcaacagagtaagacactgtcttaaaaaaaaaaaaaraaaaagaaaaagaaagaaagaaactatattctgcaaccatactgtaataaaattagaacttgataactaaaatatacttaaaattgtaagtgaacaaata

SEQ ID NO: 21597 - DNA, 201 bp, Homo sapiens
catttcaccttgaacacagatgggagaaaaaaataattatttatgaaccgaattcaacaatattacaaataataatactgggaggccgaggtgggaggatygcctgaggccaggagttcaagaccagcattgtcaacatactgagatcctgtgagatcctgtctctacaaaaaattaaaaaattagccaggtgtgatggtg

SEQ ID NO: 21598 - DNA, 201 bp, Homo sapiens
gaacccaggaggcagaggttgcagtgagctgagattgtgccactgccctccagcctgggcaacagagtaagacactgtcttaaaaaaaaaaaaaaaaaaaraaaaagaaagaaagaaactatattctgcaaccatactgtaataaaattagaacttgataactaaaatatacttaaaattgtaagtgaacaaatatattta

SEQ ID NO: 21599 - DNA, 201 bp, Homo sapiens
aatccaaaaaatctgtaaccactagtatacataacggaaaaaccttgggtatccaagacaagaatgttcactataattactagcttatcatagcactaaarcctatgggcaacataacaagaccccatttaccaaaaataaatttaaaacattttaattagctggcatggtggcatgcacctgtagtcctacctacttggg

SEQ ID NO: 21600 - DNA, 201 bp, Homo sapiens
aattaaagagttcaattgaggattgggatttagaaaggaaggcaggaattaagaataatccttagttctcttcctaatttgcacctctctcactgatacayatgtattattttctttttatgtcttttagaatctaataaacatgttttatattatataacaaactagaatatatggattatctttggtcttccttaccaa

SEQ ID NO: 21601 - DNA, 201 bp, Homo sapiens
ataactaaaatatacttaaaattgtaagtgaacaaatatatttatcagtaacatggatttaaaaggcagtcgtggatgggagcatcgctggagtccagaaratggaggctgcagtgaggcatgattgcgtcactgcactccagcctcagcaatagagtgggaccctgtgtcaaataaataaacagcagttataaagaaaat

SEQ ID NO: 21602 - DNA, 201 bp, Homo sapiens
gaaagtggcttgtatgagtcgggattctccagagaagcagaaccaataggatgttggcagagagagatttattttaagtaattggctcatactactgtggragctggcacggtcgaaatctgcaggtaggctggagacccaggaagagctgatgttgcggcttgagtctgaaggtggtccagaggcagaattccctcttcc

SEQ ID NO: 21603 - DNA, 201 bp, Homo sapiens
atgtagaggattcccactttcagcagcatacctgaaatctataaagagaccacaaaaaaagggactgaggtagagaaatctggaggggacacaaagaaccrcagtcattaacctgaaggaaatatcaagtccctgtctcctaagtgacatcggcaggctcaataggcagacaggagaatgaaccagagaccccatggagtc

SEQ ID NO: 21604 - DNA, 201 bp, Homo sapiens
ttgataactaaaatatacttaaaattgtaagtgaacaaatatatttatcagtaacatggatttaaaaggcagtcgtggatgggagcatcgctggagtccaraagatggaggctgcagtgaggcatgattgcgtcactgcactccagcctcagcaatagagtgggaccctgtgtcaaataaataaacagcagttataaagaa

SEQ ID NO: 21605 - DNA, 201 bp, Homo sapiens
aaccaataggatgttggcagagagagatttattttaagtaattggctcatactactgtgggagctggcacggtcgaaatctgcaggtaggctggagacccrggaagagctgatgttgcggcttgagtctgaaggtggtccagaggcagaattccctcttccttggaggacctcagtctttgcccctaagaccttcaactga

SEQ ID NO: 21606 - DNA, 201 bp, Homo sapiens
ctcctgcctttccacttgcaccagttttcccaccccagcctcagggcggggctgcctcgtcacttgtctcggggcagatctgccctacacacgttagcgcmgcgcgcaaagcagccccgcagcacccaggcgcctcctggcggcgccgcgaaggggcggggctgtcggctgcgcgttgtgcgctgtcccaggttggaaacc

SEQ ID NO: 21607 - DNA, 201 bp, Homo sapiens
tggaagaagcagactcaccgtattagttacctattgccatgtaatgaatgacacccgcttaaaataacagacatttactataaggtgttactgggacaatrggggattttttaatatggattgtgtgtttgataatatggtatcaattttaagtatcttgggggtgatgacagtattagggttttgcaggagaaatgtcct

SEQ ID NO: 21608 - DNA, 201 bp, Homo sapiens
taaaattaactatcacttggctcaaggtgaaacttccagatcaatgtggcaggagtgttgaggaaggaagtgaactcggttctaaccaagtaggacagccraatcatcactgaagtgtggcactggcctttcgccaaggtaacatgtggcaaggttttaggttaggataggtaccaggcaaaagctgggtgactcgatgga

SEQ ID NO: 21609 - DNA, 201 bp, Homo sapiens
aggccaaggcgggtggttcacctgaggtcaggagttcgtgaccagtctggccaacatggtgaaacctcatctctacttaaaatacaaaaattagctgggcrtggtgcctgtaatcccagctactcgggaggctgaggcagggagaatcgcttgaacccgggaggcaaaggtggcagtgagccaagattgcgccattgcact

SEQ ID NO: 21610 - DNA, 201 bp, Homo sapiens
gtagatggagagcagtacctagagggaggtaagaatagtgaaagtgaggtagtctgcttgccagcattatgtgaagcaagaagggtaaagaatggaaggamatcacacagatggtgctgggccagaggaaggaatcacactggggagtgaaggtggagggacctcacctccacagcctgggtgaactgcatctggtagaga

SEQ ID NO: 21611 - DNA, 201 bp, Homo sapiens
catgcgtgtgacatgccttaagggcacagcaaagactttgagaactgaatgaagattagatcttttaaaattggaagacttcggccaggcgcggtggctcrtgcctgtaattccagcactttgggaggccaaggcgggtggttcacctgaggtcaggagttcgtgaccagtctggccaacatggtgaaacctcatctctac

SEQ ID NO: 21612 - DNA, 201 bp, Homo sapiens
aattccagcactttgggaggccgaagtgggcggatcacaaggtcaggagattgagaccatcctggctaacacggagaaacctcgtctctactaaaaatacaaaaaaaaaaaaaaaattagccgggcgtggtggcgggtgcctgtagtcccagctactcaggaggctgaggcgggagaacggcgtgaacccgggaggcggag

SEQ ID NO: 21613 - DNA, 201 bp, Homo sapiens
aggagtaccaggttacccctgagctgcacatgcgtgtgacatgccttaagggcacagcaaagactttgagaactgaatgaagattagatcttttaaaattrgaagacttcggccaggcgcggtggctcgtgcctgtaattccagcactttgggaggccaaggcgggtggttcacctgaggtcaggagttcgtgaccagtct

SEQ ID NO: 21614 - DNA, 201 bp, Homo sapiens
attccagcactttgggaggccgaagtgggcggatcacaaggtcaggagattgagaccatcctggctaacacggagaaacctcgtctctactaaaaatacaaaaaaaaaaaaaaaattagccgggcgtggtggcgggtgcctgtagtcccagctactcaggaggctgaggcgggagaacggcgtgaacccgggaggcggagc

SEQ ID NO: 21615 - DNA, 201 bp, Homo sapiens
gcctcaggtgcagagctgcactgcgtggtagcacaagccctgagttaacaagagaaataccggctttctggccagaggaatgaagaaaaagggcccctgcrggcaggaatgtgtaggggaatctccaaactgagagtacaggcggaaattccctaattctgagtctgaaccctcaggagtaccaggttacccctgagctgc

SEQ ID NO: 21616 - DNA, 201 bp, Homo sapiens
gaatggagttgaccttccccaaaagccactatgataagctatttggtgggtgcttgggtctctgaatttgtggaggaggatctggggtctgaatgtgtatrtgacctgtcccagtagtgtacagggatgagtaaaggaatagggtctgagagggggacaggagatagatttttgagggtcttctttccatctgtgcttagg

SEQ ID NO: 21617 - DNA, 201 bp, Homo sapiens
cgcatctctccaatccacatggttgggtggattttatgtaccatactgaaaggaagccacctagcatctttaaagagagggagggggctagggacactgagtagagtcattgagcctcaggttgctaggacgaaaatactgaaccaaccatttcccagtaaaggaggagtgggagcagggtcataggaatgggaatggagt

SEQ ID NO: 21618 - DNA, 201 bp, Homo sapiens
ctactgccaccactcgtggcttgggggcggctttgttagagaggaatagcctctaacttgaagttaaccctgttctttgaccctctattcatgataagtckgtccgtcggaaagcatactcagaggagcgtcctttggggccagagtaacttacggcctggtaagaaagacacagtgaaaccacttataatttgggaaatc

SEQ ID NO: 21619 - DNA, 201 bp, Homo sapiens
aaaactgccaaaaaaaattacatcaatgcctctaaacccaaaggactctacccccacaggtccctggttgttgtggtgattttcattgtgtaaaatacttyccacatcttttgacaccaagtctttctgcagccatgtttgaaaattaactttcaggctacagagtctttcttataccaaagttgaagaaagttttaagaa

SEQ ID NO: 21620 - DNA, 201 bp, Homo sapiens
gagacctctggcaagactcctaaggaaaatacaggagattcagaacgaaaagggtaaatgacatttatacacattttaaaatgcaaaatcttacgaccaaytctatacatataaatttgaaaatttagataaaacggatacgtttctagaaagatataaaggtcaaaactacaggaagaaatagaaaactaaaatagagta

SEQ ID NO: 21621 - DNA, 201 bp, Homo sapiens
caaatattctttgcccaaattacttttggttaaaatttctcctaaatgtgctacagagtgcaaactctgtctccctgccattccgctatatacttactaaytattattttattcaagatcatgcatgctctacttgaaggtctatttctatcttttcaatgctacccttacccactagcctaatcacattattcctatttt

SEQ ID NO: 21622 - DNA, 201 bp, Homo sapiens
tgcaaactctgtctccctgccattccgctatatacttactaactattattttattcaagatcatgcatgctctacttgaaggtctatttctatcttttcartgctacccttacccactagcctaatcacattattcctattttcaacatctaggaatcaattacatagtgaacatgcctaagaaataataatctgggcaga

SEQ ID NO: 21623 - DNA, 201 bp, Homo sapiens
tgcaggaggatatgagtcctttctgtgcattgtaacactgaggctcctccaggaagggaatctcaggcatgaacccctctttcaatgtcagccttcaggcragtggggaaagagcattgcttggctccattgctgaaggaagcagagatcaactctgttatttatcagcctgagacgcatcctctcaccataatttttctc

SEQ ID NO: 21624 - DNA, 201 bp, Homo sapiens
ccctttgagaggccgagcgggtggatcacttgaggtcaggcgttggtcaagtgctcctagagaaccaggctgaccaacatggagaaaccttgtctctactrataatacaaaaattagccaggtgaagtggcaggcacctataatcccagctattcgggaggctgaggaaggagaattggttgaagcccggaggtggaggtt

SEQ ID NO: 21625 - DNA, 201 bp, Homo sapiens
gggtgggttgcaggaggatatgagtcctttctgtgcattgtaacactgaggctcctccaggaagggaatctcaggcatgaacccctctttcaatgtcagcyttcaggcaagtggggaaagagcattgcttggctccattgctgaaggaagcagagatcaactctgttatttatcagcctgagacgcatcctctcaccataa

SEQ ID NO: 21626 - DNA, 201 bp, Homo sapiens
gagaaggcaactagaacaaacaggaatccttgccttggtgaaatgtatttgaactgggtcagaaatgaggccattgggtatcaggccttaactccagcgcmccctggaggtcactgatgtggctccaggctgacctgctcctgtcaaagaatattgagcaagatgcctctcgtggaatgttctgggaccttaaaacagata

SEQ ID NO: 21627 - DNA, 201 bp, Homo sapiens
aatggtgagcagactgcaaatctgcctgataggacccatattcccacagcactaattcaacatataccttactgagagcatgttttatcattaccattaakaagttaaatgaacatcagaatttaaaatcataaatataatctaatacactttaaccattttctttgtgtgccatcacaaatactccttaaccaaatacgg

SEQ ID NO: 21628 - DNA, 201 bp, Homo sapiens
ggagtctcataaattctggctgttattgctgttattattatgagggccagagggaacatagactatgaggaccagatagatcaatgagcccctaaaatctstgatccctgaagcagcaattgatgtgaaccaccccatcactcaccccgacgctcctgcgtcctcctgagcactcacccttgatggccccagctcctcgga

SEQ ID NO: 21629 - DNA, 201 bp, Homo sapiens
agccaaggagagggctctcaagatcacagctctgatatggaacattctgtcttcagggcgcatgttgtggggtctataattgatgactgtgagcacaggarcagtgatgaggaactgaggccgagtggaggcagatgagactgaaactgtgggcctctagcactggaaatgggtggagaggaatcagcatggctgggattc

SEQ ID NO: 21630 - DNA, 201 bp, Homo sapiens
agcactcacccttgatggccccagctcctcggagactcagcaggaaagccaaggagagggctctcaagatcacagctctgatatggaacattctgtcttcwgggcgcatgttgtggggtctataattgatgactgtgagcacaggaacagtgatgaggaactgaggccgagtggaggcagatgagactgaaactgtgggcc

SEQ ID NO: 21631 - DNA, 201 bp, Homo sapiens
caaagcaatacatgtagcactctttttcaaacactggtctttttttttttcttaacaatccaacattgttatgtgttttgcgtctcatattgacacctttyggtcaaggtagaggacatgtttgttgtaagctttctttttcgtgtagaggatggattcttcactcctgatacacacaatcagtgcacagcagctctctta

SEQ ID NO: 21632 - DNA, 201 bp, Homo sapiens
cctctttcaatgtcagccttcaggcaagtggggaaagagcattgcttggctccattgctgaaggaagcagagatcaactctgttatttatcagcctgagaygcatcctctcaccataatttttctctcctggacttacaggaaggaggctggcaacctgggataacttgtcttttacccccacagggttcctgagctcact

SEQ ID NO: 21633 - DNA, 201 bp, Homo sapiens
ccgaaagctactgtgctcctcttgcccatctccccttgcaaataatatcttccatcgggggaccggcttcctccaatttcaggagaggtggggctgaaggyacagacttgggcgtcactggcacagatataagtaaatacagctggagtctgcagagaggctggactgagtcagggagtcaggaaagagaagccacacaca

SEQ ID NO: 21634 - DNA, 201 bp, Homo sapiens
cttgatggccccagctcctcggagactcagcaggaaagccaaggagagggctctcaagatcacagctctgatatggaacattctgtcttcagggcgcatgytgtggggtctataattgatgactgtgagcacaggaacagtgatgaggaactgaggccgagtggaggcagatgagactgaaactgtgggcctctagcactg

SEQ ID NO: 21635 - DNA, 201 bp, Homo sapiens
cattgtctgtatatcttaatttcaagatattatttgagtaaattttgcttcctttgtatcaagatagaactttgaaaaggtaggtaatttcacagttgatyaaatattctttgcccaaattacttttggttaaaatttctcctaaatgtgctacagagtgcaaactctgtctccctgccattccgctatatacttactaac

SEQ ID NO: 21636 - DNA, 201 bp, Homo sapiens
ggcacctgtccctggtcaattcccgaaagctactgtgctcctcttgcccatctccccttgcaaataatatcttccatcgggggaccggcttcctccaattycaggagaggtggggctgaaggcacagacttgggcgtcactggcacagatataagtaaatacagctggagtctgcagagaggctggactgagtcagggagt

SEQ ID NO: 21637 - DNA, 201 bp, Homo sapiens
tttgcgtctcatattgacaccttttggtcaaggtagaggacatgtttgttgtaagctttctttttcgtgtagaggatggattcttcactcctgatacacayaatcagtgcacagcagctctcttatacatccagttgatgccttcagtctccctggcttcttacaagcatcttctgggccttgtgtgtccctgggcacctg

SEQ ID NO: 21638 - DNA, 201 bp, Homo sapiens
aaaaaaggaaggaaggaaggaaggaaggaaggaaggaaggaaggaaggaaggaaagaaggacaatctcaaattctatttcattatttttcttccacgctcstagtccagcctagggtgaatgtttccccctccaagaaggggcccttgcagcaccacaacctgcttgtctgccacgtgacggatttctacccaggcagcat

SEQ ID NO: 21639 - DNA, 201 bp, Homo sapiens
tatccctgatcagcctcatttcctcaaaaactataaaggaaaatgctgctgacttgtttttgcgtagtaatttcagctgtcacataataagctaaggaagrcagtatatagtaaataaggaccctttatctgtcttattttcccttttggcttcacaggaaacttgtgagaaacctatgcagcataaaattaatatgattt

SEQ ID NO: 21640 - DNA, 201 bp, Homo sapiens
tagaaaactaaaatagagtagagaatatcaaagaaattgtcatgggaagcaaagaatcgccttccaaagggccctgtcctgatcttattgcagatgagggygtcctcccacatttccaggagcagatcatgcctcttacacgtgtgattctagaacatagaatggaacagaatttttgagatcattttatgaggttggttc

SEQ ID NO: 21641 - DNA, 201 bp, Homo sapiens
caaccctgctgtcttgagagaggaaagcttgtgaccacccacaaagacccaggaagagccctagggtcctagaagagagggaggatacagaaacactcttygcacttcgtctcctaatgcagagtccatagctcggagttcctgtaaagcagccacaaaagatagaggctggggatcccagagagataggagggccctgat

SEQ ID NO: 21642 - DNA, 201 bp, Homo sapiens
tttgagctatttatttgatactcatagagaaggtcacaaaacatttactatttaatgtaatgatgaagtacatatattacgttaatattttatcttatttrtggtagccttaccttgcataaataataattactaacagattaggacatgagagattctgttattagtgctttgcatgcattacctcatttaaacctcata

SEQ ID NO: 21643 - DNA, 201 bp, Homo sapiens
atgggaacgagggtcagatagtggaacctgtgtaatctgagtttcttgctgggcaggaagatggtctctgcaataccctcaatgactggctccccattgcrcagccacgtgatgttcagcactggtgggaagaacttgtcaacatggcagacgagggtgttgggctggcccagatccacaggctccttgggaaagacgctt

SEQ ID NO: 21644 - DNA, 201 bp, Homo sapiens; identical to SEQ ID NO: 2781

SEQ ID NO: 21645 - DNA, 201 bp, Homo sapiens
ctacctcctggcctaaggaggggcacagggatgctggcaacagtctatttcttcacccgggtactagttacatgggtgcttgcggtgataaccattcaacrtacattctattggtttgtgtgtttcttccaaatgtcccctagttcacaatagaaagggcttaaatagagaagtaaaggagaatttgggaatttgaagcaa

SEQ ID NO: 21646 - DNA, 201 bp, Homo sapiens
aaattctctctctgcgtggtgagaaaacaggcctggagaggctctgcgacccgcttaggaccacagaactcggtactaggaaaactcctattttaaaatcyagccctgggtgggaagatttgggaagaatcgttaatattgagagagagagggagaaagaggattagatgagagtggcgcctccgctcatgtccgccccct

SEQ ID NO: 21647 - DNA, 201 bp, Homo sapiens
tcaatttcttttacacagtaagaataggatcagctgtgctaaactaacaaatacccagatatccaggtttggctcatgctacacgtccaaagtaagtcatscaggaagctctgcttatcatcgtactcaggaagccaggctgacagtctttctcctgcacatctgctcccagaacctccccagcagaatgaagggaaccta

SEQ ID NO: 21648 - DNA, 201 bp, Homo sapiens
tctctgcgtggtgagaaaacaggcctggagaggctctgcgacccgcttaggaccacagaactcggtactaggaaaactcctattttaaaatccagccctgrgtgggaagatttgggaagaatcgttaatattgagagagagagggagaaagaggattagatgagagtggcgcctccgctcatgtccgccccctccccgcag

SEQ ID NO: 21649 - DNA, 201 bp, Homo sapiens
aggaaggatgcagtgcagagacaggtcccagaggagacaagagctgagagaccatccaaactgggaccaccttgtcactagacttcaaattttcaatattkatagagtgttttctaagagtcaggccctttgctgagtgctatgtgcagcaggatcaaaggcagccaggaggtagaggagtcttgaggtacatcagtcatt

SEQ ID NO: 21650 - DNA, 201 bp, Homo sapiens
cgtggtgagaaaacaggcctggagaggctctgcgacccgcttaggaccacagaactcggtactaggaaaactcctattttaaaatccagccctgggtgggwagatttgggaagaatcgttaatattgagagagagagggagaaagaggattagatgagagtggcgcctccgctcatgtccgccccctccccgcagagaatt

SEQ ID NO: 21651 - DNA, 201 bp, Homo sapiens
aatcaactgccagattgcagacagccctgatgccagcctaaggagtgtgggtttctcctccaggcccgcaggtccccaacctcactcctctgaagactctyctggagatcctctgtgatgcacagatctccagactcagtgcccccagactcagattccctgggtggggaggtctggggatctctgcttgtaatcagctcc

SEQ ID NO: 21652 - DNA, 201 bp, Homo sapiens
ttactaactattattttattcaagatcatgcatgctctacttgaaggtctatttctatcttttcaatgctacccttacccactagcctaatcacattattyctattttcaacatctaggaatcaattacatagtgaacatgcctaagaaataataatctgggcagatgcagtggctcaggcccgtaatcccagccctttga

SEQ ID NO: 21653 - DNA, 201 bp, Homo sapiens
gatgtaaaaagataagttacaccttcttctgacggcaaatgttttccattatgttccttctcccgagccccacccccatcccagacagtcagatgatcttygatgttttttggtcactatattttaaatcatgttttatgttatgttgtcaatattttacaaaaatattctgctgataattaagaatgaatgtgctatcta

SEQ ID NO: 21654 - DNA, 201 bp, Homo sapiens
gcaattggcaaaaactgttactaagactttgtagaggcaccaatcagtgacatggcagcattttctttcacagtaatcaactgccagattgcagacagccytgatgccagcctaaggagtgtgggtttctcctccaggcccgcaggtccccaacctcactcctctgaagactcttctggagatcctctgtgatgcacagat

SEQ ID NO: 21655 - DNA, 201 bp, Homo sapiens
cttcctggggaacagatggcttcaatgtaggcattcagaaaacagggcaaaagccacttctctcagggaagacagcctgaccgggagaagatactgagttyactgtggggctattgcacttagaagacctgaaagtcatctaaggagaaataatacatagatatttgtggattatgggtggtctcaggagaggaatttagg

SEQ ID NO: 21656 - DNA, 201 bp, Homo sapiens
ttggaaaacttattcatctttttgagcttcagttttttcaaaataatttctaaataaaaggaataatttctaaatgaatggaatattatcttcattgaagrttcctgtgagatgtaaatggggaaagaaactatgcaggagtctcataaattctggctgttattgctgttattattatgagggccagagggaacatagact

SEQ ID NO: 21657 - DNA, 201 bp, Homo sapiens
ctcataaattctggctgttattgctgttattattatgagggccagagggaacatagactatgaggaccagatagatcaatgagcccctaaaatctgtgatycctgaagcagcaattgatgtgaaccaccccatcactcaccccgacgctcctgcgtcctcctgagcactcacccttgatggccccagctcctcggagactc

SEQ ID NO: 21658 - DNA, 201 bp, Homo sapiens
gacaatgtggatcagtctgaaaacaaggcaaaaatacaatagggagtaagggttgtgtgtcagttcaagactgtacttttacctggcccagcgccatgttrgggtatttgtgttctccaggaagtagaaaggaaagaactgagtgattagggacctagaagactaatttgagacattcctcttgatgagctgttctctagg

SEQ ID NO: 21659 - DNA, 201 bp, Homo sapiens
ctggctgttattgctgttattattatgagggccagagggaacatagactatgaggaccagatagatcaatgagcccctaaaatctgtgatccctgaagcarcaattgatgtgaaccaccccatcactcaccccgacgctcctgcgtcctcctgagcactcacccttgatggccccagctcctcggagactcagcaggaaag

SEQ ID NO: 21660 - DNA, 201 bp, Homo sapiens
ttctgtgcattgtaacactgaggctcctccaggaagggaatctcaggcatgaacccctctttcaatgtcagccttcaggcaagtggggaaagagcattgcwtggctccattgctgaaggaagcagagatcaactctgttatttatcagcctgagacgcatcctctcaccataatttttctctcctggacttacaggaagga

SEQ ID NO: 21661 - DNA, 201 bp, Homo sapiens
gctattcgggaggctgaggaaggagaattggttgaagcccggaggtggaggttgcagtgagccaatattgcgccactgcattccagacttggcaacagagygacactccatctcaacaaaaagaaagaatgaaagaaagaaagagcgagattatgtctcaaaaaaaaggaaggaaggaaggaaggaaggaaggaaggaagg

SEQ ID NO: 21662 - DNA, 201 bp, Homo sapiens; identical to SEQ ID NO: 2502

SEQ ID NO: 21663 - DNA, 201 bp, Homo sapiens
catcctcctcggggctgagatggattttacttgtcttgggttccccacggctgtcacagggcagtgtctcagttcattcgtctttttccttcaggaagtckgggtgtaaagggatggagagaggtgaggtgtgtgcagtaagaggatttctcaaggatgggacaggaaggccttggagctttggcttcctcctgtgaactt

SEQ ID NO: 21664 - DNA, 201 bp, Homo sapiens
gatgccagcctaaggagtgtgggtttctcctccaggcccgcaggtccccaacctcactcctctgaagactcttctggagatcctctgtgatgcacagatcyccagactcagtgcccccagactcagattccctgggtggggaggtctggggatctctgcttgtaatcagctccctagaggttcccatgtagccagataagt

SEQ ID NO: 21665 - DNA, 201 bp, Homo sapiens
gcaggtgtttatgaaactctgggatttctaaggaaggatgcagtgcagagacaggtcccagaggagacaagagctgagagaccatccaaactgggaccacyttgtcactagacttcaaattttcaatattgatagagtgttttctaagagtcaggccctttgctgagtgctatgtgcagcaggatcaaaggcagccaggag

SEQ ID NO: 21666 - DNA, 201 bp, Homo sapiens
ttggtggtccctaagtgaggatttcccctcccagcccagcatggggagaaccagtcctctacttagatgcatagtgtgacagcaggttcagtgccgcacayggatggtgagggtcccccactgagtttagggtctagaggattactcacctacagaaatgaatcccaaaggaaaaagaaaaatacatggtgtatagactgg

SEQ ID NO: 21667 - DNA, 201 bp, Homo sapiens
agcattgcttggctccattgctgaaggaagcagagatcaactctgttatttatcagcctgagacgcatcctctcaccataatttttctctcctggacttamaggaaggaggctggcaacctgggataacttgtcttttacccccacagggttcctgagctcactgaaaagactattgtgccttaggaaaagcatttgctgt

SEQ ID NO: 21668 - DNA, 201 bp, Homo sapiens
tggttaacacattagtggactccgcaaaattcatattaatttaaactgaattcagctcaagacatagacagaatttaatcaatttcatgacatgttaaagrtagtgaaccaaaaatctatagcatatatatttcaaagaaatgaggtggattgcctttgagattgtgcaaaagataggatgtccttcgttgctggaaatgt

SEQ ID NO: 21669 - DNA, 201 bp, Homo sapiens
gcaacacctggtcatctgtgagaccttcatgggacctgaagacgcagcacagaggaggaacttgaaaaaggacgggatttctactactcaagcatgtaggrgctcaggatattctgtaaatatgaagattttgagtttttgtaggtgaggtaaaaaaatacataggttttttacagaataagacatgtaaagctctcttca

SEQ ID NO: 21670 - DNA, 201 bp, Homo sapiens
agtttttgtaggtgaggtaaaaaaatacataggttttttacagaataagacatgtaaagctctcttcattttctttgtattttcatgaagttattagattmacaggccaccataatgccattgtctgtatatcttaatttcaagatattatttgagtaaattttgcttcctttgtatcaagatagaactttgaaaaggtag

SEQ ID NO: 21671 - DNA, 201 bp, Homo sapiens
cttgtctctactaataatacaaaaattagccaggtgaagtggcaggcacctataatcccagctattcgggaggctgaggaaggagaattggttgaagcccdgaggtggaggttgcagtgagccaatattgcgccactgcattccagacttggcaacagagtgacactccatctcaacaaaaagaaagaatgaaagaaagaa

SEQ ID NO: 21672 - DNA, 201 bp, Homo sapiens
tagcaatgacactggagactaaaggtggactccatggtgcccttgagcccagccctaccccatctccactatcctctgccaccagctgtgcaacttctgcwaggggtgaggttaataaactggagaagttaatttgtggagcatgaaacagatgagcagaacaatcacagcaccttaatttccccagtgtgcccaagaaca

SEQ ID NO: 21673 - DNA, 201 bp, Homo sapiens
aatgcagccagatgcatgaggtcccaagtactcaggctcctgcggagcgtccattgagtgatgggcaatggaatttggtgggatggaaatgtttctctaaytatctgaggtggtttcaatggctgattatataacctttcgtctttcatttcagttcaacgaggatctgcataaacaggtaatattcctgctttgatttcc

SEQ ID NO: 21674 - DNA, 201 bp, Homo sapiens
tctcctggacttacaggaaggaggctggcaacctgggataacttgtcttttacccccacagggttcctgagctcactgaaaagactattgtgccttaggamaagcatttgctgtgtttcgttagcatctggctccaggacagaccttcaacttccaaattggatactgctgccaagaagttgctctgaagtcagtttctat

SEQ ID NO: 21675 - DNA, 201 bp, Homo sapiens
aggaataatttctaaatgaatggaatattatcttcattgaagattcctgtgagatgtaaatggggaaagaaactatgcaggagtctcataaattctggctrttattgctgttattattatgagggccagagggaacatagactatgaggaccagatagatcaatgagcccctaaaatctgtgatccctgaagcagcaattg

SEQ ID NO: 21676 - DNA, 201 bp, Homo sapiens
cctggagaggctctgcgacccgcttaggaccacagaactcggtactaggaaaactcctattttaaaatccagccctgggtgggaagatttgggaagaatcsttaatattgagagagagagggagaaagaggattagatgagagtggcgcctccgctcatgtccgccccctccccgcagagaattaccttttccagggacgg

SEQ ID NO: 21677 - DNA, 201 bp, Homo sapiens
tactggaacagccagaaggacatcctggaggagaagcgggcagtgccggacaggatgtgcagacacaactacgagctgggcgggcccatgaccctgcagcrccgaggtgagtgagggctttgggccggcggtcccagggcagccccgcgggcccgtgcccagggcgcaggagcagccgggttggcctaagggaccttagtg

SEQ ID NO: 21678 - DNA, 201 bp, Homo sapiens
caatcccagggtcacagaagactacttgggttcatggtctctaatatttcaaacaggagctccctttagcgagtccttcttttcctgactgcagctctttycattttgccatccttttccagctccatgatggttctgcaggtttctgcggccccccggacagtggctctgacggcgttactgatggtgctgctcacatct

SEQ ID NO: 21679 - DNA, 201 bp, Homo sapiens
aaactggagaagttaatttgtggagcatgaaacagatgagcagaacaatcacagcaccttaatttccccagtgtgcccaagaacagagcaggcctgaagayactcaaacagaaacaaacatgtgccgtgtcactgataattctgtgtagacacacacctgccagacactgctcatggcactccctaggaagaacagcatgt

SEQ ID NO: 21680 - DNA, 201 bp, Homo sapiens
actggaacagccagaaggacatcctggaggagaagcgggcagtgccggacaggatgtgcagacacaactacgagctgggcgggcccatgaccctgcagcgycgaggtgagtgagggctttgggccggcggtcccagggcagccccgcgggcccgtgcccagggcgcaggagcagccgggttggcctaagggaccttagtgc

SEQ ID NO: 21681 - DNA, 201 bp, Homo sapiens
atttgggaagaatcgttaatattgagagagagagggagaaagaggattagatgagagtggcgcctccgctcatgtccgccccctccccgcagagaattacsttttccagggacggcaggaatgctacgcgtttaatgggacacagcgcttcctggagagatacatctacaaccgggaggagttcgcgcgcttcgacagcga

SEQ ID NO: 21682 - DNA, 201 bp, Homo sapiens
attcctattttcaacatctaggaatcaattacatagtgaacatgcctaagaaataataatctgggcagatgcagtggctcaggcccgtaatcccagccctwtgagaggccgagcgggtggatcacttgaggtcaggcgttggtcaagtgctcctagagaaccaggctgaccaacatggagaaaccttgtctctactaataa

SEQ ID NO: 21683 - DNA, 201 bp, Homo sapiens
ttgggaagaatcgttaatattgagagagagagggagaaagaggattagatgagagtggcgcctccgctcatgtccgccccctccccgcagagaattacctkttccagggacggcaggaatgctacgcgtttaatgggacacagcgcttcctggagagatacatctacaaccgggaggagttcgcgcgcttcgacagcgacg

SEQ ID NO: 21684 - DNA, 201 bp, Homo sapiens
gggaagaatcgttaatattgagagagagagggagaaagaggattagatgagagtggcgcctccgctcatgtccgccccctccccgcagagaattacctttwccagggacggcaggaatgctacgcgtttaatgggacacagcgcttcctggagagatacatctacaaccgggaggagttcgcgcgcttcgacagcgacgtg

SEQ ID NO: 21685 - DNA, 201 bp, Homo sapiens
gaatcgttaatattgagagagagagggagaaagaggattagatgagagtggcgcctccgctcatgtccgccccctccccgcagagaattaccttttccagkgacggcaggaatgctacgcgtttaatgggacacagcgcttcctggagagatacatctacaaccgggaggagttcgcgcgcttcgacagcgacgtggggga

SEQ ID NO: 21686 - DNA, 201 bp, Homo sapiens
tgtgggtttctcctccaggcccgcaggtccccaacctcactcctctgaagactcttctggagatcctctgtgatgcacagatctccagactcagtgccccsagactcagattccctgggtggggaggtctggggatctctgcttgtaatcagctccctagaggttcccatgtagccagataagtattgtcagaacactgaa

SEQ ID NO: 21687 - DNA, 201 bp, Homo sapiens
ttcacaggccaccataatgccattgtctgtatatcttaatttcaagatattatttgagtaaattttgcttcctttgtatcaagatagaactttgaaaaggyaggtaatttcacagttgatcaaatattctttgcccaaattacttttggttaaaatttctcctaaatgtgctacagagtgcaaactctgtctccctgccat

SEQ ID NO: 21688 - DNA, 201 bp, Homo sapiens
ctctctttgtccccatttgtcaagtagcagtgaggccgagccaggggatggtgaaagtggaaggaggtgggagttgggcattgggtgtgaagatgctcttkaaaggggttttaataaccacttgctaccaggccagtgaacacttaccatagttgatgccttttgagcatgttgcattgtaaactgtccctgaaattcctg

SEQ ID NO: 21689 - DNA, 201 bp, Homo sapiens
gaacactgaagatttttgaaaaatgaaaaagagaaggttggagatgtgtcttcagaagactactaagggtgctggctagaggagggaccagaggcagggaratgaggtaggaaactgctattatttgtcagggaaattgcaatcaaggcatgagttagaacagggaaaacacagaggcaagggagaggtggaagggggagg

SEQ ID NO: 21690 - DNA, 201 bp, Homo sapiens
attattattacagtgaattacagagagtttagggttcggcctggaagaggaagtgaagccaaatgacactgcatggttggtggtccctaagtgaggatttyccctcccagcccagcatggggagaaccagtcctctacttagatgcatagtgtgacagcaggttcagtgccgcacacggatggtgagggtcccccactgag

SEQ ID NO: 21691 - DNA, 201 bp, Homo sapiens
  misc_feature (1)...(201): n = A,T,C or G, or insertion/deletion polymorphism (see Tables 1-2)
cttcacctctcccggtgtctgattcctgctctgtaacatgaaataaataagaaccaacctccagatgtaaataagtgaacacatgagaagcacttagaatmgtgcctagaacatagtaagcaactcaatgaatgtcatttctcattacatttgttaatnnnnnnnnnnnnnnnnnnnnccttggcttaggggttcctgaag

SEQ ID NO: 21692 - DNA, 201 bp, Homo sapiens
gtattccccctgatttcatggttcccagaagctctatggggaagaaattgtaggtaattcacaactgagatttagacataagttgaatagtgtaatggacrttgagttaaccgaggtaatgaagtagtgagacacaggtgcccctgaaataaactcacattgagggaagaggctgacaatgtggatcagtctgaaaacaag

SEQ ID NO: 21693 - DNA, 201 bp, Homo sapiens
ctgagacgcatcctctcaccataatttttctctcctggacttacaggaaggaggctggcaacctgggataacttgtcttttacccccacagggttcctgasctcactgaaaagactattgtgccttaggaaaagcatttgctgtgtttcgttagcatctggctccaggacagaccttcaacttccaaattggatactgctg

SEQ ID NO: 21694 - DNA, 201 bp, Homo sapiens; identical to SEQ ID NO: 2816

SEQ ID NO: 21695 - DNA, 201 bp, Homo sapiens
agtggggcaattgaacaggcaggggcggatggatggcagaggaggaggaatctggactcaaggagctggggggctctgggcctggaattttagggtctggsgcccaaggcaccaggagaagaggcaggtcaggatatctgagtcaagacctgggatcttgccttagcaatgacactggagactaaaggtggactccatggt

SEQ ID NO: 21696 - DNA, 201 bp, Homo sapiens
ttgcttcctttgtatcaagatagaactttgaaaaggtaggtaatttcacagttgatcaaatattctttgcccaaattacttttggttaaaatttctcctawatgtgctacagagtgcaaactctgtctccctgccattccgctatatacttactaactattattttattcaagatcatgcatgctctacttgaaggtctat

SEQ ID NO: 21697 - DNA, 201 bp, Homo sapiens
ggccactgatatcagataatcggggaacaaacatgacctatagcgagagagggatcccaggctgggatcttaatgcagccagatgcatgaggtcccaagtrctcaggctcctgcggagcgtccattgagtgatgggcaatggaatttggtgggatggaaatgtttctctaattatctgaggtggtttcaatggctgattat

SEQ ID NO: 21698 - DNA, 201 bp, Homo sapiens
tctagaggattactcacctacagaaatgaatcccaaaggaaaaagaaaaatacatggtgtatagactgggctacacagatgtaattggttcagcttaggtyactttgtatttattatatttacaaaatctgaaaactaaaggttggcacattttgaagcaaattccacacttcaaatgttaattttcattcagttaataaa

SEQ ID NO: 21699 - DNA, 201 bp, Homo sapiens
ttcagtgccgcacacggatggtgagggtcccccactgagtttagggtctagaggattactcacctacagaaatgaatcccaaaggaaaaagaaaaatacayggtgtatagactgggctacacagatgtaattggttcagcttaggttactttgtatttattatatttacaaaatctgaaaactaaaggttggcacattttg

SEQ ID NO: 21700 - DNA, 201 bp, Homo sapiens
ttcctccaatttcaggagaggtggggctgaaggcacagacttgggcgtcactggcacagatataagtaaatacagctggagtctgcagagaggctggactragtcagggagtcaggaaagagaagccacacacaaggacaaccaatcatgtttctcataatcttcttaacctagggaataggacacaatcattttttcttt

SEQ ID NO: 21701 - DNA, 201 bp, Homo sapiens
acacacttctcgcatttcattttccaatgtaaatcatatggctgcaactaacttcaaataagtgggaatacttgaaggtggaaaacatttaagaagtacayactaaataaataataaaatacttctacaagagatatttatggaggacctactgtgtaccaggagcaatgctaggcattatggatatcagcagcctttggc

SEQ ID NO: 21702 - DNA, 201 bp, Homo sapiens
ctgaggtggtttcaatggctgattatataacctttcgtctttcatttcagttcaacgaggatctgcataaacaggtaatattcctgctttgatttccttgkggggtgggttgcaggaggatatgagtcctttctgtgcattgtaacactgaggctcctccaggaagggaatctcaggcatgaacccctctttcaatgtcag

SEQ ID NO: 21703 - DNA, 201 bp, Homo sapiens
acatagactatgaggaccagatagatcaatgagcccctaaaatctgtgatccctgaagcagcaattgatgtgaaccaccccatcactcaccccgacgctcytgcgtcctcctgagcactcacccttgatggccccagctcctcggagactcagcaggaaagccaaggagagggctctcaagatcacagctctgatatggaa

SEQ ID NO: 21704 - DNA, 201 bp, Homo sapiens
acagatctccagactcagtgcccccagactcagattccctgggtggggaggtctggggatctctgcttgtaatcagctccctagaggttcccatgtagccrgataagtattgtcagaacactgaagatttttgaaaaatgaaaaagagaaggttggagatgtgtcttcagaagactactaagggtgctggctagaggaggg

SEQ ID NO: 21705 - DNA, 201 bp, Homo sapiens
tgaaattagaattggtggtccaacaggatcacatttataagtgtctaaagtaagaagtaatgttctttgaaagtttgtaaaaatattcactctaaacaaartagaatcagatgctttgaaggaggtggggtctttgatgattttttttcactttcttccttatttaccagtcaatttatattctctatggactttattttt

SEQ ID NO: 21706 - DNA, 201 bp, Homo sapiens
tatgtgtgcatgtgtctttatagcagcatgatttataatcctttgggtatatatccagtaatgggatggctgggtcaaatggtatttctagttctagatcyttgaggaattgccacactgtcttgagataccatctcacaccagttaaaatggcgatcattaaaaagtcaggaaacaacaggtgctggagaggatgtggag

SEQ ID NO: 21707 - DNA, 201 bp, Homo sapiens
gcatgctctacttgaaggtctatttctatcttttcaatgctacccttacccactagcctaatcacattattcctattttcaacatctaggaatcaattacrtagtgaacatgcctaagaaataataatctgggcagatgcagtggctcaggcccgtaatcccagccctttgagaggccgagcgggtggatcacttgaggtc

SEQ ID NO: 21708 - DNA, 201 bp, Homo sapiens
tgaggtgtggcagaattggggaaatgataatccctgtagatgggccagcagaatatttgagatcaccttcagagcaaagaaaacgcataatctccccaaayatcatgacttatctgactggttaaaatgagtatcactgtctttcctccgtcatcttaagtgcatcacaggctttatattttcagacctttcatactaact

SEQ ID NO: 21709 - DNA, 201 bp, Homo sapiens
atgagtcctttctgtgcattgtaacactgaggctcctccaggaagggaatctcaggcatgaacccctctttcaatgtcagccttcaggcaagtggggaaaragcattgcttggctccattgctgaaggaagcagagatcaactctgttatttatcagcctgagacgcatcctctcaccataatttttctctcctggactta

SEQ ID NO: 21710 - DNA, 201 bp, Homo sapiens
ctactggcctattctctctccaaggacatgggtacagtaaacagagagaggtgcccagtggtcagtgcttgtctttggggaaaatgggaccaagaggtccwggataaccttggacagacaaggtttgcagagagagaagttggcaagtgcaggctcctgggcgtgttcatgtctgcatccagcctggaggggactcaggca

SEQ ID NO: 21711 - DNA, 201 bp, Homo sapiens
cttcctgtgtccatgtgttctcattgttcagttcccacctatgagtgagaacatgtggtctttggttttttgtccttgcaatagtttgctgtgaatgatgrtttccagcttcctccatgtccctacaaaggacatgaactcatccttttttatggctgcacagtattccatggtgtatatgtgtgcattttcttaatccag

SEQ ID NO: 21712 - DNA, 201 bp, Homo sapiens
aatcgttaatattgagagagagagggagaaagaggattagatgagagtggcgcctccgctcatgtccgccccctccccgcagagaattaccttttccaggkacggcaggaatgctacgcgtttaatgggacacagcgcttcctggagagatacatctacaaccgggaggagttcgcgcgcttcgacagcgacgtgggggag

SEQ ID NO: 21713 - DNA, 201 bp, Homo sapiens
tgaataagagacgaattcattcagatcagtggtttcaaaccgtgctctgggcaactcaattgctaagggttccacaaacaggataaagtttcttatatacaaaaaaaaatgaaggtttcaaattacaccataaaacccctcattgcttatgtctacttggcaggtaaaattccatttcaaaagttaaatgtacttaaaaaa

SEQ ID NO: 21714 - DNA, 201 bp, Homo sapiens
tgtggggtctataattgatgactgtgagcacaggaacagtgatgaggaactgaggccgagtggaggcagatgagactgaaactgtgggcctctagcactgsaaatgggtggagaggaatcagcatggctgggattcacctatcagagaaatcatagagctgacattctctgttgctgggtaaagaggacgctggaaggtgc

SEQ ID NO: 21715 - DNA, 201 bp, Homo sapiens
ctccccgcagagaattaccttttccagggacggcaggaatgctacgcgtttaatgggacacagcgcttcctggagagatacatctacaaccgggaggagtwcgcgcgcttcgacagcgacgtgggggagttccgggcggtgacggagctggggcggcctgctgcggagtactggaacagccagaaggacatcctggaggag

SEQ ID NO: 21716 - DNA, 201 bp, Homo sapiens
atacaggagattcagaacgaaaagggtaaatgacatttatacacattttaaaatgcaaaatcttacgaccaactctatacatataaatttgaaaatttagrtaaaacggatacgtttctagaaagatataaaggtcaaaactacaggaagaaatagaaaactaaaatagagtagagaatatcaaagaaattgtcatgggaa

SEQ ID NO: 21717 - DNA, 201 bp, Homo sapiens
catggtgtatatgtgtgcattttcttaatccagtctatcactgatggacagttgggttggttccaagtctttgctattgtgaatagtgccgcaataaacayatgtgtgcatgtgtctttatagcagcatgatttataatcctttgggtatatatccagtaatgggatggctgggtcaaatggtatttctagttctagatct

SEQ ID NO: 21718 - DNA, 201 bp, Homo sapiens
tggggaagagatgggagaattttaggtaccagcgtggtcaagagagctccagttcacagttcattttcagagttagagaaagagatgtaaaaagataagtyacaccttcttctgacggcaaatgttttccattatgttccttctcccgagccccacccccatcccagacagtcagatgatctttgatgttttttggtcact

SEQ ID NO: 21719 - DNA, 201 bp, Homo sapiens
cccgcagagaattaccttttccagggacggcaggaatgctacgcgtttaatgggacacagcgcttcctggagagatacatctacaaccgggaggagttcgygcgcttcgacagcgacgtgggggagttccgggcggtgacggagctggggcggcctgctgcggagtactggaacagccagaaggacatcctggaggagaag

SEQ ID NO: 21720 - DNA, 201 bp, Homo sapiens; identical to SEQ ID NO: 2846

SEQ ID NO: 21721 - DNA, 201 bp, Homo sapiens
ttgtcgtctaagtctgcattcatccaccagcctaggcctcctgtcttaattttcatacagacagaaatgactccccactggggaaagagcaaagcaatacrtgtagcactctttttcaaacactggtctttttttttttcttaacaatccaacattgttatgtgttttgcgtctcatattgacaccttttggtcaaggtag

SEQ ID NO: 21722 - DNA, 201 bp, Homo sapiens; identical to SEQ ID NO: 2549

SEQ ID NO: 21723 - DNA, 201 bp, Homo sapiens
cttacacactacctcctggcctaaggaggggcacagggatgctggcaacagtctatttcttcacccgggtactagttacatgggtgcttgcggtgataacyattcaacgtacattctattggtttgtgtgtttcttccaaatgtcccctagttcacaatagaaagggcttaaatagagaagtaaaggagaatttgggaatt

SEQ ID NO: 21724 - DNA, 201 bp, Homo sapiens; identical to SEQ ID NO: 2550

SEQ ID NO: 21725 - DNA, 201 bp, Homo sapiens
ccgggaggagttcgcgcgcttcgacagcgacgtgggggagttccgggcggtgacggagctggggcggcctgctgcggagtactggaacagccagaaggachtcctggaggagaagcgggcagtgccggacaggatgtgcagacacaactacgagctgggcgggcccatgaccctgcagcgccgaggtgagtgagggctttg

SEQ ID NO: 21726 - DNA, 201 bp, Homo sapiens
tcctgaaaagcttacacactacctcctggcctaaggaggggcacagggatgctggcaacagtctatttcttcacccgggtactagttacatgggtgcttgyggtgataaccattcaacgtacattctattggtttgtgtgtttcttccaaatgtcccctagttcacaatagaaagggcttaaatagagaagtaaaggagaa

SEQ ID NO: 21727 - DNA, 201 bp, Homo sapiens
acctgcagaagaaaaaacccggcgggcttaggactcccagctgagtgttgtatcctccatccctttccacctggtcccttcattttctacccctcacagtyccctaacgagaaggtggtccacccaacagacaacgctgcctcagatggttatcaaggggtaccctaagaagaaatcatctcaccctctctttgtccccat

SEQ ID NO: 21728 - DNA, 201 bp, Homo sapiens
agagggaacatagactatgaggaccagatagatcaatgagcccctaaaatctgtgatccctgaagcagcaattgatgtgaaccaccccatcactcaccccracgctcctgcgtcctcctgagcactcacccttgatggccccagctcctcggagactcagcaggaaagccaaggagagggctctcaagatcacagctctga

SEQ ID NO: 21729 - DNA, 201 bp, Homo sapiens
aggaaggaaggaaggaaggaaggaaggaaggaaggaaggaaagaaggacaatctcaaattctatttcattatttttcttccacgctcctagtccagcctarggtgaatgtttccccctccaagaaggggcccttgcagcaccacaacctgcttgtctgccacgtgacggatttctacccaggcagcattcaagtccgatgg

SEQ ID NO: 21730 - DNA, 201 bp, Homo sapiens
ggcctgctgcggagtactggaacagccagaaggacatcctggaggagaagcgggcagtgccggacaggatgtgcagacacaactacgagctgggcgggccsatgaccctgcagcgccgaggtgagtgagggctttgggccggcggtcccagggcagccccgcgggcccgtgcccagggcgcaggagcagccgggttggcct

SEQ ID NO: 21731 - DNA, 201 bp, Homo sapiens
atgggaagcaaagaatcgccttccaaagggccctgtcctgatcttattgcagatgagggcgtcctcccacatttccaggagcagatcatgcctcttacacrtgtgattctagaacatagaatggaacagaatttttgagatcattttatgaggttggttcatttatatttccagagccagctaagaatagtacaggagaac

SEQ ID NO: 21732 - DNA, 201 bp, Homo sapiens
aagaagaaatcatctcaccctctctttgtccccatttgtcaagtagcagtgaggccgagccaggggatggtgaaagtggaaggaggtgggagttgggcatygggtgtgaagatgctctttaaaggggttttaataaccacttgctaccaggccagtgaacacttaccatagttgatgccttttgagcatgttgcattgtaa

SEQ ID NO: 21733 - DNA, 201 bp, Homo sapiens
ggtctcaggagaggaatttaggccatagaactgagagtcattagtggcaggtgcaggttaaataagattttccaggaagagtgccaaaaatcagaattgcygagatctcagggtataatgagagaacatgatagttaagaggtggtttaaaagatgataaggaggatccaggtaaacaggagaaaaataaggacagggtag

SEQ ID NO: 21734 - DNA, 201 bp, Homo sapiens
attcacaggccaccataatgccattgtctgtatatcttaatttcaagatattatttgagtaaattttgcttcctttgtatcaagatagaactttgaaaagrtaggtaatttcacagttgatcaaatattctttgcccaaattacttttggttaaaatttctcctaaatgtgctacagagtgcaaactctgtctccctgcca

SEQ ID NO: 21735 - DNA, 201 bp, Homo sapiens
atctcaggcatgaacccctctttcaatgtcagccttcaggcaagtggggaaagagcattgcttggctccattgctgaaggaagcagagatcaactctgttmtttatcagcctgagacgcatcctctcaccataatttttctctcctggacttacaggaaggaggctggcaacctgggataacttgtcttttacccccacag

SEQ ID NO: 21736 - DNA, 201 bp, Homo sapiens
ctcagttcattcgtctttttccttcaggaagtctgggtgtaaagggatggagagaggtgaggtgtgtgcagtaagaggatttctcaaggatgggacaggarggccttggagctttggcttcctcctgtgaacttgtggggtggggagcctggtgcaccaacctgagggacttgagggagtagtatcaggatgtgggattga

SEQ ID NO: 21737 - DNA, 201 bp, Homo sapiens
tggacaagactgcagccactgcaggcccaaagcctgggtttaaatccaagctttgcactttgaagctgtgtggtcttcacctctcccggtgtctgattccygctctgtaacatgaaataaataagaaccaacctccagatgtaaataagtgaacacatgagaagcacttagaatagtgcctagaacatagtaagcaactca

SEQ ID NO: 21738 - DNA, 201 bp, Homo sapiens
cagattgcagacagccctgatgccagcctaaggagtgtgggtttctcctccaggcccgcaggtccccaacctcactcctctgaagactcttctggagatcmtctgtgatgcacagatctccagactcagtgcccccagactcagattccctgggtggggaggtctggggatctctgcttgtaatcagctccctagaggttc

SEQ ID NO: 21739 - DNA, 201 bp, Homo sapiens
catttatgtctcagaccactattcttaactattcaatggtgagcagactgcaaatctgcctgataggacccatattcccacagcactaattcaacatataycttactgagagcatgttttatcattaccattaagaagttaaatgaacatcagaatttaaaatcataaatataatctaatacactttaaccattttctttg

SEQ ID NO: 21740 - DNA, 201 bp, Homo sapiens
taaaaacaatacgttttgaccaattttagatttattctaggaatgcaatgattcttcagtgtcagaaaatatataatgtggttaacacattagtggactcygcaaaattcatattaatttaaactgaattcagctcaagacatagacagaatttaatcaatttcatgacatgttaaaggtagtgaaccaaaaatctatagc

SEQ ID NO: 21741 - DNA, 201 bp, Homo sapiens
cttgtggggtgggttgcaggaggatatgagtcctttctgtgcattgtaacactgaggctcctccaggaagggaatctcaggcatgaacccctctttcaatstcagccttcaggcaagtggggaaagagcattgcttggctccattgctgaaggaagcagagatcaactctgttatttatcagcctgagacgcatcctctca

SEQ ID NO: 21742 - DNA, 201 bp, Homo sapiens
gctgagtgctatgtgcagcaggatcaaaggcagccaggaggtagaggagtcttgaggtacatcagtcattggagttgaagagcagagattcaaaggaaagytggaactggagctttaaaggagatgtgaagtgggtgactcaacctctgactcagaaaaattgatacctgcagaagaaaaaacccggcgggcttaggactc

SEQ ID NO: 21743 - DNA, 201 bp, Homo sapiens
atctataccctggggccatgtccaaaccccatctttcttctataccagctcctgagcatagtttgaagccagggaaatggagacttcctgaccttggcttrggggttcctgaagattcatagttctcccccttgtcagagaatctagggacactgactggtctcgaaaccctcacacttaggaactgacctcacacatagg

SEQ ID NO: 21744 - DNA, 201 bp, Homo sapiens; identical to SEQ ID NO: 2873

SEQ ID NO: 21745 - DNA, 201 bp, Homo sapiens; identical to SEQ ID NO: 2572

SEQ ID NO: 21746 - DNA, 201 bp, Homo sapiens
gggttggttccaagtctttgctattgtgaatagtgccgcaataaacatatgtgtgcatgtgtctttatagcagcatgatttataatcctttgggtatatayccagtaatgggatggctgggtcaaatggtatttctagttctagatctttgaggaattgccacactgtcttgagataccatctcacaccagttaaaatggc

SEQ ID NO: 21747 - DNA, 201 bp, Homo sapiens
cagtattccatggtgtatatgtgtgcattttcttaatccagtctatcactgatggacagttgggttggttccaagtctttgctattgtgaatagtgccgcwataaacatatgtgtgcatgtgtctttatagcagcatgatttataatcctttgggtatatatccagtaatgggatggctgggtcaaatggtatttctagtt

SEQ ID NO: 21748 - DNA, 201 bp, Homo sapiens
tgggcattgggtgtgaagatgctctttaaaggggttttaataaccacttgctaccaggccagtgaacacttaccatagttgatgccttttgagcatgttgyattgtaaactgtccctgaaattcctgtgcacttggcttatgggatgaaacatcctcctagttctcttgtctctcagcttctctgaagtctcattgagcac

SEQ ID NO: 21749 - DNA, 201 bp, Homo sapiens
tctgtcttattttcccttttggcttcacaggaaacttgtgagaaacctatgcagcataaaattaatatgatttcaatccagggattcaacgatggaaggargtcatgagaatagcagaaagtcttcaaatcgagatcattatgaaatcctcagacccagagcacataaatcctaccctcagagtcactgagcagttaacat

SEQ ID NO: 21750 - DNA, 201 bp, Homo sapiens
cgcgcgcttcgacagcgacgtgggggagttccgggcggtgacggagctggggcggcctgctgcggagtactggaacagccagaaggacatcctggaggagragcgggcagtgccggacaggatgtgcagacacaactacgagctgggcgggcccatgaccctgcagcgccgaggtgagtgagggctttgggccggcggtcc

SEQ ID NO: 21751 - DNA, 201 bp, Homo sapiens
tgttattagtgctttgcatgcattacctcatttaaacctcatattaaacctgagggaggtattattaatgtctactgtaaaaataaattacctgagacatygaggaagtatttgtctaattatctatggcaggtaaatgacaaggagaaaagtcccacccaggcagttactaaaaaaactgagtttttctccacaatcctc

SEQ ID NO: 21752 - DNA, 201 bp, Homo sapiens
ctgagaacaacaggacaagctggggcacaaatgcaaagatgcagagggaggcaacacctggtcatctgtgagaccttcatgggacctgaagacgcagcacwgaggaggaacttgaaaaaggacgggatttctactactcaagcatgtaggagctcaggatattctgtaaatatgaagattttgagtttttgtaggtgaggt

SEQ ID NO: 21753 - DNA, 201 bp, Homo sapiens
attgggaacatgaaggaataacacagaaaatgagaaatgcaaatgaaagaaaagaaaaggagtgagaagaaacaaagacagaaatgacccatggacgatayaggttgtttcccttgtccctgaagacttaacatccgtctatgataatggtaatgctgaatacagtaagataatatttattgggcacttactatgtgctaa

SEQ ID NO: 21754 - DNA, 201 bp, Homo sapiens
agagagccctaagctggagtgtccaggctctgaggatcactgaggattcagtgctcacgaagaatgcctcttattccccagggtggagcaggagcccacaycccttggacaattaaggagagaagggagggagggggataggttttagcccctgaaggcattctcattaaaggtacttctcccagcctccccagaacttgg

SEQ ID NO: 21755 - DNA, 201 bp, Homo sapiens
gggggagttccgggcggtgacggagctggggcggcctgctgcggagtactggaacagccagaaggacatcctggaggagaagcgggcagtgccggacaggrtgtgcagacacaactacgagctgggcgggcccatgaccctgcagcgccgaggtgagtgagggctttgggccggcggtcccagggcagccccgcgggcccg

SEQ ID NO: 21756 - DNA, 201 bp, Homo sapiens
gggagttccgggcggtgacggagctggggcggcctgctgcggagtactggaacagccagaaggacatcctggaggagaagcgggcagtgccggacaggatrtgcagacacaactacgagctgggcgggcccatgaccctgcagcgccgaggtgagtgagggctttgggccggcggtcccagggcagccccgcgggcccgtg

SEQ ID NO: 21757 - DNA, 201 bp, Homo sapiens
cacacaatcagtgcacagcagctctcttatacatccagttgatgccttcagtctccctggcttcttacaagcatcttctgggccttgtgtgtccctgggcrcctgtccctggtcaattcccgaaagctactgtgctcctcttgcccatctccccttgcaaataatatcttccatcgggggaccggcttcctccaatttcag

SEQ ID NO: 21758 - DNA, 201 bp, Homo sapiens
ccatattgaagacaaggaatcgaagtccaagagaggcagtgtcgttaaagctgcatatttacatggtagggtaggtggtgtgtccacgctcccagtgtaasgtccctagactgagccctcctgaccctgatgacagtcctgtggaagaacctggtaactcctgcacatcgcaggactcacagacctctgggagaaagtaaa

SEQ ID NO: 21759 - DNA, 201 bp, Homo sapiens
tagtggatctccctgaatgaactgttctctaggagcacttgacccttttctgtgtttgttttttgttttgtgtttgtgtttgtttttgagacaggttctcrctttgtctcccaggctggagtgctgtggcaccatcatggctcactgcagcctcaacctcctgggctcaagtgatcctcctgcctcagcctcccatgtagc

SEQ ID NO: 21760 - DNA, 201 bp, Homo sapiens
gtctgatgggcaggtagacagaagggtctgcagccggggaggagactgagatacatgagaccatccagggagaggggacccagggggaagagcaaaggacyggatcctgggaactggacagttgtgatttggccaagacagaaaagcctgtgaaagagaccaaaaaaacccaagtgcagtgtgaggagaggcccgcagaga

SEQ ID NO: 21761 - DNA, 201 bp, Homo sapiens
aaagttgctgaggtaattggttgagagaggtgttcaaataaaaataacgcaattggcaaaaactgttactaagactttgtagaggcaccaatcagtgacayggcagcattttctttcacagtaatcaactgccagattgcagacagccctgatgccagcctaaggagtgtgggtttctcctccaggcccgcaggtccccaa

SEQ ID NO: 21762 - DNA, 201 bp, Homo sapiens
ggttcctgatggccaagatgagaggatcctcagggatgtaccagagacaagtcagaagcttagctccacgtgtgaggacacaaagaaagtgtctctgggayaggatgcagactgaaggcaaggttgttttttatcagttggtttgcacttatgtttttaaggtaaatgacatgtttaaatgttaagagactgggcagggaa

SEQ ID NO: 21763 - DNA, 201 bp, Homo sapiens
agttttttcaaaataatttctaaataaaaggaataatttctaaatgaatggaatattatcttcattgaagattcctgtgagatgtaaatggggaaagaaamtatgcaggagtctcataaattctggctgttattgctgttattattatgagggccagagggaacatagactatgaggaccagatagatcaatgagccccta

SEQ ID NO: 21764 - DNA, 201 bp, Homo sapiens
ggaggtctggggatctctgcttgtaatcagctccctagaggttcccatgtagccagataagtattgtcagaacactgaagatttttgaaaaatgaaaaagmgaaggttggagatgtgtcttcagaagactactaagggtgctggctagaggagggaccagaggcagggagatgaggtaggaaactgctattatttgtcagg

SEQ ID NO: 21765 - DNA, 201 bp, Homo sapiens
aggctgaggaaggagaattggttgaagcccggaggtggaggttgcagtgagccaatattgcgccactgcattccagacttggcaacagagtgacactccayctcaacaaaaagaaagaatgaaagaaagaaagagcgagattatgtctcaaaaaaaaggaaggaaggaaggaaggaaggaaggaaggaaggaaggaaggaa

SEQ ID NO: 21766 - DNA, 201 bp, Homo sapiens
ggagacttcctgaccttggcttaggggttcctgaagattcatagttctcccccttgtcagagaatctagggacactgactggtctcgaaaccctcacactyaggaactgacctcacacataggaacagttctcttccttcagcattttagcctcttctcaggcattttgagaggcaacttccagaatcagcatttgccacc

SEQ ID NO: 21767 - DNA, 201 bp, Homo sapiens
tgcggagcgtccattgagtgatgggcaatggaatttggtgggatggaaatgtttctctaattatctgaggtggtttcaatggctgattatataacctttcstctttcatttcagttcaacgaggatctgcataaacaggtaatattcctgctttgatttccttgtggggtgggttgcaggaggatatgagtcctttctgtg

SEQ ID NO: 21768 - DNA, 201 bp, Homo sapiens
taaaatcataaatataatctaatacactttaaccattttctttgtgtgccatcacaaatactccttaaccaaatacggcttggacttttgaatgcatccartagacgtcatttgtcgtctaagtctgcattcatccaccagcctaggcctcctgtcttaattttcatacagacagaaatgactccccactggggaaagagc

SEQ ID NO: 21769 - DNA, 201 bp, Homo sapiens
atgaaaatgggagaatccacactcagagtggggcaattgaacaggcaggggcggatggatggcagaggaggaggaatctggactcaaggagctggggggcyctgggcctggaattttagggtctggggcccaaggcaccaggagaagaggcaggtcaggatatctgagtcaagacctgggatcttgccttagcaatgacac

SEQ ID NO: 21770 - DNA, 201 bp, Homo sapiens
cctgcacatctgctcccagaacctccccagcagaatgaagggaacctaagaatttattcactggcttttaatgatccctcctagaaagaacacacttctcrcatttcattttccaatgtaaatcatatggctgcaactaacttcaaataagtgggaatacttgaaggtggaaaacatttaagaagtacacactaaataaat

SEQ ID NO: 21771 - DNA, 201 bp, Homo sapiens
atgtgtctcactctgacatatgcaggtgtttatgaaactctgggatttctaaggaaggatgcagtgcagagacaggtcccagaggagacaagagctgagaraccatccaaactgggaccaccttgtcactagacttcaaattttcaatattgatagagtgttttctaagagtcaggccctttgctgagtgctatgtgcagc

SEQ ID NO: 21772 - DNA, 201 bp, Homo sapiens
ctccattgctgaaggaagcagagatcaactctgttatttatcagcctgagacgcatcctctcaccataatttttctctcctggacttacaggaaggaggcyggcaacctgggataacttgtcttttacccccacagggttcctgagctcactgaaaagactattgtgccttaggaaaagcatttgctgtgtttcgttagca

SEQ ID NO: 21773 - DNA, 201 bp, Homo sapiens
ccttgtggggtgggttgcaggaggatatgagtcctttctgtgcattgtaacactgaggctcctccaggaagggaatctcaggcatgaacccctctttcaaygtcagccttcaggcaagtggggaaagagcattgcttggctccattgctgaaggaagcagagatcaactctgttatttatcagcctgagacgcatcctctc

SEQ ID NO: 21774 - DNA, 201 bp, Homo sapiens
aggatttcccctcccagcccagcatggggagaaccagtcctctacttagatgcatagtgtgacagcaggttcagtgccgcacacggatggtgagggtcccycactgagtttagggtctagaggattactcacctacagaaatgaatcccaaaggaaaaagaaaaatacatggtgtatagactgggctacacagatgtaatt

SEQ ID NO: 21775 - DNA, 201 bp, Homo sapiens
ttcaaatcgagatcattatgaaatcctcagacccagagcacataaatcctaccctcagagtcactgagcagttaacattacaaattacaaaccatatccartcagagtcattctctttcctgcttgtctcctgtactcatgttacaggttagggcagtaccccgagtggagtgaacaatctctggactaacacttgtcagg

SEQ ID NO: 21776 - DNA, 201 bp, Homo sapiens
gtggggtgggttgcaggaggatatgagtcctttctgtgcattgtaacactgaggctcctccaggaagggaatctcaggcatgaacccctctttcaatgtcrgccttcaggcaagtggggaaagagcattgcttggctccattgctgaaggaagcagagatcaactctgttatttatcagcctgagacgcatcctctcacca

SEQ ID NO: 21777 - DNA, 201 bp, Homo sapiens
tcctgcacatctgctcccagaacctccccagcagaatgaagggaacctaagaatttattcactggcttttaatgatccctcctagaaagaacacacttctygcatttcattttccaatgtaaatcatatggctgcaactaacttcaaataagtgggaatacttgaaggtggaaaacatttaagaagtacacactaaataaa

SEQ ID NO: 21778 - DNA, 201 bp, Homo sapiens
tctgtgcattgtaacactgaggctcctccaggaagggaatctcaggcatgaacccctctttcaatgtcagccttcaggcaagtggggaaagagcattgctyggctccattgctgaaggaagcagagatcaactctgttatttatcagcctgagacgcatcctctcaccataatttttctctcctggacttacaggaaggag

SEQ ID NO: 21779 - DNA, 201 bp, Homo sapiens
aacattgttatgtgttttgcgtctcatattgacaccttttggtcaaggtagaggacatgtttgttgtaagctttctttttcgtgtagaggatggattcttyactcctgatacacacaatcagtgcacagcagctctcttatacatccagttgatgccttcagtctccctggcttcttacaagcatcttctgggccttgtgt

SEQ ID NO: 21780 - DNA, 201 bp, Homo sapiens
attatttttcttccacgctcctagtccagcctagggtgaatgtttccccctccaagaaggggcccttgcagcaccacaacctgcttgtctgccacgtgacrgatttctacccaggcagcattcaagtccgatggttcctgaatggacaggaggaaacagctggggtcgtgtccaccaacctgatccgtaatggagactgga

SEQ ID NO: 21781 - DNA, 201 bp, Homo sapiens
aggaggaaacagctggggtcgtgtccaccaacctgatccgtaatggagactggaccttccagatcctggtgatgctggaaatgaccccccagcagggagaygtctacacctgccaagtggagcacaccagcctggatagtcctgtcaccgtggagtggagtgagtctctgatgaccctctagaccccacctctgaagagca

SEQ ID NO: 21782 - DNA, 201 bp, Homo sapiens
acagctggggtcgtgtccaccaacctgatccgtaatggagactggaccttccagatcctggtgatgctggaaatgaccccccagcagggagatgtctacayctgccaagtggagcacaccagcctggatagtcctgtcaccgtggagtggagtgagtctctgatgaccctctagaccccacctctgaagagcaggggactc

SEQ ID NO: 21783 - DNA, 201 bp, Homo sapiens
tccgtaatggagactggaccttccagatcctggtgatgctggaaatgaccccccagcagggagatgtctacacctgccaagtggagcacaccagcctggayagtcctgtcaccgtggagtggagtgagtctctgatgaccctctagaccccacctctgaagagcaggggactctctggctctggggtccactcatcttatc

SEQ ID NO: 21784 - DNA, 201 bp, Homo sapiens
gcatggttggtggtccctaagtgaggatttcccctcccagcccagcatggggagaaccagtcctctacttagatgcatagtgtgacagcaggttcagtgcygcacacggatggtgagggtcccccactgagtttagggtctagaggattactcacctacagaaatgaatcccaaaggaaaaagaaaaatacatggtgtata

SEQ ID NO: 21785 - DNA, 201 bp, Homo sapiens
aagcatcttctgggccttgtgtgtccctgggcacctgtccctggtcaattcccgaaagctactgtgctcctcttgcccatctccccttgcaaataatatcytccatcgggggaccggcttcctccaatttcaggagaggtggggctgaaggcacagacttgggcgtcactggcacagatataagtaaatacagctggagtc

SEQ ID NO: 21786 - DNA, 201 bp, Homo sapiens
ataacgcaattggcaaaaactgttactaagactttgtagaggcaccaatcagtgacatggcagcattttctttcacagtaatcaactgccagattgcagasagccctgatgccagcctaaggagtgtgggtttctcctccaggcccgcaggtccccaacctcactcctctgaagactcttctggagatcctctgtgatgca

SEQ ID NO: 21787 - DNA, 201 bp, Homo sapiens
ttattccacgatgaggggtttgacagaaaagaaatgtcagaaagctctagaggccactgatatcagataatcggggaacaaacatgacctatagcgagagrgggatcccaggctgggatcttaatgcagccagatgcatgaggtcccaagtactcaggctcctgcggagcgtccattgagtgatgggcaatggaatttggt

SEQ ID NO: 21788 - DNA, 201 bp, Homo sapiens
tatcagagaaatcatagagctgacattctctgttgctgggtaaagaggacgctggaaggtgctggggaagagatgggagaattttaggtaccagcgtggtyaagagagctccagttcacagttcattttcagagttagagaaagagatgtaaaaagataagttacaccttcttctgacggcaaatgttttccattatgttc

SEQ ID NO: 21789 - DNA, 201 bp, Homo sapiens
attcacacttattccacgatgaggggtttgacagaaaagaaatgtcagaaagctctagaggccactgatatcagataatcggggaacaaacatgacctatrgcgagagagggatcccaggctgggatcttaatgcagccagatgcatgaggtcccaagtactcaggctcctgcggagcgtccattgagtgatgggcaatgg

SEQ ID NO: 21790 - DNA, 201 bp, Homo sapiens
tcaggatggaaatgtcagtcagggagttaagtagggggagcagctccgccctccacgtccccagctcctcccgcccctgttttttctcccagtgaccccamgtgaaacgtctccgcctcctccagccaccagcagaagggactgccttcccctcagtgctcgcccctccctagtgatcactcagtgcccctgagctcattc

SEQ ID NO: 21791 - DNA, 201 bp, Homo sapiens
cgggacttaccttcccctggcatattcacacttattccacgatgaggggtttgacagaaaagaaatgtcagaaagctctagaggccactgatatcagatartcggggaacaaacatgacctatagcgagagagggatcccaggctgggatcttaatgcagccagatgcatgaggtcccaagtactcaggctcctgcggagc

SEQ ID NO: 21792 - DNA, 201 bp, Homo sapiens
tctttctgcagccatgtttgaaaattaactttcaggctacagagtctttcttataccaaagttgaagaaagttttaagaaatatatttctacatctcctamatgcaaaacaacaggagcaagttgaggaattctcaagaaactggtcgagaagagagagcgcttagctatggaaaagagaaagaaggaagggagggcttcc

SEQ ID NO: 21793 - DNA, 201 bp, Homo sapiens
tctctcctggacttacaggaaggaggctggcaacctgggataacttgtcttttacccccacagggttcctgagctcactgaaaagactattgtgccttagraaaagcatttgctgtgtttcgttagcatctggctccaggacagaccttcaacttccaaattggatactgctgccaagaagttgctctgaagtcagtttct

SEQ ID NO: 21794 - DNA, 201 bp, Homo sapiens
accaagtctttctgcagccatgtttgaaaattaactttcaggctacagagtctttcttataccaaagttgaagaaagttttaagaaatatatttctacatytcctacatgcaaaacaacaggagcaagttgaggaattctcaagaaactggtcgagaagagagagcgcttagctatggaaaagagaaagaaggaagggagg

SEQ ID NO: 21795 - DNA, 201 bp, Homo sapiens
aaggaaggaaggaaggaaggaaggaaggaaggaaagaaggacaatctcaaattctatttcattatttttcttccacgctcctagtccagcctagggtgaaygtttccccctccaagaaggggcccttgcagcaccacaacctgcttgtctgccacgtgacggatttctacccaggcagcattcaagtccgatggttcctga

SEQ ID NO: 21796 - DNA, 201 bp, Homo sapiens; identical to SEQ ID NO: 2510

SEQ ID NO: 21797 - DNA, 201 bp, Homo sapiens
catgagcttaggaaagttgctgaggtaattggttgagagaggtgttcaaataaaaataacgcaattggcaaaaactgttactaagactttgtagaggcacmaatcagtgacatggcagcattttctttcacagtaatcaactgccagattgcagacagccctgatgccagcctaaggagtgtgggtttctcctccaggccc

SEQ ID NO: 21798 - DNA, 201 bp, Homo sapiens
taatcggggaacaaacatgacctatagcgagagagggatcccaggctgggatcttaatgcagccagatgcatgaggtcccaagtactcaggctcctgcggrgcgtccattgagtgatgggcaatggaatttggtgggatggaaatgtttctctaattatctgaggtggtttcaatggctgattatataacctttcgtcttt

SEQ ID NO: 21799 - DNA, 201 bp, Homo sapiens
accataatttttctctcctggacttacaggaaggaggctggcaacctgggataacttgtcttttacccccacagggttcctgagctcactgaaaagactawtgtgccttaggaaaagcatttgctgtgtttcgttagcatctggctccaggacagaccttcaacttccaaattggatactgctgccaagaagttgctctga

SEQ ID NO: 21800 - DNA, 201 bp, Homo sapiens
tgtagaggatggattcttcactcctgatacacacaatcagtgcacagcagctctcttatacatccagttgatgccttcagtctccctggcttcttacaagyatcttctgggccttgtgtgtccctgggcacctgtccctggtcaattcccgaaagctactgtgctcctcttgcccatctccccttgcaaataatatcttcc

SEQ ID NO: 21801 - DNA, 201 bp, Homo sapiens
tgatgccagcctaaggagtgtgggtttctcctccaggcccgcaggtccccaacctcactcctctgaagactcttctggagatcctctgtgatgcacagatmtccagactcagtgcccccagactcagattccctgggtggggaggtctggggatctctgcttgtaatcagctccctagaggttcccatgtagccagataag

SEQ ID NO: 21802 - DNA, 201 bp, Homo sapiens
agaggccactgatatcagataatcggggaacaaacatgacctatagcgagagagggatcccaggctgggatcttaatgcagccagatgcatgaggtcccargtactcaggctcctgcggagcgtccattgagtgatgggcaatggaatttggtgggatggaaatgtttctctaattatctgaggtggtttcaatggctgat

SEQ ID NO: 21803 - DNA, 201 bp, Homo sapiens
aaataatacatacgtcctgttctgcagacgcgtataagtcacagaaggaaacacaagtgacaggacaacagcaggttcagaaggataagtgcagatacgtrggtatacacaagatgcgaccaaacagcacatcagggaaggcttcctggggaacagatggcttcaatgtaggcattcagaaaacagggcaaaagccacttc

SEQ ID NO: 21804 - DNA, 201 bp, Homo sapiens
gcagacgcgtataagtcacagaaggaaacacaagtgacaggacaacagcaggttcagaaggataagtgcagatacgtaggtatacacaagatgcgaccaarcagcacatcagggaaggcttcctggggaacagatggcttcaatgtaggcattcagaaaacagggcaaaagccacttctctcagggaagacagcctgaccg

SEQ ID NO: 21805 - DNA, 201 bp, Homo sapiens
tcaatggctgattatataacctttcgtctttcatttcagttcaacgaggatctgcataaacaggtaatattcctgctttgatttccttgtggggtgggttrcaggaggatatgagtcctttctgtgcattgtaacactgaggctcctccaggaagggaatctcaggcatgaacccctctttcaatgtcagccttcaggcaa

SEQ ID NO: 21806 - DNA, 201 bp, Homo sapiens
ctcagggaagacagcctgaccgggagaagatactgagtttactgtggggctattgcacttagaagacctgaaagtcatctaaggagaaataatacatagayatttgtggattatgggtggtctcaggagaggaatttaggccatagaactgagagtcattagtggcaggtgcaggttaaataagattttccaggaagagtg

SEQ ID NO: 21807 - DNA, 201 bp, Homo sapiens
gtggggctattgcacttagaagacctgaaagtcatctaaggagaaataatacatagatatttgtggattatgggtggtctcaggagaggaatttaggccakagaactgagagtcattagtggcaggtgcaggttaaataagattttccaggaagagtgccaaaaatcagaattgccgagatctcagggtataatgagagaa

SEQ ID NO: 21808 - DNA, 201 bp, Homo sapiens
gaaagtcatctaaggagaaataatacatagatatttgtggattatgggtggtctcaggagaggaatttaggccatagaactgagagtcattagtggcaggygcaggttaaataagattttccaggaagagtgccaaaaatcagaattgccgagatctcagggtataatgagagaacatgatagttaagaggtggtttaaaa

SEQ ID NO: 21809 - DNA, 201 bp, Homo sapiens
tttttttcactttcttccttatttaccagtcaatttatattctctatggactttatttttccaaagcaatttcagacctattgatctcatttgatcttaasagctttgctataaggcaggttatatcatccccatattgaagacaaggaatcgaagtccaagagaggcagtgtcgttaaagctgcatatttacatggtagg

SEQ ID NO: 21810 - DNA, 201 bp, Homo sapiens
cccacaacaggccccggtgtatgatgttccccttcctgtgtccatgtgttctcattgttcagttcccacctatgagtgagaacatgtggtctttggttttytgtccttgcaatagtttgctgtgaatgatgatttccagcttcctccatgtccctacaaaggacatgaactcatccttttttatggctgcacagtattcca

SEQ ID NO: 21811 - DNA, 201 bp, Homo sapiens
tcttattcttgaatgaaaaacgttctcttactggtgattgaggaggagaaacaaagactaacaaatgaaaatgggagaatccacactcagagtggggcaaytgaacaggcaggggcggatggatggcagaggaggaggaatctggactcaaggagctggggggctctgggcctggaattttagggtctggggcccaaggca

SEQ ID NO: 21812 - DNA, 201 bp, Homo sapiens; identical to SEQ ID NO: 2529

SEQ ID NO: 21813 - DNA, 201 bp, Homo sapiens
aaagagaaagaaggaagggagggcttcctggaggaggtggcatttgaaccaggactgacatcaggatggaaatgtcagtcagggagttaagtagggggagsagctccgccctccacgtccccagctcctcccgcccctgttttttctcccagtgaccccacgtgaaacgtctccgcctcctccagccaccagcagaaggga

SEQ ID NO: 21814 - DNA, 201 bp, Homo sapiens
gaagggaatctcaggcatgaacccctctttcaatgtcagccttcaggcaagtggggaaagagcattgcttggctccattgctgaaggaagcagagatcaaytctgttatttatcagcctgagacgcatcctctcaccataatttttctctcctggacttacaggaaggaggctggcaacctgggataacttgtcttttacc

SEQ ID NO: 21815 - DNA, 201 bp, Homo sapiens; identical to SEQ ID NO: 2530

SEQ ID NO: 21816 - DNA, 201 bp, Homo sapiens
ggtgtgtgaggtgtggcagaattggggaaatgataatccctgtagatgggccagcagaatatttgagatcaccttcagagcaaagaaaacgcataatctcsccaaacatcatgacttatctgactggttaaaatgagtatcactgtctttcctccgtcatcttaagtgcatcacaggctttatattttcagacctttcata

SEQ ID NO: 21817 - DNA, 201 bp, Homo sapiens; identical to SEQ ID NO: 2532

SEQ ID NO: 21818 - DNA, 201 bp, Homo sapiens
acgtgtgaggacacaaagaaagtgtctctgggacaggatgcagactgaaggcaaggttgttttttatcagttggtttgcacttatgtttttaaggtaaatkacatgtttaaatgttaagagactgggcagggaagccctgaagagacagctgagctcattaggaatttctaccaagaatactaaaaagtatttgcatctat

SEQ ID NO: 21819 - DNA, 201 bp, Homo sapiens; identical to SEQ ID NO: 2534

SEQ ID NO: 21820 - DNA, 201 bp, Homo sapiens; identical to SEQ ID NO: 2536

SEQ ID NO: 21821 - DNA, 201 bp, Homo sapiens; identical to SEQ ID NO: 2537

SEQ ID NO: 21822 - DNA, 201 bp, Homo sapiens; identical to SEQ ID NO: 2538

SEQ ID NO: 21823 - DNA, 201 bp, Homo sapiens
tttcttaacaatccaacattgttatgtgttttgcgtctcatattgacaccttttggtcaaggtagaggacatgtttgttgtaagctttctttttcgtgtaraggatggattcttcactcctgatacacacaatcagtgcacagcagctctcttatacatccagttgatgccttcagtctccctggcttcttacaagcatct

SEQ ID NO: 21824 - DNA, 201 bp, Homo sapiens; identical to SEQ ID NO: 2539

SEQ ID NO: 21825 - DNA, 201 bp, Homo sapiens; identical to SEQ ID NO: 2541

SEQ ID NO: 21826 - DNA, 201 bp, Homo sapiens; identical to SEQ ID NO: 2545

SEQ ID NO: 21827 - DNA, 201 bp, Homo sapiens; identical to SEQ ID NO: 2544

SEQ ID NO: 21828 - DNA, 201 bp, Homo sapiens
cattgggtatcaggccttaactccagcgcaccctggaggtcactgatgtggctccaggctgacctgctcctgtcaaagaatattgagcaagatgcctctcrtggaatgttctgggaccttaaaacagatacccaagtattccccctgatttcatggttcccagaagctctatggggaagaaattgtaggtaattcacaact

SEQ ID NO: 21829 - DNA, 201 bp, Homo sapiens
gggtctagaggattactcacctacagaaatgaatcccaaaggaaaaagaaaaatacatggtgtatagactgggctacacagatgtaattggttcagcttakgttactttgtatttattatatttacaaaatctgaaaactaaaggttggcacattttgaagcaaattccacacttcaaatgttaattttcattcagttaat

SEQ ID NO: 21830 - DNA, 201 bp, Homo sapiens
gatggtgaaagtggaaggaggtgggagttgggcattgggtgtgaagatgctctttaaaggggttttaataaccacttgctaccaggccagtgaacacttaycatagttgatgccttttgagcatgttgcattgtaaactgtccctgaaattcctgtgcacttggcttatgggatgaaacatcctcctagttctcttgtctc

SEQ ID NO: 21831 - DNA, 201 bp, Homo sapiens
ttactgtgctgagatcgctcacaaaatttcctccagaactgcaaagtcatcatggaaagagtcacccagccggccatcagagtcaccaaccccagtaccasggtgcacagctaagaaaatgagtagaaagttcatgtccacgttttgtgtgtaaataaaaccataaaaactgccaaaaaaaattacatcaatgcctctaaa

SEQ ID NO: 21832 - DNA, 201 bp, Homo sapiens
gatttgggaagaatcgttaatattgagagagagagggagaaagaggattagatgagagtggcgcctccgctcatgtccgccccctccccgcagagaattamcttttccagggacggcaggaatgctacgcgtttaatgggacacagcgcttcctggagagatacatctacaaccgggaggagttcgcgcgcttcgacagcg

SEQ ID NO: 21833 - DNA, 201 bp, Homo sapiens
caagcatgtaggagctcaggatattctgtaaatatgaagattttgagtttttgtaggtgaggtaaaaaaatacataggttttttacagaataagacatgtmaagctctcttcattttctttgtattttcatgaagttattagattcacaggccaccataatgccattgtctgtatatcttaatttcaagatattatttgag

SEQ ID NO: 21834 - DNA, 201 bp, Homo sapiens
tgggaagaatcgttaatattgagagagagagggagaaagaggattagatgagagtggcgcctccgctcatgtccgccccctccccgcagagaattaccttbtccagggacggcaggaatgctacgcgtttaatgggacacagcgcttcctggagagatacatctacaaccgggaggagttcgcgcgcttcgacagcgacgt

SEQ ID NO: 21835 - DNA, 201 bp, Homo sapiens
tggagacttcctgaccttggcttaggggttcctgaagattcatagttctcccccttgtcagagaatctagggacactgactggtctcgaaaccctcacacwtaggaactgacctcacacataggaacagttctcttccttcagcattttagcctcttctcaggcattttgagaggcaacttccagaatcagcatttgccac

SEQ ID NO: 21836 - DNA, 201 bp, Homo sapiens
cgttaatattgagagagagagggagaaagaggattagatgagagtggcgcctccgctcatgtccgccccctccccgcagagaattaccttttccagggackgcaggaatgctacgcgtttaatgggacacagcgcttcctggagagatacatctacaaccgggaggagttcgcgcgcttcgacagcgacgtgggggagttc

SEQ ID NO: 21837 - DNA, 201 bp, Homo sapiens
gagagagggagaaagaggattagatgagagtggcgcctccgctcatgtccgccccctccccgcagagaattaccttttccagggacggcaggaatgctacscgtttaatgggacacagcgcttcctggagagatacatctacaaccgggaggagttcgcgcgcttcgacagcgacgtgggggagttccgggcggtgacgga

SEQ ID NO: 21838 - DNA, 201 bp, Homo sapiens
cgcctccgctcatgtccgccccctccccgcagagaattaccttttccagggacggcaggaatgctacgcgtttaatgggacacagcgcttcctggagagakacatctacaaccgggaggagttcgcgcgcttcgacagcgacgtgggggagttccgggcggtgacggagctggggcggcctgctgcggagtactggaacag

SEQ ID NO: 21839 - DNA, 201 bp, Homo sapiens
tgtccgccccctccccgcagagaattaccttttccagggacggcaggaatgctacgcgtttaatgggacacagcgcttcctggagagatacatctacaacmgggaggagttcgcgcgcttcgacagcgacgtgggggagttccgggcggtgacggagctggggcggcctgctgcggagtactggaacagccagaaggacat

SEQ ID NO: 21840 - DNA, 201 bp, Homo sapiens
gccccctccccgcagagaattaccttttccagggacggcaggaatgctacgcgtttaatgggacacagcgcttcctggagagatacatctacaaccgggargagttcgcgcgcttcgacagcgacgtgggggagttccgggcggtgacggagctggggcggcctgctgcggagtactggaacagccagaaggacatcctgg

SEQ ID NO: 21841 - DNA, 201 bp, Homo sapiens
agtgagaaggtggacacactgggtggggatgaggtgagtgacatgagcttaggaaagttgctgaggtaattggttgagagaggtgttcaaataaaaataaygcaattggcaaaaactgttactaagactttgtagaggcaccaatcagtgacatggcagcattttctttcacagtaatcaactgccagattgcagacagcc

SEQ ID NO: 21842 - DNA, 201 bp, Homo sapiens
agtctcattgagcaccttctcttcaatttcttttacacagtaagaataggatcagctgtgctaaactaacaaatacccagatatccaggtttggctcatgytacacgtccaaagtaagtcatccaggaagctctgcttatcatcgtactcaggaagccaggctgacagtctttctcctgcacatctgctcccagaacctcc

SEQ ID NO: 21843 - DNA, 201 bp, Homo sapiens
tccccgcagagaattaccttttccagggacggcaggaatgctacgcgtttaatgggacacagcgcttcctggagagatacatctacaaccgggaggagttygcgcgcttcgacagcgacgtgggggagttccgggcggtgacggagctggggcggcctgctgcggagtactggaacagccagaaggacatcctggaggaga

SEQ ID NO: 21844 - DNA, 201 bp, Homo sapiens
tttgttgtaagctttctttttcgtgtagaggatggattcttcactcctgatacacacaatcagtgcacagcagctctcttatacatccagttgatgccttmagtctccctggcttcttacaagcatcttctgggccttgtgtgtccctgggcacctgtccctggtcaattcccgaaagctactgtgctcctcttgcccatc

SEQ ID NO: 21845 - DNA, 201 bp, Homo sapiens; identical to SEQ ID NO: 2565

SEQ ID NO: 21846 - DNA, 201 bp, Homo sapiens; identical to SEQ ID NO: 2567

SEQ ID NO: 21847 - DNA, 201 bp, Homo sapiens
aaggtatcagatgtgtctcactctgacatatgcaggtgtttatgaaactctgggatttctaaggaaggatgcagtgcagagacaggtcccagaggagacargagctgagagaccatccaaactgggaccaccttgtcactagacttcaaattttcaatattgatagagtgttttctaagagtcaggccctttgctgagtgc

SEQ ID NO: 21848 - DNA, 201 bp, Homo sapiens
aggttggttcatttatatttccagagccagctaagaatagtacaggagaacaggattgtggactaattttagccatgtcactgaatccaacagtacattayaaaaacaatacgttttgaccaattttagatttattctaggaatgcaatgattcttcagtgtcagaaaatatataatgtggttaacacattagtggactcc

SEQ ID NO: 21849 - DNA, 201 bp, Homo sapiens
tcacaaatactccttaaccaaatacggcttggacttttgaatgcatccaatagacgtcatttgtcgtctaagtctgcattcatccaccagcctaggcctcytgtcttaattttcatacagacagaaatgactccccactggggaaagagcaaagcaatacatgtagcactctttttcaaacactggtctttttttttttct

SEQ ID NO: 21850 - DNA, 201 bp, Homo sapiens
tgctcctcttgcccatctccccttgcaaataatatcttccatcgggggaccggcttcctccaatttcaggagaggtggggctgaaggcacagacttgggcrtcactggcacagatataagtaaatacagctggagtctgcagagaggctggactgagtcagggagtcaggaaagagaagccacacacaaggacaaccaatc

SEQ ID NO: 21851 - DNA, 201 bp, Homo sapiens
ttgcaggaggatatgagtcctttctgtgcattgtaacactgaggctcctccaggaagggaatctcaggcatgaacccctctttcaatgtcagccttcaggyaagtggggaaagagcattgcttggctccattgctgaaggaagcagagatcaactctgttatttatcagcctgagacgcatcctctcaccataatttttct

SEQ ID NO: 21852 - DNA, 201 bp, Homo sapiens
aagtgggtgactcaacctctgactcagaaaaattgatacctgcagaagaaaaaacccggcgggcttaggactcccagctgagtgttgtatcctccatcccyttccacctggtcccttcattttctacccctcacagttccctaacgagaaggtggtccacccaacagacaacgctgcctcagatggttatcaaggggtacc

SEQ ID NO: 21853 - DNA, 201 bp, Homo sapiens
aacccctctttcaatgtcagccttcaggcaagtggggaaagagcattgcttggctccattgctgaaggaagcagagatcaactctgttatttatcagcctragacgcatcctctcaccataatttttctctcctggacttacaggaaggaggctggcaacctgggataacttgtcttttacccccacagggttcctgagct

SEQ ID NO: 21854 - DNA, 201 bp, Homo sapiens
ccattttctttgtgtgccatcacaaatactccttaaccaaatacggcttggacttttgaatgcatccaatagacgtcatttgtcgtctaagtctgcattcrtccaccagcctaggcctcctgtcttaattttcatacagacagaaatgactccccactggggaaagagcaaagcaatacatgtagcactctttttcaaaca

SEQ ID NO: 21855 - DNA, 201 bp, Homo sapiens
gggttgcaggaggatatgagtcctttctgtgcattgtaacactgaggctcctccaggaagggaatctcaggcatgaacccctctttcaatgtcagccttcrggcaagtggggaaagagcattgcttggctccattgctgaaggaagcagagatcaactctgttatttatcagcctgagacgcatcctctcaccataatttt

SEQ ID NO: 21856 - DNA, 201 bp, Homo sapiens; identical to SEQ ID NO: 2760

SEQ ID NO: 21857 - DNA, 201 bp, Homo sapiens
ggcttggacttttgaatgcatccaatagacgtcatttgtcgtctaagtctgcattcatccaccagcctaggcctcctgtcttaattttcatacagacagaratgactccccactggggaaagagcaaagcaatacatgtagcactctttttcaaacactggtctttttttttttcttaacaatccaacattgttatgtgtt

SEQ ID NO: 21858 - DNA, 201 bp, Homo sapiens; identical to SEQ ID NO: 2761

SEQ ID NO: 21859 - DNA, 201 bp, Homo sapiens
catgacctatagcgagagagggatcccaggctgggatcttaatgcagccagatgcatgaggtcccaagtactcaggctcctgcggagcgtccattgagtgrtgggcaatggaatttggtgggatggaaatgtttctctaattatctgaggtggtttcaatggctgattatataacctttcgtctttcatttcagttcaacg

SEQ ID NO: 21860 - DNA, 201 bp, Homo sapiens; identical to SEQ ID NO: 2484

SEQ ID NO: 21861 - DNA, 201 bp, Homo sapiens
tctgggtgtaaagggatggagagaggtgaggtgtgtgcagtaagaggatttctcaaggatgggacaggaaggccttggagctttggcttcctcctgtgaayttgtggggtggggagcctggtgcaccaacctgagggacttgagggagtagtatcaggatgtgggattgagccctggaccttttttctagaaagaggaaaa

SEQ ID NO: 21862 - DNA, 201 bp, Homo sapiens
ggaaattgcaatcaaggcatgagttagaacagggaaaacacagaggcaagggagaggtggaagggggaggaaagaagtagtgacaattccagggtggatgyccacccaaatctagaagtaattgagcaaatgttttctgggcattagagaaggcaactagaacaaacaggaatccttgccttggtgaaatgtatttgaact

SEQ ID NO: 21863 - DNA, 201 bp, Homo sapiens
ggacatgtttgttgtaagctttctttttcgtgtagaggatggattcttcactcctgatacacacaatcagtgcacagcagctctcttatacatccagttgrtgccttcagtctccctggcttcttacaagcatcttctgggccttgtgtgtccctgggcacctgtccctggtcaattcccgaaagctactgtgctcctctt

SEQ ID NO: 21864 - DNA, 201 bp, Homo sapiens
aggagggaccagaggcagggagatgaggtaggaaactgctattatttgtcagggaaattgcaatcaaggcatgagttagaacagggaaaacacagaggcargggagaggtggaagggggaggaaagaagtagtgacaattccagggtggatgtccacccaaatctagaagtaattgagcaaatgttttctgggcattagag

SEQ ID NO: 21865 - DNA, 201 bp, Homo sapiens
agaaagaaagagcgagattatgtctcaaaaaaaaggaaggaaggaaggaaggaaggaaggaaggaaggaaggaaggaaggaaagaaggacaatctcaaatkctatttcattatttttcttccacgctcctagtccagcctagggtgaatgtttccccctccaagaaggggcccttgcagcaccacaacctgcttgtctgcc

SEQ ID NO: 21866 - DNA, 201 bp, Homo sapiens; identical to SEQ ID NO: 2485

SEQ ID NO: 21867 - DNA, 201 bp, Homo sapiens; identical to SEQ ID NO: 2486

SEQ ID NO: 21868 - DNA, 201 bp, Homo sapiens
caaccgggaggagttcgcgcgcttcgacagcgacgtgggggagttccgggcggtgacggagctggggcggcctgctgcggagtactggaacagccagaagsacatcctggaggagaagcgggcagtgccggacaggatgtgcagacacaactacgagctgggcgggcccatgaccctgcagcgccgaggtgagtgagggct

SEQ ID NO: 21869 - DNA, 201 bp, Homo sapiens
cgggaggagttcgcgcgcttcgacagcgacgtgggggagttccgggcggtgacggagctggggcggcctgctgcggagtactggaacagccagaaggacawcctggaggagaagcgggcagtgccggacaggatgtgcagacacaactacgagctgggcgggcccatgaccctgcagcgccgaggtgagtgagggctttgg

SEQ ID NO: 21870 - DNA, 201 bp, Homo sapiens
ggagttcgcgcgcttcgacagcgacgtgggggagttccgggcggtgacggagctggggcggcctgctgcggagtactggaacagccagaaggacatcctgkaggagaagcgggcagtgccggacaggatgtgcagacacaactacgagctgggcgggcccatgaccctgcagcgccgaggtgagtgagggctttgggccgg

SEQ ID NO: 21871 - DNA, 201 bp, Homo sapiens
gcgcttcgacagcgacgtgggggagttccgggcggtgacggagctggggcggcctgctgcggagtactggaacagccagaaggacatcctggaggagaagygggcagtgccggacaggatgtgcagacacaactacgagctgggcgggcccatgaccctgcagcgccgaggtgagtgagggctttgggccggcggtcccag

SEQ ID NO: 21872 - DNA, 201 bp, Homo sapiens
agaaggtccaagggccagatcttgatgcccaacattgcttatgggagcaacaacaacaacaaaaaaaacatgctgcccagtggcttccagaagtttctggyccacagcctcaaggagctgaaagtgctgctgatgtgcaacaaatcttactgtgctgagatcgctcacaaaatttcctccagaactgcaaagtcatcatgg

SEQ ID NO: 21873 - DNA, 201 bp, Homo sapiens
tcacccgggtactagttacatgggtgcttgcggtgataaccattcaacgtacattctattggtttgtgtgtttcttccaaatgtcccctagttcacaataraaagggcttaaatagagaagtaaaggagaatttgggaatttgaagcaaaagcaagaagccactgaatcaagcacaaatattgagctttgataaagattgg

SEQ ID NO: 21874 - DNA, 201 bp, Homo sapiens
gcttcgacagcgacgtgggggagttccgggcggtgacggagctggggcggcctgctgcggagtactggaacagccagaaggacatcctggaggagaagcgkgcagtgccggacaggatgtgcagacacaactacgagctgggcgggcccatgaccctgcagcgccgaggtgagtgagggctttgggccggcggtcccaggg

SEQ ID NO: 21875 - DNA, 201 bp, Homo sapiens
cgacagcgacgtgggggagttccgggcggtgacggagctggggcggcctgctgcggagtactggaacagccagaaggacatcctggaggagaagcgggcaktgccggacaggatgtgcagacacaactacgagctgggcgggcccatgaccctgcagcgccgaggtgagtgagggctttgggccggcggtcccagggcagc

SEQ ID NO: 21876 - DNA, 201 bp, Homo sapiens
accccagtaccagggtgcacagctaagaaaatgagtagaaagttcatgtccacgttttgtgtgtaaataaaaccataaaaactgccaaaaaaaattacatsaatgcctctaaacccaaaggactctacccccacaggtccctggttgttgtggtgattttcattgtgtaaaatactttccacatcttttgacaccaagtct

SEQ ID NO: 21877 - DNA, 201 bp, Homo sapiens
acagcgacgtgggggagttccgggcggtgacggagctggggcggcctgctgcggagtactggaacagccagaaggacatcctggaggagaagcgggcagtkccggacaggatgtgcagacacaactacgagctgggcgggcccatgaccctgcagcgccgaggtgagtgagggctttgggccggcggtcccagggcagccc

SEQ ID NO: 21878 - DNA, 201 bp, Homo sapiens
ggactttgggttggggattcatggggggagcccatctggagcttgtcaggggagcgagcgcggggacctggactgggctgagcatggagtgaggaggacgrgagcagagagacccccgggacttcatcaggcctggcagctgactgcatgtggggtgaaaaaaggaagccacaggacagcgcacaagggtatggtgtggag

SEQ ID NO: 21879 - DNA, 201 bp, Homo sapiens
agcgacgtgggggagttccgggcggtgacggagctggggcggcctgctgcggagtactggaacagccagaaggacatcctggaggagaagcgggcagtgcyggacaggatgtgcagacacaactacgagctgggcgggcccatgaccctgcagcgccgaggtgagtgagggctttgggccggcggtcccagggcagccccg

SEQ ID NO: 21880 - DNA, 201 bp, Homo sapiens
attcatggggggagcccatctggagcttgtcaggggagcgagcgcggggacctggactgggctgagcatggagtgaggaggacgagagcagagagaccccsgggacttcatcaggcctggcagctgactgcatgtggggtgaaaaaaggaagccacaggacagcgcacaagggtatggtgtggagatggaggtggagatgg

SEQ ID NO: 21881 - DNA, 201 bp, Homo sapiens
tgggggagttccgggcggtgacggagctggggcggcctgctgcggagtactggaacagccagaaggacatcctggaggagaagcgggcagtgccggacagratgtgcagacacaactacgagctgggcgggcccatgaccctgcagcgccgaggtgagtgagggctttgggccggcggtcccagggcagccccgcgggccc

SEQ ID NO: 21882 - DNA, 201 bp, Homo sapiens
ccacactcagagtggggcaattgaacaggcaggggcggatggatggcagaggaggaggaatctggactcaaggagctggggggctctgggcctggaatttyagggtctggggcccaaggcaccaggagaagaggcaggtcaggatatctgagtcaagacctgggatcttgccttagcaatgacactggagactaaaggtgg

SEQ ID NO: 21883 - DNA, 201 bp, Homo sapiens
gtgtgcagtaagaggatttctcaaggatgggacaggaaggccttggagctttggcttcctcctgtgaacttgtggggtggggagcctggtgcaccaacctkagggacttgagggagtagtatcaggatgtgggattgagccctggaccttttttctagaaagaggaaaaaaatgaagggaggaggaggaggaagctgggga

SEQ ID NO: 21884 - DNA, 201 bp, Homo sapiens
cggagtactggaacagccagaaggacatcctggaggagaagcgggcagtgccggacaggatgtgcagacacaactacgagctgggcgggcccatgaccctrcagcgccgaggtgagtgagggctttgggccggcggtcccagggcagccccgcgggcccgtgcccagggcgcaggagcagccgggttggcctaagggacct

SEQ ID NO: 21885 - DNA, 201 bp, Homo sapiens
aggtttgtagggggaatgagatgaggcagtggagccatgtgacagggactgagggtagattactggagctccctgcgtagaatgaatgttcaatcaaaacytgctggagggagagctggagccataggggagtgggtaaagtgggcagggctgattccacaattccctgcatgctcccccaactccacacacatccccaac

SEQ ID NO: 21886 - DNA, 201 bp, Homo sapiens
ttctcgtgctcctgacctggccccctcagcccagcctttctcttgagtaagaagaaaatgcctcctcctctgctgtcctaagaacccagctgtgtggaccyaagatttctcgctctcagggaaggggctcattcatgagtgggcatcatggcctctagttctatgtgtggcagagaggccctcccatccctccagctggac

SEQ ID NO: 21887 - DNA, 201 bp, Homo sapiens
tgtgcagtaagaggatttctcaaggatgggacaggaaggccttggagctttggcttcctcctgtgaacttgtggggtggggagcctggtgcaccaacctgwgggacttgagggagtagtatcaggatgtgggattgagccctggaccttttttctagaaagaggaaaaaaatgaagggaggaggaggaggaagctggggag

SEQ ID NO: 21888 - DNA, 201 bp, Homo sapiens
tatcattaccattaagaagttaaatgaacatcagaatttaaaatcataaatataatctaatacactttaaccattttctttgtgtgccatcacaaatactmcttaaccaaatacggcttggacttttgaatgcatccaatagacgtcatttgtcgtctaagtctgcattcatccaccagcctaggcctcctgtcttaattt

SEQ ID NO: 21889 - DNA, 201 bp, Homo sapiens
gacccaggaagagccctagggtcctagaagagagggaggatacagaaacactctttgcacttcgtctcctaatgcagagtccatagctcggagttcctgtraagcagccacaaaagatagaggctggggatcccagagagataggagggccctgatagtaggtcactgtgtgcaggaatctggggaaggcagtgtatgacc

SEQ ID NO: 21890 - DNA, 201 bp, Homo sapiens
ccgcaggtccccaacctcactcctctgaagactcttctggagatcctctgtgatgcacagatctccagactcagtgcccccagactcagattccctgggtrgggaggtctggggatctctgcttgtaatcagctccctagaggttcccatgtagccagataagtattgtcagaacactgaagatttttgaaaaatgaaaaa

SEQ ID NO: 21891 - DNA, 201 bp, Homo sapiens
agggtcctagaagagagggaggatacagaaacactctttgcacttcgtctcctaatgcagagtccatagctcggagttcctgtaaagcagccacaaaagayagaggctggggatcccagagagataggagggccctgatagtaggtcactgtgtgcaggaatctggggaaggcagtgtatgaccctcagagctgggtctgg

SEQ ID NO: 21892 - DNA, 201 bp, Homo sapiens
tgcatgaggctgagtgtggcgcatcctcctcggggctgagatggattttacttgtcttgggttccccacggctgtcacagggcagtgtctcagttcattcrtctttttccttcaggaagtctgggtgtaaagggatggagagaggtgaggtgtgtgcagtaagaggatttctcaaggatgggacaggaaggccttggagct

SEQ ID NO: 21893 - DNA, 201 bp, Homo sapiens
cccaacctcactcctctgaagactcttctggagatcctctgtgatgcacagatctccagactcagtgcccccagactcagattccctgggtggggaggtckggggatctctgcttgtaatcagctccctagaggttcccatgtagccagataagtattgtcagaacactgaagatttttgaaaaatgaaaaagagaaggtt

SEQ ID NO: 21894 - DNA, 201 bp, Homo sapiens
acacggtcagatttgtgtttggatggggcacctgtaggaaggatgggctggaggaggcgggactcaaggcaagaccagtagcacttttaagccctctggtrggaagtaatgaaggcgtaggccagggcaggaacatggggtgaggaggacagcagatggatttgatggcagtaatgacatgagaggccacaggaatcacta

SEQ ID NO: 21895 - DNA, 201 bp, Homo sapiens
aggaagatggtctctgcaataccctcaatgactggctccccattgcgcagccacgtgatgttcagcactggtgggaagaacttgtcaacatggcagacgarggtgttgggctggcccagatccacaggctccttgggaaagacgcttacctcggtgggggctccaaaaggggatagaacccaaggagcctactgccattgg

SEQ ID NO: 21896 - DNA, 201 bp, Homo sapiens
atctgtgagaccttcatgggacctgaagacgcagcacagaggaggaacttgaaaaaggacgggatttctactactcaagcatgtaggagctcaggatattmtgtaaatatgaagattttgagtttttgtaggtgaggtaaaaaaatacataggttttttacagaataagacatgtaaagctctcttcattttctttgtatt

SEQ ID NO: 21897 - DNA, 201 bp, Homo sapiens
ttcttcagtgtgactgaagccaggggagatgtgggccaggcagcactgtaacctgccttgtgtgctgatggcaagtgtttgcattttatcccacaggacayaggaagttgtgaagtatcttaagcaggagagtaacacggtcagatttgtgtttggatggggcacctgtaggaaggatgggctggaggaggcgggactcaa

SEQ ID NO: 21898 - DNA, 201 bp, Homo sapiens
gtgtgaataaactctggtagaggccagaccatctccttctcatccaggttcacgtagaactgctcctcctcatcaaattcaaacatatactccccagaggktctgtgcgtctgcacaaactccgcatatgttgacacatggtctgctgcatgaaggagaagatggagaatgggtgaatacgtaggatgctacacagaatgc

SEQ ID NO: 21899 - DNA, 201 bp, Homo sapiens
acctgagggaggtattattaatgtctactgtaaaaataaattacctgagacatcgaggaagtatttgtctaattatctatggcaggtaaatgacaaggagraaagtcccacccaggcagttactaaaaaaactgagtttttctccacaatcctctcctggccccttaatcctactagacaccttctactacataattattt

SEQ ID NO: 21900 - DNA, 201 bp, Homo sapiens
tgctggctagaggagggaccagaggcagggagatgaggtaggaaactgctattatttgtcagggaaattgcaatcaaggcatgagttagaacagggaaaasacagaggcaagggagaggtggaagggggaggaaagaagtagtgacaattccagggtggatgtccacccaaatctagaagtaattgagcaaatgttttctg

SEQ ID NO: 21901 - DNA, 201 bp, Homo sapiens; identical to SEQ ID NO: 2785

SEQ ID NO: 21902 - DNA, 201 bp, Homo sapiens
ggaagggaatctcaggcatgaacccctctttcaatgtcagccttcaggcaagtggggaaagagcattgcttggctccattgctgaaggaagcagagatcarctctgttatttatcagcctgagacgcatcctctcaccataatttttctctcctggacttacaggaaggaggctggcaacctgggataacttgtcttttac

SEQ ID NO: 21903 - DNA, 201 bp, Homo sapiens
tataacctttcgtctttcatttcagttcaacgaggatctgcataaacaggtaatattcctgctttgatttccttgtggggtgggttgcaggaggatatgastcctttctgtgcattgtaacactgaggctcctccaggaagggaatctcaggcatgaacccctctttcaatgtcagccttcaggcaagtggggaaagagca

SEQ ID NO: 21904 - DNA, 201 bp, Homo sapiens
ctcccagaacctccccagcagaatgaagggaacctaagaatttattcactggcttttaatgatccctcctagaaagaacacacttctcgcatttcattttmcaatgtaaatcatatggctgcaactaacttcaaataagtgggaatacttgaaggtggaaaacatttaagaagtacacactaaataaataataaaatactt

SEQ ID NO: 21905 - DNA, 201 bp, Homo sapiens
gagacagctgagctcattaggaatttctaccaagaatactaaaaagtatttgcatctatgaagagaagcctattgtggtgtttattataacataacattaraaataactcaggtgaccgcgaacagggcaatagatacttctggttctacccagcctgacctcctctttattctacacatcttaaataaaactgtctgaag

SEQ ID NO: 21906 - DNA, 201 bp, Homo sapiens
accggatcctgggaactggacagttgtgatttggccaagacagaaaagcctgtgaaagagaccaaaaaaacccaagtgcagtgtgaggagaggcccgcagrgaagagtcttggaagctgaggggaggtgacctcagcagcacagtggacagcggtgccagtgacttgggaaggtcagaaaacagaagatggaaagtgggtt

SEQ ID NO: 21907 - DNA, 201 bp, Homo sapiens
caattgaacaggcaggggcggatggatggcagaggaggaggaatctggactcaaggagctggggggctctgggcctggaattttagggtctggggcccaasgcaccaggagaagaggcaggtcaggatatctgagtcaagacctgggatcttgccttagcaatgacactggagactaaaggtggactccatggtgcccttg

SEQ ID NO: 21908 - DNA, 201 bp, Homo sapiens
ggtaggaaactgctattatttgtcagggaaattgcaatcaaggcatgagttagaacagggaaaacacagaggcaagggagaggtggaagggggaggaaagragtagtgacaattccagggtggatgtccacccaaatctagaagtaattgagcaaatgttttctgggcattagagaaggcaactagaacaaacaggaatcc

SEQ ID NO: 21909 - DNA, 201 bp, Homo sapiens
ttggtcaaggtagaggacatgtttgttgtaagctttctttttcgtgtagaggatggattcttcactcctgatacacacaatcagtgcacagcagctctctkatacatccagttgatgccttcagtctccctggcttcttacaagcatcttctgggccttgtgtgtccctgggcacctgtccctggtcaattcccgaaagct

SEQ ID NO: 21910 - DNA, 201 bp, Homo sapiens
aatggacattgagttaaccgaggtaatgaagtagtgagacacaggtgcccctgaaataaactcacattgagggaagaggctgacaatgtggatcagtctgwaaacaaggcaaaaatacaatagggagtaagggttgtgtgtcagttcaagactgtacttttacctggcccagcgccatgttagggtatttgtgttctccag

SEQ ID NO: 21911 - DNA, 201 bp, Homo sapiens
gaggtttgtagggggaatgagatgaggcagtggagccatgtgacagggactgagggtagattactggagctccctgcgtagaatgaatgttcaatcaaaayctgctggagggagagctggagccataggggagtgggtaaagtgggcagggctgattccacaattccctgcatgctcccccaactccacacacatccccaa

SEQ ID NO: 21912 - DNA, 201 bp, Homo sapiens
ggtgggttgcaggaggatatgagtcctttctgtgcattgtaacactgaggctcctccaggaagggaatctcaggcatgaacccctctttcaatgtcagccytcaggcaagtggggaaagagcattgcttggctccattgctgaaggaagcagagatcaactctgttatttatcagcctgagacgcatcctctcaccataat

SEQ ID NO: 21913 - DNA, 201 bp, Homo sapiens
tgtccctaatacacctataggatgactcataggagcccctggacccggggatgctgtcagatcgcttggtctttgagacaatggtgccattaaggaccccygccaggcccaccagcaggccgagggcacagaccagcatctccatggtctcaggcacctggattagttcatggacctctggggcaccaagggaagacagag

SEQ ID NO: 21914 - DNA, 201 bp, Homo sapiens; identical to SEQ ID NO: 2796

SEQ ID NO: 21915 - DNA, 201 bp, Homo sapiens
gggcacaaatgcaaagatgcagagggaggcaacacctggtcatctgtgagaccttcatgggacctgaagacgcagcacagaggaggaacttgaaaaaggaygggatttctactactcaagcatgtaggagctcaggatattctgtaaatatgaagattttgagtttttgtaggtgaggtaaaaaaatacataggtttttta

SEQ ID NO: 21916 - DNA, 201 bp, Homo sapiens
gtgggatgagggacagtgttgggagccaccaaggaaacccagaggtgggggagcagagagcagaagggggcatgtgatgctgggcagtgaaagggaggacrggcaaaggctgggttgaggtttgtagggggaatgagatgaggcagtggagccatgtgacagggactgagggtagattactggagctccctgcgtagaatg

SEQ ID NO: 21917 - DNA, 201 bp, Homo sapiens
taaccaaatacggcttggacttttgaatgcatccaatagacgtcatttgtcgtctaagtctgcattcatccaccagcctaggcctcctgtcttaattttcrtacagacagaaatgactccccactggggaaagagcaaagcaatacatgtagcactctttttcaaacactggtctttttttttttcttaacaatccaacat

SEQ ID NO: 21918 - DNA, 201 bp, Homo sapiens
atggagaaaccttgtctctactaataatacaaaaattagccaggtgaagtggcaggcacctataatcccagctattcgggaggctgaggaaggagaattgsttgaagcccggaggtggaggttgcagtgagccaatattgcgccactgcattccagacttggcaacagagtgacactccatctcaacaaaaagaaagaatg

SEQ ID NO: 21919 - DNA, 201 bp, Homo sapiens
tcagccctgggaactgcagaggggtgaggctggggagagaggaggctggagcagcactggtgacactgaacagtgtcaggaggaagtgacggatgcagcgyccccatcccataggcagagctgtcatgtgggatgagggacagtgttgggagccaccaaggaaacccagaggtgggggagcagagagcagaagggggcatg

SEQ ID NO: 21920 - DNA, 201 bp, Homo sapiens
ctcagccctgggaactgcagaggggtgaggctggggagagaggaggctggagcagcactggtgacactgaacagtgtcaggaggaagtgacggatgcagcrcccccatcccataggcagagctgtcatgtgggatgagggacagtgttgggagccaccaaggaaacccagaggtgggggagcagagagcagaagggggcat

SEQ ID NO: 21921 - DNA, 201 bp, Homo sapiens
cggctcagccctgggaactgcagaggggtgaggctggggagagaggaggctggagcagcactggtgacactgaacagtgtcaggaggaagtgacggatgcrgcgcccccatcccataggcagagctgtcatgtgggatgagggacagtgttgggagccaccaaggaaacccagaggtgggggagcagagagcagaaggggg

SEQ ID NO: 21922 - DNA, 201 bp, Homo sapiens
taaccagcaggacggctcagccctgggaactgcagaggggtgaggctggggagagaggaggctggagcagcactggtgacactgaacagtgtcaggaggargtgacggatgcagcgcccccatcccataggcagagctgtcatgtgggatgagggacagtgttgggagccaccaaggaaacccagaggtgggggagcagag

SEQ ID NO: 21923 - DNA, 201 bp, Homo sapiens
tgggagggggtgcatgaggctgagtgtggcgcatcctcctcggggctgagatggattttacttgtcttgggttccccacggctgtcacagggcagtgtctsagttcattcgtctttttccttcaggaagtctgggtgtaaagggatggagagaggtgaggtgtgtgcagtaagaggatttctcaaggatgggacaggaagg

SEQ ID NO: 21924 - DNA, 201 bp, Homo sapiens
gtctttggggaaaatgggaccaagaggtcctggataaccttggacagacaaggtttgcagagagagaagttggcaagtgcaggctcctgggcgtgttcatrtctgcatccagcctggaggggactcaggcagagagccctaagctggagtgtccaggctctgaggatcactgaggattcagtgctcacgaagaatgcctct

SEQ ID NO: 21925 - DNA, 201 bp, Homo sapiens
agtgtgactgaagccaggggagatgtgggccaggcagcactgtaacctgccttgtgtgctgatggcaagtgtttgcattttatcccacaggacataggaarttgtgaagtatcttaagcaggagagtaacacggtcagatttgtgtttggatggggcacctgtaggaaggatgggctggaggaggcgggactcaaggcaag

SEQ ID NO: 21926 - DNA, 201 bp, Homo sapiens
cctgatccgtaatggagactggaccttccagatcctggtgatgctggaaatgaccccccagcagggagatgtctacacctgccaagtggagcacaccagcmtggatagtcctgtcaccgtggagtggagtgagtctctgatgaccctctagaccccacctctgaagagcaggggactctctggctctggggtccactcatc

SEQ ID NO: 21927 - DNA, 201 bp, Homo sapiens
tgtctttggggaaaatgggaccaagaggtcctggataaccttggacagacaaggtttgcagagagagaagttggcaagtgcaggctcctgggcgtgttcaygtctgcatccagcctggaggggactcaggcagagagccctaagctggagtgtccaggctctgaggatcactgaggattcagtgctcacgaagaatgcctc

SEQ ID NO: 21928 - DNA, 201 bp, Homo sapiens
gggtacagtaaacagagagaggtgcccagtggtcagtgcttgtctttggggaaaatgggaccaagaggtcctggataaccttggacagacaaggtttgcasagagagaagttggcaagtgcaggctcctgggcgtgttcatgtctgcatccagcctggaggggactcaggcagagagccctaagctggagtgtccaggctc

SEQ ID NO: 21929 - DNA, 201 bp, Homo sapiens
gagcagatcatgcctcttacacgtgtgattctagaacatagaatggaacagaatttttgagatcattttatgaggttggttcatttatatttccagagccrgctaagaatagtacaggagaacaggattgtggactaattttagccatgtcactgaatccaacagtacattataaaaacaatacgttttgaccaattttag

SEQ ID NO: 21930 - DNA, 201 bp, Homo sapiens
aaaataatttctaaataaaaggaataatttctaaatgaatggaatattatcttcattgaagattcctgtgagatgtaaatggggaaagaaactatgcaggmgtctcataaattctggctgttattgctgttattattatgagggccagagggaacatagactatgaggaccagatagatcaatgagcccctaaaatctgtg

SEQ ID NO: 21931 - DNA, 201 bp, Homo sapiens
tgacccttttctgtgtttgttttttgttttgtgtttgtgtttgtttttgagacaggttctcactttgtctcccaggctggagtgctgtggcaccatcatgrctcactgcagcctcaacctcctgggctcaagtgatcctcctgcctcagcctcccatgtagctagaactacagatacacgtaccaccatgtctggctaatt

SEQ ID NO: 21932 - DNA, 201 bp, Homo sapiens
aggaaggaaagaaggacaatctcaaattctatttcattatttttcttccacgctcctagtccagcctagggtgaatgtttccccctccaagaaggggcccytgcagcaccacaacctgcttgtctgccacgtgacggatttctacccaggcagcattcaagtccgatggttcctgaatggacaggaggaaacagctggggt

SEQ ID NO: 21933 - DNA, 201 bp, Homo sapiens
attattcctattttcaacatctaggaatcaattacatagtgaacatgcctaagaaataataatctgggcagatgcagtggctcaggcccgtaatcccagcmctttgagaggccgagcgggtggatcacttgaggtcaggcgttggtcaagtgctcctagagaaccaggctgaccaacatggagaaaccttgtctctactaa

SEQ ID NO: 21934 - DNA, 201 bp, Homo sapiens
tcacttgaggtcaggcgttggtcaagtgctcctagagaaccaggctgaccaacatggagaaaccttgtctctactaataatacaaaaattagccaggtgargtggcaggcacctataatcccagctattcgggaggctgaggaaggagaattggttgaagcccggaggtggaggttgcagtgagccaatattgcgccactg

SEQ ID NO: 21935 - DNA, 201 bp, Homo sapiens
gaagaaaaaacccggcgggcttaggactcccagctgagtgttgtatcctccatccctttccacctggtcccttcattttctacccctcacagttccctaasgagaaggtggtccacccaacagacaacgctgcctcagatggttatcaaggggtaccctaagaagaaatcatctcaccctctctttgtccccatttgtcaa

SEQ ID NO: 21936 - DNA, 201 bp, Homo sapiens
catccctttccacctggtcccttcattttctacccctcacagttccctaacgagaaggtggtccacccaacagacaacgctgcctcagatggttatcaagrggtaccctaagaagaaatcatctcaccctctctttgtccccatttgtcaagtagcagtgaggccgagccaggggatggtgaaagtggaaggaggtgggag

SEQ ID NO: 21937 - DNA, 201 bp, Homo sapiens
aggagcacttgacccttttctgtgtttgttttttgttttgtgtttgtgtttgtttttgagacaggttctcactttgtctcccaggctggagtgctgtggcrccatcatggctcactgcagcctcaacctcctgggctcaagtgatcctcctgcctcagcctcccatgtagctagaactacagatacacgtaccaccatgtc

SEQ ID NO: 21938 - DNA, 201 bp, Homo sapiens
aagttgcaaggagaactgcagttcttcagtgtgactgaagccaggggagatgtgggccaggcagcactgtaacctgccttgtgtgctgatggcaagtgttygcattttatcccacaggacataggaagttgtgaagtatcttaagcaggagagtaacacggtcagatttgtgtttggatggggcacctgtaggaaggatgg

SEQ ID NO: 21939 - DNA, 201 bp, Homo sapiens
aggacgggatttctactactcaagcatgtaggagctcaggatattctgtaaatatgaagattttgagtttttgtaggtgaggtaaaaaaatacataggttwtttacagaataagacatgtaaagctctcttcattttctttgtattttcatgaagttattagattcacaggccaccataatgccattgtctgtatatctta

SEQ ID NO: 21940 - DNA, 201 bp, Homo sapiens
tagcctaatcacattattcctattttcaacatctaggaatcaattacatagtgaacatgcctaagaaataataatctgggcagatgcagtggctcaggccygtaatcccagccctttgagaggccgagcgggtggatcacttgaggtcaggcgttggtcaagtgctcctagagaaccaggctgaccaacatggagaaacct

SEQ ID NO: 21941 - DNA, 201 bp, Homo sapiens; identical to SEQ ID NO: 2522

SEQ ID NO: 21942 - DNA, 201 bp, Homo sapiens; identical to SEQ ID NO: 2523

SEQ ID NO: 21943 - DNA, 201 bp, Homo sapiens
tttcaatgtcagccttcaggcaagtggggaaagagcattgcttggctccattgctgaaggaagcagagatcaactctgttatttatcagcctgagacgcakcctctcaccataatttttctctcctggacttacaggaaggaggctggcaacctgggataacttgtcttttacccccacagggttcctgagctcactgaaa

SEQ ID NO: 21944 - DNA, 201 bp, Homo sapiens
gcaggtttctgcggccccccggacagtggctctgacggcgttactgatggtgctgctcacatctgtggtccagggcagggccactccaggtaagagccgarctgccattcttggagggtctggctcagggaacaattcctaggggacgttatctttaagggatcaaattctgagacaggctgcgggggctcctgccctaag

SEQ ID NO: 21945 - DNA, 201 bp, Homo sapiens
agactttgtagaggcaccaatcagtgacatggcagcattttctttcacagtaatcaactgccagattgcagacagccctgatgccagcctaaggagtgtgrgtttctcctccaggcccgcaggtccccaacctcactcctctgaagactcttctggagatcctctgtgatgcacagatctccagactcagtgcccccagac

SEQ ID NO: 21946 - DNA, 201 bp, Homo sapiens
ggaaatgaccccccagcagggagatgtctacacctgccaagtggagcacaccagcctggatagtcctgtcaccgtggagtggagtgagtctctgatgaccvtctagaccccacctctgaagagcaggggactctctggctctggggtccactcatcttatcttctgcatctataccctggggccatgtccaaaccccatct

SEQ ID NO: 21947 - DNA, 201 bp, Homo sapiens; identical to SEQ ID NO: 2527

SEQ ID NO: 21948 - DNA, 201 bp, Homo sapiens
ataggcagagctgtcatgtgggatgagggacagtgttgggagccaccaaggaaacccagaggtgggggagcagagagcagaagggggcatgtgatgctggrcagtgaaagggaggacaggcaaaggctgggttgaggtttgtagggggaatgagatgaggcagtggagccatgtgacagggactgagggtagattactgga

SEQ ID NO: 21949 - DNA, 201 bp, Homo sapiens
cagcgcccccatcccataggcagagctgtcatgtgggatgagggacagtgttgggagccaccaaggaaacccagaggtgggggagcagagagcagaagggrgcatgtgatgctgggcagtgaaagggaggacaggcaaaggctgggttgaggtttgtagggggaatgagatgaggcagtggagccatgtgacagggactga

SEQ ID NO: 21950 - DNA, 201 bp, Homo sapiens
caaccattgtactctcaggacatttctagtccaaatttacaccaacactctgagaggaaggactgcaaagtaggtaccttagttttccactgacttccacytttcctgcttacacccttcctcctagacctctccacacccctcctaggacacacctagaaggtactgacatcatgtcacctcctcatctttcagggtagc

SEQ ID NO: 21951 - DNA, 201 bp, Homo sapiens
tgaggtgcttgaggggcagatgggtggtctgatgggcaggtagacagaagggtctgcagccggggaggagactgagatacatgagaccatccagggagagrggacccagggggaagagcaaaggaccggatcctgggaactggacagttgtgatttggccaagacagaaaagcctgtgaaagagaccaaaaaaacccaagt

SEQ ID NO: 21952 - DNA, 201 bp, Homo sapiens; identical to SEQ ID NO: 2535

SEQ ID NO: 21953 - DNA, 201 bp, Homo sapiens
gcagatgcagtggctcaggcccgtaatcccagccctttgagaggccgagcgggtggatcacttgaggtcaggcgttggtcaagtgctcctagagaaccagsctgaccaacatggagaaaccttgtctctactaataatacaaaaattagccaggtgaagtggcaggcacctataatcccagctattcgggaggctgaggaa

SEQ ID NO: 21954 - DNA, 201 bp, Homo sapiens
ttacagagagtttagggttcggcctggaagaggaagtgaagccaaatgacactgcatggttggtggtccctaagtgaggatttcccctcccagcccagcayggggagaaccagtcctctacttagatgcatagtgtgacagcaggttcagtgccgcacacggatggtgagggtcccccactgagtttagggtctagaggat

SEQ ID NO: 21955 - DNA, 201 bp, Homo sapiens
ccagagacaagtcagaagcttagctccacgtgtgaggacacaaagaaagtgtctctgggacaggatgcagactgaaggcaaggttgttttttatcagttgrtttgcacttatgtttttaaggtaaatgacatgtttaaatgttaagagactgggcagggaagccctgaagagacagctgagctcattaggaatttctacca

SEQ ID NO: 21956 - DNA, 201 bp, Homo sapiens
ctagtctcattttaaatatttcaattttgagctatttatttgatactcatagagaaggtcacaaaacatttactatttaatgtaatgatgaagtacatatrttacgttaatattttatcttatttgtggtagccttaccttgcataaataataattactaacagattaggacatgagagattctgttattagtgctttgca

SEQ ID NO: 21957 - DNA, 201 bp, Homo sapiens
ctccctgatttcagctacaggaaaaaggagcattcactacggtccatctctggctgagtccttgcagctatcaaaagtctaggcctcccttgcagtcctgratctctcagaacccgaatcacaaggctatcaagaccatgcaaccctgctgtcttgagagaggaaagcttgtgaccacccacaaagacccaggaagagccc

SEQ ID NO: 21958 - DNA, 201 bp, Homo sapiens
ttatagcagcatgatttataatcctttgggtatatatccagtaatgggatggctgggtcaaatggtatttctagttctagatctttgaggaattgccacamtgtcttgagataccatctcacaccagttaaaatggcgatcattaaaaagtcaggaaacaacaggtgctggagaggatgtggagaaataggaacactttta

SEQ ID NO: 21959 - DNA, 201 bp, Homo sapiens
gacagtggctctgacggcgttactgatggtgctgctcacatctgtggtccagggcagggccactccaggtaagagccgaactgccattcttggagggtctrgctcagggaacaattcctaggggacgttatctttaagggatcaaattctgagacaggctgcgggggctcctgccctaaggcagtgtcctctcttcccagc

SEQ ID NO: 21960 - DNA, 201 bp, Homo sapiens
taaggagtgtgggtttctcctccaggcccgcaggtccccaacctcactcctctgaagactcttctggagatcctctgtgatgcacagatctccagactcastgcccccagactcagattccctgggtggggaggtctggggatctctgcttgtaatcagctccctagaggttcccatgtagccagataagtattgtcagaa

SEQ ID NO: 21961 - DNA, 201 bp, Homo sapiens
gagattcaaaggaaagttggaactggagctttaaaggagatgtgaagtgggtgactcaacctctgactcagaaaaattgatacctgcagaagaaaaaaccyggcgggcttaggactcccagctgagtgttgtatcctccatccctttccacctggtcccttcattttctacccctcacagttccctaacgagaaggtggtc

SEQ ID NO: 21962 - DNA, 201 bp, Homo sapiens
gactcccagctgagtgttgtatcctccatccctttccacctggtcccttcattttctacccctcacagttccctaacgagaaggtggtccacccaacagayaacgctgcctcagatggttatcaaggggtaccctaagaagaaatcatctcaccctctctttgtccccatttgtcaagtagcagtgaggccgagccagggg

SEQ ID NO: 21963 - DNA, 201 bp, Homo sapiens
catccgtctatgataatggtaatgctgaatacagtaagataatatttattgggcacttactatgtgctaaacttactcattgaatcttcacacccccatgyagaagaacttattttccatagtagggaactgaccccagaggtaaagtaacttgtccaagtcacacaactcctggtagaaacaatattgagtagtcctcct

SEQ ID NO: 21964 - DNA, 201 bp, Homo sapiens
tctgactcagaaaaattgatacctgcagaagaaaaaacccggcgggcttaggactcccagctgagtgttgtatcctccatccctttccacctggtcccttyattttctacccctcacagttccctaacgagaaggtggtccacccaacagacaacgctgcctcagatggttatcaaggggtaccctaagaagaaatcatct

SEQ ID NO: 21965 - DNA, 201 bp, Homo sapiens
aacctttcgtctttcatttcagttcaacgaggatctgcataaacaggtaatattcctgctttgatttccttgtggggtgggttgcaggaggatatgagtcytttctgtgcattgtaacactgaggctcctccaggaagggaatctcaggcatgaacccctctttcaatgtcagccttcaggcaagtggggaaagagcattg

SEQ ID NO: 21966 - DNA, 201 bp, Homo sapiens
acgctcctagtccagcctagggtgaatgtttccccctccaagaaggggcccttgcagcaccacaacctgcttgtctgccacgtgacggatttctacccagrcagcattcaagtccgatggttcctgaatggacaggaggaaacagctggggtcgtgtccaccaacctgatccgtaatggagactggaccttccagatcctg

SEQ ID NO: 21967 - DNA, 201 bp, Homo sapiens
attctatttcattatttttcttccacgctcctagtccagcctagggtgaatgtttccccctccaagaaggggcccttgcagcaccacaacctgcttgtctrccacgtgacggatttctacccaggcagcattcaagtccgatggttcctgaatggacaggaggaaacagctggggtcgtgtccaccaacctgatccgtaat

SEQ ID NO: 21968 - DNA, 201 bp, Homo sapiens
aaggaaggaaggaaagaaggacaatctcaaattctatttcattatttttcttccacgctcctagtccagcctagggtgaatgtttccccctccaagaaggrgcccttgcagcaccacaacctgcttgtctgccacgtgacggatttctacccaggcagcattcaagtccgatggttcctgaatggacaggaggaaacagct

SEQ ID NO: 21969 - DNA, 201 bp, Homo sapiens
cccagctgagtgttgtatcctccatccctttccacctggtcccttcattttctacccctcacagttccctaacgagaaggtggtccacccaacagacaacrctgcctcagatggttatcaaggggtaccctaagaagaaatcatctcaccctctctttgtccccatttgtcaagtagcagtgaggccgagccaggggatgg

SEQ ID NO: 21970 - DNA, 201 bp, Homo sapiens
ttctgggccttgtgtgtccctgggcacctgtccctggtcaattcccgaaagctactgtgctcctcttgcccatctccccttgcaaataatatcttccatckggggaccggcttcctccaatttcaggagaggtggggctgaaggcacagacttgggcgtcactggcacagatataagtaaatacagctggagtctgcagag

SEQ ID NO: 21971 - DNA, 201 bp, Homo sapiens
ccttgtgtgtccctgggcacctgtccctggtcaattcccgaaagctactgtgctcctcttgcccatctccccttgcaaataatatcttccatcgggggacyggcttcctccaatttcaggagaggtggggctgaaggcacagacttgggcgtcactggcacagatataagtaaatacagctggagtctgcagagaggctgg

SEQ ID NO: 21972 - DNA, 201 bp, Homo sapiens
cagtgcccctgagctcattcttttcagtaaattctctctctgcgtggtgagaaaacaggcctggagaggctctgcgacccgcttaggaccacagaactcgrtactaggaaaactcctattttaaaatccagccctgggtgggaagatttgggaagaatcgttaatattgagagagagagggagaaagaggattagatgaga

SEQ ID NO: 21973 - DNA, 201 bp, Homo sapiens
agagggctctcaagatcacagctctgatatggaacattctgtcttcagggcgcatgttgtggggtctataattgatgactgtgagcacaggaacagtgatraggaactgaggccgagtggaggcagatgagactgaaactgtgggcctctagcactggaaatgggtggagaggaatcagcatggctgggattcacctatca

SEQ ID NO: 21974 - DNA, 201 bp, Homo sapiens
gccaccagcagaagggactgccttcccctcagtgctcgcccctccctagtgatcactcagtgcccctgagctcattcttttcagtaaattctctctctgcrtggtgagaaaacaggcctggagaggctctgcgacccgcttaggaccacagaactcggtactaggaaaactcctattttaaaatccagccctgggtgggaa

SEQ ID NO: 21975 - DNA, 201 bp, Homo sapiens
tggcaaaaactgttactaagactttgtagaggcaccaatcagtgacatggcagcattttctttcacagtaatcaactgccagattgcagacagccctgatrccagcctaaggagtgtgggtttctcctccaggcccgcaggtccccaacctcactcctctgaagactcttctggagatcctctgtgatgcacagatctcca

SEQ ID NO: 21976 - DNA, 201 bp, Homo sapiens
acctatagcgagagagggatcccaggctgggatcttaatgcagccagatgcatgaggtcccaagtactcaggctcctgcggagcgtccattgagtgatggkcaatggaatttggtgggatggaaatgtttctctaattatctgaggtggtttcaatggctgattatataacctttcgtctttcatttcagttcaacgagga

SEQ ID NO: 21977 - DNA, 201 bp, Homo sapiens
atggccccagctcctcggagactcagcaggaaagccaaggagagggctctcaagatcacagctctgatatggaacattctgtcttcagggcgcatgttgtrgggtctataattgatgactgtgagcacaggaacagtgatgaggaactgaggccgagtggaggcagatgagactgaaactgtgggcctctagcactggaaa

SEQ ID NO: 21978 - DNA, 201 bp, Homo sapiens
gtcttcagaagactactaagggtgctggctagaggagggaccagaggcagggagatgaggtaggaaactgctattatttgtcagggaaattgcaatcaagrcatgagttagaacagggaaaacacagaggcaagggagaggtggaagggggaggaaagaagtagtgacaattccagggtggatgtccacccaaatctagaa

SEQ ID NO: 21979 - DNA, 201 bp, Homo sapiens
cagcgccatgttagggtatttgtgttctccaggaagtagaaaggaaagaactgagtgattagggacctagaagactaatttgagacattcctcttgatgarctgttctctagggtagtcctctgaaagagctgttctctagtggatctccctgaatgaactgttctctaggagcacttgacccttttctgtgtttgttttt

SEQ ID NO: 21980 - DNA, 201 bp, Homo sapiens
ttcaacatctaggaatcaattacatagtgaacatgcctaagaaataataatctgggcagatgcagtggctcaggcccgtaatcccagccctttgagaggcygagcgggtggatcacttgaggtcaggcgttggtcaagtgctcctagagaaccaggctgaccaacatggagaaaccttgtctctactaataatacaaaaat

SEQ ID NO: 21981 - DNA, 201 bp, Homo sapiens
acacctgtaggatttaatttattttgtttcttagtctttattagtttgtaagaattagcaaagataagaggataaaagcaactattatcatgaaagaaaaygatgaatgtgtatgtgaaagtctgggtttagaatgataaatgcatcagagtgagaaggaactacgggactcttctgctctcacctcccaactcacagatt

SEQ ID NO: 21982 - DNA, 201 bp, Homo sapiens
cccagtgcctgaggagaggctggtgcaggccccagtgctccccctggaggtcacaggtgtcctcggccatgggaacgagggtcagatagtggaacctgtgkaatctgagtttcttgctgggcaggaagatggtctctgcaataccctcaatgactggctccccattgcgcagccacgtgatgttcagcactggtgggaaga

SEQ ID NO: 21983 - DNA, 201 bp, Homo sapiens
gaaattgcaatcaaggcatgagttagaacagggaaaacacagaggcaagggagaggtggaagggggaggaaagaagtagtgacaattccagggtggatgtycacccaaatctagaagtaattgagcaaatgttttctgggcattagagaaggcaactagaacaaacaggaatccttgccttggtgaaatgtatttgaactg

SEQ ID NO: 21984 - DNA, 201 bp, Homo sapiens
ttatgttcaggagtacatgtgcaggtttgttgtataggtaaactcatgacttgggggtttagtgtacagattatttcatcacacaggtactaagcattctraacttttcttacatttatattttgatttttgttttagaggccaactagaaattattgctgagtttggaacacctgtaggatttaatttattttgtttctt

SEQ ID NO: 21985 - DNA, 201 bp, Homo sapiens
gtagaaaaaaatacaaaattgagaggaagaagaaaatatccttcaaattttagggctcttgacagttttaaagtttctgtcttagtttatgaacatgaaamtgtagaatgtatagctttgttgataatatttttcatttggggcatataaattcaaaagtacagtacagttattttggcatttgttccaaacttttgtttc

SEQ ID NO: 21986 - DNA, 201 bp, Homo sapiens
cagccctgatgccagcctaaggagtgtgggtttctcctccaggcccgcaggtccccaacctcactcctctgaagactcttctggagatcctctgtgatgcrcagatctccagactcagtgcccccagactcagattccctgggtggggaggtctggggatctctgcttgtaatcagctccctagaggttcccatgtagcca

SEQ ID NO: 21987 - DNA, 201 bp, Homo sapiens
acgatataggttgtttcccttgtccctgaagacttaacatccgtctatgataatggtaatgctgaatacagtaagataatatttattgggcacttactatrtgctaaacttactcattgaatcttcacacccccatgtagaagaacttattttccatagtagggaactgaccccagaggtaaagtaacttgtccaagtcac

SEQ ID NO: 21988 - DNA, 201 bp, Homo sapiens
gtggtctttggttttttgtccttgcaatagtttgctgtgaatgatgatttccagcttcctccatgtccctacaaaggacatgaactcatccttttttatgrctgcacagtattccatggtgtatatgtgtgcattttcttaatccagtctatcactgatggacagttgggttggttccaagtctttgctattgtgaatagt

SEQ ID NO: 21989 - DNA, 201 bp, Homo sapiens
gtagaggacatgtttgttgtaagctttctttttcgtgtagaggatggattcttcactcctgatacacacaatcagtgcacagcagctctcttatacatccrgttgatgccttcagtctccctggcttcttacaagcatcttctgggccttgtgtgtccctgggcacctgtccctggtcaattcccgaaagctactgtgctc

SEQ ID NO: 21990 - DNA, 201 bp, Homo sapiens
atgttttctgggcattagagaaggcaactagaacaaacaggaatccttgccttggtgaaatgtatttgaactgggtcagaaatgaggccattgggtatcargccttaactccagcgcaccctggaggtcactgatgtggctccaggctgacctgctcctgtcaaagaatattgagcaagatgcctctcgtggaatgttctg

SEQ ID NO: 21991 - DNA, 201 bp, Homo sapiens
agacccagagcacataaatcctaccctcagagtcactgagcagttaacattacaaattacaaaccatatccagtcagagtcattctctttcctgcttgtckcctgtactcatgttacaggttagggcagtaccccgagtggagtgaacaatctctggactaacacttgtcaggatcagaagctgaggtatctgcacccaca

SEQ ID NO: 21992 - DNA, 201 bp, Homo sapiens
ctttaaaggggttttaataaccacttgctaccaggccagtgaacacttaccatagttgatgccttttgagcatgttgcattgtaaactgtccctgaaattmctgtgcacttggcttatgggatgaaacatcctcctagttctcttgtctctcagcttctctgaagtctcattgagcaccttctcttcaatttcttttacac

SEQ ID NO: 21993 - DNA, 201 bp, Homo sapiens
tgtgctaaactaacaaatacccagatatccaggtttggctcatgctacacgtccaaagtaagtcatccaggaagctctgcttatcatcgtactcaggaagycaggctgacagtctttctcctgcacatctgctcccagaacctccccagcagaatgaagggaacctaagaatttattcactggcttttaatgatccctcct

SEQ ID NO: 21994 - DNA, 201 bp, Homo sapiens
gtgcagtgtgaggagaggcccgcagagaagagtcttggaagctgaggggaggtgacctcagcagcacagtggacagcggtgccagtgacttgggaaggtcrgaaaacagaagatggaaagtgggtttggaaaccagggagacctggggagagcaggttggccgcagcggcaggagctggaatgggagggggtgcatgaggc

SEQ ID NO: 21995 - DNA, 201 bp, Homo sapiens
aggcaccaatcagtgacatggcagcattttctttcacagtaatcaactgccagattgcagacagccctgatgccagcctaaggagtgtgggtttctcctcyaggcccgcaggtccccaacctcactcctctgaagactcttctggagatcctctgtgatgcacagatctccagactcagtgcccccagactcagattccct

SEQ ID NO: 21996 - DNA, 201 bp, Homo sapiens
ttacacgtgtgattctagaacatagaatggaacagaatttttgagatcattttatgaggttggttcatttatatttccagagccagctaagaatagtacargagaacaggattgtggactaattttagccatgtcactgaatccaacagtacattataaaaacaatacgttttgaccaattttagatttattctaggaatg

SEQ ID NO: 21997 - DNA, 201 bp, Homo sapiens
agtttgaagccagggaaatggagacttcctgaccttggcttaggggttcctgaagattcatagttctcccccttgtcagagaatctagggacactgactgrtctcgaaaccctcacacttaggaactgacctcacacataggaacagttctcttccttcagcattttagcctcttctcaggcattttgagaggcaacttcc

SEQ ID NO: 21998 - DNA, 201 bp, Homo sapiens
ccggcgggcttaggactcccagctgagtgttgtatcctccatccctttccacctggtcccttcattttctacccctcacagttccctaacgagaaggtggyccacccaacagacaacgctgcctcagatggttatcaaggggtaccctaagaagaaatcatctcaccctctctttgtccccatttgtcaagtagcagtgag

SEQ ID NO: 21999 - DNA, 201 bp, Homo sapiens
agcattcaagtccgatggttcctgaatggacaggaggaaacagctggggtcgtgtccaccaacctgatccgtaatggagactggaccttccagatcctggwgatgctggaaatgaccccccagcagggagatgtctacacctgccaagtggagcacaccagcctggatagtcctgtcaccgtggagtggagtgagtctctg

SEQ ID NO: 22000 - DNA, 201 bp, Homo sapiens
gaataggacacaatcattttttctttttaaaacatctttatccctgatcagcctcatttcctcaaaaactataaaggaaaatgctgctgacttgtttttgygtagtaatttcagctgtcacataataagctaaggaagacagtatatagtaaataaggaccctttatctgtcttattttcccttttggcttcacaggaaac

SEQ ID NO: 22001 - DNA, 201 bp, Homo sapiens
gctctgcgacccgcttaggaccacagaactcggtactaggaaaactcctattttaaaatccagccctgggtgggaagatttgggaagaatcgttaatattragagagagagggagaaagaggattagatgagagtggcgcctccgctcatgtccgccccctccccgcagagaattaccttttccagggacggcaggaatgc

SEQ ID NO: 22002 - DNA, 201 bp, Homo sapiens
ccgccccctccccgcagagaattaccttttccagggacggcaggaatgctacgcgtttaatgggacacagcgcttcctggagagatacatctacaaccggsaggagttcgcgcgcttcgacagcgacgtgggggagttccgggcggtgacggagctggggcggcctgctgcggagtactggaacagccagaaggacatcct

SEQ ID NO: 22003 - DNA, 201 bp, Homo sapiens
gagattcagaacgaaaagggtaaatgacatttatacacattttaaaatgcaaaatcttacgaccaactctatacatataaatttgaaaatttagataaaamggatacgtttctagaaagatataaaggtcaaaactacaggaagaaatagaaaactaaaatagagtagagaatatcaaagaaattgtcatgggaagcaaag

SEQ ID NO: 22004 - DNA, 201 bp, Homo sapiens
cattcagacaaaaatatgtattaaaagactactatatgtcaaacactgttagatgctaaatacccaaataaaaataatacatacgtcctgttctgcagacrcgtataagtcacagaaggaaacacaagtgacaggacaacagcaggttcagaaggataagtgcagatacgtaggtatacacaagatgcgaccaaacagcac

SEQ ID NO: 22005 - DNA, 201 bp, Homo sapiens
acaggacataggaagttgtgaagtatcttaagcaggagagtaacacggtcagatttgtgtttggatggggcacctgtaggaaggatgggctggaggaggckggactcaaggcaagaccagtagcacttttaagccctctggtgggaagtaatgaaggcgtaggccagggcaggaacatggggtgaggaggacagcagatgg

SEQ ID NO: 22006 - DNA, 201 bp, Homo sapiens
gggtcccccactgagtttagggtctagaggattactcacctacagaaatgaatcccaaaggaaaaagaaaaatacatggtgtatagactgggctacacagmtgtaattggttcagcttaggttactttgtatttattatatttacaaaatctgaaaactaaaggttggcacattttgaagcaaattccacacttcaaatgt

SEQ ID NO: 22007 - DNA, 201 bp, Homo sapiens
agaacaaacaggaatccttgccttggtgaaatgtatttgaactgggtcagaaatgaggccattgggtatcaggccttaactccagcgcaccctggaggtcrctgatgtggctccaggctgacctgctcctgtcaaagaatattgagcaagatgcctctcgtggaatgttctgggaccttaaaacagatacccaagtattcc

SEQ ID NO: 22008 - DNA, 201 bp, Homo sapiens
gtgcttccttgccatgacgatgccagcaatacccctctgagaggaacaggcagctataggcagtgccatttgtggcccaagtctgtttggaccattgatcygggtgttcaagtgcttccttgccatgacgatgccagcaatacccctctgagcaccaaagtcaaaggtgtgaataaactctggtagaggccagaccatctc

SEQ ID NO: 22009 - DNA, 201 bp, Homo sapiens
gcagaaaaacagcaaaaagaaaatacatgtaaataataaggacaaaagctgaattcaatgaaatataaaaatagagaagataaaatcaaattttgaggcartgaaaactttaatgagacctctggcaagactcctaaggaaaatacaggagattcagaacgaaaagggtaaatgacatttatacacattttaaaatgcaaa

SEQ ID NO: 22010 - DNA, 201 bp, Homo sapiens
gtaagaggatttctcaaggatgggacaggaaggccttggagctttggcttcctcctgtgaacttgtggggtggggagcctggtgcaccaacctgagggacytgagggagtagtatcaggatgtgggattgagccctggaccttttttctagaaagaggaaaaaaatgaagggaggaggaggaggaagctggggagatcaca

SEQ ID NO: 22011 - DNA, 201 bp, Homo sapiens
tgatatcagataatcggggaacaaacatgacctatagcgagagagggatcccaggctgggatcttaatgcagccagatgcatgaggtcccaagtactcagrctcctgcggagcgtccattgagtgatgggcaatggaatttggtgggatggaaatgtttctctaattatctgaggtggtttcaatggctgattatataacc

SEQ ID NO: 22012 - DNA, 201 bp, Homo sapiens
tgaacatgcctaagaaataataatctgggcagatgcagtggctcaggcccgtaatcccagccctttgagaggccgagcgggtggatcacttgaggtcaggmgttggtcaagtgctcctagagaaccaggctgaccaacatggagaaaccttgtctctactaataatacaaaaattagccaggtgaagtggcaggcacctat

SEQ ID NO: 22013 - DNA, 201 bp, Homo sapiens
aggcaaggttgttttttatcagttggtttgcacttatgtttttaaggtaaatgacatgtttaaatgttaagagactgggcagggaagccctgaagagacarctgagctcattaggaatttctaccaagaatactaaaaagtatttgcatctatgaagagaagcctattgtggtgtttattataacataacattagaaataa

SEQ ID NO: 22014 - DNA, 201 bp, Homo sapiens
gaccagatagatcaatgagcccctaaaatctgtgatccctgaagcagcaattgatgtgaaccaccccatcactcaccccgacgctcctgcgtcctcctgascactcacccttgatggccccagctcctcggagactcagcaggaaagccaaggagagggctctcaagatcacagctctgatatggaacattctgtcttcag

SEQ ID NO: 22015 - DNA, 201 bp, Homo sapiens
cgcatcctctcaccataatttttctctcctggacttacaggaaggaggctggcaacctgggataacttgtcttttacccccacagggttcctgagctcacygaaaagactattgtgccttaggaaaagcatttgctgtgtttcgttagcatctggctccaggacagaccttcaacttccaaattggatactgctgccaaga

SEQ ID NO: 22016 - DNA, 201 bp, Homo sapiens
tcttcagaagactactaagggtgctggctagaggagggaccagaggcagggagatgaggtaggaaactgctattatttgtcagggaaattgcaatcaaggmatgagttagaacagggaaaacacagaggcaagggagaggtggaagggggaggaaagaagtagtgacaattccagggtggatgtccacccaaatctagaag

SEQ ID NO: 22017 - DNA, 201 bp, Homo sapiens
gcatcctgaccctacacaatagtaatagtaacaatgacagctaacatttgttgagcacttacttgtgccaggcatccttctaaatactttacatatttcastcgctgaattgtcacaataaccctatgaagcaaatacatatcatacattttacaggtaaggaaatgcagggaagttacatattaataacttgctaaggtc

SEQ ID NO: 22018 - DNA, 201 bp, Homo sapiens
tcccacatttccaggagcagatcatgcctcttacacgtgtgattctagaacatagaatggaacagaatttttgagatcattttatgaggttggttcatttrtatttccagagccagctaagaatagtacaggagaacaggattgtggactaattttagccatgtcactgaatccaacagtacattataaaaacaatacgtt

SEQ ID NO: 22019 - DNA, 201 bp, Homo sapiens
ctgagatggattttacttgtcttgggttccccacggctgtcacagggcagtgtctcagttcattcgtctttttccttcaggaagtctgggtgtaaagggayggagagaggtgaggtgtgtgcagtaagaggatttctcaaggatgggacaggaaggccttggagctttggcttcctcctgtgaacttgtggggtggggagc

SEQ ID NO: 22020 - DNA, 201 bp, Homo sapiens
actcaggctcctgcggagcgtccattgagtgatgggcaatggaatttggtgggatggaaatgtttctctaattatctgaggtggtttcaatggctgattayataacctttcgtctttcatttcagttcaacgaggatctgcataaacaggtaatattcctgctttgatttccttgtggggtgggttgcaggaggatatgag

SEQ ID NO: 22021 - DNA, 201 bp, Homo sapiens; identical to SEQ ID NO: 2505

SEQ ID NO: 22022 - DNA, 201 bp, Homo sapiens
ttttctttcacagtaatcaactgccagattgcagacagccctgatgccagcctaaggagtgtgggtttctcctccaggcccgcaggtccccaacctcactyctctgaagactcttctggagatcctctgtgatgcacagatctccagactcagtgcccccagactcagattccctgggtggggaggtctggggatctctgc

SEQ ID NO: 22023 - DNA, 201 bp, Homo sapiens; identical to SEQ ID NO: 2791

SEQ ID NO: 22024 - DNA, 201 bp, Homo sapiens
ctaacaaatgaaaatgggagaatccacactcagagtggggcaattgaacaggcaggggcggatggatggcagaggaggaggaatctggactcaaggagctrgggggctctgggcctggaattttagggtctggggcccaaggcaccaggagaagaggcaggtcaggatatctgagtcaagacctgggatcttgccttagca

SEQ ID NO: 22025 - DNA, 201 bp, Homo sapiens
tctcaaaaaaaaggaaggaaggaaggaaggaaggaaggaaggaaggaaggaaggaaggaaagaaggacaatctcaaattctatttcattatttttcttccmcgctcctagtccagcctagggtgaatgtttccccctccaagaaggggcccttgcagcaccacaacctgcttgtctgccacgtgacggatttctacccagg

SEQ ID NO: 22026 - DNA, 201 bp, Homo sapiens
acaagctggggcacaaatgcaaagatgcagagggaggcaacacctggtcatctgtgagaccttcatgggacctgaagacgcagcacagaggaggaacttgraaaaggacgggatttctactactcaagcatgtaggagctcaggatattctgtaaatatgaagattttgagtttttgtaggtgaggtaaaaaaatacatag

SEQ ID NO: 22027 - DNA, 201 bp, Homo sapiens
cctccccgcagagaattaccttttccagggacggcaggaatgctacgcgtttaatgggacacagcgcttcctggagagatacatctacaaccgggaggagytcgcgcgcttcgacagcgacgtgggggagttccgggcggtgacggagctggggcggcctgctgcggagtactggaacagccagaaggacatcctggagga

SEQ ID NO: 22028 - DNA, 201 bp, Homo sapiens
gaggtaattggttgagagaggtgttcaaataaaaataacgcaattggcaaaaactgttactaagactttgtagaggcaccaatcagtgacatggcagcatyttctttcacagtaatcaactgccagattgcagacagccctgatgccagcctaaggagtgtgggtttctcctccaggcccgcaggtccccaacctcactcc

SEQ ID NO: 22029 - DNA, 201 bp, Homo sapiens
tggatctccctgaatgaactgttctctaggagcacttgacccttttctgtgtttgttttttgttttgtgtttgtgtttgtttttgagacaggttctcactytgtctcccaggctggagtgctgtggcaccatcatggctcactgcagcctcaacctcctgggctcaagtgatcctcctgcctcagcctcccatgtagctag

SEQ ID NO: 22030 - DNA, 201 bp, Homo sapiens
ttggctcctgaaaagcttacacactacctcctggcctaaggaggggcacagggatgctggcaacagtctatttcttcacccgggtactagttacatgggtrcttgcggtgataaccattcaacgtacattctattggtttgtgtgtttcttccaaatgtcccctagttcacaatagaaagggcttaaatagagaagtaaag

SEQ ID NO: 22031 - DNA, 201 bp, Homo sapiens
cattttctttgtattttcatgaagttattagattcacaggccaccataatgccattgtctgtatatcttaatttcaagatattatttgagtaaattttgcwtcctttgtatcaagatagaactttgaaaaggtaggtaatttcacagttgatcaaatattctttgcccaaattacttttggttaaaatttctcctaaatgt

SEQ ID NO: 22032 - DNA, 201 bp, Homo sapiens
gcagtgagccaatattgcgccactgcattccagacttggcaacagagtgacactccatctcaacaaaaagaaagaatgaaagaaagaaagagcgagattaygtctcaaaaaaaaggaaggaaggaaggaaggaaggaaggaaggaaggaaggaaggaaggaaagaaggacaatctcaaattctatttcattatttttcttc

SEQ ID NO: 22033 - DNA, 201 bp, Homo sapiens
tcccagctgagtgttgtatcctccatccctttccacctggtcccttcattttctacccctcacagttccctaacgagaaggtggtccacccaacagacaaygctgcctcagatggttatcaaggggtaccctaagaagaaatcatctcaccctctctttgtccccatttgtcaagtagcagtgaggccgagccaggggatg

SEQ ID NO: 22034 - DNA, 201 bp, Homo sapiens
attatgtctcaaaaaaaaggaaggaaggaaggaaggaaggaaggaaggaaggaaggaaggaaggaaagaaggacaatctcaaattctatttcattattttycttccacgctcctagtccagcctagggtgaatgtttccccctccaagaaggggcccttgcagcaccacaacctgcttgtctgccacgtgacggatttcta

SEQ ID NO: 22035 - DNA, 201 bp, Homo sapiens
agaaggtggtccacccaacagacaacgctgcctcagatggttatcaaggggtaccctaagaagaaatcatctcaccctctctttgtccccatttgtcaagyagcagtgaggccgagccaggggatggtgaaagtggaaggaggtgggagttgggcattgggtgtgaagatgctctttaaaggggttttaataaccacttgc

SEQ ID NO: 22036 - DNA, 201 bp, Homo sapiens
tcagggaaattgcaatcaaggcatgagttagaacagggaaaacacagaggcaagggagaggtggaagggggaggaaagaagtagtgacaattccagggtgkatgtccacccaaatctagaagtaattgagcaaatgttttctgggcattagagaaggcaactagaacaaacaggaatccttgccttggtgaaatgtatttg

SEQ ID NO: 22037 - DNA, 201 bp, Homo sapiens
tcacctgagaacaacaggacaagctggggcacaaatgcaaagatgcagagggaggcaacacctggtcatctgtgagaccttcatgggacctgaagacgcakcacagaggaggaacttgaaaaaggacgggatttctactactcaagcatgtaggagctcaggatattctgtaaatatgaagattttgagtttttgtaggtg

SEQ ID NO: 22038 - DNA, 201 bp, Homo sapiens
agtactcaggctcctgcggagcgtccattgagtgatgggcaatggaatttggtgggatggaaatgtttctctaattatctgaggtggtttcaatggctgawtatataacctttcgtctttcatttcagttcaacgaggatctgcataaacaggtaatattcctgctttgatttccttgtggggtgggttgcaggaggatat

SEQ ID NO: 22039 - DNA, 201 bp, Homo sapiens
acataataagctaaggaagacagtatatagtaaataaggaccctttatctgtcttattttcccttttggcttcacaggaaacttgtgagaaacctatgcarcataaaattaatatgatttcaatccagggattcaacgatggaaggaggtcatgagaatagcagaaagtcttcaaatcgagatcattatgaaatcctcaga

SEQ ID NO: 22040 - DNA, 201 bp, Homo sapiens
gactaacacttgtcaggatcagaagctgaggtatctgcacccacattacaggaacaggatatgtgctcctagggaactgagggtgtcaggagatgaggaawgtccctggagtcacagaaagaaggtatcagatgtgtctcactctgacatatgcaggtgtttatgaaactctgggatttctaaggaaggatgcagtgcaga

SEQ ID NO: 22041 - DNA, 201 bp, Homo sapiens
tttgatactcatagagaaggtcacaaaacatttactatttaatgtaatgatgaagtacatatattacgttaatattttatcttatttgtggtagccttacsttgcataaataataattactaacagattaggacatgagagattctgttattagtgctttgcatgcattacctcatttaaacctcatattaaacctgaggg

SEQ ID NO: 22042 - DNA, 201 bp, Homo sapiens
acaaatacccagatatccaggtttggctcatgctacacgtccaaagtaagtcatccaggaagctctgcttatcatcgtactcaggaagccaggctgacagkctttctcctgcacatctgctcccagaacctccccagcagaatgaagggaacctaagaatttattcactggcttttaatgatccctcctagaaagaacaca

SEQ ID NO: 22043 - DNA, 201 bp, Homo sapiens
ttgcacttcgtctcctaatgcagagtccatagctcggagttcctgtaaagcagccacaaaagatagaggctggggatcccagagagataggagggccctgrtagtaggtcactgtgtgcaggaatctggggaaggcagtgtatgaccctcagagctgggtctggacttcaaacttggctcgttgatctgctgtgtaacctt

SEQ ID NO: 22044 - DNA, 201 bp, Homo sapiens
tgaattaagaggatggaaaagcagaaaaacagcaaaaagaaaatacatgtaaataataaggacaaaagctgaattcaatgaaatataaaaatagagaagayaaaatcaaattttgaggcaatgaaaactttaatgagacctctggcaagactcctaaggaaaatacaggagattcagaacgaaaagggtaaatgacattta

SEQ ID NO: 22045 - DNA, 201 bp, Homo sapiens
ctttcacagtaatcaactgccagattgcagacagccctgatgccagcctaaggagtgtgggtttctcctccaggcccgcaggtccccaacctcactcctcygaagactcttctggagatcctctgtgatgcacagatctccagactcagtgcccccagactcagattccctgggtggggaggtctggggatctctgcttgt

SEQ ID NO: 22046 - DNA, 201 bp, Homo sapiens
tatgagtgagaaggtggacacactgggtggggatgaggtgagtgacatgagcttaggaaagttgctgaggtaattggttgagagaggtgttcaaataaaartaacgcaattggcaaaaactgttactaagactttgtagaggcaccaatcagtgacatggcagcattttctttcacagtaatcaactgccagattgcagac

SEQ ID NO: 22047 - DNA, 201 bp, Homo sapiens
aaatagtggaggaagaggaaataactgaaaacataatagatgtttagtctttatagaaagatgaaataagttcattcaaaatgctgcatagaatgtcagaytgttaaacaattttgttagagtaaaatgactgtaaacaaatgagctaattatgtgaattaagaggatggaaaagcagaaaaacagcaaaaagaaaataca

SEQ ID NO: 22048 - DNA, 201 bp, Homo sapiens
aatcagtgacatggcagcattttctttcacagtaatcaactgccagattgcagacagccctgatgccagcctaaggagtgtgggtttctcctccaggcccrcaggtccccaacctcactcctctgaagactcttctggagatcctctgtgatgcacagatctccagactcagtgcccccagactcagattccctgggtggg

SEQ ID NO: 22049 - DNA, 201 bp, Homo sapiens
gccgcagcggcaggagctggaatgggagggggtgcatgaggctgagtgtggcgcatcctcctcggggctgagatggattttacttgtcttgggttccccayggctgtcacagggcagtgtctcagttcattcgtctttttccttcaggaagtctgggtgtaaagggatggagagaggtgaggtgtgtgcagtaagaggatt

SEQ ID NO: 22050 - DNA, 201 bp, Homo sapiens
aggagaatttgggaatttgaagcaaaagcaagaagccactgaatcaagcacaaatattgagctttgataaagattggaataagaaacataataaatgagayaagaaataggacttttgcaactgaagtgtaattaataaacaaaaagccaaactgagaaactgtcccaaggacaatatgatcgagtaaacaatagaaaatg

SEQ ID NO: 22051 - DNA, 201 bp, Homo sapiens
ttgaaaaaggacgggatttctactactcaagcatgtaggagctcaggatattctgtaaatatgaagattttgagtttttgtaggtgaggtaaaaaaatacmtaggttttttacagaataagacatgtaaagctctcttcattttctttgtattttcatgaagttattagattcacaggccaccataatgccattgtctgta

SEQ ID NO: 22052 - DNA, 201 bp, Homo sapiens; identical to SEQ ID NO: 2799

SEQ ID NO: 22053 - DNA, 201 bp, Homo sapiens
tccattgctgaaggaagcagagatcaactctgttatttatcagcctgagacgcatcctctcaccataatttttctctcctggacttacaggaaggaggctrgcaacctgggataacttgtcttttacccccacagggttcctgagctcactgaaaagactattgtgccttaggaaaagcatttgctgtgtttcgttagcat

SEQ ID NO: 22054 - DNA, 201 bp, Homo sapiens
gcggcaggagctggaatgggagggggtgcatgaggctgagtgtggcgcatcctcctcggggctgagatggattttacttgtcttgggttccccacggctgkcacagggcagtgtctcagttcattcgtctttttccttcaggaagtctgggtgtaaagggatggagagaggtgaggtgtgtgcagtaagaggatttctcaa

SEQ ID NO: 22055 - DNA, 201 bp, Homo sapiens
tccagggagaggggacccagggggaagagcaaaggaccggatcctgggaactggacagttgtgatttggccaagacagaaaagcctgtgaaagagaccaawaaaacccaagtgcagtgtgaggagaggcccgcagagaagagtcttggaagctgaggggaggtgacctcagcagcacagtggacagcggtgccagtgactt

SEQ ID NO: 22056 - DNA, 201 bp, Homo sapiens
gaaacctacagggaggtagctgggtttgaggtgcttgaggggcagatgggtggtctgatgggcaggtagacagaagggtctgcagccggggaggagactgrgatacatgagaccatccagggagaggggacccagggggaagagcaaaggaccggatcctgggaactggacagttgtgatttggccaagacagaaaagcct

SEQ ID NO: 22057 - DNA, 201 bp, Homo sapiens
tggggtccactcatcttatcttctgcatctataccctggggccatgtccaaaccccatctttcttctataccagctcctgagcatagtttgaagccagggmaatggagacttcctgaccttggcttaggggttcctgaagattcatagttctcccccttgtcagagaatctagggacactgactggtctcgaaaccctcac

SEQ ID NO: 22058 - DNA, 201 bp, Homo sapiens
ggcatgaagttgcaaggagaactgcagttcttcagtgtgactgaagccaggggagatgtgggccaggcagcactgtaacctgccttgtgtgctgatggcargtgtttgcattttatcccacaggacataggaagttgtgaagtatcttaagcaggagagtaacacggtcagatttgtgtttggatggggcacctgtaggaa

SEQ ID NO: 22059 - DNA, 201 bp, Homo sapiens
aataacgcaattggcaaaaactgttactaagactttgtagaggcaccaatcagtgacatggcagcattttctttcacagtaatcaactgccagattgcagrcagccctgatgccagcctaaggagtgtgggtttctcctccaggcccgcaggtccccaacctcactcctctgaagactcttctggagatcctctgtgatgc

SEQ ID NO: 22060 - DNA, 201 bp, Homo sapiens; identical to SEQ ID NO: 2817

SEQ ID NO: 22061 - DNA, 201 bp, Homo sapiens
aggaggtggcatttgaaccaggactgacatcaggatggaaatgtcagtcagggagttaagtagggggagcagctccgccctccacgtccccagctcctccygcccctgttttttctcccagtgaccccacgtgaaacgtctccgcctcctccagccaccagcagaagggactgccttcccctcagtgctcgcccctcccta

SEQ ID NO: 22062 - DNA, 201 bp, Homo sapiens
tgaagattttgagtttttgtaggtgaggtaaaaaaatacataggttttttacagaataagacatgtaaagctctcttcattttctttgtattttcatgaarttattagattcacaggccaccataatgccattgtctgtatatcttaatttcaagatattatttgagtaaattttgcttcctttgtatcaagatagaactt

SEQ ID NO: 22063 - DNA, 201 bp, Homo sapiens
ctggggcggcctgctgcggagtactggaacagccagaaggacatcctggaggagaagcgggcagtgccggacaggatgtgcagacacaactacgagctggdcgggcccatgaccctgcagcgccgaggtgagtgagggctttgggccggcggtcccagggcagccccgcgggcccgtgcccagggcgcaggagcagccggg

SEQ ID NO: 22064 - DNA, 201 bp, Homo sapiens
cttactaactattattttattcaagatcatgcatgctctacttgaaggtctatttctatcttttcaatgctacccttacccactagcctaatcacattatwcctattttcaacatctaggaatcaattacatagtgaacatgcctaagaaataataatctgggcagatgcagtggctcaggcccgtaatcccagccctttg

SEQ ID NO: 22065 - DNA, 201 bp, Homo sapiens; identical to SEQ ID NO: 2525

SEQ ID NO: 22066 - DNA, 201 bp, Homo sapiens
gcgcgcttcgacagcgacgtgggggagttccgggcggtgacggagctggggcggcctgctgcggagtactggaacagccagaaggacatcctggaggagargcgggcagtgccggacaggatgtgcagacacaactacgagctgggcgggcccatgaccctgcagcgccgaggtgagtgagggctttgggccggcggtccc

SEQ ID NO: 22067 - DNA, 201 bp, Homo sapiens
gggcggcctgctgcggagtactggaacagccagaaggacatcctggaggagaagcgggcagtgccggacaggatgtgcagacacaactacgagctgggcgrgcccatgaccctgcagcgccgaggtgagtgagggctttgggccggcggtcccagggcagccccgcgggcccgtgcccagggcgcaggagcagccgggttg

SEQ ID NO: 22068 - DNA, 201 bp, Homo sapiens
tattatcattcacataacattcacaaaattgtcttgtggagtgtagttttcaagtgtagtttcacctggaaatacaagttgttggcatttgaaagacctaygggatagtatcttagctttacctgatacataagaagcagcaactggttgataacaaaaagtgaattattattacagtgaattacagagagtttagggttc

SEQ ID NO: 22069 - DNA, 201 bp, Homo sapiens
aaaaatgataccttctataattttatccacaacacttacattttaggcagagtaaatttaaaagtattatcattcacataacattcacaaaattgtcttgwggagtgtagttttcaagtgtagtttcacctggaaatacaagttgttggcatttgaaagacctatgggatagtatcttagctttacctgatacataagaag

SEQ ID NO: 22070 - DNA, 201 bp, Homo sapiens; identical to SEQ ID NO: 2825

SEQ ID NO: 22071 - DNA, 201 bp, Homo sapiens
aggaggctggcaacctgggataacttgtcttttacccccacagggttcctgagctcactgaaaagactattgtgccttaggaaaagcatttgctgtgtttygttagcatctggctccaggacagaccttcaacttccaaattggatactgctgccaagaagttgctctgaagtcagtttctatcattctgctctttgattc

SEQ ID NO: 22072 - DNA, 201 bp, Homo sapiens
caaacatatactccccagagggtctgtgcgtctgcacaaactccgcatatgttgacacatggtctgctgcatgaaggagaagatggagaatgggtgaataygtaggatgctacacagaatgcaggaagcaaacaggtaacaggaaggttattgggaacatgaaggaataacacagaaaatgagaaatgcaaatgaaagaaa

SEQ ID NO: 22073 - DNA, 201 bp, Homo sapiens
gctggcaacctgggataacttgtcttttacccccacagggttcctgagctcactgaaaagactattgtgccttaggaaaagcatttgctgtgtttcgttarcatctggctccaggacagaccttcaacttccaaattggatactgctgccaagaagttgctctgaagtcagtttctatcattctgctctttgattcaaagc

SEQ ID NO: 22074 - DNA, 201 bp, Homo sapiens
gccagaccatctccttctcatccaggttcacgtagaactgctcctcctcatcaaattcaaacatatactccccagagggtctgtgcgtctgcacaaactcygcatatgttgacacatggtctgctgcatgaaggagaagatggagaatgggtgaatacgtaggatgctacacagaatgcaggaagcaaacaggtaacagga

SEQ ID NO: 22075 - DNA, 201 bp, Homo sapiens
ccatttgtggcccaagtctgtttggaccattgatccgggtgttcaagtgcttccttgccatgacgatgccagcaatacccctctgagcaccaaagtcaaargtgtgaataaactctggtagaggccagaccatctccttctcatccaggttcacgtagaactgctcctcctcatcaaattcaaacatatactccccagagg

SEQ ID NO: 22076 - DNA, 201 bp, Homo sapiens
aagacagagttataaggtacagagagcaggggctggccttggatgtgggaggtgttgggtattcgaaaccatgagatggtgaaatttggataaagtgaccrtaaaacatgggattgaggaaggcaggtgctgaggggcgatgggcccaggaaataaaggtggtgccaaggccgtgagggcagagggagggcgctccatacc

SEQ ID NO: 22077 - DNA, 201 bp, Homo sapiens
agcaaggttggaatctcctgaatacagcccctcaagccctaaaacctcttatctattaccttgggttcattgtccaggaaggggaggagaacttgaacttrtagtcacagaagggtgctgagaactaaccagcaggacggctcagccctgggaactgcagaggggtgaggctggggagagaggaggctggagcagcactgg

SEQ ID NO: 22078 - DNA, 201 bp, Homo sapiens
ggcaacctgggataacttgtcttttacccccacagggttcctgagctcactgaaaagactattgtgccttaggaaaagcatttgctgtgtttcgttagcayctggctccaggacagaccttcaacttccaaattggatactgctgccaagaagttgctctgaagtcagtttctatcattctgctctttgattcaaagcact

SEQ ID NO: 22079 - DNA, 201 bp, Homo sapiens
aggactgcaaagtaggtaccttagttttccactgacttccacttttcctgcttacacccttcctcctagacctctccacacccctcctaggacacacctaraaggtactgacatcatgtcacctcctcatctttcagggtagcaaggttggaatctcctgaatacagcccctcaagccctaaaacctcttatctattacct

SEQ ID NO: 22080 - DNA, 201 bp, Homo sapiens
cctgggataacttgtcttttacccccacagggttcctgagctcactgaaaagactattgtgccttaggaaaagcatttgctgtgtttcgttagcatctggytccaggacagaccttcaacttccaaattggatactgctgccaagaagttgctctgaagtcagtttctatcattctgctctttgattcaaagcactgtttc

SEQ ID NO: 22081 - DNA, 201 bp, Homo sapiens
tcttttacccccacagggttcctgagctcactgaaaagactattgtgccttaggaaaagcatttgctgtgtttcgttagcatctggctccaggacagaccytcaacttccaaattggatactgctgccaagaagttgctctgaagtcagtttctatcattctgctctttgattcaaagcactgtttctctcactgggcctc

SEQ ID NO: 22082 - DNA, 201 bp, Homo sapiens
tctctaatgtttttctgttacaggtaatgttaattttttattttatattctctttaccatatttaagaaatacttttctagtctcattttaaatatttcarttttgagctatttatttgatactcatagagaaggtcacaaaacatttactatttaatgtaatgatgaagtacatatattacgttaatattttatcttatt

SEQ ID NO: 22083 - DNA, 201 bp, Homo sapiens
caagatgcctctcgtggaatgttctgggaccttaaaacagatacccaagtattccccctgatttcatggttcccagaagctctatggggaagaaattgtasgtaattcacaactgagatttagacataagttgaatagtgtaatggacattgagttaaccgaggtaatgaagtagtgagacacaggtgcccctgaaataaa

SEQ ID NO: 22084 - DNA, 201 bp, Homo sapiens
cagggtgagcgggacttaccttcccctggcatattcacacttattccacgatgaggggtttgacagaaaagaaatgtcagaaagctctagaggccactgawatcagataatcggggaacaaacatgacctatagcgagagagggatcccaggctgggatcttaatgcagccagatgcatgaggtcccaagtactcaggctc

SEQ ID NO: 22085 - DNA, 201 bp, Homo sapiens
ccatgtagccagataagtattgtcagaacactgaagatttttgaaaaatgaaaaagagaaggttggagatgtgtcttcagaagactactaagggtgctggstagaggagggaccagaggcagggagatgaggtaggaaactgctattatttgtcagggaaattgcaatcaaggcatgagttagaacagggaaaacacagag

SEQ ID NO: 22086 - DNA, 201 bp, Homo sapiens
ggacaggatgtgcagacacaactacgagctgggcgggcccatgaccctgcagcgccgaggtgagtgagggctttgggccggcggtcccagggcagccccgygggcccgtgcccagggcgcaggagcagccgggttggcctaagggaccttagtgccgggcggaaaggggactttgggttggggattcatggggggagccca

SEQ ID NO: 22087 - DNA, 201 bp, Homo sapiens
gcagcacagaggaggaacttgaaaaaggacgggatttctactactcaagcatgtaggagctcaggatattctgtaaatatgaagattttgagtttttgtargtgaggtaaaaaaatacataggttttttacagaataagacatgtaaagctctcttcattttctttgtattttcatgaagttattagattcacaggccacc

SEQ ID NO: 22088 - DNA, 201 bp, Homo sapiens
atatatttctacatctcctacatgcaaaacaacaggagcaagttgaggaattctcaagaaactggtcgagaagagagagcgcttagctatggaaaagagaragaaggaagggagggcttcctggaggaggtggcatttgaaccaggactgacatcaggatggaaatgtcagtcagggagttaagtagggggagcagctccg

SEQ ID NO: 22089 - DNA, 201 bp, Homo sapiens
gatcaactctgttatttatcagcctgagacgcatcctctcaccataatttttctctcctggacttacaggaaggaggctggcaacctgggataacttgtcytttacccccacagggttcctgagctcactgaaaagactattgtgccttaggaaaagcatttgctgtgtttcgttagcatctggctccaggacagaccttc

SEQ ID NO: 22090 - DNA, 201 bp, Homo sapiens
ctctcttcattttctttgtattttcatgaagttattagattcacaggccaccataatgccattgtctgtatatcttaatttcaagatattatttgagtaawttttgcttcctttgtatcaagatagaactttgaaaaggtaggtaatttcacagttgatcaaatattctttgcccaaattacttttggttaaaatttctcc

SEQ ID NO: 22091 - DNA, 201 bp, Homo sapiens
ctgtaaagcagccacaaaagatagaggctggggatcccagagagataggagggccctgatagtaggtcactgtgtgcaggaatctggggaaggcagtgtaygaccctcagagctgggtctggacttcaaacttggctcgttgatctgctgtgtaaccttggaaaacttattcatctttttgagcttcagttttttcaaaat

SEQ ID NO: 22092 - DNA, 201 bp, Homo sapiens
tcggggaacaaacatgacctatagcgagagagggatcccaggctgggatcttaatgcagccagatgcatgaggtcccaagtactcaggctcctgcggagcrtccattgagtgatgggcaatggaatttggtgggatggaaatgtttctctaattatctgaggtggtttcaatggctgattatataacctttcgtctttcat

SEQ ID NO: 22093 - DNA, 201 bp, Homo sapiens
tcaaaaaaaaggaaggaaggaaggaaggaaggaaggaaggaaggaaggaaggaaggaaagaaggacaatctcaaattctatttcattatttttcttccacrctcctagtccagcctagggtgaatgtttccccctccaagaaggggcccttgcagcaccacaacctgcttgtctgccacgtgacggatttctacccaggca

SEQ ID NO: 22094 - DNA, 201 bp, Homo sapiens
gcatagtttgaagccagggaaatggagacttcctgaccttggcttaggggttcctgaagattcatagttctcccccttgtcagagaatctagggacactgrctggtctcgaaaccctcacacttaggaactgacctcacacataggaacagttctcttccttcagcattttagcctcttctcaggcattttgagaggcaac

SEQ ID NO: 22095 - DNA, 201 bp, Homo sapiens
aaggagagggctctcaagatcacagctctgatatggaacattctgtcttcagggcgcatgttgtggggtctataattgatgactgtgagcacaggaacagygatgaggaactgaggccgagtggaggcagatgagactgaaactgtgggcctctagcactggaaatgggtggagaggaatcagcatggctgggattcacct

SEQ ID NO: 22096 - DNA, 201 bp, Homo sapiens
ttcagttcaacgaggatctgcataaacaggtaatattcctgctttgatttccttgtggggtgggttgcaggaggatatgagtcctttctgtgcattgtaayactgaggctcctccaggaagggaatctcaggcatgaacccctctttcaatgtcagccttcaggcaagtggggaaagagcattgcttggctccattgctga

SEQ ID NO: 22097 - DNA, 201 bp, Homo sapiens
aattcacctgagaacaacaggacaagctggggcacaaatgcaaagatgcagagggaggcaacacctggtcatctgtgagaccttcatgggacctgaagacrcagcacagaggaggaacttgaaaaaggacgggatttctactactcaagcatgtaggagctcaggatattctgtaaatatgaagattttgagtttttgtag

SEQ ID NO: 22098 - DNA, 201 bp, Homo sapiens
attcatagttctcccccttgtcagagaatctagggacactgactggtctcgaaaccctcacacttaggaactgacctcacacataggaacagttctcttcyttcagcattttagcctcttctcaggcattttgagaggcaacttccagaatcagcatttgccaccttgttgaggtcacacccctgttccagatatgagggt

SEQ ID NO: 22099 - DNA, 201 bp, Homo sapiens
gcggaaacccagaggtcttaacagtagggttcgtagaaggtccaagggccagatcttgatgcccaacattgcttatgggagcaacaacaacaacaaaaaamacatgctgcccagtggcttccagaagtttctggtccacagcctcaaggagctgaaagtgctgctgatgtgcaacaaatcttactgtgctgagatcgctca

SEQ ID NO: 22100 - DNA, 201 bp, Homo sapiens
tccttgcagctatcaaaagtctaggcctcccttgcagtcctgaatctctcagaacccgaatcacaaggctatcaagaccatgcaaccctgctgtcttgagrgaggaaagcttgtgaccacccacaaagacccaggaagagccctagggtcctagaagagagggaggatacagaaacactctttgcacttcgtctcctaatg

SEQ ID NO: 22101 - DNA, 201 bp, Homo sapiens
tgagaacaacaggacaagctggggcacaaatgcaaagatgcagagggaggcaacacctggtcatctgtgagaccttcatgggacctgaagacgcagcacakaggaggaacttgaaaaaggacgggatttctactactcaagcatgtaggagctcaggatattctgtaaatatgaagattttgagtttttgtaggtgaggta

SEQ ID NO: 22102 - DNA, 201 bp, Homo sapiens
cacaaggctatcaagaccatgcaaccctgctgtcttgagagaggaaagcttgtgaccacccacaaagacccaggaagagccctagggtcctagaagagagrgaggatacagaaacactctttgcacttcgtctcctaatgcagagtccatagctcggagttcctgtaaagcagccacaaaagatagaggctggggatccca

SEQ ID NO: 22103 - DNA, 201 bp, Homo sapiens
aaaccttgtctctactaataatacaaaaattagccaggtgaagtggcaggcacctataatcccagctattcgggaggctgaggaaggagaattggttgaascccggaggtggaggttgcagtgagccaatattgcgccactgcattccagacttggcaacagagtgacactccatctcaacaaaaagaaagaatgaaagaa

SEQ ID NO: 22104 - DNA, 201 bp, Homo sapiens
aatgaaggcgtaggccagggcaggaacatggggtgaggaggacagcagatggatttgatggcagtaatgacatgagaggccacaggaatcactaaatcacrtgccagaagtagggatatgaagaagtcgagaataaccacgcaacgtggagaattgtggcatccgtgcctgcaaaggtgataattaagtgattgagagaag

SEQ ID NO: 22105 - DNA, 201 bp, Homo sapiens
ctgtcttgagagaggaaagcttgtgaccacccacaaagacccaggaagagccctagggtcctagaagagagggaggatacagaaacactctttgcacttcstctcctaatgcagagtccatagctcggagttcctgtaaagcagccacaaaagatagaggctggggatcccagagagataggagggccctgatagtaggtc

SEQ ID NO: 22106 - DNA, 201 bp, Homo sapiens
cagtaagaataggatcagctgtgctaaactaacaaatacccagatatccaggtttggctcatgctacacgtccaaagtaagtcatccaggaagctctgctyatcatcgtactcaggaagccaggctgacagtctttctcctgcacatctgctcccagaacctccccagcagaatgaagggaacctaagaatttattcactg

SEQ ID NO: 22107 - DNA, 201 bp, Homo sapiens
aaggtactgacatcatgtcacctcctcatctttcagggtagcaaggttggaatctcctgaatacagcccctcaagccctaaaacctcttatctattacctygggttcattgtccaggaaggggaggagaacttgaacttgtagtcacagaagggtgctgagaactaaccagcaggacggctcagccctgggaactgcagag

SEQ ID NO: 22108 - DNA, 201 bp, Homo sapiens
agcactggtgacactgaacagtgtcaggaggaagtgacggatgcagcgcccccatcccataggcagagctgtcatgtgggatgagggacagtgttgggagycaccaaggaaacccagaggtgggggagcagagagcagaagggggcatgtgatgctgggcagtgaaagggaggacaggcaaaggctgggttgaggtttgta

SEQ ID NO: 22109 - DNA, 201 bp, Homo sapiens
agacactgctcatggcactccctaggaagaacagcatgtgggaaaggctgccaaaattgttcatgtaaaaattacatcaatgctgtcttcctcggtgctgyctatgcagctggcagccatctcttcctccacatcatggcctccctcagactcctcatgaaggataagatcctcaaaaagaggaccaacaagttcatgagg

SEQ ID NO: 22110 - DNA, 201 bp, Homo sapiens
ttggtctttgagacaatggtgccattaaggacccccgccaggcccaccagcaggccgagggcacagaccagcatctccatggtctcaggcacctggattakttcatggacctctggggcaccaagggaagacagagttataaggtacagagagcaggggctggccttggatgtgggaggtgttgggtattcgaaaccatga

SEQ ID NO: 22111 - DNA, 201 bp, Homo sapiens
atgactcataggagcccctggacccggggatgctgtcagatcgcttggtctttgagacaatggtgccattaaggacccccgccaggcccaccagcaggccsagggcacagaccagcatctccatggtctcaggcacctggattagttcatggacctctggggcaccaagggaagacagagttataaggtacagagagcagg

SEQ ID NO: 22112 - DNA, 201 bp, Homo sapiens
gcggcctgctgcggagtactggaacagccagaaggacatcctggaggagaagcgggcagtgccggacaggatgtgcagacacaactacgagctgggcgggsccatgaccctgcagcgccgaggtgagtgagggctttgggccggcggtcccagggcagccccgcgggcccgtgcccagggcgcaggagcagccgggttggc

SEQ ID NO: 22113 - DNA, 201 bp, Homo sapiens
ttacccccacagggttcctgagctcactgaaaagactattgtgccttaggaaaagcatttgctgtgtttcgttagcatctggctccaggacagaccttcarcttccaaattggatactgctgccaagaagttgctctgaagtcagtttctatcattctgctctttgattcaaagcactgtttctctcactgggcctccaac

SEQ ID NO: 22114 - DNA, 201 bp, Homo sapiens
ccacagggttcctgagctcactgaaaagactattgtgccttaggaaaagcatttgctgtgtttcgttagcatctggctccaggacagaccttcaacttccmaattggatactgctgccaagaagttgctctgaagtcagtttctatcattctgctctttgattcaaagcactgtttctctcactgggcctccaaccatgtt

SEQ ID NO: 22115 - DNA, 201 bp, Homo sapiens
gcctgctgcggagtactggaacagccagaaggacatcctggaggagaagcgggcagtgccggacaggatgtgcagacacaactacgagctgggcgggcccrtgaccctgcagcgccgaggtgagtgagggctttgggccggcggtcccagggcagccccgcgggcccgtgcccagggcgcaggagcagccgggttggccta

SEQ ID NO: 22116 - DNA, 201 bp, Homo sapiens
aggagaagcgggcagtgccggacaggatgtgcagacacaactacgagctgggcgggcccatgaccctgcagcgccgaggtgagtgagggctttgggccggsggtcccagggcagccccgcgggcccgtgcccagggcgcaggagcagccgggttggcctaagggaccttagtgccgggcggaaaggggactttgggttggg

SEQ ID NO: 22117 - DNA, 201 bp, Homo sapiens
actcccagctgagtgttgtatcctccatccctttccacctggtcccttcattttctacccctcacagttccctaacgagaaggtggtccacccaacagacracgctgcctcagatggttatcaaggggtaccctaagaagaaatcatctcaccctctctttgtccccatttgtcaagtagcagtgaggccgagccagggga

SEQ ID NO: 22118 - DNA, 201 bp, Homo sapiens
acacttaccatagttgatgccttttgagcatgttgcattgtaaactgtccctgaaattcctgtgcacttggcttatgggatgaaacatcctcctagttctyttgtctctcagcttctctgaagtctcattgagcaccttctcttcaatttcttttacacagtaagaataggatcagctgtgctaaactaacaaatacccag

SEQ ID NO: 22119 - DNA, 201 bp, Homo sapiens
actctaggggcagggactcctaggaatcgtcacataaaatcatgacatcaaggattcacagtcataagccctacaggagaccctagagagagggacccctsaggtctacaggagcccagctccagtccagcagtgagggagaggcccctaccccctagcacggcaccagagttcagttccctcacatccctctgagaacag

SEQ ID NO: 22120 - DNA, 201 bp, Homo sapiens
cgcaggttgtccccggtctgcctgtccatatcgccccctttcccccaggtttccgcatgggccggaccgtggtcgtgctgggcggaggcatcagcggcttsgccgccagttaccacctgagccgggccccctgcccccctaaggtgagtgctccacttgtgccagagggagcttcatttaatgctcttcccatttccatca

SEQ ID NO: 22121 - DNA, 201 bp, Homo sapiens
gccctcttctcttcataccccaccccctcataattcccaaaactcattattgggagtgaaggccttcatttccatccgtcacagtgggaatgtcccccaayccaaaccctatcccaccctcattccctaccaaataggggctgtggaaatcagtcagtgtagattattttttcgctccttagtcctagtctcacccttaag

SEQ ID NO: 22122 - DNA, 201 bp, Homo sapiens
tctgcctgatgaacggctcaagaaactggagctgggacggggacggacctcaggccctcgtcccagaggcccccttcgagcagatcatggggttcccctgyctggctcaccacccccaacagtggctttgcctctcccatctcggaccaacttagcccgttccaagtctgtgagcagtggggacttgcgtccaatggggat

SEQ ID NO: 22123 - DNA, 201 bp, Homo sapiens
gatttgctgggggcaaggtgtctctgcgggattgtttcaaccttttcactaaggaagaagagctagagtcggagaatgccccagtatgtggaggttcacargggatacagtaagggtgggagacctggggggactccatgtggataaaagggattgcatgatgtcttcatatggggaataatatttatgtatctgggtttg

SEQ ID NO: 22124 - DNA, 201 bp, Homo sapiens
ctcttgtcgccaggtggtcctagtggagagcagtgagcgtctgggaggctggattcgctccgttcgaggccctaatggtgctatctttgagcttggacctyggggaattaggccagcgggagccctaggggcccggaccttgctcctggtgagaggcttgtgggatgtctaggagaggttgtggagggggcttccattggg

SEQ ID NO: 22125 - DNA, 201 bp, Homo sapiens
ggaggctggattcgctccgttcgaggccctaatggtgctatctttgagcttggacctcggggaattaggccagcgggagccctaggggcccggaccttgcycctggtgagaggcttgtgggatgtctaggagaggttgtggagggggcttccattggggaatagagtttaggggaggaagtatgtttggtgggtcagatct

SEQ ID NO: 22126 - DNA, 201 bp, Homo sapiens
gaggactgacaactgtaatgggaatgccttctgagtcaggcctctgcctgatctctagtgctcagtgagctgctccctgctgaggctgcccctctggctcrtgccctgagtgccatcactgcagtgtctgtagctgtggtgaatctgcagtaccaaggagcccatctgcctgtccaggtatgataaagggacggagaggct

SEQ ID NO: 22127 - DNA, 201 bp, Homo sapiens
gagtggccgggatagaactcaaaaccggcggggcttctggagcgcaggttgtccccggtctgcctgtccatatcgccccctttcccccaggtttccgcatvggccggaccgtggtcgtgctgggcggaggcatcagcggcttggccgccagttaccacctgagccgggccccctgcccccctaaggtgagtgctccacttg

SEQ ID NO: 22128 - DNA, 201 bp, Homo sapiens
  misc_feature (1)...(201): n = A,T,C or G, or insertion/deletion polymorphism (see Tables 1-2)
tgagtggccgggatagaactcaaaaccggcggggcttctggagcgcaggttgtccccggtctgcctgtccatatcgccccctttcccccaggtttccgcangggccggaccgtggtcgtgctgggcggaggcatcagcggcttggccgccagttaccacctgagccgggccccctgcccccctaaggtgagtgctccactt

SEQ ID NO: 22129 - DNA, 201 bp, Homo sapiens
aaagggctcctaggagctgcccttgcagtctaggaaggacgcagagagaggccattctgtcaaaagaataagagaagactgggagttgctgagaatcttadaatagtgactgagctaccccagcttctctcccacatcccccatgttaagaaaaaggtaggccaggtgcagtggctcacacctgcaatcctagcacttttg

SEQ ID NO: 22130 - DNA, 201 bp, Homo sapiens
gcttctggagcgcaggttgtccccggtctgcctgtccatatcgccccctttcccccaggtttccgcatgggccggaccgtggtcgtgctgggcggaggcaycagcggcttggccgccagttaccacctgagccgggccccctgcccccctaaggtgagtgctccacttgtgccagagggagcttcatttaatgctcttccc

SEQ ID NO: 22131 - DNA, 201 bp, Homo sapiens
tgctgggaggttcctggttacagacactggaggctagtggctgtgtcttatctcaggagctgtttcaacagcgggcccaggaagcagctgctacacaattmggactgaaggagatgccgagccactgcttggtccatctacacaaggtaagttgggataaacttccctcagctctccactgaaggccttgaagacagagac

SEQ ID NO: 22132 - DNA, 201 bp, Homo sapiens
gtatcatgggggatccagagtagagaaaagcaaggaagggattaaatgtttctgtacacacaaaaaaacaactattacttagtaggcaaaagaaaaaaaaagcccaggacagaagtcaaacagaaagaaggaaatggctgaagagaatataaaagctggatgtatccaaatcctcagggcccagtgccagtcaccctaggg

SEQ ID NO: 22133 - DNA, 201 bp, Homo sapiens
aaaataaaaattgctggagcttggcttggtctggctgttctatcacctataggcataagaatgcggggcagcaaagaggcaaagtgtgcctgggatgcagraagcaggagcagatgcgagacaaagtcctttattagaaaatatatcaaaatcccagccccctgagccaggaccagaagagggagctattccagcataggc

SEQ ID NO: 22134 - DNA, 201 bp, Homo sapiens
tgtctgtaggtggcacggagaaaagggggctaaagaataaaagtgaaggccgggcgcggtggcttacgcctgtaatcccagtactttgggaggccaaggcrggcagatcacaaggtcaggagattgagaccaccctggctaacacggtaaaaccccatctctactaaaaatacaaaaaattagctgggcatggtggtacac

SEQ ID NO: 22135 - DNA, 201 bp, Homo sapiens
ggtggcgtctctagccatggacagtctctgccgtggagtgtttgcaggcaacagccgtgagctcagcatcaggtcctgctttcccagtctcttccaagctkagcaaacccatcgttccatattactgggcctgctgctgggggcaggtgaggggggattgattcagagggtgaaaatattaagtactgccaaagtgaggga

SEQ ID NO: 22136 - DNA, 201 bp, Homo sapiens
tctccatggaagagggaggggcttggggtccagccctgctcctactctaggggcagggactcctaggaatcgtcacataaaatcatgacatcaaggattcrcagtcataagccctacaggagaccctagagagagggacccctcaggtctacaggagcccagctccagtccagcagtgagggagaggcccctaccccctag

SEQ ID NO: 22137 - DNA, 201 bp, Homo sapiens
gagcaggtttctgagcttggcttggattcagaagtgctgcctgtccggggagaccacccagctgcccagaacaggttcctctacgtgggcggtgccctgcmtgccctacccactggcctcaggtaacaccagcacctccgctccttttactgtgccctcatcctcatatgccttccatttctttcttcttttctttttttt

SEQ ID NO: 22138 - DNA, 201 bp, Homo sapiens
cccttctccaaacctctgttttgggctgggctgagggagctgaccaagccccggggcaaagagcctgatgagactgtgcacagttttgcccagcgccgccytggacctgaggtgacacttgcccagaggccccaaacctcttccctcctaaaccagctgcagagctccctgttcaaatctaccacctaggggctcttctgt

SEQ ID NO: 22139 - DNA, 201 bp, Homo sapiens
gcaggcaacagccgtgagctcagcatcaggtcctgctttcccagtctcttccaagctgagcaaacccatcgttccatattactgggcctgctgctgggggyaggtgaggggggattgattcagagggtgaaaatattaagtactgccaaagtgagggagtggggacaaggggtgctattcaatgattctttttttcttttt

SEQ ID NO: 22140 - DNA, 201 bp, Homo sapiens
agctagagccctttccttctgacgcatgaatgtccttctctccagggatttggacatttggtgccatcttcagaagatccaggagtcctgggaatcgtgtrtgactcagttgctttccctgagcaggacgggagcccccctggcctcagagtgactgtgaggaggaggaaactttgcctagtggcatttccagagggctcc

SEQ ID NO: 22141 - DNA, 201 bp, Homo sapiens
ggctagggagagaaagatccttgcataccccgagtcttctggggacacatccccaaccacaatccgcttggctctcctccttccacaggatagtaggcttycctgtttcccagtacccttccatgccctctacctgtatccaaacttgttcatagcaacggcaacatggcggggtccccgggggtcacacacatacagatt

SEQ ID NO: 22142 - DNA, 201 bp, Homo sapiens
tctccatgcagggggctactccgcccttcaccccccttctccaaacctctgttttgggctgggctgagggagctgaccaagccccggggcaaagagcctgwtgagactgtgcacagttttgcccagcgccgccttggacctgaggtgacacttgcccagaggccccaaacctcttccctcctaaaccagctgcagagctcc

SEQ ID NO: 22143 - DNA, 201 bp, Homo sapiens
acagtggctttgcctctcccatctcggaccaacttagcccgttccaagtctgtgagcagtggggacttgcgtccaatggggattgccttgggagggcaccrtggcaccggagagcttggggctgcactgagccgcttggccctccggcctgagccacccactttgagacgtagcacttctctccgccgcctagggggcttt

SEQ ID NO: 22144 - DNA, 201 bp, Homo sapiens
ttcaccccccttctccaaacctctgttttgggctgggctgagggagctgaccaagccccggggcaaagagcctgatgagactgtgcacagttttgcccagygccgccttggacctgaggtgacacttgcccagaggccccaaacctcttccctcctaaaccagctgcagagctccctgttcaaatctaccacctaggggct

SEQ ID NO: 22145 - DNA, 201 bp, Homo sapiens
ccaaaccctatcccaccctcattccctaccaaataggggctgtggaaatcagtcagtgtagattattttttcgctccttagtcctagtctcacccttaagvtggcgtctctagccatggacagtctctgccgtggagtgtttgcaggcaacagccgtgagctcagcatcaggtcctgctttcccagtctcttccaagctga

SEQ ID NO: 22146 - DNA, 201 bp, Homo sapiens
tcggggatggtgctggacccggacctgtgtcccccagcagtgaaggttatgtactgggaggaaaagaggaaaggcatacttgagtgaggctgcgtgcaggytctggggcgactggtttggtcggcgatgggggagtgccactgttgacaaacactgggtacgttgccgggcggccctagctcccgtaggcccggtctgttg

SEQ ID NO: 22147 - DNA, 201 bp, Homo sapiens; identical to SEQ ID NO: 2903

SEQ ID NO: 22148 - DNA, 201 bp, Homo sapiens
gattattttttcgctccttagtcctagtctcacccttaaggtggcgtctctagccatggacagtctctgccgtggagtgtttgcaggcaacagccgtgagstcagcatcaggtcctgctttcccagtctcttccaagctgagcaaacccatcgttccatattactgggcctgctgctgggggcaggtgaggggggattgat

SEQ ID NO: 22149 - DNA, 201 bp, Homo sapiens
ccaagagttcctgaagctcctcatggagcggctacaccttgaaatcaaccgccgaggccgccgggctccaccgatacttgccaatggtccagttccctctmcaccccgccgaggaggggctctgctagaagaacctgagttaaggtaagggtcgttccctctacctcctttccccgtagtttatcagcatcattcacactt

SEQ ID NO: 22150 - DNA, 201 bp, Homo sapiens
gtcagttgcccatactctttgtctggctgtagccagcaggatgcccaagagttcctgaagctcctcatggagcggctacaccttgaaatcaaccgccgagrccgccgggctccaccgatacttgccaatggtccagttccctctccaccccgccgaggaggggctctgctagaagaacctgagttaaggtaagggtcgttc

SEQ ID NO: 22151 - DNA, 201 bp, Homo sapiens
atgttgcctcaggcccttgaaacccacctgactagtaggggggtcagtgttctcagaggccagccggtctgtgggctcagcctccaggcagaagggcgctrgaaggtaggggaacccctggagtgtaatgaacctgtcagtgtttccatctttatccaagtggcttaactaggccagggccgataggactggagttcctca

SEQ ID NO: 22152 - DNA, 201 bp, Homo sapiens
tctcattttctgggtctctcaaatgttttcatgctctcaggtatctctaagggacagcagtctggaggctgaccacgttattagtgccattccagcttcargtaatggaatagccaccttccccttccccaacccctaccagtgagaagcaaaagctataccttcctgggtcagcaggaccacaccatgcccctgaactgg

SEQ ID NO: 22153 - DNA, 201 bp, Homo sapiens
tcatctctatgggagtctaatcccaaagaggactgacaactgtaatgggaatgccttctgagtcaggcctctgcctgatctctagtgctcagtgagctgcyccctgctgaggctgcccctctggctcgtgccctgagtgccatcactgcagtgtctgtagctgtggtgaatctgcagtaccaaggagcccatctgcctgtc

SEQ ID NO: 22154 - DNA, 201 bp, Homo sapiens
aggtcaaatctgagggttagaggttggagactaagacccagaaaggaacagccagaaatctagggacctttaggattttcctggctaggggtacagaaccstgaggatccagtaacaattcccaggcagtccttccttcttcctacctgtggggattttcctcattgcccttatctcctcggtgcttcaccatcttatagt

SEQ ID NO: 22155 - DNA, 201 bp, Homo sapiens
ccccacccccccaaaaaaatgggaaggagagacagcctcagctagagccctttccttctgacgcatgaatgtccttctctccagggatttggacatttggkgccatcttcagaagatccaggagtcctgggaatcgtgtatgactcagttgctttccctgagcaggacgggagcccccctggcctcagagtgactgtgagg

SEQ ID NO: 22156 - DNA, 201 bp, Homo sapiens
cctagtggcatttccagagggctcctctgtgctccattgtaggcaaggccagactgatcagtgctatattccctccttaggtgatgctgggaggttcctgrttacagacactggaggctagtggctgtgtcttatctcaggagctgtttcaacagcgggcccaggaagcagctgctacacaattaggactgaaggagatgc

SEQ ID NO: 22157 - DNA, 201 bp, Homo sapiens
gtggcatttccagagggctcctctgtgctccattgtaggcaaggccagactgatcagtgctatattccctccttaggtgatgctgggaggttcctggttayagacactggaggctagtggctgtgtcttatctcaggagctgtttcaacagcgggcccaggaagcagctgctacacaattaggactgaaggagatgccgag

SEQ ID NO: 22158 - DNA, 201 bp, Homo sapiens; identical to SEQ ID NO: 3104

SEQ ID NO: 22159 - DNA, 201 bp, Homo sapiens; identical to SEQ ID NO: 3105

SEQ ID NO: 22160 - DNA, 201 bp, Homo sapiens
attcttctttgcttcctctgcagggcggaccccacagccagactcagcactcattcgccaggccttggctgagcgctggagccagtggtcacttcgtggasgtctagagatgttgcctcaggcccttgaaacccacctgactagtaggggggtcagtgttctcagaggccagccggtctgtgggctcagcctccaggcaga

SEQ ID NO: 22161 - DNA, 201 bp, Homo sapiens; identical to SEQ ID NO: 3107

SEQ ID NO: 22162 - DNA, 201 bp, Homo sapiens
tcctctgcagggcggaccccacagccagactcagcactcattcgccaggccttggctgagcgctggagccagtggtcacttcgtggaggtctagagatgtygcctcaggcccttgaaacccacctgactagtaggggggtcagtgttctcagaggccagccggtctgtgggctcagcctccaggcagaagggcgctggaag

SEQ ID NO: 22163 - DNA, 201 bp, Homo sapiens
tgggaggaaaagaggaaaggcatacttgagtgaggctgcgtgcaggctctggggcgactggtttggtcggcgatgggggagtgccactgttgacaaacacygggtacgttgccgggcggccctagctcccgtaggcccggtctgttgctaacatcaaggagctgtttatggagccgcctccccgtggactggccttaagtg

SEQ ID NO: 22164 - DNA, 201 bp, Homo sapiens
ggaaatcagtcagtgtagattattttttcgctccttagtcctagtctcacccttaaggtggcgtctctagccatggacagtctctgccgtggagtgtttgyaggcaacagccgtgagctcagcatcaggtcctgctttcccagtctcttccaagctgagcaaacccatcgttccatattactgggcctgctgctgggggca

SEQ ID NO: 22165 - DNA, 201 bp, Homo sapiens
ccttaaggtggcgtctctagccatggacagtctctgccgtggagtgtttgcaggcaacagccgtgagctcagcatcaggtcctgctttcccagtctcttcyaagctgagcaaacccatcgttccatattactgggcctgctgctgggggcaggtgaggggggattgattcagagggtgaaaatattaagtactgccaaagt

SEQ ID NO: 22166 - DNA, 201 bp, Homo sapiens
agtctctgccgtggagtgtttgcaggcaacagccgtgagctcagcatcaggtcctgctttcccagtctcttccaagctgagcaaacccatcgttccatatkactgggcctgctgctgggggcaggtgaggggggattgattcagagggtgaaaatattaagtactgccaaagtgagggagtggggacaaggggtgctattc

SEQ ID NO: 22167 - DNA, 201 bp, Homo sapiens
gccactgcatccagcctcaatgattcttctttgcttcctctgcagggcggaccccacagccagactcagcactcattcgccaggccttggctgagcgctgragccagtggtcacttcgtggaggtctagagatgttgcctcaggcccttgaaacccacctgactagtaggggggtcagtgttctcagaggccagccggtct

SEQ ID NO: 22168 - DNA, 201 bp, Homo sapiens
ttacaggcgtgagccaccacgcccgacctgccttccatttcttcatctccctgtcagccttcccagcaaaaggaagccaaatgagtggaaatgaccccagygcctggagctggggaggtatgtcaggagcttccccctcactatgcctttctccatgcagggggctactccgcccttcaccccccttctccaaacctctgt

SEQ ID NO: 22169 - DNA, 201 bp, Homo sapiens
cacacacatacagattgtggtcattttctggcaagaggtccacatcgtgcaagaacaggcagtcccactcttcatcacgcagggcctctcgcaccccaacrttcaacagttttgccctgttaaatgttccatttccagcctggaagataatggaggggaaccagactatgtctgtaggtggcacggagaaaagggggctaa

SEQ ID NO: 22170 - DNA, 201 bp, Homo sapiens
agcccccagaccctctgcaatatcactttttgtgaataaatttattaagaaaaaatgatgtgcttatttgtatttttgcttagggggtgatagagaactgrgccaaattggagtcttcttgggacccaagttccctctctaacaggtgggggcgctctcagagccgagggggaaggtttcggggatggtgctggacccgga

SEQ ID NO: 22171 - DNA, 201 bp, Homo sapiens
cgggggcaggagggggttttgggggcagaaaggtgggagtggtgagcagctgggcaaccatgccggtgctgggggagttgccccaggagctgcaacgtcarctagctgagcagaggagtaagtgggcaacaggtgggacagccatggctgagtccgtggtacattcagctgtgatgggcttactgctcatgaccagtgagg

SEQ ID NO: 22172 - DNA, 201 bp, Homo sapiens
gttttattggtgaacgtgatccggggccttccaagtcccgccaatccagatgtaggagaggtagggttaggcgcgtgccgcgagaacagagtggacggagmgtaggagagaccgaaaaggctgggggtgggagtagcggatttgaagcacttgttggcctacagaggtgtggcaagcagagcacctcagaactcaggcgta

SEQ ID NO: 22173 - DNA, 201 bp, Homo sapiens
ccagagggagcttcatttaatgctcttcccatttccatcaaaagctagatggatcctggccctctgaatatgcctcttcccctcccctcctgacctctcgscggcggctacaggcggtgctgcagtgtctctccctcttgtcgccaggtggtcctagtggagagcagtgagcgtctgggaggctggattcgctccgttcga

SEQ ID NO: 22174 - DNA, 201 bp, Homo sapiens
tcacacctgtaatcccagcattttgggaggccgaggtgggcagataacaaggtcaggagttcgagaccagcctggccaacatggtgaaaccccatctctaygaaaaatacaaaaattagccaggtgtggtggcttgcacctgtaatctcagctactcgggaggctaaggcaggagaatcgcttgaacccaggaggtggagg

SEQ ID NO: 22175 - DNA, 201 bp, Homo sapiens
tagagccctttccttctgacgcatgaatgtccttctctccagggatttggacatttggtgccatcttcagaagatccaggagtcctgggaatcgtgtatgmctcagttgctttccctgagcaggacgggagcccccctggcctcagagtgactgtgaggaggaggaaactttgcctagtggcatttccagagggctcctct

SEQ ID NO: 22176 - DNA, 201 bp, Homo sapiens; identical to SEQ ID NO: 3069

SEQ ID NO: 22177 - DNA, 201 bp, Homo sapiens
tatgtcaggagcttccccctcactatgcctttctccatgcagggggctactccgcccttcaccccccttctccaaacctctgttttgggctgggctgaggkagctgaccaagccccggggcaaagagcctgatgagactgtgcacagttttgcccagcgccgccttggacctgaggtgacacttgcccagaggccccaaac

SEQ ID NO: 22178 - DNA, 201 bp, Homo sapiens
tgtgtctttttaatcggggaggggggagggggtggttgtagctccattattttttttattaaaaaatacccttccacctggaggctcccttgtctcccagycccatgtacaaagctcaccaagcccctgcccatgtacagcccccagaccctctgcaatatcactttttgtgaataaatttattaagaaaaaatgatgtgc

SEQ ID NO: 22179 - DNA, 201 bp, Homo sapiens
caaccatgccggtgctgggggagttgccccaggagctgcaacgtcagctagctgagcagaggagtaagtgggcaacaggtgggacagccatggctgagtcygtggtacattcagctgtgatgggcttactgctcatgaccagtgaggtagggagactagaatacctagtgaggggaatagggtagagtttggggatgaaac

SEQ ID NO: 22180 - DNA, 201 bp, Homo sapiens
cagtactttgggaggccaaggcaggcagatcacaaggtcaggagattgagaccaccctggctaacacggtaaaaccccatctctactaaaaatacaaaaarttagctgggcatggtggtacacgcctgtagtcccagctactcaggaggctgaggcaggagaatggcgtaaaacccgggaggtggagcttgcagtcagccg

SEQ ID NO: 22181 - DNA, 201 bp, Homo sapiens
cttttcactcatcaaattctcattttctgggtctctcaaatgttttcatgctctcaggtatctctaagggacagcagtctggaggctgaccacgttattaktgccattccagcttcaggtaatggaatagccaccttccccttccccaacccctaccagtgagaagcaaaagctataccttcctgggtcagcaggaccaca

SEQ ID NO: 22182 - DNA, 201 bp, Homo sapiens
tctcttttcactcatcaaattctcattttctgggtctctcaaatgttttcatgctctcaggtatctctaagggacagcagtctggaggctgaccacgttawtagtgccattccagcttcaggtaatggaatagccaccttccccttccccaacccctaccagtgagaagcaaaagctataccttcctgggtcagcaggacc

SEQ ID NO: 22183 - DNA, 201 bp, Homo sapiens
ctctggcacctgtgaagccctttaaacacccttaagccccaggctccccgtttacctcagagacgtctatttttgtgtctttttaatcggggaggggggarggggtggttgtagctccattattttttttattaaaaaatacccttccacctggaggctcccttgtctcccagccccatgtacaaagctcaccaagcccct

SEQ ID NO: 22184 - DNA, 201 bp, Homo sapiens
cccttcaccccccttctccaaacctctgttttgggctgggctgagggagctgaccaagccccggggcaaagagcctgatgagactgtgcacagttttgccyagcgccgccttggacctgaggtgacacttgcccagaggccccaaacctcttccctcctaaaccagctgcagagctccctgttcaaatctaccacctaggg

SEQ ID NO: 22185 - DNA, 201 bp, Homo sapiens
ctagtgtctcccctgtcagtgaaaaccaggtggcatccagcgagggctacgtgctgttctaccaactgatgcaggagccaccccggtgcctgtgacacctytaagctctggcacctgtgaagccctttaaacacccttaagccccaggctccccgtttacctcagagacgtctatttttgtgtctttttaatcggggaggg

SEQ ID NO: 22186 - DNA, 201 bp, Homo sapiens
ggagctggggaggtatgtcaggagcttccccctcactatgcctttctccatgcagggggctactccgcccttcaccccccttctccaaacctctgttttgrgctgggctgagggagctgaccaagccccggggcaaagagcctgatgagactgtgcacagttttgcccagcgccgccttggacctgaggtgacacttgccc

SEQ ID NO: 22187 - DNA, 201 bp, Homo sapiens
gaatgaccacaaccctttcccgatctccttttttcctagtgtctcccctgtcagtgaaaaccaggtggcatccagcgagggctacgtgctgttctaccaaytgatgcaggagccaccccggtgcctgtgacacctctaagctctggcacctgtgaagccctttaaacacccttaagccccaggctccccgtttacctcaga

SEQ ID NO: 22188 - DNA, 201 bp, Homo sapiens
cttcatgtgcctgggtgccaactcctcaggtgcagggaccgtgaccacctgggggctgtaagcgaacagccccggagctcggcggagagtagggtgggggwggcgtcctctaccttttctacctttcccctcttctagcgggggtggggaggagggttactgctgaagagaaagggagagggagagcaggggcagagacag

SEQ ID NO: 22189 - DNA, 201 bp, Homo sapiens
tgaggttcggtcttgtagggagaagggagtaaacaggaatgaccacaaccctttcccgatctccttttttcctagtgtctcccctgtcagtgaaaaccagktggcatccagcgagggctacgtgctgttctaccaactgatgcaggagccaccccggtgcctgtgacacctctaagctctggcacctgtgaagccctttaa

SEQ ID NO: 22190 - DNA, 201 bp, Homo sapiens
ccctcactatgcctttctccatgcagggggctactccgcccttcaccccccttctccaaacctctgttttgggctgggctgagggagctgaccaagccccsgggcaaagagcctgatgagactgtgcacagttttgcccagcgccgccttggacctgaggtgacacttgcccagaggccccaaacctcttccctcctaaac

SEQ ID NO: 22191 - DNA, 201 bp, Homo sapiens
agcggggctcacaacctgcagggcggtaccggccccctggttctacccggggattccgctccacaatctctgccagtgatggcactgggctaaaggacacygacacaggacccactgttgggaaggaatggcaagtagagggatcagaggggcaaagagaaaagaatcaaactagggtttgggaatacctctgacactggc

SEQ ID NO: 22192 - DNA, 201 bp, Homo sapiens
ctttgcttcctctgcagggcggaccccacagccagactcagcactcattcgccaggccttggctgagcgctggagccagtggtcacttcgtggaggtctaragatgttgcctcaggcccttgaaacccacctgactagtaggggggtcagtgttctcagaggccagccggtctgtgggctcagcctccaggcagaagggcg

SEQ ID NO: 22193 - DNA, 201 bp, Homo sapiens
gagccctttccttctgacgcatgaatgtccttctctccagggatttggacatttggtgccatcttcagaagatccaggagtcctgggaatcgtgtatgacycagttgctttccctgagcaggacgggagcccccctggcctcagagtgactgtgaggaggaggaaactttgcctagtggcatttccagagggctcctctgt

SEQ ID NO: 22194 - DNA, 201 bp, Homo sapiens
agtgagactctgtcccccccacccccccaaaaaaatgggaaggagagacagcctcagctagagccctttccttctgacgcatgaatgtccttctctccagsgatttggacatttggtgccatcttcagaagatccaggagtcctgggaatcgtgtatgactcagttgctttccctgagcaggacgggagcccccctggcct

SEQ ID NO: 22195 - DNA, 201 bp, Homo sapiens
tttttttttttttttttgagacggagtatcgctctcgcccaggatggagtgcaatggcgcgatcttggctcactgcaacttccgcctttcgggttcaagcrattctcctgcctcagcctcccgagtagctgggactacaggtgcctaccaccacgtctggctagtttttgtatttttagtagagatggggtttcaccatat

SEQ ID NO: 22196 - DNA, 201 bp, Homo sapiens
ggaaggaatggcaagtagagggatcagaggggcaaagagaaaagaatcaaactagggtttgggaatacctctgacactggcagtctggttctggggcttarttctcagggctcactcagaaatctcgcatgccttggattacctatcactgggacagctctacaaaggctggaaggtgcaggatccttacctagccttctc

SEQ ID NO: 22197 - DNA, 201 bp, Homo sapiens
tcttttctttttttttttttttttttttttttttgagacggagtatcgctctcgcccaggatggagtgcaatggcgcgatcttggctcactgcaacttccrcctttcgggttcaagcgattctcctgcctcagcctcccgagtagctgggactacaggtgcctaccaccacgtctggctagtttttgtatttttagtagag

SEQ ID NO: 22198 - DNA, 201 bp, Homo sapiens
cgctggagccagtggtcacttcgtggaggtctagagatgttgcctcaggcccttgaaacccacctgactagtaggggggtcagtgttctcagaggccagcsggtctgtgggctcagcctccaggcagaagggcgctggaaggtaggggaacccctggagtgtaatgaacctgtcagtgtttccatctttatccaagtggct

SEQ ID NO: 22199 - DNA, 201 bp, Homo sapiens
ataccccaccccctcataattcccaaaactcattattgggagtgaaggccttcatttccatccgtcacagtgggaatgtcccccaacccaaaccctatccyaccctcattccctaccaaataggggctgtggaaatcagtcagtgtagattattttttcgctccttagtcctagtctcacccttaaggtggcgtctctagc

SEQ ID NO: 22200 - DNA, 201 bp, Homo sapiens
gacacaatgggcagtagcatgcaagcctgacctgggtatcctaaaaagactaagggaaaggaatgggctcagtgcaggaccagggagctaaaggttagtgytgaagggctatggtcaaaggtggtcttagaggacagggatccagactggggtcaggagggaggaagtggcaggaagtctgacctggtagcaatgtcgtca

SEQ ID NO: 22201 - DNA, 201 bp, Homo sapiens
cggggcttctggagcgcaggttgtccccggtctgcctgtccatatcgccccctttcccccaggtttccgcatgggccggaccgtggtcgtgctgggcggargcatcagcggcttggccgccagttaccacctgagccgggccccctgcccccctaaggtgagtgctccacttgtgccagagggagcttcatttaatgctct

SEQ ID NO: 22202 - DNA, 201 bp, Homo sapiens
atactatttcctattgatcttatgtcctctcccaagaacaaactaaccaggagactgaaggatgacacaatgggcagtagcatgcaagcctgacctgggtrtcctaaaaagactaagggaaaggaatgggctcagtgcaggaccagggagctaaaggttagtgttgaagggctatggtcaaaggtggtcttagaggacagg

SEQ ID NO: 22203 - DNA, 201 bp, Homo sapiens
acgcccgacctgccttccatttcttcatctccctgtcagccttcccagcaaaaggaagccaaatgagtggaaatgaccccagcgcctggagctggggaggyatgtcaggagcttccccctcactatgcctttctccatgcagggggctactccgcccttcaccccccttctccaaacctctgttttgggctgggctgaggg

SEQ ID NO: 22204 - DNA, 201 bp, Homo sapiens
gctccatatcctaatcttcagattcttacttctcttaggatacctcccatacattctctttcctccatgtttccagagaattgaattttccttaggaaaaktctgccacccacttttccacaagatgctcccagtgtgtcgggagtggggagaggacagctttcaggatagaagaagttcccctcagaggcccactgcctc

SEQ ID NO: 22205 - DNA, 201 bp, Homo sapiens; identical to SEQ ID NO: 3111

SEQ ID NO: 22206 - DNA, 201 bp, Homo sapiens; identical to SEQ ID NO: 3113

SEQ ID NO: 22207 - DNA, 201 bp, Homo sapiens
caaggggcccctgcacccaagggaccctgtccctcggtggcctccccaggcccctggacacgacagttctcctcaggcaggtgggctttgtggtcctcgcygcccctggccacatcgccctctcctcttacacctggtgaccttcgaatgtttcagagcgcagggccgttctccctcgtgtcctctggacccacccgcccc

SEQ ID NO: 22208 - DNA, 201 bp, Homo sapiens
tccctgcgggacctcgggaagggggaagagcgtcaacaatttacggagggtccagccgctgggtcagattgagacaaaccattgtgtggttgggtttgggycagcaggctggagagggttctgttctttttgatcattatcgtttggggccccaagggagggtcttgggagccacctgagccccaaagctgggaaattcct

SEQ ID NO: 22209 - DNA, 201 bp, Homo sapiens; identical to SEQ ID NO: 3167

SEQ ID NO: 22210 - DNA, 201 bp, Homo sapiens
ctgccaccttccattatctgctaataatgagaaccagggaacttggctgctccacaaggaggtctataaatccttcaaaagagggcttgggaccacttgcraggatcgtgctcaggaactgacagagctaggcagtgagtcacgagcttggggccccgctctcctcatttgtcaaacagggatctgatggatacgcacaga

SEQ ID NO: 22211 - DNA, 201 bp, Homo sapiens
ttctctcctcagagcgcctgtcactccatccccggcagggagggaccgtcagctcacaaggccctctttgtttcctgctcccagacataagcccaaggggyccctgcacccaagggaccctgtccctcggtggcctccccaggcccctggacacgacagttctcctcaggcaggtgggctttgtggtcctcgccgcccctg

SEQ ID NO: 22212 - DNA, 201 bp, Homo sapiens
atctaggcacatctggttactgctcccaagtcacaggaaaggtcaacaagcacctctgcccccgacacgctccaaccgaggctctcacctggttcccatcrtccttatcaggaaactggatgttcacgtcatgctccaaccggatttgggtaattactgccccctttctcccgataatcttgggatggtatttggggtcta

SEQ ID NO: 22213 - DNA, 201 bp, Homo sapiens
catagagaaggaaacgtggtaacaaaacacctgtagcccacaatcggcgaaaacaacatgtccacaacacaaaaaccaccatgcaacaggactagaggacrgggacaaatcacaaccatcacgcaacaggactagaggacagggacaaatcacaacacggaaccatcatcacgcaacaggactagaggacagggacaaatg

SEQ ID NO: 22214 - DNA, 201 bp, Homo sapiens
ctctcttctgctgtgtctggccacttaaaagtttattccattcatttgagggattttttttccaatggctatatttttaacttgcaatatttggttttttkttttttttattttcctacaaagttgaccctggtaatagttttcatggagtgcaacatgtaactttatattagaaaatggaatgtcacatctttaccatgg

SEQ ID NO: 22215 - DNA, 201 bp, Homo sapiens
acacacacaaaaagaatatgtggttttaatgtgctttgatgagtactgccaaacttactccacagaaaaggcctctttctgaacatcctcgcctgcgttcyatttcacccaccgtgatgcctggcctgagggcggcgtgcttgcttgtagcatttcttgaggatttgctacttgttcacctgcctcttaggagcactgtgc

SEQ ID NO: 22216 - DNA, 201 bp, Homo sapiens
ggaggaagaaggggaaggggaaggggaagcagcggaaaaccctgggcggcacatccacagtgggagcgaggggcgtggaggggctctgctgccagggggtytgctgtttctggaaaccagcacaactgtggccaccaaggcttgctagtctcccactgtgggcaaagctgtgctggacacgcctaggaagcagacacccca

SEQ ID NO: 22217 - DNA, 201 bp, Homo sapiens; identical to SEQ ID NO: 3168

SEQ ID NO: 22218 - DNA, 201 bp, Homo sapiens
gagggagggctctgctggacagggacagtctctgagcaggtgaactgctgatctcacagaggtcagcaatcggcggattttcaccgtgtaagtagactgawgtcatccgtagaagcacagacgtactggactgtcacatctactagaaaataaagcatctgccacctggggggtggggagggtccagtttagcccaatggg

SEQ ID NO: 22219 - DNA, 201 bp, Homo sapiens; identical to SEQ ID NO: 3169

SEQ ID NO: 22220 - DNA, 201 bp, Homo sapiens
ggctctgctggacagggacagtctctgagcaggtgaactgctgatctcacagaggtcagcaatcggcggattttcaccgtgtaagtagactgaagtcatcygtagaagcacagacgtactggactgtcacatctactagaaaataaagcatctgccacctggggggtggggagggtccagtttagcccaatgggggacaac

SEQ ID NO: 22221 - DNA, 201 bp, Homo sapiens
ctttgatgagtactgccaaacttactccacagaaaaggcctctttctgaacatcctcgcctgcgttctatttcacccaccgtgatgcctggcctgagggcrgcgtgcttgcttgtagcatttcttgaggatttgctacttgttcacctgcctcttaggagcactgtgccctgcctccatggaagggctcttccggcaggga

SEQ ID NO: 22222 - DNA, 201 bp, Homo sapiens
tttccacgctggatcataatgtgacgtgcagttctgccctgtgctggggagccacatgaagcttcccctggctaacttgctaccccgcagcaatcccagtktggccgtctgcttgctaaaaaatggatctgtgctcatctgtattgatgtccttggagttctacaagtggaacttaagtgtcaaaaagaatatgtggtttt

SEQ ID NO: 22223 - DNA, 201 bp, Homo sapiens
ctcccatccatggcatgaggccccgaccctgtgctttgcctaattcgagcacgtggtgaggggtcggtgccgtcacttcctgctgtgtcatcttggtcaartcagagctcttctctgcacctgcgttttccctgcctggcctcatccctgggttgtggtgtggacattgtgggtgtctccacaggagccccagggccacga

SEQ ID NO: 22224 - DNA, 201 bp, Homo sapiens
cctcaggcaggtgggctttgtggtcctcgccgcccctggccacatcgccctctcctcttacacctggtgaccttcgaatgtttcagagcgcagggccgttytccctcgtgtcctctggacccacccgccccttcctgccctgtttgcgcagggacatcacccacatgccccagctctcggaccctgcagctctgtgtccca

SEQ ID NO: 22225 - DNA, 201 bp, Homo sapiens
accccgcctctactaaaaatacaatattagccgggcgtggtggtgcacgcctgtaatcccagctactcccggggctgaggcacgagaattgcttgaacccrggaggcggaggttgctgtgagccgagattgcgccactgcactccagcctgggcaacagagcaaaactccatctcaaaaaaaaaaaaacaaaaaaaaaaca

SEQ ID NO: 22226 - DNA, 201 bp, Homo sapiens
ccacagcaaaggtctgttgaacccctccctccattcccagttatctgggtcctctggattcttctgtttcttgaatcaggctctgctttccccctagccastacaggcagcctctgacagtgccgctttacttgcattctgcagcaattacatgtgtccttttgatccttgcccaacttccctccctctcccagctcctgg

SEQ ID NO: 22227 - DNA, 201 bp, Homo sapiens
ttctcctcaggcaggtgggctttgtggtcctcgccgcccctggccacatcgccctctcctcttacacctggtgaccttcgaatgtttcagagcgcagggcygttctccctcgtgtcctctggacccacccgccccttcctgccctgtttgcgcagggacatcacccacatgccccagctctcggaccctgcagctctgtgt

SEQ ID NO: 22228 - DNA, 201 bp, Homo sapiens
cacatctttaccatgggacagagacacaggaagatgtcaaagtctgaaatagcaagtgaagctgaatgtagcttatgatagggagggagggctctgctggrcagggacagtctctgagcaggtgaactgctgatctcacagaggtcagcaatcggcggattttcaccgtgtaagtagactgaagtcatccgtagaagcaca

SEQ ID NO: 22229 - DNA, 201 bp, Homo sapiens; identical to SEQ ID NO: 3165

SEQ ID NO: 22230 - DNA, 201 bp, Homo sapiens
ttttcctcttccctcaggcagcggctgtgtgaaccgctggctgctgttgtgcctcatctctgggcacattgcctgcttccccccagcgccggcttctctcytcagagcgcctgtcactccatccccggcagggagggaccgtcagctcacaaggccctctttgtttcctgctcccagacataagcccaaggggcccctgca

SEQ ID NO: 22231 - DNA, 201 bp, Homo sapiens
ctgcagctctgtgtcccaggccacagcaaaggtctgttgaacccctccctccattcccagttatctgggtcctctggattcttctgtttcttgaatcaggstctgctttccccctagccactacaggcagcctctgacagtgccgctttacttgcattctgcagcaattacatgtgtccttttgatccttgcccaacttcc

SEQ ID NO: 22232 - DNA, 201 bp, Homo sapiens
ggcagccacagcccctgaacacccatggccaaaggctacaggtatgacctggctgcaggagacaacccagagtccacgcaggggtacactgacaccatgtraggttcacgagctccaccccattcaccagactcaacgtgctcacgggaggagtggaaagccaacccccttagcaaaccagcaccccagcacagtctgctc

SEQ ID NO: 22233 - DNA, 201 bp, Homo sapiens
ccaggcctggaggagcggccgcacacacagccaggcgctaggctccctgcgggacctcgggaagggggaagagcgtcaacaatttacggagggtccagccrctgggtcagattgagacaaaccattgtgtggttgggtttgggtcagcaggctggagagggttctgttctttttgatcattatcgtttggggccccaaggg

SEQ ID NO: 22234 - DNA, 201 bp, Homo sapiens
gggcaactgctgactgtctggcagccagaggacagggacaggcagccaccctcttgccatgaccacacctgggtctccctcaatgtggctcccgaggggcygttgaacacagtgttgagaactgctgagaaaatcacaccaaagacgaactacccacagatgccagtcaccactccagggtgacgagaaagagaacacaca

SEQ ID NO: 22235 - DNA, 201 bp, Homo sapiens
ttgctacttgttcacctgcctcttaggagcactgtgccctgcctccatggaagggctcttccggcagggatgcaggctcacagcgccctggggctggacascaccggccggagcatggcggacagcacacacggcccggggcgggaaccttggaaactttacacagatggggagctcagccattccacgtgtgctttcgct

SEQ ID NO: 22236 - DNA, 201 bp, Homo sapiens
tgagcgggcacggccaggcctggaggagcggccgcacacacagccaggcgctaggctccctgcgggacctcgggaagggggaagagcgtcaacaatttacrgagggtccagccgctgggtcagattgagacaaaccattgtgtggttgggtttgggtcagcaggctggagagggttctgttctttttgatcattatcgttt

SEQ ID NO: 22237 - DNA, 201 bp, Homo sapiens
cagagtctgtggagatcaaagtgaagcgggagtactacctggctaagcaggcactggctgagaatgaggtgaactgtacagcccagtctcggccctccccscagccctctccctatccttgtcagtggctgctctacctccggacactgagtcacatccctcttcctcttgctgcccttttttggggacaggttctttttg

SEQ ID NO: 22238 - DNA, 201 bp, Homo sapiens
gctacaggtatgacctggctgcaggagacaacccagagtccacgcaggggtacactgacaccatgtgaggttcacgagctccaccccattcaccagactcracgtgctcacgggaggagtggaaagccaacccccttagcaaaccagcaccccagcacagtctgctccaagttccagaacccctgctcctgtctgcagcac

SEQ ID NO: 22239 - DNA, 201 bp, Homo sapiens
tttcccatccagagtagccaccaccttagccaccaagcagagatggaactggggactttgcatttggcgtctgccgtgggacattgcgcgagctccatccrtgccgagcatccatctcagcccctcctggctgctgggctgcttcgtgtttggcttagggtcattttgcagttgtgtgctttactgtgggttgcatattta

SEQ ID NO: 22240 - DNA, 201 bp, Homo sapiens
cagccgctgggtcagattgagacaaaccattgtgtggttgggtttgggtcagcaggctggagagggttctgttctttttgatcattatcgtttggggcccmaagggagggtcttgggagccacctgagccccaaagctgggaaattcctcagagctgctcatgtcaggagcctgtgcagagagaggacacggcttcaggag

SEQ ID NO: 22241 - DNA, 201 bp, Homo sapiens; identical to SEQ ID NO: 3166

SEQ ID NO: 22242 - DNA, 201 bp, Homo sapiens
ccaccagttaaaggtattgtcagagtatcctgtttgggaagaattcccatttcaggcaccctcgatgaagagccaggccaggaacatgggatgagagagcraaatggtggaaaaaggggagataggctaattccagaggcacctgcccagccaacactcagccctggctgcgcgcactgagtcctgtgtctgctgcaggta

SEQ ID NO: 22243 - DNA, 201 bp, Homo sapiens
attgcgcgagctccatccatgccgagcatccatctcagcccctcctggctgctgggctgcttcgtgtttggcttagggtcattttgcagttgtgtgctttrctgtgggttgcatatttagggcccaacagaactgctgggtcagggataaacatgttcggcatttttttttttttgagatggagtctcgctctgtcaccca

SEQ ID NO: 22244 - DNA, 201 bp, Homo sapiens
ccctcaatgagggctgcagggcaactgctgactgtctggcagccagaggacagggacaggcagccaccctcttgccatgaccacacctgggtctccctcartgtggctcccgaggggccgttgaacacagtgttgagaactgctgagaaaatcacaccaaagacgaactacccacagatgccagtcaccactccagggtga

SEQ ID NO: 22245 - DNA, 201 bp, Homo sapiens
gctctacctccggacactgagtcacatccctcttcctcttgctgcccttttttggggacaggttctttttggaacgaacggaacaaaggatgagcagcccragggctcagaggcaagtctgggagcagccaggcccctgccccgtgcactccctgaggtcacagggccctgcccagccgcccactgtgcctcgtggccatg

SEQ ID NO: 22246 - DNA, 201 bp, Homo sapiens
tctctcttctgctgtgtctggccacttaaaagtttattccattcatttgagggattttttttccaatggctatatttttaacttgcaatatttggtttttkgttttttttattttcctacaaagttgaccctggtaatagttttcatggagtgcaacatgtaactttatattagaaaatggaatgtcacatctttaccatg

SEQ ID NO: 22247 - DNA, 201 bp, Homo sapiens; identical to SEQ ID NO: 3163

SEQ ID NO: 22248 - DNA, 201 bp, Homo sapiens
ctggattcttctgtttcttgaatcaggctctgctttccccctagccactacaggcagcctctgacagtgccgctttacttgcattctgcagcaattacatrtgtccttttgatccttgcccaacttccctccctctcccagctcctggcccctggcccagggcccctcttgctgtttttacctctgttccttggggcctag

SEQ ID NO: 22249 - DNA, 201 bp, Homo sapiens; identical to SEQ ID NO: 3164

SEQ ID NO: 22250 - DNA, 201 bp, Homo sapiens
atgtttcagagcgcagggccgttctccctcgtgtcctctggacccacccgccccttcctgccctgtttgcgcagggacatcacccacatgccccagctctyggaccctgcagctctgtgtcccaggccacagcaaaggtctgttgaacccctccctccattcccagttatctgggtcctctggattcttctgtttcttgaa

SEQ ID NO: 22251 - DNA, 201 bp, Homo sapiens
aggctccctgcgggacctcgggaagggggaagagcgtcaacaatttacggagggtccagccgctgggtcagattgagacaaaccattgtgtggttgggttygggtcagcaggctggagagggttctgttctttttgatcattatcgtttggggccccaagggagggtcttgggagccacctgagccccaaagctgggaaat

SEQ ID NO: 22252 - DNA, 201 bp, Homo sapiens
cagagactcacgtattcctcctccagattgaggatgtggtcgatggcttcctccacattctctgggagccccgtcacagtgacgcagttggggtctggggstccgctctgtgggaagcgaatgtccacctggaaggggtgtacaacgtcagatgaggggactccaagcgaggaaaagggttaaaattatgtgtcaatttct

SEQ ID NO: 22253 - DNA, 201 bp, Homo sapiens
ccaagggaccctgtccctcggtggcctccccaggcccctggacacgacagttctcctcaggcaggtgggctttgtggtcctcgccgcccctggccacatcrccctctcctcttacacctggtgaccttcgaatgtttcagagcgcagggccgttctccctcgtgtcctctggacccacccgccccttcctgccctgtttgc

SEQ ID NO: 22254 - DNA, 201 bp, Homo sapiens
tattcccagacctactggaatcttcttgccatccgcctggccttcgtcattgtgtttgaggtagccgaggcacctgctggttctcccatccatggcatgasgccccgaccctgtgctttgcctaattcgagcacgtggtgaggggtcggtgccgtcacttcctgctgtgtcatcttggtcaaatcagagctcttctctgca

SEQ ID NO: 22255 - DNA, 201 bp, Homo sapiens
cccactgtgcctcgtggccatggcctgctcctggccctagtctgacttgtccctgcccccaaccctctccccagctcagctcccactggacacccttcacrgttcccaaggccagccagctgcagcagtgacgcctggaaggacatctggtggtccttaggggagtggcccctcctgagccctgcgagcagcgtccttttc

SEQ ID NO: 22256 - DNA, 201 bp, Homo sapiens
ccaggcgctaggctccctgcgggacctcgggaagggggaagagcgtcaacaatttacggagggtccagccgctgggtcagattgagacaaaccattgtgtrgttgggtttgggtcagcaggctggagagggttctgttctttttgatcattatcgtttggggccccaagggagggtcttgggagccacctgagccccaaag

SEQ ID NO: 22257 - DNA, 201 bp, Homo sapiens
tgatttggttttgagagaaactgcaaatttacacggaagtccaactttgtcacttttttatgaaaaagagaaaggtgccatgctcttggctagttccacakcaagacccctggatgctgactgcgtcctggcactgcctgcatctcacctccagccagatgtcgctgggatgctgggatcctgaagaacttccctagattc

SEQ ID NO: 22258 - DNA, 201 bp, Homo sapiens
gtgtctttatagcagcatgatttataatcctttgggtatatacccagtaatgggatggctggatcaaatggtatttctagttctagatccctaaggaatcrccacactgacttccacaatggttgaactagtttacagttccaccaacagtgtcaaagcgttcctatttctccacatcctctccagcacctgttgtttcct

SEQ ID NO: 22259 - DNA, 201 bp, Homo sapiens
tagcagcatgatttataatcctttgggtatatacccagtaatgggatggctggatcaaatggtatttctagttctagatccctaaggaatcaccacactgwcttccacaatggttgaactagtttacagttccaccaacagtgtcaaagcgttcctatttctccacatcctctccagcacctgttgtttcctgacttttta

SEQ ID NO: 22260 - DNA, 201 bp, Homo sapiens
ctatttttcctctaagattgcaacagagactatcacaaggcatttggcaacctgagaagccctggatggccagataactacgacaatgacaaggattgcaycgttactctcacagccccccagaaccacaccatttccctcttttttcattcacttggcatcgagaactcagttgaatgcagaaacgatttcttggaggtg

SEQ ID NO: 22261 - DNA, 201 bp, Homo sapiens
tttcttggaggtgatatgcatttgaatatcgtttgaatgaattatttaaaagatggtggatcacttaagattttacaccttttatctagtgctgctaataytatatgattcttatttgtttcattaatttattcattaccctttcattccctaaacatctacagagcaccagtccaaacaccggaaattgggaaccttagg

SEQ ID NO: 22262 - DNA, 201 bp, Homo sapiens
gtttcttggtagcttcagcctttgttcccaacaaaacatcttctgcttcttagcaccaagggctttctttctttcttttctttcttcttctttcttttctsccctgcaacccccctcatccgatttggctcctagggctgctggcaccttctgcccagcctggccaggaagggtgttctggcatatggtctttgcatatgg

SEQ ID NO: 22263 - DNA, 201 bp, Homo sapiens
tttcttggtagcttcagcctttgttcccaacaaaacatcttctgcttcttagcaccaagggctttctttctttcttttctttcttcttctttcttttctgscctgcaacccccctcatccgatttggctcctagggctgctggcaccttctgcccagcctggccaggaagggtgttctggcatatggtctttgcatatggg

SEQ ID NO: 22264 - DNA, 201 bp, Homo sapiens
cctctttgttctgaagacgtgattcttgttgtttccctgctcactttgttttgttttgtttgtttttgtttgtttgtttttgagacagagtcttgctcttsacacccaggctggagtgcaattgctgcaacctctgcatcctgggtacaagcaattctcctacctcagcctcccgagtagctgggattacaggcacctgac

SEQ ID NO: 22265 - DNA, 201 bp, Homo sapiens
tagcttcagcctttgttcccaacaaaacatcttctgcttcttagcaccaagggctttctttctttcttttctttcttcttctttcttttctgccctgcaayccccctcatccgatttggctcctagggctgctggcaccttctgcccagcctggccaggaagggtgttctggcatatggtctttgcatatgggtttagctt

SEQ ID NO: 22266 - DNA, 201 bp, Homo sapiens
ctctttgttctgaagacgtgattcttgttgtttccctgctcactttgttttgttttgtttgtttttgtttgtttgtttttgagacagagtcttgctcttgwcacccaggctggagtgcaattgctgcaacctctgcatcctgggtacaagcaattctcctacctcagcctcccgagtagctgggattacaggcacctgaca

SEQ ID NO: 22267 - DNA, 201 bp, Homo sapiens
gaaagatggaataatcccgttaggttggagtcacagtgcaactaactcttaactcactccagcttgaatggaccattattgatcagagtcaacgtttgccrtttgcctgatagatgctgggaagcaaagccttgctttccagccgtggagagtgagaattcctcctcctagctgtccttcattactccacagaatggatct

SEQ ID NO: 22268 - DNA, 201 bp, Homo sapiens
ggtgggaagatcgcttgaacctgggaggcagatgttgcagtgagccgagatcgcaccactgcactccgcctgggcacaagaccctgtctcaaaacaaaacraaacaaaacaaaacaaaaaggtgcataaaaatgcagcatcttcatataactctacttatcagaatgtaagaatataacatgcaggaacaatggtgcagga

SEQ ID NO: 22269 - DNA, 201 bp, Homo sapiens
caagttgtcagcagtgtcagtggaaattagtatcctgctgctcctctcagagcaacggcattttgaaagaggaccctgagggaaaaacgcccaaactcaaragcgtggtgctggctatggcagccctcccatctactagtggatgactggctactctgtcatggcaaggttactttgtttaaacacttagcagaataatcc

SEQ ID NO: 22270 - DNA, 201 bp, Homo sapiens
gattgcaccactgcactccagcctgggtgacagagcaagactctgtctcaaaaataaataaataaataaataaataaataaataaataaataaataaatargaggatcctccttttatagatgaaataatgaaaagtaggtgaagctaaacattttttgttaacacttcttagcttgtaattgtaatagttgaatttcaaa

SEQ ID NO: 22271 - DNA, 201 bp, Homo sapiens
agccagtttctttgggaatgttctttcctaattttgattaggaaggatggatctccttttctagctattgtacactattagattcgtgggaaatgtagcakttttcaagtcagagaagcaatggtgtgtgcctgttggctgagttaaatcaagtgtagccactcatggcaaaccactgtttagggaaaagtttgaggaaag

SEQ ID NO: 22272 - DNA, 201 bp, Homo sapiens
tttccttccttccatttagttttcatgaattctatttcctggcattgaaaacattcttttgaaaaaaaaatattcttaggtgagaaacttgtaatactttyattaccaattcgcaagaaaattcatcttgtttttttcttgattattgtgatttcatatcttctcactcataatggacataatatggtagaaaatatatac

SEQ ID NO: 22273 - DNA, 201 bp, Homo sapiens
tggcaaaccactgtttagggaaaagtttgaggaaaggaattagaggaagtaatacagtagacaggtttttcagactgaatcagagagtgctggaaaggaartactgaaagacaaccctagaccaaatcttaggtctgcaggtggtccactgtgtaagtgtgcacgtgtgtacttgtgtgtgttttaatgtcaatttaaaag

SEQ ID NO: 22274 - DNA, 201 bp, Homo sapiens
agcagttttcaagtgtataatacaatattgttaatgatagtcaccatgctgtacattagatctctagaagctattcattccagagaacataaacgttttascctttgaccaacatttccctattgcccccacctctcagctcctggccaccaccattctactttctgcttctatgagtttaactttttttagatttcacat

SEQ ID NO: 22275 - DNA, 201 bp, Homo sapiens
acaaacaaaaattgtatatttatggtgtacaacatgttttgacatatgtacatgttgtagagtggctaaatccagttaattaacatgtctgctcactcacwtacttagcactttttgtggggagagcatttaaaacctctcttagcaatttttaagtattcggcaagtaatcaagtatttcaggtattcaaccttgttatt

SEQ ID NO: 22276 - DNA, 201 bp, Homo sapiens
agcatgctaatgcactataattagcatatagtgagcagtgaggacgaccagaggtcactttcctcaccatcttggttttggtggtgtttgactgccttctytactgcatcctgttttatcaacaaggtctttgcgacctgtatcttgtgccgacctcctatctcatcccgtgactatgaattccttaaactcctggaaatg

SEQ ID NO: 22277 - DNA, 201 bp, Homo sapiens
ctgaggcaggagaattgcttgaacctgggaggtggaggttgcagtcagctgagatcgcaccactgcactccagcctggtgacagagcaagactccatctcaaaaaaaaaaaaaaaaaaattcagacagagagaaggcattggggtgatgggagaaggagacacactttgctgaacctcagccatgagttacatttggatgt

SEQ ID NO: 22278 - DNA, 201 bp, Homo sapiens
tgaggcaggagaatcgcttgaacctaggaggtggaaattgcagtgagtcaagatcatgccgttgcattccagcctgagtgacccagtgagactccatctcaaaaaaaaaaaaaaaaatagaaaaaaataaaaattggatttttaggctataactactctttcatgatgccattttgctgtgcaatttgatttaaaggatag

SEQ ID NO: 22279 - DNA, 201 bp, Homo sapiens
gaaattccttcaaatagatgggtattttcaaccactcataaccatattaattttcttgttacatatcagctttctatttctaaaccacaatttatctgcaratttgtcaagctacctcggtatattcgaaatttcttactcttgggttagtctctcatggcagtgaaaagttacactttgcaaaatgttctatagcattca

SEQ ID NO: 22280 - DNA, 201 bp, Homo sapiens
gctgggcaccataatcgtgatttggtaaagcgtaatggagaaagctacagaaaggaggatgcttttgaattgggctttaaaggaggctttggcagaaagagggggggaggaaagagatgaaacatttccaggacctgaactccatttctttcgactcatttgaggatgaaatggcaacaaaaaggtgtttaaaaactcaaa

SEQ ID NO: 22281 - DNA, 201 bp, Homo sapiens
atctgtgtacaattttctttatgtcacattcgtgaaaagttcttctactgaaaaccatggtttcatggctaagttcagtgctgaggatttgggtaagagaytgttcccttttttttttcctcctcttgggcttgtatcagaataagtgaatgatagaaataaattatatgaaaatcatctgtactgtgaaaaattttaaag

SEQ ID NO: 22282 - DNA, 201 bp, Homo sapiens
gaagttcatgaggcattagagagttattcgcatctcagatgttattttgagaattacagtaatatttgtcattaatggaatgcccatcatgtgctagacastactaccaatactttgatagatataattgtctgtcctcatagtagtccagtaactgagtataagtatgctcacaggagaacagggattgagatggggaac

SEQ ID NO: 22283 - DNA, 201 bp, Homo sapiens
ttgaaggactcacacttcctgatttcaaaacttagaacaaagctacaataatcaagacagtatcttattgaagtaaggatataaatatagatctatggaayacaattgcaagtccagaagtgaacacatacttttatggccaattgatatatgaaaatgatgccaaaacatatcaatggagaaaaatcattttttcaacaa

SEQ ID NO: 22284 - DNA, 201 bp, Homo sapiens
catggacttctccataagggctttgctttctctctgtgctctccgaatctgtttaaaggcaaatttcttctgtccttggaaagaccttgcatccgctctartaagtgaagcgtaaatcagtgtttgtgtttgcagtgcacgtcactgctggtcacatgatggcataacagattccaaacaggtgccaaggatgattcttca

SEQ ID NO: 22285 - DNA, 201 bp, Homo sapiens
aaaattgagataaaattattaatatctggacaagcactactataatttttatgcttacagcttgcggggatgaattaactggagaaggggtcattcgctcrcctttttttcctaacgtgtatcctggagaaagaacctgtaggtggaccatccaccagccccaaagccaagtcattctcctcaacttcactgtctttgaaa

SEQ ID NO: 22286 - DNA, 201 bp, Homo sapiens
tgcactattattattcccatatttgatctggtatataagctggcaatggactgtgaatttatttttctagaactgtgtttaggatttgtgtatctatattrataggtgacatcagtctatagtttttatttctataatctatgttgggatttggtaacagcgttctaacaaaaattatttggaaattattctatgtttgag

SEQ ID NO: 22287 - DNA, 201 bp, Homo sapiens
gatgcttattttaatgcataattttctccccccaaaggcaaaaagaaactaattgtcattcatcagtgttgccccccaaacctactgcctagcccctccacccccacccagtacttttacaatgtgttattaaagaccactgaacagctgagatccaggggtctccttcaatgcgtaatcccatccagaaggaaggaaaaa

SEQ ID NO: 22288 - DNA, 201 bp, Homo sapiens
atttgaattgctttgaattaaaatttaatgcttattattttagaaattatagtataaaaccaaatctggattcatagcagaggaagacaaatgagcgtgcrtattaagacatggctttgggacttgactcattccagatgttaaagctcacgactcactaggctcaaaagcccacatttaaaatttcatgtaaatggtgtt

SEQ ID NO: 22289 - DNA, 201 bp, Homo sapiens
gtcctccgtctgaaccttttctttcaccaccttcccctgcatccttccctctacttctccctccccgctacactcctgcttcagcctaagcagccctcccrcatctcctgcatgtctttagatgaatgcaaattcacaaaggacctccttttgtgacttcttaggcattgagatgattccactatgagcttgggattgggt

SEQ ID NO: 22290 - DNA, 201 bp, Homo sapiens
gagagttccataagcactcattaaagaatagattttaactgcaaaagataagaatgatattgacccagtgtagcatatctttctttttttttaacacaagkaacacacattaacatgttaattcttagatttatatatctctcttaagtgaagtttctacttttaaagatatacattacccatggaagatgtgacatggct

SEQ ID NO: 22291 - DNA, 201 bp, Homo sapiens
ggtttagaggggggttgactttgtcctttactgactccattgatgagtaaaagcagtccacccaaaattttagaaagagtggagaagagaaaagaaattcyacagagatgtgggagaatgatcctaaggacatttactttgcatgtgaataggtgtacttttaagaatcctagatcttctctttgtgtggttttaggtgcc

SEQ ID NO: 22292 - DNA, 201 bp, Homo sapiens
tttgtgaactgaacccgttttctaaaaagtatattcacttctcttgttgttcttcagatagtggtcatacaagaaagtgatacaggaaccaaattctaatracattattatgactcaatatattgttccctaaaatgatgtcttcattttttaaagctatctctaaaaaatgaaatatttatgaaaaagaattaaaaaaag

SEQ ID NO: 22293 - DNA, 201 bp, Homo sapiens
aagagtaacaaagaacatctttacttgtcccctttcttcatttccttttctttccacggaatctggtgccaacctcctgttcccctttcaattgttttccrtgcaaatcaactccccctggctacatcttgctattctgtattcattttttctttaatctgcttcatgtatacagttatgtagtttattttgttacatgtt

SEQ ID NO: 22294 - DNA, 201 bp, Homo sapiens
gcttcccaagtagctgagattacaggcatgcgccaccatgcccagccgatttttgtatttttagtagacagagcgtttccccatattggccaggctggtcycaaactcctgaactcaggtgatccaacctcccaaagtgctgggattacaggcatgagccaccgcgcccggccagattactttaaattctacatttattca

SEQ ID NO: 22295 - DNA, 201 bp, Homo sapiens
cacatcactggcgtcaactctgggcatgcaaagatctctacaccatcgaaagcacacagacaacaacttgattttctcccacagttactttatcaagtttkttttttttttttttttccattctgctctcaacccccaattttcaaagtacagtcctggaggaagttatccctgggttgtgatatgcaggcaaaggcacgt

SEQ ID NO: 22296 - DNA, 201 bp, Homo sapiens
ctctgggcatgcaaagatctctacaccatcgaaagcacacagacaacaacttgattttctcccacagttactttatcaagtttgttttttttttttttttycattctgctctcaacccccaattttcaaagtacagtcctggaggaagttatccctgggttgtgatatgcaggcaaaggcacgtgtgtggaggatggaaga

SEQ ID NO: 22297 - DNA, 201 bp, Homo sapiens
agcagtgtttgtggggcgagagcaggaaccagacagtgtaaagaggtacaaagaggagagtgagtgtagactgaagtctaggtccctgaattctgaggctstctgtaacaaaccagagtaagtgatggcttcttttctccaatccttatccttcatttccctaactggtcctcatctagttcacgtgtgtgggacacactc

SEQ ID NO: 22298 - DNA, 201 bp, Homo sapiens
catcgaaagcacacagacaacaacttgattttctcccacagttactttatcaagtttgttttttttttttttttccattctgctctcaacccccaattttmaaagtacagtcctggaggaagttatccctgggttgtgatatgcaggcaaaggcacgtgtgtggaggatggaagaggtggaggtggcagtgggaagagagg

SEQ ID NO: 22299 - DNA, 201 bp, Homo sapiens
tctgacacatttgccagaggctttattcgaaagggtgaagattaaacatattctctcagtttgtgattggttatataaaacaccataccagctatgaatgwtggttattctttgttaagtcattcaaatatgatttttaaaaatttaaaagtgaaaatcgtgttttttagagtaagtgtagtgtttgagagaaattacttc

SEQ ID NO: 22300 - DNA, 201 bp, Homo sapiens; identical to SEQ ID NO: 3204

SEQ ID NO: 22301 - DNA, 201 bp, Homo sapiens
cagaatcacctgtggagttacttacattagacttccagttcccaccgaaacccactgaatcgggatttcccagggaggagtcacagcacgctgtttttttwaaaaaaagctccctctgtgacgtcagtgcactgcctagggttgaatacccatgtttatttctgcataaatagaactgtagaaaatttggacacgtggctc

SEQ ID NO: 22302 - DNA, 201 bp, Homo sapiens
tttaatgtcttaatacctgcagcgtggcagtgccttgatcaatatttgccaaatgaatgaatagaaagtgagagacaacggggacccatgtatccccccaacacacacacacacacacacacacacacacacacacacacacactgttccacagaagtatatgaaaataaatctcaagaggaaaaactataaacactgagg

SEQ ID NO: 22303 - DNA, 201 bp, Homo sapiens
tgaggcaggagaattgcttgaacctgggaggtggaggttgcagtcagctgagatcgcaccactgcactccagcctggtgacagagcaagactccatctcaaaaaaaaaaaaaaaaaaattcagacagagagaaggcattggggtgatgggagaaggagacacactttgctgaacctcagccatgagttacatttggatgtg

SEQ ID NO: 22304 - DNA, 201 bp, Homo sapiens
ttaatgtcttaatacctgcagcgtggcagtgccttgatcaatatttgccaaatgaatgaatagaaagtgagagacaacggggacccatgtatccccccaacacacacacacacacacacacacacacacacacacacacacactgttccacagaagtatatgaaaataaatctcaagaggaaaaactataaacactgagga

SEQ ID NO: 22305 - DNA, 201 bp, Homo sapiens
gaggcaggagaattgcttgaacctgggaggtggaggttgcagtcagctgagatcgcaccactgcactccagcctggtgacagagcaagactccatctcaaaaaaaaaaaaaaaaaaattcagacagagagaaggcattggggtgatgggagaaggagacacactttgctgaacctcagccatgagttacatttggatgtga

SEQ ID NO: 22306 - DNA, 201 bp, Homo sapiens
taatgtcttaatacctgcagcgtggcagtgccttgatcaatatttgccaaatgaatgaatagaaagtgagagacaacggggacccatgtatccccccaacacacacacacacacacacacacacacacacacacacacacactgttccacagaagtatatgaaaataaatctcaagaggaaaaactataaacactgaggat

SEQ ID NO: 22307 - DNA, 201 bp, Homo sapiens
ttcagacggtaaagaaatataatgtctccaaagtactctgaattggctgagataataagtgtgaatatttgtgtgtctgtgcatgtgtgtgtggggggggkggagagagagagagaaatgataaagtaatgggagcagaatacaaatacataataaatctgggtaaaaagaattcaggagctcattcttgcatcttttaaa

SEQ ID NO: 22308 - DNA, 201 bp, Homo sapiens
aatgtcttaatacctgcagcgtggcagtgccttgatcaatatttgccaaatgaatgaatagaaagtgagagacaacggggacccatgtatccccccaacacacacacacacacacacacacacacacacacacacacacactgttccacagaagtatatgaaaataaatctcaagaggaaaaactataaacactgaggatg

SEQ ID NO: 22309 - DNA, 201 bp, Homo sapiens
atttccctgatgactaatagtgctgagtccttttcacatgctttttgacaattcatttattttcttttgtgaggtgttcattaaaaccatatggttcatttttgtttgtttcttattaatgagtcatatgttgtatattctgcatacaaatacgtcctttgccagataaatgtattgcaagtattttcttccagtgtgtgg

SEQ ID NO: 22310 - DNA, 201 bp, Homo sapiens
cgagctacagattcgctagctacagtaaaagtaacctttccccagcccttctaaagtgagcctgagggattcatgtgcaatatattgggatgaaaccgagrattgctctgaaggaaggtcatagctttattgagggagccttggcctttctagctgctataggcacttggaactgtttctgagagactctgttcaaatggc

SEQ ID NO: 22311 - DNA, 201 bp, Homo sapiens
tttccctgatgactaatagtgctgagtccttttcacatgctttttgacaattcatttattttcttttgtgaggtgttcattaaaaccatatggttcatttttgtttgtttcttattaatgagtcatatgttgtatattctgcatacaaatacgtcctttgccagataaatgtattgcaagtattttcttccagtgtgtggc

SEQ ID NO: 22312 - DNA, 201 bp, Homo sapiens
ctctgaaggaaggtcatagctttattgagggagccttggcctttctagctgctataggcacttggaactgtttctgagagactctgttcaaatggctaagyatttctgagcccaggatcccagcagagccagtgttgacttaggtggtgatgaaggttctagatctgtcatcttggtggaccattagcacaaaaggtggga

SEQ ID NO: 22313 - DNA, 201 bp, Homo sapiens
ttccctgatgactaatagtgctgagtccttttcacatgctttttgacaattcatttattttcttttgtgaggtgttcattaaaaccatatggttcatttttgtttgtttcttattaatgagtcatatgttgtatattctgcatacaaatacgtcctttgccagataaatgtattgcaagtattttcttccagtgtgtggct

SEQ ID NO: 22314 - DNA, 201 bp, Homo sapiens
tccctgatgactaatagtgctgagtccttttcacatgctttttgacaattcatttattttcttttgtgaggtgttcattaaaaccatatggttcatttttgtttgtttcttattaatgagtcatatgttgtatattctgcatacaaatacgtcctttgccagataaatgtattgcaagtattttcttccagtgtgtggcta

SEQ ID NO: 22315 - DNA, 201 bp, Homo sapiens
ggattaactgaagtcccagtttatgggttatatctaatagaaagcttaaagaaaaaaagtaaaaaaaaattagttttagatttttctttttgacatttttytccccatcaagaagcacaataaatgagctttgtcagttttctttatttcctcctatttaaattttttaaaaactggtattgctcaactgctgtttcttct

SEQ ID NO: 22316 - DNA, 201 bp, Homo sapiens
ctttcttccctttctgctttctgagaagcagaagaaaacaattttgcgtatttcacattgttgatcatattatgagtaataaaattgagcctgaatgtatrcacaaaagttggcagccatcccaaagatggatttagaccaattccttgcaaaataaaaaaaagattgaagatagaaatattgtgttataaatcatcagat

SEQ ID NO: 22317 - DNA, 201 bp, Homo sapiens
ggctggagtgcagtggcatgatctcggctcaccgcaagctccacctcccaggttcaagcgatcctcctgccttagcctcctgagtagctgggactacaggygcccaccaccacacccagctaattttttgtatttttagtagagatggtgtttcaccatgttggccaggatggtcttgatctcttgacctcatgatccacc

SEQ ID NO: 22318 - DNA, 201 bp, Homo sapiens
agaaaaaagtgggcagtggtccttttgaaatgtttcctattgatattttattcaactggcagagcactggagcagatggtgtagtttctgtgaaatccctygtttgcctgtgttacactccaatttgctttaatttgtttggccttcgtgcgcaatggaacttagctgtatactagtacatgcttccccctcctctgaatc

SEQ ID NO: 22319 - DNA, 201 bp, Homo sapiens
tgtgttataaatcatcagattgtcaaaggagacaaatatgtggtttgttttgtctgatgtggatatatcctgatttcaattatcagttatagcttgctgtraaaattccatctagtctagtccagatggtctatactgtagtgacccaccttggtgggattctgagagccaccagcttaccaccaggcttactgatttggt

SEQ ID NO: 22320 - DNA, 201 bp, Homo sapiens
cattatttattctcattaataatctttcctaggaagattaaggaaaaaaatatggaaattctctgcaaagctccctgctgtgcactttcttgcaagaaataaagtttgtcatttggagcctgacttaggagaaatacaggaattgcataagattctgtggttattttgaagtgattattttattggaaatacttgaaaata

SEQ ID NO: 22321 - DNA, 201 bp, Homo sapiens
ctttcctttccttccttccttctttttccttccttcctttcttttcttttcttttcttcacagagtcttgctctgttgcccaggctggactacagtggtgsgatctcagctcactgcaacctccgcttcccaggttcaagcaattctcatggctcagcctcccgagtagctgggattacaggcaccagacaccatgcccag

SEQ ID NO: 22322 - DNA, 201 bp, Homo sapiens
taatcattatttatgtttttccacatatgcattgaaaaatcacaatttagaagacagttttggcgaagtagagaagataatatgagtcattccactaggayttttcacagtacagcaattcaccattgttcatttgttaaaaatctaaataaaaatgtattgaagtgtcatgaatcataaactatggaatcaaaaaacaag

SEQ ID NO: 22323 - DNA, 201 bp, Homo sapiens
ttcttttcttcacagagtcttgctctgttgcccaggctggactacagtggtgcgatctcagctcactgcaacctccgcttcccaggttcaagcaattctcrtggctcagcctcccgagtagctgggattacaggcaccagacaccatgcccagctaataattgtatttttagtagaggtggggtttcaccttgttggccgg

SEQ ID NO: 22324 - DNA, 201 bp, Homo sapiens
cagctcactgcaacctccgcttcccaggttcaagcaattctcatggctcagcctcccgagtagctgggattacaggcaccagacaccatgcccagctaatwattgtatttttagtagaggtggggtttcaccttgttggccgggctggtctcaaactcctgacctcaagtgatctgcctgcctcggcctcccaaagtgttg

SEQ ID NO: 22325 - DNA, 201 bp, Homo sapiens
cagattgtcaaaggagacaaatatgtggtttgttttgtctgatgtggatatatcctgatttcaattatcagttatagcttgctgtgaaaattccatctagwctagtccagatggtctatactgtagtgacccaccttggtgggattctgagagccaccagcttaccaccaggcttactgatttggttagagacctaccaat

SEQ ID NO: 22326 - DNA, 201 bp, Homo sapiens
ctcagaaaaagtaccttttaagtttcaatatcaggaagagtaacaaagaacatctttacttgtcccctttcttcatttccttttctttccacggaatctgstgccaacctcctgttcccctttcaattgttttccgtgcaaatcaactccccctggctacatcttgctattctgtattcattttttctttaatctgcttca

SEQ ID NO: 22327 - DNA, 201 bp, Homo sapiens
agagaggtttgtgcatgcgagcagtgcagtctctctggattttatcctcgggtcaagtccagctgcacaggggctggggctggcttccagcatcacagtgycccagactctagagcttcacttccagccaaatactattagctgttaggacctcagttgctttgataccttaaaacaaacaaacaacaaaacacaggaaat

SEQ ID NO: 22328 - DNA, 201 bp, Homo sapiens
tagggaaaagactagataaatacacgtaagaatggacccttgaagaaacataattgagtgaacagaagagaggtttaaaaactattatcctcggtgatacytgagaagagagtacattcatgaaacaaatgcagggtgttattataggccggcagtccaataggactggtgtccttagaagaagagacaccaagggtgtga

SEQ ID NO: 22329 - DNA, 201 bp, Homo sapiens
agaatgagactccatctcaaaaaaacaaacaacaacaacaacaattcctgctccctttttgtattatggatagacatatcaactttatgggtgacaattayattggaaaggacagtgaatgcgataagtaacaccatcaaatccaaaaggtcttgataagctacaacaatgggccaattgtaacagacgaaatgtgacaga

SEQ ID NO: 22330 - DNA, 201 bp, Homo sapiens
aaccttctcaaatgaaaattatgtcacacttaaccattttaatatgcaaagtgatctggtttgctgaaacacacagaggttggcagaagttctggaattcyttacaatttcacatacagaaattaatatcatcaaagtgaaaaagatgactctacaatcctggtattcatcgctcagatggttcagccctgtttaaatagt

SEQ ID NO: 22331 - DNA, 201 bp, Homo sapiens
agcaccaccattgcctattccttaacacaatatgttaagttataaataaacaatatggtttgccacttaacaagaagtagaaagttcagtagcacatcctyatctccaatgctgccagacatgtaactaagtgaggtagttattagcttccttttcataagaaaattcaatgcttttataaagtttttcagtgcctctaga

SEQ ID NO: 22332 - DNA, 201 bp, Homo sapiens
tatgtaaatttcatatcttacacatctaaaatgttacctatctcacttatttctaatgtctgtattactacagtctggatttttattatttagtgtttctrtcatttgatttacagtagcatttctcatagaaatctaagccactacagattctttgttaaataaatgtgggtattaatgaagagcaggttcttccagtca

SEQ ID NO: 22333 - DNA, 201 bp, Homo sapiens
tcacacccagtcttgtttccaatcttttggaattccaaatgttactgcaacaaaataccttattcacttgtcgtattgtatttttgccaatgtacctttgsgatatctttccaatggtagtattgtttggtcaaaagaaaatgaaatgcataggtttttgctaggtattgctatattctcttatgtagtgatcgtaccatc

SEQ ID NO: 22334 - DNA, 201 bp, Homo sapiens
ctattgacggacatttggcttgtttccagtcctttggccattttctttttagtcttttgttttttatttttgagacagggtgcgatcgtgtctcacagcarcctcaacctcccaggctcaagtgatcctccttcctcagtctccccagtagctgggactacagacacgcaccaccatacccagctaatttttattttttta

SEQ ID NO: 22335 - DNA, 201 bp, Homo sapiens
ataaactagaattaaggccccagaagtttttaggaaaatgctatttccagaattttgctaagtatatcaaatatgatatattacatttcaaaaatttccawatcagaaggaaaacgttgaaagattctctgtaaaatacagcagtatgtttatatagttaatagtatagtttctttatcgtgttttctctgacacatttgc

SEQ ID NO: 22336 - DNA, 201 bp, Homo sapiens
ttctgatctcctcaggttgaacttcccattaaaagcctcttttgcactttctctaatggttttagcattctttaggttcagtatttagatgagttattcaytgagacctacaacatgataatagtttgattttattatttcttctttatttatttattatttgaagttctttaatggaatagaagttactcatatcagcta

SEQ ID NO: 22337 - DNA, 201 bp, Homo sapiens
aatgcagtctagtaggtctcagccctattttatccagcccctattcaagatggagttgctctggtttgaatgcctatggtttattaccccactcccttttmcaaggggacctttaatcctaagggttgtagagggatgtcagtccattttctgtaactccttcaggatgaataggggtgatgatattcctgcctaactatt

SEQ ID NO: 22338 - DNA, 201 bp, Homo sapiens
acgcctggctaatttttgtattttttttagtagagacagggtttcaccatgttggccaggctggtctcggactcctgacctcaggtgatctgcccacctcrgcctcccaaagtgctgggattgcaggcatgagccaccgcacccagcctacttctctctatattataaattcaccttactattatttttgctttaaatcac

SEQ ID NO: 22339 - DNA, 201 bp, Homo sapiens
gtgactatgaattccttaaactcctggaaatgcagtctagtaggtctcagccctattttatccagcccctattcaagatggagttgctctggtttgaatgyctatggtttattaccccactcccttttacaaggggacctttaatcctaagggttgtagagggatgtcagtccattttctgtaactccttcaggatgaata

SEQ ID NO: 22340 - DNA, 201 bp, Homo sapiens
tgttcatatggtatatcttttttcattcttttagttacaacttagtttcaccattatatataatggcatcattatatataatgtgcatgcatagtaaaaarcatataattgggtcctgctttttctgtgttttagttgaagtatttagaccatttacaactaatgtaattatttttatggttgaatttaacataccattat

SEQ ID NO: 22341 - DNA, 201 bp, Homo sapiens
atgtcttaatacctgcagcgtggcagtgccttgatcaatatttgccaaatgaatgaatagaaagtgagagacaacggggacccatgtatccccccaacacmcacacacacacacacacacacacacacacacacacacactgttccacagaagtatatgaaaataaatctcaagaggaaaaactataaacactgaggatga

SEQ ID NO: 22342 - DNA, 201 bp, Homo sapiens
aactattacttcatgcatgcacatttaggattattatgttttactgataaattgtcccctttgtcattatgaaatgtctttctataaatctaataatattwtccttcttgaagtcacttttgtttgatattatttcagtgatttcagctttcttatatttactgttcatatggtatatcttttttcattcttttagttaca

SEQ ID NO: 22343 - DNA, 201 bp, Homo sapiens
ttggcctttttcttaatcttgacaggaaagcgtttagtcctttaccacttaagtatgatgttagctttggattttccatagatgccattcatcagtttgtkgagttcccttctgggcatacttgctgagtttttatcctggataggtgttgaatttttctgcatcttttggtatctttcaaagcttttctttttttattct

SEQ ID NO: 22344 - DNA, 201 bp, Homo sapiens
cgtgcatccttctagaagttgttttttttttgagacggagtctcactctgtcgcccaggctggagtccggtggtgcgatctcggctcactgcaagctccgwctcccgggttcacgccattctcttgcctcagcctcccgagtagctgggactgcaggcgcccgccaccatgcccaggtaattttttgtatttttagtagag

SEQ ID NO: 22345 - DNA, 201 bp, Homo sapiens
acgtgcatccttctagaagttgttttttttttgagacggagtctcactctgtcgcccaggctggagtccggtggtgcgatctcggctcactgcaagctccractcccgggttcacgccattctcttgcctcagcctcccgagtagctgggactgcaggcgcccgccaccatgcccaggtaattttttgtatttttagtaga

SEQ ID NO: 22346 - DNA, 201 bp, Homo sapiens
gtatttaatgcaaatataaacatatgtgttgaatacatatataaaaatatatgtattaaataaatttattttataaatatattatatataatgaatatttataatattttatatataattacatatatttatttataatatatatacataataaatatatatattttttcttcctcacttcttctggattatagtccttta

SEQ ID NO: 22347 - DNA, 201 bp, Homo sapiens
tatttaatgcaaatataaacatatgtgttgaatacatatataaaaatatatgtattaaataaatttattttataaatatattatatataatgaatatttataatattttatatataattacatatatttatttataatatatatacataataaatatatatattttttcttcctcacttcttctggattatagtcctttac

SEQ ID NO: 22348 - DNA, 201 bp, Homo sapiens
atttaatgcaaatataaacatatgtgttgaatacatatataaaaatatatgtattaaataaatttattttataaatatattatatataatgaatatttataatattttatatataattacatatatttatttataatatatatacataataaatatatatattttttcttcctcacttcttctggattatagtcctttaca

SEQ ID NO: 22349 - DNA, 201 bp, Homo sapiens
ccaaatatatatgtgtgtgtgtctctgtgtgtgtatatatacacacacatatatacacatcatatatgtgtgtgtgtacatacacagatgatttttatttwttttttttaaaggaaaatctcatcttggagcacttatgaagtatataatagtggttcttaacagtcatttctttttccagcatgtgagaatgtggtaata

SEQ ID NO: 22350 - DNA, 201 bp, Homo sapiens
aacttccttattgttcaatacagacatttaataaattgttgatgagttttgattatgtctcgtaccactgccatttcatgaatgaactttctgtatttcarctagttcctttaatcaactatttgtcaacataatcaagtataagtgacactataccttatgtttcacagccttttcactgttttctaagacaactgccac

SEQ ID NO: 22351 - DNA, 201 bp, Homo sapiens
acttctccataagggctttgctttctctctgtgctctccgaatctgtttaaaggcaaatttcttctgtccttggaaagaccttgcatccgctctagtaagygaagcgtaaatcagtgtttgtgtttgcagtgcacgtcactgctggtcacatgatggcataacagattccaaacaggtgccaaggatgattcttcaatttc

SEQ ID NO: 22352 - DNA, 201 bp, Homo sapiens
caagatttcaatccagcatcagcaatttttccctacattctgtgattttggttttataacttgatatattgttgctaaataatttctataactaatgcacmatttttttattctcaaactcatctactttgaattttttaaaattccagtggagcttttgatgtcttaaagacaaatactgaggttataactaaggtacat

SEQ ID NO: 22353 - DNA, 201 bp, Homo sapiens
tcttccagctcaaaggtctatgatttcacgttgttctatgaaccaggttcttctctgttcctgagaccatctgcagcaggtggtgagaattttaagaggcwtaataataataataataataataataataataataaatgtttagtgttttactgtagcaggataattggcagagggaaggctgaggtttatggaattaaa

SEQ ID NO: 22354 - DNA, 201 bp, Homo sapiens
ttgggtcattcccaatggggcatttgtaagtaagtaaattttgtgtgttggggtgatgtggatcattagatatatgttcaagttagcatcgccatgaaatraaagcattttgttcttgtggcttgtaaatgaaaatgggaaaatatttcacattgttaatcatcagagcaattaaaattaaatatcacaatgaagtttcgt

SEQ ID NO: 22355 - DNA, 201 bp, Homo sapiens
ggttcaccaatcagaaagacataatctttgcccaaagccccattgtagggggtactatctggaattttaggatccctcctcagacaagcaggcctatcaawagctattcctgaagctaggatatgggtagcatcagaaattgtatccttcctattcatataagtgaggacaaaaggcatcactcttccaactctggagatc

SEQ ID NO: 22356 - DNA, 201 bp, Homo sapiens
tagcagcgctattgacatgttgggctaggtagttttttgtgggtcccagagggtccggggtgtaggtgctgccctgtgtatagcagcatcttcaggagcawccctggtctctactccactctacagtgtgacagcaaaaatgccttcagatagtgctaggtgttcttggggaggcaacacggtccccagtttacagtcact

SEQ ID NO: 22357 - DNA, 201 bp, Homo sapiens
gcaaagaaatctccaagggaccacaaaaacccccgggatattggttatgtacccttcaagctgtaggggaaggagaatttggcccaacccaggtacatgtmcccttctccctctctgatttaaagcagatcaacgcagacctggggaagttttcagatgatcctgataggtacatagatgtcctacagggtctagggcaaa

SEQ ID NO: 22358 - DNA, 201 bp, Homo sapiens
ggggtgtaggtgctgccctgtgtatagcagcatcttcaggagcatccctggtctctactccactctacagtgtgacagcaaaaatgccttcagatagtgcyaggtgttcttggggaggcaacacggtccccagtttacagtcactgagttaaaggaaccgttatctaaagaaaggaaattctgaattgtttcaaggtggaa

SEQ ID NO: 22359 - DNA, 201 bp, Homo sapiens
ggtggaaagtgtctactgtgaagtcctacctgttttatcatacctgtgcttgttttgtagttagagtaaacattgtttcaacaggaaactaagttaaatayctcgtttctcattttaatttttatagcaattgcatgagtcatcatcacatttttgtttttatttttatggccttaattgtttgtgtaggttctgatcata

SEQ ID NO: 22360 - DNA, 201 bp, Homo sapiens
tacatagatgtcctacagggtctagggcaaacctttgatctcacttgaagagatatcttgctattgttagatcaaaccctggcctttaatgaaaagaatgyggctttagctgcagcccaagagtttggagatacctggtgtcttagtgaagtaaatgataggatgacagctgaagaaagggacaaattctctactggtcaa

SEQ ID NO: 22361 - DNA, 201 bp, Homo sapiens
gtctatctatctatatatatatgtatgtatacaatctaaatgtattttttcagttttcagcctggatcctggagctcaccataatgaaatttacatctgcrtgtttattttattttacttatttatttatttgagactagctctcactctgtcgcccaggctggagtgcagtggcgtgatctcagctcactgcaacctcca

SEQ ID NO: 22362 - DNA, 201 bp, Homo sapiens
atcagatgaagagtgttctttcctatgtcaactactattgctgtataactaatttcccacaaatttagtgttgtagaacattaatcatttgactttgtttytgattttgtgggccaggaatttggaaagaacctaacatgacagttgctacttgaaatctattcagcagttataagcgggtgtcagctgggactgtagctg

SEQ ID NO: 22363 - DNA, 201 bp, Homo sapiens
attttttttctcaaggctgttgaaaggaagcatttattatatattttatatataaatatatattatttagtctatattttcaaaattattccatattatgrattgtttattagagctactgccaaaataaattgaaaatgcaggctgggcatggtgtcccatgcctgtaatcccagcacagggaggctgaggcaggcaggt

SEQ ID NO: 22364 - DNA, 201 bp, Homo sapiens
taagctataataaacccaccacaaaactctaaagtaaatccatgtaagaagccttgcttgttcaggaactctagaaatcgttatttgaaatgacaaagaayaagacctgaattaaacactgtataagacagagaaaagttagggatgcatctgtcaggataggttatgcacatagtaacaaacaactccacctcacagcag

SEQ ID NO: 22365 - DNA, 201 bp, Homo sapiens
ggaagagtaaatatggtatttttaatgagacctaaaaaactaaagtattgctgggatagtaaatatcagttcaacttgtcaaaagttgttctcagatggaytttaatatgccctagactgtgaattccttgaaaagtaagactgtatcttactcactttgacatccccagctgctgtcacagtttttgttgtattgtaatt

SEQ ID NO: 22366 - DNA, 201 bp, Homo sapiens
aaggaaatgcctgtacatttttgaggtgccatttccatgcagctgctttccttatagtatgcagctccaaaaccgccagatgctttggtagccctaaatcrtgagttgtttgtttgccatagcaagggtattgctgtctccttgggcttcacttctttgaattcttgagtgtgtatgggacatactttatatgcttctctt

SEQ ID NO: 22367 - DNA, 201 bp, Homo sapiens
tcttctctgtgcatttgcagcttgggaatgagctaaggacccaaggaaatgcctgtacatttttgaggtgccatttccatgcagctgctttccttatagtrtgcagctccaaaaccgccagatgctttggtagccctaaatcgtgagttgtttgtttgccatagcaagggtattgctgtctccttgggcttcacttctttg

SEQ ID NO: 22368 - DNA, 201 bp, Homo sapiens
ccaggcctctgggcctgtgatgggaggggtttcagcaaaggtttctgaaatgcctttggggacttttctccattatcttggatattagcagttggcttttrgttatgcaaatatctctagcaagtggatgcctcacagcctgcttgaattcctctcctgaaaaagctttttctttctctgccatatggccaggctgtaaat

SEQ ID NO: 22369 - DNA, 201 bp, Homo sapiens
aaagtatctcctttctgactgaatgaggcaacacatcccttcagtatttattatgcagtctctcttcaattcttagcaacttccctcccctccgaaactgytctctgttagttagacctgctgtcttctctgtgcatttgcagcttgggaatgagctaaggacccaaggaaatgcctgtacatttttgaggtgccatttcc

SEQ ID NO: 22370 - DNA, 201 bp, Homo sapiens; identical to SEQ ID NO: 3200

SEQ ID NO: 22371 - DNA, 201 bp, Homo sapiens
tttcataaaagtatctcctttctgactgaatgaggcaacacatcccttcagtatttattatgcagtctctcttcaattcttagcaacttccctcccctccraaactgttctctgttagttagacctgctgtcttctctgtgcatttgcagcttgggaatgagctaaggacccaaggaaatgcctgtacatttttgaggtgc

SEQ ID NO: 22372 - DNA, 201 bp, Homo sapiens; identical to SEQ ID NO: 3202

SEQ ID NO: 22373 - DNA, 201 bp, Homo sapiens
tagagatggcattgaactgtagactgctttgcatagtatggacattttaacagtattctttcaatttgtgaacaccaaatattttctttttttcattaatstggtatagttttcaaaatacagatatttcactttcttggttaaatacattcctaagtatttaactttttgacactattgtaaatgggattttcttcttaa

SEQ ID NO: 22374 - DNA, 201 bp, Homo sapiens
tgaaatagaagggattaaaaaacatgagtcttagttggtcccttatcaaattactgaacagcctttttataagctctactagtagtttactgcaggaataytgaggacattgtccaccccttcatgtagtattccttcatcttaatgatcactcaataattttttctttttgttattattttgttttaattattctatttt

SEQ ID NO: 22375 - DNA, 201 bp, Homo sapiens
tcaagcaatccatctaatttggcctcccaaagtgctgggattacaggcatgagccactgtgaccaaccataattactttaaaatcaaatcaacctagaatkaattagaatttattttgtgtctaaaggcaacaaaataagcatgaaatagaagggattaaaaaacatgagtcttagttggtcccttatcaaattactgaac

SEQ ID NO: 22376 - DNA, 201 bp, Homo sapiens
ttgtgaatggtaatattagccagttcaacttaattcaggtagattttcaaatctccaatttattttactgctttagaaacaatgtcagttatatatttgamataccttggtctggtggacttgacaagtttaatgaaattggggtaaatctatgttattaacattaagattttttgatatattttgatattagttgaagtt

SEQ ID NO: 22377 - DNA, 201 bp, Homo sapiens
ggatagttcaattaatgaacatttgagtttcatttaaactgttttaagaaagtcatgtagtaataggtaactgatcttaaaataccctagcacagaatttwaaaaattccttatattctttttcattaactgaatattgttgtgattttaggttctgatgaaaattaaattcgacagccttcttttgattgtttatctcaa

SEQ ID NO: 22378 - DNA, 201 bp, Homo sapiens
agaagtttgaatgggccagagacaaagctacttatagttttgaccatggtgggtattgctctaccccttgtttcctccctcgtctgcatggtgttcttttstttgatacagtgcagaatccatggaatttaacatacaaagtgtgtcaccaaaccaaagcctaggtcaacagcatgccagcatggctaggattttccctct

SEQ ID NO: 22379 - DNA, 201 bp, Homo sapiens
atacccagtaatgggatggctggatcaaatggtatttctagttctagatccctaaggaatcaccacactgacttccacaatggttgaactagtttacagtyccaccaacagtgtcaaagcgttcctatttctccacatcctctccagcacctgttgtttcctgactttttaacaatcaccattctaactggtgtgagatgg

SEQ ID NO: 22380 - DNA, 201 bp, Homo sapiens
tacccagtaatgggatggctggatcaaatggtatttctagttctagatccctaaggaatcaccacactgacttccacaatggttgaactagtttacagttycaccaacagtgtcaaagcgttcctatttctccacatcctctccagcacctgttgtttcctgactttttaacaatcaccattctaactggtgtgagatggt

SEQ ID NO: 22381 - DNA, 201 bp, Homo sapiens
tatggtatttttaatgagacctaaaaaactaaagtattgctgggatagtaaatatcagttcaacttgtcaaaagttgttctcagatggactttaatatgcyctagactgtgaattccttgaaaagtaagactgtatcttactcactttgacatccccagctgctgtcacagtttttgttgtattgtaattactaaaaacaa

SEQ ID NO: 22382 - DNA, 201 bp, Homo sapiens
gatggctggatcaaatggtatttctagttctagatccctaaggaatcaccacactgacttccacaatggttgaactagtttacagttccaccaacagtgtmaaagcgttcctatttctccacatcctctccagcacctgttgtttcctgactttttaacaatcaccattctaactggtgtgagatggtatctcattgtggt

SEQ ID NO: 22383 - DNA, 201 bp, Homo sapiens
aaggctggaagatgtctttccggcagacattgggtaagaattctggacttgtaaatctatttttcaggactgttacctttctgctttatttaatttccccrccccccccccacccccacctgattatgattgcttttccttgaagcttagaagaatatgccatgtaagggcttggttttaaaacttacgtatgacatattt

SEQ ID NO: 22384 - DNA, 201 bp, Homo sapiens
ctagcctgggtgacagaatgagactctgtctcaaaaaaaaaaaaaaaaaaaatcactttggtagcacagtggaggaaggctagaagaacctacaacatggraaggaagaagcttatgatagaaatctagatgggaagtgtcaaagccttgaacggacccagaggggaaagagataaagggaagggcagaaatctgagagac

SEQ ID NO: 22385 - DNA, 201 bp, Homo sapiens
aaaaaagacatatggccagatggaaagagctgattgatgcatgatatcattgcttggtgatacggctttagaaaagccctataacgttttgaatctcaatytttatctactaaaaaactgatcaatttgaaatattacaactatttaagaatgtgatggggataaagcagataatttctggaaagcaccttagctgtcaga

SEQ ID NO: 22386 - DNA, 201 bp, Homo sapiens
gatatcattgcttggtgatacggctttagaaaagccctataacgttttgaatctcaatttttatctactaaaaaactgatcaatttgaaatattacaactrtttaagaatgtgatggggataaagcagataatttctggaaagcaccttagctgtcagagtgaaagactctatgtattagaaagtaatattgaagtcccaa

SEQ ID NO: 22387 - DNA, 201 bp, Homo sapiens
catggttttaattgttgtttttatttttaaatgtaagttcatttcagtatatttttatttttgtaaaattgaagtttcaattgttataatcatgaccactrgtaacatttattcaactgtctgtatgcaatttcaggcaataaatcttgcttaaatattaggcaaccttgaatataaggtaatatgttatttttgcaataa

SEQ ID NO: 22388 - DNA, 201 bp, Homo sapiens
actctatgtattagaaagtaatattgaagtcccaaattttcaagccccccgcccaaccctatttccaaggttggagggtggctgagggtggggtgggcagsgatcaacattctcaacaggaccacatcatgctacagtgatttttcgttctttcctacccactttgcagtgacacctaaccgtcaaatcctaaagtacatt

SEQ ID NO: 22389 - DNA, 201 bp, Homo sapiens
taatcccagcgacttgggaggctgaggcatgagaatcgcttgaacccaggaggtggaggttgcagtgagccaagattgcgccactgcactccagcctggcracacagcgagactccttctcaaaaaaaaaaaaaaaaaaaaaaaaaagaaggtctttaagagaagtttgaatgggccagagacaaagctacttatagtttt

SEQ ID NO: 22390 - DNA, 201 bp, Homo sapiens
atgtaataaggaagttgaattataacttgaataattggataaatcactgatcaaacaactctcagtttagcaataatgagggtattgctccaaagcaaccrtggaatgtcatttttctggtttcctaatgtcatttgctccctgtgatgaagtctgagaatgagatgagctgaaactgtaaacccatttaaagaaaaaccc

SEQ ID NO: 22391 - DNA, 201 bp, Homo sapiens
tagatagttgagcttttttttcccagtttttagctattacaaaaaaagctaccatgaacattgacttgcaggttttttgtggacgtattcattctcttgcrtaaaatacctaggagtagaacttctgggtctcatatggtaatgatatgtttaactttataagaaagtgccaaattgttttccaaagtggttatgccattt

SEQ ID NO: 22392 - DNA, 201 bp, Homo sapiens
tgctgcagtaaacatacgtgtgcatctgtctttatagtagaatgatttataatcctttgggtatatacccagtaatgggattgctgagtcaaatggtattwctggttctagatccttgaggaattgccacattgtcttccacaatggttgaactaatttacactcccaccaacgagtaaaaacgttcctatttctccacat

SEQ ID NO: 22393 - DNA, 201 bp, Homo sapiens
aacttcttccataaagtcacttttgactcttctgcccctcacttaaactcctgatttggaatcaacacatttattgagaggttgttgttatatgtttaggrcaatagtagaccctatggaaaaatatgaaagtgtaaaatactgtctccacttatgaactgctcaccttgcagctgaggagacaagaccaaccccaatggg

SEQ ID NO: 22394 - DNA, 201 bp, Homo sapiens
aacttcactcaagcaagttttctttcgtcaccggaccccatgtaccaccatgagtattttccactgtgttcatttatttggaatgtttctcccgataaacstcctcacacatcttccttgtttctcatccagatgtgtctgtccctcaggagcacttccctctcaacttcttccataaagtcacttttgactcttctgccc

SEQ ID NO: 22395 - DNA, 201 bp, Homo sapiens
gccaggctggtctcaaactcctgaactcaggtgatccaacctcccaaagtgctgggattacaggcatgagccaccgcgcccggccagattactttaaattytacatttattcattatttctgtttataaaagaatatatattcatatatgaaacatatataaggtaaggtaggaagattcaaaaattccttggtaaattaa

SEQ ID NO: 22396 - DNA, 201 bp, Homo sapiens
caatgatcttctataaccaagtctcactcaatccatctaaccttttttttcactagttccctagaaataacttcactcaagcaagttttctttcgtcaccrgaccccatgtaccaccatgagtattttccactgtgttcatttatttggaatgtttctcccgataaacctcctcacacatcttccttgtttctcatccaga

SEQ ID NO: 22397 - DNA, 201 bp, Homo sapiens
agtaactttatatttttagctacctgtgtacctgattagtttatgttaagaatagagattttaacattgaaagtacagattacttttttttttttgaaatrgaatctcgctgtgtcatccagcctggagtgtagtggcgtgatcttagctcactgcaacctccacctcccaggttcaagtgattctcctacctcagcttcc

SEQ ID NO: 22398 - DNA, 201 bp, Homo sapiens
ggcactacattcctattatttgggttgattaaagtttagtgtctatccatttgttttatggtattatgtgttttttttccccttaggacactgtctctggytatttttgtaagtgtgactcaggttggacaggtgtcaactgtacagaaaacatcaatgagtgtttgagcaacccctgtttgaatggaggaacttgtgttg

SEQ ID NO: 22399 - DNA, 201 bp, Homo sapiens
aaccaaagtttaaaccatggaattatatagggaacagaggaacttccaatattttgaatacatagatcagtaaaatcagcatttccgcatgtcaggctggktccaacatacattgcccgcgtaacgtttccgtaagaagcgtcgagagccctcctggaagcagggctggttgtgaatgcagggtagcagccaggctggggg

SEQ ID NO: 22400 - DNA, 201 bp, Homo sapiens
cagaggaggagacctgtatttacacgtttgtttttatttctgaacaggttccttacctctctgcacgtgtctcccgggttatactggaaatggttatggghcaaatggatgtgtgcagctcagtaatatttgcctaagtcacccctgtctaaatggacaatgcatcgtgagtcctttgtttttcctgtggacagagagtac

SEQ ID NO: 22401 - DNA, 201 bp, Homo sapiens
taaaaaattttttcttggaaatggagtctcactctgtcacccaggctggagtgcagtggcactatctcagctcactacaacctctgcctcctgggttcaartgattctcctgcctcaccctcccaagtagctgggattacaggcgtgtgccaccatgcctggctaatttttgtatttttagtagagacagggtttctccac

SEQ ID NO: 22402 - DNA, 201 bp, Homo sapiens
atccgcctgcctcggcctcccaaagttcagggattacagattccatagggctctttattagtattattattattataattaaaaaattttttcttggaaayggagtctcactctgtcacccaggctggagtgcagtggcactatctcagctcactacaacctctgcctcctgggttcaagtgattctcctgcctcaccctc

SEQ ID NO: 22403 - DNA, 201 bp, Homo sapiens
cgtggatgttaattcatgttttaaatagacacgatcatttcaaattccttttgaccaagttccttcctaacctaattcgattgccattgttttaaccttgwaccttggcaatgaggagctcatcagaagtgtgggagaagttttggtgctggtattttgttgatgtccccatatatttatgttactatattatcttcaatc

SEQ ID NO: 22404 - DNA, 201 bp, Homo sapiens
ggatattaaatttagtaaaattttgtaatgtctatgacgagtatttttaacctaacattgcgtaagaaaactgtcaagatgctggatgctctaaaactctwgttagctattacctcatgtacatcataattaatcgtggatgttaattcatgttttaaatagacacgatcatttcaaattccttttgaccaagttccttcc

SEQ ID NO: 22405 - DNA, 201 bp, Homo sapiens
ccagctttaaatgtctttgtattctgcttcctgtagtttccagtaaagcttccttcagctgcagcctaaagccacagatggcttgctggaaacaggagagsgcctgaagtcaagccagtctgtatctgctcgtacagcacactgtgcaccttctcagtagtggtcaaccagagacaggcagagatactatccagacaacct

SEQ ID NO: 22406 - DNA, 201 bp, Homo sapiens
ctgtagtttccagtaaagcttccttcagctgcagcctaaagccacagatggcttgctggaaacaggagagggcctgaagtcaagccagtctgtatctgctsgtacagcacactgtgcaccttctcagtagtggtcaaccagagacaggcagagatactatccagacaacctcaggaaaatgtcagccgtatagaatgtgag

SEQ ID NO: 22407 - DNA, 201 bp, Homo sapiens
gcaccttctcagtagtggtcaaccagagacaggcagagatactatccagacaacctcaggaaaatgtcagccgtatagaatgtgagccacaaaaatgtcarttctccaaataatgatttaaaaatgtatctaactccactgaagccttcgagatgttttatccaagagaatgtaactattttttcccttatcagattgatc

SEQ ID NO: 22408 - DNA, 201 bp, Homo sapiens
gcctggccaacatggtgaaaccctgtttctactaaagacacaaaaaattagccgggtgtggcggcgggcgcctgtagtcccagctgctccagaggctgagrcaggagaatcgcttgaacccgggaggtggaggttgcagtgagctgagatctcgccactgcactctagcctgggtagcagagcaagactccgtctcaaaaa

SEQ ID NO: 22409 - DNA, 201 bp, Homo sapiens
ggctccggtgagaagacagctccacgaatagagaggacacagcaaagagccttccttccatcaggagaaaggatgctttcttagagggagtcagcatagattttcagagagtcaggctctcagctccaggaaaagtacccagggaggcaactggagaaggcaaaaggcacaggaaaagaacagacgcgtcatgaaaagata

SEQ ID NO: 22410 - DNA, 201 bp, Homo sapiens
aactggcagatcaaagaatagcccttggaatgtggagcttggagctttctttattaaagagatttttctgtgataaatgggacggttgattccttttagatttttttttagagattataatcaaatcactttttagaaaagctaatttaactgaactctgtggtagatacacaagtaaaatcataccaattccattattca

SEQ ID NO: 22411 - DNA, 201 bp, Homo sapiens
ctggatattaaatttagtaaaattttgtaatgtctatgacgagtatttttaacctaacattgcgtaagaaaactgtcaagatgctggatgctctaaaactmttgttagctattacctcatgtacatcataattaatcgtggatgttaattcatgttttaaatagacacgatcatttcaaattccttttgaccaagttcctt

SEQ ID NO: 22412 - DNA, 201 bp, Homo sapiens
aaagataaatcttttctcttactatttctcccttcacagtcatgtttaggaaggctttctttactgaactctttaaaaattgtcaagtacatgttcttttwtacttctatggtttctttttttatggtaagatattttatatttttagaatgtattttttatccgtagcatcaaatagagatctggcttggtatttttgct

SEQ ID NO: 22413 - DNA, 201 bp, Homo sapiens
ggcgggcggatcacgaggtcaggagatggagaccatcctggctaacacggtgaaaccttgtctctactgaaaatacaaaaaaattagccgggcgcggtggygggcgcctgtagtcctagctactcaggaggctgaggcaggagaatggcgtgaacccgggaggcggaggttgcagtgagtcgagatcgcgccactgcactc

SEQ ID NO: 22414 - DNA, 201 bp, Homo sapiens
agctgcgtataatggtgtagatcctaaaggcaccatttatatcccagtttatatatgattccccctcctcatcattggatagggcgtcccctgcaacgcaytgtagggcaacctggcaaaagtctgtagtgaaggtttagtgttatcagagaacaagagagcagatagagatcttgggtttgaggcagaggagtttagagc

SEQ ID NO: 22415 - DNA, 201 bp, Homo sapiens
atcatgaaattttaacttgtttaccagaaaaagtgcatgacctaaaacttggcaaatgtgctcttccatgaaacaaaggggtgaagattagaaaactcgastttcatctgattctgaattaactaaaatcatgtttaagttggaaagacagtgccatctagtggtgcatttctttttcttttacaatgactggttttagtc

SEQ ID NO: 22416 - DNA, 201 bp, Homo sapiens
tgggaggatcacttgagcccgggaagttgaggctgcagtgagccacgatcataccactgcactccagcctgagtgacaaagcgagaccctgtctcaaaggaaaaaaaaaaaaaaagaacatggtatatggtataataagtgctagaaagaggaatgcacagaacagaaacacctacttcagcccaggacatcagagagggt

SEQ ID NO: 22417 - DNA, 201 bp, Homo sapiens
cagtctgggaactagaaggctcaagagggcaatatgtaagttgagacctaaaaggatcagagggaagtctaaggacaacatgctggttctgtaaaatgaarctcaatgatactaaatagctcacctaattttcctgacagctacagtaagtttggggcatcgtcaacatcctctaaagacaagtgtttccttgaataaatg

SEQ ID NO: 22418 - DNA, 201 bp, Homo sapiens
ttgttaggtttttggctgggtggatccattcttcccacagacatttatcaagaactttccatgggacagacactgtatcaggccccggggatgtggcagtaaacaaacaaaatccatgtcctcatggaacctaattctagtgttaagatgcagacaataaataagtaaaatatataatatgccatatggtgaaaggtatca

SEQ ID NO: 22419 - DNA, 201 bp, Homo sapiens
tcaacatcctctaaagacaagtgtttccttgaataaatgctccctggtctcaggggggtgtggtctgtcctttcttcaccacaactccagagcttgaattkgggcacagaaatgacttcactgtttgcccatcgtccacacacccaccctccactcccaccccaggacacactgagagagaagcccccttgtgcctggagc

SEQ ID NO: 22420 - DNA, 201 bp, Homo sapiens
aaatattaaaaagctcctttatcctctggcataacattactaataaattatttcattccattgatcttggttctcaaatgcatctaaatcctgaagaaatstaatgaatgaatgctccccgagttgtgcaaagatatatctgcttagtcttttaaatataccaagatcatagctctgcatcattctgctgtactgaatgct

SEQ ID NO: 22421 - DNA, 201 bp, Homo sapiens
tcaggggggtgtggtctgtcctttcttcaccacaactccagagcttgaatttgggcacagaaatgacttcactgtttgcccatcgtccacacacccacccyccactcccaccccaggacacactgagagagaagcccccttgtgcctggagcaggcagaaccatgcgcctcgtgggcctgaaactttggggtcctccagtg

SEQ ID NO: 22422 - DNA, 201 bp, Homo sapiens
accacaactccagagcttgaatttgggcacagaaatgacttcactgtttgcccatcgtccacacacccaccctccactcccaccccaggacacactgagaragaagcccccttgtgcctggagcaggcagaaccatgcgcctcgtgggcctgaaactttggggtcctccagtgcccccgatgagctccctctgtgctcttt

SEQ ID NO: 22423 - DNA, 201 bp, Homo sapiens
tggcggcttcactgcttcctatacctccagtgaagatgcaggtaatgtaggatgttgtaaatgccccccattttaatcaggggcactgcagatgcccccakctactgccaatggcagcagagccatccattttccctttagtgatacttgaaatctttgacataagacaaacacacataagcagatgaaaaacgcactgca

SEQ ID NO: 22424 - DNA, 201 bp, Homo sapiens
tttttttttttttttttgagactgagtctcagtctgttgcccaggctggagtgcagtggcaagctcccagctcactgcaacctccaccttccgggtttcakcaattctcgtgcctcagcctcccgagtagctgggactacaggcatgcaccagcacgcctggctaatttttgtattttttttagtagagacagggtttcac

SEQ ID NO: 22425 - DNA, 201 bp, Homo sapiens
gaggtggaggttgcagtgagccaagattgcgccactgcactccagcctggcaacacagcgagactccttctcaaaaaaaaaaaaaaaaaaaaaaaaaagarggtctttaagagaagtttgaatgggccagagacaaagctacttatagttttgaccatggtgggtattgctctaccccttgtttcctccctcgtctgcatg

SEQ ID NO: 22426 - DNA, 201 bp, Homo sapiens
aatctcatttcagattgtggcggaatacagataggtgacagtggagtgatcacaagccccaactatccaaatgcttatgacagcctgacccactgctcttsgctgttggaggccccacaagggcacaccatcactgtgagtgctaatgactgggtgaaatgcttctgagacaatagaaccacaatagcctgtcctgcatga

SEQ ID NO: 22427 - DNA, 201 bp, Homo sapiens
gataggcaaggcagaaatgaatattgaataactctttaccattgtcatcaccattatcatcattattattaaacttatgttcccaggccaaaaggtagagwtgtcgaatctataattaatgacttcagaaaagtataagcacttaagcattcttggattccttcattaaagaacttgaggctctttattaagttttagccc

SEQ ID NO: 22428 - DNA, 201 bp, Homo sapiens
tgagtaatttggtatcattccatgtgaagaaaatgttgaatagtcaagtaagattaatacacatccaactacatccttgtttgagatagttgtctgttgakagaaagggcatattgggtattgcagattgcgtagcaatagtcctggcccctacccactagatactacccatcacaccgagtgtgacaatagaaaaatgac

SEQ ID NO: 22429 - DNA, 201 bp, Homo sapiens
ccccggtagcaccaatgtaaaccaagcagaccagaattccaccacacagattctgaatattgaagagcaactggaactgtaacccacaaaatgtgcaaggcacgtggtaaacataaacagggtgacagcctgctaaaataaaagatttgaataggacccaaagttccctaacataataaatgacatgtcctgggtacaatc

SEQ ID NO: 22430 - DNA, 201 bp, Homo sapiens
ttatataatattttgaaatgatagtgttttagaaatggaaagcagagagccagaggttagagagaaggcaatgtaggagtaaattgtgtgtggttataaayaacaaaagcaacttagggattcctgtggtattggaatttcagtatcttgaatgcaattgtgtacaacttgtatataacttaatacacacacacacacaca

SEQ ID NO: 22431 - DNA, 201 bp, Homo sapiens
tggtgtgtgcctgttggctgagttaaatcaagtgtagccactcatggcaaaccactgtttagggaaaagtttgaggaaaggaattagaggaagtaatacartagacaggtttttcagactgaatcagagagtgctggaaaggaagtactgaaagacaaccctagaccaaatcttaggtctgcaggtggtccactgtgtaag

SEQ ID NO: 22432 - DNA, 201 bp, Homo sapiens
aaagatatttctttctgtttcgaaaaccagggatgcatgtaagaatttgataagagttgggattaataaatccagctagttttaaaaagcaaccattgttktggctagattacaatggtaatgaaaatagcagttttctaataataagacattttaaaaacattaattgtgtaaagtactaatcagatacaaatcattttt

SEQ ID NO: 22433 - DNA, 201 bp, Homo sapiens
ccgggcgcggtggtgggcgcctgtagtcctagctactcaggaggctgaggcaggagaatggcgtgaacccgggaggcggaggttgcagtgagtcgagatcscgccactgcactccagcctgggccacagagcgagactccgtctcaaaaaaaaaaaaaaaaaaaaaaagggattgcttttccctctaaaaggaatcctgcc

SEQ ID NO: 22434 - DNA, 201 bp, Homo sapiens
ctcctgattttcttagtaagccttcattgcctctgtggcaattgataaaaatacccagggatgtgatgtgtgtgtgtgtgtgtgtgtgtgtgtgtgtgtgwgagagagagagagagagacggagtctcactctgttgccaggctggagtgcaatggcgtgatctccgctcactgcaacctccttctcccaggttcaagcaa

SEQ ID NO: 22435 - DNA, 201 bp, Homo sapiens
gagatcacgccactgcactccagcctgggtgacagagtgagactccatctgcggggggaaacatgtactctaacctccttaccaactctgggtctcagacrtggctccacagggttgcttgtaaaatgcaaacatgaccatgttaatctcttccctaagagactctcataattctgcagtattaaaagtaaataaaatcta

SEQ ID NO: 22436 - DNA, 201 bp, Homo sapiens
gttagcaacaaccagtgtggctggcctgtggcaccttgaccacaaaatcccgtggggggcttgaaacacatgcagattcctgagcctcactccaggcccawctgaattcagaatttccatgacgaagtctttcctgttttttttttttttttttgacacggcgtctcactctgtcgccaggctggagtgcagtggtgcaat

SEQ ID NO: 22437 - DNA, 201 bp, Homo sapiens
tgaagattcagagaatttaagggaaaaagattgtcagtgaggttcatggttaaaaaatacatatacacattttttcttaaaaagaagaggacctttttcakgaactttggctagaactactctgaaaatcaaatgaagaattgacatttgttttgtaatttaatttaaataaatactactgctatttttttgtttttctta

SEQ ID NO: 22438 - DNA, 201 bp, Homo sapiens
caaagtgaacagcaaatgccatacccaagaagcagcaacacacctggtttggctcaagaagcggaatcgaacaaagtgaagacaataagaaattagattaraaaggtcaggggtgggagaggagagaaagccattgtgatgcctttggctgtttgattgagtggatgggaagcagttaggaggatttcagcagagcagtga

SEQ ID NO: 22439 - DNA, 201 bp, Homo sapiens
acaaggtacatttcacaggttcagtgattttgatgtggttccctccacctcctgctcccatgactacctggcaatttacgatggtgccaataccagcgatccccttcttggcaaattctgcggttccaagcgcccaccaaatgtgaagagcagcaataatagtatgctcctggtgttcaagacagattcatttcagacagc

SEQ ID NO: 22440 - DNA, 201 bp, Homo sapiens
catattctgattaccatgaccccttcttaaccttaaattcccctcatatgaaattctagtatactgggattaactttcatgtatgtttttgatgaccacargaatttttatttgtgaagtctgtgggaattatttaaaggaggagcaaagaactgagcattcagaatataaagggaggagaagtgaatgtcacagaaggag

SEQ ID NO: 22441 - DNA, 201 bp, Homo sapiens
caccgcgccgggccctaagggttttattttaatgaatgcgtacaaatgtgcataagggttccttaggtaaactctccaactaggtgccctcctccaaacaytgagcagcccccagagcagatcctccctgtccgagggctccattgctagcaccccatataaaagcttcctcaccctggttactcagttccactcaaggat

SEQ ID NO: 22442 - DNA, 201 bp, Homo sapiens
acagctgtgaattctttttgtcattttttcttttaaggaatctaaacccaagagaggatacaggagggtgaggattattatatttctttacatgatattgrtaacagcttatatttaatgaacacttattttgtgccagtaacctaatgtgctaaacattttacataacttcagtgctgttattatctgtctgctgatgaa

SEQ ID NO: 22443 - DNA, 201 bp, Homo sapiens
gttcttaaccttcaaccatgtggtcttccctagactggaggcttcagagggaagaatctgcaatttactacatttcgtgttcctatcatcttatagatggytaatatgtaaagggcacatgcagaatattaggggaatgcattctagattagggaagagacaggagttttactagtcaatgaaagatagaatttcaggtct

SEQ ID NO: 22444 - DNA, 201 bp, Homo sapiens
tttcgtgttcctatcatcttatagatggctaatatgtaaagggcacatgcagaatattaggggaatgcattctagattagggaagagacaggagttttacyagtcaatgaaagatagaatttcaggtctatagaatgtttaccttgggagaggagaagaagagaggttatctaccatatagatctgaaggtcatagattct

SEQ ID NO: 22445 - DNA, 201 bp, Homo sapiens
taggggaatgcattctagattagggaagagacaggagttttactagtcaatgaaagatagaatttcaggtctatagaatgtttaccttgggagaggagaaraagagaggttatctaccatatagatctgaaggtcatagattctaaaactactttaattcatctttcctgaagtatttctgaatagagtaagtaaacagaa

SEQ ID NO: 22446 - DNA, 201 bp, Homo sapiens
atacagtcatgcaaccacaatcacaatcatgatacagaacattttcatcacccttaaatattccctcatgcctccttgcgatcaatctcctccccaacccstggcctctgatttgttgtctatcagtgtagttttggcttttttagattttcatatggaatcatgtgatatagaatcacttaggaagtagtcttttgtgtc

SEQ ID NO: 22447 - DNA, 201 bp, Homo sapiens
ggcgcccgccactaagcccggctaattttttgtatttgtagtagagacggggtttcaccacgttagccaggatgttctcgatctcctgacctcgtgatccrcccgcctcggcctcccaaagtgctgggattacaggcgtgagccaccgcgcccggcataagtaaagaattataagctatggtacataatgatcctctcctc

SEQ ID NO: 22448 - DNA, 201 bp, Homo sapiens
caagagatattaaatatgcttggcttctatagcactgcttgtattatgggcagatgctcaataaacacttatgagtgaatgaaggaataaataaatggaaytgggaagctattttacctctttcaaattttagaaatacgaagacagttaagtttctaccgtaattaccagaattacaacgtgcaggtttgttacatatgt

SEQ ID NO: 22449 - DNA, 201 bp, Homo sapiens
ctaagcccggctaattttttgtatttgtagtagagacggggtttcaccacgttagccaggatgttctcgatctcctgacctcgtgatccacccgcctcggsctcccaaagtgctgggattacaggcgtgagccaccgcgcccggcataagtaaagaattataagctatggtacataatgatcctctcctcaaagagcctac

SEQ ID NO: 22450 - DNA, 201 bp, Homo sapiens
cacacaagtacttacaggcacatagagaagagtgctccctgcaaggtgggctcagttgaggcaaaaacagtaaagaaataaagagcctgacatggcagccycaatttgttcctcatttctgaggatgtaaagtggaacgtgtccactgatagtgtataaaccatggaaatacttcaaaatgcgttaaccccattataattt

SEQ ID NO: 22451 - DNA, 201 bp, Homo sapiens
gctctttttattaaagaaaaccttgtggattatttgctttaaatactaggaaaaaagacattgtgggtccatataactatactgtaatttttttaaagcawtactgaatgccccgaatctgtattaccattccagtttacagcgacaatttaagggtattagtatcctgttatttgcgaaggaattcacaaggaaacgtaa

SEQ ID NO: 22452 - DNA, 201 bp, Homo sapiens
caggctttgaacatgagtttgactgtcccccaaactcctgattttcttagtaagccttcattgcctctgtggcaattgataaaaatacccagggatgtgakgtgtgtgtgtgtgtgtgtgtgtgtgtgtgtgtgtgagagagagagagagagacggagtctcactctgttgccaggctggagtgcaatggcgtgatctccg

SEQ ID NO: 22453 - DNA, 201 bp, Homo sapiens
agaagttgttgacacgtgccatgcatttcacacttccatggcctggcatttattactgtctggctgggatacccttcctgttttgtaggtctggaaggtctttttttttttttttttgggacagagtttcgctcttgtcgcccaggctggaatgcagtggtgcgatcttggctcactgcaacctctgcctcccgggttcaa

SEQ ID NO: 22454 - DNA, 201 bp, Homo sapiens
atttttgtcctattcttctgagttttatgttatagtttcagattttttgaaccattgtgagttaattttatagttttagctcttagatttagatctttgamcttttttgagttaatttttgcatatggtatgaggtaagcctcctacttcttttgcatgtggatatctagttttcctagcgctgggtaaaggtggaactcc

SEQ ID NO: 22455 - DNA, 201 bp, Homo sapiens
aagttgcgcatcacttaaggtagattttgacctctcacaagttgaagagtactgaagatctaagatcatttacatccctctggaagaaaaaataacatagscttctagggcaaagaagaaaaaactcaacagttacaggatattccatggttcaaagtacacctgcctggtttgctgttctccaaaatcccatgctcagtt

SEQ ID NO: 22456 - DNA, 201 bp, Homo sapiens
catggttcaaagtacacctgcctggtttgctgttctccaaaatcccatgctcagttggttggagtggcctcactcttacctgccaacctgggaggttgatkatgaacatgtctttaccttttctttggagtttgcttaccttattaatatttgctgaagtaaatggcgaagctggagaacttgagctgcagagacaaaaaa

SEQ ID NO: 22457 - DNA, 201 bp, Homo sapiens
atgcattctctcgtttgaattatataggcctcgaatggctacagagagaggaaatttggtgtttcttacggggtctgctcaaaacattgagtttagaaccrgatccctgggaaaaattaaattaaatgatgaagatctcagtgagtgtttacatcaggtaatacactggaaatatattgaagtcattttgtatatccatat

SEQ ID NO: 22458 - DNA, 201 bp, Homo sapiens
gctaaaagatagaagctcattgtgccagacaatgcaccctagtccagagaaggcacggagggtggaactgaaactcctccacaggggatgcgaggaagtargggaccaaggatatgtggacatgtgaccagtttgcttttgccacagaacagaattggccagttattctcctgccttactgggtgttttcatttcccaata

SEQ ID NO: 22459 - DNA, 201 bp, Homo sapiens
aagaaagaaaggaagaaagaaagaaaagaagccttgctgaagttctgagagcaatcttcttattggggaagtggatgcatcactgacatttatgaacattyccatagtcactgcctacagagaagcaatcggtcaacttatcagtgggttgtactttaaaaaaaaacttaaaaaaaccccagaaatctatgtgataggagg

SEQ ID NO: 22460 - DNA, 201 bp, Homo sapiens
ttaatgttttaaagagcattctatgatggacagagccaattgttgtgctagcacaaagagaaaaatagaataatggaataaaacagggttcataaagagamccccagacgtgtggtcatctaatttatgaccaaagtggagaaggaatgtgctttgcagaaaatggtattgagtcagttggctatcctctggctttctatt

SEQ ID NO: 22461 - DNA, 201 bp, Homo sapiens
ttaaagagcattctatgatggacagagccaattgttgtgctagcacaaagagaaaaatagaataatggaataaaacagggttcataaagagacccccagaygtgtggtcatctaatttatgaccaaagtggagaaggaatgtgctttgcagaaaatggtattgagtcagttggctatcctctggctttctatttcatccat

SEQ ID NO: 22462 - DNA, 201 bp, Homo sapiens
tgtgtgtgtgtgtgtgtatatatatatatattttaaatatatagctttaaaatattttgttgtagtttataaaattatataattcattataattatataaygtactatatagttacattatttatgtaatattcttatataattttataacatatatagatatgtcccagatatatgtaatatattatgtagtatattata

SEQ ID NO: 22463 - DNA, 201 bp, Homo sapiens
atcccagcactttaggaggccgaggcaggtggatcatgtgaggtcgggagtttgagatcagcctggtcaacatggtggaaccctgtctctactaaaaatasgaaaattagccaggcgtagtgggacattcctgtagtcccagctactgaggaggctgaggcatgagaatcgcttcaacccaagaggtggaggttgcagtga

SEQ ID NO: 22464 - DNA, 201 bp, Homo sapiens
actggaggtgagtgagaaaaggaggtttcctaaagtacttaagccgagccctcgttaaatttcatgaaatgcttgggaaaacgtatgaaggctacacactkataacttagtgacatcccaaagggcagcctactgagacctgacatatacccttccctaaaatacgtgataaagtttaacttcctaagggtcaccacatat

SEQ ID NO: 22465 - DNA, 201 bp, Homo sapiens
cagcgagactccttctcaaaaaaaaaaaaaaaaaaaaaaaaaagaaggtctttaagagaagtttgaatgggccagagacaaagctacttatagttttgachatggtgggtattgctctaccccttgtttcctccctcgtctgcatggtgttcttttgtttgatacagtgcagaatccatggaatttaacatacaaagtgtg

SEQ ID NO: 22466 - DNA, 201 bp, Homo sapiens
tggcaatttgtttttaatgaaatggccatattttaccttcatactttcagtcacattctaatggttggcaggttgatgcatgcgtcctgctcagttgataycttgcagtgaacaagaggaaagggtttcaattctggactctggaatctagtggtctgattcaacgtgacctgctccctcttaggaattgtgtgacttggg

SEQ ID NO: 22467 - DNA, 201 bp, Homo sapiens
ctcagcaacaacatttttaacaatcaccctaatgaggcctctccacagatcctgctgtggtggttgtttggggtggggaacatctgagcagatgccctgasaattccctaggtcccatccttctggatctccagtgattcagcagcaggaactacagggctgggtaggacccaaaggggaagggaggctgcaacaggaaga

SEQ ID NO: 22468 - DNA, 201 bp, Homo sapiens
acagatcctgctgtggtggttgtttggggtggggaacatctgagcagatgccctgagaattccctaggtcccatccttctggatctccagtgattcagcascaggaactacagggctgggtaggacccaaaggggaagggaggctgcaacaggaagagatgctgctcacttttagcatgagagccactttgcttgccagtg

SEQ ID NO: 22469 - DNA, 201 bp, Homo sapiens
tgcttatctccaccccacacaggatgattcgccttggtttctgcatggctgtccgggatgcctcagtctccacaatgcccaagttgtcatagcaacacacygcgaggattggcctccacctcctcactgaattcatcacttccccatctgccctaccagtgacgatttctgtgaactcttttatgtgagtcagctcctgtt

SEQ ID NO: 22470 - DNA, 201 bp, Homo sapiens
aagttaatctctacatcccaagctcatatatataagataattacttgtaattttaatttattacagttttaaatttttagccatgaaacaatttagcaagyaaggcacttgaaagacatatttttgttcttggagatcctgcagttcataaagttgatttctactgaggggacaggtggggtgtctgggtctctgctcact

SEQ ID NO: 22471 - DNA, 201 bp, Homo sapiens
atctgtgtgaatataaacaaaaaacctgattttattaacggcaaactttaaaaaacgaggtatgagtttttttttttttccttttcgagacattgttctayacatttattactagattggacattatatttaagcattttcataaatgtctatttgatgcttattttaatgcataattttctccccccaaaggcaaaaaga

SEQ ID NO: 22472 - DNA, 201 bp, Homo sapiens
acatggtggaaccctgtctctactaaaaataggaaaattagccaggcgtagtgggacattcctgtagtcccagctactgaggaggctgaggcatgagaatygcttcaacccaagaggtggaggttgcagtgagccgagatcataccactgcactccagcctgggtgacagaccgaggctccatctcaaaaacaaacaaaca

SEQ ID NO: 22473 - DNA, 201 bp, Homo sapiens
tctatttgatgcttattttaatgcataattttctccccccaaaggcaaaaagaaactaattgtcattcatcagtgttgccccccaaacctactgcctagcycctccacccccacccagtacttttacaatgtgttattaaagaccactgaacagctgagatccaggggtctccttcaatgcgtaatcccatccagaaggaa

SEQ ID NO: 22474 - DNA, 201 bp, Homo sapiens
cccgtctctactaaaaatacaaaaaattagctgggcgtggtggcgggcgcctgtagtcccagctacttaggaggctgaggcaggagaatggcatggacccrggaggcagagcctgcagtgagcggagatcgcgccactgcactccagcctgggcgacagagcaagactccgtctcaaaaaaaagaaaaaaaaatcaaaaag

SEQ ID NO: 22475 - DNA, 201 bp, Homo sapiens
tatgaggattatctctagtccttacaaccaccctgtgagggaagtccgcttcatatcctcatcttaccagtgtggacactgaagcttagaaaggttagtgkcttgcccaaagttccacagctagaaaacgtcaaagcacatatgtgattccagactacgttatggccacacttcttcaactctatcataaccaaggtatct

SEQ ID NO: 22476 - DNA, 201 bp, Homo sapiens
ctttaagtcacgtgaaaatgccacatttcttaatcttgcagagctgacaggcaaaaatgctatgctgttcatgaccttgtgcaggattgaaatataattcygcaacatgctgcgacctagtattccgtaagacacatcgagcttagggtgattatagttatggagaaatcttacctatgttttgttggataagggttatga

SEQ ID NO: 22477 - DNA, 201 bp, Homo sapiens
actaaaaatacaaaaaattagctgggcgtggtggcgggcgcctgtagtcccagctacttaggaggctgaggcaggagaatggcatggacccgggaggcagmgcctgcagtgagcggagatcgcgccactgcactccagcctgggcgacagagcaagactccgtctcaaaaaaaagaaaaaaaaatcaaaaagaaaagaaaa

SEQ ID NO: 22478 - DNA, 201 bp, Homo sapiens
gggcgtggtggcgggcgcctgtagtcccagctacttaggaggctgaggcaggagaatggcatggacccgggaggcagagcctgcagtgagcggagatcgcrccactgcactccagcctgggcgacagagcaagactccgtctcaaaaaaaagaaaaaaaaatcaaaaagaaaagaaaaaagaaaaaagaaaaaaaagaagt

SEQ ID NO: 22479 - DNA, 201 bp, Homo sapiens
agaatggtggaacctgcctcaatctgcatgattcctttttttgtatctgtcccccacagtggaaggtgagtcatctactctttggttaagaatgatggcargtcagcatctgtggtttccttggaatcatcaggcatatttaattctccatctaaagtttctaggattctgtggcctcccaaatcaaattgaaatatacca

SEQ ID NO: 22480 - DNA, 201 bp, Homo sapiens
ttggttaagaatgatggcaggtcagcatctgtggtttccttggaatcatcaggcatatttaattctccatctaaagtttctaggattctgtggcctcccamatcaaattgaaatataccaggtatgctaaaacccaaacagtggtgagtatgattgtataacccaccaaatactaaagccattgaaaggagaggttcactt

SEQ ID NO: 22481 - DNA, 201 bp, Homo sapiens
tatttagctcttgcttaacgtctacatagctatttttacttaactgaagaaaagctcatgagtcctttactctcaccccgtgaagaaatccttgctctaayatccccaaggaaccggaagaaggctcccgtgattggcacagagagtaagcatggcctggtgcaaaaggagctgaagacttaggaagagccggagcattga

SEQ ID NO: 22482 - DNA, 201 bp, Homo sapiens
aggaaactttcccttccctttttaagcagagtgaggcatctcagggcctctatgttcccatcatgctctagggatatccatcgtcaaagctttgctgatgmcacacacattgtctttctaaaaacgaagtccaaaaaattaaggcagatcaatgccaaacttacttttgtacagttctttgaagtcaccttttaaactaga

SEQ ID NO: 22483 - DNA, 201 bp, Homo sapiens
acataaatttcaagcattgtctccagtcaaacctcggtcaaaacactgccatataagcatatttagtgaatatattacttatgggtgtttttaatgtcgawtcataggaaaccaaactattggcaacttaaaatataaggacatttattttttacctaaaaacaaatcaggaagtagataatctctaggttttttagcaag

SEQ ID NO: 22484 - DNA, 201 bp, Homo sapiens
cctttcacaagaaagaatatggggtgagtccatacagtaaagtgaaagcaagtttattaagaaagtgaaggaataaagaatggctactccataggcagagyggcccattgttcaaatttatttgtgaaagaaatggattgtttgttctgtagatcatcccacatcttggattttgctgtttatattctacatgccatttgt

SEQ ID NO: 22485 - DNA, 201 bp, Homo sapiens
tttgcattgctggctgacgattccaagttaacatcgttgatttgtaatttgaattatttttctcattgatattaagagacaggcactggccccaaagcgcrtgccctgacattgtgctcttgtgtaaccaacagttgtcactgcccacctgagacgtacggaccccagtgtgcatccaaatatgacgactgtgaagggggt

SEQ ID NO: 22486 - DNA, 201 bp, Homo sapiens
caggtgcaatggaatagaatgagacttaaggctcaccttgacgttaagcagagaaagggtagggatagactagaaagaatgaaagtcagacagggatgggraaaaggaaggggtagggttggcctgagaggaggagaatttgagctgcgatgcacaaagccaggggcatgtgttgtacttgtcaaacaggaaggggcacat

SEQ ID NO: 22487 - DNA, 201 bp, Homo sapiens
aaaggtcttctttaacaagagatctgaaatgtcttcaaatctcaggtgggccaatctgcaagtggagagccccagagcagtggttcccaaaatgtggtccytagagagcagcgtcagcattacctggaacctgttagaaattcaaattcttgggccccatcccaggcctacagaatcacaaactttgaagtggagcccagt

SEQ ID NO: 22488 - DNA, 201 bp, Homo sapiens
gtctagctaaaggtttgtaaatgcaccaatcagcgctctgtgtctagctaaaggtttgtaaatgcaccaatcagcactctgtaaaaacccaccaatcagcrctctgtgtctagctaaaggtttgtaaatgtaccaatcagcggtctgtaaaaacggaccaatcagtgctctgtaaaatgtatgaatcagtgctctgtaaaa

SEQ ID NO: 22489 - DNA, 201 bp, Homo sapiens
taaaaacccaccaatcagcgctctgtgtctagctaaaggtttgtaaatgtaccaatcagcggtctgtaaaaacggaccaatcagtgctctgtaaaatgtakgaatcagtgctctgtaaaatggaccaatcagtgctctgtaaaatggaccaatcagcaggacgtgggcagggccaaataagggaataaaagctggccaccc

SEQ ID NO: 22490 - DNA, 201 bp, Homo sapiens
gtctgtaaaaacggaccaatcagtgctctgtaaaatgtatgaatcagtgctctgtaaaatggaccaatcagtgctctgtaaaatggaccaatcagcaggaygtgggcagggccaaataagggaataaaagctggccaccctagccagcagcggcaacccactcgggtccccttccacactgtggaagctttgttctttcac

SEQ ID NO: 22491 - DNA, 201 bp, Homo sapiens
aataaatggaaagacatttaatgttcatggattagaagacaatattgttaagatggcaatactccctaaagtgagctaaagattcaattcaatccccatamaaatcacagcgggctcttttaaaaaaatacataagctgatcgtaaaattcatatgaatatgcaagggaaccagaataaccaaaatgttcttgaaaaatta

SEQ ID NO: 22492 - DNA, 201 bp, Homo sapiens
ttcacaatgaatcttgctgctgctcactctttgggtccacactaccttaatgagctgtagcactcactgcgaaggtctgcggcttcattcctgaagtcagsgagaccatgaacccaccggaaggaaaaaactgtggacgcatctgaacatctgaacaaacaaaatccggacacaccatctttaagaactataacactcacc

SEQ ID NO: 22493 - DNA, 201 bp, Homo sapiens
tgcgaaggtctgcggcttcattcctgaagtcagcgagaccatgaacccaccggaaggaaaaaactgtggacgcatctgaacatctgaacaaacaaaatccrgacacaccatctttaagaactataacactcaccacgagggtccgcagcttcattcttgaagtcagcgagaccaagaacccactggaaggaataaattccg

SEQ ID NO: 22494 - DNA, 201 bp, Homo sapiens
aagtgaggacaaaaggcatcactcttccaactctggagatcccttcccttcctcaggatatggccctctgcttcatttttggggcataacacctttatacratgcgggtaaggtcccagtactaacaagagaatgcttaggactctaacaggttttcaagaatgtgtcagtaagggccactaaatccaatttttcttggtc

SEQ ID NO: 22495 - DNA, 201 bp, Homo sapiens
ttttaaattttattattattatactttaagttttagggtacatgtgcacaatgttcaggtttgttacttatgtatacatgtgccatgttggtgtgctgcayccattaactcgtcatttagcattaggtatatctcctaatgctatccctccaccctccccccaccccacaacagtccccggtgtgtgatgttccccttcct

SEQ ID NO: 22496 - DNA, 201 bp, Homo sapiens
ggctggaagcaaaatgcagtctagtctctcatttccgtgaacccattatctcctgatttctgtttatgggcatttatcaaggaggattgctacatagaggyattggtggcaaatgtccaggctcctagaacttctgctttctgaccttcctgatatctaggaatgttacagagattagatttcactcctagtcttccttta

SEQ ID NO: 22497 - DNA, 201 bp, Homo sapiens
tctgctgctgcgttggtgagtgcaactattctgatcagcagggtccagggactgttgcgggttcttgggcagagggagaaacaaaacaaaccaaaagcacrggcagttttgtctttcagatgggaaacactcaggcatcaacaggctcacccttgaaatgtgtcctaagccattgggaccaatttgacccgcaaaccctga

SEQ ID NO: 22498 - DNA, 201 bp, Homo sapiens
atctaggaatgttacagagattagatttcactcctagtcttcctttatcatcactgtcttttggagtcttgtgggccaatagagcgacaagtatgggcaamctgtgatgagatccatagaccaagataaaggctgttgctgttttcagcacgttattttttccccctgcaaaatgaaaaacaaaacaaaaacccttttact

SEQ ID NO: 22499 - DNA, 201 bp, Homo sapiens
atggatccccactgggacctcgactcagattatggggactggagttgtaaacatccaatgacctgtgctctagaaggactaaggagaattaggaaaaagcycatgaattattcaatgatgtccaccataactcagggaaaggaagaaaatccttctgccttcctcaagtggctatgggaggccttaagaaaatatactccc

SEQ ID NO: 22500 - DNA, 201 bp, Homo sapiens
ggaaccaagttggcaataaaaggtcatagaaaagacacttctgctatatcagtaactaataactaaagcaggaatagtagtaagttggttttaaaaatacratatatggcttttattttcacttagggaggtatataagtaattgttcatttttaaaggccatatcaagacaccttgaaaatatattttgcctgttaaccc

SEQ ID NO: 22501 - DNA, 201 bp, Homo sapiens
aataaaaggtcatagaaaagacacttctgctatatcagtaactaataactaaagcaggaatagtagtaagttggttttaaaaatacaatatatggcttttrttttcacttagggaggtatataagtaattgttcatttttaaaggccatatcaagacaccttgaaaatatattttgcctgttaaccctgttatgtttaaaa

SEQ ID NO: 22502 - DNA, 201 bp, Homo sapiens
cctgtctcaaaacaaaacgaaacaaaacaaaacaaaaaggtgcataaaaatgcagcatcttcatataactctacttatcagaatgtaagaatataacatgyaggaacaatggtgcaggagtcgggtagacctaagtgtctatttatcttctgccaattattcattttgtggttttgggaaatgttagtctgtaaaatggga

SEQ ID NO: 22503 - DNA, 201 bp, Homo sapiens
gactggaggcttcagagggaagaatctgcaatttactacatttcgtgttcctatcatcttatagatggctaatatgtaaagggcacatgcagaatattagkggaatgcattctagattagggaagagacaggagttttactagtcaatgaaagatagaatttcaggtctatagaatgtttaccttgggagaggagaagaag

SEQ ID NO: 22504 - DNA, 201 bp, Homo sapiens
agattcttcagcagggtgcggtggctcacgcctgtaatcccaggactttgggaggccgaggtgggcagatcacctgaggtcaagagttcgagaccagcctmtacctctagaaaagagacttctgctaaatcagtaactaatcaattggtttcaccacatggtgaaaacccatctctactaaaaaaagaaataaaaaattag

SEQ ID NO: 22505 - DNA, 201 bp, Homo sapiens
tctgcaatttactacatttcgtgttcctatcatcttatagatggctaatatgtaaagggcacatgcagaatattaggggaatgcattctagattagggaasagacaggagttttactagtcaatgaaagatagaatttcaggtctatagaatgtttaccttgggagaggagaagaagagaggttatctaccatatagatct

SEQ ID NO: 22506 - DNA, 201 bp, Homo sapiens
gagaattgcttgaacctgggaggcggaggttgcagtgagctgagatcatgccactgcagtccagcctgggtgacagagtgagactccatctcaaaaaaaamaaaaacaaaaataaaaaagattcttaaacattgttgggaggtgttgggacaggtggcaaagtaaacttttagtaatgaagtctcctggatcaaatgctca

SEQ ID NO: 22507 - DNA, 201 bp, Homo sapiens
gcagacagtctgacttgcctattgatctgagctagagttgagtgaatgagctggatgtaaaattccctaactcatcactaaaagtcagtcagaccttgaasgacggttactttcttttttttttctaacatgggtgacaatgagcaattgaatgcttagattgggagctgagagattatctttactttgttgagtaataaa

SEQ ID NO: 22508 - DNA, 201 bp, Homo sapiens
caaatgctcaaatatgtgtatgaactgttttaaagttccataatcctcaagagtctaattaaattctctatacaaatattctatgtaaagatgggaggacmaagaggaaagaaaacaatatgagaaggaaagtagagagagatgcggggaatataaatgtctatgggggggatggataattcaatttctctttaattttaa

SEQ ID NO: 22509 - DNA, 201 bp, Homo sapiens
aggctcacctcgagggaccaaagataagaatcaccggtaaaataaccggaatctccattttattttctttgtgcaatagcaacatccattattatttccayacctgaaacctttactcctgtccactgaggtctctttctcaggtgagaataatacttttccaagacaaagtgagaatcttctcccctcagacttcatccc

SEQ ID NO: 22510 - DNA, 201 bp, Homo sapiens
ggtatatctcctaatgctatccctccaccctccccccaccccacaacagtccccggtgtgtgatgttccccttcctgtgtccatgtgttctcattgttcarttcccacctatgagtgagaacatgcggtgtttggttttttgtccttgtgatagtttgctgagaatgatggtttccagcttcatccatgtccctacaaagg

SEQ ID NO: 22511 - DNA, 201 bp, Homo sapiens
taaatcagggttctttctcttgatatgggaatagtttctgaaacctcatgaattccatttcattatctacactttaagtcccgtaattcaggcatatgttrgagactttttgagggaataaaagaaaatgaaaaaaggtgcatgagcataagattaaattattgctttgtggaatccacgtgtaatgaaacaagtgaacat

SEQ ID NO: 22512 - DNA, 201 bp, Homo sapiens
ggactcctctaccctcctcctcccctagctcccatgctcagatcatagaagttcccattaagctgcagagataaggctaaagcagctttaacaatgacaasggcttaaaacaacattgcttatttgattatcattggacttaaatcttctagtaacaaagcacccactgctagcttacgcatagtgtaataattaccacat

SEQ ID NO: 22513 - DNA, 201 bp, Homo sapiens
ttcatcttgtttttttcttgattattgtgatttcatatcttctcactcataatggacataatatggtagaaaatatatacaaatcaggatagttcaattartgaacatttgagtttcatttaaactgttttaagaaagtcatgtagtaataggtaactgatcttaaaataccctagcacagaattttaaaaattccttata

SEQ ID NO: 22514 - DNA, 201 bp, Homo sapiens
cttttttcagttttggcaatttttttctcaagaaactcatctgtactttcagaatattttcttactatgttttagtgttcgtaggctctgtagtgatgtcrtctcttttcattcctgatattgataatttatgttatcttttttaccttgataagtcttaccaaggatttgttagttttactaatgttttcaaaattccaa

SEQ ID NO: 22515 - DNA, 201 bp, Homo sapiens
ataaagttatgctgccatctaactttgatcccagtaagaaaagtaatttgaatagacaaaattgaccatattaaaatattctttagttcattgactcctcrgtggtttatatagtatagaatttgcaattacaacaaaattatagagagattgacatgattacatcatagattaaaaaccaacaattagaaaaggatttct

SEQ ID NO: 22516 - DNA, 201 bp, Homo sapiens
tatggggactggagttgtaaacatccaatgacctgtgctctagaaggactaaggagaattaggaaaaagcccatgaattattcaatgatgtccaccataastcagggaaaggaagaaaatccttctgccttcctcaagtggctatgggaggccttaagaaaatatactcccctgtcacctgactcactcgagggtcaattg

SEQ ID NO: 22517 - DNA, 201 bp, Homo sapiens
attcaatgatgtccaccataactcagggaaaggaagaaaatccttctgccttcctcaagtggctatgggaggccttaagaaaatatactcccctgtcaccygactcactcgagggtcaattgatcctaaaagataagtttattacccaatcagctgcagatatcaggagagggctccagaagcgagccctgggtcctgaac

SEQ ID NO: 22518 - DNA, 201 bp, Homo sapiens
ggccttaagaaaatatactcccctgtcacctgactcactcgagggtcaattgatcctaaaagataagtttattacccaatcagctgcagatatcaggagarggctccagaagcgagccctgggtcctgaacaaaatctggaggcattattaaacctggtaacctcggtgttctataatagggatcaagaggaacagaccca

SEQ ID NO: 22519 - DNA, 201 bp, Homo sapiens
cccaaggaggtggcagtcttacactgctgaagccatcaaaaaggggaaggagagaggagaacagcagcataagtggctggcagaggcagggaaagaccagmagaaaggaaagaaagagacagaaagtcagacagagagacagagagaggaagagagagacaaagagggagtcagagagaaagagaaagaaagagaaggaga

SEQ ID NO: 22520 - DNA, 201 bp, Homo sapiens
cacccgagctagcagcggcaacctgctcgggtccccttccacgctgtggaagctttgttctctcactcttcacaataaatcttgctgctgctcactctggkttcacactacctttatgagctgtaacactcactgtgaaggtttgcggcttcattcctgaagtcagcaagaccacgaacccaccgggaggaacaaataact

SEQ ID NO: 22521 - DNA, 201 bp, Homo sapiens
agacatttaatgttcatggattagaagacaatattgttaagatggcaatactccctaaagtgagctaaagattcaattcaatccccataaaaatcacagcrggctcttttaaaaaaatacataagctgatcgtaaaattcatatgaatatgcaagggaaccagaataaccaaaatgttcttgaaaaattacaaagttgaag

SEQ ID NO: 22522 - DNA, 201 bp, Homo sapiens
gacacatctgaacatctgaacaaactctggacacaccatctttaagaactgtaacactcactgtgagggtccgtggcttcattcttgaaatcagcgagacmaagaacccaccagaaggaataaattccagacacactactgtcttagagtgatctagccctggaacatgtagtgcttgtgggtctcatagcagtagttctc

SEQ ID NO: 22523 - DNA, 201 bp, Homo sapiens
acacacccataggatagctataataaaaagagtcagataatggtgtggacaaggatgtggagaaattggaacctttatacactcctggtggagatgtaaamtggtacagccaccttgaaaaacagttggcagttcctcaaaaagttaaacatagagatactatctgatccagcaattctacttttagatatattctcaagg

SEQ ID NO: 22524 - DNA, 201 bp, Homo sapiens
gactacaggtgtgtaccactgcacctggcatttttttttttttagtagagttgaggtcttgctatgttgcccagtctgatcttgaacttctgagctcaagmagtcctcctgccttggcctcccaaagtgatgggattacaggtgtgagccactgcacctggcccaagtgggtagattcaacctaagtcaactcatggatcc

SEQ ID NO: 22525 - DNA, 201 bp, Homo sapiens
agcacccactgctagcttacgcatagtgtaataattaccacattttgttggaaattcaagtgtggctatgaaagaaatgccactgtattatattatataamtacgctttttatggatagaagacatattgccctttgtaagataataataatgatcatagactgtgaggtgtggacactggattgcgtgtggggttatata

SEQ ID NO: 22526 - DNA, 201 bp, Homo sapiens
cctcctcctatgcccactgcatacaagcactacctggagcttacagaggtgaagtcacttcctgtctgtaagtaggacataggcgaggaggggagatgaastatgcaggaagtaggacccagagattaagatgtcattatgtaaaataggatttttttttttttttttttttgagatggagcctcactctgtcacccaggc

SEQ ID NO: 22527 - DNA, 201 bp, Homo sapiens
ctacaggtgtgtaccactgcacctggcatttttttttttttagtagagttgaggtcttgctatgttgcccagtctgatcttgaacttctgagctcaagcartcctcctgccttggcctcccaaagtgatgggattacaggtgtgagccactgcacctggcccaagtgggtagattcaacctaagtcaactcatggatccgt

SEQ ID NO: 22528 - DNA, 201 bp, Homo sapiens
tcagcctcctgagtagctgggattacaggagcatgccaacatgcctggctaattttggtatttttagtagagacggggttttgccatgttggccaggatgrtctcgaactcctgacctcaggtgatccacccgcctcagccccgcaaagcgctgcgattacaggcatgagccaccgtgcccggccgaaatgggaccatttt

SEQ ID NO: 22529 - DNA, 201 bp, Homo sapiens
cacctggcatttttttttttttagtagagttgaggtcttgctatgttgcccagtctgatcttgaacttctgagctcaagcagtcctcctgccttggcctcmcaaagtgatgggattacaggtgtgagccactgcacctggcccaagtgggtagattcaacctaagtcaactcatggatccgttaaatgcagggattggatt

SEQ ID NO: 22530 - DNA, 201 bp, Homo sapiens
ggcccaagtgggtagattcaacctaagtcaactcatggatccgttaaatgcagggattggattgattcatctctataatacagatgatctgtagtattccrtgattctgaaacacatgattctaactagagacagtgtgaaaagagacagaaaggtcaggagaatcctgggaaatggcccagaatttcaagggctggggca

SEQ ID NO: 22531 - DNA, 201 bp, Homo sapiens
ggttggcgaggtgccagaaccaattttctttcactattgatgagtaagaagacaattcttaggaggtgttcaaatccagttttgtgtcctggttctgctcracgatctcactgctatcacaattccacgtcaaaagggggaggcttgtccaaaactgtgctagagtcagactttggggcaaggttagccatagaatttgta

SEQ ID NO: 22532 - DNA, 201 bp, Homo sapiens
gtctagtagctcttgcctgggtgtgtcattagagtatcttgcggccttgacctaaacagaggtatccagctccattatgccctgcagcaactgaatctccrgggatgccatatgttgagtcatggaaaacatgggctccgttagtcaaagactgcctgtgtttgaatccgagggcatcttttgttttatgagatagtcatc

SEQ ID NO: 22533 - DNA, 201 bp, Homo sapiens
atgagaacttgagcttaaagaggttgaataacttgcccaagatcgcatagctttacagatagccagaattgaaacccaagtttcttggcaagtttcttctygccaagaaaccccacacacctattgccccatgtagtgatttttggtttagtggttttctgcgtgtatatatttagatcttgtaaaactggaaagaaatgg

SEQ ID NO: 22534 - DNA, 201 bp, Homo sapiens
tttcttggcaagtttcttctcgccaagaaaccccacacacctattgccccatgtagtgatttttggtttagtggttttctgcgtgtatatatttagatctygtaaaactggaaagaaatggaaaaaaaaaacctataaagactttttccctcttagttctcaggggcaagcacaatttgcaagcaatcacattttgaaggt

SEQ ID NO: 22535 - DNA, 201 bp, Homo sapiens
aatatatgctgcttataaaatatcactacaaaaatatggaaaaaatagaaaaaaatacctttgatcttatcacacagaggaccatgatgaacatttgggcrtttttttcttccaactttttttcatgtacacattttgccatgcacaaatatgataattttcttaggcagagtcttagaagaggattctacttaaatcaaa

SEQ ID NO: 22536 - DNA, 201 bp, Homo sapiens
caggtatttctgaatccaaatgcaaatgttttttgatctacacgtggaacatttttcccctttgcaagtgaaggtgacttctgcatgtattttcagaaaaygcttcattcttaactgtataaaaagacaaagcttttccgaccaatgtcatcattcaaattgtctccattttaatgtatataccttagagaagaaagtgta

SEQ ID NO: 22537 - DNA, 201 bp, Homo sapiens
tacacctgggtcttcccactgccaggcctgtccaccaggtgctgcctcggttcaatgtcaacctcctgaccccagcacagggaacacagacataggaatayggaatctagtgctccatttaaaatatgatttctggctgagtgcagttgctcatgcctgtaatcccagcactttgggaggctgaggtgggcagatcacatg

SEQ ID NO: 22538 - DNA, 201 bp, Homo sapiens
cttgaactctctaggccacagttttctcatctgtaaaattaaggaattggatttggtaatcttcgagagatgacttctggctttaatcatctatgaacatmattttaatttggtgcatgaataaactggctgtatcttagataacatataatacaggcagggcctcctgaaaatgtggaaatctttgtaatgatatgcaaa

SEQ ID NO: 22539 - DNA, 201 bp, Homo sapiens
tggccaacatggtgaaaccctgtctctactaaaaagacaaaaattagctgggcatggtggtgcatgcttgtaatcctagctactcgggaggctgaggcacsagaatcgcttgaacctgggaagcggagattgcagtgagctgagatcgcaccattgcactccagcctaggcaacagagtgagactctgtcttaaaaaaata

SEQ ID NO: 22540 - DNA, 201 bp, Homo sapiens
tgccaatcttttcatttttagccactggcagttgcatagcagtatctgatggttttattttgcatttccctgatgactaatagtgctgagtccttttcacrtgctttttgacaattcatttattttcttttgtgaggtgttcattaaaaccatatggttcatttttgtttgtttcttattaatgagtcatatgttgtatat

SEQ ID NO: 22541 - DNA, 201 bp, Homo sapiens
gcttggttgggaaaggtttcagccaaccttaaatgatgggtaagagtgtatatgttaaactgtgtattggcaggggttgttgggtggcgggttaggtaaarggtaaagcatttcagacaaagtgaatggtgtaaatatcattggaacacatcaagaactgtagtttacttttgtgccagcaacagaaaagaagcttggtga

SEQ ID NO: 22542 - DNA, 201 bp, Homo sapiens
cttattcttcaccccgtggtggaggtacctgctttgtcatttctcataaatgcatgctttggtgaaaaccactttaaagggagcttatgaaaaggcaagaytgaattatttctaggccctcctgcagtggatcctaatttttaatgtttatggtaatttgcaaggattagaaaaacgtaacactttcaagacttaaagggt

SEQ ID NO: 22543 - DNA, 201 bp, Homo sapiens
ggttttggaaacataattctactgaatcaaaatttatccataattttacacaattatcttttcccacagaatcaaaatttatccataattttatgtaattrtctgaaagtggaattaaaagtcacaaaattattaactgtatacacaatatcccttgaattaactgaaagagtaataacatttaaccttgattatgtatga

SEQ ID NO: 22544 - DNA, 201 bp, Homo sapiens
ttttgttgaaaactcagctcaagaaaatgccaccattggattgaagactttttttctgtaatttcacattttcctttcttctttaaatcctttctactctrtctattcgcttggtacttcctgatgactaactagagggagaacggagcctttactgtgaatttcatgcagacttttgaatgttcaacaaagccatgttgt

SEQ ID NO: 22545 - DNA, 201 bp, Homo sapiens
  misc_feature (1)...(201): n = A,T,C or G, or insertion/deletion polymorphism (see Tables 1-2)
agcgagactccttctcaaaaaaaaaaaaaaaaaaaaaaaaaagaaggtctttaagagaagtttgaatgggccagagacaaagctacttatagttttgaccntggtgggtattgctctaccccttgtttcctccctcgtctgcatggtgttcttttgtttgatacagtgcagaatccatggaatttaacatacaaagtgtgt

SEQ ID NO: 22546 - DNA, 201 bp, Homo sapiens
acacacgcagtgcaatcctacaaattggagcacaaaccaaaataggactcatgatcttgccgagcgttgcacgtataacagtgtgctgggcaccataatcrtgatttggtaaagcgtaatggagaaagctacagaaaggaggatgcttttgaattgggctttaaaggaggctttggcagaaagagggggggaggaaagaga

SEQ ID NO: 22547 - DNA, 201 bp, Homo sapiens
gcacaaaccaaaataggactcatgatcttgccgagcgttgcacgtataacagtgtgctgggcaccataatcgtgatttggtaaagcgtaatggagaaagcyacagaaaggaggatgcttttgaattgggctttaaaggaggctttggcagaaagagggggggaggaaagagatgaaacatttccaggacctgaactccatt

SEQ ID NO: 22548 - DNA, 201 bp, Homo sapiens
agccatggggccaaaataaatttaaaaattactctcaatgctcaagacacacacacacaccacacacacacacacacacggggagggactctacagccacrggactaaataaatgtaaaaattactctcagtgctcaagagacacaccacacacacacacacacacacacacacaccacacacgggcagggactctacagc

SEQ ID NO: 22549 - DNA, 201 bp, Homo sapiens
ggctaaataaatgtaaaaattactctcaatgctcaagtgtaattgtaattttttttttgagacgaggtgtcattctatttcccaggctagagtgcagtggygcaatctcagctcactgcagcctcagccttttgataaggtgatcctcccacctcatcctcttgagtagctgggactacaggggtgcaccacttcacccag

SEQ ID NO: 22550 - DNA, 201 bp, Homo sapiens
ttttttatggtaagatattttatatttttagaatgtattttttatccgtagcatcaaatagagatctggcttggtatttttgctcaaataagtggacccarttccatttcttgaataatcatgtctcttgctatttcaagataccacctttattttttattaatttgtcatatacttgcatatatagaaaagaacatatat

SEQ ID NO: 22551 - DNA, 201 bp, Homo sapiens
tcgtgccctggccaggtcaagtggctttaaactcctagcctcttttcctcagaatcctatcaccttgcaatcccttccccctgccccaccctccccactgsactcttttctaaactgtgcagtacgatctccaaacaccaagcagagagttcaaacttggcagcgacatcatttcctgagcactgcttctgaggaagagtt

SEQ ID NO: 22552 - DNA, 201 bp, Homo sapiens
cagcagggtttttctatccatctttaacagttcttgctgatggaggaatgtagttaactgccacattgatttccttgtattatttcaaccattgtgcagtrgtagaaagaacatatatttctgcaatgagatgtggctttttgctattaagtgagaaatctggaaaactctctggatattaaatttagtaaaattttgtaa

SEQ ID NO: 22553 - DNA, 201 bp, Homo sapiens
tggctttaagaaaacggatctacaacgaggctttatctgtgggctctttctgaacatggccatgcagacatgagacaaagtaacattgcagggccttttaygcgggtcctcaaagagggccccaccctggaaataaagaaatggccacagttgccctgtctctaatcggttcatggtattcagccttgacagcattgtcca

SEQ ID NO: 22554 - DNA, 201 bp, Homo sapiens
aaaaattaggtgaggttttgggccagagaaagagactttggaataaactacatgttggtgaatttggagttgtgagcatgatgaaatatatatccaaaacygtgcaaggtatttttaggcatatgaaagaaataccacgttagtctttgtcttcaagctgagcatgatcagttaggaagcaggtgtagaaaactaacagaa

SEQ ID NO: 22555 - DNA, 201 bp, Homo sapiens
tcatcagaagtgtgggagaagttttggtgctggtattttgttgatgtccccatatatttatgttactatattatcttcaatctgtggttttattgcaaacrtcttttagagacttaagttcattctgtgatagctatttagcctgtttaaaactggcagcatgcaatctgcacatccacataactggggacatgtggcctg

SEQ ID NO: 22556 - DNA, 201 bp, Homo sapiens
cgaggaatagcggtctgcagagacaagacaactgatgatccaaggtgagtaacattctgatgaatcctcagcaaagacactcaagggctatgtggccagtkctgtgataaatcctggcacagaaaatattagatcaattgccgcattctctcttcctaataatttcttcaaagttataactttgaaatacagactcatgat

SEQ ID NO: 22557 - DNA, 201 bp, Homo sapiens
ctgcacatccacataactggggacatgtggcctgcctgtgtaagccacactcctgtacaggtgtgctgtaggcagcctacacacgaggggagtgcttgctstctgggctcccctcattctagctgtgtgtgtgtgtccttggccgggacaggctgtctgtgtactggcttcatctgtaaagtggggattataagagagtac

SEQ ID NO: 22558 - DNA, 201 bp, Homo sapiens
aaacctattaataacaagtagactactagaaaatacttacatataaacacatatatatttgtagcacctgttaaatatatcagtaggccaggcgtggtggytcatgcctgtaatcccaacactttgggagggtgaggcgggtgcatcacgagccaggagatcaagaccagcctgaccgacatggtgaaacactgtctctac

SEQ ID NO: 22559 - DNA, 201 bp, Homo sapiens
tggctcatgcctgtaatcccaacactttgggagggtgaggcgggtgcatcacgagccaggagatcaagaccagcctgaccgacatggtgaaacactgtctytactgcaaaaagttagccaggtgtggtggcgcgtgcctgtaatcccagctactcaggaggctgagaccggagaatcacttgaacccgggaggcagaggtt

SEQ ID NO: 22560 - DNA, 201 bp, Homo sapiens
tatttgcaggggcatcaatttccttgaatgaatggcttgaattgaacacaaccacggagttggtattttgcaagggaagtttgaaggaaagacacgaagcragggagttggagctcatcaaagggatttgcaatttagagtttcagagatgggggagttggaagtatgacagaattcaggatgtgactgtaagtggatgag

SEQ ID NO: 22561 - DNA, 201 bp, Homo sapiens
aattatttttaaatatataattatatattattttatatataataattatataattattatatattatatatctccatggcactacattcctattatttggrttgattaaagtttagtgtctatccatttgttttatggtattatgtgttttttttccccttaggacactgtctctggttatttttgtaagtgtgactcagg

SEQ ID NO: 22562 - DNA, 201 bp, Homo sapiens
cccagctagagaaactgtgtagtagtgtgaatgtaagcaatgagattaaatcttcaggaaacacaatgaaagtcatttttttcacggatggatccaggccrtatggcggcttcactgcttcctatacctccagtgaagatgcaggtaatgtaggatgttgtaaatgccccccattttaatcaggggcactgcagatgcccc

SEQ ID NO: 22563 - DNA, 201 bp, Homo sapiens
acttctttgctagccagaattagtccagagttgcacttctcttcactgtctcctttatatgaagagagcatataaagaattcaacaaatgctacatttttygggggaacaagacatctcatgggtgtccagattgttgaaacagtctccccgtcgccactcctgtagatctcttttggtacattagtgtttatagatttcc

SEQ ID NO: 22564 - DNA, 201 bp, Homo sapiens
tataattatatattattttatatataataattatataattattatatattatatatctccatggcactacattcctattatttgggttgattaaagtttaktgtctatccatttgttttatggtattatgtgttttttttccccttaggacactgtctctggttatttttgtaagtgtgactcaggttggacaggtgtcaa

SEQ ID NO: 22565 - DNA, 201 bp, Homo sapiens
cccttttccttatcgggcaccttgaccactatcatcttccattaaatcatttccttattccttccccttttccactaaagtccatttcaagtcctcgtgayagtgtgggggacttcagtcaaaggcatttccctccagtctttataacatgcatttcatctcttgccaaatccttgctgatgtcatcctgttcaccccaga

SEQ ID NO: 22566 - DNA, 201 bp, Homo sapiens
caacagattcctctgctgaacccactttcttgtccagttgctcagatactgagaactaagtctttccttgcagaaatggtataaaattcacaagctaaatmtttataaatctcactgtaagccaagaacttttcttccaaagaataaatacattagtatttgccattttcactatgtcctttttgaatataaaacatgcta

SEQ ID NO: 22567 - DNA, 201 bp, Homo sapiens
gagtcactggaattagaactgcctcagccagcactcttctatctggtgactaccatgggatgctaatgacaaagatgtagtaagtcctctagcactcgttygcaagagaatgtcttctaggcacccagacatatgatagaatgtgctaaattggtagtctctgtacctgcttcagagtgaagcaggtaacttcagaatgaa

SEQ ID NO: 22568 - DNA, 201 bp, Homo sapiens
tgcctgttaaatagagactgggattaattttcaatgatcttctataaccaagtctcactcaatccatctaaccttttttttcactagttccctagaaatamcttcactcaagcaagttttctttcgtcaccggaccccatgtaccaccatgagtattttccactgtgttcatttatttggaatgtttctcccgataaacct

SEQ ID NO: 22569 - DNA, 201 bp, Homo sapiens
gactaccatgggatgctaatgacaaagatgtagtaagtcctctagcactcgttcgcaagagaatgtcttctaggcacccagacatatgatagaatgtgctraattggtagtctctgtacctgcttcagagtgaagcaggtaacttcagaatgaagtttaaacccaaactccactacttagtagctaggtgaccttgggcaa

SEQ ID NO: 22570 - DNA, 201 bp, Homo sapiens
tcagaatgaagtttaaacccaaactccactacttagtagctaggtgaccttgggcaagttccttagtgtctatgtgcctcactttccctttctgtaaaacrgagtaataagagtcaatgaatccatatatgtaaagagccaaaacaaggtctggcaaatagagaacaaatctataaatgttcactgttattatttgcactg

SEQ ID NO: 22571 - DNA, 201 bp, Homo sapiens
ttatccaccatgatttgattttgcatttgcccccttgggctttgcttatccacaatggaagcgctgtatctcctctgtgattcttattatttatttatttwtttttttttttgagagaatcttgctctgtttcccaggctggagtgcagtggtgcgatctcggctcactgcaagctccacctcctggggttcaagtgattc

SEQ ID NO: 22572 - DNA, 201 bp, Homo sapiens
gtgcaatggaatagaatgagacttaaggctcaccttgacgttaagcagagaaagggtagggatagactagaaagaatgaaagtcagacagggatggggaaraggaaggggtagggttggcctgagaggaggagaatttgagctgcgatgcacaaagccaggggcatgtgttgtacttgtcaaacaggaaggggcacatctg

SEQ ID NO: 22573 - DNA, 201 bp, Homo sapiens
gaaggggcacatctggatcccacctacgaattggtggttcaggaagcaggtagggatcatcattcctctgaagatgaaaggtcttctttaacaagagatcygaaatgtcttcaaatctcaggtgggccaatctgcaagtggagagccccagagcagtggttcccaaaatgtggtccctagagagcagcgtcagcattacct

SEQ ID NO: 22574 - DNA, 201 bp, Homo sapiens; identical to SEQ ID NO: 3201

SEQ ID NO: 22575 - DNA, 201 bp, Homo sapiens
taggaggacaggcaagggtgcaggttttggagaatacattgataagggccactaaatctgaccttcctcagtcctccttgtggtctaggaggaaaactagygtttctgctgctgcgttggtgagtgcaactattctgatcagcagggtccagggactgttgcgggttcttgggcagagggagaaacaaaacaaaccaaaag

SEQ ID NO: 22576 - DNA, 201 bp, Homo sapiens
tgctctagaaggactaaggagaattaggaaaaagcccatgaattattcaatgatgtccaccataactcagggaaaggaagaaaatccttctgccttcctcragtggctatgggaggccttaagaaaatatactcccctgtcacctgactcactcgagggtcaattgatcctaaaagataagtttattacccaatcagctgc

SEQ ID NO: 22577 - DNA, 201 bp, Homo sapiens
ggcaaaaagcatagatagtcaatccttttacaggaagggaagtgaataactatgtaaaataatgccatccatcccagttcatgagcataaaggaaagaggtttttttttttttttttggtgggggtgcaaatttatcaagtcctagattattgaacgcaatacatgcttcagaggtagctagggtcactttagaacatttg

SEQ ID NO: 22578 - DNA, 201 bp, Homo sapiens
caaaataatgaaattgaaggaatgcaggataaataatatagattttaccacctaaatgtaatcttaaatttgtctgaagatattatgataaaaataaactrtcttgccatgtaaagagtgaatgaaaatatgattaaacgcttagtgcattggtttaattgacatctcattcactattactgttgttgatgttatcatttt

SEQ ID NO: 22579 - DNA, 201 bp, Homo sapiens
tttgagtatttatatgacatcttgaataggaatgtaaaggtcattatatagcggtccacagcattgatttctaagcttcttgtatctgttttccaagtcaytgacttcatgcaataacttattctttcactgttttttattgtatctctaccattgaaacccgatgctctactttatatccactgctgtatagaaattagt

SEQ ID NO: 22580 - DNA, 201 bp, Homo sapiens
gtatttatatgacatcttgaataggaatgtaaaggtcattatatagcggtccacagcattgatttctaagcttcttgtatctgttttccaagtcactgacktcatgcaataacttattctttcactgttttttattgtatctctaccattgaaacccgatgctctactttatatccactgctgtatagaaattagtcgaat

SEQ ID NO: 22581 - DNA, 201 bp, Homo sapiens
tgtgatacctggccctgtatttgctgctagttttctcaacaatagaccttttctgttttcatgaaaatcttacccttgaccaaccatcctctaaacctcargatgacaaataggaagtaataattacaagatggaatacagaaagtttacaaatgtgcactccttgaataccacacaaatagttgttaccattttgtacct

SEQ ID NO: 22582 - DNA, 201 bp, Homo sapiens
ttcttggtgtctgggaccaaatttccctcttcgtataaggataccaagaatattggatttcagttccaccccaatccagtatgatctcattttaacttgaytgcatctgccaaggccctttcctccaaaaaggtcacagtcacaggttcctggtaggcataagtctcgggggacagtgttcaacccaatacagggacaact

SEQ ID NO: 22583 - DNA, 201 bp, Homo sapiens
cctccaaaaaggtcacagtcacaggttcctggtaggcataagtctcgggggacagtgttcaacccaatacagggacaactctctcctctcctggagtcacratgttttgtcctcttcttccttttcactctcttctttcttccttcttttttctcaaggaaattttatgttccttggcctttatattacttgattttcttc

SEQ ID NO: 22584 - DNA, 201 bp, Homo sapiens
ttccttttcactctcttctttcttccttcttttttctcaaggaaattttatgttccttggcctttatattacttgattttcttctttgatttcatctcgtsatcactccagtttgtgtccccttcctcacagaatacatgctatctgactaaatccctcagaaaaatccatctgcacatgcttcatgtccttatgaatttg

SEQ ID NO: 22585 - DNA, 201 bp, Homo sapiens
ttatgaatttgaggagctccacccttggccttgtgttcagagaggactagtgaccctagtaggacagatgcctatcacttggccacatacctgtgaaatgytggggaattaactggtaacatcaaaccaggaattactgactttttgtggttctcattacatgccagtcacctttggacaactttggccattttaaggagc

SEQ ID NO: 22586 - DNA, 201 bp, Homo sapiens
cctgcctttgcctccctaagtgctgggattacaggcatgagccactgcgcccagcccacaagccgcctttttacacaatgaaggcaaactggccttgccartgaagcacatctcaaggtcttatagagcagaaagagtttttattgttaagttatagaaaaaaagctattaaaatataaattgagcattttaatgaagcac

SEQ ID NO: 22587 - DNA, 201 bp, Homo sapiens
ggagcaggccaatcacctgggagggcttgttatcagtgtggtttacaaggacactttaaaaaagattgtccagtgagaaacaagccgccccctcgtccatrtccactatgctgaggcaatcactggaaggtgcactgcccctgagtgcagtggttctctgggcaagaagtccccaaccagatgatccaacaacaggactga

SEQ ID NO: 22588 - DNA, 201 bp, Homo sapiens
atattaaccatccaaatgagtcttcagagtctaagttggctaagcatcatgcagactgaaagcgtagaacatccagctactctcctgacaaagaccatttygaaattttggatgacatttacaaacatctttctaaaagtagccagtggttcatgaggtagtgtgaagtttctgagtgaatatctgagagaggtgtgagtc

SEQ ID NO: 22589 - DNA, 201 bp, Homo sapiens
tttacaaggacactttaaaaaagattgtccagtgagaaacaagccgccccctcgtccatgtccactatgctgaggcaatcactggaaggtgcactgccccwgagtgcagtggttctctgggcaagaagtccccaaccagatgatccaacaacaggactgagggtgcccagggcaagtgccagctcatgttatgacccttat

SEQ ID NO: 22590 - DNA, 201 bp, Homo sapiens
tataatttttcatgtgtaatagccgattaaataagagagttccctgacctccgttacaggacattcaacaggggtgtgtctcatctgttcaagtgctgcakgttcaaaccccttatgggcagggaaacatgcagacaggggtgcaggagccggggagagtgcttctggactccgggccccatggtagcatctaggggtggg

SEQ ID NO: 22591 - DNA, 201 bp, Homo sapiens
cctacttgaggttggaagctgggaggagggagcaagttgaaaacctacccatcacgttctttgctcattacctgggtgacaaaatagactgtacaccaaasccccatgacaggcaatttacctctatagcaaacctgcacatggacccttgaacctaaggtgaaaggtttttagaaaaagaagtcagggtcaggacttgcc

SEQ ID NO: 22592 - DNA, 201 bp, Homo sapiens
gattgtccagtgagaaacaagccgccccctcgtccatgtccactatgctgaggcaatcactggaaggtgcactgcccctgagtgcagtggttctctgggcmagaagtccccaaccagatgatccaacaacaggactgagggtgcccagggcaagtgccagctcatgttatgacccttattgagccccggttacatttaacc

SEQ ID NO: 22593 - DNA, 201 bp, Homo sapiens
ccaggtatttctcctacctcctcagttgtaattgggagactttgctcttttcacatgccttcttgttatgcctgaaagtcccacacccttattagggaggratatattagccaaagctggagctattatctacatgaatatggggaacaatttacccatttgttttcccctacttgaggagggaatcaaccctggagtctg

SEQ ID NO: 22594 - DNA, 201 bp, Homo sapiens
gagggtgagtaagctgggctctaggagaagatctgctggacccagcctataatgaacaggcagctacaactgtgaatcatgttaattacatgattatttayatgtcaattacacataacctctgccagcagatattttttgagaagaagtttttcattcattcaaccaaccatccagcatatattttgggcttgttgtcta

SEQ ID NO: 22595 - DNA, 201 bp, Homo sapiens
tgttaattacatgattatttatatgtcaattacacataacctctgccagcagatattttttgagaagaagtttttcattcattcaaccaaccatccagcayatattttgggcttgttgtctaaatatagagagtattaatttgcttgggctgtcgtaacaaaaatgccacagattgggaggcttaagcagcagaagtgtgc

SEQ ID NO: 22596 - DNA, 201 bp, Homo sapiens
ttgcctctttttaaaggccctatccccgaggacagtcacattctgaggtctgggagttagaacttcaacatatgaattttggcagagatacaattcagccyataccagaaaggaaggagatcacattcttgactttggggagttagtcatagagtaggcaaggcaggtaaaccaagtgtagaaatatatacataatccagg

SEQ ID NO: 22597 - DNA, 201 bp, Homo sapiens
aagttgggatagtgactaagaaaatcccacagctcttttggccttgacttcagagtttctccagcaaggtcccaatgatcagaggcagcattaaagctgtrcatatgcagacctttcagaatgagtggaaaagctcactcctgacatttctgcctccttgacgacagcagtaaatacacatccacacagttgaccttcatc

SEQ ID NO: 22598 - DNA, 201 bp, Homo sapiens
ttgaccctgtgtaccaaaataatgaaattgaaggaatgcaggataaataatatagattttaccacctaaatgtaatcttaaatttgtctgaagatattatsataaaaataaactatcttgccatgtaaagagtgaatgaaaatatgattaaacgcttagtgcattggtttaattgacatctcattcactattactgttgtt

SEQ ID NO: 22599 - DNA, 201 bp, Homo sapiens
tagattttaccacctaaatgtaatcttaaatttgtctgaagatattatgataaaaataaactatcttgccatgtaaagagtgaatgaaaatatgattaaaygcttagtgcattggtttaattgacatctcattcactattactgttgttgatgttatcattttaaaacatgactcaacatgtgtaatttaaaaatatgatc

SEQ ID NO: 22600 - DNA, 201 bp, Homo sapiens
ctgaaggagaagcaaaaagggtttaataacttgcaagaagacatgtgggcaataacactttttatgtctataaatgtctttctttttttcaagagatattmaatatgcttggcttctatagcactgcttgtattatgggcagatgctcaataaacacttatgagtgaatgaaggaataaataaatggaactgggaagctat

SEQ ID NO: 22601 - DNA, 201 bp, Homo sapiens
agaaccatctgagctgaaaatgcaagttgagaaaaaaatttcagtaacaggctttgcttacctgtaatgtattttagtaaaaggtggtacatcttaacacragttacatgaggcactgtgttgtaccactccggaagcatcctgttatagaatgtcctgtgagcggtgctccctggagttgggcattggtacaggagatac

SEQ ID NO: 22602 - DNA, 201 bp, Homo sapiens
tcaagaagatagtagtgctttgagctagagtcagatttctctgccgaatcaagattcttagaattctcagtgcttctcagtgcagtggggaattctgcacrgagattttttttttaactccttaacttttaaaagcttttcttctaactcactgtacaggaggaatttgcatagagtggacagtagacaagatctcagact

SEQ ID NO: 22603 - DNA, 201 bp, Homo sapiens
atgatttttttctcattgttttataactgcataattataactttattgtaacttaacggttttctcctaaattaagcattgtatatttttgatggcctttyggtgagttgaatttggaattattttccacgggctgttgcccactttgaactgactgaacctttctgttttaacaggttgtggtggagagctgtctggggc

SEQ ID NO: 22604 - DNA, 201 bp, Homo sapiens
tcaaaactaacgctcaaaaaggttaatgggcttttccatgaccacatggaaggggagtggaagagctaataactgaagccagtcactgctcaacactccartaaatcctgagaccatagatgggtgcagggtgcaaggggtcgatacgaatagtatggacgttacaggaaactttaacaaaaactttaattataaaacaag

SEQ ID NO: 22605 - DNA, 201 bp, Homo sapiens
gctctacagacaatttactattgtaattgtaaatgaaatcagatagaactggaaagtcttcacggaaggactgttgccaagtcatgactccatctcagagragaaacaaggtgcctcctgaaattcacactcacagcacaaagtaggactagcatccatgtgcagaatgttcagatggcctcgctcgcctgcaaggatatt

SEQ ID NO: 22606 - DNA, 201 bp, Homo sapiens
tgttgatgttatcattttaaaacatgactcaacatgtgtaatttaaaaatatgatcttgagaagtgaagccagctggacttcctgggtccagtggggactyggagaacttttctgtctagcttgaagcattgtaaatgcgccagtcggcgctctgtggctagctaaaagtttgtaaatgcaccaatcagcactctgtaaaa

SEQ ID NO: 22607 - DNA, 201 bp, Homo sapiens
agggagaggcctgcaatgtaggtccctggaggctctttgagcttttccctgcaagagccctgtgtaccaaaataatgaaattgaaggaatgcaggtttgartaatatttctaaatagaagtatgactgttgaacttggaaactgcctacagagaacatgttttctctgtctttgtttgtttgagggatttcataaagaagc

SEQ ID NO: 22608 - DNA, 201 bp, Homo sapiens
ttacacagaaactccaaaattatggcttctttggatttctttctctttgatgatgtactaaagggaaacacatcagtatttagatctaggccatcttagakagtcagatggctatgacagtcttaactttgagtatttatatgacatcttgaataggaatgtaaaggtcattatatagcggtccacagcattgatttctaa

SEQ ID NO: 22609 - DNA, 201 bp, Homo sapiens
gaggccacgaggggaggctgcaagggaaggatggggaaatggtgcacgcacatttgggaataaaaaatgagagtgttgtccctggagcgtgaagaaatgcyggggagcatgtggagaccaaggggctacagaagacatctgagctctcttctgctccagttaagaatttgaaattatcctataggtagtatggagtcagtg

SEQ ID NO: 22610 - DNA, 201 bp, Homo sapiens
tgatgatgtactaaagggaaacacatcagtatttagatctaggccatcttagatagtcagatggctatgacagtcttaactttgagtatttatatgacatyttgaataggaatgtaaaggtcattatatagcggtccacagcattgatttctaagcttcttgtatctgttttccaagtcactgacttcatgcaataactta

SEQ ID NO: 22611 - DNA, 201 bp, Homo sapiens
aggatgaagtctccatggaacatgaaactttctaaacgttcattgactctccaacactaaaaatcgttatgacttaactccctggttcttgggtttacctrtttcttcctgatgtgatacctggccctgtatttgctgctagttttctcaacaatagaccttttctgttttcatgaaaatcttacccttgaccaaccatcc

SEQ ID NO: 22612 - DNA, 201 bp, Homo sapiens
ttatgacttaactccctggttcttgggtttacctgtttcttcctgatgtgatacctggccctgtatttgctgctagttttctcaacaatagaccttttctrttttcatgaaaatcttacccttgaccaaccatcctctaaacctcaagatgacaaataggaagtaataattacaagatggaatacagaaagtttacaaatg

SEQ ID NO: 22613 - DNA, 201 bp, Homo sapiens
tggtggaatggtttttttcacccctccctagctgctgataacatgttagtagtgggtttaaaagtttgttacccatgatgggcatgtgatctaaaaacttygctgactttctcagcctgcatgtgagtgtagtcaagtggggccttacagccactaagtattgggcttacctgggtttcacaaaatttattcagaagccat

SEQ ID NO: 22614 - DNA, 201 bp, Homo sapiens
aatgggttaaccaaaatcagtggagagttggtttttaaaaaaaaatggagaaatataagttgtgtgaagagggcaggtggaaaaagagcagctgaatgtgrgagccaggcgaacagtagagaaaatcatgttttcagcacagagacaccaagaagcgccagattggttctatgaatgttgtattttttagaataagaaatt

SEQ ID NO: 22615 - DNA, 201 bp, Homo sapiens
cccttatctaataaatggctaatataatttgtcttcagtaggatgactaacagctggatacccagtgcttaaaaatcaattgaaacaatacggctttaaakagctgagaattattaaaccaatgctatgaatcagtgctatttcacatctcttgctatggactgatttcccaatagaaatgtttttaatgacttgatgttt

SEQ ID NO: 22616 - DNA, 201 bp, Homo sapiens
ccttatctaataaatggctaatataatttgtcttcagtaggatgactaacagctggatacccagtgcttaaaaatcaattgaaacaatacggctttaaagwgctgagaattattaaaccaatgctatgaatcagtgctatttcacatctcttgctatggactgatttcccaatagaaatgtttttaatgacttgatgtttt

SEQ ID NO: 22617 - DNA, 201 bp, Homo sapiens
gaaatgtttttaatgacttgatgttttattgctgtgggtgaggaatatccttgagaagagatgtgtttggaatgagtaatttggtatcattccatgtgaaraaaatgttgaatagtcaagtaagattaatacacatccaactacatccttgtttgagatagttgtctgttgagagaaagggcatattgggtattgcagatt

SEQ ID NO: 22618 - DNA, 201 bp, Homo sapiens
cagcactttgggaggcctaggcaggcagatcatgaagtcaggaggtcgagaccatcctggccaacatggtgaaaccccatctctattaaaaatacaaaaaytagctgggtgtggtggtgtgtgcttgtaatcccagcgacttgggaggctgaggcatgagaatcgcttgaacccaggaggtggaggttgcagtgagccaag

SEQ ID NO: 22619 - DNA, 201 bp, Homo sapiens
tgtttggaatgagtaatttggtatcattccatgtgaagaaaatgttgaatagtcaagtaagattaatacacatccaactacatccttgtttgagatagttstctgttgagagaaagggcatattgggtattgcagattgcgtagcaatagtcctggcccctacccactagatactacccatcacaccgagtgtgacaatag

SEQ ID NO: 22620 - DNA, 201 bp, Homo sapiens
aaatgttgaatagtcaagtaagattaatacacatccaactacatccttgtttgagatagttgtctgttgagagaaagggcatattgggtattgcagattgygtagcaatagtcctggcccctacccactagatactacccatcacaccgagtgtgacaatagaaaaatgactacaaaccttgccagaggtcccaaaattgc

SEQ ID NO: 22621 - DNA, 201 bp, Homo sapiens
ccaggacaattgcttggtgtggacagttacctcagtctggcctctctgcgataggcttttgtgagctcagccttgcaagaagggaagtaaataatgtccamagtggcagtgtttattcttctagaggcttctgggtccagccaactcatacccattatgtttgtgatctcaaggggatgtttgagcagagaaaacaaagaa

SEQ ID NO: 22622 - DNA, 201 bp, Homo sapiens
ttaaccagctcagtgactcttggtacccgacttcctgtctggcatccaggaagaatcaggtcacacacggacttgaaggatggtgaatgtggggattttaytgggcgatggaggtagctgtcattggaatggatggggaactggaaaggggatggagtgtgaagatgatcttccccatagagtttcgctgtgctgtggatg

SEQ ID NO: 22623 - DNA, 201 bp, Homo sapiens
accatgatctctcacctgaactagggcaaaacctacctgactgttttccggcatcctttctgactcctattttccgaattgtaatgttttccaaaaaccartcttcttggtggctccttgctgtattcaggacagtggcccgagtctctaacgtgtcctgcagccccctctgcaggcttcctcaccccttcctccttggtt

SEQ ID NO: 22624 - DNA, 201 bp, Homo sapiens
gatgatcaactgtctgaccatccccggccaaactcctctcaacgttcagatgctccttctctctccttctctgccacgttgttcttctcctcctctgctcytctattcatctgcccatctgctcgtggagcctggagttggaggtttatatgggtacaggagatggggacgtggcaggccaaaaggcaacatctgggtgtg

SEQ ID NO: 22625 - DNA, 201 bp, Homo sapiens
tcggggttcgctcggggcaggctcacttcccccagttaggtaaagccaccaattatatattctcaacagccccatcataatgccttgtttatagctggaawtttgcatgtaaatttatgattctgtgattcatgtctctgtttttccctggactgataagaattggtttgatttggaattttggtgctcaccgtttatttc

SEQ ID NO: 22626 - DNA, 201 bp, Homo sapiens
ttcctagcaactgttttttgcatgagtatataaattcagtcattcgaggtggccagaccaattaagtgacagcccaggtctacttgggagttgccaaccaratttttggtgaatagcacacactgactggatgtcagcttttcatcaaaatggaccctacaattccacacagccaagaagtgttctgatttattccatttc

SEQ ID NO: 22627 - DNA, 201 bp, Homo sapiens
atgctccttctctctccttctctgccacgttgttcttctcctcctctgctcttctattcatctgcccatctgctcgtggagcctggagttggaggtttatrtgggtacaggagatggggacgtggcaggccaaaaggcaacatctgggtgtggaaacaagaatgcctgttcccgtttagggccgtgggtttccaggcttgg

SEQ ID NO: 22628 - DNA, 201 bp, Homo sapiens
catttctttttttaaaggtccccctaaaattcagaaaatcgacttaatattgtatgatctgtaatgtttctgctagagaaagcaggaaagcccacaaagamatgaaaaagacaaaaagaggagatagggaagattctggaataatctactccgtcctcctctgcaattctggctgatgaaacaagcaggcattttatgggt

SEQ ID NO: 22629 - DNA, 201 bp, Homo sapiens
ctcttgggtacccaagttcttgtccagtgtccaggaagaatcaggtcacacgaacaaattgaagggtggtgaatgtggataactttattaagaggtagaartggctctcagcaggaaggcgagcttgaaagaggttggaggaagtgggttgcaggagtctggccttccttggctgaactcctctctgaccatagtctccga

SEQ ID NO: 22630 - DNA, 201 bp, Homo sapiens
tgaggataatttctgtatattgggtggttattaaagttgtgggagtaggtatgatcacttttaggagtattttaccaagagaaaggggccaagccaactcytggggaaacactgccatgtaacgggtggatgaaagatcagaggagaggaggctgaggaggtgcgctgagtgcttggtggagaaccagaagagagtggtag

SEQ ID NO: 22631 - DNA, 201 bp, Homo sapiens
gatccaggcttgagggtggagcactcaccagggacctcaacctcttctaccaagcattttcctgccttctggcccatcactactaccaacacttttaatgmattcctacctgaaactaatgctttgcgcttcatataagagtgaatgaagttctattttgaagggtttttttttctttctgtttttaaattttttggctac

SEQ ID NO: 22632 - DNA, 201 bp, Homo sapiens
gcaaaaattttctcctattctgtagattgcctgttcactctggtgatagtttcttttgctatgaagaagctctttagtttaattagatgccatttgttaaytttggcttttgttaccattgctcttggtgtttaagtcatgaagtctttgcccatgcctatgtcctgaatggtattgcctgggttttcttctagggttttt

SEQ ID NO: 22633 - DNA, 201 bp, Homo sapiens
accaaaatcagtggagagttggtttttaaaaaaaaatggagaaatataagttgtgtgaagagggcaggtggaaaaagagcagctgaatgtgagagccaggsgaacagtagagaaaatcatgttttcagcacagagacaccaagaagcgccagattggttctatgaatgttgtattttttagaataagaaattgaaacccat

SEQ ID NO: 22634 - DNA, 201 bp, Homo sapiens
gcaggtggaaaaagagcagctgaatgtgagagccaggcgaacagtagagaaaatcatgttttcagcacagagacaccaagaagcgccagattggttctatkaatgttgtattttttagaataagaaattgaaacccatggcttggcacaagatttttctgatttataaattcattatgttaaaaattgcataaattgtata

SEQ ID NO: 22635 - DNA, 201 bp, Homo sapiens
aggggacaggaggtctgcagaggtttggaaccagaccaggcaatgccctggcaaggctggaagcttgttagttagttgtccagggattcatgaaggccggmgttgaagcaccagccctctatctttacagccagatggacactggacgggaaacgtaccccaaagtccaacatcttacataatatctctgcagtctcagtt

SEQ ID NO: 22636 - DNA, 201 bp, Homo sapiens
aggtttggaaccagaccaggcaatgccctggcaaggctggaagcttgttagttagttgtccagggattcatgaaggccggagttgaagcaccagccctctrtctttacagccagatggacactggacgggaaacgtaccccaaagtccaacatcttacataatatctctgcagtctcagttcatataaagccaatccttca

SEQ ID NO: 22637 - DNA, 201 bp, Homo sapiens
tttggaaccagaccaggcaatgccctggcaaggctggaagcttgttagttagttgtccagggattcatgaaggccggagttgaagcaccagccctctatcyttacagccagatggacactggacgggaaacgtaccccaaagtccaacatcttacataatatctctgcagtctcagttcatataaagccaatccttcattt

SEQ ID NO: 22638 - DNA, 201 bp, Homo sapiens
cctggcaaggctggaagcttgttagttagttgtccagggattcatgaaggccggagttgaagcaccagccctctatctttacagccagatggacactggaygggaaacgtaccccaaagtccaacatcttacataatatctctgcagtctcagttcatataaagccaatccttcattttggagacattcaagttaatgtcc

SEQ ID NO: 22639 - DNA, 201 bp, Homo sapiens
ccctcaccctcttcatggcttggggttcttagtttgcttatttagaaaatcaggtgcctggggaacagaagcagaaagaagaaaactaaggaagaggattsagttaggagttgcatttgtgggtaagaaaaggaggacaagatggcagatgaaatggccactgagggcccagtgacgtcagtggtggtttcatcctcaaag

SEQ ID NO: 22640 - DNA, 201 bp, Homo sapiens
tagctcagtgtgagagcaggaagaggaaagtccgttcagcagcaccagctggcccctggagattcctgacctctgcttccagcatcctctttgctcagatsattggaatgtctgctttgtgagaatcagcaaggagcagctcaaagcaagccgaccatggtccaggtcctgcctctcatttggaggaaaacacaaacgagg

SEQ ID NO: 22641 - DNA, 201 bp, Homo sapiens
aaagcaagccgaccatggtccaggtcctgcctctcatttggaggaaaacacaaacgagggctaacagagcctggtaccaaaaagcaaaagcaaaagcaatrtgattagtaacttctgaagctttttgtggctatctaggagaaagaaagaaaagtgtctgatgtgatccggaaaaaaaaaaaattccctgtgctcccaccc

SEQ ID NO: 22642 - DNA, 201 bp, Homo sapiens
tggagatcttaaaacagaagccacgtccattaaacttgatacattcctggcggcagcaagaggctagattaactggcgttagtagccatctggcttgggtrctgcagtgctgttatatgaatagtgccctttcatgtctgtatgtaatcacttatgcatccgagtgatgaaacactaaagaacttttaatatagattttat

SEQ ID NO: 22643 - DNA, 201 bp, Homo sapiens
tggctaaacctgggggtctaggggaggagtatgggggtctacggggaggatgagtcacctaatcccaagaagacacctttcttccaaatagcagtgagaasagaactgaattgagaagtgatataaaagccatgaggggcactaaccaacgtctagaaataagcctggcatccagagtgggctgatattgggcagaagcgc

SEQ ID NO: 22644 - DNA, 201 bp, Homo sapiens
ttagcaacaaccagtgtggctggcctgtggcaccttgaccacaaaatcccgtggggggcttgaaacacatgcagattcctgagcctcactccaggcccaaytgaattcagaatttccatgacgaagtctttcctgttttttttttttttttttgacacggcgtctcactctgtcgccaggctggagtgcagtggtgcaatc

SEQ ID NO: 22645 - DNA, 201 bp, Homo sapiens
aattgtatatttatggtgtacaacatgttttgacatatgtacatgttgtagagtggctaaatccagttaattaacatgtctgctcactcacttacttagcrctttttgtggggagagcatttaaaacctctcttagcaatttttaagtattcggcaagtaatcaagtatttcaggtattcaaccttgttattcgctattgg

SEQ ID NO: 22646 - DNA, 201 bp, Homo sapiens
gtgaccaatatatcctaaatctccactcccacataccctaccagcctctggtaaccaccattctactctctgcttctatgagttcgacatttttagattcyacatccaagtgagatcatgcaatgtttgcctttctgtgtgtagcttatttcacttagcataatgtcctccaggttcatccatgttgtcacaaatgacaag

SEQ ID NO: 22647 - DNA, 201 bp, Homo sapiens
attgacacctgcttagggagggttttaccatgaagggaaaaatacagattgttgaaccacactcaactcttaggttacaaaggctcagtgacctactttcygcttaccacaaagtaagttgctccaagtttaatgttggtctaaatttctctaactttctcattacttttacatttccagtactagacattccatgaacta

SEQ ID NO: 22648 - DNA, 201 bp, Homo sapiens
aaagtgacattgcaatatgaagaagacccaactacaaatttgagaactgataaataccatagctaaaattaacacctcagcagaaggctttttggggggaytaggcagagatgaagagataaatagtgactacagagaaacagtgaactggaagataagtcaagaatctactcagaaaaaagtatggataaaaaaaggatg

SEQ ID NO: 22649 - DNA, 201 bp, Homo sapiens
gttggtctaaatttctctaactttctcattacttttacatttccagtactagacattccatgaactacagaccattgatgtttgtcctcattttggaatcyggtattattaaataactgcttattttattttcccaaatattaaacagtccaaaattttgtgttctcattattcatgtggccaactagaagccctcaatct

SEQ ID NO: 22650 - DNA, 201 bp, Homo sapiens
aagagctactgactaaaatttttccaaaactggtggaagtcatcattaaaaaaatagaatctcaaggaacccaaacagcaaagcaggataaatagaatgaygtacttttctaaaaaaaaaataataataacaaagataaagagaaaatgttacagtcagctagaggagtaggtaggtggggaacagattgcttgttagaaa

SEQ ID NO: 22651 - DNA, 201 bp, Homo sapiens
tactagacattccatgaactacagaccattgatgtttgtcctcattttggaatctggtattattaaataactgcttattttattttcccaaatattaaacrgtccaaaattttgtgttctcattattcatgtggccaactagaagccctcaatctgctaaaaaaaaaaaaaattatagatccagttttcttatttcataga

SEQ ID NO: 22652 - DNA, 201 bp, Homo sapiens
gcaagccagtgccttctaaaccttgattattctttcattaaaattagatagtaggccgggcatggtggctcacgcctgtaattcccccactttgggaggcygaggtgggcggatcatgaggtcagggggtcgagaacatcctggctaacacggtgaatccttgtctctactaaacaaaatgcaaaaaattagccgggcgtg

SEQ ID NO: 22653 - DNA, 201 bp, Homo sapiens
tcattaaaaaaatagaatctcaaggaacccaaacagcaaagcaggataaatagaatgacgtacttttctaaaaaaaaaataataataacaaagataaagaraaaatgttacagtcagctagaggagtaggtaggtggggaacagattgcttgttagaaagtagagactaaatgctgacttttcaaccaggattggaagtaa

SEQ ID NO: 22654 - DNA, 201 bp, Homo sapiens
atccttgtctctactaaacaaaatgcaaaaaattagccgggcgtggtggcgggcgcctgtagtcccagctactcgggaagctgaagcaggagaatggcgtkaacccgggaggcggagcttgcagtgagccaagattgcgctactgccctccagcctggacaacagagcaagactctgtctcaaaataaataaatacataaa

SEQ ID NO: 22655 - DNA, 201 bp, Homo sapiens
agactaaatgctgacttttcaaccaggattggaagtaaaaaaaatttttttaaagacaatagactgatatattcagattaaagaaaaaaaagtaactaccrgccaggaactctatgctctcctaaaattcctttaagaatgaaggtgaggatgtgtatggtagatcacacctgtaatttcagcactttgggagcatgaggc

SEQ ID NO: 22656 - DNA, 201 bp, Homo sapiens
gcatgaaggagaaaaagaaaacttcagagatttcaagccctaactgtttctttccctctttctcatgatcatacaatatttttcctgacagagtatcactkataaaattgaaatttctcagctgggcatggtggctcacacctgtaatcccagcactttgggaggccaaggcgggtggatcacctaaggtcaggagttcga

SEQ ID NO: 22657 - DNA, 201 bp, Homo sapiens
aaaaaatttttttaaagacaatagactgatatattcagattaaagaaaaaaaagtaactaccggccaggaactctatgctctcctaaaattcctttaagartgaaggtgaggatgtgtatggtagatcacacctgtaatttcagcactttgggagcatgaggcaagaggatcacttgagcccaggagtttgagaccagcct

SEQ ID NO: 22658 - DNA, 201 bp, Homo sapiens
agcattactgaatgccccgaatctgtattaccattccagtttacagcgacaatttaagggtattagtatcctgttatttgcgaaggaattcacaaggaaaygtaaaacaattggaaaagacaatggaaaaatgttacacagagttttatgtgaatcaactaagataaaaaaattgaatcagattggctgatgaacgaatgc

SEQ ID NO: 22659 - DNA, 201 bp, Homo sapiens
taaagacaatagactgatatattcagattaaagaaaaaaaagtaactaccggccaggaactctatgctctcctaaaattcctttaagaatgaaggtgaggmtgtgtatggtagatcacacctgtaatttcagcactttgggagcatgaggcaagaggatcacttgagcccaggagtttgagaccagcctgggcaatgtagt

SEQ ID NO: 22660 - DNA, 201 bp, Homo sapiens
actagaccagagaatggcggttggaccagagaaggacaaggaggagcttcatatctgaatccaggaatagaatcaagtttatgtggcaacgatagaagttstgggtttatgtattgaccccagacactgcgctctttgttacccattctgctaagtgagccatgctgggaatcccatgcacgttcactggaatggaatgca

SEQ ID NO: 22661 - DNA, 201 bp, Homo sapiens
cataagccttcctcaaattttacctcttctgcaaagttttctcttcctctccatactgaaatctctgtctgaattcctgcaaacgatttgagagcctgtgyggtatagtaatgaagtattaagatacaaccagatcacctcagttagtatcctagcatcaattaaccttggaaaatccacaccacctctgtttgcactgat

SEQ ID NO: 22662 - DNA, 201 bp, Homo sapiens
cctgtctctacaaaacagttaaaaaattagccaagcatggtggcacagacctgtaatcccagctacttgggaggctgaggtgaaaggatcacttgagggtrgaaggcaggagttgcagtgagcacagatcttgccactgcacttcagcctaggcaacaagcaagaccctgtctgttaaaaaaaaaaaaaaaaaggaataaa

SEQ ID NO: 22663 - DNA, 201 bp, Homo sapiens
agaaggacaaggaggagcttcatatctgaatccaggaatagaatcaagtttatgtggcaacgatagaagttgtgggtttatgtattgaccccagacactgygctctttgttacccattctgctaagtgagccatgctgggaatcccatgcacgttcactggaatggaatgcaggacagatgccaaccacttggaaagccac

SEQ ID NO: 22664 - DNA, 201 bp, Homo sapiens
tagtccaaacaagttgtcagaatcagataatgctgtatgaagtacagttgactcttgaacaatgctgggattagggtcattggccccctgcttccctgtcrtgcagtgaaaaatctacatacaactttcaagtcccccaaaacttaactactaatacctatgacggacagaaggcttaccattaacataaacagtcaatta

SEQ ID NO: 22665 - DNA, 201 bp, Homo sapiens
atctacatacaactttcaagtcccccaaaacttaactactaatacctatgacggacagaaggcttaccattaacataaacagtcaattaacagatattttrtatgttttatatattacatactgtattctttcaacaaagtaagctagagaaaataaaatgctatcaagaaaattgtaaagaagagaaaatatatttacta

SEQ ID NO: 22666 - DNA, 201 bp, Homo sapiens
tcctctagagatggcttcaaagccccaacaggagtgggcccagattcacacctaatatttgcctaaattctcttggattaactgaagtcccagtttatggsttatatctaatagaaagcttaaagaaaaaaagtaaaaaaaaattagttttagatttttctttttgacatttttttccccatcaagaagcacaataaatga

SEQ ID NO: 22667 - DNA, 201 bp, Homo sapiens
ctatttgtggaattactcatccttagttttccttcagttctctcatagttcttagaactatgatgaagtttggaattagacattgcccagtaataaatccyggaaaaatagaacaaaaaattaaattttactgcatggtatagagccttgcccattgcaaacgatgaatatgttttaaagtttttaggaaggatggaaaat

SEQ ID NO: 22668 - DNA, 201 bp, Homo sapiens
agcgaaggagctgaatgtattcttaaaatgatttaagaatgtgtggtaactctttaatgcacagagatgctttttaaaagtatttgtcaagattctttgawtggcaagttatcttcaaaagttagcttagatacaaagtagggtttataagaaggatactgggtgatttcatctcatcaaaggaagggcttctagaacaaa

SEQ ID NO: 22669 - DNA, 201 bp, Homo sapiens
caacatgtgctatcactataaaaaggaaaatattcagccataaagaggaatgacatactgacacatgctactacatggatggactcaaaaacattatattragtgaaagaagccagccacaaaaggtcacatattgcatgattttattcatgtgaaatgtccggagtagacaaatccatagaggcggaaagtagtttagta

SEQ ID NO: 22670 - DNA, 201 bp, Homo sapiens
aatgatgaaaaacttcctcaaatatttatgtacaggaatgtttgtttcaacaatatttttatttacagaaatgtggagaatatagaatttcaagcaatagrggattgatggaatgtggatggcacatctatatgttggaatttgatataggcattaatatattatgttggtgcaaaagttaggctggtttttttcctttcc

SEQ ID NO: 22671 - DNA, 201 bp, Homo sapiens
ttttttcctttcctttcataataatataatgttttattttatttgagatggagtcttgtgctatcacccaggctggagtgaagtggcgcgatctcagctcmctgtaacttctgccttccaggttcaagcgattctcttgcctcagcctcctgagtagctgggactacaggcgcgcaccaccacacctgactaatttttgta

SEQ ID NO: 22672 - DNA, 201 bp, Homo sapiens
tcccttatctggacataagcttggagcaagttttctcagtagcagcgctattgacatgttgggctaggtagttttttgtgggtcccagagggtccggggtrtaggtgctgccctgtgtatagcagcatcttcaggagcatccctggtctctactccactctacagtgtgacagcaaaaatgccttcagatagtgctaggtg

SEQ ID NO: 22673 - DNA, 201 bp, Homo sapiens
gaccacataattgtgtataaagtgaaaaggagtgattgctacccttatctgacatgtaattcacttttacagatggacctgggggtctgaacacacaagtwcttacaggcacatagagaagagtgctccctgcaaggtgggctcagttgaggcaaaaacagtaaagaaataaagagcctgacatggcagcctcaatttgtt

SEQ ID NO: 22674 - DNA, 201 bp, Homo sapiens
cagcactttaggaggccgaggcggggggatcacgaggtcaggagatcgagaccatcctggctaacatggtgaaaccccgtctctactaaaaatataaaaakcagccaggcatggcgggaactcgggaggcagagcttgcattgagccaagatcacgccactgcactccagcctgggcgacagagtgagactccctctcaaa

SEQ ID NO: 22675 - DNA, 201 bp, Homo sapiens
cagttgaggcaaaaacagtaaagaaataaagagcctgacatggcagcctcaatttgttcctcatttctgaggatgtaaagtggaacgtgtccactgatagygtataaaccatggaaatacttcaaaatgcgttaaccccattataattttagaatcataaatatacatagataggtctttccactgcagggagagtgatca

SEQ ID NO: 22676 - DNA, 201 bp, Homo sapiens
aaaaaaaaagagttaattgtagttggaaaatcccagccagtgggcagaagagacattagaagcaaatacctctaagaacccaggcaagacattaaaataaraagtgagccacaccgatagtgtgagtcagcacagtgcttcagctaagaaatctagctctaatatagggtggttctggggctgagcctggactttgtgata

SEQ ID NO: 22677 - DNA, 201 bp, Homo sapiens
gttgaggcaaaaacagtaaagaaataaagagcctgacatggcagcctcaatttgttcctcatttctgaggatgtaaagtggaacgtgtccactgatagtgkataaaccatggaaatacttcaaaatgcgttaaccccattataattttagaatcataaatatacatagataggtctttccactgcagggagagtgatcatc

SEQ ID NO: 22678 - DNA, 201 bp, Homo sapiens
ccaggcaagacattaaaataagaagtgagccacaccgatagtgtgagtcagcacagtgcttcagctaagaaatctagctctaatatagggtggttctgggrctgagcctggactttgtgatattctagctgtgttctttggaagaaagttaacctttcagcttcagtttccttaatggaaatggggataataagaggacct

SEQ ID NO: 22679 - DNA, 201 bp, Homo sapiens
gtgagtcagcacagtgcttcagctaagaaatctagctctaatatagggtggttctggggctgagcctggactttgtgatattctagctgtgttctttggargaaagttaacctttcagcttcagtttccttaatggaaatggggataataagaggacctaggtcagatttattgttaggtatttgagataatatagatgac

SEQ ID NO: 22680 - DNA, 201 bp, Homo sapiens
cgtgttcatcgcggcactgtccacaatagcaaaggcatggaatcaacctagatgcccatcaatggtggatgggatgaagaaaacgtgctacgtatacaccrgggaatgtgacacagccacaagaatgaacaagaccatgtccttttcagcaacatggatggagctggaggccataatcctaaatgaagtaacacaggaaca

SEQ ID NO: 22681 - DNA, 201 bp, Homo sapiens
attacctgggtgacaaaatagactgtacaccaaacccccatgacaggcaatttacctctatagcaaacctgcacatggacccttgaacctaaggtgaaagrtttttagaaaaagaagtcagggtcaggacttgccgtctgtaattctgggcctcaagctcttaagcagaagagcccactttcgaatcttcctcgtagtata

SEQ ID NO: 22682 - DNA, 201 bp, Homo sapiens
aaggtgaaaggtttttagaaaaagaagtcagggtcaggacttgccgtctgtaattctgggcctcaagctcttaagcagaagagcccactttcgaatcttcytcgtagtatagcacctaggatttagcatatctagggctcagtgctctggaatcattgtgaaaatggccgacatcattcatttgggcctggaagccaggga

SEQ ID NO: 22683 - DNA, 201 bp, Homo sapiens
gagatttttaatagagttcaagtgtactctttaaataccagtgaaaattatgctggaatgggaccagccatcctgttttttcaaaacttctataacaattygggttgttagaagaagaaatagtaatttagctgtatgttaaatatgatttcacatatgattaactgtcataaacctatagatacatagaatgttaaggtt

SEQ ID NO: 22684 - DNA, 201 bp, Homo sapiens
atctttttttttttttttttttttttgagacagtcttgcactgtcacccaggctggagtgtagtggcaccatctcagctcactgtaacctccacctcctarattcaagttattctcctgcctcagcctcccaagtatatgggattacaggggtgtaccaccacgcccggccgagttggggatatgtgagtaaagacctgaa

SEQ ID NO: 22685 - DNA, 201 bp, Homo sapiens
ccaggcaaagtgaacagcaaatgccatacccaagaagcagcaacacacctggtttggctcaagaagcggaatcgaacaaagtgaagacaataagaaattarattagaaaggtcaggggtgggagaggagagaaagccattgtgatgcctttggctgtttgattgagtggatgggaagcagttaggaggatttcagcagagc

SEQ ID NO: 22686 - DNA, 201 bp, Homo sapiens
taaagtcacttttataatgaagtcattcctgccgtcacctacaataacgcactccctcttggtttagtgctgaattttacttctaattttacttcactcayatcactggcgtcaactctgggcatgcaaagatctctacaccatcgaaagcacacagacaacaacttgattttctcccacagttactttatcaagtttgtt

SEQ ID NO: 22687 - DNA, 201 bp, Homo sapiens
tagggaacatatgaatttaggggaacacaaacattccaaccatggtatacataccaactcatagaggtatgttatatattctctctctctttatctgtctrtctatctatatatatatgtatgtatacaatctaaatgtattttttcagttttcagcctggatcctggagctcaccataatgaaatttacatctgcatgtt

SEQ ID NO: 22688 - DNA, 201 bp, Homo sapiens
taggtgaccagtagaagaaaagtgcctggtgccaatttttattccatagtataaaatagtctctcaggacagggtttttggtgagagaagcacaggatgtygctgggtgactgagaccgggtcaggaaatagggaggcagagggcaacagtttctctagaatttaaaatttggttgcttttggaagagaaagcaagagatt

SEQ ID NO: 22689 - DNA, 201 bp, Homo sapiens
gctagaagaacctacaacatgggaaggaagaagcttatgatagaaatctagatgggaagtgtcaaagccttgaacggacccagaggggaaagagataaagkgaagggcagaaatctgagagacggaaggcagaatacattggaagcacagtgtttggactctgatgatattttaatgaggacatgaattgaggatgacttt

SEQ ID NO: 22690 - DNA, 201 bp, Homo sapiens
cagatagtggattttcatttacaaagctgtttgctcagcctggaaaacaatatcttcacttagtaaataattgatgtgaagaggagaccattttagtctawgacatttccgtttcgatcttaactaaaacactaagtagggttttgcagatttgctatttagattatacacttggcaatgttttatgtacatctgcttcaa

SEQ ID NO: 22691 - DNA, 201 bp, Homo sapiens
catgctgatgacgagggccactgtctgccttcctccacctggggtatttgtcacatggagactgagtcaggttgcattaaggtcagttcagagacctttgytaagagaccaaggcaaaaatacccaagcacatatataacaaggacagaatgaattacagtccaacaaatgtataaatatgttcaggtaggctgggcacgg

SEQ ID NO: 22692 - DNA, 201 bp, Homo sapiens
catggagatccaaatatttatatgaagtgtaaagcagaaagaatgaggagagtgggatctggaggaaagatggaataatcccgttaggttggagtcacagygcaactaactcttaactcactccagcttgaatggaccattattgatcagagtcaacgtttgccatttgcctgatagatgctgggaagcaaagccttgctt

SEQ ID NO: 22693 - DNA, 201 bp, Homo sapiens
ccatctaaaaaaaaaaaaaaaaaagaaagaaaaaaagacatatggccagatggaaagagctgattgatgcatgatatcattgcttggtgatacggctttaraaaagccctataacgttttgaatctcaatttttatctactaaaaaactgatcaatttgaaatattacaactatttaagaatgtgatggggataaagcaga

SEQ ID NO: 22694 - DNA, 201 bp, Homo sapiens
taagtttcccagttttggtgttaaatttaaactttgtgaggcattctaaaatagctaaacaatacaagaataaacttaaaaattcaatggcataaaaaatwtatgtatatgtctctaggtacctcttggtggcctgattgaagttgtcagctcacgttactgttagaagtacaaatgtaataaggaagttgaattataact

SEQ ID NO: 22695 - DNA, 201 bp, Homo sapiens
ggtaaagccaggctttgaacatgagtttgactgtcccccaaactcctgattttcttagtaagccttcattgcctctgtggcaattgataaaaatacccagrgatgtgatgtgtgtgtgtgtgtgtgtgtgtgtgtgtgtgtgtgagagagagagagagagacggagtctcactctgttgccaggctggagtgcaatggcgt

SEQ ID NO: 22696 - DNA, 201 bp, Homo sapiens
tgattttcttagtaagccttcattgcctctgtggcaattgataaaaatacccagggatgtgatgtgtgtgtgtgtgtgtgtgtgtgtgtgtgtgtgtgagwgagagagagagagacggagtctcactctgttgccaggctggagtgcaatggcgtgatctccgctcactgcaacctccttctcccaggttcaagcaattct

SEQ ID NO: 22697 - DNA, 201 bp, Homo sapiens
ctctactaaaaatacaaaaattagctgggttttgtggtgcatacctgtagtcccagctactcgggaggctaaggcaggagaatcacttgaaccccggaggyggaggctgcagtgagctgagatcgtgccactgcactccagcctggcaactgagcaagactccatctaaaaaaaaaaaaaatggagcagtaatacacagcc

SEQ ID NO: 22698 - DNA, 201 bp, Homo sapiens
tcacctgaggtcaggagtttgagaccagcctggccaacatggtgaaaccccatctctaccaaagaatacaaaaattagctaggcttggtggcacacacctrtagtcccagctactcgggcagctgaagcaggagaatcccttgaacctgggaggcagaggttgcagtgagtggagatcacagcactgcactccagcctggg

SEQ ID NO: 22699 - DNA, 201 bp, Homo sapiens
aaatggagcagtaatacacagcctccatcctctttcacagaacccacagcagtagtctttatatcgccaaagcaccaatgtttttgatgcatgaattgttratagatgcatagctgaataaatgaatttttgtcatctctgctcctgcaatgctcagtgctttggtggaaaatctcagaggacaccatcgggaatgtgctg

SEQ ID NO: 22700 - DNA, 201 bp, Homo sapiens
gcactttctgctcagtcaccttcaagtgtctggtgtaattaaccttgggctctcctcaatgacacatcaggagcatttcttgctaaggaagctgtgggacycatcggctgggcatggccttgtctggtcagcacgcaagtggcttcattacgtttcctttcacgaaggctgagtattaaagtgacctctggctgacagttt

SEQ ID NO: 22701 - DNA, 201 bp, Homo sapiens
atctgatacttgaggatgatctttttcaaacgtttatcttgtgacttgcatttgtattaacatgcttagctactttgcttcctggtgcgggtgtcttattracaaccaaatgctgagccagtgctttgaatctgcaagatgaaggaagagttgagttgaagccacagctctcaatctgtggacacgggtttggtttggctt

SEQ ID NO: 22702 - DNA, 201 bp, Homo sapiens
agaccttggcagcctggacttcattatccatatcactatcagaattttagttgcaacttttaaacagtctctaagaagttccaaattttccctcatctttmtgtcttctgagccttccaaactcttccaacctctacccattatcttgttccaaagtcagttccacattttcaggtatctttataacaaaaccccactcct

SEQ ID NO: 22703 - DNA, 201 bp, Homo sapiens
aatatattcctgtttttttttttttttttttagaaataaaaatacagatattactgaggaagctacaattcatttccccctcattcatgaggggtgcaaaygatgactgacatttcagtcaggtggtcacgagccatttaatcaccccagggttttgattacagcagagaggggcagccgctgaagtgctctgcatcacgt

SEQ ID NO: 22704 - DNA, 201 bp, Homo sapiens
tacagcagagaggggcagccgctgaagtgctctgcatcacgtccatgtcaatcacgtggtctttagtgcttaggcaaagcatgcgtgattactggtctttmtttcgtgcaatttaaaaatgtatgctcagctttactttagtatgtgatgttacattttagaaagcgcacgctgtgcactgagttgttttgagactgaatg

SEQ ID NO: 22705 - DNA, 201 bp, Homo sapiens
tagaatctaatttaaagttgatacttttatcatgttataatcaataatcaatccaaggaccttggaacattttaaacccacttacccacttcctgtctttwgtgctatctatgccaagtattttaattctacgtacataataggtacacaaaacatttttattgttttatacaattactaataatgtaaaattacccttgc

SEQ ID NO: 22706 - DNA, 201 bp, Homo sapiens
actacgctgagttagaggggtgtgaaatcaatatcgttgccttgttcctgatcttagggagaaagcgtttagtatttcaccattaattatgctgttagctstaggtttttgcagatggtttttatcaagtcaagaaatttctcctctattcctagtttgccaagagtttttatcatgaatgtgtgttggattttgtcaaat

SEQ ID NO: 22707 - DNA, 201 bp, Homo sapiens
gagacaggcagagatactatccagacaacctcaggaaaatgtcagccgtatagaatgtgagccacaaaaatgtcaattctccaaataatgatttaaaaatrtatctaactccactgaagccttcgagatgttttatccaagagaatgtaactattttttcccttatcagattgatcttggcttaagcttcactctgaggtt

SEQ ID NO: 22708 - DNA, 201 bp, Homo sapiens
ttaaaaaatgcaatttcaaaatatcagtatggtaaatatatatgactttctgatgcgtgggactctattgcatagtcacagaggtcgcccttgtttatatwcccccaccattgaaacacagaaagagcaatgtggcaatagctccttttgggaaagaacccttcttttgttaatattgatcattacgttttctcaaagaca

SEQ ID NO: 22709 - DNA, 201 bp, Homo sapiens
aaaaatgcaatttcaaaatatcagtatggtaaatatatatgactttctgatgcgtgggactctattgcatagtcacagaggtcgcccttgtttatattccyccaccattgaaacacagaaagagcaatgtggcaatagctccttttgggaaagaacccttcttttgttaatattgatcattacgttttctcaaagacatat

SEQ ID NO: 22710 - DNA, 201 bp, Homo sapiens
tatgactttctgatgcgtgggactctattgcatagtcacagaggtcgcccttgtttatattcccccaccattgaaacacagaaagagcaatgtggcaatakctccttttgggaaagaacccttcttttgttaatattgatcattacgttttctcaaagacatatacacttacatttcattttgcatggagcagttttgcta

SEQ ID NO: 22711 - DNA, 201 bp, Homo sapiens
gcccttgtttatattcccccaccattgaaacacagaaagagcaatgtggcaatagctccttttgggaaagaacccttcttttgttaatattgatcattacrttttctcaaagacatatacacttacatttcattttgcatggagcagttttgctatatttaagcactaaagagggggaattagagcaattgctattccctg

SEQ ID NO: 22712 - DNA, 201 bp, Homo sapiens
tttttctccatgttctttattctgtgtgtatattttgtgaattgaacaatgagctctattatagtttgatagctcaaacaagctattaatattagttgtgygtattagtctgctattaccatgacagtgctacttaacaaaccatccaaaattcagtgtcttataatgaaagcatttgtttttatcacttatgggtccacg

SEQ ID NO: 22713 - DNA, 201 bp, Homo sapiens
tcaagtgcacagaaaaatatactctccattttagtgcagtgcaaagagagatactgaagaattaaaaatcagccagttaagctgggcatggtggcatgcayctgtaatcccagctattcaagaggctgaggtggaaggatttgcttgaccccaagaatacgagaccagcctgggcatcatagcaagtcctcatctagaaga

SEQ ID NO: 22714 - DNA, 201 bp, Homo sapiens
aggaaggaaggaaggaaggaagggaaggagggagggaggggaggggaggggaggagagaggaggggaggggaggggaagagagatagagagaaagagagasagagaaagagagagagagaaaaaaggaaaggaaaggaagaaaaaagaaggagtgagggaggaagagaggaagggagggagggagggaggaaggaaggaag

SEQ ID NO: 22715 - DNA, 201 bp, Homo sapiens
tttgccagaaaaaccccagagctcacggggtttgagctttgcaagctctgtcgaaaatgcattcatccttaggaaatatacttaggtggaacctaaaaacmaagagcataaagatgctgagttcctctgtgagtggagtttaaatctaaacctcatcctgaccgtctctaaactggctttgtaccacacaagagtcttcag

SEQ ID NO: 22716 - DNA, 201 bp, Homo sapiens
aaaagtgcctggtgccaatttttattccatagtataaaatagtctctcaggacagggtttttggtgagagaagcacaggatgttgctgggtgactgagacygggtcaggaaatagggaggcagagggcaacagtttctctagaatttaaaatttggttgcttttggaagagaaagcaagagattcctggaagccagaacgt

SEQ ID NO: 22717 - DNA, 201 bp, Homo sapiens
aaaaagaaggagtgagggaggaagagaggaagggagggagggagggaggaaggaaggaaggaaggaaggaaaggagggaggatggatcagccaatttaccwctcaatccatggcaaacacatcagtgatttaaggatgcttgttctggggttccctggaatgtgggtgtgctgctttatggcattagtcatagcagtagta

SEQ ID NO: 22718 - DNA, 201 bp, Homo sapiens
ctggttctggatcaatttttagatcagacttgattagcaagtgcatcctgattctaccacttatttgattaaaaatctttcaactgaatcccattagccamagaacacagtctgacagccaaactctgtataatccagcattgaaggccctctgtagaagaccccatcctgttttcccaatcctaattctcattattctcc

SEQ ID NO: 22719 - DNA, 201 bp, Homo sapiens
ttgcaaaactgtaagacgtttctgcctcttttactgaacctatcattttctaaattgcgtcatcattatttatctatgtcttactactaatggactatcayttatctttttctacttaaatactaaatatactttcttgaatattgaaacaatatgtaataaataaatttatcaatccattcataccctcagtcatcgttc

SEQ ID NO: 22720 - DNA, 201 bp, Homo sapiens
ttatgggatgacacatgcaaattaagaatgcatagttcaggatagtcagcatttaagcgctaatgaatgcattcgatgcaggcttgaagcaatgtgcaagsttagaaggaaagaaagttcatgaaactcgtgtgatcaagaatgacttgatagagcgagggaaaacttactcaggtcaggagagaattcaggcaaggtgaa

SEQ ID NO: 22721 - DNA, 201 bp, Homo sapiens
cacgtctgtaatcccagcacactgggaggcagaggtaggcagattgcttgagctcagaagtttgagacaagccctggcaacatagtgagaacccgtctctmcaaaaaatacaaaacaattatctgggtgtggtgctgtgcacctacggtaccagcttctcgggagactgaggtggaaggatcccctgaacccagaaggtat

SEQ ID NO: 22722 - DNA, 201 bp, Homo sapiens
tcaaactttctgtttcttccatagtgtggataaacttcgtttctctgatgcaaaacggagtttaccttcaacttcttgatattgggcatgtgaatttttcyatgcagtacttgaggaaagcaattagacattgtgttttgaaggcttcccggtaaaccacacacctcaagacaaattgtatcagaaaatccctttgccacc

SEQ ID NO: 22723 - DNA, 201 bp, Homo sapiens
agcctgggcaacagagtgagatactttcgccaaaaaaaaaaaaaaaaaaaaaaaaaaaaaaggctgggagagaccaaaatgactagagcagtcctaaagcygaattcaaaactgtttgagagctctcctggctttacagaaaggtaataaggtttagagacggacagtatggggactctaacccaattttgctgtcagaca

SEQ ID NO: 22724 - DNA, 201 bp, Homo sapiens
ccctcaccacagcaatgtcctttcacctggtctcatctccttcagtctcgttcccttgcatgtaaaatgctggttctggatcaatttttagatcagacttrattagcaagtgcatcctgattctaccacttatttgattaaaaatctttcaactgaatcccattagccaaagaacacagtctgacagccaaactctgtata

SEQ ID NO: 22725 - DNA, 201 bp, Homo sapiens
cgcccgcctcggcctcccaaagtgctgggattacaggcatgagccaccacgcccggccaaacacatttaaataacggacatttttttcacattgtataacrtgttgcataacatgacaaaaatcataaatagaaacaacatagaagggcagagcagaagaggctctgattggctttgttttggctaggaaaggctttctag

SEQ ID NO: 22726 - DNA, 201 bp, Homo sapiens
tgatcagaaaagttcaaaggatgctcgagtattcgtctttaaaggagaagcctcctgtgtcatgcttcctgtaggcgtgtttgtgtgaacgagctgttgcrttgcacctgtgtgtgctgcttgagcaattcacttcactgctcagggtctcaattatctcaaaggtaaacgaagaagctggattacttttttctaaagttt

SEQ ID NO: 22727 - DNA, 201 bp, Homo sapiens
atggaaaataattcccgtccaatgatggggatggaagggttgaggaggtgggtaggaggaagaactttccaaagaaaaacaaacggaattgattttccaargtctgtgcctacatgggtgtttttccctctaaaaacatagcaggctgagttgattgactttaattatattgacttacagttcttgattgttgttactctt

SEQ ID NO: 22728 - DNA, 201 bp, Homo sapiens
tgcaatggtcattttcaaatctggagttgtaaacagaaactctagaatgagtttcacctatcagattgcaggtgaggccaggaacttcatcttttattcaraaaagctgccatcattaccattattcgtagaataattacaattatttctagaattgactcctgtgagtaaattaggatttgttaacaaaaaccacatccc

SEQ ID NO: 22729 - DNA, 201 bp, Homo sapiens
cctctgcctcccgaattcaagtgattctcctgcctcggcctcccaagttgctgggattacagacatgcaccaccatgcccagctaatttttgtatttttartagagacggggtttcaccatgttggccaggcttgtctcgaactcctgaccttaggtgatccacctaccttggcctcccaaagtgctgggattacaggtgt

SEQ ID NO: 22730 - DNA, 201 bp, Homo sapiens
atgcccagcaacagcattttcctgtctacctacctccaactcttcagtgctcctacctgcagccctcaccacagcaatgtcctttcacctggtctcatctycttcagtctcgttcccttgcatgtaaaatgctggttctggatcaatttttagatcagacttgattagcaagtgcatcctgattctaccacttatttgatt

SEQ ID NO: 22731 - DNA, 201 bp, Homo sapiens
ctgaagaaatggctcttttgtgtgagagagatatttccaattcagggaagaaagagtgacgtttgttcttggacgcagggtgtgtcatcagagagtgactracacacctgattgatgaggcaggtgctgatggatgagagctgtctaggtggccccaaaatgtgtagtaatgaggaaatgatggattggtgatgctaaaca

SEQ ID NO: 22732 - DNA, 201 bp, Homo sapiens
acaaatgtctgacaggacattcaaaagttatgtgggacaaaaatcttcactttgcaaaactgtcctgtgaattactaaatgccagttataggcccaaattrtagtgatgacccaaaaaccaccacacttgtgcaaaacactccctatggggtggtattgacctcattgagaaggtctgacttaatgcaccgggcttaacca

SEQ ID NO: 22733 - DNA, 201 bp, Homo sapiens
ccttttaaaattattatttatacatcctgtgactcttgtttcagtagttaccttagagattacagtattcaaccttaatatgttagaatctaatttaaagktgatacttttatcatgttataatcaataatcaatccaaggaccttggaacattttaaacccacttacccacttcctgtcttttgtgctatctatgccaag

SEQ ID NO: 22734 - DNA, 201 bp, Homo sapiens
caaattcccaggaaaatattaaaagataaagtcctaaggatattaatgtatgaaattattacctttgaaaagaattgtagtccaatatcaaagtctattgmccttgtgcattaaaagttcatagaaattaaaatccaaaaattttctttcccagtttttctaactgctcaagtcaatagctgggtgaaatgtgggattttg

SEQ ID NO: 22735 - DNA, 201 bp, Homo sapiens
cccttttaaaattattatttatacatcctgtgactcttgtttcagtagttaccttagagattacagtattcaaccttaatatgttagaatctaatttaaarttgatacttttatcatgttataatcaataatcaatccaaggaccttggaacattttaaacccacttacccacttcctgtcttttgtgctatctatgccaa

SEQ ID NO: 22736 - DNA, 201 bp, Homo sapiens
atgtcagttatcccgaggccacaagctatttcaactcacttaggagaaatcttactgtggcaatgaatgaactaacacaagaccagcttggggccaggtaygtatgtcatttccttccatccagccctggcttctgcctcctaccttccttcacatttaccagttatccatttaaaacccaaatctgatcttacatcacgt

SEQ ID NO: 22737 - DNA, 201 bp, Homo sapiens
tatctgataaaattactaacaatattagttttagatagacctttgtactatttgtgttttgtttgtcccacttctttttgttttcctttaactatcttttytttttaaaattaatcacttttttattactccccttttaaaattattatttatacatcctgtgactcttgtttcagtagttaccttagagattacagtatt

SEQ ID NO: 22738 - DNA, 201 bp, Homo sapiens
tgccatgcatttcacacttccatggcctggcatttattactgtctggctgggatacccttcctgttttgtaggtctggaaggtcttttttttttttttttkgggacagagtttcgctcttgtcgcccaggctggaatgcagtggtgcgatcttggctcactgcaacctctgcctcccgggttcaagcaattctcctgcctc

SEQ ID NO: 22739 - DNA, 201 bp, Homo sapiens
atctaatcctcagagctaccagatgagacaggaattaccccattttacaaaggaagaaagaaaaatttaagagattaagtaatttgtctgtggtccaaagrgtttgtaagaggtaaagccaggctttgaacatgagtttgactgtcccccaaactcctgattttcttagtaagccttcattgcctctgtggcaattgataa

SEQ ID NO: 22740 - DNA, 201 bp, Homo sapiens
gacagtgccatctagtggtgcatttctttttcttttacaatgactggttttagtcattcctgtcttacataatcctagcactttagaataatgtcagtggwcatggtcatggctgttctgaggccttgaacacatagctctgttatgaattgaatatttggagttagatacacacagacactcattttagaagtacaatgg

SEQ ID NO: 22741 - DNA, 201 bp, Homo sapiens
gctcctggtgttcaagacagattcatttcagacagcaaaaggctggaagatgtctttccggcagacattgggtaagaattctggacttgtaaatctatttktcaggactgttacctttctgctttatttaatttccccaccccccccccacccccacctgattatgattgcttttccttgaagcttagaagaatatgccat

SEQ ID NO: 22742 - DNA, 201 bp, Homo sapiens
tagctaggcatggtggcatgcacctgtagtcccaggtacttgggaggctgaggtgggaggatcacttgagcccagaagttcaaggttgcagtgagctatgrttgcagcactgcactccagcctgggcaacagcgtgagaccttatttcaaaaaaaaaaaaaagctaaatatgtagtatatagaagaaggtaacagttgctg

SEQ ID NO: 22743 - DNA, 201 bp, Homo sapiens
aggggaacacaaacattccaaccatggtatacataccaactcatagaggtatgttatatattctctctctctttatctgtctatctatctatatatatatrtatgtatacaatctaaatgtattttttcagttttcagcctggatcctggagctcaccataatgaaatttacatctgcatgtttattttattttacttatt

SEQ ID NO: 22744 - DNA, 201 bp, Homo sapiens
catggtggcatgcacctgtagtcccaggtacttgggaggctgaggtgggaggatcacttgagcccagaagttcaaggttgcagtgagctatgattgcagcmctgcactccagcctgggcaacagcgtgagaccttatttcaaaaaaaaaaaaaagctaaatatgtagtatatagaagaaggtaacagttgctgtggagaaa

SEQ ID NO: 22745 - DNA, 201 bp, Homo sapiens
tgtaggattgattattgccttgttctgttcaggttgctttaacaaaatatcataaactgggtggcttataaacaacaaaaggctgcaaaagtccaaggtcraggcagattcgttgtctggtgagctcctgttttctggcttatagaaggtaccttcttgctgtgtcttcatgagctggaagggcctcttataaaacactaa

SEQ ID NO: 22746 - DNA, 201 bp, Homo sapiens
ggcatgcacctgtagtcccaggtacttgggaggctgaggtgggaggatcacttgagcccagaagttcaaggttgcagtgagctatgattgcagcactgcamtccagcctgggcaacagcgtgagaccttatttcaaaaaaaaaaaaaagctaaatatgtagtatatagaagaaggtaacagttgctgtggagaaaaatcaa

SEQ ID NO: 22747 - DNA, 201 bp, Homo sapiens
gtgtcaacgatggcgtgcacattatcagaggttacagcgtcatgtccaccccatttgctactgtgtgtggggatgagatgccagctcccctcaccatcgcygggccggttctgcttaacttctactccaacgagcaaatcacagacttcggattcaagttttcctataggataatctgtgagtagccataatgacagagtt

SEQ ID NO: 22748 - DNA, 201 bp, Homo sapiens
tgtatgtgccacattttcttaatccggtctatcattgttggacatttgggatggttccaagtctttgctattgtgaatagtgccgcaataaacatacgtgygcatgtgtctttatagcagcatgatttataatcctttgggtatatacccagtaatgggatggctggatcaaatggtatttctagttctagatccctaagg

SEQ ID NO: 22749 - DNA, 201 bp, Homo sapiens
tgctcagctgatgttaacgaatgtgagatttactcaggaacacccttgagctgccagaatggaggcacatgtgttaatacaatgggaagttacaggtaactttttttttttttttttggtaaatatcaggtatatttttgaaggcctaaaacatcccatagttaagagcatcctaaattaactatctgtattccaccaaaa

SEQ ID NO: 22750 - DNA, 201 bp, Homo sapiens
ggcagggaagacagaattgcaaagattgcctgagatgagacatgaataaaatgtctcctgtgttgctttttcctccctctccagtgccttgtggtggaacrtacaatgcaacttggaccccacaaaatatttcatcacccaattcatcagacccagatgtcccattttccatctgtacttgggtcattgattcccctccgc

SEQ ID NO: 22751 - DNA, 201 bp, Homo sapiens
atttaagttttggagagtattccgttgcacgagtgtggcctaatttatttaatgaagcccctctaagtggacatttaggtctcttgaactttttgcaactrcagacaacacttaataaactttttggtagtgatatctttatacatatagttacattacttggtgagaaatggtaatcacaggaccagcagacactgtatc

SEQ ID NO: 22752 - DNA, 201 bp, Homo sapiens
cattatgcaaaagtaaaattaaccacttctgacttaaatttagtgttatgttattaaagagctttttgattccaggactctgtttctcatttaaatgaagmcttttttccctgcctttgttaggcttgggctggaagcaaaatgcagtctagtctctcatttccgtgaacccattatctcctgatttctgtttatgggcat

SEQ ID NO: 22753 - DNA, 201 bp, Homo sapiens
gttttcagcacgttattttttccccctgcaaaatgaaaaacaaaacaaaaacccttttactatttaccactctgcagcatgtcagaggttagagttctttwtccacacacacatatgacagaatgagagctaggaggaaaggaaccatttatttgttgaaagctgcatttctaaatgacagattcaactttgtaagaacag

SEQ ID NO: 22754 - DNA, 201 bp, Homo sapiens
aagagttcaagaccagcctggccaacatagtgaaaccccatctctactaaaaatacaaaaattagctgggcgtggtggcgtgcccttgcagtctcagctayttgggaggctgaggcaggagaattgcttgaatctgggaggcggaggttgcagtgatccgagatcgtgccactgcactccagcctaggtgacagagtgaga

SEQ ID NO: 22755 - DNA, 201 bp, Homo sapiens
ttccagcttcatccatgtcccttcaaagtacatgaactcatccttttttatggctacaaagtattccatggtgtataggtgccacattttctttatccagyctatcattgatgcacatttgggttggttccaagtctttgccattgtgaatagtgctgcagtaaacatacgtgtgcatctgtctttatagtagaatgattt

SEQ ID NO: 22756 - DNA, 201 bp, Homo sapiens; identical to SEQ ID NO: 3196

SEQ ID NO: 22757 - DNA, 201 bp, Homo sapiens
acgaactgaggatggataccaggagaacatctgagaatacctggattgtctttctgcagtttggggagcaactaaccctccccagttcattccagtaaaawgtcatggtcaaagccccatatgctggactagtagagtatctgttgtcttctgagttttcagggtccccttcattataaatctggggtcccctgcttctca

SEQ ID NO: 22758 - DNA, 201 bp, Homo sapiens
ccttaattgtttgtgtaggttctgatcataatgcggttgttccatgccttttccagctcgttccgctgtgacgggaagctgtgtcaacgatggcgtgcacrttatcagaggttacagcgtcatgtccaccccatttgctactgtgtgtggggatgagatgccagctcccctcaccatcgctgggccggttctgcttaactt

SEQ ID NO: 22759 - DNA, 201 bp, Homo sapiens
gagatgtgctggcagctgaatagaccctggacttgctgagtttggtgcaaagcatatatgctgagatgagctcccaaggtggacaagatgctagattatcrtcattccattggtaatggttttcaggacaaaatctctattacccattggtaccctagaggacttacagccaagtggaacaggccctttgggtgaaagctc

SEQ ID NO: 22760 - DNA, 201 bp, Homo sapiens
gtgtcatttcctattaatacaaattaggtatgatccaagttaatattttaacagtatgtgttcacctacaaaaatcactggatatgttgtagtggacacayatctttttaatttcttgtttattttgttttatatttttctttgggggatggtaggctggagcatatattcacattataattggcaaacaaaacaataata

SEQ ID NO: 22761 - DNA, 201 bp, Homo sapiens
gaaggaatgatgtgtagggtggttacggaggatgttcagtggttagctggcactggagatgaacagagatgcagagatagaaggccctaaggttaagaaayatgaagttgagggtgtttaatggcttgtctataaaaacacagaaacctctaaagggttcagaaaggaaatcaggggcaggagatgactatgagctgagac

SEQ ID NO: 22762 - DNA, 201 bp, Homo sapiens
taatcatcagagcaattaaaattaaatatcacaatgaagtttcgtttcgcatgcaccagaatggctaaaattaaaaagactgacaatgtcaaatgttggcrtccctgcagagcactggaagtcccacacatccctggtgagaatgtatactgatgtaactactatgagatatagtttggcagtttcttgtaaaattaaata

SEQ ID NO: 22763 - DNA, 201 bp, Homo sapiens
agtacttattttgaattgactcaaatgaaagcttcctttggttaaaacaaacgaaagtacttttggtatttttttaccaaaaaaaaaaaaaaaggtaaatracgatttgccacaaataactcaacaatggatttaaaatccttgtgcaaaactctgtcttggaggtagcatccttgtcgaaaagagagtctgaatgctact

SEQ ID NO: 22764 - DNA, 201 bp, Homo sapiens
ggatcatgaggtcagggggtcgagaacatcctggctaacacggtgaatccttgtctctactaaacaaaatgcaaaaaattagccgggcgtggtggcgggcscctgtagtcccagctactcgggaagctgaagcaggagaatggcgtgaacccgggaggcggagcttgcagtgagccaagattgcgctactgccctccagcc

SEQ ID NO: 22765 - DNA, 201 bp, Homo sapiens
gtgggaacggaaatgtctgactgagaattctgactgtgttactaccaagcgagggccgagctctagaccatgcttggaatctgttttcatgccttcacctyccctttcaagatcctctgatgtcccagagatgcccactgctctaggtggccccattcttcctaggagaggaaagtgaataagacaagttgtcagcagtgt

SEQ ID NO: 22766 - DNA, 201 bp, Homo sapiens
ctctgatgtcccagagatgcccactgctctaggtggccccattcttcctaggagaggaaagtgaataagacaagttgtcagcagtgtcagtggaaattagyatcctgctgctcctctcagagcaacggcattttgaaagaggaccctgagggaaaaacgcccaaactcaagagcgtggtgctggctatggcagccctccca

SEQ ID NO: 22767 - DNA, 201 bp, Homo sapiens
ttttggagtcttgtgggccaatagagcgacaagtatgggcaaactgtgatgagatccatagaccaagataaaggctgttgctgttttcagcacgttatttyttccccctgcaaaatgaaaaacaaaacaaaaacccttttactatttaccactctgcagcatgtcagaggttagagttctttatccacacacacatatgac

SEQ ID NO: 22768 - DNA, 201 bp, Homo sapiens
tgaaagctgcatttctaaatgacagattcaactttgtaagaacagtacgaaattctctcttgcactcttttataaaggagagcaagaatacagaagaactratgatgtgtggatggctttggaaatgatcttgattcctagactctgcccttcatagatttgctggaggacattagagaacagagcatttaaatcagggtt

SEQ ID NO: 22769 - DNA, 201 bp, Homo sapiens
gatgtcccagagatgcccactgctctaggtggccccattcttcctaggagaggaaagtgaataagacaagttgtcagcagtgtcagtggaaattagtatcytgctgctcctctcagagcaacggcattttgaaagaggaccctgagggaaaaacgcccaaactcaagagcgtggtgctggctatggcagccctcccatcta

SEQ ID NO: 22770 - DNA, 201 bp, Homo sapiens
tagaaaggtcaggggtgggagaggagagaaagccattgtgatgcctttggctgtttgattgagtggatgggaagcagttaggaggatttcagcagagcagkgacatggtgtgacttacattttaacagtatcctctcgatgacattttgaggatacactaaagaggaacacgagcagaatcaggggcttcatgggaggctg

SEQ ID NO: 22771 - DNA, 201 bp, Homo sapiens
tattaaacagtccaaaattttgtgttctcattattcatgtggccaactagaagccctcaatctgctaaaaaaaaaaaaaattatagatccagttttcttayttcatagataaagcacttcttgaggcaaaatgaagcaagccagtgccttctaaaccttgattattctttcattaaaattagatagtaggccgggcatggt

SEQ ID NO: 22772 - DNA, 201 bp, Homo sapiens
attttggaatctggtattattaaataactgcttattttattttcccaaatattaaacagtccaaaattttgtgttctcattattcatgtggccaactagawgccctcaatctgctaaaaaaaaaaaaaattatagatccagttttcttatttcatagataaagcacttcttgaggcaaaatgaagcaagccagtgccttct

SEQ ID NO: 22773 - DNA, 201 bp, Homo sapiens
gaggtaaagatggctctgggagaacagttttgggagggctagtgggacagaggaatcaaagcacttgtttatttatttattagatatttattgagagcctstcacgtgcagacacttttctaaaaactgggaacatggcagtgagcagaaaagaaatctgtacattcatggaacttgtattgtcttcagagagaaagccaa

SEQ ID NO: 22774 - DNA, 201 bp, Homo sapiens
ccgtaagaagcgtcgagagccctcctggaagcagggctggttgtgaatgcagggtagcagccaggctgggggacagaaagtggttcagttcacagtgtagwtctctctccccataaaacacaggctcatctcctgtttttatatgtgtctactcaaaaatgagttgaaacaaaaaagcaacaaggcctcggaatgtgtttg

SEQ ID NO: 22775 - DNA, 201 bp, Homo sapiens
atcatcttctgtttcccattattgtattggacttgtggtatcatttctgtttacatcaacagtagaattcaaataatgaggaaagcactaaccgttttcaraatttttaaaacttcaattcagagtcacttggcacctaaaagttttcaaatgtgctggtgaaatgaagaaaacaaaatttgtaatagaatcaatctttct

SEQ ID NO: 22776 - DNA, 201 bp, Homo sapiens
caaaaggtgggattggcaaggaaaagatgtggtatcccaggctacaaaatactgtgaggaaacacacttgtccctatatggcgtctactaaacattgacamctgcttagggagggttttaccatgaagggaaaaatacagattgttgaaccacactcaactcttaggttacaaaggctcagtgacctactttccgcttacc

SEQ ID NO: 22777 - DNA, 201 bp, Homo sapiens
agaaattcctttcgttctgaactttattatactttgcattgtattttttcatagcctctttacagccaagtaattttcaatgggaaacacgtgcacacacmcacatacacaaacacacacacaatgagaaaggtgtaatagttgactggaagcagagcaggcaacattgcccccgcccatctccaccttttaaaaattcac

SEQ ID NO: 22778 - DNA, 201 bp, Homo sapiens
gaagtaatacagtagacaggtttttcagactgaatcagagagtgctggaaaggaagtactgaaagacaaccctagaccaaatcttaggtctgcaggtggtycactgtgtaagtgtgcacgtgtgtacttgtgtgtgttttaatgtcaatttaaaaggatagagatattttcgtgcttgatagatcagagagtgaagtggat

SEQ ID NO: 22779 - DNA, 201 bp, Homo sapiens
ttgtattttttcatagcctctttacagccaagtaattttcaatgggaaacacgtgcacacacacacatacacaaacacacacacaatgagaaaggtgtaayagttgactggaagcagagcaggcaacattgcccccgcccatctccaccttttaaaaattcactttacctacattctccagaatgtttccccaaaagcaaa

SEQ ID NO: 22780 - DNA, 201 bp, Homo sapiens
tctaacactgctacacaaagtcacataataaaatagattccttttatatgtagaatggtggtgaataaaaagtataaatgtaaacaaatacgggtgggttrtatttgcaacccgcatgccaatagcagcatcaccatctgcaagataagtttccagaatggtggaaaaactcaaaacaaacatttctaaaccaaacaaagt

SEQ ID NO: 22781 - DNA, 201 bp, Homo sapiens
ctggagtgtagtggcgtgatcttagctcactgcaacctccacctcccaggttcaagtgattctcctacctcagcttcccaagtagctgagattacaggcaygcgccaccatgcccagccgatttttgtatttttagtagacagagcgtttccccatattggccaggctggtctcaaactcctgaactcaggtgatccaacc

SEQ ID NO: 22782 - DNA, 201 bp, Homo sapiens
actgcaacctccacctcccaggttcaagtgattctcctacctcagcttcccaagtagctgagattacaggcatgcgccaccatgcccagccgatttttgtrtttttagtagacagagcgtttccccatattggccaggctggtctcaaactcctgaactcaggtgatccaacctcccaaagtgctgggattacaggcatga

SEQ ID NO: 22783 - DNA, 201 bp, Homo sapiens
tggagaatcacttgaacttgggagatggaggctgtagtgagccgagatcacgccactgcactccagcctgggtgacggagcaagactccgtctcaaaaaamaaaacaaaacaaaaaaaacccaccatgaacccgggaggtggagcttgcagtgagccaagatcgtgccactgcactccagcctgggcgacagagcaagact

SEQ ID NO: 22784 - DNA, 201 bp, Homo sapiens
taagtgcattaaaatattgatgggaaacccttgagcattaaagttctgtgtatgtccgtgctaggtgtgggcaggaactgaggaggtggacaaagccctgmtagccactggctgtgggaacgtggctccgggtcccgttatcacaccaagtaacacattcactgccgtcttccagtctcaggaggcaccagctcagggctt

SEQ ID NO: 22785 - DNA, 201 bp, Homo sapiens
ttagacctcagtggtcagaggcccagccacgtgctctgtaactatgccagccagcttcttcctgtcccagagatgacctggatctccacagatatatagtytaaatcatgacagccttcatatacagattaacaaattgaacaaattaacaccaaaacttgaagtatttgaccttaagtatgtcagttattagcctggtaa

SEQ ID NO: 22786 - DNA, 201 bp, Homo sapiens
atgggagcatgagtgccatctggtgggcattgcattaaattactattaagagttacaaaaatcagccctgcgtcagaatcacctgtggagttacttacatyagacttccagttcccaccgaaacccactgaatcgggatttcccagggaggagtcacagcacgctgtttttttaaaaaaaagctccctctgtgacgtcagt

SEQ ID NO: 22787 - DNA, 201 bp, Homo sapiens
tttttttataaatgtggatataatttcatgtgtaattgttttttttcttaaaggtaccactgatttctttaacactttatcaatgttaaacataaatgaaraaatgtaaaacataagtataaaacatgaagtacagaggtagctcttgttttgctaatatttacatacaactttttgtaagttgtaatattttactaatat

SEQ ID NO: 22788 - DNA, 201 bp, Homo sapiens
tttgctaatatttacatacaactttttgtaagttgtaatattttactaatatttacatacatactttcacatgttacatacatacatatttacatgcatawttacatacatatgaaagttgtatacttttgtatgtatactccttaagtatacaattcaactttttatgtatgtaaatatgcatgtaaatatgtttgttaa

SEQ ID NO: 22789 - DNA, 201 bp, Homo sapiens
catgttacatacatacatatttacatgcatatttacatacatatgaaagttgtatacttttgtatgtatactccttaagtatacaattcaactttttatgyatgtaaatatgcatgtaaatatgtttgttaaacttgtaatatttatatacatacagtatttaaatacatacagtgtacatacagaggtagctccttattt

SEQ ID NO: 22790 - DNA, 201 bp, Homo sapiens
atttccattcactttgaagatttttacctagaaagtcaccaagactgtcaatttgatgtcctcgagtttcgagtgggtgagttctatctaagaatgcgttytcccatttatctacaatattctttttatcttttttgttgttgtcgctgctgttgttgttgttttgagacaggagcttgctctcttgcccggactggagtg

SEQ ID NO: 22791 - DNA, 201 bp, Homo sapiens; identical to SEQ ID NO: 3177

SEQ ID NO: 22792 - DNA, 201 bp, Homo sapiens
gagcttcatttctggagccaagctgcctgagtttcaattttaactgtactagttaagtgcttacacaatctctctgtgctcagtttcttcatttgtataargggattattttacctgtctcacagggttgcaataattaagtatatatgtgtaaagactcagaacaatacctggtgcatattaagtaattggtaaatgcta

SEQ ID NO: 22793 - DNA, 201 bp, Homo sapiens
tcctactaccacacactctcaaagcatttctcagacagtttgcaagaaataacaaaatctgtccagtaaggatagtaactacaatcccaaatagactcttyggcagcagtgactctccaaaactgctgaggcctagaccctcctcactgctgagaaaggaggactttgcaccttctttgggaaagagtgttgcttttacac

SEQ ID NO: 22794 - DNA, 201 bp, Homo sapiens
ttattaatagcaaagaaaaattaaaatcccaaacttacaaggttttctactaacgtagagtttgctaaaagttaacagtgtaacatgcattatcctactaycacacactctcaaagcatttctcagacagtttgcaagaaataacaaaatctgtccagtaaggatagtaactacaatcccaaatagactcttcggcagcag

SEQ ID NO: 22795 - DNA, 201 bp, Homo sapiens
atagacttcattcagaaaacaaaatgataatttttctctcctgggacataaatggataagaattgcgtactccttcttttgcaatgtaaaggagttgatgmaattttaatttgtctttccagctaagaaatggtcctgatatctattctccacccttgggaccccctggaggaaatggtcatttttgtggcagtcatgctt

SEQ ID NO: 22796 - DNA, 201 bp, Homo sapiens
ctccaaagaccttgccttaactacagagaagtttgccgtaacctctgaattctctatttccctcccatttgactcaaacttctgtttctcctggccacgcygaaccttttcttcatttatccccaggaccctgtactctcctggttatttaatttctctgagtattctccactctcctgtagaatggtggccctcttcaca

SEQ ID NO: 22797 - DNA, 201 bp, Homo sapiens
tctagcaagtggatgcctcacagcctgcttgaattcctctcctgaaaaagctttttctttctctgccatatggccaggctgtaaattttccaaatttttamactctgctttcctttttaatataagttccaattcgaagtcatttctttgctcccacatctgagcacatgctattagaagcagccagcccaaatcttgaac

SEQ ID NO: 22798 - DNA, 201 bp, Homo sapiens
acatggtgctgacatctgcttggcttctggggcagcctcaggaagcttataatcatggaggaaggcgaaggggaaacaggcatgtcacacggtgaaagcasgagcaagacagcgagagtatgggacaggtgccacacacttttaagtggccagctctcatgtgaactcagagcaagagctcacttatcaccaagggtatgg

SEQ ID NO: 22799 - DNA, 201 bp, Homo sapiens
cacacacttttaagtggccagctctcatgtgaactcagagcaagagctcacttatcaccaagggtatggcccaagccattcatgagggatctacccccacratctaaacacctcccaccaggccgatctccaacactggcttttataactcaacatgagatttgagcagggacaaatatccaaactctattatgtatttac

SEQ ID NO: 22800 - DNA, 201 bp, Homo sapiens
taacaataaagtacccttctccctcctctcatccatttttctttatagaatttatcaccatctcacatatcatgtatttgtttattgtatgtcttccccakctataaagaaatctttatgaaagcaggtaatttgtcttgtttacttacctctgtatcccagatctcaatgaccaccacaaactgagtagccaatagcatg

SEQ ID NO: 22801 - DNA, 201 bp, Homo sapiens
gatctaaacacctcccaccaggccgatctccaacactggcttttataactcaacatgagatttgagcagggacaaatatccaaactctattatgtatttaygctcaggagtacaaagtttccataagcaccaccattgcctattccttaacacaatatgttaagttataaataaacaatatggtttgccacttaacaagaa

SEQ ID NO: 22802 - DNA, 201 bp, Homo sapiens
aattcctgctccctttttgtattatggatagacatatcaactttatgggtgacaattacattggaaaggacagtgaatgcgataagtaacaccatcaaatmcaaaaggtcttgataagctacaacaatgggccaattgtaacagacgaaatgtgacagatataagatcttcctcttttatcaaaaaatgaattgcaaaagt

SEQ ID NO: 22803 - DNA, 201 bp, Homo sapiens
aggcttgggagcatgacattttcgtgtatagccaagggaagtagttattgagtaattcagtttttgagtaattcagctggaagaaggagaaaagagtcaastgtactctcattcgtaagacccaccgtatatcctctggttctgctttacatttaattcacttgtttccaaatgtttattgagcatcagctatgtgatacg

SEQ ID NO: 22804 - DNA, 201 bp, Homo sapiens
agccagtggagagtagcaaaaacagtttggtttttcctatctcaaacaggagtgaaaacaaattcctatgaaacagaagtgaatggaggcatgcagctcaraataacttcaagagagacatgcaggagggctgggactctctgttccaggtgtaacctggatgtggggctggctggtgcagtgtgaggggctaaaaccaaa

SEQ ID NO: 22805 - DNA, 201 bp, Homo sapiens
gaaaacaatacaaacaaacaagagaccactccagctatctagaaaaaccagttcagatcttcacacttgaactcaaaagaacaaccaagaatcaatcaccrgagaggggaagaatctttcttttctagggaaaagactagataaatacacgtaagaatggacccttgaagaaacataattgagtgaacagaagagaggttt

SEQ ID NO: 22806 - DNA, 201 bp, Homo sapiens
agtgaacatcacctatactgggagaaaccgatgccatctgtaccttgatatcatgcactggaaaagacacatcgctttagtggtgtttctccaaaaattcrtaacctgaaagggaacatcaaacttactttgaaggatattccacacaatacctggtctgtattcttaaataatgtctagttcaataaacataaaagccaa

SEQ ID NO: 22807 - DNA, 201 bp, Homo sapiens
cttcaccgtcctgagacccaggctctagagcttgctgggggaaaagtaaaagatggttgaattatgcagtgacttccaaagcttctatgtggaaattggtktatcacttttgctcacactctgttgggcaaagcaagtcctatggctaagcccatagtcaatgggaagattatgtattaattctccgtatggcagtattgc

SEQ ID NO: 22808 - DNA, 201 bp, Homo sapiens
acacattttttttttgtaggatgcctactatgagcaaagcactgtgctgggtgcattggtaggcaattagccagacctcaggttcatctgcgctccagggrtgttcttagaaatggagccacaaagataatgtaataatagtagctggttttgttttgttttgttgttgttgttttgagacagagtctctccctgtcaccc

SEQ ID NO: 22809 - DNA, 201 bp, Homo sapiens
taggaagtagtcttttgtgtcttattgttgtccttgaaaaatatttttaagcaagcaaaatgacttgccacaggttggcagaaaaatatttgcaaaatacrtatttgaaaattcttgtatctagaatatatgagctcttacaatcaataaaagacaaacaacaaaattttaaaaaataggcaaaatatctaaacagacagt

SEQ ID NO: 22810 - DNA, 201 bp, Homo sapiens
cagccttgatactaattaggaatacttttgtttgtttgtttttgggttttttttgttgttgtttttgttgtttgttggtttgttttttgagatggagtttyactcttgttgcccaggctggagtgcaatggcaatatctcagctcactgcaacctctgcctcctaggttcaagtgattctcctgcctcagcctcccaagta

SEQ ID NO: 22811 - DNA, 201 bp, Homo sapiens
gttctctgggcaagaagtccccaaccagatgatccaacaacaggactgagggtgcccagggcaagtgccagctcatgttatgacccttattgagccccggktacatttaaccattgagggccaggaaattgacttcctcctggacactggcatggccttctcagtgttaatctcttgtcctggatgactgtcctcaaggtt

SEQ ID NO: 22812 - DNA, 201 bp, Homo sapiens
gcaagtgccagctcatgttatgacccttattgagccccggttacatttaaccattgagggccaggaaattgacttcctcctggacactggcatggccttckcagtgttaatctcttgtcctggatgactgtcctcaaggttttaccatccaaggaatcctgggacatcctgtaaccaggtatttctcctacctcctcagtt

SEQ ID NO: 22813 - DNA, 201 bp, Homo sapiens
ttgatgcctaaatagtcagcacttgatattaaatgggttatatagcaaaattatggtgaaaatggagaacacaatgcattttttttacatcaaagatcaaytgcggaaattgcagctttccgaatcagtgggttacatacgatattcattgatttctctgagaaattgtttcaattggttgcttcttttcagtagagggct

SEQ ID NO: 22814 - DNA, 201 bp, Homo sapiens
gcaggcgactctagatctcttgaaatttctagctaatcaagggtacaaggcatctaggtcgaagacccagctttgcctacagcaggccaaatatctaggcytaatcttagccagagggaccagggccctcagcaaggaacgaaagcagcctacactggattatgctcaccctaagacattaaaacagttgtgggggttcct

SEQ ID NO: 22815 - DNA, 201 bp, Homo sapiens
acgcccgcctaattggagcttactgtggtacccagactgaatctttcagctccactggaaattctttgacatttcatttttactccgactcttcaatctcrgggaagggattccttctggagtggtttgcagtggatgcacctgatggtgttttacctaccattgctccaggtgtgtttggtaataaatgaagttcttttt

SEQ ID NO: 22816 - DNA, 201 bp, Homo sapiens
tggaatcatcggcttttgctgactgtggatccccagatacaaggagatagccaggcccctctatactctaatcaaggagacccagagggcaaatactcatytagtagaatgggaaccaggggcagaaacagccttcaaaaccttaaagcagaccctagtaaaagctccagctttaagctttcccacaggacaaaacttttc

SEQ ID NO: 22817 - DNA, 201 bp, Homo sapiens
tttatgttagagtattaaaaattttaatgatcatataaaaataaatataaatataaaaatcatggtgatcattgctatccagacattggctaccatatcarttccagaaacacaatcggatgcttacaggctatgaccccaccttattcatcttggattcttggtcatgaatagatcccagtgcctgatgggtgcccaata

SEQ ID NO: 22818 - DNA, 201 bp, Homo sapiens
tacactgctgaagccatcaaaaaggggaaggagagaggagaacagcagcataagtggctggcagaggcagggaaagaccagcagaaaggaaagaaagagayagaaagtcagacagagagacagagagaggaagagagagacaaagagggagtcagagagaaagagaaagaaagagaaggagacagagagatagaaagtcag

SEQ ID NO: 22819 - DNA, 201 bp, Homo sapiens
agtaatgacaataatatactctgtccctgatttttttctcctcctagttccacaggctactcaaatatagactattttgaccctgtgtaccaaaataatgmaattgaaggaatgcaggataaataatatagattttaccacctaaatgtaatcttaaatttgtctgaagatattatgataaaaataaactatcttgccatg

SEQ ID NO: 22820 - DNA, 201 bp, Homo sapiens
gcaatgataatattgtgggaactcatgggaaagtcgcctctcctttctggcctgaaaactacccacataactccaattaccaatggacagtaaatgtgaaygcatctcacgttgtccatggtagaatcttggagatggacatagaagaaatacaaaactgctattatgacaaattaagggtgagtttccacatgcaatcaa

SEQ ID NO: 22821 - DNA, 201 bp, Homo sapiens
gttctacatggctgaaggcatcttcaacagccctggctacccagacatttatccccctaatgtggaatgtgtctggaacatcgtcagttcccctggcaacyggctccagctgtcttttatgtaaatccttttttatggtgtattgtttcagtgctaatgaatctgtaggaaagaagttctggtgctaataggatgggcaac

SEQ ID NO: 22822 - DNA, 201 bp, Homo sapiens
gctaggcaaaagacaagttcgaaatagctgatgttatttgcaatccttaaacacaatttctgctttattactcatttataaagtgctgttctggagctgctatatatgttgctgatggaatccaccgatctgggagaaaccacggagatcatctggtcagttgccaaggtttagttatacaaactcgcttacaagagggag

SEQ ID NO: 22823 - DNA, 201 bp, Homo sapiens
tacacaatgtatatgtgtattgaaacatcacactatccctcatacatgtgttcaattattatgcatcacttaaaaccaaaataaaaaataaatataaactrtatatattcataaaattgaatcttaaacttttataaaaatgaaaaaatgctattctaaacaaataaatgaataaattatcttgagagaagtaaatagtct

SEQ ID NO: 22824 - DNA, 201 bp, Homo sapiens
cataaacagtcaattaacagatattttatatgttttatatattacatactgtattctttcaacaaagtaagctagagaaaataaaatgctatcaagaaaaytgtaaagaagagaaaatatatttactatttattaagtggaagttgatcatcataaaggtcttcatcctcatcatcttcacattgagtgggttggggagga

SEQ ID NO: 22825 - DNA, 201 bp, Homo sapiens
cgtgatccaccagcctcggcctcccaaagtggtgggattacaggtgtgagccacctcgctcaccctggtgttctttttggcttgtttgttaaggcagcccyaacctggggaggagaggaacgaggagctacccaggactgggtttcttagcctcttagcccagagagtgctgttggtcactgccatcttccttgtttttag

SEQ ID NO: 22826 - DNA, 201 bp, Homo sapiens
acgaatgcaggaaccggggtgaacgaaccctagaactggctggtccctcctctctggtggaagcaggctctgtgcacggcccacggcagcgtccaagcttsttacaatgctcttttagctctgccatctcggagagggtgtctgcgaccccaagagccccaaagggcatgtgttgcaatcagtgctcttttagcatttgcc

SEQ ID NO: 22827 - DNA, 201 bp, Homo sapiens
ggcttatttgcttggctgcctagctgaattcaggagggagcacacgaatagacgaatgcaggaaccggggtgaacgaaccctagaactggctggtccctcmtctctggtggaagcaggctctgtgcacggcccacggcagcgtccaagcttcttacaatgctcttttagctctgccatctcggagagggtgtctgcgaccc

SEQ ID NO: 22828 - DNA, 201 bp, Homo sapiens
atagaacaggttgggagatgggagtggaggagaaggaatatggctatgaattggtcagatgacaaaaagagtttctgctactgagatgggaaagtttcctkgactcctttacaggacttgcgaagggggtggcttatttgcttggctgcctagctgaattcaggagggagcacacgaatagacgaatgcaggaaccggggt

SEQ ID NO: 22829 - DNA, 201 bp, Homo sapiens
ggaaaacctatgtaacatctagtccagtgcttttcaaactgcaattcatgactcattcgtgagtcatgaaattaatttattcggttgctacttgtgattgytaaaagtatggagtaggatagaaaggaataggagagaaagtatcagagtttatcatacaaagtaaggtgccgcttcatgagaactgtttgtagtatctcc

SEQ ID NO: 22830 - DNA, 201 bp, Homo sapiens
ctaggcaaaagacaagttcgaaatagctgatgttatttgcaatccttaaacacaatttctgctttattactcatttataaagtgctgttctggagctgctatatatgttgctgatggaatccaccgatctgggagaaaccacggagatcatctggtcagttgccaaggtttagttatacaaactcgcttacaagagggaga

SEQ ID NO: 22831 - DNA, 201 bp, Homo sapiens
gagagcagtgctgtgatctcggctcaatgcgacttccacctcctgggttcaagcaattctcctgcctcagtctcctgaatagttgagattacaggcgcatrccaccacgcccagctaatttttgcatttttagtagagacagggtttcaccatgttgggacaggctggtctcgaactcatgacctcaggtgatctgcccac

SEQ ID NO: 22832 - DNA, 201 bp, Homo sapiens
gtttccagcttcatccatgtccctaaaaaggatatgaactcatcattttttatggctgcatagtattccatggtgtatatgtgccacattttcttaatccrgtctatcattgttggacatttgggttggttccaagtctttgctcttgtgaatagtgcgggaataaacatacatgtgcatgtgtctttatagcagcatgat

SEQ ID NO: 22833 - DNA, 201 bp, Homo sapiens
aaaaaaaaaaaaaaaaaaagggattgcttttccctctaaaaggaatcctgccaccaacttttaaataatgcaacatgcttttaaataatgcttatttatargacaaaggtgtgtatgagaattaaaaagttccctttgcttggcttctttattttcccacattaccgttctttagaactatgatcacaggcctccagaact

SEQ ID NO: 22834 - DNA, 201 bp, Homo sapiens
catagtattccatggtgtatatgtgccacattttcttaatccggtctatcattgttggacatttgggttggttccaagtctttgctcttgtgaatagtgcsggaataaacatacatgtgcatgtgtctttatagcagcatgatttatattcctttgggtatatacccagtaatgggatggctgggtcaaatggtatttgta

SEQ ID NO: 22835 - DNA, 201 bp, Homo sapiens
tttttacctccatgttctcatttaaacattaaatcgttccatgaggtaagaggggaattttattcccattttacagtggtcaaaactaacgctcaaaaagrttaatgggcttttccatgaccacatggaaggggagtggaagagctaataactgaagccagtcactgctcaacactccagtaaatcctgagaccatagatg

SEQ ID NO: 22836 - DNA, 201 bp, Homo sapiens
tctcagtctgttgcccaggctggagtgcagtggcaagctcccagctcactgcaacctccaccttccgggtttcagcaattctcgtgcctcagcctcccgartagctgggactacaggcatgcaccagcacgcctggctaatttttgtattttttttagtagagacagggtttcaccatgttggccaggctggtctcggact

SEQ ID NO: 22837 - DNA, 201 bp, Homo sapiens
acacagaggcatgaataccaggacgtggggctcactgagagctgggtcagaagttgcctaccaccccccacccctacaatctccagttggaaaattttcayttcttatctctcccactcctacctacccatatttctggacaacccccaccccaccccttggttctcttttcttttttgcctccatagctttctaattccc

SEQ ID NO: 22838 - DNA, 201 bp, Homo sapiens
agggagaaaataaacttagggtcaggctggagccactttgattttttttttttttttgagatggagtttcactcttgttgcccaggctggagtgcaaaggygtgatctcagctcactgcgacctccacctcccaggttcaagcaattctcctgcctcagcctcccaagtagctgggattacaggcatgtgccaccatgccc

SEQ ID NO: 22839 - DNA, 201 bp, Homo sapiens
ttaccccagtccttataggagcaacacagactgttcttgggtcattcgggttgacagaaatcatcgtgttctcttgaacttcactgactttgatcttgaaycacaagactcttgtattatggtaagtgacataaatttcaagcattgtctccagtcaaacctcggtcaaaacactgccatataagcatatttagtgaatat

SEQ ID NO: 22840 - DNA, 201 bp, Homo sapiens
acaagacagaaagtgctagcaagagggcaggaaccatcttttctcacctcattatggaggtgacagactatcacttccattgtattctgttaattagaacmaatcacgaggtctatcccatacgccagggaggagattacacagaggcatgaataccaggacgtggggctcactgagagctgggtcagaagttgcctacca

SEQ ID NO: 22841 - DNA, 201 bp, Homo sapiens
atcacaagactcttgtattatggtaagtgacataaatttcaagcattgtctccagtcaaacctcggtcaaaacactgccatataagcatatttagtgaatrtattacttatgggtgtttttaatgtcgaatcataggaaaccaaactattggcaacttaaaatataaggacatttattttttacctaaaaacaaatcagga

SEQ ID NO: 22842 - DNA, 201 bp, Homo sapiens
tcatgtgaatgtacacagggttcagttccttgcaggctgttggctgaggcctcccttgactccctgccacacaggcctcgccacggagtatctcagaacayggcaccttgctcaccagggcaagcaatagagaggacaagagagagtccaacaagacagaaagtgctagcaagagggcaggaaccatcttttctcacctca

SEQ ID NO: 22843 - DNA, 201 bp, Homo sapiens
aaaacaaatcaggaagtagataatctctaggttttttagcaagtcagtttctgcgctaccattattagcctgttggcttttcattttgttgttacttcatkgtcaaaaaatggctgcagtggtttttatctgaatgtcctacctgagtctacctctgaaaaaaggaagaagcaatagtgttaactatttctgttttgtttg

SEQ ID NO: 22844 - DNA, 201 bp, Homo sapiens
ttttgtttgtgtttcttttaataaggaaagcaaattttccaaaaaagcccctgatatatcattagccagaactgactacaaaagagatccagaaagtatcrtggaatagatttatcataaatgttttagatcaattattattattaagcatctgggattttcacaggattctgcttctcttgagacaaggatatcttgatt

SEQ ID NO: 22845 - DNA, 201 bp, Homo sapiens
cctgcgtgcttcctggctcactcatgtgaatgtacacagggttcagttccttgcaggctgttggctgaggcctcccttgactccctgccacacaggcctckccacggagtatctcagaacatggcaccttgctcaccagggcaagcaatagagaggacaagagagagtccaacaagacagaaagtgctagcaagagggcag

SEQ ID NO: 22846 - DNA, 201 bp, Homo sapiens
tggtcagatgacaaaaagagtttctgctactgagatgggaaagtttcctggactcctttacaggacttgcgaagggggtggcttatttgcttggctgcctmgctgaattcaggagggagcacacgaatagacgaatgcaggaaccggggtgaacgaaccctagaactggctggtccctcctctctggtggaagcaggctct

SEQ ID NO: 22847 - DNA, 201 bp, Homo sapiens
tcttcattccacacccgcagacttaccccagaacttaccagcttaagacaacaacatttacagtttccgtgggtcaggaagccaggtgccactcacctgcrtgcttcctggctcactcatgtgaatgtacacagggttcagttccttgcaggctgttggctgaggcctcccttgactccctgccacacaggcctcgccacg

SEQ ID NO: 22848 - DNA, 201 bp, Homo sapiens
tattttgcatattttaagactttatgtacatcatgtcacacgctacatatccttcttcaacttgctctattcactcattattctgtttttcacattttctrcattgtaatgcatacagatctaatgcattcttttagtcactacacattctattttatatatgcaccacaagtcatttgcccattctcctgttaatgaaca

SEQ ID NO: 22849 - DNA, 201 bp, Homo sapiens
atgttctgatagaacaggttgggagatgggagtggaggagaaggaatatggctatgaattggtcagatgacaaaaagagtttctgctactgagatgggaargtttcctggactcctttacaggacttgcgaagggggtggcttatttgcttggctgcctagctgaattcaggagggagcacacgaatagacgaatgcagga

SEQ ID NO: 22850 - DNA, 201 bp, Homo sapiens
catgttctgatagaacaggttgggagatgggagtggaggagaaggaatatggctatgaattggtcagatgacaaaaagagtttctgctactgagatgggaragtttcctggactcctttacaggacttgcgaagggggtggcttatttgcttggctgcctagctgaattcaggagggagcacacgaatagacgaatgcagg

SEQ ID NO: 22851 - DNA, 201 bp, Homo sapiens
taatggattattttcgagcatccatgattcctctcatgaaataattgtgttccccacttccaggttgtggtgggattttccaggctcccagtggagagatwcattctccaaattaccccagtccttataggagcaacacagactgttcttgggtcattcgggttgacagaaatcatcgtgttctcttgaacttcactgact

SEQ ID NO: 22852 - DNA, 201 bp, Homo sapiens
ttggctgcctagctgaattcaggagggagcacacgaatagacgaatgcaggaaccggggtgaacgaaccctagaactggctggtccctcctctctggtggragcaggctctgtgcacggcccacggcagcgtccaagcttcttacaatgctcttttagctctgccatctcggagagggtgtctgcgaccccaagagcccca

SEQ ID NO: 22853 - DNA, 201 bp, Homo sapiens
ctggtggaagcaggctctgtgcacggcccacggcagcgtccaagcttcttacaatgctcttttagctctgccatctcggagagggtgtctgcgaccccaaragccccaaagggcatgtgttgcaatcagtgctcttttagcatttgccgtccatggacagctaagtgttaaccagctcagtggagggtcagggtgacagcc

SEQ ID NO: 22854 - DNA, 201 bp, Homo sapiens
atacttttatggccaattgatatatgaaaatgatgccaaaacatatcaatggagaaaaatcattttttcaacaaatggtgctcaatagccacatgcaaaaytatggtgctggaccccttccttatagcatacacaaaaattaactaaaaatggattatagacctaaatgtcagagctaaaaccatgaaactcttaggagaa

SEQ ID NO: 22855 - DNA, 201 bp, Homo sapiens
gctggatagattgcaaaaattttctcctattctgtagattgcctgttcactctggtgatagtttcttttgctatgaagaagctctttagtttaattagatsccatttgttaattttggcttttgttaccattgctcttggtgtttaagtcatgaagtctttgcccatgcctatgtcctgaatggtattgcctgggttttct

SEQ ID NO: 22856 - DNA, 201 bp, Homo sapiens
ccagactggccaaatcttcatattttgccacatttgcttcaagttcttttgttttctcccaaacagaaatgaactgttcaagacacaggtgaagtcccacrtgctcctatcattgatcccatgccctgttccccgtcccagaggaaactgctaatgagatttctggtttgtgattcccatgaaggtttttatagttttttc

SEQ ID NO: 22857 - DNA, 201 bp, Homo sapiens
cactctggtgatagtttcttttgctatgaagaagctctttagtttaattagatgccatttgttaattttggcttttgttaccattgctcttggtgtttaartcatgaagtctttgcccatgcctatgtcctgaatggtattgcctgggttttcttctagggtttttatgattttaggttttacatttaagtctttaatcca

SEQ ID NO: 22858 - DNA, 201 bp, Homo sapiens
gactgacatttcagtcaggtggtcacgagccatttaatcaccccagggttttgattacagcagagaggggcagccgctgaagtgctctgcatcacgtccaygtcaatcacgtggtctttagtgcttaggcaaagcatgcgtgattactggtctttatttcgtgcaatttaaaaatgtatgctcagctttactttagtatgt

SEQ ID NO: 22859 - DNA, 201 bp, Homo sapiens
ttccaacaatctcagggaatatattcctgtttttttttttttttttttagaaataaaaatacagatattactgaggaagctacaattcatttccccctcaktcatgaggggtgcaaacgatgactgacatttcagtcaggtggtcacgagccatttaatcaccccagggttttgattacagcagagaggggcagccgctga

SEQ ID NO: 22860 - DNA, 201 bp, Homo sapiens
ttttcttctagggtttttatgattttaggttttacatttaagtctttaatccatcttgagttaatttttgtataaggtgtaaggaaggggtccaatttcasttttctgcatatggctagccagttttcccaacaccatttattaaatagggaatcctttcctcattgcttgtttttgtcaggtttgttaaagatcagatgg

SEQ ID NO: 22861 - DNA, 201 bp, Homo sapiens
gttactgtaggcttgtagtatagtttgaagtcaggtaacgttatgtctccagctttgttctttttgcttaggattgtcttggctgtacaggctcttttttkgttccacatgaaatttagagttttttttctaattccgtgaagaaagtcaatggtagcttgatgggtatagcattgaatctataaattactttggacatta

SEQ ID NO: 22862 - DNA, 201 bp, Homo sapiens
aaatgtatttaaagtacctatcagtgtctggttcagataagtatttgctgctattcctaatttttctattacaatgactcctgcttctattactattaackctatgttaaagatcttaaggaatcttttaaaaaaattttctccctgagcaagatgaaacttagtaaacaagataaaaaatccagtagaaaaaaattcctc

SEQ ID NO: 22863 - DNA, 201 bp, Homo sapiens
gcttaggattgtcttggctgtacaggctcttttttggttccacatgaaatttagagttttttttctaattccgtgaagaaagtcaatggtagcttgatggrtatagcattgaatctataaattactttggacattatggccattttcatgatattaattcttcctatccatgagcgtggaatgtttttccatttgtttgtg

SEQ ID NO: 22864 - DNA, 201 bp, Homo sapiens
ccattctgctaagtgagccatgctgggaatcccatgcacgttcactggaatggaatgcaggacagatgccaaccacttggaaagccacaggagcccagtayaagactttctcaaatgctactgaggatgcttgattgcaggttcagatgcaaaggatgggggactcccaccctatttccagagctgctgtggttttctttc

SEQ ID NO: 22865 - DNA, 201 bp, Homo sapiens
ccgtgaagaaagtcaatggtagcttgatgggtatagcattgaatctataaattactttggacattatggccattttcatgatattaattcttcctatccaygagcgtggaatgtttttccatttgtttgtgtcctctcttatttccttgagcagtggtttataattctccttgaagagatccttcacatcccttgtaagtt

SEQ ID NO: 22866 - DNA, 201 bp, Homo sapiens
tacccattctgctaagtgagccatgctgggaatcccatgcacgttcactggaatggaatgcaggacagatgccaaccacttggaaagccacaggagcccartacaagactttctcaaatgctactgaggatgcttgattgcaggttcagatgcaaaggatgggggactcccaccctatttccagagctgctgtggttttct

SEQ ID NO: 22867 - DNA, 201 bp, Homo sapiens
ctcatcttaccagtgtggacactgaagcttagaaaggttagtggcttgcccaaagttccacagctagaaaacgtcaaagcacatatgtgattccagactaygttatggccacacttcttcaactctatcataaccaaggtatctatataagagctctcccctaaagttaattatgtaggaatttaaataaacacacacaca

SEQ ID NO: 22868 - DNA, 201 bp, Homo sapiens
aaaccctgtctctactaaaaataaaacaaataaaaaaaaattagccaggtgtagtggcacattcctgtaatcccagctactcgggaggctgaggcaggagaattgcttgaatccaggaggcggagtttgtagtgagcagagacagtgccactgtactccagcctggccaacagagtaagactccatctcacaaaaaaaaaa

SEQ ID NO: 22869 - DNA, 201 bp, Homo sapiens
gatggctaacacctcacacttgcagtctgagaaagctcccccagaaagagcattcgtgtggcggagcatagagactgggcactgccaacaagcacagggayggcctaccagggctgccgctgctcttcaaggggccgccagggccatctgccgcagagcgcttttgtaaaaaaatggccacctaggtagcatgaggcattt

SEQ ID NO: 22870 - DNA, 201 bp, Homo sapiens
ataaaatggtatgtctgaatagataaaattttcccttgaaatcctattaactttttccagcaaactattacagagggcattgtacaagggtcaaaaaacatttttttttcctttgaggagggaggactatttgcgacctggtaacctcacactaaaataaactccaaaataaatttcccagtgggtatgctatgtgaattt

SEQ ID NO: 22871 - DNA, 201 bp, Homo sapiens
taattataactttattgtaacttaacggttttctcctaaattaagcattgtatatttttgatggcctttcggtgagttgaatttggaattattttccacgkgctgttgcccactttgaactgactgaacctttctgttttaacaggttgtggtggagagctgtctggggccacaggctccttcagcagccccgggttcccc

SEQ ID NO: 22872 - DNA, 201 bp, Homo sapiens
caggcacctcccttatctaataaatggctaatataatttgtcttcagtaggatgactaacagctggatacccagtgcttaaaaatcaattgaaacaatacrgctttaaagagctgagaattattaaaccaatgctatgaatcagtgctatttcacatctcttgctatggactgatttcccaatagaaatgtttttaatgac

SEQ ID NO: 22873 - DNA, 201 bp, Homo sapiens
tgaatcagtgctatttcacatctcttgctatggactgatttcccaatagaaatgtttttaatgacttgatgttttattgctgtgggtgaggaatatccttsagaagagatgtgtttggaatgagtaatttggtatcattccatgtgaagaaaatgttgaatagtcaagtaagattaatacacatccaactacatccttgtt

SEQ ID NO: 22874 - DNA, 201 bp, Homo sapiens
gaagaaaatgttgaatagtcaagtaagattaatacacatccaactacatccttgtttgagatagttgtctgttgagagaaagggcatattgggtattgcasattgcgtagcaatagtcctggcccctacccactagatactacccatcacaccgagtgtgacaatagaaaaatgactacaaaccttgccagaggtcccaaa

SEQ ID NO: 22875 - DNA, 201 bp, Homo sapiens
ctgcactctgactcccagtttctctttgcctttgaggataccacagaccacacgtcccaacttacatggatagttgtgccccaagggtttagggatagccytcatctgtttgctcaggcactggcccaagatctaggtaacttctcaagtccaggcactctggtccttcaatatgtggatgatttacttttggctacctgt

SEQ ID NO: 22876 - DNA, 201 bp, Homo sapiens
attggtttgctgttctggacctcaaggatgccttcttctgtattctcctgcactctgactcccagtttctctttgcctttgaggataccacagaccacacrtcccaacttacatggatagttgtgccccaagggtttagggatagccttcatctgtttgctcaggcactggcccaagatctaggtaacttctcaagtccag

SEQ ID NO: 22877 - DNA, 201 bp, Homo sapiens
tgacttcgatgtggagtatcattcaaggtgcaactttgatgtcttggaggtaggaagtgagatggttttttcagcacattccaaagtttggggtagaacargaaatcactctgccaagattccgaattctttccagtagtcagcagtgttctattcttagacattttaatgagcatcagcccttcggtgatcatttggtag

SEQ ID NO: 22878 - DNA, 201 bp, Homo sapiens
gagaaacagtgaactggaagataagtcaagaatctactcagaaaaaagtatggataaaaaaaggatgaaaaatatataagagaggttaagacacatagaasacactcagaaaatatataacacacagttaattggagtctcacaaggaaaagagagatatatggaacagaagcaaactttgaagagctactgactaaaatt

SEQ ID NO: 22879 - DNA, 201 bp, Homo sapiens
gtaccccaaagtccaacatcttacataatatctctgcagtctcagttcatataaagccaatccttcattttggagacattcaagttaatgtcctgttcctrttgcttagacagagttattagcaaagagaaaaatattcagttgccagtgatgctgtcagataatgttggggttcaggagatttttaatagagttcaagtg

SEQ ID NO: 22880 - DNA, 201 bp, Homo sapiens
ggaaacaagtcttctttaaatatttactgttttacaaacaaatccatgacagaaaccagtctctctctctcccctcctcttcctctctccctctcttttcctctctctctctctcttttcctctctctctctccctgtctttctgtccctctttctttccctcttcctcttgctctctctccctctcttcctctttccccc

SEQ ID NO: 22881 - DNA, 201 bp, Homo sapiens
gaaacaagtcttctttaaatatttactgttttacaaacaaatccatgacagaaaccagtctctctctctcccctcctcttcctctctccctctcttttcctctctctctctctcttttcctctctctctctccctgtctttctgtccctctttctttccctcttcctcttgctctctctccctctcttcctctttccccct

SEQ ID NO: 22882 - DNA, 201 bp, Homo sapiens
gctctttgttacccattctgctaagtgagccatgctgggaatcccatgcacgttcactggaatggaatgcaggacagatgccaaccacttggaaagccacrggagcccagtacaagactttctcaaatgctactgaggatgcttgattgcaggttcagatgcaaaggatgggggactcccaccctatttccagagctgctg

SEQ ID NO: 22883 - DNA, 201 bp, Homo sapiens
atcatttggtagacatgggattaatgtgtggtttgggttttcctgaagcaatgcctgagggccttgcagcagctgagttaggaggtaatgccaggaagccrgagcccaggacgagtgagtgaaggaaaggaggagggggaaccagcagagggagcccctgggggcaacttgggctccatccgctgggaccttctgaaggac

SEQ ID NO: 22884 - DNA, 201 bp, Homo sapiens
aaacaagtcttctttaaatatttactgttttacaaacaaatccatgacagaaaccagtctctctctctcccctcctcttcctctctccctctcttttcctctctctctctctcttttcctctctctctctccctgtctttctgtccctctttctttccctcttcctcttgctctctctccctctcttcctctttccccctc

SEQ ID NO: 22885 - DNA, 201 bp, Homo sapiens
atgtttcctctattttggagaagttcgtattccaaagtgggaattccattagcagctataccgccatattataacatgtgaaaatacctcatggactctcratcctcaaaatcactttgcacctccatgtgaattatctctcctgtgccctaaatgtcttattcttcaccacatttttgcaccctgctaagatcaaaggca

SEQ ID NO: 22886 - DNA, 201 bp, Homo sapiens
aacaagtcttctttaaatatttactgttttacaaacaaatccatgacagaaaccagtctctctctctcccctcctcttcctctctccctctcttttcctctctctctctctcttttcctctctctctctccctgtctttctgtccctctttctttccctcttcctcttgctctctctccctctcttcctctttccccctct

SEQ ID NO: 22887 - DNA, 201 bp, Homo sapiens
aacagcttgtataatttcctgagggatttccctccctatcacttaatgtttcctctattttggagaagttcgtattccaaagtgggaattccattagcagstataccgccatattataacatgtgaaaatacctcatggactctcaatcctcaaaatcactttgcacctccatgtgaattatctctcctgtgccctaaatg

SEQ ID NO: 22888 - DNA, 201 bp, Homo sapiens
cccaattcctgatgtgcttaagaacaagcatttcctaatctgatagggaagtcatttctacagttgcttctaaatttaaaaacaatttcttttttttcatktcaaggcctagcaaaggttaaaaaacacacacacgcacaacaacacaacacacctacaaccttgctgtattaacaggcgtatgcaggcgtatgagattgg

SEQ ID NO: 22889 - DNA, 201 bp, Homo sapiens
ctgccatgttgtcattcattctccttgtcattatcttcattatttaggccgttactgtggcaccgacatgccccatcctatcacatccttcagcagcgccytgacgctgagattcgtctctgattctagcatcagtgctgggggtttccacaccacggtcaccgcatcagtgtcgggtaagaaaccctagcacctgactct

SEQ ID NO: 22890 - DNA, 201 bp, Homo sapiens
ttgcagaaattccttctaatccaccacactgcatggcccttggtcttcagtttgcagaattgttcccttattttatatgacatgaatgttttaaaatgtgwgatggaaatactatctattcttttacattgataatggctctagcgttctttctcctttattttatagtgtctgatgcagtctttgctctgatactcactt

SEQ ID NO: 22891 - DNA, 201 bp, Homo sapiens
cacatttatgactgtaacagcttgtataatttcctgagggatttccctccctatcacttaatgtttcctctattttggagaagttcgtattccaaagtggsaattccattagcagctataccgccatattataacatgtgaaaatacctcatggactctcaatcctcaaaatcactttgcacctccatgtgaattatctct

SEQ ID NO: 22892 - DNA, 201 bp, Homo sapiens
ttgttcccttattttatatgacatgaatgttttaaaatgtgagatggaaatactatctattcttttacattgataatggctctagcgttctttctcctttrttttatagtgtctgatgcagtctttgctctgatactcactttatttctattttcttccagcttgtggtggaacgttctacatggctgaaggcatcttcaa

SEQ ID NO: 22893 - DNA, 201 bp, Homo sapiens
ggttgtgaattgaacttagtattgaatttccaaggagcgtaactggaaaaaaatcactgacaaaggaaactgatgcttcctccttcctcagccccaagaaragatgctataatgagtaatattttcatttccttccgcattcacatttatgactgtaacagcttgtataatttcctgagggatttccctccctatcactta

SEQ ID NO: 22894 - DNA, 201 bp, Homo sapiens
ggtccacactaccttaatgagctgtagcactcactgcgaaggtctgcggcttcattcctgaagtcagcgagaccatgaacccaccggaaggaaaaaactgyggacgcatctgaacatctgaacaaacaaaatccggacacaccatctttaagaactataacactcaccacgagggtccgcagcttcattcttgaagtcagc

SEQ ID NO: 22895 - DNA, 201 bp, Homo sapiens
caacatttccaggaatctttgagtcagtgctcgcaacaactgcaaatttttagagtttatagtctcttgtaagatgtgaagactgagtgggagagtgtagmacaaagaaataggggtgaacgcatcgtgatatgagatgtggggttgtgaattgaacttagtattgaatttccaaggagcgtaactggaaaaaaatcactg

SEQ ID NO: 22896 - DNA, 201 bp, Homo sapiens
cataattataactttattgtaacttaacggttttctcctaaattaagcattgtatatttttgatggcctttcggtgagttgaatttggaattattttccaygggctgttgcccactttgaactgactgaacctttctgttttaacaggttgtggtggagagctgtctggggccacaggctccttcagcagccccgggttcc

SEQ ID NO: 22897 - DNA, 201 bp, Homo sapiens
ccgtccaggccttgcttgtctacatcccgcctactccgcccacacctgagcgtgtcggtctgggctggcgtcagaatcttagcccctctggaatcaacatmcctggcgggcagtgatgaacgtctgtgtgtttgataacaggccacaggttattcagggaattagggtgtacattcttgtgaatggtaatattagccagtt

SEQ ID NO: 22898 - DNA, 201 bp, Homo sapiens
agctgatgtctaatgatgtattctgttagattttgcctcaaagtcaattaaaagatttttgctttgtttacgttttccaggttgctatggtgattgtcttyagtggagggacaggacagtaatgagggcagcattcaacattgttagttccgtgcctttgagctgaagttctcggcaaggcatgggggagagagaacacag

SEQ ID NO: 22899 - DNA, 201 bp, Homo sapiens
tttatctgttttatttctttatctgcatgaaccatattctatcattgctcgtttatcctttcttaatatcttaatattaagggatttgcagtagatttgtsgtaatattacgaggactcagtccataaaactctgcagcattttctaaaaatgtataatattcttattaagcacatatgtatgtttttaaatcagagcttt

SEQ ID NO: 22900 - DNA, 201 bp, Homo sapiens
catttatccccctaatgtggaatgtgtctggaacatcgtcagttcccctggcaaccggctccagctgtcttttatgtaaatccttttttatggtgtattgyttcagtgctaatgaatctgtaggaaagaagttctggtgctaataggatgggcaactcatagtgtacgtgaaatttaggaagtatttttccaaatttcctc

SEQ ID NO: 22901 - DNA, 201 bp, Homo sapiens
agtgtacgtgaaatttaggaagtatttttccaaatttcctctgtttcagtcatagtttgagttataaatagcatgaagtttctctcgaccatggttcttgvgtcctgtctaacatttccaaaagtacattcttgagtccttggtgaatgaatgaatctgtggcgcattcatgttcagagtacaggaatcttatcttttttt

SEQ ID NO: 22902 - DNA, 201 bp, Homo sapiens
cttccccttgccttccgttcccctcccttcccttcccttcctttcccttccccttccccttcccccttcccttccttttcccttcccttcccttccttttyccttcccttcccttccctttttcctttaccctttcccctttcctgtttgttcatgctttcatttcattggggtataaacctagaagtgaaattgctggtt

SEQ ID NO: 22903 - DNA, 201 bp, Homo sapiens
cacttcagcctctatctcccaggcttaagccatcttcctgcctcagcctcccaagtagctgggattataggcacaggccaccacacatagctacattttawtttttgtagagagggggtttcactgtgttgctcaggctggtctcaaactcctgggttcaagtgatcctcccacctcagcctcccaaagtgctgagattat

SEQ ID NO: 22904 - DNA, 201 bp, Homo sapiens
tccttaaatgtttatttgtgaaagtaaaacgagcatcttagatttcttctcatgtcaacatttccaggaatctttgagtcagtgctcgcaacaactgcaartttttagagtttatagtctcttgtaagatgtgaagactgagtgggagagtgtagcacaaagaaataggggtgaacgcatcgtgatatgagatgtggggtt

SEQ ID NO: 22905 - DNA, 201 bp, Homo sapiens
acttcagcctctatctcccaggcttaagccatcttcctgcctcagcctcccaagtagctgggattataggcacaggccaccacacatagctacattttattttttgtagagagggggtttcactgtgttgctcaggctggtctcaaactcctgggttcaagtgatcctcccacctcagcctcccaaagtgctgagattatg

SEQ ID NO: 22906 - DNA, 201 bp, Homo sapiens
ttgttcttctctctccctctccctttttgtctctttctctctctcctccctgtatctctctctcactctctctttcttccctccctcctttatgccccacsacaggaatttttgtttccatctgatacttgaggatgatctttttcaaacgtttatcttgtgacttgcatttgtattaacatgcttagctactttgcttcc

SEQ ID NO: 22907 - DNA, 201 bp, Homo sapiens
ccctttctttgttcttctctctccctctccctttttgtctctttctctctctcctccctgtatctctctctcactctctctttcttccctccctcctttaygccccacgacaggaatttttgtttccatctgatacttgaggatgatctttttcaaacgtttatcttgtgacttgcatttgtattaacatgcttagctact

SEQ ID NO: 22908 - DNA, 201 bp, Homo sapiens
cttggtgggacgatactgtggaaactccttccctctcaattattcttccatcgttggacataccctgtgggtcagatttatctcagatggttctggcagcrgcacgggcttccaggccacatttatgaagagtaagttgtttctattttagtgatagcttccagaatatgtcttacaaactagaaataataattttctcag

SEQ ID NO: 22909 - DNA, 201 bp, Homo sapiens
tggaaattctttgacatttcatttttactccgactcttcaatctcagggaagggattccttctggagtggtttgcagtggatgcacctgatggtgttttamctaccattgctccaggtgtgtttggtaataaatgaagttctttttaggactgatatgtgcaggccaatgtttcaaaggatcctatcataacaggggtcag

SEQ ID NO: 22910 - DNA, 201 bp, Homo sapiens
atctcagggaagggattccttctggagtggtttgcagtggatgcacctgatggtgttttacctaccattgctccaggtgtgtttggtaataaatgaagttmtttttaggactgatatgtgcaggccaatgtttcaaaggatcctatcataacaggggtcagatataaaaataagtacagccccaaagcccttccaccatat

SEQ ID NO: 22911 - DNA, 201 bp, Homo sapiens
ggccacccgagctagcagcggcaacctgctcgggtccccttccacgctgtggaagctttgttctctcactcttcacaataaatcttgctgctgctcactctgggttcacactacctttatgagctgtaacactcactgtgaaggtttgcggcttcattcctgaagtcagcaagaccacgaacccaccgggaggaacaaata

SEQ ID NO: 22912 - DNA, 201 bp, Homo sapiens
agcccttccaccatatgttcagatgttgttttaaattcataaacactaccttttgtagaaattgtacgtttctttctaaaaaatgcaggtcccattatatwttttatattaattaggggcttgatatccataagatcgtctacttacaatttctagagaccactttagaaatccctgaaaatttgatttgcagatactaca

SEQ ID NO: 22913 - DNA, 201 bp, Homo sapiens
ccttctctctctctccctctgtctctccttctttctctctccgtctctccttctctctctttctccctccttctcttcttatctttccctttctttgttcytctctctccctctccctttttgtctctttctctctctcctccctgtatctctctctcactctctctttcttccctccctcctttatgccccacgacagga

SEQ ID NO: 22914 - DNA, 201 bp, Homo sapiens
cagaatggtggaacctgcctcaatctgcatgattcctttttttgtatctgtcccccacagtggaaggtgagtcatctactctttggttaagaatgatggcmggtcagcatctgtggtttccttggaatcatcaggcatatttaattctccatctaaagtttctaggattctgtggcctcccaaatcaaattgaaatatacc

SEQ ID NO: 22915 - DNA, 201 bp, Homo sapiens
attgcatgctgctataatgagaaaagggaaaaactggattttttgacttctgttgaaattgtgatggcatcgagcggagctaatcaggaagctggacttgmaggcaggtttcaacacatttggtaatatatttgcactttctgctcagtcaccttcaagtgtctggtgtaattaaccttgggctctcctcaatgacacatc

SEQ ID NO: 22916 - DNA, 201 bp, Homo sapiens
ttattcctcctgatgccatcagtttatggcatatagtttcaggaaaatgccagccagcaaagcgctgactgcatttgagcagtcgccgggcaatacagcakttactttttaaattttgtgccttggattccatttagctgtttcattactggtttgcttttattaaagctcttataaaaaaaacacacagatacgaactta

SEQ ID NO: 22917 - DNA, 201 bp, Homo sapiens
tgtattctgccagagatggaggctatgaaaaatcaccattgctgggaatattctatggctcaaatctacccccaacaatcatctctcatagtaacaaactrtggttaaaatttaagagtgaccaaatagacacaaggtctggattctcagcttactgggatgggtcatcaacaggtaaatagcaaagagctgtcttttact

SEQ ID NO: 22918 - DNA, 201 bp, Homo sapiens
aagaaagtcaatggtagcttgatgggtatagcattgaatctataaattactttggacattatggccattttcatgatattaattcttcctatccatgagcrtggaatgtttttccatttgtttgtgtcctctcttatttccttgagcagtggtttataattctccttgaagagatccttcacatcccttgtaagttgtatt

SEQ ID NO: 22919 - DNA, 201 bp, Homo sapiens
cttggtttggaatagatactgtggaaagtcgatcccgccatctctcacaagcagtggtaactcattgatgctggtgtttgtgactgactccgacctcgctyatgaaggcttcttaataaactatgaagcaatcagtgcagcaacaggtaacaaaacagcattgcatactcggttttattgactccattgcaaaacagtgct

SEQ ID NO: 22920 - DNA, 201 bp, Homo sapiens
gatcatatgttttttgtcctctattctgtaaatatagtgagttaaattgattgattttgaatggtgaatcaactttgcattcatcaaatattttccatttkttcatggcaagttatgctttttatacattgctagattttatttgctaatatgtatttttaggatttttatatctatatttgggtgatattcttttgtaat

SEQ ID NO: 22921 - DNA, 201 bp, Homo sapiens
tcttggtttggaatagatactgtggaaagtcgatcccgccatctctcacaagcagtggtaactcattgatgctggtgtttgtgactgactccgacctcgcytatgaaggcttcttaataaactatgaagcaatcagtgcagcaacaggtaacaaaacagcattgcatactcggttttattgactccattgcaaaacagtgc

SEQ ID NO: 22922 - DNA, 201 bp, Homo sapiens
tagtcattttatgtcctcaagtgttaagtggaaaatattctcatagaaatgttatattcggttatctcctcaggcagtattagattttgcaataaaattgrgataaaattattaatatctggacaagcactactataatttttatgcttacagcttgcggggatgaattaactggagaaggggtcattcgctcgccttttt

SEQ ID NO: 22923 - DNA, 201 bp, Homo sapiens
gcccttccaccatatgttcagatgttgttttaaattcataaacactaccttttgtagaaattgtacgtttctttctaaaaaatgcaggtcccattatattktttatattaattaggggcttgatatccataagatcgtctacttacaatttctagagaccactttagaaatccctgaaaatttgatttgcagatactacac

SEQ ID NO: 22924 - DNA, 201 bp, Homo sapiens
tgagcattgtcctatcagtatttctttctttttttttttctttttttttttttttttgagatggagtctcgctctgtcgcccaggctggagtgcagtggcrcaatctcggctctctgcaagctccgcctcccgagttcataccattctcctgcctcagcctcccaagtagctaggactacaggtgcccaccaccacacctg

SEQ ID NO: 22925 - DNA, 201 bp, Homo sapiens
gcaagctccgcctcccgagttcataccattctcctgcctcagcctcccaagtagctaggactacaggtgcccaccaccacacctggctgatttttttgtakttttagtacagatggggtttcaccgtgttaggcaggatggtctcgatctcctgacctcatgatctgcccacctcggcctcccaaagtgctagaattacag

SEQ ID NO: 22926 - DNA, 201 bp, Homo sapiens
aggctcccgactctaccgtggaactcaacattctttccctggacattgaatctcaccgaacgtgtgcctatgatagccttgtgatacgagatggtgagaayattataaagaatgctgagtttcaaccctgacacataattagttctagtccattatcatcagacttgcatactgcctccatccgtttggtttggaattaca

SEQ ID NO: 22927 - DNA, 201 bp, Homo sapiens
gctgaaaaaaatacttataattgtaatgtgactggacatagtggttcacaccataatcccagcactttgggaggtcgaggagaaggatcacttgagtccargagttccagaccagcctgggcagcagaatgagaccctgtctctaaaataataataagaagaatataaaatagtaatgtattcatttctctttgtcccctg

SEQ ID NO: 22928 - DNA, 201 bp, Homo sapiens
cctgcctctactaaaaatacaataattagtcagaagtggtggttcacccctataaaaccagctactcaggaggctgaggcaggagaatcacttgaaccccrgaggcagaggctgcattaaaccgagactgtgccactgcactccagcctgcgcaacagaggaagactccatctcaaaaaaaaaaaaaaaggggggggtggg

SEQ ID NO: 22929 - DNA, 201 bp, Homo sapiens
acttgaaccccggaggcagaggctgcattaaaccgagactgtgccactgcactccagcctgcgcaacagaggaagactccatctcaaaaaaaaaaaaaaargggggggtggggtggggtgggggtaaagaaaagggcaggaagcaccattgcaagctggagccagaatgatatcacccctgaggggtccttctttttgagg

SEQ ID NO: 22930 - DNA, 201 bp, Homo sapiens
cttgaaccccggaggcagaggctgcattaaaccgagactgtgccactgcactccagcctgcgcaacagaggaagactccatctcaaaaaaaaaaaaaaagrggggggtggggtggggtgggggtaaagaaaagggcaggaagcaccattgcaagctggagccagaatgatatcacccctgaggggtccttctttttgagga

SEQ ID NO: 22931 - DNA, 201 bp, Homo sapiens
tggcttaagagcatgggctttggaactagacctaagatacattttcacctctacaatttaactagctgtgtgagatgtctgcccttactgatgagcttctrgtccctgacaactggagaattaatgcctcctccttttatcctcttcctttatctcctgccctctcactctcatgtatatattactatgtatcgcaactca

SEQ ID NO: 22932 - DNA, 201 bp, Homo sapiens
gtgtgtgtctatgtatatatacatacttggcagctcccggtctagaatgtatttcaaatttaacctgtgagtggtataatggactttggagactcagaagyggggaggatgggtggggtatgagggataaaaaactacatattaggtgtaatgtatactagtcagggaaccagcgcactaaaatatagacttcaccagtat

SEQ ID NO: 22933 - DNA, 201 bp, Homo sapiens
tgagcagtcgccgggcaatacagcatttactttttaaattttgtgccttggattccatttagctgtttcattactggtttgcttttattaaagctcttatwaaaaaaacacacagatacgaacttaaagatagtacctacataggagattattattaaatgtttcagtactggaattttataactcatggcttgttttgga

SEQ ID NO: 22934 - DNA, 201 bp, Homo sapiens
ccagggaagcgttcacactggaggcgacatttaagtggcagagtctcgccagtagaaatgcagcagtgaggccacgaggggaggctgcaagggaaggatgrggaaatggtgcacgcacatttgggaataaaaaatgagagtgttgtccctggagcgtgaagaaatgctggggagcatgtggagaccaaggggctacagaag

SEQ ID NO: 22935 - DNA, 201 bp, Homo sapiens
taagaatttgaaattatcctataggtagtatggagtcagtgaaaattttctgtaaaacgggaataacatactcagagctgtattctacagtgacaacaggyagcagtgtgtgaagaatggcttggcagagaaaaagaaagatggtagcatgtctgtttgggaagcaatggaaaaagcttggatcagaggtgataaggtctc

SEQ ID NO: 22936 - DNA, 201 bp, Homo sapiens
ttctttgcttatattcattttcttctagatcactaagaatttataatgaaaaaaatcaaaagggaaagatctttgattagtaacatcatgacaaaaattcwaactatatgtccagccttggaattgaaatccagtcacaggccaggcgcggtggctcatgcctgtaatcccagcactttgggaggccgagatggtcagatc

SEQ ID NO: 22937 - DNA, 201 bp, Homo sapiens
tctccttctgagactcaaattacacatatgctgaaggttttgactgtttctaatagttcttatggttttatattcttgccttctttttttgctttgattcyatttggttattttgttttggaaagtctgtaagtactgttgaaatgttcttcaactattttgtcaaccttttcctctaagttttatcataattattttgga

SEQ ID NO: 22938 - DNA, 201 bp, Homo sapiens
agaattagaaaaaacttttttgttgttttttaaagaaaaaataccctatatattcatagtgatcttacactatattggaatattgagattatagagttgctttttttttttttttttactttacatttctacctcttctctcatacagtaaaaatcctggttcccaatgacatgaacatattatttatgtacttagtccta

SEQ ID NO: 22939 - DNA, 201 bp, Homo sapiens
aatgttgaatagtcaagtaagattaatacacatccaactacatccttgtttgagatagttgtctgttgagagaaagggcatattgggtattgcagattgcktagcaatagtcctggcccctacccactagatactacccatcacaccgagtgtgacaatagaaaaatgactacaaaccttgccagaggtcccaaaattgct

SEQ ID NO: 22940 - DNA, 201 bp, Homo sapiens
tattttttcaaatattgcattgccacttttttcctctttcttctccttctgagactcaaattacacatatgctgaaggttttgactgtttctaatagttcytatggttttatattcttgccttctttttttgctttgattccatttggttattttgttttggaaagtctgtaagtactgttgaaatgttcttcaactattt

SEQ ID NO: 22941 - DNA, 201 bp, Homo sapiens
gtataatggactttggagactcagaagcggggaggatgggtggggtatgagggataaaaaactacatattaggtgtaatgtatactagtcagggaaccagygcactaaaatatagacttcaccagtatgcaattcatccatgtaacgaaaaaccacttgtatcccaattagattagatagatagatagatagatagataga

SEQ ID NO: 22942 - DNA, 201 bp, Homo sapiens
gtgtaatgtatactagtcagggaaccagcgcactaaaatatagacttcaccagtatgcaattcatccatgtaacgaaaaaccacttgtatcccaattagaytagatagatagatagatagatagatagatagaaaaaaaaatttcacctttgaaagttgaacactttattcccacccttttccatgccaccaccccccaat

SEQ ID NO: 22943 - DNA, 201 bp, Homo sapiens
gacataaatggataagaattgcgtactccttcttttgcaatgtaaaggagttgatgaaattttaatttgtctttccagctaagaaatggtcctgatatctrttctccacccttgggaccccctggaggaaatggtcatttttgtggcagtcatgcttcatcaactctgttcacctcggataatcaaatgtttgttcagttt

SEQ ID NO: 22944 - DNA, 201 bp, Homo sapiens
tttcacctggtaccaaagcatttcaagagtagcagtgtcctgagtctagtgagtagacgtcagcccatcctacccatcctacataactctactcttttgtttttgtttataatagactcagtcttttttttctttcttgagacagggtctctctgtcgcccaggctagagtacagcggcatgatctcagcctactgcaacc

SEQ ID NO: 22945 - DNA, 201 bp, Homo sapiens
ttcacctggtaccaaagcatttcaagagtagcagtgtcctgagtctagtgagtagacgtcagcccatcctacccatcctacataactctactcttttgtttttgtttataatagactcagtcttttttttctttcttgagacagggtctctctgtcgcccaggctagagtacagcggcatgatctcagcctactgcaacct

SEQ ID NO: 22946 - DNA, 201 bp, Homo sapiens
tcacctggtaccaaagcatttcaagagtagcagtgtcctgagtctagtgagtagacgtcagcccatcctacccatcctacataactctactcttttgtttttgtttataatagactcagtcttttttttctttcttgagacagggtctctctgtcgcccaggctagagtacagcggcatgatctcagcctactgcaacctc

SEQ ID NO: 22947 - DNA, 201 bp, Homo sapiens
cacctggtaccaaagcatttcaagagtagcagtgtcctgagtctagtgagtagacgtcagcccatcctacccatcctacataactctactcttttgtttttgtttataatagactcagtcttttttttctttcttgagacagggtctctctgtcgcccaggctagagtacagcggcatgatctcagcctactgcaacctct

SEQ ID NO: 22948 - DNA, 201 bp, Homo sapiens
acctggtaccaaagcatttcaagagtagcagtgtcctgagtctagtgagtagacgtcagcccatcctacccatcctacataactctactcttttgtttttgtttataatagactcagtcttttttttctttcttgagacagggtctctctgtcgcccaggctagagtacagcggcatgatctcagcctactgcaacctctg

SEQ ID NO: 22949 - DNA, 201 bp, Homo sapiens
ggtaccaaagcatttcaagagtagcagtgtcctgagtctagtgagtagacgtcagcccatcctacccatcctacataactctactcttttgtttttgtttataatagactcagtcttttttttctttcttgagacagggtctctctgtcgcccaggctagagtacagcggcatgatctcagcctactgcaacctctgcctc

SEQ ID NO: 22950 - DNA, 201 bp, Homo sapiens
gctgtgccctgtggttgggccccttcattctccttcagacctggcatataggaagcctgcccagaaagcagccgagctgacctccgtccccctgtgactarcctcttacccacaattgtgtctactatgtgtttacagcattgaatctatgagggcaaggacagctgtttcttaactcagggttttcctcaaccctagttc

SEQ ID NO: 22951 - DNA, 201 bp, Homo sapiens
tgacctccgtccccctgtgactaacctcttacccacaattgtgtctactatgtgtttacagcattgaatctatgagggcaaggacagctgtttcttaactmagggttttcctcaaccctagttctcaatttttagagaccagcaactgtcatacatattcatttattcatttgttcatcaaacatttattgcctgtatgtg

SEQ ID NO: 22952 - DNA, 201 bp, Homo sapiens
gtgcccatgcctgggttccaatatccagagacaggattcagttggtctgcagtggggccctgactattgctaatttctaaatgctccttaagtgattcatccgtacagtcaggatggagagtttgggagggcagtgattttgctgattactttctcctaagtggctgcttcctctcccctccaggctgttctagccttact

SEQ ID NO: 22953 - DNA, 201 bp, Homo sapiens
ttaagaaatgggagaggctttacagtaagatgggaaacacagcaaccaggtatgtgtgaacctggagaaaaaagcaagcaaaattttgaggttattaagtkttcttaatcagtgttagacttttggatacatgagatgttttgggatctgaagatatataatatttttataatttattttattttattcatttatttattt

SEQ ID NO: 22954 - DNA, 201 bp, Homo sapiens
actatttttgttccacatcctacatttactaacagatctaagccaaagggtgtagttgcttataaaatgtaccagcctaaagcaaagacttccaagcatawtaaagctttttttatagtttaatttaatccttctaggtatttgcctaccaccatgtccaacggaatgtcttttctgccatctagcactggattgcagtag

SEQ ID NO: 22955 - DNA, 201 bp, Homo sapiens
gacttgtctatagagctaaacttttaaatcctcttgttttcctaggctggcaaggcaatggatatatttgcgaagatatcaatgaatgtgagataaataayggcggctgttctgtggctccacccgttgagtgtgtgaatacacctgggtcttcccactgccaggcctgtccaccaggtgctgcctcggttcaatgtcaac

SEQ ID NO: 22956 - DNA, 201 bp, Homo sapiens
tagtaatgcgtaagagttctaatttctccatatcctcatcagcacttcttattttctatttttaaataatagtcttcctggtggtttgtagtgttatctcwttgtggttttgatttgcatttctctaatgactaataatgtttgaaaatcttttcatgtttttattggccattcataaatcttctttggagaaatgtgtat

SEQ ID NO: 22957 - DNA, 201 bp, Homo sapiens
atctctcacctgaactagggcaaaacctacctgactgttttccggcatcctttctgactcctattttccgaattgtaatgttttccaaaaaccaatcttcytggtggctccttgctgtattcaggacagtggcccgagtctctaacgtgtcctgcagccccctctgcaggcttcctcaccccttcctccttggttttctct

SEQ ID NO: 22958 - DNA, 201 bp, Homo sapiens
ttttccaaaaaccaatcttcttggtggctccttgctgtattcaggacagtggcccgagtctctaacgtgtcctgcagccccctctgcaggcttcctcaccmcttcctccttggttttctctctcttctctgaactagccacggcctttcctgccatcggggttcgctcggggcaggctcacttcccccagttaggtaaagc

SEQ ID NO: 22959 - DNA, 201 bp, Homo sapiens
gggcttgaaacacatgcagattcctgagcctcactccaggcccaactgaattcagaatttccatgacgaagtctttcctgttttttttttttttttttgasacggcgtctcactctgtcgccaggctggagtgcagtggtgcaatctcggctcactgcaccctccacgtcctgggttcacgccattctcctgcaacctcca

SEQ ID NO: 22960 - DNA, 201 bp, Homo sapiens
cccaggggaatggcccactttagcttgcagtgatgctatttggctgttttttttccttcttgtcatcttctaatgggcgaaatagaaaagagagactacartcttcgaagaagcaaatagaaccctggaggattagagagcaggaagataactttgtgtttcatgctttctagttttcaagaactgcagtatgtctgtatc

SEQ ID NO: 22961 - DNA, 201 bp, Homo sapiens
aaagaattttatgggaattacattgaaactataattaactttggaagaaatgacatcttaaaaatattcagcctgccaatgcatgaacataaactattttwaaatttagttctcttttcatttatcctggcaatgttttatagctttcagtgtctaagtattccatatctttgttagatttatttacagatatttgatata

SEQ ID NO: 22962 - DNA, 201 bp, Homo sapiens
tactaaactttgtttagaagtcttcaatcatttcaaaaacatccaaggagagggaaaagagattgatcaaatgattgatttctcctgaagaattgtaagcmagggatttctactgggaaaccattttttaatttgattgaaattagtagcttaaaaggaaactgataaagttaatcaaagtgaaaagatgacaagattggc

SEQ ID NO: 22963 - DNA, 201 bp, Homo sapiens
ttcagcctgccaatgcatgaacataaactatttttaaatttagttctcttttcatttatcctggcaatgttttatagctttcagtgtctaagtattccatrtctttgttagatttatttacagatatttgatatattatgcttagtgaaatattaattttctaaaatttaatttttcacttgttatgtaaaaatatgtatt

SEQ ID NO: 22964 - DNA, 201 bp, Homo sapiens
ttcaaacatctcaagttgctttttttaatccatcaatcagacagagcctcttcagggtataagtggccttgtgttaaaacaaagacaccctctgcatgccraaaggcaatgcaagtttaagctgcctcacaggaaggaggttttggtttgtctttttttttttttttttttttttggagacacagtctggctctgttgccc

SEQ ID NO: 22965 - DNA, 201 bp, Homo sapiens
tagtaagtcgattcgtcttttaaagatttactttcttactggctagtgttttctcataattttgtatgtacaggtgtcccagcacttctctgctcagttcrtttatcttgtttgttatatttcttactccttagaataaaaatgcaacaaaatgcttaatcatgatattctgagttccctacttgtcttcatccttaaatt

SEQ ID NO: 22966 - DNA, 201 bp, Homo sapiens
catctttcacaatgaaggattttcgtatgattgcattaatttgcagcagttaatgaaccaacgttccaaccttcaaaagagcctctgctctcagattcaaragaaactctgcgtgtttcctctcttcaaacatgaaggacagaattaggatgaataataatcaaacctaaaataatttctgaactaccctgaagcagtaaa

SEQ ID NO: 22967 - DNA, 201 bp, Homo sapiens
ctttgggaggccgaggcgggtggatcatgaggtcaggagatcgagaccatcctggctaacaaggtgaaaccccgtctctactaaaaatacaaaaaaaaatyagccgggcgcggtggcgggcgcctgtagtcccagctactcgggaggctgaggcaggagaatggcgtgaacccgggaagcggagcttgcagtgagccgaga

SEQ ID NO: 22968 - DNA, 201 bp, Homo sapiens
ggatcatgaggtcaggagatcgagaccatcctggctaacaaggtgaaaccccgtctctactaaaaatacaaaaaaaaatcagccgggcgcggtggcgggcrcctgtagtcccagctactcgggaggctgaggcaggagaatggcgtgaacccgggaagcggagcttgcagtgagccgagattgcgccactgcagtccgcag

SEQ ID NO: 22969 - DNA, 201 bp, Homo sapiens
ggagaatggcgtgaacccgggaagcggagcttgcagtgagccgagattgcgccactgcagtccgcagtcccgcctgggcgacagagcgagactccgtctcaaaaaaaaaaaaaaaaaaaaaagagatgacatcttttgttgtggagtgcattctccttctgcataactgttagtgccatagtctgagtcattatttctaat

SEQ ID NO: 22970 - DNA, 201 bp, Homo sapiens
gttactgttcctgtattgtttatctcttccgttgtggcctgaatcttactactactttctctgttgccttctgttttcttagtgtgtggtgggtctcttcsaaatactcctgaaggaaactttacttctcctggctatgacggagtcaggaattactcaagaaacctgaactgcgaatggactctcagcaatccaaatcag

SEQ ID NO: 22971 - DNA, 201 bp, Homo sapiens
acaggtgtacatcaccacatacaactaattattaaaattttttgtagagatggggtctccctatgttgtccaggctggtctcaaactcctggcctcaagtratcctccctctttggcctcccaaagtgctggggttacaggcatgagccaccacggctggcctacaatattcttcatatgcttggagactactaacaatga

SEQ ID NO: 22972 - DNA, 201 bp, Homo sapiens
gctgaggcaggagaatagcttgaaactgggaggcagaggttgcagtgagccaagatggcaccactgcgctccagcctgggcaatagagtgagattctgctaaaaaaaaaaaaaaagagctatttagaaggtaggatgggcagatctgatggtggagtagatgtgtgtcaatctgggagacagaagaaggaatcatggatag

SEQ ID NO: 22973 - DNA, 201 bp, Homo sapiens
caagttgtagtcagtgccacaaagaatccatgtggctggttgtataaaagggcatatttactcatgtctcatattctatttttgttttttataaactcgaratttattaattctctgccttaggacaaaagagaaaaaaacaacatattttcccagccacggcatccaagtctgctataatcccctttgctccattttggt

SEQ ID NO: 22974 - DNA, 201 bp, Homo sapiens
ggtctccctatgttgtccaggctggtctcaaactcctggcctcaagtgatcctccctctttggcctcccaaagtgctggggttacaggcatgagccaccayggctggcctacaatattcttcatatgcttggagactactaacaatgaagggagtcaaatggctctaacataggtacacacgatccaaaagaactctgttc

SEQ ID NO: 22975 - DNA, 201 bp, Homo sapiens
ccactcccacttctcagcctttaacctaggtccttttgtgaacattttttgacatcaaatcacctagttttataccatttttctccagagacactccttcrctatggttgattgagatttctaggaccctgtggtagatgccttttattctcacctgattaataggcctgttaattaattagtcaaacatttacaaggtgt

SEQ ID NO: 22976 - DNA, 201 bp, Homo sapiens
ctcccacttctcagcctttaacctaggtccttttgtgaacattttttgacatcaaatcacctagttttataccatttttctccagagacactccttcgctrtggttgattgagatttctaggaccctgtggtagatgccttttattctcacctgattaataggcctgttaattaattagtcaaacatttacaaggtgtttc

SEQ ID NO: 22977 - DNA, 201 bp, Homo sapiens
atctttgggagaaattatagcttgcttttactctgaaataaagatgtttccctttttgcatggtctggtctaaatgcttaatcatatgggaagaaaaagasaagccagtggattggccttatggaaatgaacgttagaggataaacagttaggggcttgatgaaatgttcaaaggcttttcttgctgattttcatgattgt

SEQ ID NO: 22978 - DNA, 201 bp, Homo sapiens
tatggttgattgagatttctaggaccctgtggtagatgccttttattctcacctgattaataggcctgttaattaattagtcaaacatttacaaggtgttycacatcatgcaaaccaccgagttctgccaaggagttcacagtgtggtaaaggagacagacaagcaaaggcacaattagaacatgatataaggctgggcac

SEQ ID NO: 22979 - DNA, 201 bp, Homo sapiens
cacctgattaataggcctgttaattaattagtcaaacatttacaaggtgtttcacatcatgcaaaccaccgagttctgccaaggagttcacagtgtggtaraggagacagacaagcaaaggcacaattagaacatgatataaggctgggcacggtggttcacgcctgtaatcccagcactttgagaagccaaggcaggagg

SEQ ID NO: 22980 - DNA, 201 bp, Homo sapiens
cagaaacacctacttcagcccaggacatcagagagggttccaggggaagtggatgaagagatttgcccatcagtgataaaaagatgtgaatgcatagaaartctcaatgttacaagtcatattcaataatttgaaagaattcactactgctagagatcagagtcaaaaagagataaacataatagtgatgaagcaggcagg

SEQ ID NO: 22981 - DNA, 201 bp, Homo sapiens
aaaaggttatgggaggcattggaagtttttgctccaaagcctgaacagcgtgatcagattaaaaacactaatgtagctgcaacactgaaaacattggagayggggaaggctgaagagagagagaccagatgaaagagtaatttagggaaaaaatttactccctgaactaaggcaatggcagtaagaaggtaggagagaggg

SEQ ID NO: 22982 - DNA, 201 bp, Homo sapiens
tgaggctcagatttggacagagtttaaagggtcacagaacaccactgccatggacgtggtgctgcccacctgtgtccatttctccgggtggagtcctctcmctgcagagggaaggttagaggttggaggaggtgagggaaggaatcagggagaggcctgcaatgtaggtccctggaggctctttgagcttttccctgcaag

SEQ ID NO: 22983 - DNA, 201 bp, Homo sapiens
ttctgagctcttagttaccaattcacatcacacctgccttaccaaaagggtccttgctggcagtttctcttctgtgtcctcccttcctccacaagctgcctttttttttttttttttagatggagtctcactctgttgccaggctggagtgcagtggtgtgatctcagctcactgcaacctccacttcttgggttcaagtg

SEQ ID NO: 22984 - DNA, 201 bp, Homo sapiens
acaggcgtgagccaccacaaccagcctctgtgattcttgctttgcaatttctactgttgttacaggaacatttcaaagcccttcaaatttaaagtaacctraacttggataaagttccaagtttttccaggagatgtgagtgcaaacctcagcaacaacatttttaacaatcaccctaatgaggcctctccacagatcctg

SEQ ID NO: 22985 - DNA, 201 bp, Homo sapiens
tctagaaggactaaggagaattaggaaaaagcccatgaattattcaatgatgtccaccataactcagggaaaggaagaaaatccttctgccttcctcaagyggctatgggaggccttaagaaaatatactcccctgtcacctgactcactcgagggtcaattgatcctaaaagataagtttattacccaatcagctgcaga

SEQ ID NO: 22986 - DNA, 201 bp, Homo sapiens
ccttgagcagtggtttataattctccttgaagagatccttcacatcccttgtaagttgtattcctaggtattttattctctttgtagcaattgcgaatggsagttcactcatgatttggctttctgtttggctattactggtgtataggaatgcttgtgatttttgcacattgattttgtgtcctgagactttgctgaagt

SEQ ID NO: 22987 - DNA, 201 bp, Homo sapiens
ttgctagcttttaacttttctgtatgttaaatttcgttagaaatttatatatgaggccgggcacagtggctcatgcctgtaatcccagcactttgggaggmtgaggtggatggattgcttgaggtcaggagttcgaaaatagcctggccaacatggagaaaacctgtccctactacaaatacaaaaaattagctgggcgtg

SEQ ID NO: 22988 - DNA, 201 bp, Homo sapiens
cgtgtagaacacattggattccatgcaaagtattcctttacaggtaagaattataattaagatcttgataaaattacttataaagattaatgatttttttccataaagatttcatatatattttgttagatttatttctacatagctattagttttgttaatattatcaatgagattttctaaattacattttttaattgg

SEQ ID NO: 22989 - DNA, 201 bp, Homo sapiens
atatatagtgtgtatatatatactatatatggtgtgtgtgtgtatatatatatactatatatggtgtgtgtgtatatatataccctatatatggtgtgtgtatatatatatatatacacactatatatggtgtgtgtgtatatatatactatatatggtgtatatatatacacactatatatggtgtatatatatatatac

SEQ ID NO: 22990 - DNA, 201 bp, Homo sapiens
tatatagtgtgtatatatatactatatatggtgtgtgtgtgtatatatatatactatatatggtgtgtgtgtatatatataccctatatatggtgtgtgtatatatatatatatacacactatatatggtgtgtgtgtatatatatactatatatggtgtatatatatacacactatatatggtgtatatatatatatact

SEQ ID NO: 22991 - DNA, 201 bp, Homo sapiens
atggtgtgtgtgtatatatatactatatatggtgtatatatatacacactatatatggtgtatatatatatatactatatatggtgtgtgtgtgtgtgtgwgtgtatatatatatatatatatactatatatggtgtatatatataatatggtttttttttgagatagagtcttgttctgtcaccctgactggagtgcaat

SEQ ID NO: 22992 - DNA, 201 bp, Homo sapiens
tggtgtgtgtgtatatatatactatatatggtgtatatatatacacactatatatggtgtatatatatatatactatatatggtgtgtgtgtgtgtgtgtrtgtatatatatatatatatatactatatatggtgtatatatataatatggtttttttttgagatagagtcttgttctgtcaccctgactggagtgcaatg

SEQ ID NO: 22993 - DNA, 201 bp, Homo sapiens
ctacaccatcgaaagcacacagacaacaacttgattttctcccacagttactttatcaagtttgttttttttttttttttccattctgctctcaacccccmattttcaaagtacagtcctggaggaagttatccctgggttgtgatatgcaggcaaaggcacgtgtgtggaggatggaagaggtggaggtggcagtgggaa

SEQ ID NO: 22994 - DNA, 201 bp, Homo sapiens
gtgtgtgtgtatatatatactatatatggtgtatatatatacacactatatatggtgtatatatatatatactatatatggtgtgtgtgtgtgtgtgtgtrtatatatatatatatatatactatatatggtgtatatatataatatggtttttttttgagatagagtcttgttctgtcaccctgactggagtgcaatggc

SEQ ID NO: 22995 - DNA, 201 bp, Homo sapiens
ccttgaccacaaaatcccgtggggggcttgaaacacatgcagattcctgagcctcactccaggcccaactgaattcagaatttccatgacgaagtctttcmtgttttttttttttttttttgacacggcgtctcactctgtcgccaggctggagtgcagtggtgcaatctcggctcactgcaccctccacgtcctgggttc

SEQ ID NO: 22996 - DNA, 201 bp, Homo sapiens
tgaccacaaaatcccgtggggggcttgaaacacatgcagattcctgagcctcactccaggcccaactgaattcagaatttccatgacgaagtctttcctgytttttttttttttttttgacacggcgtctcactctgtcgccaggctggagtgcagtggtgcaatctcggctcactgcaccctccacgtcctgggttcacg

SEQ ID NO: 22997 - DNA, 201 bp, Homo sapiens
tgccatctatgcaactataactcagacaaattctaagtattgttgaaagaacaaaatcacagtaacctgtcaaaataattgtaaaagttgtttgaagagamtatcagctatcactctgtgcatcagggtcatagaataaattttaagagtgaatgatcacgacaaatggcaaaaccggagaggctgtgggaagctaagcct

SEQ ID NO: 22998 - DNA, 201 bp, Homo sapiens
gtaatcccagctactcgggaggctgaggcaggagaatcgcttgaacccaggaggcggaagttgcggtgagcctagatcatgccattgcactccagcctggscgacaagagcgaaactctgtctcaaaaagaaaaaattaatatatgtgccctgcttttagtaaatactaccattgggcgttctttcttctgctccatctcg

SEQ ID NO: 22999 - DNA, 201 bp, Homo sapiens
tactgaaaggatgactggtatctctgtatgcatgagggggccctgactctttagcaaaacctgcaaacctacaaatgtcatatccacaggtcttttctctyggggaggttaaaactccagcgacgaatcactttcagaattaatttttcttctgagtctttagttctaatgtccacattcctttttttgaaatgtattttt

SEQ ID NO: 23000 - DNA, 201 bp, Homo sapiens
ctcaaaaaataaataaataaaaattaaagtaaataaagaaaaatatctgctttattatgtacatgaaatcatcagaaactgatatttaagcttcccttccwagtaacaaatgtcctgatgcattgttaagaaaaactgcccatcagtgagctctgcagaccacattgtaagcacaatggctcatctcctttacattgagag

SEQ ID NO: 23001 - DNA, 201 bp, Homo sapiens
gtaggatgttgtaaatgccccccattttaatcaggggcactgcagatgcccccagctactgccaatggcagcagagccatccattttccctttagtgatayttgaaatctttgacataagacaaacacacataagcagatgaaaaacgcactgcagacagaaaaaaagctttctgatttcagaaagaaactgccatagtga

SEQ ID NO: 23002 - DNA, 201 bp, Homo sapiens
acttccacaatggttgaactagtttacagtcccaccaacagtgtaaaagtgttcctatttctccacatcctctccagcacttgttgtttcctgactttttratgatcgcacataaaaagccttgatgaagaataagagaaggtaattggaagaatttaccaaccaataaagaatattaaaaaaaaaaaaaaaaagaaaaag

SEQ ID NO: 23003 - DNA, 201 bp, Homo sapiens
aatattaaaagaaaaacgctaagttatttcattggtacaagaagcatctgttcctttattaaaagggggcaaattaatggcaaattaatgtcctattatckgtttgatttaaaataatttattagatcaagtggagaattgctaatcaagccattaggacctgccaccattatatttatgtattcctctaaagtaaatatt

SEQ ID NO: 23004 - DNA, 201 bp, Homo sapiens
taaataaaatttaaaaaatgaaaaaaattgggtagtaacattaattcaccttggtgataatgaggaatttagaaattctcaatttaaaaattctacacgcmgtaaactgtaaactcagtgtttctcagatccagtaattcttgacaagcattggagggtgcagcagcgcttagctcgtgaggtggaaacaccaaagggaca

SEQ ID NO: 23005 - DNA, 201 bp, Homo sapiens
gggcatggtggctcacgcctgtaattcccccactttgggaggccgaggtgggcggatcatgaggtcagggggtcgagaacatcctggctaacacggtgaawccttgtctctactaaacaaaatgcaaaaaattagccgggcgtggtggcgggcgcctgtagtcccagctactcgggaagctgaagcaggagaatggcgtga

SEQ ID NO: 23006 - DNA, 201 bp, Homo sapiens
cttcccaggttcaagcaattctcatggctcagcctcccgagtagctgggattacaggcaccagacaccatgcccagctaataattgtatttttagtagagrtggggtttcaccttgttggccgggctggtctcaaactcctgacctcaagtgatctgcctgcctcggcctcccaaagtgttgggattacaggtgtgagcca

SEQ ID NO: 23007 - DNA, 201 bp, Homo sapiens
tcatggctcagcctcccgagtagctgggattacaggcaccagacaccatgcccagctaataattgtatttttagtagaggtggggtttcaccttgttggcsgggctggtctcaaactcctgacctcaagtgatctgcctgcctcggcctcccaaagtgttgggattacaggtgtgagccactgtgcctggcccctagaacc

SEQ ID NO: 23008 - DNA, 201 bp, Homo sapiens
atttaggggaacacaaacattccaaccatggtatacataccaactcatagaggtatgttatatattctctctctctttatctgtctatctatctatatatmtatgtatgtatacaatctaaatgtattttttcagttttcagcctggatcctggagctcaccataatgaaatttacatctgcatgtttattttattttact

SEQ ID NO: 23009 - DNA, 201 bp, Homo sapiens
agaatcacttgaacccaggaggcagaggttgcagtgacccagtgacccaagatagcaccattgcactccagcctgggcaacaagagcaaaactccgtcccaaaaaaaaaaaaaaaaaaaaaaaaaaaaagctgggcatggtggctcacgcctgtaatctcagcactttgggaggccgaggtgtgtgaatcacctgaggtcg

SEQ ID NO: 23010 - DNA, 201 bp, Homo sapiens
gaatcacttgaacccaggaggcagaggttgcagtgacccagtgacccaagatagcaccattgcactccagcctgggcaacaagagcaaaactccgtcccaaaaaaaaaaaaaaaaaaaaaaaaaaaaagctgggcatggtggctcacgcctgtaatctcagcactttgggaggccgaggtgtgtgaatcacctgaggtcgg

SEQ ID NO: 23011 - DNA, 201 bp, Homo sapiens
ttaaaaacctaagtaactgtactatatccgaatattaaatttttaaagggtagatattaaattatttttaaatgcatgcactactagattatcacaattctggaaggaaacatattattcttccagtatgctatatttttagaggacaatgaagaagcagcattccatggctttgtgaaaacgtgatttcatttgcgtttc

SEQ ID NO: 23012 - DNA, 201 bp, Homo sapiens
ggtaagtatggctaaggcaagagatttccttcctctctgagtgtgtcaagaggagttgagatatttgggggtagggtgggggtggggggacctaagccackaaaatcctaaatgaataatctctttaagagaataacaaaagatttcacagaggaaggttttgtaatatacacatctccgcatctgaagatatatttaatg

SEQ ID NO: 23013 - DNA, 201 bp, Homo sapiens
aatcacttgaacccaggaggcagaggttgcagtgacccagtgacccaagatagcaccattgcactccagcctgggcaacaagagcaaaactccgtcccaaaaaaaaaaaaaaaaaaaaaaaaaaaaagctgggcatggtggctcacgcctgtaatctcagcactttgggaggccgaggtgtgtgaatcacctgaggtcggg

SEQ ID NO: 23014 - DNA, 201 bp, Homo sapiens
aactggaactgtaacccacaaaatgtgcaaggcacgtggtaaacataaacagggtgacagcctgctaaaataaaagatttgaataggacccaaagttcccyaacataataaatgacatgtcctgggtacaatcagaaagaacacgttgtatcaggaatcaagaacatcacaacttgaaagagaaaagaatcaagtgatgtc

SEQ ID NO: 23015 - DNA, 201 bp, Homo sapiens
gcttataagggaaagggaagttgtggtttgagaatgttctccatggaattctgataaaccctcaccccctctgcctgtttcaaaaccaccggcttgtggtmttaagcagaacagctgtatctcaaatttcagtcagctaaatgctgtcttctctttatttgctcaggtttagaggcagttaaaatactatatatcattgat

SEQ ID NO: 23016 - DNA, 201 bp, Homo sapiens
ccttctggcccatcactactaccaacacttttaatgaattcctacctgaaactaatgctttgcgcttcatataagagtgaatgaagttctattttgaaggktttttttttctttctgtttttaaattttttggctacctaattttcttttattattgttattattattatactttaagttctgggatacatgtgtagaagc

SEQ ID NO: 23017 - DNA, 201 bp, Homo sapiens
taattttaaaattattcaataataaactgcataattttaaaattattaaattttaaaattatccaataattatttaataattaataataataaataattawtaataataattattatttaataattttaaaattattttataatttgcataattattataaattttataattttgcatacatgtaactttagtccaaagat

SEQ ID NO: 23018 - DNA, 201 bp, Homo sapiens
aaattattaaattttaaaattatccaataattatttaataattaataataataaataattattaataataattattatttaataattttaaaattattttrtaatttgcataattattataaattttataattttgcatacatgtaactttagtccaaagatctagctatcctcttattagttttaatatgttgtctatag

SEQ ID NO: 23019 - DNA, 201 bp, Homo sapiens
ctaatgccagccttcaccttgggcattaagaccccacagtctgaaaaaaccgtgagaaagccatgtaaaaatgatgggaatggggcatcaggagagcaaakctctttcaaaatctaaagttataaatgctgctcgtgtggcagtggcttgtcactttccactgacttgtgactatgatgactgtcttagaaattcatttca

SEQ ID NO: 23020 - DNA, 201 bp, Homo sapiens
taatgccagccttcaccttgggcattaagaccccacagtctgaaaaaaccgtgagaaagccatgtaaaaatgatgggaatggggcatcaggagagcaaagytctttcaaaatctaaagttataaatgctgctcgtgtggcagtggcttgtcactttccactgacttgtgactatgatgactgtcttagaaattcatttcat

SEQ ID NO: 23021 - DNA, 201 bp, Homo sapiens
atatatatatacatataataaaatacatttaatatacacttttcttaatggctttttccatgaactaaatgaactctcttctcatgaaatgaatcaatatmaagtattcagacttaagtaaaactttcaagtgctccagttgtaaaactggaatgtggaaaatggcctaggctcattccttctctggattgaatgggggtc

SEQ ID NO: 23022 - DNA, 201 bp, Homo sapiens
tcatgaaatgaatcaatatcaagtattcagacttaagtaaaactttcaagtgctccagttgtaaaactggaatgtggaaaatggcctaggctcattccttstctggattgaatgggggtccctctgataacatcgggcaagcccaacgctgctgccgagtgggatgtattaggaaccctgccaaaaataagtggccgtggg

SEQ ID NO: 23023 - DNA, 201 bp, Homo sapiens
tacccacccagagacaccagggtaggtgggactggaaaaatgggtcccagtcacagaaaggggccagtctgggaagcctctttgtccccacaggccagacmtgctcctcttccacccagagacattgaggtacccgggggtattggtaggggaaaattactataccctttgccttcaactgagaaacacacagagtccctc

SEQ ID NO: 23024 - DNA, 201 bp, Homo sapiens
tccccaacaacataaaataacacctcccctactatactcatgttctgagagcctatgaagatattttcgtcaataaagattgcttttccggccgggcgccrtggctcacgcctgtaatcccagcactttgggaggctgaggcgggcggatcacgaggtcaggagatggagaccatcctggctaacacggtgaaaccttgtc

SEQ ID NO: 23025 - DNA, 201 bp, Homo sapiens
agttgattttccttcatcagattcaaagaagagtcaggtttcagtaaacagtattatttgtattgaacatcagaccatattattcttcagaaatgtatttktttttcaattttcaattttctatgctaataccgtatggaattttgttattcctaaacttttacccaattttacttttcttctatttaatttcatttattt

SEQ ID NO: 23026 - DNA, 201 bp, Homo sapiens
ggggccagtctgggaagcctctttgtccccacaggccagacctgctcctcttccacccagagacattgaggtacccgggggtattggtaggggaaaattastataccctttgccttcaactgagaaacacacagagtccctcaggtagcaccagcaagaaccagtgagagccccggtagcaccaatgtaaaccaagcagac

SEQ ID NO: 23027 - DNA, 201 bp, Homo sapiens
gaagcctctttgtccccacaggccagacctgctcctcttccacccagagacattgaggtacccgggggtattggtaggggaaaattactataccctttgcyttcaactgagaaacacacagagtccctcaggtagcaccagcaagaaccagtgagagccccggtagcaccaatgtaaaccaagcagaccagaattccacca

SEQ ID NO: 23028 - DNA, 201 bp, Homo sapiens
tatcagcaaaaaaacaatggttacaataaagaactaaatagaaattatagaactgaaaaatacactaacataaataaagaacatgctgaataggctcaatrgtagcatggagatgacagagaatagaatcagtgaacttgaagatagaacaatagaattcacccagtctgcacaataaagagaaaatagactgaaaaaaca

SEQ ID NO: 23029 - DNA, 201 bp, Homo sapiens
agttcagacatatcttaattaaacttctgaacactgaaggcaaacaaaaagtcttgaaagcagtcagagagaattgggacattacctagagaggaagaccrgttagaataaaagcagatttctcatctgaaaccatggaggccctaatgaattgacaatatattcttcaagtgctgaaacaaaggaattgtcaaccataca

SEQ ID NO: 23030 - DNA, 201 bp, Homo sapiens
tcttcaagtgctgaaacaaaggaattgtcaaccatacattttatatctggaaaactatctttcaggagtaaagaggaaataaaaacttctcatatgaaggwaaactaaacaaaattatcactaggaaacctaccattaaagatggtcaaacagaagttcttcaaacaaaaatgaaattattaaagaaccgtggagcatgag

SEQ ID NO: 23031 - DNA, 201 bp, Homo sapiens
aaagatggtcaaacagaagttcttcaaacaaaaatgaaattattaaagaaccgtggagcatgagaaaagaaaaaggaaagtggaaaaagcaaaaatatgtrtacatacaatagaatatccttttccccataaagcttgtgaatcatatttaataaaacaagaaattataatgccctctgttattcagtataatgatatgga

SEQ ID NO: 23032 - DNA, 201 bp, Homo sapiens
acaacagaaaaagaggaatcttacataatgataaaaggatcaatccaccaggaagacataatgatcctcctaaatgtgtatgcaccaaacaacagaggcayaaaatacataaagcaataactgatagagctaagaagagaagtagacaaatcttcggttatagctgaggacttcaacactctcctctcagtaattgataga

SEQ ID NO: 23033 - DNA, 201 bp, Homo sapiens
ggcaatacagcaaaatcccctctctacaaaacatttaaaaattagccaagtgtggtggtgcacacctgtagtcccagctatttgggaggctgaggtgggaggatcccttgagcccaggaggtcaaggctgcagtgagctgtcacaccactgtatgccagcctgggtgacagggtaagaccctgactacaaaaataacaatt

SEQ ID NO: 23034 - DNA, 201 bp, Homo sapiens
agatggatcagtgtagatatagaaatggtctcattgccaagtaagccccaaacaaatatgtgcaggatctgagtgctaaaaataatgaaatgctggcataracctaaatgaaagagacaattatatttatgaattggaagactcaacatagtaaagatgtcccttctccccaaaatgatggataggtttaatgcaattcct

SEQ ID NO: 23035 - DNA, 201 bp, Homo sapiens
tggtggatatttattcatgcttctgtgatgttctgccccgtgcaccatgtgccataatcatttggttggctttaagaaagaatgaaatttccaatgagaayagataaatggtctggcaaaataaaaagtgtcacacctcgtagctccctcgatagcaaattgagaatttgtttgctggaaaagaaaatgaggatcataaca

SEQ ID NO: 23036 - DNA, 201 bp, Homo sapiens
ccatgtgaaatattttcatccagtctgtagccagtctgttcattttcttcacataggcaatgtactactatgtaaaatatataaagaagtctcaaactcargagtaaaatacaaacagttctattagaatatggacaaaagacatgggcagatagtccaccaaagagactctacagatgataaataccagaaaagatgttc

SEQ ID NO: 23037 - DNA, 201 bp, Homo sapiens
tactatgaaaggggctaaggttgggaggccagaaaaataacagtgtggtttggtgagagcaagacagacaagtgagactgcagtgggcagagaatggaacrgggctccggtgagaagacagctccacgaatagagaggacacagcaaagagccttccttccatcaggagaaaggatgctttcttagagggagtcagcatag

SEQ ID NO: 23038 - DNA, 201 bp, Homo sapiens
ttccaaaagtaacacacacataaagagtcaaaatgtgtattcatgccaggcttcctccaaacaccacatcctcaatgtttcccaatactgtctctcaaagkatacattttcttttttcttttcttttttttttttttttgagagaaggtctcactttgtcacccaggctggagtgtagtggcacaatctcggctcactgca

SEQ ID NO: 23039 - DNA, 201 bp, Homo sapiens
atgttcccctccctgtgtccatgcgttctcattgttcaactcccacttacgagtgagaatatgcggtgtttggttttttgttcctgtgttagtttgctgakaatgatggtttccagcttcatccatgtcccttcaaagtacatgaactcatccttttttatggctacaaagtattccatggtgtataggtgccacattttc

SEQ ID NO: 23040 - DNA, 201 bp, Homo sapiens
tgatgttgaataaatcccttttttgttgtttgtttcaaaaagctacagattataaactagaattaaggccccagaagtttttaggaaaatgctatttccaraattttgctaagtatatcaaatatgatatattacatttcaaaaatttccaaatcagaaggaaaacgttgaaagattctctgtaaaatacagcagtatgtt

SEQ ID NO: 23041 - DNA, 201 bp, Homo sapiens
tgggtgcagtagctcttgcctgtaatcccagcactttgagaggatgaggtgggtgcatcacctgaggtcaggagttccagaccagtctggtcaatatggcraaaccctgtctctactaaaaataaaacaaataaaaaaaaattagccaggtgtagtggcacattcctgtaatcccagctactcgggaggctgaggcaggag

SEQ ID NO: 23042 - DNA, 201 bp, Homo sapiens
ttccctcccttcctcccctcttcttccccttcctctcctccccttccttttcctcatctctctttccctccccttccctttctttccacagggtctctctytgtcacccaggctggagtgcagtggtgcaatcacggctcactgaagcctcgacctcccaggctcaggcaatcctcccacctcagcctcctgagtagctgg

SEQ ID NO: 23043 - DNA, 201 bp, Homo sapiens
aaattagccaggtgtagtggcacattcctgtaatcccagctactcgggaggctgaggcaggagaattgcttgaatccaggaggcggagtttgtagtgagcrgagacagtgccactgtactccagcctggccaacagagtaagactccatctcacaaaaaaaaaaaaaaaaaaaaaaaaaaagagtaacaaggccaggcctg

SEQ ID NO: 23044 - DNA, 201 bp, Homo sapiens
atcctcccacctcagcctcctgagtagctgggactataggtgcacccccacgcctggctattttttttcttttttagagatgggatctgctctgttgcccrggctggtctcaaactcctggcctcaagtgattctcctgtcttagcctcccaccatacctggccatttttgttcttaaatcaccacttctccaagaccttt

SEQ ID NO: 23045 - DNA, 201 bp, Homo sapiens
tgcttgaatccaggaggcggagtttgtagtgagcagagacagtgccactgtactccagcctggccaacagagtaagactccatctcacaaaaaaaaaaaawaaaaaaaaaaaaaagagtaacaaggccaggcctggtggctcacgcctgtgatcctagtactttatgaggctgaggcgggcacattgcctgaggtcaggaa

SEQ ID NO: 23046 - DNA, 201 bp, Homo sapiens
tccaggaggcggagtttgtagtgagcagagacagtgccactgtactccagcctggccaacagagtaagactccatctcacaaaaaaaaaaaaaaaaaaaawaaaaaagagtaacaaggccaggcctggtggctcacgcctgtgatcctagtactttatgaggctgaggcgggcacattgcctgaggtcaggaattcaagac

SEQ ID NO: 23047 - DNA, 201 bp, Homo sapiens
cactggttgactgactgcaagccactagttaatctgtaaaatcatgttgttactgagacagtattttagaagatggttgcttagttttatgttgattattrtgcaaaaatggccactgatattaagatagttttcttatcaaatgtctttgctctgccatgttctatactaagtgctccatatacattacagcattccatt

SEQ ID NO: 23048 - DNA, 201 bp, Homo sapiens
aaattccttatattctttttcattaactgaatattgttgtgattttaggttctgatgaaaattaaattcgacagccttcttttgattgtttatctcaaatraggttgtcagtacgttttataagttatattactatatttgaagtctgtattctaatccattcggacacatttttgtgtttattctcttctacttgtatgc

SEQ ID NO: 23049 - DNA, 201 bp, Homo sapiens
tgattttgtgggccaggaatttggaaagaacctaacatgacagttgctacttgaaatctattcagcagttataagcgggtgtcagctgggactgtagctgwctaaaggctggactgggctgaatatccaagatggcctactccagtggctaccaattgatgctggctttcaatgagagttcaactaggctatggacctgag

SEQ ID NO: 23050 - DNA, 201 bp, Homo sapiens
tgagcctgcaggcttccttgtgagaaggctttaaattatgattcaatgtatttaatatagatctattcagagtttacatttcttcttttttcagttttggyaatttttttctcaagaaactcatctgtactttcagaatattttcttactatgttttagtgttcgtaggctctgtagtgatgtcgtctcttttcattcctg

SEQ ID NO: 23051 - DNA, 201 bp, Homo sapiens
agtgtccttgctttgaagtcaggaggtcagggtttccttcattactttccccttcggtgccaaatatgtaccagacactgccaggcgcttgtttctggacrtgtaccacccctcaccctcttcatggcttggggttcttagtttgcttatttagaaaatcaggtgcctggggaacagaagcagaaagaagaaaactaagga

SEQ ID NO: 23052 - DNA, 201 bp, Homo sapiens
gaaagtgtctactgtgaagtcctacctgttttatcatacctgtgcttgttttgtagttagagtaaacattgtttcaacaggaaactaagttaaatatctcrtttctcattttaatttttatagcaattgcatgagtcatcatcacatttttgtttttatttttatggccttaattgtttgtgtaggttctgatcataatgc

SEQ ID NO: 23053 - DNA, 201 bp, Homo sapiens
tccatgttgtcacaaatgacaggatttccttttctttttaaggataaataatatcccatttatgtctgtgtgtgtgtttttgtgtatttatatattgcacwttttctttatccatttacctgttgatgagcacttagattgattccatatcttggctatggtgaatgtatgaatgtattgtgaataatgctgcaatgaaca

SEQ ID NO: 23054 - DNA, 201 bp, Homo sapiens
aattttttctttttcagttccaaacttagaaacaataccatgaacaaataatggaacccaggtagtaatctcatgcaagggtttaagaaatatacttagayattggtggaacttggagagttaagtctgttaggattaagagaggaagtgacatcaaagtggaaagaatttggttaattgtaggtgtagtaataaattgcc

SEQ ID NO: 23055 - DNA, 201 bp, Homo sapiens
cctaatgtatggttactttaacaattttttcctagcttcttgacttggaagcattgacaaatgagtttgaacttcttagaatttctaatatatgcactaawactaatgcattttccttggagaacttttatttgcatcccacaggttttaatatgtatgttttcattagcattcggctgaaagtattttgtcatttttatt

SEQ ID NO: 23056 - DNA, 201 bp, Homo sapiens
gtcctctacctatattaacttagtcaagttggtaaatagtgtttttcaaatattaaatttctttactgatttaaaaaaatatttgctttattacttagtcwgaaagttatagtaaaatctcaaactatgattctagatttgccagctttttgttctgaaacttttgctttatttattttcttacattatttttatcttctt

SEQ ID NO: 23057 - DNA, 201 bp, Homo sapiens
atatgtataacttgtgaaatgattaccacaatgtaactaatatatctatcatacatagttaccattttagtcaatatggtgaaaatatttaagatctactstcagcagttttcaagtgtataatacaatattgttaatgatagtcaccatgctgtacattagatctctagaagctattcattccagagaacataaacgttt

SEQ ID NO: 23058 - DNA, 201 bp, Homo sapiens
gtatactttcaacaagggttcccttttctccacatctcatcaatacttgttgtcttttatcttctcgataatggccattctaacaagtatgaggtggcatyttattgtggttttgatttgcatttccatgatgattagtgatgttgagcattttctcatatatttgttgaccatttatatgttttctattcagaaatgtct

SEQ ID NO: 23059 - DNA, 201 bp, Homo sapiens
tcttttatcttctcgataatggccattctaacaagtatgaggtggcatcttattgtggttttgatttgcatttccatgatgattagtgatgttgagcattytctcatatatttgttgaccatttatatgttttctattcagaaatgtctatttggatcctttgcccatttttaagattgggttagtttgttttgttgatat

SEQ ID NO: 23060 - DNA, 201 bp, Homo sapiens
ttttatatgttgattttatatcctgtaactttactgaattagtttgttcatttattagttctaaaagtattttagtggagtctttagggtattctatgtaygaaagatcatgccatttgcaaacagaccattttacattctaatgggatcatttttcttcagcctgaagaacatattttaatatttctcacagagcatgtc

SEQ ID NO: 23061 - DNA, 201 bp, Homo sapiens
ttgttgttctcctgaagataatgtgtctttttctcccccctcactgcttttattgtgtgtttatatttaattttccacaacttgattatggcgtatctagrtctggttttctctgtgtttgtcctgcttgagagtcactgagagttttgaatctataggttgctttcttttatacaattttgagaaatttcagccaatatt

SEQ ID NO: 23062 - DNA, 201 bp, Homo sapiens
ttctggattatattatcttcctctcagaagggttgggtttttttctagtaggcacttatgttcctggcagatcactttcattcaatcaaggcttgaatttwcaggggacctatttcaaattttccatgaatcctggtggattgccatatttcctagaatatgaatcttactcctgtagcatacttttctcacgtttcaatt

SEQ ID NO: 23063 - DNA, 201 bp, Homo sapiens
ctttgaaagctcctttgctttctggtcagaaaagatgttctaggctcttcctgcacattatttacctcaggactgaaaaccctgatttccctaaagagctstgactttttctgtgggaaatggtatttagatctcacaatctgggtgctacggatggctattggtactgggtgtgtcatcgtctctagacctttcagtgga

SEQ ID NO: 23064 - DNA, 201 bp, Homo sapiens
cacagcctttaacaaattgagcagttttccaacttgcctttctattatgggagcatgagtgccatctggtgggcattgcattaaattactattaagagttmcaaaaatcagccctgcgtcagaatcacctgtggagttacttacattagacttccagttcccaccgaaacccactgaatcgggatttcccagggaggagtc

SEQ ID NO: 23065 - DNA, 201 bp, Homo sapiens
aattaagcaaatgatctcatataattgtattttcctctttcttagataaaagggagcataatatacacactggtctatagttggctttttttcacatcatrtatcctggagattactccataatcagagcatagtatgccgctatgtgatgtctcattttctgttcaatcaatactctattgacggacatttggcttgttt

SEQ ID NO: 23066 - DNA, 201 bp, Homo sapiens
ctcctgacctcgtgatccacccgcctcggcctcccaaagtgctgggattacaggtttgagccaccgcgccgggccctaagggttttattttaatgaatgcrtacaaatgtgcataagggttccttaggtaaactctccaactaggtgccctcctccaaacactgagcagcccccagagcagatcctccctgtccgagggct

SEQ ID NO: 23067 - DNA, 201 bp, Homo sapiens
tctatgtccccacagcctctccaataatttgttttcaaaactctgcatttttaacattctgaggggtaagaaatggcatctcaattaaggttttatttgcwccttctttgtgatgagtgaggttgaacatcctttcatatgtttaagagacatctgaacttttttcagtgcactctattcatgtctctattctttttagaa

SEQ ID NO: 23068 - DNA, 201 bp, Homo sapiens
tcttattttgtcattaatcttttcctttgcttatgctattttatgcatttaaaactggtaacttttaaagtattacattgggaaatgcctctttttctgargaactgagatgttttctcagtaggaacaatgagactcatggaactaatttgtttcattttttactttggcaggaaaatttttatttgaacaacctgtata

SEQ ID NO: 23069 - DNA, 201 bp, Homo sapiens
acccgggaggcggaggttgcagtgagctgagatcgtgccactgcactccagcctgggtgacagagtgaggctctgtctaaaaaaaaaaaaaaaaaaaaaaraaaaagaaaaataatagtgattgtgttgaactgggttaggttcctggaataaagtaatcattattactgagaggagaggtatcagccgaagctccttctg

SEQ ID NO: 23070 - DNA, 201 bp, Homo sapiens
caatggtgttccttcttctgttttctttgcttatattcattttcttctagatcactaagaatttataatgaaaaaaatcaaaagggaaagatctttgattrgtaacatcatgacaaaaattcaaactatatgtccagccttggaattgaaatccagtcacaggccaggcgcggtggctcatgcctgtaatcccagcacttt

SEQ ID NO: 23071 - DNA, 201 bp, Homo sapiens
gttctcagaattacattgaggtaactttcactactcaatcgcccttagatgacattcatcaacatttttatattctgcagagtggtggtcttcaaaagatkgttgggccaccagcagccagaatacctgagagcttgttagaaatacaataataactaagctctaatgactaaggtgcaggcaaataaggctgataggatg

SEQ ID NO: 23072 - DNA, 201 bp, Homo sapiens
ttagcataagatctagctagacttagttgaagtgcattgaccatagcactacagcagtatgtatgtatgtatgtatgtatgtatgtatgtatgtatgtatktatttatttattttgagacggagtttcgctcttgttgcccaggctagagtacaatgtcatgatctcagctcaccacaacctctgcctcctgagttcaagc

SEQ ID NO: 23073 - DNA, 201 bp, Homo sapiens
cataagatctagctagacttagttgaagtgcattgaccatagcactacagcagtatgtatgtatgtatgtatgtatgtatgtatgtatgtatgtatgtatktatttattttgagacggagtttcgctcttgttgcccaggctagagtacaatgtcatgatctcagctcaccacaacctctgcctcctgagttcaagcaatt

SEQ ID NO: 23074 - DNA, 201 bp, Homo sapiens
gcaattcatccatgtaacgaaaaaccacttgtatcccaattagattagatagatagatagatagatagatagatagaaaaaaaaatttcacctttgaaagytgaacactttattcccacccttttccatgccaccaccccccaattctacactcctcataatctcagcaaatggaaagtacatttttctcattatttaagt

SEQ ID NO: 23075 - DNA, 201 bp, Homo sapiens
caatatattgttccctaaaatgatgtcttcattttttaaagctatctctaaaaaatgaaatatttatgaaaaagaattaaaaaaagaatgttggtatttcraatactttggtggtttagaggggggttgactttgtcctttactgactccattgatgagtaaaagcagtccacccaaaattttagaaagagtggagaagag

SEQ ID NO: 23076 - DNA, 201 bp, Homo sapiens
aaacagaaaagttgaaaaatataatcaataagacaggaaggagtaatttacattgaattttatttctgaaatctagggaatatacctgttctacaagtggygttgaaccctaattcatcatattttagacctctatggcaatcccagtaaattaacaaagcagaaattgtacatctcttcacaatataacataacccaaga

SEQ ID NO: 23077 - DNA, 201 bp, Homo sapiens
ctctctgctctgaaatcctcttttataggagaaatgatcagacacccttgcttctccttgtacccaagattataaagacagctgtgaattctttttgtcaktttttcttttaaggaatctaaacccaagagaggatacaggagggtgaggattattatatttctttacatgatattgataacagcttatatttaatgaaca

SEQ ID NO: 23078 - DNA, 201 bp, Homo sapiens
gcgcccggcataagtaaagaattataagctatggtacataatgatcctctcctcaaagagcctacataagtaagacacaaaataagtaaaacacaaacagkcttgtcctgaaagagcctgcatgggtattaaccaatgcaatggtaattacctagagatttttcttagaagtgaaatttttacagctctccctcaaattca

SEQ ID NO: 23079 - DNA, 201 bp, Homo sapiens
ttttgaaccattgtgagttaattttatagttttagctcttagatttagatctttgaacttttttgagttaatttttgcatatggtatgaggtaagcctccwacttcttttgcatgtggatatctagttttcctagcgctgggtaaaggtggaactcctctgcaagggaggtgaggaaggaggggaacagagaaaggtgtag

SEQ ID NO: 23080 - DNA, 201 bp, Homo sapiens
tgatcaaaaagtgaagatgtatttggcctgtagttattcagtaagaaactttgttattttggtttaaaaattgtacttgctaattactgatgcattctctsgtttgaattatataggcctcgaatggctacagagagaggaaatttggtgtttcttacggggtctgctcaaaacattgagtttagaaccggatccctggga

SEQ ID NO: 23081 - DNA, 201 bp, Homo sapiens
tactagaatcattaatagagctgctattcttattttgaaggtgaatggatgattaatattaaaaacttgctttttcccataatttaattctcatcccagcrtgtgcttcccaggatgcagatgcagagctgagtctaagacagatgaaatgacaaggctgaggtctccgagcctgttagggcttctgaccctgagtttgca

SEQ ID NO: 23082 - DNA, 201 bp, Homo sapiens
attctcccatcagggactggggctcggaaagcaagcatcctctctgacgctaagctcggaagtctaggtgtatcacaaaatagtccgaattttcttaaaaygacatttgctggtaattaaacttgaacagtttcttacagaaaacattgtataactgtactacatgcttgtagactgatctatgtaaacttaggcttctta

SEQ ID NO: 23083 - DNA, 201 bp, Homo sapiens
tgtcagtttcctgtgccttcaccgtcctgagacccaggctctagagcttgctgggggaaaagtaaaagatggttgaattatgcagtgacttccaaagcttytatgtggaaattggtgtatcacttttgctcacactctgttgggcaaagcaagtcctatggctaagcccatagtcaatgggaagattatgtattaattctc

SEQ ID NO: 23084 - DNA, 201 bp, Homo sapiens
tacaggaagggaagtgaataactatgtaaaataatgccatccatcccagttcatgagcataaaggaaagaggtttttttttttttttttggtgggggtgcraatttatcaagtcctagattattgaacgcaatacatgcttcagaggtagctagggtcactttagaacatttgatgaattttattctagtgtctctttcaa

SEQ ID NO: 23085 - DNA, 201 bp, Homo sapiens
gccatccatcccagttcatgagcataaaggaaagaggtttttttttttttttttggtgggggtgcaaatttatcaagtcctagattattgaacgcaatacrtgcttcagaggtagctagggtcactttagaacatttgatgaattttattctagtgtctctttcaaaggagttgtagttaaagtattgccatgtctagaat

SEQ ID NO: 23086 - DNA, 201 bp, Homo sapiens
cacctcaggtcaagagttcaagaccagcctggccaacatagtgaaaccccatctctactaaaaatacaaaaattagctgggcgtggtggcgtgcccttgcwgtctcagctatttgggaggctgaggcaggagaattgcttgaatctgggaggcggaggttgcagtgatccgagatcgtgccactgcactccagcctaggtg

SEQ ID NO: 23087 - DNA, 201 bp, Homo sapiens
ctcaggtcaagagttcaagaccagcctggccaacatagtgaaaccccatctctactaaaaatacaaaaattagctgggcgtggtggcgtgcccttgcagtytcagctatttgggaggctgaggcaggagaattgcttgaatctgggaggcggaggttgcagtgatccgagatcgtgccactgcactccagcctaggtgaca

SEQ ID NO: 23088 - DNA, 201 bp, Homo sapiens
tttggtgtttcttacggggtctgctcaaaacattgagtttagaaccggatccctgggaaaaattaaattaaatgatgaagatctcagtgagtgtttacatyaggtaatacactggaaatatattgaagtcattttgtatatccatatacggtgacttaattgaacaagtctagattaatctgtaccttgaatcttttttaa

SEQ ID NO: 23089 - DNA, 201 bp, Homo sapiens
ggctgaggcaggagaattgcttgaatctgggaggcggaggttgcagtgatccgagatcgtgccactgcactccagcctaggtgacagagtgagacttcatytcaaaaaaaaaaaaaaaaaaaaaaaaaaaagaaaacaaagaaaaatcttctctttactacctgtttgccttggcctagataactcctactcagctttcaa

SEQ ID NO: 23090 - DNA, 201 bp, Homo sapiens
ttttaaatgatagattttatgaagttaatatccaaagtgacctagtttgttaaaaatctgaccactttgagcttaatgattcatccttttgttttagattygagatggtcctttgtatcaggacccccttcttgggaagttctgcaccactttctctgtcccaccgctccagactactggcccctttgccagaattcactt

SEQ ID NO: 23091 - DNA, 201 bp, Homo sapiens
ctcaatgtctgtcccgtctccacctggcctggagaataaagctcaagctcctgcagatgttaaccaagagccccagaacccaccctgacctctctccagcrtcagtcacccacatccctggggcaccccatgctccagctgagcctctatagatgctcctctgtgtctgctcaggcagtcccctccctggcctcccttttc

SEQ ID NO: 23092 - DNA, 201 bp, Homo sapiens
agcgattctcctgcctcagcctcctgagtagctgggattacaggcacttgccaccacacctggctaatttttgtatttttagtagagacgaggtttcactrtgttggccagactggtctcaaactcctgacctcgtgatccaccagcctcggcctcccaaagtggtgggattacaggtgtgagccacctcgctcaccctgg

SEQ ID NO: 23093 - DNA, 201 bp, Homo sapiens
cataatcccctgggtgagttcagagtctttggttaacccagtggttctctacaatttaagactttttaatatcactccttgattattcagaaatgaaatamactgatttaaccccactagacacattatatttaaaaatatgtaaagttgtaagaataacattaagaaaaaatagagtaacagaataaaatcacatttatt

SEQ ID NO: 23094 - DNA, 201 bp, Homo sapiens
attagctacaaggacactgaaggcccagggacctgaagttcacgaccacggctcacacggtccattgtacttccgactatgttatgtaattcttaccttaytataataaagaaaatctaaaattagaatgacttttttttaaagtacgaaggtttgatatggtaagaaaaaggatcgagcattattgtactaaattatata

SEQ ID NO: 23095 - DNA, 201 bp, Homo sapiens
gaattagacacattaaggttcttccagggaatcactagtattgtttattccagcagagccctcccatctcaattaagcattctttacgcttttatcttatmcctacctcaatccacctttccttctatttctgtcagaagaatggttctggggctgggtgtagtggctcatgcctgtaatcccgcactttgggaggccaag

SEQ ID NO: 23096 - DNA, 201 bp, Homo sapiens
ttgctacttactaaatgccagtaatgccccatgattgctgtgataataattaacacaaaaccaaaaaggtactctcacacatttcccaaatgctagattgyggtccctgctgagaaccattggttaggtaacaatgaagtatcctgcgcttccccaaaaaccgcagtcatcatacttttcaaaaatgttcctgcctattgt

SEQ ID NO: 23097 - DNA, 201 bp, Homo sapiens
tacaaggacactgaaggcccagggacctgaagttcacgaccacggctcacacggtccattgtacttccgactatgttatgtaattcttaccttattataakaaagaaaatctaaaattagaatgacttttttttaaagtacgaaggtttgatatggtaagaaaaaggatcgagcattattgtactaaattatatataatcc

SEQ ID NO: 23098 - DNA, 201 bp, Homo sapiens
gccatctagcactggattgcagtagtcaagtacttagaaaagaccttcactttgtaatcttctggagcatcggacagaatgctaatgtgcatgttgatcayctaggatcttgctgaaattcactttctcactgagttggttggtggggccagattccttgtttcaaacaagctctccggtgatgccgatgttgctggatta

SEQ ID NO: 23099 - DNA, 201 bp, Homo sapiens
ttcatctgtttgcttcaacaatcccatgagcttagatagagtaacttgctcaaggctattaagtgaggtggtttgtaagtgacagaggtaggttttgaacscaagtccatagactgtattcatggccactatactataagagctggctatttggccgggcgcagtggctcacgcgtgtaatcccagcactttgggagtccg

SEQ ID NO: 23100 - DNA, 201 bp, Homo sapiens
ttcagcctaggcaacaagcaagaccctgtctgttaaaaaaaaaaaaaaaaaggaataaaggtgaaataaatattgaagcaaaagaagggtcttggcctggygtggtggctcacaactgtaatcccagcactttgggaggcctaggcaggcagatcatgaagtcaggaggtcgagaccatcctggccaacatggtgaaaccc

SEQ ID NO: 23101 - DNA, 201 bp, Homo sapiens
attctgagagccaccagcttaccaccaggcttactgatttggttagagacctaccaatgctagtatctggcttgagagctaggttagagcagagctgaccrgttacttcacccctgtggtctggtaggcagggagtgaccagagatgtgcctggtatattgattagtggtagggcttgaggtggtcagagcctccaggctg

SEQ ID NO: 23102 - DNA, 201 bp, Homo sapiens
gagcagtaatacacagcctccatcctctttcacagaacccacagcagtagtctttatatcgccaaagcaccaatgtttttgatgcatgaattgttaatagmtgcatagctgaataaatgaatttttgtcatctctgctcctgcaatgctcagtgctttggtggaaaatctcagaggacaccatcgggaatgtgctgtactg

SEQ ID NO: 23103 - DNA, 201 bp, Homo sapiens
agtaaaatagataaaccaaaattagagagtggggctgctcaccccaccttcccatgtccccaagtcccctaggggctcagaaccccttttcacatgggaarttgtggcctcttttcacaccatgcaacgttttaaggaccttttctaaggaagtgatagcccagaaaccaaaaaggaggcagtatttctttccctagtcag

SEQ ID NO: 23104 - DNA, 201 bp, Homo sapiens
tcatttgttcatcaaacatttattgcctgtatgtgccaggttctgtactttttaaaaagtctcctatttttatataataaagttaagctttttgtttttgkgggggttttttgtttgttttgttttgagatggagtcttattctgtcacccaggctggagtacagtggcaccatctccactcattgtagcctctgcctcct

SEQ ID NO: 23105 - DNA, 201 bp, Homo sapiens
aagttccaaacagccattgtagtttatatgaaaagtaatgggtgaattgcttggctgtgttgagatgggagaacatatatttgcaggggcatcaatttccwtgaatgaatggcttgaattgaacacaaccacggagttggtattttgcaagggaagtttgaaggaaagacacgaagcaagggagttggagctcatcaaagg

SEQ ID NO: 23106 - DNA, 201 bp, Homo sapiens
caaaaagtttggttaaatccagggggttttatgtggtaaaaaataatcttttcaggagatacatgaaatctgcttttctattatgaagttaacattggtcrgagtgttctgatctcctcaggttgaacttcccattaaaagcctcttttgcactttctctaatggttttagcattctttaggttcagtatttagatgagtt

SEQ ID NO: 23107 - DNA, 201 bp, Homo sapiens
ggctgacattatctgctgcccctccctcttctacctgtttgtcttatctcaaactcctctcttctttgctctctgggatccagccacctggcctccattcygttccctgaatgtgctgagatgctccccatctggctgttgccttcatctggaatgcccctccccagatggcggcctgctccacaccctcacttcactggg

SEQ ID NO: 23108 - DNA, 201 bp, Homo sapiens
ttaaagaaagtcccttccatccttagtgtgaaaaagctttttttaaatgtaaatgggcataggattttatcagatgattttctgcatccattgagatgatkcaactttttctcctttcataagttaatgtgatgaattatatgaaagatttatttctcttggtaaaccatccttgcatttctgggataaatcctattttgt

SEQ ID NO: 23109 - DNA, 201 bp, Homo sapiens
ttgagttcccaggttgtcctgtattttttatcaccataaatctcagccccttgcagcagtgtgaaaaagacaatacgcatttccaagtccattagagaggratagagtcaatgcaattattcataaaggatagaaggatgtggtgtcaaaaaggggctctgcaagtaaaagtcattagtaattcagcaataatggatttga

SEQ ID NO: 23110 - DNA, 201 bp, Homo sapiens
gaacagtgatccaggaaggtggatttttaaaaaatcaccacccagctatgcaaaaaggaacaccatctccttagagaagtcaagaatgggacatgctattytaaaaacagctttaaaaaaattattctcaaaagaaaatactacagatttgtccatgttttgtttactcttatgcttagttctgtatacgtgtgagtgcca

SEQ ID NO: 23111 - DNA, 201 bp, Homo sapiens
cagtacctctgaatggttcatcctctcaggctttgcagaacactagaactgaatttcagtgagcggttccatgaactcctctgaattcttctgaaaagttygcacaaaaaatcataaaactggctttggaagttttaatttcataaaccagaatggtggaatgttttgtagccagaaggggattaaagttagttcacctaa

SEQ ID NO: 23112 - DNA, 201 bp, Homo sapiens
ctacccacaaaactttcttcctttccgttataattccttgcttttgttcctcacccccacccacaggaaaccacaaatctactttctatctctgtagattygtttgcatatcatctaaatggaatcatactatacgtactgaatgtttttctgactttcctcaattagcataatttttgttgagcttcttggatccgaaga

SEQ ID NO: 23113 - DNA, 201 bp, Homo sapiens
tgcagacaaaaagattcaatttccccagaaggaaaggggtgtgtgtcattccacttctttctcctgtaggttgcgggggtaatctcaccacttcaagcggyacgttcatatctcccaactacccgatgccctattaccacagctctgaatgctactggtggttgaaatctagccacggcagcgcatttgaactggaattca

SEQ ID NO: 23114 - DNA, 201 bp, Homo sapiens
cttgaaacaaactgaaataagtgtaacgcattggtgtgagcaattgaacttcatcttagtttcttctgtgaatcgtttaactccatttgagggagaaataygtattaaatttaatctcatataactaaaacatctggcaaactatagaaacttagaagagtatttaatatgctgagagagttgcaattcagtgaaagatca

SEQ ID NO: 23115 - DNA, 201 bp, Homo sapiens
agctagttcgtatgtgtacccataaaatggtcagaaagttccatggagcctcttggatttctgcttagattgatttctttagagggttctccttttttgcmccccccaaaattattcctgattttgtagtgagaatttagtttttcagaatttgccaattttctagaatgttctttcctttttcaattgcgttttcatttg

SEQ ID NO: 23116 - DNA, 201 bp, Homo sapiens
cccaccacaccagtgtccccagctgtactctttccatgtattagcaagctcatagttttgggtaaagagagctttattcaatgctatgtcaaaatgtgacyataacgaggtcaaagattaaactgaggttcaatgaatgaagtaactctctctgaccacagtcatcattatcagtacagctctatcttctcttctgactta

SEQ ID NO: 23117 - DNA, 201 bp, Homo sapiens
aggtcaaagattaaactgaggttcaatgaatgaagtaactctctctgaccacagtcatcattatcagtacagctctatcttctcttctgacttattctgtmaagtgacttgtccacagaattctcctgctcagctcaggcatcactttctgcaggaaactttcccttccctttttaagcagagtgaggcatctcagggcct

SEQ ID NO: 23118 - DNA, 201 bp, Homo sapiens
tgtgtgctgttttagttatatcttttacttctctctgtgttataaattcaccttactattatttttgctttaaatcactaattctctctctctctctctcytttttttttttttttttttttgagactgagtctcagtctgttgcccaggctggagtgcagtggcaagctcccagctcactgcaacctccaccttccgggt

SEQ ID NO: 23119 - DNA, 201 bp, Homo sapiens
aaaagaaaacttgagcctcagaatcatctggacctgcaaaaatgtagtcatggcatcaaagttcgctttggagtttggacctcattcagtttctttaactmtttgagctcttttacttggacggaaaaaggagtctttaactggattaataatttgccattgtaaagacctctgaaaaggtgcagatactcattcatggaa

SEQ ID NO: 23120 - DNA, 201 bp, Homo sapiens
tggcatcaaagttcgctttggagtttggacctcattcagtttctttaactctttgagctcttttacttggacggaaaaaggagtctttaactggattaatmatttgccattgtaaagacctctgaaaaggtgcagatactcattcatggaaagtcctgtttcatacctgtttcataggtaaacttctggtggaaattcttt

SEQ ID NO: 23121 - DNA, 201 bp, Homo sapiens
acaatgattatagcacaagaaacatcattttctgtttccactgattcttttggcttgaggtctagacccagagcttcagacaactaacacaattacatttygccacttctccatgctgttactccctctttgttctgaagacgtgattcttgttgtttccctgctcactttgttttgttttgtttgtttttgtttgtttgt

SEQ ID NO: 23122 - DNA, 201 bp, Homo sapiens
attcttatataattttataacatatatagatatgtcccagatatatgtaatatattatgtagtatattatatacttacactataaattataataattaatmattacaataattaatatttattataacagattattatattatatattttaatgtaagtatataatacactacatattatgtaatatgttatatatagtta

SEQ ID NO: 23123 - DNA, 201 bp, Homo sapiens
ttcaaatcttatttttcttctccttcagataattttaatgttatactttttctgaaaataacccattaaaaacattcatagagttgtacatagatttcacrtttaaaaaaatcttagtatctgtgtctttgtcattttcaattttgtatatttgtgcttatatatttattttctttttagacttgccagagatttgtcttt

SEQ ID NO: 23124 - DNA, 201 bp, Homo sapiens
tggaaggggagtggaagagctaataactgaagccagtcactgctcaacactccagtaaatcctgagaccatagatgggtgcagggtgcaaggggtcgataygaatagtatggacgttacaggaaactttaacaaaaactttaattataaaacaagttcttaccttgaaaagaaatggaattatcccctcagtgagagtcac

SEQ ID NO: 23125 - DNA, 201 bp, Homo sapiens
tctccttcagataattttaatgttatactttttctgaaaataacccattaaaaacattcatagagttgtacatagatttcacgtttaaaaaaatcttagtrtctgtgtctttgtcattttcaattttgtatatttgtgcttatatatttattttctttttagacttgccagagatttgtcttttatatccccacccataac

SEQ ID NO: 23126 - DNA, 201 bp, Homo sapiens
ggtagaggctgcagtgagctatgattgtgccattgcaccctagcctgggtaacagagtgagaccctgtatcaaaaaaaagaaatgccaaaaacaaaaggayacacccataggatagctataataaaaagagtcagataatggtgtggacaaggatgtggagaaattggaacctttatacactcctggtggagatgtaaact

SEQ ID NO: 23127 - DNA, 201 bp, Homo sapiens
gtgacttaattctctcaatctttaccatttctgaagtatcttctgtgatagctcacaaataaatccaaacgggcagcactaggctctccttccagaggatrggagattacacacacagaaagcaagtttcatctatttcagtgcttaatagacattacattttaattaccatatagaacatcgtaatgactcagctatttc

SEQ ID NO: 23128 - DNA, 201 bp, Homo sapiens
tctcaaggggaatgaaaatatatgtccacacaaaaatttgtatgtgaatatatctacagtcatcatctataataacatatacaaatagcaaaatgcaatcwttatttttaattttaaaagtagaaacaacttaagtgtccatcaactggtaaacggataaataaaatgtggtatatctttacagtggaatattacaaggca

SEQ ID NO: 23129 - DNA, 201 bp, Homo sapiens
aaaatgtggtatatctttacagtggaatattacaaggcattaaaaaagaatgaaataatgatccatgctacaacgtggatgaactttgaaaatgttatacrgtgtgaaagaagctaatcacaaaagaccccatattgtataatcccattttgtttgaaatgtccaaaatgggcaatctacagagacagaaagtagattagt

SEQ ID NO: 23130 - DNA, 201 bp, Homo sapiens
gaggtggaaggatcccctgaacccagaaggtataagctgcagtcagtcgtgattgcatcactgcacaccagcctgggcaacagagtgagatactttcgccmaaaaaaaaaaaaaaaaaaaaaaaaaaaaaggctgggagagaccaaaatgactagagcagtcctaaagctgaattcaaaactgtttgagagctctcctggc

SEQ ID NO: 23131 - DNA, 201 bp, Homo sapiens; identical to SEQ ID NO: 3190

SEQ ID NO: 23132 - DNA, 201 bp, Homo sapiens
ggggatatctttttttttttttttttttttttgagacagtcttgcactgtcacccaggctggagtgtagtggcaccatctcagctcactgtaacctccacytcctagattcaagttattctcctgcctcagcctcccaagtatatgggattacaggggtgtaccaccacgcccggccgagttggggatatgtgagtaaaga

SEQ ID NO: 23133 - DNA, 201 bp, Homo sapiens
cttggtggatcatatggtagttctatttttaatgttttgggaaactgccatgcatttttccataatggctgcactaatttacattcccatcaaaagtgtaygaggaagagttcccttttctccacatccttgccaaaacttatctcttgtcttttgataatagccttggaagataagttcattcttaagtaaactctaatt

SEQ ID NO: 23134 - DNA, 201 bp, Homo sapiens
accgactctgagacatcccttggaaggtaaggttatgtttgtttgtttgtttaacaataaaacttcactgatttcctgcttcagtgaaggatcttaaaatygaccacgttgtgttatgaaaaccaggtgagatcctcatgcttcttaatgaccatttctacataactactctgtagttgtggcctgtaggcattaagtttt

SEQ ID NO: 23135 - DNA, 201 bp, Homo sapiens
ttgcactgtcacccaggctggagtgtagtggcaccatctcagctcactgtaacctccacctcctagattcaagttattctcctgcctcagcctcccaagtwtatgggattacaggggtgtaccaccacgcccggccgagttggggatatgtgagtaaagacctgaagaaatgcacgaggacaaactatgtggatatacagg

SEQ ID NO: 23136 - DNA, 201 bp, Homo sapiens
cagtgtgagcctcatcctaaggctggctcctctcattgctgtaggggtgctgctctcacagtgggtactcctcacccacatcagaaagagagatggcttcyatcctgtggtaagctagagttgggttgcaccatcttgcaagagtcaattttgctcatctattcctattctgcatttaatgacttgttgttaatagcttga

SEQ ID NO: 23137 - DNA, 201 bp, Homo sapiens
ttgacatctgtatatattcatgaagtcaaaaccaaaattaaaataatgcatatatccactacccacaaaactttcttcctttccgttataattccttgctkttgttcctcacccccacccacaggaaaccacaaatctactttctatctctgtagatttgtttgcatatcatctaaatggaatcatactatacgtactgaa

SEQ ID NO: 23138 - DNA, 201 bp, Homo sapiens
cttgaacttgggagatggaggctgtagtgagccgagatcacgccactgcactccagcctgggtgacggagcaagactccgtctcaaaaaaaaaaacaaaamaaaaaaaacccaccatgaacccgggaggtggagcttgcagtgagccaagatcgtgccactgcactccagcctgggcgacagagcaagactccatctcaaa

SEQ ID NO: 23139 - DNA, 201 bp, Homo sapiens
tgtccggagtagacaaatccatagaggcggaaagtagtttagtaattatgtagggcaggagaccatatacaggaaggatgagactggagtgattgttaatrggcataacattttcctatgggcaatgaaaatgtagaattgggaagaatgtcagatgccaaaaatgttgtgggagagtaagtcggcaacaccaatctaggg

SEQ ID NO: 23140 - DNA, 201 bp, Homo sapiens
tctctagcttaaaaaatctgtgagatatagttgtagctattttaatgactttatctactaattcagacatttggattgtttcctgctatggttttatagaytgatttttcctctctttctgagttatactttcccacgtcttttcatgtctgggtaatattcagtgggataccagacattttcaattttatgtttttggct

SEQ ID NO: 23141 - DNA, 201 bp, Homo sapiens
aagaataaacttaaaaattcaatggcataaaaaatatatgtatatgtctctaggtacctcttggtggcctgattgaagttgtcagctcacgttactgttaraagtacaaatgtaataaggaagttgaattataacttgaataattggataaatcactgatcaaacaactctcagtttagcaataatgagggtattgctcca

SEQ ID NO: 23142 - DNA, 201 bp, Homo sapiens
tccctataataatcaacatccttactcagatcagcctggctttgttatagcattcccaggaacataaaaacaaaatatatgcagtgagcaataaaaatttkaaaacattcttttgttataaataaactgttaggaaatataatagtgggaccgtgttcttctcttcattctaatatgtgaaaagtctgttaacattacatg

SEQ ID NO: 23143 - DNA, 201 bp, Homo sapiens
attttgtcctatatgacctctgtgaatatatcagggactgggcctttggaagcatttcaactttgggaaatgtctgactatgcaaatactctatagtttcrcctgacttagaagctatggacaggccaagcctgacctactaagtaatgtgcctgtaacaaaaatcaccctgcacgtttgctatctatccattggatttac

SEQ ID NO: 23144 - DNA, 201 bp, Homo sapiens
cttccttccatcaggagaaaggatgctttcttagagggagtcagcatagattttcagagagtcaggctctcagctccaggaaaagtacccagggaggcaaytggagaaggcaaaaggcacaggaaaagaacagacgcgtcatgaaaagataaatgtgaagaccaggaatagtgtagtatccctgaagtcaaggggcagggg

SEQ ID NO: 23145 - DNA, 201 bp, Homo sapiens
aggaaggaagagcagcaggaacagggctgtggacaggagtcctcctgggatgaaggaagtgcagctagcagtgaggtgtgggcagcctgggaaggaggcasaggccagagcagctggggcttgcagactgtgggagggagctggaattttactttaggtgcaatggggatctgccgaagcattttagacagagcaggagca

SEQ ID NO: 23146 - DNA, 201 bp, Homo sapiens
actagtagagtatctgttgtcttctgagttttcagggtccccttcattataaatctggggtcccctgcttctcatgtggtcttgctggggaaagaaaagtycaggttgtgtgactccagagtggagaggcgtgagatgtgctggcagctgaatagaccctggacttgctgagtttggtgcaaagcatatatgctgagatga

SEQ ID NO: 23147 - DNA, 201 bp, Homo sapiens
atagcagcatcttcaggagcatccctggtctctactccactctacagtgtgacagcaaaaatgccttcagatagtgctaggtgttcttggggaggcaacayggtccccagtttacagtcactgagttaaaggaaccgttatctaaagaaaggaaattctgaattgtttcaaggtggaaagtgtctactgtgaagtcctacc

SEQ ID NO: 23148 - DNA, 201 bp, Homo sapiens
tcttctgagttttcagggtccccttcattataaatctggggtcccctgcttctcatgtggtcttgctggggaaagaaaagtccaggttgtgtgactccagwgtggagaggcgtgagatgtgctggcagctgaatagaccctggacttgctgagtttggtgcaaagcatatatgctgagatgagctcccaaggtggacaaga

SEQ ID NO: 23149 - DNA, 201 bp, Homo sapiens
atctgagcttgccatgcatggatggtgtgtgttgtacatttagggctcagatctagaaggctttccagaaaaacaaaaagttgagtttctctggttttccrgaaacatgatgattagtaaattttatttcacttatttccattcatatcactggtagattttacatcatgcagagtttaaacaatgaggataatctagttt

SEQ ID NO: 23150 - DNA, 201 bp, Homo sapiens
ggccatatcaagacaccttgaaaatatattttgcctgttaaccctgttatgtttaaaaggtacatgaggctgggcacggtggctcacacctgtaatcccarcattttgggaggccgaggtgggtggatcacctgatgtcaggagttcgagaccagccttgctaacatggtgaaaccctgtctctaccaaaaaatgcaatac

SEQ ID NO: 23151 - DNA, 201 bp, Homo sapiens
aaaaatgcaatacttagcttacgtgctggcacgcatctgtagtcccagctacttgagaggcagaggtgggaagatcgcttgaacctgggaggcagatgttkcagtgagccgagatcgcaccactgcactccgcctgggcacaagaccctgtctcaaaacaaaacgaaacaaaacaaaacaaaaaggtgcataaaaatgcag

SEQ ID NO: 23152 - DNA, 201 bp, Homo sapiens
aaacaaaacgaaacaaaacaaaacaaaaaggtgcataaaaatgcagcatcttcatataactctacttatcagaatgtaagaatataacatgcaggaacaayggtgcaggagtcgggtagacctaagtgtctatttatcttctgccaattattcattttgtggttttgggaaatgttagtctgtaaaatgggattaataata

SEQ ID NO: 23153 - DNA, 201 bp, Homo sapiens
gtccatgaaccagaatctcctctcaaatcttatgtcattttgcaatagttaagcacttagtgataaaataaagacaatcttcttagcacttgctacagggraatgcctgtagactgcaatatgaccataattcacagagattaccactattatttcataagaaattgaggcagagggagttagtacattgtctgggtaaac

SEQ ID NO: 23154 - DNA, 201 bp, Homo sapiens
aatcaattggtttcaccacatggtgaaaacccatctctactaaaaaaagaaataaaaaattagccgggtgtggtggcacgcacctgtagtcccagctactygggaggctgaagcaggagaattgcttgaacctgggaggcggaggttgcagtgagctgagatcatgccactgcagtccagcctgggtgacagagtgagact

SEQ ID NO: 23155 - DNA, 201 bp, Homo sapiens
gactccatctcaaaaaaaacaaaaacaaaaataaaaaagattcttaaacattgttgggaggtgttgggacaggtggcaaagtaaacttttagtaatgaagyctcctggatcaaatgctcaaatatgtgtatgaactgttttaaagttccataatcctcaagagtctaattaaattctctatacaaatattctatgtaaaga

SEQ ID NO: 23156 - DNA, 201 bp, Homo sapiens
tttaaagttccataatcctcaagagtctaattaaattctctatacaaatattctatgtaaagatgggaggacaaagaggaaagaaaacaatatgagaaggraagtagagagagatgcggggaatataaatgtctatgggggggatggataattcaatttctctttaattttaatcatttattgttattttcctatgacttt

SEQ ID NO: 23157 - DNA, 201 bp, Homo sapiens
aatatgcatttctcaatttgacctaatgaagttaaacttttcagcatttattcctttcattgtatttttcctattacttaatttctcattattactatgcyctttgcaaatgaagtataggaaacaaatcccttttgcaggcacagtctttgaggtaagatgtgaaccagagatgctcccagccccaagagcctgtgcatg

SEQ ID NO: 23158 - DNA, 201 bp, Homo sapiens
gtaagatgtgaaccagagatgctcccagccccaagagcctgtgcatgggattgatgaaggagtcatatttcgttaggctcatgtttccctaggatgtgttsttttttagagactctgagctttccttttgcatcattgtattaaaggacccaaataacatccagcatagacccatagtaggcatatggtgaccatgcttcc

SEQ ID NO: 23159 - DNA, 201 bp, Homo sapiens
gtaggcatatggtgaccatgcttccaagcatttctccgctttgggattaccccagcagcatggtacaattcactgagctccctccagaaagaactggtagsttttcctatgttgggacatgcaccctgtgacacactctggcatcctgagaaccccagatgcttatcttttaaagtccccactccctaaaataaataaaag

SEQ ID NO: 23160 - DNA, 201 bp, Homo sapiens
tcaatcaatacttttctcccaggtaggaacctctgcaggagcagttcattatccagctcaagtgcaagcacatgcgaaatggaatccctggcagttacaayaggctatggtgtgtgattgacgtattcactggacttcattcaggtggttaacatccagtgaccaaaattggtttcttaagaaattatagggtgcacacaa

SEQ ID NO: 23161 - DNA, 201 bp, Homo sapiens
ttcgagagatgacttctggctttaatcatctatgaacataattttaatttggtgcatgaataaactggctgtatcttagataacatataatacaggcaggkcctcctgaaaatgtggaaatctttgtaatgatatgcaaagtaagacatacctttgtaaaacaattctattaccatcctagcttgtaaggcaatattttgt

SEQ ID NO: 23162 - DNA, 201 bp, Homo sapiens
gcagttaaaataattgggcagggaggatattagattttaattctaaaagttttcagaaagataagatacacgtaaaataaaaatgagtcaggaaaagagayagaagcaaactggacaggaaaggaaactataaagaaagagagaagaaaaagcaagcaataaaagtgaaggggagacgatgttttcatagaaactcaaaag

SEQ ID NO: 23163 - DNA, 201 bp, Homo sapiens
tatcacaaggcatttggcaacctgagaagccctggatggccagataactacgacaatgacaaggattgcaccgttactctcacagccccccagaaccacascatttccctcttttttcattcacttggcatcgagaactcagttgaatgcagaaacgatttcttggaggtgatatgcatttgaatatcgtttgaatgaatt

SEQ ID NO: 23164 - DNA, 201 bp, Homo sapiens
agaattgcttgaacctgggaggcggaggttgcggtgagagaaaatcgcaccactgcactccagcctgggcaacaagagcgaaactccatgaaaaaaaaaaraaaaagaaaagaaaaaccagggattgttaaagagaataggatttggaaagagggaacttgggttcatattttatcttggccatgtctgaagttaagtgtc

SEQ ID NO: 23165 - DNA, 201 bp, Homo sapiens
ctccctctgtgctctttctgccccatcgctgcattgggcatatgagatggaacatgaacatcatcgctcataggcaggagatagtctgaataagcctcatstgatgtggacccagtgtgtggaactcagcccctgtgttttgccagaaaaaccccagagctcacggggtttgagctttgcaagctctgtcgaaaatgcatt

SEQ ID NO: 23166 - DNA, 201 bp, Homo sapiens
gcttgaacctgggaggcggaggttgcggtgagagaaaatcgcaccactgcactccagcctgggcaacaagagcgaaactccatgaaaaaaaaaagaaaaaraaaagaaaaaccagggattgttaaagagaataggatttggaaagagggaacttgggttcatattttatcttggccatgtctgaagttaagtgtcttttag

SEQ ID NO: 23167 - DNA, 201 bp, Homo sapiens
gtctgaataagcctcatgtgatgtggacccagtgtgtggaactcagcccctgtgttttgccagaaaaaccccagagctcacggggtttgagctttgcaagytctgtcgaaaatgcattcatccttaggaaatatacttaggtggaacctaaaaacaaagagcataaagatgctgagttcctctgtgagtggagtttaaatc

SEQ ID NO: 23168 - DNA, 201 bp, Homo sapiens
attcctttgtaaagcatttgcattcattctttgcaaggttacttcaagaaatatatgcaggttcaccataaattctataaagtttctttatgtggtacttygttactaggctaacattcctagaaaaacgttcaaatatgtgaaatatataattggatactttttttttcaattttaggacaccagcatagctcccttcgt

SEQ ID NO: 23169 - DNA, 201 bp, Homo sapiens
cactaccgaagttatcaggatctcccacgtgcatccttctagaagttgttttttttttgagacggagtctcactctgtcgcccaggctggagtccggtggygcgatctcggctcactgcaagctccgactcccgggttcacgccattctcttgcctcagcctcccgagtagctgggactgcaggcgcccgccaccatgccc

SEQ ID NO: 23170 - DNA, 201 bp, Homo sapiens
ctttataggaaacatggtgctgacatctgcttggcttctggggcagcctcaggaagcttataatcatggaggaaggcgaaggggaaacaggcatgtcacayggtgaaagcaggagcaagacagcgagagtatgggacaggtgccacacacttttaagtggccagctctcatgtgaactcagagcaagagctcacttatcac

SEQ ID NO: 23171 - DNA, 201 bp, Homo sapiens
cttgcttgatttcctgagccagtcctgaggcaaaaaccttaatattcttatctggtgaaacatacattgagccaacttcccagatctagtggccaagggayaagtttcctgattccaaattgtgtcaccatgaagtttcactgctagcaatcaggaccctggacaggctaaccatcatcctagcaaattaatcaaacctga

SEQ ID NO: 23172 - DNA, 201 bp, Homo sapiens
tggcaactgagcaagactccatctaaaaaaaaaaaaaatggagcagtaatacacagcctccatcctctttcacagaacccacagcagtagtctttatatcrccaaagcaccaatgtttttgatgcatgaattgttaatagatgcatagctgaataaatgaatttttgtcatctctgctcctgcaatgctcagtgctttggt

SEQ ID NO: 23173 - DNA, 201 bp, Homo sapiens
ctatgactttatcttagtgagccgttccaaaggcaactttggaatgctcagaaatgtcatatattaatgaatcagcttttatgtaaatatatactgatgtygtaaattgcatggaacatatttataccaaaaaatattcatttattggaaactcacatttatttgggcatgctgtatttttatttgctaagtctggcctcc

SEQ ID NO: 23174 - DNA, 201 bp, Homo sapiens
tttctggccacactcattgctctcctcttccttagaaactgccaaaaagctgccaccccagcaattggttctggggcccaccacaggcaagccgaatcctrtgcctggaggttggttcttgatgcctttcaaacagtcaaatgctaatttcccacaatgtcgttcatacattgtcatccatgaacattactaagctccttg

SEQ ID NO: 23175 - DNA, 201 bp, Homo sapiens
ttttgttttcagtttaatcgtctcctgttgggtagtgaatttcaaaaatatgaaatatctttgtatcttatgaccactttgtattgccgtaaaatgatctyattcaaccttcagattttatttccaagttctaatatctgaaggactgaactgttttctttcagatcttgaaaataagaaaccaagtgtgttttcttttat

SEQ ID NO: 23176 - DNA, 201 bp, Homo sapiens
cactcattgctctcctcttccttagaaactgccaaaaagctgccaccccagcaattggttctggggcccaccacaggcaagccgaatcctgtgcctggagkttggttcttgatgcctttcaaacagtcaaatgctaatttcccacaatgtcgttcatacattgtcatccatgaacattactaagctccttgtacctcactg

SEQ ID NO: 23177 - DNA, 201 bp, Homo sapiens
aaaattgagtaggtgcattttttttcctgacatttttattgatcttaggcatttggcagaatatctgcacttttgttctcagtaggtccagcgccaggcasctcccttatctaataaatggctaatataatttgtcttcagtaggatgactaacagctggatacccagtgcttaaaaatcaattgaaacaatacggcttta

SEQ ID NO: 23178 - DNA, 201 bp, Homo sapiens
gccgaatcctgtgcctggaggttggttcttgatgcctttcaaacagtcaaatgctaatttcccacaatgtcgttcatacattgtcatccatgaacattackaagctccttgtacctcactgtgtcttgttaaaatagctcttttcctttgtagaatggcatgggagggaggcctggccacgcaggcacgccctgttccttg

SEQ ID NO: 23179 - DNA, 201 bp, Homo sapiens
agacacactttgctgaacctcagccatgagttacatttggatgtgatggggaaacttccttgagcgatcacttttaaatgatagattttatgaagttaatwtccaaagtgacctagtttgttaaaaatctgaccactttgagcttaatgattcatccttttgttttagattcgagatggtcctttgtatcaggaccccctt

SEQ ID NO: 23180 - DNA, 201 bp, Homo sapiens
ttcaaaggcttttcttgctgattttcatgattgtctttattcacgctgttgtcatcctgccagcccaagtacagctgcgtctgtgatgctgggtggatgtyttcacccaacagccctgcctgcacgctggacagagacgagtgcagcttccagcccgggccttgctccacacttgtgcagtgtttcaacactcaaggctct

SEQ ID NO: 23181 - DNA, 201 bp, Homo sapiens
tgattgaacttgtgtgttcctaaggcacagggagtgcctttgaaaactcagctcaagtttatagtgcatccccacccagggaggctgagatttcaatctcyaataatcatagaacccaaggagccgggggtcaaaatgagccagagcaagggcctgtaattgcttaaaatattttttaaagtcttttttcctacatcccat

SEQ ID NO: 23182 - DNA, 201 bp, Homo sapiens
cctaagggtcaccacatatgtgaaagcaagaatgtaagtgtgtaagtccatggtgagagcagaactagggtgataggccagacccactctccaagggctcrtacctcttaaccagcctccatacctcatgccatagtacagacctttagattcttggcaaatatcaaacttgcaaacattaaatttgtgaatcccaaggaa

SEQ ID NO: 23183 - DNA, 201 bp, Homo sapiens
cgaattactacccaagaagttcagggagtactaagggataaactgaaaccttgtatgtttaaataacatggaactacagtactttgggcttctataataaytgacctctaagaacatcagagtcactgtaatataaaaatattaactttcttagtgtcagcactttctaagtctaccagtagttttatacatatttttttc

SEQ ID NO: 23184 - DNA, 201 bp, Homo sapiens
ggcttcagtttgagacactgattttcggggtttgtggaacatggaagagatgatgtctacgatacagttgtctatacaagcctagggcttaggggagaggrctggggcacagttgtagatattaggcaatgaacagatgctttggagatcttaaaacagaagccacgtccattaaacttgatacattcctggcggcagcaa

SEQ ID NO: 23185 - DNA, 201 bp, Homo sapiens
acactgattttcggggtttgtggaacatggaagagatgatgtctacgatacagttgtctatacaagcctagggcttaggggagagggctggggcacagttrtagatattaggcaatgaacagatgctttggagatcttaaaacagaagccacgtccattaaacttgatacattcctggcggcagcaagaggctagattaac

SEQ ID NO: 23186 - DNA, 201 bp, Homo sapiens
tgtcagttttcccaaagaattttatgggaattacattgaaactataattaactttggaagaaatgacatcttaaaaatattcagcctgccaatgcatgaamataaactatttttaaatttagttctcttttcatttatcctggcaatgttttatagctttcagtgtctaagtattccatatctttgttagatttatttaca

SEQ ID NO: 23187 - DNA, 201 bp, Homo sapiens
aagaggctagattaactggcgttagtagccatctggcttgggtactgcagtgctgttatatgaatagtgccctttcatgtctgtatgtaatcacttatgcrtccgagtgatgaaacactaaagaacttttaatatagattttatttttaaaccttacatgctcctcatattaaatttgtagaatacagaaaagaagaaata

SEQ ID NO: 23188 - DNA, 201 bp, Homo sapiens
acatacaaatatatacacgcactcatgtacacacaaacatgcatagttaagataatattatatataattttgtatcttgcctttttcacttcatattattygaaattttcttaaatagtttctttggctagtcaatgaaatggacgtgctgtaattcagttagccacggtttattattaaccatttggattattaatgggt

SEQ ID NO: 23189 - DNA, 201 bp, Homo sapiens
tttgtatcttgcctttttcacttcatattattcgaaattttcttaaatagtttctttggctagtcaatgaaatggacgtgctgtaattcagttagccacgstttattattaaccatttggattattaatgggttttttcttttcttgttataacaatgctatgaggagtatctttatatgtgaatcttagtacatttccta

SEQ ID NO: 23190 - DNA, 201 bp, Homo sapiens
actgcaaagagcagtacagcatgtgacttgaatacagcactggacagcctcattcttcggaagcctttgttcttcattccacacccgcagacttaccccaraacttaccagcttaagacaacaacatttacagtttccgtgggtcaggaagccaggtgccactcacctgcgtgcttcctggctcactcatgtgaatgtaca

SEQ ID NO: 23191 - DNA, 201 bp, Homo sapiens
aagttgttttttttttgagacggagtctcactctgtcgcccaggctggagtccggtggtgcgatctcggctcactgcaagctccgactcccgggttcacgycattctcttgcctcagcctcccgagtagctgggactgcaggcgcccgccaccatgcccaggtaattttttgtatttttagtagagacgggtttcaccgtg

SEQ ID NO: 23192 - DNA, 201 bp, Homo sapiens
tgtacatatttacccctttaacaatagaacattatattacttaatgttacataatttcatattgtatattaaaatctggaagtataaaacctctagattgrtacttatttttcaaaattgtttgggctatcctagattttttgtgtctccatattcattttagaatcagcttttcaatatataaaaaaacttgagaatttg

SEQ ID NO: 23193 - DNA, 201 bp, Homo sapiens
ctcctacctacccatatttctggacaacccccaccccaccccttggttctcttttcttttttgcctccatagctttctaattccctacttcatttcttacrcagcaatttagctcccactttgtctcactttgatactagaggctaacatctatcacatgcttactacatgccagccactctcctaagtattgtatctttt

SEQ ID NO: 23194 - DNA, 201 bp, Homo sapiens
ttttatcctggataggtgttgaatttttctgcatcttttggtatctttcaaagcttttctttttttattctgtttaggtggtaaattatgttgatttagtyttctactgtcaaaccaatcttgtgtaatacatcagaactccacctggttctgatctattataacttttacgtgtattcagaattgttatgctaaaatttt

SEQ ID NO: 23195 - DNA, 201 bp, Homo sapiens
gaaaatacaaaaaaattagccgggcgcggtggtgggcgcctgtagtcctagctactcaggaggctgaggcaggagaatggcgtgaacccgggaggcggagsttgcagtgagtcgagatcgcgccactgcactccagcctgggccacagagcgagactccgtctcaaaaaaaaaaaaaaaaaaaaaaagggattgcttttcc

SEQ ID NO: 23196 - DNA, 201 bp, Homo sapiens
tcaggctggtcttgaactcccgacttcaggtgatctgcccacctcagcttcccaaagtctgggattacaggcgtgaaccaccacacgaagcctgagaatawtgatttgatattataagtgttaaaaacactcaaatgaaagaatttatatttcaaaatctgttaaaaatattctccctccttgatagcctgaggtttcaaa

SEQ ID NO: 23197 - DNA, 201 bp, Homo sapiens
cctccgcctcctggtttcaagtgattctcctgcctcagcctcccaagtagctgggattacaggcgctcgccaccatgcctggttaatttttgtatttttgrtagagacggggtttcaccatattggtcaccctggtcttgaactcctgaccacgtaatctgcccaccttggcctcccaaagtgctaggattacaggagtga

SEQ ID NO: 23198 - DNA, 201 bp, Homo sapiens
ttatttcagtgatttcagctttcttatatttactgttcatatggtatatcttttttcattcttttagttacaacttagtttcaccattatatataatggcrtcattatatataatgtgcatgcatagtaaaaagcatataattgggtcctgctttttctgtgttttagttgaagtatttagaccatttacaactaatgtaa

SEQ ID NO: 23199 - DNA, 201 bp, Homo sapiens
acatgtccaagtgtagttttcttttatttctcctgtttagtattgactgaactcctatatcttactagacatttttcataaaatttaggagaattttagcygctatttccttctccttttttggcccatttttattaccttcttcttctggttctctaattgtatgtgtgttaacctatttgttgttttttctttgttttt

SEQ ID NO: 23200 - DNA, 201 bp, Homo sapiens
gttttcttttatttctcctgtttagtattgactgaactcctatatcttactagacatttttcataaaatttaggagaattttagccgctatttccttctcyttttttggcccatttttattaccttcttcttctggttctctaattgtatgtgtgttaacctatttgttgttttttctttgtttttttaaatatctgtcca

SEQ ID NO: 23201 - DNA, 201 bp, Homo sapiens
cttgatttgattcatattttctcattttttgttttgtttttttaagacggactctcactctgtcgccaggctggagtgcagtggcatgatctcggctcacygcaagctccacctcccaggttcaagcgatcctcctgccttagcctcctgagtagctgggactacaggcgcccaccaccacacccagctaattttttgtat

SEQ ID NO: 23202 - DNA, 201 bp, Homo sapiens
acatatgaatttaggggaacacaaacattccaaccatggtatacataccaactcatagaggtatgttatatattctctctctctttatctgtctatctatmtatatatatatgtatgtatacaatctaaatgtattttttcagttttcagcctggatcctggagctcaccataatgaaatttacatctgcatgtttatttt

SEQ ID NO: 23203 - DNA, 201 bp, Homo sapiens
cctgggaggcagaggttgcagtgagtggagatcacagcactgcactccagcctgggtgacagagtgaaactctatctcaaaaaaaaaaaaaaggcattcaytgggaaaatggacaatctatggagaaataaaacacatgcacaaagttacaggtgcatcccatttcaatggatgccagctaacctgaacattggtaatgct

SEQ ID NO: 23204 - DNA, 201 bp, Homo sapiens
tcaaaaaaaaaaaaaaggcattcattgggaaaatggacaatctatggagaaataaaacacatgcacaaagttacaggtgcatcccatttcaatggatgccrgctaacctgaacattggtaatgctttggggcataaggcagagaacaataggtgctgagagaggagagatatgcaaaggccaggcatggagggctctgtat

SEQ ID NO: 23205 - DNA, 201 bp, Homo sapiens
gtgctgcgtgggaatttttcagcctatgtttggaagtcattgtgttatttctgccatactcaatgggttaacttagtcacaagctgacccaaattcaaggygaggggacataggcccacttctaaatgggagaggtgtcagaatttataaagaattaaaaaaaaacccacaccttttgttcctagttaccaagaattttaa

SEQ ID NO: 23206 - DNA, 201 bp, Homo sapiens
taccattcttttagttttatgattcctaaatattaccagactaaatacacattttaatttagattaagctgggtttcaaattaggataactaaagtgagtsaaattaagtgaagcaactaaaaacaaacaaaacaataaaaaacctcattacaaaaactactaacttttttcttgtaaaacataaatattatacctgaagt

SEQ ID NO: 23207 - DNA, 201 bp, Homo sapiens
gaggtggcatcttattgtggttttgatttgcatttccatgatgattagtgatgttgagcattttctcatatatttgttgaccatttatatgttttctattsagaaatgtctatttggatcctttgcccatttttaagattgggttagtttgttttgttgatattgagttgagttttttatatatttcagttgtgcttttgt

SEQ ID NO: 23208 - DNA, 201 bp, Homo sapiens
gagttttttatatatttcagttgtgcttttgtggtcatatccaaaaaaatcactactcagactaatgtcatagggcttttcctgtatgttttcctggattrgttcttcagttttaggccttatgtttaagtctttaattttgagttgactttgtatgtggtgtgggataagggttcagtttcatttttctgcaaatggata

SEQ ID NO: 23209 - DNA, 201 bp, Homo sapiens
ccctaagacattaaaacagttgtgggggttccttggaatcatcggcttttgctgactgtggatccccagatacaaggagatagccaggcccctctatactstaatcaaggagacccagagggcaaatactcatctagtagaatgggaaccaggggcagaaacagccttcaaaaccttaaagcagaccctagtaaaagctcc

SEQ ID NO: 23210 - DNA, 201 bp, Homo sapiens
actgggtgtgtcatcgtctctagacctttcagtggacagaattagaaaaaacttttttgttgttttttaaagaaaaaataccctatatattcatagtgatyttacactatattggaatattgagattatagagttgctttttttttttttttttactttacatttctacctcttctctcatacagtaaaaatcctggttcc

SEQ ID NO: 23211 - DNA, 201 bp, Homo sapiens
cacatttgggttggttccaagtctttgccattgtgaatagtgctgcagtaaacatacgtgtgcatctgtctttatagtagaatgatttataatcctttggktatatacccagtaatgggattgctgagtcaaatggtatttctggttctagatccttgaggaattgccacattgtcttccacaatggttgaactaatttac

SEQ ID NO: 23212 - DNA, 201 bp, Homo sapiens
cttatttccttgagcagtggtttataattctccttgaagagatccttcacatcccttgtaagttgtattcctaggtattttattctctttgtagcaattgygaatggcagttcactcatgatttggctttctgtttggctattactggtgtataggaatgcttgtgatttttgcacattgattttgtgtcctgagactttg

SEQ ID NO: 23213 - DNA, 201 bp, Homo sapiens
gaactgggttaggttcctggaataaagtaatcattattactgagaggagaggtatcagccgaagctccttctgcctacccattagtaaaagattaaaatayggaggaggagaaaaggctcttatattcaaatgccgtttgtacgtaggtgcatcaaaaagtgttgctcttcatttgtagactgacaagataatggagaaga

SEQ ID NO: 23214 - DNA, 201 bp, Homo sapiens
ctttagattcttggcaaatatcaaacttgcaaacattaaatttgtgaatcccaaggaattactgtgtgttctatggtgactttctgcccaagattttaggyagtctaaataaattgcctgttgtatatttttaaactataacaaaaatctatggcacaaaatagtgtaacagatgttagcatatgcaactactagagatag

SEQ ID NO: 23215 - DNA, 201 bp, Homo sapiens
ctcttatattcaaatgccgtttgtacgtaggtgcatcaaaaagtgttgctcttcatttgtagactgacaagataatggagaagattgagttcccaggttgycctgtattttttatcaccataaatctcagccccttgcagcagtgtgaaaaagacaatacgcatttccaagtccattagagagggatagagtcaatgcaat

SEQ ID NO: 23216 - DNA, 201 bp, Homo sapiens
atcaaacttgcaaacattaaatttgtgaatcccaaggaattactgtgtgttctatggtgactttctgcccaagattttaggtagtctaaataaattgcctrttgtatatttttaaactataacaaaaatctatggcacaaaatagtgtaacagatgttagcatatgcaactactagagatagccacatttgcagaatgctt

SEQ ID NO: 23217 - DNA, 201 bp, Homo sapiens
ataatgatttgatattataagtgttaaaaacactcaaatgaaagaatttatatttcaaaatctgttaaaaatattctccctccttgatagcctgaggtttyaaaatttcataaaatgacaattaggtacataaaacttaataactataatgctacggtttgaatgtgtcccctccaagttcatgtgctggaagcttaatac

SEQ ID NO: 23218 - DNA, 201 bp, Homo sapiens
tttgtgaatcccaaggaattactgtgtgttctatggtgactttctgcccaagattttaggtagtctaaataaattgcctgttgtatatttttaaactatarcaaaaatctatggcacaaaatagtgtaacagatgttagcatatgcaactactagagatagccacatttgcagaatgcttactgtgtactaggcacttttc

SEQ ID NO: 23219 - DNA, 201 bp, Homo sapiens
tatttcactgtggctttgatttggatttcactggtgattagtgatgttgagcattttttcatttacctgttggtcatttgtatgtcttctcttgaagacaraaagacttatcaatggatgaatggatttttaaaatgtgatatatataaacaatgggatggtacttagcaatagaaatgaacacaatcctgtcatttgtgg

SEQ ID NO: 23220 - DNA, 201 bp, Homo sapiens
aaagacttatcaatggatgaatggatttttaaaatgtgatatatataaacaatgggatggtacttagcaatagaaatgaacacaatcctgtcatttgtggyatcatggatgagcctgaaggactttatgttcatggaaataagccaggcacagaaagataaatattgcatgatgtcactcatttgtggagtgtaaaaatgc

SEQ ID NO: 23221 - DNA, 201 bp, Homo sapiens
ccatgatttgataattacacaatgtatatgtgtattgaaacatcacactatccctcatacatgtgttcaattattatgcatcacttaaaaccaaaataaaraataaatataaactgtatatattcataaaattgaatcttaaacttttataaaaatgaaaaaatgctattctaaacaaataaatgaataaattatcttgag

SEQ ID NO: 23222 - DNA, 201 bp, Homo sapiens
gtatctataaccttaggacagcataaaaccaagtatagagataataaagacttgaattaaaccaatggtggtgatatttgagagtagactcaagtatgaaygtagtaagaggttttgtagtgatggtttaaatgtcattttgtctactgtttacagtgttcaacgtgttcaaaggaaggattcatactagattggaaatta

SEQ ID NO: 23223 - DNA, 201 bp, Homo sapiens
aaccaagtatagagataataaagacttgaattaaaccaatggtggtgatatttgagagtagactcaagtatgaatgtagtaagaggttttgtagtgatggwttaaatgtcattttgtctactgtttacagtgttcaacgtgttcaaaggaaggattcatactagattggaaattataatttgaattggttagaaaaatgga

SEQ ID NO: 23224 - DNA, 201 bp, Homo sapiens
ctcccaggttcaagcgatcctcctgccttagcctcctgagtagctgggactacaggcgcccaccaccacacccagctaattttttgtatttttagtagagrtggtgtttcaccatgttggccaggatggtcttgatctcttgacctcatgatccacctgccttgacctcctaaagtgctgggattacaggtgtgagccact

SEQ ID NO: 23225 - DNA, 201 bp, Homo sapiens
gattggaaattataatttgaattggttagaaaaatggaatttagtttttaatcaatctttgttgaatgaaaatcagtcatcaggtttcatttattggagakatatatatatatatttaaattttgaacattaaataataaaaaagaaaagatttgctgctccagaacagacccacatttgttttaaacttattattgtaag

SEQ ID NO: 23226 - DNA, 201 bp, Homo sapiens
caggttcaagcgatcctcctgccttagcctcctgagtagctgggactacaggcgcccaccaccacacccagctaattttttgtatttttagtagagatggkgtttcaccatgttggccaggatggtcttgatctcttgacctcatgatccacctgccttgacctcctaaagtgctgggattacaggtgtgagccactgcac

SEQ ID NO: 23227 - DNA, 201 bp, Homo sapiens
gaatgcccattcctttgagagctacacacagatagtagaacctataatatgttctatgcatctctatgttttcaataccaatgattcttcttttctgagcwtggggattatatagcagcaactagggaaacagcataactaaacatccttattattattattattattttgactcacaatgaaacacaatagtttattgta

SEQ ID NO: 23228 - DNA, 201 bp, Homo sapiens
tatatatatttaaattttgaacattaaataataaaaaagaaaagatttgctgctccagaacagacccacatttgttttaaacttattattgtaagagcttyagctcctcagaaagttaaaaatcctattgatatttgattcatgggcttgtataagccaaactgagaatatcctgccaatcatacctgtggctaaagagaa

SEQ ID NO: 23229 - DNA, 201 bp, Homo sapiens
ttcttatgaaatataaatggcaatttgtttttaatgaaatggccatattttaccttcatactttcagtcacattctaatggttggcaggttgatgcatgcrtcctgctcagttgataccttgcagtgaacaagaggaaagggtttcaattctggactctggaatctagtggtctgattcaacgtgacctgctccctcttag

SEQ ID NO: 23230 - DNA, 201 bp, Homo sapiens
aaaacaaaaacaaaagcattcaaaccagattttctttgtaaaatatttcagatttggagggcataggagattgagtgggtggtaataaacacagaatcgastgaataggtaacgttaaaactgttaaactagaaaagtttttaaagaagatatttatttaggacttcaaaattgtccaggtactatgctaaatgttttata

SEQ ID NO: 23231 - DNA, 201 bp, Homo sapiens
ttggcaggttgatgcatgcgtcctgctcagttgataccttgcagtgaacaagaggaaagggtttcaattctggactctggaatctagtggtctgattcaaygtgacctgctccctcttaggaattgtgtgacttgggcccattacttaggctctctgtgcctctgttgtcctgttcttaaaaacagaaagaaatttgggag

SEQ ID NO: 23232 - DNA, 201 bp, Homo sapiens
ttttatttgggattttaaatctggaatcttatgtattataaatgttattctataatataaagtaaggtattaaaataataaatcataattggaccctatcrtgctaaaatgacataattttcttaatttacagcagttactcactggactttgatgttgaataaatcccttttttgttgtttgtttcaaaaagctacagat

SEQ ID NO: 23233 - DNA, 201 bp, Homo sapiens
agttttgaatattaagttttaatatatagctttgttcttcagaaatgtatcactagtacataaaaaggtctcctaagttctatcagagatacatctgtttkactatgtaatcatttatctaattttattactgctgtgctaatctatttctggttataatcagattgtttaagggtttcttttttttcttttcatttctga

SEQ ID NO: 23234 - DNA, 201 bp, Homo sapiens
cctgaaagtgtaaatgagtgcacataagaggcaaaatcagagcaaactagtgagattatctgtaaaatttgccatgggaaattggagatttacaaatagtrtaaggtctgagtgctgagagtggcccatgtggtttactggaatgtattttcctgggccctgtgttgcccctagtcatcgaggcacgtgatgcctatctgc

SEQ ID NO: 23235 - DNA, 201 bp, Homo sapiens
attctttaaaaatcctttatggacaaaactgtgacctaaagattttcaaacagaatgggtttaagtattctccctgctccaacaaagcaatattttgaagmgccacaaatgtacacttttttaaaccaaagttataaatggtgttctacccaccttcagaaagcatatcgtagtaggaatacatctatgaatcacactttc

SEQ ID NO: 23236 - DNA, 201 bp, Homo sapiens
tctgtaatttcacattttcctttcttctttaaatcctttctactctgtctattcgcttggtacttcctgatgactaactagagggagaacggagcctttaytgtgaatttcatgcagacttttgaatgttcaacaaagccatgttgttactggtttttagcattcccataggattttgggtttttaaactgttgaatttaa

SEQ ID NO: 23237 - DNA, 201 bp, Homo sapiens
tgtgtgtgtctctgtgtgtgtatatatacacacacatatatacacatcatatatgtgtgtgtgtacatacacagatgatttttatttattttttttaaagraaaatctcatcttggagcacttatgaagtatataatagtggttcttaacagtcatttctttttccagcatgtgagaatgtggtaatagtcaatcaaacct

SEQ ID NO: 23238 - DNA, 201 bp, Homo sapiens
aaacacacacacaatgagaaaggtgtaatagttgactggaagcagagcaggcaacattgcccccgcccatctccaccttttaaaaattcactttacctacrttctccagaatgtttccccaaaagcaaaggctgcaggatcacagcacaaactacggtataaaaaagctgcctggtgttttaattgctgtaggttaacagg

SEQ ID NO: 23239 - DNA, 201 bp, Homo sapiens
gaattgtgtgacttgggcccattacttaggctctctgtgcctctgttgtcctgttcttaaaaacagaaagaaatttgggaggataaaatgggacagtgtaygtgaagggctgaatccagttcctggcacatagtaagcactaatgaatgggagttattattaatcatccaagcaaaggaactcatttcccccctgatttac

SEQ ID NO: 23240 - DNA, 201 bp, Homo sapiens
aatctcgctctctgttgcccaggctggagtgcagtggtgggatctcagctcactgcaacctccgcctcccaggttcaagcaattctcctgcctcagcctcmtgagtagctttgactacaggtgcacaccaccacacctggctaatttgtgtattttttattagagacgggggtctcgccatgttggccaggctggtcttga

SEQ ID NO: 23241 - DNA, 201 bp, Homo sapiens
tcatcttaccagtgtggacactgaagcttagaaaggttagtggcttgcccaaagttccacagctagaaaacgtcaaagcacatatgtgattccagactacsttatggccacacttcttcaactctatcataaccaaggtatctatataagagctctcccctaaagttaattatgtaggaatttaaataaacacacacacac

SEQ ID NO: 23242 - DNA, 201 bp, Homo sapiens
aggctggagtgcagtggtgggatctcagctcactgcaacctccgcctcccaggttcaagcaattctcctgcctcagcctcctgagtagctttgactacagrtgcacaccaccacacctggctaatttgtgtattttttattagagacgggggtctcgccatgttggccaggctggtcttgaactcctgacctcaggtgatc

SEQ ID NO: 23243 - DNA, 201 bp, Homo sapiens
atcatgcagactgaaagcgtagaacatccagctactctcctgacaaagaccatttcgaaattttggatgacatttacaaacatctttctaaaagtagccartggttcatgaggtagtgtgaagtttctgagtgaatatctgagagaggtgtgagtccagtctttgggaccattttttcctgcagggcctttactgatccac

SEQ ID NO: 23244 - DNA, 201 bp, Homo sapiens
tctaaatcagccttatatcacccctatcgtttgaaaagaattctgccatttctcttctcttgagcattaccctatcacgaaacttatgaagaacaaacagrtccaacaaatgttgggattctgacaacaaatgctcatcactcatcattatttctcgtctgttttctcatgtgtctattcttgcattacacatttccagca

SEQ ID NO: 23245 - DNA, 201 bp, Homo sapiens
gaggggacaatataacaaaaatgagatgtaatatgagtaagagacaatagaaacaaatccactaatatgccagatagtaaagttacctggcacacttgctrtacaactgtgattactcaactcatggaaataaaagtcaaactgagaactttcagcaaggaactgcatactatagaaagtgacattgcaatatgaagaaga

SEQ ID NO: 23246 - DNA, 201 bp, Homo sapiens
tatatcacccctatcgtttgaaaagaattctgccatttctcttctcttgagcattaccctatcacgaaacttatgaagaacaaacaggtccaacaaatgtygggattctgacaacaaatgctcatcactcatcattatttctcgtctgttttctcatgtgtctattcttgcattacacatttccagcacatgttgtgggca

SEQ ID NO: 23247 - DNA, 201 bp, Homo sapiens
cccctggaagcagtggtttccctcatttctgaatcctgccattgtccaactgaggagtcactgttgttttccatttatttttctttctttgttccctcccytcctcccctcttcttccccttcctctcctccccttccttttcctcatctctctttccctccccttccctttctttccacagggtctctctctgtcaccca

SEQ ID NO: 23248 - DNA, 201 bp, Homo sapiens
tatggtcatgccatttctcttgtgcaacattgacggtgaaagagcaaaaatacaaaatgagaaccagaagttcagaaaggccttccaaaaaaacggcgctrttgccagagggaggagattgttttccatctctgtgagccaagaggccagaccagagcaatagctgcaatagctggtctatgatggaaattttaacacaca

SEQ ID NO: 23249 - DNA, 201 bp, Homo sapiens
atgatggaaattttaacacacaaacaaccatttacagagagaaaactcacacacacagaaatctagcttccattattttaatcgcttctgggttttttcarctgacttccccaaatcccaactggatgcctgttactagagccagaatttagttattctgaattaataaaatggaaactacaaaaagacttaattacgtgc

SEQ ID NO: 23250 - DNA, 201 bp, Homo sapiens
aggagtcactgttgttttccatttatttttctttctttgttccctcccttcctcccctcttcttccccttcctctcctccccttccttttcctcatctctstttccctccccttccctttctttccacagggtctctctctgtcacccaggctggagtgcagtggtgcaatcacggctcactgaagcctcgacctcccagg

SEQ ID NO: 23251 - DNA, 201 bp, Homo sapiens
tgattctcctgtcttagcctcccaccatacctggccatttttgttcttaaatcaccacttctccaagacctttttacccattgcctttcatctgctcgttytaagagatgaaccccttatcccatagtcagagatgacttgtattcagatgactcagaacattcactacaaatacatttagtctgtgtagtcattatgtct

SEQ ID NO: 23252 - DNA, 201 bp, Homo sapiens
gctgggcacggtggctcaggcctataatctcagctactcaggaggctgaggcaggagaatcactagaacccgggaggcggagtttgcagtgagctgggatygcaccattgcattccagcctgggtgacgaagtgagaccctgtctaaaaaaaaaaaaaaaggtgactgtgtcatgggagccaagggaagagcagtcgagag

SEQ ID NO: 23253 - DNA, 201 bp, Homo sapiens
cagatgactcagaacattcactacaaatacatttagtctgtgtagtcattatgtctatcttagtcaactcgcttatattctgtagtaaagagctctggatkgggacagtgcctggatcgaggtctcccaaatacgcaccatagacctttagactttggagcaagacagactatattcttgttgattttaaagaaaaactag

SEQ ID NO: 23254 - DNA, 201 bp, Homo sapiens
gagagcaggaaccagacagtgtaaagaggtacaaagaggagagtgagtgtagactgaagtctaggtccctgaattctgaggctctctgtaacaaaccagartaagtgatggcttcttttctccaatccttatccttcatttccctaactggtcctcatctagttcacgtgtgtgggacacactcctttgcatgttctcttg

SEQ ID NO: 23255 - DNA, 201 bp, Homo sapiens
aattccatgtctcttcttccagtttcaaaatcaaactaggcatgtttctacctcctcttcattgacatcacactctcttctgaaagcatccatgccatccdtgtttccctctttcatttgccctagtcacagccttaaaattagacattttttctaatgttcaacaatatttttctgtgccatttcccaaagtttagctag

SEQ ID NO: 23256 - DNA, 201 bp, Homo sapiens
agtccagagttgcacttctcttcactgtctcctttatatgaagagagcatataaagaattcaacaaatgctacattttttgggggaacaagacatctcatrggtgtccagattgttgaaacagtctccccgtcgccactcctgtagatctcttttggtacattagtgtttatagatttcctttacaaaagattgcagtctc

SEQ ID NO: 23257 - DNA, 201 bp, Homo sapiens
tctgccacaaatgttggtagatgtttcacaaatagagacctatattctaataaatctgcgatatgccaaattaaaacacaattaagcagggtttgttgttktgttttgcgtttgctgtggtatttcctcaggctgtcactatcctaaatatgcattcttcattcctttatccatgtatccagtcagtaggatatattttag

SEQ ID NO: 23258 - DNA, 201 bp, Homo sapiens
gtatgctcacaggagaacagggattgagatggggaaccatactcagtgcaggaagtgtcatcactacatgaagtgatgaaactacgttcacactcagtgcygcacgaatacagtgtgggctctggagtccacctggctccaaagctctttaccagctgtgatcttgggcaaggaatttaacgtctggctgctttggttctc

SEQ ID NO: 23259 - DNA, 201 bp, Homo sapiens
acacaatgagaaaggtgtaatagttgactggaagcagagcaggcaacattgcccccgcccatctccaccttttaaaaattcactttacctacattctccaraatgtttccccaaaagcaaaggctgcaggatcacagcacaaactacggtataaaaaagctgcctggtgttttaattgctgtaggttaacaggtatttctg

SEQ ID NO: 23260 - DNA, 201 bp, Homo sapiens
ttttaagatggaatctcgctcttgtcacccaggctggagtgcagtggtgcgcgcaatctcaactcactgcaacctccgcctcctgggttcaagcaattctyctgcctcagcctcctgagtagctgggattacaggtgcctgccaccacactcagctaatttttgtacttttagtagaaacagggttttgccatgttgacca

SEQ ID NO: 23261 - DNA, 201 bp, Homo sapiens
tgggaggctgaggcgggcggatcacgaggtcaggagatggagaccatcctggctaacacggtgaaaccttgtctctactgaaaatacaaaaaaattagccrggcgcggtggtgggcgcctgtagtcctagctactcaggaggctgaggcaggagaatggcgtgaacccgggaggcggaggttgcagtgagtcgagatcgcg

SEQ ID NO: 23262 - DNA, 201 bp, Homo sapiens
aagcatttcctaatctgatagggaagtcatttctacagttgcttctaaatttaaaaacaatttcttttttttcatgtcaaggcctagcaaaggttaaaaamcacacacacgcacaacaacacaacacacctacaaccttgctgtattaacaggcgtatgcaggcgtatgagattgggggtaaaccaaaataatcgataaat

SEQ ID NO: 23263 - DNA, 201 bp, Homo sapiens
agagaaacagtgaactggaagataagtcaagaatctactcagaaaaaagtatggataaaaaaaggatgaaaaatatataagagaggttaagacacatagarcacactcagaaaatatataacacacagttaattggagtctcacaaggaaaagagagatatatggaacagaagcaaactttgaagagctactgactaaaat

SEQ ID NO: 23264 - DNA, 201 bp, Homo sapiens
tattttctgacctggtaacagtccgatggtaaggacttctgtcctcattttacagacagagaacatcaggaaatgcccctcaaggacatgacagaatggcygcaaagcgggtgatgctggggcccttctgaatcctgtttcagaggagccctgccctcctttgaggtttgcaggaaaatacagtttcaggcataatgtagg

SEQ ID NO: 23265 - DNA, 201 bp, Homo sapiens
caagaatctactcagaaaaaagtatggataaaaaaaggatgaaaaatatataagagaggttaagacacatagaacacactcagaaaatatataacacacasttaattggagtctcacaaggaaaagagagatatatggaacagaagcaaactttgaagagctactgactaaaatttttccaaaactggtggaagtcatcat

SEQ ID NO: 23266 - DNA, 201 bp, Homo sapiens
agtgcctggaatgaacctacccaggagtcctcttatttaccactgccagtgtttcagatgccacaggcagtttcaaaagcatctattccgttactcttcawaggaaaccatctattctattactcttcaaaggaaaccatctaggatagaagttgtccccttcccttgctttatcccttcaaccatgtgcaaatccgcctc

SEQ ID NO: 23267 - DNA, 201 bp, Homo sapiens
gaggactagaagaagagacagcgcggaatactaggagcagaaatgcacttagaagtcagagtcagacatgcatgcccgtgttcatcgcggcactgtccacratagcaaaggcatggaatcaacctagatgcccatcaatggtggatgggatgaagaaaacgtgctacgtatacaccagggaatgtgacacagccacaagaa

SEQ ID NO: 23268 - DNA, 201 bp, Homo sapiens
ccttcaaccatgtgcaaatccgcctcattcattacttctctgctggagaacccttacatgaaattaccagaagtaaaatttatctccctgtatgttttttwattttaattttattttgtaaaaaaattttattgttaatttttgtgggtacatagtagatgtatatatgtatggggtacatgagatgttttgatacaggca

SEQ ID NO: 23269 - DNA, 201 bp, Homo sapiens
gaaagagcagcctaagccaaataaagatgattagagggtaagaaagcaggcttgaatgtggggttcagggaactcagcctgtttattaatatattcaaacrtgtgaatagtttgtgtatatgttttaaaacatttaaaaattgcagctgctttaaagaatagtggaatgcaacccatcccagcattaggtagcattctatc

SEQ ID NO: 23270 - DNA, 201 bp, Homo sapiens
aacaaatctataaatgttcactgttattatttgcactgatgctgatgtaagagaaacatctcagtaaggtatagagaaattcacaaatagagagccttcawttctttaggttgagatataattaatgattcatttctcaagacatttaattttcctcttgttttctgcctgcagcctgcatggttaatgcattttgacact

SEQ ID NO: 23271 - DNA, 201 bp, Homo sapiens
ttaaaacatttaaaaattgcagctgctttaaagaatagtggaatgcaacccatcccagcattaggtagcattctatcagaaatttcttgttaatatttgaycaagttcttacattcacatggagtatgtttctttcagccttgtccttagtggaagcgaaaaaaaaagcacttaattagataattaattaattaattccat

SEQ ID NO: 23272 - DNA, 201 bp, Homo sapiens
aaatttcttgttaatatttgaccaagttcttacattcacatggagtatgtttctttcagccttgtccttagtggaagcgaaaaaaaaagcacttaattagrtaattaattaattaattccattaaaaatctgtctttttgtttgttagacatcccaataaaattaaagagtgccgctatctagtttctgaaatgctctcag

SEQ ID NO: 23273 - DNA, 201 bp, Homo sapiens
tgaggtggaaggatcccctgaacccagaaggtataagctgcagtcagtcgtgattgcatcactgcacaccagcctgggcaacagagtgagatactttcgcmaaaaaaaaaaaaaaaaaaaaaaaaaaaaaaggctgggagagaccaaaatgactagagcagtcctaaagctgaattcaaaactgtttgagagctctcctgg

SEQ ID NO: 23274 - DNA, 201 bp, Homo sapiens
tgcagcctgcatggttaatgcattttgacacttctcactaaggataaatgacaaatgataaaaccaacaatttttgtccacttattttactcaaagctccrttaagaaaaataatgaaaaaaattttaatttcagtgactaacaggagtgttcgtattgtccctatcattttaaaaattgttttggttactctctattatt

SEQ ID NO: 23275 - DNA, 201 bp, Homo sapiens
gcatccacacttttctgtgctacaaaatagtggatattagtgcatttatttgtatgggtccgactgggctggagatttttgctttaggtacatgtgtcccytggtcatctaagtttttcctctggtcctattgttcttgatcatgtttataaatcacctctcctatatatagctcctatatatagtttattttaaatcatc

SEQ ID NO: 23276 - DNA, 201 bp, Homo sapiens
gccctgagcttggtttcctgcattagacagtaccactggggggtgatgggaaacaatgacagattatcaggcattcgattctcataaggagcacgcaaccyagatccctcgcgtgtgcagttcacaatagggttcatgctcctatgagagtttgatgccaccagtactggtctggggactggggctcttgctctgtagcat

SEQ ID NO: 23277 - DNA, 201 bp, Homo sapiens
tatctttttttttggaattagacacattaaggttcttccagggaatcactagtattgtttattccagcagagccctcccatctcaattaagcattctttaygcttttatcttatccctacctcaatccacctttccttctatttctgtcagaagaatggttctggggctgggtgtagtggctcatgcctgtaatcccgcac

SEQ ID NO: 23278 - DNA, 201 bp, Homo sapiens
gcaacctagatccctcgcgtgtgcagttcacaatagggttcatgctcctatgagagtttgatgccaccagtactggtctggggactggggctcttgctctrtagcattttgtggtaaataaatctgtggtttccagagcagccttcccagttgtaattaacatcaattggccccactgtgttgaaagcagtgctgcttctc

SEQ ID NO: 23279 - DNA, 201 bp, Homo sapiens
gccctcccatctcaattaagcattctttacgcttttatcttatccctacctcaatccacctttccttctatttctgtcagaagaatggttctggggctggrtgtagtggctcatgcctgtaatcccgcactttgggaggccaaggcgggtggatcacttgagatcaagagttcgagaccagcccggccaacatgacgaaac

SEQ ID NO: 23280 - DNA, 201 bp, Homo sapiens
cttcccagttgtaattaacatcaattggccccactgtgttgaaagcagtgctgcttctcctgcctcccagttttcctacaaaagccactgggattgtagayaaaatcctgttttccagttggcgagatgcagagaagcagatgagattttgtctgagcagcggtggatctgagccgactttgattatggctccaccgccaa

SEQ ID NO: 23281 - DNA, 201 bp, Homo sapiens
agatgctttgtagtgtcgttgagtttagcatgaggcattttagaagaaattttggttttaagattgcctgagtaaaatgtgattttttagttataaaaaawtgaaagaagaaatgttatttcagtgtgatcagaatccctttccttaaaaagaaatgctgatcttttctgaccatctttcacaatgaaggattttcgtatg

SEQ ID NO: 23282 - DNA, 201 bp, Homo sapiens
acttcggcctcccaaagtgctgggattacaggcgtgaaccatcgcacccggcaggctctttatttaatagactttcttttcctgatctcactgtcttcagsgagagcccggatggcagtcctctggcttcttccagctcaaaggtctatgatttcacgttgttctatgaaccaggttcttctctgttcctgagaccatctg

SEQ ID NO: 23283 - DNA, 201 bp, Homo sapiens
cagcaggtggtgagaattttaagaggcataataataataataataataataataataataataaatgtttagtgttttactgtagcaggataattggcagrgggaaggctgaggtttatggaattaaattttcatgtatacacaggagagtatgcttagctttcaaagcatttcacttaccactagggagggatttaggag

SEQ ID NO: 23284 - DNA, 201 bp, Homo sapiens
gatattgctttaaaaataaatttatcagatcacaaaggaatttatagtcattataggaaattgggaaaatgtagaaaaagctagattaaaaaatcctaaaktatatcattattactaatatttggtggtattgatttcctgtcatcgctccttgtatatttattttattttaatattcgaaggagattattcagtacatac

SEQ ID NO: 23285 - DNA, 201 bp, Homo sapiens
cctctgtgattcttgctttgcaatttctactgttgttacaggaacatttcaaagcccttcaaatttaaagtaacctgaacttggataaagttccaagtttytccaggagatgtgagtgcaaacctcagcaacaacatttttaacaatcaccctaatgaggcctctccacagatcctgctgtggtggttgtttggggtgggg

SEQ ID NO: 23286 - DNA, 201 bp, Homo sapiens
gatctacgagattctagaatgaatctttccccatcttggaagctggaacgttttcccttcagccccctggcagccctgctggttctccttgtctgggctcrcactcttggtggtggcaccgaaacacaatctgagccacatgaagaggacaggcgcatgtgacaggctggttactttgagaaggctcacacctccccacac

SEQ ID NO: 23287 - DNA, 201 bp, Homo sapiens
agtagtaggatcctatcacattctgagtggtcttagattaaattagacagcaacaataatatgtcctagagtagatgtaaaaagcacacattttaatcaaytgatagagaggtatatgtgacacgtcacactgataatggatgcttattatatattgagagataagatcctggaatttaaattgccgttttgaattgaaat

SEQ ID NO: 23288 - DNA, 201 bp, Homo sapiens
agatgtaaaaagcacacattttaatcaactgatagagaggtatatgtgacacgtcacactgataatggatgcttattatatattgagagataagatcctgraatttaaattgccgttttgaattgaaatttatttaccagtctattttacatattactaggctgtggttgggattgctaattctgttttgaagcgaatata

SEQ ID NO: 23289 - DNA, 201 bp, Homo sapiens
gggtgtggtggtgtgtgcttgtaatcccagcgacttgggaggctgaggcatgagaatcgcttgaacccaggaggtggaggttgcagtgagccaagattgcrccactgcactccagcctggcaacacagcgagactccttctcaaaaaaaaaaaaaaaaaaaaaaaaaagaaggtctttaagagaagtttgaatgggccaga

SEQ ID NO: 23290 - DNA, 201 bp, Homo sapiens
tatgggacaactatcctatttgtggaccaagttcaaacatctcaagttgctttttttaatccatcaatcagacagagcctcttcagggtataagtggcctygtgttaaaacaaagacaccctctgcatgccgaaaggcaatgcaagtttaagctgcctcacaggaaggaggttttggtttgtctttttttttttttttttt

SEQ ID NO: 23291 - DNA, 201 bp, Homo sapiens
tagtaacattaattcaccttggtgataatgaggaatttagaaattctcaatttaaaaattctacacgcagtaaactgtaaactcagtgtttctcagatccrgtaattcttgacaagcattggagggtgcagcagcgcttagctcgtgaggtggaaacaccaaagggacaaatgcctttgcttgttgtcctctagagatggc

SEQ ID NO: 23292 - DNA, 201 bp, Homo sapiens
gcctcagcctcctgagtagctaggattacaggcacatgccaccatcccaggctagtttttatatttttagtagtgatggagtttcaccatgttggccaagytggtctcgaactcccaacttcaagtaattcacccaccttggcctcccaaagtgctgggattacaggcatgagccaccgtgcctggcctggtttgtctttg

SEQ ID NO: 23293 - DNA, 201 bp, Homo sapiens
tgggagagaccaaaatgactagagcagtcctaaagctgaattcaaaactgtttgagagctctcctggctttacagaaaggtaataaggtttagagacggasagtatggggactctaacccaattttgctgtcagacaaatttcctaatctccccgattcctcatcatttcgtcaatttttctttaaatcacataatagtac

SEQ ID NO: 23294 - DNA, 201 bp, Homo sapiens
accacacagctagtgcatagcaaatgtttggtgacttaattctctcaatctttaccatttctgaagtatcttctgtgatagctcacaaataaatccaaacrggcagcactaggctctccttccagaggatgggagattacacacacagaaagcaagtttcatctatttcagtgcttaatagacattacattttaattacca

SEQ ID NO: 23295 - DNA, 201 bp, Homo sapiens
aatgctaatgtgcatgttgatcatctaggatcttgctgaaattcactttctcactgagttggttggtggggccagattccttgtttcaaacaagctctccrgtgatgccgatgttgctggattatgcactttgcatagaaagattttagaggcaacttcgtgtaatttacgttctgaggaaaatgatctccctttcttccc

SEQ ID NO: 23296 - DNA, 201 bp, Homo sapiens
acagaaagatacacatgacagagaagtacatttttcctttcctttccccttccccttccccttgccttccgttcccctcccttcccttcccttcctttccyttccccttccccttcccccttcccttccttttcccttcccttcccttccttttcccttcccttcccttccctttttcctttaccctttcccctttcctgt

SEQ ID NO: 23297 - DNA, 201 bp, Homo sapiens
agatacacatgacagagaagtacatttttcctttcctttccccttccccttccccttgccttccgttcccctcccttcccttcccttcctttcccttcccyttccccttcccccttcccttccttttcccttcccttcccttccttttcccttcccttcccttccctttttcctttaccctttcccctttcctgtttgttc

SEQ ID NO: 23298 - DNA, 201 bp, Homo sapiens
aactttttgaggaaccaccaaacttttttatagggatggactattttacattcccgttagtaatgcgtaagagttctaatttctccatatcctcatcagcrcttcttattttctatttttaaataatagtcttcctggtggtttgtagtgttatctctttgtggttttgatttgcatttctctaatgactaataatgtttg

SEQ ID NO: 23299 - DNA, 201 bp, Homo sapiens
atcccagcactttgaaaggccaaggtgggtggatcatttgaggtcaagagttcaagaccagcctggccaacatggtgagaccctgtctctactaaaaataygaaatgtagctgggtgtactggtgcatgcctgtaatcccagctactttggaggctgagacatgagaattgcttgaacctgggagacagaggctacagtga

SEQ ID NO: 23300 - DNA, 201 bp, Homo sapiens
ctagaccccaagagagggttcttggacctttcacaagaaagaatatggggtgagtccatacagtaaagtgaaagcaagtttattaagaaagtgaaggaatraagaatggctactccataggcagagcggcccattgttcaaatttatttgtgaaagaaatggattgtttgttctgtagatcatcccacatcttggattttg

SEQ ID NO: 23301 - DNA, 201 bp, Homo sapiens
catggtcaccatgcctggctaattttgtatttttagtagagacagggtttcaccgtgttggtcaggctggtcctgaactcctgacctcaggtgatcccccygcctcagcctcccaaagtgctgttattacaggcatgagccaccgcacccagccataatttggaatactttggacaactcacaagcctctctgattatttc

SEQ ID NO: 23302 - DNA, 201 bp, Homo sapiens
acctgagatctctcatctacacctctctaaaaagtgtggtgataatgcctggctgttttgcaaagttgaggaagacaaaatgagacattcaatgtgaaaaytacattagagttgtaaaggaccatgactttgccagatataaaatatgattctcaatatccaaggacaattttacaatagctactttgcttatttctatat

SEQ ID NO: 23303 - DNA, 201 bp, Homo sapiens
gctaccatgaacattgacttgcaggttttttgtggacgtattcattctcttgcgtaaaatacctaggagtagaacttctgggtctcatatggtaatgataygtttaactttataagaaagtgccaaattgttttccaaagtggttatgccattttatattcccacctatatgattgacaattctgaaataggagttggggc

SEQ ID NO: 23304 - DNA, 201 bp, Homo sapiens
gaacttctgggtctcatatggtaatgatatgtttaactttataagaaagtgccaaattgttttccaaagtggttatgccattttatattcccacctatatrattgacaattctgaaataggagttggggctccacaccagaccagatggaagactggctaaaacagggaagagacagaagcacctctgcataagacatgcc

SEQ ID NO: 23305 - DNA, 201 bp, Homo sapiens
accttcctgggtggagtcccaatatgggggcttgcctgccttgcagcagttcttttctccatctttcccaatccttaatattgccaatcttttcatttttrgccactggcagttgcatagcagtatctgatggttttattttgcatttccctgatgactaatagtgctgagtccttttcacatgctttttgacaattcatt

SEQ ID NO: 23306 - DNA, 201 bp, Homo sapiens
tttctccatatcctcatcagcacttcttattttctatttttaaataatagtcttcctggtggtttgtagtgttatctctttgtggttttgatttgcatttytctaatgactaataatgtttgaaaatcttttcatgtttttattggccattcataaatcttctttggagaaatgtgtattcggtttgttttccattttaat

SEQ ID NO: 23307 - DNA, 201 bp, Homo sapiens
catcatttattctcataaattacttggttgaagtcagccatctgagggttggcaggaagagtttgttgctcttgaaatatgaatttgatgagtcaaaagcrggcaccatatatgggataccatcatgcacagtatgattgagacttttcaaacttgacatgtgaagtccagtaacagccttaaatccaaactaactgaaag

SEQ ID NO: 23308 - DNA, 201 bp, Homo sapiens
ttttccattttaattgggttatttgtttttaattttcgagttgcaggagttattttatattcaggatactaccttggtcatgtgtttttattttctttggktatatatttaggggtggaatttctgggcattaattggatgtacatttaattttatgagaaactcccaaataattattcaaagtggctatgtcagtatgca

SEQ ID NO: 23309 - DNA, 201 bp, Homo sapiens
ttttaattgggttatttgtttttaattttcgagttgcaggagttattttatattcaggatactaccttggtcatgtgtttttattttctttgggtatatayttaggggtggaatttctgggcattaattggatgtacatttaattttatgagaaactcccaaataattattcaaagtggctatgtcagtatgcagtcccac

SEQ ID NO: 23310 - DNA, 201 bp, Homo sapiens
atattcaggatactaccttggtcatgtgtttttattttctttgggtatatatttaggggtggaatttctgggcattaattggatgtacatttaattttatragaaactcccaaataattattcaaagtggctatgtcagtatgcagtcccacgaggaatatataagacttcagttgctttgcacgcttgtcaacaattgat

SEQ ID NO: 23311 - DNA, 201 bp, Homo sapiens
gcctttatatttacatccttgagaaatattaagttagtttctgtgtacgaagataggcagaggtagaggttctttttttcctctctctccataaggatatycgttattgcatcaccatttgttaaaatgagttttccccttgatttgtcttggcaccatggattgaattggattgacagtgtatttgtgggtccccttctg

SEQ ID NO: 23312 - DNA, 201 bp, Homo sapiens
ttccattcatccatttgtctacccttacaccaataccactttatcttgagtagctcatgtttttaagcagtaaggccaagttttgaaagtactcaactagsacctacatgttccagactctttagatatgttacctatgaacatcatatgaggtagatactatttcctatcctcgactccccaacacatcgtagttgcaga

SEQ ID NO: 23313 - DNA, 201 bp, Homo sapiens
accccaccttattcatcttggattcttggtcatgaatagatcccagtgcctgatgggtgcccaatatgtatgggaatgactattacataatttgtttggtrgagtattttataataactgttcatatgaatttgtcctgagctatttaaaaattatcacagaatatgcctcaaaataggtaatttgagattttaaaaccaa

SEQ ID NO: 23314 - DNA, 201 bp, Homo sapiens
agtgaaagtgatattgagctagcattgtttggggagacttttttcttgaaaaatttttaaatgagaccgggtgcggtggctgatgcctgtaatcccagcayttttggaggcagaggtagacggatcacttgtggtcgggagttcgagactagcctggccaacatggcaaaaccccatctctactaaaaatacaaaaattag

SEQ ID NO: 23315 - DNA, 201 bp, Homo sapiens
ctggatcaaatggtatttctagttctagatccctaaggaatcaccacactgacttccacaatggttgaactagtttacagttccaccaacagtgtcaaagygttcctatttctccacatcctctccagcacctgttgtttcctgactttttaacaatcaccattctaactggtgtgagatggtatctcattgtggttttga

SEQ ID NO: 23316 - DNA, 201 bp, Homo sapiens
aggctctggatggctggctccccttacatcagtgctgagtcctcatccaaagcactggggccaagtcgtacaaaagtgtgctgccttcaggtctctggtgkggcatcttcgctccaaaggaggtgtgtccagggaatgcatgagagagagctttaaagcaatttttcagcctagctgagggctggaactagatagagcaca

SEQ ID NO: 23317 - DNA, 201 bp, Homo sapiens
ttgcataccttttggtgaatgatattgtaacattagtgtaggatctgaggtcaaagagccaactgtttttttttttcttttacctacttgaccttcagcartcagagtaactgaggtcagagtctctaatcgacagacatatcatcactgggtctccatcgcttcccaatcccaggtactctgattttgagttttagtgac

SEQ ID NO: 23318 - DNA, 201 bp, Homo sapiens
aatttaaaatttggttgcttttggaagagaaagcaagagattcctggaagccagaacgtcatgtttcacaaatgtaaaagtcctagttgggaaagacacaycgctttagtggtgttttcaaatgacttttaaaatagtagggttttacttgtaggttctagctacaagtaaaaaggctaaaagccagccttagaaacctgt

SEQ ID NO: 23319 - DNA, 201 bp, Homo sapiens
cctcatatacaaaatggggataaaaataaatgcccacctaatagtgtcactgtgaagataaaatcagatagtacatgtgaagcacttaaaggggtatatastaattgctcaataaatgtcagtcttgaataatcttggggcctcagtgtctatatctgtaaattgaagaggttggactagagaaagaattgccaagttgcc

SEQ ID NO: 23320 - DNA, 201 bp, Homo sapiens
cttgcatacagcaaagtggcttgtaactcctgtaagattcagttcctcatatacaaaatggggataaaaataaatgcccacctaatagtgtcactgtgaasataaaatcagatagtacatgtgaagcacttaaaggggtatatagtaattgctcaataaatgtcagtcttgaataatcttggggcctcagtgtctatatct

SEQ ID NO: 23321 - DNA, 201 bp, Homo sapiens
tttttgtatttttagtagaggtggggtttcactgtgttaaccaggatggtcttgatctcctgacctcgtgatctgcccaccttggcctcccaaagtgctgkgattacaggtgtgagccaccacacctggcctatgactaaattttaaatcccacttcaattatttgttctttgcccagccagccttttgcttctgagtagc

SEQ ID NO: 23322 - DNA, 201 bp, Homo sapiens
attcctttttatgcactggcaatgtgagtagatgctcaataaggttccttccttcctcatttgtttaattatttattcaagaaatagttattgagtgcctrgtctgtgtcagttggtgagtattgtagtcatttacacattgttaatatatttttatgactaaatttgatgtttttttttttttgagacggagtctcactc

SEQ ID NO: 23323 - DNA, 201 bp, Homo sapiens
tttttgttccatcactaacttctcttggaagcagagagtctggggagcagtccttttttcctgtgtggctttgcacaggtcacaaagtggctccaaacccsttctacctgtgagatagacaaatacctccctcacaggctttttctgaggattaaggaaagtaataaatgaaatctttttagcaaaagtacaagcattttg

SEQ ID NO: 23324 - DNA, 201 bp, Homo sapiens
tctctgaaatatattgctacataaaagtgatggcaaaaataattgttaaaatcaactttttgagaactctggaaatagaccaaagccttatagcaatctgyggcatatttattcaagaaaaatcactgaatctaagtaagagtcatttttgtggcattctcttcctattcccatctctctctctcctcctagctttgtagt

SEQ ID NO: 23325 - DNA, 201 bp, Homo sapiens
tgctcatagttcattggccaaaactggtcaaatggcctctctcagccacttgcagaatgcagttctaccatgtgtttggaagtggagacaaaggaaatatytggcaaacagcactaatgacccacagtcattataaccatattttacaaattcaagataagaaatatttcacatagaggaaaaccttaaaatttgaagata

SEQ ID NO: 23326 - DNA, 201 bp, Homo sapiens
aaccaggaggcagagtagagtttgtagtgagccgagaacatgccactgcgctccagcctgggcgacagagtgagactccgtttcgaaaagaaaagaaaagsaatttatttaaatgaatttgagcgtttcttatggatttcaggattgacatagaagaaattaatcagatatttcttggaggatattctaagtccttgaatg

SEQ ID NO: 23327 - DNA, 201 bp, Homo sapiens
ccatggtagaatcttggagatggacatagaagaaatacaaaactgctattatgacaaattaagggtgagtttccacatgcaatcaatgttcataaatattrgtgaattgctattggtaaaaataaatccaaggtaacgtctattcaagcatttgcaaatcatgtgggatagtctgctctaaatcatgtttagagcagactg

SEQ ID NO: 23328 - DNA, 201 bp, Homo sapiens
tttgcttctaacttcttatatcagcagaagtcactaatgaagataatttgtacttatatttatttaatgtcccttagtattccattctgaaatgttgttcytacctctctaataaggtgctttcatgacactgaatacaaatctcttacttaaaatattgatctgtctatctaagagcaaagaaccatcagcaagactgac

SEQ ID NO: 23329 - DNA, 201 bp, Homo sapiens
attttgaaatatgtcaacttattgagcattgtcctatcagtatttctttctttttttttttctttttttttttttttttgagatggagtctcgctctgtcrcccaggctggagtgcagtggcacaatctcggctctctgcaagctccgcctcccgagttcataccattctcctgcctcagcctcccaagtagctaggacta

SEQ ID NO: 23330 - DNA, 201 bp, Homo sapiens
atccctgatccctagacccctgccgagtgagaaaaatcgaatggtgaaggtgctttatgtcccttctgtagaggcagaacactaagtagagactcaaatcratcatacacacatgatgagatgtcaaagcatgacactccccctttttcccatcagcaatcggctatcagcacgttgcacagaggagtatcaaagcaccag

SEQ ID NO: 23331 - DNA, 201 bp, Homo sapiens
tggggtttcactgtgttaaccaggatggtcttgatctcctgacctcgtgatctgcccaccttggcctcccaaagtgctgtgattacaggtgtgagccaccrcacctggcctatgactaaattttaaatcccacttcaattatttgttctttgcccagccagccttttgcttctgagtagcagaagcatgtaacattctgaa

SEQ ID NO: 23332 - DNA, 201 bp, Homo sapiens
catctgaggttaatctgcaaaggttaacatcactgttaacttctatctctatgcccttgcatacagcaaagtggcttgtaactcctgtaagattcagttcytcatatacaaaatggggataaaaataaatgcccacctaatagtgtcactgtgaagataaaatcagatagtacatgtgaagcacttaaaggggtatatagt

SEQ ID NO: 23333 - DNA, 201 bp, Homo sapiens
ctgatctagaccccaagagagggttcttggacctttcacaagaaagaatatggggtgagtccatacagtaaagtgaaagcaagtttattaagaaagtgaargaataaagaatggctactccataggcagagcggcccattgttcaaatttatttgtgaaagaaatggattgtttgttctgtagatcatcccacatcttgga

SEQ ID NO: 23334 - DNA, 201 bp, Homo sapiens
aggctcaagattaggctcaatctttctgcaatctatatgttgaggttttggaaggctccagaaataccccagtactcagtatgaagactgaaggggtggaygggcaagtaacaaaccatctgtgatttttgggtcatcttcccactaatgagtaggctaatcaacaagcacttattttgagataagcattgtttcaccaga

SEQ ID NO: 23335 - DNA, 201 bp, Homo sapiens
tagtacaggtaatcagagaataagtcaacaaaaaataatattgggtgaaatgtgtagcaaaatagcataatgaagtgcacttactataaatgcaaaagaaytataagagatacacttttgaattataaagaatgcaaaagtttccagcgatcagaaaccctccaaagaatgccattttgagcattttgtatttataactct

SEQ ID NO: 23336 - DNA, 201 bp, Homo sapiens
aaagaaagtttaaaaaagtgaacgggttaacctagcatgtgatccgggagaatcccaaagtctattctctcaatttaatccctttaaatatttttttcccmaaatcagatctttccagttggaagactctcaggactgcagcagagattttgtggagatccgtgaaggaaatgccacgggtcacttggtgggacgatactg

SEQ ID NO: 23337 - DNA, 201 bp, Homo sapiens
tggctgagccaggggctgaatccaggtagcctggctccagcatccacacttttctgtgctacaaaatagtggatattagtgcatttatttgtatgggtccractgggctggagatttttgctttaggtacatgtgtcccttggtcatctaagtttttcctctggtcctattgttcttgatcatgtttataaatcacctctc

SEQ ID NO: 23338 - DNA, 201 bp, Homo sapiens
cacttgcctaggatcacacaactagcaaatggctgagccaggggctgaatccaggtagcctggctccagcatccacacttttctgtgctacaaaatagtgratattagtgcatttatttgtatgggtccgactgggctggagatttttgctttaggtacatgtgtcccttggtcatctaagtttttcctctggtcctattg

SEQ ID NO: 23339 - DNA, 201 bp, Homo sapiens
agcgggtgatgctggggcccttctgaatcctgtttcagaggagccctgccctcctttgaggtttgcaggaaaatacagtttcaggcataatgtaggaaagkctttaagttcttcactctgcacagtaattaatcgcctgtgtgaaaatagggaagtcacttaagctaatcaggccatgaaaaagtaatctgcaaaatgaag

SEQ ID NO: 23340 - DNA, 201 bp, Homo sapiens
agtttttgacatgtgtgccttgagtatagctgatgttcaagacagttgctgagtgaacaaatgaagaagagtcacagactggagaatcagtgactcacggrccagaatgcaatgcgcgcacctatccatcaaagcaaacattcataaaacctgggctctcctgcaaggtactattccagcacaggcctagaagaaacattg

SEQ ID NO: 23341 - DNA, 201 bp, Homo sapiens
caccacttctccaagacctttttacccattgcctttcatctgctcgttctaagagatgaaccccttatcccatagtcagagatgacttgtattcagatgaytcagaacattcactacaaatacatttagtctgtgtagtcattatgtctatcttagtcaactcgcttatattctgtagtaaagagctctggatggggacag

SEQ ID NO: 23342 - DNA, 201 bp, Homo sapiens
atgaaacactaaagaacttttaatatagattttatttttaaaccttacatgctcctcatattaaatttgtagaatacagaaaagaagaaataagaaattawtgccatccttagtattacaatatagatacaagctattgaaattttggtttatttccctcacaaacacacacatacaaatatatacacgcactcatgtaca

SEQ ID NO: 23343 - DNA, 201 bp, Homo sapiens
cctcattgcactataacactttttgaaatggactataaatatggaattagtagtaggatcctatcacattctgagtggtcttagattaaattagacagcawcaataatatgtcctagagtagatgtaaaaagcacacattttaatcaactgatagagaggtatatgtgacacgtcacactgataatggatgcttattatat

SEQ ID NO: 23344 - DNA, 201 bp, Homo sapiens
atatcaagaaatctaatagtggctctgacagaggaagtcctgctgaaattcacgtcagcatccctagaaatgaccaaagacttgttacagctgtgagaaargacaataaagccagtttccctagatccagcaaacgtgtgattatccactagtatatcggcgtgcagacagttcgtggaatacaggccttctagatgtgaa

SEQ ID NO: 23345 - DNA, 201 bp, Homo sapiens
ctctcttcctaatataatgtttttgggcaccaggacacaagacaagtcagaggacatgggtctctgcccaggctctggatggctggctccccttacatcartgctgagtcctcatccaaagcactggggccaagtcgtacaaaagtgtgctgccttcaggtctctggtgtggcatcttcgctccaaaggaggtgtgtccag

SEQ ID NO: 23346 - DNA, 201 bp, Homo sapiens
acatacatgtatacacatgtatgtatatagtaagggtggaaccattggaattaatatgtgtgtttatatatgtatataatatatataaatatgtgtgtgtrtctatgtatatatacatacttggcagctcccggtctagaatgtatttcaaatttaacctgtgagtggtataatggactttggagactcagaagcggggag

SEQ ID NO: 23347 - DNA, 201 bp, Homo sapiens
tcatccattctgacttccatgatgtacctctaacacatcaagcctttacactgttttctgaactggaatgttttctcccccataactatctggcttgatcsttcatttcattcatgtctctgctaagatgttactccaatgacgtggcttttctaacttaactctaacaataaagtacccttctccctcctctcatccatt

SEQ ID NO: 23348 - DNA, 201 bp, Homo sapiens
agctaagaaatggtcctgatatctattctccacccttgggaccccctggaggaaatggtcatttttgtggcagtcatgcttcatcaactctgttcacctcrgataatcaaatgtttgttcagtttatttctgatcacagtaatgaagggcaaggatttaaaatcaaatatgaggcaaagagtttaggtaagtattttcact

SEQ ID NO: 23349 - DNA, 201 bp, Homo sapiens
acatttgccttattttgtaataatttgtatgctgttttcaaaagaacacataattttttgattctattattactgatttaattatatattacatgatatcygtaattgcttgtacttaattacacttgattataattgcatttaattctactgtaatgatttgattttgatgacatttgctttttagtaatgtttaattga

SEQ ID NO: 23350 - DNA, 201 bp, Homo sapiens
aaataaaaagtgtcacacctcgtagctccctcgatagcaaattgagaatttgtttgctggaaaagaaaatgaggatcataacagatgaaaggaaatggagwcaaaatacagagaagtcgactttaaaagatgatttgtggccattgactgcatccccttcaccagatcatagactgatttaagtgtgtttgctcacagcct

SEQ ID NO: 23351 - DNA, 201 bp, Homo sapiens
tatagaatgaatatgttaaaacttttttaaaaaccatgactttttaaaaataagtctatttgcctaattttaaaaatattttaatgctagaaataagtaakgagtgtaaatgtttgaaactacagtcattaatcaactttaatttctcttttaattttcattttaaaaagtaatcttagtaaacttaaatattttatattt

SEQ ID NO: 23352 - DNA, 201 bp, Homo sapiens
aacttttctaacagtatactattatgattcttctattttattattagttattgttgttaatctcttatgtctaatttatacagcaaactttatcataggtmcatatatagagaaaaaaacagtctatatgtctgtatagggtttggtactatctgaggctttaggcactcactgggggtcttggaatgtatcccccaagga

SEQ ID NO: 23353 - DNA, 201 bp, Homo sapiens
cacatagtaagcactaatgaatgggagttattattaatcatccaagcaaaggaactcatttcccccctgatttacacataagagtattcaaaaattcatcyagacactgagttccaagcaaattagtaagcttcaaattttacaaatcaatacagagatttcaggtatatgtgacatagattccatttcattacatgcctg

SEQ ID NO: 23354 - DNA, 201 bp, Homo sapiens
atcatacctgtggctaaagagaacatgcagaatcatacctgtgtgctaaacagaacactgattataatcatcaccagatttttaaagtcacttgcgagtamcttccttacattgaatctccgaactttctatttttttccccaagattttcttatgaaatataaatggcaatttgtttttaatgaaatggccatattttac

SEQ ID NO: 23355 - DNA, 201 bp, Homo sapiens
tagcaatagaaatgaacacaatcctgtcatttgtggcatcatggatgagcctgaaggactttatgttcatggaaataagccaggcacagaaagataaataytgcatgatgtcactcatttgtggagtgtaaaaatgctgatctcgcacaagtacagggtagaatagtggttaccagaggctggggacggtagcagggagga

SEQ ID NO: 23356 - DNA, 201 bp, Homo sapiens
agctcactgcaacctctgcctcctgggttgaagcaaatctcatgcctcagcctcctgagtagctgggattacaggtgcccaccaccatgcctggctaattkttttttgtatttttagtagagacatggttttgtcatgttggccaggctggtcttgagaaaaccttctatttttgatccattccttgtgaagtattacttc

SEQ ID NO: 23357 - DNA, 201 bp, Homo sapiens
gactttttaatgatcgcacataaaaagccttgatgaagaataagagaaggtaattggaagaatttaccaaccaataaagaatattaaaaaaaaaaaaaaamagaaaaagaggcccagaaatgttaagagcaaaaaatgttttgttaatcaccaaaaattgctgttggaaaacaagataatttcttttctaattgtgtctct

SEQ ID NO: 23358 - DNA, 201 bp, Homo sapiens
cttactagcctacattgaatgagacagtagtttaatagcttagcacttgcctccctgtctttatttttatagaaaatcacacaggttaggatgtttgtgayggagcttgtaaaattataacatgctcatcacatttggggtgtcattggtatataatttgaattccgggacacatgaaaaccttctttttattgagatgga

SEQ ID NO: 23359 - DNA, 201 bp, Homo sapiens
ctttaggcactcactgggggtcttggaatgtatcccccaaggaaaaggaagaaatgcagtatgtttattactttaagtaataaaaccatttaagaaccagrtaactctatttagcacagtgtctttgaattcctcatcaaatataaaataattaaccttttttttctctgagtctctagtgccaaatcagtcactggataa

SEQ ID NO: 23360 - DNA, 201 bp, Homo sapiens
ccaccctccccagccccacacatacacacaggagataaacaggacccagaggagactgagaaacctgtctgtgaggcctcctggaggcctggcctaggctmtccttgcctgcaagatgccctccgtgagcccaaggagactctttccagaggactatgtcactggggtattggattccagtcagacagacagtttgggaga

SEQ ID NO: 23361 - DNA, 201 bp, Homo sapiens
gagccgagattgcaccactgcactccattctgggcgacagagcgagactctgtctcagaaaaaaaaaaaatgtagtaaagcataagggtccaggtgagaargaggccacactagaccagagaatggcggttggaccagagaaggacaaggaggagcttcatatctgaatccaggaatagaatcaagtttatgtggcaacga

SEQ ID NO: 23362 - DNA, 201 bp, Homo sapiens
tgtggaaacaccattcctgacagcatagacacttctagcaatactgctgtggtcaggtttgtcacagacggctctgtgactgcctcaggattcagactgcratttgaatccagtatggaaggtgagttcattgattcattcaacacaacattgagcacctgcattggacagacactatgctaggcaccagtgttaaaatat

SEQ ID NO: 23363 - DNA, 201 bp, Homo sapiens
aaaaaaaaaaaatgtagtaaagcataagggtccaggtgagaaagaggccacactagaccagagaatggcggttggaccagagaaggacaaggaggagcttyatatctgaatccaggaatagaatcaagtttatgtggcaacgatagaagttgtgggtttatgtattgaccccagacactgcgctctttgttacccattctg

SEQ ID NO: 23364 - DNA, 201 bp, Homo sapiens
gaagagactatcagctatcactctgtgcatcagggtcatagaataaattttaagagtgaatgatcacgacaaatggcaaaaccggagaggctgtgggaagmtaagcctacagcagcacacagctgaatgggaccagagtcacagcacaagccaccacgaaagttctgagcaggtgggtggtcctgcataagcactgctctc

SEQ ID NO: 23365 - DNA, 201 bp, Homo sapiens
agatccctgagtgtgaataacaaatagattgttaactgtgaagtgctgtgcacacatatgtgtgtgtagataggaagattggattaatattagtaaatttmtccacccaacttgccccttctgcagtgtttgttatctcagtaaataattccaaacttctggttgcttgggtcaaaaatcttgatgtctattttggaatcc

SEQ ID NO: 23366 - DNA, 201 bp, Homo sapiens
ttctgcagtgtttgttatctcagtaaataattccaaacttctggttgcttgggtcaaaaatcttgatgtctattttggaatccttcctctcacaccctatrtggcatctataagcaagtcccattgggtgtatctttaaaaatatccacaattgaactatttctcatcatatctgctactaatacccccaccgttcacttg

SEQ ID NO: 23367 - DNA, 201 bp, Homo sapiens
aaaatatccacaattgaactatttctcatcatatctgctactaatacccccaccgttcacttggattattttagaaagttccacctcgtccccctggttcmgttctcctctccctacgttctcaacacagcagcatgtgatggttttaaacctcaatcggatcatgttgctgcctttgaaaatcctctaatggcttctcat

SEQ ID NO: 23368 - DNA, 201 bp, Homo sapiens
tgtaatcccagcactttgggaggccgaggcgggtggatcatgaggtcaggagatcgagaccatcctggctaacaaggtgaaaccccgtctctactaaaaayacaaaaaaaaatcagccgggcgcggtggcgggcgcctgtagtcccagctactcgggaggctgaggcaggagaatggcgtgaacccgggaagcggagcttg

SEQ ID NO: 23369 - DNA, 201 bp, Homo sapiens
ccttctgaactgttagaaataaatttctgctctttataaatcacctggcctcaggtattctatggtatcacaaagaagcagactgaggtgtgtcatgagcwttttaaagagaagtaacatggtaaatctagaatttggagagagaagacgctgctactcactagtgatgtgaacttggatgacttactagcctacattgaa

SEQ ID NO: 23370 - DNA, 201 bp, Homo sapiens
cgggcgcggtggtgggcgcctgtagtcctagctactcaggaggctgaggcaggagaatggcgtgaacccgggaggcggaggttgcagtgagtcgagatcgygccactgcactccagcctgggccacagagcgagactccgtctcaaaaaaaaaaaaaaaaaaaaaaagggattgcttttccctctaaaaggaatcctgcca

SEQ ID NO: 23371 - DNA, 201 bp, Homo sapiens
gcctggtaccaaaaagcaaaagcaaaagcaatatgattagtaacttctgaagctttttgtggctatctaggagaaagaaagaaaagtgtctgatgtgatcyggaaaaaaaaaaaattccctgtgctcccacccaaagctgcaatgtctgttgttgttccattattcgacaataaaatgcagggtggaacagggcagatacc

SEQ ID NO: 23372 - DNA, 201 bp, Homo sapiens
ccatcggctgggcatggccttgtctggtcagcacgcaagtggcttcattacgtttcctttcacgaaggctgagtattaaagtgacctctggctgacagttwaattgcttaattagagcctttcttctaagtcttcgattcatgtagctctgcaagctcttattgatctcctagaaaggctgcttgtagctcagtgtgagag

SEQ ID NO: 23373 - DNA, 201 bp, Homo sapiens
gctgtgggacccatcggctgggcatggccttgtctggtcagcacgcaagtggcttcattacgtttcctttcacgaaggctgagtattaaagtgacctctgrctgacagtttaattgcttaattagagcctttcttctaagtcttcgattcatgtagctctgcaagctcttattgatctcctagaaaggctgcttgtagctc

SEQ ID NO: 23374 - DNA, 201 bp, Homo sapiens
gtaattaaccttgggctctcctcaatgacacatcaggagcatttcttgctaaggaagctgtgggacccatcggctgggcatggccttgtctggtcagcacrcaagtggcttcattacgtttcctttcacgaaggctgagtattaaagtgacctctggctgacagtttaattgcttaattagagcctttcttctaagtcttc

SEQ ID NO: 23375 - DNA, 201 bp, Homo sapiens
ggcaaaatataaaatgtaataatagtccaaacaagttgtcagaatcagataatgctgtatgaagtacagttgactcttgaacaatgctgggattagggtcrttggccccctgcttccctgtcgtgcagtgaaaaatctacatacaactttcaagtcccccaaaacttaactactaatacctatgacggacagaaggcttac

SEQ ID NO: 23376 - DNA, 201 bp, Homo sapiens
atgccagcatggctaggattttccctcttgtggtcatgaggagggttttccacctacatgggacataaacacacagacaaggttttctatgaacactgccrtatttcagcatgcagctgggcttggcttaacaaagtgcagcaggaggaaacagcaggagtgaaacctcaaatgtgatcgggtcttaggcacggagatgga

SEQ ID NO: 23377 - DNA, 201 bp, Homo sapiens
gatgtgtgttttatacatataatgggtattatttgctagtgttttgtgttggatttgcatatgcaacattcagagtttgtgctggaaaacccagccctacwcttgactgcttcccttggcaatgggaggttttctagtcccttttcacgagcatgccagtttgtttagattcccaacttcttgtaaaagtctcaattccag

SEQ ID NO: 23378 - DNA, 201 bp, Homo sapiens
cagttgtaaaactggaatgtggaaaatggcctaggctcattccttctctggattgaatgggggtccctctgataacatcgggcaagcccaacgctgctgcygagtgggatgtattaggaaccctgccaaaaataagtggccgtgggaagcactcgtcttctcctaatgggcccgagatgcttgtttctgccaagaaatgct

SEQ ID NO: 23379 - DNA, 201 bp, Homo sapiens
tctttgagtatattaaaactgaactaaaaaacagtaacagaatatcttattaagcactgagctgagctggagagaactgagctgccaattgttggagcagstaattaaaacaacaggccaaaatgtaagtaacagtcctgtctttcatcattttctgctgtggtgtaagaggccaaacaggagaaagctctgtctccctca

SEQ ID NO: 23380 - DNA, 201 bp, Homo sapiens
ctaaaaaacagtaacagaatatcttattaagcactgagctgagctggagagaactgagctgccaattgttggagcagctaattaaaacaacaggccaaaakgtaagtaacagtcctgtctttcatcattttctgctgtggtgtaagaggccaaacaggagaaagctctgtctccctcaatcgtccattctttcccatggga

SEQ ID NO: 23381 - DNA, 201 bp, Homo sapiens
ctccctcaatcgtccattctttcccatgggaagtgcctggtaaggatcagatggatcagtgtagatatagaaatggtctcattgccaagtaagccccaaayaaatatgtgcaggatctgagtgctaaaaataatgaaatgctggcataaacctaaatgaaagagacaattatatttatgaattggaagactcaacatagta

SEQ ID NO: 23382 - DNA, 201 bp, Homo sapiens
gggtatgtgacctcccccaaccaccctcataattatcccccgcacgctgattgcatttggatcttagcggctccaccggaaacacgcatacagctgcaatktgaagatcgattcgatattgaagtaacacccaagtatgtcacttccattttcatttttttcctaccccaagttagtattttttaaccgtcatgtctcaaa

SEQ ID NO: 23383 - DNA, 201 bp, Homo sapiens
tgtgtgtgtgtgtgtgtgtgtgtgtgtgtgtgtgtgtgtctgctgagtctggggcttggagttcttatgggcaccagatgggcgcagggcaggccaaaagrcaacatttgggtgggaaaacagggatggttctcactttgagtggcagatccaggcttgagggtggagcactcaccagggacctcaacctcttctaccaag

SEQ ID NO: 23384 - DNA, 201 bp, Homo sapiens
agcattccatggctttgtgaaaacgtgatttcatttgcgtttccttttaattatttttaaaataaattttggcatctgtatttaaagtgtttgaagtattytcttagtatcatccatgtcatcccttcttattctgttgggataaatggcttaatgtggatatcaaattcttcagtgtttttagcatcgactaactgattc

SEQ ID NO: 23385 - DNA, 201 bp, Homo sapiens
ggtagatattaaattatttttaaatgcatgcactactagattatcacaattctggaaggaaacatattattcttccagtatgctatatttttagaggacartgaagaagcagcattccatggctttgtgaaaacgtgatttcatttgcgtttccttttaattatttttaaaataaattttggcatctgtatttaaagtgtt

SEQ ID NO: 23386 - DNA, 201 bp, Homo sapiens
taactgtactatatccgaatattaaatttttaaagggtagatattaaattatttttaaatgcatgcactactagattatcacaattctggaaggaaacatrttattcttccagtatgctatatttttagaggacaatgaagaagcagcattccatggctttgtgaaaacgtgatttcatttgcgtttccttttaattattt

SEQ ID NO: 23387 - DNA, 201 bp, Homo sapiens
agttttctattattggcttatattatcataaatccaagaaatggtgggtcatagagaagacattgaactaacaggtatttgataacatcaaaggaattttwaaaaacctaagtaactgtactatatccgaatattaaatttttaaagggtagatattaaattatttttaaatgcatgcactactagattatcacaattctg

SEQ ID NO: 23388 - DNA, 201 bp, Homo sapiens
ttatgggagggggagcatgcagattggcaggtgcaggaacccaggcaagatgctacccacagtacggtctagtggtgggtgcctgtgactctcaaagcccycatgggcaggctacagtattcttttagctctgccatccacagagggctcaagtgttaaccagctcagtgactcttggtacccgacttcctgtctggcatc

SEQ ID NO: 23389 - DNA, 201 bp, Homo sapiens
ataccacatcagtgtcttgtcacttccataatttttttggggagaggaacctcagcagtaattcttgttgttctcctgaagataatgtgtctttttctccmccctcactgcttttattgtgtgtttatatttaattttccacaacttgattatggcgtatctagatctggttttctctgtgtttgtcctgcttgagagtca

SEQ ID NO: 23390 - DNA, 201 bp, Homo sapiens
ggtcaggagatggagaccatcctggctaacacggtgaaaccttgtctctactgaaaatacaaaaaaattagccgggcgcggtggtgggcgcctgtagtccyagctactcaggaggctgaggcaggagaatggcgtgaacccgggaggcggaggttgcagtgagtcgagatcgcgccactgcactccagcctgggccacaga

SEQ ID NO: 23391 - DNA, 201 bp, Homo sapiens
gtcagttgccaaggtttagttatacaaactcgcttacaagagggagaagttatattaaagtgaagagtaaaagggtagctgctcccagaacaacttggccrggctagagtggaccatgggaatggggtggagcatgtgaggatttgggtaatttagttgtttttcttcccctaagctaaggacccaggctggctggatgca

SEQ ID NO: 23392 - DNA, 201 bp, Homo sapiens
aacatcacagaagtgcgttttctagaattgcatgctgctataatgagaaaagggaaaaactggattttttgacttctgttgaaattgtgatggcatcgagsggagctaatcaggaagctggacttgaaggcaggtttcaacacatttggtaatatatttgcactttctgctcagtcaccttcaagtgtctggtgtaattaa

SEQ ID NO: 23393 - DNA, 201 bp, Homo sapiens
tgatccagtttcaaaggcttcccactaagtgacacaattcattctttctttaggttcaagtagcaataatatgtgggttggggcggaggggcgcattgctwggcaaaagacaagttcgaaatagctgatgttatttgcaatccttaaacacaatttctgctttattactcatttataaagtgctgttctggagctgctata

SEQ ID NO: 23394 - DNA, 201 bp, Homo sapiens
gcacacaccacctttaagagctgtaacactcactgtgaaggtctgcagcttgacacctgaagtcagcaagatcacgaacgcaccagaaggaagaaactccrgacacatctgaacatttgaaggagcaaactccggacacaccatctttaagaactgtaacactcactgttcaggtccgtggcttcattcttgaagtcagcg

SEQ ID NO: 23395 - DNA, 201 bp, Homo sapiens
ttatgaattgtggtcagcaaagattctagcgcaggttcacagggctgggctgtgaatcacactgtctggttctaatctcaggcgcagaccttctctccgtwggtaatggaattgctttcacagtgtcgcttcctgctaggctgtgatagacataatgtcacacagagagaaatggtaaagcacccatccatccgcctccaa

SEQ ID NO: 23396 - DNA, 201 bp, Homo sapiens
tatttagaaggtaggatgggcagatctgatggtggagtagatgtgtgtcaatctgggagacagaagaaggaatcatggatagctcccgttttcctgcggtrtatgatttggtgcatggtggtgccattattcatagataggaaatcccagataaagaccatgtttgggggaaaattgtgagcttctatttgaacatgctga

SEQ ID NO: 23397 - DNA, 201 bp, Homo sapiens
gtgagccacatgagcacttagataacatcacagaagtgcgttttctagaattgcatgctgctataatgagaaaagggaaaaactggattttttgacttctrttgaaattgtgatggcatcgagcggagctaatcaggaagctggacttgaaggcaggtttcaacacatttggtaatatatttgcactttctgctcagtcac

SEQ ID NO: 23398 - DNA, 201 bp, Homo sapiens
gcatgaattgttaatagatgcatagctgaataaatgaatttttgtcatctctgctcctgcaatgctcagtgctttggtggaaaatctcagaggacaccatygggaatgtgctgtactgagttcactccctggcattgttattgatatacaatcttcgtgttgtgagccacatgagcacttagataacatcacagaagtgcg

SEQ ID NO: 23399 - DNA, 201 bp, Homo sapiens
caggtggaccatgaggtcaggagtttgagactggcctggcccaccccatctctactaaaaattcaaaaattagccagctgtggtggtgcgtgcctgtaatmctagctactcaggaggctgaggcaggagaatagcttgaaactgggaggcagaggttgcagtgagccaagatggcaccactgcgctccagcctgggcaata

SEQ ID NO: 23400 - DNA, 201 bp, Homo sapiens
aaatatgaaatggaaagtgtccttgctttgaagtcaggaggtcagggtttccttcattactttccccttcggtgccaaatatgtaccagacactgccaggygcttgtttctggacgtgtaccacccctcaccctcttcatggcttggggttcttagtttgcttatttagaaaatcaggtgcctggggaacagaagcagaaa

SEQ ID NO: 23401 - DNA, 201 bp, Homo sapiens
caggcagctttgacatttgaactgagttttaaagaatgggcaagaattgatcagacaaatatctgggagaggaaggcttttctaagtagaagcagcaaggygtgagggcacaaaagttttgcaaagagcaagtccttcagctagaccacacattctctgcattctccattggggcagtatcaactccaaggaggtaaaatt

SEQ ID NO: 23402 - DNA, 201 bp, Homo sapiens
gtatataatagtggttcttaacagtcatttctttttccagcatgtgagaatgtggtaatagtcaatcaaacctatggcatcttagagagtatagggtatcygaatccttattctgaaaatcagcattgcaactggaccatccgggcaacaacaggcaacactgtgaactacacatttttagcatttgacttggaacatcac

SEQ ID NO: 23403 - DNA, 201 bp, Homo sapiens
ggcttaagcagcagaagtgtgctgtctcctggaggctggaagtccaaggtcaaggtgtcggcagggttggtttctcctgaggcctctctccttggcttgcrgatgctgccttttccctgtgtcctcacatggtgttttctctgtgtgtgttcatcctgatagctctgtgtgtccaaatttgctccttataaggacaccagt

SEQ ID NO: 23404 - DNA, 201 bp, Homo sapiens
caagccttgagaagtttcagaaattagaagagaacattttaaaaaccgtgtcaacatcttttatgactggctcggtttggatgtaagccagtgccttcttractacctgtgggcatgaggcactgtaccaaagggcttttaaaaaacatctttagagcactggcagaaaaccgccatgaggtcggcagtgtttctcttaaa

SEQ ID NO: 23405 - DNA, 201 bp, Homo sapiens
taacatatcagaaggaaaataattagaaaggcttctccttgcacagccccgcaagggatgttctcagaatcaggtggagggctcaggacagccccgctaaygctggtcctggagttgctcttcgtgccctggccaggtcaagtggctttaaactcctagcctcttttcctcagaatcctatcaccttgcaatcccttcccc

SEQ ID NO: 23406 - DNA, 201 bp, Homo sapiens
acctctgaaccaaaacctaaaaaataagcaggagttaactaggcaagcaggataaggaaaaggattccaggtagaagaaagaccctgtgataggagggagyggggagagcccgagggacctgagaagtcaagaggatggaactgagtcgaagagaaacagcgctgccaaggtggctgcagagctaagcacataatgtggct

SEQ ID NO: 23407 - DNA, 201 bp, Homo sapiens
gcttcctacgaagtgaataagtattttggtaaaatataaaaattgcagttatgtacaggaaacggaatggcagactagaaaaatagagggagaaaataaayttagggtcaggctggagccactttgattttttttttttttttgagatggagtttcactcttgttgcccaggctggagtgcaaaggcgtgatctcagctca

SEQ ID NO: 23408 - DNA, 201 bp, Homo sapiens
ctgaagtaggtctttagtttgagataacctgagaaggggagcccacagagagggcgagctcttccatgggagaggtcccgccatttttgatccattggagktaaatgcaagacgtaaatcatgatgtatcattcacgcatttgttcattccacagacactaaggatgtcttttgtgccaggtactgtgctgagacggggga

SEQ ID NO: 23409 - DNA, 201 bp, Homo sapiens
gaaattaacagcaggatcagcactaaaacgaaagccttatgcttcctacgaagtgaataagtattttggtaaaatataaaaattgcagttatgtacaggawacggaatggcagactagaaaaatagagggagaaaataaacttagggtcaggctggagccactttgattttttttttttttttgagatggagtttcactct

SEQ ID NO: 23410 - DNA, 201 bp, Homo sapiens
ctacccagatgctcctgtgcacatgaaccctggggatcttgttggatagaggatggggtctggggcaaggcccgtgaatctgcatttctaacaagctcccrggtaatgctgctggtgctgctctatggaccgctctgaggaacaaggtgagagcaagtgttgagactggagaaatgagatggtagaaagacagtatcccta

SEQ ID NO: 23411 - DNA, 201 bp, Homo sapiens
tataccaggaaccaagcatagacatctaagctgtggccctgctgtcaaaatcagggctgagctctagctgagcacacatgaatgtgtgcagtggttgactmttaacattgttcacattctggtgcactcattataggaatgtcagagctacttataactgaatagccctattatacacttaggagtgctaggcgttctgag

SEQ ID NO: 23412 - DNA, 201 bp, Homo sapiens
attatttattctcattaataatctttcctaggaagattaaggaaaaaaatatggaaattctctgcaaagctccctgctgtgcactttcttgcaagaaataaagtttgtcatttggagcctgacttaggagaaatacaggaattgcataagattctgtggttattttgaagtgattattttattggaaatacttgaaaataa

SEQ ID NO: 23413 - DNA, 201 bp, Homo sapiens
tttcacatatgattaactgtcataaacctatagatacatagaatgttaaggttggaagaagaaagcttagagttcgtttgctgttgtcacctaattttttwaaaaaagacattgaggtggaggtggggcagtgcaaaaaataaaaattaattaaaaaataaaaaagatactgagatccagaaatgtcagggtcaaggctaa

SEQ ID NO: 23414 - DNA, 201 bp, Homo sapiens
gccacattttctttatccagtctatcattgatgcacatttgggttggttccaagtctttgccattgtgaatagtgctgcagtaaacatacgtgtgcatctstctttatagtagaatgatttataatcctttgggtatatacccagtaatgggattgctgagtcaaatggtatttctggttctagatccttgaggaattgcc

SEQ ID NO: 23415 - DNA, 201 bp, Homo sapiens
tgtcctgttcctgttgcttagacagagttattagcaaagagaaaaatattcagttgccagtgatgctgtcagataatgttggggttcaggagatttttaayagagttcaagtgtactctttaaataccagtgaaaattatgctggaatgggaccagccatcctgttttttcaaaacttctataacaatttgggttgttaga

SEQ ID NO: 23416 - DNA, 201 bp, Homo sapiens
gagacaaagctacttatagttttgaccatggtgggtattgctctaccccttgtttcctccctcgtctgcatggtgttcttttgtttgatacagtgcagaayccatggaatttaacatacaaagtgtgtcaccaaaccaaagcctaggtcaacagcatgccagcatggctaggattttccctcttgtggtcatgaggagggt

SEQ ID NO: 23417 - DNA, 201 bp, Homo sapiens
gaaaaaaaaaaaatgtagtaaagcataagggtccaggtgagaaagaggccacactagaccagagaatggcggttggaccagagaaggacaaggaggagctycatatctgaatccaggaatagaatcaagtttatgtggcaacgatagaagttgtgggtttatgtattgaccccagacactgcgctctttgttacccattct

SEQ ID NO: 23418 - DNA, 201 bp, Homo sapiens
ggaggccgagatggtcagatcatgaggtcaagagattgagaccatcctggccaacatggtgaaaccctgtctctactaaaaatacaacaaatagctgggcstggtggcaggtgcctgtagtcccagctacttgggaggctgaggcaggagaattgcttgaacctgggaggtggaggttgcagtcagctgagatcgcaccac

SEQ ID NO: 23419 - DNA, 201 bp, Homo sapiens
ttacttttgctcagtaagagagttccataagcactcattaaagaatagattttaactgcaaaagataagaatgatattgacccagtgtagcatatctttctttttttttaacacaaggaacacacattaacatgttaattcttagatttatatatctctcttaagtgaagtttctacttttaaagatatacattacccatg

SEQ ID NO: 23420 - DNA, 201 bp, Homo sapiens
taagaactgtaacactcactgtgagggtccgtggcttcattcttgaaatcagcgagaccaagaacccaccagaaggaataaattccagacacactactgtsttagagtgatctagccctggaacatgtagtgcttgtgggtctcatagcagtagttctcaaccatgatgctagagctcattggtgtatttcaatcaactgg

SEQ ID NO: 23421 - DNA, 201 bp, Homo sapiens
acccatagcattcctatcaaacatccttaacccagcaagtttcctaacaggggatctaaatcttaattaccatacaaaggtcccaccagacataggaggarctcccttcaggacaggatatagatggttcctcccaggtgattaaggaaaaagacacaatgggtattcaggaaactcttatggaagcagagttaggaaaat

SEQ ID NO: 23422 - DNA, 201 bp, Homo sapiens
aaactcaactccctggtaaaatctttaagatttaaaagaagagaaccaaaataattgggaaagcaggagagcagaagctgaggcaggaaggtctgtcctcygtctgaaccttttctttcaccaccttcccctgcatccttccctctacttctccctccccgctacactcctgcttcagcctaagcagccctcccgcatctc

SEQ ID NO: 23423 - DNA, 201 bp, Homo sapiens
agccttcagtgtaagctcacacgcttattactgctgcacatgtccacagcttaattgcctgagtttatggcctgagtttataaatacctaaatataatttwtaaggttattttatttcatggctattcttttgtgatgtcatatatataacaaaaaatatatatttattatatataaagatatatttattttatatatatt

SEQ ID NO: 23424 - DNA, 201 bp, Homo sapiens
aaaaagaataaatgtgtatacagatagcaagtatgcttatctaatcctacatgcccgtgctgcaatatggaaagaaagggagttcctaacctctgggggawcccctattaaataccacaaggaaatcatggagttattgcactcagtgccaaaacccaaggaggtggcagtcttacactgctgaagccatcaaaaagggga

SEQ ID NO: 23425 - DNA, 201 bp, Homo sapiens
ccatactgaagtaagcctcttcccccagggaccagcaactagttagcagaactagtggcacttactcgagccttagaactgggaaagggaaaaagaataartgtgtatacagatagcaagtatgcttatctaatcctacatgcccgtgctgcaatatggaaagaaagggagttcctaacctctgggggatcccctattaaa

SEQ ID NO: 23426 - DNA, 201 bp, Homo sapiens
tgatgtaaatggcatactaggtgccaaaggaagtttatggctatcagacaaccgcctacttagataccaggtgctactccttgagggaccagtgcttcagmtacgtacatgcacggccctcaaccctgccacttttctcccagaggatggggaaccaattgagcatgactgccaacaaattatagtccagatttatgcagc

SEQ ID NO: 23427 - DNA, 201 bp, Homo sapiens
tgcttttctaggttctcctgtaagaatgatttctaatataaactccaggactctgttaccttctttaggcacctgggttcaccaatcagaaagacataatytttgcccaaagccccattgtagggggtactatctggaattttaggatccctcctcagacaagcaggcctatcaatagctattcctgaagctaggatatgg

SEQ ID NO: 23428 - DNA, 201 bp, Homo sapiens
aagacttgcccatctatcctatctatcctgacccttgcctcctgggtcctaatgcctgtcagacaaatttcctctcgcctctcttctctgaggctagtccygcttctaaaaaccactccctgtctctgttgcttttctaggttctcctgtaagaatgatttctaatataaactccaggactctgttaccttctttaggcac

SEQ ID NO: 23429 - DNA, 201 bp, Homo sapiens
cagactaaagacacgggtgtcaggctttctgggaaacggctctctaacaacccccaactcttcggagttgggagcgttggttggcctggaaccagcttccrcttttcctgtacttctgggctgagctgagggttgacagagaggaaagccattcagctctggggtcccaacaacaagttggttggccctgcagccatgagt

SEQ ID NO: 23430 - DNA, 201 bp, Homo sapiens
gaaacgtaccccaaagtccaacatcttacataatatctctgcagtctcagttcatataaagccaatccttcattttggagacattcaagttaatgtcctgktcctgttgcttagacagagttattagcaaagagaaaaatattcagttgccagtgatgctgtcagataatgttggggttcaggagatttttaatagagttc

SEQ ID NO: 23431 - DNA, 201 bp, Homo sapiens
aaagagcagctgaatgtgagagccaggcgaacagtagagaaaatcatgttttcagcacagagacaccaagaagcgccagattggttctatgaatgttgtaytttttagaataagaaattgaaacccatggcttggcacaagatttttctgatttataaattcattatgttaaaaattgcataaattgtatacaaactaagt

SEQ ID NO: 23432 - DNA, 201 bp, Homo sapiens
aaaaaaaatggagaaatataagttgtgtgaagagggcaggtggaaaaagagcagctgaatgtgagagccaggcgaacagtagagaaaatcatgttttcagsacagagacaccaagaagcgccagattggttctatgaatgttgtattttttagaataagaaattgaaacccatggcttggcacaagatttttctgatttat

SEQ ID NO: 23433 - DNA, 201 bp, Homo sapiens
atagtgctgtggaccgtgacactgcactcaagttttgtctcctggagggcttcattatattcgctcagccagtcctcctaccctcatccctcaggaggaaygttgaatgattttcaaatgtgaatgctttgtgcctttggatagggcaaatgctctctggccaccacagtccccaccactccctattgtcttcctcctgac

SEQ ID NO: 23434 - DNA, 201 bp, Homo sapiens
aaaaaaaaaaaaaaaatagctgggcatggtggcatgagcctgtactcacagctacttgggaggctgaagtgggaggatggcttgagccagggaggttgagrctgcagtgagctatgatcatgccactgtgctccagcccaggcaacagagtgggaccttgccagaaaaaaaaaaaaaaaaaaagaaagagagagagagaga

SEQ ID NO: 23435 - DNA, 201 bp, Homo sapiens
ggacttgtggaatgcatgaggcacttgcttccctcaagtggacctgctgctcagagtctcatggctgcaattcacagactacacacctaaatgtcagaaamagaataaggcctggagcaagcaaacacaccacataggctgaatagtattgtgtttttcagttaagtacatattgaaattaattgtaggtcagaaaaatat

SEQ ID NO: 23436 - DNA, 201 bp, Homo sapiens
agtaatgccccatgattgctgtgataataattaacacaaaaccaaaaaggtactctcacacatttcccaaatgctagattgtggtccctgctgagaaccaytggttaggtaacaatgaagtatcctgcgcttccccaaaaaccgcagtcatcatacttttcaaaaatgttcctgcctattgtaagttccttgtgagcagtg

SEQ ID NO: 23437 - DNA, 201 bp, Homo sapiens
agatgggacaatcaccaagcggtgagtaccactggacccctttcgcttgctattctgtcctatttttccttagaatttgggggctatataccgggcacctsttggccagttaaaagtgactagcatggccgccagactaaagacacgggtgtcaggctttctgggaaacggctctctaacaacccccaactcttcggagtt

SEQ ID NO: 23438 - DNA, 201 bp, Homo sapiens
ggacttgctaggttgacataaaaccaaaagttactagttgggtttccaaatttattgggcttaggaatcagatccatctctaataccctctctatgcaatyatcaatttttaattcttatgttgagttctgtgtactcaacccacctcagcagatttacctctaacttttgaaccaaggaacagcttttgctacttgtgta

SEQ ID NO: 23439 - DNA, 201 bp, Homo sapiens
caaataggtatattacacatatatacaaatgaaaaaagtatcaagagaaatttttggatttaatgaaatattaacagtgtttgtctttagtcgaatcaatrtttgtattttcctttttcatatatttctaaaatgtctgattattttacaggtagcatttattttaaaaattacctcttgaagggatggctaccccatttt

SEQ ID NO: 23440 - DNA, 201 bp, Homo sapiens
aaaaaaaaatccttcaatgtcaaagtaattaaaataacacaagttaagacaattacaaaaaggcagtttttcactgtcagtactagtttaaaacatgatcrtcatcataattgacaaagctccactgaaagaaacacctctgttaactgcttgtgggaggataggttggtataaactttctggtaagaaatttaataatat

SEQ ID NO: 23441 - DNA, 201 bp, Homo sapiens
gaatgcctggggatgtgatcatttccacaaaagaagcacagatgaaaagcaagggctttcaaaggcagactaatttatgcctgactgcagggattaggggyggctccatggaggtgctttgtaacatttggtggtaaagttctccacactcaaatcaatatgtttcaaacaatatttcatgtcataacattttttttcaat

SEQ ID NO: 23442 - DNA, 201 bp, Homo sapiens
tcttctcttattctcccctattcattataggggaggcttctgataaatgtgtagaatattagaaacttgataataaatatacacattcaaagcagcagtamgaaaaacagaaaaaaaggaagctacagcagtaagcctgaaaaataaaactcatctttattcatttgcttaaaatgcttaggtttagtgctttggggtgaa

SEQ ID NO: 23443 - DNA, 201 bp, Homo sapiens
tctgttccgtttcgtttccctcttcattttctgttgctttattcttctcttattctcccctattcattataggggaggcttctgataaatgtgtagaataytagaaacttgataataaatatacacattcaaagcagcagtacgaaaaacagaaaaaaaggaagctacagcagtaagcctgaaaaataaaactcatcttta

SEQ ID NO: 23444 - DNA, 201 bp, Homo sapiens
gaaaaactctaaagctgagatgaatctcctgcagggaagcagggatttagaagcacaggctgcaaggttggcctctcgccctccggtttctccgcctgcakgagagggtgggactgaacgctaaggtgaaaagcttctgttccgtttcgtttccctcttcattttctgttgctttattcttctcttattctcccctattca

SEQ ID NO: 23445 - DNA, 201 bp, Homo sapiens
tctttaagtcacgtgaaaatgccacatttcttaatcttgcagagctgacaggcaaaaatgctatgctgttcatgaccttgtgcaggattgaaatataattycgcaacatgctgcgacctagtattccgtaagacacatcgagcttagggtgattatagttatggagaaatcttacctatgttttgttggataagggttatg

SEQ ID NO: 23446 - DNA, 201 bp, Homo sapiens
agcttctgagcttttccccagagttacggaaatgagtggcataaggagaaaatgggcagtaaccaatgggttaaccaaaatcagtggagagttggtttttwaaaaaaaatggagaaatataagttgtgtgaagagggcaggtggaaaaagagcagctgaatgtgagagccaggcgaacagtagagaaaatcatgttttcag

SEQ ID NO: 23447 - DNA, 201 bp, Homo sapiens
accactgaacagctgagatccaggggtctccttcaatgcgtaatcccatccagaaggaaggaaaaaaaagaaatctctttaagtcacgtgaaaatgccacrtttcttaatcttgcagagctgacaggcaaaaatgctatgctgttcatgaccttgtgcaggattgaaatataattccgcaacatgctgcgacctagtattc

SEQ ID NO: 23448 - DNA, 201 bp, Homo sapiens
taaagtaacctgaacttggataaagttccaagtttttccaggagatgtgagtgcaaacctcagcaacaacatttttaacaatcaccctaatgaggcctctscacagatcctgctgtggtggttgtttggggtggggaacatctgagcagatgccctgagaattccctaggtcccatccttctggatctccagtgattcagc

SEQ ID NO: 23449 - DNA, 201 bp, Homo sapiens
tatgataaaaggaagcattataggcaaaatatgattttaaattaatgctggagcagattaccttacatggtaacatttcagtggattaatttttacatatmaccttgagatacttaagaaaagattatggagatagacaatttaatatttttagtaggccaggtgtttatttgacagtctaaaagggtatgaaattctgag

SEQ ID NO: 23450 - DNA, 201 bp, Homo sapiens
tctaccatatagatctgaaggtcatagattctaaaactactttaattcatctttcctgaagtatttctgaatagagtaagtaaacagaatgagtgccaatsccttggaaacagcaattgatttttatattgcttttcacagagtcaacatatgcagacagtctgacttgcctattgatctgagctagagttgagtgaatga

SEQ ID NO: 23451 - DNA, 201 bp, Homo sapiens
gattggaagattctagcccagactattttatcctattctaaacttgccaaaaatttcatattgtcaaactttccctccaccccatgccaagttgttaagctttcaaataaacaaatttattatgataaatttcatctctattgatgtaaaggctattggatatcttttcttagcatttagtttaataccaaattaatattt

SEQ ID NO: 23452 - DNA, 201 bp, Homo sapiens
ataattaatgattcatttctcaagacatttaattttcctcttgttttctgcctgcagcctgcatggttaatgcattttgacacttctcactaaggataaaygacaaatgataaaaccaacaatttttgtccacttattttactcaaagctccgttaagaaaaataatgaaaaaaattttaatttcagtgactaacaggagt

SEQ ID NO: 23453 - DNA, 201 bp, Homo sapiens
tttatcctattctaaacttgccaaaaatttcatattgtcaaactttccctccaccccatgccaagttgttaagctttcaaataaacaaatttattatgataaatttcatctctattgatgtaaaggctattggatatcttttcttagcatttagtttaataccaaattaatattttgtatcatcctgatatatgaagacat

SEQ ID NO: 23454 - DNA, 201 bp, Homo sapiens
catctcagtaaggtatagagaaattcacaaatagagagccttcaattctttaggttgagatataattaatgattcatttctcaagacatttaattttcctyttgttttctgcctgcagcctgcatggttaatgcattttgacacttctcactaaggataaatgacaaatgataaaaccaacaatttttgtccacttatttt

SEQ ID NO: 23455 - DNA, 201 bp, Homo sapiens
caccttgaccactatcatcttccattaaatcatttccttattccttccccttttccactaaagtccatttcaagtcctcgtgatagtgtgggggacttcartcaaaggcatttccctccagtctttataacatgcatttcatctcttgccaaatccttgctgatgtcatcctgttcaccccagatgcttatatcacagttt

SEQ ID NO: 23456 - DNA, 201 bp, Homo sapiens
caccctccaccctcaggtaggccccagtgcctgctgtttccctgtcctgtgtccatgtgttctcagcacttagctcccacatataagtgagaacatgcagyacttggttttctgtttcctgcattagtttgctgaggaaaatggcctccagctccattcacattcttgcaaaggacctgatcttgctcttttttatggctg

SEQ ID NO: 23457 - DNA, 201 bp, Homo sapiens
gatgagtagagaagcaaactgtgggatagccatatgatgaaatactactcaataataaaagggaaccaattaatgatatacactacagcacagatgaattrcaaaagcattatgttgagtgaaagaagcagatacaagagacatatagaagaaattgggaaggtttaaaaaaaatttttaaaagcagtgactatttgagta

SEQ ID NO: 23458 - DNA, 201 bp, Homo sapiens
ttaaaggaggagcaaagaactgagcattcagaatataaagggaggagaagtgaatgtcacagaaggagaaaaggttgcacagagatatcttgaaaaacataaaaaacaggagaaaggagtagttcattctgattcttacaaccaccttcaggtggttttggaaggagggagggagggagagaagggagctaagacttcagt

SEQ ID NO: 23459 - DNA, 201 bp, Homo sapiens
atttgcatgtgtcttgctgaagaagtcaaagagagtaaaggctgatgagtggaaatcaacagtacagcagacaccattataaacttaaagtctacaacatgccattaatgttatcagtgttctgacctaagggttttatttattttttattattttattttatttttattttttgagacagagtctcactctgtcacccag

SEQ ID NO: 23460 - DNA, 201 bp, Homo sapiens
attcaacttggacctgtgtacctcccccaccatggagatccaaatatttatatgaagtgtaaagcagaaagaatgaggagagtgggatctggaggaaagawggaataatcccgttaggttggagtcacagtgcaactaactcttaactcactccagcttgaatggaccattattgatcagagtcaacgtttgccatttgcc

SEQ ID NO: 23461 - DNA, 201 bp, Homo sapiens
tgtgcatatatatagacacatatataatatatatgtatgtgtgtgcatacatatatatgaaatgtaatcaacagtttgcccctattttaactttttaaaarcagagaattaggttgggtacggtggctcacgcctgtaatcccagcactttaggaggccgaggcaggtggatcatgtgaggtcgggagtttgagatcagcc

SEQ ID NO: 23462 - DNA, 201 bp, Homo sapiens
aaattagccaggcgtagtgggacattcctgtagtcccagctactgaggaggctgaggcatgagaatcgcttcaacccaagaggtggaggttgcagtgagcygagatcataccactgcactccagcctgggtgacagaccgaggctccatctcaaaaacaaacaaacaaacaaaacaacgataccaaccaaaacccagacaa

SEQ ID NO: 23463 - DNA, 201 bp, Homo sapiens
ttcaagagaggaggaatacctttataaaatatcccaaaataccaaaataccttcaaaataagaaagataaacagaactcactttaaatatcttaagaaaakcgttctataaagataatcgtgggtaatggaatcttggcacccaaaggaagcttaaaggtgacctccaatgctcaaattttatcaacgagcaaataaaaca

SEQ ID NO: 23464 - DNA, 201 bp, Homo sapiens
aaggcaaagatacattgtgagttttagaaaagtctagttttgtgatttttgtaatggtccacagaaggcatttgtatgttttttcatttctttctttacattttttttttttgaggttggtcagagagaaaaatatgtgagttttgccaacagttgtctttgatcctcagagatgtgcttttccattgctagttcagttga

SEQ ID NO: 23465 - DNA, 201 bp, Homo sapiens
aaataattcagggcaccaggtccctcgtggtgtttgatgtttagttgtgagagaggtttgtgcatgcgagcagtgcagtctctctggattttatcctcggrtcaagtccagctgcacaggggctggggctggcttccagcatcacagtgtcccagactctagagcttcacttccagccaaatactattagctgttaggacc

SEQ ID NO: 23466 - DNA, 201 bp, Homo sapiens
ctgtttttaaattttttggctacctaattttcttttattattgttattattattatactttaagttctgggatacatgtgtagaagctgcaggtttgttayataggtatacacgtgccatggtggtttgctgcactcatcaacccgtcatctacataaggtatttctcctaatgctatccctcccttagccccccacccct

SEQ ID NO: 23467 - DNA, 201 bp, Homo sapiens
aactccacaccgatgctctcagccataacaccacataccccgggagcactctcacagtgtcctgtcaccctcacagggatcatggggaagtgttcctgctkcccccaagtctaccattctattgacactgccgcaaagagaaatcaatgttttgcatgactccatagataagcaggtgccatttattataatcacctcttt

SEQ ID NO: 23468 - DNA, 201 bp, Homo sapiens
cagtaatacacagcctccatcctctttcacagaacccacagcagtagtctttatatcgccaaagcaccaatgtttttgatgcatgaattgttaatagatgmatagctgaataaatgaatttttgtcatctctgctcctgcaatgctcagtgctttggtggaaaatctcagaggacaccatcgggaatgtgctgtactgagt

SEQ ID NO: 23469 - DNA, 201 bp, Homo sapiens
tttctttcgactcatttgaggatgaaatggcaacaaaaaggtgtttaaaaactcaaattaaaaaatgcttgttccagcaactgcagagtagctcattagasccccttatggatgacgtgtctgtcatgttatggtcatgccatttctcttgtgcaacattgacggtgaaagagcaaaaatacaaaatgagaaccagaagtt

SEQ ID NO: 23470 - DNA, 201 bp, Homo sapiens
tcctacaaattggagcacaaaccaaaataggactcatgatcttgccgagcgttgcacgtataacagtgtgctgggcaccataatcgtgatttggtaaagcrtaatggagaaagctacagaaaggaggatgcttttgaattgggctttaaaggaggctttggcagaaagagggggggaggaaagagatgaaacatttccagg

SEQ ID NO: 23471 - DNA, 201 bp, Homo sapiens
atgtaagttcatttcagtatatttttatttttgtaaaattgaagtttcaattgttataatcatgaccactagtaacatttattcaactgtctgtatgcaayttcaggcaataaatcttgcttaaatattaggcaaccttgaatataaggtaatatgttatttttgcaataagaaattttaacttaaaaagctttttgataa

SEQ ID NO: 23472 - DNA, 201 bp, Homo sapiens
atggtatttgaacaggtatatttcatatttaatgtattaaattgtgaatacagagaactatctatgtttttaggtttcagtgtaacttctggactcattgrcctcatattacttaacttacatggaaggagagtaataacctctattttttgttggttgtttttatgtttgttctctgtgtataagagatcagaaaatgtt

SEQ ID NO: 23473 - DNA, 201 bp, Homo sapiens
aagggtgaagattaaacatattctctcagtttgtgattggttatataaaacaccataccagctatgaatgatggttattctttgttaagtcattcaaataygatttttaaaaatttaaaagtgaaaatcgtgttttttagagtaagtgtagtgtttgagagaaattacttcatccaataaactgctaatgtttgcaatccc

SEQ ID NO: 23474 - DNA, 201 bp, Homo sapiens
ctctgtgtgtgggtcaatgagtctgtctgttctgtcaactcagggatactgggtcattgctttcatttgatgtcctttttttagcttagtaagtttcattrctgggtctgaaatattaatagaccaatgctatactcctccccgctctctttatccctcttttctgcctttcctgttgtctcccttctgtctgtcttattc

SEQ ID NO: 23475 - DNA, 201 bp, Homo sapiens
gggaggctgaggcaggagaatcgcttgaacctgggaggtgaaggttgtggtgagccaagattgtgcccagcctgaggaacaagagcaaaaaaatccatctaaaaaaaaaaaaaaaaaagaaagaaaaaaagacatatggccagatggaaagagctgattgatgcatgatatcattgcttggtgatacggctttagaaaagc

SEQ ID NO: 23476 - DNA, 201 bp, Homo sapiens
acaggttcgtctgaaacctagtagaatgtttttacatgaatacactgctttggagcaattgtgtatctgcagctttataaattacagtaaggctgattccaaaaaaggataatgcatttctagccctgcatccctgggtggtagaaaggaagctgtctaggtgtgctcgaatttccctaaggcaccagctttaaatgtctt

SEQ ID NO: 23477 - DNA, 201 bp, Homo sapiens
gggaggcaaagatagagggagggagggaaagatagagggagggagggaaagatggagggagggatggaaagatggagggagggaaagatagagtgaggaakggaaagatggagggagggagggaaagatagagggagggatggaaagatggagggagggaaagatagagtgaggaagggaaagatagagggagggagggag

SEQ ID NO: 23478 - DNA, 201 bp, Homo sapiens
tgatggagggagggaaagatggagggagggaaagatagagggagggagggaaagatagagtgagggaggcaaagatagagggagggagggaaagatagagkgagggagggaaagattgagggagggaaagatggagggagggaaagatagagggagggagggaaagatagagtcagggagggaaagatggagggagggaaa

SEQ ID NO: 23479 - DNA, 201 bp, Homo sapiens
agatggagggagggaaagatagagggagggagggaaagatagagtgagggaggcaaagatagagggagggagggaaagatagagggagggagggaaagatkgagggagggaaagatggagggagggaaagatagagggagggagggaaagatagagtcagggagggaaagatggagggagggaaagatagagggagagagg

SEQ ID NO: 23480 - DNA, 201 bp, Homo sapiens
agatagagtgagggaggcaaagatagagggagggagggaaagatagagggagggagggaaagattgagggagggaaagatggagggagggaaagatagagkgagggagggaaagatagagtcagggagggaaagatggagggagggaaagatagagggagagagggaaagagagtgagggagggaaagacagagtgaggga

SEQ ID NO: 23481 - DNA, 201 bp, Homo sapiens
aagaggtggaggttgcagtgagccgagatcataccactgcactccagcctgggtgacagaccgaggctccatctcaaaaacaaacaaacaaacaaaacaaygataccaaccaaaacccagacaattggactatgagtgaaattcataaagtggccatcattgcataatcaagtgttccctctaaagaagttttctctggct

SEQ ID NO: 23482 - DNA, 201 bp, Homo sapiens
gatagagggagggagggaaagatagagggagggagggaaagattgagggagggaaagatggagggagggaaagatagagggagggagggaaagatagagtsagggagggaaagatggagggagggaaagatagagggagagagggaaagagagtgagggagggaaagacagagtgagggagggaaatatagagggagggag

SEQ ID NO: 23483 - DNA, 201 bp, Homo sapiens
aagtatggaaccagcagagagaggtcctcatcctaacattgcccagtttttcctcaaccccatccgtgccccttttctttttctttttctttttcttttcttttttttttttttgagacagagtttctatcttgtcacccaggctcgagtgcaatggtgtgatattggcttactgcaacctctgcctcccgaattcaagtg

SEQ ID NO: 23484 - DNA, 201 bp, Homo sapiens
gaggctgaggcgggcggatcacgaggtcaggagatcgagaccatcctggctaacacggtgaaaccccgtctctactaaaaatacaaaaaattagctgggcrtggtggcgggcgcctgtagtcccagctacttaggaggctgaggcaggagaatggcatggacccgggaggcagagcctgcagtgagcggagatcgcgccac

SEQ ID NO: 23485 - DNA, 201 bp, Homo sapiens
agtatggaaccagcagagagaggtcctcatcctaacattgcccagtttttcctcaaccccatccgtgccccttttctttttctttttctttttcttttcttttttttttttttgagacagagtttctatcttgtcacccaggctcgagtgcaatggtgtgatattggcttactgcaacctctgcctcccgaattcaagtga

SEQ ID NO: 23486 - DNA, 201 bp, Homo sapiens
ggcggatcacgaggtcaggagatcgagaccatcctggctaacacggtgaaaccccgtctctactaaaaatacaaaaaattagctgggcgtggtggcgggcrcctgtagtcccagctacttaggaggctgaggcaggagaatggcatggacccgggaggcagagcctgcagtgagcggagatcgcgccactgcactccagcc

SEQ ID NO: 23487 - DNA, 201 bp, Homo sapiens
aaggggtcttatgtcttgaagatctggaaagggctttacatgtccttgtatgcctgggatctagcacagaggcctggcatacaggtcccagaataaaaatscttgctaatataaatgtgatcataaagacagcaatgattatcatgaaattttaacttgtttaccagaaaaagtgcatgacctaaaacttggcaaatgtgc

SEQ ID NO: 23488 - DNA, 201 bp, Homo sapiens
acggtgaaaccccgtctctactaaaaatacaaaaaattagctgggcgtggtggcgggcgcctgtagtcccagctacttaggaggctgaggcaggagaatgkcatggacccgggaggcagagcctgcagtgagcggagatcgcgccactgcactccagcctgggcgacagagcaagactccgtctcaaaaaaaagaaaaaaa

SEQ ID NO: 23489 - DNA, 201 bp, Homo sapiens
aaattagctgggcgtggtggcgggcgcctgtagtcccagctacttaggaggctgaggcaggagaatggcatggacccgggaggcagagcctgcagtgagcrgagatcgcgccactgcactccagcctgggcgacagagcaagactccgtctcaaaaaaaagaaaaaaaaatcaaaaagaaaagaaaaaagaaaaaagaaaa

SEQ ID NO: 23490 - DNA, 201 bp, Homo sapiens
gctgggcgtggtggcgggcgcctgtagtcccagctacttaggaggctgaggcaggagaatggcatggacccgggaggcagagcctgcagtgagcggagatygcgccactgcactccagcctgggcgacagagcaagactccgtctcaaaaaaaagaaaaaaaaatcaaaaagaaaagaaaaaagaaaaaagaaaaaaaaga

SEQ ID NO: 23491 - DNA, 201 bp, Homo sapiens
ttccatgtattagcaagctcatagttttgggtaaagagagctttattcaatgctatgtcaaaatgtgaccataacgaggtcaaagattaaactgaggttcaatgaatgaagtaactctctctgaccacagtcatcattatcagtacagctctatcttctcttctgacttattctgtcaagtgacttgtccacagaattctc

SEQ ID NO: 23492 - DNA, 201 bp, Homo sapiens
tccatgtattagcaagctcatagttttgggtaaagagagctttattcaatgctatgtcaaaatgtgaccataacgaggtcaaagattaaactgaggttcaatgaatgaagtaactctctctgaccacagtcatcattatcagtacagctctatcttctcttctgacttattctgtcaagtgacttgtccacagaattctcc

SEQ ID NO: 23493 - DNA, 201 bp, Homo sapiens
ccatgtattagcaagctcatagttttgggtaaagagagctttattcaatgctatgtcaaaatgtgaccataacgaggtcaaagattaaactgaggttcaatgaatgaagtaactctctctgaccacagtcatcattatcagtacagctctatcttctcttctgacttattctgtcaagtgacttgtccacagaattctcct

SEQ ID NO: 23494 - DNA, 201 bp, Homo sapiens
catgtattagcaagctcatagttttgggtaaagagagctttattcaatgctatgtcaaaatgtgaccataacgaggtcaaagattaaactgaggttcaatgaatgaagtaactctctctgaccacagtcatcattatcagtacagctctatcttctcttctgacttattctgtcaagtgacttgtccacagaattctcctg

SEQ ID NO: 23495 - DNA, 201 bp, Homo sapiens
aatgtcattaattcaggttcctccacctgagacctaatcacacttaacattctcccacagacaagttgcattagagatatgcaagacaattgtatttcccytccaggagtacagtgagtaagcaagaacaagtgacgacagataatttcctctaaatatttgatttactggccaaagctctctgtgtgtgggtcaatgagt

SEQ ID NO: 23496 - DNA, 201 bp, Homo sapiens
agtacagtgagtaagcaagaacaagtgacgacagataatttcctctaaatatttgatttactggccaaagctctctgtgtgtgggtcaatgagtctgtctrttctgtcaactcagggatactgggtcattgctttcatttgatgtcctttttttagcttagtaagtttcattactgggtctgaaatattaatagaccaatg

SEQ ID NO: 23497 - DNA, 201 bp, Homo sapiens
aacaaaagcattcaaaccagattttctttgtaaaatatttcagatttggagggcataggagattgagtgggtggtaataaacacagaatcgactgaatagrtaacgttaaaactgttaaactagaaaagtttttaaagaagatatttatttaggacttcaaaattgtccaggtactatgctaaatgttttataaatgacct

SEQ ID NO: 23498 - DNA, 201 bp, Homo sapiens
ggtggcgggttaggtaaagggtaaagcatttcagacaaagtgaatggtgtaaatatcattggaacacatcaagaactgtagtttacttttgtgccagcaayagaaaagaagcttggtgagtaaatcaaaatttcagtacagattaacagactcccaccagttgttccagaataatcacattcatgtaagcaagataaaggg

SEQ ID NO: 23499 - DNA, 201 bp, Homo sapiens
tatacagattttctggaaatcaggtcagcacttttatttatttcattataatcttttcattatttattctcattaataatctttcctaggaagattaaggaaaaaaatatggaaattctctgcaaagctccctgctgtgcactttcttgcaagaaataaagtttgtcatttggagcctgacttaggagaaatacaggaatt

SEQ ID NO: 23500 - DNA, 201 bp, Homo sapiens
aaaattttattatgctaaataaattaattctgcttggttgggaaaggtttcagccaaccttaaatgatgggtaagagtgtatatgttaaactgtgtattgkcaggggttgttgggtggcgggttaggtaaagggtaaagcatttcagacaaagtgaatggtgtaaatatcattggaacacatcaagaactgtagtttactt

SEQ ID NO: 23501 - DNA, 201 bp, Homo sapiens
agacatacctttgtaaaacaattctattaccatcctagcttgtaaggcaatattttgtgcagaaagaacccagagcagttaaaataattgggcagggaggwtattagattttaattctaaaagttttcagaaagataagatacacgtaaaataaaaatgagtcaggaaaagagatagaagcaaactggacaggaaaggaaa

SEQ ID NO: 23502 - DNA, 201 bp, Homo sapiens
atacaggcagggcctcctgaaaatgtggaaatctttgtaatgatatgcaaagtaagacatacctttgtaaaacaattctattaccatcctagcttgtaagrcaatattttgtgcagaaagaacccagagcagttaaaataattgggcagggaggatattagattttaattctaaaagttttcagaaagataagatacacgt

SEQ ID NO: 23503 - DNA, 201 bp, Homo sapiens
tgaagttttcagacggtaaagaaatataatgtctccaaagtactctgaattggctgagataataagtgtgaatatttgtgtgtctgtgcatgtgtgtgtgkgggggggggagagagagagagaaatgataaagtaatgggagcagaatacaaatacataataaatctgggtaaaaagaattcaggagctcattcttgcatc

SEQ ID NO: 23504 - DNA, 201 bp, Homo sapiens
ggcaactaagaaacatttttccttttaatctttgaagaggttattatcagagccttttaatttgaaatccaggtagcttggttacttgctgcagtaattawaatttttatttcaacagcatgtggagaaattcttacagaatcaacagggaccattcaaagtcctggccatccaaatgtctacccccacggtatcaactgt

SEQ ID NO: 23505 - DNA, 201 bp, Homo sapiens
cctcttgggcttgtatcagaataagtgaatgatagaaataaattatatgaaaatcatctgtactgtgaaaaattttaaagtacactcaaagacaaagaatrtatattttctaatcaacatttatatcaaaagttaattgttacttattaataagagaaaaatcaggttatcttaagtggcaactaagaaacatttttcctt

SEQ ID NO: 23506 - DNA, 201 bp, Homo sapiens
gtgtgcatgtgtctttatagcagcatgatttataatcctttgggtatatacccagtaatgggatggctggatcaaatggtatttctagttctagatccctraggaatcaccacactgacttccacaatggttgaactagtttacagttccaccaacagtgtcaaagcgttcctatttctccacatcctctccagcacctgt

SEQ ID NO: 23507 - DNA, 201 bp, Homo sapiens
ctaaataataaagagtgttaggtgataagttttatgatagagataatgtgtgctttaaaacacacagcataaaacagatggaaaacacctcatggagaagsgagagcttgaattggtgtttgattgaaggacaagaaaaatctgttggtaacttcctcctggctctgacctctgatgcagttaaagtaaagcaacttagaa

SEQ ID NO: 23508 - DNA, 201 bp, Homo sapiens
tgatctctgaccctcggctcttgtgcttcctgctacaggatccctgctgggcaccaacagctccaccatggggctggcctggggactaggcgtcctgttcytgatgcatgtgtgtggcaccaaccgcattccaggtgagtttgtgtggcacctttaggggaaggagggacaaggaagaggtgctggctatcccaggtgtgc

SEQ ID NO: 23509 - DNA, 201 bp, Homo sapiens
ggcagagagtaatttattactctatgggtctgctctgtaaatagctgaagactctggagccagatggttctgcaaattctccaaacaggagtcacgttaaraagcacgagtgggcacaaaaactgtttttcaagacacaatttcaatttggcttgtggaaactggatacgagtaagtttccttaaaattcgagtagaaagc

SEQ ID NO: 23510 - DNA, 201 bp, Homo sapiens
ggccactatagcgaccccatgtaccgctgcgagtgcaagcctggctacgctggcaatggcatcatctgcggggaggacacagacctggatggctggcccartgagaacctggtgtgcgtggccaatgcgacttaccactgcaaaaaggtagagccaggtcctttgtgtgcctccagaaagagggcccatcaccttatcaaa

SEQ ID NO: 23511 - DNA, 201 bp, Homo sapiens
ctttgcagtgcaagtctagaaataattttactctgtgtttctttctgtctccctcttccctcccctttttccttcctaccctcccctcccctccctcctcyttctttctctctctctctctctctctcatacatacaaacatcaaataccagaaaagcatagatttagaaagctgaactcctctgaaacgctgacggacaa

SEQ ID NO: 23512 - DNA, 201 bp, Homo sapiens; identical to SEQ ID NO: 3223

SEQ ID NO: 23513 - DNA, 201 bp, Homo sapiens
gtagcgagttcttagatcctaagagactgatgcatacatggggaaaaacaaatataaaacctggcagttgtacctatccctgtgggtgctgaggatgtctrggaacatgatggagaaccttctgaaggctgcaggttttaacctggctctgggctcttcttccaggttatgatgagtttaatgctgtggacttcagtggca

SEQ ID NO: 23514 - DNA, 201 bp, Homo sapiens
gaactaaattttaaaaagacaaagagaaacaggagaaactggaaccttcatgcacgactggcaggaatggaaaatggtgcagtagctttagaaacagtctrgcagttcctgagaaggttaccatagacctggcaattccacttctaggtataagcccaagagaaatgaaagcatacatccatacaaaaacttgtacacaag

SEQ ID NO: 23515 - DNA, 201 bp, Homo sapiens
cgagtagaaagcagctgtcctccccgggccccttgatgagaatacgcacaccgcccccaagcggccggccgagggagcgccgcggcagcgggagaggcgcmtctgtgggccccctggcagccgcggcaggaaagggcccgaaggcagcgaaggcgaacgcggcgcaccaacctgccggccccgccgacgccgcgctcacct

SEQ ID NO: 23516 - DNA, 201 bp, Homo sapiens
gaggtgaaccccaggggtttccccctgcccgtgctgagatccttatttggtcaagcttctacctatgccctggcctcggagcgagcccgatagcgctggaycacagcagagggagcgaggcggctgacgtcccatcccgaagagatgaatggaattccaggaagctagagtcatgctggcttgggacagtggcttggagac

SEQ ID NO: 23517 - DNA, 201 bp, Homo sapiens
atagcctcaacaaccgatgtgagggctcctcggtccagacacggacctgccacattcaggagtgtgacaagagatgtaagcatcttagcctctcagggacrtggagaactgacctgtccttgttgtcgtcaccaagggcagctccacagcatgtatattaagaacacgggttctaggatctctggatcccaatcccactgc

SEQ ID NO: 23518 - DNA, 201 bp, Homo sapiens
gccctcacattaaaggggataggttttcttttcccttttcccatccctgcttctctcaaagctgcacagaggtatatgaggtttggggaatatttgcagcmcatgttggctggcaagaatgtgggtgaattcctgttaaggggcgcagacactccctcttctatgacctttcctttccacccagaacaactgaagtatcat

SEQ ID NO: 23519 - DNA, 201 bp, Homo sapiens
atctgaaatccaacaaacatgtgccttaggaacataccggtcatcttttagaggcattttatatacatattgagtaactagaaaacactctttccgtaatmcacacacacacacacacacacacacaccatcttgtcatacaacactcccacgcaagaaaagcgaaactgctgtttgatgaatgtaaacacttggctgttt

SEQ ID NO: 23520 - DNA, 201 bp, Homo sapiens; identical to SEQ ID NO: 3218

SEQ ID NO: 23521 - DNA, 201 bp, Homo sapiens
acaaaaaagacagagggagattaacacacacagatggagggaggcaatgtgaagacggaggcagagactggagtgacgtggccacaaagccaggaatgccyatagccaggagaagctggaagaagcatggaagcgttctagcgttctctcctagggcctccaggtggcgtgtggccttggtgacaccttgatttcaaactt

SEQ ID NO: 23522 - DNA, 201 bp, Homo sapiens
aaggtactttctgtacattattttcactaccaccatttatttttgataatcctaaagtagaagtaagtagtaaaccatttagtccggagcttctcactctktaacatgcacacaaatcacctgcggggtatcttaaaattcaggctctgattcagtaggtctgcagtgggcctggcactctacatttctttttgttgttgt

SEQ ID NO: 23523 - DNA, 201 bp, Homo sapiens; identical to SEQ ID NO: 3222

SEQ ID NO: 23524 - DNA, 201 bp, Homo sapiens
aatgctgcagtcagcattcgaggagattccagcttggttagtcctgagcgatttgattgctctaagatgcaggtggacaacataatcccaacaagttatcrgttccctataccctataatatcttacactgtgttaagtgcccagcatggcagtatggcagcttagaccaaccatttactgtgactgtctctctctccttg

SEQ ID NO: 23525 - DNA, 201 bp, Homo sapiens
gttgatgaggtgaggaactgatggggctccgagtttctggatctaggaaagcagctaacctgtgcagtcgcttccttatggcagtgacttctaaacatgawgcacgctcttatttcctccatagtgcaaagaagtgcctgatgcctgcttcaaccacaatggagagcaccggtgtgagaacacggaccccggctacaactg

SEQ ID NO: 23526 - DNA, 201 bp, Homo sapiens
atgcatgtgtgtggcaccaaccgcattccaggtgagtttgtgtggcacctttaggggaaggagggacaaggaagaggtgctggctatcccaggtgtgcccyctcacgtgctgtcctctccctcttgagcctgactggacatcaggacgcagcttcactctgatcctggtatttattcacctctttcagtggttgccaggag

SEQ ID NO: 23527 - DNA, 201 bp, Homo sapiens
aggactgcgttggtgatgtaacagaaaaccagatctgcaacaagcaggactgtccaattggtgagccacgcagcccaggatgaaacgacccaggagctttkctcttttactgaatgctgcagtcagcattcgaggagattccagcttggttagtcctgagcgatttgattgctctaagatgcaggtggacaacataatccc

SEQ ID NO: 23528 - DNA, 201 bp, Homo sapiens
tacgaaaacaaagataaaggaaaaaaacttttaaaatgtaattgctactattgctatctttctgcaggagtgtgtaaatagacatgacaccccactggctrtatcaaacaatggagaattttccctgtggtgggggcataagttatctttaacatgaatggtttatactgcaatttaccctccatttacatctctctttca

SEQ ID NO: 23529 - DNA, 201 bp, Homo sapiens
tggatcacagcagagggagcgaggcggctgacgtcccatcccgaagagatgaatggaattccaggaagctagagtcatgctggcttgggacagtggcttgkagaccagacttcaatgacagaagcactaggcagcggcactcatggcaatgtgtgcacccacagaaatgtaacccacacctcgggttcaggagccgaaaaa

SEQ ID NO: 23530 - DNA, 201 bp, Homo sapiens
aaaaacatgaacagggctagctctttttgggcaactgtgttccatagtcaactcttctgtccaaaaaaaagttcagtactctatccaaataccagcaaagyatgacttgtgttcacaacatctataaagcctagagcatttacacaaattctgtatgtatatcccccaagaaaagttttattttcttgtcttcccataaaa

SEQ ID NO: 23531 - DNA, 201 bp, Homo sapiens
gactgaccttcaaataatcaggttgtactgaaataaaggacttgttaaaaattaaaattatgtcatcgagatgatagcttttttcctcctccaacagtttwttgtcatgtgttgtgggagagctcgagtgaagagcaataaactccaggtcttataagaatgtacatacaataaaggtggtgccagcagtttttttttttc

SEQ ID NO: 23532 - DNA, 201 bp, Homo sapiens
gagccagagaggctgctcccaaatacagtcctccccatcagcaacactgcagtagcctgcacctatcgtccagagtatgaaaaagacttttgccaaagacrgcttttggggatttatcattattacatgttaagagcctgttctccatgtcctcaccttcctaccttgctaatcttccccatttccatctttcggcccagt

SEQ ID NO: 23533 - DNA, 201 bp, Homo sapiens
cagagtatgaaaaagacttttgccaaagacggcttttggggatttatcattattacatgttaagagcctgttctccatgtcctcaccttcctaccttgctmatcttccccatttccatctttcggcccagtgtgagacctcaccatctccttttcccatcttctttcctccatacccttggtttcctagcaggtcaatgcc

SEQ ID NO: 23534 - DNA, 201 bp, Homo sapiens
ctgccttggccttccaaagtgctgggattacaggtgtgagccactgcgcccagcccacattctcttcttctgcaaactaacatgtctatacctttttcagkcctttaatgacctgtgtggaccctgtacataacaacgtgctctgtgggcccctccgttgtgggtcgaacaattaaacacctcactctggttggtgccagc

SEQ ID NO: 23535 - DNA, 201 bp, Homo sapiens
gaaaatcgcttgaatctgggaggcaaaagttgcagtgagctgagattgtaccactgcactccagcctgggagacagagcaagactccatcccaccccccaycaaaaaaaaattctggtctttacatgtgaaaaaataaaagctaatttttaaaaactaaataataaagagtgttaggtgataagttttatgatagagataa

SEQ ID NO: 23536 - DNA, 201 bp, Homo sapiens
gcacctgtgctgtcttctggacttccaccaccaacagtctccaggacctgtttcaagttgcttcacctctttgaaccgacttcatctattaactgagtggktgaactagatggctctttctggcttaaaaattctgtgatttcatttctggaggaatttcaagcatgggtagagagagaagaaactgagaggcaagaggta

SEQ ID NO: 23537 - DNA, 201 bp, Homo sapiens
tcgagtagaaagcagctgtcctccccgggccccttgatgagaatacgcacaccgcccccaagcggccggccgagggagcgccgcggcagcgggagaggcgyctctgtgggccccctggcagccgcggcaggaaagggcccgaaggcagcgaaggcgaacgcggcgcaccaacctgccggccccgccgacgccgcgctcacc

SEQ ID NO: 23538 - DNA, 201 bp, Homo sapiens
aaactgagaggcaagaggtatggtttggactcatcaaattaaatcacaggtgactttccagtccccccaccaccccgatctgtaaggctgcctttgggtgygtggccttcctgcaaaatggcaaacacttgaaaaagcttccacgctgaaacccaaaccagaccatatttaggatgccccataaggtggcattttttacta

SEQ ID NO: 23539 - DNA, 201 bp, Homo sapiens; identical to SEQ ID NO: 3221

SEQ ID NO: 23540 - DNA, 201 bp, Homo sapiens; identical to SEQ ID NO: 3224

SEQ ID NO: 23541 - DNA, 201 bp, Homo sapiens
tgtccttgttttgttgaaagaagccaagttccaagaaatctgcagaggcattcctacaatccctcagccatggcagcatgaatcctgaaggggcagtgagygctggtttctactctgtctgcacagctaagcctaggggagataatcttttcatacaagatgcattctgcttttgtgggcctcttgcagccctcaagcccc

SEQ ID NO: 23542 - DNA, 201 bp, Homo sapiens
ttgatggagacggtaaggtgctgcctgatcagagggcccgcgggagacagggacatgcacagctttccaaacgtacttctgtctagtcctggctattagtrtgcactttggtggaaacatccaaggctggagagcccagctcttatttgtcccttgttctcttcaggtatcctcaatgaacgggacaactgccagtacgtc

SEQ ID NO: 23543 - DNA, 201 bp, Homo sapiens
ttaagaaaagagcttatttcaaatgcattcccccaattttaatcttgtttgaaatggatactttctatgggcagaatcagtaccactttgctattggattyctcatggggatgcagctggtctcacataaaaggttaaaatagcagttagttgttgctgttacagcttcatctgtgccttaacttctagatctttgcaacg

SEQ ID NO: 23544 - DNA, 201 bp, Homo sapiens; identical to SEQ ID NO: 3229

SEQ ID NO: 23545 - DNA, 201 bp, Homo sapiens
caaactaacatgtctatacctttttcagtcctttaatgacctgtgtggaccctgtacataacaacgtgctctgtgggcccctccgttgtgggtcgaacaaytaaacacctcactctggttggtgccagccagatgagttgatgaaacctgagaggccagattgcttccagttctgtaaaacctgtttgagaattaaaagag

SEQ ID NO: 23546 - DNA, 201 bp, Homo sapiens
acgccatcagggtaaagaactcgtccagactgtcaactgtgatcctggactcgctgtaggtgagtagcgagttcttagatcctaagagactgatgcatacrtggggaaaaacaaatataaaacctggcagttgtacctatccctgtgggtgctgaggatgtctaggaacatgatggagaaccttctgaaggctgcaggttt

SEQ ID NO: 23547 - DNA, 201 bp, Homo sapiens
tatttttagtaaagacggggtttcaccttgttccggacaaacactaagccctaaagggaaatccaaaataaaaacatctatttttaataacactttctatmtaaatcagggtgactttttaaaaaaaatccggaagctttgtgttgaattacgttacagacttagttaccagtccttgttagagttaccttcagttgacat

SEQ ID NO: 23548 - DNA, 201 bp, Homo sapiens
gacaaaaagacaaaaagtattaaatagcattgtcactaaacaagattttttttccctgcagagtggtgatgtatgaagggaagaaaatcatggctgactcrggacccatctatgataaaacctatgctggtggtagactagggttgtttgtcttctctcaagaaatggtgttcttctctgacctgaaatacgaatgtagag

SEQ ID NO: 23549 - DNA, 201 bp, Homo sapiens
tggctggcaagaatgtgggtgaattcctgttaaggggcgcagacactccctcttctatgacctttcctttccacccagaacaactgaagtatcatgataaraggaagggctttgtgtttgagataagcagctcctatacctgtcagctttctctaataagaaagctctttcctgccaccgtataggtcaccttcttattgg

SEQ ID NO: 23550 - DNA, 201 bp, Homo sapiens
ttaccctctctgaggctctttcctcatttgcaacttggagataataatagttcttgataagtttatcttgagcattttatttagatactgcatgtaaagcmgttagcactgagttttggtttatggtaagcaccctgtaaatgttaggatattaacagcaacccataaaaacagcgaacttatccgttctctggtagaaaa

SEQ ID NO: 23551 - DNA, 201 bp, Homo sapiens
caaatgatgaatggataagcaaaatgtgatatatccatataattgagacttattcaacaatagaaaagagtggagtatggatacatgctacaacatggatraatcttgaagacataatgtaagaagccagtcacaaaaggccatatgccgtatgattccatttatatgaaatgttcagactaggcaaattcacagagacag

SEQ ID NO: 23552 - DNA, 201 bp, Homo sapiens; identical to SEQ ID NO: 3236

SEQ ID NO: 23553 - DNA, 201 bp, Homo sapiens; identical to SEQ ID NO: 3237

SEQ ID NO: 23554 - DNA, 201 bp, Homo sapiens
tgtttatttaacagatccctaatcatcaaattgttgattgaaagactgatcataaaccaatgctggtattgcaccttctggaactatgggcttgagaaaayccccaggatcacttctccttggcttccttcttttctgtgcttgcatcagtgtggactcctagaacgtgcgacctgcctcaagaaaatgcagttttcaaaa

SEQ ID NO: 23555 - DNA, 201 bp, Homo sapiens
ctctctctctcttctataatttctttttctttttatttttgagatgaagtcttgctctgtcgcccaggctggagtgcagtgacacaatctcggctcactgyaacctctgcctccccggttcaagcaattctccctcctgcctcagcctcccaagtagctgggactacaagcgcccgccaccaagcctggctaattctgtat

SEQ ID NO: 23556 - DNA, 201 bp, Homo sapiens
agctgtccagcatggtcctggaactcaggggcctgcgcaccattgtgaccacgctgcaggacagcatccgcaaagtggtcagtggcctctgcacccagccygttagcatgaaccctggaaggtttatcgcagatggtcccaaatgactgaaaatgcggggggacactaatgatattctctcccatttagactgaagagaac

SEQ ID NO: 23557 - DNA, 201 bp, Homo sapiens
tccttaattacacgcaattttaaaactagctgtaactgacagccctttcctcacacttactgccaatgtatttaggtcaatcccacctccaattagagaawcttagaaaaaggaaatcctacggtgaaatgccatatgccttacaattttcagtaactaatcctcaaggatgacaacttggcaaaaaagagaactggacca

SEQ ID NO: 23558 - DNA, 201 bp, Homo sapiens
aacatattcagagagaaatgaatttatgatgtcttcaatttgaagatgctatgattttagactattctagaatacaatgatttttcattgcttcacacttstaagaaatgttccactactgaaaatttgcaacacttaaaaaattcctacacaaaatcacagcccaccttgctgttctatgctaaataaacaaaatatttt

SEQ ID NO: 23559 - DNA, 201 bp, Homo sapiens
ggcctggaagttttgcccctttcatctgtagggataagagggcctaagagaatagcagcaatctgagctctagagcaccaaaagaaataaggcacgatatygttccatggcacgttatccctggcttttgttaccagtaaaatgaatgactttgctgagacaatacttagtgtagcaggtacaagttataaaagtgattca

SEQ ID NO: 23560 - DNA, 201 bp, Homo sapiens
tcacaaaccaactcatcaggacaccccaagatttccttactctctgaagtcctccttaagcctttgtatcagcactccagggaagagtctgtacttccccgtgccctccctgcaaccccaaactacagttcctgatcttgctcaccttcgacttcccaaaagcccccaaattgttggtcttgcgccccccacactttaaaa

SEQ ID NO: 23561 - DNA, 201 bp, Homo sapiens; identical to SEQ ID NO: 3219

SEQ ID NO: 23562 - DNA, 201 bp, Homo sapiens
catgtacaccatggtgaccatagttaataatactggattgtatgcttaaaatttgctaagagagtagatcttaagtcatcaccaaaaaaagtaactgtaaratgatggagatgtgttaattagcttgacggtggtaatcacaatatatgtgtatatcaaaacatcacattatacaccttaaatgtatataatatttgtcaa

SEQ ID NO: 23563 - DNA, 201 bp, Homo sapiens
gaataagaatcgacggcttttgtttgaacctacatctttggggaaataccctaatcgccacagagattctttttatgttccatggcctgataacaaagtgttttttttttctttaagatgcaattatggcatctataagttcttctttaaactctcagatggtttatcaaagtattaattataccccaggctaagtatcta

SEQ ID NO: 23564 - DNA, 201 bp, Homo sapiens
tcagtaaagccaaaaagaaataaatatattgcttttcaccctctggcaagtggagggccctgaacagagccctctaaagaacagcttgtcctaatcatcaygtacctgatgaacctctgtttcccctgcagccagcgactctgcggacgatggctggtctccatggtccgagtggacctcctgttctacgagctgtggcaa

SEQ ID NO: 23565 - DNA, 201 bp, Homo sapiens
gctggagccactggtccccgtggtcatcttgttctgtgacatgtggtgatggtgtgatcacaaggatccggctctgcaactctcccagcccccagatgaaygggaaaccctgtgaaggcgaagcgcgggagaccaaagcctgcaagaaagacgcctgccccagtaagtgtgaggtccgctgcaagggtgagcatgggcagc

SEQ ID NO: 23566 - DNA, 201 bp, Homo sapiens
tacagtcaatggaggctggggtccttggtcaccatgggacatctgttctgtcacctgtggaggaggggtacagaaacgtagtcgtctctgcaacaaccccrcaccccagtttggaggcaaggactgcgttggtgatgtaacagaaaaccagatctgcaacaagcaggactgtccaattggtgagccacgcagcccaggatg

SEQ ID NO: 23567 - DNA, 201 bp, Homo sapiens
agttttgcccctttcatctgtagggataagagggcctaagagaatagcagcaatctgagctctagagcaccaaaagaaataaggcacgatatcgttccatrgcacgttatccctggcttttgttaccagtaaaatgaatgactttgctgagacaatacttagtgtagcaggtacaagttataaaagtgattcattacaact

SEQ ID NO: 23568 - DNA, 201 bp, Homo sapiens
ttcttacagtcaatggaggctggggtccttggtcaccatgggacatctgttctgtcacctgtggaggaggggtacagaaacgtagtcgtctctgcaacaaycccgcaccccagtttggaggcaaggactgcgttggtgatgtaacagaaaaccagatctgcaacaagcaggactgtccaattggtgagccacgcagcccag

SEQ ID NO: 23569 - DNA, 201 bp, Homo sapiens
atggaattcagcagcgcggccgctcctgcgatagcctcaacaaccgatgtgagggctcctcggtccagacacggacctgccacattcaggagtgtgacaaragatgtaagcatcttagcctctcagggacgtggagaactgacctgtccttgttgtcgtcaccaagggcagctccacagcatgtatattaagaacacgggt

SEQ ID NO: 23570 - DNA, 201 bp, Homo sapiens
aacagatccctaatcatcaaattgttgattgaaagactgatcataaaccaatgctggtattgcaccttctggaactatgggcttgagaaaacccccaggaycacttctccttggcttccttcttttctgtgcttgcatcagtgtggactcctagaacgtgcgacctgcctcaagaaaatgcagttttcaaaaacagactca

SEQ ID NO: 23571 - DNA, 201 bp, Homo sapiens
atgtatattaagaacacgggttctaggatctctggatcccaatcccactgcttagctgtgcacccttgaacacaacttaccctctctgaggctctttcctsatttgcaacttggagataataatagttcttgataagtttatcttgagcattttatttagatactgcatgtaaagcagttagcactgagttttggtttatg

SEQ ID NO: 23572 - DNA, 201 bp, Homo sapiens
ttttcaccccaaccctttgtctccacccctaaggactcagccccctactgctggtcccagcctagaaagctcactttgtgttctctcctgtctaacagagkctggcggagacaacagcgtgtttgacatctttgaactcaccggggccgcccgcaaggggtctgggcgccgactggtgaagggccccgacccttccagccc

SEQ ID NO: 23573 - DNA, 201 bp, Homo sapiens
tctgaggctctttcctcatttgcaacttggagataataatagttcttgataagtttatcttgagcattttatttagatactgcatgtaaagcagttagcaytgagttttggtttatggtaagcaccctgtaaatgttaggatattaacagcaacccataaaaacagcgaacttatccgttctctggtagaaaacattccat

SEQ ID NO: 23574 - DNA, 201 bp, Homo sapiens
acaacaacgtggtgaatggttccagccctgccatccgcactaactacattggccacaagacaaaggacttgcaagccatctgcggcatctcctgtgatgarctgtccagcatggtcctggaactcaggggcctgcgcaccattgtgaccacgctgcaggacagcatccgcaaagtggtcagtggcctctgcacccagcccg

SEQ ID NO: 23575 - DNA, 201 bp, Homo sapiens
gatgggagcctctatttggctgtctctaagccaaaaccatttgtgaccatcaactctgtactttagttaaacaggatggtggctggagccactggtccccrtggtcatcttgttctgtgacatgtggtgatggtgtgatcacaaggatccggctctgcaactctcccagcccccagatgaacgggaaaccctgtgaaggcg

SEQ ID NO: 23576 - DNA, 201 bp, Homo sapiens
cacgcaattttaaaactagctgtaactgacagccctttcctcacacttactgccaatgtatttaggtcaatcccacctccaattagagaaacttagaaaarggaaatcctacggtgaaatgccatatgccttacaattttcagtaactaatcctcaaggatgacaacttggcaaaaaagagaactggaccagctccctgaa

SEQ ID NO: 23577 - DNA, 201 bp, Homo sapiens
ttgaacacaacttaccctctctgaggctctttcctcatttgcaacttggagataataatagttcttgataagtttatcttgagcattttatttagatactkcatgtaaagcagttagcactgagttttggtttatggtaagcaccctgtaaatgttaggatattaacagcaacccataaaaacagcgaacttatccgttct

SEQ ID NO: 23578 - DNA, 201 bp, Homo sapiens
agctataatattagtttgcttagcaatctctgtgctcctcatacacagtgcaaaggtaagctgcagaaaagctcctatataatttggacttcattaataayactgttctttacaattatatatttatatatcttactgcttattgttttatgcatgccatcacagcacgagttagcattcccaacttttccctgtatacaa

SEQ ID NO: 23579 - DNA, 201 bp, Homo sapiens; identical to SEQ ID NO: 3235

SEQ ID NO: 23580 - DNA, 201 bp, Homo sapiens
actggacttccaattctaatgccaactcatcttatggaatgtcaacacaaaattttctcatgaatctaagttactgacttgtaactaaaccatctctcttmaaatagtaccgcagactgtcttttaaagtagctcatctttatttgatgcaatctaaaaggcccaaactctgaaagaaaataagaaactattgttaactat

SEQ ID NO: 23581 - DNA, 201 bp, Homo sapiens
taaatcgatgaatgaatggatggcagatggatgatgaatgaatagcatggagccttggggttttaaagcatggctgcacagcagaatcacccagaccctgwtctcagaaactgacttaaatgactgctgccagaacccacccctagaaattgacttaattcatctgggatggaaccaagctgctaatctgttttaaatctc

SEQ ID NO: 23582 - DNA, 201 bp, Homo sapiens
acactaagccctaaagggaaatccaaaataaaaacatctatttttaataacactttctatctaaatcagggtgactttttaaaaaaaatccggaagctttktgttgaattacgttacagacttagttaccagtccttgttagagttaccttcagttgacatgctgtgaatggtcccacctcttttatggcagaattcatta

SEQ ID NO: 23583 - DNA, 201 bp, Homo sapiens
gtttaagtgctaagatgggaggtgaaccccaggggtttccccctgcccgtgctgagatccttatttggtcaagcttctacctatgccctggcctcggagcsagcccgatagcgctggatcacagcagagggagcgaggcggctgacgtcccatcccgaagagatgaatggaattccaggaagctagagtcatgctggcttg

SEQ ID NO: 23584 - DNA, 201 bp, Homo sapiens
ggaacagtgtaattctatggcaactgacaatcccaacagtaagccaacacagcaccacccccaggagcaacagcaagtgtttgagtgggttcaaaagagakttggggaactagggggattggggctgcacgtgacgaggagaaagggtgtgggataacatgggttggccttggttgataggctatgtccagtctctgctgc

SEQ ID NO: 23585 - DNA, 201 bp, Homo sapiens
tatcttcatctttctttcatgtattcatcaatttccatctcagcgtctcctctctctattgccatctaccccctgttctggtgttctgggctgccctggarccctaagagacctcaacccaaggcccagtcctggaggaacccccaactttaaggagatggacctggatagagatatccccaacttcatgggatcaggaaa

SEQ ID NO: 23586 - DNA, 201 bp, Homo sapiens
tctggtgcatagcaggtgcccagaaggtgtctgtttctatgtttccatcaccaaagccctgtaaacacaagagggtcatgacaacaatttcatagtagctrttgctgataagaaaccacctgaaaactcattggtttaaaccaataagtgtttatgtttgctaataagtctttgggacagttggcaggttcttctgtatat

SEQ ID NO: 23587 - DNA, 201 bp, Homo sapiens; identical to SEQ ID NO: 3318

SEQ ID NO: 23588 - DNA, 201 bp, Homo sapiens
gggccattgctctttctcactgagccttggtttcctcatctgtaaaatggggataataatccctacttaaaagatggtcagagtaatgtaatggagtcacrtctctggtgcatagcaggtgcccagaaggtgtctgtttctatgtttccatcaccaaagccctgtaaacacaagagggtcatgacaacaatttcatagtag

SEQ ID NO: 23589 - DNA, 201 bp, Homo sapiens
caagctttgcccacagctggggttgctgtgctgcctccagctgaacacgtgaccgatgtgcagacaggaggggctgtggtggagatgccattgcctccatygcccctggacttccacctgtctaacctctgttgctgtttgctcatgtctggggcgtgtctctacaatggctgttatatggccaggtctgccttgtatatt

SEQ ID NO: 23590 - DNA, 201 bp, Homo sapiens
tccccacgtgcatcaagcctgtgctctttgctccaggtagacattgcactggccaagctttgcccacagctggggttgctgtgctgcctccagctgaacaygtgaccgatgtgcagacaggaggggctgtggtggagatgccattgcctccatcgcccctggacttccacctgtctaacctctgttgctgtttgctcatgt

SEQ ID NO: 23591 - DNA, 201 bp, Homo sapiens
ggggcacaaagaagtttgttggttaaggattcaggccatgggtgcagacagacctagtcttaggcctcaggcttgccgtggtctgggactgtgggcaagtractttattgttcagagcctcaggctcttcatctggaaaatgggatgaatgagagcccagggaacatggtgtgtggatccacatggggaaagaccttttct

SEQ ID NO: 23592 - DNA, 201 bp, Homo sapiens
ctcatgttaggaattgtcatgtattttgtggccatgtcaggacatgtgaacacatgtcagggtcatgtctcatgtccaggtccatgtcagaagatgccatrtcagaagatgtcagagagtgctgggacagacagggtgtcctaggtccttgtgaagcattctgtagaatgctgagctgtgctcaggggttgcggaacatgt

SEQ ID NO: 23593 - DNA, 201 bp, Homo sapiens
agtcttggtaggcctgggtcttccagagctactgttttgggggcacaaagaagtttgttggttaaggattcaggccatgggtgcagacagacctagtcttrggcctcaggcttgccgtggtctgggactgtgggcaagtgactttattgttcagagcctcaggctcttcatctggaaaatgggatgaatgagagcccaggg

SEQ ID NO: 23594 - DNA, 201 bp, Homo sapiens
ttcccagaaatggcccatgatttacttctcctggcctggatcacaggaccaatttttcacccaatccctgtgtctctgattgcccagtcttggtaggcctrggtcttccagagctactgttttgggggcacaaagaagtttgttggttaaggattcaggccatgggtgcagacagacctagtcttaggcctcaggcttgcc

SEQ ID NO: 23595 - DNA, 201 bp, Homo sapiens
ggccacctttcccctagagttcccagaaatggcccatgatttacttctcctggcctggatcacaggaccaatttttcacccaatccctgtgtctctgattkcccagtcttggtaggcctgggtcttccagagctactgttttgggggcacaaagaagtttgttggttaaggattcaggccatgggtgcagacagacctagt

SEQ ID NO: 23596 - DNA, 201 bp, Homo sapiens
caacgatgagtcccagaagctcagttcttatgggaaaggccacctttcccctagagttcccagaaatggcccatgatttacttctcctggcctggatcacrggaccaatttttcacccaatccctgtgtctctgattgcccagtcttggtaggcctgggtcttccagagctactgttttgggggcacaaagaagtttgttg

SEQ ID NO: 23597 - DNA, 201 bp, Homo sapiens
gacattggtctgggcaaggattttttttttggtaagacctcaaaagcacaggcaacaaaagcaaatagacaaacggggtcatacgaaaccaaaaagcttcygcacagcaaagaaacaaatcaacaaagtgaagagacaacctacagaatgagaaaaaatatttgcaaatcatccatctgacaagggattagtaattagaat

SEQ ID NO: 23598 - DNA, 201 bp, Homo sapiens
ctgtctttctctcttggctttagctttctccatgtcgcttttcctatcaaggtggccttttcctcatgatgtcaacgatgagtcccagaagctcagttctyatgggaaaggccacctttcccctagagttcccagaaatggcccatgatttacttctcctggcctggatcacaggaccaatttttcacccaatccctgtgt

SEQ ID NO: 23599 - DNA, 201 bp, Homo sapiens; identical to SEQ ID NO: 3289

SEQ ID NO: 23600 - DNA, 201 bp, Homo sapiens; identical to SEQ ID NO: 3290

SEQ ID NO: 23601 - DNA, 201 bp, Homo sapiens; identical to SEQ ID NO: 3294

SEQ ID NO: 23602 - DNA, 201 bp, Homo sapiens
ctttatccattcagttgatgggcacttaggttgattccatattttggctgttttgaatagtgctgcaataaatacggaagtatagatatctcttcaacagwtttattttctttctttgggatagaaatttcttctctttcttttcagtagtggaatttctgggttatatgttagttctacttttagtttcttgaggaacct

SEQ ID NO: 23603 - DNA, 201 bp, Homo sapiens
ctcaggtaccatctggaacagctggtggggcagtgcatttgaggcctgcacttccgctatccccaagctcctgtgtgggccctgcagtactctggcctctsctttccttccctctcagctatcttcatctttctttcatgtattcatcaatttccatctcagcgtctcctctctctattgccatctaccccctgttctggt

SEQ ID NO: 23604 - DNA, 201 bp, Homo sapiens
cgtctccagggggataagattctctagatttatcactctagaatgtgggcaaatctttgaagcaatacttaatctctaatttccaagggaaattgccattkaattctcctgtaactcaggttgccagtaactttttctcagaaacttttcattaaaatattcatgggtcattgagtcttcccagtaggaacccaagaggag

SEQ ID NO: 23605 - DNA, 201 bp, Homo sapiens
tgactttatgtgtgtgtgtctgtgtctatatctgtgttatgtctatgtttatgtgtatttgtgtgtctgtgtcagtttctaagtctatgactttgtctatrtgtgtttgtgtctgtgtctatgtctttgtctatgtgtaggtctattgtgacagatgcattaaacctctagatcagagcagcccatgtcttgctcacagca

SEQ ID NO: 23606 - DNA, 201 bp, Homo sapiens
cttctacagcttcctggagccctggctgggtgagtatctgcaggtgaacagggttgggaaaaacgttggggggccaggggagggagaggtccttgcccatkgcccttggctgccctgctaggggatgggctcctgctgagtgctggtgacaagtggagccgccaccgtcggatgctgacgcctgccttccatttcaacatc

SEQ ID NO: 23607 - DNA, 201 bp, Homo sapiens
caaaggacaagttcttctacagcttcctggagccctggctgggtgagtatctgcaggtgaacagggttgggaaaaacgttggggggccaggggagggagasgtccttgcccatggcccttggctgccctgctaggggatgggctcctgctgagtgctggtgacaagtggagccgccaccgtcggatgctgacgcctgcctt

SEQ ID NO: 23608 - DNA, 201 bp, Homo sapiens
gtagagccaagtggtctgttttgacagggcgctgattggtgcgtttacaatccttgagctagacacaaaggttctccacgtccccaccagactcagaagcmcagctggcttcacccagtggatcccgcaccggggctgcaggtggagctgcctgccagtcccgcgccgtgcgctcgcactcctcagcccttgggtggtcga

SEQ ID NO: 23609 - DNA, 201 bp, Homo sapiens
tggggatatgggctgctggtgggtggggccctggcaggcagtcatccacatctttctccccacgtgcatcaagcctgtgctctttgctccaggtagacatygcactggccaagctttgcccacagctggggttgctgtgctgcctccagctgaacacgtgaccgatgtgcagacaggaggggctgtggtggagatgccatt

SEQ ID NO: 23610 - DNA, 201 bp, Homo sapiens
ctgacagaaggtgccaggctgggggtggcaggcctggggggggtcctggcctgggatggagaggggcactgcccaaggcccacgcagctcctgggtgctgscctggaggatgggtggtttccgagtaactgaaaccaagcccctggcaacctcacagtgattcaggctgggcctttctggactttaatcagtctctctctc

SEQ ID NO: 23611 - DNA, 201 bp, Homo sapiens
ttgcaaagagtgaaagaacaaagcttccacagtgtggaagggggcctgagcgggttgccactgctggctcgggcagcctgcttttattctcttatctggcyctacctatgtcctgctgattggtagagccaagtggtctgttttgacagggcgctgattggtgcgtttacaatccttgagctagacacaaaggttctccac

SEQ ID NO: 23612 - DNA, 201 bp, Homo sapiens
acatggggaaagaccttttctgtctgtgtaactgaaggactggagagtcctgcatggaggatgtgaggaggcagggggtgctcagcactgacaggaggatkagatgctgcttgaaattctcagggagagggcttcgacctcttccctgcagatccttctctctcacagcctaggagagcatgaattgggtcctgtgtgttt

SEQ ID NO: 23613 - DNA, 201 bp, Homo sapiens
acagtgattcaggctgggcctttctggactttaatcagtctctctctctctttcccattctaagtgcttactagggaactggaggccacttggctgctggwtttggttgggcctttctggactttacctctcagcccctttttacccatccctgagccctccctgctctacctccggcactgcccgtccctgcctctccac

SEQ ID NO: 23614 - DNA, 201 bp, Homo sapiens
tgggatcaggaaagggccagagggagatggatcacagcccagggaagaacaaggtctctgctggggcaggctggaaggcttcctagaggaggagttactgsagctgtgtctggaacaatgagtaggaatgtttgaaaggagagtgcagggtgaggcaattggacatcgttagtattcaaggccccttgccaggcctagcat

SEQ ID NO: 23615 - DNA, 201 bp, Homo sapiens
ggcacgtaggtagatagataatagaatagatggatgcatggacacatggatgcacagatagcatggatggatggatggatggatggatggatggatggatrgatagatagacaaataataggacatatggatgcatggacacacggatgcacagataggatggatggatggatggatgatggatggatgggtagatagagt

SEQ ID NO: 23616 - DNA, 201 bp, Homo sapiens
tgggatggctggggcatattatcagtgtatgtttaccatgatgagaaactatcaaactgtttccaaaaggtccatgtcatttttaattcctatcaggaatrtattgaagtggcgttgttgtctggggtaaatacccaatgttcatcatctcacatcaaggaaatcaaggacaccgacacacaagaagtaagcttaagagtt

SEQ ID NO: 23617 - DNA, 201 bp, Homo sapiens
ccaggatggggctcctgggtgcagtcagagttcccacctccctcccctaggaactgcatcgggcagacgttcgcgatggcggagatgaaggtggtcctggsgctcacgctgctgcgcttccgcgtcctgcctgaccacaccgagccccgcaggaagccggagctggtcctgcgcgcagagggcggactttggctgcgggtg

SEQ ID NO: 23618 - DNA, 201 bp, Homo sapiens
gggcttctgagagagttggtgatgatatgtgaggacagataacgccacttagcacgtgttcagcaaatgaacttcccctccactctcttcctttcctcccmgaaatatcattttttttgaacatcttcacttcttgaatgtttgctcttctgttccctaattcctactctccagtcgagtccagggttttataagggagac

SEQ ID NO: 23619 - DNA, 201 bp, Homo sapiens
cactggaaatctgtctttctctcttggctttagctttctccatgtcgcttttcctatcaaggtggccttttcctcatgatgtcaacgatgagtcccagaasctcagttcttatgggaaaggccacctttcccctagagttcccagaaatggcccatgatttacttctcctggcctggatcacaggaccaatttttcaccca

SEQ ID NO: 23620 - DNA, 201 bp, Homo sapiens
tcaggcatggctggatccaggtctcacacaaggtcactggaaatctgtctttctctcttggctttagctttctccatgtcgcttttcctatcaaggtggcsttttcctcatgatgtcaacgatgagtcccagaagctcagttcttatgggaaaggccacctttcccctagagttcccagaaatggcccatgatttacttct

SEQ ID NO: 23621 - DNA, 201 bp, Homo sapiens
ttcaggcatggctggatccaggtctcacacaaggtcactggaaatctgtctttctctcttggctttagctttctccatgtcgcttttcctatcaaggtggmcttttcctcatgatgtcaacgatgagtcccagaagctcagttcttatgggaaaggccacctttcccctagagttcccagaaatggcccatgatttacttc

SEQ ID NO: 23622 - DNA, 201 bp, Homo sapiens
aagtccagggagggtggccttcaggcatggctggatccaggtctcacacaaggtcactggaaatctgtctttctctcttggctttagctttctccatgtcrcttttcctatcaaggtggccttttcctcatgatgtcaacgatgagtcccagaagctcagttcttatgggaaaggccacctttcccctagagttcccagaa

SEQ ID NO: 23623 - DNA, 201 bp, Homo sapiens
ggaaacccaacctggtgtggtctaagcaaagaaagataatctattgactttaaagtccagggagggtggccttcaggcatggctggatccaggtctcacayaaggtcactggaaatctgtctttctctcttggctttagctttctccatgtcgcttttcctatcaaggtggccttttcctcatgatgtcaacgatgagtcc

SEQ ID NO: 23624 - DNA, 201 bp, Homo sapiens
tgggctggtacccagctgtctctggttattgaagtctctttcagttgtgagtggtggaaacccaacctggtgtggtctaagcaaagaaagataatctattkactttaaagtccagggagggtggccttcaggcatggctggatccaggtctcacacaaggtcactggaaatctgtctttctctcttggctttagctttctc

SEQ ID NO: 23625 - DNA, 201 bp, Homo sapiens
gttgctctcctgctgcaggtcccggggatctccaagaggagactccaccccagcttgggtccctttccttgacccctgtgcttcccatcgttggacgggcraggctgagcagggggaatgggcagcatcctacagagaccatggctctgacctcaaaatgctgagtgactctgggctggtacccagctgtctctggttatt

SEQ ID NO: 23626 - DNA, 201 bp, Homo sapiens
attccctttaccccatcctatagcttgtctgccctaagttcgttgctctcctgctgcaggtcccggggatctccaagaggagactccaccccagcttgggwccctttccttgacccctgtgcttcccatcgttggacgggcgaggctgagcagggggaatgggcagcatcctacagagaccatggctctgacctcaaaatg

SEQ ID NO: 23627 - DNA, 201 bp, Homo sapiens
atggattgatggatagatgggtaggcagatagatatatagatagaaaaattagatagataggatgaatagattagacacacccagaaataatgtttgaccractacctgggcatcccttagcccagtcaagtagacacctagaattaactatcacagaaggtaatgacccctgccttgcttgcaggtcaaccccacagagg

SEQ ID NO: 23628 - DNA, 201 bp, Homo sapiens
cctctcctttccttccctctcagctatcttcatctttctttcatgtattcatcaatttccatctcagcgtctcctctctctattgccatctaccccctgtkctggtgttctgggctgccctggaaccctaagagacctcaacccaaggcccagtcctggaggaacccccaactttaaggagatggacctggatagagatat

SEQ ID NO: 23629 - DNA, 201 bp, Homo sapiens
atggctattaatagatgataagcagacagacagatgaatatatggatggatgaaagcacagataaaatggattgatggatagatgggtaggcagatagatrtatagatagaaaaattagatagataggatgaatagattagacacacccagaaataatgtttgaccaactacctgggcatcccttagcccagtcaagtaga

SEQ ID NO: 23630 - DNA, 201 bp, Homo sapiens
gaaagataatctattgactttaaagtccagggagggtggccttcaggcatggctggatccaggtctcacacaaggtcactggaaatctgtctttctctctwggctttagctttctccatgtcgcttttcctatcaaggtggccttttcctcatgatgtcaacgatgagtcccagaagctcagttcttatgggaaaggccac

SEQ ID NO: 23631 - DNA, 201 bp, Homo sapiens
tgttataagtaaagttttggtgccgcaaaagaaatatcactcaaatataaaattttctttttaattctcagcaaggaaaggtacttctatagaagggtgcrcccttacagatggagcaatggtgagctcacacttggacaagggaggggaaggggttcttatccttgatgcatgtggcccctgctgctgtgtcgttcctct

SEQ ID NO: 23632 - DNA, 201 bp, Homo sapiens
tagggggtatagaaagtgtctcagttgagagcctaaataatgatcagtagataattgggtacagttggggggcagtgctctaggtcaagaagactgcctgkggtctttgggggaggaagagagagggaggaagagagagaggagagcgagggagagagagagaaggagagagagagagagcagggtcaggacagaaaggag

SEQ ID NO: 23633 - DNA, 201 bp, Homo sapiens
catgttaggaattgtcatgtattttgtggccatgtcaggacatgtgaacacatgtcagggtcatgtctcatgtccaggtccatgtcagaagatgccatatsagaagatgtcagagagtgctgggacagacagggtgtcctaggtccttgtgaagcattctgtagaatgctgagctgtgctcaggggttgcggaacatgttg

SEQ ID NO: 23634 - DNA, 201 bp, Homo sapiens
taggaattgtcatgtattttgtggccatgtcaggacatgtgaacacatgtcagggtcatgtctcatgtccaggtccatgtcagaagatgccatatcagaakatgtcagagagtgctgggacagacagggtgtcctaggtccttgtgaagcattctgtagaatgctgagctgtgctcaggggttgcggaacatgttggatcg

SEQ ID NO: 23635 - DNA, 201 bp, Homo sapiens
ggtcttccagagctactgttttgggggcacaaagaagtttgttggttaaggattcaggccatgggtgcagacagacctagtcttaggcctcaggcttgccrtggtctgggactgtgggcaagtgactttattgttcagagcctcaggctcttcatctggaaaatgggatgaatgagagcccagggaacatggtgtgtggat

SEQ ID NO: 23636 - DNA, 201 bp, Homo sapiens
aaccttcccatcccccttcccccatcctccctgaggccctcaatgcatgggtgctgtctaccttcgggtgctgaagcagcccagagacccaagcctgcctkgctgccccccaggccatgacaccacggccagtggtctctcctgggtcctgtaccatcttgcaaagcacccagaataccaggagcgctgccggcaggaggt

SEQ ID NO: 23637 - DNA, 201 bp, Homo sapiens
ataaaagtgttttgtctcactttgtaagaattagcttcatatacattgactattagtaacaaattgagttattcttcatcaagtaacttttggggtagagrtctcattttcacagcaatagatgcacaaatattcatgtaagatacaggtgtggttagacacctttcatagaacagttatgatctggaaattccacagaca

SEQ ID NO: 23638 - DNA, 201 bp, Homo sapiens
catgtttgggttctctcacgtgtctaggtttggcctcatctgggacccctggatgttcctccctatgattgtctccttccagaaggcgcgccatggttcayaatgcaggcagggttccaaggagtaagacaaggcttagcttcgttagttattaactcatcattttcaccacattgtattttgacatcgaaagccaaaagt

SEQ ID NO: 23639 - DNA, 201 bp, Homo sapiens
ccattgctggactcgaggcttcttatgcccactgtccagggtcctctccttgcctggactatttcctgttatgagggtacagctgggccagaggagaggcmtgggccgtctcccacttccactacacccgaaggcacctttctcttatattcttcttcttatctccctcttatcaatgagacctgttgccaaacccagata

SEQ ID NO: 23640 - DNA, 201 bp, Homo sapiens
taggtctcaggatggatggacttcctgaggggtacgaggcttagggagtgggggtgaaggggtgggctgggatctggggtggcagagaagcagaggaggcrtcttactcattcctctgcttattcatttctgtgaggtgcctacgcaagcccttctcacttccttgtcctcccactccaggcctgcattgaatccttttcc

SEQ ID NO: 23641 - DNA, 201 bp, Homo sapiens
atggagaggggcactgcccaaggcccacgcagctcctgggtgctggcctggaggatgggtggtttccgagtaactgaaaccaagcccctggcaacctcacagtgattcaggctgggcctttctggactttaatcagtctctctctctctttcccattctaagtgcttactagggaactggaggccacttggctgctggttt

SEQ ID NO: 23642 - DNA, 201 bp, Homo sapiens
gatggagaggggcactgcccaaggcccacgcagctcctgggtgctggcctggaggatgggtggtttccgagtaactgaaaccaagcccctggcaacctcacagtgattcaggctgggcctttctggactttaatcagtctctctctctctttcccattctaagtgcttactagggaactggaggccacttggctgctggtt

SEQ ID NO: 23643 - DNA, 201 bp, Homo sapiens
cagggtcctctccttgcctggactatttcctgttatgagggtacagctgggccagaggagaggcatgggccgtctcccacttccactacacccgaaggcayctttctcttatattcttcttcttatctccctcttatcaatgagacctgttgccaaacccagataaaagttggccactcacttcacctttcagaagctttc

SEQ ID NO: 23644 - DNA, 201 bp, Homo sapiens
ctggagtttgttctttctgatgttcagatgtgttcggagtttcttccttctggtgggttcgtggtctcgctggctcaggagtgaagctgcagactttcgcrgtgagtgttacagctcataaaagcagtgtgaacctaaagagtgagcagcagcaagatttattgcaaagagtgaaagaacaaagcttccacagtgtggaag

SEQ ID NO: 23645 - DNA, 201 bp, Homo sapiens
ttatgcccactgtccagggtcctctccttgcctggactatttcctgttatgagggtacagctgggccagaggagaggcatgggccgtctcccacttccacyacacccgaaggcacctttctcttatattcttcttcttatctccctcttatcaatgagacctgttgccaaacccagataaaagttggccactcacttcacc

SEQ ID NO: 23646 - DNA, 201 bp, Homo sapiens
ttatttaaagagactgtttaaggttagtcaagcagagtgacatacagaaaagaagactactattaaatcattggcaatatccctctgtattaggccactcytgtgttgctataaagaaatacctggctgggtatggtggctcatgcctgtaatcccagcattttaggatgccaaggtgggagaattgcttgaggcttggag

SEQ ID NO: 23647 - DNA, 201 bp, Homo sapiens
ggcattcccacattctccattgctggactcgaggcttcttatgcccactgtccagggtcctctccttgcctggactatttcctgttatgagggtacagctrggccagaggagaggcatgggccgtctcccacttccactacacccgaaggcacctttctcttatattcttcttcttatctccctcttatcaatgagacctg

SEQ ID NO: 23648 - DNA, 201 bp, Homo sapiens
agctggtgaagcgttccacctacttcttcagctgacacccggcgggccttgtgccagtgtgtaaataaagctcttttgccaccccctcaaaaaaaaaaaaagtctagtagaattaatcagtgaaccaattggggtcttggctttctgttttggaaggttattaattattgtttcaatcgatttaatagatataggcctatt

SEQ ID NO: 23649 - DNA, 201 bp, Homo sapiens
ttttcctgcctgtcttcccacattaatgcacctctgcggggctcctgggcagagggttggctgcacagagaggcgagtccctggcattcccacattctccrttgctggactcgaggcttcttatgcccactgtccagggtcctctccttgcctggactatttcctgttatgagggtacagctgggccagaggagaggcatg

SEQ ID NO: 23650 - DNA, 201 bp, Homo sapiens
cccagtaggaacccaagaggaggcaaggaagccagagaggaaggccatgaggtgagggctctggccatggtgaccaagaggggtctaggagtgcaagatgkacttggatttctggaaaaaggatgaatcttcagagactgtctcagattagactcaagagcccttagagctagtgtgactttttatgggggtgggggttgg

SEQ ID NO: 23651 - DNA, 201 bp, Homo sapiens
ggcctgcacttccgctatccccaagctcctgtgtgggccctgcagtactctggcctctcctttccttccctctcagctatcttcatctttctttcatgtaytcatcaatttccatctcagcgtctcctctctctattgccatctaccccctgttctggtgttctgggctgccctggaaccctaagagacctcaacccaagg

SEQ ID NO: 23652 - DNA, 201 bp, Homo sapiens
tggtaaaaattataacattgatagagaaatataggacccatatgcattatttaaatacctatataataatcataaaacatgtttatgccataagtgcaagrattgaaggacaatatgaaaagtgtagttaggtgaatcttacaaattatttaaagagactgtttaaggttagtcaagcagagtgacatacagaaaagaaga

SEQ ID NO: 23653 - DNA, 201 bp, Homo sapiens
ggctgggatctggggtggcagagaagcagaggaggcatcttactcattcctctgcttattcatttctgtgaggtgcctacgcaagcccttctcacttcctwgtcctcccactccaggcctgcattgaatccttttcctgcctgtcttcccacattaatgcacctctgcggggctcctgggcagagggttggctgcacagag

SEQ ID NO: 23654 - DNA, 201 bp, Homo sapiens
ctccctgctctacctccggcactgcccgtccctgcctctccactgtccctggaggtccctgggccgttctctgggcctcaggatctcaccgtccatcccgyctgccctgcaggatgtcccagctgagcctgtcctggctgggcctctggccagtggcagcatccccttggctgctcctcctgctggtcggggcctcctggc

SEQ ID NO: 23655 - DNA, 201 bp, Homo sapiens
ttttttgtttctttcttcttttcttctttctcttttcatttcttgtcatgtctgtctgtatttggcattaggtataatgctggcctcataaaatgaattargcaatatttcctctgcttctgtctttcaaaagacatggaagaaaattggtataattccttccttaaatgtttagtagatgcaacggcctacagcattatg

SEQ ID NO: 23656 - DNA, 201 bp, Homo sapiens
tccctgagccctccctgctctacctccggcactgcccgtccctgcctctccactgtccctggaggtccctgggccgttctctgggcctcaggatctcaccrtccatcccgtctgccctgcaggatgtcccagctgagcctgtcctggctgggcctctggccagtggcagcatccccttggctgctcctcctgctggtcggg

SEQ ID NO: 23657 - DNA, 201 bp, Homo sapiens
aggtttgtgagcaatattaatctgtatagtttttttgtttctttcttcttttcttctttctcttttcatttcttgtcatgtctgtctgtatttggcattargtataatgctggcctcataaaatgaattaggcaatatttcctctgcttctgtctttcaaaagacatggaagaaaattggtataattccttccttaaatgt

SEQ ID NO: 23658 - DNA, 201 bp, Homo sapiens
tctcagcccctttttacccatccctgagccctccctgctctacctccggcactgcccgtccctgcctctccactgtccctggaggtccctgggccgttctytgggcctcaggatctcaccgtccatcccgtctgccctgcaggatgtcccagctgagcctgtcctggctgggcctctggccagtggcagcatccccttggc

SEQ ID NO: 23659 - DNA, 201 bp, Homo sapiens
ttacctctcagcccctttttacccatccctgagccctccctgctctacctccggcactgcccgtccctgcctctccactgtccctggaggtccctgggccsttctctgggcctcaggatctcaccgtccatcccgtctgccctgcaggatgtcccagctgagcctgtcctggctgggcctctggccagtggcagcatcccc

SEQ ID NO: 23660 - DNA, 201 bp, Homo sapiens
ttttatggaagtggttcctttatttttttgctctttttctttggattctttaaaaatatttacttttaagaatgtgtattaaaattgattttttttttttragatgcagtctctatcgcccaggttggagtgcagtggtgtgatctcagctcactgcaacctccacctcccaggttcaagccattctcttgcctcagcctc

SEQ ID NO: 23661 - DNA, 201 bp, Homo sapiens
aattccctgaagtgcaattgctgaatcaaagaacatttgcactgtacaattttaattatcattgcaaatcctttcctattagctgagtttgatggcacaarttttcccataactttaccaatactactaatgtattattaaattttaaaatctatgccaatcttcatatttcttcttttgatggacattgttttaaataag

SEQ ID NO: 23662 - DNA, 201 bp, Homo sapiens
agagactgagttgtaatgagatgataaaaccggagatggtagcaggggctggctgtggaagccttggggaaaatgttaatggcttcagttttagcccaatrgcaatagggagccatgggaagtgtttgagcagtgtagggacaggtcacatctgggtaccaggaagatctttctagggctagtgtggagggcgtactggag

SEQ ID NO: 23663 - DNA, 201 bp, Homo sapiens
tgggccctgcagtactctggcctctcctttccttccctctcagctatcttcatctttctttcatgtattcatcaatttccatctcagcgtctcctctctcyattgccatctaccccctgttctggtgttctgggctgccctggaaccctaagagacctcaacccaaggcccagtcctggaggaacccccaactttaaggag

SEQ ID NO: 23664 - DNA, 201 bp, Homo sapiens
tgctggttttggttgggcctttctggactttacctctcagcccctttttacccatccctgagccctccctgctctacctccggcactgcccgtccctgccyctccactgtccctggaggtccctgggccgttctctgggcctcaggatctcaccgtccatcccgtctgccctgcaggatgtcccagctgagcctgtcctgg

SEQ ID NO: 23665 - DNA, 201 bp, Homo sapiens
ctggaggatgggtggtttccgagtaactgaaaccaagcccctggcaacctcacagtgattcaggctgggcctttctggactttaatcagtctctctctctytttcccattctaagtgcttactagggaactggaggccacttggctgctggttttggttgggcctttctggactttacctctcagcccctttttacccatc

SEQ ID NO: 23666 - DNA, 201 bp, Homo sapiens
tgctctttgctccaggtagacattgcactggccaagctttgcccacagctggggttgctgtgctgcctccagctgaacacgtgaccgatgtgcagacaggwggggctgtggtggagatgccattgcctccatcgcccctggacttccacctgtctaacctctgttgctgtttgctcatgtctggggcgtgtctctacaatg

SEQ ID NO: 23667 - DNA, 201 bp, Homo sapiens
gattggttggcccagcccaacccagccagccctcccacagcctttgctatatcaagggccagggtcaaaggcctcccagcagacagagagaggaggttgtytgggacagactgctcctgacagaaggtgccaggctgggggtggcaggcctggggggggtcctggcctgggatggagaggggcactgcccaaggcccacgc

SEQ ID NO: 23668 - DNA, 201 bp, Homo sapiens
tcctgctggtcggggcctcctggctcctggcccatgtcctggcctggacctacgccttctatgacaactgccgccgccttcggtgtttcccacaacccccragacggaactggttttggggacaccagggcatggtgagtgtggcagcaggatgggtctaggtctcaggatggatggacttcctgaggggtacgaggctta

SEQ ID NO: 23669 - DNA, 201 bp, Homo sapiens
caaggacatttggggcatgtgagggcctgtttggttcttgtctcaggtgctgtttgacactgccgttttctcctggtggtccaaacatctgggcgttgtgwgaggtctgggggttgtgtgaggtctgggacccagggtccctatgtgaactgtctgagacattatttgagtcttgtctgaggcatgtgttatagtatattt

SEQ ID NO: 23670 - DNA, 201 bp, Homo sapiens
gggattggttggcccagcccaacccagccagccctcccacagcctttgctatatcaagggccagggtcaaaggcctcccagcagacagagagaggaggttrtctgggacagactgctcctgacagaaggtgccaggctgggggtggcaggcctggggggggtcctggcctgggatggagaggggcactgcccaaggcccac

SEQ ID NO: 23671 - DNA, 201 bp, Homo sapiens
agcttcctggagccctggctgggtgagtatctgcaggtgaacagggttgggaaaaacgttggggggccaggggagggagaggtccttgcccatggcccttkgctgccctgctaggggatgggctcctgctgagtgctggtgacaagtggagccgccaccgtcggatgctgacgcctgccttccatttcaacatcctgaagc

SEQ ID NO: 23672 - DNA, 201 bp, Homo sapiens
agctgtacgtttatccattccatctatttatcctattatctatgtatctatctatcatctattaatagctatctatccatctgtctaatatatccattatmtatatctactttatctatctacctaatgtatccatcctatctactctatctatctgtgcatctacccatccatctggaccctgagctgattcctctgcac

SEQ ID NO: 23673 - DNA, 201 bp, Homo sapiens
catcttagctgtacgtttatccattccatctatttatcctattatctatgtatctatctatcatctattaatagctatctatccatctgtctaatatatcyattatctatatctactttatctatctacctaatgtatccatcctatctactctatctatctgtgcatctacccatccatctggaccctgagctgattcct

SEQ ID NO: 23674 - DNA, 201 bp, Homo sapiens
ccatcttagctgtacgtttatccattccatctatttatcctattatctatgtatctatctatcatctattaatagctatctatccatctgtctaatatatmcattatctatatctactttatctatctacctaatgtatccatcctatctactctatctatctgtgcatctacccatccatctggaccctgagctgattcc

SEQ ID NO: 23675 - DNA, 201 bp, Homo sapiens
ttgcttgagagtgactctgatcctgtttctgatggtcatgttcctcagcatcatactgagtaagtcactggccttgtagcatctggagtgattggagtgayccaagatccctagttcccatgtcacaaatgaggatcccacatatctgggacagagatggaacattatttctgggtgtgtctatctaatctattcacccta

SEQ ID NO: 23676 - DNA, 201 bp, Homo sapiens
cagaaagaaacctagcataagaaatttcacgcttaatgggccaaagagtaaatcagaaaactccatgggtgatggtatgctcatggtggtggtggtggtgwtggggaattatttgccctcctgtgacctcccttggattaatttctccccaggacaatgggaaaaatcatttaatccttggagtttttttttttttttttt

SEQ ID NO: 23677 - DNA, 201 bp, Homo sapiens
gcagctgatgtctccatcatgaaccaggtgtgccgggagcagtttgcttgcacagcgagtccatcctgcaggacctgtccaggttcctggtcaggcggttytgctctgagccccagaagatcttggaggccagccagatgaaggagacactgcaggtggtgcccaagccaggggccttcgacctggagctggtgaagcgtt

SEQ ID NO: 23678 - DNA, 201 bp, Homo sapiens
gcatctaggtttgtgagcaatattaatctgtatagtttttttgtttctttcttcttttcttctttctcttttcatttcttgtcatgtctgtctgtatttgscattaggtataatgctggcctcataaaatgaattaggcaatatttcctctgcttctgtctttcaaaagacatggaagaaaattggtataattccttcctt

SEQ ID NO: 23679 - DNA, 201 bp, Homo sapiens
aagtcaaaaccatgataagatgtcatctcacccctgttaacatatgtaattatttttatacattgttggatttgatttgatattttcttgaggattttgcrtctaggtttgtgagcaatattaatctgtatagtttttttgtttctttcttcttttcttctttctcttttcatttcttgtcatgtctgtctgtatttggca

SEQ ID NO: 23680 - DNA, 201 bp, Homo sapiens
gttgtggcaaacaaaataagttttctttctttttttttttttaaggctgaatggtattccattgtatatacacaccacatggaaaatgagcattaaattayaaaaccagtgataagaacagattcttcttgcaccaaatgagatattacagataagactagctttttccttgacaatcctgccaccccacctaatcctttc

SEQ ID NO: 23681 - DNA, 201 bp, Homo sapiens
tcaatttccatctcagcgtctcctctctctattgccatctaccccctgttctggtgttctgggctgccctggaaccctaagagacctcaacccaaggcccwgtcctggaggaacccccaactttaaggagatggacctggatagagatatccccaacttcatgggatcaggaaagggccagagggagatggatcacagccc

SEQ ID NO: 23682 - DNA, 201 bp, Homo sapiens
aaagagaatgagagagacagagaaagagagagagagagattgagtgagaatggtagctttgtgagagatggtgtgctttgttctggagcataaacaaatcytcttcagtgagatgccatagtccttagccttacaacccaaacgtctccagggggataagattctctagatttatcactctagaatgtgggcaaatctttg

SEQ ID NO: 23683 - DNA, 201 bp, Homo sapiens
tctaccttcgggtgctgaagcagcccagagacccaagcctgccttgctgccccccaggccatgacaccacggccagtggtctctcctgggtcctgtaccaycttgcaaagcacccagaataccaggagcgctgccggcaggaggtgcaagaacttctgaaggaccgtgagcctaaagagattgaatggtgagtgcaggtgc

SEQ ID NO: 23684 - DNA, 201 bp, Homo sapiens
tggcagttggggttggagaggtgctcaagggagcaaggagcctgccccagctctgtccccttctctggctaggccaagtggcagctcctggcctcagaggdtagtgcctgtttggatatgtttgagcacatcagcctcatgaccttggacagtctacagaaatgtgtcttcagctttgacagccattgtcaggagtaagtt

SEQ ID NO: 23685 - DNA, 201 bp, Homo sapiens
gagaaattttccatgttaaggacatcagtgtcttgcattcatgacatgcccagaaagaatgctcaggactcaacgaaggactacctccccaaaaacagggatatttttgaaatcaatttataacaatgcagacggggaaatccaacatttattgatcacataccatatgccagaaacaatgccatgtgcccattccatgat

SEQ ID NO: 23686 - DNA, 201 bp, Homo sapiens
cttgggtccctttccttgacccctgtgcttcccatcgttggacgggcgaggctgagcagggggaatgggcagcatcctacagagaccatggctctgacctmaaaatgctgagtgactctgggctggtacccagctgtctctggttattgaagtctctttcagttgtgagtggtggaaacccaacctggtgtggtctaagca

SEQ ID NO: 23687 - DNA, 201 bp, Homo sapiens
aaaataaaatacccagtgagaagtaatggtgctacatatgcccttcatctgcccagtttcttcatgtgtataaaggtaaatactttcacacctagtgcatyctttcatagtatatttagccaaacaatatatgtaattagtcaccctaattacatattagcatgcctacattacaatgagtgtgcttacttgccactcctg

SEQ ID NO: 23688 - DNA, 201 bp, Homo sapiens
aagtgctggggttacaggcgtgagccactgcacccagccccaagtttttaaatataatattgttgaccagaagtacattcactcgtgtaaaaaataaaatrcccagtgagaagtaatggtgctacatatgcccttcatctgcccagtttcttcatgtgtataaaggtaaatactttcacacctagtgcatcctttcatagt

SEQ ID NO: 23689 - DNA, 201 bp, Homo sapiens; identical to SEQ ID NO: 3338

SEQ ID NO: 23690 - DNA, 201 bp, Homo sapiens
cagtggcacaatcttggctcactgaaacctctgccttccgggttccagcgattctcctgcctcagcctcccgagtagctgaaattgcaggtacgctctacygcacccagctaattttttgtatttttagtagagacggggttacaccatgttggccaggctggtcttgaactcctgacctcagatgatccacctgccctgg

SEQ ID NO: 23691 - DNA, 201 bp, Homo sapiens
tggagtctcactatgtcgcccaggctggagtgcagtggcacaatcttggctcactgaaacctctgccttccgggttccagcgattctcctgcctcagcctyccgagtagctgaaattgcaggtacgctctaccgcacccagctaattttttgtatttttagtagagacggggttacaccatgttggccaggctggtcttga

SEQ ID NO: 23692 - DNA, 201 bp, Homo sapiens
ccgtcggatgctgacgcctgccttccatttcaacatcctgaagccctatatgaagattttcaatgagagtgtgaacatcatgcacgtgagttatttgaagscaaggtcccacttgcagccttggggtgaaaggacaacagagagatctagtctggagttttggctctgctgggtgccattgggccattgctctttctcact

SEQ ID NO: 23693 - DNA, 201 bp, Homo sapiens
gagatggagtctcactatgtcgcccaggctggagtgcagtggcacaatcttggctcactgaaacctctgccttccgggttccagcgattctcctgcctcarcctcccgagtagctgaaattgcaggtacgctctaccgcacccagctaattttttgtatttttagtagagacggggttacaccatgttggccaggctggtc

SEQ ID NO: 23694 - DNA, 201 bp, Homo sapiens
attttcaatgagagtgtgaacatcatgcacgtgagttatttgaagccaaggtcccacttgcagccttggggtgaaaggacaacagagagatctagtctggmgttttggctctgctgggtgccattgggccattgctctttctcactgagccttggtttcctcatctgtaaaatggggataataatccctacttaaaagatg

SEQ ID NO: 23695 - DNA, 201 bp, Homo sapiens
cacgtaaatgtaataaatttagatattaataagcattttcccagataaaaagattacatataaataaaaaacctggacgtgtgagagaatatttacagtgmttattttgacatgggattgtggataacttctatttcttacttttgcttacttgtcttttttatgggaatattcatcattttggaatgaaaaatttaacta

SEQ ID NO: 23696 - DNA, 201 bp, Homo sapiens
catcaagtaacttttggggtagagatctcattttcacagcaatagatgcacaaatattcatgtaagatacaggtgtggttagacacctttcatagaacagytatgatctggaaattccacagacactgaatattttggtcgtattaacagaagtagatcactgagaagggagaaggtgacttttcagctcccccaggtaaa

SEQ ID NO: 23697 - DNA, 201 bp, Homo sapiens
agggtcatgacaacaatttcatagtagctgttgctgataagaaaccacctgaaaactcattggtttaaaccaataagtgtttatgtttgctaataagtctwtgggacagttggcaggttcttctgtatatggaagggaccactcatggtacatgagcagctgggggtcaggtaggcagccttgcaggtgttgactgaattc

SEQ ID NO: 23698 - DNA, 201 bp, Homo sapiens
gaggcatctcacagagatgggatgcagggagagaagagagcttggagaatcaatctcatgctgatccccaccctgtatctgtggggtcatctgttcctggwtactctgtttactgataggaggtagatcctggctgctggtgggaggtgatcctggggcttcaggtatattaaattgttgcctccctttctgcccttatcc

SEQ ID NO: 23699 - DNA, 201 bp, Homo sapiens
ctgtggttctgatttgcttgtctctaatgacaaataatgttgagcaccttttcctgtgcttcccagtgtttaaaacagcattttcaggctgaacgcagtgkctcacacctgtaattcattttgggaagccgaggtgggtggatcacttgaggccacgagtttgagaccagcctggccaacatggcgaaaccctgtctctac

SEQ ID NO: 23700 - DNA, 201 bp, Homo sapiens
ggctgtgaagaagcatcacactgtggttctgatttgcttgtctctaatgacaaataatgttgagcaccttttcctgtgcttcccagtgtttaaaacagcaytttcaggctgaacgcagtgtctcacacctgtaattcattttgggaagccgaggtgggtggatcacttgaggccacgagtttgagaccagcctggccaaca

SEQ ID NO: 23701 - DNA, 201 bp, Homo sapiens
gggattacaggtgtgagccaccgagcccagccctgaagtttcttttatagagcgaaaggttttaatgtttatgaagtaccctttatcaattttgttttttrtggattacttttacgccattatatttaagaactctttgcctaatccctatgtcccgggggttgaaatatttctgtatccctgggatatacaggttaggca

SEQ ID NO: 23702 - DNA, 201 bp, Homo sapiens
cgagccaccatgcccggccaaagagttcttacctgtaacagtgaaatatgtgggatgtagaaatataattgagttttgtttattgaccgtgtatcctacaytctatttgatcattcctgttggaatacatataatgctatatttcctcaatcttaaaacagttcttctcttagcctcactttcatactagctgatgtttgt

SEQ ID NO: 23703 - DNA, 201 bp, Homo sapiens
attatcagtgtatgtttaccatgatgagaaactatcaaactgtttccaaaaggtccatgtcatttttaattcctatcaggaatgtattgaagtggcgttgwtgtctggggtaaatacccaatgttcatcatctcacatcaaggaaatcaaggacaccgacacacaagaagtaagcttaagagttgaggtttaggctgagcg

SEQ ID NO: 23704 - DNA, 201 bp, Homo sapiens
tccgctatccccaagctcctgtgtgggccctgcagtactctggcctctcctttccttccctctcagctatcttcatctttctttcatgtattcatcaattyccatctcagcgtctcctctctctattgccatctaccccctgttctggtgttctgggctgccctggaaccctaagagacctcaacccaaggcccagtcctg

SEQ ID NO: 23705 - DNA, 201 bp, Homo sapiens
ggaggccacttggctgctggttttggttgggcctttctggactttacctctcagcccctttttacccatccctgagccctccctgctctacctccggcacygcccgtccctgcctctccactgtccctggaggtccctgggccgttctctgggcctcaggatctcaccgtccatcccgtctgccctgcaggatgtcccagc

SEQ ID NO: 23706 - DNA, 201 bp, Homo sapiens
agtgctgggattacaggtgtgagccaccgagcccagccctgaagtttcttttatagagcgaaaggttttaatgtttatgaagtaccctttatcaattttgktttttgtggattacttttacgccattatatttaagaactctttgcctaatccctatgtcccgggggttgaaatatttctgtatccctgggatatacaggt

SEQ ID NO: 23707 - DNA, 201 bp, Homo sapiens
aactcctgacctcagatgatccacctgccctggcctcccaaagtgctggggttacaggcgtgagccactgcacccagccccaagtttttaaatataatatygttgaccagaagtacattcactcgtgtaaaaaataaaatacccagtgagaagtaatggtgctacatatgcccttcatctgcccagtttcttcatgtgtat

SEQ ID NO: 23708 - DNA, 201 bp, Homo sapiens
atgagtcagggtggaacaggtaatccgaaaaggctgctttatgaggaagttaaatttaaaagtagaaggcaaagaattgaacatcctgacatattgattcwttgaaaagaaatttagaactcatatctaacacacctgcctcagtctcccacagtgctgggattacaggtgtgagccaccgagcccagccctgaagtttct

SEQ ID NO: 23709 - DNA, 201 bp, Homo sapiens
ctcccagtcccgattttttttttttgagatggagtctcactatgtcgcccaggctggagtgcagtggcacaatcttggctcactgaaacctctgccttccrggttccagcgattctcctgcctcagcctcccgagtagctgaaattgcaggtacgctctaccgcacccagctaattttttgtatttttagtagagacgggg

SEQ ID NO: 23710 - DNA, 201 bp, Homo sapiens
aatgagtcagggtggaacaggtaatccgaaaaggctgctttatgaggaagttaaatttaaaagtagaaggcaaagaattgaacatcctgacatattgattstttgaaaagaaatttagaactcatatctaacacacctgcctcagtctcccacagtgctgggattacaggtgtgagccaccgagcccagccctgaagtttc

SEQ ID NO: 23711 - DNA, 201 bp, Homo sapiens
cctcccagtcccgattttttttttttgagatggagtctcactatgtcgcccaggctggagtgcagtggcacaatcttggctcactgaaacctctgccttcygggttccagcgattctcctgcctcagcctcccgagtagctgaaattgcaggtacgctctaccgcacccagctaattttttgtatttttagtagagacggg

SEQ ID NO: 23712 - DNA, 201 bp, Homo sapiens
ttcttatccttgatgcatgtggcccctgctgctgtgtcgttcctctattggctagggttagaccacacaggctaaactaattccgattggctaatttaaasagagtggtgggatgagtggtttggcgggaaaaatggttatgacagagcaggtaatcagaatgagtcacggtggagtaggtaataggaatgagtcagggtg

SEQ ID NO: 23713 - DNA, 201 bp, Homo sapiens
gcacccttacagatggagcaatggtgagctcacacttggacaagggaggggaaggggttcttatccttgatgcatgtggcccctgctgctgtgtcgttccyctattggctagggttagaccacacaggctaaactaattccgattggctaatttaaacagagtggtgggatgagtggtttggcgggaaaaatggttatgac

SEQ ID NO: 23714 - DNA, 201 bp, Homo sapiens
acaactgcctaagttgcaattaccacagctacatctagaaggaagatgtgagagttttcattccacattaactagaaacctagcatgaggcagatggctgsaagcagtcgagggagtgtccaagaccttacacagaaaatcatgttcagagaggaagcttgttgctcattccttttttgtgcccagctgcctgggttccct

SEQ ID NO: 23715 - DNA, 201 bp, Homo sapiens
gcttttcctatcaaggtggccttttcctcatgatgtcaacgatgagtcccagaagctcagttcttatgggaaaggccacctttcccctagagttcccagawatggcccatgatttacttctcctggcctggatcacaggaccaatttttcacccaatccctgtgtctctgattgcccagtcttggtaggcctgggtcttcc

SEQ ID NO: 23716 - DNA, 201 bp, Homo sapiens
tccaggtccatgtcagaagatgccatatcagaagatgtcagagagtgctgggacagacagggtgtcctaggtccttgtgaagcattctgtagaatgctgarctgtgctcaggggttgcggaacatgttggatcgtgtaggaggcatgtcaaggcatgctggaaccctgacatagctcctacacgccatgttaggcagtgtc

SEQ ID NO: 23717 - DNA, 201 bp, Homo sapiens; identical to SEQ ID NO: 3295

SEQ ID NO: 23718 - DNA, 201 bp, Homo sapiens
ccttccaggaacagggtgggtagacccccacaaccttcccatcccccttcccccatcctccctgaggccctcaatgcatgggtgctgtctaccttcgggtrctgaagcagcccagagacccaagcctgccttgctgccccccaggccatgacaccacggccagtggtctctcctgggtcctgtaccatcttgcaaagcacc

SEQ ID NO: 23719 - DNA, 201 bp, Homo sapiens
cttctctattcctcaaactgctctaggtggggttgggtgtcccaggccaggttaccggcttgatggggccaggatggggctcctgggtgcagtcagagttyccacctccctcccctaggaactgcatcgggcagacgttcgcgatggcggagatgaaggtggtcctggcgctcacgctgctgcgcttccgcgtcctgcctg

SEQ ID NO: 23720 - DNA, 201 bp, Homo sapiens
gacattgtgctcccagacggccgggtcatccccaaaggtgctcacagcctcacggggaggagtctcctgggtaggaagaggggcccctcagtgaaggaggmcttctcctgactgctcccttctctcccacaggcattatctgcctcatcagtgttttcggaacccatcacaacccagctgtgtggccggaccctgaggtgc

SEQ ID NO: 23721 - DNA, 201 bp, Homo sapiens
gtgtctccagagccatagatttgttatctatctatctatctatccatcatctatctatgtatctatatacctatctactatctatatatcatctatgtatytctgtttctatcatctatgtatgtatctgtctattctctatctctctatatctcttatttattatctgtcatctatcaatctatcatctatctctgaatc

SEQ ID NO: 23722 - DNA, 201 bp, Homo sapiens
cctccactcctgtttctatgagcttgactattttaggtcccaagataagtaagatcatgtgtgtttgtgtttctgagcctagcttacttcacttagcatamgttcctccaggttctttcatgttgtggcaaacaaaataagttttctttctttttttttttttaaggctgaatggtattccattgtatatacacaccacat

SEQ ID NO: 23723 - DNA, 201 bp, Homo sapiens
gggtttcaccatattggacaggctggtcttgaactcctgaccttgtgatctgccgcccttggcctcccaaagtgctgggattacaggcgtgagccaccgcrcccgacctccactcctgtttctatgagcttgactattttaggtcccaagataagtaagatcatgtgtgtttgtgtttctgagcctagcttacttcactta

SEQ ID NO: 23724 - DNA, 201 bp, Homo sapiens
tgcccacatttatatgaattcacactgtgatttttatttatatgaacacatactgtgtttttctttgtaaagaaaactatacaaaatagacgcagttctgracattatctctgagatctatttttcttaaaatacgagttttcaaaaatgagtttgtttttaaattgttctttcattgataaattttaataatcaaggtaa

SEQ ID NO: 23725 - DNA, 201 bp, Homo sapiens
tttcccctattgagttatttgagctccttatataatatattctggttattaatcgcttgtcagatgagtaatttgagaatattttctgccattctgtaagytgattcttcactttgttgactgtttcctttgctgtgcagaagctttttaccttgatgtaatctcatttgtctattgcctgtgcttttgaggtcttaacac

SEQ ID NO: 23726 - DNA, 201 bp, Homo sapiens
cgaggtttcacgttgttgaccaggctggtctcgaactcctgacctcaggtgatccacctgttataagtaaagttttggtgccgcaaaagaaatatcactcraatataaaattttctttttaattctcagcaaggaaaggtacttctatagaagggtgcacccttacagatggagcaatggtgagctcacacttggacaagg

SEQ ID NO: 23727 - DNA, 201 bp, Homo sapiens
tgtcgcctgaaatatttagtcttttctttatgctagaaacataactaacataagctaactatttaggaatatacagtacatatcgtaaactatagtgaacycactgatctatcaagtgctaggttttatttctcctatcaaacctcttatttatgcccgttaatcaacttctcctcacccctccctcccttctaccaatct

SEQ ID NO: 23728 - DNA, 201 bp, Homo sapiens
atctgtcgcctgaaatatttagtcttttctttatgctagaaacataactaacataagctaactatttaggaatatacagtacatatcgtaaactatagtgwacccactgatctatcaagtgctaggttttatttctcctatcaaacctcttatttatgcccgttaatcaacttctcctcacccctccctcccttctaccaa

SEQ ID NO: 23729 - DNA, 201 bp, Homo sapiens
gaagtaagcttaagagttgaggtttaggctgagcgcagtggctcatgcctgtaatccagcactttgggaggctggggcaggtggattacctgaggtcaggrgttcgagaccagcctgaccaacatggcaaaaccctgtctctactaaaaatacaaaaaattagccaggtgtggtggcgcacacctgtagtgtgctactcgg

SEQ ID NO: 23730 - DNA, 201 bp, Homo sapiens
atggatatttgtacacaggttcttcagggaaactaaattcccattgctgttagaatgggatggctggggcatattatcagtgtatgtttaccatgatgagwaactatcaaactgtttccaaaaggtccatgtcatttttaattcctatcaggaatgtattgaagtggcgttgttgtctggggtaaatacccaatgttcatc

SEQ ID NO: 23731 - DNA, 201 bp, Homo sapiens
cggggtcacccgctacggtgggcgcctgcagattgagaagcgcctccgggagctgaacgactttccccaggagttcgtgtgggaggcctcccactacctcktacgccaggtcttcaggagtctacaggagatgttctcggggacccgggccatccagcactggctgatcgagagcgcccacctcgtctcccacacgggctc

SEQ ID NO: 23732 - DNA, 201 bp, Homo sapiens
cttattgctgggtagaatttctgggcatggataggacactctttgttcagtggctgaagggcaagtggattgtttctggtttttggatattatgaataaawctgttatggatatttgtacacaggttcttcagggaaactaaattcccattgctgttagaatgggatggctggggcatattatcagtgtatgtttaccatg

SEQ ID NO: 23733 - DNA, 201 bp, Homo sapiens
ctagccagggtgttgatgacttcctccaagccaaggccaaatccaagactttggacttcattgatgtactcctgctgagcaaggtgggcctctctgggatytgaattcaagaagtagaagggagcttcatgtgaaatgtcagatgaaagaatttgaacttgattaagagggcactagggagccatggaaggtgattgagga

SEQ ID NO: 23734 - DNA, 201 bp, Homo sapiens
cctcagcctcccaagtaactggaattacaggtgcacaccaccacacccggctaatttttgtatttttaatagagatggggttttgccatgttggccaggcwggtctcaaactcctgacctcaggtgatctgccccctcagcctcccaaagtgctgggattacaggcgtgagatagttcagagttttgacacatggctagag

SEQ ID NO: 23735 - DNA, 201 bp, Homo sapiens
cctccagctgaacacgtgaccgatgtgcagacaggaggggctgtggtggagatgccattgcctccatcgcccctggacttccacctgtctaacctctgttsctgtttgctcatgtctggggcgtgtctctacaatggctgttatatggccaggtctgccttgtatatttacacctgggtcctggttacacctgaaatatgt

SEQ ID NO: 23736 - DNA, 201 bp, Homo sapiens
actctccctagccagggtgttgatgacttcctccaagccaaggccaaatccaagactttggacttcattgatgtactcctgctgagcaaggtgggcctctytgggatctgaattcaagaagtagaagggagcttcatgtgaaatgtcagatgaaagaatttgaacttgattaagagggcactagggagccatggaaggtga

SEQ ID NO: 23737 - DNA, 201 bp, Homo sapiens
gagaagggagaaggtgacttttcagctcccccaggtaaatgctgatttcatcctcacatcgatcttacagattgtagatgaactcacttgttcaaggtcastcagtgaagggtggagtcgggggtgaatctgagcagttggcatcagaggtcatgccttatcgtatcaaggacatgattttcaaagcgagtctcagcccta

SEQ ID NO: 23738 - DNA, 201 bp, Homo sapiens; identical to SEQ ID NO: 3320

SEQ ID NO: 23739 - DNA, 201 bp, Homo sapiens; identical to SEQ ID NO: 3285

SEQ ID NO: 23740 - DNA, 201 bp, Homo sapiens; identical to SEQ ID NO: 3323

SEQ ID NO: 23741 - DNA, 201 bp, Homo sapiens
agacacctagaattaactatcacagaaggtaatgacccctgccttgcttgcaggtcaaccccacagaggagggcatgagagttctgactcagctggtggcyacctacccccagggctttaaggtctggatgggacccatctcccccctcctcagtttgtgccaccccgacatcatccggtctgtcatcaacgcctcaggta

SEQ ID NO: 23742 - DNA, 201 bp, Homo sapiens
cttccacagtgtctgtactgatttaccttccagcctgcagaatgtgatgagactagtgatccctatttcctccttttgtgtagctgtatagtattccatcstgtggctgtttatctaaacatcttcccatcaatgtgtatgtggcttgtttccaaccttttgctaaaagtggacatgaggcagtcagcatgtgtgcacagt

SEQ ID NO: 23743 - DNA, 201 bp, Homo sapiens
gtggcacgatcttggctcactgcaacctctgcctcccgggttcaagctattcttctgcctcagcctcccaagcagctgggactatgggtgcacaccaccaygcctggctaatttttgtatttttaatagggctggggtttcaccatattggccaggctggtctcgaactcctgacctcatgatctgcctgcctcggcctcc

SEQ ID NO: 23744 - DNA, 201 bp, Homo sapiens
catccatgttgccacaaatgacaaaattccagtgtttttaatggtgcatagtattccattgtgtatacatgccacatttcctttcttccttccttccttcytccctccctccctctctctctttctctctttcttctttcctttctttctttctttgagacagagtcttgttctgtcgcccaggctgaagtgcggtggcac

SEQ ID NO: 23745 - DNA, 201 bp, Homo sapiens
tttcagctcccccaggtaaatgctgatttcatcctcacatcgatcttacagattgtagatgaactcacttgttcaaggtcactcagtgaagggtggagtcrggggtgaatctgagcagttggcatcagaggtcatgccttatcgtatcaaggacatgattttcaaagcgagtctcagccctaggcacatcagattacctgg

SEQ ID NO: 23746 - DNA, 201 bp, Homo sapiens
ggggcccctcagtgaaggaggccttctcctgactgctcccttctctcccacaggcattatctgcctcatcagtgttttcggaacccatcacaacccagctrtgtggccggaccctgaggtgcggggcccctctctctgtttttgtccattccaaggctcctagaggagggggcagggttttgatcaggagtatccaacatc

SEQ ID NO: 23747 - DNA, 201 bp, Homo sapiens
tgctccccaggtggggaggggaggaaaagctgtttttgttgattctgccactattgcctagtgggaataggagcagaggaccacaggcaggacttagtacmcatcctgactgtctggggaaaggttataggcccttaggacagaaagacctgggcttctgagagagttggtgatgatatgtgaggacagataacgccactt

SEQ ID NO: 23748 - DNA, 201 bp, Homo sapiens
accatcttgcaaagcacccagaataccaggagcgctgccggcaggaggtgcaagaacttctgaaggaccgtgagcctaaagagattgaatggtgagtgcargtgcttgtggcctcttcctgagaccttctcattggctctgctccccaggtggggaggggaggaaaagctgtttttgttgattctgccactattgcctagt

SEQ ID NO: 23749 - DNA, 201 bp, Homo sapiens
gtgataatctaatacattcatataactggtaaagatcaaatcagtgtacttgggatatctgtcgcctgaaatatttagtcttttctttatgctagaaacawaactaacataagctaactatttaggaatatacagtacatatcgtaaactatagtgaacccactgatctatcaagtgctaggttttatttctcctatcaaa

SEQ ID NO: 23750 - DNA, 201 bp, Homo sapiens
gtccagtgaggaggagaaacatttttctgcttttaaaaccaataatttttctgcatttttaacaaacaattttttattgctgcataaatagatgcacatakatttgaaatacatgtgataatctaatacattcatataactggtaaagatcaaatcagtgtacttgggatatctgtcgcctgaaatatttagtcttttctt

SEQ ID NO: 23751 - DNA, 201 bp, Homo sapiens
ggaggaagagagagaggagagcgagggagagagagagaaggagagagagagagagcagggtcaggacagaaaggaggagaaggggagagagagggagagaytgagttgtaatgagatgataaaaccggagatggtagcaggggctggctgtggaagccttggggaaaatgttaatggcttcagttttagcccaatggcaat

SEQ ID NO: 23752 - DNA, 201 bp, Homo sapiens
cagtgctctaggtcaagaagactgcctgtggtctttgggggaggaagagagagggaggaagagagagaggagagcgagggagagagagagaaggagagagrgagagagcagggtcaggacagaaaggaggagaaggggagagagagggagagactgagttgtaatgagatgataaaaccggagatggtagcaggggctggc

SEQ ID NO: 23753 - DNA, 201 bp, Homo sapiens
gtagataattgggtacagttggggggcagtgctctaggtcaagaagactgcctgtggtctttgggggaggaagagagagggaggaagagagagaggagagygagggagagagagagaaggagagagagagagagcagggtcaggacagaaaggaggagaaggggagagagagggagagactgagttgtaatgagatgataa

SEQ ID NO: 23754 - DNA, 201 bp, Homo sapiens
gctcttctgttccctaattcctactctccagtcgagtccagggttttataagggagacctaggggtaaaattcatccattcttgtccggaacacttgcacygttcatccgtcccatccttattcagcaaacactcccacactgcattctcacccccacatctgtgcacagcatctttctgtgctctggagacctgggaagg

SEQ ID NO: 23755 - DNA, 201 bp, Homo sapiens
gcttctgagagagttggtgatgatatgtgaggacagataacgccacttagcacgtgttcagcaaatgaacttcccctccactctcttcctttcctcccagraatatcattttttttgaacatcttcacttcttgaatgtttgctcttctgttccctaattcctactctccagtcgagtccagggttttataagggagacct

SEQ ID NO: 23756 - DNA, 201 bp, Homo sapiens
aggacttagtacccatcctgactgtctggggaaaggttataggcccttaggacagaaagacctgggcttctgagagagttggtgatgatatgtgaggacarataacgccacttagcacgtgttcagcaaatgaacttcccctccactctcttcctttcctcccagaaatatcattttttttgaacatcttcacttcttgaa

SEQ ID NO: 23757 - DNA, 201 bp, Homo sapiens
gacccctttcgctttgacccagagaacatcaaggagaggtcacctctggcttttattcccttctcggcagggcccaggtaagggcggcctgtgtctgaggygggaacgggttgatgggtgcaggggtctgggcatgacagtggggaaaagggggacattgtagatggtccaagttccagctctctttccctcacctcctct

SEQ ID NO: 23758 - DNA, 201 bp, Homo sapiens
tcctggaggagttttgttatacctgatcattgaaggactggtatgaactttatcttgaggtttccagggagccattgaaggggtttgaactggtgggtgtkgtcagagctctgtaggggactgactaatgtagcactaaatggagttaacactgatgcaaagaggctagggtgaaagctagaccatggaccagttgcagga

SEQ ID NO: 23759 - DNA, 201 bp, Homo sapiens
cctttcgctttgacccagagaacatcaaggagaggtcacctctggcttttattcccttctcggcagggcccaggtaagggcggcctgtgtctgaggtgggdacgggttgatgggtgcaggggtctgggcatgacagtggggaaaagggggacattgtagatggtccaagttccagctctctttccctcacctcctctggag

SEQ ID NO: 23760 - DNA, 201 bp, Homo sapiens
acacagagcacaggggacagagctggaacttgaacctagttctcctaactcccaatcttgggtcttcatctcttaatagtaacagcttttgtttgcaccakaacctggtgctccctggggaggggtccctggggagaagatgaagaggcttattctggggagcccatcttggcagttggggttggagaggtgctcaaggga

SEQ ID NO: 23761 - DNA, 201 bp, Homo sapiens
gcagagatgggatttacagtaagagaagcaggactagggggtatagaaagtgtctcagttgagagcctaaataatgatcagtagataattgggtacagttvgggggcagtgctctaggtcaagaagactgcctgtggtctttgggggaggaagagagagggaggaagagagagaggagagcgagggagagagagagaagga

SEQ ID NO: 23762 - DNA, 201 bp, Homo sapiens
ataagggagacctaggggtaaaattcatccattcttgtccggaacacttgcactgttcatccgtcccatccttattcagcaaacactcccacactgcattytcacccccacatctgtgcacagcatctttctgtgctctggagacctgggaaggaaccaacccagggatctgttttccaggtgctcccagcctggtggtgg

SEQ ID NO: 23763 - DNA, 201 bp, Homo sapiens
tttggacttcattgatgtactcctgctgagcaaggtgggcctctctgggatctgaattcaagaagtagaagggagcttcatgtgaaatgtcagatgaaagratttgaacttgattaagagggcactagggagccatggaaggtgattgaggaagggagggacaggtcagagataggttttagagatgactgtggagtgcac

SEQ ID NO: 23764 - DNA, 201 bp, Homo sapiens
cttcctttcctcccagaaatatcattttttttgaacatcttcacttcttgaatgtttgctcttctgttccctaattcctactctccagtcgagtccagggwtttataagggagacctaggggtaaaattcatccattcttgtccggaacacttgcactgttcatccgtcccatccttattcagcaaacactcccacactgc

SEQ ID NO: 23765 - DNA, 201 bp, Homo sapiens
tctgtgtttctaagtctgtgactttgtctatgtgtgtgtgtgtctatgtctatgtttatgtgtgtctgtgtttctaagtctgtgattttgtgtatgtgtgygtatgtctgtgtctatatctgtgtctatgtctatgtttacgtgtatttgtgtgtctgtgtttctaagtctgtgacttagtctatatgtgtgtgcctgtgt

SEQ ID NO: 23766 - DNA, 201 bp, Homo sapiens
tatgtgtatttatgtgtctgtgtttctaagtctgtgactttgtctatgtgtgtgtgtgtctatgtctatgtttatgtgtgtctgtgtttctaagtctgtgwttttgtgtatgtgtgtgtatgtctgtgtctatatctgtgtctatgtctatgtttacgtgtatttgtgtgtctgtgtttctaagtctgtgacttagtctat

SEQ ID NO: 23767 - DNA, 201 bp, Homo sapiens
aaacgttggggggccaggggagggagaggtccttgcccatggcccttggctgccctgctaggggatgggctcctgctgagtgctggtgacaagtggagccrccaccgtcggatgctgacgcctgccttccatttcaacatcctgaagccctatatgaagattttcaatgagagtgtgaacatcatgcacgtgagttatttg

SEQ ID NO: 23768 - DNA, 201 bp, Homo sapiens
gatgtgccgcaggacgtgtacagcagcgtggccgcgcaggtggaggtgttccgtaggcaggacgcccagcggggcatgcgggtggcacaggtgctggaagscttcatcacccgcaaggtggtgaagcagacggtgatgaccgtggtgtacggggtcacccgctacggtgggcgcctgcagattgagaagcgcctccgggag

SEQ ID NO: 23769 - DNA, 201 bp, Homo sapiens
ttatattcttcttcttatctccctcttatcaatgagacctgttgccaaacccagataaaagttggccactcacttcacctttcagaagctttccttggcckttctcctccccgtgaccttgccctctgacttagaccgctctcctctttggggaatgtggtcttagtctgctcatttgcaaatggcaggattgatggatgt

SEQ ID NO: 23770 - DNA, 201 bp, Homo sapiens
gtctatatctgtgtctatgtctatgtttacgtgtatttgtgtgtctgtgtttctaagtctgtgactttgtctatgtgtgtgtgtgtctgtgtctatatctrtgtctatgtctaggtttatgtgtatttgtgtgcctgtgtttctaagtctgtgacttagtctatgtgtgcgtgtgtctgtgtctatgtctatgtttatgtg

SEQ ID NO: 23771 - DNA, 201 bp, Homo sapiens
atgcaacggcctacagcattatgctgccctgggccgcgacagcgtgggcgccgcctcggtcaacctggagccctcggatgtgccgcaggacgtgtacagcrgcgtggccgcgcaggtggaggtgttccgtaggcaggacgcccagcggggcatgcgggtggcacaggtgctggaaggcttcatcacccgcaaggtggtgaa

SEQ ID NO: 23772 - DNA, 201 bp, Homo sapiens
tattcttcttcttatctccctcttatcaatgagacctgttgccaaacccagataaaagttggccactcacttcacctttcagaagctttccttggcctttmtcctccccgtgaccttgccctctgacttagaccgctctcctctttggggaatgtggtcttagtctgctcatttgcaaatggcaggattgatggatgtgtc

SEQ ID NO: 23773 - DNA, 201 bp, Homo sapiens
gatagatagatagatagatagatagatagatagctaataggatagatagatagatgcacagataggatggatagatggatggatggatggatggacaggcrcgtaggtagatagataatagaatagatggatgcatggacacatggatgcacagatagcatggatggatggatggatggatggatggatggatggatagat

SEQ ID NO: 23774 - DNA, 201 bp, Homo sapiens
ttgcaagtattttcccctagtctgcggctagccttttcattatctgtttttttttcttttctttttttttttcctttttaagacagagtctcactctgtcrccccagctggagtgcagtggcgccatcttggctcactgcaatctccatctcctgagttcaagcaattctcctgtctcagccttgggactataggtgcctg

SEQ ID NO: 23775 - DNA, 201 bp, Homo sapiens
atttttgaaatcaatttataacaatgcagacggggaaatccaacatttattgatcacataccatatgccagaaacaatgccatgtgcccattccatgataygagtatgtattgtctaatttgattttaacagctctgcgaaggagagattatgtatttttgccccatggtagatgatgaaactgcaggtctgagagattag

SEQ ID NO: 23776 - DNA, 201 bp, Homo sapiens
tttaaagtccagggagggtggccttcaggcatggctggatccaggtctcacacaaggtcactggaaatctgtctttctctcttggctttagctttctccaygtcgcttttcctatcaaggtggccttttcctcatgatgtcaacgatgagtcccagaagctcagttcttatgggaaaggccacctttcccctagagttccc

SEQ ID NO: 23777 - DNA, 201 bp, Homo sapiens
caaggtggccttttcctcatgatgtcaacgatgagtcccagaagctcagttcttatgggaaaggccacctttcccctagagttcccagaaatggcccatgrtttacttctcctggcctggatcacaggaccaatttttcacccaatccctgtgtctctgattgcccagtcttggtaggcctgggtcttccagagctactgt

SEQ ID NO: 23778 - DNA, 201 bp, Homo sapiens
gcctttgctatatcaagggccagggtcaaaggcctcccagcagacagagagaggaggttgtctgggacagactgctcctgacagaaggtgccaggctgggkgtggcaggcctggggggggtcctggcctgggatggagaggggcactgcccaaggcccacgcagctcctgggtgctggcctggaggatgggtggtttccga

SEQ ID NO: 23779 - DNA, 201 bp, Homo sapiens
cggcctgtgtctgaggtgggaacgggttgatgggtgcaggggtctgggcatgacagtggggaaaagggggacattgtagatggtccaagttccagctctcyttccctcacctcctctggagtttataggaaaaggtccatagagtacggttgggttggtcctagaagggtctgtggtgtgctcagagccccctcctacccc

SEQ ID NO: 23780 - DNA, 201 bp, Homo sapiens
atggcacacagagcacaggggacagagctggaacttgaacctagttctcctaactcccaatcttgggtcttcatctcttaatagtaacagcttttgtttgyaccataacctggtgctccctggggaggggtccctggggagaagatgaagaggcttattctggggagcccatcttggcagttggggttggagaggtgctca

SEQ ID NO: 23781 - DNA, 201 bp, Homo sapiens
gtgctcagagccccctcctaccccaccttggtctaggctgggggttggagctcggctaggcttgcaggatatgcaagcccgcatggggatccaggcacggwtacccccttctctattcctcaaactgctctaggtggggttgggtgtcccaggccaggttaccggcttgatggggccaggatggggctcctgggtgcagtc

SEQ ID NO: 23782 - DNA, 201 bp, Homo sapiens
ggagagattatgtatttttgccccatggtagatgatgaaactgcaggtctgagagattagggaactaacccaagttcacccagctaataagtgagcatggygaggtggagcagagtttctaatgtgaattatatggctccaaagcacatcatcttaactgtttctgaagatttgacaggcaggatataggggagggtaatg

SEQ ID NO: 23783 - DNA, 201 bp, Homo sapiens
gaaatcaatttataacaatgcagacggggaaatccaacatttattgatcacataccatatgccagaaacaatgccatgtgcccattccatgatatgagtaygtattgtctaatttgattttaacagctctgcgaaggagagattatgtatttttgccccatggtagatgatgaaactgcaggtctgagagattagggaact

SEQ ID NO: 23784 - DNA, 201 bp, Homo sapiens
gaaagaatgctcaggactcaacgaaggactacctccccaaaaacagggatatttttgaaatcaatttataacaatgcagacggggaaatccaacatttatygatcacataccatatgccagaaacaatgccatgtgcccattccatgatatgagtatgtattgtctaatttgattttaacagctctgcgaaggagagatta

SEQ ID NO: 23785 - DNA, 201 bp, Homo sapiens
ttgcattcatgacatgcccagaaagaatgctcaggactcaacgaaggactacctccccaaaaacagggatatttttgaaatcaatttataacaatgcagayggggaaatccaacatttattgatcacataccatatgccagaaacaatgccatgtgcccattccatgatatgagtatgtattgtctaatttgattttaaca

SEQ ID NO: 23786 - DNA, 201 bp, Homo sapiens
tcattttcaccacattgtattttgacatcgaaagccaaaagtccaacacagaatcaaaggcagggggataaaataggctctgtctattaatgggagttgcygaaaaatcacattgcaaagggtgtggatatggcaggaagggaagaattgtggcaaaggttttgcgaagtatctaggattttttttttaacttgcaaattg

SEQ ID NO: 23787 - DNA, 201 bp, Homo sapiens
acgtgtctaggtttggcctcatctgggacccctggatgttcctccctatgattgtctccttccagaaggcgcgccatggttcacaatgcaggcagggttcyaaggagtaagacaaggcttagcttcgttagttattaactcatcattttcaccacattgtattttgacatcgaaagccaaaagtccaacacagaatcaaag

SEQ ID NO: 23788 - DNA, 201 bp, Homo sapiens
tgggttttggctgggacatgtttgggttctctcacgtgtctaggtttggcctcatctgggacccctggatgttcctccctatgattgtctccttccagaakgcgcgccatggttcacaatgcaggcagggttccaaggagtaagacaaggcttagcttcgttagttattaactcatcattttcaccacattgtattttgac

SEQ ID NO: 23789 - DNA, 201 bp, Homo sapiens
gtacatgagcagctgggggtcaggtaggcagccttgcaggtgttgactgaattctgccacatgtttgggttttggctgggacatgtttgggttctctcacrtgtctaggtttggcctcatctgggacccctggatgttcctccctatgattgtctccttccagaaggcgcgccatggttcacaatgcaggcagggttccaa

SEQ ID NO: 23790 - DNA, 201 bp, Homo sapiens
acacaactctgagaaattttccatgttaaggacatcagtgtcttgcattcatgacatgcccagaaagaatgctcaggactcaacgaaggactacctccccmaaaacagggatatttttgaaatcaatttataacaatgcagacggggaaatccaacatttattgatcacataccatatgccagaaacaatgccatgtgccc

SEQ ID NO: 23791 - DNA, 201 bp, Homo sapiens
taagtctttgggacagttggcaggttcttctgtatatggaagggaccactcatggtacatgagcagctgggggtcaggtaggcagccttgcaggtgttgastgaattctgccacatgtttgggttttggctgggacatgtttgggttctctcacgtgtctaggtttggcctcatctgggacccctggatgttcctccctat

SEQ ID NO: 23792 - DNA, 201 bp, Homo sapiens
gtgatccaagatccctagttcccatgtcacaaatgaggatcccacatatctgggacagagatggaacattatttctgggtgtgtctatctaatctattcaycctatctatctaatttctcatctatatatatatttgcctacccatccatccatcaatccatcttagctgtacgtttatccattccatctatttatcctat

SEQ ID NO: 23793 - DNA, 201 bp, Homo sapiens
caggtggagctgcctgccagtcccgcgccgtgcgctcgcactcctcagcccttgggtggtcgatgggactgggcgccctggagcagggggcggcgctcatyggggaggctcgggctgcacaggaacctacggaggccgggggctcaggcatggcgggctgcaggtcctgggccctgccccgcgggaaggcagctaaggccc

SEQ ID NO: 23794 - DNA, 201 bp, Homo sapiens
actttcgcggtgagtgttacagctcataaaagcagtgtgaacctaaagagtgagcagcagcaagatttattgcaaagagtgaaagaacaaagcttccacartgtggaagggggcctgagcgggttgccactgctggctcgggcagcctgcttttattctcttatctggccctacctatgtcctgctgattggtagagccaa

SEQ ID NO: 23795 - DNA, 201 bp, Homo sapiens
gctataaagaaatacctggctgggtatggtggctcatgcctgtaatcccagcattttaggatgccaaggtgggagaattgcttgaggcttggagtttaagmccaaaaaaaaaaaaaaaaaaaaaaggaaatacctgagactgggtaatttgtaaacaaaagaggtttaactggatcacggttctgcaggctgtacaggaag

SEQ ID NO: 23796 - DNA, 201 bp, Homo sapiens
agcatgctgtcacctctcagtgggagcaggtgtgacaagagttgggcaaatcagacctttaatccaccctgataggctggagtgtgggcttatggcatttytcctttgacccaattaacctccactcccaatgtatctctgtgcagaaggctcagctaggtgtatcagccattgtaaatcctcaacataaattataattta

SEQ ID NO: 23797 - DNA, 201 bp, Homo sapiens
ctcctcacacatgatgctcaccaccctgcactgctacaggaagggcctgaccttcgtctctgtgcacgactgttaccggacccatgcagctgatgtctccrtcatgaaccaggtgtgccgggagcagtttgcttgcacagcgagtccatcctgcaggacctgtccaggttcctggtcaggcggttctgctctgagccccag

SEQ ID NO: 23798 - DNA, 201 bp, Homo sapiens
ggacgcccagcggggcatgcgggtggcacaggtgctggaaggcttcatcacccgcaaggtggtgaagcagacggtgatgaccgtggtgtacggggtcaccygctacggtgggcgcctgcagattgagaagcgcctccgggagctgaacgactttccccaggagttcgtgtgggaggcctcccactacctcgtacgccaggt

SEQ ID NO: 23799 - DNA, 201 bp, Homo sapiens
tggtataattccttccttaaatgtttagtagatgcaacggcctacagcattatgctgccctgggccgcgacagcgtgggcgccgcctcggtcaacctggarccctcggatgtgccgcaggacgtgtacagcagcgtggccgcgcaggtggaggtgttccgtaggcaggacgcccagcggggcatgcgggtggcacaggtgc

SEQ ID NO: 23800 - DNA, 201 bp, Homo sapiens
ccgcgcaggtggaggtgttccgtaggcaggacgcccagcggggcatgcgggtggcacaggtgctggaaggcttcatcacccgcaaggtggtgaagcagacrgtgatgaccgtggtgtacggggtcacccgctacggtgggcgcctgcagattgagaagcgcctccgggagctgaacgactttccccaggagttcgtgtggg

SEQ ID NO: 23801 - DNA, 201 bp, Homo sapiens
atggaagaaaattggtataattccttccttaaatgtttagtagatgcaacggcctacagcattatgctgccctgggccgcgacagcgtgggcgccgcctcrgtcaacctggagccctcggatgtgccgcaggacgtgtacagcagcgtggccgcgcaggtggaggtgttccgtaggcaggacgcccagcggggcatgcggg

SEQ ID NO: 23802 - DNA, 201 bp, Homo sapiens
ggatggatggacaggcacgtaggtagatagataatagaatagatggatgcatggacacatggatgcacagatagcatggatggatggatggatggatggakggatggatggatagatagatagacaaataataggacatatggatgcatggacacacggatgcacagataggatggatggatggatggatgatggatggat

SEQ ID NO: 23803 - DNA, 201 bp, Homo sapiens
tttaaaaaataggcaaactatctgaatagacatttctcaaaagaggagatacaaatggcaaacacatacattaaaaaatggtcaacatcactaatcatctrggaaatgcaagtcaaaaccatgataagatgtcatctcacccctgttaacatatgtaattatttttatacattgttggatttgatttgatattttcttgag

SEQ ID NO: 23804 - DNA, 201 bp, Homo sapiens
caggagttcgtgtgggaggcctcccactacctcgtacgccaggtcttcaggagtctacaggagatgttctcggggacccgggccatccagcactggctgaycgagagcgcccacctcgtctcccacacgggctctgtggtggagtgggtcacccccctgggcgtccccatcatccagccgtatcgcctggagtccaaggtc

SEQ ID NO: 23805 - DNA, 201 bp, Homo sapiens
gatgcacagatagcatggatggatggatggatggatggatggatggatggatagatagatagacaaataataggacatatggatgcatggacacacggatscacagataggatggatggatggatggatgatggatggatgggtagatagagtagataggatggatagattatgtagacagatggagtagatatatatgat

SEQ ID NO: 23806 - DNA, 201 bp, Homo sapiens
caaacggggtcatacgaaaccaaaaagcttctgcacagcaaagaaacaaatcaacaaagtgaagagacaacctacagaatgagaaaaaatatttgcaaatyatccatctgacaagggattagtaattagaatacataaggaacttaaacaactgaatagcaaaaaaaaaaaccacctcaaaataatccttttaaaaaatag

SEQ ID NO: 23807 - DNA, 201 bp, Homo sapiens
ccggtctgtcatcaacgcctcaggtaccatctggaacagctggtggggcagtgcatttgaggcctgcacttccgctatccccaagctcctgtgtgggcccygcagtactctggcctctcctttccttccctctcagctatcttcatctttctttcatgtattcatcaatttccatctcagcgtctcctctctctattgcca

SEQ ID NO: 23808 - DNA, 201 bp, Homo sapiens
attccagcctgggcaacagagtgagactgtctcaaaaaataaaataaaataaaataaaataaaataaaataaaataaaataaaataaaataaaataaaataaaatataaaatagcattttttgttttagatagagtctcactctgtggccaggttggagtacagtggtgtgatctcagctcactgcaacctctgcctcctg

SEQ ID NO: 23809 - DNA, 201 bp, Homo sapiens
tgcagacaggaggggctgtggtggagatgccattgcctccatcgcccctggacttccacctgtctaacctctgttgctgtttgctcatgtctggggcgtgwctctacaatggctgttatatggccaggtctgccttgtatatttacacctgggtcctggttacacctgaaatatgttatacctggttacatctggtatata

SEQ ID NO: 23810 - DNA, 201 bp, Homo sapiens
gaggtgcaagaacttctgaaggaccgtgagcctaaagagattgaatggtgagtgcaggtgcttgtggcctcttcctgagaccttctcattggctctgctcyccaggtggggaggggaggaaaagctgtttttgttgattctgccactattgcctagtgggaataggagcagaggaccacaggcaggacttagtacccatcc

SEQ ID NO: 23811 - DNA, 201 bp, Homo sapiens
cattccagcctgggcaacagagtgagactgtctcaaaaaataaaataaaataaaataaaataaaataaaataaaataaaataaaataaaataaaataaaayaaaatataaaatagcattttttgttttagatagagtctcactctgtggccaggttggagtacagtggtgtgatctcagctcactgcaacctctgcctcct

SEQ ID NO: 23812 - DNA, 201 bp, Homo sapiens
acattccagcctgggcaacagagtgagactgtctcaaaaaataaaataaaataaaataaaataaaataaaataaaataaaataaaataaaataaaataaaataaaatataaaatagcattttttgttttagatagagtctcactctgtggccaggttggagtacagtggtgtgatctcagctcactgcaacctctgcctcc

SEQ ID NO: 23813 - DNA, 201 bp, Homo sapiens
cacattccagcctgggcaacagagtgagactgtctcaaaaaataaaataaaataaaataaaataaaataaaataaaataaaataaaataaaataaaataaaataaaatataaaatagcattttttgttttagatagagtctcactctgtggccaggttggagtacagtggtgtgatctcagctcactgcaacctctgcctc

SEQ ID NO: 23814 - DNA, 201 bp, Homo sapiens
catgtattttgtggccatgtcaggacatgtgaacacatgtcagggtcatgtctcatgtccaggtccatgtcagaagatgccatatcagaagatgtcagagrgtgctgggacagacagggtgtcctaggtccttgtgaagcattctgtagaatgctgagctgtgctcaggggttgcggaacatgttggatcgtgtaggaggc

SEQ ID NO: 23815 - DNA, 201 bp, Homo sapiens
tttatagattatattttgcagacaagtcttttgtcagatgtgtgatttgcaagtattttcccctagtctgcggctagccttttcattatctgtttttttttcttttctttttttttttcctttttaagacagagtctcactctgtcaccccagctggagtgcagtggcgccatcttggctcactgcaatctccatctcctg

SEQ ID NO: 23816 - DNA, 201 bp, Homo sapiens
gggctgaagggctcctcaagtgccgccaaagtgggagcccaggcagaggaggcgccgagagcgagtgagggctgtgaggactgccagcatgctgtcacctytcagtgggagcaggtgtgacaagagttgggcaaatcagacctttaatccaccctgataggctggagtgtgggcttatggcatttctcctttgacccaatt

SEQ ID NO: 23817 - DNA, 201 bp, Homo sapiens
gcaggtggattacctgaggtcaggagttcgagaccagcctgaccaacatggcaaaaccctgtctctactaaaaatacaaaaaattagccaggtgtggtggygcacacctgtagtgtgctactcgggaggctgaggcaggagaatcacttgaacccaggaggcagaggttgcagcaagctgagatcgcaccattgcactcta

SEQ ID NO: 23818 - DNA, 201 bp, Homo sapiens
tgcagtggcacaatcatagctcactgcaacctcaaactcctggccaaagtgatggcattaaaggtgtgagcccctcctcccagtcccgattttttttttttgagatggagtctcactatgtcgcccaggctggagtgcagtggcacaatcttggctcactgaaacctctgccttccgggttccagcgattctcctgcctca

SEQ ID NO: 23819 - DNA, 201 bp, Homo sapiens
ctatccctccctcagccctggcctctggtaaccatcattctgcttctatttcttttcttttctttctttcttttttttttcatttttgagatggagtctcrctctgtcacccaggctggagtgcagtggcacgatctcagcttactgcgacctctgcctcccaggttcaagtgattctcctgcctcagcctcctgagtagc

SEQ ID NO: 23820 - DNA, 201 bp, Homo sapiens
tgaccaacatctcacccttctctatccctccctcagccctggcctctggtaaccatcattctgcttctatttcttttcttttctttctttcttttttttttcatttttgagatggagtctcgctctgtcacccaggctggagtgcagtggcacgatctcagcttactgcgacctctgcctcccaggttcaagtgattctcc

SEQ ID NO: 23821 - DNA, 201 bp, Homo sapiens
ttctggttattaatcgcttgtcagatgagtaatttgagaatattttctgccattctgtaagttgattcttcactttgttgactgtttcctttgctgtgcaraagctttttaccttgatgtaatctcatttgtctattgcctgtgcttttgaggtcttaacacagaaaatctttgcctggacccatgtcctggagtataaaa

SEQ ID NO: 23822 - DNA, 201 bp, Homo sapiens
ctcgggcagcctgcttttattctcttatctggccctacctatgtcctgctgattggtagagccaagtggtctgttttgacagggcgctgattggtgcgttyacaatccttgagctagacacaaaggttctccacgtccccaccagactcagaagcccagctggcttcacccagtggatcccgcaccggggctgcaggtgga

SEQ ID NO: 23823 - DNA, 201 bp, Homo sapiens
actctatctatctgtgcatctacccatccatctggaccctgagctgattcctctgcacccagctggcctgacgccaggtgttgattggctgcccaggctcmggagacacatccaggctgcagggattggttggcccagcccaacccagccagccctcccacagcctttgctatatcaagggccagggtcaaaggcctccca

SEQ ID NO: 23824 - DNA, 201 bp, Homo sapiens
ctcatgtttgcttcctgtcttctaaaagactacttaagataacagggtaatcacagaaaagcattagaaatagagttatatgagaaacaactgtagttaakgctaggtttatgttagactgagaaattttagtgcatacttaagttatttaggccaggttactttttgtagaacaaacatttcagtttcgctcagtttcat

SEQ ID NO: 23825 - DNA, 201 bp, Homo sapiens
tgagcacctaccatgatgagtatctctgatcttcatatctttgaaatgtggatactattaccttcacttaattggtaagaaaatttgtgctcagggaggtraagtcactttctcacagtcacacagctatttcacaggagagtgcagtatcaaatttaggtttttctggtcccaaaccctgatgtttcccccacatcattg

SEQ ID NO: 23826 - DNA, 201 bp, Homo sapiens
gaccctcaggtaagagcatgtttagcaagttcagagaaaagcctcttaggtcaggtctggagcgagagtggaaaatgtaacaggacagatcatgtaaagayttgtagaccacagttagaggcttggacaataactctgaggatgacatgaaggtattgggagggggtgttgagcagaggagtgatatgatctggtttatat

SEQ ID NO: 23827 - DNA, 201 bp, Homo sapiens
agttggtacaaaaccctttagcttttgcaaacctcctttaagacccgatttaaatgcttccctcctcatgaagctcttctggatccactccttcccatcamtaagttgaaagtaagatccccttctctttacttccattagacttggattacagcactctttgtatcatgtatttaattctgttttttaattacagttaac

SEQ ID NO: 23828 - DNA, 201 bp, Homo sapiens
cttctgccttcttgaattgatttgcctctttatctcccctttcagccttgaaagttcctcgaaggcagggactgtgtccccatcttttctataaatggcaktgttgtacattggtaaagttgagtgaaaaaatctttttgataatcacaaattattaccatatattgagcacctaccatgatgagtatctctgatcttcat

SEQ ID NO: 23829 - DNA, 201 bp, Homo sapiens
caatttacatttcctttcagtctcattctcttcttttaacagctttattcaggtataatttacatacaatataatttgcttgttttttaagagtataattyagtgatttttggtaaattgagagttttgcaaccatcaccacaatccagttttagaacttttccatcaccccacatctgtcttatatacacatataaatgt

SEQ ID NO: 23830 - DNA, 201 bp, Homo sapiens
aatgaaaagcttacataaaattgatttccggtggggccttcagttactctccattctacgaagaccacaaatagcattcaggcaaagagcatttattccarcaatggaggagcactggatttggttcctaaaacaaaataaagtttgaaatcctgtctttcccatgttgaaaacaaagttggtacaaaaccctttagcttt

SEQ ID NO: 23831 - DNA, 201 bp, Homo sapiens
aatcctagcactttgggaggccaaggcgagtggatcacctgaggtcaggagttcaagaccagcctggccaacatgatgaaaccccaactctactaaaaatmcaaaaaggaataatagctgggcgtgatggcgggtgcctgtaatcccaacaactcgggaggctgaggcaggagaattgcttgaacctggggctttggaggt

SEQ ID NO: 23832 - DNA, 201 bp, Homo sapiens
agtcgcatcccagacagtttggcttccgtgagtttaccaatctcatggtaaagactttgtcagactatcaaagttttgacaaatgaaatattagcaaaagkccaaaagggattctctattttcatttgagtatcttcacctgaaaatagttgcctgaataagtagcctgcatagaaaggtacattttagaaatacttgagg

SEQ ID NO: 23833 - DNA, 201 bp, Homo sapiens
cagaactcttgtgtcctctttacttggtttgtttcaagttcatgtcctgcttcatcttttccctaactcactgcaaggtgaattttcttctctgcaatcgrcaattccccaaatcacatcaggtcattaatttattcactcatttgtattcattcattcattagttcatccatccatctattcattcattcatccaattta

SEQ ID NO: 23834 - DNA, 201 bp, Homo sapiens
atttactcaactcaattttttacttggttcataatgaaaactatactattgcttcagtcagatgtttgcgaatagctgtgtgatctcaaaatgttttcctrtgtgatctatagaaaatggaatgatagagtattaggctgtaagggcctaagaaacaaaggaaaaagagaagtgaactgttagtttagttgtaaaacctaa

SEQ ID NO: 23835 - DNA, 201 bp, Homo sapiens
aaacagcacgttcacgttcttgatctttggtttgcacaacaacctgtgaatgttattagccccgttttttttgtttgtttgttttttgagacagagtgtcrctcttgttgcccaggctggattgcaatggcgtgatctcggctcactgcaacctctgcctccaagcaattctcctgcctcagcttcctgagtagctgggat

SEQ ID NO: 23836 - DNA, 201 bp, Homo sapiens
tagctggctttcattactgtttttcacacattaactttggcctcaacttgacaactcaaataatatttataaatacagccacacttaaaatggtcccattrtgaaatacatatttaaatatctatacgatgtgttaaaaccaagaaaatatttgattcttctctgatatttaagaattgaaggtttgaggtagttacgtgt

SEQ ID NO: 23837 - DNA, 201 bp, Homo sapiens
tcttcgtatctgcatgtggatacaaccatgaatggccaaagttattgcagtgttgaatagacacttatatagcactgtgtggcaagtactgtttgaaatgyttttcacgtgtttattcattgtatttattttgagatagggtcttgctctgttgcacagggtggagtgcagctgcacagacaaggctcactgcaacctcag

SEQ ID NO: 23838 - DNA, 201 bp, Homo sapiens
gtatgtgtgagtcagcattcagagtacttaacacacttagtgtcattagtgataacttaacccacacgtataggaagctagacctccatttacagaaaaayggaggctcagagagcctaactgactttcccaaggccacataactggaaaattctggaactgagttttttcaggtatgtcttggtatccctcggtgagcct

SEQ ID NO: 23839 - DNA, 201 bp, Homo sapiens
cggcacgatcttggttcactgcaacctctgcctcccgggttcaaacaattcttcctgcctcagcctcccgaatagctgggattacaggcacttaccaccakgcctggctaatttttgtattttttagtagagacggggttttgccatgttggccatttgaactcctgaccatctttgaactcctgaccatgtttgccatgt

SEQ ID NO: 23840 - DNA, 201 bp, Homo sapiens
ttctgaaataccttttttttttaaggttgtggagctctctgaagcttataaggattttgccaggaaaagataagaaatatctttgggcattttgtcactgkgctggagatgaaccctttggaggacatatcaccttgttgaggtcaaggggcggaaagggacaggactggcagagagatccggggcagcagcctgccatcc

SEQ ID NO: 23841 - DNA, 201 bp, Homo sapiens
ccagggactttctgcttaggacccctctcatcacttctccaacgctggtatcatgaaccccattctacagatgatgtccactagattaagaatggcatgtraggccaagtttccacctgagagtcagttttattcagaagagacaggtctctgggatgtggggaatgggacggacagacttggcatgaagcattgtataaa

SEQ ID NO: 23842 - DNA, 201 bp, Homo sapiens
gaaataagatgccagatgtaagttgtcaacagttgcagccacatgacagacatagatatatgtgcacacactagtaaacctctttccttctcatccatggktgccacttttatctttttatttttatttttttttttgagatggagtctcgctctgacgcccaggctggagtgcagtggctcgatctcggctcactgcaac

SEQ ID NO: 23843 - DNA, 201 bp, Homo sapiens
ctcagcgtggtggcatgctcctgtagtcccagctactcgtgaggctgagacaggagaatcgtttgaacctgggaggcggaggttgcagtgagccaatatcrcgccattgcactccagcctggctgacagagtgagactccatctcaaaaaaaaaaaaaaaaaaagaattttataaaatcaggaaataatattagtgtttat

SEQ ID NO: 23844 - DNA, 201 bp, Homo sapiens
ccacttttgttccatttttcccactttgttctttggcacacagaatgtttgatttgtgaaaatcttaataacagtagttttttctataaggaacactcagaatcttgataatattggaataatacagatccttttgtaggatcctctcagacctcatataatagagttcatgtagtcaatatttaaagaaaaacaccctta

SEQ ID NO: 23845 - DNA, 201 bp, Homo sapiens
cccacttttgttccatttttcccactttgttctttggcacacagaatgtttgatttgtgaaaatcttaataacagtagttttttctataaggaacactcagaatcttgataatattggaataatacagatccttttgtaggatcctctcagacctcatataatagagttcatgtagtcaatatttaaagaaaaacaccctt

SEQ ID NO: 23846 - DNA, 201 bp, Homo sapiens
gcacccctaccagcaatgtgggagaaaatagcaacatatttttgatgttggggtctagtgttacggtttcttctgctctttgggatgtatattccatggcwactgaatacccaagtcccaaacagttttcttagactcagaaggtcatccacttcagcttcttcatcaaaaagacatattttctggctgggcacggtggct

SEQ ID NO: 23847 - DNA, 201 bp, Homo sapiens
attctcctgcctcagcctccctagtagctgggattacaggtgcatgccaccacacccggctaatttttgtatttttagcagagatggggtttcgtcatgtyggccaggctggtctccaactcctgacctcaggtgatccacccacctcggcctcccaaagtgctagaatcacaggtgtgagccgccgcacccggccgctta

SEQ ID NO: 23848 - DNA, 201 bp, Homo sapiens
cccatatttcagaacttgatacatttttaggataaaccatgaatgacacccgtttcttctccctcaccctcccttccctcccattttttttttttttttttagaagctgaataatatcaatgatatcctgaagtccgtgttcttgatcttcccacatttttgcctgggacgagggctcatcgacatggtgaaaaaccaggc

SEQ ID NO: 23849 - DNA, 201 bp, Homo sapiens
ttttaaatttggtggaatatgtttttattagcttgtatctttaattcctaaattaagctgtgtgtgtgtgtgtgtgtgtgtgtgtgtgtgtgtgtgtgtgtgaagtttaaagccaggatgagctagtttaaagtatgcagcctttggagtcatacagatctgggtttgaatctggtctctaaactttatagatgtatgata

SEQ ID NO: 23850 - DNA, 201 bp, Homo sapiens
tagtgaaaccctgtctctgctaaaaacatagaaaaattagccgggcatggtggcgtgcgcctgtaatcccagctactcgggaggctgaggtgagagaattrcttgaacccgggaggcggaggttgcagtgagcccagattgcaccactgcactccagcctgggcgacagagcaagactccatctcaaaaaaagctctcaga

SEQ ID NO: 23851 - DNA, 201 bp, Homo sapiens
ttgtttgttgcagatatatagaaggaagcggaagcctgctgttgacaggatttgcgtgggcattcctcctggtgaggtaaagacactttgtctatattgcrtttgtccctattagttcagactatctctacccaatcaagcaacgatgctcgttaagaggtaaaagtggattttaaaggcttctgtatttatgccaggatg

SEQ ID NO: 23852 - DNA, 201 bp, Homo sapiens
ccccgtctctactaaaaatacaaaaattagctgggcgtggtggtgcaagcctgtaatcccagctactcaggaggcttaggcagaagaatcgcttgaacccrggaggcagagattgcagtgagccgagatggtgccactgcacagagcgagactccatctcaaaaaaacaaaacaaaacaaaacaaaaatcttgctttatag

SEQ ID NO: 23853 - DNA, 201 bp, Homo sapiens
tattcattgtatttattttgagatagggtcttgctctgttgcacagggtggagtgcagctgcacagacaaggctcactgcaacctcagcctcctgcgctcrcgtgatcctcatacatcagcctcttaaggagctggggccacaggcacgcaccactgctcctggctaaatttttacaattttttgtaaagacaaggtctca

SEQ ID NO: 23854 - DNA, 201 bp, Homo sapiens
aaaacttcatttgaatttttaatacataagaaaacaataagaaatagttaaaaatatatatttatataatatatatgtgtgtgtgtgtgtgtgtgtgtatrtatatatatatattttatttatttatttttttttgagatggagtctcgctctgttgcccaggctggagtgcagtggctcaatcttggctcactgccacct

SEQ ID NO: 23855 - DNA, 201 bp, Homo sapiens
ctccagagccaacctggcagcagcctgtgggggcatcatctacttcacgctgtacctgccctacgtcctgtgtgtggcatggcaggactacgtgggcttcmcactcaagatcttcgctgtgagtacctctggcctttcttcagtggctgtaggcatttgaccttcctttggagtccctgaataaaagcagcaagttgagaa

SEQ ID NO: 23856 - DNA, 201 bp, Homo sapiens
aaaccaaatactttttcttttttttttttttctgagatggagtcttgctcttttgcctaggctggagcgcagtagaatgatcttggctcactgcaacttcygcctctcaggttcaggtgattctcctgcctcaacctcctgagtagctgggattacaggtgcgtgccaccacacccggctagtttttgtgtttttagtagg

SEQ ID NO: 23857 - DNA, 201 bp, Homo sapiens
gtagaatgatcttggctcactgcaacttccgcctctcaggttcaggtgattctcctgcctcaacctcctgagtagctgggattacaggtgcgtgccaccayacccggctagtttttgtgtttttagtagggacagggtttcaccatgttggccaggctggtctcaagctcctgacctcaagtgatctgccagcctcagcct

SEQ ID NO: 23858 - DNA, 201 bp, Homo sapiens
ggaaaacttcatttgaatttttaatacataagaaaacaataagaaatagttaaaaatatatatttatataatatatatgtgtgtgtgtgtgtgtgtgtgtrtatatatatatatattttatttatttatttttttttgagatggagtctcgctctgttgcccaggctggagtgcagtggctcaatcttggctcactgccac

SEQ ID NO: 23859 - DNA, 201 bp, Homo sapiens
atagactcttctaattatgaagatatctagatgtctagaaaatatcaaaatgcatgtggtttttgcatttctaaaatacttttaaaaccaaatactttttyttttttttttttttctgagatggagtcttgctcttttgcctaggctggagcgcagtagaatgatcttggctcactgcaacttccgcctctcaggttcagg

SEQ ID NO: 23860 - DNA, 201 bp, Homo sapiens
aaggagacaattagagatcaatctggaaaacttcatttgaatttttaatacataagaaaacaataagaaatagttaaaaatatatatttatataatatatrtgtgtgtgtgtgtgtgtgtgtgtatatatatatatatattttatttatttatttttttttgagatggagtctcgctctgttgcccaggctggagtgcagt

SEQ ID NO: 23861 - DNA, 201 bp, Homo sapiens
accttctgggtactgaaatcagcaagtcacttgccctccatggccgaatccctgcttcccacgaagagaacctcacaaaaatttcccccaagttaaagagkggaattttcttgatttttttttcttttttttttaacggccgtagtttagaacccagacttaaattatgatcttcttttcaaacaaaacttaaagtcctta

SEQ ID NO: 23862 - DNA, 201 bp, Homo sapiens
aacctccacctcctgggttcaagagattctcctgcctcagcctcctgagtagctgggactataggcgcacgccaccatgcctggctagtttttgcattttyagtagagacagagtttcaccatgttggccaggatggtctcgatttcctgacctcttgatccacccgcctcggcctcccaaagtgctgggattacaggcgt

SEQ ID NO: 23863 - DNA, 201 bp, Homo sapiens
aggtgctttaaggagacaattagagatcaatctggaaaacttcatttgaatttttaatacataagaaaacaataagaaatagttaaaaatatatatttatataatatatatgtgtgtgtgtgtgtgtgtgtgtatatatatatatatattttatttatttatttttttttgagatggagtctcgctctgttgcccaggctg

SEQ ID NO: 23864 - DNA, 201 bp, Homo sapiens
tctactaggtgtctttgctcgcggttccgactgtgaatccggtgaagaccggtggttgcagacggggaggaactatgaggttgaggcgaaagcccgttttktttttttttttttgtttttttggttttttttttgttagcgtgtttgccaactcccaggccattggtaaagcaggaaggttcttggggcggcggacggtgc

SEQ ID NO: 23865 - DNA, 201 bp, Homo sapiens
cacatgcagtgtccctttccaaatcctcccatgccatttatgtccaatgctgttgacctattgggagttcacggtctcgatccctgagggacattttctttgttgtcttggcttctagaagagtatcttttacttgccccctcccaaacacacatttcatggtctcctaacaagctagaagaaagaggtaaagacaagcgt

SEQ ID NO: 23866 - DNA, 201 bp, Homo sapiens
ccggctctactaggtgtctttgctcgcggttccgactgtgaatccggtgaagaccggtggttgcagacggggaggaactatgaggttgaggcgaaagcccrttttgtttttttttttttgtttttttggttttttttttgttagcgtgtttgccaactcccaggccattggtaaagcaggaaggttcttggggcggcggac

SEQ ID NO: 23867 - DNA, 201 bp, Homo sapiens
tcacatgcagtgtccctttccaaatcctcccatgccatttatgtccaatgctgttgacctattgggagttcacggtctcgatccctgagggacattttctttgttgtcttggcttctagaagagtatcttttacttgccccctcccaaacacacatttcatggtctcctaacaagctagaagaaagaggtaaagacaagcg

SEQ ID NO: 23868 - DNA, 201 bp, Homo sapiens
ctccctctcccacgttccctgcagccccatcttccagaccgttgctgctggtctctcggggcagcttctgcctgggcgcagatggggaagctgggccgagktggtgccgtggaatgaccgggagtaaccccggcgggcggcgcagaactcggagctccgccgcggggctgggctgggctctgccgtgagggtgggggtgct

SEQ ID NO: 23869 - DNA, 201 bp, Homo sapiens
atcacatgcagtgtccctttccaaatcctcccatgccatttatgtccaatgctgttgacctattgggagttcacggtctcgatccctgagggacattttctttgttgtcttggcttctagaagagtatcttttacttgccccctcccaaacacacatttcatggtctcctaacaagctagaagaaagaggtaaagacaagc

SEQ ID NO: 23870 - DNA, 201 bp, Homo sapiens
cctcctgagtagctgggattacaggcgcgtcaccacatccagctaatttttgtatttttagtagagacggggtttcaacttgttggccaggctggtctcgmaccctcgacctcaggtgatccaccggcctcggcctccccaagtgctgggattataggcgtgagccaccgcgcgcggccgagttttgtttcttttaaaaac

SEQ ID NO: 23871 - DNA, 201 bp, Homo sapiens
atgacaaagccaaggccacaaatagaactgaaaactcttgatgtcagagatgacctctcttgtcttccttgtgtccagtatggtgttttgcttgagtaatrttttctgaactaagcacaactgaggagcaggtgcctcatcccacaaattcctgacttggacacttccttccctcgtacagagcagggggatatcttggag

SEQ ID NO: 23872 - DNA, 201 bp, Homo sapiens
cggggcggggaggagggagagcacaggctttgaccgatagtaacctctgcgctcggtgcagccgaatctataaaaggaactagtcccggcaaaaaccccgyaattgcgagcgagagtgagtggggccgggacccgcagagccgagccgacccttctctcccgggctgcggcagggcagggcggggagctccgcgcaccaac

SEQ ID NO: 23873 - DNA, 201 bp, Homo sapiens
ctaagacacctgctgtaccctccacccccaccccaccccacccacctccccccaactccctagatgtgtcgtgggcggctgaacgtcgcccgtttaagggrcgggccccggctccacgtgctttctgctgagtgactgaactacataaacagaggccgggaacggggcggggaggagggagagcacaggctttgaccgata

SEQ ID NO: 23874 - DNA, 201 bp, Homo sapiens
gcagtgtatgtggtttatagtcctgccttccacagttgcttgggagagctgtgagtcactgaggcttatgaatgtttacattttgtttgttgcagatatayagaaggaagcggaagcctgctgttgacaggatttgcgtgggcattcctcctggtgaggtaaagacactttgtctatattgcgtttgtccctattagttca

SEQ ID NO: 23875 - DNA, 201 bp, Homo sapiens
ctaccacgcccagctaattttgtatttttagtagagatgggttttatccatgttggtcaggctggtctcgagctccagacctcaggtgatctgcccgcctyggcctcccaaagtgctgggattataggcctgagccacagcgctcagccataactttaatttgaaaatgattgtctagcttgatagctctcaccactgagg

SEQ ID NO: 23876 - DNA, 201 bp, Homo sapiens
gccagctggttaaaataaaattgatttctggcttatcacttggcatttgtgatgatttcctcctacaagggatacattttaagttgagttaaacttaaaawatattcacagttctgaggcaataaccgtggttaagggttattgatctggaggagctctgtctaaaaaattgaggacaggagactttagacaagggtgtat

SEQ ID NO: 23877 - DNA, 201 bp, Homo sapiens
cgtagttacctccttagagtatgaaaaaataggcttagggcatccccaagtcccctctatgtctgagagctgaggctggctgtcaaagaggaactaaggaygccagggactttctgcttaggacccctctcatcacttctccaacgctggtatcatgaaccccattctacagatgatgtccactagattaagaatggcatg

SEQ ID NO: 23878 - DNA, 201 bp, Homo sapiens
tgtgtgttgaaaccagtggtacctaacacatttacatcccaaccttaaactcctatgcacttatttaccctttaatgagcctctttacttaagtacagtgkgaggaacagcggcatcaggatcacttgggaacttgttagaaattcagcaacttgggcccagctcagacctactgaatcagaatcaggagcaattctctgg

SEQ ID NO: 23879 - DNA, 201 bp, Homo sapiens
ggtcttgaactcctgacctcaggtgatccgcccaccttggcctcccaaagtgctgggattacaggcgcgagccactgtgcccagcccacttcatcttaccrtagttacctccttagagtatgaaaaaataggcttagggcatccccaagtcccctctatgtctgagagctgaggctggctgtcaaagaggaactaaggatg

SEQ ID NO: 23880 - DNA, 201 bp, Homo sapiens
aggtgcccttgaggagctttgtagctggcagaggaggtgaaactgacaaatgtttggcagatggaggagagtaccagaggggtttgagatgagctaaattycaatctaaccgcaggtgtgaggaagaggcttggattgggaccatggagatgggggttctactcccagtcacgccagctgactttgcgagtgttctttgtc

SEQ ID NO: 23881 - DNA, 201 bp, Homo sapiens
atattatttacttgtcttcctgtacacccactgcctagtcctgatcctacttttgtttgcaaataggatggggcacaacgtacaaggaagggcctttgccrcccctgctaagggataacctgaaataccttcaccatcactgccctgtgctgcttttcacctatgccagtctgtctacagtgccagtgtctcctggcattg

SEQ ID NO: 23882 - DNA, 201 bp, Homo sapiens
ttccagtgagcctcctgcctcagcctcccaaatagctgagactacaggcatgtgccaccacgtccggctaatttttgtatttttagtagagacagggtttygccatgttgaccacactggtctcgaactcctggcctcaggtgattcgcccgcctcagcctcccaaagtgctgggattacaggcatgagccaccatgcccg

SEQ ID NO: 23883 - DNA, 201 bp, Homo sapiens
gaagtcttcctttgaaggttgcttggtgtttgcttagtggaaatcagcaggggaagagaggctatctctaacattttgttagagtttcttcgtagttctayagtgatgaaacaaggacttggggtacaggacagatctgctttcagaaatcctggctcttgtgaggtttagaagccctgagaccatttagctggtggcaac

SEQ ID NO: 23884 - DNA, 201 bp, Homo sapiens
tagtgcaatctccgctcactacaatgtctgcctcccaggttccagtgagcctcctgcctcagcctcccaaatagctgagactacaggcatgtgccaccacrtccggctaatttttgtatttttagtagagacagggttttgccatgttgaccacactggtctcgaactcctggcctcaggtgattcgcccgcctcagcctc

SEQ ID NO: 23885 - DNA, 201 bp, Homo sapiens
gtatacagatcttcctttgagaaaaactgattgtgttcagcctctcatgttacaaatggggaacctgaattctgaggtctctagtgagagaacagggactrgaatctgtggatcctatctgttttaataataattgtaaagtataatagataatattatattaataaaataaaagcaaacacttagaatgagcttccatgt

SEQ ID NO: 23886 - DNA, 201 bp, Homo sapiens
ctctatgttcaggtgctgaggagctggcaaaaggttttaagtcggggagaggcatgttcagatatttggtctagctgagtaactttgggtgctctgtgacraatggttgggagaccagtgaggtggcagttgcggtcatctaggagcaggatcagagtggcctattgactgggatgactgtgaagtgggatcctttccagc

SEQ ID NO: 23887 - DNA, 201 bp, Homo sapiens
tattaggaagtaaaagtaggtataaacttcttataggctgttattatacaactatatgacccatacatatttacaaattaagtgcagccaaaattgcaaartcaataccattcaaattaataccttaaatgtggtgaggcagctgttgttcaactgaaaccaaattataagttgcatggcagtaaatgctatcatgctgat

SEQ ID NO: 23888 - DNA, 201 bp, Homo sapiens
accagggaggaggctctccaagtggccaaggcataaagcaagaaatgaggcctggtgactgcttagtggcagagcagtgaaagagagggaggcatcaaagygagtctcgatttctagctgggtgggtggtagcgatgtccagtaggccagtggctactgaggtctgcagtggaggagggtggttgggctggagacagatga

SEQ ID NO: 23889 - DNA, 201 bp, Homo sapiens
attgcttcagtcagatgtttgcgaatagctgtgtgatctcaaaatgttttcctatgtgatctatagaaaatggaatgatagagtattaggctgtaagggcmtaagaaacaaaggaaaaagagaagtgaactgttagtttagttgtaaaacctaactttggtgaattgtaaaaatttgttataatacaatatgattcttgct

SEQ ID NO: 23890 - DNA, 201 bp, Homo sapiens
gggctgagaactccacaaagtgccggaatacatttgcatgtaagacagaacgctgcctgggtcattgatgcctgttgagtggcagtcacagacactgcctrgggtttctgactcacgctgttgggactgttctatgcagggcaccctcttgtgtggcataggatttgtgcctcaccacacactgttgtagctttgctgtct

SEQ ID NO: 23891 - DNA, 201 bp, Homo sapiens
tctttgcaagagggacaagagtgtgggagatactgagttaatgcaacttgcaggttttaagtgtcctgtcattgtgccttgtgctttgatacattctgagkttcagtaaagagacctgatgcattggactgttgcaatggaacctgttttaagatcttcaaagctgtattgatatgaagttctccaaaagacttcaaggac

SEQ ID NO: 23892 - DNA, 201 bp, Homo sapiens
ctaaatacaagtcctgtgtttttatcacagggaggctgatcaatataatgaaattaaaagggggctggtccatattgttctgtgtttttgtttgtttgttttgtttgtttctttttttgtttttgtggcctccttcctctcaatttatgaagagaagcagtaagatgttcctctcgggtcctctgagggacctggggagct

SEQ ID NO: 23893 - DNA, 201 bp, Homo sapiens
actaaatacaagtcctgtgtttttatcacagggaggctgatcaatataatgaaattaaaagggggctggtccatattgttctgtgtttttgtttgtttgttttgtttgtttctttttttgtttttgtggcctccttcctctcaatttatgaagagaagcagtaagatgttcctctcgggtcctctgagggacctggggagc

SEQ ID NO: 23894 - DNA, 201 bp, Homo sapiens
aactaaatacaagtcctgtgtttttatcacagggaggctgatcaatataatgaaattaaaagggggctggtccatattgttctgtgtttttgtttgtttgttttgtttgtttctttttttgtttttgtggcctccttcctctcaatttatgaagagaagcagtaagatgttcctctcgggtcctctgagggacctggggag

SEQ ID NO: 23895 - DNA, 201 bp, Homo sapiens
aaactaaatacaagtcctgtgtttttatcacagggaggctgatcaatataatgaaattaaaagggggctggtccatattgttctgtgtttttgtttgtttgttttgtttgtttctttttttgtttttgtggcctccttcctctcaatttatgaagagaagcagtaagatgttcctctcgggtcctctgagggacctgggga

SEQ ID NO: 23896 - DNA, 201 bp, Homo sapiens
aatcacatgcagtgtccctttccaaatcctcccatgccatttatgtccaatgctgttgacctattgggagttcacggtctcgatccctgagggacattttctttgttgtcttggcttctagaagagtatcttttacttgccccctcccaaacacacatttcatggtctcctaacaagctagaagaaagaggtaaagacaag

SEQ ID NO: 23897 - DNA, 201 bp, Homo sapiens
tgaggagcagggcattggagtgcagtgggacaacctgtttgagagtcctgtggaggaagatggcttcaatctcaccacttcggtctccatgatgctgtttracaccttcctctatggggtgatgacctggtacattgaggctgtctttccaggtacactgctttgggcatctgtttggaaaatatgacttctagctgatgt

SEQ ID NO: 23898 - DNA, 201 bp, Homo sapiens
gtatctttgtcaaggtaggagaccttgtggcctccacgtgcacttccagggcctgcttgggcctcttctacgggtctgtcctgagtcttctatgaatctgyccttcagggcagattcatatttagactcttcacagtttgacctgagttttggccagaataaggtgacatttagtttgttggcttgatggatgacttaaat

SEQ ID NO: 23899 - DNA, 201 bp, Homo sapiens
atataaatgatgtcacagtgtacaaggctgttgtgggatcaagcaatcaaatgagatcatgcttgtcttttccaaatggtgagggaatagatgcatgtttrtggttgttacggaatgatcctgtgctcctgaggcaacagaaaggccaggccatctctggtaatcctactcttgctgtcttccctttgcagagacacgccc

SEQ ID NO: 23900 - DNA, 201 bp, Homo sapiens
gtgggaggatcgcttgagcccagggagtcaagtctacactgagccatgattggatcactgcactccagcctgggtagacagagcaagaccctgtctcaaamaaaagaaatgaaagagaaagaaagaaagaggagaggagaggagatgaggggaggggaggggaggagggagggggggaggaaggaaggaaggaaggaagga

SEQ ID NO: 23901 - DNA, 201 bp, Homo sapiens
tggaaacataaagttttaaaagttttatgcttcactgtatatgcatttctgaaatgtttgtatataatgagtggttacaaatggaatcattttatatgttrcttggtagcccaccactcccctaaagggactctataggtaaatactacttctgcaccttatgattgatccattttgcaaattcaaatttctccaggtata

SEQ ID NO: 23902 - DNA, 201 bp, Homo sapiens
ggtagaattggctgctcatctcaaccccgctactgactatctctgtgatttacccttcctccagccttagccttgctacatataaaatcaagacaataatrtttcctatctcacagggttgtcctgaggattaaattaagtaattaatataaaatgtgccttgtacatattgggccctaaataaacagtagctactattta

SEQ ID NO: 23903 - DNA, 201 bp, Homo sapiens
caggagtttgagaccaacctggccaacatagtgaaaccccgtctctactaaaaaatataaaaaattagccgggcatggtggcaggtgcctgtaatctcagytactcgggaggtggaggttgcaatgagcccagatcgcaccattgcactccagcctgggcaacaaaaggtgaaactccatctcaattaaaaaaaaaataat

SEQ ID NO: 23904 - DNA, 201 bp, Homo sapiens; identical to SEQ ID NO: 3373

SEQ ID NO: 23905 - DNA, 201 bp, Homo sapiens
ggtggctgggatacacagaatgtagtatcccttgttcacgagaagaccttcttgccctagcatggcaaacagtcctccaaggaggcacctgtgacacccarcggagtaggggggcggtgtgttcaggtgcaggtggaacaaggccagaagtgtgcatatgtgctgaccatgggagcttgtttgtcggtttcacagttgatg

SEQ ID NO: 23906 - DNA, 201 bp, Homo sapiens
atatttttgagtcttgctctgctggagtgcagtggtgtgatctgggctcactgcaagttctgcctctcaggttcacaccattcttctgcctcagcctcccsagcagctgggactacaggcgcctgccaccatgcccagctaattttttgtatttttagtagagacggggtttcaccctgttagccaggatggtctcgatct

SEQ ID NO: 23907 - DNA, 201 bp, Homo sapiens
ttgaacccaggaggcagaggttgcagtgagctaagatcgcatcattgcactcccgcctgggcaataagagtgaaactccatctcaaaaaaaaaaaaagatrcaaaaatagaaaaaggggcttggtaagggtagtagggttttgggcaatttttttttttttttttttttattgtatggttctaaaggaatggttgattacc

SEQ ID NO: 23908 - DNA, 201 bp, Homo sapiens
ggacagaattgctcccagtattgatcattgtgttctgagatgggggagcaaattgtgcaggaggccaggtcagtgccaaggtgggtgggaggaattggagsaggaagcttgcctaagtgtgcccagcaaagccacggtagaactttctactgtggctctatgctacttcttagcaaccttctccatgtgcttcctggagag

SEQ ID NO: 23909 - DNA, 201 bp, Homo sapiens
gactgcaattctctggctgcacttcacaaatgtatacaaactaaatacaagtcctgtgtttttatcacagggaggctgatcaatataatgaaattaaaagrgggctggtccatattgttctgtgtttttgtttgtttgttttgtttgtttctttttttgtttttgtggcctccttcctctcaatttatgaagagaagcagt

SEQ ID NO: 23910 - DNA, 201 bp, Homo sapiens
gcatttctcactctccagaaaatctctaagatttcagctattaggcatttgtctttttttttttttttttttttttttttgagactgagtcttgctgggtygcccaggctggaatgcagtgtcacaatctcggctcatcacaacctccacctccctgattcaagtgattctcctgcctcagactcccgagtagctgtgact

SEQ ID NO: 23911 - DNA, 201 bp, Homo sapiens
ttatattagtagggatgggtaagaggtgttttggtctggttggttggttagttgctatgactcagaattgctaagaaaacagaaaagtaagataagatcaytgttttaacctcttttcctccacaaaatcaataaataacatatccctaaattactcttagaatttctcttaaattgcagtgaaaaaccaaaatccttcat

SEQ ID NO: 23912 - DNA, 201 bp, Homo sapiens
ccacctcattctggccaaaactcaggtcaaactgtgaagagtctaaatgtgaatctgcccttcaaggtggctacaaaggtatctttgtcaaggtaggagaycttgtggcctccacgtgcacttccagggcctgcttgggcctcttctacgggtctgtcctgagtcttctatgaatctgcccttcagggcagattcatattt

SEQ ID NO: 23913 - DNA, 201 bp, Homo sapiens
tagtagagatgagtttcaccatgttggtcaggctggtctcaaattcctgacctcaagtgatcacccgcctcaacctcccaaagtgctgggattacaggccrgagccacagtgcccagccaaggctaacctcttgatcccaatgacaaacagaacaaacatcttactcaagtccagaagcaataataattttgaatcttgct

SEQ ID NO: 23914 - DNA, 201 bp, Homo sapiens
agcacatctgtgcaggcctctgcctcggcccctctggatctgctgattgagcagcggattgatctgtccttctctttcgtgttgacccatgtgaggaaccractggcaagggaacaagaaatggaaataggcctcctttgcatcatgacctgtacatcctgcaattggaaaagattgtactttagttggtttaaccagcag

SEQ ID NO: 23915 - DNA, 201 bp, Homo sapiens
acctgaggggtagggaggtcctgcctacagtctccgtgcgctcagctgagctggtgtccctggcgcagagcgcggacgagttttgtttccttttctttttyttttttttctttcctttaagtctcggtctgtcgcccaggctggagtgcaatggaacgatctccgctcactgcaacctccgcctcccgggttcaagcgatt

SEQ ID NO: 23916 - DNA, 201 bp, Homo sapiens
cagaggcagaaagactttacgtaaattgctcatcatgtggttgtcaagtttgaccccaaaacccaatttattgaccaaggttattctttgactgaggcaarggggtccgctctcctgggccttgggctttagaaagctcatctctggcctttctgagatccatccctttctttttatttttcttgacacggagtcttgctc

SEQ ID NO: 23917 - DNA, 201 bp, Homo sapiens
ctccaattcggtagaaccagagcttcatcttctctgtcgaagctgtgacaggagttgcaaatgcctctcctttttgctgagtttgcagctgctgtttttcyggcagcacatctgtgcaggcctctgcctcggcccctctggatctgctgattgagcagcggattgatctgtccttctctttcgtgttgacccatgtgagga

SEQ ID NO: 23918 - DNA, 201 bp, Homo sapiens
ggtcggccagtacctacggagacaaatgccagcactgagtcttcactcggttcttaagaagctggtctgttctgacctgggaattggctatatgctccccsggactggagcggcacagtcccggactgtgaatccgggaactcgagttggaggtgtcccaaacggtccgtggtgctattgctcactagaggccttgggtct

SEQ ID NO: 23919 - DNA, 201 bp, Homo sapiens
ggctgatcaatataatgaaattaaaagggggctggtccatattgttctgtgtttttgtttgtttgttttgtttgtttctttttttgtttttgtggcctccwtcctctcaatttatgaagagaagcagtaagatgttcctctcgggtcctctgagggacctggggagctcaggctgggaatctccaaggcagtaggtcgcct

SEQ ID NO: 23920 - DNA, 201 bp, Homo sapiens
gtggcccttcccctcccctctgtgctctatagctcagtcttcccaggcggtgtgaacacgcagtgacatttccaggaatacagggatttattaatgatttmttgtgaaatgtttggaaatacaaagtactctataaatatttcataatagcattggggctgagaactccacaaagtgccggaatacatttgcatgtaagac

SEQ ID NO: 23921 - DNA, 201 bp, Homo sapiens
gcaacaaaaggtgaaactccatctcaattaaaaaaaaaataatgattttggtggtcgacttcaaataggtaggagaagaaggagagaggagatggagggtyagggagatctaattactctctaaaatcatgctaggaaagataacaccttttaataacactctctgcttttataacatcattctgccaaggagctcaaagg

SEQ ID NO: 23922 - DNA, 201 bp, Homo sapiens
ctcaccccacaggtcccagggcacctctctcgggcaagtcttggaaccctctgacactgatttgctctcttttctgagctgcttttagccacccatcctcrggacctgttttctctctgcctccacccctgcgggcagtcttaggtctcctgcccctcacgagcaccccagagaggccacgtgctcagtgatctcagtggg

SEQ ID NO: 23923 - DNA, 201 bp, Homo sapiens
gtgctagatgccccctctctggagaaaaaaaatccttgtggcctctgacccacctctggagagcctagttcccttctggaggcagaaggcaaagcttaggwcctagagagtgctggaccacgccactcacaggaaccagcaggctgtgaggttgaaagctaggcatatggagctttccaggctgggtgcagggcctcgtgg

SEQ ID NO: 23924 - DNA, 201 bp, Homo sapiens
tttcaccctgttagccaggatggtctcgatctcctgatctcatgatccgcccgcctcggcctcccaaaatgctgggattacaggcgtgagccaccgcgccyggcccagtatttttgttttatgaagatattacatttgtaaagtatgagcttggtgtcagcaaacttatatccctgtgtacaaactggccgaatcacttag

SEQ ID NO: 23925 - DNA, 201 bp, Homo sapiens
tgtgggtggaagaaaagggaacctcttccaactgttttctttgcttcttccctctctttctctttttttttttttttggacagagtcttgctctgtcaccyaggctgaaatgcagtggcatgatcttggctcaccacagcctccgcctcctgggttcaagcaattctcctgtctcagcctccagagtagctgggattacag

SEQ ID NO: 23926 - DNA, 201 bp, Homo sapiens
tgtaattagaagatgccagggtcatctcagaatagaacctcaagccacccaggctacatttacagaatcagcctctccagaaaaacagcaacaaaggaggrccttcctatgtatttggaaggagtcacctagaggagggacttggggttttggtgttggtgtggggggcagggatgggatggggagggggaagcttattga

SEQ ID NO: 23927 - DNA, 201 bp, Homo sapiens
atttggctagctggctttcattactgtttttcacacattaactttggcctcaacttgacaactcaaataatatttataaatacagccacacttaaaatggwcccattatgaaatacatatttaaatatctatacgatgtgttaaaaccaagaaaatatttgattcttctctgatatttaagaattgaaggtttgaggtagt

SEQ ID NO: 23928 - DNA, 201 bp, Homo sapiens
agggttggaagggtggtttttaaaaagaattatcactcactaatcaactagaaatccagtggaatatgcagtacttgtctgtaatccagcaggctaacttytttttttttttttttttgagacggagtctcgctctgtcacccaggctggagtgcagtggcatgatcttggcttaccgcaacctctgcctcccagttcaag

SEQ ID NO: 23929 - DNA, 201 bp, Homo sapiens
ttagacatggtgtgtaggcctgcattcctactcttgcctttttttttgcccctccagtgttttgggtagttttgctcccctacagccaaaggcaaacagakaagttggaggtctggagtggctacataattttacacgactgcaattctctggctgcacttcacaaatgtatacaaactaaatacaagtcctgtgttttta

SEQ ID NO: 23930 - DNA, 201 bp, Homo sapiens; identical to SEQ ID NO: 3379

SEQ ID NO: 23931 - DNA, 201 bp, Homo sapiens
ggttttatatgcttacatttatgtgttagttattaaaacatactaatattgtatatctagtcaaaactgaggtagagagaataaatggttgattttgagtytgagtttcatagtccaaaaagctgatatattgcctgtgttcaagagggtctatatcagccctctagatgccagcatctccaaattttacttttttggaat

SEQ ID NO: 23932 - DNA, 201 bp, Homo sapiens
tattttaaaaacaccatggagacttcttaaagaattcttactgagaattcttttgtgatatgaattcccattctcgaatacattggttttatatgcttacmtttatgtgttagttattaaaacatactaatattgtatatctagtcaaaactgaggtagagagaataaatggttgattttgagtttgagtttcatagtcca

SEQ ID NO: 23933 - DNA, 201 bp, Homo sapiens
cagactataatatagcattaatgatgaaacagacacagtcatcttcgggaagaagaatagaggcttatttgctgcctgtgaaattaaaattactctgactkggaatccatcgttcagtaagtttactgagtgtgacaccttggcttgactgttggaaagacagaaagggcatgtagtttataaaatcagccaaggggaaaa

SEQ ID NO: 23934 - DNA, 201 bp, Homo sapiens
gttttatttttgttttatcttgattcagtaattactcctttcagtaaacacagactgagtgctgtgtgtctgacttatgccaggcataggtgattcagagrtgaaaggtcaagtccctgaacccatctcttgtcttcctgggtattatctgtccctccctgctttagagctcctgaaatttgctagaagcatgtcttcatc

SEQ ID NO: 23935 - DNA, 201 bp, Homo sapiens
cctctaacttctctgatgggttttaacctccagagtcagaatgttctttgccttactaggaaagccatctgtcatttgaaaactctgtacattttatcagyagcttatccatccattgcaaatatgtttttgtgccagccacaatatattgcttctatttggaccaatatgggggatttgaaggaattctgaagttctaat

SEQ ID NO: 23936 - DNA, 201 bp, Homo sapiens
aatctgatctttgggaatacagctacattttataggcttcttagataatgttactctaagtactttaaatatgtggggcttctctgggcttttttttttttgagacggagtttcactcttactgcccaggctggagagcaatggcgcgaccttggctcactgcaacctccgcctcccaggttcaagcgattctcctgcctc

SEQ ID NO: 23937 - DNA, 201 bp, Homo sapiens
taatgtttcagcactgtggatgcaaagtgagcaggataaacaggctcttctttcaaagcttgtggtccactggaccacgtatgaagtagaatagtttaggyccagaaaggcaattaagtaaaatatgaccaagaagaggctctctagtgggtttggtataaagaaaagataagaatgatttagaattggcctatcaatgag

SEQ ID NO: 23938 - DNA, 201 bp, Homo sapiens
ttttaaaaagaattatcactcactaatcaactagaaatccagtggaatatgcagtacttgtctgtaatccagcaggctaacttttttttttttttttttttgagacggagtctcgctctgtcacccaggctggagtgcagtggcatgatcttggcttaccgcaacctctgcctcccagttcaagcaattctcttgcctcag

SEQ ID NO: 23939 - DNA, 201 bp, Homo sapiens
ttacagacatgacccactgcacccggcctgttgtcagtattcttaaacatagacactaactgtaggctgacagcctagcagcaaggaccagttaaagaaaygagtagaactgaagtgtgcttgagtatctctggcagtcagcaaaaacttaatgggaatcatggtaggccaaatgttctgcagtatttcaaaagctgcatg

SEQ ID NO: 23940 - DNA, 201 bp, Homo sapiens
tttttaaaaagaattatcactcactaatcaactagaaatccagtggaatatgcagtacttgtctgtaatccagcaggctaacttttttttttttttttttttgagacggagtctcgctctgtcacccaggctggagtgcagtggcatgatcttggcttaccgcaacctctgcctcccagttcaagcaattctcttgcctca

SEQ ID NO: 23941 - DNA, 201 bp, Homo sapiens
aaccttctctgcatccgtttataattggaaattgacctgcaccagggaaagagagtagcccaggtgtctggggcttgttcccattagatcttccccaaggrgtttttctccttggtggctggcctgtggggcccctctccaggaggcattggtgaagaaactaggggagctggttgccacagacagtgatgtactaatctt

SEQ ID NO: 23942 - DNA, 201 bp, Homo sapiens
gcaggcatttcttggggatggggaggactggcacagggctgctgtgatggggtatcttttcagggaggagccaaagcgctcattgtctgtgcttctcctcctttttctgcggtccctggctccccacctgactccaggtgaacaagaccttccaggaactggctgtgttccatgatctggaaggcatgtgggaggaactca

SEQ ID NO: 23943 - DNA, 201 bp, Homo sapiens
tcattcctcttcttgtgagcgctggcctgctagtggtcatcctgaaggtaaggcagcctcactcgctcttccctgccaggaaactccgaaatagctcaacrcgggctaagggaggagaagaagaaaaaaaatccaagcctctggtagagaaggggtcatacctgtcatttcctgcaatttcatccatttatagttggggaa

SEQ ID NO: 23944 - DNA, 201 bp, Homo sapiens
agcaggcatttcttggggatggggaggactggcacagggctgctgtgatggggtatcttttcagggaggagccaaagcgctcattgtctgtgcttctcctcctttttctgcggtccctggctccccacctgactccaggtgaacaagaccttccaggaactggctgtgttccatgatctggaaggcatgtgggaggaactc

SEQ ID NO: 23945 - DNA, 201 bp, Homo sapiens
cgatctcctgacctcgtgatccgcctgtctcggcctcccaaagtgctgggattacaggcgtgaaccactgcgccctgttgagaatttttttttttttttttgggagacggagtttcgctcttgttgcccgggctagagtgcagtgacacaatctcggctcactgcaacctctgcctcctgggttcaagcgattctcctgcc

SEQ ID NO: 23946 - DNA, 201 bp, Homo sapiens
gctccgcctcccgggttcacgccattctcctgcctcagcctcctgagtagctggaactgcaggtgcccgccaccatgcccagctaatttttttttttttttgtattttgagtagagacggggtttcactgtgttagccaggatggtctcgatctcctgacctcgtgatccgcctgtctcggcctcccaaagtgctgggatt

SEQ ID NO: 23947 - DNA, 201 bp, Homo sapiens
aggatgagagcagttcctgataggctcaaccacaatgagatgtagctgttcagagaaagcattcttttatctataaactggaagataatcccggtgaaacraagcccagccccaggggcttcactaactccaggctgtgcttctcaaactttagtgagcataggaatcacctgggcatcttgtgaagctgtagatttgaat

SEQ ID NO: 23948 - DNA, 201 bp, Homo sapiens
agagacatgacgtgacttttcaaaggctgtaagctgacgagggacatagctagggttcagacttgagtttttctttttctttttctttttcttttttttttaagactgagtcttgcttttgtcgcccaggctggattgcagtggtgcttggctcactgcaacctctgcctcccgggttcaagcaattctcctgcctcagcc

SEQ ID NO: 23949 - DNA, 201 bp, Homo sapiens
cagagacatgacgtgacttttcaaaggctgtaagctgacgagggacatagctagggttcagacttgagtttttctttttctttttctttttcttttttttttaagactgagtcttgcttttgtcgcccaggctggattgcagtggtgcttggctcactgcaacctctgcctcccgggttcaagcaattctcctgcctcagc

SEQ ID NO: 23950 - DNA, 201 bp, Homo sapiens
tagaggaagcaaattccactggtgcccttggctgccgggaacgtggactagagagtctgcggcgcagccccgagcccagcgcttcccgcgcgtcttaggcyggcgggcccgggcgggggaagggcacgcagaccgcggaccctaagacacctgctgtaccctccacccccaccccaccccacccacctccccccaactccc

SEQ ID NO: 23951 - DNA, 201 bp, Homo sapiens
atgcctgggctctttctgatagttttccttttttaattgtcccctcctcattgttaccttggggatttcaagagattcatgtagcttctaaatcaacgaastgattcctggagagcagcttctgtatgagaaaaatctagctaattatttatttcagtgtctctggaatgcaagctctgtcctgagccacttagaaaacaa

SEQ ID NO: 23952 - DNA, 201 bp, Homo sapiens
tcagagacatgacgtgacttttcaaaggctgtaagctgacgagggacatagctagggttcagacttgagtttttctttttctttttctttttcttttttttttaagactgagtcttgcttttgtcgcccaggctggattgcagtggtgcttggctcactgcaacctctgcctcccgggttcaagcaattctcctgcctcag

SEQ ID NO: 23953 - DNA, 201 bp, Homo sapiens
gattggcgtcctgagggagattcagcctagagctctctctcccccaatccctccctccggctgaggaaactaacaaaggaaaaaaaaattgcggaaagcasgatttagaggaagcaaattccactggtgcccttggctgccgggaacgtggactagagagtctgcggcgcagccccgagcccagcgcttcccgcgcgtctt

SEQ ID NO: 23954 - DNA, 201 bp, Homo sapiens
gtttcccctcctgctttatctttcagttaatgaccagccacggcgtccctgctgtgagctctggccgctgccttccagggctcccgagccacacgctgggsgtgctggctgagggaacatggcttgttggcctcagctgaggttgctgctgtggaagaacctcactttcagaagaagacaaacagtaagcttgggtttttc

SEQ ID NO: 23955 - DNA, 201 bp, Homo sapiens
ctcagagacatgacgtgacttttcaaaggctgtaagctgacgagggacatagctagggttcagacttgagtttttctttttctttttctttttcttttttttttaagactgagtcttgcttttgtcgcccaggctggattgcagtggtgcttggctcactgcaacctctgcctcccgggttcaagcaattctcctgcctca

SEQ ID NO: 23956 - DNA, 201 bp, Homo sapiens
ttcaaagggctataagggactttggagagaatttcattcagttttcctcaaactagaataatgcttgcactgtctgtaaaagaacaaaagtgtcaaagcayccttttgttcactaaatttccttttttattatagtgttacttaaatattaggaagtaaaagtaggtataaacttcttataggctgttattatacaactat

SEQ ID NO: 23957 - DNA, 201 bp, Homo sapiens
actcagagacatgacgtgacttttcaaaggctgtaagctgacgagggacatagctagggttcagacttgagtttttctttttctttttctttttcttttttttttaagactgagtcttgcttttgtcgcccaggctggattgcagtggtgcttggctcactgcaacctctgcctcccgggttcaagcaattctcctgcctc

SEQ ID NO: 23958 - DNA, 201 bp, Homo sapiens
tgcctaatcgcttttcagtggtgtcattattttgcctattctccatctgagaatattgaagtttctgactccttccttgcctttctccctgcctcccgtgkttatccccaggtcttggtgttccagtcctctatgtccgtccttactcttattcctttgctacagtgtgatccagggctcctgccccttcttatcctggta

SEQ ID NO: 23959 - DNA, 201 bp, Homo sapiens
gagggtttatgtttaggaaaagtgctaagcttagagaaggaggagaaatctgattttattaatgagtgtagccataatggcatatcctggcagaagtcaastttggtttctagagggaggctattatgaaaagaaatacctggaacattcccctgggtttggaaggtgagttctaggttcaatgatgggaagaattttaga

SEQ ID NO: 23960 - DNA, 201 bp, Homo sapiens
gatgggaagaattttagaggtccaagataaaagggcaaagattaaattttgtctctcatgagttctctggctcaggtggtgtgaactttgcagacagtctytttaattcactcatacatgctagtctcccagctcagcaagggctttgagagagcaggtgtctgtatgctctggtaagtgaaggcaaagtgcataaggagg

SEQ ID NO: 23961 - DNA, 201 bp, Homo sapiens
gaggattcttcaaatgcacaggaccgtgatgtgagttaggacggagtaaggacgatgggatgtggctcaggacaatcctgaggaagctgcagctgcggcaygcagggccacactgtcatgttcatggaccctagactggctttgtagcctccatgggccccttccatacacaaatattaaaaattatatttcatgactgca

SEQ ID NO: 23962 - DNA, 201 bp, Homo sapiens
agctttgtcgtattcctgatccaggagcgggtcagcaaagcaaaacacctgcagttcatcagtggagtgaagcctgtcatctactggctctctaattttgwctgggatatggtaaggacacaggcctgctgtatctttctgatgtctgtcagggccatggattgatatggataagaaagaaagagctctggctatcatcag

SEQ ID NO: 23963 - DNA, 201 bp, Homo sapiens
ggggacagaagagttcttgaagccagtttgtccatcatggaaaatgagataggtgatgtggctacgtcagggggcccgaaggctccttgttactgatttcygtcttttctctctgccttttccccaagggccaggacccctggatctctgggcagagcagacgcaggcccctataatagccctcatgctagaaaggagccg

SEQ ID NO: 23964 - DNA, 201 bp, Homo sapiens
cactgcctgggtaaagattgtcttgccagctgtgtttgtctgcattgcccttgtgttcagcctgatcgtgccaccctttggcaagtaccccagcctggaayttcagccctggatgtacaacgaacagtacacatttgtcaggtatgtttgtcttctacatcccaggagggggtaagattcgagcagaccaaagatgtttac

SEQ ID NO: 23965 - DNA, 201 bp, Homo sapiens
ccaggattcaggacttctggctcctggtcctgggttcatggcccaatgtagtctttctcagtcttcaggaggaggaagggcaggacccagtgttctgagtyaccctgaatgtgagcactatttacttcgtgaacttcttggcttagtgcctctgccaggtggccataacctctggccttgtgttgccagagaaaaggttta

SEQ ID NO: 23966 - DNA, 201 bp, Homo sapiens
gtttatggatggatagtctacttgtgccaggtgctgagatttgttttttgttttttgatttttttttaatcactgtgacctcatttaattctcaaaaaaakatgaaaaaatgaacactcaggaatgctgacatgagattcagaatcaggggtttggggcttcaaagtccatcctctctttatccatgtaatgcctcccctt

SEQ ID NO: 23967 - DNA, 201 bp, Homo sapiens
cccagctcagacctactgaatcagaatcaggagcaattctctggtgtgactgtgtcacagccaggtatcaactggattctcatacataggaaatgacaaaygtttatggatggatagtctacttgtgccaggtgctgagatttgttttttgttttttgatttttttttaatcactgtgacctcatttaattctcaaaaaaa

SEQ ID NO: 23968 - DNA, 201 bp, Homo sapiens
gctgggcagctggcttgattgccttccctgcgacctcaaggaccttacagtgggtagtatcaggaggggtcaggggctgtaaagcaccagcgttagcctcrgtggcttccagcacgattcctcaaccattctaaccattccaaagggtatatctttggggggtgacattcttttcctgttttctttttaatctttttttaa

SEQ ID NO: 23969 - DNA, 201 bp, Homo sapiens
gtctctaagcagatgtgagaagcacctgtgagacgcaatcaagctgggcagctggcttgattgccttccctgcgacctcaaggaccttacagtgggtagtrtcaggaggggtcaggggctgtaaagcaccagcgttagcctcagtggcttccagcacgattcctcaaccattctaaccattccaaagggtatatctttggg

SEQ ID NO: 23970 - DNA, 201 bp, Homo sapiens
caagagtttggatgattgtgggaatgcagaatccatggtgatcaagagggaaagtcaagttgcctggccattttccttggcttttagacagaaaagttacrtgggatattatctcccacagctcttctgtggtgccaccagtcatagtccttatataaggagaaaccagttgaaattacctattgaagaaacaaagagcaa

SEQ ID NO: 23971 - DNA, 201 bp, Homo sapiens
agggactggccagtgagagagagtaaaatctgaagagtataatgccatatgttgaagctcagagaattattgtttcaggaaggcagaagttgtcaattatrtccaacattgctgagaagatgagtaaggaatgtaaatgagtaaaggcaggaatggctattgaatttgttaagacagaggtccttggtgaccttcataaga

SEQ ID NO: 23972 - DNA, 201 bp, Homo sapiens
tgcatttgtggcaccacctactgttgaagggttataaagccattagaaaagtagaggggaagtgatttggatcaaaaggaaaaactttagaaaagattcaratgttcccttaatcataaaagagaactgaggggactacttgaaaataaaaggttgttttgtattttcatgttggttaagatactgagtaactggtattaa

SEQ ID NO: 23973 - DNA, 201 bp, Homo sapiens
gtgctttaaggagacaattagagatcaatctggaaaacttcatttgaatttttaatacataagaaaacaataagaaatagttaaaaatatatatttatatwatatatatgtgtgtgtgtgtgtgtgtgtgtatatatatatatatattttatttatttatttttttttgagatggagtctcgctctgttgcccaggctgga

SEQ ID NO: 23974 - DNA, 201 bp, Homo sapiens
tccttggggcctccagctttctgcgggtgatgagccggtcaatgcccctcttcatgacgctggcctggatttactcagtggctgtgatcatcaagggcatygtgtatgagaaggaggcacggctgaaagagaccatgcggatcatgggcctggacaacagcatcctctggtttagctggttcattagtagcctcattcctc

SEQ ID NO: 23975 - DNA, 201 bp, Homo sapiens
cagatgtctctgctatctccaacctcatcaggaagcatgtgtctgaagcccggctggtggaagacatagggcatgagctgacctatgtgctgccatatgargctgctaaggagggagcctttgtggaactctttcatgagattgatgaccggctctcagacctgggcatttctagttatggcatctcagagacgaccctgg

SEQ ID NO: 23976 - DNA, 201 bp, Homo sapiens
ttgtcgggtattttgattaatagtttatgtggcttcattaattcagagttactctccaatatgtttatctgccctttcttgtctgataatggtgaaaactygtgtgatgcattgtatatttgatttaggggtgaactggatgtctttgttttcacttttagtgcaattacgttgtccctgccacactggtcattatcatct

SEQ ID NO: 23977 - DNA, 201 bp, Homo sapiens
agaaaccatactgggcagggccgacttcaccctaaaggctgcgtctcttcactctgcttttgtttgttccaaataaagtggcttcagaattgctaaccctrgcctctgtgaacttgtgaggtacaattttgtgtctgttatgttaacaaaaatacatacataccttcctggtgatggtataaattgctattctctattgga

SEQ ID NO: 23978 - DNA, 201 bp, Homo sapiens
gtccaaaattcatttgggtcaatgttatgtcttagtgttatcttccatttccttctgagcttcaaagccaggctgactgtgcccttccacgccctggccaktgtgaccaggacatcctttccctctggggctgcactggctctttgggggaattgttaccattcagggtcttcaaccctcattctagggacttccagtaac

SEQ ID NO: 23979 - DNA, 201 bp, Homo sapiens
atctcagtgactaatggtagcaaagcattcccttaaaaaggcattatttgtgaaacttatctaaaatcgaattcgggtccaattaaatttttgaaattttrtattaaaaattatattagtagggatgggtaagaggtgttttggtctggttggttggttagttgctatgactcagaattgctaagaaaacagaaaagtaag

SEQ ID NO: 23980 - DNA, 201 bp, Homo sapiens
attgctatattgttattgtgagaaattggaaatagactaaatgttcagcactataggaataattaatgaaattacatatactctatacaatcattatgctsccattgaaataataaatacaaaggcgcaaggggggaaaagcttataatgttagtgaaactaagactgatttttttataaagcagcagttttcagaccctt

SEQ ID NO: 23981 - DNA, 201 bp, Homo sapiens
tgcaggcatgagccactgcgcccagccccaaattttggtttttgcttgaaaactgaggtctgaattcagccttctggttgcccctcaagagtcagtttaartgttggtcatgttagttgtcagtgaaaacaatggtgaggctggcatgagagtgtgaatctggatgggagggcttgtgcttcacgaaaacatttttccaga

SEQ ID NO: 23982 - DNA, 201 bp, Homo sapiens
aggctgtgcttctcaaactttagtgagcataggaatcacctgggcatcttgtgaagctgtagatttgaattctgcaggtcggcagaggggtctcagaatcygcatttccaacaatgtctccagtaatgctgatgctgctcgtccctggaccacagattgggtagccaggttctggcaagctcatcccaaggctttgagatg

SEQ ID NO: 23983 - DNA, 201 bp, Homo sapiens
atgatttcttgtgaaatgtttggaaatacaaagtactctataaatatttcataatagcattggggctgagaactccacaaagtgccggaatacatttgcaygtaagacagaacgctgcctgggtcattgatgcctgttgagtggcagtcacagacactgcctagggtttctgactcacgctgttgggactgttctatgcag

SEQ ID NO: 23984 - DNA, 201 bp, Homo sapiens
gcagttagctctgactcccagccagtgcacactccacctttctgactcccagccttgtctcaaattaggcttggaagcgaggaactgtctggtgtcccccwgcataggaagctgagccagggggcagtgctcacaaacaatacagactttaacgtgtaggatattggaaaataataatttgtggggaaattgtctcagact

SEQ ID NO: 23985 - DNA, 201 bp, Homo sapiens
tgtaaagaggagaattatctctgccactgcccatgcactgcttttgtctgaccagcaatttctccatattgcttcttcagtagcaaggccaatcattttascaacacacatgcttgctaactaacaggaataacgtggtacccctaattcagccctttcccttgaaagcatctggcttctgaggttcaactatgggaatat

SEQ ID NO: 23986 - DNA, 201 bp, Homo sapiens
ctcacgtctttttctctttggaagcctgaacactcagaacccaacttgaggctcctcagctatagcaattctgacttcacagtctgtaaattattgttctwttttttctttagcttatgctttctgccctaatttatcttttccctgttctaatgaattattgtcctatatctgctgtgcagttaggtgacatataacagc

SEQ ID NO: 23987 - DNA, 201 bp, Homo sapiens
acctgtttttgctcatgaattactctctatggaaggaacaatcatgaacacctctgcgtatcacagaggcctatctgagtctgacgtttaagggagaccgygtaggtccctttgaggactgtgaatgtgggagtcctgggactctggtgaagaacccgttccagaagagatgaatgagctggacaagttctttcatagaac

SEQ ID NO: 23988 - DNA, 201 bp, Homo sapiens
gaatcatgtgtgttttgttaaccctgtgatgtcaatccatgcctgattgtgtaactccaaccaatattcctttgaaaatggaaatttgtttatattgactrcagattgccaatattattagtaaatgctgagcacttaatctcgaataaagaactagtttaaaaatgattctaacaatggcattgactgttctaccttatt

SEQ ID NO: 23989 - DNA, 201 bp, Homo sapiens
gctggttgtggcatgggttttgtgacacaaccatttgtctgtgtctctgatagcattgagaaaagtgaaagggcagttttgaaggtaaggaaaatagtgtyatttgcttggatccactggctcatgccactgtctgggttggttagaagcactggaaaagtcaaaccataactttgagaattaggtgatcagggaatcaga

SEQ ID NO: 23990 - DNA, 201 bp, Homo sapiens
agctggttgtggcatgggttttgtgacacaaccatttgtctgtgtctctgatagcattgagaaaagtgaaagggcagttttgaaggtaaggaaaatagtgktatttgcttggatccactggctcatgccactgtctgggttggttagaagcactggaaaagtcaaaccataactttgagaattaggtgatcagggaatcag

SEQ ID NO: 23991 - DNA, 201 bp, Homo sapiens
gtgagagcccaggagatgaggaacagccttccagatttttcttgggtagcgtgtgtaggaggccagtgtcaccagtagcatatgtggaacagaagtcttgrcccttgctatctctgcctagtcctaatggctggcttttcccaggaaggcttctgcttccatggactgttagattaaccctttatttaggtaaatgaggga

SEQ ID NO: 23992 - DNA, 201 bp, Homo sapiens
gggccatggtttttgatccctccattctgaccggatctctgcattgtgtctactaggggagaatcgctttgtgtcaccattatcttgggacttggtgggaygaaacctcttcgccatggccgtggaaggggtggtgttcttcctcattactgttctgatccagtacagattcttcatcaggcccaggtgagctttttctta

SEQ ID NO: 23993 - DNA, 201 bp, Homo sapiens
agtggacactgaataccagggatgaggagctgagggccaagccaggagggtgggatttgagcttagtacataagaagagtgagagcccaggagatgaggarcagccttccagatttttcttgggtagcgtgtgtaggaggccagtgtcaccagtagcatatgtggaacagaagtcttgacccttgctatctctgcctagtc

SEQ ID NO: 23994 - DNA, 201 bp, Homo sapiens
ctggggtatccagtagggcccagagctgacctgcctccctgtccccaggctgactgtcgaagaacacatctggttctatgcccgcttgaaagggctctctragaagcacgtgaaggcggagatggagcagatggccctggatgttggtttgccatcaagcaagctgaaaagcaaaacaagccagctgtcaggtgcggccca

SEQ ID NO: 23995 - DNA, 201 bp, Homo sapiens
aagatagggaacttcacatacagtaccttttctcccaaggcggaagagggctgttcaatttctacactagagttcggggagttttagaaatgagtcagttrtcgaggatgagagcagttcctgataggctcaaccacaatgagatgtagctgttcagagaaagcattcttttatctataaactggaagataatcccggtga

SEQ ID NO: 23996 - DNA, 201 bp, Homo sapiens
cagaaccgtcagctacactgtgtcccatcctgctgtgttgtggttgtgccttgtggatgcgttggtttatgaccaggtattgattaaggtggctactaccrggtgctttctgcatatctcgggtttgtggagcactcaggttctgcttctgcccctctgctgttaccaagagacctctcttcaaaatggggctcttgagtt

SEQ ID NO: 23997 - DNA, 201 bp, Homo sapiens
tttgaatcatgtgtgttttgttaaccctgtgatgtcaatccatgcctgattgtgtaactccaaccaatattcctttgaaaatggaaatttgtttatattgwctacagattgccaatattattagtaaatgctgagcacttaatctcgaataaagaactagtttaaaaatgattctaacaatggcattgactgttctacctt

SEQ ID NO: 23998 - DNA, 201 bp, Homo sapiens
aagtcacttgtctcctgggtgcaatggagacctatgtgagttcatagccaagagaatgtttttggttagaaaaataatagtaggaattccaagctgtgaaytttttactgaagctctttggaaataggatttggcaagttttgtctgccttcgtcaagtaagcatgagcaggagagcacagttaatagcaggtgcagacac

SEQ ID NO: 23999 - DNA, 201 bp, Homo sapiens
ttcggatgccacggcgggcagatcacgtgaggtcagcagtttgagaccagcctggccaacatggtgaaaccctgtctctacaaaaatacaaaaaatagccrggcgtgatggtgggcacctgtaattccagctactcgggaggctgaggcaggaggatcgcttgagcctaggaggtggaggctgcagtgagctgagatctgt

SEQ ID NO: 24000 - DNA, 201 bp, Homo sapiens
ctgcattgttcattccttcaacaaatactggctataatgtttcagcactgtggatgcaaagtgagcaggataaacaggctcttctttcaaagcttgtggtycactggaccacgtatgaagtagaatagtttaggtccagaaaggcaattaagtaaaatatgaccaagaagaggctctctagtgggtttggtataaagaaaa

SEQ ID NO: 24001 - DNA, 201 bp, Homo sapiens
gaacccgggaggcgggggttgcagtgagctgagattccaccattgcactccaacctaggtgacagggtgagactccgtctcaaaataaaaaaaaaaaaagraaaggaaaggctgtgtgtgtgtgtatgtgtgtgtgtgtgtgtgtgtgtgtgtgtaacagcaccatcacactgtttgagttgaggagcacatgctgagtgt

SEQ ID NO: 24002 - DNA, 201 bp, Homo sapiens
tctcttgaacccgggaggcgggggttgcagtgagctgagattccaccattgcactccaacctaggtgacagggtgagactccgtctcaaaataaaaaaaaraaaagaaaaggaaaggctgtgtgtgtgtgtatgtgtgtgtgtgtgtgtgtgtgtgtgtgtaacagcaccatcacactgtttgagttgaggagcacatgct

SEQ ID NO: 24003 - DNA, 201 bp, Homo sapiens
gcccaagaaactgcattttcgcatgctccctaaatgaagcttaggtgctctgaggtttgacaactgcagtagagagcctaatgctaacagtgtagagtcayatgtgatgggaagcatcaggtaggtagcagtttgcaggagcactgattctgagggacactaactgggcctaagaacagctactggctgtcatgaggaata

SEQ ID NO: 24004 - DNA, 201 bp, Homo sapiens
tctgttcctgggaaggcagttccagtggttagaagtcctgttcactcctggggtgtggcctggggatggtcctgacatccctgggctcttcctggacctgrccagctaaaaggaaatctcctatgatggtactcagatacttttggaaccttgtcagccctaatcccatctcctagtgtttagtattcagctacccttcac

SEQ ID NO: 24005 - DNA, 201 bp, Homo sapiens
gtcatacccctccgcctgcacgtgcaaatgtgttcctcagcttggtcccagaggcctggacctgggtcccagaggtcccagctggttccccggcttggtcycagaggcctggatgtgtggcaagaagctgagggttctgcttcgtttcttccagcccacaaacacacatgtcacctgttttttgttctttttcctttcctt

SEQ ID NO: 24006 - DNA, 201 bp, Homo sapiens
aacactgaatggcctggaaagcaggacctcgcccccaccccgcgtcatacccctccgcctgcacgtgcaaatgtgttcctcagcttggtcccagaggcctrgacctgggtcccagaggtcccagctggttccccggcttggtcccagaggcctggatgtgtggcaagaagctgagggttctgcttcgtttcttccagccca

SEQ ID NO: 24007 - DNA, 201 bp, Homo sapiens
ttttaaagaatactttcattgcaaattggaaacttcgtttaaaaaatgctcatactaaaattggcatttctaacccataggcccacttgtagttatttacygaagcaaaaggacagctttgctttgtgtgggtctggtagggttcattagaaaggaatgggggcggtgggagggttggtgttctgttctctctgcagactg

SEQ ID NO: 24008 - DNA, 201 bp, Homo sapiens
tggcagctctgcttcctgacctttcaccctcaggaagcgaggctgttcacacggcacacacatgccagacagggtcctctgaagccacggctgccagtgcrtgtgtcccagggaaagctttttcctttagttctcacacaacagagcttcttggaagccctccccggcaaaggtgctggtggctctgccttgctccgtccc

SEQ ID NO: 24009 - DNA, 201 bp, Homo sapiens
gaacagaagatgattgtcttttccaatgggacatgaaccttagctctagattctaagctctttaagggtaagggcaagcattgtgttttattaaattgttwacctttagtcttctcagtgaatcctggttgaattgaattgaatggaatttttccgagagccagactgcatcttgaactgggctggggataaatggcattg

SEQ ID NO: 24010 - DNA, 201 bp, Homo sapiens
caatgggcggaggtgtagttattgcagacatctgaaatatgtaatgtttcttccagattctggaaattctcttattctctgtggttggtggtggtggtggsatgtgtgtgtgtgtgtgtgtgtgtgtgtgtgtgtgtagggatcaggatgcgggaggagctgggttctgcttgtattggttctctgttttgcattgaatag

SEQ ID NO: 24011 - DNA, 201 bp, Homo sapiens
gaactgaaggaacactgaatggcctggaaagcaggacctcgcccccaccccgcgtcatacccctccgcctgcacgtgcaaatgtgttcctcagcttggtcycagaggcctggacctgggtcccagaggtcccagctggttccccggcttggtcccagaggcctggatgtgtggcaagaagctgagggttctgcttcgtttc

SEQ ID NO: 24012 - DNA, 201 bp, Homo sapiens; identical to SEQ ID NO: 3422

SEQ ID NO: 24013 - DNA, 201 bp, Homo sapiens
aaaccaacctaagggctggagggaagaaaattcacacttgtaagcttctttttcaaggggcatctcttaggctctagcttttgagattcagtatatatatwtttttgagtcttgctctgctggagtgcagtggtgtgatctgggctcactgcaagttctgcctctcaggttcacaccattcttctgcctcagcctcccgag

SEQ ID NO: 24014 - DNA, 201 bp, Homo sapiens
ttattcccttgtgttagcccaggtcaacagagcctacgaataataatgatgacagaagttcttcaaaaagtcttggccttctttctttcacaaaattgccycccagagctttctggaagggcagccatgaacccagaggcctaaagtagatttactgggaagctaaaaatatttactttatttttcatagctcctttcaag

SEQ ID NO: 24015 - DNA, 201 bp, Homo sapiens
ggccatggtttttgatccctccattctgaccggatctctgcattgtgtctactaggggagaatcgctttgtgtcaccattatcttgggacttggtgggacraaacctcttcgccatggccgtggaaggggtggtgttcttcctcattactgttctgatccagtacagattcttcatcaggcccaggtgagctttttcttag

SEQ ID NO: 24016 - DNA, 201 bp, Homo sapiens
tcaacaggccattttccaaataaagccatgccctctgcaggaacacttccttgggttcaggggattatctgtaatgccaacaacccctgtttccgttaccygactcctggggaggctcccggagttgttggaaactttaacaaatccatgtaagtatcagatcaggttttctttccaaacttgtcagttaatccttttcct

SEQ ID NO: 24017 - DNA, 201 bp, Homo sapiens
cctaatttcattagtattttcttttcttttttttgaggtgaagtctcactctgttgcccaggctggagtgcaatggagcgatcttggctcaccccaacctytgtctcctgggttcaaacagttctcctgcctcagcctcccgagtagctgggattacaggctcccgccaccatgcccagctatttttttgtattttcagta

SEQ ID NO: 24018 - DNA, 201 bp, Homo sapiens
tttgcaaatttagtggaattagtgccatttttcagtttacaattccagtcacatttcacatgatcagagcatggctttcttctctgtggagcaaatagagrgctgtctgacacttggttccagtggcttccattaagcagagtggatatgtccctggagtctgcagagaagggcatggcactctgaccccagatggcactc

SEQ ID NO: 24019 - DNA, 201 bp, Homo sapiens; identical to SEQ ID NO: 3416

SEQ ID NO: 24020 - DNA, 201 bp, Homo sapiens
aaatggaggcaggaagtatgaactactcttttgagtcatattgtaaaggaaaaaaatggggtgattttactcttttttttttttaaagataggaaaaaaaagtatatttatatgctgaggagaagaatccagttgaaggggaatactgtggcttcaggagacaggaaaactgcctaagccacatccttcagcaagtgagtg

SEQ ID NO: 24021 - DNA, 201 bp, Homo sapiens
ttttaaaagttttatgcttcactgtatatgcatttctgaaatgtttgtatataatgagtggttacaaatggaatcattttatatgttacttggtagcccaycactcccctaaagggactctataggtaaatactacttctgcaccttatgattgatccattttgcaaattcaaatttctccaggtataatttacactagaa

SEQ ID NO: 24022 - DNA, 201 bp, Homo sapiens
tggcaatgccgaaaacacctaagataataggtgaccttcagtgttggcttcttgcagaatccagagagacagacttgctcagtgggatggatggcaaaggrtcctaccaggtgaaaggctggaaacttacacagcaacagtttgtggcccttttgtggaagagactgctaattgccagacggagtcggaaaggattttttg

SEQ ID NO: 24023 - DNA, 201 bp, Homo sapiens
ttgtgacctgaactaggtagatggttgtgttaaaaatgcagtgggtatttcagtctgaagctcaggggcaatgatggaaaataagataaatgtgtgcaagytggctgggcgtggtggtgcacgcctataatcacagcactttgggaggccgagacgggtggatcacttgaggtcaggcgtttgcgaccagcctaacatggt

SEQ ID NO: 24024 - DNA, 201 bp, Homo sapiens
ctatctcattcctgtgtgtgtttagccaggcaactgttgatcatcaatattatgataacgtttctccactgtcccattgtgcccactttttttttttttttgagttacttactaaataaaaataaaacactatttctcaatagacttgaagcttcaagatttcctggtggacaatgaaaccttctctgggttcctgtatca

SEQ ID NO: 24025 - DNA, 201 bp, Homo sapiens
ccagcctgggcgacagagccagactccatctaaataaataaatagataaataaataaaataaaataaaaacttgtagggaggtggcagtgtgctatggagrataggtgcaacctctgtgagaatgtagagaaaatagtataagtgagtggtgaggacccccaagagggggttttatagtaaaacaatggtcagaagtggca

SEQ ID NO: 24026 - DNA, 201 bp, Homo sapiens
aatacaagtcctgtgtttttatcacagggaggctgatcaatataatgaaattaaaagggggctggtccatattgttctgtgtttttgtttgtttgttttgyttgtttctttttttgtttttgtggcctccttcctctcaatttatgaagagaagcagtaagatgttcctctcgggtcctctgagggacctggggagctcag

SEQ ID NO: 24027 - DNA, 201 bp, Homo sapiens
ggccctgcattcctcattgccgtgctggttggtcggggaggtgggctggactcgtagggatttgccccttggccttgtttctaacacttgccgtttcctgytgtccccctgccccctccactgcctgggtaaagattgtcttgccagctgtgtttgtctgcattgcccttgtgttcagcctgatcgtgccaccctttggca

SEQ ID NO: 24028 - DNA, 201 bp, Homo sapiens
ggacgagatcacttcaaaggtctgtaatcccacgtctataatcccagcactttgggaggccaaggcgggaaaatcacttgaggtcaggagttcgagaccakcctggccaacatggcaaagcctgtctctactaaaaatatgaaaattagctcagcgtggtggcatgctcctgtagtcccagctactcgtgaggctgagaca

SEQ ID NO: 24029 - DNA, 201 bp, Homo sapiens
attctggttttctactcaccagatagattctcttaaaaccagggaaagattcctggaggaaggatgtatctggaaagagatgttccttattataataaaaygaaattgtaatactcttggattttgtgcagcacgaattctttatagagagttggtcctcccagagaattaagaatactcagtttctggaccctgttccca

SEQ ID NO: 24030 - DNA, 201 bp, Homo sapiens
aataaacatttatagcctcctgcctgcctgagaaaccagggtggacatggagagaaggcacttctgaaagttcaagcgcagtgcgctgtgtccttacactscactcctcagtgctttctgtgggttcatttctgtcttctctcctgtcacagtctgcatggaggaggaacccacccacttgaagctgggcgtgtccattca

SEQ ID NO: 24031 - DNA, 201 bp, Homo sapiens
tctctgagaagcacgtgaaggcggagatggagcagatggccctggatgttggtttgccatcaagcaagctgaaaagcaaaacaagccagctgtcaggtgcrgcccagagctaccttccctatccctctcccctcctcctccggctacacacatgcggaggaaaatcagcactgccccagggtcccaggctgggtgcggttg

SEQ ID NO: 24032 - DNA, 201 bp, Homo sapiens
tgctcatattatccccatgttgaaatagcaagatgggaagtgcaaagtggtgcttcggtactcttggagcagctttgactttggtgagaaacgccttttawaaacaatgtttcttcccatcttcccaccccatggggaggtgtggggttgggtgggtaggcaccaaagcaagatttagaagagttttctgtaggaatttat

SEQ ID NO: 24033 - DNA, 201 bp, Homo sapiens
gccccctctctggagaaaaaaaatccttgtggcctctgacccacctctggagagcctagttcccttctggaggcagaaggcaaagcttaggacctagagartgctggaccacgccactcacaggaaccagcaggctgtgaggttgaaagctaggcatatggagctttccaggctgggtgcagggcctcgtggcccttcccc

SEQ ID NO: 24034 - DNA, 201 bp, Homo sapiens
tggatatccacgtgatcaggctgcaagttctttgtagtggaggatctttggccctccctgctgcttcccaacccagcgaacctaccacaccatgcacgtgyacagccaagggttgttgactgtttaatcagtctctgggttcttatgtctcatccgggggattcactgataggaggctggagcttgatcacatccagatgt

SEQ ID NO: 24035 - DNA, 201 bp, Homo sapiens
ctaggtgacagggtgagactccgtctcaaaataaaaaaaaaaaaagaaaaggaaaggctgtgtgtgtgtgtatgtgtgtgtgtgtgtgtgtgtgtgtgtgtaacagcaccatcacactgtttgagttgaggagcacatgctgagtgtggctcaacatgttaccagaaagcaatattttcatgcctctcctgatatggcgat

SEQ ID NO: 24036 - DNA, 201 bp, Homo sapiens
attttgaatcttgcttgcatgtcaacaggagccacattaatacagaagaggatcacattggtccaattaaattgaattgattgagagcctctgcaatacayggtctactgcacaaataatgatggttcctggtacatttttatttgaccattgattgctcgatttgtttctgtgtctaactgtgtattggaattaagctga

SEQ ID NO: 24037 - DNA, 201 bp, Homo sapiens
caaactaaatacaagtcctgtgtttttatcacagggaggctgatcaatataatgaaattaaaagggggctggtccatattgttctgtgtttttgtttgttkgttttgtttgtttctttttttgtttttgtggcctccttcctctcaatttatgaagagaagcagtaagatgttcctctcgggtcctctgagggacctgggg

SEQ ID NO: 24038 - DNA, 201 bp, Homo sapiens
acaaacagaacaaacatcttactcaagtccagaagcaataataattttgaatcttgcttgcatgtcaacaggagccacattaatacagaagaggatcacaytggtccaattaaattgaattgattgagagcctctgcaatacacggtctactgcacaaataatgatggttcctggtacatttttatttgaccattgattgc

SEQ ID NO: 24039 - DNA, 201 bp, Homo sapiens
gaagagccaccctggttccaaccagaagagaatatcagaaagtaagtgctgttgacctcctgctctttctttaacctagtgctgctgcctctgctaactgytgggggcaagcgatgtctcctgcctttctaaaagactgtgaaaccactccaggggcagagaaatcacatgcagtgtccctttccaaatcctcccatgcca

SEQ ID NO: 24040 - DNA, 201 bp, Homo sapiens
tatccaggattctggttttctactcaccagatagattctcttaaaaccagggaaagattcctggaggaaggatgtatctggaaagagatgttccttattayaataaaatgaaattgtaatactcttggattttgtgcagcacgaattctttatagagagttggtcctcccagagaattaagaatactcagtttctggaccc

SEQ ID NO: 24041 - DNA, 201 bp, Homo sapiens
ctcttaaggggatagcttgaaggaaagagggttggaagggtggtttttaaaaagaattatcactcactaatcaactagaaatccagtggaatatgcagtayttgtctgtaatccagcaggctaacttttttttttttttttttttgagacggagtctcgctctgtcacccaggctggagtgcagtggcatgatcttggctt

SEQ ID NO: 24042 - DNA, 201 bp, Homo sapiens
aactataaaacagccaatatttattaggcactgatttcatgccagagacactctgggcatgaaagaaagtaatgataatagttaattttatatagcgttgwtaccatttacaaccttttttttttttttaacctctatcatctcaattaaagtgcagagagaccctgggaagaaggtaactatatttattatcccagatga

SEQ ID NO: 24043 - DNA, 201 bp, Homo sapiens
tgttaaagcttagagagtggtgggagagactggagaagttgattaattagtaaatgaagttgtctgtggatttcccagatcccagtggcattggatatccrtattatttttaaatttacagtgttctatcttatttcccactcagtgtcagctgctgctggaagtggcctggcctctatttatcttcctgatcctgatctc

SEQ ID NO: 24044 - DNA, 201 bp, Homo sapiens
atttttttattttcaaattttccataaaaatataaggacttgaagatcaagaaaaaatttctgctttggctcagtgcagtggctcacgcctgtaatcccarcagtttgggagccctaggggagaggatcacttgaacccaagagtttgacgttccagtgagctatgatctccggatcgtaccgcctggacgatggagcaag

SEQ ID NO: 24045 - DNA, 201 bp, Homo sapiens
ctggatctgtgctctctaagataactgttagtggtggcgtgtgtgttctcacactcagacatttgatctgctctttgtttcccattcttagctgcaaggcrgtgttaaagaaccctgtgtctccatatccactccccacacttaagcacttttgtgggcccgtgtgccgtatgcctcgtggcagcagggatccaatgtcac

SEQ ID NO: 24046 - DNA, 201 bp, Homo sapiens
caagagccaggattcaagcccaaatctgcctggatctgtgctctctaagataactgttagtggtggcgtgtgtgttctcacactcagacatttgatctgcyctttgtttcccattcttagctgcaaggcagtgttaaagaaccctgtgtctccatatccactccccacacttaagcacttttgtgggcccgtgtgccgtat

SEQ ID NO: 24047 - DNA, 201 bp, Homo sapiens
tcaccactgaggaaatgttctctggcaaaaacggcttctctcccaggtaactctgagaaagtgttattaagaaatgtggcttctactttctctgtcttacrgggctaacatgccactcagtaatataataatcgtggcagtggtgactactctcgtaatgttggtgcttataatgttctcatctctctcattttccagata

SEQ ID NO: 24048 - DNA, 201 bp, Homo sapiens
caggtatggacctctaaaataaggcttcctctccattccggttgtcattgcctttgtccaaacacagcacacaaggccttttacagttgcacaactcttcytgtccatacccaccacaccctttcccagctgtaagcttcagatgagttgcctccaaccaccatgctcctgtaggcctggcttgaaatgcccttcttctgt

SEQ ID NO: 24049 - DNA, 201 bp, Homo sapiens
tctgggggaagatgagtaatgtctcgttccacccctgattccagtgctgactgattctggagtggcagagagggttggaggctcaccgctctgctcacccsaccctctggccatctcctcttagaatgcaagggcagggattttgttacacagcgcctcttttgttataggctagctcctgccttcaaggagcactgagaa

SEQ ID NO: 24050 - DNA, 201 bp, Homo sapiens
ctgttgggactgttctatgcagggcaccctcttgtgtggcataggatttgtgcctcaccacacactgttgtagctttgctgtcttgatgatgagtagagggcagtgtccaggccatggtataagcatctactgccccccagggttaccaaaaccaagccaagttgtgtctcagcgagctccgtgaagcatggagaagttga

SEQ ID NO: 24051 - DNA, 201 bp, Homo sapiens
acaccacatggatgaagcggacgtcctgggggacaggattgccatcatctcccatgggaagctgtgctgtgtgggctcctccctgtttctgaagaaccagytgggaacaggctactacctgaccttggtcaagaaagatgtggaatcctccctcagttcctgcagaaacagtagtagcactgtgtcatacctgaaaaaggt

SEQ ID NO: 24052 - DNA, 201 bp, Homo sapiens
taaggcttcctctccattccggttgtcattgcctttgtccaaacacagcacacaaggccttttacagttgcacaactcttcctgtccatacccaccacacyctttcccagctgtaagcttcagatgagttgcctccaaccaccatgctcctgtaggcctggcttgaaatgcccttcttctgtcacagggtctggtagtata

SEQ ID NO: 24053 - DNA, 201 bp, Homo sapiens
aaggatgatgtactggtcttaatattaccattgagataagctttataataacataaaaagaaataacagtaatgataatagcaacaacaacaacaacaaaraactaacatttaagtagaatttcttgtgcactgtgcattctgtttaagttatctcattttaccctcatgataaccctgcagggaagattctttaacccca

SEQ ID NO: 24054 - DNA, 201 bp, Homo sapiens
gtctggggctggtcctggagtttgtcttgctctgtttttttgtaggtggaatgcagagaaagctatctgtggccttggcctttgtcgggggatctaaggtkgtcattctggatgaacccacagctggtgtggacccttactcccgcaggggaatatgggagctgctgctgaaataccgacaaggtgcctgatgtgtattta

SEQ ID NO: 24055 - DNA, 201 bp, Homo sapiens
ttatttctagaatgttacataaatggaaccatacagtaggtatccttttgatactggctttttttttttttcactcagcagtattcccttagatctatccmagttgtgtgtgtcaacagttcattcctcttcactgctgagtagtgttccctgggaggggtgtatcacagttccatggcatttttagatgtattttttaaa

SEQ ID NO: 24056 - DNA, 201 bp, Homo sapiens
ccccagaactgggggcaaaaaactcaaggtagcttcagaggtgtgcgctaagtatactcacggctcttctggaattcccagagtgaaaacctcaagtctgwtgcagaccagagctgggccagctccccagtcgtgggtatagaatcatagttacaagcaggcatttcttggggatggggaggactggcacagggctgctgt

SEQ ID NO: 24057 - DNA, 201 bp, Homo sapiens
tttaaatttggtggaatatgtttttattagcttgtatctttaattcctaaattaagctgtgtgtgtgtgtgtgtgtgtgtgtgtgtgtgtgtgtgtgtgtgaagtttaaagccaggatgagctagtttaaagtatgcagcctttggagtcatacagatctgggtttgaatctggtctctaaactttatagatgtatgatat

SEQ ID NO: 24058 - DNA, 201 bp, Homo sapiens
cagagcaagactccatctcaaaaaaagctctcagaacaaccaggtttacaaatttggtcagttggtaaataaactgggtttcaaacatactttgctgaaayaatcactgactaaataggaaatgaatctttttttttttttttttaagctggcaagctggtctgtaggacctgataagtactcacttcatttctctgtgtc

SEQ ID NO: 24059 - DNA, 201 bp, Homo sapiens
acaaacaggtcagtgtacaatgccacaggagggatatatgcagtgaagaaaaagcagggtaaggggcatagagcatgagaaggtgctttttttaaaggggktgattaggaaagctctctctaaggtgacagttggacctgaaggagatgatagcatgtctgtggtgagggaaggaaactccgaacaggaagaatggcagat

SEQ ID NO: 24060 - DNA, 201 bp, Homo sapiens
gctgggctcagtgggtggattgacactgcagaaatggccagatctaaaggatcaacatttacgtagctgggaaatgtagctgggacttcagtttcactgcsctagtgatttttcctaccactaagcagctcagtccatacccctacgagacccacaagcttatgagatactgttcttccaggaaagcagtggggccagggc

SEQ ID NO: 24061 - DNA, 201 bp, Homo sapiens
attttccagatattcctcaaggtggccgaagagagtggggtggatgctgagacctcaggtaactgccttgagggagaatggcacacttaagatagtgcctyctgctggctttctcagtgcacgagtattgttcctttccctttgaattgttctattgcattctcatttgtagagtgtaggtttgttgcagatggggaaggt

SEQ ID NO: 24062 - DNA, 201 bp, Homo sapiens
aaaggaatgggagaggtgatagacttcaggcagtgtaactagttgtctgaacactactggctcaattatattgtgtctagtgatttccatcttgtccgtckgctaatttatcgcctggtaactcactgaggcagggttttcctttggagaaacctcattgttttaaccagtgtatcatgcttgtttagaagttcaatgatc

SEQ ID NO: 24063 - DNA, 201 bp, Homo sapiens
taactttttactgattttgtttttatttacttattttatttgtttaaatttatttttagttttttttttttttagagacagggtctctttctgttacccargctagagtgcagtggtgcccttagagctcactgagctcactgcagcctcgaattcctgggctcaagtgatcctcctgccttagcctcccgaagggctggg

SEQ ID NO: 24064 - DNA, 201 bp, Homo sapiens
aggcaaaatggcctggttctctgtcccctttctgtctgtatgcctcgtacaggttatgaaaagaaaaagttgggaaaagctgtccacctcacctaattgtrttcttgtggagtgtgctagatgccccctctctggagaaaaaaaatccttgtggcctctgacccacctctggagagcctagttcccttctggaggcagaag

SEQ ID NO: 24065 - DNA, 201 bp, Homo sapiens
ggtgaaaggttattatgaatggtacaaaactttgttacaaaaccattttcttggactgttttgggctgcttcactgcatgacaaatgctcaccctttcagytggaatgattgaaattttggaaaagatgggtgtttttagaagacattgtaatttgttccggtgctgtgcccattcattccatttcacttctgtttactca

SEQ ID NO: 24066 - DNA, 201 bp, Homo sapiens
tcagcaaatgtttgttaaacaccatgtactgtggaaagtactaggtgctggacagaggtcaaaagacttttaagaatctgccaccattaatgatctctttytgcttggcattcaaggctctttgaaataagactgtgacccactttgatagttttgtcctggattataagacacatgctcgaaggaactatagctggtttt

SEQ ID NO: 24067 - DNA, 201 bp, Homo sapiens
tttcctaaagcctggcagacctgggttttggagctttgtatcacatgttttatgtttggaatgaaaatgagaccatgtctgtgaaggcactttgatatgcrtaatgcactctgccagtgtttgtcaaaacatggtccccaggtcagcagcatcagcatcacctgtaagtgattctccagtcgcatcccagggccgctgtat

SEQ ID NO: 24068 - DNA, 201 bp, Homo sapiens
actaaaattctggattcttagtgctgctttttctgttttgttgcactggattgaagccttttctaactgtactcagagggcctattatttagggagattcygtatgaaatcctttagcaatcaaatcatttaatagggctgatggtttaaatatatgttaatgtgttttcctaaagcctggcagacctgggttttggagct

SEQ ID NO: 24069 - DNA, 201 bp, Homo sapiens
ttctactttaagaaccccttcctggcattgtttggctcctcattgttctggaatctcatgtccatctcatgtatttgccttggttcacacttgatcttctrctcatattcctcacctactgaaattttacccatcaaccagaccgtgggtgatggaacacagcatgggctagttcttcttatatatgatctcatttaattt

SEQ ID NO: 24070 - DNA, 201 bp, Homo sapiens
ttctgagcttcaaagccaggctgactgtgcccttccacgccctggccagtgtgaccaggacatcctttccctctggggctgcactggctctttgggggaaktgttaccattcagggtcttcaaccctcattctagggacttccagtaacttctcccaccttccctcttctcagtaagacatgggtattgtcttattctgtt

SEQ ID NO: 24071 - DNA, 201 bp, Homo sapiens
ctttgggatagtgcctagtgagaaggcttgatatttattcttttgtgagtatataaatggtgcctctaacataaagggaaataaaactgagcaaaacagtrtagtggaaagaatgagggctttgaagtccgaactgcattcaaattctgtctttaccatttactggttctgtgactcttgggcaagtgacttaactactgt

SEQ ID NO: 24072 - DNA, 201 bp, Homo sapiens
atcatcacacaaataaaaatataactatcaactgtgatgaggattatgaaggaaaaaatccggcaaactatggtactggtgttagatactagcaggtgtgkgtagggatttcatttagattgacaggttgtcacattaaagctgagagccctgaagttcaagcaatggttagccaggcaaagatcagaggcttagagatag

SEQ ID NO: 24073 - DNA, 201 bp, Homo sapiens
caggcctctctcatctggctcctctcctcctcctttatcattactcttcttcgtagcttatcctactccagccatgctgtcttcctattattcctaaaaartagaaatgcatttcttcctagggcctttgtacctgcacttgccatcgcttttgctcagaatgttctttttgccaagcttttgcccagcttgttctccatc

SEQ ID NO: 24074 - DNA, 201 bp, Homo sapiens
tttaaatagttttctggagatcctccatttgggtattttttcctgctttcaggtttggagatggttatacaatagttgtacgaatagcagggtccaacccrgacctgaagcctgtccaggatttctttggacttgcatttcctggaagtgttctaaaagagaaacaccggaacatgctacaataccagcttccatcttcat

SEQ ID NO: 24075 - DNA, 201 bp, Homo sapiens
taatgattgaattctccacccatttttctacttgtatgaccttaatttgatggcacctgttccatcctcatgagtttgctacaattatactggtgccaacrcaatcataaacacaaatataaacttgggctttgaaatcttgtgccagaacttggctttaaagtaagcatttaaaaaatccatatgtgtttattagacttt

SEQ ID NO: 24076 - DNA, 201 bp, Homo sapiens
aactttttttcaaatatgcatataattgtcagtggttactatattttggggaagagattgttgacttctttgaagaaagatacggattttctcttcagaaraaatacacatgggctcatataatccaaattttatgtgtaattacagggtgttcatgaatgcccacaaatccattaagccatgtgaccttggacaagtcat

SEQ ID NO: 24077 - DNA, 201 bp, Homo sapiens
cagctaatttttgtatttttagtagagacggggtttcaacttgttggccaggctggtctcgaaccctcgacctcaggtgatccaccggcctcggcctcccmaagtgctgggattataggcgtgagccaccgcgcgcggccgagttttgtttcttttaaaaacaagacttaggagagcctgcggagacccggaggtggggtg

SEQ ID NO: 24078 - DNA, 201 bp, Homo sapiens
atattcctcaaggtggccgaagagagtggggtggatgctgagacctcaggtaactgccttgagggagaatggcacacttaagatagtgccttctgctggcyttctcagtgcacgagtattgttcctttccctttgaattgttctattgcattctcatttgtagagtgtaggtttgttgcagatggggaaggtttgttttgt

SEQ ID NO: 24079 - DNA, 201 bp, Homo sapiens
taactgtaggctgacagcctagcagcaaggaccagttaaagaaatgagtagaactgaagtgtgcttgagtatctctggcagtcagcaaaaacttaatgggratcatggtaggccaaatgttctgcagtatttcaaaagctgcatgggttttgagaggcttttggtccatcactcaccttaggttgttctacaagcacatca

SEQ ID NO: 24080 - DNA, 201 bp, Homo sapiens
atatctgtcacatctaatcagtttaaaataaggggcatcctaagcatggagatggtccttggatggtccttggagtttctgtattttcagtattctttttyttgagcatacaagacatttattgaaaaattcttgggatcaatacttgtgtaaggaaaggaaagggaacaaagcatgattgggcagaggcagaagatgaca

SEQ ID NO: 24081 - DNA, 201 bp, Homo sapiens
ccccctgccaatttcatatctgtcacatctaatcagtttaaaataaggggcatcctaagcatggagatggtccttggatggtccttggagtttctgtattktcagtattcttttttttgagcatacaagacatttattgaaaaattcttgggatcaatacttgtgtaaggaaaggaaagggaacaaagcatgattgggcag

SEQ ID NO: 24082 - DNA, 201 bp, Homo sapiens
aacccccctgctgctccaggcagttctccttctacagtgctctattgtgctgttttaataatctttcaactgggaagaactcccatttcaggaattaagcygtggacaaatcttttaattatccttgaaatcatcctaataagaaatccaaggaggaagtcttacagggtgcctcacccacttttctcatcactggaactt

SEQ ID NO: 24083 - DNA, 201 bp, Homo sapiens
ctccacatagatgttatgaattttacttttacagaggagccaactgaggctcagataagttacttattatatgactagtagtggtagagctggggtttcarctaagaactctctggctccaaagcccttgtaagtttctatcagtatatgaccatgcatatgagcatttgtctctcctcttcttcatagctccttactgca

SEQ ID NO: 24084 - DNA, 201 bp, Homo sapiens
tgggtagcaccagacccagcttgcatggttattgatttttcagagacactttttgagcttattctctggcagaaaggggaactgcttcctcccctatctcrtgtctgcatactagcttgtctttacaagaagcagaagtagtggaaatgtttattcttgaaaataagctttttgcttcacatgatctagaatttttaaaat

SEQ ID NO: 24085 - DNA, 201 bp, Homo sapiens
atttctattctagagaagaatctgacccagaagggggaagtgactgtcccaagtctacacaaccacagaagggatattctgggaataaatcacggctaaahccccctgctgctccaggcagttctccttctacagtgctctattgtgctgttttaataatctttcaactgggaagaactcccatttcaggaattaagccgt

SEQ ID NO: 24086 - DNA, 201 bp, Homo sapiens
aagaatgtgaagctctttgcactaggatggcaatcatggtcaatggaaggttcaggtgccttggcagtgtccagcatctaaaaaataggtaataaagatartttctttgggatagtgcctagtgagaaggcttgatatttattcttttgtgagtatataaatggtgcctctaacataaagggaaataaaactgagcaaaac

SEQ ID NO: 24087 - DNA, 201 bp, Homo sapiens
ttactctaattctttgattcatcaagaaataactagaatggcaagttaaaatttaagctgtttcaaagatgcttctgcatttaaaaacaaatttatctttkattttttttccccccagcaaataagacttattttattctaattacaggatgaacccaccacaggcatggatcccaaagcccggcggttcttgtggaattg

SEQ ID NO: 24088 - DNA, 201 bp, Homo sapiens
aaaaaaaaaaaaaaaaaaaaaaaaaaaaaaaaaaaaagatgtgtagggagcaattttggagttattcatttggtcatttgatatgtagttttagttttggbgctgatagagcccagaatgtaccctgaatttgatgaacattctgatatatgggggagctcattgtcccccacttacctttttgcctctcagaatatcttt

SEQ ID NO: 24089 - DNA, 201 bp, Homo sapiens
ttgtcaggttatgattatagaatctagtcctactcagtgaaagaactttcatacatgtatgtgtaggacagcatgataaaattcccaagccagaccaaagycaaggtgctttttatcactgtaggttggtgagtgggcgattcggaaactgggcctcgtgaagtatggagaaaaatatgctggtaactatagtggaggcaa

SEQ ID NO: 24090 - DNA, 201 bp, Homo sapiens
catattcctcacctactgaaattttacccatcaaccagaccgtgggtgatggaacacagcatgggctagttcttcttatatatgatctcatttaattttcwctggaactctgagataggtagcatttcagcccactcaagttgactcaaatttttgtaatcatcaatatattttaaaataactttatatttgacctgtaat

SEQ ID NO: 24091 - DNA, 201 bp, Homo sapiens
ggggctggaaaatcatcaactttcaagatgttaacaggagataccactgttaccagaggagatgctttccttaacaaaaataggtgagaaaagaagtggcytgtattttgctgcaaagactttgtttttaatttatttaaagaaataggttgttatttttgattacagtggtatttttagagttcataaaaatgttgaaat

SEQ ID NO: 24092 - DNA, 201 bp, Homo sapiens
atctctacccaatcaagcaacgatgctcgttaagaggtaaaagtggattttaaaggcttctgtatttatgccaggatggagcaattagtcatcgagaagaragggaccctgtatgtcaagagaatgatttcagagaatccaatacaatttaagaaaaagcatggggctgggcgcagtgattcactcctgtaatcccagcac

SEQ ID NO: 24093 - DNA, 201 bp, Homo sapiens
cccttggctgccgggaacgtggactagagagtctgcggcgcagccccgagcccagcgcttcccgcgcgtcttaggctggcgggcccgggcgggggaagggsacgcagaccgcggaccctaagacacctgctgtaccctccacccccaccccaccccacccacctccccccaactccctagatgtgtcgtgggcggctgaac

SEQ ID NO: 24094 - DNA, 201 bp, Homo sapiens
cgggccaacctgcaaaagggagagaaccctagccattatggaattactgctttcaatcatcccctgaatctcaccaagcagcagctctcagaggtggctcygtaagtgtggctgtgtctgtatagatggagtggggcaagggagagggttatggagaaggggagaaaaatgtgaatctcattgtaggggaacagctgcaga

SEQ ID NO: 24095 - DNA, 201 bp, Homo sapiens
agggatgggatggggagggggaagcttattgaaatatactaaaagacaaaccaacctaagggctggagggaagaaaattcacacttgtaagcttctttttyaaggggcatctcttaggctctagcttttgagattcagtatatatatatttttgagtcttgctctgctggagtgcagtggtgtgatctgggctcactgcaa

SEQ ID NO: 24096 - DNA, 201 bp, Homo sapiens
tgggttttaatgtcaggctgttcttttaggtatggcggcttttccctgggtgtcagtaatactcaagcacttcctccgagtcaagaagttaatgatgccaycaaacaaatgaagaaacacctaaagctggccaaggtaaaatatctatcgtaagatgtatcagaaaaatgggcatgtagctgctgggatataggagtagtt

SEQ ID NO: 24097 - DNA, 201 bp, Homo sapiens
tccccatctgcttgcctccagacccacattcacacccgagccactgggttggaggagcatctgtgagatgaaacaccattctttcctcaatgtctcagctrtctaactgtgtgtgtaatcaggccaggtcctccctgctgggcagaaaccatgggagttaagagattgccaacatttattagaggaagctgacgtgtaact

SEQ ID NO: 24098 - DNA, 201 bp, Homo sapiens
cagtgctgacaatcttatactctaggttgaacctccggggaaggtgcccttgcttgatggcatgtttaccaggggttctagagcctcaatcacagattctstctagctcacatgaagttaatgaaaatgaatgtgcttccctacaaattagagaggctttgaggaaaaatcagattaaatgcactcctgcttgaacttatg

SEQ ID NO: 24099 - DNA, 201 bp, Homo sapiens
attgtatccaggtgtttataggctccctgagttcctgacttgagcctatctatgggtttagagttcaaggctctttaccagtgctgacaatcttatactcyaggttgaacctccggggaaggtgcccttgcttgatggcatgtttaccaggggttctagagcctcaatcacagattctctctagctcacatgaagttaatg

SEQ ID NO: 24100 - DNA, 201 bp, Homo sapiens
ccttcctggcattgtttggctcctcattgttctggaatctcatgtccatctcatgtatttgccttggttcacacttgatcttctgctcatattcctcacctactgaaattttacccatcaaccagaccgtgggtgatggaacacagcatgggctagttcttcttatatatgatctcatttaattttcactggaactctgag

SEQ ID NO: 24101 - DNA, 201 bp, Homo sapiens
gctgtagaggtgacatcagcccagccagtggatgggggcttgggaaacattgcttcccattattgtcatgctggagggccctttagcccatcctctcccccgccaccctccttattgaggcctggagcagacttcccagacctggtagtgcttcagggccctggtatgatggacctatatttgctgcttaagacatttgct

SEQ ID NO: 24102 - DNA, 201 bp, Homo sapiens
gatgatgctgagcttggctcatacctgtgctttgctttcaggccagtacggaattcccaggccctggtattttccttgcaccaagtcctactggtttggcraggaaagtgatgagaagagccaccctggttccaaccagaagagaatatcagaaagtaagtgctgttgacctcctgctctttctttaacctagtgctgctg

SEQ ID NO: 24103 - DNA, 201 bp, Homo sapiens
actaatgcgttcctcgtttttacagttttattatttctagaatgttacataaatggaaccatacagtaggtatccttttgatactggctttttttttttttcactcagcagtattcccttagatctatccaagttgtgtgtgtcaacagttcattcctcttcactgctgagtagtgttccctgggaggggtgtatcacagt

SEQ ID NO: 24104 - DNA, 201 bp, Homo sapiens
ctgggaaaagacattcgctctgagatgagcaccatccggcagaacctgggggtctgtccccagcataacgtgctgtttgacatgtgagtaccagcagcacrttaagaataggccttttctggatgtgtgtgtgtcatgccatcatgggaggagtgggacttaagcattttactttgctgtgtttttgttttttcttttttt

SEQ ID NO: 24105 - DNA, 201 bp, Homo sapiens
aggaagtatattttgctgaatcagaaagaaaagtgatttatttcaggttgctgatgcttagattgttagagttggaaagatctggcttgcatcttgtacarctgacagaactggggctcaggggggcacaggtgcccagagttggtcagtcaggaaagtagcaccagaaccagtctcctggtggccctacagttgcagacc

SEQ ID NO: 24106 - DNA, 201 bp, Homo sapiens
tgattcatcaagaaataactagaatggcaagttaaaatttaagctgtttcaaagatgcttctgcatttaaaaacaaatttatctttgattttttttccccycagcaaataagacttattttattctaattacaggatgaacccaccacaggcatggatcccaaagcccggcggttcttgtggaattgtgccctaagtgttg

SEQ ID NO: 24107 - DNA, 201 bp, Homo sapiens
ttttaaatagttttctggagatcctccatttgggtattttttcctgctttcaggtttggagatggttatacaatagttgtacgaatagcagggtccaaccyggacctgaagcctgtccaggatttctttggacttgcatttcctggaagtgttctaaaagagaaacaccggaacatgctacaataccagcttccatcttca

SEQ ID NO: 24108 - DNA, 201 bp, Homo sapiens
tttgtggttgttacggaatgatcctgtgctcctgaggcaacagaaaggccaggccatctctggtaatcctactcttgctgtcttccctttgcagagacacrccctgccaggcaggggaggaagagtggaccactgccccagttccccagaccatcatggacctcttccagaatgggaactggacaatgcagaacccttcac

SEQ ID NO: 24109 - DNA, 201 bp, Homo sapiens
aagctgggcgtgtccattcagaacctggtaaaagtctaccgagatgggatgaaggtggctgtcgatggcctggcactgaatttttatgagggccagatcayctccttcctgggccacaatggagcggggaagacgaccaccatgtaagaagagggtgtggttcccgcagaatcagccacaggagggttctgcagtagagtt

SEQ ID NO: 24110 - DNA, 201 bp, Homo sapiens
tgagctgcagtcttggtgctgggctggtgttgggtctgggcagccaggacttgctggctgtgaatgatttctccatctccaccccttttgccatgttgaarccaccatctccctgctctgttgcccctttgaaatcatatcatacttaaggcatggaaagctaaggggccctctgctcccattgtgctagttctgttgaat

SEQ ID NO: 24111 - DNA, 201 bp, Homo sapiens
attaactgcaaattaaaatcttagtctcttgcctctttaatccaggcttcttcatactataccagaatttaggataactattacagtgccctttataggaragaaagaagaaattgtgtctgtagatgtctgttcctttcagcttaaaatggacactgaaatgttaaatattggactggcctcatttatttctcctgtctg

SEQ ID NO: 24112 - DNA, 201 bp, Homo sapiens
tgggttcatttctgtcttctctcctgtcacagtctgcatggaggaggaacccacccacttgaagctgggcgtgtccattcagaacctggtaaaagtctacygagatgggatgaaggtggctgtcgatggcctggcactgaatttttatgagggccagatcacctccttcctgggccacaatggagcggggaagacgaccac

SEQ ID NO: 24113 - DNA, 201 bp, Homo sapiens
tccctatccctctcccctcctcctccggctacacacatgcggaggaaaatcagcactgccccagggtcccaggctgggtgcggttggtaacagaaacttgyccctggctgtgcccctaggtcctctgccttcactcactgtctggggctggtcctggagtttgtcttgctctgtttttttgtaggtggaatgcagagaaag

SEQ ID NO: 24114 - DNA, 201 bp, Homo sapiens
cctacttgcaggatgtggtggagcaggcaatcatcagggtgctgacgggcaccgagaagaaaactggtgtctatatgcaacagatgccctatccctgttasgttgatgacatgtaagttacctgcaagccactgtttttaaccagtttatactgtgccagatgggggtgtatatatgtgtgtgcatgtgcatgcatgtgtg

SEQ ID NO: 24115 - DNA, 201 bp, Homo sapiens
gttgattacctgtggtttggttttaggtactgggaccctggtcctcgagctgacccctttgaggacatgcggtacgtctgggggggcttcgcctacttgcrggatgtggtggagcaggcaatcatcagggtgctgacgggcaccgagaagaaaactggtgtctatatgcaacagatgccctatccctgttacgttgatgac

SEQ ID NO: 24116 - DNA, 201 bp, Homo sapiens
ctcgaaggaactatagctggttttctcaccagactgattaacatatagtatggtttggtacctgttaaatgagtctctctctacaggttttcatcttctaytttaagaaccccttcctggcattgtttggctcctcattgttctggaatctcatgtccatctcatgtatttgccttggttcacacttgatcttctgctcat

SEQ ID NO: 24117 - DNA, 201 bp, Homo sapiens
ttgtatggttctaaaggaatggttgattacctgtggtttggttttaggtactgggaccctggtcctcgagctgacccctttgaggacatgcggtacgtctbggggggcttcgcctacttgcaggatgtggtggagcaggcaatcatcagggtgctgacgggcaccgagaagaaaactggtgtctatatgcaacagatgccc

SEQ ID NO: 24118 - DNA, 201 bp, Homo sapiens
actaggtgctggacagaggtcaaaagacttttaagaatctgccaccattaatgatctctttctgcttggcattcaaggctctttgaaataagactgtgacscactttgatagttttgtcctggattataagacacatgctcgaaggaactatagctggttttctcaccagactgattaacatatagtatggtttggtacct

SEQ ID NO: 24119 - DNA, 201 bp, Homo sapiens
cacactcttctccagagccaacctggcagcagcctgtgggggcatcatctacttcacgctgtacctgccctacgtcctgtgtgtggcatggcaggactacrtgggcttcacactcaagatcttcgctgtgagtacctctggcctttcttcagtggctgtaggcatttgaccttcctttggagtccctgaataaaagcagca

SEQ ID NO: 24120 - DNA, 201 bp, Homo sapiens
gctagttctgttgaatcccgttttccttttcctatgaggcacagagagtgatggagaaggtccttagaggacattattatgtcaaagaaaagagacttgtyaagaggtaagagccttggctacaaatgacctggtgttcctgctcattacttttcaatctcattgaccttaacttttaaactataaaacagccaatattta

SEQ ID NO: 24121 - DNA, 201 bp, Homo sapiens
gtgatttaattagcattcaataaaaattcatgttgaatttttctttagtacttctttcttaatataatacatcttcttgaccaagtccaagaggaacctgygttggacagttttcatatgagatcaaattctgagagagcaagatttaaccctttttggttcaccttctgatcctcccctaaggaggtatacatgaaatat

SEQ ID NO: 24122 - DNA, 201 bp, Homo sapiens
tgagtagctgggattacaggcatgcgccaccacacccggctaattttgtatttttagtagagacggggtttcttcatgttggtcaggctggtctcgaactyccgacctcagttgatccacccgtcttggcctcccaaagtgctgtattagccccattttatatccaaggaaactgaggcttagggagatttaaataggggg

SEQ ID NO: 24123 - DNA, 201 bp, Homo sapiens
ttctcatctgaaatgcaaaggaaggaggagttggtttaattcaataagtttcagttgagtaaacatgatttagtgagacactgttcttgcttctgactcaycatttggaaaatctctctaaaataaaattggactctccatctcggacatcattttgggtgtaggttttgcttttttttttgagatggagtctcgttatgt

SEQ ID NO: 24124 - DNA, 201 bp, Homo sapiens
tttgcctcagtttcatcatctgtaaaataggtatttgtgtttgtgtataatgtgaaccgtataatataatgcttggcctatagtgaaatttattcatacgmgtgttttcagtgattttaaaagcttgctttaggccgggcgcgatggcttctgcctataattccagcactttgggaggccaaggtgggcggatcatgaggt

SEQ ID NO: 24125 - DNA, 201 bp, Homo sapiens
gtgaccccctgcccctgcccaccagagaacaaccccctttgactgtaattttccattaccttcccaaatcctataaaacggccccacccctatctcccttygctgactctcttttcggactcagcccacctgcagccaggtgaaaaaaacagctttattgctcacacaaagcctgtttggtggtctcttcacacagacgca

SEQ ID NO: 24126 - DNA, 201 bp, Homo sapiens
taaaagtctaccgagatgggatgaaggtggctgtcgatggcctggcactgaatttttatgagggccagatcacctccttcctgggccacaatggagcgggraagacgaccaccatgtaagaagagggtgtggttcccgcagaatcagccacaggagggttctgcagtagagttagaaatttataccttaggaaaccatgct

SEQ ID NO: 24127 - DNA, 201 bp, Homo sapiens
ggtgctttaaggagacaattagagatcaatctggaaaacttcatttgaatttttaatacataagaaaacaataagaaatagttaaaaatatatatttatawaatatatatgtgtgtgtgtgtgtgtgtgtgtatatatatatatatattttatttatttatttttttttgagatggagtctcgctctgttgcccaggctgg

SEQ ID NO: 24128 - DNA, 201 bp, Homo sapiens
tgttcctgctcattacttttcaatctcattgaccttaacttttaaactataaaacagccaatatttattaggcactgatttcatgccagagacactctggkcatgaaagaaagtaatgataatagttaattttatatagcgttgttaccatttacaaccttttttttttttttaacctctatcatctcaattaaagtgcag

SEQ ID NO: 24129 - DNA, 201 bp, Homo sapiens
gtgttcctgctcattacttttcaatctcattgaccttaacttttaaactataaaacagccaatatttattaggcactgatttcatgccagagacactctgkgcatgaaagaaagtaatgataatagttaattttatatagcgttgttaccatttacaaccttttttttttttttaacctctatcatctcaattaaagtgca

SEQ ID NO: 24130 - DNA, 201 bp, Homo sapiens
aatagagatttcaggtttacatttgaattcagaaacaaagttttctttctcattacagagaacactaaactctacatctcccttcccgagcaaggagctgrctgaagccacaaaaacattgctgcatagtcttgggactctggcccaggaggtaagttgtgtctttccagtaccaggaagcggatcatccactgtatcagt

SEQ ID NO: 24131 - DNA, 201 bp, Homo sapiens
taagagccttggctacaaatgacctggtgttcctgctcattacttttcaatctcattgaccttaacttttaaactataaaacagccaatatttattaggcwctgatttcatgccagagacactctgggcatgaaagaaagtaatgataatagttaattttatatagcgttgttaccatttacaacctttttttttttttta

SEQ ID NO: 24132 - DNA, 201 bp, Homo sapiens; identical to SEQ ID NO: 3417

SEQ ID NO: 24133 - DNA, 201 bp, Homo sapiens
ctctttcatgagattgatgaccggctctcagacctgggcatttctagttatggcatctcagagacgaccctggaagaagtaagttaagtggctgactgtcrgaatatatagcaaggccaaatgtcctaaggccagaccagtagcctgcattgggagcaggattatcatggagttagtcattgagtttttaggtcatcgaca

SEQ ID NO: 24134 - DNA, 201 bp, Homo sapiens
tgcacttatttaccctttaatgagcctctttacttaagtacagtgtgaggaacagcggcatcaggatcacttgggaacttgttagaaattcagcaacttgsgcccagctcagacctactgaatcagaatcaggagcaattctctggtgtgactgtgtcacagccaggtatcaactggattctcatacataggaaatgacaa

SEQ ID NO: 24135 - DNA, 201 bp, Homo sapiens
ggcactgtgtgaatgatgagctgctgttactgtgtggaggggaaatgcacttagtgcttcagagccacttgaaagggataagtgctctagagacaattggrttcaaatgtggagcaggctgagcaagaacagaatgtctcctttgcctgagcctgagtgctgttaatcacatcttcctgccttgggctgagttagagaatc

SEQ ID NO: 24136 - DNA, 201 bp, Homo sapiens
tcaccatgttggccaggctggtcttgaactcctgacctcaggtgatccacccgcctcgacctcccaaagtactgggattacaggtgtgagccactgcaccsggcccagactcgagtttttcatcttaatgctttttcattgcctgacactttactgagaccaagatagggaacttcacatacagtaccttttctcccaagg

SEQ ID NO: 24137 - DNA, 201 bp, Homo sapiens
ccctttagcttttgcaaacctcctttaagacccgatttaaatgcttccctcctcatgaagctcttctggatccactccttcccatcactaagttgaaagtmagatccccttctctttacttccattagacttggattacagcactctttgtatcatgtatttaattctgttttttaattacagttaacatttatttgtctt

SEQ ID NO: 24138 - DNA, 201 bp, Homo sapiens
ttgaaaacaaagttggtacaaaaccctttagcttttgcaaacctcctttaagacccgatttaaatgcttccctcctcatgaagctcttctggatccactcyttcccatcactaagttgaaagtaagatccccttctctttacttccattagacttggattacagcactctttgtatcatgtatttaattctgttttttaat

SEQ ID NO: 24139 - DNA, 201 bp, Homo sapiens
tttgaaatcctgtctttcccatgttgaaaacaaagttggtacaaaaccctttagcttttgcaaacctcctttaagacccgatttaaatgcttccctcctcrtgaagctcttctggatccactccttcccatcactaagttgaaagtaagatccccttctctttacttccattagacttggattacagcactctttgtatca

SEQ ID NO: 24140 - DNA, 201 bp, Homo sapiens
atttacttgctgattttctaatgcacatcacacatagtcatattaaacacacacacacacacacacacacacacacacccctcaagaaacattttctgagrcgtgatttcctgatttcatcaaaaaagaaaagagcgggccaggcacagtgggaagtcaaggtgggtggatcacttgaggtcaggagtttgaaaccagcct

SEQ ID NO: 24141 - DNA, 201 bp, Homo sapiens
ggattacaggcatgagccaccatgcctggccttctttgagaagctggagacatgagttaagtggtgaagaagccaaatctgtatctaaaaaccctacagtwgtgtgcagagctctgaggagagaaggtcccttagattttgagtgtattattatgtcagtgcttgttttacatctctctgttcacgcagtatgtccccttt

SEQ ID NO: 24142 - DNA, 201 bp, Homo sapiens
caaaataaagtttgaaatcctgtctttcccatgttgaaaacaaagttggtacaaaaccctttagcttttgcaaacctcctttaagacccgatttaaatgcytccctcctcatgaagctcttctggatccactccttcccatcactaagttgaaagtaagatccccttctctttacttccattagacttggattacagcact

SEQ ID NO: 24143 - DNA, 201 bp, Homo sapiens
ataaaattgatttccggtggggccttcagttactctccattctacgaagaccacaaatagcattcaggcaaagagcatttattccaacaatggaggagcaytggatttggttcctaaaacaaaataaagtttgaaatcctgtctttcccatgttgaaaacaaagttggtacaaaaccctttagcttttgcaaacctccttt

SEQ ID NO: 24144 - DNA, 201 bp, Homo sapiens
gacccacaagcttatgagatactgttcttccaggaaagcagtggggccagggccaccttttaattgtgtttcttggcctggtcccatctttctcacaatayatagcaacagttatttacttgctgattttctaatgcacatcacacatagtcatattaaacacacacacacacacacacacacacacacacccctcaagaa

SEQ ID NO: 24145 - DNA, 201 bp, Homo sapiens
acattaccctgtggctgcatgactttgtgaataggttagttagcaccctttcagccacttcttcttacctgttaatgagataaaacatgtaattgcttaaraacagtatttggcacataggaagcacttagtgaatatgaattatgattttttttggagtggtgacatctcaaccaagccatttaacccctcagccttact

SEQ ID NO: 24146 - DNA, 201 bp, Homo sapiens
agggtgctgacgggcaccgagaagaaaactggtgtctatatgcaacagatgccctatccctgttacgttgatgacatgtaagttacctgcaagccactgtwtttaaccagtttatactgtgccagatgggggtgtatatatgtgtgtgcatgtgcatgcatgtgtgaatgatctggaaataagatgccagatgtaagttgt

SEQ ID NO: 24147 - DNA, 201 bp, Homo sapiens
gcccctctccaggaggcattggtgaagaaactaggggagctggttgccacagacagtgatgtactaatcttctctgggaagacagaagaaaagtccccagrgaagaatactacagacttggccttagggacagctaggggtgcagattgctgccaactgcattttttctgaagttggccatatggttgcagtgaatggatt

SEQ ID NO: 24148 - DNA, 201 bp, Homo sapiens
aacagaggccgggaacggggcggggaggagggagagcacaggctttgaccgatagtaacctctgcgctcggtgcagccgaatctataaaaggaactagtcycggcaaaaaccccgtaattgcgagcgagagtgagtggggccgggacccgcagagccgagccgacccttctctcccgggctgcggcagggcagggcgggga

SEQ ID NO: 24149 - DNA, 201 bp, Homo sapiens
cactgagcctactgtggttcatggataagttggccctgggggcatgtgtgtgcatgcatgtgtgtgcacatgcatgatgagccgggccttgaagggtggtragatttgggtgtgtagaccaatggagaaaggcatttggggcagtgatgatgggtgggggagggaacatggtgatgaatggagctgggtgtggggagccat

SEQ ID NO: 24150 - DNA, 201 bp, Homo sapiens
cgtgggtatagaatcatagttacaagcaggcatttcttggggatggggaggactggcacagggctgctgtgatggggtatcttttcagggaggagccaaagcgctcattgtctgtgcttctcctcctttttctgcggtccctggctccccacctgactccaggtgaacaagaccttccaggaactggctgtgttccatgat

SEQ ID NO: 24151 - DNA, 201 bp, Homo sapiens
agttctgttgaatcccgttttccttttcctatgaggcacagagagtgatggagaaggtccttagaggacattattatgtcaaagaaaagagacttgtcaakaggtaagagccttggctacaaatgacctggtgttcctgctcattacttttcaatctcattgaccttaacttttaaactataaaacagccaatatttatta

SEQ ID NO: 24152 - DNA, 201 bp, Homo sapiens
ttgaatcttgaagattatttttcagaaattgataaagttattttaaaaagcacggggagagaaaaatatgcccattctcatctgttctgggccaggggacwctgtattctggggtatccagtagggcccagagctgacctgcctccctgtccccaggctgactgtcgaagaacacatctggttctatgcccgcttgaaagg

SEQ ID NO: 24153 - DNA, 201 bp, Homo sapiens; identical to SEQ ID NO: 3383

SEQ ID NO: 24154 - DNA, 201 bp, Homo sapiens
ccagcctgggtagacagagcaagaccctgtctcaaaaaaaagaaatgaaagagaaagaaagaaagaggagaggagaggagatgaggggaggggaggggagsagggagggggggaggaaggaaggaaggaaggaaggaaaaaaagatgaaaaaagaaaaaaacaagatgaaacagaggcagaaagactttacgtaaattgct

SEQ ID NO: 24155 - DNA, 201 bp, Homo sapiens
ggatcactgcactccagcctgggtagacagagcaagaccctgtctcaaaaaaaagaaatgaaagagaaagaaagaaagaggagaggagaggagatgagggkaggggaggggaggagggagggggggaggaaggaaggaaggaaggaaggaaaaaaagatgaaaaaagaaaaaaacaagatgaaacagaggcagaaagactt

SEQ ID NO: 24156 - DNA, 201 bp, Homo sapiens
ggatcgcttgagcccagggagtcaagtctacactgagccatgattggatcactgcactccagcctgggtagacagagcaagaccctgtctcaaaaaaaagraatgaaagagaaagaaagaaagaggagaggagaggagatgaggggaggggaggggaggagggagggggggaggaaggaaggaaggaaggaaggaaaaaaa

SEQ ID NO: 24157 - DNA, 201 bp, Homo sapiens
acaagtgatttaagtttcttttaaacagagaatagtaatacctacctcatattattattgtcagtgtatcatcttacaatcacagtctttctcttagggcygggctcagtgggtggattgacactgcagaaatggccagatctaaaggatcaacatttacgtagctgggaaatgtagctgggacttcagtttcactgccct

SEQ ID NO: 24158 - DNA, 201 bp, Homo sapiens
tctgagaagttccccagcttccctctgttccccgtttccacacttagcgaggctcttgtccactgctacatcccccatagccagtccctcagccttgccaytgcttatgctggtctggaaacaattcctagacttgtggggcatctggggaagttctccatctttttttagctggcatgacccaagtggtgtgggcagggc

SEQ ID NO: 24159 - DNA, 201 bp, Homo sapiens
catggggcctcattgttttaattagtgacaaaacaacaataataacaacaaaacccccgaagcttcacagatgacatcagaccccaagcctgtgtgtttttcaggtgcccttgaggagctttgtagctggcagaggaggtgaaactgacaaatgtttggcagatggaggagagtaccagaggggtttgagatgagctaaat

SEQ ID NO: 24160 - DNA, 201 bp, Homo sapiens
gtttcctatctcacagggttgtcctgaggattaaattaagtaattaatataaaatgtgccttgtacatattgggccctaaataaacagtagctactatttrtccttaaagtacaaatggtagtttcagagcttcaaggctgatggctatttatcttactcatactctttgtttagcttcatttttttcccctaatttcatt

SEQ ID NO: 24161 - DNA, 201 bp, Homo sapiens
tctccaattttagctctgtgagatggcactggggaaacagaaatgaacggactagtgtcacaaagctcaggtgggatggacgagatcacttcaaaggtctrtaatcccacgtctataatcccagcactttgggaggccaaggcgggaaaatcacttgaggtcaggagttcgagaccatcctggccaacatggcaaagcctg

SEQ ID NO: 24162 - DNA, 201 bp, Homo sapiens
ccctccatggccgaatccctgcttcccacgaagagaacctcacaaaaatttcccccaagttaaagagtggaattttcttgatttttttttcttttttttttaacggccgtagtttagaacccagacttaaattatgatcttcttttcaaacaaaacttaaagtccttaagttttcatctccccttttatttcaacctattc

SEQ ID NO: 24163 - DNA, 201 bp, Homo sapiens
ttgagttaaacttaaaaaatattcacagttctgaggcaataaccgtggttaagggttattgatctggaggagctctgtctaaaaaattgaggacaggagamtttagacaagggtgtatttggagacttttaagaattttataaaataagggctggacgcagtggcactgagttgagaactgttgcttgctttgcattaaat

SEQ ID NO: 24164 - DNA, 201 bp, Homo sapiens
ttagcgtgtttgccaactcccaggccattggtaaagcaggaaggttcttggggcggcggacggtgccagggttatgtgtaggtgcctctttaggtatatcktttatcaaaaagaagcaaagaaataagattaaaaataaacaaagaaaaaagttgtctggcactggcagtaattggcctgcctttgcagcactgataccat

SEQ ID NO: 24165 - DNA, 201 bp, Homo sapiens
ctggcttatcacttggcatttgtgatgatttcctcctacaagggatacattttaagttgagttaaacttaaaaaatattcacagttctgaggcaataaccrtggttaagggttattgatctggaggagctctgtctaaaaaattgaggacaggagactttagacaagggtgtatttggagacttttaagaattttataaaa

SEQ ID NO: 24166 - DNA, 201 bp, Homo sapiens
cagattcatatttagactcttcacagtttgacctgagttttggccagaataaggtgacatttagtttgttggcttgatggatgacttaaatatttagacawggtgtgtaggcctgcattcctactcttgcctttttttttgcccctccagtgttttgggtagttttgctcccctacagccaaaggcaaacagagaagttgg

SEQ ID NO: 24167 - DNA, 201 bp, Homo sapiens
gaggtagtttgaatacaacttcacttaattttacttccctattcaggcaggaattgccaaaccatccaggagtggaatatgcaacctggcgtcatgggccmgctggttaaaataaaattgatttctggcttatcacttggcatttgtgatgatttcctcctacaagggatacattttaagttgagttaaacttaaaaaata

SEQ ID NO: 24168 - DNA, 201 bp, Homo sapiens
aagaaaggacagtaggaagactaatagataatggtggattgaactaagatggtagcaacagatagggagctatggtaatgttcagtatccactttggagayagatccagcaggacttgctgacagactgcatgtaagggctgagggaaagagagctagcaaggtgacttctagtttgtgacctgaactaggtagatggttg

SEQ ID NO: 24169 - DNA, 201 bp, Homo sapiens
catctactagacgaatgattttctggaatgattacaagcaggcaagatggtgtagtggaaatagcaaatgtcttcggcatcagacaagttggggtttgtttgtatcctgcctctgcccttcaccgaggttgtgatcttgggcagattgttgagttttaacctagattcctctgactccagatcataaattttcagaaaagt

SEQ ID NO: 24170 - DNA, 201 bp, Homo sapiens
attatatccaacattgctgagaagatgagtaaggaatgtaaatgagtaaaggcaggaatggctattgaatttgttaagacagaggtccttggtgaccttcmtaagagtcatttcagcatgacaaggatgcagacctaactggaatagattttcagggaagactgagaggcaaggaaggggagactgcaaatatatgcaaat

SEQ ID NO: 24171 - DNA, 201 bp, Homo sapiens
gaaagctaaggggccctctgctcccattgtgctagttctgttgaatcccgttttccttttcctatgaggcacagagagtgatggagaaggtccttagaggrcattattatgtcaaagaaaagagacttgtcaagaggtaagagccttggctacaaatgacctggtgttcctgctcattacttttcaatctcattgacctta

SEQ ID NO: 24172 - DNA, 201 bp, Homo sapiens
catcatgttggccaggttggtttcgaactcctgacctgaggtgagctgcccaccttggcctcccaaagtgctgggattacaggcatgagccactgcgcccrgctcagatccatccctttctaagggcaaacagtccatggtgcaaaggggccatgccacccagagttatgagtacctgggactccagaattccttgcctgg

SEQ ID NO: 24173 - DNA, 201 bp, Homo sapiens
ctttctcacaatatatagcaacagttatttacttgctgattttctaatgcacatcacacatagtcatattaaacacacacacacacacacacacacacacmcacccctcaagaaacattttctgagacgtgatttcctgatttcatcaaaaaagaaaagagcgggccaggcacagtgggaagtcaaggtgggtggatcact

SEQ ID NO: 24174 - DNA, 201 bp, Homo sapiens
aacagaagatgattgtcttttccaatgggacatgaaccttagctctagattctaagctctttaagggtaagggcaagcattgtgttttattaaattgtttmcctttagtcttctcagtgaatcctggttgaattgaattgaatggaatttttccgagagccagactgcatcttgaactgggctggggataaatggcattga

SEQ ID NO: 24175 - DNA, 201 bp, Homo sapiens
gagaccaagatagggaacttcacatacagtaccttttctcccaaggcggaagagggctgttcaatttctacactagagttcggggagttttagaaatgagycagttatcgaggatgagagcagttcctgataggctcaaccacaatgagatgtagctgttcagagaaagcattcttttatctataaactggaagataatcc

SEQ ID NO: 24176 - DNA, 201 bp, Homo sapiens
gggctcagtgggtggattgacactgcagaaatggccagatctaaaggatcaacatttacgtagctgggaaatgtagctgggacttcagtttcactgccctrgtgatttttcctaccactaagcagctcagtccatacccctacgagacccacaagcttatgagatactgttcttccaggaaagcagtggggccagggccac

SEQ ID NO: 24177 - DNA, 201 bp, Homo sapiens
cagacccttctccattcccaggcatgtttggtggcagagtttaccttagttggggttaggctgttgtctggtactgtgagagagaaggaagaagaagataygatattaacaacaacaatacatatttatatttgaaaattaaatgcactaatacacctatagtgctattaaacaaatttatttgttcagcaaatgtttgtt

SEQ ID NO: 24178 - DNA, 201 bp, Homo sapiens
caccctttggcaagtaccccagcctggaacttcagccctggatgtacaacgaacagtacacatttgtcaggtatgtttgtcttctacatcccaggaggggrtaagattcgagcagaccaaagatgtttacgagggccaagggaatggacttcagaattacacggtggaatgaattttactgctgcggctcaggtccctgta

SEQ ID NO: 24179 - DNA, 201 bp, Homo sapiens
gctgttcaccgacaatgtgagtcatgcagagagaacactcctgctgggatgagcatctctgggagccagaggacagtgtttaattgtgatcttattccacytgtcagtggtattgacactgctgactgccttgtcctgtcttcagagtctgtcttccctgagaaggcaaagcacctttctttcttgctgtgccttacattt

SEQ ID NO: 24180 - DNA, 201 bp, Homo sapiens
tgaatcatagaaccagaaggggttctcatctgaaatgcaaaggaaggaggagttggtttaattcaataagtttcagttgagtaaacatgatttagtgagayactgttcttgcttctgactcaccatttggaaaatctctctaaaataaaattggactctccatctcggacatcattttgggtgtaggttttgctttttttt

SEQ ID NO: 24181 - DNA, 201 bp, Homo sapiens
ttctgaggcagctgtgatttaagaaaatgctctagtctgtggcattccatattcaagtactttgagttgtatattaatttatttttgttaataagagtgasatgactcactaagtaatttagagatttaaacacttttttaaaaaacagtaacttcatatgcattggatctattcttctataaagtcttttcttggggggt

SEQ ID NO: 24182 - DNA, 201 bp, Homo sapiens
caatggaggagcactggatttggttcctaaaacaaaataaagtttgaaatcctgtctttcccatgttgaaaacaaagttggtacaaaaccctttagctttkgcaaacctcctttaagacccgatttaaatgcttccctcctcatgaagctcttctggatccactccttcccatcactaagttgaaagtaagatccccttct

SEQ ID NO: 24183 - DNA, 201 bp, Homo sapiens
catacatcagcctcttaaggagctggggccacaggcacgcaccactgctcctggctaaatttttacaattttttgtaaagacaaggtctcactatcttgcycagactggtcttgaactcctgggctcaagtgatcctcccacatcagcctcccaaagtgctgggattacaggcataagccactgtgcaggtcatcaaatgc

SEQ ID NO: 24184 - DNA, 201 bp, Homo sapiens
tgagaaactttccgtttctgttgagagtatcattctcttgagaaactttctcctaaatcagagaaagtatggaagcatggaaagtattcctgagtagaacytctacagatattacaatatttttcaaatacaaagtttccattgtcagcctgtttcccaagtgcttccacaaaccattaaataattccacaaaccattaaa

SEQ ID NO: 24185 - DNA, 201 bp, Homo sapiens
tgcgatgaaacaattctgacattcatgttatgagcagttacctcataaatagattacatgtgagattgaacttgggcagactataatatagcattaatgaygaaacagacacagtcatcttcgggaagaagaatagaggcttatttgctgcctgtgaaattaaaattactctgactgggaatccatcgttcagtaagttta

SEQ ID NO: 24186 - DNA, 201 bp, Homo sapiens
actcaggctggagtgcagtggcatgatctcgactcactgtaacctctgcctcccgggttcaagcgattctcctgcctcagcctcctgagataacaggcgcycgccaccacatctggctaatttttgtatttttagtaaagactgggtttcatcatgttggccaggttggtttcgaactcctgacctgaggtgagctgccca

SEQ ID NO: 24187 - DNA, 201 bp, Homo sapiens
atgatgatgagatctttgctgtttataccaagccccttagactgtgtcactcttctgatccggttgtccttgtatggccatgctgtatattgtgaatgtccgttttcaaaagcaaagccaagaattaaccttgtgttcaggctgtggtctgaatggttatgggtccagagggagttgatctttagctcacacttctattac

SEQ ID NO: 24188 - DNA, 201 bp, Homo sapiens
gtcttgctctgtcactcaggctggagtgcagtggcatgatctcgactcactgtaacctctgcctcccgggttcaagcgattctcctgcctcagcctcctgrgataacaggcgctcgccaccacatctggctaatttttgtatttttagtaaagactgggtttcatcatgttggccaggttggtttcgaactcctgacctga

SEQ ID NO: 24189 - DNA, 201 bp, Homo sapiens
tgacttcaatagaggtttcagacaaaaagttgttttgtatatacttatcagtcatgaaaagataattacaactaaatggcctttttccttccctatttatytggagaaatttaattacataaaaaagtactcagaatatttgagtttcctgcatcaataagacatttataataatgaccttgtttacaaatgaatttgaaa

SEQ ID NO: 24190 - DNA, 201 bp, Homo sapiens
tcgcatcccctgtgacttgcacatatacgcccagatggcctgaagtaactgaagaatcacaaaagaagtgaaaaggccctgcctcgccttaactgatgacrttccaccattgtgatttgttcctgccccaccttaactgagtgattaaccctgtgaatttccttctcctggctcagaagctcccccactgagcaccttgtg

SEQ ID NO: 24191 - DNA, 201 bp, Homo sapiens
ctgtaaggctaacagttgcaatatactagggtaatctgagtgagctggaattaaaaaaaaaaaggaatttcaccccaatcttatactgacttcaatagagstttcagacaaaaagttgttttgtatatacttatcagtcatgaaaagataattacaactaaatggcctttttccttccctatttatttggagaaatttaat

SEQ ID NO: 24192 - DNA, 201 bp, Homo sapiens
ctcctaggcttagcattttctccccacactatgctgccatgttgcttattccaacattaggaagcataggtgccatccccagcttttgaggccaatatcaygatgaagcatttttaaaacatctcattaaattgctgatatagtggaaagaaccaaagctttgcagtcaaagctgtttgggttcaaatttaccacttgttt

SEQ ID NO: 24193 - DNA, 201 bp, Homo sapiens
ccccactttttccttttgctgcagccctgggagccacctggctctccaaaagcccctaatgggcccctgtatttctggaagctgtgggtgaagtgagttartggccccactcttagagatcaatactgggtatcttggtgtcaatctggattctttccttcaggcctggaggaatataataactgagacttgttttatttc

SEQ ID NO: 24194 - DNA, 201 bp, Homo sapiens
gctccctctttccccacatccattcaaatctgttccttctccaaaggatgtgtcaaggaggaaatggacctggctgggaaaccctcagaatactgggatgwtgctgagcttggctcatacctgtgctttgctttcaggccagtacggaattcccaggccctggtattttccttgcaccaagtcctactggtttggcgagga

SEQ ID NO: 24195 - DNA, 201 bp, Homo sapiens
ggagaaggtccttagaggacattattatgtcaaagaaaagagacttgtcaagaggtaagagccttggctacaaatgacctggtgttcctgctcattacttwtcaatctcattgaccttaacttttaaactataaaacagccaatatttattaggcactgatttcatgccagagacactctgggcatgaaagaaagtaatga

SEQ ID NO: 24196 - DNA, 201 bp, Homo sapiens
cacagagagtgatggagaaggtccttagaggacattattatgtcaaagaaaagagacttgtcaagaggtaagagccttggctacaaatgacctggtgttcstgctcattacttttcaatctcattgaccttaacttttaaactataaaacagccaatatttattaggcactgatttcatgccagagacactctgggcatga

SEQ ID NO: 24197 - DNA, 201 bp, Homo sapiens
ctttgggggaggcctcagcttctctgtctataagattgcagcaggggtgtagtgggaatgagtcttcaacattccaagagattttatctactaatacgacmgtcaaatggagcatgactttgtggaagcctctcctcttccacccagaggggccaatttctctgtcccagtgagatgttgacacttgtatgatccctgctt

SEQ ID NO: 24198 - DNA, 201 bp, Homo sapiens
tataagattgcagcaggggtgtagtgggaatgagtcttcaacattccaagagattttatctactaatacgacagtcaaatggagcatgactttgtggaagyctctcctcttccacccagaggggccaatttctctgtcccagtgagatgttgacacttgtatgatccctgcttggagacttccctcttctggaacctgccc

SEQ ID NO: 24199 - DNA, 201 bp, Homo sapiens
agattctattacgtttttcaggatgtcccaggagtcacctgggaagctcagcagtcctttgtgactttcaagcatatggtagaagctgctgaacacagagmtccctctttggggataatttgcccaaatcatttaatcaggcttgagaaatgagttaccacaggtccaggagtgctgccacccttgaattctgacacccta

SEQ ID NO: 24200 - DNA, 201 bp, Homo sapiens
cactctctcagttcattgtcctaaagatgcttcatcagaaaggaataacttccaccccgttactctctgtccccttactctgctttatttttcttcgtcartcctaccaccaccacccactgtttgaacaacccactattatttgtctgtttcccatccctggtagaataggagccccatgaatgaaggaactttgcttct

SEQ ID NO: 24201 - DNA, 201 bp, Homo sapiens
ctgggatgactgtgaagtgggatcctttccagccagtaactggaaatgtgtatgagggcagaagtgagtgtactgcatttgaaacattgagaaatctagtrcatagtactgtctcttttatatcttttttttttttttttttgattttggtttgtttgttcactaacttggaaaactgatgtggaaatgtccctttggctt

SEQ ID NO: 24202 - DNA, 201 bp, Homo sapiens; identical to SEQ ID NO: 3377

SEQ ID NO: 24203 - DNA, 201 bp, Homo sapiens
tgtccctttggcttcagttacctgagcagaaggggccgggcattgccaaactctcctcttaggacagaattgctcccagtattgatcattgtgttctgagwtgggggagcaaattgtgcaggaggccaggtcagtgccaaggtgggtgggaggaattggaggaggaagcttgcctaagtgtgcccagcaaagccacggtag

SEQ ID NO: 24204 - DNA, 201 bp, Homo sapiens; identical to SEQ ID NO: 3380

SEQ ID NO: 24205 - DNA, 201 bp, Homo sapiens
acagtcctccaaggaggcacctgtgacacccaacggagtaggggggcggtgtgttcaggtgcaggtggaacaaggccagaagtgtgcatatgtgctgaccrtgggagcttgtttgtcggtttcacagttgatgccctgagcctgccatagcagacttgtttctccatgggatgctgttttctttccagagacacagcgcta

SEQ ID NO: 24206 - DNA, 201 bp, Homo sapiens
ttccgtttgtgttcttttatgcccttttgccagagtaggtggtgcaatttggctagctggctttcattactgtttttcacacattaactttggcctcaacytgacaactcaaataatatttataaatacagccacacttaaaatggtcccattatgaaatacatatttaaatatctatacgatgtgttaaaaccaagaaaa

SEQ ID NO: 24207 - DNA, 201 bp, Homo sapiens
gccttcccctcaccccagcctaggcctttgaaaggaaacaaaagacaagacaaaatgattggcgtcctgagggagattcagcctagagctctctctccccyaatccctccctccggctgaggaaactaacaaaggaaaaaaaaattgcggaaagcaggatttagaggaagcaaattccactggtgcccttggctgccggga

SEQ ID NO: 24208 - DNA, 201 bp, Homo sapiens
ttgatggtgctttttttttttttttttgagacagagtctcgctctgtcgccatgctggagtgtagtggcacaatcttggctcactgcacctccgcctgccrggttcagcgattctcctgcctcagcctcccaagtagctgggactacaggtgcctgccaccatgcccagctaatttttgtatttttagtagagacggggtt

SEQ ID NO: 24209 - DNA, 201 bp, Homo sapiens
ctttgtggttttgagttggggattggaggagggagggagggaaggaagctgtgttggttttcacacagggattgatggaatctggctcttatggacacagractgtgtggtccggatatggcatgtggcttatcatagagggcagatttgcagccaggtagaaatagtagctttggtttgtgctactgcccaggcatgagt

SEQ ID NO: 24210 - DNA, 201 bp, Homo sapiens
gagttggggattggaggagggagggagggaaggaagctgtgttggttttcacacagggattgatggaatctggctcttatggacacaggactgtgtggtcyggatatggcatgtggcttatcatagagggcagatttgcagccaggtagaaatagtagctttggtttgtgctactgcccaggcatgagttctgatccctag

SEQ ID NO: 24211 - DNA, 201 bp, Homo sapiens
aagggttttggggccacttgttagctcacatagtgagaaccagccctgcccattaggtaggggaagaagttagcagtccatgatagctgttgcctgcagcrtatggatgttcattgcacagttcctgtctcctgagatcctggagtgtatacgcttggcctcagagcccagcacagagcctggcccttgggacatgcttag

SEQ ID NO: 24212 - DNA, 201 bp, Homo sapiens
ggttttggggccacttgttagctcacatagtgagaaccagccctgcccattaggtaggggaagaagttagcagtccatgatagctgttgcctgcagcgtayggatgttcattgcacagttcctgtctcctgagatcctggagtgtatacgcttggcctcagagcccagcacagagcctggcccttgggacatgcttagtaa

SEQ ID NO: 24213 - DNA, 201 bp, Homo sapiens
ttggggccacttgttagctcacatagtgagaaccagccctgcccattaggtaggggaagaagttagcagtccatgatagctgttgcctgcagcgtatggaygttcattgcacagttcctgtctcctgagatcctggagtgtatacgcttggcctcagagcccagcacagagcctggcccttgggacatgcttagtaagtat

SEQ ID NO: 24214 - DNA, 201 bp, Homo sapiens
ttgttagctcacatagtgagaaccagccctgcccattaggtaggggaagaagttagcagtccatgatagctgttgcctgcagcgtatggatgttcattgcrcagttcctgtctcctgagatcctggagtgtatacgcttggcctcagagcccagcacagagcctggcccttgggacatgcttagtaagtatttactgaatg

SEQ ID NO: 24215 - DNA, 201 bp, Homo sapiens
aatgagtgggaaatgtcttaaggcccattagtttgcaggtcttgaggaggctcccttgcactaggaagaatagaaagcatacataaagcctgtgtgctgcygccaggaagactagaaacgctatgttcagcctggagctgaatggtataccccagagcaaccctgttgaaaggcagtgcttgccttttcattctgtgtcct

SEQ ID NO: 24216 - DNA, 201 bp, Homo sapiens
gctattatttaggagaatttaccttggttctgattaacttacccatacttgcaaatcatttgcagctttttagttaactttgtgagttctcttagatttaygaccatgccagaaacagaaaggatattttcatctcttcctttctgatgtttattcttcttgtttcctttttttatcccccattatattctcaagaatctc

SEQ ID NO: 24217 - DNA, 201 bp, Homo sapiens
cgattcggaaactgggcctcgtgaagtatggagaaaaatatgctggtaactatagtggaggcaacaaacgcaagctctctacagccatggctttgatcggygggcctcctgtggtgtttctggtgagtataactgtggatggaaaactgttgttctggcctgagtggaaaacatgactgttcaaaagtcctatatgtccag

SEQ ID NO: 24218 - DNA, 201 bp, Homo sapiens
aggcaattaacgtgggctaaattggacttttccaaagatgctgtctttgggaaacatcacacatgctttggatcagaaaacctaggcttctaatttgttgrtaaggcatgaactcaggagactgttttcagtcctagtgaatggtgataattgtaattataacagtagacaacatctcttttacacattttaaatcatgaa

SEQ ID NO: 24219 - DNA, 201 bp, Homo sapiens
tcctttctgatgtttattcttcttgtttcctttttttatcccccattatattctcaagaatctctcaatactaagaaatagcgacttcatttttcagcgcrgagtgcattattttggctaccatgattcagaagcctcttgcctaaggcccaattttattctgctagttttctctgttctttgtacatggcccttgcgctg

SEQ ID NO: 24220 - DNA, 201 bp, Homo sapiens
atgcatattgaataacatgatgataagtactagactctgtgctaagccttctatgtgaaatacatttaattctcataataactctagagcagtggttctcraccggggccggttatccccctaccccaccccaccctcacccttccaccagggacataacatctggagatatttttggttgtcacaatcctgggaatgtat

SEQ ID NO: 24221 - DNA, 201 bp, Homo sapiens
agttctgttaaagcttagagagtggtgggagagactggagaagttgattaattagtaaatgaagttgtctgtggatttcccagatcccagtggcattggayatccatattatttttaaatttacagtgttctatcttatttcccactcagtgtcagctgctgctggaagtggcctggcctctatttatcttcctgatcctg

SEQ ID NO: 24222 - DNA, 201 bp, Homo sapiens
attggacttttccaaagatgctgtctttgggaaacatcacacatgctttggatcagaaaacctaggcttctaatttgttgataaggcatgaactcaggagrctgttttcagtcctagtgaatggtgataattgtaattataacagtagacaacatctcttttacacattttaaatcatgaaaatagaataaccttactgat

SEQ ID NO: 24223 - DNA, 201 bp, Homo sapiens
acacatgctttggatcagaaaacctaggcttctaatttgttgataaggcatgaactcaggagactgttttcagtcctagtgaatggtgataattgtaattrtaacagtagacaacatctcttttacacattttaaatcatgaaaatagaataaccttactgataattttagaaagtggtgattaaaagcacatttaagata

SEQ ID NO: 24224 - DNA, 201 bp, Homo sapiens
cataacaaccttgaatagaactcagatcatctgtcaatcatgtattttgataacagcctttacagtgagcatagaaaatacagtagtggctaacaacacargctccagatgtcaggttatctgggtatgaattctggtgtcagcattcactaagcatatgaccttggacaagtgatttaagtttcttttaaacagagaata

SEQ ID NO: 24225 - DNA, 201 bp, Homo sapiens
agatcatctgtcaatcatgtattttgataacagcctttacagtgagcatagaaaatacagtagtggctaacaacacaggctccagatgtcaggttatctgrgtatgaattctggtgtcagcattcactaagcatatgaccttggacaagtgatttaagtttcttttaaacagagaatagtaatacctacctcatattatta

SEQ ID NO: 24226 - DNA, 201 bp, Homo sapiens
accgaggttgtgatcttgggcagattgttgagttttaacctagattcctctgactccagatcataaattttcagaaaagttctgaaattcttgtatatacwgatggtaaatgagacttttccttacatctatgcacttctttgtttgtttgttttgagatggtcttgctctgttgcccagactggagtgcagtagtgcaat

SEQ ID NO: 24227 - DNA, 201 bp, Homo sapiens
ggttgtgatcttgggcagattgttgagttttaacctagattcctctgactccagatcataaattttcagaaaagttctgaaattcttgtatatactgatgrtaaatgagacttttccttacatctatgcacttctttgtttgtttgttttgagatggtcttgctctgttgcccagactggagtgcagtagtgcaatctccg

SEQ ID NO: 24228 - DNA, 201 bp, Homo sapiens
aacaggaagatagggagattaactgtgtaaatgttcaataggccagagtccctgcagagggtggccacagtgatcagatcttatcacatccttgctttggrtgttgcctctctggttggagtatggatagaaaagaaagaaagaccctatattgaaatgcaaagtgcagcaagtcctgactttggattaacttctcagccc

SEQ ID NO: 24229 - DNA, 201 bp, Homo sapiens
aatatcagaaagtaagtgctgttgacctcctgctctttctttaacctagtgctgctgcctctgctaactgttgggggcaagcgatgtctcctgcctttctraaagactgtgaaaccactccaggggcagagaaatcacatgcagtgtccctttccaaatcctcccatgccatttatgtccaatgctgttgacctattggga

SEQ ID NO: 24230 - DNA, 201 bp, Homo sapiens
atggaacgatctccgctcactgcaacctccgcctcccgggttcaagcgattctcctgcctcagcctcctgagtagctgggattacaggcgcgtcaccacayccagctaatttttgtatttttagtagagacggggtttcaacttgttggccaggctggtctcgaaccctcgacctcaggtgatccaccggcctcggcctcc

SEQ ID NO: 24231 - DNA, 201 bp, Homo sapiens
ccatagcaacagaagtctggctcatcaacaagtccatggagctgctggatgagaggaagttctgggctggtattgtgttcactggaattactccaggcagyattgagctgccccatcatgtcaagtacaagatccgaatggacattgacaatgtggagaggacaaataaaatcaaggatgggtaagtggaatcccatcaca

SEQ ID NO: 24232 - DNA, 201 bp, Homo sapiens
agggtggccacagtgatcagatcttatcacatccttgctttgggtgttgcctctctggttggagtatggatagaaaagaaagaaagaccctatattgaaaygcaaagtgcagcaagtcctgactttggattaacttctcagcccatttgcatgaaaataaaaagatgaataaaacaaggttcccactttggagggaggtgg

SEQ ID NO: 24233 - DNA, 201 bp, Homo sapiens
agaaagaaagaccctatattgaaatgcaaagtgcagcaagtcctgactttggattaacttctcagcccatttgcatgaaaataaaaagatgaataaaacarggttcccactttggagggaggtggtagctgtgagatggaaggagtgttcctgctgggcaacagcagagtaagtgctggggtagattcactcccacagtgc

SEQ ID NO: 24234 - DNA, 201 bp, Homo sapiens
tcagcccatttgcatgaaaataaaaagatgaataaaacaaggttcccactttggagggaggtggtagctgtgagatggaaggagtgttcctgctgggcaayagcagagtaagtgctggggtagattcactcccacagtgcctggaaaatcctcataggctcatttgttgagtctttgtcctacaccaggcactctgcaaaa

SEQ ID NO: 24235 - DNA, 201 bp, Homo sapiens
tgaataaaacaaggttcccactttggagggaggtggtagctgtgagatggaaggagtgttcctgctgggcaacagcagagtaagtgctggggtagattcaytcccacagtgcctggaaaatcctcataggctcatttgttgagtctttgtcctacaccaggcactctgcaaaaacgctttgcctgcaaggtctcatgcgat

SEQ ID NO: 24236 - DNA, 201 bp, Homo sapiens
cccaagtcccctctatgtctgagagctgaggctggctgtcaaagaggaactaaggatgccagggactttctgcttaggacccctctcatcacttctccaaygctggtatcatgaaccccattctacagatgatgtccactagattaagaatggcatgtgaggccaagtttccacctgagagtcagttttattcagaagaga

SEQ ID NO: 24237 - DNA, 201 bp, Homo sapiens
ctagagggtaggggctggcacaaagatgcatgctggaagggtccttgcccataagaagctgacagccaaggctaggggagttctgtcttctctgcatcagrtcacctctctcacctctgtcactgccccatcagactacaatgtctgcaggtctttctcccctgagtgtgagctccctgagcaaagcaggatgctgcccct

SEQ ID NO: 24238 - DNA, 201 bp, Homo sapiens
  misc_feature (1)...(201): n = A,T,C or G, or insertion/deletion polymorphism (see Tables 1-2)
atgctggaagggtccttgcccataagaagctgacagccaaggctaggggagttctgtcttctctgcatcaggtcacctctctcacctctgtcactgccccntcagactacaatgtctgcaggtctttctcccctgagtgtgagctccctgagcaaagcaggatgctgccccttccctttgtattcctggctcctggcttca

SEQ ID NO: 24239 - DNA, 201 bp, Homo sapiens
ccatgggagtgggttagggccagcctgtggaggacctgggagccaggctgagttctatgcacttggcagtcacttctgtaaagcagcagaggcagttggcmtagctaaagcctttcgccttttcttgcaccctttacagtgtggctcgcctgttctcagatgctcggaggcttcttttatacagccagaaagacaccagca

SEQ ID NO: 24240 - DNA, 201 bp, Homo sapiens
tggttttatatgcttacatttatgtgttagttattaaaacatactaatattgtatatctagtcaaaactgaggtagagagaataaatggttgattttgagwttgagtttcatagtccaaaaagctgatatattgcctgtgttcaagagggtctatatcagccctctagatgccagcatctccaaattttacttttttggaa

SEQ ID NO: 24241 - DNA, 201 bp, Homo sapiens
cacagcgctcagccataactttaatttgaaaatgattgtctagcttgatagctctcaccactgaggaaatgttctctggcaaaaacggcttctctcccagrtaactctgagaaagtgttattaagaaatgtggcttctactttctctgtcttacggggctaacatgccactcagtaatataataatcgtggcagtggtgac

SEQ ID NO: 24242 - DNA, 201 bp, Homo sapiens
tgttcaagatccccagcacagcctatgtggtgctcaccagcgtgaacctcttcattggcattaatggcagcgtggccacctttgtgctggagctgttcacygacaatgtgagtcatgcagagagaacactcctgctgggatgagcatctctgggagccagaggacagtgtttaattgtgatcttattccacttgtcagtgg

SEQ ID NO: 24243 - DNA, 201 bp, Homo sapiens
gaaaattagctcagcgtggtggcatgctcctgtagtcccagctactcgtgaggctgagacaggagaatcgtttgaacctgggaggcggaggttgcagtgarccaatatcacgccattgcactccagcctggctgacagagtgagactccatctcaaaaaaaaaaaaaaaaaaagaattttataaaatcaggaaataatatt

SEQ ID NO: 24244 - DNA, 201 bp, Homo sapiens
ggcttacacctgttatcccagcattttgggatgccgaggcgggcaaagcacaaggtcaggagtttgagaccagcctggccaacatagtgaaaccctgtctytgctaaaaacatagaaaaattagccgggcatggtggcgtgcgcctgtaatcccagctactcgggaggctgaggtgagagaattgcttgaacccgggaggc

SEQ ID NO: 24245 - DNA, 201 bp, Homo sapiens
gatatggataagtgaaagttaagcacttctttctaaaaagagaatgcaattcattttcccctaatcatttcaattagtctgatgggcatttgaacttgttrtctttaaaaagtgaaatctttacctctgatctggtaagtatccaggcaatttcttgtgtgccacccaggaggtatctggggagtgggcattttctgactg

SEQ ID NO: 24246 - DNA, 201 bp, Homo sapiens
tgatctgcccacctcggcctcccaaagtgttgggattaaaggcatgagtcaccgtgcctggtcccatgttataattttaaagtaaggtatatttctctacrgggatctttgcaaccctaagtaactggcctaaaaagttagagaagctgacttgtgcagacatttgcagcctgttggtcttttttgtgctgtgaatcatag

SEQ ID NO: 24247 - DNA, 201 bp, Homo sapiens
acttgttgtctttaaaaagtgaaatctttacctctgatctggtaagtatccaggcaatttcttgtgtgccacccaggaggtatctggggagtgggcatttkctgactgaggcattggctgccatagcatcagagcagccttccaggcagtggcctggcaaggggacagaggctggtgggagcagctggctgagtgcagcca

SEQ ID NO: 24248 - DNA, 201 bp, Homo sapiens
  misc_feature (1)...(201): n = A,T,C or G, or insertion/deletion polymorphism (see Tables 1-2)
tgaacagtcacaactgaggcaggtttctgttgtttacaggacagttctgcagatcgatttctcaacagcttgggaagatttatgacaggactggacaccanaaataatgtcaaggtaaaccgctgtctttgttctagtagctttttgatgaacaataatccttatgtttcctggagtactttcaactcatggtaaagttgg

SEQ ID NO: 24249 - DNA, 201 bp, Homo sapiens
ctcccaaagtgctgggattataggcttgagccaccacgcctggccgatggtgctttttatcatttgaaggactcagttgtataacccactgaaaattagtmtgtaaggaagttcagggaatagtataagtcactccaggcttgaggcaaaatttacaaatgctgctgactttgtatgtaaggggaggcattttcttagaaa

SEQ ID NO: 24250 - DNA, 201 bp, Homo sapiens
gaggcagtacggtgtagtgtagtgattcagagaatttgctttgccaccagacataccaggtaaccttgactaagttacttaacctatctaaacctcagttycctcatctgtgaaatggagacagtaatcatagctatttccaaactgttgtgagaattcaatgagttaaaggtataaggtcctcaccacagcgcctgccca

SEQ ID NO: 24251 - DNA, 201 bp, Homo sapiens
tgatctctgttcggctgagctacccaccctatgaacaacatgaatgtaagtaactgtggatgttgcctgagactcaccaatggcagggaaaatccaggcarttaacgtgggctaaattggacttttccaaagatgctgtctttgggaaacatcacacatgctttggatcagaaaacctaggcttctaatttgttgataagg

SEQ ID NO: 24252 - DNA, 201 bp, Homo sapiens
cacatgtgattcttcacttgactggcttcatagaaccccaaagccaccccaccaccacataaattgtgtctctaggttctgtgttgctcacactcaaaatktctgggccttctcatttggtgcatgtgaatggtgcatatgagtgaagtctaggatggggccttagcattaaagccctggggtagtgtgactgagattgtt

SEQ ID NO: 24253 - DNA, 201 bp, Homo sapiens
ttctctcttttctctgtgctctcagagtccttagtccatgcctccagtacaacgtacatccacttacatggtaatttcctgtttacatacttttcctactyggagtggagtctgtttcttaataattttgcctctcccatgccctagcacagtgcatccagcgtatagccccttattcagttggtagatatttggccactg

SEQ ID NO: 24254 - DNA, 201 bp, Homo sapiens
gcttgctcctagtaccaagctcctgacgcatatagcagtggcagtaataaccagcccatagtaaggtttgtcacagggactggttgtaagaactgatttgrttggtatagctgtgagggcctggcacggtgtccacgtgtgcctcaatcctaattctgaaaaaggctgaccctgggggtgctaattagatacacagagagg

SEQ ID NO: 24255 - DNA, 201 bp, Homo sapiens
ggagtgcagtggcgcagtcttggctcactgcagcctctgcctcctgggttcaagcgattctcctgcctcagcctcctgagtagctgggactataggcatgstccaccatgcccaactaatttttgtatttttagtagagatgagatttcaccatgttggccaggatggtctcgatctcctaacctcgtgatctgcccgcct

SEQ ID NO: 24256 - DNA, 201 bp, Homo sapiens
agaatttaaaattagtttttattgttaatgagtgtattatgaatatttcccagtgggttacatttcctaagatgtggaattttacattgctacataaaatycccctatgtacatgtacctataatttatttaataaattccttataaatgttggacacattagtttccatttttcactatgtaaatatgtccctgtataca

SEQ ID NO: 24257 - DNA, 201 bp, Homo sapiens
ttattacaaatttctactctgtggaatttaatttttaaaatacctgcaatacatatatatgttgaatagatgaaaaattatgtagatgataatgaatgatrcggttctaaaaagacaggttaaaaagtaagttcacttttattttgagcttcagaatcattcagaagccagtcgccacaaacgcagaccaaggctcttggc

SEQ ID NO: 24258 - DNA, 201 bp, Homo sapiens
taacctcgtgatctgcccgcctaggccttccaaagtgctgggattacaggcatgagccaccatgcctggccttctttgagaagctggagacatgagttaaktggtgaagaagccaaatctgtatctaaaaaccctacagtagtgtgcagagctctgaggagagaaggtcccttagattttgagtgtattattatgtcagtg

SEQ ID NO: 24259 - DNA, 201 bp, Homo sapiens
ggaattttacattgctacataaaatccccctatgtacatgtacctataatttatttaataaattccttataaatgttggacacattagtttccatttttcrctatgtaaatatgtccctgtatacatcttttattatttcctcaggaacaattcctacaaagtaaattgccctctctaaagagcatacaaattgactgagc

SEQ ID NO: 24260 - DNA, 201 bp, Homo sapiens
tctaccactcactaagtagcccattctgggtgttgacagctctaattgttagaaaatattcaccaccctgttatgctttctagagaacaagtctaattctrttttccttgaaatagtcgaagacagctctcatgtttttctttccctgttttcccaaagtccatgattttttaggcaaaatggcctcctttcctcttatgg

SEQ ID NO: 24261 - DNA, 201 bp, Homo sapiens
acttggatgggggatcacctgggactacccaaggatgtgggctgtctgctagactatagccccttgagggcaaggtgggcgccttgctcatggttccatcmtaagccccagcacagtagtgggtgcatggtgagccattagtgaatctttgtggaatgaaggtgggagaaaataaaatacctgtacttcacagggtattgt

SEQ ID NO: 24262 - DNA, 201 bp, Homo sapiens
ggctggtggaagacatagggcatgagctgacctatgtgctgccatatgaagctgctaaggagggagcctttgtggaactctttcatgagattgatgaccgrctctcagacctgggcatttctagttatggcatctcagagacgaccctggaagaagtaagttaagtggctgactgtcggaatatatagcaaggccaaatgt

SEQ ID NO: 24263 - DNA, 201 bp, Homo sapiens
ttgagaggagtcccagagaaagaagttggcaaggtactgtgggcacctgaaagccagcctgtctcctttggcatcctgacaatatataccttatggctttyccacacgcattgacttcaggctgtttttcctcatgaatgcagcagcacaaaatgctggttctttgtatctgctttcagggtggaaacctgtaacggtggt

SEQ ID NO: 24264 - DNA, 201 bp, Homo sapiens
atttgcaatatttttattacaaatttctactctgtggaatttaatttttaaaatacctgcaatacatatatatgttgaatagatgaaaaattatgtagatrataatgaatgatacggttctaaaaagacaggttaaaaagtaagttcacttttattttgagcttcagaatcattcagaagccagtcgccacaaacgcagac

SEQ ID NO: 24265 - DNA, 201 bp, Homo sapiens
attttcttccctcttccctttaatcaagaccgtatgtgccaaagtaaatggatgactgagcagttggtgatgtaggggtggggggcgatatagaaagtcartttttggccgggcgtggtggctcatgcctgtaatcccagcactttgggaggctgaggagcaggcagatcatgaggtcaggagatccagataatcctggcc

SEQ ID NO: 24266 - DNA, 201 bp, Homo sapiens
atacacacatgaaggagccgaagttcagagaggccaagtaacttgcctaagaaagcacagctggcaaggggcagtaataggaccagaattccagtttctcrtgctctgttgttgttatatcctaaagagagcagctctgagtagccagaagcttccctaaagtcacaggacatggggcatgggctggctgggatgagaaag

SEQ ID NO: 24267 - DNA, 201 bp, Homo sapiens
ggtgaaaccccgtctctactaaaaatacaaaaattagctgggcatggtggtgcgcacttgtagtcccagctacttgcgaggctgaggcaggagaattgctygaacccaggaggtggaggttacagtgagccaaggtctcgccactgcactccagcctggggacagagcaagaccccatttcaaggggggaaaaaaagtcta

SEQ ID NO: 24268 - DNA, 201 bp, Homo sapiens
agtgagccaaggtctcgccactgcactccagcctggggacagagcaagaccccatttcaaggggggaaaaaaagtctatttttaagttgttattgcttttytcaagtattcttccctccttcacacacagttttctagttaatccatttatgtaattctgtatgctcctacttgacctaatttcaacatctggaaaaatag

SEQ ID NO: 24269 - DNA, 201 bp, Homo sapiens
taatgtctcgttccacccctgattccagtgctgactgattctggagtggcagagagggttggaggctcaccgctctgctcacccgaccctctggccatctyctcttagaatgcaagggcagggattttgttacacagcgcctcttttgttataggctagctcctgccttcaaggagcactgagaaaaatattatccctttg

SEQ ID NO: 24270 - DNA, 201 bp, Homo sapiens; identical to SEQ ID NO: 3390

SEQ ID NO: 24271 - DNA, 201 bp, Homo sapiens
agctaatttttgtatttttagtagagatggggtttcactatacgttggccaggctggtctcaaactcctgacctaaggtgatccttctgccttgggctccmaaagtgctgggattacaggcatgagccaccttgcctggccctacccatgagccttgactaaaacattcttctatctgtagaaaagcccaaaagaactttt

SEQ ID NO: 24272 - DNA, 201 bp, Homo sapiens
gctttggaattaaaaaccctggccctcaaggaatttctattcttctgggagcaggatatttacatgggtgactgcagcttgatctgtgtggtactagtggraaacataggatgttgggcacaaaagagtcacaaaacgccgggcgcggtggctcatgcctctaatcctagcactttgggaggccaaggcgagtggatcacc

SEQ ID NO: 24273 - DNA, 201 bp, Homo sapiens
attcttctatctgtagaaaagcccaaaagaacttttccagattcaaaaaacttggcactttgtaatggtaatgtttacattaagtaaaaaaaaaaaaaaamcccacttagcttcagttttcaagtgtttactgtgttgtcatgcacttcatttaattctcaacacctgccctatgaggtaaaaagtaccattttacatatg

SEQ ID NO: 24274 - DNA, 201 bp, Homo sapiens
agaggaggcgcacagggaaacactcaccaatgggggttgcattgaactgaactcaaaatatgtgataaaactgattttcctgatgtgggcatcccgcagcyccctccctgcccatcctggagactgtggcaagtaggttttataatactacgttagagactgaatctttgtcctgaaaaatagtttgaaaggttcattttt

SEQ ID NO: 24275 - DNA, 201 bp, Homo sapiens
gggagcaggatatttacatgggtgactgcagcttgatctgtgtggtactagtggaaaacataggatgttgggcacaaaagagtcacaaaacgccgggcgcrgtggctcatgcctctaatcctagcactttgggaggccaaggcgagtggatcacctgaggtcaggagttcaagaccagcctggccaacatgatgaaacccc

SEQ ID NO: 24276 - DNA, 201 bp, Homo sapiens
agctgagatcgcaccattgcactccagcctgggcaacaagagcgaaactccatctaaaaaaaaaagtgtgcaagttattggtacgtatatatttaagcctygggactgaatgagattacctagagagaatgaagatagggaacattcttgagcctgagatcctataacatttagaagagaagctagccagggaaattgaga

SEQ ID NO: 24277 - DNA, 201 bp, Homo sapiens
caaaatttagccctcctttgaacaggaatttgactcagtgaaccttgtacacactcgcactgagtctgctgctgatgatactgtgcaccccactgtctggsttttaatgtcaggctgttcttttaggtatggcggcttttccctgggtgtcagtaatactcaagcacttcctccgagtcaagaagttaatgatgccatcaa

SEQ ID NO: 24278 - DNA, 201 bp, Homo sapiens
cagataaacctcatcttgggccagtgcttccatttactgtctccttttggcttgcttatccttccttctgccttcttgaattgatttgcctctttatctcycctttcagccttgaaagttcctcgaaggcagggactgtgtccccatcttttctataaatggcattgttgtacattggtaaagttgagtgaaaaaatcttt

SEQ ID NO: 24279 - DNA, 201 bp, Homo sapiens
gggtgtggaaccaaatcagattggttgcatatctgtttctcttcctgaaaatacaattcaaataccttcatagtctgtgacagcaacttataaccaacagrcaatggtattatttttatttattgatggcactcccccatagccagaacttctactgagtcattcatcgtgtattccaggaatactttccaaatggagtag

SEQ ID NO: 24280 - DNA, 201 bp, Homo sapiens
ttcccccagctgggcagagtggaggcagaggaggagaggtgcagaggctggtggcgctgactcaaggtttgctgctgggctggggctgggtggctgcgggkgtgggagcagcttggtggcgggttggcctaatgcttgctggggtgcctggggctcggtttgggagctagcagggcagtgtcccagagagctgagatgatt

SEQ ID NO: 24281 - DNA, 201 bp, Homo sapiens
tcagccctaatcccatctcctagtgtttagtattcagctacccttcactgggcagtaattctgtgccaggcctgatctgggcattggtggtactaagaacrcatattccctatcctataggcatagtctggtagagacaacatgcaagtaaaacaatgttccttaaactgtggttccacacctccctcccccaacattaaa

SEQ ID NO: 24282 - DNA, 201 bp, Homo sapiens
gtgtgtgtgtgtaacagcaccatcacactgtttgagttgaggagcacatgctgagtgtggctcaacatgttaccagaaagcaatattttcatgcctctccygatatggcgatgctcccctatctcattcctgtgtgtgtttagccaggcaactgttgatcatcaatattatgataacgtttctccactgtcccattgtgcc

SEQ ID NO: 24283 - DNA, 201 bp, Homo sapiens
ggggcaatgatggaaaataagataaatgtgtgcaagttggctgggcgtggtggtgcacgcctataatcacagcactttgggaggccgagacgggtggatcmcttgaggtcaggcgtttgcgaccagcctaacatggtgaaaccccatctctaataaatacaaaaaaattagctgggcatggtggtgcatgcctgtaatcca

SEQ ID NO: 24284 - DNA, 201 bp, Homo sapiens
aatatctgagaattgcaaaactagacaaaagtttcacaacagatttctaagttaaatcattttcattaaaaggaaaaaagaaaaaaaattttgtatgtcartaactttatatgaagtattaaaatgcatatttctatgttgtaatataatgagtcacaaaataaagctgtgacagttctgttggtctacagaaatttactt

SEQ ID NO: 24285 - DNA, 201 bp, Homo sapiens; identical to SEQ ID NO: 3398

SEQ ID NO: 24286 - DNA, 201 bp, Homo sapiens
tctcagctatctaactgtgtgtgtaatcaggccaggtcctccctgctgggcagaaaccatgggagttaagagattgccaacatttattagaggaagctgaygtgtaacttctctgaggcaaaatttagccctcctttgaacaggaatttgactcagtgaaccttgtacacactcgcactgagtctgctgctgatgatactg

SEQ ID NO: 24287 - DNA, 201 bp, Homo sapiens; identical to SEQ ID NO: 3399

SEQ ID NO: 24288 - DNA, 201 bp, Homo sapiens; identical to SEQ ID NO: 3400

SEQ ID NO: 24289 - DNA, 201 bp, Homo sapiens
ccctttaatcaagaccgtatgtgccaaagtaaatggatgactgagcagttggtgatgtaggggtggggggcgatatagaaagtcagtttttggccgggcgyggtggctcatgcctgtaatcccagcactttgggaggctgaggagcaggcagatcatgaggtcaggagatccagataatcctggccaacagggtgaaaccc

SEQ ID NO: 24290 - DNA, 201 bp, Homo sapiens
agcatctagagttaagggtaggtcaaccctgacttctgtacttctaaatttttgtcctcaggtcaatcctgaccgggttgttccccccgacctcgggcacygcctacatcctgggaaaagacattcgctctgagatgagcaccatccggcagaacctgggggtctgtccccagcataacgtgctgtttgacatgtgagtac

SEQ ID NO: 24291 - DNA, 201 bp, Homo sapiens
ctataatatagcattaatgatgaaacagacacagtcatcttcgggaagaagaatagaggcttatttgctgcctgtgaaattaaaattactctgactgggartccatcgttcagtaagtttactgagtgtgacaccttggcttgactgttggaaagacagaaagggcatgtagtttataaaatcagccaaggggaaaatgct

SEQ ID NO: 24292 - DNA, 201 bp, Homo sapiens
cacatcgagcataagatccagactctttcccaggcctctctcatctggctcctctcctcctcctttatcattactcttcttcgtagcttatcctactccarccatgctgtcttcctattattcctaaaaagtagaaatgcatttcttcctagggcctttgtacctgcacttgccatcgcttttgctcagaatgttcttttt

SEQ ID NO: 24293 - DNA, 201 bp, Homo sapiens
gtgcaaagcacgtcattacagacatttgtttactgatttagaaccttaatatttaatttaaatagcactttacacttactgatgaaatgcttttcctttcyttctctcccagcccctgtacttaagtgcttcaataggctctcattatatatgatttttaggttttgtttatcagcttcttcgcttttataatctgaaaag

SEQ ID NO: 24294 - DNA, 201 bp, Homo sapiens
tcttaatcttttaacaggtatttgtgaactttgccaaggaccaaagtgatgatgaccacttaaaagacctctcattacacaaaaaccagacagtagtggamgttgcagttctcacatcttttctacaggatgagaaagtgaaagaaagctatgtatgaagaatcctgttcatacggggtggctgaaagtaaagaggaacta

SEQ ID NO: 24295 - DNA, 201 bp, Homo sapiens
ggtgtggacatctttgcaggggatattcagtctgctgtagctttcttgattggaaggaatagtttatcatatatttgaagtgttccctcagtgcctttggyttttgttgacccctctgcagctctctgctttttcttgcccatatttggaaagtgactctaaagcataataagcatcacctattagggtttttaatgtaca

SEQ ID NO: 24296 - DNA, 201 bp, Homo sapiens
atctctgaactaggtatgagacattcatcgaaaaaaatccatcaagtgtttattgtatgtctgctttataccagcactgttctaggcactgaagttcgacyaccaacaaggcagttgtgatgcacttggagctttcattctgatgggcattgagatccaggctgaaggctgagtctgggaatttgaggaattctttgtagg

SEQ ID NO: 24297 - DNA, 201 bp, Homo sapiens
cagggagtaagtataaatagaaaagagaagtggtccaaggactcagtccttacatcagaggtcaaagagacaagatggagactaggagatatgaaggcttrtgcagtgagtgtttcggagaaacgaagaaactttccagaagaaaggagaggtcaactgctaacaagtcaagtgaaatgagaactgggaaatgagttgaca

SEQ ID NO: 24298 - DNA, 201 bp, Homo sapiens
gcatctaaaaaataggtaataaagataatttctttgggatagtgcctagtgagaaggcttgatatttattcttttgtgagtatataaatggtgcctctaamataaagggaaataaaactgagcaaaacagtatagtggaaagaatgagggctttgaagtccgaactgcattcaaattctgtctttaccatttactggttct

SEQ ID NO: 24299 - DNA, 201 bp, Homo sapiens
ccaaggactcagtccttacatcagaggtcaaagagacaagatggagactaggagatatgaaggcttgtgcagtgagtgtttcggagaaacgaagaaacttyccagaagaaaggagaggtcaactgctaacaagtcaagtgaaatgagaactgggaaatgagttgacaagagcaatttggctggcgtgatcagagaatgttt

SEQ ID NO: 24300 - DNA, 201 bp, Homo sapiens
ttttttgagttacttactaaataaaaataaaacactatttctcaatagacttgaagcttcaagatttcctggtggacaatgaaaccttctctgggttcctrtatcacaacctctctctcccaaagtctactgtggacaagatgctgagggctgatgtcattctccacaaggtaagctgatgcctccagcttcctcagtagg

SEQ ID NO: 24301 - DNA, 201 bp, Homo sapiens
  misc_feature (1)...(201): n = A,T,C or G, or insertion/deletion polymorphism (see Tables 1-2)
ggctaccagttacatttgacaagtctgtgcaatggatcaaaatcagaagagatgattcaacttggtgaccaagaagtttctgagctttgtggcctaccaanggagaaactggctgcagcagagcgagtacttcgttccaacatggacatcctgaagccaatcctggtgagtagacttgctcactggagaaacttcaagcac

SEQ ID NO: 24302 - DNA, 201 bp, Homo sapiens
aaaagccccagtgggaaaaagcttggcaagctgaggtggtaaaagagctatctgtactaatgtctcttgtactgagttagcaaggacaagagtggcagggrgtggaactggagagatagcagggaccacatctcacaggatctcgccagcctttttaaggtatttggattttattgttagtgcaacaaggagccactggag

SEQ ID NO: 24303 - DNA, 201 bp, Homo sapiens
tgcattccagccagcgtgacagagtgagactctgtctcagaaaaagaaaaaaaagatagaagttttcttctgtagatcagtgttagaactcataccaagcraagtggtcctggtgagtatttcagtgaaaaactgcattcttgctcagatattgtcaagacttttcacccaaagattcttatttatgtctcagtccgtacc

SEQ ID NO: 24304 - DNA, 201 bp, Homo sapiens
aagcgaagtggtcctggtgagtatttcagtgaaaaactgcattcttgctcagatattgtcaagacttttcacccaaagattcttatttatgtctcagtccrtaccttgtgtgaaaattaatactggatgtcagaacgctgttgtgtttttaaagttccctggggttaagagcagtttccattaggtgttctctgcttttta

SEQ ID NO: 24305 - DNA, 201 bp, Homo sapiens
atgttcattgtggaaaatgctgaagacttggaaaatacaaaaatgctgagatcaaacactattgatacgttagtgtatttcttcctgtcctgttctacttwctttctttgaattctgctcacgtgtttctgactgatgaggtctgacttttgggttccttttccagaggagaagccttctttcagcttgccatttgttacc

SEQ ID NO: 24306 - DNA, 201 bp, Homo sapiens
tggttgttgggttgagaagagactgggatgggggaaagggaggacaaaggacattgtgctggattgagaaagcagtaagtcagtttcattcattcactcarccgatgatgttcaaataccaccatcatccgtgggctaaaggatgaagagccatccctccctgagagtcaggaagcacttcccagataaagtttggagtgt

SEQ ID NO: 24307 - DNA, 201 bp, Homo sapiens
gtactttgagttgtatattaatttatttttgttaataagagtgagatgactcactaagtaatttagagatttaaacacttttttaaaaaacagtaacttcrtatgcattggatctattcttctataaagtcttttcttggggggtgtttgtttaaaattccccggtgttttctctgccaaatccaacttccaagaagcatt

SEQ ID NO: 24308 - DNA, 201 bp, Homo sapiens
tgatgcaggggaacctttctccatttccaaccacaggtgtgtctttcagacactgagtgaggcaggttttgtactttattgtaacacaagaaccttttctyctctggagtaaagcactccagacattcgcaagttgctttacaagccttaaaaggatggtattgtaggcaactttaattaaatcccatctcctcctctccc

SEQ ID NO: 24309 - DNA, 201 bp, Homo sapiens
ttccctttaatcaagaccgtatgtgccaaagtaaatggatgactgagcagttggtgatgtaggggtggggggcgatatagaaagtcagtttttggccgggygtggtggctcatgcctgtaatcccagcactttgggaggctgaggagcaggcagatcatgaggtcaggagatccagataatcctggccaacagggtgaaac

SEQ ID NO: 24310 - DNA, 201 bp, Homo sapiens
ccttgcctgagatggttggcaaaggcctcattgcagcattcattggcaggccacagttcttttggcagctctgcttcctgacctttcaccctcaggaagcraggctgttcacacggcacacacatgccagacagggtcctctgaagccacggctgccagtgcatgtgtcccagggaaagctttttcctttagttctcacac

SEQ ID NO: 24311 - DNA, 201 bp, Homo sapiens
tcaagcgattctcctgcctcagcctcatgcgtcaccacgcccagctaattttgtatttttagtagagacagggtttctccatgttggtcaggctggtctcsaactcccaacctcaggtggttcgcccgccttggcctcccaaagtgctgggattgcaggcatgagccactgcgcccagccccaaattttggtttttgcttg

SEQ ID NO: 24312 - DNA, 201 bp, Homo sapiens
tagctggatagtattccattaggatatactcttatttaactattcccccttttgtagacatttggattatttccaacttgttcacaattgtaaacaccacyacactgaacagcatcatccctatatccacatgtacttgtaacagaatacaattccctaggaagctggaatgctggaagtcatggtgatgttctcatggtt

SEQ ID NO: 24313 - DNA, 201 bp, Homo sapiens
gccatgggatactcttctgttatcacagaagagataaagggcattgagactgagattcctgagaggagatgctgtgtctttattcatctttttgtccccarcatggtgcactaaatttatggttagttgaaagggtggatgcttaaatgaatggaagcggagaggggcaggaagacgattgggctctctggttagagatct

SEQ ID NO: 24314 - DNA, 201 bp, Homo sapiens
tctgaattcagccttctggttgcccctcaagagtcagtttaaatgttggtcatgttagttgtcagtgaaaacaatggtgaggctggcatgagagtgtgaayctggatgggagggcttgtgcttcacgaaaacatttttccagatcagctcagtcgtgagttatccgtcattgacgttataataagctctgattatttatca

SEQ ID NO: 24315 - DNA, 201 bp, Homo sapiens
taaagaatgtgcagtggttggcatgacctcagaaattctgaaatgggactgcacctgcagactgaagtgttcagagagccagggaggtgcaaggactgggragggtagaggcaggaaccctgcctgccaggaagagctagcatcctgggggcagaaaggctgtgctttcaagtagcagcagatgtattggtatctttgtaa

SEQ ID NO: 24316 - DNA, 201 bp, Homo sapiens
taattgcagtaccctattttcctttttggctgcagcctctcagccagccacagcatctccctgtgtcttggtaggttttggaaagaagtgtgggagcaaamgcatgatgttacatgtagactggcctgagatactcattctcagggcactgtgtgaatgatgagctgctgttactgtgtggaggggaaatgcacttagtgc

SEQ ID NO: 24317 - DNA, 201 bp, Homo sapiens
aaaattatgtagatgataatgaatgatacggttctaaaaagacaggttaaaaagtaagttcacttttattttgagcttcagaatcattcagaagccagtcrccacaaacgcagaccaaggctcttggcacatcaaatatgcctatggcttagggttattgacaagtcttatgttgcagtgtatgtggtttatagtcctgcc

SEQ ID NO: 24318 - DNA, 201 bp, Homo sapiens
ggaaaacaggtaagaggctctccagtgacttacttgggcgttattgttttgtttcgaggccaaggaggcttcgggaagtgctcggtttcggggactttgayccggagccccacatccccaccacttgcaactcagatgggaccggaggcggtgttaaatggggagacgatgtcctagtacgagctctggtgaccccaggac

SEQ ID NO: 24319 - DNA, 201 bp, Homo sapiens
cttgccctttcttggaaaatcctgcttgtctgtgccaaagggataattgtgaaagcacttttgaaatacttaatgagttgattttcttcaaattaaaaaawatatataaatgtatatgtgtatgtacatgtgtgtacacatacacacctttatacatacagcccatttaaaacaagctccactttggagtgctctacgtca

SEQ ID NO: 24320 - DNA, 201 bp, Homo sapiens
ttcttcatcaggcccaggtgagctttttcttagaacccgtggagcacctggttgagggtcacagaggaggcgcacagggaaacactcaccaatgggggttrcattgaactgaactcaaaatatgtgataaaactgattttcctgatgtgggcatcccgcagccccctccctgcccatcctggagactgtggcaagtaggtt

SEQ ID NO: 24321 - DNA, 201 bp, Homo sapiens
ctcaggctgggaatctccaaggcagtaggtcgcctatcaaaaatcaaagtccaggtttgtggggggaaaacaaaagcagcccattacccagaggactgtcygccttcccctcaccccagcctaggcctttgaaaggaaacaaaagacaagacaaaatgattggcgtcctgagggagattcagcctagagctctctctcccc

SEQ ID NO: 24322 - DNA, 201 bp, Homo sapiens
aagatgtttacgagggccaagggaatggacttcagaattacacggtggaatgaattttactgctgcggctcaggtccctgtataagctaatactgcatgcrtagaacagcagcgaactaaccctgaataataggccagtcttctgttgagcctttcagcctctctcctcttcatcctactgttgtcaggaacagccacatg

SEQ ID NO: 24323 - DNA, 201 bp, Homo sapiens
atacacattggctctgaaattctgattgatactgggtcataaaaagttttcccaaatcagacttggaaagtgatcactctcttgttactcttttttccttstcatgggtgatagccatttgtgtttattggaagatcggtgaattttaaggaacataggcccaaatttgaggaagggccatggtttttgatccctccattc

SEQ ID NO: 24324 - DNA, 201 bp, Homo sapiens; identical to SEQ ID NO: 3412

SEQ ID NO: 24325 - DNA, 201 bp, Homo sapiens
taactctgccattatttttctgcgtagttttgggtaagtcacttatcttctttaggatggtaatgatcagttgcctcatcagaaagatgaacagcattacrcctctgcattgtctctaacatgagtaggaataaaccctgtcttttttctgtagatcatacaagtgagtgcttgggattgttgaggcagcacatttgatgt

SEQ ID NO: 24326 - DNA, 201 bp, Homo sapiens; identical to SEQ ID NO: 3413

SEQ ID NO: 24327 - DNA, 201 bp, Homo sapiens
ttggagttgttcttcatcgagctgaaacatccagccctttgtgctcccccaaggcctccctcctgacaccacctacctcagccctctcaatcaatcactgsatgtgggctgccctgggaaggtcgtgccccagggcctacatggctctctgctgctgtgacaaacccagagttgctgatgcctgaggccgtctactgacag

SEQ ID NO: 24328 - DNA, 201 bp, Homo sapiens
cttgtgagcgctggcctgctagtggtcatcctgaaggtaaggcagcctcactcgctcttccctgccaggaaactccgaaatagctcaacacgggctaaggraggagaagaagaaaaaaaatccaagcctctggtagagaaggggtcatacctgtcatttcctgcaatttcatccatttatagttggggaaagtgaggccca

SEQ ID NO: 24329 - DNA, 201 bp, Homo sapiens; identical to SEQ ID NO: 3414

SEQ ID NO: 24330 - DNA, 201 bp, Homo sapiens
cagtcacaactgaggcaggtttctgttgtttacaggacagttctgcagatcgatttctcaacagcttgggaagatttatgacaggactggacaccagaaayaatgtcaaggtaaaccgctgtctttgttctagtagctttttgatgaacaataatccttatgtttcctggagtactttcaactcatggtaaagttggcagg

SEQ ID NO: 24331 - DNA, 201 bp, Homo sapiens
aaagggcagttttgaaggtaaggaaaatagtgttatttgcttggatccactggctcatgccactgtctgggttggttagaagcactggaaaagtcaaaccrtaactttgagaattaggtgatcagggaatcagaaggaaagatgcaaactttggctcttttaggcgaatcatgtgcctgcagatgaggtcatttattatct

SEQ ID NO: 24332 - DNA, 201 bp, Homo sapiens
gagaatcaaattttttcttcactcccatatttcagaacttgatacatttttaggataaaccatgaatgacacccgtttcttctccctcaccctcccttccytcccattttttttttttttttttagaagctgaataatatcaatgatatcctgaagtccgtgttcttgatcttcccacatttttgcctgggacgagggctc

SEQ ID NO: 24333 - DNA, 201 bp, Homo sapiens
ataccttcctggtgatggtataaattgctattctctattggaaagcaatttggaatgaaaatttaaagaaccattttaaaatatgctatcctgcgtacctscattccacccacccccagggatgtagcctactgaaataattttaaagaagtcaccatatgagagaaaatgttattgctatattgttattgtgagaaattg

SEQ ID NO: 24334 - DNA, 201 bp, Homo sapiens
tagtaccaagctcctgacgcatatagcagtggcagtaataaccagcccatagtaaggtttgtcacagggactggttgtaagaactgatttggttggtatarctgtgagggcctggcacggtgtccacgtgtgcctcaatcctaattctgaaaaaggctgaccctgggggtgctaattagatacacagagaggaatgaatgc

SEQ ID NO: 24335 - DNA, 201 bp, Homo sapiens
gtatgagacattcatcgaaaaaaatccatcaagtgtttattgtatgtctgctttataccagcactgttctaggcactgaagttcgaccaccaacaaggcarttgtgatgcacttggagctttcattctgatgggcattgagatccaggctgaaggctgagtctgggaatttgaggaattctttgtaggtcctgggtctaca

SEQ ID NO: 24336 - DNA, 201 bp, Homo sapiens
tctgtgcttctcctcctttttctgcggtccctggctccccacctgactccaggtgaacaagaccttccaggaactggctgtgttccatgatctggaaggchtgtgggaggaactcagccccaagatctggaccttcatggagaacagccaagaaatggaccttgtccgggtgagtgtccctcccattattaccatgtgcct

SEQ ID NO: 24337 - DNA, 201 bp, Homo sapiens
gaccagacccaattaccaggtatgttttcctctgtaccgcagtacatgcctgagatttatttgtgtgttgaagccagtggtacctaatgtatttacatccsaacctgaaactcctatccacttatttaccttttaatgagcctcttaactcaagtgcagtctgaggaccagcagcatcaggatcacttgggaacttgttag

SEQ ID NO: 24338 - DNA, 201 bp, Homo sapiens
gaccaggaaaggagcagctgccgtatagagcaggagacgctctgctgggtgtgatacagtccctgatggggcctcctactgcagtctttccagtcaggaargaaacatcctctaagtggggacctaaagaatggatgtcagccaggtaaagaacagggagtagaatgttccaggtagaggacatagtatatgcattggtcc

SEQ ID NO: 24339 - DNA, 201 bp, Homo sapiens
ccttgaaagcatctggcttctgaggttcaactatgggaatatggtctcttaatgaacattaagttgagtttgccttttaggtccacatgttgacaaatgtrtcagagtaatctctgtcctaggatcagagggcctgtaggcacttgcaaaagcagttagctctgactcccagccagtgcacactccacctttctgactccc

SEQ ID NO: 24340 - DNA, 201 bp, Homo sapiens
gatctctttctgcttggcattcaaggctctttgaaataagactgtgacccactttgatagttttgtcctggattataagacacatgctcgaaggaactatmgctggttttctcaccagactgattaacatatagtatggtttggtacctgttaaatgagtctctctctacaggttttcatcttctactttaagaacccctt

SEQ ID NO: 24341 - DNA, 201 bp, Homo sapiens
ccctgaaacgggtgctgggaagagtcaatagtttggaataactcaataatttatggtgcttctttagaaagatttgctggctttatgtgggaagaaatttktttttttgattggggagtggtgggttggtggtgaggctgcctgtggaaagagaagtgagtgttttgactcactgttatttaaaaatctctagggctgttc

SEQ ID NO: 24342 - DNA, 201 bp, Homo sapiens
cagctactggaaagaaatgaataaacccttgtccttgtaatggtggtgaaggggagggaggtagtttgaatacaacttcacttaattttacttccctattsaggcaggaattgccaaaccatccaggagtggaatatgcaacctggcgtcatgggccagctggttaaaataaaattgatttctggcttatcacttggcatt

SEQ ID NO: 24343 - DNA, 201 bp, Homo sapiens
gcagaggaaagtgctagcatacattaccctgtggctgcatgactttgtgaataggttagttagcaccctttcagccacttcttcttacctgttaatgagawaaaacatgtaattgcttaaaaacagtatttggcacataggaagcacttagtgaatatgaattatgattttttttggagtggtgacatctcaaccaagcca

SEQ ID NO: 24344 - DNA, 201 bp, Homo sapiens
cgtcttttctctctgccttttccccaagggccaggacccctggatctctgggcagagcagacgcaggcccctataatagccctcatgctagaaaggagccrgagcctgtgtataaggccagcgcagcctactctggacagtgcagggttcccactctcccaactccccatctgcttgcctccagacccacattcacacccg

SEQ ID NO: 24345 - DNA, 201 bp, Homo sapiens
ccggagcctgtgtataaggccagcgcagcctactctggacagtgcagggttcccactctcccaactccccatctgcttgcctccagacccacattcacachcgagccactgggttggaggagcatctgtgagatgaaacaccattctttcctcaatgtctcagctatctaactgtgtgtgtaatcaggccaggtcctccct

SEQ ID NO: 24346 - DNA, 201 bp, Homo sapiens
cggtttgggggcattaccttgtacctggtatgttttctttcaggtgtggttcaataacaagggctggcatgcaatcagctctttcctgaatgtcatcaacratgccattctccgggccaacctgcaaaagggagagaaccctagccattatggaattactgctttcaatcatcccctgaatctcaccaagcagcagctctc

SEQ ID NO: 24347 - DNA, 201 bp, Homo sapiens
gtctctaggttctgtgttgctcacactcaaaatttctgggccttctcatttggtgcatgtgaatggtgcatatgagtgaagtctaggatggggccttagcrttaaagccctggggtagtgtgactgagattgttggtaaagaatgtgcagtggttggcatgacctcagaaattctgaaatgggactgcacctgcagactga

SEQ ID NO: 24348 - DNA, 201 bp, Homo sapiens
ctcaagagtcagtttaaatgttggtcatgttagttgtcagtgaaaacaatggtgaggctggcatgagagtgtgaatctggatgggagggcttgtgcttcaygaaaacatttttccagatcagctcagtcgtgagttatccgtcattgacgttataataagctctgattatttatcaagcatcattctttatagatatctca

SEQ ID NO: 24349 - DNA, 201 bp, Homo sapiens
attgtttttatctttgaataatatgttcttgtttgtccattttccatgcatgcgatgttaggcatacaaaatacattttttaaagaatactttcattgcarattggaaacttcgtttaaaaaatgctcatactaaaattggcatttctaacccataggcccacttgtagttatttaccgaagcaaaaggacagctttgctt

SEQ ID NO: 24350 - DNA, 201 bp, Homo sapiens
acctcaagtctgatgcagaccagagctgggccagctccccagtcgtgggtatagaatcatagttacaagcaggcatttcttggggatggggaggactggcrcagggctgctgtgatggggtatcttttcagggaggagccaaagcgctcattgtctgtgcttctcctcctttttctgcggtccctggctccccacctgact

SEQ ID NO: 24351 - DNA, 201 bp, Homo sapiens
ggactggcacagggctgctgtgatggggtatcttttcagggaggagccaaagcgctcattgtctgtgcttctcctcctttttctgcggtccctggctcccyacctgactccaggtgaacaagaccttccaggaactggctgtgttccatgatctggaaggcatgtgggaggaactcagccccaagatctggaccttcatgg

SEQ ID NO: 24352 - DNA, 201 bp, Homo sapiens
gggcagtcttaggtctcctgcccctcacgagcaccccagagaggccacgtgctcagtgatctcagtgggcgcatctttctagtcttgctattctttttggycatgttgttcagaaaccatactgggcagggccgacttcaccctaaaggctgcgtctcttcactctgcttttgtttgttccaaataaagtggcttcagaat

SEQ ID NO: 24353 - DNA, 201 bp, Homo sapiens
gctgacaagtcacacgtttctgggggtacatacacaccgcggtccctgtgaatggcactctccatgagaactgtgatgatttgagttgaatagtgcacagsctacatggttctctgccatggcctggagttccttatcttgccttctccagtgaggactagggctgcaactggcctactttggctcctgacttgggggatt

SEQ ID NO: 24354 - DNA, 201 bp, Homo sapiens
tggagtgcagtggcgcaatctcggctcactgcaacttccgcctcccagattcaagcagttctcctgcctcaacctcctgagtagctgggactacaggcgtrtgccaccatgtccggctaatttttgtatttttttaatagagacggggttttactatggtggctaggctggtctttaactcctgaccttgtgatctgccca

SEQ ID NO: 24355 - DNA, 201 bp, Homo sapiens
gttaacaaaaatacatacataccttcctggtgatggtataaattgctattctctattggaaagcaatttggaatgaaaatttaaagaaccattttaaaatrtgctatcctgcgtacctccattccacccacccccagggatgtagcctactgaaataattttaaagaagtcaccatatgagagaaaatgttattgctatat

SEQ ID NO: 24356 - DNA, 201 bp, Homo sapiens
gcaaggggggaaaagcttataatgttagtgaaactaagactgatttttttataaagcagcagttttcagacccttggagactccaattcggtagaaccagrgcttcatcttctctgtcgaagctgtgacaggagttgcaaatgcctctcctttttgctgagtttgcagctgctgtttttccggcagcacatctgtgcaggc

SEQ ID NO: 24357 - DNA, 201 bp, Homo sapiens
tttctagagaacaagtctaattctgttttccttgaaatagtcgaagacagctctcatgtttttctttccctgttttcccaaagtccatgattttttaggcraaatggcctcctttcctcttatggaatgtttttcctccccatttctgcctctcctctggttgtgtttcagtatgtctgtgtgcttcttgaagtttactgg

SEQ ID NO: 24358 - DNA, 201 bp, Homo sapiens
gaaataggcctcctttgcatcatgacctgtacatcctgcaattggaaaagattgtactttagttggtttaaccagcagcattatttttctaaactaagcaktaagaaggaattaggttttatgtgggatcaacagactgggtctcaaaagaggaaggtgatagaacacagtggggagggggaggtgcactagaaacagagg

SEQ ID NO: 24359 - DNA, 201 bp, Homo sapiens
aaataaaaatgaataggtgcttagaatggggcctgacattagtaagtgcttagttttgtgtgtgtatatgttatttttattttggaggagaacataaaaargacaaagtgtagaaaaactggttgggtgtattcagctgtcataacatgagagttgttatgcccagatgcacttgacatgtgaatttattagaaacatgat

SEQ ID NO: 24360 - DNA, 201 bp, Homo sapiens
tcacttgagcccaggtgttcaagaccagcccaggcaacatggcaagactctgtctctatgaaaaaattaaaaattagccaggtgtggtggtgtgcacctgkagtcttagctacttggtaggctgagatgggaggatcacttgggcttgggaggtcaaggctgcggtgagctgtgattccatcactgcactccagcccgggc

SEQ ID NO: 24361 - DNA, 201 bp, Homo sapiens
atagcagctaacttgaaatgtaaactataaaacctaatgtagtatctggcacatagtagattcccaataaatgagagccagtattcttctaagacagtgargcatttctgagcacctggccttgttcttctgccttgcaatttatgcagcagttgaaatagactggctgatgggggtaagttgtcaagcagactttctgat

SEQ ID NO: 24362 - DNA, 201 bp, Homo sapiens
tgatcactttcatgacaccaaacacagcattgggtaccagagttcatgtcacaccagagggaaaattctgtacacaatgatgaaaattaataccactaccrcttaagttcctatgtgacaactttcccaagaatcagagagatacaagtcaaaactccaagtcaatgcctctaacttctctgatgggttttaacctccaga

SEQ ID NO: 24363 - DNA, 201 bp, Homo sapiens
ctcaagagaatatttctacccattttcttctaggttttcctatctcagtgactaatggtagcaaagcattcccttaaaaaggcattatttgtgaaacttayctaaaatcgaattcgggtccaattaaatttttgaaattttatattaaaaattatattagtagggatgggtaagaggtgttttggtctggttggttggtta

SEQ ID NO: 24364 - DNA, 201 bp, Homo sapiens
ttaggggtggcatggaggaggtgctgcttcacagcagagagaggtatggctgtgcttggagtgtccacttagacaactcctggctgtgcagccaggccatsgagatgctgtttccttgacctgcaggtcctggtcttgcacatggatgtttcttctggtgcaggagacagaaaggtagcaacaacccctgatcaaagcctc

SEQ ID NO: 24365 - DNA, 201 bp, Homo sapiens
ttctctccaggatgaccacatcagtggatgtccttgtgtccatctgtgtcatctttgcaatgtccttcgtcccagccagctttgtcgtattcctgatccargagcgggtcagcaaagcaaaacacctgcagttcatcagtggagtgaagcctgtcatctactggctctctaattttgtctgggatatggtaaggacacagg

SEQ ID NO: 24366 - DNA, 201 bp, Homo sapiens
ttctagagtttaaaccagactcagatttgagttttttttttttttttttttttttttttttttttttttttttttttaaaggctacaaaactgtgctttcyttgggcagtaaaagaggcaatgggcaatgggggacctgatgacaaagggaagcaaagctgtcttaggggtggcatggaggaggtgctgcttcacagcaga

SEQ ID NO: 24367 - DNA, 201 bp, Homo sapiens
aatgatcatcttaaccctgaataaaatgtgtctggtgaacagatgtttttccttgggctgtgcctcagatatctctgtgtgtgtgtacgtgtgtgtttgtytgtgtgtccatgtcctcactgattgagccctaactgcatcaaagacccctcagattttcacacgctttttctctccaggatgaccacatcagtggatgtc

SEQ ID NO: 24368 - DNA, 201 bp, Homo sapiens
cattagatcttccccaaggggtttttctccttggtggctggcctgtggggcccctctccaggaggcattggtgaagaaactaggggagctggttgccacaracagtgatgtactaatcttctctgggaagacagaagaaaagtccccagggaagaatactacagacttggccttagggacagctaggggtgcagattgctg

SEQ ID NO: 24369 - DNA, 201 bp, Homo sapiens
aactgaattacttagttgtacgtttaaaagtgtaggtcaaaaacaaatccagaggccaggagctgtggctcatgcctgtaatcctagcactttgggaggcygaagcgggtggatcacttgaggtcaggagttcgagaccagcctggcctacatgacaaaaccccgtatctactaaaaatacaaaaaaattagctgggcttg

SEQ ID NO: 24370 - DNA, 201 bp, Homo sapiens
agggttctatagctaccccaggttcccatgactggagaattggggcacagggtggcgggggagagtgagtgacaagaatcctaacaatcttatttccattsagtccttataaaagaagtggattaactaccacgtttttaagtttttcttaaatttaggttatgtggatctggcgtttcttgttttgtcctgggtttgttt

SEQ ID NO: 24371 - DNA, 201 bp, Homo sapiens
acccaaataggccctaaataaacatttatagcctcctgcctgcctgagaaaccagggtggacatggagagaaggcacttctgaaagttcaagcgcagtgcsctgtgtccttacactccactcctcagtgctttctgtgggttcatttctgtcttctctcctgtcacagtctgcatggaggaggaacccacccacttgaagc

SEQ ID NO: 24372 - DNA, 201 bp, Homo sapiens
ttaggaggccaaggcgggtggatcacttgaggtcaggagtttgagaccagcctggccaacatggggaaaccctgtctctactaaaaatacaaaataagctrggcgtggtggtgcgtgcctgtaatcccagctacttgggaggctgaggcaggagaattgcttgaatctgggaggcggaggttgcagtgagctgagttcatg

SEQ ID NO: 24373 - DNA, 201 bp, Homo sapiens
agaattggcctatcaatgagataagaggcctggctttctggcactctgctctagggcaagtaaaatggagaattccaaattctgaaattgttagaacatarttctgtgtcttagttaaatatctacacttacagataaatagcataaatgctttctccccatatttcagcccagtcctacttaaagacaacataaattgca

SEQ ID NO: 24374 - DNA, 201 bp, Homo sapiens
tgtgtttttatcacagggaggctgatcaatataatgaaattaaaagggggctggtccatattgttctgtgtttttgtttgtttgttttgtttgtttctttwtttgtttttgtggcctccttcctctcaatttatgaagagaagcagtaagatgttcctctcgggtcctctgagggacctggggagctcaggctgggaatct

SEQ ID NO: 24375 - DNA, 201 bp, Homo sapiens
tgcagctgcggcacgcagggccacactgtcatgttcatggaccctagactggctttgtagcctccatgggccccttccatacacaaatattaaaaattatrtttcatgactgcattggtataaagatgaatataatccagaccagattcatgattattcatacatttttagtgtattaacttttaattctgcttttaaaat

SEQ ID NO: 24376 - DNA, 201 bp, Homo sapiens
agggccacactgtcatgttcatggaccctagactggctttgtagcctccatgggccccttccatacacaaatattaaaaattatatttcatgactgcattsgtataaagatgaatataatccagaccagattcatgattattcatacatttttagtgtattaacttttaattctgcttttaaaataaattaaaacattcta

SEQ ID NO: 24377 - DNA, 201 bp, Homo sapiens
cagctactcgggaggtggaggttgcaatgagcccagatcgcaccattgcactccagcctgggcaacaaaaggtgaaactccatctcaattaaaaaaaaaakaatgattttggtggtcgacttcaaataggtaggagaagaaggagagaggagatggagggtcagggagatctaattactctctaaaatcatgctaggaaag

SEQ ID NO: 24378 - DNA, 201 bp, Homo sapiens
ggagttcgaaaccagcttggccaatgtggcgaaaccctgtctctactaaaaattcaaaaattagccaggcatggtggcacatgcctgtaatcccagttacytgggaggctgaagcaggagaattgcttgaacctgggaggtggaggtcgcagggagccaaaattgcgccactgtactccagcctgagcaacacagcaaaac

SEQ ID NO: 24379 - DNA, 201 bp, Homo sapiens
ccaaggctaggggagttctgtcttctctgcatcaggtcacctctctcacctctgtcactgccccatcagactacaatgtctgcaggtctttctcccctgaktgtgagctccctgagcaaagcaggatgctgccccttccctttgtattcctggctcctggcttcagtgcctggacataagtatgggcataataagtgtccc

SEQ ID NO: 24380 - DNA, 201 bp, Homo sapiens
caactctggtattcttagagactctgtttgggaaggagtcctgagccattttttttttcttgagaatttcaggaagaggagtgcttatgatagctctctgmtgcttttatcagcaaccaaattgcaggatgaggacaagcaattctaaatgagtacaggaactaaaagaaggcttggttaccactcttgaaaataatagct

SEQ ID NO: 24381 - DNA, 201 bp, Homo sapiens
agtttcaagggcaaactcagttttttcatctactagacgaatgattttctggaatgattacaagcaggcaagatggtgtagtggaaatagcaaatgtcttyggcatcagacaagttggggtttgtttgtatcctgcctctgcccttcaccgaggttgtgatcttgggcagattgttgagttttaacctagattcctctgac

SEQ ID NO: 24382 - DNA, 201 bp, Homo sapiens
ttcaagcgattctcctgcctcagcctcctgagtagctgggattacaggcacgcaccaccatgtctggctaatttttgtgtttttagtagagatagggtttygccgtgttggctaggctggtctggaattcctgacctcaggtgatccacccgcctcggcctcccaaagtgctgggattacaggcgtgagccactacgccca

SEQ ID NO: 24383 - DNA, 201 bp, Homo sapiens
aagtcatttttttttcagagaagatatggtagaaagtcttaggaggttgaagaaggaattggatatttattctttctgagactatcatgggagataatgaytatggttgtccatgattggagccgttgctgtagagttggttttattatagtgtaggatttgaatgggccatgtgttctcagacctcagattaaaatgaga

SEQ ID NO: 24384 - DNA, 201 bp, Homo sapiens
ctctatttatcttcctgatcctgatctctgttcggctgagctacccaccctatgaacaacatgaatgtaagtaactgtggatgttgcctgagactcaccartggcagggaaaatccaggcaattaacgtgggctaaattggacttttccaaagatgctgtctttgggaaacatcacacatgctttggatcagaaaacctag

SEQ ID NO: 24385 - DNA, 201 bp, Homo sapiens
cagctttgtgtgcaattagaggagcaagggttgtgtgtatttagcacagcaggttggcctggtcctctcctctcaacatagtcaccacatacctggcactrtgctaaggctgggaatgcagacagatgggtgcctgctttcagagtgctcaatgtgctgaggaagccagcaacagaaacagatgatttcaggagctccagg

SEQ ID NO: 24386 - DNA, 201 bp, Homo sapiens
ggcttctctcccaggtaactctgagaaagtgttattaagaaatgtggcttctactttctctgtcttacggggctaacatgccactcagtaatataataatygtggcagtggtgactactctcgtaatgttggtgcttataatgttctcatctctctcattttccagatattcctcaaggtggccgaagagagtggggtgga

SEQ ID NO: 24387 - DNA, 201 bp, Homo sapiens
ggaggtgtggggttgggtgggtaggcaccaaagcaagatttagaagagttttctgtaggaatttataatggtaaaggatcaacttcatttccaagctattyatgagggtttatgtttaggaaaagtgctaagcttagagaaggaggagaaatctgattttattaatgagtgtagccataatggcatatcctggcagaagtc

SEQ ID NO: 24388 - DNA, 201 bp, Homo sapiens
ggtttcaccatgttggccaggctgatctcaaactcttgacctcaggtgatccgcccacctctggctcccaaagtgctaggattacaggcatgagccactgygcccagccccagttttatttattcaccagttgatggtcttttcgacaactaattgtttccagtttttggctattctgtataaggcttctataaatattca

SEQ ID NO: 24389 - DNA, 201 bp, Homo sapiens
tctgactgggaatccatcgttcagtaagtttactgagtgtgacaccttggcttgactgttggaaagacagaaagggcatgtagtttataaaatcagccaargggaaaatgcttgtcaaaatgtattgtcgggtattttgattaatagtttatgtggcttcattaattcagagttactctccaatatgtttatctgcccttt

SEQ ID NO: 24390 - DNA, 201 bp, Homo sapiens
aacctcctgagtagctgggactacaggcgtatgccaccatgtccggctaatttttgtatttttttaatagagacggggttttactatggtggctaggctgktctttaactcctgaccttgtgatctgcccaccttggcttcccagagtgctgggattacagatgtgagccacagtgcccggcctaagttttacttcttata

SEQ ID NO: 24391 - DNA, 201 bp, Homo sapiens
cctgagtagctgggactacaggcgtatgccaccatgtccggctaatttttgtatttttttaatagagacggggttttactatggtggctaggctggtcttkaactcctgaccttgtgatctgcccaccttggcttcccagagtgctgggattacagatgtgagccacagtgcccggcctaagttttacttcttataatgga

SEQ ID NO: 24392 - DNA, 201 bp, Homo sapiens
aagcattggatcatacgtacatttcagagtctagagggcctgtccttctgtggcccagatgtggtgctccctctagcatgcaggctcagaggccttggccyatcaccctggctcacgtgtgtctttctttctccccttgtccttccttggggcctccagctttctgcgggtgatgagccggtcaatgcccctcttcatgac

SEQ ID NO: 24393 - DNA, 201 bp, Homo sapiens
gatgtgtcgtgggcggctgaacgtcgcccgtttaaggggcgggccccggctccacgtgctttctgctgagtgactgaactacataaacagaggccgggaasggggcggggaggagggagagcacaggctttgaccgatagtaacctctgcgctcggtgcagccgaatctataaaaggaactagtcccggcaaaaaccccgt

SEQ ID NO: 24394 - DNA, 201 bp, Homo sapiens
cctggatttactcagtggctgtgatcatcaagggcatcgtgtatgagaaggaggcacggctgaaagagaccatgcggatcatgggcctggacaacagcatmctctggtttagctggttcattagtagcctcattcctcttcttgtgagcgctggcctgctagtggtcatcctgaaggtaaggcagcctcactcgctcttcc

SEQ ID NO: 24395 - DNA, 201 bp, Homo sapiens
tgctagtggtcatcctgaaggtaaggcagcctcactcgctcttccctgccaggaaactccgaaatagctcaacacgggctaagggaggagaagaagaaaaraaatccaagcctctggtagagaaggggtcatacctgtcatttcctgcaatttcatccatttatagttggggaaagtgaggcccagagaggggcagtgact

SEQ ID NO: 24396 - DNA, 201 bp, Homo sapiens
aaaaaagaagacaaaaagggattttataccagtattatcttggctgtgtgactctgaagccacagttgtaagttataattactctgaaacacaaggccctrtgactcttttgggctctttggtgtttatcttgattacaacgttggaatatagaaatgaaaggaatgggagaggtgatagacttcaggcagtgtaactagt

SEQ ID NO: 24397 - DNA, 201 bp, Homo sapiens
ctcgctcttccctgccaggaaactccgaaatagctcaacacgggctaagggaggagaagaagaaaaaaaatccaagcctctggtagagaaggggtcatacmtgtcatttcctgcaatttcatccatttatagttggggaaagtgaggcccagagaggggcagtgacttgcccaaggtcaacccagccgggtagcagctaag

SEQ ID NO: 24398 - DNA, 201 bp, Homo sapiens
gaagaaaaaaaatccaagcctctggtagagaaggggtcatacctgtcatttcctgcaatttcatccatttatagttggggaaagtgaggcccagagagggrcagtgacttgcccaaggtcaacccagccgggtagcagctaagtaggatgagagtgcagggttcatgctttccagataaccacatgctcaactgtgccatg

SEQ ID NO: 24399 - DNA, 201 bp, Homo sapiens
gggggttctactcccagtcacgccagctgactttgcgagtgttctttgtcagtcactttatcttattttatttatttttatttttttgaaatggagtttcrctcttgtcgcccaggctggagtgaaatggcgcgatcttggctcactgcaacctccccctcctgagttcaagcgattctcctgcctcagcctccagagtac

SEQ ID NO: 24400 - DNA, 201 bp, Homo sapiens
actgcaaggggaaggtcagtggcagaggtagtggtcccatggttggtgcataagagctgctctgagacaactgcatgctggtgggtcctgcagacatgtasccatcagccggagataggctcaaaatatccacaagagtttggatgattgtgggaatgcagaatccatggtgatcaagagggaaagtcaagttgcctggcc

SEQ ID NO: 24401 - DNA, 201 bp, Homo sapiens
gaccgaatcctaggaccaagcccaaatatgtcccatcatccttttggtaagaagctcattgtaagaaagaaagaggagagcaagaggatgacctagtgcayggggcctcattgttttaattagtgacaaaacaacaataataacaacaaaacccccgaagcttcacagatgacatcagaccccaagcctgtgtgtttttca

SEQ ID NO: 24402 - DNA, 201 bp, Homo sapiens
tttccttggcttttagacagaaaagttacgtgggatattatctcccacagctcttctgtggtgccaccagtcatagtccttatataaggagaaaccagttraaattacctattgaagaaacaaagagcaaactcgcccactgaaatgcgtagaaagccctggactctgttgtattcataactctgccattatttttctgcg

SEQ ID NO: 24403 - DNA, 201 bp, Homo sapiens
cctgtggaaagagaagtgagtgttttgactcactgttatttaaaaatctctagggctgttccaataagcaacaaaaggcaaaatggcctggttctctgtcmcctttctgtctgtatgcctcgtacaggttatgaaaagaaaaagttgggaaaagctgtccacctcacctaattgtgttcttgtggagtgtgctagatgccc

SEQ ID NO: 24404 - DNA, 201 bp, Homo sapiens
ttacagtcatgccatttaaaaggaaagttgtattcctgtctttgttaatatttataagtgattttattcagctacaagcttggaatggcatataattttgkattctgcttttttcacttaatattacatggctaatgatttctgtgtttcataaacattattctgatgatggcatgatatattgttgagtacatgtaccat

SEQ ID NO: 24405 - DNA, 201 bp, Homo sapiens
aagaaacaaagagcaaactcgcccactgaaatgcgtagaaagccctggactctgttgtattcataactctgccattatttttctgcgtagttttgggtaartcacttatcttctttaggatggtaatgatcagttgcctcatcagaaagatgaacagcattacgcctctgcattgtctctaacatgagtaggaataaaccc

SEQ ID NO: 24406 - DNA, 201 bp, Homo sapiens
gagcttcaaggctgatggctatttatcttactcatactctttgtttagcttcatttttttcccctaatttcattagtattttcttttcttttttttgaggkgaagtctcactctgttgcccaggctggagtgcaatggagcgatcttggctcaccccaacctctgtctcctgggttcaaacagttctcctgcctcagcctc

SEQ ID NO: 24407 - DNA, 201 bp, Homo sapiens
acggcttctctcccaggtaactctgagaaagtgttattaagaaatgtggcttctactttctctgtcttacggggctaacatgccactcagtaatataatartcgtggcagtggtgactactctcgtaatgttggtgcttataatgttctcatctctctcattttccagatattcctcaaggtggccgaagagagtggggtg

SEQ ID NO: 24408 - DNA, 201 bp, Homo sapiens
tctgttgtattcataactctgccattatttttctgcgtagttttgggtaagtcacttatcttctttaggatggtaatgatcagttgcctcatcagaaagawgaacagcattacgcctctgcattgtctctaacatgagtaggaataaaccctgtcttttttctgtagatcatacaagtgagtgcttgggattgttgaggca

SEQ ID NO: 24409 - DNA, 201 bp, Homo sapiens
aatggtagtttcagagcttcaaggctgatggctatttatcttactcatactctttgtttagcttcatttttttcccctaatttcattagtattttcttttyttttttttgaggtgaagtctcactctgttgcccaggctggagtgcaatggagcgatcttggctcaccccaacctctgtctcctgggttcaaacagttctc

SEQ ID NO: 24410 - DNA, 201 bp, Homo sapiens
ggatgaggagctgagggccaagccaggagggtgggatttgagcttagtacataagaagagtgagagcccaggagatgaggaacagccttccagatttttcytgggtagcgtgtgtaggaggccagtgtcaccagtagcatatgtggaacagaagtcttgacccttgctatctctgcctagtcctaatggctggcttttccc

SEQ ID NO: 24411 - DNA, 201 bp, Homo sapiens
ttcgctgtgagtacctctggcctttcttcagtggctgtaggcatttgaccttcctttggagtccctgaataaaagcagcaagttgagaacagaagatgatwgtcttttccaatgggacatgaaccttagctctagattctaagctctttaagggtaagggcaagcattgtgttttattaaattgtttacctttagtcttct

SEQ ID NO: 24412 - DNA, 201 bp, Homo sapiens
gggatgaggagctgagggccaagccaggagggtgggatttgagcttagtacataagaagagtgagagcccaggagatgaggaacagccttccagatttttmttgggtagcgtgtgtaggaggccagtgtcaccagtagcatatgtggaacagaagtcttgacccttgctatctctgcctagtcctaatggctggcttttcc

SEQ ID NO: 24413 - DNA, 201 bp, Homo sapiens
agacttcccctttacaaaagtatgatgagttttgacaaatggatacacatgtgtatctaccactgccatgctccttttcagtctgtcgtcccctccacccrtgaccactggtcaccactgcagtgatttctgtccccttcatttcaccttttccagaatgtcatataaatggaatcatgcagtatgtagttttttgtgtct

SEQ ID NO: 24414 - DNA, 201 bp, Homo sapiens
tttactatggtggctaggctggtctttaactcctgaccttgtgatctgcccaccttggcttcccagagtgctgggattacagatgtgagccacagtgcccrgcctaagttttacttcttataatggactcctgttaagccaataggtgatgaaaggaaaccataaccaactcttcaggctcattcatccttcaagaatagc

SEQ ID NO: 24415 - DNA, 201 bp, Homo sapiens
tagttttggtgctgatagagcccagaatgtaccctgaatttgatgaacattctgatatatgggggagctcattgtcccccacttacctttttgcctctcaraatatcttttgatatttttatctgttttttccccattgaatgttattaccttatcaagctcaaaaaagtaccctatcgctattttaagttcagttgtgtt

SEQ ID NO: 24416 - DNA, 201 bp, Homo sapiens
gtgctagttctgttgaatcccgttttccttttcctatgaggcacagagagtgatggagaaggtccttagaggacattattatgtcaaagaaaagagacttrtcaagaggtaagagccttggctacaaatgacctggtgttcctgctcattacttttcaatctcattgaccttaacttttaaactataaaacagccaatatt

SEQ ID NO: 24417 - DNA, 201 bp, Homo sapiens
agattcaagcagttctcctgcctcaacctcctgagtagctgggactacaggcgtatgccaccatgtccggctaatttttgtatttttttaatagagacggkgttttactatggtggctaggctggtctttaactcctgaccttgtgatctgcccaccttggcttcccagagtgctgggattacagatgtgagccacagtgc

SEQ ID NO: 24418 - DNA, 201 bp, Homo sapiens
tctaaaaagacaggttaaaaagtaagttcacttttattttgagcttcagaatcattcagaagccagtcgccacaaacgcagaccaaggctcttggcacatyaaatatgcctatggcttagggttattgacaagtcttatgttgcagtgtatgtggtttatagtcctgccttccacagttgcttgggagagctgtgagtcac

SEQ ID NO: 24419 - DNA, 201 bp, Homo sapiens
aaaaaaaaaaaaaaaaaaaaaagatgtgtagggagcaattttggagttattcatttggtcatttgatatgtagttttagttttggtgctgatagagcccaraatgtaccctgaatttgatgaacattctgatatatgggggagctcattgtcccccacttacctttttgcctctcagaatatcttttgatatttttatctg

SEQ ID NO: 24420 - DNA, 201 bp, Homo sapiens
caaatcagaactgagaggcctcacctgtcccacatccttgtgtttgtgcctggcaggccgcaccattattctctctacacaccacatggatgaagcggacrtcctgggggacaggattgccatcatctcccatgggaagctgtgctgtgtgggctcctccctgtttctgaagaaccagctgggaacaggctactacctgac

SEQ ID NO: 24421 - DNA, 201 bp, Homo sapiens
ttgagtgaatgaagatttgaatcatagaaccagaaggggttctcatctgaaatgcaaaggaaggaggagttggtttaattcaataagtttcagttgagtamacatgatttagtgagacactgttcttgcttctgactcaccatttggaaaatctctctaaaataaaattggactctccatctcggacatcattttgggtgt

SEQ ID NO: 24422 - DNA, 201 bp, Homo sapiens
cacaatgcctggcatatagcaagttcccaaataaaatgctactgttcttacctctgtgaggatgtggtacctatatatacaaagctttgccattctagggrtcatagccatacagggtgaaaggtggcttccaggtctcttccagtgcttacccctgctaatatctctctagtccctgtcactgtgacaaatcagaactga

SEQ ID NO: 24423 - DNA, 201 bp, Homo sapiens
ctctgccaaatccaacttccaagaagcatttggaagtcaaaacattttatctggttagtcttaaagtccagatattttgtgatagctggtatttagtttaygatatttcccaggaagaactttttagtagttgaaccatttatgaaagacttccttgaagctaccttagagagttgatttagttcttcctaaataagtaaa

SEQ ID NO: 24424 - DNA, 201 bp, Homo sapiens; identical to SEQ ID NO: 3385

SEQ ID NO: 24425 - DNA, 201 bp, Homo sapiens
tctggggctggtcctggagtttgtcttgctctgtttttttgtaggtggaatgcagagaaagctatctgtggccttggcctttgtcgggggatctaaggttrtcattctggatgaacccacagctggtgtggacccttactcccgcaggggaatatgggagctgctgctgaaataccgacaaggtgcctgatgtgtatttat

SEQ ID NO: 24426 - DNA, 201 bp, Homo sapiens
  misc_feature (1)...(201): n = A,T,C or G, or insertion/deletion polymorphism (see Tables 1-2)
gggcgacagagtgagactccgtcttgaaaaaaaatgtctgccttgtaaaagtgaaataggatgagaaagtgcctttcttattaattggtgtaatgaattanaaataaactctttgaagacacctcttggtaaaaatagttacatttactgttgatttatggtatgttggatatgtttttaagttttccgtgtaataactca

SEQ ID NO: 24427 - DNA, 201 bp, Homo sapiens
actccacatagaagactactctgtttctcagacaacacttgaccaagtaagctttgagtgtcaaaacagatttacttctcagggtgtggattcctgccccsacactcccgcccataggtccaagagcagtttgtatcttgaattggtgcttgaattcctgatctactattcctagctatgctttttactaaacctctctga

SEQ ID NO: 24428 - DNA, 201 bp, Homo sapiens
ggcccagagctaccttccctatccctctcccctcctcctccggctacacacatgcggaggaaaatcagcactgccccagggtcccaggctgggtgcggttrgtaacagaaacttgtccctggctgtgcccctaggtcctctgccttcactcactgtctggggctggtcctggagtttgtcttgctctgtttttttgtaggt

SEQ ID NO: 24429 - DNA, 201 bp, Homo sapiens
gctgttctctctctgggactttgatttttttcttgggctcatcccctttttgtagtatcttatctttgtcttatttgtataggacttaactgttcccattyccttattagagcaatctaagtgattaccttcataccttttggaattatatgcttcaaaattccaaaaagaatgattttgggctgggcacagtggctcaca

SEQ ID NO: 24430 - DNA, 201 bp, Homo sapiens
attttttttttaaagggatcttctctcccgtaagccgggatacttaagctatatatgtagtggctacaaattaaggtcttcactgttttcatttttagctsctagaataagtgaacattaccttagatagactcttctaattatgaagatatctagatgtctagaaaatatcaaaatgcatgtggtttttgcatttctaaa

SEQ ID NO: 24431 - DNA, 201 bp, Homo sapiens
ttagctttttattatcttctgtagtacttacctttttggagaggagttggttgggatatttttccatttaaattttttttttaaagggatcttctctcccrtaagccgggatacttaagctatatatgtagtggctacaaattaaggtcttcactgttttcatttttagctgctagaataagtgaacattaccttagatag

SEQ ID NO: 24432 - DNA, 201 bp, Homo sapiens
ttgattgttttcaaggattggttccttctgctcaaggaagtcccattgtaaacataaaaaaatgaatgaaactgaagaagttcagtgacttagctttttaktatcttctgtagtacttacctttttggagaggagttggttgggatatttttccatttaaattttttttttaaagggatcttctctcccgtaagccgggat

SEQ ID NO: 24433 - DNA, 201 bp, Homo sapiens
gttttttttttttttttttttttttttttttttttttttttttttttaaaggctacaaaactgtgctttccttgggcagtaaaagaggcaatgggcaatgkgggacctgatgacaaagggaagcaaagctgtcttaggggtggcatggaggaggtgctgcttcacagcagagagaggtatggctgtgcttggagtgtccac

SEQ ID NO: 24434 - DNA, 201 bp, Homo sapiens
tgtgagcccctacaagtgcaagttgtcagatgtccccaggtcacttatcaggaaagctaagagtgactcataggatgctcctgttgcctcagtctgggctycataggcatcagcagccccaaacaggcacctctgatcctgagccatccttggctgagcagggagcctcagaagactgtgggtatgcgcatgtgtgtgggg

SEQ ID NO: 24435 - DNA, 201 bp, Homo sapiens
  misc_feature (1)...(201): n = A,T,C or G, or insertion/deletion polymorphism (see Tables 1-2)
tgagtactttgccctttttgaggagcagggcattggagtgcagtgggacaacctgtttgagagtcctgtggaggaagatggcttcaatctcaccacttcgntctccatgatgctgtttgacaccttcctctatggggtgatgacctggtacattgaggctgtctttccaggtacactgctttgggcatctgtttggaaaat

SEQ ID NO: 24436 - DNA, 201 bp, Homo sapiens
gcaaagagcaatttgggagtccagtttgtttctcattgaaagctttcccatttctggtcctcttgtcactgttgcattgaggcaccaaaaggcaatctcartgcgacactattcaacagactaagttgcaccggataatgataccattttacatttttcatatattattacattgaaggcttcaaacagcactagcagggg

SEQ ID NO: 24437 - DNA, 201 bp, Homo sapiens
acggaattcccaggccctggtattttccttgcaccaagtcctactggtttggcgaggaaagtgatgagaagagccaccctggttccaaccagaagagaatrtcagaaagtaagtgctgttgacctcctgctctttctttaacctagtgctgctgcctctgctaactgttgggggcaagcgatgtctcctgcctttctaaaa

SEQ ID NO: 24438 - DNA, 201 bp, Homo sapiens
ggcaccacctctccagaagtacaggccatggtgcagagataacgctgtgcatatcagcatccatgccactcacggtcaaatagcagttttctgcaaaactyagtgagggctggtgtttggaagtggagttgagtaattgcagtaccctattttcctttttggctgcagcctctcagccagccacagcatctccctgtgtct

SEQ ID NO: 24439 - DNA, 201 bp, Homo sapiens
ccacagagctcagcctatgcttcataatgtaatcattacccagatccctaatcctctcttggctcttaactgcagacagagatgtccacagctcatcaaakgctctgccttctgggttctttgtgcttagagtggcttcctaaatatttaataggtcccttttctgccagtctcttctgtgcccatcccctgattgccctt

SEQ ID NO: 24440 - DNA, 201 bp, Homo sapiens
gctgcagtgagctatgaccatactactgtactccagcctgggcaacagagtgaaactctgtctgaaaaaaaaaaaaaaaaaaaaaaaaaaaaaaaaaaaargatgtgtagggagcaattttggagttattcatttggtcatttgatatgtagttttagttttggtgctgatagagcccagaatgtaccctgaatttgatga

SEQ ID NO: 24441 - DNA, 201 bp, Homo sapiens
gactccatctctataaaaataaggaaattagtcaggcatggtggtacttgcctggagtcccagctacttggaaggctgaggtaggagaattgcttgagtcyaggtggtcaaggctgcagtgagctatgaccatactactgtactccagcctgggcaacagagtgaaactctgtctgaaaaaaaaaaaaaaaaaaaaaaaaa

SEQ ID NO: 24442 - DNA, 201 bp, Homo sapiens
agactccatctctataaaaataaggaaattagtcaggcatggtggtacttgcctggagtcccagctacttggaaggctgaggtaggagaattgcttgagtycaggtggtcaaggctgcagtgagctatgaccatactactgtactccagcctgggcaacagagtgaaactctgtctgaaaaaaaaaaaaaaaaaaaaaaaa

SEQ ID NO: 24443 - DNA, 201 bp, Homo sapiens
gctctggcctttctgtccatacctgaacaggtccttgggttaagagcccctcgtccagggcctattaatcttgatcctcataagcagcatccatgtattamggccgcaaaccaaactgtgccagaccgaatcctaggaccaagcccaaatatgtcccatcatccttttggtaagaagctcattgtaagaaagaaagaggag

SEQ ID NO: 24444 - DNA, 201 bp, Homo sapiens
acctgagctctgcaatcttgggcaaggcttttcccttatgtttcttcttatctaaagtgaacagctggggctcatgtgctccctcctcatctaaagtgaayacatggggctcatgtgcagggtcctccccgctttcagagcctgaggtcccctgaggctcaggaaggctgctccaggtgagtgccgagctgacttcttggt

SEQ ID NO: 24445 - DNA, 201 bp, Homo sapiens
ctcatgcctgtattcccagcactttgggaggctgaggtggggggattgcttgagactaggagttcaacaccagcctgggcagcatagcaagactccatctytataaaaataaggaaattagtcaggcatggtggtacttgcctggagtcccagctacttggaaggctgaggtaggagaattgcttgagtccaggtggtcaa

SEQ ID NO: 24446 - DNA, 201 bp, Homo sapiens
attctgagtaaatggactgagagagagcggggggcttttgagaagtgtggctgtatctcatggctaggcttctgtgaagccatgggatactcttctgttakcacagaagagataaagggcattgagactgagattcctgagaggagatgctgtgtctttattcatctttttgtccccaacatggtgcactaaatttatggt

SEQ ID NO: 24447 - DNA, 201 bp, Homo sapiens
ttgggacatttattaaaacctggatatggtggctcatgcctgtattcccagcactttgggaggctgaggtggggggattgcttgagactaggagttcaacmccagcctgggcagcatagcaagactccatctctataaaaataaggaaattagtcaggcatggtggtacttgcctggagtcccagctacttggaaggctga

SEQ ID NO: 24448 - DNA, 201 bp, Homo sapiens
catcagtacccaaataggccctaaataaacatttatagcctcctgcctgcctgagaaaccagggtggacatggagagaaggcacttctgaaagttcaagcrcagtgcgctgtgtccttacactccactcctcagtgctttctgtgggttcatttctgtcttctctcctgtcacagtctgcatggaggaggaacccacccac

SEQ ID NO: 24449 - DNA, 201 bp, Homo sapiens
gcaggtgtgggtagggatttcatttagattgacaggttgtcacattaaagctgagagccctgaagttcaagcaatggttagccaggcaaagatcagaggcytagagatagggaaatccattccaggcagagagactgggggtgcctgtcccctaggtcagggaacagaagaaagccagtggcactggtggagtgaataaga

SEQ ID NO: 24450 - DNA, 201 bp, Homo sapiens
acagggtcctctgaagccacggctgccagtgcatgtgtcccagggaaagctttttcctttagttctcacacaacagagcttcttggaagccctccccggcraaggtgctggtggctctgccttgctccgtccctgacccgttctcacctccttctttgccatcaggaggacagtgtttctcagagcagttctgatgctggc

SEQ ID NO: 24451 - DNA, 201 bp, Homo sapiens
actgagaggcctcacctgtcccacatccttgtgtttgtgcctggcaggccgcaccattattctctctacacaccacatggatgaagcggacgtcctggggkacaggattgccatcatctcccatgggaagctgtgctgtgtgggctcctccctgtttctgaagaaccagctgggaacaggctactacctgaccttggtcaa

SEQ ID NO: 24452 - DNA, 201 bp, Homo sapiens
caaatggaatcattttatatgttacttggtagcccaccactcccctaaagggactctataggtaaatactacttctgcaccttatgattgatccattttgyaaattcaaatttctccaggtataatttacactagaagagatagaaaaatgagactgaccaggaaatggataggtgactttgcctgtttctcacagagcct

SEQ ID NO: 24453 - DNA, 201 bp, Homo sapiens
ggaatgcagaatccatggtgatcaagagggaaagtcaagttgcctggccattttccttggcttttagacagaaaagttacgtgggatattatctcccacasctcttctgtggtgccaccagtcatagtccttatataaggagaaaccagttgaaattacctattgaagaaacaaagagcaaactcgcccactgaaatgcgt

SEQ ID NO: 24454 - DNA, 201 bp, Homo sapiens
cccaccaggtcttcttaatcataacaaattcatcttaaaacatcattttaaaatatattattttttattcttcattgacttcctgcattactctattttttcagagtttctagcaaccagtatcattggtattttaaacaatgtgtacatgtacatttatgcagatgagttaacatatatcaaagcaacctccaaacaatg

SEQ ID NO: 24455 - DNA, 201 bp, Homo sapiens
gttagggatgggtctaaaattaatttttcttcacattcatatcatgtcatcccagtgattatttaataaataatcacttgattaaatagtgattccttttytagttatttttgggacatttattaaaacctggatatggtggctcatgcctgtattcccagcactttgggaggctgaggtggggggattgcttgagactag

SEQ ID NO: 24456 - DNA, 201 bp, Homo sapiens
cccgccttggcctcccaaagtgctgggattataggcatgagccaccgtgccccaccaggtcttcttaatcataacaaattcatcttaaaacatcattttaraatatattattttttattcttcattgacttcctgcattactctattttttcagagtttctagcaaccagtatcattggtattttaaacaatgtgtacatg

SEQ ID NO: 24457 - DNA, 201 bp, Homo sapiens
tctctagcatttttctgatgtgatccttaagatttcactttagttttcccaggtctcattggcatgtatgctgttagggatgggtctaaaattaatttttyttcacattcatatcatgtcatcccagtgattatttaataaataatcacttgattaaatagtgattccttttctagttatttttgggacatttattaaaac

SEQ ID NO: 24458 - DNA, 201 bp, Homo sapiens
aaaaatcatttcccctctctagcatttttctgatgtgatccttaagatttcactttagttttcccaggtctcattggcatgtatgctgttagggatgggtytaaaattaatttttcttcacattcatatcatgtcatcccagtgattatttaataaataatcacttgattaaatagtgattccttttctagttatttttgg

SEQ ID NO: 24459 - DNA, 201 bp, Homo sapiens
ctgctgtgatggggtatcttttcagggaggagccaaagcgctcattgtctgtgcttctcctcctttttctgcggtccctggctccccacctgactccaggygaacaagaccttccaggaactggctgtgttccatgatctggaaggcatgtgggaggaactcagccccaagatctggaccttcatggagaacagccaagaa

SEQ ID NO: 24460 - DNA, 201 bp, Homo sapiens
tttgtagttcagggaaggcaggcctggttttaaaaatcatttcccctctctagcatttttctgatgtgatccttaagatttcactttagttttcccaggtytcattggcatgtatgctgttagggatgggtctaaaattaatttttcttcacattcatatcatgtcatcccagtgattatttaataaataatcacttgatt

SEQ ID NO: 24461 - DNA, 201 bp, Homo sapiens
catagcaacagaagtctggctcatcaacaagtccatggagctgctggatgagaggaagttctgggctggtattgtgttcactggaattactccaggcagcrttgagctgccccatcatgtcaagtacaagatccgaatggacattgacaatgtggagaggacaaataaaatcaaggatgggtaagtggaatcccatcacac

SEQ ID NO: 24462 - DNA, 201 bp, Homo sapiens
ggaaaactacgttagagaggattagagagagaggatgagcaatcgtgtagtcagcccttgcctcctagtgtaggatttgtctcagccactgcttgttgtcstggctgccaacgttctcatgaaggctgttcttctatcagtgtgtcaacctgaacaagctagaacccatagcaacagaagtctggctcatcaacaagtcca

SEQ ID NO: 24463 - DNA, 201 bp, Homo sapiens
tgacctcgtgatccgcctgtctcggcctcccaaagtgctgggattacaggcgtgaaccactgcgccctgttgagaatttttttttttttttttgggagacrgagtttcgctcttgttgcccgggctagagtgcagtgacacaatctcggctcactgcaacctctgcctcctgggttcaagcgattctcctgcctcagcctc

SEQ ID NO: 24464 - DNA, 201 bp, Homo sapiens
ctggtaaaagtctaccgagatgggatgaaggtggctgtcgatggcctggcactgaatttttatgagggccagatcacctccttcctgggccacaatggagyggggaagacgaccaccatgtaagaagagggtgtggttcccgcagaatcagccacaggagggttctgcagtagagttagaaatttataccttaggaaacca

SEQ ID NO: 24465 - DNA, 201 bp, Homo sapiens
tgttacaacttttgtatttgggtttttgttaagtgtacatatactagtttgtgttaattaaagagaatttttttttttttttttgagagggagtctcgctycgttgcccaggctggagtgcagtggcgccatctcggctcactgcaagctccgcctcccgggttcacgccattctcctgcctcagcctcctgagtagctgg

SEQ ID NO: 24466 - DNA, 201 bp, Homo sapiens
atacatttttaggataaaccatgaatgacacccgtttcttctccctcaccctcccttccctcccattttttttttttttttttagaagctgaataatatcmatgatatcctgaagtccgtgttcttgatcttcccacatttttgcctgggacgagggctcatcgacatggtgaaaaaccaggcaatggctgatgccctgga

SEQ ID NO: 24467 - DNA, 201 bp, Homo sapiens
tattctctgtggttggtggtggtggtgggatgtgtgtgtgtgtgtgtgtgtgtgtgtgtgtgtgtagggatcaggatgcgggaggagctgggttctgcttktattggttctctgttttgcattgaatagtgtgtttccttgtatggctatctatagcttttcaaggtcaccagaaattatcctgtttttcaccttctaaac

SEQ ID NO: 24468 - DNA, 201 bp, Homo sapiens
acaatgactcacaatttgaacacactggacagggggatagccaataaaattgaaaagagcaaggaaattaatgtattcatgatctcctctcctgtctcttwcatttttgcagtagcaatgtaaaggaatcctaagagaacagacattctgggaatagcaggcctagcgctgcacaactgctttcctaggcttgctcctagt

SEQ ID NO: 24469 - DNA, 201 bp, Homo sapiens
atctagagataatcacaatttacatttcctttcagtctcattctcttcttttaacagctttattcaggtataatttacatacaatataatttgcttgtttyttaagagtataatttagtgatttttggtaaattgagagttttgcaaccatcaccacaatccagttttagaacttttccatcaccccacatctgtcttata

SEQ ID NO: 24470 - DNA, 201 bp, Homo sapiens
agaaatgataaagttctagagtttaaaccagactcagatttgagttttttttttttttttttttttttttttttttttttttttttttttaaaggctacaraactgtgctttccttgggcagtaaaagaggcaatgggcaatgggggacctgatgacaaagggaagcaaagctgtcttaggggtggcatggaggaggtgct

SEQ ID NO: 24471 - DNA, 201 bp, Homo sapiens
gagctctggcctttctgtccatacctgaacaggtccttgggttaagagcccctcgtccagggcctattaatcttgatcctcataagcagcatccatgtatwacggccgcaaaccaaactgtgccagaccgaatcctaggaccaagcccaaatatgtcccatcatccttttggtaagaagctcattgtaagaaagaaagagg

SEQ ID NO: 24472 - DNA, 201 bp, Homo sapiens
actggagatgagatacacaaaacgtcttgagtacacagtagctgcccaatattggctgtaagtattataaatctacaagctgtgaattaattttacctctstggatcctgttgatatttctagaccattccacctagtggggccatttcctacctgagtcacccgtggtgtcaaatagaatgtcatgtggcctcctgagtt

SEQ ID NO: 24473 - DNA, 201 bp, Homo sapiens
ttcccaagtgcttccacaaaccattaaataattccacaaaccattaaaataattaatgctagggaattttaggaaaacattggtttacaatcagaaggacmggggaagtgggtcttcagccttcacgatgactacaagccatttaagggactagaattgctactgttgtcagagcaatttaggagtctgtatttgagcacc

SEQ ID NO: 24474 - DNA, 201 bp, Homo sapiens
agcacccgcatagtgttccagaatgacatatctgactgtaacctggacacgtgtgatatgttgtctcccctgcagatgagcatttgaaatctcaaccctcrtatttctacgagtgcaggcctataatggaccctgggcacattttttttttttttgagatgcagtctcgctctgtttcccaggctggagtgcagtggcacg

SEQ ID NO: 24475 - DNA, 201 bp, Homo sapiens
ttgagtactcagagacatgacgtgacttttcaaaggctgtaagctgacgagggacatagctagggttcagacttgagtttttctttttctttttctttttcttttttttttaagactgagtcttgcttttgtcgcccaggctggattgcagtggtgcttggctcactgcaacctctgcctcccgggttcaagcaattctcc

SEQ ID NO: 24476 - DNA, 201 bp, Homo sapiens
aaaatacacatatttgccaggcaggcgtggtggcgcacacctgtaatcccagctactgaagaggctgaggcacaagaatcgcttgaacccaggaggtggargttgcagtgagctgagatcactccactgcattccagccagcgtgacagagtgagactctgtctcagaaaaagaaaaaaaagatagaagttttcttctgta

SEQ ID NO: 24477 - DNA, 201 bp, Homo sapiens
caactgtgatgaggattatgaaggaaaaaatccggcaaactatggtactggtgttagatactagcaggtgtgggtagggatttcatttagattgacaggtygtcacattaaagctgagagccctgaagttcaagcaatggttagccaggcaaagatcagaggcttagagatagggaaatccattccaggcagagagactgg

SEQ ID NO: 24478 - DNA, 201 bp, Homo sapiens
aattttaaagtaaggtatatttctctacagggatctttgcaaccctaagtaactggcctaaaaagttagagaagctgacttgtgcagacatttgcagcctrttggtcttttttgtgctgtgaatcatagagggtgaaaggttattatgaatggtacaaaactttgttacaaaaccattttcttggactgttttgggctgct

SEQ ID NO: 24479 - DNA, 201 bp, Homo sapiens
accacgcccagctattttttgtatttttagtagacatagggtttcactatgttgcccagctggtctcgaactcctgagctcaagtgatctgcccacctcgkcctcccaaagtgttgggattaaaggcatgagtcaccgtgcctggtcccatgttataattttaaagtaaggtatatttctctacagggatctttgcaaccc

SEQ ID NO: 24480 - DNA, 201 bp, Homo sapiens
ttaaactcctatgcacttatttaccctttaatgagcctctttacttaagtacagtgtgaggaacagcggcatcaggatcacttgggaacttgttagaaatwcagcaacttgggcccagctcagacctactgaatcagaatcaggagcaattctctggtgtgactgtgtcacagccaggtatcaactggattctcatacata

SEQ ID NO: 24481 - DNA, 201 bp, Homo sapiens
agtatcttatcaaacatccatgaagtacatcagaacatgggctactgccctcagtttgatgccatcacagagctgttgactgggagagaacacgtggagtyctttgcccttttgagaggagtcccagagaaagaagttggcaaggtactgtgggcacctgaaagccagcctgtctcctttggcatcctgacaatatatacc

SEQ ID NO: 24482 - DNA, 201 bp, Homo sapiens
gcctaggaggtggaggctgcagtgagctgagatctgtctcactctgttgcccaggctggagtgcagtggcgcgatctcgactcactgcaacctccgcctcycaggcttaagtgattctcatgcctcagcctccgagtacctgggactacaggcacctgccaccacgcccagctattttttgtatttttagtagacataggg

SEQ ID NO: 24483 - DNA, 201 bp, Homo sapiens
tctcatgctctcacctgttttctttggatggcctttagccaaggtgatagatccctacagagtccaaagagaagtgaggaaatggtaaaagccacttgttytttgcagcatcgtgcatgtgatcaaacctgaaagagcctatccatatcacttcctttaaagacataaagatggtgcctcaatcctctgaacccatgtatt

SEQ ID NO: 24484 - DNA, 201 bp, Homo sapiens
gaggatcgcttgagcctaggaggtggaggctgcagtgagctgagatctgtctcactctgttgcccaggctggagtgcagtggcgcgatctcgactcactgsaacctccgcctctcaggcttaagtgattctcatgcctcagcctccgagtacctgggactacaggcacctgccaccacgcccagctattttttgtattttt

SEQ ID NO: 24485 - DNA, 201 bp, Homo sapiens
aaaatcctgcttgtctgtgccaaagggataattgtgaaagcacttttgaaatacttaatgagttgattttcttcaaattaaaaaaaatatataaatgtatmtgtgtatgtacatgtgtgtacacatacacacctttatacatacagcccatttaaaacaagctccactttggagtgctctacgtcaccctgatgccgaata

SEQ ID NO: 24486 - DNA, 201 bp, Homo sapiens
taactatcaactgtgatgaggattatgaaggaaaaaatccggcaaactatggtactggtgttagatactagcaggtgtgggtagggatttcatttagattkacaggttgtcacattaaagctgagagccctgaagttcaagcaatggttagccaggcaaagatcagaggcttagagatagggaaatccattccaggcagag

SEQ ID NO: 24487 - DNA, 201 bp, Homo sapiens
ctactcgggaggctgaggcaggaggatcgcttgagcctaggaggtggaggctgcagtgagctgagatctgtctcactctgttgcccaggctggagtgcagwggcgcgatctcgactcactgcaacctccgcctctcaggcttaagtgattctcatgcctcagcctccgagtacctgggactacaggcacctgccaccacgc

SEQ ID NO: 24488 - DNA, 201 bp, Homo sapiens
ctttacacttactgatgaaatgcttttcctttctttctctcccagcccctgtacttaagtgcttcaataggctctcattatatatgatttttaggttttgyttatcagcttcttcgcttttataatctgaaaagatggcatatgaatttttataaaaagggacactttcttcttctcaaattgtatatttttattgtactt

SEQ ID NO: 24489 - DNA, 201 bp, Homo sapiens
aaaagaatgaactatccaaaaattaaaactcctcatttatgagcttttagagaattttacagagtagatggaaactctctgcatcctttccccacttctastttcacctgacacatttcttccctgtccttactcctgggccggcagcagtggtcatgattccaatcccagcttggccaccatctgcctcagtggcctagg

SEQ ID NO: 24490 - DNA, 201 bp, Homo sapiens
tcccaccactttcggatgccacggcgggcagatcacgtgaggtcagcagtttgagaccagcctggccaacatggtgaaaccctgtctctacaaaaatacamaaaatagccgggcgtgatggtgggcacctgtaattccagctactcgggaggctgaggcaggaggatcgcttgagcctaggaggtggaggctgcagtgagc

SEQ ID NO: 24491 - DNA, 201 bp, Homo sapiens
atggcatatgaatttttataaaaagggacactttcttcttctcaaattgtatatttttattgtactttccttcaaaacccccttttaaaaagtaagcagtrgataaataaattcagtgaagcatccatatgactcttaagtgagtgtaggggaagggaggtcaccagatcactgtgagtgaagatggtggagaggtgagga

SEQ ID NO: 24492 - DNA, 201 bp, Homo sapiens
gatccaaccaatttaaatagccaccatcaatgcatgagactttgtagttcagggaaggcaggcctggttttaaaaatcatttcccctctctagcatttttytgatgtgatccttaagatttcactttagttttcccaggtctcattggcatgtatgctgttagggatgggtctaaaattaatttttcttcacattcatatc

SEQ ID NO: 24493 - DNA, 201 bp, Homo sapiens
tctggaccctgttcccagatcataccctagaatgtgaccttagaaacacacttcaggattcatacctttgattgaccatcaaaaagtttttgtatcggccwggtgtggtggctcacgcctgtaatcccaccactttcggatgccacggcgggcagatcacgtgaggtcagcagtttgagaccagcctggccaacatggtga

SEQ ID NO: 24494 - DNA, 201 bp, Homo sapiens
gggtggtaaatcctagcagctaatattggttcccaaataaccagatgacaaggatagagaaggacacagacacggcctatctggatttcatggtgcctttsattttccacatgaaggttgtgtagggaagatagaagcatgagatgagatgataatatagttatctggattcatcactggccagctgaaccatatgaactc

SEQ ID NO: 24495 - DNA, 201 bp, Homo sapiens
ttttatagagatgcggtttcaccatattggccaggctggtctgaaactcctgaccttgtgatcctcctacctcggcttcccaaagtgctgggattacaggygtgacccacagtgccccctgagaatttaattttattttatgtgcaagaggattccctgaggtagtcaggccacattgtctggtgactcttgggatagagg

SEQ ID NO: 24496 - DNA, 201 bp, Homo sapiens
acacctggctaattgttgtatttttagtagagacggggtttcaccatgttggttggccagactggtcttgaactcctgacctcaggtgatccgtctgcctyggcctcccaaagtgttggaattacagacatgacccactgcacccggcctgttgtcagtattcttaaacatagacactaactgtaggctgacagcctagca

SEQ ID NO: 24497 - DNA, 201 bp, Homo sapiens
cttcaggacctgacaggaagaaacatttcggattatctggtgaagacgtatgtgcagatcatagccaaaaggtgactttttactaaacttggcccctgccktattattactaattagaggaattaaagacctacaaataacagactgaaacagtgggggaaatgccagattatggcctgattctgtctattggaagtttag

SEQ ID NO: 24498 - DNA, 201 bp, Homo sapiens
atatttatttatttatttatttatttatttatttatttatttatttatttttcaagacggagtctagttctgtcgcccaggctggagtgcagtggagcaawctcggctcactgcaacttttgcctcctggtttcaagcgattctcctgcctcagcctcctagtagctgggattacagacgcccaccaccatgcccagctaa

SEQ ID NO: 24499 - DNA, 201 bp, Homo sapiens
ctgcagggaagattctttaaccccacatttcataggctcagagaggttaagtgccttggttagagccacatcagagttaatccacaagagccaggattcargcccaaatctgcctggatctgtgctctctaagataactgttagtggtggcgtgtgtgttctcacactcagacatttgatctgctctttgtttcccattct

SEQ ID NO: 24500 - DNA, 201 bp, Homo sapiens
tgatttccgtcttttctctctgccttttccccaagggccaggacccctggatctctgggcagagcagacgcaggcccctataatagccctcatgctagaarggagccggagcctgtgtataaggccagcgcagcctactctggacagtgcagggttcccactctcccaactccccatctgcttgcctccagacccacattc

SEQ ID NO: 24501 - DNA, 201 bp, Homo sapiens
gcaccacgcctggctaatttttgtatttttagtagagacatggttttagcatgttggccaggctggtcttgaactcctgacctcaagtgatccacccacckcagccttccaatctgctgggattacaggcatgagccactgcacccagccagagtaccactatttgggcattctttaatgaaaaagaatgaactatccaaa

SEQ ID NO: 24502 - DNA, 201 bp, Homo sapiens
aaaaactaacatttaagtagaatttcttgtgcactgtgcattctgtttaagttatctcattttaccctcatgataaccctgcagggaagattctttaaccycacatttcataggctcagagaggttaagtgccttggttagagccacatcagagttaatccacaagagccaggattcaagcccaaatctgcctggatctgt

SEQ ID NO: 24503 - DNA, 201 bp, Homo sapiens
aaaactccatctcaaaaaacaaattaaatccagagatttaaaagctctcagaggctgggcgcggtggcttacacctgttatcccagcattttgggatgccraggcgggcaaagcacaaggtcaggagtttgagaccagcctggccaacatagtgaaaccctgtctctgctaaaaacatagaaaaattagccgggcatggtg

SEQ ID NO: 24504 - DNA, 201 bp, Homo sapiens
caacatggggaaaccctgtctctactaaaaatacaaaataagctgggcgtggtggtgcgtgcctgtaatcccagctacttgggaggctgaggcaggagaaytgcttgaatctgggaggcggaggttgcagtgagctgagttcatgccattgcattccagcctgggcaacaagagcgaaaccatctcccaaaagaaaaaaaa

SEQ ID NO: 24505 - DNA, 201 bp, Homo sapiens
tagtatacttgaaatttgctaagagagtagatccgaagtgttcacactacacaaaaaaggcaactatgaggtgatggatttattaacagcttgattgtggkgatccttttacaaagtatacatatattaaaacatcacattgtataccttaaatatatacaatttttgtcagttgtaactcaaaaaagctagaaaagcatt

SEQ ID NO: 24506 - DNA, 201 bp, Homo sapiens
tccccatggaacaaactggacaaagtgagggtggccacatggcctcttttcttttgcctttattattaattttctcaaatagatctgactagtcatgtggytgggaaaatagttaattgtgatttttttttttttaaactgagtctcactctattgcccaggctggagtgcagtggtatgatctcagctcgccgcaacctc

SEQ ID NO: 24507 - DNA, 201 bp, Homo sapiens
tggcctcagctgaggttgctgctgtggaagaacctcactttcagaagaagacaaacagtaagcttgggtttttcagcagcggggggttctctcattttttstttgtggttttgagttggggattggaggagggagggagggaaggaagctgtgttggttttcacacagggattgatggaatctggctcttatggacacagg

SEQ ID NO: 24508 - DNA, 201 bp, Homo sapiens
agtagagatggggtttcaccatgttggccaggctggtcttgaactcctgacctcaggtgatccacccgcctcgacctcccaaagtactgggattacaggtrtgagccactgcacccggcccagactcgagtttttcatcttaatgctttttcattgcctgacactttactgagaccaagatagggaacttcacatacagta

SEQ ID NO: 24509 - DNA, 201 bp, Homo sapiens
agtgattctcctgcctcagactcccgagtagctgtgactataggtgcaaaccaccacgcccagctaatttttgtatttttagtagagacaggttttcactrtgttggccaagctggtctcaaactcctaacctcaagtgatctgcccgccttggcctcccaaagtgctgggattataggcatgagccaccgtgccccacca

SEQ ID NO: 24510 - DNA, 201 bp, Homo sapiens
ggcatggagatctcatttggactcacagatttctagtctagcgcttggttttgtatccatacctcgctactgcattcttagttccttctgctccttgttcstcatgcccagtgtcccaccctacccttgcccctactcctctagaggccacagtgattcactgagccatttcataagcacagctaggagagttcatggcta

SEQ ID NO: 24511 - DNA, 201 bp, Homo sapiens
gagaatgagaaagagaaactgttttgcaagtccgtagctatttctctagggccctgttagctgacattgacatgccttgcattgctctgcagatcccctcrcagccctctgtcccttgttcatttctggccttagagaaagcaaagcagggtctgtaacaggggaggctgcctctaaactcagggtttggttacagctgtt

SEQ ID NO: 24512 - DNA, 201 bp, Homo sapiens
tcactggatctatatatttttaaacggacagtgtgatagcagaacctcttatagaatgatagaattcctctggaatgattggataacttcatttcatcctygacttttaccttggaggatttcttaccccttttggcttctcaaatttgactattaaaatgttgcctttaaaaataggaacacagtttcaggggggagtac

SEQ ID NO: 24513 - DNA, 201 bp, Homo sapiens
gtgactgaaaaaaattgattttttttctatgacatagaatgttgaaaggttgatttcttttctagaggaaagattctttttttctatgtgctacatacccsccgaccagggaaaaggcaaatagtggtattgtttgctgaagtcttcctttgaaggttgcttggtgtttgcttagtggaaatcagcaggggaagagaggct

SEQ ID NO: 24514 - DNA, 201 bp, Homo sapiens
tttgccaggcaggcgtggtggcgcacacctgtaatcccagctactgaagaggctgaggcacaagaatcgcttgaacccaggaggtggaggttgcagtgagytgagatcactccactgcattccagccagcgtgacagagtgagactctgtctcagaaaaagaaaaaaaagatagaagttttcttctgtagatcagtgttag

SEQ ID NO: 24515 - DNA, 201 bp, Homo sapiens
gctgagatctgtctcactctgttgcccaggctggagtgcagtggcgcgatctcgactcactgcaacctccgcctctcaggcttaagtgattctcatgcctyagcctccgagtacctgggactacaggcacctgccaccacgcccagctattttttgtatttttagtagacatagggtttcactatgttgcccagctggtct

SEQ ID NO: 24516 - DNA, 201 bp, Homo sapiens
caattttttacttggttcataatgaaaactatactattgcttcagtcagatgtttgcgaatagctgtgtgatctcaaaatgttttcctatgtgatctatakaaaatggaatgatagagtattaggctgtaagggcctaagaaacaaaggaaaaagagaagtgaactgttagtttagttgtaaaacctaactttggtgaatt

SEQ ID NO: 24517 - DNA, 201 bp, Homo sapiens
tgttccagaatgacatatctgactgtaacctggacacgtgtgatatgttgtctcccctgcagatgagcatttgaaatctcaaccctcgtatttctacgagwgcaggcctataatggaccctgggcacattttttttttttttgagatgcagtctcgctctgtttcccaggctggagtgcagtggcacgatatggctcactg

SEQ ID NO: 24518 - DNA, 201 bp, Homo sapiens
atttgaaatctcaaccctcgtatttctacgagtgcaggcctataatggaccctgggcacattttttttttttttgagatgcagtctcgctctgtttcccargctggagtgcagtggcacgatatggctcactgcaacctccacctcctgggttcaagagattctcctgcctcagcctcctgagtagctgggactataggcg

SEQ ID NO: 24519 - DNA, 201 bp, Homo sapiens
gacagggtcctctgaagccacggctgccagtgcatgtgtcccagggaaagctttttcctttagttctcacacaacagagcttcttggaagccctccccggyaaaggtgctggtggctctgccttgctccgtccctgacccgttctcacctccttctttgccatcaggaggacagtgtttctcagagcagttctgatgctgg

SEQ ID NO: 24520 - DNA, 201 bp, Homo sapiens
agtgaagcctgtcatctactggctctctaattttgtctgggatatggtaaggacacaggcctgctgtatctttctgatgtctgtcagggccatggattgayatggataagaaagaaagagctctggctatcatcaggaaatgttccagctactctaaagatgtatgaaaaagaaatagccagaggcaggtgatcactttca

SEQ ID NO: 24521 - DNA, 201 bp, Homo sapiens
acctcttccagaatgggaactggacaatgcagaacccttcacctgcatgccagtgtagcagcgacaaaatcaagaagatgctgcctgtgtgtcccccaggkgcaggggggctgcctcctccacaagtgagtcactttcagggggtgattgggcagaaggggtgcaggatgggctggtagcttccgcttggaagcaggaatg

SEQ ID NO: 24522 - DNA, 201 bp, Homo sapiens
acttatatagcactgtgtggcaagtactgtttgaaatgtttttcacgtgtttattcattgtatttattttgagatagggtcttgctctgttgcacagggtrgagtgcagctgcacagacaaggctcactgcaacctcagcctcctgcgctcacgtgatcctcatacatcagcctcttaaggagctggggccacaggcacgc

SEQ ID NO: 24523 - DNA, 201 bp, Homo sapiens
ccaccatgcctggctagtttttgcattttcagtagagacagagtttcaccatgttggccaggatggtctcgatttcctgacctcttgatccacccgcctcrgcctcccaaagtgctgggattacaggcgtgaggcaccgcgcccgacccctggacacattttgacttagaacatattttcggtttgtgtgagacagtgcat

SEQ ID NO: 24524 - DNA, 201 bp, Homo sapiens
acacttgttttgtttatgctgagagaaggcctactccaaaaaatgcaaccatcttcgtatctgcatgtggatacaaccatgaatggccaaagttattgcartgttgaatagacacttatatagcactgtgtggcaagtactgtttgaaatgtttttcacgtgtttattcattgtatttattttgagatagggtcttgctct

SEQ ID NO: 24525 - DNA, 201 bp, Homo sapiens
cctcctagtgtaggatttgtctcagccactgcttgttgtcctggctgccaacgttctcatgaaggctgttcttctatcagtgtgtcaacctgaacaagctrgaacccatagcaacagaagtctggctcatcaacaagtccatggagctgctggatgagaggaagttctgggctggtattgtgttcactggaattactccag

SEQ ID NO: 24526 - DNA, 201 bp, Homo sapiens
aacggcttctctcccaggtaactctgagaaagtgttattaagaaatgtggcttctactttctctgtcttacggggctaacatgccactcagtaatataatratcgtggcagtggtgactactctcgtaatgttggtgcttataatgttctcatctctctcattttccagatattcctcaaggtggccgaagagagtggggt

SEQ ID NO: 24527 - DNA, 201 bp, Homo sapiens
gaaaaagcacgcacatctaaaacatgcttttgtgatccatttgggatggtgatgacattcaaatagttttttaaaaatagattttctcctttctggtttcygtttgtgttcttttatgcccttttgccagagtaggtggtgcaatttggctagctggctttcattactgtttttcacacattaactttggcctcaacttga

SEQ ID NO: 24528 - DNA, 201 bp, Homo sapiens
cctaggtgacagggtgagactccgtctcaaaataaaaaaaaaaaaagaaaaggaaaggctgtgtgtgtgtgtatgtgtgtgtgtgtgtgtgtgtgtgtgtgtaacagcaccatcacactgtttgagttgaggagcacatgctgagtgtggctcaacatgttaccagaaagcaatattttcatgcctctcctgatatggcga

SEQ ID NO: 24529 - DNA, 201 bp, Homo sapiens
ggaagcatcaggtaggtagcagtttgcaggagcactgattctgagggacactaactgggcctaagaacagctactggctgtcatgaggaataactaggagctagccatagaggggtagcagtgaatcatttctctagcgatgtaaatcttgctcaatttattctgtctatataactcaatattactgaagtttgcctaaag

SEQ ID NO: 24530 - DNA, 201 bp, Homo sapiens
tccttaactctcttcctgatttctaaaggaagtatattttgctgaatcagaaagaaaagtgatttatttcaggttgctgatgcttagattgttagagttgsaaagatctggcttgcatcttgtacagctgacagaactggggctcaggggggcacaggtgcccagagttggtcagtcaggaaagtagcaccagaaccagtc

SEQ ID NO: 24531 - DNA, 201 bp, Homo sapiens
ctgaccgagagtaaccccgtctggctcagctcagctcagcaaagggctttcctcctccgccttcctgagctgctctccctcctctcctttcctccttctttcccagcctcccccaagctccttcacccctctcttccctctcctccctcctcccaccttccttgtcctctatgctcagagaactgaaggaacactgaatgg

SEQ ID NO: 24532 - DNA, 201 bp, Homo sapiens
tgagcaaaacagtatagtggaaagaatgagggctttgaagtccgaactgcattcaaattctgtctttaccatttactggttctgtgactcttgggcaagtkacttaactactgtaagagttagtttccctggaagatctacctcctagctttgtgctatagatgaaatgaaaaaaatttacatgtgccagtactggtgaga

SEQ ID NO: 24533 - DNA, 201 bp, Homo sapiens
gttaccattcagggtcttcaaccctcattctagggacttccagtaacttctcccaccttccctcttctcagtaagacatgggtattgtcttattctgtttstgctgctagaagaaaattctcgagactgagtaatttatacacaatagaaatttacttctcacagttctggaggctgggaaatccaaaatcaaggtgttgg

SEQ ID NO: 24534 - DNA, 201 bp, Homo sapiens
atgcctttagccttgatcataaccttgaactctaatctcaaattctcacttgcctagtggattgctccatttagatagtatatagataccccaacctggayatgtcctagttttctttccccttggaacttaatgcttttcttgccatccctgtcacactcagtggcactaccatccactcggttgcccaagctggctctt

SEQ ID NO: 24535 - DNA, 201 bp, Homo sapiens
gggggctgccccccacctccctcccggacggggtggctggccgggcgggggctggcccccacctccctcccggacggggcggctggccgggcgggggctgscccccacctccctcccggacggggcggctggctgccctgctaatttttgtattttcagtagagatggggttttaccatgttggtcaggctggtctcgaac

SEQ ID NO: 24536 - DNA, 201 bp, Homo sapiens
ggacggggcggctggccgggcgggggctgccccccacctccctcccggacggggtggctggccgggcgggggctggcccccacctccctcccggacggggyggctggccgggcgggggctgccccccacctccctcccggacggggcggctggctgccctgctaatttttgtattttcagtagagatggggttttaccatg

SEQ ID NO: 24537 - DNA, 201 bp, Homo sapiens
actgcagcctcgaattcctgggctcaagtgatcctcctgccttagcctcccgaagggctgggatgacaggcatgagccactgcacctggccaactttttgytgattgcgaatagcactcttgtcaatttcggagagaagctgagactggcatatgtcagtatggatccccacttagagacctgtgtttatctgcactgaca

SEQ ID NO: 24538 - DNA, 201 bp, Homo sapiens
tggcaaaagaagaaatgataaagttctagagtttaaaccagactcagatttgagttttttttttttttttttttttttttttttttttttttttttttttwaaggctacaaaactgtgctttccttgggcagtaaaagaggcaatgggcaatgggggacctgatgacaaagggaagcaaagctgtcttaggggtggcatgg

SEQ ID NO: 24539 - DNA, 201 bp, Homo sapiens
tagaatagacccaaaggaaaagaaagaaagacagtgactaagatttgggtttgtctgccccaccaaatgctttgagcactttcataaatataaatccttcrggttgggagaaggttgaacatctgaagacactgattcttcagagatgtaatccaaacaaagtgatctttggtgatatggtcactaaaccatttatcccaa

SEQ ID NO: 24540 - DNA, 201 bp, Homo sapiens
ataagtactcacttcatttctctgtgtctcaggtttcccatttttaggtgagaattaaggggctctgataaaacagaccctaggattgtggacagcagtgrtagtcctagagtccacaagtctgcttttgagtgatgggcccatgtatctggcacatctgcaggcagagcgtggttctggctcttcagatgatgccggtgg

SEQ ID NO: 24541 - DNA, 201 bp, Homo sapiens
acttcactgtgaaattgccagaattaatcatggtaatagctactgtacacttactttgttccaggaactggataaatgttttacatacattatcagttctrttttttggagaagatacaggggctcagagtccctagggttccagagctggtgagtagcagagtcaggattcaaacccagctttctctgactctaaaacct

SEQ ID NO: 24542 - DNA, 201 bp, Homo sapiens
atgggacggacagacttggcatgaagcattgtataaatggagcctcaaaatcgcttcagggaattaatgtttctccctgtgtttttctactcctcgatttsaacaggccattttccaaataaagccatgccctctgcaggaacacttccttgggttcaggggattatctgtaatgccaacaacccctgtttccgttacccg

SEQ ID NO: 24543 - DNA, 201 bp, Homo sapiens
gctatggaggataggtgcaacctctgtgagaatgtagagaaaatagtataagtgagtggtgaggacccccaagagggggttttatagtaaaacaatggtcwgaagtggcaacaggataccgtataatgctttcacctctaccaatgcactgggtactggagagcgctccagtttgctctggaaaggccctttctgtggaca

SEQ ID NO: 24544 - DNA, 201 bp, Homo sapiens
tcttcttctcaaattgtatatttttattgtactttccttcaaaacccccttttaaaaagtaagcagtagataaataaattcagtgaagcatccatatgacycttaagtgagtgtaggggaagggaggtcaccagatcactgtgagtgaagatggtggagaggtgaggatcttatgaggccgtgctcaaggctggtagaggt

SEQ ID NO: 24545 - DNA, 201 bp, Homo sapiens
tagtgcatggggcctcattgttttaattagtgacaaaacaacaataataacaacaaaacccccgaagcttcacagatgacatcagaccccaagcctgtgtgtttttcaggtgcccttgaggagctttgtagctggcagaggaggtgaaactgacaaatgtttggcagatggaggagagtaccagaggggtttgagatgagc

SEQ ID NO: 24546 - DNA, 201 bp, Homo sapiens
ttactgtagtgaatctgctttaactatcttttcttatcgctgaggttttacttccattctacatgtgattgtggagcgctgcgtcattgtgggttcagtgyagtggagagtaggaagatggtgagacacagtagcttgttgcacattgcttaatttatcagggatcactgatgagttagtacactagagaagattgtaggt

SEQ ID NO: 24547 - DNA, 201 bp, Homo sapiens
gccaacatggtgaaaccctgtctctacaaaaatacaaaaaatagccgggcgtgatggtgggcacctgtaattccagctactcgggaggctgaggcaggagratcgcttgagcctaggaggtggaggctgcagtgagctgagatctgtctcactctgttgcccaggctggagtgcagtggcgcgatctcgactcactgcaac

SEQ ID NO: 24548 - DNA, 201 bp, Homo sapiens
ttgttataccactgcctgctaacctgttttccttaactctcttcctgatttctaaaggaagtatattttgctgaatcagaaagaaaagtgatttatttcargttgctgatgcttagattgttagagttggaaagatctggcttgcatcttgtacagctgacagaactggggctcaggggggcacaggtgcccagagttggt

SEQ ID NO: 24549 - DNA, 201 bp, Homo sapiens
agtttctggaccctgttcccagatcataccctagaatgtgaccttagaaacacacttcaggattcatacctttgattgaccatcaaaaagtttttgtatcrgccaggtgtggtggctcacgcctgtaatcccaccactttcggatgccacggcgggcagatcacgtgaggtcagcagtttgagaccagcctggccaacatg

SEQ ID NO: 24550 - DNA, 201 bp, Homo sapiens
gctggccctcgccgggctgcagaaatagaagtgtcttgcacacatgacatatgactgtctcaagagctggctggtgaaaggacgttctggagaaggctgcygatactgtatgaactagaactggacaagagcctggagattggataactcagtttggcgcaagtaaagggaataaaagtgttaaggtggcaaaattgtatc

SEQ ID NO: 24551 - DNA, 201 bp, Homo sapiens
actttgattaaattgtcactaaccgagttagctggccctcgccgggctgcagaaatagaagtgtcttgcacacatgacatatgactgtctcaagagctggstggtgaaaggacgttctggagaaggctgccgatactgtatgaactagaactggacaagagcctggagattggataactcagtttggcgcaagtaaaggga

SEQ ID NO: 24552 - DNA, 201 bp, Homo sapiens
aaaatgaaacccaataattccatttttgggaattattcccacttttgttccatttttcccactttgttctttggcacacagaatgtttgatttgtgaaaawcttaataacagtagttttttctataaggaacactcagaatcttgataatattggaataatacagatccttttgtaggatcctctcagacctcatataata

SEQ ID NO: 24553 - DNA, 201 bp, Homo sapiens
gtggtggcatgctcctgtagtcccagctactcgtgaggctgagacaggagaatcgtttgaacctgggaggcggaggttgcagtgagccaatatcacgccaytgcactccagcctggctgacagagtgagactccatctcaaaaaaaaaaaaaaaaaaagaattttataaaatcaggaaataatattagtgtttatgttgaa

SEQ ID NO: 24554 - DNA, 201 bp, Homo sapiens
aagatctgggtgaatgagtttaggtaagttgctgtctttctggcacgtttagctcagggggaggatggtgttgtaggtgtcttggattgaagaaagccttrgggattgtttgtcactcacacacttgtgggtgccatctcactgtgaggaggacagaagccctgtgaacatgtggagcacacaggggcacagacagattta

SEQ ID NO: 24555 - DNA, 201 bp, Homo sapiens
ccaaaaatgaaacccaataattccatttttgggaattattcccacttttgttccatttttcccactttgttctttggcacacagaatgtttgatttgtgaraatcttaataacagtagttttttctataaggaacactcagaatcttgataatattggaataatacagatccttttgtaggatcctctcagacctcatata

SEQ ID NO: 24556 - DNA, 201 bp, Homo sapiens
cttcaaaggtctgtaatcccacgtctataatcccagcactttgggaggccaaggcgggaaaatcacttgaggtcaggagttcgagaccatcctggccaacrtggcaaagcctgtctctactaaaaatatgaaaattagctcagcgtggtggcatgctcctgtagtcccagctactcgtgaggctgagacaggagaatcgtt

SEQ ID NO: 24557 - DNA, 201 bp, Homo sapiens
aaacacttagcgcgttgttgcttgggggattggattgtgtgaatttttcaaaactacagttgacagaaggaggctaccaaaaatgaaacccaataattccmtttttgggaattattcccacttttgttccatttttcccactttgttctttggcacacagaatgtttgatttgtgaaaatcttaataacagtagttttttc

SEQ ID NO: 24558 - DNA, 201 bp, Homo sapiens
acttcaaaggtctgtaatcccacgtctataatcccagcactttgggaggccaaggcgggaaaatcacttgaggtcaggagttcgagaccatcctggccaamatggcaaagcctgtctctactaaaaatatgaaaattagctcagcgtggtggcatgctcctgtagtcccagctactcgtgaggctgagacaggagaatcgt

SEQ ID NO: 24559 - DNA, 201 bp, Homo sapiens
gatgttgatgttggctgcttaaaattaactgtgaatcaaggcagggtttttatttttattttttttttactttaatgattgtgttaattatagtgaaaacyttgagttcacgagaaagaaagcctttggtcaagtattgtttattaagttgtcagtcttgttgcaggatttgcaaatttagtggaattagtgccatttttc

SEQ ID NO: 24560 - DNA, 201 bp, Homo sapiens
gagatcacttcaaaggtctgtaatcccacgtctataatcccagcactttgggaggccaaggcgggaaaatcacttgaggtcaggagttcgagaccatcctkgccaacatggcaaagcctgtctctactaaaaatatgaaaattagctcagcgtggtggcatgctcctgtagtcccagctactcgtgaggctgagacaggag

SEQ ID NO: 24561 - DNA, 201 bp, Homo sapiens
cgagatcacttcaaaggtctgtaatcccacgtctataatcccagcactttgggaggccaaggcgggaaaatcacttgaggtcaggagttcgagaccatccwggccaacatggcaaagcctgtctctactaaaaatatgaaaattagctcagcgtggtggcatgctcctgtagtcccagctactcgtgaggctgagacagga

SEQ ID NO: 24562 - DNA, 201 bp, Homo sapiens
cactgcactccagcctgggtagacagagcaagaccctgtctcaaaaaaaagaaatgaaagagaaagaaagaaagaggagaggagaggagatgaggggaggkgaggggaggagggagggggggaggaaggaaggaaggaaggaaggaaaaaaagatgaaaaaagaaaaaaacaagatgaaacagaggcagaaagactttacg

SEQ ID NO: 24563 - DNA, 201 bp, Homo sapiens
tagtgtcacaaagctcaggtgggatggacgagatcacttcaaaggtctgtaatcccacgtctataatcccagcactttgggaggccaaggcgggaaaatcwcttgaggtcaggagttcgagaccatcctggccaacatggcaaagcctgtctctactaaaaatatgaaaattagctcagcgtggtggcatgctcctgtagt

SEQ ID NO: 24564 - DNA, 201 bp, Homo sapiens
ctagtgtcacaaagctcaggtgggatggacgagatcacttcaaaggtctgtaatcccacgtctataatcccagcactttgggaggccaaggcgggaaaatsacttgaggtcaggagttcgagaccatcctggccaacatggcaaagcctgtctctactaaaaatatgaaaattagctcagcgtggtggcatgctcctgtag

SEQ ID NO: 24565 - DNA, 201 bp, Homo sapiens
ccagcactttgggaggctgaggccagaggatcgcttgagctccagagtttgagaccagcctggataacatggcaaaaccctgtctctacaaaaaaaatacraaaattagatgggtgtggtggcatgcacctgtggtcccagctacttgggaggctaaggtgggaggatcgcttgagcccagggagtcaagtctacactgag

SEQ ID NO: 24566 - DNA, 201 bp, Homo sapiens
ggggtttcaccctgttagccaggatggtctcgatctcctgatctcatgatccgcccgcctcggcctcccaaaatgctgggattacaggcgtgagccaccgygcccggcccagtatttttgttttatgaagatattacatttgtaaagtatgagcttggtgtcagcaaacttatatccctgtgtacaaactggccgaatcac

SEQ ID NO: 24567 - DNA, 201 bp, Homo sapiens
gccttgctccgtccctgacccgttctcacctccttctttgccatcaggaggacagtgtttctcagagcagttctgatgctggcctgggcagcgaccatgasagtgacacgctgaccatcggtaaggactctggggtttcttattcaggtggtgcctgagcttcccccagctgggcagagtggaggcagaggaggagaggtg

SEQ ID NO: 24568 - DNA, 201 bp, Homo sapiens
ggtaatctccaatttaaaagcctcaatagaatgataagattgagcttttctgtagttccatgacctccagcagagtctgcaaggccacagctgcctgaagrttgattctgtaattagaagatgccagggtcatctcagaatagaacctcaagccacccaggctacatttacagaatcagcctctccagaaaaacagcaaca

SEQ ID NO: 24569 - DNA, 201 bp, Homo sapiens
ccagacagggtcctctgaagccacggctgccagtgcatgtgtcccagggaaagctttttcctttagttctcacacaacagagcttcttggaagccctcccyggcaaaggtgctggtggctctgccttgctccgtccctgacccgttctcacctccttctttgccatcaggaggacagtgtttctcagagcagttctgatgc

SEQ ID NO: 24570 - DNA, 201 bp, Homo sapiens
gcctttgccacccctgctaagggataacctgaaataccttcaccatcactgccctgtgctgcttttcacctatgccagtctgtctacagtgccagtgtctyctggcattgaaaggggagaatcttttggtcctttgagtatttggttgggttacataaatctccctgaatgaagagcagctgacttaggcaaggggccttg

SEQ ID NO: 24571 - DNA, 201 bp, Homo sapiens
atctttctcacaatatatagcaacagttatttacttgctgattttctaatgcacatcacacatagtcatattaaacacacacacacacacacacacacacmcacacccctcaagaaacattttctgagacgtgatttcctgatttcatcaaaaaagaaaagagcgggccaggcacagtgggaagtcaaggtgggtggatca

SEQ ID NO: 24572 - DNA, 201 bp, Homo sapiens
gcctggtcccatctttctcacaatatatagcaacagttatttacttgctgattttctaatgcacatcacacatagtcatattaaacacacacacacacacmcacacacacacacacccctcaagaaacattttctgagacgtgatttcctgatttcatcaaaaaagaaaagagcgggccaggcacagtgggaagtcaaggt

SEQ ID NO: 24573 - DNA, 201 bp, Homo sapiens
tcaggagactgttttcagtcctagtgaatggtgataattgtaattataacagtagacaacatctcttttacacattttaaatcatgaaaatagaataaccktactgataattttagaaagtggtgattaaaagcacatttaagataatgccttaacacctagtcttttccatatgcatgatgtcttaatcacacattgcaa

SEQ ID NO: 24574 - DNA, 201 bp, Homo sapiens
gagtggtgggagagactggagaagttgattaattagtaaatgaagttgtctgtggatttcccagatcccagtggcattggatatccatattatttttaaawttacagtgttctatcttatttcccactcagtgtcagctgctgctggaagtggcctggcctctatttatcttcctgatcctgatctctgttcggctgagct

SEQ ID NO: 24575 - DNA, 201 bp, Homo sapiens
ctgtcccagtgagatgttgacacttgtatgatccctgcttggagacttccctcttctggaacctgccctggctcaggcatgagggctgactgtcacccttygataggagcccagcactaaagctcatgtgttggcagtgttcttgcgggaaggaaaaagaccagccagcccatttgttactgcacaagcaaacagcttctg

SEQ ID NO: 24576 - DNA, 201 bp, Homo sapiens
cagcagatcaagaaatccagctcaagtaagtaaaaaccttctctgcatccgtttataattggaaattgacctgcaccagggaaagagagtagcccaggtgkctggggcttgttcccattagatcttccccaaggggtttttctccttggtggctggcctgtggggcccctctccaggaggcattggtgaagaaactagggg

SEQ ID NO: 24577 - DNA, 201 bp, Homo sapiens
aaagcttagagagtggtgggagagactggagaagttgattaattagtaaatgaagttgtctgtggatttcccagatcccagtggcattggatatccatatyatttttaaatttacagtgttctatcttatttcccactcagtgtcagctgctgctggaagtggcctggcctctatttatcttcctgatcctgatctctgtt

SEQ ID NO: 24578 - DNA, 201 bp, Homo sapiens
gtggctcacgcctgtaatcccagcagtttgggagccctaggggagaggatcacttgaacccaagagtttgacgttccagtgagctatgatctccggatcgkaccgcctggacgatggagcaagaccctgtctcaaaaaaaaaaatctttgctttttttttttgtttgtttttgagacggagtctctctctgttgccccagc

SEQ ID NO: 24579 - DNA, 201 bp, Homo sapiens
agtggctcacgcctgtaatcccagcagtttgggagccctaggggagaggatcacttgaacccaagagtttgacgttccagtgagctatgatctccggatcstaccgcctggacgatggagcaagaccctgtctcaaaaaaaaaaatctttgctttttttttttgtttgtttttgagacggagtctctctctgttgccccag

SEQ ID NO: 24580 - DNA, 201 bp, Homo sapiens
gaaatgttaaatattggactggcctcatttatttctcctgtctgttggtccaatttgaatcttaaggcgtctttcaactggaattttttgtttctctcaamtaaaaattgttctttgtaagtttgaatcagaacaaaatcctgaatgttgagggtttcctaaaggctgtttctttatgcaaaagcctgaaacccgatgttg

SEQ ID NO: 24581 - DNA, 201 bp, Homo sapiens
tttttattttcaaattttccataaaaatataaggacttgaagatcaagaaaaaatttctgctttggctcagtgcagtggctcacgcctgtaatcccagcastttgggagccctaggggagaggatcacttgaacccaagagtttgacgttccagtgagctatgatctccggatcgtaccgcctggacgatggagcaagacc

SEQ ID NO: 24582 - DNA, 201 bp, Homo sapiens
tagtctcttgcctctttaatccaggcttcttcatactataccagaatttaggataactattacagtgccctttataggagagaaagaagaaattgtgtctrtagatgtctgttcctttcagcttaaaatggacactgaaatgttaaatattggactggcctcatttatttctcctgtctgttggtccaatttgaatcttaa

SEQ ID NO: 24583 - DNA, 201 bp, Homo sapiens
ctcccaccacacgagtcccttctccctgctttggctcctcaccagttgtcaggttatgattatagaatctagtcctactcagtgaaagaactttcatacaygtatgtgtaggacagcatgataaaattcccaagccagaccaaagtcaaggtgctttttatcactgtaggttggtgagtgggcgattcggaaactgggcct

SEQ ID NO: 24584 - DNA, 201 bp, Homo sapiens
tatcaaaggtctttggaaataaaaaacagttttttaaaaatatcagaaataaaacaacaaataaataaataaataaaaacacccaaaacaatctgaagcaygagcacctagcagaaaggttcaattatgatctattcatagagtggaatatcaagtagacattacaggacatgttttaagattatattttatgtcatggga

SEQ ID NO: 24585 - DNA, 201 bp, Homo sapiens
tgccctccagcctgggtgacagagcgaaactctgtgtcaagaaacaaaaaaaaggacttgttttctgttccattacccacagtggtagaatggcgtgctaratttattctccagctgccattaactgcaaattaaaatcttagtctcttgcctctttaatccaggcttcttcatactataccagaatttaggataactatt

SEQ ID NO: 24586 - DNA, 201 bp, Homo sapiens
gggtgggggtgggggtgggggtgggggtgggggccggcccggcccggcccggcccggcccggcccggcccggcccggcccggcccggcccggcccggcccrgcagtctgcattttaacaagctctccaggtgattctgatgcatacttaagtttgagaaccattgcttgttttgcattaaacaggagattagtctctgcag

SEQ ID NO: 24587 - DNA, 201 bp, Homo sapiens
tatgtaaggaagttcagggaatagtataagtcactccaggcttgaggcaaaatttacaaatgctgctgactttgtatgtaaggggaggcattttcttagaraagagaggtaggtctctgggattccagtatgccatttccatcctcagtgtttttggccacctgagagaggtctattttcagaaatgcattcttcattccc

SEQ ID NO: 24588 - DNA, 201 bp, Homo sapiens
tcttctgctctttgggatgtatattccatggctactgaatacccaagtcccaaacagttttcttagactcagaaggtcatccacttcagcttcttcatcaraaagacatattttctggctgggcacggtggctcacacctgtaatcacagcactttgggaggtggaggcaggagaattgcttgaacccaggaggctgaagt

SEQ ID NO: 24589 - DNA, 201 bp, Homo sapiens
ccagcaatgtgggagaaaatagcaacatatttttgatgttggggtctagtgttacggtttcttctgctctttgggatgtatattccatggctactgaatamccaagtcccaaacagttttcttagactcagaaggtcatccacttcagcttcttcatcaaaaagacatattttctggctgggcacggtggctcacacctgt

SEQ ID NO: 24590 - DNA, 201 bp, Homo sapiens
taaagcagaatacacctggatcatacagcatttatgagagactggctgggctgtcaggccctcctgttactttatctctgcatgtgaccctcttagctccrcggattaactcctgtcctcattaagcctcacactgtagccccattttcagatcaaacctgtttctcttctggtaaatgatttcagtttgcaaagtttgcc

SEQ ID NO: 24591 - DNA, 201 bp, Homo sapiens
gatttttcttgggtagcgtgtgtaggaggccagtgtcaccagtagcatatgtggaacagaagtcttgacccttgctatctctgcctagtcctaatggctgrcttttcccaggaaggcttctgcttccatggactgttagattaaccctttatttaggtaaatgagggaacctactttataagcataggaaagggtgaagaa

SEQ ID NO: 24592 - DNA, 201 bp, Homo sapiens
ggagaagttaaataacttgttcatggttccatatttggctaatggcagagccagggattcaaactcttgtctctctgactcccaggtttgtgcttttcccmcttggctgaatttctcatgctacctcctccataacacctttcctagaacttttaaggaatgcttcccctgttctctcatagcattttaatgtaagttgcc

SEQ ID NO: 24593 - DNA, 201 bp, Homo sapiens
cagctactggctgtcatgaggaataactaggagctagccatagaggggtagcagtgaatcatttctctagcgatgtaaatcttgctcaatttattctgtcyatataactcaatattactgaagtttgcctaaagcagaatacacctggatcatacagcatttatgagagactggctgggctgtcaggccctcctgttactt

SEQ ID NO: 24594 - DNA, 201 bp, Homo sapiens
ctgggcatgaaagaaagtaatgataatagttaattttatatagcgttgttaccatttacaaccttttttttttttttaacctctatcatctcaattaaagbgcagagagaccctgggaagaaggtaactatatttattatcccagatgagggaagtgaggcttgtagggaattggtagctgattcaaggtcacccagcagg

SEQ ID NO: 24595 - DNA, 201 bp, Homo sapiens
tcccacatttggggaaatactgagcttgcctattattatattagccccatatttcagatgatgcacctgagccgaggagaagttaaataacttgttcatgkttccatatttggctaatggcagagccagggattcaaactcttgtctctctgactcccaggtttgtgcttttcccacttggctgaatttctcatgctacct

SEQ ID NO: 24596 - DNA, 201 bp, Homo sapiens
aagtgtaagggatgcttattcaaatgtagatttgtaggctctgcactctagacccactatttcagaatctctggggactgggcccaagaaactgcattttmgcatgctccctaaatgaagcttaggtgctctgaggtttgacaactgcagtagagagcctaatgctaacagtgtagagtcacatgtgatgggaagcatcag

SEQ ID NO: 24597 - DNA, 201 bp, Homo sapiens
ttcaagaatagcatgctagtacccatcctaggaggagaattggactatacctcatgaggatagtttgaagtatctcagaagaccctcactgggggtaggtsggtaagacacaaagctttctaaagcactgtaccaaatttgttgtttgagagatcataacaaattagaagtggaaagaagaaggagtaaaaggaagaagag

SEQ ID NO: 24598 - DNA, 201 bp, Homo sapiens
ttccctatcctataggcatagtctggtagagacaacatgcaagtaaaacaatgttccttaaactgtggttccacacctccctcccccaacattaaaagtgyaagggatgcttattcaaatgtagatttgtaggctctgcactctagacccactatttcagaatctctggggactgggcccaagaaactgcattttcgcatg

SEQ ID NO: 24599 - DNA, 201 bp, Homo sapiens
ggggccatgccacccagagttatgagtacctgggactccagaattccttgcctggtggcctccacatgcacttccagggcctgcttgggcctcttctatgsgtctgtcctgagtgttgatagaaccactgatgtgagtacctgggcttgagccgtggcctggagatcctgttgactgtagcatggagggggcttgtgcagc

SEQ ID NO: 24600 - DNA, 201 bp, Homo sapiens
ccatgtgaccttggacaagtcattttacttttctgttttttaggttgttggtctgtaaaatgatactacttgacttttaaagagcccttcaagctcttatstcctctaaccccaggtctgtattcagaagaaggggtggtcctttaattagagccatctagagatctgaggaacatgctgggcattagtgtaacataccat

SEQ ID NO: 24601 - DNA, 201 bp, Homo sapiens
agtgttgatagaaccactgatgtgagtacctgggcttgagccgtggcctggagatcctgttgactgtagcatggagggggcttgtgcagctgaatgtctgyatgcaggtggtgggagttctggaatatgatggagctggaggtgggaagagaagtaggcttggggcagctctctcatgccacctcattctggccaaaactc

SEQ ID NO: 24602 - DNA, 201 bp, Homo sapiens
tctttgcctcagtttcatcatctgtaaaataggtatttgtgtttgtgtataatgtgaaccgtataatataatgcttggcctatagtgaaatttattcataygagtgttttcagtgattttaaaagcttgctttaggccgggcgcgatggcttctgcctataattccagcactttgggaggccaaggtgggcggatcatgag

SEQ ID NO: 24603 - DNA, 201 bp, Homo sapiens
agcttgatcacatccagatgttctcatcttcagagcctgttaacataacagaagtcttataaacatgctgagcacactcactggtctggagagtgttgcargatgacctaggcccattgcaggggtggcctgggtcgccctcccacacttctgccaccctgcttgggaaggagggagctgttttgaagttccctggtgcaa

SEQ ID NO: 24604 - DNA, 201 bp, Homo sapiens
atttggggagttttctgcatggtagaatagacccaaaggaaaagaaagaaagacagtgactaagatttgggtttgtctgccccaccaaatgctttgagcastttcataaatataaatccttcaggttgggagaaggttgaacatctgaagacactgattcttcagagatgtaatccaaacaaagtgatctttggtgatatg

SEQ ID NO: 24605 - DNA, 201 bp, Homo sapiens
aagtcactttctcacagtcacacagctatttcacaggagagtgcagtatcaaatttaggtttttctggtcccaaaccctgatgtttcccccacatcattgkttctcagacttggctgcaatcacctgaaaaattttattaaattctttttttttttttttttgagacagagtctcgctctgtcacccaggctggagtgcaa

SEQ ID NO: 24606 - DNA, 201 bp, Homo sapiens
aattggtaagaaaatttgtgctcagggaggtaaagtcactttctcacagtcacacagctatttcacaggagagtgcagtatcaaatttaggtttttctggkcccaaaccctgatgtttcccccacatcattgtttctcagacttggctgcaatcacctgaaaaattttattaaattctttttttttttttttttgagacag

SEQ ID NO: 24607 - DNA, 201 bp, Homo sapiens
ccttcacttaattggtaagaaaatttgtgctcagggaggtaaagtcactttctcacagtcacacagctatttcacaggagagtgcagtatcaaatttaggkttttctggtcccaaaccctgatgtttcccccacatcattgtttctcagacttggctgcaatcacctgaaaaattttattaaattcttttttttttttttt

SEQ ID NO: 24608 - DNA, 201 bp, Homo sapiens
gactctgaattcagactggtctgactttgagtctcagctccacatctagtaatactatgaccaagccctggttaaaatcatgtttttttttcttcagcctyagtcttctcacatataaaatagggacactgtcatttacctcagttttctgtgaggataaaacaacgacagtgtatatgcaagtattttgtaaattttgta

SEQ ID NO: 24609 - DNA, 201 bp, Homo sapiens
tggcagtcacagacactgcctagggtttctgactcacgctgttgggactgttctatgcagggcaccctcttgtgtggcataggatttgtgcctcaccacasactgttgtagctttgctgtcttgatgatgagtagagggcagtgtccaggccatggtataagcatctactgccccccagggttaccaaaaccaagccaagt

SEQ ID NO: 24610 - DNA, 201 bp, Homo sapiens; identical to SEQ ID NO: 3419

SEQ ID NO: 24611 - DNA, 201 bp, Homo sapiens
gcttcgggaagtgctcggtttcggggactttgatccggagccccacatccccaccacttgcaactcagatgggaccggaggcggtgttaaatggggagackatgtcctagtacgagctctggtgaccccaggactctgcgctgctgcgcttggggcttgcccgacggtggagaccggggagcatctctgggcgtggagacc

SEQ ID NO: 24612 - DNA, 201 bp, Homo sapiens
tttcacccttttgaccaggctggtcttgaactcctgacctcatgatcaacccacctcagcctcccaaagtgctgggattacaggtgtgagccaccacgccmggcctcataagtattttctaaatttatttacagtcatgccatttaaaaggaaagttgtattcctgtctttgttaatatttataagtgattttattcagct

SEQ ID NO: 24613 - DNA, 201 bp, Homo sapiens
gagtacacagtagctgcccaatattggctgtaagtattataaatctacaagctgtgaattaattttacctctctggatcctgttgatatttctagaccatkccacctagtggggccatttcctacctgagtcacccgtggtgtcaaatagaatgtcatgtggcctcctgagttgggtagaattggctgctcatctcaaccc

SEQ ID NO: 24614 - DNA, 201 bp, Homo sapiens
aaaaaaaaaaaaaaaaaagatgtgtagggagcaattttggagttattcatttggtcatttgatatgtagttttagttttggtgctgatagagcccagaatktaccctgaatttgatgaacattctgatatatgggggagctcattgtcccccacttacctttttgcctctcagaatatcttttgatatttttatctgtttt

SEQ ID NO: 24615 - DNA, 201 bp, Homo sapiens
gcctggctaatttttgtatttttagtagagacatggttttagcatgttggccaggctggtcttgaactcctgacctcaagtgatccacccacctcagcctyccaatctgctgggattacaggcatgagccactgcacccagccagagtaccactatttgggcattctttaatgaaaaagaatgaactatccaaaaattaaa

SEQ ID NO: 24616 - DNA, 201 bp, Homo sapiens
tcaaaagggcacaatgttttggtgaggaagaggtgggagaacacgtgccaggtgctaactagggtcatcatttcccccttcacagccagcttcctgtgaaygtgtgtgtgtgtgtgtgtgtgtgtgtgtgtgtgtgtgtgtgtatttcttttgccagcatcactgaatctgtctgctgtctggtattccaggttttggttt

SEQ ID NO: 24617 - DNA, 201 bp, Homo sapiens
tagtattaggacatcttggagtatagatgcaaatattggtgaaaaagaacatggatatcagagtcaaattaatgtagattggaattctggttattactaawggatatctgacattaggcaagttgctgatcactctttgcctcagtttcatcatctgtaaaataggtatttgtgtttgtgtataatgtgaaccgtataata

SEQ ID NO: 24618 - DNA, 201 bp, Homo sapiens
gtttctgtagctcagggtgtttatgaattcactaatcccttcccttcagatcccttttattctggtgttatgattgtgactgaaaaaaattgattttttttctatgacatagaatgttgaaaggttgatttcttttctagaggaaagattctttttttctatgtgctacataccccccgaccagggaaaaggcaaatagtg

SEQ ID NO: 24619 - DNA, 201 bp, Homo sapiens
tctattcttctataaagtcttttcttggggggtgtttgtttaaaattccccggtgttttctctgccaaatccaacttccaagaagcatttggaagtcaaarcattttatctggttagtcttaaagtccagatattttgtgatagctggtatttagtttatgatatttcccaggaagaactttttagtagttgaaccattta

SEQ ID NO: 24620 - DNA, 201 bp, Homo sapiens
gatttctctctttttttttttttttaagatggagtttcactcttgttgcccaggctggaattcaatggcatgatctcggctcactgcaacctctgcctccygggttcaagtgagacttgatggtctcacttgatggtttcctggctcagcctcctgagtagctgagattacaggcacccactaccatgcccagctactttt

SEQ ID NO: 24621 - DNA, 201 bp, Homo sapiens
actagagaagattgtaggtagagctgaaaagatggaggaattataaggctcagatttctctctttttttttttttttaagatggagtttcactcttgttgyccaggctggaattcaatggcatgatctcggctcactgcaacctctgcctcccgggttcaagtgagacttgatggtctcacttgatggtttcctggctcag

SEQ ID NO: 24622 - DNA, 201 bp, Homo sapiens
gagatgactcactaagtaatttagagatttaaacacttttttaaaaaacagtaacttcatatgcattggatctattcttctataaagtcttttcttggggkgtgtttgtttaaaattccccggtgttttctctgccaaatccaacttccaagaagcatttggaagtcaaaacattttatctggttagtcttaaagtccaga

SEQ ID NO: 24623 - DNA, 201 bp, Homo sapiens
agtatctctgatcttcatatctttgaaatgtggatactattaccttcacttaattggtaagaaaatttgtgctcagggaggtaaagtcactttctcacagkcacacagctatttcacaggagagtgcagtatcaaatttaggtttttctggtcccaaaccctgatgtttcccccacatcattgtttctcagacttggctgc

SEQ ID NO: 24624 - DNA, 201 bp, Homo sapiens
aaaaagtgagtactgggaggggcaaggctgaaagttctccactccccgaggtgctgcaggagcaggagtgctgggtgggctagtgccaggtgccccaggcscagtcccaggtgtgccgggcacgggaggagtgccaggtgagctgtgtctccagcccagagatgggtttggtttgtctcatggaagggtccctggagttga

SEQ ID NO: 24625 - DNA, 201 bp, Homo sapiens
ctctctccccgtcctggaattaataaagactctgtgcagactgcggtttgcaagtctgaaagctggttcctgcccgtgtcactgcctcgagaagagagggstccagctccccacagtagcccctgccttcctccttcccaggcaggcggaggcacgcagatataccattgacttcccctcccctgcagcaggcacatcctg

SEQ ID NO: 24626 - DNA, 201 bp, Homo sapiens
gagaccagcctgggcaacatggtaaaatcttgtcactacaaaaaatacaaaaaaaaaaaaatttgccgggcacagtggcatgcacctgtagttccacctasttggaaggctgaggcgggaggattgcttgagcctgggtggttgaggctgcagtgagccaagatcgcaccactgcactccagcctgggtgacagagtgaga

SEQ ID NO: 24627 - DNA, 201 bp, Homo sapiens
ccggccatccgaggggtccctggtggcctctgggaagagaggaactgcagaagtccctttcattttccagctgaggtgctggctctgggccgatgctgccrggcaccccacaggaggtagccgccctctctggctcagtcaccagcacgagggcagggccactcctttggggctgcttgtcacgggtgccctttgccagcc

SEQ ID NO: 24628 - DNA, 201 bp, Homo sapiens
agagaaaagtaaatggggccaggtgcagtgactcatgcctgtaatcctagcactttgggaggcccacatgggcagattgcttgagcccaggagtttgagamcagcctgggcaacataggaaggcccccgtctctatttaaaaaataaatgaatatttaaaaagaaagaaaaagaaagaaagagagagagagagagagaaag

SEQ ID NO: 24629 - DNA, 201 bp, Homo sapiens
tgcctgggtgggaagggctggggaggggtccctggaggctgagctgctgctagtaactttgctttcttttggccacaggtgtggggctgccaggtgtatavccaggtggcgtgctcccaggtgagagcaaggagggaaacagggactctataggaagaaagcagccaggacgcagtggctcatgcctataatcccattgct

SEQ ID NO: 24630 - DNA, 201 bp, Homo sapiens
tgcaaggcctgccttcctacactcactgctttgtcccccggcaggagctcggttccccggtgtgggggtgctccctggagttcccactggagcaggagttwagcccaaggctccaggtatgcagctgtctggacagagggctgatggcagggactctccaaccaccttctggccccgggtgtgaaatggggtgggatcctg

SEQ ID NO: 24631 - DNA, 201 bp, Homo sapiens
ggtctccatccctgccctcccacctatcaataatgagaccttaagtgagctgtgttgcttctttgagcctctgtgttctcatctgtaaaatggacataacractccatacatgtgtttgtatttgttttcactctggctgggggtgacaggtgcagactcaggacagcttgggccccgagggcagagcagggggaggggga

SEQ ID NO: 24632 - DNA, 201 bp, Homo sapiens; identical to SEQ ID NO: 3456

SEQ ID NO: 24633 - DNA, 201 bp, Homo sapiens
aaactctctccccctggctccggactctctccccgtcctggaattaataaagactctgtgcagactgcggtttgcaagtctgaaagctggttcctgcccgygtcactgcctcgagaagagaggggtccagctccccacagtagcccctgccttcctccttcccaggcaggcggaggcacgcagatataccattgacttccc

SEQ ID NO: 24634 - DNA, 201 bp, Homo sapiens
tggtcaacatggtgaaaccctgtctctactaaaaaaaatgcaaaaattagccaaacgtggtggacgcctgtaatcccagctactcgggaggctgaggcggragaatcactggagcctgggaagcggaggttgcagtgagccaagatcgcaccactgcactccagcctgggtgacagagcaagaccccatctcaaaaaaata

SEQ ID NO: 24635 - DNA, 201 bp, Homo sapiens
ctccccacagtagcccctgccttcctccttcccaggcaggcggaggcacgcagatataccattgacttcccctcccctgcagcaggcacatcctgggcatygagcttcagaccctgcccctgagcagcccctaaccccaccaacaaagggtggcttgggggggctttcaccccagcataatctccatcagctaccctcaaa

SEQ ID NO: 24636 - DNA, 201 bp, Homo sapiens
aaatgcagcagctcacaactataatcccagaactttgggaggccaagtcgggtggatcacccaaggtcaggagtttaagaccagcctggccaacatggtgraaccctgtctctactaaaaatacaaaaaaattagccgggcatggtggtgcgcacctgtagtcccagctactcaggaggctgaggcaggagactcacttga

SEQ ID NO: 24637 - DNA, 201 bp, Homo sapiens
agaaaaccctccagcctgtgccaagggctgcaggcccaaactggggcccaggccccaggagggagagaatcccgtagcttcctggaggaagtggcctgtcmctgggaatttctcaactgacccatgatggagattcagggagtccctcgaagcaggatggtttctggatgctgtagcaagctccttctgtctgagcagaaa

SEQ ID NO: 24638 - DNA, 201 bp, Homo sapiens
tttgagtactgatggggtcttgaatgaacaagtaaatgaatgaatgaatggatggtggccgatgactgtcatctctagttcttacattatgtatcttatgyatcagactacacggcatggatattcagtgcaatggatttgattgtgaattgaggcccccttttgcaatcttgttgcatgttatgttcgtggagctcctgc

SEQ ID NO: 24639 - DNA, 201 bp, Homo sapiens
agacagagtcccactctgtcacccaggctggagtgcagtggctcagtctcagctccccgcacctggtgcagttgatctcagctcaccacaacctccacctmcccggttcaagtgattcttgtgtctcagcctcccaaatagctggaattaccagtgtgcaccaccacgctcggctaatttttgtattcttagtagagacgg

SEQ ID NO: 24640 - DNA, 201 bp, Homo sapiens
tgctcaggtgcccgggtgcccgccctgtagggggatcagagcatcctgggggagggcccagcgggaacccctgggtctggagacaccacagtctgcacacytgtggacacagctggggtgcacaccagccctggggacagggaacctgggcttgataccagctcaaccgcagtgagctgtgtgacctcagcaggttccttg

SEQ ID NO: 24641 - DNA, 201 bp, Homo sapiens
ctgctgtgttctccctgctgaggcaggcagggactcctggtatgcatttgtgtgtgtgtgtgtgtgtgcatgcacacaggaatgagcgtgctgtgtgctcrtgtgtgtatgtgtgcatgcacaggtgtgcatgtgtgcagatgcccggctgtgtcactgaacagggaaagggatttctggaggggtacatatgtctgctca

SEQ ID NO: 24642 - DNA, 201 bp, Homo sapiens
ctctctccctccctctttccctcacagccgacgaggcaacaattaggctttggggataaaacgaggtgcggagagcgggctggggcatttctccccgagarggcgggtctgacggcggcggccccgcggcccggagtcctcctgctcctgctgtccatcctccacccctctcggcctggaggtaaggacccctcgcccctg

SEQ ID NO: 24643 - DNA, 201 bp, Homo sapiens
ctggtatgcatttgtgtgtgtgtgtgtgtgtgcatgcacacaggaatgagcgtgctgtgtgctcgtgtgtgtatgtgtgcatgcacaggtgtgcatgtgtkcagatgcccggctgtgtcactgaacagggaaagggatttctggaggggtacatatgtctgctcacaggttcatccttaggcaggtgtatgcgtatgtttg

SEQ ID NO: 24644 - DNA, 201 bp, Homo sapiens
ctacttacaccatgttttgtctagtggaggggcagctaatgtgtaaatagatgtgcaatgatgaaagaagcagacaggactcggttgggggtggccagaakgagccttgagaaatccaggaaggcttcccagcagaagtgacatttgagttaaacctaaagagaaaagtaaatggggccaggtgcagtgactcatgcctgt

SEQ ID NO: 24645 - DNA, 201 bp, Homo sapiens
caattccaccatccctaagcttgccctgaccctgacagttacatggtccctgtgtccaggaagggactgggcctgctgtgggtatgaggagtctgggcagyctctgcctccaccccagctctctggcccgagcaaaggagctggtattcctcatctgggcaccccgggcccccgcccgccttcctgtcctgccagcaggac

SEQ ID NO: 24646 - DNA, 201 bp, Homo sapiens
cctaagcttgccctgaccctgacagttacatggtccctgtgtccaggaagggactgggcctgctgtgggtatgaggagtctgggcagtctctgcctccacyccagctctctggcccgagcaaaggagctggtattcctcatctgggcaccccgggcccccgcccgccttcctgtcctgccagcaggaccgctcccaccacg

SEQ ID NO: 24647 - DNA, 201 bp, Homo sapiens
taacgtacatgaaacttccacacacccaggtcatgcggatgatgctgatgtccataatagatgcacattttgacactacagaaggtaggaacattgacacrcctaccagaagtcacacccacttaaaaatgcaattaacaagacattgatttacagctattaagagcatacaggctggacatggtggcttatgcctgtaat

SEQ ID NO: 24648 - DNA, 201 bp, Homo sapiens
tcttaagccaggtaagacccaaggcctcggagcattgagagacagcgagggagctggggagggaggagcctacccagctgggaatgggacaaggaaactasgaacaggacaaggaagccaacgggcaggaggaaggagggaggtgtggacaccgattagcctcccaaggatgagtaggccggggccaggtcccagggcttc

SEQ ID NO: 24649 - DNA, 201 bp, Homo sapiens; identical to SEQ ID NO: 3451

SEQ ID NO: 24650 - DNA, 201 bp, Homo sapiens
atagaaaatcagcatagaccaatagtgagtaaggagattaaatcagtaataaaaagtctcccaacagagaaaaacccaggaccagatggcttcactggagrattctaacaaacatttaaaaaattaacaccaatcctcctgaaactcttccagaaaactgaagtagagggaacacttccaatctccttctaagaggccagc

SEQ ID NO: 24651 - DNA, 201 bp, Homo sapiens
tatctgcaaggaagcagaagagagacctcactggcctggggtgaggtctcgctcacggactctgctctgtcccagcccttgctgaaagccctgctgaatcytgttagccagcagggcttctaggagaagcacaggcctggcccaggcttgttagggatcggtgcaatgacacctgcactgcacatagtagtcgctcactaa

SEQ ID NO: 24652 - DNA, 201 bp, Homo sapiens
cagcagggcttctaggagaagcacaggcctggcccaggcttgttagggatcggtgcaatgacacctgcactgcacatagtagtcgctcactaaactactgrtggatgctattttatcaggatcgaccctgagcatcacaggcttagggaccagcctagggacctgagtggctgatcacagcactgccctaactccaggaga

SEQ ID NO: 24653 - DNA, 201 bp, Homo sapiens
gaagcctccatgggccccgcctccatctctaatccccctctctctccctccctcagctgcagcaaaatccgctgccaaggtggctgccaaagcccagctcygtgagtgcctcgcccacctttctctcctctccccaacgatctcagagctggttaggggcaacagccagggaggaggccgctgcttggatctgggcccctt

SEQ ID NO: 24654 - DNA, 201 bp, Homo sapiens
tcggaggtatccctggagtcgcaggtgtccctggtgtcggaggtgttcccggagtcggaggtgtcccgggagttggcatttcccgtgagccttagtcacayctggggacatgggttgagaagggatgggggcttcttgtctgctcggctctgcaggggcagtggggactgtagatcgggcttgaatgtgctcagggaggag

SEQ ID NO: 24655 - DNA, 201 bp, Homo sapiens
cagaggacacctccgccctccacaggccgaggcttcagtcccacctttctgaccagcggagtctaatgctcagctgtctccacaggcctagtgggagccgmtgggctcggaggactcggagtcggagggcttggagttccaggtgttgggggccttggaggtgagagttgttctgaaatcagtgagtgtgtgtggtgtgtg

SEQ ID NO: 24656 - DNA, 201 bp, Homo sapiens
agcccctctgtggacaggaaaggtctgagcatgtcccttgccctctcagagctcaggaaacatgcctggcttgagagaagcgactgccagcgcaggtgggkctggcccgggtgctgggaagtgactcctgcctgatcgccaggcactcccgcccggaggcaaagatgcttcttacatgaggctggctgagtttcagagggg

SEQ ID NO: 24657 - DNA, 201 bp, Homo sapiens
agtcggagttggaggcattcctacttacggggttggagctgggggctttcccggctttggtgtcggagtcggaggtatccctggagtcgcaggtgtccctrgtgtcggaggtgttcccggagtcggaggtgtcccgggagttggcatttcccgtgagccttagtcacatctggggacatgggttgagaagggatgggggct

SEQ ID NO: 24658 - DNA, 201 bp, Homo sapiens
gctaaggcagctgcaaaggcagccaaatacggtgagtgctatgctgacagctctgccccaccctgtcctggcctttacttgccagaactaaaggaccctcytctacttgcccagagaagggaagtgacttgcccaaggtcaccgagcaagtcaccagcaggcctcaggacaatgtctcccccatttgtctcccaccacagg

SEQ ID NO: 24659 - DNA, 201 bp, Homo sapiens
cttgtgtcaaaaaaaaaaaaatccattaccggtgagcagtgctcacatggatgtcctgcaggcattgatgtctggcagagagcggaagagcctccaatgtrcttcctgagtggggcacagccaggcagggccagagcgtaggagtcttcataggtgtggtagctcaggacctcaccccatcctcccctccgcagggctcgg

SEQ ID NO: 24660 - DNA, 201 bp, Homo sapiens
gcatttttaaaataatctattctcttattcagagtctgctaatttgggctcatggatccttgtaattagtgcacattgctaaggtttaatactccctctcrctacttacaccatgttttgtctagtggaggggcagctaatgtgtaaatagatgtgcaatgatgaaagaagcagacaggactcggttgggggtggccagaa

SEQ ID NO: 24661 - DNA, 201 bp, Homo sapiens
caggacaaggaagccaacgggcaggaggaaggagggaggtgtggacaccgattagcctcccaaggatgagtaggccggggccaggtcccagggcttccagraacaagaggctggaagcagctccatgtcctccctgtgtgagggcgtctagcatctaccctacatgtgcatgtgtgttcacccagctgtccagagactcct

SEQ ID NO: 24662 - DNA, 201 bp, Homo sapiens
tggggcctggaggcaaacctcttaagccaggtaagacccaaggcctcggagcattgagagacagcgagggagctggggagggaggagcctacccagctggraatgggacaaggaaactaggaacaggacaaggaagccaacgggcaggaggaaggagggaggtgtggacaccgattagcctcccaaggatgagtaggccgg

SEQ ID NO: 24663 - DNA, 201 bp, Homo sapiens
gcagggggcgggtgtgtccttgagatggccacagggcaaggacctcaccctctgtggctgtgttttcaggcgttgggactccagctgcagctgcagctgcrgcagcagccgctaaggcagccaagtatggtgagtgcctcccggggtggcaagtccacggctcgggcccctgcatagacctcggagaccctagccgcaaag

SEQ ID NO: 24664 - DNA, 201 bp, Homo sapiens
cataacaactccatacatgtgtttgtatttgttttcactctggctgggggtgacaggtgcagactcaggacagcttgggccccgagggcagagcagggggrgggggagggcagcagtggtgatgtctgcacagatgaccatcaagcctctctgttttgcaggctatgggcccggaggagtggctggtgcagcgggcaaggc

SEQ ID NO: 24665 - DNA, 201 bp, Homo sapiens
tctgagcactttgctcttccccccacctccaccacactgttccctgcagtctgctctggagccagagagtagagaggaagggagagaggcacgtgaagaaygagggagagggggagaaagaggaggaaggagagaggccgaggcagagaaagacgcataagagactgttgagagctggaggccggagccagggaaggcatc

SEQ ID NO: 24666 - DNA, 201 bp, Homo sapiens
ctccacaggccgaggcttcagtcccacctttctgaccagcggagtctaatgctcagctgtctccacaggcctagtgggagccgctgggctcggaggactcrgagtcggagggcttggagttccaggtgttgggggccttggaggtgagagttgttctgaaatcagtgagtgtgtgtggtgtgtgtatgcgagacagagatg

SEQ ID NO: 24667 - DNA, 201 bp, Homo sapiens
caatctactggggctcagggaggcagctagctgtgcccagtctgaaggtgagttagtaacggggccagacctcaatgctgggccctcagcatgcagccccrggcccttctgcctccccactgttccttacgcaatgcctcacctgtcctggctctgcaggcgctgggcttggtggtgtcccaggagttggtggcttaggag

SEQ ID NO: 24668 - DNA, 201 bp, Homo sapiens
gagccgtgcctgtcactgacagtcagtcccaagggaggtcagctgggggacccgaggaggggaggggttcccagcagggcctgcaaggcctgccttcctayactcactgctttgtcccccggcaggagctcggttccccggtgtgggggtgctccctggagttcccactggagcaggagttaagcccaaggctccaggtat

SEQ ID NO: 24669 - DNA, 201 bp, Homo sapiens
gtgcaatgatgaaagaagcagacaggactcggttgggggtggccagaaggagccttgagaaatccaggaaggcttcccagcagaagtgacatttgagttaracctaaagagaaaagtaaatggggccaggtgcagtgactcatgcctgtaatcctagcactttgggaggcccacatgggcagattgcttgagcccaggagt

SEQ ID NO: 24670 - DNA, 201 bp, Homo sapiens
gacccgaggaggggaggggttcccagcagggcctgcaaggcctgccttcctacactcactgctttgtcccccggcaggagctcggttccccggtgtggggktgctccctggagttcccactggagcaggagttaagcccaaggctccaggtatgcagctgtctggacagagggctgatggcagggactctccaaccacctt

SEQ ID NO: 24671 - DNA, 201 bp, Homo sapiens
gaggaggtgatcccagacagaggtcttgggtgagccagtgcaggcagaaagtgatgaggctggagtcagtttccacccctaccaacccaccaacctgaaatctctcctgcaggagtggcagcaagacctggcttcggattgtctcccattttcccaggtatgccaggctccctgcccctgggccctgccctggagctgcag

SEQ ID NO: 24672 - DNA, 201 bp, Homo sapiens
aaacattttaatcactctaatataactctggatgaaacacacctttttttttaataagaaaagagaattaactgcttcagaaatgactaataaatgaaaarcctttaaaggaaactgtgtcttagcttccttcgtatgatttaatctgccttcaactcgctggcctggatggggataagggctctgcttcagggaacctcc

SEQ ID NO: 24673 - DNA, 201 bp, Homo sapiens
gtgtccacagttccagggctgtagtgacagctttttatcattacaggtgtaggtggagcttttgctggaatcccaggtgaggcaaggctggtgggagaagmagggtggccagccaggcagaggctctggcgttgggaggggttgggcacccaagatcccatccaagcctgcccaatttctcccacgcctgcagagccaggt

SEQ ID NO: 24674 - DNA, 201 bp, Homo sapiens
atgctcactggtcccagcaaggcaggtgatataatggccattttgtagatggcaaaaactaagcctcatcggagaggcaaattgacctgcttgtgctcatrgaggctgggtagcagcagcagggtctgaatctagaactctctgactctagaaagaaggaggatggagctggccaggtccctggactcccagctgtggtca

SEQ ID NO: 24675 - DNA, 201 bp, Homo sapiens
tggaggcatcgcaggtaacatctgtcccagcagggggcgggtgtgtccttgagatggccacagggcaaggacctcaccctctgtggctgtgttttcaggcrttgggactccagctgcagctgcagctgcagcagcagccgctaaggcagccaagtatggtgagtgcctcccggggtggcaagtccacggctcgggcccctg

SEQ ID NO: 24676 - DNA, 201 bp, Homo sapiens
ttttcctgaaatgttaggatgtttcaacatatgaaaatcaatcagtgaaatataacatataaacagaatgaaagacaattacatgatcatctcaattgcarcagaaaaagcagcaagatccaataaactttcatgataaaaacattcaacagactaggaatagaagcaaaccacttcaacctaataaaggctatagatgaa

SEQ ID NO: 24677 - DNA, 201 bp, Homo sapiens
tctatcctggcctcgcccaaggggctgggatctgccacgagggtccactctcagctctggggaatgcacccccaggaaggaaggtggggcaggtccctccrggaaatactggcggataaggagcaggtggaggaaacagcgtctctgtccagattgatggtccctcggcatgagacgctccacatgtgactttggccgccc

SEQ ID NO: 24678 - DNA, 201 bp, Homo sapiens
gagttggaggcattcctacttacggggttggagctgggggctttcccggctttggtgtcggagtcggaggtatccctggagtcgcaggtgtccctggtgtyggaggtgttcccggagtcggaggtgtcccgggagttggcatttcccgtgagccttagtcacatctggggacatgggttgagaagggatgggggcttcttg

SEQ ID NO: 24679 - DNA, 201 bp, Homo sapiens
gtttcaacatatgaaaatcaatcagtgaaatataacatataaacagaatgaaagacaattacatgatcatctcaattgcagcagaaaaagcagcaagatcmaataaactttcatgataaaaacattcaacagactaggaatagaagcaaaccacttcaacctaataaaggctatagatgaaagcccacagctaacatcata

SEQ ID NO: 24680 - DNA, 201 bp, Homo sapiens
ggagggcaggcagagacagaagtggtcaggccacatgacaggatgctcaggctgggatcatgggaaaaaggaagatggccccagagaagctgcctgccccycactgcagccccagcctcttctcacttcctgtgcagtcctcagcttcccctcccagcccctctgtggacaggaaaggtctgagcatgtcccttgccctct

SEQ ID NO: 24681 - DNA, 201 bp, Homo sapiens
ttcccggagtcggaggtgtcccgggagttggcatttcccgtgagccttagtcacatctggggacatgggttgagaagggatgggggcttcttgtctgctcrgctctgcaggggcagtggggactgtagatcgggcttgaatgtgctcagggaggagttgggggagaagaagggaggtcgtatccatgccttacagggcaga

SEQ ID NO: 24682 - DNA, 201 bp, Homo sapiens
aattgcagcagaaaaagcagcaagatccaataaactttcatgataaaaacattcaacagactaggaatagaagcaaaccacttcaacctaataaaggctayagatgaaagcccacagctaacatcatacttaatggtgaaagactgggcttgagtggtggctcacacctgtaatcccagcactttgggaggctgaggcagg

SEQ ID NO: 24683 - DNA, 201 bp, Homo sapiens
gaggtgtcccgggagttggcatttcccgtgagccttagtcacatctggggacatgggttgagaagggatgggggcttcttgtctgctcggctctgcagggrcagtggggactgtagatcgggcttgaatgtgctcagggaggagttgggggagaagaagggaggtcgtatccatgccttacagggcagaagagctttaaac

SEQ ID NO: 24684 - DNA, 201 bp, Homo sapiens; identical to SEQ ID NO: 3445

SEQ ID NO: 24685 - DNA, 201 bp, Homo sapiens
ttgtaatcccagcactttgggaggccgaggcaggcagatcacttgaggtcaggagttcaagaccagcctggctaacatggcaaaaccccaacaacaacaamaaaaattagctgggtgtggtggtgcatgcttgtaatcccagctactctggggactgaggcaggtgaatcgcttgaacccaggaggcagaggttgcagtga

SEQ ID NO: 24686 - DNA, 201 bp, Homo sapiens
gcagccttaaactcccaggctggagcaatcctcccaactacaggcacataccaccatacccagctaatttttaaatttttttatagagatagaatcttgcyatgttgcagccaggcgtggtggctcatacctgtaatcccagcactttgggaggccgaggcaggcggatcatgaggtcaggagttcaagaccagcctggcc

SEQ ID NO: 24687 - DNA, 201 bp, Homo sapiens
gaatggcgtgaacctgggaggcggagcttgcagtgagccgagatcgcgccactgcactccagcctgggcgacagagcgagactccgtctcaaaaaaaaaawatatatatatatatatatatgtatgtatgtatgtatataaattagctgggcatggtgacacacgcctgtaatcccagctactcgggagcctgagacagga

SEQ ID NO: 24688 - DNA, 201 bp, Homo sapiens
aaattttgaggagacacagttccacccctaagagttacctcatggaaaaagggtctttgtagttgtgattaagtcaaggatcttgagagatagggagattrtcctgctgggccctaaatgctacataggtattcttatgagaagctggggctgggcacaatggctcacacctatcatcccaacactttgggaggccaaagc

SEQ ID NO: 24689 - DNA, 201 bp, Homo sapiens
aagaatggcgtgaacctgggaggcggagcttgcagtgagccgagatcgcgccactgcactccagcctgggcgacagagcgagactccgtctcaaaaaaaawatatatatatatatatatatatgtatgtatgtatgtatataaattagctgggcatggtgacacacgcctgtaatcccagctactcgggagcctgagacag

SEQ ID NO: 24690 - DNA, 201 bp, Homo sapiens
acttcactcgacaaaaatatccattgctggtttttcctcaggtctccggcctctaaaagtcagtaagccccagcattcaggcctgtggactccctgtcttrgtttctcatagcttgcggttttatttatttatcagagacagggcctcagtctttcgcccaggctggagtgcagtggtgctatcacagctcactgcagcct

SEQ ID NO: 24691 - DNA, 201 bp, Homo sapiens
catggtggctcacgcctgtgatcccagcactttgggaggctgaggtgggcagatcacgaggtcagatcaagaccatcctggctaacacagtgaaaccccgyctctactaaaaatacaaaaaattagctgggcgtggtggcagacgcctgtagtcccagctactcaggaggctgaggcagaagaatggcgtgaacctgggag

SEQ ID NO: 24692 - DNA, 201 bp, Homo sapiens
aagtgccgggtcagtgcggaatccctggggctggaggacagagggcagggaggggcagagggcagggaggaacagagccctctccatgccactgcacttgsggaggaagggcagggcctggcttcagtcgggcagagaaactagccaggctggtgcctgcgtctgtgaaatggggaggaggggcctggcccacttcccggg

SEQ ID NO: 24693 - DNA, 201 bp, Homo sapiens
ccatgcagactggagcatatgtgggtttgcatacgaggatccttgcgatcccagaaggagctgggagggaaagagaaagctggtggagggtatgctcagasagagcttcccagaggacagtaaagggcaaaaaacattttaccaggcaaagaatagaacagagaggagggtcaggcctttcaggcagaggacaggacaact

SEQ ID NO: 24694 - DNA, 201 bp, Homo sapiens
gcagcaaccttgcaaccttgcaacaaccaagtgattatctgccccatgtcacaaaaaaggaaaccgatgttcagagaggttgagtgactttcccaaggtcrcacagatggtaagaagcagcgaaggcagaattagaagccagaggggtctgttctgagcactttgctcttccccccacctccaccacactgttccctgcag

SEQ ID NO: 24695 - DNA, 201 bp, Homo sapiens
cactgcctctttttaaatatttttttaattattgttttccgtccttaagtaggaacaggggttttcaacctggctatctattagacttcccacccaagaayccctgcttgctttggttggagagggacctggacacagacttttcaggcttcccaggtgacggtggggtcgccagggccaagaagcactggtttagaggtc

SEQ ID NO: 24696 - DNA, 201 bp, Homo sapiens
tgaagtatagaaattaaaaaaaaattagctgggcatagtggtgcacgcctgtagtcctagctactggggaggctgaggcaggaggatcacttgagcttagsagttcaaggctgcagtgagctataatagcaccactgcactgaagtctgggtgacagagtaaaaccctgtctctaaaaagaaaaggggaaaaaaagaaaag

SEQ ID NO: 24697 - DNA, 201 bp, Homo sapiens
taccttccaaaattccagagctgctccctccaaagacccagggaaaaggaagggtttgtccagggtcctggggtggccccgtatagaccaaagcctgatarctgtcctagaagcagagtacttgcagagcgagtgacggcaactgtggtattgacaccagtcctagcaccagctgaacacagagcatttttgatctagcag

SEQ ID NO: 24698 - DNA, 201 bp, Homo sapiens
cctgtgggtgactcatctggttgccccttggtggcactgagccaggcaacaagcgggaaaggcttgtcaatgataacggcaagaccaacgatcaccaggcrgccaggtgcacccggtagccctctgtgggcaattctgcatgtatgaccttatttagtcatacagctaggcaaggaggtgacactaagcatttgagtactg

SEQ ID NO: 24699 - DNA, 201 bp, Homo sapiens
cgctttctcctcctttccagatgctagaatccttggggcatttggggcaggtgagtgcaaaggaaggagggcaggcagagacagaagtggtcaggccacakgacaggatgctcaggctgggatcatgggaaaaaggaagatggccccagagaagctgcctgccccccactgcagccccagcctcttctcacttcctgtgca

SEQ ID NO: 24700 - DNA, 201 bp, Homo sapiens
cgggcccttctgcctccccactgttccttacgcaatgcctcacctgtcctggctctgcaggcgctgggcttggtggtgtcccaggagttggtggcttaggrgtgtctgcaggtacgatggctatccccgaactccctgggtcaaagttgcaggcctgggtggagccaactctgatgcagccccttctgtgccaggtgcggt

SEQ ID NO: 24701 - DNA, 201 bp, Homo sapiens
gagcctagagatgggaagcagggaggggtgtgagagattactctctcaccccttctcttcacacctccaggagtggggaccccagcagctgcagctgctaragcagccgccaaagccgcccagtttggtaagtccccctcacccccgccactggctcacggagaactgctttctcctgtgccctgctctggggtctgaccg

SEQ ID NO: 24702 - DNA, 201 bp, Homo sapiens
cttcctgttcctttccaccccacttaagctgtcacattctggggtgggccctccttagaccttttggcccactgatgaatgacctctaggagtgtgggtgrtgtttctgattaggggagcagggtgagcagtgtgagcctccctgttcctaaagcccctggtgcctcccaggctattggggacctgacctcatgctgagct

SEQ ID NO: 24703 - DNA, 201 bp, Homo sapiens
agatgcttcttacatgaggctggctgagtttcagaggggtccagctcccactagtaggaaatgagggacgaggagtggttagtaacggagaccacacccarggaaagccaggggggacctctccagggtacagcaggctccatgtttgggatccatccctggagaggactcacccctgaggctcaggactagcacttgtag

SEQ ID NO: 24704 - DNA, 201 bp, Homo sapiens
ctggcgttggcgtggctcccggcattggccctggtggagttgcaggtgagtttcatgagtcaatgagcctgaggggcccccgaagcctccatgggccccgyctccatctctaatccccctctctctccctccctcagctgcagcaaaatccgctgccaaggtggctgccaaagcccagctccgtgagtgcctcgcccacct

SEQ ID NO: 24705 - DNA, 201 bp, Homo sapiens
tcggtgtggctcctggagttggcttggctcctggagttggcgtggctcctggagttggtgtggctcctggcgttggcgtggctcccggcattggccctggwggagttgcaggtgagtttcatgagtcaatgagcctgaggggcccccgaagcctccatgggccccgcctccatctctaatccccctctctctccctccctc

SEQ ID NO: 24706 - DNA, 201 bp, Homo sapiens; identical to SEQ ID NO: 3446

SEQ ID NO: 24707 - DNA, 201 bp, Homo sapiens
cgaaactgagaggggccggactcacagtgatgtgcacctcctcccgtccaggtggggcctgcctggggaaagcttgtggccggaagagaaaatgagcttcmtaggacccctgactcacgacctcatcaacgttggtgctactgcttggtggagaatgtaaaccctttgtaaccccatcccatgcccctccgactccccacc

SEQ ID NO: 24708 - DNA, 201 bp, Homo sapiens
attatatagtgggggggatggagaggaggtgatcccagacagaggtcttgggtgagccagtgcaggcagaaagtgatgaggctggagtcagtttccacccytaccaacccaccaacctgaaatctctcctgcaggagtggcagcaagacctggcttcggattgtctcccattttcccaggtatgccaggctccctgcccct

SEQ ID NO: 24709 - DNA, 201 bp, Homo sapiens
cccagggaaaaggaagggtttgtccagggtcctggggtggccccgtatagaccaaagcctgataactgtcctagaagcagagtacttgcagagcgagtgamggcaactgtggtattgacaccagtcctagcaccagctgaacacagagcatttttgatctagcagaaatacaagaccacgttgtatttgtctttgcaataa

SEQ ID NO: 24710 - DNA, 201 bp, Homo sapiens
gatcaggtctgagtttggcctggggccatgacttggcttctcttggcttcttggagcctccattcgagtgggtcagagcaggcggggattagagccgaaamtgagaggggccggactcacagtgatgtgcacctcctcccgtccaggtggggcctgcctggggaaagcttgtggccggaagagaaaatgagcttcctagga

SEQ ID NO: 24711 - DNA, 201 bp, Homo sapiens
cagatgtactgggcaaacgggcaagctataaggttggggacagtgccaggctgagctcagggttgaggccatgaggtgccacacctggttgctaggtggcrgcatgttgtgttgagaaagccactctggctgtagtgagggggattggctgggcgtggtggctcacgcctgtaatcccagcactttgggaggcctaggtgg

SEQ ID NO: 24712 - DNA, 201 bp, Homo sapiens
tcagaggggggccttctgaggtggaggcagggcccccggtttgggaccctgtctgttgccatggcgatggctcaggcagggtctggatccagcatcacagygttccccagtgagagcttcactggtccatggggactgaactcgtgatcctgtctggccggtgaattcgcttttccttaggaaactattcactgtgctcat

SEQ ID NO: 24713 - DNA, 201 bp, Homo sapiens
tgagagggccgtctcctgcagacactgactctcccttcatcccatgttccttgatggagctgctcttagcctttccccgaaaggcttcttggagcagtggrgccaggagccagtgccaggccccgtccttccccagccaggccccatgacctgcccccttttctgcgagcgttggtttcatccaagtaatatcttgggggc

SEQ ID NO: 24714 - DNA, 201 bp, Homo sapiens
catctctactaaaaattcaaaaattagccaggcgtggtggcgggcacctgtaatcccagcactttgggaggccgaggtgggcagatcaactgaggtcgggrgttccagaccagcctgaccaatatggtgaaaccccatctctactaaaaacacaaaaattagccaggtgtggtggcgggcacctgtaatcccagctactcg

SEQ ID NO: 24715 - DNA, 201 bp, Homo sapiens
gccactgcactccagcctgggcggcacagcaagactccgtctcaaaaaaaaaaaaaaaattagccaggtgtggtggtgcacgcctgtaatcccagctactytggaggctgagacaggagaattgcttgaacccaggaggcggaggttgcagtgagctgagactacaccactgccctctagcctgggtgatgacagggcaag

SEQ ID NO: 24716 - DNA, 201 bp, Homo sapiens
tcacatgccaccatgcccagtttaaaaaaaaaaaaaattgtatgcgatcctcccacattggcctctcaaagtgctgggatgacaggcatgagccaacgtgyctggcctacaaaaatcttacagagttgattttatttttcccattttacagatgtggaaactgaggttcccagagcttaagtaacttgcctacagttgcac

SEQ ID NO: 24717 - DNA, 201 bp, Homo sapiens
cccgggaggcggagcatggtgtgaacccgggaggcggagcttgcagtgagccgagattgcgccactgcactccagcctgggcggcacagcaagactccgtytcaaaaaaaaaaaaaaaattagccaggtgtggtggtgcacgcctgtaatcccagctactctggaggctgagacaggagaattgcttgaacccaggaggcg

SEQ ID NO: 24718 - DNA, 201 bp, Homo sapiens
tgagaccagcctgagcaacatactgagaccccatctttccaaaaagtatttaaaaattatctaggcatggtggcacatgcctgtggtcccagccacctgcraggctgaggtgagaggattgcttgagcctagtagttcaaggctgcagtgagctatgatcatgccactgcactccagcctgggtaagtgagaatttggttc

SEQ ID NO: 24719 - DNA, 201 bp, Homo sapiens
gctccttctgtctgagcagaaagtggagtgggtggcggagggtttggaagggggtgctgggacctgaacttgctctctttattcccacaggagttggaccytttgggggaccgcaacctggagtcccactggggtatcccatcaaggcccccaagctgcctggtaagtcagagggacggttcaagatgcaccactcggccg

SEQ ID NO: 24720 - DNA, 201 bp, Homo sapiens
tgttaaaagaaatgctctaaagcagcttaccaacacagaatgcaagccacatctgtaattttaaattttcaagtagccacattaagaattaaaaagagtcrggcatggtggctcacacctgtaatcctaacactttgggaggctgaggcgggcggatcatctgaggtcaggagtttgagaccagcctggccaacatggtgg

SEQ ID NO: 24721 - DNA, 201 bp, Homo sapiens; identical to SEQ ID NO: 3476

SEQ ID NO: 24722 - DNA, 201 bp, Homo sapiens
atccatgcaaacagacagaggcatttaaaaaatatggtatttaatgatttaatgtcagtatcatacaagaatctatggatatttcttaaatgctcccaaayaccaaacttgcaaacaaaataaattcagtttcggaaccaaataaatagagtttacatatgactagggtgactccactggcaccccgatatagacatatgt

SEQ ID NO: 24723 - DNA, 201 bp, Homo sapiens
tccctgaagtgataaagagttagaaccagacacacacttctgcattcagctgctgtctttccttgtgagtggaaaaacacactcagtacattctctgcaaycctgcttaaaacctcttctaaagcttctttgacacagttattcaaaagcttctaaaagtagtatcgacgtattacaaaataatccaatcatttcaagttc

SEQ ID NO: 24724 - DNA, 201 bp, Homo sapiens
atggccaggggtaaggcaggggtgggaggaggaagggcaggagacccaacggatggtgctgcctggacagtccctgaagtgataaagagttagaaccagayacacacttctgcattcagctgctgtctttccttgtgagtggaaaaacacactcagtacattctctgcaatcctgcttaaaacctcttctaaagcttcttt

SEQ ID NO: 24725 - DNA, 201 bp, Homo sapiens
gagaaaattatacattctcagaattccattcataaaggactactggtcacaaaagaatggccaggggtaaggcaggggtgggaggaggaagggcaggagayccaacggatggtgctgcctggacagtccctgaagtgataaagagttagaaccagacacacacttctgcattcagctgctgtctttccttgtgagtggaaa

SEQ ID NO: 24726 - DNA, 201 bp, Homo sapiens
taaagaagcattcttctgagaaaattatacattctcagaattccattcataaaggactactggtcacaaaagaatggccaggggtaaggcaggggtgggargaggaagggcaggagacccaacggatggtgctgcctggacagtccctgaagtgataaagagttagaaccagacacacacttctgcattcagctgctgtct

SEQ ID NO: 24727 - DNA, 201 bp, Homo sapiens
agaaatatttggtgagctaaagaagcattcttctgagaaaattatacattctcagaattccattcataaaggactactggtcacaaaagaatggccagggrtaaggcaggggtgggaggaggaagggcaggagacccaacggatggtgctgcctggacagtccctgaagtgataaagagttagaaccagacacacacttct

SEQ ID NO: 24728 - DNA, 201 bp, Homo sapiens
actgtcccccataagccctcacacctcctaccaagctccaaggactgttctgttcttctgcctactcccgcaatgcagttcaaacgtttaccagggctctrcagtgagctacttttccaaagacagaaaagcaaggctatgtgcaatcagacgaaactccagctctcattgtaacatccagcttaaagccatatgttagcc

SEQ ID NO: 24729 - DNA, 201 bp, Homo sapiens
aggaggatctttttcccccctcagcaaacaagaaatatttggtgagctaaagaagcattcttctgagaaaattatacattctcagaattccattcataaasgactactggtcacaaaagaatggccaggggtaaggcaggggtgggaggaggaagggcaggagacccaacggatggtgctgcctggacagtccctgaagtg

SEQ ID NO: 24730 - DNA, 201 bp, Homo sapiens
gtctcagcagctgctaaaacacgtccaagcactttgcatctatccggaaatccagaatggcagcctgggttcacagatctgctgccaagggcagatgtatscgcactgcagctgggccctcctccccaggggccccatgggcacaagcagctcagggtgggccagcgagcctcagtcacactggctgccctcagccccacc

SEQ ID NO: 24731 - DNA, 201 bp, Homo sapiens; identical to SEQ ID NO: 3478

SEQ ID NO: 24732 - DNA, 201 bp, Homo sapiens
tcatgtctgcatacttaacatagatttaatatttctccaggccaaagatcatatgcagagtttttctttgactggaggacagaagagacaaggagagaagragaacgtctggaattcctttgttcttggagacaactccagagaacaattctcaataagaaaagttataaaaagcttcaatcagcaccctcacgtttctga

SEQ ID NO: 24733 - DNA, 201 bp, Homo sapiens; identical to SEQ ID NO: 3479

SEQ ID NO: 24734 - DNA, 201 bp, Homo sapiens
gaggagagagagagagacagagagagagaccaagcaacacgaacacacaggcagatcaggaagcaagaaatcttctcagagcagaccacggaaaccctcartaacttactcaattttagagtttgaggaaacggcacaggtagtccgatgcaagccccccgagttcaaagaaaggaaatggaagtacagggcagacaggtg

SEQ ID NO: 24735 - DNA, 201 bp, Homo sapiens
ctctcaaaatggcagtctgttaggtcaagtttggctgttttgttaatcgcctatcaacagaaacagctttgctaggcacacccagaagttcatctctcctmatcacccacctttggcacccagtgacttttccaaggaggatctttttcccccctcagcaaacaagaaatatttggtgagctaaagaagcattcttctgag

SEQ ID NO: 24736 - DNA, 201 bp, Homo sapiens
actgcacagccaccagtacacctcgaagccaattaatcctgcaaaacaaattcctctcaaaatggcagtctgttaggtcaagtttggctgttttgttaatygcctatcaacagaaacagctttgctaggcacacccagaagttcatctctcctcatcacccacctttggcacccagtgacttttccaaggaggatcttttt

SEQ ID NO: 24737 - DNA, 201 bp, Homo sapiens
ccttgagaggaaaaggcaaggctagagttcggccaggtgagccgtgccggctggtcagcacgggagagcaccactggggccaaggacacagcaggcaggcrggagggagtggcacatggagtgtggcatgttgtcacggggtagctgttgaccactcaggagcttcacactgtaccacatgcctatcctatagggacttgc

SEQ ID NO: 24738 - DNA, 201 bp, Homo sapiens
gccgagaatgtcacactggcatacacatgaggaaagcaagacagaggtattaacgcaacaaagaaagaggcttttcaagcacaggaagaaaccagaacaawtgtacaaataggtttaactggtgagagctgaaggggctccagatattttccaaatacttggcatgcaaaaatcaccacaagtcagtggttctgaaagctt

SEQ ID NO: 24739 - DNA, 201 bp, Homo sapiens; identical to SEQ ID NO: 3473

SEQ ID NO: 24740 - DNA, 201 bp, Homo sapiens; identical to SEQ ID NO: 3475

SEQ ID NO: 24741 - DNA, 201 bp, Homo sapiens
accaaggcccaggcaatttaaataacttgctcatttctagtcgccactcttagacttggacccagaatgcaggcctcacccctaccccaggggtcttcaawcagtagctcatcagaaacagccaaaaacctatggcaagaccaaagtaactacctacctagttcgtgaacaactctccacttaatgacgtttcatatggca

SEQ ID NO: 24742 - DNA, 201 bp, Homo sapiens
tgcagttctccaggcgcttcagctgctgatagtcgttgcggatgtcgatgcctggcccgcagactgaagggagacaagagggtaaacgtctcagttagaargaaataatttttaaactattttccaaacaataatacagttggttttcaggaatcctgtattattattaaagaaatgaggttcaattgttcactgcagagc

SEQ ID NO: 24743 - DNA, 201 bp, Homo sapiens
agaagagtttccagccgcggatgaccgtgaggttggggaagaggtctccgaggctctcgaggccagccactcggaacagcagcaagtactcggtaatgacmgtgagcttggggaagcggtagctgcggtagtcctcggccttggagatgagcaggatgtggaggtagccctcgatcaccgtgcagttctccaggcgcttca

SEQ ID NO: 24744 - DNA, 201 bp, Homo sapiens
aattaccatttctctctaatgaccacttactcccttcttacacattttcatcagctctttattctacactgagtatttccaagaattaggataacactacygcccaataagatagagttggggttacccaaataagcaacagaagctttccagtgggaccgagtcaagtcaagggtctcaagtccccccaccctaaagcac

SEQ ID NO: 24745 - DNA, 201 bp, Homo sapiens
aaattagacgggcatggtggcacatgcttgtaattccagctacttgggaggctgaggcaagagaatcgcttgaacccaggagacggaggttgcagtgagcygagatcgcgccgctgcactccagcctgggtgatgagagcgaaactccgcctcaaaaaaaaaaaaaaaagaataaaaaggaaacaggcaggtgaaatttaa

SEQ ID NO: 24746 - DNA, 201 bp, Homo sapiens
acgtttaccagggctctgcagtgagctacttttccaaagacagaaaagcaaggctatgtgcaatcagacgaaactccagctctcattgtaacatccagcttaaagccatatgttagccagtggcaggtacagattagaacccagaatggtctagattttgggtttctacttggggttccttcttccatataaatgatctct

SEQ ID NO: 24747 - DNA, 201 bp, Homo sapiens; identical to SEQ ID NO: 3477

SEQ ID NO: 24748 - DNA, 201 bp, Homo sapiens
ttagttatggtagtgaacatatatagtcaacacagcttaagactcagaattttagatggtctcagaatgcaactcttagatagtttaatttaaaaaaaaaatagcagcagctgccaccatttaccaaaaacctatgtgcttggaaacatgttagatgcttttcaaatactgtcctattcctgtctcactgaaggaaggtga

SEQ ID NO: 24749 - DNA, 201 bp, Homo sapiens
gtgccacagacagaaaaatcccatctcccacccaccagcctccctggaacaaacaccttggctgtctctcgctacctccaagtcaggggaacattccaacyaggatggtgctcagagaccccaccttttatagccagagtccctgattcacaccatatgcccaaaggaggcgtgtttctaagtgatgcttccaacttcacc

SEQ ID NO: 24750 - DNA, 201 bp, Homo sapiens
cccaattcggacaagccacagttcaagtactcaataagccacgtggcttactcaataagcggctaccacactggacaatgcaggtctaaatggaatctacrcaaaccaagaggaagttctgattcaactagaaaatctccaagaaatatgcccatgcctgagttttcaggacaaggggaagggaagtcaatttcccggaaa

SEQ ID NO: 24751 - DNA, 201 bp, Homo sapiens
ctacttgggaggctgaggcaagagaatcgcttgaacccaggagacggaggttgcagtgagctgagatcgcgccgctgcactccagcctgggtgatgagagmgaaactccgcctcaaaaaaaaaaaaaaaagaataaaaaggaaacaggcaggtgaaatttaagaacacattttacttaatctaatatatccaaaatgttat

SEQ ID NO: 24752 - DNA, 201 bp, Homo sapiens
gttaaaagaaatgctctaaagcagcttaccaacacagaatgcaagccacatctgtaattttaaattttcaagtagccacattaagaattaaaaagagtcgrgcatggtggctcacacctgtaatcctaacactttgggaggctgaggcgggcggatcatctgaggtcaggagtttgagaccagcctggccaacatggtggt

SEQ ID NO: 24753 - DNA, 201 bp, Homo sapiens
tcgagaccagcctggttaacatggtgaaaccccgtctctactaaaaatacaaaaattagctgggtgtggtggtgcgggcctgtaatcccagctactcaggmggctgaggcagtagaatcacttgaacctgggagcccggaggttgcaatgagccaagatcgcaccactgcactccagcctgggtgacagagtaagactctt

SEQ ID NO: 24754 - DNA, 201 bp, Homo sapiens
ctgctctacttaatactgcctgtgccacagacagaaaaatcccatctcccacccaccagcctccctggaacaaacaccttggctgtctctcgctacctccragtcaggggaacattccaaccaggatggtgctcagagaccccaccttttatagccagagtccctgattcacaccatatgcccaaaggaggcgtgtttcta

SEQ ID NO: 24755 - DNA, 201 bp, Homo sapiens; identical to SEQ ID NO: 3474

SEQ ID NO: 24756 - DNA, 201 bp, Homo sapiens
gtcatcactgcacagccaccagtacacctcgaagccaattaatcctgcaaaacaaattcctctcaaaatggcagtctgttaggtcaagtttggctgttttrttaatcgcctatcaacagaaacagctttgctaggcacacccagaagttcatctctcctcatcacccacctttggcacccagtgacttttccaaggaggat

SEQ ID NO: 24757 - DNA, 201 bp, Homo sapiens
actggagggattttgcgactggagttacaggaggctgaggagctggcatctgaaagtccatgcttcacgcttttcaaatgcactatgtataaccaagctcrtttccaaaaacagaatctgaactagctcataataaaccattcaccttttattttttgctgaaggggtcagagcatcatcccaattaccatttctctctaa

SEQ ID NO: 24758 - DNA, 201 bp, Homo sapiens
ccctcacgtttctgatttaaagttggggtgggggagcgtggaataaaaagagagggaactaaacatgtacgaaactcattctagcgtgagacgttgtcagrtactttgctgacattttatcataaaactctctctcggtggccacgggttacagcagggaacctaaaacctagacttgggaccccaagtcctcgcttcaca

SEQ ID NO: 24759 - DNA, 201 bp, Homo sapiens
aactccagagaacaattctcaataagaaaagttataaaaagcttcaatcagcaccctcacgtttctgatttaaagttggggtgggggagcgtggaataaaragagagggaactaaacatgtacgaaactcattctagcgtgagacgttgtcaggtactttgctgacattttatcataaaactctctctcggtggccacggg

SEQ ID NO: 24760 - DNA, 201 bp, Homo sapiens
tgttcttggagacaactccagagaacaattctcaataagaaaagttataaaaagcttcaatcagcaccctcacgtttctgatttaaagttggggtgggggrgcgtggaataaaaagagagggaactaaacatgtacgaaactcattctagcgtgagacgttgtcaggtactttgctgacattttatcataaaactctctct

SEQ ID NO: 24761 - DNA, 201 bp, Homo sapiens
gtcacggcacagaaggagtttaaaggacagtgccaagtgaaaaccgcgcaacagcacgacaaaatcgagtaggctcaacgatttcacacacacccttgacrtgtttctccagatgttctccgtagttctacagccagccaacagaagattacctgaatgggattcttctgtgcttaatgttttcgaatggccatcttaatg

SEQ ID NO: 24762 - DNA, 201 bp, Homo sapiens
gctgaaagatgcaatcaatttaatatttccctctgcccatttacatgacttatttgtttcggcagatcttctttgccacaaatccttcatttgcccattcrtgtctgcatacttaacatagatttaatatttctccaggccaaagatcatatgcagagtttttctttgactggaggacagaagagacaaggagagaaggag

SEQ ID NO: 24763 - DNA, 201 bp, Homo sapiens
gagggatcacgtccatagagggagtagagtctactacgctgccagacactgcagagtcacggcacagaaggagtttaaaggacagtgccaagtgaaaaccrcgcaacagcacgacaaaatcgagtaggctcaacgatttcacacacacccttgacgtgtttctccagatgttctccgtagttctacagccagccaacagaa

SEQ ID NO: 24764 - DNA, 201 bp, Homo sapiens
agtaccaggagctgaaagatgcaatcaatttaatatttccctctgcccatttacatgacttatttgtttcggcagatcttctttgccacaaatccttcatytgcccattcatgtctgcatacttaacatagatttaatatttctccaggccaaagatcatatgcagagtttttctttgactggaggacagaagagacaagg

SEQ ID NO: 24765 - DNA, 201 bp, Homo sapiens
aactccctcatctttccattatttcaaatgacaaccttttcccactactttatctttgcattaagtaccaggagctgaaagatgcaatcaatttaatattkccctctgcccatttacatgacttatttgtttcggcagatcttctttgccacaaatccttcatttgcccattcatgtctgcatacttaacatagatttaat

SEQ ID NO: 24766 - DNA, 201 bp, Homo sapiens
aaatgcaacacgactgcaccctgcccagcggaactcgtgcactcagaagagaagggaggtcaaggaggaggagaggagagagagaggcagagagaaagcarcagtcagcatcattcttacttttctggcagcggtttgtggtccagcagcggtagttgtactcattgttgatggtggtcttctcacacatcggcttctcct

SEQ ID NO: 24767 - DNA, 201 bp, Homo sapiens
tctcactgaacttctctattccagggccgatgcctttgttttaatggcagcgcatcatcgactaaccaaatccacaggtactgcacaggtctgaaggatcyggctctgagggataccgaggcatccggggctccctctgtcttctttctgtgtacacaaggtaccttcagtgactgcaaggaaaatcctcttgctttctac

SEQ ID NO: 24768 - DNA, 201 bp, Homo sapiens
ctggcttctgggcacactatgtaggatgagagaatcaaatccattcagtcctaatctactgccccacttaataaacaaaaaatgttaagaacatgcatttwaaaaaaaatctaaatgccttcataatatagatacagcaagtcttcccataatgctaatgaaggcttctcacaagagtttaatgagctagtatccagtatc

SEQ ID NO: 24769 - DNA, 201 bp, Homo sapiens
aaattctacaatttagaaaagcaatacagaaggaccatttagttatggtagtgaacatatatagtcaacacagcttaagactcagaattttagatggtctyagaatgcaactcttagatagtttaatttaaaaaaaaaatagcagcagctgccaccatttaccaaaaacctatgtgcttggaaacatgttagatgcttttc

SEQ ID NO: 24770 - DNA, 201 bp, Homo sapiens
ctattctcatgatagtgaataagtctgacgagatctgatgggtttatcagggtttccacttttgcttcttccacattttctcttgctgccaccatgtaagmagtaccttttgcctcctgccatgattctgaggcctccccagccatgtggaattgtaagtccaattaaaacctctttttcttcacagtcttgggtacgtct

SEQ ID NO: 24771 - DNA, 201 bp, Homo sapiens
tgacatcctgaaaacctaacagcggccaagctgaccccgcagaagaagtgatctaacctggatggtcacccttccctgcctaagactcaccctttccaccsgccccagaagcccttattcctccttgacttgaaaagacaactgtcccccataagccctcacacctcctaccaagctccaaggactgttctgttcttctgc

SEQ ID NO: 24772 - DNA, 201 bp, Homo sapiens
agttattggacaccgcatccaggatcagggaccagtccacagtggagaggtaacagaggtcagcatttttctcaatcctgatggccccccgagtaatgttyctcaggttgtaaagcccaatatccttgagattggtcatctcgaagatgaccagggcgtagttgtagaagagtttccagccgcggatgaccgtgaggttgg

SEQ ID NO: 24773 - DNA, 201 bp, Homo sapiens
tgctctctcccactttagtaacccctgcttcataactgtctgtgccagaaagccacagtgagcccccagtggcccctgtattacccacccagagagacaasctctcccctccatgaaactcatttctgggacccacacctaaactttaacacaaatcagaaaagttgagactccttaaaaatgcgttttgcaagctcacag

SEQ ID NO: 24774 - DNA, 201 bp, Homo sapiens
ggctcctaccccagtgcaataggcagatccatgagagctctcactggggctgctggagaactggctgctctctcccactttagtaacccctgcttcataamtgtctgtgccagaaagccacagtgagcccccagtggcccctgtattacccacccagagagacaagctctcccctccatgaaactcatttctgggacccac

SEQ ID NO: 24775 - DNA, 201 bp, Homo sapiens
aaaagctgacggtgatggctcctaccccagtgcaataggcagatccatgagagctctcactggggctgctggagaactggctgctctctcccactttagtmacccctgcttcataactgtctgtgccagaaagccacagtgagcccccagtggcccctgtattacccacccagagagacaagctctcccctccatgaaact

SEQ ID NO: 24776 - DNA, 201 bp, Homo sapiens
gtagaaaggggagtggggcagtaaatggccagggaacaggagacagtgggctggagggtgtcccaggttctaaccccagctgggccttcagagccctggtrtggtctgggctaacctctcaatccttttccaagtcttaagtttccttccaactcactgtgattcttccagagaattacacagggcaggtgaaattatttc

SEQ ID NO: 24777 - DNA, 201 bp, Homo sapiens
gtagagtgtctcgtcacaccgcataagttgtctctctcttttaaatgtcaagtgtttttatcttatctcacaacagaatcctagtttgtgtcatctcatastgcctagcatgagacttgcacaaaacgggggcaccttaattgtgcagctgagggacacgatggaaactctggccaaggaactagcaaggaaacctgcaaa

SEQ ID NO: 24778 - DNA, 201 bp, Homo sapiens
tccccgcccaaatctcaacttgaattgtgtctcccagaattttcatgtgttatgggaaggacccaggtgaggtaattgaatcatgagggctggtctttccygtgctattctcatgatagtgaataagtctgacgagatctgatgggtttatcagggtttccacttttgcttcttccacattttctcttgctgccaccatgt

SEQ ID NO: 24779 - DNA, 201 bp, Homo sapiens
ttttcccactactttatctttgcattaagtaccaggagctgaaagatgcaatcaatttaatatttccctctgcccatttacatgacttatttgtttcggcrgatcttctttgccacaaatccttcatttgcccattcatgtctgcatacttaacatagatttaatatttctccaggccaaagatcatatgcagagtttttc

SEQ ID NO: 24780 - DNA, 201 bp, Homo sapiens
cgaacacagtccttgctaagagggtgatatgatttggctgtgtccccgcccaaatctcaacttgaattgtgtctcccagaattttcatgtgttatgggaargacccaggtgaggtaattgaatcatgagggctggtctttcctgtgctattctcatgatagtgaataagtctgacgagatctgatgggtttatcagggttt

SEQ ID NO: 24781 - DNA, 201 bp, Homo sapiens
gtacgtctttatcagcagcatgaaaacagactaatacagagggtaatcaccacaggaatccagacggggagtggggtcagttcactggtacaaggatcttsatcaaaggaactcatttcccacctgatccctattcactccagggtccacatctaggagtcccaaagaccggcatgcatgggttgggtcaacaggctgcct

SEQ ID NO: 24782 - DNA, 201 bp, Homo sapiens; identical to SEQ ID NO: 3480

SEQ ID NO: 24783 - DNA, 201 bp, Homo sapiens
atctggacatggtggtgggcacctgtaaccacagctactcgggaagctgaggcaggagaatcggttgaactcgggaggcagaggttcagtgagctgagatyatgccattgcactacagcctgggtgacagagcaagactccgtctcaaaaaagaaagtagagtgagaagtgctgtggtatggttaagagggatttgggaat

SEQ ID NO: 24784 - DNA, 201 bp, Homo sapiens
gcctgttatgggggcacaggtaagtgtggattcaggcaggactgtctccagaacatggtacagcaagactggagttggctcacagggttacttctgagtcyacagtcaggtctagttggtgggcctgcttccagaggtggactggcatgactcccacctgtttcctaagtaggcaaaacttccccaagaccatggtagtgt

SEQ ID NO: 24785 - DNA, 201 bp, Homo sapiens
taggagatatacctaatgtaaatgacgagttaatgggtgcagcacaccaacatggcacatgtatacatatgtaacaaacctgcacgttgtgcacatgtacsctagaacttacagtataataaaaaaaaagaaattgcaaaattacacattctttgtaagcacacaaaggaaacatgttagaattttccattttaagctaca

SEQ ID NO: 24786 - DNA, 201 bp, Homo sapiens
cctgaggaattgccacactgacttccacaatggttgaactagtttacagtcccaccaacagtgtaaaagtgttcctatttctccacatcctctccagcacrtgttgtttcctgactttttaatgatcgccattctaactggtgtgagatggtatctcactgtggttttgatttgcatttctctgatggccagtgatgatga

SEQ ID NO: 24787 - DNA, 201 bp, Homo sapiens
aacaatgtgaatgtacctttttcagcctgaacaggtgaaagagtttctactaattgagttggggaagattgaaaaggtatcaggtgtaggaaggaatgtcmggtatctgacctgatagagcatagtcaggttttgttttgttttcttggaggggatatattttgctttggaaactgaccattttcaggagtcacctgtgta

SEQ ID NO: 24788 - DNA, 201 bp, Homo sapiens; identical to SEQ ID NO: 3503

SEQ ID NO: 24789 - DNA, 201 bp, Homo sapiens
ctgtctgtctgtctctctctctctgtctctctggatgagctaaactgttttagttcaagactgaaagcaggaaaaagctgatgttccagtccaaaggcagwcaggcagcaagaatactttcttacttggggaagactcagtctttttgttctattcaggccttcaactaattggatgatgcctcccacattagggagagca

SEQ ID NO: 24790 - DNA, 201 bp, Homo sapiens
attgtttttgcaggcatcaatggctatgtttttgatagtttgcagttgtcagtttgtttgcatgaggtggcatactggtacattctaagcattggagcacmgactgacttcctttctgtcttcttctctggatataccttcaaacacaaaatggtctatgaagacacactcaccctattcccattctcaggagaaactgtc

SEQ ID NO: 24791 - DNA, 201 bp, Homo sapiens
tgaaattctgggttgaaaattcttttctttaagaatgttgaatgttggcccccactctcttctggcttgtagagtttctgccgaaagatcagctgttagtytgatgggcttccctttgtgggtaacccgacctttctgtctggctgtccttaacattttttccttcatttcaactttggtgaatctgacaattatatgtct

SEQ ID NO: 24792 - DNA, 201 bp, Homo sapiens
caagtgacagtacaggaatttgctctgtttttcaccatctttgatgagaccaaaagctggtacttcactgaaaatatggaaagaaactgcagggctccctscaatatccagatggaagatcccacttttaaagagaattatcgcttccatggtaatatattccacatccaaacattatcactgtgaaatgcagattgcact

SEQ ID NO: 24793 - DNA, 201 bp, Homo sapiens
tttaatgttgatttagttaccagataacttagaaatactacttggaagagtttggagatttaaccctaaacaagtaagagagccactggtctattatgtayggaccccagtttcttcagctgtaaaatgtgaatcattctagcacctgttaggattaattaaatgaactaatacagtaaaacgttgagtacagttcttggc

SEQ ID NO: 24794 - DNA, 201 bp, Homo sapiens
gatttgcctgaaagtgagacaggcaaataaatcacatgtttctgccagcgtggaaaatattcactcaaatggcaaaggtctcaggctggggagctggataytgtcctgtaataggttcatctcagaactgaatcacacacttggagggtgttaatgctcttaggaacatctagttattccctttgaatagagtcctgtcct

SEQ ID NO: 24795 - DNA, 201 bp, Homo sapiens
gaaaccatacatgtgtcctatgaaaagaccagcatttgggcacctcccacacagagaacattgatgaccaaatagtgttgtcaaagatagagcagcaggayctgttaaacaagagtctgtttgccctttcttctattacctaccctccctcacccccagctcctggaaaagggaagagaaggctcagaaatattgaaagaa

SEQ ID NO: 24796 - DNA, 201 bp, Homo sapiens
tttttattttttacatagttcagggtattgctttccttctgaaggattcagatttcacatttgtgcaagagtctaatgcttagtatttaattctagtggcmcagagctttttcttttctccctcttctctccagcctcatggctttggtttagaattccttcagcctgatagaatattgtattttataatttccttattgt

SEQ ID NO: 24797 - DNA, 201 bp, Homo sapiens
tcctagcattgatggtctttacaatttggcatgattttgcagtggctggtactggttgctcctttccatgtttagtgcttccttcagaagctctcttaggkcaggcctggtggtgacaaaatctctcagcatttgcttgtctgtaaaggattttatttctccttcacttatgaagcttagtttggctggatatgaaattct

SEQ ID NO: 24798 - DNA, 201 bp, Homo sapiens
ttatcttctgtatatctactgtgtgggggggcggtcgggggggttaccacagggatcaaattgaacactttatagttatggcagtctgttttaagctgacracaccttcaatcacatacagaaactctatactttactcattccccccgccacaactttatgtaatcgacgtcatattttacttccttctatattgtgttt

SEQ ID NO: 24799 - DNA, 201 bp, Homo sapiens
ttttcttgttgatcctagtcgttttaggatttgatcttagatctcgcttatactttcagattatatttaagaatcaagcaagcagaccatataacatctascctcacggaatcactgatgtccgtcctttgtattcaaggagattaccaaaaggtaaatattccctcgatttatagctcttttttacctgtagatacagat

SEQ ID NO: 24800 - DNA, 201 bp, Homo sapiens; identical to SEQ ID NO: 3532

SEQ ID NO: 24801 - DNA, 201 bp, Homo sapiens
ttagaagcttggagataacatgagactgatgcaggttttagtccatttcatgggctcttctcttttcaggcttccagtgtatacttgctttctccacttcmcctcacctttccttccacagaaaggtcagggtatggagctcatatgagggtttagaggaatttggctcaagggccagggccagcttcctccagtgtttcg

SEQ ID NO: 24802 - DNA, 201 bp, Homo sapiens
cggcctcccaaagtgctgggattacagatgtgagccattgggtctggcctttaatcagaaacatttaaagtgaaagcactgtggtaacttatgttgaaatmccttagaaatcaatggaaactgcacagagagggggtaggatagacgtagtggaaccaaggatatgatatggaaaaaggagaaaggtagcaaactagggat

SEQ ID NO: 24803 - DNA, 201 bp, Homo sapiens
attaaccttttgcttctccagttgaacatttgtagcaataagtcatgcaaatagagctctccacctgcttctttctgtgccttttgcgattctgctttagkgccaccagaagatactacctgggtgcagtggaactgtcatgggactatatgcaaagtgatctcggtgagctgcctgtggacgcaaggtaaaggcatgtcc

SEQ ID NO: 24804 - DNA, 201 bp, Homo sapiens
tctccagttgaacatttgtagcaataagtcatgcaaatagagctctccacctgcttctttctgtgccttttgcgattctgctttagtgccaccagaagatrctacctgggtgcagtggaactgtcatgggactatatgcaaagtgatctcggtgagctgcctgtggacgcaaggtaaaggcatgtcctgtagggtctgatc

SEQ ID NO: 24805 - DNA, 201 bp, Homo sapiens
tggcaggaaaaggctctcattgtcaaagttcaaagtaattgatcattgaaaaaataatgatcacattaaaaacaacacttatataatagagatacatattrtaatactcataaatgaaatgatatcctgtctaggattggcttcaaacacatccaagctgatgttacaatcattaggtgaattcctgatgtggaatttgac

SEQ ID NO: 24806 - DNA, 201 bp, Homo sapiens
gttgaacatttgtagcaataagtcatgcaaatagagctctccacctgcttctttctgtgccttttgcgattctgctttagtgccaccagaagatactaccbgggtgcagtggaactgtcatgggactatatgcaaagtgatctcggtgagctgcctgtggacgcaaggtaaaggcatgtcctgtagggtctgatcggggcc

SEQ ID NO: 24807 - DNA, 201 bp, Homo sapiens
tagcaataagtcatgcaaatagagctctccacctgcttctttctgtgccttttgcgattctgctttagtgccaccagaagatactacctgggtgcagtggwactgtcatgggactatatgcaaagtgatctcggtgagctgcctgtggacgcaaggtaaaggcatgtcctgtagggtctgatcggggccaggattgtgggg

SEQ ID NO: 24808 - DNA, 201 bp, Homo sapiens
agagaagcttgtatttttctcactccttgccttgattgaatcatataagctgttttagagttggatttgagcctacctagaatttttcttcccaacctctmatctttttttctcttatacagaagttataaaagtcaatatttgaacaatggccctcagcggattggtaggaagtacaaaaaagtccgatttatggcatac

SEQ ID NO: 24809 - DNA, 201 bp, Homo sapiens
ccgactactcagtcctccgtcttccggtccagggccccttgccaagcaccgggtccacctctccgtccccaccccggttgccttagaagtccgtcctgtcscaacactgcagtcatggtcttgaggcccacccgccccaacgaacaccatcatgctgaggactttcccgggcaggccctgacttgctcagaaccagcgggg

SEQ ID NO: 24810 - DNA, 201 bp, Homo sapiens
ttgatttgagacggagtctcactctgtcgctcaggctgcagtgtggtggtgcaatctccactcaccataacctctgcttcctgggctcaagcgattctccrgcctcaaagcattctctatcagaatcccaaagacatttttttttttgaggaatagaaaaatctatcctaaaattcagatggaatttcaagggaccctgaa

SEQ ID NO: 24811 - DNA, 201 bp, Homo sapiens
aaagtatataaaaatctaagaaaagtcagcatttatttatatgttactgaaaattaattaatttggattgaattaatatattctaaaataattctaatcamacctgtttttaatttataccttagcataaattagggaagtaaattttgcataatttgtttttatcctattttttatggtgaaatcagcttcactgtacct

SEQ ID NO: 24812 - DNA, 201 bp, Homo sapiens
tttttcctttcttcacgcagatttcctcctagagtgccaaaatcttttccattcaacacctcagtcgtgtacaaaaagactctgtttgtagaattcacggwtcaccttttcaacatcgctaagccaaggccaccctggatgggtaatgaaaacaatgttgaatgctatttatgaaattgggtatcttattttctatcacag

SEQ ID NO: 24813 - DNA, 201 bp, Homo sapiens
attgtttggtttgtctgactccagatggcatggaagcttatgtcaaagtagacagctgtccagaggaaccccaactacgaatgaaaaataatgaagaagcrgaagactatgatgatgatcttactgattctgaaatggatgtggtcaggtttgatgatgacaactctccttcctttatccaaattcgctcagttgccaaga

SEQ ID NO: 24814 - DNA, 201 bp, Homo sapiens
tttttgaagtgtccaccaaaatgaacgactttttcctttcttcacgcagatttcctcctagagtgccaaaatcttttccattcaacacctcagtcgtgtamaaaaagactctgtttgtagaattcacggatcaccttttcaacatcgctaagccaaggccaccctggatgggtaatgaaaacaatgttgaatgctatttat

SEQ ID NO: 24815 - DNA, 201 bp, Homo sapiens
tccactgtgaccttgactctaacttttggaataacaggttttctggagtactatccccaagtaacctttggcggacatctcattcttacaggtctgctagbtcctaccatccaggctgaggtttatgatacagtggtcattacacttaagaacatggcttcccatcctgtcagtcttcatgctgttggtgtatcctactgg

SEQ ID NO: 24816 - DNA, 201 bp, Homo sapiens
tactatccccaagtaacctttggcggacatctcattcttacaggtctgctaggtcctaccatccaggctgaggtttatgatacagtggtcattacacttamgaacatggcttcccatcctgtcagtcttcatgctgttggtgtatcctactggaaagcttctgagggtgagtaaaataccctcctattgtcctgtcattct

SEQ ID NO: 24817 - DNA, 201 bp, Homo sapiens
tccccaagtaacctttggcggacatctcattcttacaggtctgctaggtcctaccatccaggctgaggtttatgatacagtggtcattacacttaagaacrtggcttcccatcctgtcagtcttcatgctgttggtgtatcctactggaaagcttctgagggtgagtaaaataccctcctattgtcctgtcattctatgaa

SEQ ID NO: 24818 - DNA, 201 bp, Homo sapiens
acctttggcggacatctcattcttacaggtctgctaggtcctaccatccaggctgaggtttatgatacagtggtcattacacttaagaacatggcttcccrtcctgtcagtcttcatgctgttggtgtatcctactggaaagcttctgagggtgagtaaaataccctcctattgtcctgtcattctatgaatagaacagtg

SEQ ID NO: 24819 - DNA, 201 bp, Homo sapiens; identical to SEQ ID NO: 3571

SEQ ID NO: 24820 - DNA, 201 bp, Homo sapiens; identical to SEQ ID NO: 3573

SEQ ID NO: 24821 - DNA, 201 bp, Homo sapiens
ttttcatagatgccctttgtcaaattgaggaagtttccttctattcttggtgtgagagtttttatcaagatttgatattagattttgtcaaatgctttttstgcatctattcaaatggtcatatggtttatcttgtttattctgttatggtgaattaccttgattgattttttaatgaggaactagctatgtattcccagg

SEQ ID NO: 24822 - DNA, 201 bp, Homo sapiens
tctgtgggtagtattttcactttcctaatagtatcctgtgatgcacaaagtttttcattttgatgaaatccaatatttatttattttacccctttggttgyttgtatttttgttgtcatatctaagaaatcaatgtcaaatcaaagatcactaagatttaaacctatattttcttttgagacttttatagttttagttctt

SEQ ID NO: 24823 - DNA, 201 bp, Homo sapiens
agacaaccaataaatgctatctttcctctttcaggtttttcagggaaatcaagactccttcacacctgtggtgaactctctagacccaccgttactgactbgctaccttcgaattcacccccagagttgggtgcaccagattgccctgaggatggaggttctgggctgcgaggcacaggacctctactgagggtggccact

SEQ ID NO: 24824 - DNA, 201 bp, Homo sapiens; identical to SEQ ID NO: 3576

SEQ ID NO: 24825 - DNA, 201 bp, Homo sapiens; identical to SEQ ID NO: 3577

SEQ ID NO: 24826 - DNA, 201 bp, Homo sapiens
atttgtgctaatctctccatacaggtcttctttggcaatgtggattcatctgggataaaacacaatatttttaaccctccaattattgctcgatacatccrtttgcacccaactcattatagcattcgcagcactcttcgcatggagttgatgggctgtgatttaaatagtaagtgccaagtcatcccatatccttcttcc

SEQ ID NO: 24827 - DNA, 201 bp, Homo sapiens
tggtatggttaagagggatttgggaatttctgggagtaaatggtgaccaagaggctactagtccaactctattgccctcaggtgaataatccaaaagagtsgctgcaagtggacttccagaagacaatgaaagtcacaggagtaactactcagggagtaaaatctctgcttaccagcatgtatgtgaaggagttcctcatc

SEQ ID NO: 24828 - DNA, 201 bp, Homo sapiens
gtcctttcactttctttttgatatggtctctgttgcctaggttggagtgcagtggtgcgatcatagattactgcagtcttgaactcctggctgggctcacrcggtcttcccacctcagcctccagagtgggactacaggtgtgtgccactatgcctggctaaattttcgggttttgtgtgtggggtggggaagattggggt

SEQ ID NO: 24829 - DNA, 201 bp, Homo sapiens
agaggaatgtcatcctgttttctgtatttgatgagaaccgaagctggtacctcacagagaatatacaacgctttctccccaatccagctggagtgcagctygaggatccagagttccaagcctccaacatcatgcacagtgagtaaagcagcacttaagtccagtgggtggtgaataaagaaaaattgatgtaatcaaagt

SEQ ID NO: 24830 - DNA, 201 bp, Homo sapiens
gattctgccttctgatgccagagtgggtcatcactccttgatgagatactacaaacagtgatttggcttgtcaagagctgtggtagttgctaaatattgtraggccatgggccgagtgcttcagtaatagagagccctgggatagactggcaacacaggagcagctgttacatgaaagtgagacatgcattatatccaaag

SEQ ID NO: 24831 - DNA, 201 bp, Homo sapiens
gtagaattggtatcatttcttttttaaatgtttattcaccagggaaatcatcttatcccagtgttttttgttttggtttggttttttttttaagggtcttwattgtgaattctatttttaataggtaaagggctatttgaattttctatttcttataggataaattttaataatttcttttaagaaattccatttgagact

SEQ ID NO: 24832 - DNA, 201 bp, Homo sapiens
ttccctggtggaagccatacatatgtctggcaggtcctgaaagagaatggtccaatggcctctgacccactgtgccttacctactcatatctttctcatgwggacctggtaaaagacttgaattcaggcctcattggagccctactagtatgtagagaaggtaagtgtatgaaagcgtaggattgagatgaaataagcaga

SEQ ID NO: 24833 - DNA, 201 bp, Homo sapiens
cagaaattgctttttactctgtattcactttccatgtatttgtgctaatctctccatacaggtcttctttggcaatgtggattcatctgggataaaacacratatttttaaccctccaattattgctcgatacatccgtttgcacccaactcattatagcattcgcagcactcttcgcatggagttgatgggctgtgattt

SEQ ID NO: 24834 - DNA, 201 bp, Homo sapiens
ccttttgctcagaaagaccctgggaatgtaggtcaatcataatgcagtagcattctcctgtcccaaccatcaaagaattcagtcaccctgtttctcatctsctggggggaggggagtggtcagaactcaatctccacaacccccaactgtaagggtcacgtagcaagcactttgcatttgaggggtccaaaagtagtggaa

SEQ ID NO: 24835 - DNA, 201 bp, Homo sapiens
gaggtcaggagaaagggcatgcagaccatgtgggatgctctaggacctaggccatggtaaagatgtagggttttaccctgatggaggtcagaagccattgraggattctgagaagaggagtgacaggactcgctttatagttttaaattataactataaattatagtttttaaaacaatagttgcctaacctcatgttata

SEQ ID NO: 24836 - DNA, 201 bp, Homo sapiens
cttcccatatagcctgcagaaacatgagccaattcaatctcttttctttataaattacctagtctctggtatagaacagcctaatatagcaagacactctracattgtttggtttgtctgactccagatggcatggaagcttatgtcaaagtagacagctgtccagaggaaccccaactacgaatgaaaaataatgaagaa

SEQ ID NO: 24837 - DNA, 201 bp, Homo sapiens
tcatgtgtctgttggctgcataaatgtcttcttttgagaagtgtctgttcatatcctttgtataagattattagtggatttctcagaagaaatattgtagrccagaagggagtgaaaatatagatttaaaatcctgaaaggaaataaaaactagcaatgaaaaatactatatccagtaattttatctttcagaaatgaagg

SEQ ID NO: 24838 - DNA, 201 bp, Homo sapiens
cacccaggctggagtgcagtggtgcgatctcggctcactgcaagctccgcctcccgggttcacgccattctcctgcctcagcctcccgagtagctgggackacaggcgcccgccaccacgcctggctaattttttatactgatagtagagacggggtttcaccgtgttagccaggatagtctcgatctcctgacctcatga

SEQ ID NO: 24839 - DNA, 201 bp, Homo sapiens
atttcttcctgctataggagctgaatatgatgatcagaccagtcaaagggagaaagaagatgataaagtcttccctggtggaagccatacatatgtctggyaggtcctgaaagagaatggtccaatggcctctgacccactgtgccttacctactcatatctttctcatgtggacctggtaaaagacttgaattcaggcct

SEQ ID NO: 24840 - DNA, 201 bp, Homo sapiens
ctgtggcaatgacagtggctggcaacagaaacctgccggagtaaaaacttagggaggggaacattattcttcattcagtacagctacagatctaagacatygggggaaaagcacattactttctctctgtctttccccttccattgcttgaccttagctatgatgtagttgtggaaattggaagcttctggttagaaaacc

SEQ ID NO: 24841 - DNA, 201 bp, Homo sapiens
cttcctgctataggagctgaatatgatgatcagaccagtcaaagggagaaagaagatgataaagtcttccctggtggaagccatacatatgtctggcaggycctgaaagagaatggtccaatggcctctgacccactgtgccttacctactcatatctttctcatgtggacctggtaaaagacttgaattcaggcctcatt

SEQ ID NO: 24842 - DNA, 201 bp, Homo sapiens; identical to SEQ ID NO: 3600

SEQ ID NO: 24843 - DNA, 201 bp, Homo sapiens; identical to SEQ ID NO: 3601

SEQ ID NO: 24844 - DNA, 201 bp, Homo sapiens; identical to SEQ ID NO: 3602

SEQ ID NO: 24845 - DNA, 201 bp, Homo sapiens
aaagggagaaagaagatgataaagtcttccctggtggaagccatacatatgtctggcaggtcctgaaagagaatggtccaatggcctctgacccactgtgscttacctactcatatctttctcatgtggacctggtaaaagacttgaattcaggcctcattggagccctactagtatgtagagaaggtaagtgtatgaaag

SEQ ID NO: 24846 - DNA, 201 bp, Homo sapiens
aagaagatgataaagtcttccctggtggaagccatacatatgtctggcaggtcctgaaagagaatggtccaatggcctctgacccactgtgccttacctamtcatatctttctcatgtggacctggtaaaagacttgaattcaggcctcattggagccctactagtatgtagagaaggtaagtgtatgaaagcgtaggatt

SEQ ID NO: 24847 - DNA, 201 bp, Homo sapiens
agaagatgataaagtcttccctggtggaagccatacatatgtctggcaggtcctgaaagagaatggtccaatggcctctgacccactgtgccttacctacycatatctttctcatgtggacctggtaaaagacttgaattcaggcctcattggagccctactagtatgtagagaaggtaagtgtatgaaagcgtaggattg

SEQ ID NO: 24848 - DNA, 201 bp, Homo sapiens
taaagtcttccctggtggaagccatacatatgtctggcaggtcctgaaagagaatggtccaatggcctctgacccactgtgccttacctactcatatcttyctcatgtggacctggtaaaagacttgaattcaggcctcattggagccctactagtatgtagagaaggtaagtgtatgaaagcgtaggattgagatgaaat

SEQ ID NO: 24849 - DNA, 201 bp, Homo sapiens
cttccctggtggaagccatacatatgtctggcaggtcctgaaagagaatggtccaatggcctctgacccactgtgccttacctactcatatctttctcatrtggacctggtaaaagacttgaattcaggcctcattggagccctactagtatgtagagaaggtaagtgtatgaaagcgtaggattgagatgaaataagcag

SEQ ID NO: 24850 - DNA, 201 bp, Homo sapiens
attggaggcgcagcctctgagacggtaattaggattagataaggtcatcggggtgagacccccaggatgcgactggtggctttataagaataggaagagargcctgaaacgacatacacgctcttgccctctcgccgtgtgataccctctgccgtccccagatgccgggtcacttcccagtccccagaacggtaagaaata

SEQ ID NO: 24851 - DNA, 201 bp, Homo sapiens
aacggtaagaaataaatttcttttctttataaattgttcagtgtcgggtattcaattatggcaacagaaaacagactaagacatcttttcatgtgcttctyggccctctgtacctctgctttggaggaatgtctattcaagccctttgcccattttttaattcggttgattgtattttggctgtgggcttctaaaacttat

SEQ ID NO: 24852 - DNA, 201 bp, Homo sapiens
gtacgctccacctttgggggcagggcaaagacaaacaaaaagacagcagtaacctctgcagacttaaatgtccctgtctgacagctttgaagagagtagtsgttctcccagcacagagtttgtgatctgagaacggacagactgcctcctcaagtgggtccctgacccccgagtagcctaactgggaggcacgccccagta

SEQ ID NO: 24853 - DNA, 201 bp, Homo sapiens
gacaattttatttcttcctgctataggagctgaatatgatgatcagaccagtcaaagggagaaagaagatgataaagtcttccctggtggaagccatacayatgtctggcaggtcctgaaagagaatggtccaatggcctctgacccactgtgccttacctactcatatctttctcatgtggacctggtaaaagacttgaa

SEQ ID NO: 24854 - DNA, 201 bp, Homo sapiens
ttgaggatttttgcatcaatgttcatcagagatattggcctgtagtttctttttgtgtatgtgtgtgtctttgtctggtttggtttcagggtaatactggmcttgtggaatcagtttggaagtatttttcccccttgatttttgggatagtttgtgaagagctggtattagttctttttttttattattatacattaagtt

SEQ ID NO: 24855 - DNA, 201 bp, Homo sapiens
agactgaggcagaagattgcttgaacccaggaggtggaggttgcagtgagcagagatcacgccactgcactccagactggcagacagaccgagactccatytgaaaaaaaaaaagaagaggaaatgtgtacacacagagacaccagggatgcatattcacagaggaaagaccaagccaaggagaggtgtcagtaaaaacca

SEQ ID NO: 24856 - DNA, 201 bp, Homo sapiens
aatggtattgcctaggttttcttctagggtttttatggttttaggtctaacgtttaagtctttaatccatcttgaattaattttagtataaggtgtaaggmagggttccagtttcagctttctacatatggctagccagttttcccagcaccatttattaaatagggaatcctttccccactgcttatttttctcaggctt

SEQ ID NO: 24857 - DNA, 201 bp, Homo sapiens
gccctaacactagtatttcagaatgtgactgtatttggagatagggtctttaaggggtttattaagttaaaatgaggttgttacaatgggccctaatccartatgactagtgtccttataagaagaggaaatgtgggccaggcacagtggctcacgcctgtaatcccagcattttgggaggccaaggcgggcggatcacga

SEQ ID NO: 24858 - DNA, 201 bp, Homo sapiens
caaaggatgaagtcaaaatggatgctgaagacagaaatgaagaacaatgccaccaagcagatgcactttagggtccaagtgagattctgagagtctgccamgattgagtgattgtctgctgcccaagtttcctccttgccctgaggaccagggaaagccagattgtatgatggacacttttgctgctacttcacttgctct

SEQ ID NO: 24859 - DNA, 201 bp, Homo sapiens
ctctccatacaggtcttctttggcaatgtggattcatctgggataaaacacaatatttttaaccctccaattattgctcgatacatccgtttgcacccaaytcattatagcattcgcagcactcttcgcatggagttgatgggctgtgatttaaatagtaagtgccaagtcatcccatatccttcttccctcaaccatggg

SEQ ID NO: 24860 - DNA, 201 bp, Homo sapiens
ctagtaaaaagttctctgtcagtttttggtcagaatgggtctttattttgcctagataccaagtccttggttggatttacatattgtgaatgttttctccmagtctgtggtttgtcttttcactcctttaagggtgcattatggttaatagaagttcttacatttaattaattcttatttttcagttttttatggttaatg

SEQ ID NO: 24861 - DNA, 201 bp, Homo sapiens
acccctttatagctgctgttttgaactccaacatggataggttaaaggtaaggggataagatagttcttacctatttacagctggcaccattgttgtaaastagcttaacactgtttgtgcctggcaatacttgttgactctttctcctgcagggcactttcagggaactctttagagactcccttacgtgactgtcatga

SEQ ID NO: 24862 - DNA, 201 bp, Homo sapiens
tgcaaatagagctctccacctgcttctttctgtgccttttgcgattctgctttagtgccaccagaagatactacctgggtgcagtggaactgtcatgggaytatatgcaaagtgatctcggtgagctgcctgtggacgcaaggtaaaggcatgtcctgtagggtctgatcggggccaggattgtggggatgtaagtctgct

SEQ ID NO: 24863 - DNA, 201 bp, Homo sapiens
cttcatttctgaggcatagaagtatagcatagtggttaggagcatgacttctggagccagagtacatgggtttgaatgctaccactcacaagctgtgtggmcatggagaagttgcctaacctctccgtgcttcagtttcatcacccataaaatgaaggtaagaatagtacctgtatttaaaagcacctagaacagttcctg

SEQ ID NO: 24864 - DNA, 201 bp, Homo sapiens
gtcatgcaaatagagctctccacctgcttctttctgtgccttttgcgattctgctttagtgccaccagaagatactacctgggtgcagtggaactgtcatrggactatatgcaaagtgatctcggtgagctgcctgtggacgcaaggtaaaggcatgtcctgtagggtctgatcggggccaggattgtggggatgtaagtc

SEQ ID NO: 24865 - DNA, 201 bp, Homo sapiens
catatatgtctatgatctagtttgaataaatttttgtgtatggtgtgaagaagaggtctaacctcttttttattttttgcatgtaaacatccagttgtccyggcaccatttgttgaaaatatgattcttttcccattaagtcatcttgacacccttgttgaaaatcaattgaccataaatgtgagagtttatttctgaact

SEQ ID NO: 24866 - DNA, 201 bp, Homo sapiens
aatataccttatctggccgggcgcggtggctcacgcctgtaatttcagcagtttcggaggccgaggcgggcggatcacgcggtcaggagatcgaggccatsctggctaacatggtgaaaccccgtctctactaaaaatacaaaaaattagccgggcatggtggcggccgcctgtagtcccagctactcgggaggctgaggc

SEQ ID NO: 24867 - DNA, 201 bp, Homo sapiens; identical to SEQ ID NO: 3655

SEQ ID NO: 24868 - DNA, 201 bp, Homo sapiens
tttatctctgtgtattttataagtgtgatgctattgttaataagatagttttctcctatttccatttatgagtgcttagtaccaaatagagataagctatkggtttgtgtattttcagctttttcttttgagcctgggtctcattttgtcacccaggctggagtgcagtggggtgatctcaccttactgcagcctcaacct

SEQ ID NO: 24869 - DNA, 201 bp, Homo sapiens
taacaattaatattgagataattttacttaatacactgtgtatattagtgtccatctagcatgcagcctgaggcacagagaataatagtttgagtataaamttgaattgaatggaatacatcattaatttattatctagctttctgttattgtataggcagtcacatgtatttaccagaaaaaagttgatagaatttttat

SEQ ID NO: 24870 - DNA, 201 bp, Homo sapiens
ctgattaacaggataagctgactctggacacatcctgacagcctctgccaaggtttgaaataaacagctgggaaaattcagttttatattatctgttcccrcagctgctcagtttcttctaaccacaggtcagggaatataataggttttccgattagttttagataaaatgtgaaagaacagttcatgtcaaggacaatg

SEQ ID NO: 24871 - DNA, 201 bp, Homo sapiens; identical to SEQ ID NO: 3659

SEQ ID NO: 24872 - DNA, 201 bp, Homo sapiens
ccggcagcagcttggcgggcggtggttgcaggaggagcagcagcagcacgcgggacacctcgcagcggaccagcacgtccgagaaggcgcccagggcggcrggagagggcgccgccgagccggagttcggaggaagcagcgcggccggtagggcgggcgtcgccccgggcccgggctggggtgccggcggcgggggcggcg

SEQ ID NO: 24873 - DNA, 201 bp, Homo sapiens
gtgtggtagtgtgcacttgtagttcttgttacaagggtgcagtgagctagggttgtgccactgcactccagcctgggaaacagaacaagaccctgcctctaaaaaaaaaaataaagagaaggagaagaagaagaaaaggaaaagaaaaaaaaaaagaaccaagcctgctggccaggcgtggtaactcatgcctgtaatccc

SEQ ID NO: 24874 - DNA, 201 bp, Homo sapiens; identical to SEQ ID NO: 3664

SEQ ID NO: 24875 - DNA, 201 bp, Homo sapiens; identical to SEQ ID NO: 3666

SEQ ID NO: 24876 - DNA, 201 bp, Homo sapiens; identical to SEQ ID NO: 3668

SEQ ID NO: 24877 - DNA, 201 bp, Homo sapiens; identical to SEQ ID NO: 3670

SEQ ID NO: 24878 - DNA, 201 bp, Homo sapiens; identical to SEQ ID NO: 3672

SEQ ID NO: 24879 - DNA, 201 bp, Homo sapiens
tcagtcagatcaagaggaaattgactatgatgataccatatcagttgaaatgaagaaggaagattttgacatttatgatgaggatgaaaatcagagccccygcagctttcaaaagaaaacacgacactattttattgctgcagtggagaggctctgggattatgggatgagtagctccccacatgttctaagaaacaggta

SEQ ID NO: 24880 - DNA, 201 bp, Homo sapiens
ctagcctcaaattactataatgtagatagaggccacttttatttatctggagttagaccacagttttcttgttgatcctagtcgttttaggatttgatctyagatctcgcttatactttcagattatatttaagaatcaagcaagcagaccatataacatctaccctcacggaatcactgatgtccgtcctttgtattcaa

SEQ ID NO: 24881 - DNA, 201 bp, Homo sapiens
cagtcagatcaagaggaaattgactatgatgataccatatcagttgaaatgaagaaggaagattttgacatttatgatgaggatgaaaatcagagcccccrcagctttcaaaagaaaacacgacactattttattgctgcagtggagaggctctgggattatgggatgagtagctccccacatgttctaagaaacaggtat

SEQ ID NO: 24882 - DNA, 201 bp, Homo sapiens
ttagtaagagcttaataggctacgtgcggtggctcacgcctgtaatctcagcactttgggaggccgagacaggaggattgcttgagctcaggatttcaagmccatcctgggcaaaatagtaagaccttgtctacaaaaaaaaaaaaaaaaaaaaaaaattagctgggcatggtggtgtgtgcctgtagtcccacctactca

SEQ ID NO: 24883 - DNA, 201 bp, Homo sapiens
aaggccaggcacagtggttcatgcctgtaatcccagcactttgggaggctgaagtaggaggaataattagactttgatattaaaaatggggaagatatggmggtataagatatgaggaagtatgtcttcttggacttttctgaaatctgccagccatgagcatccactctttttatcttttgatacctgttttatattaac

SEQ ID NO: 24884 - DNA, 201 bp, Homo sapiens
tgactatgatgataccatatcagttgaaatgaagaaggaagattttgacatttatgatgaggatgaaaatcagagcccccgcagctttcaaaagaaaacabgacactattttattgctgcagtggagaggctctgggattatgggatgagtagctccccacatgttctaagaaacaggtatgaatgcattggttattcctt

SEQ ID NO: 24885 - DNA, 201 bp, Homo sapiens
tattgcctaggttttcttctagggtttttatggttttaggtctaacgtttaagtctttaatccatcttgaattaattttagtataaggtgtaaggaagggwtccagtttcagctttctacatatggctagccagttttcccagcaccatttattaaatagggaatcctttccccactgcttatttttctcaggcttgtcaa

SEQ ID NO: 24886 - DNA, 201 bp, Homo sapiens
tatgtggcttgttgtactctaattgagctatttatggttttgcttgtgggtaggtgtaaaacatttgaaggattttccaattctgccaggagaaatattcraatataaatggacagtgactgtagaagatgggccaactaaatcagatcctcggtgcctgacccgctattactctagtttcgttaatatggagagagatct

SEQ ID NO: 24887 - DNA, 201 bp, Homo sapiens
tgaaatgaagaaggaagattttgacatttatgatgaggatgaaaatcagagcccccgcagctttcaaaagaaaacacgacactattttattgctgcagtgragaggctctgggattatgggatgagtagctccccacatgttctaagaaacaggtatgaatgcattggttattcctttgctctgctcttgtgacatttgac

SEQ ID NO: 24888 - DNA, 201 bp, Homo sapiens
ctgggcaggcctcaggaaacgtgcaatcatggcggaaggcgaaggggaagcaagcaccttcttcacatgttggagcaggaggaagagagagagaacgcacrcaaagggggaagcgctgcacattttcaaacaatcatcagatcttgtgagcgctctatcagaagaatagcaagggggaagtccgcccccatgattcaatca

SEQ ID NO: 24889 - DNA, 201 bp, Homo sapiens
taaagactaaggcctaattccactggtttctttgaattccgtggtcctaagtccattttcaggtaagtggtttcccgctggatgtgggtctctttaagccrtatcaaacagtaggtgagtgtatcagttataaatgtcttaagtaataggaggcccaaattataatggctcaaataaaagtatatttttctcataccatgc

SEQ ID NO: 24890 - DNA, 201 bp, Homo sapiens
catcagtagcatttctttacccctttcaatatatgtaattaacagataatgtcagacaagaggaatgtcatcctgttttctgtatttgatgagaaccgaakctggtacctcacagagaatatacaacgctttctccccaatccagctggagtgcagcttgaggatccagagttccaagcctccaacatcatgcacagtgag

SEQ ID NO: 24891 - DNA, 201 bp, Homo sapiens
aacctttggcggacatctcattcttacaggtctgctaggtcctaccatccaggctgaggtttatgatacagtggtcattacacttaagaacatggcttccyatcctgtcagtcttcatgctgttggtgtatcctactggaaagcttctgagggtgagtaaaataccctcctattgtcctgtcattctatgaatagaacagt

SEQ ID NO: 24892 - DNA, 201 bp, Homo sapiens
ggttttctggagtactatccccaagtaacctttggcggacatctcattcttacaggtctgctaggtcctaccatccaggctgaggtttatgatacagtggwcattacacttaagaacatggcttcccatcctgtcagtcttcatgctgttggtgtatcctactggaaagcttctgagggtgagtaaaataccctcctattg

SEQ ID NO: 24893 - DNA, 201 bp, Homo sapiens
aaccggataatcaattacagctttttactttttaaaaaaattgtttgaatcttaaaattataataggtgcgactttagcttccacttgctcagaaacttcrtatgtacatacagatttgtagaacccttgcaacaacaacatgattatcaatatgtggcttgttgtactctaattgagctatttatggttttgcttgtggg

SEQ ID NO: 24894 - DNA, 201 bp, Homo sapiens
ctgcagcgacttgatggcttccgtgtccttttcgtgggtagccatgaccaaagactggagcagcagaaagagctcctcgggaagctggccgctgctctcckgcccgtggctgtcaaaagcctcccaggagtacttctccagggtctgggcgtgctccggcagcagcttggcgggcggtggttgcaggaggagcagcagcag

SEQ ID NO: 24895 - DNA, 201 bp, Homo sapiens
tatttgtgctaatctctccatacaggtcttctttggcaatgtggattcatctgggataaaacacaatatttttaaccctccaattattgctcgatacatcygtttgcacccaactcattatagcattcgcagcactcttcgcatggagttgatgggctgtgatttaaatagtaagtgccaagtcatcccatatccttcttc

SEQ ID NO: 24896 - DNA, 201 bp, Homo sapiens
cttctttggcaatgtggattcatctgggataaaacacaatatttttaaccctccaattattgctcgatacatccgtttgcacccaactcattatagcattygcagcactcttcgcatggagttgatgggctgtgatttaaatagtaagtgccaagtcatcccatatccttcttccctcaaccatgggtagggtgactaact

SEQ ID NO: 24897 - DNA, 201 bp, Homo sapiens
aggacagtaagcctttttgttatatttaggccttcaactgattggataagttctacccacactggggagaacaatctgctttacttagtctaccaattcamatgttaatctcaccaaaaaacactctcacagacacacataaaataaagtttaatcaaatatatgggcaccccatggcccagtcaagttgacacataaaat

SEQ ID NO: 24898 - DNA, 201 bp, Homo sapiens; identical to SEQ ID NO: 3689

SEQ ID NO: 24899 - DNA, 201 bp, Homo sapiens
gcgaaatgaaggcagaaataaagatgttctttgaaaccaatgagaacaaagacacaatataccagaatctctgggacacatttaaagcagtgtgtagaggraaatttatagcactaagtgcccacaggagaaagcaggaaagatcaaaaattgacaccctaacatcacaatttaaagaactagagaagcaagagcaaacac

SEQ ID NO: 24900 - DNA, 201 bp, Homo sapiens; identical to SEQ ID NO: 3690

SEQ ID NO: 24901 - DNA, 201 bp, Homo sapiens
tgcataatagtctattatatgaatttatggaaccatagtttatgtaaccatttattttgaacaagcttttagacagtttcttttttcactatataaataaygctgtaatcacaacagtttttctaagataaaattccagaagtgcaatgtatttgagcatcttaagagtttttcttattaattatttggtaatgtcccttg

SEQ ID NO: 24902 - DNA, 201 bp, Homo sapiens; identical to SEQ ID NO: 3691

SEQ ID NO: 24903 - DNA, 201 bp, Homo sapiens
tgtgaacccctctctcaaaaagaaaacctaatgaaaatatcttttatgcgttaaagcaaaagaggaaattaggacacagacaggcacagagggacgaccayatgaagatatagaaagaggacagacacctacaagccaacgagagaggccttacaagaaaccaacccttagccaggtgtggtagtgtgcacttgtagttct

SEQ ID NO: 24904 - DNA, 201 bp, Homo sapiens
tttttagtgaaaagaaataatttctgttcctgttggtttttataaggtgtttttgagacagtggaaatgttaccatccaaagctggaatttggcgggtggratgccttattggcgagcatctacatgctgggatgagcacactttttctggtgtacagcaatagtgagtagcaatgtgggcagaggttccctacctactca

SEQ ID NO: 24905 - DNA, 201 bp, Homo sapiens
ggcactttgtcaaaggtgagttggctataaatgtgtggatttatttctgggttttctgtcgtgttccactggcatatatttctggttttatgccagtaccrtgctgtttttgttactacagctttgtagtatagtttcaagtcaagtagtgtcatgcctccagctttgttcattttgctccagattatttagctgtttgga

SEQ ID NO: 24906 - DNA, 201 bp, Homo sapiens
gcatgcttctccactgtgaccttgactctaacttttggaataacaggttttctggagtactatccccaagtaacctttggcggacatctcattcttacagrtctgctaggtcctaccatccaggctgaggtttatgatacagtggtcattacacttaagaacatggcttcccatcctgtcagtcttcatgctgttggtgta

SEQ ID NO: 24907 - DNA, 201 bp, Homo sapiens
ctctatccaggtatgagcttgtttgtgctctttcttctacctactctatttgttgagtacttactttaaatggtctaggcactgggaacacaatcagtgawcaaagcagacaagctccatgctcttaagtaatactttttcaaatgctttttaaaccatttgttcaaagcaaatgaacaagataatttcagatatagaaaa

SEQ ID NO: 24908 - DNA, 201 bp, Homo sapiens
tttagttaaatttattcctcgacattttattgtttcgatgctactgtaaaatgaatcatttccttaatcttattttcatgttattcattgctagggtgtasaaatacaaccgactgttgcagattgatcttggatactgcaactttgctgagccgaatatgctttgctgagcatactcagacagggttggcatattagtcc

SEQ ID NO: 24909 - DNA, 201 bp, Homo sapiens
caggctgaggtttatgatacagtggtcattacacttaagaacatggcttcccatcctgtcagtcttcatgctgttggtgtatcctactggaaagcttctgwgggtgagtaaaataccctcctattgtcctgtcattctatgaatagaacagtgagatgtgtgtgctttgtaatggtggcgttacaactcttttaaggtcct

SEQ ID NO: 24910 - DNA, 201 bp, Homo sapiens
ggctgaggtttatgatacagtggtcattacacttaagaacatggcttcccatcctgtcagtcttcatgctgttggtgtatcctactggaaagcttctgagsgtgagtaaaataccctcctattgtcctgtcattctatgaatagaacagtgagatgtgtgtgctttgtaatggtggcgttacaactcttttaaggtcctaa

SEQ ID NO: 24911 - DNA, 201 bp, Homo sapiens
gctcattttttagtgaaaagaaataatttctgttcctgttggtttttataaggtgtttttgagacagtggaaatgttaccatccaaagctggaatttggcsggtggaatgccttattggcgagcatctacatgctgggatgagcacactttttctggtgtacagcaatagtgagtagcaatgtgggcagaggttccctacc

SEQ ID NO: 24912 - DNA, 201 bp, Homo sapiens
ttatgtagaacctattggtgacaataaacttgacatgtttctttgagtgtacagtggatatagaaaggacaattttatttcttcctgctataggagctgamtatgatgatcagaccagtcaaagggagaaagaagatgataaagtcttccctggtggaagccatacatatgtctggcaggtcctgaaagagaatggtccaa

SEQ ID NO: 24913 - DNA, 201 bp, Homo sapiens
atgtagaacctattggtgacaataaacttgacatgtttctttgagtgtacagtggatatagaaaggacaattttatttcttcctgctataggagctgaatrtgatgatcagaccagtcaaagggagaaagaagatgataaagtcttccctggtggaagccatacatatgtctggcaggtcctgaaagagaatggtccaatg

SEQ ID NO: 24914 - DNA, 201 bp, Homo sapiens
aacctattggtgacaataaacttgacatgtttctttgagtgtacagtggatatagaaaggacaattttatttcttcctgctataggagctgaatatgatgrtcagaccagtcaaagggagaaagaagatgataaagtcttccctggtggaagccatacatatgtctggcaggtcctgaaagagaatggtccaatggcctct

SEQ ID NO: 24915 - DNA, 201 bp, Homo sapiens
gtaatggctcaggatcaaaggattcgatggtatctgctcagcatgggcagcaatgaaaacatccattctattcatttcagtggacatgtgttcactgtacvaaaaaaagaggagtataaaatggcactgtacaatctctatccaggtatgagcttgtttgtgctctttcttctacctactctatttgttgagtacttactt

SEQ ID NO: 24916 - DNA, 201 bp, Homo sapiens
ctgtgtccttctccagcaatcaatggctacataatggatacactacctggcttagtaatggctcaggatcaaaggattcgatggtatctgctcagcatggrcagcaatgaaaacatccattctattcatttcagtggacatgtgttcactgtacgaaaaaaagaggagtataaaatggcactgtacaatctctatccaggt

SEQ ID NO: 24917 - DNA, 201 bp, Homo sapiens
gtctgccacactaacacactgaaccctgctcatgggagacaagtgacagtacaggaatttgctctgtttttcaccatctttgatgagaccaaaagctggtrcttcactgaaaatatggaaagaaactgcagggctccctgcaatatccagatggaagatcccacttttaaagagaattatcgcttccatggtaatatattc

SEQ ID NO: 24918 - DNA, 201 bp, Homo sapiens
gacaaccaataaatgctatctttcctctttcaggtttttcagggaaatcaagactccttcacacctgtggtgaactctctagacccaccgttactgactcrctaccttcgaattcacccccagagttgggtgcaccagattgccctgaggatggaggttctgggctgcgaggcacaggacctctactgagggtggccactg

SEQ ID NO: 24919 - DNA, 201 bp, Homo sapiens
gagcaggaggaagagagagagaacgcacgcaaagggggaagcgctgcacattttcaaacaatcatcagatcttgtgagcgctctatcagaagaatagcaarggggaagtccgcccccatgattcaatcacctcccactaggcccttccttcaacaggtggggattacaattcgacatgagatttgggtggggacacagagc

SEQ ID NO: 24920 - DNA, 201 bp, Homo sapiens
agctggcatgatggtacacacctgtagtcccagctactagggaagctgggataggaggatcgcttgagcccaggaggtggaggctgcagtgagccatgatygcaccactgcactccagcctgggtgtcagagcaagaccctgtctgtaaaaaatcatttaactaaaaatgtatcaaaaaactaaatataaaagctaaaacc

SEQ ID NO: 24921 - DNA, 201 bp, Homo sapiens
gagtgtacagtggatatagaaaggacaattttatttcttcctgctataggagctgaatatgatgatcagaccagtcaaagggagaaagaagatgataaagwcttccctggtggaagccatacatatgtctggcaggtcctgaaagagaatggtccaatggcctctgacccactgtgccttacctactcatatctttctcat

SEQ ID NO: 24922 - DNA, 201 bp, Homo sapiens
ctggttctctctaggcctgaggctcagttatcaacttgggacttttatttaccctccctcaggataggtacctggttcttggataccaggtcttactcttrtttgagatactcctttattttggtggcaaacattccataatcacttcctgataatggtgacatttgaggtagattttctgagtctttatatgttagaata

SEQ ID NO: 24923 - DNA, 201 bp, Homo sapiens
cctagaatttttcttcccaacctctcatctttttttctcttatacagaagttataaaagtcaatatttgaacaatggccctcagcggattggtaggaagtrcaaaaaagtccgatttatggcatacacagatgaaacctttaagactcgtgaagctattcagcatgaatcaggaatcttgggacctttactttatggggaa

SEQ ID NO: 24924 - DNA, 201 bp, Homo sapiens
aatggccctcagcggattggtaggaagtacaaaaaagtccgatttatggcatacacagatgaaacctttaagactcgtgaagctattcagcatgaatcagraatcttgggacctttactttatggggaagttggagacacactgttggtaagttgaagaaaagatttaaggtcaggtaagaagaaaaagtctggagagttt

SEQ ID NO: 24925 - DNA, 201 bp, Homo sapiens
aactcctgagctcaagcgatctgcctgcctcagcctcccaaagtgctggaaccaaatctttttcttcttaaagacattcttgtagtgaatagcattaactwcttttcccttgtacatttctattttttgatttcttcttttgtttttctggaagtatattctcaagtaacttctaaatatgtggtacatagagggtgaact

SEQ ID NO: 24926 - DNA, 201 bp, Homo sapiens
gaacctattggtgacaataaacttgacatgtttctttgagtgtacagtggatatagaaaggacaattttatttcttcctgctataggagctgaatatgatkatcagaccagtcaaagggagaaagaagatgataaagtcttccctggtggaagccatacatatgtctggcaggtcctgaaagagaatggtccaatggcctc

SEQ ID NO: 24927 - DNA, 201 bp, Homo sapiens
gggaagttggagacacactgttggtaagttgaagaaaagatttaaggtcaggtaagaagaaaaagtctggagagttttgagtttctaaaatacctcataaktcagccttgtctccaatggacatgatcttttaaaagctataaatgttacacaaataatagctgattgtatgtatttaaagtttgagtatatagaataaaa

SEQ ID NO: 24928 - DNA, 201 bp, Homo sapiens
cctattggtgacaataaacttgacatgtttctttgagtgtacagtggatatagaaaggacaattttatttcttcctgctataggagctgaatatgatgatyagaccagtcaaagggagaaagaagatgataaagtcttccctggtggaagccatacatatgtctggcaggtcctgaaagagaatggtccaatggcctctga

SEQ ID NO: 24929 - DNA, 201 bp, Homo sapiens
ttggtgacaataaacttgacatgtttctttgagtgtacagtggatatagaaaggacaattttatttcttcctgctataggagctgaatatgatgatcagaycagtcaaagggagaaagaagatgataaagtcttccctggtggaagccatacatatgtctggcaggtcctgaaagagaatggtccaatggcctctgaccca

SEQ ID NO: 24930 - DNA, 201 bp, Homo sapiens
attgtcctgtcagacaaccaataaatgctatctttcctctttcaggtttttcagggaaatcaagactccttcacacctgtggtgaactctctagacccacygttactgactcgctaccttcgaattcacccccagagttgggtgcaccagattgccctgaggatggaggttctgggctgcgaggcacaggacctctactga

SEQ ID NO: 24931 - DNA, 201 bp, Homo sapiens
cctacaatgagattttttaaatagaagataaatgttctcacttctttttcagggagtctggccaaggaaaagacacagaccttgcacaaatttatactacwttttgctgtatttgatgaaggttagtgagtcttaatctgaattttggattcctgaaagaaatcctctgctactattaagaggaggtgattatagaaagat

SEQ ID NO: 24932 - DNA, 201 bp, Homo sapiens
cattgtcctgtcagacaaccaataaatgctatctttcctctttcaggtttttcagggaaatcaagactccttcacacctgtggtgaactctctagacccaycgttactgactcgctaccttcgaattcacccccagagttgggtgcaccagattgccctgaggatggaggttctgggctgcgaggcacaggacctctactg

SEQ ID NO: 24933 - DNA, 201 bp, Homo sapiens
atgagattttttaaatagaagataaatgttctcacttctttttcagggagtctggccaaggaaaagacacagaccttgcacaaatttatactactttttgmtgtatttgatgaaggttagtgagtcttaatctgaattttggattcctgaaagaaatcctctgctactattaagaggaggtgattatagaaagatcataaa

SEQ ID NO: 24934 - DNA, 201 bp, Homo sapiens; identical to SEQ ID NO: 3726

SEQ ID NO: 24935 - DNA, 201 bp, Homo sapiens
aatgagattttttaaatagaagataaatgttctcacttctttttcagggagtctggccaaggaaaagacacagaccttgcacaaatttatactactttttrctgtatttgatgaaggttagtgagtcttaatctgaattttggattcctgaaagaaatcctctgctactattaagaggaggtgattatagaaagatcataa

SEQ ID NO: 24936 - DNA, 201 bp, Homo sapiens
agattttttaaatagaagataaatgttctcacttctttttcagggagtctggccaaggaaaagacacagaccttgcacaaatttatactactttttgctgkatttgatgaaggttagtgagtcttaatctgaattttggattcctgaaagaaatcctctgctactattaagaggaggtgattatagaaagatcataaatta

SEQ ID NO: 24937 - DNA, 201 bp, Homo sapiens
tttaaatagaagataaatgttctcacttctttttcagggagtctggccaaggaaaagacacagaccttgcacaaatttatactactttttgctgtatttgwtgaaggttagtgagtcttaatctgaattttggattcctgaaagaaatcctctgctactattaagaggaggtgattatagaaagatcataaattacattac

SEQ ID NO: 24938 - DNA, 201 bp, Homo sapiens
aatagaagataaatgttctcacttctttttcagggagtctggccaaggaaaagacacagaccttgcacaaatttatactactttttgctgtatttgatgawggttagtgagtcttaatctgaattttggattcctgaaagaaatcctctgctactattaagaggaggtgattatagaaagatcataaattacattactgtt

SEQ ID NO: 24939 - DNA, 201 bp, Homo sapiens
taaatagaagataaatgttctcacttctttttcagggagtctggccaaggaaaagacacagaccttgcacaaatttatactactttttgctgtatttgatraaggttagtgagtcttaatctgaattttggattcctgaaagaaatcctctgctactattaagaggaggtgattatagaaagatcataaattacattactg

SEQ ID NO: 24940 - DNA, 201 bp, Homo sapiens; identical to SEQ ID NO: 3735

SEQ ID NO: 24941 - DNA, 201 bp, Homo sapiens
aatctctccatacaggtcttctttggcaatgtggattcatctgggataaaacacaatatttttaaccctccaattattgctcgatacatccgtttgcaccvaactcattatagcattcgcagcactcttcgcatggagttgatgggctgtgatttaaatagtaagtgccaagtcatcccatatccttcttccctcaaccat

SEQ ID NO: 24942 - DNA, 201 bp, Homo sapiens
gatcctagaagattattcttgcttttttttttttgtcgttattgttctacaggtaactttcagaaatcaggcctctcgtccctattccttctattctagcyttatttcttatgaggaagatcagaggcaaggagcagaacctagaaaaaactttgtcaagcctaatgaaaccaaaacttacttttggaaagtgcaacatca

SEQ ID NO: 24943 - DNA, 201 bp, Homo sapiens
aaagtccgatttatggcatacacagatgaaacctttaagactcgtgaagctattcagcatgaatcaggaatcttgggacctttactttatggggaagttgkagacacactgttggtaagttgaagaaaagatttaaggtcaggtaagaagaaaaagtctggagagttttgagtttctaaaatacctcataattcagccttg

SEQ ID NO: 24944 - DNA, 201 bp, Homo sapiens
agagtggcagtgtccctcagttcaagaaagttgttttccaggaatttactgatggctcctttactcagcccttataccgtggagaactaaatgaacatttsggactcctggggccatatataagagcagaagttgaagataatatcatggtgagttaaggacagtggaattacaagaaaattaattttatatatttatttt

SEQ ID NO: 24945 - DNA, 201 bp, Homo sapiens
tgttgtactctaattgagctatttatggttttgcttgtgggtaggtgtaaaacatttgaaggattttccaattctgccaggagaaatattcaaatataaakggacagtgactgtagaagatgggccaactaaatcagatcctcggtgcctgacccgctattactctagtttcgttaatatggagagagatctagcttcagg

SEQ ID NO: 24946 - DNA, 201 bp, Homo sapiens; identical to SEQ ID NO: 3742

SEQ ID NO: 24947 - DNA, 201 bp, Homo sapiens; identical to SEQ ID NO: 3743

SEQ ID NO: 24948 - DNA, 201 bp, Homo sapiens; identical to SEQ ID NO: 3744

SEQ ID NO: 24949 - DNA, 201 bp, Homo sapiens; identical to SEQ ID NO: 3745

SEQ ID NO: 24950 - DNA, 201 bp, Homo sapiens; identical to SEQ ID NO: 3746

SEQ ID NO: 24951 - DNA, 201 bp, Homo sapiens; identical to SEQ ID NO: 3747

SEQ ID NO: 24952 - DNA, 201 bp, Homo sapiens; identical to SEQ ID NO: 3748

SEQ ID NO: 24953 - DNA, 201 bp, Homo sapiens; identical to SEQ ID NO: 3749

SEQ ID NO: 24954 - DNA, 201 bp, Homo sapiens
ggggccgggtgggtggacgagtggacctgtcaggtcccaggggccgggtgtcagaagctagtcctcgccaggggccacttgagagatggtggtcgtgttgmaaagggtgctcagtagcctgtcgttgtgaaccaccatgtccagcagcaggggagtgatgttccgctctccgctgttctgggcctcgttgcccgccagctc

SEQ ID NO: 24955 - DNA, 201 bp, Homo sapiens
acactgggagcagggaaggagaaaggggaggcggtcattcatgagacacatgcttagctgactctatctttgccttctctctcatcagggaaaagttggcrctcagaaacaaagaactccttgatgcaggatagggatgctgcatctgctcgggcctggcctaaaatgcacacagtcaatggttatgtaaacaggtctctg

SEQ ID NO: 24956 - DNA, 201 bp, Homo sapiens
aggaaccatcgccaggcgtccttggaaatctcgccaataactttccttactgctcaaacactcttgatggaccttggacagtttctactgttttgtcatakctcttcccaccaacatggtaatatcttggatctttaaaatgaatattataaatatccagtcctacttttaataaaatttactggacaatgtacaggaata

SEQ ID NO: 24957 - DNA, 201 bp, Homo sapiens
tcaatctcttttctttataaattacctagtctctggtatagaacagcctaatatagcaagacactctgacattgtttggtttgtctgactccagatggcayggaagcttatgtcaaagtagacagctgtccagaggaaccccaactacgaatgaaaaataatgaagaagcggaagactatgatgatgatcttactgattct

SEQ ID NO: 24958 - DNA, 201 bp, Homo sapiens
actgatggctcctttactcagcccttataccgtggagaactaaatgaacatttgggactcctggggccatatataagagcagaagttgaagataatatcayggtgagttaaggacagtggaattacaagaaaattaattttatatatttattttcttgctgactataatgtattcccacttttggaaatttttaaagtata

SEQ ID NO: 24959 - DNA, 201 bp, Homo sapiens
ttctttataaattacctagtctctggtatagaacagcctaatatagcaagacactctgacattgtttggtttgtctgactccagatggcatggaagcttawgtcaaagtagacagctgtccagaggaaccccaactacgaatgaaaaataatgaagaagcggaagactatgatgatgatcttactgattctgaaatggatg

SEQ ID NO: 24960 - DNA, 201 bp, Homo sapiens
tttcatctttatatagtcaaaacctcctatcttttatcaatcttttcatttatatgtctctggatctttttcacttatgttttctgcctgagaatgtcttkgccacccccaagacactacaaaaatagtctatattttattctcttacttgtatagctttatttttacagtgagcaatctaattgccctggaagttacttt

SEQ ID NO: 24961 - DNA, 201 bp, Homo sapiens
ggcgggcgggccggggcggggcgacgtgccctgcgtccccctcggcgggctgccgccgtgcccgcgccggctccccagcccgagcctgccccttgccctgrtgaggtgcaaagagcgggatcggaggcggggcctggccgggctgtgagcggcgtatgcaaatcgagggtctcggggatgcggatccaagaccctgggaag

SEQ ID NO: 24962 - DNA, 201 bp, Homo sapiens
atataagctgttttagagttggatttgagcctacctagaatttttcttcccaacctctcatctttttttctcttatacagaagttataaaagtcaatattygaacaatggccctcagcggattggtaggaagtacaaaaaagtccgatttatggcatacacagatgaaacctttaagactcgtgaagctattcagcatgaa

SEQ ID NO: 24963 - DNA, 201 bp, Homo sapiens
tgtaaatttggttttgaacatgtgggttttttgagatatctaggtggagatgttgagaaagtgattggctgtatgagcctggagttccagaagaggtcagsaggggagacagaagaaggagcagtctgagaagtaggagaaaaaaacccacagagatgttggcacagaggccaagggaagagagagttttaaaaacgaatg

SEQ ID NO: 24964 - DNA, 201 bp, Homo sapiens
tcagagtggcagtgtccctcagttcaagaaagttgttttccaggaatttactgatggctcctttactcagcccttataccgtggagaactaaatgaacatktgggactcctggggccatatataagagcagaagttgaagataatatcatggtgagttaaggacagtggaattacaagaaaattaattttatatatttatt

SEQ ID NO: 24965 - DNA, 201 bp, Homo sapiens
aggctgcagtgtggtggtgcaatctccactcaccataacctctgcttcctgggctcaagcgattctccggcctcaaagcattctctatcagaatcccaaaracatttttttttttgaggaatagaaaaatctatcctaaaattcagatggaatttcaagggaccctgaatagccaaaacaatcttgaaaaagaacaacgtt

SEQ ID NO: 24966 - DNA, 201 bp, Homo sapiens
catcaatggatgaatggataaagaaactgtgatatagatacacaatggaatactattcatccatttaaaaaagatgaaatcctgtcattttcaacaacgtkgatgagcctggaggacattatgttaagtgaaataagccaggcagagaaagacaaatactccatgatctcagtcctatgtacaatctttaaaatttgatct

SEQ ID NO: 24967 - DNA, 201 bp, Homo sapiens
ttctccagggctcagagtggcagtgtccctcagttcaagaaagttgttttccaggaatttactgatggctcctttactcagcccttataccgtggagaacyaaatgaacatttgggactcctggggccatatataagagcagaagttgaagataatatcatggtgagttaaggacagtggaattacaagaaaattaatttt

SEQ ID NO: 24968 - DNA, 201 bp, Homo sapiens
aggccacttttatttatctggagttagaccacagttttcttgttgatcctagtcgttttaggatttgatcttagatctcgcttatactttcagattatatktaagaatcaagcaagcagaccatataacatctaccctcacggaatcactgatgtccgtcctttgtattcaaggagattaccaaaaggtaaatattccctc

SEQ ID NO: 24969 - DNA, 201 bp, Homo sapiens
ctgctttttttctccagggctcagagtggcagtgtccctcagttcaagaaagttgttttccaggaatttactgatggctcctttactcagcccttataccrtggagaactaaatgaacatttgggactcctggggccatatataagagcagaagttgaagataatatcatggtgagttaaggacagtggaattacaagaaa

SEQ ID NO: 24970 - DNA, 201 bp, Homo sapiens
ccacttttatttatctggagttagaccacagttttcttgttgatcctagtcgttttaggatttgatcttagatctcgcttatactttcagattatatttamgaatcaagcaagcagaccatataacatctaccctcacggaatcactgatgtccgtcctttgtattcaaggagattaccaaaaggtaaatattccctcgat

SEQ ID NO: 24971 - DNA, 201 bp, Homo sapiens
ggaacgatgtctttttattcctccccagacgcaaacgtggatgcatgaggtttggtaacaggcaaagtcatctggttaacgtgactgatgcaaaaagtccmggcctgggcaaaaagaagtcactgggtgaatgggatggatcagactccctgtcctgagggggagatggtttcttgcagaacgaggtgaaggaggtggttc

SEQ ID NO: 24972 - DNA, 201 bp, Homo sapiens
aaggaagattttgacatttatgatgaggatgaaaatcagagcccccgcagctttcaaaagaaaacacgacactattttattgctgcagtggagaggctctrggattatgggatgagtagctccccacatgttctaagaaacaggtatgaatgcattggttattcctttgctctgctcttgtgacatttgactttaccagat

SEQ ID NO: 24973 - DNA, 201 bp, Homo sapiens
agaagataacaaaaatgggcctgtttaactgcagcatccccttcccaagctgccaggcaccatgcagaaaagttcccccagactgacagtatgtacatcaraaaaagtgacatctagatgaagagccagctttcccaccatcttgggttcctttgcagaaaaatcattcctgcctcaatccgtgggaagcagcctgattgc

SEQ ID NO: 24974 - DNA, 201 bp, Homo sapiens
cagatcaagaggaaattgactatgatgataccatatcagttgaaatgaagaaggaagattttgacatttatgatgaggatgaaaatcagagcccccgcagmtttcaaaagaaaacacgacactattttattgctgcagtggagaggctctgggattatgggatgagtagctccccacatgttctaagaaacaggtatgaat

SEQ ID NO: 24975 - DNA, 201 bp, Homo sapiens
tttgagcctacctagaatttttcttcccaacctctcatctttttttctcttatacagaagttataaaagtcaatatttgaacaatggccctcagcggattrgtaggaagtacaaaaaagtccgatttatggcatacacagatgaaacctttaagactcgtgaagctattcagcatgaatcaggaatcttgggacctttact

SEQ ID NO: 24976 - DNA, 201 bp, Homo sapiens; identical to SEQ ID NO: 3772

SEQ ID NO: 24977 - DNA, 201 bp, Homo sapiens
cagaggtcttcacaccagcccctcccatcaccggcccagaggcctaagaggaaaaagttgtttcatgggctgggcccaggatccccatgctgtgtgcagcytagggagtcggtgccttgtgtcccagccgctacagccatggctgaaaggggtcaatgtagagctcaggctgtggcttcatagggtacaagtcccaagcct

SEQ ID NO: 24978 - DNA, 201 bp, Homo sapiens
actggttataaaaattttcccgctgggtgcggtggctcacgcctgtaatcccagcactttgggaggccgaggcgggcagatcacttgaggtcaggagttcragaccagcttggccaacatggtgaaaacccatctctactaaaaatacaaaaaaaatagccgggcattgtggcgtgtgcctgtaatcccagctactcagga

SEQ ID NO: 24979 - DNA, 201 bp, Homo sapiens
cagagtctcactctgttgcccaggctggagtgcactggtgtgatctcggctcactgcaacctctgcctcccgggctcaagtgattctcctgcctcagcctsctgagtagctgggactacgggctcatgccaccacacccagctaatttttgtatttttagtagagacagggttttgccatgttgaccaggctggtcttgaa

SEQ ID NO: 24980 - DNA, 201 bp, Homo sapiens; identical to SEQ ID NO: 3773

SEQ ID NO: 24981 - DNA, 201 bp, Homo sapiens
agaactgaaatattattctatattctccaatctcctctcttcagtattttggtttatatagctataggttataaaaaatgaggtttatacatattagtgargtttacatatgaaatcttagcagatccaattagcaagcgactaattcataaatctggttcatatacaaaatgctcttctgaaaaaaatttgaatgtttta

SEQ ID NO: 24982 - DNA, 201 bp, Homo sapiens
taccaggttaatctcactgtggcttgtcggacagtgggtgcaggacagtgggtgcagcccaccgagcatgagccgaagcagggtaaggtatcacctcaccygggaagcacaaggggtcagggaattccctttcctagccaagggaagctgtgacagatggcacctggaaaattgggtcactcccatcctaatactgcgctt

SEQ ID NO: 24983 - DNA, 201 bp, Homo sapiens
tgatgattgtgagcttgcttatggatatcctaggtttgaggttatagtaggacaatcaggttgaaatgtccagcaggcagtaggtgaaagacaagtttagrgggcaaaaccatggatggagatgaagattcatgacttccacataaaaggatgggtgaaactttgggaattgatgaattctctagaggtgagctcaagacc

SEQ ID NO: 24984 - DNA, 201 bp, Homo sapiens
gattcacaaatgtttaacattttgcaattttgtttttcattttcttttctttatatacacacttctgttacttattttctatttgaaaattagttgcagayatcacatccctttacctctcaatactttagtacacatttcctgtgaataaagatatcttttacataacagacacttcaaattgataaagcacatttccat

SEQ ID NO: 24985 - DNA, 201 bp, Homo sapiens
aattgactatgatgataccatatcagttgaaatgaagaaggaagattttgacatttatgatgaggatgaaaatcagagcccccgcagctttcaaaagaaawcacgacactattttattgctgcagtggagaggctctgggattatgggatgagtagctccccacatgttctaagaaacaggtatgaatgcattggttattc

SEQ ID NO: 24986 - DNA, 201 bp, Homo sapiens; identical to SEQ ID NO: 3775

SEQ ID NO: 24987 - DNA, 201 bp, Homo sapiens
ggcagtgtccctcagttcaagaaagttgttttccaggaatttactgatggctcctttactcagcccttataccgtggagaactaaatgaacatttgggacycctggggccatatataagagcagaagttgaagataatatcatggtgagttaaggacagtggaattacaagaaaattaattttatatatttattttcttgc

SEQ ID NO: 24988 - DNA, 201 bp, Homo sapiens
ataacaataggagatggctactaccgttaattttatgcagttgcgatttaatactggatctttacgtttgtttacatttgtcccaactgggaatggtgccrtgtatggttgtaagtatgtaagtttttataaatttcaactttttataatagatttttgtatattttatggtaataaatgataaaatagtctagtatcaac

SEQ ID NO: 24989 - DNA, 201 bp, Homo sapiens; identical to SEQ ID NO: 3777

SEQ ID NO: 24990 - DNA, 201 bp, Homo sapiens
actctggttcataggtgagagagcttatactcataggattgatgtcttccctccctaggaaaaagatgtgcactcaggcctgattggaccccttctggtcygccacactaacacactgaaccctgctcatgggagacaagtgacagtacaggaatttgctctgtttttcaccatctttgatgagaccaaaagctggtactt

SEQ ID NO: 24991 - DNA, 201 bp, Homo sapiens
atagatgtcagtttttttggtggagtggagagaaagaaacttatataatagattttaacaggcttctctgtgtccttctccagcaatcaatggctacatartggatacactacctggcttagtaatggctcaggatcaaaggattcgatggtatctgctcagcatgggcagcaatgaaaacatccattctattcatttcag

SEQ ID NO: 24992 - DNA, 201 bp, Homo sapiens
gcttctctgtgtccttctccagcaatcaatggctacataatggatacactacctggcttagtaatggctcaggatcaaaggattcgatggtatctgctcakcatgggcagcaatgaaaacatccattctattcatttcagtggacatgtgttcactgtacgaaaaaaagaggagtataaaatggcactgtacaatctctat

SEQ ID NO: 24993 - DNA, 201 bp, Homo sapiens
ctactctgatatttcgcataaaccaatgtatctcatgctcattttttagtgaaaagaaataatttctgttcctgttggtttttataaggtgtttttgagasagtggaaatgttaccatccaaagctggaatttggcgggtggaatgccttattggcgagcatctacatgctgggatgagcacactttttctggtgtacagc

SEQ ID NO: 24994 - DNA, 201 bp, Homo sapiens
catttatagcattttcttccttgaggtacagggatctagtttctcctctgagtagttattattttcacccttgcaactaataaacagtttgaaggatcacrtagtagttctatttttagttttttgaggaacctccttactcttttccacagtatttgtacttatttacactcccaccaacagtgtacaagcattcccctt

SEQ ID NO: 24995 - DNA, 201 bp, Homo sapiens
tttatctggagttagaccacagttttcttgttgatcctagtcgttttaggatttgatcttagatctcgcttatactttcagattatatttaagaatcaagbaagcagaccatataacatctaccctcacggaatcactgatgtccgtcctttgtattcaaggagattaccaaaaggtaaatattccctcgatttatagctc

SEQ ID NO: 24996 - DNA, 201 bp, Homo sapiens
tgaggttgcagcatgccattgggaatggagagtaaagcaatatcagatgcacagattactgcttcatcctactttaccaatatgtttgccacctggtctcyttcaaaagctcgacttcacctccaagggaggagtaatgcctggagacctcaggtaagaggcaacagatttactgtttaactgactcagagcagtggttgg

SEQ ID NO: 24997 - DNA, 201 bp, Homo sapiens
ctttcagattatatttaagaatcaagcaagcagaccatataacatctaccctcacggaatcactgatgtccgtcctttgtattcaaggagattaccaaaargtaaatattccctcgatttatagctcttttttacctgtagatacagatgagataaatatcatcaataacaactaaaattatgttggtcctttctccagct

SEQ ID NO: 24998 - DNA, 201 bp, Homo sapiens
accaataaatgctatctttcctctttcaggtttttcagggaaatcaagactccttcacacctgtggtgaactctctagacccaccgttactgactcgctascttcgaattcacccccagagttgggtgcaccagattgccctgaggatggaggttctgggctgcgaggcacaggacctctactgagggtggccactgcagc

SEQ ID NO: 24999 - DNA, 201 bp, Homo sapiens
gatcctcggtgcctgacccgctattactctagtttcgttaatatggagagagatctagcttcaggactcattggccctctcctcatctgctacaaagaatytgtagatcaaagaggaaaccaggtgagttcttgcctttccaagtgctgggtttcattctcagtgtatgtccccttataacctgaagaaaatataatggtt

SEQ ID NO: 25000 - DNA, 201 bp, Homo sapiens; identical to SEQ ID NO: 3788

SEQ ID NO: 25001 - DNA, 201 bp, Homo sapiens
cctcggtgcctgacccgctattactctagtttcgttaatatggagagagatctagcttcaggactcattggccctctcctcatctgctacaaagaatctgyagatcaaagaggaaaccaggtgagttcttgcctttccaagtgctgggtttcattctcagtgtatgtccccttataacctgaagaaaatataatggtttgc

SEQ ID NO: 25002 - DNA, 201 bp, Homo sapiens
cggtgcctgacccgctattactctagtttcgttaatatggagagagatctagcttcaggactcattggccctctcctcatctgctacaaagaatctgtagmtcaaagaggaaaccaggtgagttcttgcctttccaagtgctgggtttcattctcagtgtatgtccccttataacctgaagaaaatataatggtttgcaat

SEQ ID NO: 25003 - DNA, 201 bp, Homo sapiens
tcggtgcctgacccgctattactctagtttcgttaatatggagagagatctagcttcaggactcattggccctctcctcatctgctacaaagaatctgtasatcaaagaggaaaccaggtgagttcttgcctttccaagtgctgggtttcattctcagtgtatgtccccttataacctgaagaaaatataatggtttgcaa

SEQ ID NO: 25004 - DNA, 201 bp, Homo sapiens
cgctattactctagtttcgttaatatggagagagatctagcttcaggactcattggccctctcctcatctgctacaaagaatctgtagatcaaagaggaarccaggtgagttcttgcctttccaagtgctgggtttcattctcagtgtatgtccccttataacctgaagaaaatataatggtttgcaatataggtcagtaa

SEQ ID NO: 25005 - DNA, 201 bp, Homo sapiens
tgagtgcttagtaccaaatagagataagctattggtttgtgtattttcagctttttcttttgagcctgggtctcattttgtcacccaggctggagtgcagkggggtgatctcaccttactgcagcctcaacctcctggattcaagcaattctcctgtatatcagccccccaagtagctgggactacaggagcaggccacca

SEQ ID NO: 25006 - DNA, 201 bp, Homo sapiens
attactctagtttcgttaatatggagagagatctagcttcaggactcattggccctctcctcatctgctacaaagaatctgtagatcaaagaggaaaccakgtgagttcttgcctttccaagtgctgggtttcattctcagtgtatgtccccttataacctgaagaaaatataatggtttgcaatataggtcagtaaaaga

SEQ ID NO: 25007 - DNA, 201 bp, Homo sapiens
ctattactctagtttcgttaatatggagagagatctagcttcaggactcattggccctctcctcatctgctacaaagaatctgtagatcaaagaggaaacmaggtgagttcttgcctttccaagtgctgggtttcattctcagtgtatgtccccttataacctgaagaaaatataatggtttgcaatataggtcagtaaaa

SEQ ID NO: 25008 - DNA, 201 bp, Homo sapiens
ctacggacaaagacatctctccttggcagagtgagctaggattaccagctcttcagccgcagctgaaggcgggagtccatggaaccccagaagctgctgayaattggatttctgctatgctctctaacttgcctcttgttggagacagtagcttcctctcctttgcctttgtctgccttgggaatacaagaaaaaacagga

SEQ ID NO: 25009 - DNA, 201 bp, Homo sapiens
tctctccatacaggtcttctttggcaatgtggattcatctgggataaaacacaatatttttaaccctccaattattgctcgatacatccgtttgcacccarctcattatagcattcgcagcactcttcgcatggagttgatgggctgtgatttaaatagtaagtgccaagtcatcccatatccttcttccctcaaccatgg

SEQ ID NO: 25010 - DNA, 201 bp, Homo sapiens
tctagaacgataagtgaataaatttcttttgttttaaaggcaccaagtgtgtggtgaatttgttacagtagccctagaaatctaatactaacaaaaagaaygttagagttgaattagaagtgtcagtgagaacttaggaatttaaaaaatcatattcttagcactgttcactgagggaatctagaagtaattacactgcag

SEQ ID NO: 25011 - DNA, 201 bp, Homo sapiens
cggtggctcacacctgtaatcccagcactttgggaggccgaggcaggtggatcatgaggtcaggaaattgagaccatcctggctaacatggtgaaaccccrtctctactaaaaaaaaatacaaaaattagccgggtgtggtggcggacacctgtagtcccagttactcaggagggtgaggcaggagaatggcgtgaactcg

SEQ ID NO: 25012 - DNA, 201 bp, Homo sapiens
cttttttttttttgtcgttattgttctacaggtaactttcagaaatcaggcctctcgtccctattccttctattctagccttatttcttatgaggaagatyagaggcaaggagcagaacctagaaaaaactttgtcaagcctaatgaaaccaaaacttacttttggaaagtgcaacatcatatggcacccactaaagatga

SEQ ID NO: 25013 - DNA, 201 bp, Homo sapiens
tttcttatgaggaagatcagaggcaaggagcagaacctagaaaaaactttgtcaagcctaatgaaaccaaaacttacttttggaaagtgcaacatcatatrgcacccactaaagatgagtttgactgcaaagcctgggcttatttctctgatgttgacctggtaagcaggtgtctattgtgctgaccactttttggtttaa

SEQ ID NO: 25014 - DNA, 201 bp, Homo sapiens
ttatgaggaagatcagaggcaaggagcagaacctagaaaaaactttgtcaagcctaatgaaaccaaaacttacttttggaaagtgcaacatcatatggcayccactaaagatgagtttgactgcaaagcctgggcttatttctctgatgttgacctggtaagcaggtgtctattgtgctgaccactttttggtttaaaaga

SEQ ID NO: 25015 - DNA, 201 bp, Homo sapiens
tgaggaagatcagaggcaaggagcagaacctagaaaaaactttgtcaagcctaatgaaaccaaaacttacttttggaaagtgcaacatcatatggcacccmctaaagatgagtttgactgcaaagcctgggcttatttctctgatgttgacctggtaagcaggtgtctattgtgctgaccactttttggtttaaaagaaat

SEQ ID NO: 25016 - DNA, 201 bp, Homo sapiens
ggaagatcagaggcaaggagcagaacctagaaaaaactttgtcaagcctaatgaaaccaaaacttacttttggaaagtgcaacatcatatggcacccactwaagatgagtttgactgcaaagcctgggcttatttctctgatgttgacctggtaagcaggtgtctattgtgctgaccactttttggtttaaaagaaatggt

SEQ ID NO: 25017 - DNA, 201 bp, Homo sapiens; identical to SEQ ID NO: 3803

SEQ ID NO: 25018 - DNA, 201 bp, Homo sapiens; identical to SEQ ID NO: 3804

SEQ ID NO: 25019 - DNA, 201 bp, Homo sapiens; identical to SEQ ID NO: 3806

SEQ ID NO: 25020 - DNA, 201 bp, Homo sapiens
tggtacattctaagcattggagcacagactgacttcctttctgtcttcttctctggatataccttcaaacacaaaatggtctatgaagacacactcaccckattcccattctcaggagaaactgtcttcatgtcgatggaaaacccaggttagttattatatttttcttgtaccaacagctgtgaatgcttcactagccat

SEQ ID NO: 25021 - DNA, 201 bp, Homo sapiens; identical to SEQ ID NO: 3808

SEQ ID NO: 25022 - DNA, 201 bp, Homo sapiens
gtggcatactggtacattctaagcattggagcacagactgacttcctttctgtcttcttctctggatataccttcaaacacaaaatggtctatgaagacasactcaccctattcccattctcaggagaaactgtcttcatgtcgatggaaaacccaggttagttattatatttttcttgtaccaacagctgtgaatgcttc

SEQ ID NO: 25023 - DNA, 201 bp, Homo sapiens
ttgttgcattccttcactcagctaatcttgttcatggtagaaattaatattgctagtaccatggtagaattttatattagctggatcctagacctaaatgmtccttccttgtgcttacatattctgcaagtgggtgacagtggatgctaggtattgtgttatgtgatttcaatgtattatatgatggggtagatactatta

SEQ ID NO: 25024 - DNA, 201 bp, Homo sapiens; identical to SEQ ID NO: 3810

SEQ ID NO: 25025 - DNA, 201 bp, Homo sapiens
ttgcatgaggtggcatactggtacattctaagcattggagcacagactgacttcctttctgtcttcttctctggatataccttcaaacacaaaatggtctrtgaagacacactcaccctattcccattctcaggagaaactgtcttcatgtcgatggaaaacccaggttagttattatatttttcttgtaccaacagctgt

SEQ ID NO: 25026 - DNA, 201 bp, Homo sapiens; identical to SEQ ID NO: 3812

SEQ ID NO: 25027 - DNA, 201 bp, Homo sapiens
tttgcatgaggtggcatactggtacattctaagcattggagcacagactgacttcctttctgtcttcttctctggatataccttcaaacacaaaatggtcwatgaagacacactcaccctattcccattctcaggagaaactgtcttcatgtcgatggaaaacccaggttagttattatatttttcttgtaccaacagctg

SEQ ID NO: 25028 - DNA, 201 bp, Homo sapiens; identical to SEQ ID NO: 3813

SEQ ID NO: 25029 - DNA, 201 bp, Homo sapiens
tttgcagttgtcagtttgtttgcatgaggtggcatactggtacattctaagcattggagcacagactgacttcctttctgtcttcttctctggatataccytcaaacacaaaatggtctatgaagacacactcaccctattcccattctcaggagaaactgtcttcatgtcgatggaaaacccaggttagttattatattt

SEQ ID NO: 25030 - DNA, 201 bp, Homo sapiens; identical to SEQ ID NO: 3815

SEQ ID NO: 25031 - DNA, 201 bp, Homo sapiens; identical to SEQ ID NO: 3816

SEQ ID NO: 25032 - DNA, 201 bp, Homo sapiens
tcacccttaagtaataaacaggactaaagtcactttatgtcacaaatacagttcaaatcagaaattacaatgtccatcccaagatattaatcaaaattgtraacttgatttaacttcaatctcccctcctccaacttgagcctgcatcaggctggaagtctgcattggaaaagggagacatggttgagtcctctgtttctg

SEQ ID NO: 25033 - DNA, 201 bp, Homo sapiens; identical to SEQ ID NO: 3817

SEQ ID NO: 25034 - DNA, 201 bp, Homo sapiens
atatcacatgcatgccatcgctttcatcatagactgctagctcctacctgacaacatcagtagcatttctttacccctttcaatatatgtaattaacagabaatgtcagacaagaggaatgtcatcctgttttctgtatttgatgagaaccgaagctggtacctcacagagaatatacaacgctttctccccaatccagct

SEQ ID NO: 25035 - DNA, 201 bp, Homo sapiens
atcacatgcatgccatcgctttcatcatagactgctagctcctacctgacaacatcagtagcatttctttacccctttcaatatatgtaattaacagatartgtcagacaagaggaatgtcatcctgttttctgtatttgatgagaaccgaagctggtacctcacagagaatatacaacgctttctccccaatccagctgg

SEQ ID NO: 25036 - DNA, 201 bp, Homo sapiens
catgcatgccatcgctttcatcatagactgctagctcctacctgacaacatcagtagcatttctttacccctttcaatatatgtaattaacagataatgtmagacaagaggaatgtcatcctgttttctgtatttgatgagaaccgaagctggtacctcacagagaatatacaacgctttctccccaatccagctggagtg

SEQ ID NO: 25037 - DNA, 201 bp, Homo sapiens
ttgcttttcctctgctttttttctccagggctcagagtggcagtgtccctcagttcaagaaagttgttttccaggaatttactgatggctcctttactcarcccttataccgtggagaactaaatgaacatttgggactcctggggccatatataagagcagaagttgaagataatatcatggtgagttaaggacagtgga

SEQ ID NO: 25038 - DNA, 201 bp, Homo sapiens
cttttattattacaaatattaactctttgtcatgtatattgcagttttccccaagatctattgtttgtctgttgactttcttataacttttaccaaaacartttttaatttttataatcagagatatcttttctttcatatcttcagagtcggcaaggttggttaaaaatgtttcccacacctcaagattgtacgtgtaat

SEQ ID NO: 25039 - DNA, 201 bp, Homo sapiens
gaggacatacccgagactgggtaatttataaaggaaagagatttaatggactcacagttccacatggctggggaggcctcacaatcatggtggaaggcaarggaggagcaaagacacatcttatatggcatggtggcagacaagagagcattgtacaggagaactgccctttataaaaccatcagccctcatgagacttat

SEQ ID NO: 25040 - DNA, 201 bp, Homo sapiens
tgttgtagtttataggatagccagtaagtaatagaaatacacacaatgtaagactcccaaaatggtagaagaaaaaatatgaaaggataaaatatactcarcaaacctaaatgaaagcaagcaaagagagataaagaaacataaaacaggtaggaaaaatagcaagataagatggtatatttaaattgaaatataacagta

SEQ ID NO: 25041 - DNA, 201 bp, Homo sapiens
acttgccgcacgcctccttccacaccaccactaccagcccccacaccctcccacacacaccccctgcccccgcccatacacacgttcccgatagtccctgrcaacccctagtccatctgctttctgtccatagaggttagcctgttctggagatttcctatagatggaattatacgaccaaatgtgaggccgtgtgtgtct

SEQ ID NO: 25042 - DNA, 201 bp, Homo sapiens
gggaaatgcaaatcaaaaccacaatgagatagcatttcaaacctgctaggatggctaaattaaaaaaaaaacaaaaacaaaatgtcaagcgggaaaataasaagtgttagcaagaatataaagaaattggaaccttccttgatgatgagaatgtgaaatagggcagccactgtagaaaatattttggcagttcctcagtaa

SEQ ID NO: 25043 - DNA, 201 bp, Homo sapiens
ttcttttagggatgtaaaccctaaggaccttaagatcctagaagattattcttgcttttttttttttgtcgttattgttctacaggtaactttcagaaatyaggcctctcgtccctattccttctattctagccttatttcttatgaggaagatcagaggcaaggagcagaacctagaaaaaactttgtcaagcctaatga

SEQ ID NO: 25044 - DNA, 201 bp, Homo sapiens
cgacttcacctccaagggaggagtaatgcctggagacctcaggtaagaggcaacagatttactgtttaactgactcagagcagtggttggggaaaaaatckgggaaggccttgactgtttcttctgaggtatttctgtcaactgttagttctaaaaagtgtgtcaaggaagtttggttatgggcagacaaccacacaggca

SEQ ID NO: 25045 - DNA, 201 bp, Homo sapiens
aacactctgcaggatattatccaggagaacttccccaacctagcaaggcaggccaacattcaaattcaggaaatacagagaacgccacaaagatactcctygagaagagcaactccaagacacataactgtcagattcaccaaagttgaaatgaaggaaaaaatgttaagggcagccagacagaaagttcgggttacccgc

SEQ ID NO: 25046 - DNA, 201 bp, Homo sapiens
ttttagggatgtaaaccctaaggaccttaagatcctagaagattattcttgcttttttttttttgtcgttattgttctacaggtaactttcagaaatcagscctctcgtccctattccttctattctagccttatttcttatgaggaagatcagaggcaaggagcagaacctagaaaaaactttgtcaagcctaatgaaac

SEQ ID NO: 25047 - DNA, 201 bp, Homo sapiens
cagaattctaaaaaactattttaaagttcatttggaaccaaaaaagagcccgcattgccaagtcaatcctaagccaaaagaacaaagctggaggcatcacrctacctgacttcaaactatactacacggctacagtaaccaaaacagcatggtactggtaccaaaacagagatatagaccaatggaacagaacagagccct

SEQ ID NO: 25048 - DNA, 201 bp, Homo sapiens
aaaactttgtcaagcctaatgaaaccaaaacttacttttggaaagtgcaacatcatatggcacccactaaagatgagtttgactgcaaagcctgggcttakttctctgatgttgacctggtaagcaggtgtctattgtgctgaccactttttggtttaaaagaaatggtctttgtgtactaagaattttgatatttatcct

SEQ ID NO: 25049 - DNA, 201 bp, Homo sapiens
tttgtcaagcctaatgaaaccaaaacttacttttggaaagtgcaacatcatatggcacccactaaagatgagtttgactgcaaagcctgggcttatttctstgatgttgacctggtaagcaggtgtctattgtgctgaccactttttggtttaaaagaaatggtctttgtgtactaagaattttgatatttatcctacgtg

SEQ ID NO: 25050 - DNA, 201 bp, Homo sapiens
gaggcaggttggactggcataaaaattgatgagaaatccactctggttcataggtgagagagcttatactcataggattgatgtcttccctccctaggaaraagatgtgcactcaggcctgattggaccccttctggtctgccacactaacacactgaaccctgctcatgggagacaagtgacagtacaggaatttgctct

SEQ ID NO: 25051 - DNA, 201 bp, Homo sapiens
tctcagtttttttttttttcttttgttggactctttagtgtcctctatataagaacatgccatctatgcatctatgaatagagatggttttacttgttccyttccaatctggatgccttttatttctttttcttgactaattgccctgactagaactttgagtacgatgttgagttacaagtggcattcctgatcttaggg

SEQ ID NO: 25052 - DNA, 201 bp, Homo sapiens
cccattgtttttgcaggcatcaatggctatgtttttgatagtttgcagttgtcagtttgtttgcatgaggtggcatactggtacattctaagcattggagyacagactgacttcctttctgtcttcttctctggatataccttcaaacacaaaatggtctatgaagacacactcaccctattcccattctcaggagaaact

SEQ ID NO: 25053 - DNA, 201 bp, Homo sapiens
gagagagcttatactcataggattgatgtcttccctccctaggaaaaagatgtgcactcaggcctgattggaccccttctggtctgccacactaacacacygaaccctgctcatgggagacaagtgacagtacaggaatttgctctgtttttcaccatctttgatgagaccaaaagctggtacttcactgaaaatatggaa

SEQ ID NO: 25054 - DNA, 201 bp, Homo sapiens
agaccagcctgggcaacacagtgagactctgtatctacaaaacaagaaaaaaaaattagctggcatgatggtacacacctgtagtcccagctactagggargctgggataggaggatcgcttgagcccaggaggtggaggctgcagtgagccatgatcgcaccactgcactccagcctgggtgtcagagcaagaccctgtc

SEQ ID NO: 25055 - DNA, 201 bp, Homo sapiens
aaatctcttttccccattgtttttgcaggcatcaatggctatgtttttgatagtttgcagttgtcagtttgtttgcatgaggtggcatactggtacattcyaagcattggagcacagactgacttcctttctgtcttcttctctggatataccttcaaacacaaaatggtctatgaagacacactcaccctattcccattc

SEQ ID NO: 25056 - DNA, 201 bp, Homo sapiens
aggattgatgtcttccctccctaggaaaaagatgtgcactcaggcctgattggaccccttctggtctgccacactaacacactgaaccctgctcatgggakacaagtgacagtacaggaatttgctctgtttttcaccatctttgatgagaccaaaagctggtacttcactgaaaatatggaaagaaactgcagggctccc

SEQ ID NO: 25057 - DNA, 201 bp, Homo sapiens
tactaaaaaaaaatacaaaaattagccgggtgtggtggcggacacctgtagtcccagttactcaggagggtgaggcaggagaatggcgtgaactcgggagrctagattttaacacatctctcgtcaattgatggaacaatgtatagaaatagaacaattaacatgattcacaagtttgatcttatagacatatttagaaaa

SEQ ID NO: 25058 - DNA, 201 bp, Homo sapiens
gtgatgtgtctaaatctcttttccccattgtttttgcaggcatcaatggctatgtttttgatagtttgcagttgtcagtttgtttgcatgaggtggcatastggtacattctaagcattggagcacagactgacttcctttctgtcttcttctctggatataccttcaaacacaaaatggtctatgaagacacactcaccc

SEQ ID NO: 25059 - DNA, 201 bp, Homo sapiens; identical to SEQ ID NO: 3833

SEQ ID NO: 25060 - DNA, 201 bp, Homo sapiens
taaatctgtgatgtgtctaaatctcttttccccattgtttttgcaggcatcaatggctatgtttttgatagtttgcagttgtcagtttgtttgcatgaggyggcatactggtacattctaagcattggagcacagactgacttcctttctgtcttcttctctggatataccttcaaacacaaaatggtctatgaagacaca

SEQ ID NO: 25061 - DNA, 201 bp, Homo sapiens; identical to SEQ ID NO: 3836

SEQ ID NO: 25062 - DNA, 201 bp, Homo sapiens
ctaaatctgtgatgtgtctaaatctcttttccccattgtttttgcaggcatcaatggctatgtttttgatagtttgcagttgtcagtttgtttgcatgagrtggcatactggtacattctaagcattggagcacagactgacttcctttctgtcttcttctctggatataccttcaaacacaaaatggtctatgaagacac

SEQ ID NO: 25063 - DNA, 201 bp, Homo sapiens; identical to SEQ ID NO: 3838

SEQ ID NO: 25064 - DNA, 201 bp, Homo sapiens
tgagtaaccagagtcttattcttcctcatctccaggtctatggattctggggtgccacaactcagactttcggaacagaggcatgaccgccttactgaagktttctagttgtgacaagaacactggtgattattacgaggacagttatgaagatatttcagcatacttgctgagtaaaaacaatgccattgaaccaagaag

SEQ ID NO: 25065 - DNA, 201 bp, Homo sapiens
gaatctgtgttatgagtaaccagagtcttattcttcctcatctccaggtctatggattctggggtgccacaactcagactttcggaacagaggcatgaccrccttactgaaggtttctagttgtgacaagaacactggtgattattacgaggacagttatgaagatatttcagcatacttgctgagtaaaaacaatgccat

SEQ ID NO: 25066 - DNA, 201 bp, Homo sapiens
gttttagaatctgtgttatgagtaaccagagtcttattcttcctcatctccaggtctatggattctggggtgccacaactcagactttcggaacagaggcmtgaccgccttactgaaggtttctagttgtgacaagaacactggtgattattacgaggacagttatgaagatatttcagcatacttgctgagtaaaaacaa

SEQ ID NO: 25067 - DNA, 201 bp, Homo sapiens
tctcaaaaagaaaacctaatgaaaatatcttttatgcgttaaagcaaaagaggaaattaggacacagacaggcacagagggacgaccacatgaagatatasaaagaggacagacacctacaagccaacgagagaggccttacaagaaaccaacccttagccaggtgtggtagtgtgcacttgtagttcttgttacaagggt

SEQ ID NO: 25068 - DNA, 201 bp, Homo sapiens
acgttttagaatctgtgttatgagtaaccagagtcttattcttcctcatctccaggtctatggattctggggtgccacaactcagactttcggaacagagrcatgaccgccttactgaaggtttctagttgtgacaagaacactggtgattattacgaggacagttatgaagatatttcagcatacttgctgagtaaaaac

SEQ ID NO: 25069 - DNA, 201 bp, Homo sapiens
agtagagtgagaagtgctgtggtatggttaagagggatttgggaatttctgggagtaaatggtgaccaagaggctactagtccaactctattgccctcagrtgaataatccaaaagagtggctgcaagtggacttccagaagacaatgaaagtcacaggagtaactactcagggagtaaaatctctgcttaccagcatgta

SEQ ID NO: 25070 - DNA, 201 bp, Homo sapiens
gacttccaggactacattttatagaattggtgaaagtgggcatccttatcttgtttcagatcttaaaggaaaggcttttggttttccacatttggtatgakattagccgtagtttgtcatatatggcatttattgttttgaggtaagctttctatacccggtttgttgagagttttctcatgaagggatgttgaatttaat

SEQ ID NO: 25071 - DNA, 201 bp, Homo sapiens
gcattgatggtctttacaatttggcatgattttgcagtggctggtactggttgctcctttccatgtttagtgcttccttcagaagctctcttaggtcaggyctggtggtgacaaaatctctcagcatttgcttgtctgtaaaggattttatttctccttcacttatgaagcttagtttggctggatatgaaattctgggtt

SEQ ID NO: 25072 - DNA, 201 bp, Homo sapiens
ctatacatattctctggattcctgcttgtgtaaattagaaaactcaagtcatgattttggagtgtagtgcaccttgtcatgggtcaccttcatacctcacytcgcctgctgggacttgagtgtagttatagatctaataacaaagaggggtggtagggtgggtcctgaagggaatcagcattatcttgcatggcagttgcc

SEQ ID NO: 25073 - DNA, 201 bp, Homo sapiens
tttcatttaaaaaaattatgagaacccttttattattacaaatattaactctttgtcatgtatattgcagttttccccaagatctattgtttgtctgttgwctttcttataacttttaccaaaacagtttttaatttttataatcagagatatcttttctttcatatcttcagagtcggcaaggttggttaaaaatgtttc

SEQ ID NO: 25074 - DNA, 201 bp, Homo sapiens
gcaggttggactggcataaaaattgatgagaaatccactctggttcataggtgagagagcttatactcataggattgatgtcttccctccctaggaaaaadatgtgcactcaggcctgattggaccccttctggtctgccacactaacacactgaaccctgctcatgggagacaagtgacagtacaggaatttgctctgtt

SEQ ID NO: 25075 - DNA, 201 bp, Homo sapiens
ggactggcataaaaattgatgagaaatccactctggttcataggtgagagagcttatactcataggattgatgtcttccctccctaggaaaaagatgtgcvctcaggcctgattggaccccttctggtctgccacactaacacactgaaccctgctcatgggagacaagtgacagtacaggaatttgctctgtttttcacc

SEQ ID NO: 25076 - DNA, 201 bp, Homo sapiens
gcataaaaattgatgagaaatccactctggttcataggtgagagagcttatactcataggattgatgtcttccctccctaggaaaaagatgtgcactcagdcctgattggaccccttctggtctgccacactaacacactgaaccctgctcatgggagacaagtgacagtacaggaatttgctctgtttttcaccatcttt

SEQ ID NO: 25077 - DNA, 201 bp, Homo sapiens
caaaagctggtacttcactgaaaatatggaaagaaactgcagggctccctgcaatatccagatggaagatcccacttttaaagagaattatcgcttccatrgtaatatattccacatccaaacattatcactgtgaaatgcagattgcactttgacaaatgagacttgatccagggacttgaacattgtatttatttagag

SEQ ID NO: 25078 - DNA, 201 bp, Homo sapiens
agtggaatcctcatagatgtcagtttttttggtggagtggagagaaagaaacttatataatagattttaacaggcttctctgtgtccttctccagcaatcratggctacataatggatacactacctggcttagtaatggctcaggatcaaaggattcgatggtatctgctcagcatgggcagcaatgaaaacatccattc

SEQ ID NO: 25079 - DNA, 201 bp, Homo sapiens
gtggaatcctcatagatgtcagtttttttggtggagtggagagaaagaaacttatataatagattttaacaggcttctctgtgtccttctccagcaatcartggctacataatggatacactacctggcttagtaatggctcaggatcaaaggattcgatggtatctgctcagcatgggcagcaatgaaaacatccattct

SEQ ID NO: 25080 - DNA, 201 bp, Homo sapiens
ccctccctaggaaaaagatgtgcactcaggcctgattggaccccttctggtctgccacactaacacactgaaccctgctcatgggagacaagtgacagtayaggaatttgctctgtttttcaccatctttgatgagaccaaaagctggtacttcactgaaaatatggaaagaaactgcagggctccctgcaatatccagat

SEQ ID NO: 25081 - DNA, 201 bp, Homo sapiens
gaatcctcatagatgtcagtttttttggtggagtggagagaaagaaacttatataatagattttaacaggcttctctgtgtccttctccagcaatcaatgsctacataatggatacactacctggcttagtaatggctcaggatcaaaggattcgatggtatctgctcagcatgggcagcaatgaaaacatccattctatt

SEQ ID NO: 25082 - DNA, 201 bp, Homo sapiens
ccctaggaaaaagatgtgcactcaggcctgattggaccccttctggtctgccacactaacacactgaaccctgctcatgggagacaagtgacagtacaggratttgctctgtttttcaccatctttgatgagaccaaaagctggtacttcactgaaaatatggaaagaaactgcagggctccctgcaatatccagatggaa

SEQ ID NO: 25083 - DNA, 201 bp, Homo sapiens; identical to SEQ ID NO: 3494

SEQ ID NO: 25084 - DNA, 201 bp, Homo sapiens
agcatgggcagcaatgaaaacatccattctattcatttcagtggacatgtgttcactgtacgaaaaaaagaggagtataaaatggcactgtacaatctctrtccaggtatgagcttgtttgtgctctttcttctacctactctatttgttgagtacttactttaaatggtctaggcactgggaacacaatcagtgatcaaa

SEQ ID NO: 25085 - DNA, 201 bp, Homo sapiens; identical to SEQ ID NO: 3495

SEQ ID NO: 25086 - DNA, 201 bp, Homo sapiens
ctggtctgccacactaacacactgaaccctgctcatgggagacaagtgacagtacaggaatttgctctgtttttcaccatctttgatgagaccaaaagctkgtacttcactgaaaatatggaaagaaactgcagggctccctgcaatatccagatggaagatcccacttttaaagagaattatcgcttccatggtaatata

SEQ ID NO: 25087 - DNA, 201 bp, Homo sapiens
tggagtggagagaaagaaacttatataatagattttaacaggcttctctgtgtccttctccagcaatcaatggctacataatggatacactacctggcttwgtaatggctcaggatcaaaggattcgatggtatctgctcagcatgggcagcaatgaaaacatccattctattcatttcagtggacatgtgttcactgtac

SEQ ID NO: 25088 - DNA, 201 bp, Homo sapiens
taatagattttaacaggcttctctgtgtccttctccagcaatcaatggctacataatggatacactacctggcttagtaatggctcaggatcaaaggattygatggtatctgctcagcatgggcagcaatgaaaacatccattctattcatttcagtggacatgtgttcactgtacgaaaaaaagaggagtataaaatggc

SEQ ID NO: 25089 - DNA, 201 bp, Homo sapiens
agacaagaggaatgtcatcctgttttctgtatttgatgagaaccgaagctggtacctcacagagaatatacaacgctttctccccaatccagctggagtgyagcttgaggatccagagttccaagcctccaacatcatgcacagtgagtaaagcagcacttaagtccagtgggtggtgaataaagaaaaattgatgtaatc

SEQ ID NO: 25090 - DNA, 201 bp, Homo sapiens
tggcatgtgattggaatgggcaccactcctgaagtgcactcaatattcctcgaaggtcacacatttcttgtgaggaaccatcgccaggcgtccttggaaakctcgccaataactttccttactgctcaaacactcttgatggaccttggacagtttctactgttttgtcatatctcttcccaccaacatggtaatatcttg

SEQ ID NO: 25091 - DNA, 201 bp, Homo sapiens
aatagattttaacaggcttctctgtgtccttctccagcaatcaatggctacataatggatacactacctggcttagtaatggctcaggatcaaaggattcdatggtatctgctcagcatgggcagcaatgaaaacatccattctattcatttcagtggacatgtgttcactgtacgaaaaaaagaggagtataaaatggca

SEQ ID NO: 25092 - DNA, 201 bp, Homo sapiens
tttcaatatatgtaattaacagataatgtcagacaagaggaatgtcatcctgttttctgtatttgatgagaaccgaagctggtacctcacagagaatatayaacgctttctccccaatccagctggagtgcagcttgaggatccagagttccaagcctccaacatcatgcacagtgagtaaagcagcacttaagtccagtg

SEQ ID NO: 25093 - DNA, 201 bp, Homo sapiens
cggcggcagtgactgcaccgggtggctgccgtgctcccgcgccaggcgctgcatgcgcgtgaagaccgccagggcgccggtgtagtcgcgcgccagcagckggcaggaggcggcctcgccaagcgcctgcagcgcggccaggggcagctggggcagctggagctgggcggcgcgctggaagtgaccggcggcggcggccgg

SEQ ID NO: 25094 - DNA, 201 bp, Homo sapiens
tacaggtctgattggatgccacaggaaatcagtctattggcatgtgattggaatgggcaccactcctgaagtgcactcaatattcctcgaaggtcacacayttcttgtgaggaaccatcgccaggcgtccttggaaatctcgccaataactttccttactgctcaaacactcttgatggaccttggacagtttctactgtt

SEQ ID NO: 25095 - DNA, 201 bp, Homo sapiens
aagaccatggtagtgtggtactgaagctgctttaggtacagggctgcttcagagtccacagttgggagccctgttactggggttgccaatgggagttgctyctcccagattcctgggcagatagggatagtggtaggaccacatacaaacaactctggagctaagtccccagggtggtgggctgcttctgggtccacaacc

SEQ ID NO: 25096 - DNA, 201 bp, Homo sapiens
tagccataggtgtcttattcctactttacaggtctgattggatgccacaggaaatcagtctattggcatgtgattggaatgggcaccactcctgaagtgcmctcaatattcctcgaaggtcacacatttcttgtgaggaaccatcgccaggcgtccttggaaatctcgccaataactttccttactgctcaaacactcttg

SEQ ID NO: 25097 - DNA, 201 bp, Homo sapiens
gttacgaatgaatgatcctgtcactgaagtagtgaacatagtacccaataggtggtttttcactccttgctacccttcctcctccctctttcctctagtcrtctccagtgtctattattctatgtccatgtgttctcatcatttagctcccacttctaagtgagaacatatggtatttggttttcagttcctgtgttaatt

SEQ ID NO: 25098 - DNA, 201 bp, Homo sapiens
cctggccagactatttaatgctactgaactgtatatttaaacatgcttgggctgggcatggtgcctcatgcctataatcccagcactttgggaagccaagragggtggattgcttgagcccaggagtgtgacaccagcctgggcaacatggtgaaaccctgtctctacaaaaacattaaccgggcatggtggcacacgcct

SEQ ID NO: 25099 - DNA, 201 bp, Homo sapiens
gcatgccatcgctttcatcatagactgctagctcctacctgacaacatcagtagcatttctttacccctttcaatatatgtaattaacagataatgtcagrcaagaggaatgtcatcctgttttctgtatttgatgagaaccgaagctggtacctcacagagaatatacaacgctttctccccaatccagctggagtgcag

SEQ ID NO: 25100 - DNA, 201 bp, Homo sapiens
ggctcacgcctgtaatcccagcactttgggaggccgaggcgggcagatcacttgaggtcaggagttcaagaccagcttggccaacatggtgaaaacccatytctactaaaaatacaaaaaaaatagccgggcattgtggcgtgtgcctgtaatcccagctactcaggaggctgaggcaggagaattgcttgaaactgggag

SEQ ID NO: 25101 - DNA, 201 bp, Homo sapiens
atttgagactaacttgggcaggatagtgagatctcatctctataaaaaatttaaaaattagtaaagcatggtggtgcatgcctgtagtcccagctactcargaggtggaggtgggaggactgcttgagcctgggggggtcaaggctacagtaagcaatgatcacaccactacactccagcctgggcaacagagcaagaccc

SEQ ID NO: 25102 - DNA, 201 bp, Homo sapiens
atatgaaaggataaaactcactagtaaaaataagtacattgtcaaatccaaaacactctagtagtgtaatggcagtgggtaaattaattatatctttagtrtaaaagataaaagacaaagaaagctattttaaaaactaaagctataataatgtgttaaggaatgcaaattattaaaatatgtaaactgtcacatcaaaaa

SEQ ID NO: 25103 - DNA, 201 bp, Homo sapiens
caatatatgtaattaacagataatgtcagacaagaggaatgtcatcctgttttctgtatttgatgagaaccgaagctggtacctcacagagaatatacaaygctttctccccaatccagctggagtgcagcttgaggatccagagttccaagcctccaacatcatgcacagtgagtaaagcagcacttaagtccagtgggt

SEQ ID NO: 25104 - DNA, 201 bp, Homo sapiens; identical to SEQ ID NO: 3509

SEQ ID NO: 25105 - DNA, 201 bp, Homo sapiens
tagcatttctttacccctttcaatatatgtaattaacagataatgtcagacaagaggaatgtcatcctgttttctgtatttgatgagaaccgaagctggtmcctcacagagaatatacaacgctttctccccaatccagctggagtgcagcttgaggatccagagttccaagcctccaacatcatgcacagtgagtaaagc

SEQ ID NO: 25106 - DNA, 201 bp, Homo sapiens; identical to SEQ ID NO: 3512

SEQ ID NO: 25107 - DNA, 201 bp, Homo sapiens
gtagcatttctttacccctttcaatatatgtaattaacagataatgtcagacaagaggaatgtcatcctgttttctgtatttgatgagaaccgaagctggyacctcacagagaatatacaacgctttctccccaatccagctggagtgcagcttgaggatccagagttccaagcctccaacatcatgcacagtgagtaaag

SEQ ID NO: 25108 - DNA, 201 bp, Homo sapiens
agtagcatttctttacccctttcaatatatgtaattaacagataatgtcagacaagaggaatgtcatcctgttttctgtatttgatgagaaccgaagctgstacctcacagagaatatacaacgctttctccccaatccagctggagtgcagcttgaggatccagagttccaagcctccaacatcatgcacagtgagtaaa

SEQ ID NO: 25109 - DNA, 201 bp, Homo sapiens
atcagtagcatttctttacccctttcaatatatgtaattaacagataatgtcagacaagaggaatgtcatcctgttttctgtatttgatgagaaccgaagstggtacctcacagagaatatacaacgctttctccccaatccagctggagtgcagcttgaggatccagagttccaagcctccaacatcatgcacagtgagt

SEQ ID NO: 25110 - DNA, 201 bp, Homo sapiens
tttatcagtattttagttttcattatagagatatctcagctctttggtttaatttattccaatatatttatttttattatagctattgtaaatgatttttwaaaaatttctttttaggttgttagctcttggtatatagaaatgctactgatttttgcatgttggttttgtatcctgcaactttactgaatttgtttatca

SEQ ID NO: 25111 - DNA, 201 bp, Homo sapiens
aatttggtaggtctactctgatatttcgcataaaccaatgtatctcatgctcattttttagtgaaaagaaataatttctgttcctgttggtttttataagstgtttttgagacagtggaaatgttaccatccaaagctggaatttggcgggtggaatgccttattggcgagcatctacatgctgggatgagcacacttttt

SEQ ID NO: 25112 - DNA, 201 bp, Homo sapiens
aagctttttgatgtgctgctggatttggtttgccagtgttttattgaggatttttgtatcgatgttcatcagggatattggcctgaaattttctttttttkttgtgtctctgtcaggttttggtatcaggatgatgctggcttcataaaatgagttagggaggattccctctttttctattgtttggaatagtttcagaag

SEQ ID NO: 25113 - DNA, 201 bp, Homo sapiens
ctgatatttcgcataaaccaatgtatctcatgctcattttttagtgaaaagaaataatttctgttcctgttggtttttataaggtgtttttgagacagtgkaaatgttaccatccaaagctggaatttggcgggtggaatgccttattggcgagcatctacatgctgggatgagcacactttttctggtgtacagcaatag

SEQ ID NO: 25114 - DNA, 201 bp, Homo sapiens
gtcttgtcttacatggatggcagcaggcaaagaaagaaagcttgtgcaggaaaactcttttttttcttttcttctttttagacagagtcttgctctgtcaygcaggctggagtcagtggcgtgatcttggctcactgcaacctccacctcccgggttcaagtgattctcctgcctcagccttccaagtagctggtactaca

SEQ ID NO: 25115 - DNA, 201 bp, Homo sapiens
gagacagtggaaatgttaccatccaaagctggaatttggcgggtggaatgccttattggcgagcatctacatgctgggatgagcacactttttctggtgtrcagcaatagtgagtagcaatgtgggcagaggttccctacctactcagcctacttctttacagctttcttcctttctggaatggttgcttgtgtcaggaaa

SEQ ID NO: 25116 - DNA, 201 bp, Homo sapiens
ctcctgcctcagcctcctgagtagctggcattacaggcatgccccaccacgcccagctaatttttgtatttttagtagacagggtttcttcatgttggccyggctggtgtcgaactcctgacctcaggtgatcctcccgcctcggcctcccaaagtgctgggattacagatgtgagccattgggtctggcctttaatcaga

SEQ ID NO: 25117 - DNA, 201 bp, Homo sapiens
gtggaaatgttaccatccaaagctggaatttggcgggtggaatgccttattggcgagcatctacatgctgggatgagcacactttttctggtgtacagcartagtgagtagcaatgtgggcagaggttccctacctactcagcctacttctttacagctttcttcctttctggaatggttgcttgtgtcaggaaataaata

SEQ ID NO: 25118 - DNA, 201 bp, Homo sapiens
tagcatttgttgacgttctcccattttcattgacttacatttgagaagctgaattttgtgcactctagttactgtgttccacccgtttcatttcagagtgwcagactcccctgggaatggcttctggacacattagagattttcagattacagcttcaggacaatatggtaaatactattatttttgctccaagaacctgg

SEQ ID NO: 25119 - DNA, 201 bp, Homo sapiens
agattttaacaggcttctctgtgtccttctccagcaatcaatggctacataatggatacactacctggcttagtaatggctcaggatcaaaggattcgatrgtatctgctcagcatgggcagcaatgaaaacatccattctattcatttcagtggacatgtgttcactgtacgaaaaaaagaggagtataaaatggcactg

SEQ ID NO: 25120 - DNA, 201 bp, Homo sapiens
gggagtctggccaaggaaaagacacagaccttgcacaaatttatactactttttgctgtatttgatgaaggttagtgagtcttaatctgaattttggattsctgaaagaaatcctctgctactattaagaggaggtgattatagaaagatcataaattacattactgttcaggaatgaaggagatggggttaaaaatgaat

SEQ ID NO: 25121 - DNA, 201 bp, Homo sapiens
ctctgtgtccttctccagcaatcaatggctacataatggatacactacctggcttagtaatggctcaggatcaaaggattcgatggtatctgctcagcatrggcagcaatgaaaacatccattctattcatttcagtggacatgtgttcactgtacgaaaaaaagaggagtataaaatggcactgtacaatctctatccag

SEQ ID NO: 25122 - DNA, 201 bp, Homo sapiens
ccagcaatcaatggctacataatggatacactacctggcttagtaatggctcaggatcaaaggattcgatggtatctgctcagcatgggcagcaatgaaamcatccattctattcatttcagtggacatgtgttcactgtacgaaaaaaagaggagtataaaatggcactgtacaatctctatccaggtatgagcttgttt

SEQ ID NO: 25123 - DNA, 201 bp, Homo sapiens
attatgatgacagtagccctagaatatcagtggaagctgctcagtataactgaggctgaagcatgtccttgtgataaccttcttttttcttttctttgagkttgcagcatgccattgggaatggagagtaaagcaatatcagatgcacagattactgcttcatcctactttaccaatatgtttgccacctggtctccttca

SEQ ID NO: 25124 - DNA, 201 bp, Homo sapiens
atcaatggctacataatggatacactacctggcttagtaatggctcaggatcaaaggattcgatggtatctgctcagcatgggcagcaatgaaaacatccwttctattcatttcagtggacatgtgttcactgtacgaaaaaaagaggagtataaaatggcactgtacaatctctatccaggtatgagcttgtttgtgctc

SEQ ID NO: 25125 - DNA, 201 bp, Homo sapiens
gatacactacctggcttagtaatggctcaggatcaaaggattcgatggtatctgctcagcatgggcagcaatgaaaacatccattctattcatttcagtgdacatgtgttcactgtacgaaaaaaagaggagtataaaatggcactgtacaatctctatccaggtatgagcttgtttgtgctctttcttctacctactcta

SEQ ID NO: 25126 - DNA, 201 bp, Homo sapiens
tacactacctggcttagtaatggctcaggatcaaaggattcgatggtatctgctcagcatgggcagcaatgaaaacatccattctattcatttcagtggabatgtgttcactgtacgaaaaaaagaggagtataaaatggcactgtacaatctctatccaggtatgagcttgtttgtgctctttcttctacctactctatt

SEQ ID NO: 25127 - DNA, 201 bp, Homo sapiens
atttcgcataaaccaatgtatctcatgctcattttttagtgaaaagaaataatttctgttcctgttggtttttataaggtgtttttgagacagtggaaatrttaccatccaaagctggaatttggcgggtggaatgccttattggcgagcatctacatgctgggatgagcacactttttctggtgtacagcaatagtgagt

SEQ ID NO: 25128 - DNA, 201 bp, Homo sapiens
tgctcattttttagtgaaaagaaataatttctgttcctgttggtttttataaggtgtttttgagacagtggaaatgttaccatccaaagctggaatttggygggtggaatgccttattggcgagcatctacatgctgggatgagcacactttttctggtgtacagcaatagtgagtagcaatgtgggcagaggttccctac

SEQ ID NO: 25129 - DNA, 201 bp, Homo sapiens
agaaataatttctgttcctgttggtttttataaggtgtttttgagacagtggaaatgttaccatccaaagctggaatttggcgggtggaatgccttattgrcgagcatctacatgctgggatgagcacactttttctggtgtacagcaatagtgagtagcaatgtgggcagaggttccctacctactcagcctacttcttt

SEQ ID NO: 25130 - DNA, 201 bp, Homo sapiens
  misc_feature (1)...(201): n = A,T,C or G, or insertion/deletion polymorphism (see Tables 1-2)
taaatgctatctttcctctttcaggtttttcagggaaatcaagactccttcacacctgtggtgaactctctagacccaccgttactgactcgctaccttcnaattcacccccagagttgggtgcaccagattgccctgaggatggaggttctgggctgcgaggcacaggacctctactgagggtggccactgcagcacctg

SEQ ID NO: 25131 - DNA, 201 bp, Homo sapiens
cattcacatagcgataagttttatcctgtttttaaaatttgccaattttacaggtgtagagtgatattgcatcattactttcattgtgttatttttatttmtaataagttgagcatctttttaaatgcttgttggctattggatttatttgggggatttaattagtcatatgatttgcccattattctttggactctttca

SEQ ID NO: 25132 - DNA, 201 bp, Homo sapiens
acaacatcagtagcatttctttacccctttcaatatatgtaattaacagataatgtcagacaagaggaatgtcatcctgttttctgtatttgatgagaacbgaagctggtacctcacagagaatatacaacgctttctccccaatccagctggagtgcagcttgaggatccagagttccaagcctccaacatcatgcacag

SEQ ID NO: 25133 - DNA, 201 bp, Homo sapiens
gacaacatcagtagcatttctttacccctttcaatatatgtaattaacagataatgtcagacaagaggaatgtcatcctgttttctgtatttgatgagaascgaagctggtacctcacagagaatatacaacgctttctccccaatccagctggagtgcagcttgaggatccagagttccaagcctccaacatcatgcaca

SEQ ID NO: 25134 - DNA, 201 bp, Homo sapiens
ctgacaacatcagtagcatttctttacccctttcaatatatgtaattaacagataatgtcagacaagaggaatgtcatcctgttttctgtatttgatgagraccgaagctggtacctcacagagaatatacaacgctttctccccaatccagctggagtgcagcttgaggatccagagttccaagcctccaacatcatgca

SEQ ID NO: 25135 - DNA, 201 bp, Homo sapiens
tacctgacaacatcagtagcatttctttacccctttcaatatatgtaattaacagataatgtcagacaagaggaatgtcatcctgttttctgtatttgatkagaaccgaagctggtacctcacagagaatatacaacgctttctccccaatccagctggagtgcagcttgaggatccagagttccaagcctccaacatcat

SEQ ID NO: 25136 - DNA, 201 bp, Homo sapiens
tattactctagtttcgttaatatggagagagatctagcttcaggactcattggccctctcctcatctgctacaaagaatctgtagatcaaagaggaaaccrggtgagttcttgcctttccaagtgctgggtttcattctcagtgtatgtccccttataacctgaagaaaatataatggtttgcaatataggtcagtaaaag

SEQ ID NO: 25137 - DNA, 201 bp, Homo sapiens
ttcaaatataaatggacagtgactgtagaagatgggccaactaaatcagatcctcggtgcctgacccgctattactctagtttcgttaatatggagagagvtctagcttcaggactcattggccctctcctcatctgctacaaagaatctgtagatcaaagaggaaaccaggtgagttcttgcctttccaagtgctgggtt

SEQ ID NO: 25138 - DNA, 201 bp, Homo sapiens
agtttagtcaatttacacttaaagtaattattgataggttaggactttctgttgccattctgttaatagttttctgttttgtagttttcttgttcctttcytctttttctttctttgtggtttgatgatttttgcttggatgtgttttgattcttttctctttatcttctgtatatctactgtgtgggggggcggtcgggg

SEQ ID NO: 25139 - DNA, 201 bp, Homo sapiens
tgatgaaggttagtgagtcttaatctgaattttggattcctgaaagaaatcctctgctactattaagaggaggtgattatagaaagatcataaattacatkactgttcaggaatgaaggagatggggttaaaaatgaattccaagaaaacaaaacgtaacctcagttccactggcagctatgaggtaagaagatagaggag

SEQ ID NO: 25140 - DNA, 201 bp, Homo sapiens
tttgagacagtggaaatgttaccatccaaagctggaatttggcgggtggaatgccttattggcgagcatctacatgctgggatgagcacactttttctggygtacagcaatagtgagtagcaatgtgggcagaggttccctacctactcagcctacttctttacagctttcttcctttctggaatggttgcttgtgtcagg

SEQ ID NO: 25141 - DNA, 201 bp, Homo sapiens
atagcatttgttgacgttctcccattttcattgacttacatttgagaagctgaattttgtgcactctagttactgtgttccacccgtttcatttcagagtrtcagactcccctgggaatggcttctggacacattagagattttcagattacagcttcaggacaatatggtaaatactattatttttgctccaagaacctg

SEQ ID NO: 25142 - DNA, 201 bp, Homo sapiens
gttctcccattttcattgacttacatttgagaagctgaattttgtgcactctagttactgtgttccacccgtttcatttcagagtgtcagactcccctggdaatggcttctggacacattagagattttcagattacagcttcaggacaatatggtaaatactattatttttgctccaagaacctgggctgattatatctt

SEQ ID NO: 25143 - DNA, 201 bp, Homo sapiens
ctttcaggtttttcagggaaatcaagactccttcacacctgtggtgaactctctagacccaccgttactgactcgctaccttcgaattcacccccagagtygggtgcaccagattgccctgaggatggaggttctgggctgcgaggcacaggacctctactgagggtggccactgcagcacctgccactgccgtcacctct

SEQ ID NO: 25144 - DNA, 201 bp, Homo sapiens
aagtgctggaaccaaatctttttcttcttaaagacattcttgtagtgaatagcattaactacttttcccttgtacatttctattttttgatttcttctttkgtttttctggaagtatattctcaagtaacttctaaatatgtggtacatagagggtgaactttctgaatccttcagtatcacatgatgggcagacagactg

SEQ ID NO: 25145 - DNA, 201 bp, Homo sapiens
aagacttggaaccaacccaaatatccaacaatgatagactgattaagaaaatgtggcacatatacaccatggaatactatgcagccataaaaaatgtcccygtttgcagatgacatgattgtatatctagaaaacaccattgtctcagcccaaaatctccttaagctgataagcaacttcagcaaagtctcaggatacaaa

SEQ ID NO: 25146 - DNA, 201 bp, Homo sapiens
tttgttagttatgtgaaatgaagtggaatctattttttccaagtggatagtcatattttctattatcatttaccaactagctgatttttttcctgtactgrttggagatgctgcctttattatatattaagtttcaacttattatatattaagtttccgcttacatcttgtcagtttctggactccatattttgtttgata

SEQ ID NO: 25147 - DNA, 201 bp, Homo sapiens
ccatacatatgtctggcaggtcctgaaagagaatggtccaatggcctctgacccactgtgccttacctactcatatctttctcatgtggacctggtaaaakacttgaattcaggcctcattggagccctactagtatgtagagaaggtaagtgtatgaaagcgtaggattgagatgaaataagcagagaagtacaaacaac

SEQ ID NO: 25148 - DNA, 201 bp, Homo sapiens
  misc_feature (1)...(201): n = A,T,C or G, or insertion/deletion polymorphism (see Tables 1-2)
atgccattgggaatggagagtaaagcaatatcagatgcacagattactgcttcatcctactttaccaatatgtttgccacctggtctccttcaaaagctcnacttcacctccaagggaggagtaatgcctggagacctcaggtaagaggcaacagatttactgtttaactgactcagagcagtggttggggaaaaaatcgg

SEQ ID NO: 25149 - DNA, 201 bp, Homo sapiens
acatcacatccctttacctctcaatactttagtacacatttcctgtgaataaagatatcttttacataacagacacttcaaattgataaagcacatttccrtaatttacaactggtattccagttgtatcaaccaatgctgtcatttatagcattttcttctttgaagtacagggatctagtacaagtaactacttgtcct

SEQ ID NO: 25150 - DNA, 201 bp, Homo sapiens
agccatacatatgtctggcaggtcctgaaagagaatggtccaatggcctctgacccactgtgccttacctactcatatctttctcatgtggacctggtaamagacttgaattcaggcctcattggagccctactagtatgtagagaaggtaagtgtatgaaagcgtaggattgagatgaaataagcagagaagtacaaaca

SEQ ID NO: 25151 - DNA, 201 bp, Homo sapiens
attcaaatataaatggacagtgactgtagaagatgggccaactaaatcagatcctcggtgcctgacccgctattactctagtttcgttaatatggagagabatctagcttcaggactcattggccctctcctcatctgctacaaagaatctgtagatcaaagaggaaaccaggtgagttcttgcctttccaagtgctgggt

SEQ ID NO: 25152 - DNA, 201 bp, Homo sapiens
gagtcttttgtggttccacacaaattttaagattcttttttctatttctgtgaaaaacttcactggcatttggataggtattacattaaatctggtagcaytgatattttaacaatattagtttttccagcccattaaaatgggatagataccttttcagttttttgtgtgttcttcaattccctttatcagtattttagt

SEQ ID NO: 25153 - DNA, 201 bp, Homo sapiens
atattcaaatataaatggacagtgactgtagaagatgggccaactaaatcagatcctcggtgcctgacccgctattactctagtttcgttaatatggagasagatctagcttcaggactcattggccctctcctcatctgctacaaagaatctgtagatcaaagaggaaaccaggtgagttcttgcctttccaagtgctgg

SEQ ID NO: 25154 - DNA, 201 bp, Homo sapiens
ctgccaggagaaatattcaaatataaatggacagtgactgtagaagatgggccaactaaatcagatcctcggtgcctgacccgctattactctagtttcgwtaatatggagagagatctagcttcaggactcattggccctctcctcatctgctacaaagaatctgtagatcaaagaggaaaccaggtgagttcttgcctt

SEQ ID NO: 25155 - DNA, 201 bp, Homo sapiens
tccaattctgccaggagaaatattcaaatataaatggacagtgactgtagaagatgggccaactaaatcagatcctcggtgcctgacccgctattactctdgtttcgttaatatggagagagatctagcttcaggactcattggccctctcctcatctgctacaaagaatctgtagatcaaagaggaaaccaggtgagttc

SEQ ID NO: 25156 - DNA, 201 bp, Homo sapiens
ttttccaattctgccaggagaaatattcaaatataaatggacagtgactgtagaagatgggccaactaaatcagatcctcggtgcctgacccgctattacyctagtttcgttaatatggagagagatctagcttcaggactcattggccctctcctcatctgctacaaagaatctgtagatcaaagaggaaaccaggtgag

SEQ ID NO: 25157 - DNA, 201 bp, Homo sapiens; identical to SEQ ID NO: 3556

SEQ ID NO: 25158 - DNA, 201 bp, Homo sapiens; identical to SEQ ID NO: 3557

SEQ ID NO: 25159 - DNA, 201 bp, Homo sapiens; identical to SEQ ID NO: 3558

SEQ ID NO: 25160 - DNA, 201 bp, Homo sapiens
gtgggtaggtgtaaaacatttgaaggattttccaattctgccaggagaaatattcaaatataaatggacagtgactgtagaagatgggccaactaaatcaratcctcggtgcctgacccgctattactctagtttcgttaatatggagagagatctagcttcaggactcattggccctctcctcatctgctacaaagaatc

SEQ ID NO: 25161 - DNA, 201 bp, Homo sapiens
gttttgcttgtgggtaggtgtaaaacatttgaaggattttccaattctgccaggagaaatattcaaatataaatggacagtgactgtagaagatgggccawctaaatcagatcctcggtgcctgacccgctattactctagtttcgttaatatggagagagatctagcttcaggactcattggccctctcctcatctgcta

SEQ ID NO: 25162 - DNA, 201 bp, Homo sapiens
tggctgcaagtggacttccagaagacaatgaaagtcacaggagtaactactcagggagtaaaatctctgcttaccagcatgtatgtgaaggagttcctcayctccagcagtcaagatggccatcagtggactctcttttttcagaatggcaaagtaaaggtaagctggtctccttggaaagaaagaaagaaagaaaaaaaa

SEQ ID NO: 25163 - DNA, 201 bp, Homo sapiens
gctttttttctccagggctcagagtggcagtgtccctcagttcaagaaagttgttttccaggaatttactgatggctcctttactcagcccttataccgtrgagaactaaatgaacatttgggactcctggggccatatataagagcagaagttgaagataatatcatggtgagttaaggacagtggaattacaagaaaat

SEQ ID NO: 25164 - DNA, 201 bp, Homo sapiens; identical to SEQ ID NO: 3570

SEQ ID NO: 25165 - DNA, 201 bp, Homo sapiens
tttctttgagtgtacagtggatatagaaaggacaattttatttcttcctgctataggagctgaatatgatgatcagaccagtcaaagggagaaagaagatsataaagtcttccctggtggaagccatacatatgtctggcaggtcctgaaagagaatggtccaatggcctctgacccactgtgccttacctactcatatct

SEQ ID NO: 25166 - DNA, 201 bp, Homo sapiens
tggccctcccgtagactgcgctccacctggctcactgaaaacgaaagctccgctcggacggtgcgagagcaggtccgcccccggccgccagcaccggaggrccctcggcgtctcctcctcctcggcatgctgggcgttgagtgtgctatctcggcttggcccagctaggcaagatggctctcaagaggacagttaccgcgt

SEQ ID NO: 25167 - DNA, 201 bp, Homo sapiens
gtggccctcccgtagactgcgctccacctggctcactgaaaacgaaagctccgctcggacggtgcgagagcaggtccgcccccggccgccagcaccggagraccctcggcgtctcctcctcctcggcatgctgggcgttgagtgtgctatctcggcttggcccagctaggcaagatggctctcaagaggacagttaccgcg

SEQ ID NO: 25168 - DNA, 201 bp, Homo sapiens
gttgatcctagtcgttttaggatttgatcttagatctcgcttatactttcagattatatttaagaatcaagcaagcagaccatataacatctaccctcacrgaatcactgatgtccgtcctttgtattcaaggagattaccaaaaggtaaatattccctcgatttatagctcttttttacctgtagatacagatgagataa

SEQ ID NO: 25169 - DNA, 201 bp, Homo sapiens
ttctcactcctaccttttgtgctcttgtcatttatttgaattctacatatattttaaaccccataagacattattattgttttatataatcaatatcatttatatatatatatatatatttacacctttcatttctttcattcttttctgcatttcttgcttccatctatgatcattttctttttgtctgaagaaacttct

SEQ ID NO: 25170 - DNA, 201 bp, Homo sapiens
agtaatggctcaggatcaaaggattcgatggtatctgctcagcatgggcagcaatgaaaacatccattctattcatttcagtggacatgtgttcactgtaygaaaaaaagaggagtataaaatggcactgtacaatctctatccaggtatgagcttgtttgtgctctttcttctacctactctatttgttgagtacttact

SEQ ID NO: 25171 - DNA, 201 bp, Homo sapiens
tctcactcctaccttttgtgctcttgtcatttatttgaattctacatatattttaaaccccataagacattattattgttttatataatcaatatcatttatatatatatatatatatttacacctttcatttctttcattcttttctgcatttcttgcttccatctatgatcattttctttttgtctgaagaaacttctt

SEQ ID NO: 25172 - DNA, 201 bp, Homo sapiens
tttagaatctgtgttatgagtaaccagagtcttattcttcctcatctccaggtctatggattctggggtgccacaactcagactttcggaacagaggcatsaccgccttactgaaggtttctagttgtgacaagaacactggtgattattacgaggacagttatgaagatatttcagcatacttgctgagtaaaaacaatg

SEQ ID NO: 25173 - DNA, 201 bp, Homo sapiens
tgttatgagtaaccagagtcttattcttcctcatctccaggtctatggattctggggtgccacaactcagactttcggaacagaggcatgaccgccttacwgaaggtttctagttgtgacaagaacactggtgattattacgaggacagttatgaagatatttcagcatacttgctgagtaaaaacaatgccattgaacca

SEQ ID NO: 25174 - DNA, 201 bp, Homo sapiens; identical to SEQ ID NO: 3581

SEQ ID NO: 25175 - DNA, 201 bp, Homo sapiens; identical to SEQ ID NO: 3583

SEQ ID NO: 25176 - DNA, 201 bp, Homo sapiens
gaccgagactccatttgaaaaaaaaaaagaagaggaaatgtgtacacacagagacaccagggatgcatattcacagaggaaagaccaagccaaggagaggygtcagtaaaaaccaaacctgccaataccttgatcttggaattttagtgttcaaaactgtgagaaaacacattcctgttatttacacctcccagtctgtgg

SEQ ID NO: 25177 - DNA, 201 bp, Homo sapiens
aagtgtccaccaaaatgaacgactttttcctttcttcacgcagatttcctcctagagtgccaaaatcttttccattcaacacctcagtcgtgtacaaaaasactctgtttgtagaattcacggatcaccttttcaacatcgctaagccaaggccaccctggatgggtaatgaaaacaatgttgaatgctatttatgaaatt

SEQ ID NO: 25178 - DNA, 201 bp, Homo sapiens
agtccgatttatggcatacacagatgaaacctttaagactcgtgaagctattcagcatgaatcaggaatcttgggacctttactttatggggaagttggaracacactgttggtaagttgaagaaaagatttaaggtcaggtaagaagaaaaagtctggagagttttgagtttctaaaatacctcataattcagccttgtc

SEQ ID NO: 25179 - DNA, 201 bp, Homo sapiens; identical to SEQ ID NO: 3590

SEQ ID NO: 25180 - DNA, 201 bp, Homo sapiens; identical to SEQ ID NO: 3591

SEQ ID NO: 25181 - DNA, 201 bp, Homo sapiens; identical to SEQ ID NO: 3592

SEQ ID NO: 25182 - DNA, 201 bp, Homo sapiens; identical to SEQ ID NO: 3593

SEQ ID NO: 25183 - DNA, 201 bp, Homo sapiens; identical to SEQ ID NO: 3594

SEQ ID NO: 25184 - DNA, 201 bp, Homo sapiens; identical to SEQ ID NO: 3595

SEQ ID NO: 25185 - DNA, 201 bp, Homo sapiens; identical to SEQ ID NO: 3596

SEQ ID NO: 25186 - DNA, 201 bp, Homo sapiens
cagaaatcacccgtcttctgcatcacttatgctgggagctgtagactggagctgttcctattcggccatcttggctcccaatgcaaagaccttcaaacaaygtgacttcattttctcactcctaccttttgtgctcttgtcatttatttgaattctacatatattttaaaccccataagacattattattgttttatataa

SEQ ID NO: 25187 - DNA, 201 bp, Homo sapiens
aaaggtccaaagcataccactacagaaagccatcaaactataaaggaagaatgcaacagaagaagaaaggatcaaaggatctaaaaaaaaaaaaagaaagmaagcaattaacaaaatgacacaagtatgaccaaagtccactgcttctttattactgatatagaatatctttcagatcttaagggactgattaattacttg

SEQ ID NO: 25188 - DNA, 201 bp, Homo sapiens
actctgtgtgggtgccctgagcccacatttcccttctgcactgccctagcagagtttctacatgaaggcccacccccgcagcaaacttctgcctgggcatycaggcacttccattaatttctaaacaacaaagcattcaagaggcgacttgggtgctattaagggcattcagtttcataagggaagcagagcataaaagtt

SEQ ID NO: 25189 - DNA, 201 bp, Homo sapiens
agattgaactatgaggaaatagaaaacttgagcagaccaataactagtaatgagattgaagcagtagtaaaaagtctggcattaaataaaagtccaggacytgatgacttcactgctgaagaaaaacttacaccaattatactgaaactatttaatattgcaaaaaattgaagagaaaagaatgtttccaaactcattcta

SEQ ID NO: 25190 - DNA, 201 bp, Homo sapiens
gtttggaaaatttgcagcctgataatgttagagaaaagcaaatcccattttctgaggagaaattcaagcaggctgcagaaatttgcataagtaatgaggakccgaatgttaatccccaagacaatggggaaaatgtctccagggcatgtcagaggtcttcacaccagcccctcccatcaccggcccagaggcctaagagga

SEQ ID NO: 25191 - DNA, 201 bp, Homo sapiens
ggaggcctcaaaatcatggcagaaggcaaggaggagcaagtcttgtcttacatggatggcagcaggcaaagaaagaaagcttgtgcaggaaaactcttttktttcttttcttctttttagacagagtcttgctctgtcatgcaggctggagtcagtggcgtgatcttggctcactgcaacctccacctcccgggttcaagt

SEQ ID NO: 25192 - DNA, 201 bp, Homo sapiens
tgagatgaagattaacatgcaggaattttatttggagtgttcttgggatcaacacctgaggaatcagggataggcagagggagaagcgcgctgccgggtakgctccaggacagccttgctggatcttacagggagctctggagctggaatgaaccttccaggttggaccaacatgtccaggcctctgtgtccctgcactga

SEQ ID NO: 25193 - DNA, 201 bp, Homo sapiens
aagtgtttttccccatctggtttcttacaacattttttgtctttgattttctggagtttgaatataatatgcctaggtgtagggtttttttatttgtttgytcgtttgcatctatcttttttttttttttttttttttttgagacagaatctcgccctgtcacccaggctggagtgcagtggcgcgaactcggctcactgc

SEQ ID NO: 25194 - DNA, 201 bp, Homo sapiens; identical to SEQ ID NO: 3598

SEQ ID NO: 25195 - DNA, 201 bp, Homo sapiens
aatctaagaaaagtcagcatttatttatatgttactgaaaattaattaatttggattgaattaatatattctaaaataattctaatcaaacctgtttttawtttataccttagcataaattagggaagtaaattttgcataatttgtttttatcctattttttatggtgaaatcagcttcactgtaccttttccttgttcc

SEQ ID NO: 25196 - DNA, 201 bp, Homo sapiens; identical to SEQ ID NO: 3603

SEQ ID NO: 25197 - DNA, 201 bp, Homo sapiens
agtcatgcaaatagagctctccacctgcttctttctgtgccttttgcgattctgctttagtgccaccagaagatactacctgggtgcagtggaactgtcakgggactatatgcaaagtgatctcggtgagctgcctgtggacgcaaggtaaaggcatgtcctgtagggtctgatcggggccaggattgtggggatgtaagt

SEQ ID NO: 25198 - DNA, 201 bp, Homo sapiens; identical to SEQ ID NO: 3610

SEQ ID NO: 25199 - DNA, 201 bp, Homo sapiens; identical to SEQ ID NO: 3611

SEQ ID NO: 25200 - DNA, 201 bp, Homo sapiens
aacaatggccctcagcggattggtaggaagtacaaaaaagtccgatttatggcatacacagatgaaacctttaagactcgtgaagctattcagcatgaatsaggaatcttgggacctttactttatggggaagttggagacacactgttggtaagttgaagaaaagatttaaggtcaggtaagaagaaaaagtctggagag

SEQ ID NO: 25201 - DNA, 201 bp, Homo sapiens
aaagagtggctgcaagtggacttccagaagacaatgaaagtcacaggagtaactactcagggagtaaaatctctgcttaccagcatgtatgtgaaggagtkcctcatctccagcagtcaagatggccatcagtggactctcttttttcagaatggcaaagtaaaggtaagctggtctccttggaaagaaagaaagaaagaa

SEQ ID NO: 25202 - DNA, 201 bp, Homo sapiens
ttgagcctacctagaatttttcttcccaacctctcatctttttttctcttatacagaagttataaaagtcaatatttgaacaatggccctcagcggattgdtaggaagtacaaaaaagtccgatttatggcatacacagatgaaacctttaagactcgtgaagctattcagcatgaatcaggaatcttgggacctttactt

SEQ ID NO: 25203 - DNA, 201 bp, Homo sapiens
ggggcaggatgaaatcatctagggtaggtatttagagggagggcgccgtgcaaaataaaatcctcactatgaaacaaaggcggaggcaggaggctgcgttrggtggaagcagcggaggaaggagacgaaagggattgtcattttcatgtcgtggctttttagaagacagccatgtcctctactctgattctatcaaaatgt

SEQ ID NO: 25204 - DNA, 201 bp, Homo sapiens
ctggccaatgggaaacacaccttttgctcagaaagaccctgggaatgtaggtcaatcataatgcagtagcattctcctgtcccaaccatcaaagaattcastcaccctgtttctcatctcctggggggaggggagtggtcagaactcaatctccacaacccccaactgtaagggtcacgtagcaagcactttgcatttgag

SEQ ID NO: 25205 - DNA, 201 bp, Homo sapiens
gtggtcaggtttgatgatgacaactctccttcctttatccaaattcgctcagttgccaagaagcatcctaaaacttgggtacattacattgctgctgaagrggaggactgggactatgctcccttagtcctcgcccccgatgacaggtaagcactttttgactattggtactctctcttccccatactcaaaaagttctta

SEQ ID NO: 25206 - DNA, 201 bp, Homo sapiens
aagaccagcattatcccaatacccaaaccagacaaagacacaacaacagcaaaaagaaaactacaggccaacttcgctgatgaatatagatgcaaaaatcytcaacaaagtactagcaaactaaattcaacaacacattaaaatgagtatttgtcatgcccaagggggattcatcctaggaacacaaagatagttcaacat

SEQ ID NO: 25207 - DNA, 201 bp, Homo sapiens
tctgaaatggatgtggtcaggtttgatgatgacaactctccttcctttatccaaattcgctcagttgccaagaagcatcctaaaacttgggtacattacaktgctgctgaagaggaggactgggactatgctcccttagtcctcgcccccgatgacaggtaagcactttttgactattggtactctctcttccccatactc

SEQ ID NO: 25208 - DNA, 201 bp, Homo sapiens
agatccactgagagcttgcaccgtgggcctggaaaagccacaggcactcaatgccagcccatgaaagcagccaggagcagggctgtaccctgcaaagctaygggggtggagcttcccaaggctgtgggagcctgccttttgtatcagggtgacctaaatgtgagacacggagtcaaaggagaacattttggaactttcagg

SEQ ID NO: 25209 - DNA, 201 bp, Homo sapiens
tgggtggaaacatatggtttggctctgtgtccccacccaaatctcatcttgaattgtagtatattgtttgtaaaaattcctgcctatccagagattttttwaaaaaaaacaatactttcttcaattttctcttacaatttaattttttacatttaactttttaatacttcctgtagactaaaagttattttggtgcattgt

SEQ ID NO: 25210 - DNA, 201 bp, Homo sapiens
tggttataaaaattttcccgctgggtgcggtggctcacgcctgtaatcccagcactttgggaggccgaggcgggcagatcacttgaggtcaggagttcaasaccagcttggccaacatggtgaaaacccatctctactaaaaatacaaaaaaaatagccgggcattgtggcgtgtgcctgtaatcccagctactcaggagg

SEQ ID NO: 25211 - DNA, 201 bp, Homo sapiens
ttttgtcgttattgttctacaggtaactttcagaaatcaggcctctcgtccctattccttctattctagccttatttcttatgaggaagatcagaggcaakgagcagaacctagaaaaaactttgtcaagcctaatgaaaccaaaacttacttttggaaagtgcaacatcatatggcacccactaaagatgagtttgactg

SEQ ID NO: 25212 - DNA, 201 bp, Homo sapiens
cagaggcaaggagcagaacctagaaaaaactttgtcaagcctaatgaaaccaaaacttacttttggaaagtgcaacatcatatggcacccactaaagatgrgtttgactgcaaagcctgggcttatttctctgatgttgacctggtaagcaggtgtctattgtgctgaccactttttggtttaaaagaaatggtctttgtg

SEQ ID NO: 25213 - DNA, 201 bp, Homo sapiens
gattgatgtcttccctccctaggaaaaagatgtgcactcaggcctgattggaccccttctggtctgccacactaacacactgaaccctgctcatgggagayaagtgacagtacaggaatttgctctgtttttcaccatctttgatgagaccaaaagctggtacttcactgaaaatatggaaagaaactgcagggctccctg

SEQ ID NO: 25214 - DNA, 201 bp, Homo sapiens
atttctattttttgatttcttcttttgtttttctggaagtatattctcaagtaacttctaaatatgtggtacatagagggtgaactttctgaatccttcaktatcacatgatgggcagacagactggttataaaaattttcccgctgggtgcggtggctcacgcctgtaatcccagcactttgggaggccgaggcgggcag

SEQ ID NO: 25215 - DNA, 201 bp, Homo sapiens
ccttctggtctgccacactaacacactgaaccctgctcatgggagacaagtgacagtacaggaatttgctctgtttttcaccatctttgatgagaccaaawgctggtacttcactgaaaatatggaaagaaactgcagggctccctgcaatatccagatggaagatcccacttttaaagagaattatcgcttccatggtaa

SEQ ID NO: 25216 - DNA, 201 bp, Homo sapiens
gtgagccaagatcaccccactgcactccagcctgggcaacagagcaagactgcatctcaaaaaaaattccttcccctgttttctaatattcattattgccrataagaattctttatttgcatttctttatggaagaatggcatagtgacagagttctggggagattttgaatgtgtgtcccgaaatttggaggcatacgtg

SEQ ID NO: 25217 - DNA, 201 bp, Homo sapiens
ttctggtctgccacactaacacactgaaccctgctcatgggagacaagtgacagtacaggaatttgctctgtttttcaccatctttgatgagaccaaaagstggtacttcactgaaaatatggaaagaaactgcagggctccctgcaatatccagatggaagatcccacttttaaagagaattatcgcttccatggtaata

SEQ ID NO: 25218 - DNA, 201 bp, Homo sapiens
cattttcttactccagtctatcattgttggacatttgggttggttccaagtctttgctattgtgaatactgccgctataaacatacgtgtgcatgtgtctytatagcagcatgatttatagtcctttgggtatatacccagtaatgggatggctgggtcaaatggtatttctagttctagatccctgaggaatcgccacac

SEQ ID NO: 25219 - DNA, 201 bp, Homo sapiens
aagtgacagtacaggaatttgctctgtttttcaccatctttgatgagaccaaaagctggtacttcactgaaaatatggaaagaaactgcagggctccctgvaatatccagatggaagatcccacttttaaagagaattatcgcttccatggtaatatattccacatccaaacattatcactgtgaaatgcagattgcactt

SEQ ID NO: 25220 - DNA, 201 bp, Homo sapiens
taacaggcttctctgtgtccttctccagcaatcaatggctacataatggatacactacctggcttagtaatggctcaggatcaaaggattcgatggtatcygctcagcatgggcagcaatgaaaacatccattctattcatttcagtggacatgtgttcactgtacgaaaaaaagaggagtataaaatggcactgtacaat

SEQ ID NO: 25221 - DNA, 201 bp, Homo sapiens
tttcctatagtactcattcccagtctgggatttagctctctctagctgatcctccccatttttatatgtccaattaccacctattttcagatgacccacaratttatatctacagcctagatttcttccatggacatctcattatgggtgactcaaaagtacctcaaaattaacatgtctgcagcatgtagcactgttgca

SEQ ID NO: 25222 - DNA, 201 bp, Homo sapiens
tgaagcatgtccttgtgataaccttcttttttcttttctttgaggttgcagcatgccattgggaatggagagtaaagcaatatcagatgcacagattactscttcatcctactttaccaatatgtttgccacctggtctccttcaaaagctcgacttcacctccaagggaggagtaatgcctggagacctcaggtaagagg

SEQ ID NO: 25223 - DNA, 201 bp, Homo sapiens
caagaggctactagtccaactctattgccctcaggtgaataatccaaaagagtggctgcaagtggacttccagaagacaatgaaagtcacaggagtaactrctcagggagtaaaatctctgcttaccagcatgtatgtgaaggagttcctcatctccagcagtcaagatggccatcagtggactctcttttttcagaatgg

SEQ ID NO: 25224 - DNA, 201 bp, Homo sapiens
ataaatgctatctttcctctttcaggtttttcagggaaatcaagactccttcacacctgtggtgaactctctagacccaccgttactgactcgctaccttbgaattcacccccagagttgggtgcaccagattgccctgaggatggaggttctgggctgcgaggcacaggacctctactgagggtggccactgcagcacct

SEQ ID NO: 25225 - DNA, 201 bp, Homo sapiens
tttttcttttctttgaggttgcagcatgccattgggaatggagagtaaagcaatatcagatgcacagattactgcttcatcctactttaccaatatgtttsccacctggtctccttcaaaagctcgacttcacctccaagggaggagtaatgcctggagacctcaggtaagaggcaacagatttactgtttaactgactca

SEQ ID NO: 25226 - DNA, 201 bp, Homo sapiens
taatgatcgccattctaactggtgtgagatggtatctcactgtggttttgatttgcatttctctgatggccagtgatgatgagcatattttcatgtgtctkttggctgcataaatgtcttcttttgagaagtgtctgttcatatcctttgtataagattattagtggatttctcagaagaaatattgtaggccagaaggga

SEQ ID NO: 25227 - DNA, 201 bp, Homo sapiens
ttttttttgagacggagtcttgctgtcgcccaggctggagtgcagtggcgcaatctcagctcactgcaggctctgccccccggggttcacgccattctccygcctcagcctcccgagtagctgggactacaggcgcccgccacctcgactggctaattttttgtatttttagtagagacggggtttcattgtgttagccag

SEQ ID NO: 25228 - DNA, 201 bp, Homo sapiens
tactgattctgaaatggatgtggtcaggtttgatgatgacaactctccttcctttatccaaattcgctcagttgccaagaagcatcctaaaacttgggtasattacattgctgctgaagaggaggactgggactatgctcccttagtcctcgcccccgatgacaggtaagcactttttgactattggtactctctcttccc

SEQ ID NO: 25229 - DNA, 201 bp, Homo sapiens
cctattggggccttctagtccttagtagagagtctggactttattctatgtggaatgacagcctccagtgggttttaggctggcggatactacaatcagayctggaatgcagaaatagtacaccagtttctttgtgggtaaaagtcttagaggggagaatatgaccaactgtagggagacctgtaaaaaaagtttatcagt

SEQ ID NO: 25230 - DNA, 201 bp, Homo sapiens
tgatcttactgattctgaaatggatgtggtcaggtttgatgatgacaactctccttcctttatccaaattcgctcagttgccaagaagcatcctaaaactkgggtacattacattgctgctgaagaggaggactgggactatgctcccttagtcctcgcccccgatgacaggtaagcactttttgactattggtactctct

SEQ ID NO: 25231 - DNA, 201 bp, Homo sapiens
tccaccaaaatgaacgactttttcctttcttcacgcagatttcctcctagagtgccaaaatcttttccattcaacacctcagtcgtgtacaaaaagactcygtttgtagaattcacggatcaccttttcaacatcgctaagccaaggccaccctggatgggtaatgaaaacaatgttgaatgctatttatgaaattgggta

SEQ ID NO: 25232 - DNA, 201 bp, Homo sapiens
ttgcccaggctggtgttgaacccctgggctcaagtgatcatcctgccctggcctcccaaagtactgggattacaggtgtgtgccaccacacctggccagamtatttaatgctactgaactgtatatttaaacatgcttgggctgggcatggtgcctcatgcctataatcccagcactttgggaagccaaggagggtggatt

SEQ ID NO: 25233 - DNA, 201 bp, Homo sapiens
ctttttcctttcttcacgcagatttcctcctagagtgccaaaatcttttccattcaacacctcagtcgtgtacaaaaagactctgtttgtagaattcacgkatcaccttttcaacatcgctaagccaaggccaccctggatgggtaatgaaaacaatgttgaatgctatttatgaaattgggtatcttattttctatcaca

SEQ ID NO: 25234 - DNA, 201 bp, Homo sapiens
ctaatatagcaagacactctgacattgtttggtttgtctgactccagatggcatggaagcttatgtcaaagtagacagctgtccagaggaaccccaactaygaatgaaaaataatgaagaagcggaagactatgatgatgatcttactgattctgaaatggatgtggtcaggtttgatgatgacaactctccttcctttat

SEQ ID NO: 25235 - DNA, 201 bp, Homo sapiens
gtccttctccagcaatcaatggctacataatggatacactacctggcttagtaatggctcaggatcaaaggattcgatggtatctgctcagcatgggcagmaatgaaaacatccattctattcatttcagtggacatgtgttcactgtacgaaaaaaagaggagtataaaatggcactgtacaatctctatccaggtatga

SEQ ID NO: 25236 - DNA, 201 bp, Homo sapiens
acctggcttagtaatggctcaggatcaaaggattcgatggtatctgctcagcatgggcagcaatgaaaacatccattctattcatttcagtggacatgtgwtcactgtacgaaaaaaagaggagtataaaatggcactgtacaatctctatccaggtatgagcttgtttgtgctctttcttctacctactctatttgttga

SEQ ID NO: 25237 - DNA, 201 bp, Homo sapiens
atgctcattttttagtgaaaagaaataatttctgttcctgttggtttttataaggtgtttttgagacagtggaaatgttaccatccaaagctggaatttgkcgggtggaatgccttattggcgagcatctacatgctgggatgagcacactttttctggtgtacagcaatagtgagtagcaatgtgggcagaggttcccta

SEQ ID NO: 25238 - DNA, 201 bp, Homo sapiens
gagtagcaatgtgggcagaggttccctacctactcagcctacttctttacagctttcttcctttctggaatggttgcttgtgtcaggaaataaatacaagyttacatcattatcaaatttaaaatgaatattgctggtagaaatcatcagagttctcagagtagggcagatatacttgaagctttgaacactttgtacctg

SEQ ID NO: 25239 - DNA, 201 bp, Homo sapiens
ctgaggtgggaagatagcttgagcccaggaggtcgaggctgcagtgagcctggatgacaaagcgacaccctgtctcaaaaaaaaaaaaaaaaaaaaaaaaraaagcttaataaatacttttgggcaaaacatagggaaagatataaaatatttcaaaatatggctagaatttggaccatttctactgctttaaaaaataaa

SEQ ID NO: 25240 - DNA, 201 bp, Homo sapiens
ctcttgaaaaggaggcgtgagagttttacaccaaaatagtaacatttttcactaggtggaagggttacattttaaaatgtcttttatttgtatttttactwatttttacttttcattttctgatttttctacaatgaacatacattgcgtaataaataataggcggggcacgttggctcatgcctcccagcactttgcaag

SEQ ID NO: 25241 - DNA, 201 bp, Homo sapiens
tctcaaaaaaaaaaaaaaaaaaaaaaaaaaaagcttaataaatacttttgggcaaaacatagggaaagatataaaatatttcaaaatatggctagaatttrgaccatttctactgctttaaaaaataaagctaaattctctgaacaagaaaagcttagttcttcacaaaaactcattgctcggccccagaataactcagtg

SEQ ID NO: 25242 - DNA, 201 bp, Homo sapiens
tttgcttctccagttgaacatttgtagcaataagtcatgcaaatagagctctccacctgcttctttctgtgccttttgcgattctgctttagtgccaccasaagatactacctgggtgcagtggaactgtcatgggactatatgcaaagtgatctcggtgagctgcctgtggacgcaaggtaaaggcatgtcctgtagggt

SEQ ID NO: 25243 - DNA, 201 bp, Homo sapiens
ccgccaccacacccagctaattttttgtatttttagtagagacagggtttcaccgtgttagccaggatggtctcgatttcctgacctcgtgatccacccgmctcggcctcccaaagtgctgggattacaggcgtgagccaccgtgcccagcctgaatgtcttcttttgagaaatgtctattcagatctttgtccattttta

SEQ ID NO: 25244 - DNA, 201 bp, Homo sapiens
ccagttgaacatttgtagcaataagtcatgcaaatagagctctccacctgcttctttctgtgccttttgcgattctgctttagtgccaccagaagatactrcctgggtgcagtggaactgtcatgggactatatgcaaagtgatctcggtgagctgcctgtggacgcaaggtaaaggcatgtcctgtagggtctgatcggg

SEQ ID NO: 25245 - DNA, 201 bp, Homo sapiens
cagggtttcaccgtgttagccaggatggtctcgatttcctgacctcgtgatccacccgcctcggcctcccaaagtgctgggattacaggcgtgagccaccrtgcccagcctgaatgtcttcttttgagaaatgtctattcagatctttgtccatttttaatagggttctttgttttttttgctattgactagagtttctta

SEQ ID NO: 25246 - DNA, 201 bp, Homo sapiens
taattttggtatatggtgtgaggaggggatccaagttcgttctacagcctatatagcctgcagatgagcaatgttagtgaccttgaaagtagaggcccagrttgtcagtagcctggcatctaactaaacaaccatttatccattaaagttagccctgttaacaattaatattgagataattttacttaatacactgtgtat

SEQ ID NO: 25247 - DNA, 201 bp, Homo sapiens
ttcaccgtgttagccaggatggtctcgatttcctgacctcgtgatccacccgcctcggcctcccaaagtgctgggattacaggcgtgagccaccgtgcccrgcctgaatgtcttcttttgagaaatgtctattcagatctttgtccatttttaatagggttctttgttttttttgctattgactagagtttcttatatatt

SEQ ID NO: 25248 - DNA, 201 bp, Homo sapiens
ttttggtatatggtgtgaggaggggatccaagttcgttctacagcctatatagcctgcagatgagcaatgttagtgaccttgaaagtagaggcccaggttrtcagtagcctggcatctaactaaacaaccatttatccattaaagttagccctgttaacaattaatattgagataattttacttaatacactgtgtatatt

SEQ ID NO: 25249 - DNA, 201 bp, Homo sapiens
tgaagtgtccaccaaaatgaacgactttttcctttcttcacgcagatttcctcctagagtgccaaaatcttttccattcaacacctcagtcgtgtacaaaragactctgtttgtagaattcacggatcaccttttcaacatcgctaagccaaggccaccctggatgggtaatgaaaacaatgttgaatgctatttatgaaa

SEQ ID NO: 25250 - DNA, 201 bp, Homo sapiens
catgccattgggaatggagagtaaagcaatatcagatgcacagattactgcttcatcctactttaccaatatgtttgccacctggtctccttcaaaagctbgacttcacctccaagggaggagtaatgcctggagacctcaggtaagaggcaacagatttactgtttaactgactcagagcagtggttggggaaaaaatcg

SEQ ID NO: 25251 - DNA, 201 bp, Homo sapiens
aaaagagtggctgcaagtggacttccagaagacaatgaaagtcacaggagtaactactcagggagtaaaatctctgcttaccagcatgtatgtgaaggagwtcctcatctccagcagtcaagatggccatcagtggactctcttttttcagaatggcaaagtaaaggtaagctggtctccttggaaagaaagaaagaaaga

SEQ ID NO: 25252 - DNA, 201 bp, Homo sapiens
tttctgggagtaaatggtgaccaagaggctactagtccaactctattgccctcaggtgaataatccaaaagagtggctgcaagtggacttccagaagacartgaaagtcacaggagtaactactcagggagtaaaatctctgcttaccagcatgtatgtgaaggagttcctcatctccagcagtcaagatggccatcagtg

SEQ ID NO: 25253 - DNA, 201 bp, Homo sapiens
ggtatggttaagagggatttgggaatttctgggagtaaatggtgaccaagaggctactagtccaactctattgccctcaggtgaataatccaaaagagtgkctgcaagtggacttccagaagacaatgaaagtcacaggagtaactactcagggagtaaaatctctgcttaccagcatgtatgtgaaggagttcctcatct

SEQ ID NO: 25254 - DNA, 201 bp, Homo sapiens
gaggctgaagcatgtccttgtgataaccttcttttttcttttctttgaggttgcagcatgccattgggaatggagagtaaagcaatatcagatgcacagawtactgcttcatcctactttaccaatatgtttgccacctggtctccttcaaaagctcgacttcacctccaagggaggagtaatgcctggagacctcaggta

SEQ ID NO: 25255 - DNA, 201 bp, Homo sapiens
tgctgaggactttcccgggcaggccctgacttgctcagaaccagcgggggtgtccccttcccacccagggccactcccctgcactgtcacccggagagackgctcctctgtgccatccctggctcccacccaaccccagacccccaccacctctccatccctccagctgtggaggtctcacaaccccccaacccatctcac

SEQ ID NO: 25256 - DNA, 201 bp, Homo sapiens
aaatacaaaaaatgagccgggcatggtggcgggcacctgtagtcccagctacttgggaggctgaggcaggagaatggcgtgaacccgggaggcggagcttrcagtgagccgagatggtgccactgcactccagcctgggcgacagagcgagactccgtctcaaaaaaaaaaaaaaaaattgaggcagaatttcgctatgtt

SEQ ID NO: 25257 - DNA, 201 bp, Homo sapiens
ttctgttcctttttctccaagactcttgcttattctcaccatttggctggactttctactgtaggattacctcggaatccacacaaaacccacagggtttyagagttgccttgaattacacgttttgaacattcagatcttcattttcccaaacatccacccagttataggtgacctttgctccaaagtcctggagtagca

SEQ ID NO: 25258 - DNA, 201 bp, Homo sapiens
gttcattgtagattctggatattagccctttgtcagatgagtaggttgcgaaaattttctcccattttgtaggttgcctgttcactctgatggtagtttcytttgctgtgcagaagctctttagtttaattagttcccatttgtcaattttggcttttgttgccattgcttttggtgttttagacatgaagtccttgcaca

SEQ ID NO: 25259 - DNA, 201 bp, Homo sapiens
gtgcatacatgtacaaatgtgtgtgtgtatgtgtgtgtgtgtgtgcatttcacacaaaaacaagagcagtgtaaattggtctgtaccttgatttttaaaargtaacaatatattttgaattagccaggcatggtggcacatgcctgtagtcccagctactctggaggctgaggcaggagaatcgctcgaatctgggaggcg

SEQ ID NO: 25260 - DNA, 201 bp, Homo sapiens
gtgtgagaaggtgcagagaatacttcctgaagcaattgaaacaatttttaaagaagtggaaaggggcctttagagagaaacctaagtactgtcagccctcyacattgtcaactgaagaatcctaagtttgtaaatttggagtggaaagggttgcaggctgggaagtgtagcctctggcagcaaatggaagcaagcactttg

SEQ ID NO: 25261 - DNA, 201 bp, Homo sapiens
caagtaacctttggcggacatctcattcttacaggtctgctaggtcctaccatccaggctgaggtttatgatacagtggtcattacacttaagaacatggyttcccatcctgtcagtcttcatgctgttggtgtatcctactggaaagcttctgagggtgagtaaaataccctcctattgtcctgtcattctatgaataga

SEQ ID NO: 25262 - DNA, 201 bp, Homo sapiens
catacatatgtctggcaggtcctgaaagagaatggtccaatggcctctgacccactgtgccttacctactcatatctttctcatgtggacctggtaaaagrcttgaattcaggcctcattggagccctactagtatgtagagaaggtaagtgtatgaaagcgtaggattgagatgaaataagcagagaagtacaaacaact

SEQ ID NO: 25263 - DNA, 201 bp, Homo sapiens
ttataatagatttttgtatattttatggtaataaatgataaaatagtctagtatcaacatgtatatgtatatataagtgtgtatacatatatatatatatwtattttttttttttttgagacggagtcttgctgtcgcccaggctggagtgcagtggcgcaatctcagctcactgcaggctctgccccccggggttcacgc

SEQ ID NO: 25264 - DNA, 201 bp, Homo sapiens
aaatgaagtatttttttcctgccaataatggaataaaactataaatcaacaacaggaggaacaactgtacaaatacatggaaattaaagaacatgcccctmaacaaacaatgggtcaatgaagaaattaaaggagaagttaaaaaatttcttgaaacaaatgaaaatggaaacataacatgccaaaacttatgggatacag

SEQ ID NO: 25265 - DNA, 201 bp, Homo sapiens
aaaggtgactagacttttctgatggataaagtgtatgagagaaaaagaagagtcattactatatatgtaaatctaagcaaacatttactttttaaagcaayttaaagtttgttacttgaatatataaaatatatcatggagttaaaaatatatagaaatttattatatttggtatctaaagtagtcaaattcatagaaaca

SEQ ID NO: 25266 - DNA, 201 bp, Homo sapiens
tacttcatagccataggtgtcttattcctactttacaggtctgattggatgccacaggaaatcagtctattggcatgtgattggaatgggcaccactcctdaagtgcactcaatattcctcgaaggtcacacatttcttgtgaggaaccatcgccaggcgtccttggaaatctcgccaataactttccttactgctcaaac

SEQ ID NO: 25267 - DNA, 201 bp, Homo sapiens
atatatgaccaaattttcagagcaaaatttattaagtacctatggtagcaagacattgtaaaaggcattctgagagaacacagtgactttaagaaaaaggyaaaatactgagaaaagggcagagtagatccaagagttaattctcctcatcagcaccttgattcccaagcctttttgacctttaagtttagtggtccagga

SEQ ID NO: 25268 - DNA, 201 bp, Homo sapiens
gtttgtctgactccagatggcatggaagcttatgtcaaagtagacagctgtccagaggaaccccaactacgaatgaaaaataatgaagaagcggaagactrtgatgatgatcttactgattctgaaatggatgtggtcaggtttgatgatgacaactctccttcctttatccaaattcgctcagttgccaagaagcatcct

SEQ ID NO: 25269 - DNA, 201 bp, Homo sapiens
ttggatttgagcctacctagaatttttcttcccaacctctcatctttttttctcttatacagaagttataaaagtcaatatttgaacaatggccctcagcsgattggtaggaagtacaaaaaagtccgatttatggcatacacagatgaaacctttaagactcgtgaagctattcagcatgaatcaggaatcttgggacct

SEQ ID NO: 25270 - DNA, 201 bp, Homo sapiens
acagattactgcttcatcctactttaccaatatgtttgccacctggtctccttcaaaagctcgacttcacctccaagggaggagtaatgcctggagacctyaggtaagaggcaacagatttactgtttaactgactcagagcagtggttggggaaaaaatcggggaaggccttgactgtttcttctgaggtatttctgtca

SEQ ID NO: 25271 - DNA, 201 bp, Homo sapiens
ggatttgagcctacctagaatttttcttcccaacctctcatctttttttctcttatacagaagttataaaagtcaatatttgaacaatggccctcagcggwttggtaggaagtacaaaaaagtccgatttatggcatacacagatgaaacctttaagactcgtgaagctattcagcatgaatcaggaatcttgggaccttt

SEQ ID NO: 25272 - DNA, 201 bp, Homo sapiens
cattctgtcacccaggctggagtgctgtggtgtgatcacagctcactactgcagcctcaacttcctgggctgaagtgatcctcccacctcagcctcccaartagctggtactataggcatgcaccaccacgcctagctaatttttttattttttgtagagatgaggtctcactgtgttacccaggctggtcttgaagtcct

SEQ ID NO: 25273 - DNA, 201 bp, Homo sapiens
ctagaatatcagtggaagctgctcagtataactgaggctgaagcatgtccttgtgataaccttcttttttcttttctttgaggttgcagcatgccattggkaatggagagtaaagcaatatcagatgcacagattactgcttcatcctactttaccaatatgtttgccacctggtctccttcaaaagctcgacttcacctc

SEQ ID NO: 25274 - DNA, 201 bp, Homo sapiens
tctgggataaaacacaatatttttaaccctccaattattgctcgatacatccgtttgcacccaactcattatagcattcgcagcactcttcgcatggagtbgatgggctgtgatttaaatagtaagtgccaagtcatcccatatccttcttccctcaaccatgggtagggtgactaactgttctagttatcctgagactgg

SEQ ID NO: 25275 - DNA, 201 bp, Homo sapiens
ttcctctttcaggtttttcagggaaatcaagactccttcacacctgtggtgaactctctagacccaccgttactgactcgctaccttcgaattcacccccmgagttgggtgcaccagattgccctgaggatggaggttctgggctgcgaggcacaggacctctactgagggtggccactgcagcacctgccactgccgtca

SEQ ID NO: 25276 - DNA, 201 bp, Homo sapiens
cgcctgtaatcccagcactttgggaggccgaggcgggcagatcacttgaggtcaggagttcaagaccagcttggccaacatggtgaaaacccatctctacwaaaaatacaaaaaaaatagccgggcattgtggcgtgtgcctgtaatcccagctactcaggaggctgaggcaggagaattgcttgaaactgggaggtgaag

SEQ ID NO: 25277 - DNA, 201 bp, Homo sapiens
tatttatctattctgcattaagactgcatttttaattataatagctttataatatctcaatgttgtataggaaaaaaacttcaattattaattagttataytaagccaatgtctaagtattgcttagtggtttgtgggcaaccatcttacacagtacctagtaacagagtagacaagtgtttattgaatggatggatgaat

SEQ ID NO: 25278 - DNA, 201 bp, Homo sapiens
gcagcacgcgggacacctcgcagcggaccagcacgtccgagaaggcgcccagggcggcgggagagggcgccgccgagccggagttcggaggaagcagcgcrgccggtagggcgggcgtcgccccgggcccgggctggggtgccggcggcgggggcggcggcagtgactgcaccgggtggctgccgtgctcccgcgccaggc

SEQ ID NO: 25279 - DNA, 201 bp, Homo sapiens
gcatgaacccgggaggcagagcttgcagtgagccgagatcgcaccactgcattccaacctgggcaacagagtgagactccatctcaaaaaaaaaaaaaaargaaaatacgctaagtgaataggccagacataaaaggatagatattatatgattctacttatatgagtgtgttagtcagggatatccaaagaaatagaacc

SEQ ID NO: 25280 - DNA, 201 bp, Homo sapiens
aatgcaagtggtctaggttgctaaaggcatcccacagcctctccatctgaacatgacccaaaggaaactcgtgaccctaattccatgtctgcgcatttctrgactgttgtccccccccccccccgccccgactactcagtcctccgtcttccggtccagggccccttgccaagcaccgggtccacctctccgtccccaccc

SEQ ID NO: 25281 - DNA, 201 bp, Homo sapiens
gggttttggtatcaacacagatgtttatacatagagagaaaatgatgtctgtgtgcttagctgtcaaataaggagactgggggagggttaaatgtaatcartgatatcataaggagtggtggaattctgtttggaacttcagagacctaaggagaagactgaccagcttcttctgaagacttctgccctctaaagactaag

SEQ ID NO: 25282 - DNA, 201 bp, Homo sapiens
atgcaagtggtctaggttgctaaaggcatcccacagcctctccatctgaacatgacccaaaggaaactcgtgaccctaattccatgtctgcgcatttctgsactgttgtccccccccccccccgccccgactactcagtcctccgtcttccggtccagggccccttgccaagcaccgggtccacctctccgtccccacccc

SEQ ID NO: 25283 - DNA, 201 bp, Homo sapiens
attctctggattcctgcttgtgtaaattagaaaactcaagtcatgattttggagtgtagtgcaccttgtcatgggtcaccttcatacctcacctcgcctgmtgggacttgagtgtagttatagatctaataacaaagaggggtggtagggtgggtcctgaagggaatcagcattatcttgcatggcagttgcctcagggga

SEQ ID NO: 25284 - DNA, 201 bp, Homo sapiens
ataggaagagaggcctgaaacgacatacacgctcttgccctctcgccgtgtgataccctctgccgtccccagatgccgggtcacttcccagtccccagaayggtaagaaataaatttcttttctttataaattgttcagtgtcgggtattcaattatggcaacagaaaacagactaagacatcttttcatgtgcttcttgg

SEQ ID NO: 25285 - DNA, 201 bp, Homo sapiens; identical to SEQ ID NO: 3660

SEQ ID NO: 25286 - DNA, 201 bp, Homo sapiens
attgtttcgatgctactgtaaaatgaatcatttccttaatcttattttcatgttattcattgctagggtgtagaaatacaaccgactgttgcagattgatyttggatactgcaactttgctgagccgaatatgctttgctgagcatactcagacagggttggcatattagtccgttcctacactgctataaagaactgcct

SEQ ID NO: 25287 - DNA, 201 bp, Homo sapiens
ttcctagactgccatccgggcgcccctcaccctcttgctgctcagctccaggtcgtcgtgggttcagggctcagctgcacgctcctgcccgcgccctgggygtgatggcacccccagcccctgccattcttccccctcaccccctctccctgccactgctctgcattgccctgggttagcctggcggggccaggtggcacc

SEQ ID NO: 25288 - DNA, 201 bp, Homo sapiens
ccttcagtatcacatgatgggcagacagactggttataaaaattttcccgctgggtgcggtggctcacgcctgtaatcccagcactttgggaggccgaggygggcagatcacttgaggtcaggagttcaagaccagcttggccaacatggtgaaaacccatctctactaaaaatacaaaaaaaatagccgggcattgtggc

SEQ ID NO: 25289 - DNA, 201 bp, Homo sapiens; identical to SEQ ID NO: 3661

SEQ ID NO: 25290 - DNA, 201 bp, Homo sapiens
atgcatctatgaatagagatggttttacttgttcccttccaatctggatgccttttatttctttttcttgactaattgccctgactagaactttgagtacratgttgagttacaagtggcattcctgatcttagggggaaatcaaccagtctttcaccattaagtatgatattatctctgggtttttcatggatgccctct

SEQ ID NO: 25291 - DNA, 201 bp, Homo sapiens
atcttaaaggaaaggcttttggttttccacatttggtatgatattagccgtagtttgtcatatatggcatttattgttttgaggtaagctttctatacccrgtttgttgagagttttctcatgaagggatgttgaatttaatctttttggcatcaattgaaatgatcatttgtttttgtccttcattctgttgatatgatg

SEQ ID NO: 25292 - DNA, 201 bp, Homo sapiens
ttttctcttatacagaagttataaaagtcaatatttgaacaatggccctcagcggattggtaggaagtacaaaaaagtccgatttatggcatacacagatkaaacctttaagactcgtgaagctattcagcatgaatcaggaatcttgggacctttactttatggggaagttggagacacactgttggtaagttgaagaaa

SEQ ID NO: 25293 - DNA, 201 bp, Homo sapiens; identical to SEQ ID NO: 3662

SEQ ID NO: 25294 - DNA, 201 bp, Homo sapiens
ttatacagaagttataaaagtcaatatttgaacaatggccctcagcggattggtaggaagtacaaaaaagtccgatttatggcatacacagatgaaacctktaagactcgtgaagctattcagcatgaatcaggaatcttgggacctttactttatggggaagttggagacacactgttggtaagttgaagaaaagattta

SEQ ID NO: 25295 - DNA, 201 bp, Homo sapiens
acccctttcaatatatgtaattaacagataatgtcagacaagaggaatgtcatcctgttttctgtatttgatgagaaccgaagctggtacctcacagagawtatacaacgctttctccccaatccagctggagtgcagcttgaggatccagagttccaagcctccaacatcatgcacagtgagtaaagcagcacttaagtc

SEQ ID NO: 25296 - DNA, 201 bp, Homo sapiens
caaaatactaaatctgtgatgtgtctaaatctcttttccccattgtttttgcaggcatcaatggctatgtttttgatagtttgcagttgtcagtttgtttscatgaggtggcatactggtacattctaagcattggagcacagactgacttcctttctgtcttcttctctggatataccttcaaacacaaaatggtctatg

SEQ ID NO: 25297 - DNA, 201 bp, Homo sapiens
tttgtttgcatgaggtggcatactggtacattctaagcattggagcacagactgacttcctttctgtcttcttctctggatataccttcaaacacaaaatsgtctatgaagacacactcaccctattcccattctcaggagaaactgtcttcatgtcgatggaaaacccaggttagttattatatttttcttgtaccaaca

SEQ ID NO: 25298 - DNA, 201 bp, Homo sapiens
aggctggatcaaggaaactgccaggcaatcttagatgatcttggtgatcttgatgtgccagaagattaatgggatcatgtgaaaagaacacagaaactggyctgaagggcttcctgttggccagatttgagacaatttgagcatcaaaaggaataatgagggtaatggatcataactggaaaatcagtttgcaaccatcaa

SEQ ID NO: 25299 - DNA, 201 bp, Homo sapiens
gaaataatattaaccttgcaaaaattctttcagaaaatggaaaaagatggaatgttattcaattatcttatgataatagcataaccttgacaaccaaaccsaacaagaacaatattagaaaggaagataataggcccgttttattcataaacataaatcccaaacaaaatattagcaatatggatccaaattggatttatg

SEQ ID NO: 25300 - DNA, 201 bp, Homo sapiens
ctttccatgtatttgtgctaatctctccatacaggtcttctttggcaatgtggattcatctgggataaaacacaatatttttaaccctccaattattgctygatacatccgtttgcacccaactcattatagcattcgcagcactcttcgcatggagttgatgggctgtgatttaaatagtaagtgccaagtcatcccata

SEQ ID NO: 25301 - DNA, 201 bp, Homo sapiens
ttagtacccattcctatacatattctctggattcctgcttgtgtaaattagaaaactcaagtcatgattttggagtgtagtgcaccttgtcatgggtcacyttcatacctcacctcgcctgctgggacttgagtgtagttatagatctaataacaaagaggggtggtagggtgggtcctgaagggaatcagcattatcttg

SEQ ID NO: 25302 - DNA, 201 bp, Homo sapiens
ctctgctcttagggctggtggccttctcctttctcttcctgggatactccctctcctcagcctcctgcaggactcccagatatactctaggcaacaacacyttagtaaagactttcttgttatcaagtcatgcttctctttcaaaaagtacccaatatactcaagatatccgaaacaacaattattgttcctatttgactt

SEQ ID NO: 25303 - DNA, 201 bp, Homo sapiens
tttccatttcagattctctacttcatagccataggtgtcttattcctactttacaggtctgattggatgccacaggaaatcagtctattggcatgtgattrgaatgggcaccactcctgaagtgcactcaatattcctcgaaggtcacacatttcttgtgaggaaccatcgccaggcgtccttggaaatctcgccaataac

SEQ ID NO: 25304 - DNA, 201 bp, Homo sapiens
tcatagccataggtgtcttattcctactttacaggtctgattggatgccacaggaaatcagtctattggcatgtgattggaatgggcaccactcctgaagkgcactcaatattcctcgaaggtcacacatttcttgtgaggaaccatcgccaggcgtccttggaaatctcgccaataactttccttactgctcaaacactc

SEQ ID NO: 25305 - DNA, 201 bp, Homo sapiens
ttattcctactttacaggtctgattggatgccacaggaaatcagtctattggcatgtgattggaatgggcaccactcctgaagtgcactcaatattcctcdaaggtcacacatttcttgtgaggaaccatcgccaggcgtccttggaaatctcgccaataactttccttactgctcaaacactcttgatggaccttggaca

SEQ ID NO: 25306 - DNA, 201 bp, Homo sapiens
tattcctactttacaggtctgattggatgccacaggaaatcagtctattggcatgtgattggaatgggcaccactcctgaagtgcactcaatattcctcgraggtcacacatttcttgtgaggaaccatcgccaggcgtccttggaaatctcgccaataactttccttactgctcaaacactcttgatggaccttggacag

SEQ ID NO: 25307 - DNA, 201 bp, Homo sapiens
cttgtgataaccttcttttttcttttctttgaggttgcagcatgccattgggaatggagagtaaagcaatatcagatgcacagattactgcttcatcctaytttaccaatatgtttgccacctggtctccttcaaaagctcgacttcacctccaagggaggagtaatgcctggagacctcaggtaagaggcaacagattta

SEQ ID NO: 25308 - DNA, 201 bp, Homo sapiens
gaacaactgcttcacatctaagtgtatgtctttaaaaatctctccttttccatgtttatgtctgatgtgttttgttatggcaaagtggcatgtagtatacrgttcataagtgaatcgatgtatatctgtggagggcaaatgctcaattttagatctacacatgaaagcttttttccagggcaggagccttgctttctccaa

SEQ ID NO: 25309 - DNA, 201 bp, Homo sapiens
cttctattgtcttctttccgggccttcatctcctgcttgtgattaagtagtgcatgctgagtggagcaaagtggtggaataggactcttcagcaataatcycctcacagaaacatcaaggtaacaactcgatgcgtgaaattaccttcagaagagttaagaaaacctgaacccatgagcaagactgtgaagcccttttgga

SEQ ID NO: 25310 - DNA, 201 bp, Homo sapiens
ctcttagtcagtttgtgctgcaataacagtataccacagaatgggtaatttataatggacagaaatttattggctcacatttctgggggctgggaggtccmatatcaagttgcctttttctgcgtcttaacatggtggaaggcattatatgaccaaagggcaaagaaagggtgagagagagcaagaggagggtgagctcac

SEQ ID NO: 25311 - DNA, 201 bp, Homo sapiens
aatggacagaaatttattggctcacatttctgggggctgggaggtcccatatcaagttgcctttttctgcgtcttaacatggtggaaggcattatatgacmaaagggcaaagaaagggtgagagagagcaagaggagggtgagctcactcctgtgataacaaatccactcccatgaacactttccccagataactgcatta

SEQ ID NO: 25312 - DNA, 201 bp, Homo sapiens
ttagtccattcatgagggtggaacgcttatgacctaaacaccttttatatgttcacctctcaataccatcacgatgataattaaatttcaatatgagtttyggaggggacagacattcaaaccatagcaagagttattggagaaaaatgtcggagaggcctaatcttttatatttaatagcatttctttcttcctattact

SEQ ID NO: 25313 - DNA, 201 bp, Homo sapiens
cataagtatatgactgcccttttccccacaccattgccaacaacatatattataaaccttcagaaaattttccaatttgatgagcaaaatgtttatatgtkgtcttcatttgcatttccctggttagtggtcaaattgtatattgtttcatgtttgttggctatttgtataactccctctgtgaattgcctgcttgtaaat

SEQ ID NO: 25314 - DNA, 201 bp, Homo sapiens
gcttgtaaattttgtccagttttctatttggtcagtcatcttttgcttatgtatttgtaaaaggtctttatagattatggatattgacacattgttatttrtctttcaaatgttttcctcacattgtcacttgtactttaactcctttatgatattttttgtccttcaaagatttttcatctttatatagtcaaaacctcc

SEQ ID NO: 25315 - DNA, 201 bp, Homo sapiens
atacaatgaaataccatgtgacaatgaagattcacaaaaataaagctatacacaacaatatgaataagtatcacaaagacaatttttagtaaaatggtaartgtcaaaagaatatatacagtattatattatttacataaagttcaaaaatgggcaaaattaacttatatagtttagggatacagaggaagaaaagtataa

SEQ ID NO: 25316 - DNA, 201 bp, Homo sapiens
ctagtatttcagaatgtgactgtatttggagatagggtctttaaggggtttattaagttaaaatgaggttgttacaatgggccctaatccaatatgactastgtccttataagaagaggaaatgtgggccaggcacagtggctcacgcctgtaatcccagcattttgggaggccaaggcgggcggatcacgaggtcaagag

SEQ ID NO: 25317 - DNA, 201 bp, Homo sapiens
gtgactgtatttggagatagggtctttaaggggtttattaagttaaaatgaggttgttacaatgggccctaatccaatatgactagtgtccttataagaasaggaaatgtgggccaggcacagtggctcacgcctgtaatcccagcattttgggaggccaaggcgggcggatcacgaggtcaagagatcgagaccatcctg

SEQ ID NO: 25318 - DNA, 201 bp, Homo sapiens
tttacaggtctgattggatgccacaggaaatcagtctattggcatgtgattggaatgggcaccactcctgaagtgcactcaatattcctcgaaggtcacayatttcttgtgaggaaccatcgccaggcgtccttggaaatctcgccaataactttccttactgctcaaacactcttgatggaccttggacagtttctactg

SEQ ID NO: 25319 - DNA, 201 bp, Homo sapiens; identical to SEQ ID NO: 3694

SEQ ID NO: 25320 - DNA, 201 bp, Homo sapiens; identical to SEQ ID NO: 3695

SEQ ID NO: 25321 - DNA, 201 bp, Homo sapiens; identical to SEQ ID NO: 3696

SEQ ID NO: 25322 - DNA, 201 bp, Homo sapiens; identical to SEQ ID NO: 3697

SEQ ID NO: 25323 - DNA, 201 bp, Homo sapiens; identical to SEQ ID NO: 3698

SEQ ID NO: 25324 - DNA, 201 bp, Homo sapiens; identical to SEQ ID NO: 3699

SEQ ID NO: 25325 - DNA, 201 bp, Homo sapiens
catgtgattggaatgggcaccactcctgaagtgcactcaatattcctcgaaggtcacacatttcttgtgaggaaccatcgccaggcgtccttggaaatctygccaataactttccttactgctcaaacactcttgatggaccttggacagtttctactgttttgtcatatctcttcccaccaacatggtaatatcttggat

SEQ ID NO: 25326 - DNA, 201 bp, Homo sapiens
atgggcaccactcctgaagtgcactcaatattcctcgaaggtcacacatttcttgtgaggaaccatcgccaggcgtccttggaaatctcgccaataacttyccttactgctcaaacactcttgatggaccttggacagtttctactgttttgtcatatctcttcccaccaacatggtaatatcttggatctttaaaatgaa

SEQ ID NO: 25327 - DNA, 201 bp, Homo sapiens
caccactcctgaagtgcactcaatattcctcgaaggtcacacatttcttgtgaggaaccatcgccaggcgtccttggaaatctcgccaataactttccttrctgctcaaacactcttgatggaccttggacagtttctactgttttgtcatatctcttcccaccaacatggtaatatcttggatctttaaaatgaatatta

SEQ ID NO: 25328 - DNA, 201 bp, Homo sapiens
agagagatctgtccacatacctcttccccaaatttctttgtcacctgttttctaatcatgttccttccaagtccctatctggacaaagcactgactacagmccattacttgacatataattgcacacctggccatttctccttctaagcaaagtccacaaccaggtacactgcctaaaattctgcccactgtccttcatgg

SEQ ID NO: 25329 - DNA, 201 bp, Homo sapiens
ttaattgatgaactcatagatgacatacaatttatctttttattcttgtgtcacttgtgcttttgatgtcacatctaggaaggctttgtctagcccaaggscacatttacttccatattttcttctaagagtttgatagttgtagctgttacatatatgtctatgatctagtttgaataaatttttgtgtatggtgtgaag

SEQ ID NO: 25330 - DNA, 201 bp, Homo sapiens
acatgaaaacatctgaaggtataaaacccacaggtaaaagtaagtatcccgacaaattcagaattctctaacatggtaattgtagaacataaatcacttayatccttagtaggaagattaaaaaacaaaacagataaaaataattaccataacctgttaaagaataagcaatataaaaagatgtaaatgatgacatcaaaa

SEQ ID NO: 25331 - DNA, 201 bp, Homo sapiens
ttgattttgtatcctgaggctttgctgaagttgcttatcagcttaaggagattttgggctgagacaatggggttttctagatatacaatcctgacatctgyaaacagggacaatttgacttcctcttttcctaattgaatacactttatttccttctcctgcctaattgccctggccagaacttccaacactatgttgaat

SEQ ID NO: 25332 - DNA, 201 bp, Homo sapiens
ttttgtaaatggtgtttattctattctcatttgccacaaaatgtttatcataaataagttttcagcagctggtatcatctgaattgtcttctttgatatgytgatgaacaaattatgttcatagatgtcctgacactaaatacccttacattcttggagtaaaatctactattcatggaatttgatcattagtgggttcta

SEQ ID NO: 25333 - DNA, 201 bp, Homo sapiens
gacttcctcttttcctaattgaatacactttatttccttctcctgcctaattgccctggccagaacttccaacactatgttgaataggaaaggtgagagarggcatccctgtcttgtgccagttttcaaagggaatgcttccagtttttgcccattcagtatgatattggctgtgggtttgccatagatagctcttattat

SEQ ID NO: 25334 - DNA, 201 bp, Homo sapiens
aggcctcattggagccctactagtatgtagagaaggtaagtgtatgaaagcgtaggattgagatgaaataagcagagaagtacaaacaactgaatctatcyataacagttagcatttgtgttccttcacctgaaagaggcttttttactctagcatcatgctcatggaaaggagaataatccagtttctgagagaagcaga

SEQ ID NO: 25335 - DNA, 201 bp, Homo sapiens
actgatcctaccctaaacatgtagctgtataatcagagacaggaagccatggcaaatctggagggtctcggcttggctatatcttaaagagttacatgtawtcgtagttcaacattggggaaattttccaaaaattggtggagaaacgagtggccaatgcaattttatctttttttttctgctgacatcagggagagataa

SEQ ID NO: 25336 - DNA, 201 bp, Homo sapiens
accactcctgaagtgcactcaatattcctcgaaggtcacacatttcttgtgaggaaccatcgccaggcgtccttggaaatctcgccaataactttccttaytgctcaaacactcttgatggaccttggacagtttctactgttttgtcatatctcttcccaccaacatggtaatatcttggatctttaaaatgaatattat

SEQ ID NO: 25337 - DNA, 201 bp, Homo sapiens
actcctgaagtgcactcaatattcctcgaaggtcacacatttcttgtgaggaaccatcgccaggcgtccttggaaatctcgccaataactttccttactgytcaaacactcttgatggaccttggacagtttctactgttttgtcatatctcttcccaccaacatggtaatatcttggatctttaaaatgaatattataaa

SEQ ID NO: 25338 - DNA, 201 bp, Homo sapiens
aatctcttttctttataaattacctagtctctggtatagaacagcctaatatagcaagacactctgacattgtttggtttgtctgactccagatggcatgraagcttatgtcaaagtagacagctgtccagaggaaccccaactacgaatgaaaaataatgaagaagcggaagactatgatgatgatcttactgattctga

SEQ ID NO: 25339 - DNA, 201 bp, Homo sapiens
aaaattagctggacatggtggcgagctcctgtagtcccagctactcgggagactgaggcagaagattgcttgaacccaggaggtggaggttgcagtgagcrgagatcacgccactgcactccagactggcagacagaccgagactccatttgaaaaaaaaaaagaagaggaaatgtgtacacacagagacaccagggatgc

SEQ ID NO: 25340 - DNA, 201 bp, Homo sapiens; identical to SEQ ID NO: 3728

SEQ ID NO: 25341 - DNA, 201 bp, Homo sapiens
atcctcactattctttttgtacctttcttagctattcttagacactttattcttccacataaaactgttaagatatttttcaaattaaaaagatccaagcyctgttgtgattctaactgcaatttcattaaactcagaccttaattttattaatgtaataaatttaaatatttttcttattacatttatctctgtgtattt

SEQ ID NO: 25342 - DNA, 201 bp, Homo sapiens
aataatgaagaagcggaagactatgatgatgatcttactgattctgaaatggatgtggtcaggtttgatgatgacaactctccttcctttatccaaattcvctcagttgccaagaagcatcctaaaacttgggtacattacattgctgctgaagaggaggactgggactatgctcccttagtcctcgcccccgatgacagg

SEQ ID NO: 25343 - DNA, 201 bp, Homo sapiens
acttgggagagaaagtttgtgttgagaagatttgcttgtgttgcaatgagaaggggaagttctactcaacagaagctgtacaggcacatatgacaaaagcyggtgtaagctttttacagatggtgatgctgctttggaatttgcagacttgtatgagtttaggagtagctacccagatcacaaggaaggggaggaccctaa

SEQ ID NO: 25344 - DNA, 201 bp, Homo sapiens
tgtctcctcctagtgacaatttcctacaatgagattttttaaatagaagataaatgttctcacttctttttcagggagtctggccaaggaaaagacacagmccttgcacaaatttatactactttttgctgtatttgatgaaggttagtgagtcttaatctgaattttggattcctgaaagaaatcctctgctactattaa

SEQ ID NO: 25345 - DNA, 201 bp, Homo sapiens
ttttgtgtgtggggtggggaagattggggtattgctatgttgctcaggctgggtctcgaactcctgacctaaagcaatcctccagcctcagcctcctaaastgctaggttacaagtatgagccaccacactcagccccactcaatttctaaacgagctcactgaaatagagcagtcacaaacaaacccagactgtgaacat

SEQ ID NO: 25346 - DNA, 201 bp, Homo sapiens
caaataagcataataatacatgcaaaattacaaactgagcattactctgaaggaaaattacataattctatgtaagcctataatacaggaatctgacctaractggggaatcagagaaggcttccctaagcaagtaccccttgaacttagctttgaaactgggaaaatgaggcaatgtgagatgaagctgttagaggtatt

SEQ ID NO: 25347 - DNA, 201 bp, Homo sapiens
tggtttgcatttctctggtaattagtgatgttgagcagtttttcatatacttgttggccatttgtatgtcttctttttttttttttttttttttttttcaracggagtctcgctctgtagcccaggctggagtgcggtggcacgatctcggctcactgcaagctccgccacccgggttcacgccattctcctgcctcagcc

SEQ ID NO: 25348 - DNA, 201 bp, Homo sapiens
ttctttggcaatgtggattcatctgggataaaacacaatatttttaaccctccaattattgctcgatacatccgtttgcacccaactcattatagcattckcagcactcttcgcatggagttgatgggctgtgatttaaatagtaagtgccaagtcatcccatatccttcttccctcaaccatgggtagggtgactaactg

SEQ ID NO: 25349 - DNA, 201 bp, Homo sapiens
aaagtcattggtagcttgatggggatggcattgaatctataaattacattgggcagtatggccattttcatgatattgattcttcctacccatgagcatgsaatagtcttccatttgtttgtatcctcttttatttccttgagcagtggtttgtagttctccttgaagaggtccttcacatccgttgtaagttgtattcct

SEQ ID NO: 25350 - DNA, 201 bp, Homo sapiens
taatgaagaagcggaagactatgatgatgatcttactgattctgaaatggatgtggtcaggtttgatgatgacaactctccttcctttatccaaattcgcycagttgccaagaagcatcctaaaacttgggtacattacattgctgctgaagaggaggactgggactatgctcccttagtcctcgcccccgatgacaggta

SEQ ID NO: 25351 - DNA, 201 bp, Homo sapiens
aatgaagaagcggaagactatgatgatgatcttactgattctgaaatggatgtggtcaggtttgatgatgacaactctccttcctttatccaaattcgcthagttgccaagaagcatcctaaaacttgggtacattacattgctgctgaagaggaggactgggactatgctcccttagtcctcgcccccgatgacaggtaa

SEQ ID NO: 25352 - DNA, 201 bp, Homo sapiens
ttctgaaatggatgtggtcaggtttgatgatgacaactctccttcctttatccaaattcgctcagttgccaagaagcatcctaaaacttgggtacattacwttgctgctgaagaggaggactgggactatgctcccttagtcctcgcccccgatgacaggtaagcactttttgactattggtactctctcttccccatact

SEQ ID NO: 25353 - DNA, 201 bp, Homo sapiens
cttgattgaatcatataagctgttttagagttggatttgagcctacctagaatttttcttcccaacctctcatctttttttctcttatacagaagttatawaagtcaatatttgaacaatggccctcagcggattggtaggaagtacaaaaaagtccgatttatggcatacacagatgaaacctttaagactcgtgaagct

SEQ ID NO: 25354 - DNA, 201 bp, Homo sapiens
ataatgggagactttaacaccccactgtcaacattagacagttcaacgagacagaaagttaacaaggatatccaggaattgaactcagctctgcagcaagyggacctaatagacatctacagaactctccatcccaaatcaacagaatatacattcttctcagcaccacatccaaaactgaccacatagttggaagtaaag

SEQ ID NO: 25355 - DNA, 201 bp, Homo sapiens
atttttcttcccaacctctcatctttttttctcttatacagaagttataaaagtcaatatttgaacaatggccctcagcggattggtaggaagtacaaaaragtccgatttatggcatacacagatgaaacctttaagactcgtgaagctattcagcatgaatcaggaatcttgggacctttactttatggggaagttgga

SEQ ID NO: 25356 - DNA, 201 bp, Homo sapiens
ggaatgcaaattattaaaatatgtaaactgtcacatcaaaaacataaaataggctgggcacagtggctcatggctgtaatcccaacactttgtgggggccraggtgggaggatcacttgagcccaggcatttgagactaacttgggcaggatagtgagatctcatctctataaaaaatttaaaaattagtaaagcatggtg

SEQ ID NO: 25357 - DNA, 201 bp, Homo sapiens
tcttcccaacctctcatctttttttctcttatacagaagttataaaagtcaatatttgaacaatggccctcagcggattggtaggaagtacaaaaaagtcygatttatggcatacacagatgaaacctttaagactcgtgaagctattcagcatgaatcaggaatcttgggacctttactttatggggaagttggagacac

SEQ ID NO: 25358 - DNA, 201 bp, Homo sapiens
ttgttcattttgctccagattatttagctgtttggagtcttttgtggttccacacaaattttaagattcttttttctatttctgtgaaaaacttcactggyatttggataggtattacattaaatctggtagcattgatattttaacaatattagtttttccagcccattaaaatgggatagataccttttcagttttttg

SEQ ID NO: 25359 - DNA, 201 bp, Homo sapiens
atcctccctaactcattttatgaggccagcatcatcctgataccaaagcctggcagagaaacaacaaaaaaagagaattttagaccaatatccctgatgarcattgatgcaaaaatcctcaataaaatactggcaaaccaaatccagcagcacatcaaaaagcttatccaccatgatcaagtgggcttcatctctgggatg

SEQ ID NO: 25360 - DNA, 201 bp, Homo sapiens
ctcatctttttttctcttatacagaagttataaaagtcaatatttgaacaatggccctcagcggattggtaggaagtacaaaaaagtccgatttatggcawacacagatgaaacctttaagactcgtgaagctattcagcatgaatcaggaatcttgggacctttactttatggggaagttggagacacactgttggtaag

SEQ ID NO: 25361 - DNA, 201 bp, Homo sapiens
ccaaaagcaatggcaacaaaagccaaaattgacaaatgggatctaatgaaactaaagagcttccgcacagcaaaagaaactaccatcccagtgaacaggcragctacaaattgggagaaaatgtttgcaatctattcatctgacaaagggctaatatccagaatctacgaagaactcaaacaaacttacaagaaaaaaaga

SEQ ID NO: 25362 - DNA, 201 bp, Homo sapiens
agttagaatggcgatcattaaaaagtcaggaaacaacaggtgctggagaggatgtggagaaataggaacgcttttacactgttggtgggactgtaaactarttcaacaattgtggaagacagtgtggcgattcctcaaggatctagaactagaaataccatttgacccagccatcccattactgggtatgtacccaaagga

SEQ ID NO: 25363 - DNA, 201 bp, Homo sapiens
ggaagacagtgtggcgattcctcaaggatctagaactagaaataccatttgacccagccatcccattactgggtatgtacccaaaggattataaatcatgstgctataaagacacatgcacacgtatgtttattgcggcactattcacaatagcaaagacttggaaccaacccaaatgtccatcaatgatagactggatta

SEQ ID NO: 25364 - DNA, 201 bp, Homo sapiens
tatatttgccatgctatatacattatgctatatattctatgtgctgaagatacaacaatgaccaaggtctttgcccttgtggaactgacatttggtggcgragacagaggaaacagtcaataagcatgtaaagagataaaggaaaagatactgaatgctacaaaggaaacaaataagttgagatttagaacaaaaaagagt

SEQ ID NO: 25365 - DNA, 201 bp, Homo sapiens
ggtggatcacgaggtcaggagatcaagaccatcctggctaacacagtgaaaccccatctctactaaaaatacaaaaaatgagccgggcatggtggcgggcrcctgtagtcccagctacttgggaggctgaggcaggagaatggcgtgaacccgggaggcggagcttacagtgagccgagatggtgccactgcactccagcc

SEQ ID NO: 25366 - DNA, 201 bp, Homo sapiens
ttgggcaggggctatattaggcagaacttggagaccagagtaagggggccaaggtgggaacagaccgattaaattggcatctcttgggggggtgggggggkggggaagctaacccatgcatcattttttaaaagctccaaaggcgattccaataagcagccagggttgggaacctagggggaaaatgtagctagatgaatg

SEQ ID NO: 25367 - DNA, 201 bp, Homo sapiens
agaaaatgtcatattttgtatataattttattttttgtttagtcctggatccatctagaatttctattttgcatagcatggcaaagggctcacacccaacrtcatattaaataaggtctttttccctgatatgaaatgccacatatatatgttattataatgcatagttagataccatgtggtgaataaaatatcttagaa

SEQ ID NO: 25368 - DNA, 201 bp, Homo sapiens
aggctactagtccaactctattgccctcaggtgaataatccaaaagagtggctgcaagtggacttccagaagacaatgaaagtcacaggagtaactactcrgggagtaaaatctctgcttaccagcatgtatgtgaaggagttcctcatctccagcagtcaagatggccatcagtggactctcttttttcagaatggcaaa

SEQ ID NO: 25369 - DNA, 201 bp, Homo sapiens
tagacaggcatactcctgaaaaaccaaactaagccagacacaaagactggaataaataacttagcattcatacaaagacatagatatatgtgcataaaaarcaagagcaaatagggagctatgacctctccaaatggaaacagcatggagccagtgaccaaccctaatgagatggcaaattgtagctctcaaatcaataat

SEQ ID NO: 25370 - DNA, 201 bp, Homo sapiens
ttgtttgcatgaggtggcatactggtacattctaagcattggagcacagactgacttcctttctgtcttcttctctggatataccttcaaacacaaaatgktctatgaagacacactcaccctattcccattctcaggagaaactgtcttcatgtcgatggaaaacccaggttagttattatatttttcttgtaccaacag

SEQ ID NO: 25371 - DNA, 201 bp, Homo sapiens
ctcttatacagaagttataaaagtcaatatttgaacaatggccctcagcggattggtaggaagtacaaaaaagtccgatttatggcatacacagatgaaayctttaagactcgtgaagctattcagcatgaatcaggaatcttgggacctttactttatggggaagttggagacacactgttggtaagttgaagaaaagat

SEQ ID NO: 25372 - DNA, 201 bp, Homo sapiens
tggaattaaaccaatggattagatatatcacatgcatgccatcgctttcatcatagactgctagctcctacctgacaacatcagtagcatttctttacccstttcaatatatgtaattaacagataatgtcagacaagaggaatgtcatcctgttttctgtatttgatgagaaccgaagctggtacctcacagagaatata

SEQ ID NO: 25373 - DNA, 201 bp, Homo sapiens
ttagaagacagccatgtcctctactctgattctatcaaaatgtgttctcggggtgctggtaacgttcagccaacgaaataattcctatggcggcagtaggrataacaaaacgcagaagcgggaacgatgtctttttattcctccccagacgcaaacgtggatgcatgaggtttggtaacaggcaaagtcatctggttaacg

SEQ ID NO: 25374 - DNA, 201 bp, Homo sapiens
ttcaatgggcataaagtttcagctatgctgctgggcacagtggctcatgcctgtaatcctggcactttgggaggccaaggcgggcggatcacctgaggtcrggagttcaagaccagcctagccaacatggcgaaatcccgtcgctaataaaaatataaaaattagttgggcatggtggcacatgcctgtagtcccagctac

SEQ ID NO: 25375 - DNA, 201 bp, Homo sapiens
aagggtgctcagtagcctgtcgttgtgaaccaccatgtccagcagcaggggagtgatgttccgctctccgctgttctgggcctcgttgcccgccagctccrggaccttggccgtcaggtactcaataaccgcagcgaggtagaccggcgccgtgcgactcaggcgctgagcgtagtggccctcccgtagactgcgctccac

SEQ ID NO: 25376 - DNA, 201 bp, Homo sapiens
tttctttgaggttgcagcatgccattgggaatggagagtaaagcaatatcagatgcacagattactgcttcatcctactttaccaatatgtttgccacctrgtctccttcaaaagctcgacttcacctccaagggaggagtaatgcctggagacctcaggtaagaggcaacagatttactgtttaactgactcagagcagt

SEQ ID NO: 25377 - DNA, 201 bp, Homo sapiens
gcacgagaactatgtgacgaatgcataagctttagtagccgatgcgatcaactggaagaaagggtatcagtgattgaagatcaaatgaatgaaatgaagcsagaagagaagtttagagaaaaaagaataaaaagaaatgaacaaagcctccaagaaatatgggactatgtgaaaagaccaaatctatgtctgattagtgta

SEQ ID NO: 25378 - DNA, 201 bp, Homo sapiens
taggatcagcttgtcagtttttacaaagaaggcaggttggattctgacaggcatcacgatgaatctgtatattgccttggagattatgggcatcttaacartattaagtgtcccaatccgttaacacaaaatgcctttcgatttatttaggtcttctttaatttattttagcaacgtcttgaaattttcagagtatacatc

SEQ ID NO: 25379 - DNA, 201 bp, Homo sapiens
attctatttttaataggtaaagggctatttgaattttctatttcttataggataaattttaataatttcttttaagaaattccatttgagactgggcatgrtggctcacacctgtaaccccaacactttgggaggaggcagcaggattgctctaggccaggagtttgagatcagcctgggcaacataacaagacttgactt

SEQ ID NO: 25380 - DNA, 201 bp, Homo sapiens
aatgaacgactttttcctttcttcacgcagatttcctcctagagtgccaaaatcttttccattcaacacctcagtcgtgtacaaaaagactctgtttgtaraattcacggatcaccttttcaacatcgctaagccaaggccaccctggatgggtaatgaaaacaatgttgaatgctatttatgaaattgggtatcttattt

SEQ ID NO: 25381 - DNA, 201 bp, Homo sapiens
cgcctgtagtcccagctactcaggagactgaggcaggagaatggcttgaacccaggaggcagaccttgcagtgagccgagattgcgccactgcactccagyctgggcgacagagcgagactccgtcacaaaaaaaaaaaaaaatctaaaatgcactcttcaaaatctatgtcatttattctggaggaatgcagttggcaga

SEQ ID NO: 25382 - DNA, 201 bp, Homo sapiens
tgcaaggtttttatgtctgtccctgactgatgaccaaataccctatagcctgcacagctgcaagctgtatagccatacaatttgcaggacacacacacatacacacacacacacacacacacacacactaacatataatataatataatataatataatataatataatataatataatataattaatatatataaacctg

SEQ ID NO: 25383 - DNA, 201 bp, Homo sapiens
gagaaccactactggggaaaggacaaattcagggaaacagtgagctcaatggtgacgccagagctcacgtagcactgggggataccggggttctgatcagyccgaggagagacacctcattgaacatctcgggcattcagtagagaccccagaaaagtcatactttaggagtaggatttatgccttcttagaataaagact

SEQ ID NO: 25384 - DNA, 201 bp, Homo sapiens
tatatatacatatatatgttcatataagttagtattcatatatatgttcatatatatatgttcatacagactagtattcatatatatatacatatatatayacacacacacatatatatatatatatatgttctagggaaacatgcaaggtttttatgtctgtccctgactgatgaccaaataccctatagcctgcacagc

SEQ ID NO: 25385 - DNA, 201 bp, Homo sapiens
gcaaggtttttatgtctgtccctgactgatgaccaaataccctatagcctgcacagctgcaagctgtatagccatacaatttgcaggacacacacacatacacacacacacacacacacacacacactaacatataatataatataatataatataatataatataatataatataatataattaatatatataaacctgt

SEQ ID NO: 25386 - DNA, 201 bp, Homo sapiens
taatataatataatataatataatataattaatatatataaacctgtgtgaacacactgggttctaagctccagttttctgaagggatatgggttgccagkagaggaagagcaaaagcaagaatgtagatgagaattaggaagtaaacagatatggagattaaaatgggcaggtacatggacaaaaaaccaggtctgacaa

SEQ ID NO: 25387 - DNA, 201 bp, Homo sapiens
agaaagtaataaggaataagaatgaaatttatgaacaaacatgtggaaggttggaagcaagagtggggccaacacgcatggggaggaagcatttgggcagygactccgcagacccagactcaagctgagctatacaacctccttacgcctcagtttcctcaactgaagaacaggaatgacaagtgcctgtttcataggacc

SEQ ID NO: 25388 - DNA, 201 bp, Homo sapiens
accaaataccctatagcctgcacagctgcaagctgtatagccatacaatttgcaggacacacacacatacacacacacacacacacacacacacactaacwtataatataatataatataatataatataatataatataatataatataattaatatatataaacctgtgtgaacacactgggttctaagctccagtttt

SEQ ID NO: 25389 - DNA, 201 bp, Homo sapiens
attagtttatacattacagaagaaaaagtgaaccagaagataactcaatgaaagccatacaatctgtaagacacacacacacgcacacgcgcgcgcgcgcrcacacacacacacacagagagagagagagagagaaagagagagagagaaaggctgaaaaaaataaatagaaccttaaggatatcagtgaaaatagcaaaa

SEQ ID NO: 25390 - DNA, 201 bp, Homo sapiens
accgtcaccatatttccaggacatttttctcatccccaaaggaaacctcatgcccattaagcagtcactcctcattaaaatattagttatgaagactgtakcatttttttaaaaactcatgatataacattgattgaaaaaatcagtataggaaattgtgcattatgatgtaatagtaaaagaagcatataaaaatctgaa

SEQ ID NO: 25391 - DNA, 201 bp, Homo sapiens
tagtttatacattacagaagaaaaagtgaaccagaagataactcaatgaaagccatacaatctgtaagacacacacacacgcacacgcgcgcgcgcgcacrcacacacacacacagagagagagagagagagaaagagagagagagaaaggctgaaaaaaataaatagaaccttaaggatatcagtgaaaatagcaaaaga

SEQ ID NO: 25392 - DNA, 201 bp, Homo sapiens
ccctccatgggtttgattactttgctagagtggctcacagaactcagggaaacacgttacttttatttacccatttattataaaagatattaaaaaggatmctggtgaacagccaggtggaagagatgcacagggcaaggcacgtgggaaggggctcagagcctctatgccctctccagtgcaccagtccccagtacccta

SEQ ID NO: 25393 - DNA, 201 bp, Homo sapiens
ttttatttacccatttattataaaagatattaaaaaggatcctggtgaacagccaggtggaagagatgcacagggcaaggcacgtgggaaggggctcagakcctctatgccctctccagtgcaccagtccccagtaccctaagtgttcagcaacccagaagctctccaagtgcagtcttgttgggtttttatggaggcttc

SEQ ID NO: 25394 - DNA, 201 bp, Homo sapiens
ggtgttctgatggcttgaacaagtcacttaggaaatgtggggttttggaggcattctctgataggctgatacgttttgagtttagagttcccaccgcacawccccacacccctagagtctagggcatttagtgctccatgagggaacctgtagagtgaggacatctgcatcacaggctgggccttctagtgtccagaagca

SEQ ID NO: 25395 - DNA, 201 bp, Homo sapiens
tttgtgttgtggcaattgtatgatacctttaatgggaatatttcaaagacacttgttaagactttgttagaacaaaatgtagagggtgctggatgtccctsaatattcttccgcctcctgtaacttgtattgctttggaatttccagtggcctgacaatgaactactgcaggaatccagatgccgatacaggcccttggtg

SEQ ID NO: 25396 - DNA, 201 bp, Homo sapiens
ggcttgaacaagtcacttaggaaatgtggggttttggaggcattctctgataggctgatacgttttgagtttagagttcccaccgcacatccccacacccytagagtctagggcatttagtgctccatgagggaacctgtagagtgaggacatctgcatcacaggctgggccttctagtgtccagaagcagaaagtgtgtc

SEQ ID NO: 25397 - DNA, 201 bp, Homo sapiens
acaagtcacttaggaaatgtggggttttggaggcattctctgataggctgatacgttttgagtttagagttcccaccgcacatccccacacccctagagtstagggcatttagtgctccatgagggaacctgtagagtgaggacatctgcatcacaggctgggccttctagtgtccagaagcagaaagtgtgtctgcttca

SEQ ID NO: 25398 - DNA, 201 bp, Homo sapiens
ccatgttggataaatgcatattgtgcactgcccaaaacaaagaaactggaaagtgtaagactttggaatcagcaggcttatgtagcaacagaggtgacccraaagaattaggtataagaagaatagaagaattgcatgaaaatttgacatatgactaagataactatttcaaatatttaaaaaaagatgaatatgtaataa

SEQ ID NO: 25399 - DNA, 201 bp, Homo sapiens
acacactgggttctaagctccagttttctgaagggatatgggttgccaggagaggaagagcaaaagcaagaatgtagatgagaattaggaagtaaacagayatggagattaaaatgggcaggtacatggacaaaaaaccaggtctgacaaaaactggctttctgccataaatgactataaaagatattaaaaaacactttc

SEQ ID NO: 25400 - DNA, 201 bp, Homo sapiens
ctaggacgacatgtccagccaaaacaaacaaataaacaaaaaaaccctttaaaataaacgtgatgtaaatacgtattctgccacctccagaggaaacaagsaaaaaaacaaaagaatgtttccaaggcaggcttctgtattaaaagattttaaggaaagttattcaggtagaagaaaaataataccagatgggaactttaa

SEQ ID NO: 25401 - DNA, 201 bp, Homo sapiens
ctaagaagcgtttgctactttagatttttttttataataataatcttttaagtatgagaaatgtgcagacaggattagtgattgagagccatttgtgcttstggcaatcatatggtacttttatgggaatattagaaaggcactggtaatgaccttgttgcagcacaaaggagagggtgtggggtgcccctgcatattgtc

SEQ ID NO: 25402 - DNA, 201 bp, Homo sapiens
cacaaatgactgatgccttctcatcagaaacaatgaaagtcagaaacaataaagtaacatctttaaagtaatagaagaaaaacccaagaggtgagggatcrtggcagacaggaggcaggactagattgcagctctggacagagcagcatgcagaggctcatattgtgaattttagccccatattgactgcaagaacagacc

SEQ ID NO: 25403 - DNA, 201 bp, Homo sapiens
gtaactcggtcctgacactctatctggagacagtgtcagatcccacaagttaaggctcagtcctacaagactgccccactgcagatgccaatcccaagttscaggctgtgacctgtacttctgcccagctggataaagatctgtttttctatatgaccctccatgggtttgattactttgctagagtggctcacagaactc

SEQ ID NO: 25404 - DNA, 201 bp, Homo sapiens
ggtgtctcttaggaagaacacataggacacagacccatctgcctgcatgttttgcttcctcatctcctttctacaccagggcacctgtgctcaattgctgttctcctctaaagagacttccttctgtaagtttgtgaaatgccatcgacaaacctgatcgcatcgcatttcactctgctgttgagttgatttttctttact

SEQ ID NO: 25405 - DNA, 201 bp, Homo sapiens
tgtctcttaggaagaacacataggacacagacccatctgcctgcatgttttgcttcctcatctcctttctacaccagggcacctgtgctcaattgctgttctcctctaaagagacttccttctgtaagtttgtgaaatgccatcgacaaacctgatcgcatcgcatttcactctgctgttgagttgatttttctttacttt

SEQ ID NO: 25406 - DNA, 201 bp, Homo sapiens
tctcttaggaagaacacataggacacagacccatctgcctgcatgttttgcttcctcatctcctttctacaccagggcacctgtgctcaattgctgttctcctctaaagagacttccttctgtaagtttgtgaaatgccatcgacaaacctgatcgcatcgcatttcactctgctgttgagttgatttttctttactttat

SEQ ID NO: 25407 - DNA, 201 bp, Homo sapiens
gtttcctcagctgatgtgggctgcagggctgttatgggggaaataataagaaagtgcatcaagtgctgagcacatcctaagcactccatcatggcagctcstactactaataaagaatagaattatatctaacatgattctttcttgcaagtgacagaaaatccaactcaaattggattaagcaaaacaagggaaattctt

SEQ ID NO: 25408 - DNA, 201 bp, Homo sapiens
tgctgagtctgggagcactgaggccaggtaaaaggaaacttggcaaatgaggggcacctatgggtgtgggaggctgctcctggtgtttgcatattttaaartttaaatgctacaaaccactgtgagttaggtattattgttcctattttaccattgaggaagctggggctcagagaaggtggagggtggtacagacaaacc

SEQ ID NO: 25409 - DNA, 201 bp, Homo sapiens
atttttatttttttctacagactgtatgtttgggaatgggaaaggataccggggcaagaaggcaaccactgttactgggacgccatgccaggaatgggctkcccaggagccccatagacacagcacgttcattccagggacaaataaatgggcaggtctggaaaaaaatgtaagccactttgatttggactctttttccct

SEQ ID NO: 25410 - DNA, 201 bp, Homo sapiens
tccgcctcctgtaacttgtattgctttggaatttccagtggcctgacaatgaactactgcaggaatccagatgccgatacaggcccttggtgttttaccayggaccccagcatcaggtgggagtactgcaacctgacgcgatgctcagacacagaagggactgtggtcgctcctccgactgtcatccaggttccaagccta

SEQ ID NO: 25411 - DNA, 201 bp, Homo sapiens
cttgcacgtgagcacagtttccattgagaagccctctcatttgtcctttttttctaagcttttatgtgaaatatttctaagaacttactacagttctaaartgttaggaatttgtttctttggtgtttttgtttgttggttggttgttgcttttctcaagtccatctgcctacaaataaagaaacaagaatgttacttgtc

SEQ ID NO: 25412 - DNA, 201 bp, Homo sapiens
catgtcgtcatgaacactctgtagagattcctagaaatgagcttccatgttagtggagtttccgatgagaagcaatctgatatttcttttccactaagttktacatgaaatatttctaagaacttactacagttctagaatggtaggcatctcttactttcgtgtttgtttgtgtgttttctcatgtccatttgcctatta

SEQ ID NO: 25413 - DNA, 201 bp, Homo sapiens
aaatttctatatctttttaaatgagagttgactacttgaagcaaaatgatagcaatatatttaactttagcatatgtagaggtaaaaatttgaacatataractaaatcatgtggggaataattggaagtgtaccattgtaagtttcttaccttatccacgatggtatgtaatattaatgaaaggttgaatttgtgggtcc

SEQ ID NO: 25414 - DNA, 201 bp, Homo sapiens
atattatataataagaattttccatgtatccaaaagagggaagccaaggaagaaaaagaagtctttcaagtactcaagctctgagcacatccagttgctcwttgaaccagcttcctggaatggagggtctgggcttgagactaggtcacatgtgtagagtctctagagagacagtgttggatccccatggcccataataca

SEQ ID NO: 25415 - DNA, 201 bp, Homo sapiens
cgttttctgccccatggcctggaagccagaggccttggctttcatgatcaacgatctagggaaacatgcaaaatttccatgtctttcccctcctctgcccycgacagccaattaccacctgcatcctgcattgccaaatgcagtgccctttgtatgaacattcagtagagtttcatagaaaggtgctacttcgtgagcgca

SEQ ID NO: 25416 - DNA, 201 bp, Homo sapiens
tcgtcatgaacactctgtagagattcctagaaatgagcttccatgttagtggagtttccgatgagaagcaatctgatatttcttttccactaagttttacrtgaaatatttctaagaacttactacagttctagaatggtaggcatctcttactttcgtgtttgtttgtgtgttttctcatgtccatttgcctattaataa

SEQ ID NO: 25417 - DNA, 201 bp, Homo sapiens
ttcacaattcaccttgttctaaaatgggctacctcagtgtcccagccaaaatttttattgtaacgtgctgtcaggtgtgtgactctttcagtccagtaagsttttccggggatttcttcaagtagccagcattcagtgcaatcttcagcattgcagattcagagaaatgtggctctggagcctgtcatcctcgagaaacct

SEQ ID NO: 25418 - DNA, 201 bp, Homo sapiens
aaggaagggccaatggaagtttctgttagaagagtcatgcttcaaggtgactgctcaggactcaacttggctcagatgcagaggaacatttcctgtgagcmaaagttcttagagaagactttgtttttttgagacagagtcttgctttgttgcccaggctggagtgcagtggcatgatctcggctcactgcaagctccgcc

SEQ ID NO: 25419 - DNA, 201 bp, Homo sapiens
aagtttctgttagaagagtcatgcttcaaggtgactgctcaggactcaacttggctcagatgcagaggaacatttcctgtgagcaaaagttcttagagaakactttgtttttttgagacagagtcttgctttgttgcccaggctggagtgcagtggcatgatctcggctcactgcaagctccgcctcccgggttcacacca

SEQ ID NO: 25420 - DNA, 201 bp, Homo sapiens
ctgcctcagcctcccaaagtgctgggattacaggcgtgagccaccgtgcctggctgagaagacattttttaagctggctctccttcctcctagttttatgkaagcagaaggatatatggagttgagaagatcttattaataaaacagccgggatgacaaatgaccaaagagttagagtatccttctacaacatcggctgag

SEQ ID NO: 25421 - DNA, 201 bp, Homo sapiens
gccattgctatagcatcctccaggtgtgaaagctgagaagtagatattgagatcaactgtatgtaaataaattcatgaatgtagatcatgtggatggattscttaggtaaataacaaatcagcaaatcaaacactgaatagatcatgcagttttatagagacttacagacagcctgacagataaacatttgtatgtacgtg

SEQ ID NO: 25422 - DNA, 201 bp, Homo sapiens
aacttactacagttctagattggtaggaatctgtaggtttgctgtatgttttttggttggttttctcccatccatctgcctacaggtaagggaaagataamgttcgtaattctcatagactcctttctggttgtgtcataaatggcttcacatatttcgttattctcagagatactcagtttatttcttgtgttttcattt

SEQ ID NO: 25423 - DNA, 201 bp, Homo sapiens
ctaggaaaaatccacacatttaatatatgtgttaggcaagtcacagaaggagaagaaaaagatatcatgacagacattatacttgaagcgatgatggctcrcaacacgccaaatatacagaaaacaagaaactcatagtcaagaagctaaatgactcaggtatagaattttaaagagcaaaactctatgatttactgggat

SEQ ID NO: 25424 - DNA, 201 bp, Homo sapiens
gtaggtttgctgtatgttttttggttggttttctcccatccatctgcctacaggtaagggaaagataacgttcgtaattctcatagactcctttctggttktgtcataaatggcttcacatatttcgttattctcagagatactcagtttatttcttgtgttttcatttcagcaccgactgagcagaggcctggggtgcag

SEQ ID NO: 25425 - DNA, 201 bp, Homo sapiens
cacagcagtcttgcttaactgaggagagagactggagtctgcgatgcctcaggcagctgatgtgttctaggctggctaagaatgagaagggatttgtggargaaaggagctccaggaatacacacagaagtctcctcaaggctttggctaaatacaaagctgcgtatgcacagggagagttttcataaagaaagaacaaca

SEQ ID NO: 25426 - DNA, 201 bp, Homo sapiens
gtcttagccagaagaatattctaacattttgccaaatttgtgaagatttaccaagctcatgataagcctttcatggtatttcttcaagtagtcagtgttcrttgcatctttggctttgcggtttcggaggaatgcggtttttgagtctgtcatccttgagaaacctaatatgacttttcttagttccatatacttctgggt

SEQ ID NO: 25427 - DNA, 201 bp, Homo sapiens
ggacatgtcagtcttggtcctctatgacaccacactggcatcagagaaccacagaatactacccaaatgggtatgtctttgagttttctcccaagagaaasagccacccacttaaatttctcctggaagagccatgcttccagctaacttcttatgacccaatttctctcagacccagaatgttggacagaatgtctcagg

SEQ ID NO: 25428 - DNA, 201 bp, Homo sapiens
atgtagaacagagcatggtcgtcattttcagagatgatgtcctgtttctatcatggattttttttctcatgcttctgtgttctggaaattactcagtttgwtttctcctctttgaatttcagcaccaacggagcaaagccccacagtccaggactgctaccatggtgatggacagagttatcgaggctcattctccaccac

SEQ ID NO: 25429 - DNA, 201 bp, Homo sapiens
ttgaaggaatgccatttttgaggctgttgttcttgagaaacctaacatgtcttcattagatccgtattgtcctgagactttgaagcagtacatagccaccraattgtttatctccccagcctaccttcatcttgggcatgccttccacacctaggatttgagggaagggatttctcagtgttctcatccctgcttctcatg

SEQ ID NO: 25430 - DNA, 201 bp, Homo sapiens
aggtatgtaactgaatattcatttacacacacaaatatatgtgtgcatgtgtgtatatatatatatacccatatatatatatatatatacacatatatatrtatatatatatagtatatatatatatatatatatatacacatatatatatatatatatatgtatatatatatatatatatatatacacacacacacacac

SEQ ID NO: 25431 - DNA, 201 bp, Homo sapiens
tcccagtgtcagatgggagtactgcaacctgacgcaatgtccagtgatggaatcaactctcctcacaactcccacggtggtcccagttccaagcacagagsttccttctgaagaaggtaagaagcctgcagtcagacaaccataccctcggacattgggataaaaagatttgcaaaatctttgtgatgcagaaaacttcca

SEQ ID NO: 25432 - DNA, 201 bp, Homo sapiens
tttacactttgttacagcaaaatgtagagggcgctaagtgcccttgaatcttctcccatctctggtgacctgtgttgttttgaaatttgcagtggcctgascaggaactactgcaggaatccagatgctgagattcgcccttggtgttacaccatggatcccagtgtcaggtgggagtactgcaacctgacacaatgcctg

SEQ ID NO: 25433 - DNA, 201 bp, Homo sapiens
aatttctatatctttttaaatgagagttgactacttgaagcaaaatgatagcaatatatttaactttagcatatgtagaggtaaaaatttgaacatatagmctaaatcatgtggggaataattggaagtgtaccattgtaagtttcttaccttatccacgatggtatgtaatattaatgaaaggttgaatttgtgggtcca

SEQ ID NO: 25434 - DNA, 201 bp, Homo sapiens
ttctaacattttgccaaatttgtgaagatttaccaagctcatgataagcctttcatggtatttcttcaagtagtcagtgttcattgcatctttggctttgyggtttcggaggaatgcggtttttgagtctgtcatccttgagaaacctaatatgacttttcttagttccatatacttctgggtccaggtagcagtacatag

SEQ ID NO: 25435 - DNA, 201 bp, Homo sapiens
tctccatcttaagccagtcctgcacaactaggctttgatgggagggatctctcagtgttcttgcccctccttctcatggaacatatatctgtgttggtctytgagaagaagagtagtggatatctactttgttgcaatgcagaatcctgggccaaagataccagccatccctccaagggaataaaattttggccagtagcc

SEQ ID NO: 25436 - DNA, 201 bp, Homo sapiens
agttttcttataaagcatagattactttgaatgtgttacaataagaatcataagctgtctttgaaatgttgacagttgtttagaagttgaggaccatttgygagtgttatgggactttagtgagaatatttcaaatttgcttgtttacactttgttacaagaaaacatagagggtgccaggtggtgctgtatcttctccaa

SEQ ID NO: 25437 - DNA, 201 bp, Homo sapiens
ttcttataaagcatagattactttgaatgtgttacaataagaatcataagctgtctttgaaatgttgacagttgtttagaagttgaggaccatttgtgagygttatgggactttagtgagaatatttcaaatttgcttgtttacactttgttacaagaaaacatagagggtgccaggtggtgctgtatcttctccaatctc

SEQ ID NO: 25438 - DNA, 201 bp, Homo sapiens
tagcacgcttatacaaagcctgagaagataaacagagcctcaaggacatctatgaaaatatcaaaatatttaatatttgtttaaagcaagtcacagaggargggaaagagatattggaacagaaaaaatacttgaagcagtgatggctgatgactttctaaatatggaaaaaatgataaactcacatagtcaagaagctca

SEQ ID NO: 25439 - DNA, 201 bp, Homo sapiens
atgggtcatttcagtgtcctagccaaaatggatattctaacagcctgccaaatatgtgaagatttccaagccaataagcctttccagtgatttaaagtagrcttttttcattgcaatctacagtttgcagtttcttaagaacatggcctttgagtatgatatcctagagaaacctaaggagactgcattatttttctattg

SEQ ID NO: 25440 - DNA, 201 bp, Homo sapiens
acggctgacaaatttccaaacatacagaaaatgagaaattcatagtcatgaagctcaatgactcaggtatagatttttaaagagcaaaactctgatttacyggggtacatcatagttaaattgtctgatttcaaagctaagaagaaaaaaagggggttcctatgaacaaacattttgacagttgatctaagaccacagctt

SEQ ID NO: 25441 - DNA, 201 bp, Homo sapiens
gtttgctgagaatgatggtttccagcttcatccacatccctacaaaggacatgaagtcatccttctttatggctgcatagtattccatggtgtatatgtgycacattttcttaatccagtctaccattgatggacgtttgtgttggttccaagtctttgctattgtgaatagtgccgcaataaacatatgtgtgcatgtgt

SEQ ID NO: 25442 - DNA, 201 bp, Homo sapiens
gagcaaagccccggggtccaggattgctaccatggtgatggacagagttatcgaggctcattctctaccactgtcacaggaaggacatgtcagtcttggtyctctatgacaccacactggcatcagaggacaacagaatattatccaaatgggtacaaccttgagttttcttcaaagacagacagcagcccccttacattt

SEQ ID NO: 25443 - DNA, 201 bp, Homo sapiens
atagctcttattattttgagatatgtcccatcaatacatagtttattgagagttcagcatggagagctgttgaattttgtcaaaggccttttctgcatctrttgagataatcatgtggtttttgtctttggttctgtttatatgatggattacatttattgatttgcatatgttgaaccagccttgcatcccagggataaa

SEQ ID NO: 25444 - DNA, 201 bp, Homo sapiens
cacatttcccttttctaggcaatactgagcttgattttctcttttaatttcagcaccaactgaaaacagcactggggtccaggactgctaccgaggtgatrgacagagttatcgaggcacactctccaccactatcacaggaagaacatgtcagtcttggtcgtctatgacaccacattggcatcggaggatcccattata

SEQ ID NO: 25445 - DNA, 201 bp, Homo sapiens
tgctggattcagtttgccagtattttattgaggatttttgcatcaatgttcatcatggatgttggtctaaaattctcatttttgttgtgtctctgccaggmtttggtatcaggatgatgctggcctcataaaatgagttagggaggattccctctttttctatgattggaatagtttcagaagaattggtaccagctcctc

SEQ ID NO: 25446 - DNA, 201 bp, Homo sapiens
ttctctgctcatgcaattactgagtatgatttattttattttaatttcagcaccacctgagaaaagccctgtggtccaggattgctaccatggtgatggayggagttatcgaggcatatcctccaccactgtcacaggaaggacctgtcaatcttggtcatctatgataccacactggcatcagaggaccccagaaaacta

SEQ ID NO: 25447 - DNA, 201 bp, Homo sapiens
ttgcaatcttagtctttgatgaaacagactttaaaccatcaaagatcaaaagagacaaaggagggcattacctaatggtaaaagtatcaatgcaacaagargatctgactgtcctacttatatatgcacccaatacaggagcacccagattaataaagcaagttcttagagacctacaaagagacttagacttccacacaa

SEQ ID NO: 25448 - DNA, 201 bp, Homo sapiens
cctcagtgtcccagccaaaatttttattgtaacgtgctgtcaggtgtgtgactctttcagtccagtaagcttttccggggatttcttcaagtagccagcaktcagtgcaatcttcagcattgcagattcagagaaatgtggctctggagcctgtcatcctcgagaaacctaacagggctgcattaattccatatggtcctg

SEQ ID NO: 25449 - DNA, 201 bp, Homo sapiens
ctttgctgtttgctgccccatagtcctcatgaacattcagtagaaattcccataaatgtgcttgcacgtgagcacagtttccattgagaagccctctcatytgtcctttttttctaagcttttatgtgaaatatttctaagaacttactacagttctaaagtgttaggaatttgtttctttggtgtttttgtttgttggtt

SEQ ID NO: 25450 - DNA, 201 bp, Homo sapiens
actcaggatgtgggtcatgagaggatttcatctctcctgcaggggagtaagctgttcgcctccacccatccctgataactgaagtgtctttgtctgcagtyctagacgaaggactgttgtctctcccatggcccagaagctgaagaccttgccttttgttatgaaacgttcattgttttcatgtctgtccgtttctctgcc

SEQ ID NO: 25451 - DNA, 201 bp, Homo sapiens
agcaccaggtaatgtataaaggaaaccctatcagattaacagccagtttttcagcaggaactgtacaagctataaaggattggagccctatcatagcctcytcaaacaaaacaattatcagtcaagaattttgtatccagcgaaagtaagcatcatatatgaaggaaagatacagtcgtttttggacaaacaaatgctaag

SEQ ID NO: 25452 - DNA, 201 bp, Homo sapiens
catggtttagaaagaacttatatttccttgaaaggagagtgtcctttgttgtttactaccactttttaaacttagaaagaaaaatctaaagagtgtttatsattttaccatttaatttcacctttgagatgtgaaaaactagtgcttggaattcgtcctgaattaaacgacacaattgctaacttggactcaaatgcgact

SEQ ID NO: 25453 - DNA, 201 bp, Homo sapiens
gcacatgagtctttgttccaattgtaagagcactgataggtccttttcccaccaggttttgaatataaaatttctaagaacttattaaaatattagaatgytattaatctattgtttttgcttcagcatgtccttctgcttgtgagtatactaaagagaacagtcataattctgaaactactgtcctgtttgtgtcataaa

SEQ ID NO: 25454 - DNA, 201 bp, Homo sapiens
tttaactttagcatatgtagaggtaaaaatttgaacatatagactaaatcatgtggggaataattggaagtgtaccattgtaagtttcttaccttatccaygatggtatgtaatattaatgaaaggttgaatttgtgggtccaaagggatattgtaaatcctaaagcaatcataaaattttgaattctgagggatattata

SEQ ID NO: 25455 - DNA, 201 bp, Homo sapiens
gaaggttttggcgtgcacacatccttgagaagcaaagtgtctttgccttcagtcagatatataggatcgttttctgccccatggcctggaagccagaggcyttggctttcatgatcaacgatctagggaaacatgcaaaatttccatgtctttcccctcctctgcccccgacagccaattaccacctgcatcctgcattgc

SEQ ID NO: 25456 - DNA, 201 bp, Homo sapiens
ccttcagtcagatatataggatcgttttctgccccatggcctggaagccagaggccttggctttcatgatcaacgatctagggaaacatgcaaaatttccrtgtctttcccctcctctgcccccgacagccaattaccacctgcatcctgcattgccaaatgcagtgccctttgtatgaacattcagtagagtttcataga

SEQ ID NO: 25457 - DNA, 201 bp, Homo sapiens
gcaaaatttccatgtctttcccctcctctgcccccgacagccaattaccacctgcatcctgcattgccaaatgcagtgccctttgtatgaacattcagtakagtttcatagaaaggtgctacttcgtgagcgcactttgcagtgagaagatctgttctgttctgtttttctaaggatttcaggtgaaatatttcctagaac

SEQ ID NO: 25458 - DNA, 201 bp, Homo sapiens
gtgtcccagccaaaatttttattgtaacgtgctgtcaggtgtgtgactctttcagtccagtaagcttttccggggatttcttcaagtagccagcattcagwgcaatcttcagcattgcagattcagagaaatgtggctctggagcctgtcatcctcgagaaacctaacagggctgcattaattccatatggtcctgggtct

SEQ ID NO: 25459 - DNA, 201 bp, Homo sapiens
cagcacctgtactacattttatggattccttcttctctttgcggtatgccctgacaataattatatccgtcagccttacccccttggcagtaggaaaactraaactgtcttaaagtctcagctctactttctcagaggtgcaggcaagggcactgggagtctggggccctggaaaactgttctgactctgccacttgccag

SEQ ID NO: 25460 - DNA, 201 bp, Homo sapiens
aacatggcaaaaccccatctctacgaaaaattaaaaaattagccggtcatggtggtgggtacctgtaattccaactacttgggaggctgaggcaggagaarcacttgagcctgggattcagagtttgctgtgagccgagaacatgccactgcactccagcctgggtgacagagcaagactcaatctcaaaaaaaaaaaaaa

SEQ ID NO: 25461 - DNA, 201 bp, Homo sapiens
cattgcagattcagagaaatgtggctctggagcctgtcatcctcgagaaacctaacagggctgcattaattccatatggtcctgggtctatggagcagtayatgagctcccaatgctctaaggctcttcagtcctaggctttgaagggagtgatttctcagtgttcttaaacctctttctgatggcacttgtacctgtgag

SEQ ID NO: 25462 - DNA, 201 bp, Homo sapiens
gtggcctgaccaggaactactgcaggaatccagatgctgagattcgcccttggtgttataccatggatcccagtgtcagatgggagtactgcaacctgacrcaatgtccagtgatggaatcaactctcctcacaactcccacggtggtcccagttccaagcacagagcttccttctgaagaaggtaagaagcctgcagtca

SEQ ID NO: 25463 - DNA, 201 bp, Homo sapiens
gccgtcgcgcctccgactgttaccccggttccaagcctagaggctccttccgaacaaggtaaggagtctgtggccagacatctacacgcttcgatgctggratgaaaagccatggaaattcccactgatgcagccgccttcaatggtaaacggatgctcgagtgttgcctgagttctaccatgttgggggaagcctccgtg

SEQ ID NO: 25464 - DNA, 201 bp, Homo sapiens
atctatctctttctatatctacgtctattccaatatgtagaaacacagtcggttctgaccaccagtggtctgaagggatactggttgttagagaataaaartggcaggaaggcagatgagagtcagcaaagagagagatcctgtaaagtaaaagggtggatagatggacagaagcccaggtctgaccagcccatggccagg

SEQ ID NO: 25465 - DNA, 201 bp, Homo sapiens
aggaaggcagatgagagtcagcaaagagagagatcctgtaaagtaaaagggtggatagatggacagaagcccaggtctgaccagcccatggccaggctttmggccataagtgacaccaaagacatggaaaaatggtttctacatgttggacaacagacagtagtggaccaaaagaatagtgacagggggaacaatgagatc

SEQ ID NO: 25466 - DNA, 201 bp, Homo sapiens
agacagtagtggaccaaaagaatagtgacagggggaacaatgagatcaactccatagataccttggctttcttcctggaggcccttcttgcactgaagagyaaggtgatggagcccagatggactgtagccatcttcctgaatgcaggagagagattggaatttgggactactgtggtagctaggattttataggcctgct

SEQ ID NO: 25467 - DNA, 201 bp, Homo sapiens
ataattcaatagaatctacagaaatagctgcacatatatacacacaatggcacacgtgcacacacccacacccacacaggtgtgaatcctagagccacacsagcattgaaacatagagaagtaaaaattgttcattgaggaatatgtagcaatgctcaatgtgttttaccctaataagagcttttgtgatgtatgattgaa

SEQ ID NO: 25468 - DNA, 201 bp, Homo sapiens
gaattaaagtcatacagagtgtgtcactttattctcccagaataaagtgagatatgaataatgagaagtttgccagcttctcaaatatttgggagtcatayggtgcatttcaaaatactctttgggacaaagaaaacatcactaaggaatttagaaaagttttgaactgagtaagaatataacacaatttatccaaactta

SEQ ID NO: 25469 - DNA, 201 bp, Homo sapiens
atactataaatattcatcttgtgttttgaaaaagaaaagctctttggaatcccctatgaacaaagactttgacagttgttgatctaagaccacagcttaartatctacacaagaaaaaaaaaaaaagcaaataagagccaaggaaagcagatggaaggaagtagtccaaaccagtgacattcagtgaacaagaaaagagac

SEQ ID NO: 25470 - DNA, 201 bp, Homo sapiens
agaggtgccattactatagcatcttccagttctgaaagctgaaaagaagattttgagaacaattgtatgtgaataaattcaggaatgttaatcatgtgggmcaattcctgaggaagacaacaaatcagcaaaccagatgctgaatagttagtgtagtcctgtagagagacatacagagaggctgacagagaaatatttgta

SEQ ID NO: 25471 - DNA, 201 bp, Homo sapiens
agagtggtaagaaggaaaacaagataaaatcagaaacaatgaaataacacctttagagtagtaagaagaagaaaagatcaggtcagaaaaaatggaataayatgctaagaagaaaaaaaaagatcaagtcagaaacaatggaataacacctttagagtgaaaagaaggaaaaaaacccagcaagcttaaacgctatgcaca

SEQ ID NO: 25472 - DNA, 201 bp, Homo sapiens
taataatttggaatcagcaggcttgtgtaacaagagatgttgcccaaagaaaattagctagaagaagaatagttcaagaggagaactttctgcagcccacrtaatgaagaacccagcaaatggcaaatgtagatgtaaatgcaaaatattttcttgatcaaatttctatatctttttaaatgagagttgactacttgaagc

SEQ ID NO: 25473 - DNA, 201 bp, Homo sapiens
ttacctaatggtaaaagtatcaatgcaacaagaagatctgactgtcctacttatatatgcacccaatacaggagcacccagattaataaagcaagttcttrgagacctacaaagagacttagacttccacacaaaaatagtgggagactttaacaccccacagccaatattagatcgacgtgacagaaaattaacaaggat

SEQ ID NO: 25474 - DNA, 201 bp, Homo sapiens
tagtacagaacagagcatggtagtctttctcagagacaatgatcctgtttcagtcacagatttcttctgatgcttctgtgttctagaaattactcagcttkatttctcctctttgaatttcagcaccaacggagcaaagccccggggtccaggattgctaccatggtgatggacagagttatcgaggctcattctctacca

SEQ ID NO: 25475 - DNA, 201 bp, Homo sapiens
catgatcaagttggcttcatccctgggatgcaaggctggttcaacatattcaaatcaataaacataatccatcacataaacagaaccaatgacaaaaaccrtatgattatcgcaatagacgcagaaaaggcctttgataaaattcaatacccaatcatgctaaaaactcttaataaactaggtattgatggagcatgtctc

SEQ ID NO: 25476 - DNA, 201 bp, Homo sapiens
tacaaatgcaaataataatattattgttgtcttctttgattttctctttcctggtgaaattttgttttattaagcctgacaaagtgatacctttgcttacrtcacttaaagttagtctatttggacctaggtgacagtacaatcagctaagaaacagtatttgtaggagaggcaggtttgggacaggtgacaaggcatgtg

SEQ ID NO: 25477 - DNA, 201 bp, Homo sapiens
agcctagaggctttttttgaacaaggtaagaagttgtgccagacatttacctgcttggatgctgggatgaaaagccatggatacccccactgacgcacaasccttcagtgctacactggttctcgtgtgttggttctgggtctgccatgtgggaggaagccttagcgcactctctgggggagccagaggtgtgatttttgg

SEQ ID NO: 25478 - DNA, 201 bp, Homo sapiens
aactctcacggtggtcccagatccaagcacagaggcttcttctgaagaaggtaggaagtctatggccagacaaccacaccctaggacgttgggatgaaaasagttgcaaaatcttagtgatatagaagccttccatgctcacacaattccaagtagaatgtggactcagggtcagccactgggaaggaacactcagcgcct

SEQ ID NO: 25479 - DNA, 201 bp, Homo sapiens
catgaacacccagaagaggtgtaagcaaaagaccattcacatgagtgtaattttgaagtataggcactctgatctgttttttgtttgtttctttgtttgtytgttttccagggttgaattaaaatatttatgactacttattaaatttctagaatcctataagtctatttgtatttttattctacatttcaatttgcatgc

SEQ ID NO: 25480 - DNA, 201 bp, Homo sapiens
agctgttgcggggttgggggcatggtgggagtaagaccagcccttcagtttgcatgggtgctgggtgaggcctgtgactgacagcttccctccacttcccygacaactcagatgactcagcagaggcagccataatcctcctaggtacacaactccagtgacctgggaacttcacccccacaccatacagaagcttcagta

SEQ ID NO: 25481 - DNA, 201 bp, Homo sapiens
tatgttttttggttggttttctcccatccatctgcctacaggtaagggaaagataacgttcgtaattctcatagactcctttctggttgtgtcataaatgkcttcacatatttcgttattctcagagatactcagtttatttcttgtgttttcatttcagcaccgactgagcagaggcctggggtgcaggagtgctaccac

SEQ ID NO: 25482 - DNA, 201 bp, Homo sapiens
cccagccaaaatttttattgtaacgtgctgtcaggtgtgtgactctttcagtccagtaagcttttccggggatttcttcaagtagccagcattcagtgcartcttcagcattgcagattcagagaaatgtggctctggagcctgtcatcctcgagaaacctaacagggctgcattaattccatatggtcctgggtctatgg

SEQ ID NO: 25483 - DNA, 201 bp, Homo sapiens
gcataaatttatatatttttaatatttcactaaaaattatattgtttcactatgtatgtctgagtatttttatatattttaatataacattttaaatattyatatataaatattcaggtatgtaactgaatattcatttacacacacaaatatatgtgtgcatgtgtgtatatatatatatacccatatatatatatatat

SEQ ID NO: 25484 - DNA, 201 bp, Homo sapiens
ccctacctctgtttagggtgacagtggagggcctctggtttgcttcgagaaggacaaatacattttacaaggagtcacttcttggggtcttggctgtgcaygccccaataagcctggtgtctatgctcgtgtttcaaggtttgttacttggattgagggaatgatgagaaataattaattggacgggagacagagtgaagc

SEQ ID NO: 25485 - DNA, 201 bp, Homo sapiens
aaagggaattccctgaccccttacacttcccgggtgaggcaatatcccgccttgcttcggctcactctccgtgggctgcacccactgtctgacaagccccrgtgagatgaacccagtacctcagctggaaatgcagaaaccacccatcttctgctttgctcatgctgggaactgtggactggagctgttcctattcggcca

SEQ ID NO: 25486 - DNA, 201 bp, Homo sapiens
agctttataacaaaggagaagtaaaatcctttacaaacaagcaaatgctgaggaattttgtcaacaccaggcctgccttacaagaggtcctgaagaaaacmctaaatatggaaaggaaaaaccagtaacagctactgcaaaaacataccaaattgtaaacaccatcaacactataaagaaactgcatcaactaatgggcaa

SEQ ID NO: 25487 - DNA, 201 bp, Homo sapiens
acatgctgtcaactgtgtgattatttccaagccaataagcatttccagtaatttcttaaaatagtgttcattgcagtcttcagcgttgtggctcctgaggratgtggcccctgattctgtcgtcctagagaagcctgacatgactgcattgattctgtatcgtcctgggtctatgtggctgcctggctgtctgtaatcatc

SEQ ID NO: 25488 - DNA, 201 bp, Homo sapiens
agaagcctgacatgactgcattgattctgtatcgtcctgggtctatgtggctgcctggctgtctgtaatcatctgttttatttttatttttttctacagaytgtatgtttgggaatgggaaaggataccggggcaagaaggcaaccactgttactgggacgccatgccaggaatgggctgcccaggagccccatagacaca

SEQ ID NO: 25489 - DNA, 201 bp, Homo sapiens
ttctacaacatcggctgagggttaatacaaccttttcaccttggaattctatcattctaagctctagtccctgaagtgaatgttgtgttggccttttgcaycttgggtcacagggaattgatacttgcacatctatggagaggcaaatctttttctatctacttctttttcaatgggtacaaacacacttggtcctgagca

SEQ ID NO: 25490 - DNA, 201 bp, Homo sapiens
ctgatggcacttgtacctgtgaggggtctagagagaaaggttagtagacttctcctttactgcaattcaggatgcagggcatgagaggattccctccctcstccaagggaagaaggttttggcgtgcacacatccttgagaagcaaagtgtctttgccttcagtcagatatataggatcgttttctgccccatggcctgga

SEQ ID NO: 25491 - DNA, 201 bp, Homo sapiens
tatgtccttgcctcctccccaaaaaaccattttaatgcttggagacttgcttttcagctttgccaaatgcatcaccctttcttctatgctgttccatgtcrtcatgaacactctgtagagattcctagaaatgagcttccatgttagtggagtttccgatgagaagcaatctgatatttcttttccactaagttttacatg

SEQ ID NO: 25492 - DNA, 201 bp, Homo sapiens
taaatattcaggtatgtaactgaatattcatttacacacacaaatatatgtgtgcatgtgtgtatatatatatatacccatatatatatatatatatacayatatatatatatatatatatagtatatatatatatatatatatatacacatatatatatatatatatatgtatatatatatatatatatatatacacaca

SEQ ID NO: 25493 - DNA, 201 bp, Homo sapiens
catatattgaggaacaacaactacaagggaacagtgagcttaataaaggtgacagagctcacatagtgctctggaatattggagttttgaccagctagagrgaagagacctcattgaaaatcttgggcattcagtagagacctcagaaaagtcagactttatgagtagactttgtatattcctagaataaaggcagctcca

SEQ ID NO: 25494 - DNA, 201 bp, Homo sapiens
cagtgttcttgcccctccttctcatggaacatatatctgtgttggtctctgagaagaagagtagtggatatctactttgttgcaatgcagaatcctgggcsaaagataccagccatccctccaagggaataaaattttggccagtagccctctctgagagacaatttgtctttgcctacgagtcctagatgcaggaccgct

SEQ ID NO: 25495 - DNA, 201 bp, Homo sapiens
tgtgatccataaccaggagaaaaatcattcaatacaaatagacccagaaatgacagaaatgatagaattagcaaaaacatttaaaatatacatatgatcayttgatcttgtgatcagatatcacaagagaagaaagagatacttgaacagaaaaaatgcctgaagcaatgatggctgaaaactttccaaatatgaagaaaa

SEQ ID NO: 25496 - DNA, 201 bp, Homo sapiens
cacagcagtcttgcttaactgaggagagagactggagtttgtgatgcctcaggcatctgacgtattctaggctggctaagaatgagaggggatttgtggargaaaggagctccaagaatacacaccgaagtcttctcaaggctttggctaaatacaaagctgcgtatgcacaaggagagttttcacaaagaaagaacaata

SEQ ID NO: 25497 - DNA, 201 bp, Homo sapiens
catgtacctagaagtcacctcagtgtaatataaatctgcatatgcacagggagtgattccacaatgaaagtaggacaaagaacagctactggggaaagaayaactacaagggaacaatgagttcaatggagatggcagagctcacaaagcactgggggatatttgagttcttaccagctagaaaagagacctcattgcaaa

SEQ ID NO: 25498 - DNA, 201 bp, Homo sapiens
ccacagtccaggactgctaccatggtgatggacagagttatcgaggctcattctccaccactgttacaggaaggacatgtcagtcttggtcctctatgacmccacactggcatcagagaaccacagaatactacccaaatgggtatgtctttgagttttctcccaagagaaacagccacccacttaaatttctcctggaag

SEQ ID NO: 25499 - DNA, 201 bp, Homo sapiens
acacatttaatatatgtgttaggcaagtcacagaaggagaagaaaaagatatcatgacagacattatacttgaagcgatgatggctcgcaacacgccaaayatacagaaaacaagaaactcatagtcaagaagctaaatgactcaggtatagaattttaaagagcaaaactctatgatttactgggatatatcatagttaa

SEQ ID NO: 25500 - DNA, 201 bp, Homo sapiens
atatatctgacaaatggcctgtatccagagtatagaaacatttctcccactcactaatcagaggacaaacaacctaatcaaaatgggcaacaggcttgaayagtcatttcttaggagaagatgcacacagagccaacaatcacctgaaaaagtgcacaacatcttagccatcaaaaatcaagagttataaccctcataaga

SEQ ID NO: 25501 - DNA, 201 bp, Homo sapiens
ttgacatcctcatcttttctaggtcctcaaggccttcatcctacaaggtcatcctgggtgcacaccaagaagtgaacctcgaatctcatgttcaggaaatrgaagtgtctaggctgttcttggagcccacacaagcagatattgccttgctaaagctaagcaggtactcgctcacctgtggtcttcaccccacgctggtga

SEQ ID NO: 25502 - DNA, 201 bp, Homo sapiens
caagcacagagcttccttctgaagaaggtaagaagcctgcagtcagacaaccataccctcggacattgggataaaaagatttgcaaaatctttgtgatgcrgaaaacttccatgctgcacaggaagtcgaaggtgaagtcatggacagccaatgggaaggaagcttcagtgccttctctggggggaccagagctgggatgt

SEQ ID NO: 25503 - DNA, 201 bp, Homo sapiens
ggactacaggcacccaccaccacacccggctaattttttgtatttttagtagagacagggtttcactgttctagccaggatggtcttggtctcctgacctygtgatccgcctgcctcagcctcccaaagtgctgggattacaggcgtgagccaccgtgcctggctgagaagacattttttaagctggctctccttcctcct

SEQ ID NO: 25504 - DNA, 201 bp, Homo sapiens
aatttacaaatcagatctaattaaaataaagagcttctgcacagcaaaaaactctcatcagagtgaaaaagcaacctatggagaaaaattctgtggtctakccatctgacaaagggctaatgtttagaatgtacaagcaacttaaacaaatgtacaagaaaaaaaaaacaaccccatcaaaaagtgggcaaaggatatgaa

SEQ ID NO: 25505 - DNA, 201 bp, Homo sapiens
aagaaaatgataaactcacagtcaagaagctcaatgaatcagaaatagtatttttaaaagcaaaactctatgatttacttgggtacattatagataaatcrtccaacatcaaagataacaaggataatcttataagccagaggaaaacaatatcatttacatagagggacagtaatgaaagtgaccgatgccttctccttg

SEQ ID NO: 25506 - DNA, 201 bp, Homo sapiens
cctccaatggtaaacggatgctcgagtgttgactgagttctgtcatgtaggaggaagcctccgtgcactctctgggggagccagcggattgatttctggtrcaacgttgggtgggctgtgtctttagaattggcacaaaccctccagggtgatcgacttcacaactcacctcgttgaaaaatgggctatctcagtgtctta

SEQ ID NO: 25507 - DNA, 201 bp, Homo sapiens
ggattgctaccatggtgatggacggagttatcgaggcatatcctccaccactgtcacaggaaggacctgtcaatcttggtcatctatgataccacactggyatcagaggaccccagaaaactacccaaatgcgtatgtatttgattaaaaccataagaggagcaacagccaactcaaatattggttagaagacccatgctt

SEQ ID NO: 25508 - DNA, 201 bp, Homo sapiens
gctgtatgttttttggttggttttctcccatccatctgcctacaggtaagggaaagataacgttcgtaattctcatagactcctttctggttgtgtcataratggcttcacatatttcgttattctcagagatactcagtttatttcttgtgttttcatttcagcaccgactgagcagaggcctggggtgcaggagtgcta

SEQ ID NO: 25509 - DNA, 201 bp, Homo sapiens
tcccagcaagagaagatccaaggaaggaaggcagatgagagtcagcacagagagggatgctgaaaagtaaaagggatgggtagatggatagaagccctggyctgaccaccccatggccaatcatttggccataatcaacaaccaaagacatggaaaaatggtttctacatgtgggacaacagatggtagaggacctagaga

SEQ ID NO: 25510 - DNA, 201 bp, Homo sapiens
caacagatggtagaggacctagagaattgagagagggccaatgatgagctcaactccatagatgccttggctttcttcctggatacccttcctgcactgartagcaaggagatggagctcaagcagcctgtagccatctagctgagcagaggagagggattggagtttgggatgactctggtattttctaggtccgctaca

SEQ ID NO: 25511 - DNA, 201 bp, Homo sapiens
tgcatcaactaatgggcaaaatagccagctagcatcataatgacaggatcaaattcacacataacaatattaaccttaaatgtaaatgggctaaatgcccyaattaaaagacacagactgggaaattgaataaagagtcaagacccattggtttgctgtgttcagaagacccatctcagggtgaaaagacatacatgggct

SEQ ID NO: 25512 - DNA, 201 bp, Homo sapiens
gtgttcctccgtagctgtccgacctcttcagatctcttagtctaccctgccatcttcctttatgccatgggtcccactgttctttcaactcatcccccttwccctcagtgcagagtagctgcggccagcagagggtagactgagagcaggagagaaggtcctgcccaggaacccattctagagatgctgcattctgcctgg

SEQ ID NO: 25513 - DNA, 201 bp, Homo sapiens
ttatgtgcttacttatggacaggtgaattgatctgtttctatttctacctgtattccaatagggagaaaatctcttggtcctaagtaccagtggcctgaarggatagaggttcccagcaagagaagatccaaggaaggaaggcagatgagagtcagcacagagagggatgctgaaaagtaaaagggatgggtagatggata

SEQ ID NO: 25514 - DNA, 201 bp, Homo sapiens
ggtctatgtggctgcctggctgtctgtaatcatctgttttatttttatttttttctacagactgtatgtttgggaatgggaaaggataccggggcaagaargcaaccactgttactgggacgccatgccaggaatgggctgcccaggagccccatagacacagcacgttcattccagggacaaataaatgggcaggtctgg

SEQ ID NO: 25515 - DNA, 201 bp, Homo sapiens
gaaaatctcttggtcctaagtaccagtggcctgaaaggatagaggttcccagcaagagaagatccaaggaaggaaggcagatgagagtcagcacagagagkgatgctgaaaagtaaaagggatgggtagatggatagaagccctggtctgaccaccccatggccaatcatttggccataatcaacaaccaaagacatggaa

SEQ ID NO: 25516 - DNA, 201 bp, Homo sapiens
caaccataccctcggacattgggataaaaagatttgcaaaatctttgtgatgcagaaaacttccatgctgcacaggaagtcgaaggtgaagtcatggacarccaatgggaaggaagcttcagtgccttctctggggggaccagagctgggatgttgagtgccttgtgagggatggtgtctttaaaaggggcacagaccctc

SEQ ID NO: 25517 - DNA, 201 bp, Homo sapiens
ccaagatggtctcgctctgttgacctcgtgatccacccgccttggcttcccaaagtgctgggattacaggcgtgagccaaagcacccagcctgtgcctctyacttactcaattgtttttctgaaccctccatagctggtggaccttttcagatcccatagtctagccagccctctcactttatgccttgggtcccactgtt

SEQ ID NO: 25518 - DNA, 201 bp, Homo sapiens
tgtttgggaatgggaaaggataccggggcaagaaggcaaccactgttactgggacgccatgccaggaatgggctgcccaggagccccatagacacagcacrttcattccagggacaaataaatgggcaggtctggaaaaaaatgtaagccactttgatttggactctttttccctttgctgacaaatcttttcaaacagaa

SEQ ID NO: 25519 - DNA, 201 bp, Homo sapiens
gacattcagtgaacaagaaaatagaccaacaaaggagtaaatccatgaaacagaaagttggttctttgaaaagattcatgtgattgaccacagtctggctraacagatgacagaccaaggagggagtacaaccatcaccatttgaagtaacaggggagaggagccattgctataccatactccaggtctgaaagctgacaa

SEQ ID NO: 25520 - DNA, 201 bp, Homo sapiens
ctgaacctcttgggaatacagtagagactccagaaaagtcatactttaggagtagaattagtaaatttctagaaaaaaaggcagctctagacaaaccctgrcaaaactgaaaagcaagtctccaagcattaaaatcatttccaagtcaattaactgcctgggagaggaaaaccctctttagaggtaaacaacaaagtcaag

SEQ ID NO: 25521 - DNA, 201 bp, Homo sapiens
gagtatgatatcctagagaaacctaaggagactgcattatttttctattgtcctggggctgcatagcaggaggtaaccaacgaatgctgtctctccctggyctatctcagtctttcacaggctctgttcacctcagctttgaagttagaaatttctaggtgttcttgcctcttcttctcatgaaacctgcattggcagtga

SEQ ID NO: 25522 - DNA, 201 bp, Homo sapiens
tagatgtaaatgcaaaatattttcttgatcaaatttctatatctttttaaatgagagttgactacttgaagcaaaatgatagcaatatatttaactttagmatatgtagaggtaaaaatttgaacatatagactaaatcatgtggggaataattggaagtgtaccattgtaagtttcttaccttatccacgatggtatgta

SEQ ID NO: 25523 - DNA, 201 bp, Homo sapiens
ccttggcatgttttctttctaggtttggaaagcacttctgtggaggcaccttaatatccccagagtgggtgctgactgctgctcactgcttgaagaagtaygtttaagggaaaactgacatggggtcttatcttcaagacttttttcctccctctcttcctccatcccttctttcttcccaccctccccttccttcctccc

SEQ ID NO: 25524 - DNA, 201 bp, Homo sapiens
ctgtagctcattgaaccagcttcctggaatggagggtctgggattgacactaggccacatgtatagagtctctagagagacagtgtttcatccccatggcycgtaatacatttcccattttctcaggcagccacaggtcatgaatgtgaggatagagagaggttggagcaacgttcttgggaggcataaggaagagcaaat

SEQ ID NO: 25525 - DNA, 201 bp, Homo sapiens
ggaaactgcttccttaatatggatttggaaaaaaaaaagcaaaaaaaacagaaaatggcttttgagctgagtgcttctggggaggagatggctgccctctscaccagagcctgcttttcatcatggccaccttgaacctgccctactattggccccatttgttaggaaaacacccgcccctcccaccacacacacataaat

SEQ ID NO: 25526 - DNA, 201 bp, Homo sapiens
gtcttaaatgaagaaattactgtatgtccgcctgaaaaatttagatgtttcagaagaaaaaattaaccaaaaacaattctgcagaacctacagaatgagcyacacacacacacattcaaaacacacccatacacacacacatgcaaaaactcacaagttctaacacacacacaaacacacacacacatgcacatccctaaa

SEQ ID NO: 25527 - DNA, 201 bp, Homo sapiens
caattctgtcattctaaatttcaattcccgaaggtttgtttgccatttttgtcatgggtaataagtaaaaaaaaaaaaattaagatgtgtatatatatatrtatatatatatatatacacacacacacacacacacaaacatctgaatatttatatatatgtctgaatatttatatacttgtgtataaaacttatatttaa

SEQ ID NO: 25528 - DNA, 201 bp, Homo sapiens
acagttgtttagaagttgaggacgatttgtgattgttacaggacctttagtgagaatatttcaaagtcactttttaccactttgttacaacaaaatgtagrggatgtctggtgcccttgtatcttctcccatctctggtgaactgtattgttttgtaatttgcagtggcctgaccaggaactactgcaggaatccagatgc

SEQ ID NO: 25529 - DNA, 201 bp, Homo sapiens
agcccagctgaccacagcagtcttgcttaactgaggagagagactggagtctgcgatgcctcaggcagctgatgtgttctaggctggctaagaatgagaakggatttgtggaagaaaggagctccaggaatacacacagaagtctcctcaaggctttggctaaatacaaagctgcgtatgcacagggagagttttcataaa

SEQ ID NO: 25530 - DNA, 201 bp, Homo sapiens
ccaaatggaaatttaaaaactgagaaaagttatatctgtaatgaggaattcactggatggccttataaccagtttagatattatggtaggaaaaggtgaaygagaaaatgattcaattaaagctagacaaaccacaagacagacagacagacacaaatacacatacacacaatgactgaaccaattaatcaacagagcctc

SEQ ID NO: 25531 - DNA, 201 bp, Homo sapiens
cacctacaacctgcacagcctgatgcatagcagtctagtttcctgccttattctcaggaacacccagaagatgtctatattaaagagcatgcacatgagtrcaattttgactgataggcactctgatctttcctttggtgcctgtgttttaaaggaaatctttctaagaactcgttaaagttctagaatgctatgaatctt

SEQ ID NO: 25532 - DNA, 201 bp, Homo sapiens
aaacatctgaatatttatatatatgtctgaatatttatatacttgtgtataaaacttatatttaaatttttgcataaatttatatatttttaatatttcaytaaaaattatattgtttcactatgtatgtctgagtatttttatatattttaatataacattttaaatatttatatataaatattcaggtatgtaactgaa

SEQ ID NO: 25533 - DNA, 201 bp, Homo sapiens
aagaaaactttttgactactgtgatatccctctctgtggtaagttgccttctgttttggtaaggaaactgcttccttaatatggatttggaaaaaaaaaarcaaaaaaaacagaaaatggcttttgagctgagtgcttctggggaggagatggctgccctctccaccagagcctgcttttcatcatggccaccttgaacct

SEQ ID NO: 25534 - DNA, 201 bp, Homo sapiens
ccaaacacaacaggctagaacaaatatgcagaaaattagacatagtatctttgttctcaataaaaacgtcgacctatttaacattataccgaactaccgartacacattaaagtgtgcatggagcattcactgaggtgtactctacacatgaccttccagcaagtctccatagatttaaaagaattaaagtcatacagagt

SEQ ID NO: 25535 - DNA, 201 bp, Homo sapiens
aagtagaaaaaataaattcagagctcaaagacaaggacttcaaattaacccaatccaacaaagacaaagaataaaggataagaaaatatgaacaaagcctycaagatgtctgggattatgttaaatgaccaaatataagaataatcgtggctcctgaggaaaaagacaatactaaaagcttggaaaacatatttgggggaa

SEQ ID NO: 25536 - DNA, 201 bp, Homo sapiens
caggcttatgtagcaacagaggtgacccgaaagaattaggtataagaagaatagaagaattgcatgaaaatttgacatatgactaagataactatttcaawtatttaaaaaaagatgaatatgtaataaaacagataaaatatcaaaagaaagtaacagtattgactagccaaatcaaattaaagacttagtgtaaaaagc

SEQ ID NO: 25537 - DNA, 201 bp, Homo sapiens
acatcaaagataacaaggataatcttataagccagaggaaaacaatatcatttacatagagggacagtaatgaaagtgaccgatgccttctccttggaaayaatggcataacatctttaaagtgataaagagaaataaaaacagatcaacctaggacgacatgtccagccaaaacaaacaaataaacaaaaaaacccttta

SEQ ID NO: 25538 - DNA, 201 bp, Homo sapiens
agaatattcatagcagctttattttttataaccccaaactgtagacaatttcaatgtcaatcaataagaaaatgaataaataatttgtgaactagtcatayaatggcatactgttcagcaataaaagggagcatgtttttgatactctcaaatagtatggaagatgctcaaaaatattacattaaagaaagatgccagata

SEQ ID NO: 25539 - DNA, 201 bp, Homo sapiens
aatgtgaggattctgagaggttggagcaacattcctgggaggaacgaaggggagcacattctccaagatcccccaccaccggggtcctcaccggctgtgcttttttttttttttttcttgacagagtctcgctctgtcgccaggcaggagtgtaatggcccaatctcggctgattgcagcctccaactccagggttcaaga

SEQ ID NO: 25540 - DNA, 201 bp, Homo sapiens
cctgacacaatgcctggtgacagaatcaagtgtccttgcaactctcacggtggtcccagatccaagcacagaggcttcttctgaagaaggtaggaagtctrtggccagacaaccacaccctaggacgttgggatgaaaagagttgcaaaatcttagtgatatagaagccttccatgctcacacaattccaagtagaatgtg

SEQ ID NO: 25541 - DNA, 201 bp, Homo sapiens
aaaaacaattttataccacctacagaaccagctacacatacacaaatgacacacacatatacacacatactcacacatgcacaggcttagaaacatgcacrcacacacacacacacacacacacacacctccacaaatactaaaaaatgaaatccactgatcctcacagacaggcgggaaaatataaaaagatttcctgca

SEQ ID NO: 25542 - DNA, 201 bp, Homo sapiens
gtgtgtctttccaagccagtaaacttttccagggatttcttcaagtagacagcattcagtgcaatcttcagcattgcagattccgagaaatgtggctctaratcctgttatccttgagaaacctaactgggttgcattaattccatatctccctgggtctgtggagtagtacatgagctcccgaagctctatctctcaggt

SEQ ID NO: 25543 - DNA, 201 bp, Homo sapiens
attacatttattgatttgcatatgttgaaccagccttgcatcccagggataaagccaacttgatcatggtggataagctttttgatgtgctgctggattcrgtttgccagtattttattgaggatttttgcatcaatgttcatcatggatgttggtctaaaattctcatttttgttgtgtctctgccaggatttggtatca

SEQ ID NO: 25544 - DNA, 201 bp, Homo sapiens
acatcacacaccagggcttgtcagggggtgggaagctggtgaagggatagcattaggagaaatatctaatgtaaatgacgagttgatgggtgcagcaaacyaacacggcacatgtatacctatgtaacaaacctgcacgttgtgcacatgtaccccagaacttaaagtataataataaaaaaagaaatatttgtttttgat

SEQ ID NO: 25545 - DNA, 201 bp, Homo sapiens
gaatccagatgctgagattcgcccttggtgttataccatggatcccagtgtcagatgggagtactgcaacctgacgcaatgtccagtgatggaatcaactstcctcacaactcccacggtggtcccagttccaagcacagagcttccttctgaagaaggtaagaagcctgcagtcagacaaccataccctcggacattggg

SEQ ID NO: 25546 - DNA, 201 bp, Homo sapiens
cggttttcttatggagtatagacgagtttggatgtgttacaataagaatgataatctgtctttgaaatgttcacagttgtttagaagttgaggacgatttrtgattgttacaggacctttagtgagaatatttcaaagtcactttttaccactttgttacaacaaaatgtagaggatgtctggtgcccttgtatcttctcc

SEQ ID NO: 25547 - DNA, 201 bp, Homo sapiens
tatttccaagccaataagcatttccagtaatttcttaaaatagtgttcattgcagtcttcagcgttgtggctcctgaggaatgtggcccctgattctgtcrtcctagagaagcctgacatgactgcattgattctgtatcgtcctgggtctatgtggctgcctggctgtctgtaatcatctgttttatttttatttttttc

SEQ ID NO: 25548 - DNA, 201 bp, Homo sapiens
gttacaccatggatcccagtgtcaggtgggagtactgcaacctgacacaatgcctggtgacagaatcaagtgtccttgcaactctcacggtggtcccagayccaagcacagaggcttcttctgaagaaggtaggaagtctatggccagacaaccacaccctaggacgttgggatgaaaagagttgcaaaatcttagtgata

SEQ ID NO: 25549 - DNA, 201 bp, Homo sapiens
agtgaccttgcatagatcttgtcataaaaaatgaaagagaccttgggaaggtcttgggctggtcacttttgtcagagtccagggctgtggggtgaaagccrcagctatagagcttcattctggagtcacttagctttgctctcctggggacaggctgtgcctattcttgcctcaggcatcaaaaaaagtggcacagatggg

SEQ ID NO: 25550 - DNA, 201 bp, Homo sapiens
tagtctgcccagctgtctccctttatgccatgagtgccactgttctttcaactcatcccccattccctcagtcccggaattgctgtggccagcagaggatrgactgagagcaggagaggaagtcctgaccaggaacccatcctagagatactgcatcctgcctgaaagctaggtttccagggcagctttgagaagtcttgc

SEQ ID NO: 25551 - DNA, 201 bp, Homo sapiens
tcctttgctttgggaatatgaacatgatcaaaactgagtgaacttgtcttcctggctttctgtacaatgaagtagaacaaaccatccaatttgaccaaagycttggcatgttttctttctaggtttggaaagcacttctgtggaggcaccttaatatccccagagtgggtgctgactgctgctcactgcttgaagaagtac

SEQ ID NO: 25552 - DNA, 201 bp, Homo sapiens
aggaaaagcaaataagacacaaggaaaggggatggatggaaatagtccaaaccaatgacattcagtgaacaagaaaatagaccaacaaaggagtaaatccrtgaaacagaaagttggttctttgaaaagattcatgtgattgaccacagtctggctgaacagatgacagaccaaggagggagtacaaccatcaccatttga

SEQ ID NO: 25553 - DNA, 201 bp, Homo sapiens
atttcaattcccgaaggtttgtttgccatttttgtcatgggtaataagtaaaaaaaaaaaaattaagatgtgtatatatatatatatatatatatatatayacacacacacacacacacaaacatctgaatatttatatatatgtctgaatatttatatacttgtgtataaaacttatatttaaatttttgcataaattta

SEQ ID NO: 25554 - DNA, 201 bp, Homo sapiens
atttttgtataagtaatgcccttctttgtctcttttgatctttgttggcttaaagtatattttatcagagactagaattgcaatccctgcttttttttttytttttgctttccttttgcttggtaaatattcttccatccctttattttgagcctatgtatgtctgcacatgagataggtttcctgaatacagcacaccaa

SEQ ID NO: 25555 - DNA, 201 bp, Homo sapiens
gggggaatattggaaaatccacaaatagatagaaattaatcaatatgctcctgaacaatcaatgagtcgaagaagatattaaaagaggaaattttaaaaamtcaagacatgagttcatgtcctttgcagggacatgaatgaagctggaaaccatcattctcagcaaactatcataaggacagaaatccaaacaccgcatgt

SEQ ID NO: 25556 - DNA, 201 bp, Homo sapiens
ataacattttaaatatttatatataaatattcaggtatgtaactgaatattcatttacacacacaaatatatgtgtgcatgtgtgtatatatatatatacmcatatatatatatatatatacacatatatatatatatatatatagtatatatatatatatatatatatacacatatatatatatatatatatgtatatat

SEQ ID NO: 25557 - DNA, 201 bp, Homo sapiens
gacagagaaacatttgtacgtgcataaaacaatctacaagactcacttcaaaatctctcagttaatccaaagtaacatatttggcagaaggtggaaggagrgtattctgatcctttcttgtacacattgatgttttctctcggttttcttatggagtatagacgagtttggatgtgttacaataagaatgataatctgtct

SEQ ID NO: 25558 - DNA, 201 bp, Homo sapiens
actacagttctagattggtaggaatctgtaggtttgctgtatgttttttggttggttttctcccatccatctgcctacaggtaagggaaagataacgttcrtaattctcatagactcctttctggttgtgtcataaatggcttcacatatttcgttattctcagagatactcagtttatttcttgtgttttcatttcagca

SEQ ID NO: 25559 - DNA, 201 bp, Homo sapiens
atgcgacttcttttcccaccttgtgccacagcatcctcttcatttgattgtgggaagcctcaagtggagccgaagaaatgtcctggaagcattgtaggggkgtgtgtggcccacccacattcctggccctggcaagtcagtctcagaacaaggtaagaacaggcccagaaaccatctatactgtccttccatgtaagcccc

SEQ ID NO: 25560 - DNA, 201 bp, Homo sapiens
gaggcacactctccaccactatcacaggaagaacatgtcagtcttggtcgtctatgacaccacattggcatcggaggatcccattatactatccaaatgcrtatgtctatcatgttagccataaaaggaacaatagtcaactaaaatttctcttagctggcccatgctacaagctcacttcctaggtccaaatttctcata

SEQ ID NO: 25561 - DNA, 201 bp, Homo sapiens
gaagagaaatgttaagctgcctcaccttcctcctagttttgtggagcagaagggaaatgaggaggcgaggagatcaccttatgaagaaagtcagaatgacraaccaccaaacacttagattacccttgcccaacacccactaagcgtcaatgaagactttccagttggaattccgttattctgacttccaattcctgaagg

SEQ ID NO: 25562 - DNA, 201 bp, Homo sapiens
gaagggatttctcagtgttctcatccctgcttctcatggaacatttatctccgttgttttttgagaagaagagtagtggatgtcagctttcttgtaatgakggatcctgggcccaagattccctgtctcccctcctaggctataaaattttggcctgtactccttctccctgagaggcaatgtgtctttacctacaagtcc

SEQ ID NO: 25563 - DNA, 201 bp, Homo sapiens
gacaggatcaaattcacacataacaatattaaccttaaatgtaaatgggctaaatgccccaattaaaagacacagactgggaaattgaataaagagtcaakacccattggtttgctgtgttcagaagacccatctcagggtgaaaagacatacatgggctcaaaataaagaaatgaaggaatatttaccaagcaaatggaa

SEQ ID NO: 25564 - DNA, 201 bp, Homo sapiens
aggttgtgtttgccatgtttgtcttgggtaacaagtgaaggatatctatattgacttcgagatcttccgatcactttctcctctaacctgtataaacacaytgggttctgagaacaaggtgtctgaaaagctatgtgttgccagcccatgaggggcaaaaggaggaaggcagctgagagtcaggaagtatagagatgctga

SEQ ID NO: 25565 - DNA, 201 bp, Homo sapiens
ttccctttttctgtcattttcctattatttttaaaacctcacctccttgactccttgttccctttttctgcactgctgagtctgggagcactgaggccagrtaaaaggaaacttggcaaatgaggggcacctatgggtgtgggaggctgctcctggtgtttgcatattttaaaatttaaatgctacaaaccactgtgagtt

SEQ ID NO: 25566 - DNA, 201 bp, Homo sapiens
tgtcacaggaaggacctgtcaatcttggtcatctatgataccacactggcatcagaggaccccagaaaactacccaaatgcgtatgtatttgattaaaacmataagaggagcaacagccaactcaaatattggttagaagacccatgctttaagctcacttcctagggacaaatttctcttagactcacattttggcaaaa

SEQ ID NO: 25567 - DNA, 201 bp, Homo sapiens
ttagtctgattggcttccctttccgggtaacccaacctttctctctggctgcccttagaaatttttccttcatttcaaccttggtgaatctgacgattatstcttgaggtggctcttctcgaggagtatctttgtggtgttctctgtatttcctgaatttgaatgttggtctgtcttgctaggttggggaagctctccttg

SEQ ID NO: 25568 - DNA, 201 bp, Homo sapiens
gaagaagaagaagaagaagagtaagagaaattttttggagccgcaggaggagccagaagaagaagaagaagaagaagaagaagaagaagaagaagaaggargaagaagaagaagaagaagaagaagaagaagaagaagaagaagaagaagaagaagaagaagaagaagaaaatagaaatgagtgcatatatttatatatga

SEQ ID NO: 25569 - DNA, 201 bp, Homo sapiens
aaatttcaattcccgaaggtttgtttgccatttttgtcatgggtaataagtaaaaaaaaaaaaattaagatgtgtatatatatatatatatatatatatayacacacacacacacacacacaaacatctgaatatttatatatatgtctgaatatttatatacttgtgtataaaacttatatttaaatttttgcataaatt

SEQ ID NO: 25570 - DNA, 201 bp, Homo sapiens
cccatcccatgacaggccccggtgtgtgatgttccccactctgtgtccatgtactctcattgttcaattcccacctatgagtgagaacattcggtgtttgratttctgtccttgtgatagtttgctgagaatgatggtttccagcttcatccacatccctacaaaggacatgaagtcatccttctttatggctgcatagta

SEQ ID NO: 25571 - DNA, 201 bp, Homo sapiens
acacacctccacaaatactaaaaaatgaaatccactgatcctcacagacaggcgggaaaatataaaaagatttcctgcatgtgggtaggaagtcacagaasgagaggaaggagagattgctacaggaacaaatactggaagcaaggatagctaaaaacttttcaaataagaagaatattaaaaaccacagattcaagaagc

SEQ ID NO: 25572 - DNA, 201 bp, Homo sapiens
aacaaatactggaagcaaggatagctaaaaacttttcaaataagaagaatattaaaaaccacagattcaagaagctgaatgaatcagacagggaatttccaaaaaaaaaaaaaaaaaactgtatgattcacttttgtacatcaccgttcaacagtcagaaggcaaagatataataacaagaaacatctcatgagaaactgg

SEQ ID NO: 25573 - DNA, 201 bp, Homo sapiens
ccccagtctaagtgttgctcagaaactccccagatctgtccctgaatgcatattcagatcatctaaggagacgtcttggggcttgagttccagatccatarcaagggagccgtaagtgccataactacctcaggccactcaccttcctggtgtgtgctggtcaccagtgactgaagtggtggcttttccagtagagaggaa

SEQ ID NO: 25574 - DNA, 201 bp, Homo sapiens
agaggtgatctaatcagcccgggatagtcccaccgaacccttctttgtctagcgtgggatgcatgaaaaacaaatttagagtcattatgatgaaaaactgycctcttctgcagctgagaagaaaaaaaaaatacgagcagcaggaaacagctaagcatgtaatgcacattgtaaacctcagatggccatcctaggaaatca

SEQ ID NO: 25575 - DNA, 201 bp, Homo sapiens
gcaatactgagcttgattttctcttttaatttcagcaccaactgaaaacagcactggggtccaggactgctaccgaggtgatggacagagttatcgaggcmcactctccaccactatcacaggaagaacatgtcagtcttggtcgtctatgacaccacattggcatcggaggatcccattatactatccaaatgcgtatgt

SEQ ID NO: 25576 - DNA, 201 bp, Homo sapiens
tctgaagttgacctgggacgctcaagcttggtgggaggaggggtatccacaaatactggggcttgagtaggaggttttcccctcacagtgtaagcaaaacygctaggaagtttgaactgggcagggtgcactgcagcttggcaaagccattgtagcaagagtgcctctctagattcctcctctctgggcagggcatctctg

SEQ ID NO: 25577 - DNA, 201 bp, Homo sapiens
ccgaacccttctttgtctagcgtgggatgcatgaaaaacaaatttagagtcattatgatgaaaaactgtcctcttctgcagctgagaagaaaaaaaaaatwcgagcagcaggaaacagctaagcatgtaatgcacattgtaaacctcagatggccatcctaggaaatcaatgaagggtagtgcagctctttagccccagat

SEQ ID NO: 25578 - DNA, 201 bp, Homo sapiens
tagacagatagagatacttttgtatgtgcataaccaattccacaatacacacgtcaaaatccataccagttattccagagagatggattgggcagaaggcrgaaggaggatattctgatccctttttggccacatgtatgtataatctcagtgtttctaggaagtgtgtgctgcattagattttttttctttaaaaaaagt

SEQ ID NO: 25579 - DNA, 201 bp, Homo sapiens
ggaagaacttgccaagcttggtcatctatgacaccacaccagcatagtcggaccccagaaaactacccaaatgcgtacgtctttgttctttaccataagcraaggaagggccaatggaagtttctgttagaagagtcatgcttcaaggtgactgctcaggactcaacttggctcagatgcagaggaacatttcctgtgagc

SEQ ID NO: 25580 - DNA, 201 bp, Homo sapiens
caaatgcgacttcttttcccaccttgtgccacagcatcctcttcatttgattgtgggaagcctcaagtggagccgaagaaatgtcctggaagcattgtagsggggtgtgtggcccacccacattcctggccctggcaagtcagtctcagaacaaggtaagaacaggcccagaaaccatctatactgtccttccatgtaagc

SEQ ID NO: 25581 - DNA, 201 bp, Homo sapiens
gtgttttcatttcagcaccgactgagcagaggcctggggtgcaggagtgctaccacggtaatggacagagttatcgaggcacatactccaccactgtcachggaagaacctgccaagcttggtcatctatgacaccacactcgcatagtcggaccccagaatactacccaaatgcgtatgtctttgttctttaccataaga

SEQ ID NO: 25582 - DNA, 201 bp, Homo sapiens
tgttacaatatgaatgataatttgtctttgagatgttcgcagttgtttagaagttgaggaccatttgtgcatattatgggacctttagtgaaaatatttcaaagtctctttttacactttgttacagcaaaatgtagagggcgctaagtgcccttgaatcttctcccatctctggtgacctgtgttgttttgaaatttgca

SEQ ID NO: 25583 - DNA, 201 bp, Homo sapiens
gttacaatatgaatgataatttgtctttgagatgttcgcagttgtttagaagttgaggaccatttgtgcatattatgggacctttagtgaaaatatttcaaagtctctttttacactttgttacagcaaaatgtagagggcgctaagtgcccttgaatcttctcccatctctggtgacctgtgttgttttgaaatttgcag

SEQ ID NO: 25584 - DNA, 201 bp, Homo sapiens
ccttccgaacaaggtaaggagtctgtggccagacatctacacgcttcgatgctgggatgaaaagccatggaaattcccactgatgcagccgccttcaatgktaaacggatgctcgagtgttgcctgagttctaccatgttgggggaagcctccgtgtactctctgggggagccagcggagtgatttctggtgcaacgtggt

SEQ ID NO: 25585 - DNA, 201 bp, Homo sapiens
ctgtgttgttttgaaatttgcagtggcctgaccaggaactactgcaggaatccagatgctgagattcgcccttggtgttacaccatggatcccagtgtcaggtgggagtactgcaacctgacacaatgcctggtgacagaatcaagtgtccttgcaactctcacggtggtcccagatccaagcacagaggcttcttctgaa

SEQ ID NO: 25586 - DNA, 201 bp, Homo sapiens
tctttaccataagagaataaagggccaactgaagtttctgtgacaagagacatgcttcaagctgagttctccgaactcaacttgtgtcagattcagatggygtagcaaaatgtctcaggatgatttccttggagctaagggtctgagagaagagaaatgttaagctgcctcaccttcctcctagttttgtggagcagaagg

SEQ ID NO: 25587 - DNA, 201 bp, Homo sapiens
accgatccgtgtgtgaggtgggagtactgcaatctgacacaatgctcagaaacagaatcaggtgtcctagagactcccactgttgttccagttccaagcayggaggctcattctgaagcaggtaagaagtctgtggccagatatctacacatttgaacattgggatgaaaagagatggaaaatctgactgatgcagaagcc

SEQ ID NO: 25588 - DNA, 201 bp, Homo sapiens
agaaatgttaagctgcctcaccttcctcctagttttgtggagcagaagggaaatgaggaggcgaggagatcaccttatgaagaaagtcagaatgacgaacsaccaaacacttagattacccttgcccaacacccactaagcgtcaatgaagactttccagttggaattccgttattctgacttccaattcctgaagggaag

SEQ ID NO: 25589 - DNA, 201 bp, Homo sapiens
ctgtaatgaggaattcactggatggccttataaccagtttagatattatggtaggaaaaggtgaacgagaaaatgattcaattaaagctagacaaaccacaagacagacagacagacacaaatacacatacacacaatgactgaaccaattaatcaacagagcctcaaggacatctaggaaaacatccacacatttaatat

SEQ ID NO: 25590 - DNA, 201 bp, Homo sapiens
aagaaaatgaaaaaagaatttccagtatatttatacaaaggaatactattcatcaacaaggaacaagttactgatagtctcagaagcatgaacaaacctcraaaatatattaaggaaagaagccagacgtcaaagtgtatagtctgtatgagtccattcatgtgagtttatagaaaacacaatttatggtgaaagaaacca

SEQ ID NO: 25591 - DNA, 201 bp, Homo sapiens
tgtaatgaggaattcactggatggccttataaccagtttagatattatggtaggaaaaggtgaacgagaaaatgattcaattaaagctagacaaaccacaagacagacagacagacacaaatacacatacacacaatgactgaaccaattaatcaacagagcctcaaggacatctaggaaaacatccacacatttaatata

SEQ ID NO: 25592 - DNA, 201 bp, Homo sapiens
aagggactgccgtcgcgcctccgactgttaccccggttccaagcctagaggctccttccgaacaaggtaaggagtctgtggccagacatctacacgcttcsatgctgggatgaaaagccatggaaattcccactgatgcagccgccttcaatggtaaacggatgctcgagtgttgcctgagttctaccatgttgggggaag

SEQ ID NO: 25593 - DNA, 201 bp, Homo sapiens
cataacattggtgagaagaaaattagaagatctaaataaagacacatcatgcttatagattaaaaaatccaatgtcacttttcacaaaactgatctttagyttcaacccacacccaagcagaattcctgcagtcttttcttgaaaacctaacagaatgtatatgctagaatcaccaagacaatctttaaaaagaataaaaa

SEQ ID NO: 25594 - DNA, 201 bp, Homo sapiens
tggtctatcaattttgttgatcttttcaaaaaaccagctcctggattcattgatgttttgaaggtttttttgtgtctctatctccttcagttctgctctgrtcttagttatttcttgccttctgctagctttttaatgtgtttgctcttgcttctctagttcttttaatggtgatgttagggtgtcaattttagatctttc

SEQ ID NO: 25595 - DNA, 201 bp, Homo sapiens
gttttccagtgacattttccactgtcacacccttttagagaataatttggcaatgttactgtgagatagaaatatgtctatataattatgggaactgagayttcagaaagtaataaggaataagaatgaaatttatgaacaaacatgtggaaggttggaagcaagagtggggccaacacgcatggggaggaagcatttggg

SEQ ID NO: 25596 - DNA, 201 bp, Homo sapiens
gtaatgaggaattcactggatggccttataaccagtttagatattatggtaggaaaaggtgaacgagaaaatgattcaattaaagctagacaaaccacaagacagacagacagacacaaatacacatacacacaatgactgaaccaattaatcaacagagcctcaaggacatctaggaaaacatccacacatttaatatat

SEQ ID NO: 25597 - DNA, 201 bp, Homo sapiens
tagaaagaaataactttgtcaaaaaatataataatgatagaaaggaagaaggaacgctcccttttgtcttctaagaatagatgtgaaatgtgtgtgccttrgaatatcttctccctctcctgctccacgtgagctggagcttacatgcctgcttgttttcagtactgccgtaaccctgatggtgacatcaatggtccctgg

SEQ ID NO: 25598 - DNA, 201 bp, Homo sapiens
tccatctggaaaaacagcatttcctctggcactttagcagaggttctgtttcaatttggcgaaggaaattaagcagtttttcacaaaagaagaactacaaygaggagaattgtccctagtatttcttctccctaattgtcaaggaagtgtaaattagaaaatgaatcaggacaatttccacctactatgttagctaatatt

SEQ ID NO: 25599 - DNA, 201 bp, Homo sapiens
aatgaggaattcactggatggccttataaccagtttagatattatggtaggaaaaggtgaacgagaaaatgattcaattaaagctagacaaaccacaagacagacagacagacacaaatacacatacacacaatgactgaaccaattaatcaacagagcctcaaggacatctaggaaaacatccacacatttaatatatgt

SEQ ID NO: 25600 - DNA, 201 bp, Homo sapiens
agctgggcttgcaacattggaaacttggattatttgtgagagcactgagaaatccctgggcatgtccatctggaaaaacagcatttcctctggcactttarcagaggttctgtttcaatttggcgaaggaaattaagcagtttttcacaaaagaagaactacaacgaggagaattgtccctagtatttcttctccctaatt

SEQ ID NO: 25601 - DNA, 201 bp, Homo sapiens
gcttcttgctttgggcacagggtctgagaggagagaaatgtcaggccagctctcttttctcatagttgatagaagtaggaggatacttggaggtggtgagktctcatgaatagaaagctcagaagaacatatgaccatgtgcttagaaatagcaccattccacaatgcccactaaagaccagtgaaatagttcaaccaggg

SEQ ID NO: 25602 - DNA, 201 bp, Homo sapiens
tggatagaagccctggtctgaccaccccatggccaatcatttggccataatcaacaaccaaagacatggaaaaatggtttctacatgtgggacaacagatsgtagaggacctagagaattgagagagggccaatgatgagctcaactccatagatgccttggctttcttcctggatacccttcctgcactgaatagcaagg

SEQ ID NO: 25603 - DNA, 201 bp, Homo sapiens
aacagttacacaaatgactgatgccttctcatcagaaacaatgaaagtcagaaacaataaagtaacatctttaaagtaatagaagaaaaacccaagaggtragggatcatggcagacaggaggcaggactagattgcagctctggacagagcagcatgcagaggctcatattgtgaattttagccccatattgactgcaag

SEQ ID NO: 25604 - DNA, 201 bp, Homo sapiens
acccttcctgcactgaatagcaaggagatggagctcaagcagcctgtagccatctagctgagcagaggagagggattggagtttgggatgactctggtatwttctaggtccgctacaaataagaactggtttgtggaggaaaggagctctacaaatacgcatagaagtctcctccagtagttggcctcacatgacactgca

SEQ ID NO: 25605 - DNA, 201 bp, Homo sapiens
gtttgggatgactctggtattttctaggtccgctacaaataagaactggtttgtggaggaaaggagctctacaaatacgcatagaagtctcctccagtagytggcctcacatgacactgcatgtgcacagaaaatggttctacagaaagtgtggcaaagaacatttactgagaaacagcaactacaagagaacagcaagct

SEQ ID NO: 25606 - DNA, 201 bp, Homo sapiens
agcaagtgtccaagcatcaaatgggtttccaatcaatgaagtgcctgtgagaggaaatctcaactctcttcagaagtaaacaacaaagtcaattgcctcarctatgcggtatccccagagtgagtcctaaattaaaaatttgactacgtgtagaaaagaatttcgtgtgatccatgaccagaaaataaatcaggcaataca

SEQ ID NO: 25607 - DNA, 201 bp, Homo sapiens
ccactgttgttccagttccaagcatggaggctcattctgaagcaggtaagaagtctgtggccagatatctacacatttgaacattgggatgaaaagagatrgaaaatctgactgatgcagaagccttccatgctacacagaaacttgagggtatggcaggtggaaagaagcctcagcactctctctggtggagcaattttt

SEQ ID NO: 25608 - DNA, 201 bp, Homo sapiens
gtgcatgtgtgtatatatatatatacccatatatatatatatatatacacatatatatatatatatatatagtatatatatatatatatatatatacacayatatatatatatatatatgtatatatatatatatatatatatacacacacacacacacacacatacatacaggtataaacacactgggcctgaagcacca

SEQ ID NO: 25609 - DNA, 201 bp, Homo sapiens
aacaaagtcaattgcctcagctatgcggtatccccagagtgagtcctaaattaaaaatttgactacgtgtagaaaagaatttcgtgtgatccatgaccagraaataaatcaggcaatacaaacaggctcagaaatgacatcgataattagaattgcatgaaaatttgacatatcagtatgataactgatttcagatattta

SEQ ID NO: 25610 - DNA, 201 bp, Homo sapiens
tctgtcattctaaatttcaattcccgaaggtttgtttgccatttttgtcatgggtaataagtaaaaaaaaaaaaattaagatgtgtatatatatatatatrtatatatatatacacacacacacacacacacaaacatctgaatatttatatatatgtctgaatatttatatacttgtgtataaaacttatatttaaattt

SEQ ID NO: 25611 - DNA, 201 bp, Homo sapiens
tcttgtgatcagatatcacaagagaagaaagagatacttgaacagaaaaaatgcctgaagcaatgatggctgaaaactttccaaatatgaagaaaaaaaarctcacagattcaagaaaactaatcaatcagaaatatgattttgaaaagtaaaaatgtatgatttactttggcaaatcttcttggttaaattgtctaaaat

SEQ ID NO: 25612 - DNA, 201 bp, Homo sapiens
ttacctacagtctatcacaggcacagatttttttttacacttttgtgaatcattgaattcaatgccgaggctattcatctattcacaaacacatgaacaarttatgggttgtgatccccataaatgaagagtaatcagtccgaacccacagaacctggacattttgggtatcgtttcagtggaacatgcaattcgtaagtt

SEQ ID NO: 25613 - DNA, 201 bp, Homo sapiens
cactttgcagtgagaagatctgttctgttctgtttttctaaggatttcaggtgaaatatttcctagaacttactacagttctagattggtaggaatctgtrggtttgctgtatgttttttggttggttttctcccatccatctgcctacaggtaagggaaagataacgttcgtaattctcatagactcctttctggttgtg

SEQ ID NO: 25614 - DNA, 201 bp, Homo sapiens
atatacacatatatatatatatatatatagtatatatatatatatatatatatacacatatatatatatatatatatgtatatatatatatatatatatayacacacacacacacacacacatacatacaggtataaacacactgggcctgaagcaccagtggtctgaaaggacatgtgttgccaggacttgaagagcaaa

SEQ ID NO: 25615 - DNA, 201 bp, Homo sapiens
ctccttctgaacaaggtaaggagcctgtggccagaaacctacacgtttcgatgctgggatgaaaagccatggaaattcccactgatgcagcagcctccaayggtaaacggatgctcgagtgttgactgagttctgtcatgtaggaggaagcctccgtgcactctctgggggagccagcggattgatttctggtgcaacgtt

SEQ ID NO: 25616 - DNA, 201 bp, Homo sapiens
tgggactatgtgaaaagattgaacctacgtttgattggtgtacctgaaagtgatgggagaatggaaccaagttggaaaacactcttcaggatattatccaggagaacttccccaacctagcaagacaggccaacattcaaattaaggaaatacagagaataccacattcaaattcaggaaatacagagaacaccacaaaga

SEQ ID NO: 25617 - DNA, 201 bp, Homo sapiens
ggaaatacagagaacaccacaaagatactcctcaagaagagcaacctgaagacacataatcgtcagattcaccaaggttgaaatgaaggaaaaaaatgttragggcagccagagagaaagtttgggttacccacaaagggaaccccatcagactaacagtggatcttcctgcagaaactctacaagccagaagagagtggg

SEQ ID NO: 25618 - DNA, 201 bp, Homo sapiens
caaggaagaaaaagaagtctttcaagtactcaagctctgagcacatccagttgctcattgaaccagcttcctggaatggagggtctgggcttgagactagstcacatgtgtagagtctctagagagacagtgttggatccccatggcccataatacatttcccgttttcccaggcagccacaggtcacgaatgggaggatt

SEQ ID NO: 25619 - DNA, 201 bp, Homo sapiens
ttatatggttttaggtctaacatttaagtctttaatccatcttgaattaatttttatataaggtgtaaggaagggatccagtttcagctttctacatatgkctaggcagttttcccagcaccatgtattaaatagggaaacctttccctatttcttgtttttgtcaggtttgtcatagatcagatggttgtagatgtgtgg

SEQ ID NO: 25620 - DNA, 201 bp, Homo sapiens
ttggtctaaaattctcatttttgttgtgtctctgccaggatttggtatcaggatgatgctggcctcataaaatgagttagggaggattccctctttttctmtgattggaatagtttcagaagaattggtaccagctcctctttgtatctgtggtagaattcggctatgaatctctcctggactttttttggttggtaggct

SEQ ID NO: 25621 - DNA, 201 bp, Homo sapiens
actttttttggttggtaggctcttaattattgcctcaatttcagagcctgttattggtctattcaaggattcaatttctttctggtttagtcttggtaggktgtatgtgtccaggaatttttccatttcttctagattttctagtttatttgcacagaggtgtttataatattctctgatggtagtttgtatttctgtggg

SEQ ID NO: 25622 - DNA, 201 bp, Homo sapiens
aaaaccaaccgaacctcacagacatgttgcaaaataggaaaagatttcctgcatatgggaagcaagtcacagaaaagagaacgggagattggaaacagaarcaaataccggaatcaaggatggccgaaaacttttcattgatcaagaatattaacaaaatcgcaaaaacacgaaattcaatgcatcaaataggcgtttcga

SEQ ID NO: 25623 - DNA, 201 bp, Homo sapiens
tgcactgtggtctgagagacagtttgttataatttctgttcttttacatttgctgaggaatgcctcacttccaactatctggtcaatttcagaataagtgygatgtggtgctgagaagaatgtatattctgttgatttggggtggagagttctgtagatgtctattaggtctgcttggtgcagagctgagttcaattcctg

SEQ ID NO: 25624 - DNA, 201 bp, Homo sapiens
cttcctccatccctttattttgagcctatgtgtgtctctgcacgtgagatgtgtcttcagaatacagcacactgatggatcttgactctttatccaatttkccagtctgtgtcttttaattggagcatttagcccatttacatttaaggttaatatttttatgtgtgaatttgatcctgtcatcatgatgttcgctggtta

SEQ ID NO: 25625 - DNA, 201 bp, Homo sapiens
gttataaccctcataagatgacactgaacatccagtgtacatggatatcattaagaagacacaataataagtggtgtcaccgatttggagctagaatgtgycactctctcatatgctggtggaagttcaaaatcatacaacaaattaaaaaatcagtctgatgctttcttataaagttcgataaatatgcatctatcctac

SEQ ID NO: 25626 - DNA, 201 bp, Homo sapiens
ttttttctctaaacttctcttctcgcttcatttcattcatttgatctttaatcactgataccctttcttccacttgattgaatcaactactgaaacttgtkcatgtgtcacgtagttctcgtgccatggttttcagctccattagatcatttaaggtcttctctatgctgtttattttagtctgccattcatctaaacttt

SEQ ID NO: 25627 - DNA, 201 bp, Homo sapiens
aaaaaaaaattaagatgtgtatatatatatatatatatatatatatacacacacacacacacacacaaacatctgaatatttatatatatgtctgaatatwtatatacttgtgtataaaacttatatttaaatttttgcataaatttatatatttttaatatttcactaaaaattatattgtttcactatgtatgtctgag

SEQ ID NO: 25628 - DNA, 201 bp, Homo sapiens
gttttcagctccattagatcatttaaggtcttctctatgctgtttattttagtctgccattcatctaaactttttcaaggtttttagcttctttgcaatgrgttcgaacatccttctttagctcggagaaatttgttattacagatcgtctgaagccttcttctctcaactcatcaaagtcattctctgtccagctttgtt

SEQ ID NO: 25629 - DNA, 201 bp, Homo sapiens
gtatatatatatatacccatatatatatatatatatacacatatatatatatatatatatagtatatatatatatatatatatatacacatatatatatayatatatatgtatatatatatatatatatatatacacacacacacacacacacatacatacaggtataaacacactgggcctgaagcaccagtggtctgaa

SEQ ID NO: 25630 - DNA, 201 bp, Homo sapiens
tatatatacccatatatatatatatatatacacatatatatatatatatatatagtatatatatatatatatatatatacacatatatatatatatatatrtgtatatatatatatatatatatatacacacacacacacacacacatacatacaggtataaacacactgggcctgaagcaccagtggtctgaaaggacat

SEQ ID NO: 25631 - DNA, 201 bp, Homo sapiens
tatatatatatatatacacatatatatatatatatatatagtatatatatatatatatatatatacacatatatatatatatatatatgtatatatatatrtatatatatatacacacacacacacacacacatacatacaggtataaacacactgggcctgaagcaccagtggtctgaaaggacatgtgttgccaggact

SEQ ID NO: 25632 - DNA, 201 bp, Homo sapiens
caatggttgaactagtttacagtcccaccaccagtgtaaaaatgttcctatttctccacatcctctctagcatctgttgtttcctgactttttaatgatcmccattctaactggtatgagatggtatctcattgtggttttgatttgcatttctctgatggccagtgatggtgagcactttttcatgtgtctcttgactgc

SEQ ID NO: 25633 - DNA, 201 bp, Homo sapiens
actgcccaaagtgatttatagattcaatgttatccccatcaagctaccattgatttcttcacataattagaaaaaactactttcaatttcatatggaataraaaaagggcctgtatatccaagacaacctaagcaaaaagaacaaagctggaggcatcatgctatctgacttcaaaatatactacaaggctacagtaacaa

SEQ ID NO: 25634 - DNA, 201 bp, Homo sapiens
atgtaagacctaaaaccataaaaaccctagaagacactttgggaggccgaggtggatggatcacgaggtcaggagatcgagaccatcttggctaacacagkgaaagcccatctctactaaaaatacaaaaaattagctgggtgtggtcgtgggcacctgtagtcccagctacttgggaggctgaggcaggagaatggcatg

SEQ ID NO: 25635 - DNA, 201 bp, Homo sapiens
ggctaacacagtgaaagcccatctctactaaaaatacaaaaaattagctgggtgtggtcgtgggcacctgtagtcccagctacttgggaggctgaggcagragaatggcatgagctgaggaggttgagcttgcagcaagccaagattgtgccactgcactccagcctgggcaacagagtgagactccatcaaaaaaacaaa

SEQ ID NO: 25636 - DNA, 201 bp, Homo sapiens
taagtttcttacctcatgcacaatggtatgtaatattaataaaatgttactgtgtgggttcaaggagatattgcaaatcctagagcaatcacaaagttttsaactctgaggtatattgtataataagaatattccatgtattcaaaagagagaagccaaggaagaaagaaatttgtcacgagtttgggctcttagtacatc

SEQ ID NO: 25637 - DNA, 201 bp, Homo sapiens
agggcttgtcagggggtgggaagctggtgaagggatagcattaggagaaatatctaatgtaaatgacgagttgatgggtgcagcaaaccaacacggcacakgtatacctatgtaacaaacctgcacgttgtgcacatgtaccccagaacttaaagtataataataaaaaaagaaatatttgtttttgatttatatgccaat

SEQ ID NO: 25638 - DNA, 201 bp, Homo sapiens
ctcaagtgcacagggaatattctccagaatagatcatatgttaggtcacaaaactagtcaaaaaatgtaagaagattgaaatcatatcaggttttttttttagatcataatcgtatgaaactagaaatcaataatgggggaatattggaaaatccacaaatagatagaaattaatcaatatgctcctgaacaatcaatgag

SEQ ID NO: 25639 - DNA, 201 bp, Homo sapiens
gcttttttttttctttttgctttccttttgcttggtaaatattcttccatccctttattttgagcctatgtatgtctgcacatgagataggtttcctgaayacagcacaccaatgggtcttgactctttattcaatttgccagtctgtgtcttttaattgggggcatttagtccatttacatttaaggttaatattgttat

SEQ ID NO: 25640 - DNA, 201 bp, Homo sapiens
tttcgagaaaaaaaactacatgatgcacttctctacatcacagttcaaaggtaacaaggcaaggatataagaagaagaaacatctcacgagaaactggagraaaaagagctgtgtcttcctagagtacagtgatacaaattgctaatgcgttcacctcagaaacactggaagccagataccagggaatattattaaaatga

SEQ ID NO: 25641 - DNA, 201 bp, Homo sapiens
ctcagactactgtgctagcagttcaatctcagactgctgtactagcagtgagcaaggctctgtgggcatgggaccctctgagccatgtgcaggatataatmtcctggtgtgccgtttgctaagaccattggaaaagtgcaatattagggtgggagtgtcccgattttccgggtacatctgtcatggcttcccttggctagg

SEQ ID NO: 25642 - DNA, 201 bp, Homo sapiens
attgtaaacaccatcaacactataaagaaactgcatcaactaatgggcaaaatagccagctagcatcataatgacaggatcaaattcacacataacaataytaaccttaaatgtaaatgggctaaatgccccaattaaaagacacagactgggaaattgaataaagagtcaagacccattggtttgctgtgttcagaagac

SEQ ID NO: 25643 - DNA, 201 bp, Homo sapiens
atcatgctaaaaactcttaataaactaggtattgatggagcatgtctcaaaataataagagctacttatgacaaatgcatagccaatatcatactgaatgrgcagaagctggaagcattccctttgaaaaccagcacaagacaaggatgccctctctcaccactcctattcaacatagtattggaaattctgtccagggca

SEQ ID NO: 25644 - DNA, 201 bp, Homo sapiens
caaactggacaaaaataagcaatggggaaaggattccctatttaataaatggtgttgggaaaactggctagccatatgcagaaaactgaaactggatcccytccttacaccttatacacaaattaactcaagatagattaaagaattaaatgtaagacctaaaaccataaaaaccctagaagacactttgggaggccgagg

SEQ ID NO: 25645 - DNA, 201 bp, Homo sapiens
cttctatttaaaaatttaatagagacacaagaagctttcactgtgatacataactgggagaaaaaatcactcaacacaaacaggcccagaaattatagaaytgatgacattggtgagaacatttaaaatgcacctctgagaactgtgtttcaggaaaatgtcagcaaaagctgaccatgagagaaacaaaagcagaatagc

SEQ ID NO: 25646 - DNA, 201 bp, Homo sapiens
gaaaaccaaacaccatatgttctcactcataagtgtgagttgaacaatgagaacacatggacacaggaaggggaacatcacacacaggggcctgttggggwgttgaggctaggggagggattggattaggagaaatacctaatgtagatgatgggttgctgggtgcagcaaaccaccatgacacgtgtatacctatgtaac

SEQ ID NO: 25647 - DNA, 201 bp, Homo sapiens
ataatttgcaacctactggtacacttgaatactattcagcactgagtatcttaaatagcatggatggagctcaaaaatatactcaggaaagaagccatgtrtattctgtatgagttcatttacatgagatcatttacatttcctccaaaagaggaaaaactaatttctgttgaaagaaaccaatgtatttgcctctggcag

SEQ ID NO: 25648 - DNA, 201 bp, Homo sapiens
tatatatgttcatataagttagtattcatatatatgttcatatatatatgttcatacagactagtattcatatatatatacatatatatatacacacacayatatatatatatatatatgttctagggaaacatgcaaggtttttatgtctgtccctgactgatgaccaaataccctatagcctgcacagctgcaagctgt

SEQ ID NO: 25649 - DNA, 201 bp, Homo sapiens
ggattgacactaggccacatgtatagagtctctagagagacagtgtttcatccccatggcccgtaatacatttcccattttctcaggcagccacaggtcaygaatgtgaggatagagagaggttggagcaacgttcttgggaggcataaggaagagcaaatgcttcaagatccccgcagcccaaactcctacctgctttgc

SEQ ID NO: 25650 - DNA, 201 bp, Homo sapiens
ggaaaatttccggaaacttcataagttccagaaatttatgaaatcaggtaaaaacggaaaatccatcaggaaaggcagagaaattcctagccaacttaggrgtttcggaaaaagaaagttatttggaataagttatagtaaaactccattctaactgactaataaaaatgagggtagattttcctcatgtttttaaagggt

SEQ ID NO: 25651 - DNA, 201 bp, Homo sapiens
taacttcctttaattatttcttatggcattaccatttaaggataatctaaatgcgtgacctgtacatatttggagatgcatttagggggctaacatcttargtgtgtttactggaagaatagacccttgggaaattatatcggtacttttttcttttttcatccattcaacacatttttattgcatgtttctctgtcccca

SEQ ID NO: 25652 - DNA, 201 bp, Homo sapiens
taattacattcagtggtttttgtaacttcattatttattgggaattagtgatttagtcagtgggagttttgtaaaacttaagattttggcttttttccccmtcctcctggataaccagttaacccaataatggcttggccgatggaagggtaaaatgaggacagttatattttttaaatgtcattactgtcaccaaatcac

SEQ ID NO: 25653 - DNA, 201 bp, Homo sapiens
tgctttcttatatgtcatttatgccataaatcccattgttagaaggtaatgcttctaacggattccattcatgcttttgagataaatggcattgactttcwtattgatcacatggaaagctgttacctgattcctttcctgagatcacttccagcctaatgtgcatttggctggaatatggttgtctcagaataacatcat

SEQ ID NO: 25654 - DNA, 201 bp, Homo sapiens
aatgaggtgggggggaaatcttttgtgtaatgctttataaacatctgcagcttgaatccataaatggcttctcagtgattcagaatgtggagagctgcccwttatgcagctccacaaggaactcatggttacacatttcaaactttggttgagagatgttgtttttccccttaggacactcacatgggagtcaagaaggtg

SEQ ID NO: 25655 - DNA, 201 bp, Homo sapiens
gtaatctgcttccctgaatccccatcttgcttgtagttgtgaagctatgcaactttccttcctctaagcatagtctgactcgtatatgtgtagtagtgatrtgttacaggaaagaggaagcattgcattaggctgggtggggtgaagcaatggacagtaaccagggaaaagatcaaggtcgtactcttccatagcaacttt

SEQ ID NO: 25656 - DNA, 201 bp, Homo sapiens
gatgaatgaatgcatagggggatggctgggtgcatttctctcaacttttcaatttcttgaaataaataacaaaatcttaccttccctcagaagtcctggcrtggttcctttcatcttgccacagccactgataatcactttcattttctgtgtaactcaccaggcaagaagtccatgcagatttacttttagtagttcaca

SEQ ID NO: 25657 - DNA, 201 bp, Homo sapiens
actccttactggtttttggaaagcaaccaacagctaattccaacaccatgggcagcccatacagtctctaattatctgagaaaatcaaatgatgctgttayaataattacgctggtacaagttaataaaagtgccatgttacagtcaaacagctatgttgctatctataccattgagggcatagttttaaaaagtagttat

SEQ ID NO: 25658 - DNA, 201 bp, Homo sapiens
tgatctctgaagccccttaaggtctagtgctccttcttaaattcttataactaggaataacttaaaaattagaatttgtctcttaaaagcacttattagaygcctagagcactgaatattggaatgagttatttatgagaatcatcctaccctcctgaaactactcagacagatagaaacacataaatccaaagggaaatg

SEQ ID NO: 25659 - DNA, 201 bp, Homo sapiens
atgtaaggtggataggtggatgctcttatacaggaaaaaaatgttcctttcaaaagaagcctacatttccttttatatgtttaataatattataccaaagrcatctacaagattcaacaagtcatcctgtccttttttagaaacatagttctcctgaagggacttgaaaatcctgactgatgataaaagattaaagcaaga

SEQ ID NO: 25660 - DNA, 201 bp, Homo sapiens
agggaaagggccttggactgttttggagatttgtaaagtcaaaggccactgtcaacataggataggggatgttgaaacacccagatgtctggtaggaactkgttttgctcccttttaagttttaacaaaagcatcaaattgcataaacaagagccatcctgtccccatataaccattgtaatcaagatttcagtgtgcaca

SEQ ID NO: 25661 - DNA, 201 bp, Homo sapiens
gcttcctgagttcaagcgattctcctgcctcagcctcctgagtagctgagattacagcatgccaccatgcccagctaatttttgtagttttagagatgggrtttcaccatgttggtcaggctggtctcaaactcctgacctcgtgattcacccacttcagcctcctaaagtgctgggattacaggcgtgagccaccgcacc

SEQ ID NO: 25662 - DNA, 201 bp, Homo sapiens
aaaagtgtgtttctgaggaaatttcaatgagtcattcgtttatataacaaatacttgttgagcatctactttctattgggtactgttatagggattagagwtaacagctgcaagcaagtaaaaggcccttgctttctcagagctttcattccaggaaggagagaaagagagtaaccacacacatcaatagatgaccaggct

SEQ ID NO: 25663 - DNA, 201 bp, Homo sapiens
tttttttttgagatggagttttgctttgttgcccaggctggagtgcagtggcgcgacctcggcccactgcaacctctgcttcctgagttcaagcgattctyctgcctcagcctcctgagtagctgagattacagcatgccaccatgcccagctaatttttgtagttttagagatggggtttcaccatgttggtcaggctgg

SEQ ID NO: 25664 - DNA, 201 bp, Homo sapiens
atccagaaataccatggttaccattttaatatacgtcttttttttttttttttttttgagatggagttttgctttgttgcccaggctggagtgcagtggcrcgacctcggcccactgcaacctctgcttcctgagttcaagcgattctcctgcctcagcctcctgagtagctgagattacagcatgccaccatgcccagct

SEQ ID NO: 25665 - DNA, 201 bp, Homo sapiens
ctccagtgacagtgcaggtgggatatctcagggctggaaaccagggccacagtgggcaggagtagaaaggaagaacagaaatcgggccctcctgtcagtcycccccacttctgactctacctccctctccaaactcatctaaaccaggaaaaggtgaggcaaaggtagtgctgagcaggaaatcagagataaaccaaaatt

SEQ ID NO: 25666 - DNA, 201 bp, Homo sapiens
ttcttcctgggttctgcaaactagctgagctcatactcagatctgtccctggcctgtcccagagaagtgccatgttagttactaaagcttccttcctaaaygaatgatcaccaagaggaccccatgtcatacctaggtcctttctatcccaatccaatttccacttatttctggggtccaaggtgaagcatgtaattttcc

SEQ ID NO: 25667 - DNA, 201 bp, Homo sapiens
cactgctgggacagggattgcactttgagagctactgctctggaggaaagccttgcatctgaaagcctcaggaagaattcaagcagtgtcccaatttaacmttgcactacaccagagtgattaagagcttgagctttgtagcaaaaatggcctgagttcgattccagccctccgcatattaactgagcaagatgctttaaa

SEQ ID NO: 25668 - DNA, 201 bp, Homo sapiens
tatgtatattgctgagttgaaagcacttattggaaaatattaaaaggctaacattaaaagactaaaggaaacagactcagaagtctctaatttaaaagaaygggaggctgagagggacagaactatgcttatctggcaccgtctgggtaatttagaggaacaaagtcaaaggtatctgaggtggctgaagcctcacactca

SEQ ID NO: 25669 - DNA, 201 bp, Homo sapiens
ttgtctcccctttttatgcccaagtttgagtgaggctcaccatcagatttaaatgtttacacattgaaaacaaatatgaagatggatatttacatggtggyttccacaataactctctatggaggagcactaggaggtagggattcattagaaatgcttctgaaatagagacagaagtcacaggttcactggggactttag

SEQ ID NO: 25670 - DNA, 201 bp, Homo sapiens
acccagtgtgtggctctaggtgacatgtggccacccaagtgaggtttcggatccacctgcagtgtcagatgcttcaaggctggggtcccctgatggagagraggtggttggagatcacctgggcctcctcagcactgcctcctggctggggctggggctggggataagagagtaactgcaattgtgcttccccggcacctt

SEQ ID NO: 25671 - DNA, 201 bp, Homo sapiens
gtctactctattggtccataacctctatcgagacagtgaccttgtctgctttattcaatgcctggatcttttcctagcacagtgcccagcacatggagacwctgaatttggattctcctttttgaagtccccatatccacttcagtattggggtgattttgatgggattgtgacttaccatggtggatgcatcctgtgagt

SEQ ID NO: 25672 - DNA, 201 bp, Homo sapiens
ttgttggaaatgcagaatccttggccaacccagacctactgaatcaggatctgcattttaactacactctcccacccaggtggtttatatgcacattaaartttggaagcttagactgtgctagactgcttttctcaccattgaagccaattgaacaatctctgtgcatatgtctcagattacatgtcatctcccaacagg

SEQ ID NO: 25673 - DNA, 201 bp, Homo sapiens
gctagactgcttttctcaccattgaagccaattgaacaatctctgtgcatatgtctcagattacatgtcatctcccaacaggaatatcaagtgctcctctytgtggaacttgctactgtggccagtcctaccctggctggatttgtagacatctagggcacaaggcaagacctgctatctcacatccatcttctgtggctt

SEQ ID NO: 25674 - DNA, 201 bp, Homo sapiens
ttggagaccagagggctcaacggaaaacattcttggtttatttccagccagaaaggcttgtttgagagatgcaatcagccatttagtattagcttcttgartcaaagtggatcctgaatcacagagttctctgtttctcaggagagacacacagacatctgaggagtcttgcctctctatagtggtttgcagcatggctag

SEQ ID NO: 25675 - DNA, 201 bp, Homo sapiens
gctcatttatcgctcagagggaggcacttgggacattttattcattacatgatgcaggagatttattggagaccagagggctcaacggaaaacattcttgrtttatttccagccagaaaggcttgtttgagagatgcaatcagccatttagtattagcttcttgaatcaaagtggatcctgaatcacagagttctctgttt

SEQ ID NO: 25676 - DNA, 201 bp, Homo sapiens
tcacaatacaatgagggtaaatccttgcaatcaccagttaccagcaattgtgaagcaatggatggcatagatgtcagggggtcaggagagccttgcaagcrttcagagggcttgggagtggacacatcacagttgcactctgctgggcagcgctgtaagtctctgattggattttgccttgaattttttctggtcaagact

SEQ ID NO: 25677 - DNA, 201 bp, Homo sapiens
ttgcatgaggtgaaaaaagctgctccttgtcctgtattcttgtgcatggaacctaccagggctggtttcctcacatgagtagggactgaagccttatctgrgagccagtttgcccccagttgtttcaagaaataaagtgtcctcttggtcacagacagcagcagtaacaactttttcctgcggactggcagcattttccaa

SEQ ID NO: 25678 - DNA, 201 bp, Homo sapiens
gaaagaaaaatggaaatcataaagattgcacgacttaggattttgtcaaaatgtgtcagaggctataatataaggctagtttttggcattctgtcagtcaytgaatgtccttcgtcagatcacagctccttttggttgtgctgactttatacccatctggaatccactgaccattagctgaaataaaatcccagatgtgct

SEQ ID NO: 25679 - DNA, 201 bp, Homo sapiens
agtttggcactacagaccagctttataggacaaaaaaaccttctttcagagctcctttttctcgccttcctgacagctccctagcagacctcttcccatgygggtagggagataaggttcctagacactgggacactggtctccatgacccctctgtgctgcccacagccctatagtaatgagcgtgctaaaggcctggtg

SEQ ID NO: 25680 - DNA, 201 bp, Homo sapiens
catggagacactgaatttggattctcctttttgaagtccccatatccacttcagtattggggtgattttgatgggattgtgacttaccatggtggatgcakcctgtgagttccaaactcaacttcttaaaaaaccttgtctatcatctatccatctatctgtctgtctgtctatctatctatctatctatctatctatcta

SEQ ID NO: 25681 - DNA, 201 bp, Homo sapiens
caccatttgccccaactgtgttcctgctgcacttgaaaatgattccagctgcctctggaagattttcatcccatttctgggaaaaacattagccaataaaytctcattgaatttggcagggcgggcacaccagcaagctgacactatgtgcatacaggcttcctggaacaactgttgctgagcaaatgaagcagcatggaa

SEQ ID NO: 25682 - DNA, 201 bp, Homo sapiens
taagatttcaaacaattgttctgaaagaaaattagtagctatttaataaggactgtctatgcatatagcagatatttaaatcataataagtataaagtaamctcaaaagcgtctcaataaggacagcatctctcttccaaacctcaatgggttttgctggctgcacttccagggcaagttgtcttggccacactttacttc

SEQ ID NO: 25683 - DNA, 201 bp, Homo sapiens
tttctaacaggttccaagatgatgcttttgctgctggtccagggacctcactttgaggagtgctggttgttatgagtctggttgttaagtgctggttgttwgttgttaaagtagagaaaacccctagcacagtgcttggcacacactaaagccatcataaaccatagtgatcatcaatgatggtgctcagtaaggatgatg

SEQ ID NO: 25684 - DNA, 201 bp, Homo sapiens
ggcctccaataggtgttcatttattcagcaaacatcttttgagtggctcctgtgactaccagccctggcaaggagaaagagaaggtaaaaaacaaaaagastaccaccccttttctaaaagaatcttgaggtttagtggcagtattggcctcttgaatttgaattggctaatatttattgagaacattccctgtgccagac

SEQ ID NO: 25685 - DNA, 201 bp, Homo sapiens; identical to SEQ ID NO: 4272

SEQ ID NO: 25686 - DNA, 201 bp, Homo sapiens
ggaagaacagaaatcgggccctcctgtcagtctcccccacttctgactctacctccctctccaaactcatctaaaccaggaaaaggtgaggcaaaggtagygctgagcaggaaatcagagataaaccaaaatttccaagaagaaaacagataatgagactttccatgcctcttctttctcaagccctggttcattgcacac

SEQ ID NO: 25687 - DNA, 201 bp, Homo sapiens
ttcccagctccagtgacagtgcaggtgggatatctcagggctggaaaccagggccacagtgggcaggagtagaaaggaagaacagaaatcgggccctcctstcagtctcccccacttctgactctacctccctctccaaactcatctaaaccaggaaaaggtgaggcaaaggtagtgctgagcaggaaatcagagataaac

SEQ ID NO: 25688 - DNA, 201 bp, Homo sapiens
tgtcttaatctaaagctttctggtgatagatgtttgagaagctaggattatattaactagtcatgttgaaactacagatttaactttaaaaaattattttwaacttactataatacccatattccaatacacattattaatgttagctatcatctcaccatttccttttttacttattttcaattttttttgaaaataagt

SEQ ID NO: 25689 - DNA, 201 bp, Homo sapiens
aagtagaaagatatgttgacagctattggtgaggaaaatagacaattatgtctcccaactgatattcttctcacagtccaggcaactcctagtagtacaayggaagaaacagctacccagaaggaacagtggtttggcaacagatggcatgagggatatcgccaaacacccagagaagactcccattcgacaacagggaca

SEQ ID NO: 25690 - DNA, 201 bp, Homo sapiens
ttctcacagtccaggcaactcctagtagtacaacggaagaaacagctacccagaaggaacagtggtttggcaacagatggcatgagggatatcgccaaacmcccagagaagactcccattcgacaacagggacagctggtaatggatggtttaacaagtaaatttggatggaaacttccttttgggttaaacggtagacat

SEQ ID NO: 25691 - DNA, 201 bp, Homo sapiens
acccagaaggaacagtggtttggcaacagatggcatgagggatatcgccaaacacccagagaagactcccattcgacaacagggacagctggtaatggatrgtttaacaagtaaatttggatggaaacttccttttgggttaaacggtagacattgaggacattgaacaaaaggacactggaggaattgtcacgagatgtt

SEQ ID NO: 25692 - DNA, 201 bp, Homo sapiens
attaaacatttggatcatttgatttctcatatcccttttagaatatcagtggcctgtttccttggtgcctttcttttctaccttccctccccatgtgtatmtgcccttaaagtagaaagatatgttgacagctattggtgaggaaaatagacaattatgtctcccaactgatattcttctcacagtccaggcaactcctag

SEQ ID NO: 25693 - DNA, 201 bp, Homo sapiens
aagatcattggggtcacttcatctctgtctgtctttcctgattgattatcctattttcaaagaatgagactcaaaatgtcctgttctgctttgcaaaatakagtttcacataagaaattaccttgggcaaggttgtgagaggatttggaatctaaatggagaaaagtgtagaggcatatttttcaatcttctacttctatg

SEQ ID NO: 25694 - DNA, 201 bp, Homo sapiens
ccatactttcttgggttattggccctcttgagtttgcatcggcttattgttggtagtcccgtgggcaacccttcttgagagaggcttctgcaaaccaagcrggccgtgctgctagctactcactgcttcttgggttccctgtctttttaaagtaaccatgtcgaaggtgcttatcattatggtaggcaattttgtcggatg

SEQ ID NO: 25695 - DNA, 201 bp, Homo sapiens
tgccaaaacagtaaccttgaaaaatattctgggcacctaggccaaaggtggtcaacctcagaagcaacatgctgagaagcagtctatacagagtaagcacytaaaagatcagctaaattaataaatacattattacattaatgaaagactagagattcatttggtttttaatatttcaactgagtaaattctttgttgtga

SEQ ID NO: 25696 - DNA, 201 bp, Homo sapiens
gcaccccttcctatctatggaagctggccattttgtgtattttctggaaaacatgaaggtattccagagccagcatgaatcttacatcaaaacttctctcwtctgtgactcaggcttccttctgtttgttcaaatagactcaacactgctgaacacaaattttaactgaaactaattattcctttcatgatttttttttaa

SEQ ID NO: 25697 - DNA, 201 bp, Homo sapiens
cacaagtgatatataattattgaaaacatttgaaaaaatacaactaaataaaataatggaaatataaatcaattattatcaatctcaccatccagaaatamcatggttaccattttaatatacgtcttttttttttttttttttttgagatggagttttgctttgttgcccaggctggagtgcagtggcgcgacctcggcc

SEQ ID NO: 25698 - DNA, 201 bp, Homo sapiens
actttaatatccccaatttacagttagcatgacccataaaaccggtaggcaacatgaggtggcaaaaactcagtaatagcttacaaagagaatgcaatagmttctagaatgttggtgttatccatacttgatgacatgatgtgatgggggtgagttggcgggtaggttcaccaagaagtattatttagaaaaactgtgcca

SEQ ID NO: 25699 - DNA, 201 bp, Homo sapiens
tagctgagattacagcatgccaccatgcccagctaatttttgtagttttagagatggggtttcaccatgttggtcaggctggtctcaaactcctgacctcrtgattcacccacttcagcctcctaaagtgctgggattacaggcgtgagccaccgcacccggcctttcctgtcattttaaaatgtaaaatatataccaaaa

SEQ ID NO: 25700 - DNA, 201 bp, Homo sapiens
gaatattctttcctccttgtgaacagtaacttactcatgccacatacacacatataaactttaatatccccaatttacagttagcatgacccataaaacckgtaggcaacatgaggtggcaaaaactcagtaatagcttacaaagagaatgcaatagattctagaatgttggtgttatccatacttgatgacatgatgtga

SEQ ID NO: 25701 - DNA, 201 bp, Homo sapiens
acacactcacatgcacacagactgcttttgaaaagtcaagctgcagaactctacggaaaccatgaagtgtaagttaagtgcttctatcctccaacactggktacagtcatgcacccacattatgagtgatggctgagactcttgctgaaagggaaaaggaaagtcttttgcctaaaattgccctgtctgatatggtagcca

SEQ ID NO: 25702 - DNA, 201 bp, Homo sapiens
cttaactaacaacaaggagtggtgcctggccaggcacttggggcattgtcccaagaggatgtcaacatgtcttcttagagaaggacagtcattgaggcctraggaagtgttcaggaggaataagcttcaccaggatagtttcaatgacttaaccctttgcatgcagtttcctcaagtgtaaaccgggggtcatatagtccc

SEQ ID NO: 25703 - DNA, 201 bp, Homo sapiens
aataagtgtgcaatgctcattggctctgattattaagtgtcaaacaccatatcaagtgtttgacataccttatttcatgtaatagtcccataaaccctgamaggttcgcattgtcatcccatcaaggaagaggtggagagtcagagaggttaagtaattaacaacctgtgtcacctaaagtgagtggcagggtcaggaatt

SEQ ID NO: 25704 - DNA, 201 bp, Homo sapiens
agcctatataaaatagtatttcatgtgtgttttaaaaacacacatttcattaacccctatagaatatctcttaagaactgtatcttcccttcctaagttartcagcaaacgtattttgagaacctactacgtaccaggcctattagaatgcttgggatcgaaggataaacatagttaggaagtaatattgaagagaggcaa

SEQ ID NO: 25705 - DNA, 201 bp, Homo sapiens
tagaatggatgagggagggagagaaactctgagaaaagaggctgtcaggagtagggctgtacatatccagggcacaaggaatttggcaaaagctggaagtrtactatagcccttctctccagccctagcctaaaccagatgaccaggcttctatttggcccagcatgtgaccatcccatcagggagcaagagagtttcctc

SEQ ID NO: 25706 - DNA, 201 bp, Homo sapiens
tatagtaatgagcgtgctaaaggcctggtggcatttctaccacgggaagtctcctctccaaatccaaaagtggcctcaaacagtcagtgttttcagttgarctcatttatcgctcagagggaggcacttgggacattttattcattacatgatgcaggagatttattggagaccagagggctcaacggaaaacattcttgg

SEQ ID NO: 25707 - DNA, 201 bp, Homo sapiens
aagaagaaaatgacttcttcgtgtcctattaagacagtgagttgtggcttttttgagagcagcttgctcagacctcttatgaaagatagatcagtagcaasagcactggtgtaggagtcagaaatctgcaattatgaaccactgagttttgtgtgtgtgtgtgtgtgtttttgtttttgttttttgtttgttttgttttgt

SEQ ID NO: 25708 - DNA, 201 bp, Homo sapiens
cagggtaacagctaggagaacccttgggattcttctccaatgtgacaggcccctccatgttggttcagcgttgactgccatgacaggctccaggctccacrgaaaaaaggcagagaaatcagggggtccagccaggcgccaagacgttggggtgccttgcatttctaagtgccaagtgatgaatagctcagttgaaagcaa

SEQ ID NO: 25709 - DNA, 201 bp, Homo sapiens
ttacgaaagtcttccctcaaactaaagctaagcagttccacaaaatgccagctatagacattagcagaaactgtatattgattaggtgatgtatcagtcaytgtaactacccagaaaaaaaaatacaatgacaaaaccaagtggcccaaccttattttctacttgcaagaggaaaaaccctatttgggccccaagatgctt

SEQ ID NO: 25710 - DNA, 201 bp, Homo sapiens
catcttgggtggcaggaaggcaaggtgtgcctgggggagctacagggagttattcaaggtcacataattagcttataattaacagagtttaggctagaacyagtgcatcccactcccagatgggggcccccggcttatctcagcatgtcagcaacccatgaatcagccctgaaatatagatattacctatgagtaacagtt

SEQ ID NO: 25711 - DNA, 201 bp, Homo sapiens
aagtcttttttaaaaataaaatcggtgtatccctgaccaagcgtccattaacactttgacaattgctcaaactgcatggtcacagcagcctcagctcatamcagccatccaatgcaaggaaggacaacaccaagcccagaggacagttcctggactgatttcttcaacccaatctcacaccccatgggacgaggtcatcaa

SEQ ID NO: 25712 - DNA, 201 bp, Homo sapiens
gagagagacatttgcatgtggcccctgagaaagaagagatttgtctgcctcaccccctgctggtgcaaacttgcacctctctcagcctcagttttcttatrtgtatcaagtttcaatgatcgcaatagtacttatctcatgtgactactgtgggattgaaacgagatagttcatgtgaagtaccgagcacagagcctggca

SEQ ID NO: 25713 - DNA, 201 bp, Homo sapiens
gcttttgtgtcctccagttcacatgctgattgctaagaagaaaatgagcatgagtgaacccaaagctgctgaaacattctgcgtttatgcaacttccttgscctctatacaaggaagatggtttcattgtcttgtctagagaataaagtcttttttaaaaataaaatcggtgtatccctgaccaagcgtccattaacactt

SEQ ID NO: 25714 - DNA, 201 bp, Homo sapiens
tttctctatgaaattctccctgtcttctttggtctcatggctacttcctgggaggaaaaagtagtaatcagctccctccccccagctaaatgtgcatggtrttagcaaattctaacccaagatgttaaaactatctgagaagaggcatgattctgcttcttgtctgtaccctcctaaagtcaaggtgcagcaaggagagag

SEQ ID NO: 25715 - DNA, 201 bp, Homo sapiens
agagcttctctacatcacatgaaggcttggaagaagataaagaccatccaacaacttctactctgacatcaagcagtaaggattataaaacctagttggcytcagctattgataagaatcaatcaattatgggtacttttgcagtgtctttggtggaggtgcatccattagctgccgttacactgttacttttaatcaaaa

SEQ ID NO: 25716 - DNA, 201 bp, Homo sapiens
gcaccctgtgaatcatagtggtggtatggggaaaggggtaaaaaagcatcaatctatggagtatgcgaaccagatggcatctgtcctgggaagaacaaatrtccttcataggagaattagaggactatactagtcaggcagaaatccagtccattcatcaagcttttcctcttgctgtggtccctacagggtcagccctgt

SEQ ID NO: 25717 - DNA, 201 bp, Homo sapiens
cctcctaaagtgctgggattacaggcgtgagccaccgcacccggcctttcctgtcattttaaaatgtaaaatatataccaaaatgtgattacaccttacayggtgtttagcaaacattgcctactggttaaccatggcttccatgtcattgaatatttcctcctcatattgtagtgcgtaatgcaatagatgtaccctaat

SEQ ID NO: 25718 - DNA, 201 bp, Homo sapiens
atacttgcaaaatatagatatgctgccatgtgctgaggaccaggggagttcttacaactgccactggccaatcatcaagcacttagatgctgggagccctrctgcccacctggccaaacccctcacttaatcctcaaactgcagtattggtcaatattatcacctcattttatggatgaagcagccgaggcttagcgaatt

SEQ ID NO: 25719 - DNA, 201 bp, Homo sapiens
gtcagtggtggttgtaaggtaaattgtaagtaagagctattggccaccaagtgccaagggttatgaatgatttacctttttttttttttctaaactgaagsaaactcatggttgttcctagaaaaacatgcacactcacttgcttgcattcggataagcttctttgagtaacagggaagaggccactaggattacaaggca

SEQ ID NO: 25720 - DNA, 201 bp, Homo sapiens; identical to SEQ ID NO: 4284

SEQ ID NO: 25721 - DNA, 201 bp, Homo sapiens
acaggggggaatacattgggaagactggcacccagtccaggaaatttaacatgcaaatgctgtaatcaaagtcacaggaagagaaaacaaataggaagaamtcatccaagaaaaaaatcaagaaaacttcccagaactttaaaacatgaatatcttgactaaggacaaggtgagtacttagtaaaatgaataaaaacagac

SEQ ID NO: 25722 - DNA, 201 bp, Homo sapiens
tttttgcagctgcatcacttcattgctaatatatttgaagaaggcaagataacctaaaggcatgaatcttgttctgttttaatccacctgtaagtcagtgktggttgtaaggtaaattgtaagtaagagctattggccaccaagtgccaagggttatgaatgatttacctttttttttttttctaaactgaaggaaactca

SEQ ID NO: 25723 - DNA, 201 bp, Homo sapiens
tgaatccaattgctcctctttacaagttaaaggatgaatgagaatactacaccctcttggtaggaaaagatggaatagtcttttcttcctgggttctgcamactagctgagctcatactcagatctgtccctggcctgtcccagagaagtgccatgttagttactaaagcttccttcctaaatgaatgatcaccaagagga

SEQ ID NO: 25724 - DNA, 201 bp, Homo sapiens
tggggtggaccaagaagctattattcctcgcaggccctacaatctaggcaaagctttgaaatgtgctcggacaattttatcagagatctattttccttgawctgaggcttagggggcagtatagatgagattaatggcatttgggatcagtgatggtttatccaggagagaatgcatagtacctgtaaccaggagcctgaa

SEQ ID NO: 25725 - DNA, 201 bp, Homo sapiens
ggctttatatccttgctgctcagagcgtagtccctggaaccagcagcctgggtaccctgggagtttgttggaaatgcacaatctcagacccaaccccagayctcctatggcagagtctgcatcttaacaagtttccagggattcatgtgcatggtgcagcttaagacatctttctctgccccggtttttagagacaggaga

SEQ ID NO: 25726 - DNA, 201 bp, Homo sapiens
ctcagcctcacttgttgcatctgtgaaatgggggtgattttttgacttctcaaggtatagcatctattaaggcacatagactacaatctgacacaaattarcagctccatacattgcagaatcttttctttttcacttaaggagatgctaaaagaggcaagaggaaagaaaatcaaatttggagatgccgtgggctgtgtg

SEQ ID NO: 25727 - DNA, 201 bp, Homo sapiens
gaagaggccactaggattacaaggcagttagtgcccattggagtgtgactggcattgtgcaccctgtgaatcatagtggtggtatggggaaaggggtaaawaagcatcaatctatggagtatgcgaaccagatggcatctgtcctgggaagaacaaatatccttcataggagaattagaggactatactagtcaggcagaa

SEQ ID NO: 25728 - DNA, 201 bp, Homo sapiens
gcaaagatgaattccaaatcttatttaatctgtgtgctgggggggaagaggagtgtatttccttttgccaggtatctgagcctacaaaaagccccataaayaagtaaaatgtgtccatgagttcataaaagagtgagccttagacatacagaccacctgtcaaaagagccctgtcattctctattatattatcctctttta

SEQ ID NO: 25729 - DNA, 201 bp, Homo sapiens
tagcatctcaactttttaatgaacccaaaaatgaacaggagggttttctgagccagtcccctgcctccacacagttagctcatgaatccaacatcatgggrggaagtcttcaggattttgtttcccattccttttttatcacctaaatatagttaaaggatttgtgatgactgcatccagagatgtttaaaaatggacctg

SEQ ID NO: 25730 - DNA, 201 bp, Homo sapiens
gggcatgggaagtaggggtcacatagtacaactgtggctgccagaagctgctcttcacaatctggatgaaatattcagagaaggaactataacttgtgggktgggccacaaatccaaaaagggtcttgtgagtattatcgtcactgaataaactctcaggtgctgcaaagagaaaatggtgttatttctagtcagaatata

SEQ ID NO: 25731 - DNA, 201 bp, Homo sapiens
attttatattaaaaattgctctttcataggcaggaaaaagtccttcctaatagtttgagtccaaagcttaagggtctagcatctcaactttttaatgaacmcaaaaatgaacaggagggttttctgagccagtcccctgcctccacacagttagctcatgaatccaacatcatgggaggaagtcttcaggattttgtttcc

SEQ ID NO: 25732 - DNA, 201 bp, Homo sapiens
ctcatattaacatcgtggttggcattactggcctcctgtatgggatgaaagtttaatgacttctgcaaggttatgaaaggtcaagatcacagctaattagygcaaattcaggatttgaattctagtttctaccccagagctgatgtccatgtcaccatggacatcatttgctcccaatatacctgatttactttcaagggg

SEQ ID NO: 25733 - DNA, 201 bp, Homo sapiens
attgagttgtttgttcattaggataggatagggctgaaagggatgtgaattgagttgtttgttcattatcacttcattatttgtcacctggatgaaaggtraaggtggctgattagtgtttctccatcagctagaactttgactgggaaatgagccaatcaaatagcagcaaaatatttgccctcaccttacaggcccttg

SEQ ID NO: 25734 - DNA, 201 bp, Homo sapiens
ctcactccccactgtgggcacggaggcactgcgccacccagggcaagacctcgccctctctccagctcctctcccaggatatccaacatcctgtgaaaccmagagatcttgctccagccggattcagagaaatttagcgggaaaggagaggccaaaggctgaacccaatggtgcaaggttttacggttcggtcatcctctg

SEQ ID NO: 25735 - DNA, 201 bp, Homo sapiens
agaagtcctggcatggttcctttcatcttgccacagccactgataatcactttcattttctgtgtaactcaccaggcaagaagtccatgcagatttacttktagtagttcacatgacaaataaatactgcgtttgatttccaaacattaaaccatagtatattatagatagatatagagttatcattcaaagtatgatatt

SEQ ID NO: 25736 - DNA, 201 bp, Homo sapiens
cagacatgtacacccatgttcgctttagcatctgatagaaaaagaggaacatgaggaaagacagagattgagtcaccaacatgtgacctggtgatttctgwgtcctctgactttgaaatcagtggaaatttagagctctactttgtcacttgtaatgctttgttgttgcaaataaatatttttgcagctgcatcacttcat

SEQ ID NO: 25737 - DNA, 201 bp, Homo sapiens
acacacacatacatgcacacacacacagacatgtacacccatgttcgctttagcatctgatagaaaaagaggaacatgaggaaagacagagattgagtcaycaacatgtgacctggtgatttctgagtcctctgactttgaaatcagtggaaatttagagctctactttgtcacttgtaatgctttgttgttgcaaataaa

SEQ ID NO: 25738 - DNA, 201 bp, Homo sapiens
gctttatatccttgctgctcagagcgtagtccctggaaccagcagcctgggtaccctgggagtttgttggaaatgcacaatctcagacccaaccccagacstcctatggcagagtctgcatcttaacaagtttccagggattcatgtgcatggtgcagcttaagacatctttctctgccccggtttttagagacaggagac

SEQ ID NO: 25739 - DNA, 201 bp, Homo sapiens
tttaaaaatatccccacaatccagcttctccctctgtagggcttctgcttgggaaagtttgtgtaactccccaaaacatctgaagagtgaatagcagtagkgttcttggactgcgaaggagaccctgcttcttatgtgcatgctcttgtgcacacagacagaaacacacacatacatgcacacacacacagacatgtacac

SEQ ID NO: 25740 - DNA, 201 bp, Homo sapiens
ctttatggaaactaatggtgctttaagaggcacagatttcatagaaagagacccagttgttcccaccctgatggttctaggtctaggtctaggtcaccaaygtctatggtgaaagaatgggcttttgcgaggtatggtctcctgtcatgtatgagggtcatttatttaagggaaaaccaagaccttattttctttgacaac

SEQ ID NO: 25741 - DNA, 201 bp, Homo sapiens
ccttagacatacagaccacctgtcaaaagagccctgtcattctctattatattatcctcttttattttctgtgtaacactatgagtatctgaaattaccgkattcatgtattaatcatttacctgtatactatatcctcactctagaggtaagctctttgagggcacagatcgtgtctgactccccagcccccaagattgt

SEQ ID NO: 25742 - DNA, 201 bp, Homo sapiens
gtctttcttggatctttccgatccaagccatatggttactgcaatctcacaatacaatgagggtaaatccttgcaatcaccagttaccagcaattgtgaarcaatggatggcatagatgtcagggggtcaggagagccttgcaagcgttcagagggcttgggagtggacacatcacagttgcactctgctgggcagcgctg

SEQ ID NO: 25743 - DNA, 201 bp, Homo sapiens
actctccccaggggcaatggggcctccaaggccaccaaagatcaaggtgccaggtgggggatgcctcccagcttcccattcatttttcagttgggggccastcagcagctcctcaggtgaggattgtctcagaactgaagaatggttcaaattggcccaagatgctgaaatttattgcagggatcactgggacagtgtgta

SEQ ID NO: 25744 - DNA, 201 bp, Homo sapiens; identical to SEQ ID NO: 4281

SEQ ID NO: 25745 - DNA, 201 bp, Homo sapiens
caaaacaattgagaactcttgggaggcatcttcaggaaaggaggtggtggaaactttcctctcctcactctccccaggggcaatggggcctccaaggccaycaaagatcaaggtgccaggtgggggatgcctcccagcttcccattcatttttcagttgggggccactcagcagctcctcaggtgaggattgtctcagaac

SEQ ID NO: 25746 - DNA, 201 bp, Homo sapiens
gcagctgggcttagaactggaaggctcctttcccacagctgaatggattattgcctaaggagtcaaccccacgtattaatttggccaagtcaatctgcaayctgtatgacaactggagtttaaagtcagctaaagacacctttgtgaatcatagagcgggaacccagaggaagccattaggggtcctctcggctggaatcc

SEQ ID NO: 25747 - DNA, 201 bp, Homo sapiens
aggtgggaggagtgcttgggcccaggagtttgaggttacactgagctaagattgtgctactgcactccagcctgggtgatggagccagaccctgtctctaytaaaaattaggaaaagaaatagcctgtctactctattggtccataacctctatcgagacagtgaccttgtctgctttattcaatgcctggatcttttcct

SEQ ID NO: 25748 - DNA, 201 bp, Homo sapiens
caccccaactccatctgtgcagcaaacaacacaggggtgtacatcctcacatccaacacctcccagtatgacacatattgcttcaatgcttcaggttggtyctcaggggggtgtctgttggcgtgaaaggctgtgggagcctggtctttggagctcagcttaagtggggattcatgtagcctccatttacataacaaatgc

SEQ ID NO: 25749 - DNA, 201 bp, Homo sapiens
ctttcaattctgccactcccagtgtcttcctgcaatttagcacccctcatgttcctaaactaaatcccacagttccaggcatcctaggaaaaaaaaaatcmatatttagcagcagaagaaagagtgtatattcacaaacatctcttctaaaattggaggagcggctttttgggaagtccttaattgacctctccttatttc

SEQ ID NO: 25750 - DNA, 201 bp, Homo sapiens
gagctgcagcacatggcagaaagtaaccgttctcccggatgcgcacagtcgttgtctggactaacaggctcctgtgcccaagggctcgccaagccccaccrggctgtgtctaggcagggcagagctgggcggggcagagactggggctggaacagggcgagtggctgttatcaaggtggtcacagaagggatcacaattcc

SEQ ID NO: 25751 - DNA, 201 bp, Homo sapiens
gtcaagtgaattgatctttggaatccttattttctatgaagatctttgatgaatacagtgtcttttttgcattctgtccctgactgttctatagaaagacrtcccttgtactctttagagcaaagttggtagctcttatggtcttcatttgaattctaccactgcttctttttctgtttttaagcccatggtaacttgggg

SEQ ID NO: 25752 - DNA, 201 bp, Homo sapiens
actctatttctccctatttatggataacaagtggaaagcttttgcagcaattgtgtgttctggagacaagcacatggtgggtggtgatcttacaaatacgrgttcatcactgattccacctccacacagataggaatgatgtcacaggtggaagaagagacccaaatcattctgaaggctcaactactttactggaaggtt

SEQ ID NO: 25753 - DNA, 201 bp, Homo sapiens
atgtacaatgtctagtctcaacctcatacctgcaaagatatcacaatatttttgttagcatgttccttaccacagttcttggatttctaccaaaacaaagyttctacaaaacttcctgtggtcatccttcttagcctttgctgccccagtttccttaattcttattaaagttctagctcatttatcagtggattaagcaat

SEQ ID NO: 25754 - DNA, 201 bp, Homo sapiens
ttatatattttttaagaataatcatctgtcaaaatgtaatttcatgcaatagtctggtatataaaactgatgcaagtggaacttctgtggttgggatgggkcctggggagggagaggcacagcttactcctcagcttttactctgaccactaggtctgcttctgaggggtctctaaggaacctccaggttccatgaaacac

SEQ ID NO: 25755 - DNA, 201 bp, Homo sapiens
aatagaaatatttaaaaattagtagagtataggcactagctaattcaaatgcttggttgtaaacaactatgtcttgtaaatgagaataaagtttattctcycaatgacgatgataacatctttctcactcacttttactcaaattggctttattgggcaggagagacagagatggagttataggtatcatgattgaactta

SEQ ID NO: 25756 - DNA, 201 bp, Homo sapiens
tatttggtatttttttatcctttttgacttaatgagcatttggaaaccataaggcccacagcaacctgacctttgacttgcccagactctctgagcaattytgtgagttgagtcaacaatcaatggttttcaaattattcaattgttcactcaacgcatactagttgaacaccaatatctgtgctctgctaggcactgggg

SEQ ID NO: 25757 - DNA, 201 bp, Homo sapiens
atgcagcaacaccaaaatatgtgttcaaagagggagaagaggagaaaaagagaaaggaagttatcgtggtctgataacagggcatgtcagaatgggaaagrgtgttaggaattatgtagccaacttgtttgattggaaagataaggaagcctcaagggctgcaagtgactttcccaaggtcacaaaactaattggtggcaa

SEQ ID NO: 25758 - DNA, 201 bp, Homo sapiens
tttcaacaatcaattcaatcatgattacaacagctttgatgagcactagtgctacagcaactgagacagcaaccaagaggcaagaaacctgggattggttytcatggttgtttctaccatcagagtcaaagaatcatcttcacacaacaacacaaatggctggtaatgagttattattatctcatagcgtatgttttcttg

SEQ ID NO: 25759 - DNA, 201 bp, Homo sapiens
atactgtgtgaaccatttggggataataatccctctgcctcccctagacctctccacctttgcctgctggtgtgaaagtgttttgtgctagtaggcagaarcacgtgatataaaactacaaggtcctattattacctaggataactttcgcctctatctatgtctcctgttgctggttgaccccaatcattgaaactgtat

SEQ ID NO: 25760 - DNA, 201 bp, Homo sapiens
agagaggggagaggagagaaacccagggaaaggcaaaacatgagccaggtgtttaaagtgggggaataagaatggcttgattggggccaggggaggggtcwgtctgcttggataagagaattcatgaaaagaacagtgagagatgaggtcggacagattccaggcaatcaagtaacagtggcactgtccactggcagaaga

SEQ ID NO: 25761 - DNA, 201 bp, Homo sapiens
taatctgagtgataccaaattgtatctctcttgagaagtagttaatgtgaaaaatgggtgaacctatgatcataccttagttatatcttgatgagattatrgaagaagaaatagaatgttttgagaagtggggaaaatatctcacaaaatttctcttgtctcatgttcttcctgttttatttatctatgggatctactgct

SEQ ID NO: 25762 - DNA, 201 bp, Homo sapiens
gagagcataaccaagtgtcagaagacaggaaaaacagacatctcgattgcatgtgaaggcttcaaggaatttgaggatgagttgaatgtggaaaagaagayagacagagagaggggagaggagagaaacccagggaaaggcaaaacatgagccaggtgtttaaagtgggggaataagaatggcttgattggggccagggga

SEQ ID NO: 25763 - DNA, 201 bp, Homo sapiens
aaatcataaagattgcacgacttaggattttgtcaaaatgtgtcagaggctataatataaggctagtttttggcattctgtcagtcactgaatgtccttcrtcagatcacagctccttttggttgtgctgactttatacccatctggaatccactgaccattagctgaaataaaatcccagatgtgctcagatctcacatc

SEQ ID NO: 25764 - DNA, 201 bp, Homo sapiens
ctttaaatgagtagctactacatgccaatcacagatgttgcctctgctgagtatccagtcaaaaaaccagaatctaacagagctaactaagcaccatcttrcaggaaaccagctgacgtcagctccgcagccaccagtgagttactgggcccacatctgcctgcaagagggggaggggaattcaggtaacccacaagaggg

SEQ ID NO: 25765 - DNA, 201 bp, Homo sapiens
aaaaatgaaggaggaggaagttgtaatggaaacttctgccaatgcatattctgagttgactcattcattctgatctctgaatagaagctctactctcttcyatgtgatggaaagttgaggatagggtagggctgagagggatgtgaattgagttgtttgttcattaggataggatagggctgaaagggatgtgaattgagt

SEQ ID NO: 25766 - DNA, 201 bp, Homo sapiens
tgtcactatgttagagtgcttctcttggtatattaagatatcgaggcaccctagaaatccagacgattgtacctggaagtactgtagttgttttcaaaaayttcatttgggaatctagttgtgggtgaggtcataacatccactgagcttttaaacatgatgtcagaggaaggggttagaattgcaaaaatgaaggaggag

SEQ ID NO: 25767 - DNA, 201 bp, Homo sapiens
tggggtatgcaagtcaactccctcactttcttttaaaaatcctgggaaatccattataccttctgtgcctgattttcttcctttgcaagtgggttgcttgscgtccagctcagccactaatgcaagtcaccacaacaggtacgtcttcaaataccatctcagcaggctgggagccaaatgaagaaaatgaagatgaaagag

SEQ ID NO: 25768 - DNA, 201 bp, Homo sapiens
tagttaatgtgaaaaatgggtgaacctatgatcataccttagttatatcttgatgagattatggaagaagaaatagaatgttttgagaagtggggaaaatrtctcacaaaatttctcttgtctcatgttcttcctgttttatttatctatgggatctactgctacagattgtctttgaatgatcaggctttatcagagaat

SEQ ID NO: 25769 - DNA, 201 bp, Homo sapiens
gctcaagaaataacatttttctaattgcttcaatcatcgttatcacagtttcaaccacaccacgggcttttgaccacacaaaacagaaccaggactggacycagtggaacccaagccattcaaatccggaagtgctacttcagacaaccacaaggatgactggtaatgggttctgcatatttaatgaaagatttttttccc

SEQ ID NO: 25770 - DNA, 201 bp, Homo sapiens
tttgtatgaagtggagagaagaggaataaatatgaattttagttactacatgaacataaaataaatataattaaaaataaatataattacattcccttaartaatagtgcataaaatatagactgttttgcttgtgttccttccagttagcttgctacataaagccacataccattaattcaaatttcatcgtcaaaaatt

SEQ ID NO: 25771 - DNA, 201 bp, Homo sapiens
acatgactttgtcagagggcttggggctgggcatggtgtgggtggcgaaggggagaaggaggaaaggggaaggaaaggagctcttgttgccccattctggrgagtggtggactctggacaaccacgaggaaactttggaaaggagcaaggctttgaggaggagtccagtctttgtatgggaaagcaaaaagtggagaaatg

SEQ ID NO: 25772 - DNA, 201 bp, Homo sapiens
ggctttttatgttttaacttgatttacattcatactattgatagtgtaatattcagtgattttcaccaacgataatttactcaacaattcctttgtttttrgtccaaggaagcatatctggaagagttttctggtgaaattaaatcagcttaagagctctataatccagcctgttggggaatgttctcaatacttacttgg

SEQ ID NO: 25773 - DNA, 201 bp, Homo sapiens
ctgtggcagcatggcatgggtcaagaagtacttctccttcatcttcctttgatgtcggtaactcatcctttctgcactgcgggagttgttaatgcttttgkgtcctccagttcacatgctgattgctaagaagaaaatgagcatgagtgaacccaaagctgctgaaacattctgcgtttatgcaacttccttgccctctat

SEQ ID NO: 25774 - DNA, 201 bp, Homo sapiens
agtttctacaaaacttcctgtggtcatccttcttagcctttgctgccccagtttccttaattcttattaaagttctagctcatttatcagtggattaagcratgaacggtaattaacattgtggacccattcaaggctgttttgccatcattttttggaataccttaaaaagactaaactttgtgataggctgtataagaa

SEQ ID NO: 25775 - DNA, 201 bp, Homo sapiens
aaaccatgaacaactttataaaccccatgcttattggaaaaggaaggagcaaagtcatgtgtaaatgtgtttgggagattgcttggtatggtagaaacagyatgagctttgggatcagacaaattttgggttttaatactgattctaccacttacttaactgtgaaactctgttcacacatcttaaatattttgagtcagt

SEQ ID NO: 25776 - DNA, 201 bp, Homo sapiens
cgcagcagcctgggtgaagagtgagaccctgaaaaagaaaagaaagataagaaaagaaaagaaacaagaaaagaaaagaaacaaaaaaagaaaagaaaggycatactgaaaaagtgaaaccatgcttaaagagtgttgagattccctatcctcctctcccagcttggctctcagaatgctgggagctaggcatatgttctc

SEQ ID NO: 25777 - DNA, 201 bp, Homo sapiens
caagaactactcctggacttccagttaaagagaggagagtgtacataccttcattccctcatgtaagcctctaaaaagaaaataaagagatatttccagayggaatcaaccagtggagttaaagagattggaagaagagacaagagcaacaaaaacttgaagctgaaaagtgatagctgattggtaactgaatgaacaagt

SEQ ID NO: 25778 - DNA, 201 bp, Homo sapiens
ttgtcactatgttagagtgcttctcttggtatattaagatatcgaggcaccctagaaatccagacgattgtacctggaagtactgtagttgttttcaaaamcttcatttgggaatctagttgtgggtgaggtcataacatccactgagcttttaaacatgatgtcagaggaaggggttagaattgcaaaaatgaaggagga

SEQ ID NO: 25779 - DNA, 201 bp, Homo sapiens; identical to SEQ ID NO: 4277

SEQ ID NO: 25780 - DNA, 201 bp, Homo sapiens
caggccttccgagccccttttcttctttcttttttccttttttttttttttttttttttgagacggagtcttactgtgtcacccaggctggagtgcggtgrtgcaatctcagcttactgcaacctccacctcccaggttcaagcaattctcctgcttcagtctcctgagtagttgggattcagccacgcaccaccatgccc

SEQ ID NO: 25781 - DNA, 201 bp, Homo sapiens
gtctgattacccttgttttgtggctgggattaccgaaactcccagaggttaagtcatcctctgataagggggaaagccaatgctcagacctggactttctyggtccaaggctgctgattgaattctggattcttcccaaatagtgtaatctcgtgtcaactcaaatcaattcaagtttcctttccagtttcccacatccca

SEQ ID NO: 25782 - DNA, 201 bp, Homo sapiens
tttgagaccagcgtggccaacatggagaaaccctacctctactaaaaacacaaaaattagccaggtgtggtggcgggtgcctgtaatcccagctacttggktggctgaggcaggagaatttcttgaacccaggaggcagaggttgcagtgagccgagatagtgccattgcaccccagcctggttgatgaagtgagactttg

SEQ ID NO: 25783 - DNA, 201 bp, Homo sapiens
ccatcatcacagcagatgtagacagaaatggcaccactgcttatgaaggaaactggaacccagaagcacaccctcccctcattcaccatgagcatcatgargaagaagagaccccacattctacaagcacaagtaagcaagatggcggtcggcagttctgggttagatgaattagtaaagacattccagcaatagggaaga

SEQ ID NO: 25784 - DNA, 201 bp, Homo sapiens
ccagctttccatttcacactcctgctcacatttggtttagatttggcttttctttgctcgagaggaacaggatttattactaccagtcagaagccatcagkccccaatatttcagcaaagaaccctagtctgccagagtgagtaatgctctgtttgcactcaagtctccctgaaccagtcaccccaaataggatgtcactg

SEQ ID NO: 25785 - DNA, 201 bp, Homo sapiens
cacagctctaaaacagtgcaaaataaatccctaaatatcgttaaggattgtcaggtagaagagtcatgagatcagttgccaagttacccacctaaatcttytgagataaattctgccatgccataaaagtatgttacctggcttctaaaccccagccagcctgccctctctttcctggtgaggtctcagtctgcctccttc

SEQ ID NO: 25786 - DNA, 201 bp, Homo sapiens
ggagatgacaaatagggatcaggcacacctgggtggctcaagttagaaaacaaattaactcattttgcagaatctggagacgtctggtctggagaactgayagtgccctctctttgggcatagtatgactgtaggttgtctttgggtggtcttcatatggaatgtactgtgtttgccatgttccctaggagatctggcctc

SEQ ID NO: 25787 - DNA, 201 bp, Homo sapiens
ggctaccatattggatggcacagctctaaaacagtgcaaaataaatccctaaatatcgttaaggattgtcaggtagaagagtcatgagatcagttgccaasttacccacctaaatcttttgagataaattctgccatgccataaaagtatgttacctggcttctaaaccccagccagcctgccctctctttcctggtgagg

SEQ ID NO: 25788 - DNA, 201 bp, Homo sapiens
gaaaatcattagtctctgaagttgacatacaaggatgggtcatgggcttgcatgatgaagtgatctgtgagtcacgttgtcttaaagatgctgggttgggrgttctattacttctttaggtttttccacccctgccatcatccaaaacagctttctttgctgttcctcatgtcacctgactccttgagttacagctctcca

SEQ ID NO: 25789 - DNA, 201 bp, Homo sapiens
cttcacaatctggatgaaatattcagagaaggaactataacttgtgggttgggccacaaatccaaaaagggtcttgtgagtattatcgtcactgaataaaytctcaggtgctgcaaagagaaaatggtgttatttctagtcagaatatacaaccatctcacaatgatactctaaggaatcaaggcatagtcctatgcaaat

SEQ ID NO: 25790 - DNA, 201 bp, Homo sapiens
gactttttcagaacagcgagatagttgtgctgacaaaacaaaaacaaaaacatcatttaagatgccttcagatgcaagtacatgtcataatagaaatattyaaaaattagtagagtataggcactagctaattcaaatgcttggttgtaaacaactatgtcttgtaaatgagaataaagtttattctctcaatgacgatga

SEQ ID NO: 25791 - DNA, 201 bp, Homo sapiens
aaaactttcttttggttccccaactaatttttttttggtcgagggaccgcctgctgatgtggacagaataaacttttcagaaagtatgcatgtgcagtgargaggctgggacacctggttctcctgagcatcaagacaaggcatttgttgcaaattctttatttgacttggaattaaaattgatttgtcatagagaattac

SEQ ID NO: 25792 - DNA, 201 bp, Homo sapiens
atccccttcaaaggctgaggcttttctgctttgagtgtcacatttaagagaaagagatacagaatcctattttcatcagagaaagtttggttgaaaatggrgcctccaataggtgttcatttattcagcaaacatcttttgagtggctcctgtgactaccagccctggcaaggagaaagagaaggtaaaaaacaaaaagag

SEQ ID NO: 25793 - DNA, 201 bp, Homo sapiens
agcgagtatctcaccaggaaagtagctgcttggatgccataaattactatgtcctgatttgataattgaaaacagatttgccacgcagctaaaaggtggtkaacagctgtacgggccccttaatgggctctgtgattctaaagctgtcaacccatttctaatccccttcaaaggctgaggcttttctgctttgagtgtcac

SEQ ID NO: 25794 - DNA, 201 bp, Homo sapiens
tttacaaagagtctttatacctcccttcagcttcctcattttcccttggattacttttgctcaattaaatatgaatttcctattgtgtgcaatcagccctytattgccaagccctagaatgcaccacttttgctcacatacacagtccataagctttgcacatgtcaccatagaaacgctggcatggatgctgtcgacatt

SEQ ID NO: 25795 - DNA, 201 bp, Homo sapiens
ttttaaatgggtgaaatggtaaattttatgttatgcatattttaacataacaatgataataattttaactaagtacgttgcctccttatttcctacagggycaagttcaaactccctggcatagcttacaccttgtagtccccatacctgtaacctcatgtctgctatcttcccccagccccttcatctgatctatgttca

SEQ ID NO: 25796 - DNA, 201 bp, Homo sapiens
aattatctgagaaaatcaaatgatgctgttacaataattacgctggtacaagttaataaaagtgccatgttacagtcaaacagctatgttgctatctatamcattgagggcatagttttaaaaagtagttatgctacctgattgtataaggaacaaaactgagagaaaaaatctaaaaggccgcctatgattgaatggaaa

SEQ ID NO: 25797 - DNA, 201 bp, Homo sapiens
aacatttgaaaaaatacaactaaataaaataatggaaatataaatcaattattatcaatctcaccatccagaaataccatggttaccattttaatatacgkcttttttttttttttttttttgagatggagttttgctttgttgcccaggctggagtgcagtggcgcgacctcggcccactgcaacctctgcttcctgagt

SEQ ID NO: 25798 - DNA, 201 bp, Homo sapiens
aattctttatttgacttggaattaaaattgatttgtcatagagaattactaaagggaagggttctcctaaggttgtaaattacccttttaattctctcctsttcagaggtctccagactgagcctctcttggggaaagagaagaatgtggcatgcaccgttctcctttgccccagcttgcctaagcacacctgaagacaga

SEQ ID NO: 25799 - DNA, 201 bp, Homo sapiens
agacttggagaaggtagattgacccagcacacatggctagttagcaagggacagcggtgagacttaaatccagggttgtccagctctagacaccaaagtcytgaacactgtgcaacactgctgctgagaattctcatgttccttgacacaaaataacattactaagccttagccttaatcaaatgaggtgggggggaaatc

SEQ ID NO: 25800 - DNA, 201 bp, Homo sapiens
tggtagctttgagatgaggcataagattctgcatttctagcgatctccccaggtatgcctgtcctgatggtctgagagccacactttgagtagcaaggtcytaaattaaaaatagaaaataacaaccacacacaactaccaataccgtgtatttcttcaaatctctgcaaaattatgatgaacagcattctgttatcccca

SEQ ID NO: 25801 - DNA, 201 bp, Homo sapiens
agcaattctcctgcctcagcctcccgagtagctgggactacaggcacatgccactatgcctggctaatttttgtatttttagtagagacggggtttcaccmtgttgactaggttgatctcaatctcttgaccttgtgatccgcctgcttcagcctcccaaagtactgggattacaggcgtgagcaaactccttattttata

SEQ ID NO: 25802 - DNA, 201 bp, Homo sapiens
tcagtaatatattagcagggactctaatagggtgatttttcatagtcagaaagggccactgccgctaaactccttatttatttattgtgaggtggagtctygctctgttgccaagctgtaatgcagaggcacaatctcagctcactgcaacctctgcttcctgggttcaagcaattctcctgcctcagcctcccgagtagc

SEQ ID NO: 25803 - DNA, 201 bp, Homo sapiens
tgaatgaatgaatgaaattatgaaaaactacaaatgaatgaattgactgtgtgattcaatgagaaaatgtcctttagaaagaagtctgccggaaagtgcasgcttctcctttctgctgatctgattctcacagccagtaataagagaaggaaatgcagatttctctcatcaaagtgtaggccctgaacccttctttggaca

SEQ ID NO: 25804 - DNA, 201 bp, Homo sapiens
tccacccctgccatcatccaaaacagctttctttgctgttcctcatgtcacctgactccttgagttacagctctccaagagaaatcatattttattccctyttcatgagagcacataattattttaggagtcagttgggttgatagatactgcgtgaggctccagagaagattttcctttaaagaatctatctgggccagg

SEQ ID NO: 25805 - DNA, 201 bp, Homo sapiens
atgaaatattcagagaaggaactataacttgtgggttgggccacaaatccaaaaagggtcttgtgagtattatcgtcactgaataaactctcaggtgctgyaaagagaaaatggtgttatttctagtcagaatatacaaccatctcacaatgatactctaaggaatcaaggcatagtcctatgcaaatctaaaattgtcca

SEQ ID NO: 25806 - DNA, 201 bp, Homo sapiens
tgaacctgtctgttctactatatgatgaggtgtgagggtacggagaaattcattatggtcccccaaaccaggtaagtagaaagtggtagaaccagggatasagctcagctctctccaaagtctctggcttaacatgcctgaattgtctattgtcagaagtttggtaaactgaatttgctgaagttaagacatcatctccaa

SEQ ID NO: 25807 - DNA, 201 bp, Homo sapiens
agaccaattaggtaaagtcactcaaaatttttgagagtggatgctcagaggtaacactttggcatagaattgttaaatagcatgcactttaatggaagaayagaatcattaaagattggttgataacaagtcacagtgtatttaaccatcatcacagcagatgtagacagaaatggcaccactgcttatgaaggaaactgg

SEQ ID NO: 25808 - DNA, 201 bp, Homo sapiens
ggctatgaatggcttgctcatgacatattttgtatttgatgagaataccatagtgtttgataaatattcagaaatgtatcgctaaaacatatggctattckaggtattctttttcagaatcatctataggaaagctctagctgctcaggcattcctttccccactgaaattactaacaacataaagtgattatcatggtat

SEQ ID NO: 25809 - DNA, 201 bp, Homo sapiens
aggcctgtttgacaggaggaaaactgatgcttagagacgttaagtgacttgctggcattcacatagccaggagcagtgctggatggaaacccagctccacygagctccaaagcctaggcttagaatatgttagactgtataagatggacgaacttggaaggatttcagggagggaaggattttggtggactctaggcctta

SEQ ID NO: 25810 - DNA, 201 bp, Homo sapiens
gcatgacttgccccaggatccagtggtggagttgggatttccgcattatctaacatcctcccatgttagactccaatgcttatgctccttcaattcattaygtgtctggaggactttggaagctatacgtggctctcccacactacctgtcccctgtggccagcataagtgaactcttgcatgggtggcttctctctccat

SEQ ID NO: 25811 - DNA, 201 bp, Homo sapiens
tgaagaatgtgatgaggagggtattaattaaaagttgtaggccaggcgtggtggctcacacctgtaatcccagcaccctgggaggccgaggcgggcagatsacgaggtcaggagatcgagaccatcctggctaacacagtgaaaccccatctctactaaaaaatacaaaaaattaaccaggcgtagtggcgggtgcctgta

SEQ ID NO: 25812 - DNA, 201 bp, Homo sapiens
gaagtttcttttttaaaaaaattgtttatttatttattatttttatttttaacagggacaggatctccctatgtttcccaggctggtctcaaagtcctggrctcaagagatcctcctgtctcagcctcccaaagtgctgggattacaggtgtgagccaccatgcccggcttcttagaagtttcttttagaaccattgtgtc

SEQ ID NO: 25813 - DNA, 201 bp, Homo sapiens
cataagaaattaccttgggcaaggttgtgagaggatttggaatctaaatggagaaaagtgtagaggcatatttttcaatcttctacttctatgtcattttycctgtgtgttggattgctaagattatgtatctattgctggcagaaatatcatatcctaaattcttggagaatgatattggttgcccaagattgtatagaa

SEQ ID NO: 25814 - DNA, 201 bp, Homo sapiens
tttgaagcaatggaggaagaatttttaaaaattcatgaagctttcattttgatgaggctcttcacaagatgtcttagaagtttcttttttaaaaaaattgkttatttatttattatttttatttttaacagggacaggatctccctatgtttcccaggctggtctcaaagtcctggactcaagagatcctcctgtctcagc

SEQ ID NO: 25815 - DNA, 201 bp, Homo sapiens
ggaaaaggtctttttggcagtgtttcatcttcttggttcatttttgggctttcttgatagctgaaaaaaaaatctaactcaccttactattttgtttgggsatgatggtttcagcctctctgcttgaacttgttctcagttttttgtctactgttagctcatattcttccaatgcacatttttgggcattattggttatag

SEQ ID NO: 25816 - DNA, 201 bp, Homo sapiens
aggaggctgaggcaggagaattgctcggacctggcaggcagagtttgcagtgagccaagattgcaccactgcactccagcctgggtgacagagcaagactytgtctcaaaaaaaaccaaaaaacaaaaaacaaaaaaacaggttaatatcagcaaattcatagagtttatctagtatgaactcattcagtcatcctataaa

SEQ ID NO: 25817 - DNA, 201 bp, Homo sapiens
ttctttacatttgtttgccttatatgacattggataaattatattctttacttctataaataatcgtgaggaaaatagtgctcatgttatgttatggttgycatatcacaatgtctaagatcatgcaggggtggggaggggggatacagagattgcagaataaagacaatgctatttttaaatgttgacaatgtttatctt

SEQ ID NO: 25818 - DNA, 201 bp, Homo sapiens
atcccagcactttaggaggccgaggcaggtggatcacgaggtcaggagttcgagaccagcctggccaaccctgtctctactaaaaatacaaaaattagccrggcgtggtcctgcgcacctgtaatcccagctactcaggaggctgaggcaggagaattgctcggacctggcaggcagagtttgcagtgagccaagattgca

SEQ ID NO: 25819 - DNA, 201 bp, Homo sapiens
tcgaaaacctccagctcatggctcagtcgcccaatcaagtaaatagaaaatctctttccttcacaggttattaaattgctgcttgattttgctttgatcakgaattcaggggattcagtttgaagaatgagtagcatgaaatttatacccatgaggaatttgcatttctgatgttgtcctaagattgtgggagacattagg

SEQ ID NO: 25820 - DNA, 201 bp, Homo sapiens
ttcctgattcagtaggtctggggtggagcccaagcatttgcatttctaatcagttccctggtaatactgacactgctgggacagggattgcactttgagarctactgctctggaggaaagccttgcatctgaaagcctcaggaagaattcaagcagtgtcccaatttaacattgcactacaccagagtgattaagagcttg

SEQ ID NO: 25821 - DNA, 201 bp, Homo sapiens
atccaccagcctcagcctcccaaagtgctaggattacagacgtgagccaccacgcccagccatgaatttaaagtttaaatggcaattttaatagtcacagkaccctagaatgcttatagcctaatgttagtaaatcaaatgctttttacaagactgatattcacagacactgattctttctgatttccacagtggtacgga

SEQ ID NO: 25822 - DNA, 201 bp, Homo sapiens
tttgggatttagtgactgtctttctcctggttgtaatatttattcggtggtgggcatggcttatgggtgtgctttatgaagtttttgcacctgcaactcargtcagtacctttcttaaaagaacacaaaagaaataaacttgaaacagtccaagtgattttagatatgggcaatgggtcaacctccagttgatatatgtca

SEQ ID NO: 25823 - DNA, 201 bp, Homo sapiens
gcgggatccctggaacaacaacaacaacaaaacattgctagtatctctttctatcactaagaaatgttcaaattctagtagccttaatttctactctatgwgcagggatgtcctagagatcagcctaaagtcgttcataatttctttgaggaatacaaaagaaatctagaattaagaaggtcccattttactgcttgccac

SEQ ID NO: 25824 - DNA, 201 bp, Homo sapiens
attgacaatcaacaaaggtggcgggatccctggaacaacaacaacaacaaaacattgctagtatctctttctatcactaagaaatgttcaaattctagtarccttaatttctactctatgtgcagggatgtcctagagatcagcctaaagtcgttcataatttctttgaggaatacaaaagaaatctagaattaagaaggt

SEQ ID NO: 25825 - DNA, 201 bp, Homo sapiens
cttctgcaaaccaagcgggccgtgctgctagctactcactgcttcttgggttccctgtctttttaaagtaaccatgtcgaaggtgcttatcattatggtakgcaattttgtcggatgttagcgaacacaataattagtggtctcagcaggaaggagaataggtctaccctaaagtaccacttcccaccaaagaagaaaatc

SEQ ID NO: 25826 - DNA, 201 bp, Homo sapiens
cggcaaatgctcttctgtatttagacctgctggtttcctagccagaagtgggtgtttgcacaagtggacaaaacttgccccttaaaaaagaaaatcaaaakcttcatcattttgcagatgtatcttccctgctgaggctattagtctgctacttcaaatccttttcggaggaatatatggaattaatagcaacacatttta

SEQ ID NO: 25827 - DNA, 201 bp, Homo sapiens
gaaaccacagatgttgatcttcatgtatatctgtgcttgttaatttccaggttgaatttcacagagaacggcaaatgctcttctgtatttagacctgctgrtttcctagccagaagtgggtgtttgcacaagtggacaaaacttgccccttaaaaaagaaaatcaaaatcttcatcattttgcagatgtatcttccctgct

SEQ ID NO: 25828 - DNA, 201 bp, Homo sapiens
aaatcagctgtagaccataagccaccttcaggtagtggtttgggaaatcaagcaataacactaatattgattccttcagatatggactccagtcatagtayaacgcttcagcctactgcaaatccaaacacaggtttggtggaagatttggacaggacaggacctctttcaatgacaacgcgtaagaataacgatgctcag

SEQ ID NO: 25829 - DNA, 201 bp, Homo sapiens
ttgtgttggaccacattcaaagtcatcctggaccacacaaggcctgtgagccgcaggttggacaagcttgccctatatgaagtctgaaagtgataaaagtkctataaaaaagaaagcaaaatacgaggctaatgagtgctagggatgcttttattttctgagaaggtggtcagggaaagtgcctcctggactgttctgaga

SEQ ID NO: 25830 - DNA, 201 bp, Homo sapiens
ttaaatgtcattgaatgggatattatgaaattcccatcttagccatttaggtcaatatcctgttgtttttctcttacaggtatgggttcatagaagggcaygtggtgattccccggatccaccccaactccatctgtgcagcaaacaacacaggggtgtacatcctcacatccaacacctcccagtatgacacatattgct

SEQ ID NO: 25831 - DNA, 201 bp, Homo sapiens
acagtccaggcaactcctagtagtacaacggaagaaacagctacccagaaggaacagtggtttggcaacagatggcatgagggatatcgccaaacacccaragaagactcccattcgacaacagggacagctggtaatggatggtttaacaagtaaatttggatggaaacttccttttgggttaaacggtagacattgagg

SEQ ID NO: 25832 - DNA, 201 bp, Homo sapiens
aagaataacgatgctcagccactttattgacttgtattcctgcttcatctcttactcgctattggccaagatgcagagctttggtggtggaatggtgctaygtggcttacttcagcccagagtgtgaaactgtcttcattgtctgtatttcttgtggaggtctctcaacctgattttcccttcatttctttgtgccttcca

SEQ ID NO: 25833 - DNA, 201 bp, Homo sapiens
gaaaaacctgctggatttagcttcctcctctctgccctcctgctgcaccacagcttcccttgcacatggcattttctcagcccacatctcattttttgagrcattttatattcaaaaaaaattgtgtttttagcacaattaaaaaataagcaagtttttagccaccaggatgctgctagaagaggctgggctgtgtatgtt

SEQ ID NO: 25834 - DNA, 201 bp, Homo sapiens
gctaacccattcctatttaggctgaaaacaattaagagttatgggtacttaaaaaaatcattatgtttataaaattagtgatagaaggagcatagtgttctatacagtcacacacatacacttccttatttcttttatttaaactttgagtaacatagcagtctatgtttgggtcagttttcccttttttgtaattacatt

SEQ ID NO: 25835 - DNA, 201 bp, Homo sapiens
aaatcaagcaataacactaatattgattccttcagatatggactccagtcatagtataacgcttcagcctactgcaaatccaaacacaggtttggtggaasatttggacaggacaggacctctttcaatgacaacgcgtaagaataacgatgctcagccactttattgacttgtattcctgcttcatctcttactcgctat

SEQ ID NO: 25836 - DNA, 201 bp, Homo sapiens
tgcttagtagtggaatctggaaagaaagtttgtcaagtgaattgatctttggaatccttattttctatgaagatctttgatgaatacagtgtcttttttgyattctgtccctgactgttctatagaaagacatcccttgtactctttagagcaaagttggtagctcttatggtcttcatttgaattctaccactgcttctt

SEQ ID NO: 25837 - DNA, 201 bp, Homo sapiens
tctactattatgaaaactcaggttttctaaaacaatctcaagttgcggcagtggactgtgagaatagggggccccctcactccccaaacataagaagtatrtgcttttcttcttttatctatcccgctgagatatgtctatcttatttggaataaaagtatttattttggaaaacagctttttagcatttttaaaatgatg

SEQ ID NO: 25838 - DNA, 201 bp, Homo sapiens
agccaccgcgcccggccttatttgactttttaaggagtctgtcctaaactgaacttattactgtctccaaattatttatgcaaaagaatctaacatttctrtttcttcccatagatttgaatataacctgccgctttgcaggtgtattccacgtggagaaaaatggtcgctacagcatctctcggacggaggccgctgacc

SEQ ID NO: 25839 - DNA, 201 bp, Homo sapiens
acaaaacatgttgactcagattttgtcatgatccttctgttaggtgcatctcttattccagccctaacagattgggtgacaatatcagggtgctggtggaygtacgcctctttctttccagtgtgctgctatgatggtggctggttacctgtggtgtcttattttctttcactggctatgaatggcttgctcatgacatat

SEQ ID NO: 25840 - DNA, 201 bp, Homo sapiens
ccaggctggtcttgagctcctgacctcaggtgatccacccacctcggcctcccaaagtgctgggattgtaggcatgagccaccgcgcccggccttatttgrctttttaaggagtctgtcctaaactgaacttattactgtctccaaattatttatgcaaaagaatctaacatttctatttcttcccatagatttgaatata

SEQ ID NO: 25841 - DNA, 201 bp, Homo sapiens
aattcatgacacctggggcaaagaaatgatcctatgaacatctagaaaggaaaaatacatacatggaggatcaacaatcagaatagaatcagatttctcartggccacattggaagatagaagaccatgaaacagggcctcaaaatactgaaagaattatttccaagctagaattctaacttagttaagctgcaaattaag

SEQ ID NO: 25842 - DNA, 201 bp, Homo sapiens
ttctgcttagcacctatggacataattcaacatgatgccctctttcttctggaggggtgtgataactgcttgataataagcactttttcaggcctattgaraatgtggttaatgattctaaacttgatttttcataacttgtaaaatagagctgacagtattatagttctgaaaacagttttgcgttatttgggtatcaaa

SEQ ID NO: 25843 - DNA, 201 bp, Homo sapiens
aaaaaattaaccaggcgtagtggcgggtgcctgtagtcctagctattcgggaggctgaggcaggagaatggtgtgaacccaggaggagatcgcgccactgyactccagcactctaacctgggtgacagagccagactccatctcaaaaaaaaaaaaaaaaagttgtggaagttcctaaattgaaggccctaaaggcttaaa

SEQ ID NO: 25844 - DNA, 201 bp, Homo sapiens
gagggacagaactatgcttatctggcaccgtctgggtaatttagaggaacaaagtcaaaggtatctgaggtggctgaagcctcacactcattttatttttwaaaaaagcaaaaacaaaatgggtttccatcaacttgaaagtcttcttttggagaaaatctggttttctatgagtgatgtgtggttcacatgtttcaaact

SEQ ID NO: 25845 - DNA, 201 bp, Homo sapiens
gagctgggttttagaatcataaactctcaggtttggaaaggatgttaaatggtctggttcaatcaacacttctaataatttaatctcttacacaactttcytgccaagtgatcttcctgactatgggaaacataatactttatgaagaagttcattgttggatagttcagattattggttttttaaatccaacatttggaa

SEQ ID NO: 25846 - DNA, 201 bp, Homo sapiens
taagattatgtatctattgctggcagaaatatcatatcctaaattcttggagaatgatattggttgcccaagattgtatagaagattaaggagctaggacyctgaagagctgggttttagaatcataaactctcaggtttggaaaggatgttaaatggtctggttcaatcaacacttctaataatttaatctcttacacaa

SEQ ID NO: 25847 - DNA, 201 bp, Homo sapiens; identical to SEQ ID NO: 4274

SEQ ID NO: 25848 - DNA, 201 bp, Homo sapiens
aaatatgggagattacaaggacaccctcatttattaactttcattgatggagttaatggccatatttcaaaataactaggcattctttctgcagagggggrtaataaacatggaaaaattattctttacatttgtttgccttatatgacattggataaattatattctttacttctataaataatcgtgaggaaaatagtg

SEQ ID NO: 25849 - DNA, 201 bp, Homo sapiens
cctgagatttaagggaagaggagataaaggtaagacacagatccatgaggatctctgatcttcagagtcagaagatccaagctgtggctgggcgcgggggytcacacctgtaatcccagcactttgggaggctgaggcaggcagatcatttgaggtcaggagtttgagaccagcgtggccaacatggagaaaccctacctc

SEQ ID NO: 25850 - DNA, 201 bp, Homo sapiens
gaccttcctgagcattgcacactcacgtgctgattttctcgtctctagacagctggaagctggtgatgccattcagggaggtgggctcttgtggttgtcartaaactgcctgcattgactactactgcctaccttttttcctcatctataactgtttttcttaccttagcataagaagtgccatattggaagttttatttt

SEQ ID NO: 25851 - DNA, 201 bp, Homo sapiens
ctcataaggtaaaagaaacttatttccaagcaggaccacctttattgtgtccccagatcacctcacagggcagaaaaatgcccctcagtctgggagaagayctagagagaattatggactccttactggtttttggaaagcaaccaacagctaattccaacaccatgggcagcccatacagtctctaattatctgagaaaa

SEQ ID NO: 25852 - DNA, 201 bp, Homo sapiens
gtttcatcgtcttcttgctgttaggaggtctatgaagcagagaagaactttcctttggaaaacaactaaatgaagacagtcacctcgctagaactgacacrtgggctgtttttatattcttgaaggccactctctccctacctgaaccaagacctataggtttacatgttatttacattttatatataatatatatatata

SEQ ID NO: 25853 - DNA, 201 bp, Homo sapiens
ataagaagagcactgtttcatcgtcttcttgctgttaggaggtctatgaagcagagaagaactttcctttggaaaacaactaaatgaagacagtcacctcsctagaactgacacatgggctgtttttatattcttgaaggccactctctccctacctgaaccaagacctataggtttacatgttatttacattttatatat

SEQ ID NO: 25854 - DNA, 201 bp, Homo sapiens
tctaccactgcttctttttctgtttttaagcccatggtaacttggggaaggctttgatgctcttactgttatttctactattatgaaaactcaggttttcyaaaacaatctcaagttgcggcagtggactgtgagaatagggggccccctcactccccaaacataagaagtatgtgcttttcttcttttatctatcccgct

SEQ ID NO: 25855 - DNA, 201 bp, Homo sapiens
gttctttgaccttccagaaagttaacaaacaaaatgccttgagcatctcagacaacggctgccatgaccttggctctacactggtccacctgctttgactkgtccacttttgctttgactggaccacttccacctcttggtagctattcctttgattgtgctttgtcttcaggatcacacacataaggccatgtttcatct

SEQ ID NO: 25856 - DNA, 201 bp, Homo sapiens
ggaaaatgaggatactaatattacccacctcataggaatgttttaaggataaaatgagtaaataattctaaagtgcctaaaatagagcctggcatatacayaatgaatgcacaataaatattagccactgctcttgctgttggcattattaatatcctcccgggtaataatttgggtttgcgttagtatcaaggaaacctg

SEQ ID NO: 25857 - DNA, 201 bp, Homo sapiens
aggttaagtaattaacaacctgtgtcacctaaagtgagtggcagggtcaggaattgaaccaggtttgaggaggtcctaactaggttgaactactgaccttmataaaagtttggcactacagaccagctttataggacaaaaaaaccttctttcagagctcctttttctcgccttcctgacagctccctagcagacctcttc

SEQ ID NO: 25858 - DNA, 201 bp, Homo sapiens
aaaccctgacaggttcgcattgtcatcccatcaaggaagaggtggagagtcagagaggttaagtaattaacaacctgtgtcacctaaagtgagtggcaggktcaggaattgaaccaggtttgaggaggtcctaactaggttgaactactgaccttcataaaagtttggcactacagaccagctttataggacaaaaaaacc

SEQ ID NO: 25859 - DNA, 201 bp, Homo sapiens
taatggcatttgggatcagtgatggtttatccaggagagaatgcatagtacctgtaaccaggagcctgaataggaggcaacatagcatagaggttagaatsctgactttcccacttggatgacattgggcaaaggacttcaccactttgtgcctcagtttcctcatctctaaaatgggtttagcaatagtgcctacctcat

SEQ ID NO: 25860 - DNA, 201 bp, Homo sapiens
cacacctgggtggctcaagttagaaaacaaattaactcattttgcagaatctggagacgtctggtctggagaactgacagtgccctctctttgggcatagyatgactgtaggttgtctttgggtggtcttcatatggaatgtactgtgtttgccatgttccctaggagatctggcctcagaaatggccctgtgatggtatg

SEQ ID NO: 25861 - DNA, 201 bp, Homo sapiens
agaaggttgcttcagctacactgcagtctgcttttaagacacaaggaatggaatgcagggtggaagtttcagggcctgttatcagaccgcttgagacagtrctgctcagagggctaccagtaacatctgtggatgatcagtcaggcccaagattcaggcagaaatctttattcctaaagcaagggatgaaagagtagagga

SEQ ID NO: 25862 - DNA, 201 bp, Homo sapiens
atccctcctgaggagatgacaaatagggatcaggcacacctgggtggctcaagttagaaaacaaattaactcattttgcagaatctggagacgtctggtckggagaactgacagtgccctctctttgggcatagtatgactgtaggttgtctttgggtggtcttcatatggaatgtactgtgtttgccatgttccctagga

SEQ ID NO: 25863 - DNA, 201 bp, Homo sapiens
aaatttggagagcttaccagtgcttctggctgcccaagtggtttgtgtgtggttgactcccaggagctcaatcactttgggtgcagtccacccagagagcyatgttccagctacatcaacctggagccttagcttggtcagtctagatttttgggtttggctgcagacatctcgtaatgtcacaaggacagcctgtgtcct

SEQ ID NO: 25864 - DNA, 201 bp, Homo sapiens
ggtgacgatcaggttactatagattccttataaggtgccttcataatggataactgtagccattttatgtaagcattgtcctgtgattaaaaaaaaaaaaagattccagtatgcttttgaaaaatgtgggtgggggagagagttttaatatgctgcattcaagatttgacctatggatttagattctagcaattcatgagg

SEQ ID NO: 25865 - DNA, 201 bp, Homo sapiens
tataaatatttatttatatttatatatttatattcatttatataaatttatatttatatatttatatttatttatataaatttatatataaattatatttwtatatttaaatatatattataaatatataaaaattatatttatatataaatttatatatatatattatatataattctatatataatataatatataata

SEQ ID NO: 25866 - DNA, 201 bp, Homo sapiens
caataatgctttaaaacaacaaaaccttgtccttttcccttcctacttctgatcagaaccagctcagtaagatttattagttgtgcaatctgttttggacwtgagctcagcaaatcagaggacagaaatagaatcctggctttttaatgataaacactgtaaaaataaaaaatttggagagcttaccagtgcttctggctg

SEQ ID NO: 25867 - DNA, 201 bp, Homo sapiens
aacttgggtatattttagataaaagaatgcttccttttgccagtgttttttccatttgtctgtgtttgcatgtgtgtgtgtgtgtgtgtgtgtgtgtgtgttgtgtgtacaagttggctgttatgatggaattgctttctttgtcttatcttgtgatatatgaagttgaaccacatgaaactgatatttttgcaggtgaaa

SEQ ID NO: 25868 - DNA, 201 bp, Homo sapiens
acatcttgctggagtgtcagttttccctaaagatgtgaaggggatgttaaattagctggaaagggacttaagacattatcagcctgagacaaacacagatwtatacatatacatatatatatatttatatatatatttatttatatatatttataaatatttatttatatttatatatttatattcatttatataaattta

SEQ ID NO: 25869 - DNA, 201 bp, Homo sapiens
ctttgagacgataaaggagaggacactaactaaacaagaagacaatgatctgatcaggacaagaagacttggagtacaaaatgagaagaagataatagggkaatggattttttagtggcacagtgggaaatggcgtaggtgtttacactgcactggagccctcactgtgcttggaactggttccctgtgcacagtcttgca

SEQ ID NO: 25870 - DNA, 201 bp, Homo sapiens
gactcatggtctgcactgggcagccaaaggcgattcggccaccaagtgtgattctggcctcattcagaagtggatgctaaacaatacaccctttcaccagsagcccatcacatgggcatcaggagatgggggcgagtgatgtgccagccttctagactggcaggcctggggggcagcagagggcacaatagctagaaagac

SEQ ID NO: 25871 - DNA, 201 bp, Homo sapiens
aaacttgggtatattttagataaaagaatgcttccttttgccagtgttttttccatttgtctgtgtttgcatgtgtgtgtgtgtgtgtgtgtgtgtgtgtgttgtgtgtacaagttggctgttatgatggaattgctttctttgtcttatcttgtgatatatgaagttgaaccacatgaaactgatatttttgcaggtgaa

SEQ ID NO: 25872 - DNA, 201 bp, Homo sapiens
ttttgagaaggatcaaaatataaatgtcaaatatctcgatgccaactatcaaaagtcttacctcttaaactgggccttctgttcccatggaaggtttgaakttgggtgaagggaaagatgaagccttgaggtaaacttggtacatcttgctggagtgtcagttttccctaaagatgtgaaggggatgttaaattagctgga

SEQ ID NO: 25873 - DNA, 201 bp, Homo sapiens
ctgcccaccacagcatcacagaaaggtgaattggacttggtttatgaaaaataaaaaaaccctggatagtcagagaaaggaagtgggtggtgggggttggdggggggggcagttttcctaagaaggagactcctgtaaggagaaacgtgaaggaagaaaagccaaggaatgaatatgtcagtgagtggatccatttttcac

SEQ ID NO: 25874 - DNA, 201 bp, Homo sapiens
ctggaaaacatgaaggtattccagagccagcatgaatcttacatcaaaacttctctcttctgtgactcaggcttccttctgtttgttcaaatagactcaamactgctgaacacaaattttaactgaaactaattattcctttcatgatttttttttaaagctctttataggtctctaaataaaatcactttgtttctatca

SEQ ID NO: 25875 - DNA, 201 bp, Homo sapiens
tcagatttgagcttaatatcatggtgctttggaatgctggagtgaattttgaaggctctggctagcagagaagtttatttggctttttgtttgtttgttcyttttttttttttttttttgagatagagtctcgctctgtcacccaggctggagtgtagtggcatgatctcggctcactgtaacctctgcctcctggttcaa

SEQ ID NO: 25876 - DNA, 201 bp, Homo sapiens
aatgtaagagtgatattattttaccatgtcttttctcagatttgagcttaatatcatggtgctttggaatgctggagtgaattttgaaggctctggctagyagagaagtttatttggctttttgtttgtttgttctttttttttttttttttttgagatagagtctcgctctgtcacccaggctggagtgtagtggcatga

SEQ ID NO: 25877 - DNA, 201 bp, Homo sapiens
ggaagtgttcaggaggaataagcttcaccaggatagtttcaatgacttaaccctttgcatgcagtttcctcaagtgtaaaccgggggtcatatagtcccargagttttcaattacagcctttgaagtcttttgagattgttacacaggatcaagtagaagaggatgatttctagctctctattggaatttcagattaatgt

SEQ ID NO: 25878 - DNA, 201 bp, Homo sapiens
atggagctggttaatgccagttctgtctgattccagacctggttcttaactaacaacaaggagtggtgcctggccaggcacttggggcattgtcccaagasgatgtcaacatgtcttcttagagaaggacagtcattgaggcctgaggaagtgttcaggaggaataagcttcaccaggatagtttcaatgacttaaccctt

SEQ ID NO: 25879 - DNA, 201 bp, Homo sapiens
tcaaaataaagtttgaaacaattaggatggatttgcaaataacctttcacaaaacatgttgactcagattttgtcatgatccttctgttaggtgcatctcwtattccagccctaacagattgggtgacaatatcagggtgctggtggatgtacgcctctttctttccagtgtgctgctatgatggtggctggttacctgtg

SEQ ID NO: 25880 - DNA, 201 bp, Homo sapiens
acccaaacagatctacctgtaaatgaattgtatggtcaggcttcagggaaaaatttcccatggtgttggttttttttttttttttttttttttttaatttkttaaatctctatggcatatttttccaatttctgcttttctttttttttcttttctgcttagcacctatggacataattcaacatgatgccctctttcttc

SEQ ID NO: 25881 - DNA, 201 bp, Homo sapiens
cagctgggtcattaagacagctcagcctgcatgcagtaaattctactcagcaaatatttattaacccagttccacgggagtactgagaaattgaaacacayagtctcacccaggtagtttagattgagtacccagtataaagtatcttgaattactttctgctttctctatcttcctactttctgcagtaggaagaaagtg

SEQ ID NO: 25882 - DNA, 201 bp, Homo sapiens
acggaaaaaaggcagagaaatcagggggtccagccaggcgccaagacgttggggtgccttgcatttctaagtgccaagtgatgaatagctcagttgaaagyaacccagggcacattctggaggaaattctctgggtatgattgtgcatgactgttttctctgctcattaaaccctcatctgcctccagggcaattccggga

SEQ ID NO: 25883 - DNA, 201 bp, Homo sapiens
gtcacataattagcttataattaacagagtttaggctagaaccagtgcatcccactcccagatgggggcccccggcttatctcagcatgtcagcaacccawgaatcagccctgaaatatagatattacctatgagtaacagtttctcatcctacctcaactgttacgaaagtcttccctcaaactaaagctaagcagttcc

SEQ ID NO: 25884 - DNA, 201 bp, Homo sapiens
aagctgccagagccttagtgttacagccacatccattaccccaccattcacatacatttcatgccccagggtgagaatccacatatcccaagcagagaggcacagctttggtaaactgagtcttagctaactcatgtcagaaaccaagtgttatcctggggtttgactcctggctcttgccacattcatagcaggatgctg

SEQ ID NO: 25885 - DNA, 201 bp, Homo sapiens
tatcaagtttcaatgatcgcaatagtacttatctcatgtgactactgtgggattgaaacgagatagttcatgtgaagtaccgagcacagagcctggcacasagtaggtactctattagtgttaatatcactggaaaacccagctgggggctcagcagtagaagctgccagagccttagtgttacagccacatccattaccc

SEQ ID NO: 25886 - DNA, 201 bp, Homo sapiens
tggctcctaattatcaggaagcctggaggtcttgagtggttgtaaccaaggatactgaaagtggttgaccagttaataaagaattaagttagagtaagagrcactttacttttaagctgcctttaatacactttaatctttgagatgattggctaatatctgttaagtaccaggctctttgcagagagtcaggtcctttgc

SEQ ID NO: 25887 - DNA, 201 bp, Homo sapiens
gatataggaaaggagcccgattatctgtttgagcttcctgttctttgtattgtttggaaggctaaagtcaacagccacttttgtattctgcattgtttgcrttgttaaaaactctggaaaactcatctggtttcttctccaaaagtagcttcccagagccctgggagacactcagaaataagatccttttcaaataggcca

SEQ ID NO: 25888 - DNA, 201 bp, Homo sapiens
gtgaaaattacacagtgctctcttcccagcacatgttgtgattttctacaacttcagaaataactggggtggaccaagaagctattattcctcgcaggccmtacaatctaggcaaagctttgaaatgtgctcggacaattttatcagagatctattttccttgatctgaggcttagggggcagtatagatgagattaatgg

SEQ ID NO: 25889 - DNA, 201 bp, Homo sapiens
gatgtattgaccagctcctggattccatattgaaaatcccttgcagcccagctccaatactagtaccaggccactcacctctcaggaaagtttgggaagaygtagataatggcaacttgggtgaaaattacacagtgctctcttcccagcacatgttgtgattttctacaacttcagaaataactggggtggaccaagaag

SEQ ID NO: 25890 - DNA, 201 bp, Homo sapiens
caggagaatggtgtgaacccaggaggagatcgcgccactgcactccagcactctaacctgggtgacagagccagactccatctcaaaaaaaaaaaaaaaaagttgtggaagttcctaaattgaaggccctaaaggcttaaatgatgggagctagaactcaagaattatcttagttaatcaaagcccagctgaggtcaaagg

SEQ ID NO: 25891 - DNA, 201 bp, Homo sapiens
attggctgtgcatggtggcatgcacctgtagtcccagctgctcaggaggctgaggtgggaggagtgcttgggcccaggagtttgaggttacactgagctargattgtgctactgcactccagcctgggtgatggagccagaccctgtctctattaaaaattaggaaaagaaatagcctgtctactctattggtccataacc

SEQ ID NO: 25892 - DNA, 201 bp, Homo sapiens
taattgtgaagaagggagacaccatttctgttgtcaacgaagcccacagagaagttccaaaatttcagaatgctggaatttctggttactagagaccttgragataataatttcttgtaattctttacctggttgtgtcacagactttgaaaaccaatgaaaaccagagatgttgccctacctaaacacacacacacacac

SEQ ID NO: 25893 - DNA, 201 bp, Homo sapiens
tcactcttgctaattaggcttctgacttcagacaggtcagaagctctgtccagcaaaatttttaaatctttaatataaggagcatgaaccagatgacatttaagatccttccctctctgacattctataaacttcagtttgagtctctgaaaaaaatggaacttttttgctttttccctttcttttcaccatctatatcaa

SEQ ID NO: 25894 - DNA, 201 bp, Homo sapiens
tcccttttctactgcactcttagagtgcattaatgtgtgtgaagtgttttcggttccattatctaaagcagccctcatattaacatcgtggttggcattaytggcctcctgtatgggatgaaagtttaatgacttctgcaaggttatgaaaggtcaagatcacagctaattagtgcaaattcaggatttgaattctagttt

SEQ ID NO: 25895 - DNA, 201 bp, Homo sapiens
aacctaaactaattcaggaagcagactcctgccttggaacactgtatttccttgtcttctgggtgtcaaaggaattctttcttttttttttttttttttttcagatctggtatggcctatttgggtggggaaaattagaaattctgctggctaggcagtagctttttccatttttccccctcataccactcctttcaggaa

SEQ ID NO: 25896 - DNA, 201 bp, Homo sapiens
agagcataatagggagatctcatctgatttaaagcaccagggaaagcctcccaggacctgttggatgaatagcagtaaccatgtctccaggatccccacarttccttgaggacccttgttgtcagacttctcagagctgtaccagccctctcactgtctcaccattgggtcttctgagtaagaaagcaagaaaaaaaattt

SEQ ID NO: 25897 - DNA, 201 bp, Homo sapiens
caaattagcagctccatacattgcagaatcttttctttttcacttaaggagatgctaaaagaggcaagaggaaagaaaatcaaatttggagatgccgtggsctgtgtgttgaagttgggctctggtggaattggtggtgaccttttgcttctctccatctggatggctgtatcttcaaagacaacaagtcttaactgcagt

SEQ ID NO: 25898 - DNA, 201 bp, Homo sapiens
aaacctaaactaattcaggaagcagactcctgccttggaacactgtatttccttgtcttctgggtgtcaaaggaattctttcttttttttttttttttttttcagatctggtatggcctatttgggtggggaaaattagaaattctgctggctaggcagtagctttttccatttttccccctcataccactcctttcagga

SEQ ID NO: 25899 - DNA, 201 bp, Homo sapiens
tttataaagtctctctttctctttctctctctctcatctctctccaatctatcctctctatcaagagagaacacatgtaatgtagagtgagagcccatgtrttggataattaggcttctggctcctaattatcaggaagcctggaggtcttgagtggttgtaaccaaggatactgaaagtggttgaccagttaataaagaa

SEQ ID NO: 25900 - DNA, 201 bp, Homo sapiens
tacttttaaatttttttacaatgttcctgcattacttttgtaatcacaaattttaaaaatcctccctaatgtgtttgcattagagaaggagccgtgtctatcttatttaaaattgtacccccaggcttccacagtgcctgatatagaatgtatatttattaatgaatgaattcactgtggtgggaaaatttccggaaactt

SEQ ID NO: 25901 - DNA, 201 bp, Homo sapiens
ctgagagcaggatgctggtaacactttcttttgtgttttgccaattgtttctttttactggctagtccaccctgtctgacgcattcattataccataaccmccttgacaccagagtgaaatgccatttctctgcaggtaggagagagtcacacggattccttgagtgtttgtagcgtaagtgagaaagatatgtagccttc

SEQ ID NO: 25902 - DNA, 201 bp, Homo sapiens
ttacttttaaatttttttacaatgttcctgcattacttttgtaatcacaaattttaaaaatcctccctaatgtgtttgcattagagaaggagccgtgtctatcttatttaaaattgtacccccaggcttccacagtgcctgatatagaatgtatatttattaatgaatgaattcactgtggtgggaaaatttccggaaact

SEQ ID NO: 25903 - DNA, 201 bp, Homo sapiens
tgcactaggcagagatggagtaagaaagaactggaggctacatttcttgtcttaaaggagttaacaatcttgttgaagcaatgagacaaaaaaaaaaaaaagaaagaaactggagaagaggataaatgtgtttaaggataaataaattctgaatgtcttggattagagtcagatgataggggtattaagtgagctaaagat

SEQ ID NO: 25904 - DNA, 201 bp, Homo sapiens
attctgagagcaggatgctggtaacactttcttttgtgttttgccaattgtttctttttactggctagtccaccctgtctgacgcattcattataccatamccaccttgacaccagagtgaaatgccatttctctgcaggtaggagagagtcacacggattccttgagtgtttgtagcgtaagtgagaaagatatgtagcc

SEQ ID NO: 25905 - DNA, 201 bp, Homo sapiens
gtggcaaaaactcagtaatagcttacaaagagaatgcaatagattctagaatgttggtgttatccatacttgatgacatgatgtgatgggggtgagttggygggtaggttcaccaagaagtattatttagaaaaactgtgccaaagaaatctatcatttcacccataactggtattaagtattgcaaaactcatttccata

SEQ ID NO: 25906 - DNA, 201 bp, Homo sapiens
tcctcaggtgaggattgtctcagaactgaagaatggttcaaattggcccaagatgctgaaatttattgcagggatcactgggacagtgtgtagcaatttakgaggcttctctctaagggaatcagtagctgctgcatttctcttaattgaaaccactctttccctccagcttcgatggggcaggttctcatatctgcgtgc

SEQ ID NO: 25907 - DNA, 201 bp, Homo sapiens
aaataaatatgtggctgttagagtcttggccctgcagacttggatcaaagcagacttttcaaactactctctcttactctctcttaaaaaaaattttttttggtttctcttctatgtttctctggtttgaaaaagtaaataaaaaggcatgaaagttattaagctatattatattaagatatattatttttgggagccctg

SEQ ID NO: 25908 - DNA, 201 bp, Homo sapiens
gagtgctgcatgagtggcttaagagaacaccattaggcttgaaaaagagtgaactgcaaaaacacattttctccatttcacctagttgttattttccccccatgtgctaatgatgcaaacaaaagaaaataaaaataatagacattggcttatgtcttttcaagttccatttcttgtttcttcttttactattttcagaat

SEQ ID NO: 25909 - DNA, 201 bp, Homo sapiens
tgtattgatggtcagcaatgtaaatagcacagcgttaagcatcaaaggagatgcaaataagcctatgaatggtccttgccaaagaaggacttatatttccrttttatgtcactgttggcttttgttctgacattgggtttgggatttagtgactgtctttctcctggttgtaatatttattcggtggtgggcatggcttat

SEQ ID NO: 25910 - DNA, 201 bp, Homo sapiens
cagctctaaaacagtgcaaaataaatccctaaatatcgttaaggattgtcaggtagaagagtcatgagatcagttgccaagttacccacctaaatcttttragataaattctgccatgccataaaagtatgttacctggcttctaaaccccagccagcctgccctctctttcctggtgaggtctcagtctgcctccttcca

SEQ ID NO: 25911 - DNA, 201 bp, Homo sapiens
cctgtctccatggagcttacatgctaaattggggaggcaaacaataaacaaataaatattaaataccattcaggactgtccaatcttttggcttccctagstcacattgggagaagaattgtcttgggccccacataaattacactaaaactaagagtagctgataagctaaaacacaaacaaaaatcacacaaaaaaaat

SEQ ID NO: 25912 - DNA, 201 bp, Homo sapiens
tttattagttgtgcaatctgttttggacatgagctcagcaaatcagaggacagaaatagaatcctggctttttaatgataaacactgtaaaaataaaaaakttggagagcttaccagtgcttctggctgcccaagtggtttgtgtgtggttgactcccaggagctcaatcactttgggtgcagtccacccagagagctatg

SEQ ID NO: 25913 - DNA, 201 bp, Homo sapiens
tagtctcctctctcctggaacttacagtctatctggaagacagacagtaaacaactaatgatgcctttgtttaattacacttgtggtaagtgctatgaagragaagcactggatcttgtgagagcataatagggagatctcatctgatttaaagcaccagggaaagcctcccaggacctgttggatgaatagcagtaacca

SEQ ID NO: 25914 - DNA, 201 bp, Homo sapiens
acaaaacaaattccaatgtatcttctcctgtcttctgcagcactgggggagtcccctgataacagggatcatgtcacattcatttttgtgggcccagatcycagtaatattgacccataactgttgaactgcaatgaatgtctagaatataaaagtcatgatatctatatatatggaagcatgctgtcagtatgggctaag

SEQ ID NO: 25915 - DNA, 201 bp, Homo sapiens
ttaatctgagtgataccaaattgtatctctcttgagaagtagttaatgtgaaaaatgggtgaacctatgatcataccttagttatatcttgatgagattayggaagaagaaatagaatgttttgagaagtggggaaaatatctcacaaaatttctcttgtctcatgttcttcctgttttatttatctatgggatctactgc

SEQ ID NO: 25916 - DNA, 201 bp, Homo sapiens
tggagaggaggtggttggagatcacctgggcctcctcagcactgcctcctggctggggctggggctggggataagagagtaactgcaattgtgcttccccrgcaccttcgctttaggtcactccaccgaagagcctgaaagggaagtggttcttgcgaaagaatgagctgaagcaggtggcagatgctaccaggcaccgtg

SEQ ID NO: 25917 - DNA, 201 bp, Homo sapiens
ctccattcaccatttgccccaactgtgttcctgctgcacttgaaaatgattccagctgcctctggaagattttcatcccatttctgggaaaaacattagcyaataaactctcattgaatttggcagggcgggcacaccagcaagctgacactatgtgcatacaggcttcctggaacaactgttgctgagcaaatgaagcag

SEQ ID NO: 25918 - DNA, 201 bp, Homo sapiens
gtgttgagaaagaggagagcgtctgagagccctgggtcttagggctggcacacacctttctgctcccttctctctaattgagcattagagactccgccccytgctgggagttagaactttagctgtgttttcccatgtgaaggagcaaagaggcaaagcttcatctctgttggggctagcatcaactaattcaggtattcc

SEQ ID NO: 25919 - DNA, 201 bp, Homo sapiens
tgttctttgtattgtttggaaggctaaagtcaacagccacttttgtattctgcattgtttgcgttgttaaaaactctggaaaactcatctggtttcttctscaaaagtagcttcccagagccctgggagacactcagaaataagatccttttcaaataggccagcagggaccagggtctctcagaaccagctttcctatct

SEQ ID NO: 25920 - DNA, 201 bp, Homo sapiens
cggccctcgctttcatgtgcttgtaaagttgtttggcaggaactgggacttggaaaggagacatgactttgtcagagggcttggggctgggcatggtgtgrgtggcgaaggggagaaggaggaaaggggaaggaaaggagctcttgttgccccattctggggagtggtggactctggacaaccacgaggaaactttggaaa

SEQ ID NO: 25921 - DNA, 201 bp, Homo sapiens
aggatcttttcaaacatgtcttatccttgttagtgcctcaaactagatcctgttcagatatatcaagttagtgagagtttattttggtgcaaaaaaaaaaatttgaaatctatgtatagttttttcatagcacgtatttttcatggaacttttggaagacccgtcatatagacacactcacacaatggatgcatgtattgt

SEQ ID NO: 25922 - DNA, 201 bp, Homo sapiens
gctactgcactccagcctgggtgatggagccagaccctgtctctattaaaaattaggaaaagaaatagcctgtctactctattggtccataacctctatcragacagtgaccttgtctgctttattcaatgcctggatcttttcctagcacagtgcccagcacatggagacactgaatttggattctcctttttgaagtcc

SEQ ID NO: 25923 - DNA, 201 bp, Homo sapiens
gagcatgaatatgagaggcaaccactggaccagctgcttggtcctcaccacctcctgcttctgccaatcagtgtggggaaatctcaacagtaaggtggctyatattccctgcctggcagcctcagagcagagagaagagccttgataccagggcaacatcagggaccctggagctagggctccaatatctcatccaaacag

SEQ ID NO: 25924 - DNA, 201 bp, Homo sapiens
cttgtaattctttacctggttgtgtcacagactttgaaaaccaatgaaaaccagagatgttgccctacctaaacacacacacacacacacacacacacacatccatacacacaatcttgcatataatctcacaggtccatggatgtattgaccagctcctggattccatattgaaaatcccttgcagcccagctccaatac

SEQ ID NO: 25925 - DNA, 201 bp, Homo sapiens
ctccaatgggcaagagtgttgtagggacaaagtgctttgcccgtagtacttcatagaatcctctagaccatgtggaaggtgagcagatgaagcagctctgrccagagaagttaggaacatgtcccagtcacacaactgaaactgcaggaagtcagtcctgggattaactgcaggatctgaacactgtactctttatattgt

SEQ ID NO: 25926 - DNA, 201 bp, Homo sapiens
cgggaggacccatacaccagttgattcccctcttgccacttaacagcagcgtgagcttgggcagttgcacttgttaaatgtctggaacaatacttagcacrtaatttctaaagcttaatgtttagttcacagaaggtatcccaagaatagaaatgattattatattttagcttctctctattactgattcactatgtgctg

SEQ ID NO: 25927 - DNA, 201 bp, Homo sapiens
tcttgtaattctttacctggttgtgtcacagactttgaaaaccaatgaaaaccagagatgttgccctacctaaacacacacacacacacacacacacacacatccatacacacaatcttgcatataatctcacaggtccatggatgtattgaccagctcctggattccatattgaaaatcccttgcagcccagctccaata

SEQ ID NO: 25928 - DNA, 201 bp, Homo sapiens
cacctccatataatcagatgcttggtgtggtgtaatgaagatgaggaggtctggctttgataagagtcatttagaaggtataaaggcagtggaacaagacrggaggacccatacaccagttgattcccctcttgccacttaacagcagcgtgagcttgggcagttgcacttgttaaatgtctggaacaatacttagcacgt

SEQ ID NO: 25929 - DNA, 201 bp, Homo sapiens
caacttcttaaaaaaccttgtctatcatctatccatctatctgtctgtctgtctatctatctatctatctatctatctatctatctatctatctatcatcygtctgtattctatgttccatctatcatctatctgtcatatatctatctctatctattaattatctctatctttatctatttatatctatcatctatctgc

SEQ ID NO: 25930 - DNA, 201 bp, Homo sapiens
acactcctccaacccccatgtctgcttctggaaggtggtggcagaggagagaagtagaagtactatatgggagatgcgggagattcttgccttctctgtcrgtctctttgggcaattatcaagctgtcatctgaccagatactaccatagcttcttcgggggcaaatccgtagggaatcctgacatccgacggggagccac

SEQ ID NO: 25931 - DNA, 201 bp, Homo sapiens
actcaacttcttaaaaaaccttgtctatcatctatccatctatctgtctgtctgtctatctatctatctatctatctatctatctatctatctatctatcatctgtctgtattctatgttccatctatcatctatctgtcatatatctatctctatctattaattatctctatctttatctatttatatctatcatctatc

SEQ ID NO: 25932 - DNA, 201 bp, Homo sapiens
tcatctgtcaagccaaggatgagagtaatgaaaattttcccatcaagtttcacgtcctttgcagaaacttcgttttcaaccatcttgttggccttctctgscctgttgataatgcgccccctagtggatgctttacaacatcccctttgtcttcgtagaaactgagtccttccgcctgacttcagttctcgaatcctcaac

SEQ ID NO: 25933 - DNA, 201 bp, Homo sapiens
ccaaactcaacttcttaaaaaaccttgtctatcatctatccatctatctgtctgtctgtctatctatctatctatctatctatctatctatctatctatctatcatctgtctgtattctatgttccatctatcatctatctgtcatatatctatctctatctattaattatctctatctttatctatttatatctatcatc

SEQ ID NO: 25934 - DNA, 201 bp, Homo sapiens
ggcggcagcccctccggctgagtcggccctgggggactggagtcaagtgagctgtctgcgaagtgcattgggctccggaaagcagggctgggatttgcgcyaaaccgttggagaatgtgtctgtggaagcaccatttggttgaaagaaaaagagaaagagaagaaagtttgttgggcaggctgccggcgcgcagttttggg

SEQ ID NO: 25935 - DNA, 201 bp, Homo sapiens
atgctgctataaagacacatgcacatgtatgtttattgtggcattattcacaatagcaaagacttggaaccaacccaaatgtccaacaatgatagactggrtgaggggatctttgcttgggaattgcatgcctggtgttgagaaagaggagagcgtctgagagccctgggtcttagggctggcacacacctttctgctccc

SEQ ID NO: 25936 - DNA, 201 bp, Homo sapiens
ttgtgacttaccatggtggatgcatcctgtgagttccaaactcaacttcttaaaaaaccttgtctatcatctatccatctatctgtctgtctgtctatctrtctatctatctatctatctatctatctatctatctatcatctgtctgtattctatgttccatctatcatctatctgtcatatatctatctctatctatta

SEQ ID NO: 25937 - DNA, 201 bp, Homo sapiens
tggacaaaatttagacctttgtgtaaaagctgactgagaaaagtgcaatgtgttcatctgtcaagccaaggatgagagtaatgaaaattttcccatcaagkttcacgtcctttgcagaaacttcgttttcaaccatcttgttggccttctctggcctgttgataatgcgccccctagtggatgctttacaacatccccttt

SEQ ID NO: 25938 - DNA, 201 bp, Homo sapiens
aaagaagagggccctggtggtttccctatagtctctagggaagtttatttgtatgttacctaccagtgccatcttctgctttgtctttgggcattctgacycctgactccttccaacctgtctccccgttccttctaaaaggccccacttccaaatatttggcactgtcctaacccttgaggttctcccagagacccgcag

SEQ ID NO: 25939 - DNA, 201 bp, Homo sapiens
gggattgtgacttaccatggtggatgcatcctgtgagttccaaactcaacttcttaaaaaaccttgtctatcatctatccatctatctgtctgtctgtctrtctatctatctatctatctatctatctatctatctatctatcatctgtctgtattctatgttccatctatcatctatctgtcatatatctatctctatct

SEQ ID NO: 25940 - DNA, 201 bp, Homo sapiens
aagaaatgaagagagaaatgtgaagaaaagctgtcagaggggtaaactgtcagagggatgcaaagaagagtaagatttcaaacaattgttctgaaagaaarttagtagctatttaataaggactgtctatgcatatagcagatatttaaatcataataagtataaagtaacctcaaaagcgtctcaataaggacagcatct

SEQ ID NO: 25941 - DNA, 201 bp, Homo sapiens
gggatttggggatctaggatttatactactgaagctgaaataataataataatgatagcaacaacacagcctgtcatggtggcccatgcctgtaatcctakgactttgggaggctgaggcagcaaattacccaaggtcaggagtttgagaccagccttggccaacatggtgaaaccccatctttacaaaaaatacaaaaat

SEQ ID NO: 25942 - DNA, 201 bp, Homo sapiens
ttaggaacatgtcccagtcacacaactgaaactgcaggaagtcagtcctgggattaactgcaggatctgaacactgtactctttatattgtactttaaaaacattgcttcacatggccagaaaagccaacctctgaagaagagaaaaattgttcccttcactctcagagcttcatgagcaccttggacttgccagctttcc

SEQ ID NO: 25943 - DNA, 201 bp, Homo sapiens
gggaacatctggctcagtccacaggaagggatgcaggccttttcctgggaatgaggactcatcccatattccagcccccttcccccaacttttttttttttcaattttagtgcatctctttacacttaacaggtctgcagtgacttctaggaggatccacacaccaatcgtggaactaggcagcatctttttccacttcct

SEQ ID NO: 25944 - DNA, 201 bp, Homo sapiens
ggcaaaggctcagtggagaagaaagtctggctgggcatcctggcctcaagccccatttcttgcctgtgttgacacctggtcttgaacaccagtagtttgcytgtcagggccgcccataacccggctcctcaatcctgccccattaggcttccagactgctgatctcattacgtggtgactactgttttccagaagtcttgt

SEQ ID NO: 25945 - DNA, 201 bp, Homo sapiens
aaccatgaacaactttataaaccccatgcttattggaaaaggaaggagcaaagtcatgtgtaaatgtgtttgggagattgcttggtatggtagaaacagcrtgagctttgggatcagacaaattttgggttttaatactgattctaccacttacttaactgtgaaactctgttcacacatcttaaatattttgagtcagta

SEQ ID NO: 25946 - DNA, 201 bp, Homo sapiens
agagaagattttcctttaaagaatctatctgggccaggtgcagtggctcactccatgtgcagtggctcactttgggaggccgaggcagtggattagttgakcctaggagttcaagaccagcctgggcaacatggcgaaaccccatctctacaaaaaacacaaaaattagccgggcatagtggcgcatgcctgtggtctcag

SEQ ID NO: 25947 - DNA, 201 bp, Homo sapiens
agtgcttgggcccaggagtttgaggttacactgagctaagattgtgctactgcactccagcctgggtgatggagccagaccctgtctctattaaaaattargaaaagaaatagcctgtctactctattggtccataacctctatcgagacagtgaccttgtctgctttattcaatgcctggatcttttcctagcacagtgc

SEQ ID NO: 25948 - DNA, 201 bp, Homo sapiens
acagatggcagagtctcatgggttaggataaaaccttagcagctactctcttttgtctgccccaccctgattggtagcaactcttagatatatgaaaactyattaccatttaattgtgcccacaccccctgccaagctaaggaggctttggggaaaccagtttgtctgttcagatgagaaattagtcatgcgagctacaat

SEQ ID NO: 25949 - DNA, 201 bp, Homo sapiens
tgtttctctggtttgaaaaagtaaataaaaaggcatgaaagttattaagctatattatattaagatatattatttttgggagccctgagagggctcctacyagttattctagagctgcatagagccttcctcaaactatggctccaagcaagataatcacaacaagcaaggactttattttttgaatttccaatggccttg

SEQ ID NO: 25950 - DNA, 201 bp, Homo sapiens
agagactggggctggaacagggcgagtggctgttatcaaggtggtcacagaagggatcacaattccaagtgtgagactagctggcaatgggttttccagaraggggtcctgggttctcccagctccccactgagccttgttccaaagcttacagtccgcagtgtcactgccaccttagcgctgtggaagcttgaaccagct

SEQ ID NO: 25951 - DNA, 201 bp, Homo sapiens
gtgttatttctagtcagaatatacaaccatctcacaatgatactctaaggaatcaaggcatagtcctatgcaaatctaaaattgtccattgaatagccacrgtccgagtctacacatttaaagttgtcttattctaggattctaatttgtcagagggctgtgagagtcaacattctccattctctaccttagcaatactct

SEQ ID NO: 25952 - DNA, 201 bp, Homo sapiens
gcctctgccaggttcggtccgccatcctcgtcccgtcctccgccggcccctgccccgcgcccagggatcctccagctcctttcgcccgcgccctccgttcrctccggacaccatggacaagttttggtggcacgcagcctggggactctgcctcgtgccgctgagcctggcgcagatcggtgagtgcccgccgcagcctgg

SEQ ID NO: 25953 - DNA, 201 bp, Homo sapiens
ctcttttcacctcctccactccaacaaaagcttccaaaggaaatcttccttcttaaaagaaactgatttccatgattcagaataaaatttagtaaagactratgaattaggactccattaatttagcatttttgctacatcaagaatcaaaaagggattaaacttttctatccccatatctcttaaagccaggaaagattt

SEQ ID NO: 25954 - DNA, 201 bp, Homo sapiens
gtgtcctcttggtcacagacagcagcagtaacaactttttcctgcggactggcagcattttccaagcacctgctcttcaggtgggagttacgggtcactgycttcattccagacgggcggctctttgagtcatggcatgccagcttctgagtggctgaggactagatccagacaaggatttttcagtcccaaacactcttc

SEQ ID NO: 25955 - DNA, 201 bp, Homo sapiens
ttaagccttcacatctaggaaggctaaaggttgagtttgtctgtttcatcctgtcttggctgatcacatgcacatacaaccacacactcacttgcatacamacatataagtatgaggagaattcaaaatgttcatggaaaaatgagattaaaagataaaagtttaaagatgtaaactttacttctcaacataagcaccatc

SEQ ID NO: 25956 - DNA, 201 bp, Homo sapiens
attcaagatactgttataagctatgatagcggccatttagtccatccctaaagaactgagggtcctgggaatttaatcacatcaatgcaatctttcttacwttgttaactaaagaaaaatgggtgccctttgaagatttttaaagattaagtaacaaaaaaaaaaaagtcagaaggagtcaaatttggactataaggtgga

SEQ ID NO: 25957 - DNA, 201 bp, Homo sapiens
aagaatctaacatttctatttcttcccatagatttgaatataacctgccgctttgcaggtgtattccacgtggagaaaaatggtcgctacagcatctctcsgacggaggccgctgacctctgcaaggctttcaatagcaccttgcccacaatggcccagatggagaaagctctgagcatcggatttgagacctgcaggtaa

SEQ ID NO: 25958 - DNA, 201 bp, Homo sapiens
gacagcagcagtaacaactttttcctgcggactggcagcattttccaagcacctgctcttcaggtgggagttacgggtcactgtcttcattccagacgggyggctctttgagtcatggcatgccagcttctgagtggctgaggactagatccagacaaggatttttcagtcccaaacactcttcctgaaaatgcaagagga

SEQ ID NO: 25959 - DNA, 201 bp, Homo sapiens
accttgggaactcacccatgcagaagtggagagacaggttttcaataataaaggctaagggcttcaaatttcagcttgggttactagagttcagtgagagmtttactttttattttcgcctcttctaggattctttaaatctcattaagaaatgaagagagaaatgtgaagaaaagctgtcagaggggtaaactgtcagag

SEQ ID NO: 25960 - DNA, 201 bp, Homo sapiens
ctaccggaaagaatgctggggggttaaatgagataatatctgtaaaatgatggaatatagtagacgcatataggtttccttccctcatttctgctatcttmatcacttttgtgtgaatacacagtaggggtctagaaagaatatgaaccatgatttgggagaagtcagaggtgttccaaaaatttctgaacctctcccaaa

SEQ ID NO: 25961 - DNA, 201 bp, Homo sapiens
acagcagcagtaacaactttttcctgcggactggcagcattttccaagcacctgctcttcaggtgggagttacgggtcactgtcttcattccagacgggcrgctctttgagtcatggcatgccagcttctgagtggctgaggactagatccagacaaggatttttcagtcccaaacactcttcctgaaaatgcaagaggag

SEQ ID NO: 25962 - DNA, 201 bp, Homo sapiens
taggggtgaactgaatgaagtgttgcacggcattaaatgtcattgaatgggatattatgaaattcccatcttagccatttaggtcaatatcctgttgtttytctcttacaggtatgggttcatagaagggcacgtggtgattccccggatccaccccaactccatctgtgcagcaaacaacacaggggtgtacatcctcac

SEQ ID NO: 25963 - DNA, 201 bp, Homo sapiens
ggctgggcatggtgtgggtggcgaaggggagaaggaggaaaggggaaggaaaggagctcttgttgccccattctggggagtggtggactctggacaaccaygaggaaactttggaaaggagcaaggctttgaggaggagtccagtctttgtatgggaaagcaaaaagtggagaaatggccaaatgtagttaagtgacattg

SEQ ID NO: 25964 - DNA, 201 bp, Homo sapiens
tttcttttgtggttacaactagactacaggctatcatagtgttcattttccctgccgtcacatttcttgacacacagttaggtgcttttggttactgatargagcattgggattcaaatattcttttttccatgtctctgtgttctctggttttctggagtgactgggagcaatgctgcaattgagcctggacaatccagg

SEQ ID NO: 25965 - DNA, 201 bp, Homo sapiens
aagcgtttccttggtgcagtgatgaaaatcccaatgcacaggtgaaattaagaaataacttaataatggagtaaaatggtaactttaatttaatgaccttyacaaggtagctaagtatttccttgtataaatttgatctgtgttacttgagtaggctattctagataggcttctttttcttttgtggttacaactagacta

SEQ ID NO: 25966 - DNA, 201 bp, Homo sapiens
tcaacctccagttgatatatgtcactgagggccctgtgtttgcccaggcaagcgtttccttggtgcagtgatgaaaatcccaatgcacaggtgaaattaaraaataacttaataatggagtaaaatggtaactttaatttaatgacctttacaaggtagctaagtatttccttgtataaatttgatctgtgttacttgagt

SEQ ID NO: 25967 - DNA, 201 bp, Homo sapiens
gcaaacaacacaggggtgtacatcctcacatccaacacctcccagtatgacacatattgcttcaatgcttcaggttggttctcaggggggtgtctgttggygtgaaaggctgtgggagcctggtctttggagctcagcttaagtggggattcatgtagcctccatttacataacaaatgctcactgaatatctgtacagca

SEQ ID NO: 25968 - DNA, 201 bp, Homo sapiens
tatttcagaatctgaagctccccatgaagaaagcccttcaattttagttgaaaggtttttgctttcaaagcaaggctaacaagcagggagtccaggaagcwaataactggcattcgttgattaaatcttggccatctaggttgtggctgtaggttaaccaaagttgggcatccacccaaggctttgatcgtcacctccagg

SEQ ID NO: 25969 - DNA, 201 bp, Homo sapiens
actgcaaaaacacattttctccatttcacctagttgttattttccccccatgtgctaatgatgcaaacaaaagaaaataaaaataatagacattggcttaygtcttttcaagttccatttcttgtttcttcttttactattttcagaatcaaggaagataatacagaattttaacagttttcttacctcattttgcatttg

SEQ ID NO: 25970 - DNA, 201 bp, Homo sapiens
taactgtgaaactctgttcacacatcttaaatattttgagtcagtaaagagacagtaaaaccttcatagggtggctatgaggattaaatttaacaagtacrtgtcagtgctggggtatattaggtcctcaaaaatattaattcctacctgccatcacccacatatgcacagtaggtacttaacttcttccttcaccatttc

SEQ ID NO: 25971 - DNA, 201 bp, Homo sapiens
cctgctggatttagcttcctcctctctgccctcctgctgcaccacagcttcccttgcacatggcattttctcagcccacatctcattttttgaggcatttwatattcaaaaaaaattgtgtttttagcacaattaaaaaataagcaagtttttagccaccaggatgctgctagaagaggctgggctgtgtatgttgtatct

SEQ ID NO: 25972 - DNA, 201 bp, Homo sapiens
gattttaaaagaagggaaatagattctatctcctaatgggagaagctgcaaagtcacactgcaaaaaatatggttacaaaaaagccaattatcagggccaktagtgtgatcaagatctacgatagacatgttgaaagattcttgtgctcaagggcacctctcatgtttatgcttaaaatacactcaccatttgagccatat

SEQ ID NO: 25973 - DNA, 201 bp, Homo sapiens
tcttacaggtatgggttcatagaagggcacgtggtgattccccggatccaccccaactccatctgtgcagcaaacaacacaggggtgtacatcctcacatmcaacacctcccagtatgacacatattgcttcaatgcttcaggttggttctcaggggggtgtctgttggcgtgaaaggctgtgggagcctggtctttggag

SEQ ID NO: 25974 - DNA, 201 bp, Homo sapiens
atgcatttgtgtgtgtgattaacaaacaggtcagctagaagctgtctgatttcggacagcttcatctgggatgattggggtctttttccatctgactcttmcatgcctccagctggctggtccaggcctgacagggttccaagtaagagcacatgctcacaggtcctcttgaggcctaggctcagaactggtgctctgtca

SEQ ID NO: 25975 - DNA, 201 bp, Homo sapiens
gagcacaaatttaaaaataaacctcacagaaggtttgcaagataaagttaaagaaataccctcagaaatacagcaaaagcaaataaatggaaacagggggraatacattgggaagactggcacccagtccaggaaatttaacatgcaaatgctgtaatcaaagtcacaggaagagaaaacaaataggaagaactcatccaa

SEQ ID NO: 25976 - DNA, 201 bp, Homo sapiens
taatcctagcactttgggaggttgaggagggcggattgcttgagctcaggagcttagagaatagcctgggcaacatggcaaacccttgtctctataaaaartataaaaattagccaggtatggtggtgtgtacctgtggtcccagctactcgggaggctgagttgggaggatcatgtttgagcctgggaggtcaaagctgc

SEQ ID NO: 25977 - DNA, 201 bp, Homo sapiens; identical to SEQ ID NO: 4278

SEQ ID NO: 25978 - DNA, 201 bp, Homo sapiens; identical to SEQ ID NO: 4280

SEQ ID NO: 25979 - DNA, 201 bp, Homo sapiens
atattaagatatattatttttgggagccctgagagggctcctaccagttattctagagctgcatagagccttcctcaaactatggctccaagcaagataawcacaacaagcaaggactttattttttgaatttccaatggccttgcggtaagcggtgcacaagaagagcaagccacggtggcaatcacagtgaattgttgt

SEQ ID NO: 25980 - DNA, 201 bp, Homo sapiens; identical to SEQ ID NO: 4283

SEQ ID NO: 25981 - DNA, 201 bp, Homo sapiens
acatccgacggggagccactttggcaatggcaaacggtgtctcctctccacagagcttgtgatgtcagaaattacccataactggggcaggttttgtcttyccaaagattgtctgcccagctagacctgagagacagggagacaaacacagaatgagggggtgggtcttgtgggggtggggaacgatggaaactcacagag

SEQ ID NO: 25982 - DNA, 201 bp, Homo sapiens
aatggacagtaaccagggaaaagatcaaggtcgtactcttccatagcaactttcttttgcgtttgggtcttaagtaatgtttgagaaaccttaaattaacragaataatttgtcttatgttattaaacttcctatatcagggttgtatgagttagccaatgttaggaaaacatcactatggccttatacctctagaaaaat

SEQ ID NO: 25983 - DNA, 201 bp, Homo sapiens
gtaaagctgggatatgaacccagcatatttttgctgccctcttaaaatataatgcgggggtgagagggctgcttgagggtaggagagcctaaattaatacracctttttgaaaagcagttttgaagtacttatcaaaattttgtaaaattagcatacattttcatcaactaattccacttctagggctccagtttaaggca

SEQ ID NO: 25984 - DNA, 201 bp, Homo sapiens
ttagcaagattgcctaaattagaagtagatgagaaaaacagaagacaacaagagtaggaacaaaagacgagctgtgaagaacctattgcaaaaatgaaaayaattgctggagtctgaacattggctatgagtgagttgaaaatcccactctatgcaaatccaaaaaggaaaggtgttttagaacatcacagcatggagttt

SEQ ID NO: 25985 - DNA, 201 bp, Homo sapiens
tgtgtgagagagagagagagagagagagagagagagagagagagagagagagaaaggctgggcaataaagacctaaaggaggtgagggagtgagtcatgawgatatgttgggggagaaggtcaaggagtgagagcatctggaccactaggatctagaataggcagtgcagaaagaaaggtaaggcaaggacctgccttaga

SEQ ID NO: 25986 - DNA, 201 bp, Homo sapiens
ggatgcctgtctcttttttttttttgagacagagttttactcttgttgcccaggctggagtgcaatggcttgatcttggctcaccgcaacctccgcttccrgggctcaagcgattctcctgcctcagcctcctgagtagctgggattacaggcatgcaccaccatgcccagctaattttgtatttttagtagagatggggt

SEQ ID NO: 25987 - DNA, 201 bp, Homo sapiens
aataacccagctatattaggtttctccagagaaagagaacccactggatggatagatagatagatagataggcaggcaggcagatagatagataggtgggdagatagatagatagatagatagatagatagatagatagataggcaggctggcaggcaggcagatagatagatagatagatagatagatagatagatagat

SEQ ID NO: 25988 - DNA, 201 bp, Homo sapiens
agatagataggcaggcaggcagatagatagataggtgggtagatagatagatagatagatagatagatagatagatagataggcaggctggcaggcaggcagatagatagatagatagatagatagatagatagatagatagatagatacacagtcatacatcgcttaacaaacatacattttgagaatgcatctttaggc

SEQ ID NO: 25989 - DNA, 201 bp, Homo sapiens
gatagataggcaggcaggcagatagatagataggtgggtagatagatagatagatagatagatagatagatagatagataggcaggctggcaggcaggcagatagatagatagatagatagatagatagatagatagatagatagatacacagtcatacatcgcttaacaaacatacattttgagaatgcatctttaggcg

SEQ ID NO: 25990 - DNA, 201 bp, Homo sapiens
ttacttgttttggcctcctaaatccccttggattataggtatgagccactgtgcccagtctaagtagaattttaaaaatctccttttctaaagaaaattgmatttgttgatagtaaagttttaaaattgggaagttatattgaaatgtgtctggtgcaaccagtggagtttaaattatttttgaccaaaatggattctgaa

SEQ ID NO: 25991 - DNA, 201 bp, Homo sapiens
atagataggcaggcaggcagatagatagataggtgggtagatagatagatagatagatagatagatagatagatagataggcaggctggcaggcaggcagatagatagatagatagatagatagatagatagatagatagatagatacacagtcatacatcgcttaacaaacatacattttgagaatgcatctttaggcga

SEQ ID NO: 25992 - DNA, 201 bp, Homo sapiens
ttataggtatgagccactgtgcccagtctaagtagaattttaaaaatctccttttctaaagaaaattgaatttgttgatagtaaagttttaaaattgggamgttatattgaaatgtgtctggtgcaaccagtggagtttaaattatttttgaccaaaatggattctgaagaaatggtatggatagaaaacaaagaatgtaa

SEQ ID NO: 25993 - DNA, 201 bp, Homo sapiens
tagataggcaggcaggcagatagatagataggtgggtagatagatagatagatagatagatagatagatagatagataggcaggctggcaggcaggcagatagatagatagatagatagatagatagatagatagatagatagatacacagtcatacatcgcttaacaaacatacattttgagaatgcatctttaggcgat

SEQ ID NO: 25994 - DNA, 201 bp, Homo sapiens
gagcagctgccctccagttgcaatgctggtctctgagatgagtgactgtaatgaagagattgatgataaccccatgtcctcagaccttcattgtttctgcrgaagggaactgggaaagtcttccaccaaggaatcttttgtgaggcagtgagcttgccttcctgttttctgtaattcctcccattctcccatgtgcttgcg

SEQ ID NO: 25995 - DNA, 201 bp, Homo sapiens
ctgtgcccagtctaagtagaattttaaaaatctccttttctaaagaaaattgaatttgttgatagtaaagttttaaaattgggaagttatattgaaatgtrtctggtgcaaccagtggagtttaaattatttttgaccaaaatggattctgaagaaatggtatggatagaaaacaaagaatgtaagttttatcttgaataa

SEQ ID NO: 25996 - DNA, 201 bp, Homo sapiens
taatagtgggtgtgctcagctgggagtgggtttggtttggtttggtttggttcaaaggcagcagaagtctgcatcttagctgtcttaatgtgaatgtgggrtcttgtgacagggtctcttctgtatcctgggggtggatctgcactctgcctgatggcctagctactttgccagaccctgcctgcttggtcttcaccaggt

SEQ ID NO: 25997 - DNA, 201 bp, Homo sapiens
aggctgggcggtggctcatgcctgcaacctgcagcaccttgggaggccaaggtgggcggataacttgaggtcaggaggtcgagaccagcctgactaacatsgtgaaacctggtctctactaaaaaaaataacaaaaattagctgagggtggtggcatgcgcctgtaatcccggttactcaggaggctgaggcccgagaatc

SEQ ID NO: 25998 - DNA, 201 bp, Homo sapiens
ggagaccttagggaactagcaatcatggtggaaggtgaaaggggagaagccacgtcacgtggttagagtagcaagaatgggctggggaggtgctacacactttttttttttttttttttgagacggagtctcaccctgttgcccaggctggagtgcaatggtgcgatctcagctcactacaacctctgtctcctgggttca

SEQ ID NO: 25999 - DNA, 201 bp, Homo sapiens
caacacttgagaaacctagtccctgataaacaacagcagaaagctacactgcaagccaatctaaatatcaattccaactgtaaattttctaattgtttgayaatgaaaaaatatacaatttaaataataccaggaacaggctgggcggtggctcatgcctgcaacctgcagcaccttgggaggccaaggtgggcggataac

SEQ ID NO: 26000 - DNA, 201 bp, Homo sapiens
cctctactttcaaatagcctgtcctcaagcttgctaattctttcttctgcttgatgaattctgctataaaaagactcttatgcattctaaagtgtgccatytgcatttctcaactccagaatttctgcttgattccctttaattatttcaatctgtttcttatatttgtctgatagaattctggattccttctctgtgtta

SEQ ID NO: 26001 - DNA, 201 bp, Homo sapiens
caagttagcaaaaatgatgaggaggttggaaagctccaatgaaaccatggtcagtgggtgataagtgtgtgttgcagtttgataacatgaaagactgaaamtgagagagagttgaaaaataagtctttagaaaaatagagtttagggactggaagcctcaatgaggtagaaaaccagggtggagtaaggaggaactgaaag

SEQ ID NO: 26002 - DNA, 201 bp, Homo sapiens
ggaggaactgaaagcaaaagaaaagcacgtgtgtgacttgagagtgagatttccaaagtcagtttcagttaccacccaagcaatcactaacccttctaaaktgtcattatttcgtatattgatatggtattttattaattaatacactttttttttcaagatagagtttttctctgtcacctagattgaagtgcaatactg

SEQ ID NO: 26003 - DNA, 201 bp, Homo sapiens
cactaacccttctaaattgtcattatttcgtatattgatatggtattttattaattaatacactttttttttcaagatagagtttttctctgtcacctagrttgaagtgcaatactgtgatcatggcttactacagcctcagcttcccaaacgatccttctaatctcagcctcctgagtagctgggaccacaggaatgtgc

SEQ ID NO: 26004 - DNA, 201 bp, Homo sapiens
caagatagagtttttctctgtcacctagattgaagtgcaatactgtgatcatggcttactacagcctcagcttcccaaacgatccttctaatctcagcctsctgagtagctgggaccacaggaatgtgccatcttgcttgtctaactaaaaaaaaattttttattttagacatggagtctcactattttgcccaggctggt

SEQ ID NO: 26005 - DNA, 201 bp, Homo sapiens
acacttacctgcctgaaggcagtgtgctgaaatgaagaggcacattcaacagcattgtcatacattggacctgtgaggggtgtcattgaattgaccacttrggatgtttaaatgtttatttaaagttgcccttggctataaagcctgaagtgggtgttggagtagtcaacgactaacccaggatggatttgtgccaataca

SEQ ID NO: 26006 - DNA, 201 bp, Homo sapiens
cggaagggaactgggaaagtcttccaccaaggaatcttttgtgaggcagtgagcttgccttcctgttttctgtaattcctcccattctcccatgtgcttgyggcgagaggaggacgtgaggattgtgttaaagggtgatgagagagcaggagtggttgcagttctggaaaaagatctaataaaacacttacctgcctgaag

SEQ ID NO: 26007 - DNA, 201 bp, Homo sapiens
aaaataagtacataaacaccccagaaggttatatcagaagtcaaagtactatgatctctctgcatgcttttcagacatggtgagcgagcgttctgaacccycgggcccactttgcctggaggaccactgaggttttctactctctagtcttggggtgctgaagcctcaagagattagaaacaaatgcaattctctcccacc

SEQ ID NO: 26008 - DNA, 201 bp, Homo sapiens
aaaatattcaaaagtggagctgctgtggtggggtcattgaggggagagggatttcgagggcttaccgaggagccctgcagggcctctgacttgctcctggyagggtagcttggaaaccagcagatcaggtcattatttggatttcttgaagctgtggtgcaggaatgtgtttctaagacatctgcaacctaatgggaagta

SEQ ID NO: 26009 - DNA, 201 bp, Homo sapiens
atttttctgttcctagaggaatctagggaggaagtaaggtggagaggttaaagtcacagctcttcaatgatcttataactcacagagtttctgtttaagtyctcaaagtgacactgtgatgagcatctgtaaatgtgtgtgtttgtgctctcctggccacttcctcagatgaccttctaggcagaattgccagatcaaaag

SEQ ID NO: 26010 - DNA, 201 bp, Homo sapiens
aaattaaatccaggtggataagaacaggtgaataatcatgggaagttatggccaggtgggtaaggccaggacatttaagccaggaaatgaagcctgggtcrgtaaggccaagagtttcgtagggccacatggatgaagcttgtttaagaataccatcaggataaggtgattaacacaatgaggttaatcatgtctgttgag

SEQ ID NO: 26011 - DNA, 201 bp, Homo sapiens
cctgaagccagcaagtctcagaggctcactcaagacacttgacgtagaacttgggtatcactgcttgttatttagcccccaagggctcttcagttagcagktgataaatgctgccaagactgggtccttcccttcagggctgcagatcctcttctgggcgggctgcagattctcttctgggctagggtgtgtctagaaatg

SEQ ID NO: 26012 - DNA, 201 bp, Homo sapiens
cctcttctgggcgggctgcagattctcttctgggctagggtgtgtctagaaatgttatctaggaactaggatctgaaatgggggcctcacaactccgactsgttccctatcctgttgctgagctgatatccaagatgcaagacaaagtcctcactcctctttctcctctcctcaagcagaaggaaggagtctcttttggag

SEQ ID NO: 26013 - DNA, 201 bp, Homo sapiens
ctatgttgtccaggctggtcttgaactcctaggctcaagtgatcctcttgccttggcctcaatgcaaagagctgggattacaggtgtgagccgtggtgccyggcctatgataataataatacatccacatgtttaaaaaaaaatcaaaacgtaagtttggatataaaatgaagattacttccccattctggctcaggctgt

SEQ ID NO: 26014 - DNA, 201 bp, Homo sapiens
tttagttcgtttggtgaagtcatgttttactggatgttgttgatgctaatagttgttctttggtgtctaggcattgaataattagatatttattgtagttsgcactgtctaggcttgtttgtactcatttttcttgggaagactttccaggtatttgaaaggacttaggtgttgtgatctaagctgtatctgctttagagg

SEQ ID NO: 26015 - DNA, 201 bp, Homo sapiens
cactatagcctagaagtcctgggcttaagctatcctcccacctttagcctcctgatagctggggctacaggtgtgtgccagccatcatgcctggataattaaaaaaaaaaattttgtagatataggatctcactatattgccaaggctggtctcaaattcctgggctcaagtgattttcccacttcagcctcccaacagtg

SEQ ID NO: 26016 - DNA, 201 bp, Homo sapiens
ttttatagaacttgatctccagtaactccttctttcctagaggttgttgggtgggcctgaaagatccaacttttggaaaagtagggtagatatggggaagycttgattataatgctaaggactttcatttgtttgataaccagttgccctctgttttggaagctgactgtgagaggggagaatctgagggcaaggaccaga

SEQ ID NO: 26017 - DNA, 201 bp, Homo sapiens
ctttttcttatttcccgtattacctcaatttgtcagtaagtatcaggctgggggtgatgtctcatgcctgtaattccagcaccttgggaagcccaggcagraggagtgcttaagctcaggagtttgaggtcagcctgggcaacacggcaagacttcatctctacaaaacataaaaataaaaaaaaaattagccaggtgtgg

SEQ ID NO: 26018 - DNA, 201 bp, Homo sapiens
aaagctataaacatttcttgatgtcaattttttaatgattatctcttggtagtcaacatgaatgagaaactttgttcatattagtagctgacaaaatattytattgttttctatcaaatttacaatagttgccaagagaatgtaacagctcttttattcttttctagaaaaatgtgatattgaaatctgttgtgataatga

SEQ ID NO: 26019 - DNA, 201 bp, Homo sapiens
ggtcacagagtaccaaaactcagggaggaaaagactcctggttgcctggttatccaacatctattcttccctttacttattagtaaaatctgtaaattttsgctgagcacataactgcctagtttgaaatcagcattcccaagcctccccaggataatctgtaaaactcagttctgatgaatgggatgggaacagatcatt

SEQ ID NO: 26020 - DNA, 201 bp, Homo sapiens
tgaaatcagcattcccaagcctccccaggataatctgtaaaactcagttctgatgaatgggatgggaacagatcattcacgctcttataaaaaaggggcaygtgctttcgttcttttctcctcttcccactggctacaaagatgacttgcttatgggaacaggagaaaccctgttgatggtaattgccaaacagatccact

SEQ ID NO: 26021 - DNA, 201 bp, Homo sapiens
ggctctctgggcaacttttatggggcagaggtttagaaagctaggagtaagctgccaggtatcaggaaaccactagatggcagggccatcccttggagccygttcttcaatcaagaaagtggtcagagaggaaagtggagtggggaagagtccaagtacacatgttaaatgcacgttaataagtggatggtgaagatgagc

SEQ ID NO: 26022 - DNA, 201 bp, Homo sapiens
tgagatgaaagggactaggaaaggaataagaatattgtggcattctttccagagtaattttgttgaagtctcatcagagttttcaattttcccacaatgtrtattttaacacttaaaagtacattagaaaaattgcagaatcactttaattcaatacttttatttttagaacacttaaaaatatttttcaaatacacttga

SEQ ID NO: 26023 - DNA, 201 bp, Homo sapiens
caccttcaggatggatattttcccttcttagcaattcattcatgaaaacttaaaaacaatttatccacagtaaatgtcaaaaatacttgatcagaggtatyatgtggatgtaatagtcccatccttctttccccctccctagttcttaatccacatcctatcaaagtttcctcatttcaaagttttataaaaatgacaacg

SEQ ID NO: 26024 - DNA, 201 bp, Homo sapiens
aggttggtctttatctcctgacctcgtgatctgcctgccttggcctcccaaagtgctgggaattcaggtagcttttattgttagttattcctttcccattyggtttgagctatgagtcaatcaggcattttcatcactgagagacaagggtcttttcaaaaatttgacagaatatattaaagatctatttctgtggttctc

SEQ ID NO: 26025 - DNA, 201 bp, Homo sapiens
tggccaaacactacttttcttggactttcacggtggaattatttacttttcatggggaagaatgctactcagagatagctttcacagaaccaagggaaagmtgtcttcttttcttgaaaaagacttgcctcaggaaataatgggcctcattggctgctgctaattggtgaaatgttttttttttttttttttggtctgtgt

SEQ ID NO: 26026 - DNA, 201 bp, Homo sapiens
cactttggaaggccgaggcaggcagaccacgaggtcaggagatcaagaccatcctggccaacatggtgaaaccccgtctctactaaaagtacaaaaattarctgggcatggtggcatgtgcctgtaaccccagctactcaggaggctgaggcaggagaatcgcttgaaccagggagtcagaagttgcagtgagccgatatc

SEQ ID NO: 26027 - DNA, 201 bp, Homo sapiens
ctgaataacctcgacaattctaattttggttatgccttgcatgaatttagtgaaactttatgggaagcttatttttattctcacccctaattgtgtcctaygggttaatgaggttcctcattttactacttattttgtagcagtagaactttacttatcttcaattaacttcttgtaaaatctaaggcaggaaccaccaca

SEQ ID NO: 26028 - DNA, 201 bp, Homo sapiens
gaagtggatcgactctccaagaatgagttttatgtctatagacaaaagattgcaaactaaggctgggtgcggtggctcatgcctatcattccagcactttyggaggctgaggcgggcagatcacttcagtccaggaattcgagaccagcctgggcaacatgacaaaaccccgtctctacaaaatatacaaaaaaatggacc

SEQ ID NO: 26029 - DNA, 201 bp, Homo sapiens
atttgtctggaatcaagctgtgtctttgggaatagctatagaacatgtggcttggttatttataagcttgggttcagagagttatgcaaatgcaaaagcargcaaggggctgctgtcctcttagtaaggatggtgtgtgcagctgagtcagaggaagggttggaagcccagccccagtgctgccctagctttgggactgta

SEQ ID NO: 26030 - DNA, 201 bp, Homo sapiens
aaagacatcatctctcttgaagtccaagatgtgttggaaggtgagcagaaaattatatcttagttatttgtctggaatcaagctgtgtctttgggaatagytatagaacatgtggcttggttatttataagcttgggttcagagagttatgcaaatgcaaaagcaggcaaggggctgctgtcctcttagtaaggatggtgt

SEQ ID NO: 26031 - DNA, 201 bp, Homo sapiens
gagctttaaaaacaagatgtatgtaaggctgggcgcagtggctcacgcctgtagtttcagcaatctgggaggctgaggcgggcggatcacctgagctcacragtttgagatgagcctgctcaacattgtgaaaccccatctctactaaaaatagaaaaattagctgggcgtggtggggggtgcctgtaatcccagctattc

SEQ ID NO: 26032 - DNA, 201 bp, Homo sapiens
gaggtgcctgccaccatgcctggctaattttttgtatttttagtagggacggggtttcgcgatgttggccagcctggtctcgaactcctgacctcaagtawtctgcccgcctctgcctcccaaagtgctgggattacaggcgtgaaccaccacgcgcggcctcaaactcatatttgaaatttagagagattgccaagaccc

SEQ ID NO: 26033 - DNA, 201 bp, Homo sapiens
tgtttgaagaatttaccaaaacttagaggtaacctgttctcgggatgccagcaggctttggcaatgaacctacatgaggttggacataggctccaacattkactaattaaggaactatgggcaagtttcttaatctgtcttttttcttttttttttcactgttccaaagtttaattaaaaacacaatttacaaatatttaa

SEQ ID NO: 26034 - DNA, 201 bp, Homo sapiens
cagtgcacaccagctgggtgtcctctaattcaactcaactcttacactagctatctagagatactgtcagatcccacaggttaagggctcagtcccacaakactgtcccccacttcagaggccagttataagactgaattgccagaacttctgatccactggctacaaattggggctcccaagaccctgcccaggggttca

SEQ ID NO: 26035 - DNA, 201 bp, Homo sapiens
atgcctgtaatccagctacgcgggaggctaacgcaggagaattgcttgaacccgggaggtggaggttgcagtgactcaagatcgcgccactgcactccagytgggacacaggcacacacacactccatgtatgtagtagacagctccaggctgggatctgatgccacgtgtgtgtgccacacccactgtcttccaaagaac

SEQ ID NO: 26036 - DNA, 201 bp, Homo sapiens
gtccaggaaatccaaatctgtaaaacagggtcttccaaaatgagaaaacagggcagatgctgtgattacatccaagtggaaagttactgttattttcttcytcatactttttgctttgctttcttctccttcaaattatcatggaatgtgctacttataaactcagaaaactacaaactacaaaaagcacacaactcagac

SEQ ID NO: 26037 - DNA, 201 bp, Homo sapiens
tctactaaaaatacaaaaattagccaggcgtggtggcaggcgcctgtaatcctagctactaggaaggttgaggcaggagaatctcttgaacccggcaggcrgaggttgcagtgagccgagatcacaccactgtacttcagacagagcaagactgtctcaaaaaaaaaaaaaaaaaggcttgtaagtaaataatgatacaaa

SEQ ID NO: 26038 - DNA, 201 bp, Homo sapiens
gtgggaatgccaggtaggtaatgtaagttggtaatctaggttggtaaaggccatgaggttaaggccaaatgggtgaatctagatgggtaatacaaggtgtwtgagtctagggggaagtgggtgggaggaggtggtaaatccagggaataagggcagaagcataagtccagggaagtaaacctatggaggtaattttagcgg

SEQ ID NO: 26039 - DNA, 201 bp, Homo sapiens
gggtgccttagcaaggcagcatagacttcagtggaaaatagaagagttatactcttgaagcagcactgaggccctgaaaggggaggagagatgtgggtgasagtcagagctccagcaagaaaaggggattgagtgactattttgtttggaggttgaaggtatggggaagattagtttctcattttctattctttttattat

SEQ ID NO: 26040 - DNA, 201 bp, Homo sapiens
ctaggaaggttgaggcaggagaatctcttgaacccggcaggcagaggttgcagtgagccgagatcacaccactgtacttcagacagagcaagactgtctcaaaaaaaaaaaaaaaaaggcttgtaagtaaataatgatacaaagaagatacatgagcagtgtcaaaaggcaggtttatttttcttccctttatccataact

SEQ ID NO: 26041 - DNA, 201 bp, Homo sapiens
ttctcagcctccctgtctatatgtcaggatttgagaagtcctgatcctggctctgcagccgctgatgctaacacggaggccctggggttaaattctaggckctgagttttgagatttctcctgcttcttaagtgagacctccatttccaccctggagcccactgtagatttagacctaatttgttctggtcctgatgtaag

SEQ ID NO: 26042 - DNA, 201 bp, Homo sapiens
cccaagactagatagtggaaaatctcagtagctctccaggcaaagctggccgggtggcggctggggggcattgggggcggggttgggattcagaacgctcmcccaccatgtctgaaaagcatccagagagatcataatgctttgacttctgatataaccttttggggtgtttatgtacttttgatgcttcaaggaataaaa

SEQ ID NO: 26043 - DNA, 201 bp, Homo sapiens
gctccctcgctactcacctcctgctgtgcagcccagttcctaacaggccacggaccagtaccagtccatggcctgggggccgaagacccctgctctatatmctttactttgcacagtctttttagagttgactttgtatcattttgtgtgtaaatattgtcaaaaataaatataaaaattttacaatcatggaagtctatt

SEQ ID NO: 26044 - DNA, 201 bp, Homo sapiens
aatggagacattcccagtaggataaatgccaagttgccaagccagctaactaatgacaggaaactaacactaggtgggcaagacagtgtggggaaggtgartaggtgaaggccagatgaattaaaccaggtactcaacatcagatgggtatgaggccagcagatgatgtcatgctatgcttaccgaggccaggcaggtgaa

SEQ ID NO: 26045 - DNA, 201 bp, Homo sapiens
cagtagctctccaggcaaagctggccgggtggcggctggggggcattgggggcggggttgggattcagaacgctcacccaccatgtctgaaaagcatccaragagatcataatgctttgacttctgatataaccttttggggtgtttatgtacttttgatgcttcaaggaataaaaagtctaaatagaattctaaatgcaa

SEQ ID NO: 26046 - DNA, 201 bp, Homo sapiens
tttttggcagagtcttactttcttgcccaggctaaagtgcagtggtgtgatcatagctcactgtaacctggaactattgggcacgagtgatcctcctacckcagcttcctgagtagttgggactacaaacacatgctaccacaactagctaattttttacttacttccttacttatttatttttgagagagagtcttgctc

SEQ ID NO: 26047 - DNA, 201 bp, Homo sapiens
cagatgggtatgaggccagcagatgatgtcatgctatgcttaccgaggccaggcaggtgaatatggcaggtgagtatggctgtcaggttaataatgttggytacagaaggcctactgtttgaggccagtagttgaacaaggccaagtgggtaaggccaagaaaatacagtcatgtgaaaaggccaataggtgaaggccagg

SEQ ID NO: 26048 - DNA, 201 bp, Homo sapiens
gtagctctccaggcaaagctggccgggtggcggctggggggcattgggggcggggttgggattcagaacgctcacccaccatgtctgaaaagcatccagaragatcataatgctttgacttctgatataaccttttggggtgtttatgtacttttgatgcttcaaggaataaaaagtctaaatagaattctaaatgcaaaa

SEQ ID NO: 26049 - DNA, 201 bp, Homo sapiens
gagagagtcttgctctattgtccaggttggagtgcaatggcatgatctcagctcactgcaatctctacctcctaggttcaagagattttcatatttttagyagaggtggggttttgccatgttgcccagactggttttgaactcctggcttcaagtgatccacctgccttggcctcctaaagtgttgagattacaggcatg

SEQ ID NO: 26050 - DNA, 201 bp, Homo sapiens
ggaagtgctcccaagaagtggagaaaagtcatgatgttgcaaagaaaaattgaattgcttgatctgaaccacagattgaggtctgcagctgcggttgcctrccattttaggcagatcattcacctcatatacagacaatgtaaacctgtggtgtcaatagagtgcagtgttgtaaatgtattttttcttccatatgatttt

SEQ ID NO: 26051 - DNA, 201 bp, Homo sapiens
cacttcttcagcatcctaaatttgcacatgataacatctgttgtcctccatcagatataatcagtattgctaatctacagtgccacattggcagtagtgatttttttttttttttgagacggagtcttgctctgtcgcccagcctggagtgcagtggcaagatcttggctcactgcaagctctgcctcctgggttcacgcc

SEQ ID NO: 26052 - DNA, 201 bp, Homo sapiens
atcacctgaggtcaggagttcaagaccagcctggccaagatggtgaaaccccatctccactaaaaatacaaaaattagccgggcatgatggtgggcgcccrcaatcccagctacttgggaggctgaggcagcagaatcactggaacccaggagacagaggttgcagtgagccaagaccgcaccattgcactccagcctgga

SEQ ID NO: 26053 - DNA, 201 bp, Homo sapiens
taaagtcaatcctggcttgtttttcagtttgtgatgtgattgtagcattagcgatgtagcgtattgacacagcagtaaactggtgaattcaaataaccatrtggcaatacaatgtagtaggctggaatccttcccacataaaggcaaatcgtgtttgactcttttctaagattgtgatacagaaaaaacttttgcaagaca

SEQ ID NO: 26054 - DNA, 201 bp, Homo sapiens
taccttctcagggtaaacaaactacagcggcatttctccattccagcaggctggctgacccctcagggacaacctgtcatgtgttgggatcatacacaggyatcttttatcgttccataataagctgtgggtcctgcagcaatccagacatgctcttctagtccgcagcattcaaagtctagaaggctgctcctcagccag

SEQ ID NO: 26055 - DNA, 201 bp, Homo sapiens
agctttagagtctgaggtgggaagatcacttgaaccccgaaggtcaaggccgtagtgagctgtgatcatgctactgcactccagctttggtgacagtaagmccctgtctctaaaaaataaaaaaagtacaaaggcccaggcccaccccctgcccccaccaactgtattagtttcctgtgtctgtcacaacaaatgaccaaa

SEQ ID NO: 26056 - DNA, 201 bp, Homo sapiens
atctggataaaatggcttgtgaataatgtcccagcatgctcctgacgaaccccaaaatgagattcaaaagcattaaacaggattggattgtcaataaatgrtatgtaagaacattaacataaaaagcttttttatctgcctcagttatttaatctctgccagttcagatgtgcatctcctgtgccctgctgttaatacgta

SEQ ID NO: 26057 - DNA, 201 bp, Homo sapiens
accactgccagcagctgcctatctccagacatcttggtaggtgagaaaaataaccccctattcatttcagttcccagaacttgggatttctgttactttcrgctaaaggttttctggatacatcccagatcacgcatctgcctttgcatgggcacacataaatggtctttgctaaatttctactacttgtccttttcattc

SEQ ID NO: 26058 - DNA, 201 bp, Homo sapiens
tttttttgtgtgtgtgtgacattgtcttgctcttacacccaggctgatgtgcagtggcgcaatctcagctcactgcaacctccacctcccaggttcaagcrattctcctgcctcagcctcctgagtagctgggactacaggcatgcagcaccatgcccagctaattctgtatttttagtagagatggggtttcactatgtt

SEQ ID NO: 26059 - DNA, 201 bp, Homo sapiens
agcacaaccactttaaaaaggtgaaagtaggaaaactagctcaatgagagggctaatatttttatggggccaatgatttgaattggtagacatatatgccytcctacatgatataggagatagagtgcaaaaatcaaaccaaagtgttttttcctaccctcactcaccacacactactcctcacatgccaagcaagcaagc

SEQ ID NO: 26060 - DNA, 201 bp, Homo sapiens
gaatatacttgaacaaataaattctagtttaaacattggtaaacttgaattttaatctgaaattaaatccttacggaattacactatcacacccatatttwtttttttgttgtttttgagacagagtcttgctctgtcgccaaggctggagtgcagtggcgtgatcttggctcactgcagcctccacctcctgggttcaag

SEQ ID NO: 26061 - DNA, 201 bp, Homo sapiens
aaaggccctgaggcaggagcgtgcctttgaaaagaaatggcaaggaatggctggaggacagcaagtgcagggaggctgggaggagacggaggaaagggcartgagatcctagagggccctggccacactgaaagaagctcctgtgaaacggagtctctcagaataggtcccttttaaagtcacctgaaaccaggtgtcagt

SEQ ID NO: 26062 - DNA, 201 bp, Homo sapiens
gcagcgagctgtgatcgtatcactgcctgggccacaaagtgaaactctgtttcagaaaacaacaaacaaaaaccagttctccaccatgccaaataaaacaytgggaaccagaaataaagaagtggaagtctcacctcaggggtggctattcctagcatcttgctagatttttaaaggtactcagtaatacattacagctga

SEQ ID NO: 26063 - DNA, 201 bp, Homo sapiens
aaattaaatccttacggaattacactatcacacccatatttatttttttgttgtttttgagacagagtcttgctctgtcgccaaggctggagtgcagtggmgtgatcttggctcactgcagcctccacctcctgggttcaagcgattctcctgcctcactgtcccaagtagctgggattacaggtgcctgccaccatgcct

SEQ ID NO: 26064 - DNA, 201 bp, Homo sapiens
ggacactgcctatgtgattcctcccaggtaagatgcagggacgttggtcaccacccactgagagttattcttatgaattgcaggtgtgaaagctgagcagyagcaatatctggacactgagagagccacacttactgtcctgagagtcacagagatgataaagaaagaggttcatgtagagctttcttatgtagcagagag

SEQ ID NO: 26065 - DNA, 201 bp, Homo sapiens
  misc_feature (1)...(201): n = A,T,C or G, or insertion/deletion polymorphism (see Tables 1-2)
ttcccctattattaacatctcacattactatggcatgtttgttacaaataatgaaccgatattgatacattagtattaactaaagtccatactttatttcnatttccttagttttttatctaatattctttttctgttcaatgatcccatccaagacgccacattgcatttccctgctgtgtctctttagcttcctcttgg

SEQ ID NO: 26066 - DNA, 201 bp, Homo sapiens
ccagtaaaagtccatgcctcatttgctggctctgggcctctttggcctcttgaaactggtgcctttcccagtggagctgatagagatttgccacaacaggsacatgggcagaagaactagtttaaacctagaagggatttcccacttgcctacgagtaaagtccatctaagagtggctgatactagatggcttcaaggaag

SEQ ID NO: 26067 - DNA, 201 bp, Homo sapiens
aaaagatgtggtacataggatctatgtatatacacaatttgcaatcatatattcatgtcacttgcaaattaaactgtttttatgataatttttcctttttkcgagacagggtctctgtcacccagatggaagtacagtggcacaatcacagctcactgcagcctcaacctcctgggctagagggatcctcccacctcagcc

SEQ ID NO: 26068 - DNA, 201 bp, Homo sapiens
aattagctgggtgtgatggcatgtgcctgtaatcacagctactcaggaggctgaggcaggagaatcgcttgaacccgggaggtggaggttgcagtgagctragattgcgccattgcactccagcctgggggacaagagcaaaactccatcaaaaaaaaaaaaaaaagtccaaggactttctagaagcccttttacacctgc

SEQ ID NO: 26069 - DNA, 201 bp, Homo sapiens
gctaattttttaattttttttatagaaatgaggtctccctatgttgtccaggctggtcttgaactcctaggctcaagtgatcctcttgccttggcctcaaygcaaagagctgggattacaggtgtgagccgtggtgcccggcctatgataataataatacatccacatgtttaaaaaaaaatcaaaacgtaagtttggata

SEQ ID NO: 26070 - DNA, 201 bp, Homo sapiens
agccactgctgctgccttaggtccctctgtggctgaccacagaacctgactgcagttgcagtcttgcttgtgacttgcctggagagcctctatcttgttcmccaaggggtgtctgttgagcagctgatgctgctgtctttatgtggaggaaggtctcttcaaggaatgtttcacaattattttttaaatcctgaaatggtg

SEQ ID NO: 26071 - DNA, 201 bp, Homo sapiens
aagggtgagaaagcaaatataataattgtctcatctctataacatttaaagatttgattaagtgaaacaaagccccagctgctggagcagaggttccactygggttccacagacacccacagcccaaatccctggaggtcagtggggctcacagtgagtgtggggatgcttctaatagtgggtgtgctcagctgggagtgg

SEQ ID NO: 26072 - DNA, 201 bp, Homo sapiens
taattttttaattttttttatagaaatgaggtctccctatgttgtccaggctggtcttgaactcctaggctcaagtgatcctcttgccttggcctcaatgsaaagagctgggattacaggtgtgagccgtggtgcccggcctatgataataataatacatccacatgtttaaaaaaaaatcaaaacgtaagtttggatata

SEQ ID NO: 26073 - DNA, 201 bp, Homo sapiens
ttcactatttgagtgatgggttcaatggaagctcaaactccagcattattcagtacactagtgtaacaaacctgcacatgtaccccctgaatttataattwaaaaaaatttaaaaatagaaaacaaatattttgtaatattcttttatccttaaaggcaatgaataaatcatataacccatttaaattcataatttcgaag

SEQ ID NO: 26074 - DNA, 201 bp, Homo sapiens
gttcaggggatttatattgaataagtccagcaggttcataaggcatttgagtgaatctaagttggctaaacactgaggttaagaccaggtcaggaagccahgtgaatgaaaaggctgggtgggtaatgccagtaagttaaggcctcctgaatagagctaggtggctactccacgtgggtaatgctaagaggttaaagctag

SEQ ID NO: 26075 - DNA, 201 bp, Homo sapiens
ggagttcgaggctgcactgagctatgattatgccactgcaccctagcctgggtgacaaagtgagatcctgtctcaaaaaaaaaaaaaaaaagaataaaaamcaaaaaataaaacatggtagaaaaaatgactgatagggtaaaatactgataatacatttaagtgaaaaggaagattagaacaaaatgtccagtacattca

SEQ ID NO: 26076 - DNA, 201 bp, Homo sapiens
gagttcgaggctgcactgagctatgattatgccactgcaccctagcctgggtgacaaagtgagatcctgtctcaaaaaaaaaaaaaaaaagaataaaaaamaaaaaataaaacatggtagaaaaaatgactgatagggtaaaatactgataatacatttaagtgaaaaggaagattagaacaaaatgtccagtacattcac

SEQ ID NO: 26077 - DNA, 201 bp, Homo sapiens
aatcctagctactcaggaggctgaggcacaagaatcgcttaaacctgggaggtgaaggttgcagtgagccgattatgtcagtgcactctagcctagatgamaagagtgagactctgtctcaaaaaaaaaaataataataataaattaaaaaagtacaccatgattggttacattaaccacatttatttatttaatattttt

SEQ ID NO: 26078 - DNA, 201 bp, Homo sapiens
tcccacaatgctggaattgcaggtatgagccatcacgcccagctttgaattcttaaaattacctgtaccacatgtgaatagaatttgtgaactatgcaggractttaagtcataatcggcatccacctgagaacctcatagcagagtaaggcttttgcaggaatctcagccagcctagtaaatattcactgaactctgact

SEQ ID NO: 26079 - DNA, 201 bp, Homo sapiens
gcttcctgatgtatggcagattgttcctggctttcaaatttccacaccttgaaagatgcccagggagcctatgaaaagcccaagacctggctgggcgcggyggctcaggcctgtaatcccagcactttggaagaccgagacgggtggatcacctgaagtcaggagttcaagacgagcctggccaacatggcaaaaccccgt

SEQ ID NO: 26080 - DNA, 201 bp, Homo sapiens
aggtgagcaaggctaatggggtctcaccagagaggggagtaagacctgggtgtaaggacaggggagtaaggcctcatgggtaagatcaggtgggtcgtggyggcagattgaggccagcaaattaaagccagctgggtgagaataggtggatgatggtaagaagttacggtcaggtgggtaaggccaggacttttagtctag

SEQ ID NO: 26081 - DNA, 201 bp, Homo sapiens
ctgaggcaggagaatcgcttgaagctgggaggcagaggttgcagtgagctgagattgcaccatcgcattccagcctggcgacagagcaagactccatctcaaaaaaaaaaaaaaaaaaaaagagagagagaaaagaaaagcccaagacctcggggccatccccaaacctactgttatcagattttgaatctatcttttttt

SEQ ID NO: 26082 - DNA, 201 bp, Homo sapiens
tctaggaaattaagcctggatcttatgggcaggagtttcaaagggctacatggaagaagcttgtataataatgccatgagaataaggatgattaagacaaygaggttaataaggtctgctgagtaaggcaaggttgctaaaacaggtgtataaataggctgaataagactatttgggtaacaccaggccagtcaatcaagg

SEQ ID NO: 26083 - DNA, 201 bp, Homo sapiens
caaccctactcactccccaccatgccagctcactgtcccatttggtgtcccttttgtgtgatatcttttcccactgttggacactacgggctgtgaagtgygttgcttggtttaaaaaaatgtaagccagtggttctacatggtacactatttttgttccattccttttatggtgttttaagcattgtgcgtctattactg

SEQ ID NO: 26084 - DNA, 201 bp, Homo sapiens
catgccagctcactgtcccatttggtgtcccttttgtgtgatatcttttcccactgttggacactacgggctgtgaagtgcgttgcttggtttaaaaaaaygtaagccagtggttctacatggtacactatttttgttccattccttttatggtgttttaagcattgtgcgtctattactgggtatggaaagtgcaattgg

SEQ ID NO: 26085 - DNA, 201 bp, Homo sapiens
gataagaccaagatcattagttaggctaggaaattaaacctgggtcagtaaggccaggagtttcatagggccacatggatgaaacttgtttaataatgccrtgagggtaaggtgattaaggaagtgaggttaataatgtctggtgagtaaggccagattgttaaaaccaggcatttaaatttagccaaagaaaagactatt

SEQ ID NO: 26086 - DNA, 201 bp, Homo sapiens
ataaagatcacatgtattccttctgcccaaagataatgaacacctcacaatgctgtagactcttctaggaggctcctgtgtggccagccacagtaatgctktttatttattattttattattattattattattatttgagatggagttttgctcttcttgaccaggctggagtccaatgttgcgatctccgctttctgca

SEQ ID NO: 26087 - DNA, 201 bp, Homo sapiens
aactgggtaagcctgggtaggtaagatcagttgggtaactctagttggtaaagatatgatgttaaagccagtagggtaaagccaggtgggtaagccaggtrcacaaggccaggggattaatactgcatgagtgaggccagtagcttaacaaggtaggtgggtaaatctaagttggcaaaaccatgaagttaaggccaggtc

SEQ ID NO: 26088 - DNA, 201 bp, Homo sapiens
tttttgttgttgttgttttgttttttttgagacagagtcttgctctgtcccccaggctggagtgcagtggcgggatcttggctcactgcaggctctgcttyccggattcatgccattctcctgcctcagcctcccgagtagctgggactacaggcgcccaccaccacacccgctaattttttgtattttagtaaatacggg

SEQ ID NO: 26089 - DNA, 201 bp, Homo sapiens
aggtgggtaagccaggtgcacaaggccaggggattaatactgcatgagtgaggccagtagcttaacaaggtaggtgggtaaatctaagttggcaaaaccawgaagttaaggccaggtcaggaagccaagctatttaaaaggccagataggtaaggccagtaagttaaggcctccctgcatacaactaggtggctgagttta

SEQ ID NO: 26090 - DNA, 201 bp, Homo sapiens
gttgttgttgttttgttttttttgagacagagtcttgctctgtcccccaggctggagtgcagtggcgggatcttggctcactgcaggctctgcttcccggrttcatgccattctcctgcctcagcctcccgagtagctgggactacaggcgcccaccaccacacccgctaattttttgtattttagtaaatacggggtttc

SEQ ID NO: 26091 - DNA, 201 bp, Homo sapiens
taagtgggtaaagaggatgtccatgtgagtaagaatggaaagataaggccaggttggtaagctcagttggtaatccaggttggtaaagccatgagtttaaygccagttgggtaactccagatgggtttagaagggtatctaagtctggggaggggaaatatagagaataatggaaggtggataagtccagaggagtcaacc

SEQ ID NO: 26092 - DNA, 201 bp, Homo sapiens
tttgcacttgtttctgtatgtttctggttctcaactgagctggcaggttcctgctgttgtcattcaggctttcaatagctcagggcctcacactctttacstctgccctctgctggggtcaggaagacaaaataacccagctatattaggtttctccagagaaagagaacccactggatggatagatagatagatagatag

SEQ ID NO: 26093 - DNA, 201 bp, Homo sapiens
agggagatataagtaccttaaggccagattgtcagctgatttggccatgtaggtgttgaagtgatgatagtgtgagatggatcggagtcagagagaaagckgggagtcaggtgccaatgtcttcaataaaggggcaggggtgtggggggtagaaatcaaaaaggacagtgggtgccttagcaaggcagcatagacttcagt

SEQ ID NO: 26094 - DNA, 201 bp, Homo sapiens
tcaccatgttggtcaggctggtcttgaactcctgacctcaggtgatttacctgccttggcctcccaaagttctgggattacaggcatgagccaccgtgccyggccagtaatgctgtttaaaatgaaagaaggctctacaatggggccatgacgcacaccgcatatgaagtgggcatcttccgtgtcagtaagttttatgta

SEQ ID NO: 26095 - DNA, 201 bp, Homo sapiens
gggaactgtttagagatgaagtctcactgagtcaaggtaggtggttaacaccagatggatataagaccagaagattaagtcatgctgggtgaggtcaggcwggcaagtatggtcgtatctttaagaaggccacgtgggtaaggcctagtgggtcgggctggaaggtgaataaagccaagtggttaaggccaggtagtgaag

SEQ ID NO: 26096 - DNA, 201 bp, Homo sapiens
tttgtgctctcctggccacttcctcagatgaccttctaggcagaattgccagatcaaaagggtacacaccttggaagcattgatgtgggatgcctgtctcttttttttttttgagacagagttttactcttgttgcccaggctggagtgcaatggcttgatcttggctcaccgcaacctccgcttccggggctcaagcgat

SEQ ID NO: 26097 - DNA, 201 bp, Homo sapiens
tggcggcatccacttctggggagaccttagggaactagcaatcatggtggaaggtgaaaggggagaagccacgtcacgtggttagagtagcaagaatgggytggggaggtgctacacactttttttttttttttttttgagacggagtctcaccctgttgcccaggctggagtgcaatggtgcgatctcagctcactacaa

SEQ ID NO: 26098 - DNA, 201 bp, Homo sapiens
aacaacaacaaaaaaaatacaagcaaaaaaactataatacctatttacacagcaaaaaattgcctctaccacactcctgacaatcttgtgtgagtctcacrgaatccgaggccctggtttgtaacctcccatgtcctatcctatgtgagtctggttctctaatgtcactttagacattaaaatggtccaaggtcatccaac

SEQ ID NO: 26099 - DNA, 201 bp, Homo sapiens
agaagaggaagggtgttgtccccgctgcaatagagagagcaaattctctcttcctctgcctttgtgttctatccaggccctcagccctttggatggtgccygcccacattggtgaggtcagatcttccttattcagttcactgattcaaatgccaatctcttccggaaataccttcacagacatacccagaaataatgtgc

SEQ ID NO: 26100 - DNA, 201 bp, Homo sapiens
caggtttacatctacaatgacccaccacaccagtcaaatacaaatcagcaagactcagctggagtgaagtagtgcagatgggctgggcactgcttggtggstccactgcttacctttcccacctcacattttacatttctacagggggcagatgcctgagcatagctctgtgatcaacaggctttgtgggtttttattatt

SEQ ID NO: 26101 - DNA, 201 bp, Homo sapiens
ggccgattcaggctgacttcctagaactgaatcaaaaggaaaaccccacctctccatgtccaagtaacaaaaagatcagaggctactccctttacactcckcccctccccactcccattccactgcattgcagatgaaaaattgaaagtacctctgattggttgcctccctctaccaattagactggttgtgggccaagtc

SEQ ID NO: 26102 - DNA, 201 bp, Homo sapiens
caatttgacttcctctcttcctatttgaatacatgttatttctttctcttgcctgactgccctggccagaactttcaatactatgttgaataggagtggtragagagggcatccttgtcttgtgctggttttcaaagggaacgcttccagtttttgcccattcagtatgatattggcagtgggtttgtcataaatagctct

SEQ ID NO: 26103 - DNA, 201 bp, Homo sapiens
cctaaatttaaagttcagctttatcaggggagcctgggagaatggttacattaacctctttgtggcctttgaaacatacatagaaaatatcaagggatagwtgtaaaaatgaggataaaaacatctaaagtgctaagtagaaagtaactgagtagaatggaagcctgtagagcaaaaaattagattgtggtttgagtgagt

SEQ ID NO: 26104 - DNA, 201 bp, Homo sapiens
caggtatgatgctagtgcttatttaattttctgaaatcttttagaagaaggctgcttgtgccacgtggggtacctgtgttcttttggctgtggagtttgcrcaggaagaggtttggagatccaggagcctgaagtcagatgacaggtgccttgacctctgtggcatgtctctttggactctgtgaaagttatttaattgct

SEQ ID NO: 26105 - DNA, 201 bp, Homo sapiens
gcaaaactctgtcttaaaaaaaaagaaaaaggtattttacgttctgtatccattcatccattcgacagaaatcaaaattggacatttcagctatggtttaracaagaaactggaagaagtggatcgactctccaagaatgagttttatgtctatagacaaaagattgcaaactaaggctgggtgcggtggctcatgcctat

SEQ ID NO: 26106 - DNA, 201 bp, Homo sapiens
gtttggagatccaggagcctgaagtcagatgacaggtgccttgacctctgtggcatgtctctttggactctgtgaaagttatttaattgctgtggttttcyagaagaatatgaagataattgtaaggtgccacatgcactgcttggactcttacagttctgacagttattcctgacaaatttcaaaaccaaagtctgtttc

SEQ ID NO: 26107 - DNA, 201 bp, Homo sapiens
aagtggatcgactctccaagaatgagttttatgtctatagacaaaagattgcaaactaaggctgggtgcggtggctcatgcctatcattccagcactttcrgaggctgaggcgggcagatcacttcagtccaggaattcgagaccagcctgggcaacatgacaaaaccccgtctctacaaaatatacaaaaaaatggacct

SEQ ID NO: 26108 - DNA, 201 bp, Homo sapiens
ctcttgcctgctgccatataagaagtcccttaactcctccttcctcttccgccataattgtgaggcctccccagccatgtggaactgtgagtctactaaawcctctttttctttataaattacccagtctcagatatgtctttattagtagcatgagaatggattaatacagtaaattggtattgggtagtggggcactgc

SEQ ID NO: 26109 - DNA, 201 bp, Homo sapiens
agtcccttaactcctccttcctcttccgccataattgtgaggcctccccagccatgtggaactgtgagtctactaaaacctctttttctttataaattacscagtctcagatatgtctttattagtagcatgagaatggattaatacagtaaattggtattgggtagtggggcactgctgtaaagatacctgaaaatgtgg

SEQ ID NO: 26110 - DNA, 201 bp, Homo sapiens
tgatagggcagcatctgagcagagaccagaggatatgaggggagtgagcaacagggctatttgtgggggaagacagtaagtgcaaaggccctgaggcaggrgcgtgcctttgaaaagaaatggcaaggaatggctggaggacagcaagtgcagggaggctgggaggagacggaggaaagggcaatgagatcctagagggcc

SEQ ID NO: 26111 - DNA, 201 bp, Homo sapiens
cctcttccgccataattgtgaggcctccccagccatgtggaactgtgagtctactaaaacctctttttctttataaattacccagtctcagatatgtcttkattagtagcatgagaatggattaatacagtaaattggtattgggtagtggggcactgctgtaaagatacctgaaaatgtggaagcgactatggaacaggc

SEQ ID NO: 26112 - DNA, 201 bp, Homo sapiens
ttccattcacatcaaagctctgtccctcctccccaggcaagctagagtgctcagcggaggcctatctgaggaggtgacggcaagcccaagggccagctcattttttttttttttttttttgaatcagtctcaccgtagcccaagctggagtgcagtggtgcaatcttggctcactacaacctccagccccagggctcaagt

SEQ ID NO: 26113 - DNA, 201 bp, Homo sapiens
aacataaccatccctacattccaatatccctctttttcatttttcctttaaaaataaacgtgcatttttttctcaaaagtgactgagctccatactccacrcaaccactgtttttagaccatccagatgctttgacacatgattttatattttaatagaagaaggctgaatatgaattgcaaaatcatctgtctccttttc

SEQ ID NO: 26114 - DNA, 201 bp, Homo sapiens
gcctctaccacactcctgacaatcttgtgtgagtctcacagaatccgaggccctggtttgtaacctcccatgtcctatcctatgtgagtctggttctctamtgtcactttagacattaaaatggtccaaggtcatccaacagcttaatcgatgaacaccattatcaatacaagaatatacatccaattataggctcattat

SEQ ID NO: 26115 - DNA, 201 bp, Homo sapiens
acacctaccatcccacctttaggcactgccttacccaacacccaagcctaaatgtttactttcttagcctttcttgcaattaacagtggccatgtaacacrattcctgtctagatgtgtgttagcggctatggcagccatcttgtgaccaggaggaagcttctgagaatcacagagatgcaacctctgaagctgccaaacc

SEQ ID NO: 26116 - DNA, 201 bp, Homo sapiens
caagcctcccacttctgttcacccctcccggcttgactcttctcgcactttgtaatttactgtacactttccttattctttattgcctattattccccaaytgaagtataaactctgtaagggcaggaattttgccaggtaagaaaagtgcagaagcaagtgccttgcagtctggatggaacaggcctgggaggggtcacg

SEQ ID NO: 26117 - DNA, 201 bp, Homo sapiens
cagacaggaaggaaaagtcatgaccaaaaagcacagccacaaaaacagacacacagggatcaggataatgaaatcgccaggagtaaaccctaaaaaatctrtaatatgtccaagctattaaagctcaaggttgagaatttcagcaaaggaactaaaagccataaaagacatcaaaaggaagttccagagcaaaaaaaaagt

SEQ ID NO: 26118 - DNA, 201 bp, Homo sapiens
ggactaggcaggcctggccttcagaggcttcctgggaatctttatccctcatgtcctgaccacatttacaccatggtgcttagcttgaatccctatcccaytggtaataatatgcttttagctttatagtctctctcagagcgcttgcatgaacatgatttcgtttgaaactgacagtagcccttgctctgtgctttgttt

SEQ ID NO: 26119 - DNA, 201 bp, Homo sapiens
acattatacattagaataaatatgagctatatatccactgaaggttaataaaaacaaggcaattaccaaatttttggtgaatgagtgcatgatggtgattrtagtggtgataggttaaatcaagaataggctgggtgtggtggctcacacctgtagtcccagcactttgggaggccgagctgggtggaccacctgaggtca

SEQ ID NO: 26120 - DNA, 201 bp, Homo sapiens
tgtgttctcacattttataatcctatttctgaaaaaacaatagtttgttaaccttgtagcttattccaaagaagcagctttggaggatttgcagaagtggwgtcatgggagggcattttctgagctctatgggccctggtgattgtcagacactcagaggatcctttaaaagtttctaggactaggaatggaaagagagag

SEQ ID NO: 26121 - DNA, 201 bp, Homo sapiens
aagttattcagataagtagatgtatggaatacctaacagatccctaatatcattacatttatgcagcaaaataaaaattctggaggacagaggccgggcayggtggctcatgcctgtaatcccagaactttaggaggctgaggcaggtggatcacttgaggccaggagttcaagcccagcctggccaacatggtgaaaccg

SEQ ID NO: 26122 - DNA, 201 bp, Homo sapiens
gggcacccatgcaaatgcctgtcctggtgtgccgacttgctcttggtctgcgaagcctgtggacacatggtcaacatgaaaccaccttaacccgcttcccrtcaggtctcgtgggagggatggggcagtgcctggagcacagagaggctcaggaaagggcagttcaactggtttcactgtggtggatcccttatgggggtc

SEQ ID NO: 26123 - DNA, 201 bp, Homo sapiens
ttacaattgaaggcttaggatgactctccagagagaattttctgtgcttgggatctttttccactaatagtcaaggaccacattatatcaaatttaagaaytgtagttcccagaatgagccaggtcagccttatcctgaggctgtagtcctctgaggttctagcttactatgggcatatttgtgtgtctcctgttagatcc

SEQ ID NO: 26124 - DNA, 201 bp, Homo sapiens
atgaaaccaccttaacccgcttcccatcaggtctcgtgggagggatggggcagtgcctggagcacagagaggctcaggaaagggcagttcaactggtttcrctgtggtggatcccttatgggggtctttctagcccaaactgggtgtgatcctgggatagtcaagagctcatgggaagctcttgtttttctcgtattttat

SEQ ID NO: 26125 - DNA, 201 bp, Homo sapiens
ccgcttcccatcaggtctcgtgggagggatggggcagtgcctggagcacagagaggctcaggaaagggcagttcaactggtttcactgtggtggatccctyatgggggtctttctagcccaaactgggtgtgatcctgggatagtcaagagctcatgggaagctcttgtttttctcgtattttataggaacgtggagtttt

SEQ ID NO: 26126 - DNA, 201 bp, Homo sapiens
tgtcagtgttcatttagctttatacacatacttcctactttctttgctcttttttccttcttgcagctcagacctctttttgcaatcattcttctactgtraggggagcctttcagaatttcctttcacatgggggtgatggtggcaacactgctgttttgttagtttgaaatgtctttattttactctcttgtggggtat

SEQ ID NO: 26127 - DNA, 201 bp, Homo sapiens
tggtggatcccttatgggggtctttctagcccaaactgggtgtgatcctgggatagtcaagagctcatgggaagctcttgtttttctcgtattttataggmacgtggagttttcaggaagtccaaaaaagtgcccagtggtcttggcaggctttgagtcttggccacctgacttgttgccagttcccttcacccctggtga

SEQ ID NO: 26128 - DNA, 201 bp, Homo sapiens
cttagatatggtattttctttctttctttctctttctttctttctcttttctttctttctttctttctttctttctttctttctttctttctttctttctytctttctctttctctttctttctttctctctctctttctttctcttttctctctctctcctttttttttttttgacagcattttgctgtaatgcccaggc

SEQ ID NO: 26129 - DNA, 201 bp, Homo sapiens
ggtgtgcaccaccacgcctggctaatttttgtatttttagtagagacggggttttgccatgttggctgggctggtctcaaactcctggcctcaagtgaccygcccgcctcagcctccaaaagttctggaattataggcgtgagccaccgctcctggcctcttagtgcttttgaatgaaataaaaacccgtaattattttaa

SEQ ID NO: 26130 - DNA, 201 bp, Homo sapiens
gtggatcccttatgggggtctttctagcccaaactgggtgtgatcctgggatagtcaagagctcatgggaagctcttgtttttctcgtattttataggaaygtggagttttcaggaagtccaaaaaagtgcccagtggtcttggcaggctttgagtcttggccacctgacttgttgccagttcccttcacccctggtgacc

SEQ ID NO: 26131 - DNA, 201 bp, Homo sapiens
atcccttagatatggtattttctttctttctttctctttctttctttctcttttctttctttctttctttctttctttctttctttctttctttctttctytctttctttctctttctctttctttctttctctctctctttctttctcttttctctctctctcctttttttttttttgacagcattttgctgtaatgccc

SEQ ID NO: 26132 - DNA, 201 bp, Homo sapiens
tttgagtcttggccacctgacttgttgccagttcccttcacccctggtgacccctaacgtttatctggggtctcatcatggggtcagaatttgttacttcmgtttcttttatgaaagagtgcatttgggtgtatttgaattgtttattttatactctatgaagtcaataaacccattcctatcacccatcccactgcctga

SEQ ID NO: 26133 - DNA, 201 bp, Homo sapiens
gtagactttcgactgagtttagcctttggtaactcataaattctggtcagccattgaagaggccctctctgagggtagctctgcccaaagggatagcactrtctagggaggacttctctctcttgtttctcaatagcatcacagggacaaagatctcacttcacagctctgaacttcaagatgacaggctccctttaaggc

SEQ ID NO: 26134 - DNA, 201 bp, Homo sapiens
gtttatgcctgtaatccgagaaatttgggaggccaagatgggaggattgcttgagtccagaagttcaagaccagcctgggcaattagcaagaccctgtctstataaaaaattaaaaattagctggatgtggtggtgtgcacctgtagtcccaacaatttggtaagctgaagagagaggatagcttgagcccaggaagctga

SEQ ID NO: 26135 - DNA, 201 bp, Homo sapiens
gcgattctcctccctcagcctcccaagtagctgggattacaggcacctgccaccatgcctggctaatttttgtatttttagtagtgacagggtttcaccaygttggccaggctggtctcgaactcctgactttgtgatctacctgccttggcttcccaaagtgctgggattacaggcgtgagccaccatacctggccccat

SEQ ID NO: 26136 - DNA, 201 bp, Homo sapiens
gtgacatgcacttgtgctcctagctgcttgggaggcttgaggactccttgagcccaggagttccagggtacagtgagcataacttgccactgtgctgcaayctggaggacaaaaccctgtctctactaaaagaaaaaagaagaataaggagaagaagaagaagataaggaagtttttccttcgttctttgaaatctctttc

SEQ ID NO: 26137 - DNA, 201 bp, Homo sapiens
actactcgttgtagtgttggacatagacatccaacagtcatgtccccgttcttcacagagcctagattttgtcaaatggttaacccatcctgagcccctgrgaagtgtcctaattggtgcaagccagtcagctcaggacatccctttgctgactattcttggtccaggtgtagacatggcacttaaattggccgtttcata

SEQ ID NO: 26138 - DNA, 201 bp, Homo sapiens
gaagaggagaaggctcccacgggctgtgtgctctggaaaactgctgggcatgagagggagaccccaaggggctcaccaactgccctaccacccagctctgscaccctgtttaaatactcaacaggagcacacacagatgtacaccaaagcctgtggcaagatgctcaaaactagtttgtcatcactgccaaaaacgggaag

SEQ ID NO: 26139 - DNA, 201 bp, Homo sapiens
aagaggagaaggctcccacgggctgtgtgctctggaaaactgctgggcatgagagggagaccccaaggggctcaccaactgccctaccacccagctctgcmaccctgtttaaatactcaacaggagcacacacagatgtacaccaaagcctgtggcaagatgctcaaaactagtttgtcatcactgccaaaaacgggaagt

SEQ ID NO: 26140 - DNA, 201 bp, Homo sapiens
ttgtttattttatactctatgaagtcaataaacccattcctatcacccatcccactgcctgagctaaggggccttccacagttgacctggagagttcaagygcactgcactcgagtgcgcttctgggttgaagctgccacctggtactcccagagcctgtgcctctgaggcttcctcttaggttgtggatccgtggaagag

SEQ ID NO: 26141 - DNA, 201 bp, Homo sapiens
tctaattgtttgcatacacaatctctttttactcttaacagtgagactctagtaagtggtctcttgatgcttactataactttggggatgtttgaaagtgktgaccgagtcacccacctggtcttctgccatgtcacttggccctgctggtccatttgtttttggccagtgcccgtttgggagccaaaccttgtcacctac

SEQ ID NO: 26142 - DNA, 201 bp, Homo sapiens
gcatacacaatctctttttactcttaacagtgagactctagtaagtggtctcttgatgcttactataactttggggatgtttgaaagtgttgaccgagtcmcccacctggtcttctgccatgtcacttggccctgctggtccatttgtttttggccagtgcccgtttgggagccaaaccttgtcacctacctccagcccac

SEQ ID NO: 26143 - DNA, 201 bp, Homo sapiens
caccttcagaggattagggaatgtttttaaacatgtgctgcagactctgaaggcagtaagcaagtgtttattaaatgcatgctaccgcaggcactaggctyactgtggtgactcagagatgcagaggacctagtccttatacccgaagaggtacagactaaaggaagagacagaggggaagctgtcaatcaggtgacagta

SEQ ID NO: 26144 - DNA, 201 bp, Homo sapiens
tctgaggctaagtcaggaggatctcttgagcccaggagttctttgagttcagcctgggcaacatagtgagatcttgtctcaaaaaagaaaaaaaatatgcygctattagctgctattattattgttcttttcattagttcaaatctttttccttcctccatgtaacaactgccgatccttggttctggttgtctatagtta

SEQ ID NO: 26145 - DNA, 201 bp, Homo sapiens
ttctttttattataaaatataacacacatagaaaaaagtacgttaagacctaaatgtacagcataacaaataattataaagcatatagccatgtaactgctgccctgttaaagaaatagtgtatcgttgacaccccagaagcactctgtgtgtgttctctctttatcacatccccttccctctggaattaaccactatcct

SEQ ID NO: 26146 - DNA, 201 bp, Homo sapiens
gtaaatgattccatggtgaaagacaagaaaataacttctccagtaggatgaggtggtctcataccaaccaaagcaaccaaagcttgcataccaacattgtyaggtgggtgagaattgcattcattcctaacctcttgaggcttcagcatcccaagactagatagtggaaaatctcagtagctctccaggcaaagctggccg

SEQ ID NO: 26147 - DNA, 201 bp, Homo sapiens
gttcatttagctttatacacatacttcctactttctttgctcttttttccttcttgcagctcagacctctttttgcaatcattcttctactgtgaggggakcctttcagaatttcctttcacatgggggtgatggtggcaacactgctgttttgttagtttgaaatgtctttattttactctcttgtggggtatatttgat

SEQ ID NO: 26148 - DNA, 201 bp, Homo sapiens
catggtgaaaacctgtctctactaataatagaaaaattagctgggcatggtggcatgtgcctgtagtctcagctacttgggaggctgaggcaggagaatcrcttgaacctgagaggcggaggtggcagtgagctgagattgcgccactgcactccagcctgaagacagagcaagactacgcctccaaaaaaataaaaaaaa

SEQ ID NO: 26149 - DNA, 201 bp, Homo sapiens
aaccaaagcttgcataccaacattgtcaggtgggtgagaattgcattcattcctaacctcttgaggcttcagcatcccaagactagatagtggaaaatctyagtagctctccaggcaaagctggccgggtggcggctggggggcattgggggcggggttgggattcagaacgctcacccaccatgtctgaaaagcatccag

SEQ ID NO: 26150 - DNA, 201 bp, Homo sapiens
gttaaggcccatagggatagaccaggtggagaaggctaatggggtatggccaaggccctaaaatgaagttggtaagaccagggagtaatggcagccgagtyaggcctcatgggcaagatcatgtgggtcttgaccagagatcaaggccagcaaattaaagccaggtaggtaagaacaagtggattatggcgggcgggaagt

SEQ ID NO: 26151 - DNA, 201 bp, Homo sapiens
ttaaatcagctttggaaaattttttgtcattacctcttcaaatgttgcacctattgctcccaactcaatttcactttcctacccttctgaagctctaattrcacatcagaccttttcctgtttttatggtattgcctacatattttttctttttaaaaatacttgggtgcttccatagggatattttctaccaaccaatct

SEQ ID NO: 26152 - DNA, 201 bp, Homo sapiens
ttggagccaggttggtcaggtgctagagcctatgctgtattaggctttcaaaggtaagagtgtttgaagaatttaccaaaacttagaggtaacctgttctygggatgccagcaggctttggcaatgaacctacatgaggttggacataggctccaacattgactaattaaggaactatgggcaagtttcttaatctgtctt

SEQ ID NO: 26153 - DNA, 201 bp, Homo sapiens
ctcagagtgattatgacaaccgatgatatcctcctttcagacataatatactgctcttggtgctagatgggctgtgagggacatagactaataataataayaacaaccagtggtgtaggcattgcaattatatccacatttttacggctgaggaaacctaggaacacagacgctaagtcagtcactgaaagtcatatagtt

SEQ ID NO: 26154 - DNA, 201 bp, Homo sapiens
gattatgacaaccgatgatatcctcctttcagacataatatactgctcttggtgctagatgggctgtgagggacatagactaataataataacaacaaccmgtggtgtaggcattgcaattatatccacatttttacggctgaggaaacctaggaacacagacgctaagtcagtcactgaaagtcatatagttagtaaata

SEQ ID NO: 26155 - DNA, 201 bp, Homo sapiens
aagtcagtcactgaaagtcatatagttagtaaatagcagtgctgggatttgaatccatgtggtccgagtcttgaagctattttcttaatagaaaggtagamcttcaaacaagtttttattgttgagaaggctagatggcatcttcccctctccctccaaatctgtaacaaacaatgagaaacatgagaaacaaaaacaaga

SEQ ID NO: 26156 - DNA, 201 bp, Homo sapiens
cctgaagtttgaaaatgagcaacagagacacaggacaagaacaaggcaaaaaataaatgtcatagaagacatataagtattgaaaagttttcaagacaccygaatgcccaatactgtccccttactcattgtgtaaccttggagaattttatttatctttcctcatctgtaaaatgggtagaataaggctaaagataagaa

SEQ ID NO: 26157 - DNA, 201 bp, Homo sapiens
gatcagcctagaaccttctgagacaaggattctgaaaacttttagtctttatttgccattttatcttcaatgctgtttttaaaagctggttctcttgcaayccctggtcccccaacactgccctgataggccaattgtctaggcagcagttgtggcaacagctggaactgcctgcactttctgggcactagtgctggcata

SEQ ID NO: 26158 - DNA, 201 bp, Homo sapiens
ggcatgtaattgtaccaataagatgatcacaacattgtcagataacaccatccaaaatcatatgcatagaaaaaaaggatagaagaaaacaccaaaatatstactgtagctggatatcgttgggtagtgggattacacaaactgttttctttatttgtttctacttgttttacttttaataatggctgaagaatttttact

SEQ ID NO: 26159 - DNA, 201 bp, Homo sapiens
gttggacatagacatccaacagtcatgtccccgttcttcacagagcctagattttgtcaaatggttaacccatcctgagcccctgagaagtgtcctaattkgtgcaagccagtcagctcaggacatccctttgctgactattcttggtccaggtgtagacatggcacttaaattggccgtttcatattgagtgcatatttt

SEQ ID NO: 26160 - DNA, 201 bp, Homo sapiens
tatctgagcagcagggggagaaatagtaagtgagcggagccagaaaggctatagcactaaaggaactttgggcctacgatcaaaagacctaatttctagcytctttctgctacttggtacctatgtaagctggggcaagccactgcctttcctaattttcatatcagcaaaatggagatggtaatcttttgttgtgctagt

SEQ ID NO: 26161 - DNA, 201 bp, Homo sapiens
atgcctgtcttcattgttattctccctgacaagtagacaaggtcagagtcataggacctgaacagaagatttggaactatatctttggtgccataatttarggtggcagctcatcctcagatgaagtgagatcccaaagaggcttgtgatcagttgagaccgtaaatttgcatgtgtaggtcagcactgtaaacgtgattt

SEQ ID NO: 26162 - DNA, 201 bp, Homo sapiens
tttatttggttcacattttggttcacaatgggtcataatcaggcaccaatcttgcttgtttcccagcaatatttgcagatatgcaaactggccccttgcakgcaaatcctggagcacgtcctggagcctttagaggtgagtgagaaggtaagtgtagtgaaatcctcttgaaggattttaagaggcagagcctcagacaag

SEQ ID NO: 26163 - DNA, 201 bp, Homo sapiens
cacacacgaaaagaataaaagtaaaacaattacttttcagacaatgatttctgccaccatatttttatcccatgtcctcgtcaccaaagcagtcaccctcrcttatataaatatttgttttatattagcatctgtgttatggtgattcagaacataacaaagcaagttcttgcctatgaataacattatagatgccccaga

SEQ ID NO: 26164 - DNA, 201 bp, Homo sapiens
tcatatcagatagtatgcctaaaaaagctataaacatttcttgatgtcaattttttaatgattatctcttggtagtcaacatgaatgagaaactttgttcrtattagtagctgacaaaatattttattgttttctatcaaatttacaatagttgccaagagaatgtaacagctcttttattcttttctagaaaaatgtgat

SEQ ID NO: 26165 - DNA, 201 bp, Homo sapiens
gttgccaagagaatgtaacagctcttttattcttttctagaaaaatgtgatattgaaatctgttgtgataatgaaaatagatttttttaaaaacagaactwtttttttcccctttacattctttttttttaactctcattttaggttcaggggtacatgtgcaggtttgttacataagtaaacttatgtcatgggggtttg

SEQ ID NO: 26166 - DNA, 201 bp, Homo sapiens
acaaccagttgcaccttaggctgtgatccaagtacggcgggcacctggaacccagggtcctccagcaactccataggcccaagaccacatggcacagagaygcactctgctgccaaactgaaggagctgtccaggctgcagagcacctctttggctgtgtttgaggtgtggctaggaagctgggagtgctgcgaatcagtg

SEQ ID NO: 26167 - DNA, 201 bp, Homo sapiens
tggcacagagatgcactctgctgccaaactgaaggagctgtccaggctgcagagcacctctttggctgtgtttgaggtgtggctaggaagctgggagtgcygcgaatcagtgtagggaacggtgctcattgctaatggtgacagcacatagtcaggaatactctgcttagggttcccttcaggggatcgaatgagcctagg

SEQ ID NO: 26168 - DNA, 201 bp, Homo sapiens
gagagaaactgttttcctaaatgtgtgtttctatgtactccaactacagttacacttctgggttctctcccaatcctcattttctttcttgggtcaggaaraaggaaatatctgattgatgagtttagaagaaatagaatgtgtggctcaggcccctcctctctttcagggtctgtctgcttgcagagaggctgcaagctg

SEQ ID NO: 26169 - DNA, 201 bp, Homo sapiens
gaagaaatagaatgtgtggctcaggcccctcctctctttcagggtctgtctgcttgcagagaggctgcaagctggtctgcctcagctcagtggctcttaarggggcagtttctgcccctgcccttagggaactcagtaggggtcgagcgtggcctggaattgtgtgaataaggcagcttaatccagggtaaggtatgttag

SEQ ID NO: 26170 - DNA, 201 bp, Homo sapiens
gctcttaaaggggcagtttctgcccctgcccttagggaactcagtaggggtcgagcgtggcctggaattgtgtgaataaggcagcttaatccagggtaagktatgttagcagactattttggctgcttatctaaaattacatattctaatcagctttaatcaggaataaagaaaacaacatcggccgggtgtggtggctca

SEQ ID NO: 26171 - DNA, 201 bp, Homo sapiens
aggctgaggtgggaagatcagttgggctctggaggtccagaagcagtgagcagtgattgcttcactgcattccagcctggatggcaaagcaaaatcctgtytcaaaaaaattagtaaaataggccgggcgcagtggctcatgcctgtaatcccagcactttgggaggctgaggtgggcggatcactcgaggtcaggagttc

SEQ ID NO: 26172 - DNA, 201 bp, Homo sapiens
ttgggaggctgaggtgggcggatcactcgaggtcaggagttcgagacaagcctgagcaatatggtgaaaccccatccctactaaaaatacaaaaaattagyggggcgtggtggtgtatgcctgtaatcctagctactcgggaggctgaggcaggagaatcacttgaatccaggaggcagaggttgcagtgagctgagatca

SEQ ID NO: 26173 - DNA, 201 bp, Homo sapiens
tttgtagctggtgggtcagaagttctagaggctcagatctgcaactggtatctgaagttggggacagttttgtgagactaacccctgaacctatgagatctaacactgtctttaggtagggagtgtcaaaattgagttgaattagaggacacccagctagtgtccactggagaacctgctggaaaacggattgtttggtgt

SEQ ID NO: 26174 - DNA, 201 bp, Homo sapiens
gaggaagggaggcagggcagagctggggaaaagctctagaaaggtcagagcctgggttgatcctgttcagatttctgacttctttctgctcatcctctatsagagctgctcacactgtctccttttctcagaccctagggcctaggtgacaaaatgttatttaacgagagatcagggtgcacaggacaagcacctgtgtta

SEQ ID NO: 26175 - DNA, 201 bp, Homo sapiens
aagtggattgcttgaacccaggagtttgagaccagcctgggcaacatagggattccccatctccacaaaaaatacaaaaattagtcaggcatggtggcacrtgcctgtactcccacctaccaagtaggctgaggtgggaggatcacctgagcccggaaggtcaaggctatagtgagccatgattgtgtcactgtactctaa

SEQ ID NO: 26176 - DNA, 201 bp, Homo sapiens
taatatgctgagtgccatgggggacagcacatcagcgggtgttctgatgtcttgtgagaactgtgacaaatttatgttgagtaataactaggtgctggcastgtattgtgtcatttaatcttcacaataacacagttaattaggtcccaccgttttctgaatttcatcaatgaggaaatagcagcaaagaggaggtaacaa

SEQ ID NO: 26177 - DNA, 201 bp, Homo sapiens
attattttttatggctgtgtagtattccatggtgtatatgtaccatgttttctttatccagtctgccattgatagccatttaggttaattctgtgttttcrctattgtgaatagtgctgccatgaacattcgcgtgcatgtgtctttacggcagaacaatttatattcctttgggtatatacccagtaatgggattactgg

SEQ ID NO: 26178 - DNA, 201 bp, Homo sapiens
taatgggattactgggtgaaatggtagttctatttttagctcaaagtgacactcttaatcacagtgctgtaacatcatcatcatcagcagcagcagcatcstaatacatttttagcagagttttgtacacattaaatcatttaatcctcataaccttaaagagagttattattatcccattttacagatgaggaaatgggt

SEQ ID NO: 26179 - DNA, 201 bp, Homo sapiens
gtccaattaagattaattgaattgtgaggagcaatgcacagcacattatgaaagattgaaaggggaaaggagccctttaagaaggcttggtggcattgagyttattttaagatattcctaaggcaacaagctagaaaatactcaagaaaaaattcctagagagcagaaaggcagaggacatcttttaaaacattagccttt

SEQ ID NO: 26180 - DNA, 201 bp, Homo sapiens
gtccataaaccctttattcatcccagtaaatcaaactactttctttggctgtcgaagtttggagacataaacaaaggaaacattgatgaaacattccagcrtatgtttgcttctctctcagatcagatcaaaatacacaaagagttggtattaccagacgcttaatcaattacccaaaactattgggctttgaactttcta

SEQ ID NO: 26181 - DNA, 201 bp, Homo sapiens
gttcgagacaagcctgagcaatatggtgaaaccccatccctactaaaaatacaaaaaattagcggggcgtggtggtgtatgcctgtaatcctagctactcrggaggctgaggcaggagaatcacttgaatccaggaggcagaggttgcagtgagctgagatcacgccatggcgctccagcctgggtgacaaagcaagactc

SEQ ID NO: 26182 - DNA, 201 bp, Homo sapiens
gtacaaaacattaaattgatttctataatcttttgacccttaggactatatctgggagtaggggtgtcagcttttgcacaaaaaaatctatatgaattggrgcacctaaaagttacccattttgaacctttcttcgggaaacaaagcagttttcacttgagccccctgtccaattaagattaattgaattgtgaggagcaa

SEQ ID NO: 26183 - DNA, 201 bp, Homo sapiens
cagttccagtggtcaccatcaggcaccacttacgcactttttttttttttttgagacggactctcactctgtcacccaggctggagtgcagtggtaccatyttggctcactgcaacctccacctcctgggttcaagcgattcttatgcctcaacctcccaagtagctgggattacaggcacatgccaccatgcatggctaa

SEQ ID NO: 26184 - DNA, 201 bp, Homo sapiens
aggagatagattaggcagatgtaagaaaaagactccaagtatgttagcataaacatgataggtgtttatgtttttcaaaagcaaaaatccgtatagttggyccagggctaatatatggtttaatagtgacagggcagtggtaacctgtcttcaagatggcccccaataattcctgcctccttctgttcatacatttgtgta

SEQ ID NO: 26185 - DNA, 201 bp, Homo sapiens
acaaagggcttttaaacatcacctaaggacattaaaaaataaaattgtgtaacctctctgtttaaaaagaataataatttaaggcagcttatgagtagacytgaaatttagcaagattgcctaaattagaagtagatgagaaaaacagaagacaacaagagtaggaacaaaagacgagctgtgaagaacctattgcaaaaa

SEQ ID NO: 26186 - DNA, 201 bp, Homo sapiens
tttgctaatcagctgatctaagagtagagagatgatcctggattatctgggtgaatccagtgtaagcagtgtcctcaaaagtagaagcgggtagaaggtcrgtccagagggagcagcatgagaaagactcaaccagacattgctggtatggacaatggaaggggccacaagtcaaggaatgtgggcagcctctagacctga

SEQ ID NO: 26187 - DNA, 201 bp, Homo sapiens
atggatccaggggtcaggagtagagcagagggaagagttgacaaggtgtggccaagtccttattcagtatggagaacacagggtgggcaggagggactctsagagggcttgtgggccaaggcttggtagctcctcaggtgagcgggagaggaaggccctgagaatggggaatggagattgttctagctttacagggattac

SEQ ID NO: 26188 - DNA, 201 bp, Homo sapiens
tttttttttttgagacggactctcactctgtcacccaggctggagtgcagtggtaccatcttggctcactgcaacctccacctcctgggttcaagcgattyttatgcctcaacctcccaagtagctgggattacaggcacatgccaccatgcatggctaattttttttttttttttttttttttttttttttttttttttt

SEQ ID NO: 26189 - DNA, 201 bp, Homo sapiens
acatttacaccatggtgcttagcttgaatccctatcccattggtaataatatgcttttagctttatagtctctctcagagcgcttgcatgaacatgatttygtttgaaactgacagtagcccttgctctgtgctttgtttttacagatgaggcaaatgtggctcagatccccagactataaaaggcctctgagctgaacta

SEQ ID NO: 26190 - DNA, 201 bp, Homo sapiens
ggaggtgggggtctaggtgtccttgcagggtgtgaggctggagggctggatggggccatgccatgagggcaggggatgccatactaaggagtgtactttcygtgctgagagtagtggggagtcttcctgggttttaggcgggagatgtggcagaatttgcatgatggggggatcccttcagccacagcatgaaggatggat

SEQ ID NO: 26191 - DNA, 201 bp, Homo sapiens
taccatcttggctcactgcaacctccacctcctgggttcaagcgattcttatgcctcaacctcccaagtagctgggattacaggcacatgccaccatgcawggctaatttttttttttttttttttttttttttttttttttttttttttagtagagacagggtttcaccatgttggccaggctggtctcaaactcctgac

SEQ ID NO: 26192 - DNA, 201 bp, Homo sapiens
aagccaccacgcctggcccagaaacacatattctataaaccaacttgaattagcagcagagatgtatatcccttagatatggtattttctttctttctttmtctttctttctttctcttttctttctttctttctttctttctttctttctttctttctttctttctttctttctttctctttctctttctttctttctct

SEQ ID NO: 26193 - DNA, 201 bp, Homo sapiens
gtgccactgcactcctgcctgggcaacagagtgggaccctgtcttgaaaaaaaaaaaaaaaagaaaaagaaaaagaagaaaagaaagacccccaaatgccrgttcagatcagaggtcaagaggtcagaggtctccaagagaaaattcttcagggctttgattttatgaatacctgacgcttctaaacaccttaagaggaat

SEQ ID NO: 26194 - DNA, 201 bp, Homo sapiens
taagaaccaagtgtgaaggccatgtgggtaacatatggtgggtaaaactaatgttaaaactaggtaggtaatacaggttgttaagcccattaggttatggmccataaggtttgcccaggtggatgaggctgatggggtctggccagggcagtaaaaagaggtggtaaggccagtgaataagggaaggagagtatggttcca

SEQ ID NO: 26195 - DNA, 201 bp, Homo sapiens
ccattctcctgcctcagcctcccgagtagctggggctacaggcgccaccgctaccacgcccggctaattttttgtatttttagtagatacggggtttcacygtgttagccaggatggtctcgatctcctgacttcatgattcacatgcctcggcctcccaaagtgctgggattacaggtgagagtcactgcacccggcctc

SEQ ID NO: 26196 - DNA, 201 bp, Homo sapiens
gtagggtaaggccaggtaagtaagctaggtgcataagaccaggggattaatactaaatgagtgaggccaggatgttaataaggtaggtgggtaaatttaarttggcaaaaccatgaggttaagggtaggtcaggtagccaagctatttaaaaagccagatggttaagaccagtaagttaaggcctccttgaatacaactag

SEQ ID NO: 26197 - DNA, 201 bp, Homo sapiens
atttacagtaattataggttttttttttttttgagacagagtttcactcttgttgcccaggctggagtgcaatggtgtgatctcagctcactgcaacctcygcctcctgggtttaagcgattctcctgcctcagcctcccaagtagctgggattacagaggtgcctgccaccatgcctggctaattttttgtatttttagt

SEQ ID NO: 26198 - DNA, 201 bp, Homo sapiens
ggcttgaggaaagtgtagttcatagaggtaagatttgtgcttaattccagagcttgggttcttaacatctgtgctatatgctctttcattaactatgaagwaatctgaaatcaaatgcaataataatacctcatccattttctaatagatttctacattaaccattgcagtgtaggttaatatgggccagatgctctctga

SEQ ID NO: 26199 - DNA, 201 bp, Homo sapiens
gttaaggcctccttgaatacaactaggtggctgagtttaagtgggtaaagctaagaggttaaacctaggcacattatgccagaaggttaaggccatgagartgacagtagaacattaaggccaggtaagaaggtcagggagttaagttggtaatcctggatggtcaggccatgaggttgaggccaggtgggcaaatccaga

SEQ ID NO: 26200 - DNA, 201 bp, Homo sapiens
ataataatacctcatccattttctaatagatttctacattaaccattgcagtgtaggttaatatgggccagatgctctctgattgcaggcgcacacattcyagaggccccacacctcatattcccacagctcctatctctcttcatgcacaaatttacttgaccctggactggatgtactatataaaggctgcttcatatt

SEQ ID NO: 26201 - DNA, 201 bp, Homo sapiens
agggcctcagtaaggggaagacagtgttcataccctcctcatgtacggagcctgggagctgtccgaaccaagtacccagggaagcatcggccctccccacrtcaaacacagagacacacagagtctgaattcttctgatatggccagtgctgacctgccagcctccaaaggtgtttcatttgcttatcaagaaatctggat

SEQ ID NO: 26202 - DNA, 201 bp, Homo sapiens
cccacatcaaacacagagacacacagagtctgaattcttctgatatggccagtgctgacctgccagcctccaaaggtgtttcatttgcttatcaagaaatmtggataaaatggcttgtgaataatgtcccagcatgctcctgacgaaccccaaaatgagattcaaaagcattaaacaggattggattgtcaataaatgata

SEQ ID NO: 26203 - DNA, 201 bp, Homo sapiens
gcggtggttcacacctgtaatcccaacattttgggaggccaaggcaggcagatcacctgaggtcaggagctcgagaccagcctggccaacatggcgaaacsccatctctactaaaaatacaaaaattagccaggcgtggtggcaggcgcctgtaatcctagctactaggaaggttgaggcaggagaatctcttgaacccgg

SEQ ID NO: 26204 - DNA, 201 bp, Homo sapiens
tccagctgcaggagtgtccacctccaattggggtgacaggagctctctgtcctgtccagaatggtgctggccctttgtctcagtctttttgtctgtaatarcaaaatacccaagactgggtaatttgtaaaaaacaaaacaacaagaacaacaaaaccaggaatttatttctcacagcctctgaagtctgggaagtccaag

SEQ ID NO: 26205 - DNA, 201 bp, Homo sapiens
ccacacacaagccataaaacctagaaaggtcactctcctccttctcccttgaagattcttattccagagggatcctgccccatacccaggagggaagaaaygctacacagacaggccaagaagaatctgaacagacaagccttgcttggtttcctcctcagtctactaccattagatcataaccttctgggtttccccctc

SEQ ID NO: 26206 - DNA, 201 bp, Homo sapiens
gcaattcattcatgaaaacttaaaaacaatttatccacagtaaatgtcaaaaatacttgatcagaggtatcatgtggatgtaatagtcccatccttctttycccctccctagttcttaatccacatcctatcaaagtttcctcatttcaaagttttataaaaatgacaacggtttggagggacctcgctttttaggaagca

SEQ ID NO: 26207 - DNA, 201 bp, Homo sapiens
gcaattcttctgcctcagcctcctgagtagctgggattacaggcatgcgccaccaaacttggctaatttttgtatttttagtagagacagggctttgccaygttgggcaggctggtctcgaactcctgacctcaggtgatccacccgccttggcctcccaaagtgctgggattacaggcatgagccactgcacccagccta

SEQ ID NO: 26208 - DNA, 201 bp, Homo sapiens
ccactgttgatgctggcttttgatcatctggctgagatagtgtttgcaggtttcttcactgtgaatacaaataattattttgtctgcctattttctcctcrgtcttacttcattttcacatttctagatagtagcaatctctgaacttgtccttttgcaataattccacatcatcccgttgtcaatgtatgatgtgtacta

SEQ ID NO: 26209 - DNA, 201 bp, Homo sapiens
ttttctcctcggtcttacttcattttcacatttctagatagtagcaatctctgaacttgtccttttgcaataattccacatcatcccgttgtcaatgtatsatgtgtactaactgcttgtcattctgctatttcagtgagagatttgttcttgcctttgtcctgtgtgtgtttttttttgtgtgtgggcatgtgtaaaagg

SEQ ID NO: 26210 - DNA, 201 bp, Homo sapiens
catttctagatagtagcaatctctgaacttgtccttttgcaataattccacatcatcccgttgtcaatgtatgatgtgtactaactgcttgtcattctgcwatttcagtgagagatttgttcttgcctttgtcctgtgtgtgtttttttttgtgtgtgggcatgtgtaaaagggagtaggtagcttgtcggtaacctttta

SEQ ID NO: 26211 - DNA, 201 bp, Homo sapiens
taccagataattaatttttgtagacaaacctactttggcaaactccttactagagtattttcttaatttcacattaagggattcacattatctaccggttwatatttctataaataaatttatttatacaaatacatttctgtttatacaattaagtttatatgaaaagattatttatacagatgaattgtcacatgtctc

SEQ ID NO: 26212 - DNA, 201 bp, Homo sapiens
ctgtttatacaattaagtttatatgaaaagattatttatacagatgaattgtcacatgtctcagtatgcactgtaattctaatctgagaagcaggattgayaaggagagtgagagagtaggaagaatttgagccaggctccctaggtgtttctctatagcagatgtattagtctgctcaggctatcagtctaagtggctta

SEQ ID NO: 26213 - DNA, 201 bp, Homo sapiens
ggcccccaacaaagctggtgttcttttctttttgtctgtagtttcttatcctcctttgggtgtctaagggtcttttacatctcttgagtttttcaatactyacctttggatgtctggccagaccatgtcctagaactgttctgtcttcccaaagtcctggacctttaatggggcagctgacaactaaatatttttcatgtt

SEQ ID NO: 26214 - DNA, 201 bp, Homo sapiens
ttaaacaacagaaattgttttaagttctggaggctggaaggccaggatgaagatattggcagggctggtttcttctgaggcctccatctttggcttgcagrtggctgccttctccttgtatcttcatgtggtctttcttctgcaaacatctgtgttctagtctcttccttttaaaaggacaccagtcatattggattaagt

SEQ ID NO: 26215 - DNA, 201 bp, Homo sapiens
cttatgatggctgtgggtgctggcccccaacaaagctggtgttcttttctttttgtctgtagtttcttatcctcctttgggtgtctaagggtcttttacayctcttgagtttttcaatacttacctttggatgtctggccagaccatgtcctagaactgttctgtcttcccaaagtcctggacctttaatggggcagctga

SEQ ID NO: 26216 - DNA, 201 bp, Homo sapiens
tctaactaattttgtgccaccctctcccttgtccatcactttccaccctttagcttctttctacttcttgagcacattaagcttatatctaccttagtccytttgcatttgttccttttgcctggaatgatcccaccatcccatcttgacctttctaactcctttttttgtcatttatgtttcttgttaaatgtcattttc

SEQ ID NO: 26217 - DNA, 201 bp, Homo sapiens
tcagcaagccagccaaataatgacaggaggctaatgctaggtaggtaagacaggtgaggagaaagcaaggaggttaaggcaagctgaacaaaactaggggktagacaccagatgggcatgaggccagcagattaagtcatgctgtctgagaccaggcatgtgaataaggttggtgagtatggccctaaggttaagcaggtc

SEQ ID NO: 26218 - DNA, 201 bp, Homo sapiens
aggaggctaatgctaggtaggtaagacaggtgaggagaaagcaaggaggttaaggcaagctgaacaaaactaggggttagacaccagatgggcatgaggcsagcagattaagtcatgctgtctgagaccaggcatgtgaataaggttggtgagtatggccctaaggttaagcaggtcaggtggggaaagcctactgggtaa

SEQ ID NO: 26219 - DNA, 201 bp, Homo sapiens
ctcaagagattagaaacaaatgcaattctctcccacctagcaatttgggatgcaagctcaaaggtgagctcctcatcccctggagaagtacaactggccamacactacttttcttggactttcacggtggaattatttacttttcatggggaagaatgctactcagagatagctttcacagaaccaagggaaagctgtctt

SEQ ID NO: 26220 - DNA, 201 bp, Homo sapiens
gatgacattcaatttgctaatcagctgatctaagagtagagagatgatcctggattatctgggtgaatccagtgtaagcagtgtcctcaaaagtagaagcrggtagaaggtcagtccagagggagcagcatgagaaagactcaaccagacattgctggtatggacaatggaaggggccacaagtcaaggaatgtgggcagc

SEQ ID NO: 26221 - DNA, 201 bp, Homo sapiens
gtcaggactaagcataatgcccctaggttaaggtgagtagggctgggagatgtgagtaagaccagaagtttggactaattgtgaaagccaaatgggtaagkctgggtagataaaatcagttcagtgattcaggttggtaaggacatgaggttaaggccagtagggtaaagccaggtgggtaagccaggttcgtaaggtcag

SEQ ID NO: 26222 - DNA, 201 bp, Homo sapiens
ttctctcccacctagcaatttgggatgcaagctcaaaggtgagctcctcatcccctggagaagtacaactggccaaacactacttttcttggactttcacrgtggaattatttacttttcatggggaagaatgctactcagagatagctttcacagaaccaagggaaagctgtcttcttttcttgaaaaagacttgcctca

SEQ ID NO: 26223 - DNA, 201 bp, Homo sapiens
agaggaatgaaggtgcagatgacattcaatttgctaatcagctgatctaagagtagagagatgatcctggattatctgggtgaatccagtgtaagcagtgwcctcaaaagtagaagcgggtagaaggtcagtccagagggagcagcatgagaaagactcaaccagacattgctggtatggacaatggaaggggccacaagt

SEQ ID NO: 26224 - DNA, 201 bp, Homo sapiens
tattcgcacactccctccccttttgaaactccctaataaaaacttgctgttttttgcggcttgtggggcatcacggaacctaccaacatgtgatgtctccyccggatgcccggctttaaaatttctctcttttgtactctgtccctttatttctcaagctggccgacacttagggaaaatagaaaagaacctacgtgaata

SEQ ID NO: 26225 - DNA, 201 bp, Homo sapiens
ggaagaatgctactcagagatagctttcacagaaccaagggaaagctgtcttcttttcttgaaaaagacttgcctcaggaaataatgggcctcattggctsctgctaattggtgaaatgttttttttttttttttttggtctgtgtagatattgtcactacttcagcatcatgagtgtggtgggtgattaatattctggat

SEQ ID NO: 26226 - DNA, 201 bp, Homo sapiens
aaatgctgttcatcatagtagtgctaattaaaaatgcacaacaataccacaagggccatgaatttatacagtgggtcttctggatgataaaatgttagtcyacccttttgtcagacagaggagggaatataaccagagagaggagacaacttgctaaggtcaaagtgatgatttatgtcggggtccagaaccaaacccagg

SEQ ID NO: 26227 - DNA, 201 bp, Homo sapiens
ataacttctaaagggggaactgttaaggtcacagtttgatggatataacaaacatgcaaacccttaagacaagctgagatttaatttgcagtgcacacacrcacacacatacacagagatgtcatcttagtgtgttggaaagcaccgttgggtaaaattatgaaatgtatcttaggaagtaaaggactgtatgattgaaga

SEQ ID NO: 26228 - DNA, 201 bp, Homo sapiens
aaaaatttgtgattcccacccaaaagggcaaaggcacctcagagcatcgtcatcatcattattttttatttttattttaaggaaatgaagtctcagacatwttgtccaggctggaatgtagcggctattcacaggcatgatcatagtgcactacagcctcaaactcctgggctcaagcaatcctcccatctcaatgtccgg

SEQ ID NO: 26229 - DNA, 201 bp, Homo sapiens
ctccctccccttttgaaactccctaataaaaacttgctgttttttgcggcttgtggggcatcacggaacctaccaacatgtgatgtctcctccggatgccyggctttaaaatttctctcttttgtactctgtccctttatttctcaagctggccgacacttagggaaaatagaaaagaacctacgtgaatatcagggcagg

SEQ ID NO: 26230 - DNA, 201 bp, Homo sapiens
aattttcttcactttccacatccataaaaagggttattaggatggttatgtttatttgtggtaaactcttaggaacatgcctggcatttaggaagcacaaytgagcagttgctactactttttttttgtctaaaacagattccattaatatactgtttttgatattacatagatctaattcatactcatatttttaatgta

SEQ ID NO: 26231 - DNA, 201 bp, Homo sapiens
gacagtgggtgccttagcaaggcagcatagacttcagtggaaaatagaagagttatactcttgaagcagcactgaggccctgaaaggggaggagagatgtrggtgagagtcagagctccagcaagaaaaggggattgagtgactattttgtttggaggttgaaggtatggggaagattagtttctcattttctattctttt

SEQ ID NO: 26232 - DNA, 201 bp, Homo sapiens
ttttactttatacatataagtaacattttttctatcatatataatttaataaaatccaatctcactgtgaacactgtactgctgaaaattcatttttactrtaaaatagaattctgtaaattgctttaagaaagcatttattggctgggtgtggtggctcacacttgtaatcccagcactttgggaggccaaggtgggtgg

SEQ ID NO: 26233 - DNA, 201 bp, Homo sapiens
gaagagcagccacactgggcacaaacccacaacctcagtgtggcctgtgcaagcctcccacttctgttcacccctcccggcttgactcttctcgcactttstaatttactgtacactttccttattctttattgcctattattccccaactgaagtataaactctgtaagggcaggaattttgccaggtaagaaaagtgca

SEQ ID NO: 26234 - DNA, 201 bp, Homo sapiens
gggtttcactatgttggccaggatagtcttgatctcttgaccttgtgatccgcccgctttggcctcccaaagtgctaggattacaggtgtgagccaccgcrcccggcccaaaatgtttagtcctcaaataaggataataactgaatggcccagtgtgacacagagaagaggacttatgatggctgtgggtgctggccccca

SEQ ID NO: 26235 - DNA, 201 bp, Homo sapiens
tgtacagcataacaaataattataaagcatatagccatgtaactgctgccctgttaaagaaatagtgtatcgttgacaccccagaagcactctgtgtgtgytctctctttatcacatccccttccctctggaattaaccactatcctgacttttggggcaattatgtccttcctttacatttattgagggtttttaaaaat

SEQ ID NO: 26236 - DNA, 201 bp, Homo sapiens
gtggcatgcactttttgaattatgtaatctgggcatattgtatacctttattttaaaaattttgtttaaaaatgccaatcacgtttattttactttatacmtataagtaacattttttctatcatatataatttaataaaatccaatctcactgtgaacactgtactgctgaaaattcatttttactataaaatagaattc

SEQ ID NO: 26237 - DNA, 201 bp, Homo sapiens
attgcctattattccccaactgaagtataaactctgtaagggcaggaattttgccaggtaagaaaagtgcagaagcaagtgccttgcagtctggatggaamaggcctgggaggggtcacggagatacaagcagtgagtcgaaaacttcttaaagggctgtctcataaataattcaggcttgaggaccctcgggtcctcatc

SEQ ID NO: 26238 - DNA, 201 bp, Homo sapiens
attatttctaggtgagtttgtgaggctgtttctgggaaggattagcactgaatcagcagattgagtgaggaagattgccctccccaatgtgggcagccatmatccagtccagtgagggcccactgggatacagcaaaatgggggagcaagggtggactccctctcacttttgagctgatatattcatctttttctcccctc

SEQ ID NO: 26239 - DNA, 201 bp, Homo sapiens
cacactgaaaacatctactaatgaggaactggagacaaagccatacatggacacattagcaatctgcacatattactggccacactgcctcagaaacgcayatgataaggttagggcccactctgaccaagtttttacccacacatacatctcagctccataaccagcatcatgattaactagtcaaaggtcaaaagcatg

SEQ ID NO: 26240 - DNA, 201 bp, Homo sapiens
cccagacaaccagtagtcaccattccaagtgaggggtggctgcaactctacagccccgttcgtctctcctcactgtcaaagctgctgagaccccagactcracacttgaaagaaacccatgtctgtgaagcacttgtggaccattcaagattgtggaagaatcactcaagagaaggagataggtgatgggatctagcttct

SEQ ID NO: 26241 - DNA, 201 bp, Homo sapiens
tgtgaggctgtttctgggaaggattagcactgaatcagcagattgagtgaggaagattgccctccccaatgtgggcagccatcatccagtccagtgagggyccactgggatacagcaaaatgggggagcaagggtggactccctctcacttttgagctgatatattcatctttttctcccctcagacattggagcagctcc

SEQ ID NO: 26242 - DNA, 201 bp, Homo sapiens
atgatggtgattatagtggtgataggttaaatcaagaataggctgggtgtggtggctcacacctgtagtcccagcactttgggaggccgagctgggtggaycacctgaggtcaggagtttgagaccagcctggcgaatatgatgaaattccatctgtactgaaaatacaaaaattagccaggtgtggtggaacgtgcctgt

SEQ ID NO: 26243 - DNA, 201 bp, Homo sapiens
tcactcaagagaaggagataggtgatgggatctagcttctgatggtttctattttattgaatgtctaatagggcaagaatttgaaaaacgagaatgtttgycatgcaggaggacctgggaaggagataacacatttacagggagaaagattgggattcagttgggaggagtaactgaggaaaggggtcactcaaaatattt

SEQ ID NO: 26244 - DNA, 201 bp, Homo sapiens
gtagtttcatctcattgctaatcaataaaattctcttcttgctaaagcatttggagtgggaattctaaagataaccctaggaacatctccttcaataaacygggggaattgatatagtcttcagggttgcctgtgcctgagataatggcaacttgattttctcaggtcacgtctcctcctgcaagaagcaaacagtgtttc

SEQ ID NO: 26245 - DNA, 201 bp, Homo sapiens
ggagaaagattgggattcagttgggaggagtaactgaggaaaggggtcactcaaaatattttgtattttaggtcctttttctattaaggaggaatggattrtcaaagccttaacattaaattgtattgtgtcaggtgaattgctatggtttgaatgtggtgtgtccccctcccaaactcacattgaatttttttttttttt

SEQ ID NO: 26246 - DNA, 201 bp, Homo sapiens
ctccattttctgagatgttagagagtaaaatggggccataggtaatagagtcatttcttctttgaagagtcattattatcactcaaagttcatagttcacrttagggttcactcttcatgttgaacattctgtgggtacaatgcattttgacatgtatctaccattactgtatcacacagaatagtttcactgccctaaaa

SEQ ID NO: 26247 - DNA, 201 bp, Homo sapiens
gtatcttaagtaatcacattgtgagcaaagcctataggcttcccccagagtgagtgatccaagagagagcagggacgaggccacaatgccacaatgccacwcatgacctaatcatttctaccatattttatttgttagaagtgagtcactaaatctggtccatgctgacaggacgaggaattgggcttcacatttaaaggg

SEQ ID NO: 26248 - DNA, 201 bp, Homo sapiens
ggaaatattcatagcaaaatttttctgcacacagatgtcccctcttctctcacccagttgcccacccctttttcgtcatacagtacaggtctcagagctcytgcccaggttaatttctggatcaaatgccagggagaaattcataggatcaggtcttcttgttacatatcctttcccaacctcatcccaaaggcctaggtg

SEQ ID NO: 26249 - DNA, 201 bp, Homo sapiens
cagggtctgaacaggagctgctactgccatggtctcctctgttctaaggattaatcttaaagctatctcggtgaggacattattgctggggaagttcacayttagcggactgagaggagataggccctcccctccagtgttacatctcctgaattagcacagaaaggatgctatatagtctcaatttttaatctccctctc

SEQ ID NO: 26250 - DNA, 201 bp, Homo sapiens
agtggagacacagctgatgctaaattagggcaagaagacaaatcagacattttcccagagttgaatagaggcaaaaatgacacagagaagagagaagccaygatgcacaagtccaggaaatccaaatctgtaaaacagggtcttccaaaatgagaaaacagggcagatgctgtgattacatccaagtggaaagttactgtt

SEQ ID NO: 26251 - DNA, 201 bp, Homo sapiens
ggacagagagttggtgaaggggatttttggaaagcgttgttggtgcattaagagtctgatccccaacaaagagcaaggactcctcccatctcaaacccaaygaaaggggcttcaagaaaaccttgggggagcgagatgggggcagaggggtctcctacagctggtcatggcagtctggggttaactttggtctgagaagtg

SEQ ID NO: 26252 - DNA, 201 bp, Homo sapiens
cctttgttgttttctctctacttttgccccctcttacttttttttttctttttatgcatttaaatttcttagaactctctttcattgtcctggctggaagyactggattcctcctttcaaatgaactaaaatattttccaagatgtcaagtcaatctgggcaaactttctcaacataaccatccctacattccaatatccc

SEQ ID NO: 26253 - DNA, 201 bp, Homo sapiens
ctttattcaagtctggaaaatctactgtagtcttgatgagccacttcccttttcatgggccacacaggacatttgtacagaaaatttattagtaccagcaytccaacttctaacatgtcagcaattaaagtggtattctctttttgtctactaggattcatccgacactgtgtcaaattaacaagctatgtgggctcaggc

SEQ ID NO: 26254 - DNA, 201 bp, Homo sapiens
gcaaaaccataaggttaacaccaggccaggaagccaagcgactgaaaaaaccaggtgggtaaagctagtaaagttatggccagcaagtacagccaggttcrtaactccaactgtgtaaggcttgtgtgggaagtcagtgacccccaaatggagggaccacctgaagccatggcagaagaatgtggattgtgaagatttcat

SEQ ID NO: 26255 - DNA, 201 bp, Homo sapiens
ggatgaagatattggcagggctggtttcttctgaggcctccatctttggcttgcagatggctgccttctccttgtatcttcatgtggtctttcttctgcamacatctgtgttctagtctcttccttttaaaaggacaccagtcatattggattaagtcctactctaatacttcatttaaacttaactgatctgcaaataca

SEQ ID NO: 26256 - DNA, 201 bp, Homo sapiens
aggccagtgaataagggaaggagagtatggttccatgggtaagatcaggtgggtcctgatggcagattgaagccagcaaattaaatccaggtggataagarcaggtgaataatcatgggaagttatggccaggtgggtaaggccaggacatttaagccaggaaatgaagcctgggtcagtaaggccaagagtttcgtaggg

SEQ ID NO: 26257 - DNA, 201 bp, Homo sapiens
ctaacatcagatgggtcttgacagcagattgaggccagcaaattaaagggctacatggatgaatcttgtttaataatgccatgaggataaggacgattaargcaataaggttaataaggtctgctgaataaggcaaggttgctaaaaccaggtgtataaatccgggtgaataaaagacatttgggtaacaccaggccagtc

SEQ ID NO: 26258 - DNA, 201 bp, Homo sapiens
cctctagcacagccccctaccaccctcaccagcctctggtaacaatccttctactctctatccccatgagttcaattgttttaatttttagctttcacaartaagtgagaacatgagaagtttttctttctctgcctggcctatttcacttaacataatgacctccagttccattcatgttgttgcaaatgaaaggatctc

SEQ ID NO: 26259 - DNA, 201 bp, Homo sapiens
aatctggggctgagcgcagtgactcatatctataatcccagcacattgggaggctgagacaggcagatcacctgaggtcaggagtttgagactagcctggycagcacggtcaatctccatctctactaaaactacaataattagccaggtatggtgtcaggctactgtaatcccagctactaaggaagcataggcaggaga

SEQ ID NO: 26260 - DNA, 201 bp, Homo sapiens
aggccatgtttggtaagactaggtggcaaaccctggcagctaattcaatttgttaaggctgtgagtttaaagcccacaagggtaagccaggtgagcaaggytaatggggtctcaccagagaggggagtaagacctgggtgtaaggacaggggagtaaggcctcatgggtaagatcaggtgggtcgtggcggcagattgagg

SEQ ID NO: 26261 - DNA, 201 bp, Homo sapiens
ataaggccatgagagtaagaatgaaaggtaaaggccgggtgggaaggccaggttggtaagctatgttggtcatcttggcttgtgaagccatgaggttaagrccaggtgggtaagtccaggtggctaatgcaagttttctaagttcaagggtgaagggtaaacctagagaataatggcaggggtattagtctaggggagtaa

SEQ ID NO: 26262 - DNA, 201 bp, Homo sapiens
caggggttaagacctggcagataaaaccagaagattaaggacagttgtgtaaaccaacgttaaggccatttgggtcatgtaaggtcagtaagaccaggtgrgaaaacatggtggctaatccaggttgttgaggccatgaggttaaggcccatagggttacgtctggtgaggaagactaattgggtcttgccagggttgtaa

SEQ ID NO: 26263 - DNA, 201 bp, Homo sapiens
atttgaaagccagcaagcacaagaaaaagtgctcaacatgcttaatcaccatgcaacacaaattgaaaccccaatgctaaccaacacacaccaaacaaaayggctaaaggctgttgtacagtgacatcacatgctggtaaccaaggaagaggagaaggctcccacgggctgtgtgctctggaaaactgctgggcatgagag

SEQ ID NO: 26264 - DNA, 201 bp, Homo sapiens
tctacccttttgggatgtgtggctgggaactatgaattgaactgacaaaagacagattaacaggagcaaaggcatacaacttttattaacagttttacackcacaagatgttcaaagacacaggggcttgtatatcatcctaacaaataacaatttgtgaaggaactagataaaggaaaagaggattaagactcctaggca

SEQ ID NO: 26265 - DNA, 201 bp, Homo sapiens
gaagtaatcaaactcctttaacagtggaagaacagatcaaggaggtacattcaggaaacaaagtattgctgttggaagcatagttgacttttcataggctkgacattgagcatgagaaacgaaccccccagagggagggcattgcccaggaggatcttgtatggcttgtagtgtctcctgggtggtagtgacacaagtgtg

SEQ ID NO: 26266 - DNA, 201 bp, Homo sapiens
aggagtttgtatttctgtgggatcagtggtgataacccctttatcattttttattgtttctatttgattcttctctcttttcttctttattagtctggccygcggtctattttgttgatcttctcaaaaagcaagctcctggattcgttgattttttttgaagggtttttcgtgtctctatctccttcagttctgctctga

SEQ ID NO: 26267 - DNA, 201 bp, Homo sapiens
gccaggcggcgtggtgtgcacctgtaatcccagctactcaggaggcggaggcaggagaatcacttgaacccaggaggcagaggttgcagtgagctgagatrgtgccactgcacttcagcctgggtgacagagtgagactctgtctttacaaaaaaaaaaaaaaagggtacaaatgtggccaggcatgatggctcagtctgt

SEQ ID NO: 26268 - DNA, 201 bp, Homo sapiens
aggagtaactgaggaaaggggtcactcaaaatattttgtattttaggtcctttttctattaaggaggaatggattatcaaagccttaacattaaattgtaytgtgtcaggtgaattgctatggtttgaatgtggtgtgtccccctcccaaactcacattgaatttttttttttttttttgagacggagtctcgctctgttg

SEQ ID NO: 26269 - DNA, 201 bp, Homo sapiens
gctttctgtctccttctgtgtctctctctacatcagcttctcggtgacacgtgcggtgcggccggcccgcggggcttgcggcgctttcggattaactcccsgggtgcccggccgcagccgttccgggacggccccgccgcctccagctcggcccaaaatgaaagcgaaatgttcgcagttactgcgcggggtccacaggcg

SEQ ID NO: 26270 - DNA, 201 bp, Homo sapiens
ccctcctctccctaagcttggggcatgtttctctggattacatattttttcattatgtaaacacaataaatcatgtcaacagcctgtgctaaccagcctcyacacctcactgtgacacttgcttctggtgaaaattgtttcttcttttgctaaagtgactgtattctatgaatacctatttcaagtataacttctaaaggg

SEQ ID NO: 26271 - DNA, 201 bp, Homo sapiens
cattgttgcaaaaaaaaccattttttaaaaataatttttctcccaaatctaacttctgaagtaggaccagttaaaatcccataatgatggataccagaaaygtgaatttttagaagcaggtgagatttgatgcacagtttttaaccacactgcatgctctgggaggaaaatcctttataccttggttaattccaatggtaa

SEQ ID NO: 26272 - DNA, 201 bp, Homo sapiens
aaaaaaaaccattttttaaaaataatttttctcccaaatctaacttctgaagtaggaccagttaaaatcccataatgatggataccagaaacgtgaatttytagaagcaggtgagatttgatgcacagtttttaaccacactgcatgctctgggaggaaaatcctttataccttggttaattccaatggtaaacaggcctc

SEQ ID NO: 26273 - DNA, 201 bp, Homo sapiens
cttctggtgaaaattgtttcttcttttgctaaagtgactgtattctatgaatacctatttcaagtataacttctaaagggggaactgttaaggtcacagtytgatggatataacaaacatgcaaacccttaagacaagctgagatttaatttgcagtgcacacacgcacacacatacacagagatgtcatcttagtgtgtt

SEQ ID NO: 26274 - DNA, 201 bp, Homo sapiens
atgatttctgccaccatatttttatcccatgtcctcgtcaccaaagcagtcaccctcgcttatataaatatttgttttatattagcatctgtgttatggtrattcagaacataacaaagcaagttcttgcctatgaataacattatagatgccccagatgataggtcattcttttatttggttcacattttggttcacaat

SEQ ID NO: 26275 - DNA, 201 bp, Homo sapiens
agtataacttctaaagggggaactgttaaggtcacagtttgatggatataacaaacatgcaaacccttaagacaagctgagatttaatttgcagtgcacasacgcacacacatacacagagatgtcatcttagtgtgttggaaagcaccgttgggtaaaattatgaaatgtatcttaggaagtaaaggactgtatgattga

SEQ ID NO: 26276 - DNA, 201 bp, Homo sapiens
gtgaggacattattgctggggaagttcacacttagcggactgagaggagataggccctcccctccagtgttacatctcctgaattagcacagaaaggatgstatatagtctcaatttttaatctccctctctctcaaggattggtataattccacttggagaaaagttggggtgcagctgagaggcatcaagcaggtgccc

SEQ ID NO: 26277 - DNA, 201 bp, Homo sapiens
ctaatgggtggcaggcactccattaggtactaagaacatgacagagaagaggaccatgtataccctcctggattgcaagtttagctgctgagacagacaaktgcccaaatgaccaggaggcatcagtaggtgagacatggtgagaagggcatgaagcttctgaggaggggcaggaagggaagcaaagcttcctagagttgg

SEQ ID NO: 26278 - DNA, 201 bp, Homo sapiens
gttcacacttagcggactgagaggagataggccctcccctccagtgttacatctcctgaattagcacagaaaggatgctatatagtctcaatttttaatcwccctctctctcaaggattggtataattccacttggagaaaagttggggtgcagctgagaggcatcaagcaggtgccccctagaaatgtctctcctcacca

SEQ ID NO: 26279 - DNA, 201 bp, Homo sapiens
gatgggcattttgctgcttcatagctccatggacattactcctgaatctagaagctcaattcccagagacagaagagcttttcctctatcaagggtaatasagtaatttcagctccctgcttgagtcttctttttcaaggtgaagagtcatgccatagggtgctgtatggtaaacacacatggtagcagtaacttaagcat

SEQ ID NO: 26280 - DNA, 201 bp, Homo sapiens
caattgcccaaatgaccaggaggcatcagtaggtgagacatggtgagaagggcatgaagcttctgaggaggggcaggaagggaagcaaagcttcctagagwtgggacacccacattaagaggagtaaagtgtcgacaatggaggagggaaatttcagacagaggtaacagcatgagccaagaagcaaggcctgaaaattca

SEQ ID NO: 26281 - DNA, 201 bp, Homo sapiens
agaggcatcaagcaggtgccccctagaaatgtctctcctcaccaagtttcaactggtttccagtatggcatcccagcatcttctctggcttctgggtatgytcctgatccccctggggaggttctctctgagaaactgggcttgacccctttctcctttgctcaggagtctgtcccagatataattcttcttcctctccca

SEQ ID NO: 26282 - DNA, 201 bp, Homo sapiens
cttcctaatgaatctgtaatgatcactgctaataatagatgtatcatatactttcatattaacagtgtttgacttaaacttacatgggcttggcatatggmacaattttatcctggtcatatgccagagaaagtaacaatgatggaattaaatctgtgcttttgcctctacagtggtgtggcactatacaatagcttccta

SEQ ID NO: 26283 - DNA, 201 bp, Homo sapiens
ccaagaagcaaggcctgaaaattcagaatacgtttgggcacaagtagtaaaatccctttctgtggtagctagaccaattctccacctccaaagacatccayctcccaatccctggaacccggtaatgagctatgtgacctgccaaagaggaatgaaggtgcagatgacattcaatttgctaatcagctgatctaagagtag

SEQ ID NO: 26284 - DNA, 201 bp, Homo sapiens
ctgcacccaaaactcagtgcacgaccctaaagtgagcagaaatttaaaatttgaagccttcttaggtggttaagaaaaagcatttcagaagtgatcactcrtgttttctctgtctccttaaattgaggatcaaagtttgggagagaaccttcagacacagtgaaaaaacctgaaagtctcttctcaaacttgtacagtgag

SEQ ID NO: 26285 - DNA, 201 bp, Homo sapiens
aagatagttagaaggcaatattaaaaagcaccagtgtgaatgaaacagatttgaaatactacaggtacccagataaggggagagagaaaggcatgcatgartgggaacacaaggcttcccaaaacttagagagctgagggaggccaagaaggatggagaaggtaggggcaagaggagggaggaaggtgtcctacatgaggg

SEQ ID NO: 26286 - DNA, 201 bp, Homo sapiens
tcgtggaggtctcggccaatgctataaggaaagaaaaagaaatgagagctttaaacattggaaaagaaaaggtaaaactgtcactttttacagttgatatrcaaaaagaaaaaaaattaatagactattagaactaagaagagaatttaacaacatcatgcaatacacatatcaacttaaaaaaaatcagccgattttctt

SEQ ID NO: 26287 - DNA, 201 bp, Homo sapiens
cttaggtggttaagaaaaagcatttcagaagtgatcactcgtgttttctctgtctccttaaattgaggatcaaagtttgggagagaaccttcagacacagwgaaaaaacctgaaagtctcttctcaaacttgtacagtgagctgttaggttggtagaaaggaaaactttggaagtgtttccaacttagcccaacaattgtg

SEQ ID NO: 26288 - DNA, 201 bp, Homo sapiens
aaagaaccccaagtaaccccttgtcgcttcagtcagatttcgctgttaagaatttaagagaaaacttctggtgtccagagctgtgtaagtttaagaattgygagtaagtgattgcggaactctattgacttaaatgagaatgatatattcaaaatagtacacattatacaaagacacagacaaaaggatatatattagtag

SEQ ID NO: 26289 - DNA, 201 bp, Homo sapiens
ttttttttttaactgttagaattttaaacttgtttttatacttttacgcaagttcataaaattgtgagaattatgtgtgatatgaaagtaaattggtgccrggcacagtggctcacgcctgtaatcccagcactttgggagtctgaggcacgcagattacaaggtcaggagttcaagaccagcctgaccaacatggtgaaa

SEQ ID NO: 26290 - DNA, 201 bp, Homo sapiens
aagcgtggtggtgcatgcctgtgatcccagctactcaggaggctgaggcaggataattgcttgaatctgggaggctgaggttgcagtgagctgagatcacrccactgcactttagcctgggcaacagagggagactctgtctcaaaaaaaaaaaaatgtaaattggctctgagtgatggtatagaagttacttacaatgaa

SEQ ID NO: 26291 - DNA, 201 bp, Homo sapiens
tctgtctcaaaaaaaaaaaaatgtaaattggctctgagtgatggtatagaagttacttacaatgaagaagattgcaaatttcaaggcataaaccacagaaygtctcttctggacattgtgagggcatttcaaaataaaatttcctttctgcttttgataagttatttctgagtagatgtaatattattataaataattgtg

SEQ ID NO: 26292 - DNA, 201 bp, Homo sapiens
gaaagagctgaccatctctgcttccttccgggcttcagtcaagagttaattcttctgagaaatgaaccagggaggctccaaacttggaaataccagacaargaaatttctccgggatacattgggaagtgaaacaaacaaacatgttatagatacacatgagcaaatctcttgtatattaacaaacaaaacaaaacatatg

SEQ ID NO: 26293 - DNA, 201 bp, Homo sapiens
tctacatattgccacctattcagataaccaggaatggtcagcccatatcacatgggcctttttcagcttgctaggccatctgtcatctgtcttgtactcartccctttcctcttaaaaagatgcttataattttgtccataattaatggacagttatcacttgagcctgtcatctcagtttataaagcatattaggttctg

SEQ ID NO: 26294 - DNA, 201 bp, Homo sapiens
tctgatcttagttatttcttgtcttctgctagcttttgaatttgtttgctctttcttctctagttcttttaattgtaatgttagggtatcgattttagatytttcgtgctttctcttgtgggcatttagtgctatgaatttccgtctacatactgctttaaatgtgtcccagagattctggtacattgtgtctttgttccc

SEQ ID NO: 26295 - DNA, 201 bp, Homo sapiens
cattgtgttctcacattttataatcctatttctgaaaaaacaatagtttgttaaccttgtagcttattccaaagaagcagctttggaggatttgcagaagyggagtcatgggagggcattttctgagctctatgggccctggtgattgtcagacactcagaggatcctttaaaagtttctaggactaggaatggaaagaga

SEQ ID NO: 26296 - DNA, 201 bp, Homo sapiens
aatataagatgaacctttctgactcccaagcccatgatgaagatatttggggctggagttgaaatacaggagactgtaccttttatgaaagaaatcttctytggtttgtgtagaactttagtgttttggacataaaaacagaaatcaaattgcacacaaatatgttcaagaatttataaggaatgttctggactcagactc

SEQ ID NO: 26297 - DNA, 201 bp, Homo sapiens
tcacaaggtggaacgagaacaagctcatgctgaggcctcctttaagagaatgtatcttattgcgaaggctctgccctcaggaccttatccatccctaatcrcctcccaagggccccacctcctaacaccatccctttagaagggtagggcttcattatgtaaatgacattcagttcacagtccatcaacaggatggattaa

SEQ ID NO: 26298 - DNA, 201 bp, Homo sapiens
tttttgtagagacagggtcttgctatgctgcttaggcttatctcaaactcctgacccgaagtggtcttcctgccttggccttcaaagtgctgggattacasgtgtgaaccactgctactggctggtctctaatcaggaaattttgaatgggtggtgcatggatgagaatcccatgaagaggtataaataactgttatgaag

SEQ ID NO: 26299 - DNA, 201 bp, Homo sapiens
atgttgcgatctccgctttctgcaacctctgcctcccagattcaagcaattctcctgcctcagcctcccgagtagctgggattacaggcatgcaccacaaygcccggctaacttttttgttgttgttgttttgttttttttgagacagagtcttgctctgtcccccaggctggagtgcagtggcgggatcttggctcactg

SEQ ID NO: 26300 - DNA, 201 bp, Homo sapiens
tgatgaataaatactttcatatcttcctcacaaaaagtctaaaagaaagctagaataaagtcaccccattttatactggaggaaactgaggcacagagggkttaagtgacttgggaatagttgtctggttactggtagaattgattctagcacccaaatcacccaactcttggtcctaaaaatgaaatagcaactacagct

SEQ ID NO: 26301 - DNA, 201 bp, Homo sapiens
caactcagtcccttatgccactcctaaacccaatccaaatctactctcagccagatcaccaggcagaatgagaaaagaaatactcattttccaagcacatscatcttcaatgagctctgaaaagacccttaaaactatttagaaaaaatcatcagtgggagttgtgtcttagaaagaaacagttcctttaaaatgacatct

SEQ ID NO: 26302 - DNA, 201 bp, Homo sapiens
gcaggcagattgcctgaggtaaggagttcaagaccagcctgggaaacatggtgaaaccccatctctactaaaaatagaaaaaattagccaggcggcgtggygtgcacctgtaatcccagctactcaggaggcggaggcaggagaatcacttgaacccaggaggcagaggttgcagtgagctgagatagtgccactgcactt

SEQ ID NO: 26303 - DNA, 201 bp, Homo sapiens
gcttgattataataaatagttaaaaatattttagccaggtgtggtggctcatgcctgtaatcccagcactttggaaggccgaggcaggtagatcacttgakgtcaggagttcgagaccagcctgtccaacatggtgaaaccctgtctctactaaaaataaaaaaaaattagccaggtgtggtggcatgtacctgtaatccc

SEQ ID NO: 26304 - DNA, 201 bp, Homo sapiens
gatcgacccaccttggcctcccaaagtgctgggattataggcgtgagccacctcatccagcctaaaaaaatctttatagtctgaatttggtctttctgctyagctatttgatgtctgtcttgtcctggaagaatgtcagcatgccagtctttctactgtggtggcccccaagcctagaacggggctggagtgtgtaggcat

SEQ ID NO: 26305 - DNA, 201 bp, Homo sapiens
ctcagcataaaccaacgaggggactgcattctgcaaccacagtggttggtttagggatggggatctgacctaggggatatgagtccatggaccggatgggsatatgagcccatgacccaggggatatgagcccatggaccagatggaactttgaggcacaccctttttcaggtagctttgaacctgagaggaagacaggtc

SEQ ID NO: 26306 - DNA, 201 bp, Homo sapiens
tctctgatagggcagcatctgagcagagaccagaggatatgaggggagtgagcaacagggctatttgtgggggaagacagtaagtgcaaaggccctgaggyaggagcgtgcctttgaaaagaaatggcaaggaatggctggaggacagcaagtgcagggaggctgggaggagacggaggaaagggcaatgagatcctagag

SEQ ID NO: 26307 - DNA, 201 bp, Homo sapiens
aataaaagagcgtaatagactctttcctagtgtttattcccctagcagtgtttcccagtgccggcttagtgtacatcggtaaaatatgaaaattctcctcyactgaccattaaaattatgaaagcacagactaaattcttattaacattttaaacaaatggagcaaaatatttgtacacttctttcctctttttttcactg

SEQ ID NO: 26308 - DNA, 201 bp, Homo sapiens
gagaagcatttttttttccatgaaaaatcgctctatttctgcaaaaatagtgggagtctatggcttctcatccagggctgtttctctccccaccccagctmagtcagtacaaaggttctggcagcatgaggcagactgaacagacctgaagtttgattgctggaagaaactgactccaggtttggcagagggtgagaaacc

SEQ ID NO: 26309 - DNA, 201 bp, Homo sapiens
attcattattggaggctgacccttataaaaaccttgtgggtactgcaaaagacagggaaaccgaggctcagagtggttcagcaacttgtgtgaggtcacayacctcatgtcaaagctgagatttaaatgtgtgtggctaggctggacatggtggctcacacctgtaatcctagcaccctgggaggctgaggtggaacacac

SEQ ID NO: 26310 - DNA, 201 bp, Homo sapiens
gggaaatttgacctctgggctctataacagatctcaaattcatagtgaaactgtggaagactcccattcattaaaaatcccattcatactgtgcatgtgargtcaagaaaccacattttgggttgtagaggcagccactcaaaatgaccctcctgaccagttgttcctgttataatgtacatttcctgtgaattccaagga

SEQ ID NO: 26311 - DNA, 201 bp, Homo sapiens
ttttagtagagatggcgtttgaccatgttgggcaggctggtcttgaactcctgacgtcaggtgatccacttgccttggcctcccaaagtgctgggattacwggcatgagccacagcgcccggcctaaccactttaaaaatatatttaagtgcccccagtatcactgctttctaaactatttcaaaaactgaagggtactat

SEQ ID NO: 26312 - DNA, 201 bp, Homo sapiens
atggcggtagctaccagctgttacccactttctatttgtcaggacccacactgagcacttgaatctcacaaccaccctatgaagggagcaccattattatytcattttccagatgaggaaaacatatattaaagggattgagtagcttccttaggggcatacatttgagatttgaacctaggcttgtttgactccaaagcg

SEQ ID NO: 26313 - DNA, 201 bp, Homo sapiens
caccagcccccatctcatcctggctctgacctgcctctttccaggggtctcttggccaagtttctcttcctgcctgcccctcaaaaccccatgctctgttytaaaaccactgacaatcctgtctaaatgactttatttgcaataaacccatttttaccccaaatgcatacattcctgtgttagtgtttaaaagctaatggt

SEQ ID NO: 26314 - DNA, 201 bp, Homo sapiens
tgtgacctcggctcactgcaacctccgcttcctgggttcaagcgattctcctgcctcagcctcccaagtagctgggattacaggcatctgccaccacaccyggctaatttttttgtatttttatagagatggggttttgtcatgttgaccaggctggtctcgaacttctgacctcaggtgatccacccacctcagcctcca

SEQ ID NO: 26315 - DNA, 201 bp, Homo sapiens
gaggccagcaaattaaagccaggtggataagtacaggtggataatggcaggaagttttgaccaggtggttaaggccaggacttttaggccaggaaattaakactgggtgagtaaggtcaggagtttaataaggccagatagataatgccaggttcataataccatgaggacaagataaggtgatgaaggcaatgagcttat

SEQ ID NO: 26316 - DNA, 201 bp, Homo sapiens
attgcatttgaggaaagagctgtgtgtcttaccatcataaaagaggtctttctggaggccaggcaactcccattctagaggaaaaaataatcagacatcastgatatgaattcatcatacaggctgaaacttttcattttttgacttacagttatgaaagaggtctctctggaatttaggcaactctcattctagagggaa

SEQ ID NO: 26317 - DNA, 201 bp, Homo sapiens
tagtctaaactctttcacccattgtcttagccctaacctgtggggaagctgggtcttttaaccggagccttggttggcaacttgagctgcaaatcctaaaygctcctctgaaacctcctgacatccatgccatttgttccatgcctaatctatcttgaactcctgggtcttcagcgtttccccagcctgaaccttcacctc

SEQ ID NO: 26318 - DNA, 201 bp, Homo sapiens
taaatagttgtcaaaagacaacttttatgtgtgcacagaaatagaatgtttccagcatcagagaactgtaagtctcattgaagagttaaggactttggatsggttaggagctggggagccagccagcttcttctctcacagccatcttagcttcaagaggtgctagatccaatgtctatacaaagagaaataggagagaag

SEQ ID NO: 26319 - DNA, 201 bp, Homo sapiens
gatctgacaggaggcggagctcaggtggtaatacttgctcacctgccactcacctactgctgtggggcccactgcccaacaggccacagaccagtaccacwccatggcctggggatcggggactcctggtttagagaattaaaaagatggaatttaacatttagctcattaagagcacatctcttaagccaaagtaaggca

SEQ ID NO: 26320 - DNA, 201 bp, Homo sapiens
ttgcatgtgtagttcacaatagggttcacactcctatgagaatctaatgctgccactgatctgacaggaggcggagctcaggtggtaatacttgctcacckgccactcacctactgctgtggggcccactgcccaacaggccacagaccagtaccactccatggcctggggatcggggactcctggtttagagaattaaaa

SEQ ID NO: 26321 - DNA, 201 bp, Homo sapiens
ccactaaaaagaagagcaagcactctgaattttagtctctgttatgccatttcctggcatttggaggaaaagcacattctacagaaaaatcacgggatggyactatctgttttgtatctgattttaacatgtgttatctcttaggtacagggtcatacacttggaaggtgtgatattgtgaaatatgtatttggtcttcct

SEQ ID NO: 26322 - DNA, 201 bp, Homo sapiens
ctccagttgacttccaaggctaggtcataaaaggcaatatggcttccacctggctctctctcaggacaactgcccttggaaccatgttgtgaggaagctcrggccacatggtgagacttcatgtggatgttccagttgacagctccagctgggccccgccgagtcagcagcaccaatcacctgattgtgaatgaatgacct

SEQ ID NO: 26323 - DNA, 201 bp, Homo sapiens
ggaggcctgagtgggcggatcacgagatcaagagatggagaccatcctggccaacatggtaaaaccctgtctctactaaaaatataaaaattagctgagcrtggtggtgtggtaaaaccccgtctctactaaaaatataaaaattagctaggcctgtagtcccagctacttgggaggctgaggcaggagaatcacttgaac

SEQ ID NO: 26324 - DNA, 201 bp, Homo sapiens
accctgtctctactaaaaatataaaaattagctgagcatggtggtgtggtaaaaccccgtctctactaaaaatataaaaattagctaggcctgtagtcccrgctacttgggaggctgaggcaggagaatcacttgaacccgggaggtggaggttgcagtgagtcgagatcgcgccactgcactccagcctggtgacagagc

SEQ ID NO: 26325 - DNA, 201 bp, Homo sapiens
ctataactttggggatgtttgaaagtgttgaccgagtcacccacctggtcttctgccatgtcacttggccctgctggtccatttgtttttggccagtgccygtttgggagccaaaccttgtcacctacctccagcccaccttgcccctggggagtcaggtgcagatgcttctccgggcccttcccactgtcctgttctgat

SEQ ID NO: 26326 - DNA, 201 bp, Homo sapiens
gcaggggctggttttgtggaagacaatttttccacagacccggggggcagggggcaaagatagtttcgggatgaaactgttccacctcgtattatcaggcrttacttagattcttataaggagcatgcagcctagatcccttgcatgtgtagttcacaatagggttcacactcctatgagaatctaatgctgccactgatc

SEQ ID NO: 26327 - DNA, 201 bp, Homo sapiens
gttctctagagaaacatatgcatttgtatgtaagatatagaaaagattcatttcaaggaattggcctgtgtgattgtggggactggcaagtctgaaatgtrcaggacaggcaggaaatgtgcaagaattgatgctaaagtcgcggcagaattccttccctctaaaacctcaatttttgctcttaaagccttcaactggtta

SEQ ID NO: 26328 - DNA, 201 bp, Homo sapiens
ctgtgtcagggaaataaggagacgtgggagtgaggccatgtgcttgtgctgggcaggactgtgcatggggcgcacctgtgaggtcgagtaggagagacgtygggtgcttctgggggtggagattagatttgcagattggggagtaggttagatgccctccctgggctctcaacgtggaaaggaggctgggagtgggcagtg

SEQ ID NO: 26329 - DNA, 201 bp, Homo sapiens
gggtgcttctgggggtggagattagatttgcagattggggagtaggttagatgccctccctgggctctcaacgtggaaaggaggctgggagtgggcagtgrggcctggggcgttagcagctggaggtgggatgacagagaagaacgagaaggccaatggagaaatggcattcccactccagctttctgcaaggttgtatca

SEQ ID NO: 26330 - DNA, 201 bp, Homo sapiens
gtcagcaaaggctcccgggagcaggcaggggccccaacctgagtgttaaaaacaagcaggcattagaccgcttccagcgggagggcacgcagggtctagcmaggggaaacagggatcagaagcgcagtcatgaagggttgagggaggtgggggtctaggtgtccttgcagggtgtgaggctggagggctggatggggccat

SEQ ID NO: 26331 - DNA, 201 bp, Homo sapiens
gattagatttgcagattggggagtaggttagatgccctccctgggctctcaacgtggaaaggaggctgggagtgggcagtggggcctggggcgttagcagytggaggtgggatgacagagaagaacgagaaggccaatggagaaatggcattcccactccagctttctgcaaggttgtatcattgaagtcgtgcatgtcag

SEQ ID NO: 26332 - DNA, 201 bp, Homo sapiens
agctggaggtgggatgacagagaagaacgagaaggccaatggagaaatggcattcccactccagctttctgcaaggttgtatcattgaagtcgtgcatgtsagccttctagatgtgtgggtagaggggtaagactggaggagcagggccgagtcaaggctgggtaggacttgggtgacaccaaatgaaattagtattaaag

SEQ ID NO: 26333 - DNA, 201 bp, Homo sapiens
gatcctcccacctcagcttcctgagtagctgggactacaggcgctgtcaccacacctggctgtgtgtgtgtgtctcgatggggggggtctctctatgttgyccaggctggtctcgaactcctggactcaaatgatcttcctgcttgggtctcccacaatgctggaattgcaggtatgagccatcacgcccagctttgaatt

SEQ ID NO: 26334 - DNA, 201 bp, Homo sapiens
atgagaaactccagggtagagcctagcaatttgtgttttagtaagccctccgggtgttttaatctatgaagtttggaaaactctgcctcagagtacatcasctctgcagatatatataaatatatatatatatataattatttttttagatcttcgggcctttgagacatcctaaactgtaaaggtttccactgttcttcc

SEQ ID NO: 26335 - DNA, 201 bp, Homo sapiens
ggaattacagatatgagccactgtgcccagccttgatgggatgtttctacaaagcagaaacataacaactttgactaaagatacactggtgcatagttatygccctccaaattttcagcataaacctttaaataattcggaaccctgaacacacccatcttgcaggaataactcagctagcagagggaaaagcaaataatt

SEQ ID NO: 26336 - DNA, 201 bp, Homo sapiens
gtcagcacctagcacatgcctggcctacatgggttcactctagatggttgttggtctgaattgatccctgcaagggctttgctttgctatccattatttaraacacctctgcaggaccacattattaccagctattacatctagagcaaagcagcaagaaatcaactatctttgggatttatgtgaaaaagactcgtggta

SEQ ID NO: 26337 - DNA, 201 bp, Homo sapiens
accttttgggcagcaggggctggttttgtggaagacaatttttccacagacccggggggcagggggcaaagatagtttcgggatgaaactgttccacctcrtattatcaggcattacttagattcttataaggagcatgcagcctagatcccttgcatgtgtagttcacaatagggttcacactcctatgagaatctaatg

SEQ ID NO: 26338 - DNA, 201 bp, Homo sapiens
tgaaacctaagatttacatgatttacagcagtggtccgcaaccttttgggcagcaggggctggttttgtggaagacaatttttccacagacccggggggcrgggggcaaagatagtttcgggatgaaactgttccacctcgtattatcaggcattacttagattcttataaggagcatgcagcctagatcccttgcatgtg

SEQ ID NO: 26339 - DNA, 201 bp, Homo sapiens
cactgtattgtgtcatttaatcttcacaataacacagttaattaggtcccaccgttttctgaatttcatcaatgaggaaatagcagcaaagaggaggtaamaaattcggtgcaggtgcttagcccaaagactaataatacatttcaaaatgtgcttacatttattgtgcacttactatgtgccaggtgcaacgctagccct

SEQ ID NO: 26340 - DNA, 201 bp, Homo sapiens
gctgaggaagggtaagacgccccatgaaccttgggctacaaaggaaactcaaaaaagaaacatcttgaaagcttcctccagttgccaggcctctacttccstcttgaaacaagaactctaatctggaaaagcaggattagagaaaatctaaaaccgtttatgtcaacaggcctgtgggatttgatcagggatactcacagt

SEQ ID NO: 26341 - DNA, 201 bp, Homo sapiens
cacacttaatatgctgagtgccatgggggacagcacatcagcgggtgttctgatgtcttgtgagaactgtgacaaatttatgttgagtaataactaggtgytggcactgtattgtgtcatttaatcttcacaataacacagttaattaggtcccaccgttttctgaatttcatcaatgaggaaatagcagcaaagaggagg

SEQ ID NO: 26342 - DNA, 201 bp, Homo sapiens
accctgccttttgccctcatacttcacaccaggcagccgcttgtgccgaccacacttaatatgctgagtgccatgggggacagcacatcagcgggtgttckgatgtcttgtgagaactgtgacaaatttatgttgagtaataactaggtgctggcactgtattgtgtcatttaatcttcacaataacacagttaattaggt

SEQ ID NO: 26343 - DNA, 201 bp, Homo sapiens
cacatgctgagccggcactgcagggacacagggcgagccgctggatgcagacctgtggccgcggcaggtgagggcggtggctgggaggctgacccaggggrccacatttttataattgtcccgaggcgcggcaggactttcccgggactctggtctcttgctttctgtctccttctgtgtctctctctacatcagcttctc

SEQ ID NO: 26344 - DNA, 201 bp, Homo sapiens
taggacttgggtgacaccaaatgaaattagtattaaagccagacttgtgatttgagctcaaattcaaacaattaaattctcttttatccattttcaaagaygaacaggctcctttgatgtgaaacagactggttgtggactcagggagaatttagaaaagaaattaattgagtttggatctcttttacaaaatgtatgatt

SEQ ID NO: 26345 - DNA, 201 bp, Homo sapiens
atctgctcacatttgtgctccctatagacggcaccctcaaggctgtcttcttgaaaatgtaggtctgtcaggcctttaaaaggcctccagacctctttttrtatctctttatcaaagaccctggctggttatctttagcatgaaaaaggtgctctcactgatagaatgaagtcttacctgcatcagctcatcaataactgc

SEQ ID NO: 26346 - DNA, 201 bp, Homo sapiens
ttttatccattttcaaagacgaacaggctcctttgatgtgaaacagactggttgtggactcagggagaatttagaaaagaaattaattgagtttggatctsttttacaaaatgtatgatttttaaaataaatcatttctactctttattcagtgtgtgcatttcctgacctttgttttcatttaagacaggacaacagttc

SEQ ID NO: 26347 - DNA, 201 bp, Homo sapiens
ataacaggaaaattcactgctcttccctctcataatacattttaatattatggaaatgtggtccttgaaaaagtggtcattgagcacttaccaggtgctayggatacaattcctctgcagcttgcattctagtggggagagacaggaaacaaatgctaaaatgtgcagggtgccaggagtggcccattccctgaaagaaaa

SEQ ID NO: 26348 - DNA, 201 bp, Homo sapiens
acttaccgagtgcttgctgcctgccaggcacaatccccacctgtgatttaatttccataactttgtggaggtgataatattgtaactcccatttaacagayaaggaaagtgaggcacagagagactcaattacacacatagaggcacatgctcaggcaacacgtggccagtgcagataacaggaaaattcactgctcttcc

SEQ ID NO: 26349 - DNA, 201 bp, Homo sapiens
tataaagggacacgttcagcacccccttgctctctctctcaccttccgccatatgatgatggggcacaaaggccatcatcagatgttggccccttgttctygaacttcccaacctccagagcagtaaaaaaataaatcactgttctttacaaatggcccagtctcagatattctgttacagcagtacaaaatgaactaagt

SEQ ID NO: 26350 - DNA, 201 bp, Homo sapiens
ctgtgatttaatttccataactttgtggaggtgataatattgtaactcccatttaacagacaaggaaagtgaggcacagagagactcaattacacacataraggcacatgctcaggcaacacgtggccagtgcagataacaggaaaattcactgctcttccctctcataatacattttaatattatggaaatgtggtcctt

SEQ ID NO: 26351 - DNA, 201 bp, Homo sapiens
cctttagatggctcactagatgccaggccgacgttgcaccaggtgcaggacacccagggagaacaggacccttggggcattgccacactaaatcagactcmaggcgttttgttcacaggtcttttctgaaacctgaaaagggatgagagctggctgactctgcaattattactcttgtagagaatccagtttaacgatagg

SEQ ID NO: 26352 - DNA, 201 bp, Homo sapiens
aaagtggtcattgagcacttaccaggtgctacggatacaattcctctgcagcttgcattctagtggggagagacaggaaacaaatgctaaaatgtgcaggrtgccaggagtggcccattccctgaaagaaaaggaaaggggagagtggttgtgtcaggagattctctctgatagggcagcatctgagcagagaccagagga

SEQ ID NO: 26353 - DNA, 201 bp, Homo sapiens
ctggcttgacactggacctttgattgatgttaactgtgactcaccctctcttgcctcctttcagtttccaaattctctctgcttgggtcaaaagtcattgyttgccagaagtttaatagtgtgtgcattgtgtgtatgtgtgtgcatgccaatatgtatgcaacccatacaatgcctggaacaccaatttagcttcatatt

SEQ ID NO: 26354 - DNA, 201 bp, Homo sapiens
attaatattgtttccagcatagaaaccgttagatacacaataagagtccttcctctcctagaataccctgggaacataccaaaaagagaagatctggtaarataacctttcgctgaatgttattcattcatttaactaatcacactgctgttccatgaatatttattgagtgtctagtaagtggcaggcactgtaccaggt

SEQ ID NO: 26355 - DNA, 201 bp, Homo sapiens
agcttcatattttaacagaccatgattccaacatcatgtcaaagtcttatatgttaaaagttctgcatccacattagaaggtactatggatcactgtgtakcccatgccaaatggtacatgagctctctttctcctctgggtcctgatattttaaacaaagaaacagtgtgccattatgggcccttgattctgtgcaaagt

SEQ ID NO: 26356 - DNA, 201 bp, Homo sapiens
ttttctctttggctatgtctggatagctgaagagaaagctggatgccatctggaggctgaatgaacctacatttattcactaaatttttctttgtggattrcatttttctttcacaggagttctatttggttctttttgaaatgtgttattttgctttttatggttttcttgtccctgcagatattttcaagcttgtcttt

SEQ ID NO: 26357 - DNA, 201 bp, Homo sapiens
cctggccttaacctccttgccttaccagcctgtttctattaaccttctggtgttactcacctggtcttaacctcatggtcttacccattgtgcttacccayctggtattatccacctggttttgatctcctggccttagcaattaggccttactcacctggcactagcttttggccataccactttgccttacttacctag

SEQ ID NO: 26358 - DNA, 201 bp, Homo sapiens
tctaattcaactcaactcttacactagctatctagagatactgtcagatcccacaggttaagggctcagtcccacaagactgtcccccacttcagaggccwgttataagactgaattgccagaacttctgatccactggctacaaattggggctcccaagaccctgcccaggggttcaattaatttgttacagtggctcac

SEQ ID NO: 26359 - DNA, 201 bp, Homo sapiens
agaagataacagatgggaaagagctatccagaattggtgtgggcgctggtaccaggcctggccatggagaggactcccccatatttaacctagggcatctrttttctgcagccttgctgcttaaaatggggtctgggaaccaaggtaccatgaggatcagcatcaactgagagcagcttgttaagacgcgaagtctcagcc

SEQ ID NO: 26360 - DNA, 201 bp, Homo sapiens
tcttgcagctgtaacagattttaaaaagaaataaatggaaagggaatgatttatcttctgtttacagcttgtgaaatggacgtctgtttttactgacctcmtcagctttcattccctctccatttcttcctggaccctcactctccattgagcacatcctcagacagactggaaatggaggtgtccaattctccctggcca

SEQ ID NO: 26361 - DNA, 201 bp, Homo sapiens
tgggaacacacatctcccagatccttcactgtaacttgaaggccttcacttaatcctggtaattgcaagaggaggaattctaatttcaaagccagacatgyactatgcaagcaaatctcgttaaccctctggttaatgaaataacttagcaaatttaaatgtggtacatcacctagtggatcttaaaagatagcagatttg

SEQ ID NO: 26362 - DNA, 201 bp, Homo sapiens
tcaatagtcactgcccgaattctgaaagcatgaagaagtatgcagagcttgattttagttttataaaaatccggttcttcaagggaggatttttgtggcayagtctcactgttgaaattcagggcctaggagaatgaacagtaagcatgacttacatggtattccaaaattcaaatattcattcataaaaatgagtgaagc

SEQ ID NO: 26363 - DNA, 201 bp, Homo sapiens
gagatgataaggcatgcaatatgaaataatcaaatcatagagaatgggacatccatcccctcaagcatttatccttggtgttacaaacaattcaattacastcttttagttatttaaaagtatatagttactattgactatagtcactctgttgtgctatgaaatattaggtcttattcattctttctaagtgtgtttttg

SEQ ID NO: 26364 - DNA, 201 bp, Homo sapiens
cccacatctgctgttttgcaactgccttcagctaaaagtaatttttatgccaaagtggcatattttgggggtaacattcatattcccttcagtttctacarcactttgaggcaggtctgattagccccattttttccttctgcaatttaatgttaatttttcatttttgtgaggacatagtaggtatatatatttatgggg

SEQ ID NO: 26365 - DNA, 201 bp, Homo sapiens
ctgaggcaggagaatcgcttgaacccgggaggtggaggttgcagtgagctgagattgcgccattgcactccagcctgggggacaagagcaaaactccatcaaaaaaaaaaaaaaaagtccaaggactttctagaagcccttttacacctgctttgataaagcttatcattagacatgctttagaattggcagtaattcaga

SEQ ID NO: 26366 - DNA, 201 bp, Homo sapiens
ggcgatgaggaaatgtatggcatataaggattgcttagtagggcttgttatgcagattcattttggtgccaagagtcaggctcctctccctggtatggtaygggggggataccttaacaaatggaaatctatgctttgcttttaggcaaaaagggggagggaagagaggtcttcccacatctgctgttttgcaactgcctt

SEQ ID NO: 26367 - DNA, 201 bp, Homo sapiens
gacagattaacaggagcaaaggcatacaacttttattaacagttttacacgcacaagatgttcaaagacacaggggcttgtatatcatcctaacaaataayaatttgtgaaggaactagataaaggaaaagaggattaagactcctaggcacagtgaattttcgggaggcgatgaggaaatgtatggcatataaggattgc

SEQ ID NO: 26368 - DNA, 201 bp, Homo sapiens
caaaagtagctacacattccatggagacccgaacattcctgcactccatcttggtccttcttgagcaggctctgagcctgagttggtttttcatgaggatrtttcaactaggaggaaccagcctcacagccagacacaatctcttgaactgttatattccccgcaaaaatataacagttaatgcctcagcccgctttgtga

SEQ ID NO: 26369 - DNA, 201 bp, Homo sapiens
aaaaacatttacatgaacatgtaacaaaccaagagctaatgtcactgtgtaaatgcaaaagtcaataagaaaaaggccaataattcaattcaaaactgggmaaaggatatgaacagacagctcagagaaaaagatacacaaattacttataaacatatgaaaaatactcagctgcactgataattgaataaatgcaaataa

SEQ ID NO: 26370 - DNA, 201 bp, Homo sapiens
gagttgtctataggaatattatagacaacttttaaagagaaatcataacccagaaaaaacatttacatgaacatgtaacaaaccaagagctaatgtcactrtgtaaatgcaaaagtcaataagaaaaaggccaataattcaattcaaaactgggcaaaggatatgaacagacagctcagagaaaaagatacacaaattact

SEQ ID NO: 26371 - DNA, 201 bp, Homo sapiens
cagatcaattatacagtgaacaggtaagaattttgtaaagtggtagaatgtcaacaatattagatatcattctacagtgagtgatagtgaaatatagttaytaattttagattaagacacacatacagtttcttccaaaactatttctttgctctctttgaaacattaagtggcaacttctcaatagcggtggaggggagt

SEQ ID NO: 26372 - DNA, 201 bp, Homo sapiens
caggcacctgccaccatgcctggctaatttttgtatttttagtagtgacagggtttcaccatgttggccaggctggtctcgaactcctgactttgtgatcyacctgccttggcttcccaaagtgctgggattacaggcgtgagccaccatacctggccccatccttgacttttaacatgtacagagcaaccaataacgagt

SEQ ID NO: 26373 - DNA, 201 bp, Homo sapiens
taatttttgtatttttagtagtgacagggtttcaccatgttggccaggctggtctcgaactcctgactttgtgatctacctgccttggcttcccaaagtgytgggattacaggcgtgagccaccatacctggccccatccttgacttttaacatgtacagagcaaccaataacgagtccttcctcaaagtaaagtgaaatg

SEQ ID NO: 26374 - DNA, 201 bp, Homo sapiens
aggagtttgagaccaggctgggcaacacggtgaacccctgtctctaccaaacaatacaaaaaaattagcccagcatggtggtaattgcctgtagtcccagmtgctctggaggctgaggtgagaggatttcttgagcccgggaggtcaagattgcaccactgccctccagcctggatgatagagtgagactctgtctcaaaa

SEQ ID NO: 26375 - DNA, 201 bp, Homo sapiens
tttgggtatatacccagtaatgggattactgggtgaaatggtagttctatttttagctcaaagtgacactcttaatcacagtgctgtaacatcatcatcakcagcagcagcagcatcctaatacatttttagcagagttttgtacacattaaatcatttaatcctcataaccttaaagagagttattattatcccatttta

SEQ ID NO: 26376 - DNA, 201 bp, Homo sapiens
gcaatggtggctacaaatcccactttctgatttgaaatgtgggattgacagcagttgaaaaataaggattaggtctataataaactgtctttattaatgarctatagtttgagtaattaacacaaattcagaataagtagtaccatttaatgagtttatgtttttaacaagtacattaattagaaaggcctcatgcacact

SEQ ID NO: 26377 - DNA, 201 bp, Homo sapiens
caccttcacccatccattcatgcttggcacccacctccctcaacccatttccaacacttttccttcaacacctgagagatgactcgagttattacaaagcrccactctattctagggctagaagccagctccctgtgagggtctagagatgagcttggacaagggtgttgaacccaacactcacccagagaaagcctacat

SEQ ID NO: 26378 - DNA, 201 bp, Homo sapiens
gggttattgagcctggagaagccttctggagtgatgtaatttttctaagtcttgacttgggtgatttgcttacatgggtgtacccatatgtaaaaattcaycaagctgtacactaagatctgtacactttactttagataagctatacctcaattttaaaaagtgttcaccaccagggcaatgtgcatctgggctgagtcc

SEQ ID NO: 26379 - DNA, 201 bp, Homo sapiens
ctacaaatcccactttctgatttgaaatgtgggattgacagcagttgaaaaataaggattaggtctataataaactgtctttattaatgagctatagtttragtaattaacacaaattcagaataagtagtaccatttaatgagtttatgtttttaacaagtacattaattagaaaggcctcatgcacacttcctgggaag

SEQ ID NO: 26380 - DNA, 201 bp, Homo sapiens
ctgctaatgaacttccacaatttctctgcagttccatcaggtaccagaggggaggatcagaggccccttcctcagggagggtgcaggtccacagtggagasgacaggaaaggctcaccttctggagcatgttgctgacggccctcagcaggttttgggagtggtgaaggcatgggaacattcctgggtctggagtggccac

SEQ ID NO: 26381 - DNA, 201 bp, Homo sapiens
aaccagccttagcatgatggcggatgggaaggggaaggtggggaggtagtcaggagaatgtaagcgttcaagagtggatttgactttccaaaacaacccaragtcatctggagccaagtcataccctggatctggcatcctcatgctcaataaatttttgatgattaaataaataagtgcttgagctgtacagtatcgttt

SEQ ID NO: 26382 - DNA, 201 bp, Homo sapiens
agttgaaaaataaggattaggtctataataaactgtctttattaatgagctatagtttgagtaattaacacaaattcagaataagtagtaccatttaatgrgtttatgtttttaacaagtacattaattagaaaggcctcatgcacacttcctgggaagctagaatagctgatcatattctgctaatgcggagggaggttc

SEQ ID NO: 26383 - DNA, 201 bp, Homo sapiens
tggagccaagtcataccctggatctggcatcctcatgctcaataaatttttgatgattaaataaataagtgcttgagctgtacagtatcgtttggtggggrtaggggtggggaggagacagaggcctctacaaaatagaggggctaaattttcttgtgtagcagctcattaactaaatgaaagacattctaagaggagctt

SEQ ID NO: 26384 - DNA, 201 bp, Homo sapiens
gtaaacttgaattttaatctgaaattaaatccttacggaattacactatcacacccatatttatttttttgttgtttttgagacagagtcttgctctgtcrccaaggctggagtgcagtggcgtgatcttggctcactgcagcctccacctcctgggttcaagcgattctcctgcctcactgtcccaagtagctgggatta

SEQ ID NO: 26385 - DNA, 201 bp, Homo sapiens
ggagccaagtcataccctggatctggcatcctcatgctcaataaatttttgatgattaaataaataagtgcttgagctgtacagtatcgtttggtggggawaggggtggggaggagacagaggcctctacaaaatagaggggctaaattttcttgtgtagcagctcattaactaaatgaaagacattctaagaggagcttc

SEQ ID NO: 26386 - DNA, 201 bp, Homo sapiens
aagtcataccctggatctggcatcctcatgctcaataaatttttgatgattaaataaataagtgcttgagctgtacagtatcgtttggtggggataggggkggggaggagacagaggcctctacaaaatagaggggctaaattttcttgtgtagcagctcattaactaaatgaaagacattctaagaggagcttcagaaat

SEQ ID NO: 26387 - DNA, 201 bp, Homo sapiens
ttgagctgtacagtatcgtttggtggggataggggtggggaggagacagaggcctctacaaaatagaggggctaaattttcttgtgtagcagctcattaamtaaatgaaagacattctaagaggagcttcagaaatgttttgagtagtgtcagcaacatcagaatgagtataaagcctctgaacataactaccttgaaagg

SEQ ID NO: 26388 - DNA, 201 bp, Homo sapiens
gtgacttctctcgtgtcttccagcaacatcccaaaggtaatgacaaccttgtgccctgacattggtttccaaatatccttcccaagtaaaatgaactaggrctccatggagaaatggctgatttcatggcagaagcaggaaaagtaaaagataaacctagaacgtcttgttgtatcagaaagtaaggatgagttcaaagaa

SEQ ID NO: 26389 - DNA, 201 bp, Homo sapiens
ttgccagaacttctgatccactggctacaaattggggctcccaagaccctgcccaggggttcaattaatttgttacagtggctcacagagctcagggcaakactttacttacatttactggtttattagttagagatataataaaggatgcagatgaacagccagatggaaagatactcagggagctatctggaatggtcc

SEQ ID NO: 26390 - DNA, 201 bp, Homo sapiens
gacatatcaacagatgctaaaaaatagtgtgtaaaagaaggatgagccaaggtggtgccattgcactccagcctggcaacagagactttgcgagaagcagyggttccaaatcagcgtccagtgaagggtatacatggaattgaggtggaggctgcagtcttagcagctatggaaggggggtctttggtctgcagtgtggct

SEQ ID NO: 26391 - DNA, 201 bp, Homo sapiens
aagaagaaaggaaagcacaggagctgaataatccagaaactggataattaaaatggactctatttgagaactacctggcaaagacctcttgctggctacartatcagaattcagagttgaacccaaaagttaaatggctactttcaatacaattacagtgcttgggcaaaaccatctttctttaaaaaaaaaaaaaagttt

SEQ ID NO: 26392 - DNA, 201 bp, Homo sapiens
aggccaggtgggtaatgcaagatgtctaaatatgggcttggggctggggctggggttggggcattcagcttgggataaagctagggaaaaagggcaggggkatgataaaagcaagggaaaaaaacctagggaggtaactccagggacttaagacctgttagataaaaccagaaggctaaggacagttgcataaaccaagtg

SEQ ID NO: 26393 - DNA, 201 bp, Homo sapiens
catttaacagacaaggaaagtgaggcacagagagactcaattacacacatagaggcacatgctcaggcaacacgtggccagtgcagataacaggaaaattyactgctcttccctctcataatacattttaatattatggaaatgtggtccttgaaaaagtggtcattgagcacttaccaggtgctacggatacaattcctc

SEQ ID NO: 26394 - DNA, 201 bp, Homo sapiens
ctaaaaatattttaaaaaattagctgggtatggtagcaggctcctgtaatcccagctactagggaggctgaggcaggagaatcgcttgaacccaggaggcrgaggttgcagtgagccgagatcaccccactgcactccagcctgggtgacagagggagactccgtctcaaaataaataaatttaattaaataaataaatag

SEQ ID NO: 26395 - DNA, 201 bp, Homo sapiens
tggaagcctgtagagcaaaaaattagattgtggtttgagtgagtggtttatgcctgtaatccgagaaatttgggaggccaagatgggaggattgcttgagyccagaagttcaagaccagcctgggcaattagcaagaccctgtctctataaaaaattaaaaattagctggatgtggtggtgtgcacctgtagtcccaacaa

SEQ ID NO: 26396 - DNA, 201 bp, Homo sapiens
tagaatctatctcaccttccagcgttggacacatagagactgatcctttatatggagaaaaaccactggacacattaatagatatttttatttttaaatttttatttatttatttatttatttatttatttttgagacggagcctcgaactttcgcccaggctggagtgcagtggcgcaatcttggctcactgcaagctcc

SEQ ID NO: 26397 - DNA, 201 bp, Homo sapiens
agaatctatctcaccttccagcgttggacacatagagactgatcctttatatggagaaaaaccactggacacattaatagatatttttatttttaaatttttatttatttatttatttatttatttatttttgagacggagcctcgaactttcgcccaggctggagtgcagtggcgcaatcttggctcactgcaagctcca

SEQ ID NO: 26398 - DNA, 201 bp, Homo sapiens
gaatctatctcaccttccagcgttggacacatagagactgatcctttatatggagaaaaaccactggacacattaatagatatttttatttttaaatttttatttatttatttatttatttatttatttttgagacggagcctcgaactttcgcccaggctggagtgcagtggcgcaatcttggctcactgcaagctccac

SEQ ID NO: 26399 - DNA, 201 bp, Homo sapiens
tttcacagaaccaagggaaagctgtcttcttttcttgaaaaagacttgcctcaggaaataatgggcctcattggctgctgctaattggtgaaatgtttttkttttttttttttggtctgtgtagatattgtcactacttcagcatcatgagtgtggtgggtgattaatattctggatatattttacattatttgatccata

SEQ ID NO: 26400 - DNA, 201 bp, Homo sapiens
aatctatctcaccttccagcgttggacacatagagactgatcctttatatggagaaaaaccactggacacattaatagatatttttatttttaaatttttatttatttatttatttatttatttatttttgagacggagcctcgaactttcgcccaggctggagtgcagtggcgcaatcttggctcactgcaagctccacc

SEQ ID NO: 26401 - DNA, 201 bp, Homo sapiens
cataaattgtaaagatttcatggacacttatcacttccccaatcaatacccttgtgatttcctatgcctgtctttactttaatctcttaatcctgtcagcygaggaggatgtacattgcctcaggaccctgtaataattgcattaactgcacaaattgtacagcatgtgtgtttgagcaatatgaaatgtgggcaccttga

SEQ ID NO: 26402 - DNA, 201 bp, Homo sapiens
aagatctgtaggcttgaggcccccttggctcagactcatgcattcctcagttcttcaggttacccctctgtccatagctaggtctgatgtccatcagaatycttcagcttcagctgtagatgcagctctccttgagccactgctgctgccttaggtccctctgtggctgaccacagaacctgactgcagttgcagtcttgc

SEQ ID NO: 26403 - DNA, 201 bp, Homo sapiens
tgcatttcccttgtttaatgttggtgctgggaagccctcttgcaaccactcctttaatatcctcctttctcctgggagaagctggagagagctacaggtcmtgaggtcctcctctgggagaagggagatggagagaaacaccagatacacctccatctcctgcagctgttttgagtttgatttcttattctatttgaagga

SEQ ID NO: 26404 - DNA, 201 bp, Homo sapiens
aattgctgaagctgggtgatgctacatggggtttaattaaactgtcctgatgacttttgtgtatatttaacatttttccataatgaaaagttgaaaaagccacacacacacacttttttttttttcatgttgcggcgttcagaaaactgaactgttgagtctccagagagcacaagttgaatacccacaaggcagtatcca

SEQ ID NO: 26405 - DNA, 201 bp, Homo sapiens
ggggtggatctgcactctgcctgatggcctagctactttgccagaccctgcctgcttggtcttcaccaggttgctcctgctgtgtatgattacagccttgrcatgggactgcatttcccttgtttaatgttggtgctgggaagccctcttgcaaccactcctttaatatcctcctttctcctgggagaagctggagagagc

SEQ ID NO: 26406 - DNA, 201 bp, Homo sapiens
ctgttttgagtttgatttcttattctatttgaaggaaattttttagaataacagatacatgtataataaacacattttcgaacgtaaagagggaaagtagsaatgggatggaagtgagaccactgaaattcactggctccatgtgggagctcagggccatagtgtcatcatctacaaatggcactgaagtttctcctgcca

SEQ ID NO: 26407 - DNA, 201 bp, Homo sapiens
attgctgaagctgggtgatgctacatggggtttaattaaactgtcctgatgacttttgtgtatatttaacatttttccataatgaaaagttgaaaaagccacacacacacacttttttttttttcatgttgcggcgttcagaaaactgaactgttgagtctccagagagcacaagttgaatacccacaaggcagtatccat

SEQ ID NO: 26408 - DNA, 201 bp, Homo sapiens
cagcagaagtctgcatcttagctgtcttaatgtgaatgtggggtcttgtgacagggtctcttctgtatcctgggggtggatctgcactctgcctgatggcytagctactttgccagaccctgcctgcttggtcttcaccaggttgctcctgctgtgtatgattacagccttggcatgggactgcatttcccttgtttaatg

SEQ ID NO: 26409 - DNA, 201 bp, Homo sapiens
cccgggttcaggccattatcctgcttcagcctcccgagtacctggaactacaggcacccgccaccatgcccggctaattttttgtatttttagtagagacrgggtttcaccgtgttagccaggatggtctcgatctcctgacctcgtgattcacccgccttggcctcccaaagtgctgggattacaggtgtgagccaccgt

SEQ ID NO: 26410 - DNA, 201 bp, Homo sapiens
aaaaaatgctccactaacatcagaaaaatgccaattaaaaaacacaatgagatatcatctcacatcagtcagaatggctattatgaaaaggtaaaaaaatwacagatgttggtgagaatatggtgaaaagggaacacttatacactgttggtgggaatgtaagttcgtttagcccctgtggaaaacagtatggagatttct

SEQ ID NO: 26411 - DNA, 201 bp, Homo sapiens
gacctcgtgattcacccgccttggcctcccaaagtgctgggattacaggtgtgagccaccgtgccaggccaaatttaatttttgataatggccatgtttarcaactagctcacagaattcttaaaaatttcacaattgactcttgtgagccagtaacaagccagccccagcacatgactcctttctccttttaatgaatta

SEQ ID NO: 26412 - DNA, 201 bp, Homo sapiens
aaaaataaaaaaaaaattagccaggtgtggtggcatgcacctgtagtctcagctacttgggaggcgagataggacgacacttgagccggggaggtcgaggstgcagcgagctgtgatcgtatcactgcctgggccacaaagtgaaactctgtttcagaaaacaacaaacaaaaaccagttctccaccatgccaaataaaac

SEQ ID NO: 26413 - DNA, 201 bp, Homo sapiens
tggataagtgtttagcctttctgatgatctcccactttaaaatgtacctgggataaggccgggcatggtggctgacgcctgtaatcccagaacttcgggasgctgaggtgggcagatcacgaggtcaggagatggagaccatcctgaccaacatggtgaaaccccgtctctactaaaaatataaaaattagctgggcatgg

SEQ ID NO: 26414 - DNA, 201 bp, Homo sapiens
gtatttgcaaacctggaacctctctgaaccctgtccttttggttttatagaagctttaatttgtaggcatgattgattacatcactggccgttagtgatcractccattttcagccctcctccctatctgctggttatggggtggagctgaaaatcctaactttccaatccagccttggtttttactgtgacccactccta

SEQ ID NO: 26415 - DNA, 201 bp, Homo sapiens
gtggaagtctcacctcaggggtggctattcctagcatcttgctagatttttaaaggtactcagtaatacattacagctgaagagtgaagcatgtttttttkttgttgttgttttccaagacagagtcttgctctgtcacccaggctgcagtgtaatggcaccatctcagctcaccgcaacctgcgcctcccaggttcaagt

SEQ ID NO: 26416 - DNA, 201 bp, Homo sapiens
aaaaaattttttattttagacatggagtctcactattttgcccaggctggtgtcaaactcctgggcccaaggaatttacttgttttggcctcctaaatccycttggattataggtatgagccactgtgcccagtctaagtagaattttaaaaatctccttttctaaagaaaattgaatttgttgatagtaaagttttaaaa

SEQ ID NO: 26417 - DNA, 201 bp, Homo sapiens
ttgcacagtctttttagagttgactttgtatcattttgtgtgtaaatattgtcaaaaataaatataaaaattttacaatcatggaagtctatttactcccmtacatgcttttgcacaagttgctacatgtaacacatataaacccatataattataataaatgttacaatttttgctttaagtattacgtgtattttaaag

SEQ ID NO: 26418 - DNA, 201 bp, Homo sapiens
gaactatcactgtgaatgaacattacactctaacagtggtatgttatatgaaatggtaccatttagtccttaaaattgattggaaaacagtgattggggarcatttaaatatattttaaaagtgagagaagtaacaattaatgctatactttttttaataaggagagtatattttcattgtaagtatctattaatgattga

SEQ ID NO: 26419 - DNA, 201 bp, Homo sapiens
cctgaataatttttgtacttttagtagagacggggttttgacatgttgtccaggctggtctcgaattcccgacctcaggtgatctgcccgcctcagcctcytaaagtgctgggattacaggcttgagccaccacgcctggccctcttgcttcttttaggatggctttcatttttgtaatgtttatatctttattttctttt

SEQ ID NO: 26420 - DNA, 201 bp, Homo sapiens
tgctgggattacaggcttgagccaccacgcctggccctcttgcttcttttaggatggctttcatttttgtaatgtttatatctttattttctttttattgkcccaagactctgccatctcactcttcaacgattttgtcatcttatctgatcttatttgatctcttgaatttattctttgagttttatttcttccagagtt

SEQ ID NO: 26421 - DNA, 201 bp, Homo sapiens
catttttgtaacatgaaagacctgggtttggcctgtgggttttaacttctttggagccatggtccccttcagaatgtctggaagctgggactactctcccygaatatgtacatgtgcatatatacccccagtccacagccctggaatagatggtctttatgagccattccagccctgacctaattgaaagttctcatgctt

SEQ ID NO: 26422 - DNA, 201 bp, Homo sapiens
aggctatgccctttcagtaccccctcttccctggctctgtttctaatctaggaataaacaagaaagtccttagtctttgaaaagaaaatgattccaaaatmcaaaaaaaaaaaaaaaaaaaaaaaagttaaaaagttaaacatcacgtttgtttggcttaaaataattatacatggcttgtaatgagggaaatccaaaatt

SEQ ID NO: 26423 - DNA, 201 bp, Homo sapiens
agattgtatttgcatgaagggcatgtagttagcctacaggtatgatgctagtgcttatttaattttctgaaatcttttagaagaaggctgcttgtgccacrtggggtacctgtgttcttttggctgtggagtttgcgcaggaagaggtttggagatccaggagcctgaagtcagatgacaggtgccttgacctctgtggca

SEQ ID NO: 26424 - DNA, 201 bp, Homo sapiens
ggtagattctagtattaccttcctttttcagaagaggagaccaatggggagcattggaatgatttggttgcaagcatactacactacttgtaaactgcagrcacaggcttaaaaaaagtgaaaaactaaccatgcaataaagaatggaatgaaccatgaagctgtttctgtggccagtcatgtttttgaagcatatcccat

SEQ ID NO: 26425 - DNA, 201 bp, Homo sapiens
cacccctctctccctaattgagtcatagaaaccagaactcctgttctccaaagctgaccatagcaactagaacccctctctccaaaatcaagccatacaayctaaaaggtgtatacttgaagcctgcagctcagccatttgcctctggctgcaaaggccccaagtggggtggcttttgttctaattccagcctctgccaga

SEQ ID NO: 26426 - DNA, 201 bp, Homo sapiens
tgtagccattttataagtctctcttcccctaccctccagccatataagttgattcatatagtatttgtttttctgtgtttggtttatttaactaagcatartgttttcaaggtccctccatgttgtagcatatgtcaacatttcattcctctttatagctgaataatagtccattgtatgtatgtaccatatagctgaatg

SEQ ID NO: 26427 - DNA, 201 bp, Homo sapiens
cttccctctcataatacattttaatattatggaaatgtggtccttgaaaaagtggtcattgagcacttaccaggtgctacggatacaattcctctgcagcwtgcattctagtggggagagacaggaaacaaatgctaaaatgtgcagggtgccaggagtggcccattccctgaaagaaaaggaaaggggagagtggttgtg

SEQ ID NO: 26428 - DNA, 201 bp, Homo sapiens
ttactactaggcagactatgtcaggagggtaaggccatgtgagttagaatcaaaggttaaggccaggtgggaatgccaggttggtaagctatgttggtcawccaggttgggaaggtcatgaggttaaggccaggtgggtaatgcaagatgtctaaatatgggcttggggctggggctggggttggggcattcagcttggga

SEQ ID NO: 26429 - DNA, 201 bp, Homo sapiens
taataccaagagtgaagagctttaaaaacaagatgtatgtaaggctgggcgcagtggctcacgcctgtagtttcagcaatctgggaggctgaggcgggcgratcacctgagctcacgagtttgagatgagcctgctcaacattgtgaaaccccatctctactaaaaatagaaaaattagctgggcgtggtggggggtgcct

SEQ ID NO: 26430 - DNA, 201 bp, Homo sapiens
ctccccggatatgttttggctgtgtccccacccaaatctcatcttgaattgtagctctcataattcccatgtgttgtaggagggacctggtgggagataaytgaatcatgggggcggtttcccctatgctgctcttgtggtagtgaataactctcacaagatctgatgatcttataaggggaaattcctttcgcttggctc

SEQ ID NO: 26431 - DNA, 201 bp, Homo sapiens
gtaggattactttgaaaaagttctatgaaaaaccatcgttttagctatagctctttgcatatttttccatttgttttagttatgtcagcagtagccaccatttttttttttgagatggagttttgctcttgttgcccaggctggagtgcaatggcacaatctcagcccaccgcaacctccacctcctgggttcaagtgatt

SEQ ID NO: 26432 - DNA, 201 bp, Homo sapiens
tattactgggtatggaaagtgcaattgggagcaagtgtctattcgtgtcaggaccattttatagtcttccaaggtgaccagcactgaatggcatcatatarcttatctctaagctctgcatcagggactttccctgcaggaaacctgccctataatcatccgcagtctctgtctttcctgctggcagacaggacagctctt

SEQ ID NO: 26433 - DNA, 201 bp, Homo sapiens
cccttttaaagtcacctgaaaccaggtgtcagtgcctgcctgcctgccttccctccttctttcctttctttctttctttctttccttcttctttctttctytctctctctccttccttccttccatccttccttcctttctctctttcttctctttctcactttcttctctttctttctttcttctttgtttctttgtttg

SEQ ID NO: 26434 - DNA, 201 bp, Homo sapiens
tctctcgcttgcttgcttgctttccttccttccttccttccttccttccttccttccttccttccttctttccttctttctttctttctttctttctttcyttctttctttctttctttctttctttctttctttctttctttctttctttctttctttctttctttctttctttctttctttctttctttctttctttct

SEQ ID NO: 26435 - DNA, 201 bp, Homo sapiens
ttctctgatccttttaggtagattctagtattaccttcctttttcagaagaggagaccaatggggagcattggaatgatttggttgcaagcatactacacwacttgtaaactgcagacacaggcttaaaaaaagtgaaaaactaaccatgcaataaagaatggaatgaaccatgaagctgtttctgtggccagtcatgttt

SEQ ID NO: 26436 - DNA, 201 bp, Homo sapiens
ttgcttgcttgctttccttccttccttccttccttccttccttccttccttccttccttctttccttctttctttctttctttctttctttctttctttcyttctttctttctttctttctttctttctttctttctttctttctttctttctttctttctttctttctttctttctttctttctttctttctttcttttc

SEQ ID NO: 26437 - DNA, 201 bp, Homo sapiens
tttcaaaatgtgcttacatttattgtgcacttactatgtgccaggtgcaacgctagccctttgcacgagttgttccattttaccctttctctgatcctttkaggtagattctagtattaccttcctttttcagaagaggagaccaatggggagcattggaatgatttggttgcaagcatactacactacttgtaaactgca

SEQ ID NO: 26438 - DNA, 201 bp, Homo sapiens
tttcaccacattggccaggctggtcttgaactcctgacctcgtgatccacctgcctcagcctcccaaagtgttgggattacaagtgtgagccaccacgccyggccctagtgcctttcttacttccaaacacatgtttctgaactgcataaggagcctggaaggctgatggcagccaaggctaagtgccattgtgagcactg

SEQ ID NO: 26439 - DNA, 201 bp, Homo sapiens
attgtgtcatttaatcttcacaataacacagttaattaggtcccaccgttttctgaatttcatcaatgaggaaatagcagcaaagaggaggtaacaaattyggtgcaggtgcttagcccaaagactaataatacatttcaaaatgtgcttacatttattgtgcacttactatgtgccaggtgcaacgctagccctttgcac

SEQ ID NO: 26440 - DNA, 201 bp, Homo sapiens
gaggaggaggctgcagtgagctgagatcttgccactgtattccagcctgggtgacagagtgagactctgtctcaaaaaaaaaaaaaaaaaaaaaaaaaaaraaaaagaaaaagaaaaaacaaaaattgggttcattttgggttttgttgcacaaatatacatatttaagcacctgttaggtgcaaggcattatggcctgag

SEQ ID NO: 26441 - DNA, 201 bp, Homo sapiens
ctttctttctctttctctttctttctttctctctctctttctttctcttttctctctctctcctttttttttttttgacagcattttgctgtaatgcccakgctggagtgcaatggcatgatcttcactcactgcaacctctgcctcctgggttcaagcaattctcctgtctcagcctcccgagtagttgggactacaagt

SEQ ID NO: 26442 - DNA, 201 bp, Homo sapiens
ctttctttctttctctctctctttctttctcttttctctctctctcctttttttttttttgacagcattttgctgtaatgcccaggctggagtgcaatggsatgatcttcactcactgcaacctctgcctcctgggttcaagcaattctcctgtctcagcctcccgagtagttgggactacaagtgcgtgccaccacgccc

SEQ ID NO: 26443 - DNA, 201 bp, Homo sapiens
tctttctctctctctttctttctcttttctctctctctcctttttttttttttgacagcattttgctgtaatgcccaggctggagtgcaatggcatgatcwtcactcactgcaacctctgcctcctgggttcaagcaattctcctgtctcagcctcccgagtagttgggactacaagtgcgtgccaccacgcccggctaat

SEQ ID NO: 26444 - DNA, 201 bp, Homo sapiens
cctcacctgtaaaattgagatgcctcatctctctcagagggctgcagaggaacagatgagatgctgctgcttctgatattggacatgaactaactaagcawtgatgtgcagcaatgagctgccttggactgtgccagggactgctgctgggaatggctcaggagcgtctttttgcagctctaagggaggattctttctagg

SEQ ID NO: 26445 - DNA, 201 bp, Homo sapiens
aagagtgagccaccgtgccgggccagatatggtattttcaatgtttcaaaatagtgcattgtgttctcacattttataatcctatttctgaaaaaacaatwgtttgttaaccttgtagcttattccaaagaagcagctttggaggatttgcagaagtggagtcatgggagggcattttctgagctctatgggccctggtga

SEQ ID NO: 26446 - DNA, 201 bp, Homo sapiens
tcatttgagtcatgtatggtcagtaagaccaggtgggaaaacatggtagctaatccaggttgttgaggccatgaggttaaggcccatagggttaggtctaytgaggaagactaatgggttccagctagggtggtaaaatacgggaggcaaggacacggagtcaaggcaggggactaatcacgggcaagatcaggtgggtca

SEQ ID NO: 26447 - DNA, 201 bp, Homo sapiens
gtgtcaggaatgatagtagtgaacaagacaggcacagtccctgcccttggggaatttgctttctagttgagggagacatcagcaatacattaatcagatayattgtggataacagtgttataaaggaaataaggcaggttaatgcaatggaaatggtttggggtctagagggccccctgatctgaatggcaggacagatcc

SEQ ID NO: 26448 - DNA, 201 bp, Homo sapiens
aggataaggccagagagcaagggcaggggagcatggcaggagcttcataaagctgatgggtaaatcttagctgataaaatcagctgggtcttgatgggagmttgaggacagcaaattacaaccaggtgagtaagaacaagtggacaatggcaggaagttaaggccagtcaggtaaggtcaggattgttaggcaaagtcatg

SEQ ID NO: 26449 - DNA, 201 bp, Homo sapiens
attaataggagaaacgtgcaggagaattaaggccaagtcagcaagccagccaaataatgacaggaggctaatgctaggtaggtaagacaggtgaggagaargcaaggaggttaaggcaagctgaacaaaactaggggttagacaccagatgggcatgaggccagcagattaagtcatgctgtctgagaccaggcatgtgaa

SEQ ID NO: 26450 - DNA, 201 bp, Homo sapiens
caccaaatctggctctctagcctctggagagtctgtgagttatccaatggatttttttttaattgtttaaaaacaagagcaagactctgtccccccccccmcccaaaaaaaggtaaagaaatgtagactcagattcagtaggtctggttgggcatgaggctctgcatttcttttttttttctttttctttttttgtgtgtg

SEQ ID NO: 26451 - DNA, 201 bp, Homo sapiens
gccactgcactctgcctgggtgacagagtgagaccctgtctcaaaaaaataaaaataaaaacaaataaatgtgtgtggctgattctcatgcaaatattggwgaagatctggtagtgatgtaaattggtagaacctcagtgggagataactttgcaatagctatcaaatgaaaactgtgtatattctttgtttcaggaattt

SEQ ID NO: 26452 - DNA, 201 bp, Homo sapiens
agtcttgctctgttgcccaggctggagtgcaatggcgcgatctcagctcactgcaacctctgcctcccgtgttcaagcgattctcctccctcagcctcccragtagctgggattacaggcacctgccaccatgcctggctaatttttgtatttttagtagtgacagggtttcaccatgttggccaggctggtctcgaactc

SEQ ID NO: 26453 - DNA, 201 bp, Homo sapiens
ttcttccttctggtgggtttgtggtctcgcggactcaggagtgaagtttcagatcttcgtggtgagtgttaacagcacataaaggcagtgaggacccaaaraaaaagcagcagcaagatttagcgcaaagagtgaaagaacaacgctcccacaacaagcaaggggacgagttgccactcttgcttctggcagcctgctttt

SEQ ID NO: 26454 - DNA, 201 bp, Homo sapiens
ccgagtagctggggctacaggcgccaccgctaccacgcccggctaattttttgtatttttagtagatacggggtttcaccgtgttagccaggatggtctcsatctcctgacttcatgattcacatgcctcggcctcccaaagtgctgggattacaggtgagagtcactgcacccggcctccatataccagtgatagcagtg

SEQ ID NO: 26455 - DNA, 201 bp, Homo sapiens
atggcacaatctcagcccaccgcaacctccacctcctgggttcaagtgattctcctgcctcagtctcccaagtagctgggattacaggcatgtgccaccaygcctggctagttttgtatttttagtagagatggggtttctccatgttggtcaggctggtctcgaactcccgatttcaggtgatctgcctgcctcggcctc

SEQ ID NO: 26456 - DNA, 201 bp, Homo sapiens
ctaacacagagaaaatgctatggaaatagttgttctattattttaaaatttgtatttttttattgttgtttttaaaacattttccaaatatttcatgtgtrtatatatatgtgtgtgtgtgtgtgtgtgtgtgtgtgtgtgtatatatatatatatttatgtattaagacagggtcttgctctgttgctcaggctggagtg

SEQ ID NO: 26457 - DNA, 201 bp, Homo sapiens
atttattctatgtaatttttatcaaagtttataacgttgttattttaatcaagtaatgattagaaattataataataactcaatatagaataattttattwcttataactttatggtcacagaaaatgttaaaaaatttaggttgatatttatattcatattctggtgcaacaaagtttgatagaatgatcaataaaacat

SEQ ID NO: 26458 - DNA, 201 bp, Homo sapiens
gaaaatgctatggaaatagttgttctattattttaaaatttgtatttttttattgttgtttttaaaacattttccaaatatttcatgtgtgtatatatatrtgtgtgtgtgtgtgtgtgtgtgtgtgtgtgtatatatatatatatttatgtattaagacagggtcttgctctgttgctcaggctggagtgcagtggcatg

SEQ ID NO: 26459 - DNA, 201 bp, Homo sapiens
ttttaaaatttgtatttttttattgttgtttttaaaacattttccaaatatttcatgtgtgtatatatatgtgtgtgtgtgtgtgtgtgtgtgtgtgtgtrtatatatatatatatttatgtattaagacagggtcttgctctgttgctcaggctggagtgcagtggcatgatcatgactcactgtagcctccatctctca

SEQ ID NO: 26460 - DNA, 201 bp, Homo sapiens
tttttattgttgtttttaaaacattttccaaatatttcatgtgtgtatatatatgtgtgtgtgtgtgtgtgtgtgtgtgtgtgtgtatatatatatatatwtatgtattaagacagggtcttgctctgttgctcaggctggagtgcagtggcatgatcatgactcactgtagcctccatctctcaggttcaagtaatcctc

SEQ ID NO: 26461 - DNA, 201 bp, Homo sapiens
aaataaaaatcacatctgcttgcttttccttattcttaggaaacttctgagatcataaaagataatgaaataatgtgaaaaggtctaaattacttcctggrggcaaattgaacacctctgggaagtttcaataactttttcaggccaacaggatactggttagttcctcaaagagtataaatgaaaggtattcttattact

SEQ ID NO: 26462 - DNA, 201 bp, Homo sapiens
gcccaccttggcctcccaaagtgctgggattacaggtgtgagctactgtgcccagccaaaatgtgtttttttaatatttaattttgtggccaggagtctcwcgcctgttatcccagcactttgggaggccgaggcgagtggatcacgaggtcaagagatcgagaccatcctggccaacatggtgaaaacctgtctctacta

SEQ ID NO: 26463 - DNA, 201 bp, Homo sapiens
ttgagaccagcctggacaacatggggaaatctcgtctctactaaaaatacaaaaaaaattagcccagtgtggtggtgcatgcctgtagtcccagctactcrggaggctgaggcaggagaacgcttgaacctgggaggtggaggttgcagtgagccaggattgcaccactgcactctagcctgggtgacacagcgagacttt

SEQ ID NO: 26464 - DNA, 201 bp, Homo sapiens
tacagatgcacaccaccacaccatgcttatttttgaatcttgtttctttttgaatcttgtttctttttgaaacagggtctcattatgtttcccaggctggkcttgaactcctgggcttaagtaatccacccgacttggcctcctaaagtgctgggattacaggtgtgagctatcacatgcagcagcaaatatttagacctg

SEQ ID NO: 26465 - DNA, 201 bp, Homo sapiens
gatcggagtcagagagaaagctgggagtcaggtgccaatgtcttcaataaaggggcaggggtgtggggggtagaaatcaaaaaggacagtgggtgccttakcaaggcagcatagacttcagtggaaaatagaagagttatactcttgaagcagcactgaggccctgaaaggggaggagagatgtgggtgagagtcagagct

SEQ ID NO: 26466 - DNA, 201 bp, Homo sapiens
cagtgaggacccaaaaaaaaagcagcagcaagatttagcgcaaagagtgaaagaacaacgctcccacaacaagcaaggggacgagttgccactcttgcttytggcagcctgcttttattcttatctggccccacccacatcctgctgattggtccattttacagagagccaattggtctgttttacagagagctgattggt

SEQ ID NO: 26467 - DNA, 201 bp, Homo sapiens
gatctttttccactaatagtcaaggaccacattatatcaaatttaagaattgtagttcccagaatgagccaggtcagccttatcctgaggctgtagtcctytgaggttctagcttactatgggcatatttgtgtgtctcctgttagatccttcatcttgtgcaggtcttgggattgataaatattccttttgccccacaag

SEQ ID NO: 26468 - DNA, 201 bp, Homo sapiens
agactttttttattatactttaagttttagggtacatgtgcacagatttttaaagaaaattccaacttataatgattaaaaattacatagctgattatatrtacatgtgtagctaaatctattttttacatgaattttgcttcaataaaataatttgttaagcataccactgaatgtgactcataggtcagaaaatgattt

SEQ ID NO: 26469 - DNA, 201 bp, Homo sapiens
ggcctcctaaagtgctgggattacaggtgtgagctatcacatgcagcagcaaatatttagacctgaggttccttcagtttccagatatgaagcctgcagawaagagtgctgaatgaggccaggtgaggtggctcacgcctgtaatcccagcactttgggacgcccaggcaggtggatcacctgaggtcaggagttcaagac

SEQ ID NO: 26470 - DNA, 201 bp, Homo sapiens
tgtggagaggttatgtagcttgctcgaggtcacacagcaagaaaatgacaagaggtggtatttgaaaccaggtttatctgacttcaagaccttctctttamgctttagcaacactctttcctatgaacagattctaaaccttaaaaactagaagctgctcatgcctgtaatcccagcactttgggaggctgaggtgggagg

SEQ ID NO: 26471 - DNA, 201 bp, Homo sapiens
tttcaagtggtgcccattcggtcacagactctcagccttcatacccacagtcaccatcttttcagggactctagagaatgtggtttgggatgcaggaggartcagaagatctcgtatacactttggccactgggaaatgtctgcttctgtactggactggttcaaaggaagaacacttaacattgtgtttggctgcaagta

SEQ ID NO: 26472 - DNA, 201 bp, Homo sapiens
gtgtagctaaatctattttttacatgaattttgcttcaataaaataatttgttaagcataccactgaatgtgactcataggtcagaaaatgatttgtcctyagactttatgtactaatttttagttctgaaaaatgtagtcatcatatgtaaaagaaaaaatatattagcttttgaattagactgtccttaaggtagactg

SEQ ID NO: 26473 - DNA, 201 bp, Homo sapiens
gaaaccccgtctctactaaaagtacaaaaattagctgggcatggtggcatgtgcctgtaaccccagctactcaggaggctgaggcaggagaatcgcttgamccagggagtcagaagttgcagtgagccgatatcacgccaccacactccagcctgatgacagagcgaggctccgtctcaaaaaaaataagtacataaacac

SEQ ID NO: 26474 - DNA, 201 bp, Homo sapiens
gagttacaattgttggttctgggactgtcttacctttttctgagatccaagacccaactcaagccccatgtcctctgtaaagcattctttgaccaccccaraccacagaattgctctcctcctcttcctcttcccttttacagcatttagtatatcagttgctcataaagccctggatagaggtgactcttagatagtctt

SEQ ID NO: 26475 - DNA, 201 bp, Homo sapiens
cgtcaggcccactttggtggtgccaaggctaacatgagctggtttggagataaaaccatcccatgtgcccatacgatggagaccttccagagcattgtcaycacacttgaatctactctgcaccactccctgagatccaggagaagatggtctggcaaatgcttcccttcacctatggctttatttgtgcctcagtttccc

SEQ ID NO: 26476 - DNA, 201 bp, Homo sapiens
atattttcccttcttagcaattcattcatgaaaacttaaaaacaatttatccacagtaaatgtcaaaaatacttgatcagaggtatcatgtggatgtaatrgtcccatccttctttccccctccctagttcttaatccacatcctatcaaagtttcctcatttcaaagttttataaaaatgacaacggtttggagggacct

SEQ ID NO: 26477 - DNA, 201 bp, Homo sapiens
tttagatggaatctcgctctgttgccaggctggagtgcagtggtgcgatatcggctcactgcaacctccgcctcctgggttcaagcaattctcctgcctcrgcctcctgagtagctgggactacaggcacacaccaccatgcccaactaatttttgtatttttagtagagacagggtttcactatgttggccaggatagtc

SEQ ID NO: 26478 - DNA, 201 bp, Homo sapiens
gaatttaacttgtttggaaaaaggatatttgcagatataattaaagacctcagatgagattattacggtttagtcagtgagcactaaatccaactacacgygtccttgtaagggatacccagagaagagtcccatgaagaagaggaagaggtcatgtgaagatggaggcagaattgcaactatgtagtcacaaggcaagga

SEQ ID NO: 26479 - DNA, 201 bp, Homo sapiens
ggattaagattagggaggggttgttgttgaaaatgcaaaatggggatatgactctgaaagggagtagccgaggttgggttgggaacaggatccctggatgrgaagacaggaactgagaagctaagactttgagaggatcatctttgtggatgttgaaatccccaagaattaaggcaagagtagggttggagagagtgacag

SEQ ID NO: 26480 - DNA, 201 bp, Homo sapiens
ttgcaattgtcttaaacaccttccccaggaatctcatcaaataaccaggagagattaaccaccagagaagagaagaacctggaattatcaccacacccagmcagacttttcttctattctcctaagggcagctctgagagataacctgggggtctttttctgcataataaaataacctttgttcctgtgcagttcttcccc

SEQ ID NO: 26481 - DNA, 201 bp, Homo sapiens
agggaaagatttgagaatagtgttcatatctttccctatatttcctcatttaatcctgagcctgagtggagggtgaggctgtgtcagggaaataaggagaygtgggagtgaggccatgtgcttgtgctgggcaggactgtgcatggggcgcacctgtgaggtcgagtaggagagacgtcgggtgcttctgggggtggagat

SEQ ID NO: 26482 - DNA, 201 bp, Homo sapiens
aattgtatttcagtaaacatgtatattaaataattatttcaactggaagttgtttcacaaaacagtacttactcatactgtatgaatgcactttattttgkctctttctcttttcttcttcctccttcctccctccttctctctctccttgcttccttcctccctccttccttcccttcccttcccttcccttcccttccc

SEQ ID NO: 26483 - DNA, 201 bp, Homo sapiens
cctttttctttctgtcatgttggttactactcagtaaattgatctaacagataactaatgtttttaaaacattgctctagaatactgagccaaaaacctcragttgtcagtcacccgcttccagcaggtgaatgactcataatgagatgctatcttcctatcttcagtcctgctcatcatgtctacagtaaaggcaattag

SEQ ID NO: 26484 - DNA, 201 bp, Homo sapiens
accacgaggtcaggagatcaagaccatcctggccaacatggtgaaaccccgtctctactaaaagtacaaaaattagctgggcatggtggcatgtgcctgtmaccccagctactcaggaggctgaggcaggagaatcgcttgaaccagggagtcagaagttgcagtgagccgatatcacgccaccacactccagcctgatga

SEQ ID NO: 26485 - DNA, 201 bp, Homo sapiens
atcccagcactttggaagaccgagacgggtggatcacctgaagtcaggagttcaagacgagcctggccaacatggcaaaaccccgtctctactaaaaaatmcaaaaaaaaaaaaaaaaaaattgggcgtggtggcaggtgcctgtaatcccagctactcgggagtctgaggcaggagaatcgcttgaagctgggaggcaga

SEQ ID NO: 26486 - DNA, 201 bp, Homo sapiens
atcccatgtcctcgtcaccaaagcagtcaccctcgcttatataaatatttgttttatattagcatctgtgttatggtgattcagaacataacaaagcaagytcttgcctatgaataacattatagatgccccagatgataggtcattcttttatttggttcacattttggttcacaatgggtcataatcaggcaccaatct

SEQ ID NO: 26487 - DNA, 201 bp, Homo sapiens
caggagagggctttttggtaaaaaatgtataaaaagaattgagtgacttgcacattaaaatatgccttctttagaggtttaaaaacaaagatagaggccargcacggtggctcacacctgtaattccaggattttgggaggccgaagcgggtgaatcacttgaggtcagaagctcgagactagcctggccaacatggagaa

SEQ ID NO: 26488 - DNA, 201 bp, Homo sapiens
aggtttaaaaacaaagatagaggccaggcacggtggctcacacctgtaattccaggattttgggaggccgaagcgggtgaatcacttgaggtcagaagctygagactagcctggccaacatggagaaaccctgcctctactaaaaatattttaaaaaattagctgggtatggtagcaggctcctgtaatcccagctactag

SEQ ID NO: 26489 - DNA, 201 bp, Homo sapiens
atgataaccatattctcaacaaaggccttctttgcagccgtagactttcgactgagtttagcctttggtaactcataaattctggtcagccattgaagagrccctctctgagggtagctctgcccaaagggatagcactatctagggaggacttctctctcttgtttctcaatagcatcacagggacaaagatctcacttc

SEQ ID NO: 26490 - DNA, 201 bp, Homo sapiens
ctgaaatctgtaagaaaaagtaatcttccttgagttggaacagagaaatctttatgttcaagtgacagtgctgagtgaattgttcaaaatcttttaagaaytgaacagcctaactcctctctgcattagcacaaaagctgtttgtcatgataaccatattctcaacaaaggccttctttgcagccgtagactttcgactga

SEQ ID NO: 26491 - DNA, 201 bp, Homo sapiens
ggatggtgtgtgctatggggatgtggcgggggctggcagcagccccagagtgacagttatgaaggcagagacagttcctgccatcattagaatccctgtcygtgattcctctgacccatggctgtccaaaacacaacggttaccttcatgaaaaaattaaaagcaaacgttatttcctctttttgtgaaattccttaatac

SEQ ID NO: 26492 - DNA, 201 bp, Homo sapiens
tgcaatggtgtgatctcagctcaccgcaagctctgcctgtcaggttcaagtgaagctcctgcccccagcctccatagagtagctgggactactgacatgcmccaccatgcccagcttatttttttttgtttgtttttgaaatggagttttgctctgttgcccaggctggagtgcagttggtgcaatctcggctcactgcaa

SEQ ID NO: 26493 - DNA, 201 bp, Homo sapiens
gggtgccaggagtggcccattccctgaaagaaaaggaaaggggagagtggttgtgtcaggagattctctctgatagggcagcatctgagcagagaccagasgatatgaggggagtgagcaacagggctatttgtgggggaagacagtaagtgcaaaggccctgaggcaggagcgtgcctttgaaaagaaatggcaaggaat

SEQ ID NO: 26494 - DNA, 201 bp, Homo sapiens
aatggtgtgatctcagctcaccgcaagctctgcctgtcaggttcaagtgaagctcctgcccccagcctccatagagtagctgggactactgacatgcaccmccatgcccagcttatttttttttgtttgtttttgaaatggagttttgctctgttgcccaggctggagtgcagttggtgcaatctcggctcactgcaattt

SEQ ID NO: 26495 - DNA, 201 bp, Homo sapiens
actgaagacatgccatttgtgtcagataaacctggcaatgaatttcccaagtttagcactttgatttgataacagaatataaaaccttacatttgcacccytgatgaataaatactttcatatcttcctcacaaaaagtctaaaagaaagctagaataaagtcaccccattttatactggaggaaactgaggcacagaggg

SEQ ID NO: 26496 - DNA, 201 bp, Homo sapiens
ctagatgctaacattctttgatacttggatgaagctcattgcctttcaaacaagaaatctggcacatgcacacacacacacacacacacacacacacacamacacacacacgaaaagaataaaagtaaaacaattacttttcagacaatgatttctgccaccatatttttatcccatgtcctcgtcaccaaagcagtcacc

SEQ ID NO: 26497 - DNA, 201 bp, Homo sapiens
gtgtgtgtgatttggtcatttgttgtgacagacacaggaaattaatacagttggtgggcgggggcggggcctgggcctttgtacatttttttattttttayttttttgagacagggtcatccatgttgtcacgtggatgagtactttctatctatttgtctgaagaagcagggtatggtagagaagcctcaggcttcagag

SEQ ID NO: 26498 - DNA, 201 bp, Homo sapiens
atgcctgtaatccaagcactttgggaagccaaggaaagtggattgcttgaacccaggagtttgagaccagcctgggcaacatagggattccccatctccayaaaaaatacaaaaattagtcaggcatggtggcacatgcctgtactcccacctaccaagtaggctgaggtgggaggatcacctgagcccggaaggtcaagg

SEQ ID NO: 26499 - DNA, 201 bp, Homo sapiens
tctgagtagatgtaatattattataaataattgtgaatacacatggggcacaggatgcatggaaagcttcaggttttttttaatatctatcagtggatgcrttttcttggcattcacagaaggcaggaggaggcggatgtctcacagatgcatgggacactgaggcacagctatgttaaatgttatctggtactaaagcct

SEQ ID NO: 26500 - DNA, 201 bp, Homo sapiens
agcactgttatctttgcaccagagcccactctcacctaatctccgtgtgctggtgctacgtcaagtgtggtggtggttaggagtcaccttccgtgtgaggycaagcgttctggctcccgttgtccttgaagttgcatctcaggcttctgggcatggcagagcctgcgttcctgtgactcggctgaggccggtgtgatggag

SEQ ID NO: 26501 - DNA, 201 bp, Homo sapiens
ctcattttcatctttgtgttcagtcttttcaaattcctgcaaactcaggtaaatagggtagatctgtttagagcccttcaatgttggaacaccagcagggkcacctgtgagtccactgaaccttccatagtgctgcaataagatatttcttttgaatcatcaatattcagctttttcatcccagttttttttttttggggg

SEQ ID NO: 26502 - DNA, 201 bp, Homo sapiens
atcagtggatgcattttcttggcattcacagaaggcaggaggaggcggatgtctcacagatgcatgggacactgaggcacagctatgttaaatgttatctkgtactaaagcctctagaatagatgccccttaaagtaaagctactgcatgaaaaccatactgttattaaaaactatgtgatatggtttggctgtgtcccca

SEQ ID NO: 26503 - DNA, 201 bp, Homo sapiens
cagcactgttatctttgcaccagagcccactctcacctaatctccgtgtgctggtgctacgtcaagtgtggtggtggttaggagtcaccttccgtgtgagrtcaagcgttctggctcccgttgtccttgaagttgcatctcaggcttctgggcatggcagagcctgcgttcctgtgactcggctgaggccggtgtgatgga

SEQ ID NO: 26504 - DNA, 201 bp, Homo sapiens
ggaaaaatcttcattacttgaaaagtcgtgcaaaatcaaggttcagactagtgtataatatgcttccatttgtacagagaaaaaagtatattcatgtacaracacacatagatacacgtgtagtatagatataaatctatgcttctaagagtagtgaccattgcctctaaagaagtagattgagtctttgaagtaggagga

SEQ ID NO: 26505 - DNA, 201 bp, Homo sapiens
cttaactcctccttcctcttccgccataattgtgaggcctccccagccatgtggaactgtgagtctactaaaacctctttttctttataaattacccagtmtcagatatgtctttattagtagcatgagaatggattaatacagtaaattggtattgggtagtggggcactgctgtaaagatacctgaaaatgtggaagcg

SEQ ID NO: 26506 - DNA, 201 bp, Homo sapiens
aaaaaagtatattcatgtacagacacacatagatacacgtgtagtatagatataaatctatgcttctaagagtagtgaccattgcctctaaagaagtagaytgagtctttgaagtaggaggaaaacctgacttttattgaatatgctctgtactttttgaattatttaacatacaaatgtattatagcttcatttattttt

SEQ ID NO: 26507 - DNA, 201 bp, Homo sapiens
tggagaattccatggaaaggtgtatgcataggtgggaagctctttttcatgatttggatgaaaatatgcttgattataataaatagttaaaaatattttasccaggtgtggtggctcatgcctgtaatcccagcactttggaaggccgaggcaggtagatcacttgaggtcaggagttcgagaccagcctgtccaacatgg

SEQ ID NO: 26508 - DNA, 201 bp, Homo sapiens
aggggcacctgtgagtccactgaaccttccatagtgctgcaataagatatttcttttgaatcatcaatattcagctttttcatcccagttttttttttttkggggggatagagtcctgctctgtcaccaggctggagtgcaatggtgagatctcggctcactgcaacctccacctcctgggttcaagtgattctcctgctt

SEQ ID NO: 26509 - DNA, 201 bp, Homo sapiens
gctactcaggaggcggaggcaggagaatcacttgaacccaggaggcagaggttgcagtgagctgagatagtgccactgcacttcagcctgggtgacagagygagactctgtctttacaaaaaaaaaaaaaaagggtacaaatgtggccaggcatgatggctcagtctgtaattcaacactatgggaggccgaggcaggaga

SEQ ID NO: 26510 - DNA, 201 bp, Homo sapiens
ttaggaggctgaggcaggtggatcacttgaggccaggagttcaagcccagcctggccaacatggtgaaaccgcatctctactacaaatacaaaaattagcygggcttggggacgcgggccagtaatcccagctacttgagaagctgaggcataagaatcgcttgaacccgggaggcagaggttgcagtgaactaagattgc

SEQ ID NO: 26511 - DNA, 201 bp, Homo sapiens
tttccagagcttaggtctgaagttgtattttaccacttgttcctggtgcttttcctgtgttaccgcaagagttaagcaacacgtatgtgaaaataaaatgkaggattgcatagtacagaccaaggaggtagtttggggcaaagtctagtctgtgctttgtttgtcaaactgtgatccttattgcagcatgaaggagggggt

SEQ ID NO: 26512 - DNA, 201 bp, Homo sapiens
tcctgcttcagtttcctgagtagctgggactacaccaccatgccaggcacacaccaccatgcctggctaatttttatttttatttttgtagagacagggtsttgctatgctgcttaggcttatctcaaactcctgacccgaagtggtcttcctgccttggccttcaaagtgctgggattacacgtgtgaaccactgctact

SEQ ID NO: 26513 - DNA, 201 bp, Homo sapiens
tattttgcccaggctggtgtcaaactcctgggcccaaggaatttacttgttttggcctcctaaatccccttggattataggtatgagccactgtgcccagwctaagtagaattttaaaaatctccttttctaaagaaaattgaatttgttgatagtaaagttttaaaattgggaagttatattgaaatgtgtctggtgcaa

SEQ ID NO: 26514 - DNA, 201 bp, Homo sapiens
ccttgacttcttgggctcaaatgatcctcccactgcagccgtctgagtagctgggactataggcatgcagcaccaaacctggctaatttttaaatcttttrtaaagaagtggtcttgctacattgcccaggctggcctccagtgaaccttctgcctaggtctccctaggtgttaggattataggcgtagccaccgcacctg

SEQ ID NO: 26515 - DNA, 201 bp, Homo sapiens
ctcaccacacactactcctcacatgccaagcaagcaagcaagcaatttttctgcagattctgcagtgcacaccagctgggtgtcctctaattcaactcaaytcttacactagctatctagagatactgtcagatcccacaggttaagggctcagtcccacaagactgtcccccacttcagaggccagttataagactgaat

SEQ ID NO: 26516 - DNA, 201 bp, Homo sapiens
acagcacatgatgttgttaaacttttgttttgcccgtctgttgggtagagaaaatcatattgcattaccttagtttcattttcctgtttcaaaaactattyaaatgtttcttggccatttgagtttccatcttcatgaataacctgtccttcacattctcctagttcttcctggcaatatgctcttccaaaaggatgtagg

SEQ ID NO: 26517 - DNA, 201 bp, Homo sapiens
atcttttgtaaagaagtggtcttgctacattgcccaggctggcctccagtgaaccttctgcctaggtctccctaggtgttaggattataggcgtagccacygcacctggctgtccccttcttaaacccctttcagcagctcttggaatttcattgcccatggaatacaatccaaactccttacgatggccacgcgagtcct

SEQ ID NO: 26518 - DNA, 201 bp, Homo sapiens
ccgtctgttgggtagagaaaatcatattgcattaccttagtttcattttcctgtttcaaaaactatttaaatgtttcttggccatttgagtttccatcttyatgaataacctgtccttcacattctcctagttcttcctggcaatatgctcttccaaaaggatgtaggattactttgaaaaagttctatgaaaaaccatcg

SEQ ID NO: 26519 - DNA, 201 bp, Homo sapiens
atcacttgaaccccgaaggtcaaggccgtagtgagctgtgatcatgctactgcactccagctttggtgacagtaagaccctgtctctaaaaaataaaaaawgtacaaaggcccaggcccaccccctgcccccaccaactgtattagtttcctgtgtctgtcacaacaaatgaccaaattacaaaaaaagaaaaaacaactt

SEQ ID NO: 26520 - DNA, 201 bp, Homo sapiens
ggattacaggtgcacaccaccacgcctgaataatttttgtacttttagtagagacggggttttgacatgttgtccaggctggtctcgaattcccgacctcrggtgatctgcccgcctcagcctcctaaagtgctgggattacaggcttgagccaccacgcctggccctcttgcttcttttaggatggctttcatttttgta

SEQ ID NO: 26521 - DNA, 201 bp, Homo sapiens
acttattcactaacatgagaacaacatgggaaagacccgcccccatgattcaattacttcccactggggattatgggagctacaattcaaaatgagatttsggtggggacagagccaacccatgtcactcattatgatgtgtctgacattttagttatattgcttaagagttgtagtgattcttgaatctgtggattgata

SEQ ID NO: 26522 - DNA, 201 bp, Homo sapiens
ggagagattgaggaatggtagccatggggtgtgggttatcttcttgggctaatgaaatattctaaaatgggtcgtgctgatggatgcctaactgcgactayaataaaagccattgaattgaattgtacacttcaaatggttgcattgtatgtgaattatatctccgtaagcctctttgtttgtttttaagtattcatgggc

SEQ ID NO: 26523 - DNA, 201 bp, Homo sapiens
tctggagtatgatgggccatagtagtttgagctcagattgttttcagggcaaatctacccttacaacacagttaggagatttgtgttgtctcagggtatcyaaaaactcttacagttgaatcagtttaaatcctctagaagatatttaataatagatgataaacattttttaaagtattggaggaagtaaagaaagtgagg

SEQ ID NO: 26524 - DNA, 201 bp, Homo sapiens
gaaccagggaggaggaggctgcagtgagctgagatcttgccactgtattccagcctgggtgacagagtgagactctgtctcaaaaaaaaaaaaaaaaaaaraaaaaaagaaaaagaaaaagaaaaaacaaaaattgggttcattttgggttttgttgcacaaatatacatatttaagcacctgttaggtgcaaggcattat

SEQ ID NO: 26525 - DNA, 201 bp, Homo sapiens
gtgaaatcctcttgaaggattttaagaggcagagcctcagacaagtggtttaactctcctaaggtttggttccctcctttgtgcagatcccatatggttgytttgaggctgacataagaaaatgcacaaaaacatttgccgagtgtgggggataccacagagtgaatactttggagtctgcttttcataatgtgatctgct

SEQ ID NO: 26526 - DNA, 201 bp, Homo sapiens
actccagaatttctgcttgattccctttaattatttcaatctgtttcttatatttgtctgatagaattctggattccttctctgtgttatcttgaatttcyttgaggttcttcaacacagatattttgaattctgtgtctgaaaggtcacatatctctgtttctccaggattggtccatggcagcttatttagttcgtttg

SEQ ID NO: 26527 - DNA, 201 bp, Homo sapiens
aagcagaattggagagggagggggctcaaatcaagtgtgatgtgagagaagcctagaaagttctcaaaatctttgatgcctggttatcagcatttttacarggtgctggtgaccttggccatggtggctaggggactatcaaggacagatgtgatagctaagataatgtgtccactcatatgaactcctgtattttactag

SEQ ID NO: 26528 - DNA, 201 bp, Homo sapiens
tttccagaaaggccccttcagcagtcatatgagtaacagatagattctatcagggctcagaacacagtgcctcaaaatatggcaccttggcatgctgagtwctttgaactgaaggagattgcaaagactaagaagcaaggtttctctgaccttcgcctactctcctgtctcccacgcctcattcttccctgaattaagtca

SEQ ID NO: 26529 - DNA, 201 bp, Homo sapiens
aacagagggctctgtctggcccagagacctgcctcatgaaacccttgttcctgaacagcaagaggaaatcccgctccccttggctccactcacagagccayagttcacatttgtggtagttttagtttccctctttgtgaggtaagcagctttctcccaaccaaccccatgtcagcgccccttctttattttggcttccag

SEQ ID NO: 26530 - DNA, 201 bp, Homo sapiens
cagtggcgcaatcttggctcactgcaagctccacctcccaggttcacgccattctcctgcctcagcctcccgagtagctgggactacagacacccagcacyacccacgcccagctaattttttgtatttttagtagagatggggtttcaccacgttagccaggatggtttcaatctcctgacctcgtgatccacccgcctc

SEQ ID NO: 26531 - DNA, 201 bp, Homo sapiens
cttccttccgggcttcagtcaagagttaattcttctgagaaatgaaccagggaggctccaaacttggaaataccagacaaggaaatttctccgggatacaytgggaagtgaaacaaacaaacatgttatagatacacatgagcaaatctcttgtatattaacaaacaaaacaaaacatatgtacataaatataaatgtgaa

SEQ ID NO: 26532 - DNA, 201 bp, Homo sapiens
agagaatgaaaagtctaggaaggtgtcgtcttgtcccacttttgtcttgcactcatttctcctctttggcaactgaaaattgaagttcttcttccatcagtttttttttttctcattttctcatagccccatttaagacaaaagctttcattttgtgtgttgtcaattcctctgggttcacttacatcagctttggctgga

SEQ ID NO: 26533 - DNA, 201 bp, Homo sapiens
aaaggggctgcaggacttggcgagagaggagtggcgagggctcagctggagggtgggggctatttgcttggcccccattgtgtctccaagggcttttctgkatgacttgggagatgctgggaaatcactctcccaggctgactgaaggctgggagaaaacagcagagaacaaactcctctctagtttgttgcctgggctgc

SEQ ID NO: 26534 - DNA, 201 bp, Homo sapiens
tctatttacctgggctctagttatcttatttacctgggctcttaaaaataccagctacaatcagaggttctaagagagcctcaaaaaagatggcctttccmaaagtatatttcatcaagtgggagcttcttatattttcttggcttctgttgaaacttttatagttaaatgatgtgacaaaataatgacactagcttccgt

SEQ ID NO: 26535 - DNA, 201 bp, Homo sapiens
agcaggaatgcttgcttcctgctgacctggaaaccagctgtccagcagaatggaaaaacaggtggacttagacccaaagacctgagtatgaatccagcccygctcttctctactgtgtgccatggcacagagcacacacacgccatgccagacaattgattttaatcaactttatctagttgataaagtacttacaatatt

SEQ ID NO: 26536 - DNA, 201 bp, Homo sapiens
gccagcaggctttggcaatgaacctacatgaggttggacataggctccaacattgactaattaaggaactatgggcaagtttcttaatctgtcttttttcttttttttttcactgttccaaagtttaattaaaaacacaatttacaaatatttaatatcttctgaaaagcatttctaagttaagaatgaaaaagtatgtac

SEQ ID NO: 26537 - DNA, 201 bp, Homo sapiens
attgctcaagatctgctggctagtttgaactcaggtctttggactgcaaatttttctttcccctctgcctcctagtatgcggcatgaatctccagactaawgtgagaccttttagatggctgaataaggaagaaacctggagaacatacatgtgggttagaagtcattatggctccgagatcgcaggctgatgccattgtt

SEQ ID NO: 26538 - DNA, 201 bp, Homo sapiens
tcctttgtggcaacagttagctggaactgagtagttgcatgcatcagcatttcactgccccatttagacctggggaacacccagtttaacacagtcatcamcactcctcattgctttacatgcagctgggtccactcagttactttatttccccagctcctgaaaatattttgagttcgtatccctgaaatatccttccaa

SEQ ID NO: 26539 - DNA, 201 bp, Homo sapiens
tgtgaaaggatcttttcttttgggttccttggcccctacccctgagtgtgatttccagggtttcttattcgaaggccatgagcagaaacttctcacggcaygtcacctcatccaaatgccacagaaatgaaaagtgaaaccactggggacagactcagaaatcaaaacaaaacaaattctcctctcagaggcttggtttcc

SEQ ID NO: 26540 - DNA, 201 bp, Homo sapiens
gaggcttggtttccatttgtgccagtgtaattaaacaattctttctttcttttacttggaactcttcatttgaccaccaggaacttccctctggcaggggsaacagccactccaaggacttaccccagagatttcagagcagaagcaacggcgtttcctcttgaactgttatttctctgcccaaggaatcttcttgactgt

SEQ ID NO: 26541 - DNA, 201 bp, Homo sapiens
ttccagagcttaggtctgaagttgtattttaccacttgttcctggtgcttttcctgtgttaccgcaagagttaagcaacacgtatgtgaaaataaaatgtrggattgcatagtacagaccaaggaggtagtttggggcaaagtctagtctgtgctttgtttgtcaaactgtgatccttattgcagcatgaaggagggggta

SEQ ID NO: 26542 - DNA, 201 bp, Homo sapiens
aggattgcatagtacagaccaaggaggtagtttggggcaaagtctagtctgtgctttgtttgtcaaactgtgatccttattgcagcatgaaggagggggtmcctttttcttattcaggttcctggcaactctaagatagaatttttccctaatccatctcactggactagtttcctatcttttcaggcagaaaaagttggc

SEQ ID NO: 26543 - DNA, 201 bp, Homo sapiens
tttggggcaaagtctagtctgtgctttgtttgtcaaactgtgatccttattgcagcatgaaggagggggtacctttttcttattcaggttcctggcaactytaagatagaatttttccctaatccatctcactggactagtttcctatcttttcaggcagaaaaagttggctgagaagacaatctaagcccagctgtttat

SEQ ID NO: 26544 - DNA, 201 bp, Homo sapiens
tttatcatttttaaccatttgtaagtgtacaattcagtagcattaaatacattcacaatgttttatgactgttactgctatctatactcaaaacttttttmttgtcctccccaaaaactctgtagccattttataagtctctcttcccctaccctccagccatataagttgattcatatagtatttgtttttctgtgtttg

SEQ ID NO: 26545 - DNA, 201 bp, Homo sapiens
tcttaatccacatcctatcaaagtttcctcatttcaaagttttataaaaatgacaacggtttggagggacctcgctttttaggaagcattcagatagctcrtcactctatcaatagtcactgcccgaattctgaaagcatgaagaagtatgcagagcttgattttagttttataaaaatccggttcttcaagggaggattt

SEQ ID NO: 26546 - DNA, 201 bp, Homo sapiens
agggtgatgatgccatttagtggcttagggaagaaaagggggaaaaaagtagtgcatagacactactcgttgtagtgttggacatagacatccaacagtcwtgtccccgttcttcacagagcctagattttgtcaaatggttaacccatcctgagcccctgagaagtgtcctaattggtgcaagccagtcagctcaggaca

SEQ ID NO: 26547 - DNA, 201 bp, Homo sapiens
tgccttgtctcttccagcttctgattgttccactgtttcttgccttgtgactgcatagttgcaatttctgcctccatcttcatgtgatctcttcctcttcytcgtgggactcttctctggcggctctgctgtgaagtcagctgcccactgttagcagtgcaggtgtctgttcttgcctggtgcctggtaacccaggcactg

SEQ ID NO: 26548 - DNA, 201 bp, Homo sapiens
cacatcctatcaaagtttcctcatttcaaagttttataaaaatgacaacggtttggagggacctcgctttttaggaagcattcagatagctcatcactctrtcaatagtcactgcccgaattctgaaagcatgaagaagtatgcagagcttgattttagttttataaaaatccggttcttcaagggaggatttttgtggca

SEQ ID NO: 26549 - DNA, 201 bp, Homo sapiens
taaaataggccgggcgcagtggctcatgcctgtaatcccagcactttgggaggctgaggtgggcggatcactcgaggtcaggagttcgagacaagcctgascaatatggtgaaaccccatccctactaaaaatacaaaaaattagcggggcgtggtggtgtatgcctgtaatcctagctactcgggaggctgaggcaggag

SEQ ID NO: 26550 - DNA, 201 bp, Homo sapiens
tgggctcgtcccctctctggagtgatgtgggtgttgtacctgatggcaacatcaccaaatctggctctctagcctctggagagtctgtgagttatccaatrgatttttttttaattgtttaaaaacaagagcaagactctgtccccccccccccccaaaaaaaggtaaagaaatgtagactcagattcagtaggtctggtt

SEQ ID NO: 26551 - DNA, 201 bp, Homo sapiens
gccacttagcatgtaaaggagggaaatgtcgatttaccttctcagggtaaacaaactacagcggcatttctccattccagcaggctggctgacccctcagrgacaacctgtcatgtgttgggatcatacacaggcatcttttatcgttccataataagctgtgggtcctgcagcaatccagacatgctcttctagtccgca

SEQ ID NO: 26552 - DNA, 201 bp, Homo sapiens
tgggcatgaggctctgcatttcttttttttttctttttctttttttgtgtgtgtgtgacattgtcttgctcttacacccaggctgatgtgcagtggcgcartctcagctcactgcaacctccacctcccaggttcaagcaattctcctgcctcagcctcctgagtagctgggactacaggcatgcagcaccatgcccagct

SEQ ID NO: 26553 - DNA, 201 bp, Homo sapiens
agaaagagagtagaaggagtaaacttcagaaaaaaatatttgaagactaatgagtgaaaatttcctgaagtttgaaaatgagcaacagagacacaggacargaacaaggcaaaaaataaatgtcatagaagacatataagtattgaaaagttttcaagacacctgaatgcccaatactgtccccttactcattgtgtaacc

SEQ ID NO: 26554 - DNA, 201 bp, Homo sapiens
ataaaattgtgtgcttgggaacaaaggaaactaaggagcaagggatagggaattgggagtatagttagtgtgtgtgtgtgtgtgtgtgtgtgtgtgtgtgwgagagagagagagagagagagagagagagagagagagagagagagaaaggctgggcaataaagacctaaaggaggtgagggagtgagtcatgaagatatg

SEQ ID NO: 26555 - DNA, 201 bp, Homo sapiens
taaaaagaaacagaagaaacccttggtggtataggtacaggcttgggtcagtaaatggctataatgactggctaataagatcctgccactgcactccagcmtaggtgacagaccgagcccctgttgcaaaagaaaaacaacaaacaaacccaataatttttgataatagatcacaatgtgattttggtatataattcaaag

SEQ ID NO: 26556 - DNA, 201 bp, Homo sapiens
actccgtccctacgagaaatacaaaaattagctgggtgtgatggcatgtgcctgtaatcacagctactcaggaggctgaggcaggagaatcgcttgaaccygggaggtggaggttgcagtgagctgagattgcgccattgcactccagcctgggggacaagagcaaaactccatcaaaaaaaaaaaaaaaagtccaaggac

SEQ ID NO: 26557 - DNA, 201 bp, Homo sapiens
atcagccaaagtggggaactcctgagcctggagtcacagaactttacaactctcatcttaaatctactccctttgctcacagaactactgttaaatgttcyggtgacacagtctgcagtggtgcacacctcttcctgctatgagttcagaacaactgctaagtgggcatactgaaaattcaaatttcacaggagagggctt

SEQ ID NO: 26558 - DNA, 201 bp, Homo sapiens
aaagaaaaacaacaaacaaacccaataatttttgataatagatcacaatgtgattttggtatataattcaaaggaaactcaaagaattgattgacattgcmgtagcaagatttttcccatttccatctacttattttaaagttttctcaaggtttacatctataaaaacaaataatagaaatagaattgatggagaactct

SEQ ID NO: 26559 - DNA, 201 bp, Homo sapiens
aactttagattttcttgggctgaggaagggcttaggtctcagcttttaatccacaggaggaagttttatttaccctgtggatacttaatacatatttttcrttgctgtttctcttgtccagttgggcttatcttgcccatgaagttgcctctgaagaaccaagtccaactgtgtatgctgagagatgtctggctacttcct

SEQ ID NO: 26560 - DNA, 201 bp, Homo sapiens
gtgccggtgatgggcattttgctgcttcatagctccatggacattactcctgaatctagaagctcaattcccagagacagaagagcttttcctctatcaarggtaatacagtaatttcagctccctgcttgagtcttctttttcaaggtgaagagtcatgccatagggtgctgtatggtaaacacacatggtagcagtaac

SEQ ID NO: 26561 - DNA, 201 bp, Homo sapiens
cctggagtcacagaactttacaactctcatcttaaatctactccctttgctcacagaactactgttaaatgttccggtgacacagtctgcagtggtgcacmcctcttcctgctatgagttcagaacaactgctaagtgggcatactgaaaattcaaatttcacaggagagggctttttggtaaaaaatgtataaaaagaat

SEQ ID NO: 26562 - DNA, 201 bp, Homo sapiens
ctccacagctgctggtccgggtgctaagcccctcactgcctggggccggcagggccggccagctgctccgaatgtgggacccgccaagcccacgcccaccyggaactctagctggcccgcaagtgccgcctgcagccccggttcccacccgtgcctctctctccacacctccccgcagggtgagggagccggctccagcct

SEQ ID NO: 26563 - DNA, 201 bp, Homo sapiens
actaggaaaacaaatcccctctgggatctggctttatccaggagggtttgggccatcccctctatggggactcagatagccaggaaagcctttgtggaaayatgtgccttccttcccttgaccagctcccctccctcccgaggggctgaagttccctgcccagtgctccagagttcacgccaccctgttggggttacaggg

SEQ ID NO: 26564 - DNA, 201 bp, Homo sapiens
agacattccttcacattttatcctctgctttagtagtttcttgggtttgcacaggcttgccatcttgactttgcaacagtgttatctgttgttcaggcacmatttttctattagagagtggtcctgagactaataaccatagctctgaccagctgaagtccaagcatggcacagcaccagaatctgccccagcactctcct

SEQ ID NO: 26565 - DNA, 201 bp, Homo sapiens
atttcaaagatacattgtattggatatatcagatatctttaaaaattttcatattgagagtgatctggaaatgatattatttgcagttctttaaacgtacrataaacattttgaggtcaacttagaaatatgtgagtagtatatggctttgttttttgttgttgagacagggtccagctgtgtcacccacgttgcagtgca

SEQ ID NO: 26566 - DNA, 201 bp, Homo sapiens
ggttcatgtagagctttcttatgtagcagagaggagaggaaagagcactagctgtgggtaagaagactgaccagaggaaagggatggcacaggccaatgtstttggggcagtctgtcctctttacagactggagttgtcaggggctccgttgagctgccaggagttagagtagccaatgaaagaaacaagccaaaaatgag

SEQ ID NO: 26567 - DNA, 201 bp, Homo sapiens
catggtggctcacgcctgtaatcccagcactttgggaggccaaggcgggcagatcacctgaggttaggagtttgagaccagcctcgccaacatggtgaaaycccatttctacttaaaatacaaaaattagccaggtgtggtggcaggcacctgtaatcccagctactcgggaggctgaggcaggagaattgcttgaaccca

SEQ ID NO: 26568 - DNA, 201 bp, Homo sapiens
agtgcagtggtgtgaccttggctcactgcaacctctgcctcctgagttcaaatgattcttctgcctcagccacccatgtagctgggattacaggcaagagytaccacgcccagctaatttttgtattttttgtagagatggggtttcaccatgttggccaggctagtcttgaactcctgacctcaagtgatccacccacct

SEQ ID NO: 26569 - DNA, 201 bp, Homo sapiens
tgtggctcaggtaggaagaatccaagagcaggctttttatgtcttaggccccagaaataaagagagccttctggtttccttctcaatggtctcacccactwcctaagcctggaggaggggcagggactctggtaaaagcctggccctaaatcttcccgtgggtttttgttttcagaatcctgacctattatatgtagtgct

SEQ ID NO: 26570 - DNA, 201 bp, Homo sapiens
ctgccctctgctggggtcaggaagacaaaataacccagctatattaggtttctccagagaaagagaacccactggatggatagatagatagatagataggkaggcaggcagatagatagataggtgggtagatagatagatagatagatagatagatagatagatagataggcaggctggcaggcaggcagatagatagat

SEQ ID NO: 26571 - DNA, 201 bp, Homo sapiens
gatatggtattttctttctttctttctctttctttctttctcttttctttctttctttctttctttctttctttctttctttctttctttctttctttctytctctttctctttctttctttctctctctctttctttctcttttctctctctctcctttttttttttttgacagcattttgctgtaatgcccaggctgga

SEQ ID NO: 26572 - DNA, 201 bp, Homo sapiens
accctcccaaagtgctgggattacaggcgtgagccactgtgcctgagcaacatcagtaaagttttaagatcctcaggtgattccaaagtgcagtcaagatytgaagccgttattctgcaggctgccctgagtgttaattttaatgattctcattaggaacaagtgatagactataaaatgttagaggctgggcaggacttt

SEQ ID NO: 26573 - DNA, 201 bp, Homo sapiens
actcctgggctcaagccatccttgtgcctcagcctctggattggcgaggatgataggcatgcaccaccatgcctggctaattttttaattttaatagagayaaaattttgctgtgttgcccaggctggtcttgaattcctggactcaagccatcctcccgcctcggcctcctaaagtgctggaattacagatatgagccac

SEQ ID NO: 26574 - DNA, 201 bp, Homo sapiens
gtagggctgggagaggtgagcaagaccagaagtttaagagtaattgtgggcagggcgctgtggcttgcgcctgtaatcccagcactttgggaggccaaggygggtggatcacttgaggtcaggagttcaagaccagcttggccaatatggtgaaatcctgtctctactaaaaacacaaaaattagccataaatggtggtac

SEQ ID NO: 26575 - DNA, 201 bp, Homo sapiens
gtgtttcagatattttgcagaccttgcacttgatggatcagctggcaccacccagattgataaagtggctcatctgatcttgtggcccatacccaggaackgactcagtgcaagaggacagcttcaacttcccatgatttcatctcctacctaaccaattagcactcctggctcactggcttctctctacccaccaagttg

SEQ ID NO: 26576 - DNA, 201 bp, Homo sapiens
ctcaataaaggactatttcagtaaccccacgctgtgaaatcaacagagtaaacacccagtaggattcacggcaagttgacaagccagtcaaatgatgactsgaggcaaatactaggtacgtaagacagtgcagctaaggtgaggaggtgaaggccagctgaataaaccaggtggtaaacaccagtagggtatgaagccagc

SEQ ID NO: 26577 - DNA, 201 bp, Homo sapiens
atttgttatgcttttcttttgttaacctgtcttgtgctttaagagtgttagctgtccgccttctatgggaaggaaagatatcacaattttctacccttatrccaccaagttcaacctcccatcatgatgttttccagatacaaactcatttgatcttacttaacttttttcagcatcccgtaagggggcacagcagcaatt

SEQ ID NO: 26578 - DNA, 201 bp, Homo sapiens
accagggagtcagaggttgcagtgagccgagatcacaccactgaactccaacctggcaacatagcgagactccgtcttaaaataataataataataataawaaaataaataaataaaatgaagtgggtaaggccaggcagtaaagaaagggcaggaaggcaccatgggcaagagcgggtaggttttgacagcagattgaaa

SEQ ID NO: 26579 - DNA, 201 bp, Homo sapiens
cgaggaggatgtacattgcctcaggaccctgtaataattgcattaactgcacaaattgtacagcatgtgtgtttgagcaatatgaaatgtgggcaccttgaaaaaagaacaggataacgcaattgttcagagaataagagagataaccctaaactctgaccgccggtgagccgggcggaacagagccatatttctcttctt

SEQ ID NO: 26580 - DNA, 201 bp, Homo sapiens
aattctttttctcagcacagaacatccctaagaaagaaaatgcgcacctgggggtgggtctctgaactggcccccctgggcgtggtcgtctcttatggtcsagactgcagaggtgaaatagactccagtctcccatagtgctcccaggcttattaggaagaggaaattcccgcctaataaattttggtcagaccaggtgat

SEQ ID NO: 26581 - DNA, 201 bp, Homo sapiens
ccccctgggcgtggtcgtctcttatggtcgagactgcagaggtgaaatagactccagtctcccatagtgctcccaggcttattaggaagaggaaattcccrcctaataaattttggtcagaccaggtgatctcaaaaccctgtctcctgataagatgttatcaatgacaatggtgcccgaaacttcattagcaattttaat

SEQ ID NO: 26582 - DNA, 201 bp, Homo sapiens
gaagaattgcttgaacccgggaggcagaggctgcagtgagccgagattgcgccactgcagtccagcctgggcaacaaagagagactccatctcaaaaataaaataaataacataacataacataacataacataacataacataacatataaaataaaataaaatataaaataaaataaaataaaataaaataaaaataaa

SEQ ID NO: 26583 - DNA, 201 bp, Homo sapiens
aagaattgcttgaacccgggaggcagaggctgcagtgagccgagattgcgccactgcagtccagcctgggcaacaaagagagactccatctcaaaaataaaataaataacataacataacataacataacataacataacataacatataaaataaaataaaatataaaataaaataaaataaaataaaataaaaataaaa

SEQ ID NO: 26584 - DNA, 201 bp, Homo sapiens
tggcaataatcattgtctcagtgattggcttcctgtgcggtgagcaattgtacctagatcaaactcctggcattttggtagcacttttttttttaggtaargaagttgagaaatgttacaggacttcctcaagttcctacaaccagaaaagggcagtgctgggttggaactccacttagcagctaaagttcatgtaagtaa

SEQ ID NO: 26585 - DNA, 201 bp, Homo sapiens
gagcaattgtacctagatcaaactcctggcattttggtagcacttttttttttaggtaaggaagttgagaaatgttacaggacttcctcaagttcctacarccagaaaagggcagtgctgggttggaactccacttagcagctaaagttcatgtaagtaagcaacatgctagcttgtcttccaacaaaactatgtgaaaat

SEQ ID NO: 26586 - DNA, 201 bp, Homo sapiens
gaccctggctggttatctttagcatgaaaaaggtgctctcactgatagaatgaagtcttacctgcatcagctcatcaataactgccagcatgttttgatcyagaaagatctgcctcttaggatccatcagaagctttgcattcatggtcttgaactccacctggtacatcttcaagtcttcataaatactactaaggcaca

SEQ ID NO: 26587 - DNA, 201 bp, Homo sapiens
agattgatagccctttccgactatgagttttactgcctatggccttaaatttttgtatccacagaattattgaaagaaaaaaatgactttactgaaaatarccacactaatatttatgtataagtttatactttaaaaaaataattttgacacatgacaagtaactattctgaagaaacacattattatgtgctacctact

SEQ ID NO: 26588 - DNA, 201 bp, Homo sapiens
gcctatggccttaaatttttgtatccacagaattattgaaagaaaaaaatgactttactgaaaataaccacactaatatttatgtataagtttatactttwaaaaaataattttgacacatgacaagtaactattctgaagaaacacattattatgtgctacctacttcacaaatgataaactaaggaaatgagtaagacc

SEQ ID NO: 26589 - DNA, 201 bp, Homo sapiens
ctgaagtccaagcatggcacagcaccagaatctgccccagcactctcctttactttcattttagctattacagataaaaatcactgaaggaggccaggcgyggtggctcacgcatttaatcccagcacgttaggaggccaaccaaggtgggtggatcatttgaggtcagaagtttgagaccagcctggacaacatggggaa

SEQ ID NO: 26590 - DNA, 201 bp, Homo sapiens
tgggttcaagagattcgtccacctcagccttctaaagtactgggattacaggtgtgagccactgtgcttggcttccatataattttctcaataacattttytttctttttttttttttttttttttttggagatgggtcttgttctgttgcccaggctggagtacagtggtgtgaatatagctaattgtaaccttgaactc

SEQ ID NO: 26591 - DNA, 201 bp, Homo sapiens
agtttaagaattgtgagtaagtgattgcggaactctattgacttaaatgagaatgatatattcaaaatagtacacattatacaaagacacagacaaaaggrtatatattagtaggatagatcccactggggagtgaggggaatgagaatgaggactagtgataatgaaaatatataaatacatttagatatttgtatttga

SEQ ID NO: 26592 - DNA, 201 bp, Homo sapiens
acagataaaaatcactgaaggaggccaggcgtggtggctcacgcatttaatcccagcacgttaggaggccaaccaaggtgggtggatcatttgaggtcagragtttgagaccagcctggacaacatggggaaatctcgtctctactaaaaatacaaaaaaaattagcccagtgtggtggtgcatgcctgtagtcccagcta

SEQ ID NO: 26593 - DNA, 201 bp, Homo sapiens
ctatacacctaggctatatgatagagcctattgcttcaaggctacaaagctgtatgacatgttactgtgctgaatactgtaggaaactgtaatacaatggyaagtatttgtgtatttaaacacatccaaacctggagaagatagagtaaaaaaatggcttaaaacataaaaaatggtacacctgtagagagcacttaccat

SEQ ID NO: 26594 - DNA, 201 bp, Homo sapiens
acacagaacaattttgagtggtttctctccagaagctgaatactaatgttcccatgcctaataaatatgtagtttataaaaagattaagcaaatgtatgcwcataaagcaatagaaaataatctactttgtatttaaatagagctaaaccaatttaatgcaattgtttcagggcatccatctgacaaacagctttctataa

SEQ ID NO: 26595 - DNA, 201 bp, Homo sapiens
tattgcttcaaggctacaaagctgtatgacatgttactgtgctgaatactgtaggaaactgtaatacaatggtaagtatttgtgtatttaaacacatccaracctggagaagatagagtaaaaaaatggcttaaaacataaaaaatggtacacctgtagagagcacttaccatgaatgaaacttgcaggactggaggttgc

SEQ ID NO: 26596 - DNA, 201 bp, Homo sapiens
gctacaaacaggatctaatgctgactagattggtgaccttggcaagccacttcatctttccaggcttcattttttttttctctaagtaaaagagaaatggratcaagtgattactaagttcccttctgggcctaaaaagttatgattttataaatgacactaaactaattagacaaatatgttttgagagcctattatgtg

SEQ ID NO: 26597 - DNA, 201 bp, Homo sapiens
accttagggaactagcaatcatggtggaaggtgaaaggggagaagccacgtcacgtggttagagtagcaagaatgggctggggaggtgctacacacttttwttttttttttttttgagacggagtctcaccctgttgcccaggctggagtgcaatggtgcgatctcagctcactacaacctctgtctcctgggttcaaacg

SEQ ID NO: 26598 - DNA, 201 bp, Homo sapiens
agggaactagcaatcatggtggaaggtgaaaggggagaagccacgtcacgtggttagagtagcaagaatgggctggggaggtgctacacactttttttttwtttttttttgagacggagtctcaccctgttgcccaggctggagtgcaatggtgcgatctcagctcactacaacctctgtctcctgggttcaaacgattct

SEQ ID NO: 26599 - DNA, 201 bp, Homo sapiens
agaattgcttgaacccgggaggcagaggctgcagtgagccgagattgcgccactgcagtccagcctgggcaacaaagagagactccatctcaaaaataaaataaataacataacataacataacataacataacataacataacatataaaataaaataaaatataaaataaaataaaataaaataaaataaaaataaaat

SEQ ID NO: 26600 - DNA, 201 bp, Homo sapiens
gaattgcttgaacccgggaggcagaggctgcagtgagccgagattgcgccactgcagtccagcctgggcaacaaagagagactccatctcaaaaataaaataaataacataacataacataacataacataacataacataacatataaaataaaataaaatataaaataaaataaaataaaataaaataaaaataaaata

SEQ ID NO: 26601 - DNA, 201 bp, Homo sapiens
ttgaacccgggaggcagaggctgcagtgagccgagattgcgccactgcagtccagcctgggcaacaaagagagactccatctcaaaaataaaataaataacataacataacataacataacataacataacataacatataaaataaaataaaatataaaataaaataaaataaaataaaataaaaataaaataaaatata

SEQ ID NO: 26602 - DNA, 201 bp, Homo sapiens
cgtgccatggtggtttgctgcacccatcaacccgtcacctacattaggtatttctcctagtgctgtcccttccctagccccccaccccccaataggccccrgtgtgtgatgtttccctctctgtgtccatgtgttctcattgttcagctcccacttatgagtgagaacatgtagtgtttggttttctgttcttgtgttagt

SEQ ID NO: 26603 - DNA, 201 bp, Homo sapiens
acagcagcaattgttacattttgcagggggagagacagctgcagaggggttgaaggaattgctagggttacacagctgatacactgcctcgcctgagttgraaaccagctctgcatgtctgcagctgctcttgctcggtaccacacagcggaggctggtcccaagtctcctcttctgttaatagaaaaatgggataatcat

SEQ ID NO: 26604 - DNA, 201 bp, Homo sapiens
acaccatttattaaatagggaatcgtttccccatttcttgtttttgccaggtttgtcaaagatcagatggttgtagatgtgtggtgttctttctgaggtckctgttctgttctatttgtgtatatatctgttttggtaccagtaccatgctgttttggttactgtcgccttgtagtatagtttgaagtcaggtagcctgat

SEQ ID NO: 26605 - DNA, 201 bp, Homo sapiens
gaagtcaagaaaccacattttgggttgtagaggcagccactcaaaatgaccctcctgaccagttgttcctgttataatgtacatttcctgtgaattccaargaattcatgaatagtggaaaaaaagaagtattttcttatttcactttttatatagacactaaagctttgttgggaggttacatgggcatgggccagggac

SEQ ID NO: 26606 - DNA, 201 bp, Homo sapiens
attgccttggctatgtgggctcttttttggttccatatgaagtttaaagtagtttttttcaattctgtgaagaaagtcaatggtagcttgagggggatagyattgaatctataaattactttgggcagtatggccattttcacgatattgattcttcctgtccatgagcatgaaatgtttttccattcatatgtgtcctct

SEQ ID NO: 26607 - DNA, 201 bp, Homo sapiens
ctccactagtgtggagggcagcacttttgtttcttttattctttgctgtgtctccaatacttggaaaaatgcccaaaacattttttgtgattgatgtacawggtgcaatgatgaggtaggcaagtttgaaggatacatctaaaggtcatggaagaatgagctacaggaatggtctttacactgcagtatgcttatctcaaa

SEQ ID NO: 26608 - DNA, 201 bp, Homo sapiens
ccttggctatgtgggctcttttttggttccatatgaagtttaaagtagtttttttcaattctgtgaagaaagtcaatggtagcttgagggggatagcattsaatctataaattactttgggcagtatggccattttcacgatattgattcttcctgtccatgagcatgaaatgtttttccattcatatgtgtcctctctta

SEQ ID NO: 26609 - DNA, 201 bp, Homo sapiens
ttgagggggatagcattgaatctataaattactttgggcagtatggccattttcacgatattgattcttcctgtccatgagcatgaaatgtttttccattyatatgtgtcctctcttatttccttgagcagtggtttgtgtagttctccttgaagaggtccttcacatcccttgtaagttgaattcctaggtattttattc

SEQ ID NO: 26610 - DNA, 201 bp, Homo sapiens
cttcccatgttccccagctttgactcagccattggccatccaacatcgtagagttactctctgcatctctgcaccataaggttagcaagaaggaacctaaytgtatttcagggctaagcccaagagtctaccctgatgttcactaagttaaaccacagaattacacaacaggaaagccaaaaagcctaaactcccttccca

SEQ ID NO: 26611 - DNA, 201 bp, Homo sapiens
ttcgtgctttctcttgtgggcatttagtgctatgaatttccgtctacatactgctttaaatgtgtcccagagattctggtacattgtgtctttgttcccaytggtttcaaagaacacctttatttctgccttcatttcgttatttacccagtagttattcaggagcaagttgttcagtttccacgtagttgtgtggttttg

SEQ ID NO: 26612 - DNA, 201 bp, Homo sapiens
tctcagtttataaagcatattaggttctgatatctagcaggcttaatacacttcagaattggctctgttagagaccttatgagaacattgaatctcaagcrggggctttgaagacacttgccatcttgaaaagacacggagttttaagttgtttcataaggtctaagaactggtggagaaacagattggtgaggaactgcg

SEQ ID NO: 26613 - DNA, 201 bp, Homo sapiens
ggcccagaaacacatattctataaaccaacttgaattagcagcagagatgtatatcccttagatatggtattttctttctttctttctctttctttctttmtcttttctttctttctttctttctttctttctttctttctttctttctttctttctttctttctctttctctttctttctttctctctctctttctttct

SEQ ID NO: 26614 - DNA, 201 bp, Homo sapiens
gacacagtgtctgtagggaacatccatgagccatctatcctgtttttgagagacttcaaaaatcttgacaacgggcttcaagaaaaaaaatccagaaaggwgtcatttattacttattggtgctccagaataaagattgtatgaatacttttgcaaacttttctgcatcttgagacagtttagcaacttatctgaatatga

SEQ ID NO: 26615 - DNA, 201 bp, Homo sapiens
acagggacgacatacttgcaatacatagacatgagctaggtgtatgtccaaaatagacaaagaagccctacaaatcaccacacaaagacaaatagcccctygcttttttaagagatgggatcttttgcccaggctggtcatgaactcttggcctcaagctgtcatcccatctcggcttcccaaagtgctgggattacgggc

SEQ ID NO: 26616 - DNA, 201 bp, Homo sapiens
ggttcttcaacacagatattttgaattctgtgtctgaaaggtcacatatctctgtttctccaggattggtccatggcagcttatttagttcgtttggtgargtcatgttttactggatgttgttgatgctaatagttgttctttggtgtctaggcattgaataattagatatttattgtagttggcactgtctaggcttgt

SEQ ID NO: 26617 - DNA, 201 bp, Homo sapiens
gtttgaggccagtagttgaacaaggccaagtgggtaaggccaagaaaatacagtcatgtgaaaaggccaataggtgaaggccaggaaagtagagccagggsctgggacagcagataatgacactaggttagggccagtagggctgggacagctaagtaagaccaaaaggttgaggctgattgtgaaggtgaactgggtaag

SEQ ID NO: 26618 - DNA, 201 bp, Homo sapiens
aaacaatcatgggaatagatttgaaatgtcttccagaagcaggtgggaaatgccggcttagaatgcagaagagctcagggatggagctaaatacaaggaartcgtcatcagaggttgaaggattgctgtgaaaggatcttttcttttgggttccttggcccctacccctgagtgtgatttccagggtttcttattcgaagg

SEQ ID NO: 26619 - DNA, 201 bp, Homo sapiens
tgtctctgctgctcttcttcagccttcctgctgcacttcacacctccctattctggcatctcctaatgccctgctcttcctggcctggcccctcatgcctyatagcgacttccctgagcaggtcagaccatggcagtggtcaccacctggtcctgcctggcacacaggcaccccgtaaaagttaagtaaatggatgtggga

SEQ ID NO: 26620 - DNA, 201 bp, Homo sapiens
cttgatcttggctcaccgcaacctccgcttccggggctcaagcgattctcctgcctcagcctcctgagtagctgggattacaggcatgcaccaccatgccyagctaattttgtatttttagtagagatggggtttctccattttggtcaggctggtctcgaactcccaacctcaggtgatccacccacctcggcctcgcaa

SEQ ID NO: 26621 - DNA, 201 bp, Homo sapiens
ttgatcttggctcaccgcaacctccgcttccggggctcaagcgattctcctgcctcagcctcctgagtagctgggattacaggcatgcaccaccatgcccrgctaattttgtatttttagtagagatggggtttctccattttggtcaggctggtctcgaactcccaacctcaggtgatccacccacctcggcctcgcaaa

SEQ ID NO: 26622 - DNA, 201 bp, Homo sapiens
aggttaactaatttcagagcaatttttcagatttagaaaattggagtcaggcgcagtggctcacgcctgtaatcccagcactttgggaggccgaggcgggmagatcacctgaggtcaggagttcaagaccagcctggccaaaatggtgaagcgttttctctactaaaaatacaaaaattagtcaggagtggtggtgtgcgc

SEQ ID NO: 26623 - DNA, 201 bp, Homo sapiens
gaaacattgatgaaacattccagcgtatgtttgcttctctctcagatcagatcaaaatacacaaagagttggtattaccagacgcttaatcaattacccamaactattgggctttgaactttctaaagaaataagaatagttttcaaataccctctaccagaaactaaatgtgacaatgctttatcctcaactcagctact

SEQ ID NO: 26624 - DNA, 201 bp, Homo sapiens
agggaggctgggaggagacggaggaaagggcaatgagatcctagagggccctggccacactgaaagaagctcctgtgaaacggagtctctcagaataggtyccttttaaagtcacctgaaaccaggtgtcagtgcctgcctgcctgccttccctccttctttcctttctttctttctttctttccttcttctttctttctc

SEQ ID NO: 26625 - DNA, 201 bp, Homo sapiens
ctatgggccctggtgattgtcagacactcagaggatcctttaaaagtttctaggactaggaatggaaagagagaggagccaggttaaggcaatcaggtggygatggcaatgcccagtgcagttaagtgctttgttcctgtatttcctccagacttgctgtcaaacctggacaggagccgaggaggtgggaggcaagggcca

SEQ ID NO: 26626 - DNA, 201 bp, Homo sapiens
cttcaggtctcaaattttttttattatggtaaaaacacatatcataatatttagcatctgaactatttttaagtgttaagtgtattcacattgttgcaaawaaaaccattttttaaaaataatttttctcccaaatctaacttctgaagtaggaccagttaaaatcccataatgatggataccagaaacgtgaatttttag

SEQ ID NO: 26627 - DNA, 201 bp, Homo sapiens
tataaacatatgaaaaatactcagctgcactgataattgaataaatgcaaataaaaataatagatataatttttatcctgtagtttgcaaagctaaaagtytgatagtttgtaaagtgtgtaagggtatgtggaaatgtgtaatctagtgaaatctatttggagggatagttggcaatagctatcaaaatgaaaaatgcac

SEQ ID NO: 26628 - DNA, 201 bp, Homo sapiens
ttagtatcaaaaaacttgaaatgcttccaatgtcttattagcaggaaaccatttaaataaaacatgactcatcttttcaagggactattatgcaactatcmaaaagattgaggcagatttatatatatgacaggaaaaatcttcattacttgaaaagtcgtgcaaaatcaaggttcagactagtgtataatatgcttccat

SEQ ID NO: 26629 - DNA, 201 bp, Homo sapiens
ctgttggaggtcaccgctgagcagctctttgcaattgcaaagctcccactggaaaacagagattaatgagctcacaaatggaacagcacataatttcagawcttggtgatgataacaaggagctctttaggatcctccttgcttgataacagaatcactttctttcttacgtttgtcatccagaagtctaaagtcagtagc

SEQ ID NO: 26630 - DNA, 201 bp, Homo sapiens
ggggtttcagtatgttggccacgctggtatcaaactcctgacctcgtgatccgcctgcctcagtccccaaaagtgctgggattacaggggtgagcccccgygcccagccagcatctcccgctttattcaattactatcatgactagatagacatgtccttaaaaacacagaataacccccctcctcccatatgtctctcct

SEQ ID NO: 26631 - DNA, 201 bp, Homo sapiens
ttaaaaactccctaggtgatcaatgtgcagccaagtttgggtactattggtttaatccatcatttttacaagcttggcgggggttgggggggtgggggtgraggtggggagtgggcagtggagggtgtcacagatgttgaattggataaaagcttttgtctctcattccaggcacttgcatttagatgtaaaacctggcat

SEQ ID NO: 26632 - DNA, 201 bp, Homo sapiens
tgatcaatgtgcagccaagtttgggtactattggtttaatccatcatttttacaagcttggcgggggttgggggggtgggggtggaggtggggagtgggcmgtggagggtgtcacagatgttgaattggataaaagcttttgtctctcattccaggcacttgcatttagatgtaaaacctggcatagtatttcaggggatt

SEQ ID NO: 26633 - DNA, 201 bp, Homo sapiens
gatcaatgtgcagccaagtttgggtactattggtttaatccatcatttttacaagcttggcgggggttgggggggtgggggtggaggtggggagtgggcartggagggtgtcacagatgttgaattggataaaagcttttgtctctcattccaggcacttgcatttagatgtaaaacctggcatagtatttcaggggattt

SEQ ID NO: 26634 - DNA, 201 bp, Homo sapiens
tgtgtctgaaaggtcacatatctctgtttctccaggattggtccatggcagcttatttagttcgtttggtgaagtcatgttttactggatgttgttgatgytaatagttgttctttggtgtctaggcattgaataattagatatttattgtagttggcactgtctaggcttgtttgtactcatttttcttgggaagacttt

SEQ ID NO: 26635 - DNA, 201 bp, Homo sapiens
agggctgggagagctgagtaagaccagaagttaggactaattatgaagaccaactggttaatgttgggtagctaagatcagttgggtaattcctgttggtragaacatgaggttaatgccagtagggtaaggtcagaagcgtaggcaggtgcataaagcctggggcgtaatactggatgagcaaggccaggaggctaataa

SEQ ID NO: 26636 - DNA, 201 bp, Homo sapiens
atgagcttataagttctgctgagtgcagccaggttgttaaaaccaggtgtttaaatccagctgaagaaaagactgagcaaccccaggccaggatatcaacrggggaactgcccagtaggattaagggcaagttgtaaaaccagccaaatgatgacctgaggctaatgtaggtgggtaagacagtgcagggaaggcaaggag

SEQ ID NO: 26637 - DNA, 201 bp, Homo sapiens
tgacatacggttccttcaatccttggaatcttctgtgctaatgaggtgactggaggctgagggcctctagatagcctcagggtgggaactttttgtgggamaaatcaagttctgattacagggttaagatattcagccccaggccccaacctccaaggagggaaggggggctgaaaattgagttgatcgttaatggctaat

SEQ ID NO: 26638 - DNA, 201 bp, Homo sapiens
tggttttcttcatcacatcactacatggaattttgtttggtcatgtattttttattctatccccattagatagtaactccatgaaggcagggactttgccrgtcacttctatctccagttcctctggcacagagaaggcattcaattaaaaaaaaaaaggtacaggaatgaattcaaatagttaatgtaggctgggcacag

SEQ ID NO: 26639 - DNA, 201 bp, Homo sapiens
gaactgttaagtcaattaaagcacaaacacctcctgagaaaatacacaaaagacccaaagctgtaaaaacataagccactgcattctatcccattcatacygagagaaatgcaaaggaaaacctctaccgctggactggcagagatgtgagcagacaaaaacctggctctggtggccggctcctgcccacaccccctagtc

SEQ ID NO: 26640 - DNA, 201 bp, Homo sapiens
gacagagcaagactccatctcaaaaaaaaaaaaaaaaaaaaagagagagagaaaagaaaagcccaagacctcggggccatccccaaacctactgttatcarattttgaatctatctttttttctcttaagagacaggctctcactctgttgcccaggctggagtgcagtggcatggtcatggctcactgcagccttgagct

SEQ ID NO: 26641 - DNA, 201 bp, Homo sapiens
cctcccaaatagctgggattacaggcatgtgccaccatgcccggctaattttgtatttttattagagacggggtttctccatgttggtcagactggtctckaactcccgacctcaggtgatctgcctgcctcagcctcccaaagtgctgggattacaggcgtgagccaccacatgcggcccaacaggcctgttttaaagtt

SEQ ID NO: 26642 - DNA, 201 bp, Homo sapiens
agatcttgtctcaaaaaagaaaaaaaatatgccgctattagctgctattattattgttcttttcattagttcaaatctttttccttcctccatgtaacaaytgccgatccttggttctggttgtctatagttatatggagggagggaaagatttgagaatagtgttcatatctttccctatatttcctcatttaatcctga

SEQ ID NO: 26643 - DNA, 201 bp, Homo sapiens
ctcagatctggaaggtccaaagcccatctcgtggcacattaggtatgaaccccaagtgtttatacctacttttgaagtaggttgttgtctacttttgaagyaggttgttgtctacttttgaagccttgcatttttacatggtccacacccatatccatagcaaaataatagttaatatcagatagctaacacttaccgagt

SEQ ID NO: 26644 - DNA, 201 bp, Homo sapiens
taaatacagaacaaatggcaggtattacggctgtttttggtaattttccattctaacctgcagcatagaaattaaaatcttaaaaacataaggtcctaatrttttctctttcttttaacataaggacagactctacttcccaagagctaatacatcatgcagcagcaaaggtctttaatagaacaagtagatgacatttca

SEQ ID NO: 26645 - DNA, 201 bp, Homo sapiens
aatggtcactgtaagtagtaggaataaatcagtgcaacttttctgaaaagaaatttggcaacattcactaagtcttaaaatgtttataccttttaactccrgtaaatctgatagtctaccctaagttatttgcagaaatgcaaaataacagctatgtcctaagatttttgtaataacgaaataaatggaagaatatatgtc

SEQ ID NO: 26646 - DNA, 201 bp, Homo sapiens
aggccctgaaaggggaggagagatgtgggtgagagtcagagctccagcaagaaaaggggattgagtgactattttgtttggaggttgaaggtatggggaasattagtttctcattttctattctttttattataaaatataacacacatagaaaaaagtacgttaagacctaaatgtacagcataacaaataattataaag

SEQ ID NO: 26647 - DNA, 201 bp, Homo sapiens
gtgctggaagagaaaccctggctgatttgagtagatagctcgatatgcctgtcttcattgttattctccctgacaagtagacaaggtcagagtcataggamctgaacagaagatttggaactatatctttggtgccataatttagggtggcagctcatcctcagatgaagtgagatcccaaagaggcttgtgatcagttga

SEQ ID NO: 26648 - DNA, 201 bp, Homo sapiens
ctacactccagtaatgatgctcagcttgaaatccaatttgggatgagtgtgtaatttacatgtttatttaattcagagccacttctcagtaaataggatgytcaggggcttgaattaccaaagctctctctacccaaggctcccttactaatctactcctgacatttattcactgtgtgtgcagctgccaaaaagcccaat

SEQ ID NO: 26649 - DNA, 201 bp, Homo sapiens
gcacctagcacatgcctggcctacatgggttcactctagatggttgttggtctgaattgatccctgcaagggctttgctttgctatccattatttagaacrcctctgcaggaccacattattaccagctattacatctagagcaaagcagcaagaaatcaactatctttgggatttatgtgaaaaagactcgtggtagctg

SEQ ID NO: 26650 - DNA, 201 bp, Homo sapiens
ttattattatcccattttacagatgaggaaatgggtacagggatttttaaataactgaagtctcattgctcataggtagatagttttgtaaataaacaccyatcacccagaggggtcagctgaggcttagtgagatgaagcatcttatctaagatcacatgaccagtcagtggcaaggcagggactgaacctgaagtttgc

SEQ ID NO: 26651 - DNA, 201 bp, Homo sapiens
gctgaggcttagtgagatgaagcatcttatctaagatcacatgaccagtcagtggcaaggcagggactgaacctgaagtttgcctggctctcaatgcaagmcccttagaaatctgcactgagtctccaacatgaggactccctgccccatatttcagtgcctggagcagaaaaatctgggtgggggtgcaagaattatttt

SEQ ID NO: 26652 - DNA, 201 bp, Homo sapiens
tgaggcttagtgagatgaagcatcttatctaagatcacatgaccagtcagtggcaaggcagggactgaacctgaagtttgcctggctctcaatgcaagccycttagaaatctgcactgagtctccaacatgaggactccctgccccatatttcagtgcctggagcagaaaaatctgggtgggggtgcaagaattattttca

SEQ ID NO: 26653 - DNA, 201 bp, Homo sapiens
tcaactgataccctaagcacaacacaataatggtgccccttgcctcttctattgcttaaaacaaagggtctgttacacaactcagctgatgagttaaatgstagtcagacccagcccttgtgtttatattggatggaagtgaaactctcacaccatgagatggaaacaaatgagatatctgatgacaccttcatgccaaac

SEQ ID NO: 26654 - DNA, 201 bp, Homo sapiens
ctcaatgcaagccccttagaaatctgcactgagtctccaacatgaggactccctgccccatatttcagtgcctggagcagaaaaatctgggtgggggtgcragaattattttcacaggggtccttcctgtgtgcatgtgccatgtgtgactcaagcaccctgggaaactgaaggttcaaggatcattgtgcaagtcctcct

SEQ ID NO: 26655 - DNA, 201 bp, Homo sapiens
tttgtgtagcagtcctaagagacagagtctgttatcattcccattttacagatgagaaagttgaagcacagaacttaataatgcattgcaagtcgcatagwtagaaagtagtggcgctgagatttagcagaatggctccatagcttatgcccttatcccgcatgttccaccacttctccaaatgttggctttctcatctat

SEQ ID NO: 26656 - DNA, 201 bp, Homo sapiens
gcctactccatctcacagttgtgtgaggatcagatgagataagacatatgaaagtgcctcaagaaggccatgaacagactaaagacatggtcacagtcatmcatgtttaaatgcaaatggaaggaaacgcagcaatttcttgttaatccgtttacagctttcattctgcctcctgacatctggatgatgggcttcttgcaa

SEQ ID NO: 26657 - DNA, 201 bp, Homo sapiens
tctgctcctgcccttacatcctgtcatctattttcagcaccacagccagaggaacctctacaggtagaagtcagttgatgtcactcttttcaaaaccttckaaaagctccccatctcactcagagagaaagcagtctttatcatggcctgcaaaaccctaactgatctggcttcctattcacttctatgaccacatttttg

SEQ ID NO: 26658 - DNA, 201 bp, Homo sapiens
ttggctcagggcagtgactcaggtcagtgcagcaggaggagaagctgaagcagcaccagctgcggatgctgagaaagaccccagacctgcctgtggcattyctgcataattggtgacagcctgtctgcccttctggccttcttgttaccagggcaacagtgggcctattcctagctggctgagaggttgctaccctcctct

SEQ ID NO: 26659 - DNA, 201 bp, Homo sapiens
agtctttgaaaagaaaatgattccaaaatacaaaaaaaaaaaaaaaaaaaaaaaagttaaaaagttaaacatcacgtttgtttggcttaaaataattatayatggcttgtaatgagggaaatccaaaattcacaagcctcttgatgtaaaataatttaaatatctttggtttgggattatgtggttactacaaaacatacc

SEQ ID NO: 26660 - DNA, 201 bp, Homo sapiens
atgtacttttgatgcttcaaggaataaaaagtctaaatagaattctaaatgcaaaacctctctctgtactactgaggattctcagatggaagaatacattkgttaaccatggtaacaacatatataatcaaagttttgcattattttgagcttggttataacaatgtgctacatccatccacacacacacagaaagagaag

SEQ ID NO: 26661 - DNA, 201 bp, Homo sapiens
ggggtcttgctctgtcacccaggctggagtgcagtgggacaatcttgactcactgcaacctccacctcccaagttcaagcaattctccctcctcagccttycaagtagctgggactacaggcatgcaccaccacaccccagctaattttttttttttgtatttttaaagatatggggttttgccatatcagtcagagtgtt

SEQ ID NO: 26662 - DNA, 201 bp, Homo sapiens
tgctggaccagctcacagaacccagggaaatgcttaattatatttacggttttattataaagtatatgacaaaggatacagatgaacagccaggtgaaggkatggatagggcaaggtttagtggggcatggagcttccatgccctctctagtcatgcactctcccagcacctccacatgtacagcttatcaaatcttattg

SEQ ID NO: 26663 - DNA, 201 bp, Homo sapiens
taaataatagtttgttttttaaaggggaaggaaggagatcagcaaaggtttcaggaatgatgaggactctaaagagaacccagggctttgcaaggtgaagrtgatcctctgagattgttttggtagcatggtcagactatcttgaattgaaaagtaattaagagcagtggaaagggagaaaattggcataaactttttgac

SEQ ID NO: 26664 - DNA, 201 bp, Homo sapiens
tcctgtgactcggctgaggccggtgtgatggagacttcccggcagcctcccggacctggtctctccaaggtcagatcttgaaacttctgggcacccatgcraatgcctgtcctggtgtgccgacttgctcttggtctgcgaagcctgtggacacatggtcaacatgaaaccaccttaacccgcttcccatcaggtctcgtg

SEQ ID NO: 26665 - DNA, 201 bp, Homo sapiens
tcctgacttcatgattcacatgcctcggcctcccaaagtgctgggattacaggtgagagtcactgcacccggcctccatataccagtgatagcagtgtttyatttacagtaattataggttttttttttttttgagacagagtttcactcttgttgcccaggctggagtgcaatggtgtgatctcagctcactgcaacctc

SEQ ID NO: 26666 - DNA, 201 bp, Homo sapiens
tatcaaatttaagaattgtagttcccagaatgagccaggtcagccttatcctgaggctgtagtcctctgaggttctagcttactatgggcatatttgtgtrtctcctgttagatccttcatcttgtgcaggtcttgggattgataaatattccttttgccccacaaggacatcaatactgaagtttaaacttttcagaata

SEQ ID NO: 26667 - DNA, 201 bp, Homo sapiens
aaaaagtcatttctagtgggatgttgttccaaataacctatgatcttatcataaataaaaggtttggccattttcttacataaagtgagaactccaaaggraattgtaggaagttttcttaggaaacaagggtcatagtagaaggaggtcatagtagaggaggtcatagtagaagaaggaatataggattaatgatatatg

SEQ ID NO: 26668 - DNA, 201 bp, Homo sapiens
aagaaggaaaaagagactagcgcagaagcaatattccaatagaaataggcagaacaatcaatcaataacctcttcatcaaaagaaacccttacaaattttwaaaaagcaagtcaaagacagggacgacatacttgcaatacatagacatgagctaggtgtatgtccaaaatagacaaagaagccctacaaatcaccacaca

SEQ ID NO: 26669 - DNA, 201 bp, Homo sapiens
aaaacactcgaacatatacatcactgctgtgcacaataacttgaaataaccagtgtgcaaatgggacaccaggctgggtactcatcatgggagaggaggamgaagttaggtccttgtccatcgctgagcagtgagctaggtgatgccgagaaatgttttgcttgggacctgtgtgaattctatcagtcagatctgtcagtt

SEQ ID NO: 26670 - DNA, 201 bp, Homo sapiens
actgctgtgcacaataacttgaaataaccagtgtgcaaatgggacaccaggctgggtactcatcatgggagaggaggaagaagttaggtccttgtccatcrctgagcagtgagctaggtgatgccgagaaatgttttgcttgggacctgtgtgaattctatcagtcagatctgtcagttgacctggcctcgctttgggaca

SEQ ID NO: 26671 - DNA, 201 bp, Homo sapiens
aggtggataaggcaatagaagaagctcagaaaagtaaggcaggggaggatgatcagaggataatgacactaggttaaggccagcagggctgggagagctgrgtaagaccagaagttaggactaattatgaagaccaactggttaatgttgggtagctaagatcagttgggtaattcctgttggtgagaacatgaggttaat

SEQ ID NO: 26672 - DNA, 201 bp, Homo sapiens
gatgggcggctgggcagagacgctcctcacttcctagatgggatggcggccgggaagaggcgcttctcacttcctagatgggatggaggccgggcagagaygctcctcactttccagactgggcagccaggcagaggggctcctcacgtcccagacggggtggcggccgggcagaggctgcaatctcggcactttgggagg

SEQ ID NO: 26673 - DNA, 201 bp, Homo sapiens
tgtaaaccaacgtgaaggtcatttgagtcatgtatggtcagtaagaccaggtgggaaaacatggtagctaatccaggttgttgaggccatgaggttaaggyccatagggttaggtctactgaggaagactaatgggttccagctagggtggtaaaatacgggaggcaaggacacggagtcaaggcaggggactaatcacgg

SEQ ID NO: 26674 - DNA, 201 bp, Homo sapiens
aaggattcctgtcacttctcacctctttctagctttatctccagtatttgaaatgcctggaggatccttaactgaaactctccactagtcaactgtgctgyactatagcacaaccactttaaaaaggtgaaagtaggaaaactagctcaatgagagggctaatatttttatggggccaatgatttgaattggtagacatat

SEQ ID NO: 26675 - DNA, 201 bp, Homo sapiens
ttgcacttttagtagagacgtgttttcaccatgttggccaggctggtttcaaactcctgacctcaagtgatccactcacctcggcctcccaaagtgctagkattacaggtgtgagccaccacatctggcctaattgtaagtttataaatttaatttttttttctttttttttcttgagacagagtcttgctctgtcaccca

SEQ ID NO: 26676 - DNA, 201 bp, Homo sapiens
tatgattgtgtgcttaccattatatttggaaaaaattagagtttacaattgaaggcttaggatgactctccagagagaattttctgtgcttgggatctttktccactaatagtcaaggaccacattatatcaaatttaagaattgtagttcccagaatgagccaggtcagccttatcctgaggctgtagtcctctgaggtt

SEQ ID NO: 26677 - DNA, 201 bp, Homo sapiens
atggccttccagcagacaggaggagagaggctcaatcccacaggtgtttgttgttgttgttgttgttgttgttgttgttgtgtgtgtgtttgcagaagttmtcactgatgcaatggtttaagcagaaattaaaagtctaattattatcaaagagtatttaagattatcattatctgcagataatatgctagctgttctcaa

SEQ ID NO: 26678 - DNA, 201 bp, Homo sapiens
tctgtgtcgttctccccatgtgttcatgtgtaaacagaactttttttacaccatgaacttcaaagtagtgaggaagcggtcgtgtgaagaaagggcatgcrtttttggaggagtgtcactaaaaaaatccatcagccacaaaataagtgacagtatgtgctcagtgtcaggacaatgattccaagctgccagctggtgaag

SEQ ID NO: 26679 - DNA, 201 bp, Homo sapiens
ttttcttttcttttcttttctttttttttttttgagacagagtgttgctctgtggcctaggctggagtgcagtggcacgatcttggcttactgcaacctcygcctcctgggttcaagtgattctcctgcctcagcatcccaagtagctgggattacaggtgtgtaccaccatgcctggcttatttttgtatgtttagtaga

SEQ ID NO: 26680 - DNA, 201 bp, Homo sapiens
aaatccatcagccacaaaataagtgacagtatgtgctcagtgtcaggacaatgattccaagctgccagctggtgaagcatctgccccattcccacaaccarttgcaccttaggctgtgatccaagtacggcgggcacctggaacccagggtcctccagcaactccataggcccaagaccacatggcacagagatgcactct

SEQ ID NO: 26681 - DNA, 201 bp, Homo sapiens
gttatctccatacagatgaaatgcctaggaataacttaacaagaaacgtgagagatttgtatgaagatataataagactttaccacaagatataaaaaatwacttcaataaatagagccataacatgttcttggatgggagaaccgaatattatgagattgtcaattcctaccaaattaatttatagtttaatatgactcc

SEQ ID NO: 26682 - DNA, 201 bp, Homo sapiens
ggagaatgaacagtaagcatgacttacatggtattccaaaattcaaatattcattcataaaaatgagtgaagccagtacatgtctcagagcctgcaactcrgtcccttatgccactcctaaacccaatccaaatctactctcagccagatcaccaggcagaatgagaaaagaaatactcattttccaagcacatccatctt

SEQ ID NO: 26683 - DNA, 201 bp, Homo sapiens
cataacatgttcttggatgggagaaccgaatattatgagattgtcaattcctaccaaattaatttatagtttaatatgactccaatcaaaatcacaatagkgttatttttggaatattacaaaaatcattccagagtgcatctggaggacaaataggcaatagtaactaatacattttgagggtaaataaagggtggtagg

SEQ ID NO: 26684 - DNA, 201 bp, Homo sapiens
attttgagggtaaataaagggtggtagggaggatttagccttccaagaaagtaaaacacaacagaagataacaataatgttatcggtttgtctctcctgcyagaataatttggcaggacagaatagataggccagaaagaacccataggatatatatgatgacgatgataaaggtggcatcacaaggcaggaaggaagggc

SEQ ID NO: 26685 - DNA, 201 bp, Homo sapiens
tgttggtccagttaaatctccaaaactggagtaattggttggagaaaaatttatgtcctaacacacgcaatatatgaagaataacctctacaaaagtttarctaatacaaattaaaatcaagatacatgatcaaatttttggatcaaggaagactgtctaggattaaaagcaaagacaaatatccctaggcaaagacacat

SEQ ID NO: 26686 - DNA, 201 bp, Homo sapiens
agaccaagcatctgaaaacacaggccttgctgggtttccccctcagtctattaccattagatcatacctttttgtctaatcacacttttacatggctatcsgttcttcacagactctaagcttaaacacagaaggtttttcctaggtctttgggtcttcatttctgaagcctcctctgtcacagaaaaatgtgattaagta

SEQ ID NO: 26687 - DNA, 201 bp, Homo sapiens
tgttgaaagtaatcttataaatatgtttgttggatgggtgggaatccaaggaagcttcaatctctaaacctttatctttagctgaaaaggaattcatctayaaccaaatataaaaacagtgataatagcttataactagtaagtttcctggatatgctaggcactatattcagtattttatttgcagttttatcatttaat

SEQ ID NO: 26688 - DNA, 201 bp, Homo sapiens
atttttgccagatatactattctagggtaaactttcttctccttcagcactttaaatatgccatgctactctctcctggcccataagctttccactgaaargtctgctgccagacatattggagctacattgtgtgttattcatttctcttctcttaggtttgagaagttctctgttattattcctttgaataaattttct

SEQ ID NO: 26689 - DNA, 201 bp, Homo sapiens
gggtcttctggatgataaaatgttagtctacccttttgtcagacagaggagggaatataaccagagagaggagacaacttgctaaggtcaaagtgatgatktatgtcggggtccagaaccaaacccaggccttctgggagttctttcccctgctctgcaaggccttccctagcaaaacactctgttgtctattaattcatc

SEQ ID NO: 26690 - DNA, 201 bp, Homo sapiens
attgcccattttcctgaccatgtagccagccatccactggccaatgcccatgagttggaatgcacccagactttggggaattgttcaattcttccatcackgtgagaaaaccagtaggcaatcaagccactgagcttatttgttctcaacttcttcaattagaatttttgcattatttggtcatagtgcagagccttccaa

SEQ ID NO: 26691 - DNA, 201 bp, Homo sapiens
ccgagtcaggcctcatgggcaagatcatgtgggtcttgaccagagatcaaggccagcaaattaaagccaggtaggtaagaacaagtggattatggcgggcrggaagttatgtccaggtaggtgaagccaggacttttaatctaggaaattaagactcggagagaatggccaggaggttaataaagccagatagataatgcc

SEQ ID NO: 26692 - DNA, 201 bp, Homo sapiens
catgatcttcactcactgcaacctctgcctcctgggttcaagcaattctcctgtctcagcctcccgagtagttgggactacaagtgcgtgccaccacgccyggctaatttttgtatttttagtagagacggggtttcaccatattggccaggctgttctcgaactcctgacctcaagtgatccacctgcctcagcctccca

SEQ ID NO: 26693 - DNA, 201 bp, Homo sapiens
tcaccatattggccaggctgttctcgaactcctgacctcaagtgatccacctgcctcagcctcccaaagtgctgggattacaagagtgagccaccgtgccrggccagatatggtattttcaatgtttcaaaatagtgcattgtgttctcacattttataatcctatttctgaaaaaacaatagtttgttaaccttgtagct

SEQ ID NO: 26694 - DNA, 201 bp, Homo sapiens
taatttctttaagtttgaaaaaaatcctctgaattattttttaaccagatgagaaaaacagaatggaatgccatagcttaacttaagtaaatttgaccctrtgctgataaacatttggatgttgcatatgatcacccaaaagtaaactactctgcagccaacttcaagtgacactctagtgtttagacaatagtgaacttc

SEQ ID NO: 26695 - DNA, 201 bp, Homo sapiens
tctgctgttaccaacaagggcaaaatccttgtacatatatctgcacatattttaaaaggaaagaataaattgatactctaagacttattgaagtacaaatkcattacaagtaaaaatagaaaaaagggattatccataatttctttaagtttgaaaaaaatcctctgaattattttttaaccagatgagaaaaacagaatg

SEQ ID NO: 26696 - DNA, 201 bp, Homo sapiens
tggcagtgggcagggcagagttaaaagctggggctctttccaggatgccagaagcatgcagggcacttcaccttttctttgcagttgagatcatccagtgwcatcattcgtagccagaaactggttgtaaaaaggcaagaactagatcactttacttcccataatagctttctacaaaggagagagatgctgccagctgag

SEQ ID NO: 26697 - DNA, 201 bp, Homo sapiens
tctgcaaagcagacaatactgtctgtctagcctccccagcaatgttgctaagagggtctaatgcataaaatatgtaagagtgttttgtaaacgataacackccatcacaattttaagatatatttattaccgtttctttagctaaattaattgtatgggcagaagaatgactaggcagtggaatgaactgacaggcagatt

SEQ ID NO: 26698 - DNA, 201 bp, Homo sapiens
aaggagagagatgctgccagctgagataatgcctaattttagctgatgctgctggacagactcaggatggtctcctctccctggccagaacccaacttagyacccctttaccagataaataatgatgcattagcaagagactcccggcgtcttcttcccctgaaaaggggtttggaccttaggagaaatcgtgtcctaagc

SEQ ID NO: 26699 - DNA, 201 bp, Homo sapiens
ttgtgtatgccatttaatgtctttattagcatatgtgtataagaataatcatgatgatagttttaatctaatactattttccttgtcatgacaagaactgsttaatgtgcaaaataataaacatgacttcacacttgctgcaaaaaatagtgaaaatctgcatcaatccagaaccacacaccaaatgatagtctgagttgc

SEQ ID NO: 26700 - DNA, 201 bp, Homo sapiens
tttggttcacattttggttcacaatgggtcataatcaggcaccaatcttgcttgtttcccagcaatatttgcagatatgcaaactggccccttgcatgcamatcctggagcacgtcctggagcctttagaggtgagtgagaaggtaagtgtagtgaaatcctcttgaaggattttaagaggcagagcctcagacaagtggt

SEQ ID NO: 26701 - DNA, 201 bp, Homo sapiens
tccaatttcagggagtaatcagtgaaatcagctcattagtgtagccatctgagcaggcatcatctgaaatactctagatacacttaagaggaaagaaatgyatcttgctcactggaaatggattcttgcaaagttcatcataacctttatttctcaatgaggttttctgtatggctttctgtggtatgatgtctaaacagg

SEQ ID NO: 26702 - DNA, 201 bp, Homo sapiens
tctgcaacctctgcctcccagattcaagcaattctcctgcctcagcctcccgagtagctgggattacaggcatgcaccacaacgcccggctaacttttttkttgttgttgttttgttttttttgagacagagtcttgctctgtcccccaggctggagtgcagtggcgggatcttggctcactgcaggctctgcttcccgga

SEQ ID NO: 26703 - DNA, 201 bp, Homo sapiens
ccccttaaagtaaagctactgcatgaaaaccataccaatattaaaaactatgggtaccaacttttatttgattcacatatttggggccataaaacaacacracaaatggccaaaaagctgattttctcctcccagagaagaggagccttctttagggagctgagttgtggtgttggagctgatcagtaacactgggtagga

SEQ ID NO: 26704 - DNA, 201 bp, Homo sapiens
cgactaaaagcaccaaggacaaaatcactatactgcggaaatattgtttattctagagagtgaacaattatttaaggtgtctaaagatatcaacagcaggrgtggttgtcctgtcctatttttcaagagtacagtgctcacagagggaagcatttctcatgggccatttgttgcagtgccactaagccgtacctcagggat

SEQ ID NO: 26705 - DNA, 201 bp, Homo sapiens
ggcggggagaatatgacttgggagctattgttatgatggccgttctaggaaaacaccctgccatgggagcccatgcctcttttccagcctcgaacatctcrgattccaatagagccaggtgaaagggcaccacgcctctagacaggtgcatatcgactaaaagcaccaaggacaaaatcactatactgcggaaatattgtt

SEQ ID NO: 26706 - DNA, 201 bp, Homo sapiens
taagcaagagcatgcattagttgacgtttggtttctgatggttgtcaccactgatccatttcccttgttggagcccctcactcccatgacgcatccgtggstttcgtgtacctgtgagacacatctgaccttcacttggggcctcttcctatgctcctcaatctagtaacgcttcagccccagtctcctcttccttcctta

SEQ ID NO: 26707 - DNA, 201 bp, Homo sapiens
gctgggaggtggtgtgggccgctccctttgctgttccccaccccttccccatccttctgtagaggacggaagctgtctccttaagcaagagcatgcattarttgacgtttggtttctgatggttgtcaccactgatccatttcccttgttggagcccctcactcccatgacgcatccgtggctttcgtgtacctgtgagac

SEQ ID NO: 26708 - DNA, 201 bp, Homo sapiens
ctgttcaggaggacacgcaagggaaagtgccaagttcaaacttcccacaaatatctttattcaaattttcctggggatgtcctccacctagtagacttgcycctaagtgagagagaccgagagaagactctcgcatctgcctgaatttggattaaagcctaatgataatgatttgtgatttggggaagaggaaaatgagga

SEQ ID NO: 26709 - DNA, 201 bp, Homo sapiens
aaatattttaaaaagggtttcaaggtccaaataggatcatgagaataggtggttagattggagcagagtgttgaagctgggggaagggagatataagtacyttaaggccagattgtcagctgatttggccatgtaggtgttgaagtgatgatagtgtgagatggatcggagtcagagagaaagctgggagtcaggtgccaa

SEQ ID NO: 26710 - DNA, 201 bp, Homo sapiens
tgtaagtgtacaattcagtagcattaaatacattcacaatgttttatgactgttactgctatctatactcaaaacttttttcttgtcctccccaaaaactytgtagccattttataagtctctcttcccctaccctccagccatataagttgattcatatagtatttgtttttctgtgtttggtttatttaactaagcata

SEQ ID NO: 26711 - DNA, 201 bp, Homo sapiens
gaccatatgaattatgcataaagaacttaactcaagccatgcatataaaatgggcattcagaacacaaccttgactctcttattcttttataaatagactyccacagggcttgctagcctagtgtgtacacctctcctaagcacaaaatggagtttgctttgttggtttgaaactaatttacaaaattgagatgactaaga

SEQ ID NO: 26712 - DNA, 201 bp, Homo sapiens
agatccatatttgtattaatcaggggatgtcaaagaaatggaaccaataggagatgggtggggagcctatggtggaagtcctggcccaagaaccaggagtyccaatgtctgagggcaggagaagatgatgtcccagctcaaacagaagaaaattcacccttcctctgccttttgttctattcaggcccgcaatggattgga

SEQ ID NO: 26713 - DNA, 201 bp, Homo sapiens
gctcactcctgtaatcccagcattttgggaggccaaggcgggcggatcatgaggtcaggagttcgaggccagcctggccaatatggcaaaaccctgtctcyactaaaaatacaaaaattagctgggcatggtggcaggcgcctgtaatcctagctatttgggaggttgagttaggagaatcgcttgaacccgggaggcgga

SEQ ID NO: 26714 - DNA, 201 bp, Homo sapiens
agaagatgatgtcccagctcaaacagaagaaaattcacccttcctctgccttttgttctattcaggcccgcaatggattggataatgccaacccacattgrtgagagtggatcttatttattcagtttacagattcaaatactaatctcttccagacacaccctcagagacaccccagaaataatgttttactaatgattt

SEQ ID NO: 26715 - DNA, 201 bp, Homo sapiens
gctgctggacagactcaggatggtctcctctccctggccagaacccaacttagcacccctttaccagataaataatgatgcattagcaagagactcccggygtcttcttcccctgaaaaggggtttggaccttaggagaaatcgtgtcctaagcataaagatgtggtaaaaatcctacttttctcaacagcaaacaagtct

SEQ ID NO: 26716 - DNA, 201 bp, Homo sapiens
ccctttaccagataaataatgatgcattagcaagagactcccggcgtcttcttcccctgaaaaggggtttggaccttaggagaaatcgtgtcctaagcatwaagatgtggtaaaaatcctacttttctcaacagcaaacaagtcttctacttcccatggagaaacctgttactattgagtgatttttttaataagatactc

SEQ ID NO: 26717 - DNA, 201 bp, Homo sapiens
aatgggcaggtctcccagtgctaagtattaacgtgcttaagaagcacattaatatttcattttcatcatctgggggttctctccattttctgagatgttasagagtaaaatggggccataggtaatagagtcatttcttctttgaagagtcattattatcactcaaagttcatagttcacattagggttcactcttcatgt

SEQ ID NO: 26718 - DNA, 201 bp, Homo sapiens
atcatcatagacaatcataactaaaatgtaagtttcacaaaataacaccctttaccaaatgggatacattctgatattttctcttctgttctattctagamtattctattccatattttaaaaggctgtcatgatccactaaatgtaaattactaataaattcaggattgctaatgggttgcagcctgcattttaaaacaa

SEQ ID NO: 26719 - DNA, 201 bp, Homo sapiens
caggtacacaccaccacaccaggctaatgtttattttttgtagagatggaggtcttgctagggggcccaggctgttcttgaatcttggtctgaagccatcytgctgcctctgtctcccaaagtgctaaagtgctaggattacaggtgtgagccactgtacctggcaaactttataattttaaaagtgaatccttaatatca

SEQ ID NO: 26720 - DNA, 201 bp, Homo sapiens
ttcacattagggttcactcttcatgttgaacattctgtgggtacaatgcattttgacatgtatctaccattactgtatcacacagaatagtttcactgccytaaaaatcctctgtgctctacctccttctcccataacacctggcaaccactgatctttatactgtatccatagttttgccgttgccagaatgtcatagag

SEQ ID NO: 26721 - DNA, 201 bp, Homo sapiens
tttgatgaaaagggccctaagttccaatgatagaatttgataggaaaacatagatacaacagttaatttagtttttgagatagggtctccctctgttgccyagactggagtgcaatggcacaatcacggctcactgcaacctccacctcccaggttcaagtgatcctcccacctcagcttcctgagtagctgggactacag

SEQ ID NO: 26722 - DNA, 201 bp, Homo sapiens
tttgggaggccgaggcgggcagatcacctgaggtcaggagttcaagaccagcctggccaaaatggtgaagcgttttctctactaaaaatacaaaaattagycaggagtggtggtgtgcgcctgtagtcccagctgaggcataagaattgtttgaaccagggaggaggaggctgcagtgagctgagatcttgccactgtatt

SEQ ID NO: 26723 - DNA, 201 bp, Homo sapiens
tagaaaccacgcatggtagagccttgaaataagaggagcctgggtgaacaccatggagaatgatgccagccctggcccattcatcaacctcatatgtccakctgaaagatggtccagctagcatctttaccctaccatgttgcctcttggagttttactcacaggagcaatgtcacctggtagttaagaatgcttgctttc

SEQ ID NO: 26724 - DNA, 201 bp, Homo sapiens
gcattaacacttcagtcctgaatcatggaacagtcctggaagtggaaaggtaatggtagagtgtgtatgcatgagtgggagggggctgttactcagtgggktcagggcagtgagtatataccaaccagtaaagaaatacttctgtagtttaacaatctgctattgtgtagtatcagagtgtcagctttgctgctaggatga

SEQ ID NO: 26725 - DNA, 201 bp, Homo sapiens
gttgttccatctggttttcttctttcaaattcgcactgactgttcacaagccgcctggtcagttttcctccagattccttcacaatgcggtcaagatgctyctgctctctctctaaattattgcttttaaacttatcttcaagcgtatctttttctttttctttgctgggactcttgaaggcgtgtgcttcggcatctcca

SEQ ID NO: 26726 - DNA, 201 bp, Homo sapiens
ctcgacctcctgacctcaagtgatctgcgagctttagcctcccaaaatgttgggattacagacgtaagccaccacgcctggcccagaaacacatattctawaaaccaacttgaattagcagcagagatgtatatcccttagatatggtattttctttctttctttctctttctttctttctcttttctttctttctttctt

SEQ ID NO: 26727 - DNA, 201 bp, Homo sapiens
ctgtgactcggctgaggccggtgtgatggagacttcccggcagcctcccggacctggtctctccaaggtcagatcttgaaacttctgggcacccatgcaartgcctgtcctggtgtgccgacttgctcttggtctgcgaagcctgtggacacatggtcaacatgaaaccaccttaacccgcttcccatcaggtctcgtggg

SEQ ID NO: 26728 - DNA, 201 bp, Homo sapiens
gtgtcatccatggcctggggcactccaagggtctgtgggagcaagcaagggaggccgtcctacctgcttcctcatatgtccgttaaagttaaaagtccttktattgatgtgactttgacttggactcatgggactcagaaaagctgttatactcatggttgtagtttactaaatatatatagtttgtgaaacatgttttag

SEQ ID NO: 26729 - DNA, 201 bp, Homo sapiens
gataatccagttattaaaactcagcctcatttgttttaaaactccaacttcatatactttttaaagtgttattttgattttaattggcatataattgtacwtttccatgatgtttcgatacatgtatacgttgtataatgatcaaatcagagagattagcatattcatcacctcaaacacttgtgattcaaatctttcttc

SEQ ID NO: 26730 - DNA, 201 bp, Homo sapiens
atccagtgtggaccacagcagggtctcagagaggcaggaaagaacctccctcatcagtgccagtggctcagaagctggaagaactgcacagctgtgggcasgccagtaggcagtgatccagggaatggagacccaggggtcttcttaccaggaagtgaacatgtggaggagcaaaaagagagataccctgtgaataaagca

SEQ ID NO: 26731 - DNA, 201 bp, Homo sapiens
aaaaatgaatctagacacagatcttcacaaaaattaactcaaaatgtgtcatagatctaaaggtaaaatgtaaaactgtaaaactagaagataacatagargaaaacctagatgatcttgggtttggtgacgacttagataaaagaggtgattagaagtaagcaagggctgtgagaaacagggtaaaatgtttgaatttgg

SEQ ID NO: 26732 - DNA, 201 bp, Homo sapiens
gtaattatccttcatccgctaatttctaggcaggaaaaatatgattaaaatgagtttccgcacagctgttgattaggcataatgggaaagtcatcatcataaaactaataatcagagcagagctaacatttggaaagttattgttgagtaaccggaaggctctaaaagccaaaaacaatgtccaactaactagaaaattac

SEQ ID NO: 26733 - DNA, 201 bp, Homo sapiens
tatattcctttgggtatatacccagtaatgggattactgggtgaaatggtagttctatttttagctcaaagtgacactcttaatcacagtgctgtaacatyatcatcatcagcagcagcagcatcctaatacatttttagcagagttttgtacacattaaatcatttaatcctcataaccttaaagagagttattattatc

SEQ ID NO: 26734 - DNA, 201 bp, Homo sapiens
tagttcacagcaacctcaaactcctgggctcaagccatccttgtgcctcagcctctggattggcgaggatgataggcatgcaccaccatgcctggctaatkttttaattttaatagagacaaaattttgctgtgttgcccaggctggtcttgaattcctggactcaagccatcctcccgcctcggcctcctaaagtgctgg

SEQ ID NO: 26735 - DNA, 201 bp, Homo sapiens
acaatacttattgtatacctattatgtgccagcactgtttaggtatgataaacttaaacatagcatttgtgccactttcttgaccatgaaatcatggtttwtgtaatatgctaacactacttgttgcaaagagtggcatttgggagatgttggctaggtcttcctgatcttttgttagcatttggccgtctaggatagatg

SEQ ID NO: 26736 - DNA, 201 bp, Homo sapiens
tctgtactggactggttcaaaggaagaacacttaacattgtgtttggctgcaagtaacagaaaacctgaagaaatggtggcttaaacaaataagaactttwatttttttctcatgtaaaagaagtccagagggaggcagcagggagctggtatgtggttcggtgatgtcatcttgttgcctcatggttacaatatatcaac

SEQ ID NO: 26737 - DNA, 201 bp, Homo sapiens
cccacctttgggctgtgggctggtaccagtccatggcctgttaggaactgggctgcacaggaggtggtgagcagtgccagtaagaattaccgcctgagctytgcctcctgtcagatcagcagatcacaggagtgtgaactctactgtaaaatgcatatgtgagggatctaggctgtgcactccttaagagaatctaactca

SEQ ID NO: 26738 - DNA, 201 bp, Homo sapiens
aggatttcttgagcccgggaggtcaagattgcaccactgccctccagcctggatgatagagtgagactctgtctcaaaaaaaaaaaaaaaaaaaaaaaaaaagaagaataaagatgagtaggataagggtttggaggcattcaatgatgagatacagagtgattgatgaatgctactttagggtgactagggaaaggcctc

SEQ ID NO: 26739 - DNA, 201 bp, Homo sapiens
ctgattgtgaatgaatgaccttttagaggattcctgccccctgcctttgattctttcagccaatgtctgagatattgagtagagccaagcaagccttgttrtgcctgtttgaacccctgactcataggaactgtgggaaataataaatgatttttgttgttttaaaagcctctaagttttggggtgatttactacacagcc

SEQ ID NO: 26740 - DNA, 201 bp, Homo sapiens
tcctaacactttgagaagctgcagcaggaggatcacttgagcccgggagttcaagggcagcctggaaaacatagcaagaccctgactctacaaaaaacttytaaaaattagccaggtgtggtggtgtgtgcctctagtcccagctactcaggaggctgaggtaggaggattgcttgagcccaggaatctgatgctgcattg

SEQ ID NO: 26741 - DNA, 201 bp, Homo sapiens
ttgcatatcacaccctgacccatattcattgccacagcggtatcggagggtggtgacatgaggggcgatgaggcttcaggagccggtgctaacagtgatamaggattaggggacgtggcagctcttctgagaggcaagaaggtggtgagaagtgtgatgaccttgcttctaaatctcaattctgccaccactgactctatg

SEQ ID NO: 26742 - DNA, 201 bp, Homo sapiens
gcttctgctgtcctcataagtacaacttctaacttggtttacaagcccttggtgaccttgcccatccttgtcctgccagcctcctttctccacattccatwgccatcctatcactcacattcttcacagcattccctaattaaaagctgaggatttcttcacaaaccaagacctctgcatgtgttcctctctctgactcaa

SEQ ID NO: 26743 - DNA, 201 bp, Homo sapiens
tctttaatagaacaagtagatgacatttcaatggatagattattcttaagaaataaggagtcttggtttttatccctcttattggaaaccatgagtcaatrgcagtattgctttgtgtaagtctctttcaacagttatacaatgctttaaaaattcctagaagttttgatacaagttttcagctaattaatgtgataacag

SEQ ID NO: 26744 - DNA, 201 bp, Homo sapiens
gagtgggagggggctgttactcagtggggtcagggcagtgagtatataccaaccagtaaagaaatacttctgtagtttaacaatctgctattgtgtagtakcagagtgtcagctttgctgctaggatgattttgaggattaaatacgatattgcatataaggcacttggctcatggtaaatacagaacaaatggcaggtat

SEQ ID NO: 26745 - DNA, 201 bp, Homo sapiens
aatcctctttcgcccagttctccttcctcttcttcattctgcttgtttaaactccattcatgttttaaatctcagatttcctccagaaagtctttcctggccccccagactaagctaggtttcctagccctataatcattagtctttgttgtgattgcctgtgtccccattggaccatcaattctgtaaagcaggggacca

SEQ ID NO: 26746 - DNA, 201 bp, Homo sapiens
gtggggtcagggcagtgagtatataccaaccagtaaagaaatacttctgtagtttaacaatctgctattgtgtagtatcagagtgtcagctttgctgctargatgattttgaggattaaatacgatattgcatataaggcacttggctcatggtaaatacagaacaaatggcaggtattacggctgtttttggtaattttc

SEQ ID NO: 26747 - DNA, 201 bp, Homo sapiens
ttgcttggcccccattgtgtctccaagggcttttctgtatgacttgggagatgctgggaaatcactctcccaggctgactgaaggctgggagaaaacagcrgagaacaaactcctctctagtttgttgcctgggctgccactgaccccatttctgctctctgcctcaagatcaggccttgtgtggcatgctgggtggtgaa

SEQ ID NO: 26748 - DNA, 201 bp, Homo sapiens
agggaaagcactggagggaaataagtgtaattgcttctcatttgagatattcagcaatgtctgatgtatatctccagggaggatactttcagtttaggggrggatttgagaacttggtttggggattctaagcctagcatgaacagtgaagaaaatcttttatgcctctgtacagaatcatcaccaagcaactttcaggca

SEQ ID NO: 26749 - DNA, 201 bp, Homo sapiens
actgctgtgtcatccatggcctggggcactccaagggtctgtgggagcaagcaagggaggccgtcctacctgcttcctcatatgtccgttaaagttaaaartccttttattgatgtgactttgacttggactcatgggactcagaaaagctgttatactcatggttgtagtttactaaatatatatagtttgtgaaacatg

SEQ ID NO: 26750 - DNA, 201 bp, Homo sapiens
ttgtgctctcctggccacttcctcagatgaccttctaggcagaattgccagatcaaaagggtacacaccttggaagcattgatgtgggatgcctgtctcttttttttttttgagacagagttttactcttgttgcccaggctggagtgcaatggcttgatcttggctcaccgcaacctccgcttccggggctcaagcgatt

SEQ ID NO: 26751 - DNA, 201 bp, Homo sapiens
gggatgcctgtctcttttttttttttgagacagagttttactcttgttgcccaggctggagtgcaatggcttgatcttggctcaccgcaacctccgcttcyggggctcaagcgattctcctgcctcagcctcctgagtagctgggattacaggcatgcaccaccatgcccagctaattttgtatttttagtagagatgggg

SEQ ID NO: 26752 - DNA, 201 bp, Homo sapiens
tcataatgctttgacttctgatataaccttttggggtgtttatgtacttttgatgcttcaaggaataaaaagtctaaatagaattctaaatgcaaaacctytctctgtactactgaggattctcagatggaagaatacatttgttaaccatggtaacaacatatataatcaaagttttgcattattttgagcttggttata

SEQ ID NO: 26753 - DNA, 201 bp, Homo sapiens
ggatgtaagtctgttaagtaagatattaatctccttaattacggaaattacatagaaacctttatttttattttaaagtaatacacacatcatttattaattgttgtttccagatatattaattacaagcatggttttagacagcattggaaaagtatttatatggtaaataaaataacttctagttgtcaaggaaagtga

SEQ ID NO: 26754 - DNA, 201 bp, Homo sapiens
tatttttggttcaagggtatatatgcagctttgttacacaggtaaactcatgtcgcaggggtttattgtacaaattatttcttcacccaggtaccaagccytgtagtatcaatagttatttttcctgatcctctctctcttcccaccctccatcctcaagtaggccccagtgtctcttgttcccctctatatgtccatgtg

SEQ ID NO: 26755 - DNA, 201 bp, Homo sapiens
gatgtaagtctgttaagtaagatattaatctccttaattacggaaattacatagaaacctttatttttattttaaagtaatacacacatcatttattaattgttgtttccagatatattaattacaagcatggttttagacagcattggaaaagtatttatatggtaaataaaataacttctagttgtcaaggaaagtgaa

SEQ ID NO: 26756 - DNA, 201 bp, Homo sapiens
gttagctggcctttagtaacagcatgctcttttatgcttgcgtacttgtacctctgcactattgcatgttgtggctctaataatatatatttgcttactgtttttttttttttcattgctaacatttccatggagtagccctgttctctataacccatcacccaggataatagccacagactatgatccacatagatattt

SEQ ID NO: 26757 - DNA, 201 bp, Homo sapiens
atgtaagtctgttaagtaagatattaatctccttaattacggaaattacatagaaacctttatttttattttaaagtaatacacacatcatttattaattgttgtttccagatatattaattacaagcatggttttagacagcattggaaaagtatttatatggtaaataaaataacttctagttgtcaaggaaagtgaaa

SEQ ID NO: 26758 - DNA, 201 bp, Homo sapiens
agtagttgaacaaggccaagtgggtaaggccaagaaaatacagccatgtgggaaggccaataggtgaagtccaagaaagtaaagcaaggggctgggacagygaataatgacactaggttaaggtcagtagggctgggacagctaagtaaagccagaaggttgagactaattgtgaaggccaactgggtaagcctgggtagg

SEQ ID NO: 26759 - DNA, 201 bp, Homo sapiens
catcttagttattttgcatatgagtatgtaccaaatgttacaaatgttattcatcaccctttataatagtgtctctgttttagagatgaagaaattgaaawaaaatttttttttgagataaggtcttgctctgttgcccaggctggagtgcagtggcctgatcatggctcactacagcctccacctcctgggctcaaggga

SEQ ID NO: 26760 - DNA, 201 bp, Homo sapiens
gcatgaaccagggaggcagaacttgcagtgagccaagatcgcgccactgcactccagcctgggtgacagagcgatattccatctcaaaaaaaaaaaaaaawttatttatatagtacttatatattatctatgtactttttcccagacacacacagtgaacaagtgatcactgggctcctttcccaggcacagtttttgtaa

SEQ ID NO: 26761 - DNA, 201 bp, Homo sapiens
gaattctgttatagcttcacaaaacaaactaagacatgtatacaggtgctcaccactctcttctgttcacttgtctttttttttgtgtgtgtgtgtttttwtttatttatttatttatttatttatttatttattttattgatcattcttgggtgtttctcacagagggggatttggcagggtcataggacaatagtggag

SEQ ID NO: 26762 - DNA, 201 bp, Homo sapiens
ggaggctgagtcaggagaattgtttgtacctggaaggtggaggttgcagtgagccaagatcgccattgcactccagcctgggcaacaagagtgaaacttcrtctcaaaaaaaaaaaaaaaagaaagaaagaaagaaagaaaaaattagaactaaacaggtgttcttgtctgtccaacatagactggtagactcagagggag

SEQ ID NO: 26763 - DNA, 201 bp, Homo sapiens
agcagtgaggagaagaggggctgagagacagttaaaaggcagtagggtagatgaattatcagctcagtgaggtactggaaagaatgagatgtgttggggcwcagattgtgatactgctaagtatggcaccttagcatgctgagtattttgaactgaaagagactgtagagtttcagaggcaaggtccctctgaccttctcc

SEQ ID NO: 26764 - DNA, 201 bp, Homo sapiens
gtttgtacctggaaggtggaggttgcagtgagccaagatcgccattgcactccagcctgggcaacaagagtgaaacttcgtctcaaaaaaaaaaaaaaaaraaagaaagaaagaaagaaaaaattagaactaaacaggtgttcttgtctgtccaacatagactggtagactcagagggagtattccaatgttcggaaactg

SEQ ID NO: 26765 - DNA, 201 bp, Homo sapiens
gagtattttgaactgaaagagactgtagagtttcagaggcaaggtccctctgaccttctcctgccctcctgtgtctcacccctctctccctaattgagtcrtagaaaccagaactcctgttctccaaagctgaccatagcaactagaacccctctctccaaaatcaagccatacaatctaaaaggtgtatacttgaagcct

SEQ ID NO: 26766 - DNA, 201 bp, Homo sapiens
agtgctgggattacaggcgtgagccaccatacctggccccatccttgacttttaacatgtacagagcaaccaataacgagtccttcctcaaagtaaagtgaaatgaataataaatgtctaagactttgtggttaaacctaactccacactgaggtgggtcctgtccctgttgatctaaattttcctccactaggggtctaa

SEQ ID NO: 26767 - DNA, 201 bp, Homo sapiens
cgcctgtaatcccagcactttgggaggccgaggcgggcagatcacctgaggtcaggagttcaagaccagcctggccaaaatggtgaagcgttttctctacyaaaaatacaaaaattagtcaggagtggtggtgtgcgcctgtagtcccagctgaggcataagaattgtttgaaccagggaggaggaggctgcagtgagctg

SEQ ID NO: 26768 - DNA, 201 bp, Homo sapiens
agtaatgctttttatttattattttattattattattattattatttgagatggagttttgctcttcttgaccaggctggagtccaatgttgcgatctccrctttctgcaacctctgcctcccagattcaagcaattctcctgcctcagcctcccgagtagctgggattacaggcatgcaccacaacgcccggctaacttt

SEQ ID NO: 26769 - DNA, 201 bp, Homo sapiens
aattattgttagtaaatattatatgtaattactacatgacatttattaagaacatagacaaaataatcatgaaaatgaacatttcagtagatggatagaaraaatattaagaaggaattcacaaaaagaaaaatacaaatagctaatgaatatgtttaaaaagtcatatacacaaatgatcaaagagatgcagttaaaatg

SEQ ID NO: 26770 - DNA, 201 bp, Homo sapiens
gtcaggaatgatagtagtgaacaagacaggcacagtccctgcccttggggaatttgctttctagttgagggagacatcagcaatacattaatcagatataytgtggataacagtgttataaaggaaataaggcaggttaatgcaatggaaatggtttggggtctagagggccccctgatctgaatggcaggacagatcctg

SEQ ID NO: 26771 - DNA, 201 bp, Homo sapiens
aatcatggatgatgagaagaaaaggaagtctgctttttgacactgctcttctttgtattatttacttacaggtcctgttttaaagcatcctattccttggytgtctttcctttggctctttggcaatagttggttttgatcccagctctttggctcctgggccaaggctgagtgagtgccagacagggtaaactagttcac

SEQ ID NO: 26772 - DNA, 201 bp, Homo sapiens
catctcagacgatgggcggctgggcagagacgctcctcacttcctagatgggatggcggccgggaagaggcgcttctcacttcctagatgggatggaggcsgggcagagacgctcctcactttccagactgggcagccaggcagaggggctcctcacgtcccagacggggtggcggccgggcagaggctgcaatctcggca

SEQ ID NO: 26773 - DNA, 201 bp, Homo sapiens
catctcttgagtttttcaatacttacctttggatgtctggccagaccatgtcctagaactgttctgtcttcccaaagtcctggacctttaatggggcagckgacaactaaatatttttcatgttaattctctgatttagtcattcttaggtgtgagatacactttcaaggtttagtttcttttgaataaagtagtttgtta

SEQ ID NO: 26774 - DNA, 201 bp, Homo sapiens
tgccagtccttgccaaggtagattgcttccagttttgagagactggttagacttacaggtgtaaagtgatagtgaccacagctataaaaacaaaggaagtrccaggacaaggagttaagtagatcattacaatagggacatttgtccatcatactgaagagccccaggctgctagtttttttttttttaactgttagaatt

SEQ ID NO: 26775 - DNA, 201 bp, Homo sapiens
agcccatttgcttctctccatatccatcatctctggcctggacaactgtgtctgcttcctactcaggaaggagtcttcctgcctccctgcaatctaatctycacacagaagccaggggatctttggaaaaatctgatactgtctgtgataaagaataacttgaggaggtatgcatgggacacagagcacagagccagattg

SEQ ID NO: 26776 - DNA, 201 bp, Homo sapiens
ggaggtatgcatgggacacagagcacagagccagattgtctgggttgaaatcctgatgacaccattaagaagccaggagttcctttttaaaaacaaaaacttttttttttttttctgagacagggttttgctctgctgctcaggctgaagtgcagtggcatgatcatagctcactgaagccttgacttcttgggctcaaat

SEQ ID NO: 26777 - DNA, 201 bp, Homo sapiens
ctacttcattgaggcttctagaccctcacctccatttttccgaagtcttatttttctgccctctcatagtttcacagtgtttcatgtttcaaactgggacrtgagtttaccgttgacaaccgtttcctaagagctttctaacctcctcaccatctttgcttaaatcattctccaatctggaaatgactcagcatttacaga

SEQ ID NO: 26778 - DNA, 201 bp, Homo sapiens
ctgcttcactcatatcccttagcattaatgggacattctcctcttatatcttaggctgcttctaaacttccttaacttaatcatgtctgcaaagtcatgtwatctaaacaaggtaacattaatttggttccaaggattaggacctagtatctttttggagacattattcagcctgctacagactgctattgattttggtgt

SEQ ID NO: 26779 - DNA, 201 bp, Homo sapiens
ccagggaggaggaggctgcagtgagctgagatcttgccactgtattccagcctgggtgacagagtgagactctgtctcaaaaaaaaaaaaaaaaaaaaaaraaaagaaaaagaaaaagaaaaaacaaaaattgggttcattttgggttttgttgcacaaatatacatatttaagcacctgttaggtgcaaggcattatggc

SEQ ID NO: 26780 - DNA, 201 bp, Homo sapiens
tataataaactgtctttattaatgagctatagtttgagtaattaacacaaattcagaataagtagtaccatttaatgagtttatgtttttaacaagtacadtaattagaaaggcctcatgcacacttcctgggaagctagaatagctgatcatattctgctaatgcggagggaggttcccccaagaacaacagggacaatg

SEQ ID NO: 26781 - DNA, 201 bp, Homo sapiens
ttaaaatttgtatttttttattgttgtttttaaaacattttccaaatatttcatgtgtgtatatatatgtgtgtgtgtgtgtgtgtgtgtgtgtgtgtgtrtatatatatatatttatgtattaagacagggtcttgctctgttgctcaggctggagtgcagtggcatgatcatgactcactgtagcctccatctctcagg

SEQ ID NO: 26782 - DNA, 201 bp, Homo sapiens
ttattaaggaaagaggtttaattgactcacagttcttcatgactggtatggcctcacaatcatggtggaaggtgaagtaggagcaaagtcttgtcttacayggtgggaggcaagagaatgtgtgcaggggaactcccctttataaaaccatcagatcttatgaaacttattcactaacatgagaacaacatgggaaagacc

SEQ ID NO: 26783 - DNA, 201 bp, Homo sapiens
cacaattcagtgttgactatgatattctgaaaagcacacaggccgggcatggtggctcatgtctgtaatcccaatgcttttggaaggagaagcaggtggaycctcggtgccaggagtttgacaccagcctgggcaacaaagggagacctcagttcttttttttttgaggtggagtcttgctctgtcacccaggctggagtg

SEQ ID NO: 26784 - DNA, 201 bp, Homo sapiens
cagagttgttaaaatatgcatgtgtcttgttgagatgatctaacagtacctcatatcccccagacaccccaggatgatggaggtcatcctgactcctccawctcccttgcctcacacctctggtcactcttcatgtcctggggactcttcttcctcagtgtctctcacatctagcacttcttctaactctcatggccacca

SEQ ID NO: 26785 - DNA, 201 bp, Homo sapiens
ttagtagagacggggtttcaccatgttggttaggctggtctggaactcctgacctcgtgatgcgcctgcctcggcctcccaaagtgctgggattataggcrtgagccactgcgcctggccgagaccccatttctataaaaatttttaaaaattagccaggcatggtggtgcgttcctgtggtctcagctacttgggaggct

SEQ ID NO: 26786 - DNA, 201 bp, Homo sapiens
tgaggcaggagaattgcttgaatcccgggggcgaaggttgcagtaagccgagatcgtgccactgcactccagcctgggcgacagagcgagactctgtgtcaaaaaaaaaaaaaaaaaaaaagaatgctggtggggcgtggtggcttatacctgtaatcccagcattttggcaggctgaggcaggaggatcacttgaaccca

SEQ ID NO: 26787 - DNA, 201 bp, Homo sapiens
gccactgcgcctggccgagaccccatttctataaaaatttttaaaaattagccaggcatggtggtgcgttcctgtggtctcagctacttgggaggctgagrtgggaggatagcttgagcctgggaggttaaggctgctgtgagccatgatggctgcagtgagtcatgatggtgccagtgcactccagcctgaatgacagag

SEQ ID NO: 26788 - DNA, 201 bp, Homo sapiens
ggtatatctcctaatgctatgccttccccctccccccaccccactgcaggccctagtgtgtgatgttccccttcctgtgtccaggtgttctcattgttcawttctcatctatgagtgagaacatgtggtgtttggttttctgtccttgcaatagtttgctcagaatgatggtttccagcttcatccatgtccttacaaagg

SEQ ID NO: 26789 - DNA, 201 bp, Homo sapiens
tgttaacagcacataaaggcagtgaggacccaaaaaaaaagcagcagcaagatttagcgcaaagagtgaaagaacaacgctcccacaacaagcaaggggasgagttgccactcttgcttctggcagcctgcttttattcttatctggccccacccacatcctgctgattggtccattttacagagagccaattggtctgtt

SEQ ID NO: 26790 - DNA, 201 bp, Homo sapiens
taaaagtaaaataaaataaacatttaagagtaatccaggagaattcatgggccactgaacaatgtattccatgtctgttacttgatgcaatatgctatgasttctagacattctccaaacaggccctgtggaggaggaggaactgaagctgtcttcctaagttgtagactctaggtaagtgaacaggctggtgatacggtt

SEQ ID NO: 26791 - DNA, 201 bp, Homo sapiens
tgttttccaacgtgctgagtgatattgtaggagactattattttgctggaatttctatgaatacatctatgaatacatttaaaataaaaagtgttttttgtttttttttttgagatggagtttcactcttattgcccaggctggagtgcaatggcgctcccttggctcacacaacctctgcctcctcggttcatgctattc

SEQ ID NO: 26792 - DNA, 201 bp, Homo sapiens
agaaaagaacaaggaaaagaagaaggaggcatgaatactttctagacttaggtagtgagtctgggataactggaagtggataattgtgagctccttgaagsccaggccattgtctcattcatctttttatcctcagtgtttgaaccaggatctgtcacacagagttcaaattaataagcgtgtattgaatgtctactatgg

SEQ ID NO: 26793 - DNA, 201 bp, Homo sapiens
gactatagttaccctgttgtgctatcaaatagttggtcttattcattctttctaattattttcttggtagtcaaaataaaatgtttatttttatgacttctttttttttttttttttttttttgagatggagtctcgctctgttgcccaggctggaatgcagtggcgtgatctcggctcactgcaacctctgcctcccggg

SEQ ID NO: 26794 - DNA, 201 bp, Homo sapiens
tataggtaatggaataaaggtggtcacataacacagactttttttattatactttaagttttagggtacatgtgcacagatttttaaagaaaattccaacttataatgattaaaaattacatagctgattatatatacatgtgtagctaaatctattttttacatgaattttgcttcaataaaataatttgttaagcatac

SEQ ID NO: 26795 - DNA, 201 bp, Homo sapiens
actaatagattgacttcctttgcatatttttgcaatgttctgtgagatatcaagtcacttccctggtagtttcttattcagtatttcactgtactgctttaaaaaaaaaaaaaagtcaggcctcaaccctaacagagtcacttggagatcttgttaaaaagttgagtttagagtctgatacaggttttgagatggccctga

SEQ ID NO: 26796 - DNA, 201 bp, Homo sapiens
ataggtaatggaataaaggtggtcacataacacagactttttttattatactttaagttttagggtacatgtgcacagatttttaaagaaaattccaacttataatgattaaaaattacatagctgattatatatacatgtgtagctaaatctattttttacatgaattttgcttcaataaaataatttgttaagcatacc

SEQ ID NO: 26797 - DNA, 201 bp, Homo sapiens
gcctgagctctgcctcctgtcagatcagcagatcacaggagtgtgaactctactgtaaaatgcatatgtgagggatctaggctgtgcactccttaagagamtctaactcatgcctgatgatcttcggtggaacagtttcatcccaaaaccatccctgcctgccacccctgtggaaaaattgtcttccatcaaaccaatccc

SEQ ID NO: 26798 - DNA, 201 bp, Homo sapiens
acacgtggacatggcaggaagttatggccagttgggtaaggccagcatttttaggcaaagtcatgaagactgggcgacaagggccaggaggttaataaggycagatggataatgtcaagtttgtcataccatgaggataaaataaggtgaggaaggcaatcagattaataaggttggctgagtttggccaggttgttaaaa

SEQ ID NO: 26799 - DNA, 201 bp, Homo sapiens
tgacttcttgggctcaaatgatcctcccactgcagccgtctgagtagctgggactataggcatgcagcaccaaacctggctaatttttaaatcttttgtaragaagtggtcttgctacattgcccaggctggcctccagtgaaccttctgcctaggtctccctaggtgttaggattataggcgtagccaccgcacctggct

SEQ ID NO: 26800 - DNA, 201 bp, Homo sapiens
tcaccatgttggccaggctggtcttgaactcctgacctcaagtgatccacccgcctcagcctcccaaagtgctgggattacaggcgtgagccaccgtgccyggcccatcccagttgttaatatttgaaaatttccaccctgctgggataagtcccttgactatttcctttgactttgcccattccttttgtgactgggcat

SEQ ID NO: 26801 - DNA, 201 bp, Homo sapiens
caacctgatcattataaagccagtacagccgggattggatatgtggcaaatcagctgcctcattttgggaggccacttagcatgtaaaggagggaaatgtygatttaccttctcagggtaaacaaactacagcggcatttctccattccagcaggctggctgacccctcagggacaacctgtcatgtgttgggatcataca

SEQ ID NO: 26802 - DNA, 201 bp, Homo sapiens
aacttgtggaaaagtccactttgtcctgagaagaactgacttgcaggaggtcaagtgaggtccttgacagtgctctgagccatcctgtccacttcctatgwgtcaggcagactatgagcccaaaggtcttgaagtattacggtgttaggttttgtttaaacattagttatttctgatttttctaattgtttgcatacacaa

SEQ ID NO: 26803 - DNA, 201 bp, Homo sapiens
gcagatcacctgaggtcaggagttcaagaccagcctggccaaaatggtgaagcgttttctctactaaaaatacaaaaattagtcaggagtggtggtgtgcrcctgtagtcccagctgaggcataagaattgtttgaaccagggaggaggaggctgcagtgagctgagatcttgccactgtattccagcctgggtgacagag

SEQ ID NO: 26804 - DNA, 201 bp, Homo sapiens
taatctgcagtaggcaggattccaaggcaactcttgttcacatcagaatttgagaagcaactgttctagaatacactagggagccatatgagatctcaggrtcaagtgtagagtgacttgaggtttctccttggttgagagctcctcaaataagataggcctcccaggttaactaatttcagagcaatttttcagatttag

SEQ ID NO: 26805 - DNA, 201 bp, Homo sapiens
tttactataaaatagaattctgtaaattgctttaagaaagcatttattggctgggtgtggtggctcacacttgtaatcccagcactttgggaggccaaggygggtggatcatgaggtcaggagatggagaccatcctggctaacacggtgaaaccccgtctctactaaaaatacaaaaaattagctgggcgtggtggcagg

SEQ ID NO: 26806 - DNA, 201 bp, Homo sapiens
aggagcccagctggcttcacccagtggaccctgcacaggggctacaggtggagctgcctgccagtccctcacctgcgcctgcacttctcagcccttgggcrgtctatgggactccgtgctgtggagcagggggcggcactcgtggcgggggctcaggccacgcaggagcccaaggtagggggcggggcggagactcaggca

SEQ ID NO: 26807 - DNA, 201 bp, Homo sapiens
atctcaggatcaagtgtagagtgacttgaggtttctccttggttgagagctcctcaaataagataggcctcccaggttaactaatttcagagcaatttttyagatttagaaaattggagtcaggcgcagtggctcacgcctgtaatcccagcactttgggaggccgaggcgggcagatcacctgaggtcaggagttcaaga

SEQ ID NO: 26808 - DNA, 201 bp, Homo sapiens
gacgttggtcaccacccactgagagttattcttatgaattgcaggtgtgaaagctgagcagtagcaatatctggacactgagagagccacacttactgtcytgagagtcacagagatgataaagaaagaggttcatgtagagctttcttatgtagcagagaggagaggaaagagcactagctgtgggtaagaagactgacc

SEQ ID NO: 26809 - DNA, 201 bp, Homo sapiens
acatatatgccttcctacatgatataggagatagagtgcaaaaatcaaaccaaagtgttttttcctaccctcactcaccacacactactcctcacatgccvagcaagcaagcaagcaatttttctgcagattctgcagtgcacaccagctgggtgtcctctaattcaactcaactcttacactagctatctagagatactg

SEQ ID NO: 26810 - DNA, 201 bp, Homo sapiens
ttttgtatgtgtgtggatggatgtagcacattgtcataactgagctcaaatcaattcaagactttgattattatatgttgttactacaacgaatatagtgttttttttttctaagaatcctcagtaattcagagagaggttttatttaaaattctatttagatttttttattcctggccgggcgcggtggctcatgcctgt

SEQ ID NO: 26811 - DNA, 201 bp, Homo sapiens
tgtggtgtgtccccctcccaaactcacattgaatttttttttttttttttgagacggagtctcgctctgttgcccaggctggagtgcagtggtgcgatctyggctcactacaagctctgcctcccgggttcaagagattctcctgcctcagcctcccgagtagctgggattacagatgttcgtcaccacacctggctaatt

SEQ ID NO: 26812 - DNA, 201 bp, Homo sapiens
gtgggaggcaagagaatgtgtgcaggggaactcccctttataaaaccatcagatcttatgaaacttattcactaacatgagaacaacatgggaaagaccckcccccatgattcaattacttcccactggggattatgggagctacaattcaaaatgagatttgggtggggacagagccaacccatgtcactcattatgatg

SEQ ID NO: 26813 - DNA, 201 bp, Homo sapiens
gcagccgtctgagtagctgggactataggcatgcagcaccaaacctggctaatttttaaatcttttgtaaagaagtggtcttgctacattgcccaggctgscctccagtgaaccttctgcctaggtctccctaggtgttaggattataggcgtagccaccgcacctggctgtccccttcttaaacccctttcagcagctct

SEQ ID NO: 26814 - DNA, 201 bp, Homo sapiens
cactatgttggctaggctggtctcaaactcccgacatcaggtgatccacccacctcggcctcccaaagtgctgggattagaggagtgagccactgcacccmgcctcacgttgaggtttaattgccattgtaacagtataaagatgtgggacctttacgaggtgattaggcaatgaggactctgccctcatgaatggattaa

SEQ ID NO: 26815 - DNA, 201 bp, Homo sapiens
atggggttctttgtttttttcttgtaaatttgtatgagttctttgtagattctggatatcagccctttgtgaaatgagcagattgcaaaaattttctcccrttctttaggttgcctgttcactctgatggtagcttcttttgctgtgcagaagctctttaatgtaattatatcccatttgtcaattttggcccttgtttag

SEQ ID NO: 26816 - DNA, 201 bp, Homo sapiens
catcaccaaatctggctctctagcctctggagagtctgtgagttatccaatggatttttttttaattgtttaaaaacaagagcaagactctgtcccccccmccccccaaaaaaaggtaaagaaatgtagactcagattcagtaggtctggttgggcatgaggctctgcatttcttttttttttctttttctttttttgtgt

SEQ ID NO: 26817 - DNA, 201 bp, Homo sapiens
tggagagattttctggttgcaaattagagacaacttttctctcagagcccaaagggtcacaaaaattagaataattaggctagaaggcctcttagtgacattttttttctggttgaagaatactatgaagtatttttctaatgcacagcatacttttagtcttatgttgaacaaaaataataaaccctcaaaaaccatgac

SEQ ID NO: 26818 - DNA, 201 bp, Homo sapiens
atgcggaagaaactcaagataaggtgtaacaaccaagttaggaagggtgcaggtgaaagttcagagaatcctactaagcggtcagtcatttaactaatatstattaaggttttactatattccaggcacaaagtgctaaaaatataggtggctactgccacccattccctatcattaccgtctgtttctgctcctcctact

SEQ ID NO: 26819 - DNA, 201 bp, Homo sapiens
cagcacttttgtttcttttattctttgctgtgtctccaatacttggaaaaatgcccaaaacattttttgtgattgatgtacatggtgcaatgatgaggtaggcaagtttgaaggatacatctaaaggtcatggaagaatgagctacaggaatggtctttacactgcagtatgcttatctcaaaagagtttacaaagacttt

SEQ ID NO: 26820 - DNA, 201 bp, Homo sapiens
atgctaacattctttgatacttggatgaagctcattgcctttcaaacaagaaatctggcacatgcacacacacacacacacacacacacacacacacacamacacacgaaaagaataaaagtaaaacaattacttttcagacaatgatttctgccaccatatttttatcccatgtcctcgtcaccaaagcagtcaccctcg

SEQ ID NO: 26821 - DNA, 201 bp, Homo sapiens
agcacttttgtttcttttattctttgctgtgtctccaatacttggaaaaatgcccaaaacattttttgtgattgatgtacatggtgcaatgatgaggtaggcaagtttgaaggatacatctaaaggtcatggaagaatgagctacaggaatggtctttacactgcagtatgcttatctcaaaagagtttacaaagactttc

SEQ ID NO: 26822 - DNA, 201 bp, Homo sapiens
agtgttttaaaaacagtggagtgagaaagcctgactttttttgtttttttaagacggagtctcactctgtggcccagactggagtgcagtggcacgatttyggctcactgcaacctccacctccgagttcaagcaattttccctgccttagactcccgagtagatgggattacaggcacccaccaccacactcggctaatt

SEQ ID NO: 26823 - DNA, 201 bp, Homo sapiens
ttttctttttttttttgagacagagtctcactctgttgcccaggctggagtgtggtggcatgatctcagctcactgcaacctctgcctcccaggttcaagsgattctcctgcctcagccacccaaggagctgggactacaggcacatgctgccacgccggactaatttttgtacatttaatagagatggggtttcaccatg

SEQ ID NO: 26824 - DNA, 201 bp, Homo sapiens
gagtctcactctgtggcccagactggagtgcagtggcacgatttcggctcactgcaacctccacctccgagttcaagcaattttccctgccttagactccsgagtagatgggattacaggcacccaccaccacactcggctaatttgtgtatttgttagtagagacggggtttcaccatgttggtcaggctggtcttgaac

SEQ ID NO: 26825 - DNA, 201 bp, Homo sapiens
agtgctgggattataggcatgagccactgcgcctggccgagaccccatttctataaaaatttttaaaaattagccaggcatggtggtgcgttcctgtggtytcagctacttgggaggctgaggtgggaggatagcttgagcctgggaggttaaggctgctgtgagccatgatggctgcagtgagtcatgatggtgccagtg

SEQ ID NO: 26826 - DNA, 201 bp, Homo sapiens
tgttggccaggctagtcttgaactcctgacctcaagtgatccacccacctcggcctcccaaagtgttgggattacaggcgtgagccaccaagcctggccattttttttgtatttttcatagagacagggtttcctcatgttggccaggctggtctctaactcctgacctcaagtgatccaaccaccttggcctcccaaagt

SEQ ID NO: 26827 - DNA, 201 bp, Homo sapiens
ctccacctccgagttcaagcaattttccctgccttagactcccgagtagatgggattacaggcacccaccaccacactcggctaatttgtgtatttgttastagagacggggtttcaccatgttggtcaggctggtcttgaactcctgacctcaggagatctgtccgccttggcctcccaaagtgctgggattacaggcgt

SEQ ID NO: 26828 - DNA, 201 bp, Homo sapiens
ggggcgtggtggtgtatgcctgtaatcctagctactcgggaggctgaggcaggagaatcacttgaatccaggaggcagaggttgcagtgagctgagatcaygccatggcgctccagcctgggtgacaaagcaagactctgtctcaaataaataataaataaataaataaataaataattaaataaataaaataaaataaaa

SEQ ID NO: 26829 - DNA, 201 bp, Homo sapiens
agaagtcctttgtccaaaagacagatagacaccttctgtaagcagatgactcaaggtcattgtttgcaaacttcaattgctatttggtacattcaggtagttttttgttttgttttgttttgttttcgagacggagtctcactctgtcgcccaggctggagtgcagtggctcaatcttggctcactgcaagctttgcctcc

SEQ ID NO: 26830 - DNA, 201 bp, Homo sapiens
tctagaatattctattccatattttaaaaggctgtcatgatccactaaatgtaaattactaataaattcaggattgctaatgggttgcagcctgcattttraaacaaaattggttagtggaaaagagatgttgggcaggaaacttaccatttaacacatctggcccggggttgaagtcacaggcagctggatttcatttgc

SEQ ID NO: 26831 - DNA, 201 bp, Homo sapiens
ttttctgcaggttggtctaattgaaggcaatggagaagtaagtctttatggatcaaaatcttagctctagaaaaggtgagggggcctgttttggaaatacrtctattcataaatatattgtttgatgtaattatgaatttgatgatattgaagcctctcagtactctcaattacccttatgggtaatcttagggcttataa

SEQ ID NO: 26832 - DNA, 201 bp, Homo sapiens
tgaatctcctttctcatctttacctattgtaagtccagttaaaatgagggtagacgtggatggtgaactgaaagtagcaaagtagacagatgcaatggtgrctacaaatcccactttctgatttgaaatgtgggattgacagcagttgaaaaataaggattaggtctataataaactgtctttattaatgagctatagttt

SEQ ID NO: 26833 - DNA, 201 bp, Homo sapiens
cttcttgggttgattgtttttttcctatgtagaagatttccttggacttggccttcagaaaacctaaatttaaagttcagctttatcaggggagcctgggmgaatggttacattaacctctttgtggcctttgaaacatacatagaaaatatcaagggatagttgtaaaaatgaggataaaaacatctaaagtgctaagta

SEQ ID NO: 26834 - DNA, 201 bp, Homo sapiens
gtccagaagttcaagaccagcctgggcaattagcaagaccctgtctctataaaaaattaaaaattagctggatgtggtggtgtgcacctgtagtcccaacratttggtaagctgaagagagaggatagcttgagcccaggaagctgaggctgcagtgagccacatcactccagccaaggtgacagatggagatgctgcctc

SEQ ID NO: 26835 - DNA, 201 bp, Homo sapiens
ctgtatttcctccagacttgctgtcaaacctggacaggagccgaggaggtgggaggcaagggccagtgcatgtagtggggttcaaattccagttctacccyttcctagaggaggacttgggcaaatggagtagctcctctgaggttctctgtccataatatagtgataagagggctttctggggggaaggtggtattcagt

SEQ ID NO: 26836 - DNA, 201 bp, Homo sapiens
tggcctcccaaagtgctgggattacaggcgtgagccacaacacacagccaaaattttaaccattttgaatggaaacattttatttcagaaaacaatggacrtaatttaacataaatatcagctttgaatgctgaggtaacacaggttggtgtctaatttgcacttgtttctgtatgtttctggttctcaactgagctggca

SEQ ID NO: 26837 - DNA, 201 bp, Homo sapiens
ttcatggacccagttggccacctcaagtaagtgcaacaagattttgacttaaagttgcaatcactttcaggctggaaaagaggttcttctcatgagcattkatgtgtcttatttaatgcatcccttaaattcttttttttttttttgagacaaagtctcgctctgtcacccaggctggagtgcagtggtgcaatctcagct

SEQ ID NO: 26838 - DNA, 201 bp, Homo sapiens
atcactttcaggctggaaaagaggttcttctcatgagcatttatgtgtcttatttaatgcatcccttaaattcttttttttttttttgagacaaagtctcrctctgtcacccaggctggagtgcagtggtgcaatctcagctcaccacaacctccgcctcctggcttcaagcgattctcctgcctcagtctcccgagtagc

SEQ ID NO: 26839 - DNA, 201 bp, Homo sapiens
aaaaacatgctaaattccattgctgttcagtccatttcctttaaaggtgggctatgccacagggctagattttaaaacgtggaatttcacaccagtgctcsaaatcttatgaaagcaaaagggacctctgtagttgtactccactttggcttgagtaaaaaccactgctgtaccctttttctttcctttccctgcccattt

SEQ ID NO: 26840 - DNA, 201 bp, Homo sapiens
ctccaaggacactactattggaaattattcatttagactttatttgaaactaattttaaaagtgtagacattgtactatctcctttttttggtatcatctyaactattttattgttagtttattcatattgaataagagagggagtaaagatttcacaatggcgatagctagtatatgccaattaagttaatttaaaaagt

SEQ ID NO: 26841 - DNA, 201 bp, Homo sapiens
tggattataatttaaataatctatttaccagataaatgcacgcatagactaatggtcatttagttacaaattatcattttatgttgatcccactcttccaktggagggctaacactgaataatttggggctattttgctagtgatttttaaatactgtagatgtttgggtataggggaagggaaaataatattttagtcaa

SEQ ID NO: 26842 - DNA, 201 bp, Homo sapiens
acctacatcaactattaattttttttctctaacccaggagttgcaacaatatccaattcacaaagacatcagatcctctatactcacatcgtggcacagarcaaatttggattataatttaaataatctatttaccagataaatgcacgcatagactaatggtcatttagttacaaattatcattttatgttgatcccact

SEQ ID NO: 26843 - DNA, 201 bp, Homo sapiens
ttgaacctacatcaactattaattttttttctctaacccaggagttgcaacaatatccaattcacaaagacatcagatcctctatactcacatcgtggcayagagcaaatttggattataatttaaataatctatttaccagataaatgcacgcatagactaatggtcatttagttacaaattatcattttatgttgatcc

SEQ ID NO: 26844 - DNA, 201 bp, Homo sapiens
ttcacacaaaaacttgcacacagatgttcatagcagcatcattcatagtagccaaacacggaaacaacccaatgtccatcgactaatgaatggatcaacaraatgtggtatatccatataatgaaatatctgaccataaaaggaatgtacatgctgcaatataaacctttaaaatattatgctaagttgaagccagacacg

SEQ ID NO: 26845 - DNA, 201 bp, Homo sapiens
agtcttatacatatttatcatctgcaaaacacagtattaaagatttcaacagaaatactgaaagtagtgctatggaggttcaggggatgataatacttttygctggggatttgggaaaaagctctaatcagtaattataccttcatgcaaacttctattcttgtggtagatggatgtgggtgtgtatttgtttgaacctac

SEQ ID NO: 26846 - DNA, 201 bp, Homo sapiens
ttaaacctgggaggtggagtttgcagtgagctgagattgagccactgcactctagcctgggcaacaagagcgaaactctgtctcaaaaaaaaaaaaaaaaagtgaaggtgcccagtgtctgcaactatgtcaccccgggcatatcacatatcactctgtttttccgtctgtaaaacgggagcaacaatgccattgccttat

SEQ ID NO: 26847 - DNA, 201 bp, Homo sapiens
caacttattccgcatcttcagagaagactacataaatagaaaaacatatcactttgataaggttcaatctcagctcactgccactgacatagagttgaacmaaaggtttaggtttccttctatgtttgaaatttaaatagggcacattcacaggctaaattgataaaattaaaaagaatttatcccataaattaaaatgat

SEQ ID NO: 26848 - DNA, 201 bp, Homo sapiens
tactcgggaggctgaggcaggagaagcgcttaaacctgggaggtggagtttgcagtgagctgagattgagccactgcactctagcctgggcaacaagagcraaactctgtctcaaaaaaaaaaaaaaaaagtgaaggtgcccagtgtctgcaactatgtcaccccgggcatatcacatatcactctgtttttccgtctgta

SEQ ID NO: 26849 - DNA, 201 bp, Homo sapiens
tctaatcccagctactcgggaggctgaggcaggagaagcgcttaaacctgggaggtggagtttgcagtgagctgagattgagccactgcactctagcctgrgcaacaagagcgaaactctgtctcaaaaaaaaaaaaaaaaagtgaaggtgcccagtgtctgcaactatgtcaccccgggcatatcacatatcactctgtt

SEQ ID NO: 26850 - DNA, 201 bp, Homo sapiens
acatgaaaaatggtggatatggaaggtggagaagagaggagataacagctttatctttcaaaatagagaattgagagatggtaccaaaagctgatgaagtaaaaaaaaaaaaaaaaaaaaaaagatacttaatataatactttaaattacaaatataaacacaagaagaacaaatataatgatacaaatgtcagacactgg

SEQ ID NO: 26851 - DNA, 201 bp, Homo sapiens
tagaatcataaagataatccatgctattaaaagtattctttccttttttttttgtttgtttttgtttttgtttttttgagagagagtttcgctcttgttgyccaggctggagtgtatggcacaatctcggctcactgcaacctctgcttcctgggttcaagcaattctgctgcctcagcctcctgagtagctgggattaca

SEQ ID NO: 26852 - DNA, 201 bp, Homo sapiens
tccagtttactcccatttcattcattaacacaattttgagacaacagaaaacttcatgtgaagtgtgtttgtgtgtgtgtgtgtgtgtgtgtgtgtgtgtgatgttacatcatatacataaggattgggaagaataattagataattatttatataatttttaaacctcattgacatgatttaatgtcaaaaatataatta

SEQ ID NO: 26853 - DNA, 201 bp, Homo sapiens
gtccagtttactcccatttcattcattaacacaattttgagacaacagaaaacttcatgtgaagtgtgtttgtgtgtgtgtgtgtgtgtgtgtgtgtgtgtgatgttacatcatatacataaggattgggaagaataattagataattatttatataatttttaaacctcattgacatgatttaatgtcaaaaatataatt

SEQ ID NO: 26854 - DNA, 201 bp, Homo sapiens
aatcagctgggcatggtggtgcgtgcctgtaattgcagctacttgggaggttgaggcaggagaatagcttgaacccaggaggcagaggttgcagtgagccragaccgcgccactgcactccagcctgggcaacagagtgagaccccatctcaaaaacaacccaaaaaaccaaaaaacaaacaaacaaaaagaaatataatc

SEQ ID NO: 26855 - DNA, 201 bp, Homo sapiens
atacactgctttattttttcctctttttttccctctattttccttttgcctccccctccctttgctttgtaactcaatagaggtgccccaactcactgacytaagctttgttgatataaccgattcaagcatcggcctgaggtggaccccgctaaactcttccaccattattgggtaccgcatcacagtagttgcggcagg

SEQ ID NO: 26856 - DNA, 201 bp, Homo sapiens
tctataaagcttttcagctcttcaaaataaaatgtctgagaggtagatattttcctattttctaattacagttgacctttctctctgaatgccaaaggagrtaatctacacattactagttatatatttcttgaaatggatgaatttgatatataccaaggaaacgttttaaaataccaaaactttacatggatgagccaa

SEQ ID NO: 26857 - DNA, 201 bp, Homo sapiens
actggtagtatctataaagcttttcagctcttcaaaataaaatgtctgagaggtagatattttcctattttctaattacagttgacctttctctctgaatrccaaaggagataatctacacattactagttatatatttcttgaaatggatgaatttgatatataccaaggaaacgttttaaaataccaaaactttacatg

SEQ ID NO: 26858 - DNA, 201 bp, Homo sapiens
tattgaagtatttgtagatactataaagccagccctgggaaccactggtagtatctataaagcttttcagctcttcaaaataaaatgtctgagaggtagawattttcctattttctaattacagttgacctttctctctgaatgccaaaggagataatctacacattactagttatatatttcttgaaatggatgaatttg

SEQ ID NO: 26859 - DNA, 201 bp, Homo sapiens; identical to SEQ ID NO: 4443

SEQ ID NO: 26860 - DNA, 201 bp, Homo sapiens
tgcagcccacagtggagtatgtggttagtgtctatgctcagaatccaagcggagagagtcagcctctggttcagactgcagtaaccagtacgtaaccactkcttggtttccattttcaaagtcaaattttgttcttgggtgtctgaatgcccacgacatgtcttttgcaattacacatagggaaagtgaacttgttggtta

SEQ ID NO: 26861 - DNA, 201 bp, Homo sapiens; identical to SEQ ID NO: 4445

SEQ ID NO: 26862 - DNA, 201 bp, Homo sapiens
ccaacttattccgcatcttcagagaagactacataaatagaaaaacatatcactttgataaggttcaatctcagctcactgccactgacatagagttgaamaaaaggtttaggtttccttctatgtttgaaatttaaatagggcacattcacaggctaaattgataaaattaaaaagaatttatcccataaattaaaatga

SEQ ID NO: 26863 - DNA, 201 bp, Homo sapiens
tctttctttttctttcctttcctttccctttctttctttctctttccttccttccttcctttctctctctcttttcttcctttcctttcctttccttcctyccttcctttctttctttctttctttctttctttctttctttctttctttcttttctttctttctctctcactctctctctctttctttcttatttttggt

SEQ ID NO: 26864 - DNA, 201 bp, Homo sapiens
ccttgtgggaggtggggatcttcgaattgtttgtttgtttttgttttgttttgtttttgagacagagtcttgctctgtcaccaggctggagtgcagtagcrctatctcagctcactgcaacctctgcctccagggttcaagcaattctcctgcctcagcctcctgagtagctgggactacaggcacatgccaccacaccca

SEQ ID NO: 26865 - DNA, 201 bp, Homo sapiens
aattaaagaatactgtagtaagccctgttatcttaactaagaaacgcctctgtttctaaagtttaaaaaaaaaggcaaaaaaaaaaaaacctttcaagtaraagagtaaactcccaagcattcctataaaaatcagtcagatgttattttttttcttatgagacagagatatcctgtttccttaaataaattagatatcta

SEQ ID NO: 26866 - DNA, 201 bp, Homo sapiens
tctctctgaatacagttttagaaagaaagaaggaaagaaggaaaaagaaagaaagaaagaaagaaagaaagaaagaaagaaagaaagaaagaaagaaagaraaagaaagaaagaaagaaatccaagagtatttcctaccaataggagaatacaatttactgaggaagaacccacctggataaaatagaattcttaaggaag

SEQ ID NO: 26867 - DNA, 201 bp, Homo sapiens
atttttaacttctcacacctgtggttaatgagtaacatttttgtaaacgtggccattttcaaggaagaagggaagcattttatgccaaaaaaaaaaaaaaattcaaaataagaaaaaaaaaaaactaccctaatttatctccctctaatctacctatagaagaagatgaaatgaaagttcgagctctccagagtcaatggc

SEQ ID NO: 26868 - DNA, 201 bp, Homo sapiens
gccaccatgcctggctaatttttttttttttttttttgtatttttttagtagagacggggtttcaccatgttagccaggatggtctcgatctcctgacctygtgatccgcccgcctcggtctcccaaagtgctgggattacaggcatgaaccaccacgcccggccagcagtgccttagtttttaatgtttaaaatagtaat

SEQ ID NO: 26869 - DNA, 201 bp, Homo sapiens
cctcccgggttcacgccattctcctgcctcagcctcctgagtagctgggactacaggcgcctgccaccatgcctggctaatttttttttttttttttttgkatttttttagtagagacggggtttcaccatgttagccaggatggtctcgatctcctgaccttgtgatccgcccgcctcggtctcccaaagtgctgggatt

SEQ ID NO: 26870 - DNA, 201 bp, Homo sapiens
agtgttttgtttttaacagtagtacactataacttaaaatagacttagattagactgtttgcatgattatgattctgtttcctttatgcatgaaatattgrttttacctttccagctacttcgttagctttaattttaaaattacattaactgagtcttccttcttgttcgaaaccagctgttcctcctcccactgacctg

SEQ ID NO: 26871 - DNA, 201 bp, Homo sapiens
ctctttttttccctctattttccttttgcctccccctccctttgctttgtaactcaatagaggtgccccaactcactgacctaagctttgttgatataacygattcaagcatcggcctgaggtggaccccgctaaactcttccaccattattgggtaccgcatcacagtagttgcggcaggagaaggtatccctatttttg

SEQ ID NO: 26872 - DNA, 201 bp, Homo sapiens
taccatcattgctttaacattccaccaattttactactagtaacctgatatacactgctttattttttcctctttttttccctctattttccttttgcctycccctccctttgctttgtaactcaatagaggtgccccaactcactgacctaagctttgttgatataaccgattcaagcatcggcctgaggtggaccccgc

SEQ ID NO: 26873 - DNA, 201 bp, Homo sapiens
aaacagattgcatattaccatcattgctttaacattccaccaattttactactagtaacctgatatacactgctttattttttcctctttttttccctctrttttccttttgcctccccctccctttgctttgtaactcaatagaggtgccccaactcactgacctaagctttgttgatataaccgattcaagcatcggcc

SEQ ID NO: 26874 - DNA, 201 bp, Homo sapiens
caggaagttcagtcagttttgtcgatatattccgcatgtctgcaatacgacaggcatagagagtgttcagtaagtatttgtgggaaaagaatggatgagtkgataaagtaggaagagacacctgcttgtggaatgtagcttctttgtgaatgaagcaaccatctcaaaaataggaaatggtattgagatgcctgccccatc

SEQ ID NO: 26875 - DNA, 201 bp, Homo sapiens
gaaaattacggatgtgaaaagtttcccttttttttctagtttctgatgttccgagggacctggaagttgttgctgcgacccccaccagcctactgatcagmtgggatgctcctgctgtcacagtgagatattacaggatcacttacggagaaacaggtacagcagtaaaatgctattttacactctgattaaatcagattc

SEQ ID NO: 26876 - DNA, 201 bp, Homo sapiens
caccacgcccggctaatttttgtatttttagtagagatgggattttaccatgttggccaggctggttttgaactcctgacctcaaatgatccacccgcctyggcctcccaaagtgctgggattacaggcgtgagccaccacgcccggccttgtatcacttttttttttttttttttttttaacttttctgtagttttgaaa

SEQ ID NO: 26877 - DNA, 201 bp, Homo sapiens
tcgtcaagccagagacaaatacctaagggaagggtatataggtgttcattgtattacttttttttttttttttcttcctgaaatggagtcttgctctgtcrcccaggctggagtgcaatggtgggatcttggctcactgcaacctctgcctcccaggctcgagcaattctcttgcctcagcctcccaagtagctgggacta

SEQ ID NO: 26878 - DNA, 201 bp, Homo sapiens
cttgaacccaggaggcggaggttgcagtaagccaagattgtgtcactgcactccagcctggtgacagagggagactctgtctcaaaaaaaaaaaaaaaaarggtggaaaactgaacactgtttcaaagtacctttaaaaatataattttagggtaatagtgtcattgttcttagcagatagaggctgaagtacttacggga

SEQ ID NO: 26879 - DNA, 201 bp, Homo sapiens
tcctgtttccttaaataaattagatatctatgggattgaaatataaaagtttcttccaaaatgtaaggtgggctttccacttcaagctccactatgcataygattctagtgtattttcagtgcagtaaatatatcaaactatcatggttttggttgaccaaatacttttctaatcacttatttccttcccccagaatcaat

SEQ ID NO: 26880 - DNA, 201 bp, Homo sapiens
ctgggtgacagagcaagaccctgtctcaaaaaaaaaaaaaaaaaaagggccaggcgcaatggctcacgcttgtaatcccagcactttgggaggccaaggcrggtggatcacgaggtcaagagatcgagaccatcctggccaacatgatgaaacctcgtctctactaaaaatacaaaaattagctgggcgtggtggcatgca

SEQ ID NO: 26881 - DNA, 201 bp, Homo sapiens
gttgcctctagtgttcagtacagtaacatgctgcacaggctcatagcctaggagcaataggctagaccacatagcttatagcttaggtgtgtcaaaggctytaccatctaggttttttgttttgttttgttttgttttgtttttgagacggagtctccctctgttgcccaggatggagtgcagtggcacgatctgggctca

SEQ ID NO: 26882 - DNA, 201 bp, Homo sapiens
attacagttgcctctagtgttcagtacagtaacatgctgcacaggctcatagcctaggagcaataggctagaccacatagcttatagcttaggtgtgtcawaggctctaccatctaggttttttgttttgttttgttttgttttgtttttgagacggagtctccctctgttgcccaggatggagtgcagtggcacgatctg

SEQ ID NO: 26883 - DNA, 201 bp, Homo sapiens
taaagtcaacatatttgaaagtagattaaaattttttttaaatatatcaatgatggcaaaaaggttaaagggggcctaacagtactgtgtgtagtgttttrtttttaacagtagtacactataacttaaaatagacttagattagactgtttgcatgattatgattctgtttcctttatgcatgaaatattggttttacct

SEQ ID NO: 26884 - DNA, 201 bp, Homo sapiens
aagtttaggaccctcttgtctttttgtctgtgtgcatgtatttctttgtaaagtactgctatgtttctctttgctgtgtggcaacttaagcctcttcggcytgggataaaataatctgcagtggtattaataatgtacataaagtcaacatatttgaaagtagattaaaattttttttaaatatatcaatgatggcaaaaa

SEQ ID NO: 26885 - DNA, 201 bp, Homo sapiens
tccaaaatgtttccaacttttttatgtagacccctggccagatggaaatgacatcattgtatataacttttagcaaagttaaaaggaaaaaaatatgtacstcaatattcacatgaagaaaattccataattttgggaaaaggagaaatgcaaatgtaacgttttccttcaattatttgcagccggttgttatgacaatgg

SEQ ID NO: 26886 - DNA, 201 bp, Homo sapiens
ttaaaaggaaaaaaatatgtacgtcaatattcacatgaagaaaattccataattttgggaaaaggagaaatgcaaatgtaacgttttccttcaattatttkcagccggttgttatgacaatggaaaacactatcagataaatcaacagtgggagcggacctacctaggcaatgcgttggtttgtacttgttatggaggaag

SEQ ID NO: 26887 - DNA, 201 bp, Homo sapiens
taaaaggaaaaaaatatgtacgtcaatattcacatgaagaaaattccataattttgggaaaaggagaaatgcaaatgtaacgttttccttcaattatttgyagccggttgttatgacaatggaaaacactatcagataaatcaacagtgggagcggacctacctaggcaatgcgttggtttgtacttgttatggaggaagc

SEQ ID NO: 26888 - DNA, 201 bp, Homo sapiens; identical to SEQ ID NO: 4439

SEQ ID NO: 26889 - DNA, 201 bp, Homo sapiens
acatggggagggaggtgctcccaattctgatggaggagaattggagattggaatttagattgaattcagtatctctctctgtctctctctctctctctctcccattaacacttacaacgactgtgattgtatgaccttagaactcagtcattctggtatgaaattgtgtgatggagaatgaatttgctgggaagttgattt

SEQ ID NO: 26890 - DNA, 201 bp, Homo sapiens
tacatggggagggaggtgctcccaattctgatggaggagaattggagattggaatttagattgaattcagtatctctctctgtctctctctctctctctctcccattaacacttacaacgactgtgattgtatgaccttagaactcagtcattctggtatgaaattgtgtgatggagaatgaatttgctgggaagttgatt

SEQ ID NO: 26891 - DNA, 201 bp, Homo sapiens
ttacatggggagggaggtgctcccaattctgatggaggagaattggagattggaatttagattgaattcagtatctctctctgtctctctctctctctctctcccattaacacttacaacgactgtgattgtatgaccttagaactcagtcattctggtatgaaattgtgtgatggagaatgaatttgctgggaagttgat

SEQ ID NO: 26892 - DNA, 201 bp, Homo sapiens
gacacttccaataagagtggggattagcatcttaatccccagatgcttaagggtgtcaactatatttgggatttaattccgatctcccagctgcactttcyaaaaccaagaagtcaaagcagcgatttggacaaatgcttgctgttaacactgctttactgtctgtgcttcactgggatgctgtgtgttgcagcgagtatg

SEQ ID NO: 26893 - DNA, 201 bp, Homo sapiens
aataacagtgacagtggagtcctcagtaaatgccaagtcctgcattccgccctgtgaatccatcattggagtctagttaaatatgctctggctcacagatyctctgtgcaataacttcccttttcttttttctccagacattactggttatagaattaccacaacccctacaaacggccagcagggaaattctttggaaga

SEQ ID NO: 26894 - DNA, 201 bp, Homo sapiens
ggccagtcctacaaccagtattctcagagataccatcagagaacaaacactgtaagtgcattagcagcacaagtgtgttccctcatactagacagtctctktctacaggtatctttcttcagaatgaaccaagtgttttaattaattaaaaaaaaaaacaactcataaatgacttaagtgaaacactgtattccataatat

SEQ ID NO: 26895 - DNA, 201 bp, Homo sapiens
aaccagtattctcagagataccatcagagaacaaacactgtaagtgcattagcagcacaagtgtgttccctcatactagacagtctctttctacaggtatstttcttcagaatgaaccaagtgttttaattaattaaaaaaaaaaacaactcataaatgacttaagtgaaacactgtattccataatatagtttaagttat

SEQ ID NO: 26896 - DNA, 201 bp, Homo sapiens; identical to SEQ ID NO: 4447

SEQ ID NO: 26897 - DNA, 201 bp, Homo sapiens
tcctgtctacttcacaaacaacaggtacatgtgtgctacatagtgttaaaagaatctttttctgtaaaacacaggcctgtagtagcacttcctgactgttygccccactttctttctttcttagcgcctgatgccccacctgacccgactgtggaccaagttgatgacacctcaattgttgttcgctggagcagaccccag

SEQ ID NO: 26898 - DNA, 201 bp, Homo sapiens
tccaccatcacacctggctaatttttatatttttagcagagacaaggtttcaccatgttggccaggttggtcttgaactcctggcctcaagtgattcaccyacatcagcctcccaaagtgctgggattacaggcatgagccactgcgcctggccaaagtaatattttcaataagaaaaataacagtgatgtcaggatgcta

SEQ ID NO: 26899 - DNA, 201 bp, Homo sapiens
agcatgcaacattttaaaggttctctgctgtgcatgggaaaagaaacatgctgagaaccaatttgcatgaacatgttcacttgtaagtagaattcactgartggaactgtagctctagatatctcacatggggggaagtttaggaccctcttgtctttttgtctgtgtgcatgtatttctttgtaaagtactgctatgttt

SEQ ID NO: 26900 - DNA, 201 bp, Homo sapiens
ggttcaagatttcctttaaagtgaggatcttggcggaggttgaagtgagccaagatcacaccgctgcactccagcctgggtgatagagggagactgtctcmaaaaataaaaataaaaaaataaagtgaggatcttagtactgcctgaaaggattgttgcaagcattgaataacagtgacagtggagtcctcagtaaatgcc

SEQ ID NO: 26901 - DNA, 201 bp, Homo sapiens
atctgtgagtttgagttttgaatatgtgcattgattctctctcacagtgcagcctgggagctctattccaccttacaacaccgaggtgactgagaccaccmttgtgatcacatggacgcctgctccaagaattggttttaaggtaaactgcagatgttcctaatctctgtgatacagccctgaagctgtccttgtgtttcc

SEQ ID NO: 26902 - DNA, 201 bp, Homo sapiens
ctcttttcttcctttcctttcctttccttccttccttcctttctttctttctttctttctttctttctttctttctttctttcttttctttctttctctcwcactctctctctctttctttcttatttttggtgctaaaacccaaaacaaatcttttatttaaaaataagattttttttttttttggccaggtgtgatggc

SEQ ID NO: 26903 - DNA, 201 bp, Homo sapiens
tctttttctttcctttcctttccctttctttctttctctttccttccttccttcctttctctctctcttttcttcctttcctttcctttccttccttcctycctttctttctttctttctttctttctttctttctttctttctttcttttctttctttctctctcactctctctctctttctttcttatttttggtgcta

SEQ ID NO: 26904 - DNA, 201 bp, Homo sapiens
actggagtctttaccacacgtaagctgaaaattaagtgccttttcttaactatatttacattctctattcttcatgctttaaaacaaaacaaaacaaaacmaaaaaaacattaaaaaattagtacataatttaaatcagtgatactaaaaatgtgctccatagactggctgctggcccgttaattgtttgctgctagtctg

SEQ ID NO: 26905 - DNA, 201 bp, Homo sapiens
aatgtctatcagatatctgaggatggggagcagagtttgatcctgtctacttcacaaacaacaggtacatgtgtgctacatagtgttaaaagaatcttttyctgtaaaacacaggcctgtagtagcacttcctgactgtttgccccactttctttctttcttagcgcctgatgccccacctgacccgactgtggaccaagt

SEQ ID NO: 26906 - DNA, 201 bp, Homo sapiens
aataaaccaaaattgcattttttctgtagtcttgtccaaaattgggtaaccacttctgatggggtagctcatatccaagaatgagtcacaaaaccagactygttgaacctggtatatgatgagtcacaaagcaacattctgcctttgttttttcaggacaagaaacttgaattgtatcccactgagttaaaagataaaata

SEQ ID NO: 26907 - DNA, 201 bp, Homo sapiens
tacgatcactctcgcttattccaaaaatataaatggacacttgagtatttgaattattgaggaaatggttgactgggtaatttttaaaaatcactgggcayaaaaaatatattttgacttatattagtttagagtatttacacttgaaagagtctcatcttttctgaagggtgtttctttcatacacattttattgcactg

SEQ ID NO: 26908 - DNA, 201 bp, Homo sapiens
gaggaataattccattgaaccttgattctggaaactttgatccacccagcagtcatgatgttagactcattgaaaagaatgtatttctaatgcatgatgcratcggtctatagatgtgtcatggaaacttggttgcaacttcaagacaaaataaaaagtaaacatttacatgaaaaatggtggatatggaaggtggagaag

SEQ ID NO: 26909 - DNA, 201 bp, Homo sapiens
attacatggggagggaggtgctcccaattctgatggaggagaattggagattggaatttagattgaattcagtatctctctctgtctctctctctctctctctcccattaacacttacaacgactgtgattgtatgaccttagaactcagtcattctggtatgaaattgtgtgatggagaatgaatttgctgggaagttga

SEQ ID NO: 26910 - DNA, 201 bp, Homo sapiens
ctcaaccatttctaaaatatgcccagtataacaaaaaataataagcctttctctaatatgatttcaaatttcaaaatgaaattatgtgtaactcaaataaaagcaatggaatgtgacagccctttgttttcaacgaagacatgccctcccagcaactccccaaatcctggtgggtgaggggcatgcttcacactcaagggt

SEQ ID NO: 26911 - DNA, 201 bp, Homo sapiens
tctcaaccatttctaaaatatgcccagtataacaaaaaataataagcctttctctaatatgatttcaaatttcaaaatgaaattatgtgtaactcaaataaaagcaatggaatgtgacagccctttgttttcaacgaagacatgccctcccagcaactccccaaatcctggtgggtgaggggcatgcttcacactcaaggg

SEQ ID NO: 26912 - DNA, 201 bp, Homo sapiens
ttctcaaccatttctaaaatatgcccagtataacaaaaaataataagcctttctctaatatgatttcaaatttcaaaatgaaattatgtgtaactcaaataaaagcaatggaatgtgacagccctttgttttcaacgaagacatgccctcccagcaactccccaaatcctggtgggtgaggggcatgcttcacactcaagg

SEQ ID NO: 26913 - DNA, 201 bp, Homo sapiens
cttctcaaccatttctaaaatatgcccagtataacaaaaaataataagcctttctctaatatgatttcaaatttcaaaatgaaattatgtgtaactcaaataaaagcaatggaatgtgacagccctttgttttcaacgaagacatgccctcccagcaactccccaaatcctggtgggtgaggggcatgcttcacactcaag

SEQ ID NO: 26914 - DNA, 201 bp, Homo sapiens
aactgcatgaacccaggagatggaggttacagtgagccgagattgcaccacttcactccagtctgggcgacagagaaagactttgtctcaaaaaaaaaaawaaataaaaagtaaataaataaataaaataaatggcccattataggggtttttatctttaacttgctatttttccagatcatggttctgaagaccctgtga

SEQ ID NO: 26915 - DNA, 201 bp, Homo sapiens
taactgcatgaacccaggagatggaggttacagtgagccgagattgcaccacttcactccagtctgggcgacagagaaagactttgtctcaaaaaaaaaaataaataaaaagtaaataaataaataaaataaatggcccattataggggtttttatctttaacttgctatttttccagatcatggttctgaagaccctgtg

SEQ ID NO: 26916 - DNA, 201 bp, Homo sapiens
ctcggctcactgcaacctctgcctcccaggttcaagcaattctcctgcctcagcctcccaaatagctgggattacaggcatgtgccaccgcacccagctaatttttgtatttttagtagagacggggtttcacgatgttggccaggatggtctcgatctcctgacctcgtgatccgcccgccttggcctcccaaagtgctg

SEQ ID NO: 26917 - DNA, 201 bp, Homo sapiens
aaaggccaggcgcggtggctcacgcctgtaatcccagcactttgggaggccgaggcaggcagatcacaaggtcaggagatcgagaccatcctggctaacayggtgaaaccccatctctactaaaaatacaaaaacaaaattagccaggcgtggtgatgggtgcctgtagtcccagctactcgggtggctgaggcaggagaa

SEQ ID NO: 26918 - DNA, 201 bp, Homo sapiens
tctgtatagagtatcacctggactttaaaattcccacagaacatacagacattagaaggagacactggctttttagaattggggggaacaggaaaatagaagcagacatgagaggaattgaactagacacttcccacagaggctgcacaaacactggccaatctctcctacccttcacttgcctttagtttcacttttcat

SEQ ID NO: 26919 - DNA, 201 bp, Homo sapiens
acatagtgttaaaagaatctttttctgtaaaacacaggcctgtagtagcacttcctgactgtttgccccactttctttctttcttagcgcctgatgccccwcctgacccgactgtggaccaagttgatgacacctcaattgttgttcgctggagcagaccccaggctcccatcacaggtcagctaagcctccccctctttg

SEQ ID NO: 26920 - DNA, 201 bp, Homo sapiens
tctctctctcttttcttcctttcctttcctttccttccttccttcctttctttctttctttctttctttctttctttctttctttctttcttttctttctytctctctcactctctctctctttctttcttatttttggtgctaaaacccaaaacaaatcttttatttaaaaataagattttttttttttttggccaggtg

SEQ ID NO: 26921 - DNA, 201 bp, Homo sapiens
tcaacttttaaaatatgatttccatcttcccgttggaccctttccagtgtattaggtctaatttttggaagtgccaccctaagatctgtatagcagtactrctcttagggatgattcacataaatatgtggtgtttgcgctgtgatgatacaaatttaggacagaaatagaacccacccctagatcaagtctgcagtattg

SEQ ID NO: 26922 - DNA, 201 bp, Homo sapiens
cagtgctactgctatggccgtggcattggggagtggcattgccaacctttacagacctatccaagtaagtagctctattactgcaagttgagaactgccarttgggttataacaacagggcagtgattattaatgctctcatgcctaagttgggggtctcccctctttcccacccttttctcttgttattatctaataatc

SEQ ID NO: 26923 - DNA, 201 bp, Homo sapiens
tgggagaagtatgtgcatggtgtcagataccagtgctactgctatggccgtggcattggggagtggcattgccaacctttacagacctatccaagtaagtwgctctattactgcaagttgagaactgccaattgggttataacaacagggcagtgattattaatgctctcatgcctaagttgggggtctcccctctttccc

SEQ ID NO: 26924 - DNA, 201 bp, Homo sapiens
ctcttccccaaatttgaaataatcattttatcacaatttgaatgggctctgtaaccccttatcttgaattcgtcataatataaaattctgctaattacacrtagtatttacatgattgtatggaagaatcattaagacaattatctggaaaatgaacaaacagtaaatctgaatattgtttgaaaattacggatgtgaaaa

SEQ ID NO: 26925 - DNA, 201 bp, Homo sapiens
agacatgtatttgttcaaatactggcttctcacaggaaagtgtattttaccacattctttacttgagcatactgtaacctctgcaaaagttacacattttrggaagaaaaaaatttttttggcaaaaattgtattactgaccaaactttgaaaaaaatgttattctatgcttgtagaaaagttattttagtggaaggtgtt

SEQ ID NO: 26926 - DNA, 201 bp, Homo sapiens
gtctctcatccctctcaactcttttactgcccaatttctgtgattcctgaagacttcaacaatcaatactctctttttttgtttgttttgtttttttttttgagacagagtctcactctgtcacccaggcttggagtgcagtggcgccatctcaactcactgcaacctccgtctcctgggctcaagcgattctcgtgcctc

SEQ ID NO: 26927 - DNA, 201 bp, Homo sapiens
agagggagtaaagatttcacaatggcgatagctagtatatgccaattaagttaatttaaaaagttataccaactaccagtagcgaaaaaggactgtcaaargtttaaatctaaataatgtaaaagatgtcataatttttaacttttctgtctttaaaggatacatagtataagctagagtaattatacgtagtataagcta

SEQ ID NO: 26928 - DNA, 201 bp, Homo sapiens
aatctgattgtggaagtactataagtatatgaatggtttgtttgtttatatgatgcaaatgatacttaaatggtagaaacttctaaaaaaatgctctgtgktttctatatttatgattgttattggtgttgcaatttgctgaaaatgatttccttctgaatgattgagagagatcttcgtctctctcaacataaggctgtc

SEQ ID NO: 26929 - DNA, 201 bp, Homo sapiens
taaaagagtccccaaatcatttcccaataaaagtacactgtgcagtttctgaagagtttacactatttaaagcataatcatagcctcacagcagtaacagkcctctggaaatatttgtccttggtgtttactttgcattccttcctctagctgggtgtacgaccaagccagggaggagaggcaccacgagaagtgacttca

SEQ ID NO: 26930 - DNA, 201 bp, Homo sapiens
atcatatacataaggattgggaagaataattagataattatttatataatttttaaacctcattgacatgatttaatgtcaaaaatataattacttatttstaagtctggaaatatgaatttgcacaggtttgtctttgtaaagagcacacaactgagtagcttacaacatttaatatatgtatgacggctttagtcacag

SEQ ID NO: 26931 - DNA, 201 bp, Homo sapiens
tctcattgaagccataaataagcagctgctggtgggagataaagcatctctgtttactgacactcttttgattatgattgtagctgtaacccagacttacrgtggcaactcaaatggagagccatgtgtcttaccattcacctacaatggcaggacgttctactcctgcaccacagaagggcgacaggacggacatctttg

SEQ ID NO: 26932 - DNA, 201 bp, Homo sapiens
gttttatcatttataaaagagggatggcattgtacctgttgagagaaaatacaaaatacttgccgtaatattagacacacacacacacacacacacacacwctctctctctctcacacacacatacacacacacacacaaaattgttagctggccatgttattgtaactcctaccacacatatttttacattataatacat

SEQ ID NO: 26933 - DNA, 201 bp, Homo sapiens
aggtgactgagaccaccattgtgatcacatggacgcctgctccaagaattggttttaaggtaaactgcagatgttcctaatctctgtgatacagccctgaagctgtccttgtgtttcccatgtagtggaaacagggtgctcaggagtcaggagacctgggttttgtcacctgcttctgtccatacatctttgactacattg

SEQ ID NO: 26934 - DNA, 201 bp, Homo sapiens
gggtgatacagcgagaccccatctcaaaaaaataaaataaaataaaaaataaaaaaaattataaatgtcagtctaccaaaatagattaaaagtgtaggtgrgaattaaatggggataaacactcaataaatgttagctatatatgaatattgccaatactgaaaagattccattgttcaaaaaagtttgagaagcaatggg

SEQ ID NO: 26935 - DNA, 201 bp, Homo sapiens
gcgcctggccaaagtaatattttcaataagaaaaataacagtgatgtcaggatgctagaaaatgcaaaataaatttgttataattcctgattctggtgatraaatactaaatttttgcagtattattctgaaagaataatcacgtatttaaagtacaaatctttagacttcaaagtgcatccatggtggcagattttgttt

SEQ ID NO: 26936 - DNA, 201 bp, Homo sapiens
aatttacacattattggttgttaaaactttttttaatgtcaagttttaaatttttcagaaaaaaagaaaaatgacatacaaataaaccttagggggaaaaragccagatttatctccaaaagataaaactgagttttaaagaatgctagcatcataaaacttaccatggatagatcacgcacacacgcacacacacacgta

SEQ ID NO: 26937 - DNA, 201 bp, Homo sapiens
catttctctctctgaatacagttttagaaagaaagaaggaaagaaggaaaaagaaagaaagaaagaaagaaagaaagaaagaaagaaagaaagaaagaaaraaagaaaaagaaagaaagaaagaaatccaagagtatttcctaccaataggagaatacaatttactgaggaagaacccacctggataaaatagaattctta

SEQ ID NO: 26938 - DNA, 201 bp, Homo sapiens
gtcacatttctctctctgaatacagttttagaaagaaagaaggaaagaaggaaaaagaaagaaagaaagaaagaaagaaagaaagaaagaaagaaagaaaraaagaaagaaaaagaaagaaagaaagaaatccaagagtatttcctaccaataggagaatacaatttactgaggaagaacccacctggataaaatagaatt

SEQ ID NO: 26939 - DNA, 201 bp, Homo sapiens
acttgggtacccatgaatctactttctgtctctattgatttccctttttttgtcacatttctctctctgaatacagttttagaaagaaagaaggaaagaargaaaaagaaagaaagaaagaaagaaagaaagaaagaaagaaagaaagaaagaaagaaagaaaaagaaagaaagaaagaaatccaagagtatttcctacca

SEQ ID NO: 26940 - DNA, 201 bp, Homo sapiens
taaaagagggatggcattgtacctgttgagagaaaatacaaaatacttgccgtaatattagacacacacacacacacacacacacactctctctctctctyacacacacatacacacacacacacaaaattgttagctggccatgttattgtaactcctaccacacatatttttacattataatacattaataattttaat

SEQ ID NO: 26941 - DNA, 201 bp, Homo sapiens
gcctgatgccccacctgacccgactgtggaccaagttgatgacacctcaattgttgttcgctggagcagaccccaggctcccatcacaggtcagctaagcstccccctctttggctgctatgttaatcttaatgacatcagcagggagggcgcagattctgactgcggacctgcatatcactttaaatctccaatataatt

SEQ ID NO: 26942 - DNA, 201 bp, Homo sapiens
atgctgtcactggccgtggagacagccccgcaagcagcaagccaatttccattaattaccgaacaggtacaaacttctactctggggtgacaccagcttttacttattcagatactgttttgcaatgttctcccaaggtatttttctaattgtagaatagattttcctttttaatgagcaacaacctgcagctagcacctg

SEQ ID NO: 26943 - DNA, 201 bp, Homo sapiens
tatgctgtcactggccgtggagacagccccgcaagcagcaagccaatttccattaattaccgaacaggtacaaacttctactctggggtgacaccagcttttacttattcagatactgttttgcaatgttctcccaaggtatttttctaattgtagaatagattttcctttttaatgagcaacaacctgcagctagcacct

SEQ ID NO: 26944 - DNA, 201 bp, Homo sapiens
attcacaaacatattatcagtggtggaaataagtgatttttattttttcttctctttacttttctgtattttccaaattttatttaaaaggaatgtattctgttaaaagttttaaaaaggacacaatgcatgcaatcctgggttgagggcttaccttctcccacttctaatgctactctactactcagtgacattttaaag

SEQ ID NO: 26945 - DNA, 201 bp, Homo sapiens
aattcacaaacatattatcagtggtggaaataagtgatttttattttttcttctctttacttttctgtattttccaaattttatttaaaaggaatgtattctgttaaaagttttaaaaaggacacaatgcatgcaatcctgggttgagggcttaccttctcccacttctaatgctactctactactcagtgacattttaaa

SEQ ID NO: 26946 - DNA, 201 bp, Homo sapiens
gtcatttcatttttgattcttaagtattataaaatgattcagtaaaacaaaaactgttacattattttctgcagttatttcaaaggctttttctaaaaaawtttttagtatcttttcttataaccctctccccccaccaccatatgacacttcatatgctggtaactcacttattacctattttagataaaaggttcaaat

SEQ ID NO: 26947 - DNA, 201 bp, Homo sapiens
ggccggacggggtggctcacgtcagtaatctcagcactttgggaggccgaaatgggcagatcacttgaggtcagaagttcaagaccagcctggccaacatrgtgaaaccccatctctactaaatatacaaaaattagcaaggtgtggtggcatgcacctgtaatcccagctactggggaggctgaggcaggagaatctttg

SEQ ID NO: 26948 - DNA, 201 bp, Homo sapiens
aaactcctgacctcaagtgatccacccactttggcctcccaaagtgctgggattacaggcgtgagccatcgtgcccagccggaaggtcttactagtatccktattgaatacttaaagaaactgaggctttaaaaaagttctgcaacttgtagggtcacagagataggaagggatagagctggctctataacctatgtccga

SEQ ID NO: 26949 - DNA, 201 bp, Homo sapiens
tggtggcagtaaagaagataatttttttcctctcaagaaatttctcacctgatttgggtatttatgcatttctaataacacaagttttgttgaaaatgtaraaaattggccggacggggtggctcacgtcagtaatctcagcactttgggaggccgaaatgggcagatcacttgaggtcagaagttcaagaccagcctggc

SEQ ID NO: 26950 - DNA, 201 bp, Homo sapiens
aaagaaactcagaagactttcctacccagttggtagattctgtaaagtagcttgctgttgtctgtcatcagctctcaaaaaaaaaaaaaaaaaaaaaaaaatagatcattgtcatggtacatggagagggaagtgagaaaatgtggagaaacatcttccttagaatatggtaaagaagcccgggcgtggtggcagtaaaga

SEQ ID NO: 26951 - DNA, 201 bp, Homo sapiens
caaagaaactcagaagactttcctacccagttggtagattctgtaaagtagcttgctgttgtctgtcatcagctctcaaaaaaaaaaaaaaaaaaaaaaaaatagatcattgtcatggtacatggagagggaagtgagaaaatgtggagaaacatcttccttagaatatggtaaagaagcccgggcgtggtggcagtaaag

SEQ ID NO: 26952 - DNA, 201 bp, Homo sapiens
ataaatgcattcagaggttttttcccaatgggaacaaaatttgattgagatgtaaagagaggaagaattgtggagatgtcaaacatgtgaccagagctatkaacacacttgatacccttgaacttaaacttacccaactcaaaatatctggccttctgcgatcttacctttctacatttataataagatttgcaaggttgt

SEQ ID NO: 26953 - DNA, 201 bp, Homo sapiens
aacccttcctgtaactattttctatgacacgtttggactacgttttctgcctccagggctcaaaaattctaccccttcacctgacagcacttagatgtctytgatgcacacaaagcttcttcccaagtgagaattcttaggatgaccaaactgaactgatccttttgcacacatacatgtttagacctggtgatcatttat

SEQ ID NO: 26954 - DNA, 201 bp, Homo sapiens
gtatgttttacatctttatgttaaagattaagccaggtattgttttctggattcctagagagaagggtaatactatgttactcagaacacatccagtataycagcatgctttggtaacttctggaagtcaagaaaactttcataaccaacttattccgcatcttcagagaagactacataaatagaaaaacatatcacttt

SEQ ID NO: 26955 - DNA, 201 bp, Homo sapiens
gatgctgggtgtgtcattctttctgaacagagtgccacttaaaaaaaatgtggctgaatttttgcttacacactacactttaaattacagggagcttgcayaattcaaaataacctttttttcctgtttttcttccaaatttccctacagctgagaagtgttttgatcatgctgctgggacttcctatgtggtcggagaaa

SEQ ID NO: 26956 - DNA, 201 bp, Homo sapiens
agagagaagggtaatactatgttactcagaacacatccagtatatcagcatgctttggtaacttctggaagtcaagaaaactttcataaccaacttattcygcatcttcagagaagactacataaatagaaaaacatatcactttgataaggttcaatctcagctcactgccactgacatagagttgaacaaaaggtttag

SEQ ID NO: 26957 - DNA, 201 bp, Homo sapiens
aatttcctgtgatctctctgggaaagcaggattcatgacctcttccttgccatccagatttctctgtggttttccattgtgttctaagcaagacacttaaytgaattgactccaagtgaccagacctgttaacgtttcccctgtctctgatgggaaagctgttgtctgtgtctctactttagccaacctaagtacctacca

SEQ ID NO: 26958 - DNA, 201 bp, Homo sapiens
atctgtatctctcacttcattttattctttgaggtgtaccatgttacttgtggaatagagaagtgggttttcctttagaggggattagtgaactagaaaarcttgtacctaagtgaggctcacatggactttccttttcccctcagctgaagagacttgctttgacaagtacactgggaacacttaccgagtgggtgacac

SEQ ID NO: 26959 - DNA, 201 bp, Homo sapiens
gcccataaacttgggtacccatgaatctactttctgtctctattgatttccctttttttgtcacatttctctctctgaatacagttttagaaagaaagaargaaagaaggaaaaagaaagaaagaaagaaagaaagaaagaaagaaagaaagaaagaaagaaagaaagaaaaagaaagaaagaaagaaatccaagagtatt

SEQ ID NO: 26960 - DNA, 201 bp, Homo sapiens
aacttctcagacattatactcatgcgagctgccttcagggcattttctttttccttttcacatctgtgcttaatgagtagcatttttgcacattgtttttytaagctttatatcctcatctgtaagaggagaggatgatagtgcttaccttaaaagtttgttgatggttagatgaaaaaaattcatatgaaacacttagta

SEQ ID NO: 26961 - DNA, 201 bp, Homo sapiens
aatttctacaaggcttgtgattgagaaaacttcattctttgtcaattatcaacaaacttctcagacattatactcatgcgagctgccttcagggcattttytttttccttttcacatctgtgcttaatgagtagcatttttgcacattgtttttctaagctttatatcctcatctgtaagaggagaggatgatagtgctta

SEQ ID NO: 26962 - DNA, 201 bp, Homo sapiens
ttggcagagtcctgtgtgacatcttttgataaattaatctcatgtgaaagaagtcacccacaaaattctttagccagttgtcttgcccatacctttggttytgagggagaccattatgtaatcacttgactaatcacctggtattgacagtgacacaacttgacgccacaatttctacaaggcttgtgattgagaaaactt

SEQ ID NO: 26963 - DNA, 201 bp, Homo sapiens
ttggcaggaaaatctggcaggaacgatggcccctatccttgttccatttctctcctcagctggttaggaccactataccctccctcttttttttttttttkttttttgttttttgtcttcctttgctttgtttaaacagtgagggttattggtaagaggagagcccgtgtcattcctcactataatgctttctctctgctt

SEQ ID NO: 26964 - DNA, 201 bp, Homo sapiens
gaaaatctggcaggaacgatggcccctatccttgttccatttctctcctcagctggttaggaccactataccctccctcttttttttttttttgttttttkttttttgtcttcctttgctttgtttaaacagtgagggttattggtaagaggagagcccgtgtcattcctcactataatgctttctctctgctttggatgt

SEQ ID NO: 26965 - DNA, 201 bp, Homo sapiens
gcaaagaaactcagaagactttcctacccagttggtagattctgtaaagtagcttgctgttgtctgtcatcagctctcaaaaaaaaaaaaaaaaaaaaaaaaatagatcattgtcatggtacatggagagggaagtgagaaaatgtggagaaacatcttccttagaatatggtaaagaagcccgggcgtggtggcagtaaa

SEQ ID NO: 26966 - DNA, 201 bp, Homo sapiens
tcagaaagttttgtgtttggcatcattaccactctgttgacatataaatttcctcttgagcttaggaggcttctctgagagtcaaacatttactttgagagtgggcagatcttgctttacttggaaggatacacttacaggatagaaacacagaatacttgaacactgaagaatttgaaaatgtcaattctcagaagatct

SEQ ID NO: 26967 - DNA, 201 bp, Homo sapiens
ttcagaaagttttgtgtttggcatcattaccactctgttgacatataaatttcctcttgagcttaggaggcttctctgagagtcaaacatttactttgagagtgggcagatcttgctttacttggaaggatacacttacaggatagaaacacagaatacttgaacactgaagaatttgaaaatgtcaattctcagaagatc

SEQ ID NO: 26968 - DNA, 201 bp, Homo sapiens
gagtaaaacctcgtcaaaaagaaaaaataataaaaataaaaaaaaatggaacaagatactcagggatgtatatttaattttttaaaaaatattctgctctcattttaatatggcagaaccgattgctttctaagtgtggcttttttccagtaaaggttaattattaagaccactagtcctggcctgggtcaatcccagtat

SEQ ID NO: 26969 - DNA, 201 bp, Homo sapiens
agagtaaaacctcgtcaaaaagaaaaaataataaaaataaaaaaaaatggaacaagatactcagggatgtatatttaattttttaaaaaatattctgctctcattttaatatggcagaaccgattgctttctaagtgtggcttttttccagtaaaggttaattattaagaccactagtcctggcctgggtcaatcccagta

SEQ ID NO: 26970 - DNA, 201 bp, Homo sapiens
gcagctcagcgtgaccataatcttggtttcttactttgtggctgagggcaagaatatctttatattggcatatccaccaccccagggctgttgcttctgtmcaccctggaatcactaattacagcatcacccagtatacaagcccctgcatcacaatgtctgtcccttagccgtagacctgtcacatgttaatcatgtgtt

SEQ ID NO: 26971 - DNA, 201 bp, Homo sapiens
taacctagagcatagcaaatgaattctaaattctcaagtaggaggagctaagagcaagagagctgcaaccaagctacaaactaaactctgaattcaatgcmcagctccattaattttgaaagatgtaatgtttgttgctatcttaatatacttttgatatctacagctttaaaaaaatcatagtggaaaaacacctgcagg

SEQ ID NO: 26972 - DNA, 201 bp, Homo sapiens
gaagacctagaatttttcttcttaaataccaaacacgaataccaaattgcgtaagtaccaattaattataagaaatatatcaccaaaatgtaccatcatgmtcttccttctaccctttgataaactctaccatgctccttctttgtagctaaaaacccatcaaaatttagggtagagtggatgggcattgttttgaggtag

SEQ ID NO: 26973 - DNA, 201 bp, Homo sapiens
ttcttatttttggtgctaaaacccaaaacaaatcttttatttaaaaataagattttttttttttttggccaggtgtgatggctcatgcctgtaattccagyactttgggaggccgaggtgggtagatcacctaaggtcaggagttcgagactggcctggccaacatagtgaaaccccatctttactaaaaatacaaaaatt

SEQ ID NO: 26974 - DNA, 201 bp, Homo sapiens
catagatgaaacagcccactaaaccagtagtacctcaattcagccattagagctatcattatgaagtggcccacacatatatttggctttttctcacacartatttttaaaataaaaataaaaaatggctccttagaatccagactgaaaaaaaaatgcgagaattgcgatgttgattctaaattcccacatggcaaagaa

SEQ ID NO: 26975 - DNA, 201 bp, Homo sapiens
taggtctccttgaggagtgaacagtgggtttcttaatcttttgatttgggaaagtggagacaagcttcaaaaatgagtcatgatttaatgttattacaggrcactttagcacttgtccaacctgagtattttgaccattatctgcagtaaaatgctacaaagaagctttattggtctgtagattcaacttttaaaatatga

SEQ ID NO: 26976 - DNA, 201 bp, Homo sapiens
tttcattatcaggctgtaactctcattcacagaaatgattggagactttaggtctccttgaggagtgaacagtgggtttcttaatcttttgatttgggaargtggagacaagcttcaaaaatgagtcatgatttaatgttattacaggacactttagcacttgtccaacctgagtattttgaccattatctgcagtaaaat

SEQ ID NO: 26977 - DNA, 201 bp, Homo sapiens
agagaagtgggaccgtcagggagaaaatggccagatgatgagctgcacatgtcttgggaacggaaaaggagaattcaagtgtgaccctcgtatgtcatcasagatcatttttagtgccttattaagcattctcactttcattatcaggctgtaactctcattcacagaaatgattggagactttaggtctccttgaggagt

SEQ ID NO: 26978 - DNA, 201 bp, Homo sapiens
ttaaaccacaagtagatataaagctagagaaatacagatgtctgctctgttaaatataaaatagcaaatgttcattcaatttgaagacctagaatttttcktcttaaataccaaacacgaataccaaattgcgtaagtaccaattaattataagaaatatatcaccaaaatgtaccatcatgctcttccttctaccctttg

SEQ ID NO: 26979 - DNA, 201 bp, Homo sapiens
aggctctaagaatggtttcgacatcctaaacagccatatgatttttaggaatctgaacagttcaaattgtaccctttaaggatgttttcaaaatgtaaaawatatatatatatatatatattccctaaaagaatattcctgtttattcttctagggaagcaaactgttcatgatgcttaggaagtcttttcagagaattta

SEQ ID NO: 26980 - DNA, 201 bp, Homo sapiens
aaattagccagtcgcggtggcacgtgcctgtaatcccagctactcaggaggctgaggcagaagaatcacttggacccaggaggcagaagttgcagtgagcyaagatcatgcctctgcaccccagcctaggtgatagagtgagactccatctcaaaaaaaaacaaaacaaaacaattataacaatttgaatctgacattgca

SEQ ID NO: 26981 - DNA, 201 bp, Homo sapiens
tgaatcaggctttaaactgttgtgccagtgcttaggctttggaagtggtcatttcagatgtgattcatctagtgagtagttgctttgtccatccacttccrtgtttgtctcctcaagttccatgcatgcactcatgtgccaaggaagcatgtttggaagacacaggttcttccaaacatgaagcaaacaagagaatactgt

SEQ ID NO: 26982 - DNA, 201 bp, Homo sapiens
tcatagtggaggcactgaaagaccagcagaggcataaggttcgggaagaggttgttaccgtgggcaactctggtatgtaaacacgtactatttagacacargctcccctctgctgtacaccagagatgggcttttctgttgactgtacctttgttgccattgtctttttatctttgggatttaatgcaacacatcaacatg

SEQ ID NO: 26983 - DNA, 201 bp, Homo sapiens
ttccttcctttctctctctcttttcttcctttcctttcctttccttccttccttcctttctttctttctttctttctttctttctttctttctttctttcytttctttctttctctctcactctctctctctttctttcttatttttggtgctaaaacccaaaacaaatcttttatttaaaaataagattttttttttttt

SEQ ID NO: 26984 - DNA, 201 bp, Homo sapiens
taaatcagttgctacaaaaactgattggtttttgtcacttcatctcttcactaatggagatagctttacactttctgctttaatagatttaagtggacccmaatatttattaaaattgctagtttaccgttcagaagtataatagaaataatctttagttgctcttttctaaccattgtaattcttcccttcttccctcca

SEQ ID NO: 26985 - DNA, 201 bp, Homo sapiens
tctctccaattagagataacagacttagagttacaagggaccttgataattaaagaatactgtagtaagccctgttatcttaactaagaaacgcctctgtytctaaagtttaaaaaaaaaggcaaaaaaaaaaaaacctttcaagtaaaagagtaaactcccaagcattcctataaaaatcagtcagatgttatttttttt

SEQ ID NO: 26986 - DNA, 201 bp, Homo sapiens; identical to SEQ ID NO: 4441

SEQ ID NO: 26987 - DNA, 201 bp, Homo sapiens
atttaaatcagtgatactaaaaatgtgctccatagactggctgctggcccgttaattgtttgctgctagtctgcaacaagaaaaacggttgtgccagaacrtaaatcacaaagcacactgcttagtacagctgagaatttttctgaagccagattttcttgatgaaggaagcagtgtgttaatttgcacacattgccaagc

SEQ ID NO: 26988 - DNA, 201 bp, Homo sapiens
agcctgcatctgagtacaccgtatccctcgtggccataaagggcaaccaagagagccccaaagccactggagtctttaccacacgtaagctgaaaattaartgccttttcttaactatatttacattctctattcttcatgctttaaaacaaaacaaaacaaaacaaaaaaaacattaaaaaattagtacataatttaaat

SEQ ID NO: 26989 - DNA, 201 bp, Homo sapiens
cactggagtctttaccacacgtaagctgaaaattaagtgccttttcttaactatatttacattctctattcttcatgctttaaaacaaaacaaaacaaaamaaaaaaaacattaaaaaattagtacataatttaaatcagtgatactaaaaatgtgctccatagactggctgctggcccgttaattgtttgctgctagtct

SEQ ID NO: 26990 - DNA, 201 bp, Homo sapiens
gccactggagtctttaccacacgtaagctgaaaattaagtgccttttcttaactatatttacattctctattcttcatgctttaaaacaaaacaaaacaamacaaaaaaaacattaaaaaattagtacataatttaaatcagtgatactaaaaatgtgctccatagactggctgctggcccgttaattgtttgctgctagt

SEQ ID NO: 26991 - DNA, 201 bp, Homo sapiens
agagagccccaaagccactggagtctttaccacacgtaagctgaaaattaagtgccttttcttaactatatttacattctctattcttcatgctttaaaamaaaacaaaacaaaacaaaaaaaacattaaaaaattagtacataatttaaatcagtgatactaaaaatgtgctccatagactggctgctggcccgttaatt

SEQ ID NO: 26992 - DNA, 201 bp, Homo sapiens
gggaagctgaggctggtggatcacttgaggccaggagttcgagatcagcctggccaacatggtgaacctccatctctaataaaaatgcaaaaaaaatagcygggtgtggtggtgtgcacctgtaatcccagctactcgggaggccgaggcagaagaattgcttgaaccggaaaggtagaggatgcagtgagctgaaattgt

SEQ ID NO: 26993 - DNA, 201 bp, Homo sapiens
cctggaacttctaccagtgccactctgacaggcctcaccagaggtgccacctacaacatcatagtggaggcactgaaagaccagcagaggcataaggttcrggaagaggttgttaccgtgggcaactctggtatgtaaacacgtactatttagacacaggctcccctctgctgtacaccagagatgggcttttctgttgac

SEQ ID NO: 26994 - DNA, 201 bp, Homo sapiens
acaggctcccctctgctgtacaccagagatgggcttttctgttgactgtacctttgttgccattgtctttttatctttgggatttaatgcaacacatcaayatgaaataaatgagcaactttatattaaattaatctctcccccacctcctgccatatcctgttgtcttcacaaaatgcatacgtaattgacagactctca

SEQ ID NO: 26995 - DNA, 201 bp, Homo sapiens
tcacatccccagggaagatgtagactatcacctgtacccacacggtccgggactcaatccaaatgcctctacaggacaagaagctctctctcagacaaccrtctcatgggccccattccaggacacttctgagtacatcatttcatgtcatcctgttggcactgatgaagaacccttacaggtaattaattgttctcttca

SEQ ID NO: 26996 - DNA, 201 bp, Homo sapiens
tctcaccttttctcctttcttggttctcttcctataaatcccatagtttcagaccttttaaattaggagagctctctggggaatgtgcttaaggtggagarcgattctatactaggcaggtagaaaggaatattcctcagctgtcttcaaatgattcattaaggaaaagcagggtacagtgataggaccatgagatttgga

SEQ ID NO: 26997 - DNA, 201 bp, Homo sapiens
ttgctctgaatttgaaactttaagttgacaatcttcgtgcttgttagcagcaggatcattaatatctcgtctcaatggcccagcccacacatatggatgaycactagcaagtgtaatgatctcaatatttatttctcattcagttgggtttccttgtatttgccacattagtgtttaccctgttcctaatggcaaaatatt

SEQ ID NO: 26998 - DNA, 201 bp, Homo sapiens
tgctacaaaaactgattggtttttgtcacttcatctcttcactaatggagatagctttacactttctgctttaatagatttaagtggaccccaatatttaytaaaattgctagtttaccgttcagaagtataatagaaataatctttagttgctcttttctaaccattgtaattcttcccttcttccctccacctttcctt

SEQ ID NO: 26999 - DNA, 201 bp, Homo sapiens
ttccagctgagttgctctgaatttgaaactttaagttgacaatcttcgtgcttgttagcagcaggatcattaatatctcgtctcaatggcccagcccacayatatggatgaccactagcaagtgtaatgatctcaatatttatttctcattcagttgggtttccttgtatttgccacattagtgtttaccctgttcctaat

SEQ ID NO: 27000 - DNA, 201 bp, Homo sapiens; identical to SEQ ID NO: 4570

SEQ ID NO: 27001 - DNA, 201 bp, Homo sapiens
gccaaaggagataatctacacattactagttatatatttcttgaaatggatgaatttgatatataccaaggaaacgttttaaaataccaaaactttacatrgatgagccaagcaggcactaatctctagctatgctcctgtgcagatgtcagcccaccaagaagggctcgtgtgacagatgctactgagaccaccatcacc

SEQ ID NO: 27002 - DNA, 201 bp, Homo sapiens
catagaagtcttaactttgcttcaaaagcataaggtagaattgaaagatttagaatggagtcatttcttttacctaatagctgatctcagattcctccttsgtcaagatataatttatttaaaagaaaaaaaaatgacactttggacacatttctatatggaatgtcctggaccgaaacatgaaatagtgtgtgcttgtca

SEQ ID NO: 27003 - DNA, 201 bp, Homo sapiens
atagggaatgtggcaggttacaattaaaaaatcccattttcaagggagacaattcaactcttaagaaaaaaaaaaaaagaccgctgttgggacttcccatrtttggaaacatttaaagattaccattaaggctgataaagcagaagaaacacaaagatgaccttgcagaaactaaggaagttttttcaaaatacttgaaat

SEQ ID NO: 27004 - DNA, 201 bp, Homo sapiens
actacaaacctaaaaatatttaccctaaaatgcagtgtaagggccgggaagggtggttcacacctgtaatcccagtactttgaggcgccgaggtgggaggrttgcttgagctcgggagttcaaggccagtctgggtaacatagcgagacccctgtctctacaaaaaataaaacaattagccaggcatggtggcacatgcct

SEQ ID NO: 27005 - DNA, 201 bp, Homo sapiens
tcaggagtttgagaccagcctggccaacatggcgaaaccttgtctctattaaaaatacaaatgttaccaggcatggcagtgggcgcctttggtcccggctwctcagaaggctgaggtaggagaatggcttgaacccagaaggcggaggttgcagtgagctgagattgtgccattgaactccagcatgggggacagagcaag

SEQ ID NO: 27006 - DNA, 201 bp, Homo sapiens
agtagtataggaaaaacagaggaaatgagaaatggcttggctcttaatgatatagttgaagatgttaaattagcatacatttcaaagtcaagctaattaarttctaagtgggtctgacaaatacagttctgggtaggctggaattagcaagaaagagaagcatgaactggctgaggtttacgatgactaaggtttagttgg

SEQ ID NO: 27007 - DNA, 201 bp, Homo sapiens
gcccattataggggtttttatctttaacttgctatttttccagatcatggttctgaagaccctgtgacacgtcccagttcacctactgtcttgtgagtcaraatatacaaataactttttggtcctgactttccccacccctacaggatggtgccatgacaatggtgtgaactacaagattggagagaagtgggaccgtca

SEQ ID NO: 27008 - DNA, 201 bp, Homo sapiens
ggcacagagtatgtggtcagcatcgttgctcttaatggcagagaggaaagtcccttattgattggccaacaatcaacaggtaacttttcttgtctgcaaaraaactcagaagactttcctacccagttggtagattctgtaaagtagcttgctgttgtctgtcatcagctctcaaaaaaaaaaaaaaaaaaaaaaaaatag

SEQ ID NO: 27009 - DNA, 201 bp, Homo sapiens
tcaccatgttggccaggttggtcttgaactcctggcctcaagtgattcacctacatcagcctcccaaagtgctgggattacaggcatgagccactgcgccyggccaaagtaatattttcaataagaaaaataacagtgatgtcaggatgctagaaaatgcaaaataaatttgttataattcctgattctggtgataaaata

SEQ ID NO: 27010 - DNA, 201 bp, Homo sapiens
acttgttgaggaagttgggattggaatgagcctcagcagatgggcaaggtttgaataggaagagaagagacatttcaggagaaagaaacaacatagagagmcagatgtaggtataagatatggtaataagccaaaatgtattaagagttataaatgcatgaaatcatcatcaaagcttgcttagtgattaactgcttatat

SEQ ID NO: 27011 - DNA, 201 bp, Homo sapiens
tattttatggcatcagaaatgttctttccatgtcaagaatatttatgaactggcaagatgaaaataatttcaatagtattgcaaaatcattaatcataaaraagtctttgtcagagaattactgctgtccatcatattttcataatgtaacctatatttttatgggagggagggagggagggaagaagcatggaagagagg

SEQ ID NO: 27012 - DNA, 201 bp, Homo sapiens
cagacatggggacagttggcttttgctcctgatataaaatgctaccaacattgtgcatttctgtctgcagagaatgttattccaatgttatttccattttwttccaatgttatttccatttttttttctgactatacaggttaaaagcttctatagaggttaaaagatcattaactcttctttgtagcacctgggaaatcc

SEQ ID NO: 27013 - DNA, 201 bp, Homo sapiens
atggtatattaaaatgctaagacttttgcattataagcaaaagacagcctttaataattattctttatttagtgaacattttctaagtcttggaaaagggkcaatgttttgaattcatggccttatataatcttcacaagattccccaggaggtatagatatttttattattacgctagtattgcagatgagggaagcaag

SEQ ID NO: 27014 - DNA, 201 bp, Homo sapiens
ctgtaggaaatttatgagcttagaaacatgagtttgaggatttgcccaactgttttaaggactccacactggggtcagatgtcacctggaggagcatgacygtgtctcccatatagcgcagtgtccaggttttatgtgaagcaaacatggccagggcttccagagggcttatgcagacctgcgactgaagcaagatcaatg

SEQ ID NO: 27015 - DNA, 201 bp, Homo sapiens
ttagtagagacggggtttcacgatgttggccaggatggtctcgatctcctgacctcgtgatccgcccgccttggcctcccaaagtgctgggactacaagcmtgagccacccactacacccggcccactgacagtatcaatttttattgtgttgttacttttagaaagtggcagaatttaaaaactgacaacactgtaggaa

SEQ ID NO: 27016 - DNA, 201 bp, Homo sapiens
ggtaattaattgttctcttcacttctcatggggcagcacagaaaggaataagttaggtaactgaagtgaccagccctcgaataaaaagtggcttcatggcygggtgtgatggctcacgcctgtaatcccagcactttgggaggccgaggcaggtggatcatttgaggttaggagttcaagaccagcctggccaacatggtg

SEQ ID NO: 27017 - DNA, 201 bp, Homo sapiens
tggtcatcgacgcctccactggtaactataccttctactgaggaaatgccattgacttgtatgcaatcagtttcatgaactcaaaaaacaaatgtgaggcrtatatttttgtattatagattccagagaatcttgtttccggtttacagtattctcagattcttttaagtgtgtttagaacggctcgggagaaaagtgtgg

SEQ ID NO: 27018 - DNA, 201 bp, Homo sapiens
aaatttttagaggtgataggtttgttcatttcttgaatgcggtgatggtctcccaagtcacacatatgtaaaaacccatcactttaaagatatgcagtacrttgtatgacaagaaattgcttttaaaaggagcaaactaccttccagggttgttgtgaggcataaatggcaatccacagcaccacagcaaggattatcatg

SEQ ID NO: 27019 - DNA, 201 bp, Homo sapiens
atggcattgtacctgttgagagaaaatacaaaatacttgccgtaatattagacacacacacacacacacacacacactctctctctctctcacacacacayacacacacacacacaaaattgttagctggccatgttattgtaactcctaccacacatatttttacattataatacattaataattttaatatttattgaa

SEQ ID NO: 27020 - DNA, 201 bp, Homo sapiens
acagatctctagtcatcactgtttttatttgaatgtctctcatccctctcaactcttttactgcccaatttctgtgattcctgaagacttcaacaatcaayactctctttttttgtttgttttgtttttttttttgagacagagtctcactctgtcacccaggcttggagtgcagtggcgccatctcaactcactgcaacc

SEQ ID NO: 27021 - DNA, 201 bp, Homo sapiens
ggtagaattgaaagatttagaatggagtcatttcttttacctaatagctgatctcagattcctccttcgtcaagatataatttatttaaaagaaaaaaaartgacactttggacacatttctatatggaatgtcctggaccgaaacatgaaatagtgtgtgcttgtcacactctgctcatttcttttcaaattaaaagttg

SEQ ID NO: 27022 - DNA, 201 bp, Homo sapiens
agggaggccttgggaagcttactcatggtggaaggccaagggggagcaggcacatcacatggctgtggcaaaagcaagaccgagagagagagagagttggsgggggaggaccttatacatttaaatgacccagtctcttgagaactcactgtcataaagagggcaccaagccacaagggatctgcccccatgatccaaaca

SEQ ID NO: 27023 - DNA, 201 bp, Homo sapiens
cccaactccaccagtggtccactgtgtgacttccctgctccctctaagcaagtcactcctctcctctgggtctctgtttccttacctataaaatgagaacrtttcttcatgtgatctcaagtcccttttaaaatcgctaggattctttgaaaaccttttctatcatctagtgcagagaacttgttgaggaagttgggattg

SEQ ID NO: 27024 - DNA, 201 bp, Homo sapiens
gactgacatctagtttatgctctacttgttagaatttgttttcatagagctaagcttggggagaccactggcttctgctatatcttaacaatgcatattasgccattcttgcattactataaagaaataccggagactgggtaatttctaaagaaaagaggcttaattggcccacaggccagcaggctttacaggaagcat

SEQ ID NO: 27025 - DNA, 201 bp, Homo sapiens
catacatgcagaaaactgctaggaacctaggggactgatgtacctcttaacataaggccaatttcaggggaaactacagaaagagggttcagagacaaaakggaacattctctttgcctctctatgataaggaaaaaattatgatttacacctgtcagatcataaaaaagaaaaatacgctaatacccacttttctcattt

SEQ ID NO: 27026 - DNA, 201 bp, Homo sapiens
ggacagaaatagaacccacccctagatcaagtctgcagtattgttctcagcttatgcgtgcatctgtcttgtgtctatatgcagatgaggcaacgtgttaygatgatgggaagacataccacgtaggagaacagtggcagaaggaatatctcggtgccatttgctcctgcacatgctttggaggccagcgggtaagactgg

SEQ ID NO: 27027 - DNA, 201 bp, Homo sapiens
ttcagtgaaagaaactgactgttctctgaattgttttttgtgggccattaaaaatggtcacacagggctggccatggcattttggcacagtcaccagcagycaagtggtgtataatttcagaggtactaaaaggcatcgggtcacccatcccagtcatgtccccccaccccccaccaaacaccatcaaaataataacatac

SEQ ID NO: 27028 - DNA, 201 bp, Homo sapiens
taatttttggttatgtctatccttttgctcaacattttaaaggaagtggtcttaaatctcccacatatctacatcacaataacaacctctattcacaaacygattcctattaaatacatttccatttacattacagagaattatgagactccttatttctagctgaacatcatttgttattttcaactcgacattttgaat

SEQ ID NO: 27029 - DNA, 201 bp, Homo sapiens
gctgcagaagattaaagtacttttgcagacggaatcgctcttttcttaaattactcttgaaattcctcagaggagaaaaatactaacaataatttttggtyatgtctatccttttgctcaacattttaaaggaagtggtcttaaatctcccacatatctacatcacaataacaacctctattcacaaaccgattcctatta

SEQ ID NO: 27030 - DNA, 201 bp, Homo sapiens
tttctctctgctttggatgtaccgataattgcagttcagggttcctggaacttctaccagtgccactctgacaggcctcaccagaggtgccacctacaacrtcatagtggaggcactgaaagaccagcagaggcataaggttcgggaagaggttgttaccgtgggcaactctggtatgtaaacacgtactatttagacaca

SEQ ID NO: 27031 - DNA, 201 bp, Homo sapiens
cacctcgggcccagataacaggataccgactgaccgtgggccttacccgaagaggacagcccaggcagtacaatgtgggtccctctgtctccaagtacccmctgaggaatctgcagcctgcatctgagtacaccgtatccctcgtggccataaagggcaaccaagagagccccaaagccactggagtctttaccacacgta

SEQ ID NO: 27032 - DNA, 201 bp, Homo sapiens; identical to SEQ ID NO: 4434

SEQ ID NO: 27033 - DNA, 201 bp, Homo sapiens
atctgtttggctcagagctaactgtgaacttcagaagtgtttgttttgcctttttaaaaataccattgctttaatgtaactataatttctgagactgatgygaaagtcttgctggaaaattagacttcccaaaggatcacagtcaagcaaaatggttccacaatttctcatgactggcagagttttggcaaagttttgtgt

SEQ ID NO: 27034 - DNA, 201 bp, Homo sapiens
acagtaaaggtcatttatgttatcttttcaaaacttaatagacatttaaccatcataagcttgtcccccctcaaaatcatgattgacaagactaaataaartgtatatcaggtgtctctttatggaggaaattgtagtaggatttatttaaaggatcaatatttaaatagccctatgccaattatcataaataattaagga

SEQ ID NO: 27035 - DNA, 201 bp, Homo sapiens
gagggatggcattgtacctgttgagagaaaatacaaaatacttgccgtaatattagacacacacacacacacacacacacactctctctctctctcacacwcacatacacacacacacacaaaattgttagctggccatgttattgtaactcctaccacacatatttttacattataatacattaataattttaatattta

SEQ ID NO: 27036 - DNA, 201 bp, Homo sapiens
tatcatttataaaagagggatggcattgtacctgttgagagaaaatacaaaatacttgccgtaatattagacacacacacacacacacacacacactctcwctctctctcacacacacatacacacacacacacaaaattgttagctggccatgttattgtaactcctaccacacatatttttacattataatacattaat

SEQ ID NO: 27037 - DNA, 201 bp, Homo sapiens
atgttaatggggttccagtgccagaccctcccaaagtgctcaacttccttggttactggctacctccaccaagattaacttgagtacatataaaggaaaayaccacctcacagagcaaaatatgaggaacccaggagtaagcttgcatgtgaggggtggcactttggcttaaggcaggacaccgctttttttggcataaca

SEQ ID NO: 27038 - DNA, 201 bp, Homo sapiens
tattagtttttccctaaacttctgatatttagctgaaatgtcataagtaacttatcaaagctggctactggcctttctgattaaaaactgacaccataacrtccatctacaaattttcccctagaagcttaagggtcatttcatttttgattcttaagtattataaaatgattcagtaaaacaaaaactgttacattattt

SEQ ID NO: 27039 - DNA, 201 bp, Homo sapiens
attatggatcttctgtccttctgctggaaacaacagacataagatcattatgcatttcacttaaacaccagtgaaactccactcttgacgtttcgaatgaytgaattatactagacatatatatgttaatggggttccagtgccagaccctcccaaagtgctcaacttccttggttactggctacctccaccaagattaac

SEQ ID NO: 27040 - DNA, 201 bp, Homo sapiens
caccccacgctcaggtaacttttttaagaagacacttcctatgttatcttatcaggattgttcctgaaggagggttgttttgtctctgtcaacagtcctcwcattcaagaaatcttatatattagtttttccctaaacttctgatatttagctgaaatgtcataagtaacttatcaaagctggctactggcctttctgatt

SEQ ID NO: 27041 - DNA, 201 bp, Homo sapiens
aagaaaatcaagaaagtacacctgttgtcattcaacaagaaaccactggcaccccacgctcaggtaacttttttaagaagacacttcctatgttatcttawcaggattgttcctgaaggagggttgttttgtctctgtcaacagtcctctcattcaagaaatcttatatattagtttttccctaaacttctgatatttagc

SEQ ID NO: 27042 - DNA, 201 bp, Homo sapiens
ggtggagtttgcagtgagctgagattgagccactgcactctagcctgggcaacaagagcgaaactctgtctcaaaaaaaaaaaaaaaaagtgaaggtgccyagtgtctgcaactatgtcaccccgggcatatcacatatcactctgtttttccgtctgtaaaacgggagcaacaatgccattgccttatcatcagaaggat

SEQ ID NO: 27043 - DNA, 201 bp, Homo sapiens
acttcctggtgcgttactcacctgtgaaaaatgaggaagatgttgcagagttgtcaatttctccttcagacaatgcagtggtcttaacaagtaagcagttsaatgtatctgttccataaatattaacctagagcatagcaaatgaattctaaattctcaagtaggaggagctaagagcaagagagctgcaaccaagctaca

SEQ ID NO: 27044 - DNA, 201 bp, Homo sapiens
cggaggttgcagtgagccaggatcacgccactgcactccagcctgggcaacaagagcgaaactccatctcaaaaaaaaaaaaaaaaagtacattgaattgraaagtcttcaaaaagcagcagtgatgaattttttgagatttttaacaattacaaaaattcagggttttttctaatggatgccacctgagactttattttc

SEQ ID NO: 27045 - DNA, 201 bp, Homo sapiens
tgaaaaaaaaagccaaattaatatatttcttttttgattcactttttaagtgatcatttttaaaactttacttttgacccactgaatttatttagatagarggaaaagagatgatgggagggaagtttagataaaggatggaagttggttttatttaaacaatagccctgtgatttcctaatgagaagtgactagaaattg

SEQ ID NO: 27046 - DNA, 201 bp, Homo sapiens
aaattttatttctttaacagctgggctgttcttccctaacaagacctgccagaacccatagctcacacttagaatcacatcctttgtttgacatcgtttgkgggtttgtggtttggtgattttcccataatggccttcccaggcagagagcatcatcttaaacttgggaagactctaggtggctggctcaagcaatagaaa

SEQ ID NO: 27047 - DNA, 201 bp, Homo sapiens
ctttaaagtaatgatattagggaagcggtgaatacaaatgaatatgtttaaaagaattccattctttggcatttagtgtgaagagagaaatatttgttatygctggaaatcatgactcaatccccttgattgtttaaaaaaatacaccaaagataaagtttgtaaatggccatatttatgattatgctactcaaatataga

SEQ ID NO: 27048 - DNA, 201 bp, Homo sapiens
aatacaaatgaatatgtttaaaagaattccattctttggcatttagtgtgaagagagaaatatttgttatcgctggaaatcatgactcaatccccttgatygtttaaaaaaatacaccaaagataaagtttgtaaatggccatatttatgattatgctactcaaatatagaagaactttctgaagagtgccagtatacctt

SEQ ID NO: 27049 - DNA, 201 bp, Homo sapiens
taaagacctgcagggttctgtgctctgaggaagggacataggctgggctttagaaaggtggcctggagagaagcaggtgtcaaagggcaaggcaacgggargaagaatggaggatccctttcatggactgttttctccctgtgcccaggggatcccccaatagaaatacactcagtattggtcaggacgttgttacattat

SEQ ID NO: 27050 - DNA, 201 bp, Homo sapiens
catatacacaaaagcattatgaaaagaataatcagcatctttttgaaacagtatttatcgtgactcaggtggtattttaagtgcccgcaatattttgtctmatttgctcttcagagcaactctaagacgtcagtattgttctcatctcattctacaaattgaaagtgcgggaaaggcaatgtgaatcactaaacatcacat

SEQ ID NO: 27051 - DNA, 201 bp, Homo sapiens
cctggcacactgcttaacaaatggtgaatgaaaaaaaaaaaagaaaagtcattctttttcttctttcaccctatgtccataatctggccatttgcagaacwtgatgtccagtgatcgaaatcaacagcatcagtgcatccaatatcttctagtctctcatcttcttattacatcattaattttatttactttaaaattaag

SEQ ID NO: 27052 - DNA, 201 bp, Homo sapiens
gaggtgtaagcatgttgtctacatggaggcaagaccagaataatagaaaatggaaacagattcccttaaagaggggaatcgtgtctttctcattggctcartgtagtctccgtagagtctagaatgcttcagcacctggcacactgcttaacaaatggtgaatgaaaaaaaaaaaagaaaagtcattctttttcttctttc

SEQ ID NO: 27053 - DNA, 201 bp, Homo sapiens
ccaagatggcactactgcactccagcctgggagacagagaaagaccctgtgtcaacataaataaatatataaataaatcatcaagtctcatattaaagacyctgtaaatatgacttattgttgacaaatgaaacaaatagaggtgtaagcatgttgtctacatggaggcaagaccagaataatagaaaatggaaacagatt

SEQ ID NO: 27054 - DNA, 201 bp, Homo sapiens
gccaagatggcactactgcactccagcctgggagacagagaaagaccctgtgtcaacataaataaatatataaataaatcatcaagtctcatattaaagastctgtaaatatgacttattgttgacaaatgaaacaaatagaggtgtaagcatgttgtctacatggaggcaagaccagaataatagaaaatggaaacagat

SEQ ID NO: 27055 - DNA, 201 bp, Homo sapiens
ctaaaaatacaaaaattagccaggcttgggggcgcacgcctgtagtcccagctcctcaggagctgaggtaggagaatcacttgaacccaggaggcaaaggktgcagggagttgagccaagatcgcgccattgcaccctagcctgggcaacagagcgagattctgtttcaaaaaacccccaagtgtattataaggcaataat

SEQ ID NO: 27056 - DNA, 201 bp, Homo sapiens
cagaggtgaacatttagactcaaaaacagcctccttcaacataaaccaaacatgcacatatcatagtacccatgcacacacttttgcatcacacacatagyccaggtagcttgaacgttgctagaaatatgaaagaaaaaacagataatctgcttttagatcattaaaaatcaacttgaattgataaatgtttgattttca

SEQ ID NO: 27057 - DNA, 201 bp, Homo sapiens
ttccaaggataaaaagaaacttttaaagtcttctatactcagccaggttatcaatcaaatatgagggcaaaataatattttcagacagattttaggcagtktatcttccatatatccttttctttaagggtatttgtagatacactccagaaaaacaagagtgaaatatgaaggaagttgtggggtccagcaaacagtgct

SEQ ID NO: 27058 - DNA, 201 bp, Homo sapiens
tgttgaatgagatcagaggtgaacatttagactcaaaaacagcctccttcaacataaaccaaacatgcacatatcatagtacccatgcacacacttttgcrtcacacacatagcccaggtagcttgaacgttgctagaaatatgaaagaaaaaacagataatctgcttttagatcattaaaaatcaacttgaattgataaa

SEQ ID NO: 27059 - DNA, 201 bp, Homo sapiens
catcataaagatagtgttttaagaaaagatagttttctgttctgcaagcataaattttctagctatttcattattatcttaaatggagttaacactacttwgaaattgatgctacttcccttattttccttttattttaaacaaaagaaccaaaaccatactttaaattttgttgataacagtgatatacatcaaggtgta

SEQ ID NO: 27060 - DNA, 201 bp, Homo sapiens
tcaaatattatttagtacaacactctgagtccttacttgtgagtatctgagttgatatagggcacaggtttcctgatgtcttttcccagaccctctccatytcaccatgctgctgtcctcttgagtgattaaatactgaaacgattacctataaagaaaataccccttctgcagacatggggacagttggcttttgctcct

SEQ ID NO: 27061 - DNA, 201 bp, Homo sapiens
acttcctgaacaaaaacatgctaaattccattgctgttcagtccatttcctttaaaggtgggctatgccacagggctagattttaaaacgtggaatttcasaccagtgctcgaaatcttatgaaagcaaaagggacctctgtagttgtactccactttggcttgagtaaaaaccactgctgtaccctttttctttcctttc

SEQ ID NO: 27062 - DNA, 201 bp, Homo sapiens
ccagggcttccagagggcttatgcagacctgcgactgaagcaagatcaatggcaggccgtctctagtattgtcgagggctcctgttaactacggagcacgyaggtagattgttggcaggaaaatctggcaggaacgatggcccctatccttgttccatttctctcctcagctggttaggaccactataccctccctctttt

SEQ ID NO: 27063 - DNA, 201 bp, Homo sapiens
ccacatagctgcttgctggaagcatttaggtggacatgttggagataaaatctggaaaggaaggaatccttgagtattggagtattacatgttgaccttaytcctactctttaaaaaggagaacagcaagatcccactgagcatagaggtgatttcggagggaagagattggaatttgacctcagatatgctctttggtgc

SEQ ID NO: 27064 - DNA, 201 bp, Homo sapiens
tggccaaaggtagtgttagccaagcctcattcctccatttcctcatctgtaatatgggaagattgtagctgattacctttaatgttccatcctaaatactraacacccagatgcaccttttctaggaacttggaagattctgcttttcccaaccctcagacactgtcagtgctggggaaggtgacttcacttttgaaggct

SEQ ID NO: 27065 - DNA, 201 bp, Homo sapiens
aggtaacaaggagaaagataggacaaaactaataacaaatgagcaatcttgcaatatgaaaaggttctccatgttttgatgcatttcttgtgatttttttwatctaacagcatagtgtatatattgtattctttaataggagaaataatttaacatgcactgcagagtttggttttattttttttctttactacagccact

SEQ ID NO: 27066 - DNA, 201 bp, Homo sapiens
gattaagccaggtattgttttctggattcctagagagaagggtaatactatgttactcagaacacatccagtatatcagcatgctttggtaacttctggawgtcaagaaaactttcataaccaacttattccgcatcttcagagaagactacataaatagaaaaacatatcactttgataaggttcaatctcagctcactg

SEQ ID NO: 27067 - DNA, 201 bp, Homo sapiens
atttatcccataaattaaaatgatttatctactctggagttagggatagtgtctctgacctaacgcatttgattagtgctgtaaagaagctggcctctggygtctttactgctccttctaagattgtcttggggtcttaattgttgcctttgggtttgaaggctccttttttgatattgtaaactaataacagctagagag

SEQ ID NO: 27068 - DNA, 201 bp, Homo sapiens
acctaacgcatttgattagtgctgtaaagaagctggcctctggtgtctttactgctccttctaagattgtcttggggtcttaattgttgcctttgggtttsaaggctccttttttgatattgtaaactaataacagctagagagtttgttgaagtaaaacagccattaactactggtgttgtaaataagtttaaaatcaaa

SEQ ID NO: 27069 - DNA, 201 bp, Homo sapiens
tgcatcccactaaagttctccactagcttcaattgcctcaagatctgttccatgttctatgaagtagtttcaacagaaatggcaattatcttagaagcaakggaaaaataaaagatgggcttcctgtcgggtgcctgtgacaggtgtcacatctaaccatggttttttagagcagttaatgccttgatagaacagatgaat

SEQ ID NO: 27070 - DNA, 201 bp, Homo sapiens
cttcctgtaactattttctatgacacgtttggactacgttttctgcctccagggctcaaaaattctaccccttcacctgacagcacttagatgtctttgaygcacacaaagcttcttcccaagtgagaattcttaggatgaccaaactgaactgatccttttgcacacatacatgtttagacctggtgatcatttatcaag

SEQ ID NO: 27071 - DNA, 201 bp, Homo sapiens
agtttagaagaaaaaacccacttttgcttgtaattctatatccaaacccatagtttttatttgatccagaataaactggaactgggaaaagttatgaagcygtagttaaatccaggcttctagaacagcaagaaccctttgtgtggatgtgtagatattatcttagtttaacatcccctaacccttcctgtaactattttc

SEQ ID NO: 27072 - DNA, 201 bp, Homo sapiens
aatactctttctgcacagaccacactggtgagtgtcccaagggggagccacagaagtgagaaaaactcactttcatgccctagttttatttgccagcattytagccatttattttgaacccgcccaagaagcatcgcttttgttcagtttggactcaagagatcgcagcgctcacgtaacagctgaggattcttccatctt

SEQ ID NO: 27073 - DNA, 201 bp, Homo sapiens
tttgcattccagaatttactttaccagtgtccttgtctgtatcagtgattcactttcgagatatgtttcttgttaacagttaacatccatagcatgctctmctttactgttcaaatgtggaccactttggtagtctatataaatatgggatgatagaagaacccagaaaaattgcaggctagcttgagaattctcctagta

SEQ ID NO: 27074 - DNA, 201 bp, Homo sapiens
atggcaataacaattgctacacaattctcccccagaatagtctcatatattaattttatggcatagatatagtcataaatattatcccaacatccttaagyagcatccttaattgacctgtataaatatagctttacaaatagagaaactgaggcatggcagcagaagtggtcatgaaggacatcagcagaagaactcagg

SEQ ID NO: 27075 - DNA, 201 bp, Homo sapiens
tgctaaagctcaccatgcccttatttctctaggtggccaccaaatatgaagtgagtgtctatgctcttaaggacactttgacaagcagaccagctcagggwgttgtcaccactctggagagtaagtaacaaaatgtcttcatatggacaaaccttctgtatagacaaaaattaaagaatggtaaatcagtggggttcagtg

SEQ ID NO: 27076 - DNA, 201 bp, Homo sapiens
ccgacattgaactctttttgtagtggaaaccatcctttatatgtggtttctatgctctggcaaactttgttacattctataaagtaacacacaattatttycttcatgtattggcattcgaaattttagaaattcagagaggacttagagatggccatgaaagacatgatatctaagcattctttttaaaaaacaagtttt

SEQ ID NO: 27077 - DNA, 201 bp, Homo sapiens
ttcctctgcatcaaataatcttattgtaattttatatcaacggaattcctttatgttgacctaagttttccagatgactattgggacagaattttataaayagctttggattttgtgcagctcttttagatgtattgtgcttattttaaaaggttgtggggggcaatttacatatccattggttgaatgcataaatcgact

SEQ ID NO: 27078 - DNA, 201 bp, Homo sapiens
aaaataggtctctcatgaaaagtggtaaccattttgaccaaagctttcccagaaacttgctggtttattagatattttgcatttaaaatgttactgtgatyatcagacttccaagatctttgtggcaatattttagcttaagacaaattagatgtctgattcaaaccttatctgttatttagaactctttaaatagcaagt

SEQ ID NO: 27079 - DNA, 201 bp, Homo sapiens
acatgcctgtagtcccagctactcaagaggctgaggtagaggatcacttgagcctacgagttcaaggctgcagtgagctatgataactccactgcactgcygcctggatgacacagagagaccgtttctaaattaattaattaacaattttaagaaagaaaaagggccattgcttatttttccatacaaaagtaaaataaa

SEQ ID NO: 27080 - DNA, 201 bp, Homo sapiens
cgagggacctggaagttgttgctgcgacccccaccagcctactgatcagctgggatgctcctgctgtcacagtgagatattacaggatcacttacggagaracaggtacagcagtaaaatgctattttacactctgattaaatcagattctgttgtggataacctgaaagcccaacagtgaacaaagaattaaagaaactt

SEQ ID NO: 27081 - DNA, 201 bp, Homo sapiens
aaaagaacaagtcccgtgtgaataggcccaatcaactttccccatatttcatgttagggtttatccaagttcacaggcaaatcgcaagaggcaagggtccrtagtgtttacaatctagttcagcatttgaatgtgccattgggcttaacaacttagaaaactaccaggatttccacactttatatgcatatgtctgtttgc

SEQ ID NO: 27082 - DNA, 201 bp, Homo sapiens
gaatctgacattgcaaatcagctttaccacttccaaggtatagaaaatccaggtctatgagactaacatcacattgtaaaaatcaaatcgtggtagaatayctttaaattaatataaatacatccccattgtggggacattttgcagggtatctgcttatctcacatacacctatgttttaataagtgatgcaacattgca

SEQ ID NO: 27083 - DNA, 201 bp, Homo sapiens
gcagaagaatcacttggacccaggaggcagaagttgcagtgagccaagatcatgcctctgcaccccagcctaggtgatagagtgagactccatctcaaaamaaaacaaaacaaaacaattataacaatttgaatctgacattgcaaatcagctttaccacttccaaggtatagaaaatccaggtctatgagactaacatca

SEQ ID NO: 27084 - DNA, 201 bp, Homo sapiens
caaccatctcaaaaataggaaatggtattgagatgcctgccccatccctctaaaagctctctctgtattctttcgagaagaaatacctttctcatgtaagmgatcattcgaatatgtaccagacctagagaggaggacttgtccaatcttgtctccaaggactggggcttcactggtttctccctgcttttatttgtagaa

SEQ ID NO: 27085 - DNA, 201 bp, Homo sapiens
atttacagagaaagaagttgtgaaaccaccatagttagttgctgtgctttgaatttcttttgctcaaatggcctcagcgaaatcttatttgcctatagcawatctacaaaaaattttcctagaccgtcttttctacaactggatggtaaagttgattgaagtgtgcctcatgtagctttatgtttggggcatttgaagggc

SEQ ID NO: 27086 - DNA, 201 bp, Homo sapiens
attcccgtgtaagggtgaaaaagaattattaggaaagatcctctttaaagaggaatagtaagaaacaataaaacttaggtgatatttaaggaaacaagtcwgattaaaagaaattttggagtatcctggcttatacacaagaccataaagcaagacatttgaagaggatactaaagttgtggattatttcctaagctctga

SEQ ID NO: 27087 - DNA, 201 bp, Homo sapiens
cttattcagatactgttttgcaatgttctcccaaggtatttttctaattgtagaatagattttcctttttaatgagcaacaacctgcagctagcacctgcrgcgaacagagttttgagccagataaagaaggaagcaccccaagggcaggaagttcagtcagttttgtcgatatattccgcatgtctgcaatacgacaggc

SEQ ID NO: 27088 - DNA, 201 bp, Homo sapiens
aaccaccaagtgagttatgctgggagtaaaggtttggggctttatattatgattcttaacagagaagctgcatagagagatggcatgaaatgcagcataakgtacgtgttcattcaacatgtcatctaagctccctttgcatcaaacttttcatttgtttgatcagttgccaccaggaacacagtatgttgggccaagggt

SEQ ID NO: 27089 - DNA, 201 bp, Homo sapiens
tttgactgaaaatatggcctacattcagaaacaaaagagtttcagggtgtcagaatctgcatgcgacagaaattaagattaactctgtgataaaagattcrctgtgacagagaacaagctatgggaacaacttggccaaaggtagtgttagccaagcctcattcctccatttcctcatctgtaatatgggaagattgtagc

SEQ ID NO: 27090 - DNA, 201 bp, Homo sapiens
cctcctccttgtgtccttgtggacatagaaatatgattaggcttagaggtgaacagtaaaggtcatttatgttatcttttcaaaacttaatagacatttawccatcataagcttgtcccccctcaaaatcatgattgacaagactaaataaaatgtatatcaggtgtctctttatggaggaaattgtagtaggatttattt

SEQ ID NO: 27091 - DNA, 201 bp, Homo sapiens
ttaaatagtcacatctccaaaatttttcttgaatagttgtctttaaaaatgtgtttacatttgtaaggatcttcataaacagaaggggtaattcaaagatrggcatggaattgacttatgccaattgattaaaacaaacatcctgtgtgttctgtgaaatacatacaactttaaaatgaaaaactcataattttatgcatg

SEQ ID NO: 27092 - DNA, 201 bp, Homo sapiens
gcttagataataaagtttgaaaatcaatgtattttttttcctagaagctttcagaaaacttaaatctgttaataatctggtgaagtgctttattacacatrcaaaattttgctctgtttgacagagtgtcagttagaaattcttgaaaaggttactataagacacaatttttatttctagtaatttaaacattgactgaca

SEQ ID NO: 27093 - DNA, 201 bp, Homo sapiens
aaatattaacctagagcatagcaaatgaattctaaattctcaagtaggaggagctaagagcaagagagctgcaaccaagctacaaactaaactctgaattsaatgcacagctccattaattttgaaagatgtaatgtttgttgctatcttaatatacttttgatatctacagctttaaaaaaatcatagtggaaaaacacc

SEQ ID NO: 27094 - DNA, 201 bp, Homo sapiens
cgggccagcagaattggtattatctgtgtttgtcagaaatgcaaactccctagttttttgttggacctccagaaacagaatctgcattttagccagacccmagatgatgtgtgtggcacattaaagattgagaagcctgatcctctcccaattctcacccaatgaaaaaatatgttacatcctctatccactgcttggtta

SEQ ID NO: 27095 - DNA, 201 bp, Homo sapiens
ttaaaaaatattctgctctcattttaatatggcagaaccgattgctttctaagtgtggcttttttccagtaaaggttaattattaagaccactagtcctgscctgggtcaatcccagtatgatcctgggcaagtaaattaaagaagataacttctctgtgcctcagtttttttttgttttgttttttgttttttcatttac

SEQ ID NO: 27096 - DNA, 201 bp, Homo sapiens
cagtaagacatgcttaggggagttgcccattttaaatcacctggatatcttcaagctagacaaatcatgagacttttctgcagtgactgggaaggtgttcrtgaagagtgaaccagccatgtgttgtctggtcttcatgtttgcaatgcagagacctcttgcacctcacagaaacagtctggtttcttggtgaccagtagg

SEQ ID NO: 27097 - DNA, 201 bp, Homo sapiens
ctctacaaaaaatacaaaaaaaaaaaaaaaaaaaaaaatagcactgtggggagtgcctgtaatcccagctactcaggaggctgaggcaggataactgcatraacccaggagatggaggttacagtgagccgagattgcaccacttcactccagtctgggcgacagagaaagactttgtctcaaaaaaaaaaataaataaaa

SEQ ID NO: 27098 - DNA, 201 bp, Homo sapiens
ggttcctgtgtttcttaaagacgggtatgagcacagatggaatcagtgtttgatgtgtgtgcgtttatgagtgtgtgtgcatttatgagtgtgtgtgtttstgtacatagtagaaccaagagacctcttgggttccatttcagtaagacatgcttaggggagttgcccattttaaatcacctggatatcttcaagctagac

SEQ ID NO: 27099 - DNA, 201 bp, Homo sapiens
atttggcattcgattacaaaaattatacgtctttagaaaaaaagttggaaaaatgaaaggaagaaggaggaggaggagaaaggagaaagacaagaagtggkgttttcccatagtacattaataatcacagattaggtgggtgcggtggctaactcctataatctcagcacttcgggaagctgaggctggtggatcacttga

SEQ ID NO: 27100 - DNA, 201 bp, Homo sapiens
gcccctgcatcacaatgtctgtcccttagccgtagacctgtcacatgttaatcatgtgttctaagaccttattataatcctaatgctacagatgacctcarggtagcccctctccctcctagcaaagtcattattatcctcttttaaagatgaagcaaaccagtgcagtggctctcgcctgtataatcccagcactttggg

SEQ ID NO: 27101 - DNA, 201 bp, Homo sapiens
tacatgaagtggtaattgttaaactttgcattagtaagtaaaaatacatacaccatttttctaatagaattacctgtcatttcctcttaagtttaaaaackgcttatatttgcttttcacatgcttttacctttaaaacaaagaaacgaatctttcccaaattagttcctagagtcttctttttgctttactctcccaaag

SEQ ID NO: 27102 - DNA, 201 bp, Homo sapiens
cccccaaggagaagaccggaccaatgaaagaaatcaaccttgctcctgacagctcatccgtggttgtatcaggacttatggtaagacatgaccgttgttcrttggaataaagatggagatcatctctaacacagtttctaaggtggtgaaaatataatatcataataaatctaactgttcttttcctctgcatcaaataat

SEQ ID NO: 27103 - DNA, 201 bp, Homo sapiens; identical to SEQ ID NO: 4513

SEQ ID NO: 27104 - DNA, 201 bp, Homo sapiens
aaaatgcatacgtaattgacagactctcaaatggtgatatgattatagatctggaagggatttcaaatattatttagtacaacactctgagtccttacttstgagtatctgagttgatatagggcacaggtttcctgatgtcttttcccagaccctctccatctcaccatgctgctgtcctcttgagtgattaaatactga

SEQ ID NO: 27105 - DNA, 201 bp, Homo sapiens
tgtgcgagtgtgtgcgcgctttactgagagaaaccagctgtgcacacaaaaggaccgagttttgagcacgctggttctgagggcctgggatgataagaccrtgcattggaggacgaggactctgcgactttcccgtgttctaataaattctgcacgttcagattgtccttctaggaattaaccaaaacttgcctttaaaga

SEQ ID NO: 27106 - DNA, 201 bp, Homo sapiens
tgagacaggaacgaaatgttggatgtacgttaatttcccctacaccttcctcacttcctaaactggtggtgtcttttcttttttttttctcttcctccccygggtgggaaaaacaggtcttgattccccaactggcattgacttttctgatattactgccaactcttttactgtgcactggattgctcctcgagccaccat

SEQ ID NO: 27107 - DNA, 201 bp, Homo sapiens
aaaagaaaacttcattctctgaacttccccgggatctgcaaagcgccccgcggaactcccggtacttagtagaagctcattaaaggtctctgttccccttwgctccccgttcgcccgctggccctttctcagagccagacaggcacagcgctgagaagggaagaagtccgaacagggagctgtgaagacaaaataagggag

SEQ ID NO: 27108 - DNA, 201 bp, Homo sapiens
aaatacatctccattttttgttgtcatggtgtgtgtacctttgtcatcacagtatgattttatcgctggtctcaaaaactaaaagataccttactcaacartcacctagactttcagtcactaacaaattaagaaatttgttgtctgtccttttaaaaaacattttctaagaagatctttgttatttagatttagcagaca

SEQ ID NO: 27109 - DNA, 201 bp, Homo sapiens
attcagatttccataattgctcatgctcctccttaaccttctggaataataaaatttcccaataccattgccccccgccacccacacccccctagttcccraaaatatatgtgcttctttttgttacaaaaagtttaaattgcctgaggctctgggaaaattctatcactatggcaattccaagaagaaacaaggcacagt

SEQ ID NO: 27110 - DNA, 201 bp, Homo sapiens
gtaggctataggactggacatttggatatttcatcagttcaaatagtcctgggcgtgctttagtttctcatgcttttgagcagagttttaaaataagcccsatttgcccctacagatctcctgcctggtacagaatatgtagtgagtgtctccagtgtctacgaacaacatgagagcacacctcttagaggaagacagaaa

SEQ ID NO: 27111 - DNA, 201 bp, Homo sapiens
aagaagaagctgggcacagtggctcacgcctgtaatcccagcactttgagaggccaaggcgggtggatcacaaggtcaggatttccagtccaagcctggtyaacacggtgaagccccgtctctattaaaaatacaaaaattagccaggcatggtggcaggcacctgtaatcccagctactcaggagtctgaggcaggagaa

SEQ ID NO: 27112 - DNA, 201 bp, Homo sapiens
aagctacaaactaaactctgaattcaatgcacagctccattaattttgaaagatgtaatgtttgttgctatcttaatatacttttgatatctacagctttwaaaaaatcatagtggaaaaacacctgcaggaaagttccatgacttcaaacaaattctgcttctaaataagcacgtaaaaataagtgaatatcaagagaaa

SEQ ID NO: 27113 - DNA, 201 bp, Homo sapiens
taaccaggttctcccagctttgagacgtctcagacttaccagttctccaaaacgctattttctttaagggtgacaccttttaaaaattaggcacctcaaayatctactgcttttgagcttttgagttttgcactgtaaaaagaaaaatacacagtgggattttaagtcaaattagtttatctaatttttagggaataattt

SEQ ID NO: 27114 - DNA, 201 bp, Homo sapiens
agggttttaccgtgttggccaggctggtctcgaactcccaacctcaggtgatctgcctgcctcaacctcccaatcaatactctttctagaataagtatcascacttttgtttctcaccttttctcctttcttggttctcttcctataaatcccatagtttcagaccttttaaattaggagagctctctggggaatgtgctt

SEQ ID NO: 27115 - DNA, 201 bp, Homo sapiens
aatcccagtagccccagctgagctggaggatggagaccacttggtagacacttgtggattatttcctaggctaaatgcaaaagctactgctgaataagggwcatttttttccagtcccaggccagtagcgacatagatttcagagtgatctctgtgagatcctgaagatcctgactgcagaaagtagtgaattgtcttctc

SEQ ID NO: 27116 - DNA, 201 bp, Homo sapiens
catcattttcataatttgaaaaaaaaagccaaattaatatatttcttttttgattcactttttaagtgatcatttttaaaactttacttttgacccactgwatttatttagatagaaggaaaagagatgatgggagggaagtttagataaaggatggaagttggttttatttaaacaatagccctgtgatttcctaatgag

SEQ ID NO: 27117 - DNA, 201 bp, Homo sapiens
attaagattcaaagtatttgctaatcttcaaccaactttgaattgttactggtgtggaagtgagcatattgttttagaatttctgaatctacatggatatmcaagttatatattttttctgctacagaaagctttgttttccaagagaatttaatggcttagataataaagtttgaaaatcaatgtattttttttcctaga

SEQ ID NO: 27118 - DNA, 201 bp, Homo sapiens
gtgttggccaggctggtctcgaactcccaacctcaggtgatctgcctgcctcaacctcccaatcaatactctttctagaataagtatcaccacttttgttyctcaccttttctcctttcttggttctcttcctataaatcccatagtttcagaccttttaaattaggagagctctctggggaatgtgcttaaggtggagaa

SEQ ID NO: 27119 - DNA, 201 bp, Homo sapiens
ctgaagagacttgctttgacaagtacactgggaacacttaccgagtgggtgacacttatgagcgtcctaaagactccatgatctgggactgtacctgcatyggggctgggcgagggagaataagctgtaccatcgcaagtaaggaagagattgtgtaaaatgatgccaaaatatcaaatatgaatttctctgttaccatca

SEQ ID NO: 27120 - DNA, 201 bp, Homo sapiens
tatgtcttctcctatctctatctcccctccaaattctccaccctcacttgcagcctgtgagaaagtgcagtaaaccattcactcagaggtgtatggcttasagagagggaaatacccagccggcaagggaatgcatagtgaacacaaagcacattaaacttgaaaacaaaactcagacaagctccatggatgctaagtggt

SEQ ID NO: 27121 - DNA, 201 bp, Homo sapiens
tgttgcttctgttcaccctggaatcactaattacagcatcacccagtatacaagcccctgcatcacaatgtctgtcccttagccgtagacctgtcacatgytaatcatgtgttctaagaccttattataatcctaatgctacagatgacctcaaggtagcccctctccctcctagcaaagtcattattatcctcttttaaa

SEQ ID NO: 27122 - DNA, 201 bp, Homo sapiens
tcttcatgcaagcttattttctactaaaacagttttggaattattaaaagcattgctgatacttacttcagatattatgtctaggctctaagaatggtttygacatcctaaacagccatatgatttttaggaatctgaacagttcaaattgtaccctttaaggatgttttcaaaatgtaaaaaatatatatatatatatat

SEQ ID NO: 27123 - DNA, 201 bp, Homo sapiens
agtacatataaaggaaaacaccacctcacagagcaaaatatgaggaacccaggagtaagcttgcatgtgaggggtggcactttggcttaaggcaggacacygctttttttggcataacacagggaagtgagacagtaaaatgagaaaggagctgttgacagccctaaactgagtcgttttccagagtgaagaatggttgct

SEQ ID NO: 27124 - DNA, 201 bp, Homo sapiens
ttgataattaagtggaagtagttgtatgctttgagaagcataccttttttctttcatcaatggaactttaaaaagtttctcactcacccacctgtttcctraacagatcagtgcattgttgatgacatcacttacaatgtgaacgacacattccacaagcgtcatgaagaggggcacatgctgaactgtacatgcttcggt

SEQ ID NO: 27125 - DNA, 201 bp, Homo sapiens
cttcaaaacaaatgaaatcaatttaattcagatttccataattgctcatgctcctccttaaccttctggaataataaaatttcccaataccattgcccccygccacccacacccccctagttcccgaaaatatatgtgcttctttttgttacaaaaagtttaaattgcctgaggctctgggaaaattctatcactatggca

SEQ ID NO: 27126 - DNA, 201 bp, Homo sapiens
tgggtctggagtgcagtggtgtgatcacagctccctgcagctttgatctctcgatcttctgggctccagtcatcccccaggactcatgtcagactcctgartagctgggacgagaggtgcctgtcaccatatctggttattattatcattattattaagagtgtctcactatattgcccaggctggacttgaactcctggg

SEQ ID NO: 27127 - DNA, 201 bp, Homo sapiens
tgttttgtttttttttttgagacagagtctcactctgtcacccaggcttggagtgcagtggcgccatctcaactcactgcaacctccgtctcctgggctcragcgattctcgtgcctcagcctccccaagtagctgggactacagacatgcgccaccaagcccagctattttttagatttttagtagagacagggttttac

SEQ ID NO: 27128 - DNA, 201 bp, Homo sapiens
atgctttgtttgcatagatttttttaaaataagcttttccaaatcataaagagataagatcttaggtaacatgaagagactcccttacttattcctaaatmatctatattccaagggcattttcttatttggaacagttgacctcactgataaagctgtctcaccactataataacaatgtccaaaatctaggctttctgc

SEQ ID NO: 27129 - DNA, 201 bp, Homo sapiens
gacattgcttcatttcaagggttgtatgccaatacaactattaattacacataagattatggtgctaatttgatttttgaaattttctgtgaaaacaaatkgataaagacttttggaaccaggtctatttaagagtattagagacacagaaaaacctcaaatctcttttaatcttcagtgttgaatgagatcagaggtgaa

SEQ ID NO: 27130 - DNA, 201 bp, Homo sapiens
aataacatgtatatggcatctttacaattcgattgaatgtattcttaatttattttaactaattaattcactaattagacaggtaggcataaatattgacwgctcatatcaaaatagtctattgttggcataaattgttatttactagataatgtttgtggttatttttaagcatttggctcaactaacttttgtgattag

SEQ ID NO: 27131 - DNA, 201 bp, Homo sapiens
gaagcatttgtctaaattccttgttcacatatatttgaaaattatttataaaatgctaaaatgtataaagatagttgttaacaatattcaaacagcatgaygtactatagcaataacaggaaattttagatacccattacttttgccaaaaccacatggaagtctcaacaaacctatggagaaaaatcttaaacaaaaata

SEQ ID NO: 27132 - DNA, 201 bp, Homo sapiens
tgattcaaaatgctgaaacacagccaggctgtttgaaggaaattggttcccagaagaatggccttggctacaacagatggaaactggtagcgtgtcagttrgcagagtcctgtgtgacatcttttgataaattaatctcatgtgaaagaagtcacccacaaaattctttagccagttgtcttgcccatacctttggttctg

SEQ ID NO: 27133 - DNA, 201 bp, Homo sapiens
actgaattgttggaagggtagatggaggctgcgaaagtgttttgcaaaggataaaacattagcacgaagctgctgcttattgttatcttattttctctatyctttcctgcagggaattacatttcaaaaaaacatgggaaaactttatttgatgtgttgttctaaatgagtgtgaacaagttcacaaaagccagtttaggg

SEQ ID NO: 27134 - DNA, 201 bp, Homo sapiens
ttctgttatccatgactggatattccgaactttgaggtttgcccctggtgaccaggtactcttaagtggtcacccaactggttcctgtgtttcttaaagaygggtatgagcacagatggaatcagtgtttgatgtgtgtgcgtttatgagtgtgtgtgcatttatgagtgtgtgtgtttctgtacatagtagaaccaagag

SEQ ID NO: 27135 - DNA, 201 bp, Homo sapiens
caccattgtgatcacatggacgcctgctccaagaattggttttaaggtaaactgcagatgttcctaatctctgtgatacagccctgaagctgtccttgtgkttcccatgtagtggaaacagggtgctcaggagtcaggagacctgggttttgtcacctgcttctgtccatacatctttgactacattgtcagggcctaaca

SEQ ID NO: 27136 - DNA, 201 bp, Homo sapiens
ccattattgtggaataattcagcgtaaagctttttttttttctttttttgagacggagtctcattctgtcacccaggctggagtgcaatggcatgatctcrgctcactgcaacttctatctccagggttcaagcgattcttgtgtctcagcctcccaagaagctgggactacaggcatgagccaccatgacagttaatttt

SEQ ID NO: 27137 - DNA, 201 bp, Homo sapiens
gtttaacttttatatagcatcttttattgcaaccaaaaatagctgaccattattgtggaataattcagcgtaaagctttttttttttctttttttgagacrgagtctcattctgtcacccaggctggagtgcaatggcatgatctcggctcactgcaacttctatctccagggttcaagcgattcttgtgtctcagcctcc

SEQ ID NO: 27138 - DNA, 201 bp, Homo sapiens
atattcctgttaagaagcaaaaagcatagattaaggcttttaaaaagtgctgattaaaaaataaagtcacttaaaatgtaaacaaaatgcctattaagcgmaaactggttagctttcatggcataatttaaagcccttatccagtattttctccctggttgcaggcaccctgtcaattcttgacaaacttttcagacattc

SEQ ID NO: 27139 - DNA, 201 bp, Homo sapiens
tgttctgtattacattatttttgtaggatcgtttcacaattttctcacaattcttactttgatagtagagaaaataaaagcaagccaagagactttttttwaaaaatatattttatttgctataaacaactatgatttgcatttctcatgtgaagaataataattatcggctaaaaatggatttgctgcattgattttcaa

SEQ ID NO: 27140 - DNA, 201 bp, Homo sapiens
cagtccctgtatacgtctggtttgtaacaagagattctttatcaagcaaaacagtatgtaatgacatttctctggaaccttccattacaagccaccttaaygcagtttggaagatacctcccccacctgggggaatttccagctaaagtatataaaagagtccccaaatcatttcccaataaaagtacactgtgcagtttc

SEQ ID NO: 27141 - DNA, 201 bp, Homo sapiens
ctaccatgtgacccacagtccctgtatacgtctggtttgtaacaagagattctttatcaagcaaaacagtatgtaatgacatttctctggaaccttccatyacaagccaccttaatgcagtttggaagatacctcccccacctgggggaatttccagctaaagtatataaaagagtccccaaatcatttcccaataaaagt

SEQ ID NO: 27142 - DNA, 201 bp, Homo sapiens
cattttacagaagaatcaaactccaagagggttaagctatgtgcccaagattgcccacctactgactggcaaaacaaggtactgattatcctaagaggcayaaagacaatttcctcgagggaaagatggagccgtaatcaagcacaggaatgtgggggccttctagcaaaatctccttcttgacctggttggtggtgacac

SEQ ID NO: 27143 - DNA, 201 bp, Homo sapiens
agatgtaagatgctgagccaagtgctggaaagctatttttgactcaaaaatgtacggcgatggtggagcaactggaaccctcattcatcgctggtggaaaygtaaaacggtgcggctgctgtgggaaacagcctggcagctcttcaaaacgttaaacagttaccatacgacttcacagttccattcctagatatatactcg

SEQ ID NO: 27144 - DNA, 201 bp, Homo sapiens
cttcctttctctctctcttttcttcctttcctttcctttccttccttccttcctttctttctttctttctttctttctttctttctttctttctttctttyctttctttctctctcactctctctctctttctttcttatttttggtgctaaaacccaaaacaaatcttttatttaaaaataagattttttttttttttgg

SEQ ID NO: 27145 - DNA, 201 bp, Homo sapiens
atgatgaaactttcttttgtactgatcatttctcagcaaatagcatagtatagagttttgtcttggggaaaccccattgtatgataaccccaatctaatgygtcttactttgtgtcagctgacacttttagcatggcttgataagctcccagctaaacagtttgtttactcctgatctcaaacaggagaaccaactatttc

SEQ ID NO: 27146 - DNA, 201 bp, Homo sapiens
tccagcctgggcaacacagcaagactctgtgtaaaaataataataataatcactgattagctattagcacattaccttctagtcgcttttccctatgaatrtataattcttaaaatatccttcttataagctgtagagtcatttgagggactagtttgctctgattagttaccttttcttttcatttcaaagatcttccaa

SEQ ID NO: 27147 - DNA, 201 bp, Homo sapiens
ttcattggcgcactgaagtgtgtgccatcgtaagcactgagttcagtgaatttgaattcttataaagtgaacacaccacaagaccagcacccagatcaagraaaagaatatctctctaccctcaccccatcatcttccgccaataatcactaccctgactcttactgcagagagctatttttaaaaatttggcattcgatt

SEQ ID NO: 27148 - DNA, 201 bp, Homo sapiens
aagagaaaactgttttgtcaagtgatgagaaattccaaaaaaatcctctaacccagacaggattctaaatttggggaaatccatggcactctttcaatttrgagtgtgggtcacaaagattcctcaagaggtttttttacactatttgtaggaaactgatatttgctgggtgttttgctttgttttggtttggttttaaat

SEQ ID NO: 27149 - DNA, 201 bp, Homo sapiens
gtggatcacctgaggtcaggagtttgagaccagcctggccaacatggcgaaaccttgtctctattaaaaatacaaatgttaccaggcatggcagtgggcgyctttggtcccggcttctcagaaggctgaggtaggagaatggcttgaacccagaaggcggaggttgcagtgagctgagattgtgccattgaactccagcat

SEQ ID NO: 27150 - DNA, 201 bp, Homo sapiens
cgtagagtctagaatgcttcagcacctggcacactgcttaacaaatggtgaatgaaaaaaaaaaaagaaaagtcattctttttcttctttcaccctatgtycataatctggccatttgcagaacttgatgtccagtgatcgaaatcaacagcatcagtgcatccaatatcttctagtctctcatcttcttattacatcatt

SEQ ID NO: 27151 - DNA, 201 bp, Homo sapiens
ggctttatgccctactgaatgaattatgcttcactgggctattgattcccgtgtaagggtgaaaaagaattattaggaaagatcctctttaaagaggaatrgtaagaaacaataaaacttaggtgatatttaaggaaacaagtctgattaaaagaaattttggagtatcctggcttatacacaagaccataaagcaagaca

SEQ ID NO: 27152 - DNA, 201 bp, Homo sapiens
ccaggcgcagtggctcacacctctaatcccagcactttgggaggctgaggcaggtggatcacctgaggtcaggagtttgagaccagcctggccaacatggygaaaccttgtctctattaaaaatacaaatgttaccaggcatggcagtgggcgcctttggtcccggcttctcagaaggctgaggtaggagaatggcttgaa

SEQ ID NO: 27153 - DNA, 201 bp, Homo sapiens
aaagatagtgttttaagaaaagatagttttctgttctgcaagcataaattttctagctatttcattattatcttaaatggagttaacactactttgaaatkgatgctacttcccttattttccttttattttaaacaaaagaaccaaaaccatactttaaattttgttgataacagtgatatacatcaaggtgtagaaata

SEQ ID NO: 27154 - DNA, 201 bp, Homo sapiens
ttcccagaaatttaccaagcattttacaaggagctcttttatatttgaaaagagaaaactgttttgtcaagtgatgagaaattccaaaaaaatcctctaayccagacaggattctaaatttggggaaatccatggcactctttcaatttggagtgtgggtcacaaagattcctcaagaggtttttttacactatttgtagg

SEQ ID NO: 27155 - DNA, 201 bp, Homo sapiens
atagcagctgataagtgattgattctctaaaacgtatattatttaatttgtgttgacagtatccatttttttttttccccgagatggagtcttgctctatsgccctggctggagtgcagtggcgtgatctcggctcactgcaacctctgcctcccaggttcaagcaattctcctgcctcagcctcccaaatagctgggatt

SEQ ID NO: 27156 - DNA, 201 bp, Homo sapiens
tgatatcttagtttggtttcttattgaaaagaactagtaaatgctgtaactgaaacagaaatttgctggaagtcccagagactaagtgatttgaatttgcracaaactctgaatttttgtgcatttttgaaaaatgcatttttcaaaactgtcaattcacgaggaattatcagcattgtaatttgtctgggataatgtctt

SEQ ID NO: 27157 - DNA, 201 bp, Homo sapiens
gttaaaagaatctttttctgtaaaacacaggcctgtagtagcacttcctgactgtttgccccactttctttctttcttagcgcctgatgccccacctgacmcgactgtggaccaagttgatgacacctcaattgttgttcgctggagcagaccccaggctcccatcacaggtcagctaagcctccccctctttggctgcta

SEQ ID NO: 27158 - DNA, 201 bp, Homo sapiens
ggaccaagttgatgacacctcaattgttgttcgctggagcagaccccaggctcccatcacaggtcagctaagcctccccctctttggctgctatgttaatsttaatgacatcagcagggagggcgcagattctgactgcggacctgcatatcactttaaatctccaatataatttatgggagaggggtttgtgtgtgtgtg

SEQ ID NO: 27159 - DNA, 201 bp, Homo sapiens
aggttactataagacacaatttttatttctagtaatttaaacattgactgacatcataaagatagtgttttaagaaaagatagttttctgttctgcaagcrtaaattttctagctatttcattattatcttaaatggagttaacactactttgaaattgatgctacttcccttattttccttttattttaaacaaaagaac

SEQ ID NO: 27160 - DNA, 201 bp, Homo sapiens
acaagctatgggaacaacttggccaaaggtagtgttagccaagcctcattcctccatttcctcatctgtaatatgggaagattgtagctgattacctttartgttccatcctaaatactgaacacccagatgcaccttttctaggaacttggaagattctgcttttcccaaccctcagacactgtcagtgctggggaaggt

SEQ ID NO: 27161 - DNA, 201 bp, Homo sapiens
tgctgtgtggcaacttaagcctcttcggcctgggataaaataatctgcagtggtattaataatgtacataaagtcaacatatttgaaagtagattaaaatyttttttaaatatatcaatgatggcaaaaaggttaaagggggcctaacagtactgtgtgtagtgttttgtttttaacagtagtacactataacttaaaata

SEQ ID NO: 27162 - DNA, 201 bp, Homo sapiens
gtcaaagcaagcgtgagtactgaccgcgggctgaaacaggctgcctcagggatgggaccctaaagccgaccaaagttggggctgaagttttgtgcgcgcgygtgtgtgcgagtgtgtgcgcgctttactgagagaaaccagctgtgcacacaaaaggaccgagttttgagcacgctggttctgagggcctgggatgataag

SEQ ID NO: 27163 - DNA, 201 bp, Homo sapiens
aattactgtctaatctgaaccatgtgaaaataacttttatttctctagcaaagggctattcacagaatattgcttttgacccatagagagcttcttcttgytgtcattttaggaggcatatccctttttccttaatctgtttggctcagagctaactgtgaacttcagaagtgtttgttttgcctttttaaaaataccatt

SEQ ID NO: 27164 - DNA, 201 bp, Homo sapiens
atctcaaaaaaaaaaaaaaaaaaaaagaataccctggaaaagttagccaaaaaatgtctattcaggcgtcagatatgatagtaagataattagtttgcgaygcggactttatatgcaggatatttgggtgtttatggaggaaaagtgaagtcgattttaccttcaagaggccaacagccagctggagaggaagtgcctgct

SEQ ID NO: 27165 - DNA, 201 bp, Homo sapiens
tgcactccagcctgggagacagagaaagaccctgtgtcaacataaataaatatataaataaatcatcaagtctcatattaaagactctgtaaatatgactyattgttgacaaatgaaacaaatagaggtgtaagcatgttgtctacatggaggcaagaccagaataatagaaaatggaaacagattcccttaaagagggga

SEQ ID NO: 27166 - DNA, 201 bp, Homo sapiens
tatctatgaaaagcacagcaaaatgttgagcccatgagcctaatataatggttggtactgagtgctccctatctgaaaataatgttaaagtcattatttcygatgcttatcaatgaggctgcaatcacataatgctgtcagtactatccctatcccttcactcccacaaaataaatagacccgatatcaactctattgaaa

SEQ ID NO: 27167 - DNA, 201 bp, Homo sapiens
ttaatatcatgccatgaaaacacaggatgcggcagtttcccggcagggaaaacaacaacaacaacaaaatgaaaacacaggtgtcagtatctatgaaaagyacagcaaaatgttgagcccatgagcctaatataatggttggtactgagtgctccctatctgaaaataatgttaaagtcattatttccgatgcttatcaat

SEQ ID NO: 27168 - DNA, 201 bp, Homo sapiens
tcccacaaacagtgaagctataccagctcataaagtcactgaattttaaggagcctaaaagtaggtggagttttgcagaagtctttaaaagtgcgagcaayttactcctcagcatcctacccatcgttccttaatatcatgccatgaaaacacaggatgcggcagtttcccggcagggaaaacaacaacaacaacaaaatg

SEQ ID NO: 27169 - DNA, 201 bp, Homo sapiens
caaataggaatatccaaccccccacctgcaggtgacaataataggacattttgcaaacgccccaaagaagaacttcagaactttacgttcctttgtgagcrtgcgcttattgacttgagcaagtggcttatatagttcttgctggtttgcagacttgtttatatcatactttatttattgaaaatccaatactatacagaa

SEQ ID NO: 27170 - DNA, 201 bp, Homo sapiens
ctgtaatcccagcactttgggagacccaggcaggaggatcgcctgagcagaggaattcgagactagcctgggcaacgtggtgaagcccttcctctacattaaaaaaaaaaaaaaaaaaaattagccaggtgtggtggcataagcctgtagtcccagctactcaggaggcagagatgggaggatcacttgagcccaggaggt

SEQ ID NO: 27171 - DNA, 201 bp, Homo sapiens
caactccctcagattacaagaagcgcagcggatgtactttttaggtaccctcatattaggaacccagaagtattcatacaaataaatgcaaataatgtatsagtacaatacttgtctaagtccttgaaaaaggccaatcttccggcatcacccacacaccagctgcaaatcttggatccaccccgttatctcccagctgtg

SEQ ID NO: 27172 - DNA, 201 bp, Homo sapiens
tgtaatcccagcactttgggagacccaggcaggaggatcgcctgagcagaggaattcgagactagcctgggcaacgtggtgaagcccttcctctacattaaaaaaaaaaaaaaaaaaaattagccaggtgtggtggcataagcctgtagtcccagctactcaggaggcagagatgggaggatcacttgagcccaggaggtc

SEQ ID NO: 27173 - DNA, 201 bp, Homo sapiens
tttcacattattgggagtgatggttcagagccagccacctatgcttgactttcactctttaaaactctgcagttaatcacagccctcattatacaaaggtyacatggatataaagtttgaaagattcggttcaagactgcgagcggtggccaggaaaaaaaaaaaaaaggagaagacacaaagacaatgatcaaagaacaa

SEQ ID NO: 27174 - DNA, 201 bp, Homo sapiens
aagatgggctgagcttttggcaattttataacaaggaaaaagacataaatttgagctcaggacccaccaggaaagggccacggtaaacacaccaaaccttkggtcgggatcctaaagagttataccctcgctgtaataacaagagacagtccagccttcacaagagtggaaactcagcttcaggccatttcaattcctagt

SEQ ID NO: 27175 - DNA, 201 bp, Homo sapiens
ctttcccatcctattctcatgatagtgaataagtctcaagagatctgatgggtttatcaggcagtttctgcttttgcttcttcctcatttttctcttgctkacaccatataagaagtgcctttcgcctcctaccatgattctgaagcctccccagccatgtggaactgtaagtccagttaaacctctttttcttcccagtc

SEQ ID NO: 27176 - DNA, 201 bp, Homo sapiens
cacatgagacagtgcgacctctctctctctctctctcaattcctctcagctctccaccatatgaggacacagcaagaaacaggctacttaaaaaccagaargagggacctcactaagaactcaacaaggttggcaccctcgtctcggacttccagcctctagaactgtaagaataaatatttaagccactcattgtatgat

SEQ ID NO: 27177 - DNA, 201 bp, Homo sapiens
tcattccattgccagctctcagaaatgaaaaagccagccccatcctgcactgtccatgtggacaatgtgctacctttctaattcaagcacctttttttttwtaaaaaaaaaaaaaaaaaaaaaaaggaagaaagaaaaagaaaaattcagattgaccttggctctcaccattaaaaaagcgaaaagtggtatattactttg

SEQ ID NO: 27178 - DNA, 201 bp, Homo sapiens
cattccattgccagctctcagaaatgaaaaagccagccccatcctgcactgtccatgtggacaatgtgctacctttctaattcaagcaccttttttttttwaaaaaaaaaaaaaaaaaaaaaaaggaagaaagaaaaagaaaaattcagattgaccttggctctcaccattaaaaaagcgaaaagtggtatattactttgc

SEQ ID NO: 27179 - DNA, 201 bp, Homo sapiens
gaggctcacttttaaagtgtccaaattgacttttcattctccatcgctagtaactttttaagacgcaacttttcaaaaatatgacttaaattcaggcttcraagctacatcaacggccagagttccattaactctgtgctctgtgggctcaccatcaccttgcctaaaatcaatgactcctccaactccaaaccggacatt

SEQ ID NO: 27180 - DNA, 201 bp, Homo sapiens
atgtaaacctaataataccaagaaaataaagaaagacgttttaaagcaatgaacagcatcagtttttctagcacttgttacatcagatgcaatcagaaaawtgacgtggccatggaggcttaatagctcactgtcttgggttttaagctttgaacacaaacattcaagttctatgaaatggaaaaggtgcaaagtaattta

SEQ ID NO: 27181 - DNA, 201 bp, Homo sapiens
attgtgattggttaggaagtggtactcaaacatacaaaaaagaggcaaaatgtaaaaaactttaaagcaaattgagtttaatagaaaaacactaaattaamggataatccttaccttgtagttgcttttttaaaagtatctctgataatcaaaaaaaaaagtatctctgataatctatgtaaccagatcactatcttagat

SEQ ID NO: 27182 - DNA, 201 bp, Homo sapiens
tgataatctatgtaaccagatcactatcttagatatctttaagataattactttttaaagttttgtaaaatctaacagtggcttgtgtgtgtttgttactmttgttgttttggtctttaaaaaaataatgctgacaccatctcaattcacactgataacatttaaagcaagccctaagtttctgcttctgtgagttttctt

SEQ ID NO: 27183 - DNA, 201 bp, Homo sapiens
tcaattcacactgataacatttaaagcaagccctaagtttctgcttctgtgagttttcttgcagtggtcaaatatccacaacagtcccgcgtggaaggcaygggcaatgctagctttaaaacaaggaagtaaattatactctttacctcacttctttcacatgccaggatgcacggaacaaaacacaccgaatcattgcga

SEQ ID NO: 27184 - DNA, 201 bp, Homo sapiens
aaacgggtggatcatgaggtcaggagttcaagaccagcctggccaagatggtgaaaccccatctctactaaaaatacaaaaattagccagacgtgttggcrggtgcctggactcccagctactcgagaggctgaggcagaagaattgcttcaacctgggaggcgaaggttgcagtgagccaagaatgcgccactgcactcc

SEQ ID NO: 27185 - DNA, 201 bp, Homo sapiens
agtttctgcttctgtgagttttcttgcagtggtcaaatatccacaacagtcccgcgtggaaggcacgggcaatgctagctttaaaacaaggaagtaaattrtactctttacctcacttctttcacatgccaggatgcacggaacaaaacacaccgaatcattgcgagtttgacctttttggttataacatattcagtgatt

SEQ ID NO: 27186 - DNA, 201 bp, Homo sapiens
tttttgatccatctactggtgccttaatttaagacatctttccaagaaggcctcctagtgaccccaaccttattttggagaaggctgaggattcatatctrctcatgtataggctacaaaagtccaagaaggtctgtgtcataccaaacaggcaacggtcaagggggtttcaactgtcagcatcttatttattatgaagtc

SEQ ID NO: 27187 - DNA, 201 bp, Homo sapiens
ttccagcctctagaactgtaagaataaatatttaagccactcattgtatgatatttttgttattagcccgaagtaagacaaagaagaaatattgctccaamaagatttatgagtatattttacagatctgcattggacaagttagctttccctgcaacgaccatttactgaatctttactatgtgccagaatctgagagtc

SEQ ID NO: 27188 - DNA, 201 bp, Homo sapiens
cagcatcctacccatcgttccttaatatcatgccatgaaaacacaggatgcggcagtttcccggcagggaaaacaacaacaacaacaaaatgaaaacacargtgtcagtatctatgaaaagcacagcaaaatgttgagcccatgagcctaatataatggttggtactgagtgctccctatctgaaaataatgttaaagtca

SEQ ID NO: 27189 - DNA, 201 bp, Homo sapiens
ttcatgcgtgaagaaaatattattattgttgttattaatagcagcagctaacatttaattgagcacttaatttattccacaatgggttaagactttatatmcacagagttgatgtgtttaatagaaccacctgtatctctgaatagagatattatgatgtgcattttacagatgaagaaactgaggtttaaagaagttaag

SEQ ID NO: 27190 - DNA, 201 bp, Homo sapiens
caccgaaatctcaacttgaattatatctcccaggattcccacatgttgtgggagggacccggggggaggtaattgaatcatgggggccggtctttcccatsctattctcatgatagtgaataagtctcaagagatctgatgggtttatcaggcagtttctgcttttgcttcttcctcatttttctcttgctgacaccatat

SEQ ID NO: 27191 - DNA, 201 bp, Homo sapiens
ccaaaaaaagaagtatcctgagccataagcagaaatatgtatgtgtatgtgttgacatgtatatgtataaatgtgtgtgtctacatgtatgtgtgtgtgtrtatatatatatgtgcaagctacaagcagaaatgtacgtttgtatatatatatatatatttatgtctgtgtgagccgcaaacagaaatatatatgtgagtg

SEQ ID NO: 27192 - DNA, 201 bp, Homo sapiens
aagtatcctgagccataagcagaaatatgtatgtgtatgtgttgacatgtatatgtataaatgtgtgtgtctacatgtatgtgtgtgtgtgtatatatatrtgtgcaagctacaagcagaaatgtacgtttgtatatatatatatatatttatgtctgtgtgagccgcaaacagaaatatatatgtgagtgtgtatctgta

SEQ ID NO: 27193 - DNA, 201 bp, Homo sapiens
agtatcctgagccataagcagaaatatgtatgtgtatgtgttgacatgtatatgtataaatgtgtgtgtctacatgtatgtgtgtgtgtgtatatatatakgtgcaagctacaagcagaaatgtacgtttgtatatatatatatatatttatgtctgtgtgagccgcaaacagaaatatatatgtgagtgtgtatctgtat

SEQ ID NO: 27194 - DNA, 201 bp, Homo sapiens
tgctaaaaactgcagatagttttagaagtagttagagaccagtagctacaagactgatagttatacctctcaggaaaatgatggaagccacagctgaaaamaaataaaactttcatcttagaattctatacctagtgaaaatatttttgaaaaataaaggcagagaacaaaaattttaagcaaacgaaagctgctttttgt

SEQ ID NO: 27195 - DNA, 201 bp, Homo sapiens
tagctgcattttaaatatttgtctaaaataaaccttaacctatcgcagggcgtgctgccccagcctgagactggctgcttcatctacagttgtttctctayttgtccttgcgtagggaagttttatcaccacaaggaccgtttctcctctgtttaatctaacacctgctagtctgagattctctaaatgtcccacaataaa

SEQ ID NO: 27196 - DNA, 201 bp, Homo sapiens
ttccttcctttataataatgaataaatattaaaatcctgcaaagatactgctcactgtagttttgaatgatgctaccaagaaatctgtgggggaaaagcaygccgtttttctatcaaattttattttcccaaacaaacctgttaagtcctgctatctcacttgacaaaataacccacggcaaaggactttttattaccaga

SEQ ID NO: 27197 - DNA, 201 bp, Homo sapiens
ccaaaagaaaactagggggtggacacacatttacgttgcagtcttatttcccaaggcgtcataattttcatcactctcttattggttgcaggaggaaaaargcatcttctccatttcagatgtgtctttctgggtgaagggatctccatttgcgttaacatccctgaccccctctgccactcacttattcctgctcaaggg

SEQ ID NO: 27198 - DNA, 201 bp, Homo sapiens
tgcgagtttgacctttttggttataacatattcagtgattacagcacccaggttcccacagggcatacaattggtaaaagaaattctccatcactttttamgctatctgagaagccatctgagcttgaataaaatcagacactcagaagggagagctgggaaggagttcttcatttgataacattttgtttggggatacca

SEQ ID NO: 27199 - DNA, 201 bp, Homo sapiens
aattggtaaaagaaattctccatcactttttacgctatctgagaagccatctgagcttgaataaaatcagacactcagaagggagagctgggaaggagttyttcatttgataacattttgtttggggataccatgatgagggacgggtgaaatacaccaattttgaaatctatacctctcaggaaacgtgtaatctaacca

SEQ ID NO: 27200 - DNA, 201 bp, Homo sapiens
gtgactaggatcaatttaaattcaaaaaagagaaacagagagagaaagagctctgagttggtgaaggctttggaaccctaacagaggattccaacctgcasggcttgccaggcagagggtcttgtcagcagcgggagcctaagcacttgggaggcaagtactccccaaaagatcccaacagagattctccttcctagagta

SEQ ID NO: 27201 - DNA, 201 bp, Homo sapiens
aaatccatttgactccccttgggtgtgtgggtagtaaaaggtttttgaagctgtatctccaacctttaaagcaagacgacaataatctcaaatttactcayttttacctgtgataccaatgtcaccccttatcaccagtgagcaaaagacacctagatcatttggggaaaatgagagaagtaaaatgccaggttttgtagc

SEQ ID NO: 27202 - DNA, 201 bp, Homo sapiens
aggatcaatttaaattcaaaaaagagaaacagagagagaaagagctctgagttggtgaaggctttggaaccctaacagaggattccaacctgcacggcttsccaggcagagggtcttgtcagcagcgggagcctaagcacttgggaggcaagtactccccaaaagatcccaacagagattctccttcctagagtaaacagc

SEQ ID NO: 27203 - DNA, 201 bp, Homo sapiens
tttcttcagtgctttgagacagatagggaaaaggagataaaatcaacatgaaaccaaacaatttcttggaagagaaacagatcaggaatcttacgattctyacgagctgaactgctcccctgccatcccaaactcatacactgaagccctaacccccaacatgactgcatttggagatggggcctttatggtcataattaa

SEQ ID NO: 27204 - DNA, 201 bp, Homo sapiens
agtggtaaacatatattgagagcctaacataatcatagtaggtggaaaacaaatgttagttgcctgctttttgcaaaatccttggtgtcctatgcctcttmcccaattcgtacgacctaccaaatccagcacagtcactatgactaaaaaattaaaacttgctcctagatgtgctaccaatggtaacccgagggctgaatg

SEQ ID NO: 27205 - DNA, 201 bp, Homo sapiens
tgccacaatctgacccttcgaatagacaatatccttttaacattcggttctaaactgacctgaagcaaaacaagaactaaagacgtgaagatgaccttgayctgtagattttcactgcaagaaaatgtgaataattataacagcaagttcagaacccatgtggatgacaaccacagaaaatttaattttagacaatttaca

SEQ ID NO: 27206 - DNA, 201 bp, Homo sapiens
agatgcctggtgacttctcagggtgggctgtccccagtgtgttttatgaccatgcaggaaggaaaaataaggaatttaaaaaatcttctttcaaaagatayggattcttatcggactttcattccttagtaaagttgcattaaacccagagacatttattctttaattttccctattctctcatatggaaggtaggaagaa

SEQ ID NO: 27207 - DNA, 201 bp, Homo sapiens
tactttatttattgaaaatccaatactatacagaaaaacaatttgtaaagcaaagaaatgaggaacaaatctaatggctgatttaggatgcgctcttccckgtaatctacaactattaataatattaatagcttttatctttttgtttagctacagatcgttcagaacaatggagataagccctgtgacttgtgatgcgtt

SEQ ID NO: 27208 - DNA, 201 bp, Homo sapiens
ttgtgatgcgttgacgaatgatcatcttttccaagccaagtcaccagcttagacaggcatgaggctcgtattttacccgccccacataccacatgcctccscccaacacatatatcataaaagaaggccaaggccttccatccacaaaggcaaatcatgggacttaagcttttagtgtcaaaggagattgcatggaattcc

SEQ ID NO: 27209 - DNA, 201 bp, Homo sapiens
taggaattcgaggttacagtgagctacgatcctgccactgccctccagcctgagtgatggagcagattctgtctcaaaaaaataaaacataaagaccctcyaccaataaaaagaaagtaacaccgcatgaaattttttgtaatcaaaatatacatggcacttttttttttttttttttttttttttttgagacggagtctt

SEQ ID NO: 27210 - DNA, 201 bp, Homo sapiens
gggtggagcagacagacttggagtttggaagccagatggaccaagcaaggagcctgactctgagctcaccagctgtgcaattcgggtgagttccttcaccyttctgagccatcccttggctcgtctggaaaatgcaaaaaaaaaaaaaagaaaaacaccaggtttttgcatcctcctggatgagggatataaagtgcctga

SEQ ID NO: 27211 - DNA, 201 bp, Homo sapiens
tactgtcattaatagaagatctaggggaaatttgcataaccaaagtaatcaaatcttgcctactgtgtcatcttgggactccaccaccattgcaaagccasacaagtttaagttttttggggtattccctccttaaatgcgggtaccaaagcaacagtgcctttgatttgagttgcagctggcataatagacaagatgtgt

SEQ ID NO: 27212 - DNA, 201 bp, Homo sapiens
gaaaagcacagcaaaatgttgagcccatgagcctaatataatggttggtactgagtgctccctatctgaaaataatgttaaagtcattatttccgatgctwatcaatgaggctgcaatcacataatgctgtcagtactatccctatcccttcactcccacaaaataaatagacccgatatcaactctattgaaaacctgaa

SEQ ID NO: 27213 - DNA, 201 bp, Homo sapiens
actgagttctcctgaagcattataaaaaacaaatcagttacatgttttaaatatccgttggcaagcatcatagcatggctcttaatctgagaaataatttyaattaaactaaaaagaggtaagtcattgaacacacaataattaaacagcagactgtgctgtcagcaaaactgggctggctcttgcaggattatcagaggg

SEQ ID NO: 27214 - DNA, 201 bp, Homo sapiens
acaatacgtaaggaaattcctcatggactaacacaagcggtcagacaccacactagttgctttcattccaccttgtcgaattctcacaactctgtgatgcygacgtcatggttcccattttacagatgaggaaactgagactccggggtgaaagatactgtgccaggccccagaattggcaagctggaaagcatagacgtc

SEQ ID NO: 27215 - DNA, 201 bp, Homo sapiens
tcttctgcactctctgttaaacagatctagtgagggcctggcaggcatgaggaacattggttactcataacaatccctctcctctctctcaatccaccgcscctgcctcccagcctcagcctcatcccttttcctcctgcaaacaacgtagggagatggatgacatcaggtccatctgctcccactctaccctacctcctt

SEQ ID NO: 27216 - DNA, 201 bp, Homo sapiens
aaaataacacaataaaacaaagcacaaaagagacatatgaaacacattctcccaggctcttacacatacatgtaatctgagttccaaaacaagtgaaatasactaagaaaagcaatatttaaagacagaatggctgataatgttacaaaatcaatgacgcatacacggccaaaaaaagaagtatcctgagccataagcaga

SEQ ID NO: 27217 - DNA, 201 bp, Homo sapiens
agtaaggtctaaagagagagacatgactcaatgaacaccaaagcagacacccaggaaacagcatcctttgctcaccctgtcctgggaatcaaataagcctrttatgaatctgaatgtatattacaagcaaatactatttttccagctacacgttcttccttgtttcactgtatcacaataattttttaaaagcataggcat

SEQ ID NO: 27218 - DNA, 201 bp, Homo sapiens
tctttacatgcaatgcccctcagaggtcctgagatctcaagacagggagtgggatatgccagaccccgagaaataaagcaacagaagcccaactccaatasatactgggtaaaggaaagaataaaccatggtaatgcaggactcagacacacctatcgttgtcccagacttagagaactcacatggattcctaacacatag

SEQ ID NO: 27219 - DNA, 201 bp, Homo sapiens
caccctctctcctttagagaattcctgactgtagttacgggtaagccatctgtctctgtgtcttgtgaaattacactctggttcttacatcttcctttatytaagcaatgcattacccgttgctagtctacttttaaaagctgcaatagacaactccattttcttaccctttacaattgcctttggaacagaaacaaagcg

SEQ ID NO: 27220 - DNA, 201 bp, Homo sapiens
gtgaattctctattctagacgtctcaaaagtcacatagaggtacatgtgcttatatgttcaactcccaaaaggactgacaagtaaaaaaggaatcacagaycgacatgtcattttccctgctattatctttttgagtcagttttagtggaaggtgttttttttgttgtttgttgttgttgttttgtttttttttcagtaat

SEQ ID NO: 27221 - DNA, 201 bp, Homo sapiens
agtctatcaaattgaccttgagaaacacaggaaggtaatatttagtgacataccagatgaaatccttgcgcagagatgtgaggtgaggaaggacctgaagkgaagtagaccagcaaatatcaagggtcaaggagttgggggatgatatagagacgaagcctaacagatgtcaccagagcaagaaggccttacgacttcaca

SEQ ID NO: 27222 - DNA, 201 bp, Homo sapiens
tgacaactctctaatatttttcttcccttgcaagctcagctcagccttgcaggtatctcccttgcttttgtgagctagcttccccaggattctacttctaygcatgacatgcagtctggaggttctagcagtctgatttttctattcattgaaagtcatgagcatttgttcctcaggggttaatttgaaattatttcaggc

SEQ ID NO: 27223 - DNA, 201 bp, Homo sapiens
cagagcaagaaggccttacgacttcacatcctctctgcagggtatgaatggtgcaatggaatgaaatggtaactacagcttctggtgcaaaatttgagttwccataatcatcatcttgggaaaatgaggaacacaatataatggcatacacagagaacaagtgaaaagatgagagatgatgaacaggttgagtttcttcag

SEQ ID NO: 27224 - DNA, 201 bp, Homo sapiens
agctcagctcagccttgcaggtatctcccttgcttttgtgagctagcttccccaggattctacttctacgcatgacatgcagtctggaggttctagcagtytgatttttctattcattgaaagtcatgagcatttgttcctcaggggttaatttgaaattatttcaggccaggcatggtggctcatgtctgtgattccact

SEQ ID NO: 27225 - DNA, 201 bp, Homo sapiens
gtgcaatggaatgaaatggtaactacagcttctggtgcaaaatttgagtttccataatcatcatcttgggaaaatgaggaacacaatataatggcatacasagagaacaagtgaaaagatgagagatgatgaacaggttgagtttcttcagcctacaacctatcaaatctaattttaaacatctggagccacgtgtattag

SEQ ID NO: 27226 - DNA, 201 bp, Homo sapiens
gagcctgtaatcccagcactttgggaggccaaggcgggcagatcacttgaggttaggagttcaagaccagcctggccaacatggtgaaaccccgtctctawtaaaaatacaaaaattagctggacgtggtggcacacacctgttgtcccagctagttgggaagctgaagcaggagaatctcctttacccaggaggtggacc

SEQ ID NO: 27227 - DNA, 201 bp, Homo sapiens
aattagctgggcatggtgacgcgtgcctgtagtcccggctactcgggaggctgaggcagaagaattgcttgaacgcaggaggtgaaagttgcagtgagtcragattgtgccactgcactccagcctggtgacagagtgaaactcagtctcaaaaaaaaaataaaaaagaaaaagaaaaaaaagaaaaaagaaaatgactcg

SEQ ID NO: 27228 - DNA, 201 bp, Homo sapiens
ataacacgcggataaggttttttaaaaagcatcctttgaaaagttaaatatgattaaattcttcaatccaaacaagactagctttataaccagtaatacayggcatgtagaagtcactccctcaaggttgatggtgagatcttaatttggctaacccttccattttacataataagaagtaaaaagtttgcttggaatttg

SEQ ID NO: 27229 - DNA, 201 bp, Homo sapiens
cctaaatggccaccaaagggaagactggttatagcataagcacatgatggaatattatacagcagttaaaacaatgaagtagatctatatgcactaataasagatctcctgcagtactaagtttaaaaaaaaaaaaagtacagaacagaatgtgagtgtgtttgctggtatatagataacctttttctggaagaatacata

SEQ ID NO: 27230 - DNA, 201 bp, Homo sapiens
aattatggcaattataaaacctccctggtatagattgtcagattaataaccagcattagcagagctcagctacaccatcagcacgtgagaatcgaagagcycagagctacagggctaagtcgtaacaggagcaaagcaaagaagccaactaaaagaaacccagccagaactgtaaaagaaatctgcccacaaaataaaatg

SEQ ID NO: 27231 - DNA, 201 bp, Homo sapiens
agatgcacgtattcccatttgtactcttctcaatacatccctaaaaatcccacctactagaggttactactttttaacattagtcagaaagacaataaaakgatcagaaaaagtaagactctgttttcttttttatttaacccaaaataataagctcagtgagctcaagataagggctcatttcaaatatactgaatttca

SEQ ID NO: 27232 - DNA, 201 bp, Homo sapiens
tggtatagattgtcagattaataaccagcattagcagagctcagctacaccatcagcacgtgagaatcgaagagcccagagctacagggctaagtcgtaayaggagcaaagcaaagaagccaactaaaagaaacccagccagaactgtaaaagaaatctgcccacaaaataaaatgggtaaggctgccactcagactagct

SEQ ID NO: 27233 - DNA, 201 bp, Homo sapiens
acctgatttacaaaagtgggcctcggggggctggatttggtccacgtgccacaatctgacccttcgaatagacaatatccttttaacattcggttctaaastgacctgaagcaaaacaagaactaaagacgtgaagatgaccttgacctgtagattttcactgcaagaaaatgtgaataattataacagcaagttcagaac

SEQ ID NO: 27234 - DNA, 201 bp, Homo sapiens
agacttggagtttggaagccagatggaccaagcaaggagcctgactctgagctcaccagctgtgcaattcgggtgagttccttcacccttctgagccatcycttggctcgtctggaaaatgcaaaaaaaaaaaaaagaaaaacaccaggtttttgcatcctcctggatgagggatataaagtgcctgacacagcatatgac

SEQ ID NO: 27235 - DNA, 201 bp, Homo sapiens
atggacttgctcatgctttcattcataagacaaacaaagtgaagatgactttaaaaataaagacatgattccaagagcaataaactttacacactccactraaatctccatatggttagcccggcatgtgtatttgacaattaaaaaaaacaacaacagtcaagcgcttacccattcttctaaaatgcgtgacactgcttc

SEQ ID NO: 27236 - DNA, 201 bp, Homo sapiens
ccaaagtgctgggattacaggcgtgagccaccgcgcctggcctccatgttataatattaagaaaaaaagtcaaagtaccgaacagcgtgcacgtaagacayaaaagtggttaaacaggtgccaacattgattactgcaggagagagttaccggttgggggcaggaaaacttcttgtgcatttcataatgtcgacgctactt

SEQ ID NO: 27237 - DNA, 201 bp, Homo sapiens
atgcagtctggacttcattctgaaatccagcgatgtttcaaaaatcaaacagctcgcatcactctctagctcaaaccctctaatgtcttcctcaccgctayctcagagtctaccagatacccatcccccaacagcacctctcctacccactccattcatctccagccacactagcttccctgatgatccttgaaatctcca

SEQ ID NO: 27238 - DNA, 201 bp, Homo sapiens
gaccctctaccaataaaaagaaagtaacaccgcatgaaattttttgtaatcaaaatatacatggcacttttttttttttttttttttttttttttgagacrgagtcttgctctgtcgcccaggctggagtgcagtggcgcaatctcggctcactgcaagctccgcctcccaggttcacgccattctcctgcctcagcctcc

SEQ ID NO: 27239 - DNA, 201 bp, Homo sapiens
ttttttttttttttttttttttttgagacggagtcttgctctgtcgcccaggctggagtgcagtggcgcaatctcggctcactgcaagctccgcctcccasgttcacgccattctcctgcctcagcctcccgagtagctgggactacaggcgcccgccaccatgcccagctaattttgtgttatttttagtagagacgggg

SEQ ID NO: 27240 - DNA, 201 bp, Homo sapiens
ctttctctgtgaatttcctcttgatcacaggattgaacaggtacttaaagtaatagacactttataaattaacttctaagggacattttgaaaattaaatkatagcacatgaggcaagcaatcaattagtaatcgatacatatccaatagtcatgcatataagatgaaagggcaattcgttaaaaaacaaatggcccgaca

SEQ ID NO: 27241 - DNA, 201 bp, Homo sapiens
tcttgctctgtcgcccaggctggagtgcagtggcgcaatctcggctcactgcaagctccgcctcccaggttcacgccattctcctgcctcagcctcccgartagctgggactacaggcgcccgccaccatgcccagctaattttgtgttatttttagtagagacggggtttcaccgtgttagccaggatggtctcgatctc

SEQ ID NO: 27242 - DNA, 201 bp, Homo sapiens
aaaaaaggaagaaagaaaaagaaaaattcagattgaccttggctctcaccattaaaaaagcgaaaagtggtatattactttgcctcttgaaaagactaaaktctttatgctaccaaagtcacgtggaagtgctcaaaacacaatgttgggaaaattcagcagttttttgaggctcacttttaaagtgtccaaattgacttt

SEQ ID NO: 27243 - DNA, 201 bp, Homo sapiens
gtaaaactgtcacccttagaagaagaggagatcagaaaacagagacaaacagtaatagagggaagatgatgtgaaaagatacagggagaatggcttgtgcwgatggaggcagagactggaattaccctgccacaggccaatgaacatctagggctaccagaagctgaaagaggcaaggaagggtccttccctacacatttt

SEQ ID NO: 27244 - DNA, 201 bp, Homo sapiens
agcgtgattaatataaattacagaagaagcaattaaacttgaccacagatacacacatttgttcaagctgatggtgactctgcactcactccatacctacygtagattttgcttttctttatagttactcagaagatgcataattggaaataaaggttaagaaaaatcaaggccgggcgtggtggctcacgcctgtaatcc

SEQ ID NO: 27245 - DNA, 201 bp, Homo sapiens
gtagacacgtatcaacatcaacttctacatagacagagaaaagtaagaaatcagagatagggttaaagcttccttctttctaatcttaacaaccataagcrtaacagtctcctagttgcaatcatgggcgttcaccacgttttatttttcttaataaatgagttaaaggaagaaacattctcaaacccctgactaataaag

SEQ ID NO: 27246 - DNA, 201 bp, Homo sapiens
tcctgtacttttaaatacaaatagaaatacagaaataattagaaactacccagagtttcgccagatgtggtggctcacacctgtaatcccagtactttggkaggctgaggcaagtggactgcttgagcccacgagttcaagaccagcatgggcaacatagcaagacctcatctctattaaaaatacaaaagaaattagcca

SEQ ID NO: 27247 - DNA, 201 bp, Homo sapiens
ctgtcattacattaaatataaatggcctaaagatggcaattaaaagaaaaagtttgtcagactgaagaaaacataaatatacatatactgtccttaaaaamgaatgtacattatgttttataccttatttaaacataagcataaaaaaagtaaaagaatagaaaaggtatactgtataacacgggccaaaagaaatctgat

SEQ ID NO: 27248 - DNA, 201 bp, Homo sapiens
tagtccaagctactcaggaggctgaggtgagaggatcacttggcccaggagggagaggctacagtgagctatgatcacgctgatgcactgaagcctgggtracagagcaagaccctgtctcacaaaagcgaatcaatttaaatgttctctagaagcacaaagatcaagctgctggtacagtcacacactgcataacaacac

SEQ ID NO: 27249 - DNA, 201 bp, Homo sapiens
tacatcaaatacgtgaggctttttgtacgtcaatcatacctcaataaagttgtttttaaaaatgaaaaataaagaaaaggactacagatcctatgaacccwaagaagatcttaagatatggtgaacaactttataccaatgaatttacaatacaggtaaaaaagacaaattcctagaaaaacactacaaaaaaagttgcca

SEQ ID NO: 27250 - DNA, 201 bp, Homo sapiens
gtcccataagattacaacactgtatttttactgtaccacttctgtgtttagatacacaaatacttaccattgtgttatgactgcctatagtattcagttcrgtaccatgctatacaagtttgcagcctggaagcaacaggctatcccatacagcctctgtgtataatgggttataccacgtaggatttgtaagtacatcct

SEQ ID NO: 27251 - DNA, 201 bp, Homo sapiens
ccgaacaaagtcttgctgactgatctgccccatcaatcaggctaatgagatgccaacagccatatgcaagcaacacagtgaccaaacacaactgcatttgkgagcccgggacttcacacacccagaagatcttggacggaatggtggactgtgggtccctttgaaatttccaggtcaaagcaatgatcaggaatatctttc

SEQ ID NO: 27252 - DNA, 201 bp, Homo sapiens
tggaggcttaaagtccaaggtcaaggtggcagcatggtcacgttcttggggagggccctcctactagttacagatggctgccttcccactgtgttctcacmttcacatagcttaaggaaagttagctacctttctatcctcttctcatcagggcacaaatcttacttatgagggctccaccctcatgatctaatcacctcc

SEQ ID NO: 27253 - DNA, 201 bp, Homo sapiens
ttactggaaggagagataaagacgaaacagacaagcaaaaaggcagggtgcttggcaaaaaaaaaaaaaaaaaaaaagatcaaggattggggagcaactcygtgtaaataaatcacatgaatacaacagagatgaagctccatgaagcaagcgaaaactgtgggactcctctgtaggcagcgggagcctgtggatttaggc

SEQ ID NO: 27254 - DNA, 201 bp, Homo sapiens
caaaaacctttgaaattttctgagcaatgtgggtgaggggagagtcttttattattcacaattagagagttgtgaataattgataacccccacattccccrccttgggggaagaggaggggctggagattgacttaatcaccaatggccaatgatttaagtaatcatgcctagggtaacaaaacctctctaagaatcctaa

SEQ ID NO: 27255 - DNA, 201 bp, Homo sapiens
acttatgagggctccaccctcatgatctaatcacctcccagaggcccctgtattagtctgttttcatgctgctataaggacatatcgaagactgggaaatktataaaggaaagaggtttaattgactcacagttccacgtggctggggagacctcaggaaacttacaatcatggcaggagaggaagcaaacacgtccttct

SEQ ID NO: 27256 - DNA, 201 bp, Homo sapiens
ttgtttacccagacagggaacacaaagggagaaatggcttgggcatggtggtggagagcatcggagcaggcagccgcacaccatgagactcactggtaggytggacaggtggggacagtcgcccacagaatcctcaggcacaaaaaacatgaaggtgggaaccctgtcccctcaaatactgacaaagctcccacagaggta

SEQ ID NO: 27257 - DNA, 201 bp, Homo sapiens
tcttcacatgacagcagtaagagaagtgccaagcaaaagggaagaaagccccttataaaaccatcagatctcatgagaactcactcattatcgtgagaacrgcatgattcaattatctcccaccgggtccctcccacaagacatggggatcatgggaactatagttcaagatgagatttcagtggggacacaaccatgtcc

SEQ ID NO: 27258 - DNA, 201 bp, Homo sapiens
gtcccctcaaatactgacaaagctcccacagaggtaggagctaagaaaaaggcagcttctttccccgatgccaggaaggttccttctggtttaagtttttwaattttctccatattgtggatgtacttgggcagtgtccccatttactgtaaattatggttttaattatcatttttattaagacgcccaaaggagttgggg

SEQ ID NO: 27259 - DNA, 201 bp, Homo sapiens
gatgagatttcagtggggacacaaccatgtccaaataccatgaccttaagattagggtttcaacataggaatttttggggaagacataaacatttagtctmcaatactcattctgatttttcaaaactgtcataaatctacatttaagtaaaatatcctgattttagtatgctggcaagtagtctgacaaaaaaaaaaaga

SEQ ID NO: 27260 - DNA, 201 bp, Homo sapiens
ttctatgtttagatacacaaatacttaacactgtgttatgactgcctataatcttaggtttgcagcatagaagcaccgagtttgtggtggtccattatagyagcaacaggacattaatacaccttcccaataattaagtaaacatgtaaggaacatacaagtgagatgcaaacatgtgtacactcgggtaagtcaatcact

SEQ ID NO: 27261 - DNA, 201 bp, Homo sapiens
gatgctgtaatgtccaggtaaggaggagcacttcagagtgttactcttggctgggtaccacgccatgtgctttatgaaacacattaactaattctaaggtrttctctacagaaaccctataaagtgtcattgtcatttcatgtaagagaaaaaccactgatccccaatgttaaggaactcacaagatcagagggcaaaaaa

SEQ ID NO: 27262 - DNA, 201 bp, Homo sapiens
ggctcttaatctgagaaataattttaattaaactaaaaagaggtaagtcattgaacacacaataattaaacagcagactgtgctgtcagcaaaactgggckggctcttgcaggattatcagagggactggcgttgtcatgtgatgttttgtgactcttctacagtcctaccatcagctctcgtgaagaggatgcagcgagc

SEQ ID NO: 27263 - DNA, 201 bp, Homo sapiens
tatctttactctggtgaaatagctttgcaatgttacaagtatattcacaatgtttttcaggctcttgcattttcaaaagagaaaaagttgctgaaaaaaawattatataaataaaagtatataatatagcatattcgtttttgtccccatttaaaaatttgaaaataagcagttttgtaaagccaaagtgtattcctttct

SEQ ID NO: 27264 - DNA, 201 bp, Homo sapiens
taatgtaaatgaaattacagtgacatgacattgacgatgatcttgaaatccaactcccccacaggcatttccagatgaagttctaagatgtacaccacgcytatatgctcaatgccacatctgcaatgactagctaatccatacctctgtttctgtagttactttgattacctgaatgatcacacttgcctcccaggccat

SEQ ID NO: 27265 - DNA, 201 bp, Homo sapiens
aagatgtacaccacgcttatatgctcaatgccacatctgcaatgactagctaatccatacctctgtttctgtagttactttgattacctgaatgatcacayttgcctcccaggccatttcaattacatagttctgagttccaaagagttagagatcgtgcttactaaacacgatccacagctgccaaatcttaagaactta

SEQ ID NO: 27266 - DNA, 201 bp, Homo sapiens
agagaaacagatcaggaatcttacgattctcacgagctgaactgctcccctgccatcccaaactcatacactgaagccctaacccccaacatgactgcatytggagatggggcctttatggtcataattaaggataaatgaggtcataatgggggagccctaatccaataggactggtgtccttatgaaaaggggaaatct

SEQ ID NO: 27267 - DNA, 201 bp, Homo sapiens
taatgggggagccctaatccaataggactggtgtccttatgaaaaggggaaatctggacacagcacacggtgaggagactatgtgaacacgaagaagcctrctgagatggttaatattgagtgtcaatgtgattggattgaaggatgcaaggtgctgttcctgggtgtgtctgtgcgggtgtttccaaaggaggttaacat

SEQ ID NO: 27268 - DNA, 201 bp, Homo sapiens
ccaactaattttttgtatttttagtagagaaggggtttcaccatgttggccaggctggtcttgaacccttgacctcatgattcacctgccttggcctcccraagtactgggattacaggcatgagccaacagtgccagacctactgtctgctttttatacaatgtgaatcattagaaaagcaacaccctctcgccaacccc

SEQ ID NO: 27269 - DNA, 201 bp, Homo sapiens
cctaatccaataggactggtgtccttatgaaaaggggaaatctggacacagcacacggtgaggagactatgtgaacacgaagaagcctactgagatggttratattgagtgtcaatgtgattggattgaaggatgcaaggtgctgttcctgggtgtgtctgtgcgggtgtttccaaaggaggttaacatttaagtcagcgg

SEQ ID NO: 27270 - DNA, 201 bp, Homo sapiens
tgcttgaacctgggaggcagaggttgcagtgagctcagatcgcgccactgtactccagcctgggcgacagagtaaaactccatctccaaaaaaaaaaaaawatatatatatatatatatatatatgtgtgtgtgtgtgtatatatatatatatatatgtgtgtatatatatatatgtgtatatatatatatatatagtaat

SEQ ID NO: 27271 - DNA, 201 bp, Homo sapiens
gacggtgaatgattctgaataattcttagtctgggatcactggtctatctcaaggtactacatgttagagtaaaactataaaacagcaaattctatcatckgaaattgactcacagggacccaattaaggctcaaaatataagaaagaaagactgaacagtgggtctttgacatcatccatccaacctttttccttaaaga

SEQ ID NO: 27272 - DNA, 201 bp, Homo sapiens
gatcgcgccactgtactccagcctgggcgacagagtaaaactccatctccaaaaaaaaaaaaaaatatatatatatatatatatatatgtgtgtgtgtgtrtatatatatatatatatatgtgtgtatatatatatatgtgtatatatatatatatatagtaatggcaaaaaccacgtttgcaccaccctaataaaacatc

SEQ ID NO: 27273 - DNA, 201 bp, Homo sapiens
aactccatctccaaaaaaaaaaaaaaatatatatatatatatatatatatgtgtgtgtgtgtgtatatatatatatatatatgtgtgtatatatatatatrtgtatatatatatatatatagtaatggcaaaaaccacgtttgcaccaccctaataaaacatcaggctatcaggctatccagcttattaattattgctaca

SEQ ID NO: 27274 - DNA, 201 bp, Homo sapiens
gtgggcggatttcttgaggtcaggagtttgagactggcctggccaatacagcaaaaccccacctctactaaaaatacaaaaatcagccgggcatggtagcrtgcacctgtaatcccagctattgggaggctgaggcaggagaattgcttgaacctgggaggcagaggttgcagtgagctcagatcgcgccactgtactcca

SEQ ID NO: 27275 - DNA, 201 bp, Homo sapiens
actccatctccaaaaaaaaaaaaaaatatatatatatatatatatatatgtgtgtgtgtgtgtatatatatatatatatatgtgtgtatatatatatatgygtatatatatatatatatagtaatggcaaaaaccacgtttgcaccaccctaataaaacatcaggctatcaggctatccagcttattaattattgctacat

SEQ ID NO: 27276 - DNA, 201 bp, Homo sapiens
gttaagaaaaagaaagctgatccgaaacgtgaagtgagctggttacttaaacattttaatgtttaaagttctgagcttcctggcaaccaaggtaaggaaasgaaatataatactttataatgtcctcctcattaaacaaccaccaccaaaaaaaaaaaaaaaaaaacataccaattcttttagaggaatgagctttgtttt

SEQ ID NO: 27277 - DNA, 201 bp, Homo sapiens
tttgacaattaaaaaaaacaacaacagtcaagcgcttacccattcttctaaaatgcgtgacactgcttcactcgcccttgccatgttcctgcaggccaagrtcacatgtgcaccatggagggcaaaagacttggcggtttcgaaccctatggtttaaaggaaagtcaatgttagaaaacataacatcaacacagtgagtca

SEQ ID NO: 27278 - DNA, 201 bp, Homo sapiens
aactaatctgattaatgtaaatgaaattacagtgacatgacattgacgatgatcttgaaatccaactcccccacaggcatttccagatgaagttctaagawgtacaccacgcttatatgctcaatgccacatctgcaatgactagctaatccatacctctgtttctgtagttactttgattacctgaatgatcacacttgc

SEQ ID NO: 27279 - DNA, 201 bp, Homo sapiens
ttcttaataaatgagttaaaggaagaaacattctcaaacccctgactaataaagcagatgacactgacaatgaactacaaacaaatgcgtgaataataatkgacttgctcatgctttcattcataagacaaacaaagtgaagatgactttaaaaataaagacatgattccaagagcaataaactttacacactccactgaa

SEQ ID NO: 27280 - DNA, 201 bp, Homo sapiens
ctacaagactgatagttatacctctcaggaaaatgatggaagccacagctgaaaaaaaataaaactttcatcttagaattctatacctagtgaaaatattyttgaaaaataaaggcagagaacaaaaattttaagcaaacgaaagctgctttttgtttgtcacctacactacacctagtgtcacgtatagacccacactag

SEQ ID NO: 27281 - DNA, 201 bp, Homo sapiens
ggtgaatgaccactaagataccacaaatataactgtgagaatgacaagtgtttttgaacacccagctactagggagtatctagcatttctagttcttttgyagcttgataatgtttttacaaatgttttcattgcattaacttaacatttggctgaggagttcctgtggctataacacactgctacacagttttgttttaa

SEQ ID NO: 27282 - DNA, 201 bp, Homo sapiens
taaaggatgctcttcaggcaggaggaaaatgaccttagctataaacccagagatgcagaaagtaacaaagagcaacataaagggtaacgacatgttaagayccaaatggtaagagtgaaatctgtgagttttaaaatatatagcaaaaattactatatcaataataataacaatgcttaacctaggaggtgagtaatggaa

SEQ ID NO: 27283 - DNA, 201 bp, Homo sapiens
atactagaccctcaggaaatacctatttctttcgaatgacttgttgaatgattgctatgcatctggatagcatcaatgataaaaagcaacatctcttttayagcacagttgctattggtctaattgtgtccccccaaaaagatatgttgaagtcctaagcccagtacctcagaatgtcaccttacttggaaacagggcctt

SEQ ID NO: 27284 - DNA, 201 bp, Homo sapiens
aaagtgcctggagttgagcactagttgcctctagtaatgactaactaaaaaacacatttttatattgcctctccttccttcctgaattccccatccctctstttgtaatcacatcccaaattatgcataaatatgtctttttctctggttctgtttttggaggaacctaaggtaagacaaagaactcttaaaacattttca

SEQ ID NO: 27285 - DNA, 201 bp, Homo sapiens
ttaaaacattttcaatacagaaaacttactctctacttttatttatttatgtatttagagacagagtctcactctatcgcctgggctggagtgcagtggcrcaatctcagctcgctgcaacctccgcctcctgggttcaagcaattctcctgcctcagcctcccgagtagctgggattataggcgcctgccagtacgccca

SEQ ID NO: 27286 - DNA, 201 bp, Homo sapiens
acaaatagaaatacagaaataattagaaactacccagagtttcgccagatgtggtggctcacacctgtaatcccagtactttgggaggctgaggcaagtgkactgcttgagcccacgagttcaagaccagcatgggcaacatagcaagacctcatctctattaaaaatacaaaagaaattagccaggaatggtggtgcatg

SEQ ID NO: 27287 - DNA, 201 bp, Homo sapiens
gcgagaccctatctcaaaacaacaacaacaaaaacctaaacgatagggtttggagagcttccagattgctgagcatgtggtgcctggagaggggcatgccrggagggggtatggaagctccacatcccctccgcatgcctggccctatgtaccgcttcatctgtactctttgtaatatcctttatcataaacaggtaaaca

SEQ ID NO: 27288 - DNA, 201 bp, Homo sapiens
gttctgagaaggaaagtaacttgctcgggtcatacagataggaagtggttatcccaggtttcaaaactaggtcacgtctgcttccagagtcagtgttcctstcctacatctttccagatagaaacttgctaccaatgaagcttgccctaactgtcagcgaagctattttcagcaatggtacaatttctccacctgaaagca

SEQ ID NO: 27289 - DNA, 201 bp, Homo sapiens
aagtaatagacactttataaattaacttctaagggacattttgaaaattaaattatagcacatgaggcaagcaatcaattagtaatcgatacatatccaayagtcatgcatataagatgaaagggcaattcgttaaaaaacaaatggcccgacataagaaaagcctatcaatcttgctaatcatcagagataggcaaattt

SEQ ID NO: 27290 - DNA, 201 bp, Homo sapiens
ctctgataatcaaaaaaaaaagtatctctgataatctatgtaaccagatcactatcttagatatctttaagataattactttttaaagttttgtaaaatcyaacagtggcttgtgtgtgtttgttactattgttgttttggtctttaaaaaaataatgctgacaccatctcaattcacactgataacatttaaagcaagcc

SEQ ID NO: 27291 - DNA, 201 bp, Homo sapiens
tgggtttacaggcgtgaaccaccatgcccactcctaagcttcagcttctgaatccaggatccaatgcagtctggaaatgacatctgccttggccctccccrcagatgccactcccagcacttgaccgggcacagagcgaggcttcacgggtttaaataaattggttgattccaaactcaggattaacaaaatgaatgagct

SEQ ID NO: 27292 - DNA, 201 bp, Homo sapiens
ttcgacattatcacaagacagctgtaagcacggtgctgagaattaaatatgacaagtacggaatcttcataaattttaaacggctatcaatgtaatacaayatgataatcaataaatacgaatctgtaacaattaagtacattgtagaggtaagggtaaaaatgaaaaacattgtattagctttaacttcagtttctgtgc

SEQ ID NO: 27293 - DNA, 201 bp, Homo sapiens
aacaaccaaaatatctttactctggtgaaatagctttgcaatgttacaagtatattcacaatgtttttcaggctcttgcattttcaaaagagaaaaagttrctgaaaaaaaaattatataaataaaagtatataatatagcatattcgtttttgtccccatttaaaaatttgaaaataagcagttttgtaaagccaaagtg

SEQ ID NO: 27294 - DNA, 201 bp, Homo sapiens
cctgggcaacagagtaatactctgactcaaaaaaaaaaaaactgaaacaccacggataaggggggactactgtatacatgattacaaatttattttaaaartatatataacatacacacacccctattataagcattttacatgagattaccaaattatgagatgatgctcattagaatgttttaaattggtctcttcctt

SEQ ID NO: 27295 - DNA, 201 bp, Homo sapiens
gtagaggtaagggtaaaaatgaaaaacattgtattagctttaacttcagtttctgtgcaactacagaagaaatttgattctgattttgttcctctttatawgaaataaacttcatacaaaaggcttagctccgttcatctggctagttatcctccacctaggtagaaatagtagagacactgaaataggtttcctccccgc

SEQ ID NO: 27296 - DNA, 201 bp, Homo sapiens
catctggctagttatcctccacctaggtagaaatagtagagacactgaaataggtttcctccccgcccccatctctctgtctcagatctcctcttagagtstagtgaagaaaccttgtcttgctttcagagagcaccatatgactatggcttctaacatgaaggctccaaaaatcacaaaaagtaaaaccatcaagcacag

SEQ ID NO: 27297 - DNA, 201 bp, Homo sapiens
gtttcagttgagatctaatcaggttcacactgacagtagcccccccttatcctcgggagatgcgttccaagacccacagtgatgcctgaaaactggatagkaccaaaccctatgtattctatgctttcacctatacatacatacctaggataaattttaatttataaattaggcacagtaagagatcaacaataataataa

SEQ ID NO: 27298 - DNA, 201 bp, Homo sapiens
ctgttatgaatctgaatgtatattacaagcaaatactatttttccagctacacgttcttccttgtttcactgtatcacaataattttttaaaagcataggsatatcatgaaatcccttgctttgtagaagattccattataagagtaatcattattgaaccttttagcccagatgtaatttcttacatgttacaacaagtt

SEQ ID NO: 27299 - DNA, 201 bp, Homo sapiens
acaaaaagtaaaaccatcaagcacagcctggtgagcaaataactcaaagacttaaaacaattagatttaaaccttgtcacacaatgcaacccttcctatgyaccccattcagttaggcttgtgtagactgagaccagctcttcatgaaatgtaccgttatttatgaagccaaagggagatcacaaatttaggcaagaaact

SEQ ID NO: 27300 - DNA, 201 bp, Homo sapiens
atcagagggcaaaaaagggggaggaccccaatgggcatggtagcctgacttcaagcaggtgtaccccaccatcaggccccccacactaccacaatcaccaygtgactgtggatttgtgatattgtgatataataagaaatacatactgggtcttcatccaggttcctggcacagagctcctaaaatccttgaaattggcca

SEQ ID NO: 27301 - DNA, 201 bp, Homo sapiens
tataaattatattgcatgaataggacaaaatactgtgttacacctaaaaagaatgaggagaaatgatacggagatgcaaggaaacatttccatgttataattttttttttttttctcttgagacggagtctcgctctgtcgcccaggctggagtgcagtggcgcgatctcggctcacttcaagctccgcctcccgggttca

SEQ ID NO: 27302 - DNA, 201 bp, Homo sapiens
actatatccttggtcccaagactaatgcaagcccttagtaaatatttatgtagacacgtatcaacatcaacttctacatagacagagaaaagtaagaaatyagagatagggttaaagcttccttctttctaatcttaacaaccataagcataacagtctcctagttgcaatcatgggcgttcaccacgttttatttttctt

SEQ ID NO: 27303 - DNA, 201 bp, Homo sapiens
attaaacttgattatggtctatttttcctacctagaaggtaagcctatgagggcagggattctgtttcgtttaatactatatccttggtcccaagactaakgcaagcccttagtaaatatttatgtagacacgtatcaacatcaacttctacatagacagagaaaagtaagaaatcagagatagggttaaagcttccttct

SEQ ID NO: 27304 - DNA, 201 bp, Homo sapiens
aaaagaaatagccaggtgtggtggcaggtaccggtagtcccagctactcagaaggctgatgtcgagggattgcctgagtccaagagttcaagggcacagtsagctatgattatgccactgcactccagccagagtgacagagcaaggccctgtctcaatttaaatggaagaaagaaaggaaagagaaagaaagagagagag

SEQ ID NO: 27305 - DNA, 201 bp, Homo sapiens
atgacaattctaaatttatatgtacttaataatagagcctctcatatatgtcaaaaattgacagaattaggacaataaatagacaaattcacaattataayggaagattttaacatatccctcttagtaacagataaaataagcagacaaacacaaagtatatagaagacttgaacaacttaattgataaactgaaaataa

SEQ ID NO: 27306 - DNA, 201 bp, Homo sapiens
aactacatatattaaaaagaagaccaggcacagtggctcatggctgtaatcccaggaatcggggtggccgaggcgggtggatcgcttgagcccaagagttygagaccagcctgggcaacatggcaaaattccatctctacaaaaaattagttgggcgtggtggtgcacacctgtggtcccagctactcaggaggatgatca

SEQ ID NO: 27307 - DNA, 201 bp, Homo sapiens
taatgtcgacgctacttccatttttaacacatgcatacatgcctgctataggaagaaactaaaaataacaaaccaaatgctatctaattgataattcatgrgcctttatgaattttaatacagagcaatcaaggcaagtgagaaaaaaagggaggagcctattcctattccaaacaaggtatttcctgagcatcctgattt

SEQ ID NO: 27308 - DNA, 201 bp, Homo sapiens
attgttatggcactgggatttttcaatgcgcaggtgacaccctttctatctgtgcattgcttctgccctctcccgttctcactgtgccatcagcaccattwgtcaccagaaatgtccccaggcttcagtgaaatgctttcttctggattttctctcttgcgtatctatccacagtgggatcaccatatgacaatattacca

SEQ ID NO: 27309 - DNA, 201 bp, Homo sapiens
aaaggaaagaataaaccatggtaatgcaggactcagacacacctatcgttgtcccagacttagagaactcacatggattcctaacacatagacactgctgytaaataaaagagagtccactgcatcttgaaaacaggaaaacatcttattccaccagccacactggcctcttggaatacacaggaaaacgataggtgcttg

SEQ ID NO: 27310 - DNA, 201 bp, Homo sapiens
gatctaccatatagtactgtgctcatattgtatcatgtacttataaaatataatggtttcacaggtatatacttatctccaaacttatcaagttctatacrtcaaatacgtgaggctttttgtacgtcaatcatacctcaataaagttgtttttaaaaatgaaaaataaagaaaaggactacagatcctatgaaccctaag

SEQ ID NO: 27311 - DNA, 201 bp, Homo sapiens
attaaagtaaaatatgaaactaaacagagaatgaagagataagccagaggtgtgctctgaataaaagaagtaatgaaaaggaaaaatttcataccaattgycataataaaaacaaaggctaaaggcaactaagagaagaggggctcaacggttcccaaaaagacttacagaataggtaaaattcagcaggcattgcgaagt

SEQ ID NO: 27312 - DNA, 201 bp, Homo sapiens
tagtactgtgctcatattgtatcatgtacttataaaatataatggtttcacaggtatatacttatctccaaacttatcaagttctatacatcaaatacgtraggctttttgtacgtcaatcatacctcaataaagttgtttttaaaaatgaaaaataaagaaaaggactacagatcctatgaaccctaagaagatcttaag

SEQ ID NO: 27313 - DNA, 201 bp, Homo sapiens
aaggctaaaggcaactaagagaagaggggctcaacggttcccaaaaagacttacagaataggtaaaattcagcaggcattgcgaagtattcactgcacccmaaaaaaaaaatagtctttgcaaagtctgtactattgttgactgcaatgcccaccattaaaaatatggttaaatttctaaagaaagacttctgacagccat

SEQ ID NO: 27314 - DNA, 201 bp, Homo sapiens
gcaataaaactatattcaaacactgacactttttggatatgatcaaaaaaataggacagcaaagttgagcatttctacttaatacaccaggcagtcctatmaactatcacaaacttgggtgaacaagtgtgctaatgcagaactctcagtaaaaaagatgttaccatgatgcatggtataacggttttaaagaataatagt

SEQ ID NO: 27315 - DNA, 201 bp, Homo sapiens
cttggctttgcgtggacagagaagcacaagggtagcaggctcagggatctgcaggagcttgaacccatggtgcaagctcccttgcatttcacaaatgtcaytgagtggcagcagaacctctgggccaagaactttactggaaggagagataaagacgaaacagacaagcaaaaaggcagggtgcttggcaaaaaaaaaaaa

SEQ ID NO: 27316 - DNA, 201 bp, Homo sapiens
tattgtatcatgtacttataaaatataatggtttcacaggtatatacttatctccaaacttatcaagttctatacatcaaatacgtgaggctttttgtacrtcaatcatacctcaataaagttgtttttaaaaatgaaaaataaagaaaaggactacagatcctatgaaccctaagaagatcttaagatatggtgaacaac

SEQ ID NO: 27317 - DNA, 201 bp, Homo sapiens
cattaacaatgtttgccatttcttattcgtcacaagggttagttctcctaaccaacatgagaaacacagacacatagagccgtaccatacaaaagcaattytttaaggaaacagtctaggtacattgaagaaaacacatcttagggataatacctgtgcaagaggcacaaaatctcttaagaagatggaaggcatctacag

SEQ ID NO: 27318 - DNA, 201 bp, Homo sapiens
tgtaatcccagctactcaggaggctgagacatgagaatcaccaggccctgggagacaaaggttgcagtgagctgagatcacgccactgtactccagcctgsgcaacagagtaatactctgactcaaaaaaaaaaaaactgaaacaccacggataaggggggactactgtatacatgattacaaatttattttaaaaatata

SEQ ID NO: 27319 - DNA, 201 bp, Homo sapiens
ggactgtgggtccctttgaaatttccaggtcaaagcaatgatcaggaatatctttcttcacagtttcatcacagggtattaaaagaaaaaaaaaagatgtmagagagtggaaatgagagtaaacaattcttagtcattcaatagcagctacgtttttaacagattgagaaagcatcgatataacacaaggccaggcaggtt

SEQ ID NO: 27320 - DNA, 201 bp, Homo sapiens
aatgaataaatattaaaatcctgcaaagatactgctcactgtagttttgaatgatgctaccaagaaatctgtgggggaaaagcatgccgtttttctatcarattttattttcccaaacaaacctgttaagtcctgctatctcacttgacaaaataacccacggcaaaggactttttattaccagaaagggcacatctgaca

SEQ ID NO: 27321 - DNA, 201 bp, Homo sapiens
attcgtcacaagggttagttctcctaaccaacatgagaaacacagacacatagagccgtaccatacaaaagcaattctttaaggaaacagtctaggtacaytgaagaaaacacatcttagggataatacctgtgcaagaggcacaaaatctcttaagaagatggaaggcatctacagtccattgactgtaaatttggaatc

SEQ ID NO: 27322 - DNA, 201 bp, Homo sapiens
atggaatgtgttttcacttaagttgtattttattaaatagctccttcttcccaaaagtaatttgagagctctataaaggatatcttgaatataaagagacracagggtagatcagagtggcttcctctaagaaataggatggatcctgaaattaatcactcaaaccgcagctagagagtttgaaagcaaaatctgcaaagt

SEQ ID NO: 27323 - DNA, 201 bp, Homo sapiens
ggcttaatagctcactgtcttgggttttaagctttgaacacaaacattcaagttctatgaaatggaaaaggtgcaaagtaatttaaatacctacttatctkatactatcttacatagttttcactctttagaacagaggtcacaaactgatgatcagaggacaagtcaagcccacagacctgttttgtgtggcccatactt

SEQ ID NO: 27324 - DNA, 201 bp, Homo sapiens
ctaggcatggtggcgtgagcctgtaatcccagcactttgggaggccaaggcgggcagatcacttgaggttaggagttcaagaccagcctggccaacatggkgaaaccccgtctctaataaaaatacaaaaattagctggacgtggtggcacacacctgttgtcccagctagttgggaagctgaagcaggagaatctccttt

SEQ ID NO: 27325 - DNA, 201 bp, Homo sapiens
tttcatgcgtgaagaaaatattattattgttgttattaatagcagcagctaacatttaattgagcacttaatttattccacaatgggttaagactttatawacacagagttgatgtgtttaatagaaccacctgtatctctgaatagagatattatgatgtgcattttacagatgaagaaactgaggtttaaagaagttaa

SEQ ID NO: 27326 - DNA, 201 bp, Homo sapiens
ttagttgccagcattaaaacattggggagatcacaggtccaaaagctagatgtgtagcttctctgaaaaagcttacaccactgggggcccaatcccacgtrgtgacaggttagctgagaagccactgtcagctagaggtggggtttgggctttctagttggtcatgttgaccatgatcatcacccgtgctgctggcattac

SEQ ID NO: 27327 - DNA, 201 bp, Homo sapiens
agcaataatgtcatgaaaacacatgcccttgtgtgatttggcagaacaggctgctccctgaacacaatgggcctttttattaagtggatcccttcatcccyggcattttatacaaacaaaacaaaagagagagaaaaagaaacaaacacgacactagtaacagtcttcagtttgaacttcatcacagagaattagaagacc

SEQ ID NO: 27328 - DNA, 201 bp, Homo sapiens
gactgcctatagtattcagttcggtaccatgctatacaagtttgcagcctggaagcaacaggctatcccatacagcctctgtgtataatgggttataccaygtaggatttgtaagtacatcctatgagggtcgcacaacgatgacactgcctgacacacttctcagatcatatctctgtcattcagtgaagctgactgcat

SEQ ID NO: 27329 - DNA, 201 bp, Homo sapiens
ctatacaagtttgcagcctggaagcaacaggctatcccatacagcctctgtgtataatgggttataccacgtaggatttgtaagtacatcctatgagggtygcacaacgatgacactgcctgacacacttctcagatcatatctctgtcattcagtgaagctgactgcattttggtgtgttttgtatcctccacaagggca

SEQ ID NO: 27330 - DNA, 201 bp, Homo sapiens
caacctcagtgcaactatgttccttgatagacataagccatagtcagctgaagctgcagcaacaaaatatcatggaccgagtggcttaaatagcagacatktctttaacacagttctggaggcttaaagtccaaggtcaaggtggcagcatggtcacgttcttggggagggccctcctactagttacagatggctgccttc

SEQ ID NO: 27331 - DNA, 201 bp, Homo sapiens
caacctaaatggccaccaaagggaagactggttatagcataagcacatgatggaatattatacagcagttaaaacaatgaagtagatctatatgcactaayaacagatctcctgcagtactaagtttaaaaaaaaaaaaagtacagaacagaatgtgagtgtgtttgctggtatatagataacctttttctggaagaatac

SEQ ID NO: 27332 - DNA, 201 bp, Homo sapiens
ccagcctgggcaacagagtaatactctgactcaaaaaaaaaaaaactgaaacaccacggataaggggggactactgtatacatgattacaaatttattttwaaaatatatataacatacacacacccctattataagcattttacatgagattaccaaattatgagatgatgctcattagaatgttttaaattggtctctt

SEQ ID NO: 27333 - DNA, 201 bp, Homo sapiens
caccaaagggaagactggttatagcataagcacatgatggaatattatacagcagttaaaacaatgaagtagatctatatgcactaataacagatctcctrcagtactaagtttaaaaaaaaaaaaagtacagaacagaatgtgagtgtgtttgctggtatatagataacctttttctggaagaatacataatgtttatct

SEQ ID NO: 27334 - DNA, 201 bp, Homo sapiens
tgattgattgactgattgactgactgagacagagtctcactctgtcacccgggctggagtgcagcggtgcaatctgcaacctctgctcactagaacctccmccgcagggattcaagcgattctcgtgtctcagtctccccagcaactgggattacaggcgcgtgccaccacacccagctaatttttgtatttttagtagag

SEQ ID NO: 27335 - DNA, 201 bp, Homo sapiens
tttccatgttataattttttttttttttctcttgagacggagtctcgctctgtcgcccaggctggagtgcagtggcgcgatctcggctcacttcaagctcygcctcccgggttcacgccactctcctgcctcagcctcccgagtagctgggactacaggcgcccgccaccacacccggctaattttttgtatttttagtag

SEQ ID NO: 27336 - DNA, 201 bp, Homo sapiens
catgcctgtaatcctagcacattgggaagctgaggcaagaggatcacttaaacccaagggtttgagaccagcctggacaacacagtgagatcccatctctaaaaaaaaaaaaaaaattgtggagcacagtgccatgcacctgcagtcccagttactcaagaggctgaggtgggaggatcacttgagcccagaagttggagg

SEQ ID NO: 27337 - DNA, 201 bp, Homo sapiens
cctactgagaacaattagaaaagatggacaaaataacacacgtgcatacacacccatatctgtttgaaggcatcagaagggcactatgactaagaattttkggggccaagatctgcaaaaactgcaaggccagcatttggcagcttttttccttcaaggcatatttcatttccaaacatagtggttggaagcctgagaaga

SEQ ID NO: 27338 - DNA, 201 bp, Homo sapiens
tgtaaaaaactttaaagcaaattgagtttaatagaaaaacactaaattaaaggataatccttaccttgtagttgcttttttaaaagtatctctgataatcaaaaaaaaaagtatctctgataatctatgtaaccagatcactatcttagatatctttaagataattactttttaaagttttgtaaaatctaacagtggctt

SEQ ID NO: 27339 - DNA, 201 bp, Homo sapiens
ttaccggagcaccacttaaattaccccaagttctcaaccaggggtgattttgatccccaggggacagaagcaaatgtctggagacattttcagtggccacrgttgtggggtagagtcctactggcatctagtgggtaaacaccaggcattacaaaacatcttaccatgaacagggcagcccctgacaacatagaaccatct

SEQ ID NO: 27340 - DNA, 201 bp, Homo sapiens
gactaccaaaggaagcattttaataattaccttcattgtgaaaatcaaatctgttatgagataataaaatgaaggaaatcagttagggagcaccatctttaaaaaaaaaaaaaaagaaatttaaaattttataaggaagaatttagaaatccagggtctagaaatggaaactacatagaatatatgtattttgcccctagc

SEQ ID NO: 27341 - DNA, 201 bp, Homo sapiens
tgattccaagagcaataaactttacacactccactgaaatctccatatggttagcccggcatgtgtatttgacaattaaaaaaaacaacaacagtcaagcrcttacccattcttctaaaatgcgtgacactgcttcactcgcccttgccatgttcctgcaggccaagatcacatgtgcaccatggagggcaaaagacttgg

SEQ ID NO: 27342 - DNA, 201 bp, Homo sapiens
atagagggaagatgatgtgaaaagatacagggagaatggcttgtgcagatggaggcagagactggaattaccctgccacaggccaatgaacatctagggcyaccagaagctgaaagaggcaaggaagggtccttccctacacattttaaagggagtatggccctaccaacaccttgatttcagacttctagcctctagaac

SEQ ID NO: 27343 - DNA, 201 bp, Homo sapiens
ttcataagacaaacaaagtgaagatgactttaaaaataaagacatgattccaagagcaataaactttacacactccactgaaatctccatatggttagccyggcatgtgtatttgacaattaaaaaaaacaacaacagtcaagcgcttacccattcttctaaaatgcgtgacactgcttcactcgcccttgccatgttcct

SEQ ID NO: 27344 - DNA, 201 bp, Homo sapiens
aagagacctgagcatggtgcagggggtggactgtatcgggcacctctcatgcaccccttcaaattctcacagctccattttactcaaaccatttttacgcycaccatgcagttttcaaccaacttgacacaaatgcaaccagatggcctcacctggggctacaatatggatccccccatttccatcctagagattctctga

SEQ ID NO: 27345 - DNA, 201 bp, Homo sapiens
agactaatgcaagcccttagtaaatatttatgtagacacgtatcaacatcaacttctacatagacagagaaaagtaagaaatcagagatagggttaaagcytccttctttctaatcttaacaaccataagcataacagtctcctagttgcaatcatgggcgttcaccacgttttatttttcttaataaatgagttaaagga

SEQ ID NO: 27346 - DNA, 201 bp, Homo sapiens
ctcctgtcctcctttcccttttggttttcacatccttattctgagctaaccacatcacgagcacatctttactgctcaactgagttctcctgaagcattayaaaaaacaaatcagttacatgttttaaatatccgttggcaagcatcatagcatggctcttaatctgagaaataattttaattaaactaaaaagaggtaag

SEQ ID NO: 27347 - DNA, 201 bp, Homo sapiens
gagtccagtgctaagattctgccccaggcatttactcacaaatacgtaaataaagaatgctcacagcagcatagtttaggcccaatatcagatgatatcgyaagaaagactgatgcaagaaagagagaactgtgaaacaccattgcttggaataacaaatagcaaaacaatgcaaacaacctaaatggccaccaaagggaa

SEQ ID NO: 27348 - DNA, 201 bp, Homo sapiens
ccctctgtggcggcatatatatgaagtcatccataagaagaaaataagaacttggtcctagacacaaaacaatacgtaaggaaattcctcatggactaacrcaagcggtcagacaccacactagttgctttcattccaccttgtcgaattctcacaactctgtgatgctgacgtcatggttcccattttacagatgaggaa

SEQ ID NO: 27349 - DNA, 201 bp, Homo sapiens
tctgctttttatacaatgtgaatcattagaaaagcaacaccctctcgccaaccccacccccgacaattctaatcagttaaatgctgcctccttgcagattytgtccattggtcctggttctgtcccttgaagaaagctaggattatctctctcctagatagctactgagagaactaatttacataaatcttttcttctacc

SEQ ID NO: 27350 - DNA, 201 bp, Homo sapiens
aatgcctgatgtttccaagagcttaaatactataatggcagatattgatgtacagaaattaaagtaaaatatgaaactaaacagagaatgaagagataagmcagaggtgtgctctgaataaaagaagtaatgaaaaggaaaaatttcataccaattgtcataataaaaacaaaggctaaaggcaactaagagaagaggggc

SEQ ID NO: 27351 - DNA, 201 bp, Homo sapiens
tcacatgtgcaccatggagggcaaaagacttggcggtttcgaaccctatggtttaaaggaaagtcaatgttagaaaacataacatcaacacagtgagtcawgttgaatggcctttaccggagcaccacttaaattaccccaagttctcaaccaggggtgattttgatccccaggggacagaagcaaatgtctggagacatt

SEQ ID NO: 27352 - DNA, 201 bp, Homo sapiens
caccgagtttgtggtggtccattatagtagcaacaggacattaatacaccttcccaataattaagtaaacatgtaaggaacatacaagtgagatgcaaacatgtgtacactcgggtaagtcaatcactaacagcgtcgcgatgatgacacaccaacaagactagctttcccaaatccctcccggatcaggccagcaggaaa

SEQ ID NO: 27353 - DNA, 201 bp, Homo sapiens
gcacatgacagcctccgctgagccaaatggcccaaagacttctgaatgagcttttgctgcaacaaaaaactttggatcattttgagagcctcccgtgaggygccaatatgttgcagtaccttcccggccccgacactgatgtgattcatcgtaggtaacatatgaatacgctcaagctggccagcagcttgaaaaattgga

SEQ ID NO: 27354 - DNA, 201 bp, Homo sapiens
acttaatttattccacaatgggttaagactttatatacacagagttgatgtgtttaatagaaccacctgtatctctgaatagagatattatgatgtgcatkttacagatgaagaaactgaggtttaaagaagttaagaaacttgcccaaggtcataagatgtatctgattctaatctttgccactataatacagcatgttt

SEQ ID NO: 27355 - DNA, 201 bp, Homo sapiens
tttgggctttctagttggtcatgttgaccatgatcatcacccgtgctgctggcattacccgccaggccactgcaggcacttgatgctcagtgcacattatycaggaaacatccttgctacagacatgactcaagccttaccacaaaacaccctcagtccatatgttcacaactcaatcaccgaatctcaaagaacatctcc

SEQ ID NO: 27356 - DNA, 201 bp, Homo sapiens
caggccactgcaggcacttgatgctcagtgcacattattcaggaaacatccttgctacagacatgactcaagccttaccacaaaacaccctcagtccataygttcacaactcaatcaccgaatctcaaagaacatctcccactgatctggttgagattttatttaaaccatgtcaaaccctactatgtcaagtgtgagact

SEQ ID NO: 27357 - DNA, 201 bp, Homo sapiens
aagaacttcagaactttacgttcctttgtgagcatgcgcttattgacttgagcaagtggcttatatagttcttgctggtttgcagacttgtttatatcatmctttatttattgaaaatccaatactatacagaaaaacaatttgtaaagcaaagaaatgaggaacaaatctaatggctgatttaggatgcgctcttcccgg

SEQ ID NO: 27358 - DNA, 201 bp, Homo sapiens
acaccctcagtccatatgttcacaactcaatcaccgaatctcaaagaacatctcccactgatctggttgagattttatttaaaccatgtcaaaccctactmtgtcaagtgtgagactattaggatgctagctatgccttggaaaaccccgcagtagcacttggctttgcgtggacagagaagcacaagggtagcaggctca

SEQ ID NO: 27359 - DNA, 201 bp, Homo sapiens
ttactctcttcctccatcttcttccaaccctaatcttccctttaggagtctttcttctataactatgatttttccccaaacgccagcaaccttatattcayacactattggacttcttcattacagcatttcacacattgttttacttgatctgtacaaaacagtatgtgacagagaagttattattctcttgaatttaca

SEQ ID NO: 27360 - DNA, 201 bp, Homo sapiens
atggagataagccctgtgacttgtgatgcgttgacgaatgatcatcttttccaagccaagtcaccagcttagacaggcatgaggctcgtattttacccgcyccacataccacatgcctccccccaacacatatatcataaaagaaggccaaggccttccatccacaaaggcaaatcatgggacttaagcttttagtgtcaa

SEQ ID NO: 27361 - DNA, 201 bp, Homo sapiens
ggagcaggcagccgcacaccatgagactcactggtaggctggacaggtggggacagtcgcccacagaatcctcaggcacaaaaaacatgaaggtgggaacyctgtcccctcaaatactgacaaagctcccacagaggtaggagctaagaaaaaggcagcttctttccccgatgccaggaaggttccttctggtttaagttt

SEQ ID NO: 27362 - DNA, 201 bp, Homo sapiens
gcgaaggttgcagtgagccaagaatgcgccactgcactccagcctgggcaacagaggaagacttcatctcaaaaaaacaaaaaaaaaaaacaaaaaaaaamaaaacaaaacaaaaaacaaagaaaaaaacatagggtcaccaaggcgttcaaaatgaaccttaaacagaggtattaatacttaaatattacaatttccact

SEQ ID NO: 27363 - DNA, 201 bp, Homo sapiens
aaaccgcagctagagagtttgaaagcaaaatctgcaaagtatgaacattgatactaaacatggtaaaaagatgggccatggggtggagcagacagacttgsagtttggaagccagatggaccaagcaaggagcctgactctgagctcaccagctgtgcaattcgggtgagttccttcacccttctgagccatcccttggct

SEQ ID NO: 27364 - DNA, 201 bp, Homo sapiens
tggggacaaatgttacttgtaactgggcacaattaaaaggccacagagatggtgatttccagccccctccagccccgccccacaaacatagcactaaaacsatctttaggaaccaatcaacaagttgtagaatcttccagcacacatcctctccctccctggagatctgccattatgcataaagcaagaagataggcctaa

SEQ ID NO: 27365 - DNA, 201 bp, Homo sapiens
gaggccaaggtgggcggatcacttgagttcaggagttcaagaccagcttggccaacatggtgaatccctgtctctacgaaaaatacaaaaattagccggayatagtggctcacgcctgtaatcccagctattcaggaggctgaggcaggagaatcacttcaacccgggaggcggaggttgcagtgagctgagatcacgcca

SEQ ID NO: 27366 - DNA, 201 bp, Homo sapiens
gttaaggaactcacaagatcagagggcaaaaaagggggaggaccccaatgggcatggtagcctgacttcaagcaggtgtaccccaccatcaggccccccamactaccacaatcaccatgtgactgtggatttgtgatattgtgatataataagaaatacatactgggtcttcatccaggttcctggcacagagctcctaaa

SEQ ID NO: 27367 - DNA, 201 bp, Homo sapiens
agttttcaagctttacgtaatgctacaaaacctcaagtagaacaaaaatctattattaatttttttaattatgggtttgacccactttgtcattaaacaayagtttgtatgactctcatttgttatgctgacaccataaaaaagtaattaaaatctaaacctacatgcaggcatgaaattcaactgatggcctcatgtgac

SEQ ID NO: 27368 - DNA, 201 bp, Homo sapiens
taattttttgtatttttagtagagaaggggtttcaccatgttggccaggctggtcttgaacccttgacctcatgattcacctgccttggcctcccaaagtrctgggattacaggcatgagccaacagtgccagacctactgtctgctttttatacaatgtgaatcattagaaaagcaacaccctctcgccaaccccacccc

SEQ ID NO: 27369 - DNA, 201 bp, Homo sapiens
aaaaaagggggaggaccccaatgggcatggtagcctgacttcaagcaggtgtaccccaccatcaggccccccacactaccacaatcaccatgtgactgtgsatttgtgatattgtgatataataagaaatacatactgggtcttcatccaggttcctggcacagagctcctaaaatccttgaaattggccaggcatggggt

SEQ ID NO: 27370 - DNA, 201 bp, Homo sapiens
gtaattaaaatctaaacctacatgcaggcatgaaattcaactgatggcctcatgtgacaaaaaagtttcagttgagatctaatcaggttcacactgacagyagcccccccttatcctcgggagatgcgttccaagacccacagtgatgcctgaaaactggatagtaccaaaccctatgtattctatgctttcacctataca

SEQ ID NO: 27371 - DNA, 201 bp, Homo sapiens
attacggtctacagcagttgggtgattgctactgaaggcaggcagatgcctggtgacttctcagggtgggctgtccccagtgtgttttatgaccatgcagraaggaaaaataaggaatttaaaaaatcttctttcaaaagatatggattcttatcggactttcattccttagtaaagttgcattaaacccagagacattta

SEQ ID NO: 27372 - DNA, 201 bp, Homo sapiens
tgacttcaagcaggtgtaccccaccatcaggccccccacactaccacaatcaccatgtgactgtggatttgtgatattgtgatataataagaaatacataytgggtcttcatccaggttcctggcacagagctcctaaaatccttgaaattggccaggcatggggtctcatgcctgtaatcctagcacattgggaagctga

SEQ ID NO: 27373 - DNA, 201 bp, Homo sapiens
aaaactggatagtaccaaaccctatgtattctatgctttcacctatacatacatacctaggataaattttaatttataaattaggcacagtaagagatcamcaataataataaaatagaactataacaatgtactgtataaaagttatgtaaatgtggtctctcacactctctctctctcaaaattagtattttcagatgc

SEQ ID NO: 27374 - DNA, 201 bp, Homo sapiens
tgggaggcctaggtgtgtagatcatgagatcaggaggtcgagactatcccagccaacatggtgaaactccgtctgtattaaaaatacaaaaattagctggrcatggtgacgcgtgcctgtagtcccggctactcgggaggctgaggcagaagaattgcttgaacgcaggaggtgaaagttgcagtgagtcgagattgtgcc

SEQ ID NO: 27375 - DNA, 201 bp, Homo sapiens
atgactcgggaggtcgggcacggtggctcatgcctgtaatcccagcactttgggaggcctaggtgtgtagatcatgagatcaggaggtcgagactatcccrgccaacatggtgaaactccgtctgtattaaaaatacaaaaattagctgggcatggtgacgcgtgcctgtagtcccggctactcgggaggctgaggcagaa

SEQ ID NO: 27376 - DNA, 201 bp, Homo sapiens
accgagtttgtggtggtccattatagtagcaacaggacattaatacaccttcccaataattaagtaaacatgtaaggaacatacaagtgagatgcaaacatgtgtacactcgggtaagtcaatcactaacagcgtcgcgatgatgacacaccaacaagactagctttcccaaatccctcccggatcaggccagcaggaaat

SEQ ID NO: 27377 - DNA, 201 bp, Homo sapiens
ctacactgtcagtgggaatggaaattggagcaacaagataagaaatgactcgggaggtcgggcacggtggctcatgcctgtaatcccagcactttgggagkcctaggtgtgtagatcatgagatcaggaggtcgagactatcccagccaacatggtgaaactccgtctgtattaaaaatacaaaaattagctgggcatggt

SEQ ID NO: 27378 - DNA, 201 bp, Homo sapiens
attgcatgacatgcaaccctgttaccggacatccggttcacttcgtaaaccctgaagaagatatttgcagaaacctctccccatatcctaacaacaacaamaaaaaaaagtcaagagctcttattttattctttccattaaggaattaaattactctcttcctccatcttcttccaaccctaatcttccctttaggagtct

SEQ ID NO: 27379 - DNA, 201 bp, Homo sapiens
aatttaatgatgcaaaaacagttgtgctacagcattatcttccaagactggtttaaacatgaatgtcactgtacaatcaggttaccatagtgtcactagcrtccctggaattttacctttctagtttcaaatattacatcaaataggcagagttttacaattttgacacgccctcctgctagtcccaagaacactgcaagc

SEQ ID NO: 27380 - DNA, 201 bp, Homo sapiens
cacgaaagaagggaaaacatgcttacaatcatacatgctaaatattaatagtatacttctaactggtaagaattggggtttttttaaatcttttattcttrtttttatttttcttcgctttctaaattttccataaggaatacatgttaatcacaataacctttaaaataattacttatattaaatgagaaggcacatcaa

SEQ ID NO: 27381 - DNA, 201 bp, Homo sapiens
acctgaagtgaagtagaccagcaaatatcaagggtcaaggagttgggggatgatatagagacgaagcctaacagatgtcaccagagcaagaaggccttacracttcacatcctctctgcagggtatgaatggtgcaatggaatgaaatggtaactacagcttctggtgcaaaatttgagtttccataatcatcatcttggg

SEQ ID NO: 27382 - DNA, 201 bp, Homo sapiens
gaagaattgcttcaacctgggaggcgaaggttgcagtgagccaagaatgcgccactgcactccagcctgggcaacagaggaagacttcatctcaaaaaaamaaaaaaaaaaaacaaaaaaaaaaaaaacaaaacaaaaaacaaagaaaaaaacatagggtcaccaaggcgttcaaaatgaaccttaaacagaggtattaat

SEQ ID NO: 27383 - DNA, 201 bp, Homo sapiens
tgcaaagtatgaacattgatactaaacatggtaaaaagatgggccatggggtggagcagacagacttggagtttggaagccagatggaccaagcaaggagmctgactctgagctcaccagctgtgcaattcgggtgagttccttcacccttctgagccatcccttggctcgtctggaaaatgcaaaaaaaaaaaaaagaaa

SEQ ID NO: 27384 - DNA, 201 bp, Homo sapiens
aacctgggaggcgaaggttgcagtgagccaagaatgcgccactgcactccagcctgggcaacagaggaagacttcatctcaaaaaaacaaaaaaaaaaaamaaaaaaaaaaaaaacaaaacaaaaaacaaagaaaaaaacatagggtcaccaaggcgttcaaaatgaaccttaaacagaggtattaatacttaaatattac

SEQ ID NO: 27385 - DNA, 201 bp, Homo sapiens
taatgcaggactcagacacacctatcgttgtcccagacttagagaactcacatggattcctaacacatagacactgctgctaaataaaagagagtccactscatcttgaaaacaggaaaacatcttattccaccagccacactggcctcttggaatacacaggaaaacgataggtgcttgtcttaagaggtgagggcacca

SEQ ID NO: 27386 - DNA, 201 bp, Homo sapiens
ccccactggggtctttcaagagctctacactggaatgtcgaggtcttgctgtagctgttcatgaagtatgttttgatacctaataagctcttgttctttamatgcaatgcccctcagaggtcctgagatctcaagacagggagtgggatatgccagaccccgagaaataaagcaacagaagcccaactccaatagatactg

SEQ ID NO: 27387 - DNA, 201 bp, Homo sapiens
gaactggggacgatttgcacccccaagagacatctggcaatgcctggagacattttggttgccacaaacatacttgggtcacccctcccatatgagagggkaatagactcaagacacattctgggaagtcaggggtgagtcaaatagtaactctaagggagagccacctgcccctcttcccataccagccctctctgacca

SEQ ID NO: 27388 - DNA, 201 bp, Homo sapiens
aaaaaccacagattttaaaaacaagcaaaggaaccaaatagacaattctccaaagaaaacatacaaatagccaagtgtatgaaaaggggctcactgtcacwaattctcaggaaaatgcaaattgaaaccacagtgagatgtcacctcacacctcttaaggtggttctcatcataaaatgaaagataacaagtgtggttcag

SEQ ID NO: 27389 - DNA, 201 bp, Homo sapiens
ggcagttgggacatagctatcaaatttgaagtggacatgctctttgacccagccacaaccagaaatttatcctacaaatagacttgcaaatatgtgggagkaatattcagtacggcattatctacgacagactgcaatcaaccaaaatgttttatcaattaggttatataaattatattgcatgaataggacaaaatactg

SEQ ID NO: 27390 - DNA, 201 bp, Homo sapiens
ttatatcatactttatttattgaaaatccaatactatacagaaaaacaatttgtaaagcaaagaaatgaggaacaaatctaatggctgatttaggatgcgytcttcccggtaatctacaactattaataatattaatagcttttatctttttgtttagctacagatcgttcagaacaatggagataagccctgtgacttgt

SEQ ID NO: 27391 - DNA, 201 bp, Homo sapiens
taaaatccttgaaattggccaggcatggggtctcatgcctgtaatcctagcacattgggaagctgaggcaagaggatcacttaaacccaagggtttgagaycagcctggacaacacagtgagatcccatctctaaaaaaaaaaaaaaaattgtggagcacagtgccatgcacctgcagtcccagttactcaagaggctgag

SEQ ID NO: 27392 - DNA, 201 bp, Homo sapiens
aaaaaaaaaaaaagaaaaacaccaggtttttgcatcctcctggatgagggatataaagtgcctgacacagcatatgacagggatttgataaatgggggctrttagctgtcccattgtggatgtgagaatagcattctgctggctaaaaggcagacatgaatgttctagaacatggcgatcccggaatgtgcagtgaaggca

SEQ ID NO: 27393 - DNA, 201 bp, Homo sapiens
ctttggaaccctaacagaggattccaacctgcacggcttgccaggcagagggtcttgtcagcagcgggagcctaagcacttgggaggcaagtactccccaraagatcccaacagagattctccttcctagagtaaacagcttatggaagcatgcgcaactagaattgttatctggctcaaagctgcccctaagcacacacc

SEQ ID NO: 27394 - DNA, 201 bp, Homo sapiens
ctgactctgggtcgttagtgtcaaaactgaattgtaggacaccaagctggggtccagaaaattggagaattacgtaaaaggagggaacactccacacattkgtcatgggaagggctctgtatgagagaagaggaagacacagtgtttccttcctttagggttaagagcacacactagaagcagctccttgaggcaggagaa

SEQ ID NO: 27395 - DNA, 201 bp, Homo sapiens
actccacacatttgtcatgggaagggctctgtatgagagaagaggaagacacagtgtttccttcctttagggttaagagcacacactagaagcagctcctkgaggcaggagaaaccagcctggaatgcccccaccaggctcacaccccacagggtcttgactgtcagtcaaatacaaatcatgggatttgccatctattct

SEQ ID NO: 27396 - DNA, 201 bp, Homo sapiens
accagcctggaatgcccccaccaggctcacaccccacagggtcttgactgtcagtcaaatacaaatcatgggatttgccatctattctctgtggatattaygagatataggcttctcatatgtgtacatgcttggcatgtgtataatttaagctaaacctactaagcagctgtccggaaagagggagaagtggtccaaata

SEQ ID NO: 27397 - DNA, 201 bp, Homo sapiens
tgccatctattctctgtggatattacgagatataggcttctcatatgtgtacatgcttggcatgtgtataatttaagctaaacctactaagcagctgtcckgaaagagggagaagtggtccaaataccacctgtttcatcaacagcctaccagtgctcccttcggtgtaatcccatcaaggcacagaattgaggtctcttc

SEQ ID NO: 27398 - DNA, 201 bp, Homo sapiens
ttaatacaagaaagtaacaattgctccataattccaccccctacacgtgctgtctggcccaagttcatgttcttcagagggcaatccttttgttaactaascaatgacacacacaggcatgcgcacacacgtgcacacacacacccatggtctcacttcgtataattctgtactcacactcctatctactaagacaaccaa

SEQ ID NO: 27399 - DNA, 201 bp, Homo sapiens
gtttggccttttttattttgatgaattaatttatagccacttcaagagaagaagggaacccaactctgaatttgtaagcacactatattctattactgaaygtgtctcattgttttcacagctggtacaggatttcctttcaccattgaggcctccgttactctttctcgtctgctcgagacagggttctttatgatttag

SEQ ID NO: 27400 - DNA, 201 bp, Homo sapiens
tttaaaaaagaaaaattaagaaaaaaaaaaagaccttcattccattgccagctctcagaaatgaaaaagccagccccatcctgcactgtccatgtggacartgtgctacctttctaattcaagcacctttttttttttaaaaaaaaaaaaaaaaaaaaaaaggaagaaagaaaaagaaaaattcagattgaccttggctct

SEQ ID NO: 27401 - DNA, 201 bp, Homo sapiens
ttcattccattgccagctctcagaaatgaaaaagccagccccatcctgcactgtccatgtggacaatgtgctacctttctaattcaagcaccttttttttwttaaaaaaaaaaaaaaaaaaaaaaaggaagaaagaaaaagaaaaattcagattgaccttggctctcaccattaaaaaagcgaaaagtggtatattacttt

SEQ ID NO: 27402 - DNA, 201 bp, Homo sapiens
ccggtaatctacaactattaataatattaatagcttttatctttttgtttagctacagatcgttcagaacaatggagataagccctgtgacttgtgatgcrttgacgaatgatcatcttttccaagccaagtcaccagcttagacaggcatgaggctcgtattttacccgccccacataccacatgcctccccccaacaca

SEQ ID NO: 27403 - DNA, 201 bp, Homo sapiens
aacaggaaaacatcttattccaccagccacactggcctcttggaatacacaggaaaacgataggtgcttgtcttaagaggtgagggcaccagtgtataatkcacataaggatgtgaatgaggtagatcacatctgtgtgctgttccacaacataggaacaagccccactgccccgttttctttatttaaatatgaatgggg

SEQ ID NO: 27404 - DNA, 201 bp, Homo sapiens
atcatgggcgttcaccacgttttatttttcttaataaatgagttaaaggaagaaacattctcaaacccctgactaataaagcagatgacactgacaatgarctacaaacaaatgcgtgaataataatggacttgctcatgctttcattcataagacaaacaaagtgaagatgactttaaaaataaagacatgattccaaga

SEQ ID NO: 27405 - DNA, 201 bp, Homo sapiens
agataaaactgtgagtgtgatttatatagacaagagtcttttggcagctagatcaagcagaaataaatattgatattttgttttagagtcaaggagattasaagctggctctgaataaaatacagattgttttacttagcacagccattttgttgttgttataaaagaatagagatggacaaaagtacctaagaaagggct

SEQ ID NO: 27406 - DNA, 201 bp, Homo sapiens
aaatgctgaatcccttccacataattccactcacttcatgcttattctatggtcatttaatgacattctaagagaatgtctccttcccagggaccttgccrtcaagaaagatggagcatataggctttcggttactaagaagagctatcaacccttgtaatccattgcacctagagtgtgtacagggtctcatggtttttc

SEQ ID NO: 27407 - DNA, 201 bp, Homo sapiens
actactatatgagtttccctttgaaagcgcattatttcactgaggaaatagaaccagaaaagaacttccatggcctaccccaaccacatcttcccatcttyctgcagctgtgccagtgcactctgcagtccctcctcgtatcatggaagaatcgtccctgcgcttatctaaagccaaacctgccacctgaacgatgcatcc

SEQ ID NO: 27408 - DNA, 201 bp, Homo sapiens
ttttggcagctagatcaagcagaaataaatattgatattttgttttagagtcaaggagattagaagctggctctgaataaaatacagattgttttacttarcacagccattttgttgttgttataaaagaatagagatggacaaaagtacctaagaaagggcttcttgctataaccacaggttgacggctgtgcaacactc

SEQ ID NO: 27409 - DNA, 201 bp, Homo sapiens; identical to SEQ ID NO: 4649

SEQ ID NO: 27410 - DNA, 201 bp, Homo sapiens; identical to SEQ ID NO: 4650

SEQ ID NO: 27411 - DNA, 201 bp, Homo sapiens
gttcccttcctataacctccccatccctcacacattcacaggtatctatccaagccatggcatcactctgtggggcttgggggcaaggcaactgacactgsacgctggttctcatgcttgccaagcatgaagccctgtgctgctagcagctgtggaacatagccgttagctttaaaagagggtaaaatcacgtcctggaca

SEQ ID NO: 27412 - DNA, 201 bp, Homo sapiens; identical to SEQ ID NO: 4653

SEQ ID NO: 27413 - DNA, 201 bp, Homo sapiens
tctggggcatttggctaccaagggcggtttgaactagctccagcacacagaatacaagtctcttcagaaccaggcaaaaccctatgttgcccaatgactcstgctgtttcttgagatttgcacagaagacagagctgcaattacccacgctgatatctatttcatgaccacatatgttcaaaagccacatgtgagaggtat

SEQ ID NO: 27414 - DNA, 201 bp, Homo sapiens; identical to SEQ ID NO: 4646

SEQ ID NO: 27415 - DNA, 201 bp, Homo sapiens
ttttgtatagccaagtagatacaacctgttacatacatgttatcaaggcaaacaataactgttcctcaagtaagaggtcttgccagcaccgtttgccatayatggttcactctaaatttacctggtaattagggtaaccacttgtgttagctaactggctctacccagaggaaaatcaaatttatctttaagacaaggggt

SEQ ID NO: 27416 - DNA, 201 bp, Homo sapiens
tataggaatagatagtcactgaatttacttgcataggggatggggtataaaatgtttccttatagctccttaacatggaattcagcacccctctccccatmagccttagctctctctgaatcccaagggatatgtgttataaaaatagctgccatcataaatgagaaaaccatcaggacctggtaaaacttggcttcccaa

SEQ ID NO: 27417 - DNA, 201 bp, Homo sapiens
cccttttgtatagccaagtagatacaacctgttacatacatgttatcaaggcaaacaataactgttcctcaagtaagaggtcttgccagcaccgtttgccrtacatggttcactctaaatttacctggtaattagggtaaccacttgtgttagctaactggctctacccagaggaaaatcaaatttatctttaagacaagg

SEQ ID NO: 27418 - DNA, 201 bp, Homo sapiens
ttcaaaagccacatgtgagaggtatggttgaaatgagaggttgtgtttgccaagttgtcttctgactgtggagagctggtgagcctcttctcatctcctgrggctccatattatagagctgacgaatctcttttcttgctccttgaagtctttcattcacttatttattaattcatttaacacatcaggcacctactaact

SEQ ID NO: 27419 - DNA, 201 bp, Homo sapiens; identical to SEQ ID NO: 4655

SEQ ID NO: 27420 - DNA, 201 bp, Homo sapiens
gattgttttacttagcacagccattttgttgttgttataaaagaatagagatggacaaaagtacctaagaaagggcttcttgctataaccacaggttgacrgctgtgcaacactctccagcccggcttccctgtattcacttgtagccacaactacaatttcatactgtttaagttttcattgacaacggcagccaaatat

SEQ ID NO: 27421 - DNA, 201 bp, Homo sapiens
caacaaacctaagaggttatttttttagaggaggaagctaaggctgttgttttgatgcctttttaccactggacttgggactcaactgtttgatagtcatygagtccttgactcttctcccctgccaggatttggcccctaagcccagggcccgagtctcctccatcttcaagggagagtgggaacagcacaggccttggc

SEQ ID NO: 27422 - DNA, 201 bp, Homo sapiens
tatgttgcccaggctggtctcgaactcctggactcaaatgatcttcccactttggcctcccaaggtgctggaattacaggcatgagccacctccaattttstattggcctctaattttctaagtctgatcttttctcctcttagagggagaagatcttttgtcctcttaggggagaagaggaaagagagactttttttctg

SEQ ID NO: 27423 - DNA, 201 bp, Homo sapiens
gatatttaaactttatacaaaatacgcacacatcattcttttccacaaatgacagcatactatgtacatggtacctcacctagcttttttcacttaccagwatatcttagagattgttgcatgacagaatatacagatctgcctgtttttgttgtttttcccaagtttccaagagctagaaactgtttggtttttaagcag

SEQ ID NO: 27424 - DNA, 201 bp, Homo sapiens
ttctatggtgatcacttccttgcttttccctatagtttgactgaatctaaatatcatccctaaacaatatagcttagctttacctatttttgatcttcatrtttggattcatactttttggtttggctcaagactaaacttttaaaatgcatccacgttgtaggagatgtacatgcacaaaaattttcacggcaacattgt

SEQ ID NO: 27425 - DNA, 201 bp, Homo sapiens
ccagagctgtaggggcaggaaagcaaagaacgtattagagctgacccagtcaggacgatcgtctatccccttcctcaccccaccccattccaggaggaagyctgcccggccctaggcagctatggcacagtggcaatgtcaggtatggttctccctagccagagaccctagcctcaaaaaacctccttcttgggatccagg

SEQ ID NO: 27426 - DNA, 201 bp, Homo sapiens
gttgtgaagaatccagagctgtaggggcaggaaagcaaagaacgtattagagctgacccagtcaggacgatcgtctatccccttcctcaccccaccccatyccaggaggaagtctgcccggccctaggcagctatggcacagtggcaatgtcaggtatggttctccctagccagagaccctagcctcaaaaaacctccttc

SEQ ID NO: 27427 - DNA, 201 bp, Homo sapiens
aaaaaaaaaagaaaagaaaaaaaaattaatttttgaaatacttgaggtagaaaacttgaggcagaaaaaaattgagccaaaaaaaaggaaaattgaaccaygtgaaagcaggcaagaaagcttgcattgctcagggcatcccaggcccagagggcgctttggagggagctgggtttcctgagaggaggcagggtgggtgac

SEQ ID NO: 27428 - DNA, 201 bp, Homo sapiens
gaagtggaagtggtgagagcacagtaggaagtgagaaggggcgggccgtgcttaccaggccgtggacttaaaccaggatgagagaacccctggaggcgttkaagttggcagacttggatttcaggaagagctctctggcttctgggtggagaatggccagtggggtaagtggtgagaggaaagacagagaacggagaaggt

SEQ ID NO: 27429 - DNA, 201 bp, Homo sapiens
agagagatgaagacggggatctaaggaataaggctgtaccagagtgagagtacgggggaggggttgaacaagagttcagggaggagagaattcccagcgcwgagccagagactcctttacagaggcccaaggaggcgtggagggagggggaaggctgccaaggctctttctgtctccatgagtgtgtcaagaatgcaaagc

SEQ ID NO: 27430 - DNA, 201 bp, Homo sapiens
tctccctttctcatccacacattggtcaaactagctagcttttggagagattttgggcagtaaaagtaaaacagatctgtctcaagcttcaaaaagcctaragctggctgggcgctgtggctcacgcctgtaatcctagcattttgggaggctgaggcggaaggataatctgaggtcaggagtttgagaccagcctggcta

SEQ ID NO: 27431 - DNA, 201 bp, Homo sapiens
acatttgtcccattccttcctctcatcatgaatatccccagaggcattcagcagtgcagtgaattaaatatagaactttttttttttcagaattgcagaayggattagatcaatattaatccaaacagagcaatgagcctgacagtttagtaaaagctcaataaagggtggcttacctcccccaaaataatctgaaaagaa

SEQ ID NO: 27432 - DNA, 201 bp, Homo sapiens
ttatgctctcaacaaacctaagaggttatttttttagaggaggaagctaaggctgttgttttgatgcctttttaccactggacttgggactcaactgtttratagtcatcgagtccttgactcttctcccctgccaggatttggcccctaagcccagggcccgagtctcctccatcttcaagggagagtgggaacagcaca

SEQ ID NO: 27433 - DNA, 201 bp, Homo sapiens
gctgggcatggtggtgggcgcctgtaatcccagctacttgggaggctgaggcaggagaatcacttgaacccaggaggtggaggtggcagtgagccaagatsgcaccattgcactccagcctgggcgatgagagtgaaactccatgtcaaaaaaaaaaaaagttttctaaagtaaatgctctgagaaaaaaacagaaggtga

SEQ ID NO: 27434 - DNA, 201 bp, Homo sapiens
agctaactggctctacccagaggaaaatcaaatttatctttaagacaaggggtaattttgcagcactgagcaaggctcttcagttaggctcataccttccsacagaaactaggagatagaagcactatctcccttaggtttgtttacatttcaaagagatgacgcccaggtccttgggaaagactagcttagctcataaag

SEQ ID NO: 27435 - DNA, 201 bp, Homo sapiens
ctgagatgaatttagagataaaggcacaattggtccatatctacagggcacttaatccagtgcatctccactagacaaaatttgtatttccatgagcaagrgtcatttgcactgctatctgctataacctacggtgctgtaaaattagctcaggcaataaaagggggaggtagccccaaagagtatgccagaaaggactcc

SEQ ID NO: 27436 - DNA, 201 bp, Homo sapiens
aactggtgggtagacaatgccatgctgttctagatgggctcattgctataggaatagatagtcactgaatttacttgcataggggatggggtataaaatgkttccttatagctccttaacatggaattcagcacccctctccccatcagccttagctctctctgaatcccaagggatatgtgttataaaaatagctgccat

SEQ ID NO: 27437 - DNA, 201 bp, Homo sapiens
tccttttagatattatattcttttgtgtgtggcggggtacatagcgtgtgtatatgtttgtaggttacatgaaatgctttgatacaggcatgtaacgtgtrataatcacatcagaggaaatggggtatgcatcacctcaagcatttatcctttgtgttacacacaatccaatcatactcttttagttatttgtaaaggtaa

SEQ ID NO: 27438 - DNA, 201 bp, Homo sapiens
ccactccacaaaaaaaaaaaaaaaagaaaagaaaaaaaaattaatttttgaaatacttgaggtagaaaacttgaggcagaaaaaaattgagccaaaaaaaaggaaaattgaaccatgtgaaagcaggcaagaaagcttgcattgctcagggcatcccaggcccagagggcgctttggagggagctgggtttcctgagagga

SEQ ID NO: 27439 - DNA, 201 bp, Homo sapiens
ttttactatagtgcccctgttgtgcttgtaaatactaggtcttatttattctaagtattttttgtgcctattaaccacattatatatatatatatatataatttttttttttttttgagatggagtctcgctctttcgcccaggctggagtgcagtggcgctatctcggctcactgcaacctccaccttccggtttcaagc

SEQ ID NO: 27440 - DNA, 201 bp, Homo sapiens
tgagctttgctgtaagttgtggtaaggagggaggcagtgacaaccaggaggcctgttttgagggtttctgagggacccatctgtggtatcacgaggagacscccagaggagccgtgtgaaagggctgcctcccagccggctctggagtgaatgagcagcaagtcctggctgcgaaaagaaggggagtgcagcctgcagaag

SEQ ID NO: 27441 - DNA, 201 bp, Homo sapiens
ttttttactatagtgcccctgttgtgcttgtaaatactaggtcttatttattctaagtattttttgtgcctattaaccacattatatatatatatatatataatttttttttttttttgagatggagtctcgctctttcgcccaggctggagtgcagtggcgctatctcggctcactgcaacctccaccttccggtttcaa

SEQ ID NO: 27442 - DNA, 201 bp, Homo sapiens
gggtacatagcgtgtgtatatgtttgtaggttacatgaaatgctttgatacaggcatgtaacgtgtaataatcacatcagaggaaatggggtatgcatcamctcaagcatttatcctttgtgttacacacaatccaatcatactcttttagttatttgtaaaggtaaattaaattttttttactatagtgcccctgttgtg

SEQ ID NO: 27443 - DNA, 201 bp, Homo sapiens
aacattagcacctgcatcatagggtcactgggggcactacatgagttcatgtacatcgaggacttaggacattgcctcaggcagacctagtgctgcacaaytgcttatgtaattattcccaaatttctccagggcccacagaagaacatggaagtatcttggtttggcaattaaggtgaatcacattctcactctcctttt

SEQ ID NO: 27444 - DNA, 201 bp, Homo sapiens
gatgggagtaaatcctgtctaaaaacaaacaaacaaacaaaaaaaacttagacaatggtttctcagctttttttaatcactccccaacaagtccttttagmtattatattcttttgtgtgtggcggggtacatagcgtgtgtatatgtttgtaggttacatgaaatgctttgatacaggcatgtaacgtgtaataatcaca

SEQ ID NO: 27445 - DNA, 201 bp, Homo sapiens
gggaagctgaggtggaagaatagcttgaacccaggaggcggacctcagcacttctgcctgggtgatgggagtaaatcctgtctaaaaacaaacaaacaaamaaaaaaaacttagacaatggtttctcagctttttttaatcactccccaacaagtccttttagatattatattcttttgtgtgtggcggggtacatagcgt

SEQ ID NO: 27446 - DNA, 201 bp, Homo sapiens
aagtgaaagtaaaaaagagatataatggacaatgtgcctcgcacagggcctggcatggagaagtccttgatgtacgtcttttccttcccttttatgcagcygtttccctcacacccacccattgattgatttttctgaagagactacttttgtcatgtcaccctctaatccccagactttaaactgggaggtagcagagtg

SEQ ID NO: 27447 - DNA, 201 bp, Homo sapiens
gagagggagagtcttggccagatccaagaaaggagccctcagaagaggaggggagtcagaggcaaggaaggggctgaggcagccagcccagctgagtggascccaggagaggtatcaaggggtggtgtggggtggggaggggccagtgtcagaaagtggatggggagcggcctgactctgcttttgtcctgtggccttctg

SEQ ID NO: 27448 - DNA, 201 bp, Homo sapiens
ttgggactcaactgtttgatagtcatcgagtccttgactcttctcccctgccaggatttggcccctaagcccagggcccgagtctcctccatcttcaaggsagagtgggaacagcacaggccttggcctcagtcctgctccccctgcttctagctgtgggatgggccaggtgcttcacccagctgtgcctcctgtgaggca

SEQ ID NO: 27449 - DNA, 201 bp, Homo sapiens
ttttttttttttttttttttggtggtggttggagggaagggttgggtgtgcatttggcctgtgtgaaaaactggtgggtagacaatgccatgctgttctaratgggctcattgctataggaatagatagtcactgaatttacttgcataggggatggggtataaaatgtttccttatagctccttaacatggaattcagca

SEQ ID NO: 27450 - DNA, 201 bp, Homo sapiens
ccagatccaagaaaggagccctcagaagaggaggggagtcagaggcaaggaaggggctgaggcagccagcccagctgagtggaccccaggagaggtatcamggggtggtgtggggtggggaggggccagtgtcagaaagtggatggggagcggcctgactctgcttttgtcctgtggccttctggccaaaggcagggaaag

SEQ ID NO: 27451 - DNA, 201 bp, Homo sapiens
ggagatgtacatgcacaaaaattttcacggcaacattgtccaaactagcaacaaactgaaagccacctatgtgtgcattagcagtagaaatggcaataaaycatggactagtcacacagtggaatcctacgcagcaaggagaattagcagtctacagccaaaccaacagcatgggtgagatgcttccagaaatactgagat

SEQ ID NO: 27452 - DNA, 201 bp, Homo sapiens
aatatgtccaaggggatggaagagtgggaggcaaggggtgatcagatcatttataatacactcaacctggtggaatagtattagaagcattagtaattacrttttagagacatggagaaaagctcatgattttaaactaactgaaaaaagcatgaaaaattgcatctggatgctgttgaggaattattgctaattttttga

SEQ ID NO: 27453 - DNA, 201 bp, Homo sapiens
ctgaggcaggagaatcgcttgaaccccaggggacagaggttgcagtgagctgagatcgcaccactgcactccagcctgggtgacacagcgagactccattwaaaaaaaaaaaaatgcctagagccaaatgctcacagagccatttactgcatggctttgggcaagtcaaaggagtccgcctctcctgtcagaagagtctgt

SEQ ID NO: 27454 - DNA, 201 bp, Homo sapiens; identical to SEQ ID NO: 4652

SEQ ID NO: 27455 - DNA, 201 bp, Homo sapiens
accacctaccttcctagtctttgaggtcaggatattgtgggcttttgttattgggtgacaaaccagctactgactttaagaggcagaaagaaaagacttcygttcttaaaaggagatggtaaggctgccctttagaagagagaaaagaagagggatgaggggatttttaaaacaggacccataacatcccaaaacagttat

SEQ ID NO: 27456 - DNA, 201 bp, Homo sapiens
ctcatgggcagggaagctgagggccccatgagctctcccagcttcctgaaggctccccattaatgagagctgactgtgctgtgctttgctgactgcagggyctgctccctgccccccacctccaggttggggtaagtggcacctctctccctccagctccgcagtcttccctgaggtttagatcttccaggtttataaagt

SEQ ID NO: 27457 - DNA, 201 bp, Homo sapiens
ggtggggacacccatcactgtccagggtgtccccaccatcctcacagcctctctgtctggcctcctgcctttgagccagcccaccacactctcatttctcygcccagcagaaaccaaactgtcctctgcatttactgtctcaactggaagagaaatgcagaatgacaaagaacttgtgaacaagggtcagctccaacagag

SEQ ID NO: 27458 - DNA, 201 bp, Homo sapiens
gaactgattcaagatttagcacagttgattggactttcaacgtatccaccgtcattctggatatacttgtacatagccatctcagcataatgtagagctcwcacctgtaaaataaaagaaagaacaaaatcaaacattagcaactttatttaaatattttgtaaattatctctcggttgcatttcacaaattatctatacg

SEQ ID NO: 27459 - DNA, 201 bp, Homo sapiens
gatgaggataataatagtacctgcggccacacacagtggcttaaacgtgtaatcccagcactttgggaggctgcggcagaaggatcactcaaactcaggarttcaagagcagcctgggtacatggcgaaactctgtctctacaaaaaatacaaaaattagctgggtgtggtgatgtgtgcctgtagttccagctacttggg

SEQ ID NO: 27460 - DNA, 201 bp, Homo sapiens
ccctctgtgcctttgtcttcaaagcccacccactattcactgccacctccatcttggtcaacctggaagactttccccatccttaaaacatcagctcaaayggcagattttttttttttttttgtgatatcctcttgatcaccctcccccagtttttaaggagacagatatagaggttcaatccttgggcttcccatgact

SEQ ID NO: 27461 - DNA, 201 bp, Homo sapiens
gtgctgtctttaataagctcccagtgcctgggactgcactttgaggagaagagctgtgtgtgccccagtgtggtccagtgagtactctgggctccctctcrtgggcagggaagctgagggccccatgagctctcccagcttcctgaaggctccccattaatgagagctgactgtgctgtgctttgctgactgcagggcctg

SEQ ID NO: 27462 - DNA, 201 bp, Homo sapiens; identical to SEQ ID NO: 4647

SEQ ID NO: 27463 - DNA, 201 bp, Homo sapiens
agttcatttattcattttccattattcttccattggtaagttccactttaatggaaacacatgccatatttggtgagagagcagattttttaatttttaawttttaaaaaatgacatatactgtctgcagacagatatttttaagtattgcaaagcaaaagttgaatgatgcctaaaaaatagtttatcctaagtactcct

SEQ ID NO: 27464 - DNA, 201 bp, Homo sapiens
ttgaggcagaaaaaaattgagccaaaaaaaaggaaaattgaaccatgtgaaagcaggcaagaaagcttgcattgctcagggcatcccaggcccagagggcrctttggagggagctgggtttcctgagaggaggcagggtgggtgacggacctgtgctggagagccttgaggaccactgtgggttgggaatgggggcagtgg

SEQ ID NO: 27465 - DNA, 201 bp, Homo sapiens
cagatccaagaaaggagccctcagaagaggaggggagtcagaggcaaggaaggggctgaggcagccagcccagctgagtggaccccaggagaggtatcaargggtggtgtggggtggggaggggccagtgtcagaaagtggatggggagcggcctgactctgcttttgtcctgtggccttctggccaaaggcagggaaagg

SEQ ID NO: 27466 - DNA, 201 bp, Homo sapiens
tcaccagcgttctctgtgttgctaaatcccatggtccataatcaggcctccccttacttgacccattagcagaattaggcaaagtttcttgaagcagcttytccattcagctttggagatgccactctctcggttctccaacaacttcactggatgctcctctgcagtctccttctctggttccttcttgcctccctaacc

SEQ ID NO: 27467 - DNA, 201 bp, Homo sapiens
tgcttttgtcctgtggccttctggccaaaggcagggaaaggtggccaaacactgagaccaagaacaaagaaagaaaactgctggtggacttcttccaccaygagcaggccaccaagcccgcagcactgcactgcagcccccagctctgtcctggggttgggggaggtgaggaggggcaaggtggggagcacacagagcacc

SEQ ID NO: 27468 - DNA, 201 bp, Homo sapiens
ggagtcagaggcaaggaaggggctgaggcagccagcccagctgagtggaccccaggagaggtatcaaggggtggtgtggggtggggaggggccagtgtcaraaagtggatggggagcggcctgactctgcttttgtcctgtggccttctggccaaaggcagggaaaggtggccaaacactgagaccaagaacaaagaaaga

SEQ ID NO: 27469 - DNA, 201 bp, Homo sapiens
attcctagcagcacagcccaggcattccgagaagttgggctctctggcatcactcactctgcccagaagagccaggggaaagttggggcttctagctgaamcttgatcccacctgccctcttgaggggctcagaatctgctggctgcttcacaggtgggattctcacggcacgctggccacagctgatgcttcgaccccct

SEQ ID NO: 27470 - DNA, 201 bp, Homo sapiens
aaagaaccacaagtctgacttctatggtgatcacttccttgcttttccctatagtttgactgaatctaaatatcatccctaaacaatatagcttagctttrcctatttttgatcttcatatttggattcatactttttggtttggctcaagactaaacttttaaaatgcatccacgttgtaggagatgtacatgcacaaaa

SEQ ID NO: 27471 - DNA, 201 bp, Homo sapiens
aaaattgcatctggatgctgttgaggaattattgctaattttttgagatgagaaattgtattaaagtctttttcaaaaaagagtccttaacttttagagaygcacacaagtgtttatgggtgaaattaaataattcagtagagacattaagtgggaaatagaggaaatattgaccatgggttgctaatagttgaagccagg

SEQ ID NO: 27472 - DNA, 201 bp, Homo sapiens; identical to SEQ ID NO: 4651

SEQ ID NO: 27473 - DNA, 201 bp, Homo sapiens
gtttcctgagaggaggcagggtgggtgacggacctgtgctggagagccttgaggaccactgtgggttgggaatgggggcagtggattggggttcaaaaccsctgggaatgagaaatgggctcaggaaggctagggtggattctttcatcttcctctttgcttggctttattttcacaaaggaaggcagggcaggaaatagt

SEQ ID NO: 27474 - DNA, 201 bp, Homo sapiens
cactctgtggggcttgggggcaaggcaactgacactggacgctggttctcatgcttgccaagcatgaagccctgtgctgctagcagctgtggaacatagcygttagctttaaaagagggtaaaatcacgtcctggacaggacagccaggtgagttgggaagggaagagagcctgccacgggcacaggcatgttgggggaag

SEQ ID NO: 27475 - DNA, 201 bp, Homo sapiens
ccaccttccggtttcaagcgattctcctgcctcagcctcccaagtagttgggattacaggcacccgccaccacgcctggctaatttttatatttttagtaragacagggtttcaccattttggccaggctggtcttgaacccctgatctcgtgatccacccacgttggcctcccaaagtgctggaattacaggcgtgagcc

SEQ ID NO: 27476 - DNA, 201 bp, Homo sapiens
gagaaatgcagaatgacaaagaacttgtgaacaagggtcagctccaacagagagtgaagccaaaggggctgggcagaaagagagatgaagacggggatctraggaataaggctgtaccagagtgagagtacgggggaggggttgaacaagagttcagggaggagagaattcccagcgctgagccagagactcctttacaga

SEQ ID NO: 27477 - DNA, 201 bp, Homo sapiens
ggaagagaaatgcagaatgacaaagaacttgtgaacaagggtcagctccaacagagagtgaagccaaaggggctgggcagaaagagagatgaagacggggrtctaaggaataaggctgtaccagagtgagagtacgggggaggggttgaacaagagttcagggaggagagaattcccagcgctgagccagagactccttta

SEQ ID NO: 27478 - DNA, 201 bp, Homo sapiens
tttaacgttatattatctgtacagcgaggacagaaaaggctgttttaaagctgtttgtgagagacaactattattttccttattttttaaagcagactctmcataatatcagcaaacaatataaagacattttggcaattaatttgaattacctgtgtatttcaaagggctaaaatgggcatgttttaaaattcaagattg

SEQ ID NO: 27479 - DNA, 201 bp, Homo sapiens
ttctcttaaggggcctgggtctactattttcagttctacttcgagagaagtggcctgcaatatcctgcagatttcccctccagggagaaaagcattgtgcrgtgcaaggagcacaggctttgtggaaagaggcatctggggttgagatcctggctcttttgcttccttgaacaagttaaccaaatctctgggcctctgctg

SEQ ID NO: 27480 - DNA, 201 bp, Homo sapiens
tctggcagcttatttttcaatatctggccaatgatacagactcatgagttctgatactttattgccctagttatttaacgttatattatctgtacagcgargacagaaaaggctgttttaaagctgtttgtgagagacaactattattttccttattttttaaagcagactctccataatatcagcaaacaatataaagac

SEQ ID NO: 27481 - DNA, 201 bp, Homo sapiens
tctagatgggctcattgctataggaatagatagtcactgaatttacttgcataggggatggggtataaaatgtttccttatagctccttaacatggaattmagcacccctctccccatcagccttagctctctctgaatcccaagggatatgtgttataaaaatagctgccatcataaatgagaaaaccatcaggacctgg

SEQ ID NO: 27482 - DNA, 201 bp, Homo sapiens
gaacatgtattaagtgcttgctgtatgtgacacactgtgccaggtgctccccttaaaacagttctgtgggcaggcatgagaatgaatcccgatcttacagrcaaggaatgttaggctcagaggtttcaagctcacccatcactcagccagagaggacagatgcaggattcaatctcgggagtgcccgagtccacagaagtt

SEQ ID NO: 27483 - DNA, 201 bp, Homo sapiens
caggcgtgagccaccgcgcccggcccaattatagtcttatattaaacagtatccactgcagctcccaaatatccataagatcacctgttattagtctcttygtgtcagtgaacctgctgcatttgtgtcagcaagtgcaaggctgcctctggacgtgttcctcacctctgcactgtactataagccccttggcttttgttt

SEQ ID NO: 27484 - DNA, 201 bp, Homo sapiens
ttgagacggagtctcgctctgtcgcccaggccggactgcggactgcagtggcgcaatctcggctcactgcaagctccgcttcccgggttcacgccattctmctgcctcagcctcccgagtagctgggactacaggcgcccgccaccgcgcccggctaattttttgtattttttagtagagacggggtttcaccttgttagc

SEQ ID NO: 27485 - DNA, 201 bp, Homo sapiens; identical to SEQ ID NO: 4648

SEQ ID NO: 27486 - DNA, 201 bp, Homo sapiens
tgtttgcatcttgtacttttgaaacaagtttcagttcaggtaaaggattacttaatcctctaaaggatgaaaaagtgtagctgaggtgtctaaaattcttsattcaagtttgtccaactgagagagtttatcaggagctaatttggctcacactggacccagaatcccaccccccaacttcatttgtggtccaattatagt

SEQ ID NO: 27487 - DNA, 201 bp, Homo sapiens
agcccagcagactaacggagccccatcctccatcttgaatcagtcagcccctctatgactgcagagtcctgaatgatggcaacaccttctcttcacttagsgttgtaggatgaccaacagtcctgatttgcctgggactgaggggttcccaatagatgggactttcagggctaaaaccaggaaagtcctgggcagcccaaa

SEQ ID NO: 27488 - DNA, 201 bp, Homo sapiens
cccgctgtcctcggaacaccacagcgactagaggtaagggagcaccggatgtggctgggatgtgggcagcaaggggccagaggggccttgaaggggtcacrgaccatttaatgaaggtgtattgaaggccaccatgggccaggccctagttagggatggatcagaattatatagcatatgccaggggtcaggcaggtaatg

SEQ ID NO: 27489 - DNA, 201 bp, Homo sapiens
caggaggccctatcttaggctcagctcccaaaccttgaacatcttggaggatccacaaataggaggtacactcagctcaggctcagtcttccttaaaaagygccttgctaaagctatcaagttcactggaatacttctgcgaaggacacagcttcagcgatgtcagattttttatgtaaatggtgccttcacatgctctgg

SEQ ID NO: 27490 - DNA, 201 bp, Homo sapiens
aaaccaattagacctctggcaggcctttgaccaccctgagggccacccccaaggcacggccacactcgcatctgctgccaggaggccctatcttaggctcmgctcccaaaccttgaacatcttggaggatccacaaataggaggtacactcagctcaggctcagtcttccttaaaaagcgccttgctaaagctatcaagtt

SEQ ID NO: 27491 - DNA, 201 bp, Homo sapiens
aagtccttgatgtacgtcttttccttcccttttatgcagccgtttccctcacacccacccattgattgatttttctgaagagactacttttgtcatgtcaycctctaatccccagactttaaactgggaggtagcagagtggtctgattaagaccttagacaagggtttcttgtctgggcgcagtggctcacgcctgtaat

SEQ ID NO: 27492 - DNA, 201 bp, Homo sapiens
tgaaatgttactgcaggttccatcaccaagtgtattgaccgagtgaaatgactcagcactgcttgctggacaccaaacactccctcctggccaaacggtcrcttgaggacctaccacctgctctaccaactacatctgcacgacagtaaacagcaaaataaataccttctacagccacatatagattaggtcttcattacc

SEQ ID NO: 27493 - DNA, 201 bp, Homo sapiens
gacgcccagaggagccgtgtgaaagggctgcctcccagccggctctggagtgaatgagcagcaagtcctggctgcgaaaagaaggggagtgcagcctgcaraagtgtcttcttttttcaattcctgctcagaaggaaacaggagataagaatagtggggaagtccaaaccaaagtgaactatagggctggtaatcgtaggg

SEQ ID NO: 27494 - DNA, 201 bp, Homo sapiens
aaagaggtggcattccaggctgaggaaacagcatgtataaaggaagtgtgtgagagccacaatgtgagaaaactctgtgcgaatattaaaaggcgttagargcggagtgggtggtaggaactttctgagctgagctgttagctgtgggctgagctaaaacaaccaatggagggggtgctggttctcctcagggtgtttacg

SEQ ID NO: 27495 - DNA, 201 bp, Homo sapiens
actacgtgacttctgacctgcgtctttaagggacaggggttctccaggtaaagaaagaggtggcattccaggctgaggaaacagcatgtataaaggaagtrtgtgagagccacaatgtgagaaaactctgtgcgaatattaaaaggcgttagaagcggagtgggtggtaggaactttctgagctgagctgttagctgtggg

SEQ ID NO: 27496 - DNA, 201 bp, Homo sapiens
ttatctttgcatacacacatatgaaagtcatatattacacaacctttactgagtcgtattatatacaaaacatgaacgcagatccagagctattccaaagrcaatgagaccaagcctcttccctcaataatttaaatgcagaagagaagtgaaggaataatcacgctttgcattaggtggtagcagaggagtactacgtga

SEQ ID NO: 27497 - DNA, 201 bp, Homo sapiens
attacaggcatgagccacctccaattttctattggcctctaattttctaagtctgatcttttctcctcttagagggagaagatcttttgtcctcttagggkagaagaggaaagagagactttttttctgcttctgaaatctcccagcatattgctttcgacttgtcaatggcaacacagcctttggatgctcacttgaccc

SEQ ID NO: 27498 - DNA, 201 bp, Homo sapiens
tgagtcaaagggcatgggaacacattatctttgcatacacacatatgaaagtcatatattacacaacctttactgagtcgtattatatacaaaacatgaaygcagatccagagctattccaaaggcaatgagaccaagcctcttccctcaataatttaaatgcagaagagaagtgaaggaataatcacgctttgcattagg

SEQ ID NO: 27499 - DNA, 201 bp, Homo sapiens
atgcattttcctgtagcgagatcccttctccgtcttccaccacccactgctttggctcccctcttgctgttccctgcctgcatctgggcaggaagttccamtcctgacttgaccctttttcagctgtgtggcctaggactcattgctcttttctccccatttcatcatctgaaaatggaaaaaataatacctgactagaaa

SEQ ID NO: 27500 - DNA, 201 bp, Homo sapiens
ttaaaaggcgttagaagcggagtgggtggtaggaactttctgagctgagctgttagctgtgggctgagctaaaacaaccaatggagggggtgctggttctyctcagggtgtttacggggtttcttcgttattacctgatcctcattccaactgttgaaccataagacttttaattaaagtttaacctattcctggacttct

SEQ ID NO: 27501 - DNA, 201 bp, Homo sapiens
gtggtgtggggtggggaggggccagtgtcagaaagtggatggggagcggcctgactctgcttttgtcctgtggccttctggccaaaggcagggaaaggtgrccaaacactgagaccaagaacaaagaaagaaaactgctggtggacttcttccaccacgagcaggccaccaagcccgcagcactgcactgcagcccccagc

SEQ ID NO: 27502 - DNA, 201 bp, Homo sapiens
tgaacctgctgcatttgtgtcagcaagtgcaaggctgcctctggacgtgttcctcacctctgcactgtactataagccccttggcttttgtttttggaatraccctttgaaataagtaaaatcctgaaagcaatagtttaggaaatctacctgtcacttctgtagtcatacaatgccacatgtaaggttatcttgtaggtg

SEQ ID NO: 27503 - DNA, 201 bp, Homo sapiens
gtatccactgcagctcccaaatatccataagatcacctgttattagtctcttcgtgtcagtgaacctgctgcatttgtgtcagcaagtgcaaggctgcctstggacgtgttcctcacctctgcactgtactataagccccttggcttttgtttttggaatgaccctttgaaataagtaaaatcctgaaagcaatagtttag

SEQ ID NO: 27504 - DNA, 201 bp, Homo sapiens
agatgggctcattgctataggaatagatagtcactgaatttacttgcataggggatggggtataaaatgtttccttatagctccttaacatggaattcagmacccctctccccatcagccttagctctctctgaatcccaagggatatgtgttataaaaatagctgccatcataaatgagaaaaccatcaggacctggtaa

SEQ ID NO: 27505 - DNA, 201 bp, Homo sapiens
ctcattgctataggaatagatagtcactgaatttacttgcataggggatggggtataaaatgtttccttatagctccttaacatggaattcagcacccctytccccatcagccttagctctctctgaatcccaagggatatgtgttataaaaatagctgccatcataaatgagaaaaccatcaggacctggtaaaacttgg

SEQ ID NO: 27506 - DNA, 201 bp, Homo sapiens
gagtcttagcaaatttagaaatatccagtttctcttcaatatactcttcatccacaggagggccaagggccaagtcgttttctgagggatgtgtggcatcrtgcttctatttccgttacattacagcagttgttaggcaacagggagtgttcctccagacacacccggggcagcgctggcaaccgcaaaacatgctcagca

SEQ ID NO: 27507 - DNA, 201 bp, Homo sapiens
agctgaaccttgatcccacctgccctcttgaggggctcagaatctgctggctgcttcacaggtgggattctcacggcacgctggccacagctgatgcttcraccccctcatcttgtttggccaaagtgcagctttttagcttgtgagtaaggaagaaaagctgtatcatatgtctttaaacatcttcctagaccacctttg

SEQ ID NO: 27508 - DNA, 201 bp, Homo sapiens; identical to SEQ ID NO: 4654

SEQ ID NO: 27509 - DNA, 201 bp, Homo sapiens
gctctgtcctggggttgggggaggtgaggaggggcaaggtggggagcacacagagcacccgctgtcctcggaacaccacagcgactagaggtaagggagcwccggatgtggctgggatgtgggcagcaaggggccagaggggccttgaaggggtcacggaccatttaatgaaggtgtattgaaggccaccatgggccaggc

SEQ ID NO: 27510 - DNA, 201 bp, Homo sapiens
aatttgcatttctttgaatactaggtaagattgttcatttttcaaggcgtttgttttaaattatttgtacatttttctgattctaaaagaaagatactcaktatagaaaacatgaaaaatatacaatttaaaattaaaaatgtttaattacacaatattcaacctcccagagataactgtggtttaacactgaagttattt

SEQ ID NO: 27511 - DNA, 201 bp, Homo sapiens
tctacccagaggaaaatcaaatttatctttaagacaaggggtaattttgcagcactgagcaaggctcttcagttaggctcataccttcccacagaaactargagatagaagcactatctcccttaggtttgtttacatttcaaagagatgacgcccaggtccttgggaaagactagcttagctcataaagctgacaaaaag

SEQ ID NO: 27512 - DNA, 201 bp, Homo sapiens
attcccacaaagctttattcacaccaagtctccagtccttgcctgcattgtgtgatgggtgcctgcagtgatgggtggggacacccatcactgtccagggygtccccaccatcctcacagcctctctgtctggcctcctgcctttgagccagcccaccacactctcatttctctgcccagcagaaaccaaactgtcctctg

SEQ ID NO: 27513 - DNA, 201 bp, Homo sapiens
gttttatttctaacaatttacatatctctagatgcatatatatctatatacatactaataggtaacatctatgaagtgctcactctgcttgtcaaacactrttccaagcactttacatgcattattccttatcatcctcactacaacccagtgatgtagttgcaggtattatttccattttacagattaggaaactgaggg

SEQ ID NO: 27514 - DNA, 201 bp, Homo sapiens
tgaaggagatcctgctaaaaagctatcctaagtagaatcaaataatgtacttgtcatgagcccttatttttctattttaatttaaacactgtatttgaaakgtaccaaaatagtttttgaaatgtaatgtgttagtaaactgtttagcaaaataaatcctcccaactaattagaaacgtaagacaataaagacgaaagatc

SEQ ID NO: 27515 - DNA, 201 bp, Homo sapiens
agcctaacaaaaggaacctttgaattgctattgattctttatcacgagtacaaaataattcaaatcagaaatggaaccacagataagccagaaaagatgtraacaacaaaatgtatttctatcaaaattatgacaatctgattttataatgaggaatcatgtcaagtactttttctattcttcaaatactcatttctctag

SEQ ID NO: 27516 - DNA, 201 bp, Homo sapiens
gcacctacaaatgtgagagatgacccgtctctctagccagtggaaccaggaaaagagctttctgtcatctgaagaatagtaataggagattgtttttgttmtctctttatctgcttcgctcttacgggcaaacagaactgtgtggtggagcagaggctgagagaaaaatactgtctggctaggtgaccagaaaaaggggcc

SEQ ID NO: 27517 - DNA, 201 bp, Homo sapiens
caagcttgatgggtgactccttacgatagcatttgcaaaagagctttcataattcagtaccttaaattttgccctactacataagcaggaaaatgaatgcrttaggagaggttttatatcttatatctacatttgcataggaaatagaataatatctcacaggtccattcatcctataacgcatcaggaagttaagtcatc

SEQ ID NO: 27518 - DNA, 201 bp, Homo sapiens
gacttcacttttgcaactggcaaaataattggacacatgctcaaattaaagggagacatagattcaaatgcagctattgatcttagcaacaaagcttcatyagcattcttacaaaagcatttaggtaagaaactatttttttcatgacctaaaccagatgaatctcaggacaaagctgtctatcttaatacagctttagta

SEQ ID NO: 27519 - DNA, 201 bp, Homo sapiens; identical to SEQ ID NO: 4670

SEQ ID NO: 27520 - DNA, 201 bp, Homo sapiens
gatttggactaagctatacctatgtgcaaagctggggcctgtgtcattatggtagcaagtaatagtcactaatcagatttccagtttataactgaccaacsatttttcccaaatacagcttctacctaaactttaaaataagtgttataactttttactttgtcatttccttcttctaataattatattaggtacggcaaa

SEQ ID NO: 27521 - DNA, 201 bp, Homo sapiens
gaacaattttggcttccaggaataaatgacaatttttttattcaagaaagaaatagcagagtttggaatgtcatgcaggcccttgtctggaggagttgggkttcctcaataattggctgtgggtctattgatcagtcctagacctgtctggtcaagtagttttttccctactatcagctcattgggattagcctcacagca

SEQ ID NO: 27522 - DNA, 201 bp, Homo sapiens
ctggaatatgtttgagacacaacttctctaaaagtgcattaatttctttcttaacagggcaccttcttgcgtttatattatccatcccaagataatgatcrccttgacaccctttggatcccaaataaagaatatttttggggtcttagcaaatttcttggaacacactggcttatgggcaacattttgaggttactcttt

SEQ ID NO: 27523 - DNA, 201 bp, Homo sapiens
cacatacacactggtcttacctcctccctgacctcctaatagagatacgtctctatattcagccctgcattgctctctcctctgtacacccagaccatttygtcctgtcaactacagacagtatcttttgactgtcacttcctaaaatgagaaccttagtaccccacccttctctccaccttactcctgctcctacccctt

SEQ ID NO: 27524 - DNA, 201 bp, Homo sapiens
cagcatccctgactgctactcactagatgccagtagcagccccctcctggttgtggcaaccaaaaatatctccagacattaataagtgtcttcttgggggscaaaaatgccttagttgagagacactgctgtagagtgatgttctagctgcattctccagccttcatcctattgtaaaatatccaaagaagattttatctt

SEQ ID NO: 27525 - DNA, 201 bp, Homo sapiens
tgccatggtgaagtcttttcacaaagttctaatcttgaaaagttttaaatatgtatttcatacaatcatgagcatagttcaaataagtagcactgaagtayaaaaaagaaaagcaagagtccccacctcagcccaccccaaccccaacgtcaacctcagtctcaatctcattgccattctccaaattcttaatggtttctg

SEQ ID NO: 27526 - DNA, 201 bp, Homo sapiens
gtaagaacttaactgaagtcaccaaactagtaagtagcagattcaagattcaaaccttggcagccagaaactggagctaaatttctaaaccactttattaytctgatacaggtaagttttctcaagaagtatacccatgaccttaacctaaccatcatgtagccatttatgcatacaacactcaacagatccagttactct

SEQ ID NO: 27527 - DNA, 201 bp, Homo sapiens
ctcgtggcaatcagccctacgagaagcacccttctgcaccgaagtaaatttgctttgctaaaaaatcctttgtttgctcacttttctttaagactccgagytttatttctaacaatttacatatctctagatgcatatatatctatatacatactaataggtaacatctatgaagtgctcactctgcttgtcaaacactgt

SEQ ID NO: 27528 - DNA, 201 bp, Homo sapiens
gacacaggggcaggagtcatcttaggaataaaagcttctactctcctttgttcggtgtgctctcgtggcaatcagccctacgagaagcacccttctgcacygaagtaaatttgctttgctaaaaaatcctttgtttgctcacttttctttaagactccgagttttatttctaacaatttacatatctctagatgcatatat

SEQ ID NO: 27529 - DNA, 201 bp, Homo sapiens
ttcctgatacccaagaagatggctatttcctggaaaggaaggtggatattggattatttacactctgattcctcttaagcctaattttttttcaagattcrtgataataagcctgactgacgtctcaagatgttgagaaatttccataaaataaaagcattgaagagaaagtactgagtgaagggaaattgaagagaaaca

SEQ ID NO: 27530 - DNA, 201 bp, Homo sapiens
ttgtcatttccagggagaaatgacaccagcacagtggcaggccttccaatctggagcacggtccacacaacttccgaattggtgttcagtgtaaagtgtaycggagtgcggaaaatgcgcagggcattgccaactatagatgctcggagtaattcagtgtattcagagaacacggtgaaacaaggaaaaccggcctgactg

SEQ ID NO: 27531 - DNA, 201 bp, Homo sapiens
agactgaattaaagtccatccctcacttttggagaggtaattttgccataagaatgtaaaatgtattcaggggtaaaggatacccatggaggtggaagaaygagttagaagacaaaaatatgcatatactctaactcagaaaattcatttctgggtatttctcacacataattaaaaacatgcacaaagatttaattgcaa

SEQ ID NO: 27532 - DNA, 201 bp, Homo sapiens
ggaaagtagactgaattaaagtccatccctcacttttggagaggtaattttgccataagaatgtaaaatgtattcaggggtaaaggatacccatggaggtrgaagaatgagttagaagacaaaaatatgcatatactctaactcagaaaattcatttctgggtatttctcacacataattaaaaacatgcacaaagattta

SEQ ID NO: 27533 - DNA, 201 bp, Homo sapiens
gggagggtgctgggtgcgctcgagcaggctagcgtcgggagccgccgctgctagtgagaggccggggccacacacgctcctccccggtacctcctccagcwtcaccaggggaggagagggtcggggccacaaggccgcgctaggcggacccaggacacagcccgcgcgcagcccacccgcccgccgcctgccagagctgct

SEQ ID NO: 27534 - DNA, 201 bp, Homo sapiens
gttttcaggagctgttctcaaagcttaccacctttttagtgtgggattaggtcttcaacttcaactttgtcttcacctttgtcttaaggtcaaaagaagaygttagagatgtctttggtagggcataatgtatccttttagattgatatttgtgggccatttgttttacagggggttagtccaggaagtacaagacaatgt

SEQ ID NO: 27535 - DNA, 201 bp, Homo sapiens
tttaggggttcagtccaccagaattttgctgacttcacttttgcaactggcaaaataattggacacatgctcaaattaaagggagacatagattcaaatgyagctattgatcttagcaacaaagcttcattagcattcttacaaaagcatttaggtaagaaactatttttttcatgacctaaaccagatgaatctcaggac

SEQ ID NO: 27536 - DNA, 201 bp, Homo sapiens
catataaagaaaatgattatataaaattccaggtctgctactttacaaagttaatcatatccctttcccacattgaagtatgatacctctttattccaatsagataacccataataaactggtatggtgcgtgtccaccaatcctagcattattaggatgtcctcaatgttggctagtatgtaaccagtttaatttcatca

SEQ ID NO: 27537 - DNA, 201 bp, Homo sapiens
tcttgtcctacagttctttattgttttttgtcatttaattttctgctatattgcaaggtacaatatgataaagggctgcaaccagccccctccccaatgcrcacacacagacacacaaagcagtacaggtaaagtattgcagcaatgaagaatgcattatcttggactagatatgaaattgccaaaagttagtcagttttg

SEQ ID NO: 27538 - DNA, 201 bp, Homo sapiens
aggaagggaaggagcatgcataaataataattttgcttgtattatagagatagatctgcatctgcaacttactatttcaaggaccaatctgctgcagaaayaggggacaagtcttggctctaccttagaaccctgaaacaagaggaggagacacatatacgaaatgagcaggtacattgcagtgaaaggagaggtggttgg

SEQ ID NO: 27539 - DNA, 201 bp, Homo sapiens
catcaaactctccagatccaaaacaaaggagtcaaagctaatgcctttcttgtcatacatgaagagactctactctcattcccatcacctacccccatcgmtaagacaatctgatgtgtattcttcacttactgtctacattctgctaatatagacttttccttccttatctgtttgactagacactactgttggactgat

SEQ ID NO: 27540 - DNA, 201 bp, Homo sapiens
acagccatctttagacggctacatttaatgtcactaagagagaccttaattggaaaaagattgtttctggagctttgcaaattcctgctcatcccagaggrttgtgatgcataaacttctctttccagtctcctatggagagcagtgtaggtggcttctgaatggtgtcatactgactatacctacagagctgtgcacctg

SEQ ID NO: 27541 - DNA, 201 bp, Homo sapiens
tgtgtcatgttttgtactaagaacttgacctacattctcacctcatctttacaactgtactgtgggctggtcaagtgcttttatgtcattttacgaatgtrgatcagagaggggagcaactaggccagaggattatagcttgtaagaggtacacctgaaatctgaaatagaaccatgtccctccaattcacagggtttgtt

SEQ ID NO: 27542 - DNA, 201 bp, Homo sapiens
ctcacaagcggaggcttgtgttgggtgaaaccctcccatgcctccagaactgagcctccaattctagaggtagtgtctccaacagcagctgtggccctggrgctccttagcgagttgtgtgagccagaggtctccctgcagcaagccctgcacaggcacaccatgcctgcctaggggtggggttgcagtagcaccaggctg

SEQ ID NO: 27543 - DNA, 201 bp, Homo sapiens
cactcattctttcttgccttgtggtaagtggggaaagaaagaggtggaaggcatagactaacccaggaggagtggccaaaacgggacagccatctttagayggctacatttaatgtcactaagagagaccttaattggaaaaagattgtttctggagctttgcaaattcctgctcatcccagagggttgtgatgcataaac

SEQ ID NO: 27544 - DNA, 201 bp, Homo sapiens
gtatgaggaaaaggttgtgcaaatgaagctgtggaagagggcataaatgcagtgcttagcacatgatttttcaactatttcacccagtccaatcatttaartaatagctaacatgtgttaagtatttacctgtttctaatataagtactgaaaatgtattaattcaattgatcctcactgatgaggtagcatactattata

SEQ ID NO: 27545 - DNA, 201 bp, Homo sapiens; identical to SEQ ID NO: 4675

SEQ ID NO: 27546 - DNA, 201 bp, Homo sapiens
tcagccactcattttacagttgagaaatcccttctgaggtgtggaagggcttgcttagcaccgcaggacttttccctcagacagaacctgggacagctggktcctcatttcctctccattgtgtctctgtcccctttgcacttttgttgtgaggaacatacatgggcctaaacacattccctcactctcacctttgcacat

SEQ ID NO: 27547 - DNA, 201 bp, Homo sapiens
aaatgagacagttgagctagagggtcagcgatatattgtggagatcattctaagctaaaaactaatgttagcaatagaggtttggggctgggcgtggtggytcacgcctgtaaacccagcactttgggaggctgaggtgggcggatcacgaggtcaggagatcaagaccattctggccaacgtggtgaaaccccgtctcta

SEQ ID NO: 27548 - DNA, 201 bp, Homo sapiens
ttagtgtcagtgggacaccggatcattaaacttggctcggtttgtattagtaaccagatgtgctagatttattcactcagcaggcatttactgagtgcctstgtacaccaggcactattctaggtcttgggaatacagcagggggaaaaaccatcaaaaatccttacactcacagaactaagtttttagtggaaggtgata

SEQ ID NO: 27549 - DNA, 201 bp, Homo sapiens
ttcttttttcttttaatcatctgcttcgaaggagactaagctgaaactgctgctcagctcccaagatggtgccacccaaattgcatgtgcttttctgcctstgcggctgcctggctgtggtttatccttttgactggcaatacataaatcctgttgcccatatgaaatcatcaggtaagaggtgtatttgttcaaggtctt

SEQ ID NO: 27550 - DNA, 201 bp, Homo sapiens; identical to SEQ ID NO: 4669

SEQ ID NO: 27551 - DNA, 201 bp, Homo sapiens
cctgctattaaaatctccccctactcccataagttttccctcattattcttgtttacccaaggggttaacacttttcactgaaaaatttatctttatatawttttttgtgacataatgattgtgataataatattgtcatcttaacagtattgccagacttctccagtgggcaggacattttttaattaggtttttccccc

SEQ ID NO: 27552 - DNA, 201 bp, Homo sapiens
cttgaacccgggaggcagagtttgcagtgagccgagattgtgccattgcactccagcctgggcaacaagagcaaaactccatctcaaaaaaaaaaaaaaaacttacagttcagctctttggttggtgggtatctagtagcagtctttttaatgaatctactattcatccataaaaaagtagatataaatcagatgggtctg

SEQ ID NO: 27553 - DNA, 201 bp, Homo sapiens
ctccagcctgggctacagagcgagactctgtctcaaaacaaacaaaaaaagaatgcatatatattggtttaaagtattagaaacagtttattaaataagaytaaaataataggtgattctttataatttcttactaaatgaatacacagaaaatatggctatgcaggttaaaaggtttgtaggaatgggctagagatatcc

SEQ ID NO: 27554 - DNA, 201 bp, Homo sapiens
ctcaaaacctgcttccatgaggtgaaaaagaagcaggtgtcttgttcaacaggcatactcctggttaatagtggaaagtcatgtgagataacaatttcagktcttgggatccaaaaggaaacaatctttcctacctgataatagagagaagtagggacaagtaggtgctagggagttccagatgagaatggatgtgatcac

SEQ ID NO: 27555 - DNA, 201 bp, Homo sapiens
gagaataggatgattcccaggtttctggcttgtggtgcaggagatgaggagttcttgagttgcaggctgtgtggttggaaagtgagaagggagagttgaargatgatcatttagtttcattttggaaactagtttcattttgacattcttatgggaaggacatcaggtagagatgctcaaggagaagttataggcacaaat

SEQ ID NO: 27556 - DNA, 201 bp, Homo sapiens
ctgactggggggtgaattcagcagggagtaaatctgatcggcatcaggtctgcggaaaggagctggtgagcacgacaccacccaggcattgcctggctctstccgcggcgggctaagttaaccgcgggtccaggtgcgggccatggtcttggggagggtgctgggtgcgctcgagcaggctagcgtcgggagccgccgctg

SEQ ID NO: 27557 - DNA, 201 bp, Homo sapiens
aaaatctgttagcaagtcattatttgcgaagagataactcaatttacctttttctgttatgtttggatttttgaaatcatgtattaactttataatataaytaaatataatactgaaataagatcaaataaaatcaaccaaaattataaataatcttaaagagttgcacatatataccttttttttctgatcaaaagaaag

SEQ ID NO: 27558 - DNA, 201 bp, Homo sapiens
tccgttgaatgtagggtggttggtgagaaagaggtaggagaataggatgattcccaggtttctggcttgtggtgcaggagatgaggagttcttgagttgcmggctgtgtggttggaaagtgagaagggagagttgaaggatgatcatttagtttcattttggaaactagtttcattttgacattcttatgggaaggacatc

SEQ ID NO: 27559 - DNA, 201 bp, Homo sapiens
ataagtgtcttcttggggggcaaaaatgccttagttgagagacactgctgtagagtgatgttctagctgcattctccagccttcatcctattgtaaaatayccaaagaagattttatcttcttcagcaatcatttggtgtggtaatgggtcagttttgaggtatttaagccactttctttgactttagttgaaactgaatt

SEQ ID NO: 27560 - DNA, 201 bp, Homo sapiens
gtgtttgaaatctgtttcctctaaggcttaaatctaaagtgatttaaatttaaagtgactagcatcaaatacataccacgttcagtggtgagggcaggtascaggctctggctctgagttcagggacccttcaatacagaacacattccagtattcaaactggaagtattccaattcactaaaaagcaagaatcatttctt

SEQ ID NO: 27561 - DNA, 201 bp, Homo sapiens
aaaccactttattattctgatacaggtaagttttctcaagaagtatacccatgaccttaacctaaccatcatgtagccatttatgcatacaacactcaacmgatccagttactcttactcttactattgtgagtaatatagttgggggactgagtctgagagtaagatcaggaacttacagtatagcagcaggctgcccat

SEQ ID NO: 27562 - DNA, 201 bp, Homo sapiens
ttgctaaacaccctgcaatgcacaggacagcccccacagccaagacttatcagcccctagtgtcagcagtgctgagcttaagaattcctactttagggtcmgggtctaggttcagatcctggtttagctacttcctatccttgtgaacttgggcacgttatttaacctctttgtcttcattatctcaactgtatgtcaaag

SEQ ID NO: 27563 - DNA, 201 bp, Homo sapiens
atattattttcagtaaacctaatttattatacataaaagtatctttctctgttcggagaactggaaactcttaactaagagttaccaataaaaacaagtcrtcacaaaatgcagggaaattattgctaaaataatagctggcttaatttcaaaagttgaatatggtcagataaaaattcaaaaatagaataattaaagctg

SEQ ID NO: 27564 - DNA, 201 bp, Homo sapiens
cctcataggccaagggaaacatttggattttactctttacaatgagagaagccaaaagagagtttgaagcagagatgtgacataattgatttactttataragagatgactctgggtgctatgtggagaatggattacaggggaaggagaggggacagaagaaggccagaagcgagtttactgatggggggtggtagcagt

SEQ ID NO: 27565 - DNA, 201 bp, Homo sapiens
agagaaatttctgtcaccaaaaacgaaaagttcgggcttttattcatgcctgtggttcttgggattactgcagtggtgatgaggaaggagaggtgcgtatrgctcataaatggcagcttgccacctttaaaaggcacacggattcagatttgggatgtgttaacaaatcaggcttgcacaaattacttttgatccaaatga

SEQ ID NO: 27566 - DNA, 201 bp, Homo sapiens; identical to SEQ ID NO: 4672

SEQ ID NO: 27567 - DNA, 201 bp, Homo sapiens
attgagtttatcgacttaaaagacttaaaagcacctaacatttctagagtgtttattgcctgccatgtcctatgcgaaatgtttttaatacgccatttcaytcagtcttcataacaatcctatgagatggttattattattattgttgttgttttaaggaagaggaatatagaggtgataaagggtaatttgcccaaagtc

SEQ ID NO: 27568 - DNA, 201 bp, Homo sapiens
ggaaagactgttattaagagaaatatctgtgaaggcaagagaaggagcaggaaaagatggggagaacctttggaccatgacacaggttggacacctgaaarggtgatggggaagggagaaggattggataagaagagcttcagaatgaagcatggttctaagaaatattgagccaggccaatggaaggagtgctggactat

SEQ ID NO: 27569 - DNA, 201 bp, Homo sapiens
aggcttgtgttgggtgaaaccctcccatgcctccagaactgagcctccaattctagaggtagtgtctccaacagcagctgtggccctggggctccttagcragttgtgtgagccagaggtctccctgcagcaagccctgcacaggcacaccatgcctgcctaggggtggggttgcagtagcaccaggctgcttaccacaga

SEQ ID NO: 27570 - DNA, 201 bp, Homo sapiens
taaatctgggcactcttcactgggcatcttctcagggcactaacctgccaaatgccaactgctgtggggctgctcagagaatatgacctaatgacaatggragatgacatgttgctggcaatgagagaagtgaataaaatgttgcatacttgttttcaggagctgttctcaaagcttaccacctttttagtgtgggattag

SEQ ID NO: 27571 - DNA, 201 bp, Homo sapiens
aatcatggaaaatgattttatttcccaggggacataaaaatttataccactcatttggtaccctagtcctatcttagtggtgtcaggtgcaaagtcactcmttctgagaaattttacttctgtagccattcagattaaattttttaaaatagggagttaaactcagcttgaaattgaaggcttcctataatctgatcctaa

SEQ ID NO: 27572 - DNA, 201 bp, Homo sapiens
ggcactgagacaacaaataagacctgacttctgctttttggaaacttatatcatagtaggattatagaaattagcaagaatataacatcatattaacaccmaaaacaaccacagcagcagaaatatagtcactatataattaaatgatggaaatagccaaaatttatgaattatttactatgtgctagacatacctatgga

SEQ ID NO: 27573 - DNA, 201 bp, Homo sapiens
gcaagccctgcacaggcacaccatgcctgcctaggggtggggttgcagtagcaccaggctgcttaccacagaagaagaagcaggtgtccctaccttaaggwcctcctccttgggacttcacatctccctgttacaccagaagcatggctcagtagatactcttttaatggaagaagagccttttgtaattcaaaatagacc

SEQ ID NO: 27574 - DNA, 201 bp, Homo sapiens
accagaagctgctgctggccatgtggtgatgtctcaatgtctttcttcattgaactgggcccttcatacccaaggctggcaccatagtctgtgactgcctactgtacagccagcaagactgaaggagttgcagcattaggagtgttgtgaatctggttcagccactcattttacagttgagaaatcccttctgaggtgtgg

SEQ ID NO: 27575 - DNA, 201 bp, Homo sapiens
accgcgcccgccccggagttttcttatctgtagatctcctacagggacaatctctctctccgtctctctctctctctctctctctctctctctctctctcwcacacacacacacacacaccactacacacctctcactctgcctcctctctctctctccctccgctctctctctcacacacccttctccctctctccctct

SEQ ID NO: 27576 - DNA, 201 bp, Homo sapiens
gcctttcttgatttgtcagcttatttaaggcctcttcattgcatacttcttttttcttttaatcatctgcttcgaaggagactaagctgaaactgctgctyagctcccaagatggtgccacccaaattgcatgtgcttttctgcctctgcggctgcctggctgtggtttatccttttgactggcaatacataaatcctgtt

SEQ ID NO: 27577 - DNA, 201 bp, Homo sapiens
agctgggactgctggcgtgccgtatcacgctcggctaatttttttgaatttttagtagagacggggtttcgctgtgttcgccacaatggtctcgatctccygacctcgtgattcgcccgcctccgcctcccaaaatgctgggattacaggcatgagccaccgcgcccgccccggagttttcttatctgtagatctcctaca

SEQ ID NO: 27578 - DNA, 201 bp, Homo sapiens
acagcagcagaaatatagtcactatataattaaatgatggaaatagccaaaatttatgaattatttactatgtgctagacatacctatggatattattatratgatgacagatggttgttatatttgttatattttgttggctatttttatagctgaccatactgttataaagttagaaaactagtgaccaaaaacttaat

SEQ ID NO: 27579 - DNA, 201 bp, Homo sapiens
acactgtaccatcaaatcaagtttctctaaaaattatgaaattggcatattttatattttgctagagaatggtgtgaacaaggctgataatcaattagttmtttttcctttttgattagtatatatttttcacatgatattaaagctaccattagctgattttattctcaatgtgcctcaattctaagaaccactgcatta

SEQ ID NO: 27580 - DNA, 201 bp, Homo sapiens
tcttccaaaccttttcccgaaaggaagcaaccctaagagctcagagctggggggagaatcaggacaggcagggaacacatggagttttcttttcttttttytctctctctctctctttctttcgttccttctttctttcttttgaggcggagtctcattttgtcgccaggctggagtgcagaggcgcgatctcgactcact

SEQ ID NO: 27581 - DNA, 201 bp, Homo sapiens
tctttcttctccttttcttctttctgattttactatatgcccaggcatgccacagccccagctcacatttatttccttatttgggaatggactggcgggcgctctagtcctctgtagatgaccccttcctcctcttccctctctcccatcataagcccaccttatctaagaaagtttaaatatttagccaatcgagtctag

SEQ ID NO: 27582 - DNA, 201 bp, Homo sapiens
ctctttcttctccttttcttctttctgattttactatatgcccaggcatgccacagccccagctcacatttatttccttatttgggaatggactggcgggcgctctagtcctctgtagatgaccccttcctcctcttccctctctcccatcataagcccaccttatctaagaaagtttaaatatttagccaatcgagtcta

SEQ ID NO: 27583 - DNA, 201 bp, Homo sapiens
ggggacacagatccaaactatatcactggtaattaaaattagcattatactacatgctacttcaatctaaacaccagaatatgcctacagatttttggggktagagctagggggaagtattccatcattaggctggggtaggaactctttaaagaaaaagtcagattatcgactgagacctgcaatatactaacctgttga

SEQ ID NO: 27584 - DNA, 201 bp, Homo sapiens
cctctttcttctccttttcttctttctgattttactatatgcccaggcatgccacagccccagctcacatttatttccttatttgggaatggactggcgggcgctctagtcctctgtagatgaccccttcctcctcttccctctctcccatcataagcccaccttatctaagaaagtttaaatatttagccaatcgagtct

SEQ ID NO: 27585 - DNA, 201 bp, Homo sapiens
cattgggattagcctcacagcagagaagaaagggtgttgcattttctatagttgtccttcattattgtaatatttacactcttaaaattatcctctgtaamgtttagaacttttgagaaaccaattttagattagctgggaaagactgttattaagagaaatatctgtgaaggcaagagaaggagcaggaaaagatgggga

SEQ ID NO: 27586 - DNA, 201 bp, Homo sapiens
tgttgaataaggaaatacagtccctctgcaagtagtttaagaagttttggctggacacggcggctgatgactgtaatcccagcactttgggaggccaaggwgggcagatcatgaggtcaggagatcaagaccatcctggccaacatggtgaaaccccatctctactaaaaatacaaaaattagccgggcatggaggtgggc

SEQ ID NO: 27587 - DNA, 201 bp, Homo sapiens
ccctctttcttctccttttcttctttctgattttactatatgcccaggcatgccacagccccagctcacatttatttccttatttgggaatggactggcgggcgctctagtcctctgtagatgaccccttcctcctcttccctctctcccatcataagcccaccttatctaagaaagtttaaatatttagccaatcgagtc

SEQ ID NO: 27588 - DNA, 201 bp, Homo sapiens
aggggccccgggggcgaggcgggagtgggaggaagggcacggtcgccgcgctggaggtcgggaccccggagcggcgaccggccggggtgggctcgctgagycgcacccgctctgctggccggtcctgggctcacagtccctgcagccctcggaaacagcgctaggatccttgcggggagagggagaggatgacggtattag

SEQ ID NO: 27589 - DNA, 201 bp, Homo sapiens
cctgggagccagaaaatgtggaggacatctcagagaggaaaggagttgaaaatgtttaactcctaatgctacatgtgaactctaagtctcaggattgcccytgagctatgcacatgcagaacagagccaaataagcacagcaaagtctttgacacttaactactatataaaccactgaccaaagtccctgactaccctggg

SEQ ID NO: 27590 - DNA, 201 bp, Homo sapiens
gaacctttgaattgctattgattctttatcacgagtacaaaataattcaaatcagaaatggaaccacagataagccagaaaagatgtaaacaacaaaatgyatttctatcaaaattatgacaatctgattttataatgaggaatcatgtcaagtactttttctattcttcaaatactcatttctctagaacatatccctgg

SEQ ID NO: 27591 - DNA, 201 bp, Homo sapiens
acaggagtgagtttcataggccttttcttttctttttttttacttctttgtctcctgattttgatctgagggtgggccaaatcaaaactgcctagctagcrtagacagcaaaactctgagagaaatttcttatttatagccagtggactagggataaaggaaccctgaatgctagagagtaagaaataggtaggaaatctc

SEQ ID NO: 27592 - DNA, 201 bp, Homo sapiens
tgttagcaagtcattatttgcgaagagataactcaatttacctttttctgttatgtttggatttttgaaatcatgtattaactttataatataattaaatrtaatactgaaataagatcaaataaaatcaaccaaaattataaataatcttaaagagttgcacatatataccttttttttctgatcaaaagaaagatgttg

SEQ ID NO: 27593 - DNA, 201 bp, Homo sapiens
gacactgagttcctttagcgggagagcatctgtgcctgttgcttgtacatcccatttccggtgtgccccaggctcctccacaccccagtcaccgtggcttrcacctgcacaacagattcctggggctgtgtagcaattggtagactttggataataataatagcatttctccaagggctcacatccccataagaaccccat

SEQ ID NO: 27594 - DNA, 201 bp, Homo sapiens
tagtagagacggggtttcgctgtgttcgccacaatggtctcgatctcctgacctcgtgattcgcccgcctccgcctcccaaaatgctgggattacaggcakgagccaccgcgcccgccccggagttttcttatctgtagatctcctacagggacaatctctctctccgtctctctctctctctctctctctctctctctct

SEQ ID NO: 27595 - DNA, 201 bp, Homo sapiens
gaatacacctataagtgggaaaatctctcaccttaagtccagagctgtcagtaagaactcatcgttaatgatcctatggtctgaggaaagaacttacgccrggtgcggtggctcacgcctgtaatcccagcactttgggaggctgaggcaggtggatcacctgaggtcgggagttcacgaccagcctgaccaacatggaga

SEQ ID NO: 27596 - DNA, 201 bp, Homo sapiens
gcaaaccttttccctattcattttagaaataagcattccaactgtatggatgtcccattcaacacttttttgtttgtttgttttttacagtcttttgttgrtggcgcatgctgatgctgaaaggagaaaataactattgaaaatatctaataagttaaggttaaaaagaaataacctaacatagtgcacactgagtatttt

SEQ ID NO: 27597 - DNA, 201 bp, Homo sapiens
ctaagtgctattcctgattgtccttcattgtcatttccagggagaaatgacaccagcacagtggcaggccttccaatctggagcacggtccacacaacttscgaattggtgttcagtgtaaagtgtaccggagtgcggaaaatgcgcagggcattgccaactatagatgctcggagtaattcagtgtattcagagaacacg

SEQ ID NO: 27598 - DNA, 201 bp, Homo sapiens
atgcagtctgtagcatgatagctgagtggcacattttcataacaacaaccaccctcttcactttcttccaccactttctcacctgtcacccctcttctacytcaagggattgtaaaactcagaaaataagagagatggcttttagctgggaagaagttgggtagcacttgcaataaagaattctcttcagcactgtaaatg

SEQ ID NO: 27599 - DNA, 201 bp, Homo sapiens
ttttcaggagctgttctcaaagcttaccacctttttagtgtgggattaggtcttcaacttcaactttgtcttcacctttgtcttaaggtcaaaagaagacrttagagatgtctttggtagggcataatgtatccttttagattgatatttgtgggccatttgttttacagggggttagtccaggaagtacaagacaatgtc

SEQ ID NO: 27600 - DNA, 201 bp, Homo sapiens
catcttctcagggcactaacctgccaaatgccaactgctgtggggctgctcagagaatatgacctaatgacaatgggagatgacatgttgctggcaatgaragaagtgaataaaatgttgcatacttgttttcaggagctgttctcaaagcttaccacctttttagtgtgggattaggtcttcaacttcaactttgtcttc

SEQ ID NO: 27601 - DNA, 201 bp, Homo sapiens
tttgacttgcctataaggtgaatctaaaagcagaaaaccaatatgcagcatttctgcgactatgtgaatattgttccctgtaatctagtggagggcttgaytatgcttcctgctctgggtcatttggagaacattcagatttcagatttaaatgggatctcctgtttgagacaccactaatagctcaaaatcaatccattt

SEQ ID NO: 27602 - DNA, 201 bp, Homo sapiens
gatcaggaacttacagtatagcagcaggctgcccattgatcttagacaacttttaccttttatgacctttaagccatatagaacaccaaacatttggacawttgcacatgggatgcagattaattcccatttccaaaattgtgagtagaatcaactaattatatgttacttgcaggttttgcatctcatgcatctgcctcc

SEQ ID NO: 27603 - DNA, 201 bp, Homo sapiens
ctctctcctctgtacacccagaccatttcgtcctgtcaactacagacagtatcttttgactgtcacttcctaaaatgagaaccttagtaccccacccttcwctccaccttactcctgctcctacccctttttacctattgacgtttaccctgtgcattaaaaaaattaatcatatttacattatcttttagagtcatagtt

SEQ ID NO: 27604 - DNA, 201 bp, Homo sapiens
gtgcgggccatggtcttggggagggtgctgggtgcgctcgagcaggctagcgtcgggagccgccgctgctagtgagaggccggggccacacacgctcctcyccggtacctcctccagcatcaccaggggaggagagggtcggggccacaaggccgcgctaggcggacccaggacacagcccgcgcgcagcccacccgcccg

SEQ ID NO: 27605 - DNA, 201 bp, Homo sapiens
ccaggtgcgggccatggtcttggggagggtgctgggtgcgctcgagcaggctagcgtcgggagccgccgctgctagtgagaggccggggccacacacgctmctccccggtacctcctccagcatcaccaggggaggagagggtcggggccacaaggccgcgctaggcggacccaggacacagcccgcgcgcagcccacccg

SEQ ID NO: 27606 - DNA, 201 bp, Homo sapiens
tctctccgcggcgggctaagttaaccgcgggtccaggtgcgggccatggtcttggggagggtgctgggtgcgctcgagcaggctagcgtcgggagccgcckctgctagtgagaggccggggccacacacgctcctccccggtacctcctccagcatcaccaggggaggagagggtcggggccacaaggccgcgctaggcgg

SEQ ID NO: 27607 - DNA, 201 bp, Homo sapiens
aaactgcctctgactgactgattttgattttcttgattttatggatgaggagaccgagaagcagagatgatgaacttccccaaggtcacaccactcataartgggagaaacaagctaaaattcaggccatcttactgcagaatactcaaaatcaaaataagcaaaatttcatctccagttctggcacctcaccaaaaacca

SEQ ID NO: 27608 - DNA, 201 bp, Homo sapiens
gtaagaaataggtaggaaatctctttgctgtattgtggtgttatgtttatttctatttttttttctggccctgccctgagggtggctaaccccagttactkcctggtgacagctatggcaacataggcacctacaaatgtgagagatgacccgtctctctagccagtggaaccaggaaaagagctttctgtcatctgaaga

SEQ ID NO: 27609 - DNA, 201 bp, Homo sapiens
tctccccctcctttcttccctgtgacagacatcctgaggtgtgttctcttgggcttggcaggcatggagagctctggttctcttgaaggggacaggctacwgcctgccccccttcctgtttccccaaatgactgctctgccatggggagagtagggggctcgcctgggctcggaagagtgtctggtgagatggtgtagcag

SEQ ID NO: 27610 - DNA, 201 bp, Homo sapiens
ttggtgctttctcctaagggggacagacttgccctctctggtcccttctccccctcctttcttccctgtgacagacatcctgaggtgtgttctcttgggcytggcaggcatggagagctctggttctcttgaaggggacaggctacagcctgccccccttcctgtttccccaaatgactgctctgccatggggagagtagg

SEQ ID NO: 27611 - DNA, 201 bp, Homo sapiens
tggtgttacctggtaatggggcacatctcagcccagatagggtgggagggagctgtgaaacacagggagggggttgctttcgggtatctactaggagtcarggtgaagcctagagaggatgaaagaaggggaggggatggggagtggtaagaacctaggatttgaattcccagcctggccaacccttgcagccatgtcttg

SEQ ID NO: 27612 - DNA, 201 bp, Homo sapiens
tcgtttcctggctagatttgccttgtctggctcctgcccctgagttgcacaggggaggtatggtggggtcttgccttctgtggagaagatgcttcattccyagcccaggttcccagcaagccccaaccatctccttctccctgatggttgcccatgggctcaggaggggacagatggatgcctgtgtcaggagcccctctc

SEQ ID NO: 27613 - DNA, 201 bp, Homo sapiens
agtcctgcatttatttattctcaagggccccgcctctgtggcccagaattaccccttcatgctccagtgcaccccaggcttcgtggccagcctgggaaacygtctctaccctggtctcccttcagatcagcttctagaaatgtttcgtggctacagtggcagcactgttttttccatgatgcaagcagtttgccctcttgg

SEQ ID NO: 27614 - DNA, 201 bp, Homo sapiens
gagtcttgctctgtcacccaggctggagtacaatggtgcgatctcgggtcactgcaacctccgcctcccaggttcaagggattctccctcctcagcctccygagtagctgggattacaggcacgcaccatcatgcccgactaatttttgtgttttcgtagagacggggtttcaccatgttggccaggctggcctcaaaccc

SEQ ID NO: 27615 - DNA, 201 bp, Homo sapiens
gaaagcttagggaagtgcttcaaacacagtaggagggacttacgttagattttggaaggacttgcctgattcggaagctccaaagagtggcattacagagytgggtggagagaggggctagccatcttttgtgtcgcccaccgggctcatgtgtcatcgcctctcatgcagtggtgaagttcatggatgtctatcagcgca

SEQ ID NO: 27616 - DNA, 201 bp, Homo sapiens
ctcccagagacacagcattgccccttatggcagcctctccctgcactctctgcccgtctgtgcccgcctcttcctgcggcaggtgtcctagccagtgctgyctctttccgccgctctctctgtcttttgctgtagcgctcggatccttccagggcctgggggctgaccggctgggtgggggtgcagctgcggacatgttag

SEQ ID NO: 27617 - DNA, 201 bp, Homo sapiens
tgtggcctgagactcacccttgtctcccagagacacagcattgccccttatggcagcctctccctgcactctctgcccgtctgtgcccgcctcttcctgcrgcaggtgtcctagccagtgctgcctctttccgccgctctctctgtcttttgctgtagcgctcggatccttccagggcctgggggctgaccggctgggtgg

SEQ ID NO: 27618 - DNA, 201 bp, Homo sapiens
acagaggcctccttgcagggcagcctcttcctccgggtcggaggctgtggtgggccctgccctgggccctctggccaccagcggcctggcctggggacacygcctccgggcttagcctcccatcacaccctactttagcccaccttggtggaagggcctggacatgagccttgcacggggagaaggtggcccctgattgcc

SEQ ID NO: 27619 - DNA, 201 bp, Homo sapiens
cccacaccatcttgtctgcctccagtgctgtgcggacattgaagcccccaccaggcctcaaccccttgcctcttccctcagctcccagcttccagagcgargggatgcggaaaccttccttccaccctttggtgctttctcctaagggggacagacttgccctctctggtcccttctccccctcctttcttccctgtgaca

SEQ ID NO: 27620 - DNA, 201 bp, Homo sapiens
tgtgtcagaggaaatggcctcttttggtggctgctgtgacggtgcagttggatgcgaggccggctggagggtggtttctcagtgcatgccctcctgtaggyggcaggcggcagacacacagccctcttggccagggagaaaaagttgaatgttggtcattttcagaggcttgtgagtgctccgtgttaaggggcaggtagg

SEQ ID NO: 27621 - DNA, 201 bp, Homo sapiens
ctcactggccaggtgttatttcttccctctgggtagggaacctatttcagggacaggattgctatgtggtagtggtggtggggtgcgataggcgtggcagrctgggccacaatttggagtagtcatgccagagtcctgcatttatttattctcaagggccccgcctctgtggcccagaattaccccttcatgctccagtgc

SEQ ID NO: 27622 - DNA, 201 bp, Homo sapiens
gattagtcatcttctcccctatcgacttggctttaaaaaatgaccttttcagacttctagtctcgttcactctttttgatgatgctttgccgtaacccttygtgggtagagaaggattctgtgcccattggtggtctggataaaagaaatagagacctcacaggaagcagtggactggcctgtttccccactgttctttct

SEQ ID NO: 27623 - DNA, 201 bp, Homo sapiens
ggtgaggttccccgcctccacctcccatgggacttggggattcattccaaggggaagctttttgggggaattcctaccccaggtctttttaccctcagttrccaaccccttgcccaggccagaccttcctgctatcccctcctgggccacaagcctggccctcctctgtcccaattgtgatgaaggggcagttcaaaactt

SEQ ID NO: 27624 - DNA, 201 bp, Homo sapiens
ccagcctgttggctgccgctcactttgatgtctgcaggccagatgagggctccagatggcacattgtcagagggacacactgtggcccctgtgcccagccytgggctctctgtacatgaagcaactccagtcccaaatatgtagctgtttgggaggtcagaaatagggggtccaggagcaaactccccccaccccctttcc

SEQ ID NO: 27625 - DNA, 201 bp, Homo sapiens
accttccccttcctccttggctccttctgaactgccttcagagccacagactgtggggagtggccactgcgctcccaaggtgaggccctccaagcggggcygagtttgcccctcaactgggagccagcatgacctctgtgtgggctgctctctgcttcactgccccttcccccaatctgctaggtgaccctgggccccttt

SEQ ID NO: 27626 - DNA, 201 bp, Homo sapiens
ctcccaggccagcagagggctggctgtagctcccaggcgccccgcccccctgcccaaccccgagtccgcctgccttttgttccgttgtggtttggatcctyccatttctctggggacaccctggctctccccaccactgactgtggcctgtgctctccacctctggggagggaaggccctggggtcttccttcccgcgagt

SEQ ID NO: 27627 - DNA, 201 bp, Homo sapiens
tccctggagcgttttggttaaattgagggaaattgctgcattcccattctcagtccatgcctccacagaggctatgccagctgtaggccagaccctggcamgatctgggtggataatcagactgactggcctcagagccccaactttgttccctggggcagcctggaaatagccaggtcagaaaccagctaggaatttttc

SEQ ID NO: 27628 - DNA, 201 bp, Homo sapiens
tcggtcctcggcacccccctccgtctccaacaccagctcaccctggtatttgtcatgtcagcaggagaaggtcaccatgttgtttttctcgcccctagtcyttccttcctgccccagtccaaatttgtcctcctatttgaccttaatacttaccatggctttggaccagggaactagggggatagtgagagcagggagagg

SEQ ID NO: 27629 - DNA, 201 bp, Homo sapiens
atgtgagccaccgcgcccggcaggtaggggcttttttcatcccatctggatttttgctggagcctttaaattggccgcctggcttctcctctggccttcckttagttgaatctcacacaactgccagagtgagcctgttaaaatgtgagttaagttttggcaccttttgactcaaaaccttccagagatagttttactcgg

SEQ ID NO: 27630 - DNA, 201 bp, Homo sapiens
tggggagttagtctctctatgagggaagtgcaagtactgctcccagggagctcccagtctcaaggaggattgacatggccctggccctcaggatgctcccrgtccttacagagtatctaatctgagggaggagacagagcttctgccatcagacatttctttggatactagtttcgggaaggcaccaccctgccaccattt

SEQ ID NO: 27631 - DNA, 201 bp, Homo sapiens
gctagaacccagggagcagtgagtcagaggaaagggcccactaggcacaggtgcctatggtgcaaggctgggcttgagtctcccaggacaagagggggccrggatctgacaaagattttcaaaggctgcgtttgcctttggggagttagtctctctatgagggaagtgcaagtactgctcccagggagctcccagtctcaa

SEQ ID NO: 27632 - DNA, 201 bp, Homo sapiens
ggcaccagacatgtgagtgaagtcactttggattccctagcgccaggtgagccactctagccaacaacacataaagtagagagaagccatccctgccccartttagtgagttgtaagcaaatgtatgcactgtgttgtttaaagctactaagttttggggtggttattattcctcaataataactgagccatctaacaaaa

SEQ ID NO: 27633 - DNA, 201 bp, Homo sapiens
agggaagaagaaaagtgggacagggggaggatgtagtgctggccaaacccagggctgaaatccagacttccccaagtgtggtaaggcaaggcaaggcaagmaagagatgtctccaggggctggggctcgtcagtggaagatcggaaacctaagcatgcaagagattgcaacacacggccttagatgagagaaacagccttg

SEQ ID NO: 27634 - DNA, 201 bp, Homo sapiens
ggattacaggcatgagccactgcgcccagcctattaatgagaaattgtatactcttttggtactaagtctttgcgtctgtccaagggcagaaattgggtgwaaagaaaaaataaatctttgaatctggtgggtgttttatatttatcgcatgtctcaattagttgtagccacgtttcgagtgcttaatatacacatggcta

SEQ ID NO: 27635 - DNA, 201 bp, Homo sapiens
gctgagacgaaacccccatttctattcagaagatgagctatgagtctgggcttgggctgatagaagccttggcccctggcctggtgggagctctgggcagstggcctacagacgttccttagtgctggcgggtaggtttgaatcatcacgcaggccctggcctccacccgcccccaccagccccctggcctcagttccctg

SEQ ID NO: 27636 - DNA, 201 bp, Homo sapiens
atgcagtggtgcaatcttagctcactgcaagctctgcctcctgggttcaagtgattctcctgcctgaaccttccgagtagctgggactatgggcgcacacmaacacgtctggctaatttttgtatttttagtagaaatgggggtttcaccatattggtcaggctggtcttgaactcctgacctaagatgatccacctgcct

SEQ ID NO: 27637 - DNA, 201 bp, Homo sapiens
tgctcccccaggcagtggaggccagccctccttggaggggcggctgcctgatgaaggatgcgggtgaggttccccgcctccacctcccatgggacttgggkattcattccaaggggaagctttttgggggaattcctaccccaggtctttttaccctcagttaccaaccccttgcccaggccagaccttcctgctatcccc

SEQ ID NO: 27638 - DNA, 201 bp, Homo sapiens
gtgaatgcaggtgaggatgtagtcacggattcattatcagcaagtggctgcagggtgcctgatctgtgccagggttaagcatgctgtactttttggccccygtccagcttcccgctatgtgacctttggcattttacttcaatgtgcctcagtttctacatctgtaaaatgggcacaatagtagtatacttcatagcattg

SEQ ID NO: 27639 - DNA, 201 bp, Homo sapiens
cataggagagatgagcttcctacagcacaacaaatgtgaatgcaggtgaggatgtagtcacggattcattatcagcaagtggctgcagggtgcctgatctrtgccagggttaagcatgctgtactttttggcccccgtccagcttcccgctatgtgacctttggcattttacttcaatgtgcctcagtttctacatctgta

SEQ ID NO: 27640 - DNA, 201 bp, Homo sapiens
accccaggagccctttccttggcctaggacctggcttctcagccactgaccggccccctgcttccagtgcgccacttaccccttccagcttcccagtggtstctggtctgggagaggcaggacaaatggtctttgtttgctggagaaaaggttgtctgcgataaataaggaaaaccacgaaagcctggttgttggagtgta

SEQ ID NO: 27641 - DNA, 201 bp, Homo sapiens
cgggcaagggttagctccaagggagcctgcagcaccatgccaagagcctagggcctgtcagggatgagcagcagccgaggggttttaaacactgagcggcycagtcagatagacttttccataggtgcctggcaacagtatgggaggcagagaggccggtagaggctgttgtggtcttccaggaggaattgtgctggtggt

SEQ ID NO: 27642 - DNA, 201 bp, Homo sapiens
cagagaccaggcatctgccatggtggtaagtttggtgagaagtcagggtaagggctgacccaggcaggacaaaatattgtcctaatttctagagtgaggaragtgacttggttgtactggagtcttaccaagagaaagtgggcctcacctacagcatgggggatagaggatagaggatgagaagaactgccagagagcaca

SEQ ID NO: 27643 - DNA, 201 bp, Homo sapiens
ctgccccaggaccacaccttcctgtcctctctgctcttatggtgccggaggctgcagtgacccaggggcccccaggaatggggaggccgcctgcctcatcrccaggcctcctcacttggccctaaccccagcctttgttttccatttccctcagatgtgacaagccgaggcggtgagccgggcaggaggaaggagcctccc

SEQ ID NO: 27644 - DNA, 201 bp, Homo sapiens
ttgcctaatataggcttgggaacactttgatgtcagctaattctgactcctttacttactagctgtgcggccttggggcaacttacttagcctctttgagyctcctgttccccatctgtaaaatggaatctcaatagtgtctaatagtaccatgtggagaaacttgtgtgaaatgatagctgtggactactgtacacagta

SEQ ID NO: 27645 - DNA, 201 bp, Homo sapiens
agaccctggcacgatctgggtggataatcagactgactggcctcagagccccaactttgttccctggggcagcctggaaatagccaggtcagaaaccagcyaggaatttttccaagctgcttcctatatgcaagaatgggatggggcctttgggagcacttagggaagatgtggagagttggaggaaaagggggcttggag

SEQ ID NO: 27646 - DNA, 201 bp, Homo sapiens
ggggaggaagagtagctcgccgaggcgccgaggagagcgggccgccccacagcccgagccggagagggagcgcgagccgcgccggccccggtcgggcctcygaaaccatgaactttctgctgtcttgggtgcattggagccttgccttgctgctctacctccaccatgccaaggtaagcggtcgtgccctgctggcgccgc

SEQ ID NO: 27647 - DNA, 201 bp, Homo sapiens
ggagggagaagaaaccagggaacaggtaggagtgggagacaggtgaggctttggaaatctattgaggctctggagagatttgtgtagagaggaaaatgtgkttctcccccagggtctcctcctgggtttttaccctctaagcaacctgtgggcatgctgggttattcctaaggactagaagagcttggatgggggagggtg

SEQ ID NO: 27648 - DNA, 201 bp, Homo sapiens
gagtgaggacgtgtgtgtctgtgtgggtgagtgagtgtgtgcgtgtggggttgagggcgttggagcggggagaaggccaggggtcactccaggattccaayagatctgtgtgtccctctccccacccgtccctgtccggctctccgccttcccctgcccccttcaatattcctagcaaagagggaacggctctcaggccct

SEQ ID NO: 27649 - DNA, 201 bp, Homo sapiens; identical to SEQ ID NO: 4693

SEQ ID NO: 27650 - DNA, 201 bp, Homo sapiens; identical to SEQ ID NO: 4695

SEQ ID NO: 27651 - DNA, 201 bp, Homo sapiens; identical to SEQ ID NO: 4698

SEQ ID NO: 27652 - DNA, 201 bp, Homo sapiens
tttgttgctttgtaaagtgttcccatgtccttgtcttgtctcaagtagattgcaagctcaggagggtagactgggagcccctgagtggagctgctgctcargccggggctccctgagggcagggctggggctgttctcatactggggctttctgccccaggaccacaccttcctgtcctctctgctcttatggtgccggag

SEQ ID NO: 27653 - DNA, 201 bp, Homo sapiens
ccccatcctaagtgaagcagcatatttgaaaggaaagacaacctgttacctgggcctgcaacctccaggcagctcaagagagatgaggcctacagccacastgggaggggacatggggaatggagatggtccctcaccttcctggggcctcctgctctacgctaccccctcgggagcctcctgtccccagggcaggccctt

SEQ ID NO: 27654 - DNA, 201 bp, Homo sapiens
gggaggccctgggggtcagggtaagcgtcagtcagggaggcaagactttgtggggatttcctagacagggccaaggcacccccagctcaccccgaggctgygttagggaagtccttggagtgtctcccctcccccagcaatgttcttgtggcttgtgtgtgctcaggggatgctgggaaccaggcctgggtagttggtgtg

SEQ ID NO: 27655 - DNA, 201 bp, Homo sapiens
ccccgctcagactgaggctccctcaggccagggctatgtctccctcctcagactggggctctgagggcaaggggtctggctgttcgtttaggatggggcasttttgcctacacactgaaggagctgtagcatccaagaatactagatacctttaatcctccaccagtcatggtgacaaccccaagcagcccacacattttc

SEQ ID NO: 27656 - DNA, 201 bp, Homo sapiens
aaacaggccttcaccagtgttgatggtggaaagcttagggaagtgcttcaaacacagtaggagggacttacgttagattttggaaggacttgcctgattcrgaagctccaaagagtggcattacagagctgggtggagagaggggctagccatcttttgtgtcgcccaccgggctcatgtgtcatcgcctctcatgcagtg

SEQ ID NO: 27657 - DNA, 201 bp, Homo sapiens
cctggctcctcacggaggtggggcctctggaggggagccccctattccggcccaacccatggcacccacagaggcctccttgcagggcagcctcttcctcygggtcggaggctgtggtgggccctgccctgggccctctggccaccagcggcctggcctggggacaccgcctccgggcttagcctcccatcacaccctact

SEQ ID NO: 27658 - DNA, 201 bp, Homo sapiens
cttgggtgggatcagacaccatgtggcggcctcccttcatctggtggaagtgccctggctcctcacggaggtggggcctctggaggggagccccctattcyggcccaacccatggcacccacagaggcctccttgcagggcagcctcttcctccgggtcggaggctgtggtgggccctgccctgggccctctggccaccag

SEQ ID NO: 27659 - DNA, 201 bp, Homo sapiens
gctgagcaggctggtgttgctcttggttccgtgccagctcccaaggtagccgcttcccccacaccgggattcccagaggttctgtcgcagttgcaaatgarggcacaaggcctgatacacagccctccctcccactcctgctccccatccaggcaggtctctgaccttctccccaaagtctggcctaccttttatcacccc

SEQ ID NO: 27660 - DNA, 201 bp, Homo sapiens
ccacaccatcttgtctgcctccagtgctgtgcggacattgaagcccccaccaggcctcaaccccttgcctcttccctcagctcccagcttccagagcgagrggatgcggaaaccttccttccaccctttggtgctttctcctaagggggacagacttgccctctctggtcccttctccccctcctttcttccctgtgacag

SEQ ID NO: 27661 - DNA, 201 bp, Homo sapiens
cagggtgggcggctggcatcagcaagagcttgcagggaaagagagactgagagagagcacctgtgccctgccctttcccccacaccatcttgtctgcctcyagtgctgtgcggacattgaagcccccaccaggcctcaaccccttgcctcttccctcagctcccagcttccagagcgaggggatgcggaaaccttccttcc

SEQ ID NO: 27662 - DNA, 201 bp, Homo sapiens
tgtaaagtgttcccatgtccttgtcttgtctcaagtagattgcaagctcaggagggtagactgggagcccctgagtggagctgctgctcaggccggggctycctgagggcagggctggggctgttctcatactggggctttctgccccaggaccacaccttcctgtcctctctgctcttatggtgccggaggctgcagtga

SEQ ID NO: 27663 - DNA, 201 bp, Homo sapiens
ctccagaccctacctctgcccagtgctaggaggaatttcctgacgccccttctcttcacccatttcctttttagcctggagagaagcccctgtcaccccgyttattttcatttctctctgcggagaagatccatctaacccctttctggccccagagtccagggaaaggatgatcactgtcagaagtcgtggcgcgggagc

SEQ ID NO: 27664 - DNA, 201 bp, Homo sapiens
gcccattccctctttagccagagccggggtgtgcagacggcagtcactagggggcgctcggccaccacagggaagctgggtgaatggagcgagcagcgtcytcgagagtgaggacgtgtgtgtctgtgtgggtgagtgagtgtgtgcgtgtggggttgagggcgttggagcggggagaaggccaggggtcactccaggatt

SEQ ID NO: 27665 - DNA, 201 bp, Homo sapiens; identical to SEQ ID NO: 4694

SEQ ID NO: 27666 - DNA, 201 bp, Homo sapiens
ctttaacttcctcgggttcataaccatagcagtccaggagtggtgggcatattctgtgcccgtggggacccccggttgtgtcctgttcgactcagaagacytggagaagccagaggctgttggtgggagggaagtgaggagggaggaggggctgggtggctgggcctgtgcaccccagcccctgcccatgcccatgccttg

SEQ ID NO: 27667 - DNA, 201 bp, Homo sapiens
gaggagggggaggagtggctgcctggccacagtgtgaccttcagaggcccccagagaaggacacctggcccctgcctgcctagaaccgcccctcctgtgcyccctggccttggaaggggtatgaaatttccgtcccctttcctccttggggcccaggaggagtggagggtcccgggagaatattgtcagggggaaggcagg

SEQ ID NO: 27668 - DNA, 201 bp, Homo sapiens
tccttcaattcaccaggtttgtatcctgcccttcctgcagatcagtgtcctgctagtcacctgggggtcaggggatggagtgaaggacaagacctccttcyattgcagtgaagccacttggagaaatgtgtggaaaacagcaagacccagtgactctctcctcaccttctttccaatctcaggagagattttgtcccttca

SEQ ID NO: 27669 - DNA, 201 bp, Homo sapiens
tttcatttctctctgcggagaagatccatctaacccctttctggccccagagtccagggaaaggatgatcactgtcagaagtcgtggcgcgggagcccacygggcgctttgtcacattccaccgaaagtcccgacttggtgacagtgtgcttcccttccctcgccaacagttccgagtgagctgtgctttagctctcgtgg

SEQ ID NO: 27670 - DNA, 201 bp, Homo sapiens
gcccaggtgagaggggcttggcacctcctcaccctgggagggagaagaaaccagggaacaggtaggagtgggagacaggtgaggctttggaaatctattgrggctctggagagatttgtgtagagaggaaaatgtggttctcccccagggtctcctcctgggtttttaccctctaagcaacctgtgggcatgctgggttat

SEQ ID NO: 27671 - DNA, 201 bp, Homo sapiens
tgggagtgggagttgtattgggggtggtggctggggggtggtgtcttatgacattatctctaggctgccacttaaagtatggtttgaagacagggagaacrgggcggcggagtgaaagggttgaggacatcccaggcagaagggatagtgtgagcaaggcatgaaggtggcacttgggcaggggcagggagtgggtgggca

SEQ ID NO: 27672 - DNA, 201 bp, Homo sapiens
gtcccttcatccaccggcttctagattaaccacccacacccacacaggcgagagtttccctgaatattggaggtgacaggacatcaggacaaagtacaacyattgtgccttggcccaatcactactttctttgtctggggccgccgctggctcctggctgcctttcgcacttttctccacccccacccctttctccccttc

SEQ ID NO: 27673 - DNA, 201 bp, Homo sapiens
tggagggtcccgggagaatattgtcagggggaaggcagggggtgtcatgggaatgggtgagggggctgaggtgcagaatccagggggtccctgcaggagcygcagtggtaagctgtccagctggaagcctggtaactgttgttttctcttgagaggggcttcctgtgaccttggctgtctctgggagcagggctggggtac

SEQ ID NO: 27674 - DNA, 201 bp, Homo sapiens; identical to SEQ ID NO: 4718

SEQ ID NO: 27675 - DNA, 201 bp, Homo sapiens
catttagtgtcatttcctatatagacatgtcccatttgtgggaactgtgacccttcctgtgtgagctggaggcacagagggctcagcctaatgggatctcycctcccttccctggtttgcattcctttgggggtggagaaaaccccacttgactatgttcgggtgctgtgaacttccctcccaggccagcagagggctggc

SEQ ID NO: 27676 - DNA, 201 bp, Homo sapiens; identical to SEQ ID NO: 4696

SEQ ID NO: 27677 - DNA, 201 bp, Homo sapiens
ctcagtgaggcttaccctgaccactgcatttacgattgaccccccttcccactccacacttgggtacctccttttcaccatcccttctttttccgcttagyacctgtagccacctgacagactctagaacagtgctacccaacagaaatatagtgtgagccacttatggagtttaaaattttccaggcaccagagttcgaa

SEQ ID NO: 27678 - DNA, 201 bp, Homo sapiens
aggtgttgggggaagtgtcccttgtttcccctagctcccaggggagagtggacatttagtgtcatttcctatatagacatgtcccatttgtgggaactgtracccttcctgtgtgagctggaggcacagagggctcagcctaatgggatctcccctcccttccctggtttgcattcctttgggggtggagaaaaccccact

SEQ ID NO: 27679 - DNA, 201 bp, Homo sapiens
gccctcttggccagggagaaaaagttgaatgttggtcattttcagaggcttgtgagtgctccgtgttaaggggcaggtaggatggggtgggggacaaggtytggcggcagtaacccttcaagacagggtgggcggctggcatcagcaagagcttgcagggaaagagagactgagagagagcacctgtgccctgccctttcc

SEQ ID NO: 27680 - DNA, 201 bp, Homo sapiens
ctgcctccaccacccatccctgctctgcagaacccctgggtgctgagtggcaggagccccagggttgtcccatctgggtatggctggctgggtcactaacytctgtgatctgcttccttcctttccagattatgcggatcaaacctcaccaaggccagcacataggagagatgagcttcctacagcacaacaaatgtgaat

SEQ ID NO: 27681 - DNA, 201 bp, Homo sapiens
tctctggaatgaaaacaggccttcaccagtgttgatggtggaaagcttagggaagtgcttcaaacacagtaggagggacttacgttagattttggaaggamttgcctgattcggaagctccaaagagtggcattacagagctgggtggagagaggggctagccatcttttgtgtcgcccaccgggctcatgtgtcatcgcc

SEQ ID NO: 27682 - DNA, 201 bp, Homo sapiens
tgacccttcctgtgtgagctggaggcacagagggctcagcctaatgggatctcccctcccttccctggtttgcattcctttgggggtggagaaaaccccayttgactatgttcgggtgctgtgaacttccctcccaggccagcagagggctggctgtagctcccaggcgccccgcccccctgcccaaccccgagtccgcct

SEQ ID NO: 27683 - DNA, 201 bp, Homo sapiens
cccactctcttccccacaccagcccctagagactgaactgaaaaccctcctcagcagggagcctcttctgattaacttcatccagctctggtcacccatcrgctcttaaaatgtcaagtggggactgttctttggtatccgttcatttgttgctttgtaaagtgttcccatgtccttgtcttgtctcaagtagattgcaag

SEQ ID NO: 27684 - DNA, 201 bp, Homo sapiens
aagataagggacttgacattttagggtttttaggtgattattctgctgatgggggtttgtgtgaagtgacctgggagctaactgaagttactctaacctcycaatacctttacccaacccccaagctggctgtatctgggaatatcagtttccaaaattggaggcttaggactccgtttcggggctccccagaagggtagg

SEQ ID NO: 27685 - DNA, 201 bp, Homo sapiens
tctgctagaagtaggacttgttgcctttttcttctgctctttccagtaaaattttatttggagaaggagtcgtgcgcacagagcaggaagacagtgttcabggatcctaggtgttgggggaagtgtcccttgtttcccctagctcccaggggagagtggacatttagtgtcatttcctatatagacatgtcccatttgtgg

SEQ ID NO: 27686 - DNA, 201 bp, Homo sapiens
ccctggtggcatttgaaggtgcccaggtgagaggggcttggcacctcctcaccctgggagggagaagaaaccagggaacaggtaggagtgggagacaggtsaggctttggaaatctattgaggctctggagagatttgtgtagagaggaaaatgtggttctcccccagggtctcctcctgggtttttaccctctaagcaac

SEQ ID NO: 27687 - DNA, 201 bp, Homo sapiens
aaggcagccctggagcaggtgtttttttggaactccaaacctgcccacccaacttgcttctgaaagggactctaaagggtccctttccgctcctctctgasgccttccctcagccagaattcccttggagaggaggcaagaggaaagccatggacaggggtcgctgctaacaccgcaagttcctcagaccctggcacaaag

SEQ ID NO: 27688 - DNA, 201 bp, Homo sapiens
tgtgaaccttggtgggggtcgagcttccccttcattgcggcgggctgcgggccaggcttcactgagcgtccgcagagcccgggcccgagccgcgtgtggargggctgaggctcgcctgtccccgccccccggggcgggccgggggcggggtcccggcggggcggagccatgcgccccccccttttttttttaaaagtcggc

SEQ ID NO: 27689 - DNA, 201 bp, Homo sapiens
agtgaggcttaccctgaccactgcatttacgattgaccccccttcccactccacacttgggtacctccttttcaccatcccttctttttccgcttagtacmtgtagccacctgacagactctagaacagtgctacccaacagaaatatagtgtgagccacttatggagtttaaaattttccaggcaccagagttcgaaagc

SEQ ID NO: 27690 - DNA, 201 bp, Homo sapiens
ctatgtggtagtggtggtggggtgcgataggcgtggcaggctgggccacaatttggagtagtcatgccagagtcctgcatttatttattctcaagggcccygcctctgtggcccagaattaccccttcatgctccagtgcaccccaggcttcgtggccagcctgggaaactgtctctaccctggtctcccttcagatcagc

SEQ ID NO: 27691 - DNA, 201 bp, Homo sapiens; identical to SEQ ID NO: 4692

SEQ ID NO: 27692 - DNA, 201 bp, Homo sapiens
ctttccagattatgcggatcaaacctcaccaaggccagcacataggagagatgagcttcctacagcacaacaaatgtgaatgcaggtgaggatgtagtcayggattcattatcagcaagtggctgcagggtgcctgatctgtgccagggttaagcatgctgtactttttggcccccgtccagcttcccgctatgtgacctt

SEQ ID NO: 27693 - DNA, 201 bp, Homo sapiens; identical to SEQ ID NO: 4697

SEQ ID NO: 27694 - DNA, 201 bp, Homo sapiens
ccattgctctaggcttctgcactcgtctggaagctgagggtggtggggagggcagacatggcccaagaagggctgtgaatgactggaggcagcttgctgartgactccttggctgaaggaggagcttgggtgggatcagacaccatgtggcggcctcccttcatctggtggaagtgccctggctcctcacggaggtggggc

SEQ ID NO: 27695 - DNA, 201 bp, Homo sapiens; identical to SEQ ID NO: 4688

SEQ ID NO: 27696 - DNA, 201 bp, Homo sapiens; identical to SEQ ID NO: 4690

SEQ ID NO: 27697 - DNA, 201 bp, Homo sapiens
taggatcattgtggtggccagtgtgcaaacatggctgtcaacagttctttccatccctgtgcccacgtgctttgccccccaagaagtagagtctatttttyctctttttgaatctgggccggctttatgacttgctttgaataaaaatgcaacacaagagagatattctgggactttcaggtctaggcattgtagtgtcaa

SEQ ID NO: 27698 - DNA, 201 bp, Homo sapiens
caactgccagagtgagcctgttaaaatgtgagttaagttttggcaccttttgactcaaaaccttccagagatagttttactcggagaaaaacccaaatggycttaaaaggcctgcaccatttgggctgcctccctgactactcaatgacttcgggccccgccttggccacgtggcttcagccatgctggtttcactgttcc

SEQ ID NO: 27699 - DNA, 201 bp, Homo sapiens
acgttggtgcccgctgctgtctaatgccctggagcctccctggcccccagtacaacctccgcctgccattccctgtaaccctgcctccctcccctggtccytccctggctctcatcctcctggcccgtgtctctctctcactctctcactccactaattggcaccaacgggtagatttggtggtggcattgctggtccagg
